United States Patent 7,709,616 (MICRORNAS AND USES THEREOF) - sequence listing, part 22

SEQ ID NO: 680671 - RNA, 64 nt, hsa; identical to SEQ ID NO: 74198

SEQ ID NO: 680672 - RNA, 64 nt, hsa; identical to SEQ ID NO: 74199

SEQ ID NO: 680673 - RNA, 64 nt, hsa; identical to SEQ ID NO: 74200

SEQ ID NO: 680674 - RNA, 64 nt, hsa; identical to SEQ ID NO: 74201

SEQ ID NO: 680675 - RNA, 64 nt, hsa; identical to SEQ ID NO: 74202

SEQ ID NO: 680676 - RNA, 64 nt, hsa; identical to SEQ ID NO: 74203

SEQ ID NO: 680677 - RNA, 64 nt, hsa; identical to SEQ ID NO: 74204

SEQ ID NO: 680678 - RNA, 64 nt, hsa; identical to SEQ ID NO: 74205

SEQ ID NO: 680679 - RNA, 64 nt, hsa; identical to SEQ ID NO: 74206

SEQ ID NO: 680680 - RNA, 64 nt, hsa; identical to SEQ ID NO: 74207

SEQ ID NO: 680681 - RNA, 64 nt, hsa; identical to SEQ ID NO: 74208

SEQ ID NO: 680682 - RNA, 64 nt, hsa; identical to SEQ ID NO: 74209

SEQ ID NO: 680683 - RNA, 64 nt, hsa; identical to SEQ ID NO: 74210

SEQ ID NO: 680684 - RNA, 64 nt, hsa; identical to SEQ ID NO: 74211

SEQ ID NO: 680685 - RNA, 64 nt, hsa; identical to SEQ ID NO: 74212

SEQ ID NO: 680686 - RNA, 64 nt, hsa; identical to SEQ ID NO: 74213

SEQ ID NO: 680687 - RNA, 64 nt, hsa; identical to SEQ ID NO: 74214

SEQ ID NO: 680688 - RNA, 64 nt, hsa; identical to SEQ ID NO: 74215

SEQ ID NO: 680689 - RNA, 64 nt, hsa; identical to SEQ ID NO: 74216

SEQ ID NO: 680690 - RNA, 58 nt, hsa; identical to SEQ ID NO: 74217

SEQ ID NO: 680691 - RNA, 64 nt, hsa; identical to SEQ ID NO: 74218

SEQ ID NO: 680692 - RNA, 64 nt, hsa; identical to SEQ ID NO: 74219

SEQ ID NO: 680693 - RNA, 64 nt, hsa; identical to SEQ ID NO: 74220

SEQ ID NO: 680694 - RNA, 64 nt, hsa; identical to SEQ ID NO: 74221

SEQ ID NO: 680695 - RNA, 56 nt, hsa; identical to SEQ ID NO: 74222

SEQ ID NO: 680696 - RNA, 64 nt, hsa; identical to SEQ ID NO: 74223

SEQ ID NO: 680697 - RNA, 64 nt, hsa; identical to SEQ ID NO: 74224

SEQ ID NO: 680698 - RNA, 64 nt, hsa; identical to SEQ ID NO: 74225

SEQ ID NO: 680699 - RNA, 64 nt, hsa; identical to SEQ ID NO: 74226

SEQ ID NO: 680700 - RNA, 64 nt, hsa; identical to SEQ ID NO: 74227

SEQ ID NO: 680701 - RNA, 64 nt, hsa; identical to SEQ ID NO: 74228

SEQ ID NO: 680702 - RNA, 53 nt, hsa; identical to SEQ ID NO: 74229

SEQ ID NO: 680703 - RNA, 64 nt, hsa; identical to SEQ ID NO: 74230

SEQ ID NO: 680704 - RNA, 64 nt, hsa; identical to SEQ ID NO: 74231

SEQ ID NO: 680705 - RNA, 64 nt, hsa; identical to SEQ ID NO: 74232

SEQ ID NO: 680706 - RNA, 64 nt, hsa; identical to SEQ ID NO: 74233

SEQ ID NO: 680707 - RNA, 64 nt, hsa; identical to SEQ ID NO: 74234

SEQ ID NO: 680708 - RNA, 64 nt, hsa; identical to SEQ ID NO: 74235

SEQ ID NO: 680709 - RNA, 64 nt, hsa; identical to SEQ ID NO: 74236

SEQ ID NO: 680710 - RNA, 64 nt, hsa; identical to SEQ ID NO: 74237

SEQ ID NO: 680711 - RNA, 64 nt, hsa; identical to SEQ ID NO: 74238

SEQ ID NO: 680712 - RNA, 64 nt, hsa; identical to SEQ ID NO: 74239

SEQ ID NO: 680713 - RNA, 64 nt, hsa; identical to SEQ ID NO: 74240

SEQ ID NO: 680714 - RNA, 64 nt, hsa; identical to SEQ ID NO: 74241

SEQ ID NO: 680715 - RNA, 64 nt, hsa; identical to SEQ ID NO: 74242

SEQ ID NO: 680716 - RNA, 64 nt, hsa; identical to SEQ ID NO: 74243

SEQ ID NO: 680717 - RNA, 64 nt, hsa; identical to SEQ ID NO: 74244

SEQ ID NO: 680718 - RNA, 64 nt, hsa; identical to SEQ ID NO: 74245

SEQ ID NO: 680719 - RNA, 64 nt, hsa; identical to SEQ ID NO: 74246

SEQ ID NO: 680720 - RNA, 64 nt, hsa; identical to SEQ ID NO: 74247

SEQ ID NO: 680721 - RNA, 64 nt, hsa; identical to SEQ ID NO: 74248

SEQ ID NO: 680722 - RNA, 64 nt, hsa; identical to SEQ ID NO: 74249

SEQ ID NO: 680723 - RNA, 64 nt, hsa; identical to SEQ ID NO: 74250

SEQ ID NO: 680724 - RNA, 64 nt, hsa; identical to SEQ ID NO: 74251

SEQ ID NO: 680725 - RNA, 64 nt, hsa; identical to SEQ ID NO: 74252

SEQ ID NO: 680726 - RNA, 64 nt, hsa; identical to SEQ ID NO: 74253

SEQ ID NO: 680727 - RNA, 64 nt, hsa; identical to SEQ ID NO: 74254

SEQ ID NO: 680728 - RNA, 64 nt, hsa; identical to SEQ ID NO: 74255

SEQ ID NO: 680729 - RNA, 64 nt, hsa; identical to SEQ ID NO: 74256

SEQ ID NO: 680730 - RNA, 64 nt, hsa; identical to SEQ ID NO: 74257

SEQ ID NO: 680731 - RNA, 64 nt, hsa; identical to SEQ ID NO: 74258

SEQ ID NO: 680732 - RNA, 64 nt, hsa; identical to SEQ ID NO: 74259

SEQ ID NO: 680733 - RNA, 64 nt, hsa; identical to SEQ ID NO: 74260

SEQ ID NO: 680734 - RNA, 64 nt, hsa; identical to SEQ ID NO: 74261

SEQ ID NO: 680735 - RNA, 64 nt, hsa; identical to SEQ ID NO: 74262

SEQ ID NO: 680736 - RNA, 64 nt, hsa; identical to SEQ ID NO: 74263

SEQ ID NO: 680737 - RNA, 64 nt, hsa; identical to SEQ ID NO: 74264

SEQ ID NO: 680738 - RNA, 64 nt, hsa
gggggcugggagauguuccuggaggaggacacucccaucagaacuuggcagccuugaaguuggg

SEQ ID NO: 680739 - RNA, 64 nt, hsa
gcugggggccugaagacauuccuggaggacacucccaucagaaccuggcagccccaaaacuggg

SEQ ID NO: 680740 - RNA, 64 nt, hsa
aagcaccucuuucauuuuuuagugugagcuaauuccaucagacugcuguccuccuggacccauc

SEQ ID NO: 680741 - RNA, 64 nt, hsa
uggacuggcucauaugugaaggcacguucuccagccaucagaggcccccuccuccuccaaccca

SEQ ID NO: 680742 - RNA, 64 nt, hsa
uggauaaauagauugggaccaucagaccaugggaccaucagaccaugaccacuguaggagugau

SEQ ID NO: 680743 - RNA, 64 nt, hsa
auaaauguuggauggauggauaaauagauugggaccaucagaccaugggaccaucagaccauga

SEQ ID NO: 680744 - RNA, 64 nt, hsa
aucugccacugagcccaggucuggacuuuuuuggccaucagauggacgaucugaacauagggug

SEQ ID NO: 680745 - RNA, 64 nt, hsa
augaaaacgaaguuaaauaauuccauuuauaauaccaucagaaagaauaaaauaggaaucaacu

SEQ ID NO: 680746 - RNA, 64 nt, hsa
uggccuccaugauggaagaugauaggggacucagccaucagacaacacccuggccuccuacacg

SEQ ID NO: 680747 - RNA, 64 nt, hsa
gacacuccaauggggaugggaccuuuccccuccuccaucagaggugcucugacccuagguuaca

SEQ ID NO: 680748 - RNA, 64 nt, hsa
uguaaccuugagacgagaauuccaaggagugucaccaucagaggcuucucuucauugugucaaa

SEQ ID NO: 680749 - RNA, 64 nt, hsa
gaaaaaggacaaggacaugagacaguggugauggccaucagacagagacuucaaaugcugaugg

SEQ ID NO: 680750 - RNA, 64 nt, hsa
gccaucuuggacucuccuccccagguuugaaaggccaucagauuagcagggacgggguguaggg

SEQ ID NO: 680751 - RNA, 64 nt, hsa
agagagaaaggucggguuacccacaaagggaagcccaucagacucacagcugaccucuuggcag

SEQ ID NO: 680752 - RNA, 64 nt, hsa
aauaucaucacugaucccacagaaauacaaacuaccaucagagaauacuacaaacaccucuaug

SEQ ID NO: 680753 - RNA, 64 nt, hsa
aaacuaaagaccuucugcacagcaaaagaaacuaccaucagagucaacaggcaaccuacaaaau

SEQ ID NO: 680754 - RNA, 64 nt, hsa
cuuuuggugguugauggccacugcaaaccuggcaccaucagaucucuucugaucucuugcccca

SEQ ID NO: 680755 - RNA, 64 nt, hsa
ucugaccucacagaagaugcccagggcccagaagccaucagaauuaucaguggagaagcaccuu

SEQ ID NO: 680756 - RNA, 64 nt, hsa; identical to SEQ ID NO: 173010

SEQ ID NO: 680757 - RNA, 64 nt, hsa; identical to SEQ ID NO: 173011

SEQ ID NO: 680758 - RNA, 64 nt, hsa; identical to SEQ ID NO: 173012

SEQ ID NO: 680759 - RNA, 64 nt, hsa; identical to SEQ ID NO: 173013

SEQ ID NO: 680760 - RNA, 64 nt, hsa; identical to SEQ ID NO: 173014

SEQ ID NO: 680761 - RNA, 64 nt, hsa; identical to SEQ ID NO: 173015

SEQ ID NO: 680762 - RNA, 64 nt, hsa; identical to SEQ ID NO: 173016

SEQ ID NO: 680763 - RNA, 64 nt, hsa; identical to SEQ ID NO: 173017

SEQ ID NO: 680764 - RNA, 64 nt, hsa; identical to SEQ ID NO: 173018

SEQ ID NO: 680765 - RNA, 64 nt, hsa; identical to SEQ ID NO: 173019

SEQ ID NO: 680766 - RNA, 64 nt, hsa; identical to SEQ ID NO: 173020

SEQ ID NO: 680767 - RNA, 64 nt, hsa; identical to SEQ ID NO: 173021

SEQ ID NO: 680768 - RNA, 64 nt, hsa; identical to SEQ ID NO: 173022

SEQ ID NO: 680769 - RNA, 64 nt, hsa; identical to SEQ ID NO: 173023

SEQ ID NO: 680770 - RNA, 64 nt, hsa; identical to SEQ ID NO: 173024

SEQ ID NO: 680771 - RNA, 64 nt, hsa; identical to SEQ ID NO: 173025

SEQ ID NO: 680772 - RNA, 64 nt, hsa; identical to SEQ ID NO: 173026

SEQ ID NO: 680773 - RNA, 64 nt, hsa; identical to SEQ ID NO: 173027

SEQ ID NO: 680774 - RNA, 64 nt, hsa; identical to SEQ ID NO: 173028

SEQ ID NO: 680775 - RNA, 64 nt, hsa; identical to SEQ ID NO: 173029

SEQ ID NO: 680776 - RNA, 64 nt, hsa; identical to SEQ ID NO: 173030

SEQ ID NO: 680777 - RNA, 64 nt, hsa; identical to SEQ ID NO: 173031

SEQ ID NO: 680778 - RNA, 64 nt, hsa; identical to SEQ ID NO: 173032

SEQ ID NO: 680779 - RNA, 64 nt, hsa; identical to SEQ ID NO: 173033

SEQ ID NO: 680780 - RNA, 64 nt, hsa; identical to SEQ ID NO: 173034

SEQ ID NO: 680781 - RNA, 64 nt, hsa; identical to SEQ ID NO: 173035

SEQ ID NO: 680782 - RNA, 64 nt, hsa; identical to SEQ ID NO: 173036

SEQ ID NO: 680783 - RNA, 64 nt, hsa; identical to SEQ ID NO: 173037

SEQ ID NO: 680784 - RNA, 64 nt, hsa; identical to SEQ ID NO: 173038

SEQ ID NO: 680785 - RNA, 64 nt, hsa; identical to SEQ ID NO: 173039

SEQ ID NO: 680786 - RNA, 64 nt, hsa; identical to SEQ ID NO: 173040

SEQ ID NO: 680787 - RNA, 64 nt, hsa; identical to SEQ ID NO: 173041

SEQ ID NO: 680788 - RNA, 64 nt, hsa; identical to SEQ ID NO: 173042

SEQ ID NO: 680789 - RNA, 64 nt, hsa; identical to SEQ ID NO: 173043

SEQ ID NO: 680790 - RNA, 64 nt, hsa; identical to SEQ ID NO: 173044

SEQ ID NO: 680791 - RNA, 64 nt, hsa; identical to SEQ ID NO: 91418

SEQ ID NO: 680792 - RNA, 64 nt, hsa; identical to SEQ ID NO: 91419

SEQ ID NO: 680793 - RNA, 56 nt, hsa; identical to SEQ ID NO: 91420

SEQ ID NO: 680794 - RNA, 64 nt, hsa; identical to SEQ ID NO: 91421

SEQ ID NO: 680795 - RNA, 64 nt, hsa; identical to SEQ ID NO: 91422

SEQ ID NO: 680796 - RNA, 64 nt, hsa; identical to SEQ ID NO: 91423

SEQ ID NO: 680797 - RNA, 64 nt, hsa; identical to SEQ ID NO: 91424

SEQ ID NO: 680798 - RNA, 64 nt, hsa; identical to SEQ ID NO: 91425

SEQ ID NO: 680799 - RNA, 64 nt, hsa; identical to SEQ ID NO: 91426

SEQ ID NO: 680800 - RNA, 64 nt, hsa; identical to SEQ ID NO: 91427

SEQ ID NO: 680801 - RNA, 64 nt, hsa; identical to SEQ ID NO: 91428

SEQ ID NO: 680802 - RNA, 64 nt, hsa; identical to SEQ ID NO: 91429

SEQ ID NO: 680803 - RNA, 64 nt, hsa; identical to SEQ ID NO: 91430

SEQ ID NO: 680804 - RNA, 64 nt, hsa; identical to SEQ ID NO: 91431

SEQ ID NO: 680805 - RNA, 64 nt, hsa; identical to SEQ ID NO: 91432

SEQ ID NO: 680806 - RNA, 64 nt, hsa; identical to SEQ ID NO: 91433

SEQ ID NO: 680807 - RNA, 64 nt, hsa; identical to SEQ ID NO: 91434

SEQ ID NO: 680808 - RNA, 64 nt, hsa; identical to SEQ ID NO: 91435

SEQ ID NO: 680809 - RNA, 64 nt, hsa; identical to SEQ ID NO: 91436

SEQ ID NO: 680810 - RNA, 64 nt, hsa; identical to SEQ ID NO: 217395

SEQ ID NO: 680811 - RNA, 64 nt, hsa; identical to SEQ ID NO: 217396

SEQ ID NO: 680812 - RNA, 64 nt, hsa; identical to SEQ ID NO: 217397

SEQ ID NO: 680813 - RNA, 64 nt, hsa; identical to SEQ ID NO: 217398

SEQ ID NO: 680814 - RNA, 64 nt, hsa; identical to SEQ ID NO: 217399

SEQ ID NO: 680815 - RNA, 64 nt, hsa; identical to SEQ ID NO: 217400

SEQ ID NO: 680816 - RNA, 64 nt, hsa; identical to SEQ ID NO: 217401

SEQ ID NO: 680817 - RNA, 64 nt, hsa; identical to SEQ ID NO: 217402

SEQ ID NO: 680818 - RNA, 64 nt, hsa; identical to SEQ ID NO: 217403

SEQ ID NO: 680819 - RNA, 64 nt, hsa; identical to SEQ ID NO: 217404

SEQ ID NO: 680820 - RNA, 64 nt, hsa; identical to SEQ ID NO: 217405

SEQ ID NO: 680821 - RNA, 64 nt, hsa; identical to SEQ ID NO: 217406

SEQ ID NO: 680822 - RNA, 64 nt, hsa; identical to SEQ ID NO: 217407

SEQ ID NO: 680823 - RNA, 64 nt, hsa; identical to SEQ ID NO: 217408

SEQ ID NO: 680824 - RNA, 64 nt, hsa; identical to SEQ ID NO: 217409

SEQ ID NO: 680825 - RNA, 64 nt, hsa; identical to SEQ ID NO: 217410

SEQ ID NO: 680826 - RNA, 64 nt, hsa; identical to SEQ ID NO: 217411

SEQ ID NO: 680827 - RNA, 64 nt, hsa; identical to SEQ ID NO: 217412

SEQ ID NO: 680828 - RNA, 64 nt, hsa; identical to SEQ ID NO: 217413

SEQ ID NO: 680829 - RNA, 64 nt, hsa; identical to SEQ ID NO: 217414

SEQ ID NO: 680830 - RNA, 64 nt, hsa; identical to SEQ ID NO: 217415

SEQ ID NO: 680831 - RNA, 64 nt, hsa; identical to SEQ ID NO: 217416

SEQ ID NO: 680832 - RNA, 64 nt, hsa; identical to SEQ ID NO: 215681

SEQ ID NO: 680833 - RNA, 64 nt, hsa; identical to SEQ ID NO: 215682

SEQ ID NO: 680834 - RNA, 64 nt, hsa; identical to SEQ ID NO: 215683

SEQ ID NO: 680835 - RNA, 64 nt, hsa; identical to SEQ ID NO: 215684

SEQ ID NO: 680836 - RNA, 64 nt, hsa; identical to SEQ ID NO: 215685

SEQ ID NO: 680837 - RNA, 64 nt, hsa; identical to SEQ ID NO: 215686

SEQ ID NO: 680838 - RNA, 64 nt, hsa; identical to SEQ ID NO: 215687

SEQ ID NO: 680839 - RNA, 64 nt, hsa; identical to SEQ ID NO: 215688

SEQ ID NO: 680840 - RNA, 64 nt, hsa; identical to SEQ ID NO: 215689

SEQ ID NO: 680841 - RNA, 64 nt, hsa; identical to SEQ ID NO: 215690

SEQ ID NO: 680842 - RNA, 64 nt, hsa; identical to SEQ ID NO: 215691

SEQ ID NO: 680843 - RNA, 64 nt, hsa; identical to SEQ ID NO: 215692

SEQ ID NO: 680844 - RNA, 64 nt, hsa; identical to SEQ ID NO: 215693

SEQ ID NO: 680845 - RNA, 64 nt, hsa; identical to SEQ ID NO: 215694

SEQ ID NO: 680846 - RNA, 64 nt, hsa; identical to SEQ ID NO: 215695

SEQ ID NO: 680847 - RNA, 64 nt, hsa; identical to SEQ ID NO: 215696

SEQ ID NO: 680848 - RNA, 64 nt, hsa; identical to SEQ ID NO: 215697

SEQ ID NO: 680849 - RNA, 64 nt, hsa; identical to SEQ ID NO: 215698

SEQ ID NO: 680850 - RNA, 64 nt, hsa; identical to SEQ ID NO: 215699

SEQ ID NO: 680851 - RNA, 64 nt, hsa; identical to SEQ ID NO: 215700

SEQ ID NO: 680852 - RNA, 64 nt, hsa; identical to SEQ ID NO: 215701

SEQ ID NO: 680853 - RNA, 64 nt, hsa; identical to SEQ ID NO: 215702

SEQ ID NO: 680854 - RNA, 64 nt, hsa
ugauguccauuccaucauuagggcuacucgcaaaagaccauauguugauucuaccuguguucug

SEQ ID NO: 680855 - RNA, 64 nt, hsa
gggaucugacugaagccagaggcucuguaaaaucagaccauaguggaaguccucagcccccugg

SEQ ID NO: 680856 - RNA, 64 nt, hsa
uuucagaucuccuuggagcaguagaguaccugguagaccauaauaguggaaaagggucuaguuu

SEQ ID NO: 680857 - RNA, 64 nt, hsa
gaucucaagugagauagcagagcaagaugccaaaagaccauaaauagaguaagguuucuauaga

SEQ ID NO: 680858 - RNA, 64 nt, hsa
gaagacuuucuggcucuuaacuggggaguaguggagaccauaggagaggacucuccucccucac

SEQ ID NO: 680859 - RNA, 64 nt, hsa
gcuuugauaauguccaaauacucugaaaugcacuagaccauauaacugugaugaaauaugaaac

SEQ ID NO: 680860 - RNA, 64 nt, hsa
caugauugucuuuaugcauccccaaucuuaauugagaccauacuuguauaagauuuuuguaaua

SEQ ID NO: 680861 - RNA, 64 nt, hsa
uacauaccuauauauaaacuugugguauaaccauagaccauagcugcagguuaaccaauuaguu

SEQ ID NO: 680862 - RNA, 64 nt, hsa
cacacaccucuccuucauucacguccuauggaagagaccauaaaggcuucaaaacuagaagugc

SEQ ID NO: 680863 - RNA, 64 nt, hsa
gugcuacaguagcagaguugagucauugcaagggagaccauauggcccagguagccuaaaauau

SEQ ID NO: 680864 - RNA, 64 nt, hsa
cauuuuucuccuuaaaaauuaaaauccuugacauagaccauagcauggcuugaaaugcuauguc

SEQ ID NO: 680865 - RNA, 64 nt, hsa
cagaguuaagccucagaauaauuuuaucaccuacagaccauaugcagacuaaauacaacacuug

SEQ ID NO: 680866 - RNA, 64 nt, hsa
agaggauggggacagagugugggauggagaggacagaccauauacugcacuguguuugcaugag

SEQ ID NO: 680867 - RNA, 64 nt, hsa
agcagcauugaagugggaagauuuaggcugccccagaccauaucuacuggccuuuguuucacau

SEQ ID NO: 680868 - RNA, 64 nt, hsa
ucagcuuuuugucuuuucugaggagaaacaaauaagaccauaaagggaaaggauucauguggaa

SEQ ID NO: 680869 - RNA, 64 nt, hsa
augaaaaauaaugaucucugucuagaaauaccauagaccauauauagucucacauugauaauug

SEQ ID NO: 680870 - RNA, 64 nt, hsa
cucccuuauuuuccacaucauuccuagcauaucaagaccauaccccuugccuuuuugauccaaa

SEQ ID NO: 680871 - RNA, 64 nt, hsa
caccuuaucccaggaaccugcccuagaccuccagagaccauauuuucucucccuccauuucuac

SEQ ID NO: 680872 - RNA, 64 nt, hsa
cagaacgcauuuuuaaucugguacucacauaaucagaccauauagacgaggcacuuuggaacca

SEQ ID NO: 680873 - RNA, 64 nt, hsa
gcugaagcggguggaucaugaggucagaagaucaagaccauacuggcuaacacggugaaacccc

SEQ ID NO: 680874 - RNA, 64 nt, hsa
auuaaaaauaauagcuggcuauuauagaaaauuuagaccauacagagauguagaaagaacauaa

SEQ ID NO: 680875 - RNA, 64 nt, hsa
auaaagugaacuugcuuguuuauaguaauaaacaagaccauaagagaauaaguauagcuagaga

SEQ ID NO: 680876 - RNA, 64 nt, hsa
guguuaucaucucuguuauagaagagccuucuguagaccauauagaaaaagauuauagaggagg

SEQ ID NO: 680877 - RNA, 64 nt, hsa
cuuuacaacuuagguuuuacucuuuucuuucuacagaccauauuuuuaaagaaauguuuauaca

SEQ ID NO: 680878 - RNA, 64 nt, hsa
ucaauguuucuucuagguucuaaaaauugugaucagaccauaauguuacauuauuaucaacaau

SEQ ID NO: 680879 - RNA, 64 nt, hsa
uauugaaggaaaaggacucaagaaaaauaauaaaagaccauaaauaagggcgaaaacauuacca

SEQ ID NO: 680880 - RNA, 64 nt, hsa
cuggcuuggugacuuugcuucacuacagguuaaaagaccauaagcaaacugguuauuuaaaaug

SEQ ID NO: 680881 - RNA, 64 nt, hsa
acaaauugaaaaucugaagaccgaugcugcaagcagaccauaugcagaugugcgaguuauugac

SEQ ID NO: 680882 - RNA, 64 nt, hsa
cagauuauuacuggcuccaaaggaugaguagauaagaccauaagaauuggaucaauguaaaucc

SEQ ID NO: 680883 - RNA, 64 nt, hsa
aguuuauaaaugucugugcacuauauuaauuagaagaccauagaacaugccagcagguuggcua

SEQ ID NO: 680884 - RNA, 64 nt, hsa
uuuacauuauuuuuacguugauuauuuuagugaaagaccauaugaagaagcauuuuuaauauua

SEQ ID NO: 680885 - RNA, 64 nt, hsa
ucaccaguuuuuauuuggagccguuuuauuguguagaccauauuuacauauuuggauaaguaca

SEQ ID NO: 680886 - RNA, 64 nt, hsa
aucaaaauaggauuucuuaaauuuuucaacccccagaccauacugacucaacauggagucucac

SEQ ID NO: 680887 - RNA, 64 nt, hsa
aacuauuuauuaacuaauguaauguccuccucuaagaccauauuguaagagucuuguuaaaaug

SEQ ID NO: 680888 - RNA, 53 nt, hsa
aacucucugcuggguucugacucagaccauaggaggccaacccaaaauaagca

SEQ ID NO: 680889 - RNA, 64 nt, hsa
gaugggagaauauguuuaaaauauuaggaauccuagaccauauuuucaagucaucuuagcagcu

SEQ ID NO: 680890 - RNA, 64 nt, hsa
uuucuuuauaaagcuuuuugaaggucauaaacaaagaccauaauugaugauagaccuaauacau

SEQ ID NO: 680891 - RNA, 64 nt, hsa
aacagacaugggcuuugauuuuuuucauacuauuagaccauaucucauaaaaccuuuugaauua

SEQ ID NO: 680892 - RNA, 64 nt, hsa
aaguuuucuuuacuguugguuaaaaaaaaaagccagaccauaguuugacugguggcauggaauu

SEQ ID NO: 680893 - RNA, 64 nt, hsa
cccaagguggguagaucacgagaucaagagaucaagaccauagugaccaacauagugaaacccc

SEQ ID NO: 680894 - RNA, 64 nt, hsa
cuuuaauguauguauguauaauggcuguacagguagaccauaauucaguccuuuagauuuauuu

SEQ ID NO: 680895 - RNA, 64 nt, hsa
ccccuuaccccaaagagaaagaguuugaaacucgagaccauaaagauauucuuuaguggaggcu

SEQ ID NO: 680896 - RNA, 64 nt, hsa
acaguacuuguuuuuaguugucaugccuauguuuagaccauaucuuaauguauucacaaagaau

SEQ ID NO: 680897 - RNA, 63 nt, hsa
guggauauaaaauagaacaccugacuuugcucuuagaccauaacccccgaacuuacuauguuc

SEQ ID NO: 680898 - RNA, 64 nt, hsa
uuaccugguaucccauggauuuugugcuugggacagaccauaaaugauggaaaaugucaacaca

SEQ ID NO: 680899 - RNA, 64 nt, hsa
uuuuaaaugugucauuaaacuaauauuuagugggagaccauaaugugucagccaccuugauaaa

SEQ ID NO: 680900 - RNA, 64 nt, hsa
ucagagguccaccucuuacccuacagacuggccgagaccauaucaaguauuaaaaccauucuau

SEQ ID NO: 680901 - RNA, 64 nt, hsa
aggaaguguuuauuugccucuaauugggccugagagaccauagggagguuggggcucacugagg

SEQ ID NO: 680902 - RNA, 64 nt, hsa
auugcuauuuuugcugugauaaugguauuaugcaagaccauauucucaauuauuuggauaugca

SEQ ID NO: 680903 - RNA, 64 nt, hsa
aaguuauccuuccauuuuggccuccugaguagcuagaccauagguaugcaucaccacacccugc

SEQ ID NO: 680904 - RNA, 64 nt, hsa
ggaaaguuaugauccuccaagacccuuaauugauagaccauaccagguucugcaggucagcauc

SEQ ID NO: 680905 - RNA, 64 nt, hsa
ggcuggagcucuccugcuugccaccugccugucaagaccauaguuguacugcugcugcuucauu

SEQ ID NO: 680906 - RNA, 64 nt, hsa
aaaauaguugaauauacauuuuguuucucucauaagaccauauucccuuuaaaagaguaagcuu

SEQ ID NO: 680907 - RNA, 64 nt, hsa
uuuggagaaaugaauguuugucuggagcagagggagaccauacuagggcgacuccugugugacu

SEQ ID NO: 680908 - RNA, 64 nt, hsa
aguuacuaguuuuggcaccugcaacuuucuguauagaccauacauaucugacaucagaaaagca

SEQ ID NO: 680909 - RNA, 64 nt, hsa
ugagguuuuguacuuacuuuccccauaggaagacagaccauaggcaaacucuguuuugggaucu

SEQ ID NO: 680910 - RNA, 64 nt, hsa
ccuagacuauauccaaccccagucaggcugacacagaccauaagaauuguacagauaauccaca

SEQ ID NO: 680911 - RNA, 64 nt, hsa
aaacauuuuggaaacuucacaugcauuccgcuugagaccauaguguuuaaucuauggcaccaag

SEQ ID NO: 680912 - RNA, 64 nt, hsa
cgcuuaugcuacuuaaucagaaucuugagaaaauagaccauaaugauucccuguuguauuaaaa

SEQ ID NO: 680913 - RNA, 64 nt, hsa
cacgauucuguccagagugagcacuggaugguggagaccauaggucaccccagauuccuugacc

SEQ ID NO: 680914 - RNA, 64 nt, hsa
gaagaggcgaguagggcacaacaggcacaaagggagaccauaaggagacacagaggaaggacaa

SEQ ID NO: 680915 - RNA, 64 nt, hsa
uucucucuaaauuguauauaaguuguguauauagagaccauaauuauaugguccuuagaaaaga

SEQ ID NO: 680916 - RNA, 64 nt, hsa
gugccaucagcuaaugccaggcuuacguauuucuagaccauaaagcaguuuuucacaaauucau

SEQ ID NO: 680917 - RNA, 64 nt, hsa
aaaaaaaaaccacaccuaaaauagaccacugaggagaccauagagcggaugcuuucaugcaccc

SEQ ID NO: 680918 - RNA, 64 nt, hsa
aggagacauucaacaggaguaugaaaugagaguuagaccauaugggcugacaacaccauaaaua

SEQ ID NO: 680919 - RNA, 64 nt, hsa
gauaacugagaauuuaaaaauaagaaaauacauaagaccauaacagccaacagguggcaggacc

SEQ ID NO: 680920 - RNA, 64 nt, hsa
uauuggugagcacaauguauucauuuaauggcauagaccauaccagaccuaauuugcaaguauu

SEQ ID NO: 680921 - RNA, 64 nt, hsa
gaaacuucuaagguaucaucuguguuaagugaugagaccauauuucuuugauguuucugaacau

SEQ ID NO: 680922 - RNA, 64 nt, hsa
agccuaggcccagcuccuccgcgguuggccccccagaccauaccucugacccacccagccccug

SEQ ID NO: 680923 - RNA, 64 nt, hsa
cuacaaugaaauauuuuacagacaaaauguuaauagaccauauucuuugaauuaaauuuguuuu

SEQ ID NO: 680924 - RNA, 64 nt, hsa
auuaaagaaaaauuccuacagauuuucaaugcagagaccauaaucaaaaaguaaacuuucuuua

SEQ ID NO: 680925 - RNA, 64 nt, hsa
aaauuaucaaucucugcuaguaauuaugaauuuaagaccauauuauuaucaaaaaccuagagac

SEQ ID NO: 680926 - RNA, 64 nt, hsa
uauggacacugccuuagccucuuggaaaucagguagaccauauucuaaguuagacucuuccccu

SEQ ID NO: 680927 - RNA, 64 nt, hsa
cuuaaaugccuucuguaguuucagaucaguagggagaccauauaauaauuuuaugguaccuguu

SEQ ID NO: 680928 - RNA, 64 nt, hsa
aaucuggggaaauaauaaaauuaucaccuuugucagaccauaagaguuucuccaaaagugguca

SEQ ID NO: 680929 - RNA, 64 nt, hsa
ugagacccaccagguccaguuuugguugguguagagaccauaugcauauuauuccugggauaaa

SEQ ID NO: 680930 - RNA, 64 nt, hsa
aguaauuuuaaugucuuuauguugccacauguuaagaccauaauguaguuauaaauggaaaugu

SEQ ID NO: 680931 - RNA, 64 nt, hsa
gcuucauguuuucucugacucauggaucugguagagaccauagacaugauauagacuaacuucc

SEQ ID NO: 680932 - RNA, 64 nt, hsa
ccuuauggagcucacacuccaguggcagacaaacagaccauaaauaaggaaacgaugaaauaag

SEQ ID NO: 680933 - RNA, 60 nt, hsa
cccaccggggugggcacuaagcuaugggagagaccauagcugcagaaaccaacccugccc

SEQ ID NO: 680934 - RNA, 64 nt, hsa
gagccgggaggcacuccucccaaacacuccacucagaccauaaagcacuccuguuucacucugc

SEQ ID NO: 680935 - RNA, 64 nt, hsa; identical to SEQ ID NO: 680930

SEQ ID NO: 680936 - RNA, 64 nt, hsa
gacaaugcucauuaauauuauuuuuucuauuuguagaccauaucugaaagaaauaacauuuuuu

SEQ ID NO: 680937 - RNA, 64 nt, hsa
ugcauguuuuuuaaccugcuuuuccccauagcacagaccauaagaaacaacaaauggggccggg

SEQ ID NO: 680938 - RNA, 64 nt, hsa
acaguuuaaauguauaucuuuuaugucucuacucagaccauauuuuuaaaggggugccucauua

SEQ ID NO: 680939 - RNA, 64 nt, hsa
cagaagucaauaggccuauuuauuaauauuuuacagaccauauuaccuggauuaccagggacua

SEQ ID NO: 680940 - RNA, 64 nt, hsa
agaagauuacgacuccuagcgccuucugccccccagaccauagccccuuuuaguugguuuuagu

SEQ ID NO: 680941 - RNA, 64 nt, hsa
uuuuucacaagggaacucauacugucuacacaucagaccauaguugcuuaggaaaccuuuaaaa

SEQ ID NO: 680942 - RNA, 64 nt, hsa
uuccauuugugguacuaaaauuugcuacuguuuuagaccauauuuuccuauuauuuaucuguuc

SEQ ID NO: 680943 - RNA, 64 nt, hsa
gccagggcuugcaagaaguaaguuucuucaaagaagaccauauacaaaaccucuccacuccacu

SEQ ID NO: 680944 - RNA, 64 nt, hsa
uuuugaaggauguagggagccuuaguugggucucagaccauaaguguguacuacacagaagcug

SEQ ID NO: 680945 - RNA, 64 nt, hsa
cagaagccugauugguuaguagggaauaaaguguagaccauaugaaaugaacugcaaacucuaa

SEQ ID NO: 680946 - RNA, 64 nt, hsa
guguguguggcuuugaaaacaaauuauuugagaaagaccauaacacagugaguagccuauaugu

SEQ ID NO: 680947 - RNA, 64 nt, hsa
gucccucagaccugggaccucccuuuauagggaaagaccauauuccauagguuuagggcuuuac

SEQ ID NO: 680948 - RNA, 64 nt, hsa
acauacauaaggagagaagguacagugaugaaggagaccauaauucuguaguguugaugauccu

SEQ ID NO: 680949 - RNA, 64 nt, hsa
uuacugaagaaagcaccaagucuuaauggaacaaagaccauagaaugaauuauuuuaucuccuc

SEQ ID NO: 680950 - RNA, 64 nt, hsa
uuuuauuugaaauuuuaagucaaguccuuuauaaagaccauagcaguggaaaacaguguacuuu

SEQ ID NO: 680951 - RNA, 64 nt, hsa
aaccacacccaaaauggacccccacuaccuucccagaccauauaucuccccuugaucauagucc

SEQ ID NO: 680952 - RNA, 64 nt, hsa
aagccaacaguaagccccaggaaaggguuuuuugagaccauauguaugcuauuaaaauauauug

SEQ ID NO: 680953 - RNA, 64 nt, hsa
cuugaagcuaucauauagauccuguauuucugauagaccauacuaacagacaccaaaggaacaa

SEQ ID NO: 680954 - RNA, 64 nt, hsa
uacacccaaauuauugcauuaagaauccuggagcagaccauagcugaagcuguuauuuucaguc

SEQ ID NO: 680955 - RNA, 64 nt, hsa
auggcuauuagaaauccacauucuuacacaagaaagaccauauuagaaucuaaggaaaacaugc

SEQ ID NO: 680956 - RNA, 64 nt, hsa
agucaaaauuuuuugacuuucuuuuuaaagccaaagaccauaguuuuaguuuuaagccacuagg

SEQ ID NO: 680957 - RNA, 64 nt, hsa
uauacaauaauguuguuguaacacaaguguuauuagaccauagccacaaaauauuuaauguguu

SEQ ID NO: 680958 - RNA, 64 nt, hsa
uguauucacuuguguuugaugaacuaucuuuaaaagaccauaggucuaucauuauuucuuagac

SEQ ID NO: 680959 - RNA, 64 nt, hsa
cuugagccauguuguuugaauugcugccaauagcagaccauaucccuaucauguuguuggcuca

SEQ ID NO: 680960 - RNA, 64 nt, hsa
agacaagacucuggggaugggaaugacuuccucgagaccauacagccaggaaauagcggugaau

SEQ ID NO: 680961 - RNA, 64 nt, hsa
uucauuaauaucagaaauuuacaauagcauuuuaagaccauaguaggauucuagcauaccgugu

SEQ ID NO: 680962 - RNA, 53 nt, hsa
uacauaaaaaagaaacaugacucagaccauaagcuuuucaugccagaugucaa

SEQ ID NO: 680963 - RNA, 64 nt, hsa
cacgccacugcacuccagucugggugacagagagagaccauauccaaaaaaaaaaaaaguugcc

SEQ ID NO: 680964 - RNA, 64 nt, hsa
ugggauaaaccaccauugcuaguccucaggaauuagaccauauuuaguauaggaguuggggcaa

SEQ ID NO: 680965 - RNA, 64 nt, hsa
ggaucaaccgcaggcuuucuucagucccuuggucagaccauaaacugcauuuuugauucuuugu

SEQ ID NO: 680966 - RNA, 64 nt, hsa
gcuagugacuugaaaagaaagagagaaggaaaagagaccauauuaaguccaugccaguugcuug

SEQ ID NO: 680967 - RNA, 64 nt, hsa
cacauucacugucucagcuggcuguuacucucucagaccauauggcaaaguuuuccaagaaaau

SEQ ID NO: 680968 - RNA, 64 nt, hsa
gcagauuacuuuuucaaguuuggggaacuucaaaagaccauaaucaaccaggagcuuauuauag

SEQ ID NO: 680969 - RNA, 64 nt, hsa
aagacgccacagauuuccuucccucuccuccaggagaccauaagauagaucccccauccucuca

SEQ ID NO: 680970 - RNA, 64 nt, hsa
agaaaacauguccacucugcagaacugugauuucagaccauauaaacaaauggaaggauggagc

SEQ ID NO: 680971 - RNA, 64 nt, hsa
uauauacaguugccuuauaaaacaacauaaauuuagaccauaacuuuuauagagaaaggguuuu

SEQ ID NO: 680972 - RNA, 64 nt, hsa
cacuuuacuuggguuuaccaagccucaacuggacagaccauaaacaguccacaggcaccguucc

SEQ ID NO: 680973 - RNA, 64 nt, hsa
caacucaggaagcauuugacucguuguacuucagagaccauaaaugacaagguuuugacauuuu

SEQ ID NO: 680974 - RNA, 64 nt, hsa
augugaggcuacuucuaagauguguguucacaauagaccauaacuccucuaguaucaaaauugg

SEQ ID NO: 680975 - RNA, 64 nt, hsa
cccuaaugacaucaccaacagucaaagcaauuagagaccauaccuaauauuguuuaaauucuag

SEQ ID NO: 680976 - RNA, 64 nt, hsa
gcuguuuugugugcucucuugcuaaagaccgcagagaccauaccuguugucaaagaggguguaa

SEQ ID NO: 680977 - RNA, 64 nt, hsa
caguaucuagucguggauauaauuaaaacgcugaagaccauaaccuuuugggucaacuguuggu

SEQ ID NO: 680978 - RNA, 64 nt, hsa
aaaaaagaaaagaaaaagaaaugaauggguucaaagaccauaaucaugcauaucacauaagacc

SEQ ID NO: 680979 - RNA, 64 nt, hsa
aguuuccaauaugugaauacagggaagcaccaacagaccauaucaguaacuucgagugaguuuc

SEQ ID NO: 680980 - RNA, 64 nt, hsa
gagugcuccccagaaccagaggaggguggggcacagaccauagacggaccccucguccuccccc

SEQ ID NO: 680981 - RNA, 64 nt, hsa
uuaguuuuuguucaaggcuuaauaaccguuagcuagaccauagaggacagaaacuuuacuaaug

SEQ ID NO: 680982 - RNA, 64 nt, hsa
aaaugauaaaagggugaggguuccuguuuggauuagaccauaguugacccaucuggcauugcca

SEQ ID NO: 680983 - RNA, 64 nt, hsa
ccaucagugucguccccugcugagaggccaugugagaccauauggaaaaacaacagccauaaug

SEQ ID NO: 680984 - RNA, 64 nt, hsa
uucugcguguauguguuugcacaugaguguuuguagaccauagaccauuaaaaaauacggaauu

SEQ ID NO: 680985 - RNA, 64 nt, hsa
gugccugccuugcauuuuccuucuggugcugugaagaccauaggcuggcaggcagcugagauga

SEQ ID NO: 680986 - RNA, 64 nt, hsa
ugaccaccugggugccaguuacagguguuuccagagaccauagaaauguguuuuccugagaguu

SEQ ID NO: 680987 - RNA, 64 nt, hsa
ucccaggugauucacagccacauuaaaguucaggagaccauaggaccccugacccaugagaaga

SEQ ID NO: 680988 - RNA, 64 nt, hsa
ggccagagagggaaaaggcaggugcuuuuggcagagaccauaagagaaaccugccaaggagcau

SEQ ID NO: 680989 - RNA, 64 nt, hsa
ggguccacccacagagcacuacagagccucugaaagaccauagcaccaagcgagccccuucaga

SEQ ID NO: 680990 - RNA, 64 nt, hsa
ugucuuuugcuauauucuccaagauuaucucuuaagaccauaugcccccuguuuuaauguuucu

SEQ ID NO: 680991 - RNA, 64 nt, hsa
uugggcagcugaacuuuucugcuuuccucaaaucagaccauaugagaggauauauucuaugcau

SEQ ID NO: 680992 - RNA, 64 nt, hsa
ccuaugggcucaugguuugacaaacagaguggagagaccauauuuuagccccacucacccucuu

SEQ ID NO: 680993 - RNA, 64 nt, hsa
ggaaaauucaaguuacaguggaguauuuuuuugaagaccauaugcuuggagguagaaacaaacc

SEQ ID NO: 680994 - RNA, 64 nt, hsa
acaaacucaaguuaugucauaccuuuggauacgaagaccauacauaauaaccaaacauaacauu

SEQ ID NO: 680995 - RNA, 64 nt, hsa
cacagguaagugaaugccaaagucuucuuuuuucagaccauacaagaagucauuuugauuuuca

SEQ ID NO: 680996 - RNA, 64 nt, hsa
gaaaagggucucagggacuccuccaggggucuucagaccauacuuugagaacccaugggcuagc

SEQ ID NO: 680997 - RNA, 64 nt, hsa
uuauuguuuugauguaauggaacuuaaggauaaaagaccauaauauuugcuguuaaaauaaaua

SEQ ID NO: 680998 - RNA, 64 nt, hsa
caagccauuuaaaaaauauuuauauauacauaguagcaaauaguuuuauagauuuauuuguauc

SEQ ID NO: 680999 - RNA, 64 nt, hsa
uaaaagugauuuuagcccuaggcccgaaaugacuagcaaauaucauuuucuguaugaauugugg

SEQ ID NO: 681000 - RNA, 64 nt, hsa
caauuuuccuaaguuucuuugaggguuccaugggagcaaauaucuaaauaauggccugguaggu

SEQ ID NO: 681001 - RNA, 64 nt, hsa
acugacagccuccaccuugagcacuauucuaaggagcaaauaccuuagcucccuugagcugguu

SEQ ID NO: 681002 - RNA, 64 nt, hsa
gcaaauauuuuaugccaagaaaagcauacuauaaagcaaauaucuauuauucuccuaaacgaau

SEQ ID NO: 681003 - RNA, 64 nt, hsa
cuagguuccugcacuuuuugguaacuuuaugucuagcaaauauuuuaugccaagaaaagcauac

SEQ ID NO: 681004 - RNA, 64 nt, hsa
guuaaaaguuucaucagaaacuuuacauaucuuuagcaaauauauuuuuauauguguauggcau

SEQ ID NO: 681005 - RNA, 64 nt, hsa
cuuaaaaauaaaauaacugaaagaaauagaauucagcaaauaguuauuuuuugcacuugaacug

SEQ ID NO: 681006 - RNA, 64 nt, hsa
acacggaaaaccuuuauuuuaaagucaaguugugagcaaauagaaauaaaagacaaaaggacau

SEQ ID NO: 681007 - RNA, 64 nt, hsa
guauguuuauuuguuaauccuaaccaguauaauaagcaaauacacuauaauagauccacguuac

SEQ ID NO: 681008 - RNA, 64 nt, hsa
gucaaggcugcaaucacuuuaauaguuucuuuuuagcaaauaaauguucauugaugaagugccu

SEQ ID NO: 681009 - RNA, 64 nt, hsa
uuacguucuauaaagucacugcgaacacugaauuagcaaauauagaaccuaggggaaauacaag

SEQ ID NO: 681010 - RNA, 64 nt, hsa
uccuuuucuucaguuccucagcuccucucauuucagcaaauauccauuuucaaggugcagaaca

SEQ ID NO: 681011 - RNA, 64 nt, hsa
acuucaugcaauguacuuguucuaagcaaauuaaagcaaauauuuauuuaacauuguuacugag

SEQ ID NO: 681012 - RNA, 64 nt, hsa
uauuaaaacaauaaugcaauuagaauuugggagaagcaaauauagguccuguguuaaacacuac

SEQ ID NO: 681013 - RNA, 64 nt, hsa
caaucaccaccagguaucaaaucaacuuuuaugcagcaaauauaugauucuagugucugacuuu

SEQ ID NO: 681014 - RNA, 64 nt, hsa
ucaucucugucacauuagacuauccaucaugaccagcaaauacucauuuuaggaaaaaaaaaag

SEQ ID NO: 681015 - RNA, 64 nt, hsa
acccuccuagcuuuccauuugguuuagaacauaaagcaaauagacacagucauacugucacugc

SEQ ID NO: 681016 - RNA, 64 nt, hsa
uuaguuuaaauccaacagaaaucuagaagucacaagcaaauaucuuaaagguaaaauccaucug

SEQ ID NO: 681017 - RNA, 64 nt, hsa
aagauccaacagugcacucaucauuaguuaacaaagcaaauauguucaucacugucaggcugcc

SEQ ID NO: 681018 - RNA, 64 nt, hsa
cuaugaauagcacuuuaugauguaggcuaaacuaagcaaauaaugcagcguuauguggaucauu

SEQ ID NO: 681019 - RNA, 64 nt, hsa
agcauuaaauuagcuuuuuacccucaacucaaguagcaaauaucauggagaacuucaguguuua

SEQ ID NO: 681020 - RNA, 64 nt, hsa
cugaaaaagcccauuuuagaaccuguuuaauaagagcaaauauaggggaaaaucuuugaaauga

SEQ ID NO: 681021 - RNA, 64 nt, hsa
aaauacaugugagaagaaaaaaauggauuuuuuuagcaaauaauuaacuaagcuucuaaaugcc

SEQ ID NO: 681022 - RNA, 64 nt, hsa
ugugcuuuuaacauauuugagaauaaaaaggacuagcaaauaaaacucauuuugcauuuaaaag

SEQ ID NO: 681023 - RNA, 64 nt, hsa
ugagacugaauucuugcaaugcauaagauauaaaagcaaauaugacucacucauuucuuggggu

SEQ ID NO: 681024 - RNA, 64 nt, hsa
ugaugagaguacuaacuggaaaaaggcugaagagagcaaauauauuauuaagauggguuggagg

SEQ ID NO: 681025 - RNA, 56 nt, hsa
uuggagccuucuuacuauaggaggagagcaaauaucauuauaugaaaguccucugc

SEQ ID NO: 681026 - RNA, 64 nt, hsa
cagcauuaaauauugcauuuaaaaauuauacuguagcaaauacauuuaaaaauuaaucacaacg

SEQ ID NO: 681027 - RNA, 64 nt, hsa
uccuuguuuuguugauuagaacaacacagaaaaaagcaaauauaaauuuuuaaugacuccauuu

SEQ ID NO: 681028 - RNA, 64 nt, hsa
agaaaggugcaggagguaccuuaacucaccccucagcaaauaccuaugucaacaguauaaguua

SEQ ID NO: 681029 - RNA, 64 nt, hsa
uuguauuucuagcauuacuagauauuaaaaguuaagcaaauagauuaaugacguauacauaggc

SEQ ID NO: 681030 - RNA, 64 nt, hsa; identical to SEQ ID NO: 603880

SEQ ID NO: 681031 - RNA, 64 nt, hsa; identical to SEQ ID NO: 603881

SEQ ID NO: 681032 - RNA, 64 nt, hsa; identical to SEQ ID NO: 603882

SEQ ID NO: 681033 - RNA, 64 nt, hsa; identical to SEQ ID NO: 603883

SEQ ID NO: 681034 - RNA, 64 nt, hsa; identical to SEQ ID NO: 603884

SEQ ID NO: 681035 - RNA, 64 nt, hsa; identical to SEQ ID NO: 603885

SEQ ID NO: 681036 - RNA, 64 nt, hsa; identical to SEQ ID NO: 603886

SEQ ID NO: 681037 - RNA, 64 nt, hsa; identical to SEQ ID NO: 603887

SEQ ID NO: 681038 - RNA, 64 nt, hsa; identical to SEQ ID NO: 603888

SEQ ID NO: 681039 - RNA, 64 nt, hsa; identical to SEQ ID NO: 603889

SEQ ID NO: 681040 - RNA, 64 nt, hsa; identical to SEQ ID NO: 603890

SEQ ID NO: 681041 - RNA, 64 nt, hsa; identical to SEQ ID NO: 603891

SEQ ID NO: 681042 - RNA, 64 nt, hsa; identical to SEQ ID NO: 603892

SEQ ID NO: 681043 - RNA, 64 nt, hsa; identical to SEQ ID NO: 603893

SEQ ID NO: 681044 - RNA, 64 nt, hsa; identical to SEQ ID NO: 603894

SEQ ID NO: 681045 - RNA, 64 nt, hsa; identical to SEQ ID NO: 603895

SEQ ID NO: 681046 - RNA, 64 nt, hsa; identical to SEQ ID NO: 603896

SEQ ID NO: 681047 - RNA, 64 nt, hsa; identical to SEQ ID NO: 603897

SEQ ID NO: 681048 - RNA, 64 nt, hsa; identical to SEQ ID NO: 603898

SEQ ID NO: 681049 - RNA, 64 nt, hsa; identical to SEQ ID NO: 603899

SEQ ID NO: 681050 - RNA, 64 nt, hsa; identical to SEQ ID NO: 603900

SEQ ID NO: 681051 - RNA, 64 nt, hsa; identical to SEQ ID NO: 603901

SEQ ID NO: 681052 - RNA, 64 nt, hsa; identical to SEQ ID NO: 603902

SEQ ID NO: 681053 - RNA, 64 nt, hsa; identical to SEQ ID NO: 603903

SEQ ID NO: 681054 - RNA, 64 nt, hsa; identical to SEQ ID NO: 603904

SEQ ID NO: 681055 - RNA, 64 nt, hsa; identical to SEQ ID NO: 603905

SEQ ID NO: 681056 - RNA, 64 nt, hsa; identical to SEQ ID NO: 603906

SEQ ID NO: 681057 - RNA, 64 nt, hsa; identical to SEQ ID NO: 603907

SEQ ID NO: 681058 - RNA, 64 nt, hsa; identical to SEQ ID NO: 603908

SEQ ID NO: 681059 - RNA, 64 nt, hsa; identical to SEQ ID NO: 603909

SEQ ID NO: 681060 - RNA, 64 nt, hsa; identical to SEQ ID NO: 603910

SEQ ID NO: 681061 - RNA, 64 nt, hsa; identical to SEQ ID NO: 603911

SEQ ID NO: 681062 - RNA, 64 nt, hsa; identical to SEQ ID NO: 603912

SEQ ID NO: 681063 - RNA, 64 nt, hsa; identical to SEQ ID NO: 603913

SEQ ID NO: 681064 - RNA, 64 nt, hsa; identical to SEQ ID NO: 603914

SEQ ID NO: 681065 - RNA, 64 nt, hsa; identical to SEQ ID NO: 83782

SEQ ID NO: 681066 - RNA, 64 nt, hsa; identical to SEQ ID NO: 83783

SEQ ID NO: 681067 - RNA, 64 nt, hsa; identical to SEQ ID NO: 83784

SEQ ID NO: 681068 - RNA, 64 nt, hsa; identical to SEQ ID NO: 83785

SEQ ID NO: 681069 - RNA, 64 nt, hsa; identical to SEQ ID NO: 83786

SEQ ID NO: 681070 - RNA, 64 nt, hsa; identical to SEQ ID NO: 83787

SEQ ID NO: 681071 - RNA, 64 nt, hsa; identical to SEQ ID NO: 83788

SEQ ID NO: 681072 - RNA, 64 nt, hsa; identical to SEQ ID NO: 83789

SEQ ID NO: 681073 - RNA, 64 nt, hsa; identical to SEQ ID NO: 83790

SEQ ID NO: 681074 - RNA, 64 nt, hsa; identical to SEQ ID NO: 83791

SEQ ID NO: 681075 - RNA, 64 nt, hsa; identical to SEQ ID NO: 83792

SEQ ID NO: 681076 - RNA, 64 nt, hsa; identical to SEQ ID NO: 83793

SEQ ID NO: 681077 - RNA, 64 nt, hsa; identical to SEQ ID NO: 83794

SEQ ID NO: 681078 - RNA, 64 nt, hsa; identical to SEQ ID NO: 83795

SEQ ID NO: 681079 - RNA, 64 nt, hsa; identical to SEQ ID NO: 83796

SEQ ID NO: 681080 - RNA, 64 nt, hsa; identical to SEQ ID NO: 83797

SEQ ID NO: 681081 - RNA, 64 nt, hsa; identical to SEQ ID NO: 83798

SEQ ID NO: 681082 - RNA, 64 nt, hsa; identical to SEQ ID NO: 83799

SEQ ID NO: 681083 - RNA, 64 nt, hsa; identical to SEQ ID NO: 83800

SEQ ID NO: 681084 - RNA, 64 nt, hsa; identical to SEQ ID NO: 83801

SEQ ID NO: 681085 - RNA, 64 nt, hsa; identical to SEQ ID NO: 83802

SEQ ID NO: 681086 - RNA, 64 nt, hsa; identical to SEQ ID NO: 83803

SEQ ID NO: 681087 - RNA, 64 nt, hsa; identical to SEQ ID NO: 83804

SEQ ID NO: 681088 - RNA, 64 nt, hsa; identical to SEQ ID NO: 83805

SEQ ID NO: 681089 - RNA, 64 nt, hsa; identical to SEQ ID NO: 83806

SEQ ID NO: 681090 - RNA, 64 nt, hsa; identical to SEQ ID NO: 83807

SEQ ID NO: 681091 - RNA, 64 nt, hsa; identical to SEQ ID NO: 83808

SEQ ID NO: 681092 - RNA, 64 nt, hsa; identical to SEQ ID NO: 83809

SEQ ID NO: 681093 - RNA, 64 nt, hsa; identical to SEQ ID NO: 83810

SEQ ID NO: 681094 - RNA, 64 nt, hsa; identical to SEQ ID NO: 83811

SEQ ID NO: 681095 - RNA, 64 nt, hsa; identical to SEQ ID NO: 83812

SEQ ID NO: 681096 - RNA, 64 nt, hsa; identical to SEQ ID NO: 83813

SEQ ID NO: 681097 - RNA, 64 nt, hsa; identical to SEQ ID NO: 223145

SEQ ID NO: 681098 - RNA, 64 nt, hsa; identical to SEQ ID NO: 223146

SEQ ID NO: 681099 - RNA, 64 nt, hsa; identical to SEQ ID NO: 223147

SEQ ID NO: 681100 - RNA, 64 nt, hsa; identical to SEQ ID NO: 223148

SEQ ID NO: 681101 - RNA, 64 nt, hsa; identical to SEQ ID NO: 223149

SEQ ID NO: 681102 - RNA, 64 nt, hsa; identical to SEQ ID NO: 223150

SEQ ID NO: 681103 - RNA, 64 nt, hsa; identical to SEQ ID NO: 223151

SEQ ID NO: 681104 - RNA, 64 nt, hsa; identical to SEQ ID NO: 223152

SEQ ID NO: 681105 - RNA, 64 nt, hsa; identical to SEQ ID NO: 223153

SEQ ID NO: 681106 - RNA, 64 nt, hsa; identical to SEQ ID NO: 223154

SEQ ID NO: 681107 - RNA, 64 nt, hsa; identical to SEQ ID NO: 223155

SEQ ID NO: 681108 - RNA, 64 nt, hsa; identical to SEQ ID NO: 223156

SEQ ID NO: 681109 - RNA, 64 nt, hsa; identical to SEQ ID NO: 223157

SEQ ID NO: 681110 - RNA, 64 nt, hsa; identical to SEQ ID NO: 223158

SEQ ID NO: 681111 - RNA, 64 nt, hsa; identical to SEQ ID NO: 223159

SEQ ID NO: 681112 - RNA, 64 nt, hsa; identical to SEQ ID NO: 223160

SEQ ID NO: 681113 - RNA, 64 nt, hsa; identical to SEQ ID NO: 223161

SEQ ID NO: 681114 - RNA, 64 nt, hsa; identical to SEQ ID NO: 223162

SEQ ID NO: 681115 - RNA, 64 nt, hsa; identical to SEQ ID NO: 223163

SEQ ID NO: 681116 - RNA, 64 nt, hsa; identical to SEQ ID NO: 223164

SEQ ID NO: 681117 - RNA, 64 nt, hsa; identical to SEQ ID NO: 223165

SEQ ID NO: 681118 - RNA, 64 nt, hsa; identical to SEQ ID NO: 223166

SEQ ID NO: 681119 - RNA, 64 nt, hsa; identical to SEQ ID NO: 223167

SEQ ID NO: 681120 - RNA, 64 nt, hsa; identical to SEQ ID NO: 223168

SEQ ID NO: 681121 - RNA, 64 nt, hsa; identical to SEQ ID NO: 223169

SEQ ID NO: 681122 - RNA, 64 nt, hsa; identical to SEQ ID NO: 223170

SEQ ID NO: 681123 - RNA, 64 nt, hsa; identical to SEQ ID NO: 223171

SEQ ID NO: 681124 - RNA, 64 nt, hsa; identical to SEQ ID NO: 223172

SEQ ID NO: 681125 - RNA, 64 nt, hsa; identical to SEQ ID NO: 223173

SEQ ID NO: 681126 - RNA, 64 nt, hsa; identical to SEQ ID NO: 223174

SEQ ID NO: 681127 - RNA, 64 nt, hsa; identical to SEQ ID NO: 223175

SEQ ID NO: 681128 - RNA, 64 nt, hsa; identical to SEQ ID NO: 223176

SEQ ID NO: 681129 - RNA, 64 nt, hsa; identical to SEQ ID NO: 223177

SEQ ID NO: 681130 - RNA, 64 nt, hsa; identical to SEQ ID NO: 223178

SEQ ID NO: 681131 - RNA, 64 nt, hsa; identical to SEQ ID NO: 223179

SEQ ID NO: 681132 - RNA, 64 nt, hsa; identical to SEQ ID NO: 223180

SEQ ID NO: 681133 - RNA, 64 nt, hsa; identical to SEQ ID NO: 223181

SEQ ID NO: 681134 - RNA, 64 nt, hsa; identical to SEQ ID NO: 223182

SEQ ID NO: 681135 - RNA, 64 nt, hsa; identical to SEQ ID NO: 223183

SEQ ID NO: 681136 - RNA, 64 nt, hsa; identical to SEQ ID NO: 223184

SEQ ID NO: 681137 - RNA, 64 nt, hsa; identical to SEQ ID NO: 223185

SEQ ID NO: 681138 - RNA, 64 nt, hsa; identical to SEQ ID NO: 223186

SEQ ID NO: 681139 - RNA, 64 nt, hsa; identical to SEQ ID NO: 223187

SEQ ID NO: 681140 - RNA, 64 nt, hsa; identical to SEQ ID NO: 223188

SEQ ID NO: 681141 - RNA, 64 nt, hsa; identical to SEQ ID NO: 223189

SEQ ID NO: 681142 - RNA, 64 nt, hsa; identical to SEQ ID NO: 223190

SEQ ID NO: 681143 - RNA, 64 nt, hsa; identical to SEQ ID NO: 223191

SEQ ID NO: 681144 - RNA, 64 nt, hsa; identical to SEQ ID NO: 223192

SEQ ID NO: 681145 - RNA, 64 nt, hsa; identical to SEQ ID NO: 223193

SEQ ID NO: 681146 - RNA, 64 nt, hsa; identical to SEQ ID NO: 223194

SEQ ID NO: 681147 - RNA, 64 nt, hsa; identical to SEQ ID NO: 223195

SEQ ID NO: 681148 - RNA, 57 nt, hsa; identical to SEQ ID NO: 223196

SEQ ID NO: 681149 - RNA, 64 nt, hsa; identical to SEQ ID NO: 223197

SEQ ID NO: 681150 - RNA, 54 nt, hsa; identical to SEQ ID NO: 223198

SEQ ID NO: 681151 - RNA, 64 nt, hsa
aagugcugcucugcucugcccacccuggguucugcauuccuaugggugacccaauuauucagac

SEQ ID NO: 681152 - RNA, 64 nt, hsa
cuauauuuuugucuucuuccuuuccccucuuugccauuccuaccuugcauuuuuccugucagug

SEQ ID NO: 681153 - RNA, 64 nt, hsa
cucuguuagucauuauguuggguaauagccguggcauuccuacagaacagagugaggacaggcu

SEQ ID NO: 681154 - RNA, 64 nt, hsa
aaucacggguaaggaggauuaggaaugaguauuccauuccuaggugucaucagaugaccuugac

SEQ ID NO: 681155 - RNA, 64 nt, hsa
cgagaguaucacagccaggaugacccuugggucccauuccuaagacaugguuacuuuauuuucc

SEQ ID NO: 681156 - RNA, 64 nt, hsa
aggguggggcacccuuuucucgccgcaagaagcccauuccuauggaagucuagcaaagcaauac

SEQ ID NO: 681157 - RNA, 64 nt, hsa
cuccccauuccuacaauuucuauguggcccaagucauuccuaaucuuggucucuauagcagugu

SEQ ID NO: 681158 - RNA, 64 nt, hsa
ccagugggucugguggugcuggucuuuuccuccccauuccuacaauuucuauguggcccaaguc

SEQ ID NO: 681159 - RNA, 64 nt, hsa; identical to SEQ ID NO: 197404

SEQ ID NO: 681160 - RNA, 64 nt, hsa; identical to SEQ ID NO: 197405

SEQ ID NO: 681161 - RNA, 64 nt, hsa; identical to SEQ ID NO: 197469

SEQ ID NO: 681162 - RNA, 64 nt, hsa; identical to SEQ ID NO: 197470

SEQ ID NO: 681163 - RNA, 64 nt, hsa; identical to SEQ ID NO: 197517

SEQ ID NO: 681164 - RNA, 64 nt, hsa; identical to SEQ ID NO: 197518

SEQ ID NO: 681165 - RNA, 64 nt, hsa; identical to SEQ ID NO: 197519

SEQ ID NO: 681166 - RNA, 64 nt, hsa; identical to SEQ ID NO: 197520

SEQ ID NO: 681167 - RNA, 64 nt, hsa; identical to SEQ ID NO: 197521

SEQ ID NO: 681168 - RNA, 64 nt, hsa; identical to SEQ ID NO: 197543

SEQ ID NO: 681169 - RNA, 64 nt, hsa; identical to SEQ ID NO: 197544

SEQ ID NO: 681170 - RNA, 64 nt, hsa; identical to SEQ ID NO: 54817

SEQ ID NO: 681171 - RNA, 64 nt, hsa; identical to SEQ ID NO: 54818

SEQ ID NO: 681172 - RNA, 64 nt, hsa; identical to SEQ ID NO: 54819

SEQ ID NO: 681173 - RNA, 64 nt, hsa; identical to SEQ ID NO: 54820

SEQ ID NO: 681174 - RNA, 64 nt, hsa; identical to SEQ ID NO: 54821

SEQ ID NO: 681175 - RNA, 64 nt, hsa; identical to SEQ ID NO: 54822

SEQ ID NO: 681176 - RNA, 64 nt, hsa; identical to SEQ ID NO: 54823

SEQ ID NO: 681177 - RNA, 64 nt, hsa; identical to SEQ ID NO: 54824

SEQ ID NO: 681178 - RNA, 64 nt, hsa; identical to SEQ ID NO: 54825

SEQ ID NO: 681179 - RNA, 64 nt, hsa; identical to SEQ ID NO: 54826

SEQ ID NO: 681180 - RNA, 64 nt, hsa; identical to SEQ ID NO: 54827

SEQ ID NO: 681181 - RNA, 64 nt, hsa; identical to SEQ ID NO: 54828

SEQ ID NO: 681182 - RNA, 64 nt, hsa; identical to SEQ ID NO: 54829

SEQ ID NO: 681183 - RNA, 64 nt, hsa; identical to SEQ ID NO: 54830

SEQ ID NO: 681184 - RNA, 64 nt, hsa; identical to SEQ ID NO: 54831

SEQ ID NO: 681185 - RNA, 64 nt, hsa; identical to SEQ ID NO: 54832

SEQ ID NO: 681186 - RNA, 64 nt, hsa; identical to SEQ ID NO: 54833

SEQ ID NO: 681187 - RNA, 64 nt, hsa; identical to SEQ ID NO: 54834

SEQ ID NO: 681188 - RNA, 64 nt, hsa; identical to SEQ ID NO: 54835

SEQ ID NO: 681189 - RNA, 64 nt, hsa; identical to SEQ ID NO: 54836

SEQ ID NO: 681190 - RNA, 64 nt, hsa; identical to SEQ ID NO: 54837

SEQ ID NO: 681191 - RNA, 64 nt, hsa; identical to SEQ ID NO: 54838

SEQ ID NO: 681192 - RNA, 64 nt, hsa; identical to SEQ ID NO: 54839

SEQ ID NO: 681193 - RNA, 64 nt, hsa; identical to SEQ ID NO: 54840

SEQ ID NO: 681194 - RNA, 64 nt, hsa; identical to SEQ ID NO: 54841

SEQ ID NO: 681195 - RNA, 64 nt, hsa; identical to SEQ ID NO: 54842

SEQ ID NO: 681196 - RNA, 64 nt, hsa; identical to SEQ ID NO: 54843

SEQ ID NO: 681197 - RNA, 64 nt, hsa; identical to SEQ ID NO: 54844

SEQ ID NO: 681198 - RNA, 64 nt, hsa; identical to SEQ ID NO: 54845

SEQ ID NO: 681199 - RNA, 64 nt, hsa; identical to SEQ ID NO: 54846

SEQ ID NO: 681200 - RNA, 64 nt, hsa; identical to SEQ ID NO: 54847

SEQ ID NO: 681201 - RNA, 64 nt, hsa; identical to SEQ ID NO: 54848

SEQ ID NO: 681202 - RNA, 64 nt, hsa; identical to SEQ ID NO: 54849

SEQ ID NO: 681203 - RNA, 64 nt, hsa; identical to SEQ ID NO: 54850

SEQ ID NO: 681204 - RNA, 64 nt, hsa; identical to SEQ ID NO: 54851

SEQ ID NO: 681205 - RNA, 64 nt, hsa; identical to SEQ ID NO: 54852

SEQ ID NO: 681206 - RNA, 64 nt, hsa; identical to SEQ ID NO: 54853

SEQ ID NO: 681207 - RNA, 64 nt, hsa; identical to SEQ ID NO: 54854

SEQ ID NO: 681208 - RNA, 64 nt, hsa; identical to SEQ ID NO: 54855

SEQ ID NO: 681209 - RNA, 64 nt, hsa; identical to SEQ ID NO: 54856

SEQ ID NO: 681210 - RNA, 64 nt, hsa; identical to SEQ ID NO: 54857

SEQ ID NO: 681211 - RNA, 64 nt, hsa; identical to SEQ ID NO: 54858

SEQ ID NO: 681212 - RNA, 64 nt, hsa; identical to SEQ ID NO: 54859

SEQ ID NO: 681213 - RNA, 64 nt, hsa; identical to SEQ ID NO: 54860

SEQ ID NO: 681214 - RNA, 64 nt, hsa; identical to SEQ ID NO: 54861

SEQ ID NO: 681215 - RNA, 64 nt, hsa; identical to SEQ ID NO: 54862

SEQ ID NO: 681216 - RNA, 64 nt, hsa; identical to SEQ ID NO: 54863

SEQ ID NO: 681217 - RNA, 64 nt, hsa; identical to SEQ ID NO: 54864

SEQ ID NO: 681218 - RNA, 64 nt, hsa; identical to SEQ ID NO: 54865

SEQ ID NO: 681219 - RNA, 64 nt, hsa; identical to SEQ ID NO: 54866

SEQ ID NO: 681220 - RNA, 64 nt, hsa; identical to SEQ ID NO: 54867

SEQ ID NO: 681221 - RNA, 64 nt, hsa; identical to SEQ ID NO: 54868

SEQ ID NO: 681222 - RNA, 64 nt, hsa; identical to SEQ ID NO: 54869

SEQ ID NO: 681223 - RNA, 64 nt, hsa; identical to SEQ ID NO: 54870

SEQ ID NO: 681224 - RNA, 64 nt, hsa; identical to SEQ ID NO: 54871

SEQ ID NO: 681225 - RNA, 64 nt, hsa; identical to SEQ ID NO: 54872

SEQ ID NO: 681226 - RNA, 64 nt, hsa; identical to SEQ ID NO: 54870

SEQ ID NO: 681227 - RNA, 64 nt, hsa; identical to SEQ ID NO: 54871

SEQ ID NO: 681228 - RNA, 64 nt, hsa; identical to SEQ ID NO: 54872

SEQ ID NO: 681229 - RNA, 64 nt, hsa; identical to SEQ ID NO: 54870

SEQ ID NO: 681230 - RNA, 64 nt, hsa; identical to SEQ ID NO: 54877

SEQ ID NO: 681231 - RNA, 64 nt, hsa; identical to SEQ ID NO: 54878

SEQ ID NO: 681232 - RNA, 64 nt, hsa; identical to SEQ ID NO: 54879

SEQ ID NO: 681233 - RNA, 64 nt, hsa; identical to SEQ ID NO: 54880

SEQ ID NO: 681234 - RNA, 64 nt, hsa; identical to SEQ ID NO: 54881

SEQ ID NO: 681235 - RNA, 64 nt, hsa; identical to SEQ ID NO: 54882

SEQ ID NO: 681236 - RNA, 64 nt, hsa; identical to SEQ ID NO: 54883

SEQ ID NO: 681237 - RNA, 64 nt, hsa; identical to SEQ ID NO: 54884

SEQ ID NO: 681238 - RNA, 64 nt, hsa; identical to SEQ ID NO: 54885

SEQ ID NO: 681239 - RNA, 64 nt, hsa; identical to SEQ ID NO: 54886

SEQ ID NO: 681240 - RNA, 64 nt, hsa; identical to SEQ ID NO: 54887

SEQ ID NO: 681241 - RNA, 64 nt, hsa; identical to SEQ ID NO: 54888

SEQ ID NO: 681242 - RNA, 64 nt, hsa; identical to SEQ ID NO: 54889

SEQ ID NO: 681243 - RNA, 64 nt, hsa; identical to SEQ ID NO: 54890

SEQ ID NO: 681244 - RNA, 64 nt, hsa; identical to SEQ ID NO: 54891

SEQ ID NO: 681245 - RNA, 64 nt, hsa; identical to SEQ ID NO: 54892

SEQ ID NO: 681246 - RNA, 64 nt, hsa; identical to SEQ ID NO: 54893

SEQ ID NO: 681247 - RNA, 64 nt, hsa; identical to SEQ ID NO: 54894

SEQ ID NO: 681248 - RNA, 64 nt, hsa; identical to SEQ ID NO: 54895

SEQ ID NO: 681249 - RNA, 64 nt, hsa; identical to SEQ ID NO: 54896

SEQ ID NO: 681250 - RNA, 64 nt, hsa
gcaaucucuggauaccuucaaauccuagcucucacugugggauucuugaucucagagguguuua

SEQ ID NO: 681251 - RNA, 64 nt, hsa
ggguuuaauaacaugaguccccaagcuccucuggcugugggaccacagaugagucuuucagagg

SEQ ID NO: 681252 - RNA, 64 nt, hsa
cuuacuuccuuauuuaucugcaaaaggauggaaacugugggagucaaagccuauuuugcugagu

SEQ ID NO: 681253 - RNA, 64 nt, hsa
cauggauugcccaacuuuccaaaucuggauaaagcugugggauucuuggaagcagcuugagugu

SEQ ID NO: 681254 - RNA, 64 nt, hsa
agaaaccucuugccuccagauuuggguggagccucugugggaaccauaggaagugugugggcug

SEQ ID NO: 681255 - RNA, 64 nt, hsa
aguucugguggggucacccucccuguccucccgccugugggagggagggagggcuggcucaggc

SEQ ID NO: 681256 - RNA, 64 nt, hsa
aaauaggccuggacuauuuaaggagugagugucacugugggaagaauaagagggggacugucuu

SEQ ID NO: 681257 - RNA, 64 nt, hsa
gagacaauuacuugcaugggguaacccaguaauacugugggaugcaacuucuagggcauggcug

SEQ ID NO: 681258 - RNA, 64 nt, hsa
agcaagcugcccagcccuggcccaggugccccgacugugggacucaguuguucugagcacauuu

SEQ ID NO: 681259 - RNA, 64 nt, hsa
gcucuggcucugccucaggaggucaccugccgcccugugggagccgcagagccugacgcucagc

SEQ ID NO: 681260 - RNA, 64 nt, hsa
ccuuuggugacuucacagugaagucuugcccucucugugggauaucacaucagugguuccaaga

SEQ ID NO: 681261 - RNA, 64 nt, hsa
uuaaauacauuccaugcccuccccagaaaauagucugugggagucaguugccuuggugccaggu

SEQ ID NO: 681262 - RNA, 64 nt, hsa
cuucacuucagccuuucagucccucucucucugccugugggaaucuggacacauuuugggaggc

SEQ ID NO: 681263 - RNA, 64 nt, hsa
ggaaucuggacacauuuugggaggccucccaaggcugugggacgugcuugcucuggcagcugca

SEQ ID NO: 681264 - RNA, 64 nt, hsa
auaauaauuucugauuauaaaucauugcuuuuaacugugggacuuaguuaauucuucaaaagau

SEQ ID NO: 681265 - RNA, 64 nt, hsa
caacuauugauugcauucaaacguacaauuguaucugugggaagagaauagacucuauuuucuc

SEQ ID NO: 681266 - RNA, 64 nt, hsa
auucccaagcuucaggauguguucccucuuccagcugugggaccgcugucccuuauuucaaccc

SEQ ID NO: 681267 - RNA, 64 nt, hsa
ggaagaguucuucccuuagcccugacuuuacuugcugugggaagagagaugagggucagauagg

SEQ ID NO: 681268 - RNA, 64 nt, hsa
aaaagacauuuacaacuaggccagggauuagccacugugggaggguggacaggcaaugguucag

SEQ ID NO: 681269 - RNA, 64 nt, hsa
uuggugagcuguguauuuccuaggagguagaaaacugugggaaacuguggcuaauaaaaacuaa

SEQ ID NO: 681270 - RNA, 64 nt, hsa
gugagacuuaucagaugggacgcuugccccaagacugugggauaaaccaccauugcuaguccuc

SEQ ID NO: 681271 - RNA, 64 nt, hsa
cugggugcaguaguuuacgccuguaaucccagcacugugggaggccgaggcggauggaucaccu

SEQ ID NO: 681272 - RNA, 64 nt, hsa
cauguggagacacuccuauaaggagaguucaagccugugggaguagaaaaaucucauucccaga

SEQ ID NO: 681273 - RNA, 64 nt, hsa
caucugcuugguuggcuggcagcugagagcccugcugugggagagcgaagggggucaaaggaag

SEQ ID NO: 681274 - RNA, 64 nt, hsa
cccugcugucaugaaggggccaggcauuggucaccugugggaccuucucccucacuccccuccc

SEQ ID NO: 681275 - RNA, 64 nt, hsa
gaaagucccugccuuccacaccucucucuagucccugugggacagcccuagccccugcugucau

SEQ ID NO: 681276 - RNA, 64 nt, hsa
cccuuucccucgacgacagucgagggcucgggcucugugggacugugggagcuagggucugcgg

SEQ ID NO: 681277 - RNA, 64 nt, hsa
cucgacgacagucgagggcucgggcucugugggacugugggagcuagggucugcggggcgccug

SEQ ID NO: 681278 - RNA, 64 nt, hsa
cauguugugcuuuuguagagagaugauuauuguacugugggaggucaggaaguucgagauuccu

SEQ ID NO: 681279 - RNA, 64 nt, hsa
ccuuuuaaguuuccaucaguguccucgggucagacugugggaaugcuguacuucuaagacaaag

SEQ ID NO: 681280 - RNA, 64 nt, hsa
cagagcuccuugcagugccuucuuccuuguuuaccugugggaggaaacacuuuuuuugucaggg

SEQ ID NO: 681281 - RNA, 64 nt, hsa
ugcauucuagaaaguagaagauguaauaaauguacugugggacauguuaauaagugcuauaaag

SEQ ID NO: 681282 - RNA, 64 nt, hsa
gacgggccccuguuugccaucucggggguguucccugugggagggugagugggugaggccgagc

SEQ ID NO: 681283 - RNA, 64 nt, hsa
cucccagaaggaccccaggcccuggggaggguggcugugggaggccaaguccacugcccggaag

SEQ ID NO: 681284 - RNA, 64 nt, hsa
cucucaugcacaaccagcccuuccacgugccugccugugggacaggagggggagcgugggaugc

SEQ ID NO: 681285 - RNA, 64 nt, hsa
gaguccacguaacugaccuguacuccacgaggcccugugggaacgguccaggcugguccugccc

SEQ ID NO: 681286 - RNA, 64 nt, hsa
auggaaagggaagggaauuuccccccaccaugggcugugggagaguugaccguauucugggcaa

SEQ ID NO: 681287 - RNA, 64 nt, hsa
cugcgauggacgugaggacguguccagcucugcucugugggaaggaguuggaauguucgacagc

SEQ ID NO: 681288 - RNA, 64 nt, hsa
ccaaaauccaggcugggaacaugcuaggcaccgccugugggaccccuggauaugugggugaggg

SEQ ID NO: 681289 - RNA, 64 nt, hsa
cuggccauggaacugugaggagggccugggcaggcugugggagccggggagggacugagcagug

SEQ ID NO: 681290 - RNA, 59 nt, hsa; identical to SEQ ID NO: 76155

SEQ ID NO: 681291 - RNA, 64 nt, hsa; identical to SEQ ID NO: 76156

SEQ ID NO: 681292 - RNA, 64 nt, hsa; identical to SEQ ID NO: 76157

SEQ ID NO: 681293 - RNA, 64 nt, hsa; identical to SEQ ID NO: 76158

SEQ ID NO: 681294 - RNA, 64 nt, hsa; identical to SEQ ID NO: 76159

SEQ ID NO: 681295 - RNA, 64 nt, hsa; identical to SEQ ID NO: 76160

SEQ ID NO: 681296 - RNA, 64 nt, hsa; identical to SEQ ID NO: 76161

SEQ ID NO: 681297 - RNA, 64 nt, hsa; identical to SEQ ID NO: 76162

SEQ ID NO: 681298 - RNA, 64 nt, hsa; identical to SEQ ID NO: 76163

SEQ ID NO: 681299 - RNA, 64 nt, hsa; identical to SEQ ID NO: 76164

SEQ ID NO: 681300 - RNA, 64 nt, hsa; identical to SEQ ID NO: 76165

SEQ ID NO: 681301 - RNA, 64 nt, hsa; identical to SEQ ID NO: 76166

SEQ ID NO: 681302 - RNA, 64 nt, hsa; identical to SEQ ID NO: 76167

SEQ ID NO: 681303 - RNA, 64 nt, hsa; identical to SEQ ID NO: 76168

SEQ ID NO: 681304 - RNA, 64 nt, hsa; identical to SEQ ID NO: 76169

SEQ ID NO: 681305 - RNA, 58 nt, hsa; identical to SEQ ID NO: 76170

SEQ ID NO: 681306 - RNA, 64 nt, hsa; identical to SEQ ID NO: 76171

SEQ ID NO: 681307 - RNA, 64 nt, hsa; identical to SEQ ID NO: 76172

SEQ ID NO: 681308 - RNA, 64 nt, hsa; identical to SEQ ID NO: 76173

SEQ ID NO: 681309 - RNA, 64 nt, hsa; identical to SEQ ID NO: 76174

SEQ ID NO: 681310 - RNA, 64 nt, hsa; identical to SEQ ID NO: 76175

SEQ ID NO: 681311 - RNA, 52 nt, hsa; identical to SEQ ID NO: 76176

SEQ ID NO: 681312 - RNA, 64 nt, hsa; identical to SEQ ID NO: 76177

SEQ ID NO: 681313 - RNA, 64 nt, hsa; identical to SEQ ID NO: 76178

SEQ ID NO: 681314 - RNA, 64 nt, hsa; identical to SEQ ID NO: 76179

SEQ ID NO: 681315 - RNA, 64 nt, hsa; identical to SEQ ID NO: 76180

SEQ ID NO: 681316 - RNA, 64 nt, hsa; identical to SEQ ID NO: 76181

SEQ ID NO: 681317 - RNA, 64 nt, hsa; identical to SEQ ID NO: 76182

SEQ ID NO: 681318 - RNA, 64 nt, hsa; identical to SEQ ID NO: 76183

SEQ ID NO: 681319 - RNA, 64 nt, hsa; identical to SEQ ID NO: 76184

SEQ ID NO: 681320 - RNA, 64 nt, hsa; identical to SEQ ID NO: 76185

SEQ ID NO: 681321 - RNA, 64 nt, hsa; identical to SEQ ID NO: 76186

SEQ ID NO: 681322 - RNA, 64 nt, hsa; identical to SEQ ID NO: 76187

SEQ ID NO: 681323 - RNA, 64 nt, hsa; identical to SEQ ID NO: 76188

SEQ ID NO: 681324 - RNA, 64 nt, hsa; identical to SEQ ID NO: 76189

SEQ ID NO: 681325 - RNA, 64 nt, hsa; identical to SEQ ID NO: 76190

SEQ ID NO: 681326 - RNA, 64 nt, hsa; identical to SEQ ID NO: 76191

SEQ ID NO: 681327 - RNA, 64 nt, hsa; identical to SEQ ID NO: 76192

SEQ ID NO: 681328 - RNA, 64 nt, hsa; identical to SEQ ID NO: 76193

SEQ ID NO: 681329 - RNA, 64 nt, hsa; identical to SEQ ID NO: 76194

SEQ ID NO: 681330 - RNA, 64 nt, hsa; identical to SEQ ID NO: 76195

SEQ ID NO: 681331 - RNA, 64 nt, hsa; identical to SEQ ID NO: 76196

SEQ ID NO: 681332 - RNA, 64 nt, hsa; identical to SEQ ID NO: 76197

SEQ ID NO: 681333 - RNA, 64 nt, hsa; identical to SEQ ID NO: 76198

SEQ ID NO: 681334 - RNA, 64 nt, hsa; identical to SEQ ID NO: 76199

SEQ ID NO: 681335 - RNA, 64 nt, hsa; identical to SEQ ID NO: 76200

SEQ ID NO: 681336 - RNA, 64 nt, hsa; identical to SEQ ID NO: 76201

SEQ ID NO: 681337 - RNA, 64 nt, hsa; identical to SEQ ID NO: 76202

SEQ ID NO: 681338 - RNA, 64 nt, hsa; identical to SEQ ID NO: 76203

SEQ ID NO: 681339 - RNA, 64 nt, hsa; identical to SEQ ID NO: 76204

SEQ ID NO: 681340 - RNA, 64 nt, hsa; identical to SEQ ID NO: 76205

SEQ ID NO: 681341 - RNA, 64 nt, hsa; identical to SEQ ID NO: 76206

SEQ ID NO: 681342 - RNA, 64 nt, hsa; identical to SEQ ID NO: 76207

SEQ ID NO: 681343 - RNA, 64 nt, hsa; identical to SEQ ID NO: 76208

SEQ ID NO: 681344 - RNA, 64 nt, hsa; identical to SEQ ID NO: 76209

SEQ ID NO: 681345 - RNA, 64 nt, hsa; identical to SEQ ID NO: 76210

SEQ ID NO: 681346 - RNA, 64 nt, hsa; identical to SEQ ID NO: 76211

SEQ ID NO: 681347 - RNA, 64 nt, hsa; identical to SEQ ID NO: 76212

SEQ ID NO: 681348 - RNA, 64 nt, hsa; identical to SEQ ID NO: 76213

SEQ ID NO: 681349 - RNA, 64 nt, hsa; identical to SEQ ID NO: 76214

SEQ ID NO: 681350 - RNA, 64 nt, hsa; identical to SEQ ID NO: 76215

SEQ ID NO: 681351 - RNA, 64 nt, hsa; identical to SEQ ID NO: 76216

SEQ ID NO: 681352 - RNA, 64 nt, hsa; identical to SEQ ID NO: 76217

SEQ ID NO: 681353 - RNA, 64 nt, hsa; identical to SEQ ID NO: 76218

SEQ ID NO: 681354 - RNA, 64 nt, hsa; identical to SEQ ID NO: 76219

SEQ ID NO: 681355 - RNA, 64 nt, hsa; identical to SEQ ID NO: 76220

SEQ ID NO: 681356 - RNA, 64 nt, hsa; identical to SEQ ID NO: 76221

SEQ ID NO: 681357 - RNA, 64 nt, hsa; identical to SEQ ID NO: 76222

SEQ ID NO: 681358 - RNA, 64 nt, hsa; identical to SEQ ID NO: 76223

SEQ ID NO: 681359 - RNA, 64 nt, hsa; identical to SEQ ID NO: 76224

SEQ ID NO: 681360 - RNA, 64 nt, hsa; identical to SEQ ID NO: 76225

SEQ ID NO: 681361 - RNA, 64 nt, hsa
cugacugcuggcuggcgaggaggcugcgagcguggaaucggaagcgaccgcgggcuuuuuugcc

SEQ ID NO: 681362 - RNA, 64 nt, hsa
ucauucauggaccaguagauuguugaaaguuggugaaucggauuauaagcuucuagcuaacaca

SEQ ID NO: 681363 - RNA, 64 nt, hsa
ggaaguuggugcugcuaagaccgagaaauuuaaagaaucggacagauggacgcagagaaccaga

SEQ ID NO: 681364 - RNA, 64 nt, hsa
cccaguuuguuggaguaggacaguaacauggcaggaaucggacuucugggccuguaaucccagu

SEQ ID NO: 681365 - RNA, 64 nt, hsa
aaccacaaguuaucuggccuuuuagaucuuuuuggaaucggaccugguugaguaaggaccucuu

SEQ ID NO: 681366 - RNA, 64 nt, hsa
auagagcuuuucugcauccuacuccagauacacugaaucggaaucccuagggcuagagccuaga

SEQ ID NO: 681367 - RNA, 64 nt, hsa
gaguuggugcagcuccaggucauuccuggggugggaaucggaucaucccugacucagcuuuuac

SEQ ID NO: 681368 - RNA, 64 nt, hsa
cuucugccaaacaauaauaaagccaacuggaaacgaaucggagccauuuucauuuuccuaaccg

SEQ ID NO: 681369 - RNA, 64 nt, hsa
gagauuucaagcgucaagugggggaguauuuggugaaucggaaaagccuuagaaaauugccugu

SEQ ID NO: 681370 - RNA, 64 nt, hsa
cuccuguugcccucacaagagcaucagccuucuagaaucggagcuccggagugugaagauucag

SEQ ID NO: 681371 - RNA, 64 nt, hsa
cccaugcaugagagacucuccuccuuuccagagagaaucggaucgcaccacguguggcagccug

SEQ ID NO: 681372 - RNA, 64 nt, hsa
aaugcucaggcagaacgggguacauccacaggaggaaucggacgagaggaugugacauucgguc

SEQ ID NO: 681373 - RNA, 64 nt, hsa
gauuagggagguagaaucaauaagacucagugaagaaucggauguggggguaagggcacaugug

SEQ ID NO: 681374 - RNA, 64 nt, hsa
gaaguguguugcagaaccgacgcuuacugugcgagaaucggagggcgcgcacgcggaucccccg

SEQ ID NO: 681375 - RNA, 64 nt, hsa
ucccccacuuggagaguuugaggaauggaaaugagaaucggaggagaaauaaggccagaggcuc

SEQ ID NO: 681376 - RNA, 64 nt, hsa
guggcugcuuucuuuuggugacccuccagggguggaaucggagugugucugcccgcccuuguga

SEQ ID NO: 681377 - RNA, 64 nt, hsa
ugugccuuccaaaucaugccauaauuguaauguugaaucggacagagccuuacgugcccgaggg

SEQ ID NO: 681378 - RNA, 64 nt, hsa
aagacuguuggacagugguguguauugaggggaugaaucggaacgauagucucaugcagaaaau

SEQ ID NO: 681379 - RNA, 64 nt, hsa
gcucugacauucugauucgaaugacacuguucaggaaucggaauccugucgauuagacuggaca

SEQ ID NO: 681380 - RNA, 64 nt, hsa
aggaggcugaggcaggagaauagccugaaccugggaaucggagguugcagagccaagaucgccc

SEQ ID NO: 681381 - RNA, 64 nt, hsa
auaguagauauauuuuauuaauaaaaugguucaugaaucggagacuaacaaaguuuucaugugc

SEQ ID NO: 681382 - RNA, 64 nt, hsa
ccaugcaucugugaucaaugaacuaugugguuuugaaucggauguagaccauuaguacuacuac

SEQ ID NO: 681383 - RNA, 64 nt, hsa
aaaccgcauacacguucaccgagaaagggagagggaaucggagggagcagcggaaugcggcgaa

SEQ ID NO: 681384 - RNA, 64 nt, hsa
gugccacagcugugcugaggaggccggggacugggaaucggagugggcaccucuguguuucucu

SEQ ID NO: 681385 - RNA, 64 nt, hsa
gagacagugaaaaauagaugaacuaagagaaaaagaaucggauggucuuuguaacugauucugg

SEQ ID NO: 681386 - RNA, 64 nt, hsa
cuccacagcggaggagaccagcucagaggcccaggaaucggagcgaagcagagagguggagaac

SEQ ID NO: 681387 - RNA, 64 nt, hsa
auuaguucauuuccaaucccagaacacauggagggaaucggacaggugaugccagcaguuccug

SEQ ID NO: 681388 - RNA, 64 nt, hsa
uucggcaaagcagccugaguuauuuuuguggacggaaucggaacacgcuggcuccauaucguga

SEQ ID NO: 681389 - RNA, 64 nt, hsa
aaugcaaauucucaagccgcaucccagacuugcugaaucggaaucucuggggguugggacccag

SEQ ID NO: 681390 - RNA, 64 nt, hsa
aaauguuguccuguacuuacuaggcaaaacguaugaaucggauuaacuggaaaauauaucugaa

SEQ ID NO: 681391 - RNA, 64 nt, hsa
uaaugcuuugaauuccuugggggugcaguagaaagaaucggaaucugugccguauugauaagga

SEQ ID NO: 681392 - RNA, 64 nt, hsa
caaggcgcagccagcuccucccgaacucaacucggaaucggaagacuacuccccaagcuccucc

SEQ ID NO: 681393 - RNA, 64 nt, hsa
gaacugcuccucuguguguacuucauagaagguggaaucggacagaggcagguuagugacaguu

SEQ ID NO: 681394 - RNA, 64 nt, hsa
cugcuccccugcgaccgcccugccccccgucaccgaaucggacacucauccuuucucacacuuc

SEQ ID NO: 681395 - RNA, 64 nt, hsa
ccccuuacugggggaggguccuugcaauuccagcgaaucggaggccaggccaggacguccuugc

SEQ ID NO: 681396 - RNA, 64 nt, hsa
caugcuggauaggaccugggaugcugcuggagcugaaucggaugccaccaaggcucgguccagc

SEQ ID NO: 681397 - RNA, 64 nt, hsa
agcggccucuaagagcugagagacagccggcagggaaucggaacccucagacccacagccgcaa

SEQ ID NO: 681398 - RNA, 64 nt, hsa
agagggccaucccuaagccuccgcgccaggcccugaaucggaaaaagggcagcccuggccuugc

SEQ ID NO: 681399 - RNA, 64 nt, hsa
uuuucacucgcuucguccuagauaguuuaaaugggaaucggauccccugguugagagcuaagac

SEQ ID NO: 681400 - RNA, 64 nt, hsa
ggcacuacugcccggccaguccaggcucaggcaggaaucggacgcuggggcccgggcucugcac

SEQ ID NO: 681401 - RNA, 64 nt, hsa
uccucuuuuuguaggcagaacaguaucaaaagaagaaucggaagaugcuugugauuuuaauauu

SEQ ID NO: 681402 - RNA, 64 nt, hsa
cgagguggccgaggcaggucaaagcugaaaaguggaaucggagcuguuguauugccugggguga

SEQ ID NO: 681403 - RNA, 64 nt, hsa
agaaugaacgugggcccucgggugggaagacuaggaaucggaagcuucuagggcuucacauccc

SEQ ID NO: 681404 - RNA, 63 nt, hsa
auagaaucauccauucccaucgccgcacccccuaccccccaaacacacacacacacacacaca

SEQ ID NO: 681405 - RNA, 63 nt, hsa
ucgucuugacuguuuucccuacuugcugacuuaaccccccauagugugggggaccugcagaga

SEQ ID NO: 681406 - RNA, 63 nt, hsa
cuuccuuuuuaucauaacgcggccucuaauuccaccccccaagugaaacgguuugagagacgc

SEQ ID NO: 681407 - RNA, 63 nt, hsa
cuauccccuuccucauccauguaagguuaacccaccccccagcaagggacuggacgcccucau

SEQ ID NO: 681408 - RNA, 63 nt, hsa
ccugaggcuguggccuccaaagggucugggcgcaccccccaggucgcaggugucugaggccag

SEQ ID NO: 681409 - RNA, 63 nt, hsa
cccucuccugccagacagcccacgaccgggucgaccccccaggggacgcccaugccaggcccg

SEQ ID NO: 681410 - RNA, 63 nt, hsa
cuuaggacuuggcccuguuaugagcugacccccaccccccaccccccaccccccccccccgcc

SEQ ID NO: 681411 - RNA, 63 nt, hsa
cuuggcccuguuaugagcugacccccaccccccaccccccaccccccccccccgccaacuccu

SEQ ID NO: 681412 - RNA, 63 nt, hsa
ucaucugugguccaggccggcaucguccuggccaccccccagaucuggugccugcuggccggc

SEQ ID NO: 681413 - RNA, 63 nt, hsa
gucguccaccccaggacgagccaucagggacagaccccccacccccaaggcugcagccacacc

SEQ ID NO: 681414 - RNA, 63 nt, hsa
gcucgggguuuuuuauuuauaaaaccucuccccaccccccaccccccaacuuccuggguuuuc

SEQ ID NO: 681415 - RNA, 63 nt, hsa
guuuuuuauuuauaaaaccucuccccaccccccaccccccaacuuccuggguuuucucauugu

SEQ ID NO: 681416 - RNA, 63 nt, hsa
gccacgagccaccacugccucccgcugcugcccaccccccacaaaaaggaaaaaaugaaugag

SEQ ID NO: 681417 - RNA, 63 nt, hsa
aagcccuucuugcuuuugagagaggcugugaccaccccccauccuucucccuacacucccagc

SEQ ID NO: 681418 - RNA, 63 nt, hsa
gggccuccccugcuaucccuccucccauccuguaccccccauuucuggggccucaucacugug

SEQ ID NO: 681419 - RNA, 63 nt, hsa
uaggggggagggggguggcacagcagcuuggguaccccccaaccuccaggagcuaguggaggg

SEQ ID NO: 681420 - RNA, 63 nt, hsa
ucaccuuugaccuugccucaccuuucaccccccaccccccacagcgucagcuccuaccucuga

SEQ ID NO: 681421 - RNA, 63 nt, hsa
cugcaguucaccuuugaccuugccucaccuuucaccccccaccccccacagcgucagcuccua

SEQ ID NO: 681422 - RNA, 63 nt, hsa
cugcacuucaccgcugaccuugccucaccuuuaaccccccaccugagccccagcuccuaccuc

SEQ ID NO: 681423 - RNA, 63 nt, hsa
ugcuuuuauacauuuuucugcagcuguaggcauaccccccaagucugcuuuuagcuucccuau

SEQ ID NO: 681424 - RNA, 63 nt, hsa
uugauuuaggggcuuuggagaacuuugaaugcuaccccccaaguaaccauuguuggcaaccug

SEQ ID NO: 681425 - RNA, 63 nt, hsa
aguaucagggauuguggggacaggagugagacaaccccccagguacagcacuggcuuuucuuu

SEQ ID NO: 681426 - RNA, 63 nt, hsa
ucagggacugaagggggaccccaaaacuggcucaccccccagaacacccuccucccagggagg

SEQ ID NO: 681427 - RNA, 63 nt, hsa
ccagccccuccucccucagacccaggaguccagaccccccagccccuccucccucagacccag

SEQ ID NO: 681428 - RNA, 63 nt, hsa; identical to SEQ ID NO: 681427

SEQ ID NO: 681429 - RNA, 63 nt, hsa
ggagggguagugcuccacagcuuuuccuuccccaccccccagccuuagaugccucgcucuuuu

SEQ ID NO: 681430 - RNA, 63 nt, hsa
acuccugcugucuaccucuccucacaccccagcaccccccauuuuuucaaaccuugguaucug

SEQ ID NO: 681431 - RNA, 63 nt, hsa
uuucaacuuccugcuggaaacuagagguggggcaccccccaccccccagccucgcacuguguc

SEQ ID NO: 681432 - RNA, 63 nt, hsa
uuccugcuggaaacuagagguggggcaccccccaccccccagccucgcacuguguccuugggg

SEQ ID NO: 681433 - RNA, 64 nt, hsa; identical to SEQ ID NO: 45744

SEQ ID NO: 681434 - RNA, 64 nt, hsa; identical to SEQ ID NO: 45745

SEQ ID NO: 681435 - RNA, 64 nt, hsa; identical to SEQ ID NO: 45746

SEQ ID NO: 681436 - RNA, 64 nt, hsa; identical to SEQ ID NO: 45747

SEQ ID NO: 681437 - RNA, 64 nt, hsa; identical to SEQ ID NO: 45748

SEQ ID NO: 681438 - RNA, 64 nt, hsa; identical to SEQ ID NO: 45749

SEQ ID NO: 681439 - RNA, 64 nt, hsa; identical to SEQ ID NO: 45750

SEQ ID NO: 681440 - RNA, 64 nt, hsa; identical to SEQ ID NO: 45751

SEQ ID NO: 681441 - RNA, 64 nt, hsa; identical to SEQ ID NO: 45752

SEQ ID NO: 681442 - RNA, 64 nt, hsa; identical to SEQ ID NO: 45753

SEQ ID NO: 681443 - RNA, 64 nt, hsa; identical to SEQ ID NO: 45754

SEQ ID NO: 681444 - RNA, 64 nt, hsa; identical to SEQ ID NO: 45755

SEQ ID NO: 681445 - RNA, 64 nt, hsa; identical to SEQ ID NO: 45756

SEQ ID NO: 681446 - RNA, 64 nt, hsa; identical to SEQ ID NO: 45757

SEQ ID NO: 681447 - RNA, 64 nt, hsa; identical to SEQ ID NO: 45758

SEQ ID NO: 681448 - RNA, 64 nt, hsa; identical to SEQ ID NO: 45759

SEQ ID NO: 681449 - RNA, 64 nt, hsa; identical to SEQ ID NO: 45760

SEQ ID NO: 681450 - RNA, 64 nt, hsa; identical to SEQ ID NO: 45761

SEQ ID NO: 681451 - RNA, 64 nt, hsa; identical to SEQ ID NO: 45762

SEQ ID NO: 681452 - RNA, 64 nt, hsa; identical to SEQ ID NO: 45763

SEQ ID NO: 681453 - RNA, 64 nt, hsa; identical to SEQ ID NO: 45764

SEQ ID NO: 681454 - RNA, 64 nt, hsa; identical to SEQ ID NO: 45765

SEQ ID NO: 681455 - RNA, 64 nt, hsa; identical to SEQ ID NO: 45766

SEQ ID NO: 681456 - RNA, 64 nt, hsa; identical to SEQ ID NO: 45767

SEQ ID NO: 681457 - RNA, 64 nt, hsa; identical to SEQ ID NO: 45768

SEQ ID NO: 681458 - RNA, 64 nt, hsa; identical to SEQ ID NO: 45769

SEQ ID NO: 681459 - RNA, 64 nt, hsa; identical to SEQ ID NO: 45770

SEQ ID NO: 681460 - RNA, 64 nt, hsa; identical to SEQ ID NO: 45771

SEQ ID NO: 681461 - RNA, 64 nt, hsa; identical to SEQ ID NO: 45772

SEQ ID NO: 681462 - RNA, 64 nt, hsa; identical to SEQ ID NO: 45773

SEQ ID NO: 681463 - RNA, 64 nt, hsa; identical to SEQ ID NO: 45774

SEQ ID NO: 681464 - RNA, 64 nt, hsa; identical to SEQ ID NO: 45775

SEQ ID NO: 681465 - RNA, 64 nt, hsa; identical to SEQ ID NO: 45776

SEQ ID NO: 681466 - RNA, 64 nt, hsa; identical to SEQ ID NO: 45777

SEQ ID NO: 681467 - RNA, 64 nt, hsa; identical to SEQ ID NO: 45778

SEQ ID NO: 681468 - RNA, 64 nt, hsa; identical to SEQ ID NO: 45779

SEQ ID NO: 681469 - RNA, 64 nt, hsa
gccgcgaccucaguguggcuuuuacaggacuccccccgagcaucagcagggaccccggcggacg

SEQ ID NO: 681470 - RNA, 64 nt, hsa
uuccuggguucaagugauucucuugccuuagccucccgagcagcugggauuauaggcguccacc

SEQ ID NO: 681471 - RNA, 64 nt, hsa
aguaaaauuguuuuuucuguccgcaacacuggcucccgagcagcuuuuguuaaagcaguagguu

SEQ ID NO: 681472 - RNA, 64 nt, hsa
ucagcuggccuccgaagagccguggacuguccuacccgagcacuugauucugguagcuccuucu

SEQ ID NO: 681473 - RNA, 64 nt, hsa
ccuccagaaccgacaguuccagcaaaagcagcggcccgagcagaagaucgaggacaucagcaau

SEQ ID NO: 681474 - RNA, 64 nt, hsa
uggccagaguccacucccuuccuggcugugucaccccgagcagcucauccaccauggaggucau

SEQ ID NO: 681475 - RNA, 64 nt, hsa; identical to SEQ ID NO: 73345

SEQ ID NO: 681476 - RNA, 64 nt, hsa; identical to SEQ ID NO: 73346

SEQ ID NO: 681477 - RNA, 64 nt, hsa; identical to SEQ ID NO: 73347

SEQ ID NO: 681478 - RNA, 64 nt, hsa; identical to SEQ ID NO: 73348

SEQ ID NO: 681479 - RNA, 64 nt, hsa; identical to SEQ ID NO: 73349

SEQ ID NO: 681480 - RNA, 64 nt, hsa; identical to SEQ ID NO: 73350

SEQ ID NO: 681481 - RNA, 64 nt, hsa; identical to SEQ ID NO: 73351

SEQ ID NO: 681482 - RNA, 64 nt, hsa; identical to SEQ ID NO: 73352

SEQ ID NO: 681483 - RNA, 64 nt, hsa; identical to SEQ ID NO: 73353

SEQ ID NO: 681484 - RNA, 64 nt, hsa; identical to SEQ ID NO: 73354

SEQ ID NO: 681485 - RNA, 64 nt, hsa; identical to SEQ ID NO: 73355

SEQ ID NO: 681486 - RNA, 64 nt, hsa; identical to SEQ ID NO: 73356

SEQ ID NO: 681487 - RNA, 64 nt, hsa; identical to SEQ ID NO: 73357

SEQ ID NO: 681488 - RNA, 52 nt, hsa; identical to SEQ ID NO: 73358

SEQ ID NO: 681489 - RNA, 64 nt, hsa; identical to SEQ ID NO: 73359

SEQ ID NO: 681490 - RNA, 64 nt, hsa; identical to SEQ ID NO: 73360

SEQ ID NO: 681491 - RNA, 64 nt, hsa; identical to SEQ ID NO: 73361

SEQ ID NO: 681492 - RNA, 64 nt, hsa; identical to SEQ ID NO: 73362

SEQ ID NO: 681493 - RNA, 64 nt, hsa; identical to SEQ ID NO: 73363

SEQ ID NO: 681494 - RNA, 64 nt, hsa; identical to SEQ ID NO: 73364

SEQ ID NO: 681495 - RNA, 64 nt, hsa; identical to SEQ ID NO: 73365

SEQ ID NO: 681496 - RNA, 64 nt, hsa; identical to SEQ ID NO: 73366

SEQ ID NO: 681497 - RNA, 64 nt, hsa; identical to SEQ ID NO: 73367

SEQ ID NO: 681498 - RNA, 64 nt, hsa; identical to SEQ ID NO: 73368

SEQ ID NO: 681499 - RNA, 64 nt, hsa; identical to SEQ ID NO: 73369

SEQ ID NO: 681500 - RNA, 64 nt, hsa; identical to SEQ ID NO: 73370

SEQ ID NO: 681501 - RNA, 64 nt, hsa; identical to SEQ ID NO: 73371

SEQ ID NO: 681502 - RNA, 64 nt, hsa; identical to SEQ ID NO: 73372

SEQ ID NO: 681503 - RNA, 64 nt, hsa; identical to SEQ ID NO: 73373

SEQ ID NO: 681504 - RNA, 64 nt, hsa; identical to SEQ ID NO: 73374

SEQ ID NO: 681505 - RNA, 64 nt, hsa; identical to SEQ ID NO: 73375

SEQ ID NO: 681506 - RNA, 64 nt, hsa; identical to SEQ ID NO: 73376

SEQ ID NO: 681507 - RNA, 64 nt, hsa; identical to SEQ ID NO: 73377

SEQ ID NO: 681508 - RNA, 64 nt, hsa; identical to SEQ ID NO: 73378

SEQ ID NO: 681509 - RNA, 64 nt, hsa; identical to SEQ ID NO: 73379

SEQ ID NO: 681510 - RNA, 64 nt, hsa; identical to SEQ ID NO: 73380

SEQ ID NO: 681511 - RNA, 64 nt, hsa; identical to SEQ ID NO: 73381

SEQ ID NO: 681512 - RNA, 64 nt, hsa; identical to SEQ ID NO: 73382

SEQ ID NO: 681513 - RNA, 64 nt, hsa; identical to SEQ ID NO: 73383

SEQ ID NO: 681514 - RNA, 64 nt, hsa; identical to SEQ ID NO: 73384

SEQ ID NO: 681515 - RNA, 64 nt, hsa; identical to SEQ ID NO: 73385

SEQ ID NO: 681516 - RNA, 64 nt, hsa; identical to SEQ ID NO: 73386

SEQ ID NO: 681517 - RNA, 64 nt, hsa; identical to SEQ ID NO: 73387

SEQ ID NO: 681518 - RNA, 64 nt, hsa; identical to SEQ ID NO: 73388

SEQ ID NO: 681519 - RNA, 64 nt, hsa; identical to SEQ ID NO: 73389

SEQ ID NO: 681520 - RNA, 64 nt, hsa; identical to SEQ ID NO: 655929

SEQ ID NO: 681521 - RNA, 64 nt, hsa; identical to SEQ ID NO: 655930

SEQ ID NO: 681522 - RNA, 64 nt, hsa; identical to SEQ ID NO: 655931

SEQ ID NO: 681523 - RNA, 64 nt, hsa; identical to SEQ ID NO: 655932

SEQ ID NO: 681524 - RNA, 64 nt, hsa; identical to SEQ ID NO: 168534

SEQ ID NO: 681525 - RNA, 64 nt, hsa; identical to SEQ ID NO: 168535

SEQ ID NO: 681526 - RNA, 64 nt, hsa; identical to SEQ ID NO: 168536

SEQ ID NO: 681527 - RNA, 64 nt, hsa; identical to SEQ ID NO: 168537

SEQ ID NO: 681528 - RNA, 64 nt, hsa; identical to SEQ ID NO: 168538

SEQ ID NO: 681529 - RNA, 64 nt, hsa; identical to SEQ ID NO: 168539

SEQ ID NO: 681530 - RNA, 64 nt, hsa; identical to SEQ ID NO: 168540

SEQ ID NO: 681531 - RNA, 64 nt, hsa; identical to SEQ ID NO: 168541

SEQ ID NO: 681532 - RNA, 64 nt, hsa; identical to SEQ ID NO: 168542

SEQ ID NO: 681533 - RNA, 64 nt, hsa; identical to SEQ ID NO: 168543

SEQ ID NO: 681534 - RNA, 64 nt, hsa; identical to SEQ ID NO: 168544

SEQ ID NO: 681535 - RNA, 64 nt, hsa; identical to SEQ ID NO: 168545

SEQ ID NO: 681536 - RNA, 64 nt, hsa; identical to SEQ ID NO: 108766

SEQ ID NO: 681537 - RNA, 64 nt, hsa; identical to SEQ ID NO: 108767

SEQ ID NO: 681538 - RNA, 64 nt, hsa; identical to SEQ ID NO: 108768

SEQ ID NO: 681539 - RNA, 64 nt, hsa; identical to SEQ ID NO: 108769

SEQ ID NO: 681540 - RNA, 64 nt, hsa; identical to SEQ ID NO: 108770

SEQ ID NO: 681541 - RNA, 64 nt, hsa; identical to SEQ ID NO: 108771

SEQ ID NO: 681542 - RNA, 64 nt, hsa; identical to SEQ ID NO: 108772

SEQ ID NO: 681543 - RNA, 64 nt, hsa; identical to SEQ ID NO: 108773

SEQ ID NO: 681544 - RNA, 64 nt, hsa; identical to SEQ ID NO: 108774

SEQ ID NO: 681545 - RNA, 64 nt, hsa; identical to SEQ ID NO: 108775

SEQ ID NO: 681546 - RNA, 64 nt, hsa; identical to SEQ ID NO: 108776

SEQ ID NO: 681547 - RNA, 64 nt, hsa; identical to SEQ ID NO: 108777

SEQ ID NO: 681548 - RNA, 64 nt, hsa; identical to SEQ ID NO: 108778

SEQ ID NO: 681549 - RNA, 64 nt, hsa; identical to SEQ ID NO: 108779

SEQ ID NO: 681550 - RNA, 64 nt, hsa; identical to SEQ ID NO: 108780

SEQ ID NO: 681551 - RNA, 64 nt, hsa; identical to SEQ ID NO: 108781

SEQ ID NO: 681552 - RNA, 64 nt, hsa; identical to SEQ ID NO: 108782

SEQ ID NO: 681553 - RNA, 64 nt, hsa; identical to SEQ ID NO: 108783

SEQ ID NO: 681554 - RNA, 64 nt, hsa; identical to SEQ ID NO: 108784

SEQ ID NO: 681555 - RNA, 64 nt, hsa; identical to SEQ ID NO: 108785

SEQ ID NO: 681556 - RNA, 64 nt, hsa; identical to SEQ ID NO: 108786

SEQ ID NO: 681557 - RNA, 64 nt, hsa; identical to SEQ ID NO: 108787

SEQ ID NO: 681558 - RNA, 64 nt, hsa; identical to SEQ ID NO: 108788

SEQ ID NO: 681559 - RNA, 64 nt, hsa; identical to SEQ ID NO: 108789

SEQ ID NO: 681560 - RNA, 64 nt, hsa; identical to SEQ ID NO: 108790

SEQ ID NO: 681561 - RNA, 64 nt, hsa; identical to SEQ ID NO: 108791

SEQ ID NO: 681562 - RNA, 64 nt, hsa; identical to SEQ ID NO: 108792

SEQ ID NO: 681563 - RNA, 64 nt, hsa; identical to SEQ ID NO: 108793

SEQ ID NO: 681564 - RNA, 64 nt, hsa; identical to SEQ ID NO: 108794

SEQ ID NO: 681565 - RNA, 64 nt, hsa; identical to SEQ ID NO: 108795

SEQ ID NO: 681566 - RNA, 64 nt, hsa; identical to SEQ ID NO: 108796

SEQ ID NO: 681567 - RNA, 64 nt, hsa; identical to SEQ ID NO: 108797

SEQ ID NO: 681568 - RNA, 64 nt, hsa; identical to SEQ ID NO: 108798

SEQ ID NO: 681569 - RNA, 64 nt, hsa; identical to SEQ ID NO: 108799

SEQ ID NO: 681570 - RNA, 64 nt, hsa; identical to SEQ ID NO: 108800

SEQ ID NO: 681571 - RNA, 64 nt, hsa; identical to SEQ ID NO: 108801

SEQ ID NO: 681572 - RNA, 64 nt, hsa; identical to SEQ ID NO: 108802

SEQ ID NO: 681573 - RNA, 64 nt, hsa; identical to SEQ ID NO: 108803

SEQ ID NO: 681574 - RNA, 64 nt, hsa; identical to SEQ ID NO: 108804

SEQ ID NO: 681575 - RNA, 64 nt, hsa; identical to SEQ ID NO: 108805

SEQ ID NO: 681576 - RNA, 64 nt, hsa; identical to SEQ ID NO: 108806

SEQ ID NO: 681577 - RNA, 64 nt, hsa; identical to SEQ ID NO: 108807

SEQ ID NO: 681578 - RNA, 64 nt, hsa; identical to SEQ ID NO: 108808

SEQ ID NO: 681579 - RNA, 64 nt, hsa; identical to SEQ ID NO: 108809

SEQ ID NO: 681580 - RNA, 64 nt, hsa; identical to SEQ ID NO: 108810

SEQ ID NO: 681581 - RNA, 64 nt, hsa; identical to SEQ ID NO: 108811

SEQ ID NO: 681582 - RNA, 64 nt, hsa; identical to SEQ ID NO: 108812

SEQ ID NO: 681583 - RNA, 64 nt, hsa; identical to SEQ ID NO: 108813

SEQ ID NO: 681584 - RNA, 64 nt, hsa; identical to SEQ ID NO: 108814

SEQ ID NO: 681585 - RNA, 64 nt, hsa; identical to SEQ ID NO: 108815

SEQ ID NO: 681586 - RNA, 64 nt, hsa; identical to SEQ ID NO: 108816

SEQ ID NO: 681587 - RNA, 64 nt, hsa; identical to SEQ ID NO: 108817

SEQ ID NO: 681588 - RNA, 64 nt, hsa; identical to SEQ ID NO: 108818

SEQ ID NO: 681589 - RNA, 64 nt, hsa; identical to SEQ ID NO: 108819

SEQ ID NO: 681590 - RNA, 64 nt, hsa; identical to SEQ ID NO: 108820

SEQ ID NO: 681591 - RNA, 64 nt, hsa; identical to SEQ ID NO: 108821

SEQ ID NO: 681592 - RNA, 64 nt, hsa; identical to SEQ ID NO: 108822

SEQ ID NO: 681593 - RNA, 64 nt, hsa; identical to SEQ ID NO: 108823

SEQ ID NO: 681594 - RNA, 64 nt, hsa; identical to SEQ ID NO: 108824

SEQ ID NO: 681595 - RNA, 64 nt, hsa; identical to SEQ ID NO: 108825

SEQ ID NO: 681596 - RNA, 64 nt, hsa; identical to SEQ ID NO: 91583

SEQ ID NO: 681597 - RNA, 64 nt, hsa; identical to SEQ ID NO: 91584

SEQ ID NO: 681598 - RNA, 64 nt, hsa; identical to SEQ ID NO: 79755

SEQ ID NO: 681599 - RNA, 64 nt, hsa; identical to SEQ ID NO: 79756

SEQ ID NO: 681600 - RNA, 64 nt, hsa; identical to SEQ ID NO: 79757

SEQ ID NO: 681601 - RNA, 64 nt, hsa; identical to SEQ ID NO: 79758

SEQ ID NO: 681602 - RNA, 64 nt, hsa; identical to SEQ ID NO: 79759

SEQ ID NO: 681603 - RNA, 64 nt, hsa; identical to SEQ ID NO: 79760

SEQ ID NO: 681604 - RNA, 64 nt, hsa; identical to SEQ ID NO: 79761

SEQ ID NO: 681605 - RNA, 64 nt, hsa; identical to SEQ ID NO: 79762

SEQ ID NO: 681606 - RNA, 64 nt, hsa; identical to SEQ ID NO: 79763

SEQ ID NO: 681607 - RNA, 64 nt, hsa; identical to SEQ ID NO: 79764

SEQ ID NO: 681608 - RNA, 64 nt, hsa; identical to SEQ ID NO: 79765

SEQ ID NO: 681609 - RNA, 64 nt, hsa; identical to SEQ ID NO: 79766

SEQ ID NO: 681610 - RNA, 64 nt, hsa; identical to SEQ ID NO: 79767

SEQ ID NO: 681611 - RNA, 64 nt, hsa; identical to SEQ ID NO: 79768

SEQ ID NO: 681612 - RNA, 64 nt, hsa; identical to SEQ ID NO: 79769

SEQ ID NO: 681613 - RNA, 64 nt, hsa; identical to SEQ ID NO: 79770

SEQ ID NO: 681614 - RNA, 64 nt, hsa; identical to SEQ ID NO: 79771

SEQ ID NO: 681615 - RNA, 64 nt, hsa; identical to SEQ ID NO: 79772

SEQ ID NO: 681616 - RNA, 64 nt, hsa; identical to SEQ ID NO: 79773

SEQ ID NO: 681617 - RNA, 64 nt, hsa; identical to SEQ ID NO: 79774

SEQ ID NO: 681618 - RNA, 64 nt, hsa; identical to SEQ ID NO: 79775

SEQ ID NO: 681619 - RNA, 64 nt, hsa; identical to SEQ ID NO: 79776

SEQ ID NO: 681620 - RNA, 64 nt, hsa; identical to SEQ ID NO: 79777

SEQ ID NO: 681621 - RNA, 64 nt, hsa; identical to SEQ ID NO: 79778

SEQ ID NO: 681622 - RNA, 64 nt, hsa; identical to SEQ ID NO: 79779

SEQ ID NO: 681623 - RNA, 64 nt, hsa; identical to SEQ ID NO: 79780

SEQ ID NO: 681624 - RNA, 64 nt, hsa; identical to SEQ ID NO: 79781

SEQ ID NO: 681625 - RNA, 64 nt, hsa; identical to SEQ ID NO: 79782

SEQ ID NO: 681626 - RNA, 64 nt, hsa; identical to SEQ ID NO: 79783

SEQ ID NO: 681627 - RNA, 64 nt, hsa; identical to SEQ ID NO: 79784

SEQ ID NO: 681628 - RNA, 64 nt, hsa; identical to SEQ ID NO: 79785

SEQ ID NO: 681629 - RNA, 64 nt, hsa; identical to SEQ ID NO: 79786

SEQ ID NO: 681630 - RNA, 64 nt, hsa; identical to SEQ ID NO: 79787

SEQ ID NO: 681631 - RNA, 64 nt, hsa; identical to SEQ ID NO: 79788

SEQ ID NO: 681632 - RNA, 64 nt, hsa; identical to SEQ ID NO: 79789

SEQ ID NO: 681633 - RNA, 64 nt, hsa; identical to SEQ ID NO: 79790

SEQ ID NO: 681634 - RNA, 64 nt, hsa; identical to SEQ ID NO: 79791

SEQ ID NO: 681635 - RNA, 64 nt, hsa; identical to SEQ ID NO: 79792

SEQ ID NO: 681636 - RNA, 64 nt, hsa; identical to SEQ ID NO: 79793

SEQ ID NO: 681637 - RNA, 64 nt, hsa; identical to SEQ ID NO: 79794

SEQ ID NO: 681638 - RNA, 64 nt, hsa; identical to SEQ ID NO: 79795

SEQ ID NO: 681639 - RNA, 64 nt, hsa; identical to SEQ ID NO: 79796

SEQ ID NO: 681640 - RNA, 64 nt, hsa; identical to SEQ ID NO: 79797

SEQ ID NO: 681641 - RNA, 64 nt, hsa; identical to SEQ ID NO: 79798

SEQ ID NO: 681642 - RNA, 64 nt, hsa; identical to SEQ ID NO: 79799

SEQ ID NO: 681643 - RNA, 64 nt, hsa; identical to SEQ ID NO: 79800

SEQ ID NO: 681644 - RNA, 64 nt, hsa; identical to SEQ ID NO: 79801

SEQ ID NO: 681645 - RNA, 64 nt, hsa; identical to SEQ ID NO: 79802

SEQ ID NO: 681646 - RNA, 64 nt, hsa; identical to SEQ ID NO: 79803

SEQ ID NO: 681647 - RNA, 64 nt, hsa; identical to SEQ ID NO: 238652

SEQ ID NO: 681648 - RNA, 64 nt, hsa; identical to SEQ ID NO: 238653

SEQ ID NO: 681649 - RNA, 64 nt, hsa; identical to SEQ ID NO: 238654

SEQ ID NO: 681650 - RNA, 64 nt, hsa; identical to SEQ ID NO: 238655

SEQ ID NO: 681651 - RNA, 64 nt, hsa; identical to SEQ ID NO: 238656

SEQ ID NO: 681652 - RNA, 64 nt, hsa; identical to SEQ ID NO: 238657

SEQ ID NO: 681653 - RNA, 64 nt, hsa; identical to SEQ ID NO: 238658

SEQ ID NO: 681654 - RNA, 64 nt, hsa; identical to SEQ ID NO: 238659

SEQ ID NO: 681655 - RNA, 64 nt, hsa; identical to SEQ ID NO: 238660

SEQ ID NO: 681656 - RNA, 64 nt, hsa; identical to SEQ ID NO: 238661

SEQ ID NO: 681657 - RNA, 64 nt, hsa; identical to SEQ ID NO: 238662

SEQ ID NO: 681658 - RNA, 64 nt, hsa; identical to SEQ ID NO: 238663

SEQ ID NO: 681659 - RNA, 64 nt, hsa; identical to SEQ ID NO: 238664

SEQ ID NO: 681660 - RNA, 64 nt, hsa; identical to SEQ ID NO: 238665

SEQ ID NO: 681661 - RNA, 64 nt, hsa; identical to SEQ ID NO: 238666

SEQ ID NO: 681662 - RNA, 64 nt, hsa; identical to SEQ ID NO: 238667

SEQ ID NO: 681663 - RNA, 64 nt, hsa; identical to SEQ ID NO: 238668

SEQ ID NO: 681664 - RNA, 64 nt, hsa; identical to SEQ ID NO: 238669

SEQ ID NO: 681665 - RNA, 64 nt, hsa; identical to SEQ ID NO: 238670

SEQ ID NO: 681666 - RNA, 64 nt, hsa; identical to SEQ ID NO: 238671

SEQ ID NO: 681667 - RNA, 64 nt, hsa; identical to SEQ ID NO: 238672

SEQ ID NO: 681668 - RNA, 64 nt, hsa; identical to SEQ ID NO: 238673

SEQ ID NO: 681669 - RNA, 64 nt, hsa; identical to SEQ ID NO: 238674

SEQ ID NO: 681670 - RNA, 64 nt, hsa; identical to SEQ ID NO: 238675

SEQ ID NO: 681671 - RNA, 64 nt, hsa; identical to SEQ ID NO: 238676

SEQ ID NO: 681672 - RNA, 64 nt, hsa; identical to SEQ ID NO: 238677

SEQ ID NO: 681673 - RNA, 64 nt, hsa; identical to SEQ ID NO: 238678

SEQ ID NO: 681674 - RNA, 64 nt, hsa; identical to SEQ ID NO: 238679

SEQ ID NO: 681675 - RNA, 64 nt, hsa; identical to SEQ ID NO: 238680

SEQ ID NO: 681676 - RNA, 64 nt, hsa; identical to SEQ ID NO: 238681

SEQ ID NO: 681677 - RNA, 64 nt, hsa; identical to SEQ ID NO: 238682

SEQ ID NO: 681678 - RNA, 64 nt, hsa; identical to SEQ ID NO: 238683

SEQ ID NO: 681679 - RNA, 64 nt, hsa; identical to SEQ ID NO: 238684

SEQ ID NO: 681680 - RNA, 64 nt, hsa; identical to SEQ ID NO: 238685

SEQ ID NO: 681681 - RNA, 64 nt, hsa; identical to SEQ ID NO: 238686

SEQ ID NO: 681682 - RNA, 64 nt, hsa; identical to SEQ ID NO: 238687

SEQ ID NO: 681683 - RNA, 64 nt, hsa; identical to SEQ ID NO: 238688

SEQ ID NO: 681684 - RNA, 64 nt, hsa; identical to SEQ ID NO: 238689

SEQ ID NO: 681685 - RNA, 64 nt, hsa; identical to SEQ ID NO: 238690

SEQ ID NO: 681686 - RNA, 64 nt, hsa; identical to SEQ ID NO: 238691

SEQ ID NO: 681687 - RNA, 64 nt, hsa; identical to SEQ ID NO: 238692

SEQ ID NO: 681688 - RNA, 64 nt, hsa; identical to SEQ ID NO: 238693

SEQ ID NO: 681689 - RNA, 64 nt, hsa; identical to SEQ ID NO: 238694

SEQ ID NO: 681690 - RNA, 64 nt, hsa; identical to SEQ ID NO: 238695

SEQ ID NO: 681691 - RNA, 64 nt, hsa; identical to SEQ ID NO: 238696

SEQ ID NO: 681692 - RNA, 64 nt, hsa; identical to SEQ ID NO: 238697

SEQ ID NO: 681693 - RNA, 64 nt, hsa; identical to SEQ ID NO: 238698

SEQ ID NO: 681694 - RNA, 64 nt, hsa; identical to SEQ ID NO: 238699

SEQ ID NO: 681695 - RNA, 64 nt, hsa; identical to SEQ ID NO: 238700

SEQ ID NO: 681696 - RNA, 64 nt, hsa; identical to SEQ ID NO: 238701

SEQ ID NO: 681697 - RNA, 64 nt, hsa; identical to SEQ ID NO: 238702

SEQ ID NO: 681698 - RNA, 64 nt, hsa; identical to SEQ ID NO: 238703

SEQ ID NO: 681699 - RNA, 64 nt, hsa; identical to SEQ ID NO: 238704

SEQ ID NO: 681700 - RNA, 64 nt, hsa; identical to SEQ ID NO: 238705

SEQ ID NO: 681701 - RNA, 64 nt, hsa; identical to SEQ ID NO: 238706

SEQ ID NO: 681702 - RNA, 64 nt, hsa; identical to SEQ ID NO: 238707

SEQ ID NO: 681703 - RNA, 64 nt, hsa; identical to SEQ ID NO: 238708

SEQ ID NO: 681704 - RNA, 64 nt, hsa; identical to SEQ ID NO: 238709

SEQ ID NO: 681705 - RNA, 64 nt, hsa; identical to SEQ ID NO: 238710

SEQ ID NO: 681706 - RNA, 64 nt, hsa; identical to SEQ ID NO: 238711

SEQ ID NO: 681707 - RNA, 64 nt, hsa; identical to SEQ ID NO: 238712

SEQ ID NO: 681708 - RNA, 64 nt, hsa; identical to SEQ ID NO: 238713

SEQ ID NO: 681709 - RNA, 64 nt, hsa; identical to SEQ ID NO: 238714

SEQ ID NO: 681710 - RNA, 64 nt, hsa; identical to SEQ ID NO: 238715

SEQ ID NO: 681711 - RNA, 64 nt, hsa; identical to SEQ ID NO: 238716

SEQ ID NO: 681712 - RNA, 64 nt, hsa; identical to SEQ ID NO: 238717

SEQ ID NO: 681713 - RNA, 64 nt, hsa; identical to SEQ ID NO: 238718

SEQ ID NO: 681714 - RNA, 64 nt, hsa; identical to SEQ ID NO: 238719

SEQ ID NO: 681715 - RNA, 63 nt, hsa; identical to SEQ ID NO: 188776

SEQ ID NO: 681716 - RNA, 63 nt, hsa; identical to SEQ ID NO: 188777

SEQ ID NO: 681717 - RNA, 63 nt, hsa; identical to SEQ ID NO: 188778

SEQ ID NO: 681718 - RNA, 63 nt, hsa; identical to SEQ ID NO: 188779

SEQ ID NO: 681719 - RNA, 63 nt, hsa; identical to SEQ ID NO: 188780

SEQ ID NO: 681720 - RNA, 63 nt, hsa; identical to SEQ ID NO: 188781

SEQ ID NO: 681721 - RNA, 63 nt, hsa; identical to SEQ ID NO: 188782

SEQ ID NO: 681722 - RNA, 63 nt, hsa; identical to SEQ ID NO: 188783

SEQ ID NO: 681723 - RNA, 63 nt, hsa; identical to SEQ ID NO: 188784

SEQ ID NO: 681724 - RNA, 63 nt, hsa; identical to SEQ ID NO: 188785

SEQ ID NO: 681725 - RNA, 63 nt, hsa; identical to SEQ ID NO: 188786

SEQ ID NO: 681726 - RNA, 63 nt, hsa; identical to SEQ ID NO: 188787

SEQ ID NO: 681727 - RNA, 63 nt, hsa; identical to SEQ ID NO: 188788

SEQ ID NO: 681728 - RNA, 63 nt, hsa; identical to SEQ ID NO: 188789

SEQ ID NO: 681729 - RNA, 63 nt, hsa; identical to SEQ ID NO: 188790

SEQ ID NO: 681730 - RNA, 63 nt, hsa; identical to SEQ ID NO: 188791

SEQ ID NO: 681731 - RNA, 63 nt, hsa; identical to SEQ ID NO: 188792

SEQ ID NO: 681732 - RNA, 63 nt, hsa; identical to SEQ ID NO: 188793

SEQ ID NO: 681733 - RNA, 61 nt, hsa; identical to SEQ ID NO: 188794

SEQ ID NO: 681734 - RNA, 63 nt, hsa; identical to SEQ ID NO: 188795

SEQ ID NO: 681735 - RNA, 63 nt, hsa; identical to SEQ ID NO: 188796

SEQ ID NO: 681736 - RNA, 63 nt, hsa; identical to SEQ ID NO: 188797

SEQ ID NO: 681737 - RNA, 63 nt, hsa; identical to SEQ ID NO: 188798

SEQ ID NO: 681738 - RNA, 63 nt, hsa; identical to SEQ ID NO: 188799

SEQ ID NO: 681739 - RNA, 63 nt, hsa; identical to SEQ ID NO: 188800

SEQ ID NO: 681740 - RNA, 63 nt, hsa; identical to SEQ ID NO: 188801

SEQ ID NO: 681741 - RNA, 63 nt, hsa; identical to SEQ ID NO: 188802

SEQ ID NO: 681742 - RNA, 63 nt, hsa; identical to SEQ ID NO: 188803

SEQ ID NO: 681743 - RNA, 63 nt, hsa; identical to SEQ ID NO: 188804

SEQ ID NO: 681744 - RNA, 63 nt, hsa; identical to SEQ ID NO: 188805

SEQ ID NO: 681745 - RNA, 63 nt, hsa; identical to SEQ ID NO: 188806

SEQ ID NO: 681746 - RNA, 63 nt, hsa; identical to SEQ ID NO: 188807

SEQ ID NO: 681747 - RNA, 63 nt, hsa; identical to SEQ ID NO: 188808

SEQ ID NO: 681748 - RNA, 63 nt, hsa; identical to SEQ ID NO: 188809

SEQ ID NO: 681749 - RNA, 63 nt, hsa; identical to SEQ ID NO: 188810

SEQ ID NO: 681750 - RNA, 63 nt, hsa; identical to SEQ ID NO: 188811

SEQ ID NO: 681751 - RNA, 63 nt, hsa; identical to SEQ ID NO: 188812

SEQ ID NO: 681752 - RNA, 64 nt, hsa; identical to SEQ ID NO: 175198

SEQ ID NO: 681753 - RNA, 64 nt, hsa; identical to SEQ ID NO: 175199

SEQ ID NO: 681754 - RNA, 64 nt, hsa; identical to SEQ ID NO: 175200

SEQ ID NO: 681755 - RNA, 64 nt, hsa; identical to SEQ ID NO: 175201

SEQ ID NO: 681756 - RNA, 64 nt, hsa; identical to SEQ ID NO: 175202

SEQ ID NO: 681757 - RNA, 64 nt, hsa; identical to SEQ ID NO: 175203

SEQ ID NO: 681758 - RNA, 64 nt, hsa; identical to SEQ ID NO: 175204

SEQ ID NO: 681759 - RNA, 64 nt, hsa; identical to SEQ ID NO: 175205

SEQ ID NO: 681760 - RNA, 64 nt, hsa; identical to SEQ ID NO: 175206

SEQ ID NO: 681761 - RNA, 64 nt, hsa; identical to SEQ ID NO: 175207

SEQ ID NO: 681762 - RNA, 64 nt, hsa; identical to SEQ ID NO: 175208

SEQ ID NO: 681763 - RNA, 64 nt, hsa; identical to SEQ ID NO: 175209

SEQ ID NO: 681764 - RNA, 64 nt, hsa; identical to SEQ ID NO: 175210

SEQ ID NO: 681765 - RNA, 64 nt, hsa; identical to SEQ ID NO: 175211

SEQ ID NO: 681766 - RNA, 64 nt, hsa; identical to SEQ ID NO: 312696

SEQ ID NO: 681767 - RNA, 64 nt, hsa; identical to SEQ ID NO: 312697

SEQ ID NO: 681768 - RNA, 64 nt, hsa; identical to SEQ ID NO: 610890

SEQ ID NO: 681769 - RNA, 64 nt, hsa; identical to SEQ ID NO: 610891

SEQ ID NO: 681770 - RNA, 64 nt, hsa; identical to SEQ ID NO: 610892

SEQ ID NO: 681771 - RNA, 64 nt, hsa; identical to SEQ ID NO: 610893

SEQ ID NO: 681772 - RNA, 64 nt, hsa; identical to SEQ ID NO: 610894

SEQ ID NO: 681773 - RNA, 64 nt, hsa
ucaguaagcuuucaauuuugauacacaguucauuauucauaacuugaggcaguaauuacagugg

SEQ ID NO: 681774 - RNA, 64 nt, hsa
aauugcuuucugauucguguagucucucccacagauucauaaacuuuuaugacuuauauuguuu

SEQ ID NO: 681775 - RNA, 64 nt, hsa
aaugucuauguuuucuacuccaauucauaaaucuauucauaagucuuugguacaaguuuacaug

SEQ ID NO: 681776 - RNA, 64 nt, hsa
ccucaagguagaaaugucuauguuuucuacuccaauucauaaaucuauucauaagucuuuggua

SEQ ID NO: 681777 - RNA, 64 nt, hsa
accgaucaagcauuuugacaggaagcccuucauuauucauaacauuguaugcugaccaagacgu

SEQ ID NO: 681778 - RNA, 64 nt, hsa
guuuaagauaaaauacaaacuuuaccuaccccaaauucauaaaguacauuuagugcuguauagc

SEQ ID NO: 681779 - RNA, 64 nt, hsa
uuuacuugcauacuuaugagaauuucacauuggaauucauaaugguaaaacaacauacaucugc

SEQ ID NO: 681780 - RNA, 64 nt, hsa
ccauucguuguggacccacagauugcaucuuuaaauucauaauaaguuuccuuaacuaucuuau

SEQ ID NO: 681781 - RNA, 64 nt, hsa
uaugcauacauauauacacacauauguauauaaaauucauaaugaauauauuugccuauauucu

SEQ ID NO: 681782 - RNA, 64 nt, hsa
gaagucacccugggaaucacaguggucuaccugcauucauaauuccaggaucugugaagagcac

SEQ ID NO: 681783 - RNA, 64 nt, hsa
acacuauaguagaaaaguuuggggcacucaucccauucauaauuauuuuacauuuaaauuacug

SEQ ID NO: 681784 - RNA, 64 nt, hsa
uuacggcuuuauugaaaacauugauauauugaauauucauaaauuuuaauuuaacuuucuuuua

SEQ ID NO: 681785 - RNA, 64 nt, hsa
gagggcaaggcugguggcagguacuaugaauguaauucauaauuuaaaaggaaaacuaaaaacu

SEQ ID NO: 681786 - RNA, 64 nt, hsa
auguucaaaugauguagauugucuuagaaugaauauucauaaguacucagaacucuuaagaugc

SEQ ID NO: 681787 - RNA, 64 nt, hsa
aguaaccgacaauauauuuauuuauaaagcacauauucauaauaacgagaagaauucagaaaac

SEQ ID NO: 681788 - RNA, 64 nt, hsa
cagcaagcaacuucccuggggaagccaaacacauauucauaaaaaaaaucaaguagcugaugug

SEQ ID NO: 681789 - RNA, 64 nt, hsa
uugcaaaagccacaacaguaguggaagaauuaaaauucauaaagucucaucauucuguuggcua

SEQ ID NO: 681790 - RNA, 64 nt, hsa
acauugccuucuguuuuguauaucccuuauaguaauucauaaaugcuucccauggaguuuugcu

SEQ ID NO: 681791 - RNA, 64 nt, hsa
agagcuccaaguguauuaaacaugacagccauucauucauaaagaucuggauuugcuuuaccuu

SEQ ID NO: 681792 - RNA, 64 nt, hsa
uuuguuuuuaaaucugugaugcuuuucaaauuuaauucauaauaaauugaugcaauuucauacu

SEQ ID NO: 681793 - RNA, 64 nt, hsa
ucuguuaguguuugaauaucuucauuccucucaaauucauaacaguucuauuuaacugaauuaa

SEQ ID NO: 681794 - RNA, 64 nt, hsa
uuacuuugucagaggcacaaaaggguuuaaacugauucauaauaaauaucuguacuucuucgau

SEQ ID NO: 681795 - RNA, 64 nt, hsa
ucuagcagaaccuuuccaaaaguuuuauauugagauucauaacaacaccaagaauugauuuugu

SEQ ID NO: 681796 - RNA, 64 nt, hsa
cgcccccaaaaauacugaagacuaauccauugacauucauaaugggacagcuaaguaccaaaua

SEQ ID NO: 681797 - RNA, 64 nt, hsa
aauuuaacauuccauguaacuuuucugacuuaucauucauaaguugcaaauauuacuauuuucc

SEQ ID NO: 681798 - RNA, 64 nt, hsa
uauuugaagugaaguuauaaaagggcaaauccagauucauaaacuaucaccucggauuucuugu

SEQ ID NO: 681799 - RNA, 64 nt, hsa
acaguggauagauuaaaggcauuuaauauuuguaauucauaauaacuguagaaauggcccuaaa

SEQ ID NO: 681800 - RNA, 64 nt, hsa
ccuucuaaaguguacaauucaguggugugaguauauucauaagauuuauacuuggugucuauuc

SEQ ID NO: 681801 - RNA, 64 nt, hsa
gugaguauauucauaagauuuauacuuggugucuauucauaagacuuauauccagcauauucau

SEQ ID NO: 681802 - RNA, 64 nt, hsa
cuuggugucuauucauaagacuuauauccagcauauucauaacuagagccauaucacagaugca

SEQ ID NO: 681803 - RNA, 64 nt, hsa
ugagucugcuguugaacuauuagauuaagucauaauucauaaaauuuuaguuuaaugugcucuu

SEQ ID NO: 681804 - RNA, 64 nt, hsa
acacaauacuuaauguauuguacuagauugccaaauucauaaaauguuaauggaagcuuuuuga

SEQ ID NO: 681805 - RNA, 64 nt, hsa
gcaaugaaugcucaaguugggguugggcguuagaauucauaaaagucuuuauaugcucagauuc

SEQ ID NO: 681806 - RNA, 64 nt, hsa
uuuccuuguuuuauucccuuuggaauuugcuccaauucauaaauuugcaguuuuaugucuuuua

SEQ ID NO: 681807 - RNA, 64 nt, hsa
agucugaaacucugcgcucuaguacugcuguuaagauacacaacuuguuucuuaguucauauaa

SEQ ID NO: 681808 - RNA, 64 nt, hsa
uacacaacuuguuucuuaguucauauaaucucgggauacacacacacacacacauauauauaca

SEQ ID NO: 681809 - RNA, 64 nt, hsa
uauuuucuuauagaagcaauguauuaaaugauuagauacacaggacaguucacagcaaauuguu

SEQ ID NO: 681810 - RNA, 64 nt, hsa
aaauaaagugaaauuuauguauguuuuguacauagauacacaugauuauguuaagaggcuuuaa

SEQ ID NO: 681811 - RNA, 64 nt, hsa
ccauugcaccagcuuguccuccaaaaucaugaaugauacacaugaagauaacuuuuuuuaaaaa

SEQ ID NO: 681812 - RNA, 64 nt, hsa
acauguauuaugcuucuaaaugcucauucuaccagauacacauuuaaaagagaaaaaaggaaca

SEQ ID NO: 681813 - RNA, 64 nt, hsa
uauuaauacuuacgguuuuaaauguguugcuuuggauacacacauaguuucuuuuuuaauagaa

SEQ ID NO: 681814 - RNA, 64 nt, hsa
cacccgcccugcccuucccuggugggcuauugaagauacacaagagggacuguauuucugugga

SEQ ID NO: 681815 - RNA, 64 nt, hsa
uaucugucuacaguauuggcucuucugcgaggcugauacacaaggccucucuuccacaugauca

SEQ ID NO: 681816 - RNA, 64 nt, hsa
aacaagaacugccugaagaagaguccaagcuacagauacacagcgugugcauugcggcugucac

SEQ ID NO: 681817 - RNA, 64 nt, hsa
cuguauauaaagcgcauguagagcuacagauccagauacacacacuuguguauauauguacaua

SEQ ID NO: 681818 - RNA, 64 nt, hsa
caguguugacguuucccagaugugugcuugugaugauacacacacaugcacagguucucaacca

SEQ ID NO: 681819 - RNA, 64 nt, hsa; identical to SEQ ID NO: 463809

SEQ ID NO: 681820 - RNA, 64 nt, hsa; identical to SEQ ID NO: 463810

SEQ ID NO: 681821 - RNA, 63 nt, hsa; identical to SEQ ID NO: 463811

SEQ ID NO: 681822 - RNA, 64 nt, hsa; identical to SEQ ID NO: 463812

SEQ ID NO: 681823 - RNA, 64 nt, hsa; identical to SEQ ID NO: 463813

SEQ ID NO: 681824 - RNA, 64 nt, hsa; identical to SEQ ID NO: 463814

SEQ ID NO: 681825 - RNA, 64 nt, hsa
ugaggugacagcucauuagcggggagagagauggagcaucgagugacacugggccauccaggcg

SEQ ID NO: 681826 - RNA, 64 nt, hsa
uuuugugaauugccagcguuguguguuuucugggagcaucgaagcucuguuucggaagagcugu

SEQ ID NO: 681827 - RNA, 64 nt, hsa
aagagcuggcgucuuagaacucccuggcuuauauagcaucgacaaagaacaguaaauuuuuaga

SEQ ID NO: 681828 - RNA, 64 nt, hsa
gagguugcauucccuacuuccuaaacucucuuccagcaucgauguucuguagcucugaccuuga

SEQ ID NO: 681829 - RNA, 64 nt, hsa
cuguaggauucucaccguggggcuggaagaaaagagcaucgacuugauuucuccaaccacucau

SEQ ID NO: 681830 - RNA, 64 nt, hsa
ccucuguacgcgcagaucaacagaccuaagaaauagcaucgaugcgagcucguggugggugcuc

SEQ ID NO: 681831 - RNA, 64 nt, hsa
guaaucuagaaaguguuauguaagugauguuauuagcaucgagauucccuccaccugauuuuca

SEQ ID NO: 681832 - RNA, 64 nt, hsa
agcagagaauagaaaauguaaucuccaacauccaagcaucgaaacccaagggguaggcaauucu

SEQ ID NO: 681833 - RNA, 64 nt, hsa
aacuucuaaaggaagcagaauagcuccucuggccagcaucgaauauaaguaagaugcauuuacu

SEQ ID NO: 681834 - RNA, 64 nt, hsa
augggcuagguaaaagggggcugcuuuucuguuaagcaucgauagguaaguugauggauaaaag

SEQ ID NO: 681835 - RNA, 64 nt, hsa
gauacaucaguaugagaggacgucccaucaacaaagcaucgaugauggacagucucacacuauu

SEQ ID NO: 681836 - RNA, 64 nt, hsa
ggcuaaaggucuagaugagacuuggaaggcaaggagcaucgaaauuugagauacccaggacccu

SEQ ID NO: 681837 - RNA, 64 nt, hsa
gcuccugucccuggguucaggcugugcuucuggaagcaucgaaaugggaugucugagccuugag

SEQ ID NO: 681838 - RNA, 64 nt, hsa
ucugaaaaccagaaagaagucuugucauugcagcagcaucgauuccggugauagaguuuguauc

SEQ ID NO: 681839 - RNA, 64 nt, hsa
acacgcauagauccacgaggcaccaaggccugggagcaucgacgugaagucccacguguccggu

SEQ ID NO: 681840 - RNA, 64 nt, hsa
gcugugaccucugugccacuguuguccauagaagagcaucgacugugucacuuaaaauauuagu

SEQ ID NO: 681841 - RNA, 64 nt, hsa
agaccaacagauggccagcccuuccgugacagccagcaucgaacaugagacgucauugauuuua

SEQ ID NO: 681842 - RNA, 64 nt, hsa
ggggcaucuugcaagaccuuuagugccacaaauaagcaucgagcaccuccccauucacaccccc

SEQ ID NO: 681843 - RNA, 64 nt, hsa
gugucccgugagugugaguguggcagugagaagaagcaucgagggcgaggggaauaugaaaguu

SEQ ID NO: 681844 - RNA, 64 nt, hsa
aggggcgccagcuugggcucuccuggcgccccguagcaucgagugucuucuuugucuucuuucu

SEQ ID NO: 681845 - RNA, 64 nt, hsa
ggaaaugagccagcccaagggcaucauccucagcagcaucgaggaagggccgaggaaugugaag

SEQ ID NO: 681846 - RNA, 64 nt, hsa
uagcaauggagggaaacagaaacagccuguagagagcaucgacaaggcgcauaauggagaguug

SEQ ID NO: 681847 - RNA, 64 nt, hsa
gcuuccucucuuccugugaaggauaugacaguccagcaucgaugccugugcccucuggaaaaau

SEQ ID NO: 681848 - RNA, 64 nt, hsa
cagucacccagggaagccucccagcggcucaugaagcaucgagcuccaagcccagaugccaagc

SEQ ID NO: 681849 - RNA, 64 nt, hsa
uccccuaauauuuuccuugugcaauucagacuuaagcaucgaguuuuuaccaucuuccacuuua

SEQ ID NO: 681850 - RNA, 64 nt, hsa
augggccugccuccccagugaccugcgaaaguggagcaucgagguaggagggaaacggcaacca

SEQ ID NO: 681851 - RNA, 64 nt, hsa
uaucuggaucucuguuaugugccauuuuucuucuagcaucgagauacaauaaaaaaaaaaaaaa

SEQ ID NO: 681852 - RNA, 64 nt, hsa
ugaacugcuguugggaaccaccacgcagaccaccagcaucgacauguggugaggagauacgguu

SEQ ID NO: 681853 - RNA, 64 nt, hsa
auguucucugcacuguuuggccagcauaaccucuagcaucgauucaaagcagaguuuuaaccug

SEQ ID NO: 681854 - RNA, 64 nt, hsa
uuuucuugcuuuuuucccauccauagagcaugacagcaucgauucucauugaggagaaaccuug

SEQ ID NO: 681855 - RNA, 64 nt, hsa
uucauccacauccacaccucacacaccuguugucagcaucgagccaacaccaaccugacaaggu

SEQ ID NO: 681856 - RNA, 64 nt, hsa
ugaagcauccccgugacaaaccagagugggcagaagcaucgagagcgugacaggaaaucccaag

SEQ ID NO: 681857 - RNA, 64 nt, hsa
ccuucccaacgauaguaacaggaaaugacucuuuagcaucgauaccucaacaucaauuuagggu

SEQ ID NO: 681858 - RNA, 64 nt, hsa
gaggauagagucaaggucaguucaggaaagcuuaagcaucgaaaaaagaaaaaaagccaugaug

SEQ ID NO: 681859 - RNA, 64 nt, hsa
aaugauuucauauugaucuuuuuaucaugauccucccuaucaagcacuaaaaaguugaaccauu

SEQ ID NO: 681860 - RNA, 64 nt, hsa
guucaaaaaugccauuuuuaauauuuguauaauacccuaucaugugaguauaccuuaacuaagc

SEQ ID NO: 681861 - RNA, 64 nt, hsa
aagauuuaauccuuauaccauguuggacauuugccccuaucaguugcuccucaggaaucuucug

SEQ ID NO: 681862 - RNA, 64 nt, hsa
cuuaguauucuuccuugaggcucacaucaugugucccuaucacucuuacuacucuggucagucu

SEQ ID NO: 681863 - RNA, 60 nt, hsa
cagcacccucagggucuuaaggucuucaugcccuaucacaaauaccucuuuuaucugucc

SEQ ID NO: 681864 - RNA, 64 nt, hsa
gggcagccccaggcugucuggaaguuggagaauucccuaucagcacagggaucucagcucuggc

SEQ ID NO: 681865 - RNA, 64 nt, hsa
aagaaacauuguuugguggcagcaaucucccugucccuaucacuguuagaggccuaauuuuaua

SEQ ID NO: 681866 - RNA, 64 nt, hsa
uuauuaauuucuucacaccuacccuccuuuuuuucccuaucacugaagcuuuuuagugcauuag

SEQ ID NO: 681867 - RNA, 64 nt, hsa
agaggcuuccaaucaguguggaaagugacaaauccccuaucaacacucccagcccuugcugggg

SEQ ID NO: 681868 - RNA, 64 nt, hsa
uuuuaggauguugguuccugcaaacaagaacugacccuaucaccucugccucacaguggguaaa

SEQ ID NO: 681869 - RNA, 64 nt, hsa
uggaggagagucucugaccagcugcagagccaaccccuaucauuuuauuaacauggaacccaca

SEQ ID NO: 681870 - RNA, 64 nt, hsa
auguuuugaaauaagacauaaaacauuccaaauacccuaucaccgaggauccugcauccucuuc

SEQ ID NO: 681871 - RNA, 64 nt, hsa
guaguaaauaaugcuuugaaauugaaccuuugugcccuaucacccaacgcuccaaagucauaau

SEQ ID NO: 681872 - RNA, 64 nt, hsa
ucagcagaaguggaaugacaugaccugugacacccccuaucagugggugugcaagaagcccaug

SEQ ID NO: 681873 - RNA, 64 nt, hsa
acuccccaucugaagcuggccucugccuuuuacucccuaucaugucacucucugcucaccaucc

SEQ ID NO: 681874 - RNA, 64 nt, hsa
auuuucaagagaagaaaaaauuaagagauacauucccuaucaaaacauaucaauucaacacauu

SEQ ID NO: 681875 - RNA, 64 nt, hsa
acaccaguuuuaaaaugagccacaaacaguaaagcccuaucaguauaaaauuugaaaaaaaaaa

SEQ ID NO: 681876 - RNA, 64 nt, hsa
ucaaauuuuacuugaugucuguccauucuuguggcccuaucagccuucuccuuccuuuacuccu

SEQ ID NO: 681877 - RNA, 64 nt, hsa
uguccuuaaaacaaaacaaaaaccaaaaaagucacccuaucagguuucaaacagauuuguggcu

SEQ ID NO: 681878 - RNA, 64 nt, hsa
agcccuagcugccuugcagccccaaaccccaggacccuaucagcccccugggacucccuggccc

SEQ ID NO: 681879 - RNA, 64 nt, hsa
gccuuaaaauggaauugaaaaacucuuuauuuuccccuaucauuuauuggaugggugggugggg

SEQ ID NO: 681880 - RNA, 64 nt, hsa
ccccaggcuccuccauauggcccagggcuuaccacccuaucacacguggccuugucuagaccca

SEQ ID NO: 681881 - RNA, 64 nt, hsa
cgacgcuugaccuuccugggccucaagugcccuccccuaucaaaugaagggauggacagcauga

SEQ ID NO: 681882 - RNA, 64 nt, hsa
uaaucaagauuugaagcuuuugugauugaaaagacccuaucaagaaggugaaaagauaaccugc

SEQ ID NO: 681883 - RNA, 64 nt, hsa
uuuuuuuuuuuuuuuacuguagacacaaguuuggcccuaucaaaaacgaugaggaaaaaagauu

SEQ ID NO: 681884 - RNA, 64 nt, hsa
uccacuucaccaggucaccacagcccacacuacgcccuaucacuucccacaaugaggcugagug

SEQ ID NO: 681885 - RNA, 64 nt, hsa
gacaaaaaggccaagagaaucacagagucauugacccuaucauuauuucaccaagccaauacca

SEQ ID NO: 681886 - RNA, 64 nt, hsa
aaaaauauuaaauuuugaauugaguguguaggcucccuaucauuauauauagaguuucuuuuuc

SEQ ID NO: 681887 - RNA, 64 nt, hsa
cgguuacuguuccugaaaagaaaaagccaccuagcccuaucaagccaaagauuccccuuucugc

SEQ ID NO: 681888 - RNA, 64 nt, hsa
uuuauuguauauacuuaaaaaauagaacucacugcccuaucauacauuguagcccucuuauucu

SEQ ID NO: 681889 - RNA, 64 nt, hsa
cuguuccuuuuuugauuuucuuauccggcugcuccccuaucagaccucaucuuuuuuaauuuua

SEQ ID NO: 681890 - RNA, 64 nt, hsa
ccuugagcucuucugagcuaaggcagccuucagucccuaucagcgccuccuuuacuucccagag

SEQ ID NO: 681891 - RNA, 64 nt, hsa
cacaggcuuagggcaguucagaacccacuuguuucccuaucagagggacacagugaaguggagg

SEQ ID NO: 681892 - RNA, 64 nt, hsa
acagggaggauacagaaguauugcagcccagauccccuaucagggggacagcuggugggcaaag

SEQ ID NO: 681893 - RNA, 64 nt, hsa
gggucaucaucucuacauuccuuaggauuucucucccuaucaagcuggcccagauacaaguacc

SEQ ID NO: 681894 - RNA, 64 nt, hsa
gggggcgagcaaccucaaggaacacaauuucccucccuaucaacaagaggauuuuaacagcaaa

SEQ ID NO: 681895 - RNA, 64 nt, hsa
aucuaccuugucugucagaguugaauaucucuuucccuaucaugcugcuucugaaaauucaguu

SEQ ID NO: 681896 - RNA, 64 nt, hsa
auuuagcauaucuagacuaccuauuugaaaggaacccuaucaacugucuuauguacguuacaug

SEQ ID NO: 681897 - RNA, 64 nt, hsa
cauauggauauaagauuuggcucauaaugaugagcccuaucauuugauuugaguucuaucauuu

SEQ ID NO: 681898 - RNA, 64 nt, hsa
caauuaugagaggcuaggucauccaaagagaagacccuaucaauguagguugcaaaaucuaacc

SEQ ID NO: 681899 - RNA, 64 nt, hsa
gaaggcuccugugccaugucuuagacauugcaugcccuaucaauuacuauaauccugagccaug

SEQ ID NO: 681900 - RNA, 64 nt, hsa
gcccaagcuucuguaguagcucccuaaaauaauacccuaucaucugcuccuaaucccuccaauc

SEQ ID NO: 681901 - RNA, 64 nt, hsa
ugucuagcaagcagccuccuaagauagcuguucucccuaucaugacgguguagccaccauccug

SEQ ID NO: 681902 - RNA, 64 nt, hsa
cuaucccugacacucuggaaucuucuccauuucucccuaucacucaauuucauuuuaaucauug

SEQ ID NO: 681903 - RNA, 64 nt, hsa
aagcccauacaacucaaccaaacuuaccccugagcccuaucaaccuaggucuacagccagugga

SEQ ID NO: 681904 - RNA, 64 nt, hsa
ugauaauuugacaaauagcuauaauaggaacacucccuaucaccaacauauuuugguuaguaua

SEQ ID NO: 681905 - RNA, 64 nt, hsa
agaguucaacuguuacucuuuucuuucaucaauccccuaucaguuagaacugcaggccaguucc

SEQ ID NO: 681906 - RNA, 64 nt, hsa
cuuccuucuauguuuugguuuugguuucuauugucccuaucauuucagcaaguggaacagcagc

SEQ ID NO: 681907 - RNA, 64 nt, hsa
caccccucacauacuauaaaauaaaucuucacugcccuaucaaaauacaaauaaaucaaucuau

SEQ ID NO: 681908 - RNA, 64 nt, hsa
cccacucuaauauucaacaauuauagacaauuugcccuaucauuuauuuacaucuauguaucua

SEQ ID NO: 681909 - RNA, 64 nt, hsa
cacccccacgcccagucacggugacaaccacaaacccuaucagaucuauucaccuuuuucagag

SEQ ID NO: 681910 - RNA, 64 nt, hsa
aucuguugacaaaugacagaucuuuuuuuuuucccccuaucaguugauuuuucuuauuuacaga

SEQ ID NO: 681911 - RNA, 64 nt, hsa
ugucuuuauauuuuaucuucauccuaaauuuucucccuaucaaaacagcaggaaauuuuuaaac

SEQ ID NO: 681912 - RNA, 64 nt, hsa
cucaaaccugugucuggggugugggcucacagaucccuaucagccugguucgugggagggcucu

SEQ ID NO: 681913 - RNA, 56 nt, hsa
cugagcauaaaacucauuaaaccugccccuaucacuagugcaugcuguggccagac

SEQ ID NO: 681914 - RNA, 64 nt, hsa
ccccaucaagguuugaguccacaaaaguggaccucccuaucaugcuuccccuucccucuagcau

SEQ ID NO: 681915 - RNA, 64 nt, hsa
ucucugcuauucaugaaucuugcuauugcacaaacccuaucaagagcugcugcuucccuuccag

SEQ ID NO: 681916 - RNA, 64 nt, hsa
ucagugggaaccucugagagcauuuuccuguucccccuaucaaccgcccccagugauaacaucu

SEQ ID NO: 681917 - RNA, 64 nt, hsa
ccuggcuacccuguuguuuucaucuaccucagaccccuaucauggggcucuacccugugacaag

SEQ ID NO: 681918 - RNA, 64 nt, hsa
uggccccggaaggugaauggccugcucucccuggcccuaucagccugugaacuucacuuaggcc

SEQ ID NO: 681919 - RNA, 64 nt, hsa
guggagacaagcucagucuaaucaaacaccagaacccuaucaagucaaaagagcuggggccagg

SEQ ID NO: 681920 - RNA, 64 nt, hsa
ucuggagcuguuucuacauucagauaacuggguccccuaucacaaggcuacuggcuaauaggaa

SEQ ID NO: 681921 - RNA, 64 nt, hsa
accaaaagcagucacugcaaaucuuuuaauucuucccuaucaccuuuuguauuuuaaugcaauu

SEQ ID NO: 681922 - RNA, 64 nt, hsa
ccauggaccaaggauggaauacagauugaugcugcccuaucaauuaauuuugguuuauuaauag

SEQ ID NO: 681923 - RNA, 64 nt, hsa
uugggcuagguaguggggaccaaguucauuaccucccuaucaguucuagcauaguaaacuacgg

SEQ ID NO: 681924 - RNA, 64 nt, hsa
uaagggggaagaggagaggguauggggcggcagacccuaucaucaacuguccaguggacuggac

SEQ ID NO: 681925 - RNA, 64 nt, hsa
acguaauuuuuucccugacgucuuuaaaauugaacccuaucaugaaaugauaauuucuuccuga

SEQ ID NO: 681926 - RNA, 64 nt, hsa
auuggaagugguuucuuugacuuucaaggucauucccuaucaguuacuacuaagaguucucuua

SEQ ID NO: 681927 - RNA, 64 nt, hsa
ccuugccaucccugcagcccagcugguggugcugcccuaucagaugcugcugcaugcggccacu

SEQ ID NO: 681928 - RNA, 64 nt, hsa
cuuauuggcucuuuuaccuccuacuuuucucacucccuaucagggauauuuuggggggggaugg

SEQ ID NO: 681929 - RNA, 64 nt, hsa
gccuggagcgaauccguccucuuggcucucccagcccuaucacaggaaucauuccuggguuucu

SEQ ID NO: 681930 - RNA, 64 nt, hsa
uggacugaaguucuugcagacaccccaccugugccccuaucaucaggggaacugcuccaccuga

SEQ ID NO: 681931 - RNA, 64 nt, hsa
ucauuuuucugcuccugcuucucucucuucauuccccuaucaacauuaccgccccugucucucu

SEQ ID NO: 681932 - RNA, 64 nt, hsa
ugguuaaaugacccugaacuaaaacugauggguucccuaucaaaacaaauaaaaauauaccuuu

SEQ ID NO: 681933 - RNA, 64 nt, hsa
uaucuugaagaacccuuucaacucuaaaaauugacccuaucaacuggagagcccacaaggcaua

SEQ ID NO: 681934 - RNA, 64 nt, hsa
aggucuguguugucuagaucuuugcuuuuuaucccccuaucaguccagggcauauacuaaccug

SEQ ID NO: 681935 - RNA, 64 nt, hsa
uccuggaaccccagcccacucccccaucccuccucccuaucaaacuaguauaaugauuuugaau

SEQ ID NO: 681936 - RNA, 64 nt, hsa
aaaagauaauacccauuuguucuaucaccccucucccuaucauuaacuaucaaauaaauaaaua

SEQ ID NO: 681937 - RNA, 63 nt, hsa
ccacugccauuuccuccugggcaacagagugagacccuaucacaaaaaaaaagaaagaaaaaa

SEQ ID NO: 681938 - RNA, 64 nt, hsa
gaguacugugagcccaccccacauuggucaucuucccuaucacacaaaugauguuauuuuggac

SEQ ID NO: 681939 - RNA, 64 nt, hsa
uguuguuugaauugcugccaauagcagaccauaucccuaucauguuguuggcucaacuguuuuu

SEQ ID NO: 681940 - RNA, 64 nt, hsa
aaacagcccuccagugcccaccugccucacuccucccuaucauguaccgugaaaacccccucug

SEQ ID NO: 681941 - RNA, 64 nt, hsa
uccaugucauuccuuuauuuuuauaaauuauucccccuaucauuccuuuacagugccuagugcu

SEQ ID NO: 681942 - RNA, 64 nt, hsa
ugccuauaagaauuugcuggucugggaaaaccugcccuaucaaugaguauguugccgugguuac

SEQ ID NO: 681943 - RNA, 64 nt, hsa
gauuuauguccuugccauuaccuagugguuacagcccuaucacuaaaauuuacaucguuucuca

SEQ ID NO: 681944 - RNA, 64 nt, hsa
uagacuugauuucaaauucuuaaguucagccuuucccuaucaaucacaaaucauguauuggaaa

SEQ ID NO: 681945 - RNA, 64 nt, hsa
ccuuggcucccuguccugcucccggcuucccuuacccuaucacuggccucaggcccccgcaggc

SEQ ID NO: 681946 - RNA, 64 nt, hsa
gcgggugggaaagcugcaggcccaggccuugcuucccuaucaggcuugggcauaggggugugcc

SEQ ID NO: 681947 - RNA, 64 nt, hsa
guuuguuggacuguuccacugccccuccuccucacccuaucacccauggaucguaauguaaaau

SEQ ID NO: 681948 - RNA, 64 nt, hsa
gcuuggggguuuuugaagucuuuaauauuuuaagcccuaucacugacacaucagcauguuuucu

SEQ ID NO: 681949 - RNA, 64 nt, hsa
gcccuacuugggcccaaguuucagaauaguguuccccuaucaaggcugugacuagaucaggcag

SEQ ID NO: 681950 - RNA, 64 nt, hsa
cgugugaggauguggauggaggugaugaaaaccacccuaucaucaguuaggauuagguuuagaa

SEQ ID NO: 681951 - RNA, 64 nt, hsa
gaugagaagcacaccucagaaaucaggacauccccccuaucaggugguuuuggagaaaacaagg

SEQ ID NO: 681952 - RNA, 64 nt, hsa
uccuugaguaggugggcuccccuugcccuucccucccuaucacuccauacuggggugggcugga

SEQ ID NO: 681953 - RNA, 64 nt, hsa
acugcccagaacaguggcccauagcagggaccugcccuaucaaaauaucagguguauggaggug

SEQ ID NO: 681954 - RNA, 64 nt, hsa
uuucaauaucaugaaagaacacacuagggagaaacccuaucaauguaagcaaugugcaaaagcc

SEQ ID NO: 681955 - RNA, 64 nt, hsa
acacacacacacacacacacacuugaaacuaucacccuaucagugguauuggacauaucuguua

SEQ ID NO: 681956 - RNA, 64 nt, hsa
cucugagcuuggaagaagccuguucugagccucacccuaucagucaguagagagagauguccag

SEQ ID NO: 681957 - RNA, 64 nt, hsa
uaauagacaucagagaauucacaaaggagagaaacccuaucaguguaaagaaugugggaagguu

SEQ ID NO: 681958 - RNA, 64 nt, hsa
cuguguauauaaugcuuucuugauugacccaucucccuaucaucaaaugacuucuagucuagaa

SEQ ID NO: 681959 - RNA, 64 nt, hsa
uauuuugccauuggaagguuaacuuuaaaaugagcccuaucacugagaaauacguguuucauga

SEQ ID NO: 681960 - RNA, 64 nt, hsa
guucaauaacaaagguuacuguugagaaaaaagacccuaucauagauuuacaagugacaacgug

SEQ ID NO: 681961 - RNA, 64 nt, hsa
uuugaaauucugaacaccgucagcacccucucuucccuaucaugggucaucugaccccuguccg

SEQ ID NO: 681962 - RNA, 64 nt, hsa
aaguuacguaacauuuacuccuuuguaaauguuucccuaucaucagacaaaacucaauaaaaau

SEQ ID NO: 681963 - RNA, 64 nt, hsa
acuuggguugaggcuggguuccccucuauuguuccccuaucauaagagcuaggccaagccuaug

SEQ ID NO: 681964 - RNA, 64 nt, hsa
uuaugaagggaguuuagcugacuuuucccuguagcccuaucauauuaaaaacaaaaaguggucc

SEQ ID NO: 681965 - RNA, 64 nt, hsa
uauuuuagaaauggcuuuauaaaucaccuugguucccuaucaguagagcuaguaaggcagcacc

SEQ ID NO: 681966 - RNA, 64 nt, hsa
gcauccccagaacucagcaacccagcucuuuuaucaugaggagagguagccaugcugacucaug

SEQ ID NO: 681967 - RNA, 64 nt, hsa
gaaaguacuacagaggggaaccauuugagggauacaugaggagagaguaaauugagguuugggg

SEQ ID NO: 681968 - RNA, 64 nt, hsa
accagaauucuguuauaggcaccuaaccacgcagcaugaggaaaacggcacaacacaaucuuga

SEQ ID NO: 681969 - RNA, 64 nt, hsa
uguuacauaggugguauuacuguuggucaaaaaucaugaggaggaacaguugaauccagccuga

SEQ ID NO: 681970 - RNA, 64 nt, hsa
uuaauuucagcuuauaugggugucuucauuugaacaugaggaauauuagguuauauuuucagca

SEQ ID NO: 681971 - RNA, 64 nt, hsa
gguaucugccagcauucaagguuuuggaucauuucaugaggaucuuuccuuugacugggugcug

SEQ ID NO: 681972 - RNA, 64 nt, hsa
uaagagggcucaagauugugaauucugcuccugccaugaggagcucagaaggccaggaagccag

SEQ ID NO: 681973 - RNA, 64 nt, hsa
agcugcaggaagcccugcccagggaugguccugccaugaggaggcugcaacccuauaagagggc

SEQ ID NO: 681974 - RNA, 64 nt, hsa; identical to SEQ ID NO: 573978

SEQ ID NO: 681975 - RNA, 64 nt, hsa; identical to SEQ ID NO: 573979

SEQ ID NO: 681976 - RNA, 64 nt, hsa; identical to SEQ ID NO: 573980

SEQ ID NO: 681977 - RNA, 64 nt, hsa; identical to SEQ ID NO: 573981

SEQ ID NO: 681978 - RNA, 64 nt, hsa; identical to SEQ ID NO: 573982

SEQ ID NO: 681979 - RNA, 64 nt, hsa; identical to SEQ ID NO: 573983

SEQ ID NO: 681980 - RNA, 64 nt, hsa; identical to SEQ ID NO: 573984

SEQ ID NO: 681981 - RNA, 64 nt, hsa; identical to SEQ ID NO: 573985

SEQ ID NO: 681982 - RNA, 64 nt, hsa; identical to SEQ ID NO: 573986

SEQ ID NO: 681983 - RNA, 64 nt, hsa; identical to SEQ ID NO: 573987

SEQ ID NO: 681984 - RNA, 64 nt, hsa; identical to SEQ ID NO: 573988

SEQ ID NO: 681985 - RNA, 64 nt, hsa; identical to SEQ ID NO: 573989

SEQ ID NO: 681986 - RNA, 64 nt, hsa; identical to SEQ ID NO: 573990

SEQ ID NO: 681987 - RNA, 64 nt, hsa; identical to SEQ ID NO: 573991

SEQ ID NO: 681988 - RNA, 64 nt, hsa; identical to SEQ ID NO: 573992

SEQ ID NO: 681989 - RNA, 64 nt, hsa; identical to SEQ ID NO: 573993

SEQ ID NO: 681990 - RNA, 64 nt, hsa; identical to SEQ ID NO: 573994

SEQ ID NO: 681991 - RNA, 64 nt, hsa; identical to SEQ ID NO: 573995

SEQ ID NO: 681992 - RNA, 64 nt, hsa; identical to SEQ ID NO: 573996

SEQ ID NO: 681993 - RNA, 62 nt, hsa; identical to SEQ ID NO: 573997

SEQ ID NO: 681994 - RNA, 64 nt, hsa; identical to SEQ ID NO: 210241

SEQ ID NO: 681995 - RNA, 64 nt, hsa; identical to SEQ ID NO: 210242

SEQ ID NO: 681996 - RNA, 64 nt, hsa; identical to SEQ ID NO: 210243

SEQ ID NO: 681997 - RNA, 64 nt, hsa; identical to SEQ ID NO: 210244

SEQ ID NO: 681998 - RNA, 64 nt, hsa; identical to SEQ ID NO: 210245

SEQ ID NO: 681999 - RNA, 64 nt, hsa; identical to SEQ ID NO: 210246

SEQ ID NO: 682000 - RNA, 64 nt, hsa; identical to SEQ ID NO: 210247

SEQ ID NO: 682001 - RNA, 64 nt, hsa; identical to SEQ ID NO: 210248

SEQ ID NO: 682002 - RNA, 64 nt, hsa; identical to SEQ ID NO: 210249

SEQ ID NO: 682003 - RNA, 64 nt, hsa; identical to SEQ ID NO: 210250

SEQ ID NO: 682004 - RNA, 64 nt, hsa; identical to SEQ ID NO: 210251

SEQ ID NO: 682005 - RNA, 64 nt, hsa; identical to SEQ ID NO: 210252

SEQ ID NO: 682006 - RNA, 64 nt, hsa; identical to SEQ ID NO: 210253

SEQ ID NO: 682007 - RNA, 62 nt, hsa; identical to SEQ ID NO: 210254

SEQ ID NO: 682008 - RNA, 64 nt, hsa; identical to SEQ ID NO: 210255

SEQ ID NO: 682009 - RNA, 64 nt, hsa; identical to SEQ ID NO: 210256

SEQ ID NO: 682010 - RNA, 64 nt, hsa; identical to SEQ ID NO: 210257

SEQ ID NO: 682011 - RNA, 64 nt, hsa; identical to SEQ ID NO: 210258

SEQ ID NO: 682012 - RNA, 64 nt, hsa; identical to SEQ ID NO: 210259

SEQ ID NO: 682013 - RNA, 64 nt, hsa; identical to SEQ ID NO: 210260

SEQ ID NO: 682014 - RNA, 64 nt, hsa; identical to SEQ ID NO: 210261

SEQ ID NO: 682015 - RNA, 64 nt, hsa; identical to SEQ ID NO: 210262

SEQ ID NO: 682016 - RNA, 64 nt, hsa; identical to SEQ ID NO: 210263

SEQ ID NO: 682017 - RNA, 64 nt, hsa; identical to SEQ ID NO: 210264

SEQ ID NO: 682018 - RNA, 64 nt, hsa; identical to SEQ ID NO: 210265

SEQ ID NO: 682019 - RNA, 64 nt, hsa; identical to SEQ ID NO: 210266

SEQ ID NO: 682020 - RNA, 64 nt, hsa; identical to SEQ ID NO: 210267

SEQ ID NO: 682021 - RNA, 64 nt, hsa; identical to SEQ ID NO: 210268

SEQ ID NO: 682022 - RNA, 64 nt, hsa; identical to SEQ ID NO: 210269

SEQ ID NO: 682023 - RNA, 64 nt, hsa; identical to SEQ ID NO: 210270

SEQ ID NO: 682024 - RNA, 64 nt, hsa; identical to SEQ ID NO: 210271

SEQ ID NO: 682025 - RNA, 64 nt, hsa; identical to SEQ ID NO: 210272

SEQ ID NO: 682026 - RNA, 64 nt, hsa; identical to SEQ ID NO: 210273

SEQ ID NO: 682027 - RNA, 64 nt, hsa; identical to SEQ ID NO: 210274

SEQ ID NO: 682028 - RNA, 64 nt, hsa; identical to SEQ ID NO: 210275

SEQ ID NO: 682029 - RNA, 64 nt, hsa; identical to SEQ ID NO: 210276

SEQ ID NO: 682030 - RNA, 64 nt, hsa; identical to SEQ ID NO: 210277

SEQ ID NO: 682031 - RNA, 64 nt, hsa; identical to SEQ ID NO: 210278

SEQ ID NO: 682032 - RNA, 64 nt, hsa; identical to SEQ ID NO: 85480

SEQ ID NO: 682033 - RNA, 64 nt, hsa; identical to SEQ ID NO: 85481

SEQ ID NO: 682034 - RNA, 64 nt, hsa; identical to SEQ ID NO: 85482

SEQ ID NO: 682035 - RNA, 64 nt, hsa; identical to SEQ ID NO: 85483

SEQ ID NO: 682036 - RNA, 64 nt, hsa; identical to SEQ ID NO: 85484

SEQ ID NO: 682037 - RNA, 64 nt, hsa; identical to SEQ ID NO: 85485

SEQ ID NO: 682038 - RNA, 64 nt, hsa; identical to SEQ ID NO: 85486

SEQ ID NO: 682039 - RNA, 64 nt, hsa; identical to SEQ ID NO: 85487

SEQ ID NO: 682040 - RNA, 64 nt, hsa; identical to SEQ ID NO: 85488

SEQ ID NO: 682041 - RNA, 64 nt, hsa; identical to SEQ ID NO: 85489

SEQ ID NO: 682042 - RNA, 64 nt, hsa; identical to SEQ ID NO: 85490

SEQ ID NO: 682043 - RNA, 64 nt, hsa; identical to SEQ ID NO: 85491

SEQ ID NO: 682044 - RNA, 64 nt, hsa; identical to SEQ ID NO: 85492

SEQ ID NO: 682045 - RNA, 64 nt, hsa; identical to SEQ ID NO: 85493

SEQ ID NO: 682046 - RNA, 64 nt, hsa; identical to SEQ ID NO: 85494

SEQ ID NO: 682047 - RNA, 64 nt, hsa; identical to SEQ ID NO: 85495

SEQ ID NO: 682048 - RNA, 64 nt, hsa; identical to SEQ ID NO: 85496

SEQ ID NO: 682049 - RNA, 64 nt, hsa; identical to SEQ ID NO: 85497

SEQ ID NO: 682050 - RNA, 64 nt, hsa; identical to SEQ ID NO: 85498

SEQ ID NO: 682051 - RNA, 64 nt, hsa; identical to SEQ ID NO: 85499

SEQ ID NO: 682052 - RNA, 64 nt, hsa; identical to SEQ ID NO: 85500

SEQ ID NO: 682053 - RNA, 64 nt, hsa; identical to SEQ ID NO: 85501

SEQ ID NO: 682054 - RNA, 64 nt, hsa; identical to SEQ ID NO: 85502

SEQ ID NO: 682055 - RNA, 64 nt, hsa; identical to SEQ ID NO: 85503

SEQ ID NO: 682056 - RNA, 64 nt, hsa; identical to SEQ ID NO: 85504

SEQ ID NO: 682057 - RNA, 64 nt, hsa; identical to SEQ ID NO: 85505

SEQ ID NO: 682058 - RNA, 64 nt, hsa; identical to SEQ ID NO: 85506

SEQ ID NO: 682059 - RNA, 64 nt, hsa; identical to SEQ ID NO: 85507

SEQ ID NO: 682060 - RNA, 64 nt, hsa; identical to SEQ ID NO: 85508

SEQ ID NO: 682061 - RNA, 64 nt, hsa; identical to SEQ ID NO: 85509

SEQ ID NO: 682062 - RNA, 64 nt, hsa; identical to SEQ ID NO: 85510

SEQ ID NO: 682063 - RNA, 64 nt, hsa; identical to SEQ ID NO: 85511

SEQ ID NO: 682064 - RNA, 64 nt, hsa; identical to SEQ ID NO: 85512

SEQ ID NO: 682065 - RNA, 64 nt, hsa; identical to SEQ ID NO: 85513

SEQ ID NO: 682066 - RNA, 64 nt, hsa; identical to SEQ ID NO: 85514

SEQ ID NO: 682067 - RNA, 64 nt, hsa; identical to SEQ ID NO: 85515

SEQ ID NO: 682068 - RNA, 64 nt, hsa; identical to SEQ ID NO: 85516

SEQ ID NO: 682069 - RNA, 64 nt, hsa; identical to SEQ ID NO: 85517

SEQ ID NO: 682070 - RNA, 64 nt, hsa; identical to SEQ ID NO: 85518

SEQ ID NO: 682071 - RNA, 64 nt, hsa; identical to SEQ ID NO: 85519

SEQ ID NO: 682072 - RNA, 64 nt, hsa; identical to SEQ ID NO: 85520

SEQ ID NO: 682073 - RNA, 64 nt, hsa; identical to SEQ ID NO: 85521

SEQ ID NO: 682074 - RNA, 64 nt, hsa; identical to SEQ ID NO: 85522

SEQ ID NO: 682075 - RNA, 64 nt, hsa; identical to SEQ ID NO: 85523

SEQ ID NO: 682076 - RNA, 64 nt, hsa; identical to SEQ ID NO: 55647

SEQ ID NO: 682077 - RNA, 64 nt, hsa; identical to SEQ ID NO: 55648

SEQ ID NO: 682078 - RNA, 64 nt, hsa; identical to SEQ ID NO: 55649

SEQ ID NO: 682079 - RNA, 64 nt, hsa; identical to SEQ ID NO: 55650

SEQ ID NO: 682080 - RNA, 64 nt, hsa; identical to SEQ ID NO: 55651

SEQ ID NO: 682081 - RNA, 64 nt, hsa; identical to SEQ ID NO: 55652

SEQ ID NO: 682082 - RNA, 64 nt, hsa; identical to SEQ ID NO: 55653

SEQ ID NO: 682083 - RNA, 64 nt, hsa; identical to SEQ ID NO: 55654

SEQ ID NO: 682084 - RNA, 64 nt, hsa; identical to SEQ ID NO: 55655

SEQ ID NO: 682085 - RNA, 64 nt, hsa; identical to SEQ ID NO: 55656

SEQ ID NO: 682086 - RNA, 64 nt, hsa; identical to SEQ ID NO: 55657

SEQ ID NO: 682087 - RNA, 64 nt, hsa; identical to SEQ ID NO: 55658

SEQ ID NO: 682088 - RNA, 64 nt, hsa; identical to SEQ ID NO: 55659

SEQ ID NO: 682089 - RNA, 64 nt, hsa; identical to SEQ ID NO: 55660

SEQ ID NO: 682090 - RNA, 64 nt, hsa; identical to SEQ ID NO: 55661

SEQ ID NO: 682091 - RNA, 64 nt, hsa; identical to SEQ ID NO: 55662

SEQ ID NO: 682092 - RNA, 64 nt, hsa; identical to SEQ ID NO: 55663

SEQ ID NO: 682093 - RNA, 64 nt, hsa; identical to SEQ ID NO: 55664

SEQ ID NO: 682094 - RNA, 64 nt, hsa; identical to SEQ ID NO: 55665

SEQ ID NO: 682095 - RNA, 64 nt, hsa; identical to SEQ ID NO: 55666

SEQ ID NO: 682096 - RNA, 64 nt, hsa
aaucugagggcagcagacuuuuaucagcuugaguuuaugucauuugauggacuugguucaacaa

SEQ ID NO: 682097 - RNA, 64 nt, hsa
gacuucagaaaacagucugucagacaaaaaggccuuaugucaccacugguaccucaguuuccuc

SEQ ID NO: 682098 - RNA, 64 nt, hsa
uguguuuaagccuacaaucauugauuuuuuuuuguuaugucacaaucaguauaucuucuuuggg

SEQ ID NO: 682099 - RNA, 64 nt, hsa
guugcggagaaaggagucauacuugugaagacuuuuaugucacuacucuaaagauuuugcuguu

SEQ ID NO: 682100 - RNA, 64 nt, hsa
cauggauauauuuaugucacugaguugucagaaauuaugucaaaaugaaaacuguuuguuucau

SEQ ID NO: 682101 - RNA, 64 nt, hsa
augucaaacaaaauaggagcucacauggauauauuuaugucacugaguugucagaaauuauguc

SEQ ID NO: 682102 - RNA, 64 nt, hsa
uuauuagcucuacuacuugaaugauuuuggaauuuuaugucaugcuaagguauguguuacauau

SEQ ID NO: 682103 - RNA, 64 nt, hsa
ggagaggugggauucauuacaagacuuugggcucuuaugucacaucacaugauuuggagaaauu

SEQ ID NO: 682104 - RNA, 64 nt, hsa
ggacccuagaauccuugugauuuuucuuagcaccuuaugucagggaaaccuaaacugaggucag

SEQ ID NO: 682105 - RNA, 64 nt, hsa
gcuagugaguggugcaguccaggacaccuuugcuuuaugucacuuacacggucaccuggagccg

SEQ ID NO: 682106 - RNA, 64 nt, hsa
cuucaggaugcauugcaaucauccuuuucuuaaauuaugucacuagucuuuuauuuuuuccccu

SEQ ID NO: 682107 - RNA, 64 nt, hsa
gcuuucuugguggacuaguauaguauacggucaguuaugucaauguuucauggucaauaaaaag

SEQ ID NO: 682108 - RNA, 64 nt, hsa
uccccauggauuggggccucccaggccccccaccuuaugucaaccugcacuucuuguucaaaaa

SEQ ID NO: 682109 - RNA, 64 nt, hsa
aucgauggggaacucacuuccuuuggaaaaauucuuaugucaagcugaaauucucuaauuuuuu

SEQ ID NO: 682110 - RNA, 64 nt, hsa
gaaccauuaaaaauuugagaagaaacaacaaguauuaugucaacuuacuucaaaggcguaguuu

SEQ ID NO: 682111 - RNA, 64 nt, hsa
cuuccagcuuuucacugugugggggucuuuucucuuaugucagcucuuucuaucacauggcagc

SEQ ID NO: 682112 - RNA, 64 nt, hsa
uauuuuaggggagauguagguguagaauuauugcuuaugucauuucuuaagcaguuaugcucuu

SEQ ID NO: 682113 - RNA, 64 nt, hsa
auaguaauaaaauuacuucuguugaguaaacuuuuuaugucaucguaaaagcugaaaaaauccc

SEQ ID NO: 682114 - RNA, 64 nt, hsa
cuagauaaaagugguucuuucucaguaguuauuauuaugucaaaaugugccuccagagugauaa

SEQ ID NO: 682115 - RNA, 64 nt, hsa
aauggcaccauauuuggccuagcaggauuuauuuuuaugucaucaccucccuugccuuuguuuc

SEQ ID NO: 682116 - RNA, 64 nt, hsa
cccacccccucucaggcacaaaagccgguguccagggacucaagaccuguaccugggguugcag

SEQ ID NO: 682117 - RNA, 64 nt, hsa
uccaagggcuuggccuggaaaggcaggcucaccugggacucaacguuccuucccccgccgccac

SEQ ID NO: 682118 - RNA, 58 nt, hsa
uacugccaacaaagaagacucaacuucucagaucuauaaugggauacauugucauccu

SEQ ID NO: 682119 - RNA, 58 nt, hsa
uagauguuuguuucaagaccagcuguuucagaucuauuaauguagggaauuuuucccu

SEQ ID NO: 682120 - RNA, 58 nt, hsa
caugucaguggcaugaugcuugccaagccagaucuaggcaucuaggauaauuaaggua

SEQ ID NO: 682121 - RNA, 58 nt, hsa
gaaauuauugugugcuaaauuugggaaacagaucuauucuaacucauuaacccaguug

SEQ ID NO: 682122 - RNA, 64 nt, hsa; identical to SEQ ID NO: 429907

SEQ ID NO: 682123 - RNA, 64 nt, hsa; identical to SEQ ID NO: 429908

SEQ ID NO: 682124 - RNA, 64 nt, hsa; identical to SEQ ID NO: 429909

SEQ ID NO: 682125 - RNA, 64 nt, hsa; identical to SEQ ID NO: 429910

SEQ ID NO: 682126 - RNA, 64 nt, hsa; identical to SEQ ID NO: 429911

SEQ ID NO: 682127 - RNA, 64 nt, hsa; identical to SEQ ID NO: 429912

SEQ ID NO: 682128 - RNA, 64 nt, hsa; identical to SEQ ID NO: 429913

SEQ ID NO: 682129 - RNA, 64 nt, hsa; identical to SEQ ID NO: 429914

SEQ ID NO: 682130 - RNA, 64 nt, hsa; identical to SEQ ID NO: 429915

SEQ ID NO: 682131 - RNA, 64 nt, hsa; identical to SEQ ID NO: 429916

SEQ ID NO: 682132 - RNA, 64 nt, hsa; identical to SEQ ID NO: 429917

SEQ ID NO: 682133 - RNA, 64 nt, hsa; identical to SEQ ID NO: 429918

SEQ ID NO: 682134 - RNA, 64 nt, hsa; identical to SEQ ID NO: 429919

SEQ ID NO: 682135 - RNA, 64 nt, hsa; identical to SEQ ID NO: 429920

SEQ ID NO: 682136 - RNA, 64 nt, hsa; identical to SEQ ID NO: 429921

SEQ ID NO: 682137 - RNA, 64 nt, hsa; identical to SEQ ID NO: 429922

SEQ ID NO: 682138 - RNA, 64 nt, hsa; identical to SEQ ID NO: 141176

SEQ ID NO: 682139 - RNA, 64 nt, hsa; identical to SEQ ID NO: 141177

SEQ ID NO: 682140 - RNA, 64 nt, hsa; identical to SEQ ID NO: 141178

SEQ ID NO: 682141 - RNA, 64 nt, hsa; identical to SEQ ID NO: 141179

SEQ ID NO: 682142 - RNA, 64 nt, hsa; identical to SEQ ID NO: 141180

SEQ ID NO: 682143 - RNA, 64 nt, hsa; identical to SEQ ID NO: 141181

SEQ ID NO: 682144 - RNA, 64 nt, hsa; identical to SEQ ID NO: 141182

SEQ ID NO: 682145 - RNA, 64 nt, hsa; identical to SEQ ID NO: 141183

SEQ ID NO: 682146 - RNA, 64 nt, hsa; identical to SEQ ID NO: 141184

SEQ ID NO: 682147 - RNA, 64 nt, hsa; identical to SEQ ID NO: 141185

SEQ ID NO: 682148 - RNA, 64 nt, hsa; identical to SEQ ID NO: 141186

SEQ ID NO: 682149 - RNA, 64 nt, hsa; identical to SEQ ID NO: 141187

SEQ ID NO: 682150 - RNA, 64 nt, hsa; identical to SEQ ID NO: 141188

SEQ ID NO: 682151 - RNA, 64 nt, hsa; identical to SEQ ID NO: 141189

SEQ ID NO: 682152 - RNA, 64 nt, hsa; identical to SEQ ID NO: 141190

SEQ ID NO: 682153 - RNA, 64 nt, hsa; identical to SEQ ID NO: 141191

SEQ ID NO: 682154 - RNA, 64 nt, hsa; identical to SEQ ID NO: 141192

SEQ ID NO: 682155 - RNA, 64 nt, hsa; identical to SEQ ID NO: 141193

SEQ ID NO: 682156 - RNA, 64 nt, hsa; identical to SEQ ID NO: 141194

SEQ ID NO: 682157 - RNA, 64 nt, hsa; identical to SEQ ID NO: 141195

SEQ ID NO: 682158 - RNA, 64 nt, hsa; identical to SEQ ID NO: 141196

SEQ ID NO: 682159 - RNA, 64 nt, hsa; identical to SEQ ID NO: 141197

SEQ ID NO: 682160 - RNA, 64 nt, hsa; identical to SEQ ID NO: 141198

SEQ ID NO: 682161 - RNA, 64 nt, hsa; identical to SEQ ID NO: 141199

SEQ ID NO: 682162 - RNA, 64 nt, hsa; identical to SEQ ID NO: 141200

SEQ ID NO: 682163 - RNA, 64 nt, hsa; identical to SEQ ID NO: 141201

SEQ ID NO: 682164 - RNA, 64 nt, hsa; identical to SEQ ID NO: 141202

SEQ ID NO: 682165 - RNA, 64 nt, hsa; identical to SEQ ID NO: 141203

SEQ ID NO: 682166 - RNA, 64 nt, hsa; identical to SEQ ID NO: 141204

SEQ ID NO: 682167 - RNA, 64 nt, hsa; identical to SEQ ID NO: 141205

SEQ ID NO: 682168 - RNA, 64 nt, hsa; identical to SEQ ID NO: 141206

SEQ ID NO: 682169 - RNA, 64 nt, hsa; identical to SEQ ID NO: 141207

SEQ ID NO: 682170 - RNA, 64 nt, hsa; identical to SEQ ID NO: 141208

SEQ ID NO: 682171 - RNA, 64 nt, hsa; identical to SEQ ID NO: 141209

SEQ ID NO: 682172 - RNA, 64 nt, hsa; identical to SEQ ID NO: 141210

SEQ ID NO: 682173 - RNA, 64 nt, hsa; identical to SEQ ID NO: 141211

SEQ ID NO: 682174 - RNA, 64 nt, hsa; identical to SEQ ID NO: 141212

SEQ ID NO: 682175 - RNA, 64 nt, hsa; identical to SEQ ID NO: 141213

SEQ ID NO: 682176 - RNA, 64 nt, hsa; identical to SEQ ID NO: 141214

SEQ ID NO: 682177 - RNA, 64 nt, hsa; identical to SEQ ID NO: 141215

SEQ ID NO: 682178 - RNA, 64 nt, hsa; identical to SEQ ID NO: 141216

SEQ ID NO: 682179 - RNA, 64 nt, hsa; identical to SEQ ID NO: 141217

SEQ ID NO: 682180 - RNA, 64 nt, hsa; identical to SEQ ID NO: 141218

SEQ ID NO: 682181 - RNA, 64 nt, hsa; identical to SEQ ID NO: 141219

SEQ ID NO: 682182 - RNA, 64 nt, hsa; identical to SEQ ID NO: 141220

SEQ ID NO: 682183 - RNA, 64 nt, hsa; identical to SEQ ID NO: 141221

SEQ ID NO: 682184 - RNA, 64 nt, hsa
agcucaauuuauguuuauuggaagaacauuuuacuuaaaugauuugaggggugggagggaguga

SEQ ID NO: 682185 - RNA, 64 nt, hsa
ucaucugcagucaaauaacugagccaauccaaauuuaaaugauagaugcuuuaauugaguuuaa

SEQ ID NO: 682186 - RNA, 64 nt, hsa
caucagacauuuuuuuucuagggacgcuuacuaauuaaaugauuuaaguuguuucuuagggguu

SEQ ID NO: 682187 - RNA, 64 nt, hsa
uuggggaugguuaaaacaaauuacuauagaacauuuaaaugaucaguuuaaggggaaauaggcu

SEQ ID NO: 682188 - RNA, 64 nt, hsa
aaacuaaauugaccaugcauauaauauucuuuguuuaaaugaaagcauacuguugaaacccgca

SEQ ID NO: 682189 - RNA, 64 nt, hsa
cuucuagauauucuaguauuugcuucugguggaauuaaaugacgguaaaauuggcuaauuauuu

SEQ ID NO: 682190 - RNA, 64 nt, hsa
uagaauuuuauugaaaggccuagguauuaauuuuuuaaaugagugcuuuaacuuaaaacaggcg

SEQ ID NO: 682191 - RNA, 64 nt, hsa
aguaucuguaaccucccacugcaucagaagcagguuaaaugaagucuugugaauuuguaauaga

SEQ ID NO: 682192 - RNA, 64 nt, hsa
cuggaacaugccucugcauuucugaguguagaaauuaaaugaagccacucacaguccuuugauu

SEQ ID NO: 682193 - RNA, 64 nt, hsa
acaggcuuaggacucugugccaaaaaucucuauuuuaaaugaaaauauuuauauaaaaauacau

SEQ ID NO: 682194 - RNA, 64 nt, hsa
uauaccuauaaacuaguaccuaauucacuguuaguuaaaugagcuauagauaaggcagcuaaau

SEQ ID NO: 682195 - RNA, 64 nt, hsa
gcacuuuucaucuugguaauaucaaaacaacuuuuuaaaugaacugauugauauauguuauuuc

SEQ ID NO: 682196 - RNA, 64 nt, hsa
auuguagaauuagaaugggauuuacuguacuguuuuaaaugagauuggcuucagaauccauuac

SEQ ID NO: 682197 - RNA, 64 nt, hsa
cauuacaguuaccuuacauagcacuugauacguguuaaaugaacauaugaauguaauuuauaua

SEQ ID NO: 682198 - RNA, 64 nt, hsa
acuuauuaucuugagagcaaauaacuuggaaaauuuaaaugagauaaugcaguugcaacugugu

SEQ ID NO: 682199 - RNA, 64 nt, hsa
aucuucauugugaaacccuuccccugugcugagauuaaaugaacucuaagauuauuaaauagua

SEQ ID NO: 682200 - RNA, 64 nt, hsa
aagauguuauaguaaauuuauuuuauuuuagauauuaaaugauguuuuauuagauaaauuucaa

SEQ ID NO: 682201 - RNA, 64 nt, hsa
uuuauuauguacaaauagauucuuauaauauuauuuaaaugacugcauuuuuaaauacaaggcu

SEQ ID NO: 682202 - RNA, 64 nt, hsa
auugaacuaauuuauacuuuaaaguauuucuggguuaaaugaaacaaugaaauuuuuuaguaug

SEQ ID NO: 682203 - RNA, 64 nt, hsa
cuuagugaagcauaaaguuaccuacaucaauuaauuaaaugaacuuauguacagaaaacaugua

SEQ ID NO: 682204 - RNA, 64 nt, hsa
auaaagcuauaaaauucaauaacuuuuuagaauguuaaaugaagacacuguuuccuaacaucag

SEQ ID NO: 682205 - RNA, 64 nt, hsa
aaagugcugcugauaugauacaaguagacaaaauuuaaaugaaauuuugucacauucuauggaa

SEQ ID NO: 682206 - RNA, 64 nt, hsa
uuuccuaaaguuuguguuuugucgacaguaucuuuuaaaugagucuuaaaaauaaaggcauauu

SEQ ID NO: 682207 - RNA, 64 nt, hsa
cuaguacugaaauuacuaaauuggguaagaugauuuaaaugauuuuaauuuuaacauuuuauuu

SEQ ID NO: 682208 - RNA, 64 nt, hsa
guugaccuucugauugaauauaagcacaaccauauuaaaugaaucaauacaagaaaauuauuuc

SEQ ID NO: 682209 - RNA, 64 nt, hsa
ggaaaagggcaaaaucgcuucaguuaaacugaaauuaaaugaacaauaaggcaacuauauaagu

SEQ ID NO: 682210 - RNA, 64 nt, hsa
acagucuugccagucagcaauuucuaacagcauuuuaaaugaguuugauguacaguaaauauug

SEQ ID NO: 682211 - RNA, 64 nt, hsa
agcaguucucugcugcaauauucccauugaccacuuaaaugaccauaaguggucauuuaagaac

SEQ ID NO: 682212 - RNA, 64 nt, hsa
gauccuggauugagacgaaugccauuggaaccuguuaaaugaguaguuuguuaugugucuggaa

SEQ ID NO: 682213 - RNA, 64 nt, hsa
cugcaucugauaaaguugagagacaguaacacaauuaaaugacuuagaaacaauguuugcuuuu

SEQ ID NO: 682214 - RNA, 64 nt, hsa
uuuuaauuuuuuaaaugaaaccauauuuuaaguguuaaaugaaucaaugcucacauuaauuugc

SEQ ID NO: 682215 - RNA, 64 nt, hsa
uuaguuuuugaaguguugaaguauuuuuaauuuuuuaaaugaaaccauauuuuaaguguuaaau

SEQ ID NO: 682216 - RNA, 64 nt, hsa
cuauauuaguuuauuguuaggaucaaugauaaauuuaaaugaccucagaucuuugcaccagaua

SEQ ID NO: 682217 - RNA, 64 nt, hsa
aguggaguuuaaaaauugucucuuuucaacuuauuuaaaugacagcaccugagaagaggaaccg

SEQ ID NO: 682218 - RNA, 64 nt, hsa
aaugaaauuaaaaggcaaaagaacaugauugagcuuaaaugaucauuucuuccugcagugauuc

SEQ ID NO: 682219 - RNA, 64 nt, hsa
acuguaaagcuuuuaugacucuaauauuaaucucuuaaaugaaauuaaaaggcaaaagaacaug

SEQ ID NO: 682220 - RNA, 64 nt, hsa
augagacaaucauauuauuuuagaaucauuuauuuuaaaugagacaaucauuuuaaguuuuaag

SEQ ID NO: 682221 - RNA, 64 nt, hsa
gaaggauauacauuauuuuagaaucauuuacuauuuaaaugagacaaucauauuauuuuagaau

SEQ ID NO: 682222 - RNA, 64 nt, hsa
ugguucuuguguuauaaauguugugagcaacagauuaaaugaugcugaggaaugaaaaaagauu

SEQ ID NO: 682223 - RNA, 64 nt, hsa
gcgacagagcgagacuccgucucaaaaaaaaaaguuaaaugacuugaguacccaaaagaaaugu

SEQ ID NO: 682224 - RNA, 64 nt, hsa
aguaugcugucaaauuaucguggguugaaacuuguuaaaugagauuucaacugacuuagugaua

SEQ ID NO: 682225 - RNA, 64 nt, hsa
uuaaccacuuaaugugaugaaauauuccuaaaaguuaaaugacuauuaaagcauauauuguugc

SEQ ID NO: 682226 - RNA, 64 nt, hsa
uagacaugccuuagguaacugcagaaauagcaaauuaaaugauuaaugagcuuauuagucauag

SEQ ID NO: 682227 - RNA, 64 nt, hsa
auaauccaccacuaccaagagagauuucugugucuuaaaugauuuggugcauauuuugcaacau

SEQ ID NO: 682228 - RNA, 64 nt, hsa
gauaauuccgaccuaccucugaaaaauguguagauuaaaugaguuuuuaaagcacuuuagaaaa

SEQ ID NO: 682229 - RNA, 64 nt, hsa
uuuuuaccugauucagaugucuuacauuuuuauauuaaaugaaccuuaagcaugauucuuuugg

SEQ ID NO: 682230 - RNA, 64 nt, hsa
ucagccacauacuguagagagaggcaauuuaauguuaaaugacgcaccauccucccucccaccc

SEQ ID NO: 682231 - RNA, 64 nt, hsa
auccuccagcucuuaaagcuuaccugagaaagcuuuaaaugagaaaaggaccaugcgauuggug

SEQ ID NO: 682232 - RNA, 64 nt, hsa
uuguuguuucaaaaugaacagcgaagccuuaacuuuaaaugacauuuguauucucagacacuga

SEQ ID NO: 682233 - RNA, 64 nt, hsa
aaaaauucauaacagcaaccuugaaaaaauagacuuaaaugaaugcuucuagaaacuuccagcg

SEQ ID NO: 682234 - RNA, 64 nt, hsa
aaaugguaauauaacaauauaugauauauaaaccuuaaaugaaaaaaaugaucuauugcagaua

SEQ ID NO: 682235 - RNA, 64 nt, hsa
uuuauuuaaagaaaaaaaaggcaguauucccuuuuuaaaugagcuuucaggaaguugcugagaa

SEQ ID NO: 682236 - RNA, 64 nt, hsa
acauuggauguuauuugcuuauauucuuauaauuuuaaaugagggcacagugaaaugaaaauuu

SEQ ID NO: 682237 - RNA, 64 nt, hsa
aaacguaauuauuauuuaaaugaaagcuauuuuuuuaaaugaauugaaauuuuucaugaugcua

SEQ ID NO: 682238 - RNA, 64 nt, hsa
uauauacagagauaaagcuaaacguaauuauuauuuaaaugaaagcuauuuuuuuaaaugaauu

SEQ ID NO: 682239 - RNA, 64 nt, hsa
gaacagaaauaagaauuaaugaaaauuuaaaagauuaaaugaaugagaagaaaugauucauaaa

SEQ ID NO: 682240 - RNA, 64 nt, hsa
aaauaauuuaaaacaaauuaaagugauauaugaguuaaaugaccaagcagacuugauuccagga

SEQ ID NO: 682241 - RNA, 64 nt, hsa
cuuuaucugcaucauugcuguuuguuacuauaaauuaaaugaaccucauggaaagguugaggug

SEQ ID NO: 682242 - RNA, 64 nt, hsa
cuaggucaagcuguguaaaagucauuuauguuauuuaaaugauguacuguacugcuguuuacau

SEQ ID NO: 682243 - RNA, 64 nt, hsa
uuccuguaagggggcuccauuuuccucccucucuuuaaaugaccaccuaaaggacaguauauua

SEQ ID NO: 682244 - RNA, 64 nt, hsa
cugggucucaauccccuuggaaauucuuggugcauuaaaugaagccuuaccccauuacugcggu

SEQ ID NO: 682245 - RNA, 64 nt, hsa
acaucuuaugaucaaauaacuuucaggauguauuuuaaaugagcugcaagagagaaaaaucuga

SEQ ID NO: 682246 - RNA, 64 nt, hsa
uuaaaacauuuauauaccucauucuuuaguguuguuaaaugaaaaauuaaaauuuguguuuauu

SEQ ID NO: 682247 - RNA, 64 nt, hsa
gcagaaauuaaaugaauuuuucuuccugauuccuuuaaaugaauaugaaacacuacaaauuuau

SEQ ID NO: 682248 - RNA, 64 nt, hsa
agaauuuuugaagugacugggcaggcagcagaaauuaaaugaauuuuucuuccugauuccuuua

SEQ ID NO: 682249 - RNA, 64 nt, hsa
acucagguuuaauagucuuauaaaaaguaaucaguuaaaugauuacuugcuuauaaauaucuaa

SEQ ID NO: 682250 - RNA, 64 nt, hsa
uacuucaggaaaugaauauaaaauagguucacaguuaaaugaauaagcuuuuguuuauuugugg

SEQ ID NO: 682251 - RNA, 64 nt, hsa
cauagaucagaauuuuaaauuaaagguuuuuucuuuaaaugauuuguauuacuuuauuaaaacu

SEQ ID NO: 682252 - RNA, 64 nt, hsa
gcccggaggcuuccgaaucuagcaaagcagcauauuaaaugacuccaccugcgcaguccuugug

SEQ ID NO: 682253 - RNA, 64 nt, hsa
uaaauacuuaccuacauacacugcauguagaugauuaaaugagggcaggcccugugcucauagc

SEQ ID NO: 682254 - RNA, 64 nt, hsa
uuuaguuguugcauuuuucggacacuggaaacauuuaaaugaucaggagggaguaacagaaaga

SEQ ID NO: 682255 - RNA, 64 nt, hsa
uaaaggaagaauaagucacuguaaaacagaacuuuuaaaugaagcuuaaauuacucaauuuaaa

SEQ ID NO: 682256 - RNA, 64 nt, hsa
uaaauuauguauuuuauugccucugaguaucauauuaaaugaauauuuuauuuuaaaggcuuaa

SEQ ID NO: 682257 - RNA, 64 nt, hsa
uagcugagcuuucuaaaaugauagcucucuauuuuuaaaugaauuugaaaagucgauuaaauua

SEQ ID NO: 682258 - RNA, 64 nt, hsa
ugguuuauucuuuuucuuuacagcugaaauugcuuuaaaugaugguuaaaauuacaaauuaaau

SEQ ID NO: 682259 - RNA, 64 nt, hsa
uuacauuucugauacaugcagauagcagaugucuuuaaaugaaauacauguauauuguguaugg

SEQ ID NO: 682260 - RNA, 64 nt, hsa
uagauucuaagguucaagauuuuuaaaauuugauuuaaaugaagaaauggauuuuucucucugc

SEQ ID NO: 682261 - RNA, 64 nt, hsa
ggguuuuuaaagacagcaagucuggucauucaguuuaaaugaaugguuauacuguuuuuaauga

SEQ ID NO: 682262 - RNA, 64 nt, hsa
caauugcuaucuauuuuuuuauccagaggcuuaauuaaaugaugugguaaaaugauguuugagc

SEQ ID NO: 682263 - RNA, 64 nt, hsa
uuuuacaagucagauuuuuuguuccccaaaucuuuuaaaugaagccagugacucccaguucuca

SEQ ID NO: 682264 - RNA, 64 nt, hsa
agcuuaaugacuuacuuagaauuuauccuuuauuuuaaaugaucuguacuaucuagugucuaaa

SEQ ID NO: 682265 - RNA, 64 nt, hsa
aagcagcacacauuguguuaacuuaugucucuuguuaaaugagcuuaaugucuuuguguuuugu

SEQ ID NO: 682266 - RNA, 64 nt, hsa
uauugaaaaauguuacagacaacuugccugauuuuuaaaugagcguaaaaggcccucuaaccua

SEQ ID NO: 682267 - RNA, 64 nt, hsa
aagugacaccgagguuuuuaucgaagcauuucacuuaaaugaacaaaucauggcuguuauauua

SEQ ID NO: 682268 - RNA, 64 nt, hsa
guuacaaauuuuuuaauuuccaaaauaaucuauauuaaaugaggguuucugaucuguacuuugu

SEQ ID NO: 682269 - RNA, 64 nt, hsa
uugauuugaucuuuguuuaaaugccaaaauguacuuaaaugaguuacuuagaaugccauaaaau

SEQ ID NO: 682270 - RNA, 64 nt, hsa
agaagugcaaauugacuuuuacauucaacuuuaguuaaaugaaggcacucaguauucuuccuga

SEQ ID NO: 682271 - RNA, 64 nt, hsa
gucuagugaccuguucaggacaccugaaauauaauuaaaugacaauuaucaagguuuuaacaau

SEQ ID NO: 682272 - RNA, 64 nt, hsa
aaaaauucuuaauauuuucauaaaauuuguauuuuuaaaugaaaauucuaaauguuguauuuua

SEQ ID NO: 682273 - RNA, 64 nt, hsa
gaauguaggacuuaugauccaauucaccaaaagauuaaaugaaaccacccuguguuuuaaaaua

SEQ ID NO: 682274 - RNA, 64 nt, hsa
cuuuuucaaaauuuaaauugagcugcuaucaauauuaaaugaaguuauggcaucuacccuguag

SEQ ID NO: 682275 - RNA, 64 nt, hsa
gaccucccaaaguggguggcuuaccagaccacccuuaaaugacuuucaucugguuuccucuuuc

SEQ ID NO: 682276 - RNA, 64 nt, hsa
uggauuuccuccuuccuuccaaguucugagauucuuaaaugagagcuggcugucuucuagaggu

SEQ ID NO: 682277 - RNA, 64 nt, hsa
gcuugucuccugaauguccucugaauauuuauaguuaaaugauuuauauuugaaauguguugcc

SEQ ID NO: 682278 - RNA, 64 nt, hsa
augacugcccugugcuggccaaaagauuuuuauuuuaaaugaauagugagucagaucuauugcu

SEQ ID NO: 682279 - RNA, 64 nt, hsa
gcuugccagcuucuagcuugagagaagggauauuuuaaaugagaucauuaacgugaaacuauua

SEQ ID NO: 682280 - RNA, 64 nt, hsa
ugguggugguuauuuggucuuuaagugaacugucuuaaaugagaaacguuuuugucauuuugac

SEQ ID NO: 682281 - RNA, 64 nt, hsa
gacauaucagagcaguguauuucuggaucauuuuuuaaaugaccucuucuaaaacauaacuguc

SEQ ID NO: 682282 - RNA, 64 nt, hsa
acacacacacacacacgugcacacacacacacauuuaaaugauauaaaaagaagagguugaaag

SEQ ID NO: 682283 - RNA, 64 nt, hsa
auuuuauaaucagacuuagauuguguuuagaauauuaaaugacugggcacccucuucuugguuu

SEQ ID NO: 682284 - RNA, 64 nt, hsa
accuucuuaaaacagaaaauuuaaguaaagucuuuuaaaugaaaccuguaaaaguauugacucu

SEQ ID NO: 682285 - RNA, 64 nt, hsa
agucuggagauaauuuugcaacucauguuauggguuaaaugaauauuuuuguaaaaguaaaagc

SEQ ID NO: 682286 - RNA, 64 nt, hsa
auguguuuuguaucuucccuuucaagugaugauguuaaaugaagguaaguuuuucauccuuuuu

SEQ ID NO: 682287 - RNA, 64 nt, hsa
ccugcugcugcuccugcuuuccucucuucucgcuuuaaaugauuguuagcaaguuagauuuucc

SEQ ID NO: 682288 - RNA, 64 nt, hsa; identical to SEQ ID NO: 176114

SEQ ID NO: 682289 - RNA, 64 nt, hsa; identical to SEQ ID NO: 176115

SEQ ID NO: 682290 - RNA, 64 nt, hsa; identical to SEQ ID NO: 176116

SEQ ID NO: 682291 - RNA, 64 nt, hsa; identical to SEQ ID NO: 176117

SEQ ID NO: 682292 - RNA, 64 nt, hsa; identical to SEQ ID NO: 176118

SEQ ID NO: 682293 - RNA, 64 nt, hsa; identical to SEQ ID NO: 176119

SEQ ID NO: 682294 - RNA, 64 nt, hsa; identical to SEQ ID NO: 176120

SEQ ID NO: 682295 - RNA, 64 nt, hsa; identical to SEQ ID NO: 176121

SEQ ID NO: 682296 - RNA, 64 nt, hsa; identical to SEQ ID NO: 176122

SEQ ID NO: 682297 - RNA, 64 nt, hsa; identical to SEQ ID NO: 176123

SEQ ID NO: 682298 - RNA, 64 nt, hsa; identical to SEQ ID NO: 176124

SEQ ID NO: 682299 - RNA, 64 nt, hsa; identical to SEQ ID NO: 176125

SEQ ID NO: 682300 - RNA, 64 nt, hsa; identical to SEQ ID NO: 176126

SEQ ID NO: 682301 - RNA, 64 nt, hsa; identical to SEQ ID NO: 176127

SEQ ID NO: 682302 - RNA, 64 nt, hsa; identical to SEQ ID NO: 176128

SEQ ID NO: 682303 - RNA, 64 nt, hsa; identical to SEQ ID NO: 176129

SEQ ID NO: 682304 - RNA, 64 nt, hsa; identical to SEQ ID NO: 176130

SEQ ID NO: 682305 - RNA, 64 nt, hsa; identical to SEQ ID NO: 176131

SEQ ID NO: 682306 - RNA, 64 nt, hsa; identical to SEQ ID NO: 176132

SEQ ID NO: 682307 - RNA, 64 nt, hsa; identical to SEQ ID NO: 176133

SEQ ID NO: 682308 - RNA, 64 nt, hsa; identical to SEQ ID NO: 176134

SEQ ID NO: 682309 - RNA, 64 nt, hsa; identical to SEQ ID NO: 176135

SEQ ID NO: 682310 - RNA, 64 nt, hsa; identical to SEQ ID NO: 176136

SEQ ID NO: 682311 - RNA, 64 nt, hsa; identical to SEQ ID NO: 176137

SEQ ID NO: 682312 - RNA, 64 nt, hsa; identical to SEQ ID NO: 176138

SEQ ID NO: 682313 - RNA, 64 nt, hsa; identical to SEQ ID NO: 176139

SEQ ID NO: 682314 - RNA, 64 nt, hsa; identical to SEQ ID NO: 176140

SEQ ID NO: 682315 - RNA, 64 nt, hsa; identical to SEQ ID NO: 176141

SEQ ID NO: 682316 - RNA, 64 nt, hsa; identical to SEQ ID NO: 176142

SEQ ID NO: 682317 - RNA, 64 nt, hsa; identical to SEQ ID NO: 176143

SEQ ID NO: 682318 - RNA, 64 nt, hsa; identical to SEQ ID NO: 176144

SEQ ID NO: 682319 - RNA, 64 nt, hsa; identical to SEQ ID NO: 176145

SEQ ID NO: 682320 - RNA, 64 nt, hsa; identical to SEQ ID NO: 176146

SEQ ID NO: 682321 - RNA, 64 nt, hsa; identical to SEQ ID NO: 176147

SEQ ID NO: 682322 - RNA, 64 nt, hsa; identical to SEQ ID NO: 176148

SEQ ID NO: 682323 - RNA, 64 nt, hsa; identical to SEQ ID NO: 176149

SEQ ID NO: 682324 - RNA, 64 nt, hsa; identical to SEQ ID NO: 176150

SEQ ID NO: 682325 - RNA, 64 nt, hsa; identical to SEQ ID NO: 176151

SEQ ID NO: 682326 - RNA, 64 nt, hsa; identical to SEQ ID NO: 176152

SEQ ID NO: 682327 - RNA, 64 nt, hsa; identical to SEQ ID NO: 176153

SEQ ID NO: 682328 - RNA, 64 nt, hsa; identical to SEQ ID NO: 176154

SEQ ID NO: 682329 - RNA, 64 nt, hsa; identical to SEQ ID NO: 176155

SEQ ID NO: 682330 - RNA, 64 nt, hsa; identical to SEQ ID NO: 176156

SEQ ID NO: 682331 - RNA, 57 nt, hsa; identical to SEQ ID NO: 176157

SEQ ID NO: 682332 - RNA, 64 nt, hsa; identical to SEQ ID NO: 176158

SEQ ID NO: 682333 - RNA, 64 nt, hsa; identical to SEQ ID NO: 176159

SEQ ID NO: 682334 - RNA, 64 nt, hsa; identical to SEQ ID NO: 176160

SEQ ID NO: 682335 - RNA, 64 nt, hsa; identical to SEQ ID NO: 176161

SEQ ID NO: 682336 - RNA, 64 nt, hsa; identical to SEQ ID NO: 176162

SEQ ID NO: 682337 - RNA, 64 nt, hsa; identical to SEQ ID NO: 176163

SEQ ID NO: 682338 - RNA, 64 nt, hsa; identical to SEQ ID NO: 176164

SEQ ID NO: 682339 - RNA, 64 nt, hsa; identical to SEQ ID NO: 176165

SEQ ID NO: 682340 - RNA, 64 nt, hsa; identical to SEQ ID NO: 176166

SEQ ID NO: 682341 - RNA, 64 nt, hsa; identical to SEQ ID NO: 176167

SEQ ID NO: 682342 - RNA, 64 nt, hsa; identical to SEQ ID NO: 176168

SEQ ID NO: 682343 - RNA, 64 nt, hsa; identical to SEQ ID NO: 176169

SEQ ID NO: 682344 - RNA, 64 nt, hsa; identical to SEQ ID NO: 176170

SEQ ID NO: 682345 - RNA, 64 nt, hsa; identical to SEQ ID NO: 176171

SEQ ID NO: 682346 - RNA, 64 nt, hsa; identical to SEQ ID NO: 176172

SEQ ID NO: 682347 - RNA, 64 nt, hsa; identical to SEQ ID NO: 176173

SEQ ID NO: 682348 - RNA, 64 nt, hsa; identical to SEQ ID NO: 176174

SEQ ID NO: 682349 - RNA, 64 nt, hsa; identical to SEQ ID NO: 176175

SEQ ID NO: 682350 - RNA, 64 nt, hsa; identical to SEQ ID NO: 176176

SEQ ID NO: 682351 - RNA, 64 nt, hsa; identical to SEQ ID NO: 176177

SEQ ID NO: 682352 - RNA, 64 nt, hsa; identical to SEQ ID NO: 176178

SEQ ID NO: 682353 - RNA, 64 nt, hsa; identical to SEQ ID NO: 176179

SEQ ID NO: 682354 - RNA, 64 nt, hsa; identical to SEQ ID NO: 176180

SEQ ID NO: 682355 - RNA, 64 nt, hsa; identical to SEQ ID NO: 176181

SEQ ID NO: 682356 - RNA, 64 nt, hsa; identical to SEQ ID NO: 176182

SEQ ID NO: 682357 - RNA, 64 nt, hsa; identical to SEQ ID NO: 176183

SEQ ID NO: 682358 - RNA, 64 nt, hsa; identical to SEQ ID NO: 176184

SEQ ID NO: 682359 - RNA, 64 nt, hsa; identical to SEQ ID NO: 176185

SEQ ID NO: 682360 - RNA, 64 nt, hsa; identical to SEQ ID NO: 176186

SEQ ID NO: 682361 - RNA, 64 nt, hsa; identical to SEQ ID NO: 176187

SEQ ID NO: 682362 - RNA, 64 nt, hsa; identical to SEQ ID NO: 176188

SEQ ID NO: 682363 - RNA, 64 nt, hsa; identical to SEQ ID NO: 176189

SEQ ID NO: 682364 - RNA, 64 nt, hsa; identical to SEQ ID NO: 176190

SEQ ID NO: 682365 - RNA, 64 nt, hsa; identical to SEQ ID NO: 176191

SEQ ID NO: 682366 - RNA, 64 nt, hsa; identical to SEQ ID NO: 176192

SEQ ID NO: 682367 - RNA, 64 nt, hsa; identical to SEQ ID NO: 176193

SEQ ID NO: 682368 - RNA, 53 nt, hsa; identical to SEQ ID NO: 176194

SEQ ID NO: 682369 - RNA, 64 nt, hsa; identical to SEQ ID NO: 176195

SEQ ID NO: 682370 - RNA, 64 nt, hsa; identical to SEQ ID NO: 176196

SEQ ID NO: 682371 - RNA, 64 nt, hsa; identical to SEQ ID NO: 176197

SEQ ID NO: 682372 - RNA, 64 nt, hsa; identical to SEQ ID NO: 176198

SEQ ID NO: 682373 - RNA, 64 nt, hsa; identical to SEQ ID NO: 176199

SEQ ID NO: 682374 - RNA, 64 nt, hsa; identical to SEQ ID NO: 176200

SEQ ID NO: 682375 - RNA, 64 nt, hsa; identical to SEQ ID NO: 176201

SEQ ID NO: 682376 - RNA, 64 nt, hsa; identical to SEQ ID NO: 176202

SEQ ID NO: 682377 - RNA, 64 nt, hsa; identical to SEQ ID NO: 176203

SEQ ID NO: 682378 - RNA, 64 nt, hsa; identical to SEQ ID NO: 176204

SEQ ID NO: 682379 - RNA, 64 nt, hsa; identical to SEQ ID NO: 176205

SEQ ID NO: 682380 - RNA, 64 nt, hsa; identical to SEQ ID NO: 176206

SEQ ID NO: 682381 - RNA, 64 nt, hsa; identical to SEQ ID NO: 176207

SEQ ID NO: 682382 - RNA, 64 nt, hsa; identical to SEQ ID NO: 176208

SEQ ID NO: 682383 - RNA, 64 nt, hsa; identical to SEQ ID NO: 176209

SEQ ID NO: 682384 - RNA, 64 nt, hsa; identical to SEQ ID NO: 176210

SEQ ID NO: 682385 - RNA, 64 nt, hsa; identical to SEQ ID NO: 176211

SEQ ID NO: 682386 - RNA, 64 nt, hsa; identical to SEQ ID NO: 176212

SEQ ID NO: 682387 - RNA, 64 nt, hsa; identical to SEQ ID NO: 176213

SEQ ID NO: 682388 - RNA, 64 nt, hsa; identical to SEQ ID NO: 176214

SEQ ID NO: 682389 - RNA, 64 nt, hsa; identical to SEQ ID NO: 176215

SEQ ID NO: 682390 - RNA, 64 nt, hsa; identical to SEQ ID NO: 176216

SEQ ID NO: 682391 - RNA, 64 nt, hsa; identical to SEQ ID NO: 176217

SEQ ID NO: 682392 - RNA, 64 nt, hsa; identical to SEQ ID NO: 176218

SEQ ID NO: 682393 - RNA, 64 nt, hsa; identical to SEQ ID NO: 176219

SEQ ID NO: 682394 - RNA, 64 nt, hsa; identical to SEQ ID NO: 176220

SEQ ID NO: 682395 - RNA, 64 nt, hsa; identical to SEQ ID NO: 176221

SEQ ID NO: 682396 - RNA, 64 nt, hsa; identical to SEQ ID NO: 176222

SEQ ID NO: 682397 - RNA, 64 nt, hsa; identical to SEQ ID NO: 176223

SEQ ID NO: 682398 - RNA, 64 nt, hsa; identical to SEQ ID NO: 176220

SEQ ID NO: 682399 - RNA, 64 nt, hsa; identical to SEQ ID NO: 176225

SEQ ID NO: 682400 - RNA, 64 nt, hsa; identical to SEQ ID NO: 176226

SEQ ID NO: 682401 - RNA, 64 nt, hsa; identical to SEQ ID NO: 176227

SEQ ID NO: 682402 - RNA, 64 nt, hsa; identical to SEQ ID NO: 176228

SEQ ID NO: 682403 - RNA, 64 nt, hsa; identical to SEQ ID NO: 176229

SEQ ID NO: 682404 - RNA, 64 nt, hsa; identical to SEQ ID NO: 176230

SEQ ID NO: 682405 - RNA, 64 nt, hsa; identical to SEQ ID NO: 176231

SEQ ID NO: 682406 - RNA, 64 nt, hsa; identical to SEQ ID NO: 176232

SEQ ID NO: 682407 - RNA, 64 nt, hsa; identical to SEQ ID NO: 176233

SEQ ID NO: 682408 - RNA, 64 nt, hsa; identical to SEQ ID NO: 176234

SEQ ID NO: 682409 - RNA, 64 nt, hsa; identical to SEQ ID NO: 176235

SEQ ID NO: 682410 - RNA, 64 nt, hsa; identical to SEQ ID NO: 176236

SEQ ID NO: 682411 - RNA, 64 nt, hsa; identical to SEQ ID NO: 176237

SEQ ID NO: 682412 - RNA, 64 nt, hsa; identical to SEQ ID NO: 176238

SEQ ID NO: 682413 - RNA, 51 nt, hsa; identical to SEQ ID NO: 176239

SEQ ID NO: 682414 - RNA, 64 nt, hsa; identical to SEQ ID NO: 176240

SEQ ID NO: 682415 - RNA, 64 nt, hsa; identical to SEQ ID NO: 176241

SEQ ID NO: 682416 - RNA, 64 nt, hsa; identical to SEQ ID NO: 176242

SEQ ID NO: 682417 - RNA, 64 nt, hsa; identical to SEQ ID NO: 176243

SEQ ID NO: 682418 - RNA, 64 nt, hsa; identical to SEQ ID NO: 176244

SEQ ID NO: 682419 - RNA, 64 nt, hsa; identical to SEQ ID NO: 176245

SEQ ID NO: 682420 - RNA, 64 nt, hsa; identical to SEQ ID NO: 176246

SEQ ID NO: 682421 - RNA, 64 nt, hsa; identical to SEQ ID NO: 176247

SEQ ID NO: 682422 - RNA, 64 nt, hsa; identical to SEQ ID NO: 176248

SEQ ID NO: 682423 - RNA, 64 nt, hsa; identical to SEQ ID NO: 176249

SEQ ID NO: 682424 - RNA, 64 nt, hsa; identical to SEQ ID NO: 176250

SEQ ID NO: 682425 - RNA, 64 nt, hsa; identical to SEQ ID NO: 176251

SEQ ID NO: 682426 - RNA, 64 nt, hsa; identical to SEQ ID NO: 176252

SEQ ID NO: 682427 - RNA, 64 nt, hsa; identical to SEQ ID NO: 176253

SEQ ID NO: 682428 - RNA, 64 nt, hsa; identical to SEQ ID NO: 176254

SEQ ID NO: 682429 - RNA, 64 nt, hsa; identical to SEQ ID NO: 176255

SEQ ID NO: 682430 - RNA, 64 nt, hsa; identical to SEQ ID NO: 176256

SEQ ID NO: 682431 - RNA, 64 nt, hsa; identical to SEQ ID NO: 176257

SEQ ID NO: 682432 - RNA, 64 nt, hsa; identical to SEQ ID NO: 176258

SEQ ID NO: 682433 - RNA, 64 nt, hsa; identical to SEQ ID NO: 176259

SEQ ID NO: 682434 - RNA, 64 nt, hsa; identical to SEQ ID NO: 176260

SEQ ID NO: 682435 - RNA, 64 nt, hsa; identical to SEQ ID NO: 176261

SEQ ID NO: 682436 - RNA, 64 nt, hsa; identical to SEQ ID NO: 176262

SEQ ID NO: 682437 - RNA, 64 nt, hsa; identical to SEQ ID NO: 176263

SEQ ID NO: 682438 - RNA, 64 nt, hsa; identical to SEQ ID NO: 176264

SEQ ID NO: 682439 - RNA, 64 nt, hsa; identical to SEQ ID NO: 176265

SEQ ID NO: 682440 - RNA, 64 nt, hsa; identical to SEQ ID NO: 176266

SEQ ID NO: 682441 - RNA, 64 nt, hsa; identical to SEQ ID NO: 176267

SEQ ID NO: 682442 - RNA, 64 nt, hsa; identical to SEQ ID NO: 176268

SEQ ID NO: 682443 - RNA, 64 nt, hsa; identical to SEQ ID NO: 176269

SEQ ID NO: 682444 - RNA, 53 nt, hsa; identical to SEQ ID NO: 176270

SEQ ID NO: 682445 - RNA, 64 nt, hsa; identical to SEQ ID NO: 176271

SEQ ID NO: 682446 - RNA, 64 nt, hsa; identical to SEQ ID NO: 176272

SEQ ID NO: 682447 - RNA, 64 nt, hsa; identical to SEQ ID NO: 229070

SEQ ID NO: 682448 - RNA, 64 nt, hsa; identical to SEQ ID NO: 229071

SEQ ID NO: 682449 - RNA, 64 nt, hsa; identical to SEQ ID NO: 229072

SEQ ID NO: 682450 - RNA, 64 nt, hsa; identical to SEQ ID NO: 229073

SEQ ID NO: 682451 - RNA, 64 nt, hsa; identical to SEQ ID NO: 229074

SEQ ID NO: 682452 - RNA, 59 nt, hsa; identical to SEQ ID NO: 229075

SEQ ID NO: 682453 - RNA, 64 nt, hsa; identical to SEQ ID NO: 229076

SEQ ID NO: 682454 - RNA, 64 nt, hsa; identical to SEQ ID NO: 229077

SEQ ID NO: 682455 - RNA, 64 nt, hsa; identical to SEQ ID NO: 259689

SEQ ID NO: 682456 - RNA, 64 nt, hsa; identical to SEQ ID NO: 259690

SEQ ID NO: 682457 - RNA, 64 nt, hsa; identical to SEQ ID NO: 259691

SEQ ID NO: 682458 - RNA, 64 nt, hsa; identical to SEQ ID NO: 259692

SEQ ID NO: 682459 - RNA, 64 nt, hsa; identical to SEQ ID NO: 259693

SEQ ID NO: 682460 - RNA, 64 nt, hsa; identical to SEQ ID NO: 259694

SEQ ID NO: 682461 - RNA, 64 nt, hsa; identical to SEQ ID NO: 259695

SEQ ID NO: 682462 - RNA, 64 nt, hsa; identical to SEQ ID NO: 259696

SEQ ID NO: 682463 - RNA, 64 nt, hsa
uuuucgaaguaguagauucucagaucuuuauucuaacaauuacaugauuugaaaacaguacuca

SEQ ID NO: 682464 - RNA, 64 nt, hsa
uuuaaaaaauguuuuguaaauccagguguauuuuaacaauuaaaugccuauuuuguuauauguu

SEQ ID NO: 682465 - RNA, 64 nt, hsa
cuuucauaagacuauuuuaaauagaaauuauuucaacaauuaaaguaauguugaccaucccccu

SEQ ID NO: 682466 - RNA, 64 nt, hsa
cauguuaaugaauauuuuugcaguuguaaagcauaacaauuacaacuacacaucuauuucuaaa

SEQ ID NO: 682467 - RNA, 64 nt, hsa
gagaucaguauuguaacguaugugaauagaugauaacaauuaauauuacuaaaagucccacaug

SEQ ID NO: 682468 - RNA, 64 nt, hsa
agacugucuuggaaaaaaaauauaauaacaauuaaacaauuauuucucagagggcaacuuuauu

SEQ ID NO: 682469 - RNA, 64 nt, hsa
acagaugaagacugucuuggaaaaaaaauauaauaacaauuaaacaauuauuucucagagggca

SEQ ID NO: 682470 - RNA, 64 nt, hsa
gaaaacaaguacuuuaguaucaggacaggaguugaacaauuagguuagcagauggagaugagag

SEQ ID NO: 682471 - RNA, 64 nt, hsa
uaugguggcaauaucacaagggaggagagaggaaaacaauuaucuucucuacuuggauuaugag

SEQ ID NO: 682472 - RNA, 64 nt, hsa
uucuaaaaagucaauucaucuaguuaagucgcugaacaauuaccugccaaaugcuauacugugu

SEQ ID NO: 682473 - RNA, 64 nt, hsa
agagcagggugggguaaggaggagaaaauaaaccaacaauuaggucugcauuuucucaggcagu

SEQ ID NO: 682474 - RNA, 64 nt, hsa; identical to SEQ ID NO: 544188

SEQ ID NO: 682475 - RNA, 64 nt, hsa; identical to SEQ ID NO: 544189

SEQ ID NO: 682476 - RNA, 64 nt, hsa; identical to SEQ ID NO: 544190

SEQ ID NO: 682477 - RNA, 64 nt, hsa; identical to SEQ ID NO: 544191

SEQ ID NO: 682478 - RNA, 64 nt, hsa; identical to SEQ ID NO: 544192

SEQ ID NO: 682479 - RNA, 64 nt, hsa; identical to SEQ ID NO: 544193

SEQ ID NO: 682480 - RNA, 64 nt, hsa; identical to SEQ ID NO: 544194

SEQ ID NO: 682481 - RNA, 64 nt, hsa; identical to SEQ ID NO: 544195

SEQ ID NO: 682482 - RNA, 64 nt, hsa; identical to SEQ ID NO: 544196

SEQ ID NO: 682483 - RNA, 64 nt, hsa; identical to SEQ ID NO: 544197

SEQ ID NO: 682484 - RNA, 64 nt, hsa; identical to SEQ ID NO: 544198

SEQ ID NO: 682485 - RNA, 64 nt, hsa; identical to SEQ ID NO: 544199

SEQ ID NO: 682486 - RNA, 64 nt, hsa; identical to SEQ ID NO: 544200

SEQ ID NO: 682487 - RNA, 63 nt, hsa; identical to SEQ ID NO: 544201

SEQ ID NO: 682488 - RNA, 64 nt, hsa; identical to SEQ ID NO: 544202

SEQ ID NO: 682489 - RNA, 64 nt, hsa; identical to SEQ ID NO: 544203

SEQ ID NO: 682490 - RNA, 64 nt, hsa; identical to SEQ ID NO: 544204

SEQ ID NO: 682491 - RNA, 64 nt, hsa; identical to SEQ ID NO: 544205

SEQ ID NO: 682492 - RNA, 64 nt, hsa; identical to SEQ ID NO: 544206

SEQ ID NO: 682493 - RNA, 64 nt, hsa; identical to SEQ ID NO: 544207

SEQ ID NO: 682494 - RNA, 64 nt, hsa; identical to SEQ ID NO: 544208

SEQ ID NO: 682495 - RNA, 64 nt, hsa; identical to SEQ ID NO: 544209

SEQ ID NO: 682496 - RNA, 64 nt, hsa; identical to SEQ ID NO: 544210

SEQ ID NO: 682497 - RNA, 64 nt, hsa; identical to SEQ ID NO: 544211

SEQ ID NO: 682498 - RNA, 64 nt, hsa; identical to SEQ ID NO: 544212

SEQ ID NO: 682499 - RNA, 64 nt, hsa; identical to SEQ ID NO: 544213

SEQ ID NO: 682500 - RNA, 64 nt, hsa; identical to SEQ ID NO: 544214

SEQ ID NO: 682501 - RNA, 64 nt, hsa; identical to SEQ ID NO: 544215

SEQ ID NO: 682502 - RNA, 64 nt, hsa; identical to SEQ ID NO: 544216

SEQ ID NO: 682503 - RNA, 64 nt, hsa; identical to SEQ ID NO: 544217

SEQ ID NO: 682504 - RNA, 64 nt, hsa; identical to SEQ ID NO: 544218

SEQ ID NO: 682505 - RNA, 64 nt, hsa; identical to SEQ ID NO: 544219

SEQ ID NO: 682506 - RNA, 64 nt, hsa; identical to SEQ ID NO: 544220

SEQ ID NO: 682507 - RNA, 64 nt, hsa; identical to SEQ ID NO: 544221

SEQ ID NO: 682508 - RNA, 64 nt, hsa; identical to SEQ ID NO: 544222

SEQ ID NO: 682509 - RNA, 64 nt, hsa; identical to SEQ ID NO: 544223

SEQ ID NO: 682510 - RNA, 64 nt, hsa; identical to SEQ ID NO: 544224

SEQ ID NO: 682511 - RNA, 64 nt, hsa; identical to SEQ ID NO: 544225

SEQ ID NO: 682512 - RNA, 64 nt, hsa; identical to SEQ ID NO: 544226

SEQ ID NO: 682513 - RNA, 64 nt, hsa; identical to SEQ ID NO: 544227

SEQ ID NO: 682514 - RNA, 64 nt, hsa; identical to SEQ ID NO: 544228

SEQ ID NO: 682515 - RNA, 64 nt, hsa; identical to SEQ ID NO: 544229

SEQ ID NO: 682516 - RNA, 64 nt, hsa; identical to SEQ ID NO: 544230

SEQ ID NO: 682517 - RNA, 64 nt, hsa; identical to SEQ ID NO: 544231

SEQ ID NO: 682518 - RNA, 64 nt, hsa; identical to SEQ ID NO: 544232

SEQ ID NO: 682519 - RNA, 64 nt, hsa; identical to SEQ ID NO: 544233

SEQ ID NO: 682520 - RNA, 64 nt, hsa; identical to SEQ ID NO: 544234

SEQ ID NO: 682521 - RNA, 64 nt, hsa; identical to SEQ ID NO: 544235

SEQ ID NO: 682522 - RNA, 64 nt, hsa; identical to SEQ ID NO: 544236

SEQ ID NO: 682523 - RNA, 64 nt, hsa; identical to SEQ ID NO: 544237

SEQ ID NO: 682524 - RNA, 64 nt, hsa; identical to SEQ ID NO: 544238

SEQ ID NO: 682525 - RNA, 64 nt, hsa; identical to SEQ ID NO: 544239

SEQ ID NO: 682526 - RNA, 64 nt, hsa; identical to SEQ ID NO: 544240

SEQ ID NO: 682527 - RNA, 64 nt, hsa; identical to SEQ ID NO: 544241

SEQ ID NO: 682528 - RNA, 64 nt, hsa; identical to SEQ ID NO: 544242

SEQ ID NO: 682529 - RNA, 64 nt, hsa; identical to SEQ ID NO: 544243

SEQ ID NO: 682530 - RNA, 64 nt, hsa; identical to SEQ ID NO: 544244

SEQ ID NO: 682531 - RNA, 64 nt, hsa; identical to SEQ ID NO: 544245

SEQ ID NO: 682532 - RNA, 64 nt, hsa; identical to SEQ ID NO: 544246

SEQ ID NO: 682533 - RNA, 64 nt, hsa; identical to SEQ ID NO: 544247

SEQ ID NO: 682534 - RNA, 64 nt, hsa; identical to SEQ ID NO: 544248

SEQ ID NO: 682535 - RNA, 64 nt, hsa; identical to SEQ ID NO: 544249

SEQ ID NO: 682536 - RNA, 64 nt, hsa; identical to SEQ ID NO: 544250

SEQ ID NO: 682537 - RNA, 64 nt, hsa; identical to SEQ ID NO: 544251

SEQ ID NO: 682538 - RNA, 64 nt, hsa; identical to SEQ ID NO: 544252

SEQ ID NO: 682539 - RNA, 64 nt, hsa; identical to SEQ ID NO: 544253

SEQ ID NO: 682540 - RNA, 64 nt, hsa; identical to SEQ ID NO: 544254

SEQ ID NO: 682541 - RNA, 64 nt, hsa; identical to SEQ ID NO: 544255

SEQ ID NO: 682542 - RNA, 64 nt, hsa; identical to SEQ ID NO: 544256

SEQ ID NO: 682543 - RNA, 64 nt, hsa; identical to SEQ ID NO: 544257

SEQ ID NO: 682544 - RNA, 64 nt, hsa; identical to SEQ ID NO: 544258

SEQ ID NO: 682545 - RNA, 64 nt, hsa; identical to SEQ ID NO: 544259

SEQ ID NO: 682546 - RNA, 64 nt, hsa; identical to SEQ ID NO: 544260

SEQ ID NO: 682547 - RNA, 64 nt, hsa; identical to SEQ ID NO: 544261

SEQ ID NO: 682548 - RNA, 64 nt, hsa; identical to SEQ ID NO: 544262

SEQ ID NO: 682549 - RNA, 64 nt, hsa; identical to SEQ ID NO: 544263

SEQ ID NO: 682550 - RNA, 64 nt, hsa; identical to SEQ ID NO: 544264

SEQ ID NO: 682551 - RNA, 64 nt, hsa; identical to SEQ ID NO: 544265

SEQ ID NO: 682552 - RNA, 64 nt, hsa; identical to SEQ ID NO: 544266

SEQ ID NO: 682553 - RNA, 64 nt, hsa; identical to SEQ ID NO: 544267

SEQ ID NO: 682554 - RNA, 64 nt, hsa; identical to SEQ ID NO: 544268

SEQ ID NO: 682555 - RNA, 64 nt, hsa; identical to SEQ ID NO: 544269

SEQ ID NO: 682556 - RNA, 64 nt, hsa; identical to SEQ ID NO: 544270

SEQ ID NO: 682557 - RNA, 64 nt, hsa; identical to SEQ ID NO: 544271

SEQ ID NO: 682558 - RNA, 64 nt, hsa; identical to SEQ ID NO: 544272

SEQ ID NO: 682559 - RNA, 64 nt, hsa; identical to SEQ ID NO: 544273

SEQ ID NO: 682560 - RNA, 64 nt, hsa; identical to SEQ ID NO: 544274

SEQ ID NO: 682561 - RNA, 64 nt, hsa; identical to SEQ ID NO: 544275

SEQ ID NO: 682562 - RNA, 64 nt, hsa; identical to SEQ ID NO: 544276

SEQ ID NO: 682563 - RNA, 64 nt, hsa; identical to SEQ ID NO: 544277

SEQ ID NO: 682564 - RNA, 64 nt, hsa; identical to SEQ ID NO: 544278

SEQ ID NO: 682565 - RNA, 64 nt, hsa; identical to SEQ ID NO: 544279

SEQ ID NO: 682566 - RNA, 64 nt, hsa; identical to SEQ ID NO: 544280

SEQ ID NO: 682567 - RNA, 64 nt, hsa; identical to SEQ ID NO: 544281

SEQ ID NO: 682568 - RNA, 64 nt, hsa; identical to SEQ ID NO: 544282

SEQ ID NO: 682569 - RNA, 64 nt, hsa; identical to SEQ ID NO: 544283

SEQ ID NO: 682570 - RNA, 64 nt, hsa; identical to SEQ ID NO: 544284

SEQ ID NO: 682571 - RNA, 64 nt, hsa; identical to SEQ ID NO: 544285

SEQ ID NO: 682572 - RNA, 64 nt, hsa; identical to SEQ ID NO: 544286

SEQ ID NO: 682573 - RNA, 64 nt, hsa; identical to SEQ ID NO: 544287

SEQ ID NO: 682574 - RNA, 64 nt, hsa; identical to SEQ ID NO: 544288

SEQ ID NO: 682575 - RNA, 64 nt, hsa; identical to SEQ ID NO: 544289

SEQ ID NO: 682576 - RNA, 64 nt, hsa; identical to SEQ ID NO: 544290

SEQ ID NO: 682577 - RNA, 64 nt, hsa; identical to SEQ ID NO: 544291

SEQ ID NO: 682578 - RNA, 64 nt, hsa; identical to SEQ ID NO: 544292

SEQ ID NO: 682579 - RNA, 64 nt, hsa; identical to SEQ ID NO: 544293

SEQ ID NO: 682580 - RNA, 64 nt, hsa; identical to SEQ ID NO: 544294

SEQ ID NO: 682581 - RNA, 64 nt, hsa; identical to SEQ ID NO: 544295

SEQ ID NO: 682582 - RNA, 64 nt, hsa; identical to SEQ ID NO: 544296

SEQ ID NO: 682583 - RNA, 64 nt, hsa; identical to SEQ ID NO: 544297

SEQ ID NO: 682584 - RNA, 64 nt, hsa; identical to SEQ ID NO: 544298

SEQ ID NO: 682585 - RNA, 64 nt, hsa; identical to SEQ ID NO: 544299

SEQ ID NO: 682586 - RNA, 64 nt, hsa; identical to SEQ ID NO: 544300

SEQ ID NO: 682587 - RNA, 64 nt, hsa; identical to SEQ ID NO: 544301

SEQ ID NO: 682588 - RNA, 64 nt, hsa; identical to SEQ ID NO: 544302

SEQ ID NO: 682589 - RNA, 64 nt, hsa; identical to SEQ ID NO: 544303

SEQ ID NO: 682590 - RNA, 64 nt, hsa; identical to SEQ ID NO: 544304

SEQ ID NO: 682591 - RNA, 64 nt, hsa; identical to SEQ ID NO: 544305

SEQ ID NO: 682592 - RNA, 64 nt, hsa; identical to SEQ ID NO: 544306

SEQ ID NO: 682593 - RNA, 64 nt, hsa; identical to SEQ ID NO: 544307

SEQ ID NO: 682594 - RNA, 64 nt, hsa; identical to SEQ ID NO: 544308

SEQ ID NO: 682595 - RNA, 64 nt, hsa; identical to SEQ ID NO: 544309

SEQ ID NO: 682596 - RNA, 64 nt, hsa; identical to SEQ ID NO: 544310

SEQ ID NO: 682597 - RNA, 64 nt, hsa; identical to SEQ ID NO: 544311

SEQ ID NO: 682598 - RNA, 64 nt, hsa; identical to SEQ ID NO: 544312

SEQ ID NO: 682599 - RNA, 64 nt, hsa; identical to SEQ ID NO: 544313

SEQ ID NO: 682600 - RNA, 63 nt, hsa; identical to SEQ ID NO: 544314

SEQ ID NO: 682601 - RNA, 64 nt, hsa; identical to SEQ ID NO: 544315

SEQ ID NO: 682602 - RNA, 64 nt, hsa; identical to SEQ ID NO: 544316

SEQ ID NO: 682603 - RNA, 64 nt, hsa; identical to SEQ ID NO: 544317

SEQ ID NO: 682604 - RNA, 64 nt, hsa; identical to SEQ ID NO: 544318

SEQ ID NO: 682605 - RNA, 64 nt, hsa; identical to SEQ ID NO: 544319

SEQ ID NO: 682606 - RNA, 64 nt, hsa; identical to SEQ ID NO: 544320

SEQ ID NO: 682607 - RNA, 64 nt, hsa; identical to SEQ ID NO: 544321

SEQ ID NO: 682608 - RNA, 64 nt, hsa; identical to SEQ ID NO: 544322

SEQ ID NO: 682609 - RNA, 64 nt, hsa; identical to SEQ ID NO: 544323

SEQ ID NO: 682610 - RNA, 64 nt, hsa; identical to SEQ ID NO: 544324

SEQ ID NO: 682611 - RNA, 64 nt, hsa; identical to SEQ ID NO: 544325

SEQ ID NO: 682612 - RNA, 64 nt, hsa; identical to SEQ ID NO: 544326

SEQ ID NO: 682613 - RNA, 64 nt, hsa; identical to SEQ ID NO: 544327

SEQ ID NO: 682614 - RNA, 64 nt, hsa; identical to SEQ ID NO: 544328

SEQ ID NO: 682615 - RNA, 64 nt, hsa; identical to SEQ ID NO: 544329

SEQ ID NO: 682616 - RNA, 64 nt, hsa; identical to SEQ ID NO: 544330

SEQ ID NO: 682617 - RNA, 64 nt, hsa; identical to SEQ ID NO: 544331

SEQ ID NO: 682618 - RNA, 64 nt, hsa; identical to SEQ ID NO: 544332

SEQ ID NO: 682619 - RNA, 64 nt, hsa; identical to SEQ ID NO: 544333

SEQ ID NO: 682620 - RNA, 64 nt, hsa; identical to SEQ ID NO: 544334

SEQ ID NO: 682621 - RNA, 64 nt, hsa; identical to SEQ ID NO: 544335

SEQ ID NO: 682622 - RNA, 64 nt, hsa; identical to SEQ ID NO: 544336

SEQ ID NO: 682623 - RNA, 64 nt, hsa; identical to SEQ ID NO: 544337

SEQ ID NO: 682624 - RNA, 64 nt, hsa; identical to SEQ ID NO: 544338

SEQ ID NO: 682625 - RNA, 64 nt, hsa; identical to SEQ ID NO: 544339

SEQ ID NO: 682626 - RNA, 64 nt, hsa; identical to SEQ ID NO: 544340

SEQ ID NO: 682627 - RNA, 64 nt, hsa; identical to SEQ ID NO: 544341

SEQ ID NO: 682628 - RNA, 64 nt, hsa; identical to SEQ ID NO: 544342

SEQ ID NO: 682629 - RNA, 64 nt, hsa; identical to SEQ ID NO: 544343

SEQ ID NO: 682630 - RNA, 64 nt, hsa; identical to SEQ ID NO: 544344

SEQ ID NO: 682631 - RNA, 64 nt, hsa; identical to SEQ ID NO: 544345

SEQ ID NO: 682632 - RNA, 64 nt, hsa; identical to SEQ ID NO: 544346

SEQ ID NO: 682633 - RNA, 64 nt, hsa; identical to SEQ ID NO: 544347

SEQ ID NO: 682634 - RNA, 64 nt, hsa; identical to SEQ ID NO: 544348

SEQ ID NO: 682635 - RNA, 64 nt, hsa; identical to SEQ ID NO: 544349

SEQ ID NO: 682636 - RNA, 64 nt, hsa; identical to SEQ ID NO: 544350

SEQ ID NO: 682637 - RNA, 64 nt, hsa; identical to SEQ ID NO: 544351

SEQ ID NO: 682638 - RNA, 64 nt, hsa; identical to SEQ ID NO: 544352

SEQ ID NO: 682639 - RNA, 64 nt, hsa; identical to SEQ ID NO: 544353

SEQ ID NO: 682640 - RNA, 64 nt, hsa; identical to SEQ ID NO: 544354

SEQ ID NO: 682641 - RNA, 64 nt, hsa; identical to SEQ ID NO: 544355

SEQ ID NO: 682642 - RNA, 64 nt, hsa; identical to SEQ ID NO: 544356

SEQ ID NO: 682643 - RNA, 64 nt, hsa; identical to SEQ ID NO: 544357

SEQ ID NO: 682644 - RNA, 64 nt, hsa; identical to SEQ ID NO: 544358

SEQ ID NO: 682645 - RNA, 64 nt, hsa; identical to SEQ ID NO: 544359

SEQ ID NO: 682646 - RNA, 64 nt, hsa; identical to SEQ ID NO: 544360

SEQ ID NO: 682647 - RNA, 64 nt, hsa; identical to SEQ ID NO: 544361

SEQ ID NO: 682648 - RNA, 64 nt, hsa; identical to SEQ ID NO: 544362

SEQ ID NO: 682649 - RNA, 64 nt, hsa; identical to SEQ ID NO: 544363

SEQ ID NO: 682650 - RNA, 64 nt, hsa; identical to SEQ ID NO: 544364

SEQ ID NO: 682651 - RNA, 64 nt, hsa; identical to SEQ ID NO: 544365

SEQ ID NO: 682652 - RNA, 64 nt, hsa; identical to SEQ ID NO: 544366

SEQ ID NO: 682653 - RNA, 64 nt, hsa; identical to SEQ ID NO: 544367

SEQ ID NO: 682654 - RNA, 64 nt, hsa; identical to SEQ ID NO: 544368

SEQ ID NO: 682655 - RNA, 64 nt, hsa; identical to SEQ ID NO: 544369

SEQ ID NO: 682656 - RNA, 64 nt, hsa; identical to SEQ ID NO: 544370

SEQ ID NO: 682657 - RNA, 64 nt, hsa; identical to SEQ ID NO: 544371

SEQ ID NO: 682658 - RNA, 64 nt, hsa; identical to SEQ ID NO: 544372

SEQ ID NO: 682659 - RNA, 64 nt, hsa; identical to SEQ ID NO: 544373

SEQ ID NO: 682660 - RNA, 64 nt, hsa; identical to SEQ ID NO: 544374

SEQ ID NO: 682661 - RNA, 64 nt, hsa; identical to SEQ ID NO: 544375

SEQ ID NO: 682662 - RNA, 64 nt, hsa; identical to SEQ ID NO: 544376

SEQ ID NO: 682663 - RNA, 64 nt, hsa; identical to SEQ ID NO: 544377

SEQ ID NO: 682664 - RNA, 64 nt, hsa; identical to SEQ ID NO: 544378

SEQ ID NO: 682665 - RNA, 64 nt, hsa; identical to SEQ ID NO: 544379

SEQ ID NO: 682666 - RNA, 64 nt, hsa; identical to SEQ ID NO: 544380

SEQ ID NO: 682667 - RNA, 64 nt, hsa; identical to SEQ ID NO: 544381

SEQ ID NO: 682668 - RNA, 64 nt, hsa; identical to SEQ ID NO: 544382

SEQ ID NO: 682669 - RNA, 64 nt, hsa; identical to SEQ ID NO: 544383

SEQ ID NO: 682670 - RNA, 64 nt, hsa; identical to SEQ ID NO: 544384

SEQ ID NO: 682671 - RNA, 64 nt, hsa; identical to SEQ ID NO: 544385

SEQ ID NO: 682672 - RNA, 64 nt, hsa; identical to SEQ ID NO: 544386

SEQ ID NO: 682673 - RNA, 64 nt, hsa; identical to SEQ ID NO: 212680

SEQ ID NO: 682674 - RNA, 64 nt, hsa; identical to SEQ ID NO: 212681

SEQ ID NO: 682675 - RNA, 64 nt, hsa; identical to SEQ ID NO: 212682

SEQ ID NO: 682676 - RNA, 64 nt, hsa; identical to SEQ ID NO: 212683

SEQ ID NO: 682677 - RNA, 64 nt, hsa; identical to SEQ ID NO: 212684

SEQ ID NO: 682678 - RNA, 64 nt, hsa; identical to SEQ ID NO: 212685

SEQ ID NO: 682679 - RNA, 64 nt, hsa; identical to SEQ ID NO: 212686

SEQ ID NO: 682680 - RNA, 64 nt, hsa; identical to SEQ ID NO: 212687

SEQ ID NO: 682681 - RNA, 64 nt, hsa; identical to SEQ ID NO: 82031

SEQ ID NO: 682682 - RNA, 64 nt, hsa; identical to SEQ ID NO: 82032

SEQ ID NO: 682683 - RNA, 64 nt, hsa; identical to SEQ ID NO: 82033

SEQ ID NO: 682684 - RNA, 64 nt, hsa; identical to SEQ ID NO: 82034

SEQ ID NO: 682685 - RNA, 64 nt, hsa; identical to SEQ ID NO: 82035

SEQ ID NO: 682686 - RNA, 64 nt, hsa; identical to SEQ ID NO: 82036

SEQ ID NO: 682687 - RNA, 64 nt, hsa; identical to SEQ ID NO: 82037

SEQ ID NO: 682688 - RNA, 64 nt, hsa; identical to SEQ ID NO: 82038

SEQ ID NO: 682689 - RNA, 64 nt, hsa; identical to SEQ ID NO: 82039

SEQ ID NO: 682690 - RNA, 64 nt, hsa; identical to SEQ ID NO: 82040

SEQ ID NO: 682691 - RNA, 64 nt, hsa; identical to SEQ ID NO: 82041

SEQ ID NO: 682692 - RNA, 64 nt, hsa; identical to SEQ ID NO: 82042

SEQ ID NO: 682693 - RNA, 64 nt, hsa; identical to SEQ ID NO: 82043

SEQ ID NO: 682694 - RNA, 64 nt, hsa; identical to SEQ ID NO: 82044

SEQ ID NO: 682695 - RNA, 64 nt, hsa; identical to SEQ ID NO: 82045

SEQ ID NO: 682696 - RNA, 64 nt, hsa; identical to SEQ ID NO: 82046

SEQ ID NO: 682697 - RNA, 64 nt, hsa; identical to SEQ ID NO: 82047

SEQ ID NO: 682698 - RNA, 64 nt, hsa; identical to SEQ ID NO: 82048

SEQ ID NO: 682699 - RNA, 64 nt, hsa; identical to SEQ ID NO: 82049

SEQ ID NO: 682700 - RNA, 64 nt, hsa; identical to SEQ ID NO: 82050

SEQ ID NO: 682701 - RNA, 64 nt, hsa; identical to SEQ ID NO: 82051

SEQ ID NO: 682702 - RNA, 64 nt, hsa; identical to SEQ ID NO: 82052

SEQ ID NO: 682703 - RNA, 64 nt, hsa; identical to SEQ ID NO: 82053

SEQ ID NO: 682704 - RNA, 64 nt, hsa; identical to SEQ ID NO: 82054

SEQ ID NO: 682705 - RNA, 64 nt, hsa; identical to SEQ ID NO: 82055

SEQ ID NO: 682706 - RNA, 64 nt, hsa; identical to SEQ ID NO: 82056

SEQ ID NO: 682707 - RNA, 64 nt, hsa; identical to SEQ ID NO: 82057

SEQ ID NO: 682708 - RNA, 64 nt, hsa; identical to SEQ ID NO: 82058

SEQ ID NO: 682709 - RNA, 64 nt, hsa; identical to SEQ ID NO: 82059

SEQ ID NO: 682710 - RNA, 64 nt, hsa; identical to SEQ ID NO: 82060

SEQ ID NO: 682711 - RNA, 64 nt, hsa; identical to SEQ ID NO: 82061

SEQ ID NO: 682712 - RNA, 64 nt, hsa; identical to SEQ ID NO: 51918

SEQ ID NO: 682713 - RNA, 64 nt, hsa; identical to SEQ ID NO: 51919

SEQ ID NO: 682714 - RNA, 64 nt, hsa; identical to SEQ ID NO: 51920

SEQ ID NO: 682715 - RNA, 64 nt, hsa; identical to SEQ ID NO: 51921

SEQ ID NO: 682716 - RNA, 64 nt, hsa; identical to SEQ ID NO: 51922

SEQ ID NO: 682717 - RNA, 64 nt, hsa; identical to SEQ ID NO: 51923

SEQ ID NO: 682718 - RNA, 64 nt, hsa; identical to SEQ ID NO: 51924

SEQ ID NO: 682719 - RNA, 64 nt, hsa; identical to SEQ ID NO: 51925

SEQ ID NO: 682720 - RNA, 64 nt, hsa; identical to SEQ ID NO: 51926

SEQ ID NO: 682721 - RNA, 64 nt, hsa; identical to SEQ ID NO: 51927

SEQ ID NO: 682722 - RNA, 64 nt, hsa; identical to SEQ ID NO: 51928

SEQ ID NO: 682723 - RNA, 64 nt, hsa; identical to SEQ ID NO: 51929

SEQ ID NO: 682724 - RNA, 64 nt, hsa; identical to SEQ ID NO: 51930

SEQ ID NO: 682725 - RNA, 64 nt, hsa; identical to SEQ ID NO: 51931

SEQ ID NO: 682726 - RNA, 64 nt, hsa; identical to SEQ ID NO: 51932

SEQ ID NO: 682727 - RNA, 64 nt, hsa; identical to SEQ ID NO: 51933

SEQ ID NO: 682728 - RNA, 64 nt, hsa; identical to SEQ ID NO: 51934

SEQ ID NO: 682729 - RNA, 64 nt, hsa; identical to SEQ ID NO: 51935

SEQ ID NO: 682730 - RNA, 64 nt, hsa; identical to SEQ ID NO: 51936

SEQ ID NO: 682731 - RNA, 64 nt, hsa; identical to SEQ ID NO: 51937

SEQ ID NO: 682732 - RNA, 64 nt, hsa; identical to SEQ ID NO: 51938

SEQ ID NO: 682733 - RNA, 64 nt, hsa; identical to SEQ ID NO: 51939

SEQ ID NO: 682734 - RNA, 64 nt, hsa; identical to SEQ ID NO: 51940

SEQ ID NO: 682735 - RNA, 64 nt, hsa; identical to SEQ ID NO: 51941

SEQ ID NO: 682736 - RNA, 64 nt, hsa; identical to SEQ ID NO: 51942

SEQ ID NO: 682737 - RNA, 64 nt, hsa; identical to SEQ ID NO: 51943

SEQ ID NO: 682738 - RNA, 64 nt, hsa; identical to SEQ ID NO: 51944

SEQ ID NO: 682739 - RNA, 62 nt, hsa
gcugcuaaacaaucauuggaucacaauccucaucagacaaacccaucuguaaaaaaaaugag

SEQ ID NO: 682740 - RNA, 62 nt, hsa
ucaaauuuaagggaauaauuuauaccaucuuuucagacaagaauguacagcaaaaauaaggg

SEQ ID NO: 682741 - RNA, 62 nt, hsa
ucugcagggcuucucuuguuuacacagcugcaucagacaaugccauuucuccccaccacgga

SEQ ID NO: 682742 - RNA, 62 nt, hsa
uuccaucugaucagcuguggugugaggacuucucagacaaaggcaaggccucgugccccugc

SEQ ID NO: 682743 - RNA, 62 nt, hsa
auguuauuuauuagcccuaauuguguuugguuucagacaaaaccuuuucuccuguguaucuu

SEQ ID NO: 682744 - RNA, 62 nt, hsa
aaguuauuuauuagcccuaauuguguuugauuucagacaaaauuaacccuuuucuccugugu

SEQ ID NO: 682745 - RNA, 62 nt, hsa
ugaggaaaacauguucagugaggaaaaaacauucagacaaauguucagugaggaaaaaaagg

SEQ ID NO: 682746 - RNA, 62 nt, hsa
augcaucuugaagcaacaaagcagccacaguuucagacaaauguucagugugagugaggaaa

SEQ ID NO: 682747 - RNA, 64 nt, hsa
gucucuaacuguacaggagacuucucugccugggcugggaaaggggccuuucuuuuguuuugca

SEQ ID NO: 682748 - RNA, 64 nt, hsa
aaugcuuguggguauauuggauagcucagaaaaucugggaaaucaaaguggcucaauagcugug

SEQ ID NO: 682749 - RNA, 64 nt, hsa
cuguguguagaagcagcaggacagccugucaucacugggaaagaggccagaagagccguuuggc

SEQ ID NO: 682750 - RNA, 64 nt, hsa
ggggaggugccugagcuggggccuggagaggggccugggaaaggaaaaccagggauagcuauuu

SEQ ID NO: 682751 - RNA, 64 nt, hsa
caggagagagaucuagaaaguggguucacuagagcugggaaacagggagccccuaggaaagcag

SEQ ID NO: 682752 - RNA, 64 nt, hsa
aaaaccugguuccuguccucaaaauaaggggcaccugggaaaacagaggaaucuaccuguggug

SEQ ID NO: 682753 - RNA, 64 nt, hsa
uugcuugcagugcuuucuuaauuuuauggcucuucugggaaacuccuccccuuuuccacacgaa

SEQ ID NO: 682754 - RNA, 64 nt, hsa
guaaagugucuggucugggagcucguuaacuaugcugggaaacgguccaaaagaaucagaauuu

SEQ ID NO: 682755 - RNA, 64 nt, hsa
uccuccuccucuccacguucccuugaguaaaugucugggaaagcaugaagcuugaugcaagaac

SEQ ID NO: 682756 - RNA, 64 nt, hsa
caugguaauacagauaaaauacauucuuuuaauucugggaaauuagaaaaaguggggugaucuu

SEQ ID NO: 682757 - RNA, 64 nt, hsa
gagagugcuugcuacucaccugcuucuagcucaccugggaaauaacagcagaaccucuaccucg

SEQ ID NO: 682758 - RNA, 64 nt, hsa
auaaccaucgaugauguugucuauguuaucgauucugggaaaaugaaagaaaagagguauuccg

SEQ ID NO: 682759 - RNA, 64 nt, hsa
ugggagcacaguacugggaaaugggagcauaguacugggaaaccccagaccuggauucugaguu

SEQ ID NO: 682760 - RNA, 64 nt, hsa
ugggagcauaguacugggaaaugggagcacaguacugggaaaugggagcauaguacugggaaac

SEQ ID NO: 682761 - RNA, 64 nt, hsa
ggaguucacaguacucggaaaugggagcauaguacugggaaaugggagcacaguacugggaaau

SEQ ID NO: 682762 - RNA, 64 nt, hsa
ggagcacaguacugggaaaugggagcccacaguacugggaaaggggaguucacaguacucggaa

SEQ ID NO: 682763 - RNA, 64 nt, hsa
ggagcacacaguacugggaaaugggagcacaguacugggaaaugggagcccacaguacugggaa

SEQ ID NO: 682764 - RNA, 64 nt, hsa
ggcauacaguacugagaaaugggagcacacaguacugggaaaugggagcacaguacugggaaau

SEQ ID NO: 682765 - RNA, 64 nt, hsa
ugggaguacacuacugagaaaugggagcacaguacugggaaaugggcauacaguacugagaaau

SEQ ID NO: 682766 - RNA, 64 nt, hsa
ugggagcacaguacugggaaaugggagcacaguacugggaaaugggggcucacagcacugcaaa

SEQ ID NO: 682767 - RNA, 64 nt, hsa
ugggagcacaguacuaggaaaugggagcacaguacugggaaaugggagcacaguacugggaaau

SEQ ID NO: 682768 - RNA, 64 nt, hsa
ccgggcauguuggcucacaccugugagcacaguacugggaaaugggagcacaguacuaggaaau

SEQ ID NO: 682769 - RNA, 64 nt, hsa
cacuaaucauuaguuaagacugugcuagucuucccugggaaacuaagaagagagcuuuuuuaua

SEQ ID NO: 682770 - RNA, 64 nt, hsa
auuuaaguuuuucagauaauaugugaccaauauacugggaaagagguagucacagagaaagggu

SEQ ID NO: 682771 - RNA, 64 nt, hsa
gucugccaugaccaaggaagccucaaugccgucccugggaaagccagagcugugauuuuuggca

SEQ ID NO: 682772 - RNA, 64 nt, hsa
ggccugaccaggaacuacugcaggaauccagauucugggaaacaacccugguguuacacaacug

SEQ ID NO: 682773 - RNA, 64 nt, hsa
uuuuuuaaaagucccccaacaaauaggauucuugcugggaaaggaaguucgguaaggaaauguc

SEQ ID NO: 682774 - RNA, 64 nt, hsa
ccagccuccagagaccgagcagcuguggggccugcugggaaaccaaggucgguuuccgcccucu

SEQ ID NO: 682775 - RNA, 64 nt, hsa
uagaagucauggacuuuucugggaaaugacuuuucugggaaaugacaguuucuuugacauauuu

SEQ ID NO: 682776 - RNA, 64 nt, hsa
guugguagaauccauguagaagucauggacuuuucugggaaaugacuuuucugggaaaugacag

SEQ ID NO: 682777 - RNA, 64 nt, hsa
aaccuugggaccaugucacgcaagagauucagcacugggaaagauauaauugaaacaaaauagu

SEQ ID NO: 682778 - RNA, 64 nt, hsa
cagcccgaacacugucagacucuaauuggcgacccugggaaacaguugcccugcuauucuuuaa

SEQ ID NO: 682779 - RNA, 64 nt, hsa
cuaaaagcaugggaaauguaaaggcagucuuucucugggaaauggaugcuauucuauucugcug

SEQ ID NO: 682780 - RNA, 64 nt, hsa
gcuggugcuggugcaaggacuucuguuccaaaggcugggaaaaacuaagcugucccagccccuc

SEQ ID NO: 682781 - RNA, 64 nt, hsa
cccuccuccuguccucccccgcacccccucccuucugggaaacaagaagaguaaacaggaaacc

SEQ ID NO: 682782 - RNA, 64 nt, hsa
ucagcgcuuaaaaaaacaaauuggacagcuacuucugggaaaaacaacaucauuccaaaaagaa

SEQ ID NO: 682783 - RNA, 64 nt, hsa
auccauucagaaguuuuguuguuuuacucuaaagcugggaaaggaaaugagagggaaaagaccc

SEQ ID NO: 682784 - RNA, 64 nt, hsa
ucaccaagcaggagaguuaaggauucaccaugagcugggaaaugcuuuugccaugaguaugagc

SEQ ID NO: 682785 - RNA, 64 nt, hsa
acuucugauggaugcauggggcucugggggaaugcugggaaaaugggcaagcagagugcacagc

SEQ ID NO: 682786 - RNA, 64 nt, hsa
uggcugcugcagggcacauggagggaccuacccucugggaaagcccuugugucccucccagagu

SEQ ID NO: 682787 - RNA, 64 nt, hsa
caggaaauguaccugaaaaggauuuuagaaaacccugggaaaacccaccacaccaccacaaaau

SEQ ID NO: 682788 - RNA, 64 nt, hsa
aagagaguucauugacaguguuaggaugugaaggcugggaaacacuuauuuugcuucaagaguu

SEQ ID NO: 682789 - RNA, 64 nt, hsa
caccccagacccucuucagcuacagccacagguccugggaaagaagugggaucuagggcccugg

SEQ ID NO: 682790 - RNA, 64 nt, hsa
gugggccaugaaaggagaggauggauagggauggcugggaaauggagaucacugaaguacacag

SEQ ID NO: 682791 - RNA, 64 nt, hsa
ggacuaaagaaaugggugucccccaccccaucagcugggaaagcccaggccgcaggagugggau

SEQ ID NO: 682792 - RNA, 64 nt, hsa
aaccccgccuuccagcacuuucugucauuccaggcugggaaagucuagagcccccuuuggcccc

SEQ ID NO: 682793 - RNA, 64 nt, hsa
agaggugcccccaagugaagggguacaguggcaccugggaaaaggcaccuggaagguuuccaug

SEQ ID NO: 682794 - RNA, 64 nt, hsa
ccuugggccuggcuucuuaagaguuuugaugaugcugggaaaagugacugcgauucugaagaac

SEQ ID NO: 682795 - RNA, 64 nt, hsa
guuugacuucguuccugaauacaaucuugaguaacugggaaagucugagugaaaggauggccuc

SEQ ID NO: 682796 - RNA, 64 nt, hsa
cacacagcugagaagccggcguccugcucacaaacugggaaagugugaaaacuauuuaagauaa

SEQ ID NO: 682797 - RNA, 64 nt, hsa; identical to SEQ ID NO: 206011

SEQ ID NO: 682798 - RNA, 64 nt, hsa; identical to SEQ ID NO: 206012

SEQ ID NO: 682799 - RNA, 64 nt, hsa; identical to SEQ ID NO: 206013

SEQ ID NO: 682800 - RNA, 64 nt, hsa; identical to SEQ ID NO: 206014

SEQ ID NO: 682801 - RNA, 64 nt, hsa; identical to SEQ ID NO: 206015

SEQ ID NO: 682802 - RNA, 64 nt, hsa; identical to SEQ ID NO: 206016

SEQ ID NO: 682803 - RNA, 64 nt, hsa; identical to SEQ ID NO: 206017

SEQ ID NO: 682804 - RNA, 64 nt, hsa; identical to SEQ ID NO: 206018

SEQ ID NO: 682805 - RNA, 64 nt, hsa; identical to SEQ ID NO: 206019

SEQ ID NO: 682806 - RNA, 64 nt, hsa; identical to SEQ ID NO: 206020

SEQ ID NO: 682807 - RNA, 64 nt, hsa; identical to SEQ ID NO: 366005

SEQ ID NO: 682808 - RNA, 64 nt, hsa; identical to SEQ ID NO: 366006

SEQ ID NO: 682809 - RNA, 64 nt, hsa; identical to SEQ ID NO: 366007

SEQ ID NO: 682810 - RNA, 64 nt, hsa; identical to SEQ ID NO: 366008

SEQ ID NO: 682811 - RNA, 64 nt, hsa; identical to SEQ ID NO: 366009

SEQ ID NO: 682812 - RNA, 64 nt, hsa; identical to SEQ ID NO: 366010

SEQ ID NO: 682813 - RNA, 64 nt, hsa; identical to SEQ ID NO: 366011

SEQ ID NO: 682814 - RNA, 64 nt, hsa; identical to SEQ ID NO: 366012

SEQ ID NO: 682815 - RNA, 64 nt, hsa; identical to SEQ ID NO: 366013

SEQ ID NO: 682816 - RNA, 64 nt, hsa; identical to SEQ ID NO: 366014

SEQ ID NO: 682817 - RNA, 64 nt, hsa; identical to SEQ ID NO: 366015

SEQ ID NO: 682818 - RNA, 64 nt, hsa; identical to SEQ ID NO: 366016

SEQ ID NO: 682819 - RNA, 64 nt, hsa; identical to SEQ ID NO: 366017

SEQ ID NO: 682820 - RNA, 64 nt, hsa; identical to SEQ ID NO: 366018

SEQ ID NO: 682821 - RNA, 64 nt, hsa; identical to SEQ ID NO: 366019

SEQ ID NO: 682822 - RNA, 64 nt, hsa; identical to SEQ ID NO: 366020

SEQ ID NO: 682823 - RNA, 64 nt, hsa; identical to SEQ ID NO: 366021

SEQ ID NO: 682824 - RNA, 64 nt, hsa; identical to SEQ ID NO: 366022

SEQ ID NO: 682825 - RNA, 64 nt, hsa; identical to SEQ ID NO: 366023

SEQ ID NO: 682826 - RNA, 64 nt, hsa; identical to SEQ ID NO: 366024

SEQ ID NO: 682827 - RNA, 64 nt, hsa; identical to SEQ ID NO: 115714

SEQ ID NO: 682828 - RNA, 64 nt, hsa; identical to SEQ ID NO: 115715

SEQ ID NO: 682829 - RNA, 64 nt, hsa; identical to SEQ ID NO: 115716

SEQ ID NO: 682830 - RNA, 64 nt, hsa; identical to SEQ ID NO: 115717

SEQ ID NO: 682831 - RNA, 64 nt, hsa; identical to SEQ ID NO: 115718

SEQ ID NO: 682832 - RNA, 64 nt, hsa; identical to SEQ ID NO: 115719

SEQ ID NO: 682833 - RNA, 64 nt, hsa; identical to SEQ ID NO: 115720

SEQ ID NO: 682834 - RNA, 64 nt, hsa; identical to SEQ ID NO: 115721

SEQ ID NO: 682835 - RNA, 64 nt, hsa; identical to SEQ ID NO: 115722

SEQ ID NO: 682836 - RNA, 64 nt, hsa; identical to SEQ ID NO: 115723

SEQ ID NO: 682837 - RNA, 64 nt, hsa; identical to SEQ ID NO: 115724

SEQ ID NO: 682838 - RNA, 64 nt, hsa; identical to SEQ ID NO: 115725

SEQ ID NO: 682839 - RNA, 64 nt, hsa; identical to SEQ ID NO: 115726

SEQ ID NO: 682840 - RNA, 64 nt, hsa; identical to SEQ ID NO: 115727

SEQ ID NO: 682841 - RNA, 64 nt, hsa; identical to SEQ ID NO: 115728

SEQ ID NO: 682842 - RNA, 64 nt, hsa; identical to SEQ ID NO: 115729

SEQ ID NO: 682843 - RNA, 64 nt, hsa; identical to SEQ ID NO: 115730

SEQ ID NO: 682844 - RNA, 64 nt, hsa; identical to SEQ ID NO: 115731

SEQ ID NO: 682845 - RNA, 64 nt, hsa; identical to SEQ ID NO: 115732

SEQ ID NO: 682846 - RNA, 64 nt, hsa; identical to SEQ ID NO: 115733

SEQ ID NO: 682847 - RNA, 64 nt, hsa; identical to SEQ ID NO: 115734

SEQ ID NO: 682848 - RNA, 64 nt, hsa; identical to SEQ ID NO: 115735

SEQ ID NO: 682849 - RNA, 64 nt, hsa; identical to SEQ ID NO: 115736

SEQ ID NO: 682850 - RNA, 64 nt, hsa; identical to SEQ ID NO: 115737

SEQ ID NO: 682851 - RNA, 64 nt, hsa; identical to SEQ ID NO: 115738

SEQ ID NO: 682852 - RNA, 64 nt, hsa; identical to SEQ ID NO: 115739

SEQ ID NO: 682853 - RNA, 64 nt, hsa
ccauugggagguuuugaaaaaccaguuaauuuaauagcucaaaauugucccugauuuuauuuuc

SEQ ID NO: 682854 - RNA, 64 nt, hsa
caugacaauuuuuagagcugcagguuagcuauuauagcucaagcuuuuuuguuuguuuuuuucu

SEQ ID NO: 682855 - RNA, 64 nt, hsa
agcugggaaagacugacugagacacucccccuguuagcucaacagaucugcauuuggcugcuuc

SEQ ID NO: 682856 - RNA, 64 nt, hsa
aucugagggaagauuuauguuucguuuuggaggauagcucaaguugaauuuucuuuccagccag

SEQ ID NO: 682857 - RNA, 64 nt, hsa
gguugacaccuauuuauaauucuuaaaauaaggguagcucaaaggagccaaguacaguaguuua

SEQ ID NO: 682858 - RNA, 64 nt, hsa
uaaccucacuagcuucaagaguagacauucuuacuagcucaauuuaaauaauugauuuuaaaua

SEQ ID NO: 682859 - RNA, 64 nt, hsa; identical to SEQ ID NO: 237274

SEQ ID NO: 682860 - RNA, 64 nt, hsa; identical to SEQ ID NO: 237275

SEQ ID NO: 682861 - RNA, 64 nt, hsa; identical to SEQ ID NO: 237276

SEQ ID NO: 682862 - RNA, 64 nt, hsa; identical to SEQ ID NO: 237277

SEQ ID NO: 682863 - RNA, 64 nt, hsa; identical to SEQ ID NO: 165107

SEQ ID NO: 682864 - RNA, 64 nt, hsa; identical to SEQ ID NO: 165108

SEQ ID NO: 682865 - RNA, 64 nt, hsa; identical to SEQ ID NO: 165109

SEQ ID NO: 682866 - RNA, 64 nt, hsa; identical to SEQ ID NO: 165110

SEQ ID NO: 682867 - RNA, 64 nt, hsa; identical to SEQ ID NO: 165111

SEQ ID NO: 682868 - RNA, 64 nt, hsa; identical to SEQ ID NO: 165112

SEQ ID NO: 682869 - RNA, 64 nt, hsa; identical to SEQ ID NO: 165113

SEQ ID NO: 682870 - RNA, 64 nt, hsa; identical to SEQ ID NO: 165114

SEQ ID NO: 682871 - RNA, 64 nt, hsa; identical to SEQ ID NO: 165115

SEQ ID NO: 682872 - RNA, 64 nt, hsa; identical to SEQ ID NO: 165116

SEQ ID NO: 682873 - RNA, 64 nt, hsa; identical to SEQ ID NO: 165117

SEQ ID NO: 682874 - RNA, 64 nt, hsa; identical to SEQ ID NO: 165118

SEQ ID NO: 682875 - RNA, 64 nt, hsa; identical to SEQ ID NO: 165119

SEQ ID NO: 682876 - RNA, 64 nt, hsa; identical to SEQ ID NO: 165120

SEQ ID NO: 682877 - RNA, 64 nt, hsa; identical to SEQ ID NO: 165121

SEQ ID NO: 682878 - RNA, 64 nt, hsa; identical to SEQ ID NO: 165122

SEQ ID NO: 682879 - RNA, 64 nt, hsa; identical to SEQ ID NO: 165123

SEQ ID NO: 682880 - RNA, 64 nt, hsa; identical to SEQ ID NO: 165124

SEQ ID NO: 682881 - RNA, 64 nt, hsa; identical to SEQ ID NO: 165125

SEQ ID NO: 682882 - RNA, 64 nt, hsa; identical to SEQ ID NO: 165126

SEQ ID NO: 682883 - RNA, 64 nt, hsa; identical to SEQ ID NO: 165127

SEQ ID NO: 682884 - RNA, 64 nt, hsa; identical to SEQ ID NO: 165128

SEQ ID NO: 682885 - RNA, 64 nt, hsa; identical to SEQ ID NO: 165129

SEQ ID NO: 682886 - RNA, 64 nt, hsa; identical to SEQ ID NO: 165130

SEQ ID NO: 682887 - RNA, 64 nt, hsa; identical to SEQ ID NO: 165131

SEQ ID NO: 682888 - RNA, 64 nt, hsa; identical to SEQ ID NO: 165132

SEQ ID NO: 682889 - RNA, 64 nt, hsa; identical to SEQ ID NO: 165133

SEQ ID NO: 682890 - RNA, 64 nt, hsa; identical to SEQ ID NO: 165134

SEQ ID NO: 682891 - RNA, 64 nt, hsa; identical to SEQ ID NO: 165135

SEQ ID NO: 682892 - RNA, 64 nt, hsa; identical to SEQ ID NO: 165136

SEQ ID NO: 682893 - RNA, 64 nt, hsa; identical to SEQ ID NO: 165137

SEQ ID NO: 682894 - RNA, 64 nt, hsa; identical to SEQ ID NO: 165138

SEQ ID NO: 682895 - RNA, 64 nt, hsa; identical to SEQ ID NO: 165139

SEQ ID NO: 682896 - RNA, 64 nt, hsa; identical to SEQ ID NO: 165140

SEQ ID NO: 682897 - RNA, 64 nt, hsa; identical to SEQ ID NO: 165141

SEQ ID NO: 682898 - RNA, 64 nt, hsa; identical to SEQ ID NO: 165142

SEQ ID NO: 682899 - RNA, 64 nt, hsa; identical to SEQ ID NO: 165143

SEQ ID NO: 682900 - RNA, 64 nt, hsa; identical to SEQ ID NO: 165144

SEQ ID NO: 682901 - RNA, 64 nt, hsa; identical to SEQ ID NO: 165145

SEQ ID NO: 682902 - RNA, 64 nt, hsa; identical to SEQ ID NO: 165146

SEQ ID NO: 682903 - RNA, 64 nt, hsa; identical to SEQ ID NO: 165147

SEQ ID NO: 682904 - RNA, 64 nt, hsa; identical to SEQ ID NO: 165148

SEQ ID NO: 682905 - RNA, 64 nt, hsa; identical to SEQ ID NO: 165149

SEQ ID NO: 682906 - RNA, 64 nt, hsa; identical to SEQ ID NO: 165150

SEQ ID NO: 682907 - RNA, 64 nt, hsa; identical to SEQ ID NO: 165151

SEQ ID NO: 682908 - RNA, 64 nt, hsa; identical to SEQ ID NO: 165152

SEQ ID NO: 682909 - RNA, 64 nt, hsa; identical to SEQ ID NO: 165153

SEQ ID NO: 682910 - RNA, 64 nt, hsa; identical to SEQ ID NO: 165154

SEQ ID NO: 682911 - RNA, 64 nt, hsa; identical to SEQ ID NO: 165155

SEQ ID NO: 682912 - RNA, 64 nt, hsa; identical to SEQ ID NO: 165156

SEQ ID NO: 682913 - RNA, 60 nt, hsa
uguuaccuuuuccaccucucauuguuuuccccagaacauuguagauggggguuggcagag

SEQ ID NO: 682914 - RNA, 60 nt, hsa
cgaugugggcauccugggguucuuagggucccagaacaagccccaggcaagcuggaacuu

SEQ ID NO: 682915 - RNA, 60 nt, hsa
ggucaacucccaggccucagaugcaggggcccagaacaccugcucucaccugagccccag

SEQ ID NO: 682916 - RNA, 60 nt, hsa
ugcucucaccugaaccccaggugaaggggcccagaacaccugcucucaccugagccccag

SEQ ID NO: 682917 - RNA, 60 nt, hsa
gagggcgaaugacauuacagcuugaccucuccagaacacuaauauccuaaaauacagaac

SEQ ID NO: 682918 - RNA, 60 nt, hsa
agcaucuaauuugcacaacuagaacacaucccagaacaauuacugaaaagcugaaauuua

SEQ ID NO: 682919 - RNA, 60 nt, hsa
gguucucagucccaccccaaaaccuggcacccagaacaguuggaaguguggaaaggaggu

SEQ ID NO: 682920 - RNA, 60 nt, hsa
cuguuuucggaucugugguuccuuugaaagccagaacaauggaucggcuuccuuacccag

SEQ ID NO: 682921 - RNA, 60 nt, hsa
uucccuucccucccccuucacccacucccuccagaacauuuaguguagaugaaaaugugg

SEQ ID NO: 682922 - RNA, 60 nt, hsa
acucccacugucuccagaagucguggccuuccagaacagucugccccucaaggaagggug

SEQ ID NO: 682923 - RNA, 60 nt, hsa
ucagcaggagaugagacuaugaauuggcauccagaacaggagauuuagagcaaaaucuaa

SEQ ID NO: 682924 - RNA, 60 nt, hsa
uggagagcugaucagccaggcacagaaucuccagaacaaccuagagagugaaugcuaauu

SEQ ID NO: 682925 - RNA, 60 nt, hsa
ggagggucagccaccaagcugggagcugagccagaacaggagugaugucucugcccuucc

SEQ ID NO: 682926 - RNA, 60 nt, hsa
gcuuggagcauuggguaucugaugucugcaccagaacaagagaaccucugacgguggaga

SEQ ID NO: 682927 - RNA, 60 nt, hsa
aaauauaaccauuuaaagaaagaaugcauuccagaacaaauuguuuacauaaguuccuau

SEQ ID NO: 682928 - RNA, 60 nt, hsa
accacuugccucuuucuccagcagcugauuccagaacaaaucauuauguuuccuaacugu

SEQ ID NO: 682929 - RNA, 60 nt, hsa
uucuccuugguuaaaauuauacuugaaggcccagaacacucauggcacauuuguuuaaua

SEQ ID NO: 682930 - RNA, 60 nt, hsa
cagaaugccaaaugaaggcuaaaauuuuggccagaacauuacaaaaguuuuaaaucguag

SEQ ID NO: 682931 - RNA, 60 nt, hsa
aaaggaggaaaagucccaccaacuaccagaccagaacacgagccccucugggcagcagga

SEQ ID NO: 682932 - RNA, 60 nt, hsa
uccccaaucaauacacacacacugcagaacccagaacagaaggccacaggcuggcacuac

SEQ ID NO: 682933 - RNA, 60 nt, hsa
gacucgguucuguguugggaccccaaaaaaccagaacaaguucugugugccuccuuucag

SEQ ID NO: 682934 - RNA, 60 nt, hsa
uacuugcacuggaucuuacgcaaaaaagaaccagaacacacaguguggacaacugcccau

SEQ ID NO: 682935 - RNA, 60 nt, hsa
ggccucaacaccuucugaacguggauagugccagaacacuuaggagggugucuuuggacc

SEQ ID NO: 682936 - RNA, 60 nt, hsa
agggaagcacaugaucaugggaaugauagcccagaacaaaaagaaaucuugucuuaccac

SEQ ID NO: 682937 - RNA, 60 nt, hsa
uacaugucauuugacugucucacuuuuuacccagaacaguaacaacccacaccgucuucc

SEQ ID NO: 682938 - RNA, 60 nt, hsa
aacauugaaguuuauuuggauaucaaggucccagaacaaggaagucacuuuucaguggau

SEQ ID NO: 682939 - RNA, 60 nt, hsa
cauaaaccagagaugauaaaacagauacuuccagaacauagugugcuucaaaacauuaau

SEQ ID NO: 682940 - RNA, 60 nt, hsa
uuccucccucaauagugaagugucaaccauccagaacacaagguaggaugugacaaaugg

SEQ ID NO: 682941 - RNA, 60 nt, hsa
ucgaaaguucuagaaacugccuugaaagauccagaacaaaaaguccugaaaauccaaaac

SEQ ID NO: 682942 - RNA, 64 nt, hsa
ugcaagaagagaucuuaggucucuucuuuuauaccaagcucaucuuuuauaccaagcugugcag

SEQ ID NO: 682943 - RNA, 64 nt, hsa
uagaaaauuccccugugcaugguauuaccuuuuucaagcucagauucaucuaauccucaacugu

SEQ ID NO: 682944 - RNA, 64 nt, hsa
aagccccacaaaauuccuguuacccgcugaacuccaagcucaccaaccagauucaugagcuuuc

SEQ ID NO: 682945 - RNA, 64 nt, hsa
ucucaaucggacaccagaggugggggcaacucugcaagcucaccugcuggacgugagaauguug

SEQ ID NO: 682946 - RNA, 64 nt, hsa
ucuuggcagguuugagacaguuccagaaagaacccaagcucaagacgcaggacgagcucaguug

SEQ ID NO: 682947 - RNA, 64 nt, hsa
ccagugugaauuuuauuaaugcuaucaucucgaccaagcucaaagccuacuuauuagaaacaau

SEQ ID NO: 682948 - RNA, 64 nt, hsa
ucuguagauaguauacuaucuacacucugcucaacaagcucagaaauuaaauauuuuuaauaau

SEQ ID NO: 682949 - RNA, 64 nt, hsa
acguaacauggaauacaagcuugaaucugggaaacaagcucaaaaaacagugaaaaaaaaagua

SEQ ID NO: 682950 - RNA, 64 nt, hsa
guuccuccggcaccaguguccuuggcugccauggcaagcucaucaggggcuuguacccugguca

SEQ ID NO: 682951 - RNA, 64 nt, hsa
agugggguccaccuucuucuugcccuaugcagugcaagcucacuucucacccagcaagguugac

SEQ ID NO: 682952 - RNA, 64 nt, hsa
uuaacauguauccacuguaaacguuugucguguacaagcucagagcuuggacagaauuuuuugu

SEQ ID NO: 682953 - RNA, 64 nt, hsa
uugauaaucauauagcgaaggcauauuuuucuuccaagcucaagucaggauugugacuauauau

SEQ ID NO: 682954 - RNA, 64 nt, hsa
ggagccaguaaacagaggaguacaggugaagcaccaagcucaaagcguggacaggugugccgac

SEQ ID NO: 682955 - RNA, 64 nt, hsa
uauuugguuuggccaucucuggaugccugauugccaagcucaggaccaggcaaugugacuuugc

SEQ ID NO: 682956 - RNA, 64 nt, hsa
uugagguggacccccgagggugccccuucaccaucaagcucagcgcccggaaguaagugccccu

SEQ ID NO: 682957 - RNA, 64 nt, hsa
ccugcuacucagacguccuggacgaaaaccagagcaagcucagcgaggaccucauggaguuccg

SEQ ID NO: 682958 - RNA, 64 nt, hsa; identical to SEQ ID NO: 256790

SEQ ID NO: 682959 - RNA, 64 nt, hsa; identical to SEQ ID NO: 256791

SEQ ID NO: 682960 - RNA, 64 nt, hsa; identical to SEQ ID NO: 256792

SEQ ID NO: 682961 - RNA, 64 nt, hsa; identical to SEQ ID NO: 256793

SEQ ID NO: 682962 - RNA, 64 nt, hsa; identical to SEQ ID NO: 256794

SEQ ID NO: 682963 - RNA, 53 nt, hsa; identical to SEQ ID NO: 256795

SEQ ID NO: 682964 - RNA, 64 nt, hsa; identical to SEQ ID NO: 256796

SEQ ID NO: 682965 - RNA, 64 nt, hsa; identical to SEQ ID NO: 256797

SEQ ID NO: 682966 - RNA, 64 nt, hsa; identical to SEQ ID NO: 256798

SEQ ID NO: 682967 - RNA, 64 nt, hsa; identical to SEQ ID NO: 256799

SEQ ID NO: 682968 - RNA, 64 nt, hsa; identical to SEQ ID NO: 256800

SEQ ID NO: 682969 - RNA, 64 nt, hsa; identical to SEQ ID NO: 256801

SEQ ID NO: 682970 - RNA, 64 nt, hsa; identical to SEQ ID NO: 256802

SEQ ID NO: 682971 - RNA, 64 nt, hsa; identical to SEQ ID NO: 256803

SEQ ID NO: 682972 - RNA, 64 nt, hsa; identical to SEQ ID NO: 256804

SEQ ID NO: 682973 - RNA, 64 nt, hsa; identical to SEQ ID NO: 256805

SEQ ID NO: 682974 - RNA, 64 nt, hsa; identical to SEQ ID NO: 256806

SEQ ID NO: 682975 - RNA, 64 nt, hsa; identical to SEQ ID NO: 256807

SEQ ID NO: 682976 - RNA, 64 nt, hsa; identical to SEQ ID NO: 256808

SEQ ID NO: 682977 - RNA, 64 nt, hsa; identical to SEQ ID NO: 256809

SEQ ID NO: 682978 - RNA, 64 nt, hsa; identical to SEQ ID NO: 256810

SEQ ID NO: 682979 - RNA, 64 nt, hsa; identical to SEQ ID NO: 256811

SEQ ID NO: 682980 - RNA, 64 nt, hsa; identical to SEQ ID NO: 256812

SEQ ID NO: 682981 - RNA, 64 nt, hsa; identical to SEQ ID NO: 256813

SEQ ID NO: 682982 - RNA, 64 nt, hsa; identical to SEQ ID NO: 256814

SEQ ID NO: 682983 - RNA, 64 nt, hsa; identical to SEQ ID NO: 256815

SEQ ID NO: 682984 - RNA, 64 nt, hsa; identical to SEQ ID NO: 256816

SEQ ID NO: 682985 - RNA, 64 nt, hsa; identical to SEQ ID NO: 256817

SEQ ID NO: 682986 - RNA, 64 nt, hsa; identical to SEQ ID NO: 256818

SEQ ID NO: 682987 - RNA, 64 nt, hsa; identical to SEQ ID NO: 256819

SEQ ID NO: 682988 - RNA, 64 nt, hsa; identical to SEQ ID NO: 256820

SEQ ID NO: 682989 - RNA, 64 nt, hsa; identical to SEQ ID NO: 256821

SEQ ID NO: 682990 - RNA, 64 nt, hsa; identical to SEQ ID NO: 256822

SEQ ID NO: 682991 - RNA, 64 nt, hsa; identical to SEQ ID NO: 256823

SEQ ID NO: 682992 - RNA, 64 nt, hsa; identical to SEQ ID NO: 256824

SEQ ID NO: 682993 - RNA, 64 nt, hsa; identical to SEQ ID NO: 256825

SEQ ID NO: 682994 - RNA, 64 nt, hsa; identical to SEQ ID NO: 256826

SEQ ID NO: 682995 - RNA, 64 nt, hsa; identical to SEQ ID NO: 256827

SEQ ID NO: 682996 - RNA, 64 nt, hsa; identical to SEQ ID NO: 256828

SEQ ID NO: 682997 - RNA, 64 nt, hsa; identical to SEQ ID NO: 256829

SEQ ID NO: 682998 - RNA, 64 nt, hsa; identical to SEQ ID NO: 256830

SEQ ID NO: 682999 - RNA, 64 nt, hsa; identical to SEQ ID NO: 256831

SEQ ID NO: 683000 - RNA, 64 nt, hsa; identical to SEQ ID NO: 256832

SEQ ID NO: 683001 - RNA, 64 nt, hsa; identical to SEQ ID NO: 256833

SEQ ID NO: 683002 - RNA, 64 nt, hsa; identical to SEQ ID NO: 256834

SEQ ID NO: 683003 - RNA, 64 nt, hsa; identical to SEQ ID NO: 256835

SEQ ID NO: 683004 - RNA, 64 nt, hsa; identical to SEQ ID NO: 256836

SEQ ID NO: 683005 - RNA, 64 nt, hsa; identical to SEQ ID NO: 256837

SEQ ID NO: 683006 - RNA, 64 nt, hsa; identical to SEQ ID NO: 256838

SEQ ID NO: 683007 - RNA, 64 nt, hsa; identical to SEQ ID NO: 256839

SEQ ID NO: 683008 - RNA, 64 nt, hsa; identical to SEQ ID NO: 256840

SEQ ID NO: 683009 - RNA, 64 nt, hsa; identical to SEQ ID NO: 256841

SEQ ID NO: 683010 - RNA, 64 nt, hsa; identical to SEQ ID NO: 256842

SEQ ID NO: 683011 - RNA, 64 nt, hsa; identical to SEQ ID NO: 256843

SEQ ID NO: 683012 - RNA, 64 nt, hsa; identical to SEQ ID NO: 256844

SEQ ID NO: 683013 - RNA, 64 nt, hsa; identical to SEQ ID NO: 256845

SEQ ID NO: 683014 - RNA, 64 nt, hsa; identical to SEQ ID NO: 256846

SEQ ID NO: 683015 - RNA, 64 nt, hsa; identical to SEQ ID NO: 256847

SEQ ID NO: 683016 - RNA, 64 nt, hsa; identical to SEQ ID NO: 256848

SEQ ID NO: 683017 - RNA, 64 nt, hsa; identical to SEQ ID NO: 256849

SEQ ID NO: 683018 - RNA, 64 nt, hsa; identical to SEQ ID NO: 256850

SEQ ID NO: 683019 - RNA, 64 nt, hsa; identical to SEQ ID NO: 256851

SEQ ID NO: 683020 - RNA, 64 nt, hsa; identical to SEQ ID NO: 256852

SEQ ID NO: 683021 - RNA, 64 nt, hsa; identical to SEQ ID NO: 256853

SEQ ID NO: 683022 - RNA, 64 nt, hsa; identical to SEQ ID NO: 256854

SEQ ID NO: 683023 - RNA, 64 nt, hsa; identical to SEQ ID NO: 256855

SEQ ID NO: 683024 - RNA, 64 nt, hsa; identical to SEQ ID NO: 256856

SEQ ID NO: 683025 - RNA, 64 nt, hsa; identical to SEQ ID NO: 256857

SEQ ID NO: 683026 - RNA, 64 nt, hsa; identical to SEQ ID NO: 256858

SEQ ID NO: 683027 - RNA, 64 nt, hsa; identical to SEQ ID NO: 256859

SEQ ID NO: 683028 - RNA, 64 nt, hsa; identical to SEQ ID NO: 256860

SEQ ID NO: 683029 - RNA, 64 nt, hsa; identical to SEQ ID NO: 256861

SEQ ID NO: 683030 - RNA, 64 nt, hsa; identical to SEQ ID NO: 256862

SEQ ID NO: 683031 - RNA, 64 nt, hsa; identical to SEQ ID NO: 256863

SEQ ID NO: 683032 - RNA, 64 nt, hsa; identical to SEQ ID NO: 256864

SEQ ID NO: 683033 - RNA, 64 nt, hsa; identical to SEQ ID NO: 256865

SEQ ID NO: 683034 - RNA, 64 nt, hsa; identical to SEQ ID NO: 256866

SEQ ID NO: 683035 - RNA, 64 nt, hsa; identical to SEQ ID NO: 256867

SEQ ID NO: 683036 - RNA, 64 nt, hsa; identical to SEQ ID NO: 256868

SEQ ID NO: 683037 - RNA, 64 nt, hsa; identical to SEQ ID NO: 256869

SEQ ID NO: 683038 - RNA, 64 nt, hsa; identical to SEQ ID NO: 256870

SEQ ID NO: 683039 - RNA, 64 nt, hsa; identical to SEQ ID NO: 256871

SEQ ID NO: 683040 - RNA, 64 nt, hsa; identical to SEQ ID NO: 256872

SEQ ID NO: 683041 - RNA, 64 nt, hsa; identical to SEQ ID NO: 256873

SEQ ID NO: 683042 - RNA, 59 nt, hsa; identical to SEQ ID NO: 256874

SEQ ID NO: 683043 - RNA, 64 nt, hsa; identical to SEQ ID NO: 256875

SEQ ID NO: 683044 - RNA, 64 nt, hsa; identical to SEQ ID NO: 256876

SEQ ID NO: 683045 - RNA, 64 nt, hsa; identical to SEQ ID NO: 256877

SEQ ID NO: 683046 - RNA, 64 nt, hsa; identical to SEQ ID NO: 256878

SEQ ID NO: 683047 - RNA, 64 nt, hsa; identical to SEQ ID NO: 256879

SEQ ID NO: 683048 - RNA, 64 nt, hsa; identical to SEQ ID NO: 256880

SEQ ID NO: 683049 - RNA, 64 nt, hsa; identical to SEQ ID NO: 256881

SEQ ID NO: 683050 - RNA, 64 nt, hsa; identical to SEQ ID NO: 256882

SEQ ID NO: 683051 - RNA, 64 nt, hsa; identical to SEQ ID NO: 256883

SEQ ID NO: 683052 - RNA, 64 nt, hsa; identical to SEQ ID NO: 256884

SEQ ID NO: 683053 - RNA, 64 nt, hsa; identical to SEQ ID NO: 256885

SEQ ID NO: 683054 - RNA, 64 nt, hsa; identical to SEQ ID NO: 256886

SEQ ID NO: 683055 - RNA, 64 nt, hsa; identical to SEQ ID NO: 536323

SEQ ID NO: 683056 - RNA, 64 nt, hsa; identical to SEQ ID NO: 536324

SEQ ID NO: 683057 - RNA, 64 nt, hsa; identical to SEQ ID NO: 536325

SEQ ID NO: 683058 - RNA, 64 nt, hsa; identical to SEQ ID NO: 536326

SEQ ID NO: 683059 - RNA, 64 nt, hsa; identical to SEQ ID NO: 536327

SEQ ID NO: 683060 - RNA, 64 nt, hsa; identical to SEQ ID NO: 536328

SEQ ID NO: 683061 - RNA, 64 nt, hsa; identical to SEQ ID NO: 536329

SEQ ID NO: 683062 - RNA, 64 nt, hsa; identical to SEQ ID NO: 536330

SEQ ID NO: 683063 - RNA, 64 nt, hsa; identical to SEQ ID NO: 536331

SEQ ID NO: 683064 - RNA, 64 nt, hsa; identical to SEQ ID NO: 536332

SEQ ID NO: 683065 - RNA, 64 nt, hsa; identical to SEQ ID NO: 536333

SEQ ID NO: 683066 - RNA, 64 nt, hsa; identical to SEQ ID NO: 536334

SEQ ID NO: 683067 - RNA, 64 nt, hsa; identical to SEQ ID NO: 536335

SEQ ID NO: 683068 - RNA, 64 nt, hsa; identical to SEQ ID NO: 536336

SEQ ID NO: 683069 - RNA, 64 nt, hsa; identical to SEQ ID NO: 536337

SEQ ID NO: 683070 - RNA, 64 nt, hsa; identical to SEQ ID NO: 536338

SEQ ID NO: 683071 - RNA, 64 nt, hsa; identical to SEQ ID NO: 123248

SEQ ID NO: 683072 - RNA, 64 nt, hsa; identical to SEQ ID NO: 123249

SEQ ID NO: 683073 - RNA, 64 nt, hsa; identical to SEQ ID NO: 123250

SEQ ID NO: 683074 - RNA, 64 nt, hsa; identical to SEQ ID NO: 123251

SEQ ID NO: 683075 - RNA, 64 nt, hsa; identical to SEQ ID NO: 123252

SEQ ID NO: 683076 - RNA, 64 nt, hsa; identical to SEQ ID NO: 123253

SEQ ID NO: 683077 - RNA, 64 nt, hsa; identical to SEQ ID NO: 123254

SEQ ID NO: 683078 - RNA, 64 nt, hsa; identical to SEQ ID NO: 123255

SEQ ID NO: 683079 - RNA, 64 nt, hsa; identical to SEQ ID NO: 123256

SEQ ID NO: 683080 - RNA, 64 nt, hsa; identical to SEQ ID NO: 123257

SEQ ID NO: 683081 - RNA, 64 nt, hsa; identical to SEQ ID NO: 123258

SEQ ID NO: 683082 - RNA, 64 nt, hsa; identical to SEQ ID NO: 123259

SEQ ID NO: 683083 - RNA, 64 nt, hsa; identical to SEQ ID NO: 123260

SEQ ID NO: 683084 - RNA, 64 nt, hsa; identical to SEQ ID NO: 123261

SEQ ID NO: 683085 - RNA, 64 nt, hsa; identical to SEQ ID NO: 123262

SEQ ID NO: 683086 - RNA, 64 nt, hsa; identical to SEQ ID NO: 123263

SEQ ID NO: 683087 - RNA, 64 nt, hsa; identical to SEQ ID NO: 123264

SEQ ID NO: 683088 - RNA, 64 nt, hsa; identical to SEQ ID NO: 123265

SEQ ID NO: 683089 - RNA, 64 nt, hsa; identical to SEQ ID NO: 123266

SEQ ID NO: 683090 - RNA, 64 nt, hsa; identical to SEQ ID NO: 123267

SEQ ID NO: 683091 - RNA, 64 nt, hsa; identical to SEQ ID NO: 123268

SEQ ID NO: 683092 - RNA, 64 nt, hsa; identical to SEQ ID NO: 123269

SEQ ID NO: 683093 - RNA, 64 nt, hsa; identical to SEQ ID NO: 123270

SEQ ID NO: 683094 - RNA, 64 nt, hsa; identical to SEQ ID NO: 123271

SEQ ID NO: 683095 - RNA, 64 nt, hsa; identical to SEQ ID NO: 123272

SEQ ID NO: 683096 - RNA, 64 nt, hsa; identical to SEQ ID NO: 123273

SEQ ID NO: 683097 - RNA, 64 nt, hsa; identical to SEQ ID NO: 123274

SEQ ID NO: 683098 - RNA, 64 nt, hsa; identical to SEQ ID NO: 123275

SEQ ID NO: 683099 - RNA, 64 nt, hsa; identical to SEQ ID NO: 123276

SEQ ID NO: 683100 - RNA, 64 nt, hsa; identical to SEQ ID NO: 123277

SEQ ID NO: 683101 - RNA, 64 nt, hsa; identical to SEQ ID NO: 123278

SEQ ID NO: 683102 - RNA, 64 nt, hsa; identical to SEQ ID NO: 123279

SEQ ID NO: 683103 - RNA, 64 nt, hsa; identical to SEQ ID NO: 123280

SEQ ID NO: 683104 - RNA, 64 nt, hsa; identical to SEQ ID NO: 123281

SEQ ID NO: 683105 - RNA, 64 nt, hsa; identical to SEQ ID NO: 123282

SEQ ID NO: 683106 - RNA, 64 nt, hsa; identical to SEQ ID NO: 123283

SEQ ID NO: 683107 - RNA, 64 nt, hsa; identical to SEQ ID NO: 123284

SEQ ID NO: 683108 - RNA, 64 nt, hsa; identical to SEQ ID NO: 123285

SEQ ID NO: 683109 - RNA, 64 nt, hsa; identical to SEQ ID NO: 123286

SEQ ID NO: 683110 - RNA, 64 nt, hsa; identical to SEQ ID NO: 123287

SEQ ID NO: 683111 - RNA, 64 nt, hsa; identical to SEQ ID NO: 123288

SEQ ID NO: 683112 - RNA, 64 nt, hsa; identical to SEQ ID NO: 123289

SEQ ID NO: 683113 - RNA, 64 nt, hsa; identical to SEQ ID NO: 123290

SEQ ID NO: 683114 - RNA, 64 nt, hsa; identical to SEQ ID NO: 123291

SEQ ID NO: 683115 - RNA, 64 nt, hsa; identical to SEQ ID NO: 503392

SEQ ID NO: 683116 - RNA, 64 nt, hsa; identical to SEQ ID NO: 503393

SEQ ID NO: 683117 - RNA, 64 nt, hsa; identical to SEQ ID NO: 503394

SEQ ID NO: 683118 - RNA, 64 nt, hsa; identical to SEQ ID NO: 503395

SEQ ID NO: 683119 - RNA, 64 nt, hsa; identical to SEQ ID NO: 503396

SEQ ID NO: 683120 - RNA, 64 nt, hsa; identical to SEQ ID NO: 503397

SEQ ID NO: 683121 - RNA, 64 nt, hsa; identical to SEQ ID NO: 503398

SEQ ID NO: 683122 - RNA, 64 nt, hsa; identical to SEQ ID NO: 503399

SEQ ID NO: 683123 - RNA, 64 nt, hsa; identical to SEQ ID NO: 503400

SEQ ID NO: 683124 - RNA, 64 nt, hsa; identical to SEQ ID NO: 503401

SEQ ID NO: 683125 - RNA, 64 nt, hsa; identical to SEQ ID NO: 503402

SEQ ID NO: 683126 - RNA, 64 nt, hsa; identical to SEQ ID NO: 503403

SEQ ID NO: 683127 - RNA, 64 nt, hsa; identical to SEQ ID NO: 503404

SEQ ID NO: 683128 - RNA, 64 nt, hsa; identical to SEQ ID NO: 503405

SEQ ID NO: 683129 - RNA, 64 nt, hsa; identical to SEQ ID NO: 503406

SEQ ID NO: 683130 - RNA, 64 nt, hsa; identical to SEQ ID NO: 503407

SEQ ID NO: 683131 - RNA, 64 nt, hsa; identical to SEQ ID NO: 172545

SEQ ID NO: 683132 - RNA, 64 nt, hsa; identical to SEQ ID NO: 172546

SEQ ID NO: 683133 - RNA, 64 nt, hsa; identical to SEQ ID NO: 172547

SEQ ID NO: 683134 - RNA, 64 nt, hsa; identical to SEQ ID NO: 172548

SEQ ID NO: 683135 - RNA, 64 nt, hsa; identical to SEQ ID NO: 172549

SEQ ID NO: 683136 - RNA, 64 nt, hsa; identical to SEQ ID NO: 172550

SEQ ID NO: 683137 - RNA, 64 nt, hsa; identical to SEQ ID NO: 172551

SEQ ID NO: 683138 - RNA, 64 nt, hsa; identical to SEQ ID NO: 172552

SEQ ID NO: 683139 - RNA, 64 nt, hsa; identical to SEQ ID NO: 172553

SEQ ID NO: 683140 - RNA, 64 nt, hsa; identical to SEQ ID NO: 172554

SEQ ID NO: 683141 - RNA, 64 nt, hsa; identical to SEQ ID NO: 172555

SEQ ID NO: 683142 - RNA, 64 nt, hsa; identical to SEQ ID NO: 172556

SEQ ID NO: 683143 - RNA, 64 nt, hsa; identical to SEQ ID NO: 172557

SEQ ID NO: 683144 - RNA, 64 nt, hsa; identical to SEQ ID NO: 172558

SEQ ID NO: 683145 - RNA, 64 nt, hsa; identical to SEQ ID NO: 172559

SEQ ID NO: 683146 - RNA, 64 nt, hsa; identical to SEQ ID NO: 172560

SEQ ID NO: 683147 - RNA, 64 nt, hsa; identical to SEQ ID NO: 172561

SEQ ID NO: 683148 - RNA, 64 nt, hsa; identical to SEQ ID NO: 172562

SEQ ID NO: 683149 - RNA, 64 nt, hsa; identical to SEQ ID NO: 172563

SEQ ID NO: 683150 - RNA, 64 nt, hsa; identical to SEQ ID NO: 172564

SEQ ID NO: 683151 - RNA, 64 nt, hsa; identical to SEQ ID NO: 172565

SEQ ID NO: 683152 - RNA, 64 nt, hsa; identical to SEQ ID NO: 172566

SEQ ID NO: 683153 - RNA, 64 nt, hsa; identical to SEQ ID NO: 172567

SEQ ID NO: 683154 - RNA, 64 nt, hsa; identical to SEQ ID NO: 172568

SEQ ID NO: 683155 - RNA, 64 nt, hsa; identical to SEQ ID NO: 172569

SEQ ID NO: 683156 - RNA, 64 nt, hsa; identical to SEQ ID NO: 172570

SEQ ID NO: 683157 - RNA, 64 nt, hsa; identical to SEQ ID NO: 172571

SEQ ID NO: 683158 - RNA, 64 nt, hsa; identical to SEQ ID NO: 172572

SEQ ID NO: 683159 - RNA, 64 nt, hsa; identical to SEQ ID NO: 172573

SEQ ID NO: 683160 - RNA, 64 nt, hsa; identical to SEQ ID NO: 172574

SEQ ID NO: 683161 - RNA, 64 nt, hsa; identical to SEQ ID NO: 172575

SEQ ID NO: 683162 - RNA, 53 nt, hsa; identical to SEQ ID NO: 172576

SEQ ID NO: 683163 - RNA, 64 nt, hsa; identical to SEQ ID NO: 172577

SEQ ID NO: 683164 - RNA, 64 nt, hsa; identical to SEQ ID NO: 172578

SEQ ID NO: 683165 - RNA, 64 nt, hsa
aggcagugaauuuccagcaccaggggagaaggggcgucuucaggagggcuucgggguuuugcuu

SEQ ID NO: 683166 - RNA, 64 nt, hsa
cuucagagauguaucuugucuuugucaggcccuucgucuucauggcccaccuguuuucugccgu

SEQ ID NO: 683167 - RNA, 64 nt, hsa
gaacaaagaagcugugaccccagcaggaugucuaauaugugaggaaaugagauguccaccuaaa

SEQ ID NO: 683168 - RNA, 64 nt, hsa
auaugugaggaaaugagauguccaccuaaaauucauaugugacaaaauuaucucgaccuuacau

SEQ ID NO: 683169 - RNA, 64 nt, hsa
uuuucacagucuccagggugacaaaugccaauagauaugugaguuaauuuuuuuaaauaucucc

SEQ ID NO: 683170 - RNA, 64 nt, hsa
ccacagcagcuucaucuuuacgauaacucagugcauaugugaaagagaaugaugcauuaacuga

SEQ ID NO: 683171 - RNA, 64 nt, hsa
uuuaaaauauaaagcuacauccaaagaaaugccaauaugugacauuaguaugaaauuuacuaca

SEQ ID NO: 683172 - RNA, 64 nt, hsa
aauuuguucggaauacacuaauuuuugcuccucuauaugugaggaaaaugagacuagacagauu

SEQ ID NO: 683173 - RNA, 64 nt, hsa
acaaccuaaagaucucuguguucauacgccccagauaugugaguuacaugagauggcacaguga

SEQ ID NO: 683174 - RNA, 64 nt, hsa
uuguaaaucugccuaaagauuuuuugcauauuauauaugugaauuuugguuguaaguucauaac

SEQ ID NO: 683175 - RNA, 64 nt, hsa
auuuacauuuaauagaaacauaucuagcauauguauaugugauuuuuuuuuuuuuuuugagacc

SEQ ID NO: 683176 - RNA, 64 nt, hsa
gaauuacaggcaugagccaccgcgccuggccuguauaugugauuucuaaaaaauagaugcaugc

SEQ ID NO: 683177 - RNA, 64 nt, hsa
ccuucuuuuagaucuuccuugggccuuuggaaaaauaugugacaagugaauguaagucugugcc

SEQ ID NO: 683178 - RNA, 64 nt, hsa
gcaaauauguuuagguaaacugaccuauaacagaauaugugaaaugaauuuggaaauaaugcaa

SEQ ID NO: 683179 - RNA, 64 nt, hsa
guucaaacauuuuuggugagugcugcuuuuauaaauaugugaugucacauauuucagugacagc

SEQ ID NO: 683180 - RNA, 64 nt, hsa
ucuggguuuuguuuuuuaauauacuuuuuaauggauaugugaaaacugaaggaaauguuaaagg

SEQ ID NO: 683181 - RNA, 64 nt, hsa
uuuuguguucaguacaauuauaagcuguuuuuauauaugugaaauaaaaguagaauaaacacaa

SEQ ID NO: 683182 - RNA, 64 nt, hsa
uugcaagacauagaauaguguuggaaaaugugcaauaugugauguggcaaaucucuauuaggaa

SEQ ID NO: 683183 - RNA, 64 nt, hsa
uagggaggcauuuacaguccucuaauguugauuaauaugugaaaagaaauuguaccaauuuuac

SEQ ID NO: 683184 - RNA, 64 nt, hsa
caauguaagaggaaggguggagaaggagagagaaauaugugagguaguaaggaggacagaaaac

SEQ ID NO: 683185 - RNA, 64 nt, hsa
cucuugauaaaaaaugcacaaaaaaucacuuuguauaugugaguuucacugcauuguauauuuu

SEQ ID NO: 683186 - RNA, 64 nt, hsa
caaagaauguauucuucauagguuuauucuuuuaauaugugaacuauuauuaaaguuuacucug

SEQ ID NO: 683187 - RNA, 64 nt, hsa
uaaugaacauaaaaugcuauuuauaauaacaaguauaugugaaauuucuuauuguaagacuacu

SEQ ID NO: 683188 - RNA, 64 nt, hsa
gaaauuacaaucaaguaacuaaggccuugaguucauaugugacacugaaugcacuagcuuccuu

SEQ ID NO: 683189 - RNA, 64 nt, hsa
auccaaaaaaaaugaaaaccuaggaaaguagcaaauaugugagcaaaaugaaacaaauacuugu

SEQ ID NO: 683190 - RNA, 64 nt, hsa
aaagugaaauauagauauuuuaaggaaaaccaaaauaugugaguguuaauaaagaaaagauuuc

SEQ ID NO: 683191 - RNA, 64 nt, hsa
gggauuuucugacguaagauuuucauuuguaggaauaugugaugucaaauggaagacucagaag

SEQ ID NO: 683192 - RNA, 64 nt, hsa
uggguuaaauuugaaagcaauucucuauauauaaauaugugaaauauuaugaucugaacuuagc

SEQ ID NO: 683193 - RNA, 64 nt, hsa; identical to SEQ ID NO: 309727

SEQ ID NO: 683194 - RNA, 64 nt, hsa; identical to SEQ ID NO: 309728

SEQ ID NO: 683195 - RNA, 62 nt, hsa
gaaaggaaaaaaaggaagagagaggaagggagaagggagaggaaugaauugaggaagugaaa

SEQ ID NO: 683196 - RNA, 62 nt, hsa
aaaagcagaaaggaaaaaaaggaagagagaggaagggagaagggagaggaaugaauugagga

SEQ ID NO: 683197 - RNA, 62 nt, hsa
caaaagggagagccccacaaaacuuuggggacaagggagagagagacucaucugacacuucu

SEQ ID NO: 683198 - RNA, 62 nt, hsa
gggcaacacaguuccauucuagagggaaacaaaagggagagccccacaaaacuuuggggaca

SEQ ID NO: 683199 - RNA, 62 nt, hsa
aaggcccggcccaggaccacugugagcuggaaaagggagaaaggcagugggaaaagagguga

SEQ ID NO: 683200 - RNA, 62 nt, hsa
cccauucccucuuuaucuaucaacucuaggacaagggagaacaaaagcaagccagaagcaga

SEQ ID NO: 683201 - RNA, 62 nt, hsa
caauaaaaaaaugacuccuaguuguguuuggaaagggagagaagagaugucugaggaagguc

SEQ ID NO: 683202 - RNA, 62 nt, hsa
gccaccacgcagccuuggcuccuacagcccaaaagggagaauggagggaggcuccaggcuuu

SEQ ID NO: 683203 - RNA, 62 nt, hsa
aaugaucuuggaauauuugcugugaagggagaaagggagagaaaacucuucugaggaucauu

SEQ ID NO: 683204 - RNA, 62 nt, hsa
acugaaauaaugaucuuggaauauuugcugugaagggagaaagggagagaaaacucuucuga

SEQ ID NO: 683205 - RNA, 62 nt, hsa
gaagauuaaugcagagaaagagcaaagcccaaaagggagaaaaaaaaaacaaaaaaacaaaa

SEQ ID NO: 683206 - RNA, 62 nt, hsa
gcucuggguccuguuauuugcuagggaggguaaagggagacuauuucaaagcuacuguuccu

SEQ ID NO: 683207 - RNA, 62 nt, hsa
aaccgccaaauuguuucagagcagaaaagaaaaagggagaaaaccucuuagcaaagcccugu

SEQ ID NO: 683208 - RNA, 62 nt, hsa
cugguggcugggacccuccaggggugagaaggaagggagaagguggcauaacuuuuuggaac

SEQ ID NO: 683209 - RNA, 62 nt, hsa
ggucugugugguugucuucacgggcaaucaggaagggagagagcuggggaccauauucugca

SEQ ID NO: 683210 - RNA, 62 nt, hsa
gcaaugcagccaaauccgaggaagagaaacugaagggagaaguagauggcaaugguuaugau

SEQ ID NO: 683211 - RNA, 62 nt, hsa
uuuuaucauugcaggccaguggacagagggagaagggagaacaggggucgccaacacuugug

SEQ ID NO: 683212 - RNA, 62 nt, hsa
uaugggaccugcuaaguguggaauuaccugauaagggagagggaaauacaaggagggccucu

SEQ ID NO: 683213 - RNA, 62 nt, hsa
caagcacuugauuaacacaacacugcaaacagaagggagaaagugucagugacacaguuucc

SEQ ID NO: 683214 - RNA, 62 nt, hsa
ggacucuuuaaaaucugguauccuauccacccaagggagacacuaacagauaggccaaagua

SEQ ID NO: 683215 - RNA, 62 nt, hsa
auuugauaagagaaaugcauuugauugugaagaagggagaguuaaauucuccauuauguucg

SEQ ID NO: 683216 - RNA, 62 nt, hsa
uuuccuuugaugggcuuaaaagaaauuauccaaagggagaaagagcaguaugccacuucuua

SEQ ID NO: 683217 - RNA, 62 nt, hsa
guguccucagccgacacucacgagggcagugcaagggagaaccugccagcccagccccacca

SEQ ID NO: 683218 - RNA, 62 nt, hsa
aaagcgugguucuguaagaaaucagagggagaaagggagagaagggggagggagacaaccca

SEQ ID NO: 683219 - RNA, 62 nt, hsa
aagaagaagucuaaaagaaaacaucauuugcaaagggagagaggggcaagcaugauauguug

SEQ ID NO: 683220 - RNA, 62 nt, hsa
uucugaucuuugggcauggccaggggaagcagaagggagacucuaggaguugaaauggguca

SEQ ID NO: 683221 - RNA, 62 nt, hsa
ccauuguaccuggcacaagggcuguucaugaaaagggagacuuacugggaggugcaagacag

SEQ ID NO: 683222 - RNA, 62 nt, hsa
agguucaaguuccacuucuugguggggaugagaagggagagagagcuagagggacaaagaga

SEQ ID NO: 683223 - RNA, 62 nt, hsa
gaccuucagaaacuaaggaggaguuuuauauuaagggagacauuuuagucaguaagacgaua

SEQ ID NO: 683224 - RNA, 62 nt, hsa
ucucucuaacucuggguaucccacagaugcaaaagggagaauaaaccugaauauuauuacca

SEQ ID NO: 683225 - RNA, 62 nt, hsa
gcuggggcuggggguggcugggaggggaagggaagggagaggcaagcuggcugugaacuguc

SEQ ID NO: 683226 - RNA, 62 nt, hsa
gaaguggguggagcaucagcguuugcucaguuaagggagagguagagaggggcccgugaagu

SEQ ID NO: 683227 - RNA, 64 nt, hsa; identical to SEQ ID NO: 209051

SEQ ID NO: 683228 - RNA, 64 nt, hsa; identical to SEQ ID NO: 209052

SEQ ID NO: 683229 - RNA, 64 nt, hsa; identical to SEQ ID NO: 209053

SEQ ID NO: 683230 - RNA, 64 nt, hsa; identical to SEQ ID NO: 209054

SEQ ID NO: 683231 - RNA, 60 nt, hsa; identical to SEQ ID NO: 550573

SEQ ID NO: 683232 - RNA, 64 nt, hsa; identical to SEQ ID NO: 550574

SEQ ID NO: 683233 - RNA, 64 nt, hsa; identical to SEQ ID NO: 550575

SEQ ID NO: 683234 - RNA, 64 nt, hsa; identical to SEQ ID NO: 550576

SEQ ID NO: 683235 - RNA, 64 nt, hsa; identical to SEQ ID NO: 550577

SEQ ID NO: 683236 - RNA, 64 nt, hsa; identical to SEQ ID NO: 550578

SEQ ID NO: 683237 - RNA, 64 nt, hsa; identical to SEQ ID NO: 550579

SEQ ID NO: 683238 - RNA, 64 nt, hsa; identical to SEQ ID NO: 550580

SEQ ID NO: 683239 - RNA, 64 nt, hsa; identical to SEQ ID NO: 550581

SEQ ID NO: 683240 - RNA, 64 nt, hsa; identical to SEQ ID NO: 550582

SEQ ID NO: 683241 - RNA, 64 nt, hsa; identical to SEQ ID NO: 550583

SEQ ID NO: 683242 - RNA, 64 nt, hsa; identical to SEQ ID NO: 550584

SEQ ID NO: 683243 - RNA, 64 nt, hsa; identical to SEQ ID NO: 550585

SEQ ID NO: 683244 - RNA, 64 nt, hsa; identical to SEQ ID NO: 550586

SEQ ID NO: 683245 - RNA, 64 nt, hsa; identical to SEQ ID NO: 550587

SEQ ID NO: 683246 - RNA, 64 nt, hsa; identical to SEQ ID NO: 550588

SEQ ID NO: 683247 - RNA, 64 nt, hsa; identical to SEQ ID NO: 550589

SEQ ID NO: 683248 - RNA, 64 nt, hsa; identical to SEQ ID NO: 550590

SEQ ID NO: 683249 - RNA, 64 nt, hsa; identical to SEQ ID NO: 159659

SEQ ID NO: 683250 - RNA, 64 nt, hsa; identical to SEQ ID NO: 159660

SEQ ID NO: 683251 - RNA, 64 nt, hsa; identical to SEQ ID NO: 159661

SEQ ID NO: 683252 - RNA, 64 nt, hsa; identical to SEQ ID NO: 159662

SEQ ID NO: 683253 - RNA, 64 nt, hsa; identical to SEQ ID NO: 159663

SEQ ID NO: 683254 - RNA, 64 nt, hsa; identical to SEQ ID NO: 159664

SEQ ID NO: 683255 - RNA, 64 nt, hsa; identical to SEQ ID NO: 159665

SEQ ID NO: 683256 - RNA, 64 nt, hsa; identical to SEQ ID NO: 159666

SEQ ID NO: 683257 - RNA, 64 nt, hsa; identical to SEQ ID NO: 159667

SEQ ID NO: 683258 - RNA, 64 nt, hsa; identical to SEQ ID NO: 159668

SEQ ID NO: 683259 - RNA, 64 nt, hsa; identical to SEQ ID NO: 323443

SEQ ID NO: 683260 - RNA, 64 nt, hsa; identical to SEQ ID NO: 323444

SEQ ID NO: 683261 - RNA, 64 nt, hsa; identical to SEQ ID NO: 323445

SEQ ID NO: 683262 - RNA, 64 nt, hsa; identical to SEQ ID NO: 323446

SEQ ID NO: 683263 - RNA, 64 nt, hsa; identical to SEQ ID NO: 323447

SEQ ID NO: 683264 - RNA, 64 nt, hsa; identical to SEQ ID NO: 323448

SEQ ID NO: 683265 - RNA, 64 nt, hsa; identical to SEQ ID NO: 323449

SEQ ID NO: 683266 - RNA, 64 nt, hsa; identical to SEQ ID NO: 323450

SEQ ID NO: 683267 - RNA, 64 nt, hsa; identical to SEQ ID NO: 323451

SEQ ID NO: 683268 - RNA, 64 nt, hsa; identical to SEQ ID NO: 323452

SEQ ID NO: 683269 - RNA, 64 nt, hsa; identical to SEQ ID NO: 147168

SEQ ID NO: 683270 - RNA, 64 nt, hsa; identical to SEQ ID NO: 147169

SEQ ID NO: 683271 - RNA, 64 nt, hsa; identical to SEQ ID NO: 147170

SEQ ID NO: 683272 - RNA, 64 nt, hsa; identical to SEQ ID NO: 147171

SEQ ID NO: 683273 - RNA, 64 nt, hsa; identical to SEQ ID NO: 147172

SEQ ID NO: 683274 - RNA, 64 nt, hsa; identical to SEQ ID NO: 147173

SEQ ID NO: 683275 - RNA, 64 nt, hsa; identical to SEQ ID NO: 147174

SEQ ID NO: 683276 - RNA, 64 nt, hsa; identical to SEQ ID NO: 147175

SEQ ID NO: 683277 - RNA, 64 nt, hsa; identical to SEQ ID NO: 147176

SEQ ID NO: 683278 - RNA, 64 nt, hsa; identical to SEQ ID NO: 147177

SEQ ID NO: 683279 - RNA, 64 nt, hsa; identical to SEQ ID NO: 147178

SEQ ID NO: 683280 - RNA, 64 nt, hsa; identical to SEQ ID NO: 147179

SEQ ID NO: 683281 - RNA, 64 nt, hsa; identical to SEQ ID NO: 39347

SEQ ID NO: 683282 - RNA, 64 nt, hsa; identical to SEQ ID NO: 39348

SEQ ID NO: 683283 - RNA, 64 nt, hsa; identical to SEQ ID NO: 39349

SEQ ID NO: 683284 - RNA, 64 nt, hsa; identical to SEQ ID NO: 39350

SEQ ID NO: 683285 - RNA, 64 nt, hsa; identical to SEQ ID NO: 39351

SEQ ID NO: 683286 - RNA, 64 nt, hsa; identical to SEQ ID NO: 39352

SEQ ID NO: 683287 - RNA, 64 nt, hsa; identical to SEQ ID NO: 39353

SEQ ID NO: 683288 - RNA, 64 nt, hsa; identical to SEQ ID NO: 39354

SEQ ID NO: 683289 - RNA, 64 nt, hsa; identical to SEQ ID NO: 39355

SEQ ID NO: 683290 - RNA, 64 nt, hsa; identical to SEQ ID NO: 39356

SEQ ID NO: 683291 - RNA, 64 nt, hsa; identical to SEQ ID NO: 39357

SEQ ID NO: 683292 - RNA, 64 nt, hsa; identical to SEQ ID NO: 39358

SEQ ID NO: 683293 - RNA, 64 nt, hsa; identical to SEQ ID NO: 39359

SEQ ID NO: 683294 - RNA, 64 nt, hsa; identical to SEQ ID NO: 39360

SEQ ID NO: 683295 - RNA, 64 nt, hsa; identical to SEQ ID NO: 39361

SEQ ID NO: 683296 - RNA, 64 nt, hsa; identical to SEQ ID NO: 39362

SEQ ID NO: 683297 - RNA, 64 nt, hsa; identical to SEQ ID NO: 39363

SEQ ID NO: 683298 - RNA, 64 nt, hsa; identical to SEQ ID NO: 39364

SEQ ID NO: 683299 - RNA, 64 nt, hsa; identical to SEQ ID NO: 39365

SEQ ID NO: 683300 - RNA, 64 nt, hsa; identical to SEQ ID NO: 39366

SEQ ID NO: 683301 - RNA, 64 nt, hsa; identical to SEQ ID NO: 39367

SEQ ID NO: 683302 - RNA, 64 nt, hsa; identical to SEQ ID NO: 39368

SEQ ID NO: 683303 - RNA, 64 nt, hsa; identical to SEQ ID NO: 39369

SEQ ID NO: 683304 - RNA, 64 nt, hsa; identical to SEQ ID NO: 39370

SEQ ID NO: 683305 - RNA, 64 nt, hsa; identical to SEQ ID NO: 39371

SEQ ID NO: 683306 - RNA, 64 nt, hsa; identical to SEQ ID NO: 39372

SEQ ID NO: 683307 - RNA, 64 nt, hsa; identical to SEQ ID NO: 39373

SEQ ID NO: 683308 - RNA, 64 nt, hsa; identical to SEQ ID NO: 39374

SEQ ID NO: 683309 - RNA, 64 nt, hsa; identical to SEQ ID NO: 39375

SEQ ID NO: 683310 - RNA, 64 nt, hsa; identical to SEQ ID NO: 39376

SEQ ID NO: 683311 - RNA, 64 nt, hsa; identical to SEQ ID NO: 39377

SEQ ID NO: 683312 - RNA, 64 nt, hsa; identical to SEQ ID NO: 39378

SEQ ID NO: 683313 - RNA, 64 nt, hsa; identical to SEQ ID NO: 39379

SEQ ID NO: 683314 - RNA, 64 nt, hsa; identical to SEQ ID NO: 39380

SEQ ID NO: 683315 - RNA, 64 nt, hsa; identical to SEQ ID NO: 39381

SEQ ID NO: 683316 - RNA, 64 nt, hsa; identical to SEQ ID NO: 39382

SEQ ID NO: 683317 - RNA, 64 nt, hsa; identical to SEQ ID NO: 39383

SEQ ID NO: 683318 - RNA, 64 nt, hsa; identical to SEQ ID NO: 39384

SEQ ID NO: 683319 - RNA, 64 nt, hsa; identical to SEQ ID NO: 39385

SEQ ID NO: 683320 - RNA, 64 nt, hsa; identical to SEQ ID NO: 39386

SEQ ID NO: 683321 - RNA, 64 nt, hsa; identical to SEQ ID NO: 39387

SEQ ID NO: 683322 - RNA, 64 nt, hsa; identical to SEQ ID NO: 39388

SEQ ID NO: 683323 - RNA, 64 nt, hsa; identical to SEQ ID NO: 39389

SEQ ID NO: 683324 - RNA, 64 nt, hsa; identical to SEQ ID NO: 39390

SEQ ID NO: 683325 - RNA, 64 nt, hsa; identical to SEQ ID NO: 39391

SEQ ID NO: 683326 - RNA, 64 nt, hsa; identical to SEQ ID NO: 39392

SEQ ID NO: 683327 - RNA, 64 nt, hsa; identical to SEQ ID NO: 39393

SEQ ID NO: 683328 - RNA, 64 nt, hsa; identical to SEQ ID NO: 39394

SEQ ID NO: 683329 - RNA, 64 nt, hsa; identical to SEQ ID NO: 39395

SEQ ID NO: 683330 - RNA, 64 nt, hsa; identical to SEQ ID NO: 39396

SEQ ID NO: 683331 - RNA, 64 nt, hsa; identical to SEQ ID NO: 39397

SEQ ID NO: 683332 - RNA, 64 nt, hsa; identical to SEQ ID NO: 39398

SEQ ID NO: 683333 - RNA, 64 nt, hsa; identical to SEQ ID NO: 39399

SEQ ID NO: 683334 - RNA, 64 nt, hsa; identical to SEQ ID NO: 39400

SEQ ID NO: 683335 - RNA, 64 nt, hsa; identical to SEQ ID NO: 39401

SEQ ID NO: 683336 - RNA, 64 nt, hsa; identical to SEQ ID NO: 39402

SEQ ID NO: 683337 - RNA, 64 nt, hsa; identical to SEQ ID NO: 39403

SEQ ID NO: 683338 - RNA, 64 nt, hsa; identical to SEQ ID NO: 39404

SEQ ID NO: 683339 - RNA, 64 nt, hsa; identical to SEQ ID NO: 39405

SEQ ID NO: 683340 - RNA, 64 nt, hsa; identical to SEQ ID NO: 39406

SEQ ID NO: 683341 - RNA, 64 nt, hsa; identical to SEQ ID NO: 39407

SEQ ID NO: 683342 - RNA, 64 nt, hsa; identical to SEQ ID NO: 39408

SEQ ID NO: 683343 - RNA, 64 nt, hsa; identical to SEQ ID NO: 39409

SEQ ID NO: 683344 - RNA, 64 nt, hsa; identical to SEQ ID NO: 39410

SEQ ID NO: 683345 - RNA, 64 nt, hsa; identical to SEQ ID NO: 39411

SEQ ID NO: 683346 - RNA, 64 nt, hsa; identical to SEQ ID NO: 39412

SEQ ID NO: 683347 - RNA, 64 nt, hsa; identical to SEQ ID NO: 39413

SEQ ID NO: 683348 - RNA, 64 nt, hsa; identical to SEQ ID NO: 39414

SEQ ID NO: 683349 - RNA, 64 nt, hsa; identical to SEQ ID NO: 39415

SEQ ID NO: 683350 - RNA, 64 nt, hsa; identical to SEQ ID NO: 39416

SEQ ID NO: 683351 - RNA, 64 nt, hsa; identical to SEQ ID NO: 39417

SEQ ID NO: 683352 - RNA, 64 nt, hsa; identical to SEQ ID NO: 39418

SEQ ID NO: 683353 - RNA, 64 nt, hsa; identical to SEQ ID NO: 39419

SEQ ID NO: 683354 - RNA, 64 nt, hsa; identical to SEQ ID NO: 39420

SEQ ID NO: 683355 - RNA, 64 nt, hsa; identical to SEQ ID NO: 39421

SEQ ID NO: 683356 - RNA, 64 nt, hsa; identical to SEQ ID NO: 39422

SEQ ID NO: 683357 - RNA, 64 nt, hsa; identical to SEQ ID NO: 39423

SEQ ID NO: 683358 - RNA, 64 nt, hsa; identical to SEQ ID NO: 39424

SEQ ID NO: 683359 - RNA, 64 nt, hsa; identical to SEQ ID NO: 39425

SEQ ID NO: 683360 - RNA, 64 nt, hsa; identical to SEQ ID NO: 39426

SEQ ID NO: 683361 - RNA, 64 nt, hsa; identical to SEQ ID NO: 39427

SEQ ID NO: 683362 - RNA, 64 nt, hsa; identical to SEQ ID NO: 39428

SEQ ID NO: 683363 - RNA, 64 nt, hsa; identical to SEQ ID NO: 39429

SEQ ID NO: 683364 - RNA, 64 nt, hsa; identical to SEQ ID NO: 39430

SEQ ID NO: 683365 - RNA, 64 nt, hsa; identical to SEQ ID NO: 39431

SEQ ID NO: 683366 - RNA, 64 nt, hsa; identical to SEQ ID NO: 39432

SEQ ID NO: 683367 - RNA, 64 nt, hsa; identical to SEQ ID NO: 39433

SEQ ID NO: 683368 - RNA, 64 nt, hsa; identical to SEQ ID NO: 39434

SEQ ID NO: 683369 - RNA, 64 nt, hsa; identical to SEQ ID NO: 39435

SEQ ID NO: 683370 - RNA, 64 nt, hsa; identical to SEQ ID NO: 39436

SEQ ID NO: 683371 - RNA, 64 nt, hsa; identical to SEQ ID NO: 39437

SEQ ID NO: 683372 - RNA, 64 nt, hsa; identical to SEQ ID NO: 39438

SEQ ID NO: 683373 - RNA, 64 nt, hsa; identical to SEQ ID NO: 39439

SEQ ID NO: 683374 - RNA, 64 nt, hsa; identical to SEQ ID NO: 39440

SEQ ID NO: 683375 - RNA, 64 nt, hsa; identical to SEQ ID NO: 39441

SEQ ID NO: 683376 - RNA, 64 nt, hsa; identical to SEQ ID NO: 39442

SEQ ID NO: 683377 - RNA, 64 nt, hsa; identical to SEQ ID NO: 39443

SEQ ID NO: 683378 - RNA, 64 nt, hsa; identical to SEQ ID NO: 39444

SEQ ID NO: 683379 - RNA, 64 nt, hsa; identical to SEQ ID NO: 39445

SEQ ID NO: 683380 - RNA, 64 nt, hsa; identical to SEQ ID NO: 39446

SEQ ID NO: 683381 - RNA, 64 nt, hsa; identical to SEQ ID NO: 39447

SEQ ID NO: 683382 - RNA, 64 nt, hsa; identical to SEQ ID NO: 39448

SEQ ID NO: 683383 - RNA, 64 nt, hsa; identical to SEQ ID NO: 39449

SEQ ID NO: 683384 - RNA, 64 nt, hsa; identical to SEQ ID NO: 39450

SEQ ID NO: 683385 - RNA, 64 nt, hsa; identical to SEQ ID NO: 39451

SEQ ID NO: 683386 - RNA, 64 nt, hsa; identical to SEQ ID NO: 39452

SEQ ID NO: 683387 - RNA, 64 nt, hsa; identical to SEQ ID NO: 39453

SEQ ID NO: 683388 - RNA, 64 nt, hsa; identical to SEQ ID NO: 39454

SEQ ID NO: 683389 - RNA, 64 nt, hsa; identical to SEQ ID NO: 39455

SEQ ID NO: 683390 - RNA, 64 nt, hsa; identical to SEQ ID NO: 39456

SEQ ID NO: 683391 - RNA, 64 nt, hsa; identical to SEQ ID NO: 39457

SEQ ID NO: 683392 - RNA, 64 nt, hsa; identical to SEQ ID NO: 39458

SEQ ID NO: 683393 - RNA, 64 nt, hsa; identical to SEQ ID NO: 39459

SEQ ID NO: 683394 - RNA, 64 nt, hsa; identical to SEQ ID NO: 39460

SEQ ID NO: 683395 - RNA, 64 nt, hsa; identical to SEQ ID NO: 39461

SEQ ID NO: 683396 - RNA, 64 nt, hsa; identical to SEQ ID NO: 39462

SEQ ID NO: 683397 - RNA, 64 nt, hsa; identical to SEQ ID NO: 39463

SEQ ID NO: 683398 - RNA, 64 nt, hsa; identical to SEQ ID NO: 39464

SEQ ID NO: 683399 - RNA, 64 nt, hsa; identical to SEQ ID NO: 39465

SEQ ID NO: 683400 - RNA, 64 nt, hsa; identical to SEQ ID NO: 39466

SEQ ID NO: 683401 - RNA, 64 nt, hsa; identical to SEQ ID NO: 39467

SEQ ID NO: 683402 - RNA, 64 nt, hsa; identical to SEQ ID NO: 39468

SEQ ID NO: 683403 - RNA, 64 nt, hsa; identical to SEQ ID NO: 39469

SEQ ID NO: 683404 - RNA, 64 nt, hsa; identical to SEQ ID NO: 39470

SEQ ID NO: 683405 - RNA, 64 nt, hsa; identical to SEQ ID NO: 39471

SEQ ID NO: 683406 - RNA, 64 nt, hsa; identical to SEQ ID NO: 39472

SEQ ID NO: 683407 - RNA, 64 nt, hsa; identical to SEQ ID NO: 39473

SEQ ID NO: 683408 - RNA, 64 nt, hsa; identical to SEQ ID NO: 39474

SEQ ID NO: 683409 - RNA, 64 nt, hsa; identical to SEQ ID NO: 39475

SEQ ID NO: 683410 - RNA, 64 nt, hsa; identical to SEQ ID NO: 39476

SEQ ID NO: 683411 - RNA, 64 nt, hsa; identical to SEQ ID NO: 39477

SEQ ID NO: 683412 - RNA, 64 nt, hsa; identical to SEQ ID NO: 39478

SEQ ID NO: 683413 - RNA, 64 nt, hsa; identical to SEQ ID NO: 39479

SEQ ID NO: 683414 - RNA, 64 nt, hsa; identical to SEQ ID NO: 39480

SEQ ID NO: 683415 - RNA, 64 nt, hsa; identical to SEQ ID NO: 39481

SEQ ID NO: 683416 - RNA, 64 nt, hsa; identical to SEQ ID NO: 39482

SEQ ID NO: 683417 - RNA, 64 nt, hsa; identical to SEQ ID NO: 39483

SEQ ID NO: 683418 - RNA, 64 nt, hsa; identical to SEQ ID NO: 39484

SEQ ID NO: 683419 - RNA, 64 nt, hsa; identical to SEQ ID NO: 39485

SEQ ID NO: 683420 - RNA, 64 nt, hsa; identical to SEQ ID NO: 39486

SEQ ID NO: 683421 - RNA, 64 nt, hsa; identical to SEQ ID NO: 39487

SEQ ID NO: 683422 - RNA, 64 nt, hsa; identical to SEQ ID NO: 39488

SEQ ID NO: 683423 - RNA, 64 nt, hsa; identical to SEQ ID NO: 39489

SEQ ID NO: 683424 - RNA, 64 nt, hsa; identical to SEQ ID NO: 39490

SEQ ID NO: 683425 - RNA, 64 nt, hsa; identical to SEQ ID NO: 39491

SEQ ID NO: 683426 - RNA, 64 nt, hsa; identical to SEQ ID NO: 39492

SEQ ID NO: 683427 - RNA, 64 nt, hsa; identical to SEQ ID NO: 39493

SEQ ID NO: 683428 - RNA, 64 nt, hsa; identical to SEQ ID NO: 39494

SEQ ID NO: 683429 - RNA, 64 nt, hsa; identical to SEQ ID NO: 39495

SEQ ID NO: 683430 - RNA, 64 nt, hsa; identical to SEQ ID NO: 39496

SEQ ID NO: 683431 - RNA, 64 nt, hsa; identical to SEQ ID NO: 39497

SEQ ID NO: 683432 - RNA, 64 nt, hsa; identical to SEQ ID NO: 39498

SEQ ID NO: 683433 - RNA, 64 nt, hsa; identical to SEQ ID NO: 39499

SEQ ID NO: 683434 - RNA, 64 nt, hsa; identical to SEQ ID NO: 39500

SEQ ID NO: 683435 - RNA, 64 nt, hsa; identical to SEQ ID NO: 39501

SEQ ID NO: 683436 - RNA, 64 nt, hsa; identical to SEQ ID NO: 39502

SEQ ID NO: 683437 - RNA, 64 nt, hsa; identical to SEQ ID NO: 39503

SEQ ID NO: 683438 - RNA, 64 nt, hsa; identical to SEQ ID NO: 39504

SEQ ID NO: 683439 - RNA, 64 nt, hsa; identical to SEQ ID NO: 39505

SEQ ID NO: 683440 - RNA, 64 nt, hsa; identical to SEQ ID NO: 39506

SEQ ID NO: 683441 - RNA, 64 nt, hsa; identical to SEQ ID NO: 39507

SEQ ID NO: 683442 - RNA, 64 nt, hsa; identical to SEQ ID NO: 39508

SEQ ID NO: 683443 - RNA, 64 nt, hsa; identical to SEQ ID NO: 39509

SEQ ID NO: 683444 - RNA, 64 nt, hsa; identical to SEQ ID NO: 39510

SEQ ID NO: 683445 - RNA, 64 nt, hsa; identical to SEQ ID NO: 39511

SEQ ID NO: 683446 - RNA, 64 nt, hsa; identical to SEQ ID NO: 39512

SEQ ID NO: 683447 - RNA, 64 nt, hsa; identical to SEQ ID NO: 39513

SEQ ID NO: 683448 - RNA, 64 nt, hsa; identical to SEQ ID NO: 39514

SEQ ID NO: 683449 - RNA, 64 nt, hsa; identical to SEQ ID NO: 39515

SEQ ID NO: 683450 - RNA, 64 nt, hsa; identical to SEQ ID NO: 39516

SEQ ID NO: 683451 - RNA, 64 nt, hsa; identical to SEQ ID NO: 39517

SEQ ID NO: 683452 - RNA, 64 nt, hsa; identical to SEQ ID NO: 39518

SEQ ID NO: 683453 - RNA, 64 nt, hsa; identical to SEQ ID NO: 39519

SEQ ID NO: 683454 - RNA, 64 nt, hsa; identical to SEQ ID NO: 39520

SEQ ID NO: 683455 - RNA, 64 nt, hsa; identical to SEQ ID NO: 39521

SEQ ID NO: 683456 - RNA, 64 nt, hsa; identical to SEQ ID NO: 39522

SEQ ID NO: 683457 - RNA, 64 nt, hsa; identical to SEQ ID NO: 39523

SEQ ID NO: 683458 - RNA, 64 nt, hsa; identical to SEQ ID NO: 39524

SEQ ID NO: 683459 - RNA, 64 nt, hsa; identical to SEQ ID NO: 39525

SEQ ID NO: 683460 - RNA, 64 nt, hsa; identical to SEQ ID NO: 39526

SEQ ID NO: 683461 - RNA, 64 nt, hsa; identical to SEQ ID NO: 39527

SEQ ID NO: 683462 - RNA, 64 nt, hsa; identical to SEQ ID NO: 39528

SEQ ID NO: 683463 - RNA, 64 nt, hsa; identical to SEQ ID NO: 39529

SEQ ID NO: 683464 - RNA, 64 nt, hsa; identical to SEQ ID NO: 39530

SEQ ID NO: 683465 - RNA, 64 nt, hsa; identical to SEQ ID NO: 39531

SEQ ID NO: 683466 - RNA, 64 nt, hsa; identical to SEQ ID NO: 39532

SEQ ID NO: 683467 - RNA, 64 nt, hsa; identical to SEQ ID NO: 39533

SEQ ID NO: 683468 - RNA, 64 nt, hsa; identical to SEQ ID NO: 39534

SEQ ID NO: 683469 - RNA, 64 nt, hsa; identical to SEQ ID NO: 39535

SEQ ID NO: 683470 - RNA, 64 nt, hsa; identical to SEQ ID NO: 39536

SEQ ID NO: 683471 - RNA, 64 nt, hsa; identical to SEQ ID NO: 39537

SEQ ID NO: 683472 - RNA, 64 nt, hsa; identical to SEQ ID NO: 39538

SEQ ID NO: 683473 - RNA, 64 nt, hsa; identical to SEQ ID NO: 39539

SEQ ID NO: 683474 - RNA, 64 nt, hsa; identical to SEQ ID NO: 39540

SEQ ID NO: 683475 - RNA, 64 nt, hsa; identical to SEQ ID NO: 39541

SEQ ID NO: 683476 - RNA, 64 nt, hsa; identical to SEQ ID NO: 39542

SEQ ID NO: 683477 - RNA, 64 nt, hsa; identical to SEQ ID NO: 39543

SEQ ID NO: 683478 - RNA, 64 nt, hsa; identical to SEQ ID NO: 39544

SEQ ID NO: 683479 - RNA, 64 nt, hsa; identical to SEQ ID NO: 39545

SEQ ID NO: 683480 - RNA, 64 nt, hsa; identical to SEQ ID NO: 39546

SEQ ID NO: 683481 - RNA, 64 nt, hsa; identical to SEQ ID NO: 39547

SEQ ID NO: 683482 - RNA, 64 nt, hsa; identical to SEQ ID NO: 39548

SEQ ID NO: 683483 - RNA, 64 nt, hsa; identical to SEQ ID NO: 39549

SEQ ID NO: 683484 - RNA, 64 nt, hsa; identical to SEQ ID NO: 39550

SEQ ID NO: 683485 - RNA, 64 nt, hsa; identical to SEQ ID NO: 39551

SEQ ID NO: 683486 - RNA, 64 nt, hsa; identical to SEQ ID NO: 39552

SEQ ID NO: 683487 - RNA, 64 nt, hsa; identical to SEQ ID NO: 39553

SEQ ID NO: 683488 - RNA, 64 nt, hsa; identical to SEQ ID NO: 39554

SEQ ID NO: 683489 - RNA, 64 nt, hsa; identical to SEQ ID NO: 39555

SEQ ID NO: 683490 - RNA, 64 nt, hsa; identical to SEQ ID NO: 39556

SEQ ID NO: 683491 - RNA, 64 nt, hsa; identical to SEQ ID NO: 39557

SEQ ID NO: 683492 - RNA, 64 nt, hsa; identical to SEQ ID NO: 39558

SEQ ID NO: 683493 - RNA, 64 nt, hsa; identical to SEQ ID NO: 39559

SEQ ID NO: 683494 - RNA, 64 nt, hsa; identical to SEQ ID NO: 39560

SEQ ID NO: 683495 - RNA, 64 nt, hsa; identical to SEQ ID NO: 39561

SEQ ID NO: 683496 - RNA, 64 nt, hsa; identical to SEQ ID NO: 39562

SEQ ID NO: 683497 - RNA, 64 nt, hsa; identical to SEQ ID NO: 39563

SEQ ID NO: 683498 - RNA, 64 nt, hsa; identical to SEQ ID NO: 39564

SEQ ID NO: 683499 - RNA, 64 nt, hsa; identical to SEQ ID NO: 39565

SEQ ID NO: 683500 - RNA, 64 nt, hsa; identical to SEQ ID NO: 39566

SEQ ID NO: 683501 - RNA, 64 nt, hsa; identical to SEQ ID NO: 39567

SEQ ID NO: 683502 - RNA, 64 nt, hsa; identical to SEQ ID NO: 39568

SEQ ID NO: 683503 - RNA, 64 nt, hsa; identical to SEQ ID NO: 39569

SEQ ID NO: 683504 - RNA, 64 nt, hsa; identical to SEQ ID NO: 39570

SEQ ID NO: 683505 - RNA, 64 nt, hsa; identical to SEQ ID NO: 39571

SEQ ID NO: 683506 - RNA, 64 nt, hsa; identical to SEQ ID NO: 39572

SEQ ID NO: 683507 - RNA, 64 nt, hsa; identical to SEQ ID NO: 39573

SEQ ID NO: 683508 - RNA, 64 nt, hsa; identical to SEQ ID NO: 39574

SEQ ID NO: 683509 - RNA, 64 nt, hsa; identical to SEQ ID NO: 39575

SEQ ID NO: 683510 - RNA, 64 nt, hsa; identical to SEQ ID NO: 39576

SEQ ID NO: 683511 - RNA, 64 nt, hsa; identical to SEQ ID NO: 39577

SEQ ID NO: 683512 - RNA, 64 nt, hsa; identical to SEQ ID NO: 39578

SEQ ID NO: 683513 - RNA, 64 nt, hsa; identical to SEQ ID NO: 39579

SEQ ID NO: 683514 - RNA, 64 nt, hsa; identical to SEQ ID NO: 39580

SEQ ID NO: 683515 - RNA, 64 nt, hsa; identical to SEQ ID NO: 39581

SEQ ID NO: 683516 - RNA, 64 nt, hsa; identical to SEQ ID NO: 39582

SEQ ID NO: 683517 - RNA, 64 nt, hsa; identical to SEQ ID NO: 39583

SEQ ID NO: 683518 - RNA, 64 nt, hsa; identical to SEQ ID NO: 39584

SEQ ID NO: 683519 - RNA, 64 nt, hsa; identical to SEQ ID NO: 39585

SEQ ID NO: 683520 - RNA, 64 nt, hsa; identical to SEQ ID NO: 39586

SEQ ID NO: 683521 - RNA, 64 nt, hsa; identical to SEQ ID NO: 39587

SEQ ID NO: 683522 - RNA, 64 nt, hsa; identical to SEQ ID NO: 39588

SEQ ID NO: 683523 - RNA, 64 nt, hsa; identical to SEQ ID NO: 39589

SEQ ID NO: 683524 - RNA, 64 nt, hsa; identical to SEQ ID NO: 39590

SEQ ID NO: 683525 - RNA, 64 nt, hsa; identical to SEQ ID NO: 39591

SEQ ID NO: 683526 - RNA, 64 nt, hsa; identical to SEQ ID NO: 39592

SEQ ID NO: 683527 - RNA, 64 nt, hsa; identical to SEQ ID NO: 39593

SEQ ID NO: 683528 - RNA, 64 nt, hsa; identical to SEQ ID NO: 39594

SEQ ID NO: 683529 - RNA, 64 nt, hsa; identical to SEQ ID NO: 39595

SEQ ID NO: 683530 - RNA, 64 nt, hsa; identical to SEQ ID NO: 39596

SEQ ID NO: 683531 - RNA, 64 nt, hsa; identical to SEQ ID NO: 39597

SEQ ID NO: 683532 - RNA, 64 nt, hsa; identical to SEQ ID NO: 39598

SEQ ID NO: 683533 - RNA, 64 nt, hsa; identical to SEQ ID NO: 39599

SEQ ID NO: 683534 - RNA, 64 nt, hsa; identical to SEQ ID NO: 39600

SEQ ID NO: 683535 - RNA, 64 nt, hsa; identical to SEQ ID NO: 39601

SEQ ID NO: 683536 - RNA, 64 nt, hsa; identical to SEQ ID NO: 39602

SEQ ID NO: 683537 - RNA, 64 nt, hsa; identical to SEQ ID NO: 39603

SEQ ID NO: 683538 - RNA, 64 nt, hsa; identical to SEQ ID NO: 39604

SEQ ID NO: 683539 - RNA, 64 nt, hsa; identical to SEQ ID NO: 39605

SEQ ID NO: 683540 - RNA, 64 nt, hsa; identical to SEQ ID NO: 39606

SEQ ID NO: 683541 - RNA, 64 nt, hsa; identical to SEQ ID NO: 39607

SEQ ID NO: 683542 - RNA, 64 nt, hsa; identical to SEQ ID NO: 39608

SEQ ID NO: 683543 - RNA, 64 nt, hsa; identical to SEQ ID NO: 39609

SEQ ID NO: 683544 - RNA, 64 nt, hsa; identical to SEQ ID NO: 39610

SEQ ID NO: 683545 - RNA, 64 nt, hsa; identical to SEQ ID NO: 39611

SEQ ID NO: 683546 - RNA, 64 nt, hsa; identical to SEQ ID NO: 39612

SEQ ID NO: 683547 - RNA, 64 nt, hsa; identical to SEQ ID NO: 39613

SEQ ID NO: 683548 - RNA, 64 nt, hsa; identical to SEQ ID NO: 39614

SEQ ID NO: 683549 - RNA, 64 nt, hsa; identical to SEQ ID NO: 39615

SEQ ID NO: 683550 - RNA, 64 nt, hsa; identical to SEQ ID NO: 39616

SEQ ID NO: 683551 - RNA, 64 nt, hsa; identical to SEQ ID NO: 39617

SEQ ID NO: 683552 - RNA, 64 nt, hsa; identical to SEQ ID NO: 39618

SEQ ID NO: 683553 - RNA, 64 nt, hsa; identical to SEQ ID NO: 39619

SEQ ID NO: 683554 - RNA, 64 nt, hsa; identical to SEQ ID NO: 39620

SEQ ID NO: 683555 - RNA, 64 nt, hsa; identical to SEQ ID NO: 39621

SEQ ID NO: 683556 - RNA, 64 nt, hsa; identical to SEQ ID NO: 39622

SEQ ID NO: 683557 - RNA, 64 nt, hsa; identical to SEQ ID NO: 39623

SEQ ID NO: 683558 - RNA, 64 nt, hsa; identical to SEQ ID NO: 39624

SEQ ID NO: 683559 - RNA, 64 nt, hsa; identical to SEQ ID NO: 39625

SEQ ID NO: 683560 - RNA, 64 nt, hsa; identical to SEQ ID NO: 39626

SEQ ID NO: 683561 - RNA, 64 nt, hsa; identical to SEQ ID NO: 39627

SEQ ID NO: 683562 - RNA, 64 nt, hsa; identical to SEQ ID NO: 39628

SEQ ID NO: 683563 - RNA, 64 nt, hsa; identical to SEQ ID NO: 39629

SEQ ID NO: 683564 - RNA, 64 nt, hsa; identical to SEQ ID NO: 39630

SEQ ID NO: 683565 - RNA, 64 nt, hsa; identical to SEQ ID NO: 39631

SEQ ID NO: 683566 - RNA, 64 nt, hsa; identical to SEQ ID NO: 39632

SEQ ID NO: 683567 - RNA, 64 nt, hsa; identical to SEQ ID NO: 39633

SEQ ID NO: 683568 - RNA, 64 nt, hsa; identical to SEQ ID NO: 39634

SEQ ID NO: 683569 - RNA, 64 nt, hsa; identical to SEQ ID NO: 39635

SEQ ID NO: 683570 - RNA, 64 nt, hsa; identical to SEQ ID NO: 39636

SEQ ID NO: 683571 - RNA, 64 nt, hsa; identical to SEQ ID NO: 39637

SEQ ID NO: 683572 - RNA, 64 nt, hsa; identical to SEQ ID NO: 39638

SEQ ID NO: 683573 - RNA, 64 nt, hsa; identical to SEQ ID NO: 39639

SEQ ID NO: 683574 - RNA, 64 nt, hsa; identical to SEQ ID NO: 39640

SEQ ID NO: 683575 - RNA, 64 nt, hsa; identical to SEQ ID NO: 39641

SEQ ID NO: 683576 - RNA, 64 nt, hsa; identical to SEQ ID NO: 39642

SEQ ID NO: 683577 - RNA, 64 nt, hsa; identical to SEQ ID NO: 39643

SEQ ID NO: 683578 - RNA, 64 nt, hsa; identical to SEQ ID NO: 39644

SEQ ID NO: 683579 - RNA, 64 nt, hsa; identical to SEQ ID NO: 39645

SEQ ID NO: 683580 - RNA, 64 nt, hsa; identical to SEQ ID NO: 39646

SEQ ID NO: 683581 - RNA, 64 nt, hsa; identical to SEQ ID NO: 39647

SEQ ID NO: 683582 - RNA, 64 nt, hsa; identical to SEQ ID NO: 39648

SEQ ID NO: 683583 - RNA, 64 nt, hsa; identical to SEQ ID NO: 39649

SEQ ID NO: 683584 - RNA, 64 nt, hsa; identical to SEQ ID NO: 39650

SEQ ID NO: 683585 - RNA, 64 nt, hsa; identical to SEQ ID NO: 39651

SEQ ID NO: 683586 - RNA, 64 nt, hsa; identical to SEQ ID NO: 39652

SEQ ID NO: 683587 - RNA, 64 nt, hsa; identical to SEQ ID NO: 39653

SEQ ID NO: 683588 - RNA, 64 nt, hsa; identical to SEQ ID NO: 39654

SEQ ID NO: 683589 - RNA, 64 nt, hsa; identical to SEQ ID NO: 39655

SEQ ID NO: 683590 - RNA, 64 nt, hsa; identical to SEQ ID NO: 39656

SEQ ID NO: 683591 - RNA, 64 nt, hsa; identical to SEQ ID NO: 39657

SEQ ID NO: 683592 - RNA, 64 nt, hsa; identical to SEQ ID NO: 39658

SEQ ID NO: 683593 - RNA, 64 nt, hsa; identical to SEQ ID NO: 39659

SEQ ID NO: 683594 - RNA, 64 nt, hsa; identical to SEQ ID NO: 39660

SEQ ID NO: 683595 - RNA, 64 nt, hsa; identical to SEQ ID NO: 39661

SEQ ID NO: 683596 - RNA, 64 nt, hsa; identical to SEQ ID NO: 39662

SEQ ID NO: 683597 - RNA, 64 nt, hsa; identical to SEQ ID NO: 39663

SEQ ID NO: 683598 - RNA, 64 nt, hsa; identical to SEQ ID NO: 39664

SEQ ID NO: 683599 - RNA, 64 nt, hsa; identical to SEQ ID NO: 39665

SEQ ID NO: 683600 - RNA, 64 nt, hsa; identical to SEQ ID NO: 39666

SEQ ID NO: 683601 - RNA, 64 nt, hsa; identical to SEQ ID NO: 39667

SEQ ID NO: 683602 - RNA, 64 nt, hsa; identical to SEQ ID NO: 39668

SEQ ID NO: 683603 - RNA, 64 nt, hsa; identical to SEQ ID NO: 39669

SEQ ID NO: 683604 - RNA, 64 nt, hsa; identical to SEQ ID NO: 39670

SEQ ID NO: 683605 - RNA, 64 nt, hsa; identical to SEQ ID NO: 39671

SEQ ID NO: 683606 - RNA, 64 nt, hsa; identical to SEQ ID NO: 39672

SEQ ID NO: 683607 - RNA, 64 nt, hsa; identical to SEQ ID NO: 39673

SEQ ID NO: 683608 - RNA, 64 nt, hsa; identical to SEQ ID NO: 39674

SEQ ID NO: 683609 - RNA, 64 nt, hsa; identical to SEQ ID NO: 39675

SEQ ID NO: 683610 - RNA, 64 nt, hsa; identical to SEQ ID NO: 39676

SEQ ID NO: 683611 - RNA, 64 nt, hsa; identical to SEQ ID NO: 39677

SEQ ID NO: 683612 - RNA, 64 nt, hsa; identical to SEQ ID NO: 39678

SEQ ID NO: 683613 - RNA, 64 nt, hsa; identical to SEQ ID NO: 39679

SEQ ID NO: 683614 - RNA, 64 nt, hsa; identical to SEQ ID NO: 39680

SEQ ID NO: 683615 - RNA, 64 nt, hsa; identical to SEQ ID NO: 39681

SEQ ID NO: 683616 - RNA, 64 nt, hsa; identical to SEQ ID NO: 39682

SEQ ID NO: 683617 - RNA, 64 nt, hsa; identical to SEQ ID NO: 39683

SEQ ID NO: 683618 - RNA, 64 nt, hsa; identical to SEQ ID NO: 39684

SEQ ID NO: 683619 - RNA, 64 nt, hsa; identical to SEQ ID NO: 39685

SEQ ID NO: 683620 - RNA, 64 nt, hsa; identical to SEQ ID NO: 39686

SEQ ID NO: 683621 - RNA, 64 nt, hsa; identical to SEQ ID NO: 39687

SEQ ID NO: 683622 - RNA, 64 nt, hsa; identical to SEQ ID NO: 39688

SEQ ID NO: 683623 - RNA, 64 nt, hsa; identical to SEQ ID NO: 39689

SEQ ID NO: 683624 - RNA, 64 nt, hsa; identical to SEQ ID NO: 39690

SEQ ID NO: 683625 - RNA, 64 nt, hsa; identical to SEQ ID NO: 39691

SEQ ID NO: 683626 - RNA, 64 nt, hsa; identical to SEQ ID NO: 39692

SEQ ID NO: 683627 - RNA, 64 nt, hsa; identical to SEQ ID NO: 39693

SEQ ID NO: 683628 - RNA, 64 nt, hsa; identical to SEQ ID NO: 39694

SEQ ID NO: 683629 - RNA, 64 nt, hsa; identical to SEQ ID NO: 39695

SEQ ID NO: 683630 - RNA, 64 nt, hsa; identical to SEQ ID NO: 39696

SEQ ID NO: 683631 - RNA, 64 nt, hsa; identical to SEQ ID NO: 39697

SEQ ID NO: 683632 - RNA, 64 nt, hsa; identical to SEQ ID NO: 39698

SEQ ID NO: 683633 - RNA, 64 nt, hsa; identical to SEQ ID NO: 39699

SEQ ID NO: 683634 - RNA, 64 nt, hsa; identical to SEQ ID NO: 39700

SEQ ID NO: 683635 - RNA, 64 nt, hsa; identical to SEQ ID NO: 39701

SEQ ID NO: 683636 - RNA, 64 nt, hsa; identical to SEQ ID NO: 39702

SEQ ID NO: 683637 - RNA, 64 nt, hsa; identical to SEQ ID NO: 39703

SEQ ID NO: 683638 - RNA, 64 nt, hsa; identical to SEQ ID NO: 39704

SEQ ID NO: 683639 - RNA, 64 nt, hsa; identical to SEQ ID NO: 39705

SEQ ID NO: 683640 - RNA, 64 nt, hsa; identical to SEQ ID NO: 39706

SEQ ID NO: 683641 - RNA, 64 nt, hsa; identical to SEQ ID NO: 39707

SEQ ID NO: 683642 - RNA, 64 nt, hsa; identical to SEQ ID NO: 39708

SEQ ID NO: 683643 - RNA, 64 nt, hsa; identical to SEQ ID NO: 39709

SEQ ID NO: 683644 - RNA, 64 nt, hsa; identical to SEQ ID NO: 39710

SEQ ID NO: 683645 - RNA, 64 nt, hsa; identical to SEQ ID NO: 39711

SEQ ID NO: 683646 - RNA, 64 nt, hsa; identical to SEQ ID NO: 39712

SEQ ID NO: 683647 - RNA, 64 nt, hsa; identical to SEQ ID NO: 39713

SEQ ID NO: 683648 - RNA, 64 nt, hsa; identical to SEQ ID NO: 39714

SEQ ID NO: 683649 - RNA, 64 nt, hsa; identical to SEQ ID NO: 39715

SEQ ID NO: 683650 - RNA, 64 nt, hsa; identical to SEQ ID NO: 39716

SEQ ID NO: 683651 - RNA, 64 nt, hsa; identical to SEQ ID NO: 39717

SEQ ID NO: 683652 - RNA, 64 nt, hsa; identical to SEQ ID NO: 39718

SEQ ID NO: 683653 - RNA, 64 nt, hsa; identical to SEQ ID NO: 39719

SEQ ID NO: 683654 - RNA, 64 nt, hsa; identical to SEQ ID NO: 39720

SEQ ID NO: 683655 - RNA, 64 nt, hsa; identical to SEQ ID NO: 39721

SEQ ID NO: 683656 - RNA, 64 nt, hsa; identical to SEQ ID NO: 39722

SEQ ID NO: 683657 - RNA, 64 nt, hsa; identical to SEQ ID NO: 39723

SEQ ID NO: 683658 - RNA, 64 nt, hsa; identical to SEQ ID NO: 39724

SEQ ID NO: 683659 - RNA, 64 nt, hsa; identical to SEQ ID NO: 39725

SEQ ID NO: 683660 - RNA, 64 nt, hsa; identical to SEQ ID NO: 39726

SEQ ID NO: 683661 - RNA, 64 nt, hsa; identical to SEQ ID NO: 39727

SEQ ID NO: 683662 - RNA, 64 nt, hsa; identical to SEQ ID NO: 39728

SEQ ID NO: 683663 - RNA, 64 nt, hsa; identical to SEQ ID NO: 39729

SEQ ID NO: 683664 - RNA, 64 nt, hsa; identical to SEQ ID NO: 39730

SEQ ID NO: 683665 - RNA, 64 nt, hsa; identical to SEQ ID NO: 39731

SEQ ID NO: 683666 - RNA, 64 nt, hsa; identical to SEQ ID NO: 39732

SEQ ID NO: 683667 - RNA, 64 nt, hsa; identical to SEQ ID NO: 39733

SEQ ID NO: 683668 - RNA, 64 nt, hsa; identical to SEQ ID NO: 39734

SEQ ID NO: 683669 - RNA, 64 nt, hsa; identical to SEQ ID NO: 39735

SEQ ID NO: 683670 - RNA, 64 nt, hsa; identical to SEQ ID NO: 39736

SEQ ID NO: 683671 - RNA, 64 nt, hsa; identical to SEQ ID NO: 39737

SEQ ID NO: 683672 - RNA, 64 nt, hsa; identical to SEQ ID NO: 39738

SEQ ID NO: 683673 - RNA, 64 nt, hsa; identical to SEQ ID NO: 39739

SEQ ID NO: 683674 - RNA, 64 nt, hsa; identical to SEQ ID NO: 39740

SEQ ID NO: 683675 - RNA, 64 nt, hsa; identical to SEQ ID NO: 39741

SEQ ID NO: 683676 - RNA, 64 nt, hsa; identical to SEQ ID NO: 39742

SEQ ID NO: 683677 - RNA, 64 nt, hsa; identical to SEQ ID NO: 39743

SEQ ID NO: 683678 - RNA, 64 nt, hsa; identical to SEQ ID NO: 39744

SEQ ID NO: 683679 - RNA, 64 nt, hsa; identical to SEQ ID NO: 39745

SEQ ID NO: 683680 - RNA, 64 nt, hsa; identical to SEQ ID NO: 39746

SEQ ID NO: 683681 - RNA, 64 nt, hsa; identical to SEQ ID NO: 39747

SEQ ID NO: 683682 - RNA, 64 nt, hsa; identical to SEQ ID NO: 39748

SEQ ID NO: 683683 - RNA, 64 nt, hsa; identical to SEQ ID NO: 39749

SEQ ID NO: 683684 - RNA, 64 nt, hsa; identical to SEQ ID NO: 39750

SEQ ID NO: 683685 - RNA, 64 nt, hsa; identical to SEQ ID NO: 39751

SEQ ID NO: 683686 - RNA, 64 nt, hsa; identical to SEQ ID NO: 39752

SEQ ID NO: 683687 - RNA, 64 nt, hsa; identical to SEQ ID NO: 39753

SEQ ID NO: 683688 - RNA, 64 nt, hsa; identical to SEQ ID NO: 39754

SEQ ID NO: 683689 - RNA, 64 nt, hsa; identical to SEQ ID NO: 39755

SEQ ID NO: 683690 - RNA, 64 nt, hsa; identical to SEQ ID NO: 39756

SEQ ID NO: 683691 - RNA, 64 nt, hsa; identical to SEQ ID NO: 39757

SEQ ID NO: 683692 - RNA, 64 nt, hsa; identical to SEQ ID NO: 39758

SEQ ID NO: 683693 - RNA, 64 nt, hsa; identical to SEQ ID NO: 39759

SEQ ID NO: 683694 - RNA, 64 nt, hsa; identical to SEQ ID NO: 39760

SEQ ID NO: 683695 - RNA, 64 nt, hsa; identical to SEQ ID NO: 39761

SEQ ID NO: 683696 - RNA, 64 nt, hsa; identical to SEQ ID NO: 39762

SEQ ID NO: 683697 - RNA, 64 nt, hsa; identical to SEQ ID NO: 39763

SEQ ID NO: 683698 - RNA, 64 nt, hsa; identical to SEQ ID NO: 39764

SEQ ID NO: 683699 - RNA, 64 nt, hsa; identical to SEQ ID NO: 39765

SEQ ID NO: 683700 - RNA, 64 nt, hsa; identical to SEQ ID NO: 39766

SEQ ID NO: 683701 - RNA, 64 nt, hsa; identical to SEQ ID NO: 39767

SEQ ID NO: 683702 - RNA, 64 nt, hsa; identical to SEQ ID NO: 39768

SEQ ID NO: 683703 - RNA, 64 nt, hsa; identical to SEQ ID NO: 39769

SEQ ID NO: 683704 - RNA, 64 nt, hsa; identical to SEQ ID NO: 39770

SEQ ID NO: 683705 - RNA, 64 nt, hsa; identical to SEQ ID NO: 39771

SEQ ID NO: 683706 - RNA, 64 nt, hsa; identical to SEQ ID NO: 39772

SEQ ID NO: 683707 - RNA, 64 nt, hsa; identical to SEQ ID NO: 39773

SEQ ID NO: 683708 - RNA, 64 nt, hsa; identical to SEQ ID NO: 39774

SEQ ID NO: 683709 - RNA, 64 nt, hsa; identical to SEQ ID NO: 39775

SEQ ID NO: 683710 - RNA, 64 nt, hsa; identical to SEQ ID NO: 39776

SEQ ID NO: 683711 - RNA, 64 nt, hsa; identical to SEQ ID NO: 39777

SEQ ID NO: 683712 - RNA, 64 nt, hsa; identical to SEQ ID NO: 39778

SEQ ID NO: 683713 - RNA, 64 nt, hsa; identical to SEQ ID NO: 39779

SEQ ID NO: 683714 - RNA, 64 nt, hsa; identical to SEQ ID NO: 39780

SEQ ID NO: 683715 - RNA, 64 nt, hsa; identical to SEQ ID NO: 39781

SEQ ID NO: 683716 - RNA, 64 nt, hsa; identical to SEQ ID NO: 39782

SEQ ID NO: 683717 - RNA, 64 nt, hsa; identical to SEQ ID NO: 39783

SEQ ID NO: 683718 - RNA, 64 nt, hsa; identical to SEQ ID NO: 39784

SEQ ID NO: 683719 - RNA, 64 nt, hsa; identical to SEQ ID NO: 39785

SEQ ID NO: 683720 - RNA, 64 nt, hsa; identical to SEQ ID NO: 39786

SEQ ID NO: 683721 - RNA, 64 nt, hsa; identical to SEQ ID NO: 39787

SEQ ID NO: 683722 - RNA, 64 nt, hsa; identical to SEQ ID NO: 39788

SEQ ID NO: 683723 - RNA, 64 nt, hsa; identical to SEQ ID NO: 39789

SEQ ID NO: 683724 - RNA, 64 nt, hsa; identical to SEQ ID NO: 39790

SEQ ID NO: 683725 - RNA, 64 nt, hsa; identical to SEQ ID NO: 39791

SEQ ID NO: 683726 - RNA, 64 nt, hsa; identical to SEQ ID NO: 39792

SEQ ID NO: 683727 - RNA, 64 nt, hsa; identical to SEQ ID NO: 39793

SEQ ID NO: 683728 - RNA, 64 nt, hsa; identical to SEQ ID NO: 39794

SEQ ID NO: 683729 - RNA, 64 nt, hsa; identical to SEQ ID NO: 39795

SEQ ID NO: 683730 - RNA, 64 nt, hsa; identical to SEQ ID NO: 39796

SEQ ID NO: 683731 - RNA, 64 nt, hsa; identical to SEQ ID NO: 39797

SEQ ID NO: 683732 - RNA, 64 nt, hsa; identical to SEQ ID NO: 39798

SEQ ID NO: 683733 - RNA, 64 nt, hsa; identical to SEQ ID NO: 39799

SEQ ID NO: 683734 - RNA, 64 nt, hsa; identical to SEQ ID NO: 39800

SEQ ID NO: 683735 - RNA, 64 nt, hsa; identical to SEQ ID NO: 39801

SEQ ID NO: 683736 - RNA, 64 nt, hsa; identical to SEQ ID NO: 39802

SEQ ID NO: 683737 - RNA, 64 nt, hsa; identical to SEQ ID NO: 39803

SEQ ID NO: 683738 - RNA, 64 nt, hsa; identical to SEQ ID NO: 39804

SEQ ID NO: 683739 - RNA, 64 nt, hsa; identical to SEQ ID NO: 39805

SEQ ID NO: 683740 - RNA, 64 nt, hsa; identical to SEQ ID NO: 39806

SEQ ID NO: 683741 - RNA, 64 nt, hsa; identical to SEQ ID NO: 39807

SEQ ID NO: 683742 - RNA, 64 nt, hsa; identical to SEQ ID NO: 39808

SEQ ID NO: 683743 - RNA, 64 nt, hsa; identical to SEQ ID NO: 39809

SEQ ID NO: 683744 - RNA, 64 nt, hsa; identical to SEQ ID NO: 39810

SEQ ID NO: 683745 - RNA, 64 nt, hsa; identical to SEQ ID NO: 39811

SEQ ID NO: 683746 - RNA, 64 nt, hsa; identical to SEQ ID NO: 39812

SEQ ID NO: 683747 - RNA, 64 nt, hsa; identical to SEQ ID NO: 39813

SEQ ID NO: 683748 - RNA, 64 nt, hsa; identical to SEQ ID NO: 39814

SEQ ID NO: 683749 - RNA, 64 nt, hsa; identical to SEQ ID NO: 39815

SEQ ID NO: 683750 - RNA, 64 nt, hsa; identical to SEQ ID NO: 39816

SEQ ID NO: 683751 - RNA, 64 nt, hsa; identical to SEQ ID NO: 39817

SEQ ID NO: 683752 - RNA, 64 nt, hsa; identical to SEQ ID NO: 39818

SEQ ID NO: 683753 - RNA, 64 nt, hsa; identical to SEQ ID NO: 39819

SEQ ID NO: 683754 - RNA, 64 nt, hsa; identical to SEQ ID NO: 39820

SEQ ID NO: 683755 - RNA, 64 nt, hsa; identical to SEQ ID NO: 39821

SEQ ID NO: 683756 - RNA, 64 nt, hsa; identical to SEQ ID NO: 39822

SEQ ID NO: 683757 - RNA, 64 nt, hsa; identical to SEQ ID NO: 39823

SEQ ID NO: 683758 - RNA, 64 nt, hsa; identical to SEQ ID NO: 39824

SEQ ID NO: 683759 - RNA, 64 nt, hsa; identical to SEQ ID NO: 39825

SEQ ID NO: 683760 - RNA, 64 nt, hsa; identical to SEQ ID NO: 39826

SEQ ID NO: 683761 - RNA, 64 nt, hsa; identical to SEQ ID NO: 39827

SEQ ID NO: 683762 - RNA, 64 nt, hsa; identical to SEQ ID NO: 39828

SEQ ID NO: 683763 - RNA, 64 nt, hsa; identical to SEQ ID NO: 39829

SEQ ID NO: 683764 - RNA, 64 nt, hsa; identical to SEQ ID NO: 39830

SEQ ID NO: 683765 - RNA, 64 nt, hsa; identical to SEQ ID NO: 39831

SEQ ID NO: 683766 - RNA, 64 nt, hsa; identical to SEQ ID NO: 39832

SEQ ID NO: 683767 - RNA, 64 nt, hsa; identical to SEQ ID NO: 39833

SEQ ID NO: 683768 - RNA, 64 nt, hsa; identical to SEQ ID NO: 39834

SEQ ID NO: 683769 - RNA, 64 nt, hsa; identical to SEQ ID NO: 39835

SEQ ID NO: 683770 - RNA, 64 nt, hsa; identical to SEQ ID NO: 39836

SEQ ID NO: 683771 - RNA, 64 nt, hsa; identical to SEQ ID NO: 39837

SEQ ID NO: 683772 - RNA, 64 nt, hsa; identical to SEQ ID NO: 39838

SEQ ID NO: 683773 - RNA, 64 nt, hsa; identical to SEQ ID NO: 39839

SEQ ID NO: 683774 - RNA, 64 nt, hsa; identical to SEQ ID NO: 39840

SEQ ID NO: 683775 - RNA, 64 nt, hsa; identical to SEQ ID NO: 39841

SEQ ID NO: 683776 - RNA, 64 nt, hsa; identical to SEQ ID NO: 39842

SEQ ID NO: 683777 - RNA, 64 nt, hsa; identical to SEQ ID NO: 39843

SEQ ID NO: 683778 - RNA, 64 nt, hsa; identical to SEQ ID NO: 39844

SEQ ID NO: 683779 - RNA, 64 nt, hsa; identical to SEQ ID NO: 39845

SEQ ID NO: 683780 - RNA, 64 nt, hsa; identical to SEQ ID NO: 39846

SEQ ID NO: 683781 - RNA, 64 nt, hsa; identical to SEQ ID NO: 39847

SEQ ID NO: 683782 - RNA, 64 nt, hsa; identical to SEQ ID NO: 39848

SEQ ID NO: 683783 - RNA, 64 nt, hsa; identical to SEQ ID NO: 39849

SEQ ID NO: 683784 - RNA, 64 nt, hsa; identical to SEQ ID NO: 39850

SEQ ID NO: 683785 - RNA, 64 nt, hsa; identical to SEQ ID NO: 39851

SEQ ID NO: 683786 - RNA, 64 nt, hsa; identical to SEQ ID NO: 39852

SEQ ID NO: 683787 - RNA, 64 nt, hsa; identical to SEQ ID NO: 39853

SEQ ID NO: 683788 - RNA, 64 nt, hsa; identical to SEQ ID NO: 39854

SEQ ID NO: 683789 - RNA, 64 nt, hsa; identical to SEQ ID NO: 39855

SEQ ID NO: 683790 - RNA, 64 nt, hsa; identical to SEQ ID NO: 39856

SEQ ID NO: 683791 - RNA, 64 nt, hsa; identical to SEQ ID NO: 39857

SEQ ID NO: 683792 - RNA, 64 nt, hsa; identical to SEQ ID NO: 39858

SEQ ID NO: 683793 - RNA, 64 nt, hsa; identical to SEQ ID NO: 39859

SEQ ID NO: 683794 - RNA, 64 nt, hsa; identical to SEQ ID NO: 39860

SEQ ID NO: 683795 - RNA, 64 nt, hsa; identical to SEQ ID NO: 39861

SEQ ID NO: 683796 - RNA, 64 nt, hsa; identical to SEQ ID NO: 39862

SEQ ID NO: 683797 - RNA, 64 nt, hsa; identical to SEQ ID NO: 39863

SEQ ID NO: 683798 - RNA, 64 nt, hsa; identical to SEQ ID NO: 39864

SEQ ID NO: 683799 - RNA, 64 nt, hsa; identical to SEQ ID NO: 39865

SEQ ID NO: 683800 - RNA, 64 nt, hsa; identical to SEQ ID NO: 39866

SEQ ID NO: 683801 - RNA, 64 nt, hsa; identical to SEQ ID NO: 39867

SEQ ID NO: 683802 - RNA, 64 nt, hsa; identical to SEQ ID NO: 39868

SEQ ID NO: 683803 - RNA, 64 nt, hsa; identical to SEQ ID NO: 39869

SEQ ID NO: 683804 - RNA, 64 nt, hsa; identical to SEQ ID NO: 39870

SEQ ID NO: 683805 - RNA, 64 nt, hsa; identical to SEQ ID NO: 39871

SEQ ID NO: 683806 - RNA, 64 nt, hsa; identical to SEQ ID NO: 39872

SEQ ID NO: 683807 - RNA, 64 nt, hsa; identical to SEQ ID NO: 39873

SEQ ID NO: 683808 - RNA, 64 nt, hsa; identical to SEQ ID NO: 39874

SEQ ID NO: 683809 - RNA, 64 nt, hsa; identical to SEQ ID NO: 39875

SEQ ID NO: 683810 - RNA, 64 nt, hsa; identical to SEQ ID NO: 39876

SEQ ID NO: 683811 - RNA, 64 nt, hsa; identical to SEQ ID NO: 39877

SEQ ID NO: 683812 - RNA, 64 nt, hsa; identical to SEQ ID NO: 39878

SEQ ID NO: 683813 - RNA, 64 nt, hsa; identical to SEQ ID NO: 39879

SEQ ID NO: 683814 - RNA, 64 nt, hsa; identical to SEQ ID NO: 39880

SEQ ID NO: 683815 - RNA, 64 nt, hsa; identical to SEQ ID NO: 39881

SEQ ID NO: 683816 - RNA, 64 nt, hsa; identical to SEQ ID NO: 39882

SEQ ID NO: 683817 - RNA, 64 nt, hsa; identical to SEQ ID NO: 39883

SEQ ID NO: 683818 - RNA, 64 nt, hsa; identical to SEQ ID NO: 39884

SEQ ID NO: 683819 - RNA, 64 nt, hsa; identical to SEQ ID NO: 39885

SEQ ID NO: 683820 - RNA, 64 nt, hsa; identical to SEQ ID NO: 39886

SEQ ID NO: 683821 - RNA, 64 nt, hsa; identical to SEQ ID NO: 39887

SEQ ID NO: 683822 - RNA, 64 nt, hsa; identical to SEQ ID NO: 39888

SEQ ID NO: 683823 - RNA, 64 nt, hsa; identical to SEQ ID NO: 39889

SEQ ID NO: 683824 - RNA, 64 nt, hsa; identical to SEQ ID NO: 39890

SEQ ID NO: 683825 - RNA, 64 nt, hsa; identical to SEQ ID NO: 39891

SEQ ID NO: 683826 - RNA, 64 nt, hsa; identical to SEQ ID NO: 39892

SEQ ID NO: 683827 - RNA, 64 nt, hsa; identical to SEQ ID NO: 39893

SEQ ID NO: 683828 - RNA, 64 nt, hsa; identical to SEQ ID NO: 39894

SEQ ID NO: 683829 - RNA, 64 nt, hsa; identical to SEQ ID NO: 39895

SEQ ID NO: 683830 - RNA, 64 nt, hsa; identical to SEQ ID NO: 39896

SEQ ID NO: 683831 - RNA, 64 nt, hsa; identical to SEQ ID NO: 39897

SEQ ID NO: 683832 - RNA, 64 nt, hsa; identical to SEQ ID NO: 39898

SEQ ID NO: 683833 - RNA, 64 nt, hsa; identical to SEQ ID NO: 39899

SEQ ID NO: 683834 - RNA, 64 nt, hsa; identical to SEQ ID NO: 39900

SEQ ID NO: 683835 - RNA, 64 nt, hsa; identical to SEQ ID NO: 39901

SEQ ID NO: 683836 - RNA, 64 nt, hsa; identical to SEQ ID NO: 39902

SEQ ID NO: 683837 - RNA, 64 nt, hsa; identical to SEQ ID NO: 39903

SEQ ID NO: 683838 - RNA, 64 nt, hsa; identical to SEQ ID NO: 39904

SEQ ID NO: 683839 - RNA, 64 nt, hsa; identical to SEQ ID NO: 39905

SEQ ID NO: 683840 - RNA, 64 nt, hsa; identical to SEQ ID NO: 39906

SEQ ID NO: 683841 - RNA, 64 nt, hsa; identical to SEQ ID NO: 39907

SEQ ID NO: 683842 - RNA, 64 nt, hsa; identical to SEQ ID NO: 39908

SEQ ID NO: 683843 - RNA, 64 nt, hsa; identical to SEQ ID NO: 39909

SEQ ID NO: 683844 - RNA, 64 nt, hsa; identical to SEQ ID NO: 39910

SEQ ID NO: 683845 - RNA, 64 nt, hsa; identical to SEQ ID NO: 39911

SEQ ID NO: 683846 - RNA, 64 nt, hsa; identical to SEQ ID NO: 39912

SEQ ID NO: 683847 - RNA, 64 nt, hsa; identical to SEQ ID NO: 39913

SEQ ID NO: 683848 - RNA, 64 nt, hsa; identical to SEQ ID NO: 39914

SEQ ID NO: 683849 - RNA, 64 nt, hsa; identical to SEQ ID NO: 39915

SEQ ID NO: 683850 - RNA, 64 nt, hsa; identical to SEQ ID NO: 39916

SEQ ID NO: 683851 - RNA, 64 nt, hsa; identical to SEQ ID NO: 39917

SEQ ID NO: 683852 - RNA, 64 nt, hsa; identical to SEQ ID NO: 39918

SEQ ID NO: 683853 - RNA, 64 nt, hsa; identical to SEQ ID NO: 39919

SEQ ID NO: 683854 - RNA, 64 nt, hsa; identical to SEQ ID NO: 39920

SEQ ID NO: 683855 - RNA, 64 nt, hsa; identical to SEQ ID NO: 39921

SEQ ID NO: 683856 - RNA, 64 nt, hsa; identical to SEQ ID NO: 39922

SEQ ID NO: 683857 - RNA, 64 nt, hsa; identical to SEQ ID NO: 39923

SEQ ID NO: 683858 - RNA, 64 nt, hsa; identical to SEQ ID NO: 39924

SEQ ID NO: 683859 - RNA, 64 nt, hsa; identical to SEQ ID NO: 39925

SEQ ID NO: 683860 - RNA, 64 nt, hsa; identical to SEQ ID NO: 39926

SEQ ID NO: 683861 - RNA, 64 nt, hsa; identical to SEQ ID NO: 39927

SEQ ID NO: 683862 - RNA, 64 nt, hsa; identical to SEQ ID NO: 39928

SEQ ID NO: 683863 - RNA, 64 nt, hsa; identical to SEQ ID NO: 39929

SEQ ID NO: 683864 - RNA, 64 nt, hsa; identical to SEQ ID NO: 39930

SEQ ID NO: 683865 - RNA, 64 nt, hsa; identical to SEQ ID NO: 39931

SEQ ID NO: 683866 - RNA, 64 nt, hsa; identical to SEQ ID NO: 39932

SEQ ID NO: 683867 - RNA, 64 nt, hsa; identical to SEQ ID NO: 39933

SEQ ID NO: 683868 - RNA, 64 nt, hsa; identical to SEQ ID NO: 39934

SEQ ID NO: 683869 - RNA, 64 nt, hsa; identical to SEQ ID NO: 39935

SEQ ID NO: 683870 - RNA, 64 nt, hsa; identical to SEQ ID NO: 39936

SEQ ID NO: 683871 - RNA, 64 nt, hsa; identical to SEQ ID NO: 39937

SEQ ID NO: 683872 - RNA, 64 nt, hsa; identical to SEQ ID NO: 39938

SEQ ID NO: 683873 - RNA, 64 nt, hsa; identical to SEQ ID NO: 39939

SEQ ID NO: 683874 - RNA, 64 nt, hsa; identical to SEQ ID NO: 39940

SEQ ID NO: 683875 - RNA, 64 nt, hsa; identical to SEQ ID NO: 39941

SEQ ID NO: 683876 - RNA, 64 nt, hsa; identical to SEQ ID NO: 39942

SEQ ID NO: 683877 - RNA, 64 nt, hsa; identical to SEQ ID NO: 39943

SEQ ID NO: 683878 - RNA, 64 nt, hsa; identical to SEQ ID NO: 39944

SEQ ID NO: 683879 - RNA, 64 nt, hsa; identical to SEQ ID NO: 39945

SEQ ID NO: 683880 - RNA, 64 nt, hsa; identical to SEQ ID NO: 39946

SEQ ID NO: 683881 - RNA, 64 nt, hsa; identical to SEQ ID NO: 39947

SEQ ID NO: 683882 - RNA, 64 nt, hsa; identical to SEQ ID NO: 39948

SEQ ID NO: 683883 - RNA, 64 nt, hsa; identical to SEQ ID NO: 39949

SEQ ID NO: 683884 - RNA, 64 nt, hsa; identical to SEQ ID NO: 39950

SEQ ID NO: 683885 - RNA, 64 nt, hsa; identical to SEQ ID NO: 39951

SEQ ID NO: 683886 - RNA, 64 nt, hsa; identical to SEQ ID NO: 39952

SEQ ID NO: 683887 - RNA, 64 nt, hsa; identical to SEQ ID NO: 39953

SEQ ID NO: 683888 - RNA, 64 nt, hsa; identical to SEQ ID NO: 39954

SEQ ID NO: 683889 - RNA, 64 nt, hsa; identical to SEQ ID NO: 39955

SEQ ID NO: 683890 - RNA, 64 nt, hsa; identical to SEQ ID NO: 39956

SEQ ID NO: 683891 - RNA, 64 nt, hsa; identical to SEQ ID NO: 39957

SEQ ID NO: 683892 - RNA, 64 nt, hsa; identical to SEQ ID NO: 39958

SEQ ID NO: 683893 - RNA, 64 nt, hsa; identical to SEQ ID NO: 39959

SEQ ID NO: 683894 - RNA, 64 nt, hsa; identical to SEQ ID NO: 39960

SEQ ID NO: 683895 - RNA, 64 nt, hsa; identical to SEQ ID NO: 39961

SEQ ID NO: 683896 - RNA, 64 nt, hsa; identical to SEQ ID NO: 39962

SEQ ID NO: 683897 - RNA, 64 nt, hsa; identical to SEQ ID NO: 39963

SEQ ID NO: 683898 - RNA, 64 nt, hsa; identical to SEQ ID NO: 39964

SEQ ID NO: 683899 - RNA, 64 nt, hsa; identical to SEQ ID NO: 39965

SEQ ID NO: 683900 - RNA, 64 nt, hsa; identical to SEQ ID NO: 39966

SEQ ID NO: 683901 - RNA, 64 nt, hsa; identical to SEQ ID NO: 39967

SEQ ID NO: 683902 - RNA, 64 nt, hsa; identical to SEQ ID NO: 39968

SEQ ID NO: 683903 - RNA, 64 nt, hsa; identical to SEQ ID NO: 39969

SEQ ID NO: 683904 - RNA, 64 nt, hsa; identical to SEQ ID NO: 39970

SEQ ID NO: 683905 - RNA, 64 nt, hsa; identical to SEQ ID NO: 39971

SEQ ID NO: 683906 - RNA, 64 nt, hsa; identical to SEQ ID NO: 39972

SEQ ID NO: 683907 - RNA, 64 nt, hsa; identical to SEQ ID NO: 39973

SEQ ID NO: 683908 - RNA, 64 nt, hsa; identical to SEQ ID NO: 39974

SEQ ID NO: 683909 - RNA, 64 nt, hsa; identical to SEQ ID NO: 39975

SEQ ID NO: 683910 - RNA, 64 nt, hsa; identical to SEQ ID NO: 39976

SEQ ID NO: 683911 - RNA, 64 nt, hsa; identical to SEQ ID NO: 39977

SEQ ID NO: 683912 - RNA, 64 nt, hsa; identical to SEQ ID NO: 39978

SEQ ID NO: 683913 - RNA, 64 nt, hsa; identical to SEQ ID NO: 39979

SEQ ID NO: 683914 - RNA, 64 nt, hsa; identical to SEQ ID NO: 39980

SEQ ID NO: 683915 - RNA, 64 nt, hsa; identical to SEQ ID NO: 39981

SEQ ID NO: 683916 - RNA, 64 nt, hsa; identical to SEQ ID NO: 39982

SEQ ID NO: 683917 - RNA, 64 nt, hsa; identical to SEQ ID NO: 39983

SEQ ID NO: 683918 - RNA, 64 nt, hsa; identical to SEQ ID NO: 39984

SEQ ID NO: 683919 - RNA, 64 nt, hsa; identical to SEQ ID NO: 39985

SEQ ID NO: 683920 - RNA, 64 nt, hsa; identical to SEQ ID NO: 39986

SEQ ID NO: 683921 - RNA, 64 nt, hsa; identical to SEQ ID NO: 39987

SEQ ID NO: 683922 - RNA, 64 nt, hsa; identical to SEQ ID NO: 39988

SEQ ID NO: 683923 - RNA, 64 nt, hsa; identical to SEQ ID NO: 39989

SEQ ID NO: 683924 - RNA, 64 nt, hsa; identical to SEQ ID NO: 39990

SEQ ID NO: 683925 - RNA, 64 nt, hsa; identical to SEQ ID NO: 39991

SEQ ID NO: 683926 - RNA, 64 nt, hsa; identical to SEQ ID NO: 39992

SEQ ID NO: 683927 - RNA, 64 nt, hsa; identical to SEQ ID NO: 39993

SEQ ID NO: 683928 - RNA, 64 nt, hsa; identical to SEQ ID NO: 39994

SEQ ID NO: 683929 - RNA, 64 nt, hsa; identical to SEQ ID NO: 39995

SEQ ID NO: 683930 - RNA, 64 nt, hsa; identical to SEQ ID NO: 39996

SEQ ID NO: 683931 - RNA, 64 nt, hsa; identical to SEQ ID NO: 39997

SEQ ID NO: 683932 - RNA, 64 nt, hsa; identical to SEQ ID NO: 39998

SEQ ID NO: 683933 - RNA, 64 nt, hsa; identical to SEQ ID NO: 39999

SEQ ID NO: 683934 - RNA, 64 nt, hsa; identical to SEQ ID NO: 40000

SEQ ID NO: 683935 - RNA, 64 nt, hsa; identical to SEQ ID NO: 40001

SEQ ID NO: 683936 - RNA, 64 nt, hsa; identical to SEQ ID NO: 40002

SEQ ID NO: 683937 - RNA, 64 nt, hsa; identical to SEQ ID NO: 40003

SEQ ID NO: 683938 - RNA, 64 nt, hsa; identical to SEQ ID NO: 40004

SEQ ID NO: 683939 - RNA, 64 nt, hsa; identical to SEQ ID NO: 40005

SEQ ID NO: 683940 - RNA, 64 nt, hsa; identical to SEQ ID NO: 40006

SEQ ID NO: 683941 - RNA, 64 nt, hsa; identical to SEQ ID NO: 40007

SEQ ID NO: 683942 - RNA, 64 nt, hsa; identical to SEQ ID NO: 40008

SEQ ID NO: 683943 - RNA, 64 nt, hsa; identical to SEQ ID NO: 40009

SEQ ID NO: 683944 - RNA, 64 nt, hsa; identical to SEQ ID NO: 40010

SEQ ID NO: 683945 - RNA, 64 nt, hsa; identical to SEQ ID NO: 40011

SEQ ID NO: 683946 - RNA, 64 nt, hsa; identical to SEQ ID NO: 40012

SEQ ID NO: 683947 - RNA, 64 nt, hsa; identical to SEQ ID NO: 40013

SEQ ID NO: 683948 - RNA, 64 nt, hsa; identical to SEQ ID NO: 40014

SEQ ID NO: 683949 - RNA, 64 nt, hsa; identical to SEQ ID NO: 40015

SEQ ID NO: 683950 - RNA, 64 nt, hsa; identical to SEQ ID NO: 40016

SEQ ID NO: 683951 - RNA, 64 nt, hsa; identical to SEQ ID NO: 40017

SEQ ID NO: 683952 - RNA, 64 nt, hsa; identical to SEQ ID NO: 40018

SEQ ID NO: 683953 - RNA, 64 nt, hsa; identical to SEQ ID NO: 40019

SEQ ID NO: 683954 - RNA, 64 nt, hsa; identical to SEQ ID NO: 40020

SEQ ID NO: 683955 - RNA, 64 nt, hsa; identical to SEQ ID NO: 40021

SEQ ID NO: 683956 - RNA, 64 nt, hsa; identical to SEQ ID NO: 40022

SEQ ID NO: 683957 - RNA, 64 nt, hsa; identical to SEQ ID NO: 40023

SEQ ID NO: 683958 - RNA, 64 nt, hsa; identical to SEQ ID NO: 40024

SEQ ID NO: 683959 - RNA, 64 nt, hsa; identical to SEQ ID NO: 40025

SEQ ID NO: 683960 - RNA, 64 nt, hsa; identical to SEQ ID NO: 40026

SEQ ID NO: 683961 - RNA, 64 nt, hsa; identical to SEQ ID NO: 40027

SEQ ID NO: 683962 - RNA, 64 nt, hsa; identical to SEQ ID NO: 40028

SEQ ID NO: 683963 - RNA, 64 nt, hsa; identical to SEQ ID NO: 40029

SEQ ID NO: 683964 - RNA, 64 nt, hsa; identical to SEQ ID NO: 40030

SEQ ID NO: 683965 - RNA, 64 nt, hsa; identical to SEQ ID NO: 40031

SEQ ID NO: 683966 - RNA, 64 nt, hsa; identical to SEQ ID NO: 40032

SEQ ID NO: 683967 - RNA, 64 nt, hsa; identical to SEQ ID NO: 40033

SEQ ID NO: 683968 - RNA, 64 nt, hsa; identical to SEQ ID NO: 40034

SEQ ID NO: 683969 - RNA, 64 nt, hsa; identical to SEQ ID NO: 40035

SEQ ID NO: 683970 - RNA, 64 nt, hsa; identical to SEQ ID NO: 40036

SEQ ID NO: 683971 - RNA, 64 nt, hsa; identical to SEQ ID NO: 40037

SEQ ID NO: 683972 - RNA, 64 nt, hsa; identical to SEQ ID NO: 40038

SEQ ID NO: 683973 - RNA, 64 nt, hsa; identical to SEQ ID NO: 40039

SEQ ID NO: 683974 - RNA, 64 nt, hsa; identical to SEQ ID NO: 40040

SEQ ID NO: 683975 - RNA, 64 nt, hsa; identical to SEQ ID NO: 40041

SEQ ID NO: 683976 - RNA, 64 nt, hsa; identical to SEQ ID NO: 40042

SEQ ID NO: 683977 - RNA, 64 nt, hsa; identical to SEQ ID NO: 40043

SEQ ID NO: 683978 - RNA, 64 nt, hsa; identical to SEQ ID NO: 40044

SEQ ID NO: 683979 - RNA, 64 nt, hsa; identical to SEQ ID NO: 40045

SEQ ID NO: 683980 - RNA, 64 nt, hsa; identical to SEQ ID NO: 40046

SEQ ID NO: 683981 - RNA, 64 nt, hsa; identical to SEQ ID NO: 40047

SEQ ID NO: 683982 - RNA, 64 nt, hsa; identical to SEQ ID NO: 40048

SEQ ID NO: 683983 - RNA, 64 nt, hsa; identical to SEQ ID NO: 40049

SEQ ID NO: 683984 - RNA, 64 nt, hsa; identical to SEQ ID NO: 40050

SEQ ID NO: 683985 - RNA, 64 nt, hsa; identical to SEQ ID NO: 40051

SEQ ID NO: 683986 - RNA, 64 nt, hsa; identical to SEQ ID NO: 40052

SEQ ID NO: 683987 - RNA, 64 nt, hsa; identical to SEQ ID NO: 40053

SEQ ID NO: 683988 - RNA, 64 nt, hsa; identical to SEQ ID NO: 40054

SEQ ID NO: 683989 - RNA, 64 nt, hsa; identical to SEQ ID NO: 40055

SEQ ID NO: 683990 - RNA, 64 nt, hsa; identical to SEQ ID NO: 40056

SEQ ID NO: 683991 - RNA, 64 nt, hsa; identical to SEQ ID NO: 40057

SEQ ID NO: 683992 - RNA, 64 nt, hsa; identical to SEQ ID NO: 40058

SEQ ID NO: 683993 - RNA, 64 nt, hsa; identical to SEQ ID NO: 40059

SEQ ID NO: 683994 - RNA, 64 nt, hsa; identical to SEQ ID NO: 40060

SEQ ID NO: 683995 - RNA, 64 nt, hsa; identical to SEQ ID NO: 40061

SEQ ID NO: 683996 - RNA, 64 nt, hsa; identical to SEQ ID NO: 40062

SEQ ID NO: 683997 - RNA, 64 nt, hsa; identical to SEQ ID NO: 40063

SEQ ID NO: 683998 - RNA, 64 nt, hsa; identical to SEQ ID NO: 40064

SEQ ID NO: 683999 - RNA, 64 nt, hsa; identical to SEQ ID NO: 40065

SEQ ID NO: 684000 - RNA, 64 nt, hsa; identical to SEQ ID NO: 40066

SEQ ID NO: 684001 - RNA, 64 nt, hsa; identical to SEQ ID NO: 40067

SEQ ID NO: 684002 - RNA, 64 nt, hsa; identical to SEQ ID NO: 40068

SEQ ID NO: 684003 - RNA, 64 nt, hsa; identical to SEQ ID NO: 40069

SEQ ID NO: 684004 - RNA, 64 nt, hsa; identical to SEQ ID NO: 40070

SEQ ID NO: 684005 - RNA, 64 nt, hsa; identical to SEQ ID NO: 40071

SEQ ID NO: 684006 - RNA, 64 nt, hsa; identical to SEQ ID NO: 40072

SEQ ID NO: 684007 - RNA, 64 nt, hsa; identical to SEQ ID NO: 40073

SEQ ID NO: 684008 - RNA, 64 nt, hsa; identical to SEQ ID NO: 40074

SEQ ID NO: 684009 - RNA, 64 nt, hsa; identical to SEQ ID NO: 40075

SEQ ID NO: 684010 - RNA, 64 nt, hsa; identical to SEQ ID NO: 40076

SEQ ID NO: 684011 - RNA, 64 nt, hsa; identical to SEQ ID NO: 40077

SEQ ID NO: 684012 - RNA, 64 nt, hsa; identical to SEQ ID NO: 40078

SEQ ID NO: 684013 - RNA, 64 nt, hsa; identical to SEQ ID NO: 40079

SEQ ID NO: 684014 - RNA, 64 nt, hsa; identical to SEQ ID NO: 40080

SEQ ID NO: 684015 - RNA, 64 nt, hsa; identical to SEQ ID NO: 40081

SEQ ID NO: 684016 - RNA, 64 nt, hsa; identical to SEQ ID NO: 40082

SEQ ID NO: 684017 - RNA, 64 nt, hsa; identical to SEQ ID NO: 40083

SEQ ID NO: 684018 - RNA, 64 nt, hsa; identical to SEQ ID NO: 40084

SEQ ID NO: 684019 - RNA, 64 nt, hsa; identical to SEQ ID NO: 40085

SEQ ID NO: 684020 - RNA, 64 nt, hsa; identical to SEQ ID NO: 40086

SEQ ID NO: 684021 - RNA, 64 nt, hsa; identical to SEQ ID NO: 40087

SEQ ID NO: 684022 - RNA, 64 nt, hsa; identical to SEQ ID NO: 40088

SEQ ID NO: 684023 - RNA, 64 nt, hsa; identical to SEQ ID NO: 40089

SEQ ID NO: 684024 - RNA, 64 nt, hsa; identical to SEQ ID NO: 40090

SEQ ID NO: 684025 - RNA, 64 nt, hsa; identical to SEQ ID NO: 40091

SEQ ID NO: 684026 - RNA, 64 nt, hsa; identical to SEQ ID NO: 40092

SEQ ID NO: 684027 - RNA, 64 nt, hsa; identical to SEQ ID NO: 40093

SEQ ID NO: 684028 - RNA, 64 nt, hsa; identical to SEQ ID NO: 40094

SEQ ID NO: 684029 - RNA, 64 nt, hsa; identical to SEQ ID NO: 40095

SEQ ID NO: 684030 - RNA, 64 nt, hsa; identical to SEQ ID NO: 40096

SEQ ID NO: 684031 - RNA, 64 nt, hsa; identical to SEQ ID NO: 40097

SEQ ID NO: 684032 - RNA, 64 nt, hsa; identical to SEQ ID NO: 40098

SEQ ID NO: 684033 - RNA, 64 nt, hsa; identical to SEQ ID NO: 40099

SEQ ID NO: 684034 - RNA, 64 nt, hsa; identical to SEQ ID NO: 40100

SEQ ID NO: 684035 - RNA, 64 nt, hsa; identical to SEQ ID NO: 40101

SEQ ID NO: 684036 - RNA, 64 nt, hsa; identical to SEQ ID NO: 40102

SEQ ID NO: 684037 - RNA, 64 nt, hsa; identical to SEQ ID NO: 40103

SEQ ID NO: 684038 - RNA, 64 nt, hsa; identical to SEQ ID NO: 40104

SEQ ID NO: 684039 - RNA, 64 nt, hsa; identical to SEQ ID NO: 40105

SEQ ID NO: 684040 - RNA, 64 nt, hsa; identical to SEQ ID NO: 40106

SEQ ID NO: 684041 - RNA, 64 nt, hsa; identical to SEQ ID NO: 40107

SEQ ID NO: 684042 - RNA, 64 nt, hsa; identical to SEQ ID NO: 40108

SEQ ID NO: 684043 - RNA, 64 nt, hsa; identical to SEQ ID NO: 40109

SEQ ID NO: 684044 - RNA, 64 nt, hsa; identical to SEQ ID NO: 40110

SEQ ID NO: 684045 - RNA, 64 nt, hsa; identical to SEQ ID NO: 40111

SEQ ID NO: 684046 - RNA, 64 nt, hsa; identical to SEQ ID NO: 40112

SEQ ID NO: 684047 - RNA, 64 nt, hsa; identical to SEQ ID NO: 40113

SEQ ID NO: 684048 - RNA, 64 nt, hsa; identical to SEQ ID NO: 40114

SEQ ID NO: 684049 - RNA, 64 nt, hsa; identical to SEQ ID NO: 40115

SEQ ID NO: 684050 - RNA, 64 nt, hsa; identical to SEQ ID NO: 40116

SEQ ID NO: 684051 - RNA, 64 nt, hsa; identical to SEQ ID NO: 40117

SEQ ID NO: 684052 - RNA, 64 nt, hsa; identical to SEQ ID NO: 40118

SEQ ID NO: 684053 - RNA, 64 nt, hsa; identical to SEQ ID NO: 40119

SEQ ID NO: 684054 - RNA, 64 nt, hsa; identical to SEQ ID NO: 40120

SEQ ID NO: 684055 - RNA, 64 nt, hsa; identical to SEQ ID NO: 40121

SEQ ID NO: 684056 - RNA, 64 nt, hsa; identical to SEQ ID NO: 40122

SEQ ID NO: 684057 - RNA, 64 nt, hsa; identical to SEQ ID NO: 40123

SEQ ID NO: 684058 - RNA, 64 nt, hsa; identical to SEQ ID NO: 40124

SEQ ID NO: 684059 - RNA, 64 nt, hsa; identical to SEQ ID NO: 40125

SEQ ID NO: 684060 - RNA, 64 nt, hsa; identical to SEQ ID NO: 40126

SEQ ID NO: 684061 - RNA, 64 nt, hsa; identical to SEQ ID NO: 40127

SEQ ID NO: 684062 - RNA, 64 nt, hsa; identical to SEQ ID NO: 40128

SEQ ID NO: 684063 - RNA, 64 nt, hsa; identical to SEQ ID NO: 40129

SEQ ID NO: 684064 - RNA, 64 nt, hsa; identical to SEQ ID NO: 40130

SEQ ID NO: 684065 - RNA, 64 nt, hsa; identical to SEQ ID NO: 40131

SEQ ID NO: 684066 - RNA, 64 nt, hsa; identical to SEQ ID NO: 40132

SEQ ID NO: 684067 - RNA, 64 nt, hsa; identical to SEQ ID NO: 40133

SEQ ID NO: 684068 - RNA, 64 nt, hsa; identical to SEQ ID NO: 40134

SEQ ID NO: 684069 - RNA, 64 nt, hsa; identical to SEQ ID NO: 40135

SEQ ID NO: 684070 - RNA, 64 nt, hsa; identical to SEQ ID NO: 40136

SEQ ID NO: 684071 - RNA, 64 nt, hsa; identical to SEQ ID NO: 40137

SEQ ID NO: 684072 - RNA, 64 nt, hsa; identical to SEQ ID NO: 40138

SEQ ID NO: 684073 - RNA, 64 nt, hsa; identical to SEQ ID NO: 40139

SEQ ID NO: 684074 - RNA, 64 nt, hsa; identical to SEQ ID NO: 40140

SEQ ID NO: 684075 - RNA, 64 nt, hsa; identical to SEQ ID NO: 40141

SEQ ID NO: 684076 - RNA, 64 nt, hsa; identical to SEQ ID NO: 40142

SEQ ID NO: 684077 - RNA, 64 nt, hsa; identical to SEQ ID NO: 40143

SEQ ID NO: 684078 - RNA, 64 nt, hsa; identical to SEQ ID NO: 40144

SEQ ID NO: 684079 - RNA, 64 nt, hsa; identical to SEQ ID NO: 40145

SEQ ID NO: 684080 - RNA, 64 nt, hsa; identical to SEQ ID NO: 40146

SEQ ID NO: 684081 - RNA, 64 nt, hsa; identical to SEQ ID NO: 40147

SEQ ID NO: 684082 - RNA, 64 nt, hsa; identical to SEQ ID NO: 40148

SEQ ID NO: 684083 - RNA, 64 nt, hsa; identical to SEQ ID NO: 40149

SEQ ID NO: 684084 - RNA, 64 nt, hsa; identical to SEQ ID NO: 40150

SEQ ID NO: 684085 - RNA, 64 nt, hsa; identical to SEQ ID NO: 40151

SEQ ID NO: 684086 - RNA, 64 nt, hsa; identical to SEQ ID NO: 40152

SEQ ID NO: 684087 - RNA, 64 nt, hsa; identical to SEQ ID NO: 40153

SEQ ID NO: 684088 - RNA, 64 nt, hsa; identical to SEQ ID NO: 40154

SEQ ID NO: 684089 - RNA, 64 nt, hsa; identical to SEQ ID NO: 40155

SEQ ID NO: 684090 - RNA, 64 nt, hsa; identical to SEQ ID NO: 40156

SEQ ID NO: 684091 - RNA, 64 nt, hsa; identical to SEQ ID NO: 40157

SEQ ID NO: 684092 - RNA, 64 nt, hsa; identical to SEQ ID NO: 40158

SEQ ID NO: 684093 - RNA, 64 nt, hsa; identical to SEQ ID NO: 40159

SEQ ID NO: 684094 - RNA, 64 nt, hsa; identical to SEQ ID NO: 40160

SEQ ID NO: 684095 - RNA, 64 nt, hsa; identical to SEQ ID NO: 40161

SEQ ID NO: 684096 - RNA, 64 nt, hsa; identical to SEQ ID NO: 40162

SEQ ID NO: 684097 - RNA, 64 nt, hsa; identical to SEQ ID NO: 40163

SEQ ID NO: 684098 - RNA, 64 nt, hsa; identical to SEQ ID NO: 40164

SEQ ID NO: 684099 - RNA, 64 nt, hsa; identical to SEQ ID NO: 40165

SEQ ID NO: 684100 - RNA, 64 nt, hsa; identical to SEQ ID NO: 40166

SEQ ID NO: 684101 - RNA, 64 nt, hsa; identical to SEQ ID NO: 40167

SEQ ID NO: 684102 - RNA, 64 nt, hsa; identical to SEQ ID NO: 40168

SEQ ID NO: 684103 - RNA, 64 nt, hsa; identical to SEQ ID NO: 40169

SEQ ID NO: 684104 - RNA, 64 nt, hsa; identical to SEQ ID NO: 40170

SEQ ID NO: 684105 - RNA, 64 nt, hsa; identical to SEQ ID NO: 40171

SEQ ID NO: 684106 - RNA, 64 nt, hsa; identical to SEQ ID NO: 40172

SEQ ID NO: 684107 - RNA, 64 nt, hsa; identical to SEQ ID NO: 40173

SEQ ID NO: 684108 - RNA, 64 nt, hsa; identical to SEQ ID NO: 40174

SEQ ID NO: 684109 - RNA, 64 nt, hsa; identical to SEQ ID NO: 40175

SEQ ID NO: 684110 - RNA, 64 nt, hsa; identical to SEQ ID NO: 40176

SEQ ID NO: 684111 - RNA, 64 nt, hsa; identical to SEQ ID NO: 40177

SEQ ID NO: 684112 - RNA, 64 nt, hsa; identical to SEQ ID NO: 40178

SEQ ID NO: 684113 - RNA, 64 nt, hsa; identical to SEQ ID NO: 40179

SEQ ID NO: 684114 - RNA, 64 nt, hsa; identical to SEQ ID NO: 40180

SEQ ID NO: 684115 - RNA, 64 nt, hsa; identical to SEQ ID NO: 40181

SEQ ID NO: 684116 - RNA, 64 nt, hsa; identical to SEQ ID NO: 40182

SEQ ID NO: 684117 - RNA, 64 nt, hsa; identical to SEQ ID NO: 40183

SEQ ID NO: 684118 - RNA, 64 nt, hsa; identical to SEQ ID NO: 40184

SEQ ID NO: 684119 - RNA, 64 nt, hsa; identical to SEQ ID NO: 40185

SEQ ID NO: 684120 - RNA, 64 nt, hsa; identical to SEQ ID NO: 40186

SEQ ID NO: 684121 - RNA, 64 nt, hsa; identical to SEQ ID NO: 40187

SEQ ID NO: 684122 - RNA, 64 nt, hsa; identical to SEQ ID NO: 40188

SEQ ID NO: 684123 - RNA, 64 nt, hsa; identical to SEQ ID NO: 40189

SEQ ID NO: 684124 - RNA, 64 nt, hsa; identical to SEQ ID NO: 40190

SEQ ID NO: 684125 - RNA, 64 nt, hsa; identical to SEQ ID NO: 40191

SEQ ID NO: 684126 - RNA, 64 nt, hsa; identical to SEQ ID NO: 40192

SEQ ID NO: 684127 - RNA, 64 nt, hsa; identical to SEQ ID NO: 40193

SEQ ID NO: 684128 - RNA, 64 nt, hsa; identical to SEQ ID NO: 40194

SEQ ID NO: 684129 - RNA, 64 nt, hsa; identical to SEQ ID NO: 40195

SEQ ID NO: 684130 - RNA, 64 nt, hsa; identical to SEQ ID NO: 40196

SEQ ID NO: 684131 - RNA, 64 nt, hsa; identical to SEQ ID NO: 40197

SEQ ID NO: 684132 - RNA, 64 nt, hsa; identical to SEQ ID NO: 40198

SEQ ID NO: 684133 - RNA, 64 nt, hsa; identical to SEQ ID NO: 40199

SEQ ID NO: 684134 - RNA, 64 nt, hsa; identical to SEQ ID NO: 40200

SEQ ID NO: 684135 - RNA, 64 nt, hsa; identical to SEQ ID NO: 40201

SEQ ID NO: 684136 - RNA, 64 nt, hsa; identical to SEQ ID NO: 40202

SEQ ID NO: 684137 - RNA, 64 nt, hsa; identical to SEQ ID NO: 40203

SEQ ID NO: 684138 - RNA, 64 nt, hsa; identical to SEQ ID NO: 40204

SEQ ID NO: 684139 - RNA, 64 nt, hsa; identical to SEQ ID NO: 40205

SEQ ID NO: 684140 - RNA, 64 nt, hsa; identical to SEQ ID NO: 40206

SEQ ID NO: 684141 - RNA, 64 nt, hsa; identical to SEQ ID NO: 40207

SEQ ID NO: 684142 - RNA, 64 nt, hsa; identical to SEQ ID NO: 40208

SEQ ID NO: 684143 - RNA, 64 nt, hsa; identical to SEQ ID NO: 40209

SEQ ID NO: 684144 - RNA, 64 nt, hsa; identical to SEQ ID NO: 40210

SEQ ID NO: 684145 - RNA, 64 nt, hsa; identical to SEQ ID NO: 40211

SEQ ID NO: 684146 - RNA, 64 nt, hsa; identical to SEQ ID NO: 40212

SEQ ID NO: 684147 - RNA, 64 nt, hsa; identical to SEQ ID NO: 40213

SEQ ID NO: 684148 - RNA, 64 nt, hsa; identical to SEQ ID NO: 40214

SEQ ID NO: 684149 - RNA, 64 nt, hsa; identical to SEQ ID NO: 40215

SEQ ID NO: 684150 - RNA, 64 nt, hsa; identical to SEQ ID NO: 40216

SEQ ID NO: 684151 - RNA, 64 nt, hsa; identical to SEQ ID NO: 40217

SEQ ID NO: 684152 - RNA, 64 nt, hsa; identical to SEQ ID NO: 40218

SEQ ID NO: 684153 - RNA, 64 nt, hsa; identical to SEQ ID NO: 40219

SEQ ID NO: 684154 - RNA, 64 nt, hsa; identical to SEQ ID NO: 40220

SEQ ID NO: 684155 - RNA, 64 nt, hsa; identical to SEQ ID NO: 40221

SEQ ID NO: 684156 - RNA, 64 nt, hsa; identical to SEQ ID NO: 40222

SEQ ID NO: 684157 - RNA, 64 nt, hsa; identical to SEQ ID NO: 40223

SEQ ID NO: 684158 - RNA, 64 nt, hsa; identical to SEQ ID NO: 40224

SEQ ID NO: 684159 - RNA, 64 nt, hsa; identical to SEQ ID NO: 40225

SEQ ID NO: 684160 - RNA, 64 nt, hsa; identical to SEQ ID NO: 40226

SEQ ID NO: 684161 - RNA, 64 nt, hsa; identical to SEQ ID NO: 40227

SEQ ID NO: 684162 - RNA, 64 nt, hsa; identical to SEQ ID NO: 40228

SEQ ID NO: 684163 - RNA, 64 nt, hsa; identical to SEQ ID NO: 40229

SEQ ID NO: 684164 - RNA, 64 nt, hsa; identical to SEQ ID NO: 40230

SEQ ID NO: 684165 - RNA, 64 nt, hsa; identical to SEQ ID NO: 40231

SEQ ID NO: 684166 - RNA, 64 nt, hsa; identical to SEQ ID NO: 40232

SEQ ID NO: 684167 - RNA, 64 nt, hsa; identical to SEQ ID NO: 40233

SEQ ID NO: 684168 - RNA, 64 nt, hsa; identical to SEQ ID NO: 40234

SEQ ID NO: 684169 - RNA, 64 nt, hsa; identical to SEQ ID NO: 40235

SEQ ID NO: 684170 - RNA, 64 nt, hsa; identical to SEQ ID NO: 40236

SEQ ID NO: 684171 - RNA, 64 nt, hsa; identical to SEQ ID NO: 40237

SEQ ID NO: 684172 - RNA, 64 nt, hsa; identical to SEQ ID NO: 40238

SEQ ID NO: 684173 - RNA, 64 nt, hsa; identical to SEQ ID NO: 40239

SEQ ID NO: 684174 - RNA, 64 nt, hsa; identical to SEQ ID NO: 40240

SEQ ID NO: 684175 - RNA, 64 nt, hsa; identical to SEQ ID NO: 40241

SEQ ID NO: 684176 - RNA, 64 nt, hsa; identical to SEQ ID NO: 40242

SEQ ID NO: 684177 - RNA, 64 nt, hsa; identical to SEQ ID NO: 40243

SEQ ID NO: 684178 - RNA, 64 nt, hsa; identical to SEQ ID NO: 40244

SEQ ID NO: 684179 - RNA, 64 nt, hsa; identical to SEQ ID NO: 40245

SEQ ID NO: 684180 - RNA, 64 nt, hsa; identical to SEQ ID NO: 40246

SEQ ID NO: 684181 - RNA, 64 nt, hsa; identical to SEQ ID NO: 40247

SEQ ID NO: 684182 - RNA, 64 nt, hsa; identical to SEQ ID NO: 40248

SEQ ID NO: 684183 - RNA, 64 nt, hsa; identical to SEQ ID NO: 40249

SEQ ID NO: 684184 - RNA, 64 nt, hsa; identical to SEQ ID NO: 40250

SEQ ID NO: 684185 - RNA, 64 nt, hsa; identical to SEQ ID NO: 40251

SEQ ID NO: 684186 - RNA, 64 nt, hsa; identical to SEQ ID NO: 40252

SEQ ID NO: 684187 - RNA, 64 nt, hsa; identical to SEQ ID NO: 40253

SEQ ID NO: 684188 - RNA, 64 nt, hsa; identical to SEQ ID NO: 40254

SEQ ID NO: 684189 - RNA, 64 nt, hsa; identical to SEQ ID NO: 40255

SEQ ID NO: 684190 - RNA, 64 nt, hsa; identical to SEQ ID NO: 40256

SEQ ID NO: 684191 - RNA, 64 nt, hsa; identical to SEQ ID NO: 40257

SEQ ID NO: 684192 - RNA, 64 nt, hsa; identical to SEQ ID NO: 40258

SEQ ID NO: 684193 - RNA, 64 nt, hsa; identical to SEQ ID NO: 40259

SEQ ID NO: 684194 - RNA, 64 nt, hsa; identical to SEQ ID NO: 40260

SEQ ID NO: 684195 - RNA, 64 nt, hsa; identical to SEQ ID NO: 40261

SEQ ID NO: 684196 - RNA, 64 nt, hsa; identical to SEQ ID NO: 40262

SEQ ID NO: 684197 - RNA, 64 nt, hsa; identical to SEQ ID NO: 40263

SEQ ID NO: 684198 - RNA, 64 nt, hsa; identical to SEQ ID NO: 40264

SEQ ID NO: 684199 - RNA, 64 nt, hsa; identical to SEQ ID NO: 40265

SEQ ID NO: 684200 - RNA, 64 nt, hsa; identical to SEQ ID NO: 40266

SEQ ID NO: 684201 - RNA, 64 nt, hsa; identical to SEQ ID NO: 40267

SEQ ID NO: 684202 - RNA, 64 nt, hsa; identical to SEQ ID NO: 40268

SEQ ID NO: 684203 - RNA, 64 nt, hsa; identical to SEQ ID NO: 40269

SEQ ID NO: 684204 - RNA, 64 nt, hsa; identical to SEQ ID NO: 40270

SEQ ID NO: 684205 - RNA, 64 nt, hsa; identical to SEQ ID NO: 40271

SEQ ID NO: 684206 - RNA, 64 nt, hsa; identical to SEQ ID NO: 40272

SEQ ID NO: 684207 - RNA, 64 nt, hsa; identical to SEQ ID NO: 40273

SEQ ID NO: 684208 - RNA, 64 nt, hsa; identical to SEQ ID NO: 40274

SEQ ID NO: 684209 - RNA, 64 nt, hsa; identical to SEQ ID NO: 40275

SEQ ID NO: 684210 - RNA, 64 nt, hsa; identical to SEQ ID NO: 40276

SEQ ID NO: 684211 - RNA, 64 nt, hsa; identical to SEQ ID NO: 40277

SEQ ID NO: 684212 - RNA, 64 nt, hsa; identical to SEQ ID NO: 40278

SEQ ID NO: 684213 - RNA, 64 nt, hsa; identical to SEQ ID NO: 40279

SEQ ID NO: 684214 - RNA, 64 nt, hsa; identical to SEQ ID NO: 40280

SEQ ID NO: 684215 - RNA, 64 nt, hsa; identical to SEQ ID NO: 40281

SEQ ID NO: 684216 - RNA, 64 nt, hsa; identical to SEQ ID NO: 40282

SEQ ID NO: 684217 - RNA, 64 nt, hsa; identical to SEQ ID NO: 40283

SEQ ID NO: 684218 - RNA, 64 nt, hsa; identical to SEQ ID NO: 40284

SEQ ID NO: 684219 - RNA, 64 nt, hsa; identical to SEQ ID NO: 40285

SEQ ID NO: 684220 - RNA, 64 nt, hsa; identical to SEQ ID NO: 40286

SEQ ID NO: 684221 - RNA, 64 nt, hsa; identical to SEQ ID NO: 40287

SEQ ID NO: 684222 - RNA, 64 nt, hsa; identical to SEQ ID NO: 40288

SEQ ID NO: 684223 - RNA, 64 nt, hsa; identical to SEQ ID NO: 40289

SEQ ID NO: 684224 - RNA, 64 nt, hsa; identical to SEQ ID NO: 40290

SEQ ID NO: 684225 - RNA, 64 nt, hsa; identical to SEQ ID NO: 40291

SEQ ID NO: 684226 - RNA, 64 nt, hsa; identical to SEQ ID NO: 40292

SEQ ID NO: 684227 - RNA, 64 nt, hsa; identical to SEQ ID NO: 40293

SEQ ID NO: 684228 - RNA, 64 nt, hsa; identical to SEQ ID NO: 40294

SEQ ID NO: 684229 - RNA, 64 nt, hsa; identical to SEQ ID NO: 40295

SEQ ID NO: 684230 - RNA, 64 nt, hsa; identical to SEQ ID NO: 40296

SEQ ID NO: 684231 - RNA, 64 nt, hsa; identical to SEQ ID NO: 40297

SEQ ID NO: 684232 - RNA, 64 nt, hsa; identical to SEQ ID NO: 40298

SEQ ID NO: 684233 - RNA, 64 nt, hsa; identical to SEQ ID NO: 40299

SEQ ID NO: 684234 - RNA, 64 nt, hsa; identical to SEQ ID NO: 40300

SEQ ID NO: 684235 - RNA, 64 nt, hsa; identical to SEQ ID NO: 40301

SEQ ID NO: 684236 - RNA, 64 nt, hsa; identical to SEQ ID NO: 40302

SEQ ID NO: 684237 - RNA, 64 nt, hsa; identical to SEQ ID NO: 40303

SEQ ID NO: 684238 - RNA, 64 nt, hsa; identical to SEQ ID NO: 40304

SEQ ID NO: 684239 - RNA, 64 nt, hsa; identical to SEQ ID NO: 40305

SEQ ID NO: 684240 - RNA, 64 nt, hsa; identical to SEQ ID NO: 40306

SEQ ID NO: 684241 - RNA, 64 nt, hsa; identical to SEQ ID NO: 40307

SEQ ID NO: 684242 - RNA, 64 nt, hsa; identical to SEQ ID NO: 40308

SEQ ID NO: 684243 - RNA, 64 nt, hsa; identical to SEQ ID NO: 40309

SEQ ID NO: 684244 - RNA, 64 nt, hsa; identical to SEQ ID NO: 40310

SEQ ID NO: 684245 - RNA, 64 nt, hsa; identical to SEQ ID NO: 40311

SEQ ID NO: 684246 - RNA, 64 nt, hsa; identical to SEQ ID NO: 40312

SEQ ID NO: 684247 - RNA, 64 nt, hsa; identical to SEQ ID NO: 40313

SEQ ID NO: 684248 - RNA, 64 nt, hsa; identical to SEQ ID NO: 40314

SEQ ID NO: 684249 - RNA, 64 nt, hsa; identical to SEQ ID NO: 40315

SEQ ID NO: 684250 - RNA, 64 nt, hsa; identical to SEQ ID NO: 40316

SEQ ID NO: 684251 - RNA, 64 nt, hsa; identical to SEQ ID NO: 40317

SEQ ID NO: 684252 - RNA, 64 nt, hsa; identical to SEQ ID NO: 40318

SEQ ID NO: 684253 - RNA, 64 nt, hsa; identical to SEQ ID NO: 40319

SEQ ID NO: 684254 - RNA, 64 nt, hsa; identical to SEQ ID NO: 40320

SEQ ID NO: 684255 - RNA, 64 nt, hsa; identical to SEQ ID NO: 40321

SEQ ID NO: 684256 - RNA, 64 nt, hsa; identical to SEQ ID NO: 40322

SEQ ID NO: 684257 - RNA, 64 nt, hsa; identical to SEQ ID NO: 40323

SEQ ID NO: 684258 - RNA, 64 nt, hsa; identical to SEQ ID NO: 40324

SEQ ID NO: 684259 - RNA, 64 nt, hsa; identical to SEQ ID NO: 40325

SEQ ID NO: 684260 - RNA, 64 nt, hsa; identical to SEQ ID NO: 40326

SEQ ID NO: 684261 - RNA, 64 nt, hsa; identical to SEQ ID NO: 40327

SEQ ID NO: 684262 - RNA, 64 nt, hsa; identical to SEQ ID NO: 40328

SEQ ID NO: 684263 - RNA, 64 nt, hsa; identical to SEQ ID NO: 40329

SEQ ID NO: 684264 - RNA, 64 nt, hsa; identical to SEQ ID NO: 40330

SEQ ID NO: 684265 - RNA, 64 nt, hsa; identical to SEQ ID NO: 40331

SEQ ID NO: 684266 - RNA, 64 nt, hsa; identical to SEQ ID NO: 40332

SEQ ID NO: 684267 - RNA, 64 nt, hsa; identical to SEQ ID NO: 40333

SEQ ID NO: 684268 - RNA, 64 nt, hsa; identical to SEQ ID NO: 40334

SEQ ID NO: 684269 - RNA, 64 nt, hsa; identical to SEQ ID NO: 40335

SEQ ID NO: 684270 - RNA, 64 nt, hsa; identical to SEQ ID NO: 40336

SEQ ID NO: 684271 - RNA, 64 nt, hsa; identical to SEQ ID NO: 40337

SEQ ID NO: 684272 - RNA, 64 nt, hsa; identical to SEQ ID NO: 40338

SEQ ID NO: 684273 - RNA, 64 nt, hsa; identical to SEQ ID NO: 40339

SEQ ID NO: 684274 - RNA, 64 nt, hsa; identical to SEQ ID NO: 40340

SEQ ID NO: 684275 - RNA, 64 nt, hsa; identical to SEQ ID NO: 40341

SEQ ID NO: 684276 - RNA, 64 nt, hsa; identical to SEQ ID NO: 40342

SEQ ID NO: 684277 - RNA, 64 nt, hsa; identical to SEQ ID NO: 40343

SEQ ID NO: 684278 - RNA, 64 nt, hsa; identical to SEQ ID NO: 40344

SEQ ID NO: 684279 - RNA, 64 nt, hsa; identical to SEQ ID NO: 40345

SEQ ID NO: 684280 - RNA, 64 nt, hsa; identical to SEQ ID NO: 40346

SEQ ID NO: 684281 - RNA, 64 nt, hsa; identical to SEQ ID NO: 40347

SEQ ID NO: 684282 - RNA, 64 nt, hsa; identical to SEQ ID NO: 40348

SEQ ID NO: 684283 - RNA, 64 nt, hsa; identical to SEQ ID NO: 40349

SEQ ID NO: 684284 - RNA, 64 nt, hsa; identical to SEQ ID NO: 40350

SEQ ID NO: 684285 - RNA, 64 nt, hsa; identical to SEQ ID NO: 40351

SEQ ID NO: 684286 - RNA, 64 nt, hsa; identical to SEQ ID NO: 40352

SEQ ID NO: 684287 - RNA, 64 nt, hsa; identical to SEQ ID NO: 40353

SEQ ID NO: 684288 - RNA, 64 nt, hsa; identical to SEQ ID NO: 40354

SEQ ID NO: 684289 - RNA, 64 nt, hsa; identical to SEQ ID NO: 40355

SEQ ID NO: 684290 - RNA, 64 nt, hsa; identical to SEQ ID NO: 40356

SEQ ID NO: 684291 - RNA, 64 nt, hsa; identical to SEQ ID NO: 40357

SEQ ID NO: 684292 - RNA, 64 nt, hsa; identical to SEQ ID NO: 40358

SEQ ID NO: 684293 - RNA, 64 nt, hsa; identical to SEQ ID NO: 40359

SEQ ID NO: 684294 - RNA, 64 nt, hsa; identical to SEQ ID NO: 40360

SEQ ID NO: 684295 - RNA, 64 nt, hsa; identical to SEQ ID NO: 40361

SEQ ID NO: 684296 - RNA, 64 nt, hsa; identical to SEQ ID NO: 40362

SEQ ID NO: 684297 - RNA, 64 nt, hsa; identical to SEQ ID NO: 40363

SEQ ID NO: 684298 - RNA, 64 nt, hsa; identical to SEQ ID NO: 40364

SEQ ID NO: 684299 - RNA, 64 nt, hsa; identical to SEQ ID NO: 40365

SEQ ID NO: 684300 - RNA, 64 nt, hsa; identical to SEQ ID NO: 40366

SEQ ID NO: 684301 - RNA, 64 nt, hsa; identical to SEQ ID NO: 40367

SEQ ID NO: 684302 - RNA, 64 nt, hsa; identical to SEQ ID NO: 40368

SEQ ID NO: 684303 - RNA, 64 nt, hsa; identical to SEQ ID NO: 40369

SEQ ID NO: 684304 - RNA, 64 nt, hsa; identical to SEQ ID NO: 40370

SEQ ID NO: 684305 - RNA, 64 nt, hsa; identical to SEQ ID NO: 40371

SEQ ID NO: 684306 - RNA, 64 nt, hsa; identical to SEQ ID NO: 40372

SEQ ID NO: 684307 - RNA, 64 nt, hsa; identical to SEQ ID NO: 40373

SEQ ID NO: 684308 - RNA, 64 nt, hsa; identical to SEQ ID NO: 40374

SEQ ID NO: 684309 - RNA, 64 nt, hsa; identical to SEQ ID NO: 40375

SEQ ID NO: 684310 - RNA, 64 nt, hsa; identical to SEQ ID NO: 40376

SEQ ID NO: 684311 - RNA, 64 nt, hsa; identical to SEQ ID NO: 40377

SEQ ID NO: 684312 - RNA, 64 nt, hsa; identical to SEQ ID NO: 40378

SEQ ID NO: 684313 - RNA, 64 nt, hsa; identical to SEQ ID NO: 40379

SEQ ID NO: 684314 - RNA, 64 nt, hsa; identical to SEQ ID NO: 40380

SEQ ID NO: 684315 - RNA, 64 nt, hsa; identical to SEQ ID NO: 40381

SEQ ID NO: 684316 - RNA, 64 nt, hsa; identical to SEQ ID NO: 40382

SEQ ID NO: 684317 - RNA, 64 nt, hsa; identical to SEQ ID NO: 40383

SEQ ID NO: 684318 - RNA, 64 nt, hsa; identical to SEQ ID NO: 40384

SEQ ID NO: 684319 - RNA, 64 nt, hsa; identical to SEQ ID NO: 40385

SEQ ID NO: 684320 - RNA, 64 nt, hsa; identical to SEQ ID NO: 40386

SEQ ID NO: 684321 - RNA, 64 nt, hsa; identical to SEQ ID NO: 40387

SEQ ID NO: 684322 - RNA, 64 nt, hsa; identical to SEQ ID NO: 40388

SEQ ID NO: 684323 - RNA, 64 nt, hsa; identical to SEQ ID NO: 40389

SEQ ID NO: 684324 - RNA, 64 nt, hsa; identical to SEQ ID NO: 40390

SEQ ID NO: 684325 - RNA, 64 nt, hsa; identical to SEQ ID NO: 40391

SEQ ID NO: 684326 - RNA, 64 nt, hsa; identical to SEQ ID NO: 40392

SEQ ID NO: 684327 - RNA, 64 nt, hsa; identical to SEQ ID NO: 40393

SEQ ID NO: 684328 - RNA, 64 nt, hsa; identical to SEQ ID NO: 40394

SEQ ID NO: 684329 - RNA, 64 nt, hsa; identical to SEQ ID NO: 40395

SEQ ID NO: 684330 - RNA, 64 nt, hsa; identical to SEQ ID NO: 40396

SEQ ID NO: 684331 - RNA, 64 nt, hsa; identical to SEQ ID NO: 40397

SEQ ID NO: 684332 - RNA, 64 nt, hsa; identical to SEQ ID NO: 40398

SEQ ID NO: 684333 - RNA, 64 nt, hsa; identical to SEQ ID NO: 40399

SEQ ID NO: 684334 - RNA, 64 nt, hsa; identical to SEQ ID NO: 40400

SEQ ID NO: 684335 - RNA, 64 nt, hsa; identical to SEQ ID NO: 40401

SEQ ID NO: 684336 - RNA, 64 nt, hsa; identical to SEQ ID NO: 40402

SEQ ID NO: 684337 - RNA, 64 nt, hsa; identical to SEQ ID NO: 40403

SEQ ID NO: 684338 - RNA, 64 nt, hsa; identical to SEQ ID NO: 40404

SEQ ID NO: 684339 - RNA, 64 nt, hsa; identical to SEQ ID NO: 40405

SEQ ID NO: 684340 - RNA, 64 nt, hsa; identical to SEQ ID NO: 40406

SEQ ID NO: 684341 - RNA, 64 nt, hsa; identical to SEQ ID NO: 40407

SEQ ID NO: 684342 - RNA, 64 nt, hsa; identical to SEQ ID NO: 40408

SEQ ID NO: 684343 - RNA, 64 nt, hsa; identical to SEQ ID NO: 40409

SEQ ID NO: 684344 - RNA, 64 nt, hsa; identical to SEQ ID NO: 40410

SEQ ID NO: 684345 - RNA, 64 nt, hsa; identical to SEQ ID NO: 40411

SEQ ID NO: 684346 - RNA, 64 nt, hsa; identical to SEQ ID NO: 40412

SEQ ID NO: 684347 - RNA, 64 nt, hsa; identical to SEQ ID NO: 40413

SEQ ID NO: 684348 - RNA, 64 nt, hsa; identical to SEQ ID NO: 40414

SEQ ID NO: 684349 - RNA, 64 nt, hsa; identical to SEQ ID NO: 40415

SEQ ID NO: 684350 - RNA, 64 nt, hsa; identical to SEQ ID NO: 40416

SEQ ID NO: 684351 - RNA, 64 nt, hsa; identical to SEQ ID NO: 40417

SEQ ID NO: 684352 - RNA, 64 nt, hsa; identical to SEQ ID NO: 40418

SEQ ID NO: 684353 - RNA, 64 nt, hsa; identical to SEQ ID NO: 40419

SEQ ID NO: 684354 - RNA, 64 nt, hsa; identical to SEQ ID NO: 40420

SEQ ID NO: 684355 - RNA, 64 nt, hsa; identical to SEQ ID NO: 40421

SEQ ID NO: 684356 - RNA, 64 nt, hsa; identical to SEQ ID NO: 40422

SEQ ID NO: 684357 - RNA, 64 nt, hsa; identical to SEQ ID NO: 40423

SEQ ID NO: 684358 - RNA, 64 nt, hsa; identical to SEQ ID NO: 40424

SEQ ID NO: 684359 - RNA, 64 nt, hsa; identical to SEQ ID NO: 40425

SEQ ID NO: 684360 - RNA, 64 nt, hsa; identical to SEQ ID NO: 40426

SEQ ID NO: 684361 - RNA, 64 nt, hsa; identical to SEQ ID NO: 40427

SEQ ID NO: 684362 - RNA, 64 nt, hsa; identical to SEQ ID NO: 40428

SEQ ID NO: 684363 - RNA, 64 nt, hsa; identical to SEQ ID NO: 40429

SEQ ID NO: 684364 - RNA, 64 nt, hsa; identical to SEQ ID NO: 40430

SEQ ID NO: 684365 - RNA, 64 nt, hsa; identical to SEQ ID NO: 40431

SEQ ID NO: 684366 - RNA, 64 nt, hsa; identical to SEQ ID NO: 40432

SEQ ID NO: 684367 - RNA, 64 nt, hsa; identical to SEQ ID NO: 40433

SEQ ID NO: 684368 - RNA, 64 nt, hsa; identical to SEQ ID NO: 40434

SEQ ID NO: 684369 - RNA, 64 nt, hsa; identical to SEQ ID NO: 40435

SEQ ID NO: 684370 - RNA, 64 nt, hsa; identical to SEQ ID NO: 40436

SEQ ID NO: 684371 - RNA, 64 nt, hsa; identical to SEQ ID NO: 40437

SEQ ID NO: 684372 - RNA, 64 nt, hsa; identical to SEQ ID NO: 40438

SEQ ID NO: 684373 - RNA, 64 nt, hsa; identical to SEQ ID NO: 40439

SEQ ID NO: 684374 - RNA, 64 nt, hsa; identical to SEQ ID NO: 40440

SEQ ID NO: 684375 - RNA, 64 nt, hsa; identical to SEQ ID NO: 40441

SEQ ID NO: 684376 - RNA, 64 nt, hsa; identical to SEQ ID NO: 40442

SEQ ID NO: 684377 - RNA, 64 nt, hsa; identical to SEQ ID NO: 40443

SEQ ID NO: 684378 - RNA, 64 nt, hsa; identical to SEQ ID NO: 40444

SEQ ID NO: 684379 - RNA, 64 nt, hsa; identical to SEQ ID NO: 40445

SEQ ID NO: 684380 - RNA, 64 nt, hsa; identical to SEQ ID NO: 40446

SEQ ID NO: 684381 - RNA, 64 nt, hsa; identical to SEQ ID NO: 40447

SEQ ID NO: 684382 - RNA, 64 nt, hsa; identical to SEQ ID NO: 40448

SEQ ID NO: 684383 - RNA, 64 nt, hsa; identical to SEQ ID NO: 40449

SEQ ID NO: 684384 - RNA, 64 nt, hsa; identical to SEQ ID NO: 40450

SEQ ID NO: 684385 - RNA, 64 nt, hsa; identical to SEQ ID NO: 40451

SEQ ID NO: 684386 - RNA, 64 nt, hsa; identical to SEQ ID NO: 40452

SEQ ID NO: 684387 - RNA, 64 nt, hsa; identical to SEQ ID NO: 40453

SEQ ID NO: 684388 - RNA, 64 nt, hsa; identical to SEQ ID NO: 40454

SEQ ID NO: 684389 - RNA, 64 nt, hsa; identical to SEQ ID NO: 40455

SEQ ID NO: 684390 - RNA, 64 nt, hsa; identical to SEQ ID NO: 40456

SEQ ID NO: 684391 - RNA, 64 nt, hsa; identical to SEQ ID NO: 40457

SEQ ID NO: 684392 - RNA, 64 nt, hsa; identical to SEQ ID NO: 40458

SEQ ID NO: 684393 - RNA, 64 nt, hsa; identical to SEQ ID NO: 40459

SEQ ID NO: 684394 - RNA, 64 nt, hsa; identical to SEQ ID NO: 40460

SEQ ID NO: 684395 - RNA, 64 nt, hsa; identical to SEQ ID NO: 40461

SEQ ID NO: 684396 - RNA, 64 nt, hsa; identical to SEQ ID NO: 40462

SEQ ID NO: 684397 - RNA, 64 nt, hsa; identical to SEQ ID NO: 40463

SEQ ID NO: 684398 - RNA, 64 nt, hsa; identical to SEQ ID NO: 40464

SEQ ID NO: 684399 - RNA, 64 nt, hsa; identical to SEQ ID NO: 40465

SEQ ID NO: 684400 - RNA, 64 nt, hsa; identical to SEQ ID NO: 40466

SEQ ID NO: 684401 - RNA, 64 nt, hsa; identical to SEQ ID NO: 40467

SEQ ID NO: 684402 - RNA, 64 nt, hsa; identical to SEQ ID NO: 40468

SEQ ID NO: 684403 - RNA, 64 nt, hsa; identical to SEQ ID NO: 40469

SEQ ID NO: 684404 - RNA, 64 nt, hsa; identical to SEQ ID NO: 40470

SEQ ID NO: 684405 - RNA, 64 nt, hsa; identical to SEQ ID NO: 40471

SEQ ID NO: 684406 - RNA, 64 nt, hsa; identical to SEQ ID NO: 40472

SEQ ID NO: 684407 - RNA, 64 nt, hsa; identical to SEQ ID NO: 40473

SEQ ID NO: 684408 - RNA, 64 nt, hsa; identical to SEQ ID NO: 40474

SEQ ID NO: 684409 - RNA, 64 nt, hsa; identical to SEQ ID NO: 40475

SEQ ID NO: 684410 - RNA, 64 nt, hsa; identical to SEQ ID NO: 40476

SEQ ID NO: 684411 - RNA, 64 nt, hsa; identical to SEQ ID NO: 40477

SEQ ID NO: 684412 - RNA, 64 nt, hsa; identical to SEQ ID NO: 40478

SEQ ID NO: 684413 - RNA, 64 nt, hsa; identical to SEQ ID NO: 40479

SEQ ID NO: 684414 - RNA, 64 nt, hsa; identical to SEQ ID NO: 40480

SEQ ID NO: 684415 - RNA, 64 nt, hsa; identical to SEQ ID NO: 40481

SEQ ID NO: 684416 - RNA, 64 nt, hsa; identical to SEQ ID NO: 40482

SEQ ID NO: 684417 - RNA, 64 nt, hsa; identical to SEQ ID NO: 40483

SEQ ID NO: 684418 - RNA, 64 nt, hsa; identical to SEQ ID NO: 40484

SEQ ID NO: 684419 - RNA, 64 nt, hsa; identical to SEQ ID NO: 40485

SEQ ID NO: 684420 - RNA, 64 nt, hsa; identical to SEQ ID NO: 40486

SEQ ID NO: 684421 - RNA, 64 nt, hsa; identical to SEQ ID NO: 40487

SEQ ID NO: 684422 - RNA, 64 nt, hsa; identical to SEQ ID NO: 40488

SEQ ID NO: 684423 - RNA, 64 nt, hsa; identical to SEQ ID NO: 40489

SEQ ID NO: 684424 - RNA, 64 nt, hsa; identical to SEQ ID NO: 40490

SEQ ID NO: 684425 - RNA, 64 nt, hsa; identical to SEQ ID NO: 40491

SEQ ID NO: 684426 - RNA, 64 nt, hsa; identical to SEQ ID NO: 40492

SEQ ID NO: 684427 - RNA, 64 nt, hsa; identical to SEQ ID NO: 40493

SEQ ID NO: 684428 - RNA, 64 nt, hsa; identical to SEQ ID NO: 40494

SEQ ID NO: 684429 - RNA, 64 nt, hsa; identical to SEQ ID NO: 40495

SEQ ID NO: 684430 - RNA, 64 nt, hsa; identical to SEQ ID NO: 40496

SEQ ID NO: 684431 - RNA, 64 nt, hsa; identical to SEQ ID NO: 40497

SEQ ID NO: 684432 - RNA, 64 nt, hsa; identical to SEQ ID NO: 40498

SEQ ID NO: 684433 - RNA, 64 nt, hsa; identical to SEQ ID NO: 40499

SEQ ID NO: 684434 - RNA, 64 nt, hsa; identical to SEQ ID NO: 40500

SEQ ID NO: 684435 - RNA, 64 nt, hsa; identical to SEQ ID NO: 40501

SEQ ID NO: 684436 - RNA, 64 nt, hsa; identical to SEQ ID NO: 40502

SEQ ID NO: 684437 - RNA, 64 nt, hsa; identical to SEQ ID NO: 40503

SEQ ID NO: 684438 - RNA, 64 nt, hsa; identical to SEQ ID NO: 40504

SEQ ID NO: 684439 - RNA, 64 nt, hsa; identical to SEQ ID NO: 40505

SEQ ID NO: 684440 - RNA, 64 nt, hsa; identical to SEQ ID NO: 40506

SEQ ID NO: 684441 - RNA, 64 nt, hsa; identical to SEQ ID NO: 40507

SEQ ID NO: 684442 - RNA, 64 nt, hsa; identical to SEQ ID NO: 40508

SEQ ID NO: 684443 - RNA, 64 nt, hsa; identical to SEQ ID NO: 40509

SEQ ID NO: 684444 - RNA, 64 nt, hsa; identical to SEQ ID NO: 40510

SEQ ID NO: 684445 - RNA, 64 nt, hsa; identical to SEQ ID NO: 40511

SEQ ID NO: 684446 - RNA, 64 nt, hsa; identical to SEQ ID NO: 40512

SEQ ID NO: 684447 - RNA, 64 nt, hsa; identical to SEQ ID NO: 40513

SEQ ID NO: 684448 - RNA, 64 nt, hsa; identical to SEQ ID NO: 40514

SEQ ID NO: 684449 - RNA, 64 nt, hsa; identical to SEQ ID NO: 40515

SEQ ID NO: 684450 - RNA, 64 nt, hsa; identical to SEQ ID NO: 40516

SEQ ID NO: 684451 - RNA, 64 nt, hsa; identical to SEQ ID NO: 40517

SEQ ID NO: 684452 - RNA, 64 nt, hsa; identical to SEQ ID NO: 40518

SEQ ID NO: 684453 - RNA, 64 nt, hsa; identical to SEQ ID NO: 40519

SEQ ID NO: 684454 - RNA, 64 nt, hsa; identical to SEQ ID NO: 40520

SEQ ID NO: 684455 - RNA, 64 nt, hsa; identical to SEQ ID NO: 40521

SEQ ID NO: 684456 - RNA, 64 nt, hsa; identical to SEQ ID NO: 40522

SEQ ID NO: 684457 - RNA, 64 nt, hsa; identical to SEQ ID NO: 40523

SEQ ID NO: 684458 - RNA, 64 nt, hsa; identical to SEQ ID NO: 40524

SEQ ID NO: 684459 - RNA, 64 nt, hsa; identical to SEQ ID NO: 40525

SEQ ID NO: 684460 - RNA, 64 nt, hsa; identical to SEQ ID NO: 40526

SEQ ID NO: 684461 - RNA, 64 nt, hsa; identical to SEQ ID NO: 40527

SEQ ID NO: 684462 - RNA, 64 nt, hsa; identical to SEQ ID NO: 40528

SEQ ID NO: 684463 - RNA, 64 nt, hsa; identical to SEQ ID NO: 40529

SEQ ID NO: 684464 - RNA, 64 nt, hsa; identical to SEQ ID NO: 40530

SEQ ID NO: 684465 - RNA, 64 nt, hsa; identical to SEQ ID NO: 40531

SEQ ID NO: 684466 - RNA, 64 nt, hsa; identical to SEQ ID NO: 40532

SEQ ID NO: 684467 - RNA, 64 nt, hsa; identical to SEQ ID NO: 40533

SEQ ID NO: 684468 - RNA, 64 nt, hsa; identical to SEQ ID NO: 40534

SEQ ID NO: 684469 - RNA, 64 nt, hsa; identical to SEQ ID NO: 40535

SEQ ID NO: 684470 - RNA, 64 nt, hsa; identical to SEQ ID NO: 40536

SEQ ID NO: 684471 - RNA, 64 nt, hsa; identical to SEQ ID NO: 40537

SEQ ID NO: 684472 - RNA, 64 nt, hsa; identical to SEQ ID NO: 40538

SEQ ID NO: 684473 - RNA, 64 nt, hsa; identical to SEQ ID NO: 40539

SEQ ID NO: 684474 - RNA, 64 nt, hsa; identical to SEQ ID NO: 40540

SEQ ID NO: 684475 - RNA, 64 nt, hsa; identical to SEQ ID NO: 40541

SEQ ID NO: 684476 - RNA, 64 nt, hsa; identical to SEQ ID NO: 40542

SEQ ID NO: 684477 - RNA, 64 nt, hsa; identical to SEQ ID NO: 40543

SEQ ID NO: 684478 - RNA, 64 nt, hsa; identical to SEQ ID NO: 40544

SEQ ID NO: 684479 - RNA, 64 nt, hsa; identical to SEQ ID NO: 40545

SEQ ID NO: 684480 - RNA, 64 nt, hsa; identical to SEQ ID NO: 40546

SEQ ID NO: 684481 - RNA, 64 nt, hsa; identical to SEQ ID NO: 40547

SEQ ID NO: 684482 - RNA, 64 nt, hsa; identical to SEQ ID NO: 40548

SEQ ID NO: 684483 - RNA, 64 nt, hsa; identical to SEQ ID NO: 40549

SEQ ID NO: 684484 - RNA, 64 nt, hsa; identical to SEQ ID NO: 40550

SEQ ID NO: 684485 - RNA, 64 nt, hsa; identical to SEQ ID NO: 40551

SEQ ID NO: 684486 - RNA, 64 nt, hsa; identical to SEQ ID NO: 40552

SEQ ID NO: 684487 - RNA, 64 nt, hsa; identical to SEQ ID NO: 40553

SEQ ID NO: 684488 - RNA, 64 nt, hsa; identical to SEQ ID NO: 40554

SEQ ID NO: 684489 - RNA, 64 nt, hsa; identical to SEQ ID NO: 40555

SEQ ID NO: 684490 - RNA, 64 nt, hsa; identical to SEQ ID NO: 40556

SEQ ID NO: 684491 - RNA, 64 nt, hsa; identical to SEQ ID NO: 40557

SEQ ID NO: 684492 - RNA, 64 nt, hsa; identical to SEQ ID NO: 40558

SEQ ID NO: 684493 - RNA, 64 nt, hsa; identical to SEQ ID NO: 40559

SEQ ID NO: 684494 - RNA, 64 nt, hsa; identical to SEQ ID NO: 40560

SEQ ID NO: 684495 - RNA, 64 nt, hsa; identical to SEQ ID NO: 40561

SEQ ID NO: 684496 - RNA, 64 nt, hsa; identical to SEQ ID NO: 40562

SEQ ID NO: 684497 - RNA, 64 nt, hsa; identical to SEQ ID NO: 40563

SEQ ID NO: 684498 - RNA, 64 nt, hsa; identical to SEQ ID NO: 40564

SEQ ID NO: 684499 - RNA, 64 nt, hsa; identical to SEQ ID NO: 40565

SEQ ID NO: 684500 - RNA, 64 nt, hsa; identical to SEQ ID NO: 40566

SEQ ID NO: 684501 - RNA, 64 nt, hsa; identical to SEQ ID NO: 40567

SEQ ID NO: 684502 - RNA, 64 nt, hsa; identical to SEQ ID NO: 40568

SEQ ID NO: 684503 - RNA, 64 nt, hsa; identical to SEQ ID NO: 40569

SEQ ID NO: 684504 - RNA, 64 nt, hsa; identical to SEQ ID NO: 40570

SEQ ID NO: 684505 - RNA, 64 nt, hsa; identical to SEQ ID NO: 40571

SEQ ID NO: 684506 - RNA, 64 nt, hsa; identical to SEQ ID NO: 40572

SEQ ID NO: 684507 - RNA, 64 nt, hsa; identical to SEQ ID NO: 40573

SEQ ID NO: 684508 - RNA, 64 nt, hsa; identical to SEQ ID NO: 40574

SEQ ID NO: 684509 - RNA, 64 nt, hsa; identical to SEQ ID NO: 40575

SEQ ID NO: 684510 - RNA, 64 nt, hsa; identical to SEQ ID NO: 40576

SEQ ID NO: 684511 - RNA, 64 nt, hsa; identical to SEQ ID NO: 40577

SEQ ID NO: 684512 - RNA, 64 nt, hsa; identical to SEQ ID NO: 40578

SEQ ID NO: 684513 - RNA, 64 nt, hsa; identical to SEQ ID NO: 40579

SEQ ID NO: 684514 - RNA, 64 nt, hsa; identical to SEQ ID NO: 40580

SEQ ID NO: 684515 - RNA, 64 nt, hsa; identical to SEQ ID NO: 40581

SEQ ID NO: 684516 - RNA, 64 nt, hsa; identical to SEQ ID NO: 40582

SEQ ID NO: 684517 - RNA, 64 nt, hsa; identical to SEQ ID NO: 40583

SEQ ID NO: 684518 - RNA, 64 nt, hsa; identical to SEQ ID NO: 40584

SEQ ID NO: 684519 - RNA, 64 nt, hsa; identical to SEQ ID NO: 40585

SEQ ID NO: 684520 - RNA, 64 nt, hsa; identical to SEQ ID NO: 40586

SEQ ID NO: 684521 - RNA, 64 nt, hsa; identical to SEQ ID NO: 40587

SEQ ID NO: 684522 - RNA, 64 nt, hsa; identical to SEQ ID NO: 40588

SEQ ID NO: 684523 - RNA, 64 nt, hsa; identical to SEQ ID NO: 40589

SEQ ID NO: 684524 - RNA, 64 nt, hsa; identical to SEQ ID NO: 40590

SEQ ID NO: 684525 - RNA, 64 nt, hsa; identical to SEQ ID NO: 40591

SEQ ID NO: 684526 - RNA, 64 nt, hsa; identical to SEQ ID NO: 40592

SEQ ID NO: 684527 - RNA, 64 nt, hsa; identical to SEQ ID NO: 40593

SEQ ID NO: 684528 - RNA, 64 nt, hsa; identical to SEQ ID NO: 40594

SEQ ID NO: 684529 - RNA, 64 nt, hsa; identical to SEQ ID NO: 40595

SEQ ID NO: 684530 - RNA, 64 nt, hsa; identical to SEQ ID NO: 40596

SEQ ID NO: 684531 - RNA, 64 nt, hsa; identical to SEQ ID NO: 40597

SEQ ID NO: 684532 - RNA, 64 nt, hsa; identical to SEQ ID NO: 40598

SEQ ID NO: 684533 - RNA, 64 nt, hsa; identical to SEQ ID NO: 40599

SEQ ID NO: 684534 - RNA, 64 nt, hsa; identical to SEQ ID NO: 40600

SEQ ID NO: 684535 - RNA, 64 nt, hsa; identical to SEQ ID NO: 40601

SEQ ID NO: 684536 - RNA, 64 nt, hsa; identical to SEQ ID NO: 40602

SEQ ID NO: 684537 - RNA, 64 nt, hsa; identical to SEQ ID NO: 40603

SEQ ID NO: 684538 - RNA, 64 nt, hsa; identical to SEQ ID NO: 40604

SEQ ID NO: 684539 - RNA, 64 nt, hsa; identical to SEQ ID NO: 40605

SEQ ID NO: 684540 - RNA, 64 nt, hsa; identical to SEQ ID NO: 40606

SEQ ID NO: 684541 - RNA, 64 nt, hsa; identical to SEQ ID NO: 40607

SEQ ID NO: 684542 - RNA, 64 nt, hsa; identical to SEQ ID NO: 40608

SEQ ID NO: 684543 - RNA, 64 nt, hsa; identical to SEQ ID NO: 40609

SEQ ID NO: 684544 - RNA, 64 nt, hsa; identical to SEQ ID NO: 40610

SEQ ID NO: 684545 - RNA, 64 nt, hsa; identical to SEQ ID NO: 40611

SEQ ID NO: 684546 - RNA, 64 nt, hsa; identical to SEQ ID NO: 40612

SEQ ID NO: 684547 - RNA, 64 nt, hsa; identical to SEQ ID NO: 40613

SEQ ID NO: 684548 - RNA, 64 nt, hsa; identical to SEQ ID NO: 40614

SEQ ID NO: 684549 - RNA, 64 nt, hsa; identical to SEQ ID NO: 40615

SEQ ID NO: 684550 - RNA, 64 nt, hsa; identical to SEQ ID NO: 40616

SEQ ID NO: 684551 - RNA, 64 nt, hsa; identical to SEQ ID NO: 40617

SEQ ID NO: 684552 - RNA, 64 nt, hsa; identical to SEQ ID NO: 40618

SEQ ID NO: 684553 - RNA, 64 nt, hsa; identical to SEQ ID NO: 40619

SEQ ID NO: 684554 - RNA, 64 nt, hsa; identical to SEQ ID NO: 40620

SEQ ID NO: 684555 - RNA, 64 nt, hsa; identical to SEQ ID NO: 40621

SEQ ID NO: 684556 - RNA, 64 nt, hsa; identical to SEQ ID NO: 40622

SEQ ID NO: 684557 - RNA, 64 nt, hsa; identical to SEQ ID NO: 40623

SEQ ID NO: 684558 - RNA, 64 nt, hsa; identical to SEQ ID NO: 40624

SEQ ID NO: 684559 - RNA, 64 nt, hsa; identical to SEQ ID NO: 40625

SEQ ID NO: 684560 - RNA, 64 nt, hsa; identical to SEQ ID NO: 40626

SEQ ID NO: 684561 - RNA, 64 nt, hsa; identical to SEQ ID NO: 40627

SEQ ID NO: 684562 - RNA, 64 nt, hsa; identical to SEQ ID NO: 40628

SEQ ID NO: 684563 - RNA, 64 nt, hsa; identical to SEQ ID NO: 40629

SEQ ID NO: 684564 - RNA, 64 nt, hsa; identical to SEQ ID NO: 40630

SEQ ID NO: 684565 - RNA, 64 nt, hsa; identical to SEQ ID NO: 40631

SEQ ID NO: 684566 - RNA, 64 nt, hsa; identical to SEQ ID NO: 40632

SEQ ID NO: 684567 - RNA, 64 nt, hsa; identical to SEQ ID NO: 40633

SEQ ID NO: 684568 - RNA, 64 nt, hsa; identical to SEQ ID NO: 40634

SEQ ID NO: 684569 - RNA, 64 nt, hsa; identical to SEQ ID NO: 40635

SEQ ID NO: 684570 - RNA, 64 nt, hsa; identical to SEQ ID NO: 40636

SEQ ID NO: 684571 - RNA, 64 nt, hsa; identical to SEQ ID NO: 40637

SEQ ID NO: 684572 - RNA, 64 nt, hsa; identical to SEQ ID NO: 40638

SEQ ID NO: 684573 - RNA, 64 nt, hsa; identical to SEQ ID NO: 40639

SEQ ID NO: 684574 - RNA, 64 nt, hsa; identical to SEQ ID NO: 40640

SEQ ID NO: 684575 - RNA, 64 nt, hsa; identical to SEQ ID NO: 40641

SEQ ID NO: 684576 - RNA, 64 nt, hsa; identical to SEQ ID NO: 40642

SEQ ID NO: 684577 - RNA, 64 nt, hsa; identical to SEQ ID NO: 40643

SEQ ID NO: 684578 - RNA, 64 nt, hsa; identical to SEQ ID NO: 40644

SEQ ID NO: 684579 - RNA, 64 nt, hsa; identical to SEQ ID NO: 40645

SEQ ID NO: 684580 - RNA, 64 nt, hsa; identical to SEQ ID NO: 40646

SEQ ID NO: 684581 - RNA, 64 nt, hsa; identical to SEQ ID NO: 40647

SEQ ID NO: 684582 - RNA, 64 nt, hsa; identical to SEQ ID NO: 40648

SEQ ID NO: 684583 - RNA, 64 nt, hsa; identical to SEQ ID NO: 40649

SEQ ID NO: 684584 - RNA, 64 nt, hsa; identical to SEQ ID NO: 40650

SEQ ID NO: 684585 - RNA, 64 nt, hsa; identical to SEQ ID NO: 40651

SEQ ID NO: 684586 - RNA, 64 nt, hsa; identical to SEQ ID NO: 40652

SEQ ID NO: 684587 - RNA, 64 nt, hsa; identical to SEQ ID NO: 40653

SEQ ID NO: 684588 - RNA, 64 nt, hsa; identical to SEQ ID NO: 40654

SEQ ID NO: 684589 - RNA, 64 nt, hsa; identical to SEQ ID NO: 40655

SEQ ID NO: 684590 - RNA, 64 nt, hsa; identical to SEQ ID NO: 40656

SEQ ID NO: 684591 - RNA, 64 nt, hsa; identical to SEQ ID NO: 40657

SEQ ID NO: 684592 - RNA, 64 nt, hsa; identical to SEQ ID NO: 40658

SEQ ID NO: 684593 - RNA, 64 nt, hsa; identical to SEQ ID NO: 40659

SEQ ID NO: 684594 - RNA, 64 nt, hsa; identical to SEQ ID NO: 40660

SEQ ID NO: 684595 - RNA, 64 nt, hsa; identical to SEQ ID NO: 40661

SEQ ID NO: 684596 - RNA, 64 nt, hsa; identical to SEQ ID NO: 40662

SEQ ID NO: 684597 - RNA, 64 nt, hsa; identical to SEQ ID NO: 40663

SEQ ID NO: 684598 - RNA, 64 nt, hsa; identical to SEQ ID NO: 40664

SEQ ID NO: 684599 - RNA, 64 nt, hsa; identical to SEQ ID NO: 40665

SEQ ID NO: 684600 - RNA, 64 nt, hsa; identical to SEQ ID NO: 40666

SEQ ID NO: 684601 - RNA, 64 nt, hsa; identical to SEQ ID NO: 40667

SEQ ID NO: 684602 - RNA, 64 nt, hsa; identical to SEQ ID NO: 40668

SEQ ID NO: 684603 - RNA, 64 nt, hsa; identical to SEQ ID NO: 40669

SEQ ID NO: 684604 - RNA, 64 nt, hsa; identical to SEQ ID NO: 40670

SEQ ID NO: 684605 - RNA, 64 nt, hsa; identical to SEQ ID NO: 40671

SEQ ID NO: 684606 - RNA, 64 nt, hsa; identical to SEQ ID NO: 40672

SEQ ID NO: 684607 - RNA, 64 nt, hsa; identical to SEQ ID NO: 40673

SEQ ID NO: 684608 - RNA, 64 nt, hsa; identical to SEQ ID NO: 40674

SEQ ID NO: 684609 - RNA, 64 nt, hsa; identical to SEQ ID NO: 40675

SEQ ID NO: 684610 - RNA, 64 nt, hsa; identical to SEQ ID NO: 40676

SEQ ID NO: 684611 - RNA, 64 nt, hsa; identical to SEQ ID NO: 40677

SEQ ID NO: 684612 - RNA, 64 nt, hsa; identical to SEQ ID NO: 40678

SEQ ID NO: 684613 - RNA, 64 nt, hsa; identical to SEQ ID NO: 40679

SEQ ID NO: 684614 - RNA, 64 nt, hsa; identical to SEQ ID NO: 40680

SEQ ID NO: 684615 - RNA, 64 nt, hsa; identical to SEQ ID NO: 40681

SEQ ID NO: 684616 - RNA, 64 nt, hsa; identical to SEQ ID NO: 40682

SEQ ID NO: 684617 - RNA, 64 nt, hsa; identical to SEQ ID NO: 40683

SEQ ID NO: 684618 - RNA, 64 nt, hsa; identical to SEQ ID NO: 40684

SEQ ID NO: 684619 - RNA, 64 nt, hsa; identical to SEQ ID NO: 40685

SEQ ID NO: 684620 - RNA, 64 nt, hsa; identical to SEQ ID NO: 40686

SEQ ID NO: 684621 - RNA, 64 nt, hsa; identical to SEQ ID NO: 40687

SEQ ID NO: 684622 - RNA, 64 nt, hsa; identical to SEQ ID NO: 40688

SEQ ID NO: 684623 - RNA, 64 nt, hsa; identical to SEQ ID NO: 40689

SEQ ID NO: 684624 - RNA, 64 nt, hsa; identical to SEQ ID NO: 40690

SEQ ID NO: 684625 - RNA, 64 nt, hsa; identical to SEQ ID NO: 40691

SEQ ID NO: 684626 - RNA, 64 nt, hsa; identical to SEQ ID NO: 40692

SEQ ID NO: 684627 - RNA, 64 nt, hsa; identical to SEQ ID NO: 40693

SEQ ID NO: 684628 - RNA, 64 nt, hsa; identical to SEQ ID NO: 40694

SEQ ID NO: 684629 - RNA, 64 nt, hsa; identical to SEQ ID NO: 40695

SEQ ID NO: 684630 - RNA, 64 nt, hsa; identical to SEQ ID NO: 40696

SEQ ID NO: 684631 - RNA, 64 nt, hsa; identical to SEQ ID NO: 40697

SEQ ID NO: 684632 - RNA, 64 nt, hsa; identical to SEQ ID NO: 40698

SEQ ID NO: 684633 - RNA, 64 nt, hsa; identical to SEQ ID NO: 40699

SEQ ID NO: 684634 - RNA, 64 nt, hsa; identical to SEQ ID NO: 40700

SEQ ID NO: 684635 - RNA, 64 nt, hsa; identical to SEQ ID NO: 40701

SEQ ID NO: 684636 - RNA, 64 nt, hsa; identical to SEQ ID NO: 40702

SEQ ID NO: 684637 - RNA, 64 nt, hsa; identical to SEQ ID NO: 40703

SEQ ID NO: 684638 - RNA, 64 nt, hsa; identical to SEQ ID NO: 40704

SEQ ID NO: 684639 - RNA, 64 nt, hsa; identical to SEQ ID NO: 40705

SEQ ID NO: 684640 - RNA, 64 nt, hsa; identical to SEQ ID NO: 40706

SEQ ID NO: 684641 - RNA, 64 nt, hsa; identical to SEQ ID NO: 40707

SEQ ID NO: 684642 - RNA, 64 nt, hsa; identical to SEQ ID NO: 40708

SEQ ID NO: 684643 - RNA, 64 nt, hsa; identical to SEQ ID NO: 40709

SEQ ID NO: 684644 - RNA, 64 nt, hsa; identical to SEQ ID NO: 40710

SEQ ID NO: 684645 - RNA, 64 nt, hsa; identical to SEQ ID NO: 40711

SEQ ID NO: 684646 - RNA, 64 nt, hsa; identical to SEQ ID NO: 40712

SEQ ID NO: 684647 - RNA, 64 nt, hsa; identical to SEQ ID NO: 40713

SEQ ID NO: 684648 - RNA, 64 nt, hsa; identical to SEQ ID NO: 40714

SEQ ID NO: 684649 - RNA, 64 nt, hsa; identical to SEQ ID NO: 40715

SEQ ID NO: 684650 - RNA, 64 nt, hsa; identical to SEQ ID NO: 40716

SEQ ID NO: 684651 - RNA, 64 nt, hsa; identical to SEQ ID NO: 40717

SEQ ID NO: 684652 - RNA, 64 nt, hsa; identical to SEQ ID NO: 40718

SEQ ID NO: 684653 - RNA, 64 nt, hsa; identical to SEQ ID NO: 40719

SEQ ID NO: 684654 - RNA, 64 nt, hsa; identical to SEQ ID NO: 40720

SEQ ID NO: 684655 - RNA, 64 nt, hsa; identical to SEQ ID NO: 40721

SEQ ID NO: 684656 - RNA, 64 nt, hsa; identical to SEQ ID NO: 40722

SEQ ID NO: 684657 - RNA, 64 nt, hsa; identical to SEQ ID NO: 40723

SEQ ID NO: 684658 - RNA, 64 nt, hsa; identical to SEQ ID NO: 40724

SEQ ID NO: 684659 - RNA, 64 nt, hsa; identical to SEQ ID NO: 40725

SEQ ID NO: 684660 - RNA, 64 nt, hsa; identical to SEQ ID NO: 40726

SEQ ID NO: 684661 - RNA, 64 nt, hsa; identical to SEQ ID NO: 40727

SEQ ID NO: 684662 - RNA, 64 nt, hsa; identical to SEQ ID NO: 40728

SEQ ID NO: 684663 - RNA, 64 nt, hsa; identical to SEQ ID NO: 40729

SEQ ID NO: 684664 - RNA, 64 nt, hsa; identical to SEQ ID NO: 40730

SEQ ID NO: 684665 - RNA, 64 nt, hsa; identical to SEQ ID NO: 40731

SEQ ID NO: 684666 - RNA, 64 nt, hsa; identical to SEQ ID NO: 40732

SEQ ID NO: 684667 - RNA, 64 nt, hsa; identical to SEQ ID NO: 40733

SEQ ID NO: 684668 - RNA, 64 nt, hsa; identical to SEQ ID NO: 40734

SEQ ID NO: 684669 - RNA, 64 nt, hsa; identical to SEQ ID NO: 40735

SEQ ID NO: 684670 - RNA, 64 nt, hsa; identical to SEQ ID NO: 40736

SEQ ID NO: 684671 - RNA, 64 nt, hsa; identical to SEQ ID NO: 40737

SEQ ID NO: 684672 - RNA, 64 nt, hsa; identical to SEQ ID NO: 40738

SEQ ID NO: 684673 - RNA, 64 nt, hsa; identical to SEQ ID NO: 40739

SEQ ID NO: 684674 - RNA, 64 nt, hsa; identical to SEQ ID NO: 40740

SEQ ID NO: 684675 - RNA, 64 nt, hsa; identical to SEQ ID NO: 40741

SEQ ID NO: 684676 - RNA, 64 nt, hsa; identical to SEQ ID NO: 40742

SEQ ID NO: 684677 - RNA, 64 nt, hsa; identical to SEQ ID NO: 40743

SEQ ID NO: 684678 - RNA, 64 nt, hsa; identical to SEQ ID NO: 40744

SEQ ID NO: 684679 - RNA, 64 nt, hsa; identical to SEQ ID NO: 40745

SEQ ID NO: 684680 - RNA, 64 nt, hsa; identical to SEQ ID NO: 40746

SEQ ID NO: 684681 - RNA, 64 nt, hsa; identical to SEQ ID NO: 40747

SEQ ID NO: 684682 - RNA, 64 nt, hsa; identical to SEQ ID NO: 40748

SEQ ID NO: 684683 - RNA, 64 nt, hsa; identical to SEQ ID NO: 40749

SEQ ID NO: 684684 - RNA, 64 nt, hsa; identical to SEQ ID NO: 40750

SEQ ID NO: 684685 - RNA, 64 nt, hsa; identical to SEQ ID NO: 40751

SEQ ID NO: 684686 - RNA, 64 nt, hsa; identical to SEQ ID NO: 40752

SEQ ID NO: 684687 - RNA, 64 nt, hsa; identical to SEQ ID NO: 40753

SEQ ID NO: 684688 - RNA, 64 nt, hsa; identical to SEQ ID NO: 40754

SEQ ID NO: 684689 - RNA, 64 nt, hsa; identical to SEQ ID NO: 40755

SEQ ID NO: 684690 - RNA, 64 nt, hsa; identical to SEQ ID NO: 40756

SEQ ID NO: 684691 - RNA, 64 nt, hsa; identical to SEQ ID NO: 40757

SEQ ID NO: 684692 - RNA, 64 nt, hsa; identical to SEQ ID NO: 40758

SEQ ID NO: 684693 - RNA, 64 nt, hsa; identical to SEQ ID NO: 40759

SEQ ID NO: 684694 - RNA, 64 nt, hsa; identical to SEQ ID NO: 40760

SEQ ID NO: 684695 - RNA, 64 nt, hsa; identical to SEQ ID NO: 40761

SEQ ID NO: 684696 - RNA, 64 nt, hsa; identical to SEQ ID NO: 40762

SEQ ID NO: 684697 - RNA, 64 nt, hsa; identical to SEQ ID NO: 40763

SEQ ID NO: 684698 - RNA, 64 nt, hsa; identical to SEQ ID NO: 40764

SEQ ID NO: 684699 - RNA, 64 nt, hsa; identical to SEQ ID NO: 40765

SEQ ID NO: 684700 - RNA, 64 nt, hsa; identical to SEQ ID NO: 40766

SEQ ID NO: 684701 - RNA, 64 nt, hsa; identical to SEQ ID NO: 40767

SEQ ID NO: 684702 - RNA, 64 nt, hsa; identical to SEQ ID NO: 40768

SEQ ID NO: 684703 - RNA, 64 nt, hsa; identical to SEQ ID NO: 40769

SEQ ID NO: 684704 - RNA, 64 nt, hsa; identical to SEQ ID NO: 40770

SEQ ID NO: 684705 - RNA, 64 nt, hsa; identical to SEQ ID NO: 40771

SEQ ID NO: 684706 - RNA, 64 nt, hsa; identical to SEQ ID NO: 40772

SEQ ID NO: 684707 - RNA, 64 nt, hsa; identical to SEQ ID NO: 40773

SEQ ID NO: 684708 - RNA, 64 nt, hsa; identical to SEQ ID NO: 40774

SEQ ID NO: 684709 - RNA, 64 nt, hsa; identical to SEQ ID NO: 40775

SEQ ID NO: 684710 - RNA, 64 nt, hsa; identical to SEQ ID NO: 40776

SEQ ID NO: 684711 - RNA, 64 nt, hsa; identical to SEQ ID NO: 40777

SEQ ID NO: 684712 - RNA, 64 nt, hsa; identical to SEQ ID NO: 40778

SEQ ID NO: 684713 - RNA, 64 nt, hsa; identical to SEQ ID NO: 40779

SEQ ID NO: 684714 - RNA, 64 nt, hsa; identical to SEQ ID NO: 40780

SEQ ID NO: 684715 - RNA, 64 nt, hsa; identical to SEQ ID NO: 40781

SEQ ID NO: 684716 - RNA, 64 nt, hsa; identical to SEQ ID NO: 40782

SEQ ID NO: 684717 - RNA, 64 nt, hsa; identical to SEQ ID NO: 40783

SEQ ID NO: 684718 - RNA, 64 nt, hsa; identical to SEQ ID NO: 40784

SEQ ID NO: 684719 - RNA, 64 nt, hsa; identical to SEQ ID NO: 40785

SEQ ID NO: 684720 - RNA, 64 nt, hsa; identical to SEQ ID NO: 40786

SEQ ID NO: 684721 - RNA, 64 nt, hsa; identical to SEQ ID NO: 40787

SEQ ID NO: 684722 - RNA, 64 nt, hsa; identical to SEQ ID NO: 40788

SEQ ID NO: 684723 - RNA, 64 nt, hsa; identical to SEQ ID NO: 40789

SEQ ID NO: 684724 - RNA, 64 nt, hsa; identical to SEQ ID NO: 40790

SEQ ID NO: 684725 - RNA, 64 nt, hsa; identical to SEQ ID NO: 40791

SEQ ID NO: 684726 - RNA, 64 nt, hsa; identical to SEQ ID NO: 40792

SEQ ID NO: 684727 - RNA, 64 nt, hsa; identical to SEQ ID NO: 40793

SEQ ID NO: 684728 - RNA, 64 nt, hsa; identical to SEQ ID NO: 40794

SEQ ID NO: 684729 - RNA, 64 nt, hsa; identical to SEQ ID NO: 40795

SEQ ID NO: 684730 - RNA, 64 nt, hsa; identical to SEQ ID NO: 40796

SEQ ID NO: 684731 - RNA, 64 nt, hsa; identical to SEQ ID NO: 40797

SEQ ID NO: 684732 - RNA, 64 nt, hsa; identical to SEQ ID NO: 40798

SEQ ID NO: 684733 - RNA, 64 nt, hsa; identical to SEQ ID NO: 40799

SEQ ID NO: 684734 - RNA, 64 nt, hsa; identical to SEQ ID NO: 40800

SEQ ID NO: 684735 - RNA, 64 nt, hsa; identical to SEQ ID NO: 40801

SEQ ID NO: 684736 - RNA, 64 nt, hsa; identical to SEQ ID NO: 40802

SEQ ID NO: 684737 - RNA, 64 nt, hsa; identical to SEQ ID NO: 40803

SEQ ID NO: 684738 - RNA, 64 nt, hsa; identical to SEQ ID NO: 40804

SEQ ID NO: 684739 - RNA, 64 nt, hsa; identical to SEQ ID NO: 40805

SEQ ID NO: 684740 - RNA, 64 nt, hsa; identical to SEQ ID NO: 40806

SEQ ID NO: 684741 - RNA, 64 nt, hsa; identical to SEQ ID NO: 40807

SEQ ID NO: 684742 - RNA, 64 nt, hsa; identical to SEQ ID NO: 40808

SEQ ID NO: 684743 - RNA, 64 nt, hsa; identical to SEQ ID NO: 40809

SEQ ID NO: 684744 - RNA, 64 nt, hsa; identical to SEQ ID NO: 40810

SEQ ID NO: 684745 - RNA, 64 nt, hsa; identical to SEQ ID NO: 40811

SEQ ID NO: 684746 - RNA, 64 nt, hsa; identical to SEQ ID NO: 40812

SEQ ID NO: 684747 - RNA, 64 nt, hsa; identical to SEQ ID NO: 40813

SEQ ID NO: 684748 - RNA, 64 nt, hsa; identical to SEQ ID NO: 40814

SEQ ID NO: 684749 - RNA, 64 nt, hsa; identical to SEQ ID NO: 40815

SEQ ID NO: 684750 - RNA, 64 nt, hsa; identical to SEQ ID NO: 40816

SEQ ID NO: 684751 - RNA, 64 nt, hsa; identical to SEQ ID NO: 40817

SEQ ID NO: 684752 - RNA, 64 nt, hsa; identical to SEQ ID NO: 40818

SEQ ID NO: 684753 - RNA, 64 nt, hsa; identical to SEQ ID NO: 40819

SEQ ID NO: 684754 - RNA, 64 nt, hsa; identical to SEQ ID NO: 40820

SEQ ID NO: 684755 - RNA, 64 nt, hsa; identical to SEQ ID NO: 40821

SEQ ID NO: 684756 - RNA, 64 nt, hsa; identical to SEQ ID NO: 40822

SEQ ID NO: 684757 - RNA, 64 nt, hsa; identical to SEQ ID NO: 40823

SEQ ID NO: 684758 - RNA, 64 nt, hsa; identical to SEQ ID NO: 40824

SEQ ID NO: 684759 - RNA, 64 nt, hsa; identical to SEQ ID NO: 40825

SEQ ID NO: 684760 - RNA, 64 nt, hsa; identical to SEQ ID NO: 40826

SEQ ID NO: 684761 - RNA, 64 nt, hsa; identical to SEQ ID NO: 40827

SEQ ID NO: 684762 - RNA, 64 nt, hsa; identical to SEQ ID NO: 40828

SEQ ID NO: 684763 - RNA, 64 nt, hsa; identical to SEQ ID NO: 40829

SEQ ID NO: 684764 - RNA, 64 nt, hsa; identical to SEQ ID NO: 40830

SEQ ID NO: 684765 - RNA, 64 nt, hsa; identical to SEQ ID NO: 40831

SEQ ID NO: 684766 - RNA, 64 nt, hsa; identical to SEQ ID NO: 40832

SEQ ID NO: 684767 - RNA, 64 nt, hsa; identical to SEQ ID NO: 40833

SEQ ID NO: 684768 - RNA, 64 nt, hsa; identical to SEQ ID NO: 40834

SEQ ID NO: 684769 - RNA, 64 nt, hsa; identical to SEQ ID NO: 40835

SEQ ID NO: 684770 - RNA, 64 nt, hsa; identical to SEQ ID NO: 40836

SEQ ID NO: 684771 - RNA, 64 nt, hsa; identical to SEQ ID NO: 40837

SEQ ID NO: 684772 - RNA, 64 nt, hsa; identical to SEQ ID NO: 40838

SEQ ID NO: 684773 - RNA, 64 nt, hsa; identical to SEQ ID NO: 40839

SEQ ID NO: 684774 - RNA, 64 nt, hsa; identical to SEQ ID NO: 40840

SEQ ID NO: 684775 - RNA, 64 nt, hsa; identical to SEQ ID NO: 40841

SEQ ID NO: 684776 - RNA, 64 nt, hsa; identical to SEQ ID NO: 40842

SEQ ID NO: 684777 - RNA, 64 nt, hsa; identical to SEQ ID NO: 40843

SEQ ID NO: 684778 - RNA, 64 nt, hsa; identical to SEQ ID NO: 40844

SEQ ID NO: 684779 - RNA, 64 nt, hsa; identical to SEQ ID NO: 40845

SEQ ID NO: 684780 - RNA, 64 nt, hsa; identical to SEQ ID NO: 40846

SEQ ID NO: 684781 - RNA, 64 nt, hsa; identical to SEQ ID NO: 40847

SEQ ID NO: 684782 - RNA, 64 nt, hsa; identical to SEQ ID NO: 40848

SEQ ID NO: 684783 - RNA, 64 nt, hsa; identical to SEQ ID NO: 40849

SEQ ID NO: 684784 - RNA, 64 nt, hsa; identical to SEQ ID NO: 40850

SEQ ID NO: 684785 - RNA, 64 nt, hsa; identical to SEQ ID NO: 40851

SEQ ID NO: 684786 - RNA, 64 nt, hsa; identical to SEQ ID NO: 40852

SEQ ID NO: 684787 - RNA, 64 nt, hsa; identical to SEQ ID NO: 40853

SEQ ID NO: 684788 - RNA, 64 nt, hsa; identical to SEQ ID NO: 40854

SEQ ID NO: 684789 - RNA, 64 nt, hsa; identical to SEQ ID NO: 40855

SEQ ID NO: 684790 - RNA, 64 nt, hsa; identical to SEQ ID NO: 40856

SEQ ID NO: 684791 - RNA, 64 nt, hsa; identical to SEQ ID NO: 40857

SEQ ID NO: 684792 - RNA, 64 nt, hsa; identical to SEQ ID NO: 40858

SEQ ID NO: 684793 - RNA, 64 nt, hsa; identical to SEQ ID NO: 40859

SEQ ID NO: 684794 - RNA, 64 nt, hsa; identical to SEQ ID NO: 40860

SEQ ID NO: 684795 - RNA, 64 nt, hsa; identical to SEQ ID NO: 40861

SEQ ID NO: 684796 - RNA, 64 nt, hsa; identical to SEQ ID NO: 40862

SEQ ID NO: 684797 - RNA, 64 nt, hsa; identical to SEQ ID NO: 40863

SEQ ID NO: 684798 - RNA, 64 nt, hsa; identical to SEQ ID NO: 40864

SEQ ID NO: 684799 - RNA, 64 nt, hsa; identical to SEQ ID NO: 40865

SEQ ID NO: 684800 - RNA, 64 nt, hsa; identical to SEQ ID NO: 40866

SEQ ID NO: 684801 - RNA, 64 nt, hsa; identical to SEQ ID NO: 40867

SEQ ID NO: 684802 - RNA, 64 nt, hsa; identical to SEQ ID NO: 40868

SEQ ID NO: 684803 - RNA, 64 nt, hsa; identical to SEQ ID NO: 40869

SEQ ID NO: 684804 - RNA, 64 nt, hsa; identical to SEQ ID NO: 40870

SEQ ID NO: 684805 - RNA, 64 nt, hsa; identical to SEQ ID NO: 40871

SEQ ID NO: 684806 - RNA, 64 nt, hsa; identical to SEQ ID NO: 40872

SEQ ID NO: 684807 - RNA, 64 nt, hsa; identical to SEQ ID NO: 40873

SEQ ID NO: 684808 - RNA, 64 nt, hsa; identical to SEQ ID NO: 40874

SEQ ID NO: 684809 - RNA, 64 nt, hsa; identical to SEQ ID NO: 40875

SEQ ID NO: 684810 - RNA, 64 nt, hsa; identical to SEQ ID NO: 40876

SEQ ID NO: 684811 - RNA, 64 nt, hsa; identical to SEQ ID NO: 40877

SEQ ID NO: 684812 - RNA, 64 nt, hsa; identical to SEQ ID NO: 40878

SEQ ID NO: 684813 - RNA, 64 nt, hsa; identical to SEQ ID NO: 40879

SEQ ID NO: 684814 - RNA, 64 nt, hsa; identical to SEQ ID NO: 40880

SEQ ID NO: 684815 - RNA, 64 nt, hsa; identical to SEQ ID NO: 40881

SEQ ID NO: 684816 - RNA, 64 nt, hsa; identical to SEQ ID NO: 40882

SEQ ID NO: 684817 - RNA, 64 nt, hsa; identical to SEQ ID NO: 40883

SEQ ID NO: 684818 - RNA, 64 nt, hsa; identical to SEQ ID NO: 40884

SEQ ID NO: 684819 - RNA, 64 nt, hsa; identical to SEQ ID NO: 40885

SEQ ID NO: 684820 - RNA, 64 nt, hsa; identical to SEQ ID NO: 40886

SEQ ID NO: 684821 - RNA, 64 nt, hsa; identical to SEQ ID NO: 40887

SEQ ID NO: 684822 - RNA, 64 nt, hsa; identical to SEQ ID NO: 40888

SEQ ID NO: 684823 - RNA, 64 nt, hsa; identical to SEQ ID NO: 40889

SEQ ID NO: 684824 - RNA, 64 nt, hsa; identical to SEQ ID NO: 40890

SEQ ID NO: 684825 - RNA, 64 nt, hsa; identical to SEQ ID NO: 40891

SEQ ID NO: 684826 - RNA, 64 nt, hsa; identical to SEQ ID NO: 40892

SEQ ID NO: 684827 - RNA, 64 nt, hsa; identical to SEQ ID NO: 40893

SEQ ID NO: 684828 - RNA, 64 nt, hsa; identical to SEQ ID NO: 40894

SEQ ID NO: 684829 - RNA, 64 nt, hsa; identical to SEQ ID NO: 40895

SEQ ID NO: 684830 - RNA, 64 nt, hsa; identical to SEQ ID NO: 40896

SEQ ID NO: 684831 - RNA, 64 nt, hsa; identical to SEQ ID NO: 40897

SEQ ID NO: 684832 - RNA, 64 nt, hsa; identical to SEQ ID NO: 40898

SEQ ID NO: 684833 - RNA, 64 nt, hsa; identical to SEQ ID NO: 40899

SEQ ID NO: 684834 - RNA, 64 nt, hsa; identical to SEQ ID NO: 40900

SEQ ID NO: 684835 - RNA, 64 nt, hsa; identical to SEQ ID NO: 40901

SEQ ID NO: 684836 - RNA, 64 nt, hsa; identical to SEQ ID NO: 40902

SEQ ID NO: 684837 - RNA, 64 nt, hsa; identical to SEQ ID NO: 40903

SEQ ID NO: 684838 - RNA, 64 nt, hsa; identical to SEQ ID NO: 40904

SEQ ID NO: 684839 - RNA, 64 nt, hsa; identical to SEQ ID NO: 40905

SEQ ID NO: 684840 - RNA, 64 nt, hsa; identical to SEQ ID NO: 40906

SEQ ID NO: 684841 - RNA, 64 nt, hsa; identical to SEQ ID NO: 40907

SEQ ID NO: 684842 - RNA, 64 nt, hsa; identical to SEQ ID NO: 40908

SEQ ID NO: 684843 - RNA, 64 nt, hsa; identical to SEQ ID NO: 40909

SEQ ID NO: 684844 - RNA, 64 nt, hsa; identical to SEQ ID NO: 40910

SEQ ID NO: 684845 - RNA, 64 nt, hsa; identical to SEQ ID NO: 40911

SEQ ID NO: 684846 - RNA, 64 nt, hsa; identical to SEQ ID NO: 40912

SEQ ID NO: 684847 - RNA, 64 nt, hsa; identical to SEQ ID NO: 40913

SEQ ID NO: 684848 - RNA, 64 nt, hsa; identical to SEQ ID NO: 40914

SEQ ID NO: 684849 - RNA, 64 nt, hsa; identical to SEQ ID NO: 40915

SEQ ID NO: 684850 - RNA, 64 nt, hsa; identical to SEQ ID NO: 40916

SEQ ID NO: 684851 - RNA, 64 nt, hsa; identical to SEQ ID NO: 40917

SEQ ID NO: 684852 - RNA, 64 nt, hsa; identical to SEQ ID NO: 40918

SEQ ID NO: 684853 - RNA, 64 nt, hsa; identical to SEQ ID NO: 40919

SEQ ID NO: 684854 - RNA, 64 nt, hsa; identical to SEQ ID NO: 40920

SEQ ID NO: 684855 - RNA, 64 nt, hsa; identical to SEQ ID NO: 40921

SEQ ID NO: 684856 - RNA, 64 nt, hsa; identical to SEQ ID NO: 40922

SEQ ID NO: 684857 - RNA, 64 nt, hsa; identical to SEQ ID NO: 40923

SEQ ID NO: 684858 - RNA, 64 nt, hsa; identical to SEQ ID NO: 40924

SEQ ID NO: 684859 - RNA, 64 nt, hsa; identical to SEQ ID NO: 40925

SEQ ID NO: 684860 - RNA, 64 nt, hsa; identical to SEQ ID NO: 40926

SEQ ID NO: 684861 - RNA, 64 nt, hsa; identical to SEQ ID NO: 40927

SEQ ID NO: 684862 - RNA, 64 nt, hsa; identical to SEQ ID NO: 40928

SEQ ID NO: 684863 - RNA, 64 nt, hsa; identical to SEQ ID NO: 40929

SEQ ID NO: 684864 - RNA, 64 nt, hsa; identical to SEQ ID NO: 40930

SEQ ID NO: 684865 - RNA, 64 nt, hsa; identical to SEQ ID NO: 40931

SEQ ID NO: 684866 - RNA, 64 nt, hsa; identical to SEQ ID NO: 40932

SEQ ID NO: 684867 - RNA, 64 nt, hsa; identical to SEQ ID NO: 40933

SEQ ID NO: 684868 - RNA, 64 nt, hsa; identical to SEQ ID NO: 40934

SEQ ID NO: 684869 - RNA, 64 nt, hsa; identical to SEQ ID NO: 40935

SEQ ID NO: 684870 - RNA, 64 nt, hsa; identical to SEQ ID NO: 40936

SEQ ID NO: 684871 - RNA, 64 nt, hsa; identical to SEQ ID NO: 40937

SEQ ID NO: 684872 - RNA, 64 nt, hsa; identical to SEQ ID NO: 40938

SEQ ID NO: 684873 - RNA, 64 nt, hsa; identical to SEQ ID NO: 40939

SEQ ID NO: 684874 - RNA, 64 nt, hsa; identical to SEQ ID NO: 40940

SEQ ID NO: 684875 - RNA, 64 nt, hsa; identical to SEQ ID NO: 40941

SEQ ID NO: 684876 - RNA, 64 nt, hsa; identical to SEQ ID NO: 40942

SEQ ID NO: 684877 - RNA, 64 nt, hsa; identical to SEQ ID NO: 40943

SEQ ID NO: 684878 - RNA, 64 nt, hsa; identical to SEQ ID NO: 40944

SEQ ID NO: 684879 - RNA, 64 nt, hsa; identical to SEQ ID NO: 40945

SEQ ID NO: 684880 - RNA, 64 nt, hsa; identical to SEQ ID NO: 40946

SEQ ID NO: 684881 - RNA, 64 nt, hsa; identical to SEQ ID NO: 40947

SEQ ID NO: 684882 - RNA, 64 nt, hsa; identical to SEQ ID NO: 40948

SEQ ID NO: 684883 - RNA, 64 nt, hsa; identical to SEQ ID NO: 40949

SEQ ID NO: 684884 - RNA, 64 nt, hsa; identical to SEQ ID NO: 40950

SEQ ID NO: 684885 - RNA, 64 nt, hsa; identical to SEQ ID NO: 40951

SEQ ID NO: 684886 - RNA, 64 nt, hsa; identical to SEQ ID NO: 40952

SEQ ID NO: 684887 - RNA, 64 nt, hsa; identical to SEQ ID NO: 40953

SEQ ID NO: 684888 - RNA, 64 nt, hsa; identical to SEQ ID NO: 40954

SEQ ID NO: 684889 - RNA, 64 nt, hsa; identical to SEQ ID NO: 40955

SEQ ID NO: 684890 - RNA, 64 nt, hsa; identical to SEQ ID NO: 40956

SEQ ID NO: 684891 - RNA, 64 nt, hsa; identical to SEQ ID NO: 40957

SEQ ID NO: 684892 - RNA, 64 nt, hsa; identical to SEQ ID NO: 40958

SEQ ID NO: 684893 - RNA, 64 nt, hsa; identical to SEQ ID NO: 40959

SEQ ID NO: 684894 - RNA, 64 nt, hsa; identical to SEQ ID NO: 40960

SEQ ID NO: 684895 - RNA, 64 nt, hsa; identical to SEQ ID NO: 40961

SEQ ID NO: 684896 - RNA, 64 nt, hsa; identical to SEQ ID NO: 40962

SEQ ID NO: 684897 - RNA, 64 nt, hsa; identical to SEQ ID NO: 40963

SEQ ID NO: 684898 - RNA, 64 nt, hsa; identical to SEQ ID NO: 40964

SEQ ID NO: 684899 - RNA, 64 nt, hsa; identical to SEQ ID NO: 40965

SEQ ID NO: 684900 - RNA, 64 nt, hsa; identical to SEQ ID NO: 40966

SEQ ID NO: 684901 - RNA, 64 nt, hsa; identical to SEQ ID NO: 40967

SEQ ID NO: 684902 - RNA, 64 nt, hsa; identical to SEQ ID NO: 40968

SEQ ID NO: 684903 - RNA, 64 nt, hsa; identical to SEQ ID NO: 40969

SEQ ID NO: 684904 - RNA, 64 nt, hsa; identical to SEQ ID NO: 40970

SEQ ID NO: 684905 - RNA, 64 nt, hsa; identical to SEQ ID NO: 40971

SEQ ID NO: 684906 - RNA, 64 nt, hsa; identical to SEQ ID NO: 40972

SEQ ID NO: 684907 - RNA, 64 nt, hsa; identical to SEQ ID NO: 40973

SEQ ID NO: 684908 - RNA, 64 nt, hsa; identical to SEQ ID NO: 40974

SEQ ID NO: 684909 - RNA, 64 nt, hsa; identical to SEQ ID NO: 40975

SEQ ID NO: 684910 - RNA, 64 nt, hsa; identical to SEQ ID NO: 40976

SEQ ID NO: 684911 - RNA, 64 nt, hsa; identical to SEQ ID NO: 40977

SEQ ID NO: 684912 - RNA, 64 nt, hsa; identical to SEQ ID NO: 40978

SEQ ID NO: 684913 - RNA, 64 nt, hsa; identical to SEQ ID NO: 40979

SEQ ID NO: 684914 - RNA, 64 nt, hsa; identical to SEQ ID NO: 40980

SEQ ID NO: 684915 - RNA, 64 nt, hsa; identical to SEQ ID NO: 40981

SEQ ID NO: 684916 - RNA, 64 nt, hsa; identical to SEQ ID NO: 40982

SEQ ID NO: 684917 - RNA, 64 nt, hsa; identical to SEQ ID NO: 40983

SEQ ID NO: 684918 - RNA, 64 nt, hsa; identical to SEQ ID NO: 40984

SEQ ID NO: 684919 - RNA, 64 nt, hsa; identical to SEQ ID NO: 40985

SEQ ID NO: 684920 - RNA, 64 nt, hsa; identical to SEQ ID NO: 40986

SEQ ID NO: 684921 - RNA, 64 nt, hsa; identical to SEQ ID NO: 40987

SEQ ID NO: 684922 - RNA, 64 nt, hsa; identical to SEQ ID NO: 40988

SEQ ID NO: 684923 - RNA, 64 nt, hsa; identical to SEQ ID NO: 40989

SEQ ID NO: 684924 - RNA, 64 nt, hsa; identical to SEQ ID NO: 40990

SEQ ID NO: 684925 - RNA, 64 nt, hsa; identical to SEQ ID NO: 40991

SEQ ID NO: 684926 - RNA, 64 nt, hsa; identical to SEQ ID NO: 40992

SEQ ID NO: 684927 - RNA, 64 nt, hsa; identical to SEQ ID NO: 40993

SEQ ID NO: 684928 - RNA, 64 nt, hsa; identical to SEQ ID NO: 40994

SEQ ID NO: 684929 - RNA, 64 nt, hsa; identical to SEQ ID NO: 40995

SEQ ID NO: 684930 - RNA, 64 nt, hsa; identical to SEQ ID NO: 40996

SEQ ID NO: 684931 - RNA, 64 nt, hsa; identical to SEQ ID NO: 40997

SEQ ID NO: 684932 - RNA, 64 nt, hsa; identical to SEQ ID NO: 40998

SEQ ID NO: 684933 - RNA, 64 nt, hsa; identical to SEQ ID NO: 40999

SEQ ID NO: 684934 - RNA, 64 nt, hsa; identical to SEQ ID NO: 41000

SEQ ID NO: 684935 - RNA, 64 nt, hsa; identical to SEQ ID NO: 41001

SEQ ID NO: 684936 - RNA, 64 nt, hsa; identical to SEQ ID NO: 41002

SEQ ID NO: 684937 - RNA, 64 nt, hsa; identical to SEQ ID NO: 41003

SEQ ID NO: 684938 - RNA, 64 nt, hsa; identical to SEQ ID NO: 41004

SEQ ID NO: 684939 - RNA, 64 nt, hsa; identical to SEQ ID NO: 41005

SEQ ID NO: 684940 - RNA, 64 nt, hsa; identical to SEQ ID NO: 41006

SEQ ID NO: 684941 - RNA, 63 nt, hsa; identical to SEQ ID NO: 41007

SEQ ID NO: 684942 - RNA, 64 nt, hsa; identical to SEQ ID NO: 41008

SEQ ID NO: 684943 - RNA, 64 nt, hsa; identical to SEQ ID NO: 41009

SEQ ID NO: 684944 - RNA, 64 nt, hsa; identical to SEQ ID NO: 41010

SEQ ID NO: 684945 - RNA, 64 nt, hsa; identical to SEQ ID NO: 41011

SEQ ID NO: 684946 - RNA, 64 nt, hsa; identical to SEQ ID NO: 41012

SEQ ID NO: 684947 - RNA, 64 nt, hsa; identical to SEQ ID NO: 41013

SEQ ID NO: 684948 - RNA, 64 nt, hsa; identical to SEQ ID NO: 41014

SEQ ID NO: 684949 - RNA, 64 nt, hsa; identical to SEQ ID NO: 41015

SEQ ID NO: 684950 - RNA, 64 nt, hsa; identical to SEQ ID NO: 41016

SEQ ID NO: 684951 - RNA, 64 nt, hsa; identical to SEQ ID NO: 41017

SEQ ID NO: 684952 - RNA, 64 nt, hsa; identical to SEQ ID NO: 41018

SEQ ID NO: 684953 - RNA, 64 nt, hsa; identical to SEQ ID NO: 41019

SEQ ID NO: 684954 - RNA, 64 nt, hsa; identical to SEQ ID NO: 41020

SEQ ID NO: 684955 - RNA, 64 nt, hsa; identical to SEQ ID NO: 41021

SEQ ID NO: 684956 - RNA, 64 nt, hsa; identical to SEQ ID NO: 41022

SEQ ID NO: 684957 - RNA, 64 nt, hsa; identical to SEQ ID NO: 41023

SEQ ID NO: 684958 - RNA, 64 nt, hsa; identical to SEQ ID NO: 41024

SEQ ID NO: 684959 - RNA, 64 nt, hsa; identical to SEQ ID NO: 41025

SEQ ID NO: 684960 - RNA, 64 nt, hsa; identical to SEQ ID NO: 41026

SEQ ID NO: 684961 - RNA, 64 nt, hsa; identical to SEQ ID NO: 41027

SEQ ID NO: 684962 - RNA, 64 nt, hsa; identical to SEQ ID NO: 41028

SEQ ID NO: 684963 - RNA, 64 nt, hsa; identical to SEQ ID NO: 41029

SEQ ID NO: 684964 - RNA, 64 nt, hsa; identical to SEQ ID NO: 41030

SEQ ID NO: 684965 - RNA, 64 nt, hsa; identical to SEQ ID NO: 41031

SEQ ID NO: 684966 - RNA, 64 nt, hsa; identical to SEQ ID NO: 41032

SEQ ID NO: 684967 - RNA, 64 nt, hsa; identical to SEQ ID NO: 41033

SEQ ID NO: 684968 - RNA, 64 nt, hsa; identical to SEQ ID NO: 41034

SEQ ID NO: 684969 - RNA, 64 nt, hsa; identical to SEQ ID NO: 41035

SEQ ID NO: 684970 - RNA, 64 nt, hsa; identical to SEQ ID NO: 41036

SEQ ID NO: 684971 - RNA, 64 nt, hsa; identical to SEQ ID NO: 41037

SEQ ID NO: 684972 - RNA, 64 nt, hsa; identical to SEQ ID NO: 41038

SEQ ID NO: 684973 - RNA, 64 nt, hsa; identical to SEQ ID NO: 41039

SEQ ID NO: 684974 - RNA, 64 nt, hsa; identical to SEQ ID NO: 41040

SEQ ID NO: 684975 - RNA, 64 nt, hsa; identical to SEQ ID NO: 41041

SEQ ID NO: 684976 - RNA, 64 nt, hsa; identical to SEQ ID NO: 41042

SEQ ID NO: 684977 - RNA, 64 nt, hsa; identical to SEQ ID NO: 41043

SEQ ID NO: 684978 - RNA, 64 nt, hsa; identical to SEQ ID NO: 41044

SEQ ID NO: 684979 - RNA, 64 nt, hsa; identical to SEQ ID NO: 41045

SEQ ID NO: 684980 - RNA, 64 nt, hsa; identical to SEQ ID NO: 41046

SEQ ID NO: 684981 - RNA, 64 nt, hsa; identical to SEQ ID NO: 41047

SEQ ID NO: 684982 - RNA, 64 nt, hsa; identical to SEQ ID NO: 41048

SEQ ID NO: 684983 - RNA, 64 nt, hsa; identical to SEQ ID NO: 41049

SEQ ID NO: 684984 - RNA, 64 nt, hsa; identical to SEQ ID NO: 41050

SEQ ID NO: 684985 - RNA, 64 nt, hsa; identical to SEQ ID NO: 41051

SEQ ID NO: 684986 - RNA, 64 nt, hsa; identical to SEQ ID NO: 41052

SEQ ID NO: 684987 - RNA, 64 nt, hsa; identical to SEQ ID NO: 41053

SEQ ID NO: 684988 - RNA, 64 nt, hsa; identical to SEQ ID NO: 41054

SEQ ID NO: 684989 - RNA, 64 nt, hsa; identical to SEQ ID NO: 41055

SEQ ID NO: 684990 - RNA, 64 nt, hsa; identical to SEQ ID NO: 41056

SEQ ID NO: 684991 - RNA, 64 nt, hsa; identical to SEQ ID NO: 41057

SEQ ID NO: 684992 - RNA, 64 nt, hsa; identical to SEQ ID NO: 41058

SEQ ID NO: 684993 - RNA, 64 nt, hsa; identical to SEQ ID NO: 41059

SEQ ID NO: 684994 - RNA, 64 nt, hsa; identical to SEQ ID NO: 41060

SEQ ID NO: 684995 - RNA, 64 nt, hsa; identical to SEQ ID NO: 41061

SEQ ID NO: 684996 - RNA, 64 nt, hsa; identical to SEQ ID NO: 41062

SEQ ID NO: 684997 - RNA, 64 nt, hsa; identical to SEQ ID NO: 41063

SEQ ID NO: 684998 - RNA, 64 nt, hsa; identical to SEQ ID NO: 41064

SEQ ID NO: 684999 - RNA, 64 nt, hsa; identical to SEQ ID NO: 41065

SEQ ID NO: 685000 - RNA, 64 nt, hsa; identical to SEQ ID NO: 41066

SEQ ID NO: 685001 - RNA, 64 nt, hsa; identical to SEQ ID NO: 41067

SEQ ID NO: 685002 - RNA, 64 nt, hsa; identical to SEQ ID NO: 41068

SEQ ID NO: 685003 - RNA, 64 nt, hsa; identical to SEQ ID NO: 41069

SEQ ID NO: 685004 - RNA, 64 nt, hsa; identical to SEQ ID NO: 41070

SEQ ID NO: 685005 - RNA, 64 nt, hsa; identical to SEQ ID NO: 41071

SEQ ID NO: 685006 - RNA, 64 nt, hsa; identical to SEQ ID NO: 41072

SEQ ID NO: 685007 - RNA, 64 nt, hsa; identical to SEQ ID NO: 41073

SEQ ID NO: 685008 - RNA, 64 nt, hsa; identical to SEQ ID NO: 41074

SEQ ID NO: 685009 - RNA, 64 nt, hsa; identical to SEQ ID NO: 41075

SEQ ID NO: 685010 - RNA, 64 nt, hsa; identical to SEQ ID NO: 41076

SEQ ID NO: 685011 - RNA, 64 nt, hsa; identical to SEQ ID NO: 41077

SEQ ID NO: 685012 - RNA, 64 nt, hsa; identical to SEQ ID NO: 41078

SEQ ID NO: 685013 - RNA, 64 nt, hsa; identical to SEQ ID NO: 41079

SEQ ID NO: 685014 - RNA, 64 nt, hsa; identical to SEQ ID NO: 41080

SEQ ID NO: 685015 - RNA, 64 nt, hsa; identical to SEQ ID NO: 41081

SEQ ID NO: 685016 - RNA, 64 nt, hsa; identical to SEQ ID NO: 41082

SEQ ID NO: 685017 - RNA, 64 nt, hsa; identical to SEQ ID NO: 41083

SEQ ID NO: 685018 - RNA, 64 nt, hsa; identical to SEQ ID NO: 41084

SEQ ID NO: 685019 - RNA, 64 nt, hsa; identical to SEQ ID NO: 41085

SEQ ID NO: 685020 - RNA, 64 nt, hsa; identical to SEQ ID NO: 41086

SEQ ID NO: 685021 - RNA, 64 nt, hsa; identical to SEQ ID NO: 41087

SEQ ID NO: 685022 - RNA, 64 nt, hsa; identical to SEQ ID NO: 41088

SEQ ID NO: 685023 - RNA, 64 nt, hsa; identical to SEQ ID NO: 41089

SEQ ID NO: 685024 - RNA, 64 nt, hsa; identical to SEQ ID NO: 41090

SEQ ID NO: 685025 - RNA, 64 nt, hsa; identical to SEQ ID NO: 41091

SEQ ID NO: 685026 - RNA, 64 nt, hsa; identical to SEQ ID NO: 41092

SEQ ID NO: 685027 - RNA, 64 nt, hsa; identical to SEQ ID NO: 41093

SEQ ID NO: 685028 - RNA, 64 nt, hsa; identical to SEQ ID NO: 41094

SEQ ID NO: 685029 - RNA, 64 nt, hsa; identical to SEQ ID NO: 41095

SEQ ID NO: 685030 - RNA, 64 nt, hsa; identical to SEQ ID NO: 41096

SEQ ID NO: 685031 - RNA, 64 nt, hsa; identical to SEQ ID NO: 41097

SEQ ID NO: 685032 - RNA, 64 nt, hsa; identical to SEQ ID NO: 41098

SEQ ID NO: 685033 - RNA, 64 nt, hsa; identical to SEQ ID NO: 41099

SEQ ID NO: 685034 - RNA, 64 nt, hsa; identical to SEQ ID NO: 41100

SEQ ID NO: 685035 - RNA, 64 nt, hsa; identical to SEQ ID NO: 41101

SEQ ID NO: 685036 - RNA, 64 nt, hsa; identical to SEQ ID NO: 41102

SEQ ID NO: 685037 - RNA, 64 nt, hsa; identical to SEQ ID NO: 41103

SEQ ID NO: 685038 - RNA, 64 nt, hsa; identical to SEQ ID NO: 41104

SEQ ID NO: 685039 - RNA, 64 nt, hsa; identical to SEQ ID NO: 41105

SEQ ID NO: 685040 - RNA, 64 nt, hsa; identical to SEQ ID NO: 41106

SEQ ID NO: 685041 - RNA, 64 nt, hsa; identical to SEQ ID NO: 41107

SEQ ID NO: 685042 - RNA, 64 nt, hsa; identical to SEQ ID NO: 41108

SEQ ID NO: 685043 - RNA, 64 nt, hsa; identical to SEQ ID NO: 41109

SEQ ID NO: 685044 - RNA, 64 nt, hsa; identical to SEQ ID NO: 41110

SEQ ID NO: 685045 - RNA, 64 nt, hsa; identical to SEQ ID NO: 41111

SEQ ID NO: 685046 - RNA, 64 nt, hsa; identical to SEQ ID NO: 41112

SEQ ID NO: 685047 - RNA, 64 nt, hsa; identical to SEQ ID NO: 41113

SEQ ID NO: 685048 - RNA, 64 nt, hsa; identical to SEQ ID NO: 41114

SEQ ID NO: 685049 - RNA, 64 nt, hsa; identical to SEQ ID NO: 41115

SEQ ID NO: 685050 - RNA, 64 nt, hsa; identical to SEQ ID NO: 41116

SEQ ID NO: 685051 - RNA, 64 nt, hsa; identical to SEQ ID NO: 41117

SEQ ID NO: 685052 - RNA, 64 nt, hsa; identical to SEQ ID NO: 41118

SEQ ID NO: 685053 - RNA, 64 nt, hsa; identical to SEQ ID NO: 41119

SEQ ID NO: 685054 - RNA, 64 nt, hsa; identical to SEQ ID NO: 41120

SEQ ID NO: 685055 - RNA, 64 nt, hsa; identical to SEQ ID NO: 41121

SEQ ID NO: 685056 - RNA, 64 nt, hsa; identical to SEQ ID NO: 41122

SEQ ID NO: 685057 - RNA, 64 nt, hsa; identical to SEQ ID NO: 41123

SEQ ID NO: 685058 - RNA, 64 nt, hsa; identical to SEQ ID NO: 41124

SEQ ID NO: 685059 - RNA, 64 nt, hsa; identical to SEQ ID NO: 41125

SEQ ID NO: 685060 - RNA, 64 nt, hsa; identical to SEQ ID NO: 41126

SEQ ID NO: 685061 - RNA, 64 nt, hsa; identical to SEQ ID NO: 41127

SEQ ID NO: 685062 - RNA, 64 nt, hsa; identical to SEQ ID NO: 41128

SEQ ID NO: 685063 - RNA, 64 nt, hsa; identical to SEQ ID NO: 41129

SEQ ID NO: 685064 - RNA, 64 nt, hsa; identical to SEQ ID NO: 41130

SEQ ID NO: 685065 - RNA, 64 nt, hsa; identical to SEQ ID NO: 41131

SEQ ID NO: 685066 - RNA, 64 nt, hsa; identical to SEQ ID NO: 41132

SEQ ID NO: 685067 - RNA, 64 nt, hsa; identical to SEQ ID NO: 41133

SEQ ID NO: 685068 - RNA, 64 nt, hsa; identical to SEQ ID NO: 41134

SEQ ID NO: 685069 - RNA, 64 nt, hsa; identical to SEQ ID NO: 41135

SEQ ID NO: 685070 - RNA, 64 nt, hsa; identical to SEQ ID NO: 41136

SEQ ID NO: 685071 - RNA, 64 nt, hsa; identical to SEQ ID NO: 41137

SEQ ID NO: 685072 - RNA, 64 nt, hsa; identical to SEQ ID NO: 41138

SEQ ID NO: 685073 - RNA, 64 nt, hsa; identical to SEQ ID NO: 41139

SEQ ID NO: 685074 - RNA, 64 nt, hsa; identical to SEQ ID NO: 41140

SEQ ID NO: 685075 - RNA, 64 nt, hsa; identical to SEQ ID NO: 41141

SEQ ID NO: 685076 - RNA, 64 nt, hsa; identical to SEQ ID NO: 41142

SEQ ID NO: 685077 - RNA, 64 nt, hsa; identical to SEQ ID NO: 41143

SEQ ID NO: 685078 - RNA, 64 nt, hsa; identical to SEQ ID NO: 41144

SEQ ID NO: 685079 - RNA, 64 nt, hsa; identical to SEQ ID NO: 41145

SEQ ID NO: 685080 - RNA, 64 nt, hsa; identical to SEQ ID NO: 41146

SEQ ID NO: 685081 - RNA, 64 nt, hsa; identical to SEQ ID NO: 41147

SEQ ID NO: 685082 - RNA, 64 nt, hsa; identical to SEQ ID NO: 41148

SEQ ID NO: 685083 - RNA, 64 nt, hsa; identical to SEQ ID NO: 41149

SEQ ID NO: 685084 - RNA, 64 nt, hsa; identical to SEQ ID NO: 41150

SEQ ID NO: 685085 - RNA, 64 nt, hsa; identical to SEQ ID NO: 41151

SEQ ID NO: 685086 - RNA, 64 nt, hsa; identical to SEQ ID NO: 41152

SEQ ID NO: 685087 - RNA, 64 nt, hsa; identical to SEQ ID NO: 41153

SEQ ID NO: 685088 - RNA, 64 nt, hsa; identical to SEQ ID NO: 41154

SEQ ID NO: 685089 - RNA, 64 nt, hsa; identical to SEQ ID NO: 41155

SEQ ID NO: 685090 - RNA, 64 nt, hsa; identical to SEQ ID NO: 41156

SEQ ID NO: 685091 - RNA, 64 nt, hsa; identical to SEQ ID NO: 41157

SEQ ID NO: 685092 - RNA, 64 nt, hsa; identical to SEQ ID NO: 41158

SEQ ID NO: 685093 - RNA, 64 nt, hsa; identical to SEQ ID NO: 41159

SEQ ID NO: 685094 - RNA, 64 nt, hsa; identical to SEQ ID NO: 41160

SEQ ID NO: 685095 - RNA, 64 nt, hsa; identical to SEQ ID NO: 41161

SEQ ID NO: 685096 - RNA, 64 nt, hsa; identical to SEQ ID NO: 41162

SEQ ID NO: 685097 - RNA, 64 nt, hsa; identical to SEQ ID NO: 41163

SEQ ID NO: 685098 - RNA, 64 nt, hsa; identical to SEQ ID NO: 41164

SEQ ID NO: 685099 - RNA, 64 nt, hsa; identical to SEQ ID NO: 41165

SEQ ID NO: 685100 - RNA, 64 nt, hsa; identical to SEQ ID NO: 41166

SEQ ID NO: 685101 - RNA, 64 nt, hsa; identical to SEQ ID NO: 41167

SEQ ID NO: 685102 - RNA, 64 nt, hsa; identical to SEQ ID NO: 41168

SEQ ID NO: 685103 - RNA, 64 nt, hsa; identical to SEQ ID NO: 41169

SEQ ID NO: 685104 - RNA, 64 nt, hsa; identical to SEQ ID NO: 41170

SEQ ID NO: 685105 - RNA, 64 nt, hsa; identical to SEQ ID NO: 41171

SEQ ID NO: 685106 - RNA, 64 nt, hsa; identical to SEQ ID NO: 41172

SEQ ID NO: 685107 - RNA, 64 nt, hsa; identical to SEQ ID NO: 41173

SEQ ID NO: 685108 - RNA, 64 nt, hsa; identical to SEQ ID NO: 41174

SEQ ID NO: 685109 - RNA, 64 nt, hsa; identical to SEQ ID NO: 41175

SEQ ID NO: 685110 - RNA, 64 nt, hsa; identical to SEQ ID NO: 41176

SEQ ID NO: 685111 - RNA, 64 nt, hsa; identical to SEQ ID NO: 41177

SEQ ID NO: 685112 - RNA, 64 nt, hsa; identical to SEQ ID NO: 41178

SEQ ID NO: 685113 - RNA, 64 nt, hsa; identical to SEQ ID NO: 41179

SEQ ID NO: 685114 - RNA, 64 nt, hsa; identical to SEQ ID NO: 41180

SEQ ID NO: 685115 - RNA, 64 nt, hsa; identical to SEQ ID NO: 41181

SEQ ID NO: 685116 - RNA, 64 nt, hsa; identical to SEQ ID NO: 41182

SEQ ID NO: 685117 - RNA, 64 nt, hsa; identical to SEQ ID NO: 41183

SEQ ID NO: 685118 - RNA, 64 nt, hsa; identical to SEQ ID NO: 41184

SEQ ID NO: 685119 - RNA, 64 nt, hsa; identical to SEQ ID NO: 41185

SEQ ID NO: 685120 - RNA, 64 nt, hsa; identical to SEQ ID NO: 41186

SEQ ID NO: 685121 - RNA, 64 nt, hsa; identical to SEQ ID NO: 41187

SEQ ID NO: 685122 - RNA, 64 nt, hsa; identical to SEQ ID NO: 41188

SEQ ID NO: 685123 - RNA, 64 nt, hsa; identical to SEQ ID NO: 41189

SEQ ID NO: 685124 - RNA, 64 nt, hsa; identical to SEQ ID NO: 41190

SEQ ID NO: 685125 - RNA, 64 nt, hsa; identical to SEQ ID NO: 41191

SEQ ID NO: 685126 - RNA, 64 nt, hsa; identical to SEQ ID NO: 41192

SEQ ID NO: 685127 - RNA, 64 nt, hsa; identical to SEQ ID NO: 41193

SEQ ID NO: 685128 - RNA, 64 nt, hsa; identical to SEQ ID NO: 41194

SEQ ID NO: 685129 - RNA, 64 nt, hsa; identical to SEQ ID NO: 41195

SEQ ID NO: 685130 - RNA, 64 nt, hsa; identical to SEQ ID NO: 41196

SEQ ID NO: 685131 - RNA, 64 nt, hsa; identical to SEQ ID NO: 41197

SEQ ID NO: 685132 - RNA, 64 nt, hsa; identical to SEQ ID NO: 41198

SEQ ID NO: 685133 - RNA, 64 nt, hsa; identical to SEQ ID NO: 41199

SEQ ID NO: 685134 - RNA, 64 nt, hsa; identical to SEQ ID NO: 41200

SEQ ID NO: 685135 - RNA, 64 nt, hsa; identical to SEQ ID NO: 41201

SEQ ID NO: 685136 - RNA, 64 nt, hsa; identical to SEQ ID NO: 41202

SEQ ID NO: 685137 - RNA, 64 nt, hsa; identical to SEQ ID NO: 41203

SEQ ID NO: 685138 - RNA, 64 nt, hsa; identical to SEQ ID NO: 41204

SEQ ID NO: 685139 - RNA, 64 nt, hsa; identical to SEQ ID NO: 41205

SEQ ID NO: 685140 - RNA, 64 nt, hsa; identical to SEQ ID NO: 41206

SEQ ID NO: 685141 - RNA, 64 nt, hsa; identical to SEQ ID NO: 41207

SEQ ID NO: 685142 - RNA, 64 nt, hsa; identical to SEQ ID NO: 41208

SEQ ID NO: 685143 - RNA, 64 nt, hsa; identical to SEQ ID NO: 41209

SEQ ID NO: 685144 - RNA, 64 nt, hsa; identical to SEQ ID NO: 41210

SEQ ID NO: 685145 - RNA, 64 nt, hsa; identical to SEQ ID NO: 41211

SEQ ID NO: 685146 - RNA, 64 nt, hsa; identical to SEQ ID NO: 41212

SEQ ID NO: 685147 - RNA, 64 nt, hsa; identical to SEQ ID NO: 41213

SEQ ID NO: 685148 - RNA, 64 nt, hsa; identical to SEQ ID NO: 41214

SEQ ID NO: 685149 - RNA, 64 nt, hsa; identical to SEQ ID NO: 41215

SEQ ID NO: 685150 - RNA, 64 nt, hsa; identical to SEQ ID NO: 41216

SEQ ID NO: 685151 - RNA, 64 nt, hsa; identical to SEQ ID NO: 41217

SEQ ID NO: 685152 - RNA, 64 nt, hsa; identical to SEQ ID NO: 41218

SEQ ID NO: 685153 - RNA, 64 nt, hsa; identical to SEQ ID NO: 41219

SEQ ID NO: 685154 - RNA, 64 nt, hsa; identical to SEQ ID NO: 41220

SEQ ID NO: 685155 - RNA, 64 nt, hsa; identical to SEQ ID NO: 41221

SEQ ID NO: 685156 - RNA, 64 nt, hsa; identical to SEQ ID NO: 41222

SEQ ID NO: 685157 - RNA, 64 nt, hsa; identical to SEQ ID NO: 41223

SEQ ID NO: 685158 - RNA, 64 nt, hsa; identical to SEQ ID NO: 41224

SEQ ID NO: 685159 - RNA, 64 nt, hsa; identical to SEQ ID NO: 41225

SEQ ID NO: 685160 - RNA, 64 nt, hsa; identical to SEQ ID NO: 41226

SEQ ID NO: 685161 - RNA, 64 nt, hsa; identical to SEQ ID NO: 41227

SEQ ID NO: 685162 - RNA, 64 nt, hsa; identical to SEQ ID NO: 41228

SEQ ID NO: 685163 - RNA, 64 nt, hsa; identical to SEQ ID NO: 41229

SEQ ID NO: 685164 - RNA, 64 nt, hsa; identical to SEQ ID NO: 41230

SEQ ID NO: 685165 - RNA, 64 nt, hsa; identical to SEQ ID NO: 41231

SEQ ID NO: 685166 - RNA, 64 nt, hsa; identical to SEQ ID NO: 41232

SEQ ID NO: 685167 - RNA, 64 nt, hsa; identical to SEQ ID NO: 41233

SEQ ID NO: 685168 - RNA, 64 nt, hsa; identical to SEQ ID NO: 41234

SEQ ID NO: 685169 - RNA, 64 nt, hsa; identical to SEQ ID NO: 41235

SEQ ID NO: 685170 - RNA, 62 nt, hsa; identical to SEQ ID NO: 41236

SEQ ID NO: 685171 - RNA, 60 nt, hsa; identical to SEQ ID NO: 41237

SEQ ID NO: 685172 - RNA, 58 nt, hsa; identical to SEQ ID NO: 41238

SEQ ID NO: 685173 - RNA, 56 nt, hsa; identical to SEQ ID NO: 41239

SEQ ID NO: 685174 - RNA, 54 nt, hsa; identical to SEQ ID NO: 41240

SEQ ID NO: 685175 - RNA, 64 nt, hsa; identical to SEQ ID NO: 41241

SEQ ID NO: 685176 - RNA, 64 nt, hsa; identical to SEQ ID NO: 41242

SEQ ID NO: 685177 - RNA, 64 nt, hsa; identical to SEQ ID NO: 41243

SEQ ID NO: 685178 - RNA, 64 nt, hsa; identical to SEQ ID NO: 41244

SEQ ID NO: 685179 - RNA, 64 nt, hsa; identical to SEQ ID NO: 41245

SEQ ID NO: 685180 - RNA, 64 nt, hsa; identical to SEQ ID NO: 41246

SEQ ID NO: 685181 - RNA, 64 nt, hsa; identical to SEQ ID NO: 41247

SEQ ID NO: 685182 - RNA, 64 nt, hsa; identical to SEQ ID NO: 41248

SEQ ID NO: 685183 - RNA, 64 nt, hsa; identical to SEQ ID NO: 41249

SEQ ID NO: 685184 - RNA, 64 nt, hsa; identical to SEQ ID NO: 41250

SEQ ID NO: 685185 - RNA, 64 nt, hsa; identical to SEQ ID NO: 41251

SEQ ID NO: 685186 - RNA, 64 nt, hsa; identical to SEQ ID NO: 41252

SEQ ID NO: 685187 - RNA, 64 nt, hsa; identical to SEQ ID NO: 41253

SEQ ID NO: 685188 - RNA, 64 nt, hsa; identical to SEQ ID NO: 41254

SEQ ID NO: 685189 - RNA, 64 nt, hsa; identical to SEQ ID NO: 41255

SEQ ID NO: 685190 - RNA, 64 nt, hsa; identical to SEQ ID NO: 41256

SEQ ID NO: 685191 - RNA, 64 nt, hsa; identical to SEQ ID NO: 41257

SEQ ID NO: 685192 - RNA, 64 nt, hsa; identical to SEQ ID NO: 41258

SEQ ID NO: 685193 - RNA, 64 nt, hsa; identical to SEQ ID NO: 41259

SEQ ID NO: 685194 - RNA, 64 nt, hsa; identical to SEQ ID NO: 41260

SEQ ID NO: 685195 - RNA, 64 nt, hsa; identical to SEQ ID NO: 41261

SEQ ID NO: 685196 - RNA, 64 nt, hsa; identical to SEQ ID NO: 41262

SEQ ID NO: 685197 - RNA, 64 nt, hsa; identical to SEQ ID NO: 41263

SEQ ID NO: 685198 - RNA, 64 nt, hsa; identical to SEQ ID NO: 41264

SEQ ID NO: 685199 - RNA, 64 nt, hsa; identical to SEQ ID NO: 41265

SEQ ID NO: 685200 - RNA, 64 nt, hsa; identical to SEQ ID NO: 41266

SEQ ID NO: 685201 - RNA, 64 nt, hsa; identical to SEQ ID NO: 41267

SEQ ID NO: 685202 - RNA, 64 nt, hsa; identical to SEQ ID NO: 41268

SEQ ID NO: 685203 - RNA, 64 nt, hsa; identical to SEQ ID NO: 41269

SEQ ID NO: 685204 - RNA, 64 nt, hsa; identical to SEQ ID NO: 41270

SEQ ID NO: 685205 - RNA, 64 nt, hsa; identical to SEQ ID NO: 41271

SEQ ID NO: 685206 - RNA, 64 nt, hsa; identical to SEQ ID NO: 41272

SEQ ID NO: 685207 - RNA, 64 nt, hsa; identical to SEQ ID NO: 41273

SEQ ID NO: 685208 - RNA, 64 nt, hsa; identical to SEQ ID NO: 41274

SEQ ID NO: 685209 - RNA, 64 nt, hsa; identical to SEQ ID NO: 41275

SEQ ID NO: 685210 - RNA, 64 nt, hsa; identical to SEQ ID NO: 41276

SEQ ID NO: 685211 - RNA, 64 nt, hsa; identical to SEQ ID NO: 41277

SEQ ID NO: 685212 - RNA, 64 nt, hsa; identical to SEQ ID NO: 41278

SEQ ID NO: 685213 - RNA, 64 nt, hsa; identical to SEQ ID NO: 41279

SEQ ID NO: 685214 - RNA, 64 nt, hsa; identical to SEQ ID NO: 41280

SEQ ID NO: 685215 - RNA, 64 nt, hsa; identical to SEQ ID NO: 41281

SEQ ID NO: 685216 - RNA, 64 nt, hsa; identical to SEQ ID NO: 41282

SEQ ID NO: 685217 - RNA, 64 nt, hsa; identical to SEQ ID NO: 41283

SEQ ID NO: 685218 - RNA, 64 nt, hsa; identical to SEQ ID NO: 41284

SEQ ID NO: 685219 - RNA, 64 nt, hsa; identical to SEQ ID NO: 41285

SEQ ID NO: 685220 - RNA, 64 nt, hsa; identical to SEQ ID NO: 41286

SEQ ID NO: 685221 - RNA, 64 nt, hsa; identical to SEQ ID NO: 41287

SEQ ID NO: 685222 - RNA, 64 nt, hsa; identical to SEQ ID NO: 41288

SEQ ID NO: 685223 - RNA, 64 nt, hsa; identical to SEQ ID NO: 41289

SEQ ID NO: 685224 - RNA, 64 nt, hsa; identical to SEQ ID NO: 41290

SEQ ID NO: 685225 - RNA, 64 nt, hsa; identical to SEQ ID NO: 41291

SEQ ID NO: 685226 - RNA, 64 nt, hsa; identical to SEQ ID NO: 41292

SEQ ID NO: 685227 - RNA, 64 nt, hsa; identical to SEQ ID NO: 41293

SEQ ID NO: 685228 - RNA, 64 nt, hsa; identical to SEQ ID NO: 41294

SEQ ID NO: 685229 - RNA, 64 nt, hsa; identical to SEQ ID NO: 41295

SEQ ID NO: 685230 - RNA, 64 nt, hsa; identical to SEQ ID NO: 41296

SEQ ID NO: 685231 - RNA, 64 nt, hsa; identical to SEQ ID NO: 41297

SEQ ID NO: 685232 - RNA, 64 nt, hsa; identical to SEQ ID NO: 41298

SEQ ID NO: 685233 - RNA, 64 nt, hsa; identical to SEQ ID NO: 41299

SEQ ID NO: 685234 - RNA, 64 nt, hsa; identical to SEQ ID NO: 41300

SEQ ID NO: 685235 - RNA, 64 nt, hsa; identical to SEQ ID NO: 41301

SEQ ID NO: 685236 - RNA, 64 nt, hsa; identical to SEQ ID NO: 41302

SEQ ID NO: 685237 - RNA, 64 nt, hsa; identical to SEQ ID NO: 41303

SEQ ID NO: 685238 - RNA, 64 nt, hsa; identical to SEQ ID NO: 41304

SEQ ID NO: 685239 - RNA, 64 nt, hsa; identical to SEQ ID NO: 41305

SEQ ID NO: 685240 - RNA, 64 nt, hsa; identical to SEQ ID NO: 41306

SEQ ID NO: 685241 - RNA, 64 nt, hsa; identical to SEQ ID NO: 41307

SEQ ID NO: 685242 - RNA, 64 nt, hsa; identical to SEQ ID NO: 41308

SEQ ID NO: 685243 - RNA, 64 nt, hsa; identical to SEQ ID NO: 41309

SEQ ID NO: 685244 - RNA, 64 nt, hsa; identical to SEQ ID NO: 41310

SEQ ID NO: 685245 - RNA, 64 nt, hsa; identical to SEQ ID NO: 41311

SEQ ID NO: 685246 - RNA, 64 nt, hsa; identical to SEQ ID NO: 41312

SEQ ID NO: 685247 - RNA, 64 nt, hsa; identical to SEQ ID NO: 41313

SEQ ID NO: 685248 - RNA, 64 nt, hsa; identical to SEQ ID NO: 41314

SEQ ID NO: 685249 - RNA, 64 nt, hsa; identical to SEQ ID NO: 41315

SEQ ID NO: 685250 - RNA, 64 nt, hsa; identical to SEQ ID NO: 41316

SEQ ID NO: 685251 - RNA, 64 nt, hsa; identical to SEQ ID NO: 41317

SEQ ID NO: 685252 - RNA, 64 nt, hsa; identical to SEQ ID NO: 41318

SEQ ID NO: 685253 - RNA, 64 nt, hsa; identical to SEQ ID NO: 41319

SEQ ID NO: 685254 - RNA, 64 nt, hsa; identical to SEQ ID NO: 41320

SEQ ID NO: 685255 - RNA, 64 nt, hsa; identical to SEQ ID NO: 41321

SEQ ID NO: 685256 - RNA, 64 nt, hsa; identical to SEQ ID NO: 41322

SEQ ID NO: 685257 - RNA, 64 nt, hsa; identical to SEQ ID NO: 41323

SEQ ID NO: 685258 - RNA, 64 nt, hsa; identical to SEQ ID NO: 41324

SEQ ID NO: 685259 - RNA, 64 nt, hsa; identical to SEQ ID NO: 41325

SEQ ID NO: 685260 - RNA, 64 nt, hsa; identical to SEQ ID NO: 41326

SEQ ID NO: 685261 - RNA, 64 nt, hsa; identical to SEQ ID NO: 41327

SEQ ID NO: 685262 - RNA, 64 nt, hsa; identical to SEQ ID NO: 41328

SEQ ID NO: 685263 - RNA, 64 nt, hsa; identical to SEQ ID NO: 41329

SEQ ID NO: 685264 - RNA, 64 nt, hsa; identical to SEQ ID NO: 41330

SEQ ID NO: 685265 - RNA, 64 nt, hsa; identical to SEQ ID NO: 41331

SEQ ID NO: 685266 - RNA, 64 nt, hsa; identical to SEQ ID NO: 41332

SEQ ID NO: 685267 - RNA, 64 nt, hsa; identical to SEQ ID NO: 41333

SEQ ID NO: 685268 - RNA, 64 nt, hsa; identical to SEQ ID NO: 41334

SEQ ID NO: 685269 - RNA, 64 nt, hsa; identical to SEQ ID NO: 41335

SEQ ID NO: 685270 - RNA, 64 nt, hsa; identical to SEQ ID NO: 41336

SEQ ID NO: 685271 - RNA, 64 nt, hsa; identical to SEQ ID NO: 41337

SEQ ID NO: 685272 - RNA, 64 nt, hsa; identical to SEQ ID NO: 41338

SEQ ID NO: 685273 - RNA, 64 nt, hsa; identical to SEQ ID NO: 41339

SEQ ID NO: 685274 - RNA, 64 nt, hsa; identical to SEQ ID NO: 41340

SEQ ID NO: 685275 - RNA, 64 nt, hsa; identical to SEQ ID NO: 41341

SEQ ID NO: 685276 - RNA, 64 nt, hsa; identical to SEQ ID NO: 41342

SEQ ID NO: 685277 - RNA, 64 nt, hsa; identical to SEQ ID NO: 41343

SEQ ID NO: 685278 - RNA, 64 nt, hsa; identical to SEQ ID NO: 41344

SEQ ID NO: 685279 - RNA, 64 nt, hsa; identical to SEQ ID NO: 41345

SEQ ID NO: 685280 - RNA, 64 nt, hsa; identical to SEQ ID NO: 41346

SEQ ID NO: 685281 - RNA, 64 nt, hsa; identical to SEQ ID NO: 41347

SEQ ID NO: 685282 - RNA, 64 nt, hsa; identical to SEQ ID NO: 41348

SEQ ID NO: 685283 - RNA, 64 nt, hsa; identical to SEQ ID NO: 41349

SEQ ID NO: 685284 - RNA, 64 nt, hsa; identical to SEQ ID NO: 41350

SEQ ID NO: 685285 - RNA, 64 nt, hsa; identical to SEQ ID NO: 41351

SEQ ID NO: 685286 - RNA, 64 nt, hsa; identical to SEQ ID NO: 41352

SEQ ID NO: 685287 - RNA, 64 nt, hsa; identical to SEQ ID NO: 41353

SEQ ID NO: 685288 - RNA, 64 nt, hsa; identical to SEQ ID NO: 41354

SEQ ID NO: 685289 - RNA, 64 nt, hsa; identical to SEQ ID NO: 41355

SEQ ID NO: 685290 - RNA, 64 nt, hsa; identical to SEQ ID NO: 41356

SEQ ID NO: 685291 - RNA, 64 nt, hsa; identical to SEQ ID NO: 41357

SEQ ID NO: 685292 - RNA, 64 nt, hsa; identical to SEQ ID NO: 41358

SEQ ID NO: 685293 - RNA, 64 nt, hsa; identical to SEQ ID NO: 41359

SEQ ID NO: 685294 - RNA, 64 nt, hsa; identical to SEQ ID NO: 41360

SEQ ID NO: 685295 - RNA, 64 nt, hsa; identical to SEQ ID NO: 41361

SEQ ID NO: 685296 - RNA, 64 nt, hsa; identical to SEQ ID NO: 41362

SEQ ID NO: 685297 - RNA, 64 nt, hsa; identical to SEQ ID NO: 41363

SEQ ID NO: 685298 - RNA, 64 nt, hsa; identical to SEQ ID NO: 41364

SEQ ID NO: 685299 - RNA, 64 nt, hsa; identical to SEQ ID NO: 41365

SEQ ID NO: 685300 - RNA, 64 nt, hsa; identical to SEQ ID NO: 41366

SEQ ID NO: 685301 - RNA, 64 nt, hsa; identical to SEQ ID NO: 41367

SEQ ID NO: 685302 - RNA, 64 nt, hsa; identical to SEQ ID NO: 41368

SEQ ID NO: 685303 - RNA, 64 nt, hsa; identical to SEQ ID NO: 41369

SEQ ID NO: 685304 - RNA, 64 nt, hsa; identical to SEQ ID NO: 41370

SEQ ID NO: 685305 - RNA, 64 nt, hsa; identical to SEQ ID NO: 41371

SEQ ID NO: 685306 - RNA, 64 nt, hsa; identical to SEQ ID NO: 41372

SEQ ID NO: 685307 - RNA, 64 nt, hsa; identical to SEQ ID NO: 41373

SEQ ID NO: 685308 - RNA, 64 nt, hsa; identical to SEQ ID NO: 41374

SEQ ID NO: 685309 - RNA, 64 nt, hsa; identical to SEQ ID NO: 41375

SEQ ID NO: 685310 - RNA, 64 nt, hsa; identical to SEQ ID NO: 41376

SEQ ID NO: 685311 - RNA, 64 nt, hsa; identical to SEQ ID NO: 41377

SEQ ID NO: 685312 - RNA, 64 nt, hsa; identical to SEQ ID NO: 41378

SEQ ID NO: 685313 - RNA, 64 nt, hsa; identical to SEQ ID NO: 41379

SEQ ID NO: 685314 - RNA, 64 nt, hsa; identical to SEQ ID NO: 41380

SEQ ID NO: 685315 - RNA, 64 nt, hsa; identical to SEQ ID NO: 41381

SEQ ID NO: 685316 - RNA, 64 nt, hsa; identical to SEQ ID NO: 41382

SEQ ID NO: 685317 - RNA, 64 nt, hsa; identical to SEQ ID NO: 41383

SEQ ID NO: 685318 - RNA, 64 nt, hsa; identical to SEQ ID NO: 41384

SEQ ID NO: 685319 - RNA, 64 nt, hsa; identical to SEQ ID NO: 41385

SEQ ID NO: 685320 - RNA, 64 nt, hsa; identical to SEQ ID NO: 41386

SEQ ID NO: 685321 - RNA, 64 nt, hsa; identical to SEQ ID NO: 41387

SEQ ID NO: 685322 - RNA, 64 nt, hsa; identical to SEQ ID NO: 41388

SEQ ID NO: 685323 - RNA, 64 nt, hsa; identical to SEQ ID NO: 41389

SEQ ID NO: 685324 - RNA, 64 nt, hsa; identical to SEQ ID NO: 41390

SEQ ID NO: 685325 - RNA, 64 nt, hsa; identical to SEQ ID NO: 41391

SEQ ID NO: 685326 - RNA, 64 nt, hsa; identical to SEQ ID NO: 41392

SEQ ID NO: 685327 - RNA, 64 nt, hsa; identical to SEQ ID NO: 41393

SEQ ID NO: 685328 - RNA, 64 nt, hsa; identical to SEQ ID NO: 41394

SEQ ID NO: 685329 - RNA, 64 nt, hsa; identical to SEQ ID NO: 41395

SEQ ID NO: 685330 - RNA, 64 nt, hsa; identical to SEQ ID NO: 41396

SEQ ID NO: 685331 - RNA, 64 nt, hsa; identical to SEQ ID NO: 41397

SEQ ID NO: 685332 - RNA, 64 nt, hsa; identical to SEQ ID NO: 41398

SEQ ID NO: 685333 - RNA, 64 nt, hsa; identical to SEQ ID NO: 41399

SEQ ID NO: 685334 - RNA, 64 nt, hsa; identical to SEQ ID NO: 41400

SEQ ID NO: 685335 - RNA, 64 nt, hsa; identical to SEQ ID NO: 41401

SEQ ID NO: 685336 - RNA, 64 nt, hsa; identical to SEQ ID NO: 41402

SEQ ID NO: 685337 - RNA, 64 nt, hsa; identical to SEQ ID NO: 41403

SEQ ID NO: 685338 - RNA, 64 nt, hsa; identical to SEQ ID NO: 41404

SEQ ID NO: 685339 - RNA, 64 nt, hsa; identical to SEQ ID NO: 41405

SEQ ID NO: 685340 - RNA, 64 nt, hsa; identical to SEQ ID NO: 41406

SEQ ID NO: 685341 - RNA, 64 nt, hsa; identical to SEQ ID NO: 41407

SEQ ID NO: 685342 - RNA, 64 nt, hsa; identical to SEQ ID NO: 41408

SEQ ID NO: 685343 - RNA, 64 nt, hsa; identical to SEQ ID NO: 41409

SEQ ID NO: 685344 - RNA, 64 nt, hsa; identical to SEQ ID NO: 41410

SEQ ID NO: 685345 - RNA, 64 nt, hsa; identical to SEQ ID NO: 41411

SEQ ID NO: 685346 - RNA, 64 nt, hsa; identical to SEQ ID NO: 41412

SEQ ID NO: 685347 - RNA, 64 nt, hsa; identical to SEQ ID NO: 41413

SEQ ID NO: 685348 - RNA, 64 nt, hsa; identical to SEQ ID NO: 41414

SEQ ID NO: 685349 - RNA, 64 nt, hsa; identical to SEQ ID NO: 41415

SEQ ID NO: 685350 - RNA, 64 nt, hsa; identical to SEQ ID NO: 41416

SEQ ID NO: 685351 - RNA, 64 nt, hsa; identical to SEQ ID NO: 41417

SEQ ID NO: 685352 - RNA, 64 nt, hsa; identical to SEQ ID NO: 41418

SEQ ID NO: 685353 - RNA, 64 nt, hsa; identical to SEQ ID NO: 41419

SEQ ID NO: 685354 - RNA, 64 nt, hsa; identical to SEQ ID NO: 41420

SEQ ID NO: 685355 - RNA, 64 nt, hsa; identical to SEQ ID NO: 41421

SEQ ID NO: 685356 - RNA, 64 nt, hsa; identical to SEQ ID NO: 41422

SEQ ID NO: 685357 - RNA, 64 nt, hsa; identical to SEQ ID NO: 41423

SEQ ID NO: 685358 - RNA, 64 nt, hsa; identical to SEQ ID NO: 41424

SEQ ID NO: 685359 - RNA, 64 nt, hsa; identical to SEQ ID NO: 41425

SEQ ID NO: 685360 - RNA, 64 nt, hsa; identical to SEQ ID NO: 41426

SEQ ID NO: 685361 - RNA, 64 nt, hsa; identical to SEQ ID NO: 41427

SEQ ID NO: 685362 - RNA, 64 nt, hsa; identical to SEQ ID NO: 41428

SEQ ID NO: 685363 - RNA, 64 nt, hsa; identical to SEQ ID NO: 41429

SEQ ID NO: 685364 - RNA, 64 nt, hsa; identical to SEQ ID NO: 41430

SEQ ID NO: 685365 - RNA, 64 nt, hsa; identical to SEQ ID NO: 41431

SEQ ID NO: 685366 - RNA, 64 nt, hsa; identical to SEQ ID NO: 41432

SEQ ID NO: 685367 - RNA, 64 nt, hsa; identical to SEQ ID NO: 41433

SEQ ID NO: 685368 - RNA, 64 nt, hsa; identical to SEQ ID NO: 41434

SEQ ID NO: 685369 - RNA, 64 nt, hsa; identical to SEQ ID NO: 41435

SEQ ID NO: 685370 - RNA, 64 nt, hsa; identical to SEQ ID NO: 41436

SEQ ID NO: 685371 - RNA, 64 nt, hsa; identical to SEQ ID NO: 41437

SEQ ID NO: 685372 - RNA, 64 nt, hsa; identical to SEQ ID NO: 41438

SEQ ID NO: 685373 - RNA, 64 nt, hsa; identical to SEQ ID NO: 41439

SEQ ID NO: 685374 - RNA, 64 nt, hsa; identical to SEQ ID NO: 41440

SEQ ID NO: 685375 - RNA, 64 nt, hsa; identical to SEQ ID NO: 41441

SEQ ID NO: 685376 - RNA, 64 nt, hsa; identical to SEQ ID NO: 41442

SEQ ID NO: 685377 - RNA, 64 nt, hsa; identical to SEQ ID NO: 41443

SEQ ID NO: 685378 - RNA, 64 nt, hsa; identical to SEQ ID NO: 41444

SEQ ID NO: 685379 - RNA, 64 nt, hsa; identical to SEQ ID NO: 41445

SEQ ID NO: 685380 - RNA, 64 nt, hsa; identical to SEQ ID NO: 41446

SEQ ID NO: 685381 - RNA, 64 nt, hsa; identical to SEQ ID NO: 41447

SEQ ID NO: 685382 - RNA, 64 nt, hsa; identical to SEQ ID NO: 41448

SEQ ID NO: 685383 - RNA, 64 nt, hsa; identical to SEQ ID NO: 41449

SEQ ID NO: 685384 - RNA, 64 nt, hsa; identical to SEQ ID NO: 41450

SEQ ID NO: 685385 - RNA, 64 nt, hsa; identical to SEQ ID NO: 41451

SEQ ID NO: 685386 - RNA, 64 nt, hsa; identical to SEQ ID NO: 41452

SEQ ID NO: 685387 - RNA, 64 nt, hsa; identical to SEQ ID NO: 41453

SEQ ID NO: 685388 - RNA, 64 nt, hsa; identical to SEQ ID NO: 41454

SEQ ID NO: 685389 - RNA, 64 nt, hsa; identical to SEQ ID NO: 41455

SEQ ID NO: 685390 - RNA, 64 nt, hsa; identical to SEQ ID NO: 41456

SEQ ID NO: 685391 - RNA, 64 nt, hsa; identical to SEQ ID NO: 41457

SEQ ID NO: 685392 - RNA, 64 nt, hsa; identical to SEQ ID NO: 41458

SEQ ID NO: 685393 - RNA, 64 nt, hsa; identical to SEQ ID NO: 41459

SEQ ID NO: 685394 - RNA, 64 nt, hsa; identical to SEQ ID NO: 41460

SEQ ID NO: 685395 - RNA, 64 nt, hsa; identical to SEQ ID NO: 41461

SEQ ID NO: 685396 - RNA, 64 nt, hsa; identical to SEQ ID NO: 41462

SEQ ID NO: 685397 - RNA, 64 nt, hsa; identical to SEQ ID NO: 41463

SEQ ID NO: 685398 - RNA, 64 nt, hsa; identical to SEQ ID NO: 41464

SEQ ID NO: 685399 - RNA, 64 nt, hsa; identical to SEQ ID NO: 41465

SEQ ID NO: 685400 - RNA, 64 nt, hsa; identical to SEQ ID NO: 41466

SEQ ID NO: 685401 - RNA, 64 nt, hsa; identical to SEQ ID NO: 41467

SEQ ID NO: 685402 - RNA, 64 nt, hsa; identical to SEQ ID NO: 41468

SEQ ID NO: 685403 - RNA, 64 nt, hsa; identical to SEQ ID NO: 41469

SEQ ID NO: 685404 - RNA, 64 nt, hsa; identical to SEQ ID NO: 41470

SEQ ID NO: 685405 - RNA, 64 nt, hsa; identical to SEQ ID NO: 41471

SEQ ID NO: 685406 - RNA, 64 nt, hsa; identical to SEQ ID NO: 41472

SEQ ID NO: 685407 - RNA, 64 nt, hsa; identical to SEQ ID NO: 41473

SEQ ID NO: 685408 - RNA, 64 nt, hsa; identical to SEQ ID NO: 41474

SEQ ID NO: 685409 - RNA, 64 nt, hsa; identical to SEQ ID NO: 41475

SEQ ID NO: 685410 - RNA, 64 nt, hsa; identical to SEQ ID NO: 41476

SEQ ID NO: 685411 - RNA, 64 nt, hsa; identical to SEQ ID NO: 41477

SEQ ID NO: 685412 - RNA, 64 nt, hsa; identical to SEQ ID NO: 41478

SEQ ID NO: 685413 - RNA, 64 nt, hsa; identical to SEQ ID NO: 41479

SEQ ID NO: 685414 - RNA, 64 nt, hsa; identical to SEQ ID NO: 41480

SEQ ID NO: 685415 - RNA, 64 nt, hsa; identical to SEQ ID NO: 41481

SEQ ID NO: 685416 - RNA, 64 nt, hsa; identical to SEQ ID NO: 41482

SEQ ID NO: 685417 - RNA, 64 nt, hsa; identical to SEQ ID NO: 41483

SEQ ID NO: 685418 - RNA, 64 nt, hsa; identical to SEQ ID NO: 41484

SEQ ID NO: 685419 - RNA, 64 nt, hsa; identical to SEQ ID NO: 41485

SEQ ID NO: 685420 - RNA, 64 nt, hsa; identical to SEQ ID NO: 41486

SEQ ID NO: 685421 - RNA, 64 nt, hsa; identical to SEQ ID NO: 41487

SEQ ID NO: 685422 - RNA, 64 nt, hsa; identical to SEQ ID NO: 41488

SEQ ID NO: 685423 - RNA, 64 nt, hsa; identical to SEQ ID NO: 41489

SEQ ID NO: 685424 - RNA, 64 nt, hsa; identical to SEQ ID NO: 41490

SEQ ID NO: 685425 - RNA, 64 nt, hsa; identical to SEQ ID NO: 41491

SEQ ID NO: 685426 - RNA, 64 nt, hsa; identical to SEQ ID NO: 41492

SEQ ID NO: 685427 - RNA, 64 nt, hsa; identical to SEQ ID NO: 41493

SEQ ID NO: 685428 - RNA, 64 nt, hsa; identical to SEQ ID NO: 41494

SEQ ID NO: 685429 - RNA, 64 nt, hsa; identical to SEQ ID NO: 41495

SEQ ID NO: 685430 - RNA, 64 nt, hsa; identical to SEQ ID NO: 41496

SEQ ID NO: 685431 - RNA, 64 nt, hsa; identical to SEQ ID NO: 41497

SEQ ID NO: 685432 - RNA, 64 nt, hsa; identical to SEQ ID NO: 41498

SEQ ID NO: 685433 - RNA, 64 nt, hsa; identical to SEQ ID NO: 41499

SEQ ID NO: 685434 - RNA, 64 nt, hsa; identical to SEQ ID NO: 41500

SEQ ID NO: 685435 - RNA, 64 nt, hsa; identical to SEQ ID NO: 41501

SEQ ID NO: 685436 - RNA, 64 nt, hsa; identical to SEQ ID NO: 41502

SEQ ID NO: 685437 - RNA, 64 nt, hsa; identical to SEQ ID NO: 41503

SEQ ID NO: 685438 - RNA, 64 nt, hsa; identical to SEQ ID NO: 41504

SEQ ID NO: 685439 - RNA, 64 nt, hsa; identical to SEQ ID NO: 41505

SEQ ID NO: 685440 - RNA, 64 nt, hsa; identical to SEQ ID NO: 41506

SEQ ID NO: 685441 - RNA, 64 nt, hsa; identical to SEQ ID NO: 41507

SEQ ID NO: 685442 - RNA, 64 nt, hsa; identical to SEQ ID NO: 41508

SEQ ID NO: 685443 - RNA, 64 nt, hsa; identical to SEQ ID NO: 41509

SEQ ID NO: 685444 - RNA, 64 nt, hsa; identical to SEQ ID NO: 41510

SEQ ID NO: 685445 - RNA, 64 nt, hsa; identical to SEQ ID NO: 41511

SEQ ID NO: 685446 - RNA, 64 nt, hsa; identical to SEQ ID NO: 41512

SEQ ID NO: 685447 - RNA, 64 nt, hsa; identical to SEQ ID NO: 41513

SEQ ID NO: 685448 - RNA, 64 nt, hsa; identical to SEQ ID NO: 41514

SEQ ID NO: 685449 - RNA, 64 nt, hsa; identical to SEQ ID NO: 41515

SEQ ID NO: 685450 - RNA, 64 nt, hsa; identical to SEQ ID NO: 41516

SEQ ID NO: 685451 - RNA, 64 nt, hsa; identical to SEQ ID NO: 41517

SEQ ID NO: 685452 - RNA, 64 nt, hsa; identical to SEQ ID NO: 41518

SEQ ID NO: 685453 - RNA, 64 nt, hsa; identical to SEQ ID NO: 41519

SEQ ID NO: 685454 - RNA, 64 nt, hsa; identical to SEQ ID NO: 41520

SEQ ID NO: 685455 - RNA, 64 nt, hsa; identical to SEQ ID NO: 41521

SEQ ID NO: 685456 - RNA, 64 nt, hsa; identical to SEQ ID NO: 41522

SEQ ID NO: 685457 - RNA, 64 nt, hsa; identical to SEQ ID NO: 41523

SEQ ID NO: 685458 - RNA, 64 nt, hsa; identical to SEQ ID NO: 41524

SEQ ID NO: 685459 - RNA, 64 nt, hsa; identical to SEQ ID NO: 41525

SEQ ID NO: 685460 - RNA, 64 nt, hsa; identical to SEQ ID NO: 41526

SEQ ID NO: 685461 - RNA, 64 nt, hsa; identical to SEQ ID NO: 41527

SEQ ID NO: 685462 - RNA, 64 nt, hsa; identical to SEQ ID NO: 41528

SEQ ID NO: 685463 - RNA, 64 nt, hsa; identical to SEQ ID NO: 41529

SEQ ID NO: 685464 - RNA, 64 nt, hsa; identical to SEQ ID NO: 41530

SEQ ID NO: 685465 - RNA, 64 nt, hsa; identical to SEQ ID NO: 41531

SEQ ID NO: 685466 - RNA, 64 nt, hsa; identical to SEQ ID NO: 41532

SEQ ID NO: 685467 - RNA, 64 nt, hsa; identical to SEQ ID NO: 41533

SEQ ID NO: 685468 - RNA, 64 nt, hsa; identical to SEQ ID NO: 41534

SEQ ID NO: 685469 - RNA, 64 nt, hsa; identical to SEQ ID NO: 41535

SEQ ID NO: 685470 - RNA, 64 nt, hsa; identical to SEQ ID NO: 41536

SEQ ID NO: 685471 - RNA, 64 nt, hsa; identical to SEQ ID NO: 41537

SEQ ID NO: 685472 - RNA, 64 nt, hsa; identical to SEQ ID NO: 41538

SEQ ID NO: 685473 - RNA, 64 nt, hsa; identical to SEQ ID NO: 41539

SEQ ID NO: 685474 - RNA, 64 nt, hsa; identical to SEQ ID NO: 41540

SEQ ID NO: 685475 - RNA, 64 nt, hsa; identical to SEQ ID NO: 41541

SEQ ID NO: 685476 - RNA, 64 nt, hsa; identical to SEQ ID NO: 41542

SEQ ID NO: 685477 - RNA, 64 nt, hsa; identical to SEQ ID NO: 41543

SEQ ID NO: 685478 - RNA, 64 nt, hsa; identical to SEQ ID NO: 41544

SEQ ID NO: 685479 - RNA, 64 nt, hsa; identical to SEQ ID NO: 41545

SEQ ID NO: 685480 - RNA, 64 nt, hsa; identical to SEQ ID NO: 41546

SEQ ID NO: 685481 - RNA, 64 nt, hsa; identical to SEQ ID NO: 41547

SEQ ID NO: 685482 - RNA, 64 nt, hsa; identical to SEQ ID NO: 41548

SEQ ID NO: 685483 - RNA, 64 nt, hsa; identical to SEQ ID NO: 41549

SEQ ID NO: 685484 - RNA, 64 nt, hsa; identical to SEQ ID NO: 41550

SEQ ID NO: 685485 - RNA, 64 nt, hsa; identical to SEQ ID NO: 41551

SEQ ID NO: 685486 - RNA, 64 nt, hsa; identical to SEQ ID NO: 41552

SEQ ID NO: 685487 - RNA, 64 nt, hsa; identical to SEQ ID NO: 41553

SEQ ID NO: 685488 - RNA, 64 nt, hsa; identical to SEQ ID NO: 41554

SEQ ID NO: 685489 - RNA, 64 nt, hsa; identical to SEQ ID NO: 41555

SEQ ID NO: 685490 - RNA, 64 nt, hsa; identical to SEQ ID NO: 41556

SEQ ID NO: 685491 - RNA, 64 nt, hsa; identical to SEQ ID NO: 41557

SEQ ID NO: 685492 - RNA, 64 nt, hsa; identical to SEQ ID NO: 41558

SEQ ID NO: 685493 - RNA, 64 nt, hsa; identical to SEQ ID NO: 41559

SEQ ID NO: 685494 - RNA, 64 nt, hsa; identical to SEQ ID NO: 41560

SEQ ID NO: 685495 - RNA, 64 nt, hsa; identical to SEQ ID NO: 41561

SEQ ID NO: 685496 - RNA, 64 nt, hsa; identical to SEQ ID NO: 41562

SEQ ID NO: 685497 - RNA, 64 nt, hsa; identical to SEQ ID NO: 41563

SEQ ID NO: 685498 - RNA, 64 nt, hsa; identical to SEQ ID NO: 41564

SEQ ID NO: 685499 - RNA, 64 nt, hsa; identical to SEQ ID NO: 41565

SEQ ID NO: 685500 - RNA, 64 nt, hsa; identical to SEQ ID NO: 41566

SEQ ID NO: 685501 - RNA, 64 nt, hsa; identical to SEQ ID NO: 41567

SEQ ID NO: 685502 - RNA, 64 nt, hsa; identical to SEQ ID NO: 41568

SEQ ID NO: 685503 - RNA, 64 nt, hsa; identical to SEQ ID NO: 41569

SEQ ID NO: 685504 - RNA, 64 nt, hsa; identical to SEQ ID NO: 41570

SEQ ID NO: 685505 - RNA, 64 nt, hsa; identical to SEQ ID NO: 41571

SEQ ID NO: 685506 - RNA, 64 nt, hsa; identical to SEQ ID NO: 41572

SEQ ID NO: 685507 - RNA, 64 nt, hsa; identical to SEQ ID NO: 41573

SEQ ID NO: 685508 - RNA, 64 nt, hsa; identical to SEQ ID NO: 41574

SEQ ID NO: 685509 - RNA, 64 nt, hsa; identical to SEQ ID NO: 41575

SEQ ID NO: 685510 - RNA, 64 nt, hsa; identical to SEQ ID NO: 41576

SEQ ID NO: 685511 - RNA, 64 nt, hsa; identical to SEQ ID NO: 41577

SEQ ID NO: 685512 - RNA, 64 nt, hsa; identical to SEQ ID NO: 41578

SEQ ID NO: 685513 - RNA, 64 nt, hsa; identical to SEQ ID NO: 41579

SEQ ID NO: 685514 - RNA, 64 nt, hsa; identical to SEQ ID NO: 41580

SEQ ID NO: 685515 - RNA, 64 nt, hsa; identical to SEQ ID NO: 41581

SEQ ID NO: 685516 - RNA, 64 nt, hsa; identical to SEQ ID NO: 41582

SEQ ID NO: 685517 - RNA, 64 nt, hsa; identical to SEQ ID NO: 41583

SEQ ID NO: 685518 - RNA, 64 nt, hsa; identical to SEQ ID NO: 41584

SEQ ID NO: 685519 - RNA, 64 nt, hsa; identical to SEQ ID NO: 41585

SEQ ID NO: 685520 - RNA, 64 nt, hsa; identical to SEQ ID NO: 41586

SEQ ID NO: 685521 - RNA, 64 nt, hsa; identical to SEQ ID NO: 41587

SEQ ID NO: 685522 - RNA, 64 nt, hsa; identical to SEQ ID NO: 41588

SEQ ID NO: 685523 - RNA, 64 nt, hsa; identical to SEQ ID NO: 41589

SEQ ID NO: 685524 - RNA, 64 nt, hsa; identical to SEQ ID NO: 41590

SEQ ID NO: 685525 - RNA, 64 nt, hsa; identical to SEQ ID NO: 41591

SEQ ID NO: 685526 - RNA, 64 nt, hsa; identical to SEQ ID NO: 41592

SEQ ID NO: 685527 - RNA, 64 nt, hsa; identical to SEQ ID NO: 41593

SEQ ID NO: 685528 - RNA, 64 nt, hsa; identical to SEQ ID NO: 41594

SEQ ID NO: 685529 - RNA, 64 nt, hsa; identical to SEQ ID NO: 41595

SEQ ID NO: 685530 - RNA, 64 nt, hsa; identical to SEQ ID NO: 41596

SEQ ID NO: 685531 - RNA, 64 nt, hsa; identical to SEQ ID NO: 41597

SEQ ID NO: 685532 - RNA, 64 nt, hsa; identical to SEQ ID NO: 41598

SEQ ID NO: 685533 - RNA, 64 nt, hsa; identical to SEQ ID NO: 41599

SEQ ID NO: 685534 - RNA, 64 nt, hsa; identical to SEQ ID NO: 41600

SEQ ID NO: 685535 - RNA, 64 nt, hsa; identical to SEQ ID NO: 41601

SEQ ID NO: 685536 - RNA, 64 nt, hsa; identical to SEQ ID NO: 41602

SEQ ID NO: 685537 - RNA, 64 nt, hsa; identical to SEQ ID NO: 41603

SEQ ID NO: 685538 - RNA, 64 nt, hsa; identical to SEQ ID NO: 41604

SEQ ID NO: 685539 - RNA, 64 nt, hsa; identical to SEQ ID NO: 41605

SEQ ID NO: 685540 - RNA, 64 nt, hsa; identical to SEQ ID NO: 41606

SEQ ID NO: 685541 - RNA, 64 nt, hsa; identical to SEQ ID NO: 41607

SEQ ID NO: 685542 - RNA, 64 nt, hsa; identical to SEQ ID NO: 41608

SEQ ID NO: 685543 - RNA, 64 nt, hsa; identical to SEQ ID NO: 41609

SEQ ID NO: 685544 - RNA, 64 nt, hsa; identical to SEQ ID NO: 41610

SEQ ID NO: 685545 - RNA, 64 nt, hsa; identical to SEQ ID NO: 41611

SEQ ID NO: 685546 - RNA, 64 nt, hsa; identical to SEQ ID NO: 41612

SEQ ID NO: 685547 - RNA, 64 nt, hsa; identical to SEQ ID NO: 41613

SEQ ID NO: 685548 - RNA, 64 nt, hsa; identical to SEQ ID NO: 41614

SEQ ID NO: 685549 - RNA, 64 nt, hsa; identical to SEQ ID NO: 41615

SEQ ID NO: 685550 - RNA, 64 nt, hsa; identical to SEQ ID NO: 41616

SEQ ID NO: 685551 - RNA, 64 nt, hsa; identical to SEQ ID NO: 41617

SEQ ID NO: 685552 - RNA, 64 nt, hsa; identical to SEQ ID NO: 41618

SEQ ID NO: 685553 - RNA, 64 nt, hsa; identical to SEQ ID NO: 41619

SEQ ID NO: 685554 - RNA, 64 nt, hsa; identical to SEQ ID NO: 41620

SEQ ID NO: 685555 - RNA, 64 nt, hsa; identical to SEQ ID NO: 41621

SEQ ID NO: 685556 - RNA, 63 nt, hsa; identical to SEQ ID NO: 41622

SEQ ID NO: 685557 - RNA, 64 nt, hsa; identical to SEQ ID NO: 41623

SEQ ID NO: 685558 - RNA, 64 nt, hsa; identical to SEQ ID NO: 41624

SEQ ID NO: 685559 - RNA, 64 nt, hsa; identical to SEQ ID NO: 41625

SEQ ID NO: 685560 - RNA, 64 nt, hsa; identical to SEQ ID NO: 41626

SEQ ID NO: 685561 - RNA, 64 nt, hsa; identical to SEQ ID NO: 41627

SEQ ID NO: 685562 - RNA, 64 nt, hsa; identical to SEQ ID NO: 41628

SEQ ID NO: 685563 - RNA, 64 nt, hsa; identical to SEQ ID NO: 41629

SEQ ID NO: 685564 - RNA, 64 nt, hsa; identical to SEQ ID NO: 41630

SEQ ID NO: 685565 - RNA, 64 nt, hsa; identical to SEQ ID NO: 41631

SEQ ID NO: 685566 - RNA, 64 nt, hsa; identical to SEQ ID NO: 41632

SEQ ID NO: 685567 - RNA, 64 nt, hsa; identical to SEQ ID NO: 41633

SEQ ID NO: 685568 - RNA, 64 nt, hsa; identical to SEQ ID NO: 41634

SEQ ID NO: 685569 - RNA, 64 nt, hsa; identical to SEQ ID NO: 41635

SEQ ID NO: 685570 - RNA, 64 nt, hsa; identical to SEQ ID NO: 41636

SEQ ID NO: 685571 - RNA, 64 nt, hsa; identical to SEQ ID NO: 41637

SEQ ID NO: 685572 - RNA, 64 nt, hsa; identical to SEQ ID NO: 41638

SEQ ID NO: 685573 - RNA, 64 nt, hsa; identical to SEQ ID NO: 41639

SEQ ID NO: 685574 - RNA, 64 nt, hsa; identical to SEQ ID NO: 41640

SEQ ID NO: 685575 - RNA, 64 nt, hsa; identical to SEQ ID NO: 41641

SEQ ID NO: 685576 - RNA, 64 nt, hsa; identical to SEQ ID NO: 41642

SEQ ID NO: 685577 - RNA, 64 nt, hsa; identical to SEQ ID NO: 41643

SEQ ID NO: 685578 - RNA, 64 nt, hsa; identical to SEQ ID NO: 41644

SEQ ID NO: 685579 - RNA, 64 nt, hsa; identical to SEQ ID NO: 41645

SEQ ID NO: 685580 - RNA, 64 nt, hsa; identical to SEQ ID NO: 41646

SEQ ID NO: 685581 - RNA, 64 nt, hsa; identical to SEQ ID NO: 41647

SEQ ID NO: 685582 - RNA, 64 nt, hsa; identical to SEQ ID NO: 41648

SEQ ID NO: 685583 - RNA, 64 nt, hsa; identical to SEQ ID NO: 41649

SEQ ID NO: 685584 - RNA, 64 nt, hsa; identical to SEQ ID NO: 41650

SEQ ID NO: 685585 - RNA, 64 nt, hsa; identical to SEQ ID NO: 41651

SEQ ID NO: 685586 - RNA, 64 nt, hsa; identical to SEQ ID NO: 41652

SEQ ID NO: 685587 - RNA, 64 nt, hsa; identical to SEQ ID NO: 41653

SEQ ID NO: 685588 - RNA, 64 nt, hsa; identical to SEQ ID NO: 41654

SEQ ID NO: 685589 - RNA, 64 nt, hsa; identical to SEQ ID NO: 41655

SEQ ID NO: 685590 - RNA, 64 nt, hsa; identical to SEQ ID NO: 41656

SEQ ID NO: 685591 - RNA, 64 nt, hsa; identical to SEQ ID NO: 41657

SEQ ID NO: 685592 - RNA, 64 nt, hsa; identical to SEQ ID NO: 41658

SEQ ID NO: 685593 - RNA, 64 nt, hsa; identical to SEQ ID NO: 41659

SEQ ID NO: 685594 - RNA, 64 nt, hsa; identical to SEQ ID NO: 41660

SEQ ID NO: 685595 - RNA, 64 nt, hsa; identical to SEQ ID NO: 41661

SEQ ID NO: 685596 - RNA, 64 nt, hsa; identical to SEQ ID NO: 41662

SEQ ID NO: 685597 - RNA, 64 nt, hsa; identical to SEQ ID NO: 41663

SEQ ID NO: 685598 - RNA, 64 nt, hsa; identical to SEQ ID NO: 41664

SEQ ID NO: 685599 - RNA, 64 nt, hsa; identical to SEQ ID NO: 41665

SEQ ID NO: 685600 - RNA, 64 nt, hsa; identical to SEQ ID NO: 41666

SEQ ID NO: 685601 - RNA, 64 nt, hsa; identical to SEQ ID NO: 41667

SEQ ID NO: 685602 - RNA, 64 nt, hsa; identical to SEQ ID NO: 41668

SEQ ID NO: 685603 - RNA, 64 nt, hsa; identical to SEQ ID NO: 41669

SEQ ID NO: 685604 - RNA, 64 nt, hsa; identical to SEQ ID NO: 41670

SEQ ID NO: 685605 - RNA, 64 nt, hsa; identical to SEQ ID NO: 41671

SEQ ID NO: 685606 - RNA, 64 nt, hsa; identical to SEQ ID NO: 41672

SEQ ID NO: 685607 - RNA, 64 nt, hsa; identical to SEQ ID NO: 41673

SEQ ID NO: 685608 - RNA, 64 nt, hsa; identical to SEQ ID NO: 41674

SEQ ID NO: 685609 - RNA, 64 nt, hsa; identical to SEQ ID NO: 41675

SEQ ID NO: 685610 - RNA, 64 nt, hsa; identical to SEQ ID NO: 41676

SEQ ID NO: 685611 - RNA, 64 nt, hsa; identical to SEQ ID NO: 41677

SEQ ID NO: 685612 - RNA, 64 nt, hsa; identical to SEQ ID NO: 41678

SEQ ID NO: 685613 - RNA, 64 nt, hsa; identical to SEQ ID NO: 41679

SEQ ID NO: 685614 - RNA, 64 nt, hsa; identical to SEQ ID NO: 41680

SEQ ID NO: 685615 - RNA, 64 nt, hsa; identical to SEQ ID NO: 41681

SEQ ID NO: 685616 - RNA, 64 nt, hsa; identical to SEQ ID NO: 41682

SEQ ID NO: 685617 - RNA, 64 nt, hsa; identical to SEQ ID NO: 41683

SEQ ID NO: 685618 - RNA, 64 nt, hsa; identical to SEQ ID NO: 41684

SEQ ID NO: 685619 - RNA, 64 nt, hsa; identical to SEQ ID NO: 41685

SEQ ID NO: 685620 - RNA, 64 nt, hsa; identical to SEQ ID NO: 41686

SEQ ID NO: 685621 - RNA, 64 nt, hsa; identical to SEQ ID NO: 41687

SEQ ID NO: 685622 - RNA, 64 nt, hsa; identical to SEQ ID NO: 41688

SEQ ID NO: 685623 - RNA, 64 nt, hsa; identical to SEQ ID NO: 41689

SEQ ID NO: 685624 - RNA, 64 nt, hsa; identical to SEQ ID NO: 41690

SEQ ID NO: 685625 - RNA, 64 nt, hsa; identical to SEQ ID NO: 41691

SEQ ID NO: 685626 - RNA, 64 nt, hsa; identical to SEQ ID NO: 41692

SEQ ID NO: 685627 - RNA, 64 nt, hsa; identical to SEQ ID NO: 41693

SEQ ID NO: 685628 - RNA, 64 nt, hsa; identical to SEQ ID NO: 41694

SEQ ID NO: 685629 - RNA, 64 nt, hsa; identical to SEQ ID NO: 41695

SEQ ID NO: 685630 - RNA, 64 nt, hsa; identical to SEQ ID NO: 41696

SEQ ID NO: 685631 - RNA, 64 nt, hsa; identical to SEQ ID NO: 41697

SEQ ID NO: 685632 - RNA, 64 nt, hsa; identical to SEQ ID NO: 41698

SEQ ID NO: 685633 - RNA, 64 nt, hsa; identical to SEQ ID NO: 41699

SEQ ID NO: 685634 - RNA, 64 nt, hsa; identical to SEQ ID NO: 41700

SEQ ID NO: 685635 - RNA, 64 nt, hsa; identical to SEQ ID NO: 41701

SEQ ID NO: 685636 - RNA, 64 nt, hsa; identical to SEQ ID NO: 41702

SEQ ID NO: 685637 - RNA, 64 nt, hsa; identical to SEQ ID NO: 41703

SEQ ID NO: 685638 - RNA, 64 nt, hsa; identical to SEQ ID NO: 41704

SEQ ID NO: 685639 - RNA, 64 nt, hsa; identical to SEQ ID NO: 41705

SEQ ID NO: 685640 - RNA, 64 nt, hsa; identical to SEQ ID NO: 41706

SEQ ID NO: 685641 - RNA, 64 nt, hsa; identical to SEQ ID NO: 41707

SEQ ID NO: 685642 - RNA, 64 nt, hsa; identical to SEQ ID NO: 41708

SEQ ID NO: 685643 - RNA, 64 nt, hsa; identical to SEQ ID NO: 41709

SEQ ID NO: 685644 - RNA, 64 nt, hsa; identical to SEQ ID NO: 41710

SEQ ID NO: 685645 - RNA, 64 nt, hsa; identical to SEQ ID NO: 41711

SEQ ID NO: 685646 - RNA, 64 nt, hsa; identical to SEQ ID NO: 41712

SEQ ID NO: 685647 - RNA, 64 nt, hsa; identical to SEQ ID NO: 41713

SEQ ID NO: 685648 - RNA, 64 nt, hsa; identical to SEQ ID NO: 41714

SEQ ID NO: 685649 - RNA, 64 nt, hsa; identical to SEQ ID NO: 41715

SEQ ID NO: 685650 - RNA, 64 nt, hsa; identical to SEQ ID NO: 41716

SEQ ID NO: 685651 - RNA, 64 nt, hsa; identical to SEQ ID NO: 41717

SEQ ID NO: 685652 - RNA, 64 nt, hsa; identical to SEQ ID NO: 41718

SEQ ID NO: 685653 - RNA, 64 nt, hsa; identical to SEQ ID NO: 41719

SEQ ID NO: 685654 - RNA, 64 nt, hsa; identical to SEQ ID NO: 41720

SEQ ID NO: 685655 - RNA, 64 nt, hsa; identical to SEQ ID NO: 41721

SEQ ID NO: 685656 - RNA, 64 nt, hsa; identical to SEQ ID NO: 41722

SEQ ID NO: 685657 - RNA, 64 nt, hsa; identical to SEQ ID NO: 41723

SEQ ID NO: 685658 - RNA, 64 nt, hsa; identical to SEQ ID NO: 41724

SEQ ID NO: 685659 - RNA, 64 nt, hsa; identical to SEQ ID NO: 41725

SEQ ID NO: 685660 - RNA, 64 nt, hsa; identical to SEQ ID NO: 41726

SEQ ID NO: 685661 - RNA, 64 nt, hsa; identical to SEQ ID NO: 41727

SEQ ID NO: 685662 - RNA, 64 nt, hsa; identical to SEQ ID NO: 41728

SEQ ID NO: 685663 - RNA, 64 nt, hsa; identical to SEQ ID NO: 41729

SEQ ID NO: 685664 - RNA, 64 nt, hsa; identical to SEQ ID NO: 41730

SEQ ID NO: 685665 - RNA, 64 nt, hsa; identical to SEQ ID NO: 41731

SEQ ID NO: 685666 - RNA, 64 nt, hsa; identical to SEQ ID NO: 41732

SEQ ID NO: 685667 - RNA, 64 nt, hsa; identical to SEQ ID NO: 41733

SEQ ID NO: 685668 - RNA, 64 nt, hsa; identical to SEQ ID NO: 41734

SEQ ID NO: 685669 - RNA, 64 nt, hsa; identical to SEQ ID NO: 41735

SEQ ID NO: 685670 - RNA, 64 nt, hsa; identical to SEQ ID NO: 41736

SEQ ID NO: 685671 - RNA, 64 nt, hsa; identical to SEQ ID NO: 41737

SEQ ID NO: 685672 - RNA, 64 nt, hsa; identical to SEQ ID NO: 41738

SEQ ID NO: 685673 - RNA, 64 nt, hsa; identical to SEQ ID NO: 41739

SEQ ID NO: 685674 - RNA, 64 nt, hsa; identical to SEQ ID NO: 41740

SEQ ID NO: 685675 - RNA, 64 nt, hsa; identical to SEQ ID NO: 41741

SEQ ID NO: 685676 - RNA, 64 nt, hsa; identical to SEQ ID NO: 41742

SEQ ID NO: 685677 - RNA, 64 nt, hsa; identical to SEQ ID NO: 41743

SEQ ID NO: 685678 - RNA, 64 nt, hsa; identical to SEQ ID NO: 41744

SEQ ID NO: 685679 - RNA, 64 nt, hsa; identical to SEQ ID NO: 41745

SEQ ID NO: 685680 - RNA, 64 nt, hsa; identical to SEQ ID NO: 41746

SEQ ID NO: 685681 - RNA, 64 nt, hsa; identical to SEQ ID NO: 41747

SEQ ID NO: 685682 - RNA, 64 nt, hsa; identical to SEQ ID NO: 41748

SEQ ID NO: 685683 - RNA, 64 nt, hsa; identical to SEQ ID NO: 41749

SEQ ID NO: 685684 - RNA, 64 nt, hsa; identical to SEQ ID NO: 41750

SEQ ID NO: 685685 - RNA, 64 nt, hsa; identical to SEQ ID NO: 41751

SEQ ID NO: 685686 - RNA, 64 nt, hsa; identical to SEQ ID NO: 41752

SEQ ID NO: 685687 - RNA, 64 nt, hsa; identical to SEQ ID NO: 41753

SEQ ID NO: 685688 - RNA, 64 nt, hsa; identical to SEQ ID NO: 41754

SEQ ID NO: 685689 - RNA, 64 nt, hsa; identical to SEQ ID NO: 41755

SEQ ID NO: 685690 - RNA, 64 nt, hsa; identical to SEQ ID NO: 41756

SEQ ID NO: 685691 - RNA, 64 nt, hsa; identical to SEQ ID NO: 41757

SEQ ID NO: 685692 - RNA, 64 nt, hsa; identical to SEQ ID NO: 41758

SEQ ID NO: 685693 - RNA, 64 nt, hsa; identical to SEQ ID NO: 41759

SEQ ID NO: 685694 - RNA, 64 nt, hsa; identical to SEQ ID NO: 41760

SEQ ID NO: 685695 - RNA, 64 nt, hsa; identical to SEQ ID NO: 41761

SEQ ID NO: 685696 - RNA, 64 nt, hsa; identical to SEQ ID NO: 41762

SEQ ID NO: 685697 - RNA, 64 nt, hsa; identical to SEQ ID NO: 41763

SEQ ID NO: 685698 - RNA, 64 nt, hsa; identical to SEQ ID NO: 41764

SEQ ID NO: 685699 - RNA, 64 nt, hsa; identical to SEQ ID NO: 41765

SEQ ID NO: 685700 - RNA, 64 nt, hsa; identical to SEQ ID NO: 41766

SEQ ID NO: 685701 - RNA, 64 nt, hsa; identical to SEQ ID NO: 41767

SEQ ID NO: 685702 - RNA, 64 nt, hsa; identical to SEQ ID NO: 41768

SEQ ID NO: 685703 - RNA, 64 nt, hsa; identical to SEQ ID NO: 41769

SEQ ID NO: 685704 - RNA, 64 nt, hsa; identical to SEQ ID NO: 41770

SEQ ID NO: 685705 - RNA, 64 nt, hsa; identical to SEQ ID NO: 41771

SEQ ID NO: 685706 - RNA, 64 nt, hsa; identical to SEQ ID NO: 41772

SEQ ID NO: 685707 - RNA, 64 nt, hsa; identical to SEQ ID NO: 41773

SEQ ID NO: 685708 - RNA, 64 nt, hsa; identical to SEQ ID NO: 41774

SEQ ID NO: 685709 - RNA, 64 nt, hsa; identical to SEQ ID NO: 41775

SEQ ID NO: 685710 - RNA, 64 nt, hsa; identical to SEQ ID NO: 41776

SEQ ID NO: 685711 - RNA, 64 nt, hsa; identical to SEQ ID NO: 41777

SEQ ID NO: 685712 - RNA, 64 nt, hsa; identical to SEQ ID NO: 41778

SEQ ID NO: 685713 - RNA, 64 nt, hsa; identical to SEQ ID NO: 41779

SEQ ID NO: 685714 - RNA, 64 nt, hsa; identical to SEQ ID NO: 41780

SEQ ID NO: 685715 - RNA, 64 nt, hsa; identical to SEQ ID NO: 41781

SEQ ID NO: 685716 - RNA, 64 nt, hsa; identical to SEQ ID NO: 41782

SEQ ID NO: 685717 - RNA, 64 nt, hsa; identical to SEQ ID NO: 41783

SEQ ID NO: 685718 - RNA, 64 nt, hsa; identical to SEQ ID NO: 41784

SEQ ID NO: 685719 - RNA, 64 nt, hsa; identical to SEQ ID NO: 41785

SEQ ID NO: 685720 - RNA, 64 nt, hsa; identical to SEQ ID NO: 41786

SEQ ID NO: 685721 - RNA, 64 nt, hsa; identical to SEQ ID NO: 41787

SEQ ID NO: 685722 - RNA, 64 nt, hsa; identical to SEQ ID NO: 41788

SEQ ID NO: 685723 - RNA, 64 nt, hsa; identical to SEQ ID NO: 41789

SEQ ID NO: 685724 - RNA, 64 nt, hsa; identical to SEQ ID NO: 41790

SEQ ID NO: 685725 - RNA, 64 nt, hsa; identical to SEQ ID NO: 41791

SEQ ID NO: 685726 - RNA, 64 nt, hsa; identical to SEQ ID NO: 41792

SEQ ID NO: 685727 - RNA, 64 nt, hsa; identical to SEQ ID NO: 41793

SEQ ID NO: 685728 - RNA, 64 nt, hsa; identical to SEQ ID NO: 41794

SEQ ID NO: 685729 - RNA, 64 nt, hsa; identical to SEQ ID NO: 41795

SEQ ID NO: 685730 - RNA, 64 nt, hsa; identical to SEQ ID NO: 41796

SEQ ID NO: 685731 - RNA, 64 nt, hsa; identical to SEQ ID NO: 41797

SEQ ID NO: 685732 - RNA, 64 nt, hsa; identical to SEQ ID NO: 41798

SEQ ID NO: 685733 - RNA, 64 nt, hsa; identical to SEQ ID NO: 41799

SEQ ID NO: 685734 - RNA, 64 nt, hsa; identical to SEQ ID NO: 41800

SEQ ID NO: 685735 - RNA, 64 nt, hsa; identical to SEQ ID NO: 41801

SEQ ID NO: 685736 - RNA, 64 nt, hsa; identical to SEQ ID NO: 41802

SEQ ID NO: 685737 - RNA, 64 nt, hsa; identical to SEQ ID NO: 41803

SEQ ID NO: 685738 - RNA, 64 nt, hsa; identical to SEQ ID NO: 41804

SEQ ID NO: 685739 - RNA, 64 nt, hsa; identical to SEQ ID NO: 41805

SEQ ID NO: 685740 - RNA, 64 nt, hsa; identical to SEQ ID NO: 41806

SEQ ID NO: 685741 - RNA, 64 nt, hsa; identical to SEQ ID NO: 41807

SEQ ID NO: 685742 - RNA, 64 nt, hsa; identical to SEQ ID NO: 41808

SEQ ID NO: 685743 - RNA, 64 nt, hsa; identical to SEQ ID NO: 41809

SEQ ID NO: 685744 - RNA, 64 nt, hsa; identical to SEQ ID NO: 41810

SEQ ID NO: 685745 - RNA, 64 nt, hsa; identical to SEQ ID NO: 41811

SEQ ID NO: 685746 - RNA, 64 nt, hsa; identical to SEQ ID NO: 41812

SEQ ID NO: 685747 - RNA, 64 nt, hsa; identical to SEQ ID NO: 41813

SEQ ID NO: 685748 - RNA, 64 nt, hsa; identical to SEQ ID NO: 41814

SEQ ID NO: 685749 - RNA, 64 nt, hsa; identical to SEQ ID NO: 41815

SEQ ID NO: 685750 - RNA, 64 nt, hsa; identical to SEQ ID NO: 41816

SEQ ID NO: 685751 - RNA, 64 nt, hsa; identical to SEQ ID NO: 41817

SEQ ID NO: 685752 - RNA, 64 nt, hsa; identical to SEQ ID NO: 41818

SEQ ID NO: 685753 - RNA, 64 nt, hsa; identical to SEQ ID NO: 41819

SEQ ID NO: 685754 - RNA, 64 nt, hsa; identical to SEQ ID NO: 41820

SEQ ID NO: 685755 - RNA, 64 nt, hsa; identical to SEQ ID NO: 41821

SEQ ID NO: 685756 - RNA, 64 nt, hsa; identical to SEQ ID NO: 41822

SEQ ID NO: 685757 - RNA, 64 nt, hsa; identical to SEQ ID NO: 41823

SEQ ID NO: 685758 - RNA, 64 nt, hsa; identical to SEQ ID NO: 41824

SEQ ID NO: 685759 - RNA, 64 nt, hsa; identical to SEQ ID NO: 41825

SEQ ID NO: 685760 - RNA, 64 nt, hsa; identical to SEQ ID NO: 41826

SEQ ID NO: 685761 - RNA, 64 nt, hsa; identical to SEQ ID NO: 41827

SEQ ID NO: 685762 - RNA, 64 nt, hsa; identical to SEQ ID NO: 41828

SEQ ID NO: 685763 - RNA, 64 nt, hsa; identical to SEQ ID NO: 41829

SEQ ID NO: 685764 - RNA, 64 nt, hsa; identical to SEQ ID NO: 41830

SEQ ID NO: 685765 - RNA, 64 nt, hsa; identical to SEQ ID NO: 41831

SEQ ID NO: 685766 - RNA, 64 nt, hsa; identical to SEQ ID NO: 41832

SEQ ID NO: 685767 - RNA, 64 nt, hsa; identical to SEQ ID NO: 41833

SEQ ID NO: 685768 - RNA, 64 nt, hsa; identical to SEQ ID NO: 41834

SEQ ID NO: 685769 - RNA, 64 nt, hsa; identical to SEQ ID NO: 41835

SEQ ID NO: 685770 - RNA, 64 nt, hsa; identical to SEQ ID NO: 41836

SEQ ID NO: 685771 - RNA, 64 nt, hsa; identical to SEQ ID NO: 41837

SEQ ID NO: 685772 - RNA, 64 nt, hsa; identical to SEQ ID NO: 41838

SEQ ID NO: 685773 - RNA, 64 nt, hsa; identical to SEQ ID NO: 41839

SEQ ID NO: 685774 - RNA, 64 nt, hsa; identical to SEQ ID NO: 41840

SEQ ID NO: 685775 - RNA, 64 nt, hsa; identical to SEQ ID NO: 41841

SEQ ID NO: 685776 - RNA, 64 nt, hsa; identical to SEQ ID NO: 41842

SEQ ID NO: 685777 - RNA, 64 nt, hsa; identical to SEQ ID NO: 41843

SEQ ID NO: 685778 - RNA, 64 nt, hsa; identical to SEQ ID NO: 41844

SEQ ID NO: 685779 - RNA, 64 nt, hsa; identical to SEQ ID NO: 41845

SEQ ID NO: 685780 - RNA, 64 nt, hsa; identical to SEQ ID NO: 41846

SEQ ID NO: 685781 - RNA, 64 nt, hsa; identical to SEQ ID NO: 41847

SEQ ID NO: 685782 - RNA, 64 nt, hsa; identical to SEQ ID NO: 41848

SEQ ID NO: 685783 - RNA, 64 nt, hsa; identical to SEQ ID NO: 41849

SEQ ID NO: 685784 - RNA, 64 nt, hsa; identical to SEQ ID NO: 41850

SEQ ID NO: 685785 - RNA, 64 nt, hsa; identical to SEQ ID NO: 41851

SEQ ID NO: 685786 - RNA, 64 nt, hsa; identical to SEQ ID NO: 41852

SEQ ID NO: 685787 - RNA, 64 nt, hsa; identical to SEQ ID NO: 41853

SEQ ID NO: 685788 - RNA, 64 nt, hsa; identical to SEQ ID NO: 41854

SEQ ID NO: 685789 - RNA, 64 nt, hsa; identical to SEQ ID NO: 41855

SEQ ID NO: 685790 - RNA, 64 nt, hsa; identical to SEQ ID NO: 41856

SEQ ID NO: 685791 - RNA, 64 nt, hsa; identical to SEQ ID NO: 41857

SEQ ID NO: 685792 - RNA, 64 nt, hsa; identical to SEQ ID NO: 41858

SEQ ID NO: 685793 - RNA, 64 nt, hsa; identical to SEQ ID NO: 41859

SEQ ID NO: 685794 - RNA, 64 nt, hsa; identical to SEQ ID NO: 41860

SEQ ID NO: 685795 - RNA, 64 nt, hsa; identical to SEQ ID NO: 41861

SEQ ID NO: 685796 - RNA, 64 nt, hsa; identical to SEQ ID NO: 41862

SEQ ID NO: 685797 - RNA, 64 nt, hsa; identical to SEQ ID NO: 41863

SEQ ID NO: 685798 - RNA, 64 nt, hsa; identical to SEQ ID NO: 41864

SEQ ID NO: 685799 - RNA, 64 nt, hsa; identical to SEQ ID NO: 41865

SEQ ID NO: 685800 - RNA, 64 nt, hsa; identical to SEQ ID NO: 41866

SEQ ID NO: 685801 - RNA, 64 nt, hsa; identical to SEQ ID NO: 41867

SEQ ID NO: 685802 - RNA, 64 nt, hsa; identical to SEQ ID NO: 41868

SEQ ID NO: 685803 - RNA, 64 nt, hsa; identical to SEQ ID NO: 41869

SEQ ID NO: 685804 - RNA, 64 nt, hsa; identical to SEQ ID NO: 41870

SEQ ID NO: 685805 - RNA, 64 nt, hsa; identical to SEQ ID NO: 41871

SEQ ID NO: 685806 - RNA, 64 nt, hsa; identical to SEQ ID NO: 41872

SEQ ID NO: 685807 - RNA, 64 nt, hsa; identical to SEQ ID NO: 41873

SEQ ID NO: 685808 - RNA, 64 nt, hsa; identical to SEQ ID NO: 41874

SEQ ID NO: 685809 - RNA, 64 nt, hsa; identical to SEQ ID NO: 41875

SEQ ID NO: 685810 - RNA, 64 nt, hsa; identical to SEQ ID NO: 41876

SEQ ID NO: 685811 - RNA, 64 nt, hsa; identical to SEQ ID NO: 41877

SEQ ID NO: 685812 - RNA, 64 nt, hsa; identical to SEQ ID NO: 41878

SEQ ID NO: 685813 - RNA, 64 nt, hsa; identical to SEQ ID NO: 41879

SEQ ID NO: 685814 - RNA, 64 nt, hsa; identical to SEQ ID NO: 41880

SEQ ID NO: 685815 - RNA, 64 nt, hsa; identical to SEQ ID NO: 41881

SEQ ID NO: 685816 - RNA, 64 nt, hsa; identical to SEQ ID NO: 41882

SEQ ID NO: 685817 - RNA, 64 nt, hsa; identical to SEQ ID NO: 41883

SEQ ID NO: 685818 - RNA, 64 nt, hsa; identical to SEQ ID NO: 41884

SEQ ID NO: 685819 - RNA, 64 nt, hsa; identical to SEQ ID NO: 41885

SEQ ID NO: 685820 - RNA, 64 nt, hsa; identical to SEQ ID NO: 41886

SEQ ID NO: 685821 - RNA, 64 nt, hsa; identical to SEQ ID NO: 41887

SEQ ID NO: 685822 - RNA, 64 nt, hsa; identical to SEQ ID NO: 41888

SEQ ID NO: 685823 - RNA, 64 nt, hsa; identical to SEQ ID NO: 41889

SEQ ID NO: 685824 - RNA, 64 nt, hsa; identical to SEQ ID NO: 41890

SEQ ID NO: 685825 - RNA, 64 nt, hsa; identical to SEQ ID NO: 41891

SEQ ID NO: 685826 - RNA, 64 nt, hsa; identical to SEQ ID NO: 41892

SEQ ID NO: 685827 - RNA, 64 nt, hsa; identical to SEQ ID NO: 41893

SEQ ID NO: 685828 - RNA, 64 nt, hsa; identical to SEQ ID NO: 41894

SEQ ID NO: 685829 - RNA, 64 nt, hsa; identical to SEQ ID NO: 41895

SEQ ID NO: 685830 - RNA, 64 nt, hsa; identical to SEQ ID NO: 41896

SEQ ID NO: 685831 - RNA, 64 nt, hsa; identical to SEQ ID NO: 41897

SEQ ID NO: 685832 - RNA, 64 nt, hsa; identical to SEQ ID NO: 41898

SEQ ID NO: 685833 - RNA, 64 nt, hsa; identical to SEQ ID NO: 41899

SEQ ID NO: 685834 - RNA, 64 nt, hsa; identical to SEQ ID NO: 41900

SEQ ID NO: 685835 - RNA, 64 nt, hsa; identical to SEQ ID NO: 41901

SEQ ID NO: 685836 - RNA, 64 nt, hsa; identical to SEQ ID NO: 41902

SEQ ID NO: 685837 - RNA, 64 nt, hsa; identical to SEQ ID NO: 41903

SEQ ID NO: 685838 - RNA, 64 nt, hsa; identical to SEQ ID NO: 41904

SEQ ID NO: 685839 - RNA, 64 nt, hsa; identical to SEQ ID NO: 41905

SEQ ID NO: 685840 - RNA, 64 nt, hsa; identical to SEQ ID NO: 41906

SEQ ID NO: 685841 - RNA, 64 nt, hsa; identical to SEQ ID NO: 41907

SEQ ID NO: 685842 - RNA, 64 nt, hsa; identical to SEQ ID NO: 41908

SEQ ID NO: 685843 - RNA, 64 nt, hsa; identical to SEQ ID NO: 41909

SEQ ID NO: 685844 - RNA, 64 nt, hsa; identical to SEQ ID NO: 41910

SEQ ID NO: 685845 - RNA, 64 nt, hsa; identical to SEQ ID NO: 41911

SEQ ID NO: 685846 - RNA, 64 nt, hsa; identical to SEQ ID NO: 41912

SEQ ID NO: 685847 - RNA, 64 nt, hsa; identical to SEQ ID NO: 41913

SEQ ID NO: 685848 - RNA, 64 nt, hsa; identical to SEQ ID NO: 41914

SEQ ID NO: 685849 - RNA, 64 nt, hsa; identical to SEQ ID NO: 41915

SEQ ID NO: 685850 - RNA, 64 nt, hsa; identical to SEQ ID NO: 41916

SEQ ID NO: 685851 - RNA, 64 nt, hsa; identical to SEQ ID NO: 41917

SEQ ID NO: 685852 - RNA, 64 nt, hsa; identical to SEQ ID NO: 41918

SEQ ID NO: 685853 - RNA, 64 nt, hsa; identical to SEQ ID NO: 41919

SEQ ID NO: 685854 - RNA, 64 nt, hsa; identical to SEQ ID NO: 41920

SEQ ID NO: 685855 - RNA, 64 nt, hsa; identical to SEQ ID NO: 41921

SEQ ID NO: 685856 - RNA, 64 nt, hsa; identical to SEQ ID NO: 41922

SEQ ID NO: 685857 - RNA, 64 nt, hsa; identical to SEQ ID NO: 41923

SEQ ID NO: 685858 - RNA, 64 nt, hsa; identical to SEQ ID NO: 41924

SEQ ID NO: 685859 - RNA, 64 nt, hsa; identical to SEQ ID NO: 41925

SEQ ID NO: 685860 - RNA, 64 nt, hsa; identical to SEQ ID NO: 41926

SEQ ID NO: 685861 - RNA, 64 nt, hsa; identical to SEQ ID NO: 41927

SEQ ID NO: 685862 - RNA, 64 nt, hsa; identical to SEQ ID NO: 41928

SEQ ID NO: 685863 - RNA, 64 nt, hsa; identical to SEQ ID NO: 41929

SEQ ID NO: 685864 - RNA, 64 nt, hsa; identical to SEQ ID NO: 41930

SEQ ID NO: 685865 - RNA, 64 nt, hsa; identical to SEQ ID NO: 41931

SEQ ID NO: 685866 - RNA, 64 nt, hsa; identical to SEQ ID NO: 41932

SEQ ID NO: 685867 - RNA, 64 nt, hsa; identical to SEQ ID NO: 41933

SEQ ID NO: 685868 - RNA, 64 nt, hsa; identical to SEQ ID NO: 41934

SEQ ID NO: 685869 - RNA, 64 nt, hsa; identical to SEQ ID NO: 41935

SEQ ID NO: 685870 - RNA, 64 nt, hsa; identical to SEQ ID NO: 41936

SEQ ID NO: 685871 - RNA, 64 nt, hsa; identical to SEQ ID NO: 41937

SEQ ID NO: 685872 - RNA, 64 nt, hsa; identical to SEQ ID NO: 41938

SEQ ID NO: 685873 - RNA, 64 nt, hsa; identical to SEQ ID NO: 41939

SEQ ID NO: 685874 - RNA, 64 nt, hsa; identical to SEQ ID NO: 41940

SEQ ID NO: 685875 - RNA, 64 nt, hsa; identical to SEQ ID NO: 41941

SEQ ID NO: 685876 - RNA, 64 nt, hsa; identical to SEQ ID NO: 41942

SEQ ID NO: 685877 - RNA, 64 nt, hsa; identical to SEQ ID NO: 41943

SEQ ID NO: 685878 - RNA, 64 nt, hsa; identical to SEQ ID NO: 41944

SEQ ID NO: 685879 - RNA, 64 nt, hsa; identical to SEQ ID NO: 41945

SEQ ID NO: 685880 - RNA, 64 nt, hsa; identical to SEQ ID NO: 41946

SEQ ID NO: 685881 - RNA, 64 nt, hsa; identical to SEQ ID NO: 41947

SEQ ID NO: 685882 - RNA, 64 nt, hsa; identical to SEQ ID NO: 41948

SEQ ID NO: 685883 - RNA, 64 nt, hsa; identical to SEQ ID NO: 41949

SEQ ID NO: 685884 - RNA, 64 nt, hsa; identical to SEQ ID NO: 41950

SEQ ID NO: 685885 - RNA, 64 nt, hsa; identical to SEQ ID NO: 41951

SEQ ID NO: 685886 - RNA, 64 nt, hsa; identical to SEQ ID NO: 41952

SEQ ID NO: 685887 - RNA, 64 nt, hsa; identical to SEQ ID NO: 41953

SEQ ID NO: 685888 - RNA, 64 nt, hsa; identical to SEQ ID NO: 41954

SEQ ID NO: 685889 - RNA, 64 nt, hsa; identical to SEQ ID NO: 41955

SEQ ID NO: 685890 - RNA, 64 nt, hsa; identical to SEQ ID NO: 41956

SEQ ID NO: 685891 - RNA, 64 nt, hsa; identical to SEQ ID NO: 41957

SEQ ID NO: 685892 - RNA, 64 nt, hsa; identical to SEQ ID NO: 41958

SEQ ID NO: 685893 - RNA, 64 nt, hsa; identical to SEQ ID NO: 41959

SEQ ID NO: 685894 - RNA, 64 nt, hsa; identical to SEQ ID NO: 41960

SEQ ID NO: 685895 - RNA, 64 nt, hsa; identical to SEQ ID NO: 41961

SEQ ID NO: 685896 - RNA, 64 nt, hsa; identical to SEQ ID NO: 41962

SEQ ID NO: 685897 - RNA, 64 nt, hsa; identical to SEQ ID NO: 41963

SEQ ID NO: 685898 - RNA, 64 nt, hsa; identical to SEQ ID NO: 41964

SEQ ID NO: 685899 - RNA, 64 nt, hsa; identical to SEQ ID NO: 41965

SEQ ID NO: 685900 - RNA, 64 nt, hsa; identical to SEQ ID NO: 41966

SEQ ID NO: 685901 - RNA, 64 nt, hsa; identical to SEQ ID NO: 41967

SEQ ID NO: 685902 - RNA, 64 nt, hsa; identical to SEQ ID NO: 41968

SEQ ID NO: 685903 - RNA, 64 nt, hsa; identical to SEQ ID NO: 41969

SEQ ID NO: 685904 - RNA, 64 nt, hsa; identical to SEQ ID NO: 41970

SEQ ID NO: 685905 - RNA, 64 nt, hsa; identical to SEQ ID NO: 41971

SEQ ID NO: 685906 - RNA, 64 nt, hsa; identical to SEQ ID NO: 41972

SEQ ID NO: 685907 - RNA, 64 nt, hsa; identical to SEQ ID NO: 41973

SEQ ID NO: 685908 - RNA, 64 nt, hsa; identical to SEQ ID NO: 41974

SEQ ID NO: 685909 - RNA, 64 nt, hsa; identical to SEQ ID NO: 41975

SEQ ID NO: 685910 - RNA, 64 nt, hsa; identical to SEQ ID NO: 41976

SEQ ID NO: 685911 - RNA, 64 nt, hsa; identical to SEQ ID NO: 41977

SEQ ID NO: 685912 - RNA, 64 nt, hsa; identical to SEQ ID NO: 41978

SEQ ID NO: 685913 - RNA, 64 nt, hsa; identical to SEQ ID NO: 41979

SEQ ID NO: 685914 - RNA, 64 nt, hsa; identical to SEQ ID NO: 41980

SEQ ID NO: 685915 - RNA, 64 nt, hsa; identical to SEQ ID NO: 41981

SEQ ID NO: 685916 - RNA, 64 nt, hsa; identical to SEQ ID NO: 41982

SEQ ID NO: 685917 - RNA, 64 nt, hsa; identical to SEQ ID NO: 41983

SEQ ID NO: 685918 - RNA, 64 nt, hsa; identical to SEQ ID NO: 41984

SEQ ID NO: 685919 - RNA, 64 nt, hsa; identical to SEQ ID NO: 41985

SEQ ID NO: 685920 - RNA, 64 nt, hsa; identical to SEQ ID NO: 41986

SEQ ID NO: 685921 - RNA, 64 nt, hsa; identical to SEQ ID NO: 41987

SEQ ID NO: 685922 - RNA, 64 nt, hsa; identical to SEQ ID NO: 41988

SEQ ID NO: 685923 - RNA, 64 nt, hsa; identical to SEQ ID NO: 41989

SEQ ID NO: 685924 - RNA, 64 nt, hsa; identical to SEQ ID NO: 41990

SEQ ID NO: 685925 - RNA, 64 nt, hsa; identical to SEQ ID NO: 41991

SEQ ID NO: 685926 - RNA, 64 nt, hsa; identical to SEQ ID NO: 41992

SEQ ID NO: 685927 - RNA, 64 nt, hsa; identical to SEQ ID NO: 41993

SEQ ID NO: 685928 - RNA, 64 nt, hsa; identical to SEQ ID NO: 41994

SEQ ID NO: 685929 - RNA, 64 nt, hsa; identical to SEQ ID NO: 41995

SEQ ID NO: 685930 - RNA, 64 nt, hsa; identical to SEQ ID NO: 41996

SEQ ID NO: 685931 - RNA, 64 nt, hsa; identical to SEQ ID NO: 41997

SEQ ID NO: 685932 - RNA, 64 nt, hsa; identical to SEQ ID NO: 41998

SEQ ID NO: 685933 - RNA, 64 nt, hsa; identical to SEQ ID NO: 41999

SEQ ID NO: 685934 - RNA, 64 nt, hsa; identical to SEQ ID NO: 42000

SEQ ID NO: 685935 - RNA, 64 nt, hsa; identical to SEQ ID NO: 42001

SEQ ID NO: 685936 - RNA, 64 nt, hsa; identical to SEQ ID NO: 42002

SEQ ID NO: 685937 - RNA, 64 nt, hsa; identical to SEQ ID NO: 42003

SEQ ID NO: 685938 - RNA, 64 nt, hsa; identical to SEQ ID NO: 42004

SEQ ID NO: 685939 - RNA, 64 nt, hsa; identical to SEQ ID NO: 42005

SEQ ID NO: 685940 - RNA, 64 nt, hsa; identical to SEQ ID NO: 42006

SEQ ID NO: 685941 - RNA, 64 nt, hsa; identical to SEQ ID NO: 42007

SEQ ID NO: 685942 - RNA, 64 nt, hsa; identical to SEQ ID NO: 42008

SEQ ID NO: 685943 - RNA, 64 nt, hsa; identical to SEQ ID NO: 42009

SEQ ID NO: 685944 - RNA, 64 nt, hsa; identical to SEQ ID NO: 42010

SEQ ID NO: 685945 - RNA, 64 nt, hsa; identical to SEQ ID NO: 42011

SEQ ID NO: 685946 - RNA, 64 nt, hsa; identical to SEQ ID NO: 42012

SEQ ID NO: 685947 - RNA, 64 nt, hsa; identical to SEQ ID NO: 42013

SEQ ID NO: 685948 - RNA, 64 nt, hsa; identical to SEQ ID NO: 42014

SEQ ID NO: 685949 - RNA, 64 nt, hsa; identical to SEQ ID NO: 42015

SEQ ID NO: 685950 - RNA, 64 nt, hsa; identical to SEQ ID NO: 42016

SEQ ID NO: 685951 - RNA, 64 nt, hsa; identical to SEQ ID NO: 42017

SEQ ID NO: 685952 - RNA, 64 nt, hsa; identical to SEQ ID NO: 42018

SEQ ID NO: 685953 - RNA, 64 nt, hsa; identical to SEQ ID NO: 42019

SEQ ID NO: 685954 - RNA, 64 nt, hsa; identical to SEQ ID NO: 42020

SEQ ID NO: 685955 - RNA, 64 nt, hsa; identical to SEQ ID NO: 42021

SEQ ID NO: 685956 - RNA, 64 nt, hsa; identical to SEQ ID NO: 42022

SEQ ID NO: 685957 - RNA, 64 nt, hsa; identical to SEQ ID NO: 42023

SEQ ID NO: 685958 - RNA, 64 nt, hsa; identical to SEQ ID NO: 42024

SEQ ID NO: 685959 - RNA, 64 nt, hsa; identical to SEQ ID NO: 42025

SEQ ID NO: 685960 - RNA, 64 nt, hsa; identical to SEQ ID NO: 42026

SEQ ID NO: 685961 - RNA, 64 nt, hsa; identical to SEQ ID NO: 42027

SEQ ID NO: 685962 - RNA, 64 nt, hsa; identical to SEQ ID NO: 42028

SEQ ID NO: 685963 - RNA, 64 nt, hsa; identical to SEQ ID NO: 42029

SEQ ID NO: 685964 - RNA, 64 nt, hsa; identical to SEQ ID NO: 42030

SEQ ID NO: 685965 - RNA, 64 nt, hsa; identical to SEQ ID NO: 42031

SEQ ID NO: 685966 - RNA, 64 nt, hsa; identical to SEQ ID NO: 42032

SEQ ID NO: 685967 - RNA, 64 nt, hsa; identical to SEQ ID NO: 42033

SEQ ID NO: 685968 - RNA, 64 nt, hsa; identical to SEQ ID NO: 42034

SEQ ID NO: 685969 - RNA, 64 nt, hsa; identical to SEQ ID NO: 42035

SEQ ID NO: 685970 - RNA, 64 nt, hsa; identical to SEQ ID NO: 42036

SEQ ID NO: 685971 - RNA, 64 nt, hsa; identical to SEQ ID NO: 42037

SEQ ID NO: 685972 - RNA, 64 nt, hsa; identical to SEQ ID NO: 42038

SEQ ID NO: 685973 - RNA, 64 nt, hsa; identical to SEQ ID NO: 42039

SEQ ID NO: 685974 - RNA, 64 nt, hsa; identical to SEQ ID NO: 42040

SEQ ID NO: 685975 - RNA, 64 nt, hsa; identical to SEQ ID NO: 42041

SEQ ID NO: 685976 - RNA, 64 nt, hsa; identical to SEQ ID NO: 42042

SEQ ID NO: 685977 - RNA, 64 nt, hsa; identical to SEQ ID NO: 42043

SEQ ID NO: 685978 - RNA, 64 nt, hsa; identical to SEQ ID NO: 42044

SEQ ID NO: 685979 - RNA, 64 nt, hsa; identical to SEQ ID NO: 42045

SEQ ID NO: 685980 - RNA, 64 nt, hsa; identical to SEQ ID NO: 42046

SEQ ID NO: 685981 - RNA, 64 nt, hsa; identical to SEQ ID NO: 42047

SEQ ID NO: 685982 - RNA, 64 nt, hsa; identical to SEQ ID NO: 42048

SEQ ID NO: 685983 - RNA, 64 nt, hsa; identical to SEQ ID NO: 42049

SEQ ID NO: 685984 - RNA, 64 nt, hsa; identical to SEQ ID NO: 42050

SEQ ID NO: 685985 - RNA, 64 nt, hsa; identical to SEQ ID NO: 42051

SEQ ID NO: 685986 - RNA, 64 nt, hsa; identical to SEQ ID NO: 42052

SEQ ID NO: 685987 - RNA, 64 nt, hsa; identical to SEQ ID NO: 42053

SEQ ID NO: 685988 - RNA, 64 nt, hsa; identical to SEQ ID NO: 42054

SEQ ID NO: 685989 - RNA, 64 nt, hsa; identical to SEQ ID NO: 42055

SEQ ID NO: 685990 - RNA, 64 nt, hsa; identical to SEQ ID NO: 42056

SEQ ID NO: 685991 - RNA, 64 nt, hsa; identical to SEQ ID NO: 42057

SEQ ID NO: 685992 - RNA, 64 nt, hsa; identical to SEQ ID NO: 42058

SEQ ID NO: 685993 - RNA, 64 nt, hsa; identical to SEQ ID NO: 42059

SEQ ID NO: 685994 - RNA, 64 nt, hsa; identical to SEQ ID NO: 42060

SEQ ID NO: 685995 - RNA, 64 nt, hsa; identical to SEQ ID NO: 42061

SEQ ID NO: 685996 - RNA, 64 nt, hsa; identical to SEQ ID NO: 42062

SEQ ID NO: 685997 - RNA, 64 nt, hsa; identical to SEQ ID NO: 42063

SEQ ID NO: 685998 - RNA, 64 nt, hsa; identical to SEQ ID NO: 42064

SEQ ID NO: 685999 - RNA, 64 nt, hsa; identical to SEQ ID NO: 42065

SEQ ID NO: 686000 - RNA, 64 nt, hsa; identical to SEQ ID NO: 42066

SEQ ID NO: 686001 - RNA, 64 nt, hsa; identical to SEQ ID NO: 42067

SEQ ID NO: 686002 - RNA, 64 nt, hsa; identical to SEQ ID NO: 42068

SEQ ID NO: 686003 - RNA, 64 nt, hsa; identical to SEQ ID NO: 42069

SEQ ID NO: 686004 - RNA, 64 nt, hsa; identical to SEQ ID NO: 42070

SEQ ID NO: 686005 - RNA, 64 nt, hsa; identical to SEQ ID NO: 42071

SEQ ID NO: 686006 - RNA, 64 nt, hsa; identical to SEQ ID NO: 42072

SEQ ID NO: 686007 - RNA, 64 nt, hsa; identical to SEQ ID NO: 42073

SEQ ID NO: 686008 - RNA, 64 nt, hsa; identical to SEQ ID NO: 42074

SEQ ID NO: 686009 - RNA, 64 nt, hsa; identical to SEQ ID NO: 42075

SEQ ID NO: 686010 - RNA, 64 nt, hsa; identical to SEQ ID NO: 42076

SEQ ID NO: 686011 - RNA, 64 nt, hsa; identical to SEQ ID NO: 42077

SEQ ID NO: 686012 - RNA, 64 nt, hsa; identical to SEQ ID NO: 42078

SEQ ID NO: 686013 - RNA, 64 nt, hsa; identical to SEQ ID NO: 42079

SEQ ID NO: 686014 - RNA, 64 nt, hsa; identical to SEQ ID NO: 42080

SEQ ID NO: 686015 - RNA, 64 nt, hsa; identical to SEQ ID NO: 42081

SEQ ID NO: 686016 - RNA, 64 nt, hsa; identical to SEQ ID NO: 42082

SEQ ID NO: 686017 - RNA, 64 nt, hsa; identical to SEQ ID NO: 42083

SEQ ID NO: 686018 - RNA, 64 nt, hsa; identical to SEQ ID NO: 42084

SEQ ID NO: 686019 - RNA, 64 nt, hsa; identical to SEQ ID NO: 42085

SEQ ID NO: 686020 - RNA, 64 nt, hsa; identical to SEQ ID NO: 42086

SEQ ID NO: 686021 - RNA, 64 nt, hsa; identical to SEQ ID NO: 42087

SEQ ID NO: 686022 - RNA, 64 nt, hsa; identical to SEQ ID NO: 42088

SEQ ID NO: 686023 - RNA, 64 nt, hsa; identical to SEQ ID NO: 42089

SEQ ID NO: 686024 - RNA, 64 nt, hsa; identical to SEQ ID NO: 42090

SEQ ID NO: 686025 - RNA, 64 nt, hsa; identical to SEQ ID NO: 42091

SEQ ID NO: 686026 - RNA, 64 nt, hsa; identical to SEQ ID NO: 42092

SEQ ID NO: 686027 - RNA, 64 nt, hsa; identical to SEQ ID NO: 42093

SEQ ID NO: 686028 - RNA, 64 nt, hsa; identical to SEQ ID NO: 42094

SEQ ID NO: 686029 - RNA, 64 nt, hsa; identical to SEQ ID NO: 42095

SEQ ID NO: 686030 - RNA, 64 nt, hsa; identical to SEQ ID NO: 42096

SEQ ID NO: 686031 - RNA, 64 nt, hsa; identical to SEQ ID NO: 42097

SEQ ID NO: 686032 - RNA, 64 nt, hsa; identical to SEQ ID NO: 42098

SEQ ID NO: 686033 - RNA, 64 nt, hsa; identical to SEQ ID NO: 42099

SEQ ID NO: 686034 - RNA, 64 nt, hsa; identical to SEQ ID NO: 42100

SEQ ID NO: 686035 - RNA, 64 nt, hsa; identical to SEQ ID NO: 42101

SEQ ID NO: 686036 - RNA, 64 nt, hsa; identical to SEQ ID NO: 41907

SEQ ID NO: 686037 - RNA, 64 nt, hsa; identical to SEQ ID NO: 41906

SEQ ID NO: 686038 - RNA, 64 nt, hsa; identical to SEQ ID NO: 41905

SEQ ID NO: 686039 - RNA, 64 nt, hsa; identical to SEQ ID NO: 41904

SEQ ID NO: 686040 - RNA, 64 nt, hsa; identical to SEQ ID NO: 42106

SEQ ID NO: 686041 - RNA, 64 nt, hsa; identical to SEQ ID NO: 42107

SEQ ID NO: 686042 - RNA, 64 nt, hsa; identical to SEQ ID NO: 42108

SEQ ID NO: 686043 - RNA, 64 nt, hsa; identical to SEQ ID NO: 42109

SEQ ID NO: 686044 - RNA, 64 nt, hsa; identical to SEQ ID NO: 42110

SEQ ID NO: 686045 - RNA, 64 nt, hsa; identical to SEQ ID NO: 42111

SEQ ID NO: 686046 - RNA, 64 nt, hsa; identical to SEQ ID NO: 42112

SEQ ID NO: 686047 - RNA, 64 nt, hsa; identical to SEQ ID NO: 42113

SEQ ID NO: 686048 - RNA, 64 nt, hsa; identical to SEQ ID NO: 42114

SEQ ID NO: 686049 - RNA, 64 nt, hsa; identical to SEQ ID NO: 42115

SEQ ID NO: 686050 - RNA, 64 nt, hsa; identical to SEQ ID NO: 42116

SEQ ID NO: 686051 - RNA, 64 nt, hsa; identical to SEQ ID NO: 42117

SEQ ID NO: 686052 - RNA, 64 nt, hsa; identical to SEQ ID NO: 42118

SEQ ID NO: 686053 - RNA, 64 nt, hsa; identical to SEQ ID NO: 42119

SEQ ID NO: 686054 - RNA, 64 nt, hsa; identical to SEQ ID NO: 42120

SEQ ID NO: 686055 - RNA, 64 nt, hsa; identical to SEQ ID NO: 42121

SEQ ID NO: 686056 - RNA, 64 nt, hsa; identical to SEQ ID NO: 42122

SEQ ID NO: 686057 - RNA, 64 nt, hsa; identical to SEQ ID NO: 42123

SEQ ID NO: 686058 - RNA, 64 nt, hsa; identical to SEQ ID NO: 42124

SEQ ID NO: 686059 - RNA, 64 nt, hsa; identical to SEQ ID NO: 42125

SEQ ID NO: 686060 - RNA, 64 nt, hsa; identical to SEQ ID NO: 42126

SEQ ID NO: 686061 - RNA, 64 nt, hsa; identical to SEQ ID NO: 42127

SEQ ID NO: 686062 - RNA, 64 nt, hsa; identical to SEQ ID NO: 42128

SEQ ID NO: 686063 - RNA, 64 nt, hsa; identical to SEQ ID NO: 42129

SEQ ID NO: 686064 - RNA, 64 nt, hsa; identical to SEQ ID NO: 42130

SEQ ID NO: 686065 - RNA, 64 nt, hsa; identical to SEQ ID NO: 42131

SEQ ID NO: 686066 - RNA, 64 nt, hsa; identical to SEQ ID NO: 42132

SEQ ID NO: 686067 - RNA, 64 nt, hsa; identical to SEQ ID NO: 42133

SEQ ID NO: 686068 - RNA, 64 nt, hsa; identical to SEQ ID NO: 42134

SEQ ID NO: 686069 - RNA, 64 nt, hsa; identical to SEQ ID NO: 42135

SEQ ID NO: 686070 - RNA, 64 nt, hsa; identical to SEQ ID NO: 42136

SEQ ID NO: 686071 - RNA, 64 nt, hsa; identical to SEQ ID NO: 42137

SEQ ID NO: 686072 - RNA, 64 nt, hsa; identical to SEQ ID NO: 42138

SEQ ID NO: 686073 - RNA, 64 nt, hsa; identical to SEQ ID NO: 42139

SEQ ID NO: 686074 - RNA, 64 nt, hsa; identical to SEQ ID NO: 42140

SEQ ID NO: 686075 - RNA, 64 nt, hsa; identical to SEQ ID NO: 42141

SEQ ID NO: 686076 - RNA, 64 nt, hsa; identical to SEQ ID NO: 42142

SEQ ID NO: 686077 - RNA, 64 nt, hsa; identical to SEQ ID NO: 42143

SEQ ID NO: 686078 - RNA, 64 nt, hsa; identical to SEQ ID NO: 42144

SEQ ID NO: 686079 - RNA, 64 nt, hsa; identical to SEQ ID NO: 42145

SEQ ID NO: 686080 - RNA, 64 nt, hsa; identical to SEQ ID NO: 42146

SEQ ID NO: 686081 - RNA, 64 nt, hsa; identical to SEQ ID NO: 42147

SEQ ID NO: 686082 - RNA, 64 nt, hsa; identical to SEQ ID NO: 42148

SEQ ID NO: 686083 - RNA, 64 nt, hsa; identical to SEQ ID NO: 42149

SEQ ID NO: 686084 - RNA, 64 nt, hsa; identical to SEQ ID NO: 42150

SEQ ID NO: 686085 - RNA, 64 nt, hsa; identical to SEQ ID NO: 42151

SEQ ID NO: 686086 - RNA, 64 nt, hsa; identical to SEQ ID NO: 42152

SEQ ID NO: 686087 - RNA, 64 nt, hsa; identical to SEQ ID NO: 42153

SEQ ID NO: 686088 - RNA, 64 nt, hsa; identical to SEQ ID NO: 42154

SEQ ID NO: 686089 - RNA, 64 nt, hsa; identical to SEQ ID NO: 42155

SEQ ID NO: 686090 - RNA, 64 nt, hsa; identical to SEQ ID NO: 42156

SEQ ID NO: 686091 - RNA, 64 nt, hsa; identical to SEQ ID NO: 42157

SEQ ID NO: 686092 - RNA, 64 nt, hsa; identical to SEQ ID NO: 42158

SEQ ID NO: 686093 - RNA, 64 nt, hsa; identical to SEQ ID NO: 42159

SEQ ID NO: 686094 - RNA, 64 nt, hsa; identical to SEQ ID NO: 42160

SEQ ID NO: 686095 - RNA, 64 nt, hsa; identical to SEQ ID NO: 42161

SEQ ID NO: 686096 - RNA, 64 nt, hsa; identical to SEQ ID NO: 42162

SEQ ID NO: 686097 - RNA, 64 nt, hsa; identical to SEQ ID NO: 42163

SEQ ID NO: 686098 - RNA, 64 nt, hsa; identical to SEQ ID NO: 42164

SEQ ID NO: 686099 - RNA, 64 nt, hsa; identical to SEQ ID NO: 42165

SEQ ID NO: 686100 - RNA, 64 nt, hsa; identical to SEQ ID NO: 42166

SEQ ID NO: 686101 - RNA, 64 nt, hsa; identical to SEQ ID NO: 42167

SEQ ID NO: 686102 - RNA, 64 nt, hsa; identical to SEQ ID NO: 42168

SEQ ID NO: 686103 - RNA, 64 nt, hsa; identical to SEQ ID NO: 42169

SEQ ID NO: 686104 - RNA, 64 nt, hsa; identical to SEQ ID NO: 42170

SEQ ID NO: 686105 - RNA, 64 nt, hsa; identical to SEQ ID NO: 42171

SEQ ID NO: 686106 - RNA, 64 nt, hsa; identical to SEQ ID NO: 42172

SEQ ID NO: 686107 - RNA, 64 nt, hsa; identical to SEQ ID NO: 42173

SEQ ID NO: 686108 - RNA, 64 nt, hsa; identical to SEQ ID NO: 42174

SEQ ID NO: 686109 - RNA, 64 nt, hsa; identical to SEQ ID NO: 42175

SEQ ID NO: 686110 - RNA, 64 nt, hsa; identical to SEQ ID NO: 42176

SEQ ID NO: 686111 - RNA, 64 nt, hsa; identical to SEQ ID NO: 42177

SEQ ID NO: 686112 - RNA, 64 nt, hsa; identical to SEQ ID NO: 42178

SEQ ID NO: 686113 - RNA, 64 nt, hsa; identical to SEQ ID NO: 42179

SEQ ID NO: 686114 - RNA, 64 nt, hsa; identical to SEQ ID NO: 42180

SEQ ID NO: 686115 - RNA, 64 nt, hsa; identical to SEQ ID NO: 42181

SEQ ID NO: 686116 - RNA, 64 nt, hsa; identical to SEQ ID NO: 42182

SEQ ID NO: 686117 - RNA, 64 nt, hsa; identical to SEQ ID NO: 42183

SEQ ID NO: 686118 - RNA, 64 nt, hsa; identical to SEQ ID NO: 42184

SEQ ID NO: 686119 - RNA, 64 nt, hsa; identical to SEQ ID NO: 42185

SEQ ID NO: 686120 - RNA, 64 nt, hsa; identical to SEQ ID NO: 42186

SEQ ID NO: 686121 - RNA, 64 nt, hsa; identical to SEQ ID NO: 42187

SEQ ID NO: 686122 - RNA, 64 nt, hsa; identical to SEQ ID NO: 42188

SEQ ID NO: 686123 - RNA, 64 nt, hsa; identical to SEQ ID NO: 42189

SEQ ID NO: 686124 - RNA, 64 nt, hsa; identical to SEQ ID NO: 42190

SEQ ID NO: 686125 - RNA, 64 nt, hsa; identical to SEQ ID NO: 42191

SEQ ID NO: 686126 - RNA, 64 nt, hsa; identical to SEQ ID NO: 42192

SEQ ID NO: 686127 - RNA, 64 nt, hsa; identical to SEQ ID NO: 42193

SEQ ID NO: 686128 - RNA, 64 nt, hsa; identical to SEQ ID NO: 42194

SEQ ID NO: 686129 - RNA, 64 nt, hsa; identical to SEQ ID NO: 42195

SEQ ID NO: 686130 - RNA, 64 nt, hsa; identical to SEQ ID NO: 42196

SEQ ID NO: 686131 - RNA, 64 nt, hsa; identical to SEQ ID NO: 42197

SEQ ID NO: 686132 - RNA, 64 nt, hsa; identical to SEQ ID NO: 42198

SEQ ID NO: 686133 - RNA, 64 nt, hsa; identical to SEQ ID NO: 42199

SEQ ID NO: 686134 - RNA, 64 nt, hsa; identical to SEQ ID NO: 42200

SEQ ID NO: 686135 - RNA, 64 nt, hsa; identical to SEQ ID NO: 42201

SEQ ID NO: 686136 - RNA, 64 nt, hsa; identical to SEQ ID NO: 42202

SEQ ID NO: 686137 - RNA, 64 nt, hsa; identical to SEQ ID NO: 42203

SEQ ID NO: 686138 - RNA, 64 nt, hsa; identical to SEQ ID NO: 42204

SEQ ID NO: 686139 - RNA, 64 nt, hsa; identical to SEQ ID NO: 42205

SEQ ID NO: 686140 - RNA, 64 nt, hsa; identical to SEQ ID NO: 42206

SEQ ID NO: 686141 - RNA, 64 nt, hsa; identical to SEQ ID NO: 42207

SEQ ID NO: 686142 - RNA, 64 nt, hsa; identical to SEQ ID NO: 42208

SEQ ID NO: 686143 - RNA, 64 nt, hsa; identical to SEQ ID NO: 42209

SEQ ID NO: 686144 - RNA, 64 nt, hsa; identical to SEQ ID NO: 42210

SEQ ID NO: 686145 - RNA, 64 nt, hsa; identical to SEQ ID NO: 42211

SEQ ID NO: 686146 - RNA, 64 nt, hsa; identical to SEQ ID NO: 42212

SEQ ID NO: 686147 - RNA, 64 nt, hsa; identical to SEQ ID NO: 42213

SEQ ID NO: 686148 - RNA, 64 nt, hsa; identical to SEQ ID NO: 42214

SEQ ID NO: 686149 - RNA, 64 nt, hsa; identical to SEQ ID NO: 42215

SEQ ID NO: 686150 - RNA, 64 nt, hsa; identical to SEQ ID NO: 42216

SEQ ID NO: 686151 - RNA, 64 nt, hsa; identical to SEQ ID NO: 42217

SEQ ID NO: 686152 - RNA, 64 nt, hsa; identical to SEQ ID NO: 42218

SEQ ID NO: 686153 - RNA, 64 nt, hsa; identical to SEQ ID NO: 42219

SEQ ID NO: 686154 - RNA, 64 nt, hsa; identical to SEQ ID NO: 42220

SEQ ID NO: 686155 - RNA, 64 nt, hsa; identical to SEQ ID NO: 42221

SEQ ID NO: 686156 - RNA, 64 nt, hsa; identical to SEQ ID NO: 42222

SEQ ID NO: 686157 - RNA, 64 nt, hsa; identical to SEQ ID NO: 42223

SEQ ID NO: 686158 - RNA, 64 nt, hsa; identical to SEQ ID NO: 42224

SEQ ID NO: 686159 - RNA, 64 nt, hsa; identical to SEQ ID NO: 42225

SEQ ID NO: 686160 - RNA, 64 nt, hsa; identical to SEQ ID NO: 42226

SEQ ID NO: 686161 - RNA, 64 nt, hsa; identical to SEQ ID NO: 42227

SEQ ID NO: 686162 - RNA, 64 nt, hsa; identical to SEQ ID NO: 42228

SEQ ID NO: 686163 - RNA, 64 nt, hsa; identical to SEQ ID NO: 42229

SEQ ID NO: 686164 - RNA, 64 nt, hsa; identical to SEQ ID NO: 42230

SEQ ID NO: 686165 - RNA, 64 nt, hsa; identical to SEQ ID NO: 42231

SEQ ID NO: 686166 - RNA, 64 nt, hsa; identical to SEQ ID NO: 42232

SEQ ID NO: 686167 - RNA, 64 nt, hsa; identical to SEQ ID NO: 42233

SEQ ID NO: 686168 - RNA, 64 nt, hsa; identical to SEQ ID NO: 42234

SEQ ID NO: 686169 - RNA, 64 nt, hsa; identical to SEQ ID NO: 42235

SEQ ID NO: 686170 - RNA, 64 nt, hsa; identical to SEQ ID NO: 421584

SEQ ID NO: 686171 - RNA, 64 nt, hsa; identical to SEQ ID NO: 421585

SEQ ID NO: 686172 - RNA, 64 nt, hsa; identical to SEQ ID NO: 421586

SEQ ID NO: 686173 - RNA, 64 nt, hsa; identical to SEQ ID NO: 421587

SEQ ID NO: 686174 - RNA, 64 nt, hsa; identical to SEQ ID NO: 421588

SEQ ID NO: 686175 - RNA, 64 nt, hsa; identical to SEQ ID NO: 421589

SEQ ID NO: 686176 - RNA, 51 nt, hsa; identical to SEQ ID NO: 421590

SEQ ID NO: 686177 - RNA, 64 nt, hsa; identical to SEQ ID NO: 421591

SEQ ID NO: 686178 - RNA, 64 nt, hsa; identical to SEQ ID NO: 421592

SEQ ID NO: 686179 - RNA, 64 nt, hsa; identical to SEQ ID NO: 421593

SEQ ID NO: 686180 - RNA, 64 nt, hsa; identical to SEQ ID NO: 421594

SEQ ID NO: 686181 - RNA, 64 nt, hsa; identical to SEQ ID NO: 421595

SEQ ID NO: 686182 - RNA, 64 nt, hsa; identical to SEQ ID NO: 421596

SEQ ID NO: 686183 - RNA, 64 nt, hsa; identical to SEQ ID NO: 421597

SEQ ID NO: 686184 - RNA, 64 nt, hsa; identical to SEQ ID NO: 421598

SEQ ID NO: 686185 - RNA, 64 nt, hsa; identical to SEQ ID NO: 421599

SEQ ID NO: 686186 - RNA, 64 nt, hsa; identical to SEQ ID NO: 421600

SEQ ID NO: 686187 - RNA, 64 nt, hsa; identical to SEQ ID NO: 421601

SEQ ID NO: 686188 - RNA, 64 nt, hsa; identical to SEQ ID NO: 421602

SEQ ID NO: 686189 - RNA, 64 nt, hsa; identical to SEQ ID NO: 421603

SEQ ID NO: 686190 - RNA, 64 nt, hsa; identical to SEQ ID NO: 421604

SEQ ID NO: 686191 - RNA, 64 nt, hsa; identical to SEQ ID NO: 421605

SEQ ID NO: 686192 - RNA, 64 nt, hsa; identical to SEQ ID NO: 421606

SEQ ID NO: 686193 - RNA, 64 nt, hsa; identical to SEQ ID NO: 421607

SEQ ID NO: 686194 - RNA, 64 nt, hsa; identical to SEQ ID NO: 421608

SEQ ID NO: 686195 - RNA, 64 nt, hsa; identical to SEQ ID NO: 421609

SEQ ID NO: 686196 - RNA, 64 nt, hsa; identical to SEQ ID NO: 421610

SEQ ID NO: 686197 - RNA, 64 nt, hsa; identical to SEQ ID NO: 421611

SEQ ID NO: 686198 - RNA, 64 nt, hsa; identical to SEQ ID NO: 421612

SEQ ID NO: 686199 - RNA, 64 nt, hsa; identical to SEQ ID NO: 421613

SEQ ID NO: 686200 - RNA, 64 nt, hsa; identical to SEQ ID NO: 421614

SEQ ID NO: 686201 - RNA, 64 nt, hsa; identical to SEQ ID NO: 421615

SEQ ID NO: 686202 - RNA, 64 nt, hsa; identical to SEQ ID NO: 421616

SEQ ID NO: 686203 - RNA, 64 nt, hsa; identical to SEQ ID NO: 421617

SEQ ID NO: 686204 - RNA, 64 nt, hsa; identical to SEQ ID NO: 421618

SEQ ID NO: 686205 - RNA, 64 nt, hsa; identical to SEQ ID NO: 421619

SEQ ID NO: 686206 - RNA, 64 nt, hsa; identical to SEQ ID NO: 421620

SEQ ID NO: 686207 - RNA, 64 nt, hsa; identical to SEQ ID NO: 421621

SEQ ID NO: 686208 - RNA, 64 nt, hsa; identical to SEQ ID NO: 421622

SEQ ID NO: 686209 - RNA, 59 nt, hsa
aauaaaauaaugcauaguuguguuaaacuacaggcaaacauagcccacgggaauaucuc

SEQ ID NO: 686210 - RNA, 59 nt, hsa
ccugaaaagccuugaaggggguugaggguacaggcaaccuuguguucucugugcccuca

SEQ ID NO: 686211 - RNA, 59 nt, hsa
accugaagacucauucuucuguacgucugacaggcaaugcuggcuguuggcugggggcc

SEQ ID NO: 686212 - RNA, 59 nt, hsa
cccggcugcgugguugaugaucuuugcagacaggcaagcaccuccugccucgaacuggc

SEQ ID NO: 686213 - RNA, 59 nt, hsa
gggcuaaaugcuccaauuaaaagacacagacaggcaaauuggauaaauagucaagaccc

SEQ ID NO: 686214 - RNA, 59 nt, hsa
cacagcaaaagaaacuaccaucagagucaacaggcaaccuacaaaaugggagaaaauuu

SEQ ID NO: 686215 - RNA, 64 nt, hsa; identical to SEQ ID NO: 125921

SEQ ID NO: 686216 - RNA, 64 nt, hsa; identical to SEQ ID NO: 125922

SEQ ID NO: 686217 - RNA, 64 nt, hsa; identical to SEQ ID NO: 125923

SEQ ID NO: 686218 - RNA, 64 nt, hsa; identical to SEQ ID NO: 125924

SEQ ID NO: 686219 - RNA, 64 nt, hsa; identical to SEQ ID NO: 125925

SEQ ID NO: 686220 - RNA, 64 nt, hsa; identical to SEQ ID NO: 125926

SEQ ID NO: 686221 - RNA, 64 nt, hsa; identical to SEQ ID NO: 125927

SEQ ID NO: 686222 - RNA, 64 nt, hsa; identical to SEQ ID NO: 125928

SEQ ID NO: 686223 - RNA, 64 nt, hsa; identical to SEQ ID NO: 125929

SEQ ID NO: 686224 - RNA, 64 nt, hsa; identical to SEQ ID NO: 125930

SEQ ID NO: 686225 - RNA, 64 nt, hsa; identical to SEQ ID NO: 125931

SEQ ID NO: 686226 - RNA, 64 nt, hsa; identical to SEQ ID NO: 125932

SEQ ID NO: 686227 - RNA, 64 nt, hsa
aaauucuuuuaaauaucaacuuaauuuuuucuaaguaagauacaaaaaauuuucaucuaaagua

SEQ ID NO: 686228 - RNA, 64 nt, hsa
aaaaguaguuugaguguuaugaauauuuaaaauuguaagauaagaaacaguuucuuagagcaga

SEQ ID NO: 686229 - RNA, 64 nt, hsa
uagauucuaaucugagugaguuacugagcuuugguccacuaaaacaagcugagcuuugguccac

SEQ ID NO: 686230 - RNA, 64 nt, hsa
gagcuuugguccacuaaaacaagcugagcuuugguccacuaaaacaagaugaaaaauacaagag

SEQ ID NO: 686231 - RNA, 64 nt, hsa
aucuucuguggugcuuaaggaaacuuacuagagcuccacuaacagucucauaaggaggcagcca

SEQ ID NO: 686232 - RNA, 64 nt, hsa
uugucuuuauuacuauauguaaauuagacauuaauccacuaaacuggucuucuucaagagagcu

SEQ ID NO: 686233 - RNA, 64 nt, hsa
ugcucuucuagacaacucacaucaaagcccucacuccacuaauggagaauccuagccccacuaa

SEQ ID NO: 686234 - RNA, 64 nt, hsa
uccaacguuugccaucuggaugacaaacggaagauccacuaaaacguccacgggauuaacagaa

SEQ ID NO: 686235 - RNA, 64 nt, hsa
uaucugauucuucaccaccguauucucagucacuuccacuaaacagugccaguguuuuaagguu

SEQ ID NO: 686236 - RNA, 64 nt, hsa
gcuuaguugauguguguguguguguucugauuacuccacuaacugaugguuccccaucucucuc

SEQ ID NO: 686237 - RNA, 64 nt, hsa
uuuaccuuaaauaacugaaaugaauuaagccuucauagcguauuuuccuugaagcauuuaaauu

SEQ ID NO: 686238 - RNA, 64 nt, hsa
cauugaaaauuugaaagguaaaaaucuuauuuuaauagcguauuuuguguuggcuauuagagag

SEQ ID NO: 686239 - RNA, 64 nt, hsa
ccuugcacuuuuugaaucucucuuuuuauguaaaauagcguagaugcaucucugcguauuuuca

SEQ ID NO: 686240 - RNA, 64 nt, hsa
gagaggacggguggauauuucaaauuuuuuuaguauagcguaucgcaaggguuugacacggcug

SEQ ID NO: 686241 - RNA, 64 nt, hsa
accagcugcugcagauauauaacucaaaacagauauagcguauaaagauauaguaaaugcaucu

SEQ ID NO: 686242 - RNA, 64 nt, hsa
caaacagaccaaaugcccaggagcccaugaaguaauagcguaaaguaaaguaugauauggaaau

SEQ ID NO: 686243 - RNA, 64 nt, hsa
caaaauacauggaugcccaaguccucagcuaaaaauagcguaguauuugcauauaaccuaugca

SEQ ID NO: 686244 - RNA, 64 nt, hsa
aagaacaguguggcaugaucagacuucuaauugaauagcguaacaacaguguuuguaauuauag

SEQ ID NO: 686245 - RNA, 64 nt, hsa
aaauuaaaaacaguauuugggggagaaacgugcaauagcguaaugguggugucccugccaauuc

SEQ ID NO: 686246 - RNA, 64 nt, hsa
uguuuuacucuuuuacacuguauaauuguaagaaauagcguauuauuugugaaugcauggucug

SEQ ID NO: 686247 - RNA, 64 nt, hsa
aaaaaaaauaaagggauauggcuguuguagaaagauagcguauuugcauuuacaauaacaguag

SEQ ID NO: 686248 - RNA, 64 nt, hsa
acuccugauuaaauauuacaaauuuguucaguucauagcguagacugcuaaauacuguaauguu

SEQ ID NO: 686249 - RNA, 64 nt, hsa
aaaagaacauuuagaauucuauagagucaaaacuauagcguaaugcuguguuuauuaagccagg

SEQ ID NO: 686250 - RNA, 64 nt, hsa
cauguacauaagaauugacacaggaaccuacugaauagcguagauauaggaaggcaggaugguu

SEQ ID NO: 686251 - RNA, 64 nt, hsa
gcuaaaauaaucuuucauaaagagaccucaguuuauagcguaacagacuacacaaugcacugau

SEQ ID NO: 686252 - RNA, 64 nt, hsa
uguuuuaguuuaaugucuccuaagcuuuucucucauagcguagaccuagggaagggaugggaag

SEQ ID NO: 686253 - RNA, 64 nt, hsa
acaaauacuggauauuagcaguuuauuuaugaaaauagcguauuaucacuugucaaaucauuga

SEQ ID NO: 686254 - RNA, 64 nt, hsa
cagccccucuucccucccacaugguuuaacuguaauagcguaccgcacgggucacagccuggua

SEQ ID NO: 686255 - RNA, 64 nt, hsa
aauaaguggucucuuuuuagcagagcaaaaaaauauagcguaaauacuuauuuuuuuuaaaaac

SEQ ID NO: 686256 - RNA, 64 nt, hsa
agaggagucgggagucgagacucgagauuccaucauagcguaggugugugggguugggagcccc

SEQ ID NO: 686257 - RNA, 64 nt, hsa
guuauagcaauacucaaauggaaaaaacuucaugauagcguaaguuuggaaaguuuagcaaaau

SEQ ID NO: 686258 - RNA, 64 nt, hsa
uucauuacccugggcaauuuaaagaaaucauaucauagcguaguucagauacuaaaauuugaag

SEQ ID NO: 686259 - RNA, 64 nt, hsa
cagaagugcuauacgguuaggucuguuugugcucagucaagaacuaagaaauaguaugaauugu

SEQ ID NO: 686260 - RNA, 64 nt, hsa
cucagucaagaacuaagaaauaguaugaauuguaagucaagaugggcaacucagauggagcagc

SEQ ID NO: 686261 - RNA, 64 nt, hsa
auaaauccuuaggagaaauauucccucaaaaccuagucaagaaagugccacauucccaccuucu

SEQ ID NO: 686262 - RNA, 64 nt, hsa
gcuuuaaugcauggaaaaacuucaguuacugaccagucaagagaauuucucaagaaaaauccca

SEQ ID NO: 686263 - RNA, 64 nt, hsa
ucucuaaccugugggcaagucuuuacccuucaguagucaagauuacguuagagacuucguccac

SEQ ID NO: 686264 - RNA, 64 nt, hsa
gaggcagugacuguugaaaaagcuugaauugaggagucaagagucacuaagcagaauuuagaaa

SEQ ID NO: 686265 - RNA, 64 nt, hsa
uaucaaagcaguaauaucuucucuggaggccuguugggugaauuuaauggaaucaaguuaagua

SEQ ID NO: 686266 - RNA, 64 nt, hsa
uuaccucuuuuucuguagaggcaccacagggaggugggugaagcacuucggcucuggaguuaca

SEQ ID NO: 686267 - RNA, 64 nt, hsa
cagugagccgagauugugcugcugcacuccagccugggugaaaaagacaggcugugucuccaaa

SEQ ID NO: 686268 - RNA, 64 nt, hsa
caguguacuugcaacagaggcuugggaugaagggugggugaaguugacaucacgauagaaaaca

SEQ ID NO: 686269 - RNA, 64 nt, hsa
cggcagaagggaacugccugggcucccuugugcgugggugaagccgcugcuggguuuuccuccg

SEQ ID NO: 686270 - RNA, 64 nt, hsa
gguuuuccuccgggagaggggacggucaauccugugggugaagacagagggaaacacagcagcu

SEQ ID NO: 686271 - RNA, 64 nt, hsa
gagacagcuugguucccuuucccuagcucccuggugggugaaugccaccuccugagauccucac

SEQ ID NO: 686272 - RNA, 64 nt, hsa
gguguggucagccucucucacacaaggaggaacuugggugaaggcugagugugaggcaccugaa

SEQ ID NO: 686273 - RNA, 64 nt, hsa; identical to SEQ ID NO: 332827

SEQ ID NO: 686274 - RNA, 64 nt, hsa; identical to SEQ ID NO: 332828

SEQ ID NO: 686275 - RNA, 64 nt, hsa; identical to SEQ ID NO: 332829

SEQ ID NO: 686276 - RNA, 64 nt, hsa; identical to SEQ ID NO: 332830

SEQ ID NO: 686277 - RNA, 64 nt, hsa; identical to SEQ ID NO: 332831

SEQ ID NO: 686278 - RNA, 64 nt, hsa; identical to SEQ ID NO: 332832

SEQ ID NO: 686279 - RNA, 64 nt, hsa; identical to SEQ ID NO: 229078

SEQ ID NO: 686280 - RNA, 64 nt, hsa; identical to SEQ ID NO: 229079

SEQ ID NO: 686281 - RNA, 64 nt, hsa; identical to SEQ ID NO: 417262

SEQ ID NO: 686282 - RNA, 64 nt, hsa; identical to SEQ ID NO: 417263

SEQ ID NO: 686283 - RNA, 64 nt, hsa; identical to SEQ ID NO: 417264

SEQ ID NO: 686284 - RNA, 64 nt, hsa; identical to SEQ ID NO: 417265

SEQ ID NO: 686285 - RNA, 64 nt, hsa; identical to SEQ ID NO: 417266

SEQ ID NO: 686286 - RNA, 64 nt, hsa; identical to SEQ ID NO: 417267

SEQ ID NO: 686287 - RNA, 64 nt, hsa; identical to SEQ ID NO: 417268

SEQ ID NO: 686288 - RNA, 64 nt, hsa; identical to SEQ ID NO: 417269

SEQ ID NO: 686289 - RNA, 64 nt, hsa; identical to SEQ ID NO: 417270

SEQ ID NO: 686290 - RNA, 64 nt, hsa; identical to SEQ ID NO: 417271

SEQ ID NO: 686291 - RNA, 64 nt, hsa; identical to SEQ ID NO: 417272

SEQ ID NO: 686292 - RNA, 64 nt, hsa; identical to SEQ ID NO: 417273

SEQ ID NO: 686293 - RNA, 64 nt, hsa
ugucagcccuucugagacaggaccuggcuucaggacuguggacugggcugcuggccugcuugcu

SEQ ID NO: 686294 - RNA, 64 nt, hsa
accccaaaaugaaaguuauagaaagcugucuacaacuguggaguugguagcugguaacauuguu

SEQ ID NO: 686295 - RNA, 64 nt, hsa
gaaucaguuuugaccuugaugauuuuuuguuuccacuguggaaauaaauguuuguaaauaagug

SEQ ID NO: 686296 - RNA, 64 nt, hsa
uacaugcuuauuccuuaagggauguguuagaguuacuguggauuucucuguuuucugucuuaca

SEQ ID NO: 686297 - RNA, 64 nt, hsa
ggucauugucucguggccagagggcccagcagccacuguggaccuggggcguucuggggcugca

SEQ ID NO: 686298 - RNA, 64 nt, hsa
uggaccuggggcguucuggggcugcagaagacugacuguggaugugccauuugccaggaaggua

SEQ ID NO: 686299 - RNA, 64 nt, hsa
gggaagugacgaccgcugggagaacaucaggugcacuguggacgugggucugggggucucaccc

SEQ ID NO: 686300 - RNA, 64 nt, hsa
aacuuaaaauuuagucgaggcaguuucaauuguuacuguggaccgaauuaggaucacaauaaac

SEQ ID NO: 686301 - RNA, 64 nt, hsa
uggcaguaugaccagaaucauggaauuugcuagaacuguggaagcuucuacuccugcaguaagc

SEQ ID NO: 686302 - RNA, 64 nt, hsa
uauaucccugguaguuuuguguuaaccacugauaacuguggaaagagcuaggucuacugauaua

SEQ ID NO: 686303 - RNA, 64 nt, hsa
ccuuccccuaggucuucagaagcaucaaguuuuaacuguggacauuggauuugguggaacagca

SEQ ID NO: 686304 - RNA, 64 nt, hsa
gguguugcugcguggggagaacuugguauccaugacuguggaggggccaccccccaaagaugua

SEQ ID NO: 686305 - RNA, 64 nt, hsa
ccuuccccucaccacgagcucccggccugcccagacuguggacacuggccgugcccaaugagac

SEQ ID NO: 686306 - RNA, 64 nt, hsa
cccccucuccugcaccucccuggcccugccggccacuguggacgcccuggggcuuggcacccac

SEQ ID NO: 686307 - RNA, 64 nt, hsa
aagcaaaacagacccuaauuuuuuugugccaaaaacuguggacaugcuggcucagcauccucag

SEQ ID NO: 686308 - RNA, 64 nt, hsa
gaauuguggaucgugcagccaugguuauuguggaacuguggaaccugcagccauaguuauuuga

SEQ ID NO: 686309 - RNA, 64 nt, hsa
aggaccccagagagggcaggcagccacgcccugcacuguggagaagugaccugguccuaagcug

SEQ ID NO: 686310 - RNA, 64 nt, hsa
agcgucccggcgccuccguuagggcugcccaaacacuguggaaaggggacuuggggagcauuuu

SEQ ID NO: 686311 - RNA, 64 nt, hsa
uuauugauacuauuuuuuuuucuuuuaauguuguacuguggagaaaaacuauuuugagccaugg

SEQ ID NO: 686312 - RNA, 64 nt, hsa
ggaggggugccuccugacagcuuccaaagagcugacuguggagggcccacaguguaucccaccc

SEQ ID NO: 686313 - RNA, 64 nt, hsa
aauacauacuuucugaaugaccaaccgucccuggacuguggaauguuccggccugcauuucugc

SEQ ID NO: 686314 - RNA, 64 nt, hsa
gccugacuacucagaguacaaggaguucaagcugacuguggagaacaucggcuaccagaugcug

SEQ ID NO: 686315 - RNA, 64 nt, hsa
uauauuguuauuuauugugacaaaaggaaauaaaaagccuaaauguucagaaaauuauuuuaaa

SEQ ID NO: 686316 - RNA, 64 nt, hsa
cugguugaaggugaaagugugcuauggccuuuucaagccuaagaagucucucuuacugaguaaa

SEQ ID NO: 686317 - RNA, 64 nt, hsa
caucaguccuuccuuccuaaucucuaauccccugaagccuaacacaguuccuaauguguuuugc

SEQ ID NO: 686318 - RNA, 64 nt, hsa
guagggcugugguuuacuccugucuaaaccccugaagccuaacacaguuccuggcacacaacag

SEQ ID NO: 686319 - RNA, 64 nt, hsa
uauaauuauacaaguaaugccaaaaaccaagucaaagccuaauuaaccaaagcacucauuuaaa

SEQ ID NO: 686320 - RNA, 64 nt, hsa
gaugaacauuucaguagguucucaacuuaaaauuaagccuaaccuaaaacugccagcaacacaa

SEQ ID NO: 686321 - RNA, 64 nt, hsa
ugcagacggugugguugggggugggaggugagcuagacccaacccuuagcuuuuagccuggcug

SEQ ID NO: 686322 - RNA, 64 nt, hsa
uucuugucaccccaguucccuugguggcaaccccagacccaacccaugccccugacagaucuag

SEQ ID NO: 686323 - RNA, 64 nt, hsa
cuccacucuggcuuguuuucagaaccuaaaaagcagacccaaguuuccuuucuccuccgccgca

SEQ ID NO: 686324 - RNA, 64 nt, hsa
ugauacacaaccuucucuaaccaacuauauaucaagacccaaaaauugaagaaaaauauuguuu

SEQ ID NO: 686325 - RNA, 64 nt, hsa
ggaugacagacagggacgaagcagagaccucuacagacccaagucaccaaguggagccuuuuuu

SEQ ID NO: 686326 - RNA, 64 nt, hsa
uuucugacaaaggagccugcacauuugggugagcagacccaagcuguuuacagcucuuucuugu

SEQ ID NO: 686327 - RNA, 64 nt, hsa
uucugcucuggaagagaaggaacagggagcagagagacccaacugggagccagagauggaacuu

SEQ ID NO: 686328 - RNA, 64 nt, hsa
caggcgaagugucagcccucaauguuggguacuuagacccaaaccaauaaauggugaguuuuga

SEQ ID NO: 686329 - RNA, 64 nt, hsa
cgagacucugucucaaaacaaacaaacaaacaaaagacccaaucugagucuuaucguuguacug

SEQ ID NO: 686330 - RNA, 64 nt, hsa
ucuaaggcaugaauaagaggggaggucaaaauaaagacccaaucugaggccgggcacgguggcu

SEQ ID NO: 686331 - RNA, 64 nt, hsa
cccuacuucaaguacacuuccacaccaggaaaacagacccaaauuccauaaacagaacugacgu

SEQ ID NO: 686332 - RNA, 64 nt, hsa
cagaagggcaagagagguggaucugugagggaaaagacccaauaggauaacucaaguuacuggu

SEQ ID NO: 686333 - RNA, 64 nt, hsa
aacgcuugguuuuacaugaacaaaaaguggugugcucgaaaaagacauuacugaugccuuuuuu

SEQ ID NO: 686334 - RNA, 64 nt, hsa
aucuuuaaugaacuggagaacacuaagauuuaaacucgaaaauucguuguucaaguaaagaaag

SEQ ID NO: 686335 - RNA, 64 nt, hsa; identical to SEQ ID NO: 503603

SEQ ID NO: 686336 - RNA, 64 nt, hsa; identical to SEQ ID NO: 503604

SEQ ID NO: 686337 - RNA, 64 nt, hsa; identical to SEQ ID NO: 503605

SEQ ID NO: 686338 - RNA, 64 nt, hsa; identical to SEQ ID NO: 503606

SEQ ID NO: 686339 - RNA, 64 nt, hsa; identical to SEQ ID NO: 503607

SEQ ID NO: 686340 - RNA, 64 nt, hsa; identical to SEQ ID NO: 503608

SEQ ID NO: 686341 - RNA, 64 nt, hsa; identical to SEQ ID NO: 503609

SEQ ID NO: 686342 - RNA, 64 nt, hsa; identical to SEQ ID NO: 503610

SEQ ID NO: 686343 - RNA, 64 nt, hsa; identical to SEQ ID NO: 503611

SEQ ID NO: 686344 - RNA, 64 nt, hsa; identical to SEQ ID NO: 503612

SEQ ID NO: 686345 - RNA, 64 nt, hsa; identical to SEQ ID NO: 503613

SEQ ID NO: 686346 - RNA, 64 nt, hsa; identical to SEQ ID NO: 503614

SEQ ID NO: 686347 - RNA, 64 nt, hsa; identical to SEQ ID NO: 503615

SEQ ID NO: 686348 - RNA, 64 nt, hsa; identical to SEQ ID NO: 503616

SEQ ID NO: 686349 - RNA, 64 nt, hsa; identical to SEQ ID NO: 503617

SEQ ID NO: 686350 - RNA, 64 nt, hsa; identical to SEQ ID NO: 503618

SEQ ID NO: 686351 - RNA, 64 nt, hsa; identical to SEQ ID NO: 503619

SEQ ID NO: 686352 - RNA, 64 nt, hsa; identical to SEQ ID NO: 503620

SEQ ID NO: 686353 - RNA, 64 nt, hsa; identical to SEQ ID NO: 503621

SEQ ID NO: 686354 - RNA, 64 nt, hsa; identical to SEQ ID NO: 503622

SEQ ID NO: 686355 - RNA, 64 nt, hsa
cuuguuuacucaaaauacaaaaauuggcugggugcggugguacaugccuguagucccagcuacu

SEQ ID NO: 686356 - RNA, 64 nt, hsa
uuccuucgcccgcuaacaccacuccucuagaacucggugguaaugacugggaggucuauuccug

SEQ ID NO: 686357 - RNA, 64 nt, hsa
gcagacaaggaagaaaacuuaggggcugcucugacggugguaaacaggcugucuauauccuugu

SEQ ID NO: 686358 - RNA, 64 nt, hsa
auaaugaugaugaugauggugguguugaugguggcggugguaggguggaggggagagaagaaga

SEQ ID NO: 686359 - RNA, 64 nt, hsa
cauguacaaugagauuuauaaucaugauacucuucggugguaguuucaaaagacacuacuaaua

SEQ ID NO: 686360 - RNA, 64 nt, hsa
gagcguucaccaagcugagccggagccauccuuucggugguaguuggggaaggcuaugcagauu

SEQ ID NO: 686361 - RNA, 64 nt, hsa
uuuaucguauauuuuuguccaagcgaugagcugacggugguauugcuucucugcauguuaucag

SEQ ID NO: 686362 - RNA, 64 nt, hsa
aguggacccuaagcaggccaagggugcguagggacggugguacccagaugcccaagucuuccag

SEQ ID NO: 686363 - RNA, 64 nt, hsa
uccuacccccaggguugaggggaccaagguggcacggugguacugggggugcggcagggacacc

SEQ ID NO: 686364 - RNA, 60 nt, hsa
agagaagcgagucuucuugaaggaggagaucggugguaaggucggaaacuagcuggagcu

SEQ ID NO: 686365 - RNA, 64 nt, hsa
cauuuugauggacaaaguggcacauccaguggagcggugguagauccugauagacauggggcuc

SEQ ID NO: 686366 - RNA, 64 nt, hsa
gccagccggcagcccgggccuuucucguucacaccggugguaucuaccccagaugccugccucu

SEQ ID NO: 686367 - RNA, 64 nt, hsa
gacauuuuucugcugcccauuuguguccuggagacggugguacccugaaggcagaggccagcug

SEQ ID NO: 686368 - RNA, 64 nt, hsa
uugagggcauguugcauauuguugaauuguauugcggugguaucaaccuggggggaggaggggc

SEQ ID NO: 686369 - RNA, 64 nt, hsa; identical to SEQ ID NO: 686367

SEQ ID NO: 686370 - RNA, 64 nt, hsa
gaaaauggccuuguugccuguguagagcaaguuacggugguacugccacucugcagguggagcg

SEQ ID NO: 686371 - RNA, 64 nt, hsa
ccaggguuucucugcagaugugcggagcgggaggcggugguagagagagauaaaagguggaguu

SEQ ID NO: 686372 - RNA, 64 nt, hsa
aggaccgaggugaugaguucacauacacuggaagcggugguaaaaaucuugcugguaacaaaag

SEQ ID NO: 686373 - RNA, 64 nt, hsa
cucagggcccauuucaucucuggcagugccuuggcggugguauucaaggcaguuuuguagcacc

SEQ ID NO: 686374 - RNA, 64 nt, hsa
augcccccucccccgacacagacucucaaucugccggugguaagaaccgguucugagcuggcgu

SEQ ID NO: 686375 - RNA, 64 nt, hsa
guaccgcccaggccuuaaucacccccauuccgugcggugguaucucccaggcucuacauucucg

SEQ ID NO: 686376 - RNA, 64 nt, hsa
cuucugcugggcuggggccugauggggagggucucggugguaccaggucuccuccaccgccaug

SEQ ID NO: 686377 - RNA, 64 nt, hsa
agugggugcaugugggaacucuucuuuagggcuucggugguaaucaucugggggcccugguuuu

SEQ ID NO: 686378 - RNA, 64 nt, hsa
ucuggaguuucucuaaagucacuagugaacaauucggugguaaaaguaccacacaaacuauggg

SEQ ID NO: 686379 - RNA, 64 nt, hsa
gggguggauucucgagguggaaguccgcacaugucggugguauuuauggcacgauuccuuugga

SEQ ID NO: 686380 - RNA, 64 nt, hsa
uggaacauuucuuucuugcuggcucugagaaucacggugguaaagaaaguguggguuugguuag

SEQ ID NO: 686381 - RNA, 64 nt, hsa
ucagggguuuggccaagaaucaucacgaaagggucggugguaaccagguugugguuuaaauggu

SEQ ID NO: 686382 - RNA, 64 nt, hsa
ggccauaucucacucugucacucaggcuggagugcggugguauaaucucagcucacugcaaucu

SEQ ID NO: 686383 - RNA, 64 nt, hsa
gucaccaaagugcccaacucuggcacggggcacgcggugguagaucccuuucuaaggucccuuc

SEQ ID NO: 686384 - RNA, 64 nt, hsa
auucaguuuaggcgcuggcccgaggauaucccagcggugguacuucggagacaccugucugcau

SEQ ID NO: 686385 - RNA, 64 nt, hsa
agggcuggaggccccggcggcuaggaggaggccucggugguaccagaagaggaggggcugaugu

SEQ ID NO: 686386 - RNA, 64 nt, hsa
acagaccauagacggaccccucguccucccccagcggugguagggggacccggggggcuccucc

SEQ ID NO: 686387 - RNA, 64 nt, hsa
auuaauggcugugacugaacacacgcggcccugacggugguauccaguuaacucaaaaccaaca

SEQ ID NO: 686388 - RNA, 64 nt, hsa
gaucucacuucccuuccgcuccaagcaccaguuccggugguacgggggaauaccagugaaauag

SEQ ID NO: 686389 - RNA, 64 nt, hsa
cuuuaaaauucgucucugauuugccagagaaaaacggugguagccauggaaaucgggagugaag

SEQ ID NO: 686390 - RNA, 64 nt, hsa
cacgcugcugugggcccgaguguguugcauguccacgcaccacccguucagggcccugaauaaa

SEQ ID NO: 686391 - RNA, 64 nt, hsa
gcgacgacgccaccaucaaagccuggcgcuccccacgcaccaugcgcguccuccaggcaccucg

SEQ ID NO: 686392 - RNA, 64 nt, hsa
augaagcccacucacuugccauuccagggccaaaggaccggagguuugcauauccgccccuugu

SEQ ID NO: 686393 - RNA, 64 nt, hsa
agaagcccguccuccuaugcugguggaaggcggaggaccggagucccugcagaaggccccgugc

SEQ ID NO: 686394 - RNA, 64 nt, hsa
cauccggcaacagucugaaaguacguggaggacgggaccggaagacgagagagggcuggacauc

SEQ ID NO: 686395 - RNA, 64 nt, hsa
cacccagggaugagcaguguccagugcaguaccuggaccggagcccccuccacagacacccgcg

SEQ ID NO: 686396 - RNA, 64 nt, hsa
acagagauaguccuggaagacacguggcgccuguggaccggaagcaccaaaugcuggugcugcu

SEQ ID NO: 686397 - RNA, 64 nt, hsa
ggccgggaacuguccgaggugcugagcuggggcgggaccggaauccucccgguaggguaccagg

SEQ ID NO: 686398 - RNA, 64 nt, hsa
ggcguuguggucuuugcauugggggaggggggagggaccggaugggcggggggagggggagggg

SEQ ID NO: 686399 - RNA, 64 nt, hsa
auaccaagaacauggaggccaagaaacucuccaaggaccggaugaagaaguacauggcaagaag

SEQ ID NO: 686400 - RNA, 64 nt, hsa
uuuuuuuuuaaaugaucauaagauggcccauuuuggaccggaacugucauugccagacagaauu

SEQ ID NO: 686401 - RNA, 64 nt, hsa
gguuaauuuuucacuccagugcguccuguugcagggaccggagcugaugggagcugcuucuccc

SEQ ID NO: 686402 - RNA, 64 nt, hsa
gcugcugcguggagcacuuaaaguccagccuccaggaccggaugccccuccugucucccgcucc

SEQ ID NO: 686403 - RNA, 64 nt, hsa
augcagggcccccacaggagcguguccuauccccggaccggacgcaugcagggcccccacagga

SEQ ID NO: 686404 - RNA, 64 nt, hsa
ugaacgaggccauugguacccucaccgccaggggggaccggaaugccuggguccccaccaugcu

SEQ ID NO: 686405 - RNA, 64 nt, hsa
cacuccuuuuuuucccauuguucuaucaucucuaggaccggaacuaccuucucuucugucauga

SEQ ID NO: 686406 - RNA, 64 nt, hsa
cagacaccgcucaucccgaucucuuccugucagaggaccggagaagugugagaaggugccccuu

SEQ ID NO: 686407 - RNA, 64 nt, hsa
ggggucaggccagauggggcaggaaggcuccgcaggaccggaccccuagaccacccugccccac

SEQ ID NO: 686408 - RNA, 64 nt, hsa
caucgaguugaacaggacuuaaacgaaucaucagggaccggauauuucuuauuucucauuugga

SEQ ID NO: 686409 - RNA, 64 nt, hsa
uggcucuuccucccagagcagccggcagcuaccuggaccggaaauguccucauccccucccugg

SEQ ID NO: 686410 - RNA, 64 nt, hsa
ccacccuggacugaaguucugcaaaguccuccgaggaccggaacacguuucugcgacccggggc

SEQ ID NO: 686411 - RNA, 64 nt, hsa
cgugacauccagcacuuggucagacccuagccagggaccggacaccugccccgcccaggcuggg

SEQ ID NO: 686412 - RNA, 64 nt, hsa
ugccuggcgggcagccccugcuggaccaaggugcggaccggagcggcugaggacggggcagagc

SEQ ID NO: 686413 - RNA, 64 nt, hsa
ugggcuccuagcgcucgaaagcccaacgccucccggaccggaccgccgaggggagcugggaccu

SEQ ID NO: 686414 - RNA, 64 nt, hsa
aagggggaagccggccagggagcgagcccagaacggaccggacgccugugcacccccagcccug

SEQ ID NO: 686415 - RNA, 64 nt, hsa
cuuucuuucagacccugccuaccugcaggcagauggaccggaggguuuucugcuuccuuucaac

SEQ ID NO: 686416 - RNA, 64 nt, hsa
aggagccccgccccuccugccgggggaggcccagggaccggagcauuucugcaaggcccuugug

SEQ ID NO: 686417 - RNA, 64 nt, hsa
gcguggaccgaggaggucuuugugcccugagcagggaccggauaacaccagaaagagggaugcu

SEQ ID NO: 686418 - RNA, 64 nt, hsa
uccugguggcccugaugcagaagaaccggcggaaggaccggaagcuaggggccagucucuucac

SEQ ID NO: 686419 - RNA, 64 nt, hsa
ucaaguuuggagccguuuccgugguuguagcagaggaccggagguuggguuccugauuaaacuu

SEQ ID NO: 686420 - RNA, 64 nt, hsa
uauggacuuggucugaugcugaaugggccacuugggaccggaagugacuugcuccagacaagag

SEQ ID NO: 686421 - RNA, 64 nt, hsa
caaacaggcaugggaaaauggaaggguugaggauggaccggagaauuggaacuucagaauaggu

SEQ ID NO: 686422 - RNA, 64 nt, hsa
ccacuucugcacuugcgguuccggcauggacaauggaccggagaguggggguggggggucccaa

SEQ ID NO: 686423 - RNA, 64 nt, hsa
uugucaauagccucuuccucacugaucuguaccgggaccggaaacuucuuggugcugaagguaa

SEQ ID NO: 686424 - RNA, 64 nt, hsa
ggcgcuccagggagcggagcaaggacaaggaccgggaccggaagcggcgaagcagccggagucg

SEQ ID NO: 686425 - RNA, 64 nt, hsa
uaggaacacgaagcacgaucaguccaucccagagggaccggaguuaugacaagcuuuccaaaua

SEQ ID NO: 686426 - RNA, 64 nt, hsa
uguuucuccuucaggauccgagcuaaaaucccagggaccggagcccuggccucugcagcagccg

SEQ ID NO: 686427 - RNA, 64 nt, hsa
ugacccacacuacccucccuugaccagcugucugggaccggaaaccagcuuugucuccagguag

SEQ ID NO: 686428 - RNA, 64 nt, hsa
uaucuacugagggccuggaggggccuggggcccgggaccggaggcugacgaggcuggacuuccu

SEQ ID NO: 686429 - RNA, 64 nt, hsa
guaaugccuaaucuauuuaucaaaacugacuacuggaccggagcccagaaaccaugggucaagu

SEQ ID NO: 686430 - RNA, 64 nt, hsa
ggguggacccacuggccugucagucucaauaaagggaccggaguccaguccugaacagcuuacu

SEQ ID NO: 686431 - RNA, 64 nt, hsa
agacguggugugagagggacggcucacagggcuuggaccggagagagauggcucaugaggcuug

SEQ ID NO: 686432 - RNA, 64 nt, hsa
cugagggagcucagggcaaaggccaggcuagcgcggaccggaaggggccgaggcugcacgggcc

SEQ ID NO: 686433 - RNA, 64 nt, hsa
uuuucucuagguugguaccugcuuaguggcauauggaccggaaaggguuaauuuaaaggggggg

SEQ ID NO: 686434 - RNA, 64 nt, hsa
ggggaggggacggggaaggaagaaagaauuuaaaggaccggaaugcgagaguccagguggccuu

SEQ ID NO: 686435 - RNA, 64 nt, hsa
gcacggccucaggcccccgagggacagucggccuggaccggaccucuccuuucgcccccacacc

SEQ ID NO: 686436 - RNA, 63 nt, hsa; identical to SEQ ID NO: 48774

SEQ ID NO: 686437 - RNA, 63 nt, hsa; identical to SEQ ID NO: 48775

SEQ ID NO: 686438 - RNA, 63 nt, hsa; identical to SEQ ID NO: 48776

SEQ ID NO: 686439 - RNA, 63 nt, hsa; identical to SEQ ID NO: 48777

SEQ ID NO: 686440 - RNA, 63 nt, hsa; identical to SEQ ID NO: 48778

SEQ ID NO: 686441 - RNA, 63 nt, hsa; identical to SEQ ID NO: 48779

SEQ ID NO: 686442 - RNA, 63 nt, hsa; identical to SEQ ID NO: 48780

SEQ ID NO: 686443 - RNA, 63 nt, hsa; identical to SEQ ID NO: 48781

SEQ ID NO: 686444 - RNA, 63 nt, hsa; identical to SEQ ID NO: 48782

SEQ ID NO: 686445 - RNA, 63 nt, hsa; identical to SEQ ID NO: 48783

SEQ ID NO: 686446 - RNA, 63 nt, hsa; identical to SEQ ID NO: 48784

SEQ ID NO: 686447 - RNA, 63 nt, hsa; identical to SEQ ID NO: 48785

SEQ ID NO: 686448 - RNA, 63 nt, hsa; identical to SEQ ID NO: 48786

SEQ ID NO: 686449 - RNA, 63 nt, hsa; identical to SEQ ID NO: 48787

SEQ ID NO: 686450 - RNA, 63 nt, hsa; identical to SEQ ID NO: 48788

SEQ ID NO: 686451 - RNA, 64 nt, hsa
gaugccucaucagaacaugcuguugaguccaaugugccauaagacauuuuagcauguuaaauag

SEQ ID NO: 686452 - RNA, 64 nt, hsa
uggauuuugcaugagugaguauaguaacccaagaugccauaaaaaaaaaacuugaucguuuucu

SEQ ID NO: 686453 - RNA, 64 nt, hsa
aggaaaaucauagguuaccauuuuauaacucuauugccauaagaaaauacacucuaaaaucuug

SEQ ID NO: 686454 - RNA, 64 nt, hsa
ugauaugcuguuaucaccacccccugcccucugcugccauaaucacacaaauuuaaaaagaaag

SEQ ID NO: 686455 - RNA, 64 nt, hsa
auagucaccugacuaagaaauucugacugcuaguugccauaaauaacucaauggaaauauuccu

SEQ ID NO: 686456 - RNA, 64 nt, hsa
aaaagagaauauacaugaagaauagaaacaagccugccauaauccuuuggaaaagauguauuau

SEQ ID NO: 686457 - RNA, 64 nt, hsa
cuuuauuauuuguuauuuuuuauuugcauugcuuugccauaagucuucccuugcuuguaucuuc

SEQ ID NO: 686458 - RNA, 64 nt, hsa
gcaaauguacugaaaggguaguucaagucuaaaaugccauaaccccuuuauuauuuguuauuuu

SEQ ID NO: 686459 - RNA, 64 nt, hsa
gaccauguuugagacucagaagaaugggccuuucugccauaauucuucacuagucaagaaugcc

SEQ ID NO: 686460 - RNA, 64 nt, hsa
ucaacaauggaucccgcuacaaucugaugaacucugccauaauagagauguuugaauuuauuag

SEQ ID NO: 686461 - RNA, 64 nt, hsa
aauaaaaagaaaaaaaaaacaaaaacaaacaggcugccauaauauauuuuuuuaauuuggcagg

SEQ ID NO: 686462 - RNA, 64 nt, hsa
aaaaaaauucugguugaagauagaggauaugaaaugccauaagacccaaucaaaugaagaaaua

SEQ ID NO: 686463 - RNA, 64 nt, hsa
guacaaauuugaguaaaugcaaguuugguuugaaugccauaauaaaaugauauaaacagugcuu

SEQ ID NO: 686464 - RNA, 64 nt, hsa
auauuuucuuagagaaugaccaaaucuccuuucuugccauaauuaacauuuaguaauuauguag

SEQ ID NO: 686465 - RNA, 64 nt, hsa
ccccaaaguguauuuuucucuaagucgagggcuaugccauaauacaaauggaaauguuaccuuu

SEQ ID NO: 686466 - RNA, 64 nt, hsa
aaggaacaaauuuccuuaggauuauaguauuacaugccauaaaauacuaugcuuuauugguccc

SEQ ID NO: 686467 - RNA, 64 nt, hsa
accccuguauaucuuagcagcacugaguccagugcgagcacacacccacuauacaagaguggcu

SEQ ID NO: 686468 - RNA, 64 nt, hsa
caauauaagugugauugcaagaaugguagaggaccgagcacagaaaucuuagagauuucuuguc

SEQ ID NO: 686469 - RNA, 64 nt, hsa
agggaagggcucuggcccugacuccgcugugucccgagcacacgugcugaccgcagcccgccgc

SEQ ID NO: 686470 - RNA, 64 nt, hsa
cccgcacgcugggcaccaacagagccacggagcgcgagcacaugcccgcccggggagcacaaug

SEQ ID NO: 686471 - RNA, 64 nt, hsa
agggauuaagcuaagaacuuacagaaugcaaacacgagcacacucucuucgaacccaauugugg

SEQ ID NO: 686472 - RNA, 64 nt, hsa
acccagcugccauaaccaccuuagaacuaccagacgagcacaucagaacccuuugacagccauc

SEQ ID NO: 686473 - RNA, 64 nt, hsa
acacuuaagacucccacccugugacacugagucccgagcacagcaccuucccagucuccugugc

SEQ ID NO: 686474 - RNA, 64 nt, hsa
accagcuggcccggccacucugaauugcgccuuccgagcacacauaaaagcacaaagacagaga

SEQ ID NO: 686475 - RNA, 64 nt, hsa
gauccauguguucagguuuagaucauaugacacucgagcacagaagaauaauuucaaggagguc

SEQ ID NO: 686476 - RNA, 64 nt, hsa
ccucagguuacucaggaaaaugcuccagcaugugcgagcacaugaccugagguugcaucauagc

SEQ ID NO: 686477 - RNA, 64 nt, hsa
gcaugcguacacaauucccuggccaagccuggcucgagcacaggaagcucaucugcguuuuggc

SEQ ID NO: 686478 - RNA, 64 nt, hsa
augacuuccugcucacagcccuggaguccuguuacgagcacauccagaaagaagacaugaggcu

SEQ ID NO: 686479 - RNA, 64 nt, hsa
caggaugcacagaaugggcaugaccuucagcucacgagcacaccuggagaaauucagaaccagg

SEQ ID NO: 686480 - RNA, 64 nt, hsa
ccugcaagcgucaggcacacagggacagacauggcgagcacagugcaggcccggggcccacggg

SEQ ID NO: 686481 - RNA, 64 nt, hsa
accacagugagagcuuuuucccuuugcuaaccaacgagcacacagaagaucuccagucacccca

SEQ ID NO: 686482 - RNA, 64 nt, hsa
uucuuuuuuauuacacuucgaauuuuaggguacacgagcacaacgugcagguuaguuacauaug

SEQ ID NO: 686483 - RNA, 64 nt, hsa
ucuaagaugaaagauuuuuacucuagaaacugugcgagcacaacacacacaauccuuucuaacu

SEQ ID NO: 686484 - RNA, 56 nt, hsa
gcguccagcccuaccuauagaagggccgagcacagcaaugcaaguaagugggcacc

SEQ ID NO: 686485 - RNA, 64 nt, hsa
gauacuagcaucugguauuuuauuuauuuugcagcgagcacaugaggaagcugagucuuucacc

SEQ ID NO: 686486 - RNA, 64 nt, hsa
cacguaaagccucaaaacacagcacacacacacacgagcacacacacacacacacacacgaaca

SEQ ID NO: 686487 - RNA, 64 nt, hsa
ccugcguuugccgagcgcuaugccccggacaaaacgagcacagugcugacccggcacagccagc

SEQ ID NO: 686488 - RNA, 64 nt, hsa
uaaagcuuggucggugaccuuugcauaccaucaacgagcacagcuaagaacagagugagagagg

SEQ ID NO: 686489 - RNA, 64 nt, hsa
cccagcuuuccgccugcacccgcgaggacgcgcgcgagcacacgcggcgccccgccaggccuua

SEQ ID NO: 686490 - RNA, 64 nt, hsa
cuuucuguuucuuaagggcacacacacgugcgugcgagcacacacacacauacgugcacagggu

SEQ ID NO: 686491 - RNA, 64 nt, hsa
uauccagaccugccuucuggaagcucaauuaucacgagcacaugguggaaaacgugggccggug

SEQ ID NO: 686492 - RNA, 64 nt, hsa
gcuacuugggcacacgccuguaguccaggccacucgagcacacaccuguaguaccagcuacucu

SEQ ID NO: 686493 - RNA, 64 nt, hsa
augucuucccucccccgaccccagccugucaguccgagcacagugcagguuuggcucugacuug

SEQ ID NO: 686494 - RNA, 64 nt, hsa
uucuugucgcuuccuaucaaaauauucagagacucgagcacagcacccagacuucaugcgcccg

SEQ ID NO: 686495 - RNA, 64 nt, hsa
gcugaugggacuggagggagcccacccuucagcacgagcacacugcaucucuccugugaguugg

SEQ ID NO: 686496 - RNA, 64 nt, hsa
augccacguccauccaccccaccccuuuucgucacgagcacaauggucuuacauuggauuuuug

SEQ ID NO: 686497 - RNA, 64 nt, hsa
ccagccagcugguccucugggaacagccagcucccgagcacagccgcacuccuguugacccugg

SEQ ID NO: 686498 - RNA, 64 nt, hsa
cucugcccgacaggcugaagugguaccuccuuagcgagcacaguggcuccguggaagaugacau

SEQ ID NO: 686499 - RNA, 64 nt, hsa
cagccccgcaucucccacugccaacagcugaagccgagcacagaccucccuuugcacgcuggaa

SEQ ID NO: 686500 - RNA, 64 nt, hsa
accagagccguuacuacacacaaaggcuauugaccgagcacauaccaugugccacacaccuuga

SEQ ID NO: 686501 - RNA, 64 nt, hsa
cauccucucccaggaccaggaguuuaugaccaggcgagcacaaauggcuaaaagccaagcuguc

SEQ ID NO: 686502 - RNA, 64 nt, hsa
agagauuaaaccaauuauaacuuauuagcagucgcgagcacauguucauauagucaauguaaaa

SEQ ID NO: 686503 - RNA, 64 nt, hsa
gcagaugcccacacagccagcacugacuuguguucgagcacagaacggauauaaucagucuggc

SEQ ID NO: 686504 - RNA, 64 nt, hsa
gccccugcuuccccacccccuccucaggcuccugcgagcacacccccacccccaaaucccuccc

SEQ ID NO: 686505 - RNA, 64 nt, hsa
uuacauuuuauaugugagcgagcaagccggcaagcgagcacaguauuauuucuccauccccucc

SEQ ID NO: 686506 - RNA, 64 nt, hsa
ucuuuccagguuuugaggacuugaggaagugggacgagcacauuucuauugucuucacuuggau

SEQ ID NO: 686507 - RNA, 64 nt, hsa
caggaugcuuuccaaagccaaucacuggggagaccgagcacagggaggaccaaggggaagggga

SEQ ID NO: 686508 - RNA, 64 nt, hsa
gacuccccucuuccucaaggguagaugagaggaacgagcacagagguuggcuguggguccuggg

SEQ ID NO: 686509 - RNA, 64 nt, hsa
aggucugcagaaccauagcuuccacgcaccugaacgagcacagaaugaacugacgguggaagac

SEQ ID NO: 686510 - RNA, 64 nt, hsa
uggugccaggaaagccacuggaauugucacacggcgagcacagagggccggccaccaguccucg

SEQ ID NO: 686511 - RNA, 64 nt, hsa
aaaagcuggauuugauuuuuuuuuucuggucacucgagcacaucuaagaucacccauuagguuu

SEQ ID NO: 686512 - RNA, 64 nt, hsa
acccgcuucccaccugcugcggucaccaugguggcgagcacagcaaccccagguguccagagca

SEQ ID NO: 686513 - RNA, 64 nt, hsa
ucaggaugaaccuggaggcccaccucaaggagugcgagcacaucaaaugcccccacuccaagua

SEQ ID NO: 686514 - RNA, 64 nt, hsa
gcuaaggccucgcugccagccuucugacggcgggcgagcacacggucucuuccccugccccaac

SEQ ID NO: 686515 - RNA, 64 nt, hsa
gcggaaacgccgugcaucucuugucuguuggcagcgagcacaucgugcuggagacacgaguuuc

SEQ ID NO: 686516 - RNA, 64 nt, hsa
auucccuuaacugacauuauuuagugucagaggccgagcacaguggcucccaccuauaauccua

SEQ ID NO: 686517 - RNA, 64 nt, hsa
uguucugggaauguuucagcagccaauaagugcccgagcacacugcccccgguugccugccugg

SEQ ID NO: 686518 - RNA, 64 nt, hsa
aaaugggagacuguuucucuggccucagaagaagcgagcacaggcugggguggaugacuuaugc

SEQ ID NO: 686519 - RNA, 64 nt, hsa
cacuggcuuuugccuguaagaaaaaaaauguacccgagcacauagagcuuuuuaauagcacuaa

SEQ ID NO: 686520 - RNA, 64 nt, hsa
caggcgaccagagcuggcuguacaggaauguccacgagcacagcaggugaucuugaggccuugc

SEQ ID NO: 686521 - RNA, 64 nt, hsa
gccgggaccgggaucgugaccgugaccgugaccgcgagcacaaacggggggagcggggcaguga

SEQ ID NO: 686522 - RNA, 64 nt, hsa
augugggaaacccuucauuuaccgccauucugcucgagcacaugaaaggaaucacacuguacag

SEQ ID NO: 686523 - RNA, 64 nt, hsa
agagaaggaaaggaaagagacggggcucugaggccgagcacaguggcccaugccuauaauccca

SEQ ID NO: 686524 - RNA, 64 nt, hsa
aauaagaucauguuuuaauugugagaaacagggccgagcacaguggcucacgccuguaauacca

SEQ ID NO: 686525 - RNA, 64 nt, hsa
aguggaccaagcaccaguggcuucagcgguggaccgagcacaggagcuggcuucggcgguggac

SEQ ID NO: 686526 - RNA, 64 nt, hsa
cugaagaaagaacuugaaccuauguuauaugauacgagcacaacuugagcuacaguaaacuaca

SEQ ID NO: 686527 - RNA, 64 nt, hsa
gugccauaauuuggcaaaugcuggccuuuauggacgagcacaauucgggggucagaccugguuc

SEQ ID NO: 686528 - RNA, 64 nt, hsa
cuaaacaucuuucuugccuuaugugccccauugagcuucacagugucaggcuggacgccgugau

SEQ ID NO: 686529 - RNA, 64 nt, hsa
acaaaggggccugcguuaaaaccuaauugcuaaugcuucacaacuaggagagcaugccgucuug

SEQ ID NO: 686530 - RNA, 64 nt, hsa
acaaacaacagugaaaaugcagcaucugucuccugcuucacagggucgacugucagggugaccg

SEQ ID NO: 686531 - RNA, 64 nt, hsa
uccuugccguucagccacugugaaaccagaaucugcuucacagaaaaaagcaucucaguuagga

SEQ ID NO: 686532 - RNA, 64 nt, hsa
aaagcuacucauagcgggggccuaaaaaaaaaaagcuucacaguacccaaacugcuuuuuccaa

SEQ ID NO: 686533 - RNA, 64 nt, hsa
auagauaugaaagcugauuuuuuuuaauuaccaugcuucacaauguuaaguuauauggggagca

SEQ ID NO: 686534 - RNA, 64 nt, hsa
aacugauaaaaaguagaugagacuucuccaagcugcuucacaagcaaacuaaccgaaaaaccga

SEQ ID NO: 686535 - RNA, 64 nt, hsa
gcaaacuaaccgaaaaaccgaaaauauacaaacagcuucacacacacacacacacacacacaca

SEQ ID NO: 686536 - RNA, 64 nt, hsa
cagucagaggaggacgugagccaguuugauacccgcuucacacggcagacgccgguggacaguc

SEQ ID NO: 686537 - RNA, 64 nt, hsa
gcccucagcgagagugccaaccaggccuuccugggcuucacauacguggcgccgucuguccugg

SEQ ID NO: 686538 - RNA, 64 nt, hsa; identical to SEQ ID NO: 85278

SEQ ID NO: 686539 - RNA, 64 nt, hsa; identical to SEQ ID NO: 85279

SEQ ID NO: 686540 - RNA, 64 nt, hsa; identical to SEQ ID NO: 85280

SEQ ID NO: 686541 - RNA, 64 nt, hsa; identical to SEQ ID NO: 85281

SEQ ID NO: 686542 - RNA, 64 nt, hsa; identical to SEQ ID NO: 85282

SEQ ID NO: 686543 - RNA, 64 nt, hsa; identical to SEQ ID NO: 85283

SEQ ID NO: 686544 - RNA, 64 nt, hsa; identical to SEQ ID NO: 85284

SEQ ID NO: 686545 - RNA, 64 nt, hsa; identical to SEQ ID NO: 85285

SEQ ID NO: 686546 - RNA, 64 nt, hsa; identical to SEQ ID NO: 85286

SEQ ID NO: 686547 - RNA, 64 nt, hsa; identical to SEQ ID NO: 85287

SEQ ID NO: 686548 - RNA, 64 nt, hsa; identical to SEQ ID NO: 85288

SEQ ID NO: 686549 - RNA, 64 nt, hsa; identical to SEQ ID NO: 85289

SEQ ID NO: 686550 - RNA, 64 nt, hsa; identical to SEQ ID NO: 85290

SEQ ID NO: 686551 - RNA, 64 nt, hsa; identical to SEQ ID NO: 85291

SEQ ID NO: 686552 - RNA, 64 nt, hsa; identical to SEQ ID NO: 300578

SEQ ID NO: 686553 - RNA, 64 nt, hsa; identical to SEQ ID NO: 300579

SEQ ID NO: 686554 - RNA, 64 nt, hsa; identical to SEQ ID NO: 300580

SEQ ID NO: 686555 - RNA, 64 nt, hsa; identical to SEQ ID NO: 300581

SEQ ID NO: 686556 - RNA, 64 nt, hsa; identical to SEQ ID NO: 300582

SEQ ID NO: 686557 - RNA, 64 nt, hsa; identical to SEQ ID NO: 300583

SEQ ID NO: 686558 - RNA, 64 nt, hsa; identical to SEQ ID NO: 300584

SEQ ID NO: 686559 - RNA, 64 nt, hsa; identical to SEQ ID NO: 300585

SEQ ID NO: 686560 - RNA, 64 nt, hsa; identical to SEQ ID NO: 300586

SEQ ID NO: 686561 - RNA, 64 nt, hsa; identical to SEQ ID NO: 300587

SEQ ID NO: 686562 - RNA, 64 nt, hsa; identical to SEQ ID NO: 300588

SEQ ID NO: 686563 - RNA, 64 nt, hsa; identical to SEQ ID NO: 300589

SEQ ID NO: 686564 - RNA, 64 nt, hsa; identical to SEQ ID NO: 300590

SEQ ID NO: 686565 - RNA, 64 nt, hsa; identical to SEQ ID NO: 300591

SEQ ID NO: 686566 - RNA, 64 nt, hsa; identical to SEQ ID NO: 300592

SEQ ID NO: 686567 - RNA, 64 nt, hsa; identical to SEQ ID NO: 300593

SEQ ID NO: 686568 - RNA, 64 nt, hsa; identical to SEQ ID NO: 124456

SEQ ID NO: 686569 - RNA, 64 nt, hsa; identical to SEQ ID NO: 124457

SEQ ID NO: 686570 - RNA, 64 nt, hsa; identical to SEQ ID NO: 156518

SEQ ID NO: 686571 - RNA, 64 nt, hsa; identical to SEQ ID NO: 156519

SEQ ID NO: 686572 - RNA, 64 nt, hsa; identical to SEQ ID NO: 156520

SEQ ID NO: 686573 - RNA, 64 nt, hsa; identical to SEQ ID NO: 156521

SEQ ID NO: 686574 - RNA, 64 nt, hsa; identical to SEQ ID NO: 236580

SEQ ID NO: 686575 - RNA, 64 nt, hsa; identical to SEQ ID NO: 236581

SEQ ID NO: 686576 - RNA, 64 nt, hsa; identical to SEQ ID NO: 236582

SEQ ID NO: 686577 - RNA, 64 nt, hsa; identical to SEQ ID NO: 236583

SEQ ID NO: 686578 - RNA, 64 nt, hsa; identical to SEQ ID NO: 236584

SEQ ID NO: 686579 - RNA, 64 nt, hsa; identical to SEQ ID NO: 236585

SEQ ID NO: 686580 - RNA, 64 nt, hsa; identical to SEQ ID NO: 236586

SEQ ID NO: 686581 - RNA, 64 nt, hsa; identical to SEQ ID NO: 236587

SEQ ID NO: 686582 - RNA, 64 nt, hsa; identical to SEQ ID NO: 236588

SEQ ID NO: 686583 - RNA, 64 nt, hsa; identical to SEQ ID NO: 236589

SEQ ID NO: 686584 - RNA, 64 nt, hsa; identical to SEQ ID NO: 236590

SEQ ID NO: 686585 - RNA, 64 nt, hsa; identical to SEQ ID NO: 236591

SEQ ID NO: 686586 - RNA, 64 nt, hsa; identical to SEQ ID NO: 236592

SEQ ID NO: 686587 - RNA, 64 nt, hsa; identical to SEQ ID NO: 236593

SEQ ID NO: 686588 - RNA, 64 nt, hsa; identical to SEQ ID NO: 236594

SEQ ID NO: 686589 - RNA, 64 nt, hsa; identical to SEQ ID NO: 236595

SEQ ID NO: 686590 - RNA, 64 nt, hsa; identical to SEQ ID NO: 236596

SEQ ID NO: 686591 - RNA, 64 nt, hsa; identical to SEQ ID NO: 236597

SEQ ID NO: 686592 - RNA, 64 nt, hsa; identical to SEQ ID NO: 236598

SEQ ID NO: 686593 - RNA, 64 nt, hsa; identical to SEQ ID NO: 236599

SEQ ID NO: 686594 - RNA, 64 nt, hsa; identical to SEQ ID NO: 236600

SEQ ID NO: 686595 - RNA, 64 nt, hsa; identical to SEQ ID NO: 236601

SEQ ID NO: 686596 - RNA, 64 nt, hsa; identical to SEQ ID NO: 236602

SEQ ID NO: 686597 - RNA, 64 nt, hsa; identical to SEQ ID NO: 236603

SEQ ID NO: 686598 - RNA, 64 nt, hsa; identical to SEQ ID NO: 236604

SEQ ID NO: 686599 - RNA, 64 nt, hsa; identical to SEQ ID NO: 236605

SEQ ID NO: 686600 - RNA, 64 nt, hsa; identical to SEQ ID NO: 236606

SEQ ID NO: 686601 - RNA, 64 nt, hsa; identical to SEQ ID NO: 236607

SEQ ID NO: 686602 - RNA, 64 nt, hsa; identical to SEQ ID NO: 236608

SEQ ID NO: 686603 - RNA, 64 nt, hsa; identical to SEQ ID NO: 236609

SEQ ID NO: 686604 - RNA, 64 nt, hsa; identical to SEQ ID NO: 236610

SEQ ID NO: 686605 - RNA, 64 nt, hsa; identical to SEQ ID NO: 236611

SEQ ID NO: 686606 - RNA, 64 nt, hsa; identical to SEQ ID NO: 236612

SEQ ID NO: 686607 - RNA, 64 nt, hsa; identical to SEQ ID NO: 236613

SEQ ID NO: 686608 - RNA, 64 nt, hsa; identical to SEQ ID NO: 236614

SEQ ID NO: 686609 - RNA, 64 nt, hsa; identical to SEQ ID NO: 236615

SEQ ID NO: 686610 - RNA, 64 nt, hsa; identical to SEQ ID NO: 236616

SEQ ID NO: 686611 - RNA, 64 nt, hsa; identical to SEQ ID NO: 236617

SEQ ID NO: 686612 - RNA, 64 nt, hsa; identical to SEQ ID NO: 236618

SEQ ID NO: 686613 - RNA, 64 nt, hsa; identical to SEQ ID NO: 236619

SEQ ID NO: 686614 - RNA, 64 nt, hsa; identical to SEQ ID NO: 439599

SEQ ID NO: 686615 - RNA, 64 nt, hsa; identical to SEQ ID NO: 439600

SEQ ID NO: 686616 - RNA, 64 nt, hsa; identical to SEQ ID NO: 439601

SEQ ID NO: 686617 - RNA, 64 nt, hsa; identical to SEQ ID NO: 439602

SEQ ID NO: 686618 - RNA, 64 nt, hsa; identical to SEQ ID NO: 439603

SEQ ID NO: 686619 - RNA, 64 nt, hsa; identical to SEQ ID NO: 439604

SEQ ID NO: 686620 - RNA, 64 nt, hsa; identical to SEQ ID NO: 439605

SEQ ID NO: 686621 - RNA, 64 nt, hsa; identical to SEQ ID NO: 439606

SEQ ID NO: 686622 - RNA, 64 nt, hsa; identical to SEQ ID NO: 439607

SEQ ID NO: 686623 - RNA, 64 nt, hsa; identical to SEQ ID NO: 439608

SEQ ID NO: 686624 - RNA, 64 nt, hsa; identical to SEQ ID NO: 439609

SEQ ID NO: 686625 - RNA, 64 nt, hsa; identical to SEQ ID NO: 439610

SEQ ID NO: 686626 - RNA, 64 nt, hsa; identical to SEQ ID NO: 439611

SEQ ID NO: 686627 - RNA, 64 nt, hsa; identical to SEQ ID NO: 439612

SEQ ID NO: 686628 - RNA, 64 nt, hsa; identical to SEQ ID NO: 439613

SEQ ID NO: 686629 - RNA, 64 nt, hsa; identical to SEQ ID NO: 439614

SEQ ID NO: 686630 - RNA, 64 nt, hsa; identical to SEQ ID NO: 439615

SEQ ID NO: 686631 - RNA, 64 nt, hsa; identical to SEQ ID NO: 439616

SEQ ID NO: 686632 - RNA, 64 nt, hsa; identical to SEQ ID NO: 439617

SEQ ID NO: 686633 - RNA, 64 nt, hsa; identical to SEQ ID NO: 439618

SEQ ID NO: 686634 - RNA, 64 nt, hsa; identical to SEQ ID NO: 439619

SEQ ID NO: 686635 - RNA, 64 nt, hsa; identical to SEQ ID NO: 439620

SEQ ID NO: 686636 - RNA, 64 nt, hsa; identical to SEQ ID NO: 439621

SEQ ID NO: 686637 - RNA, 64 nt, hsa; identical to SEQ ID NO: 439622

SEQ ID NO: 686638 - RNA, 64 nt, hsa; identical to SEQ ID NO: 439623

SEQ ID NO: 686639 - RNA, 64 nt, hsa; identical to SEQ ID NO: 439624

SEQ ID NO: 686640 - RNA, 64 nt, hsa; identical to SEQ ID NO: 439625

SEQ ID NO: 686641 - RNA, 64 nt, hsa; identical to SEQ ID NO: 439626

SEQ ID NO: 686642 - RNA, 64 nt, hsa; identical to SEQ ID NO: 439627

SEQ ID NO: 686643 - RNA, 64 nt, hsa; identical to SEQ ID NO: 439628

SEQ ID NO: 686644 - RNA, 64 nt, hsa; identical to SEQ ID NO: 439629

SEQ ID NO: 686645 - RNA, 64 nt, hsa; identical to SEQ ID NO: 439630

SEQ ID NO: 686646 - RNA, 64 nt, hsa; identical to SEQ ID NO: 439631

SEQ ID NO: 686647 - RNA, 64 nt, hsa; identical to SEQ ID NO: 439632

SEQ ID NO: 686648 - RNA, 58 nt, hsa; identical to SEQ ID NO: 439633

SEQ ID NO: 686649 - RNA, 64 nt, hsa; identical to SEQ ID NO: 439634

SEQ ID NO: 686650 - RNA, 64 nt, hsa; identical to SEQ ID NO: 439635

SEQ ID NO: 686651 - RNA, 64 nt, hsa; identical to SEQ ID NO: 439636

SEQ ID NO: 686652 - RNA, 64 nt, hsa; identical to SEQ ID NO: 439637

SEQ ID NO: 686653 - RNA, 64 nt, hsa; identical to SEQ ID NO: 439638

SEQ ID NO: 686654 - RNA, 64 nt, hsa; identical to SEQ ID NO: 439639

SEQ ID NO: 686655 - RNA, 64 nt, hsa; identical to SEQ ID NO: 439640

SEQ ID NO: 686656 - RNA, 64 nt, hsa; identical to SEQ ID NO: 439641

SEQ ID NO: 686657 - RNA, 64 nt, hsa; identical to SEQ ID NO: 439642

SEQ ID NO: 686658 - RNA, 64 nt, hsa; identical to SEQ ID NO: 439643

SEQ ID NO: 686659 - RNA, 50 nt, hsa; identical to SEQ ID NO: 439644

SEQ ID NO: 686660 - RNA, 64 nt, hsa; identical to SEQ ID NO: 439645

SEQ ID NO: 686661 - RNA, 64 nt, hsa; identical to SEQ ID NO: 439646

SEQ ID NO: 686662 - RNA, 64 nt, hsa; identical to SEQ ID NO: 439647

SEQ ID NO: 686663 - RNA, 64 nt, hsa; identical to SEQ ID NO: 439648

SEQ ID NO: 686664 - RNA, 64 nt, hsa; identical to SEQ ID NO: 439649

SEQ ID NO: 686665 - RNA, 64 nt, hsa; identical to SEQ ID NO: 439650

SEQ ID NO: 686666 - RNA, 64 nt, hsa; identical to SEQ ID NO: 439651

SEQ ID NO: 686667 - RNA, 64 nt, hsa; identical to SEQ ID NO: 439652

SEQ ID NO: 686668 - RNA, 64 nt, hsa; identical to SEQ ID NO: 439653

SEQ ID NO: 686669 - RNA, 64 nt, hsa; identical to SEQ ID NO: 439654

SEQ ID NO: 686670 - RNA, 64 nt, hsa; identical to SEQ ID NO: 439655

SEQ ID NO: 686671 - RNA, 64 nt, hsa; identical to SEQ ID NO: 439656

SEQ ID NO: 686672 - RNA, 64 nt, hsa; identical to SEQ ID NO: 439657

SEQ ID NO: 686673 - RNA, 64 nt, hsa; identical to SEQ ID NO: 439658

SEQ ID NO: 686674 - RNA, 64 nt, hsa; identical to SEQ ID NO: 439659

SEQ ID NO: 686675 - RNA, 64 nt, hsa; identical to SEQ ID NO: 439660

SEQ ID NO: 686676 - RNA, 57 nt, hsa; identical to SEQ ID NO: 439661

SEQ ID NO: 686677 - RNA, 57 nt, hsa; identical to SEQ ID NO: 439662

SEQ ID NO: 686678 - RNA, 64 nt, hsa; identical to SEQ ID NO: 439663

SEQ ID NO: 686679 - RNA, 64 nt, hsa; identical to SEQ ID NO: 47016

SEQ ID NO: 686680 - RNA, 64 nt, hsa; identical to SEQ ID NO: 47017

SEQ ID NO: 686681 - RNA, 64 nt, hsa; identical to SEQ ID NO: 47018

SEQ ID NO: 686682 - RNA, 64 nt, hsa; identical to SEQ ID NO: 47019

SEQ ID NO: 686683 - RNA, 64 nt, hsa; identical to SEQ ID NO: 47020

SEQ ID NO: 686684 - RNA, 64 nt, hsa; identical to SEQ ID NO: 47021

SEQ ID NO: 686685 - RNA, 64 nt, hsa; identical to SEQ ID NO: 47022

SEQ ID NO: 686686 - RNA, 64 nt, hsa; identical to SEQ ID NO: 47023

SEQ ID NO: 686687 - RNA, 64 nt, hsa; identical to SEQ ID NO: 47024

SEQ ID NO: 686688 - RNA, 64 nt, hsa; identical to SEQ ID NO: 47025

SEQ ID NO: 686689 - RNA, 64 nt, hsa; identical to SEQ ID NO: 47026

SEQ ID NO: 686690 - RNA, 64 nt, hsa; identical to SEQ ID NO: 47027

SEQ ID NO: 686691 - RNA, 64 nt, hsa; identical to SEQ ID NO: 47028

SEQ ID NO: 686692 - RNA, 64 nt, hsa; identical to SEQ ID NO: 47029

SEQ ID NO: 686693 - RNA, 64 nt, hsa; identical to SEQ ID NO: 47030

SEQ ID NO: 686694 - RNA, 64 nt, hsa; identical to SEQ ID NO: 47031

SEQ ID NO: 686695 - RNA, 64 nt, hsa; identical to SEQ ID NO: 47032

SEQ ID NO: 686696 - RNA, 64 nt, hsa; identical to SEQ ID NO: 47033

SEQ ID NO: 686697 - RNA, 64 nt, hsa; identical to SEQ ID NO: 47034

SEQ ID NO: 686698 - RNA, 64 nt, hsa; identical to SEQ ID NO: 47035

SEQ ID NO: 686699 - RNA, 64 nt, hsa; identical to SEQ ID NO: 47036

SEQ ID NO: 686700 - RNA, 64 nt, hsa; identical to SEQ ID NO: 47037

SEQ ID NO: 686701 - RNA, 64 nt, hsa; identical to SEQ ID NO: 47038

SEQ ID NO: 686702 - RNA, 64 nt, hsa; identical to SEQ ID NO: 47039

SEQ ID NO: 686703 - RNA, 64 nt, hsa; identical to SEQ ID NO: 47040

SEQ ID NO: 686704 - RNA, 64 nt, hsa; identical to SEQ ID NO: 47041

SEQ ID NO: 686705 - RNA, 64 nt, hsa; identical to SEQ ID NO: 47042

SEQ ID NO: 686706 - RNA, 64 nt, hsa; identical to SEQ ID NO: 47043

SEQ ID NO: 686707 - RNA, 64 nt, hsa; identical to SEQ ID NO: 47044

SEQ ID NO: 686708 - RNA, 64 nt, hsa; identical to SEQ ID NO: 47045

SEQ ID NO: 686709 - RNA, 64 nt, hsa; identical to SEQ ID NO: 47046

SEQ ID NO: 686710 - RNA, 64 nt, hsa; identical to SEQ ID NO: 47047

SEQ ID NO: 686711 - RNA, 64 nt, hsa; identical to SEQ ID NO: 47048

SEQ ID NO: 686712 - RNA, 64 nt, hsa; identical to SEQ ID NO: 47049

SEQ ID NO: 686713 - RNA, 64 nt, hsa; identical to SEQ ID NO: 47050

SEQ ID NO: 686714 - RNA, 64 nt, hsa; identical to SEQ ID NO: 47051

SEQ ID NO: 686715 - RNA, 64 nt, hsa; identical to SEQ ID NO: 47052

SEQ ID NO: 686716 - RNA, 64 nt, hsa; identical to SEQ ID NO: 47053

SEQ ID NO: 686717 - RNA, 64 nt, hsa; identical to SEQ ID NO: 47054

SEQ ID NO: 686718 - RNA, 51 nt, hsa; identical to SEQ ID NO: 47055

SEQ ID NO: 686719 - RNA, 64 nt, hsa; identical to SEQ ID NO: 47056

SEQ ID NO: 686720 - RNA, 64 nt, hsa; identical to SEQ ID NO: 47057

SEQ ID NO: 686721 - RNA, 64 nt, hsa; identical to SEQ ID NO: 47058

SEQ ID NO: 686722 - RNA, 64 nt, hsa; identical to SEQ ID NO: 47059

SEQ ID NO: 686723 - RNA, 64 nt, hsa; identical to SEQ ID NO: 47060

SEQ ID NO: 686724 - RNA, 64 nt, hsa; identical to SEQ ID NO: 47061

SEQ ID NO: 686725 - RNA, 64 nt, hsa; identical to SEQ ID NO: 47062

SEQ ID NO: 686726 - RNA, 64 nt, hsa; identical to SEQ ID NO: 47063

SEQ ID NO: 686727 - RNA, 64 nt, hsa; identical to SEQ ID NO: 47064

SEQ ID NO: 686728 - RNA, 64 nt, hsa; identical to SEQ ID NO: 47065

SEQ ID NO: 686729 - RNA, 64 nt, hsa; identical to SEQ ID NO: 47066

SEQ ID NO: 686730 - RNA, 64 nt, hsa; identical to SEQ ID NO: 47067

SEQ ID NO: 686731 - RNA, 64 nt, hsa; identical to SEQ ID NO: 47068

SEQ ID NO: 686732 - RNA, 64 nt, hsa; identical to SEQ ID NO: 47069

SEQ ID NO: 686733 - RNA, 64 nt, hsa; identical to SEQ ID NO: 47070

SEQ ID NO: 686734 - RNA, 64 nt, hsa; identical to SEQ ID NO: 47071

SEQ ID NO: 686735 - RNA, 64 nt, hsa; identical to SEQ ID NO: 47072

SEQ ID NO: 686736 - RNA, 64 nt, hsa; identical to SEQ ID NO: 47073

SEQ ID NO: 686737 - RNA, 64 nt, hsa; identical to SEQ ID NO: 47074

SEQ ID NO: 686738 - RNA, 64 nt, hsa; identical to SEQ ID NO: 47075

SEQ ID NO: 686739 - RNA, 64 nt, hsa; identical to SEQ ID NO: 47076

SEQ ID NO: 686740 - RNA, 64 nt, hsa; identical to SEQ ID NO: 47077

SEQ ID NO: 686741 - RNA, 64 nt, hsa; identical to SEQ ID NO: 47078

SEQ ID NO: 686742 - RNA, 64 nt, hsa; identical to SEQ ID NO: 47079

SEQ ID NO: 686743 - RNA, 64 nt, hsa; identical to SEQ ID NO: 47080

SEQ ID NO: 686744 - RNA, 64 nt, hsa; identical to SEQ ID NO: 47081

SEQ ID NO: 686745 - RNA, 64 nt, hsa; identical to SEQ ID NO: 47082

SEQ ID NO: 686746 - RNA, 64 nt, hsa; identical to SEQ ID NO: 47083

SEQ ID NO: 686747 - RNA, 64 nt, hsa; identical to SEQ ID NO: 360611

SEQ ID NO: 686748 - RNA, 64 nt, hsa; identical to SEQ ID NO: 360612

SEQ ID NO: 686749 - RNA, 64 nt, hsa; identical to SEQ ID NO: 360613

SEQ ID NO: 686750 - RNA, 64 nt, hsa; identical to SEQ ID NO: 360614

SEQ ID NO: 686751 - RNA, 64 nt, hsa; identical to SEQ ID NO: 360615

SEQ ID NO: 686752 - RNA, 64 nt, hsa; identical to SEQ ID NO: 360616

SEQ ID NO: 686753 - RNA, 64 nt, hsa; identical to SEQ ID NO: 360617

SEQ ID NO: 686754 - RNA, 64 nt, hsa; identical to SEQ ID NO: 360618

SEQ ID NO: 686755 - RNA, 64 nt, hsa; identical to SEQ ID NO: 360619

SEQ ID NO: 686756 - RNA, 64 nt, hsa; identical to SEQ ID NO: 360620

SEQ ID NO: 686757 - RNA, 64 nt, hsa; identical to SEQ ID NO: 360621

SEQ ID NO: 686758 - RNA, 64 nt, hsa; identical to SEQ ID NO: 360622

SEQ ID NO: 686759 - RNA, 64 nt, hsa; identical to SEQ ID NO: 360623

SEQ ID NO: 686760 - RNA, 64 nt, hsa; identical to SEQ ID NO: 360624

SEQ ID NO: 686761 - RNA, 64 nt, hsa; identical to SEQ ID NO: 360625

SEQ ID NO: 686762 - RNA, 64 nt, hsa; identical to SEQ ID NO: 360626

SEQ ID NO: 686763 - RNA, 64 nt, hsa; identical to SEQ ID NO: 360627

SEQ ID NO: 686764 - RNA, 64 nt, hsa; identical to SEQ ID NO: 360628

SEQ ID NO: 686765 - RNA, 64 nt, hsa; identical to SEQ ID NO: 360629

SEQ ID NO: 686766 - RNA, 64 nt, hsa; identical to SEQ ID NO: 360630

SEQ ID NO: 686767 - RNA, 64 nt, hsa; identical to SEQ ID NO: 360631

SEQ ID NO: 686768 - RNA, 64 nt, hsa; identical to SEQ ID NO: 360632

SEQ ID NO: 686769 - RNA, 64 nt, hsa; identical to SEQ ID NO: 360633

SEQ ID NO: 686770 - RNA, 64 nt, hsa; identical to SEQ ID NO: 360634

SEQ ID NO: 686771 - RNA, 64 nt, hsa; identical to SEQ ID NO: 360635

SEQ ID NO: 686772 - RNA, 64 nt, hsa; identical to SEQ ID NO: 360636

SEQ ID NO: 686773 - RNA, 64 nt, hsa; identical to SEQ ID NO: 360637

SEQ ID NO: 686774 - RNA, 64 nt, hsa; identical to SEQ ID NO: 360638

SEQ ID NO: 686775 - RNA, 64 nt, hsa; identical to SEQ ID NO: 159774

SEQ ID NO: 686776 - RNA, 64 nt, hsa; identical to SEQ ID NO: 159775

SEQ ID NO: 686777 - RNA, 64 nt, hsa; identical to SEQ ID NO: 159776

SEQ ID NO: 686778 - RNA, 64 nt, hsa; identical to SEQ ID NO: 159777

SEQ ID NO: 686779 - RNA, 64 nt, hsa; identical to SEQ ID NO: 159778

SEQ ID NO: 686780 - RNA, 64 nt, hsa; identical to SEQ ID NO: 159779

SEQ ID NO: 686781 - RNA, 64 nt, hsa; identical to SEQ ID NO: 159780

SEQ ID NO: 686782 - RNA, 64 nt, hsa; identical to SEQ ID NO: 159781

SEQ ID NO: 686783 - RNA, 64 nt, hsa; identical to SEQ ID NO: 159782

SEQ ID NO: 686784 - RNA, 64 nt, hsa; identical to SEQ ID NO: 159783

SEQ ID NO: 686785 - RNA, 64 nt, hsa; identical to SEQ ID NO: 159784

SEQ ID NO: 686786 - RNA, 64 nt, hsa; identical to SEQ ID NO: 159785

SEQ ID NO: 686787 - RNA, 64 nt, hsa; identical to SEQ ID NO: 159786

SEQ ID NO: 686788 - RNA, 64 nt, hsa; identical to SEQ ID NO: 159787

SEQ ID NO: 686789 - RNA, 64 nt, hsa; identical to SEQ ID NO: 159788

SEQ ID NO: 686790 - RNA, 64 nt, hsa; identical to SEQ ID NO: 159789

SEQ ID NO: 686791 - RNA, 64 nt, hsa; identical to SEQ ID NO: 159790

SEQ ID NO: 686792 - RNA, 64 nt, hsa; identical to SEQ ID NO: 159791

SEQ ID NO: 686793 - RNA, 64 nt, hsa; identical to SEQ ID NO: 159792

SEQ ID NO: 686794 - RNA, 64 nt, hsa; identical to SEQ ID NO: 159793

SEQ ID NO: 686795 - RNA, 64 nt, hsa; identical to SEQ ID NO: 159794

SEQ ID NO: 686796 - RNA, 64 nt, hsa; identical to SEQ ID NO: 159795

SEQ ID NO: 686797 - RNA, 64 nt, hsa; identical to SEQ ID NO: 159796

SEQ ID NO: 686798 - RNA, 64 nt, hsa; identical to SEQ ID NO: 159797

SEQ ID NO: 686799 - RNA, 64 nt, hsa; identical to SEQ ID NO: 159798

SEQ ID NO: 686800 - RNA, 64 nt, hsa; identical to SEQ ID NO: 159799

SEQ ID NO: 686801 - RNA, 64 nt, hsa; identical to SEQ ID NO: 159800

SEQ ID NO: 686802 - RNA, 64 nt, hsa; identical to SEQ ID NO: 159801

SEQ ID NO: 686803 - RNA, 64 nt, hsa; identical to SEQ ID NO: 159802

SEQ ID NO: 686804 - RNA, 64 nt, hsa; identical to SEQ ID NO: 159803

SEQ ID NO: 686805 - RNA, 64 nt, hsa; identical to SEQ ID NO: 159804

SEQ ID NO: 686806 - RNA, 64 nt, hsa; identical to SEQ ID NO: 159805

SEQ ID NO: 686807 - RNA, 64 nt, hsa; identical to SEQ ID NO: 159806

SEQ ID NO: 686808 - RNA, 64 nt, hsa; identical to SEQ ID NO: 159807

SEQ ID NO: 686809 - RNA, 64 nt, hsa; identical to SEQ ID NO: 159808

SEQ ID NO: 686810 - RNA, 64 nt, hsa; identical to SEQ ID NO: 159809

SEQ ID NO: 686811 - RNA, 64 nt, hsa; identical to SEQ ID NO: 159810

SEQ ID NO: 686812 - RNA, 64 nt, hsa; identical to SEQ ID NO: 159811

SEQ ID NO: 686813 - RNA, 64 nt, hsa; identical to SEQ ID NO: 159812

SEQ ID NO: 686814 - RNA, 64 nt, hsa; identical to SEQ ID NO: 585216

SEQ ID NO: 686815 - RNA, 64 nt, hsa; identical to SEQ ID NO: 585217

SEQ ID NO: 686816 - RNA, 64 nt, hsa; identical to SEQ ID NO: 585218

SEQ ID NO: 686817 - RNA, 64 nt, hsa; identical to SEQ ID NO: 585219

SEQ ID NO: 686818 - RNA, 64 nt, hsa; identical to SEQ ID NO: 585220

SEQ ID NO: 686819 - RNA, 64 nt, hsa; identical to SEQ ID NO: 585221

SEQ ID NO: 686820 - RNA, 64 nt, hsa; identical to SEQ ID NO: 585222

SEQ ID NO: 686821 - RNA, 64 nt, hsa; identical to SEQ ID NO: 585223

SEQ ID NO: 686822 - RNA, 64 nt, hsa; identical to SEQ ID NO: 585224

SEQ ID NO: 686823 - RNA, 64 nt, hsa; identical to SEQ ID NO: 585225

SEQ ID NO: 686824 - RNA, 64 nt, hsa; identical to SEQ ID NO: 585226

SEQ ID NO: 686825 - RNA, 64 nt, hsa; identical to SEQ ID NO: 585227

SEQ ID NO: 686826 - RNA, 64 nt, hsa; identical to SEQ ID NO: 585228

SEQ ID NO: 686827 - RNA, 64 nt, hsa; identical to SEQ ID NO: 585229

SEQ ID NO: 686828 - RNA, 64 nt, hsa; identical to SEQ ID NO: 585230

SEQ ID NO: 686829 - RNA, 64 nt, hsa; identical to SEQ ID NO: 585231

SEQ ID NO: 686830 - RNA, 64 nt, hsa; identical to SEQ ID NO: 585232

SEQ ID NO: 686831 - RNA, 64 nt, hsa; identical to SEQ ID NO: 585233

SEQ ID NO: 686832 - RNA, 64 nt, hsa; identical to SEQ ID NO: 585234

SEQ ID NO: 686833 - RNA, 64 nt, hsa; identical to SEQ ID NO: 585235

SEQ ID NO: 686834 - RNA, 64 nt, hsa; identical to SEQ ID NO: 585236

SEQ ID NO: 686835 - RNA, 64 nt, hsa; identical to SEQ ID NO: 585237

SEQ ID NO: 686836 - RNA, 64 nt, hsa; identical to SEQ ID NO: 585238

SEQ ID NO: 686837 - RNA, 64 nt, hsa; identical to SEQ ID NO: 585239

SEQ ID NO: 686838 - RNA, 64 nt, hsa; identical to SEQ ID NO: 585240

SEQ ID NO: 686839 - RNA, 64 nt, hsa; identical to SEQ ID NO: 585241

SEQ ID NO: 686840 - RNA, 64 nt, hsa; identical to SEQ ID NO: 585242

SEQ ID NO: 686841 - RNA, 64 nt, hsa; identical to SEQ ID NO: 585243

SEQ ID NO: 686842 - RNA, 64 nt, hsa; identical to SEQ ID NO: 585244

SEQ ID NO: 686843 - RNA, 64 nt, hsa; identical to SEQ ID NO: 585245

SEQ ID NO: 686844 - RNA, 64 nt, hsa; identical to SEQ ID NO: 585246

SEQ ID NO: 686845 - RNA, 64 nt, hsa; identical to SEQ ID NO: 585247

SEQ ID NO: 686846 - RNA, 64 nt, hsa; identical to SEQ ID NO: 585248

SEQ ID NO: 686847 - RNA, 64 nt, hsa; identical to SEQ ID NO: 585249

SEQ ID NO: 686848 - RNA, 64 nt, hsa; identical to SEQ ID NO: 585250

SEQ ID NO: 686849 - RNA, 64 nt, hsa; identical to SEQ ID NO: 585251

SEQ ID NO: 686850 - RNA, 64 nt, hsa; identical to SEQ ID NO: 585252

SEQ ID NO: 686851 - RNA, 64 nt, hsa; identical to SEQ ID NO: 585253

SEQ ID NO: 686852 - RNA, 64 nt, hsa; identical to SEQ ID NO: 585254

SEQ ID NO: 686853 - RNA, 64 nt, hsa; identical to SEQ ID NO: 585255

SEQ ID NO: 686854 - RNA, 64 nt, hsa; identical to SEQ ID NO: 585256

SEQ ID NO: 686855 - RNA, 64 nt, hsa; identical to SEQ ID NO: 585257

SEQ ID NO: 686856 - RNA, 64 nt, hsa; identical to SEQ ID NO: 585258

SEQ ID NO: 686857 - RNA, 64 nt, hsa; identical to SEQ ID NO: 585259

SEQ ID NO: 686858 - RNA, 64 nt, hsa; identical to SEQ ID NO: 585260

SEQ ID NO: 686859 - RNA, 64 nt, hsa; identical to SEQ ID NO: 585261

SEQ ID NO: 686860 - RNA, 64 nt, hsa; identical to SEQ ID NO: 585262

SEQ ID NO: 686861 - RNA, 64 nt, hsa; identical to SEQ ID NO: 585263

SEQ ID NO: 686862 - RNA, 63 nt, hsa; identical to SEQ ID NO: 87681

SEQ ID NO: 686863 - RNA, 63 nt, hsa; identical to SEQ ID NO: 87682

SEQ ID NO: 686864 - RNA, 63 nt, hsa; identical to SEQ ID NO: 87683

SEQ ID NO: 686865 - RNA, 63 nt, hsa; identical to SEQ ID NO: 87684

SEQ ID NO: 686866 - RNA, 63 nt, hsa; identical to SEQ ID NO: 87685

SEQ ID NO: 686867 - RNA, 63 nt, hsa; identical to SEQ ID NO: 87686

SEQ ID NO: 686868 - RNA, 63 nt, hsa; identical to SEQ ID NO: 87687

SEQ ID NO: 686869 - RNA, 63 nt, hsa; identical to SEQ ID NO: 87688

SEQ ID NO: 686870 - RNA, 63 nt, hsa; identical to SEQ ID NO: 87689

SEQ ID NO: 686871 - RNA, 63 nt, hsa; identical to SEQ ID NO: 87690

SEQ ID NO: 686872 - RNA, 63 nt, hsa; identical to SEQ ID NO: 87691

SEQ ID NO: 686873 - RNA, 63 nt, hsa; identical to SEQ ID NO: 87692

SEQ ID NO: 686874 - RNA, 63 nt, hsa; identical to SEQ ID NO: 87693

SEQ ID NO: 686875 - RNA, 63 nt, hsa; identical to SEQ ID NO: 87694

SEQ ID NO: 686876 - RNA, 63 nt, hsa; identical to SEQ ID NO: 87695

SEQ ID NO: 686877 - RNA, 63 nt, hsa; identical to SEQ ID NO: 87696

SEQ ID NO: 686878 - RNA, 63 nt, hsa; identical to SEQ ID NO: 87697

SEQ ID NO: 686879 - RNA, 63 nt, hsa; identical to SEQ ID NO: 87698

SEQ ID NO: 686880 - RNA, 63 nt, hsa; identical to SEQ ID NO: 87699

SEQ ID NO: 686881 - RNA, 63 nt, hsa; identical to SEQ ID NO: 87700

SEQ ID NO: 686882 - RNA, 63 nt, hsa; identical to SEQ ID NO: 87701

SEQ ID NO: 686883 - RNA, 63 nt, hsa; identical to SEQ ID NO: 87702

SEQ ID NO: 686884 - RNA, 63 nt, hsa; identical to SEQ ID NO: 87703

SEQ ID NO: 686885 - RNA, 63 nt, hsa; identical to SEQ ID NO: 87702

SEQ ID NO: 686886 - RNA, 63 nt, hsa; identical to SEQ ID NO: 87703

SEQ ID NO: 686887 - RNA, 64 nt, hsa; identical to SEQ ID NO: 49499

SEQ ID NO: 686888 - RNA, 64 nt, hsa; identical to SEQ ID NO: 49500

SEQ ID NO: 686889 - RNA, 64 nt, hsa; identical to SEQ ID NO: 49501

SEQ ID NO: 686890 - RNA, 64 nt, hsa; identical to SEQ ID NO: 49502

SEQ ID NO: 686891 - RNA, 64 nt, hsa; identical to SEQ ID NO: 49503

SEQ ID NO: 686892 - RNA, 64 nt, hsa; identical to SEQ ID NO: 49504

SEQ ID NO: 686893 - RNA, 64 nt, hsa; identical to SEQ ID NO: 49505

SEQ ID NO: 686894 - RNA, 64 nt, hsa; identical to SEQ ID NO: 49506

SEQ ID NO: 686895 - RNA, 64 nt, hsa; identical to SEQ ID NO: 49507

SEQ ID NO: 686896 - RNA, 64 nt, hsa; identical to SEQ ID NO: 49508

SEQ ID NO: 686897 - RNA, 64 nt, hsa; identical to SEQ ID NO: 49509

SEQ ID NO: 686898 - RNA, 64 nt, hsa; identical to SEQ ID NO: 49510

SEQ ID NO: 686899 - RNA, 64 nt, hsa; identical to SEQ ID NO: 49511

SEQ ID NO: 686900 - RNA, 64 nt, hsa; identical to SEQ ID NO: 49512

SEQ ID NO: 686901 - RNA, 64 nt, hsa; identical to SEQ ID NO: 49513

SEQ ID NO: 686902 - RNA, 64 nt, hsa; identical to SEQ ID NO: 49514

SEQ ID NO: 686903 - RNA, 64 nt, hsa; identical to SEQ ID NO: 49515

SEQ ID NO: 686904 - RNA, 64 nt, hsa; identical to SEQ ID NO: 49516

SEQ ID NO: 686905 - RNA, 64 nt, hsa; identical to SEQ ID NO: 49517

SEQ ID NO: 686906 - RNA, 64 nt, hsa; identical to SEQ ID NO: 49518

SEQ ID NO: 686907 - RNA, 55 nt, hsa; identical to SEQ ID NO: 49519

SEQ ID NO: 686908 - RNA, 64 nt, hsa; identical to SEQ ID NO: 49520

SEQ ID NO: 686909 - RNA, 64 nt, hsa; identical to SEQ ID NO: 49521

SEQ ID NO: 686910 - RNA, 64 nt, hsa; identical to SEQ ID NO: 49522

SEQ ID NO: 686911 - RNA, 64 nt, hsa; identical to SEQ ID NO: 49523

SEQ ID NO: 686912 - RNA, 64 nt, hsa; identical to SEQ ID NO: 49524

SEQ ID NO: 686913 - RNA, 64 nt, hsa; identical to SEQ ID NO: 49525

SEQ ID NO: 686914 - RNA, 64 nt, hsa; identical to SEQ ID NO: 49526

SEQ ID NO: 686915 - RNA, 64 nt, hsa; identical to SEQ ID NO: 49527

SEQ ID NO: 686916 - RNA, 64 nt, hsa; identical to SEQ ID NO: 49528

SEQ ID NO: 686917 - RNA, 64 nt, hsa; identical to SEQ ID NO: 49529

SEQ ID NO: 686918 - RNA, 64 nt, hsa; identical to SEQ ID NO: 49530

SEQ ID NO: 686919 - RNA, 64 nt, hsa
cagggcacuccuuaccccugcugcccugagccaacgccuucacggaccucccuagccuccuaag

SEQ ID NO: 686920 - RNA, 64 nt, hsa
ucaucucaggccagaugaccagcggcaaccucaucgccuucaucaucuacgaguuuguccuggg

SEQ ID NO: 686921 - RNA, 64 nt, hsa; identical to SEQ ID NO: 55280

SEQ ID NO: 686922 - RNA, 64 nt, hsa; identical to SEQ ID NO: 55281

SEQ ID NO: 686923 - RNA, 64 nt, hsa; identical to SEQ ID NO: 55282

SEQ ID NO: 686924 - RNA, 64 nt, hsa; identical to SEQ ID NO: 55283

SEQ ID NO: 686925 - RNA, 64 nt, hsa; identical to SEQ ID NO: 55284

SEQ ID NO: 686926 - RNA, 64 nt, hsa; identical to SEQ ID NO: 55285

SEQ ID NO: 686927 - RNA, 64 nt, hsa; identical to SEQ ID NO: 55286

SEQ ID NO: 686928 - RNA, 64 nt, hsa; identical to SEQ ID NO: 55287

SEQ ID NO: 686929 - RNA, 64 nt, hsa; identical to SEQ ID NO: 55288

SEQ ID NO: 686930 - RNA, 64 nt, hsa; identical to SEQ ID NO: 55289

SEQ ID NO: 686931 - RNA, 64 nt, hsa; identical to SEQ ID NO: 55290

SEQ ID NO: 686932 - RNA, 64 nt, hsa; identical to SEQ ID NO: 55291

SEQ ID NO: 686933 - RNA, 64 nt, hsa; identical to SEQ ID NO: 55292

SEQ ID NO: 686934 - RNA, 64 nt, hsa; identical to SEQ ID NO: 55293

SEQ ID NO: 686935 - RNA, 64 nt, hsa; identical to SEQ ID NO: 55294

SEQ ID NO: 686936 - RNA, 64 nt, hsa; identical to SEQ ID NO: 55295

SEQ ID NO: 686937 - RNA, 64 nt, hsa; identical to SEQ ID NO: 55296

SEQ ID NO: 686938 - RNA, 64 nt, hsa; identical to SEQ ID NO: 55297

SEQ ID NO: 686939 - RNA, 64 nt, hsa; identical to SEQ ID NO: 55298

SEQ ID NO: 686940 - RNA, 64 nt, hsa; identical to SEQ ID NO: 55299

SEQ ID NO: 686941 - RNA, 64 nt, hsa; identical to SEQ ID NO: 55300

SEQ ID NO: 686942 - RNA, 64 nt, hsa; identical to SEQ ID NO: 55301

SEQ ID NO: 686943 - RNA, 64 nt, hsa; identical to SEQ ID NO: 55302

SEQ ID NO: 686944 - RNA, 64 nt, hsa; identical to SEQ ID NO: 55303

SEQ ID NO: 686945 - RNA, 64 nt, hsa; identical to SEQ ID NO: 55304

SEQ ID NO: 686946 - RNA, 64 nt, hsa; identical to SEQ ID NO: 55305

SEQ ID NO: 686947 - RNA, 64 nt, hsa; identical to SEQ ID NO: 55306

SEQ ID NO: 686948 - RNA, 64 nt, hsa; identical to SEQ ID NO: 55307

SEQ ID NO: 686949 - RNA, 64 nt, hsa; identical to SEQ ID NO: 55308

SEQ ID NO: 686950 - RNA, 64 nt, hsa; identical to SEQ ID NO: 55309

SEQ ID NO: 686951 - RNA, 64 nt, hsa; identical to SEQ ID NO: 55310

SEQ ID NO: 686952 - RNA, 64 nt, hsa; identical to SEQ ID NO: 55311

SEQ ID NO: 686953 - RNA, 64 nt, hsa; identical to SEQ ID NO: 55312

SEQ ID NO: 686954 - RNA, 64 nt, hsa; identical to SEQ ID NO: 55313

SEQ ID NO: 686955 - RNA, 64 nt, hsa; identical to SEQ ID NO: 55314

SEQ ID NO: 686956 - RNA, 64 nt, hsa; identical to SEQ ID NO: 55315

SEQ ID NO: 686957 - RNA, 64 nt, hsa; identical to SEQ ID NO: 55316

SEQ ID NO: 686958 - RNA, 64 nt, hsa; identical to SEQ ID NO: 55317

SEQ ID NO: 686959 - RNA, 64 nt, hsa; identical to SEQ ID NO: 55318

SEQ ID NO: 686960 - RNA, 64 nt, hsa; identical to SEQ ID NO: 55319

SEQ ID NO: 686961 - RNA, 64 nt, hsa; identical to SEQ ID NO: 55320

SEQ ID NO: 686962 - RNA, 64 nt, hsa; identical to SEQ ID NO: 55321

SEQ ID NO: 686963 - RNA, 64 nt, hsa; identical to SEQ ID NO: 55322

SEQ ID NO: 686964 - RNA, 64 nt, hsa; identical to SEQ ID NO: 55323

SEQ ID NO: 686965 - RNA, 64 nt, hsa; identical to SEQ ID NO: 55324

SEQ ID NO: 686966 - RNA, 64 nt, hsa; identical to SEQ ID NO: 55325

SEQ ID NO: 686967 - RNA, 64 nt, hsa; identical to SEQ ID NO: 55326

SEQ ID NO: 686968 - RNA, 64 nt, hsa; identical to SEQ ID NO: 55327

SEQ ID NO: 686969 - RNA, 64 nt, hsa; identical to SEQ ID NO: 55328

SEQ ID NO: 686970 - RNA, 64 nt, hsa; identical to SEQ ID NO: 55329

SEQ ID NO: 686971 - RNA, 64 nt, hsa; identical to SEQ ID NO: 55330

SEQ ID NO: 686972 - RNA, 64 nt, hsa; identical to SEQ ID NO: 55331

SEQ ID NO: 686973 - RNA, 64 nt, hsa; identical to SEQ ID NO: 55332

SEQ ID NO: 686974 - RNA, 64 nt, hsa; identical to SEQ ID NO: 55333

SEQ ID NO: 686975 - RNA, 64 nt, hsa; identical to SEQ ID NO: 55334

SEQ ID NO: 686976 - RNA, 64 nt, hsa; identical to SEQ ID NO: 55335

SEQ ID NO: 686977 - RNA, 64 nt, hsa
aaaaaccuggacagaaaauuauaaauuauaaauaugacuuuauccuggcuauaaaauuauugaa

SEQ ID NO: 686978 - RNA, 64 nt, hsa
aaacauuuuuauaagugucaagauaauggcacauugacuuuauuuuuucauuggaagaaaaugc

SEQ ID NO: 686979 - RNA, 64 nt, hsa
uauuuuauuuguucuuucaucugugacugcuugcugacuuuaucauaauuuucuucaaacaaaa

SEQ ID NO: 686980 - RNA, 64 nt, hsa
ucacugguuguuauucuuagguuauucccacacuugacuuuaucauuguuuacuacuaguaaaa

SEQ ID NO: 686981 - RNA, 64 nt, hsa
ugacuuuaaggaaaaugaagaaaaagaaccaaaaugacuuuauuaaaauaauuuccaagauuau

SEQ ID NO: 686982 - RNA, 64 nt, hsa
acauaugauauaaacagagaaauaccuuuagaggugacuuuaaggaaaaugaagaaaaagaacc

SEQ ID NO: 686983 - RNA, 64 nt, hsa
aaugggagaucuucucagcccugagguuugaaucugacuuuagccuaccuaacccagaaaaucu

SEQ ID NO: 686984 - RNA, 64 nt, hsa
auuuguguaaauuauugaugaaaauaauuuacugugacuuuauuagcagcugacuuucaaagug

SEQ ID NO: 686985 - RNA, 64 nt, hsa
ucuuuugaacaacuugguuucagaauauguaaaaugacuuuaaggaucuuguguaucaaaccua

SEQ ID NO: 686986 - RNA, 64 nt, hsa
ucuggcaacaaauugugaaacaugaaauuucugcugacuuuaauauaugaaaccuaauccuacc

SEQ ID NO: 686987 - RNA, 64 nt, hsa
uucaaguauggcuaacaucuguuaacuauuucagugacuuuaucugguuccaagaggcuguggc

SEQ ID NO: 686988 - RNA, 64 nt, hsa
agggugugaaucuauacaaagugauggaagcuggugacuuuauuugcaaagcugugaauaaaac

SEQ ID NO: 686989 - RNA, 64 nt, hsa
uucagaacuaguuugagcugcucaauaaaaccagugacuuuacucauaccuuguuuuugaccaa

SEQ ID NO: 686990 - RNA, 64 nt, hsa
auucauaggagauguacuggaauugcucauucugugacuuuauuuguguccuaaacauucuuca

SEQ ID NO: 686991 - RNA, 64 nt, hsa
cuauuguagauuuauuuuuauauuaguuaauaaaugacuuuaaauugucaccaauugaaaaucu

SEQ ID NO: 686992 - RNA, 64 nt, hsa
agugugacuuuucaaguguaacagccauucuuccugacuuuaauauuguccaguucuggucuuu

SEQ ID NO: 686993 - RNA, 64 nt, hsa
caugaugaauuacuucuucaggguguuaaggcagugacuuuagaaacaaauuuuuuucuuguuu

SEQ ID NO: 686994 - RNA, 64 nt, hsa
ggcuaucuacugagacaugacuaggaagaaaacaugacuuuaucauuuuguuauagaaacugau

SEQ ID NO: 686995 - RNA, 64 nt, hsa
gagaugauuuucuucaucucauaauuaaaauaccugacuuuagagagaguaaaaugugccagga

SEQ ID NO: 686996 - RNA, 64 nt, hsa
gugccaggagccauaggaauaucuguauguuggaugacuuuaaugcuacauuuuaaaaaaagaa

SEQ ID NO: 686997 - RNA, 64 nt, hsa
aauucaccaaugcauuuggacaacuugauguaacugacuuuauuuuaugugacuauaauaaaaa

SEQ ID NO: 686998 - RNA, 64 nt, hsa
auauaaaaacauuggaagucuuuucaccaaacccugacuuuauugaaugcuaguagaagaugua

SEQ ID NO: 686999 - RNA, 64 nt, hsa
aaaccauuuguaucuaauguguacaguguaaaauugacuuuaaaaauauugcagugcuauuuuu

SEQ ID NO: 687000 - RNA, 64 nt, hsa
auuuauuuuaauuuguuuugucauaugguuuuugugacuuuauuuuuuuaauucacaaggacca

SEQ ID NO: 687001 - RNA, 64 nt, hsa
aauuauauauguccuugggaaauauuaugacaguugacuuuaagaucaaaaggaagggaagacc

SEQ ID NO: 687002 - RNA, 64 nt, hsa
cucaaaugugaaugccuugauuuuauuuuuauggugacuuuagcuacagcauuuccuauaccca

SEQ ID NO: 687003 - RNA, 64 nt, hsa
uaaguuggccacacuuggggagugaguguggguaugacuuuacccuccugguugguucuuacug

SEQ ID NO: 687004 - RNA, 64 nt, hsa
auauguaauaugcuccucuuggcuaauuuucuuuugacuuuaaugugccaauguaacuuccuuu

SEQ ID NO: 687005 - RNA, 64 nt, hsa
aauuuauuuugcuuuacaggaguuugucauguauugacuuuaauauuguauuuugguaauaaau

SEQ ID NO: 687006 - RNA, 64 nt, hsa
ccacagguuguguucauucuuuuccuggaaaugaugacuuuauugcuuagaaaguuguaaauaa

SEQ ID NO: 687007 - RNA, 64 nt, hsa; identical to SEQ ID NO: 209092

SEQ ID NO: 687008 - RNA, 64 nt, hsa; identical to SEQ ID NO: 209093

SEQ ID NO: 687009 - RNA, 64 nt, hsa; identical to SEQ ID NO: 209094

SEQ ID NO: 687010 - RNA, 64 nt, hsa; identical to SEQ ID NO: 209095

SEQ ID NO: 687011 - RNA, 64 nt, hsa; identical to SEQ ID NO: 209096

SEQ ID NO: 687012 - RNA, 64 nt, hsa; identical to SEQ ID NO: 209097

SEQ ID NO: 687013 - RNA, 64 nt, hsa; identical to SEQ ID NO: 209098

SEQ ID NO: 687014 - RNA, 64 nt, hsa; identical to SEQ ID NO: 209099

SEQ ID NO: 687015 - RNA, 64 nt, hsa; identical to SEQ ID NO: 209100

SEQ ID NO: 687016 - RNA, 64 nt, hsa; identical to SEQ ID NO: 209101

SEQ ID NO: 687017 - RNA, 64 nt, hsa; identical to SEQ ID NO: 209102

SEQ ID NO: 687018 - RNA, 64 nt, hsa; identical to SEQ ID NO: 209103

SEQ ID NO: 687019 - RNA, 64 nt, hsa; identical to SEQ ID NO: 209104

SEQ ID NO: 687020 - RNA, 64 nt, hsa; identical to SEQ ID NO: 209105

SEQ ID NO: 687021 - RNA, 64 nt, hsa; identical to SEQ ID NO: 209106

SEQ ID NO: 687022 - RNA, 64 nt, hsa; identical to SEQ ID NO: 209107

SEQ ID NO: 687023 - RNA, 64 nt, hsa; identical to SEQ ID NO: 209108

SEQ ID NO: 687024 - RNA, 64 nt, hsa; identical to SEQ ID NO: 209109

SEQ ID NO: 687025 - RNA, 64 nt, hsa; identical to SEQ ID NO: 209110

SEQ ID NO: 687026 - RNA, 64 nt, hsa; identical to SEQ ID NO: 209111

SEQ ID NO: 687027 - RNA, 64 nt, hsa; identical to SEQ ID NO: 209112

SEQ ID NO: 687028 - RNA, 64 nt, hsa; identical to SEQ ID NO: 209113

SEQ ID NO: 687029 - RNA, 59 nt, hsa; identical to SEQ ID NO: 209114

SEQ ID NO: 687030 - RNA, 64 nt, hsa; identical to SEQ ID NO: 209115

SEQ ID NO: 687031 - RNA, 64 nt, hsa; identical to SEQ ID NO: 209116

SEQ ID NO: 687032 - RNA, 64 nt, hsa; identical to SEQ ID NO: 209117

SEQ ID NO: 687033 - RNA, 64 nt, hsa; identical to SEQ ID NO: 209118

SEQ ID NO: 687034 - RNA, 64 nt, hsa; identical to SEQ ID NO: 209119

SEQ ID NO: 687035 - RNA, 64 nt, hsa; identical to SEQ ID NO: 209120

SEQ ID NO: 687036 - RNA, 64 nt, hsa; identical to SEQ ID NO: 209121

SEQ ID NO: 687037 - RNA, 64 nt, hsa; identical to SEQ ID NO: 209122

SEQ ID NO: 687038 - RNA, 64 nt, hsa; identical to SEQ ID NO: 209123

SEQ ID NO: 687039 - RNA, 64 nt, hsa; identical to SEQ ID NO: 209124

SEQ ID NO: 687040 - RNA, 64 nt, hsa; identical to SEQ ID NO: 209125

SEQ ID NO: 687041 - RNA, 64 nt, hsa; identical to SEQ ID NO: 209126

SEQ ID NO: 687042 - RNA, 64 nt, hsa; identical to SEQ ID NO: 209127

SEQ ID NO: 687043 - RNA, 64 nt, hsa; identical to SEQ ID NO: 209128

SEQ ID NO: 687044 - RNA, 64 nt, hsa; identical to SEQ ID NO: 209129

SEQ ID NO: 687045 - RNA, 64 nt, hsa; identical to SEQ ID NO: 209130

SEQ ID NO: 687046 - RNA, 64 nt, hsa; identical to SEQ ID NO: 209131

SEQ ID NO: 687047 - RNA, 64 nt, hsa; identical to SEQ ID NO: 209132

SEQ ID NO: 687048 - RNA, 64 nt, hsa; identical to SEQ ID NO: 209133

SEQ ID NO: 687049 - RNA, 64 nt, hsa; identical to SEQ ID NO: 209134

SEQ ID NO: 687050 - RNA, 64 nt, hsa; identical to SEQ ID NO: 209135

SEQ ID NO: 687051 - RNA, 64 nt, hsa; identical to SEQ ID NO: 209136

SEQ ID NO: 687052 - RNA, 64 nt, hsa; identical to SEQ ID NO: 209137

SEQ ID NO: 687053 - RNA, 64 nt, hsa; identical to SEQ ID NO: 209138

SEQ ID NO: 687054 - RNA, 64 nt, hsa; identical to SEQ ID NO: 209139

SEQ ID NO: 687055 - RNA, 64 nt, hsa; identical to SEQ ID NO: 209140

SEQ ID NO: 687056 - RNA, 64 nt, hsa; identical to SEQ ID NO: 209141

SEQ ID NO: 687057 - RNA, 64 nt, hsa; identical to SEQ ID NO: 209142

SEQ ID NO: 687058 - RNA, 64 nt, hsa; identical to SEQ ID NO: 209143

SEQ ID NO: 687059 - RNA, 64 nt, hsa; identical to SEQ ID NO: 209144

SEQ ID NO: 687060 - RNA, 64 nt, hsa; identical to SEQ ID NO: 209145

SEQ ID NO: 687061 - RNA, 64 nt, hsa; identical to SEQ ID NO: 235738

SEQ ID NO: 687062 - RNA, 64 nt, hsa; identical to SEQ ID NO: 235739

SEQ ID NO: 687063 - RNA, 64 nt, hsa
gaacaagaacacccugaacaguccugguugggaugguguccacauucauguucugcgguucuug

SEQ ID NO: 687064 - RNA, 64 nt, hsa
gcugggacugauggggacaccggccagcuugucugguguccagcagcccugccggacuuggccu

SEQ ID NO: 687065 - RNA, 64 nt, hsa
cccgacugugcacacuuccaggccucccuggagagguguccacuccauccuucccuccguggcg

SEQ ID NO: 687066 - RNA, 64 nt, hsa
caggugguggguagacagaggagugaaccccaaagguguccaugccccaguucuaagcccugug

SEQ ID NO: 687067 - RNA, 64 nt, hsa
cggaccgugucaagcaucuaggagaggaguccaugguguccaggcaucggggcgucacaccugu

SEQ ID NO: 687068 - RNA, 64 nt, hsa
cgggggcugggccgcacaggcuucugcccuucucgguguccaggcuccuugggugaugcuggag

SEQ ID NO: 687069 - RNA, 64 nt, hsa
ucaguuucuugguaucuggcuuucuuauacagaugguguccauuugcuccaccagacaggaguu

SEQ ID NO: 687070 - RNA, 64 nt, hsa
ugaguuucuugguaucugacguuuguauacagaugguguccauuugcucaaccagacaggaguu

SEQ ID NO: 687071 - RNA, 64 nt, hsa
ccuggguugugucuuccccuggggaugaggguuggguguccauggugcccugggcuguguccuc

SEQ ID NO: 687072 - RNA, 64 nt, hsa
ccugggcugugugcucuuaugggaaugaggguuggguguccaagaugcccugggcuguguccuu

SEQ ID NO: 687073 - RNA, 64 nt, hsa
ccugggcuguguacuccccuaggaaugagggcuggguguccaagauacccugggcuguguccuc

SEQ ID NO: 687074 - RNA, 64 nt, hsa
ccugggcuguguccuccccuggggaugaggguuggguguccauggugcccugggcuguguccuc

SEQ ID NO: 687075 - RNA, 64 nt, hsa
ccugggcuguguccuccccuggggaugacgguuggguguccauggugcccugggcuguguuucc

SEQ ID NO: 687076 - RNA, 64 nt, hsa
ugugcuuuggcccugcagcucugggccaccugcugguguccaccucguccaacagagucguggu

SEQ ID NO: 687077 - RNA, 64 nt, hsa
ugcugugucgggccgcaucauccgggagcugcccgguguccacccugagcccugccccuccuug

SEQ ID NO: 687078 - RNA, 64 nt, hsa
gugccuucuagagccgggcugggaauggggacacgguguccaccauccccagcugguggcccug

SEQ ID NO: 687079 - RNA, 64 nt, hsa
uuuccucuaacucacugccuaggaggcuggccaagguguccaggguccucuagcccacucccug

SEQ ID NO: 687080 - RNA, 64 nt, hsa
cauuggccuauacaucucuuaggaccuuuguaaugguguccaugcaccuuuagaggacuucaga

SEQ ID NO: 687081 - RNA, 64 nt, hsa
cgggccuccaggauauguuugcgggggugggugugguguccagcuguuaccagcuucugagcua

SEQ ID NO: 687082 - RNA, 64 nt, hsa
cuugaguuuuuacugacacgucccugugugcggggguguccauguggcgugugugugagugaga

SEQ ID NO: 687083 - RNA, 64 nt, hsa
gcucgcucccacgcuccuccugccccagcccucugguguccacaccugcccacagagaauguaa

SEQ ID NO: 687084 - RNA, 64 nt, hsa
aaucaacauggcugcuuugcugcuuccuucuccaaagugacauauggagggaacuuuagcacuu

SEQ ID NO: 687085 - RNA, 64 nt, hsa
aguuuacuaacaauugggauaacugagggaagagaagugacaauuccacucagucuauuagagg

SEQ ID NO: 687086 - RNA, 64 nt, hsa
cccagggacuaccucaagggcuuuugaugaggacaagugacaguaggaagaugcaagagccuuu

SEQ ID NO: 687087 - RNA, 64 nt, hsa
aacaccugggagugcuggaaauguacugugaucgaagugacaaaguguguuuucauucacagug

SEQ ID NO: 687088 - RNA, 64 nt, hsa
gccucugggaacacuuggaagguuuuaagcagagaagugacagguuggaaaagaugguuuggau

SEQ ID NO: 687089 - RNA, 64 nt, hsa
cccucuucccuuccugcacugaggagauuaacugaagugacagauuagaguuagaaguggccca

SEQ ID NO: 687090 - RNA, 64 nt, hsa
cuuauuuacauccuuaccucuaaaagauacuucaaagugacaaaaacguguuccuuccccacuu

SEQ ID NO: 687091 - RNA, 64 nt, hsa
ugucucuuucaguuuguucuguaaauauuuagaaaagugacagcugucaaccucagaguaacua

SEQ ID NO: 687092 - RNA, 64 nt, hsa
aaguccagggucauacgacgccauugccagaaugaagugacaaauaugaacagaagaaaauggu

SEQ ID NO: 687093 - RNA, 64 nt, hsa
cuugcccguuuccuuguccccuaauuauucaaggaagugacaaauauuguccagacaacuuaca

SEQ ID NO: 687094 - RNA, 64 nt, hsa
ugccgcguucucuguacuacguggcucauggaaaaagugacaacauggcuuccucuaaaucauu

SEQ ID NO: 687095 - RNA, 64 nt, hsa
uauuucaucugcuuccuccccauucucucacuuuaagugacauugaggaagguauucuguccca

SEQ ID NO: 687096 - RNA, 64 nt, hsa
uccauuucuguguguucccccaaccuuuauuuccaagugacauuuucagucuuucaaauagcug

SEQ ID NO: 687097 - RNA, 64 nt, hsa
ggucaacaggaagacccagcagcuccacccucccaagugacaggccauuuucggacgcagccgu

SEQ ID NO: 687098 - RNA, 64 nt, hsa
ugauaguaacauaguagaguacucucuagcaguuaagugacaaauuaagucuauauauuaacag

SEQ ID NO: 687099 - RNA, 64 nt, hsa
cuuaauaguguauuggaaaauucauuuuacauuaaagugacaugaaugugggaaguccuucagc

SEQ ID NO: 687100 - RNA, 64 nt, hsa; identical to SEQ ID NO: 578258

SEQ ID NO: 687101 - RNA, 64 nt, hsa; identical to SEQ ID NO: 578259

SEQ ID NO: 687102 - RNA, 64 nt, hsa; identical to SEQ ID NO: 578260

SEQ ID NO: 687103 - RNA, 64 nt, hsa; identical to SEQ ID NO: 578261

SEQ ID NO: 687104 - RNA, 64 nt, hsa; identical to SEQ ID NO: 578262

SEQ ID NO: 687105 - RNA, 64 nt, hsa; identical to SEQ ID NO: 578263

SEQ ID NO: 687106 - RNA, 64 nt, hsa; identical to SEQ ID NO: 578264

SEQ ID NO: 687107 - RNA, 64 nt, hsa; identical to SEQ ID NO: 578265

SEQ ID NO: 687108 - RNA, 64 nt, hsa; identical to SEQ ID NO: 578266

SEQ ID NO: 687109 - RNA, 64 nt, hsa; identical to SEQ ID NO: 578267

SEQ ID NO: 687110 - RNA, 64 nt, hsa; identical to SEQ ID NO: 578268

SEQ ID NO: 687111 - RNA, 64 nt, hsa; identical to SEQ ID NO: 578269

SEQ ID NO: 687112 - RNA, 64 nt, hsa; identical to SEQ ID NO: 578270

SEQ ID NO: 687113 - RNA, 64 nt, hsa; identical to SEQ ID NO: 578271

SEQ ID NO: 687114 - RNA, 64 nt, hsa; identical to SEQ ID NO: 578272

SEQ ID NO: 687115 - RNA, 64 nt, hsa; identical to SEQ ID NO: 578273

SEQ ID NO: 687116 - RNA, 64 nt, hsa; identical to SEQ ID NO: 578274

SEQ ID NO: 687117 - RNA, 64 nt, hsa; identical to SEQ ID NO: 578275

SEQ ID NO: 687118 - RNA, 64 nt, hsa; identical to SEQ ID NO: 578276

SEQ ID NO: 687119 - RNA, 64 nt, hsa; identical to SEQ ID NO: 578277

SEQ ID NO: 687120 - RNA, 64 nt, hsa; identical to SEQ ID NO: 578278

SEQ ID NO: 687121 - RNA, 64 nt, hsa; identical to SEQ ID NO: 578279

SEQ ID NO: 687122 - RNA, 64 nt, hsa; identical to SEQ ID NO: 578280

SEQ ID NO: 687123 - RNA, 64 nt, hsa; identical to SEQ ID NO: 578281

SEQ ID NO: 687124 - RNA, 64 nt, hsa; identical to SEQ ID NO: 578282

SEQ ID NO: 687125 - RNA, 64 nt, hsa; identical to SEQ ID NO: 578283

SEQ ID NO: 687126 - RNA, 64 nt, hsa; identical to SEQ ID NO: 578283

SEQ ID NO: 687127 - RNA, 64 nt, hsa; identical to SEQ ID NO: 578285

SEQ ID NO: 687128 - RNA, 64 nt, hsa; identical to SEQ ID NO: 578286

SEQ ID NO: 687129 - RNA, 64 nt, hsa; identical to SEQ ID NO: 578287

SEQ ID NO: 687130 - RNA, 64 nt, hsa; identical to SEQ ID NO: 578288

SEQ ID NO: 687131 - RNA, 64 nt, hsa; identical to SEQ ID NO: 578289

SEQ ID NO: 687132 - RNA, 64 nt, hsa; identical to SEQ ID NO: 578290

SEQ ID NO: 687133 - RNA, 64 nt, hsa; identical to SEQ ID NO: 578291

SEQ ID NO: 687134 - RNA, 64 nt, hsa; identical to SEQ ID NO: 578292

SEQ ID NO: 687135 - RNA, 64 nt, hsa; identical to SEQ ID NO: 578293

SEQ ID NO: 687136 - RNA, 64 nt, hsa; identical to SEQ ID NO: 578294

SEQ ID NO: 687137 - RNA, 64 nt, hsa; identical to SEQ ID NO: 578295

SEQ ID NO: 687138 - RNA, 64 nt, hsa; identical to SEQ ID NO: 578296

SEQ ID NO: 687139 - RNA, 64 nt, hsa; identical to SEQ ID NO: 578297

SEQ ID NO: 687140 - RNA, 64 nt, hsa
gucacaaucuagauuauaaucaauaggugaacuuauuaaauaacuuuucuaaauaaaaaauuua

SEQ ID NO: 687141 - RNA, 64 nt, hsa
gauaugauuuauuuaugaaaccuaaugaagcagaauuaaauacuguauuaaaauaaguucgcug

SEQ ID NO: 687142 - RNA, 64 nt, hsa
gcuacccuucuuucccuuuagaaaacugugauuaauuaaauaaaaagucuuacuacuauaacaa

SEQ ID NO: 687143 - RNA, 64 nt, hsa
gugugcacauauacaaugugcauuauacauauauauuaaauauauccacaaagcagaugggcaa

SEQ ID NO: 687144 - RNA, 64 nt, hsa
guuuuguaauggugguguuuuaauauuuuacauaauuaaauauguacauauugauuagaaaaau

SEQ ID NO: 687145 - RNA, 64 nt, hsa
aauucaggaagcaggugagaggagucaagccaauauuaaauaugcauucuuuuaaaguaugugc

SEQ ID NO: 687146 - RNA, 64 nt, hsa
cuauuuauuauucacucaaguauuaacauucucuauuaaauaagaggagguguuguaaagagcu

SEQ ID NO: 687147 - RNA, 64 nt, hsa
cucaucaaagcaaucuuugugauauuacuucgcuauuaaauaaagaaaauuggaugcaagacaa

SEQ ID NO: 687148 - RNA, 64 nt, hsa
aaugcuucaaaaaaauuuucaauuaaacucaaauauuaaauaucuauaacuuauaaacaccaac

SEQ ID NO: 687149 - RNA, 64 nt, hsa
uuuuguuuaacacgguuacugacuuagaugauguauuaaauaccaagauaaagaaaaaugcacc

SEQ ID NO: 687150 - RNA, 64 nt, hsa
ccuuauggagccccucgugucguguaaaacuuauauuaaauaaaugugcaugcuuuucucuugc

SEQ ID NO: 687151 - RNA, 64 nt, hsa
uuauauauuaauaugcaugcuucuuuauaaaugcauuaaauaagaguuaauagcuauccuaaau

SEQ ID NO: 687152 - RNA, 64 nt, hsa
uuuuuuuuaaaaauuaaaagauuaaauaaaaaauauuaaauaaaacauggcaauaagugucaga

SEQ ID NO: 687153 - RNA, 64 nt, hsa
guacuguuaauggguuuuuuuuaaaaauuaaaagauuaaauaaaaaauauuaaauaaaacaugg

SEQ ID NO: 687154 - RNA, 64 nt, hsa
ggaguagaauggcaacuaauucuaauuuuuauuuauuaaauauuugggguuuugguuuuaaagc

SEQ ID NO: 687155 - RNA, 64 nt, hsa
auuugaugucuagauaacauucaugagauuggucauuaaauacuauuuugcuccuuuucuggug

SEQ ID NO: 687156 - RNA, 64 nt, hsa
aauuuaaugucuaggauaauuuuuaaaagaggaaauuaaauaauuuuacaugucucauauuuuc

SEQ ID NO: 687157 - RNA, 64 nt, hsa
auuuugcuguugugccaguuaaucauaggaucccauuaaauaagugugcuaacaucgaauauag

SEQ ID NO: 687158 - RNA, 64 nt, hsa
cagcuuguuucauaacauguuauuuuccugugucauuaaauaauuacuucaauguuguauuucg

SEQ ID NO: 687159 - RNA, 64 nt, hsa
gaauuuggaaacguguguugacuccuggugguaaauuaaauaguuuuuuucaucagaaaaauua

SEQ ID NO: 687160 - RNA, 64 nt, hsa
uacaauuaguacuuuauagucacauguuguauauauuaaauagcccaguuuuauucagacuugu

SEQ ID NO: 687161 - RNA, 64 nt, hsa
agccaaauuuaucaaagcauagauguuuugguagauuaaauauagauuagaaaaauuccuaaga

SEQ ID NO: 687162 - RNA, 64 nt, hsa
cauuucuucagucagaaaacuuuaaaaaauauuuauuaaauaaaaucaauuuuuaggaaguuuu

SEQ ID NO: 687163 - RNA, 64 nt, hsa
auuuccuuuccuaagcuuauguaauaguuuggccauuaaauaucuugcccuauuuucccuauua

SEQ ID NO: 687164 - RNA, 64 nt, hsa
acguguugucacuggauuaucauaaaagggagaaauuaaauauuacuguacucuuaguugcugu

SEQ ID NO: 687165 - RNA, 64 nt, hsa
uuuacuauuuguucaauagccuauauuucuagauauuaaauauuuuuuguaagauauaugcaca

SEQ ID NO: 687166 - RNA, 64 nt, hsa
cuggcuucauuuaauaaaaauaaaugauuuugaaauuaaauauaauauagaauucacauuuuau

SEQ ID NO: 687167 - RNA, 64 nt, hsa
ucaguggaauagauggcuaucuuucuuggcuaacauuaaauauucuuguaccagagcauggaaa

SEQ ID NO: 687168 - RNA, 64 nt, hsa
auaaugcauaugugauuguucuuaaagucaauguauuaaauaagguauuuuuccuuuucccucu

SEQ ID NO: 687169 - RNA, 64 nt, hsa
acaaccaugaauaaaaauacaauucucuugcaccauuaaauaguguguuaagugcuacggcagc

SEQ ID NO: 687170 - RNA, 64 nt, hsa
aaaguugaaauuuaugagcuuugaagauugcuaaauuaaauaauuuauagcuccaaaaacaaaa

SEQ ID NO: 687171 - RNA, 64 nt, hsa
uuuaaaaauugccccaaauacugacauugagugcauuaaauaacaaauuaucuuugauacauua

SEQ ID NO: 687172 - RNA, 64 nt, hsa
uuuuuccugaugaaggcagaagagaugguggucuauuaaauaugaauugaauggaggguccuaa

SEQ ID NO: 687173 - RNA, 64 nt, hsa
agcaaggaaguaaacucaaacaaaagugcguguaauuaaauacuauuaaucauaggcagauacu

SEQ ID NO: 687174 - RNA, 64 nt, hsa
uagcuuuuguugauuuuggcacuaucuuuauauuauuaaauauauuuguuguuuggauauuuca

SEQ ID NO: 687175 - RNA, 64 nt, hsa
agagaccuaugauccucauggaacuuaauuuuuuauuaaauauucagguaacaguucugaauuc

SEQ ID NO: 687176 - RNA, 64 nt, hsa
agaaaacccucaguccuauuuauuaauggguagaauuaaauauauaauuuuauagcucaguuua

SEQ ID NO: 687177 - RNA, 64 nt, hsa
aguuauaaugaacaguuaaaaaugcucauugaaaauuaaauaaaacaaaaaggcaguuauuuca

SEQ ID NO: 687178 - RNA, 64 nt, hsa
guugguacaguaggcuaaagguacgguguuccauauuaaauacagcaauaugaagaaaaauaaa

SEQ ID NO: 687179 - RNA, 64 nt, hsa
ucacaguuuacuagauuaccaaguguuacaucauauuaaauaaaauguagcagaaccaucugca

SEQ ID NO: 687180 - RNA, 64 nt, hsa
uacugaauuaauuuuuuaaaagaaaagagaucagauuaaauauuucuuuguuuuuccuuuugga

SEQ ID NO: 687181 - RNA, 64 nt, hsa
auuucauaauacuuuuuugggcucauguaguggaauuaaauauaccucuuacuucaggaacaaa

SEQ ID NO: 687182 - RNA, 64 nt, hsa
guuauauuaaguucucccuuacuguuaaaaccuaauuaaauaugcuuuagaauuuucuaagaca

SEQ ID NO: 687183 - RNA, 64 nt, hsa
cacuuuguuuuauauaauaaaguaugccuguuauauuaaauaauaagaauauggcaauuagcga

SEQ ID NO: 687184 - RNA, 64 nt, hsa
uugauaaaaucaagucuugguuguggcuugcugaauuaaauauuuaugaguggugcauuuuuaa

SEQ ID NO: 687185 - RNA, 64 nt, hsa
cuuggguucaaccuuugaaucaauuuuaccacugauuaaauaaaugacucaaagacaucuguaa

SEQ ID NO: 687186 - RNA, 64 nt, hsa
uuuauauuauguagaaaucuucaaagguagcauuauuaaauagcaaagaauaauuagaacccac

SEQ ID NO: 687187 - RNA, 64 nt, hsa
ccuuuacagguaauggaacaugagcuucacccauauuaaauauuuuggccccuuuaaggucaaa

SEQ ID NO: 687188 - RNA, 64 nt, hsa
uaagccaaagguucagaaaauuaaacuacagaauauuaaauauuauaaugugcccaaagcucug

SEQ ID NO: 687189 - RNA, 64 nt, hsa
auuauaaugugcccaaagcucugaauaguuaaaaauuaaauauuuauuuucuuccccaagcuuu

SEQ ID NO: 687190 - RNA, 64 nt, hsa
augugaaagauauuugaaguauuaauuuuaauauauuaaauaugauuucuguuauagucuucug

SEQ ID NO: 687191 - RNA, 64 nt, hsa
uucagaagcuuuugucuauuuuuuaaacucauugauuaaauaaugauuaaugcauucuccacau

SEQ ID NO: 687192 - RNA, 64 nt, hsa
acucagaagacuacauuagugagauguaagaauuauuaaauauuccauuuccgcuuuggcuaca

SEQ ID NO: 687193 - RNA, 64 nt, hsa
uaaauaaauaaauaaaucugggucugcaucucuuauuaaauaaaaauauaaaaauauguacauu

SEQ ID NO: 687194 - RNA, 64 nt, hsa
aaaaaaauguggaguuggagggcuaacauauuuaauuaaauaaauaaauaaaucugggucugca

SEQ ID NO: 687195 - RNA, 64 nt, hsa
uuacuuugcuaauaaucuacacauucuuuuuucuauuaaauaaacaaaugguuugugguucaca

SEQ ID NO: 687196 - RNA, 64 nt, hsa
guaaucuucauugacuuuucuuuaguuaaugaguauuaaauagugcauauucuguagacuauag

SEQ ID NO: 687197 - RNA, 64 nt, hsa
uuuguaagcuauaacauauuuauugugcauuaaaauuaaauacuuuuuccccaaaggcaugcag

SEQ ID NO: 687198 - RNA, 64 nt, hsa
auaccuaccucuuccguuggaaagaacauuuaaaauuaaauaaauuuuaauuaaaaaaucaagg

SEQ ID NO: 687199 - RNA, 64 nt, hsa
ucuauuucuguggaaaaaacaacagaaaagagauauuaaauaccauaaaauguaacucugccuu

SEQ ID NO: 687200 - RNA, 64 nt, hsa
aauuucuuuguaauaugugaaacuuuauuaauguauuaaauauuacaacuagcuaaauuuauug

SEQ ID NO: 687201 - RNA, 64 nt, hsa
caaagagcaaaucauauuacauaauuacauuuuaauuaaauauagaauauucuacugaauugca

SEQ ID NO: 687202 - RNA, 64 nt, hsa
auuaaauauagaauauucuacugaauugcaauuuauuaaauauucuuauccucuuaaauaaaac

SEQ ID NO: 687203 - RNA, 64 nt, hsa
uacauuuuauuuuugaaggugugguacaguguaaauuaaauauauucaauauauuucccaccaa

SEQ ID NO: 687204 - RNA, 64 nt, hsa
cgcauuuuuguguguugaaauucuugaagguuacauuaaauaaaacaaaaucucuuuauuauaa

SEQ ID NO: 687205 - RNA, 64 nt, hsa
uauuucauaauaaguggucugccaaaacccauguauuaaauaaauuguccaagugaaacucgac

SEQ ID NO: 687206 - RNA, 64 nt, hsa
guacaacuggagaaucguucuagauuaguuaccaauuaaauauaacuccgccaguguaagggug

SEQ ID NO: 687207 - RNA, 64 nt, hsa
gaaucugcacgugacuggcauuuuaaaacaacucauuaaauauuggauucauuuuaucgagaug

SEQ ID NO: 687208 - RNA, 64 nt, hsa
agaaauuauucauaagagaaaagaauuccaauuaauuaaauaucacaauagcaucccagagaga

SEQ ID NO: 687209 - RNA, 64 nt, hsa
uuuacccaagaauccacuggaggucauuacugccauuaaauaauaacugaaaagacuauguagu

SEQ ID NO: 687210 - RNA, 64 nt, hsa
agaauguuuauuuaucaaagucuuuccuucuucuauuaaauauuuagcaauuaccuuucuaaaa

SEQ ID NO: 687211 - RNA, 64 nt, hsa
gaaaaacacaaaggcagacuguugaguaaaaaauauuaaauauuguuaaauauucuguauuuug

SEQ ID NO: 687212 - RNA, 64 nt, hsa
ccaguuuguuuuucuauuguuugccaacugucagauuaaauagcauuauaauauuuuguuguaa

SEQ ID NO: 687213 - RNA, 64 nt, hsa
uaugcauaguuucauauuuaaugaauaugcuuucauuaaauagggagguagauuugaaaaaacc

SEQ ID NO: 687214 - RNA, 64 nt, hsa
uucuugcucuaucaaauuagcuuauaugccaaauauuaaauaugguuuauuuagguaagcauaa

SEQ ID NO: 687215 - RNA, 64 nt, hsa
aauacacacauuguuacaacuaacacaaauuccuauuaaauauuaaaaguaguucugguuuauu

SEQ ID NO: 687216 - RNA, 64 nt, hsa
cuuaaacaccuauuacaguuaaauuaugcaaaucauuaaauaaaaaucauacaacuuuuggaaa

SEQ ID NO: 687217 - RNA, 64 nt, hsa
cuguuaaugccccuuucccacagucuuuuauauaauuaaauauaugucaauacacauuagaauc

SEQ ID NO: 687218 - RNA, 64 nt, hsa
gcaucuuuuuuucauuuuuaaauguguuuuguuuauuaaauaguuaauauagucacaguucaaa

SEQ ID NO: 687219 - RNA, 64 nt, hsa
cgauuuaaguuacaauguuuuauggccuaaauuuauuaaauaaaaugcacaaaacuuugauucu

SEQ ID NO: 687220 - RNA, 64 nt, hsa
aacugcucagggaaauagggcuaaauaacugaacauuaaauaauugguuaaaggugcuguuagu

SEQ ID NO: 687221 - RNA, 64 nt, hsa
cuucauuaaauguauacagauuuaguuaaguagcauuaaauaggauucuuagaaguauguccuc

SEQ ID NO: 687222 - RNA, 64 nt, hsa
aaaccuaaagaguaaaaccuuagcacuuagcacaauuaaauagaaauagguuuucuugauggga

SEQ ID NO: 687223 - RNA, 64 nt, hsa
uguauaacugcaucuucaauacaaguaucaguauauuaaauaggguauugguaaagaaacgguc

SEQ ID NO: 687224 - RNA, 64 nt, hsa
acaugugcaucuguacaauaaacuuaaaaugauuauuaaauaaucaaauauaucuacuacauug

SEQ ID NO: 687225 - RNA, 64 nt, hsa
aaaaucaugugcuguauuuuuaaaaucuagccaaauuaaauaguacaugagaaauucagaguau

SEQ ID NO: 687226 - RNA, 64 nt, hsa
ucaguuguucagaaaaauaaaaauaauuucucauauuaaauacagacgcuccucaacuuaugau

SEQ ID NO: 687227 - RNA, 64 nt, hsa
gguguucacagugacuuggauacaccaauuagaaauuaaauaagcaaauauauauauauauaua

SEQ ID NO: 687228 - RNA, 64 nt, hsa
uuuuuugagcuuauaugcaaacauaauaaauauuauuaaauaucaggaaagcuaacauuucaua

SEQ ID NO: 687229 - RNA, 64 nt, hsa
uaagaaaugcucauucuuuguagaacaaaaauguauuaaauauuuuaaaaauugcucugugaua

SEQ ID NO: 687230 - RNA, 64 nt, hsa
aguuuuugacccaggcagaauaaguuaauauuuaauuaaauauugcuuugaagauggcgcucug

SEQ ID NO: 687231 - RNA, 64 nt, hsa
guauauucuagggucaggggaaauguaaucuggaauuaaauauuagccuuaaaauucacaauuu

SEQ ID NO: 687232 - RNA, 64 nt, hsa
ucagcuaauaauauaucagaccuuuuuuuauauuauuaaauauucuacaacuuuuuaaaaaugu

SEQ ID NO: 687233 - RNA, 64 nt, hsa
ucuuuucuaggaugcugaguaucuacauggauacauuaaauauauuuaugcgaguugcaacuau

SEQ ID NO: 687234 - RNA, 64 nt, hsa
acaucaaauaucuuguuuaauggggcagauaugcauuaaauaguuuguacaagcagcuuucguu

SEQ ID NO: 687235 - RNA, 64 nt, hsa
gggcuugaaacauuauaaaaauugacaaugauuuauuaaauauguuuucucaauuguaacgacu

SEQ ID NO: 687236 - RNA, 64 nt, hsa
gcuucaugugcugccugcaagcuucuuuuuucucauuaaauauaaaauauuuuguaaugcugca

SEQ ID NO: 687237 - RNA, 64 nt, hsa
agugcaauccauugcaugcauuagcaguucaaagauuaaauaugaucauaucaauagguacaga

SEQ ID NO: 687238 - RNA, 64 nt, hsa
cauaaaagguagaucucaguaggcauauauaucuauuaaauaaauugaagcaguaauuaauaac

SEQ ID NO: 687239 - RNA, 64 nt, hsa
uugcuaugaguggccuuuguauuuuauuauaugcauuaaauagugugugcacaacuuuaucuua

SEQ ID NO: 687240 - RNA, 64 nt, hsa
cuagguuauauauuagccauuccuaagacuccugauuaaauauuacaaauuuguucaguucaua

SEQ ID NO: 687241 - RNA, 64 nt, hsa
acuggucugacaagccaaaaauguuauaucugauauuaaauacuuaaugcugauuugaagagau

SEQ ID NO: 687242 - RNA, 64 nt, hsa
ugcuacaaauaauguugcuguguuaaguauucauauuaaauacaugccuucuauauggaacaug

SEQ ID NO: 687243 - RNA, 64 nt, hsa
cugaaaacgcuaaaaguauacguauugguucuuuauuaaauaauuuuugaaaaaucauuauuca

SEQ ID NO: 687244 - RNA, 64 nt, hsa
ucuaauguuaucaaaacucauuuauuguguuacuauuaaauaugcugaaaacgcuaaaaguaua

SEQ ID NO: 687245 - RNA, 64 nt, hsa
uuguaaaaccuacaugagcagaugaaauagaagcauuaaauauuuuuaucuauauccaaaaagg

SEQ ID NO: 687246 - RNA, 64 nt, hsa
ccuaccuauuugauuauauguugauugauaacauauuaaauagagaacaaauaagagagguccu

SEQ ID NO: 687247 - RNA, 64 nt, hsa
auaacuaauuuuaaaucagucaaauuggcuucuuauuaaauacaauaauucuuaugaaaaucau

SEQ ID NO: 687248 - RNA, 64 nt, hsa
cugguacuuggugugguuaaauaggaaaauuguuauuaaauaaagaauuuguaugaaccuuugc

SEQ ID NO: 687249 - RNA, 64 nt, hsa
gagacaaacaaaaaaaaaguuugcuuacuauuugauuaaauaaaauuuacuuacauuucuuuaa

SEQ ID NO: 687250 - RNA, 64 nt, hsa
aggaauuuauuaugcacagcaaaaugugucuuguauuaaauauuuuuauuaaaagaauguuuca

SEQ ID NO: 687251 - RNA, 64 nt, hsa
gcaucugauuugcagacucauaauuugauuuuuaauuaaauauauagguugugaugaagugaau

SEQ ID NO: 687252 - RNA, 64 nt, hsa
ggcucuuuuuagagcuggaaauguaguggcuuucauuaaauacuugcuguaaagucuuucuaag

SEQ ID NO: 687253 - RNA, 64 nt, hsa
cuaagaagcuagugcugcuaucucauauaugaguauuaaauaugguaugcuuaguauauuccaa

SEQ ID NO: 687254 - RNA, 64 nt, hsa
gaugccacguugaaucaugugauucuagauuaacauuaaauagauugaaaaagaaacuuugcac

SEQ ID NO: 687255 - RNA, 64 nt, hsa
guauaaagacaguagaagauuuuaguaagccuacauuaaauaggagcagaucuugugguauaaa

SEQ ID NO: 687256 - RNA, 64 nt, hsa
aaaucauauagacaauuagcuguuugaagugaguauuaaauauuucagaagugugaauuucaug

SEQ ID NO: 687257 - RNA, 64 nt, hsa
aacauguacuuugagcuuauuguuuuuauucuguauuaaauauuuucaggguuuuaaacacuaa

SEQ ID NO: 687258 - RNA, 64 nt, hsa
cuguggaauaaagaugguccaaaaauagucaaaaauuaaauauauauauauauuaguaauuuau

SEQ ID NO: 687259 - RNA, 64 nt, hsa
uugauaagugauuauuaugcuugauaaacuuugaauuaaauacaguugucuugaggguaugaua

SEQ ID NO: 687260 - RNA, 64 nt, hsa
gaguuuccagaugauacacguucuuuucagcuucauuaaauaggcaacuauguuucuaaauagu

SEQ ID NO: 687261 - RNA, 64 nt, hsa
auuuugauuuuauuuaauuuuuuaaaguugaagaauuaaauauuuuaaugguucuaaucuuuug

SEQ ID NO: 687262 - RNA, 64 nt, hsa
uacauugaauaaggcuguuuaucacaugcauaaaauuaaauauuuuuguuucaaagaaacaucu

SEQ ID NO: 687263 - RNA, 64 nt, hsa
uucaaaugcuaaggugauguuuuaccgggacuuaauuaaauacaacuuuuuccuuucgaaaaag

SEQ ID NO: 687264 - RNA, 64 nt, hsa
uagucugcucuauauauugucaauauguucccauauuaaauauuuugcuuuuuagacagcugua

SEQ ID NO: 687265 - RNA, 64 nt, hsa
uaauuuuuuucugcaaauaaaucuaaacuacguuauuaaauagaaauaguuuacucgcaacaac

SEQ ID NO: 687266 - RNA, 64 nt, hsa
cagaacguuauuaagccauggagacauaaggaaaauuaaauacaaaacugagaagucuaguugc

SEQ ID NO: 687267 - RNA, 64 nt, hsa
uugcauuauucauaauuuaauuguuugaaauuacauuaaauaaaucaacuaauuaaauacuaaa

SEQ ID NO: 687268 - RNA, 63 nt, hsa
uaauuguuugaaauuacauuaaauaaaucaacuaauuaaauacuaaaguuuuguuccuuuuua

SEQ ID NO: 687269 - RNA, 64 nt, hsa
auaucuugauauuuucacaaauuuuaaacaaaaaauuaaauaucuauaaagugaauguucaaca

SEQ ID NO: 687270 - RNA, 64 nt, hsa
auaauauacaaaugaauuauacuauuagauaagaauuaaauauucuauuuuuauaaagauaaau

SEQ ID NO: 687271 - RNA, 64 nt, hsa
aaguguucauacuaaaauauauuuuugcagauacauuaaauaugaaagauauucaauccaaaau

SEQ ID NO: 687272 - RNA, 64 nt, hsa
ugaacuuagcuuuucaauucaacauuuuuaacauauuaaauacuauugugaauucaaugaagug

SEQ ID NO: 687273 - RNA, 64 nt, hsa
ugcugaaaaggaaaacgauuucauuguucaucuaauuaaauaaauuaaaagagcgguuugugua

SEQ ID NO: 687274 - RNA, 64 nt, hsa
acaauuuauuuugguuauauguucguacauucuuauuaaauauuucauacacuuuauugcaacu

SEQ ID NO: 687275 - RNA, 64 nt, hsa
gggcaagacuuuucuuugaaggaugacuacagacauuaaauaaucgaaguaauuuugggugggg

SEQ ID NO: 687276 - RNA, 64 nt, hsa
caugaucgcuuucuacacuguauuacauaaauaaauuaaauaaaauaaccccgggcaagacuuu

SEQ ID NO: 687277 - RNA, 64 nt, hsa
auaugucgcccccgugaugcauauauacacagguauuaaauauaucgcucuauauaauauuaua

SEQ ID NO: 687278 - RNA, 64 nt, hsa
guguauuaaaaauuuaagaauaccacacuuuaauauuaaauauucauaaggucuaguaucuuga

SEQ ID NO: 687279 - RNA, 64 nt, hsa; identical to SEQ ID NO: 364238

SEQ ID NO: 687280 - RNA, 64 nt, hsa; identical to SEQ ID NO: 364239

SEQ ID NO: 687281 - RNA, 64 nt, hsa; identical to SEQ ID NO: 364240

SEQ ID NO: 687282 - RNA, 64 nt, hsa; identical to SEQ ID NO: 364241

SEQ ID NO: 687283 - RNA, 64 nt, hsa; identical to SEQ ID NO: 364242

SEQ ID NO: 687284 - RNA, 64 nt, hsa; identical to SEQ ID NO: 364243

SEQ ID NO: 687285 - RNA, 64 nt, hsa; identical to SEQ ID NO: 364244

SEQ ID NO: 687286 - RNA, 64 nt, hsa; identical to SEQ ID NO: 364245

SEQ ID NO: 687287 - RNA, 64 nt, hsa; identical to SEQ ID NO: 364246

SEQ ID NO: 687288 - RNA, 64 nt, hsa; identical to SEQ ID NO: 364247

SEQ ID NO: 687289 - RNA, 64 nt, hsa; identical to SEQ ID NO: 364248

SEQ ID NO: 687290 - RNA, 64 nt, hsa; identical to SEQ ID NO: 364249

SEQ ID NO: 687291 - RNA, 64 nt, hsa; identical to SEQ ID NO: 364250

SEQ ID NO: 687292 - RNA, 64 nt, hsa; identical to SEQ ID NO: 364251

SEQ ID NO: 687293 - RNA, 64 nt, hsa; identical to SEQ ID NO: 364252

SEQ ID NO: 687294 - RNA, 64 nt, hsa; identical to SEQ ID NO: 364253

SEQ ID NO: 687295 - RNA, 64 nt, hsa
uucauuuccuuaaguuuugaucuccgucuuccugaugaagcaggcagagcucagaggaucuugg

SEQ ID NO: 687296 - RNA, 64 nt, hsa
augcuuccugccagcacgugccugaagguuucacaugaagcaugggaagcgcacccugucguuc

SEQ ID NO: 687297 - RNA, 64 nt, hsa
guagccuaaaaaaaucuuaauuauuucauggaucaugaagcaaggaugaauaauaucaugucuu

SEQ ID NO: 687298 - RNA, 64 nt, hsa
uugucuuuaaagauauaaaaauuaggaugccuuuaugaagcacugauuauaccaaaaaaaaaag

SEQ ID NO: 687299 - RNA, 64 nt, hsa
uugauuaaaucaaccaccuauuuuugacauggaaaugaagcaggguuucuuuucuucacucaaa

SEQ ID NO: 687300 - RNA, 64 nt, hsa
cacauacacccaaacacuuacaccaaacuacugaaugaagcaguauuuugguaaccaggccauu

SEQ ID NO: 687301 - RNA, 64 nt, hsa
caaaacuucuucucugggcuaccuaucuuccuucaugaagcaggugcucaggacccggaagaau

SEQ ID NO: 687302 - RNA, 64 nt, hsa
acugguuaaguguuuacuaccauuaaagcgaggcaugaagcaaagagcugagugaguccucugc

SEQ ID NO: 687303 - RNA, 64 nt, hsa
cagguucaucuuugaaaucuagggcucuucacucaugaagcagacuccuaguccuggagugacu

SEQ ID NO: 687304 - RNA, 64 nt, hsa
uauaagucaaaggaaaaugagcccaggccuugcuaugaagcagugugugaauggacaauguuga

SEQ ID NO: 687305 - RNA, 64 nt, hsa
aaaaggaugcagagcugugcaaauuguuccucaaaugaagcaguguggaguguauuggggauuu

SEQ ID NO: 687306 - RNA, 64 nt, hsa
gugaggugauuuugaaucuuguccauauaggaaaaugaagcacagaauuacucagucuuccaua

SEQ ID NO: 687307 - RNA, 64 nt, hsa
gaaaacauuuaacauaaugguugugaaauguaacaugaagcaaacuaacuuuuuuuuuuuuaac

SEQ ID NO: 687308 - RNA, 64 nt, hsa
ugaacagacuagaaguauuugugggaggagugacaugaagcaugaguuaucugauuuuuuuugu

SEQ ID NO: 687309 - RNA, 64 nt, hsa
uaaguuggaccaagggaagucggggacguaaaaaaugaagcaaaacaaugccagggugucuccc

SEQ ID NO: 687310 - RNA, 64 nt, hsa
cuggacuugguacaaaaugucggugugguccuagaugaagcauuggggugggggagggagaggg

SEQ ID NO: 687311 - RNA, 64 nt, hsa
uguggauguuacuuaaagagaaaagcauaagagcaugaagcauaucugggaauaucuuuugccu

SEQ ID NO: 687312 - RNA, 64 nt, hsa
caauuuguuuuucugaugaauaguguucaguaaaaugaagcagucuuaagagugacuaauaauu

SEQ ID NO: 687313 - RNA, 64 nt, hsa
ucagugacugcuggauagucucccagucugaucaaugaagcauucgauuaguuuuugauuuuuu

SEQ ID NO: 687314 - RNA, 64 nt, hsa
uaauuugaugacacugucuaucaaaaaagagcaaaugaagcagaugcaaauguuagugagaagu

SEQ ID NO: 687315 - RNA, 64 nt, hsa
cucauaauggaaaaaaagacugaugaagaaauuuaugaagcagauuuauuuuugaaacaaacau

SEQ ID NO: 687316 - RNA, 64 nt, hsa
gacccaagugaagaucugguuccagaaccgccgaaugaagcaaaagaaacgugagaaggagggu

SEQ ID NO: 687317 - RNA, 64 nt, hsa
uaacccuuccuuguaucugucuucccaggagagaaugaagcaaaacaggaauuugguuuucuuu

SEQ ID NO: 687318 - RNA, 64 nt, hsa
aaacuaccuuagcugcauaguggaagaggagagcaugaagcaaagaauuccaggaaacccaaga

SEQ ID NO: 687319 - RNA, 64 nt, hsa
caaagugauauguauuccaaaaaagucauagaagaugaagcacuauaauauuguucccauauau

SEQ ID NO: 687320 - RNA, 64 nt, hsa
aaccuagacuucaaagccaguauuuguuuaggucaugaagcaaacaaugcucuaaucacaauau

SEQ ID NO: 687321 - RNA, 64 nt, hsa
gcagcuuacaucaguuguuuguuugauuagaaaaaugaagcagacacacacacacacacacaca

SEQ ID NO: 687322 - RNA, 64 nt, hsa
cauugaauuucauauuugagagacauuugucuucaugaagcagauuugcacuggaaccauugcu

SEQ ID NO: 687323 - RNA, 64 nt, hsa
cuggguaccagcugguguagcgacaucuuauccuaugaagcauauugcugaguggugccugaaa

SEQ ID NO: 687324 - RNA, 64 nt, hsa
uaguaaccuuacucugagguuuuacggucugauaaugaagcacuugcaugaguauaguaaguca

SEQ ID NO: 687325 - RNA, 64 nt, hsa
cauacuucauuuaauagcucguuaccaagugugaaugaagcaauaugucauaauagaguagcca

SEQ ID NO: 687326 - RNA, 64 nt, hsa
agaaggcucaucaggugaucauuaccuagcauccaugaagcaccugaaauuauuugcaaaaugu

SEQ ID NO: 687327 - RNA, 64 nt, hsa
aauaaugcuugaagcuuuucauauaacaaaaggaaugaagcagccccgccucgcaguguggaag

SEQ ID NO: 687328 - RNA, 64 nt, hsa
ccuucaaaaguucagucuagucuggaaaacaaacaugaagcaaagaaggcacaacaccauaugg

SEQ ID NO: 687329 - RNA, 64 nt, hsa
ucucaaagagauucgaaugacgguaaguguucucaugaagcaggaggcccuugucgugggaugg

SEQ ID NO: 687330 - RNA, 64 nt, hsa
aacguacgcaagaggacauggauccaaaaugaugaugaagcaucucccauggggaggugauggu

SEQ ID NO: 687331 - RNA, 64 nt, hsa
augaagcaauaauuuuuaaauuguguaugugcauaugaagcacagacaugcaugugugugugug

SEQ ID NO: 687332 - RNA, 64 nt, hsa
uuaaaugugauuccuuuauggcauuaggguaaagaugaagcaauaauuuuuaaauuguguaugu

SEQ ID NO: 687333 - RNA, 64 nt, hsa
gugaagaaagacucuauaggcuuuuacacagcacaugaagcaguaauccagaaagaaggaaaug

SEQ ID NO: 687334 - RNA, 64 nt, hsa
auaugugaaauauuaugaucugaacuuagcacacaugaagcaacauuucuuugcuacacagagg

SEQ ID NO: 687335 - RNA, 64 nt, hsa; identical to SEQ ID NO: 385550

SEQ ID NO: 687336 - RNA, 64 nt, hsa; identical to SEQ ID NO: 385551

SEQ ID NO: 687337 - RNA, 64 nt, hsa; identical to SEQ ID NO: 385552

SEQ ID NO: 687338 - RNA, 64 nt, hsa; identical to SEQ ID NO: 385553

SEQ ID NO: 687339 - RNA, 64 nt, hsa; identical to SEQ ID NO: 385554

SEQ ID NO: 687340 - RNA, 64 nt, hsa; identical to SEQ ID NO: 385555

SEQ ID NO: 687341 - RNA, 64 nt, hsa; identical to SEQ ID NO: 385556

SEQ ID NO: 687342 - RNA, 64 nt, hsa; identical to SEQ ID NO: 385557

SEQ ID NO: 687343 - RNA, 64 nt, hsa; identical to SEQ ID NO: 385558

SEQ ID NO: 687344 - RNA, 64 nt, hsa; identical to SEQ ID NO: 385559

SEQ ID NO: 687345 - RNA, 64 nt, hsa; identical to SEQ ID NO: 385560

SEQ ID NO: 687346 - RNA, 64 nt, hsa; identical to SEQ ID NO: 385561

SEQ ID NO: 687347 - RNA, 64 nt, hsa; identical to SEQ ID NO: 385562

SEQ ID NO: 687348 - RNA, 64 nt, hsa; identical to SEQ ID NO: 385563

SEQ ID NO: 687349 - RNA, 64 nt, hsa; identical to SEQ ID NO: 385564

SEQ ID NO: 687350 - RNA, 64 nt, hsa; identical to SEQ ID NO: 385565

SEQ ID NO: 687351 - RNA, 64 nt, hsa; identical to SEQ ID NO: 385566

SEQ ID NO: 687352 - RNA, 64 nt, hsa; identical to SEQ ID NO: 385567

SEQ ID NO: 687353 - RNA, 64 nt, hsa; identical to SEQ ID NO: 385568

SEQ ID NO: 687354 - RNA, 64 nt, hsa; identical to SEQ ID NO: 385569

SEQ ID NO: 687355 - RNA, 64 nt, hsa; identical to SEQ ID NO: 385570

SEQ ID NO: 687356 - RNA, 64 nt, hsa; identical to SEQ ID NO: 385571

SEQ ID NO: 687357 - RNA, 64 nt, hsa; identical to SEQ ID NO: 385572

SEQ ID NO: 687358 - RNA, 64 nt, hsa; identical to SEQ ID NO: 385573

SEQ ID NO: 687359 - RNA, 64 nt, hsa; identical to SEQ ID NO: 385574

SEQ ID NO: 687360 - RNA, 64 nt, hsa; identical to SEQ ID NO: 385575

SEQ ID NO: 687361 - RNA, 64 nt, hsa; identical to SEQ ID NO: 385576

SEQ ID NO: 687362 - RNA, 64 nt, hsa; identical to SEQ ID NO: 385577

SEQ ID NO: 687363 - RNA, 64 nt, hsa; identical to SEQ ID NO: 385578

SEQ ID NO: 687364 - RNA, 64 nt, hsa; identical to SEQ ID NO: 385579

SEQ ID NO: 687365 - RNA, 64 nt, hsa; identical to SEQ ID NO: 385580

SEQ ID NO: 687366 - RNA, 64 nt, hsa; identical to SEQ ID NO: 385581

SEQ ID NO: 687367 - RNA, 64 nt, hsa; identical to SEQ ID NO: 385582

SEQ ID NO: 687368 - RNA, 64 nt, hsa; identical to SEQ ID NO: 385583

SEQ ID NO: 687369 - RNA, 64 nt, hsa; identical to SEQ ID NO: 385584

SEQ ID NO: 687370 - RNA, 64 nt, hsa; identical to SEQ ID NO: 385585

SEQ ID NO: 687371 - RNA, 64 nt, hsa; identical to SEQ ID NO: 385586

SEQ ID NO: 687372 - RNA, 64 nt, hsa; identical to SEQ ID NO: 385587

SEQ ID NO: 687373 - RNA, 64 nt, hsa; identical to SEQ ID NO: 385588

SEQ ID NO: 687374 - RNA, 64 nt, hsa; identical to SEQ ID NO: 151446

SEQ ID NO: 687375 - RNA, 64 nt, hsa; identical to SEQ ID NO: 151447

SEQ ID NO: 687376 - RNA, 64 nt, hsa; identical to SEQ ID NO: 151448

SEQ ID NO: 687377 - RNA, 64 nt, hsa; identical to SEQ ID NO: 151449

SEQ ID NO: 687378 - RNA, 64 nt, hsa; identical to SEQ ID NO: 151450

SEQ ID NO: 687379 - RNA, 64 nt, hsa; identical to SEQ ID NO: 151451

SEQ ID NO: 687380 - RNA, 64 nt, hsa; identical to SEQ ID NO: 151452

SEQ ID NO: 687381 - RNA, 64 nt, hsa; identical to SEQ ID NO: 151453

SEQ ID NO: 687382 - RNA, 64 nt, hsa; identical to SEQ ID NO: 151454

SEQ ID NO: 687383 - RNA, 64 nt, hsa; identical to SEQ ID NO: 151455

SEQ ID NO: 687384 - RNA, 64 nt, hsa; identical to SEQ ID NO: 151456

SEQ ID NO: 687385 - RNA, 64 nt, hsa; identical to SEQ ID NO: 151457

SEQ ID NO: 687386 - RNA, 64 nt, hsa; identical to SEQ ID NO: 151458

SEQ ID NO: 687387 - RNA, 64 nt, hsa; identical to SEQ ID NO: 151459

SEQ ID NO: 687388 - RNA, 64 nt, hsa; identical to SEQ ID NO: 151460

SEQ ID NO: 687389 - RNA, 64 nt, hsa; identical to SEQ ID NO: 151461

SEQ ID NO: 687390 - RNA, 64 nt, hsa; identical to SEQ ID NO: 151462

SEQ ID NO: 687391 - RNA, 64 nt, hsa; identical to SEQ ID NO: 151463

SEQ ID NO: 687392 - RNA, 64 nt, hsa; identical to SEQ ID NO: 151464

SEQ ID NO: 687393 - RNA, 64 nt, hsa; identical to SEQ ID NO: 151465

SEQ ID NO: 687394 - RNA, 64 nt, hsa; identical to SEQ ID NO: 151466

SEQ ID NO: 687395 - RNA, 64 nt, hsa; identical to SEQ ID NO: 151467

SEQ ID NO: 687396 - RNA, 64 nt, hsa; identical to SEQ ID NO: 151468

SEQ ID NO: 687397 - RNA, 64 nt, hsa; identical to SEQ ID NO: 151448

SEQ ID NO: 687398 - RNA, 64 nt, hsa; identical to SEQ ID NO: 151470

SEQ ID NO: 687399 - RNA, 64 nt, hsa; identical to SEQ ID NO: 151471

SEQ ID NO: 687400 - RNA, 64 nt, hsa; identical to SEQ ID NO: 53544

SEQ ID NO: 687401 - RNA, 64 nt, hsa; identical to SEQ ID NO: 53545

SEQ ID NO: 687402 - RNA, 64 nt, hsa; identical to SEQ ID NO: 53546

SEQ ID NO: 687403 - RNA, 64 nt, hsa; identical to SEQ ID NO: 53547

SEQ ID NO: 687404 - RNA, 64 nt, hsa; identical to SEQ ID NO: 53548

SEQ ID NO: 687405 - RNA, 64 nt, hsa; identical to SEQ ID NO: 53549

SEQ ID NO: 687406 - RNA, 64 nt, hsa; identical to SEQ ID NO: 53550

SEQ ID NO: 687407 - RNA, 64 nt, hsa; identical to SEQ ID NO: 53551

SEQ ID NO: 687408 - RNA, 64 nt, hsa; identical to SEQ ID NO: 53552

SEQ ID NO: 687409 - RNA, 64 nt, hsa; identical to SEQ ID NO: 53553

SEQ ID NO: 687410 - RNA, 64 nt, hsa; identical to SEQ ID NO: 53554

SEQ ID NO: 687411 - RNA, 64 nt, hsa; identical to SEQ ID NO: 53555

SEQ ID NO: 687412 - RNA, 64 nt, hsa; identical to SEQ ID NO: 53556

SEQ ID NO: 687413 - RNA, 64 nt, hsa; identical to SEQ ID NO: 53557

SEQ ID NO: 687414 - RNA, 64 nt, hsa; identical to SEQ ID NO: 53558

SEQ ID NO: 687415 - RNA, 64 nt, hsa; identical to SEQ ID NO: 53559

SEQ ID NO: 687416 - RNA, 64 nt, hsa; identical to SEQ ID NO: 53560

SEQ ID NO: 687417 - RNA, 64 nt, hsa; identical to SEQ ID NO: 53561

SEQ ID NO: 687418 - RNA, 64 nt, hsa; identical to SEQ ID NO: 53562

SEQ ID NO: 687419 - RNA, 64 nt, hsa; identical to SEQ ID NO: 53563

SEQ ID NO: 687420 - RNA, 64 nt, hsa; identical to SEQ ID NO: 53564

SEQ ID NO: 687421 - RNA, 64 nt, hsa; identical to SEQ ID NO: 53565

SEQ ID NO: 687422 - RNA, 64 nt, hsa; identical to SEQ ID NO: 53566

SEQ ID NO: 687423 - RNA, 64 nt, hsa; identical to SEQ ID NO: 53567

SEQ ID NO: 687424 - RNA, 64 nt, hsa; identical to SEQ ID NO: 53568

SEQ ID NO: 687425 - RNA, 64 nt, hsa; identical to SEQ ID NO: 53569

SEQ ID NO: 687426 - RNA, 64 nt, hsa; identical to SEQ ID NO: 53570

SEQ ID NO: 687427 - RNA, 64 nt, hsa; identical to SEQ ID NO: 53571

SEQ ID NO: 687428 - RNA, 64 nt, hsa; identical to SEQ ID NO: 53572

SEQ ID NO: 687429 - RNA, 64 nt, hsa; identical to SEQ ID NO: 53573

SEQ ID NO: 687430 - RNA, 64 nt, hsa; identical to SEQ ID NO: 53574

SEQ ID NO: 687431 - RNA, 64 nt, hsa; identical to SEQ ID NO: 53575

SEQ ID NO: 687432 - RNA, 64 nt, hsa; identical to SEQ ID NO: 53576

SEQ ID NO: 687433 - RNA, 64 nt, hsa; identical to SEQ ID NO: 53577

SEQ ID NO: 687434 - RNA, 64 nt, hsa; identical to SEQ ID NO: 53578

SEQ ID NO: 687435 - RNA, 64 nt, hsa; identical to SEQ ID NO: 53579

SEQ ID NO: 687436 - RNA, 64 nt, hsa; identical to SEQ ID NO: 53580

SEQ ID NO: 687437 - RNA, 64 nt, hsa; identical to SEQ ID NO: 53580

SEQ ID NO: 687438 - RNA, 64 nt, hsa; identical to SEQ ID NO: 53582

SEQ ID NO: 687439 - RNA, 64 nt, hsa; identical to SEQ ID NO: 53583

SEQ ID NO: 687440 - RNA, 64 nt, hsa; identical to SEQ ID NO: 53584

SEQ ID NO: 687441 - RNA, 64 nt, hsa; identical to SEQ ID NO: 53585

SEQ ID NO: 687442 - RNA, 64 nt, hsa; identical to SEQ ID NO: 53586

SEQ ID NO: 687443 - RNA, 64 nt, hsa; identical to SEQ ID NO: 193740

SEQ ID NO: 687444 - RNA, 64 nt, hsa; identical to SEQ ID NO: 193741

SEQ ID NO: 687445 - RNA, 64 nt, hsa; identical to SEQ ID NO: 193742

SEQ ID NO: 687446 - RNA, 64 nt, hsa; identical to SEQ ID NO: 193743

SEQ ID NO: 687447 - RNA, 64 nt, hsa; identical to SEQ ID NO: 193744

SEQ ID NO: 687448 - RNA, 64 nt, hsa; identical to SEQ ID NO: 193745

SEQ ID NO: 687449 - RNA, 64 nt, hsa
ccaauccauuugccccgcaacccuggcugcuccgacaggggagacuugucucccuuguuccccu

SEQ ID NO: 687450 - RNA, 64 nt, hsa
uaucugaccugccagcaccuucuuuacugcaaagacaggggacuugccugaauggcauccgcca

SEQ ID NO: 687451 - RNA, 64 nt, hsa
ucccuuaccugggaaagggcuguuauaaucuuucacaggggacaggaugguucccuugaugaag

SEQ ID NO: 687452 - RNA, 64 nt, hsa
uaguauuucuaugaaauauuauguuaaaacugggacaggggagaaccuagggugauauuaacca

SEQ ID NO: 687453 - RNA, 64 nt, hsa
caucauggaacuccaggacggcuacagcacagagacaggggagaagggcgcccagcugucaggu

SEQ ID NO: 687454 - RNA, 60 nt, hsa
caggagacaagcuucuuugaugagaaccgcacaggggaccucaucucccgccugaccucg

SEQ ID NO: 687455 - RNA, 64 nt, hsa
aauccgccacuuucaugacuagaguugaggaagaacaggggauaguucuguaaguguucggggg

SEQ ID NO: 687456 - RNA, 64 nt, hsa
cggaagucaguccuccucauucaccagaggacacacaggggagacgccccagucugcaggaagg

SEQ ID NO: 687457 - RNA, 64 nt, hsa
gaagucagaccuccucagucaccagaggacacacacaggggagaagccuuaugucugcagagag

SEQ ID NO: 687458 - RNA, 64 nt, hsa
ggacaucuuucaccucaggcuccugguagagaagacaggggauucuacucugugccuccugacu

SEQ ID NO: 687459 - RNA, 64 nt, hsa
uccuucaauuccucagcuuccccucugccuccaaacaggggacacuucgggaaugcugaacuaa

SEQ ID NO: 687460 - RNA, 64 nt, hsa
aaugcacaggggacacuuacggacacagaaaugcacaggggaggccgagcauaaccagggguga

SEQ ID NO: 687461 - RNA, 64 nt, hsa
aggguuuauaguagucuuguggacacagaaaugcacaggggacacuuacggacacagaaaugca

SEQ ID NO: 687462 - RNA, 64 nt, hsa
cuucuguugaugcuguauucccauaucaaaagacacaggggacacccagaaacgccacaucccc

SEQ ID NO: 687463 - RNA, 64 nt, hsa
uccuaaucacucagagcagucugugacuuaguggacaggggagggggcaaagggggaggagaag

SEQ ID NO: 687464 - RNA, 64 nt, hsa; identical to SEQ ID NO: 133930

SEQ ID NO: 687465 - RNA, 64 nt, hsa; identical to SEQ ID NO: 133931

SEQ ID NO: 687466 - RNA, 64 nt, hsa; identical to SEQ ID NO: 133932

SEQ ID NO: 687467 - RNA, 64 nt, hsa; identical to SEQ ID NO: 133933

SEQ ID NO: 687468 - RNA, 64 nt, hsa; identical to SEQ ID NO: 133934

SEQ ID NO: 687469 - RNA, 64 nt, hsa; identical to SEQ ID NO: 133935

SEQ ID NO: 687470 - RNA, 64 nt, hsa; identical to SEQ ID NO: 133936

SEQ ID NO: 687471 - RNA, 64 nt, hsa; identical to SEQ ID NO: 133937

SEQ ID NO: 687472 - RNA, 64 nt, hsa; identical to SEQ ID NO: 133938

SEQ ID NO: 687473 - RNA, 64 nt, hsa; identical to SEQ ID NO: 133939

SEQ ID NO: 687474 - RNA, 64 nt, hsa; identical to SEQ ID NO: 133940

SEQ ID NO: 687475 - RNA, 64 nt, hsa; identical to SEQ ID NO: 133941

SEQ ID NO: 687476 - RNA, 64 nt, hsa; identical to SEQ ID NO: 133942

SEQ ID NO: 687477 - RNA, 64 nt, hsa; identical to SEQ ID NO: 133943

SEQ ID NO: 687478 - RNA, 64 nt, hsa; identical to SEQ ID NO: 133944

SEQ ID NO: 687479 - RNA, 64 nt, hsa; identical to SEQ ID NO: 133945

SEQ ID NO: 687480 - RNA, 64 nt, hsa; identical to SEQ ID NO: 133946

SEQ ID NO: 687481 - RNA, 64 nt, hsa; identical to SEQ ID NO: 133947

SEQ ID NO: 687482 - RNA, 64 nt, hsa; identical to SEQ ID NO: 133948

SEQ ID NO: 687483 - RNA, 64 nt, hsa; identical to SEQ ID NO: 133949

SEQ ID NO: 687484 - RNA, 64 nt, hsa; identical to SEQ ID NO: 133950

SEQ ID NO: 687485 - RNA, 64 nt, hsa; identical to SEQ ID NO: 133951

SEQ ID NO: 687486 - RNA, 64 nt, hsa; identical to SEQ ID NO: 133952

SEQ ID NO: 687487 - RNA, 64 nt, hsa; identical to SEQ ID NO: 133953

SEQ ID NO: 687488 - RNA, 64 nt, hsa; identical to SEQ ID NO: 133954

SEQ ID NO: 687489 - RNA, 64 nt, hsa; identical to SEQ ID NO: 133955

SEQ ID NO: 687490 - RNA, 64 nt, hsa; identical to SEQ ID NO: 133956

SEQ ID NO: 687491 - RNA, 64 nt, hsa; identical to SEQ ID NO: 133957

SEQ ID NO: 687492 - RNA, 64 nt, hsa; identical to SEQ ID NO: 133958

SEQ ID NO: 687493 - RNA, 64 nt, hsa; identical to SEQ ID NO: 133959

SEQ ID NO: 687494 - RNA, 64 nt, hsa; identical to SEQ ID NO: 133960

SEQ ID NO: 687495 - RNA, 64 nt, hsa; identical to SEQ ID NO: 133961

SEQ ID NO: 687496 - RNA, 64 nt, hsa; identical to SEQ ID NO: 133962

SEQ ID NO: 687497 - RNA, 64 nt, hsa; identical to SEQ ID NO: 133963

SEQ ID NO: 687498 - RNA, 64 nt, hsa; identical to SEQ ID NO: 133964

SEQ ID NO: 687499 - RNA, 64 nt, hsa; identical to SEQ ID NO: 133965

SEQ ID NO: 687500 - RNA, 64 nt, hsa; identical to SEQ ID NO: 133966

SEQ ID NO: 687501 - RNA, 64 nt, hsa; identical to SEQ ID NO: 167990

SEQ ID NO: 687502 - RNA, 64 nt, hsa; identical to SEQ ID NO: 167991

SEQ ID NO: 687503 - RNA, 64 nt, hsa; identical to SEQ ID NO: 167992

SEQ ID NO: 687504 - RNA, 64 nt, hsa; identical to SEQ ID NO: 167993

SEQ ID NO: 687505 - RNA, 64 nt, hsa; identical to SEQ ID NO: 167994

SEQ ID NO: 687506 - RNA, 64 nt, hsa; identical to SEQ ID NO: 167995

SEQ ID NO: 687507 - RNA, 64 nt, hsa; identical to SEQ ID NO: 167996

SEQ ID NO: 687508 - RNA, 64 nt, hsa; identical to SEQ ID NO: 167997

SEQ ID NO: 687509 - RNA, 64 nt, hsa; identical to SEQ ID NO: 167998

SEQ ID NO: 687510 - RNA, 64 nt, hsa; identical to SEQ ID NO: 167999

SEQ ID NO: 687511 - RNA, 64 nt, hsa; identical to SEQ ID NO: 168000

SEQ ID NO: 687512 - RNA, 64 nt, hsa; identical to SEQ ID NO: 168001

SEQ ID NO: 687513 - RNA, 64 nt, hsa; identical to SEQ ID NO: 168002

SEQ ID NO: 687514 - RNA, 64 nt, hsa; identical to SEQ ID NO: 168003

SEQ ID NO: 687515 - RNA, 64 nt, hsa; identical to SEQ ID NO: 168004

SEQ ID NO: 687516 - RNA, 64 nt, hsa; identical to SEQ ID NO: 168005

SEQ ID NO: 687517 - RNA, 64 nt, hsa; identical to SEQ ID NO: 168006

SEQ ID NO: 687518 - RNA, 64 nt, hsa; identical to SEQ ID NO: 168007

SEQ ID NO: 687519 - RNA, 64 nt, hsa; identical to SEQ ID NO: 168008

SEQ ID NO: 687520 - RNA, 64 nt, hsa; identical to SEQ ID NO: 168009

SEQ ID NO: 687521 - RNA, 64 nt, hsa; identical to SEQ ID NO: 168010

SEQ ID NO: 687522 - RNA, 64 nt, hsa; identical to SEQ ID NO: 168011

SEQ ID NO: 687523 - RNA, 64 nt, hsa; identical to SEQ ID NO: 168012

SEQ ID NO: 687524 - RNA, 64 nt, hsa; identical to SEQ ID NO: 168013

SEQ ID NO: 687525 - RNA, 64 nt, hsa; identical to SEQ ID NO: 168014

SEQ ID NO: 687526 - RNA, 64 nt, hsa; identical to SEQ ID NO: 168015

SEQ ID NO: 687527 - RNA, 64 nt, hsa; identical to SEQ ID NO: 168016

SEQ ID NO: 687528 - RNA, 64 nt, hsa; identical to SEQ ID NO: 168017

SEQ ID NO: 687529 - RNA, 64 nt, hsa; identical to SEQ ID NO: 168018

SEQ ID NO: 687530 - RNA, 64 nt, hsa; identical to SEQ ID NO: 168018

SEQ ID NO: 687531 - RNA, 64 nt, hsa; identical to SEQ ID NO: 168020

SEQ ID NO: 687532 - RNA, 64 nt, hsa; identical to SEQ ID NO: 168021

SEQ ID NO: 687533 - RNA, 64 nt, hsa; identical to SEQ ID NO: 168022

SEQ ID NO: 687534 - RNA, 64 nt, hsa; identical to SEQ ID NO: 168023

SEQ ID NO: 687535 - RNA, 64 nt, hsa; identical to SEQ ID NO: 168024

SEQ ID NO: 687536 - RNA, 64 nt, hsa; identical to SEQ ID NO: 168025

SEQ ID NO: 687537 - RNA, 64 nt, hsa; identical to SEQ ID NO: 168026

SEQ ID NO: 687538 - RNA, 64 nt, hsa; identical to SEQ ID NO: 190819

SEQ ID NO: 687539 - RNA, 64 nt, hsa; identical to SEQ ID NO: 190820

SEQ ID NO: 687540 - RNA, 64 nt, hsa; identical to SEQ ID NO: 190821

SEQ ID NO: 687541 - RNA, 64 nt, hsa; identical to SEQ ID NO: 190822

SEQ ID NO: 687542 - RNA, 64 nt, hsa; identical to SEQ ID NO: 190823

SEQ ID NO: 687543 - RNA, 64 nt, hsa; identical to SEQ ID NO: 190824

SEQ ID NO: 687544 - RNA, 64 nt, hsa; identical to SEQ ID NO: 190825

SEQ ID NO: 687545 - RNA, 64 nt, hsa; identical to SEQ ID NO: 190826

SEQ ID NO: 687546 - RNA, 64 nt, hsa; identical to SEQ ID NO: 190827

SEQ ID NO: 687547 - RNA, 64 nt, hsa; identical to SEQ ID NO: 190828

SEQ ID NO: 687548 - RNA, 64 nt, hsa; identical to SEQ ID NO: 190829

SEQ ID NO: 687549 - RNA, 64 nt, hsa; identical to SEQ ID NO: 190830

SEQ ID NO: 687550 - RNA, 64 nt, hsa; identical to SEQ ID NO: 190831

SEQ ID NO: 687551 - RNA, 64 nt, hsa; identical to SEQ ID NO: 190832

SEQ ID NO: 687552 - RNA, 64 nt, hsa; identical to SEQ ID NO: 150215

SEQ ID NO: 687553 - RNA, 64 nt, hsa; identical to SEQ ID NO: 150216

SEQ ID NO: 687554 - RNA, 64 nt, hsa; identical to SEQ ID NO: 150217

SEQ ID NO: 687555 - RNA, 64 nt, hsa; identical to SEQ ID NO: 150218

SEQ ID NO: 687556 - RNA, 64 nt, hsa; identical to SEQ ID NO: 150219

SEQ ID NO: 687557 - RNA, 64 nt, hsa; identical to SEQ ID NO: 150220

SEQ ID NO: 687558 - RNA, 64 nt, hsa; identical to SEQ ID NO: 150221

SEQ ID NO: 687559 - RNA, 64 nt, hsa; identical to SEQ ID NO: 150222

SEQ ID NO: 687560 - RNA, 64 nt, hsa; identical to SEQ ID NO: 150223

SEQ ID NO: 687561 - RNA, 64 nt, hsa; identical to SEQ ID NO: 150224

SEQ ID NO: 687562 - RNA, 64 nt, hsa; identical to SEQ ID NO: 150225

SEQ ID NO: 687563 - RNA, 64 nt, hsa; identical to SEQ ID NO: 150226

SEQ ID NO: 687564 - RNA, 64 nt, hsa; identical to SEQ ID NO: 150227

SEQ ID NO: 687565 - RNA, 64 nt, hsa; identical to SEQ ID NO: 150228

SEQ ID NO: 687566 - RNA, 64 nt, hsa; identical to SEQ ID NO: 150229

SEQ ID NO: 687567 - RNA, 64 nt, hsa; identical to SEQ ID NO: 150230

SEQ ID NO: 687568 - RNA, 64 nt, hsa; identical to SEQ ID NO: 150231

SEQ ID NO: 687569 - RNA, 64 nt, hsa; identical to SEQ ID NO: 150232

SEQ ID NO: 687570 - RNA, 64 nt, hsa; identical to SEQ ID NO: 150233

SEQ ID NO: 687571 - RNA, 64 nt, hsa; identical to SEQ ID NO: 150234

SEQ ID NO: 687572 - RNA, 64 nt, hsa; identical to SEQ ID NO: 150235

SEQ ID NO: 687573 - RNA, 64 nt, hsa; identical to SEQ ID NO: 150236

SEQ ID NO: 687574 - RNA, 64 nt, hsa; identical to SEQ ID NO: 150237

SEQ ID NO: 687575 - RNA, 64 nt, hsa; identical to SEQ ID NO: 150238

SEQ ID NO: 687576 - RNA, 64 nt, hsa; identical to SEQ ID NO: 150239

SEQ ID NO: 687577 - RNA, 64 nt, hsa; identical to SEQ ID NO: 150240

SEQ ID NO: 687578 - RNA, 64 nt, hsa; identical to SEQ ID NO: 150241

SEQ ID NO: 687579 - RNA, 64 nt, hsa; identical to SEQ ID NO: 150242

SEQ ID NO: 687580 - RNA, 64 nt, hsa; identical to SEQ ID NO: 150243

SEQ ID NO: 687581 - RNA, 64 nt, hsa; identical to SEQ ID NO: 150244

SEQ ID NO: 687582 - RNA, 64 nt, hsa; identical to SEQ ID NO: 150245

SEQ ID NO: 687583 - RNA, 64 nt, hsa; identical to SEQ ID NO: 150246

SEQ ID NO: 687584 - RNA, 64 nt, hsa; identical to SEQ ID NO: 150247

SEQ ID NO: 687585 - RNA, 64 nt, hsa; identical to SEQ ID NO: 150248

SEQ ID NO: 687586 - RNA, 64 nt, hsa; identical to SEQ ID NO: 107849

SEQ ID NO: 687587 - RNA, 64 nt, hsa; identical to SEQ ID NO: 107850

SEQ ID NO: 687588 - RNA, 64 nt, hsa; identical to SEQ ID NO: 107851

SEQ ID NO: 687589 - RNA, 64 nt, hsa; identical to SEQ ID NO: 107852

SEQ ID NO: 687590 - RNA, 64 nt, hsa; identical to SEQ ID NO: 107853

SEQ ID NO: 687591 - RNA, 64 nt, hsa; identical to SEQ ID NO: 107854

SEQ ID NO: 687592 - RNA, 64 nt, hsa; identical to SEQ ID NO: 107855

SEQ ID NO: 687593 - RNA, 64 nt, hsa; identical to SEQ ID NO: 107856

SEQ ID NO: 687594 - RNA, 64 nt, hsa; identical to SEQ ID NO: 107857

SEQ ID NO: 687595 - RNA, 64 nt, hsa; identical to SEQ ID NO: 107858

SEQ ID NO: 687596 - RNA, 64 nt, hsa; identical to SEQ ID NO: 107859

SEQ ID NO: 687597 - RNA, 64 nt, hsa; identical to SEQ ID NO: 107860

SEQ ID NO: 687598 - RNA, 64 nt, hsa; identical to SEQ ID NO: 107861

SEQ ID NO: 687599 - RNA, 64 nt, hsa; identical to SEQ ID NO: 107862

SEQ ID NO: 687600 - RNA, 64 nt, hsa; identical to SEQ ID NO: 107863

SEQ ID NO: 687601 - RNA, 63 nt, hsa; identical to SEQ ID NO: 107864

SEQ ID NO: 687602 - RNA, 64 nt, hsa; identical to SEQ ID NO: 107865

SEQ ID NO: 687603 - RNA, 64 nt, hsa; identical to SEQ ID NO: 107866

SEQ ID NO: 687604 - RNA, 64 nt, hsa; identical to SEQ ID NO: 107867

SEQ ID NO: 687605 - RNA, 64 nt, hsa; identical to SEQ ID NO: 107868

SEQ ID NO: 687606 - RNA, 64 nt, hsa; identical to SEQ ID NO: 107869

SEQ ID NO: 687607 - RNA, 64 nt, hsa; identical to SEQ ID NO: 107870

SEQ ID NO: 687608 - RNA, 64 nt, hsa; identical to SEQ ID NO: 107871

SEQ ID NO: 687609 - RNA, 64 nt, hsa; identical to SEQ ID NO: 107872

SEQ ID NO: 687610 - RNA, 64 nt, hsa; identical to SEQ ID NO: 107873

SEQ ID NO: 687611 - RNA, 64 nt, hsa; identical to SEQ ID NO: 107874

SEQ ID NO: 687612 - RNA, 64 nt, hsa; identical to SEQ ID NO: 107875

SEQ ID NO: 687613 - RNA, 64 nt, hsa; identical to SEQ ID NO: 107876

SEQ ID NO: 687614 - RNA, 64 nt, hsa; identical to SEQ ID NO: 107877

SEQ ID NO: 687615 - RNA, 64 nt, hsa; identical to SEQ ID NO: 107878

SEQ ID NO: 687616 - RNA, 64 nt, hsa; identical to SEQ ID NO: 107879

SEQ ID NO: 687617 - RNA, 64 nt, hsa; identical to SEQ ID NO: 107880

SEQ ID NO: 687618 - RNA, 64 nt, hsa; identical to SEQ ID NO: 107881

SEQ ID NO: 687619 - RNA, 64 nt, hsa; identical to SEQ ID NO: 107882

SEQ ID NO: 687620 - RNA, 64 nt, hsa; identical to SEQ ID NO: 107883

SEQ ID NO: 687621 - RNA, 64 nt, hsa; identical to SEQ ID NO: 107884

SEQ ID NO: 687622 - RNA, 64 nt, hsa; identical to SEQ ID NO: 107885

SEQ ID NO: 687623 - RNA, 64 nt, hsa; identical to SEQ ID NO: 107886

SEQ ID NO: 687624 - RNA, 64 nt, hsa; identical to SEQ ID NO: 107887

SEQ ID NO: 687625 - RNA, 64 nt, hsa; identical to SEQ ID NO: 107888

SEQ ID NO: 687626 - RNA, 64 nt, hsa; identical to SEQ ID NO: 107889

SEQ ID NO: 687627 - RNA, 64 nt, hsa; identical to SEQ ID NO: 107890

SEQ ID NO: 687628 - RNA, 64 nt, hsa; identical to SEQ ID NO: 107891

SEQ ID NO: 687629 - RNA, 64 nt, hsa; identical to SEQ ID NO: 107892

SEQ ID NO: 687630 - RNA, 64 nt, hsa; identical to SEQ ID NO: 107893

SEQ ID NO: 687631 - RNA, 64 nt, hsa; identical to SEQ ID NO: 107894

SEQ ID NO: 687632 - RNA, 64 nt, hsa; identical to SEQ ID NO: 107895

SEQ ID NO: 687633 - RNA, 64 nt, hsa; identical to SEQ ID NO: 107896

SEQ ID NO: 687634 - RNA, 64 nt, hsa; identical to SEQ ID NO: 107897

SEQ ID NO: 687635 - RNA, 64 nt, hsa; identical to SEQ ID NO: 107898

SEQ ID NO: 687636 - RNA, 64 nt, hsa; identical to SEQ ID NO: 107899

SEQ ID NO: 687637 - RNA, 64 nt, hsa; identical to SEQ ID NO: 107900

SEQ ID NO: 687638 - RNA, 64 nt, hsa; identical to SEQ ID NO: 107901

SEQ ID NO: 687639 - RNA, 64 nt, hsa; identical to SEQ ID NO: 107902

SEQ ID NO: 687640 - RNA, 64 nt, hsa; identical to SEQ ID NO: 107903

SEQ ID NO: 687641 - RNA, 64 nt, hsa; identical to SEQ ID NO: 107904

SEQ ID NO: 687642 - RNA, 64 nt, hsa; identical to SEQ ID NO: 107905

SEQ ID NO: 687643 - RNA, 64 nt, hsa; identical to SEQ ID NO: 107906

SEQ ID NO: 687644 - RNA, 64 nt, hsa; identical to SEQ ID NO: 107907

SEQ ID NO: 687645 - RNA, 64 nt, hsa; identical to SEQ ID NO: 107908

SEQ ID NO: 687646 - RNA, 64 nt, hsa; identical to SEQ ID NO: 107909

SEQ ID NO: 687647 - RNA, 64 nt, hsa; identical to SEQ ID NO: 107910

SEQ ID NO: 687648 - RNA, 64 nt, hsa; identical to SEQ ID NO: 107911

SEQ ID NO: 687649 - RNA, 64 nt, hsa; identical to SEQ ID NO: 107912

SEQ ID NO: 687650 - RNA, 64 nt, hsa; identical to SEQ ID NO: 107913

SEQ ID NO: 687651 - RNA, 64 nt, hsa; identical to SEQ ID NO: 107914

SEQ ID NO: 687652 - RNA, 64 nt, hsa; identical to SEQ ID NO: 107915

SEQ ID NO: 687653 - RNA, 64 nt, hsa; identical to SEQ ID NO: 107916

SEQ ID NO: 687654 - RNA, 64 nt, hsa; identical to SEQ ID NO: 107917

SEQ ID NO: 687655 - RNA, 64 nt, hsa; identical to SEQ ID NO: 107918

SEQ ID NO: 687656 - RNA, 64 nt, hsa; identical to SEQ ID NO: 107919

SEQ ID NO: 687657 - RNA, 64 nt, hsa; identical to SEQ ID NO: 107920

SEQ ID NO: 687658 - RNA, 64 nt, hsa; identical to SEQ ID NO: 107921

SEQ ID NO: 687659 - RNA, 64 nt, hsa; identical to SEQ ID NO: 107922

SEQ ID NO: 687660 - RNA, 64 nt, hsa; identical to SEQ ID NO: 107923

SEQ ID NO: 687661 - RNA, 64 nt, hsa; identical to SEQ ID NO: 107924

SEQ ID NO: 687662 - RNA, 64 nt, hsa; identical to SEQ ID NO: 107925

SEQ ID NO: 687663 - RNA, 64 nt, hsa; identical to SEQ ID NO: 107926

SEQ ID NO: 687664 - RNA, 64 nt, hsa; identical to SEQ ID NO: 107927

SEQ ID NO: 687665 - RNA, 64 nt, hsa; identical to SEQ ID NO: 107928

SEQ ID NO: 687666 - RNA, 64 nt, hsa; identical to SEQ ID NO: 107929

SEQ ID NO: 687667 - RNA, 64 nt, hsa; identical to SEQ ID NO: 107930

SEQ ID NO: 687668 - RNA, 64 nt, hsa; identical to SEQ ID NO: 107931

SEQ ID NO: 687669 - RNA, 64 nt, hsa; identical to SEQ ID NO: 107932

SEQ ID NO: 687670 - RNA, 64 nt, hsa; identical to SEQ ID NO: 107933

SEQ ID NO: 687671 - RNA, 64 nt, hsa; identical to SEQ ID NO: 434057

SEQ ID NO: 687672 - RNA, 64 nt, hsa; identical to SEQ ID NO: 434058

SEQ ID NO: 687673 - RNA, 64 nt, hsa; identical to SEQ ID NO: 434059

SEQ ID NO: 687674 - RNA, 64 nt, hsa; identical to SEQ ID NO: 434060

SEQ ID NO: 687675 - RNA, 64 nt, hsa; identical to SEQ ID NO: 434061

SEQ ID NO: 687676 - RNA, 64 nt, hsa; identical to SEQ ID NO: 434062

SEQ ID NO: 687677 - RNA, 64 nt, hsa; identical to SEQ ID NO: 434063

SEQ ID NO: 687678 - RNA, 64 nt, hsa; identical to SEQ ID NO: 434064

SEQ ID NO: 687679 - RNA, 64 nt, hsa; identical to SEQ ID NO: 434065

SEQ ID NO: 687680 - RNA, 64 nt, hsa; identical to SEQ ID NO: 434066

SEQ ID NO: 687681 - RNA, 63 nt, hsa
ccagagcguggacagggcuuccgugagacgccaccgugagaggccagguggcagcuugagcau

SEQ ID NO: 687682 - RNA, 63 nt, hsa
cggagcucaccgcccagagcguggacagggcuuccgugagacgccaccgugagaggccaggug

SEQ ID NO: 687683 - RNA, 64 nt, hsa; identical to SEQ ID NO: 570206

SEQ ID NO: 687684 - RNA, 64 nt, hsa; identical to SEQ ID NO: 570207

SEQ ID NO: 687685 - RNA, 64 nt, hsa; identical to SEQ ID NO: 570208

SEQ ID NO: 687686 - RNA, 64 nt, hsa; identical to SEQ ID NO: 570209

SEQ ID NO: 687687 - RNA, 64 nt, hsa; identical to SEQ ID NO: 570210

SEQ ID NO: 687688 - RNA, 64 nt, hsa; identical to SEQ ID NO: 570211

SEQ ID NO: 687689 - RNA, 64 nt, hsa; identical to SEQ ID NO: 570212

SEQ ID NO: 687690 - RNA, 64 nt, hsa; identical to SEQ ID NO: 570213

SEQ ID NO: 687691 - RNA, 64 nt, hsa; identical to SEQ ID NO: 570214

SEQ ID NO: 687692 - RNA, 64 nt, hsa; identical to SEQ ID NO: 570215

SEQ ID NO: 687693 - RNA, 64 nt, hsa; identical to SEQ ID NO: 570216

SEQ ID NO: 687694 - RNA, 64 nt, hsa; identical to SEQ ID NO: 570217

SEQ ID NO: 687695 - RNA, 62 nt, hsa
agggguguuuguuggauggguuuaaaaauaacuagaaaaacucaggcccauccauuuucuca

SEQ ID NO: 687696 - RNA, 62 nt, hsa
cuuaaaaucaguguuuccccuuugugcacuuguagaaaaaaaagaaaaaccuucuagagcug

SEQ ID NO: 687697 - RNA, 62 nt, hsa
uuuuuucagaauaaacaacuaaauaacuguauuagaaaaaaaagaaacuuacuaaauaucau

SEQ ID NO: 687698 - RNA, 62 nt, hsa
uuuacuguuucuguuauaauaaaaggguauguuagaaaaacaaaaaggaggcugggcauggu

SEQ ID NO: 687699 - RNA, 62 nt, hsa
cuguuaacuaaaaaugcugagaccccuuuuuauagaaaaacaaaaagacaucaagucuucuu

SEQ ID NO: 687700 - RNA, 62 nt, hsa
guaauuugauuuacaugcauuagagcacacaguagaaaaacuuuagcuucauuaguaauaug

SEQ ID NO: 687701 - RNA, 62 nt, hsa
aauuuuauuuuaucauccuagaaagccuugacuagaaaaaugaauaaauauugaggguuucc

SEQ ID NO: 687702 - RNA, 62 nt, hsa
agauaaaauacauucuuuuaauucugggaaauuagaaaaaguggggugaucuuuccaggaaa

SEQ ID NO: 687703 - RNA, 62 nt, hsa
ugacauuuaucuucaaaacaccaaauugucuuuagaaaaauuaaugugauuacagguagagg

SEQ ID NO: 687704 - RNA, 62 nt, hsa
uagccuccaucuuuuaaacuuuuugaacucaguagaaaaacagacugaaauuuuaaagacau

SEQ ID NO: 687705 - RNA, 62 nt, hsa
uagcuguaacauccgauucuguauaagccacauagaaaaaaguugccuuucuuuuuuuauga

SEQ ID NO: 687706 - RNA, 62 nt, hsa
uacauauggauuuuguauauauaggagauuuuuagaaaaaucaacaaccuaacaccagauuc

SEQ ID NO: 687707 - RNA, 62 nt, hsa
cagauaucauuaggaucacacagaguuaaauauagaaaaaugaaaccaucauuauauucuuu

SEQ ID NO: 687708 - RNA, 62 nt, hsa
aauaaucucuauuuauaacuaaaucauugagauagaaaaagauucccauugacuguagacuu

SEQ ID NO: 687709 - RNA, 62 nt, hsa
aauuuuagaucugaucagguaguagcuaaaauuagaaaaaaacaaaauagaugcuuaaagaa

SEQ ID NO: 687710 - RNA, 62 nt, hsa
ucaaacaaacagcacuuacaggaaauguaaaguagaaaaagauuucugcccacuuuaccuac

SEQ ID NO: 687711 - RNA, 62 nt, hsa
auauucugugugaugggauaugaaaugguccauagaaaaaaaccggaaaaauacgccaaggu

SEQ ID NO: 687712 - RNA, 62 nt, hsa
uguugucuuauuauuauauagaaaaauaacuuuagaaaaauauugaagacauuguauuacca

SEQ ID NO: 687713 - RNA, 62 nt, hsa
ccuauaugcuaugcuguugucuuauuauuauauagaaaaauaacuuuagaaaaauauugaag

SEQ ID NO: 687714 - RNA, 62 nt, hsa
ggguuuuuuucuuauuguuuucuccccaggguuagaaaaauugguauaaguuccuaauuaaa

SEQ ID NO: 687715 - RNA, 62 nt, hsa
uaaagguucugggaagcuaauaauugaauuauuagaaaaacauuucagaauaggaaguaaau

SEQ ID NO: 687716 - RNA, 62 nt, hsa
gccagguuuauuuucuccuuuuuugagauuucuagaaaaaaugcugcuugcacauguugguu

SEQ ID NO: 687717 - RNA, 62 nt, hsa
gugcaguguguaaauacuuuaaauuauuaugcuagaaaaauaaaguuacauaccuugcugug

SEQ ID NO: 687718 - RNA, 62 nt, hsa
uggccaaaaugguugcaaucauucauacuaguuagaaaaauuauguguugaaauaaguggaa

SEQ ID NO: 687719 - RNA, 62 nt, hsa
ccagaaauaccugauuuugaaucauucaacaguagaaaaagaggcauauuuucauuacuuga

SEQ ID NO: 687720 - RNA, 62 nt, hsa
auguggcauaaauuuggagaaaauaauaugacuagaaaaauuaguguuauauugggugugag

SEQ ID NO: 687721 - RNA, 62 nt, hsa
auauacagaauuagccaaaugguauaagacaauagaaaaaggcuguggauucuuugaggaca

SEQ ID NO: 687722 - RNA, 62 nt, hsa
cugaugaaauguuaacaaugccuauuguaauauagaaaaaaacauucuaucuacugauuugg

SEQ ID NO: 687723 - RNA, 62 nt, hsa
gcuaugaagagcuagagaaauucuuguuaugguagaaaaauuucacgauucauuuuugaaac

SEQ ID NO: 687724 - RNA, 62 nt, hsa
uauuugauauuuuaauuuauuuuuugauugacuagaaaaaucauuuuaauuucacuaaaaug

SEQ ID NO: 687725 - RNA, 62 nt, hsa
uguuuucccacauuuaggaccaaagacggcuauagaaaaacucaaauggauugcuucccaaa

SEQ ID NO: 687726 - RNA, 62 nt, hsa
gauccuuauagauacgguaagagccacauucguagaaaaacuucugguguggccagguuuua

SEQ ID NO: 687727 - RNA, 62 nt, hsa
aguagcuugucaucaauccccuugucgaaaacuagaaaaaaaggaguugacccauauaaauu

SEQ ID NO: 687728 - RNA, 62 nt, hsa
aacucaaauacugugaacuaucucuaaaacacuagaaaaaagaaauguuaguaucucaauua

SEQ ID NO: 687729 - RNA, 62 nt, hsa
uacccgugucaauuaacauuuaaacuggcauauagaaaaaaaggaggauuuuucugcauugu

SEQ ID NO: 687730 - RNA, 62 nt, hsa
aguuuuuaaaaauaaauuauaaacuuggagauuagaaaaauaaagcaguugcuguagaauag

SEQ ID NO: 687731 - RNA, 62 nt, hsa
ugcuuuagaguuaaauauuccuaucuuaaguuuagaaaaauacaaaaaaccauuccaaggau

SEQ ID NO: 687732 - RNA, 62 nt, hsa
uggaacuagucauuaacccaucucugaacugguagaaaaacaucugaagagcuagucuauca

SEQ ID NO: 687733 - RNA, 62 nt, hsa
uuaucucaggugagcugguagaggggagacauuagaaaaaaaugaaacaacaaaacaauuac

SEQ ID NO: 687734 - RNA, 62 nt, hsa
gccuuacuuugugauuauacguuaucuccggcuagaaaaaaauaaugguaguaaagaaacug

SEQ ID NO: 687735 - RNA, 62 nt, hsa
uuaaaaacauucauuugaacacaguaguccccuagaaaaacaacucuacaaaaauuuugcag

SEQ ID NO: 687736 - RNA, 62 nt, hsa
uuaucaccuuagcaacuuagaauaguuugaaauagaaaaaaaguauuuaauuuggaucugga

SEQ ID NO: 687737 - RNA, 62 nt, hsa
gaaagaaguauuaaaaagagugaggauggauuuagaaaaaaacaugaauuuagaaauauuca

SEQ ID NO: 687738 - RNA, 62 nt, hsa
aggcguuuuuuggggauguggagguaguuggguagaaaaauuauuagaacauucacuuuugu

SEQ ID NO: 687739 - RNA, 62 nt, hsa
ucuguagacucuaagauacacugcacuuuguuuagaaaaaaaacugaagaugaaauauauau

SEQ ID NO: 687740 - RNA, 62 nt, hsa
uugacacuuuuaauuuucauuuaacaauggauuagaaaaauauuuuggucuagccacuaaac

SEQ ID NO: 687741 - RNA, 62 nt, hsa
acccaaaaaccauuuggcuggcagaaauuaucuagaaaaauuauuauuuugcaguuaucuga

SEQ ID NO: 687742 - RNA, 62 nt, hsa
uaaaaauagcacauuugaguacauuugaaaaguagaaaaauuagaaauuauuaacuuuauug

SEQ ID NO: 687743 - RNA, 62 nt, hsa
acauagcuguuuuaacaaaugaaaaaaagacguagaaaaauguuuagaugucuuuuugugau

SEQ ID NO: 687744 - RNA, 62 nt, hsa
ugagaaggugaacuguuacgacccaggacaauuagaaaaauucacccaccaugccgcacauu

SEQ ID NO: 687745 - RNA, 62 nt, hsa
uuaugggauuggaagaaacacguggucaugaauagaaaaaaaacaaacccaaagguaggaag

SEQ ID NO: 687746 - RNA, 62 nt, hsa
gagcuuucauuuuuaaaaauuauauuuuacuuuagaaaaauaucaccuuuuuucuuccucuu

SEQ ID NO: 687747 - RNA, 62 nt, hsa
aaucuaggacuuccagcuucccucaugucagauagaaaaaaagucaggaaaccagcucgugg

SEQ ID NO: 687748 - RNA, 62 nt, hsa
cauaugccuguggaguggaauauucuguuuaguagaaaaauccuuuagaguucagcucuaac

SEQ ID NO: 687749 - RNA, 62 nt, hsa
cuuuagacuuaguaguaauuaugaaccucacauagaaaaauuucauccagccauaugccugu

SEQ ID NO: 687750 - RNA, 62 nt, hsa
uuaaaaaaaagcauaaaaacauuuuaaaaacauagaaaaauucagcaaaccauuuuuaaagu

SEQ ID NO: 687751 - RNA, 62 nt, hsa
aaaccauuuuuaaaguagaagaggguuuuagguagaaaaacauauucuugugcuuuuccuga

SEQ ID NO: 687752 - RNA, 62 nt, hsa
uuugaauacuuguuucuuuagcacuuugaagauagaaaaaccacuuuuuaaguacuaaguca

SEQ ID NO: 687753 - RNA, 62 nt, hsa
gcugugcauuuuaaccaauaaucugaugaauauagaaaaaaaugauccaaaauauggauaug

SEQ ID NO: 687754 - RNA, 62 nt, hsa
aaguugaccuuugcacuggcauuaaagagucauagaaaaagaaucauggauauuuaugaauu

SEQ ID NO: 687755 - RNA, 62 nt, hsa
uuuucuuugcauuugaauaauugucuuguacuuagaaaaaaggcgucuaugaaugaccagug

SEQ ID NO: 687756 - RNA, 62 nt, hsa
uucuuggcuuuccgaaggccaugaucuagagauagaaaaaucccuacuaagucccaacagga

SEQ ID NO: 687757 - RNA, 62 nt, hsa
ccaacaauggugugcugggggugggguuacuuuagaaaaaguggacacagaccagacuaagg

SEQ ID NO: 687758 - RNA, 62 nt, hsa
guauuauauacaaguguaauacaugcauauaauagaaaaaaaacauggaauuucaaauauac

SEQ ID NO: 687759 - RNA, 62 nt, hsa
uugaaugcuuauauauuuguucaaucuguugauagaaaaaauuguucauuuuccucagucuc

SEQ ID NO: 687760 - RNA, 62 nt, hsa
uucuaccagaaauuuccagagcauuauguagguagaaaaaaaugcaagcaagcuguuaaaga

SEQ ID NO: 687761 - RNA, 62 nt, hsa
gaaugcauuucguaguucuuuauaugaaggguuagaaaaaccggaaucaagaaguucgauuc

SEQ ID NO: 687762 - RNA, 62 nt, hsa
aucaaauuauauaaacaguaccaauaucauuauagaaaaaaauaacauuuuaauguauauug

SEQ ID NO: 687763 - RNA, 62 nt, hsa
uaauaaaauucuauugcaaaaauuucuuuuucuagaaaaaauaaauacaaaaaaaaaaaaga

SEQ ID NO: 687764 - RNA, 62 nt, hsa
gguguuuuuuuuguuuguuuguuuguuuguuuuagaaaaauugggauuuccccccaccccgc

SEQ ID NO: 687765 - RNA, 62 nt, hsa
agcacaagagaauuagagcuucagugagaauuuagaaaaauuauacuaaagugagaugcauu

SEQ ID NO: 687766 - RNA, 62 nt, hsa
acucuucugcaaaaauggauauuauuagaaauuagaaaaaaauuacuaauuuuacacauuag

SEQ ID NO: 687767 - RNA, 62 nt, hsa
ugugcaaaagcuucaaauuaaaacagcugcauuagaaaaagaggcgcuucuccccuccccua

SEQ ID NO: 687768 - RNA, 62 nt, hsa
cccucucucuuuuuuuaacaaaugccuucuuauagaaaaacuuucuaagaggcaacaauuua

SEQ ID NO: 687769 - RNA, 62 nt, hsa
uguaacaguuuuaugucaaaugaucugugcuguagaaaaacauuaacccuuguucaaaaaag

SEQ ID NO: 687770 - RNA, 62 nt, hsa
uuagauguauagaaaaguaagaaaaucuuacuuagaaaaaagccccuugaaacuugcaggau

SEQ ID NO: 687771 - RNA, 62 nt, hsa
aauagcauucuuauucacuuuaugccgguauuuagaaaaaauaaauuauagcaaguaugauu

SEQ ID NO: 687772 - RNA, 62 nt, hsa
cagcuuuggcaacagaacgagaucccaucucuuagaaaaacaaaguugauaguuaaagaaca

SEQ ID NO: 687773 - RNA, 62 nt, hsa
uggcaauaacuuuugaauuuuaauuuuuauaauagaaaaaugauuaggaauugcuagauagu

SEQ ID NO: 687774 - RNA, 62 nt, hsa
agaggaaaaguugauuaacuucugguuugguuuagaaaaaguaauguuugaaauacgaaggu

SEQ ID NO: 687775 - RNA, 62 nt, hsa
uuaauuuacuauuucagauuuuuaaaauaguauagaaaaaaguaggagugauagagaacaaa

SEQ ID NO: 687776 - RNA, 62 nt, hsa
uauauuugucacuuuaaaaaauccauuucuuuuagaaaaaauuagggugauaggauauucau

SEQ ID NO: 687777 - RNA, 62 nt, hsa
caauacaauuguaauguagaaauauaagaauuuagaaaaaaguaaacuugccauuugguuaa

SEQ ID NO: 687778 - RNA, 62 nt, hsa
aaacaaaucuuucuacgcuuaaaugaucaaauuagaaaaaccaauuccuauaauuaauaugc

SEQ ID NO: 687779 - RNA, 62 nt, hsa
gauuuauacuuuuaauauugaauauaguuucguagaaaaacauuuuauauguacuauucuua

SEQ ID NO: 687780 - RNA, 62 nt, hsa
ucaaguuaccaaauuuuuuguaauccuuuuacuagaaaaaucuuuuuugaagaguuuuucuu

SEQ ID NO: 687781 - RNA, 62 nt, hsa
ugugcuugcuucggcagcauauauacugaaauuagaaaaagaaaacuuuucuuuuuuauuau

SEQ ID NO: 687782 - RNA, 62 nt, hsa
aaagcaacuuauguguucgaucauguaugagauagaaaaauuuuuauuacucaaaguaaaau

SEQ ID NO: 687783 - RNA, 62 nt, hsa
ggccuuaugauucagcagcuuggucacuugauuagaaaaauaaaccauuguuucuucaauug

SEQ ID NO: 687784 - RNA, 62 nt, hsa
aggggauugcuacaccauguagaaaaaguauguagaaaaaaagugcuuaauauuguuauugc

SEQ ID NO: 687785 - RNA, 62 nt, hsa
uuuggggauucaaaggggauugcuacaccauguagaaaaaguauguagaaaaaaagugcuua

SEQ ID NO: 687786 - RNA, 62 nt, hsa
uuccgugguugaauauauuugagaugguaccuuagaaaaaguuucacgcagauccuugguug

SEQ ID NO: 687787 - RNA, 62 nt, hsa
aaucccaggccuugugauuugagaugguaccuuagaaaaaguuacacgcaguuccgugguug

SEQ ID NO: 687788 - RNA, 62 nt, hsa
augucgauugauaucgcugcuacaucagacucuagaaaaaagggcugagaggaagcaagacg

SEQ ID NO: 687789 - RNA, 62 nt, hsa
uugugagcucugguuauuuuucucuuguaccauagaaaaauguauaaaaauuaucaaaaagc

SEQ ID NO: 687790 - RNA, 62 nt, hsa
ggagaaaaagaaaacucuggcguuagaggauauagaaaaauauaaguacaauuguuacaaau

SEQ ID NO: 687791 - RNA, 62 nt, hsa
ugaacgcccccagaaaauugugccaaagaguuuagaaaaauaaauauacaauaaaaguaaac

SEQ ID NO: 687792 - RNA, 62 nt, hsa
gacugcagugcccaaggaauuucugcucugguuagaaaaaggacucugcuucaguccacuuc

SEQ ID NO: 687793 - RNA, 62 nt, hsa
aggacucugcuucaguccacuucugcucugguuagaaaaaggacucugcuucaguccacagu

SEQ ID NO: 687794 - RNA, 62 nt, hsa
ugcaaguuuaauuugauuuauuucagagaaaauagaaaaaacaauguuagaagguuauuuaa

SEQ ID NO: 687795 - RNA, 62 nt, hsa
auacauaaucuacaauaagggucuuagugcuuuagaaaaaaguuaaaauuggaagucauuaa

SEQ ID NO: 687796 - RNA, 62 nt, hsa
ucagaaagucuuuauaaccacuggucaacgauuagaaaaauauaacuggauuuaggccuacc

SEQ ID NO: 687797 - RNA, 62 nt, hsa
auuuucaaauuauuuagaagcagauuuuccuguagaaaaacuaauuuuucugccuuuuacca

SEQ ID NO: 687798 - RNA, 62 nt, hsa
aucuuuggucuuaguuuucuagaaaaaaggaguagaaaaaacaauucuggcuuuauauuaaa

SEQ ID NO: 687799 - RNA, 62 nt, hsa
cacaauuucuucaaucuuuggucuuaguuuucuagaaaaaaggaguagaaaaaacaauucug

SEQ ID NO: 687800 - RNA, 62 nt, hsa
aguaccauuggagaguuaacagaauaaucuaguagaaaaauaacugguugcauguaaaauuc

SEQ ID NO: 687801 - RNA, 62 nt, hsa
aaaguguuaacuuacggguauuuuugugggaauagaaaaaaauuguuuauuuuuuauucuuc

SEQ ID NO: 687802 - RNA, 64 nt, hsa
uuuguuacuguauuucuuuugaguugaggcacuuacauaacaaucuucuuugcuuuuuuggcag

SEQ ID NO: 687803 - RNA, 64 nt, hsa
cugugcugauaaguaacugauacauauaacauaaacauaacaaaguugccuaguugauguaaca

SEQ ID NO: 687804 - RNA, 64 nt, hsa
uaccuaaguaaacauaacauuaauaccuaaguaaacauaacauuacuuggaggguugcaguuuc

SEQ ID NO: 687805 - RNA, 64 nt, hsa
uggaaauuauugccucugauacauaccuaaguaaacauaacauuaauaccuaaguaaacauaac

SEQ ID NO: 687806 - RNA, 64 nt, hsa
gagucugaggguuagaaggaagucauugugucuaacauaacaacagagcaguuugugucacuga

SEQ ID NO: 687807 - RNA, 64 nt, hsa
cauauccaguaguaccuuuaaaguaacacuuuguacauaacaaauacucagcaaaugugaaacu

SEQ ID NO: 687808 - RNA, 64 nt, hsa
agccccuuauuuuucaacaaaggggauuuuguacacauaacauggguuauuuaguuuaacucug

SEQ ID NO: 687809 - RNA, 64 nt, hsa
cuaaaugaaugcaaugugcauaaauauuuuuuaaacauaacagugaacuauugcaccuuuugcu

SEQ ID NO: 687810 - RNA, 64 nt, hsa
uugcagagugccauggucaugucauucugaggucacauaacacauaaaauuaguuucuaugagu

SEQ ID NO: 687811 - RNA, 64 nt, hsa
caugcucagauguguagacauccuccguauauuuacauaacauauagagguaauagauagguga

SEQ ID NO: 687812 - RNA, 64 nt, hsa
gcuuuucucaugguauuaucuaguaggucugcacacauaacacacaucaguccacccccauugu

SEQ ID NO: 687813 - RNA, 64 nt, hsa
ucuuuaugauuucaugauuagacaauguggaauuacauaacaggcauugcacuaaaagugaugu

SEQ ID NO: 687814 - RNA, 64 nt, hsa
uuaacauaaagguuauuuucuccugauauagaucacauaacagaaugcaccagucaucagcuau

SEQ ID NO: 687815 - RNA, 64 nt, hsa
uaauccguaccuuguguuuuguuuugauuuaauaacauaacaaauaaccaacccuucccugaaa

SEQ ID NO: 687816 - RNA, 64 nt, hsa; identical to SEQ ID NO: 270805

SEQ ID NO: 687817 - RNA, 64 nt, hsa; identical to SEQ ID NO: 270806

SEQ ID NO: 687818 - RNA, 64 nt, hsa; identical to SEQ ID NO: 270807

SEQ ID NO: 687819 - RNA, 64 nt, hsa; identical to SEQ ID NO: 270808

SEQ ID NO: 687820 - RNA, 64 nt, hsa; identical to SEQ ID NO: 270809

SEQ ID NO: 687821 - RNA, 64 nt, hsa; identical to SEQ ID NO: 270810

SEQ ID NO: 687822 - RNA, 64 nt, hsa; identical to SEQ ID NO: 270811

SEQ ID NO: 687823 - RNA, 64 nt, hsa; identical to SEQ ID NO: 270812

SEQ ID NO: 687824 - RNA, 64 nt, hsa; identical to SEQ ID NO: 270813

SEQ ID NO: 687825 - RNA, 64 nt, hsa; identical to SEQ ID NO: 270814

SEQ ID NO: 687826 - RNA, 64 nt, hsa; identical to SEQ ID NO: 270815

SEQ ID NO: 687827 - RNA, 64 nt, hsa; identical to SEQ ID NO: 270816

SEQ ID NO: 687828 - RNA, 64 nt, hsa; identical to SEQ ID NO: 188606

SEQ ID NO: 687829 - RNA, 64 nt, hsa; identical to SEQ ID NO: 188607

SEQ ID NO: 687830 - RNA, 64 nt, hsa; identical to SEQ ID NO: 188608

SEQ ID NO: 687831 - RNA, 64 nt, hsa; identical to SEQ ID NO: 188609

SEQ ID NO: 687832 - RNA, 64 nt, hsa; identical to SEQ ID NO: 188610

SEQ ID NO: 687833 - RNA, 64 nt, hsa; identical to SEQ ID NO: 188611

SEQ ID NO: 687834 - RNA, 64 nt, hsa; identical to SEQ ID NO: 188612

SEQ ID NO: 687835 - RNA, 64 nt, hsa; identical to SEQ ID NO: 188613

SEQ ID NO: 687836 - RNA, 64 nt, hsa; identical to SEQ ID NO: 188614

SEQ ID NO: 687837 - RNA, 64 nt, hsa; identical to SEQ ID NO: 188615

SEQ ID NO: 687838 - RNA, 64 nt, hsa; identical to SEQ ID NO: 188616

SEQ ID NO: 687839 - RNA, 64 nt, hsa; identical to SEQ ID NO: 188617

SEQ ID NO: 687840 - RNA, 64 nt, hsa; identical to SEQ ID NO: 188618

SEQ ID NO: 687841 - RNA, 64 nt, hsa; identical to SEQ ID NO: 188619

SEQ ID NO: 687842 - RNA, 64 nt, hsa; identical to SEQ ID NO: 188620

SEQ ID NO: 687843 - RNA, 64 nt, hsa; identical to SEQ ID NO: 188621

SEQ ID NO: 687844 - RNA, 64 nt, hsa; identical to SEQ ID NO: 188622

SEQ ID NO: 687845 - RNA, 64 nt, hsa; identical to SEQ ID NO: 188623

SEQ ID NO: 687846 - RNA, 64 nt, hsa; identical to SEQ ID NO: 188624

SEQ ID NO: 687847 - RNA, 64 nt, hsa; identical to SEQ ID NO: 188625

SEQ ID NO: 687848 - RNA, 64 nt, hsa; identical to SEQ ID NO: 188626

SEQ ID NO: 687849 - RNA, 64 nt, hsa; identical to SEQ ID NO: 188627

SEQ ID NO: 687850 - RNA, 64 nt, hsa; identical to SEQ ID NO: 188628

SEQ ID NO: 687851 - RNA, 64 nt, hsa; identical to SEQ ID NO: 188629

SEQ ID NO: 687852 - RNA, 64 nt, hsa; identical to SEQ ID NO: 188630

SEQ ID NO: 687853 - RNA, 64 nt, hsa; identical to SEQ ID NO: 188631

SEQ ID NO: 687854 - RNA, 64 nt, hsa; identical to SEQ ID NO: 188632

SEQ ID NO: 687855 - RNA, 64 nt, hsa; identical to SEQ ID NO: 188633

SEQ ID NO: 687856 - RNA, 64 nt, hsa; identical to SEQ ID NO: 188634

SEQ ID NO: 687857 - RNA, 64 nt, hsa; identical to SEQ ID NO: 188635

SEQ ID NO: 687858 - RNA, 64 nt, hsa; identical to SEQ ID NO: 188636

SEQ ID NO: 687859 - RNA, 64 nt, hsa; identical to SEQ ID NO: 188637

SEQ ID NO: 687860 - RNA, 64 nt, hsa; identical to SEQ ID NO: 188638

SEQ ID NO: 687861 - RNA, 64 nt, hsa; identical to SEQ ID NO: 188639

SEQ ID NO: 687862 - RNA, 64 nt, hsa; identical to SEQ ID NO: 188640

SEQ ID NO: 687863 - RNA, 64 nt, hsa; identical to SEQ ID NO: 188641

SEQ ID NO: 687864 - RNA, 64 nt, hsa; identical to SEQ ID NO: 188642

SEQ ID NO: 687865 - RNA, 64 nt, hsa; identical to SEQ ID NO: 188643

SEQ ID NO: 687866 - RNA, 64 nt, hsa; identical to SEQ ID NO: 188644

SEQ ID NO: 687867 - RNA, 64 nt, hsa; identical to SEQ ID NO: 188645

SEQ ID NO: 687868 - RNA, 64 nt, hsa; identical to SEQ ID NO: 188646

SEQ ID NO: 687869 - RNA, 64 nt, hsa; identical to SEQ ID NO: 188647

SEQ ID NO: 687870 - RNA, 64 nt, hsa; identical to SEQ ID NO: 188648

SEQ ID NO: 687871 - RNA, 64 nt, hsa; identical to SEQ ID NO: 188649

SEQ ID NO: 687872 - RNA, 64 nt, hsa; identical to SEQ ID NO: 188650

SEQ ID NO: 687873 - RNA, 64 nt, hsa; identical to SEQ ID NO: 188651

SEQ ID NO: 687874 - RNA, 64 nt, hsa; identical to SEQ ID NO: 188652

SEQ ID NO: 687875 - RNA, 64 nt, hsa; identical to SEQ ID NO: 188653

SEQ ID NO: 687876 - RNA, 64 nt, hsa; identical to SEQ ID NO: 188654

SEQ ID NO: 687877 - RNA, 64 nt, hsa; identical to SEQ ID NO: 188655

SEQ ID NO: 687878 - RNA, 64 nt, hsa; identical to SEQ ID NO: 188656

SEQ ID NO: 687879 - RNA, 64 nt, hsa; identical to SEQ ID NO: 188657

SEQ ID NO: 687880 - RNA, 64 nt, hsa; identical to SEQ ID NO: 188658

SEQ ID NO: 687881 - RNA, 54 nt, hsa; identical to SEQ ID NO: 188659

SEQ ID NO: 687882 - RNA, 64 nt, hsa; identical to SEQ ID NO: 76253

SEQ ID NO: 687883 - RNA, 64 nt, hsa; identical to SEQ ID NO: 76254

SEQ ID NO: 687884 - RNA, 64 nt, hsa; identical to SEQ ID NO: 76255

SEQ ID NO: 687885 - RNA, 64 nt, hsa; identical to SEQ ID NO: 76256

SEQ ID NO: 687886 - RNA, 64 nt, hsa; identical to SEQ ID NO: 76257

SEQ ID NO: 687887 - RNA, 64 nt, hsa; identical to SEQ ID NO: 76258

SEQ ID NO: 687888 - RNA, 64 nt, hsa; identical to SEQ ID NO: 76259

SEQ ID NO: 687889 - RNA, 64 nt, hsa; identical to SEQ ID NO: 76260

SEQ ID NO: 687890 - RNA, 64 nt, hsa; identical to SEQ ID NO: 76261

SEQ ID NO: 687891 - RNA, 64 nt, hsa; identical to SEQ ID NO: 76262

SEQ ID NO: 687892 - RNA, 64 nt, hsa; identical to SEQ ID NO: 76263

SEQ ID NO: 687893 - RNA, 64 nt, hsa; identical to SEQ ID NO: 76264

SEQ ID NO: 687894 - RNA, 64 nt, hsa; identical to SEQ ID NO: 76265

SEQ ID NO: 687895 - RNA, 64 nt, hsa; identical to SEQ ID NO: 76266

SEQ ID NO: 687896 - RNA, 64 nt, hsa; identical to SEQ ID NO: 76267

SEQ ID NO: 687897 - RNA, 64 nt, hsa; identical to SEQ ID NO: 76268

SEQ ID NO: 687898 - RNA, 64 nt, hsa; identical to SEQ ID NO: 76269

SEQ ID NO: 687899 - RNA, 64 nt, hsa; identical to SEQ ID NO: 76270

SEQ ID NO: 687900 - RNA, 64 nt, hsa; identical to SEQ ID NO: 76271

SEQ ID NO: 687901 - RNA, 64 nt, hsa; identical to SEQ ID NO: 76272

SEQ ID NO: 687902 - RNA, 64 nt, hsa; identical to SEQ ID NO: 76273

SEQ ID NO: 687903 - RNA, 64 nt, hsa; identical to SEQ ID NO: 76274

SEQ ID NO: 687904 - RNA, 64 nt, hsa; identical to SEQ ID NO: 76275

SEQ ID NO: 687905 - RNA, 64 nt, hsa; identical to SEQ ID NO: 76276

SEQ ID NO: 687906 - RNA, 64 nt, hsa; identical to SEQ ID NO: 76277

SEQ ID NO: 687907 - RNA, 64 nt, hsa; identical to SEQ ID NO: 76278

SEQ ID NO: 687908 - RNA, 64 nt, hsa; identical to SEQ ID NO: 76279

SEQ ID NO: 687909 - RNA, 64 nt, hsa; identical to SEQ ID NO: 76280

SEQ ID NO: 687910 - RNA, 64 nt, hsa; identical to SEQ ID NO: 76281

SEQ ID NO: 687911 - RNA, 64 nt, hsa; identical to SEQ ID NO: 76282

SEQ ID NO: 687912 - RNA, 64 nt, hsa; identical to SEQ ID NO: 76283

SEQ ID NO: 687913 - RNA, 64 nt, hsa; identical to SEQ ID NO: 76284

SEQ ID NO: 687914 - RNA, 64 nt, hsa; identical to SEQ ID NO: 76285

SEQ ID NO: 687915 - RNA, 64 nt, hsa; identical to SEQ ID NO: 76286

SEQ ID NO: 687916 - RNA, 64 nt, hsa; identical to SEQ ID NO: 76287

SEQ ID NO: 687917 - RNA, 64 nt, hsa; identical to SEQ ID NO: 76288

SEQ ID NO: 687918 - RNA, 64 nt, hsa; identical to SEQ ID NO: 76289

SEQ ID NO: 687919 - RNA, 64 nt, hsa; identical to SEQ ID NO: 76290

SEQ ID NO: 687920 - RNA, 64 nt, hsa; identical to SEQ ID NO: 76291

SEQ ID NO: 687921 - RNA, 64 nt, hsa; identical to SEQ ID NO: 76292

SEQ ID NO: 687922 - RNA, 64 nt, hsa; identical to SEQ ID NO: 76293

SEQ ID NO: 687923 - RNA, 64 nt, hsa; identical to SEQ ID NO: 76294

SEQ ID NO: 687924 - RNA, 64 nt, hsa; identical to SEQ ID NO: 76295

SEQ ID NO: 687925 - RNA, 64 nt, hsa; identical to SEQ ID NO: 76296

SEQ ID NO: 687926 - RNA, 64 nt, hsa; identical to SEQ ID NO: 76297

SEQ ID NO: 687927 - RNA, 64 nt, hsa; identical to SEQ ID NO: 76298

SEQ ID NO: 687928 - RNA, 64 nt, hsa; identical to SEQ ID NO: 76299

SEQ ID NO: 687929 - RNA, 64 nt, hsa; identical to SEQ ID NO: 76300

SEQ ID NO: 687930 - RNA, 64 nt, hsa; identical to SEQ ID NO: 76301

SEQ ID NO: 687931 - RNA, 64 nt, hsa; identical to SEQ ID NO: 76302

SEQ ID NO: 687932 - RNA, 64 nt, hsa; identical to SEQ ID NO: 76303

SEQ ID NO: 687933 - RNA, 64 nt, hsa; identical to SEQ ID NO: 76304

SEQ ID NO: 687934 - RNA, 64 nt, hsa; identical to SEQ ID NO: 76305

SEQ ID NO: 687935 - RNA, 64 nt, hsa; identical to SEQ ID NO: 76306

SEQ ID NO: 687936 - RNA, 64 nt, hsa; identical to SEQ ID NO: 76307

SEQ ID NO: 687937 - RNA, 64 nt, hsa; identical to SEQ ID NO: 76308

SEQ ID NO: 687938 - RNA, 64 nt, hsa; identical to SEQ ID NO: 76309

SEQ ID NO: 687939 - RNA, 64 nt, hsa; identical to SEQ ID NO: 76310

SEQ ID NO: 687940 - RNA, 64 nt, hsa; identical to SEQ ID NO: 76311

SEQ ID NO: 687941 - RNA, 64 nt, hsa; identical to SEQ ID NO: 76312

SEQ ID NO: 687942 - RNA, 64 nt, hsa; identical to SEQ ID NO: 76313

SEQ ID NO: 687943 - RNA, 64 nt, hsa; identical to SEQ ID NO: 76314

SEQ ID NO: 687944 - RNA, 64 nt, hsa; identical to SEQ ID NO: 76315

SEQ ID NO: 687945 - RNA, 64 nt, hsa; identical to SEQ ID NO: 76316

SEQ ID NO: 687946 - RNA, 64 nt, hsa; identical to SEQ ID NO: 76317

SEQ ID NO: 687947 - RNA, 64 nt, hsa; identical to SEQ ID NO: 76318

SEQ ID NO: 687948 - RNA, 64 nt, hsa; identical to SEQ ID NO: 76319

SEQ ID NO: 687949 - RNA, 64 nt, hsa; identical to SEQ ID NO: 76320

SEQ ID NO: 687950 - RNA, 64 nt, hsa; identical to SEQ ID NO: 76321

SEQ ID NO: 687951 - RNA, 64 nt, hsa; identical to SEQ ID NO: 76322

SEQ ID NO: 687952 - RNA, 64 nt, hsa; identical to SEQ ID NO: 76323

SEQ ID NO: 687953 - RNA, 64 nt, hsa; identical to SEQ ID NO: 76324

SEQ ID NO: 687954 - RNA, 64 nt, hsa; identical to SEQ ID NO: 76325

SEQ ID NO: 687955 - RNA, 64 nt, hsa; identical to SEQ ID NO: 76326

SEQ ID NO: 687956 - RNA, 64 nt, hsa; identical to SEQ ID NO: 76327

SEQ ID NO: 687957 - RNA, 64 nt, hsa; identical to SEQ ID NO: 76328

SEQ ID NO: 687958 - RNA, 64 nt, hsa; identical to SEQ ID NO: 76329

SEQ ID NO: 687959 - RNA, 64 nt, hsa; identical to SEQ ID NO: 76330

SEQ ID NO: 687960 - RNA, 64 nt, hsa; identical to SEQ ID NO: 76331

SEQ ID NO: 687961 - RNA, 64 nt, hsa; identical to SEQ ID NO: 76332

SEQ ID NO: 687962 - RNA, 64 nt, hsa; identical to SEQ ID NO: 76333

SEQ ID NO: 687963 - RNA, 64 nt, hsa; identical to SEQ ID NO: 76334

SEQ ID NO: 687964 - RNA, 64 nt, hsa; identical to SEQ ID NO: 76335

SEQ ID NO: 687965 - RNA, 64 nt, hsa; identical to SEQ ID NO: 76336

SEQ ID NO: 687966 - RNA, 64 nt, hsa; identical to SEQ ID NO: 76337

SEQ ID NO: 687967 - RNA, 64 nt, hsa; identical to SEQ ID NO: 76338

SEQ ID NO: 687968 - RNA, 64 nt, hsa; identical to SEQ ID NO: 76339

SEQ ID NO: 687969 - RNA, 64 nt, hsa
uaguaggcacaguuguaaaaaggggagauuucgguaggcacagguguaaaaaggggagauuuca

SEQ ID NO: 687970 - RNA, 64 nt, hsa
uaccaacuguggacuuggaauaucagcagaguaguaggcacaguuguaaaaaggggagauuucg

SEQ ID NO: 687971 - RNA, 64 nt, hsa
cacaaaacacgggccccaggagggaagcgcugucuaggcacacggcaaggccuuaguaacagca

SEQ ID NO: 687972 - RNA, 64 nt, hsa
aaaccacagagauuagggggacuuaaaauuaauauaggcacaggaaagagaaaagugugcgcuc

SEQ ID NO: 687973 - RNA, 64 nt, hsa
gcuuggaaagcacugguuuagggacuuagagagguaggcacaaggugggucuccuggguaaggg

SEQ ID NO: 687974 - RNA, 64 nt, hsa
cccggccuguuucaaugacuaccgcucugcuacuuaggcacagggacuccgccgcacgcugacg

SEQ ID NO: 687975 - RNA, 64 nt, hsa; identical to SEQ ID NO: 437747

SEQ ID NO: 687976 - RNA, 64 nt, hsa; identical to SEQ ID NO: 437748

SEQ ID NO: 687977 - RNA, 64 nt, hsa; identical to SEQ ID NO: 437749

SEQ ID NO: 687978 - RNA, 64 nt, hsa; identical to SEQ ID NO: 437750

SEQ ID NO: 687979 - RNA, 64 nt, hsa; identical to SEQ ID NO: 437751

SEQ ID NO: 687980 - RNA, 64 nt, hsa; identical to SEQ ID NO: 437752

SEQ ID NO: 687981 - RNA, 64 nt, hsa; identical to SEQ ID NO: 437753

SEQ ID NO: 687982 - RNA, 64 nt, hsa; identical to SEQ ID NO: 437754

SEQ ID NO: 687983 - RNA, 64 nt, hsa; identical to SEQ ID NO: 437755

SEQ ID NO: 687984 - RNA, 64 nt, hsa; identical to SEQ ID NO: 437756

SEQ ID NO: 687985 - RNA, 64 nt, hsa; identical to SEQ ID NO: 437757

SEQ ID NO: 687986 - RNA, 64 nt, hsa; identical to SEQ ID NO: 437758

SEQ ID NO: 687987 - RNA, 64 nt, hsa; identical to SEQ ID NO: 437759

SEQ ID NO: 687988 - RNA, 64 nt, hsa; identical to SEQ ID NO: 437760

SEQ ID NO: 687989 - RNA, 64 nt, hsa; identical to SEQ ID NO: 437761

SEQ ID NO: 687990 - RNA, 64 nt, hsa; identical to SEQ ID NO: 437762

SEQ ID NO: 687991 - RNA, 64 nt, hsa; identical to SEQ ID NO: 437763

SEQ ID NO: 687992 - RNA, 64 nt, hsa; identical to SEQ ID NO: 437764

SEQ ID NO: 687993 - RNA, 64 nt, hsa; identical to SEQ ID NO: 437765

SEQ ID NO: 687994 - RNA, 64 nt, hsa; identical to SEQ ID NO: 437766

SEQ ID NO: 687995 - RNA, 64 nt, hsa; identical to SEQ ID NO: 437767

SEQ ID NO: 687996 - RNA, 64 nt, hsa; identical to SEQ ID NO: 437768

SEQ ID NO: 687997 - RNA, 64 nt, hsa; identical to SEQ ID NO: 437769

SEQ ID NO: 687998 - RNA, 64 nt, hsa; identical to SEQ ID NO: 437770

SEQ ID NO: 687999 - RNA, 64 nt, hsa; identical to SEQ ID NO: 437771

SEQ ID NO: 688000 - RNA, 64 nt, hsa; identical to SEQ ID NO: 437772

SEQ ID NO: 688001 - RNA, 64 nt, hsa
cagacacuuuucaaaagaagacaucuguggccaacaauccuauggaaaaaagcccagcaucacu

SEQ ID NO: 688002 - RNA, 64 nt, hsa
cuugaguaaaucuaaagaaauauugauaguaaggcaauccuaagcaaaaagaacaaagcuggag

SEQ ID NO: 688003 - RNA, 64 nt, hsa
uacuucugcuuuacaggcuuuauuuaaaucugaacaauccuacagggaaaucagaauuaggaaa

SEQ ID NO: 688004 - RNA, 64 nt, hsa
uuuaagguacccaguucaugguaauuuguuacagcaauccuaggaagcuaauacucugacagaa

SEQ ID NO: 688005 - RNA, 64 nt, hsa
aacgacauccaagcugagagccaaaucaagaaugcaauccuauucacaauugccacaaaaagaa

SEQ ID NO: 688006 - RNA, 64 nt, hsa
auuugaaaccaaaaaagagcccaaaaagccaaagcaauccuaagcaaaaagaacaaagcuggag

SEQ ID NO: 688007 - RNA, 64 nt, hsa
aauggaaaacaaacaaaaaaagaggcagggguugcaauccuagucucugauaaaacagaauuua

SEQ ID NO: 688008 - RNA, 64 nt, hsa
auauggaaccaaaaaagagcccacauugccaagucaauccuaagccaaaugaauaaagccggag

SEQ ID NO: 688009 - RNA, 60 nt, hsa
ucuucuacuugccuguggggaggggagugacagguccacacaccacacugggucacccug

SEQ ID NO: 688010 - RNA, 60 nt, hsa
gugugagcagggaacucagugugacaccgccagguccagcacccaugggggcgggggaga

SEQ ID NO: 688011 - RNA, 60 nt, hsa
cccucggcuguggugccuccucuggccccccagguccacguccuuuaaauuggcccuuug

SEQ ID NO: 688012 - RNA, 60 nt, hsa
cagggccaagcgggggcguggcuggccuuucagguccaggccagugggccugguagcaca

SEQ ID NO: 688013 - RNA, 60 nt, hsa
ccagaagcaucagugugcaucuacgcagcccagguccaggaccacauccuggccagcugc

SEQ ID NO: 688014 - RNA, 60 nt, hsa
agacugagaaagggguguauuuaauuccaucagguccaguacaguacuaggagucauaau

SEQ ID NO: 688015 - RNA, 60 nt, hsa
ccacgcccacaauccgacagcccccaggagcagguccagggaugaugcagcccccuucuu

SEQ ID NO: 688016 - RNA, 60 nt, hsa
aaauagcuucuccuacagugauucaugucccagguccaggaaauccaauguuggugaagg

SEQ ID NO: 688017 - RNA, 60 nt, hsa
gggacaugcagccaggacugugagucugggcagguccaaggccugcaccuucaagaagug

SEQ ID NO: 688018 - RNA, 60 nt, hsa
agcagguggcacugcagcuccccgcuccugcagguccagcguccucacaggaacaccagg

SEQ ID NO: 688019 - RNA, 60 nt, hsa
acaaggcaggacaugauaaagauuauaaagcagguccaaggaaagugccgccaguggucc

SEQ ID NO: 688020 - RNA, 60 nt, hsa
uucauuccucugauagaacaaagcgaaaugcagguccaccagggagggagacacacaagc

SEQ ID NO: 688021 - RNA, 60 nt, hsa
ccaaggucuuuccuucuggcuaccuuccugcagguccacccugucugccauuggucuccu

SEQ ID NO: 688022 - RNA, 60 nt, hsa
gccuccacucccuucugacuuuccagaccccagguccagucugcagauccuaccagguug

SEQ ID NO: 688023 - RNA, 60 nt, hsa
uuaguaagaaaggaucauguuuugaagcagcagguccaggucacuuuguauauagaauuu

SEQ ID NO: 688024 - RNA, 60 nt, hsa
uucuccuacuaggccugccugagaggcucacagguccaagggaaagcucugaacuugcca

SEQ ID NO: 688025 - RNA, 60 nt, hsa
uggauggccuccuaaaucuccccguggcaacagguccaggagaggcccauggagcagucu

SEQ ID NO: 688026 - RNA, 60 nt, hsa
ccuccuccaggugcugcaggccugaggggccagguccaccaggccuacagucaaacucca

SEQ ID NO: 688027 - RNA, 60 nt, hsa
acagugauggaacaugugcuuggccacaggcagguccagucacugcaaaagugaccaagc

SEQ ID NO: 688028 - RNA, 60 nt, hsa
gaguguccgugagcgggccgaggcgcucaucagguccagccugggcuccuccaccagcuc

SEQ ID NO: 688029 - RNA, 60 nt, hsa
gggcgaggaaggcgguccagaggcggccggcagguccacguccugggcgaccgcucuguc

SEQ ID NO: 688030 - RNA, 60 nt, hsa
aggguuuuaacuuuguuuuauuuucaaaaccagguccaaugagcuuucugaacagcuggu

SEQ ID NO: 688031 - RNA, 60 nt, hsa
cugguaaaaggugaugccaggucuugaagacagguccaccuucaaaaucuauucucuuua

SEQ ID NO: 688032 - RNA, 60 nt, hsa
ucccauuuauaaacccacuuuuaaaaauaacagguccaaguuagagugauguguguauau

SEQ ID NO: 688033 - RNA, 60 nt, hsa
ugucuccccggcccaggucccucccgccuccagguccauccaucccguccggaaaagaag

SEQ ID NO: 688034 - RNA, 60 nt, hsa
cucuucuuuuagaauuaaaugaaugcugcacagguccagauguguguugauguagacuug

SEQ ID NO: 688035 - RNA, 60 nt, hsa
cgguuucuccaaacugaagcagccucuccccagguccagcucuggaggggagggggaucc

SEQ ID NO: 688036 - RNA, 60 nt, hsa
gcugcccugaucacagagacgggaccgagccagguccauaccccuuccucucucccuccu

SEQ ID NO: 688037 - RNA, 60 nt, hsa
gaaccaaucuggaugccucauuaugucaaccagguccagaugugcuauaaucuguuuuua

SEQ ID NO: 688038 - RNA, 60 nt, hsa
uuuugcugcccucuaggugcacagacaauucagguccauggcccagaugguacuugcugu

SEQ ID NO: 688039 - RNA, 60 nt, hsa
gugcagcgcuuuggauuuccuucaguucuccagguccaccuggaaaguauaguuggccag

SEQ ID NO: 688040 - RNA, 60 nt, hsa
ggggugugggggauaaaacaggacagacgacagguccacccaagacugucaagggaugag

SEQ ID NO: 688041 - RNA, 60 nt, hsa
gucuccggacaccacaccacaugagcccaacagguccacgauggauccaccagucccacc

SEQ ID NO: 688042 - RNA, 60 nt, hsa
cugcaaaaacccaaagccuccaaaacuaaccagguccaccuaacacccccucccuccccu

SEQ ID NO: 688043 - RNA, 60 nt, hsa
cguggggacccgugucugugggagcgggcacagguccaugcugcaggccacuacggcugc

SEQ ID NO: 688044 - RNA, 60 nt, hsa
cagcacuucggccucucccuguacuggaaucagguccagggccccccaaaaccccggugg

SEQ ID NO: 688045 - RNA, 60 nt, hsa
uuaaaggcagaaaaacuggaaaaccuacugcagguccagagacuucuguuuuacaacugg

SEQ ID NO: 688046 - RNA, 60 nt, hsa
cuagcccaccuccccagccacccuccuccacagguccaggugccgcucccucccccacca

SEQ ID NO: 688047 - RNA, 60 nt, hsa
ggggacuucaagagccuguggucaggaaaucagguccagccuucccuguagccagacagu

SEQ ID NO: 688048 - RNA, 60 nt, hsa
ucaaauucucuucuuuuucuuuuuuauuaccagguccauuuugccugacaauugcaaauc

SEQ ID NO: 688049 - RNA, 60 nt, hsa
cauuuggggcccagaccuacacuuggagcccagguccagcguucccccgaccgcuuuccc

SEQ ID NO: 688050 - RNA, 60 nt, hsa
gugggaggauaucuuuuggccguguacccucagguccagugcuugguccugcucugguca

SEQ ID NO: 688051 - RNA, 60 nt, hsa
gaggcacguuuggcacaaaguguuguccuccagguccaaguggacucuacagagugcuug

SEQ ID NO: 688052 - RNA, 60 nt, hsa
uuuccauuuaagcaauuuguaagcaaaguccagguccauuuaguuuuuggauauauuuaa

SEQ ID NO: 688053 - RNA, 60 nt, hsa
gcuaaccuugaucucuaaggacuaacuacccagguccaggucuucacuagggguacugac

SEQ ID NO: 688054 - RNA, 60 nt, hsa
uauggaucucuaccauccccaugccuugcccagguccaguuccauuucucucauucacaa

SEQ ID NO: 688055 - RNA, 60 nt, hsa
caaaggugauuauuuuucuccuggaaacuccagguccauucuguuuaaaucccuaagaau

SEQ ID NO: 688056 - RNA, 60 nt, hsa
uucuguaucauuacuucacuuaauggccuccagguccauccauguuguugcaaaagauaa

SEQ ID NO: 688057 - RNA, 60 nt, hsa
aagggcugguuucaggcugacauauggccgcagguccaguucagcccaggucucucaugg

SEQ ID NO: 688058 - RNA, 60 nt, hsa
cagggagaggcugugucccugcuggggucucagguccagcuuuacuguggcugucuggau

SEQ ID NO: 688059 - RNA, 60 nt, hsa
gcuagaggguuagccuggcuggggccagcucagguccacuucaacagaagaggcugcugg

SEQ ID NO: 688060 - RNA, 60 nt, hsa
gacccugacccucggccagcaggguggccccagguccauguugggcacuagggcagguuc

SEQ ID NO: 688061 - RNA, 60 nt, hsa
gaucccugacgagaauaaagagcccagaaacagguccauguuuauaugggaacuugauuu

SEQ ID NO: 688062 - RNA, 60 nt, hsa
gggcuggaagguccuuugacggguaugaaacagguccagaaaggggagguggccugcuug

SEQ ID NO: 688063 - RNA, 60 nt, hsa
gcuuuuccuacgaucugcauuauguaaucacagguccagagagcuuuauggaagcgggag

SEQ ID NO: 688064 - RNA, 60 nt, hsa
aagaaaacagaagaagaggaaggaaaacuacagguccauaucccucauuaacacagacac

SEQ ID NO: 688065 - RNA, 60 nt, hsa
ucacccucgugugggagccucugggcucggcagguccacauuucaugagcugaggcgugg

SEQ ID NO: 688066 - RNA, 60 nt, hsa
gacaguucccggaaacgguugcccacuucacagguccaugggucugacccuuggacucug

SEQ ID NO: 688067 - RNA, 60 nt, hsa
accauguaaagcuggcuuucuggagucugccagguccacacgaagugcuacccccaguuu

SEQ ID NO: 688068 - RNA, 60 nt, hsa
aacuaagccuuuuugagguguagagauucucagguccaggcguuaaaaaauaauggucaa

SEQ ID NO: 688069 - RNA, 60 nt, hsa
guaggaauucuuuuggggaagugaggaagccagguccacggucuguucuugaagcaguag

SEQ ID NO: 688070 - RNA, 60 nt, hsa
ugcagauuuuucuuuacaguauuccauaggcagguccacuggaaaacugcagaaaaaugu

SEQ ID NO: 688071 - RNA, 60 nt, hsa
cucuuacucccucccucugcugucucacuucagguccauguauuucacuuuucuuaaaua

SEQ ID NO: 688072 - RNA, 60 nt, hsa
ugggaggaagaagggggccugagagagccccagguccauucuacccccagcuucacucag

SEQ ID NO: 688073 - RNA, 60 nt, hsa
agucuucaggaggaagagaugcccaugaagcagguccagaacuaagugggaguggaggca

SEQ ID NO: 688074 - RNA, 58 nt, hsa
ucaggaaccgcuaccugugaaaagagcgcagguccaccugguggacacgucugauuag

SEQ ID NO: 688075 - RNA, 60 nt, hsa
agauggaacagggauuuaacuccccgcccacagguccaugggagcuugaggcaguaaggg

SEQ ID NO: 688076 - RNA, 60 nt, hsa
aagugcuucauuuucuuuuuauaguagaagcagguccaugucuuuugugguuuccugcac

SEQ ID NO: 688077 - RNA, 60 nt, hsa
aaaaagaacacuuucugcucauaucauaaccagguccaacccagcuucuuggcaugaggu

SEQ ID NO: 688078 - RNA, 60 nt, hsa
agucugugcucgggacaauaaagcuugugacagguccaggaccccggcaguuggcuuguc

SEQ ID NO: 688079 - RNA, 60 nt, hsa
ggauaucugccuuccugcugcaaguggaggcagguccagcagccccucuucagagccccu

SEQ ID NO: 688080 - RNA, 60 nt, hsa
guuguucggagaaagccuagguucugggcucagguccagaugcagcggggauucuguucu

SEQ ID NO: 688081 - RNA, 60 nt, hsa
cuguggauuuguucaaauacuaaagauccucagguccagaauuccagcaucauuuauucu

SEQ ID NO: 688082 - RNA, 60 nt, hsa
acuuguagucuaaaaaguaaaaggggcgaucagguccaucucaaaggucacacguaauag

SEQ ID NO: 688083 - RNA, 60 nt, hsa
acacuaggcccaaggugccugugcucccagcagguccaagugcagcuccagccaccuuug

SEQ ID NO: 688084 - RNA, 60 nt, hsa
auucagaaggaugcuucaacuauuauuugucagguccaaaggucguacuuaauaacccca

SEQ ID NO: 688085 - RNA, 60 nt, hsa
caggaggggagcgggcccaggagccaggcucagguccagcugguuccucucuggcgccuu

SEQ ID NO: 688086 - RNA, 60 nt, hsa
ccucucuggcgccuucugaacccgucucagcagguccacagcaccugggcagaggucaga

SEQ ID NO: 688087 - RNA, 60 nt, hsa
auuuuauucuugcuuuuccaugcuucucuacagguccaaauacugaaugucuccuuuacu

SEQ ID NO: 688088 - RNA, 60 nt, hsa
aaaaugaagaaacagggcuggaugauuuugcagguccaaugcaaacaucacagaccccac

SEQ ID NO: 688089 - RNA, 60 nt, hsa
auucuaaugauuggcaagucacguuguuuucagguccagaguaguuucuuucugucugcu

SEQ ID NO: 688090 - RNA, 60 nt, hsa
augcauuuaguggugguagaaaugauucaccagguccaauguuguucaccagugcuugcu

SEQ ID NO: 688091 - RNA, 60 nt, hsa
agagcuuccuuucgugacgagacgcggacgcagguccacccucgggcccuagcucuguag

SEQ ID NO: 688092 - RNA, 60 nt, hsa
cugcagucuucuuccaucacuuuucccuaccagguccauuaauaugcuuauaacacuagu

SEQ ID NO: 688093 - RNA, 60 nt, hsa
cuggcugcguugccauuggcugagacccaccagguccaguuuugguugguguagagacca

SEQ ID NO: 688094 - RNA, 60 nt, hsa
aaggugggccccguguguuuacagcauuuccagguccagagagguuggcagacaagugcc

SEQ ID NO: 688095 - RNA, 60 nt, hsa
aggcugagggcuuccccgaaagucugggaccagguccaggugggcauggaaugcugauga

SEQ ID NO: 688096 - RNA, 60 nt, hsa
cuugugggccuucuaagaugaagccacccucagguccagggaagguugugcugguauuug

SEQ ID NO: 688097 - RNA, 60 nt, hsa
gaaaggacauugcuuucucagccccacccccagguccacaguguccaagguaauggcaca

SEQ ID NO: 688098 - RNA, 60 nt, hsa
aucguccgcugaccucuggccacaggaagccagguccaccgcccaccacccuuucaggcc

SEQ ID NO: 688099 - RNA, 60 nt, hsa
caaggcacuccuaccacugagcgccuuugccagguccagccugggcucagguuccaagac

SEQ ID NO: 688100 - RNA, 60 nt, hsa
cccugcauggcugagcugcccacagcaggccagguccagagagaccgaggagggagaguc

SEQ ID NO: 688101 - RNA, 60 nt, hsa
gggauugacuugguucccugacaaggguaccagguccaccccuucugaaaagcagcuguu

SEQ ID NO: 688102 - RNA, 60 nt, hsa
ugucaucacggguccccugaggagacaaggcagguccagcgcacaucaggcggacugagc

SEQ ID NO: 688103 - RNA, 60 nt, hsa
ccaaggcugggccagccuuuuuugggcagucagguccacaccuauguccagggcaccagg

SEQ ID NO: 688104 - RNA, 60 nt, hsa
ugggcagggcuuggacccccgucuccauggcagguccauacagcauggguggcaggguuu

SEQ ID NO: 688105 - RNA, 60 nt, hsa
gccaacccugagcgagccuguccucuguggcagguccacacggugugggugggcagggcu

SEQ ID NO: 688106 - RNA, 60 nt, hsa
ggcugggugguccgcacccuggcucuccugcagguccacacaccuuccaggccuguggcc

SEQ ID NO: 688107 - RNA, 60 nt, hsa
aaagcaaagugauuuugucugcuccuagagcagguccauaccaaguaauagaggcacuuu

SEQ ID NO: 688108 - RNA, 60 nt, hsa
cagaucaccaucuaaguuacaucuuuagcucagguccauccuucucaagaucuccuucuu

SEQ ID NO: 688109 - RNA, 60 nt, hsa
cccuuucucuuucucccaggcagggcucugcagguccauaugggcucaaugucaccaccc

SEQ ID NO: 688110 - RNA, 60 nt, hsa
caaucuuggcucacugcaaccuccaccucccagguccaagcgauucucuugccucagccu

SEQ ID NO: 688111 - RNA, 60 nt, hsa
cccaucuuuugaaauguauuuucuucauugcagguccaccuaaucauccugugaaagugg

SEQ ID NO: 688112 - RNA, 60 nt, hsa
gauuucgcgcagccuguuguuuuccuuagacagguccacgucccucuccugaggcugugg

SEQ ID NO: 688113 - RNA, 60 nt, hsa
gcuaggacgggaggcagagccggcucagagcagguccaccagcccaccuauagcaggaag

SEQ ID NO: 688114 - RNA, 60 nt, hsa
cagcaaaaugcccccugcuucccuaaggggcagguccagagcagggcccacaagggggau

SEQ ID NO: 688115 - RNA, 60 nt, hsa
gcugaguucuggucuguugcugccacucuacagguccaggguuguuagaucuucuggguu

SEQ ID NO: 688116 - RNA, 60 nt, hsa
agacaugaguucuggaaggagcaaggccaccagguccagagaaccuggcaugcaauggac

SEQ ID NO: 688117 - RNA, 54 nt, hsa
agaagcugcagaacuauuaacuaacagguccaacccuaagugagacauguuucu

SEQ ID NO: 688118 - RNA, 60 nt, hsa
ucucaccggcuccccgagcguggcagccaccagguccacagaacuacugcagcccagagg

SEQ ID NO: 688119 - RNA, 60 nt, hsa
uccccaucucaggccagagccaaggggcuucagguccaggcuguguuuggcuuucaggga

SEQ ID NO: 688120 - RNA, 60 nt, hsa
gaggccuucaccuuccuggugcccuucagccagguccagaauguggaccuggugcuggcu

SEQ ID NO: 688121 - RNA, 60 nt, hsa
ccaugccuauguuccagcuuccugggucugcagguccagccggcuggcacccuccaugua

SEQ ID NO: 688122 - RNA, 60 nt, hsa
agcaccaguggaaacacaugaacuucgaugcagguccagagaccauggacacucccacga

SEQ ID NO: 688123 - RNA, 60 nt, hsa
agguugggaagguuguucccuucccggugccagguccagauuucccuccaugauuuggga

SEQ ID NO: 688124 - RNA, 60 nt, hsa
uuuugccuguuccaaucaaaccaccccauucagguccaucagccucugauuaauauccgu

SEQ ID NO: 688125 - RNA, 60 nt, hsa
uuuuguuuuuuguguuuuguucuuuaaagucagguccaauuuguaaaaacagcauugcuu

SEQ ID NO: 688126 - RNA, 60 nt, hsa
gauagcaucacaagaaacgagccugaaaaucagguccagccgguccaagcacauggccuc

SEQ ID NO: 688127 - RNA, 60 nt, hsa
gggugggacccccugcugcagggcagaguucagguccacugggcugaguguccccuuggg

SEQ ID NO: 688128 - RNA, 60 nt, hsa
cagaagcccuguugcucacugaccugugaccagguccaauguggggagaaauaugaagga

SEQ ID NO: 688129 - RNA, 60 nt, hsa
caauaaaaucgaaauucauugauuccaucucagguccagauguuaaacguuuauaaaacc

SEQ ID NO: 688130 - RNA, 60 nt, hsa
gcagucccagaaaccccaaccuagcuggggcagguccagaguccaagcccugguggguag

SEQ ID NO: 688131 - RNA, 60 nt, hsa
cccuguggggcugucaagagcguguucugccagguccaugggggcuggcaucccagcucc

SEQ ID NO: 688132 - RNA, 60 nt, hsa
auauacuuagauuucuaaguauggugcucucagguccaaguucaacuauucuuaagcagu

SEQ ID NO: 688133 - RNA, 60 nt, hsa
aacaaucauauacugauuagcuacucugaccagguccaguacuaacucugaagaaguuau

SEQ ID NO: 688134 - RNA, 60 nt, hsa
uuaagcagacagacaauugaaaauacugggcagguccaaaaggauaguuccaggccauag

SEQ ID NO: 688135 - RNA, 60 nt, hsa
cuggugcuguccucucggcccaccaucggccagguccagcgcuuccucuggggcugacaa

SEQ ID NO: 688136 - RNA, 60 nt, hsa
aauaucucguguuucauuuuaauuaagugacagguccaagugugacauccuucagcaccc

SEQ ID NO: 688137 - RNA, 60 nt, hsa
uguuucuuccccuccuacgaguaccugcgccagguccaugcccacugggagaaggguggc

SEQ ID NO: 688138 - RNA, 60 nt, hsa
ccuuaaggcccuccuuuucccuccaugcuccagguccaugcacagguguagcauguccug

SEQ ID NO: 688139 - RNA, 60 nt, hsa
auuucuuuuuuuuuuuuaaauaguaagucacagguccacacuguguaaacaugcaucuga

SEQ ID NO: 688140 - RNA, 60 nt, hsa
caaucucugcucacugcaacaucugccucccagguccaagcgauucuccugccucagccu

SEQ ID NO: 688141 - RNA, 60 nt, hsa
uuucucucugcccucuagagcaaggcccaccagguccauccaggaggcucuccugaccuc

SEQ ID NO: 688142 - RNA, 60 nt, hsa
gagaauaagcauuuccuguucuuccagcuccagguccaccuccuguugggaggcgguggg

SEQ ID NO: 688143 - RNA, 60 nt, hsa
ggaacagagggugaaagggacagauagaugcagguccauucugcaccucuuggcucgggu

SEQ ID NO: 688144 - RNA, 60 nt, hsa
ucugucuuguucacugcaguaucccaacugcagguccagugcaggcaauaaauaugugau

SEQ ID NO: 688145 - RNA, 60 nt, hsa
gcuuccuauuucauaauccuccagccccagcagguccacuccugguuccuguguguuugg

SEQ ID NO: 688146 - RNA, 60 nt, hsa
ccccugcugaugaugagcaagugccugcugcagguccaaacacagcauccagggcuuugc

SEQ ID NO: 688147 - RNA, 60 nt, hsa
cucgucgcauuuguuauaaauguaguaaggcagguccaagcacuuacaaguuuuuuguag

SEQ ID NO: 688148 - RNA, 60 nt, hsa
aaagggcacugaaacacacaauugacuggacagguccacgcgccaugacaaaacuauaau

SEQ ID NO: 688149 - RNA, 60 nt, hsa
uccuauccauccauaucuauugaaauuguacagguccauaauuucauuuuaauuaauuau

SEQ ID NO: 688150 - RNA, 60 nt, hsa
gugcuuuggaucagggaagccacuuugggacagguccauaaagugaacugaucuuaccga

SEQ ID NO: 688151 - RNA, 60 nt, hsa
cuaauugaaagaaaaccaucugaauuguugcagguccacauuuuugccaaagauacacuc

SEQ ID NO: 688152 - RNA, 60 nt, hsa
cugaugcaguccuccugaccguuccuaccgcagguccagggccugggcccgcggacccca

SEQ ID NO: 688153 - RNA, 60 nt, hsa
guuccaguggaugagggccaccaggaagcacagguccaaggcuggucccacacuuaucag

SEQ ID NO: 688154 - RNA, 60 nt, hsa
agcccaguggcuuaaacaccauuuauaccacagguccagaugaauccugcagggccaagg

SEQ ID NO: 688155 - RNA, 60 nt, hsa
uuaaaucuaauauuguuaauacugaacuugcagguccagguugguauacauuccacccuc

SEQ ID NO: 688156 - RNA, 60 nt, hsa
ccugcauucuguacauaaaguuuuaaguggcagguccagauauguaaaaucauuucucuc

SEQ ID NO: 688157 - RNA, 60 nt, hsa
guggcagcacgucuuccucaugagccgagccagguccauggccaccacguggcuggcccc

SEQ ID NO: 688158 - RNA, 60 nt, hsa
uauuuaggccgugagcuucccauacuacugcagguccaacuccuggcaaccgcgggcuca

SEQ ID NO: 688159 - RNA, 60 nt, hsa
agaaagggaggguggagggugaggccaaaucagguccagcaaaagucaguagggacauug

SEQ ID NO: 688160 - RNA, 60 nt, hsa
ccauggguguggauggcaguguggggagggcagguccagcucugugggcccuacccuccu

SEQ ID NO: 688161 - RNA, 60 nt, hsa
uggaucucugugguuccuucucagccgaaacagguccaguaucccagucauuucuucaaa

SEQ ID NO: 688162 - RNA, 60 nt, hsa
aggggucugcaguccaguagggcaggcagucagguccaugugcacugcaaugccaggugg

SEQ ID NO: 688163 - RNA, 60 nt, hsa
gaaaccaagcuuaugaagaucuucucccagcagguccauagcaguaggcuuaggaugcag

SEQ ID NO: 688164 - RNA, 60 nt, hsa
gugaaguugugaccaucuggcugggaagcccagguccacacaguguaggagcagauguuu

SEQ ID NO: 688165 - RNA, 60 nt, hsa
gagcacugccccaugcccacccuguguacccagguccagaggguccguccaccacagcag

SEQ ID NO: 688166 - RNA, 60 nt, hsa
acaguccuugcccuggggccgguucuuacccagguccagagaaaccaacgcgggauguca

SEQ ID NO: 688167 - RNA, 60 nt, hsa
acauuauaaaugucucuuuaaugucacaggcagguccaggguuugaguucauacccuguu

SEQ ID NO: 688168 - RNA, 60 nt, hsa
uuuuugcugaggguuucugucugggccuaucagguccauacuuagacccugagcaucuuc

SEQ ID NO: 688169 - RNA, 60 nt, hsa
ccuuaaagccgagcucaguuaccauagggacagguccaccucuacugggcccucaugcuu

SEQ ID NO: 688170 - RNA, 60 nt, hsa
gaucauagaucacguuacaagcacuuggcucagguccagcaaggacagaugaacaaauuc

SEQ ID NO: 688171 - RNA, 60 nt, hsa
ugguuugccauaggcccugccaagauacugcagguccauccaggccucugcuaucugcau

SEQ ID NO: 688172 - RNA, 60 nt, hsa
ucagucugaaugcugccacaaccagccaggcagguccacagagagggagagcagagaaag

SEQ ID NO: 688173 - RNA, 60 nt, hsa
ucaacgagggaaccccaagacggacccacacagguccacccacgcugggggcuguaauca

SEQ ID NO: 688174 - RNA, 60 nt, hsa
gaaagcagcucccaggccuuacucaggccucagguccauggguugggcagccagucuggg

SEQ ID NO: 688175 - RNA, 60 nt, hsa
ggcccaugccgacagauaucguggggcugacagguccacggcaggcuugcuuucuuuuau

SEQ ID NO: 688176 - RNA, 60 nt, hsa
cuggacagaaaggcaggagcucugaguccucagguccacccauuucccucauggggaucc

SEQ ID NO: 688177 - RNA, 60 nt, hsa
cuguccccucacccccucuccuguauuucucagguccaguucaaaucuaaaauucuacuu

SEQ ID NO: 688178 - RNA, 60 nt, hsa
cacggagggaggcaccaugcaaaugucuuccagguccaaacccuucaacuccuggcuccg

SEQ ID NO: 688179 - RNA, 60 nt, hsa
gaccagcacugacagccuagccagugguuccagguccagcccugacuucauccucccuuc

SEQ ID NO: 688180 - RNA, 60 nt, hsa
uggaggacuuuggaagaggcgcuccuuggccagguccaaugaguaacaucagacugacag

SEQ ID NO: 688181 - RNA, 60 nt, hsa
guuauggugcugguaauaagccucgcagcccagguccagagcccccggcgagccgguccc

SEQ ID NO: 688182 - RNA, 60 nt, hsa
gucccaaggaaaacccaaaguggaggugcucagguccaggggaguccagugggcaggacc

SEQ ID NO: 688183 - RNA, 60 nt, hsa
uccugaugucucaggcaacccuggcagacccagguccaacugcugggguccaagaaccaa

SEQ ID NO: 688184 - RNA, 60 nt, hsa
cacugcugcccgugcagugggaccagauuccagguccaaagucaccaugaggccacccug

SEQ ID NO: 688185 - RNA, 60 nt, hsa
ggggaaaaggcccgugagucauuguaagcacagguccaacuuggcccugacuccugcggg

SEQ ID NO: 688186 - RNA, 60 nt, hsa
gacacggaguggcuugagcuucuggggaugcagguccaccgagccccugaccccugucug

SEQ ID NO: 688187 - RNA, 60 nt, hsa
gaccuugguccauuugguuuucugucuagccagguccagguagcccacuugcaucagggc

SEQ ID NO: 688188 - RNA, 60 nt, hsa
acgugauaggagcaaagucucuccauucuccagguccaaggcagagauccugaaaagaua

SEQ ID NO: 688189 - RNA, 60 nt, hsa
gauggauccacguuucaucuuuaaucacgccagguccaggcccaucugucuuguuuccuc

SEQ ID NO: 688190 - RNA, 60 nt, hsa
caagucaggguccagaacugccccccaacacagguccacagacaccccaccaccuaggca

SEQ ID NO: 688191 - RNA, 60 nt, hsa
uccuucuagggccaccuguccccuuaaacacagguccacguugugucaagaaccuagugc

SEQ ID NO: 688192 - RNA, 60 nt, hsa
ggaaaugcccuggucuggccuccgagcccccagguccaccgucuccccuccccucauuug

SEQ ID NO: 688193 - RNA, 60 nt, hsa
ggcgacacacuuaccgcaucaaucuguguucagguccaggguuacauaauugcagaagca

SEQ ID NO: 688194 - RNA, 54 nt, hsa
uugccccuggguacugcuagagaacagguccacccuggcucugggacucgcugc

SEQ ID NO: 688195 - RNA, 60 nt, hsa
gcccaggcuccacgugcuuacugaggacaucagguccaccucuggaccccuuggcaggcc

SEQ ID NO: 688196 - RNA, 60 nt, hsa
aaccacuaggaugugaucugcccuugugggcagguccagcauaguuaggaguuaggcuuu

SEQ ID NO: 688197 - RNA, 60 nt, hsa
ugggacguuuuucuucuugggcccgguccacagguccaaggacacccucccuccaggguc

SEQ ID NO: 688198 - RNA, 60 nt, hsa
caugcauaucacauaagaccagaaguggcccagguccagggucaguuaauuuagcggcuc

SEQ ID NO: 688199 - RNA, 60 nt, hsa
ggccuggcauuucacgcauugcugccaccccagguccaccugucuccacuuucacagccu

SEQ ID NO: 688200 - RNA, 60 nt, hsa
ggcucucaucccuugggauaagccccaguccagguccaggaggcucccucccugcccagc

SEQ ID NO: 688201 - RNA, 60 nt, hsa
ugaaccuggacaagcagcggcugggaaggacagguccaauaaacgcccucugcgcccagg

SEQ ID NO: 688202 - RNA, 60 nt, hsa
accucagggguuaagagcucagaguucagacagguccaaguucaagcccaggaccaccac

SEQ ID NO: 688203 - RNA, 60 nt, hsa
aucuucuuggucuacugccuccucagccagcagguccagaaacaauaucaaaagugguuu

SEQ ID NO: 688204 - RNA, 60 nt, hsa
acggccacgcccacacccggccuuuuagcucagguccaccaugggggacggcccagcgug

SEQ ID NO: 688205 - RNA, 60 nt, hsa
ucccugagcgcaccggcccuuccugucacccagguccacccucaguacucaagcugcagu

SEQ ID NO: 688206 - RNA, 60 nt, hsa
ucuucuggggacacuugggguccacaaucccagguccauacucuagguuuuggauaccau

SEQ ID NO: 688207 - RNA, 60 nt, hsa
cuuuugcauaggaaauacuugauuuaauuacagguccagggaugagcugaugguugcugg

SEQ ID NO: 688208 - RNA, 60 nt, hsa
augcagaguuguuuggacuucuuccugugccagguccaagucgggggaccugaagaauca

SEQ ID NO: 688209 - RNA, 60 nt, hsa
gaggaaaaacacaguccuagggacaaaagccagguccacagcagucauuuuuaaaauaaa

SEQ ID NO: 688210 - RNA, 60 nt, hsa
cuggaucuuggguuccaggcagacaucauccagguccaucuggaacuuucagugauagcu

SEQ ID NO: 688211 - RNA, 60 nt, hsa
cucucaaccauuacucacacuuccagcgcccagguccaagucugagccugaccuccccuu

SEQ ID NO: 688212 - RNA, 60 nt, hsa
agccgggguaggaggaucaccagaggccagcagguccacaccagccugggcaacacagca

SEQ ID NO: 688213 - RNA, 60 nt, hsa
gguucacuugguuugucaucaggaacugagcagguccaggacucagcuuucugcuucagc

SEQ ID NO: 688214 - RNA, 60 nt, hsa
cuguggacuuauaccugugugcuugguuuacagguccagugguucuucagcccaugacag

SEQ ID NO: 688215 - RNA, 60 nt, hsa
cccgucugcugaugugaccaguggcaggcacagguccagggagacagacucugaauggga

SEQ ID NO: 688216 - RNA, 60 nt, hsa
gaaggcucccuaagaccuugagagccaugacagguccaucagcaugaaguuggccaagcc

SEQ ID NO: 688217 - RNA, 60 nt, hsa
aacuugaaagcaagaccuugauugcaccaacagguccagaguaugagugcaagcaaagca

SEQ ID NO: 688218 - RNA, 60 nt, hsa
caaguaggugggauuacagguacucaccaccagguccagcuaacuuuuguauuuuuagua

SEQ ID NO: 688219 - RNA, 60 nt, hsa
ccguagugauaagcacaccggcacgaacgucagguccauuccucgaagucggagcccuca

SEQ ID NO: 688220 - RNA, 60 nt, hsa
gagccacgggaucagcugagucaugagucucagguccagguggagucuguagguugccag

SEQ ID NO: 688221 - RNA, 60 nt, hsa
ucuugugguggggaggcugcugagggguagcagguccaucuccagcagcugguccaacag

SEQ ID NO: 688222 - RNA, 60 nt, hsa
ugauuaacucuaagaguuuaguugcuaccucagguccacaggcaggacuuccuccaaccc

SEQ ID NO: 688223 - RNA, 60 nt, hsa
uguaaaaagagaagaaaguggcagguuuuccagguccacggaaagguuuggccugacgcu

SEQ ID NO: 688224 - RNA, 60 nt, hsa
ggcugcucucaccguggccuguccacgguccagguccaucucagcagcgugagggugcac

SEQ ID NO: 688225 - RNA, 60 nt, hsa
cuuggaggcccccauccaggccagaaggaccagguccacccagcagcuguuugcccagag

SEQ ID NO: 688226 - RNA, 60 nt, hsa
ucugugcagcuagggcugcagagcuguauucagguccaagguucugcccuuccuugagug

SEQ ID NO: 688227 - RNA, 57 nt, hsa
ugaucgacauggccaagugaacuguggcagguccagaaccagucagagacuugcccc

SEQ ID NO: 688228 - RNA, 60 nt, hsa
cucaggaaaccuugacuucugaauuccuaucagguccagaggguggaaggcccuggcagg

SEQ ID NO: 688229 - RNA, 60 nt, hsa
cugggcaccugccucugacagacaccagaccagguccagggccuccuccacagccucagc

SEQ ID NO: 688230 - RNA, 60 nt, hsa
ccccgggccuucgccuuccccguggacccccagguccagucugccgcugaugagacugcu

SEQ ID NO: 688231 - RNA, 60 nt, hsa
uguuuggucggguucacagugaccgagagucagguccagcacacaccugggaaagggaug

SEQ ID NO: 688232 - RNA, 60 nt, hsa
cucagaagcagcagaacugacauugggacccagguccauuggaggcaucuuuuaguuaug

SEQ ID NO: 688233 - RNA, 60 nt, hsa
aggcacugagcagggaucugcccccuaguucagguccaaauucaccuuccccuaaacccc

SEQ ID NO: 688234 - RNA, 60 nt, hsa
uaaccuuuguuggaugugggccuuagccuccagguccagacuacuacucuauguucucca

SEQ ID NO: 688235 - RNA, 60 nt, hsa
aauccaccuuuuagguaugagaaauguguucagguccagauaugguuucuccuauaauuu

SEQ ID NO: 688236 - RNA, 60 nt, hsa
aaacuugugugauuauuaaagccagccaugcagguccaugauagaaacagcaggugauga

SEQ ID NO: 688237 - RNA, 60 nt, hsa
agaccaccuggcaacaggcucagugggggucagguccagguccccgaagaggugcuggag

SEQ ID NO: 688238 - RNA, 60 nt, hsa
uaggggaagugagauuuaaaaaaccauucacagguccacaauauucauacuauguguuug

SEQ ID NO: 688239 - RNA, 60 nt, hsa
aguauuuuuccugccuuucaguggucugcccagguccaugauagaucauugcagaaaguc

SEQ ID NO: 688240 - RNA, 60 nt, hsa
gcuggguuuaugagucccuguccucuucugcagguccagcccuggcgagggcaggucaga

SEQ ID NO: 688241 - RNA, 60 nt, hsa
cuaagauuugaacccagggugucugacucccagguccaugcuccagagucagauauagaa

SEQ ID NO: 688242 - RNA, 65 nt, hsa
cucgaucuucuacuugccuguggggaggggagugacagguccacacaccacacugggucacccug

SEQ ID NO: 688243 - RNA, 65 nt, hsa
gaggugugugagcagggaacucagugugacaccgccagguccagcacccaugggggcgggggaga

SEQ ID NO: 688244 - RNA, 65 nt, hsa
ggcuccccucggcuguggugccuccucuggccccccagguccacguccuuuaaauuggcccuuug

SEQ ID NO: 688245 - RNA, 65 nt, hsa
caccucagggccaagcgggggcguggcuggccuuucagguccaggccagugggccugguagcaca

SEQ ID NO: 688246 - RNA, 65 nt, hsa
augacccagaagcaucagugugcaucuacgcagcccagguccaggaccacauccuggccagcugc

SEQ ID NO: 688247 - RNA, 65 nt, hsa
ucuggagacugagaaagggguguauuuaauuccaucagguccaguacaguacuaggagucauaau

SEQ ID NO: 688248 - RNA, 65 nt, hsa
agcggccacgcccacaauccgacagcccccaggagcagguccagggaugaugcagcccccuucuu

SEQ ID NO: 688249 - RNA, 65 nt, hsa
gaagaaaauagcuucuccuacagugauucaugucccagguccaggaaauccaauguuggugaagg

SEQ ID NO: 688250 - RNA, 65 nt, hsa
guccugggacaugcagccaggacugugagucugggcagguccaaggccugcaccuucaagaagug

SEQ ID NO: 688251 - RNA, 65 nt, hsa
uacccagcagguggcacugcagcuccccgcuccugcagguccagcguccucacaggaacaccagg

SEQ ID NO: 688252 - RNA, 65 nt, hsa
ccaggacaaggcaggacaugauaaagauuauaaagcagguccaaggaaagugccgccaguggucc

SEQ ID NO: 688253 - RNA, 65 nt, hsa
ucagcuucauuccucugauagaacaaagcgaaaugcagguccaccagggagggagacacacaagc

SEQ ID NO: 688254 - RNA, 65 nt, hsa
aaaacccaaggucuuuccuucuggcuaccuuccugcagguccacccugucugccauuggucuccu

SEQ ID NO: 688255 - RNA, 65 nt, hsa
ugcuugccuccacucccuucugacuuuccagaccccagguccagucugcagauccuaccagguug

SEQ ID NO: 688256 - RNA, 65 nt, hsa
agauauuaguaagaaaggaucauguuuugaagcagcagguccaggucacuuuguauauagaauuu

SEQ ID NO: 688257 - RNA, 65 nt, hsa
cccccuucuccuacuaggccugccugagaggcucacagguccaagggaaagcucugaacuugcca

SEQ ID NO: 688258 - RNA, 65 nt, hsa
cuccuuggauggccuccuaaaucuccccguggcaacagguccaggagaggcccauggagcagucu

SEQ ID NO: 688259 - RNA, 65 nt, hsa
cauguccuccuccaggugcugcaggccugaggggccagguccaccaggccuacagucaaacucca

SEQ ID NO: 688260 - RNA, 65 nt, hsa
gaguuacagugauggaacaugugcuuggccacaggcagguccagucacugcaaaagugaccaagc

SEQ ID NO: 688261 - RNA, 65 nt, hsa
caccugaguguccgugagcgggccgaggcgcucaucagguccagccugggcuccuccaccagcuc

SEQ ID NO: 688262 - RNA, 65 nt, hsa
guggagggcgaggaaggcgguccagaggcggccggcagguccacguccugggcgaccgcucuguc

SEQ ID NO: 688263 - RNA, 65 nt, hsa
cucccaggguuuuaacuuuguuuuauuuucaaaaccagguccaaugagcuuucugaacagcuggu

SEQ ID NO: 688264 - RNA, 65 nt, hsa
accagcugguaaaaggugaugccaggucuugaagacagguccaccuucaaaaucuauucucuuua

SEQ ID NO: 688265 - RNA, 65 nt, hsa
auaagucccauuuauaaacccacuuuuaaaaauaacagguccaaguuagagugauguguguauau

SEQ ID NO: 688266 - RNA, 65 nt, hsa
cuucuugucuccccggcccaggucccucccgccuccagguccauccaucccguccggaaaagaag

SEQ ID NO: 688267 - RNA, 65 nt, hsa
uaugccucuucuuuuagaauuaaaugaaugcugcacagguccagauguguguugauguagacuug

SEQ ID NO: 688268 - RNA, 65 nt, hsa
ugacucgguuucuccaaacugaagcagccucuccccagguccagcucuggaggggagggggaucc

SEQ ID NO: 688269 - RNA, 65 nt, hsa
caucugcugcccugaucacagagacgggaccgagccagguccauaccccuuccucucucccuccu

SEQ ID NO: 688270 - RNA, 65 nt, hsa
aucaugaaccaaucuggaugccucauuaugucaaccagguccagaugugcuauaaucuguuuuua

SEQ ID NO: 688271 - RNA, 65 nt, hsa
cacaguuuugcugcccucuaggugcacagacaauucagguccauggcccagaugguacuugcugu

SEQ ID NO: 688272 - RNA, 65 nt, hsa
cgauugugcagcgcuuuggauuuccuucaguucuccagguccaccuggaaaguauaguuggccag

SEQ ID NO: 688273 - RNA, 65 nt, hsa
cuuggggggugugggggauaaaacaggacagacgacagguccacccaagacugucaagggaugag

SEQ ID NO: 688274 - RNA, 65 nt, hsa
ucacagucuccggacaccacaccacaugagcccaacagguccacgauggauccaccagucccacc

SEQ ID NO: 688275 - RNA, 65 nt, hsa
ggaaacugcaaaaacccaaagccuccaaaacuaaccagguccaccuaacacccccucccuccccu

SEQ ID NO: 688276 - RNA, 65 nt, hsa
uucuccguggggacccgugucugugggagcgggcacagguccaugcugcaggccacuacggcugc

SEQ ID NO: 688277 - RNA, 65 nt, hsa
aggagcagcacuucggccucucccuguacuggaaucagguccagggccccccaaaaccccggugg

SEQ ID NO: 688278 - RNA, 65 nt, hsa
ugaaauuaaaggcagaaaaacuggaaaaccuacugcagguccagagacuucuguuuuacaacugg

SEQ ID NO: 688279 - RNA, 65 nt, hsa
ggcagcuagcccaccuccccagccacccuccuccacagguccaggugccgcucccucccccacca

SEQ ID NO: 688280 - RNA, 65 nt, hsa
accauggggacuucaagagccuguggucaggaaaucagguccagccuucccuguagccagacagu

SEQ ID NO: 688281 - RNA, 65 nt, hsa
accguucaaauucucuucuuuuucuuuuuuauuaccagguccauuuugccugacaauugcaaauc

SEQ ID NO: 688282 - RNA, 65 nt, hsa
uggggcauuuggggcccagaccuacacuuggagcccagguccagcguucccccgaccgcuuuccc

SEQ ID NO: 688283 - RNA, 65 nt, hsa
gccuugugggaggauaucuuuuggccguguacccucagguccagugcuugguccugcucugguca

SEQ ID NO: 688284 - RNA, 65 nt, hsa
acaaggaggcacguuuggcacaaaguguuguccuccagguccaaguggacucuacagagugcuug

SEQ ID NO: 688285 - RNA, 65 nt, hsa
uuucauuuccauuuaagcaauuuguaagcaaaguccagguccauuuaguuuuuggauauauuuaa

SEQ ID NO: 688286 - RNA, 65 nt, hsa
agugagcuaaccuugaucucuaaggacuaacuacccagguccaggucuucacuagggguacugac

SEQ ID NO: 688287 - RNA, 65 nt, hsa
auucauauggaucucuaccauccccaugccuugcccagguccaguuccauuucucucauucacaa

SEQ ID NO: 688288 - RNA, 65 nt, hsa
accuucaaaggugauuauuuuucuccuggaaacuccagguccauucuguuuaaaucccuaagaau

SEQ ID NO: 688289 - RNA, 65 nt, hsa
ugacuuucuguaucauuacuucacuuaauggccuccagguccauccauguuguugcaaaagauaa

SEQ ID NO: 688290 - RNA, 65 nt, hsa
ggggaaagggcugguuucaggcugacauauggccgcagguccaguucagcccaggucucucaugg

SEQ ID NO: 688291 - RNA, 65 nt, hsa
ggacccagggagaggcugugucccugcuggggucucagguccagcuuuacuguggcugucuggau

SEQ ID NO: 688292 - RNA, 65 nt, hsa
agcuggcuagaggguuagccuggcuggggccagcucagguccacuucaacagaagaggcugcugg

SEQ ID NO: 688293 - RNA, 65 nt, hsa
cagaggacccugacccucggccagcaggguggccccagguccauguugggcacuagggcagguuc

SEQ ID NO: 688294 - RNA, 65 nt, hsa
caagggaucccugacgagaauaaagagcccagaaacagguccauguuuauaugggaacuugauuu

SEQ ID NO: 688295 - RNA, 65 nt, hsa
ucuuggggcuggaagguccuuugacggguaugaaacagguccagaaaggggagguggccugcuug

SEQ ID NO: 688296 - RNA, 65 nt, hsa
aagcagcuuuuccuacgaucugcauuauguaaucacagguccagagagcuuuauggaagcgggag

SEQ ID NO: 688297 - RNA, 65 nt, hsa
aggcaaagaaaacagaagaagaggaaggaaaacuacagguccauaucccucauuaacacagacac

SEQ ID NO: 688298 - RNA, 65 nt, hsa
ccgugucacccucgugugggagccucugggcucggcagguccacauuucaugagcugaggcgugg

SEQ ID NO: 688299 - RNA, 65 nt, hsa
cuauggacaguucccggaaacgguugcccacuucacagguccaugggucugacccuuggacucug

SEQ ID NO: 688300 - RNA, 65 nt, hsa
uuaauaccauguaaagcuggcuuucuggagucugccagguccacacgaagugcuacccccaguuu

SEQ ID NO: 688301 - RNA, 65 nt, hsa
aaaacaacuaagccuuuuugagguguagagauucucagguccaggcguuaaaaaauaauggucaa

SEQ ID NO: 688302 - RNA, 65 nt, hsa
cuucuguaggaauucuuuuggggaagugaggaagccagguccacggucuguucuugaagcaguag

SEQ ID NO: 688303 - RNA, 65 nt, hsa
auuuuugcagauuuuucuuuacaguauuccauaggcagguccacuggaaaacugcagaaaaaugu

SEQ ID NO: 688304 - RNA, 65 nt, hsa
ggccgcucuuacucccucccucugcugucucacuucagguccauguauuucacuuuucuuaaaua

SEQ ID NO: 688305 - RNA, 65 nt, hsa
ggagcugggaggaagaagggggccugagagagccccagguccauucuacccccagcuucacucag

SEQ ID NO: 688306 - RNA, 65 nt, hsa
caaccagucuucaggaggaagagaugcccaugaagcagguccagaacuaagugggaguggaggca

SEQ ID NO: 688307 - RNA, 58 nt, hsa; identical to SEQ ID NO: 688074

SEQ ID NO: 688308 - RNA, 65 nt, hsa
aggcgagauggaacagggauuuaacuccccgcccacagguccaugggagcuugaggcaguaaggg

SEQ ID NO: 688309 - RNA, 65 nt, hsa
cagagaagugcuucauuuucuuuuuauaguagaagcagguccaugucuuuugugguuuccugcac

SEQ ID NO: 688310 - RNA, 65 nt, hsa
uuuaaaaaaagaacacuuucugcucauaucauaaccagguccaacccagcuucuuggcaugaggu

SEQ ID NO: 688311 - RNA, 65 nt, hsa
uggcgagucugugcucgggacaauaaagcuugugacagguccaggaccccggcaguuggcuuguc

SEQ ID NO: 688312 - RNA, 65 nt, hsa
uggguggauaucugccuuccugcugcaaguggaggcagguccagcagccccucuucagagccccu

SEQ ID NO: 688313 - RNA, 65 nt, hsa
uucuaguuguucggagaaagccuagguucugggcucagguccagaugcagcggggauucuguucu

SEQ ID NO: 688314 - RNA, 65 nt, hsa
uuaaucuguggauuuguucaaauacuaaagauccucagguccagaauuccagcaucauuuauucu

SEQ ID NO: 688315 - RNA, 65 nt, hsa
ccugcacuuguagucuaaaaaguaaaaggggcgaucagguccaucucaaaggucacacguaauag

SEQ ID NO: 688316 - RNA, 65 nt, hsa
gacacacacuaggcccaaggugccugugcucccagcagguccaagugcagcuccagccaccuuug

SEQ ID NO: 688317 - RNA, 65 nt, hsa
ggaucauucagaaggaugcuucaacuauuauuugucagguccaaaggucguacuuaauaacccca

SEQ ID NO: 688318 - RNA, 65 nt, hsa
gcagccaggaggggagcgggcccaggagccaggcucagguccagcugguuccucucuggcgccuu

SEQ ID NO: 688319 - RNA, 65 nt, hsa
ugguuccucucuggcgccuucugaacccgucucagcagguccacagcaccugggcagaggucaga

SEQ ID NO: 688320 - RNA, 65 nt, hsa
aaaguauuuuauucuugcuuuuccaugcuucucuacagguccaaauacugaaugucuccuuuacu

SEQ ID NO: 688321 - RNA, 65 nt, hsa
ccugaaaaaugaagaaacagggcuggaugauuuugcagguccaaugcaaacaucacagaccccac

SEQ ID NO: 688322 - RNA, 65 nt, hsa
agaaaauucuaaugauuggcaagucacguuguuuucagguccagaguaguuucuuucugucugcu

SEQ ID NO: 688323 - RNA, 65 nt, hsa
gacaaaugcauuuaguggugguagaaaugauucaccagguccaauguuguucaccagugcuugcu

SEQ ID NO: 688324 - RNA, 65 nt, hsa
caaaaagagcuuccuuucgugacgagacgcggacgcagguccacccucgggcccuagcucuguag

SEQ ID NO: 688325 - RNA, 65 nt, hsa
augggcugcagucuucuuccaucacuuuucccuaccagguccauuaauaugcuuauaacacuagu

SEQ ID NO: 688326 - RNA, 65 nt, hsa
aacaucuggcugcguugccauuggcugagacccaccagguccaguuuugguugguguagagacca

SEQ ID NO: 688327 - RNA, 65 nt, hsa
ggcagaaggugggccccguguguuuacagcauuuccagguccagagagguuggcagacaagugcc

SEQ ID NO: 688328 - RNA, 65 nt, hsa
gccccaggcugagggcuuccccgaaagucugggaccagguccaggugggcauggaaugcugauga

SEQ ID NO: 688329 - RNA, 65 nt, hsa
ggauccuugugggccuucuaagaugaagccacccucagguccagggaagguugugcugguauuug

SEQ ID NO: 688330 - RNA, 65 nt, hsa
gacuagaaaggacauugcuuucucagccccacccccagguccacaguguccaagguaauggcaca

SEQ ID NO: 688331 - RNA, 65 nt, hsa
uuucuaucguccgcugaccucuggccacaggaagccagguccaccgcccaccacccuuucaggcc

SEQ ID NO: 688332 - RNA, 65 nt, hsa
ugacacaaggcacuccuaccacugagcgccuuugccagguccagccugggcucagguuccaagac

SEQ ID NO: 688333 - RNA, 65 nt, hsa
cucuacccugcauggcugagcugcccacagcaggccagguccagagagaccgaggagggagaguc

SEQ ID NO: 688334 - RNA, 65 nt, hsa
gccaggggauugacuugguucccugacaaggguaccagguccaccccuucugaaaagcagcuguu

SEQ ID NO: 688335 - RNA, 65 nt, hsa
gaaagugucaucacggguccccugaggagacaaggcagguccagcgcacaucaggcggacugagc

SEQ ID NO: 688336 - RNA, 65 nt, hsa
uucagccaaggcugggccagccuuuuuugggcagucagguccacaccuauguccagggcaccagg

SEQ ID NO: 688337 - RNA, 65 nt, hsa
gugggugggcagggcuuggacccccgucuccauggcagguccauacagcauggguggcaggguuu

SEQ ID NO: 688338 - RNA, 65 nt, hsa
aggaagccaacccugagcgagccuguccucuguggcagguccacacggugugggugggcagggcu

SEQ ID NO: 688339 - RNA, 65 nt, hsa
aaguuggcugggugguccgcacccuggcucuccugcagguccacacaccuuccaggccuguggcc

SEQ ID NO: 688340 - RNA, 65 nt, hsa
ucaagaaagcaaagugauuuugucugcuccuagagcagguccauaccaaguaauagaggcacuuu

SEQ ID NO: 688341 - RNA, 65 nt, hsa
uuuuucagaucaccaucuaaguuacaucuuuagcucagguccauccuucucaagaucuccuucuu

SEQ ID NO: 688342 - RNA, 65 nt, hsa
ccaaacccuuucucuuucucccaggcagggcucugcagguccauaugggcucaaugucaccaccc

SEQ ID NO: 688343 - RNA, 65 nt, hsa
uggcacaaucuuggcucacugcaaccuccaccucccagguccaagcgauucucuugccucagccu

SEQ ID NO: 688344 - RNA, 65 nt, hsa
cugaacccaucuuuugaaauguauuuucuucauugcagguccaccuaaucauccugugaaagugg

SEQ ID NO: 688345 - RNA, 65 nt, hsa
gggcugauuucgcgcagccuguuguuuuccuuagacagguccacgucccucuccugaggcugugg

SEQ ID NO: 688346 - RNA, 65 nt, hsa
acagugcuaggacgggaggcagagccggcucagagcagguccaccagcccaccuauagcaggaag

SEQ ID NO: 688347 - RNA, 65 nt, hsa
cauaccagcaaaaugcccccugcuucccuaaggggcagguccagagcagggcccacaagggggau

SEQ ID NO: 688348 - RNA, 65 nt, hsa
auacugcugaguucuggucuguugcugccacucuacagguccaggguuguuagaucuucuggguu

SEQ ID NO: 688349 - RNA, 65 nt, hsa
ugaagagacaugaguucuggaaggagcaaggccaccagguccagagaaccuggcaugcaauggac

SEQ ID NO: 688350 - RNA, 54 nt, hsa; identical to SEQ ID NO: 688117

SEQ ID NO: 688351 - RNA, 65 nt, hsa
cagccucucaccggcuccccgagcguggcagccaccagguccacagaacuacugcagcccagagg

SEQ ID NO: 688352 - RNA, 65 nt, hsa
uggauuccccaucucaggccagagccaaggggcuucagguccaggcuguguuuggcuuucaggga

SEQ ID NO: 688353 - RNA, 65 nt, hsa
ucaaugaggccuucaccuuccuggugcccuucagccagguccagaauguggaccuggugcuggcu

SEQ ID NO: 688354 - RNA, 65 nt, hsa
gcucccuaggcgucccaucucgcuuccugggucugcagguccagccggcuggcacccuccaugua

SEQ ID NO: 688355 - RNA, 65 nt, hsa
ucuucagcaccaguggaaacacaugaacuucgaugcagguccagagaccauggacacucccacga

SEQ ID NO: 688356 - RNA, 65 nt, hsa
aaugaagguugggaagguuguucccuucccggugccagguccagauuucccuccaugauuuggga

SEQ ID NO: 688357 - RNA, 65 nt, hsa
agguauuuugccuguuccaaucaaaccaccccauucagguccaucagccucugauuaauauccgu

SEQ ID NO: 688358 - RNA, 65 nt, hsa
acucuuuuuguuuuuuguguuuuguucuuuaaagucagguccaauuuguaaaaacagcauugcuu

SEQ ID NO: 688359 - RNA, 65 nt, hsa
ugguggauagcaucacaagaaacgagccugaaaaucagguccagccgguccaagcacauggccuc

SEQ ID NO: 688360 - RNA, 65 nt, hsa
agggugggugggacccccugcugcagggcagaguucagguccacugggcugaguguccccuuggg

SEQ ID NO: 688361 - RNA, 65 nt, hsa
gaccacagaagcccuguugcucacugaccugugaccagguccaauguggggagaaauaugaagga

SEQ ID NO: 688362 - RNA, 65 nt, hsa
caacacaauaaaaucgaaauucauugauuccaucucagguccagauguuaaacguuuauaaaacc

SEQ ID NO: 688363 - RNA, 65 nt, hsa
gccaugcagucccagaaaccccaaccuagcuggggcagguccagaguccaagcccugguggguag

SEQ ID NO: 688364 - RNA, 65 nt, hsa
agaagcccuguggggcugucaagagcguguucugccagguccaugggggcuggcaucccagcucc

SEQ ID NO: 688365 - RNA, 65 nt, hsa
ccuaaauauacuuagauuucuaaguauggugcucucagguccaaguucaacuauucuuaagcagu

SEQ ID NO: 688366 - RNA, 65 nt, hsa
cauucaacaaucauauacugauuagcuacucugaccagguccaguacuaacucugaagaaguuau

SEQ ID NO: 688367 - RNA, 65 nt, hsa
ucagguuaagcagacagacaauugaaaauacugggcagguccaaaaggauaguuccaggccauag

SEQ ID NO: 688368 - RNA, 65 nt, hsa
ccagccuggugcuguccucucggcccaccaucggccagguccagcgcuuccucuggggcugacaa

SEQ ID NO: 688369 - RNA, 65 nt, hsa
uagucaauaucucguguuucauuuuaauuaagugacagguccaagugugacauccuucagcaccc

SEQ ID NO: 688370 - RNA, 65 nt, hsa
uggucuguuucuuccccuccuacgaguaccugcgccagguccaugcccacugggagaaggguggc

SEQ ID NO: 688371 - RNA, 65 nt, hsa
cagccccuuaaggcccuccuuuucccuccaugcuccagguccaugcacagguguagcauguccug

SEQ ID NO: 688372 - RNA, 65 nt, hsa
ucuuuauuucuuuuuuuuuuuuaaauaguaagucacagguccacacuguguaaacaugcaucuga

SEQ ID NO: 688373 - RNA, 65 nt, hsa
uggugcaaucucugcucacugcaacaucugccucccagguccaagcgauucuccugccucagccu

SEQ ID NO: 688374 - RNA, 65 nt, hsa
gccuguuucucucugcccucuagagcaaggcccaccagguccauccaggaggcucuccugaccuc

SEQ ID NO: 688375 - RNA, 65 nt, hsa
ucuaagagaauaagcauuuccuguucuuccagcuccagguccaccuccuguugggaggcgguggg

SEQ ID NO: 688376 - RNA, 65 nt, hsa
gggcaggaacagagggugaaagggacagauagaugcagguccauucugcaccucuuggcucgggu

SEQ ID NO: 688377 - RNA, 65 nt, hsa
uggacucugucuuguucacugcaguaucccaacugcagguccagugcaggcaauaaauaugugau

SEQ ID NO: 688378 - RNA, 65 nt, hsa
ucccugcuuccuauuucauaauccuccagccccagcagguccacuccugguuccuguguguuugg

SEQ ID NO: 688379 - RNA, 65 nt, hsa
agccaccccugcugaugaugagcaagugccugcugcagguccaaacacagcauccagggcuuugc

SEQ ID NO: 688380 - RNA, 65 nt, hsa
cggagcucgucgcauuuguuauaaauguaguaaggcagguccaagcacuuacaaguuuuuuguag

SEQ ID NO: 688381 - RNA, 65 nt, hsa
uuaccaaagggcacugaaacacacaauugacuggacagguccacgcgccaugacaaaacuauaau

SEQ ID NO: 688382 - RNA, 65 nt, hsa
uauuauccuauccauccauaucuauugaaauuguacagguccauaauuucauuuuaauuaauuau

SEQ ID NO: 688383 - RNA, 65 nt, hsa
aguuggugcuuuggaucagggaagccacuuugggacagguccauaaagugaacugaucuuaccga

SEQ ID NO: 688384 - RNA, 65 nt, hsa
ugaaccuaauugaaagaaaaccaucugaauuguugcagguccacauuuuugccaaagauacacuc

SEQ ID NO: 688385 - RNA, 62 nt, hsa
gccugaugcaguccuccugaccguuccuaccgcagguccagggccugggcccgcggacccca

SEQ ID NO: 688386 - RNA, 65 nt, hsa
gggauguuccaguggaugagggccaccaggaagcacagguccaaggcuggucccacacuuaucag

SEQ ID NO: 688387 - RNA, 65 nt, hsa
ugcacagcccaguggcuuaaacaccauuuauaccacagguccagaugaauccugcagggccaagg

SEQ ID NO: 688388 - RNA, 65 nt, hsa
cuaaguuaaaucuaauauuguuaauacugaacuugcagguccagguugguauacauuccacccuc

SEQ ID NO: 688389 - RNA, 65 nt, hsa
uuuuuccugcauucuguacauaaaguuuuaaguggcagguccagauauguaaaaucauuucucuc

SEQ ID NO: 688390 - RNA, 65 nt, hsa
uggcaguggcagcacgucuuccucaugagccgagccagguccauggccaccacguggcuggcccc

SEQ ID NO: 688391 - RNA, 65 nt, hsa
gucgguauuuaggccgugagcuucccauacuacugcagguccaacuccuggcaaccgcgggcuca

SEQ ID NO: 688392 - RNA, 65 nt, hsa
gagugagaaagggaggguggagggugaggccaaaucagguccagcaaaagucaguagggacauug

SEQ ID NO: 688393 - RNA, 65 nt, hsa
gguuaccauggguguggauggcaguguggggagggcagguccagcucugugggcccuacccuccu

SEQ ID NO: 688394 - RNA, 65 nt, hsa
uuaucuggaucucugugguuccuucucagccgaaacagguccaguaucccagucauuucuucaaa

SEQ ID NO: 688395 - RNA, 65 nt, hsa
gcuugaggggucugcaguccaguagggcaggcagucagguccaugugcacugcaaugccaggugg

SEQ ID NO: 688396 - RNA, 65 nt, hsa
uaucagaaaccaagcuuaugaagaucuucucccagcagguccauagcaguaggcuuaggaugcag

SEQ ID NO: 688397 - RNA, 65 nt, hsa
acuaggugaaguugugaccaucuggcugggaagcccagguccacacaguguaggagcagauguuu

SEQ ID NO: 688398 - RNA, 65 nt, hsa
guccagagcacugccccaugcccacccuguguacccagguccagaggguccguccaccacagcag

SEQ ID NO: 688399 - RNA, 65 nt, hsa
gcaaaacaguccuugcccuggggccgguucuuacccagguccagagaaaccaacgcgggauguca

SEQ ID NO: 688400 - RNA, 65 nt, hsa
ucacuacauuauaaaugucucuuuaaugucacaggcagguccaggguuugaguucauacccuguu

SEQ ID NO: 688401 - RNA, 65 nt, hsa
caguuuuuuugcugaggguuucugucugggccuaucagguccauacuuagacccugagcaucuuc

SEQ ID NO: 688402 - RNA, 65 nt, hsa
ccuggccuuaaagccgagcucaguuaccauagggacagguccaccucuacugggcccucaugcuu

SEQ ID NO: 688403 - RNA, 65 nt, hsa
agauagaucauagaucacguuacaagcacuuggcucagguccagcaaggacagaugaacaaauuc

SEQ ID NO: 688404 - RNA, 65 nt, hsa
cuuucugguuugccauaggcccugccaagauacugcagguccauccaggccucugcuaucugcau

SEQ ID NO: 688405 - RNA, 65 nt, hsa
cccguucagucugaaugcugccacaaccagccaggcagguccacagagagggagagcagagaaag

SEQ ID NO: 688406 - RNA, 65 nt, hsa
cauguucaacgagggaaccccaagacggacccacacagguccacccacgcugggggcuguaauca

SEQ ID NO: 688407 - RNA, 65 nt, hsa
gaggggaaagcagcucccaggccuuacucaggccucagguccauggguugggcagccagucuggg

SEQ ID NO: 688408 - RNA, 65 nt, hsa
gcuguggcccaugccgacagauaucguggggcugacagguccacggcaggcuugcuuucuuuuau

SEQ ID NO: 688409 - RNA, 65 nt, hsa
ccauccuggacagaaaggcaggagcucugaguccucagguccacccauuucccucauggggaucc

SEQ ID NO: 688410 - RNA, 65 nt, hsa
agaugcuguccccucacccccucuccuguauuucucagguccaguucaaaucuaaaauucuacuu

SEQ ID NO: 688411 - RNA, 65 nt, hsa
ccagccacggagggaggcaccaugcaaaugucuuccagguccaaacccuucaacuccuggcuccg

SEQ ID NO: 688412 - RNA, 65 nt, hsa
uucuggaccagcacugacagccuagccagugguuccagguccagcccugacuucauccucccuuc

SEQ ID NO: 688413 - RNA, 65 nt, hsa
uaggauggaggacuuuggaagaggcgcuccuuggccagguccaaugaguaacaucagacugacag

SEQ ID NO: 688414 - RNA, 65 nt, hsa
uggcuguuauggugcugguaauaagccucgcagcccagguccagagcccccggcgagccgguccc

SEQ ID NO: 688415 - RNA, 65 nt, hsa
agugugucccaaggaaaacccaaaguggaggugcucagguccaggggaguccagugggcaggacc

SEQ ID NO: 688416 - RNA, 65 nt, hsa
cucauuccugaugucucaggcaacccuggcagacccagguccaacugcugggguccaagaaccaa

SEQ ID NO: 688417 - RNA, 65 nt, hsa
guccacacugcugcccgugcagugggaccagauuccagguccaaagucaccaugaggccacccug

SEQ ID NO: 688418 - RNA, 65 nt, hsa
cagguggggaaaaggcccgugagucauuguaagcacagguccaacuuggcccugacuccugcggg

SEQ ID NO: 688419 - RNA, 65 nt, hsa
caggugacacggaguggcuugagcuucuggggaugcagguccaccgagccccugaccccugucug

SEQ ID NO: 688420 - RNA, 65 nt, hsa
uccuugaccuugguccauuugguuuucugucuagccagguccagguagcccacuugcaucagggc

SEQ ID NO: 688421 - RNA, 65 nt, hsa
uugggacgugauaggagcaaagucucuccauucuccagguccaaggcagagauccugaaaagaua

SEQ ID NO: 688422 - RNA, 65 nt, hsa
gcgaagauggauccacguuucaucuuuaaucacgccagguccaggcccaucugucuuguuuccuc

SEQ ID NO: 688423 - RNA, 65 nt, hsa
gugcccaagucaggguccagaacugccccccaacacagguccacagacaccccaccaccuaggca

SEQ ID NO: 688424 - RNA, 65 nt, hsa
ucuguuccuucuagggccaccuguccccuuaaacacagguccacguugugucaagaaccuagugc

SEQ ID NO: 688425 - RNA, 65 nt, hsa
uggagggaaaugcccuggucuggccuccgagcccccagguccaccgucuccccuccccucauuug

SEQ ID NO: 688426 - RNA, 65 nt, hsa
gggcuggcgacacacuuaccgcaucaaucuguguucagguccaggguuacauaauugcagaagca

SEQ ID NO: 688427 - RNA, 54 nt, hsa; identical to SEQ ID NO: 688194

SEQ ID NO: 688428 - RNA, 65 nt, hsa
cgguggcccaggcuccacgugcuuacugaggacaucagguccaccucuggaccccuuggcaggcc

SEQ ID NO: 688429 - RNA, 65 nt, hsa
cugugaaccacuaggaugugaucugcccuugugggcagguccagcauaguuaggaguuaggcuuu

SEQ ID NO: 688430 - RNA, 65 nt, hsa
uaggaugggacguuuuucuucuugggcccgguccacagguccaaggacacccucccuccaggguc

SEQ ID NO: 688431 - RNA, 65 nt, hsa
auaaucaugcauaucacauaagaccagaaguggcccagguccagggucaguuaauuuagcggcuc

SEQ ID NO: 688432 - RNA, 65 nt, hsa
ggcacggccuggcauuucacgcauugcugccaccccagguccaccugucuccacuuucacagccu

SEQ ID NO: 688433 - RNA, 65 nt, hsa
cuaucggcucucaucccuugggauaagccccaguccagguccaggaggcucccucccugcccagc

SEQ ID NO: 688434 - RNA, 65 nt, hsa
agcgcugaaccuggacaagcagcggcugggaaggacagguccaauaaacgcccucugcgcccagg

SEQ ID NO: 688435 - RNA, 65 nt, hsa
uucucaccucagggguuaagagcucagaguucagacagguccaaguucaagcccaggaccaccac

SEQ ID NO: 688436 - RNA, 65 nt, hsa
ucuucaucuucuuggucuacugccuccucagccagcagguccagaaacaauaucaaaagugguuu

SEQ ID NO: 688437 - RNA, 65 nt, hsa
cgcagacggccacgcccacacccggccuuuuagcucagguccaccaugggggacggcccagcgug

SEQ ID NO: 688438 - RNA, 65 nt, hsa
gcuccucccugagcgcaccggcccuuccugucacccagguccacccucaguacucaagcugcagu

SEQ ID NO: 688439 - RNA, 65 nt, hsa
gggacucuucuggggacacuugggguccacaaucccagguccauacucuagguuuuggauaccau

SEQ ID NO: 688440 - RNA, 65 nt, hsa
uuuuacuuuugcauaggaaauacuugauuuaauuacagguccagggaugagcugaugguugcugg

SEQ ID NO: 688441 - RNA, 65 nt, hsa
uaacuaugcagaguuguuuggacuucuuccugugccagguccaagucgggggaccugaagaauca

SEQ ID NO: 688442 - RNA, 65 nt, hsa
uucaggaggaaaaacacaguccuagggacaaaagccagguccacagcagucauuuuuaaaauaaa

SEQ ID NO: 688443 - RNA, 65 nt, hsa
agaugcuggaucuuggguuccaggcagacaucauccagguccaucuggaacuuucagugauagcu

SEQ ID NO: 688444 - RNA, 65 nt, hsa
accaccucucaaccauuacucacacuuccagcgcccagguccaagucugagccugaccuccccuu

SEQ ID NO: 688445 - RNA, 65 nt, hsa
ugggaagccgggguaggaggaucaccagaggccagcagguccacaccagccugggcaacacagca

SEQ ID NO: 688446 - RNA, 65 nt, hsa
gucuagguucacuugguuugucaucaggaacugagcagguccaggacucagcuuucugcuucagc

SEQ ID NO: 688447 - RNA, 65 nt, hsa
cuggucuguggacuuauaccugugugcuugguuuacagguccagugguucuucagcccaugacag

SEQ ID NO: 688448 - RNA, 65 nt, hsa
ugcugcccgucugcugaugugaccaguggcaggcacagguccagggagacagacucugaauggga

SEQ ID NO: 688449 - RNA, 65 nt, hsa
ccagagaaggcucccuaagaccuugagagccaugacagguccaucagcaugaaguuggccaagcc

SEQ ID NO: 688450 - RNA, 65 nt, hsa
uuguaaacuugaaagcaagaccuugauugcaccaacagguccagaguaugagugcaagcaaagca

SEQ ID NO: 688451 - RNA, 65 nt, hsa
ccucccaaguaggugggauuacagguacucaccaccagguccagcuaacuuuuguauuuuuagua

SEQ ID NO: 688452 - RNA, 65 nt, hsa
ggcgcccguagugauaagcacaccggcacgaacgucagguccauuccucgaagucggagcccuca

SEQ ID NO: 688453 - RNA, 65 nt, hsa
gcguggagccacgggaucagcugagucaugagucucagguccagguggagucuguagguugccag

SEQ ID NO: 688454 - RNA, 65 nt, hsa
acuugucuugugguggggaggcugcugagggguagcagguccaucuccagcagcugguccaacag

SEQ ID NO: 688455 - RNA, 65 nt, hsa
uuuuuugauuaacucuaagaguuuaguugcuaccucagguccacaggcaggacuuccuccaaccc

SEQ ID NO: 688456 - RNA, 65 nt, hsa
ugcauuguaaaaagagaagaaaguggcagguuuuccagguccacggaaagguuuggccugacgcu

SEQ ID NO: 688457 - RNA, 65 nt, hsa
ccucaggcugcucucaccguggccuguccacgguccagguccaucucagcagcgugagggugcac

SEQ ID NO: 688458 - RNA, 65 nt, hsa
aguuccuuggaggcccccauccaggccagaaggaccagguccacccagcagcuguuugcccagag

SEQ ID NO: 688459 - RNA, 65 nt, hsa
ugucuucugugcagcuagggcugcagagcuguauucagguccaagguucugcccuuccuugagug

SEQ ID NO: 688460 - RNA, 57 nt, hsa; identical to SEQ ID NO: 688227

SEQ ID NO: 688461 - RNA, 65 nt, hsa
ccccacucaggaaaccuugacuucugaauuccuaucagguccagaggguggaaggcccuggcagg

SEQ ID NO: 688462 - RNA, 65 nt, hsa
aaggacugggcaccugccucugacagacaccagaccagguccagggccuccuccacagccucagc

SEQ ID NO: 688463 - RNA, 65 nt, hsa
ugcuuccccgggccuucgccuuccccguggacccccagguccagucugccgcugaugagacugcu

SEQ ID NO: 688464 - RNA, 65 nt, hsa
uagaguguuuggucggguucacagugaccgagagucagguccagcacacaccugggaaagggaug

SEQ ID NO: 688465 - RNA, 65 nt, hsa
cacagcucagaagcagcagaacugacauugggacccagguccauuggaggcaucuuuuaguuaug

SEQ ID NO: 688466 - RNA, 65 nt, hsa
ugucuaggcacugagcagggaucugcccccuaguucagguccaaauucaccuuccccuaaacccc

SEQ ID NO: 688467 - RNA, 65 nt, hsa
gaagguaaccuuuguuggaugugggccuuagccuccagguccagacuacuacucuauguucucca

SEQ ID NO: 688468 - RNA, 65 nt, hsa
gcuagaauccaccuuuuagguaugagaaauguguucagguccagauaugguuucuccuauaauuu

SEQ ID NO: 688469 - RNA, 65 nt, hsa
gaugcaaacuugugugauuauuaaagccagccaugcagguccaugauagaaacagcaggugauga

SEQ ID NO: 688470 - RNA, 65 nt, hsa
aaccaagaccaccuggcaacaggcucagugggggucagguccagguccccgaagaggugcuggag

SEQ ID NO: 688471 - RNA, 65 nt, hsa
auuuuuaggggaagugagauuuaaaaaaccauucacagguccacaauauucauacuauguguuug

SEQ ID NO: 688472 - RNA, 65 nt, hsa
ugcaaaguauuuuuccugccuuucaguggucugcccagguccaugauagaucauugcagaaaguc

SEQ ID NO: 688473 - RNA, 65 nt, hsa
cagaagcuggguuuaugagucccuguccucuucugcagguccagcccuggcgagggcaggucaga

SEQ ID NO: 688474 - RNA, 65 nt, hsa
uagagcuaagauuugaacccagggugucugacucccagguccaugcuccagagucagauauagaa

SEQ ID NO: 688475 - RNA, 64 nt, hsa; identical to SEQ ID NO: 108382

SEQ ID NO: 688476 - RNA, 64 nt, hsa; identical to SEQ ID NO: 108383

SEQ ID NO: 688477 - RNA, 64 nt, hsa; identical to SEQ ID NO: 108384

SEQ ID NO: 688478 - RNA, 64 nt, hsa; identical to SEQ ID NO: 108385

SEQ ID NO: 688479 - RNA, 64 nt, hsa; identical to SEQ ID NO: 108386

SEQ ID NO: 688480 - RNA, 64 nt, hsa; identical to SEQ ID NO: 108387

SEQ ID NO: 688481 - RNA, 64 nt, hsa; identical to SEQ ID NO: 108388

SEQ ID NO: 688482 - RNA, 64 nt, hsa; identical to SEQ ID NO: 108389

SEQ ID NO: 688483 - RNA, 64 nt, hsa; identical to SEQ ID NO: 108390

SEQ ID NO: 688484 - RNA, 64 nt, hsa; identical to SEQ ID NO: 108391

SEQ ID NO: 688485 - RNA, 64 nt, hsa; identical to SEQ ID NO: 108392

SEQ ID NO: 688486 - RNA, 64 nt, hsa; identical to SEQ ID NO: 108393

SEQ ID NO: 688487 - RNA, 64 nt, hsa; identical to SEQ ID NO: 108394

SEQ ID NO: 688488 - RNA, 64 nt, hsa; identical to SEQ ID NO: 108395

SEQ ID NO: 688489 - RNA, 64 nt, hsa; identical to SEQ ID NO: 73453

SEQ ID NO: 688490 - RNA, 64 nt, hsa; identical to SEQ ID NO: 73454

SEQ ID NO: 688491 - RNA, 64 nt, hsa; identical to SEQ ID NO: 73455

SEQ ID NO: 688492 - RNA, 64 nt, hsa; identical to SEQ ID NO: 73456

SEQ ID NO: 688493 - RNA, 64 nt, hsa; identical to SEQ ID NO: 73457

SEQ ID NO: 688494 - RNA, 64 nt, hsa; identical to SEQ ID NO: 73458

SEQ ID NO: 688495 - RNA, 64 nt, hsa; identical to SEQ ID NO: 73459

SEQ ID NO: 688496 - RNA, 64 nt, hsa; identical to SEQ ID NO: 73460

SEQ ID NO: 688497 - RNA, 64 nt, hsa; identical to SEQ ID NO: 73461

SEQ ID NO: 688498 - RNA, 64 nt, hsa; identical to SEQ ID NO: 73462

SEQ ID NO: 688499 - RNA, 64 nt, hsa; identical to SEQ ID NO: 73463

SEQ ID NO: 688500 - RNA, 64 nt, hsa; identical to SEQ ID NO: 73464

SEQ ID NO: 688501 - RNA, 64 nt, hsa; identical to SEQ ID NO: 73465

SEQ ID NO: 688502 - RNA, 64 nt, hsa; identical to SEQ ID NO: 73466

SEQ ID NO: 688503 - RNA, 64 nt, hsa; identical to SEQ ID NO: 73467

SEQ ID NO: 688504 - RNA, 64 nt, hsa; identical to SEQ ID NO: 73468

SEQ ID NO: 688505 - RNA, 64 nt, hsa; identical to SEQ ID NO: 73469

SEQ ID NO: 688506 - RNA, 64 nt, hsa; identical to SEQ ID NO: 73470

SEQ ID NO: 688507 - RNA, 64 nt, hsa; identical to SEQ ID NO: 73471

SEQ ID NO: 688508 - RNA, 64 nt, hsa; identical to SEQ ID NO: 73472

SEQ ID NO: 688509 - RNA, 64 nt, hsa; identical to SEQ ID NO: 73473

SEQ ID NO: 688510 - RNA, 64 nt, hsa; identical to SEQ ID NO: 73474

SEQ ID NO: 688511 - RNA, 64 nt, hsa; identical to SEQ ID NO: 73475

SEQ ID NO: 688512 - RNA, 64 nt, hsa; identical to SEQ ID NO: 73476

SEQ ID NO: 688513 - RNA, 64 nt, hsa; identical to SEQ ID NO: 73477

SEQ ID NO: 688514 - RNA, 64 nt, hsa; identical to SEQ ID NO: 73478

SEQ ID NO: 688515 - RNA, 64 nt, hsa; identical to SEQ ID NO: 73479

SEQ ID NO: 688516 - RNA, 64 nt, hsa; identical to SEQ ID NO: 73480

SEQ ID NO: 688517 - RNA, 64 nt, hsa; identical to SEQ ID NO: 73481

SEQ ID NO: 688518 - RNA, 64 nt, hsa; identical to SEQ ID NO: 73482

SEQ ID NO: 688519 - RNA, 64 nt, hsa; identical to SEQ ID NO: 73483

SEQ ID NO: 688520 - RNA, 64 nt, hsa; identical to SEQ ID NO: 73484

SEQ ID NO: 688521 - RNA, 64 nt, hsa; identical to SEQ ID NO: 73485

SEQ ID NO: 688522 - RNA, 64 nt, hsa; identical to SEQ ID NO: 73486

SEQ ID NO: 688523 - RNA, 64 nt, hsa; identical to SEQ ID NO: 73487

SEQ ID NO: 688524 - RNA, 64 nt, hsa; identical to SEQ ID NO: 73488

SEQ ID NO: 688525 - RNA, 64 nt, hsa; identical to SEQ ID NO: 73489

SEQ ID NO: 688526 - RNA, 64 nt, hsa; identical to SEQ ID NO: 73490

SEQ ID NO: 688527 - RNA, 64 nt, hsa; identical to SEQ ID NO: 73491

SEQ ID NO: 688528 - RNA, 64 nt, hsa; identical to SEQ ID NO: 73492

SEQ ID NO: 688529 - RNA, 64 nt, hsa; identical to SEQ ID NO: 73493

SEQ ID NO: 688530 - RNA, 64 nt, hsa; identical to SEQ ID NO: 73494

SEQ ID NO: 688531 - RNA, 64 nt, hsa; identical to SEQ ID NO: 73495

SEQ ID NO: 688532 - RNA, 64 nt, hsa; identical to SEQ ID NO: 73496

SEQ ID NO: 688533 - RNA, 64 nt, hsa; identical to SEQ ID NO: 73497

SEQ ID NO: 688534 - RNA, 64 nt, hsa; identical to SEQ ID NO: 73498

SEQ ID NO: 688535 - RNA, 64 nt, hsa; identical to SEQ ID NO: 73499

SEQ ID NO: 688536 - RNA, 64 nt, hsa; identical to SEQ ID NO: 73500

SEQ ID NO: 688537 - RNA, 64 nt, hsa; identical to SEQ ID NO: 73501

SEQ ID NO: 688538 - RNA, 64 nt, hsa; identical to SEQ ID NO: 73502

SEQ ID NO: 688539 - RNA, 64 nt, hsa; identical to SEQ ID NO: 73503

SEQ ID NO: 688540 - RNA, 64 nt, hsa; identical to SEQ ID NO: 73504

SEQ ID NO: 688541 - RNA, 64 nt, hsa; identical to SEQ ID NO: 73505

SEQ ID NO: 688542 - RNA, 64 nt, hsa; identical to SEQ ID NO: 73506

SEQ ID NO: 688543 - RNA, 64 nt, hsa; identical to SEQ ID NO: 73507

SEQ ID NO: 688544 - RNA, 64 nt, hsa; identical to SEQ ID NO: 73508

SEQ ID NO: 688545 - RNA, 64 nt, hsa; identical to SEQ ID NO: 73509

SEQ ID NO: 688546 - RNA, 64 nt, hsa; identical to SEQ ID NO: 73510

SEQ ID NO: 688547 - RNA, 64 nt, hsa; identical to SEQ ID NO: 73511

SEQ ID NO: 688548 - RNA, 64 nt, hsa; identical to SEQ ID NO: 73512

SEQ ID NO: 688549 - RNA, 64 nt, hsa; identical to SEQ ID NO: 73513

SEQ ID NO: 688550 - RNA, 64 nt, hsa; identical to SEQ ID NO: 211561

SEQ ID NO: 688551 - RNA, 64 nt, hsa; identical to SEQ ID NO: 211562

SEQ ID NO: 688552 - RNA, 64 nt, hsa; identical to SEQ ID NO: 76474

SEQ ID NO: 688553 - RNA, 64 nt, hsa; identical to SEQ ID NO: 76475

SEQ ID NO: 688554 - RNA, 64 nt, hsa; identical to SEQ ID NO: 76476

SEQ ID NO: 688555 - RNA, 64 nt, hsa; identical to SEQ ID NO: 76477

SEQ ID NO: 688556 - RNA, 64 nt, hsa; identical to SEQ ID NO: 76478

SEQ ID NO: 688557 - RNA, 64 nt, hsa; identical to SEQ ID NO: 76479

SEQ ID NO: 688558 - RNA, 64 nt, hsa; identical to SEQ ID NO: 76480

SEQ ID NO: 688559 - RNA, 64 nt, hsa; identical to SEQ ID NO: 76481

SEQ ID NO: 688560 - RNA, 64 nt, hsa; identical to SEQ ID NO: 76482

SEQ ID NO: 688561 - RNA, 64 nt, hsa; identical to SEQ ID NO: 76483

SEQ ID NO: 688562 - RNA, 64 nt, hsa; identical to SEQ ID NO: 574716

SEQ ID NO: 688563 - RNA, 64 nt, hsa; identical to SEQ ID NO: 574717

SEQ ID NO: 688564 - RNA, 64 nt, hsa; identical to SEQ ID NO: 296599

SEQ ID NO: 688565 - RNA, 64 nt, hsa; identical to SEQ ID NO: 296600

SEQ ID NO: 688566 - RNA, 64 nt, hsa; identical to SEQ ID NO: 296601

SEQ ID NO: 688567 - RNA, 64 nt, hsa; identical to SEQ ID NO: 296602

SEQ ID NO: 688568 - RNA, 64 nt, hsa; identical to SEQ ID NO: 138992

SEQ ID NO: 688569 - RNA, 64 nt, hsa; identical to SEQ ID NO: 138993

SEQ ID NO: 688570 - RNA, 64 nt, hsa; identical to SEQ ID NO: 138994

SEQ ID NO: 688571 - RNA, 64 nt, hsa; identical to SEQ ID NO: 138995

SEQ ID NO: 688572 - RNA, 64 nt, hsa; identical to SEQ ID NO: 138996

SEQ ID NO: 688573 - RNA, 64 nt, hsa; identical to SEQ ID NO: 138997

SEQ ID NO: 688574 - RNA, 64 nt, hsa; identical to SEQ ID NO: 138998

SEQ ID NO: 688575 - RNA, 64 nt, hsa; identical to SEQ ID NO: 138999

SEQ ID NO: 688576 - RNA, 64 nt, hsa; identical to SEQ ID NO: 139000

SEQ ID NO: 688577 - RNA, 64 nt, hsa; identical to SEQ ID NO: 139001

SEQ ID NO: 688578 - RNA, 64 nt, hsa; identical to SEQ ID NO: 139002

SEQ ID NO: 688579 - RNA, 64 nt, hsa; identical to SEQ ID NO: 139003

SEQ ID NO: 688580 - RNA, 64 nt, hsa; identical to SEQ ID NO: 139004

SEQ ID NO: 688581 - RNA, 64 nt, hsa; identical to SEQ ID NO: 139005

SEQ ID NO: 688582 - RNA, 64 nt, hsa; identical to SEQ ID NO: 139006

SEQ ID NO: 688583 - RNA, 64 nt, hsa; identical to SEQ ID NO: 139007

SEQ ID NO: 688584 - RNA, 64 nt, hsa; identical to SEQ ID NO: 139008

SEQ ID NO: 688585 - RNA, 64 nt, hsa; identical to SEQ ID NO: 139009

SEQ ID NO: 688586 - RNA, 64 nt, hsa; identical to SEQ ID NO: 139010

SEQ ID NO: 688587 - RNA, 64 nt, hsa; identical to SEQ ID NO: 139011

SEQ ID NO: 688588 - RNA, 64 nt, hsa; identical to SEQ ID NO: 139012

SEQ ID NO: 688589 - RNA, 64 nt, hsa; identical to SEQ ID NO: 139013

SEQ ID NO: 688590 - RNA, 64 nt, hsa; identical to SEQ ID NO: 139014

SEQ ID NO: 688591 - RNA, 64 nt, hsa; identical to SEQ ID NO: 139015

SEQ ID NO: 688592 - RNA, 64 nt, hsa; identical to SEQ ID NO: 139016

SEQ ID NO: 688593 - RNA, 64 nt, hsa; identical to SEQ ID NO: 139017

SEQ ID NO: 688594 - RNA, 64 nt, hsa; identical to SEQ ID NO: 139018

SEQ ID NO: 688595 - RNA, 64 nt, hsa; identical to SEQ ID NO: 139019

SEQ ID NO: 688596 - RNA, 64 nt, hsa; identical to SEQ ID NO: 139020

SEQ ID NO: 688597 - RNA, 64 nt, hsa; identical to SEQ ID NO: 139021

SEQ ID NO: 688598 - RNA, 64 nt, hsa; identical to SEQ ID NO: 139022

SEQ ID NO: 688599 - RNA, 64 nt, hsa; identical to SEQ ID NO: 139023

SEQ ID NO: 688600 - RNA, 64 nt, hsa; identical to SEQ ID NO: 139024

SEQ ID NO: 688601 - RNA, 64 nt, hsa; identical to SEQ ID NO: 139025

SEQ ID NO: 688602 - RNA, 64 nt, hsa; identical to SEQ ID NO: 139026

SEQ ID NO: 688603 - RNA, 64 nt, hsa; identical to SEQ ID NO: 139027

SEQ ID NO: 688604 - RNA, 64 nt, hsa; identical to SEQ ID NO: 139028

SEQ ID NO: 688605 - RNA, 61 nt, hsa
uccaagacacagugaguaggagcucuguggaccaagacaaagcuggacuagagaguacagu

SEQ ID NO: 688606 - RNA, 61 nt, hsa
cccuucauucuguagacguguauugguugguccaagacacagugaguaggagcucugugga

SEQ ID NO: 688607 - RNA, 61 nt, hsa
acaucuuauuuggugucucaaagcuguauuuccaagacagugguacaaggugacccuuaau

SEQ ID NO: 688608 - RNA, 61 nt, hsa
uuucauucuucucucuuccugucaccuucugccaagacauugauggcuucugacaucuuau

SEQ ID NO: 688609 - RNA, 61 nt, hsa
cuugaaccugggaggcagaggcugcagugagccaagacaaugccacuacacuccagccugg

SEQ ID NO: 688610 - RNA, 61 nt, hsa
ucuccccuggaaaaccugcucacuucugaccccaagacagcccccuccccuucccucuguc

SEQ ID NO: 688611 - RNA, 64 nt, hsa
ugugauucauaccaacagaggacuuucugugauucauaccaacaguccuaaacugucauuuucu

SEQ ID NO: 688612 - RNA, 64 nt, hsa
uuuucacuguauauaaacgguacuuucugugauucauaccaacagaggacuuucugugauucau

SEQ ID NO: 688613 - RNA, 64 nt, hsa
gaaacagaagaaauuaaucuuuuaguuaguugaacauaccaaagcagaggacuggaaucuguuu

SEQ ID NO: 688614 - RNA, 64 nt, hsa
acuugaauaguaggauuuuaaagggcauugauagcauaccaaacaaaaggcaaaauaaagugac

SEQ ID NO: 688615 - RNA, 64 nt, hsa; identical to SEQ ID NO: 388850

SEQ ID NO: 688616 - RNA, 64 nt, hsa; identical to SEQ ID NO: 388851

SEQ ID NO: 688617 - RNA, 64 nt, hsa; identical to SEQ ID NO: 388852

SEQ ID NO: 688618 - RNA, 64 nt, hsa; identical to SEQ ID NO: 388853

SEQ ID NO: 688619 - RNA, 64 nt, hsa; identical to SEQ ID NO: 388854

SEQ ID NO: 688620 - RNA, 64 nt, hsa; identical to SEQ ID NO: 388855

SEQ ID NO: 688621 - RNA, 64 nt, hsa; identical to SEQ ID NO: 388856

SEQ ID NO: 688622 - RNA, 64 nt, hsa; identical to SEQ ID NO: 388857

SEQ ID NO: 688623 - RNA, 64 nt, hsa; identical to SEQ ID NO: 388858

SEQ ID NO: 688624 - RNA, 64 nt, hsa; identical to SEQ ID NO: 388859

SEQ ID NO: 688625 - RNA, 64 nt, hsa; identical to SEQ ID NO: 388860

SEQ ID NO: 688626 - RNA, 64 nt, hsa; identical to SEQ ID NO: 388861

SEQ ID NO: 688627 - RNA, 64 nt, hsa; identical to SEQ ID NO: 388862

SEQ ID NO: 688628 - RNA, 64 nt, hsa; identical to SEQ ID NO: 175595

SEQ ID NO: 688629 - RNA, 64 nt, hsa; identical to SEQ ID NO: 175596

SEQ ID NO: 688630 - RNA, 64 nt, hsa; identical to SEQ ID NO: 175597

SEQ ID NO: 688631 - RNA, 64 nt, hsa; identical to SEQ ID NO: 175598

SEQ ID NO: 688632 - RNA, 64 nt, hsa; identical to SEQ ID NO: 175599

SEQ ID NO: 688633 - RNA, 64 nt, hsa; identical to SEQ ID NO: 175600

SEQ ID NO: 688634 - RNA, 64 nt, hsa; identical to SEQ ID NO: 175601

SEQ ID NO: 688635 - RNA, 64 nt, hsa; identical to SEQ ID NO: 175602

SEQ ID NO: 688636 - RNA, 64 nt, hsa; identical to SEQ ID NO: 175603

SEQ ID NO: 688637 - RNA, 64 nt, hsa; identical to SEQ ID NO: 175604

SEQ ID NO: 688638 - RNA, 64 nt, hsa; identical to SEQ ID NO: 175605

SEQ ID NO: 688639 - RNA, 64 nt, hsa; identical to SEQ ID NO: 175606

SEQ ID NO: 688640 - RNA, 64 nt, hsa; identical to SEQ ID NO: 175607

SEQ ID NO: 688641 - RNA, 64 nt, hsa; identical to SEQ ID NO: 175608

SEQ ID NO: 688642 - RNA, 64 nt, hsa; identical to SEQ ID NO: 175609

SEQ ID NO: 688643 - RNA, 64 nt, hsa; identical to SEQ ID NO: 175610

SEQ ID NO: 688644 - RNA, 64 nt, hsa; identical to SEQ ID NO: 175611

SEQ ID NO: 688645 - RNA, 64 nt, hsa; identical to SEQ ID NO: 175612

SEQ ID NO: 688646 - RNA, 64 nt, hsa; identical to SEQ ID NO: 175613

SEQ ID NO: 688647 - RNA, 64 nt, hsa; identical to SEQ ID NO: 175614

SEQ ID NO: 688648 - RNA, 64 nt, hsa; identical to SEQ ID NO: 175615

SEQ ID NO: 688649 - RNA, 64 nt, hsa; identical to SEQ ID NO: 175616

SEQ ID NO: 688650 - RNA, 64 nt, hsa; identical to SEQ ID NO: 175617

SEQ ID NO: 688651 - RNA, 64 nt, hsa; identical to SEQ ID NO: 175618

SEQ ID NO: 688652 - RNA, 64 nt, hsa; identical to SEQ ID NO: 58312

SEQ ID NO: 688653 - RNA, 64 nt, hsa; identical to SEQ ID NO: 58313

SEQ ID NO: 688654 - RNA, 64 nt, hsa; identical to SEQ ID NO: 58314

SEQ ID NO: 688655 - RNA, 64 nt, hsa; identical to SEQ ID NO: 58315

SEQ ID NO: 688656 - RNA, 64 nt, hsa; identical to SEQ ID NO: 58316

SEQ ID NO: 688657 - RNA, 64 nt, hsa; identical to SEQ ID NO: 58317

SEQ ID NO: 688658 - RNA, 64 nt, hsa; identical to SEQ ID NO: 58318

SEQ ID NO: 688659 - RNA, 64 nt, hsa; identical to SEQ ID NO: 58319

SEQ ID NO: 688660 - RNA, 64 nt, hsa; identical to SEQ ID NO: 58320

SEQ ID NO: 688661 - RNA, 64 nt, hsa; identical to SEQ ID NO: 58321

SEQ ID NO: 688662 - RNA, 64 nt, hsa; identical to SEQ ID NO: 58322

SEQ ID NO: 688663 - RNA, 64 nt, hsa; identical to SEQ ID NO: 58323

SEQ ID NO: 688664 - RNA, 64 nt, hsa; identical to SEQ ID NO: 58324

SEQ ID NO: 688665 - RNA, 64 nt, hsa; identical to SEQ ID NO: 58325

SEQ ID NO: 688666 - RNA, 64 nt, hsa; identical to SEQ ID NO: 58326

SEQ ID NO: 688667 - RNA, 64 nt, hsa; identical to SEQ ID NO: 58327

SEQ ID NO: 688668 - RNA, 64 nt, hsa; identical to SEQ ID NO: 58328

SEQ ID NO: 688669 - RNA, 64 nt, hsa; identical to SEQ ID NO: 58329

SEQ ID NO: 688670 - RNA, 64 nt, hsa; identical to SEQ ID NO: 58330

SEQ ID NO: 688671 - RNA, 64 nt, hsa; identical to SEQ ID NO: 58331

SEQ ID NO: 688672 - RNA, 64 nt, hsa; identical to SEQ ID NO: 58332

SEQ ID NO: 688673 - RNA, 64 nt, hsa; identical to SEQ ID NO: 58333

SEQ ID NO: 688674 - RNA, 64 nt, hsa; identical to SEQ ID NO: 58334

SEQ ID NO: 688675 - RNA, 64 nt, hsa; identical to SEQ ID NO: 58335

SEQ ID NO: 688676 - RNA, 64 nt, hsa; identical to SEQ ID NO: 58336

SEQ ID NO: 688677 - RNA, 64 nt, hsa; identical to SEQ ID NO: 58337

SEQ ID NO: 688678 - RNA, 64 nt, hsa; identical to SEQ ID NO: 58338

SEQ ID NO: 688679 - RNA, 64 nt, hsa; identical to SEQ ID NO: 58339

SEQ ID NO: 688680 - RNA, 64 nt, hsa; identical to SEQ ID NO: 58340

SEQ ID NO: 688681 - RNA, 64 nt, hsa; identical to SEQ ID NO: 58341

SEQ ID NO: 688682 - RNA, 64 nt, hsa; identical to SEQ ID NO: 58342

SEQ ID NO: 688683 - RNA, 64 nt, hsa; identical to SEQ ID NO: 58343

SEQ ID NO: 688684 - RNA, 64 nt, hsa; identical to SEQ ID NO: 58344

SEQ ID NO: 688685 - RNA, 64 nt, hsa; identical to SEQ ID NO: 58345

SEQ ID NO: 688686 - RNA, 64 nt, hsa; identical to SEQ ID NO: 58346

SEQ ID NO: 688687 - RNA, 64 nt, hsa; identical to SEQ ID NO: 58347

SEQ ID NO: 688688 - RNA, 64 nt, hsa; identical to SEQ ID NO: 58348

SEQ ID NO: 688689 - RNA, 64 nt, hsa; identical to SEQ ID NO: 58349

SEQ ID NO: 688690 - RNA, 64 nt, hsa; identical to SEQ ID NO: 58350

SEQ ID NO: 688691 - RNA, 64 nt, hsa; identical to SEQ ID NO: 58351

SEQ ID NO: 688692 - RNA, 64 nt, hsa; identical to SEQ ID NO: 58352

SEQ ID NO: 688693 - RNA, 64 nt, hsa; identical to SEQ ID NO: 58353

SEQ ID NO: 688694 - RNA, 64 nt, hsa; identical to SEQ ID NO: 58354

SEQ ID NO: 688695 - RNA, 64 nt, hsa; identical to SEQ ID NO: 58355

SEQ ID NO: 688696 - RNA, 64 nt, hsa; identical to SEQ ID NO: 58356

SEQ ID NO: 688697 - RNA, 64 nt, hsa; identical to SEQ ID NO: 58357

SEQ ID NO: 688698 - RNA, 64 nt, hsa; identical to SEQ ID NO: 58358

SEQ ID NO: 688699 - RNA, 64 nt, hsa; identical to SEQ ID NO: 58359

SEQ ID NO: 688700 - RNA, 64 nt, hsa; identical to SEQ ID NO: 58360

SEQ ID NO: 688701 - RNA, 64 nt, hsa; identical to SEQ ID NO: 58361

SEQ ID NO: 688702 - RNA, 64 nt, hsa; identical to SEQ ID NO: 58362

SEQ ID NO: 688703 - RNA, 64 nt, hsa; identical to SEQ ID NO: 58363

SEQ ID NO: 688704 - RNA, 64 nt, hsa; identical to SEQ ID NO: 58364

SEQ ID NO: 688705 - RNA, 64 nt, hsa; identical to SEQ ID NO: 58365

SEQ ID NO: 688706 - RNA, 64 nt, hsa; identical to SEQ ID NO: 58366

SEQ ID NO: 688707 - RNA, 64 nt, hsa; identical to SEQ ID NO: 58367

SEQ ID NO: 688708 - RNA, 64 nt, hsa; identical to SEQ ID NO: 58368

SEQ ID NO: 688709 - RNA, 64 nt, hsa; identical to SEQ ID NO: 58369

SEQ ID NO: 688710 - RNA, 64 nt, hsa; identical to SEQ ID NO: 58370

SEQ ID NO: 688711 - RNA, 64 nt, hsa; identical to SEQ ID NO: 58371

SEQ ID NO: 688712 - RNA, 64 nt, hsa; identical to SEQ ID NO: 58372

SEQ ID NO: 688713 - RNA, 64 nt, hsa; identical to SEQ ID NO: 58373

SEQ ID NO: 688714 - RNA, 64 nt, hsa; identical to SEQ ID NO: 58374

SEQ ID NO: 688715 - RNA, 64 nt, hsa; identical to SEQ ID NO: 58375

SEQ ID NO: 688716 - RNA, 64 nt, hsa; identical to SEQ ID NO: 58376

SEQ ID NO: 688717 - RNA, 64 nt, hsa; identical to SEQ ID NO: 58377

SEQ ID NO: 688718 - RNA, 64 nt, hsa; identical to SEQ ID NO: 58378

SEQ ID NO: 688719 - RNA, 64 nt, hsa; identical to SEQ ID NO: 58379

SEQ ID NO: 688720 - RNA, 64 nt, hsa; identical to SEQ ID NO: 58380

SEQ ID NO: 688721 - RNA, 64 nt, hsa; identical to SEQ ID NO: 58381

SEQ ID NO: 688722 - RNA, 64 nt, hsa; identical to SEQ ID NO: 58382

SEQ ID NO: 688723 - RNA, 64 nt, hsa; identical to SEQ ID NO: 58383

SEQ ID NO: 688724 - RNA, 64 nt, hsa; identical to SEQ ID NO: 58384

SEQ ID NO: 688725 - RNA, 64 nt, hsa; identical to SEQ ID NO: 58385

SEQ ID NO: 688726 - RNA, 64 nt, hsa; identical to SEQ ID NO: 58386

SEQ ID NO: 688727 - RNA, 64 nt, hsa; identical to SEQ ID NO: 58387

SEQ ID NO: 688728 - RNA, 64 nt, hsa; identical to SEQ ID NO: 58388

SEQ ID NO: 688729 - RNA, 64 nt, hsa; identical to SEQ ID NO: 58389

SEQ ID NO: 688730 - RNA, 64 nt, hsa; identical to SEQ ID NO: 58390

SEQ ID NO: 688731 - RNA, 64 nt, hsa; identical to SEQ ID NO: 58391

SEQ ID NO: 688732 - RNA, 64 nt, hsa; identical to SEQ ID NO: 58392

SEQ ID NO: 688733 - RNA, 64 nt, hsa; identical to SEQ ID NO: 58393

SEQ ID NO: 688734 - RNA, 64 nt, hsa; identical to SEQ ID NO: 58394

SEQ ID NO: 688735 - RNA, 64 nt, hsa; identical to SEQ ID NO: 58395

SEQ ID NO: 688736 - RNA, 64 nt, hsa; identical to SEQ ID NO: 58396

SEQ ID NO: 688737 - RNA, 64 nt, hsa; identical to SEQ ID NO: 58397

SEQ ID NO: 688738 - RNA, 64 nt, hsa; identical to SEQ ID NO: 58398

SEQ ID NO: 688739 - RNA, 64 nt, hsa; identical to SEQ ID NO: 58399

SEQ ID NO: 688740 - RNA, 64 nt, hsa; identical to SEQ ID NO: 58400

SEQ ID NO: 688741 - RNA, 64 nt, hsa; identical to SEQ ID NO: 58401

SEQ ID NO: 688742 - RNA, 64 nt, hsa; identical to SEQ ID NO: 58402

SEQ ID NO: 688743 - RNA, 64 nt, hsa; identical to SEQ ID NO: 58403

SEQ ID NO: 688744 - RNA, 64 nt, hsa; identical to SEQ ID NO: 58404

SEQ ID NO: 688745 - RNA, 64 nt, hsa; identical to SEQ ID NO: 58405

SEQ ID NO: 688746 - RNA, 64 nt, hsa; identical to SEQ ID NO: 58406

SEQ ID NO: 688747 - RNA, 64 nt, hsa; identical to SEQ ID NO: 58407

SEQ ID NO: 688748 - RNA, 64 nt, hsa; identical to SEQ ID NO: 58408

SEQ ID NO: 688749 - RNA, 64 nt, hsa; identical to SEQ ID NO: 58409

SEQ ID NO: 688750 - RNA, 64 nt, hsa; identical to SEQ ID NO: 58410

SEQ ID NO: 688751 - RNA, 64 nt, hsa; identical to SEQ ID NO: 58411

SEQ ID NO: 688752 - RNA, 64 nt, hsa; identical to SEQ ID NO: 58412

SEQ ID NO: 688753 - RNA, 64 nt, hsa; identical to SEQ ID NO: 58413

SEQ ID NO: 688754 - RNA, 64 nt, hsa; identical to SEQ ID NO: 58414

SEQ ID NO: 688755 - RNA, 64 nt, hsa; identical to SEQ ID NO: 58415

SEQ ID NO: 688756 - RNA, 64 nt, hsa; identical to SEQ ID NO: 58416

SEQ ID NO: 688757 - RNA, 64 nt, hsa; identical to SEQ ID NO: 58417

SEQ ID NO: 688758 - RNA, 64 nt, hsa; identical to SEQ ID NO: 58418

SEQ ID NO: 688759 - RNA, 64 nt, hsa; identical to SEQ ID NO: 58419

SEQ ID NO: 688760 - RNA, 64 nt, hsa; identical to SEQ ID NO: 58420

SEQ ID NO: 688761 - RNA, 64 nt, hsa; identical to SEQ ID NO: 58421

SEQ ID NO: 688762 - RNA, 64 nt, hsa; identical to SEQ ID NO: 58422

SEQ ID NO: 688763 - RNA, 64 nt, hsa; identical to SEQ ID NO: 58423

SEQ ID NO: 688764 - RNA, 64 nt, hsa; identical to SEQ ID NO: 58424

SEQ ID NO: 688765 - RNA, 64 nt, hsa; identical to SEQ ID NO: 58425

SEQ ID NO: 688766 - RNA, 64 nt, hsa; identical to SEQ ID NO: 58426

SEQ ID NO: 688767 - RNA, 64 nt, hsa; identical to SEQ ID NO: 58427

SEQ ID NO: 688768 - RNA, 64 nt, hsa; identical to SEQ ID NO: 58428

SEQ ID NO: 688769 - RNA, 64 nt, hsa; identical to SEQ ID NO: 58429

SEQ ID NO: 688770 - RNA, 64 nt, hsa; identical to SEQ ID NO: 58430

SEQ ID NO: 688771 - RNA, 64 nt, hsa; identical to SEQ ID NO: 58431

SEQ ID NO: 688772 - RNA, 64 nt, hsa; identical to SEQ ID NO: 58432

SEQ ID NO: 688773 - RNA, 64 nt, hsa; identical to SEQ ID NO: 58433

SEQ ID NO: 688774 - RNA, 64 nt, hsa; identical to SEQ ID NO: 58434

SEQ ID NO: 688775 - RNA, 64 nt, hsa; identical to SEQ ID NO: 58435

SEQ ID NO: 688776 - RNA, 50 nt, hsa; identical to SEQ ID NO: 58436

SEQ ID NO: 688777 - RNA, 64 nt, hsa; identical to SEQ ID NO: 58437

SEQ ID NO: 688778 - RNA, 64 nt, hsa; identical to SEQ ID NO: 58438

SEQ ID NO: 688779 - RNA, 64 nt, hsa; identical to SEQ ID NO: 58439

SEQ ID NO: 688780 - RNA, 64 nt, hsa; identical to SEQ ID NO: 58440

SEQ ID NO: 688781 - RNA, 64 nt, hsa; identical to SEQ ID NO: 58441

SEQ ID NO: 688782 - RNA, 64 nt, hsa; identical to SEQ ID NO: 58442

SEQ ID NO: 688783 - RNA, 64 nt, hsa; identical to SEQ ID NO: 58443

SEQ ID NO: 688784 - RNA, 64 nt, hsa; identical to SEQ ID NO: 58444

SEQ ID NO: 688785 - RNA, 64 nt, hsa; identical to SEQ ID NO: 58445

SEQ ID NO: 688786 - RNA, 64 nt, hsa; identical to SEQ ID NO: 58446

SEQ ID NO: 688787 - RNA, 64 nt, hsa; identical to SEQ ID NO: 58447

SEQ ID NO: 688788 - RNA, 64 nt, hsa; identical to SEQ ID NO: 58448

SEQ ID NO: 688789 - RNA, 64 nt, hsa; identical to SEQ ID NO: 58449

SEQ ID NO: 688790 - RNA, 64 nt, hsa; identical to SEQ ID NO: 58450

SEQ ID NO: 688791 - RNA, 64 nt, hsa; identical to SEQ ID NO: 58451

SEQ ID NO: 688792 - RNA, 64 nt, hsa; identical to SEQ ID NO: 58452

SEQ ID NO: 688793 - RNA, 64 nt, hsa; identical to SEQ ID NO: 58453

SEQ ID NO: 688794 - RNA, 64 nt, hsa; identical to SEQ ID NO: 58454

SEQ ID NO: 688795 - RNA, 64 nt, hsa; identical to SEQ ID NO: 58455

SEQ ID NO: 688796 - RNA, 64 nt, hsa; identical to SEQ ID NO: 58456

SEQ ID NO: 688797 - RNA, 64 nt, hsa; identical to SEQ ID NO: 58457

SEQ ID NO: 688798 - RNA, 64 nt, hsa; identical to SEQ ID NO: 58458

SEQ ID NO: 688799 - RNA, 64 nt, hsa; identical to SEQ ID NO: 58459

SEQ ID NO: 688800 - RNA, 64 nt, hsa; identical to SEQ ID NO: 58460

SEQ ID NO: 688801 - RNA, 64 nt, hsa; identical to SEQ ID NO: 58461

SEQ ID NO: 688802 - RNA, 64 nt, hsa; identical to SEQ ID NO: 58462

SEQ ID NO: 688803 - RNA, 64 nt, hsa; identical to SEQ ID NO: 58463

SEQ ID NO: 688804 - RNA, 64 nt, hsa; identical to SEQ ID NO: 58464

SEQ ID NO: 688805 - RNA, 64 nt, hsa; identical to SEQ ID NO: 58465

SEQ ID NO: 688806 - RNA, 64 nt, hsa; identical to SEQ ID NO: 58466

SEQ ID NO: 688807 - RNA, 64 nt, hsa; identical to SEQ ID NO: 58467

SEQ ID NO: 688808 - RNA, 64 nt, hsa; identical to SEQ ID NO: 175573

SEQ ID NO: 688809 - RNA, 64 nt, hsa; identical to SEQ ID NO: 175574

SEQ ID NO: 688810 - RNA, 64 nt, hsa; identical to SEQ ID NO: 476783

SEQ ID NO: 688811 - RNA, 64 nt, hsa; identical to SEQ ID NO: 476784

SEQ ID NO: 688812 - RNA, 64 nt, hsa; identical to SEQ ID NO: 476785

SEQ ID NO: 688813 - RNA, 64 nt, hsa; identical to SEQ ID NO: 476786

SEQ ID NO: 688814 - RNA, 64 nt, hsa; identical to SEQ ID NO: 476787

SEQ ID NO: 688815 - RNA, 64 nt, hsa; identical to SEQ ID NO: 476788

SEQ ID NO: 688816 - RNA, 64 nt, hsa; identical to SEQ ID NO: 476789

SEQ ID NO: 688817 - RNA, 64 nt, hsa; identical to SEQ ID NO: 476789

SEQ ID NO: 688818 - RNA, 64 nt, hsa; identical to SEQ ID NO: 354586

SEQ ID NO: 688819 - RNA, 64 nt, hsa; identical to SEQ ID NO: 354587

SEQ ID NO: 688820 - RNA, 64 nt, hsa; identical to SEQ ID NO: 354588

SEQ ID NO: 688821 - RNA, 64 nt, hsa; identical to SEQ ID NO: 354589

SEQ ID NO: 688822 - RNA, 64 nt, hsa; identical to SEQ ID NO: 354590

SEQ ID NO: 688823 - RNA, 64 nt, hsa; identical to SEQ ID NO: 354591

SEQ ID NO: 688824 - RNA, 61 nt, hsa; identical to SEQ ID NO: 354592

SEQ ID NO: 688825 - RNA, 64 nt, hsa; identical to SEQ ID NO: 354593

SEQ ID NO: 688826 - RNA, 64 nt, hsa; identical to SEQ ID NO: 354594

SEQ ID NO: 688827 - RNA, 64 nt, hsa; identical to SEQ ID NO: 354595

SEQ ID NO: 688828 - RNA, 64 nt, hsa; identical to SEQ ID NO: 354596

SEQ ID NO: 688829 - RNA, 64 nt, hsa; identical to SEQ ID NO: 354597

SEQ ID NO: 688830 - RNA, 64 nt, hsa; identical to SEQ ID NO: 354598

SEQ ID NO: 688831 - RNA, 64 nt, hsa; identical to SEQ ID NO: 354599

SEQ ID NO: 688832 - RNA, 64 nt, hsa; identical to SEQ ID NO: 354600

SEQ ID NO: 688833 - RNA, 64 nt, hsa; identical to SEQ ID NO: 354601

SEQ ID NO: 688834 - RNA, 64 nt, hsa; identical to SEQ ID NO: 354602

SEQ ID NO: 688835 - RNA, 64 nt, hsa; identical to SEQ ID NO: 354603

SEQ ID NO: 688836 - RNA, 64 nt, hsa; identical to SEQ ID NO: 354604

SEQ ID NO: 688837 - RNA, 64 nt, hsa; identical to SEQ ID NO: 354605

SEQ ID NO: 688838 - RNA, 64 nt, hsa; identical to SEQ ID NO: 354606

SEQ ID NO: 688839 - RNA, 64 nt, hsa; identical to SEQ ID NO: 354607

SEQ ID NO: 688840 - RNA, 64 nt, hsa; identical to SEQ ID NO: 354608

SEQ ID NO: 688841 - RNA, 64 nt, hsa; identical to SEQ ID NO: 354609

SEQ ID NO: 688842 - RNA, 64 nt, hsa; identical to SEQ ID NO: 354610

SEQ ID NO: 688843 - RNA, 64 nt, hsa; identical to SEQ ID NO: 354611

SEQ ID NO: 688844 - RNA, 64 nt, hsa; identical to SEQ ID NO: 354612

SEQ ID NO: 688845 - RNA, 64 nt, hsa; identical to SEQ ID NO: 354613

SEQ ID NO: 688846 - RNA, 64 nt, hsa; identical to SEQ ID NO: 354614

SEQ ID NO: 688847 - RNA, 64 nt, hsa; identical to SEQ ID NO: 354615

SEQ ID NO: 688848 - RNA, 64 nt, hsa; identical to SEQ ID NO: 354616

SEQ ID NO: 688849 - RNA, 64 nt, hsa; identical to SEQ ID NO: 354617

SEQ ID NO: 688850 - RNA, 64 nt, hsa; identical to SEQ ID NO: 354618

SEQ ID NO: 688851 - RNA, 64 nt, hsa; identical to SEQ ID NO: 354619

SEQ ID NO: 688852 - RNA, 64 nt, hsa; identical to SEQ ID NO: 354620

SEQ ID NO: 688853 - RNA, 64 nt, hsa; identical to SEQ ID NO: 354621

SEQ ID NO: 688854 - RNA, 64 nt, hsa; identical to SEQ ID NO: 354622

SEQ ID NO: 688855 - RNA, 64 nt, hsa; identical to SEQ ID NO: 354623

SEQ ID NO: 688856 - RNA, 64 nt, hsa; identical to SEQ ID NO: 354624

SEQ ID NO: 688857 - RNA, 64 nt, hsa; identical to SEQ ID NO: 354625

SEQ ID NO: 688858 - RNA, 64 nt, hsa; identical to SEQ ID NO: 244872

SEQ ID NO: 688859 - RNA, 64 nt, hsa; identical to SEQ ID NO: 244873

SEQ ID NO: 688860 - RNA, 64 nt, hsa; identical to SEQ ID NO: 244874

SEQ ID NO: 688861 - RNA, 64 nt, hsa; identical to SEQ ID NO: 244875

SEQ ID NO: 688862 - RNA, 64 nt, hsa; identical to SEQ ID NO: 244876

SEQ ID NO: 688863 - RNA, 64 nt, hsa; identical to SEQ ID NO: 244877

SEQ ID NO: 688864 - RNA, 64 nt, hsa; identical to SEQ ID NO: 244878

SEQ ID NO: 688865 - RNA, 64 nt, hsa; identical to SEQ ID NO: 244879

SEQ ID NO: 688866 - RNA, 64 nt, hsa; identical to SEQ ID NO: 244880

SEQ ID NO: 688867 - RNA, 64 nt, hsa; identical to SEQ ID NO: 244881

SEQ ID NO: 688868 - RNA, 64 nt, hsa; identical to SEQ ID NO: 244882

SEQ ID NO: 688869 - RNA, 64 nt, hsa; identical to SEQ ID NO: 244883

SEQ ID NO: 688870 - RNA, 64 nt, hsa; identical to SEQ ID NO: 244884

SEQ ID NO: 688871 - RNA, 64 nt, hsa; identical to SEQ ID NO: 244885

SEQ ID NO: 688872 - RNA, 64 nt, hsa; identical to SEQ ID NO: 244886

SEQ ID NO: 688873 - RNA, 64 nt, hsa; identical to SEQ ID NO: 244887

SEQ ID NO: 688874 - RNA, 64 nt, hsa; identical to SEQ ID NO: 244888

SEQ ID NO: 688875 - RNA, 64 nt, hsa; identical to SEQ ID NO: 244889

SEQ ID NO: 688876 - RNA, 64 nt, hsa; identical to SEQ ID NO: 244890

SEQ ID NO: 688877 - RNA, 64 nt, hsa; identical to SEQ ID NO: 244891

SEQ ID NO: 688878 - RNA, 64 nt, hsa; identical to SEQ ID NO: 244892

SEQ ID NO: 688879 - RNA, 64 nt, hsa; identical to SEQ ID NO: 244893

SEQ ID NO: 688880 - RNA, 64 nt, hsa; identical to SEQ ID NO: 244894

SEQ ID NO: 688881 - RNA, 64 nt, hsa; identical to SEQ ID NO: 244895

SEQ ID NO: 688882 - RNA, 64 nt, hsa; identical to SEQ ID NO: 244896

SEQ ID NO: 688883 - RNA, 64 nt, hsa; identical to SEQ ID NO: 244897

SEQ ID NO: 688884 - RNA, 64 nt, hsa; identical to SEQ ID NO: 244898

SEQ ID NO: 688885 - RNA, 64 nt, hsa; identical to SEQ ID NO: 244899

SEQ ID NO: 688886 - RNA, 64 nt, hsa; identical to SEQ ID NO: 244900

SEQ ID NO: 688887 - RNA, 64 nt, hsa; identical to SEQ ID NO: 244901

SEQ ID NO: 688888 - RNA, 64 nt, hsa; identical to SEQ ID NO: 244902

SEQ ID NO: 688889 - RNA, 64 nt, hsa; identical to SEQ ID NO: 244903

SEQ ID NO: 688890 - RNA, 64 nt, hsa; identical to SEQ ID NO: 244904

SEQ ID NO: 688891 - RNA, 64 nt, hsa; identical to SEQ ID NO: 244905

SEQ ID NO: 688892 - RNA, 64 nt, hsa; identical to SEQ ID NO: 244906

SEQ ID NO: 688893 - RNA, 64 nt, hsa; identical to SEQ ID NO: 244907

SEQ ID NO: 688894 - RNA, 64 nt, hsa; identical to SEQ ID NO: 244908

SEQ ID NO: 688895 - RNA, 64 nt, hsa
uucaucaauaaucauauaauuucacuauagacauuacuugcauuaucuccuaucaguccuucua

SEQ ID NO: 688896 - RNA, 64 nt, hsa
auauaugguagcuauuguuuaaaaaugauugauuuacuugcagauuuuucagaggauguuaugu

SEQ ID NO: 688897 - RNA, 64 nt, hsa
uguuugccaucuguugaucaggaacuacuucagcuacuugcauuugauuauuuccuuuuuuuuu

SEQ ID NO: 688898 - RNA, 64 nt, hsa
ugcuacacuggauaaaaaucuaauuuaugaauuuuacuugcaccuuauaguucauagcaauuaa

SEQ ID NO: 688899 - RNA, 64 nt, hsa
ccuuucauuaggcaaaguacaaaauugccuauaauacuugcaacuaaggacaaauuagcaugca

SEQ ID NO: 688900 - RNA, 64 nt, hsa
ugagaaaaaaaaaaugaaucuauuuaaucauuucuacuugcaguacugcuaugugcuaagcuua

SEQ ID NO: 688901 - RNA, 64 nt, hsa; identical to SEQ ID NO: 452644

SEQ ID NO: 688902 - RNA, 64 nt, hsa; identical to SEQ ID NO: 452645

SEQ ID NO: 688903 - RNA, 64 nt, hsa; identical to SEQ ID NO: 452646

SEQ ID NO: 688904 - RNA, 64 nt, hsa; identical to SEQ ID NO: 452647

SEQ ID NO: 688905 - RNA, 64 nt, hsa; identical to SEQ ID NO: 452648

SEQ ID NO: 688906 - RNA, 64 nt, hsa; identical to SEQ ID NO: 452649

SEQ ID NO: 688907 - RNA, 64 nt, hsa; identical to SEQ ID NO: 452650

SEQ ID NO: 688908 - RNA, 64 nt, hsa; identical to SEQ ID NO: 452651

SEQ ID NO: 688909 - RNA, 64 nt, hsa; identical to SEQ ID NO: 452652

SEQ ID NO: 688910 - RNA, 64 nt, hsa; identical to SEQ ID NO: 452653

SEQ ID NO: 688911 - RNA, 64 nt, hsa; identical to SEQ ID NO: 452654

SEQ ID NO: 688912 - RNA, 62 nt, hsa; identical to SEQ ID NO: 452655

SEQ ID NO: 688913 - RNA, 64 nt, hsa; identical to SEQ ID NO: 452656

SEQ ID NO: 688914 - RNA, 64 nt, hsa; identical to SEQ ID NO: 452657

SEQ ID NO: 688915 - RNA, 64 nt, hsa; identical to SEQ ID NO: 452658

SEQ ID NO: 688916 - RNA, 64 nt, hsa; identical to SEQ ID NO: 452659

SEQ ID NO: 688917 - RNA, 64 nt, hsa; identical to SEQ ID NO: 452660

SEQ ID NO: 688918 - RNA, 64 nt, hsa; identical to SEQ ID NO: 452661

SEQ ID NO: 688919 - RNA, 64 nt, hsa; identical to SEQ ID NO: 452662

SEQ ID NO: 688920 - RNA, 64 nt, hsa; identical to SEQ ID NO: 452663

SEQ ID NO: 688921 - RNA, 64 nt, hsa; identical to SEQ ID NO: 452663

SEQ ID NO: 688922 - RNA, 64 nt, hsa; identical to SEQ ID NO: 452665

SEQ ID NO: 688923 - RNA, 64 nt, hsa; identical to SEQ ID NO: 452666

SEQ ID NO: 688924 - RNA, 64 nt, hsa; identical to SEQ ID NO: 247175

SEQ ID NO: 688925 - RNA, 64 nt, hsa; identical to SEQ ID NO: 247176

SEQ ID NO: 688926 - RNA, 64 nt, hsa; identical to SEQ ID NO: 247177

SEQ ID NO: 688927 - RNA, 64 nt, hsa; identical to SEQ ID NO: 247178

SEQ ID NO: 688928 - RNA, 64 nt, hsa; identical to SEQ ID NO: 247179

SEQ ID NO: 688929 - RNA, 64 nt, hsa; identical to SEQ ID NO: 247180

SEQ ID NO: 688930 - RNA, 64 nt, hsa; identical to SEQ ID NO: 247181

SEQ ID NO: 688931 - RNA, 64 nt, hsa; identical to SEQ ID NO: 247182

SEQ ID NO: 688932 - RNA, 64 nt, hsa; identical to SEQ ID NO: 247183

SEQ ID NO: 688933 - RNA, 64 nt, hsa; identical to SEQ ID NO: 247184

SEQ ID NO: 688934 - RNA, 64 nt, hsa; identical to SEQ ID NO: 247185

SEQ ID NO: 688935 - RNA, 64 nt, hsa; identical to SEQ ID NO: 247186

SEQ ID NO: 688936 - RNA, 64 nt, hsa; identical to SEQ ID NO: 247187

SEQ ID NO: 688937 - RNA, 64 nt, hsa; identical to SEQ ID NO: 247188

SEQ ID NO: 688938 - RNA, 64 nt, hsa; identical to SEQ ID NO: 247189

SEQ ID NO: 688939 - RNA, 64 nt, hsa; identical to SEQ ID NO: 247190

SEQ ID NO: 688940 - RNA, 64 nt, hsa; identical to SEQ ID NO: 247191

SEQ ID NO: 688941 - RNA, 64 nt, hsa; identical to SEQ ID NO: 247192

SEQ ID NO: 688942 - RNA, 64 nt, hsa; identical to SEQ ID NO: 247193

SEQ ID NO: 688943 - RNA, 64 nt, hsa; identical to SEQ ID NO: 247194

SEQ ID NO: 688944 - RNA, 64 nt, hsa; identical to SEQ ID NO: 247195

SEQ ID NO: 688945 - RNA, 64 nt, hsa; identical to SEQ ID NO: 247196

SEQ ID NO: 688946 - RNA, 64 nt, hsa; identical to SEQ ID NO: 247197

SEQ ID NO: 688947 - RNA, 64 nt, hsa; identical to SEQ ID NO: 247198

SEQ ID NO: 688948 - RNA, 64 nt, hsa; identical to SEQ ID NO: 247199

SEQ ID NO: 688949 - RNA, 64 nt, hsa; identical to SEQ ID NO: 247200

SEQ ID NO: 688950 - RNA, 64 nt, hsa; identical to SEQ ID NO: 247201

SEQ ID NO: 688951 - RNA, 61 nt, hsa; identical to SEQ ID NO: 247202

SEQ ID NO: 688952 - RNA, 64 nt, hsa; identical to SEQ ID NO: 247203

SEQ ID NO: 688953 - RNA, 64 nt, hsa; identical to SEQ ID NO: 247204

SEQ ID NO: 688954 - RNA, 64 nt, hsa; identical to SEQ ID NO: 247205

SEQ ID NO: 688955 - RNA, 64 nt, hsa; identical to SEQ ID NO: 247206

SEQ ID NO: 688956 - RNA, 64 nt, hsa; identical to SEQ ID NO: 247207

SEQ ID NO: 688957 - RNA, 64 nt, hsa; identical to SEQ ID NO: 247208

SEQ ID NO: 688958 - RNA, 64 nt, hsa; identical to SEQ ID NO: 247209

SEQ ID NO: 688959 - RNA, 64 nt, hsa; identical to SEQ ID NO: 247210

SEQ ID NO: 688960 - RNA, 64 nt, hsa; identical to SEQ ID NO: 247211

SEQ ID NO: 688961 - RNA, 64 nt, hsa; identical to SEQ ID NO: 247212

SEQ ID NO: 688962 - RNA, 64 nt, hsa; identical to SEQ ID NO: 247213

SEQ ID NO: 688963 - RNA, 64 nt, hsa; identical to SEQ ID NO: 247214

SEQ ID NO: 688964 - RNA, 64 nt, hsa; identical to SEQ ID NO: 247215

SEQ ID NO: 688965 - RNA, 64 nt, hsa; identical to SEQ ID NO: 247216

SEQ ID NO: 688966 - RNA, 64 nt, hsa; identical to SEQ ID NO: 247217

SEQ ID NO: 688967 - RNA, 64 nt, hsa; identical to SEQ ID NO: 247218

SEQ ID NO: 688968 - RNA, 64 nt, hsa; identical to SEQ ID NO: 247219

SEQ ID NO: 688969 - RNA, 64 nt, hsa; identical to SEQ ID NO: 247220

SEQ ID NO: 688970 - RNA, 64 nt, hsa; identical to SEQ ID NO: 247221

SEQ ID NO: 688971 - RNA, 64 nt, hsa; identical to SEQ ID NO: 247222

SEQ ID NO: 688972 - RNA, 64 nt, hsa; identical to SEQ ID NO: 247223

SEQ ID NO: 688973 - RNA, 64 nt, hsa; identical to SEQ ID NO: 247224

SEQ ID NO: 688974 - RNA, 64 nt, hsa; identical to SEQ ID NO: 247225

SEQ ID NO: 688975 - RNA, 64 nt, hsa; identical to SEQ ID NO: 247226

SEQ ID NO: 688976 - RNA, 64 nt, hsa; identical to SEQ ID NO: 247227

SEQ ID NO: 688977 - RNA, 64 nt, hsa; identical to SEQ ID NO: 247228

SEQ ID NO: 688978 - RNA, 64 nt, hsa; identical to SEQ ID NO: 247229

SEQ ID NO: 688979 - RNA, 64 nt, hsa; identical to SEQ ID NO: 247230

SEQ ID NO: 688980 - RNA, 64 nt, hsa; identical to SEQ ID NO: 247231

SEQ ID NO: 688981 - RNA, 64 nt, hsa; identical to SEQ ID NO: 247232

SEQ ID NO: 688982 - RNA, 64 nt, hsa; identical to SEQ ID NO: 247233

SEQ ID NO: 688983 - RNA, 64 nt, hsa; identical to SEQ ID NO: 247234

SEQ ID NO: 688984 - RNA, 64 nt, hsa; identical to SEQ ID NO: 247235

SEQ ID NO: 688985 - RNA, 64 nt, hsa; identical to SEQ ID NO: 247236

SEQ ID NO: 688986 - RNA, 64 nt, hsa; identical to SEQ ID NO: 247237

SEQ ID NO: 688987 - RNA, 64 nt, hsa; identical to SEQ ID NO: 247238

SEQ ID NO: 688988 - RNA, 64 nt, hsa; identical to SEQ ID NO: 247239

SEQ ID NO: 688989 - RNA, 64 nt, hsa; identical to SEQ ID NO: 247240

SEQ ID NO: 688990 - RNA, 64 nt, hsa; identical to SEQ ID NO: 247241

SEQ ID NO: 688991 - RNA, 64 nt, hsa; identical to SEQ ID NO: 247242

SEQ ID NO: 688992 - RNA, 64 nt, hsa; identical to SEQ ID NO: 247243

SEQ ID NO: 688993 - RNA, 64 nt, hsa; identical to SEQ ID NO: 247244

SEQ ID NO: 688994 - RNA, 64 nt, hsa; identical to SEQ ID NO: 247245

SEQ ID NO: 688995 - RNA, 64 nt, hsa; identical to SEQ ID NO: 247246

SEQ ID NO: 688996 - RNA, 64 nt, hsa; identical to SEQ ID NO: 247247

SEQ ID NO: 688997 - RNA, 64 nt, hsa; identical to SEQ ID NO: 247248

SEQ ID NO: 688998 - RNA, 64 nt, hsa; identical to SEQ ID NO: 247249

SEQ ID NO: 688999 - RNA, 64 nt, hsa; identical to SEQ ID NO: 247250

SEQ ID NO: 689000 - RNA, 64 nt, hsa; identical to SEQ ID NO: 247251

SEQ ID NO: 689001 - RNA, 64 nt, hsa; identical to SEQ ID NO: 247252

SEQ ID NO: 689002 - RNA, 64 nt, hsa
augaucuauauuaauguuuaguuauuuuugguugagugcuaaauauuucagaaggcuacuuaac

SEQ ID NO: 689003 - RNA, 64 nt, hsa
cauuucacuucagaagcacuuguaggucuuuacuagugcuaaguauuauggugagcuaucauua

SEQ ID NO: 689004 - RNA, 64 nt, hsa
ccccucgccccuauauucauccaggauacuuggaagugcuaaaauaggaagggauucggcuuuc

SEQ ID NO: 689005 - RNA, 64 nt, hsa
gucuucagaacucuuggaaaucuuuacacaugcgagugcuaaccacuuugagcaaggcugccuu

SEQ ID NO: 689006 - RNA, 64 nt, hsa
caguuauuauuagaguugcagaauagaaacuugaagugcuaaauggaauaauccaaaggaaauu

SEQ ID NO: 689007 - RNA, 64 nt, hsa
guauaucaccaaauuuuuaaaaagugauagucacagugcuaaguuaucuaguuggcuacuauua

SEQ ID NO: 689008 - RNA, 64 nt, hsa; identical to SEQ ID NO: 168425

SEQ ID NO: 689009 - RNA, 64 nt, hsa; identical to SEQ ID NO: 168426

SEQ ID NO: 689010 - RNA, 64 nt, hsa; identical to SEQ ID NO: 168427

SEQ ID NO: 689011 - RNA, 64 nt, hsa; identical to SEQ ID NO: 168428

SEQ ID NO: 689012 - RNA, 64 nt, hsa; identical to SEQ ID NO: 168429

SEQ ID NO: 689013 - RNA, 64 nt, hsa; identical to SEQ ID NO: 168430

SEQ ID NO: 689014 - RNA, 64 nt, hsa; identical to SEQ ID NO: 168431

SEQ ID NO: 689015 - RNA, 64 nt, hsa; identical to SEQ ID NO: 168432

SEQ ID NO: 689016 - RNA, 64 nt, hsa; identical to SEQ ID NO: 168433

SEQ ID NO: 689017 - RNA, 64 nt, hsa; identical to SEQ ID NO: 168434

SEQ ID NO: 689018 - RNA, 64 nt, hsa; identical to SEQ ID NO: 168435

SEQ ID NO: 689019 - RNA, 64 nt, hsa; identical to SEQ ID NO: 168436

SEQ ID NO: 689020 - RNA, 64 nt, hsa; identical to SEQ ID NO: 168437

SEQ ID NO: 689021 - RNA, 64 nt, hsa; identical to SEQ ID NO: 168438

SEQ ID NO: 689022 - RNA, 64 nt, hsa; identical to SEQ ID NO: 168439

SEQ ID NO: 689023 - RNA, 64 nt, hsa; identical to SEQ ID NO: 168440

SEQ ID NO: 689024 - RNA, 64 nt, hsa; identical to SEQ ID NO: 168441

SEQ ID NO: 689025 - RNA, 64 nt, hsa; identical to SEQ ID NO: 168442

SEQ ID NO: 689026 - RNA, 64 nt, hsa; identical to SEQ ID NO: 168443

SEQ ID NO: 689027 - RNA, 64 nt, hsa; identical to SEQ ID NO: 168444

SEQ ID NO: 689028 - RNA, 64 nt, hsa; identical to SEQ ID NO: 168445

SEQ ID NO: 689029 - RNA, 64 nt, hsa; identical to SEQ ID NO: 168446

SEQ ID NO: 689030 - RNA, 64 nt, hsa; identical to SEQ ID NO: 395904

SEQ ID NO: 689031 - RNA, 64 nt, hsa; identical to SEQ ID NO: 395905

SEQ ID NO: 689032 - RNA, 64 nt, hsa; identical to SEQ ID NO: 395906

SEQ ID NO: 689033 - RNA, 64 nt, hsa; identical to SEQ ID NO: 395907

SEQ ID NO: 689034 - RNA, 64 nt, hsa; identical to SEQ ID NO: 395908

SEQ ID NO: 689035 - RNA, 64 nt, hsa; identical to SEQ ID NO: 395909

SEQ ID NO: 689036 - RNA, 64 nt, hsa
cagaauuagguaaacaucugaagguuuaguauauuagaaacacccaaaccaguaauaugcuaac

SEQ ID NO: 689037 - RNA, 64 nt, hsa
ugucugucaacaaauacaccaaaaccauuuuuuauagaaacaguauuuaauggucacucaauag

SEQ ID NO: 689038 - RNA, 64 nt, hsa
cauuuauaacguuguuuaugacuacauugugaguuagaaacaaacuuaaaauuugggguauaga

SEQ ID NO: 689039 - RNA, 64 nt, hsa
ugaacacuuuauuuauugauguugaaguaaggauuagaaacauagacucccaaguuuuaaacac

SEQ ID NO: 689040 - RNA, 64 nt, hsa
ucuguucaaaggagcaagaacuuucauauaggaauagaaacaugcuggccgaagauuucaucca

SEQ ID NO: 689041 - RNA, 64 nt, hsa
uccaguccuuuuaaaauuguacaugaacauguuuuagaaacaauauggaggaugaugcauacau

SEQ ID NO: 689042 - RNA, 64 nt, hsa
agucucuguucuucaucugcuauuaaccuugccuuagaaacacauaaauuaugagauuuuuuuu

SEQ ID NO: 689043 - RNA, 64 nt, hsa
cuuuuauaauaaugaaugugcacucauacauauguagaaacauuuagauuuagaguuuuuuuuu

SEQ ID NO: 689044 - RNA, 64 nt, hsa
caaggccauuuaauccgucacauucaucucauaauagaaacacguucauauuccaguggucaau

SEQ ID NO: 689045 - RNA, 64 nt, hsa
auauauuuuaucucuuauaccuguaucucccaacuagaaacagcuccaguguuuuuaagagaau

SEQ ID NO: 689046 - RNA, 64 nt, hsa
gugcaauuuagcuuaaauggguguaugaauggucuagaaacauuucuauuuuuuuuuuaaacca

SEQ ID NO: 689047 - RNA, 64 nt, hsa
auuuaaaucuugcaagaauauuuugugcuuucuuuagaaacacaagaguauagauuuuucucac

SEQ ID NO: 689048 - RNA, 64 nt, hsa
uuauucgaaaagaggcuuuuaaaaugugcauguuuagaaacaaaauuucuucauggaaaucaua

SEQ ID NO: 689049 - RNA, 64 nt, hsa
uacaauugagauuugcccauagguuaaacaugguuagaaacaacugaaagcauaaaagaaaaau

SEQ ID NO: 689050 - RNA, 64 nt, hsa
auuaucuuuguucuccuaaugcucugaaaggauguagaaacaauauuuaaccaaagaacguaau

SEQ ID NO: 689051 - RNA, 64 nt, hsa
uaaaguugagagacaguaacacaauuaaaugacuuagaaacaauguuugcuuuucacuggcaua

SEQ ID NO: 689052 - RNA, 64 nt, hsa
auguaacuauuuuuuagaaaugccaucuacuuucuagaaacacuaaaguuauuguuuucuaagu

SEQ ID NO: 689053 - RNA, 64 nt, hsa
uaucuugaaaguugaacucaaguagaaaaauggauagaaacaaaauucucuaguacucauccag

SEQ ID NO: 689054 - RNA, 64 nt, hsa
aaauauaggugaggauucaggagaaggcaaaagcuagaaacacuugggguugucaacaugagua

SEQ ID NO: 689055 - RNA, 64 nt, hsa
agaugaacaacuuugccuucaaaaaugugcugccuagaaacagaccugcauucaaccaacugua

SEQ ID NO: 689056 - RNA, 64 nt, hsa
cuaaggagccugggaugauguuggucaaaugaccuagaaacaaggauucuaccugaacugaaag

SEQ ID NO: 689057 - RNA, 64 nt, hsa
aaugaacuguaguacauggacaauaagugugugguagaaacaaacuccauuacucugauuuuug

SEQ ID NO: 689058 - RNA, 64 nt, hsa
aaaaaagagugaaaaagagaauauacaugaagaauagaaacaagccugccauaauccuuuggaa

SEQ ID NO: 689059 - RNA, 64 nt, hsa
gaagaauuggcuuguauaguuauaacaaccacaguagaaacauuucuacuuugagagaauuuca

SEQ ID NO: 689060 - RNA, 64 nt, hsa
gauucuuaaggcaggccugaaaggccauuacuaauagaaacacagccuuuccaauccucuggaa

SEQ ID NO: 689061 - RNA, 64 nt, hsa
cuuuucucuaaaacauuuaugcccuugcuuuggcuagaaacacauuaacugguuuacucauuga

SEQ ID NO: 689062 - RNA, 64 nt, hsa
gccccauucuucauaucaauuuuguauaaauauauagaaacacacacacagccucagacuuaca

SEQ ID NO: 689063 - RNA, 64 nt, hsa
gaauguaagauacuuuagaaagcauguaaaguacuagaaacaaugagguggcuucaauuagugc

SEQ ID NO: 689064 - RNA, 64 nt, hsa
ucauucugagaccuaaauuuaaagggucaggcauuagaaacaaaaguguuucuucauaucuagg

SEQ ID NO: 689065 - RNA, 64 nt, hsa
uagcucucccccaauaaaaauaccacuaucagaguagaaacaagguagacauuucuaaaacaua

SEQ ID NO: 689066 - RNA, 64 nt, hsa
uaaucccauuuaggucuguacuaaagaggauggguagaaacacauauguauauaccuuuucuuu

SEQ ID NO: 689067 - RNA, 64 nt, hsa
guuccagugaugaaaacauucaagcagaacuagguagaaacagagggccaaaauugaaugcuau

SEQ ID NO: 689068 - RNA, 64 nt, hsa
ccuagccuuccaagagaagaaaaagaagagaaacuagaaacaguuaaagugucuaauaaugcug

SEQ ID NO: 689069 - RNA, 64 nt, hsa
aaucccccaucagugggggcggggggggggguuguagaaacagucugauaugguuuggcucugu

SEQ ID NO: 689070 - RNA, 64 nt, hsa
ugcuauuucacccugcagguuagcaguauuaaaauagaaacaucaaaucccccaucaguggggg

SEQ ID NO: 689071 - RNA, 64 nt, hsa
uuuguguggguugauagcuaccaaugggacaguguagaaacaaguuuccaccuuucuaaaacca

SEQ ID NO: 689072 - RNA, 64 nt, hsa
acaucauaaagaacuugauuugaaauguuuucuauagaaacaagugcuaaguguaccguauaua

SEQ ID NO: 689073 - RNA, 64 nt, hsa
gauucaggaagacaggcacaguccucucuguucauagaaacaccugccagugucaaggauucca

SEQ ID NO: 689074 - RNA, 64 nt, hsa
ugccauuuuaaggaaaacuaccuguauuuaaaaauagaaacauaucaaaaacaagagaaaagac

SEQ ID NO: 689075 - RNA, 64 nt, hsa
cccacuaaugcaaacugggaugaaacuaaagcaauagaaacaacacaguuuugaccuaacauac

SEQ ID NO: 689076 - RNA, 64 nt, hsa
guaguaccaaaauaaauaaggaaaagcuuagcuuuagaaacagugcaacacuggucugcuguuc

SEQ ID NO: 689077 - RNA, 64 nt, hsa
uaaaaauuaaauuggaaagcagguuucaaggaaguagaaacaaaauacaauuuuuuugguaaaa

SEQ ID NO: 689078 - RNA, 64 nt, hsa
auuuaagaugagcuauuuggagcuuauguaauaauggcauaaagccaacuagaggauguuguau

SEQ ID NO: 689079 - RNA, 64 nt, hsa
uuauguaaauauguaugauuaugauuuuuauaaauggcauaacaugaguguacuaacuaccuuc

SEQ ID NO: 689080 - RNA, 64 nt, hsa
aaaauuuuugucuuucauggaaugcaauuugacuuggcauaauugugaguuaauuugauaaaga

SEQ ID NO: 689081 - RNA, 64 nt, hsa
uuacaguucacacugcagagcuagguuguccuauuggcauaaaacaaaccagcaacuuuucuca

SEQ ID NO: 689082 - RNA, 64 nt, hsa; identical to SEQ ID NO: 98023

SEQ ID NO: 689083 - RNA, 64 nt, hsa; identical to SEQ ID NO: 98024

SEQ ID NO: 689084 - RNA, 64 nt, hsa
cagccuggggucugacaauaccucgagccacaaccgaccagaugccagggacccacggagcccu

SEQ ID NO: 689085 - RNA, 64 nt, hsa
caaucagauuagacacuauguguuagaguccccccgaccagauccuuuuccaucccacuccacu

SEQ ID NO: 689086 - RNA, 64 nt, hsa
ugcugucuagaucaggaauuucuaucuguuauaucgaccagaauguugugauuuaaagagaacu

SEQ ID NO: 689087 - RNA, 64 nt, hsa
gugacccggcgggaccugcgggcgcgcggcccgacgaccagagggcgagccugcuccucucgcc

SEQ ID NO: 689088 - RNA, 64 nt, hsa
accaggacgucagccagcacugcacagacagcugcgaccagagacuggaggugacccuugcccu

SEQ ID NO: 689089 - RNA, 64 nt, hsa
accauuaauguuuaauuuaaucuuaauaccaaaacgaccagauugaaguuugacuuuuauuguc

SEQ ID NO: 689090 - RNA, 64 nt, hsa
aagugcugggauuacaggugugagccacuauacccgaccagaucaaaucuuuuuuugacauuuu

SEQ ID NO: 689091 - RNA, 64 nt, hsa
aguuuuuuaugugugaagucauuaaauuauuacacgaccagaacuaaaaugcaauauacaguua

SEQ ID NO: 689092 - RNA, 64 nt, hsa
ugggaaucccacggaccucucgcgugucaacagacgaccagaggagugcuggagcuccagcagc

SEQ ID NO: 689093 - RNA, 64 nt, hsa
acgugaugcuaugcaugucugaccgacgaucccucgaccagaaucagauucaggagcucaguuu

SEQ ID NO: 689094 - RNA, 64 nt, hsa
ccucgucugucaaugacaucuccuccauguccaccgaccagacccuggcaucugacacugacag

SEQ ID NO: 689095 - RNA, 64 nt, hsa
aacaucuccccccaggcgauguucucccccaagacgaccagaaaauuguuuauuggggaaugcu

SEQ ID NO: 689096 - RNA, 64 nt, hsa
uucuguauuuauguauuuguacgaauguauauagcgaccagagcauucuuaauucccgccgcag

SEQ ID NO: 689097 - RNA, 64 nt, hsa
cagaaggcagggaaaggcucugaaagccagcugccgaccagagccccacacggaggcaucugca

SEQ ID NO: 689098 - RNA, 64 nt, hsa
cucuagcuacacuauugcauuguucagaaacugucgaccagaguuagaacggagcccucgguga

SEQ ID NO: 689099 - RNA, 64 nt, hsa
uuuuaucauuuuuuaagauucccucguuaugccacgaccagauaagaaucaccaguggguauuc

SEQ ID NO: 689100 - RNA, 64 nt, hsa
acgauugcugaagccugagcaggucucugugggccgaccagaggggggcuucgagguggucccu

SEQ ID NO: 689101 - RNA, 64 nt, hsa
cgggcgucugugugcgcucuguggaugccagggccgaccagaggagccuuuuuaaaacacaugu

SEQ ID NO: 689102 - RNA, 64 nt, hsa
ccccauuccugggccuuucugagggcaggaggggcgaccagauaaggagccccucucugcuggg

SEQ ID NO: 689103 - RNA, 64 nt, hsa
uguuguggguguugccgugcuucaggaaguguggcgaccagaaagcguagacccggggcccagg

SEQ ID NO: 689104 - RNA, 64 nt, hsa
ucucccagcauauagauauauccuccuuuaacuccgaccagaacccuucuuccuguggcacucc

SEQ ID NO: 689105 - RNA, 64 nt, hsa
auuuucuacccagagaccugcauguucucuccaacgaccagaauauucuacccaaaugucagga

SEQ ID NO: 689106 - RNA, 64 nt, hsa
aggguugcuuggaggaccugggguggcagccccccgaccagaagcacccuauuuuauagauagc

SEQ ID NO: 689107 - RNA, 64 nt, hsa
augugaccggaugcgcucccagaagcuccgccggcgaccagacuccugccacgccuuccaucca

SEQ ID NO: 689108 - RNA, 64 nt, hsa
cugaacaaacaaaaaacaaaacgcucaagccuuacgaccagagaaggauuucagcaaaccacca

SEQ ID NO: 689109 - RNA, 64 nt, hsa
uucccucugcuuccuggacacagaggaggucuaacgaccagaguauugcccugccaccacuauc

SEQ ID NO: 689110 - RNA, 64 nt, hsa
cucuguggccaagcuccagccaaaaaggagggcacgaccagaaaggaacucccuuugcacggag

SEQ ID NO: 689111 - RNA, 64 nt, hsa
cgagccuggggcugcccuaccucuacccauuccccgaccagagcuuugcccuugcuuggcugcc

SEQ ID NO: 689112 - RNA, 64 nt, hsa
ggccacagagaaaguacuucuccacccugcucuccgaccagacaccuugacagggcacaccggg

SEQ ID NO: 689113 - RNA, 64 nt, hsa
cacacagccugucuucagauccugcugccgcgugcgaccagaggugggaggccccugguggcau

SEQ ID NO: 689114 - RNA, 64 nt, hsa
ugauaggacaucuggcuugccacaaaggucuguucgaccagacauauccuagcuaagggauguc

SEQ ID NO: 689115 - RNA, 64 nt, hsa
uagaggccaccauggugugaggagaccaucaccucgaccagaacuccagauggucaccugcccu

SEQ ID NO: 689116 - RNA, 64 nt, hsa
agcguucggaugagucugguuauugguccacccccgaccagauucccuuacacuuaacucacuu

SEQ ID NO: 689117 - RNA, 64 nt, hsa
gcagugccaggaccacccuugccugcagccuuugcgaccagagcccuuuucaagcacaauuaau

SEQ ID NO: 689118 - RNA, 64 nt, hsa
aaaaagacaaaaaaaaaaaagccaagccgugagccgaccagaaggccguccucuuugauaucuu

SEQ ID NO: 689119 - RNA, 64 nt, hsa
cacuuuguuacugguaccugaugcacacggauugcgaccagagcaugaugccuccaucaagugg

SEQ ID NO: 689120 - RNA, 64 nt, hsa
ugggugugccuggccugggacugagggguccaggcgaccagagcuggcuguacaggaaugucca

SEQ ID NO: 689121 - RNA, 64 nt, hsa
cccucauucaugaggguggugaggacacagacugcgaccagaacagaaauaugaaaaugugaau

SEQ ID NO: 689122 - RNA, 64 nt, hsa
ccacguguaugaugggguucucaggcccaggcuucgaccagaggacccucugccaccaccguuu

SEQ ID NO: 689123 - RNA, 64 nt, hsa
ggagacuccggcaaccuucagcaacauauauccucgaccagaugcagugcuauaagaacagaac

SEQ ID NO: 689124 - RNA, 64 nt, hsa
caucccaagacagccagcagguugucucuggaaacgaccagaguuaagcucucggcuucucugc

SEQ ID NO: 689125 - RNA, 64 nt, hsa
acucccuccccauuggccgaguuauggagcgcuccgaccagacagcgucucauuggccaaagau

SEQ ID NO: 689126 - RNA, 64 nt, hsa
aucgcugguuuccucugcagcgcgagggcuccggcgaccagaggauucuucccggaaggcauuc

SEQ ID NO: 689127 - RNA, 64 nt, hsa; identical to SEQ ID NO: 87425

SEQ ID NO: 689128 - RNA, 64 nt, hsa; identical to SEQ ID NO: 87426

SEQ ID NO: 689129 - RNA, 64 nt, hsa; identical to SEQ ID NO: 87427

SEQ ID NO: 689130 - RNA, 64 nt, hsa; identical to SEQ ID NO: 87428

SEQ ID NO: 689131 - RNA, 64 nt, hsa; identical to SEQ ID NO: 87429

SEQ ID NO: 689132 - RNA, 64 nt, hsa; identical to SEQ ID NO: 87430

SEQ ID NO: 689133 - RNA, 55 nt, hsa; identical to SEQ ID NO: 194635

SEQ ID NO: 689134 - RNA, 62 nt, hsa
cccagcugcccagcccugcccccccuccccauagccagcacagcuaucccgcggggacacca

SEQ ID NO: 689135 - RNA, 62 nt, hsa
agcacugcacagacagcugcgaccaggacgucagccagcacugcacagacagcugcgaccag

SEQ ID NO: 689136 - RNA, 62 nt, hsa
uucccugugaggccgugguuagcguggacaucagccagcacugcacagacagcugcgaccag

SEQ ID NO: 689137 - RNA, 62 nt, hsa
guggaggagggacgagggacagggguuucaccagccagcaaccugggccuuguacugucugu

SEQ ID NO: 689138 - RNA, 62 nt, hsa
ccaggaccucucccggaucugucuccuccucuagccagcaguauggacagcuggaccccuga

SEQ ID NO: 689139 - RNA, 62 nt, hsa
ugacuccacucugagucccagagccaaucaguagccagcaucugccuccccuucacucccac

SEQ ID NO: 689140 - RNA, 62 nt, hsa
aaauaagcaggcgugaccugccaggcacacugagccagcagccuggcucucccagccagguu

SEQ ID NO: 689141 - RNA, 62 nt, hsa
cugagacaagcagggcuugaugcuggugguggagccagcaucucaccugccaggcuuccuuu

SEQ ID NO: 689142 - RNA, 62 nt, hsa
ggaagcaggauacccuggcgggccacccugccagccagcagcuggcccuccaccaucuucac

SEQ ID NO: 689143 - RNA, 62 nt, hsa
agucccagauacacucaugggcugcccugggcagccagcauucauuguaaguucccucuuug

SEQ ID NO: 689144 - RNA, 62 nt, hsa
guuacuuugggauagguugcaguaccagccacagccagcagauagaggaaaagacacacaua

SEQ ID NO: 689145 - RNA, 62 nt, hsa
cuugcccucccugccucuuuggugcucuuaaaagccagcagcugagaacauagcacaggccc

SEQ ID NO: 689146 - RNA, 62 nt, hsa
uaagugugcaguuucuagugcugggaagucuuagccagcaccagagcgccaggccucucccu

SEQ ID NO: 689147 - RNA, 62 nt, hsa
uaauccaggcuucagcaacacuccucuuucccagccagcaaaggcugugaauuugaauucuu

SEQ ID NO: 689148 - RNA, 62 nt, hsa
acuaacagcugggagaggggagccagcuguccagccagcauguuccuguuguacagcccggu

SEQ ID NO: 689149 - RNA, 62 nt, hsa
ccugggccccauccuugagggccuucccagccagccagcaggagaggcaagaacugggggaa

SEQ ID NO: 689150 - RNA, 62 nt, hsa
gcuuucccucccuccuugccccauccugggccagccagcagggcuccuccucuggcucuuca

SEQ ID NO: 689151 - RNA, 62 nt, hsa
cucugugggagcagacccgugggccucagggcagccagcaggcaggucuuguugccaauuua

SEQ ID NO: 689152 - RNA, 62 nt, hsa
gccuccggcccugccccacacaggccuggcccagccagcagguucucuccugugagcucccc

SEQ ID NO: 689153 - RNA, 62 nt, hsa
acuccuuguuugccuuuaggcaggaagucaggagccagcagggcgggccaggagaaagaagg

SEQ ID NO: 689154 - RNA, 62 nt, hsa
gcaggaggggugggaccaggcugggaggacagagccagcagcugccaugcccuccugcuccc

SEQ ID NO: 689155 - RNA, 62 nt, hsa
aauacuggccaaggucaggaggagcaaaaaugagccagcaccagcgccuuggcuuuguguua

SEQ ID NO: 689156 - RNA, 62 nt, hsa
gguccaccucucauugcaagccccaagcacugagccagcaggugccagggagccacccgccc

SEQ ID NO: 689157 - RNA, 62 nt, hsa
auuuagcccugcacagcggucuccuuccccuaagccagcacugcugcucccuggagcccggg

SEQ ID NO: 689158 - RNA, 62 nt, hsa
agggcucugcuccacccacuuggcuaugggagagccagcagggguucuggagaaagaaacug

SEQ ID NO: 689159 - RNA, 62 nt, hsa
cggcucuccucccagcaucacaccagccaugcagccagcagguccuccggaucacugugguu

SEQ ID NO: 689160 - RNA, 62 nt, hsa
ggccgaggggcggaggcacagcugcuuccagcagccagcauucaguggccuugucaccaagc

SEQ ID NO: 689161 - RNA, 62 nt, hsa
cuucuguggcaggacuggcccagggaggaggaagccagcagcacaccuggggaauggggucc

SEQ ID NO: 689162 - RNA, 62 nt, hsa
guaagcccugcuuagcucaucuuagagcaaagagccagcacccugaugucccugggguggcu

SEQ ID NO: 689163 - RNA, 62 nt, hsa
ggaaugcugcccgcucugcagacugcugcuagagccagcaacuccacuaagguggauuuuca

SEQ ID NO: 689164 - RNA, 62 nt, hsa
gagaaaggaaaaggcaugaaguucuauaccucagccagcagcugccuucguuuggaacugaa

SEQ ID NO: 689165 - RNA, 62 nt, hsa
ccagcagcugccuucguuuggaacugaaguccagccagcagacucucuagcuccaucucccc

SEQ ID NO: 689166 - RNA, 62 nt, hsa
uuggccccaagguugccccgggccagcagcccagccagcagcacagucucuauggugcugag

SEQ ID NO: 689167 - RNA, 62 nt, hsa
gaggaggacaugguggagaccagggacaggagagccagcaggguggaugcaaggggccucua

SEQ ID NO: 689168 - RNA, 62 nt, hsa
uggccucccagaaugcuggguuuauagaugugagccagcacaccgggccaagugaagaaucu

SEQ ID NO: 689169 - RNA, 62 nt, hsa
ggagacuuucugaaguagccugaucuuucuagagccagcaguacguggcuucagaggccugg

SEQ ID NO: 689170 - RNA, 62 nt, hsa
ugcugggauuacaggcaugagccaccaugccuagccagcaagcaucauuucuauuauaccuu

SEQ ID NO: 689171 - RNA, 62 nt, hsa
caccucucaccuccaccaccccucccugucccagccagcaucaucucuuuggggaccacucc

SEQ ID NO: 689172 - RNA, 62 nt, hsa
cccaucucaugccccuggcugggacguggcucagccagcacuuguccagcugagcgccagga

SEQ ID NO: 689173 - RNA, 62 nt, hsa
aaagaggcugaggcuggcacaggacaugcgguagccagcacacagggcagugagggagggcu

SEQ ID NO: 689174 - RNA, 64 nt, hsa
auggcuggggcucuccgugguguucuggacccagccccuggagacaccauucacuuuuacugcu

SEQ ID NO: 689175 - RNA, 64 nt, hsa
gccuccauggcuggucaugagagcaaaccguaguccccuggagacagcgacuccagagaaccuc

SEQ ID NO: 689176 - RNA, 64 nt, hsa
gugcacaccugcaaguaggcaccggccgcggcucccccuggacggggcgggcccugccugaggg

SEQ ID NO: 689177 - RNA, 64 nt, hsa
ggcucugcguuggcuucucccuggggacggggcuccccuggacagaggcggggcuacagauugg

SEQ ID NO: 689178 - RNA, 64 nt, hsa
cugcucuuggaguggacaugaccagacaccgcacccccuggaucuggcugagggcucaggacac

SEQ ID NO: 689179 - RNA, 64 nt, hsa
cagcccagaagagauggaccucucccaggagcagccccuggaugcccagcaggguccccccgaa

SEQ ID NO: 689180 - RNA, 64 nt, hsa
cuucgugcuugggguagaucuucuucacauauucccccuggaaggagcaacuuuucugugcccu

SEQ ID NO: 689181 - RNA, 64 nt, hsa
ugacuuguugaaagugcagaaauggaaugcuggcccccuggaucugcacaucugccucgcugcu

SEQ ID NO: 689182 - RNA, 64 nt, hsa
aucagggucauccuacagccuccaagcgggcuuuccccuggacaaaugccacugcaacauuuau

SEQ ID NO: 689183 - RNA, 64 nt, hsa
guucgggagaauggggccggggcuggccuggccuccccuggauauacucuauagugcaccaaaa

SEQ ID NO: 689184 - RNA, 64 nt, hsa
uggcaacucugaucugacgccucugugcucagggccccuggaggaggggcuacugccccuuggc

SEQ ID NO: 689185 - RNA, 64 nt, hsa
gcuugucccaggcuacugggcuguggucucugacccccuggaggccuccccacgccucacagaa

SEQ ID NO: 689186 - RNA, 64 nt, hsa
cugggagacagaugaggagacuggcucagcaaggccccuggaggucaagcuuggccuuugccuc

SEQ ID NO: 689187 - RNA, 64 nt, hsa
cagagugccugaggcuuccugcuugagaaccugcccccuggaucuuggacacuuacagauugag

SEQ ID NO: 689188 - RNA, 64 nt, hsa
gcuggucccccacaccgcguccugcugagccugcccccuggauuggcuguaauuugccucgaag

SEQ ID NO: 689189 - RNA, 64 nt, hsa
ggagggagccacugagcacagcaaggcaccaaagccccuggagaaaccgccagggcgaggugcg

SEQ ID NO: 689190 - RNA, 64 nt, hsa
ggcccagggggcuuccugaggggagacagagcaaccccuggaccccagccucaaauccaggacc

SEQ ID NO: 689191 - RNA, 64 nt, hsa
cauggggucucucacagacaggaccccugcaguuccccuggaagcagugcccagguggcugugg

SEQ ID NO: 689192 - RNA, 64 nt, hsa
gaggaggaggcacacggagaccuggggcucggggccccuggauuccugcaucugcauaugcgua

SEQ ID NO: 689193 - RNA, 64 nt, hsa
ggcggggcgggggucugccggccucugggcaaggccccuggagcaucucgcccaggcuuuuuau

SEQ ID NO: 689194 - RNA, 64 nt, hsa
agcacccuuccugcuggcgugaccgugucuaacuccccuggagugacgaccaccgccccaccac

SEQ ID NO: 689195 - RNA, 64 nt, hsa
cuuugcaaucaaggccaaagaaaaugaucugcuuccccuggaaaaaaaucguguuaagcuagau

SEQ ID NO: 689196 - RNA, 64 nt, hsa
ugaguguacguuuucuuccaggagacaucaggucccccuggauucaaauuaagugcaauauuuu

SEQ ID NO: 689197 - RNA, 64 nt, hsa
gcuguuuuuuggcaaaucuugauugugauaagccccccuggaggauaugauucacuuuauguga

SEQ ID NO: 689198 - RNA, 64 nt, hsa
aacaccugcagcucauuguggauuaagaaccucaccccuggagggguggaguuucuaccccuga

SEQ ID NO: 689199 - RNA, 64 nt, hsa
ugcagacaucuauuacauggaggcaguagaaggaccccuggagccagaggguuuucuaaaugag

SEQ ID NO: 689200 - RNA, 64 nt, hsa
gcgugaacuaacaaaccugugaacuguaaauaggccccuggaagcacgugcuuaagcccuuuug

SEQ ID NO: 689201 - RNA, 64 nt, hsa
agcuaggaucugcauuuucagguuccgagccugaccccuggaacugaccagcgcucgauuguca

SEQ ID NO: 689202 - RNA, 64 nt, hsa
cuguagcagugagaaaaagcuccuguccucccauccccuggacugggagguagauagguaaaua

SEQ ID NO: 689203 - RNA, 64 nt, hsa
gcacagcggccccugcauccccuuggcugugaggccccuggacaagcagagguggccagagcug

SEQ ID NO: 689204 - RNA, 64 nt, hsa
uuccugcuccacgggaaagaggucgauggauuuaccccuggacccauaagucuguucauccugc

SEQ ID NO: 689205 - RNA, 64 nt, hsa
guccuucuguuuggugcuacccuugucuacucugccccuggauggugcggggugcuuucuccac

SEQ ID NO: 689206 - RNA, 64 nt, hsa
accugcugggccagucccacacauuuccacccugccccuggagcagcagcuuugauaccauggg

SEQ ID NO: 689207 - RNA, 64 nt, hsa
agcccugcggagccacuccaccccucuuccccuuccccuggauuuccugacauagauggugugu

SEQ ID NO: 689208 - RNA, 64 nt, hsa
cugauggaaggcgggauucccgcuucugaaacucccccuggagucucacucccacacaugccca

SEQ ID NO: 689209 - RNA, 64 nt, hsa
caccguccccagagcaggucagcgucucgagaggccccuggacaauugaggaugcccauccccu

SEQ ID NO: 689210 - RNA, 64 nt, hsa; identical to SEQ ID NO: 686259

SEQ ID NO: 689211 - RNA, 64 nt, hsa; identical to SEQ ID NO: 686260

SEQ ID NO: 689212 - RNA, 64 nt, hsa; identical to SEQ ID NO: 686261

SEQ ID NO: 689213 - RNA, 64 nt, hsa; identical to SEQ ID NO: 686262

SEQ ID NO: 689214 - RNA, 64 nt, hsa; identical to SEQ ID NO: 686263

SEQ ID NO: 689215 - RNA, 64 nt, hsa; identical to SEQ ID NO: 686264

SEQ ID NO: 689216 - RNA, 60 nt, hsa; identical to SEQ ID NO: 614236

SEQ ID NO: 689217 - RNA, 60 nt, hsa; identical to SEQ ID NO: 614237

SEQ ID NO: 689218 - RNA, 60 nt, hsa; identical to SEQ ID NO: 614238

SEQ ID NO: 689219 - RNA, 60 nt, hsa; identical to SEQ ID NO: 614239

SEQ ID NO: 689220 - RNA, 60 nt, hsa; identical to SEQ ID NO: 614240

SEQ ID NO: 689221 - RNA, 60 nt, hsa; identical to SEQ ID NO: 614241

SEQ ID NO: 689222 - RNA, 60 nt, hsa; identical to SEQ ID NO: 614242

SEQ ID NO: 689223 - RNA, 60 nt, hsa; identical to SEQ ID NO: 614243

SEQ ID NO: 689224 - RNA, 60 nt, hsa; identical to SEQ ID NO: 614244

SEQ ID NO: 689225 - RNA, 60 nt, hsa; identical to SEQ ID NO: 614245

SEQ ID NO: 689226 - RNA, 60 nt, hsa; identical to SEQ ID NO: 614246

SEQ ID NO: 689227 - RNA, 60 nt, hsa; identical to SEQ ID NO: 614247

SEQ ID NO: 689228 - RNA, 60 nt, hsa; identical to SEQ ID NO: 614248

SEQ ID NO: 689229 - RNA, 60 nt, hsa; identical to SEQ ID NO: 614249

SEQ ID NO: 689230 - RNA, 60 nt, hsa; identical to SEQ ID NO: 614250

SEQ ID NO: 689231 - RNA, 60 nt, hsa; identical to SEQ ID NO: 614251

SEQ ID NO: 689232 - RNA, 60 nt, hsa; identical to SEQ ID NO: 614252

SEQ ID NO: 689233 - RNA, 60 nt, hsa; identical to SEQ ID NO: 614253

SEQ ID NO: 689234 - RNA, 60 nt, hsa; identical to SEQ ID NO: 614254

SEQ ID NO: 689235 - RNA, 60 nt, hsa; identical to SEQ ID NO: 614255

SEQ ID NO: 689236 - RNA, 60 nt, hsa; identical to SEQ ID NO: 614256

SEQ ID NO: 689237 - RNA, 60 nt, hsa; identical to SEQ ID NO: 614257

SEQ ID NO: 689238 - RNA, 60 nt, hsa; identical to SEQ ID NO: 614258

SEQ ID NO: 689239 - RNA, 60 nt, hsa; identical to SEQ ID NO: 614259

SEQ ID NO: 689240 - RNA, 60 nt, hsa; identical to SEQ ID NO: 614260

SEQ ID NO: 689241 - RNA, 60 nt, hsa; identical to SEQ ID NO: 614261

SEQ ID NO: 689242 - RNA, 60 nt, hsa; identical to SEQ ID NO: 614262

SEQ ID NO: 689243 - RNA, 60 nt, hsa; identical to SEQ ID NO: 614263

SEQ ID NO: 689244 - RNA, 60 nt, hsa; identical to SEQ ID NO: 614264

SEQ ID NO: 689245 - RNA, 60 nt, hsa; identical to SEQ ID NO: 614265

SEQ ID NO: 689246 - RNA, 60 nt, hsa; identical to SEQ ID NO: 614266

SEQ ID NO: 689247 - RNA, 60 nt, hsa; identical to SEQ ID NO: 614267

SEQ ID NO: 689248 - RNA, 60 nt, hsa; identical to SEQ ID NO: 614268

SEQ ID NO: 689249 - RNA, 60 nt, hsa; identical to SEQ ID NO: 614269

SEQ ID NO: 689250 - RNA, 60 nt, hsa; identical to SEQ ID NO: 614270

SEQ ID NO: 689251 - RNA, 60 nt, hsa; identical to SEQ ID NO: 614271

SEQ ID NO: 689252 - RNA, 60 nt, hsa; identical to SEQ ID NO: 614272

SEQ ID NO: 689253 - RNA, 60 nt, hsa; identical to SEQ ID NO: 614273

SEQ ID NO: 689254 - RNA, 60 nt, hsa; identical to SEQ ID NO: 614274

SEQ ID NO: 689255 - RNA, 60 nt, hsa; identical to SEQ ID NO: 614275

SEQ ID NO: 689256 - RNA, 60 nt, hsa; identical to SEQ ID NO: 614276

SEQ ID NO: 689257 - RNA, 60 nt, hsa; identical to SEQ ID NO: 614277

SEQ ID NO: 689258 - RNA, 60 nt, hsa; identical to SEQ ID NO: 614278

SEQ ID NO: 689259 - RNA, 60 nt, hsa; identical to SEQ ID NO: 614279

SEQ ID NO: 689260 - RNA, 60 nt, hsa; identical to SEQ ID NO: 614280

SEQ ID NO: 689261 - RNA, 60 nt, hsa; identical to SEQ ID NO: 614281

SEQ ID NO: 689262 - RNA, 60 nt, hsa; identical to SEQ ID NO: 614282

SEQ ID NO: 689263 - RNA, 60 nt, hsa; identical to SEQ ID NO: 614283

SEQ ID NO: 689264 - RNA, 60 nt, hsa; identical to SEQ ID NO: 614284

SEQ ID NO: 689265 - RNA, 60 nt, hsa; identical to SEQ ID NO: 614285

SEQ ID NO: 689266 - RNA, 60 nt, hsa; identical to SEQ ID NO: 614286

SEQ ID NO: 689267 - RNA, 60 nt, hsa; identical to SEQ ID NO: 614287

SEQ ID NO: 689268 - RNA, 60 nt, hsa; identical to SEQ ID NO: 614288

SEQ ID NO: 689269 - RNA, 60 nt, hsa; identical to SEQ ID NO: 614289

SEQ ID NO: 689270 - RNA, 60 nt, hsa; identical to SEQ ID NO: 614290

SEQ ID NO: 689271 - RNA, 60 nt, hsa; identical to SEQ ID NO: 614291

SEQ ID NO: 689272 - RNA, 60 nt, hsa; identical to SEQ ID NO: 614292

SEQ ID NO: 689273 - RNA, 60 nt, hsa; identical to SEQ ID NO: 614293

SEQ ID NO: 689274 - RNA, 60 nt, hsa; identical to SEQ ID NO: 614294

SEQ ID NO: 689275 - RNA, 60 nt, hsa; identical to SEQ ID NO: 614295

SEQ ID NO: 689276 - RNA, 60 nt, hsa; identical to SEQ ID NO: 614296

SEQ ID NO: 689277 - RNA, 60 nt, hsa; identical to SEQ ID NO: 614297

SEQ ID NO: 689278 - RNA, 60 nt, hsa; identical to SEQ ID NO: 614298

SEQ ID NO: 689279 - RNA, 60 nt, hsa; identical to SEQ ID NO: 614299

SEQ ID NO: 689280 - RNA, 60 nt, hsa; identical to SEQ ID NO: 614300

SEQ ID NO: 689281 - RNA, 60 nt, hsa; identical to SEQ ID NO: 614301

SEQ ID NO: 689282 - RNA, 60 nt, hsa; identical to SEQ ID NO: 614302

SEQ ID NO: 689283 - RNA, 60 nt, hsa; identical to SEQ ID NO: 614303

SEQ ID NO: 689284 - RNA, 60 nt, hsa; identical to SEQ ID NO: 614304

SEQ ID NO: 689285 - RNA, 60 nt, hsa; identical to SEQ ID NO: 614305

SEQ ID NO: 689286 - RNA, 60 nt, hsa; identical to SEQ ID NO: 614306

SEQ ID NO: 689287 - RNA, 60 nt, hsa; identical to SEQ ID NO: 614307

SEQ ID NO: 689288 - RNA, 60 nt, hsa; identical to SEQ ID NO: 614308

SEQ ID NO: 689289 - RNA, 60 nt, hsa; identical to SEQ ID NO: 614309

SEQ ID NO: 689290 - RNA, 60 nt, hsa; identical to SEQ ID NO: 614310

SEQ ID NO: 689291 - RNA, 60 nt, hsa; identical to SEQ ID NO: 614311

SEQ ID NO: 689292 - RNA, 60 nt, hsa; identical to SEQ ID NO: 614312

SEQ ID NO: 689293 - RNA, 60 nt, hsa; identical to SEQ ID NO: 614313

SEQ ID NO: 689294 - RNA, 60 nt, hsa; identical to SEQ ID NO: 614314

SEQ ID NO: 689295 - RNA, 60 nt, hsa; identical to SEQ ID NO: 614315

SEQ ID NO: 689296 - RNA, 60 nt, hsa; identical to SEQ ID NO: 614316

SEQ ID NO: 689297 - RNA, 60 nt, hsa; identical to SEQ ID NO: 614317

SEQ ID NO: 689298 - RNA, 60 nt, hsa; identical to SEQ ID NO: 614318

SEQ ID NO: 689299 - RNA, 60 nt, hsa; identical to SEQ ID NO: 614319

SEQ ID NO: 689300 - RNA, 60 nt, hsa; identical to SEQ ID NO: 614320

SEQ ID NO: 689301 - RNA, 60 nt, hsa; identical to SEQ ID NO: 614321

SEQ ID NO: 689302 - RNA, 58 nt, hsa; identical to SEQ ID NO: 502655

SEQ ID NO: 689303 - RNA, 60 nt, hsa; identical to SEQ ID NO: 614323

SEQ ID NO: 689304 - RNA, 60 nt, hsa; identical to SEQ ID NO: 614324

SEQ ID NO: 689305 - RNA, 60 nt, hsa; identical to SEQ ID NO: 614325

SEQ ID NO: 689306 - RNA, 60 nt, hsa; identical to SEQ ID NO: 614326

SEQ ID NO: 689307 - RNA, 60 nt, hsa; identical to SEQ ID NO: 614327

SEQ ID NO: 689308 - RNA, 60 nt, hsa; identical to SEQ ID NO: 614328

SEQ ID NO: 689309 - RNA, 60 nt, hsa; identical to SEQ ID NO: 614329

SEQ ID NO: 689310 - RNA, 60 nt, hsa; identical to SEQ ID NO: 614330

SEQ ID NO: 689311 - RNA, 60 nt, hsa; identical to SEQ ID NO: 614331

SEQ ID NO: 689312 - RNA, 60 nt, hsa; identical to SEQ ID NO: 614332

SEQ ID NO: 689313 - RNA, 60 nt, hsa; identical to SEQ ID NO: 614333

SEQ ID NO: 689314 - RNA, 60 nt, hsa; identical to SEQ ID NO: 614334

SEQ ID NO: 689315 - RNA, 60 nt, hsa; identical to SEQ ID NO: 614335

SEQ ID NO: 689316 - RNA, 60 nt, hsa; identical to SEQ ID NO: 614336

SEQ ID NO: 689317 - RNA, 60 nt, hsa; identical to SEQ ID NO: 614337

SEQ ID NO: 689318 - RNA, 60 nt, hsa; identical to SEQ ID NO: 614338

SEQ ID NO: 689319 - RNA, 60 nt, hsa; identical to SEQ ID NO: 614339

SEQ ID NO: 689320 - RNA, 60 nt, hsa; identical to SEQ ID NO: 614340

SEQ ID NO: 689321 - RNA, 60 nt, hsa; identical to SEQ ID NO: 614341

SEQ ID NO: 689322 - RNA, 60 nt, hsa; identical to SEQ ID NO: 614342

SEQ ID NO: 689323 - RNA, 60 nt, hsa; identical to SEQ ID NO: 614343

SEQ ID NO: 689324 - RNA, 60 nt, hsa; identical to SEQ ID NO: 614344

SEQ ID NO: 689325 - RNA, 60 nt, hsa; identical to SEQ ID NO: 614345

SEQ ID NO: 689326 - RNA, 60 nt, hsa; identical to SEQ ID NO: 614346

SEQ ID NO: 689327 - RNA, 60 nt, hsa; identical to SEQ ID NO: 614347

SEQ ID NO: 689328 - RNA, 60 nt, hsa; identical to SEQ ID NO: 614348

SEQ ID NO: 689329 - RNA, 60 nt, hsa; identical to SEQ ID NO: 614349

SEQ ID NO: 689330 - RNA, 60 nt, hsa; identical to SEQ ID NO: 614350

SEQ ID NO: 689331 - RNA, 60 nt, hsa; identical to SEQ ID NO: 614351

SEQ ID NO: 689332 - RNA, 60 nt, hsa; identical to SEQ ID NO: 614352

SEQ ID NO: 689333 - RNA, 60 nt, hsa; identical to SEQ ID NO: 614353

SEQ ID NO: 689334 - RNA, 60 nt, hsa; identical to SEQ ID NO: 614354

SEQ ID NO: 689335 - RNA, 60 nt, hsa; identical to SEQ ID NO: 614355

SEQ ID NO: 689336 - RNA, 60 nt, hsa; identical to SEQ ID NO: 614356

SEQ ID NO: 689337 - RNA, 60 nt, hsa; identical to SEQ ID NO: 614357

SEQ ID NO: 689338 - RNA, 60 nt, hsa; identical to SEQ ID NO: 614358

SEQ ID NO: 689339 - RNA, 60 nt, hsa; identical to SEQ ID NO: 614359

SEQ ID NO: 689340 - RNA, 60 nt, hsa; identical to SEQ ID NO: 614360

SEQ ID NO: 689341 - RNA, 60 nt, hsa; identical to SEQ ID NO: 614361

SEQ ID NO: 689342 - RNA, 60 nt, hsa; identical to SEQ ID NO: 614362

SEQ ID NO: 689343 - RNA, 60 nt, hsa; identical to SEQ ID NO: 614363

SEQ ID NO: 689344 - RNA, 60 nt, hsa; identical to SEQ ID NO: 614364

SEQ ID NO: 689345 - RNA, 60 nt, hsa; identical to SEQ ID NO: 614365

SEQ ID NO: 689346 - RNA, 60 nt, hsa; identical to SEQ ID NO: 614366

SEQ ID NO: 689347 - RNA, 60 nt, hsa; identical to SEQ ID NO: 614367

SEQ ID NO: 689348 - RNA, 60 nt, hsa; identical to SEQ ID NO: 614368

SEQ ID NO: 689349 - RNA, 60 nt, hsa; identical to SEQ ID NO: 614369

SEQ ID NO: 689350 - RNA, 60 nt, hsa; identical to SEQ ID NO: 614370

SEQ ID NO: 689351 - RNA, 60 nt, hsa; identical to SEQ ID NO: 614371

SEQ ID NO: 689352 - RNA, 60 nt, hsa; identical to SEQ ID NO: 614372

SEQ ID NO: 689353 - RNA, 60 nt, hsa; identical to SEQ ID NO: 614373

SEQ ID NO: 689354 - RNA, 60 nt, hsa; identical to SEQ ID NO: 614374

SEQ ID NO: 689355 - RNA, 60 nt, hsa; identical to SEQ ID NO: 614375

SEQ ID NO: 689356 - RNA, 60 nt, hsa; identical to SEQ ID NO: 614376

SEQ ID NO: 689357 - RNA, 60 nt, hsa; identical to SEQ ID NO: 614377

SEQ ID NO: 689358 - RNA, 60 nt, hsa; identical to SEQ ID NO: 614378

SEQ ID NO: 689359 - RNA, 60 nt, hsa; identical to SEQ ID NO: 614379

SEQ ID NO: 689360 - RNA, 60 nt, hsa; identical to SEQ ID NO: 614380

SEQ ID NO: 689361 - RNA, 60 nt, hsa; identical to SEQ ID NO: 614381

SEQ ID NO: 689362 - RNA, 60 nt, hsa; identical to SEQ ID NO: 614382

SEQ ID NO: 689363 - RNA, 60 nt, hsa; identical to SEQ ID NO: 614383

SEQ ID NO: 689364 - RNA, 60 nt, hsa; identical to SEQ ID NO: 614384

SEQ ID NO: 689365 - RNA, 60 nt, hsa; identical to SEQ ID NO: 614385

SEQ ID NO: 689366 - RNA, 60 nt, hsa; identical to SEQ ID NO: 614386

SEQ ID NO: 689367 - RNA, 60 nt, hsa; identical to SEQ ID NO: 614387

SEQ ID NO: 689368 - RNA, 60 nt, hsa; identical to SEQ ID NO: 614388

SEQ ID NO: 689369 - RNA, 60 nt, hsa; identical to SEQ ID NO: 614389

SEQ ID NO: 689370 - RNA, 60 nt, hsa; identical to SEQ ID NO: 614390

SEQ ID NO: 689371 - RNA, 60 nt, hsa; identical to SEQ ID NO: 614391

SEQ ID NO: 689372 - RNA, 60 nt, hsa; identical to SEQ ID NO: 614392

SEQ ID NO: 689373 - RNA, 60 nt, hsa; identical to SEQ ID NO: 614393

SEQ ID NO: 689374 - RNA, 60 nt, hsa; identical to SEQ ID NO: 614394

SEQ ID NO: 689375 - RNA, 60 nt, hsa; identical to SEQ ID NO: 614395

SEQ ID NO: 689376 - RNA, 60 nt, hsa; identical to SEQ ID NO: 614396

SEQ ID NO: 689377 - RNA, 60 nt, hsa; identical to SEQ ID NO: 614397

SEQ ID NO: 689378 - RNA, 60 nt, hsa; identical to SEQ ID NO: 614398

SEQ ID NO: 689379 - RNA, 60 nt, hsa; identical to SEQ ID NO: 614399

SEQ ID NO: 689380 - RNA, 60 nt, hsa; identical to SEQ ID NO: 614400

SEQ ID NO: 689381 - RNA, 60 nt, hsa; identical to SEQ ID NO: 614401

SEQ ID NO: 689382 - RNA, 60 nt, hsa; identical to SEQ ID NO: 614402

SEQ ID NO: 689383 - RNA, 60 nt, hsa; identical to SEQ ID NO: 614403

SEQ ID NO: 689384 - RNA, 60 nt, hsa; identical to SEQ ID NO: 614404

SEQ ID NO: 689385 - RNA, 60 nt, hsa; identical to SEQ ID NO: 614405

SEQ ID NO: 689386 - RNA, 60 nt, hsa; identical to SEQ ID NO: 614406

SEQ ID NO: 689387 - RNA, 60 nt, hsa; identical to SEQ ID NO: 614407

SEQ ID NO: 689388 - RNA, 60 nt, hsa; identical to SEQ ID NO: 614408

SEQ ID NO: 689389 - RNA, 60 nt, hsa; identical to SEQ ID NO: 614409

SEQ ID NO: 689390 - RNA, 60 nt, hsa; identical to SEQ ID NO: 614410

SEQ ID NO: 689391 - RNA, 60 nt, hsa; identical to SEQ ID NO: 614411

SEQ ID NO: 689392 - RNA, 60 nt, hsa; identical to SEQ ID NO: 614412

SEQ ID NO: 689393 - RNA, 60 nt, hsa; identical to SEQ ID NO: 614413

SEQ ID NO: 689394 - RNA, 60 nt, hsa; identical to SEQ ID NO: 614414

SEQ ID NO: 689395 - RNA, 60 nt, hsa; identical to SEQ ID NO: 614415

SEQ ID NO: 689396 - RNA, 60 nt, hsa; identical to SEQ ID NO: 614416

SEQ ID NO: 689397 - RNA, 60 nt, hsa; identical to SEQ ID NO: 614417

SEQ ID NO: 689398 - RNA, 60 nt, hsa; identical to SEQ ID NO: 614418

SEQ ID NO: 689399 - RNA, 60 nt, hsa; identical to SEQ ID NO: 614419

SEQ ID NO: 689400 - RNA, 60 nt, hsa; identical to SEQ ID NO: 614420

SEQ ID NO: 689401 - RNA, 60 nt, hsa; identical to SEQ ID NO: 614421

SEQ ID NO: 689402 - RNA, 60 nt, hsa; identical to SEQ ID NO: 614422

SEQ ID NO: 689403 - RNA, 60 nt, hsa; identical to SEQ ID NO: 614423

SEQ ID NO: 689404 - RNA, 60 nt, hsa; identical to SEQ ID NO: 614424

SEQ ID NO: 689405 - RNA, 60 nt, hsa; identical to SEQ ID NO: 614425

SEQ ID NO: 689406 - RNA, 60 nt, hsa; identical to SEQ ID NO: 614426

SEQ ID NO: 689407 - RNA, 60 nt, hsa; identical to SEQ ID NO: 614427

SEQ ID NO: 689408 - RNA, 60 nt, hsa; identical to SEQ ID NO: 614428

SEQ ID NO: 689409 - RNA, 60 nt, hsa; identical to SEQ ID NO: 614429

SEQ ID NO: 689410 - RNA, 60 nt, hsa; identical to SEQ ID NO: 614430

SEQ ID NO: 689411 - RNA, 60 nt, hsa; identical to SEQ ID NO: 614431

SEQ ID NO: 689412 - RNA, 60 nt, hsa; identical to SEQ ID NO: 614432

SEQ ID NO: 689413 - RNA, 60 nt, hsa; identical to SEQ ID NO: 614433

SEQ ID NO: 689414 - RNA, 60 nt, hsa; identical to SEQ ID NO: 614434

SEQ ID NO: 689415 - RNA, 60 nt, hsa; identical to SEQ ID NO: 614435

SEQ ID NO: 689416 - RNA, 60 nt, hsa; identical to SEQ ID NO: 614436

SEQ ID NO: 689417 - RNA, 60 nt, hsa; identical to SEQ ID NO: 614437

SEQ ID NO: 689418 - RNA, 60 nt, hsa; identical to SEQ ID NO: 614438

SEQ ID NO: 689419 - RNA, 60 nt, hsa; identical to SEQ ID NO: 614439

SEQ ID NO: 689420 - RNA, 60 nt, hsa; identical to SEQ ID NO: 614440

SEQ ID NO: 689421 - RNA, 60 nt, hsa; identical to SEQ ID NO: 614441

SEQ ID NO: 689422 - RNA, 60 nt, hsa; identical to SEQ ID NO: 614442

SEQ ID NO: 689423 - RNA, 60 nt, hsa; identical to SEQ ID NO: 614443

SEQ ID NO: 689424 - RNA, 60 nt, hsa; identical to SEQ ID NO: 614444

SEQ ID NO: 689425 - RNA, 60 nt, hsa; identical to SEQ ID NO: 614445

SEQ ID NO: 689426 - RNA, 60 nt, hsa; identical to SEQ ID NO: 614446

SEQ ID NO: 689427 - RNA, 60 nt, hsa; identical to SEQ ID NO: 614447

SEQ ID NO: 689428 - RNA, 60 nt, hsa; identical to SEQ ID NO: 614448

SEQ ID NO: 689429 - RNA, 60 nt, hsa; identical to SEQ ID NO: 614449

SEQ ID NO: 689430 - RNA, 60 nt, hsa; identical to SEQ ID NO: 614450

SEQ ID NO: 689431 - RNA, 60 nt, hsa; identical to SEQ ID NO: 614451

SEQ ID NO: 689432 - RNA, 60 nt, hsa; identical to SEQ ID NO: 614452

SEQ ID NO: 689433 - RNA, 60 nt, hsa; identical to SEQ ID NO: 614453

SEQ ID NO: 689434 - RNA, 60 nt, hsa; identical to SEQ ID NO: 614454

SEQ ID NO: 689435 - RNA, 60 nt, hsa; identical to SEQ ID NO: 614455

SEQ ID NO: 689436 - RNA, 60 nt, hsa; identical to SEQ ID NO: 614456

SEQ ID NO: 689437 - RNA, 60 nt, hsa; identical to SEQ ID NO: 614457

SEQ ID NO: 689438 - RNA, 60 nt, hsa; identical to SEQ ID NO: 614458

SEQ ID NO: 689439 - RNA, 60 nt, hsa; identical to SEQ ID NO: 614459

SEQ ID NO: 689440 - RNA, 60 nt, hsa; identical to SEQ ID NO: 614460

SEQ ID NO: 689441 - RNA, 60 nt, hsa; identical to SEQ ID NO: 614461

SEQ ID NO: 689442 - RNA, 60 nt, hsa; identical to SEQ ID NO: 614462

SEQ ID NO: 689443 - RNA, 60 nt, hsa; identical to SEQ ID NO: 614463

SEQ ID NO: 689444 - RNA, 60 nt, hsa; identical to SEQ ID NO: 614464

SEQ ID NO: 689445 - RNA, 60 nt, hsa; identical to SEQ ID NO: 614465

SEQ ID NO: 689446 - RNA, 60 nt, hsa; identical to SEQ ID NO: 614466

SEQ ID NO: 689447 - RNA, 60 nt, hsa; identical to SEQ ID NO: 614467

SEQ ID NO: 689448 - RNA, 60 nt, hsa; identical to SEQ ID NO: 614468

SEQ ID NO: 689449 - RNA, 60 nt, hsa; identical to SEQ ID NO: 614469

SEQ ID NO: 689450 - RNA, 60 nt, hsa; identical to SEQ ID NO: 614470

SEQ ID NO: 689451 - RNA, 60 nt, hsa; identical to SEQ ID NO: 614471

SEQ ID NO: 689452 - RNA, 60 nt, hsa; identical to SEQ ID NO: 614472

SEQ ID NO: 689453 - RNA, 60 nt, hsa; identical to SEQ ID NO: 614473

SEQ ID NO: 689454 - RNA, 60 nt, hsa; identical to SEQ ID NO: 614474

SEQ ID NO: 689455 - RNA, 60 nt, hsa; identical to SEQ ID NO: 614475

SEQ ID NO: 689456 - RNA, 60 nt, hsa; identical to SEQ ID NO: 614476

SEQ ID NO: 689457 - RNA, 60 nt, hsa; identical to SEQ ID NO: 614477

SEQ ID NO: 689458 - RNA, 60 nt, hsa; identical to SEQ ID NO: 614478

SEQ ID NO: 689459 - RNA, 60 nt, hsa; identical to SEQ ID NO: 614479

SEQ ID NO: 689460 - RNA, 60 nt, hsa; identical to SEQ ID NO: 614480

SEQ ID NO: 689461 - RNA, 60 nt, hsa; identical to SEQ ID NO: 614481

SEQ ID NO: 689462 - RNA, 60 nt, hsa; identical to SEQ ID NO: 614482

SEQ ID NO: 689463 - RNA, 60 nt, hsa; identical to SEQ ID NO: 614483

SEQ ID NO: 689464 - RNA, 60 nt, hsa; identical to SEQ ID NO: 614484

SEQ ID NO: 689465 - RNA, 60 nt, hsa; identical to SEQ ID NO: 614485

SEQ ID NO: 689466 - RNA, 60 nt, hsa; identical to SEQ ID NO: 614486

SEQ ID NO: 689467 - RNA, 60 nt, hsa; identical to SEQ ID NO: 614487

SEQ ID NO: 689468 - RNA, 60 nt, hsa; identical to SEQ ID NO: 614488

SEQ ID NO: 689469 - RNA, 60 nt, hsa; identical to SEQ ID NO: 614489

SEQ ID NO: 689470 - RNA, 60 nt, hsa; identical to SEQ ID NO: 614490

SEQ ID NO: 689471 - RNA, 60 nt, hsa; identical to SEQ ID NO: 614491

SEQ ID NO: 689472 - RNA, 60 nt, hsa; identical to SEQ ID NO: 614492

SEQ ID NO: 689473 - RNA, 60 nt, hsa; identical to SEQ ID NO: 614493

SEQ ID NO: 689474 - RNA, 60 nt, hsa; identical to SEQ ID NO: 614494

SEQ ID NO: 689475 - RNA, 60 nt, hsa; identical to SEQ ID NO: 614495

SEQ ID NO: 689476 - RNA, 60 nt, hsa; identical to SEQ ID NO: 614496

SEQ ID NO: 689477 - RNA, 60 nt, hsa; identical to SEQ ID NO: 614497

SEQ ID NO: 689478 - RNA, 60 nt, hsa; identical to SEQ ID NO: 614498

SEQ ID NO: 689479 - RNA, 60 nt, hsa; identical to SEQ ID NO: 614499

SEQ ID NO: 689480 - RNA, 60 nt, hsa; identical to SEQ ID NO: 614500

SEQ ID NO: 689481 - RNA, 60 nt, hsa; identical to SEQ ID NO: 614501

SEQ ID NO: 689482 - RNA, 60 nt, hsa; identical to SEQ ID NO: 614502

SEQ ID NO: 689483 - RNA, 60 nt, hsa; identical to SEQ ID NO: 614503

SEQ ID NO: 689484 - RNA, 60 nt, hsa; identical to SEQ ID NO: 614504

SEQ ID NO: 689485 - RNA, 60 nt, hsa; identical to SEQ ID NO: 614505

SEQ ID NO: 689486 - RNA, 60 nt, hsa; identical to SEQ ID NO: 614506

SEQ ID NO: 689487 - RNA, 60 nt, hsa; identical to SEQ ID NO: 614507

SEQ ID NO: 689488 - RNA, 60 nt, hsa; identical to SEQ ID NO: 614508

SEQ ID NO: 689489 - RNA, 60 nt, hsa; identical to SEQ ID NO: 614509

SEQ ID NO: 689490 - RNA, 60 nt, hsa; identical to SEQ ID NO: 614510

SEQ ID NO: 689491 - RNA, 60 nt, hsa; identical to SEQ ID NO: 614511

SEQ ID NO: 689492 - RNA, 60 nt, hsa; identical to SEQ ID NO: 614512

SEQ ID NO: 689493 - RNA, 60 nt, hsa; identical to SEQ ID NO: 614513

SEQ ID NO: 689494 - RNA, 60 nt, hsa; identical to SEQ ID NO: 614514

SEQ ID NO: 689495 - RNA, 60 nt, hsa; identical to SEQ ID NO: 614515

SEQ ID NO: 689496 - RNA, 60 nt, hsa; identical to SEQ ID NO: 614516

SEQ ID NO: 689497 - RNA, 60 nt, hsa; identical to SEQ ID NO: 614517

SEQ ID NO: 689498 - RNA, 60 nt, hsa; identical to SEQ ID NO: 614518

SEQ ID NO: 689499 - RNA, 60 nt, hsa; identical to SEQ ID NO: 614519

SEQ ID NO: 689500 - RNA, 60 nt, hsa; identical to SEQ ID NO: 614520

SEQ ID NO: 689501 - RNA, 60 nt, hsa; identical to SEQ ID NO: 614521

SEQ ID NO: 689502 - RNA, 60 nt, hsa; identical to SEQ ID NO: 614522

SEQ ID NO: 689503 - RNA, 60 nt, hsa; identical to SEQ ID NO: 614523

SEQ ID NO: 689504 - RNA, 60 nt, hsa; identical to SEQ ID NO: 614524

SEQ ID NO: 689505 - RNA, 61 nt, hsa
cuuauuuauaaauauuguaaguuugugucgaugaguguaaguuggcagugcgcacgucucg

SEQ ID NO: 689506 - RNA, 61 nt, hsa
cuuuuguaaugccauuuucuaaacuuauuucugaguguagucucagcuuaaaguuguguaa

SEQ ID NO: 689507 - RNA, 61 nt, hsa
augaaccagcccuuucucagagccagugaugugaguguaucagaaugccagggagggcacc

SEQ ID NO: 689508 - RNA, 61 nt, hsa
gaaaacaaaauguuauuuuuauaccauaacuugaguguauugccaaaauuuggaaauccuu

SEQ ID NO: 689509 - RNA, 61 nt, hsa
aggauuacaggcaugagccacugcgcccggcugaguguacuaguaguuaagagaauaaacu

SEQ ID NO: 689510 - RNA, 61 nt, hsa
caggccacaggagacuccgcuuuuacuucccugaguguaggucuuccugaaacucucaagc

SEQ ID NO: 689511 - RNA, 52 nt, hsa
uauuuuauaagaaauuauagagugaguguauuuuccuuguguauauauuaaa

SEQ ID NO: 689512 - RNA, 61 nt, hsa
acucuuaaaaaaaccaaacaaaacucguaucugaguguaacuuugccaauauuuuaaaagc

SEQ ID NO: 689513 - RNA, 61 nt, hsa
cccaguguuuuguuagaauaauguaguuaggugaguguaaauaaauuuauauaaagugaga

SEQ ID NO: 689514 - RNA, 61 nt, hsa
auauagaugucuguguauacauauguaugugugaguguauguauacacacacacacacaca

SEQ ID NO: 689515 - RNA, 61 nt, hsa
uggguagcucuugcuuuaauauucuguuuggugaguguaagggauucugcaagggacaggg

SEQ ID NO: 689516 - RNA, 61 nt, hsa
gguagccauccaucagugcuuuuaguuauuaugaguguaggacacugagccauccgugggu

SEQ ID NO: 689517 - RNA, 61 nt, hsa
gaaauauaauucuagguauuugauaggguauugaguguauuuuguguguguguggaugugu

SEQ ID NO: 689518 - RNA, 61 nt, hsa
agacaucuccagugugccagacaaauaggagugaguguaugugugugugugugugugugug

SEQ ID NO: 689519 - RNA, 61 nt, hsa
uaguuuucagugaucagaagcagcaguuauuugaguguaugaauggaaugaugaucacugu

SEQ ID NO: 689520 - RNA, 61 nt, hsa
uugauauuugaaauucuucuguaagccugucugaguguauguggaaacgauugucaaaucu

SEQ ID NO: 689521 - RNA, 61 nt, hsa
uauaauaaaaauguuaaccagaagguaaacuugaguguaauugucagacagacacacuuuu

SEQ ID NO: 689522 - RNA, 61 nt, hsa
ggaugaauggguuucuauauaugggucugugugaguguaugugugugugugauuuuuuuuu

SEQ ID NO: 689523 - RNA, 61 nt, hsa
guaucaacacuuacaagcucuacacagucugugaguguagauacuacuuacucguaggauu

SEQ ID NO: 689524 - RNA, 61 nt, hsa
ugauucugaagcuaaagagcuuucauccucuugaguguauguccccauagugggccccuug

SEQ ID NO: 689525 - RNA, 61 nt, hsa
uguucaugagggcaucugguguuuaugugucugaguguagcuuuguauuuaugugugugug

SEQ ID NO: 689526 - RNA, 61 nt, hsa
aacuacgcugauuugaucuuuacaaauuauaugaguguaugaauuugucacauguaucacc

SEQ ID NO: 689527 - RNA, 61 nt, hsa
cuccagauuuucuucuuuaugugcaucgacuugaguguaaacauaacuuauaugcacuggg

SEQ ID NO: 689528 - RNA, 61 nt, hsa
ucauuacaucaaggagcugccccugucagggugaguguaauuaggaacgauaccagcacau

SEQ ID NO: 689529 - RNA, 61 nt, hsa
cuguauuaacacaucacuugcuguuuccuacugaguguaccacugccuucccuucuagccc

SEQ ID NO: 689530 - RNA, 61 nt, hsa
ucuugguuaaaaggccacugguagagucaucugaguguagagaaugucccuucacugcugg

SEQ ID NO: 689531 - RNA, 61 nt, hsa
aaaacuugacuggaacaugccucugcauuucugaguguagaaauuaaaugaagccacucac

SEQ ID NO: 689532 - RNA, 61 nt, hsa
uguagcuauuuuuuguugcuuggcuuuugaaugaguguaaauuguuuucuuuuguguauuu

SEQ ID NO: 689533 - RNA, 61 nt, hsa
uaccauuccaggagugucuaaagccgagcuuugaguguacaugauugauaggacuugaaga

SEQ ID NO: 689534 - RNA, 61 nt, hsa
ccagauauuacugagaagaguguauugacucugaguguaagagaguauguguuuuuuuguu

SEQ ID NO: 689535 - RNA, 61 nt, hsa
aauuuuuacccuaaugucuucauaaaguacuugaguguaauguuuguuaccuccaacagaa

SEQ ID NO: 689536 - RNA, 61 nt, hsa
gggacccuccauuucucccccucacccaugcugaguguagagccggggccuggguggcggg

SEQ ID NO: 689537 - RNA, 61 nt, hsa
uugcucuuuuguguuucauugccuugauguuugaguguaaucuagcauuuuaauacagugu

SEQ ID NO: 689538 - RNA, 61 nt, hsa
gauuuaaucaccauaaaccauaccuauuuaaugaguguauucugugcaauuuuuuucucag

SEQ ID NO: 689539 - RNA, 61 nt, hsa
cucccuuccugaaccuaaugaagugccagagugaguguacacuuucuuuucucucaucucu

SEQ ID NO: 689540 - RNA, 61 nt, hsa
uuggugugcuaccuauucuugagagagugagugaguguauguguuuaaaggaaacaaaaug

SEQ ID NO: 689541 - RNA, 61 nt, hsa
uauauggcucuuucuauccaugcagugauagugaguguaaaaucugcuuacuucacuauug

SEQ ID NO: 689542 - RNA, 61 nt, hsa
uuuuuuccuaaggauaaaguaccuuugagcaugaguguaucacagcuuucauuaggaaaac

SEQ ID NO: 689543 - RNA, 61 nt, hsa
agggcuguugauuuaugcuuuaacuucagagugaguguagggguggugaugcuaccauuac

SEQ ID NO: 689544 - RNA, 61 nt, hsa
gagacuagacuacuguuguccagggucaauuugaguguaaagaaaauguagacaaggaauu

SEQ ID NO: 689545 - RNA, 61 nt, hsa
ggggcuagcccuaccugauacccugugucaaugaguguaccuuggagagcuauccacucag

SEQ ID NO: 689546 - RNA, 61 nt, hsa
uuccaguuuggccuuaugcuucaugcagacuugaguguaugcaggauuucauuaucugccu

SEQ ID NO: 689547 - RNA, 61 nt, hsa
ucugugaaacccuuggguccuggaagcagugugaguguaaauguguaguguuugguuucau

SEQ ID NO: 689548 - RNA, 61 nt, hsa
cuauucuuugagucauuguuacugaggcaguugaguguaaggagcuggcugcaguuuauuc

SEQ ID NO: 689549 - RNA, 61 nt, hsa
aaaaauggaugucaagauguuauguaaaagaugaguguaauugugaaauguucuauacacu

SEQ ID NO: 689550 - RNA, 61 nt, hsa
uuuuagaauugcccagugcugccagagugagugaguguaauucuccuuucagguaaagaua

SEQ ID NO: 689551 - RNA, 61 nt, hsa
gcuggaaccaccaaggaguguggaauguccuugaguguauuauuuaugcaagucacaguca

SEQ ID NO: 689552 - RNA, 61 nt, hsa
ucccuuuaauguguucauguuaaaaccuauuugaguguaagacuugcccuuucuaacaaua

SEQ ID NO: 689553 - RNA, 61 nt, hsa
ggcuuaccuccucauggcagccuacucuccuugaguguaugaguagccaggguaaggggua

SEQ ID NO: 689554 - RNA, 61 nt, hsa
ccaaagacaaaaugugcccacugugugcuuuugaguguauuuucuuuuaguuuguuuuuug

SEQ ID NO: 689555 - RNA, 61 nt, hsa
agaacaaaaaaagaguuaaaaaauucugauaugaguguaauauacuuaauauguaggaugu

SEQ ID NO: 689556 - RNA, 61 nt, hsa
ccugccaguuuugcugacucucaacuugucaugaguguaagcauuaaggacauuaugcuuc

SEQ ID NO: 689557 - RNA, 61 nt, hsa
aaagcuccuguucugcaggcaucaggaaaguugaguguaagauggaaaaagcaaacagccu

SEQ ID NO: 689558 - RNA, 61 nt, hsa
ugaaagaaguucagauuggcauuugaaguauugaguguaugggaucucuaaggauuucuua

SEQ ID NO: 689559 - RNA, 61 nt, hsa
agagaaacuucgcuaaccaacuguucuuucuugaguguauagccccaucuugugguaacuu

SEQ ID NO: 689560 - RNA, 61 nt, hsa
uuuugccacauacauagaucuucaugaugugugaguguaauuccauguggauaucaguuac

SEQ ID NO: 689561 - RNA, 61 nt, hsa
uuuuuggauucagggcuccucacaauuaaaaugaguguaaugaaacaaggugaaaauauag

SEQ ID NO: 689562 - RNA, 61 nt, hsa
uaccuaagugugaaugucucucccguuaaacugaguguagaaaucugaauuuuuaaaagag

SEQ ID NO: 689563 - RNA, 61 nt, hsa
ggcuuuugugcucccauacgcccccugguggugaguguaaagaagacuuugccucucacaa

SEQ ID NO: 689564 - RNA, 61 nt, hsa
uuuugcaucagcauagauguaaacacaauugugaguguaugauguagguaaaaauauauac

SEQ ID NO: 689565 - RNA, 61 nt, hsa
uaucauuaaagauguauguauaaaaaaaaaaugaguguauaucaaguuguucauuucuuag

SEQ ID NO: 689566 - RNA, 61 nt, hsa
ucugucauguaguuucaacaagugcuaccuuugaguguaaacuaagguagacuacuuuggg

SEQ ID NO: 689567 - RNA, 61 nt, hsa
uauuccacagaaggccucuagccagagaucuugaguguagugcaagggacucauuuuuugc

SEQ ID NO: 689568 - RNA, 61 nt, hsa
agcaaaauaauuaauugagaguauuuuuuagugaguguaauguauaauguacguaugcaaa

SEQ ID NO: 689569 - RNA, 61 nt, hsa
aguuugaaggcugcacacugacauaauguagugaguguagacuggccaugcaagugguuug

SEQ ID NO: 689570 - RNA, 61 nt, hsa
cauuaugcgcuguggccacuccaauaggugcugaguguacagaguggaauaagacagagac

SEQ ID NO: 689571 - RNA, 61 nt, hsa
aguuauucuuauaaaagcaaacaggcaaacaugaguguaaauuaaagacaaaaagaaaacu

SEQ ID NO: 689572 - RNA, 61 nt, hsa
aguauaaggauuuuuuugcauuucuuuacacugaguguaaaacucuacaaagaguuauagu

SEQ ID NO: 689573 - RNA, 61 nt, hsa
acuauacuaggcuaagcccucuuaauagccaugaguguaaaauuuaguuuacucauuuuuc

SEQ ID NO: 689574 - RNA, 61 nt, hsa
ugagacuuccugaguugauuagaaagcuguaugaguguaccuacccuagucucagaagcau

SEQ ID NO: 689575 - RNA, 61 nt, hsa
ccaaaugauaaaaaaaacugcucccugcacaugaguguaaaaacauguuuguaauuuuaag

SEQ ID NO: 689576 - RNA, 61 nt, hsa
auuugagcaaguaaaauaguaaagcacauagugaguguauguccgucuaacugguacauug

SEQ ID NO: 689577 - RNA, 61 nt, hsa
uugaucuguguuuuacuuuauuguguuuucuugaguguaaagaaagaauaaaucaaaguuc

SEQ ID NO: 689578 - RNA, 61 nt, hsa
cagccuguuaauuauaagaaacucagaauaaugaguguaaauguguuauguuauccaccca

SEQ ID NO: 689579 - RNA, 61 nt, hsa
auuuuauacaguauuuguuuuguuuugguuuugaguguauauaaugcagcauuagcaauau

SEQ ID NO: 689580 - RNA, 61 nt, hsa
uguuuuccuguuugaugcugucuauuugcauugaguguaagucauuugaacuaaugguaua

SEQ ID NO: 689581 - RNA, 61 nt, hsa
guguguauguauauguacauauacauauauaugaguguauaauucuaaauuucuaaaaacu

SEQ ID NO: 689582 - RNA, 61 nt, hsa
auguguguuguugauguucuauguuuuguuuugaguguagccugacuguuuuauaauuugg

SEQ ID NO: 689583 - RNA, 61 nt, hsa
uguaauaaugaugucaauuucaugaaaagccugaguguauugcaucucuugauuuaaucau

SEQ ID NO: 689584 - RNA, 61 nt, hsa
accgguuuggcuggcuuguuugauuucaacaugaguguauuuuuuaaaauugauuuuucuc

SEQ ID NO: 689585 - RNA, 61 nt, hsa
caugaauguauguaguguguaggcacuguagugaguguauauaugcuccacacuacgucug

SEQ ID NO: 689586 - RNA, 61 nt, hsa
acugaauuacgcauaagaagcaugcacugccugaguguauauuuuggauucuuaugagcca

SEQ ID NO: 689587 - RNA, 61 nt, hsa
accaggaaauuuauauuggagaaaaacccuaugaguguaaugaauuuggaaaaauauuuuu

SEQ ID NO: 689588 - RNA, 61 nt, hsa
gcugggcccagccccuccacgugauuuccagugaguguaaauaauuuuaaauaaccucugg

SEQ ID NO: 689589 - RNA, 61 nt, hsa
ucuggccccauccaggcaaccaaauaaaguuugaguguaccaggaacagaauccuggggcu

SEQ ID NO: 689590 - RNA, 61 nt, hsa
aucuuccuugggauauauggucauccucuaaugaguguaaaagugcgcaaaacacauccuu

SEQ ID NO: 689591 - RNA, 61 nt, hsa
ucguccuucagccccaucaugugcuuugggaugaguguaaauaaaacggggcuguggcuug

SEQ ID NO: 689592 - RNA, 61 nt, hsa
caucauaaaggaaccuaagugagguauaugaugaguguauugucuuugcacacacauauag

SEQ ID NO: 689593 - RNA, 61 nt, hsa
gaaaugcaaacuuaaacauauucuguucacuugaguguaauacuugaugcaugcacacaca

SEQ ID NO: 689594 - RNA, 61 nt, hsa
aucugaauuguauagauauaugauuuucuagugaguguauguuaggaacaaaagacaaaau

SEQ ID NO: 689595 - RNA, 61 nt, hsa
guauguuuguuaacaguuacauauguuuguaugaguguauauauauaucugugugugugua

SEQ ID NO: 689596 - RNA, 61 nt, hsa
aaacauauaaaauuuaccaucuuaaucacuuugaguguacaguucaucaguguuaacugua

SEQ ID NO: 689597 - RNA, 61 nt, hsa
uugccuauaauauauauuuaccgauaagcagugaguguaaaauuguuguagcuugaauaag

SEQ ID NO: 689598 - RNA, 61 nt, hsa
aggcucagcccugcuccugcagcuuugccgcugaguguaggaaaaacaggcaugacagacc

SEQ ID NO: 689599 - RNA, 61 nt, hsa
auagaugcacacauaucuguacauauacaugugaguguacauauauacacauauacacauc

SEQ ID NO: 689600 - RNA, 61 nt, hsa
uaucauuuuagggguguugacacaccaguuuugaguguacugugccugguuugauuuuuuu

SEQ ID NO: 689601 - RNA, 61 nt, hsa
cagcuauauuguauuacaaaguaaaaauauaugaguguauugaaaacaaaguuguuuuaac

SEQ ID NO: 689602 - RNA, 61 nt, hsa
cagauuguguuacucaugaucugcuugacugugaguguacaggagaagaaguucauacagg

SEQ ID NO: 689603 - RNA, 61 nt, hsa
uucaacaauugcacaucuucauucucccaacugaguguaguauguggagcauaaaacagca

SEQ ID NO: 689604 - RNA, 61 nt, hsa
uuuuuuuuuuuuaacaaauugaguuuagaagugaguguaauccagcaauacaguuuacugg

SEQ ID NO: 689605 - RNA, 61 nt, hsa
caguuauauccuccuuuuaaaccauuguuguugaguguaagauguccuucauguuuucuua

SEQ ID NO: 689606 - RNA, 61 nt, hsa
gcugagcgggcucugaguucuguacuggaauugaguguaaagaugggaagagaacugggcu

SEQ ID NO: 689607 - RNA, 61 nt, hsa
cuggugcuugcugugagacugagcugggcucugaguguaaacuacaugguagguugugaag

SEQ ID NO: 689608 - RNA, 61 nt, hsa
uuuaaauauagaaauaucauguuaaagaaagugaguguaucauuucuauuaacaguaauuu

SEQ ID NO: 689609 - RNA, 61 nt, hsa
gaacaacugcugauugaaacaccucauuagcugaguguagagaagugcaucuuaugaaaca

SEQ ID NO: 689610 - RNA, 61 nt, hsa
cuuaaucucacuucaucaaucaaauauuuuuugaguguaugcuguagcugaaagaguaugu

SEQ ID NO: 689611 - RNA, 61 nt, hsa
aagagaugugucuaaaacagcaucuuaaagcugaguguauuucuuugcacaaggggucaug

SEQ ID NO: 689612 - RNA, 61 nt, hsa
ucguauuucgaagcaaucuagacuguugugaugaguguaugucugaaccuguaauucuuaa

SEQ ID NO: 689613 - RNA, 61 nt, hsa
uguguauguuugcacacuugugugugggcugugaguguaagugugaguaagagcugguguc

SEQ ID NO: 689614 - RNA, 61 nt, hsa
ccaaaggucucucucuuucucucucuuuuuuugaguguagauuauuuuaaagcacuaauug

SEQ ID NO: 689615 - RNA, 61 nt, hsa
ccacccccuuacuacacccuagcagaucagcugaguguacuuuauuccaagaacuuacugg

SEQ ID NO: 689616 - RNA, 61 nt, hsa
ggauggcccugagcccagcggcuccucccgcugaguguauuucuucccaccacucagcgca

SEQ ID NO: 689617 - RNA, 61 nt, hsa
uuaacuuuuggcuaaacgacaugccuuggauugaguguauaugucuuccccaaauucauau

SEQ ID NO: 689618 - RNA, 61 nt, hsa
gguggauggggaggaugguugcacaacagugugaguguacuuaaugccacugcaacuguau

SEQ ID NO: 689619 - RNA, 61 nt, hsa
uacacagaguacccaagugaagagaacgucaugaguguaagugcaaaucaguggaaggagc

SEQ ID NO: 689620 - RNA, 61 nt, hsa
gucacugagugauaagcaugguugguuccggugaguguagggauggcacgauaccagggca

SEQ ID NO: 689621 - RNA, 61 nt, hsa
uccuuuguaccuguuuggggaaaaaguauaaugaguguacuaccaaucuaacuaagauuau

SEQ ID NO: 689622 - RNA, 61 nt, hsa
gggggugugcacgugccucuguguguguggcugaguguauucugcgcguguguguggaggg

SEQ ID NO: 689623 - RNA, 61 nt, hsa
uauaauagaggaaguauuguuaucccuagcaugaguguaauggugauaugaaaaacuuugu

SEQ ID NO: 689624 - RNA, 61 nt, hsa
ggaccuuuucuagauaugacuccaggacccuugaguguaaugcaaaaauuuggagaccagc

SEQ ID NO: 689625 - RNA, 61 nt, hsa
ccccagggugccagugacuacuucucccuggugaguguaaaccgucccgcccugaggcugg

SEQ ID NO: 689626 - RNA, 61 nt, hsa
uuuuuaaauauuuguugccuuuuaaaaucccugaguguaaguuaccaugguggcagcuuag

SEQ ID NO: 689627 - RNA, 61 nt, hsa
cugcuuugggguuccuggggugggcuuggggugaguguaguucuggccuagcagcacccuc

SEQ ID NO: 689628 - RNA, 61 nt, hsa
gugguucaucauggugacagcaugaaaggaaugaguguaugaaaaggugaaggugggagca

SEQ ID NO: 689629 - RNA, 50 nt, hsa
acaugcccaaacguguguagugaguguaggagauaacuguauauaggcua

SEQ ID NO: 689630 - RNA, 61 nt, hsa
gagcugcuuucaauaucuagaaauuuuuaauugaguguaaacacaccuaacuuuaagaaaa

SEQ ID NO: 689631 - RNA, 61 nt, hsa
aguagguguuaaaaacucauaucccuuaaacugaguguagggaaugggauauugacagaau

SEQ ID NO: 689632 - RNA, 61 nt, hsa
cucaucucuacuaaaaauacaaaaaauuagcugaguguagugacgcaugcccucaauccca

SEQ ID NO: 689633 - RNA, 61 nt, hsa
cugugacuguuuuucucuguuucacguucguugaguguaagcaaugaaaaugucccaaaua

SEQ ID NO: 689634 - RNA, 61 nt, hsa
aguguuuagcuucaagacuggaaagggaauaugaguguaaguuuacuauauauaaagcuaa

SEQ ID NO: 689635 - RNA, 61 nt, hsa
aagagucuagagugguuuuugcagcauggguugaguguacaaagccuacugugcgugagau

SEQ ID NO: 689636 - RNA, 61 nt, hsa
guagucuaacagaagaaaauguaaaauuauuugaguguaaauaauagaugucaguauuuau

SEQ ID NO: 689637 - RNA, 61 nt, hsa
cagagaggagagagaccaaccauauuugggaugaguguaaaagcuuucagaaauaaguuac

SEQ ID NO: 689638 - RNA, 61 nt, hsa
gcaguguguaaaaagaaagagccugacagaaugaguguaggaaggaagagaaaugaugcua

SEQ ID NO: 689639 - RNA, 61 nt, hsa
auuuauagaaacaucauucgauauugcuacuugaguguaaggcuaauauugauauuuauga

SEQ ID NO: 689640 - RNA, 61 nt, hsa
gugggcaucagacucagcgugggcugagugcugaguguaacuuacacuccuaaaucaagcu

SEQ ID NO: 689641 - RNA, 61 nt, hsa
ucccgccaucugcugcaggcaggaaggcaugugaguguacguuuucuuccaggagacauca

SEQ ID NO: 689642 - RNA, 61 nt, hsa
gcaaaauuuuaaggcuuuugauacuucguuaugaguguauuuuugagauauuuuccacuug

SEQ ID NO: 689643 - RNA, 61 nt, hsa
uucaccagugacagaugguuuccccauccacugaguguagcauccucagagguaggcaagu

SEQ ID NO: 689644 - RNA, 61 nt, hsa
guaucuaacuaucaaauuguguuuaguaacuugaguguaugcacaaguuugaucaacagca

SEQ ID NO: 689645 - RNA, 61 nt, hsa
aauuuagaauggauauuuugacgaaucggcaugaguguaacagugauaaccugaucuguuu

SEQ ID NO: 689646 - RNA, 61 nt, hsa
aaagugccacauuuggcaguacaaaugagucugaguguaauagcccagagauuuauauaua

SEQ ID NO: 689647 - RNA, 61 nt, hsa
aauaaagaccuuggagcauaugugcaacuuaugaguguaucaguuguugcauguaauuuuu

SEQ ID NO: 689648 - RNA, 61 nt, hsa
aaccauucugcuugguuccacaaucaucuauugaguguacauuuaugugugaagcaaauuu

SEQ ID NO: 689649 - RNA, 61 nt, hsa
uauauaggggaacaucacccuauauauaauuugaguguauauauauuuauauauaugaugu

SEQ ID NO: 689650 - RNA, 61 nt, hsa
uagcuguuauuaaugccuuuuuguuuuccauugaguguacacuacugaauaaguguaggag

SEQ ID NO: 689651 - RNA, 61 nt, hsa
gaggucacauaacacauaaaauuaguuucuaugaguguauaccauuuaaagaauuuuuuuu

SEQ ID NO: 689652 - RNA, 61 nt, hsa
ucuagagacucuaaaaacuaaccaaacuuggugaguguauucuuauauuaagaauaucuua

SEQ ID NO: 689653 - RNA, 61 nt, hsa
ggaagaauagccuauugucuuucauuuugccugaguguauuuuacuauuugggcucugaaa

SEQ ID NO: 689654 - RNA, 61 nt, hsa
uauuuuguuuuugauuuuuuuuuuccuccccugaguguaugcuuaguuguugaguauauau

SEQ ID NO: 689655 - RNA, 61 nt, hsa
cuaacuugauugauaaagauccugccucugcugaguguaccugacaguagucuaagaugag

SEQ ID NO: 689656 - RNA, 61 nt, hsa
aguagcgcuguuggccaggaggugucaggugugaguguauucugccagcuuuucaugcugu

SEQ ID NO: 689657 - RNA, 61 nt, hsa
caggcuauugcuauccuaauguaugucucuaugaguguauuuagccacacaucugcccuug

SEQ ID NO: 689658 - RNA, 61 nt, hsa
ugugugcaugucuguauguguguuggggcggugaguguaaggaugcagugggagcauggau

SEQ ID NO: 689659 - RNA, 61 nt, hsa
cucugagccccugaucugaagccagaagggcugaguguauuguaaacuuauucuugcaugu

SEQ ID NO: 689660 - RNA, 61 nt, hsa
uuuugccuucauuuuugaaaguaguuuuugcugaguguauacauuuuuggcuuuacaguuu

SEQ ID NO: 689661 - RNA, 61 nt, hsa
auauauaaguauuauucaugguuccaagcaaugaguguaauguauuuucucccaauaguaa

SEQ ID NO: 689662 - RNA, 61 nt, hsa
uuuuguguuuuaauuuuuuuuaauuucucucugaguguacauacaacauacucaagcggga

SEQ ID NO: 689663 - RNA, 61 nt, hsa
aauaagcuauguguccaggguauugcuccccugaguguauaugagugcugaguaguauugc

SEQ ID NO: 689664 - RNA, 61 nt, hsa
gcaagagcugucuguccucccugcaggaggcugaguguaaagaguaucauucauuguuucu

SEQ ID NO: 689665 - RNA, 61 nt, hsa
ugaagcucagccuguuaaucagaccagcccaugaguguauaacaaacagaauuggaggcug

SEQ ID NO: 689666 - RNA, 61 nt, hsa
cuuuuauaccgcugcauaguauuccauugugugaguguaccauaauguauuuaaccagucu

SEQ ID NO: 689667 - RNA, 61 nt, hsa
uaguucuguguagagaaugucacuguaguuuugaguguauacaugugugggugcugauaau

SEQ ID NO: 689668 - RNA, 61 nt, hsa
guacuuguaaacagaaauuugcguauaaaugugaguguauuauaaaguuugagauguugau

SEQ ID NO: 689669 - RNA, 61 nt, hsa
cuguucagaacuguuuaauagcaguuacucuugaguguauuuaccuuuuuauguuuuuuaa

SEQ ID NO: 689670 - RNA, 61 nt, hsa
uaugauuaugauuuuuauaaauggcauaacaugaguguacuaacuaccuucuaugcuggcc

SEQ ID NO: 689671 - RNA, 61 nt, hsa
auucaguggacaaucaggagaagcuucuguaugaguguaccaucucugccuccucuccuuu

SEQ ID NO: 689672 - RNA, 61 nt, hsa
gccaauggcuggcuuuuucuacacccucuuuugaguguaguuugguauuuuguaauugaga

SEQ ID NO: 689673 - RNA, 61 nt, hsa
aguugucccacugccauucaaagucagcccuugaguguauuuguucucaguccuaacccug

SEQ ID NO: 689674 - RNA, 61 nt, hsa
guauguuggauauugugguguuuuagaucacugaguguacagaagagagaaauucaaacaa

SEQ ID NO: 689675 - RNA, 61 nt, hsa
ucaguucccuucccugcuguucuauuuccuuugaguguaaagacucacaggugaccugcua

SEQ ID NO: 689676 - RNA, 61 nt, hsa
ucccaagcccagggacuggcuucucuuucucugaguguaguuauguaucuggguucuaacc

SEQ ID NO: 689677 - RNA, 61 nt, hsa
ucaaugucagauaccaagaguuguguuaagcugaguguaguguguaacuaacuacacuugg

SEQ ID NO: 689678 - RNA, 61 nt, hsa
cucugacccaccggcagcgagugcgcaggugugaguguaaguucauguaggagaguguaug

SEQ ID NO: 689679 - RNA, 61 nt, hsa
uguauggggcaggacagacagacuaauguagugaguguagcuguagcugaggcuuaacugg

SEQ ID NO: 689680 - RNA, 61 nt, hsa
uguggcccgugacccucguuauuguuacagcugaguguauguuuuuguucuguggagaaug

SEQ ID NO: 689681 - RNA, 61 nt, hsa
ugaccuuugucaguguccuuuuuaagacaagugaguguaagggucaaugugcuugcuugga

SEQ ID NO: 689682 - RNA, 61 nt, hsa
aucauucaauaacccugaagaauuugguuccugaguguacaaacucagagcccggaagcca

SEQ ID NO: 689683 - RNA, 61 nt, hsa
aaagucgcaucgcuaaugauauuugccaaguugaguguacacaaaguuucucauauccugu

SEQ ID NO: 689684 - RNA, 61 nt, hsa
caaugguaggaaaaaaggaucucaaauagcaugaguguaugucuauauccugaaauuuauu

SEQ ID NO: 689685 - RNA, 61 nt, hsa
uaacuuuuuauagcaagaugauacaaugguaugaguguaaucuaaacuuccuugugguauu

SEQ ID NO: 689686 - RNA, 61 nt, hsa
guggcuuuuuuccaacuccgugugacguuucugaguguagugugguaggaccccggcgggu

SEQ ID NO: 689687 - RNA, 61 nt, hsa
gaaacucugggagcuucuagaagaaaucuacugaguguauuucuguuuuuuguuuaauucc

SEQ ID NO: 689688 - RNA, 61 nt, hsa
augaaaaaucuuacacuggagagaaacccuaugaguguaagcaaugugggaaagccuuugu

SEQ ID NO: 689689 - RNA, 61 nt, hsa
augaaaggacucacacuggagagaaccccuaugaguguaagcaauuugggaaagccuucag

SEQ ID NO: 689690 - RNA, 61 nt, hsa
augaaaggacucacaugggagagaaacccuaugaguguaugccaagugggaaagccuucau

SEQ ID NO: 689691 - RNA, 61 nt, hsa
cuaaaaggacucacaguggagaaaaacucuaugaguguaagcaaugugggaaagucuucag

SEQ ID NO: 689692 - RNA, 61 nt, hsa
augaaaggacucacacuggagagaaacccuaugaguguaagcaaugugggaaagccuucag

SEQ ID NO: 689693 - RNA, 61 nt, hsa
gcaugguaggacucacuggagagaaacccuaugaguguaaggaaugugggaaagccuucag

SEQ ID NO: 689694 - RNA, 61 nt, hsa; identical to SEQ ID NO: 689692

SEQ ID NO: 689695 - RNA, 61 nt, hsa
augguagaacucacacuggagagaaacccuaugaguguaaggaaugugggaaagccuucag

SEQ ID NO: 689696 - RNA, 61 nt, hsa
cugaaaaaucuuacacuggagagaaacccuaugaguguaagcaaugugggaaagccuuuau

SEQ ID NO: 689697 - RNA, 61 nt, hsa
augaaaggacucacacuggagagaaacccuaugaguguaagcaauguggaaaaaccuucag

SEQ ID NO: 689698 - RNA, 61 nt, hsa
gcugauugaagcaggccuugaugagggugcaugaguguauguuugcauucacaugaaggaa

SEQ ID NO: 689699 - RNA, 61 nt, hsa
cuggucauuucuagagacagcaaucaauauuugaguguaaggaaacugucuggggugauuc

SEQ ID NO: 689700 - RNA, 61 nt, hsa
uuugccuauugaaauaaugcugcuaugaagaugaguguacaagugucuauucaagauucua

SEQ ID NO: 689701 - RNA, 61 nt, hsa
aucagagaauucacacuggugaaaggccuuaugaguguagugaaugugggaaauucuuuag

SEQ ID NO: 689702 - RNA, 61 nt, hsa
uuagaggcagcagacagaauuacugaggaauugaguguaagaguggaauaaaguuaucaag

SEQ ID NO: 689703 - RNA, 61 nt, hsa
aggcgguggacugaaggcaugagaugcccuuugaguguacagcaaaucaauguuuuccugc

SEQ ID NO: 689704 - RNA, 61 nt, hsa
augaaaguacucacacuggagauaaacccuuugaguguaaaaaauguggaaaagcauuuag

SEQ ID NO: 689705 - RNA, 61 nt, hsa
auaaaacaacucacagagcagaaaaacucugugaguguaaaauauguagggaagccuucag

SEQ ID NO: 689706 - RNA, 61 nt, hsa
auuuugggggccagagguguaauguuuuggcugaguguaugccaccucagauucauauguu

SEQ ID NO: 689707 - RNA, 61 nt, hsa
cagcuggaggcuuggaacaugugggucccuaugaguguagagcccauauccccauagaguc

SEQ ID NO: 689708 - RNA, 57 nt, hsa
acagaauucauacugguuagaaagccuugaguguaagggauaaagauaagccuuuau

SEQ ID NO: 689709 - RNA, 61 nt, hsa
gcacuacgacuugcaggccacccauuccaacugaguguagucggcucaacacccuccaccu

SEQ ID NO: 689710 - RNA, 61 nt, hsa
uauagcguuuaggcauuucuugaccaucuaaugaguguaaaacuguaccacugggccaagu

SEQ ID NO: 689711 - RNA, 61 nt, hsa
cugugguugggccugaggccuguggaggaggugaguguagccagcagcggccgucuacucc

SEQ ID NO: 689712 - RNA, 61 nt, hsa
ucauguaagugcauauacacauacacacacaugaguguagacauguguuuauuaauugaca

SEQ ID NO: 689713 - RNA, 61 nt, hsa
ugcuguaggugauuauccaaacaaguaaauuugaguguauaauuuaauuuuuaaccuguua

SEQ ID NO: 689714 - RNA, 61 nt, hsa
aaauuggacaauggcucuuuagagaguuaucugaguguaaguaaauuaauguucucauuua

SEQ ID NO: 689715 - RNA, 61 nt, hsa
ugcaggccgguggguccacuccaacucccccugaguguagcagcacacuuuccauacacca

SEQ ID NO: 689716 - RNA, 61 nt, hsa
ucuggcgaaaccuucguuugagggacugaugugaguguauguccaccucacugguggcacc

SEQ ID NO: 689717 - RNA, 61 nt, hsa
uggagguucuguauuuuaagaaacagugcguugaguguacagauuuuauuuaugcguaauu

SEQ ID NO: 689718 - RNA, 61 nt, hsa
gauggcgguaggagagaaaagugaagaggcgugaguguaagaacugggagauuccuuuucc

SEQ ID NO: 689719 - RNA, 61 nt, hsa
uaucuuuauaaaagaaugauuuauauuccuuugaguguauacccaguaaugggauugcugg

SEQ ID NO: 689720 - RNA, 61 nt, hsa
uugauaccuuugcggucaugucugugucugaugaguguagaaucucuggaugugcacuguc

SEQ ID NO: 689721 - RNA, 61 nt, hsa
uucugucucuggucuuucucuuugacccugcugaguguaagcugccuggggaggggcuaca

SEQ ID NO: 689722 - RNA, 61 nt, hsa
uuucuccacgacauagcauuauguacauagaugaguguaacauuuauaucucacauagaga

SEQ ID NO: 689723 - RNA, 61 nt, hsa
cucugauuuaugcugucacaaauugaaaaucugaguguaguuaggacaaaaaacaaagcua

SEQ ID NO: 689724 - RNA, 61 nt, hsa
uuucagguggucuuuuuugugucuggcuugcugaguguaaaaguuguuaucuggacgaucu

SEQ ID NO: 689725 - RNA, 61 nt, hsa
aguguggcuacaccguggcuuggucauagggugaguguaaacacccacaggacacuggggg

SEQ ID NO: 689726 - RNA, 61 nt, hsa
aagauuuuaaagagucccaaguuauuuaaguugaguguaauugucauuuaaggaaggcaaa

SEQ ID NO: 689727 - RNA, 61 nt, hsa
aaaccaccuuaaaacauuagugcuaugguuaugaguguaugugccaguacuuaccagucaa

SEQ ID NO: 689728 - RNA, 61 nt, hsa
acuguacaucuaaaaauauuacaguagaaucugaguguaauauguguaaccaaaaugagaa

SEQ ID NO: 689729 - RNA, 61 nt, hsa
uggcacauuuucuucaaaugcuaacauuuacugaguguacauugaaguucugugcauacag

SEQ ID NO: 689730 - RNA, 61 nt, hsa
uugcacagacacacacauauaucaauucucaugaguguauuauaaucucuggugggggcaa

SEQ ID NO: 689731 - RNA, 61 nt, hsa
cuggagguaaacaaagacuuugauccauguaugaguguauguguuuauguaacuuccugug

SEQ ID NO: 689732 - RNA, 61 nt, hsa
ccuuuuuauuucaguuuagccauguauuguaugaguguauuagucuaagcagugagaaucu

SEQ ID NO: 689733 - RNA, 61 nt, hsa
agcuuuuugguuuaauauccuguaaggcacgugaguguacacuuuuuuuuuuuuuaaggau

SEQ ID NO: 689734 - RNA, 61 nt, hsa
uuugccaccaacuggcccucuucuuacuugaugaguguaacaagaaaggagagucuugcag

SEQ ID NO: 689735 - RNA, 61 nt, hsa
uacgggcuaagguaggguagaguggguguagugaguguauauaaugugauuuggcccugug

SEQ ID NO: 689736 - RNA, 61 nt, hsa
ggcaagaggauucucugucaucucuggugacugaguguaaaauaugugccaagucugcagc

SEQ ID NO: 689737 - RNA, 61 nt, hsa
uacaaaaaaauuagccgggcaugguggcacgugaguguagucucagcuacucaggaggcug

SEQ ID NO: 689738 - RNA, 61 nt, hsa
uauuuaggggacugagaaagcacaggcuucaugaguguaaugaaaucucaccagaaguguc

SEQ ID NO: 689739 - RNA, 61 nt, hsa
guugaggaaagauaaaaauguaugcaauuccugaguguagaaacuucuugcacuuauuuaa

SEQ ID NO: 689740 - RNA, 64 nt, hsa
guaguggcuuucuggaugguaauuccaucuuaaggugucagaacuauuuucaaaugcugccuuu

SEQ ID NO: 689741 - RNA, 64 nt, hsa
ggugaugccccgucccagguugcacugcaaccaagugucagagucggggcuccggccuccugcc

SEQ ID NO: 689742 - RNA, 64 nt, hsa
ggauacuuugucauuaugaugaaguaaguguuaagugucagauaaauagcacacagaauaguuc

SEQ ID NO: 689743 - RNA, 64 nt, hsa
cuuucucuuugaaagcuggucaggaaugggagaagugucagacacuagagagccccuucugguc

SEQ ID NO: 689744 - RNA, 64 nt, hsa
uccccugggcugcccccugccccauccccuuugagugucagaagcacucugagccaaggggaca

SEQ ID NO: 689745 - RNA, 64 nt, hsa
ugcugcugccccauuugaucaagagaccauggaagugucagagauucagaauccaagauugucu

SEQ ID NO: 689746 - RNA, 64 nt, hsa
gcacccuuacagaucaaacaaugcuuagugaugugugucagaccucugagcccaagcaaagcca

SEQ ID NO: 689747 - RNA, 64 nt, hsa
uuggcaaaaggugcuuuaccuugagccauuauuugugucagagaacaaaagaaacagaaucaau

SEQ ID NO: 689748 - RNA, 64 nt, hsa
uuccagggcacaccuagacaaacaagggagaagagugucagaaucagaaucauggagaaaaugg

SEQ ID NO: 689749 - RNA, 64 nt, hsa
ucacucucagccauagcacuuuguucacuguccugugucagagcacugagcuccacccuuuucu

SEQ ID NO: 689750 - RNA, 64 nt, hsa
uaaauuugguacaaaaccacucgccagagcuguggugucagaaaaauaaaauauauuguuucuu

SEQ ID NO: 689751 - RNA, 64 nt, hsa
aacuugaggagaaaaccuuuacaauuuccuaugggugucagaaguacucucagcgaaaacugau

SEQ ID NO: 689752 - RNA, 64 nt, hsa
gaacucauucccugaacugauguaaaucuucauagugucagacauacugaccaaaaccacaauc

SEQ ID NO: 689753 - RNA, 64 nt, hsa
cuggucuuuggagucauggcacuguacgguuuuagugucagacagaccgggguucaaaucccag

SEQ ID NO: 689754 - RNA, 64 nt, hsa
gugucucccuccagcccagcccugaccucaggaagugucagagcauggccaguaguuggcagcc

SEQ ID NO: 689755 - RNA, 64 nt, hsa
ucggucuguccucagcguggcuuggacggggccugugucagaguggucagugcugaccccuggg

SEQ ID NO: 689756 - RNA, 64 nt, hsa
aggaugcucugguggagcugccgauggggcccuggugucagaacuccccaaaggccugugcguc

SEQ ID NO: 689757 - RNA, 59 nt, hsa
cuguggaugaagaagccuaagccccucuggugucagaaaccagggaaaacccuugucuu

SEQ ID NO: 689758 - RNA, 64 nt, hsa
ugcucauguuucuuaaggaaguagaguaguccuugugucagaacacauguuaauccacaaaacg

SEQ ID NO: 689759 - RNA, 64 nt, hsa
cuuuaagcucaugugucaggcagacuuuaccagagugucagacauuaccuaaaacacauacguu

SEQ ID NO: 689760 - RNA, 64 nt, hsa
uaaauaaaaaauauuaaauaaaacauggcaauaagugucagacuauuaggaauugagaaggggg

SEQ ID NO: 689761 - RNA, 64 nt, hsa
ucccugaauuccacgcaucugcuggaaacgagccgugucagaucgcacaucccugcgcccccau

SEQ ID NO: 689762 - RNA, 64 nt, hsa
accucguuugggaguguucugugggcuuggccuugugucagagcugggaguagcauggacucug

SEQ ID NO: 689763 - RNA, 64 nt, hsa
gcuucaaaaagugucccagagcccacacggcucggugucagauggugucaggcugucacggaca

SEQ ID NO: 689764 - RNA, 64 nt, hsa
caugggccuggacgacacggccucgcagcaaagugugucagacgagcagugacgggcgugcggc

SEQ ID NO: 689765 - RNA, 64 nt, hsa
gggaauuucaaugcguuuuguuguagaugcuaacgugucagaauccuuuacauucaacuuuucu

SEQ ID NO: 689766 - RNA, 64 nt, hsa
gcccaugucgggaaggaugugugcucugacagacgugucagaugcuggcagaagggauugguuu

SEQ ID NO: 689767 - RNA, 64 nt, hsa
gguauuuuguaaacguuagcagacuuuccugccagugucagaaaauccuauuuaugaauccugu

SEQ ID NO: 689768 - RNA, 64 nt, hsa
uucccuguuuuaaauuauaagaugucauccccuugugucagagacagaccccuuggcuuuugcu

SEQ ID NO: 689769 - RNA, 64 nt, hsa
aaguaacugguaugucacugaguaacuugacucggugucagagcauuuuaacuagccacucaga

SEQ ID NO: 689770 - RNA, 64 nt, hsa
aauauguuuuacuugaauguuacauuagauauuggugucagaauuuuaaaaccaaauuacugcu

SEQ ID NO: 689771 - RNA, 64 nt, hsa
ugcuccucuggcccaaggcaugaggagagaggcugugucagaaacugaagcuguucucaggauc

SEQ ID NO: 689772 - RNA, 64 nt, hsa
guagccuuuuagguggaagaagugagggugcagcgugucagacacaacauucauguuacucuua

SEQ ID NO: 689773 - RNA, 64 nt, hsa
ugaggcugcgcugcccgggaggccuuacugcuuggugucagacugcccagcucagagugcccgu

SEQ ID NO: 689774 - RNA, 64 nt, hsa
aagcccugagaugcucugucaccuucaaaggauggugucagagcagugccaccuccugucucag

SEQ ID NO: 689775 - RNA, 64 nt, hsa; identical to SEQ ID NO: 414348

SEQ ID NO: 689776 - RNA, 64 nt, hsa; identical to SEQ ID NO: 414349

SEQ ID NO: 689777 - RNA, 64 nt, hsa
cccaagugaaauuguuauaucgucugucuugcgugugucagaacuggguuuuuguggagguuca

SEQ ID NO: 689778 - RNA, 64 nt, hsa
gcaucacguaaauugguuuuguuugcuauucugugugucagaaccaacgaguguaauggagagg

SEQ ID NO: 689779 - RNA, 64 nt, hsa
agagggugggggaccuggcgggagcccugggguagugucagagcgggagugaggcuggugcagg

SEQ ID NO: 689780 - RNA, 64 nt, hsa
uuuagaugagaugaaaaacuuaauuaaaucugaagugucagaggcgcuuaguaagccuuaguaa

SEQ ID NO: 689781 - RNA, 64 nt, hsa
auuuuagguauuuucauuauaugaaagcuaccaugugucagagaugauuuaaucuauuuaagug

SEQ ID NO: 689782 - RNA, 64 nt, hsa
uucaguuucauucaaauguuaccuaaaauuuauggugucagaauaaagggagaucauagugagu

SEQ ID NO: 689783 - RNA, 64 nt, hsa
auaguaaguggugagaacuacucagggaaugaaggugucagaauaauaagaggugcuacugacu

SEQ ID NO: 689784 - RNA, 64 nt, hsa
gauaagcuuguauugaccuaauuugguuuaugaugugucagagcuaauucauguucagggugag

SEQ ID NO: 689785 - RNA, 64 nt, hsa
aucuuuuuuaaagcaguugaagcagaauguauaggugucagagaagaaaccuagucagccagac

SEQ ID NO: 689786 - RNA, 64 nt, hsa
gcuggugacuuugcuucuuuauguguguguaugugugucagagaaagagagagagagagagaga

SEQ ID NO: 689787 - RNA, 64 nt, hsa
gaaucugcuccaaaaagcuggccacaucucugaggugucagaauuaagcugccucaguaacugc

SEQ ID NO: 689788 - RNA, 64 nt, hsa
aauuuuuucuuuuccugguucuacuaauuauacugugucagauuuggaacuaaacaggcaagga

SEQ ID NO: 689789 - RNA, 64 nt, hsa
acuuauucaagcuugucugugauuaauggaauuggugucagaugcuggaauuuauucugaccaa

SEQ ID NO: 689790 - RNA, 64 nt, hsa
uaauuuugcaucauaauuucuacauugucccugagugucagaacuauaauuuauuccauuucuc

SEQ ID NO: 689791 - RNA, 64 nt, hsa
ccaggccgcauguggcuucauuauacugagccaugugucagaggauggggagacaggcaggacc

SEQ ID NO: 689792 - RNA, 64 nt, hsa
cagcuuugaagcaauacucugcuuucacguaccugugucagaccaggcuacccagucgaguccu

SEQ ID NO: 689793 - RNA, 64 nt, hsa
cguagaggauccuggccacagacaguuucaaguagugucagauuuuuguugcuugggcggcugu

SEQ ID NO: 689794 - RNA, 64 nt, hsa
cuacucacucugcagcucuggggagcucuuuccugugucagaaccaguccugcccugugaauua

SEQ ID NO: 689795 - RNA, 64 nt, hsa
augccuuuaauucuugucugagaaucuuggccaugugucagauuaucagaacaauuuuguuacc

SEQ ID NO: 689796 - RNA, 64 nt, hsa
cuguuagaguuggcaauuuccuaucacuauuucagugucagaacaaacugaaaauaauggcucg

SEQ ID NO: 689797 - RNA, 64 nt, hsa
agaagccuuaauuauuuaaaucaauucagugacugugucagaccuuaguuuuaaaucuugauau

SEQ ID NO: 689798 - RNA, 64 nt, hsa
gugcggguaugggugggauuccugguggacaggggugucagaucugucugaggagccccaguca

SEQ ID NO: 689799 - RNA, 64 nt, hsa
uuucuuucagguuuacuugauaguggauacauuggugucagaggaccuugacuggguucauuuu

SEQ ID NO: 689800 - RNA, 64 nt, hsa
uaggacuaauuggggcuaagaugaauuaauguaagugucagauacuaggcagguguuagggaug

SEQ ID NO: 689801 - RNA, 64 nt, hsa
caggugggugguuaagguccuucccacuucgcaggugucagaaccuagggcugggcucucgggg

SEQ ID NO: 689802 - RNA, 64 nt, hsa
gcacuagguugcagagaagcauccuccacauccugugucagaaacccuggucuccguggcacuu

SEQ ID NO: 689803 - RNA, 64 nt, hsa
uggguuuucaggcccucugcuccaccccuccugugugucagagcuagggugggggugcccgauu

SEQ ID NO: 689804 - RNA, 64 nt, hsa
gauagaugagaaaguucuaauucuucaugguggggugucagacauaacugaucuggagcuuuug

SEQ ID NO: 689805 - RNA, 64 nt, hsa
uuccuauugugcaauguaaauauuuuaaagaauugugucagacuguuuaguagcagugauuguc

SEQ ID NO: 689806 - RNA, 64 nt, hsa
uggcuggcccagaguuuacauucuaauuugcauugugucagaaacaugaaaugcuuccaagcau

SEQ ID NO: 689807 - RNA, 64 nt, hsa
uuaaggaagacgucaaucaaaaugucaaauaugugugucagaauauaaauaauuuuucacauug

SEQ ID NO: 689808 - RNA, 64 nt, hsa
uuuugaaacagcagucccaguauucucagagcaugugucagaguguuguuccguuaaccuuuuu

SEQ ID NO: 689809 - RNA, 64 nt, hsa
uuuucuuucucuuucagcuauuuuauuuaauauugugucagauauuuuacaagguaugaccuaa

SEQ ID NO: 689810 - RNA, 64 nt, hsa
ugauuuuacacuacagcagcaggauggaguaguugugucagagacuauguaucccacaaagcau

SEQ ID NO: 689811 - RNA, 64 nt, hsa
ggguaaacauccucugcuaaucgacagguagcaggugucagaggaggcauaauauuaauagcgc

SEQ ID NO: 689812 - RNA, 64 nt, hsa
aagaaugggaaggagaccauuggguaacccucaagugucagaaguuguuucuaaaguaacuaua

SEQ ID NO: 689813 - RNA, 64 nt, hsa
acuacaggucccgguaccugaggaaccaguguaggugucagaaauacuccuagagccucaaggu

SEQ ID NO: 689814 - RNA, 64 nt, hsa
cauagcaguguuccauagacuuggcuugguuccagugucagaagcaagcauaaucauugcugug

SEQ ID NO: 689815 - RNA, 64 nt, hsa
uaauggaaaugggaagagcaacaguaacuccaaagugucagaaaauaguuaacauucaaaaaac

SEQ ID NO: 689816 - RNA, 64 nt, hsa
guccauaagcauggugauuugguuucaugcucaugugucagauaugcuucccucaaaccuuguu

SEQ ID NO: 689817 - RNA, 64 nt, hsa
gcaucacagcaacgcugcggaucuugguuacacagugucagagcuuuuguuuuuugaugggguu

SEQ ID NO: 689818 - RNA, 64 nt, hsa
uguacuaaaaggcagaaaggucaucacaacuuuagugucagaaucuauagugguggcaaaguua

SEQ ID NO: 689819 - RNA, 64 nt, hsa
uugaacuguaguaccuuucucuaugucaaguuuugugucagacaugggaaaucauguauuuguu

SEQ ID NO: 689820 - RNA, 64 nt, hsa
gcccugggcuggccggcgccguacugccugcguugugucagagaauaggaaaagcagcuuuguu

SEQ ID NO: 689821 - RNA, 64 nt, hsa
ugcaaggacuccagugugaacucaggaggggcaggugucagaacugggcaccaggacuggagcc

SEQ ID NO: 689822 - RNA, 64 nt, hsa
gugggccagcauaggggggagggucuuuuacccugugucagagccuaccuucaccaccuauauc

SEQ ID NO: 689823 - RNA, 64 nt, hsa
aaaauuguuuuaugcuuuauuauaucgcaaaugagugucagauuuuugaguaccaaugaucaug

SEQ ID NO: 689824 - RNA, 64 nt, hsa
uuuuuuucugaauaagucucucauaaugagugcagugucagacugugccuacucugaugguaug

SEQ ID NO: 689825 - RNA, 64 nt, hsa
ugugacuuguauggucuccugguuaaagggaauggugucagaauauuugcauaaaauuauuuuu

SEQ ID NO: 689826 - RNA, 64 nt, hsa
cugcugggucacaacauucuccucucccugacuggugucagauucaucaaacaaaaaauaaauc

SEQ ID NO: 689827 - RNA, 64 nt, hsa
aucuuggugccccgguguuuacaagagccagauggugucagaggaguacgcaguuguaugcagu

SEQ ID NO: 689828 - RNA, 64 nt, hsa
uauaagucucccacaaucuuccaguucuuacccagugucagauaauuaauuacuaauuacuuuc

SEQ ID NO: 689829 - RNA, 64 nt, hsa
ugugugugugugugugugugugaguggaguugaggugucagagaaaaugaauuuuuuccagauu

SEQ ID NO: 689830 - RNA, 64 nt, hsa
guaacuuaagguugucauugguaaaaagacuucugugucagaaaaaacaaaaggcucuuuucag

SEQ ID NO: 689831 - RNA, 64 nt, hsa
cuucugggaaauuuuguuauuaaaggaauauauagugucagacggaaguuauaaucaucuugga

SEQ ID NO: 689832 - RNA, 64 nt, hsa
ugaauugugagaauucaguugugauuuuuaacaugugucagauauauauacuaacacgucuaau

SEQ ID NO: 689833 - RNA, 64 nt, hsa
acuuguaagaccugccagaaugcuagucccgagagugucagacaaggaagaagucccugggccu

SEQ ID NO: 689834 - RNA, 64 nt, hsa
aucuccaaccuccuaggucaaauuugagcugauugugucagaggccuccuaccugcgcagucua

SEQ ID NO: 689835 - RNA, 64 nt, hsa
cuucugggaaauuuuguuauuaaaagaauauauagugucagacggaaguuauaaucaucuugga

SEQ ID NO: 689836 - RNA, 64 nt, hsa
gagugagacccugucucaaaaaaaaaaagauucugugucagagcccagcccaggaguuugaggc

SEQ ID NO: 689837 - RNA, 64 nt, hsa
agacuccuaaggcacccacuggcugcaugucagggugucagauccuuaaacgugugugaaugcu

SEQ ID NO: 689838 - RNA, 64 nt, hsa
uuugagauagaugauuuuugggaaagggcaaaaugugucagaugcccuaguuaaucauguaauu

SEQ ID NO: 689839 - RNA, 64 nt, hsa
auuuuaggccucuuguucacaucaaaagauauuggugucagaauaccagcauuuuccugccaug

SEQ ID NO: 689840 - RNA, 64 nt, hsa
acuuacaauuuuuuaacaugagauaacacaucaggugucagaacuugcuugaagggaauuacca

SEQ ID NO: 689841 - RNA, 64 nt, hsa
aauucagguuuacaagaugaaagcguguggagaagugucagauggcaguggaagcauguguguu

SEQ ID NO: 689842 - RNA, 64 nt, hsa
uaaacuuuaacuuccacuuuguauaaauuuuuaagugucagacuauccauuuuacacuugcuuu

SEQ ID NO: 689843 - RNA, 64 nt, hsa
ccauauuuucccccuguuuuuagagcuuccaaaugugucagaauaggaaaacauugcaauaaau

SEQ ID NO: 689844 - RNA, 64 nt, hsa
cucagccuagugggugucauggauggaucugggggugucagacaggcuacccugugccagggag

SEQ ID NO: 689845 - RNA, 64 nt, hsa
uacuucuccaaucacugccaaagucaagcguaacgugucagagaggaaggaucaccgaccugaa

SEQ ID NO: 689846 - RNA, 64 nt, hsa
aaccugggaaguguucuuccugccuuucugcuaggugucagauagauggucccagagcuaggug

SEQ ID NO: 689847 - RNA, 64 nt, hsa
uagccauggaauggcuccgaucuaccucacagcagugucagaaggacuucgccaggguuuuggg

SEQ ID NO: 689848 - RNA, 64 nt, hsa
aagacauguggaggggcagccugugccugccuuugugucagaaaaaggaaaccacagugagccu

SEQ ID NO: 689849 - RNA, 64 nt, hsa
guuuauuuuauguuggaagagauggcgcagaugugugucagaagggagaucacggugugaguuu

SEQ ID NO: 689850 - RNA, 64 nt, hsa
cuuacaaucguggaaaucagaaauguuuauacaggugucagaucagaauuuuuaagaguuaucu

SEQ ID NO: 689851 - RNA, 64 nt, hsa
cccucucgcccuggccagggccucugugcagacagugucagagucauuaagcgggaucccagca

SEQ ID NO: 689852 - RNA, 64 nt, hsa
cugucugcagcugccugucuggugucugucuuuggugucagaacuuugggggccgggccccucc

SEQ ID NO: 689853 - RNA, 64 nt, hsa
uacugucuuguacugacacauccaaagcaugagugugucagaaaucccuugucuauuccugucu

SEQ ID NO: 689854 - RNA, 64 nt, hsa
gggagccacuuggcagaagggugcagggcugcuggugucagagcaagagggcuacagggaaagg

SEQ ID NO: 689855 - RNA, 64 nt, hsa
ccccuccaggaagaugcugacauccaggugggaggugucagagcccagcucaugcacaucagcu

SEQ ID NO: 689856 - RNA, 64 nt, hsa
ucugaguacuguauuuuuucugugcauuaccuuagugucagaauguuggucuuuauuuuaaagu

SEQ ID NO: 689857 - RNA, 64 nt, hsa
ucuuggggaagccaggaaagccaguauuuccuaugugucagaucugcuuggcuuccaagaaggg

SEQ ID NO: 689858 - RNA, 64 nt, hsa
ucuugggucauuuggauguuuuguuuguuucugugugucagacuguaagggcugagcuuucugu

SEQ ID NO: 689859 - RNA, 64 nt, hsa
ggugccagugucuuuuacaaaaacagauggcauagugucagauguaccuuacucucugcuacug

SEQ ID NO: 689860 - RNA, 64 nt, hsa
uuuaggauguaaagguauauugugaacccuagcugugucagaaucuccaucccugaaauuucuc

SEQ ID NO: 689861 - RNA, 64 nt, hsa
cuugccugucuuuuccugcugcucccagggggaggugucagaccucgggaggcagacgggacca

SEQ ID NO: 689862 - RNA, 64 nt, hsa
uuaagccucccuaagagacugaagagaggaacaggugucagauacucauaggcacugagaucua

SEQ ID NO: 689863 - RNA, 64 nt, hsa
acauguuucuucacuuccaugagaauggugccaagugucagacucuaaugagcccucagcucag

SEQ ID NO: 689864 - RNA, 64 nt, hsa
ucuguuaaaaugcagaggugcuauaacauucaaagugucagauuccuugggaguauggaaaacc

SEQ ID NO: 689865 - RNA, 64 nt, hsa
ggguuccaagaguggguaguguguguaugugugugugucagagggagaccuggcaggcaccucu

SEQ ID NO: 689866 - RNA, 64 nt, hsa
uagguaacuagcugcagugaaggcugugggaagggugucagauccugugaagaauggcaaaaca

SEQ ID NO: 689867 - RNA, 64 nt, hsa
ccagugucuguggccuggcaaguggccacgcccugugucagaccaucugggaauuaagcuccag

SEQ ID NO: 689868 - RNA, 64 nt, hsa
uggaccuuuuuuuuuuuaauggcaauaggacauugugucagauuaccaguuauaggaacaauuc

SEQ ID NO: 689869 - RNA, 64 nt, hsa
gccuugcaguugcuuccucccaugagccaagguggugucagagggcaacuggaugacucgcagu

SEQ ID NO: 689870 - RNA, 64 nt, hsa
aauaaaacaguuucgcuucuuuagcucaucuguggugucagaauccuuggagcugaagagagaa

SEQ ID NO: 689871 - RNA, 64 nt, hsa; identical to SEQ ID NO: 414350

SEQ ID NO: 689872 - RNA, 64 nt, hsa; identical to SEQ ID NO: 414351

SEQ ID NO: 689873 - RNA, 64 nt, hsa; identical to SEQ ID NO: 414352

SEQ ID NO: 689874 - RNA, 64 nt, hsa; identical to SEQ ID NO: 414353

SEQ ID NO: 689875 - RNA, 64 nt, hsa
ugaccgccuggggcaggaaguauucagguuggcugugucagaugcuaaugugcugaaucaacag

SEQ ID NO: 689876 - RNA, 64 nt, hsa
auaucaggagauuuaggguaagucauggguugaggugucagauaguaauaucuauuuguuuugu

SEQ ID NO: 689877 - RNA, 64 nt, hsa
ucuguugaccuguaaggaagcagucgauccuagagugucagaacagagccauucucuccuccug

SEQ ID NO: 689878 - RNA, 64 nt, hsa
gaccaaaauuuuaaaaaacugguauuuuguaaaugugucagagacacaugggacagaacccuac

SEQ ID NO: 689879 - RNA, 64 nt, hsa
uguggacccacccagcuuucuuccucccuguugugugucagauuaugccuugcacuugggaaag

SEQ ID NO: 689880 - RNA, 64 nt, hsa
caggccccacgcccucuccucccccuccuagggggugucagaagcugggaacguguguccaggc

SEQ ID NO: 689881 - RNA, 64 nt, hsa
cuuuuuaaauggcauauuaacaagccagcaaagugugucagaccauggcgugguauuuauugug

SEQ ID NO: 689882 - RNA, 64 nt, hsa
ggcagaagaauaugacagaugucagcuucucccugugucagaugauauguccuugaagcuggca

SEQ ID NO: 689883 - RNA, 64 nt, hsa
auccagauaguuagcugugagccagcacucagcugugucagauuugauuaauauuguauuaauc

SEQ ID NO: 689884 - RNA, 64 nt, hsa
acacaccccuucagaaggugcccuggguugccgagugucagaauauacucaggacuccagaggu

SEQ ID NO: 689885 - RNA, 64 nt, hsa
cacaggagaagucacugcuugaggcucagcugcugugucagagcggaggcacauuggugagucc

SEQ ID NO: 689886 - RNA, 64 nt, hsa
uuggagugggcaucacagccaggguggccucugggugucagaugcucucaggagggugcccagc

SEQ ID NO: 689887 - RNA, 64 nt, hsa
auuguggaaugagcauucucuuguuuuaauguuggugucagaaaauaaauaugaaacauuaagu

SEQ ID NO: 689888 - RNA, 64 nt, hsa
uuguuuccuaaaaacagugauuucuauuaaaaaggugucagaacuggagaaaaugccguguagu

SEQ ID NO: 689889 - RNA, 64 nt, hsa
cugcggaggaacccuuggcaggcagaaccuggaggugucagaggcucaacuccuccaucuaacc

SEQ ID NO: 689890 - RNA, 64 nt, hsa
ucuucccaaccguggccuagagggcccuucuuaggugucagaaugagccaagccugaagcacuu

SEQ ID NO: 689891 - RNA, 64 nt, hsa
ugauggagggcagaggaaguacuuagggagguuggugucagaggcaggagugggggaucaggga

SEQ ID NO: 689892 - RNA, 64 nt, hsa
ggcguuugcauuuguaaacuuguggucuuccuaugugucagaaacaacugugucuuggggggga

SEQ ID NO: 689893 - RNA, 64 nt, hsa
ucugucaccaccuucagcaucuggaguugaguuggugucagauaguguaugagaauuaaaugug

SEQ ID NO: 689894 - RNA, 64 nt, hsa
gacgauggcucaugucacaggccuaccugauacggugucagagaaagugguggggaaaggaucu

SEQ ID NO: 689895 - RNA, 63 nt, hsa
gcuugagcaauaaaguggaaacaauaaaaccugggugucagacaacccuuucuguucagccuu

SEQ ID NO: 689896 - RNA, 64 nt, hsa
acuaacuugguguuaccuguaagugaaaacucaagugucagaugaagggagguggaguuauccu

SEQ ID NO: 689897 - RNA, 64 nt, hsa
ggcacucccccagccguucucaugcaaaauaccugugucagaauacuccuuucauccaucacuc

SEQ ID NO: 689898 - RNA, 64 nt, hsa
gggauggaggucuacccuggacacuaagccaagugugucagagacagaagggagcuggggauug

SEQ ID NO: 689899 - RNA, 64 nt, hsa
ggcacuuucuguuugaaccccugucaugaucacagugucagagacgcguccucuuucuugggga

SEQ ID NO: 689900 - RNA, 64 nt, hsa
ucugccccagccccacacuugcucugaaaaccaagugucagagccccuuccccuuguuuuuauu

SEQ ID NO: 689901 - RNA, 64 nt, hsa; identical to SEQ ID NO: 414354

SEQ ID NO: 689902 - RNA, 64 nt, hsa; identical to SEQ ID NO: 414355

SEQ ID NO: 689903 - RNA, 64 nt, hsa
gcccauguaaaugagaacucaacugcuguuuacagugucagauuaacauuugaaaggugugauu

SEQ ID NO: 689904 - RNA, 64 nt, hsa
agcaaaugaaguauuuuuucccucuuggcaacuugugucagaguuacucuggucugagucaacu

SEQ ID NO: 689905 - RNA, 64 nt, hsa
aaccucuugaggguggacagggagaaagaugauggugucagaggucaaaacuauuauauaugac

SEQ ID NO: 689906 - RNA, 64 nt, hsa
ccccgcgcauuuccuuggccucaucugagaucuggugucagaguucucugcuccuguuggcaaa

SEQ ID NO: 689907 - RNA, 64 nt, hsa
cagcuuuuaacacaguucccugccuucacaagaggugucagauuaagaugugaaagcugcaaga

SEQ ID NO: 689908 - RNA, 64 nt, hsa
gaccaucuccuuaagguuucacccaaagcccccagugucagagacuugggaugggaagaacagu

SEQ ID NO: 689909 - RNA, 64 nt, hsa
uuuucauucaaaaacauuucacuuuugggguugcgugucagauuuggcaguauaaauucuggcu

SEQ ID NO: 689910 - RNA, 64 nt, hsa
aaauuuugaguuguauuaauaguuaaaaacauuugugucagaugacagggugggcuuuuacugu

SEQ ID NO: 689911 - RNA, 64 nt, hsa
ucuugugcuuggugagugagggucucucuacucagugucagacaucuacaggaaagaaacaacu

SEQ ID NO: 689912 - RNA, 64 nt, hsa
ggaggagaggggguacagacuuccuucuuagagagugucagagaauaugcucccaaugguggaa

SEQ ID NO: 689913 - RNA, 64 nt, hsa
uaauuucuuacacuuaaaaguguccaucaacagugugucagauggucuuuauauauuuuuucug

SEQ ID NO: 689914 - RNA, 64 nt, hsa
gcuacagaugugcugacaaggcacuucauguaaagugucagaaggagcuacaaaaccuacccuc

SEQ ID NO: 689915 - RNA, 64 nt, hsa
auacgauggaauacuagauggucauuaaaauuaugugucagaagaaggcuuaaucucaugggaa

SEQ ID NO: 689916 - RNA, 64 nt, hsa
aacaaauuucauagccugcugaacugaacugagugugucagaagugcugguuaaugacgagaag

SEQ ID NO: 689917 - RNA, 64 nt, hsa
uuuuuaugcaggagaaaagcccagaguucacugugugucagaacaacuuucuaacaaacauuua

SEQ ID NO: 689918 - RNA, 64 nt, hsa
ccaaauuuaagcuccucacuuuuugugacacauggugucagauauggggucccgcaccuauauc

SEQ ID NO: 689919 - RNA, 64 nt, hsa
guuacucugccuuuuugacguuuuuauucuuugugugucagaguucagagcucaggagccaaaa

SEQ ID NO: 689920 - RNA, 64 nt, hsa
uaugccuuaguuuuugaauagauaagacauucaagugucagaaaguaaaagucaguucaggacu

SEQ ID NO: 689921 - RNA, 64 nt, hsa
ccuaccccauggugcuaggaagaggagugggguggugucagacccuggaggccccaacccuguc

SEQ ID NO: 689922 - RNA, 64 nt, hsa
cuuacaucagacuuucuaacuaguaucaagaucagugucagauauuguugagggaaguaauuuu

SEQ ID NO: 689923 - RNA, 64 nt, hsa
gggaggcacagagcagagguucaggucucagcaggugucagaggugauuacagcccuucccauc

SEQ ID NO: 689924 - RNA, 64 nt, hsa
ggcuggugaggggcccggaggagccuuugcccgcgugucagacuccaucccuccucugccgcca

SEQ ID NO: 689925 - RNA, 64 nt, hsa
uuucucccaggaaaucuuuguacagcuuuaaguugugucagauucucugaaaacauuuuuuaga

SEQ ID NO: 689926 - RNA, 64 nt, hsa
gggauacaaaaaggaacuaacaauuuguauggcagugucagauauuuuuauuuuaguauuuccu

SEQ ID NO: 689927 - RNA, 64 nt, hsa
cagccaggagcucuguccgcaaaaccaaaucugggugucagaggccaagacccuggggugggau

SEQ ID NO: 689928 - RNA, 64 nt, hsa
cucugcaggugugggacacauguaccaccuacaagugucagaagacacuggagggccaugaugg

SEQ ID NO: 689929 - RNA, 64 nt, hsa
gccacuuuaaaaaucuuuugucagaauagaugaugugucagaucucuuuaggaugacuguauuu

SEQ ID NO: 689930 - RNA, 64 nt, hsa
aaaaggaaaaccggaggagcaauuggggauccaggugucagagguaggggaaccaggggcaagc

SEQ ID NO: 689931 - RNA, 64 nt, hsa
ugaggaaguauuuaauaaaaaaugaagucuaaaugugucagagaauuuaugugagaaaggacua

SEQ ID NO: 689932 - RNA, 64 nt, hsa
aagaggagagggcagcauaacuuccugaccaccggugucagauaucagagcauucuggacuccu

SEQ ID NO: 689933 - RNA, 64 nt, hsa
aaagucgaugaaaaguaaccacugccacugucuugugucagaacuuuuacaguacagaaaauaa

SEQ ID NO: 689934 - RNA, 64 nt, hsa
cccuuuuucucauucccuuaacugacauuauuuagugucagaggccgagcacaguggcucccac

SEQ ID NO: 689935 - RNA, 64 nt, hsa
ccaucauggcucucucugguuguauuuagaucgggugucagaggacgaccaaucuuagggaauu

SEQ ID NO: 689936 - RNA, 64 nt, hsa
uaacuggaagugaagagguuuuguugcuuguacagugucagaugaggaacaccacuaucuuaau

SEQ ID NO: 689937 - RNA, 64 nt, hsa
ucgauuuauugccaaaacccuagauuggagcuuggugucagaacucgccuagugggcaucucug

SEQ ID NO: 689938 - RNA, 64 nt, hsa
cuccgucccccucuuugaagcuguccccaucucagugucagaccagccuucuccucagcugacc

SEQ ID NO: 689939 - RNA, 64 nt, hsa
uaccauggucucucucugcaguuauuuaaugccugugucagaucuacuguaaaaagaggauuaa

SEQ ID NO: 689940 - RNA, 64 nt, hsa
gccucauacgaaauguauuugguuuuguuggagagugucagacugaucuggaagugaaacacag

SEQ ID NO: 689941 - RNA, 64 nt, hsa
uccaaggaaguuaaaaggcuugguauggauguuggugucagauaggucugacuaaccucuccgu

SEQ ID NO: 689942 - RNA, 64 nt, hsa
cacccaauuggcccaacacugucugccccucggggugucagaaauucuagcgcaaggcacuuuu

SEQ ID NO: 689943 - RNA, 64 nt, hsa
ucuucugaucagucugucuggauugaguccuacagugucagauagggcggcaaaugccaaagca

SEQ ID NO: 689944 - RNA, 64 nt, hsa
ccccuccauccccaucggcccuguccccuggagugugucagagcccaggggagaaugcagccca

SEQ ID NO: 689945 - RNA, 64 nt, hsa
gucuuggguugggcugggggguuucccacaugcagugucagaggggccgcccgguggggcuauc

SEQ ID NO: 689946 - RNA, 64 nt, hsa
uccuuguauguggguguuuauuacaaguggcuuugugucagacacgcucggcuccccaccugga

SEQ ID NO: 689947 - RNA, 64 nt, hsa
cauuucaaaugauuccauaugauugucagugugugugucagacugugaucgauuucacuagaug

SEQ ID NO: 689948 - RNA, 64 nt, hsa
caacuuuguuucaauuuuguuuugugcauucuaugugucagaacauucagaagaagucugaaga

SEQ ID NO: 689949 - RNA, 64 nt, hsa
cugugugugugugugugugugugugugugugugugugucagagguuccagaaaguuccagauuu

SEQ ID NO: 689950 - RNA, 64 nt, hsa
ggaggggcuucccguuauccacgaggauuugugggugucagagcccauaggcaucacucuucag

SEQ ID NO: 689951 - RNA, 64 nt, hsa
uucauucaacaaauauuuguaggguaccuacugugugucagaagauguucaagaucagcaucau

SEQ ID NO: 689952 - RNA, 64 nt, hsa
accagcaagggccacaguuggaacaguccccugggugucagaaggugggcuagggccuccugca

SEQ ID NO: 689953 - RNA, 64 nt, hsa
agauaucucugagggccaagcuaugcccaggaaugugucagagucaccuccauaauggucagua

SEQ ID NO: 689954 - RNA, 64 nt, hsa
uggagcuacacacaggagggaucagcuccugggugugucagaggccagccuggggagcucuggc

SEQ ID NO: 689955 - RNA, 64 nt, hsa
aaaauuaauguugccaacuuaauuuugugcauuugugucagaauguuuaguuuacaagguuggg

SEQ ID NO: 689956 - RNA, 64 nt, hsa
gagaagauauucuggugacugaaaguauggucgggugucagauauaaaugugcaaaugccuucu

SEQ ID NO: 689957 - RNA, 64 nt, hsa
agcacgcagcaggcgugcccaggagcgugugcaugugucagagccauuugguccaucaucuccu

SEQ ID NO: 689958 - RNA, 64 nt, hsa
guuaagugacaugccugaggcaccccccuaacaggugucagagcugaaauucaaaccccaucca

SEQ ID NO: 689959 - RNA, 64 nt, hsa
aaggcuuaaaggcauuucauucagaucaaaagcugugucagacacaaaacuuauuuaauaauua

SEQ ID NO: 689960 - RNA, 64 nt, hsa
cucaaaugcuagaagcugucuagguccguccggugugucagauuuuccucagauuagaugugcc

SEQ ID NO: 689961 - RNA, 64 nt, hsa
ugucaacacaggacuuucuggaucauuccagaaagugucagacguuuucucauugucuuguagu

SEQ ID NO: 689962 - RNA, 64 nt, hsa
aucccgggccccugcagggaaaagcgcugggugugugucagaggcgcaggguggguggggcugc

SEQ ID NO: 689963 - RNA, 64 nt, hsa
uuuaugugcuuguauguacauuuauugcuauccagugucagaacaguuaguuuaggaaaaguau

SEQ ID NO: 689964 - RNA, 64 nt, hsa
uuuauuuuucuguguaugcauucacugcugcccagugucagaacaguuauacaaacgagggcuu

SEQ ID NO: 689965 - RNA, 64 nt, hsa
auaauauccucaaaguucauucauuuuuuagcaugugucagaaauuuuaaggcugagcaauauu

SEQ ID NO: 689966 - RNA, 64 nt, hsa
auaaggucuucacgguucacccauguuguauaaugugucagaauauccuuccuuuuuaggugaa

SEQ ID NO: 689967 - RNA, 64 nt, hsa; identical to SEQ ID NO: 414356

SEQ ID NO: 689968 - RNA, 64 nt, hsa; identical to SEQ ID NO: 414357

SEQ ID NO: 689969 - RNA, 64 nt, hsa; identical to SEQ ID NO: 414358

SEQ ID NO: 689970 - RNA, 64 nt, hsa; identical to SEQ ID NO: 414359

SEQ ID NO: 689971 - RNA, 64 nt, hsa; identical to SEQ ID NO: 414360

SEQ ID NO: 689972 - RNA, 64 nt, hsa
auguaguauaggagcuucugaggguaacaacagagugucagauaugucaucucaaccucagacu

SEQ ID NO: 689973 - RNA, 64 nt, hsa
uucacauguaguagcuucugaggguaacaacagagugucagauaugucaucucaaccucaaacu

SEQ ID NO: 689974 - RNA, 64 nt, hsa
cccacccaaaucccaucucaauuuuaauccccaugugucagaggagggccuuggugggagauga

SEQ ID NO: 689975 - RNA, 64 nt, hsa
guuguuuauuuagugaucaguuacuucauguuuugugucagagaaaacauguacaaaacauuug

SEQ ID NO: 689976 - RNA, 64 nt, hsa; identical to SEQ ID NO: 414361

SEQ ID NO: 689977 - RNA, 64 nt, hsa; identical to SEQ ID NO: 414362

SEQ ID NO: 689978 - RNA, 64 nt, hsa
gcuauuacuuugaaaacccugcugauucugaaaagugucagaaguuaccauuugauuugaaaaa

SEQ ID NO: 689979 - RNA, 64 nt, hsa
uguuaagcugaggauacaaccaggaaaugcaacggugucagauuguguucaaaaugucuagaaa

SEQ ID NO: 689980 - RNA, 64 nt, hsa
cacaaucaaaauacaacauucaauacuuccaggugugucagacuugggaugggacgcugauaua

SEQ ID NO: 689981 - RNA, 64 nt, hsa
gcuuuguaauaacauaagaccauugugguuguuggugucagauaccuucccauccugagcucuc

SEQ ID NO: 689982 - RNA, 64 nt, hsa
ugcuuuagucacuggacgagcaucagcuacugcggugucagaucacuucucgaguagaggucug

SEQ ID NO: 689983 - RNA, 64 nt, hsa
gguggagucgcagaccagagcugucugaacucaugugucagaagccuccaagccugccucccag

SEQ ID NO: 689984 - RNA, 64 nt, hsa
uucccuucagccaggagcuccugggugcauuuccgugucagaaacaguaccgagucccaccccc

SEQ ID NO: 689985 - RNA, 64 nt, hsa
agcuaugugguugagcucaggccucucgugccuggugucagagaaggcagagcccacaguaggu

SEQ ID NO: 689986 - RNA, 64 nt, hsa
ugagacauauuuaagaauuccaagaggauauuaugugucagaauuucagacacugaugagaagu

SEQ ID NO: 689987 - RNA, 64 nt, hsa
uuguuuguuuguuuguuuugagacuccagucugggugucagaaugagaccccaucucaaaaaaa

SEQ ID NO: 689988 - RNA, 64 nt, hsa
ccgugguaaacaucugcccauccucccagcuccugugucagagccugggggacgagucacccag

SEQ ID NO: 689989 - RNA, 64 nt, hsa
ucugugcgcggcgcuguuuccauaggcagagcgggugucagacugaggauuucgcuuccccucc

SEQ ID NO: 689990 - RNA, 64 nt, hsa
guccccuugagucaucaccagcuuccccaagagagugucagaaucuuaagagcugagaggccgg

SEQ ID NO: 689991 - RNA, 64 nt, hsa
uuuugcauucuggcuugugcaguuuuuauugucugugucagacguacagccagacauguucucu

SEQ ID NO: 689992 - RNA, 64 nt, hsa
guguuuaaaaguaaaugauuugggaacugacaaugugucagaaaauauauguucauuuaucauu

SEQ ID NO: 689993 - RNA, 64 nt, hsa
gagggccacaggugagggacacuaccacuggaucgugucagaaggugcugcugaggauagacug

SEQ ID NO: 689994 - RNA, 64 nt, hsa
uugaaauggacucugagauggcagcguggugccagugucagacauccugugugugaugauaugc

SEQ ID NO: 689995 - RNA, 64 nt, hsa
gacugcuuuauucuuuuccaauaaagaagugcacgugucagagcuggagcgccugcauugugag

SEQ ID NO: 689996 - RNA, 64 nt, hsa
aacuugauaacuagccguguuuuuaaaaagaaucgugucagaacuguaaguagugcauauuuaa

SEQ ID NO: 689997 - RNA, 64 nt, hsa
auggcguuugcaagguuuacccauguuguagcaugugucagaauuucauuccuuucuauggcug

SEQ ID NO: 689998 - RNA, 64 nt, hsa
auugcuuuugcaauuucuacaaauuaauuuuaaagugucagaaaaaggugacggcaaggacaug

SEQ ID NO: 689999 - RNA, 64 nt, hsa
uuuaaagauccuugagcagaggagacaucuugaagugucagauuacaggaguaccagugggaga

SEQ ID NO: 690000 - RNA, 64 nt, hsa
gugcacagcugauaccaggagggaacauccugaagugucagagaaaaguaaggcauauggcuca

SEQ ID NO: 690001 - RNA, 64 nt, hsa
uucucugagauucugugugcagugagcaauuuuugugucagaaauucuuugucagaacaaauau

SEQ ID NO: 690002 - RNA, 64 nt, hsa
ugguacgcugucuuuuuaaaaucauguauuuaaugugucagauauugugcuugaaagauucuca

SEQ ID NO: 690003 - RNA, 64 nt, hsa
ucuagggccccugucuacugauagucaguuugcugugucagaaagcacuucugaaagcagauau

SEQ ID NO: 690004 - RNA, 64 nt, hsa
aagcguuagggcugaugggugacucagcaaggcagugucagagcugggacugggcguaggccuu

SEQ ID NO: 690005 - RNA, 64 nt, hsa
aggcaguguucugccgagaccccaagaacucggggugucagagggcaaaggaacuaccugccuu

SEQ ID NO: 690006 - RNA, 64 nt, hsa
acaaaauacacuguggcuucuucuuugaucucucuuugaccauacugacacugggaaaagccca

SEQ ID NO: 690007 - RNA, 64 nt, hsa
caagucuucagauaauugcaacuucaguugaucuuuugaccaagaccucaagagagccagaacu

SEQ ID NO: 690008 - RNA, 64 nt, hsa
aaucuaaucacuagaguuauuauauucuguuauguuugaccagaauuauaugacaagaacuggu

SEQ ID NO: 690009 - RNA, 64 nt, hsa
cggggauucuaauguuuguaagugcuuugagaucuuugaccaacaggugcuauuggagugcaaa

SEQ ID NO: 690010 - RNA, 64 nt, hsa
ggcaaaaugaacgcuuauuuuacagacuuucuaauuugaccagauuucuuaaugaauagacaca

SEQ ID NO: 690011 - RNA, 64 nt, hsa
agcguuucauacaggucagcagguuagaccggcuuuugaccauauucaucgcuauuuaaaaccu

SEQ ID NO: 690012 - RNA, 64 nt, hsa
uuuggaugaagcagcuguaacugcccuaguguaguuugaccaggacauugucgugcuccuucca

SEQ ID NO: 690013 - RNA, 64 nt, hsa
aacauugccuuuuggacauguaaaauauuuaggauuugaccacacaauggcuaugaaaaugcaa

SEQ ID NO: 690014 - RNA, 64 nt, hsa
ugagcgggucuaguggaaagauugugucuggucguuugaccacacaccgcccugauuugcuguu

SEQ ID NO: 690015 - RNA, 64 nt, hsa
ugguuuuuuagugcaauuucuucuguagcuauucuuugaccaaacuguggguauuguuaauauu

SEQ ID NO: 690016 - RNA, 64 nt, hsa
aguuuuugccauuauaauuuugaccauaaauuaauuugaccaucucucuuauuaauagagaagu

SEQ ID NO: 690017 - RNA, 64 nt, hsa
cacguauuuauuuauaaguuuuugccauuauaauuuugaccauaaauuaauuugaccaucucuc

SEQ ID NO: 690018 - RNA, 64 nt, hsa
aaauauauaacuuuguuaacacuuuuguuagcucuuugaccauaaaauaaugacaauaagcugu

SEQ ID NO: 690019 - RNA, 64 nt, hsa
cuuuucauaauuuuuccuacguauacacaaacauuuugaccaaaaauccacacuauauguacug

SEQ ID NO: 690020 - RNA, 64 nt, hsa; identical to SEQ ID NO: 154250

SEQ ID NO: 690021 - RNA, 64 nt, hsa; identical to SEQ ID NO: 154251

SEQ ID NO: 690022 - RNA, 64 nt, hsa; identical to SEQ ID NO: 154252

SEQ ID NO: 690023 - RNA, 64 nt, hsa; identical to SEQ ID NO: 154253

SEQ ID NO: 690024 - RNA, 64 nt, hsa; identical to SEQ ID NO: 154254

SEQ ID NO: 690025 - RNA, 64 nt, hsa; identical to SEQ ID NO: 154255

SEQ ID NO: 690026 - RNA, 64 nt, hsa; identical to SEQ ID NO: 154256

SEQ ID NO: 690027 - RNA, 64 nt, hsa; identical to SEQ ID NO: 154257

SEQ ID NO: 690028 - RNA, 64 nt, hsa; identical to SEQ ID NO: 154258

SEQ ID NO: 690029 - RNA, 64 nt, hsa; identical to SEQ ID NO: 154259

SEQ ID NO: 690030 - RNA, 64 nt, hsa; identical to SEQ ID NO: 154260

SEQ ID NO: 690031 - RNA, 64 nt, hsa; identical to SEQ ID NO: 154261

SEQ ID NO: 690032 - RNA, 64 nt, hsa; identical to SEQ ID NO: 154262

SEQ ID NO: 690033 - RNA, 64 nt, hsa; identical to SEQ ID NO: 154263

SEQ ID NO: 690034 - RNA, 64 nt, hsa; identical to SEQ ID NO: 154264

SEQ ID NO: 690035 - RNA, 64 nt, hsa; identical to SEQ ID NO: 154265

SEQ ID NO: 690036 - RNA, 64 nt, hsa; identical to SEQ ID NO: 154266

SEQ ID NO: 690037 - RNA, 64 nt, hsa; identical to SEQ ID NO: 154267

SEQ ID NO: 690038 - RNA, 64 nt, hsa; identical to SEQ ID NO: 154268

SEQ ID NO: 690039 - RNA, 64 nt, hsa; identical to SEQ ID NO: 154269

SEQ ID NO: 690040 - RNA, 64 nt, hsa; identical to SEQ ID NO: 154270

SEQ ID NO: 690041 - RNA, 64 nt, hsa; identical to SEQ ID NO: 154271

SEQ ID NO: 690042 - RNA, 64 nt, hsa; identical to SEQ ID NO: 154272

SEQ ID NO: 690043 - RNA, 64 nt, hsa; identical to SEQ ID NO: 154273

SEQ ID NO: 690044 - RNA, 64 nt, hsa; identical to SEQ ID NO: 154274

SEQ ID NO: 690045 - RNA, 64 nt, hsa; identical to SEQ ID NO: 154275

SEQ ID NO: 690046 - RNA, 64 nt, hsa; identical to SEQ ID NO: 154276

SEQ ID NO: 690047 - RNA, 64 nt, hsa; identical to SEQ ID NO: 154277

SEQ ID NO: 690048 - RNA, 64 nt, hsa; identical to SEQ ID NO: 154278

SEQ ID NO: 690049 - RNA, 64 nt, hsa; identical to SEQ ID NO: 132416

SEQ ID NO: 690050 - RNA, 64 nt, hsa; identical to SEQ ID NO: 132417

SEQ ID NO: 690051 - RNA, 64 nt, hsa; identical to SEQ ID NO: 132418

SEQ ID NO: 690052 - RNA, 64 nt, hsa; identical to SEQ ID NO: 132419

SEQ ID NO: 690053 - RNA, 64 nt, hsa; identical to SEQ ID NO: 132420

SEQ ID NO: 690054 - RNA, 64 nt, hsa; identical to SEQ ID NO: 132421

SEQ ID NO: 690055 - RNA, 64 nt, hsa; identical to SEQ ID NO: 132422

SEQ ID NO: 690056 - RNA, 64 nt, hsa; identical to SEQ ID NO: 132423

SEQ ID NO: 690057 - RNA, 64 nt, hsa; identical to SEQ ID NO: 132424

SEQ ID NO: 690058 - RNA, 64 nt, hsa; identical to SEQ ID NO: 132425

SEQ ID NO: 690059 - RNA, 64 nt, hsa; identical to SEQ ID NO: 132426

SEQ ID NO: 690060 - RNA, 64 nt, hsa; identical to SEQ ID NO: 132427

SEQ ID NO: 690061 - RNA, 64 nt, hsa; identical to SEQ ID NO: 132428

SEQ ID NO: 690062 - RNA, 64 nt, hsa; identical to SEQ ID NO: 132429

SEQ ID NO: 690063 - RNA, 64 nt, hsa; identical to SEQ ID NO: 132430

SEQ ID NO: 690064 - RNA, 64 nt, hsa; identical to SEQ ID NO: 132431

SEQ ID NO: 690065 - RNA, 64 nt, hsa; identical to SEQ ID NO: 132432

SEQ ID NO: 690066 - RNA, 64 nt, hsa; identical to SEQ ID NO: 132433

SEQ ID NO: 690067 - RNA, 64 nt, hsa; identical to SEQ ID NO: 132434

SEQ ID NO: 690068 - RNA, 64 nt, hsa; identical to SEQ ID NO: 132435

SEQ ID NO: 690069 - RNA, 64 nt, hsa; identical to SEQ ID NO: 132436

SEQ ID NO: 690070 - RNA, 64 nt, hsa; identical to SEQ ID NO: 132437

SEQ ID NO: 690071 - RNA, 64 nt, hsa; identical to SEQ ID NO: 132438

SEQ ID NO: 690072 - RNA, 64 nt, hsa; identical to SEQ ID NO: 132439

SEQ ID NO: 690073 - RNA, 64 nt, hsa; identical to SEQ ID NO: 132440

SEQ ID NO: 690074 - RNA, 64 nt, hsa; identical to SEQ ID NO: 132441

SEQ ID NO: 690075 - RNA, 64 nt, hsa; identical to SEQ ID NO: 132442

SEQ ID NO: 690076 - RNA, 64 nt, hsa; identical to SEQ ID NO: 132443

SEQ ID NO: 690077 - RNA, 64 nt, hsa; identical to SEQ ID NO: 132444

SEQ ID NO: 690078 - RNA, 64 nt, hsa; identical to SEQ ID NO: 132445

SEQ ID NO: 690079 - RNA, 64 nt, hsa; identical to SEQ ID NO: 132446

SEQ ID NO: 690080 - RNA, 64 nt, hsa; identical to SEQ ID NO: 132447

SEQ ID NO: 690081 - RNA, 64 nt, hsa; identical to SEQ ID NO: 132448

SEQ ID NO: 690082 - RNA, 64 nt, hsa; identical to SEQ ID NO: 132449

SEQ ID NO: 690083 - RNA, 64 nt, hsa; identical to SEQ ID NO: 132450

SEQ ID NO: 690084 - RNA, 64 nt, hsa; identical to SEQ ID NO: 132451

SEQ ID NO: 690085 - RNA, 64 nt, hsa; identical to SEQ ID NO: 132452

SEQ ID NO: 690086 - RNA, 64 nt, hsa; identical to SEQ ID NO: 132453

SEQ ID NO: 690087 - RNA, 64 nt, hsa; identical to SEQ ID NO: 132454

SEQ ID NO: 690088 - RNA, 64 nt, hsa; identical to SEQ ID NO: 132455

SEQ ID NO: 690089 - RNA, 64 nt, hsa; identical to SEQ ID NO: 132456

SEQ ID NO: 690090 - RNA, 64 nt, hsa; identical to SEQ ID NO: 132457

SEQ ID NO: 690091 - RNA, 64 nt, hsa; identical to SEQ ID NO: 132458

SEQ ID NO: 690092 - RNA, 64 nt, hsa; identical to SEQ ID NO: 132459

SEQ ID NO: 690093 - RNA, 64 nt, hsa; identical to SEQ ID NO: 132460

SEQ ID NO: 690094 - RNA, 64 nt, hsa; identical to SEQ ID NO: 132461

SEQ ID NO: 690095 - RNA, 64 nt, hsa; identical to SEQ ID NO: 132462

SEQ ID NO: 690096 - RNA, 64 nt, hsa; identical to SEQ ID NO: 132463

SEQ ID NO: 690097 - RNA, 64 nt, hsa; identical to SEQ ID NO: 132464

SEQ ID NO: 690098 - RNA, 64 nt, hsa; identical to SEQ ID NO: 132465

SEQ ID NO: 690099 - RNA, 64 nt, hsa; identical to SEQ ID NO: 132466

SEQ ID NO: 690100 - RNA, 64 nt, hsa; identical to SEQ ID NO: 132467

SEQ ID NO: 690101 - RNA, 64 nt, hsa; identical to SEQ ID NO: 132468

SEQ ID NO: 690102 - RNA, 64 nt, hsa; identical to SEQ ID NO: 132469

SEQ ID NO: 690103 - RNA, 64 nt, hsa; identical to SEQ ID NO: 132470

SEQ ID NO: 690104 - RNA, 64 nt, hsa; identical to SEQ ID NO: 132471

SEQ ID NO: 690105 - RNA, 64 nt, hsa; identical to SEQ ID NO: 132472

SEQ ID NO: 690106 - RNA, 64 nt, hsa; identical to SEQ ID NO: 132473

SEQ ID NO: 690107 - RNA, 64 nt, hsa; identical to SEQ ID NO: 132474

SEQ ID NO: 690108 - RNA, 64 nt, hsa; identical to SEQ ID NO: 132475

SEQ ID NO: 690109 - RNA, 64 nt, hsa; identical to SEQ ID NO: 132476

SEQ ID NO: 690110 - RNA, 64 nt, hsa; identical to SEQ ID NO: 265328

SEQ ID NO: 690111 - RNA, 64 nt, hsa; identical to SEQ ID NO: 265329

SEQ ID NO: 690112 - RNA, 64 nt, hsa; identical to SEQ ID NO: 265330

SEQ ID NO: 690113 - RNA, 64 nt, hsa; identical to SEQ ID NO: 265331

SEQ ID NO: 690114 - RNA, 64 nt, hsa; identical to SEQ ID NO: 265332

SEQ ID NO: 690115 - RNA, 64 nt, hsa; identical to SEQ ID NO: 265333

SEQ ID NO: 690116 - RNA, 64 nt, hsa; identical to SEQ ID NO: 265334

SEQ ID NO: 690117 - RNA, 64 nt, hsa; identical to SEQ ID NO: 265335

SEQ ID NO: 690118 - RNA, 64 nt, hsa; identical to SEQ ID NO: 265336

SEQ ID NO: 690119 - RNA, 64 nt, hsa; identical to SEQ ID NO: 265337

SEQ ID NO: 690120 - RNA, 64 nt, hsa; identical to SEQ ID NO: 265338

SEQ ID NO: 690121 - RNA, 64 nt, hsa; identical to SEQ ID NO: 265339

SEQ ID NO: 690122 - RNA, 64 nt, hsa; identical to SEQ ID NO: 265340

SEQ ID NO: 690123 - RNA, 64 nt, hsa; identical to SEQ ID NO: 265341

SEQ ID NO: 690124 - RNA, 64 nt, hsa; identical to SEQ ID NO: 265342

SEQ ID NO: 690125 - RNA, 64 nt, hsa; identical to SEQ ID NO: 265343

SEQ ID NO: 690126 - RNA, 64 nt, hsa; identical to SEQ ID NO: 265344

SEQ ID NO: 690127 - RNA, 64 nt, hsa; identical to SEQ ID NO: 265345

SEQ ID NO: 690128 - RNA, 64 nt, hsa; identical to SEQ ID NO: 265346

SEQ ID NO: 690129 - RNA, 64 nt, hsa; identical to SEQ ID NO: 265347

SEQ ID NO: 690130 - RNA, 64 nt, hsa; identical to SEQ ID NO: 265348

SEQ ID NO: 690131 - RNA, 64 nt, hsa; identical to SEQ ID NO: 265349

SEQ ID NO: 690132 - RNA, 64 nt, hsa; identical to SEQ ID NO: 265350

SEQ ID NO: 690133 - RNA, 64 nt, hsa; identical to SEQ ID NO: 265351

SEQ ID NO: 690134 - RNA, 64 nt, hsa; identical to SEQ ID NO: 265352

SEQ ID NO: 690135 - RNA, 64 nt, hsa; identical to SEQ ID NO: 265353

SEQ ID NO: 690136 - RNA, 64 nt, hsa; identical to SEQ ID NO: 265354

SEQ ID NO: 690137 - RNA, 64 nt, hsa; identical to SEQ ID NO: 265355

SEQ ID NO: 690138 - RNA, 64 nt, hsa; identical to SEQ ID NO: 265356

SEQ ID NO: 690139 - RNA, 64 nt, hsa; identical to SEQ ID NO: 265357

SEQ ID NO: 690140 - RNA, 64 nt, hsa; identical to SEQ ID NO: 265358

SEQ ID NO: 690141 - RNA, 64 nt, hsa; identical to SEQ ID NO: 265359

SEQ ID NO: 690142 - RNA, 64 nt, hsa; identical to SEQ ID NO: 265360

SEQ ID NO: 690143 - RNA, 64 nt, hsa; identical to SEQ ID NO: 265361

SEQ ID NO: 690144 - RNA, 64 nt, hsa; identical to SEQ ID NO: 265362

SEQ ID NO: 690145 - RNA, 64 nt, hsa; identical to SEQ ID NO: 265363

SEQ ID NO: 690146 - RNA, 64 nt, hsa; identical to SEQ ID NO: 265364

SEQ ID NO: 690147 - RNA, 64 nt, hsa; identical to SEQ ID NO: 265365

SEQ ID NO: 690148 - RNA, 64 nt, hsa; identical to SEQ ID NO: 265366

SEQ ID NO: 690149 - RNA, 64 nt, hsa; identical to SEQ ID NO: 265367

SEQ ID NO: 690150 - RNA, 64 nt, hsa; identical to SEQ ID NO: 265368

SEQ ID NO: 690151 - RNA, 64 nt, hsa; identical to SEQ ID NO: 265369

SEQ ID NO: 690152 - RNA, 64 nt, hsa; identical to SEQ ID NO: 265370

SEQ ID NO: 690153 - RNA, 64 nt, hsa; identical to SEQ ID NO: 265371

SEQ ID NO: 690154 - RNA, 64 nt, hsa; identical to SEQ ID NO: 265372

SEQ ID NO: 690155 - RNA, 64 nt, hsa; identical to SEQ ID NO: 265373

SEQ ID NO: 690156 - RNA, 64 nt, hsa; identical to SEQ ID NO: 265374

SEQ ID NO: 690157 - RNA, 64 nt, hsa; identical to SEQ ID NO: 265375

SEQ ID NO: 690158 - RNA, 64 nt, hsa; identical to SEQ ID NO: 265376

SEQ ID NO: 690159 - RNA, 64 nt, hsa; identical to SEQ ID NO: 265377

SEQ ID NO: 690160 - RNA, 64 nt, hsa; identical to SEQ ID NO: 265378

SEQ ID NO: 690161 - RNA, 64 nt, hsa; identical to SEQ ID NO: 265379

SEQ ID NO: 690162 - RNA, 64 nt, hsa; identical to SEQ ID NO: 265380

SEQ ID NO: 690163 - RNA, 64 nt, hsa; identical to SEQ ID NO: 265381

SEQ ID NO: 690164 - RNA, 64 nt, hsa; identical to SEQ ID NO: 265382

SEQ ID NO: 690165 - RNA, 64 nt, hsa; identical to SEQ ID NO: 265383

SEQ ID NO: 690166 - RNA, 64 nt, hsa; identical to SEQ ID NO: 265384

SEQ ID NO: 690167 - RNA, 64 nt, hsa; identical to SEQ ID NO: 265385

SEQ ID NO: 690168 - RNA, 64 nt, hsa; identical to SEQ ID NO: 265386

SEQ ID NO: 690169 - RNA, 64 nt, hsa; identical to SEQ ID NO: 265387

SEQ ID NO: 690170 - RNA, 64 nt, hsa; identical to SEQ ID NO: 265388

SEQ ID NO: 690171 - RNA, 64 nt, hsa; identical to SEQ ID NO: 265389

SEQ ID NO: 690172 - RNA, 64 nt, hsa; identical to SEQ ID NO: 265390

SEQ ID NO: 690173 - RNA, 64 nt, hsa; identical to SEQ ID NO: 265391

SEQ ID NO: 690174 - RNA, 64 nt, hsa; identical to SEQ ID NO: 265392

SEQ ID NO: 690175 - RNA, 64 nt, hsa; identical to SEQ ID NO: 265393

SEQ ID NO: 690176 - RNA, 64 nt, hsa; identical to SEQ ID NO: 265394

SEQ ID NO: 690177 - RNA, 64 nt, hsa; identical to SEQ ID NO: 265395

SEQ ID NO: 690178 - RNA, 64 nt, hsa; identical to SEQ ID NO: 265396

SEQ ID NO: 690179 - RNA, 64 nt, hsa; identical to SEQ ID NO: 265397

SEQ ID NO: 690180 - RNA, 64 nt, hsa; identical to SEQ ID NO: 265398

SEQ ID NO: 690181 - RNA, 64 nt, hsa; identical to SEQ ID NO: 265399

SEQ ID NO: 690182 - RNA, 64 nt, hsa; identical to SEQ ID NO: 265400

SEQ ID NO: 690183 - RNA, 64 nt, hsa; identical to SEQ ID NO: 265401

SEQ ID NO: 690184 - RNA, 64 nt, hsa; identical to SEQ ID NO: 265402

SEQ ID NO: 690185 - RNA, 64 nt, hsa; identical to SEQ ID NO: 265403

SEQ ID NO: 690186 - RNA, 64 nt, hsa; identical to SEQ ID NO: 265404

SEQ ID NO: 690187 - RNA, 64 nt, hsa; identical to SEQ ID NO: 265405

SEQ ID NO: 690188 - RNA, 64 nt, hsa; identical to SEQ ID NO: 265406

SEQ ID NO: 690189 - RNA, 64 nt, hsa; identical to SEQ ID NO: 265407

SEQ ID NO: 690190 - RNA, 64 nt, hsa; identical to SEQ ID NO: 265408

SEQ ID NO: 690191 - RNA, 64 nt, hsa; identical to SEQ ID NO: 265409

SEQ ID NO: 690192 - RNA, 64 nt, hsa; identical to SEQ ID NO: 265410

SEQ ID NO: 690193 - RNA, 64 nt, hsa; identical to SEQ ID NO: 265411

SEQ ID NO: 690194 - RNA, 64 nt, hsa; identical to SEQ ID NO: 265412

SEQ ID NO: 690195 - RNA, 64 nt, hsa; identical to SEQ ID NO: 265413

SEQ ID NO: 690196 - RNA, 64 nt, hsa; identical to SEQ ID NO: 265414

SEQ ID NO: 690197 - RNA, 64 nt, hsa; identical to SEQ ID NO: 265415

SEQ ID NO: 690198 - RNA, 64 nt, hsa; identical to SEQ ID NO: 265416

SEQ ID NO: 690199 - RNA, 64 nt, hsa; identical to SEQ ID NO: 265417

SEQ ID NO: 690200 - RNA, 64 nt, hsa; identical to SEQ ID NO: 265418

SEQ ID NO: 690201 - RNA, 64 nt, hsa; identical to SEQ ID NO: 265419

SEQ ID NO: 690202 - RNA, 63 nt, hsa; identical to SEQ ID NO: 265420

SEQ ID NO: 690203 - RNA, 64 nt, hsa; identical to SEQ ID NO: 265421

SEQ ID NO: 690204 - RNA, 64 nt, hsa; identical to SEQ ID NO: 265422

SEQ ID NO: 690205 - RNA, 64 nt, hsa; identical to SEQ ID NO: 265423

SEQ ID NO: 690206 - RNA, 64 nt, hsa; identical to SEQ ID NO: 265424

SEQ ID NO: 690207 - RNA, 64 nt, hsa; identical to SEQ ID NO: 265425

SEQ ID NO: 690208 - RNA, 64 nt, hsa; identical to SEQ ID NO: 265426

SEQ ID NO: 690209 - RNA, 64 nt, hsa; identical to SEQ ID NO: 265427

SEQ ID NO: 690210 - RNA, 64 nt, hsa; identical to SEQ ID NO: 265428

SEQ ID NO: 690211 - RNA, 64 nt, hsa; identical to SEQ ID NO: 265429

SEQ ID NO: 690212 - RNA, 64 nt, hsa; identical to SEQ ID NO: 265430

SEQ ID NO: 690213 - RNA, 64 nt, hsa; identical to SEQ ID NO: 265431

SEQ ID NO: 690214 - RNA, 64 nt, hsa; identical to SEQ ID NO: 265432

SEQ ID NO: 690215 - RNA, 64 nt, hsa; identical to SEQ ID NO: 265433

SEQ ID NO: 690216 - RNA, 64 nt, hsa; identical to SEQ ID NO: 265434

SEQ ID NO: 690217 - RNA, 64 nt, hsa; identical to SEQ ID NO: 265435

SEQ ID NO: 690218 - RNA, 64 nt, hsa; identical to SEQ ID NO: 265436

SEQ ID NO: 690219 - RNA, 64 nt, hsa; identical to SEQ ID NO: 265437

SEQ ID NO: 690220 - RNA, 64 nt, hsa; identical to SEQ ID NO: 265438

SEQ ID NO: 690221 - RNA, 64 nt, hsa; identical to SEQ ID NO: 265439

SEQ ID NO: 690222 - RNA, 64 nt, hsa; identical to SEQ ID NO: 265440

SEQ ID NO: 690223 - RNA, 64 nt, hsa; identical to SEQ ID NO: 265441

SEQ ID NO: 690224 - RNA, 64 nt, hsa; identical to SEQ ID NO: 265442

SEQ ID NO: 690225 - RNA, 64 nt, hsa; identical to SEQ ID NO: 265443

SEQ ID NO: 690226 - RNA, 64 nt, hsa; identical to SEQ ID NO: 265444

SEQ ID NO: 690227 - RNA, 64 nt, hsa; identical to SEQ ID NO: 265445

SEQ ID NO: 690228 - RNA, 64 nt, hsa; identical to SEQ ID NO: 265446

SEQ ID NO: 690229 - RNA, 64 nt, hsa; identical to SEQ ID NO: 265447

SEQ ID NO: 690230 - RNA, 64 nt, hsa; identical to SEQ ID NO: 265448

SEQ ID NO: 690231 - RNA, 64 nt, hsa; identical to SEQ ID NO: 265449

SEQ ID NO: 690232 - RNA, 64 nt, hsa; identical to SEQ ID NO: 265450

SEQ ID NO: 690233 - RNA, 50 nt, hsa; identical to SEQ ID NO: 265451

SEQ ID NO: 690234 - RNA, 64 nt, hsa; identical to SEQ ID NO: 265452

SEQ ID NO: 690235 - RNA, 64 nt, hsa; identical to SEQ ID NO: 265453

SEQ ID NO: 690236 - RNA, 64 nt, hsa; identical to SEQ ID NO: 265454

SEQ ID NO: 690237 - RNA, 64 nt, hsa; identical to SEQ ID NO: 265455

SEQ ID NO: 690238 - RNA, 64 nt, hsa; identical to SEQ ID NO: 265456

SEQ ID NO: 690239 - RNA, 64 nt, hsa; identical to SEQ ID NO: 265457

SEQ ID NO: 690240 - RNA, 64 nt, hsa; identical to SEQ ID NO: 265458

SEQ ID NO: 690241 - RNA, 64 nt, hsa; identical to SEQ ID NO: 265459

SEQ ID NO: 690242 - RNA, 64 nt, hsa; identical to SEQ ID NO: 265460

SEQ ID NO: 690243 - RNA, 64 nt, hsa; identical to SEQ ID NO: 265461

SEQ ID NO: 690244 - RNA, 64 nt, hsa; identical to SEQ ID NO: 265462

SEQ ID NO: 690245 - RNA, 64 nt, hsa; identical to SEQ ID NO: 265463

SEQ ID NO: 690246 - RNA, 64 nt, hsa; identical to SEQ ID NO: 265464

SEQ ID NO: 690247 - RNA, 64 nt, hsa; identical to SEQ ID NO: 298158

SEQ ID NO: 690248 - RNA, 64 nt, hsa; identical to SEQ ID NO: 298159

SEQ ID NO: 690249 - RNA, 64 nt, hsa; identical to SEQ ID NO: 298160

SEQ ID NO: 690250 - RNA, 64 nt, hsa; identical to SEQ ID NO: 298161

SEQ ID NO: 690251 - RNA, 64 nt, hsa; identical to SEQ ID NO: 298162

SEQ ID NO: 690252 - RNA, 64 nt, hsa; identical to SEQ ID NO: 298163

SEQ ID NO: 690253 - RNA, 64 nt, hsa; identical to SEQ ID NO: 298164

SEQ ID NO: 690254 - RNA, 64 nt, hsa; identical to SEQ ID NO: 298165

SEQ ID NO: 690255 - RNA, 64 nt, hsa; identical to SEQ ID NO: 298166

SEQ ID NO: 690256 - RNA, 64 nt, hsa; identical to SEQ ID NO: 298167

SEQ ID NO: 690257 - RNA, 64 nt, hsa; identical to SEQ ID NO: 298168

SEQ ID NO: 690258 - RNA, 64 nt, hsa; identical to SEQ ID NO: 298169

SEQ ID NO: 690259 - RNA, 64 nt, hsa; identical to SEQ ID NO: 298170

SEQ ID NO: 690260 - RNA, 64 nt, hsa; identical to SEQ ID NO: 298171

SEQ ID NO: 690261 - RNA, 64 nt, hsa; identical to SEQ ID NO: 298172

SEQ ID NO: 690262 - RNA, 64 nt, hsa; identical to SEQ ID NO: 298173

SEQ ID NO: 690263 - RNA, 64 nt, hsa; identical to SEQ ID NO: 298174

SEQ ID NO: 690264 - RNA, 64 nt, hsa; identical to SEQ ID NO: 298175

SEQ ID NO: 690265 - RNA, 64 nt, hsa; identical to SEQ ID NO: 298176

SEQ ID NO: 690266 - RNA, 64 nt, hsa; identical to SEQ ID NO: 298177

SEQ ID NO: 690267 - RNA, 64 nt, hsa; identical to SEQ ID NO: 298178

SEQ ID NO: 690268 - RNA, 64 nt, hsa; identical to SEQ ID NO: 298179

SEQ ID NO: 690269 - RNA, 64 nt, hsa; identical to SEQ ID NO: 298180

SEQ ID NO: 690270 - RNA, 64 nt, hsa; identical to SEQ ID NO: 298181

SEQ ID NO: 690271 - RNA, 64 nt, hsa; identical to SEQ ID NO: 298182

SEQ ID NO: 690272 - RNA, 64 nt, hsa; identical to SEQ ID NO: 298183

SEQ ID NO: 690273 - RNA, 64 nt, hsa; identical to SEQ ID NO: 298184

SEQ ID NO: 690274 - RNA, 64 nt, hsa; identical to SEQ ID NO: 298185

SEQ ID NO: 690275 - RNA, 64 nt, hsa; identical to SEQ ID NO: 298186

SEQ ID NO: 690276 - RNA, 64 nt, hsa; identical to SEQ ID NO: 298187

SEQ ID NO: 690277 - RNA, 64 nt, hsa; identical to SEQ ID NO: 298188

SEQ ID NO: 690278 - RNA, 64 nt, hsa; identical to SEQ ID NO: 298189

SEQ ID NO: 690279 - RNA, 64 nt, hsa; identical to SEQ ID NO: 298190

SEQ ID NO: 690280 - RNA, 64 nt, hsa; identical to SEQ ID NO: 298191

SEQ ID NO: 690281 - RNA, 64 nt, hsa; identical to SEQ ID NO: 298192

SEQ ID NO: 690282 - RNA, 64 nt, hsa; identical to SEQ ID NO: 298193

SEQ ID NO: 690283 - RNA, 64 nt, hsa; identical to SEQ ID NO: 298194

SEQ ID NO: 690284 - RNA, 64 nt, hsa; identical to SEQ ID NO: 298195

SEQ ID NO: 690285 - RNA, 64 nt, hsa; identical to SEQ ID NO: 298196

SEQ ID NO: 690286 - RNA, 64 nt, hsa; identical to SEQ ID NO: 298197

SEQ ID NO: 690287 - RNA, 64 nt, hsa; identical to SEQ ID NO: 298198

SEQ ID NO: 690288 - RNA, 64 nt, hsa; identical to SEQ ID NO: 298199

SEQ ID NO: 690289 - RNA, 64 nt, hsa; identical to SEQ ID NO: 298200

SEQ ID NO: 690290 - RNA, 64 nt, hsa; identical to SEQ ID NO: 298201

SEQ ID NO: 690291 - RNA, 64 nt, hsa; identical to SEQ ID NO: 298202

SEQ ID NO: 690292 - RNA, 64 nt, hsa; identical to SEQ ID NO: 298203

SEQ ID NO: 690293 - RNA, 64 nt, hsa; identical to SEQ ID NO: 298204

SEQ ID NO: 690294 - RNA, 64 nt, hsa; identical to SEQ ID NO: 298205

SEQ ID NO: 690295 - RNA, 64 nt, hsa; identical to SEQ ID NO: 298206

SEQ ID NO: 690296 - RNA, 64 nt, hsa; identical to SEQ ID NO: 298207

SEQ ID NO: 690297 - RNA, 64 nt, hsa; identical to SEQ ID NO: 298208

SEQ ID NO: 690298 - RNA, 64 nt, hsa; identical to SEQ ID NO: 298209

SEQ ID NO: 690299 - RNA, 64 nt, hsa; identical to SEQ ID NO: 298210

SEQ ID NO: 690300 - RNA, 64 nt, hsa; identical to SEQ ID NO: 298211

SEQ ID NO: 690301 - RNA, 64 nt, hsa; identical to SEQ ID NO: 298212

SEQ ID NO: 690302 - RNA, 64 nt, hsa; identical to SEQ ID NO: 298213

SEQ ID NO: 690303 - RNA, 64 nt, hsa; identical to SEQ ID NO: 298214

SEQ ID NO: 690304 - RNA, 64 nt, hsa; identical to SEQ ID NO: 298215

SEQ ID NO: 690305 - RNA, 64 nt, hsa; identical to SEQ ID NO: 298216

SEQ ID NO: 690306 - RNA, 64 nt, hsa; identical to SEQ ID NO: 298217

SEQ ID NO: 690307 - RNA, 64 nt, hsa; identical to SEQ ID NO: 298218

SEQ ID NO: 690308 - RNA, 64 nt, hsa; identical to SEQ ID NO: 298219

SEQ ID NO: 690309 - RNA, 64 nt, hsa; identical to SEQ ID NO: 298220

SEQ ID NO: 690310 - RNA, 64 nt, hsa; identical to SEQ ID NO: 298221

SEQ ID NO: 690311 - RNA, 64 nt, hsa; identical to SEQ ID NO: 298222

SEQ ID NO: 690312 - RNA, 64 nt, hsa; identical to SEQ ID NO: 298223

SEQ ID NO: 690313 - RNA, 64 nt, hsa; identical to SEQ ID NO: 298224

SEQ ID NO: 690314 - RNA, 64 nt, hsa; identical to SEQ ID NO: 298225

SEQ ID NO: 690315 - RNA, 64 nt, hsa; identical to SEQ ID NO: 298226

SEQ ID NO: 690316 - RNA, 64 nt, hsa; identical to SEQ ID NO: 298227

SEQ ID NO: 690317 - RNA, 64 nt, hsa; identical to SEQ ID NO: 298228

SEQ ID NO: 690318 - RNA, 64 nt, hsa; identical to SEQ ID NO: 298229

SEQ ID NO: 690319 - RNA, 56 nt, hsa; identical to SEQ ID NO: 298230

SEQ ID NO: 690320 - RNA, 64 nt, hsa; identical to SEQ ID NO: 298231

SEQ ID NO: 690321 - RNA, 64 nt, hsa; identical to SEQ ID NO: 298232

SEQ ID NO: 690322 - RNA, 64 nt, hsa; identical to SEQ ID NO: 298233

SEQ ID NO: 690323 - RNA, 64 nt, hsa; identical to SEQ ID NO: 298234

SEQ ID NO: 690324 - RNA, 64 nt, hsa; identical to SEQ ID NO: 298235

SEQ ID NO: 690325 - RNA, 64 nt, hsa; identical to SEQ ID NO: 298236

SEQ ID NO: 690326 - RNA, 64 nt, hsa; identical to SEQ ID NO: 298237

SEQ ID NO: 690327 - RNA, 64 nt, hsa; identical to SEQ ID NO: 298238

SEQ ID NO: 690328 - RNA, 63 nt, hsa; identical to SEQ ID NO: 298239

SEQ ID NO: 690329 - RNA, 64 nt, hsa; identical to SEQ ID NO: 298240

SEQ ID NO: 690330 - RNA, 64 nt, hsa; identical to SEQ ID NO: 298241

SEQ ID NO: 690331 - RNA, 64 nt, hsa; identical to SEQ ID NO: 298242

SEQ ID NO: 690332 - RNA, 64 nt, hsa; identical to SEQ ID NO: 298243

SEQ ID NO: 690333 - RNA, 64 nt, hsa; identical to SEQ ID NO: 298244

SEQ ID NO: 690334 - RNA, 64 nt, hsa; identical to SEQ ID NO: 298245

SEQ ID NO: 690335 - RNA, 64 nt, hsa; identical to SEQ ID NO: 298246

SEQ ID NO: 690336 - RNA, 64 nt, hsa; identical to SEQ ID NO: 298247

SEQ ID NO: 690337 - RNA, 64 nt, hsa; identical to SEQ ID NO: 298248

SEQ ID NO: 690338 - RNA, 64 nt, hsa; identical to SEQ ID NO: 298249

SEQ ID NO: 690339 - RNA, 64 nt, hsa; identical to SEQ ID NO: 226834

SEQ ID NO: 690340 - RNA, 64 nt, hsa; identical to SEQ ID NO: 226835

SEQ ID NO: 690341 - RNA, 64 nt, hsa; identical to SEQ ID NO: 226836

SEQ ID NO: 690342 - RNA, 64 nt, hsa; identical to SEQ ID NO: 226837

SEQ ID NO: 690343 - RNA, 64 nt, hsa; identical to SEQ ID NO: 226838

SEQ ID NO: 690344 - RNA, 64 nt, hsa; identical to SEQ ID NO: 226839

SEQ ID NO: 690345 - RNA, 64 nt, hsa; identical to SEQ ID NO: 226840

SEQ ID NO: 690346 - RNA, 64 nt, hsa; identical to SEQ ID NO: 226841

SEQ ID NO: 690347 - RNA, 64 nt, hsa; identical to SEQ ID NO: 226842

SEQ ID NO: 690348 - RNA, 64 nt, hsa; identical to SEQ ID NO: 226843

SEQ ID NO: 690349 - RNA, 64 nt, hsa; identical to SEQ ID NO: 226844

SEQ ID NO: 690350 - RNA, 64 nt, hsa; identical to SEQ ID NO: 226845

SEQ ID NO: 690351 - RNA, 64 nt, hsa; identical to SEQ ID NO: 226846

SEQ ID NO: 690352 - RNA, 64 nt, hsa; identical to SEQ ID NO: 226847

SEQ ID NO: 690353 - RNA, 64 nt, hsa; identical to SEQ ID NO: 226848

SEQ ID NO: 690354 - RNA, 64 nt, hsa; identical to SEQ ID NO: 226849

SEQ ID NO: 690355 - RNA, 64 nt, hsa; identical to SEQ ID NO: 226850

SEQ ID NO: 690356 - RNA, 64 nt, hsa; identical to SEQ ID NO: 226851

SEQ ID NO: 690357 - RNA, 64 nt, hsa; identical to SEQ ID NO: 226852

SEQ ID NO: 690358 - RNA, 64 nt, hsa; identical to SEQ ID NO: 226853

SEQ ID NO: 690359 - RNA, 64 nt, hsa; identical to SEQ ID NO: 226854

SEQ ID NO: 690360 - RNA, 64 nt, hsa; identical to SEQ ID NO: 226855

SEQ ID NO: 690361 - RNA, 64 nt, hsa; identical to SEQ ID NO: 226856

SEQ ID NO: 690362 - RNA, 64 nt, hsa; identical to SEQ ID NO: 226857

SEQ ID NO: 690363 - RNA, 64 nt, hsa; identical to SEQ ID NO: 226858

SEQ ID NO: 690364 - RNA, 64 nt, hsa; identical to SEQ ID NO: 226859

SEQ ID NO: 690365 - RNA, 64 nt, hsa; identical to SEQ ID NO: 226860

SEQ ID NO: 690366 - RNA, 64 nt, hsa; identical to SEQ ID NO: 226861

SEQ ID NO: 690367 - RNA, 64 nt, hsa; identical to SEQ ID NO: 226862

SEQ ID NO: 690368 - RNA, 64 nt, hsa; identical to SEQ ID NO: 226863

SEQ ID NO: 690369 - RNA, 64 nt, hsa; identical to SEQ ID NO: 226864

SEQ ID NO: 690370 - RNA, 64 nt, hsa; identical to SEQ ID NO: 226865

SEQ ID NO: 690371 - RNA, 64 nt, hsa; identical to SEQ ID NO: 226866

SEQ ID NO: 690372 - RNA, 64 nt, hsa; identical to SEQ ID NO: 226867

SEQ ID NO: 690373 - RNA, 64 nt, hsa; identical to SEQ ID NO: 226868

SEQ ID NO: 690374 - RNA, 64 nt, hsa; identical to SEQ ID NO: 226869

SEQ ID NO: 690375 - RNA, 64 nt, hsa; identical to SEQ ID NO: 226870

SEQ ID NO: 690376 - RNA, 64 nt, hsa; identical to SEQ ID NO: 226871

SEQ ID NO: 690377 - RNA, 64 nt, hsa; identical to SEQ ID NO: 226872

SEQ ID NO: 690378 - RNA, 64 nt, hsa; identical to SEQ ID NO: 226873

SEQ ID NO: 690379 - RNA, 64 nt, hsa; identical to SEQ ID NO: 226874

SEQ ID NO: 690380 - RNA, 64 nt, hsa; identical to SEQ ID NO: 226875

SEQ ID NO: 690381 - RNA, 64 nt, hsa; identical to SEQ ID NO: 226876

SEQ ID NO: 690382 - RNA, 64 nt, hsa; identical to SEQ ID NO: 226877

SEQ ID NO: 690383 - RNA, 64 nt, hsa; identical to SEQ ID NO: 226878

SEQ ID NO: 690384 - RNA, 64 nt, hsa; identical to SEQ ID NO: 226879

SEQ ID NO: 690385 - RNA, 64 nt, hsa; identical to SEQ ID NO: 226880

SEQ ID NO: 690386 - RNA, 64 nt, hsa; identical to SEQ ID NO: 226881

SEQ ID NO: 690387 - RNA, 64 nt, hsa; identical to SEQ ID NO: 226882

SEQ ID NO: 690388 - RNA, 64 nt, hsa; identical to SEQ ID NO: 226883

SEQ ID NO: 690389 - RNA, 64 nt, hsa; identical to SEQ ID NO: 226884

SEQ ID NO: 690390 - RNA, 64 nt, hsa; identical to SEQ ID NO: 226885

SEQ ID NO: 690391 - RNA, 64 nt, hsa; identical to SEQ ID NO: 226886

SEQ ID NO: 690392 - RNA, 64 nt, hsa; identical to SEQ ID NO: 226887

SEQ ID NO: 690393 - RNA, 64 nt, hsa; identical to SEQ ID NO: 226888

SEQ ID NO: 690394 - RNA, 64 nt, hsa; identical to SEQ ID NO: 226889

SEQ ID NO: 690395 - RNA, 64 nt, hsa; identical to SEQ ID NO: 226890

SEQ ID NO: 690396 - RNA, 64 nt, hsa; identical to SEQ ID NO: 265328

SEQ ID NO: 690397 - RNA, 64 nt, hsa; identical to SEQ ID NO: 265329

SEQ ID NO: 690398 - RNA, 64 nt, hsa; identical to SEQ ID NO: 265330

SEQ ID NO: 690399 - RNA, 64 nt, hsa; identical to SEQ ID NO: 265331

SEQ ID NO: 690400 - RNA, 64 nt, hsa; identical to SEQ ID NO: 265332

SEQ ID NO: 690401 - RNA, 64 nt, hsa; identical to SEQ ID NO: 265333

SEQ ID NO: 690402 - RNA, 64 nt, hsa; identical to SEQ ID NO: 265334

SEQ ID NO: 690403 - RNA, 64 nt, hsa; identical to SEQ ID NO: 265335

SEQ ID NO: 690404 - RNA, 64 nt, hsa; identical to SEQ ID NO: 265336

SEQ ID NO: 690405 - RNA, 64 nt, hsa; identical to SEQ ID NO: 265337

SEQ ID NO: 690406 - RNA, 64 nt, hsa; identical to SEQ ID NO: 265338

SEQ ID NO: 690407 - RNA, 64 nt, hsa; identical to SEQ ID NO: 265339

SEQ ID NO: 690408 - RNA, 64 nt, hsa; identical to SEQ ID NO: 265340

SEQ ID NO: 690409 - RNA, 64 nt, hsa; identical to SEQ ID NO: 265341

SEQ ID NO: 690410 - RNA, 64 nt, hsa; identical to SEQ ID NO: 265342

SEQ ID NO: 690411 - RNA, 64 nt, hsa; identical to SEQ ID NO: 265343

SEQ ID NO: 690412 - RNA, 64 nt, hsa; identical to SEQ ID NO: 265344

SEQ ID NO: 690413 - RNA, 64 nt, hsa; identical to SEQ ID NO: 265345

SEQ ID NO: 690414 - RNA, 64 nt, hsa; identical to SEQ ID NO: 265346

SEQ ID NO: 690415 - RNA, 64 nt, hsa; identical to SEQ ID NO: 265347

SEQ ID NO: 690416 - RNA, 64 nt, hsa; identical to SEQ ID NO: 265348

SEQ ID NO: 690417 - RNA, 64 nt, hsa; identical to SEQ ID NO: 265349

SEQ ID NO: 690418 - RNA, 64 nt, hsa; identical to SEQ ID NO: 265350

SEQ ID NO: 690419 - RNA, 64 nt, hsa; identical to SEQ ID NO: 265351

SEQ ID NO: 690420 - RNA, 64 nt, hsa; identical to SEQ ID NO: 265352

SEQ ID NO: 690421 - RNA, 64 nt, hsa; identical to SEQ ID NO: 265353

SEQ ID NO: 690422 - RNA, 64 nt, hsa; identical to SEQ ID NO: 265354

SEQ ID NO: 690423 - RNA, 64 nt, hsa; identical to SEQ ID NO: 265355

SEQ ID NO: 690424 - RNA, 64 nt, hsa; identical to SEQ ID NO: 265356

SEQ ID NO: 690425 - RNA, 64 nt, hsa; identical to SEQ ID NO: 265357

SEQ ID NO: 690426 - RNA, 64 nt, hsa; identical to SEQ ID NO: 265358

SEQ ID NO: 690427 - RNA, 64 nt, hsa; identical to SEQ ID NO: 265359

SEQ ID NO: 690428 - RNA, 64 nt, hsa; identical to SEQ ID NO: 265360

SEQ ID NO: 690429 - RNA, 64 nt, hsa; identical to SEQ ID NO: 265361

SEQ ID NO: 690430 - RNA, 64 nt, hsa; identical to SEQ ID NO: 265362

SEQ ID NO: 690431 - RNA, 64 nt, hsa; identical to SEQ ID NO: 265363

SEQ ID NO: 690432 - RNA, 64 nt, hsa; identical to SEQ ID NO: 265364

SEQ ID NO: 690433 - RNA, 64 nt, hsa; identical to SEQ ID NO: 265365

SEQ ID NO: 690434 - RNA, 64 nt, hsa; identical to SEQ ID NO: 265366

SEQ ID NO: 690435 - RNA, 64 nt, hsa; identical to SEQ ID NO: 265367

SEQ ID NO: 690436 - RNA, 64 nt, hsa; identical to SEQ ID NO: 265368

SEQ ID NO: 690437 - RNA, 64 nt, hsa; identical to SEQ ID NO: 265369

SEQ ID NO: 690438 - RNA, 64 nt, hsa; identical to SEQ ID NO: 265370

SEQ ID NO: 690439 - RNA, 64 nt, hsa; identical to SEQ ID NO: 265371

SEQ ID NO: 690440 - RNA, 64 nt, hsa; identical to SEQ ID NO: 265372

SEQ ID NO: 690441 - RNA, 64 nt, hsa; identical to SEQ ID NO: 265373

SEQ ID NO: 690442 - RNA, 64 nt, hsa; identical to SEQ ID NO: 265374

SEQ ID NO: 690443 - RNA, 64 nt, hsa; identical to SEQ ID NO: 265375

SEQ ID NO: 690444 - RNA, 64 nt, hsa; identical to SEQ ID NO: 265376

SEQ ID NO: 690445 - RNA, 64 nt, hsa; identical to SEQ ID NO: 265377

SEQ ID NO: 690446 - RNA, 64 nt, hsa; identical to SEQ ID NO: 265378

SEQ ID NO: 690447 - RNA, 64 nt, hsa; identical to SEQ ID NO: 265379

SEQ ID NO: 690448 - RNA, 64 nt, hsa; identical to SEQ ID NO: 265380

SEQ ID NO: 690449 - RNA, 64 nt, hsa; identical to SEQ ID NO: 265381

SEQ ID NO: 690450 - RNA, 64 nt, hsa; identical to SEQ ID NO: 265382

SEQ ID NO: 690451 - RNA, 64 nt, hsa; identical to SEQ ID NO: 265383

SEQ ID NO: 690452 - RNA, 64 nt, hsa; identical to SEQ ID NO: 265384

SEQ ID NO: 690453 - RNA, 64 nt, hsa; identical to SEQ ID NO: 265385

SEQ ID NO: 690454 - RNA, 64 nt, hsa; identical to SEQ ID NO: 265386

SEQ ID NO: 690455 - RNA, 64 nt, hsa; identical to SEQ ID NO: 265387

SEQ ID NO: 690456 - RNA, 64 nt, hsa; identical to SEQ ID NO: 265388

SEQ ID NO: 690457 - RNA, 64 nt, hsa; identical to SEQ ID NO: 265389

SEQ ID NO: 690458 - RNA, 64 nt, hsa; identical to SEQ ID NO: 265390

SEQ ID NO: 690459 - RNA, 64 nt, hsa; identical to SEQ ID NO: 265391

SEQ ID NO: 690460 - RNA, 64 nt, hsa; identical to SEQ ID NO: 265392

SEQ ID NO: 690461 - RNA, 64 nt, hsa; identical to SEQ ID NO: 265393

SEQ ID NO: 690462 - RNA, 64 nt, hsa; identical to SEQ ID NO: 265394

SEQ ID NO: 690463 - RNA, 64 nt, hsa; identical to SEQ ID NO: 265395

SEQ ID NO: 690464 - RNA, 64 nt, hsa; identical to SEQ ID NO: 265396

SEQ ID NO: 690465 - RNA, 64 nt, hsa; identical to SEQ ID NO: 265397

SEQ ID NO: 690466 - RNA, 64 nt, hsa; identical to SEQ ID NO: 265398

SEQ ID NO: 690467 - RNA, 64 nt, hsa; identical to SEQ ID NO: 265399

SEQ ID NO: 690468 - RNA, 64 nt, hsa; identical to SEQ ID NO: 265400

SEQ ID NO: 690469 - RNA, 64 nt, hsa; identical to SEQ ID NO: 265401

SEQ ID NO: 690470 - RNA, 64 nt, hsa; identical to SEQ ID NO: 265402

SEQ ID NO: 690471 - RNA, 64 nt, hsa; identical to SEQ ID NO: 265403

SEQ ID NO: 690472 - RNA, 64 nt, hsa; identical to SEQ ID NO: 265404

SEQ ID NO: 690473 - RNA, 64 nt, hsa; identical to SEQ ID NO: 265405

SEQ ID NO: 690474 - RNA, 64 nt, hsa; identical to SEQ ID NO: 265406

SEQ ID NO: 690475 - RNA, 64 nt, hsa; identical to SEQ ID NO: 265407

SEQ ID NO: 690476 - RNA, 64 nt, hsa; identical to SEQ ID NO: 265408

SEQ ID NO: 690477 - RNA, 64 nt, hsa; identical to SEQ ID NO: 265409

SEQ ID NO: 690478 - RNA, 64 nt, hsa; identical to SEQ ID NO: 265410

SEQ ID NO: 690479 - RNA, 64 nt, hsa; identical to SEQ ID NO: 265411

SEQ ID NO: 690480 - RNA, 64 nt, hsa; identical to SEQ ID NO: 265412

SEQ ID NO: 690481 - RNA, 64 nt, hsa; identical to SEQ ID NO: 265413

SEQ ID NO: 690482 - RNA, 64 nt, hsa; identical to SEQ ID NO: 265414

SEQ ID NO: 690483 - RNA, 64 nt, hsa; identical to SEQ ID NO: 265415

SEQ ID NO: 690484 - RNA, 64 nt, hsa; identical to SEQ ID NO: 265416

SEQ ID NO: 690485 - RNA, 64 nt, hsa; identical to SEQ ID NO: 265417

SEQ ID NO: 690486 - RNA, 64 nt, hsa; identical to SEQ ID NO: 265418

SEQ ID NO: 690487 - RNA, 64 nt, hsa; identical to SEQ ID NO: 265419

SEQ ID NO: 690488 - RNA, 63 nt, hsa; identical to SEQ ID NO: 265420

SEQ ID NO: 690489 - RNA, 64 nt, hsa; identical to SEQ ID NO: 265421

SEQ ID NO: 690490 - RNA, 64 nt, hsa; identical to SEQ ID NO: 265422

SEQ ID NO: 690491 - RNA, 64 nt, hsa; identical to SEQ ID NO: 265423

SEQ ID NO: 690492 - RNA, 64 nt, hsa; identical to SEQ ID NO: 265424

SEQ ID NO: 690493 - RNA, 64 nt, hsa; identical to SEQ ID NO: 265425

SEQ ID NO: 690494 - RNA, 64 nt, hsa; identical to SEQ ID NO: 265426

SEQ ID NO: 690495 - RNA, 64 nt, hsa; identical to SEQ ID NO: 265427

SEQ ID NO: 690496 - RNA, 64 nt, hsa; identical to SEQ ID NO: 265428

SEQ ID NO: 690497 - RNA, 64 nt, hsa; identical to SEQ ID NO: 265429

SEQ ID NO: 690498 - RNA, 64 nt, hsa; identical to SEQ ID NO: 265430

SEQ ID NO: 690499 - RNA, 64 nt, hsa; identical to SEQ ID NO: 265431

SEQ ID NO: 690500 - RNA, 64 nt, hsa; identical to SEQ ID NO: 265432

SEQ ID NO: 690501 - RNA, 64 nt, hsa; identical to SEQ ID NO: 265433

SEQ ID NO: 690502 - RNA, 64 nt, hsa; identical to SEQ ID NO: 265434

SEQ ID NO: 690503 - RNA, 64 nt, hsa; identical to SEQ ID NO: 265435

SEQ ID NO: 690504 - RNA, 64 nt, hsa; identical to SEQ ID NO: 265436

SEQ ID NO: 690505 - RNA, 64 nt, hsa; identical to SEQ ID NO: 265437

SEQ ID NO: 690506 - RNA, 64 nt, hsa; identical to SEQ ID NO: 265438

SEQ ID NO: 690507 - RNA, 64 nt, hsa; identical to SEQ ID NO: 265439

SEQ ID NO: 690508 - RNA, 64 nt, hsa; identical to SEQ ID NO: 265440

SEQ ID NO: 690509 - RNA, 64 nt, hsa; identical to SEQ ID NO: 265441

SEQ ID NO: 690510 - RNA, 64 nt, hsa; identical to SEQ ID NO: 265442

SEQ ID NO: 690511 - RNA, 64 nt, hsa; identical to SEQ ID NO: 265443

SEQ ID NO: 690512 - RNA, 64 nt, hsa; identical to SEQ ID NO: 265444

SEQ ID NO: 690513 - RNA, 64 nt, hsa; identical to SEQ ID NO: 265445

SEQ ID NO: 690514 - RNA, 64 nt, hsa; identical to SEQ ID NO: 265446

SEQ ID NO: 690515 - RNA, 64 nt, hsa; identical to SEQ ID NO: 265447

SEQ ID NO: 690516 - RNA, 64 nt, hsa; identical to SEQ ID NO: 265448

SEQ ID NO: 690517 - RNA, 64 nt, hsa; identical to SEQ ID NO: 265449

SEQ ID NO: 690518 - RNA, 64 nt, hsa; identical to SEQ ID NO: 265450

SEQ ID NO: 690519 - RNA, 50 nt, hsa; identical to SEQ ID NO: 265451

SEQ ID NO: 690520 - RNA, 64 nt, hsa; identical to SEQ ID NO: 265452

SEQ ID NO: 690521 - RNA, 64 nt, hsa; identical to SEQ ID NO: 265453

SEQ ID NO: 690522 - RNA, 64 nt, hsa; identical to SEQ ID NO: 265454

SEQ ID NO: 690523 - RNA, 64 nt, hsa; identical to SEQ ID NO: 265455

SEQ ID NO: 690524 - RNA, 64 nt, hsa; identical to SEQ ID NO: 265456

SEQ ID NO: 690525 - RNA, 64 nt, hsa; identical to SEQ ID NO: 265457

SEQ ID NO: 690526 - RNA, 64 nt, hsa; identical to SEQ ID NO: 265458

SEQ ID NO: 690527 - RNA, 64 nt, hsa; identical to SEQ ID NO: 265459

SEQ ID NO: 690528 - RNA, 64 nt, hsa; identical to SEQ ID NO: 265460

SEQ ID NO: 690529 - RNA, 64 nt, hsa; identical to SEQ ID NO: 265461

SEQ ID NO: 690530 - RNA, 64 nt, hsa; identical to SEQ ID NO: 265462

SEQ ID NO: 690531 - RNA, 64 nt, hsa; identical to SEQ ID NO: 265463

SEQ ID NO: 690532 - RNA, 64 nt, hsa; identical to SEQ ID NO: 265464

SEQ ID NO: 690533 - RNA, 64 nt, hsa; identical to SEQ ID NO: 91465

SEQ ID NO: 690534 - RNA, 64 nt, hsa; identical to SEQ ID NO: 91466

SEQ ID NO: 690535 - RNA, 64 nt, hsa; identical to SEQ ID NO: 91467

SEQ ID NO: 690536 - RNA, 64 nt, hsa; identical to SEQ ID NO: 91468

SEQ ID NO: 690537 - RNA, 64 nt, hsa; identical to SEQ ID NO: 91469

SEQ ID NO: 690538 - RNA, 64 nt, hsa; identical to SEQ ID NO: 91470

SEQ ID NO: 690539 - RNA, 64 nt, hsa; identical to SEQ ID NO: 91471

SEQ ID NO: 690540 - RNA, 64 nt, hsa; identical to SEQ ID NO: 91472

SEQ ID NO: 690541 - RNA, 64 nt, hsa; identical to SEQ ID NO: 91473

SEQ ID NO: 690542 - RNA, 64 nt, hsa; identical to SEQ ID NO: 91474

SEQ ID NO: 690543 - RNA, 64 nt, hsa; identical to SEQ ID NO: 91475

SEQ ID NO: 690544 - RNA, 64 nt, hsa; identical to SEQ ID NO: 91476

SEQ ID NO: 690545 - RNA, 64 nt, hsa; identical to SEQ ID NO: 91477

SEQ ID NO: 690546 - RNA, 64 nt, hsa; identical to SEQ ID NO: 91478

SEQ ID NO: 690547 - RNA, 64 nt, hsa; identical to SEQ ID NO: 91479

SEQ ID NO: 690548 - RNA, 64 nt, hsa; identical to SEQ ID NO: 91480

SEQ ID NO: 690549 - RNA, 64 nt, hsa; identical to SEQ ID NO: 91481

SEQ ID NO: 690550 - RNA, 64 nt, hsa; identical to SEQ ID NO: 91482

SEQ ID NO: 690551 - RNA, 64 nt, hsa; identical to SEQ ID NO: 91483

SEQ ID NO: 690552 - RNA, 64 nt, hsa; identical to SEQ ID NO: 91484

SEQ ID NO: 690553 - RNA, 64 nt, hsa; identical to SEQ ID NO: 51723

SEQ ID NO: 690554 - RNA, 64 nt, hsa; identical to SEQ ID NO: 51724

SEQ ID NO: 690555 - RNA, 64 nt, hsa; identical to SEQ ID NO: 51725

SEQ ID NO: 690556 - RNA, 64 nt, hsa; identical to SEQ ID NO: 51726

SEQ ID NO: 690557 - RNA, 64 nt, hsa; identical to SEQ ID NO: 51727

SEQ ID NO: 690558 - RNA, 64 nt, hsa; identical to SEQ ID NO: 51728

SEQ ID NO: 690559 - RNA, 64 nt, hsa; identical to SEQ ID NO: 51729

SEQ ID NO: 690560 - RNA, 64 nt, hsa; identical to SEQ ID NO: 51730

SEQ ID NO: 690561 - RNA, 64 nt, hsa; identical to SEQ ID NO: 51731

SEQ ID NO: 690562 - RNA, 64 nt, hsa; identical to SEQ ID NO: 51732

SEQ ID NO: 690563 - RNA, 64 nt, hsa; identical to SEQ ID NO: 51733

SEQ ID NO: 690564 - RNA, 64 nt, hsa; identical to SEQ ID NO: 51734

SEQ ID NO: 690565 - RNA, 64 nt, hsa; identical to SEQ ID NO: 51735

SEQ ID NO: 690566 - RNA, 64 nt, hsa; identical to SEQ ID NO: 51736

SEQ ID NO: 690567 - RNA, 64 nt, hsa; identical to SEQ ID NO: 51737

SEQ ID NO: 690568 - RNA, 64 nt, hsa; identical to SEQ ID NO: 51738

SEQ ID NO: 690569 - RNA, 64 nt, hsa; identical to SEQ ID NO: 51739

SEQ ID NO: 690570 - RNA, 64 nt, hsa; identical to SEQ ID NO: 51740

SEQ ID NO: 690571 - RNA, 64 nt, hsa; identical to SEQ ID NO: 51741

SEQ ID NO: 690572 - RNA, 64 nt, hsa; identical to SEQ ID NO: 51742

SEQ ID NO: 690573 - RNA, 64 nt, hsa; identical to SEQ ID NO: 51743

SEQ ID NO: 690574 - RNA, 64 nt, hsa; identical to SEQ ID NO: 51744

SEQ ID NO: 690575 - RNA, 64 nt, hsa; identical to SEQ ID NO: 51745

SEQ ID NO: 690576 - RNA, 64 nt, hsa; identical to SEQ ID NO: 51746

SEQ ID NO: 690577 - RNA, 64 nt, hsa; identical to SEQ ID NO: 51747

SEQ ID NO: 690578 - RNA, 64 nt, hsa; identical to SEQ ID NO: 51748

SEQ ID NO: 690579 - RNA, 64 nt, hsa
gcaaaugucucugcuaccauuuccuuaagguguugagcuuuaacucuaugcugacucagugaga

SEQ ID NO: 690580 - RNA, 64 nt, hsa
aauguuuguccuaaauuuucaggacccuagaggagagcuuuauacaauuaccgaugugaauuuc

SEQ ID NO: 690581 - RNA, 64 nt, hsa
cucugaccugaaauccucuuuuaggcaauaggccgagcuuuagaagcagccaggucuggugaga

SEQ ID NO: 690582 - RNA, 64 nt, hsa
gugguaagggucagggaagggcauauaggcaccagagcuuuauccaaagccccaaaucccuaga

SEQ ID NO: 690583 - RNA, 64 nt, hsa
ccagcuguuacacaagcacaagcaugcucuguaagagcuuuacauuucugagauuuuguauagu

SEQ ID NO: 690584 - RNA, 64 nt, hsa
aagauuuuaauauaaaacuugacauuggauauuagagcuuuaaugguauuccuuauuccaguaa

SEQ ID NO: 690585 - RNA, 64 nt, hsa
ccuacgaucugcauuauguaaucacagguccagagagcuuuauggaagcgggagaggaggagca

SEQ ID NO: 690586 - RNA, 64 nt, hsa
gaacuagagugcacuuguuagaugcuaaagguuugagcuuuacacaaaaugucuucaucuguau

SEQ ID NO: 690587 - RNA, 64 nt, hsa
ugauucucaaucuuagcuacauauuagccuggcagagcuuuaaaaaauugauaccuggguccua

SEQ ID NO: 690588 - RNA, 64 nt, hsa
uuuaauuguaaaauuauuagagguauuuguuguagagcuuuauauauuaaagagagguauuggu

SEQ ID NO: 690589 - RNA, 64 nt, hsa
aucuuuccucucuugguguucuagguaagccaaugagcuuuaaucucuacuugcuauaaccgug

SEQ ID NO: 690590 - RNA, 64 nt, hsa
cauacuauaaccagguaaagggacuucuuucagagagcuuuauacugccugaccaaagaacaaa

SEQ ID NO: 690591 - RNA, 64 nt, hsa; identical to SEQ ID NO: 325461

SEQ ID NO: 690592 - RNA, 64 nt, hsa; identical to SEQ ID NO: 325462

SEQ ID NO: 690593 - RNA, 64 nt, hsa; identical to SEQ ID NO: 325463

SEQ ID NO: 690594 - RNA, 64 nt, hsa; identical to SEQ ID NO: 325464

SEQ ID NO: 690595 - RNA, 64 nt, hsa; identical to SEQ ID NO: 367670

SEQ ID NO: 690596 - RNA, 64 nt, hsa; identical to SEQ ID NO: 367671

SEQ ID NO: 690597 - RNA, 64 nt, hsa; identical to SEQ ID NO: 367672

SEQ ID NO: 690598 - RNA, 64 nt, hsa; identical to SEQ ID NO: 367673

SEQ ID NO: 690599 - RNA, 64 nt, hsa; identical to SEQ ID NO: 367674

SEQ ID NO: 690600 - RNA, 64 nt, hsa; identical to SEQ ID NO: 367675

SEQ ID NO: 690601 - RNA, 64 nt, hsa; identical to SEQ ID NO: 367676

SEQ ID NO: 690602 - RNA, 64 nt, hsa; identical to SEQ ID NO: 367677

SEQ ID NO: 690603 - RNA, 64 nt, hsa; identical to SEQ ID NO: 367678

SEQ ID NO: 690604 - RNA, 64 nt, hsa; identical to SEQ ID NO: 367679

SEQ ID NO: 690605 - RNA, 64 nt, hsa; identical to SEQ ID NO: 367680

SEQ ID NO: 690606 - RNA, 64 nt, hsa; identical to SEQ ID NO: 367681

SEQ ID NO: 690607 - RNA, 64 nt, hsa; identical to SEQ ID NO: 367682

SEQ ID NO: 690608 - RNA, 64 nt, hsa; identical to SEQ ID NO: 367683

SEQ ID NO: 690609 - RNA, 64 nt, hsa; identical to SEQ ID NO: 367684

SEQ ID NO: 690610 - RNA, 64 nt, hsa; identical to SEQ ID NO: 367685

SEQ ID NO: 690611 - RNA, 64 nt, hsa; identical to SEQ ID NO: 367686

SEQ ID NO: 690612 - RNA, 64 nt, hsa; identical to SEQ ID NO: 367687

SEQ ID NO: 690613 - RNA, 64 nt, hsa; identical to SEQ ID NO: 367688

SEQ ID NO: 690614 - RNA, 64 nt, hsa; identical to SEQ ID NO: 367689

SEQ ID NO: 690615 - RNA, 64 nt, hsa
aucugagcugaguggaaggccaacuauuaaaccuacauuguaauaaacaaugguggaugcuacg

SEQ ID NO: 690616 - RNA, 64 nt, hsa
ugcauggucacuucuuuacuauuuaaaauacuacacauuguacaaaauaucgaagacacuacca

SEQ ID NO: 690617 - RNA, 64 nt, hsa
guuaaaaauguuuaauuugguuagaaguucuacaacauuguauguacauauacaaaauuucauu

SEQ ID NO: 690618 - RNA, 64 nt, hsa
gaagugguaguauggguaaguuaagcacuucuuaacauuguagcagaaaauuccaaaagaaaga

SEQ ID NO: 690619 - RNA, 64 nt, hsa
caccagugaguuagcagcacguguucccgacauaacauuguacuguaauggagugagcguagca

SEQ ID NO: 690620 - RNA, 64 nt, hsa
uauuuugacaaaauacgaaguggagauuuacacuacauuguacaaggaaugaaagugucacggg

SEQ ID NO: 690621 - RNA, 64 nt, hsa
uauuaaaacuugacugaacaaaaggggaccaucaacauuguagacacuggacacuggaggccuu

SEQ ID NO: 690622 - RNA, 64 nt, hsa
ggguuaaaguucagguaaguaaguuagagagaaaacauuguaugaucagcuccugcacuugauc

SEQ ID NO: 690623 - RNA, 64 nt, hsa
gaaggguguaaagauucuuuugaaagguuuauucacauuguagaacagcaaaugacauuuuuac

SEQ ID NO: 690624 - RNA, 64 nt, hsa
ugugccuugaauuugguauauguguauuagugaaacauuguaaaggugaacuucuaccucugua

SEQ ID NO: 690625 - RNA, 64 nt, hsa
guuuguacauuccaucacacccagcaauagcuguacauuguagucagcaaccauuuuacuuugu

SEQ ID NO: 690626 - RNA, 64 nt, hsa
gauauaaaaugauggcuaucaaaugauuuuccauacauuguacugaucaaguuauacacccagg

SEQ ID NO: 690627 - RNA, 64 nt, hsa
aaccaauaggaacaacaaaaagaaaaaguuugugacauuguaguagggaguguguaccccuuac

SEQ ID NO: 690628 - RNA, 64 nt, hsa
ggcauuuuccacuaguuuuuggacuauguaaaccacauuguacuuuuuuuuacuuuggcaacaa

SEQ ID NO: 690629 - RNA, 64 nt, hsa
acucuucaaaaauggucacagaaugccuuuuaaaacauuguauauaaucuucacuguuucacca

SEQ ID NO: 690630 - RNA, 64 nt, hsa
uguaagacuaggcuuuacugucuuaugcuuauggacauuguauauuuguauuuuaugaccaagu

SEQ ID NO: 690631 - RNA, 64 nt, hsa
auggauauguuaauuagcuugauuuaauccuuccacauuguauacauguaucagaacaucacau

SEQ ID NO: 690632 - RNA, 64 nt, hsa
auccuuccacauuguauacauguaucagaacaucacauuguacuccaucaauauaauacaauua

SEQ ID NO: 690633 - RNA, 64 nt, hsa
caaaacaaaacaaaacaaaacuauacuugaacaaaagggucagaggaccuguauuuaagcaaau

SEQ ID NO: 690634 - RNA, 64 nt, hsa
gcacaaaaugaaugaggucugggcuagguagaaaaagggucaaugcuauuuuuguuuuuagaau

SEQ ID NO: 690635 - RNA, 64 nt, hsa
caaggucuuugacuucauuuccugaagggucaccaagggucagcucagggcuaggaaaaaccau

SEQ ID NO: 690636 - RNA, 64 nt, hsa
acuuugcccccaaggucuuugacuucauuuccugaagggucaccaagggucagcucagggcuag

SEQ ID NO: 690637 - RNA, 64 nt, hsa
ucaggaaagguggucaggaaaacucuggcuggacaagggucagucuucggggucagcagcgaga

SEQ ID NO: 690638 - RNA, 64 nt, hsa
auucaucugcggagccaaaacccagccaucggggaagggucagggcuucuguggaacuuggaac

SEQ ID NO: 690639 - RNA, 64 nt, hsa; identical to SEQ ID NO: 520126

SEQ ID NO: 690640 - RNA, 64 nt, hsa; identical to SEQ ID NO: 520127

SEQ ID NO: 690641 - RNA, 64 nt, hsa; identical to SEQ ID NO: 520128

SEQ ID NO: 690642 - RNA, 64 nt, hsa; identical to SEQ ID NO: 520129

SEQ ID NO: 690643 - RNA, 64 nt, hsa; identical to SEQ ID NO: 520130

SEQ ID NO: 690644 - RNA, 64 nt, hsa; identical to SEQ ID NO: 520131

SEQ ID NO: 690645 - RNA, 64 nt, hsa; identical to SEQ ID NO: 361510

SEQ ID NO: 690646 - RNA, 64 nt, hsa; identical to SEQ ID NO: 361511

SEQ ID NO: 690647 - RNA, 64 nt, hsa; identical to SEQ ID NO: 361512

SEQ ID NO: 690648 - RNA, 64 nt, hsa; identical to SEQ ID NO: 361513

SEQ ID NO: 690649 - RNA, 64 nt, hsa; identical to SEQ ID NO: 361514

SEQ ID NO: 690650 - RNA, 64 nt, hsa; identical to SEQ ID NO: 361515

SEQ ID NO: 690651 - RNA, 64 nt, hsa; identical to SEQ ID NO: 361516

SEQ ID NO: 690652 - RNA, 64 nt, hsa; identical to SEQ ID NO: 361517

SEQ ID NO: 690653 - RNA, 64 nt, hsa; identical to SEQ ID NO: 111860

SEQ ID NO: 690654 - RNA, 64 nt, hsa; identical to SEQ ID NO: 111861

SEQ ID NO: 690655 - RNA, 64 nt, hsa; identical to SEQ ID NO: 111862

SEQ ID NO: 690656 - RNA, 64 nt, hsa; identical to SEQ ID NO: 111863

SEQ ID NO: 690657 - RNA, 64 nt, hsa; identical to SEQ ID NO: 111864

SEQ ID NO: 690658 - RNA, 64 nt, hsa; identical to SEQ ID NO: 111865

SEQ ID NO: 690659 - RNA, 64 nt, hsa; identical to SEQ ID NO: 111866

SEQ ID NO: 690660 - RNA, 64 nt, hsa; identical to SEQ ID NO: 111867

SEQ ID NO: 690661 - RNA, 64 nt, hsa; identical to SEQ ID NO: 111868

SEQ ID NO: 690662 - RNA, 64 nt, hsa; identical to SEQ ID NO: 111869

SEQ ID NO: 690663 - RNA, 64 nt, hsa; identical to SEQ ID NO: 111870

SEQ ID NO: 690664 - RNA, 64 nt, hsa; identical to SEQ ID NO: 111871

SEQ ID NO: 690665 - RNA, 64 nt, hsa; identical to SEQ ID NO: 111872

SEQ ID NO: 690666 - RNA, 64 nt, hsa; identical to SEQ ID NO: 111873

SEQ ID NO: 690667 - RNA, 64 nt, hsa; identical to SEQ ID NO: 111874

SEQ ID NO: 690668 - RNA, 64 nt, hsa; identical to SEQ ID NO: 111875

SEQ ID NO: 690669 - RNA, 64 nt, hsa; identical to SEQ ID NO: 74448

SEQ ID NO: 690670 - RNA, 64 nt, hsa; identical to SEQ ID NO: 74449

SEQ ID NO: 690671 - RNA, 64 nt, hsa; identical to SEQ ID NO: 74450

SEQ ID NO: 690672 - RNA, 64 nt, hsa; identical to SEQ ID NO: 74451

SEQ ID NO: 690673 - RNA, 64 nt, hsa; identical to SEQ ID NO: 74452

SEQ ID NO: 690674 - RNA, 64 nt, hsa; identical to SEQ ID NO: 74453

SEQ ID NO: 690675 - RNA, 64 nt, hsa; identical to SEQ ID NO: 74454

SEQ ID NO: 690676 - RNA, 64 nt, hsa; identical to SEQ ID NO: 74455

SEQ ID NO: 690677 - RNA, 64 nt, hsa; identical to SEQ ID NO: 74456

SEQ ID NO: 690678 - RNA, 64 nt, hsa; identical to SEQ ID NO: 74457

SEQ ID NO: 690679 - RNA, 64 nt, hsa; identical to SEQ ID NO: 74458

SEQ ID NO: 690680 - RNA, 64 nt, hsa; identical to SEQ ID NO: 74459

SEQ ID NO: 690681 - RNA, 64 nt, hsa
cucuuuuuuggcagggaguggggaugagauuugacaccaauaugggcaaaauuagauaaccuuu

SEQ ID NO: 690682 - RNA, 64 nt, hsa
uagggguuggaggugggacaagcaggcuuguuuccaccaauagugccaaaaagauauugccuaa

SEQ ID NO: 690683 - RNA, 64 nt, hsa
uuuucaggauauacuuuugagaugucagugauugcaccaauacuuugugcuucuaguggcuuug

SEQ ID NO: 690684 - RNA, 64 nt, hsa
uugugcuucuaguggcuuugccauaauucagugucaccaauaaggcacagcccaguuagcagcu

SEQ ID NO: 690685 - RNA, 64 nt, hsa; identical to SEQ ID NO: 164717

SEQ ID NO: 690686 - RNA, 64 nt, hsa; identical to SEQ ID NO: 164718

SEQ ID NO: 690687 - RNA, 64 nt, hsa; identical to SEQ ID NO: 164719

SEQ ID NO: 690688 - RNA, 64 nt, hsa; identical to SEQ ID NO: 164720

SEQ ID NO: 690689 - RNA, 64 nt, hsa; identical to SEQ ID NO: 164721

SEQ ID NO: 690690 - RNA, 64 nt, hsa; identical to SEQ ID NO: 164722

SEQ ID NO: 690691 - RNA, 64 nt, hsa; identical to SEQ ID NO: 164723

SEQ ID NO: 690692 - RNA, 64 nt, hsa; identical to SEQ ID NO: 164724

SEQ ID NO: 690693 - RNA, 64 nt, hsa; identical to SEQ ID NO: 164725

SEQ ID NO: 690694 - RNA, 64 nt, hsa; identical to SEQ ID NO: 164726

SEQ ID NO: 690695 - RNA, 64 nt, hsa; identical to SEQ ID NO: 228970

SEQ ID NO: 690696 - RNA, 64 nt, hsa; identical to SEQ ID NO: 228971

SEQ ID NO: 690697 - RNA, 64 nt, hsa; identical to SEQ ID NO: 228972

SEQ ID NO: 690698 - RNA, 64 nt, hsa; identical to SEQ ID NO: 228973

SEQ ID NO: 690699 - RNA, 64 nt, hsa; identical to SEQ ID NO: 228974

SEQ ID NO: 690700 - RNA, 64 nt, hsa; identical to SEQ ID NO: 228975

SEQ ID NO: 690701 - RNA, 64 nt, hsa; identical to SEQ ID NO: 228976

SEQ ID NO: 690702 - RNA, 64 nt, hsa; identical to SEQ ID NO: 228977

SEQ ID NO: 690703 - RNA, 64 nt, hsa; identical to SEQ ID NO: 228978

SEQ ID NO: 690704 - RNA, 64 nt, hsa; identical to SEQ ID NO: 228979

SEQ ID NO: 690705 - RNA, 64 nt, hsa
gaagggacugcagucgugccucugacuguuaucccgguuccaagccuagaggauccuuccaaac

SEQ ID NO: 690706 - RNA, 64 nt, hsa
aauagggcuguggccgcgccucugacuauuaucccgguuccaagacgagaggauacuuccaaac

SEQ ID NO: 690707 - RNA, 64 nt, hsa
cucuauagcaacaugacucuagcaaugugacuuucgguuccaaaucuguaucagucagcuacug

SEQ ID NO: 690708 - RNA, 64 nt, hsa
gcccgucgugaccucugaucugugcccacuccuccgguuccagacgcaccucucuccucugucu

SEQ ID NO: 690709 - RNA, 64 nt, hsa; identical to SEQ ID NO: 53673

SEQ ID NO: 690710 - RNA, 64 nt, hsa; identical to SEQ ID NO: 53674

SEQ ID NO: 690711 - RNA, 64 nt, hsa; identical to SEQ ID NO: 53675

SEQ ID NO: 690712 - RNA, 64 nt, hsa; identical to SEQ ID NO: 53676

SEQ ID NO: 690713 - RNA, 64 nt, hsa; identical to SEQ ID NO: 53677

SEQ ID NO: 690714 - RNA, 64 nt, hsa; identical to SEQ ID NO: 53678

SEQ ID NO: 690715 - RNA, 64 nt, hsa; identical to SEQ ID NO: 53679

SEQ ID NO: 690716 - RNA, 64 nt, hsa; identical to SEQ ID NO: 53680

SEQ ID NO: 690717 - RNA, 64 nt, hsa; identical to SEQ ID NO: 53681

SEQ ID NO: 690718 - RNA, 64 nt, hsa; identical to SEQ ID NO: 53682

SEQ ID NO: 690719 - RNA, 64 nt, hsa; identical to SEQ ID NO: 53683

SEQ ID NO: 690720 - RNA, 64 nt, hsa; identical to SEQ ID NO: 53684

SEQ ID NO: 690721 - RNA, 64 nt, hsa; identical to SEQ ID NO: 452736

SEQ ID NO: 690722 - RNA, 64 nt, hsa; identical to SEQ ID NO: 452737

SEQ ID NO: 690723 - RNA, 64 nt, hsa; identical to SEQ ID NO: 452738

SEQ ID NO: 690724 - RNA, 64 nt, hsa; identical to SEQ ID NO: 452739

SEQ ID NO: 690725 - RNA, 64 nt, hsa; identical to SEQ ID NO: 452740

SEQ ID NO: 690726 - RNA, 64 nt, hsa; identical to SEQ ID NO: 452740

SEQ ID NO: 690727 - RNA, 64 nt, hsa; identical to SEQ ID NO: 345901

SEQ ID NO: 690728 - RNA, 64 nt, hsa; identical to SEQ ID NO: 345902

SEQ ID NO: 690729 - RNA, 64 nt, hsa; identical to SEQ ID NO: 345903

SEQ ID NO: 690730 - RNA, 64 nt, hsa; identical to SEQ ID NO: 345904

SEQ ID NO: 690731 - RNA, 64 nt, hsa; identical to SEQ ID NO: 345905

SEQ ID NO: 690732 - RNA, 64 nt, hsa; identical to SEQ ID NO: 345906

SEQ ID NO: 690733 - RNA, 64 nt, hsa; identical to SEQ ID NO: 345907

SEQ ID NO: 690734 - RNA, 64 nt, hsa; identical to SEQ ID NO: 345908

SEQ ID NO: 690735 - RNA, 64 nt, hsa; identical to SEQ ID NO: 345909

SEQ ID NO: 690736 - RNA, 64 nt, hsa; identical to SEQ ID NO: 345910

SEQ ID NO: 690737 - RNA, 64 nt, hsa; identical to SEQ ID NO: 345911

SEQ ID NO: 690738 - RNA, 64 nt, hsa; identical to SEQ ID NO: 345912

SEQ ID NO: 690739 - RNA, 64 nt, hsa; identical to SEQ ID NO: 345913

SEQ ID NO: 690740 - RNA, 64 nt, hsa; identical to SEQ ID NO: 345914

SEQ ID NO: 690741 - RNA, 64 nt, hsa; identical to SEQ ID NO: 345915

SEQ ID NO: 690742 - RNA, 64 nt, hsa; identical to SEQ ID NO: 345916

SEQ ID NO: 690743 - RNA, 64 nt, hsa; identical to SEQ ID NO: 345917

SEQ ID NO: 690744 - RNA, 64 nt, hsa; identical to SEQ ID NO: 345918

SEQ ID NO: 690745 - RNA, 64 nt, hsa; identical to SEQ ID NO: 345919

SEQ ID NO: 690746 - RNA, 64 nt, hsa; identical to SEQ ID NO: 345920

SEQ ID NO: 690747 - RNA, 64 nt, hsa; identical to SEQ ID NO: 345921

SEQ ID NO: 690748 - RNA, 64 nt, hsa; identical to SEQ ID NO: 345922

SEQ ID NO: 690749 - RNA, 64 nt, hsa; identical to SEQ ID NO: 345923

SEQ ID NO: 690750 - RNA, 64 nt, hsa; identical to SEQ ID NO: 345924

SEQ ID NO: 690751 - RNA, 64 nt, hsa; identical to SEQ ID NO: 345925

SEQ ID NO: 690752 - RNA, 64 nt, hsa; identical to SEQ ID NO: 345926

SEQ ID NO: 690753 - RNA, 64 nt, hsa; identical to SEQ ID NO: 345927

SEQ ID NO: 690754 - RNA, 64 nt, hsa; identical to SEQ ID NO: 345928

SEQ ID NO: 690755 - RNA, 64 nt, hsa; identical to SEQ ID NO: 345929

SEQ ID NO: 690756 - RNA, 64 nt, hsa; identical to SEQ ID NO: 345930

SEQ ID NO: 690757 - RNA, 64 nt, hsa; identical to SEQ ID NO: 345931

SEQ ID NO: 690758 - RNA, 64 nt, hsa; identical to SEQ ID NO: 345932

SEQ ID NO: 690759 - RNA, 64 nt, hsa; identical to SEQ ID NO: 345933

SEQ ID NO: 690760 - RNA, 64 nt, hsa; identical to SEQ ID NO: 345934

SEQ ID NO: 690761 - RNA, 64 nt, hsa; identical to SEQ ID NO: 345935

SEQ ID NO: 690762 - RNA, 64 nt, hsa; identical to SEQ ID NO: 345936

SEQ ID NO: 690763 - RNA, 64 nt, hsa; identical to SEQ ID NO: 345937

SEQ ID NO: 690764 - RNA, 64 nt, hsa; identical to SEQ ID NO: 345938

SEQ ID NO: 690765 - RNA, 64 nt, hsa; identical to SEQ ID NO: 345939

SEQ ID NO: 690766 - RNA, 64 nt, hsa; identical to SEQ ID NO: 345940

SEQ ID NO: 690767 - RNA, 64 nt, hsa; identical to SEQ ID NO: 345941

SEQ ID NO: 690768 - RNA, 64 nt, hsa; identical to SEQ ID NO: 345942

SEQ ID NO: 690769 - RNA, 64 nt, hsa; identical to SEQ ID NO: 345943

SEQ ID NO: 690770 - RNA, 64 nt, hsa; identical to SEQ ID NO: 345944

SEQ ID NO: 690771 - RNA, 64 nt, hsa; identical to SEQ ID NO: 345945

SEQ ID NO: 690772 - RNA, 64 nt, hsa; identical to SEQ ID NO: 345946

SEQ ID NO: 690773 - RNA, 64 nt, hsa; identical to SEQ ID NO: 345947

SEQ ID NO: 690774 - RNA, 64 nt, hsa; identical to SEQ ID NO: 345948

SEQ ID NO: 690775 - RNA, 64 nt, hsa; identical to SEQ ID NO: 345949

SEQ ID NO: 690776 - RNA, 64 nt, hsa; identical to SEQ ID NO: 345950

SEQ ID NO: 690777 - RNA, 64 nt, hsa; identical to SEQ ID NO: 345951

SEQ ID NO: 690778 - RNA, 64 nt, hsa; identical to SEQ ID NO: 345952

SEQ ID NO: 690779 - RNA, 64 nt, hsa; identical to SEQ ID NO: 345953

SEQ ID NO: 690780 - RNA, 64 nt, hsa; identical to SEQ ID NO: 345954

SEQ ID NO: 690781 - RNA, 64 nt, hsa; identical to SEQ ID NO: 345955

SEQ ID NO: 690782 - RNA, 64 nt, hsa; identical to SEQ ID NO: 345956

SEQ ID NO: 690783 - RNA, 64 nt, hsa; identical to SEQ ID NO: 345957

SEQ ID NO: 690784 - RNA, 64 nt, hsa; identical to SEQ ID NO: 345958

SEQ ID NO: 690785 - RNA, 64 nt, hsa; identical to SEQ ID NO: 345959

SEQ ID NO: 690786 - RNA, 64 nt, hsa; identical to SEQ ID NO: 345960

SEQ ID NO: 690787 - RNA, 64 nt, hsa; identical to SEQ ID NO: 345961

SEQ ID NO: 690788 - RNA, 64 nt, hsa; identical to SEQ ID NO: 345962

SEQ ID NO: 690789 - RNA, 64 nt, hsa; identical to SEQ ID NO: 345963

SEQ ID NO: 690790 - RNA, 64 nt, hsa; identical to SEQ ID NO: 345964

SEQ ID NO: 690791 - RNA, 64 nt, hsa; identical to SEQ ID NO: 345965

SEQ ID NO: 690792 - RNA, 64 nt, hsa; identical to SEQ ID NO: 345966

SEQ ID NO: 690793 - RNA, 64 nt, hsa; identical to SEQ ID NO: 345967

SEQ ID NO: 690794 - RNA, 50 nt, hsa; identical to SEQ ID NO: 345968

SEQ ID NO: 690795 - RNA, 64 nt, hsa; identical to SEQ ID NO: 345969

SEQ ID NO: 690796 - RNA, 64 nt, hsa; identical to SEQ ID NO: 345970

SEQ ID NO: 690797 - RNA, 64 nt, hsa; identical to SEQ ID NO: 345971

SEQ ID NO: 690798 - RNA, 64 nt, hsa; identical to SEQ ID NO: 345972

SEQ ID NO: 690799 - RNA, 64 nt, hsa; identical to SEQ ID NO: 345973

SEQ ID NO: 690800 - RNA, 64 nt, hsa; identical to SEQ ID NO: 345974

SEQ ID NO: 690801 - RNA, 64 nt, hsa; identical to SEQ ID NO: 345975

SEQ ID NO: 690802 - RNA, 64 nt, hsa; identical to SEQ ID NO: 345976

SEQ ID NO: 690803 - RNA, 64 nt, hsa; identical to SEQ ID NO: 345977

SEQ ID NO: 690804 - RNA, 64 nt, hsa; identical to SEQ ID NO: 345978

SEQ ID NO: 690805 - RNA, 64 nt, hsa; identical to SEQ ID NO: 345979

SEQ ID NO: 690806 - RNA, 64 nt, hsa; identical to SEQ ID NO: 345980

SEQ ID NO: 690807 - RNA, 64 nt, hsa; identical to SEQ ID NO: 345981

SEQ ID NO: 690808 - RNA, 64 nt, hsa; identical to SEQ ID NO: 345982

SEQ ID NO: 690809 - RNA, 64 nt, hsa; identical to SEQ ID NO: 345983

SEQ ID NO: 690810 - RNA, 64 nt, hsa; identical to SEQ ID NO: 345984

SEQ ID NO: 690811 - RNA, 64 nt, hsa; identical to SEQ ID NO: 345985

SEQ ID NO: 690812 - RNA, 64 nt, hsa; identical to SEQ ID NO: 345986

SEQ ID NO: 690813 - RNA, 64 nt, hsa; identical to SEQ ID NO: 345987

SEQ ID NO: 690814 - RNA, 64 nt, hsa; identical to SEQ ID NO: 345988

SEQ ID NO: 690815 - RNA, 64 nt, hsa; identical to SEQ ID NO: 345989

SEQ ID NO: 690816 - RNA, 64 nt, hsa; identical to SEQ ID NO: 345990

SEQ ID NO: 690817 - RNA, 64 nt, hsa; identical to SEQ ID NO: 345991

SEQ ID NO: 690818 - RNA, 64 nt, hsa; identical to SEQ ID NO: 345992

SEQ ID NO: 690819 - RNA, 51 nt, hsa; identical to SEQ ID NO: 345993

SEQ ID NO: 690820 - RNA, 64 nt, hsa; identical to SEQ ID NO: 345994

SEQ ID NO: 690821 - RNA, 64 nt, hsa; identical to SEQ ID NO: 345995

SEQ ID NO: 690822 - RNA, 64 nt, hsa; identical to SEQ ID NO: 345996

SEQ ID NO: 690823 - RNA, 64 nt, hsa; identical to SEQ ID NO: 345997

SEQ ID NO: 690824 - RNA, 64 nt, hsa; identical to SEQ ID NO: 345998

SEQ ID NO: 690825 - RNA, 64 nt, hsa; identical to SEQ ID NO: 345999

SEQ ID NO: 690826 - RNA, 64 nt, hsa; identical to SEQ ID NO: 346000

SEQ ID NO: 690827 - RNA, 64 nt, hsa; identical to SEQ ID NO: 346001

SEQ ID NO: 690828 - RNA, 64 nt, hsa; identical to SEQ ID NO: 346002

SEQ ID NO: 690829 - RNA, 64 nt, hsa; identical to SEQ ID NO: 346003

SEQ ID NO: 690830 - RNA, 64 nt, hsa; identical to SEQ ID NO: 346004

SEQ ID NO: 690831 - RNA, 64 nt, hsa; identical to SEQ ID NO: 346005

SEQ ID NO: 690832 - RNA, 64 nt, hsa; identical to SEQ ID NO: 346006

SEQ ID NO: 690833 - RNA, 64 nt, hsa; identical to SEQ ID NO: 346007

SEQ ID NO: 690834 - RNA, 64 nt, hsa; identical to SEQ ID NO: 346008

SEQ ID NO: 690835 - RNA, 64 nt, hsa; identical to SEQ ID NO: 346009

SEQ ID NO: 690836 - RNA, 64 nt, hsa; identical to SEQ ID NO: 346010

SEQ ID NO: 690837 - RNA, 64 nt, hsa; identical to SEQ ID NO: 346011

SEQ ID NO: 690838 - RNA, 64 nt, hsa; identical to SEQ ID NO: 346012

SEQ ID NO: 690839 - RNA, 64 nt, hsa; identical to SEQ ID NO: 346013

SEQ ID NO: 690840 - RNA, 64 nt, hsa; identical to SEQ ID NO: 346014

SEQ ID NO: 690841 - RNA, 64 nt, hsa; identical to SEQ ID NO: 346015

SEQ ID NO: 690842 - RNA, 64 nt, hsa; identical to SEQ ID NO: 346016

SEQ ID NO: 690843 - RNA, 64 nt, hsa; identical to SEQ ID NO: 346017

SEQ ID NO: 690844 - RNA, 64 nt, hsa; identical to SEQ ID NO: 346018

SEQ ID NO: 690845 - RNA, 64 nt, hsa; identical to SEQ ID NO: 346019

SEQ ID NO: 690846 - RNA, 64 nt, hsa; identical to SEQ ID NO: 346020

SEQ ID NO: 690847 - RNA, 64 nt, hsa; identical to SEQ ID NO: 346021

SEQ ID NO: 690848 - RNA, 64 nt, hsa; identical to SEQ ID NO: 346022

SEQ ID NO: 690849 - RNA, 64 nt, hsa; identical to SEQ ID NO: 346023

SEQ ID NO: 690850 - RNA, 64 nt, hsa; identical to SEQ ID NO: 346024

SEQ ID NO: 690851 - RNA, 64 nt, hsa; identical to SEQ ID NO: 346025

SEQ ID NO: 690852 - RNA, 64 nt, hsa; identical to SEQ ID NO: 346026

SEQ ID NO: 690853 - RNA, 64 nt, hsa; identical to SEQ ID NO: 346027

SEQ ID NO: 690854 - RNA, 64 nt, hsa; identical to SEQ ID NO: 346028

SEQ ID NO: 690855 - RNA, 64 nt, hsa; identical to SEQ ID NO: 346029

SEQ ID NO: 690856 - RNA, 64 nt, hsa; identical to SEQ ID NO: 346030

SEQ ID NO: 690857 - RNA, 64 nt, hsa; identical to SEQ ID NO: 346031

SEQ ID NO: 690858 - RNA, 64 nt, hsa; identical to SEQ ID NO: 346032

SEQ ID NO: 690859 - RNA, 64 nt, hsa; identical to SEQ ID NO: 346033

SEQ ID NO: 690860 - RNA, 64 nt, hsa; identical to SEQ ID NO: 346034

SEQ ID NO: 690861 - RNA, 64 nt, hsa; identical to SEQ ID NO: 346035

SEQ ID NO: 690862 - RNA, 64 nt, hsa; identical to SEQ ID NO: 346036

SEQ ID NO: 690863 - RNA, 64 nt, hsa; identical to SEQ ID NO: 346037

SEQ ID NO: 690864 - RNA, 64 nt, hsa; identical to SEQ ID NO: 346038

SEQ ID NO: 690865 - RNA, 64 nt, hsa; identical to SEQ ID NO: 346039

SEQ ID NO: 690866 - RNA, 64 nt, hsa; identical to SEQ ID NO: 346040

SEQ ID NO: 690867 - RNA, 64 nt, hsa; identical to SEQ ID NO: 346041

SEQ ID NO: 690868 - RNA, 64 nt, hsa; identical to SEQ ID NO: 346042

SEQ ID NO: 690869 - RNA, 64 nt, hsa; identical to SEQ ID NO: 346043

SEQ ID NO: 690870 - RNA, 64 nt, hsa; identical to SEQ ID NO: 346044

SEQ ID NO: 690871 - RNA, 64 nt, hsa; identical to SEQ ID NO: 346045

SEQ ID NO: 690872 - RNA, 64 nt, hsa; identical to SEQ ID NO: 346046

SEQ ID NO: 690873 - RNA, 64 nt, hsa; identical to SEQ ID NO: 346047

SEQ ID NO: 690874 - RNA, 64 nt, hsa; identical to SEQ ID NO: 346048

SEQ ID NO: 690875 - RNA, 64 nt, hsa; identical to SEQ ID NO: 346049

SEQ ID NO: 690876 - RNA, 64 nt, hsa; identical to SEQ ID NO: 346050

SEQ ID NO: 690877 - RNA, 64 nt, hsa; identical to SEQ ID NO: 346051

SEQ ID NO: 690878 - RNA, 64 nt, hsa; identical to SEQ ID NO: 346052

SEQ ID NO: 690879 - RNA, 64 nt, hsa; identical to SEQ ID NO: 346053

SEQ ID NO: 690880 - RNA, 64 nt, hsa; identical to SEQ ID NO: 346054

SEQ ID NO: 690881 - RNA, 64 nt, hsa; identical to SEQ ID NO: 346055

SEQ ID NO: 690882 - RNA, 64 nt, hsa; identical to SEQ ID NO: 346056

SEQ ID NO: 690883 - RNA, 64 nt, hsa; identical to SEQ ID NO: 346057

SEQ ID NO: 690884 - RNA, 64 nt, hsa; identical to SEQ ID NO: 346058

SEQ ID NO: 690885 - RNA, 64 nt, hsa; identical to SEQ ID NO: 346059

SEQ ID NO: 690886 - RNA, 64 nt, hsa; identical to SEQ ID NO: 346060

SEQ ID NO: 690887 - RNA, 64 nt, hsa; identical to SEQ ID NO: 346061

SEQ ID NO: 690888 - RNA, 64 nt, hsa; identical to SEQ ID NO: 346062

SEQ ID NO: 690889 - RNA, 64 nt, hsa; identical to SEQ ID NO: 346063

SEQ ID NO: 690890 - RNA, 64 nt, hsa; identical to SEQ ID NO: 346064

SEQ ID NO: 690891 - RNA, 64 nt, hsa; identical to SEQ ID NO: 346065

SEQ ID NO: 690892 - RNA, 64 nt, hsa; identical to SEQ ID NO: 346066

SEQ ID NO: 690893 - RNA, 64 nt, hsa; identical to SEQ ID NO: 346067

SEQ ID NO: 690894 - RNA, 64 nt, hsa; identical to SEQ ID NO: 346068

SEQ ID NO: 690895 - RNA, 64 nt, hsa; identical to SEQ ID NO: 346069

SEQ ID NO: 690896 - RNA, 64 nt, hsa; identical to SEQ ID NO: 346070

SEQ ID NO: 690897 - RNA, 64 nt, hsa; identical to SEQ ID NO: 346071

SEQ ID NO: 690898 - RNA, 64 nt, hsa; identical to SEQ ID NO: 346072

SEQ ID NO: 690899 - RNA, 64 nt, hsa; identical to SEQ ID NO: 346073

SEQ ID NO: 690900 - RNA, 64 nt, hsa; identical to SEQ ID NO: 346074

SEQ ID NO: 690901 - RNA, 64 nt, hsa; identical to SEQ ID NO: 346075

SEQ ID NO: 690902 - RNA, 64 nt, hsa; identical to SEQ ID NO: 346076

SEQ ID NO: 690903 - RNA, 64 nt, hsa; identical to SEQ ID NO: 346077

SEQ ID NO: 690904 - RNA, 64 nt, hsa; identical to SEQ ID NO: 346078

SEQ ID NO: 690905 - RNA, 64 nt, hsa; identical to SEQ ID NO: 346079

SEQ ID NO: 690906 - RNA, 64 nt, hsa; identical to SEQ ID NO: 346080

SEQ ID NO: 690907 - RNA, 64 nt, hsa; identical to SEQ ID NO: 346081

SEQ ID NO: 690908 - RNA, 64 nt, hsa; identical to SEQ ID NO: 346082

SEQ ID NO: 690909 - RNA, 64 nt, hsa; identical to SEQ ID NO: 346083

SEQ ID NO: 690910 - RNA, 64 nt, hsa; identical to SEQ ID NO: 346084

SEQ ID NO: 690911 - RNA, 64 nt, hsa; identical to SEQ ID NO: 346085

SEQ ID NO: 690912 - RNA, 64 nt, hsa; identical to SEQ ID NO: 346086

SEQ ID NO: 690913 - RNA, 64 nt, hsa; identical to SEQ ID NO: 346087

SEQ ID NO: 690914 - RNA, 64 nt, hsa; identical to SEQ ID NO: 346088

SEQ ID NO: 690915 - RNA, 64 nt, hsa; identical to SEQ ID NO: 346089

SEQ ID NO: 690916 - RNA, 64 nt, hsa; identical to SEQ ID NO: 346090

SEQ ID NO: 690917 - RNA, 64 nt, hsa; identical to SEQ ID NO: 346091

SEQ ID NO: 690918 - RNA, 64 nt, hsa; identical to SEQ ID NO: 346092

SEQ ID NO: 690919 - RNA, 64 nt, hsa; identical to SEQ ID NO: 346093

SEQ ID NO: 690920 - RNA, 64 nt, hsa; identical to SEQ ID NO: 346094

SEQ ID NO: 690921 - RNA, 64 nt, hsa; identical to SEQ ID NO: 346095

SEQ ID NO: 690922 - RNA, 59 nt, hsa; identical to SEQ ID NO: 346096

SEQ ID NO: 690923 - RNA, 64 nt, hsa; identical to SEQ ID NO: 346097

SEQ ID NO: 690924 - RNA, 64 nt, hsa; identical to SEQ ID NO: 346098

SEQ ID NO: 690925 - RNA, 64 nt, hsa; identical to SEQ ID NO: 346099

SEQ ID NO: 690926 - RNA, 64 nt, hsa; identical to SEQ ID NO: 346100

SEQ ID NO: 690927 - RNA, 64 nt, hsa; identical to SEQ ID NO: 346101

SEQ ID NO: 690928 - RNA, 64 nt, hsa; identical to SEQ ID NO: 346102

SEQ ID NO: 690929 - RNA, 64 nt, hsa; identical to SEQ ID NO: 346103

SEQ ID NO: 690930 - RNA, 64 nt, hsa; identical to SEQ ID NO: 346104

SEQ ID NO: 690931 - RNA, 64 nt, hsa; identical to SEQ ID NO: 346105

SEQ ID NO: 690932 - RNA, 64 nt, hsa; identical to SEQ ID NO: 346106

SEQ ID NO: 690933 - RNA, 64 nt, hsa; identical to SEQ ID NO: 346107

SEQ ID NO: 690934 - RNA, 64 nt, hsa; identical to SEQ ID NO: 346108

SEQ ID NO: 690935 - RNA, 64 nt, hsa; identical to SEQ ID NO: 346109

SEQ ID NO: 690936 - RNA, 64 nt, hsa; identical to SEQ ID NO: 346110

SEQ ID NO: 690937 - RNA, 64 nt, hsa; identical to SEQ ID NO: 346111

SEQ ID NO: 690938 - RNA, 64 nt, hsa; identical to SEQ ID NO: 346112

SEQ ID NO: 690939 - RNA, 64 nt, hsa; identical to SEQ ID NO: 346113

SEQ ID NO: 690940 - RNA, 64 nt, hsa; identical to SEQ ID NO: 346114

SEQ ID NO: 690941 - RNA, 64 nt, hsa; identical to SEQ ID NO: 346115

SEQ ID NO: 690942 - RNA, 64 nt, hsa; identical to SEQ ID NO: 346116

SEQ ID NO: 690943 - RNA, 64 nt, hsa; identical to SEQ ID NO: 127496

SEQ ID NO: 690944 - RNA, 64 nt, hsa; identical to SEQ ID NO: 127497

SEQ ID NO: 690945 - RNA, 64 nt, hsa; identical to SEQ ID NO: 127498

SEQ ID NO: 690946 - RNA, 64 nt, hsa; identical to SEQ ID NO: 127499

SEQ ID NO: 690947 - RNA, 64 nt, hsa; identical to SEQ ID NO: 127500

SEQ ID NO: 690948 - RNA, 64 nt, hsa; identical to SEQ ID NO: 127501

SEQ ID NO: 690949 - RNA, 64 nt, hsa; identical to SEQ ID NO: 127502

SEQ ID NO: 690950 - RNA, 64 nt, hsa; identical to SEQ ID NO: 127503

SEQ ID NO: 690951 - RNA, 64 nt, hsa; identical to SEQ ID NO: 112922

SEQ ID NO: 690952 - RNA, 64 nt, hsa; identical to SEQ ID NO: 112923

SEQ ID NO: 690953 - RNA, 64 nt, hsa; identical to SEQ ID NO: 112924

SEQ ID NO: 690954 - RNA, 64 nt, hsa; identical to SEQ ID NO: 112925

SEQ ID NO: 690955 - RNA, 64 nt, hsa; identical to SEQ ID NO: 112926

SEQ ID NO: 690956 - RNA, 64 nt, hsa; identical to SEQ ID NO: 112927

SEQ ID NO: 690957 - RNA, 64 nt, hsa; identical to SEQ ID NO: 112928

SEQ ID NO: 690958 - RNA, 64 nt, hsa; identical to SEQ ID NO: 112929

SEQ ID NO: 690959 - RNA, 64 nt, hsa; identical to SEQ ID NO: 112930

SEQ ID NO: 690960 - RNA, 64 nt, hsa; identical to SEQ ID NO: 112931

SEQ ID NO: 690961 - RNA, 64 nt, hsa; identical to SEQ ID NO: 112932

SEQ ID NO: 690962 - RNA, 64 nt, hsa; identical to SEQ ID NO: 112933

SEQ ID NO: 690963 - RNA, 64 nt, hsa; identical to SEQ ID NO: 112934

SEQ ID NO: 690964 - RNA, 64 nt, hsa; identical to SEQ ID NO: 112935

SEQ ID NO: 690965 - RNA, 64 nt, hsa; identical to SEQ ID NO: 112936

SEQ ID NO: 690966 - RNA, 64 nt, hsa; identical to SEQ ID NO: 112937

SEQ ID NO: 690967 - RNA, 64 nt, hsa; identical to SEQ ID NO: 112938

SEQ ID NO: 690968 - RNA, 64 nt, hsa; identical to SEQ ID NO: 112939

SEQ ID NO: 690969 - RNA, 64 nt, hsa; identical to SEQ ID NO: 112940

SEQ ID NO: 690970 - RNA, 64 nt, hsa; identical to SEQ ID NO: 112941

SEQ ID NO: 690971 - RNA, 64 nt, hsa; identical to SEQ ID NO: 112942

SEQ ID NO: 690972 - RNA, 64 nt, hsa; identical to SEQ ID NO: 112943

SEQ ID NO: 690973 - RNA, 64 nt, hsa; identical to SEQ ID NO: 112944

SEQ ID NO: 690974 - RNA, 64 nt, hsa; identical to SEQ ID NO: 112945

SEQ ID NO: 690975 - RNA, 64 nt, hsa; identical to SEQ ID NO: 112946

SEQ ID NO: 690976 - RNA, 64 nt, hsa; identical to SEQ ID NO: 112947

SEQ ID NO: 690977 - RNA, 64 nt, hsa; identical to SEQ ID NO: 112948

SEQ ID NO: 690978 - RNA, 64 nt, hsa; identical to SEQ ID NO: 112949

SEQ ID NO: 690979 - RNA, 64 nt, hsa; identical to SEQ ID NO: 112950

SEQ ID NO: 690980 - RNA, 64 nt, hsa; identical to SEQ ID NO: 112951

SEQ ID NO: 690981 - RNA, 64 nt, hsa; identical to SEQ ID NO: 112952

SEQ ID NO: 690982 - RNA, 64 nt, hsa; identical to SEQ ID NO: 112953

SEQ ID NO: 690983 - RNA, 64 nt, hsa; identical to SEQ ID NO: 112954

SEQ ID NO: 690984 - RNA, 50 nt, hsa; identical to SEQ ID NO: 112955

SEQ ID NO: 690985 - RNA, 64 nt, hsa; identical to SEQ ID NO: 112956

SEQ ID NO: 690986 - RNA, 64 nt, hsa; identical to SEQ ID NO: 112957

SEQ ID NO: 690987 - RNA, 64 nt, hsa; identical to SEQ ID NO: 112958

SEQ ID NO: 690988 - RNA, 64 nt, hsa; identical to SEQ ID NO: 112959

SEQ ID NO: 690989 - RNA, 64 nt, hsa; identical to SEQ ID NO: 112960

SEQ ID NO: 690990 - RNA, 64 nt, hsa; identical to SEQ ID NO: 112961

SEQ ID NO: 690991 - RNA, 64 nt, hsa
guacacauuccaucuaccuaaucaaacauuuucagucccugaucucuccugucccuuuuccugg

SEQ ID NO: 690992 - RNA, 64 nt, hsa
acuauuuuugaauuccuauuuauuuuuuguguuugucccugauuuuuuuuuuuuaauucuaugg

SEQ ID NO: 690993 - RNA, 64 nt, hsa
gacaaacaccuuauuugucggggaagaugaaaccgucccugaguugcaccauucuuucuuggug

SEQ ID NO: 690994 - RNA, 64 nt, hsa
uucuuugcugcuguggaaaggauucuaaacagaugucccugaagucuugcauugaauuuaguca

SEQ ID NO: 690995 - RNA, 64 nt, hsa
uuucacuuucucuuuuguuuuaaaugacucauaggucccugacauuuaguugauuauuuucugc

SEQ ID NO: 690996 - RNA, 64 nt, hsa
cugccuuguuucaccuuccaugucaggccagccugucccugaaagagaagauggccaugcccuc

SEQ ID NO: 690997 - RNA, 64 nt, hsa
ccuguccgggggcggcuuuuuccuuccuuggagcgucccugacggacaaguggaggccucuugc

SEQ ID NO: 690998 - RNA, 64 nt, hsa
gguucccuucaagugcacgagggguuaggcugcugucccugaguccuccauucuguacuggggg

SEQ ID NO: 690999 - RNA, 64 nt, hsa
gggcagggcuuuuguggguuaugaggacacagaagucccugaggcccccagaccuggcucagcc

SEQ ID NO: 691000 - RNA, 64 nt, hsa
aaagcagcccccaagcaagucccuucucuagggugucccugaggacagcacagaggcgggacuc

SEQ ID NO: 691001 - RNA, 64 nt, hsa
gagcuuggugagagugacgcugccaugggguugggucccugaggccuuccucggagcauugggu

SEQ ID NO: 691002 - RNA, 64 nt, hsa
caggugggaguggacaccaggcuucccaguggacgucccugagcagcuccgcaugcuugguucu

SEQ ID NO: 691003 - RNA, 64 nt, hsa
ugugggaagguucaggauggugggagggacugaggucccugaggugaagaggcccuugguccug

SEQ ID NO: 691004 - RNA, 64 nt, hsa
agaagugccuguggucaggccccagcucuacuuggucccugaaaaagcaccuggcuaagggcug

SEQ ID NO: 691005 - RNA, 64 nt, hsa
ggggugguuauuuuuccagauuggagaguugaaagucccugacugauuucagccauuuuccuag

SEQ ID NO: 691006 - RNA, 64 nt, hsa
gcuucuguaaccagggcugucuucagaugucagggucccugaacugcugcgggcccagucagug

SEQ ID NO: 691007 - RNA, 64 nt, hsa
agaggugcagcugcccaaagucugugaaaugaaagucccugacaugaagcucccagagauaaaa

SEQ ID NO: 691008 - RNA, 64 nt, hsa
agaggugcagcugccgaaagugccagagaugaaagucccugagaugaagcuuccaaaggugccu

SEQ ID NO: 691009 - RNA, 64 nt, hsa
uugccuaucugccacaggaggacugggcccccacgucccugacuaggccggcucccccagacuc

SEQ ID NO: 691010 - RNA, 64 nt, hsa
uguccucagcaaggcucgguccuggacauucuaggucccugacucgccagaugcaucaugucca

SEQ ID NO: 691011 - RNA, 64 nt, hsa; identical to SEQ ID NO: 240065

SEQ ID NO: 691012 - RNA, 64 nt, hsa; identical to SEQ ID NO: 240066

SEQ ID NO: 691013 - RNA, 64 nt, hsa; identical to SEQ ID NO: 240067

SEQ ID NO: 691014 - RNA, 64 nt, hsa; identical to SEQ ID NO: 240068

SEQ ID NO: 691015 - RNA, 64 nt, hsa; identical to SEQ ID NO: 240069

SEQ ID NO: 691016 - RNA, 64 nt, hsa; identical to SEQ ID NO: 240070

SEQ ID NO: 691017 - RNA, 61 nt, hsa; identical to SEQ ID NO: 240071

SEQ ID NO: 691018 - RNA, 64 nt, hsa; identical to SEQ ID NO: 240072

SEQ ID NO: 691019 - RNA, 64 nt, hsa; identical to SEQ ID NO: 240073

SEQ ID NO: 691020 - RNA, 64 nt, hsa; identical to SEQ ID NO: 240074

SEQ ID NO: 691021 - RNA, 64 nt, hsa; identical to SEQ ID NO: 240075

SEQ ID NO: 691022 - RNA, 64 nt, hsa; identical to SEQ ID NO: 240076

SEQ ID NO: 691023 - RNA, 64 nt, hsa; identical to SEQ ID NO: 240077

SEQ ID NO: 691024 - RNA, 64 nt, hsa; identical to SEQ ID NO: 240078

SEQ ID NO: 691025 - RNA, 64 nt, hsa; identical to SEQ ID NO: 240079

SEQ ID NO: 691026 - RNA, 64 nt, hsa; identical to SEQ ID NO: 240080

SEQ ID NO: 691027 - RNA, 64 nt, hsa; identical to SEQ ID NO: 240081

SEQ ID NO: 691028 - RNA, 64 nt, hsa; identical to SEQ ID NO: 240082

SEQ ID NO: 691029 - RNA, 64 nt, hsa; identical to SEQ ID NO: 240083

SEQ ID NO: 691030 - RNA, 64 nt, hsa; identical to SEQ ID NO: 240084

SEQ ID NO: 691031 - RNA, 64 nt, hsa; identical to SEQ ID NO: 240085

SEQ ID NO: 691032 - RNA, 64 nt, hsa; identical to SEQ ID NO: 240086

SEQ ID NO: 691033 - RNA, 64 nt, hsa
uauuuucucuacggcuuaggcuaugugagggcaaaacacaaaucccuuugcuaaaaagaaccau

SEQ ID NO: 691034 - RNA, 64 nt, hsa
gugaaauuaucuugagucuacacauuauuuuuaaaacacaaaaauuguucggcuggaacugacc

SEQ ID NO: 691035 - RNA, 64 nt, hsa
uguguuggugcuuuagcgauugauugauguacagaacacaaaugucuaguuucuagugucacug

SEQ ID NO: 691036 - RNA, 51 nt, hsa
acgcaccaagccgaaaguaaaaacacaaaaacagauaccccccuacuuaau

SEQ ID NO: 691037 - RNA, 64 nt, hsa
agccuugacaaauuuuaccuuaaaaccaaaaugaaacacaaaaauuaauccuuaauaaugauag

SEQ ID NO: 691038 - RNA, 64 nt, hsa
uguuucucuaagauuuccuuugguuguauuuagaaacacaaauaguuuuauaaucaggauugca

SEQ ID NO: 691039 - RNA, 50 nt, hsa
uucugcaggagagaugcugaaacacaaacagguauaagacucagucucca

SEQ ID NO: 691040 - RNA, 64 nt, hsa
aacaaaacaacaacagcaaaaaacaacaaaacaaaacacaaauacucucacagggcauggaggu

SEQ ID NO: 691041 - RNA, 64 nt, hsa
gaaagcaaaguaauaaaaucacaaauguuuggaaaacacaaaaguaacuuguuuaucucagucu

SEQ ID NO: 691042 - RNA, 64 nt, hsa
ccuggccagcuuaaccuggucugaggugagacuaaacacaaaaacaguagauaaaucucucccu

SEQ ID NO: 691043 - RNA, 64 nt, hsa
gcuguucugaauuuauccacaguaauauagucugaacacaaauaguuuacuuaacuuauccuug

SEQ ID NO: 691044 - RNA, 64 nt, hsa
auuaagaaagaugaaguauuagauuuuacaucauaacacaaaguccagcagcuacaucugugga

SEQ ID NO: 691045 - RNA, 64 nt, hsa
aucaaggcacaacacaaaaaccaacacaaaacauaacacaaaaaagaagcuaccuaugauccug

SEQ ID NO: 691046 - RNA, 64 nt, hsa
gaguacuacagcaucaaggcacaacacaaaaaccaacacaaaacauaacacaaaaaagaagcua

SEQ ID NO: 691047 - RNA, 64 nt, hsa
cauaaagcaaaggaguacuacagcaucaaggcacaacacaaaaaccaacacaaaacauaacaca

SEQ ID NO: 691048 - RNA, 64 nt, hsa
acauaccaaaaaauaacaccaaaaccucugucagaacacaaaggaaugugcauaauggagagaa

SEQ ID NO: 691049 - RNA, 64 nt, hsa
auuauuuccacuugcaggccagcuuaaccucugaaacacaaaugaucuugagaccacuuuagug

SEQ ID NO: 691050 - RNA, 64 nt, hsa
acucucuuaagguucaauauguaauaaaaaacauaacacaaauaauuauucuauaugaauauua

SEQ ID NO: 691051 - RNA, 64 nt, hsa
guaagguaaugaaucucuccaucugggaaugauuaacacaaauguuggagcauguuuacauaca

SEQ ID NO: 691052 - RNA, 64 nt, hsa
caaacacacacauuuaucauuuaaugcauaaaucaacacaaaagguuuucccauuaauaugaaa

SEQ ID NO: 691053 - RNA, 64 nt, hsa
augagaaucuguucaccaaaccaaauguggaaagaacacaaagaagacauaagacuucagucaa

SEQ ID NO: 691054 - RNA, 64 nt, hsa
cuuauacaucuauucuauaacagugaugaauauuaacacaaaggaaauauggagaacuguuaua

SEQ ID NO: 691055 - RNA, 64 nt, hsa
uaaaaugaaguaguauauaugaaaaugcuuuuuaaacacaaaagcuuuauacaaaauauuguug

SEQ ID NO: 691056 - RNA, 64 nt, hsa
aagggcagcaagaaaugcuggguccaccuaauuuaacacaaaaugaaguugagauucggcaguu

SEQ ID NO: 691057 - RNA, 64 nt, hsa
ccaacugaaggcaguaaccauuacuucuaaccguaacacaaacacagcaaguuuuaaccuuuua

SEQ ID NO: 691058 - RNA, 64 nt, hsa
ccaaaaaggaaaaaaaauccaccaaaccaugauaaacacaaaaugcagcuuccugaugcuuaga

SEQ ID NO: 691059 - RNA, 64 nt, hsa
uugaccuuaucuuaauggaaaacgguuaacuccaaacacaaaagacucuacuggaaaguguagg

SEQ ID NO: 691060 - RNA, 64 nt, hsa
cugaccaauauggagaaacccugucucuacuaagaacacaaaauuagcugggcaugguggugca

SEQ ID NO: 691061 - RNA, 64 nt, hsa
ggaaagauaucuaugaaauauggugguuuuuuaaaacacaaaaauuauagaauaugggaucccg

SEQ ID NO: 691062 - RNA, 64 nt, hsa
caguuguuacccuagcaaggcuagggagggcaugaacacaaacauaagaacuggucuucuacac

SEQ ID NO: 691063 - RNA, 64 nt, hsa
gguucucuugcaguuucugguggcaucucaggggaacacaaagcuaugucuauuccccaauaua

SEQ ID NO: 691064 - RNA, 64 nt, hsa
auguuuuggauccaauacacacauuguuacaacuaacacaaauuccuauuaaauauuaaaagua

SEQ ID NO: 691065 - RNA, 64 nt, hsa
aaacuuuucaaaaucuuuguuaaaccaaacauucaacacaaaauaaacuagaaggccagaggau

SEQ ID NO: 691066 - RNA, 64 nt, hsa
cauuuuucauuugugcuuuuuuaaaaaaaaaaauaacacaaagaggaaaacuagaauauauaua

SEQ ID NO: 691067 - RNA, 64 nt, hsa
ucuaaaagugaaacaaaaaccaaccaacaaauacaacacaaagcaauuauucuuccuaucugau

SEQ ID NO: 691068 - RNA, 64 nt, hsa
ggugcugauugaaagaacaaaacaaaacaaaacaaacacaaacaaacaaaaaaccuucaacugc

SEQ ID NO: 691069 - RNA, 64 nt, hsa
aaggaaaaaaagaaaaaaggaaaaaaacaguuugaacacaaaggcucuauggaagaaaugccuc

SEQ ID NO: 691070 - RNA, 64 nt, hsa
aaaaaaaaaggaaaagaggaagacuggacaaaacaacacaaaggcagaaaggaaagaaacugaa

SEQ ID NO: 691071 - RNA, 64 nt, hsa
uaaauagaagaaauauauuuauaaagcuuagugaaacacaaaauuagaauguucaugucaggca

SEQ ID NO: 691072 - RNA, 64 nt, hsa
uuaaaaaugcagcagcauaggagugaacaacagcaacacaaaacgggcauugguuucuuaggag

SEQ ID NO: 691073 - RNA, 64 nt, hsa
cucuguucuuucaacuccuuugaggcucaaaaaaaacacaaagaucagaagccuucagauagag

SEQ ID NO: 691074 - RNA, 64 nt, hsa
caguucaauaaugaggaaacaggugagcccugaaaacacaaaaggacaguucuguguugaaaca

SEQ ID NO: 691075 - RNA, 64 nt, hsa
uaaauacagccauuccaaaugggagaaauuggccaacacaaaaggguaacagggcccaugcaag

SEQ ID NO: 691076 - RNA, 64 nt, hsa
ugccaaguuaguauuguuagagauuucauuuuacaacacaaaaauaagccugugucaaagauuu

SEQ ID NO: 691077 - RNA, 64 nt, hsa
ucuuaauaugcgaagugugccucugcaagauacuaacacaaagcucauguuaagaaaacaguug

SEQ ID NO: 691078 - RNA, 64 nt, hsa
gccugggcugguccagugcuaugccuggaggcucaacacaaaacuucccauccaaacauucaga

SEQ ID NO: 691079 - RNA, 64 nt, hsa
acaguauacugcaacacaaaagauuuuaucuguaaacacaaagcccuucaucuaauauuuguug

SEQ ID NO: 691080 - RNA, 64 nt, hsa
cuuuuccaauuuugcaaacacuacaguauacugcaacacaaaagauuuuaucuguaaacacaaa

SEQ ID NO: 691081 - RNA, 64 nt, hsa
uagaauaaaauguugauaaggcacugccucuuagaacacaaacagaauauugcaaaugcauuua

SEQ ID NO: 691082 - RNA, 64 nt, hsa
uuugaauauucccaauuuucgaagucaguaaaaaaacacaaaaacuguaugaaugacuuuguaa

SEQ ID NO: 691083 - RNA, 64 nt, hsa
cgaccagcagagcuuuuuaauacaagaaaacaacaacacaaaccacacacacucgcacacacac

SEQ ID NO: 691084 - RNA, 64 nt, hsa
ugcuuuuuagcucaguacacugaaaccauaugauaacacaaauucacauauaauuggggguuag

SEQ ID NO: 691085 - RNA, 64 nt, hsa
aaugcacugccauucauaauugccaauugaggacaacacaaaugggauugguacuuuauaguaa

SEQ ID NO: 691086 - RNA, 64 nt, hsa
cgcauacggcccaggauggcuuugaaugcagcccaacacaaauucguaaacuuucuuaaaacau

SEQ ID NO: 691087 - RNA, 64 nt, hsa
aaauccugcaugugcuauucaggacacacuuauaaacacaaaugcacugugagauaugugaaga

SEQ ID NO: 691088 - RNA, 64 nt, hsa
ucaacacaaagacauggaagauuagagguuugucaacacaaagacacaggaagaaugggcugca

SEQ ID NO: 691089 - RNA, 64 nt, hsa
ugucaacaaaaagacauggaagguuagguuugucaacacaaagacauggaagauuagagguuug

SEQ ID NO: 691090 - RNA, 64 nt, hsa
agggucagaugcaccacccauggagagguuugucaacacaaagacauggaagguuagagguuug

SEQ ID NO: 691091 - RNA, 64 nt, hsa
caacucauauguuaagaccauuuuccagauuggaaacacaaaucucuuaggaaguuaauaagua

SEQ ID NO: 691092 - RNA, 64 nt, hsa
ucaucgacuuaagagaaaaaaucuuacauguaauaacacaaagcuauuauauguuauuucuagg

SEQ ID NO: 691093 - RNA, 64 nt, hsa
aucucgccaaagaaaccacgcccacaccaaugccaacacaaaacuguguuuacugaaagccgaa

SEQ ID NO: 691094 - RNA, 64 nt, hsa
acuuucuuguuuugucucaaaacuuaaaaaaacaaacacaaaaagaugagucccaccccccacu

SEQ ID NO: 691095 - RNA, 64 nt, hsa
ggacaaaacaaucuuaaguugggcagcuuuccucaacacaaaaaaaaguuauuaauggucauug

SEQ ID NO: 691096 - RNA, 64 nt, hsa
uuuucaucaagcaacagaggaccaaugcaacaagaacacaaaugugaaaucaugggcugacuga

SEQ ID NO: 691097 - RNA, 64 nt, hsa
uaaucauccuuaauccuuaucuuagggauacuugaacacaaacacugugguaggauaacaguau

SEQ ID NO: 691098 - RNA, 64 nt, hsa
uguauuuauucacuuuuggaagcuaggaaugagcaacacaaauuuuacucugaagucagaagag

SEQ ID NO: 691099 - RNA, 64 nt, hsa
acccccaagacugggaggggacuucuuuuucuaaaacacaaaacucagcccagccaggcccccu

SEQ ID NO: 691100 - RNA, 64 nt, hsa
acaaaaaagaaaaaaaucaaaaaagcgacaaaaaaacacaaacagaagaggaaaaaaaagcaac

SEQ ID NO: 691101 - RNA, 64 nt, hsa
uuggacaucaaauuuggacaccaggucacggagaaacacaaacaccacccaggaacacgcagac

SEQ ID NO: 691102 - RNA, 64 nt, hsa
uuuuuacuggggauucuugaacuugaaaaaaaaaaacacaaaaaaagacaaaaaaaaaaaaaga

SEQ ID NO: 691103 - RNA, 64 nt, hsa
gcaccaaacuaacacaaauuuaauggcuuaaaacaacacaaaaucauuaucuuacaguucugga

SEQ ID NO: 691104 - RNA, 64 nt, hsa
uuguguuaguuuuuuaugaguguugcaccaaacuaacacaaauuuaauggcuuaaaacaacaca

SEQ ID NO: 691105 - RNA, 64 nt, hsa
uucccaagagagcugucaguuuucagcugucaguaacacaaaugaguuuaugguaacacaaaug

SEQ ID NO: 691106 - RNA, 64 nt, hsa
uuucagcugucaguaacacaaaugaguuuaugguaacacaaaugaguuuugcuaucucucugag

SEQ ID NO: 691107 - RNA, 64 nt, hsa
gaccuucccuggguuaaucaauuucccucuagacaacacaaacugcaggcaugugacuaacuuu

SEQ ID NO: 691108 - RNA, 64 nt, hsa
cuauaccauccugauuuuugaaaagugaauuauaaacacaaaauuguuaguguuuaugauguuu

SEQ ID NO: 691109 - RNA, 64 nt, hsa
aaaacauggaaacuuagacuuguauaguguaaugaacacaaauaccaaaacugcauuuugguuu

SEQ ID NO: 691110 - RNA, 64 nt, hsa
ugauuuuacauuuccuauaucacuaaaauacuuaaacacaaaaauaaaauuccacuccuuuauu

SEQ ID NO: 691111 - RNA, 64 nt, hsa
agucuagguaaagaaaaaaaaaaaaaggucaugaaacacaaauguccucaacugucaucauucu

SEQ ID NO: 691112 - RNA, 64 nt, hsa; identical to SEQ ID NO: 96702

SEQ ID NO: 691113 - RNA, 64 nt, hsa; identical to SEQ ID NO: 96703

SEQ ID NO: 691114 - RNA, 64 nt, hsa; identical to SEQ ID NO: 96704

SEQ ID NO: 691115 - RNA, 64 nt, hsa; identical to SEQ ID NO: 96705

SEQ ID NO: 691116 - RNA, 64 nt, hsa; identical to SEQ ID NO: 96706

SEQ ID NO: 691117 - RNA, 59 nt, hsa; identical to SEQ ID NO: 96707

SEQ ID NO: 691118 - RNA, 64 nt, hsa; identical to SEQ ID NO: 96708

SEQ ID NO: 691119 - RNA, 64 nt, hsa; identical to SEQ ID NO: 96709

SEQ ID NO: 691120 - RNA, 64 nt, hsa; identical to SEQ ID NO: 96710

SEQ ID NO: 691121 - RNA, 64 nt, hsa; identical to SEQ ID NO: 96711

SEQ ID NO: 691122 - RNA, 64 nt, hsa; identical to SEQ ID NO: 96712

SEQ ID NO: 691123 - RNA, 64 nt, hsa; identical to SEQ ID NO: 96713

SEQ ID NO: 691124 - RNA, 64 nt, hsa; identical to SEQ ID NO: 96714

SEQ ID NO: 691125 - RNA, 64 nt, hsa; identical to SEQ ID NO: 96715

SEQ ID NO: 691126 - RNA, 64 nt, hsa; identical to SEQ ID NO: 96716

SEQ ID NO: 691127 - RNA, 64 nt, hsa; identical to SEQ ID NO: 96717

SEQ ID NO: 691128 - RNA, 64 nt, hsa; identical to SEQ ID NO: 96718

SEQ ID NO: 691129 - RNA, 64 nt, hsa; identical to SEQ ID NO: 96719

SEQ ID NO: 691130 - RNA, 64 nt, hsa; identical to SEQ ID NO: 96720

SEQ ID NO: 691131 - RNA, 64 nt, hsa; identical to SEQ ID NO: 96721

SEQ ID NO: 691132 - RNA, 64 nt, hsa
gugaauucuaucuauuuaauuggauauuggacucugcucauauaagcuacagacaaaagccaaa

SEQ ID NO: 691133 - RNA, 64 nt, hsa
ggugauguauuugcuugaguuacuccuguaucauugcucauaauauuggaaacuaaaauaaaac

SEQ ID NO: 691134 - RNA, 64 nt, hsa
ccagccuuguuugcuuuuuuaacagauaacagugugcucauagaaacugcuuugacaugacugc

SEQ ID NO: 691135 - RNA, 64 nt, hsa
gauguuagccauaguggacaagguuccauucacaugcucauauguuuauaaacuguguuuugua

SEQ ID NO: 691136 - RNA, 64 nt, hsa
aaggggugggggugugcagucugcccuguccuucugcucauaaccugacaaaaugccaaacuag

SEQ ID NO: 691137 - RNA, 64 nt, hsa
acacuuuugcaagagugaugggaaagacccuaggugcucauaacuagaguauguguauguacuu

SEQ ID NO: 691138 - RNA, 64 nt, hsa
cauaggcaaggacaacaugugcuuuuuggugagcugcucauaauuccugaaauguguggugcca

SEQ ID NO: 691139 - RNA, 64 nt, hsa
gcaggucugagcuaagccccugaaagcaggguaaugcucauaaaaggacuguucccgcggcccc

SEQ ID NO: 691140 - RNA, 64 nt, hsa
gaugucaucuugugccuuucauguaaguuaaauuugcucauacagcuugaacguuguauuugca

SEQ ID NO: 691141 - RNA, 64 nt, hsa
ugagcccuucugcguuguuaugccacuucccuacugcucauaugcacgcuggcuccccugggca

SEQ ID NO: 691142 - RNA, 64 nt, hsa
caucuugaucuguugaauguucauucuuucuuuuugcucauacugcuguaggcuauaauucccc

SEQ ID NO: 691143 - RNA, 64 nt, hsa
uccuaucuuuuuucuucuuuguucuguuuacuuuugcucauaucaucauucccgcuaucuuucu

SEQ ID NO: 691144 - RNA, 64 nt, hsa
ccuuuuuuuucccuuaauguugaauuaaaauacuugcucauaguugauuuaccauuccuacaaa

SEQ ID NO: 691145 - RNA, 64 nt, hsa
aaaaaaacuuggguaugagauuucacauuaucauugcucauaauagccaauaaguaaaaacaac

SEQ ID NO: 691146 - RNA, 64 nt, hsa
agcaccuaccuuacuuucagggacaggaaucuauugcucauacuucugcuucccagaguuuugc

SEQ ID NO: 691147 - RNA, 64 nt, hsa
cagacauuaagcaaacucacaaauacauaaaauaugcucauaaaaggccuuuaugaagaaaaac

SEQ ID NO: 691148 - RNA, 64 nt, hsa
uagauaccuuuuugcuugaugauaaguuuuugcuugcucauauuuuuugucuugauccugagaa

SEQ ID NO: 691149 - RNA, 64 nt, hsa
cugaucauauuaaaaaucuggguaaacuaaaaccugcucauaaccucauaguaugcaaccaaag

SEQ ID NO: 691150 - RNA, 50 nt, hsa
ugcacaaaauggccucuugaugcucauaucuguucuucagcagccuguca

SEQ ID NO: 691151 - RNA, 64 nt, hsa
ugagccaaccagaauaaaauaaccaauacuccacugcucauauuuuuaucuaauucagauggau

SEQ ID NO: 691152 - RNA, 64 nt, hsa
cuuuuuugaggucuucucaacuugacuacaguugugcucauaauuguccuugccuuuccagcuu

SEQ ID NO: 691153 - RNA, 64 nt, hsa
gugagguguggguguggcgguuucuguguacguuugcucauacacgcacauccaaaagccugug

SEQ ID NO: 691154 - RNA, 64 nt, hsa
agugguccucaugaauugcauuaagacucuguacugcucauauuacacuccauccucucuguag

SEQ ID NO: 691155 - RNA, 64 nt, hsa
gucacaagugaaccacuucucaguugccaaucuuugcucauauuaaaaacaacuuacaaauacu

SEQ ID NO: 691156 - RNA, 64 nt, hsa
agcuggaacacagaagagaggagguugugucucuugcucauagcaagccuguggguagaggaaa

SEQ ID NO: 691157 - RNA, 64 nt, hsa
uucuuuuucucccucuuucauaacuggaugcagcugcucauacucaaucccauauucagcaagu

SEQ ID NO: 691158 - RNA, 64 nt, hsa
aagggcauuaggaguguuucauuugauaugugaaugcucauaaaaaaaugucaaggaaugaaga

SEQ ID NO: 691159 - RNA, 64 nt, hsa
cugcuuuaaaacaugcuuuggacauauauuuuagugcucauacuguuacuaauaaaaaaauaac

SEQ ID NO: 691160 - RNA, 64 nt, hsa
uaccuaauacugaguuuuugcaaaaaacaaugaaugcucauauguaauugaaauacuucagauc

SEQ ID NO: 691161 - RNA, 64 nt, hsa
acacucaggccugaccuaggcuugggagucaaacugcucauauugagcauauuguuaagugggu

SEQ ID NO: 691162 - RNA, 64 nt, hsa
cuucaaaacugugcuugaauagacuaauaauauaugcucauaucagaugucaguuuucauuuaa

SEQ ID NO: 691163 - RNA, 64 nt, hsa
uccuuuucagaauuaaaauuuuagagauguuuagugcucauaaucuccagucuguguucucucg

SEQ ID NO: 691164 - RNA, 64 nt, hsa
uuuaauuggaguaucuaaagccaguggcaguguaugcucauacuuggacaguuagggaaggguu

SEQ ID NO: 691165 - RNA, 64 nt, hsa
aguagcuuugacauuaagcuccccagaucccugcugcucauacuucuggcaaggguuccccucu

SEQ ID NO: 691166 - RNA, 64 nt, hsa
gugcugugauuuucaaauuuuuagccagguacucugcucauagaaaucuuaaaucaaagaauaa

SEQ ID NO: 691167 - RNA, 64 nt, hsa
cuauuauacuaaaagcuccuacugugaugugaaaugcucauacuuuauaaguaauucuaugcaa

SEQ ID NO: 691168 - RNA, 64 nt, hsa
auuugccuugugguguuggaucagguacugugucugcucauaaguacuugugucauccagaaug

SEQ ID NO: 691169 - RNA, 64 nt, hsa
caagugaggagugccagcucaaguuggaguugacugcucauacccaggugaguaaggcaaugua

SEQ ID NO: 691170 - RNA, 64 nt, hsa
cgaccuuugaguuaagcugucuuuauaagcaggaugcucauagugguuucccggagccaguagu

SEQ ID NO: 691171 - RNA, 64 nt, hsa
uucgaguguuucagugcuucgcagauguccuugaugcucauauuguucccuauuuugccagugg

SEQ ID NO: 691172 - RNA, 64 nt, hsa
cuaacacugucucuuuugugaaaaucuggaaaagugcucauauucacagguggcuggugcuagu

SEQ ID NO: 691173 - RNA, 64 nt, hsa
gugcauugcuaugcaagcucacucuuuuuagcucugcucauauuauugucuguucuuauugguc

SEQ ID NO: 691174 - RNA, 64 nt, hsa
uuccaauagucugcacuucucccaaggugugcacugcucauaaacuugccagugugugauucau

SEQ ID NO: 691175 - RNA, 64 nt, hsa
cauauuugcaaucauugcagcuucuucuuucuucugcucauaaaaggaggaacacuuuagauag

SEQ ID NO: 691176 - RNA, 64 nt, hsa
uauuagaaaaugacacauaacacgggcagcugguugcucauaggguccuucucuagggagaaac

SEQ ID NO: 691177 - RNA, 64 nt, hsa
uucuuucuuugggaauauuugaaucuugucucaaugcucauaacggaucagaaauacagauuuu

SEQ ID NO: 691178 - RNA, 64 nt, hsa
gacagugcuauuuugugcccacugucucuccugaugcucauaucaauccuauaaggcacaggga

SEQ ID NO: 691179 - RNA, 64 nt, hsa
gaaacagggguccucugacuuccucaugggggcuugcucauaccgccccuccugguggaugugu

SEQ ID NO: 691180 - RNA, 64 nt, hsa
cagccagucagguuggcuuuccugguuucagacaugcucauaccauucccauuuucucagccuc

SEQ ID NO: 691181 - RNA, 64 nt, hsa
auuccuuuguucuguuauacaaaauuaaucuuucugcucauaaugauugaugauaccaccagua

SEQ ID NO: 691182 - RNA, 64 nt, hsa
uagauuuuauccauuuuuaucuuaacuauugagaugcucauaucauuuuucuucuucaaugugu

SEQ ID NO: 691183 - RNA, 64 nt, hsa
acacacgucuaacagccuagacaaucucgucagaugcucauacuggaccaucagccuccccauu

SEQ ID NO: 691184 - RNA, 64 nt, hsa
accagucauccagaauuuccuuccugaaucuccaugcucauaugcaaugucuacaucaaggucu

SEQ ID NO: 691185 - RNA, 64 nt, hsa
agcuggcauguugauucaaaccaugggcugaauuugcucauaggcugugcaucagacaaaagcu

SEQ ID NO: 691186 - RNA, 64 nt, hsa
guagaaugcccgcugaugcauuguuuauuuuuuuugcucauaauauaaauaucagauuauguuu

SEQ ID NO: 691187 - RNA, 64 nt, hsa
ucaaaagacaagaaaugaaauugacagugaauagugcucauaaauugguagcguauauaaagag

SEQ ID NO: 691188 - RNA, 64 nt, hsa
uguguucccagcuaacucuauuuuuuuuuucacuugcucauaaacuucuggaaaaaaauaagca

SEQ ID NO: 691189 - RNA, 64 nt, hsa
caaugccuugggcuucucuaauuacuauacauugugcucauaugaauaaaagaaauuuuaaaag

SEQ ID NO: 691190 - RNA, 64 nt, hsa
cuguuagagauuugagguuacaugauaugcuuuaugcucauaacugauguggcuggagaauugg

SEQ ID NO: 691191 - RNA, 64 nt, hsa
aaucguauaaaaucuggauuuuuuuuuuuuuuuuugcucauauucacauauguaaaccagaaca

SEQ ID NO: 691192 - RNA, 64 nt, hsa
gauuuauuuuuauaugauguauacccauaaagaaugcucauauuaauguacuuaaauuacacau

SEQ ID NO: 691193 - RNA, 64 nt, hsa
aaaauuucaacagcacuuaaacugaaguuuggguugcucauacaauaaacagauugaaaaaacu

SEQ ID NO: 691194 - RNA, 64 nt, hsa
uacaagggucacccaaauagcugagugcaguccuugcucauauuuccuucaucuuaaccccgca

SEQ ID NO: 691195 - RNA, 64 nt, hsa
uuuuuacuaaucccuaauuuuuuuuccaguguauugcucauauuaucagaaggaaaaguuauuu

SEQ ID NO: 691196 - RNA, 64 nt, hsa
caaauuuaagaaugucagcaaugucaauuuuaaaugcucauaggucuuuccauaucuguaacau

SEQ ID NO: 691197 - RNA, 64 nt, hsa
aucagacaagaugaggagguacaaaaguuacuauugcucauaaugacuuacaggcuaaaauuag

SEQ ID NO: 691198 - RNA, 64 nt, hsa
auaaucacaugagccaaucuccuuaauaaaugccugcucauagaucuguaucuacaucuauauc

SEQ ID NO: 691199 - RNA, 64 nt, hsa
ccccaacucaaggccaaggacugggcguaucggaugcucauaacaccccuggccuggccccuuu

SEQ ID NO: 691200 - RNA, 64 nt, hsa
agguugauaaaucauuuuaugucaagggcagcuuugcucauauuucccaugauuucauguacug

SEQ ID NO: 691201 - RNA, 64 nt, hsa
cuuuuguuacuuuucauuugccucuaauuuugcuugcucauauuucuggccaauguacagccuc

SEQ ID NO: 691202 - RNA, 64 nt, hsa
uguuaguuugucuuguuuugcuuuccagagaucuugcucauacaaugaaucacgcaaccacuaa

SEQ ID NO: 691203 - RNA, 64 nt, hsa
ugcacugagaacaccgcgcagcgugacugugaguugcucauaccgugcugcuaucugggcagcg

SEQ ID NO: 691204 - RNA, 64 nt, hsa
aacaauuuauaugucuuacacugagaaauaaaacugcucauaagugaaaacacucauguugguc

SEQ ID NO: 691205 - RNA, 64 nt, hsa
acaagcacacaguucuuuugcaggagucaagaugugcucauaggagccaagggcaaacucgaaa

SEQ ID NO: 691206 - RNA, 64 nt, hsa
accucuccucuucuuuuaaaaaaagaacacuuucugcucauaucauaaccagguccaacccagc

SEQ ID NO: 691207 - RNA, 64 nt, hsa
guagauagaugguauagagcuuaaggcauuuucaugcucauaaaucugauaggcaacaguagcu

SEQ ID NO: 691208 - RNA, 64 nt, hsa
uguaacagccaggccaggaccaagggcagaggggugcucauagcgggcgcugccagccccgcca

SEQ ID NO: 691209 - RNA, 64 nt, hsa
aaauuguauaaagaauggaaaagucauuaauaucugcucauaucuuaacaucagcgaguuggua

SEQ ID NO: 691210 - RNA, 64 nt, hsa
cucccugggcagggucuugaggcagccacugugaugcucauaccuuaccuugccuccuacccuc

SEQ ID NO: 691211 - RNA, 64 nt, hsa
aucuaaauauuuacauauacccaaaauuaacuuaugcucauauauuaggaugugagaauaucau

SEQ ID NO: 691212 - RNA, 64 nt, hsa
cugccugguauauccaaaagcuuuuuauuccuccugcucauauugugauucugccuuuggggac

SEQ ID NO: 691213 - RNA, 64 nt, hsa
uaucucuguauccccaaggcuuugcacagugccuugcucauaguagguuuucaauaaaugauua

SEQ ID NO: 691214 - RNA, 64 nt, hsa
caggauuuuguauugccaucgggugccaaauaaaugcucauauuuauuacugaugugugcucaa

SEQ ID NO: 691215 - RNA, 64 nt, hsa
cacuaaccuagucuaucuuuucuaucuuggaauuugcucauacaaacccuauagccuagacuag

SEQ ID NO: 691216 - RNA, 64 nt, hsa
ugaaauaucuuuuugccucagacagcucuugaauugcucauacagaacaauucugcuggugcug

SEQ ID NO: 691217 - RNA, 64 nt, hsa
aaguuagcuuauagguuauacauuuaaguuaaagugcucauaaucacuugcaauuucauuguaa

SEQ ID NO: 691218 - RNA, 64 nt, hsa
agccccucuccuggaagugcuaauuuugaaaaacugcucauaugauguacauguacugauuacu

SEQ ID NO: 691219 - RNA, 64 nt, hsa
ucccacacugugaacuaaugacaagugacuuauuugcucauaaguaaaugucuucauguugaug

SEQ ID NO: 691220 - RNA, 64 nt, hsa
acaggcucggguauuuugguagggacuguaggcaugcucauaaauccuugcuguugucacagua

SEQ ID NO: 691221 - RNA, 64 nt, hsa
gauaaggaaacuuuauuuaaaugcaugucuuaaaugcucauaaagauguuaaauggaauucgug

SEQ ID NO: 691222 - RNA, 64 nt, hsa
gucuuaguucugguugauucacucaagaguucagugcucauacguaucugcucauuuugacaaa

SEQ ID NO: 691223 - RNA, 64 nt, hsa
ugguuugguuucuaucauauagauuaauuuuaccugcucauaugaagggaauuguacaucaugc

SEQ ID NO: 691224 - RNA, 64 nt, hsa
uuuaaagagagaugcacuuaagaauagagugaacugcucauaugcuuauuuaagcuuggacagu

SEQ ID NO: 691225 - RNA, 64 nt, hsa
agaggaaucacuuaaaagguaggcauaucuaagaugcucauagaagaggaagaaugggacaugg

SEQ ID NO: 691226 - RNA, 64 nt, hsa
acugguuuaguugguggguuaauuaaaaaaaauuugcucauaugaacuuucauuuuauauguuu

SEQ ID NO: 691227 - RNA, 64 nt, hsa
augggaaguugugacguugcagcuccaaccgacgugcucauagugaucagcugugcaggagcca

SEQ ID NO: 691228 - RNA, 64 nt, hsa
gacucugcuuugacaucgccccuucccaccauacugcucauaauaacauuuuagggggaaaggg

SEQ ID NO: 691229 - RNA, 64 nt, hsa
acagggguucccuucucucaauguuuguaauaauugcucauaagcaauaccagcaauucauaaa

SEQ ID NO: 691230 - RNA, 64 nt, hsa
auuucacaacauauucuuuggaagcaggaagaaaugcucauaaagaggaucagaccuucuuucc

SEQ ID NO: 691231 - RNA, 64 nt, hsa
uuccucgaacuaaagcaguuaagaccucgacauuugcucauagaaaaagucgcugagucguuuc

SEQ ID NO: 691232 - RNA, 64 nt, hsa
auuggcucugcagggcaggggugaggcagguuucugcucauaagugcuuuuggaagucaccuac

SEQ ID NO: 691233 - RNA, 64 nt, hsa
auacucuguaacaguugcauugacugucacauaaugcucauacuuaucuaauguugaguuauua

SEQ ID NO: 691234 - RNA, 64 nt, hsa
auuggagaugccauccucuuucucuuuucuaguuugcucauacuacauugaguagacacauuua

SEQ ID NO: 691235 - RNA, 64 nt, hsa
accaccuccgggucggcaccaggacugcccucggugcucauagggaauggcugggcccacggaa

SEQ ID NO: 691236 - RNA, 64 nt, hsa
auuuuuuaaaugucgaguaaaacuucgugaaaacugcucauaaagacuaaaaguugaccuguua

SEQ ID NO: 691237 - RNA, 64 nt, hsa
ggggguaaaugcuugccgcuuuagagguggauggugcucauaaaaggccccagucggggguauu

SEQ ID NO: 691238 - RNA, 64 nt, hsa
gaaacuuggccagaaaacugguguugaaggcuuuugcucauauaaacaagugccauugaguuuc

SEQ ID NO: 691239 - RNA, 64 nt, hsa
acauagccgcuaguaaaacuagccucaaacaggaugcucauagcuuaauaauaaaagcugugca

SEQ ID NO: 691240 - RNA, 64 nt, hsa
uuaugguauauuuuauguaacauuuuaauguuuaugcucauaaaacuuagugaacacacugugu

SEQ ID NO: 691241 - RNA, 64 nt, hsa
uacuauccgagguaauuuugaaguuuaauauaaaugcucauaucaaaugaauauagaacuaaua

SEQ ID NO: 691242 - RNA, 64 nt, hsa
uguagugggguucuaggcaucucuguacuuugcuugcucauaugcauguagucacuuuauaagu

SEQ ID NO: 691243 - RNA, 64 nt, hsa
uaccuuuuuauuuuuuguuuuagauguaagagcaugcucauauguuagguacuuacauaaauug

SEQ ID NO: 691244 - RNA, 64 nt, hsa
accacuguuucuggaguaucugucauccagugacugcucauauuguggcauuaugcaguguuac

SEQ ID NO: 691245 - RNA, 64 nt, hsa
gcaaaaugaagacucuuuuacucagcucugguauugcucauaacuuaccaagaggcuaauacua

SEQ ID NO: 691246 - RNA, 64 nt, hsa
ugccagcagcucccucccgucccccaaccucuccugcucauaaauccagacuucccacagcauu

SEQ ID NO: 691247 - RNA, 64 nt, hsa
uaauggcaauaauuaucaaaacuuuuaaaauagaugcucauauuuuuaaaauaaaguuuuaaaa

SEQ ID NO: 691248 - RNA, 64 nt, hsa
guggagcguuucuuaucgaagguuaaauggacucugcucauaaaccucuuacugagaugcuucc

SEQ ID NO: 691249 - RNA, 64 nt, hsa
cccucugaucgccgaucaccucugagacccaccuugcucauaaacaaaaugcccauguuggucc

SEQ ID NO: 691250 - RNA, 64 nt, hsa
gauagauuguauaauauauaguuuaauguaaucaugcucauauuuuuuaaauaaauaaaacacu

SEQ ID NO: 691251 - RNA, 63 nt, hsa
uaaaaaugcaaauaaagacugcuuccuuagagggugcucauacaaaauuccagucuuugaguc

SEQ ID NO: 691252 - RNA, 64 nt, hsa
aguagugagguuacuuuugaucggagcaacauaaugcucauagaaucuucuagaagaagagaaa

SEQ ID NO: 691253 - RNA, 58 nt, hsa
augcuucugauguggaauaauuuucagcugcucauauauuuaguuauuuaaacaaacu

SEQ ID NO: 691254 - RNA, 64 nt, hsa
gggguuauuguuccuuuggcuuaaagccaaaugcugcucauagaaugaucuuucucuaguuuca

SEQ ID NO: 691255 - RNA, 64 nt, hsa
uguguugggggggagacacuacuccuacuuaucuugcucauaaagccuuuucuggugggauauu

SEQ ID NO: 691256 - RNA, 64 nt, hsa
caaaaaguuaugaaaauuuuuauacugggaaugaugcucauauaagaauaccuuuuuaaacuau

SEQ ID NO: 691257 - RNA, 64 nt, hsa
uaaaauaacuacccucagcaaacacuagcuguucugcucauauaugaauuuuuaaugcagcaau

SEQ ID NO: 691258 - RNA, 64 nt, hsa
caccucuaugcuagcugaggauaaauuuaccaguugcucauauuuaaacugaccuaaauauguu

SEQ ID NO: 691259 - RNA, 64 nt, hsa
uuuuaaucuaaagucaucccuucugagugaaauuugcucauaaagcauuuggauacuaagccau

SEQ ID NO: 691260 - RNA, 64 nt, hsa
aagagaucuugauccagacagagcagcauaucuuugcucauacaaacuagaagaaccagcugau

SEQ ID NO: 691261 - RNA, 64 nt, hsa
ggauauuuuacuuaaucuaaaaguuaauuuauguugcucauauauuacucaaguauuuaaauuu

SEQ ID NO: 691262 - RNA, 64 nt, hsa
ucuguuaauaucagacaaaaugagcaauuggcagugcucauaauauauuccaauuuuuauugga

SEQ ID NO: 691263 - RNA, 64 nt, hsa
cugcauguagaugauuaaaugagggcaggcccugugcucauagcuuuacgauggagagaugcca

SEQ ID NO: 691264 - RNA, 64 nt, hsa
uguuuuuauuaugccauuugacauuucaaaucagugcucauauacaguaaacuugugauagaaa

SEQ ID NO: 691265 - RNA, 64 nt, hsa
ucuauaggaaugaggacgggcuucuaaagagaccugcucauacuugcuaccuccuuccaguggg

SEQ ID NO: 691266 - RNA, 64 nt, hsa
cauaagaguugacugaguuaaucccaauugguugugcucauaugccaccuuuuaaaccaaugga

SEQ ID NO: 691267 - RNA, 64 nt, hsa
aaauauguaaguuuuuugguugaaccuuuagauuugcucauaauguuuaacauaacaacauuua

SEQ ID NO: 691268 - RNA, 64 nt, hsa
cugucccagcaaccaugcgagggguugccccaguugcucauacaaacagaucagcaugaggaca

SEQ ID NO: 691269 - RNA, 63 nt, hsa
cccgccugcacucaggugaaauaaacagccauguugcucauacaaagccuguuugguggccuc

SEQ ID NO: 691270 - RNA, 64 nt, hsa
acaaaagcacauaauucugcuguuacggguacuuugcucauacgagcuuucauguucagcaugc

SEQ ID NO: 691271 - RNA, 64 nt, hsa
gcgcguggcccagauaagaauagguguuccuuugugcucauaaaacagaaugcggcgaugguug

SEQ ID NO: 691272 - RNA, 64 nt, hsa
aacaaaugugauaauguuuauuuacuuucgguucugcucauacuuuuuuguacaacauuaaaga

SEQ ID NO: 691273 - RNA, 64 nt, hsa
cuucccgcugcacauggacagacuucacagcgucugcucauaggaccugcauccuuccugggga

SEQ ID NO: 691274 - RNA, 64 nt, hsa
uacagugcccaaaauaaucucaccaacaaagcacugcucauacuagacagugcgucaugccacu

SEQ ID NO: 691275 - RNA, 64 nt, hsa
aguccccaccuggggaauaaacuccagccucuccugcucauacagaagggacugguuggguuug

SEQ ID NO: 691276 - RNA, 64 nt, hsa
uggugcaaugcucugguggcuagggauguacucaugcucauaugugugcacgcuuggacaccca

SEQ ID NO: 691277 - RNA, 64 nt, hsa
guauaccauacauuaucauucaaaacaaccauccugcucauaacaucuuugaaaagaaaaauau

SEQ ID NO: 691278 - RNA, 64 nt, hsa
auugcaccauuuucaauuuggagcauuaacuaaaugcucauacacaguuaaauaaauagaaaga

SEQ ID NO: 691279 - RNA, 64 nt, hsa
gcgcagggagguggccagcgcccccgggcacugcugcucauagguaccuuuccacugccuccuc

SEQ ID NO: 691280 - RNA, 64 nt, hsa
guccggcuggccgacguggcauuugcugaccgaaugcucauagagguugacccccacaggguca

SEQ ID NO: 691281 - RNA, 64 nt, hsa
gcaaaacaacuggaaggacgcuaaauaauaggauugcucauaccagcgcguuaugaacucaccc

SEQ ID NO: 691282 - RNA, 64 nt, hsa
ucucucaucguucuuucaggggucaaguccuuccugcucauacacuucugaauacaguagaugu

SEQ ID NO: 691283 - RNA, 64 nt, hsa
uuuggcugaaacuuuauacauagaaauaaugauuugcucauaacagguaucauuaacugccacu

SEQ ID NO: 691284 - RNA, 64 nt, hsa
guuuccauuaacaaaaccauccuaaagcguuaacugcucauaauuuuaaucagcuacaguuaug

SEQ ID NO: 691285 - RNA, 64 nt, hsa
gagagaugaaauuuagugaacagaauugaaaaggugcucauaauuucacuaugcaaacuuaccc

SEQ ID NO: 691286 - RNA, 64 nt, hsa
ugcugaaguuauaaguuuaaaacucaauuucagaugcucauaaaaguuacuuagcuaaaauuuu

SEQ ID NO: 691287 - RNA, 64 nt, hsa
ucuguauuucuuuaaacccugagaauaauuuacaugcucauaauacaggauaucagcauauuug

SEQ ID NO: 691288 - RNA, 64 nt, hsa
aaagacacgugaaaugauacuuuuauuauucccuugcucauauaacuuuaaaaauaauacuuuu

SEQ ID NO: 691289 - RNA, 64 nt, hsa
ugggggaagaaauuggcaauaucguauaaaaaucugcucauauuagaacacaguauaauucagc

SEQ ID NO: 691290 - RNA, 64 nt, hsa
cccgacuucuuugcuuugggagaauuuggucuuaugcucauaagcaguucaugagugacaagug

SEQ ID NO: 691291 - RNA, 64 nt, hsa
uaggcgaugcagacucgcgauucaaugaucgauaugcucauaaaagugcucaauuauauuuucu

SEQ ID NO: 691292 - RNA, 64 nt, hsa
uauacacaaagaauguggaaaagccauuaauaugugcucauaucuuacucaacaucagagaguc

SEQ ID NO: 691293 - RNA, 64 nt, hsa
auauuaauguggagauguuuugagcaauaauuucugcucauaugucugaaaaguauacagagau

SEQ ID NO: 691294 - RNA, 64 nt, hsa
accauucuugcaaccaaaaggacuuagagcaguuugcucauaaagacauccuuuauuauaaaag

SEQ ID NO: 691295 - RNA, 64 nt, hsa
ucagcauuuacuuuguuucuuuugcuuaggaaauugcucauaaucugguuauaauuuuggucca

SEQ ID NO: 691296 - RNA, 64 nt, hsa
gucccaggacaaagcugagacugacgggugauguugcucauaggcuccagcucugcauaagacc

SEQ ID NO: 691297 - RNA, 64 nt, hsa
gauaacuggcuuaugacaccuugaaaaguucaagugcucauauaacacaccacacugaaccccc

SEQ ID NO: 691298 - RNA, 64 nt, hsa
uaaaugagacuugacagcugcagagcuugggcugugcucauagcuaaggguuaggguucaauau

SEQ ID NO: 691299 - RNA, 64 nt, hsa
ccaaucucgucaggcugccagagaaaguuggugcugcucauacuggucucacagucuaaguaag

SEQ ID NO: 691300 - RNA, 64 nt, hsa
aaggaaaccaagccaucugcauguuuauuuccucugcucauaauaggaaaauggauguuaugga

SEQ ID NO: 691301 - RNA, 64 nt, hsa
gaguaucugagaaccaaccaaguaaaagucucguugcucauauauaguagacaaagagccagaa

SEQ ID NO: 691302 - RNA, 64 nt, hsa
uucgugguuugucuuacucaguucagucuuuuuuugcucauaaauuuaaaaguuacauaccugg

SEQ ID NO: 691303 - RNA, 64 nt, hsa
gucagaguugaauuugucaggcacgccugaaaugugcucauagccaaaacauuuuacucucucc

SEQ ID NO: 691304 - RNA, 64 nt, hsa
agggggcagcugucugccaggagucuggcucuuuugcucauagcgaccccucccuugguucugg

SEQ ID NO: 691305 - RNA, 64 nt, hsa
agcguugaaaauugaaaguuacugcuuuuccacuugcucauauaguaaagggauccuuucagcu

SEQ ID NO: 691306 - RNA, 64 nt, hsa
cuugccagugccaauugagggcauuaguacuuugugcucauaaauuggccucuguaugcaguac

SEQ ID NO: 691307 - RNA, 64 nt, hsa
aaaaauauugggaccaaaaaaugcacuuguuucuugcucauauauauauagauguauauuuuuu

SEQ ID NO: 691308 - RNA, 64 nt, hsa
ccacuagcaugcugaguaggauaguaaaucaggaugcucauaacuuuguaugucugacccaagu

SEQ ID NO: 691309 - RNA, 64 nt, hsa; identical to SEQ ID NO: 457937

SEQ ID NO: 691310 - RNA, 64 nt, hsa; identical to SEQ ID NO: 457938

SEQ ID NO: 691311 - RNA, 64 nt, hsa; identical to SEQ ID NO: 457939

SEQ ID NO: 691312 - RNA, 64 nt, hsa; identical to SEQ ID NO: 457940

SEQ ID NO: 691313 - RNA, 64 nt, hsa; identical to SEQ ID NO: 457941

SEQ ID NO: 691314 - RNA, 64 nt, hsa; identical to SEQ ID NO: 457942

SEQ ID NO: 691315 - RNA, 64 nt, hsa; identical to SEQ ID NO: 457943

SEQ ID NO: 691316 - RNA, 64 nt, hsa; identical to SEQ ID NO: 457944

SEQ ID NO: 691317 - RNA, 64 nt, hsa; identical to SEQ ID NO: 457945

SEQ ID NO: 691318 - RNA, 64 nt, hsa; identical to SEQ ID NO: 457946

SEQ ID NO: 691319 - RNA, 64 nt, hsa; identical to SEQ ID NO: 457947

SEQ ID NO: 691320 - RNA, 64 nt, hsa; identical to SEQ ID NO: 457948

SEQ ID NO: 691321 - RNA, 64 nt, hsa; identical to SEQ ID NO: 457949

SEQ ID NO: 691322 - RNA, 64 nt, hsa; identical to SEQ ID NO: 457950

SEQ ID NO: 691323 - RNA, 64 nt, hsa; identical to SEQ ID NO: 457951

SEQ ID NO: 691324 - RNA, 64 nt, hsa; identical to SEQ ID NO: 457952

SEQ ID NO: 691325 - RNA, 64 nt, hsa; identical to SEQ ID NO: 457953

SEQ ID NO: 691326 - RNA, 64 nt, hsa; identical to SEQ ID NO: 457954

SEQ ID NO: 691327 - RNA, 64 nt, hsa; identical to SEQ ID NO: 457955

SEQ ID NO: 691328 - RNA, 64 nt, hsa; identical to SEQ ID NO: 457956

SEQ ID NO: 691329 - RNA, 64 nt, hsa; identical to SEQ ID NO: 457957

SEQ ID NO: 691330 - RNA, 64 nt, hsa; identical to SEQ ID NO: 457958

SEQ ID NO: 691331 - RNA, 64 nt, hsa; identical to SEQ ID NO: 457959

SEQ ID NO: 691332 - RNA, 64 nt, hsa; identical to SEQ ID NO: 457960

SEQ ID NO: 691333 - RNA, 64 nt, hsa; identical to SEQ ID NO: 457961

SEQ ID NO: 691334 - RNA, 64 nt, hsa; identical to SEQ ID NO: 457962

SEQ ID NO: 691335 - RNA, 64 nt, hsa; identical to SEQ ID NO: 457963

SEQ ID NO: 691336 - RNA, 64 nt, hsa; identical to SEQ ID NO: 457964

SEQ ID NO: 691337 - RNA, 64 nt, hsa; identical to SEQ ID NO: 457965

SEQ ID NO: 691338 - RNA, 64 nt, hsa; identical to SEQ ID NO: 457966

SEQ ID NO: 691339 - RNA, 64 nt, hsa; identical to SEQ ID NO: 457967

SEQ ID NO: 691340 - RNA, 64 nt, hsa; identical to SEQ ID NO: 457968

SEQ ID NO: 691341 - RNA, 64 nt, hsa; identical to SEQ ID NO: 457969

SEQ ID NO: 691342 - RNA, 64 nt, hsa; identical to SEQ ID NO: 457970

SEQ ID NO: 691343 - RNA, 64 nt, hsa; identical to SEQ ID NO: 457971

SEQ ID NO: 691344 - RNA, 64 nt, hsa; identical to SEQ ID NO: 457972

SEQ ID NO: 691345 - RNA, 64 nt, hsa; identical to SEQ ID NO: 457973

SEQ ID NO: 691346 - RNA, 64 nt, hsa; identical to SEQ ID NO: 457974

SEQ ID NO: 691347 - RNA, 64 nt, hsa; identical to SEQ ID NO: 457975

SEQ ID NO: 691348 - RNA, 64 nt, hsa; identical to SEQ ID NO: 457976

SEQ ID NO: 691349 - RNA, 64 nt, hsa; identical to SEQ ID NO: 457977

SEQ ID NO: 691350 - RNA, 64 nt, hsa; identical to SEQ ID NO: 457978

SEQ ID NO: 691351 - RNA, 64 nt, hsa; identical to SEQ ID NO: 457979

SEQ ID NO: 691352 - RNA, 64 nt, hsa; identical to SEQ ID NO: 457980

SEQ ID NO: 691353 - RNA, 64 nt, hsa; identical to SEQ ID NO: 457981

SEQ ID NO: 691354 - RNA, 64 nt, hsa; identical to SEQ ID NO: 457982

SEQ ID NO: 691355 - RNA, 64 nt, hsa; identical to SEQ ID NO: 457983

SEQ ID NO: 691356 - RNA, 64 nt, hsa; identical to SEQ ID NO: 457984

SEQ ID NO: 691357 - RNA, 64 nt, hsa; identical to SEQ ID NO: 457985

SEQ ID NO: 691358 - RNA, 64 nt, hsa; identical to SEQ ID NO: 457986

SEQ ID NO: 691359 - RNA, 64 nt, hsa; identical to SEQ ID NO: 457987

SEQ ID NO: 691360 - RNA, 64 nt, hsa; identical to SEQ ID NO: 457988

SEQ ID NO: 691361 - RNA, 64 nt, hsa; identical to SEQ ID NO: 457989

SEQ ID NO: 691362 - RNA, 64 nt, hsa; identical to SEQ ID NO: 457990

SEQ ID NO: 691363 - RNA, 64 nt, hsa; identical to SEQ ID NO: 457991

SEQ ID NO: 691364 - RNA, 64 nt, hsa; identical to SEQ ID NO: 457992

SEQ ID NO: 691365 - RNA, 64 nt, hsa; identical to SEQ ID NO: 457993

SEQ ID NO: 691366 - RNA, 64 nt, hsa; identical to SEQ ID NO: 457994

SEQ ID NO: 691367 - RNA, 64 nt, hsa; identical to SEQ ID NO: 457995

SEQ ID NO: 691368 - RNA, 64 nt, hsa; identical to SEQ ID NO: 457996

SEQ ID NO: 691369 - RNA, 64 nt, hsa; identical to SEQ ID NO: 457997

SEQ ID NO: 691370 - RNA, 64 nt, hsa; identical to SEQ ID NO: 457998

SEQ ID NO: 691371 - RNA, 64 nt, hsa; identical to SEQ ID NO: 457999

SEQ ID NO: 691372 - RNA, 64 nt, hsa; identical to SEQ ID NO: 458000

SEQ ID NO: 691373 - RNA, 64 nt, hsa; identical to SEQ ID NO: 458001

SEQ ID NO: 691374 - RNA, 64 nt, hsa; identical to SEQ ID NO: 458002

SEQ ID NO: 691375 - RNA, 64 nt, hsa; identical to SEQ ID NO: 458003

SEQ ID NO: 691376 - RNA, 64 nt, hsa; identical to SEQ ID NO: 458004

SEQ ID NO: 691377 - RNA, 64 nt, hsa; identical to SEQ ID NO: 458005

SEQ ID NO: 691378 - RNA, 64 nt, hsa; identical to SEQ ID NO: 458006

SEQ ID NO: 691379 - RNA, 64 nt, hsa; identical to SEQ ID NO: 458007

SEQ ID NO: 691380 - RNA, 64 nt, hsa; identical to SEQ ID NO: 458008

SEQ ID NO: 691381 - RNA, 64 nt, hsa; identical to SEQ ID NO: 458009

SEQ ID NO: 691382 - RNA, 64 nt, hsa; identical to SEQ ID NO: 458010

SEQ ID NO: 691383 - RNA, 64 nt, hsa; identical to SEQ ID NO: 458011

SEQ ID NO: 691384 - RNA, 64 nt, hsa; identical to SEQ ID NO: 458012

SEQ ID NO: 691385 - RNA, 64 nt, hsa; identical to SEQ ID NO: 458013

SEQ ID NO: 691386 - RNA, 64 nt, hsa; identical to SEQ ID NO: 458014

SEQ ID NO: 691387 - RNA, 64 nt, hsa; identical to SEQ ID NO: 458015

SEQ ID NO: 691388 - RNA, 64 nt, hsa; identical to SEQ ID NO: 458016

SEQ ID NO: 691389 - RNA, 64 nt, hsa; identical to SEQ ID NO: 458017

SEQ ID NO: 691390 - RNA, 64 nt, hsa; identical to SEQ ID NO: 458018

SEQ ID NO: 691391 - RNA, 64 nt, hsa; identical to SEQ ID NO: 458019

SEQ ID NO: 691392 - RNA, 64 nt, hsa; identical to SEQ ID NO: 458020

SEQ ID NO: 691393 - RNA, 64 nt, hsa; identical to SEQ ID NO: 458021

SEQ ID NO: 691394 - RNA, 64 nt, hsa; identical to SEQ ID NO: 458022

SEQ ID NO: 691395 - RNA, 64 nt, hsa; identical to SEQ ID NO: 458023

SEQ ID NO: 691396 - RNA, 64 nt, hsa; identical to SEQ ID NO: 458024

SEQ ID NO: 691397 - RNA, 64 nt, hsa; identical to SEQ ID NO: 458025

SEQ ID NO: 691398 - RNA, 64 nt, hsa; identical to SEQ ID NO: 458026

SEQ ID NO: 691399 - RNA, 64 nt, hsa; identical to SEQ ID NO: 458027

SEQ ID NO: 691400 - RNA, 64 nt, hsa; identical to SEQ ID NO: 458028

SEQ ID NO: 691401 - RNA, 64 nt, hsa; identical to SEQ ID NO: 458029

SEQ ID NO: 691402 - RNA, 64 nt, hsa; identical to SEQ ID NO: 458030

SEQ ID NO: 691403 - RNA, 64 nt, hsa; identical to SEQ ID NO: 458031

SEQ ID NO: 691404 - RNA, 64 nt, hsa; identical to SEQ ID NO: 458032

SEQ ID NO: 691405 - RNA, 64 nt, hsa; identical to SEQ ID NO: 458033

SEQ ID NO: 691406 - RNA, 64 nt, hsa; identical to SEQ ID NO: 458034

SEQ ID NO: 691407 - RNA, 64 nt, hsa; identical to SEQ ID NO: 458035

SEQ ID NO: 691408 - RNA, 64 nt, hsa; identical to SEQ ID NO: 458036

SEQ ID NO: 691409 - RNA, 64 nt, hsa; identical to SEQ ID NO: 458037

SEQ ID NO: 691410 - RNA, 64 nt, hsa; identical to SEQ ID NO: 458038

SEQ ID NO: 691411 - RNA, 64 nt, hsa; identical to SEQ ID NO: 458039

SEQ ID NO: 691412 - RNA, 64 nt, hsa; identical to SEQ ID NO: 458040

SEQ ID NO: 691413 - RNA, 64 nt, hsa; identical to SEQ ID NO: 458041

SEQ ID NO: 691414 - RNA, 64 nt, hsa; identical to SEQ ID NO: 458042

SEQ ID NO: 691415 - RNA, 64 nt, hsa; identical to SEQ ID NO: 458043

SEQ ID NO: 691416 - RNA, 64 nt, hsa; identical to SEQ ID NO: 458044

SEQ ID NO: 691417 - RNA, 64 nt, hsa; identical to SEQ ID NO: 458045

SEQ ID NO: 691418 - RNA, 64 nt, hsa; identical to SEQ ID NO: 458046

SEQ ID NO: 691419 - RNA, 64 nt, hsa; identical to SEQ ID NO: 458047

SEQ ID NO: 691420 - RNA, 64 nt, hsa; identical to SEQ ID NO: 458048

SEQ ID NO: 691421 - RNA, 64 nt, hsa; identical to SEQ ID NO: 458049

SEQ ID NO: 691422 - RNA, 64 nt, hsa; identical to SEQ ID NO: 458050

SEQ ID NO: 691423 - RNA, 64 nt, hsa; identical to SEQ ID NO: 458051

SEQ ID NO: 691424 - RNA, 64 nt, hsa; identical to SEQ ID NO: 458052

SEQ ID NO: 691425 - RNA, 64 nt, hsa; identical to SEQ ID NO: 458053

SEQ ID NO: 691426 - RNA, 64 nt, hsa; identical to SEQ ID NO: 458054

SEQ ID NO: 691427 - RNA, 64 nt, hsa; identical to SEQ ID NO: 458055

SEQ ID NO: 691428 - RNA, 64 nt, hsa; identical to SEQ ID NO: 458056

SEQ ID NO: 691429 - RNA, 64 nt, hsa; identical to SEQ ID NO: 458057

SEQ ID NO: 691430 - RNA, 64 nt, hsa; identical to SEQ ID NO: 458058

SEQ ID NO: 691431 - RNA, 64 nt, hsa; identical to SEQ ID NO: 458059

SEQ ID NO: 691432 - RNA, 64 nt, hsa; identical to SEQ ID NO: 458060

SEQ ID NO: 691433 - RNA, 64 nt, hsa; identical to SEQ ID NO: 458061

SEQ ID NO: 691434 - RNA, 64 nt, hsa; identical to SEQ ID NO: 458062

SEQ ID NO: 691435 - RNA, 64 nt, hsa; identical to SEQ ID NO: 458063

SEQ ID NO: 691436 - RNA, 64 nt, hsa; identical to SEQ ID NO: 458064

SEQ ID NO: 691437 - RNA, 64 nt, hsa; identical to SEQ ID NO: 458065

SEQ ID NO: 691438 - RNA, 64 nt, hsa; identical to SEQ ID NO: 458066

SEQ ID NO: 691439 - RNA, 64 nt, hsa; identical to SEQ ID NO: 458067

SEQ ID NO: 691440 - RNA, 64 nt, hsa; identical to SEQ ID NO: 458068

SEQ ID NO: 691441 - RNA, 64 nt, hsa; identical to SEQ ID NO: 458069

SEQ ID NO: 691442 - RNA, 64 nt, hsa; identical to SEQ ID NO: 458070

SEQ ID NO: 691443 - RNA, 64 nt, hsa; identical to SEQ ID NO: 458071

SEQ ID NO: 691444 - RNA, 64 nt, hsa; identical to SEQ ID NO: 458072

SEQ ID NO: 691445 - RNA, 64 nt, hsa; identical to SEQ ID NO: 458073

SEQ ID NO: 691446 - RNA, 64 nt, hsa; identical to SEQ ID NO: 458074

SEQ ID NO: 691447 - RNA, 64 nt, hsa; identical to SEQ ID NO: 458075

SEQ ID NO: 691448 - RNA, 64 nt, hsa; identical to SEQ ID NO: 458076

SEQ ID NO: 691449 - RNA, 64 nt, hsa; identical to SEQ ID NO: 458077

SEQ ID NO: 691450 - RNA, 64 nt, hsa; identical to SEQ ID NO: 458078

SEQ ID NO: 691451 - RNA, 64 nt, hsa; identical to SEQ ID NO: 458079

SEQ ID NO: 691452 - RNA, 64 nt, hsa; identical to SEQ ID NO: 458080

SEQ ID NO: 691453 - RNA, 64 nt, hsa; identical to SEQ ID NO: 458081

SEQ ID NO: 691454 - RNA, 64 nt, hsa; identical to SEQ ID NO: 458082

SEQ ID NO: 691455 - RNA, 64 nt, hsa; identical to SEQ ID NO: 458083

SEQ ID NO: 691456 - RNA, 64 nt, hsa; identical to SEQ ID NO: 458084

SEQ ID NO: 691457 - RNA, 64 nt, hsa; identical to SEQ ID NO: 458085

SEQ ID NO: 691458 - RNA, 64 nt, hsa; identical to SEQ ID NO: 458086

SEQ ID NO: 691459 - RNA, 64 nt, hsa; identical to SEQ ID NO: 458087

SEQ ID NO: 691460 - RNA, 64 nt, hsa; identical to SEQ ID NO: 458088

SEQ ID NO: 691461 - RNA, 64 nt, hsa; identical to SEQ ID NO: 458089

SEQ ID NO: 691462 - RNA, 64 nt, hsa; identical to SEQ ID NO: 458090

SEQ ID NO: 691463 - RNA, 64 nt, hsa; identical to SEQ ID NO: 458091

SEQ ID NO: 691464 - RNA, 64 nt, hsa; identical to SEQ ID NO: 458092

SEQ ID NO: 691465 - RNA, 64 nt, hsa; identical to SEQ ID NO: 458093

SEQ ID NO: 691466 - RNA, 64 nt, hsa; identical to SEQ ID NO: 458094

SEQ ID NO: 691467 - RNA, 64 nt, hsa; identical to SEQ ID NO: 458095

SEQ ID NO: 691468 - RNA, 64 nt, hsa; identical to SEQ ID NO: 458096

SEQ ID NO: 691469 - RNA, 64 nt, hsa; identical to SEQ ID NO: 458097

SEQ ID NO: 691470 - RNA, 64 nt, hsa; identical to SEQ ID NO: 458098

SEQ ID NO: 691471 - RNA, 64 nt, hsa; identical to SEQ ID NO: 458099

SEQ ID NO: 691472 - RNA, 64 nt, hsa; identical to SEQ ID NO: 458100

SEQ ID NO: 691473 - RNA, 64 nt, hsa; identical to SEQ ID NO: 458101

SEQ ID NO: 691474 - RNA, 64 nt, hsa; identical to SEQ ID NO: 458102

SEQ ID NO: 691475 - RNA, 64 nt, hsa; identical to SEQ ID NO: 458103

SEQ ID NO: 691476 - RNA, 64 nt, hsa; identical to SEQ ID NO: 458104

SEQ ID NO: 691477 - RNA, 64 nt, hsa; identical to SEQ ID NO: 458105

SEQ ID NO: 691478 - RNA, 64 nt, hsa; identical to SEQ ID NO: 458106

SEQ ID NO: 691479 - RNA, 64 nt, hsa; identical to SEQ ID NO: 458107

SEQ ID NO: 691480 - RNA, 64 nt, hsa; identical to SEQ ID NO: 458108

SEQ ID NO: 691481 - RNA, 64 nt, hsa; identical to SEQ ID NO: 458109

SEQ ID NO: 691482 - RNA, 64 nt, hsa; identical to SEQ ID NO: 458110

SEQ ID NO: 691483 - RNA, 64 nt, hsa; identical to SEQ ID NO: 458111

SEQ ID NO: 691484 - RNA, 64 nt, hsa; identical to SEQ ID NO: 458112

SEQ ID NO: 691485 - RNA, 64 nt, hsa; identical to SEQ ID NO: 458113

SEQ ID NO: 691486 - RNA, 64 nt, hsa; identical to SEQ ID NO: 458114

SEQ ID NO: 691487 - RNA, 64 nt, hsa; identical to SEQ ID NO: 458115

SEQ ID NO: 691488 - RNA, 64 nt, hsa; identical to SEQ ID NO: 458116

SEQ ID NO: 691489 - RNA, 64 nt, hsa; identical to SEQ ID NO: 458117

SEQ ID NO: 691490 - RNA, 64 nt, hsa; identical to SEQ ID NO: 458118

SEQ ID NO: 691491 - RNA, 64 nt, hsa; identical to SEQ ID NO: 458119

SEQ ID NO: 691492 - RNA, 64 nt, hsa; identical to SEQ ID NO: 458120

SEQ ID NO: 691493 - RNA, 64 nt, hsa; identical to SEQ ID NO: 458121

SEQ ID NO: 691494 - RNA, 64 nt, hsa; identical to SEQ ID NO: 458122

SEQ ID NO: 691495 - RNA, 64 nt, hsa; identical to SEQ ID NO: 458123

SEQ ID NO: 691496 - RNA, 64 nt, hsa; identical to SEQ ID NO: 458124

SEQ ID NO: 691497 - RNA, 64 nt, hsa; identical to SEQ ID NO: 458125

SEQ ID NO: 691498 - RNA, 64 nt, hsa; identical to SEQ ID NO: 458126

SEQ ID NO: 691499 - RNA, 64 nt, hsa; identical to SEQ ID NO: 458127

SEQ ID NO: 691500 - RNA, 64 nt, hsa; identical to SEQ ID NO: 458128

SEQ ID NO: 691501 - RNA, 64 nt, hsa; identical to SEQ ID NO: 458129

SEQ ID NO: 691502 - RNA, 64 nt, hsa; identical to SEQ ID NO: 458130

SEQ ID NO: 691503 - RNA, 64 nt, hsa; identical to SEQ ID NO: 458131

SEQ ID NO: 691504 - RNA, 64 nt, hsa; identical to SEQ ID NO: 458132

SEQ ID NO: 691505 - RNA, 64 nt, hsa; identical to SEQ ID NO: 458133

SEQ ID NO: 691506 - RNA, 64 nt, hsa; identical to SEQ ID NO: 458134

SEQ ID NO: 691507 - RNA, 64 nt, hsa; identical to SEQ ID NO: 458135

SEQ ID NO: 691508 - RNA, 64 nt, hsa; identical to SEQ ID NO: 458136

SEQ ID NO: 691509 - RNA, 64 nt, hsa; identical to SEQ ID NO: 458137

SEQ ID NO: 691510 - RNA, 64 nt, hsa; identical to SEQ ID NO: 458138

SEQ ID NO: 691511 - RNA, 64 nt, hsa; identical to SEQ ID NO: 458139

SEQ ID NO: 691512 - RNA, 64 nt, hsa; identical to SEQ ID NO: 458140

SEQ ID NO: 691513 - RNA, 64 nt, hsa; identical to SEQ ID NO: 458141

SEQ ID NO: 691514 - RNA, 64 nt, hsa; identical to SEQ ID NO: 458142

SEQ ID NO: 691515 - RNA, 64 nt, hsa; identical to SEQ ID NO: 458143

SEQ ID NO: 691516 - RNA, 64 nt, hsa; identical to SEQ ID NO: 458144

SEQ ID NO: 691517 - RNA, 64 nt, hsa; identical to SEQ ID NO: 458145

SEQ ID NO: 691518 - RNA, 64 nt, hsa; identical to SEQ ID NO: 458146

SEQ ID NO: 691519 - RNA, 64 nt, hsa; identical to SEQ ID NO: 458147

SEQ ID NO: 691520 - RNA, 64 nt, hsa; identical to SEQ ID NO: 458148

SEQ ID NO: 691521 - RNA, 64 nt, hsa; identical to SEQ ID NO: 458149

SEQ ID NO: 691522 - RNA, 64 nt, hsa; identical to SEQ ID NO: 458150

SEQ ID NO: 691523 - RNA, 64 nt, hsa; identical to SEQ ID NO: 458151

SEQ ID NO: 691524 - RNA, 64 nt, hsa; identical to SEQ ID NO: 458152

SEQ ID NO: 691525 - RNA, 64 nt, hsa; identical to SEQ ID NO: 458153

SEQ ID NO: 691526 - RNA, 64 nt, hsa; identical to SEQ ID NO: 458154

SEQ ID NO: 691527 - RNA, 64 nt, hsa; identical to SEQ ID NO: 458155

SEQ ID NO: 691528 - RNA, 64 nt, hsa; identical to SEQ ID NO: 458156

SEQ ID NO: 691529 - RNA, 64 nt, hsa; identical to SEQ ID NO: 458157

SEQ ID NO: 691530 - RNA, 64 nt, hsa; identical to SEQ ID NO: 458158

SEQ ID NO: 691531 - RNA, 64 nt, hsa; identical to SEQ ID NO: 458159

SEQ ID NO: 691532 - RNA, 64 nt, hsa; identical to SEQ ID NO: 458160

SEQ ID NO: 691533 - RNA, 64 nt, hsa; identical to SEQ ID NO: 458161

SEQ ID NO: 691534 - RNA, 64 nt, hsa; identical to SEQ ID NO: 458162

SEQ ID NO: 691535 - RNA, 64 nt, hsa; identical to SEQ ID NO: 458163

SEQ ID NO: 691536 - RNA, 64 nt, hsa; identical to SEQ ID NO: 458164

SEQ ID NO: 691537 - RNA, 64 nt, hsa; identical to SEQ ID NO: 458165

SEQ ID NO: 691538 - RNA, 64 nt, hsa; identical to SEQ ID NO: 458166

SEQ ID NO: 691539 - RNA, 64 nt, hsa; identical to SEQ ID NO: 458167

SEQ ID NO: 691540 - RNA, 64 nt, hsa; identical to SEQ ID NO: 458168

SEQ ID NO: 691541 - RNA, 64 nt, hsa; identical to SEQ ID NO: 458169

SEQ ID NO: 691542 - RNA, 64 nt, hsa; identical to SEQ ID NO: 458170

SEQ ID NO: 691543 - RNA, 64 nt, hsa; identical to SEQ ID NO: 458171

SEQ ID NO: 691544 - RNA, 64 nt, hsa; identical to SEQ ID NO: 458172

SEQ ID NO: 691545 - RNA, 64 nt, hsa; identical to SEQ ID NO: 458173

SEQ ID NO: 691546 - RNA, 64 nt, hsa; identical to SEQ ID NO: 458174

SEQ ID NO: 691547 - RNA, 64 nt, hsa; identical to SEQ ID NO: 458175

SEQ ID NO: 691548 - RNA, 64 nt, hsa; identical to SEQ ID NO: 458176

SEQ ID NO: 691549 - RNA, 64 nt, hsa; identical to SEQ ID NO: 458177

SEQ ID NO: 691550 - RNA, 64 nt, hsa; identical to SEQ ID NO: 458178

SEQ ID NO: 691551 - RNA, 64 nt, hsa; identical to SEQ ID NO: 458179

SEQ ID NO: 691552 - RNA, 64 nt, hsa; identical to SEQ ID NO: 458180

SEQ ID NO: 691553 - RNA, 64 nt, hsa; identical to SEQ ID NO: 458181

SEQ ID NO: 691554 - RNA, 64 nt, hsa; identical to SEQ ID NO: 458182

SEQ ID NO: 691555 - RNA, 64 nt, hsa; identical to SEQ ID NO: 458183

SEQ ID NO: 691556 - RNA, 64 nt, hsa; identical to SEQ ID NO: 458184

SEQ ID NO: 691557 - RNA, 64 nt, hsa; identical to SEQ ID NO: 458185

SEQ ID NO: 691558 - RNA, 64 nt, hsa; identical to SEQ ID NO: 458186

SEQ ID NO: 691559 - RNA, 64 nt, hsa; identical to SEQ ID NO: 458187

SEQ ID NO: 691560 - RNA, 64 nt, hsa; identical to SEQ ID NO: 458188

SEQ ID NO: 691561 - RNA, 64 nt, hsa; identical to SEQ ID NO: 458189

SEQ ID NO: 691562 - RNA, 64 nt, hsa; identical to SEQ ID NO: 458190

SEQ ID NO: 691563 - RNA, 64 nt, hsa; identical to SEQ ID NO: 458191

SEQ ID NO: 691564 - RNA, 64 nt, hsa; identical to SEQ ID NO: 458192

SEQ ID NO: 691565 - RNA, 64 nt, hsa; identical to SEQ ID NO: 458193

SEQ ID NO: 691566 - RNA, 64 nt, hsa; identical to SEQ ID NO: 458194

SEQ ID NO: 691567 - RNA, 64 nt, hsa; identical to SEQ ID NO: 458195

SEQ ID NO: 691568 - RNA, 64 nt, hsa; identical to SEQ ID NO: 458196

SEQ ID NO: 691569 - RNA, 64 nt, hsa; identical to SEQ ID NO: 458197

SEQ ID NO: 691570 - RNA, 64 nt, hsa; identical to SEQ ID NO: 458198

SEQ ID NO: 691571 - RNA, 64 nt, hsa; identical to SEQ ID NO: 458199

SEQ ID NO: 691572 - RNA, 64 nt, hsa; identical to SEQ ID NO: 458200

SEQ ID NO: 691573 - RNA, 64 nt, hsa; identical to SEQ ID NO: 458201

SEQ ID NO: 691574 - RNA, 64 nt, hsa; identical to SEQ ID NO: 458202

SEQ ID NO: 691575 - RNA, 64 nt, hsa; identical to SEQ ID NO: 458203

SEQ ID NO: 691576 - RNA, 64 nt, hsa; identical to SEQ ID NO: 458204

SEQ ID NO: 691577 - RNA, 64 nt, hsa; identical to SEQ ID NO: 458205

SEQ ID NO: 691578 - RNA, 64 nt, hsa; identical to SEQ ID NO: 458206

SEQ ID NO: 691579 - RNA, 64 nt, hsa; identical to SEQ ID NO: 458207

SEQ ID NO: 691580 - RNA, 64 nt, hsa; identical to SEQ ID NO: 458208

SEQ ID NO: 691581 - RNA, 64 nt, hsa; identical to SEQ ID NO: 458209

SEQ ID NO: 691582 - RNA, 64 nt, hsa; identical to SEQ ID NO: 458210

SEQ ID NO: 691583 - RNA, 64 nt, hsa; identical to SEQ ID NO: 458211

SEQ ID NO: 691584 - RNA, 64 nt, hsa; identical to SEQ ID NO: 458212

SEQ ID NO: 691585 - RNA, 64 nt, hsa; identical to SEQ ID NO: 458213

SEQ ID NO: 691586 - RNA, 64 nt, hsa; identical to SEQ ID NO: 458214

SEQ ID NO: 691587 - RNA, 64 nt, hsa; identical to SEQ ID NO: 458215

SEQ ID NO: 691588 - RNA, 64 nt, hsa; identical to SEQ ID NO: 458216

SEQ ID NO: 691589 - RNA, 64 nt, hsa; identical to SEQ ID NO: 458217

SEQ ID NO: 691590 - RNA, 64 nt, hsa; identical to SEQ ID NO: 458218

SEQ ID NO: 691591 - RNA, 64 nt, hsa; identical to SEQ ID NO: 458219

SEQ ID NO: 691592 - RNA, 64 nt, hsa; identical to SEQ ID NO: 458220

SEQ ID NO: 691593 - RNA, 64 nt, hsa; identical to SEQ ID NO: 458221

SEQ ID NO: 691594 - RNA, 64 nt, hsa; identical to SEQ ID NO: 458222

SEQ ID NO: 691595 - RNA, 64 nt, hsa; identical to SEQ ID NO: 458223

SEQ ID NO: 691596 - RNA, 64 nt, hsa; identical to SEQ ID NO: 458224

SEQ ID NO: 691597 - RNA, 64 nt, hsa; identical to SEQ ID NO: 458225

SEQ ID NO: 691598 - RNA, 64 nt, hsa; identical to SEQ ID NO: 458226

SEQ ID NO: 691599 - RNA, 64 nt, hsa; identical to SEQ ID NO: 458227

SEQ ID NO: 691600 - RNA, 64 nt, hsa; identical to SEQ ID NO: 458228

SEQ ID NO: 691601 - RNA, 64 nt, hsa; identical to SEQ ID NO: 458229

SEQ ID NO: 691602 - RNA, 64 nt, hsa; identical to SEQ ID NO: 458230

SEQ ID NO: 691603 - RNA, 64 nt, hsa; identical to SEQ ID NO: 458231

SEQ ID NO: 691604 - RNA, 64 nt, hsa; identical to SEQ ID NO: 458232

SEQ ID NO: 691605 - RNA, 64 nt, hsa; identical to SEQ ID NO: 458233

SEQ ID NO: 691606 - RNA, 64 nt, hsa; identical to SEQ ID NO: 458234

SEQ ID NO: 691607 - RNA, 64 nt, hsa; identical to SEQ ID NO: 458235

SEQ ID NO: 691608 - RNA, 64 nt, hsa; identical to SEQ ID NO: 458236

SEQ ID NO: 691609 - RNA, 64 nt, hsa; identical to SEQ ID NO: 458237

SEQ ID NO: 691610 - RNA, 64 nt, hsa; identical to SEQ ID NO: 458238

SEQ ID NO: 691611 - RNA, 64 nt, hsa; identical to SEQ ID NO: 458239

SEQ ID NO: 691612 - RNA, 64 nt, hsa; identical to SEQ ID NO: 458240

SEQ ID NO: 691613 - RNA, 64 nt, hsa; identical to SEQ ID NO: 458241

SEQ ID NO: 691614 - RNA, 64 nt, hsa; identical to SEQ ID NO: 458242

SEQ ID NO: 691615 - RNA, 64 nt, hsa; identical to SEQ ID NO: 458243

SEQ ID NO: 691616 - RNA, 64 nt, hsa; identical to SEQ ID NO: 458244

SEQ ID NO: 691617 - RNA, 64 nt, hsa; identical to SEQ ID NO: 458245

SEQ ID NO: 691618 - RNA, 64 nt, hsa; identical to SEQ ID NO: 458246

SEQ ID NO: 691619 - RNA, 64 nt, hsa; identical to SEQ ID NO: 458247

SEQ ID NO: 691620 - RNA, 64 nt, hsa; identical to SEQ ID NO: 458248

SEQ ID NO: 691621 - RNA, 64 nt, hsa; identical to SEQ ID NO: 458249

SEQ ID NO: 691622 - RNA, 64 nt, hsa; identical to SEQ ID NO: 458250

SEQ ID NO: 691623 - RNA, 64 nt, hsa; identical to SEQ ID NO: 458251

SEQ ID NO: 691624 - RNA, 64 nt, hsa; identical to SEQ ID NO: 458252

SEQ ID NO: 691625 - RNA, 64 nt, hsa; identical to SEQ ID NO: 458253

SEQ ID NO: 691626 - RNA, 64 nt, hsa; identical to SEQ ID NO: 458254

SEQ ID NO: 691627 - RNA, 64 nt, hsa; identical to SEQ ID NO: 458255

SEQ ID NO: 691628 - RNA, 64 nt, hsa; identical to SEQ ID NO: 458256

SEQ ID NO: 691629 - RNA, 64 nt, hsa; identical to SEQ ID NO: 458257

SEQ ID NO: 691630 - RNA, 64 nt, hsa; identical to SEQ ID NO: 458258

SEQ ID NO: 691631 - RNA, 64 nt, hsa; identical to SEQ ID NO: 458259

SEQ ID NO: 691632 - RNA, 64 nt, hsa; identical to SEQ ID NO: 458260

SEQ ID NO: 691633 - RNA, 64 nt, hsa; identical to SEQ ID NO: 458261

SEQ ID NO: 691634 - RNA, 64 nt, hsa; identical to SEQ ID NO: 458262

SEQ ID NO: 691635 - RNA, 64 nt, hsa; identical to SEQ ID NO: 458263

SEQ ID NO: 691636 - RNA, 64 nt, hsa; identical to SEQ ID NO: 458264

SEQ ID NO: 691637 - RNA, 64 nt, hsa; identical to SEQ ID NO: 458265

SEQ ID NO: 691638 - RNA, 64 nt, hsa; identical to SEQ ID NO: 458266

SEQ ID NO: 691639 - RNA, 64 nt, hsa; identical to SEQ ID NO: 458267

SEQ ID NO: 691640 - RNA, 64 nt, hsa; identical to SEQ ID NO: 458268

SEQ ID NO: 691641 - RNA, 64 nt, hsa; identical to SEQ ID NO: 458269

SEQ ID NO: 691642 - RNA, 64 nt, hsa; identical to SEQ ID NO: 458270

SEQ ID NO: 691643 - RNA, 64 nt, hsa; identical to SEQ ID NO: 458271

SEQ ID NO: 691644 - RNA, 64 nt, hsa; identical to SEQ ID NO: 458272

SEQ ID NO: 691645 - RNA, 64 nt, hsa; identical to SEQ ID NO: 458273

SEQ ID NO: 691646 - RNA, 64 nt, hsa; identical to SEQ ID NO: 458274

SEQ ID NO: 691647 - RNA, 64 nt, hsa; identical to SEQ ID NO: 458275

SEQ ID NO: 691648 - RNA, 64 nt, hsa; identical to SEQ ID NO: 458276

SEQ ID NO: 691649 - RNA, 64 nt, hsa; identical to SEQ ID NO: 458277

SEQ ID NO: 691650 - RNA, 64 nt, hsa; identical to SEQ ID NO: 458278

SEQ ID NO: 691651 - RNA, 64 nt, hsa; identical to SEQ ID NO: 458279

SEQ ID NO: 691652 - RNA, 64 nt, hsa; identical to SEQ ID NO: 458280

SEQ ID NO: 691653 - RNA, 64 nt, hsa; identical to SEQ ID NO: 458281

SEQ ID NO: 691654 - RNA, 64 nt, hsa; identical to SEQ ID NO: 458282

SEQ ID NO: 691655 - RNA, 64 nt, hsa; identical to SEQ ID NO: 458283

SEQ ID NO: 691656 - RNA, 64 nt, hsa; identical to SEQ ID NO: 458284

SEQ ID NO: 691657 - RNA, 64 nt, hsa; identical to SEQ ID NO: 458285

SEQ ID NO: 691658 - RNA, 64 nt, hsa; identical to SEQ ID NO: 458286

SEQ ID NO: 691659 - RNA, 64 nt, hsa; identical to SEQ ID NO: 458287

SEQ ID NO: 691660 - RNA, 64 nt, hsa; identical to SEQ ID NO: 458288

SEQ ID NO: 691661 - RNA, 64 nt, hsa; identical to SEQ ID NO: 458289

SEQ ID NO: 691662 - RNA, 64 nt, hsa; identical to SEQ ID NO: 458290

SEQ ID NO: 691663 - RNA, 64 nt, hsa; identical to SEQ ID NO: 458291

SEQ ID NO: 691664 - RNA, 64 nt, hsa; identical to SEQ ID NO: 458292

SEQ ID NO: 691665 - RNA, 64 nt, hsa; identical to SEQ ID NO: 458293

SEQ ID NO: 691666 - RNA, 64 nt, hsa; identical to SEQ ID NO: 458294

SEQ ID NO: 691667 - RNA, 64 nt, hsa; identical to SEQ ID NO: 458295

SEQ ID NO: 691668 - RNA, 64 nt, hsa; identical to SEQ ID NO: 458296

SEQ ID NO: 691669 - RNA, 64 nt, hsa; identical to SEQ ID NO: 458297

SEQ ID NO: 691670 - RNA, 64 nt, hsa; identical to SEQ ID NO: 458298

SEQ ID NO: 691671 - RNA, 64 nt, hsa; identical to SEQ ID NO: 458299

SEQ ID NO: 691672 - RNA, 64 nt, hsa; identical to SEQ ID NO: 458300

SEQ ID NO: 691673 - RNA, 64 nt, hsa; identical to SEQ ID NO: 458301

SEQ ID NO: 691674 - RNA, 64 nt, hsa; identical to SEQ ID NO: 458302

SEQ ID NO: 691675 - RNA, 64 nt, hsa; identical to SEQ ID NO: 458303

SEQ ID NO: 691676 - RNA, 64 nt, hsa; identical to SEQ ID NO: 458304

SEQ ID NO: 691677 - RNA, 64 nt, hsa; identical to SEQ ID NO: 458305

SEQ ID NO: 691678 - RNA, 64 nt, hsa; identical to SEQ ID NO: 458306

SEQ ID NO: 691679 - RNA, 64 nt, hsa; identical to SEQ ID NO: 458307

SEQ ID NO: 691680 - RNA, 64 nt, hsa; identical to SEQ ID NO: 458308

SEQ ID NO: 691681 - RNA, 64 nt, hsa; identical to SEQ ID NO: 458309

SEQ ID NO: 691682 - RNA, 64 nt, hsa; identical to SEQ ID NO: 458310

SEQ ID NO: 691683 - RNA, 64 nt, hsa; identical to SEQ ID NO: 458311

SEQ ID NO: 691684 - RNA, 64 nt, hsa; identical to SEQ ID NO: 458312

SEQ ID NO: 691685 - RNA, 64 nt, hsa; identical to SEQ ID NO: 458313

SEQ ID NO: 691686 - RNA, 64 nt, hsa; identical to SEQ ID NO: 458314

SEQ ID NO: 691687 - RNA, 64 nt, hsa; identical to SEQ ID NO: 458315

SEQ ID NO: 691688 - RNA, 64 nt, hsa; identical to SEQ ID NO: 458316

SEQ ID NO: 691689 - RNA, 64 nt, hsa; identical to SEQ ID NO: 458317

SEQ ID NO: 691690 - RNA, 64 nt, hsa; identical to SEQ ID NO: 458318

SEQ ID NO: 691691 - RNA, 64 nt, hsa; identical to SEQ ID NO: 458319

SEQ ID NO: 691692 - RNA, 64 nt, hsa; identical to SEQ ID NO: 458320

SEQ ID NO: 691693 - RNA, 64 nt, hsa; identical to SEQ ID NO: 458321

SEQ ID NO: 691694 - RNA, 64 nt, hsa; identical to SEQ ID NO: 458322

SEQ ID NO: 691695 - RNA, 64 nt, hsa; identical to SEQ ID NO: 458323

SEQ ID NO: 691696 - RNA, 64 nt, hsa; identical to SEQ ID NO: 458324

SEQ ID NO: 691697 - RNA, 64 nt, hsa; identical to SEQ ID NO: 458325

SEQ ID NO: 691698 - RNA, 64 nt, hsa; identical to SEQ ID NO: 458326

SEQ ID NO: 691699 - RNA, 64 nt, hsa; identical to SEQ ID NO: 458327

SEQ ID NO: 691700 - RNA, 64 nt, hsa; identical to SEQ ID NO: 458328

SEQ ID NO: 691701 - RNA, 64 nt, hsa; identical to SEQ ID NO: 458329

SEQ ID NO: 691702 - RNA, 64 nt, hsa; identical to SEQ ID NO: 458330

SEQ ID NO: 691703 - RNA, 64 nt, hsa; identical to SEQ ID NO: 458331

SEQ ID NO: 691704 - RNA, 64 nt, hsa; identical to SEQ ID NO: 458332

SEQ ID NO: 691705 - RNA, 64 nt, hsa; identical to SEQ ID NO: 458333

SEQ ID NO: 691706 - RNA, 64 nt, hsa; identical to SEQ ID NO: 458334

SEQ ID NO: 691707 - RNA, 64 nt, hsa; identical to SEQ ID NO: 458335

SEQ ID NO: 691708 - RNA, 64 nt, hsa; identical to SEQ ID NO: 458336

SEQ ID NO: 691709 - RNA, 64 nt, hsa; identical to SEQ ID NO: 458337

SEQ ID NO: 691710 - RNA, 64 nt, hsa; identical to SEQ ID NO: 458338

SEQ ID NO: 691711 - RNA, 64 nt, hsa; identical to SEQ ID NO: 458339

SEQ ID NO: 691712 - RNA, 64 nt, hsa; identical to SEQ ID NO: 458340

SEQ ID NO: 691713 - RNA, 64 nt, hsa; identical to SEQ ID NO: 458341

SEQ ID NO: 691714 - RNA, 64 nt, hsa; identical to SEQ ID NO: 458342

SEQ ID NO: 691715 - RNA, 64 nt, hsa; identical to SEQ ID NO: 458343

SEQ ID NO: 691716 - RNA, 64 nt, hsa; identical to SEQ ID NO: 458344

SEQ ID NO: 691717 - RNA, 64 nt, hsa; identical to SEQ ID NO: 458345

SEQ ID NO: 691718 - RNA, 64 nt, hsa; identical to SEQ ID NO: 458346

SEQ ID NO: 691719 - RNA, 64 nt, hsa; identical to SEQ ID NO: 458347

SEQ ID NO: 691720 - RNA, 64 nt, hsa; identical to SEQ ID NO: 458348

SEQ ID NO: 691721 - RNA, 64 nt, hsa; identical to SEQ ID NO: 458349

SEQ ID NO: 691722 - RNA, 64 nt, hsa; identical to SEQ ID NO: 458350

SEQ ID NO: 691723 - RNA, 64 nt, hsa; identical to SEQ ID NO: 458351

SEQ ID NO: 691724 - RNA, 64 nt, hsa; identical to SEQ ID NO: 458352

SEQ ID NO: 691725 - RNA, 64 nt, hsa; identical to SEQ ID NO: 458353

SEQ ID NO: 691726 - RNA, 64 nt, hsa; identical to SEQ ID NO: 458354

SEQ ID NO: 691727 - RNA, 64 nt, hsa; identical to SEQ ID NO: 458355

SEQ ID NO: 691728 - RNA, 64 nt, hsa; identical to SEQ ID NO: 458356

SEQ ID NO: 691729 - RNA, 64 nt, hsa; identical to SEQ ID NO: 458357

SEQ ID NO: 691730 - RNA, 64 nt, hsa; identical to SEQ ID NO: 458358

SEQ ID NO: 691731 - RNA, 64 nt, hsa; identical to SEQ ID NO: 458359

SEQ ID NO: 691732 - RNA, 64 nt, hsa; identical to SEQ ID NO: 458360

SEQ ID NO: 691733 - RNA, 64 nt, hsa; identical to SEQ ID NO: 458361

SEQ ID NO: 691734 - RNA, 64 nt, hsa; identical to SEQ ID NO: 458362

SEQ ID NO: 691735 - RNA, 64 nt, hsa; identical to SEQ ID NO: 458363

SEQ ID NO: 691736 - RNA, 64 nt, hsa; identical to SEQ ID NO: 458364

SEQ ID NO: 691737 - RNA, 64 nt, hsa; identical to SEQ ID NO: 458365

SEQ ID NO: 691738 - RNA, 64 nt, hsa; identical to SEQ ID NO: 458366

SEQ ID NO: 691739 - RNA, 64 nt, hsa; identical to SEQ ID NO: 458367

SEQ ID NO: 691740 - RNA, 64 nt, hsa; identical to SEQ ID NO: 458368

SEQ ID NO: 691741 - RNA, 64 nt, hsa; identical to SEQ ID NO: 458369

SEQ ID NO: 691742 - RNA, 64 nt, hsa; identical to SEQ ID NO: 458370

SEQ ID NO: 691743 - RNA, 64 nt, hsa; identical to SEQ ID NO: 458371

SEQ ID NO: 691744 - RNA, 64 nt, hsa; identical to SEQ ID NO: 458372

SEQ ID NO: 691745 - RNA, 64 nt, hsa; identical to SEQ ID NO: 458373

SEQ ID NO: 691746 - RNA, 64 nt, hsa; identical to SEQ ID NO: 458374

SEQ ID NO: 691747 - RNA, 64 nt, hsa; identical to SEQ ID NO: 458375

SEQ ID NO: 691748 - RNA, 64 nt, hsa; identical to SEQ ID NO: 458376

SEQ ID NO: 691749 - RNA, 64 nt, hsa; identical to SEQ ID NO: 458377

SEQ ID NO: 691750 - RNA, 64 nt, hsa; identical to SEQ ID NO: 458378

SEQ ID NO: 691751 - RNA, 64 nt, hsa; identical to SEQ ID NO: 458379

SEQ ID NO: 691752 - RNA, 64 nt, hsa; identical to SEQ ID NO: 458380

SEQ ID NO: 691753 - RNA, 64 nt, hsa; identical to SEQ ID NO: 458381

SEQ ID NO: 691754 - RNA, 64 nt, hsa; identical to SEQ ID NO: 458382

SEQ ID NO: 691755 - RNA, 64 nt, hsa; identical to SEQ ID NO: 458383

SEQ ID NO: 691756 - RNA, 64 nt, hsa; identical to SEQ ID NO: 458384

SEQ ID NO: 691757 - RNA, 64 nt, hsa; identical to SEQ ID NO: 458385

SEQ ID NO: 691758 - RNA, 64 nt, hsa; identical to SEQ ID NO: 458386

SEQ ID NO: 691759 - RNA, 64 nt, hsa; identical to SEQ ID NO: 458387

SEQ ID NO: 691760 - RNA, 64 nt, hsa; identical to SEQ ID NO: 458388

SEQ ID NO: 691761 - RNA, 64 nt, hsa; identical to SEQ ID NO: 458389

SEQ ID NO: 691762 - RNA, 64 nt, hsa; identical to SEQ ID NO: 458390

SEQ ID NO: 691763 - RNA, 64 nt, hsa; identical to SEQ ID NO: 458391

SEQ ID NO: 691764 - RNA, 64 nt, hsa; identical to SEQ ID NO: 458392

SEQ ID NO: 691765 - RNA, 64 nt, hsa; identical to SEQ ID NO: 458393

SEQ ID NO: 691766 - RNA, 64 nt, hsa; identical to SEQ ID NO: 458394

SEQ ID NO: 691767 - RNA, 64 nt, hsa; identical to SEQ ID NO: 458395

SEQ ID NO: 691768 - RNA, 64 nt, hsa; identical to SEQ ID NO: 458396

SEQ ID NO: 691769 - RNA, 64 nt, hsa; identical to SEQ ID NO: 458397

SEQ ID NO: 691770 - RNA, 64 nt, hsa; identical to SEQ ID NO: 458398

SEQ ID NO: 691771 - RNA, 64 nt, hsa; identical to SEQ ID NO: 458399

SEQ ID NO: 691772 - RNA, 64 nt, hsa; identical to SEQ ID NO: 458400

SEQ ID NO: 691773 - RNA, 64 nt, hsa; identical to SEQ ID NO: 458401

SEQ ID NO: 691774 - RNA, 64 nt, hsa; identical to SEQ ID NO: 458402

SEQ ID NO: 691775 - RNA, 64 nt, hsa; identical to SEQ ID NO: 458403

SEQ ID NO: 691776 - RNA, 64 nt, hsa; identical to SEQ ID NO: 458404

SEQ ID NO: 691777 - RNA, 64 nt, hsa; identical to SEQ ID NO: 458405

SEQ ID NO: 691778 - RNA, 64 nt, hsa; identical to SEQ ID NO: 458406

SEQ ID NO: 691779 - RNA, 64 nt, hsa; identical to SEQ ID NO: 458407

SEQ ID NO: 691780 - RNA, 64 nt, hsa; identical to SEQ ID NO: 458408

SEQ ID NO: 691781 - RNA, 64 nt, hsa; identical to SEQ ID NO: 458409

SEQ ID NO: 691782 - RNA, 64 nt, hsa; identical to SEQ ID NO: 458410

SEQ ID NO: 691783 - RNA, 64 nt, hsa; identical to SEQ ID NO: 458411

SEQ ID NO: 691784 - RNA, 64 nt, hsa; identical to SEQ ID NO: 458412

SEQ ID NO: 691785 - RNA, 64 nt, hsa; identical to SEQ ID NO: 458413

SEQ ID NO: 691786 - RNA, 64 nt, hsa; identical to SEQ ID NO: 458414

SEQ ID NO: 691787 - RNA, 64 nt, hsa; identical to SEQ ID NO: 458415

SEQ ID NO: 691788 - RNA, 64 nt, hsa; identical to SEQ ID NO: 458416

SEQ ID NO: 691789 - RNA, 64 nt, hsa; identical to SEQ ID NO: 458417

SEQ ID NO: 691790 - RNA, 64 nt, hsa; identical to SEQ ID NO: 458418

SEQ ID NO: 691791 - RNA, 64 nt, hsa; identical to SEQ ID NO: 458419

SEQ ID NO: 691792 - RNA, 64 nt, hsa; identical to SEQ ID NO: 458420

SEQ ID NO: 691793 - RNA, 64 nt, hsa; identical to SEQ ID NO: 458421

SEQ ID NO: 691794 - RNA, 64 nt, hsa; identical to SEQ ID NO: 458422

SEQ ID NO: 691795 - RNA, 64 nt, hsa; identical to SEQ ID NO: 458423

SEQ ID NO: 691796 - RNA, 64 nt, hsa; identical to SEQ ID NO: 458424

SEQ ID NO: 691797 - RNA, 64 nt, hsa; identical to SEQ ID NO: 458425

SEQ ID NO: 691798 - RNA, 64 nt, hsa; identical to SEQ ID NO: 458426

SEQ ID NO: 691799 - RNA, 64 nt, hsa; identical to SEQ ID NO: 458427

SEQ ID NO: 691800 - RNA, 64 nt, hsa; identical to SEQ ID NO: 458428

SEQ ID NO: 691801 - RNA, 64 nt, hsa; identical to SEQ ID NO: 458429

SEQ ID NO: 691802 - RNA, 64 nt, hsa; identical to SEQ ID NO: 458430

SEQ ID NO: 691803 - RNA, 64 nt, hsa; identical to SEQ ID NO: 458431

SEQ ID NO: 691804 - RNA, 64 nt, hsa; identical to SEQ ID NO: 458432

SEQ ID NO: 691805 - RNA, 64 nt, hsa; identical to SEQ ID NO: 458433

SEQ ID NO: 691806 - RNA, 64 nt, hsa; identical to SEQ ID NO: 458434

SEQ ID NO: 691807 - RNA, 64 nt, hsa; identical to SEQ ID NO: 458435

SEQ ID NO: 691808 - RNA, 64 nt, hsa; identical to SEQ ID NO: 458436

SEQ ID NO: 691809 - RNA, 64 nt, hsa; identical to SEQ ID NO: 458437

SEQ ID NO: 691810 - RNA, 64 nt, hsa; identical to SEQ ID NO: 458438

SEQ ID NO: 691811 - RNA, 64 nt, hsa; identical to SEQ ID NO: 458439

SEQ ID NO: 691812 - RNA, 64 nt, hsa; identical to SEQ ID NO: 458440

SEQ ID NO: 691813 - RNA, 64 nt, hsa; identical to SEQ ID NO: 458441

SEQ ID NO: 691814 - RNA, 64 nt, hsa; identical to SEQ ID NO: 458442

SEQ ID NO: 691815 - RNA, 64 nt, hsa; identical to SEQ ID NO: 458443

SEQ ID NO: 691816 - RNA, 64 nt, hsa; identical to SEQ ID NO: 458444

SEQ ID NO: 691817 - RNA, 64 nt, hsa; identical to SEQ ID NO: 458445

SEQ ID NO: 691818 - RNA, 64 nt, hsa; identical to SEQ ID NO: 458446

SEQ ID NO: 691819 - RNA, 64 nt, hsa; identical to SEQ ID NO: 458447

SEQ ID NO: 691820 - RNA, 64 nt, hsa; identical to SEQ ID NO: 458448

SEQ ID NO: 691821 - RNA, 64 nt, hsa; identical to SEQ ID NO: 458449

SEQ ID NO: 691822 - RNA, 64 nt, hsa; identical to SEQ ID NO: 458450

SEQ ID NO: 691823 - RNA, 64 nt, hsa; identical to SEQ ID NO: 458451

SEQ ID NO: 691824 - RNA, 64 nt, hsa; identical to SEQ ID NO: 458452

SEQ ID NO: 691825 - RNA, 64 nt, hsa; identical to SEQ ID NO: 458453

SEQ ID NO: 691826 - RNA, 64 nt, hsa; identical to SEQ ID NO: 458454

SEQ ID NO: 691827 - RNA, 64 nt, hsa; identical to SEQ ID NO: 458455

SEQ ID NO: 691828 - RNA, 64 nt, hsa; identical to SEQ ID NO: 458456

SEQ ID NO: 691829 - RNA, 64 nt, hsa; identical to SEQ ID NO: 458457

SEQ ID NO: 691830 - RNA, 64 nt, hsa; identical to SEQ ID NO: 458458

SEQ ID NO: 691831 - RNA, 64 nt, hsa; identical to SEQ ID NO: 458459

SEQ ID NO: 691832 - RNA, 64 nt, hsa; identical to SEQ ID NO: 458460

SEQ ID NO: 691833 - RNA, 64 nt, hsa; identical to SEQ ID NO: 458461

SEQ ID NO: 691834 - RNA, 64 nt, hsa; identical to SEQ ID NO: 458462

SEQ ID NO: 691835 - RNA, 64 nt, hsa; identical to SEQ ID NO: 458463

SEQ ID NO: 691836 - RNA, 64 nt, hsa; identical to SEQ ID NO: 458464

SEQ ID NO: 691837 - RNA, 64 nt, hsa; identical to SEQ ID NO: 458465

SEQ ID NO: 691838 - RNA, 64 nt, hsa; identical to SEQ ID NO: 458466

SEQ ID NO: 691839 - RNA, 64 nt, hsa; identical to SEQ ID NO: 458467

SEQ ID NO: 691840 - RNA, 64 nt, hsa; identical to SEQ ID NO: 458468

SEQ ID NO: 691841 - RNA, 64 nt, hsa; identical to SEQ ID NO: 458469

SEQ ID NO: 691842 - RNA, 64 nt, hsa; identical to SEQ ID NO: 458470

SEQ ID NO: 691843 - RNA, 64 nt, hsa; identical to SEQ ID NO: 458471

SEQ ID NO: 691844 - RNA, 64 nt, hsa; identical to SEQ ID NO: 458472

SEQ ID NO: 691845 - RNA, 64 nt, hsa; identical to SEQ ID NO: 458473

SEQ ID NO: 691846 - RNA, 64 nt, hsa; identical to SEQ ID NO: 458474

SEQ ID NO: 691847 - RNA, 64 nt, hsa; identical to SEQ ID NO: 458475

SEQ ID NO: 691848 - RNA, 64 nt, hsa; identical to SEQ ID NO: 458476

SEQ ID NO: 691849 - RNA, 64 nt, hsa; identical to SEQ ID NO: 458477

SEQ ID NO: 691850 - RNA, 64 nt, hsa; identical to SEQ ID NO: 458478

SEQ ID NO: 691851 - RNA, 64 nt, hsa; identical to SEQ ID NO: 458479

SEQ ID NO: 691852 - RNA, 64 nt, hsa; identical to SEQ ID NO: 458480

SEQ ID NO: 691853 - RNA, 64 nt, hsa; identical to SEQ ID NO: 458481

SEQ ID NO: 691854 - RNA, 64 nt, hsa; identical to SEQ ID NO: 458482

SEQ ID NO: 691855 - RNA, 64 nt, hsa; identical to SEQ ID NO: 458483

SEQ ID NO: 691856 - RNA, 64 nt, hsa; identical to SEQ ID NO: 458484

SEQ ID NO: 691857 - RNA, 64 nt, hsa; identical to SEQ ID NO: 458485

SEQ ID NO: 691858 - RNA, 64 nt, hsa; identical to SEQ ID NO: 458486

SEQ ID NO: 691859 - RNA, 64 nt, hsa; identical to SEQ ID NO: 458487

SEQ ID NO: 691860 - RNA, 64 nt, hsa; identical to SEQ ID NO: 458488

SEQ ID NO: 691861 - RNA, 64 nt, hsa; identical to SEQ ID NO: 458489

SEQ ID NO: 691862 - RNA, 64 nt, hsa; identical to SEQ ID NO: 458490

SEQ ID NO: 691863 - RNA, 64 nt, hsa; identical to SEQ ID NO: 458491

SEQ ID NO: 691864 - RNA, 64 nt, hsa; identical to SEQ ID NO: 458492

SEQ ID NO: 691865 - RNA, 64 nt, hsa; identical to SEQ ID NO: 458493

SEQ ID NO: 691866 - RNA, 64 nt, hsa; identical to SEQ ID NO: 458494

SEQ ID NO: 691867 - RNA, 64 nt, hsa; identical to SEQ ID NO: 458495

SEQ ID NO: 691868 - RNA, 64 nt, hsa; identical to SEQ ID NO: 458496

SEQ ID NO: 691869 - RNA, 64 nt, hsa; identical to SEQ ID NO: 458497

SEQ ID NO: 691870 - RNA, 64 nt, hsa; identical to SEQ ID NO: 458498

SEQ ID NO: 691871 - RNA, 64 nt, hsa; identical to SEQ ID NO: 458499

SEQ ID NO: 691872 - RNA, 64 nt, hsa; identical to SEQ ID NO: 458500

SEQ ID NO: 691873 - RNA, 64 nt, hsa; identical to SEQ ID NO: 458501

SEQ ID NO: 691874 - RNA, 64 nt, hsa; identical to SEQ ID NO: 458502

SEQ ID NO: 691875 - RNA, 64 nt, hsa; identical to SEQ ID NO: 458503

SEQ ID NO: 691876 - RNA, 64 nt, hsa; identical to SEQ ID NO: 458504

SEQ ID NO: 691877 - RNA, 64 nt, hsa; identical to SEQ ID NO: 458505

SEQ ID NO: 691878 - RNA, 64 nt, hsa; identical to SEQ ID NO: 458506

SEQ ID NO: 691879 - RNA, 64 nt, hsa; identical to SEQ ID NO: 458507

SEQ ID NO: 691880 - RNA, 64 nt, hsa; identical to SEQ ID NO: 458508

SEQ ID NO: 691881 - RNA, 64 nt, hsa; identical to SEQ ID NO: 458509

SEQ ID NO: 691882 - RNA, 64 nt, hsa; identical to SEQ ID NO: 458510

SEQ ID NO: 691883 - RNA, 64 nt, hsa; identical to SEQ ID NO: 458511

SEQ ID NO: 691884 - RNA, 64 nt, hsa; identical to SEQ ID NO: 458512

SEQ ID NO: 691885 - RNA, 64 nt, hsa; identical to SEQ ID NO: 458513

SEQ ID NO: 691886 - RNA, 64 nt, hsa; identical to SEQ ID NO: 458514

SEQ ID NO: 691887 - RNA, 64 nt, hsa; identical to SEQ ID NO: 458515

SEQ ID NO: 691888 - RNA, 64 nt, hsa; identical to SEQ ID NO: 458516

SEQ ID NO: 691889 - RNA, 64 nt, hsa; identical to SEQ ID NO: 458517

SEQ ID NO: 691890 - RNA, 64 nt, hsa; identical to SEQ ID NO: 458518

SEQ ID NO: 691891 - RNA, 64 nt, hsa; identical to SEQ ID NO: 458519

SEQ ID NO: 691892 - RNA, 64 nt, hsa; identical to SEQ ID NO: 458520

SEQ ID NO: 691893 - RNA, 64 nt, hsa; identical to SEQ ID NO: 458521

SEQ ID NO: 691894 - RNA, 64 nt, hsa; identical to SEQ ID NO: 458522

SEQ ID NO: 691895 - RNA, 64 nt, hsa; identical to SEQ ID NO: 458523

SEQ ID NO: 691896 - RNA, 64 nt, hsa; identical to SEQ ID NO: 458524

SEQ ID NO: 691897 - RNA, 64 nt, hsa; identical to SEQ ID NO: 458525

SEQ ID NO: 691898 - RNA, 64 nt, hsa; identical to SEQ ID NO: 458526

SEQ ID NO: 691899 - RNA, 64 nt, hsa; identical to SEQ ID NO: 458527

SEQ ID NO: 691900 - RNA, 64 nt, hsa; identical to SEQ ID NO: 458528

SEQ ID NO: 691901 - RNA, 64 nt, hsa; identical to SEQ ID NO: 458529

SEQ ID NO: 691902 - RNA, 64 nt, hsa; identical to SEQ ID NO: 458530

SEQ ID NO: 691903 - RNA, 64 nt, hsa; identical to SEQ ID NO: 458531

SEQ ID NO: 691904 - RNA, 64 nt, hsa; identical to SEQ ID NO: 458532

SEQ ID NO: 691905 - RNA, 64 nt, hsa; identical to SEQ ID NO: 458533

SEQ ID NO: 691906 - RNA, 64 nt, hsa; identical to SEQ ID NO: 458534

SEQ ID NO: 691907 - RNA, 64 nt, hsa; identical to SEQ ID NO: 458512

SEQ ID NO: 691908 - RNA, 64 nt, hsa; identical to SEQ ID NO: 458536

SEQ ID NO: 691909 - RNA, 64 nt, hsa; identical to SEQ ID NO: 458537

SEQ ID NO: 691910 - RNA, 64 nt, hsa; identical to SEQ ID NO: 458538

SEQ ID NO: 691911 - RNA, 64 nt, hsa; identical to SEQ ID NO: 458539

SEQ ID NO: 691912 - RNA, 64 nt, hsa
aaaaaucucaaguaaaaugaaaagcaaauaugggcuacugaauuaagaaacuggcauucuagua

SEQ ID NO: 691913 - RNA, 64 nt, hsa
agaccauccuggccaacauggugaaaccccaucucuacugaauacacaaaaauuggcuggacau

SEQ ID NO: 691914 - RNA, 64 nt, hsa
aaacacuuuuuaaaaaauuguuugcuugaaaauacuacugaauauaaauaagaaugugcacagu

SEQ ID NO: 691915 - RNA, 64 nt, hsa
gaacucuucaaaaugggcucuucuaaugaggucacuacugaacaaaauuguucccucuucuguu

SEQ ID NO: 691916 - RNA, 64 nt, hsa
cacguuagcuacugaauccugggggcgagugaaacuacugaaaauccgagugaugauguuguga

SEQ ID NO: 691917 - RNA, 64 nt, hsa
ucuaggcaaaaggacauggaaacugucacguuagcuacugaauccugggggcgagugaaacuac

SEQ ID NO: 691918 - RNA, 64 nt, hsa
accacagugagaaccacugauuuuuuccacugaccuacugaauaucuagcauccuuagauuggc

SEQ ID NO: 691919 - RNA, 64 nt, hsa
caagugagccaagaaccuaggagcagggccauuccuacugaaggacgggcccccuacggagaug

SEQ ID NO: 691920 - RNA, 64 nt, hsa
aauagacauaaauuguaauuugggaacauaaaaacuacugaauaaaucauguggccuaauauug

SEQ ID NO: 691921 - RNA, 64 nt, hsa
gauugauuuaccuuuggaauugugcuccaaaugucuacugaagcuuaaccgaagaacuaauaaa

SEQ ID NO: 691922 - RNA, 64 nt, hsa
gauauaacuuccguaaguuacauccuuauggaagcuacugaauaaaagaaggggguaugcaccc

SEQ ID NO: 691923 - RNA, 64 nt, hsa
ggaguuuuugaauuccaaaccuuauacugaauaacuacugaaucccuuuacuguuaaauuuuuu

SEQ ID NO: 691924 - RNA, 64 nt, hsa
agaccagccuagccaacaugacgaaaccccaucucuacugaaaauagaaaaaaaaaauuagcca

SEQ ID NO: 691925 - RNA, 64 nt, hsa
aacaaugauuguauggguacucaaaguauaauuucuacugaaugcauaucacuugugcacuguu

SEQ ID NO: 691926 - RNA, 64 nt, hsa
uaauuuuauacuguccaccuaucuauauauucuucuacugaaaugauuuugauaucuuuggcuu

SEQ ID NO: 691927 - RNA, 64 nt, hsa
cuguuuugcaaaguuuguauaagaacacauaacacuacugaauuauaaaaauucaaucauaaaa

SEQ ID NO: 691928 - RNA, 64 nt, hsa
cagccaggcagagguuuuaaugucuguuuauuaacuacugaauaaugcuaccaggaugcuaaag

SEQ ID NO: 691929 - RNA, 64 nt, hsa
acucccucugcagaaucccuuugcaccugagacccuacugaaguggcugguagaaaaaggggcc

SEQ ID NO: 691930 - RNA, 64 nt, hsa
cagaaugguuguauggauaugcgaaguaugguuucuacugaauguguauugcuuucccaucauc

SEQ ID NO: 691931 - RNA, 64 nt, hsa
auuggaaguugaaaaugcauugaauacacccaaccuacugaacaucguagcuuagccaagccua

SEQ ID NO: 691932 - RNA, 64 nt, hsa
aaauguaugacacugaaaagauuugagugugaaucuacugaaaucacuauaaugcacauugaag

SEQ ID NO: 691933 - RNA, 64 nt, hsa
ugcuccacauguacauaagaauugacacaggaaccuacugaauagcguagauauaggaaggcag

SEQ ID NO: 691934 - RNA, 64 nt, hsa
ggcuuuagaaauuacaacauaucagguuccccuacuacugaaguagccuuccgugagaacacac

SEQ ID NO: 691935 - RNA, 64 nt, hsa
agaagugcuuaggguugaaaauugauuucauuugcuacugaauuugguaaauccuggguaacuu

SEQ ID NO: 691936 - RNA, 64 nt, hsa
uuuccuauccauuuauagcuacuacugaaaaugacuacugaauuuuaucaaauaccuuuuaagc

SEQ ID NO: 691937 - RNA, 64 nt, hsa
cuuuuuaagccuauuuccuauccauuuauagcuacuacugaaaaugacuacugaauuuuaucaa

SEQ ID NO: 691938 - RNA, 64 nt, hsa
guaggcaagggaaucuguuuacucccucuucccucuacugaauaauuuucccucuacugaauaa

SEQ ID NO: 691939 - RNA, 64 nt, hsa
uacucccucuucccucuacugaauaauuuucccucuacugaauaauuuucccucuaagaauugc

SEQ ID NO: 691940 - RNA, 57 nt, hsa; identical to SEQ ID NO: 458759

SEQ ID NO: 691941 - RNA, 64 nt, hsa; identical to SEQ ID NO: 458760

SEQ ID NO: 691942 - RNA, 64 nt, hsa; identical to SEQ ID NO: 458761

SEQ ID NO: 691943 - RNA, 64 nt, hsa; identical to SEQ ID NO: 458762

SEQ ID NO: 691944 - RNA, 64 nt, hsa; identical to SEQ ID NO: 458763

SEQ ID NO: 691945 - RNA, 64 nt, hsa; identical to SEQ ID NO: 458764

SEQ ID NO: 691946 - RNA, 64 nt, hsa; identical to SEQ ID NO: 458765

SEQ ID NO: 691947 - RNA, 64 nt, hsa; identical to SEQ ID NO: 458766

SEQ ID NO: 691948 - RNA, 64 nt, hsa; identical to SEQ ID NO: 458767

SEQ ID NO: 691949 - RNA, 64 nt, hsa; identical to SEQ ID NO: 458768

SEQ ID NO: 691950 - RNA, 64 nt, hsa; identical to SEQ ID NO: 458769

SEQ ID NO: 691951 - RNA, 64 nt, hsa; identical to SEQ ID NO: 458770

SEQ ID NO: 691952 - RNA, 64 nt, hsa; identical to SEQ ID NO: 458771

SEQ ID NO: 691953 - RNA, 64 nt, hsa; identical to SEQ ID NO: 458772

SEQ ID NO: 691954 - RNA, 64 nt, hsa; identical to SEQ ID NO: 458773

SEQ ID NO: 691955 - RNA, 64 nt, hsa; identical to SEQ ID NO: 458774

SEQ ID NO: 691956 - RNA, 64 nt, hsa; identical to SEQ ID NO: 77130

SEQ ID NO: 691957 - RNA, 64 nt, hsa; identical to SEQ ID NO: 77131

SEQ ID NO: 691958 - RNA, 64 nt, hsa; identical to SEQ ID NO: 77132

SEQ ID NO: 691959 - RNA, 64 nt, hsa; identical to SEQ ID NO: 77133

SEQ ID NO: 691960 - RNA, 64 nt, hsa; identical to SEQ ID NO: 77134

SEQ ID NO: 691961 - RNA, 64 nt, hsa; identical to SEQ ID NO: 77135

SEQ ID NO: 691962 - RNA, 64 nt, hsa; identical to SEQ ID NO: 77136

SEQ ID NO: 691963 - RNA, 62 nt, hsa; identical to SEQ ID NO: 77137

SEQ ID NO: 691964 - RNA, 64 nt, hsa; identical to SEQ ID NO: 77138

SEQ ID NO: 691965 - RNA, 64 nt, hsa; identical to SEQ ID NO: 77139

SEQ ID NO: 691966 - RNA, 64 nt, hsa; identical to SEQ ID NO: 77140

SEQ ID NO: 691967 - RNA, 64 nt, hsa; identical to SEQ ID NO: 77141

SEQ ID NO: 691968 - RNA, 64 nt, hsa; identical to SEQ ID NO: 77142

SEQ ID NO: 691969 - RNA, 64 nt, hsa; identical to SEQ ID NO: 77143

SEQ ID NO: 691970 - RNA, 64 nt, hsa; identical to SEQ ID NO: 77144

SEQ ID NO: 691971 - RNA, 64 nt, hsa; identical to SEQ ID NO: 77145

SEQ ID NO: 691972 - RNA, 64 nt, hsa; identical to SEQ ID NO: 77146

SEQ ID NO: 691973 - RNA, 64 nt, hsa; identical to SEQ ID NO: 77147

SEQ ID NO: 691974 - RNA, 64 nt, hsa; identical to SEQ ID NO: 77148

SEQ ID NO: 691975 - RNA, 64 nt, hsa; identical to SEQ ID NO: 77149

SEQ ID NO: 691976 - RNA, 64 nt, hsa; identical to SEQ ID NO: 77150

SEQ ID NO: 691977 - RNA, 64 nt, hsa; identical to SEQ ID NO: 77151

SEQ ID NO: 691978 - RNA, 64 nt, hsa; identical to SEQ ID NO: 77152

SEQ ID NO: 691979 - RNA, 64 nt, hsa; identical to SEQ ID NO: 77153

SEQ ID NO: 691980 - RNA, 64 nt, hsa; identical to SEQ ID NO: 77154

SEQ ID NO: 691981 - RNA, 64 nt, hsa; identical to SEQ ID NO: 77155

SEQ ID NO: 691982 - RNA, 64 nt, hsa; identical to SEQ ID NO: 77156

SEQ ID NO: 691983 - RNA, 64 nt, hsa; identical to SEQ ID NO: 77157

SEQ ID NO: 691984 - RNA, 64 nt, hsa; identical to SEQ ID NO: 77158

SEQ ID NO: 691985 - RNA, 64 nt, hsa; identical to SEQ ID NO: 77159

SEQ ID NO: 691986 - RNA, 64 nt, hsa; identical to SEQ ID NO: 77160

SEQ ID NO: 691987 - RNA, 64 nt, hsa; identical to SEQ ID NO: 284841

SEQ ID NO: 691988 - RNA, 64 nt, hsa; identical to SEQ ID NO: 284842

SEQ ID NO: 691989 - RNA, 64 nt, hsa; identical to SEQ ID NO: 284843

SEQ ID NO: 691990 - RNA, 64 nt, hsa; identical to SEQ ID NO: 284844

SEQ ID NO: 691991 - RNA, 64 nt, hsa; identical to SEQ ID NO: 284845

SEQ ID NO: 691992 - RNA, 64 nt, hsa; identical to SEQ ID NO: 284846

SEQ ID NO: 691993 - RNA, 64 nt, hsa; identical to SEQ ID NO: 283021

SEQ ID NO: 691994 - RNA, 64 nt, hsa; identical to SEQ ID NO: 283022

SEQ ID NO: 691995 - RNA, 64 nt, hsa; identical to SEQ ID NO: 283023

SEQ ID NO: 691996 - RNA, 64 nt, hsa; identical to SEQ ID NO: 283024

SEQ ID NO: 691997 - RNA, 64 nt, hsa; identical to SEQ ID NO: 283025

SEQ ID NO: 691998 - RNA, 64 nt, hsa; identical to SEQ ID NO: 283026

SEQ ID NO: 691999 - RNA, 64 nt, hsa; identical to SEQ ID NO: 283027

SEQ ID NO: 692000 - RNA, 64 nt, hsa; identical to SEQ ID NO: 283028

SEQ ID NO: 692001 - RNA, 64 nt, hsa; identical to SEQ ID NO: 283029

SEQ ID NO: 692002 - RNA, 64 nt, hsa; identical to SEQ ID NO: 283030

SEQ ID NO: 692003 - RNA, 64 nt, hsa; identical to SEQ ID NO: 283031

SEQ ID NO: 692004 - RNA, 64 nt, hsa; identical to SEQ ID NO: 283032

SEQ ID NO: 692005 - RNA, 64 nt, hsa; identical to SEQ ID NO: 283033

SEQ ID NO: 692006 - RNA, 64 nt, hsa; identical to SEQ ID NO: 283034

SEQ ID NO: 692007 - RNA, 64 nt, hsa; identical to SEQ ID NO: 283035

SEQ ID NO: 692008 - RNA, 64 nt, hsa; identical to SEQ ID NO: 283036

SEQ ID NO: 692009 - RNA, 64 nt, hsa; identical to SEQ ID NO: 283037

SEQ ID NO: 692010 - RNA, 64 nt, hsa; identical to SEQ ID NO: 283038

SEQ ID NO: 692011 - RNA, 64 nt, hsa; identical to SEQ ID NO: 283039

SEQ ID NO: 692012 - RNA, 64 nt, hsa; identical to SEQ ID NO: 283040

SEQ ID NO: 692013 - RNA, 64 nt, hsa; identical to SEQ ID NO: 283041

SEQ ID NO: 692014 - RNA, 64 nt, hsa; identical to SEQ ID NO: 283042

SEQ ID NO: 692015 - RNA, 64 nt, hsa; identical to SEQ ID NO: 283043

SEQ ID NO: 692016 - RNA, 64 nt, hsa; identical to SEQ ID NO: 283044

SEQ ID NO: 692017 - RNA, 62 nt, hsa; identical to SEQ ID NO: 283045

SEQ ID NO: 692018 - RNA, 64 nt, hsa
ucuaguuuugaauaagucugggugaccgcaccuaaaaugguaagcaguacccuccggcuuuuuc

SEQ ID NO: 692019 - RNA, 64 nt, hsa
cuauuacucagcagcaguaacaugguaacacuuaaaaugguacucggggaccuccaaagacuaa

SEQ ID NO: 692020 - RNA, 64 nt, hsa
guaaaacuuugaauaucccagcgaagaaauggauaaaugguacagugccuguggauaguacagu

SEQ ID NO: 692021 - RNA, 64 nt, hsa
gcaucuacucaagguauuuuacagauuaccauggaaaugguagauacaguuuaaaagugcuuac

SEQ ID NO: 692022 - RNA, 64 nt, hsa
auuccuagaaaagauuuaaguaaagcaaaaggacaaaugguaauauaaagaaauuauuuucaau

SEQ ID NO: 692023 - RNA, 64 nt, hsa
guaagaaaauuauaagcugagguuucuuuuguuaaaaugguauaacgcuguugcucauuuuaaa

SEQ ID NO: 692024 - RNA, 64 nt, hsa
ccccuuagaaagucuucugcaaacccauuucugaaaaugguacauuauaggguggguauagaug

SEQ ID NO: 692025 - RNA, 64 nt, hsa
uaaugccacuaaauuguacccauaaaaaugguuaaaaugguaaauuuuguuauguauauuuuau

SEQ ID NO: 692026 - RNA, 64 nt, hsa
uaauagucaguuuucuagaaccuacuuuuaggguaaaugguacauuauuuaauauuauauuaaa

SEQ ID NO: 692027 - RNA, 64 nt, hsa
uaaaccuccuauagcguggauuguagaccaaaggaaaugguacaauuucugagaauauauguug

SEQ ID NO: 692028 - RNA, 64 nt, hsa
uaucgccaaugcaggaugcuccuuagaaaagaaaaaaugguaaagaauggcauuuaacgauuca

SEQ ID NO: 692029 - RNA, 64 nt, hsa
cucccaacaacugcacuuuagaauaccagcagugaaaugguauuacuguuucccucugagugaa

SEQ ID NO: 692030 - RNA, 64 nt, hsa
aaaaaaaacaaagauauucaaacugcuuggguucaaaugguauacaauuugccagcuguuacug

SEQ ID NO: 692031 - RNA, 64 nt, hsa
cauauuguuggugagauaauauuuaauagguauaaaaugguaaaauaccuaguuuucuauuuag

SEQ ID NO: 692032 - RNA, 64 nt, hsa
caaaacaaagauggacuuguucugggaaaagguaaaaugguaaucaaauagauuguguuccagg

SEQ ID NO: 692033 - RNA, 64 nt, hsa
caugggcuguccaguccugauuauagagaggaagaaaugguaacaguauggcagauaagaauua

SEQ ID NO: 692034 - RNA, 64 nt, hsa
uaaguuuuucauauuucauggacaacaaaagagaaaaugguaugaacacuguacaaacuuugau

SEQ ID NO: 692035 - RNA, 64 nt, hsa
cagugguuuauggugggcaauauugcaauauuugaaaugguaaaaauggaaagaagaacaaaau

SEQ ID NO: 692036 - RNA, 64 nt, hsa
aaaacacugaugguuuuuaaagacucaccuuuuuaaaugguacuuggagcuccugauucaaauu

SEQ ID NO: 692037 - RNA, 64 nt, hsa
aggcacagaaagguuaaaugauuacucagcuaaaaaaugguagagauuuuuuuuucaaacacag

SEQ ID NO: 692038 - RNA, 64 nt, hsa
gaacaaaguaaaugauucuauuuuagaaggauaaaaaugguaaugaugauaacuaacauuuuuu

SEQ ID NO: 692039 - RNA, 64 nt, hsa
ccuacagugcuguguacccuggggcaauaggguuaaaugguaguuagcaacuagggcuagucuu

SEQ ID NO: 692040 - RNA, 64 nt, hsa
cuuagauuguguuccugaagaaaagaguccagguaaaugguaugaucaauaaaggacaggcugg

SEQ ID NO: 692041 - RNA, 64 nt, hsa
guugaaaaagaguuucauuguggagagaaaaagcaaaugguaugccacaagaucacucugauuu

SEQ ID NO: 692042 - RNA, 64 nt, hsa
gcaauggaaaugcuauacguuuuugacauuuauuaaaugguaccaauaaaguauuuuauuacca

SEQ ID NO: 692043 - RNA, 64 nt, hsa
cgucaacgcaacgucuaacuggacuucccaagauaaaugguaccagcguccucuuaaaagaugc

SEQ ID NO: 692044 - RNA, 64 nt, hsa
agcagagguggaaaaauacuuuugcuuucagggaaaaugguauaacguuaauuuauuaauaaau

SEQ ID NO: 692045 - RNA, 64 nt, hsa
cuucccugcaguccaaagaugauuuuuucaccacaaaugguaagggaugcccaccuacuuuuau

SEQ ID NO: 692046 - RNA, 64 nt, hsa
uccaggugccaacugcuaagcagauauauuccaaaaaugguaacugucaugugcacacuguugg

SEQ ID NO: 692047 - RNA, 64 nt, hsa
gugugauuagugccuaggggucuccauuuagcagaaaugguaaugacagugauauaaugccugg

SEQ ID NO: 692048 - RNA, 64 nt, hsa
uguuguuguuuuuuuaagcuucccuugagagaauaaaugguaauggagagaacuauuuaacaag

SEQ ID NO: 692049 - RNA, 64 nt, hsa
gaauauugccauuaugcuugacaugguuuccaaaaaaugguacuccacauauuucagugagggu

SEQ ID NO: 692050 - RNA, 64 nt, hsa
ucccccuguuucagaggcucagauuguaauauguaaaugguaugucauucgcuacuaugauuua

SEQ ID NO: 692051 - RNA, 64 nt, hsa
agugggucaaauauuauaaaauaggcaaacaccaaaaugguauuaaauauugaacuccugaccu

SEQ ID NO: 692052 - RNA, 64 nt, hsa
acagaaauggaacacuguaucuuuauauuccuaaaaaugguacuuuuggcauaauuaagaaauu

SEQ ID NO: 692053 - RNA, 64 nt, hsa
ucccuuuuaaaccuguuaacuugaaggagaacagaaaugguauuacuucaauagugguagauuu

SEQ ID NO: 692054 - RNA, 64 nt, hsa
acuaacuauaaauguaaugaauuauaauaauuauaaaugguauaaaugcauucuacaaugugau

SEQ ID NO: 692055 - RNA, 64 nt, hsa
gauaaauacaccuuuuuuucccucuucccccuaaaaaugguaaaucugaucauaucuacaugua

SEQ ID NO: 692056 - RNA, 64 nt, hsa
uguaaauuuguauauguuauuuaccuucagaucuaaaugguaaucugaacccaaauuuguauaa

SEQ ID NO: 692057 - RNA, 52 nt, hsa; identical to SEQ ID NO: 475095

SEQ ID NO: 692058 - RNA, 64 nt, hsa
uaucugcuaaacaggacuucagguaagugaggugaaaugguagccagugacccguuaggagcuc

SEQ ID NO: 692059 - RNA, 64 nt, hsa
cgguguuucauacagaaugucuucauaucaucugaaaugguauggcugaaguucauuuguuuac

SEQ ID NO: 692060 - RNA, 64 nt, hsa
guaucaaaagaaagugguuuucuucaaauguauacuauuuuacuuccugaaugugccaacuuug

SEQ ID NO: 692061 - RNA, 64 nt, hsa
uugauuaauuuuuugaaguuauagauauguucuccuauuuuaaaagcaaaaauaacaauugaca

SEQ ID NO: 692062 - RNA, 64 nt, hsa
acuucuccugggagacguauuaagacuggaaguccuauuuuauuuaaucaguaucaguaaaaag

SEQ ID NO: 692063 - RNA, 64 nt, hsa
cacacacacuuauauauaaacacauguaauuuuacuauuuuauugucuuuccuuuaaucgauga

SEQ ID NO: 692064 - RNA, 64 nt, hsa
aucaguuugaauuuucuuucucugacucucaucccuauuuuaccuauuuccauuuucgucuauc

SEQ ID NO: 692065 - RNA, 64 nt, hsa
ccaagguguuagguuucacauauauauucaucaacuauuuuagaagauuuaauucuaucaaauc

SEQ ID NO: 692066 - RNA, 64 nt, hsa
uuuuaaauagcaagccaauaacgagcuuugaaggcuauuuuaccauuccuguucacaaaagguu

SEQ ID NO: 692067 - RNA, 64 nt, hsa
gauauccuaggagggguguuugggaaauaucuagcuauuuuaauagauagauaccuuuuugcuu

SEQ ID NO: 692068 - RNA, 64 nt, hsa
cuguagaauucuccaguuuaaguguagacaacuccuauuuuacaaauuuguagaaauuauuuac

SEQ ID NO: 692069 - RNA, 64 nt, hsa
uggaaaguugauuuugucuguauuugaaguacuucuauuuuaaguuaauaaaucuuuuugacaa

SEQ ID NO: 692070 - RNA, 64 nt, hsa
cuaguaucaccaaauugagugauacaaauuucaucuauuuuauuacccuauuuuuaagggaauu

SEQ ID NO: 692071 - RNA, 64 nt, hsa
cauaauuuguucuuaaguauacugggcagguccccuauuuuaagucauaauuuuguauuuagug

SEQ ID NO: 692072 - RNA, 64 nt, hsa
ucuuaaguacaccuucaacuauauucccaucccucuauuuuaaucuguuaugaaggaagguaaa

SEQ ID NO: 692073 - RNA, 64 nt, hsa
gacuuaaagaaauaauccaucugcaucccaaguccuauuuuauaaggauauucauaaaaauucc

SEQ ID NO: 692074 - RNA, 64 nt, hsa
gguaucaaagaauagccacaauuagcugaaaaggcuauuuuaaaaacuuuuccaacugcguauc

SEQ ID NO: 692075 - RNA, 64 nt, hsa
uauuaaaaagaaaucugauauauaaaaauauguacuauuuuaaggaaaaauuuccaagaaguuc

SEQ ID NO: 692076 - RNA, 64 nt, hsa
agugauugguugaccuaaaccacuuugaauguuucuauuuuaugaaaugaaguuucucuucuua

SEQ ID NO: 692077 - RNA, 64 nt, hsa
aauacaacugccaguauguauuuuuaauggaacccuauuuuauaaugguacguuacugaaugug

SEQ ID NO: 692078 - RNA, 64 nt, hsa
auuugcaaacccuacaacucugggugucauaggucuauuuuaagggaagagagagaaaaacacc

SEQ ID NO: 692079 - RNA, 64 nt, hsa
aagguuuguuuauguuacauuuauuucaccagaacuauuuuaauauaucaaagggguuuacuau

SEQ ID NO: 692080 - RNA, 64 nt, hsa
cuaauauaaagggagaugcuuauagccacaacaucuauuuuaccaauauuguuuccauuacacu

SEQ ID NO: 692081 - RNA, 64 nt, hsa
uuuuuaggcaguuaaaauacuucuagaacuccaucuauuuuaccugugguccacuuuccuacau

SEQ ID NO: 692082 - RNA, 64 nt, hsa
ucauagugaguacgcucuaugcauaguaugacuucuauuuuaaugugaagaauuuuuugucucu

SEQ ID NO: 692083 - RNA, 64 nt, hsa
auuuaauuacaauuuuuagccagaaaaguccccacuauuuuacuaacuuguuaaaagauaucua

SEQ ID NO: 692084 - RNA, 64 nt, hsa
acuaguugagacauuaaaggaagcugggcaaugccuauuuuauuucuuuguuggauauuuuagu

SEQ ID NO: 692085 - RNA, 64 nt, hsa
aaaaaggccuaaugcauuauuuugucauaaaaugcuauuuuaaaauucauggaacuuucauacg

SEQ ID NO: 692086 - RNA, 64 nt, hsa
guugcucucuguucaagucauuccacacauuucccuauuuuaggcuauuauaauauagaaagaa

SEQ ID NO: 692087 - RNA, 64 nt, hsa
aucauuuucccauugcaacagagcuauauuuuuucuauuuuaagaaucauauuuuaggauuauu

SEQ ID NO: 692088 - RNA, 64 nt, hsa
ugaauuauaggucucaggcuuacuugauuuuuggcuauuuuauauuuaguguacacagggcuuu

SEQ ID NO: 692089 - RNA, 64 nt, hsa
auaugugcuguaacaucauguacguuaccuccaucuauuuuaggauauuuuccucaccuauaua

SEQ ID NO: 692090 - RNA, 64 nt, hsa
gcauuucuuuauaugauauauuucuuuuacgaagcuauuuuaaaaguaagccaagugcugucua

SEQ ID NO: 692091 - RNA, 64 nt, hsa
aacuguuuauuauagauaauuuuaagguguauagcuauuuuaaaggggguccauuuacaucaaa

SEQ ID NO: 692092 - RNA, 64 nt, hsa
gguuuucuuuguauagaauauuuauuuugaagcucuauuuuaauaguauuuauuuuagaaaguc

SEQ ID NO: 692093 - RNA, 64 nt, hsa
uuuaauguaaauagagagaugaugaaaaaagagucuauuuuaguguuaggaagccccagcaggg

SEQ ID NO: 692094 - RNA, 64 nt, hsa
uagaaaucccugggaauugcgagaauaacucccacuauuuuaaaauuuauauucagauuuguuu

SEQ ID NO: 692095 - RNA, 64 nt, hsa
aaaagacuauuuccccuuagaauagggaagcuugcuauuuuaaagcucuuguagugcuuuucuu

SEQ ID NO: 692096 - RNA, 64 nt, hsa
acucuuaagcuuugagaaauuuucacauugaugacuauuuuaaaaucaaauaaaacuauuuuac

SEQ ID NO: 692097 - RNA, 64 nt, hsa
uucacauugaugacuauuuuaaaaucaaauaaaacuauuuuacugguauggccuaacuugucuu

SEQ ID NO: 692098 - RNA, 64 nt, hsa
agagcacaaaugagagugugagagaaaguaccuucuauuuuaauaauaauauuauuauaaaaau

SEQ ID NO: 692099 - RNA, 64 nt, hsa
ggggacaagaaaaguagagguaggaaagaagacacuauuuuagcuaaugggguuucuugggacu

SEQ ID NO: 692100 - RNA, 64 nt, hsa
ggaaaugggagugggagauaauauugggagguaucuauuuuaagucaggggcuuuacuagccga

SEQ ID NO: 692101 - RNA, 64 nt, hsa
aauuccugucacuuucuguuuuccauuuaaauuucuauuuuacaaauuuuucagggaaucauau

SEQ ID NO: 692102 - RNA, 64 nt, hsa
cugcuuucugucucuauggauuuaucuauucuugcuauuuuauauaaauugaauuguaugagac

SEQ ID NO: 692103 - RNA, 64 nt, hsa
uuauugagguaaacuucacauaacauaaaauuaacuauuuuaaagugagaaguucagugccacu

SEQ ID NO: 692104 - RNA, 64 nt, hsa
ccucagugguaauaaauggugcuagauauugcuacuauuuuauagauuuccuggugcuuagccu

SEQ ID NO: 692105 - RNA, 64 nt, hsa
caugaagcucauguuaacuuucuuuuggucagugcuauuuuaaaggaaguaugaguugaaaaaa

SEQ ID NO: 692106 - RNA, 64 nt, hsa
uguguguguuuaauaggcuucaccuuauuacaugcuauuuuauuuugcuuuuuuaaaaacucag

SEQ ID NO: 692107 - RNA, 64 nt, hsa
gugguuagcaaucaauuuugaauuuauaauucugcuauuuuaaaagaaauguagucuuguagua

SEQ ID NO: 692108 - RNA, 64 nt, hsa
uccacaaacacacuauauacuuccucaccacugacuauuuuaucaaauuugccuuaaaauaaug

SEQ ID NO: 692109 - RNA, 64 nt, hsa
cugcuucagugucuuaaugaccaaaucacauuaucuauuuuagcacucauuccaaaauucagua

SEQ ID NO: 692110 - RNA, 64 nt, hsa
auucugcagucuuugcaauaguucaccuauaauccuauuuuaaaucucagagugauccugcuga

SEQ ID NO: 692111 - RNA, 64 nt, hsa
auucguuuuccucaugggucuuccaagaaaugagcuauuuuauugaugccauuaaaaagcaagu

SEQ ID NO: 692112 - RNA, 64 nt, hsa
uagauaugcuuauaccuaauuuuuaguuuuuaaacuauuuuaaaauauacuaugauuuuauaug

SEQ ID NO: 692113 - RNA, 64 nt, hsa
guaaacuuuuaauauggcaaagcaaccuuaagcucuauuuuagccaaaugaaacauaaucugaa

SEQ ID NO: 692114 - RNA, 64 nt, hsa
auaaaauaaagacuuucuuaaaggaaaauugcaccuauuuuaccuuuuuaagaguaagccauga

SEQ ID NO: 692115 - RNA, 64 nt, hsa
ucucuaacugaauccacuucuuaaacaaacuacucuauuuuaaauaaggaaagaauggagaauc

SEQ ID NO: 692116 - RNA, 64 nt, hsa
acagaagaguguuuauccugagauugguauugcacuauuuuauuuuauucugcaaaucuguauc

SEQ ID NO: 692117 - RNA, 64 nt, hsa
aauguguaguucauguaaauaauacauuauauuucuauuuuauuaugaagaaggugaauagcca

SEQ ID NO: 692118 - RNA, 64 nt, hsa
aaaugucuuuaaugcaauauacuggaaagcuuuucuauuuuaauaaaaauaauuuuuauaugau

SEQ ID NO: 692119 - RNA, 64 nt, hsa
agugacaucuuucuguauauaaacucuuuaacugcuauuuuagggaccuugcaguuugcacaua

SEQ ID NO: 692120 - RNA, 64 nt, hsa
cauucauguguuauuuaauuuacacugaucucugcuauuuuaaccccccaaauaaguuauuugu

SEQ ID NO: 692121 - RNA, 64 nt, hsa
uauuuuugguacugaugggauauggguggggaggcuauuuuagauauucuuuuagcaguguaga

SEQ ID NO: 692122 - RNA, 64 nt, hsa
uuagguugaaccauauguaauugccaagauuuuacuauuuuaacuuagaaaaaccaucguuuca

SEQ ID NO: 692123 - RNA, 64 nt, hsa
uuagaggcgcuguuuauuuacuguauacgucgaccuauuuuagaugcgcaucaguaugaaauug

SEQ ID NO: 692124 - RNA, 64 nt, hsa
aaacuggcgauuuuaugaaaugucggcaaaaugacuauuuuauuguuugaagcgaguuaauauu

SEQ ID NO: 692125 - RNA, 64 nt, hsa
augugccuaauguuaauuugauauucugacauugcuauuuuaccagaacuaagaacauauugag

SEQ ID NO: 692126 - RNA, 64 nt, hsa
uuaauccacugcaaggcaccuagagagacugcuccuauuuuaaaagugaugcaagcaucaugau

SEQ ID NO: 692127 - RNA, 64 nt, hsa
auguuuagaagaauauuggaagacacuauuuuugcuauuuuauaccauauagcaacgauauuuu

SEQ ID NO: 692128 - RNA, 64 nt, hsa
uucucuguugcuaagugacagugggcccagccaccuauuuuaacaagcccucccagugauugug

SEQ ID NO: 692129 - RNA, 64 nt, hsa
uuuuuggaaauauucuuggcucuagauuuaucagcuauuuuagcauuaaaggcugaugggugga

SEQ ID NO: 692130 - RNA, 64 nt, hsa
gagaacaugucuggaggggcaguguacaggugcucuauuuuaauggaaaacacuccccucuccc

SEQ ID NO: 692131 - RNA, 64 nt, hsa
uuaugggggaaaugcuucuuuuuguuugugauagcuauuuuaucauuuccuucauauuuuucuc

SEQ ID NO: 692132 - RNA, 64 nt, hsa
ugaaacaagaaauucucuucauuuuaucccagugcuauuuuauugauuaauuacuaaaaaguau

SEQ ID NO: 692133 - RNA, 64 nt, hsa
uggaugaguggacuucauauuaugacuagcuuuacuauuuuaauucaccuugcauaacuacuga

SEQ ID NO: 692134 - RNA, 64 nt, hsa
cuauguguucagacugaaacuggagaaauuaugacuauuuuauuuauaguaguaguuaaaucug

SEQ ID NO: 692135 - RNA, 64 nt, hsa
uuugagaaauauuucauuuguccacuggaugucacuauuuuacuaaaaggcagcuauuagugug

SEQ ID NO: 692136 - RNA, 64 nt, hsa
uaucaugaaauucuccuugucauuuuauaaaugccuauuuuaacaucauuuaugguuccagaga

SEQ ID NO: 692137 - RNA, 64 nt, hsa
caucucaugcucuguggcuccaggguuucuguuacuauuuuaugcacuugggagaaggcuuaga

SEQ ID NO: 692138 - RNA, 64 nt, hsa
aaauaaauugaaaauaacucauuauaccaauucacuauuuuauuuuuuaaugaauuaaaacuag

SEQ ID NO: 692139 - RNA, 64 nt, hsa
agcaauacguuugugcagaaucucuauguauauucuauuuuauuaaauuaauugaaucuaguau

SEQ ID NO: 692140 - RNA, 64 nt, hsa
gaauauuuuugaggcgaaggcgucugucucuuggcuauuuuaaccuaaaauaacagucuaguua

SEQ ID NO: 692141 - RNA, 64 nt, hsa
guaggcauaccccccaagucugcuuuuagcuucccuauuuuagugcaccuggagggaaaggaau

SEQ ID NO: 692142 - RNA, 64 nt, hsa
ucagguuucuacugcuaggcaauugaaguauaaacuauuuuauaaacacugucuucuuucgucu

SEQ ID NO: 692143 - RNA, 64 nt, hsa
aguaucuuccauaauuuuuaagucugacacauuucuauuuuauucuaacauaaaaaaacuucca

SEQ ID NO: 692144 - RNA, 64 nt, hsa
uauuuaauucacuuaacucugucuuuauaaguuccuauuuuagauggaauaagagaaacaaauu

SEQ ID NO: 692145 - RNA, 64 nt, hsa
aauugcuacuguacuugcuuugaaagauuaccuacuauuuuaugauaaaauguaguugucucca

SEQ ID NO: 692146 - RNA, 64 nt, hsa
uuucuguauauugcauagcauuacacauuuaugccuauuuuaacauuaacuucuaaagaaguuu

SEQ ID NO: 692147 - RNA, 64 nt, hsa
uuuguauauugcauauucacaugaucauuguucacuauuuuaugaacuggccuucucaauguuu

SEQ ID NO: 692148 - RNA, 64 nt, hsa
gagcccucagacaucuccagugugccagacaaauaggagugaguguaugugugugugugugugu

SEQ ID NO: 692149 - RNA, 64 nt, hsa
ccugucucuauuagcuggguuccgggaggcagagaggagugaccgggcacuggcacugcgauca

SEQ ID NO: 692150 - RNA, 64 nt, hsa
aagcaaaaagcaagaaucaauuacuuaaaggcaaaggagugauauugcuaaagcaugugaguaa

SEQ ID NO: 692151 - RNA, 64 nt, hsa
gggaggcagggagcuuuuggacaauuuugaguugaggagugaugugguuugaaucugaauuaua

SEQ ID NO: 692152 - RNA, 64 nt, hsa
cccuggggcacuccuccuuauguugauagcauguaggagugagaaaaagucauugagcauaagg

SEQ ID NO: 692153 - RNA, 64 nt, hsa
aaagaggccccacgcuguagagucccgaaagcccaggagugaaggggguuccuggagucucuag

SEQ ID NO: 692154 - RNA, 64 nt, hsa
ggggcuaaucacuuagaguucuucaguuuauuagaggagugacuacagguuuucuuuacaacca

SEQ ID NO: 692155 - RNA, 64 nt, hsa
aaugaaggcuauuugccaucccugccuuagacagaggagugaaagaauuaaguggguagacacc

SEQ ID NO: 692156 - RNA, 64 nt, hsa
gaaauacacaaguaaacauuccaacauugucuuuaggagugauuugcaccuugcaaaaaugguc

SEQ ID NO: 692157 - RNA, 63 nt, hsa
acaagaacuacaggauguaggaagacccuccugaggagugaagagugacaugccaccgcagga

SEQ ID NO: 692158 - RNA, 64 nt, hsa
accgcgaaugcaucagcuaaagcagcguguaaauaggagugacgagaaaguuaauggaguauuu

SEQ ID NO: 692159 - RNA, 64 nt, hsa
uauuucagauuuuuaaaauaguauagaaaaaaguaggagugauagagaacaaaaauacucuuau

SEQ ID NO: 692160 - RNA, 64 nt, hsa
uaccccacccucagcaccccuuccauguggagaaaggagugaaaccuuuagggcagcuugcccc

SEQ ID NO: 692161 - RNA, 64 nt, hsa
ggcccugaggugugggggcugcagcauguugcugaggagugaggaauaguugagccccaagucc

SEQ ID NO: 692162 - RNA, 64 nt, hsa
gggagaacacguaacuguugaaaaacuaccugggaggagugaguuccuccaguuaaauguggcu

SEQ ID NO: 692163 - RNA, 64 nt, hsa
caccaggccucuccaaggagacaguucauuauuuaggagugaauguguuccucuugcaauauua

SEQ ID NO: 692164 - RNA, 61 nt, hsa
ucucuuucccccacccuacucccuccaauucccccuuaaacuuccaaagcuucgucuugug

SEQ ID NO: 692165 - RNA, 61 nt, hsa
gauuuuuuuaaaguaguuccuauuuucuaucccccuuaaagaaaauugcaugaaacuaggc

SEQ ID NO: 692166 - RNA, 61 nt, hsa
gccucaugccaacccugggcuauugcugcugccccuuaaacacaggcuguccuuaacccac

SEQ ID NO: 692167 - RNA, 61 nt, hsa
uucuaauccuuuuccuuauuugccuucuacuccccuuaaucuaaucuaaaagcucuguucc

SEQ ID NO: 692168 - RNA, 61 nt, hsa
cauuuccccccagucagcauuauuuaacacuccccuuaacugucuuugaacuuucucuuuu

SEQ ID NO: 692169 - RNA, 61 nt, hsa
ugaugcauuuauuuuuagguguuuuuuuuuuccccuuaaaaaacuugaagugauaugcagc

SEQ ID NO: 692170 - RNA, 64 nt, hsa; identical to SEQ ID NO: 657833

SEQ ID NO: 692171 - RNA, 64 nt, hsa; identical to SEQ ID NO: 657834

SEQ ID NO: 692172 - RNA, 64 nt, hsa; identical to SEQ ID NO: 657835

SEQ ID NO: 692173 - RNA, 64 nt, hsa; identical to SEQ ID NO: 657836

SEQ ID NO: 692174 - RNA, 64 nt, hsa
accaucuaaguagccauuuucgaacaauucaccaggcauguaaacucaucugcagaaaauguaa

SEQ ID NO: 692175 - RNA, 64 nt, hsa
uuucuauuaagaaaaauguccugcugggcacaguggcauguaccuguugucucagcuauguggg

SEQ ID NO: 692176 - RNA, 64 nt, hsa
ggauggcaaggggugggcauuggggugccaggcaggcauguacagacucuauaucucuauauau

SEQ ID NO: 692177 - RNA, 64 nt, hsa
aaugcuucauuaaacugagugaaacugguuaaguggcauguaauaguaagugcucaauuaacau

SEQ ID NO: 692178 - RNA, 64 nt, hsa
uacauagccacauuuacaguuuuaaccauuuuaaggcauguaauucagugggguuagguacauu

SEQ ID NO: 692179 - RNA, 64 nt, hsa
cagucgcuccuuaccgugacuccugcccuuggagggcauguagcagugucuguccugccagucc

SEQ ID NO: 692180 - RNA, 64 nt, hsa
gugagcacagcugcuugccauugccugccuuauaggcauguagagacugccaggcccucccagg

SEQ ID NO: 692181 - RNA, 64 nt, hsa
uggccacugauaguauaaaccauggucauuuuuaggcauguaucauucauuuacucauaguuug

SEQ ID NO: 692182 - RNA, 64 nt, hsa
aauaaaaaucucuuuuccacuccauugucguauaggcauguaaacagccucuuuuugauacugg

SEQ ID NO: 692183 - RNA, 64 nt, hsa
uuggcagcccccuguaguugacagguaagcuguaggcauguagagcaauugucccaaugccacu

SEQ ID NO: 692184 - RNA, 64 nt, hsa
uauuugugcaacauuacucuuugaaauaaaaauuggcauguagccaauguuuccugcccacacu

SEQ ID NO: 692185 - RNA, 64 nt, hsa
agaaugaaugauuuuugcauuuaaguuguuugaaggcauguauuuugaaaaauaucuguuacaa

SEQ ID NO: 692186 - RNA, 64 nt, hsa
gucccccagauuccaacauuucucacugaaagggggcauguaugcaaaccucaucuuucuccuu

SEQ ID NO: 692187 - RNA, 64 nt, hsa
auguuacuugaaucugugcuucauaauaguguguggcauguaugugcagacucuuggaugcuuu

SEQ ID NO: 692188 - RNA, 64 nt, hsa
gacugcucugggccggggguagagcuagcauccgggcauguacgagggaagagggaggcaggcc

SEQ ID NO: 692189 - RNA, 64 nt, hsa
ugcugaauaugcaauuuguuauucuuuuauuaauggcauguaauauucugagcacgggcaaaga

SEQ ID NO: 692190 - RNA, 64 nt, hsa
acggagggaggacaucauaaggaaguuauuaacgggcauguauuaucacaucaagcaugcaaua

SEQ ID NO: 692191 - RNA, 64 nt, hsa
cuggcuaggcccacaccagggccuggcugggaguggcauguaugacgugacuggccugcuggau

SEQ ID NO: 692192 - RNA, 64 nt, hsa
uaaccacuaauguuagaauugauuuccaagaaucggcauguauacuuaauacugaauuucuuug

SEQ ID NO: 692193 - RNA, 64 nt, hsa
auacucaucuuuuuggaauccugaccuuagguucggcauguagaccaagugaugagaagugaau

SEQ ID NO: 692194 - RNA, 64 nt, hsa
aaaguuuuacauacuuaaguggguaccacagauaggcauguaccuuaaauucaaaucuacaguu

SEQ ID NO: 692195 - RNA, 64 nt, hsa
aagaauugaaaggaguugaacugccuuauguuugggcauguaacuccaaaauacuagguaguau

SEQ ID NO: 692196 - RNA, 64 nt, hsa
uaccacaugcaaacauacaagcagucucaccucaggcauguauuuugaaaagcauuuugucaua

SEQ ID NO: 692197 - RNA, 64 nt, hsa
uagcaagcuggccucuaccacaagggcucucuuaggcauguaggacccugcaggggguggacaa

SEQ ID NO: 692198 - RNA, 64 nt, hsa
guaaggcucggauggcaaggacgcguucugccugggcauguaggggagguguuuuugccaucac

SEQ ID NO: 692199 - RNA, 64 nt, hsa
aaauaaaacuaaggaacccuggaaacuaccagugggcauguauuagccagucauuguaaccucg

SEQ ID NO: 692200 - RNA, 64 nt, hsa
ccugccuucuuucuccuuuuauguuaucauaaguggcauguaucaaaccaaacaggcuagggga

SEQ ID NO: 692201 - RNA, 64 nt, hsa
gugauauucucccagaauguacuuaucuuaccucggcauguacuguagucacucaguauuugua

SEQ ID NO: 692202 - RNA, 64 nt, hsa
acuuuugucuguuguguauaaaagaagaaagacuggcauguaccuucauuugcuuagcuauuug

SEQ ID NO: 692203 - RNA, 64 nt, hsa
cagacaguacuaaauacuuauauuuuauuuuugaggcauguaauuuuaaaacugcaguagguua

SEQ ID NO: 692204 - RNA, 64 nt, hsa
cuucugccucccacuccauaccccgccaaggaaaggcauguacaaaaauuaugcaauucagugu

SEQ ID NO: 692205 - RNA, 64 nt, hsa
augagaugagcugaguuauagagagaaagggagaggcauguacgguguggggaaguggaagaga

SEQ ID NO: 692206 - RNA, 64 nt, hsa
cauggugauaacacuaauugaauauaucuaugagggcauguauuaguuaauggaaaaaaaaaua

SEQ ID NO: 692207 - RNA, 64 nt, hsa
cuauuuagcucuuaguaccacuaaucaaaaguucggcauguagcucaugaucuaugcuguuucu

SEQ ID NO: 692208 - RNA, 64 nt, hsa
cagguuuuuaauuuugugauaacaaaauaacgaaggcauguaagaccugauucuggaggaacau

SEQ ID NO: 692209 - RNA, 64 nt, hsa
ucaugccucagccucccaagcagcugggacuacaggcauguacugcuaugccuggcuaauuuuu

SEQ ID NO: 692210 - RNA, 64 nt, hsa
auaagagguguucuccagaauggaggaacuacuuggcauguaagaaauagcgucaguguccuaa

SEQ ID NO: 692211 - RNA, 64 nt, hsa
auaagagguguucuccagaauggaagaacgacuuggcauguaagaaauagcgucaguguccuaa

SEQ ID NO: 692212 - RNA, 64 nt, hsa
gugacugcuuuaugaaaauaauagugucuucuauggcauguaauggauaccuaauaccgaugag

SEQ ID NO: 692213 - RNA, 64 nt, hsa
acuuguguuucccugauaauguguacauuuuuuaggcauguacuuaauaguucacaauguucua

SEQ ID NO: 692214 - RNA, 64 nt, hsa
caccauucaugaauaauaauaaauauguacugcuggcauguaaugcuuaguuuucuuguauuua

SEQ ID NO: 692215 - RNA, 64 nt, hsa
uuugguuucccaucuaaucaacuuaagggaagccggcauguacccuucaaggcccugucaccac

SEQ ID NO: 692216 - RNA, 64 nt, hsa
uaguuacuauguuuuguaaauccauuuuguagagggcauguaaauaaauguuuuccuguaguca

SEQ ID NO: 692217 - RNA, 64 nt, hsa
uuaagcaugaaaaugagaacacugagauuugauaggcauguagaagucagaguaagcaagaggg

SEQ ID NO: 692218 - RNA, 64 nt, hsa
cuguauauuuaaaauuauaaauuaauguuuucguggcauguaaauuuuuaugguacagauaguu

SEQ ID NO: 692219 - RNA, 64 nt, hsa
uuguuuuauucccuugaugaccuagggaaaaaaaggcauguagaguauuauguuuauacuuuaa

SEQ ID NO: 692220 - RNA, 64 nt, hsa
gagcaagguggagggugcagaggggcugggguagggcauguaggagggaggugggugggucagg

SEQ ID NO: 692221 - RNA, 64 nt, hsa
aaauaguuauauaaaugaagaacauuuuuaauauggcauguaaagcuuuuaaaguuaugaacuc

SEQ ID NO: 692222 - RNA, 64 nt, hsa
ggugguuuuuccugccaguucaggagagauucuuggcauguaauauauaucacugcucaaguca

SEQ ID NO: 692223 - RNA, 64 nt, hsa
uguaauucucuaugguuugaaauggaucauacgaggcauguaauaccaagaauuguuacuuuac

SEQ ID NO: 692224 - RNA, 64 nt, hsa
ccagguaucuccccuccucucucuccccugcagaggcauguagggaacagcaggagauuauucu

SEQ ID NO: 692225 - RNA, 64 nt, hsa
uuuaaccagaaaaguacauugcuaaccccaaacaggcauguaucaaaacaccuguggaguacuu

SEQ ID NO: 692226 - RNA, 64 nt, hsa
ggacaggguacccuugggucgcacgggccuggcuggcauguaaacggucaguugcacugccuag

SEQ ID NO: 692227 - RNA, 64 nt, hsa
accuaaaaugauugacucauucauaguaaauaugggcauguaaacuaauaaauaugcacuggau

SEQ ID NO: 692228 - RNA, 64 nt, hsa
cuacgugaagauuaagcuuugcuuacugauacauggcauguauucuuuucagucuuuuguguuu

SEQ ID NO: 692229 - RNA, 64 nt, hsa
uuaucuuagucuauagaaaugaucauugcauggaggcauguauagguaugaucuguguaaaauc

SEQ ID NO: 692230 - RNA, 64 nt, hsa
uguugaauggaauaauaaugaggaaacuguguuaggcauguauuaaaacauuuaaauaaaauaa

SEQ ID NO: 692231 - RNA, 64 nt, hsa
aggcaggccgggcuccagggcuccccuugcguggggcauguaggugggggaggcgucugcaggu

SEQ ID NO: 692232 - RNA, 64 nt, hsa
uccaugucuuggauacauacguaucuauagagcuggcauguaauucuuccucuauaaagaauag

SEQ ID NO: 692233 - RNA, 64 nt, hsa
auaucuccaauauuaggauggaauacauauguauggcauguacuagauuguccuauauuuuaug

SEQ ID NO: 692234 - RNA, 64 nt, hsa
uagagaacuuaauguucaaaauuugcuuuguggaggcauguaauaagauaaacaucauacauua

SEQ ID NO: 692235 - RNA, 64 nt, hsa
uccuccaggaaauauaaugauuucugggaacaugggcauguauauauauauauggagagagaau

SEQ ID NO: 692236 - RNA, 64 nt, hsa
uuucuggaagaauguaaguugcuauauguggaggggcauguaggacagggguucuaauuacugu

SEQ ID NO: 692237 - RNA, 64 nt, hsa
ugaguaugacaggcacugaguaugcagaaaucaaggcauguacuugcuguucgaggcccugugg

SEQ ID NO: 692238 - RNA, 64 nt, hsa
aauacauaaaugaaaauacauuuuuuuccauauuggcauguagcuacaaauauuaaaggaggag

SEQ ID NO: 692239 - RNA, 64 nt, hsa
uagugugucggacacaaauagguucuuuauuuuuggcauguaugccuuuuuauuuucauucaau

SEQ ID NO: 692240 - RNA, 64 nt, hsa
ugcaguuuuuauaaaacauuuuuaaaacacaaauggcauguaugcuaaugagauuuacccgugu

SEQ ID NO: 692241 - RNA, 64 nt, hsa
uacacauguugaauuuauuauuguuuauuuccaaggcauguauuauucaauuucuaauuaaaau

SEQ ID NO: 692242 - RNA, 64 nt, hsa
aucucuaauuuauggucuauauaccaauuuaaauggcauguaaaccugccuguuucuucuccuc

SEQ ID NO: 692243 - RNA, 64 nt, hsa
aaauauuugcucccaggagaacuccugaccagugggcauguauuccuauuuuauccuaagauuu

SEQ ID NO: 692244 - RNA, 64 nt, hsa
cuucaaccuuagccuccugaguagccaggacuauggcauguaccaccgcaccugccucacauuu

SEQ ID NO: 692245 - RNA, 64 nt, hsa
ccacccuuucgucaccucuuccacagagcacuuuggcauguaaacaagcaagagcacugccucu

SEQ ID NO: 692246 - RNA, 64 nt, hsa
uaaacaggaguucagcggagcuagcagaagacaaggcauguagggggagccauucugucccagg

SEQ ID NO: 692247 - RNA, 64 nt, hsa
agucuagcucugcucaugaaugaacaaagaagcaggcauguaaaauggauccuuguccuaacgu

SEQ ID NO: 692248 - RNA, 64 nt, hsa
agcaaagcaaacagcuacauuaucuuuaacauaaggcauguagccauauuuucauauaguggua

SEQ ID NO: 692249 - RNA, 64 nt, hsa
gccuggccaacauggugaaaccccaucucuccugggcauguagucccagcuacucgggaggcug

SEQ ID NO: 692250 - RNA, 64 nt, hsa
ucugcuccccacuuuguagagccuagcaugagguggcauguacuagaauuggauccuaggugcu

SEQ ID NO: 692251 - RNA, 50 nt, hsa
aaguggcgcaaaguuucugaggcauguaugaugggugcaaaugaauguca

SEQ ID NO: 692252 - RNA, 64 nt, hsa
aaucgacuuuauaucuuagucacggaguugccauggcauguaguagaaaaccacaggaagaaug

SEQ ID NO: 692253 - RNA, 64 nt, hsa
uuuuuaaugcagaaguuugaaugaagcaagggaaggcauguagggacaggaaaggaaacaaugg

SEQ ID NO: 692254 - RNA, 64 nt, hsa
uccauuucuuacacacacugccagagauacucuaggcauguaaagcacaaacauacauauaaaa

SEQ ID NO: 692255 - RNA, 64 nt, hsa
cccucuagguccagggacuaucacagaagaagcaggcauguaagauuuuaaggacugguuucga

SEQ ID NO: 692256 - RNA, 64 nt, hsa
uuccccccuaccgccucaccucacaggagggccaggcauguauuccucagaggcgaaacugcca

SEQ ID NO: 692257 - RNA, 64 nt, hsa
agauuagacacuugaaguacucaggauagugccuggcauguaggaagcaccuggaaaauauucg

SEQ ID NO: 692258 - RNA, 64 nt, hsa
ugcaggguggugcugggacugagccagucccaggggcauguauuggccuggaggugggguuggg

SEQ ID NO: 692259 - RNA, 64 nt, hsa
gcuuaugaacuaaaauuucuaacauuaacauuucggcauguaauaaaacaagggccuaucuccu

SEQ ID NO: 692260 - RNA, 64 nt, hsa
guuuauuaaacaguuauaaauaugcaaaguagcuggcauguagugucacggauuuucuggauag

SEQ ID NO: 692261 - RNA, 64 nt, hsa
acagaaggaaagccauagcgcucucuugccccuuggcauguaccccaaggccugauggccacug

SEQ ID NO: 692262 - RNA, 64 nt, hsa
ccugcugggugaggacgagacuguuuccaucucaggcauguaucccaccaagugccucccucac

SEQ ID NO: 692263 - RNA, 64 nt, hsa
auaccaucauuuuuuaacugagugaaauuauuaaggcauguaauacauuaaugaacauaauaua

SEQ ID NO: 692264 - RNA, 64 nt, hsa
uuugccucauuacaucuaauaguucccauuugauggcauguauagggaagagugagagagugug

SEQ ID NO: 692265 - RNA, 64 nt, hsa
uuuuuuugugccuugugcccuugaggugaccucuggcauguauccuggugguucuuacaucccc

SEQ ID NO: 692266 - RNA, 64 nt, hsa
uuuccacauuggcacauucacuucucccacucuuggcauguaagaaauaagcauuuacauaauu

SEQ ID NO: 692267 - RNA, 64 nt, hsa
cccuugacguuccgaggaugggaaaggugacaggggcauguauggaauuugcugcuucucuggg

SEQ ID NO: 692268 - RNA, 64 nt, hsa
auucuaacacauaauucuugaauucucuacuauuggcauguaacgaauuuaaauuuuuuauaac

SEQ ID NO: 692269 - RNA, 64 nt, hsa
agugcgcaacacccucagccucaugcauuccugcggcauguaugacuucucuggccaguuugcc

SEQ ID NO: 692270 - RNA, 64 nt, hsa
aaaaaugggaaguaagguccuggcaggcagacccggcauguagccgcuggccaucuugaauccu

SEQ ID NO: 692271 - RNA, 64 nt, hsa
aaauagcuccuuaaaaguacuguucuccuucaguggcauguaguuaucuaaucaagacaccuca

SEQ ID NO: 692272 - RNA, 64 nt, hsa
aagaucucugaagaauuucuuuuauaauagaaugggcauguauuguaacaguuuuaugucaaau

SEQ ID NO: 692273 - RNA, 64 nt, hsa
guaccguguuuuuguuagguacagucuggaucauggcauguagaaauagaaauuuagaauuuua

SEQ ID NO: 692274 - RNA, 64 nt, hsa
caguuaaaaaaaaaacaaccuuuucuuucaauauggcauguaguggaguuuuuuuaacuuuaaa

SEQ ID NO: 692275 - RNA, 64 nt, hsa
aaauuugacaacauaguuucuuaauaaaugauauggcauguacuuucaauuauguagcuuugua

SEQ ID NO: 692276 - RNA, 64 nt, hsa
ucagaaagaugucuuucugguuuuaacgcaugcaggcauguaaauauuugucuggagucacagu

SEQ ID NO: 692277 - RNA, 64 nt, hsa
agugagucauaucuuaauauauuucuaaauguuuggcauguaaauguaaacucagcaucaaaau

SEQ ID NO: 692278 - RNA, 64 nt, hsa
uauucauuucugcucaaucuguuaacaggcuucuggcauguagaucaguggucuccaagcuuuu

SEQ ID NO: 692279 - RNA, 64 nt, hsa
uuuacccuuuacuuauuaguuaaaaggaaaccaaggcauguaggaaaauauugguacguuggaa

SEQ ID NO: 692280 - RNA, 64 nt, hsa
gagguuaauuucugcucaagugguaccacuuaaaggcauguauucuuuuaguauguaaaaugaa

SEQ ID NO: 692281 - RNA, 64 nt, hsa
cagagguauucaguuccuggcacaggggacuaggggcauguagaguauaugaggaggcaguaug

SEQ ID NO: 692282 - RNA, 64 nt, hsa
uuccacuucagccucccaaguagcugggacuacaggcauguaacaccauacuuggcuaaauuaa

SEQ ID NO: 692283 - RNA, 64 nt, hsa
ucccauguuuauacucuucccacacuguagauauggcauguacuuuacacuauuuauaaugacu

SEQ ID NO: 692284 - RNA, 64 nt, hsa
augauugacuaugcccaucccuggggguaauuuuggcauguauaccuguaacuaguaauuaaca

SEQ ID NO: 692285 - RNA, 64 nt, hsa
guauagcagcuaaaagaguuuaguuuguuuauauggcauguauaaguuuucaauaaaugccuaa

SEQ ID NO: 692286 - RNA, 64 nt, hsa
uguccacccaggaguggccuuguuaauuccaaguggcauguaucuucccucugagcuucauuuc

SEQ ID NO: 692287 - RNA, 64 nt, hsa
ccaggaagauggaauacaccaaauggacaggccuggcauguacccacagagacugagaguuggu

SEQ ID NO: 692288 - RNA, 64 nt, hsa
ugggugugucagcguggcagccacguggaagcagggcauguagcaggccaggccacgggcuugc

SEQ ID NO: 692289 - RNA, 64 nt, hsa
ggugacuguggccuugaagccuggaggacuguugggcauguagacuggcaccuugaagauucac

SEQ ID NO: 692290 - RNA, 64 nt, hsa
uccugccucagccuccugaguagcuggcacuguaggcauguaccaccaugcccagcuaauuuuu

SEQ ID NO: 692291 - RNA, 64 nt, hsa
cuauauuuugucuuuuuuuaguucagacagcaaaggcauguacuacuauaaaauacaaagugau

SEQ ID NO: 692292 - RNA, 64 nt, hsa
cagcagcucucgcauccacuucaggguggcguguggcauguaggaguccugcuucuuuguacau

SEQ ID NO: 692293 - RNA, 64 nt, hsa
uucacuuuugucuuauuuucuuuuaagguguauuggcauguaauuugcauagagaagguccucu

SEQ ID NO: 692294 - RNA, 64 nt, hsa
accccuccuuucccagguuucuagaauagugucuggcauguaguagaugcucaauaaacacuug

SEQ ID NO: 692295 - RNA, 64 nt, hsa
agacuguucccaaagcuuguugggcuccuuaaauggcauguacaauuuaagugcaaagacaggg

SEQ ID NO: 692296 - RNA, 64 nt, hsa
ugaacauacauuuccugcauauauauguaugaagggcauguauauguaugaaugagcaaacaua

SEQ ID NO: 692297 - RNA, 64 nt, hsa
gucaaacccaagaccagccccaaggccagaccaaggcauguaggccugggcagguggcucgggg

SEQ ID NO: 692298 - RNA, 64 nt, hsa
uuagaagauauauuaagguguuccugguaaugaaggcauguaaguuauaauaauuguagcuuuc

SEQ ID NO: 692299 - RNA, 64 nt, hsa
cuccagucucagcucccaaguagcugggauuacaggcauguacuaccaugccuggcuaauuuuc

SEQ ID NO: 692300 - RNA, 64 nt, hsa
auuugauuaugcaccuaagaauaaaugguauuugggcauguauucccaauauguguauauuuau

SEQ ID NO: 692301 - RNA, 64 nt, hsa
agcauggucaaccucuagugagagcucucuuccuggcauguaagugcccacuuccucauguuuu

SEQ ID NO: 692302 - RNA, 64 nt, hsa
cugacaccauaugagaaccuuuguauaaaauauuggcauguaaacagcacagacaccguaacac

SEQ ID NO: 692303 - RNA, 64 nt, hsa
uaucacacaggcuuucaggacagacuuguaaccuggcauguaccuauugacuguauccucaugc

SEQ ID NO: 692304 - RNA, 64 nt, hsa
uacugcucuguguuuacagacgugugcaguuguaggcauguagcuacaggacauuuuuaagggc

SEQ ID NO: 692305 - RNA, 64 nt, hsa
ucaaagggcuagaacucuccaaggucuugcccccggcauguagcaccaccugagccagaaacug

SEQ ID NO: 692306 - RNA, 64 nt, hsa
aacaguuagacauugaggggcuucacuguuaccaggcauguaacagaaggaggaagacuaacac

SEQ ID NO: 692307 - RNA, 64 nt, hsa
uccugccucagccuccugaguagcugggauuacaggcauguaccaccacacccagcuaauuuug

SEQ ID NO: 692308 - RNA, 64 nt, hsa
gccuuugcugugcccuguggccuggccgcagugaggcauguaucuguaguuccuugcugaguaa

SEQ ID NO: 692309 - RNA, 64 nt, hsa
agauaugaguuaagagcugccagauuuauuuuaaggcauguagagaaucucauaaucuauguga

SEQ ID NO: 692310 - RNA, 64 nt, hsa
uuugaaucuguaaauauuuuaaauguuuuauuaaggcauguaauaaacuauucuuugaaacuug

SEQ ID NO: 692311 - RNA, 64 nt, hsa
caggaaaauuaaggcuucucuuaaacacuaaaaaggcauguaauugcuuguuagcaaaauggau

SEQ ID NO: 692312 - RNA, 64 nt, hsa
agauguccccgcuucccuccagccccccauccuuggcauguauauuaguaggagggcuucacac

SEQ ID NO: 692313 - RNA, 64 nt, hsa
cuguccagggacagcgaagcuggggguggcggggggcauguaccacaggguggcagcagggaaa

SEQ ID NO: 692314 - RNA, 64 nt, hsa
augccuguccucccucugcaagcucuguccucauggcauguacuuucucaggaaccuuucaagc

SEQ ID NO: 692315 - RNA, 64 nt, hsa
uaauuugugguacgauauugcuuauugugacuuuggcauguauuuuugcuagcaaaaugcugua

SEQ ID NO: 692316 - RNA, 64 nt, hsa
augugcauuuugaaaacagaaaacaaauugcguuggcauguacgugggugggaagaaaaagaaa

SEQ ID NO: 692317 - RNA, 64 nt, hsa
cuccuuauggagaacuauuuauuauacacuccaaggcauguagaacuguaauaagugaauuaca

SEQ ID NO: 692318 - RNA, 64 nt, hsa
cauuccauuuauuuguaguggauuuccucuggagggcauguacccacacuaaauaccaacugcu

SEQ ID NO: 692319 - RNA, 64 nt, hsa
uccuguugcaguugggcucaucaucgucauagcuggcauguaccuggcucuggccaggugcuag

SEQ ID NO: 692320 - RNA, 64 nt, hsa; identical to SEQ ID NO: 76855

SEQ ID NO: 692321 - RNA, 64 nt, hsa; identical to SEQ ID NO: 76856

SEQ ID NO: 692322 - RNA, 64 nt, hsa; identical to SEQ ID NO: 76857

SEQ ID NO: 692323 - RNA, 64 nt, hsa; identical to SEQ ID NO: 76858

SEQ ID NO: 692324 - RNA, 64 nt, hsa; identical to SEQ ID NO: 76859

SEQ ID NO: 692325 - RNA, 64 nt, hsa; identical to SEQ ID NO: 76860

SEQ ID NO: 692326 - RNA, 64 nt, hsa; identical to SEQ ID NO: 76861

SEQ ID NO: 692327 - RNA, 64 nt, hsa; identical to SEQ ID NO: 76862

SEQ ID NO: 692328 - RNA, 64 nt, hsa; identical to SEQ ID NO: 76863

SEQ ID NO: 692329 - RNA, 64 nt, hsa; identical to SEQ ID NO: 76864

SEQ ID NO: 692330 - RNA, 64 nt, hsa; identical to SEQ ID NO: 76865

SEQ ID NO: 692331 - RNA, 64 nt, hsa; identical to SEQ ID NO: 76866

SEQ ID NO: 692332 - RNA, 64 nt, hsa; identical to SEQ ID NO: 76867

SEQ ID NO: 692333 - RNA, 64 nt, hsa; identical to SEQ ID NO: 76868

SEQ ID NO: 692334 - RNA, 64 nt, hsa; identical to SEQ ID NO: 76869

SEQ ID NO: 692335 - RNA, 64 nt, hsa; identical to SEQ ID NO: 76870

SEQ ID NO: 692336 - RNA, 64 nt, hsa
aauguuuuuaggcuuaauucauucaauugucaaguacacuuagucuuaauacacucagguuuga

SEQ ID NO: 692337 - RNA, 64 nt, hsa
ggacugagugcugcuaucuugaaaugugcacagguacacuuaccuuuuuuuuuuuuuuuuuuaa

SEQ ID NO: 692338 - RNA, 64 nt, hsa
agcccucagaaucagggccagggaugcagaagauugagaggauauggagauggauagagggcag

SEQ ID NO: 692339 - RNA, 64 nt, hsa
cccaggccaggguugcugggaugccugccccuccugagaggacccccuccccauugucaggcuc

SEQ ID NO: 692340 - RNA, 64 nt, hsa
gacuuucaaggaacauauaauguagucagaaagaugagaggauuaguuauacaauuuaaggaag

SEQ ID NO: 692341 - RNA, 64 nt, hsa
aguuuuaugaucacagccuaucuuacuuaagguuugagaggaaaccugucaccucugcaauugu

SEQ ID NO: 692342 - RNA, 64 nt, hsa
gaaagagagggacagagagauaaaagaaauugggugagaggagauagguagcuccauaaggcac

SEQ ID NO: 692343 - RNA, 64 nt, hsa
auuuagaagaaugcuuuuugauccuccuggaauaugagaggaugggaggcccuuuagaaccugc

SEQ ID NO: 692344 - RNA, 64 nt, hsa
cccagaguggaggaguuagacuugccucgugggaugagaggaguuguggcuuugugucugcugg

SEQ ID NO: 692345 - RNA, 64 nt, hsa
gugcacauaugcauauauuuuguguucauucuacugagaggaccuaaacacaaugacaccucag

SEQ ID NO: 692346 - RNA, 64 nt, hsa
gugaaugaugugcuaccaaguauaugccaggcugugagaggauuauacugaguaguagaaagaa

SEQ ID NO: 692347 - RNA, 64 nt, hsa
gguauuagagauucaguguauguauuuauuuacaugagaggaaacuggaauauaaucccauaaa

SEQ ID NO: 692348 - RNA, 64 nt, hsa
cucacuuaaaucuaggugcuucaauucacuuucuugagaggacaaaugaaaagcuguggagaaa

SEQ ID NO: 692349 - RNA, 64 nt, hsa
uuuuacgcuuugcauauauaauuuauggagguguugagaggauagauuagacacuugaaguacu

SEQ ID NO: 692350 - RNA, 64 nt, hsa
augaaaccaggaauggacuuggaguucaacaggcugagaggaugccuccaauggaccagagagc

SEQ ID NO: 692351 - RNA, 64 nt, hsa
ccuacucccugcugugaaacaaucccucucccugugagaggaaacuguggagcguuucuuaucg

SEQ ID NO: 692352 - RNA, 64 nt, hsa
caccccuggccaucacucauguguaguccagguuugagaggaacuggaaggggggugagggugg

SEQ ID NO: 692353 - RNA, 64 nt, hsa
ccugugauucucccagcccuugcaguccgcuaggugagaggaaaagcucuuuacuuccgccccu

SEQ ID NO: 692354 - RNA, 64 nt, hsa
gaggaugaggggagccuacgccucaggcauguggugagaggaugagggggagggagccaacgcc

SEQ ID NO: 692355 - RNA, 64 nt, hsa
ggaaguagaggcugggagcaaaugccccaugcggugagaggaugaggggagccuacgccucagg

SEQ ID NO: 692356 - RNA, 64 nt, hsa; identical to SEQ ID NO: 64767

SEQ ID NO: 692357 - RNA, 64 nt, hsa; identical to SEQ ID NO: 64768

SEQ ID NO: 692358 - RNA, 64 nt, hsa; identical to SEQ ID NO: 64769

SEQ ID NO: 692359 - RNA, 64 nt, hsa; identical to SEQ ID NO: 64770

SEQ ID NO: 692360 - RNA, 64 nt, hsa; identical to SEQ ID NO: 64771

SEQ ID NO: 692361 - RNA, 64 nt, hsa; identical to SEQ ID NO: 64772

SEQ ID NO: 692362 - RNA, 64 nt, hsa; identical to SEQ ID NO: 64773

SEQ ID NO: 692363 - RNA, 64 nt, hsa; identical to SEQ ID NO: 64774

SEQ ID NO: 692364 - RNA, 64 nt, hsa; identical to SEQ ID NO: 64775

SEQ ID NO: 692365 - RNA, 64 nt, hsa; identical to SEQ ID NO: 64776

SEQ ID NO: 692366 - RNA, 64 nt, hsa; identical to SEQ ID NO: 64777

SEQ ID NO: 692367 - RNA, 64 nt, hsa; identical to SEQ ID NO: 64778

SEQ ID NO: 692368 - RNA, 64 nt, hsa; identical to SEQ ID NO: 64779

SEQ ID NO: 692369 - RNA, 64 nt, hsa; identical to SEQ ID NO: 64780

SEQ ID NO: 692370 - RNA, 64 nt, hsa; identical to SEQ ID NO: 64781

SEQ ID NO: 692371 - RNA, 64 nt, hsa; identical to SEQ ID NO: 64782

SEQ ID NO: 692372 - RNA, 64 nt, hsa; identical to SEQ ID NO: 64783

SEQ ID NO: 692373 - RNA, 64 nt, hsa; identical to SEQ ID NO: 64784

SEQ ID NO: 692374 - RNA, 64 nt, hsa; identical to SEQ ID NO: 64785

SEQ ID NO: 692375 - RNA, 64 nt, hsa; identical to SEQ ID NO: 64786

SEQ ID NO: 692376 - RNA, 64 nt, hsa; identical to SEQ ID NO: 64787

SEQ ID NO: 692377 - RNA, 64 nt, hsa; identical to SEQ ID NO: 64788

SEQ ID NO: 692378 - RNA, 64 nt, hsa; identical to SEQ ID NO: 64789

SEQ ID NO: 692379 - RNA, 64 nt, hsa; identical to SEQ ID NO: 64790

SEQ ID NO: 692380 - RNA, 64 nt, hsa; identical to SEQ ID NO: 64791

SEQ ID NO: 692381 - RNA, 64 nt, hsa; identical to SEQ ID NO: 64792

SEQ ID NO: 692382 - RNA, 64 nt, hsa; identical to SEQ ID NO: 64793

SEQ ID NO: 692383 - RNA, 64 nt, hsa; identical to SEQ ID NO: 64794

SEQ ID NO: 692384 - RNA, 64 nt, hsa; identical to SEQ ID NO: 64795

SEQ ID NO: 692385 - RNA, 64 nt, hsa; identical to SEQ ID NO: 64796

SEQ ID NO: 692386 - RNA, 64 nt, hsa; identical to SEQ ID NO: 64797

SEQ ID NO: 692387 - RNA, 64 nt, hsa; identical to SEQ ID NO: 64798

SEQ ID NO: 692388 - RNA, 64 nt, hsa; identical to SEQ ID NO: 64799

SEQ ID NO: 692389 - RNA, 64 nt, hsa; identical to SEQ ID NO: 64800

SEQ ID NO: 692390 - RNA, 64 nt, hsa; identical to SEQ ID NO: 64801

SEQ ID NO: 692391 - RNA, 64 nt, hsa; identical to SEQ ID NO: 64802

SEQ ID NO: 692392 - RNA, 64 nt, hsa; identical to SEQ ID NO: 64803

SEQ ID NO: 692393 - RNA, 64 nt, hsa; identical to SEQ ID NO: 45461

SEQ ID NO: 692394 - RNA, 64 nt, hsa; identical to SEQ ID NO: 45462

SEQ ID NO: 692395 - RNA, 64 nt, hsa
uccccugcagucuggguucccagacugaguccucuccccaaaucagggcucuagacccgagccc

SEQ ID NO: 692396 - RNA, 64 nt, hsa
uucugggcuccaggauugucuccccacuccagcauccccaaacugguacucccugacccagggc

SEQ ID NO: 692397 - RNA, 64 nt, hsa
ugugucccccacagcucaugcguuggaaacuuaauccccaaagcaacagcuuugagaggugaga

SEQ ID NO: 692398 - RNA, 64 nt, hsa
guuccugauaaaaggaugaguucggccuucuucuuccccaaaaucuuuauccccacccccaccu

SEQ ID NO: 692399 - RNA, 64 nt, hsa
cagauugugcgcacacucguuuccgaacugccucuccccaaagaaugugaggcauugucaccuu

SEQ ID NO: 692400 - RNA, 64 nt, hsa
aggaaauguucucaauugagcaauucagucccucuccccaaagacuagacgugaccuggcagau

SEQ ID NO: 692401 - RNA, 64 nt, hsa
uuucuucuaagccuguguguuauaauuuaccaguuccccaaaaugccauuuuuaacgccgaacu

SEQ ID NO: 692402 - RNA, 64 nt, hsa
guaaauaaaauaaaaaauauuugucuccaccuuuuccccaaaagcaacagcaagacauauuuug

SEQ ID NO: 692403 - RNA, 64 nt, hsa
cacacacacacacacacauacauccugcuuucccuccccaaacccaucagacagguaaaugggc

SEQ ID NO: 692404 - RNA, 64 nt, hsa
cagucucucucucccuuuuaaauggugggaacccuccccaaaaccuuuccccagacacauucuc

SEQ ID NO: 692405 - RNA, 64 nt, hsa
accauguggccuaagagcucuggggagcccacacuccccaaagcaguuagacuauggagagccg

SEQ ID NO: 692406 - RNA, 64 nt, hsa
cauuauuaaagaucauauggggaaaaugaaacccuccccaaaauacaagaaguucugggaggag

SEQ ID NO: 692407 - RNA, 64 nt, hsa
ugaagcuuuuugagggcaaacuuuaccuuugugguccccaaaugauggcauuucucuuugaaau

SEQ ID NO: 692408 - RNA, 64 nt, hsa
uuguuuacuucuaaacccacuuggguaguuacuauccccaaaucuguucuguaaauaauauuau

SEQ ID NO: 692409 - RNA, 64 nt, hsa
ugcuuugggaacuguguuuauugccuauaauggguccccaaaauggguaaccuagacuucagag

SEQ ID NO: 692410 - RNA, 64 nt, hsa
agaucuggucuuuuuuuuuuuuuuuuuuuccgucuccccaaagcuuuaucugucuugacuuuuu

SEQ ID NO: 692411 - RNA, 64 nt, hsa
ccuucuuauuuuggcauucgauaucagcagccucuccccaaaguacuugaagucaguuuuagau

SEQ ID NO: 692412 - RNA, 64 nt, hsa
cauggcugcugcuuucugcccagcucgccaguccuccccaaagaguugcgcaucagcaccuggg

SEQ ID NO: 692413 - RNA, 64 nt, hsa
guaauaaucguuuuuguuuucuuguacuuugaauuccccaaagucuuaauugcuuuauuuuggu

SEQ ID NO: 692414 - RNA, 64 nt, hsa
cuagccccaguuuugacagaauaauucuuggucuuccccaaagagacaauuuguuguacccaug

SEQ ID NO: 692415 - RNA, 64 nt, hsa
auucaucccuuaauguucucaaggaggcccaggauccccaaaauauuauaagcauugcagucag

SEQ ID NO: 692416 - RNA, 64 nt, hsa
uaauauaugauccauauucaaaauucuccaguuguccccaaaauauccuuuauagcuguuuauu

SEQ ID NO: 692417 - RNA, 64 nt, hsa
uuacuuuccacuuugcccccuguccucucuguguuccccaaaucagagaauagcccgccauccc

SEQ ID NO: 692418 - RNA, 64 nt, hsa
aagaucugucuuuccaauggccgggggcauuugguccccaaauuaaggcuauuggacaucugca

SEQ ID NO: 692419 - RNA, 64 nt, hsa
gaccagaauuuuuuaucuagagaccagcauguucuccccaaagaccaagauauucugccaaaau

SEQ ID NO: 692420 - RNA, 64 nt, hsa
gaccagaauuuuuugucuagagaccagcauguucuccccaaagaccagaauauucuaccuaaau

SEQ ID NO: 692421 - RNA, 64 nt, hsa
gaccaggacuuuuuaucuagagaccagcauguucuccccaaagacuggaauauucuacccaaau

SEQ ID NO: 692422 - RNA, 64 nt, hsa
cauucaggaaauaucgacagggcuacacgugauguccccaaacugcugcuauugaagaacuucc

SEQ ID NO: 692423 - RNA, 64 nt, hsa
uaaggcaagaauaugccccaacuaaagcauagauuccccaaagugaggcucauggugggaggcc

SEQ ID NO: 692424 - RNA, 64 nt, hsa
gccagucaccacacaaggcacuggguauaugguauccccaaacaagagacauaaucccgguccu

SEQ ID NO: 692425 - RNA, 64 nt, hsa
gucuccuuuccacugcuauuagucauggucacucuccccaaaauauuauauuuuuucuauaaaa

SEQ ID NO: 692426 - RNA, 64 nt, hsa
agggggaagccaauggccugucuccccacuaccauccccaaacgcuccuuggggcgugguuccu

SEQ ID NO: 692427 - RNA, 64 nt, hsa
gagaauguuuugaaaggccagaggguggccuuuuuccccaaacaguuugguuccuuuuauguuu

SEQ ID NO: 692428 - RNA, 64 nt, hsa
gcuggccuugugcagacccuggacugcauccgguuccccaaagcccugcugcauucgagugucc

SEQ ID NO: 692429 - RNA, 64 nt, hsa
ggccagggccccuguucuagggguuaggguucuuuccccaaaggaacuuaaaaagacaagcgug

SEQ ID NO: 692430 - RNA, 64 nt, hsa
acccaagccccgugcuagcagcgcuccgugcucuuccccaaauacucacggcucuaauucccca

SEQ ID NO: 692431 - RNA, 64 nt, hsa
uccgugcucuuccccaaauacucacggcucuaauuccccaaaccugaaacuucauacccuggga

SEQ ID NO: 692432 - RNA, 64 nt, hsa
cugugcuacuucaacauagagauuggacaugcucuccccaaaugagccacuuuccucuccaggu

SEQ ID NO: 692433 - RNA, 64 nt, hsa
ugaccucuugcacaagccuaaauuccaggaaucuuccccaaaucccagauccucugcaaucuac

SEQ ID NO: 692434 - RNA, 64 nt, hsa; identical to SEQ ID NO: 156063

SEQ ID NO: 692435 - RNA, 64 nt, hsa; identical to SEQ ID NO: 156064

SEQ ID NO: 692436 - RNA, 64 nt, hsa; identical to SEQ ID NO: 156065

SEQ ID NO: 692437 - RNA, 64 nt, hsa; identical to SEQ ID NO: 156066

SEQ ID NO: 692438 - RNA, 64 nt, hsa; identical to SEQ ID NO: 156067

SEQ ID NO: 692439 - RNA, 64 nt, hsa; identical to SEQ ID NO: 156068

SEQ ID NO: 692440 - RNA, 64 nt, hsa; identical to SEQ ID NO: 156069

SEQ ID NO: 692441 - RNA, 64 nt, hsa; identical to SEQ ID NO: 156070

SEQ ID NO: 692442 - RNA, 64 nt, hsa; identical to SEQ ID NO: 156071

SEQ ID NO: 692443 - RNA, 64 nt, hsa; identical to SEQ ID NO: 156072

SEQ ID NO: 692444 - RNA, 64 nt, hsa; identical to SEQ ID NO: 156073

SEQ ID NO: 692445 - RNA, 64 nt, hsa; identical to SEQ ID NO: 156074

SEQ ID NO: 692446 - RNA, 64 nt, hsa; identical to SEQ ID NO: 156075

SEQ ID NO: 692447 - RNA, 64 nt, hsa; identical to SEQ ID NO: 156076

SEQ ID NO: 692448 - RNA, 64 nt, hsa; identical to SEQ ID NO: 156077

SEQ ID NO: 692449 - RNA, 64 nt, hsa; identical to SEQ ID NO: 156078

SEQ ID NO: 692450 - RNA, 64 nt, hsa; identical to SEQ ID NO: 156079

SEQ ID NO: 692451 - RNA, 64 nt, hsa; identical to SEQ ID NO: 156080

SEQ ID NO: 692452 - RNA, 64 nt, hsa; identical to SEQ ID NO: 156081

SEQ ID NO: 692453 - RNA, 64 nt, hsa; identical to SEQ ID NO: 156082

SEQ ID NO: 692454 - RNA, 64 nt, hsa; identical to SEQ ID NO: 156083

SEQ ID NO: 692455 - RNA, 64 nt, hsa; identical to SEQ ID NO: 156084

SEQ ID NO: 692456 - RNA, 64 nt, hsa; identical to SEQ ID NO: 156085

SEQ ID NO: 692457 - RNA, 64 nt, hsa; identical to SEQ ID NO: 156086

SEQ ID NO: 692458 - RNA, 64 nt, hsa; identical to SEQ ID NO: 156087

SEQ ID NO: 692459 - RNA, 64 nt, hsa; identical to SEQ ID NO: 156088

SEQ ID NO: 692460 - RNA, 64 nt, hsa; identical to SEQ ID NO: 156089

SEQ ID NO: 692461 - RNA, 64 nt, hsa; identical to SEQ ID NO: 156090

SEQ ID NO: 692462 - RNA, 64 nt, hsa; identical to SEQ ID NO: 156091

SEQ ID NO: 692463 - RNA, 64 nt, hsa; identical to SEQ ID NO: 156092

SEQ ID NO: 692464 - RNA, 64 nt, hsa; identical to SEQ ID NO: 156093

SEQ ID NO: 692465 - RNA, 64 nt, hsa; identical to SEQ ID NO: 156094

SEQ ID NO: 692466 - RNA, 64 nt, hsa; identical to SEQ ID NO: 156095

SEQ ID NO: 692467 - RNA, 64 nt, hsa; identical to SEQ ID NO: 156096

SEQ ID NO: 692468 - RNA, 64 nt, hsa; identical to SEQ ID NO: 156097

SEQ ID NO: 692469 - RNA, 64 nt, hsa; identical to SEQ ID NO: 156098

SEQ ID NO: 692470 - RNA, 64 nt, hsa; identical to SEQ ID NO: 156099

SEQ ID NO: 692471 - RNA, 64 nt, hsa; identical to SEQ ID NO: 156100

SEQ ID NO: 692472 - RNA, 64 nt, hsa; identical to SEQ ID NO: 156101

SEQ ID NO: 692473 - RNA, 64 nt, hsa; identical to SEQ ID NO: 156102

SEQ ID NO: 692474 - RNA, 64 nt, hsa; identical to SEQ ID NO: 156103

SEQ ID NO: 692475 - RNA, 64 nt, hsa; identical to SEQ ID NO: 156104

SEQ ID NO: 692476 - RNA, 64 nt, hsa; identical to SEQ ID NO: 156105

SEQ ID NO: 692477 - RNA, 64 nt, hsa; identical to SEQ ID NO: 156106

SEQ ID NO: 692478 - RNA, 64 nt, hsa; identical to SEQ ID NO: 156107

SEQ ID NO: 692479 - RNA, 64 nt, hsa; identical to SEQ ID NO: 156108

SEQ ID NO: 692480 - RNA, 64 nt, hsa; identical to SEQ ID NO: 156109

SEQ ID NO: 692481 - RNA, 64 nt, hsa; identical to SEQ ID NO: 156110

SEQ ID NO: 692482 - RNA, 64 nt, hsa; identical to SEQ ID NO: 156111

SEQ ID NO: 692483 - RNA, 64 nt, hsa
uaaagccuuuuuuuaggccacauugacaguggugggcggggagaagauagggaacacucauccc

SEQ ID NO: 692484 - RNA, 64 nt, hsa
ccucugggcagcgcuaucuagauagguaagugggggcggggaagggugcauagcuguuuuagcu

SEQ ID NO: 692485 - RNA, 64 nt, hsa
ugggagucaggggaauagaugugacuaguucaggggcggggacucccaggccucaguguggcag

SEQ ID NO: 692486 - RNA, 64 nt, hsa
ccagccccagccccagugggcaagaccaaaguguggcggggaguggggugggagucaggggaau

SEQ ID NO: 692487 - RNA, 64 nt, hsa
gcuugugggaggauuuggaaggagcugcauugugggcggggaguguguggguuggguucguacc

SEQ ID NO: 692488 - RNA, 64 nt, hsa
ccuuucccacuugaggacccuggggagagaugggggcggggaaaauggagguaugaauuugggg

SEQ ID NO: 692489 - RNA, 64 nt, hsa
agcagggucaggagacggggcugacggcacggguggcggggacagacguuugggacuuggccgc

SEQ ID NO: 692490 - RNA, 64 nt, hsa
guugccaaagaguuggcuuuguuuauuugguuuuggcggggagaggagugguauuugaugcuuu

SEQ ID NO: 692491 - RNA, 64 nt, hsa
cuccucccacucauccagagacggccggugggcaggcggggagagcagcuuuccuucccuggag

SEQ ID NO: 692492 - RNA, 64 nt, hsa
cuaguauacauugaccucccguucccugcaugagggcggggaguucccccugcuccauccccca

SEQ ID NO: 692493 - RNA, 64 nt, hsa
ucccaacuccgggagagccucgccuggaugcuggggcggggaaggcccaguccccggggcucug

SEQ ID NO: 692494 - RNA, 64 nt, hsa
accgccccgguguuggcccucgccauggagcagaggcggggacagcuggccaccgugucccagg

SEQ ID NO: 692495 - RNA, 64 nt, hsa
aagcaggggggaucucccgcgcaggggcggcggcggcggggaccggucgccuggcgcugggcuc

SEQ ID NO: 692496 - RNA, 64 nt, hsa
ggcggucggaccccgccucccgagcccggggaggggcggggaggacaaggggcgggcccgcggc

SEQ ID NO: 692497 - RNA, 64 nt, hsa
gccaugucccgucucuauggugguugaggagaaaggcggggaagcuuccucagccuugcagaua

SEQ ID NO: 692498 - RNA, 64 nt, hsa
uagcaacgaaaaccugugcuuguguguguguggcggcggggagggaggauccuguuucccaccu

SEQ ID NO: 692499 - RNA, 64 nt, hsa; identical to SEQ ID NO: 84602

SEQ ID NO: 692500 - RNA, 64 nt, hsa; identical to SEQ ID NO: 84603

SEQ ID NO: 692501 - RNA, 64 nt, hsa; identical to SEQ ID NO: 84604

SEQ ID NO: 692502 - RNA, 64 nt, hsa; identical to SEQ ID NO: 84605

SEQ ID NO: 692503 - RNA, 64 nt, hsa; identical to SEQ ID NO: 84606

SEQ ID NO: 692504 - RNA, 64 nt, hsa; identical to SEQ ID NO: 84607

SEQ ID NO: 692505 - RNA, 64 nt, hsa; identical to SEQ ID NO: 84608

SEQ ID NO: 692506 - RNA, 64 nt, hsa; identical to SEQ ID NO: 84609

SEQ ID NO: 692507 - RNA, 64 nt, hsa; identical to SEQ ID NO: 84610

SEQ ID NO: 692508 - RNA, 64 nt, hsa; identical to SEQ ID NO: 84611

SEQ ID NO: 692509 - RNA, 64 nt, hsa; identical to SEQ ID NO: 84612

SEQ ID NO: 692510 - RNA, 64 nt, hsa; identical to SEQ ID NO: 84613

SEQ ID NO: 692511 - RNA, 64 nt, hsa; identical to SEQ ID NO: 84614

SEQ ID NO: 692512 - RNA, 64 nt, hsa; identical to SEQ ID NO: 84615

SEQ ID NO: 692513 - RNA, 64 nt, hsa; identical to SEQ ID NO: 84616

SEQ ID NO: 692514 - RNA, 64 nt, hsa; identical to SEQ ID NO: 84617

SEQ ID NO: 692515 - RNA, 64 nt, hsa; identical to SEQ ID NO: 84618

SEQ ID NO: 692516 - RNA, 64 nt, hsa; identical to SEQ ID NO: 84619

SEQ ID NO: 692517 - RNA, 64 nt, hsa; identical to SEQ ID NO: 84620

SEQ ID NO: 692518 - RNA, 64 nt, hsa; identical to SEQ ID NO: 84621

SEQ ID NO: 692519 - RNA, 64 nt, hsa; identical to SEQ ID NO: 84622

SEQ ID NO: 692520 - RNA, 64 nt, hsa; identical to SEQ ID NO: 84623

SEQ ID NO: 692521 - RNA, 64 nt, hsa; identical to SEQ ID NO: 84624

SEQ ID NO: 692522 - RNA, 64 nt, hsa; identical to SEQ ID NO: 84625

SEQ ID NO: 692523 - RNA, 64 nt, hsa; identical to SEQ ID NO: 84626

SEQ ID NO: 692524 - RNA, 64 nt, hsa; identical to SEQ ID NO: 84627

SEQ ID NO: 692525 - RNA, 64 nt, hsa; identical to SEQ ID NO: 84628

SEQ ID NO: 692526 - RNA, 64 nt, hsa; identical to SEQ ID NO: 84629

SEQ ID NO: 692527 - RNA, 64 nt, hsa; identical to SEQ ID NO: 84630

SEQ ID NO: 692528 - RNA, 64 nt, hsa; identical to SEQ ID NO: 84631

SEQ ID NO: 692529 - RNA, 64 nt, hsa; identical to SEQ ID NO: 578845

SEQ ID NO: 692530 - RNA, 64 nt, hsa; identical to SEQ ID NO: 578846

SEQ ID NO: 692531 - RNA, 64 nt, hsa; identical to SEQ ID NO: 84602

SEQ ID NO: 692532 - RNA, 64 nt, hsa; identical to SEQ ID NO: 84603

SEQ ID NO: 692533 - RNA, 64 nt, hsa; identical to SEQ ID NO: 84604

SEQ ID NO: 692534 - RNA, 64 nt, hsa; identical to SEQ ID NO: 84605

SEQ ID NO: 692535 - RNA, 64 nt, hsa; identical to SEQ ID NO: 84606

SEQ ID NO: 692536 - RNA, 64 nt, hsa; identical to SEQ ID NO: 84607

SEQ ID NO: 692537 - RNA, 64 nt, hsa; identical to SEQ ID NO: 84608

SEQ ID NO: 692538 - RNA, 64 nt, hsa; identical to SEQ ID NO: 84609

SEQ ID NO: 692539 - RNA, 64 nt, hsa; identical to SEQ ID NO: 84610

SEQ ID NO: 692540 - RNA, 64 nt, hsa; identical to SEQ ID NO: 84611

SEQ ID NO: 692541 - RNA, 64 nt, hsa; identical to SEQ ID NO: 84612

SEQ ID NO: 692542 - RNA, 64 nt, hsa; identical to SEQ ID NO: 84613

SEQ ID NO: 692543 - RNA, 64 nt, hsa; identical to SEQ ID NO: 84614

SEQ ID NO: 692544 - RNA, 64 nt, hsa; identical to SEQ ID NO: 84615

SEQ ID NO: 692545 - RNA, 64 nt, hsa; identical to SEQ ID NO: 84616

SEQ ID NO: 692546 - RNA, 64 nt, hsa; identical to SEQ ID NO: 84617

SEQ ID NO: 692547 - RNA, 64 nt, hsa; identical to SEQ ID NO: 84618

SEQ ID NO: 692548 - RNA, 64 nt, hsa; identical to SEQ ID NO: 84619

SEQ ID NO: 692549 - RNA, 64 nt, hsa; identical to SEQ ID NO: 84620

SEQ ID NO: 692550 - RNA, 64 nt, hsa; identical to SEQ ID NO: 84621

SEQ ID NO: 692551 - RNA, 64 nt, hsa; identical to SEQ ID NO: 84622

SEQ ID NO: 692552 - RNA, 64 nt, hsa; identical to SEQ ID NO: 84623

SEQ ID NO: 692553 - RNA, 64 nt, hsa; identical to SEQ ID NO: 84624

SEQ ID NO: 692554 - RNA, 64 nt, hsa; identical to SEQ ID NO: 84625

SEQ ID NO: 692555 - RNA, 64 nt, hsa; identical to SEQ ID NO: 84626

SEQ ID NO: 692556 - RNA, 64 nt, hsa; identical to SEQ ID NO: 84627

SEQ ID NO: 692557 - RNA, 64 nt, hsa; identical to SEQ ID NO: 84628

SEQ ID NO: 692558 - RNA, 64 nt, hsa; identical to SEQ ID NO: 84629

SEQ ID NO: 692559 - RNA, 64 nt, hsa; identical to SEQ ID NO: 84630

SEQ ID NO: 692560 - RNA, 64 nt, hsa; identical to SEQ ID NO: 84631

SEQ ID NO: 692561 - RNA, 64 nt, hsa; identical to SEQ ID NO: 578845

SEQ ID NO: 692562 - RNA, 64 nt, hsa; identical to SEQ ID NO: 578846

SEQ ID NO: 692563 - RNA, 64 nt, hsa; identical to SEQ ID NO: 84602

SEQ ID NO: 692564 - RNA, 64 nt, hsa; identical to SEQ ID NO: 84603

SEQ ID NO: 692565 - RNA, 64 nt, hsa; identical to SEQ ID NO: 84604

SEQ ID NO: 692566 - RNA, 64 nt, hsa; identical to SEQ ID NO: 84605

SEQ ID NO: 692567 - RNA, 64 nt, hsa; identical to SEQ ID NO: 84606

SEQ ID NO: 692568 - RNA, 64 nt, hsa; identical to SEQ ID NO: 84607

SEQ ID NO: 692569 - RNA, 64 nt, hsa; identical to SEQ ID NO: 84608

SEQ ID NO: 692570 - RNA, 64 nt, hsa; identical to SEQ ID NO: 84609

SEQ ID NO: 692571 - RNA, 64 nt, hsa; identical to SEQ ID NO: 84610

SEQ ID NO: 692572 - RNA, 64 nt, hsa; identical to SEQ ID NO: 84611

SEQ ID NO: 692573 - RNA, 64 nt, hsa; identical to SEQ ID NO: 84612

SEQ ID NO: 692574 - RNA, 64 nt, hsa; identical to SEQ ID NO: 84613

SEQ ID NO: 692575 - RNA, 64 nt, hsa; identical to SEQ ID NO: 84614

SEQ ID NO: 692576 - RNA, 64 nt, hsa; identical to SEQ ID NO: 84615

SEQ ID NO: 692577 - RNA, 64 nt, hsa; identical to SEQ ID NO: 84616

SEQ ID NO: 692578 - RNA, 64 nt, hsa; identical to SEQ ID NO: 84617

SEQ ID NO: 692579 - RNA, 64 nt, hsa; identical to SEQ ID NO: 84618

SEQ ID NO: 692580 - RNA, 64 nt, hsa; identical to SEQ ID NO: 84619

SEQ ID NO: 692581 - RNA, 64 nt, hsa; identical to SEQ ID NO: 84620

SEQ ID NO: 692582 - RNA, 64 nt, hsa; identical to SEQ ID NO: 84621

SEQ ID NO: 692583 - RNA, 64 nt, hsa; identical to SEQ ID NO: 84622

SEQ ID NO: 692584 - RNA, 64 nt, hsa; identical to SEQ ID NO: 84623

SEQ ID NO: 692585 - RNA, 64 nt, hsa; identical to SEQ ID NO: 84624

SEQ ID NO: 692586 - RNA, 64 nt, hsa; identical to SEQ ID NO: 84625

SEQ ID NO: 692587 - RNA, 64 nt, hsa; identical to SEQ ID NO: 84626

SEQ ID NO: 692588 - RNA, 64 nt, hsa; identical to SEQ ID NO: 84627

SEQ ID NO: 692589 - RNA, 64 nt, hsa; identical to SEQ ID NO: 84628

SEQ ID NO: 692590 - RNA, 64 nt, hsa; identical to SEQ ID NO: 84629

SEQ ID NO: 692591 - RNA, 64 nt, hsa; identical to SEQ ID NO: 84630

SEQ ID NO: 692592 - RNA, 64 nt, hsa; identical to SEQ ID NO: 84631

SEQ ID NO: 692593 - RNA, 64 nt, hsa; identical to SEQ ID NO: 578845

SEQ ID NO: 692594 - RNA, 64 nt, hsa; identical to SEQ ID NO: 578846

SEQ ID NO: 692595 - RNA, 64 nt, hsa; identical to SEQ ID NO: 84602

SEQ ID NO: 692596 - RNA, 64 nt, hsa; identical to SEQ ID NO: 84603

SEQ ID NO: 692597 - RNA, 64 nt, hsa; identical to SEQ ID NO: 84604

SEQ ID NO: 692598 - RNA, 64 nt, hsa; identical to SEQ ID NO: 84605

SEQ ID NO: 692599 - RNA, 64 nt, hsa; identical to SEQ ID NO: 84606

SEQ ID NO: 692600 - RNA, 64 nt, hsa; identical to SEQ ID NO: 84607

SEQ ID NO: 692601 - RNA, 64 nt, hsa; identical to SEQ ID NO: 84608

SEQ ID NO: 692602 - RNA, 64 nt, hsa; identical to SEQ ID NO: 84609

SEQ ID NO: 692603 - RNA, 64 nt, hsa; identical to SEQ ID NO: 84610

SEQ ID NO: 692604 - RNA, 64 nt, hsa; identical to SEQ ID NO: 84611

SEQ ID NO: 692605 - RNA, 64 nt, hsa; identical to SEQ ID NO: 84612

SEQ ID NO: 692606 - RNA, 64 nt, hsa; identical to SEQ ID NO: 84613

SEQ ID NO: 692607 - RNA, 64 nt, hsa; identical to SEQ ID NO: 84614

SEQ ID NO: 692608 - RNA, 64 nt, hsa; identical to SEQ ID NO: 84615

SEQ ID NO: 692609 - RNA, 64 nt, hsa; identical to SEQ ID NO: 84616

SEQ ID NO: 692610 - RNA, 64 nt, hsa; identical to SEQ ID NO: 84617

SEQ ID NO: 692611 - RNA, 64 nt, hsa; identical to SEQ ID NO: 84618

SEQ ID NO: 692612 - RNA, 64 nt, hsa; identical to SEQ ID NO: 84619

SEQ ID NO: 692613 - RNA, 64 nt, hsa; identical to SEQ ID NO: 84620

SEQ ID NO: 692614 - RNA, 64 nt, hsa; identical to SEQ ID NO: 84621

SEQ ID NO: 692615 - RNA, 64 nt, hsa; identical to SEQ ID NO: 84622

SEQ ID NO: 692616 - RNA, 64 nt, hsa; identical to SEQ ID NO: 84623

SEQ ID NO: 692617 - RNA, 64 nt, hsa; identical to SEQ ID NO: 84624

SEQ ID NO: 692618 - RNA, 64 nt, hsa; identical to SEQ ID NO: 84625

SEQ ID NO: 692619 - RNA, 64 nt, hsa; identical to SEQ ID NO: 84626

SEQ ID NO: 692620 - RNA, 64 nt, hsa; identical to SEQ ID NO: 84627

SEQ ID NO: 692621 - RNA, 64 nt, hsa; identical to SEQ ID NO: 84628

SEQ ID NO: 692622 - RNA, 64 nt, hsa; identical to SEQ ID NO: 84629

SEQ ID NO: 692623 - RNA, 64 nt, hsa; identical to SEQ ID NO: 84630

SEQ ID NO: 692624 - RNA, 64 nt, hsa; identical to SEQ ID NO: 84631

SEQ ID NO: 692625 - RNA, 64 nt, hsa; identical to SEQ ID NO: 578845

SEQ ID NO: 692626 - RNA, 64 nt, hsa; identical to SEQ ID NO: 578846

SEQ ID NO: 692627 - RNA, 64 nt, hsa; identical to SEQ ID NO: 84602

SEQ ID NO: 692628 - RNA, 64 nt, hsa; identical to SEQ ID NO: 84603

SEQ ID NO: 692629 - RNA, 64 nt, hsa; identical to SEQ ID NO: 84604

SEQ ID NO: 692630 - RNA, 64 nt, hsa; identical to SEQ ID NO: 84605

SEQ ID NO: 692631 - RNA, 64 nt, hsa; identical to SEQ ID NO: 84606

SEQ ID NO: 692632 - RNA, 64 nt, hsa; identical to SEQ ID NO: 84607

SEQ ID NO: 692633 - RNA, 64 nt, hsa; identical to SEQ ID NO: 84608

SEQ ID NO: 692634 - RNA, 64 nt, hsa; identical to SEQ ID NO: 84609

SEQ ID NO: 692635 - RNA, 64 nt, hsa; identical to SEQ ID NO: 84610

SEQ ID NO: 692636 - RNA, 64 nt, hsa; identical to SEQ ID NO: 84611

SEQ ID NO: 692637 - RNA, 64 nt, hsa; identical to SEQ ID NO: 84612

SEQ ID NO: 692638 - RNA, 64 nt, hsa; identical to SEQ ID NO: 84613

SEQ ID NO: 692639 - RNA, 64 nt, hsa; identical to SEQ ID NO: 84614

SEQ ID NO: 692640 - RNA, 64 nt, hsa; identical to SEQ ID NO: 84615

SEQ ID NO: 692641 - RNA, 64 nt, hsa; identical to SEQ ID NO: 84616

SEQ ID NO: 692642 - RNA, 64 nt, hsa; identical to SEQ ID NO: 84617

SEQ ID NO: 692643 - RNA, 64 nt, hsa; identical to SEQ ID NO: 84618

SEQ ID NO: 692644 - RNA, 64 nt, hsa; identical to SEQ ID NO: 84619

SEQ ID NO: 692645 - RNA, 64 nt, hsa; identical to SEQ ID NO: 84620

SEQ ID NO: 692646 - RNA, 64 nt, hsa; identical to SEQ ID NO: 84621

SEQ ID NO: 692647 - RNA, 64 nt, hsa; identical to SEQ ID NO: 84622

SEQ ID NO: 692648 - RNA, 64 nt, hsa; identical to SEQ ID NO: 84623

SEQ ID NO: 692649 - RNA, 64 nt, hsa; identical to SEQ ID NO: 84624

SEQ ID NO: 692650 - RNA, 64 nt, hsa; identical to SEQ ID NO: 84625

SEQ ID NO: 692651 - RNA, 64 nt, hsa; identical to SEQ ID NO: 84626

SEQ ID NO: 692652 - RNA, 64 nt, hsa; identical to SEQ ID NO: 84627

SEQ ID NO: 692653 - RNA, 64 nt, hsa; identical to SEQ ID NO: 84628

SEQ ID NO: 692654 - RNA, 64 nt, hsa; identical to SEQ ID NO: 84629

SEQ ID NO: 692655 - RNA, 64 nt, hsa; identical to SEQ ID NO: 84630

SEQ ID NO: 692656 - RNA, 64 nt, hsa; identical to SEQ ID NO: 84631

SEQ ID NO: 692657 - RNA, 64 nt, hsa; identical to SEQ ID NO: 578845

SEQ ID NO: 692658 - RNA, 64 nt, hsa; identical to SEQ ID NO: 578846

SEQ ID NO: 692659 - RNA, 64 nt, hsa; identical to SEQ ID NO: 410385

SEQ ID NO: 692660 - RNA, 64 nt, hsa; identical to SEQ ID NO: 410386

SEQ ID NO: 692661 - RNA, 64 nt, hsa; identical to SEQ ID NO: 410387

SEQ ID NO: 692662 - RNA, 64 nt, hsa; identical to SEQ ID NO: 410388

SEQ ID NO: 692663 - RNA, 64 nt, hsa; identical to SEQ ID NO: 410389

SEQ ID NO: 692664 - RNA, 64 nt, hsa; identical to SEQ ID NO: 410390

SEQ ID NO: 692665 - RNA, 64 nt, hsa; identical to SEQ ID NO: 410391

SEQ ID NO: 692666 - RNA, 64 nt, hsa; identical to SEQ ID NO: 410392

SEQ ID NO: 692667 - RNA, 64 nt, hsa; identical to SEQ ID NO: 410393

SEQ ID NO: 692668 - RNA, 64 nt, hsa; identical to SEQ ID NO: 410394

SEQ ID NO: 692669 - RNA, 64 nt, hsa; identical to SEQ ID NO: 410395

SEQ ID NO: 692670 - RNA, 64 nt, hsa; identical to SEQ ID NO: 410396

SEQ ID NO: 692671 - RNA, 64 nt, hsa; identical to SEQ ID NO: 410397

SEQ ID NO: 692672 - RNA, 64 nt, hsa; identical to SEQ ID NO: 410398

SEQ ID NO: 692673 - RNA, 64 nt, hsa; identical to SEQ ID NO: 410399

SEQ ID NO: 692674 - RNA, 64 nt, hsa; identical to SEQ ID NO: 410400

SEQ ID NO: 692675 - RNA, 64 nt, hsa; identical to SEQ ID NO: 410401

SEQ ID NO: 692676 - RNA, 64 nt, hsa; identical to SEQ ID NO: 410402

SEQ ID NO: 692677 - RNA, 64 nt, hsa
ugugcuuugaucguuaaugagguggucacaugagaaaugauaccuguuacuacuguauuguuuu

SEQ ID NO: 692678 - RNA, 64 nt, hsa
cgaaucguuaauuuugacaguucuacugauccguaaaugauaaccacugcaaauuuuuucagua

SEQ ID NO: 692679 - RNA, 64 nt, hsa
ccugcuuuuuguuucauuuuguuuuguuuuguaaaaaugauaaaacuucagaaaauaaaauguc

SEQ ID NO: 692680 - RNA, 64 nt, hsa
uugaggccaguuuccuagcucauugcuagucaggaaaugauauuuauaaaaaauaugagagacu

SEQ ID NO: 692681 - RNA, 64 nt, hsa
gagaugcuaacuauuuuucaagcaagcuacagagaaaugauaaauguuuuuuguuuuauuauuu

SEQ ID NO: 692682 - RNA, 64 nt, hsa
acacacacaaaaaauaccuaaauuuuggaugagaaaaugauaaaauaugcuaaguucuaggcug

SEQ ID NO: 692683 - RNA, 64 nt, hsa
uaacucguuuugcugaauguuguugggugguagaaaaugauagaacaagggaauaaccgcgaau

SEQ ID NO: 692684 - RNA, 64 nt, hsa
uuuuuucacaguaguccuuggcucugcacggaauaaaugauacccucaaaucuaauuggaugug

SEQ ID NO: 692685 - RNA, 64 nt, hsa
guagaauucagcaauaugagaaaaccagccccuaaaaugauagccacaagagauuaauuguguu

SEQ ID NO: 692686 - RNA, 64 nt, hsa
uucuuauauuuauguauuucuauucugauuucugaaaugauaaccuaguagugucugaugaagu

SEQ ID NO: 692687 - RNA, 64 nt, hsa
uugaauaaaaaagugcacagugugauuguuuacaaaaugauauuauaaauaaauaaaauacuuc

SEQ ID NO: 692688 - RNA, 64 nt, hsa
augucugcccuuuuguuuacuucuugguccuuauaaaugauaguuuuguuuacuuauaaauuuu

SEQ ID NO: 692689 - RNA, 64 nt, hsa
ugaguuaugggagaaggggacauauuuguggccaaaaugauacuaaccaaaggggcuuccuugu

SEQ ID NO: 692690 - RNA, 64 nt, hsa
cuuuuugauuuuuccgaguggcauuuaagugcacaaaugauaacaagaggauuauucucccguu

SEQ ID NO: 692691 - RNA, 64 nt, hsa
cauuuacagucagaaagcuuacugggaugucaggaaaugauacaggguugguucucauuucgug

SEQ ID NO: 692692 - RNA, 64 nt, hsa
uacaauuaugaaauguaauguaagacaccaacagaaaugauauaccuguaacuguaccuaucag

SEQ ID NO: 692693 - RNA, 64 nt, hsa
cugcacccagccaagugaucauuuuuauagguuaaaaugauaggugaaaugaauauagacacuu

SEQ ID NO: 692694 - RNA, 64 nt, hsa
gaauuauuugaccagcugucaaagagaaacaaggaaaugauagcuuuguuaaucuagccucuuu

SEQ ID NO: 692695 - RNA, 64 nt, hsa
uauauuuuauuauauguaauucacaaaacuuccaaaaugauauauaucuuauauguaucaacca

SEQ ID NO: 692696 - RNA, 64 nt, hsa
cuaaggagaauugaaaaaaacuugauaugacugcaaaugauacuuaagcagaucuuuauuuuuu

SEQ ID NO: 692697 - RNA, 64 nt, hsa
ugagaaaugauucuuguuuuaguaaucauucuauaaaugauacugcuggauugauugccguggg

SEQ ID NO: 692698 - RNA, 64 nt, hsa
aagacaaagaaagguuguggaaauguuucagauuaaaugauaguaaaaacaccugacaacuaaa

SEQ ID NO: 692699 - RNA, 64 nt, hsa
aaaauucuaaucuauguugaacuuuguauacuugaaaugauaauaaaaaggauauaauuucuua

SEQ ID NO: 692700 - RNA, 64 nt, hsa
uuaaaaaucuuuuccuauagucuugguaaauuuuaaaugauagcucuauaaaugauauuuauaa

SEQ ID NO: 692701 - RNA, 64 nt, hsa
uauagucuugguaaauuuuaaaugauagcucuauaaaugauauuuauaaguuaugguuauuuuu

SEQ ID NO: 692702 - RNA, 64 nt, hsa
uuauuuugguuuacuaagauaaugcaguugguggaaaugauaaacguuuuaaguguuaacaucc

SEQ ID NO: 692703 - RNA, 64 nt, hsa
uuuccuugaucuguuggaggcuaaaaguagguauaaaugauauugaauguuggguauagugaua

SEQ ID NO: 692704 - RNA, 64 nt, hsa
aucaguauugcaaugaaagaaaaacuaaaaacagaaaugauauucucaauuuugggcaauguga

SEQ ID NO: 692705 - RNA, 64 nt, hsa
uuaguauaaaaucuaaacuuuuuccauuuaucagaaaugauaaaauccaguuaccacauaucac

SEQ ID NO: 692706 - RNA, 64 nt, hsa
ucauucaguuacucuuaauucuuuauaaaacuuuaaaugauaccacauauuuguuuguuuaaaa

SEQ ID NO: 692707 - RNA, 64 nt, hsa
aacugaaaagauuaaaagugagagcugaaaagagaaaugauaaugcuuccaaacuguagcuguc

SEQ ID NO: 692708 - RNA, 64 nt, hsa
auuagguaaaaugagauuacaugaaaagguucuaaaaugauauauuuagaugcaauaauuaacc

SEQ ID NO: 692709 - RNA, 64 nt, hsa
uuggcuguuaauaauuuggauuauuuauguuuauaaaugauacagaucuguuuacaagguuugu

SEQ ID NO: 692710 - RNA, 64 nt, hsa
acacuuagccuucugaagugcucaucucuugcuuaaaugauagucuauuuaguaguuuaaaaua

SEQ ID NO: 692711 - RNA, 64 nt, hsa
ucagagaaaauaugugaaguuuacaaaggaaccaaaaugauaaugggagaauuuagucuuaaaa

SEQ ID NO: 692712 - RNA, 64 nt, hsa
uaucaauguaaaauuuacguuauuaaaaaauuacaaaugauagaaucuuuacucagggaugggc

SEQ ID NO: 692713 - RNA, 64 nt, hsa
caaagagcauuuauauuuucuuuuuuuuuuacuaaaaugauauaggguuuauuuuauauuuuca

SEQ ID NO: 692714 - RNA, 64 nt, hsa
ggcaauacaacugucacaucagaaacaagaaaacaaaugauaaaggaacucauuuaucaauaga

SEQ ID NO: 692715 - RNA, 64 nt, hsa
cuauauugaaaaauaaagaugucaauaaaaggagaaaugauauuuuucuagaugaaauacucaa

SEQ ID NO: 692716 - RNA, 64 nt, hsa
cuuuuagagaaguauacugaaaaauguacaggugaaaugauauguuacugguauucgcuucaaa

SEQ ID NO: 692717 - RNA, 64 nt, hsa
auaauguugugaguuuuuauaaaaauaaauuuuaaaaugauauauaagacauuuuuuugcaaug

SEQ ID NO: 692718 - RNA, 63 nt, hsa
gauuugauugugauuagagaaccuuggacauuuugcugcuaaagaaucuuuuuuccccucucc

SEQ ID NO: 692719 - RNA, 63 nt, hsa
cggcucagucggccagacuuccucuaggaguggugcugcuaccuuguauguuuacauaaugcu

SEQ ID NO: 692720 - RNA, 63 nt, hsa
aacagaaaagauauuuauuggccaggaaguuggugcugcuaagaccgagaaauuuaaagaauc

SEQ ID NO: 692721 - RNA, 63 nt, hsa
uucuauucgggacaauaaaauguauuuugaaagugcugcuaacuauugaugcugacaguguuu

SEQ ID NO: 692722 - RNA, 63 nt, hsa
agucaguuauuagauuuaaaucaccuucugaaaugcugcuauagggcugguaucuguaaaaga

SEQ ID NO: 692723 - RNA, 63 nt, hsa
uuuaaaucaauggagagaaaaaacugaaaaagaugcugcuaaguaguucucuguauuaaagga

SEQ ID NO: 692724 - RNA, 63 nt, hsa
aaauugcuaaauuccaaacagaaccagugacuuugcugcuacauauuuacuaaauugaccacu

SEQ ID NO: 692725 - RNA, 63 nt, hsa
ucauagcaacauaaugugucccugaguagaggaugcugcuaugcgugaguucauggacacaag

SEQ ID NO: 692726 - RNA, 63 nt, hsa
uauucagaugacugcagaaccuggaaaagcuguugcugcuauugaugcauaacauacugcuau

SEQ ID NO: 692727 - RNA, 63 nt, hsa
guuuccucugcucagcaucauuucaugccaaagugcugcuaugggcugcuuugugugcacaaa

SEQ ID NO: 692728 - RNA, 63 nt, hsa
aaacaaaaaaaacuguuaucgaacuuucuuuguugcugcuaguuaaaacuuguugcaacuuuu

SEQ ID NO: 692729 - RNA, 63 nt, hsa
aggguucuguaugauggagacuauuauugcuauugcugcuaauuccaugagcugugaagaucc

SEQ ID NO: 692730 - RNA, 63 nt, hsa
gauggaggagacagaauaggaggaaagugaugcugcugcuaagaauauucgaggucaagagcu

SEQ ID NO: 692731 - RNA, 63 nt, hsa
auucugcguuuuugguuuuaauguuauaucugaugcugcuauauccacuguccaacggaguua

SEQ ID NO: 692732 - RNA, 63 nt, hsa
auuuuuguaagaaaccgaggcgaugccacgcuuugcugcuaccgcccugggcuggacuggagg

SEQ ID NO: 692733 - RNA, 63 nt, hsa
uggaucuuuccacauuucagcagcaccaacaucugcugcuacucaaaauguccuguugaagag

SEQ ID NO: 692734 - RNA, 63 nt, hsa
gaccccuggggaaugccccauggcccagaaugaugcugcuaguuuucuacugagugaagccau

SEQ ID NO: 692735 - RNA, 63 nt, hsa
ugggcauuugaacuuuguuuuucuuuaaagaaaugcugcuauuaaacauauuuguaaaugguu

SEQ ID NO: 692736 - RNA, 63 nt, hsa
augagcuacgccuugaugaaagaaccguguuggugcugcuaaguuuagccauuaugguuuuuc

SEQ ID NO: 692737 - RNA, 63 nt, hsa
accugggcaauuccuguuuucuaagguggucucugcugcuauuuaacaacccagaguaggccu

SEQ ID NO: 692738 - RNA, 63 nt, hsa
uaucccucguuuaucauccccuuuguuugugauugcugcuaaagucaguaguaucguuuuuuu

SEQ ID NO: 692739 - RNA, 63 nt, hsa
uuacacacugcccacacucagagcaagaugaguugcugcuauucuuugccugccccugggguu

SEQ ID NO: 692740 - RNA, 63 nt, hsa
uugcuggcuucagaagccuuuguacauaagagaugcugcuacccaagcaccaaagaccuguua

SEQ ID NO: 692741 - RNA, 63 nt, hsa
uuaucccguuaguacaguauguaauagugggucugcugcuacuuucuguuuuaaggugugagg

SEQ ID NO: 692742 - RNA, 63 nt, hsa
uacugggacauauuuaaauacugaguauaguacugcugcuacugcuucuacaauguaaaaugu

SEQ ID NO: 692743 - RNA, 63 nt, hsa
cuguugcuuugguagagaugagaggccgcauuuugcugcuaaagcaagagaaacuuggagcug

SEQ ID NO: 692744 - RNA, 63 nt, hsa
auaucuucuuuuaccuaucaauauucauugaacugcugcuacauccagacacugugcaaauaa

SEQ ID NO: 692745 - RNA, 63 nt, hsa
acagauucugcccagucucugggcauccauaauugcugcuaaccuagacauuucauaguuaca

SEQ ID NO: 692746 - RNA, 63 nt, hsa
agucccagcugaauucuugcccuuaagugcuuuugcugcuauuuuuuugcccccaguuccaca

SEQ ID NO: 692747 - RNA, 63 nt, hsa
gaucaacaaugaaguauuuuauaaauguauuuaugcugcuagacugugggucaaauguuucca

SEQ ID NO: 692748 - RNA, 63 nt, hsa
cucaacugccccaaaucucuuaauagcuucuagugcugcuacaaucuaagucaggucaccaga

SEQ ID NO: 692749 - RNA, 63 nt, hsa
caggccaaucagacagggcccagagcaucucuuugcugcuacuguuuugccauccuucuauuc

SEQ ID NO: 692750 - RNA, 63 nt, hsa
cuguccuuaaggaaugguccucugggagggcugugcugcuaguggguaccucagucacacacc

SEQ ID NO: 692751 - RNA, 63 nt, hsa
cgagaagcagggugagagauucuaacgacuggaugcugcuaguaacacauuguuuguauugcu

SEQ ID NO: 692752 - RNA, 63 nt, hsa
gaaauuguaucucagucuaaggucucaugcuguugcugcuacugucuuacuauuauagcaacu

SEQ ID NO: 692753 - RNA, 63 nt, hsa
uuaucauuaggauaggguaagugaaguuugcuaugcugcuagcauccuaagaugauaccuuug

SEQ ID NO: 692754 - RNA, 63 nt, hsa
uaccacuggugagugcuccauaguuuccuuaccugcugcuacagaauguuauuuuacaucccu

SEQ ID NO: 692755 - RNA, 63 nt, hsa
gaaaacauuuguuauuggcuauuucagguguuuugcugcuagaaauuauuaaaguuacacacu

SEQ ID NO: 692756 - RNA, 63 nt, hsa
uauaggcuuccuauuuucacuuuacugcucuaaugcugcuagucguagucuuuagcacacuag

SEQ ID NO: 692757 - RNA, 63 nt, hsa
gagguucuuuucuacaugaugaccuucagcuccugcugcuagucuccaauugccaagggaauu

SEQ ID NO: 692758 - RNA, 63 nt, hsa
cuuauggaaaugaaauaugaaauuuuauuaaaaugcugcuauauuacauaaguugcuucauua

SEQ ID NO: 692759 - RNA, 63 nt, hsa
ugguugaaaauuguacuugaauacauacaugcaugcugcuaaacuagaacuuuaauuuuuccc

SEQ ID NO: 692760 - RNA, 63 nt, hsa
uucuuacaaaucuuuuaagagggcuguaacaguugcugcuaguauuaggguuccacaucauuc

SEQ ID NO: 692761 - RNA, 63 nt, hsa
cuguuaauaaaagaauuuacaguuugguaaaauugcugcuaaacaaucauuggaucacaaucc

SEQ ID NO: 692762 - RNA, 63 nt, hsa
uuuaauggcugccuuuucauuuucaucuuuucuugcugcuacccaucuauguauguagucauu

SEQ ID NO: 692763 - RNA, 63 nt, hsa
agauaugguaguuaugaagaaaacaaugucauuugcugcuauuauuguaagagucuuauaauu

SEQ ID NO: 692764 - RNA, 63 nt, hsa
ugaaggggagcaccgggcgagugcaugugcuacugcugcuacaggccugucuaucuguuuguc

SEQ ID NO: 692765 - RNA, 63 nt, hsa
cacggugacaccaccuuccugaggcuucccuccugcugcuaccacugaugcgagggaaaggcc

SEQ ID NO: 692766 - RNA, 63 nt, hsa
aagaacaaugccauuugagagugagguggucccugcugcuacgaggccauuguacuguuuuuu

SEQ ID NO: 692767 - RNA, 63 nt, hsa
uuuauguuuguacacaacaccuaaaaccaguuuugcugcuauaauucuauacuguugauucgu

SEQ ID NO: 692768 - RNA, 63 nt, hsa
ugcugaguuguaugucuuugcauagcuccacucugcugcuaaauaugcauguucugacugaca

SEQ ID NO: 692769 - RNA, 63 nt, hsa
aaguucaugagaggacagaagaaagugacuucuugcugcuaguuuugaaggacauuguaucgc

SEQ ID NO: 692770 - RNA, 63 nt, hsa
ccucaccaguuuggacaauuugaaauuaccuauugcugcuacuuguucuguccucugaccuug

SEQ ID NO: 692771 - RNA, 63 nt, hsa
uguguguuuuuacuuuuuggcuacucugaaugaugcugcuaugaacauauuucuacaagauuu

SEQ ID NO: 692772 - RNA, 63 nt, hsa
auuuuuuuuaagucuucuugaaggcacucuaauugcugcuaaaugauguugcuucuuugcuaa

SEQ ID NO: 692773 - RNA, 63 nt, hsa
guauuugcugauaaaaggcauaacgagacauagugcugcuaccacugaauaagugauacuuug

SEQ ID NO: 692774 - RNA, 63 nt, hsa
auuaggagcuguacauccaauucaaguuuuauuugcugcuauucugggagaauaaacuuguau

SEQ ID NO: 692775 - RNA, 63 nt, hsa
acuuuugguaggaaggaaaacagggaaggugauugcugcuauucuggaauguguccauugaaa

SEQ ID NO: 692776 - RNA, 63 nt, hsa
cauugagcucaguggccuguuucaucacguaugugcugcuaccuguacagcagacaugccgcu

SEQ ID NO: 692777 - RNA, 63 nt, hsa
aagaaucaggagaaugcauuucaugucugauucugcugcuaauuaagucaaucauuuaauuuu

SEQ ID NO: 692778 - RNA, 63 nt, hsa
uggauacacauggagcuguuugggaauuuuccuugcugcuaccgcgcugccaccaaauggaau

SEQ ID NO: 692779 - RNA, 63 nt, hsa
cuaacucuguuguuuucaaccucuacguuauuuugcugcuaugugcauuuccagaucugauuu

SEQ ID NO: 692780 - RNA, 63 nt, hsa
ccugaugaugugacaaugcauggucuuugugcaugcugcuagacacuuuucuuucccagccga

SEQ ID NO: 692781 - RNA, 63 nt, hsa
gccucuuccaaaaggggacacagaagcacuggcugcugcuacagaccgcaaaagcagaaaguu

SEQ ID NO: 692782 - RNA, 63 nt, hsa
agauaucaugcaaauuucaugaccaguaaaggcugcugcuacaauguccuaacugaaagauga

SEQ ID NO: 692783 - RNA, 63 nt, hsa
uguuugucucuccuuuucuuuuguuacuguucuugcugcuagaacuuuuuuaaauaaacuuuu

SEQ ID NO: 692784 - RNA, 63 nt, hsa
agcugggaucagccugcagccaucccccgacccugcugcuaggccacggucugcgcccugggg

SEQ ID NO: 692785 - RNA, 63 nt, hsa
uugcuguugcuguugcuguugcuguuggcaucuugcugcuaauccugaggcugguagcagaau

SEQ ID NO: 692786 - RNA, 63 nt, hsa
cauuaacagcgccucuuugauagguuacccugaugcugcuaaaguaaagccuuaaguguguuu

SEQ ID NO: 692787 - RNA, 63 nt, hsa
ugaaaaccauaugauauuuugucuccuaccugcugcugcuauuauguaacauccagaagguuu

SEQ ID NO: 692788 - RNA, 63 nt, hsa
acccacaugguucucccacugcccugucugcucugcugcuacagaggggcagggccuccccca

SEQ ID NO: 692789 - RNA, 63 nt, hsa
aagggcaguggauucuggaggcucuacuucaggugcugcuauaaugccucaucuaaucaggac

SEQ ID NO: 692790 - RNA, 63 nt, hsa
uuuuuuucuaaauuuuuagcauuaguccauuucugcugcuaacaauugaauccagaaaucuac

SEQ ID NO: 692791 - RNA, 63 nt, hsa
cucuuccuuucuggccaaggaugaugucaguucugcugcuacuagccuggaguugcagaagcu

SEQ ID NO: 692792 - RNA, 63 nt, hsa
uggggaagucucuuuuuugaaacacuucagaacugcugcuauaaagaaauucucuaauugguu

SEQ ID NO: 692793 - RNA, 63 nt, hsa
cuccagaggcagaacacauguuuucagagaagcugcugcuaaggaccuucuagacugcucaca

SEQ ID NO: 692794 - RNA, 63 nt, hsa
cccugugaaaacuuacuuugccccuagucuggcugcugcuaggacuucugaggagcaauggga

SEQ ID NO: 692795 - RNA, 63 nt, hsa
agcagcauaauuauuuccaaagaccccaguauuugcugcuauuuuuaaaacuccccugaugua

SEQ ID NO: 692796 - RNA, 63 nt, hsa
ugucacccccaggaggcgcugugguacuggggcugcugcuauuuaagccaagaacugaggucc

SEQ ID NO: 692797 - RNA, 63 nt, hsa
agucggcgacaagguugugcguggcuccugaccugcugcuaagagucacuugaccagacugca

SEQ ID NO: 692798 - RNA, 63 nt, hsa
aguccaaaguauaaacaugcuccuuuccucucuugcugcuacucuugcuuuuggaaguuacca

SEQ ID NO: 692799 - RNA, 63 nt, hsa
gugaaaaauugacagcucccucacucuuaagguugcugcuauauacagucuagguuuucuguu

SEQ ID NO: 692800 - RNA, 63 nt, hsa; identical to SEQ ID NO: 423621

SEQ ID NO: 692801 - RNA, 63 nt, hsa; identical to SEQ ID NO: 423622

SEQ ID NO: 692802 - RNA, 63 nt, hsa
uccuggguaaggcuucauuugaaugaaggguucugcugcuaaaaaaaaaaaaaaagucggaaa

SEQ ID NO: 692803 - RNA, 63 nt, hsa
uuuucugaguuucucguaaugcucauuuuuacaugcugcuacuagcuuuuuuuuuuaaaaaaa

SEQ ID NO: 692804 - RNA, 63 nt, hsa
uucuaaaugcaagucaagcuuuauuguuaggcuugcugcuacucauuaacccaaauauuugua

SEQ ID NO: 692805 - RNA, 63 nt, hsa
gccugccaagaauuuuauuucugcuguuuuuuuugcugcuaaagaaaggaacuaagucaggau

SEQ ID NO: 692806 - RNA, 63 nt, hsa
auuaggagcucuuucucucacucuucugucauuugcugcuauguugaaauucuuauuuugacc

SEQ ID NO: 692807 - RNA, 63 nt, hsa
ccauuggcuugccaagaguacagaaauucauuaugcugcuaauuuaacguggaauuccuucau

SEQ ID NO: 692808 - RNA, 63 nt, hsa; identical to SEQ ID NO: 423623

SEQ ID NO: 692809 - RNA, 63 nt, hsa; identical to SEQ ID NO: 423624

SEQ ID NO: 692810 - RNA, 63 nt, hsa
cucacuuauagagcucuccaggacuggaaaaagugcugcuauuuuaacuugcucuugcuugua

SEQ ID NO: 692811 - RNA, 63 nt, hsa
acugucuggaugguucauuacucaaguuacugcugcugcuauugucuuuccuuuguugucgau

SEQ ID NO: 692812 - RNA, 63 nt, hsa
ccccgcuuguguaacaguccuguuuuguugaguugcugcuauugcacugccagugcagcccac

SEQ ID NO: 692813 - RNA, 63 nt, hsa
uacauguaguugcacacgguucaguaaaaauaaugcugcuaucgaguaugcaaauauugaagu

SEQ ID NO: 692814 - RNA, 63 nt, hsa
gcuuaaacuauugacucuauaccucuaaagaauugcugcuacuuugugcaagaacuuugaagg

SEQ ID NO: 692815 - RNA, 63 nt, hsa
guguguguguuuuuuuuaauuugguugaacauuugcugcuaaugggacuugcccagcugagug

SEQ ID NO: 692816 - RNA, 63 nt, hsa
uaugauugugacuucuaguucuuuucuagaggaugcugcuagaaaaugguuuugcuuuguauu

SEQ ID NO: 692817 - RNA, 63 nt, hsa
cuguacuguacucccaguggccaaacuuauuuaugcugcuaaaugaaagaaagaaaaaagcaa

SEQ ID NO: 692818 - RNA, 63 nt, hsa
uguaauagauguuugauagauuuucugcuacuuugcugcuaugguuuucuccaagagcuacau

SEQ ID NO: 692819 - RNA, 59 nt, hsa; identical to SEQ ID NO: 423748

SEQ ID NO: 692820 - RNA, 63 nt, hsa
uugucaccaugagauagcauuagcugcccaggaugcugcuauauauauauauauauauauaua

SEQ ID NO: 692821 - RNA, 63 nt, hsa
acuuuuaagauggauaauagggcauggacugagugcugcuaucuugaaaugugcacagguaca

SEQ ID NO: 692822 - RNA, 63 nt, hsa
gagaauucagucuacagccauuuaaaugaucauugcugcuacagaagugcuuuaagagaauug

SEQ ID NO: 692823 - RNA, 63 nt, hsa
cugagaagcagcuuuaugagguuuuacagaguaugcugcuaccucucuccuugaagggagcau

SEQ ID NO: 692824 - RNA, 63 nt, hsa
gagcuuugguuuuuagaaauaaagugcaugaauugcugcuaugcuguauccuaguaucccagu

SEQ ID NO: 692825 - RNA, 63 nt, hsa
gguugacucagagagucgcugucauucugucauugcugcuacucuaacacugagcaacacucu

SEQ ID NO: 692826 - RNA, 63 nt, hsa
ccagugaaagacagaucauaggagagacccuuuugcugcuacuucauucguucugaccuaaua

SEQ ID NO: 692827 - RNA, 63 nt, hsa
ccccuggcaaacauugucaccaaggugggauguugcugcuaaugggagagucaucauaaaaaa

SEQ ID NO: 692828 - RNA, 63 nt, hsa
ugugcaguuuuuuaacuagggaaagcuuuguacugcugcuaaugauaugcacccagaaaccuu

SEQ ID NO: 692829 - RNA, 63 nt, hsa
cuuccugguguacaagccuuuaaagacuucugcugcugcuaugccucuuggaugcacacuuug

SEQ ID NO: 692830 - RNA, 63 nt, hsa
aaaacaauucuauuucauagcacaucacaauacugcugcuacucuguagccacccccauggcu

SEQ ID NO: 692831 - RNA, 63 nt, hsa
auucuuuccuuacgcaaagcccaaggaaugagcugcugcuacuuuaaaguguggucauuauga

SEQ ID NO: 692832 - RNA, 63 nt, hsa
uuaaguuuucuuucuguuucuaagacaacaguaugcugcuauagccgucugcuaccucgagaa

SEQ ID NO: 692833 - RNA, 63 nt, hsa
cugccacauaagaucuaguuuuuauuucuagagugcugcuaugaauaauuacuauagcugcug

SEQ ID NO: 692834 - RNA, 63 nt, hsa
uuucugagguaacuggguaauagaauaucaaauugcugcuaucucggaccuauuguuaaagga

SEQ ID NO: 692835 - RNA, 63 nt, hsa
acuaaguaugcagguuuccugguaccauugaguugcugcuauuaaagcucacacacgaaaugg

SEQ ID NO: 692836 - RNA, 63 nt, hsa
ggcaauuaauuaauccugugaagguuacauugcugcugcuagagaggguggggauugcaccuu

SEQ ID NO: 692837 - RNA, 63 nt, hsa
caggcucaugauaaauguauuagucuguucucaugcugcuauuaaagacauaccugacacugg

SEQ ID NO: 692838 - RNA, 63 nt, hsa
aggaggacgaacagagauccugaaauucugacuugcugcuauuccagaacccagccuccuggg

SEQ ID NO: 692839 - RNA, 63 nt, hsa
uucaauguuccauucuucgacauccgucauugcugcugcuaccagcgccaaauguucauccuc

SEQ ID NO: 692840 - RNA, 63 nt, hsa
aaagacaguggagaauuuacggaaugacaugaaugcugcuaaaggacuggacucaaacaaaaa

SEQ ID NO: 692841 - RNA, 63 nt, hsa
uccuguaguaggcuugcuggagcaaaggaaaugugcugcuaaaaaucaacuuaugccauuuua

SEQ ID NO: 692842 - RNA, 63 nt, hsa
uuuuuuuaaucuuuuuaaaaacugcugugguuuugcugcuacacuaagaauugugauuugcau

SEQ ID NO: 692843 - RNA, 63 nt, hsa
agaggguuccaugagauuauuguagacucaugaugcugcuaucucaaccagaugcccaggaca

SEQ ID NO: 692844 - RNA, 63 nt, hsa; identical to SEQ ID NO: 423625

SEQ ID NO: 692845 - RNA, 63 nt, hsa; identical to SEQ ID NO: 423626

SEQ ID NO: 692846 - RNA, 63 nt, hsa
uuuuuuuagugcugcauuuuuuuaaaguuggauugcugcuauuuaaaaaaaaaaaaaggacac

SEQ ID NO: 692847 - RNA, 63 nt, hsa
cuugccaaaauggauccuuugauuuuugucauuugcugcuaaaauauauuaucugaagguaaa

SEQ ID NO: 692848 - RNA, 63 nt, hsa
accgcgcagcgugacugugaguugcucauaccgugcugcuaucugggcagcgcugcccauuua

SEQ ID NO: 692849 - RNA, 63 nt, hsa
ggguuguuucugacuuuuggcuauugggaauagugcugcuaugaauguuuguguaccuguauu

SEQ ID NO: 692850 - RNA, 63 nt, hsa
cucugggguaagaguaaaggcuuccagaagacaugcugcuauggucacugagggguuagcuuu

SEQ ID NO: 692851 - RNA, 63 nt, hsa
ggugacagcuccgggaucagcaacccuuccugcugcugcuacugcugcugcugcugccgccgc

SEQ ID NO: 692852 - RNA, 63 nt, hsa
gugagcugugggacuuuaggcaaguuaucuaaaugcugcuaugcuauagucuccccaccugua

SEQ ID NO: 692853 - RNA, 63 nt, hsa
uugguucguuauuuuuuaagauuagccauucucugcugcuauuucccuacauaaugucaauuu

SEQ ID NO: 692854 - RNA, 63 nt, hsa
aagucagccugcucuacuacuaacaaacaggccugcugcuagaugaucucuaaugaccaaugg

SEQ ID NO: 692855 - RNA, 63 nt, hsa
agaacaguacuggccuucaguauaugcauagaaugcugcuagaagacaagugauguccugggu

SEQ ID NO: 692856 - RNA, 63 nt, hsa
ccugcaguuacauugaauuguagguguuucgugugcugcuaagguaugcuuauuugaguuuau

SEQ ID NO: 692857 - RNA, 63 nt, hsa
auuucauuuuaaucauuggacaccuuugcguuuugcugcuaacaguguguguaugucacccuc

SEQ ID NO: 692858 - RNA, 63 nt, hsa
gcuuuauauguaaagaauuuuagaagaucuuggugcugcuauuccugcuggaggaaugaauag

SEQ ID NO: 692859 - RNA, 63 nt, hsa
accuggaaauaauuuaccaaaauaacugaguguugcugcuaaagaacaaaaguggggagguau

SEQ ID NO: 692860 - RNA, 63 nt, hsa
aaugacucguauucagaugcuuaaagaaagcauugcugcuacaaauauuucuauuuuuagaaa

SEQ ID NO: 692861 - RNA, 63 nt, hsa
gagaacacuggcuucacagaggacuuugugcauugcugcuaugaacuuugaccugagucgggg

SEQ ID NO: 692862 - RNA, 63 nt, hsa
cacauuuuuuaaaagggcaaguacaggagcaacugcugcuacccagaaaaauguguguauuau

SEQ ID NO: 692863 - RNA, 63 nt, hsa
aaauagccacaguccuuaagccacacacauuguugcugcuaugacuuuuuaccuccuuuaaac

SEQ ID NO: 692864 - RNA, 63 nt, hsa
gaagccaaauuuauauguccuaguagaaugaagugcugcuaguuuuuaugagaaguauauuau

SEQ ID NO: 692865 - RNA, 63 nt, hsa
uaguuuaaggugguugauggauuuagccauauaugcugcuaaagaaauugucuaccuuuucuu

SEQ ID NO: 692866 - RNA, 63 nt, hsa
ugaccuuuuccuaugucuaggcuccuccacaggugcugcuauuuugugagcuccggcuccugu

SEQ ID NO: 692867 - RNA, 63 nt, hsa
aacaguagcuuguagagauccagugcacgccgaugcugcuaaacucagugccugagcccggcc

SEQ ID NO: 692868 - RNA, 63 nt, hsa
gggugcgcagggaggccgggcuugggggcagccugcugcuauguccuugcuggcgcccauacc

SEQ ID NO: 692869 - RNA, 63 nt, hsa
caaaacaaaucuuauguugcauuuacuaucaacugcugcuaauacguuauuauaaaacuuacc

SEQ ID NO: 692870 - RNA, 63 nt, hsa
guguucuuuucugaauuucauuucagcaauuuaugcugcuaaauagaaucccgcaugucugca

SEQ ID NO: 692871 - RNA, 63 nt, hsa
uaauuuauuuuguaaugucuuguuuugaaguauugcugcuauccuuguuauccuucccacugu

SEQ ID NO: 692872 - RNA, 63 nt, hsa
gagaggacaagaagacacaguuuuagaaucuacugcugcuaaagcacauuaaaaacaaauccu

SEQ ID NO: 692873 - RNA, 63 nt, hsa
agacuuuuuguuucuugcaacaacagugcccucugcugcuagaaaccuuuuucuacuuacuau

SEQ ID NO: 692874 - RNA, 63 nt, hsa
caaagaagaugauuuaaugguagaacggauaccugcugcuagaccugauggaauguuaccugu

SEQ ID NO: 692875 - RNA, 63 nt, hsa
gucuuguuucuucuuuauguuucuuuuacuuauugcugcuaggauccuacauaggauuucuau

SEQ ID NO: 692876 - RNA, 63 nt, hsa
uggccccauccucacuuccucuuuuuauuucacugcugcuaaaauuguguuuuuaccuacuac

SEQ ID NO: 692877 - RNA, 63 nt, hsa
gcuuuuuaacaagaacugaugcuccuugggugcugcugcuacucagacuagcucuaaguaaug

SEQ ID NO: 692878 - RNA, 63 nt, hsa
uccaagacaggggccuaaggagggucuccacacugcugcuaggggcuguugcauuuuuuuauu

SEQ ID NO: 692879 - RNA, 63 nt, hsa
ggaucguuucuacuucuugacuauuauacauaaugcugcuaggaacuuuuguguaugaguuuu

SEQ ID NO: 692880 - RNA, 63 nt, hsa
caguguucacaaggauguugguuuggagaugucugcugcuaggaccuggggugugugacucag

SEQ ID NO: 692881 - RNA, 63 nt, hsa
uacgacuaauguuggagccugaaacuauggaaaugcugcuaaaauuuuuauauugacaaacau

SEQ ID NO: 692882 - RNA, 63 nt, hsa
ccaaagaaacccuauauuauauauccacauuacugcugcuaggauucauaguugcacauacug

SEQ ID NO: 692883 - RNA, 63 nt, hsa
aggaugugugaaaagcucacagagcccgaugccugcugcuauuucacggcaaugagccuuuuu

SEQ ID NO: 692884 - RNA, 63 nt, hsa
gcagaccuauuagaucugcaguuuaaguugccaugcugcuaggaaauuguccuuuuucuuucu

SEQ ID NO: 692885 - RNA, 63 nt, hsa
agagcuacuucauucuuuucugaaguuguguguugcugcuagaaauagucauuugugaauuau

SEQ ID NO: 692886 - RNA, 63 nt, hsa; identical to SEQ ID NO: 423627

SEQ ID NO: 692887 - RNA, 63 nt, hsa; identical to SEQ ID NO: 423628

SEQ ID NO: 692888 - RNA, 63 nt, hsa
aguacugaaauguuuuguaaauuuuuuuuaaugugcugcuagguuuuuuguuuuguuuuguuc

SEQ ID NO: 692889 - RNA, 63 nt, hsa
cuggaggaagaaugugccuucaggccacagucgugcugcuagaacagucucguagcugcaguu

SEQ ID NO: 692890 - RNA, 63 nt, hsa
aguccacugaaagucucuaaggaaguauccucuugcugcuaaacuugguacaaguugacuacc

SEQ ID NO: 692891 - RNA, 63 nt, hsa
guagaguuuuuaaacaucaaucuuuaaaccaauugcugcuacuuauauaauugccaaaaagug

SEQ ID NO: 692892 - RNA, 63 nt, hsa
gcuuuucuaacaaauucccgcguauuuugccuuugcugcuacuuuuucuaguuagauuucaaa

SEQ ID NO: 692893 - RNA, 63 nt, hsa
uaagucuguggaucugcugauguacagugccuuugcugcuauggaucaaaaucaaaagaaccg

SEQ ID NO: 692894 - RNA, 63 nt, hsa
uuuuuaucacacagcuaaagucuguaguuaaguugcugcuacuuuugagucaauaacaucaag

SEQ ID NO: 692895 - RNA, 63 nt, hsa
cuguucccccagaucuugccuugggaccacauuugcugcuacuuuuccugcugcucuauccua

SEQ ID NO: 692896 - RNA, 63 nt, hsa; identical to SEQ ID NO: 423629

SEQ ID NO: 692897 - RNA, 63 nt, hsa; identical to SEQ ID NO: 423630

SEQ ID NO: 692898 - RNA, 63 nt, hsa
uuaugguuuucuuauucgugaaaauucggagagugcugcuaaaauuggauuggugugaucuuu

SEQ ID NO: 692899 - RNA, 63 nt, hsa
gaaaauauuuguguuuguuuugucugacuaacuugcugcuaaaugcuaucuuuagguguguga

SEQ ID NO: 692900 - RNA, 63 nt, hsa
gaguuauaucuaauuuuucacucuuauaaauagugcugcuaugaaugucuguaaaaaaaaaaa

SEQ ID NO: 692901 - RNA, 63 nt, hsa
ggaaucaccgacuacugaaucuccuacauguauugcugcuacuucaagcuccuccacuugaaa

SEQ ID NO: 692902 - RNA, 63 nt, hsa
aggaggguccuggcacuacccagauuuccacagugcugcuaauaucccagcuccagccagcac

SEQ ID NO: 692903 - RNA, 63 nt, hsa
ggccugugcugcccgccucaggagguggccgacugcugcuagcggccugccgccacgucagca

SEQ ID NO: 692904 - RNA, 63 nt, hsa
uucuccccuuuauugaccaauuaacugagcacuugcugcuauuucuagacaugaaaugucacc

SEQ ID NO: 692905 - RNA, 63 nt, hsa
aagcagcauuucuuguuaacuaguuaagcacuaugcugcuaguuacaguguaggcaccccggc

SEQ ID NO: 692906 - RNA, 63 nt, hsa
cauggaucagcucuuccuguguuuguaauuuaaugcugcuacaagauguuucuguuucuuaga

SEQ ID NO: 692907 - RNA, 63 nt, hsa
agccaauccauucacaagcuuggcauugacaugugcugcuaguuuauaaacuggcauugacga

SEQ ID NO: 692908 - RNA, 63 nt, hsa
ugugcuaccuggguccuuuucagaagugagcuuugcugcuacaggggaagguggccucugugg

SEQ ID NO: 692909 - RNA, 63 nt, hsa
ucucaaguaacuaucaaauauuguaaaugcaauugcugcuaguucaguuacauuucugcugau

SEQ ID NO: 692910 - RNA, 63 nt, hsa
cuuuauaaacuaugccuuccagacaauugauaaugcugcuauaauuaguauuauguugauaau

SEQ ID NO: 692911 - RNA, 63 nt, hsa; identical to SEQ ID NO: 423631

SEQ ID NO: 692912 - RNA, 63 nt, hsa; identical to SEQ ID NO: 423632

SEQ ID NO: 692913 - RNA, 63 nt, hsa
caccacacccagcccggacagcuucuuugggagugcugcuaaccuugaaauuaucagacacuu

SEQ ID NO: 692914 - RNA, 63 nt, hsa
accucccugguccuugcucuuguuaacccaagaugcugcuacacagaugccaaauggaaaucu

SEQ ID NO: 692915 - RNA, 63 nt, hsa
auuugcuuuaagaaaacagucuugaauuucacaugcugcuauuuuuauauuuugccauuuuac

SEQ ID NO: 692916 - RNA, 63 nt, hsa
ggcccgcugggcaccuggcaccuggccugcagaugcugcuacgagugaccagugcugugugga

SEQ ID NO: 692917 - RNA, 63 nt, hsa
uacaaacaaaaaucuuugugucuggacaccuggugcugcuaauuguguucaugguuuccuuug

SEQ ID NO: 692918 - RNA, 63 nt, hsa; identical to SEQ ID NO: 423633

SEQ ID NO: 692919 - RNA, 63 nt, hsa; identical to SEQ ID NO: 423634

SEQ ID NO: 692920 - RNA, 63 nt, hsa
gaugccuuuucuaccccaucccucacagccucuugcugcuaaaauagauguuucauuuuucug

SEQ ID NO: 692921 - RNA, 63 nt, hsa
uaguauuauguaaauuuaugcugcaauagcuuuugcugcuauuaaaaugguauuauuaauacc

SEQ ID NO: 692922 - RNA, 63 nt, hsa
cauucaugaaaaacguuuuuaaguauugcuuuuugcugcuauguucugcauugagccuaguuu

SEQ ID NO: 692923 - RNA, 63 nt, hsa
ugaugauucuguggagguauugccuugugaauuugcugcuauuuuaguuuugucuuugcugua

SEQ ID NO: 692924 - RNA, 63 nt, hsa
augccuguauuuaugaagacagggccauugcacugcugcuaugcugaaaugaacuuuuauaaa

SEQ ID NO: 692925 - RNA, 63 nt, hsa
gcuuuuuuuuaaaaggaaaagauaccaaaugccugcugcuaccacccuuuucaauugcuaucu

SEQ ID NO: 692926 - RNA, 63 nt, hsa
acauuagccagggagguucuggcuaacguuaaaugcugcuauacaacugcuuugcaacaguug

SEQ ID NO: 692927 - RNA, 63 nt, hsa
gggcagagcaucugugggguggggucuuccccuugcugcuauuguauggcuggggacuggucu

SEQ ID NO: 692928 - RNA, 63 nt, hsa; identical to SEQ ID NO: 423635

SEQ ID NO: 692929 - RNA, 63 nt, hsa; identical to SEQ ID NO: 423636

SEQ ID NO: 692930 - RNA, 63 nt, hsa
gggcuuggcugagagaguggcauuggcagcaggugcugcuacccucccugcuguccccucuug

SEQ ID NO: 692931 - RNA, 63 nt, hsa
aauccuauuaggcaagucaguugaaaaugcucgugcugcuaauggaauuagagugcguucauu

SEQ ID NO: 692932 - RNA, 63 nt, hsa
cacaucgcuucuguguaucucuuucacauuguuugcugcuauuggaggaucaguuuuuuguuu

SEQ ID NO: 692933 - RNA, 63 nt, hsa
aguuaagacuuguucuuugagugauguauuaaaugcugcuagaaaagccucauuacauuaaau

SEQ ID NO: 692934 - RNA, 63 nt, hsa
uagauguacaacacugacucaucauaaauguggugcugcuauucgacaaaccaguuuuagcag

SEQ ID NO: 692935 - RNA, 63 nt, hsa
ccuuaggcuauuccaccucucgaucacaagagcugcugcuauaacuuccaguuuuacaucuuu

SEQ ID NO: 692936 - RNA, 63 nt, hsa
gccuuuuaauuuauugaaauguuucaugacuacugcugcuagcucuucaagccagguucaugc

SEQ ID NO: 692937 - RNA, 63 nt, hsa
agcuccuugaaaauccaggcggguauggaaaggugcugcuacccauaucuuuuugacuuucuu

SEQ ID NO: 692938 - RNA, 63 nt, hsa
agagggucaggguuggaggccugugcuuguguuugcugcuaauguccagcuacagacccagag

SEQ ID NO: 692939 - RNA, 63 nt, hsa
cuugguagccccucgaggcagaugcaccugacuugcugcuauuaaaaagccgugugccuucua

SEQ ID NO: 692940 - RNA, 63 nt, hsa
ggaggaacaaguaaaaaccaaaugguuacauugugcugcuagaaauaaugucauucucaauua

SEQ ID NO: 692941 - RNA, 63 nt, hsa
accaucggcucuggggaauccuggugaauauagugcugcuauguugacauuauucuuccuaga

SEQ ID NO: 692942 - RNA, 63 nt, hsa
acaggcacucauugcuacugaaggggacaccaaugcugcuauccgcaagcucaagagauccca

SEQ ID NO: 692943 - RNA, 63 nt, hsa
aauaggagauuuuguaacugcuugccauuaacuugcugcuaaauucccaauguauugauuaaa

SEQ ID NO: 692944 - RNA, 63 nt, hsa
guucugcucuagacaguguagggcaacaauacaugcugcuaauucaaagcucuauuaagauuu

SEQ ID NO: 692945 - RNA, 63 nt, hsa
guauugugaccgugcggcuccaccucuuccagcugcugcuacagcugaggccuggaucccggc

SEQ ID NO: 692946 - RNA, 63 nt, hsa
gacagggaccgcccucuugucaggacaacugccugcugcuagggucuguugccaaggucaacc

SEQ ID NO: 692947 - RNA, 63 nt, hsa
gcuguaguuuaauggauaaguuguucuaugagcugcugcuaucaguacuuuuuuccacauuuu

SEQ ID NO: 692948 - RNA, 63 nt, hsa
guaauaaauguguauuuuuguacuugcagaaacugcugcuaacuuuuaaaguuguuugguuuu

SEQ ID NO: 692949 - RNA, 63 nt, hsa
ugucauucagaaaccugaaguguggcugcaucuugcugcuaaugugugauguugacgccuaac

SEQ ID NO: 692950 - RNA, 63 nt, hsa
cuggcuuuccacuuuggaugcccgggcauccgcugcugcuacaucuuagccagaacuugaagu

SEQ ID NO: 692951 - RNA, 63 nt, hsa
ccgccucacuguggcaguguauugccuguuaauugcugcuaauucuaauucugaugaugacuc

SEQ ID NO: 692952 - RNA, 63 nt, hsa
aaauaaaauuuuguuuuucuguaaugucauauuugcugcuacaguagcucaauauuuuacagg

SEQ ID NO: 692953 - RNA, 63 nt, hsa
ugacaguaccuagcuguaauguuucacagagugugcugcuauuuuauaaacauuuuuauaaua

SEQ ID NO: 692954 - RNA, 63 nt, hsa
cguaaucucaagguuauuauucugacaccagcuugcugcuaugauuucagagcacauaaguaa

SEQ ID NO: 692955 - RNA, 63 nt, hsa
ucucuuuguacucuguaucuauauaucaaaagcugcugcuaugucucucuucugucuuauucu

SEQ ID NO: 692956 - RNA, 63 nt, hsa
uuacaacgaauuuacagucuaguacuuauuacaugcugcuauacacaagcaaugcaagaaaaa

SEQ ID NO: 692957 - RNA, 63 nt, hsa
cagaaccuggaacagggacuuucacuugaaucuugcugcuaaauguaaaugccuucucaaaug

SEQ ID NO: 692958 - RNA, 63 nt, hsa
auaucgacagggcuacacgugauguccccaaacugcugcuauugaagaacuucccaaaacuuc

SEQ ID NO: 692959 - RNA, 63 nt, hsa
cuuuaucaggaugaacccaggacugcuucugaaugcugcuacuugauuucuuucucaucccac

SEQ ID NO: 692960 - RNA, 63 nt, hsa
accucaucaggaugaacccaggacgcuucugaaugcugcuacuuaauuccuuucucaucccac

SEQ ID NO: 692961 - RNA, 63 nt, hsa
uuacuggguagauacccaaaggauuacaaaucaugcugcuauaaagacacaugcacacauaug

SEQ ID NO: 692962 - RNA, 63 nt, hsa
auuucauccagaauagaucaguuauugaagcagugcugcuaacauccauucccuuucauacca

SEQ ID NO: 692963 - RNA, 63 nt, hsa
aguucauacuuaccuaaaauuaaauauaguuuaugcugcuauuguauaaaguagcacauguca

SEQ ID NO: 692964 - RNA, 63 nt, hsa
aguauuuccuucccuuuuaucuaauuuuuuauaugcugcuaaauauauuuuaaauauacuaug

SEQ ID NO: 692965 - RNA, 63 nt, hsa; identical to SEQ ID NO: 423637

SEQ ID NO: 692966 - RNA, 63 nt, hsa; identical to SEQ ID NO: 423638

SEQ ID NO: 692967 - RNA, 63 nt, hsa
uggagaaaucuacuccccuuggccaggacaugcugcugcuacugcuaacagccaauuuuauag

SEQ ID NO: 692968 - RNA, 63 nt, hsa
aagugcuauuaccuuucucaguuaccagaaucuugcugcuaaaguugcaagugauugauaaug

SEQ ID NO: 692969 - RNA, 63 nt, hsa
agaaacacagugcauuauuuauugcggaaucauugcugcuaaauaacuacugucuguuuauuu

SEQ ID NO: 692970 - RNA, 63 nt, hsa
gggcuggaguagaggacucuggugggaagguuuugcugcuaauguauuuauggaaugaaugua

SEQ ID NO: 692971 - RNA, 63 nt, hsa
ucagcuagcaaaagaaguaacaagagugauucuugcugcuauuacugcuaaaaaaaaaaaaaa

SEQ ID NO: 692972 - RNA, 63 nt, hsa
uaaagucuagagaggacauugcaccuuugcugcugcugcuaucuuccaagagaacgggacucc

SEQ ID NO: 692973 - RNA, 63 nt, hsa
aagcaaucgggauaaaacagcauuagauagucaugcugcuagaucuuuauuauggaaaacauu

SEQ ID NO: 692974 - RNA, 63 nt, hsa
uuucugugaucucugaggucuauuuuauguuuuugcugcuacuucuguggaaguagcuuugaa

SEQ ID NO: 692975 - RNA, 63 nt, hsa
uugucugaccacauucuuuuuguauccaaauagugcugcuagaaacugcacugaaguggcuga

SEQ ID NO: 692976 - RNA, 63 nt, hsa
cauaguuagaagaauauauuuauaaagauuccuugcugcuaagucagaucagauuugcuaaca

SEQ ID NO: 692977 - RNA, 63 nt, hsa
ucuucuggacagaccacaacucuaagaagcuagugcugcuaucucauauaugaguauuaaaua

SEQ ID NO: 692978 - RNA, 63 nt, hsa
aucucuccacuguccuguaagcugugcagaaccugcugcuaacaccaaggugugaacaugccc

SEQ ID NO: 692979 - RNA, 63 nt, hsa; identical to SEQ ID NO: 423639

SEQ ID NO: 692980 - RNA, 63 nt, hsa; identical to SEQ ID NO: 423640

SEQ ID NO: 692981 - RNA, 63 nt, hsa
aaggcucuuaaagagcaaauguccucuucuccuugcugcuagagugggaggagaaagaugucu

SEQ ID NO: 692982 - RNA, 63 nt, hsa
gauguggcuuaacaaucagacuucuucuauuuuugcugcuauggugguuguauuagagaacug

SEQ ID NO: 692983 - RNA, 63 nt, hsa
ucuaaauuaacuucuauuuucaaguggaaaccuugcugcuaugcuguucauugaugacauggg

SEQ ID NO: 692984 - RNA, 63 nt, hsa
gugcaaagccagcaugcgaguucagcuuccauuugcugcuauaaauuuuguucuuguugcugc

SEQ ID NO: 692985 - RNA, 63 nt, hsa
uuuuuauuauugcauuuuauuuugacccuggacugcugcuaugaacaauagaauaugcauuug

SEQ ID NO: 692986 - RNA, 63 nt, hsa
cuuguugaauucuuacaguuuuuagauggaauuugcugcuauaagaauguccagcuaccaugg

SEQ ID NO: 692987 - RNA, 63 nt, hsa
ccaguggggacccacacccuggcugggcagaggugcugcuagcaaccucucuuccucuauaag

SEQ ID NO: 692988 - RNA, 63 nt, hsa
aauacagugucugaguuuucaucggucuucacaugcugcuauauauuccacagaguuccuugc

SEQ ID NO: 692989 - RNA, 63 nt, hsa
gaugucccccaggcaucuugaucccagccugacugcugcuacaucuaauccccuaccaaugcc

SEQ ID NO: 692990 - RNA, 63 nt, hsa
gguagaaaugaugucagcauucuuauuugcugaugcugcuaugauaccacgccuuaaaaauug

SEQ ID NO: 692991 - RNA, 63 nt, hsa
ucuggggagagcagcacacuggccgcccagcacugcugcuaugacgaggacagccggcugcug

SEQ ID NO: 692992 - RNA, 63 nt, hsa
ggagugguuugaguaguacagaccucgaagccuugcugcuaacacugagguagcucucuucau

SEQ ID NO: 692993 - RNA, 63 nt, hsa
ucuuaaaaguauauuuuuucuauaaacauccuuugcugcuacauuagaacuuuuauagccuaa

SEQ ID NO: 692994 - RNA, 63 nt, hsa; identical to SEQ ID NO: 423641

SEQ ID NO: 692995 - RNA, 63 nt, hsa; identical to SEQ ID NO: 423642

SEQ ID NO: 692996 - RNA, 63 nt, hsa
aaugccagaauguaagaguugcaagugauuuugugcugcuauucauuaaaacuuguauuccag

SEQ ID NO: 692997 - RNA, 63 nt, hsa
auccuucacaggcagugcaugugaagcaugcuuugcugcuaugaaaaugagcaucagagagug

SEQ ID NO: 692998 - RNA, 63 nt, hsa
cuggucugaauuucuuaagguuuuauaaacaaaugcugcuauuuauuagcugcaagaaugcac

SEQ ID NO: 692999 - RNA, 63 nt, hsa
uugauccccuaacucacugucugcggugcucauugcugcuaacagcauugccugugcucuccu

SEQ ID NO: 693000 - RNA, 63 nt, hsa
uucuuaagcagaaaauauuguugagguuaccuuugcugcuaaagauccaaucuucuaacgcca

SEQ ID NO: 693001 - RNA, 63 nt, hsa
uagaagacagauggaguucuccccugaacuccuugcugcuaagaagugcugagaaguuacucg

SEQ ID NO: 693002 - RNA, 63 nt, hsa
uaguaauuguuuauauucauaauuauucagcucugcugcuaaacacguaguuccacuucguuu

SEQ ID NO: 693003 - RNA, 63 nt, hsa
cacacuugcaauugugucugguaugcuuguuccugcugcuaauaaaguaaggcccauuacugu

SEQ ID NO: 693004 - RNA, 63 nt, hsa
gagacugacagcuuugcagguagcaguagugugugcugcuauuguggaauauacguguguaga

SEQ ID NO: 693005 - RNA, 63 nt, hsa
aacuuaagcaagcaagcguguauuuuccuugucugcugcuauuugaaguaauuaguacagcug

SEQ ID NO: 693006 - RNA, 63 nt, hsa
uauuucucuuuucuguuuaugaaguacaacccaugcugcuaagaugcgagcaggaagaggcau

SEQ ID NO: 693007 - RNA, 63 nt, hsa
agcgccucucacacagguaaugcccagcuuuucugcugcuaacacauuuggccaguuguugca

SEQ ID NO: 693008 - RNA, 63 nt, hsa
agccuugucuguaucugggcagcagguguuccaugcugcuagguggcgggggucgggggucuu

SEQ ID NO: 693009 - RNA, 63 nt, hsa
uucccaacugggggugguuaaagggagccccacugcugcuaccuggggaauggggcaccuggg

SEQ ID NO: 693010 - RNA, 63 nt, hsa
uuguaaauuaaaaucuuacaaacuaaaucagugugcugcuagaggguucuuuuucacuugaca

SEQ ID NO: 693011 - RNA, 63 nt, hsa
cccugccagaaaugacccgcccucaaugcuggcugcugcuaacauuaaugagaagguggccuu

SEQ ID NO: 693012 - RNA, 63 nt, hsa
uuucaaaaccagcuuuuuucuauauauaaauuaugcugcuauuacagauuuaacauuuucugu

SEQ ID NO: 693013 - RNA, 63 nt, hsa
gguaccaggaaagaggauauucuaggcuuugcgugcugcuagcuggguucaggcuucacccac

SEQ ID NO: 693014 - RNA, 63 nt, hsa
guauguauggaguggguuggggccccaaagcuuugcugcuauugauuuguccccgacagcagg

SEQ ID NO: 693015 - RNA, 63 nt, hsa
agaauuggucuuuccuaaaaaugcaacagauaaugcugcuagauuguuauuuuguuugcacuu

SEQ ID NO: 693016 - RNA, 63 nt, hsa
ggggugcguacuagcacgugcccaguugcucagugcugcuaguagaaauugauuugcauaguc

SEQ ID NO: 693017 - RNA, 63 nt, hsa
cgccugaccugggggagccgaccaauuagucacugcugcuacugccccucuccgaaagaagac

SEQ ID NO: 693018 - RNA, 63 nt, hsa
acaaaaacuauggaaaauaucuuuguucuuguuugcugcuauuuucuguccuauuuugagaaa

SEQ ID NO: 693019 - RNA, 63 nt, hsa
ucuaucuugaauuucaugcuuuccuaaagucucugcugcuaaggcucuauuuccucccccagu

SEQ ID NO: 693020 - RNA, 63 nt, hsa
acuugagugugcaagcaaagaacccauuugccaugcugcuaugaagacuacuuuuagaucaac

SEQ ID NO: 693021 - RNA, 63 nt, hsa
ugcuucagucaccucccaccucuugccaccugcugcugcuaucuguccuuacuugugggcuuc

SEQ ID NO: 693022 - RNA, 63 nt, hsa
gccacccgugggaaugcugcccgcucugcagacugcugcuagagccagcaacuccacuaaggu

SEQ ID NO: 693023 - RNA, 63 nt, hsa
gccaggaaacaauaggaaccaaaagccucugccugcugcuauugcaauucccaggaucucucc

SEQ ID NO: 693024 - RNA, 63 nt, hsa
aggagggauugaaaggcaucccaguucuaaggcugcugcuaauuacagcccccaaccuccaac

SEQ ID NO: 693025 - RNA, 63 nt, hsa
auguuuuuuacucucaggggaaaguuggggacaugcugcuacaauacggcuaaucuuucauug

SEQ ID NO: 693026 - RNA, 63 nt, hsa
ugaaguuuuccuugcuauuucaauaacagauggugcugcuaauucccaacauuucuuaaauua

SEQ ID NO: 693027 - RNA, 63 nt, hsa
ggagcaaauguccuaacagagaaauagaggugaugcugcuaaagggagaaaugccaggcggac

SEQ ID NO: 693028 - RNA, 63 nt, hsa
ucuugacagugagaggauauugagggcuucagcugcugcuauuaugauguuuugcaaaggaaa

SEQ ID NO: 693029 - RNA, 63 nt, hsa
acuugucacaccugucuuaauaaacuggaguuuugcugcuaaagaacucuucucucugggggc

SEQ ID NO: 693030 - RNA, 63 nt, hsa
ucucccccgcccugccccgccuucgugugcugcugcugcuauugcugucuggugagguggccc

SEQ ID NO: 693031 - RNA, 63 nt, hsa
uuaaauaaaagaaaugcacaaugucuugguacuugcugcuauuuuacugucuuaauuaaguaa

SEQ ID NO: 693032 - RNA, 63 nt, hsa
aaagaaaggauauuuuaauaaguucuuucugcuugcugcuaagaguuugcuaaagugucauga

SEQ ID NO: 693033 - RNA, 63 nt, hsa
ucucugcaggcugucucucaagguggucucuucugcugcuagcaacucaaaaaucccaacagc

SEQ ID NO: 693034 - RNA, 63 nt, hsa
aaguucuggcuuagcagcugcaggcaagcauuaugcugcuauugaagaagcauuagggguaug

SEQ ID NO: 693035 - RNA, 63 nt, hsa
ccuccacuccuuccugccaccugcugcugcugcugcugcuaaucuucagggcacugcugcugc

SEQ ID NO: 693036 - RNA, 63 nt, hsa
uuuaauauuaaauauguucucacuuaauugcuuugcugcuagacuugcaacuaauuuuuuuaa

SEQ ID NO: 693037 - RNA, 53 nt, hsa; identical to SEQ ID NO: 423966

SEQ ID NO: 693038 - RNA, 63 nt, hsa
uuuguuaaaaggcuacacgagcucucuagaaacugcugcuacuagaaaugucuaaacuauaag

SEQ ID NO: 693039 - RNA, 63 nt, hsa
aguacaagugugugauguuagaaccucccuaguugcugcuauaucaaacacugcacacuugac

SEQ ID NO: 693040 - RNA, 63 nt, hsa
cgcacggccuuggagcaggaggugggucuggcaugcugcuaugucucaaaagaggucauccgg

SEQ ID NO: 693041 - RNA, 63 nt, hsa
gaacauaaaagaaagagaaucucagaaguaguuugcugcuaauauauacauauauuguauaaa

SEQ ID NO: 693042 - RNA, 63 nt, hsa
auuccauacagugaaggaaauuugagucuguauugcugcuacaaggguaaaaccaggaccaau

SEQ ID NO: 693043 - RNA, 63 nt, hsa
gcaguccugggcuuagcuucugcccagcuuuauugcugcuauuggcaaagagcacaggacuca

SEQ ID NO: 693044 - RNA, 63 nt, hsa
ugauugauaaagggaauguugcauuugggacuaugcugcuaacgaaaugguuugaaguauuuu

SEQ ID NO: 693045 - RNA, 63 nt, hsa
aauucuccucaaugccccccccgcccaguccuuugcugcuauccacugugauuuuuaugcauu

SEQ ID NO: 693046 - RNA, 63 nt, hsa
cgugagcugagcaggccacacuucaaacuacuuugcugcuaauauuuuccuccugagugcuug

SEQ ID NO: 693047 - RNA, 63 nt, hsa
gucaaagugaugaauauggaauauccaauccugugcugcuauccugccaaaaucauuuuaaug

SEQ ID NO: 693048 - RNA, 63 nt, hsa
gaagaagacuguuuccaaauaauuugaacagcuugcugcuaaaugggacccaauuuuuggccu

SEQ ID NO: 693049 - RNA, 63 nt, hsa
ccccaccgcccaccaccuccuccccuucauuccugcugcuaccccuggucccgagggcuggga

SEQ ID NO: 693050 - RNA, 63 nt, hsa
gguggccccguggggguagcucacucccccuccugcugcuaugccugugacccccgcggccca

SEQ ID NO: 693051 - RNA, 63 nt, hsa
uacuccugacuuguaauaagaagacaucagagaugcugcuaagucggcuccagcacacaggag

SEQ ID NO: 693052 - RNA, 63 nt, hsa; identical to SEQ ID NO: 423643

SEQ ID NO: 693053 - RNA, 63 nt, hsa; identical to SEQ ID NO: 423644

SEQ ID NO: 693054 - RNA, 63 nt, hsa
ucugucccacggcccacacgcucacuugacucaugcugcuaagaugcacaaccgcacacccau

SEQ ID NO: 693055 - RNA, 63 nt, hsa
ugggcuacuuccaccuuuugccuauugaaauaaugcugcuaugaagaugaguguacaaguguc

SEQ ID NO: 693056 - RNA, 63 nt, hsa
aggggacagguagguggcuggagggacccuuuuugcugcuagaaagccccucccuucucccgg

SEQ ID NO: 693057 - RNA, 63 nt, hsa
agaucaaguguaucugaacucucagguugugagugcugcuauuggacccaaaaggaacguguc

SEQ ID NO: 693058 - RNA, 63 nt, hsa
cuugggucccacugucaccaaggcaaccaguccugcugcuaccugucaccuagagucacacac

SEQ ID NO: 693059 - RNA, 63 nt, hsa
gcucccauccucaucucucuccuugacuggaauugcugcuacccagcuggggugggugaggcc

SEQ ID NO: 693060 - RNA, 63 nt, hsa
cucugcauacccucaucaaaaacacucucacuaugcugcuauggacgaccuccagcucucagu

SEQ ID NO: 693061 - RNA, 63 nt, hsa
cacaccccugcgucuggccgguccccccacugcugcugcuaucaacgccagaauaaacacacu

SEQ ID NO: 693062 - RNA, 63 nt, hsa
cucugcacggcauggagugggaaccccaccagcugcugcuacaggaccugggauugccuggga

SEQ ID NO: 693063 - RNA, 63 nt, hsa
gccaacccaccccccaguccacauggucaccacugcugcuaccagcugcucagugcaguggcc

SEQ ID NO: 693064 - RNA, 63 nt, hsa
ugacagggcuggggccacagucuacucugucucugcugcuagagaagccaccuguggaggacu

SEQ ID NO: 693065 - RNA, 63 nt, hsa
ugaaagcaaacuucacaauaauggacguagacuugcugcuaugaaaacauauuuuuuuuauuu

SEQ ID NO: 693066 - RNA, 63 nt, hsa
cauuuauacuucuccagacccccugccauccucugcugcuacccacacaggcagaauaaaagg

SEQ ID NO: 693067 - RNA, 63 nt, hsa
gcugugcugauagugcugagggagauaggaauuugcugcuaagauuuuucuuugggguggagu

SEQ ID NO: 693068 - RNA, 63 nt, hsa
aguggagccugccggcgcaucugaggggcagaaugcugcuagcacuugaaucugggaucucgc

SEQ ID NO: 693069 - RNA, 63 nt, hsa
acacucgggaaaugaguaaagaaaauguaaaauugcugcuagucaaaucuuuuggaaagaauu

SEQ ID NO: 693070 - RNA, 63 nt, hsa
gcugaacccucucaaagggcugucaccaucaccugcugcuaggacacuacaaaacaaucaaau

SEQ ID NO: 693071 - RNA, 63 nt, hsa
aaaggcaguggcaaguaaguuauagaagagaaaugcugcuagaaggaauuaagcguuguagua

SEQ ID NO: 693072 - RNA, 63 nt, hsa
cuccuggacgggcuggagcugggcuccugccuuugcugcuaacacuggaggcgguguuccuaa

SEQ ID NO: 693073 - RNA, 63 nt, hsa
aacccuugccuuccugucacaggguuugcuuguugcugcuauaguuuuuaacuuuuuuuuauu

SEQ ID NO: 693074 - RNA, 63 nt, hsa
aacugccauaaauuuucuaguuccaguuuaguuugcugcuauuagcagaaacucaauuguuuc

SEQ ID NO: 693075 - RNA, 63 nt, hsa
cugcacagacaagacacucaguguccuuggcagugcugcuacuccucaggugcagcauacaua

SEQ ID NO: 693076 - RNA, 63 nt, hsa
ucacucucuggcugcugggucugccgucgguccugcugcuaaccuggcaccagagccucugcc

SEQ ID NO: 693077 - RNA, 63 nt, hsa
ggcgcucaugauuguuucugauuguuucacgcaugcugcuaacccagagccugggcccaaagc

SEQ ID NO: 693078 - RNA, 63 nt, hsa
ggcacagaacccugugccccaccaggauuggccugcugcuaggggccaggggcccugaccagg

SEQ ID NO: 693079 - RNA, 63 nt, hsa
gggugcauauacguagagucugaacaggugcucugcugcuagaaacagcaaaccaucuagauu

SEQ ID NO: 693080 - RNA, 63 nt, hsa
ggauggagacaguggcagcucccacagugaugcugcugcuaagggcuuccaaacauugccugc

SEQ ID NO: 693081 - RNA, 63 nt, hsa
cuccacauaucccuacaugaaauaugggaaaguugcugcuauugauucagggucugucuugga

SEQ ID NO: 693082 - RNA, 63 nt, hsa
gucagcguccuuauuuauugguucuugaaguuuugcugcuauguuacugaaucauacuaaaga

SEQ ID NO: 693083 - RNA, 63 nt, hsa
cacucugaauucuuacuugauggagguuuuguuugcugcuacgguuuuaaucauccagggugc

SEQ ID NO: 693084 - RNA, 63 nt, hsa
cuauuugcacacgacagauuucuagauacuuuuugcugcuaguuuuauguaauauuuauugaa

SEQ ID NO: 693085 - RNA, 63 nt, hsa
uacucucucagauggcucaucauaggggaaaccugcugcuacaucaugagauagcccugugga

SEQ ID NO: 693086 - RNA, 63 nt, hsa
ucuuuuggcccuccgcccccgcaggcuucugugugcugcuaacuguauuuauugugaugccuu

SEQ ID NO: 693087 - RNA, 63 nt, hsa
ugagggaagcaauagguagcuggggagcccuauugcugcuaagucauuggcaaagugacaaag

SEQ ID NO: 693088 - RNA, 63 nt, hsa; identical to SEQ ID NO: 423645

SEQ ID NO: 693089 - RNA, 63 nt, hsa; identical to SEQ ID NO: 423646

SEQ ID NO: 693090 - RNA, 63 nt, hsa
ucuuuaauucuugucauccaggucaacauaugaugcugcuauaagucuggggcucaaauugau

SEQ ID NO: 693091 - RNA, 63 nt, hsa
agaaggcaaagcugccaguaaaugucucagcauugcugcuaauuuugguccugcuaguuucug

SEQ ID NO: 693092 - RNA, 63 nt, hsa
uuuggguuuccacucuuuagcuauuaugaauaaugcugcuaugaacauuuguguauaaguuuu

SEQ ID NO: 693093 - RNA, 63 nt, hsa
ugauugauugauugauugauacauucagcuuccugcugcuagcaaugccacgauuuagauuua

SEQ ID NO: 693094 - RNA, 63 nt, hsa
uuuuaccuugucauuuuggucuaagguugccauugcugcuaaagguuaccgauuucaaagucc

SEQ ID NO: 693095 - RNA, 63 nt, hsa
ccaucccccgccuuuuuuuuuuuuuuuuuuaacugcugcuaucugcagcuggauacucuucuu

SEQ ID NO: 693096 - RNA, 63 nt, hsa
ccaucacuaaaggccaaucagaauuuggaaccaugcugcuacccaagaaaucuaauggaauga

SEQ ID NO: 693097 - RNA, 63 nt, hsa
uuuagaaacacauaauuaacacuuaagguugggugcugcuaauucuuugcaaaaauccaaaua

SEQ ID NO: 693098 - RNA, 63 nt, hsa
uggggccccugacugcaaugugaaaccucucgcugcugcuagguuuacaaacaagcccauugu

SEQ ID NO: 693099 - RNA, 63 nt, hsa
cuauccaccucccccaagccccuuuaccuaugcugcugcuaacgcugcugcugcugcugcugc

SEQ ID NO: 693100 - RNA, 63 nt, hsa; identical to SEQ ID NO: 693091

SEQ ID NO: 693101 - RNA, 63 nt, hsa
cccgggcucuggccacccuggcccgccccucgcugcugcuacuacccgagcccagcuacauuc

SEQ ID NO: 693102 - RNA, 63 nt, hsa
cuccagaggaguacgccgacuucagcagcuuccugcugcuagucgaugcagcaguacaaacgg

SEQ ID NO: 693103 - RNA, 63 nt, hsa
acuauuugcacacaacagauuuuagauacuuuuugcugcuaguuguguaauauuuauugaaca

SEQ ID NO: 693104 - RNA, 63 nt, hsa
aagcugcaguggugauggcaggcuccuaaagacugcugcuaaaagacacaagaauuauacagu

SEQ ID NO: 693105 - RNA, 64 nt, hsa; identical to SEQ ID NO: 223137

SEQ ID NO: 693106 - RNA, 64 nt, hsa; identical to SEQ ID NO: 223138

SEQ ID NO: 693107 - RNA, 64 nt, hsa; identical to SEQ ID NO: 223139

SEQ ID NO: 693108 - RNA, 64 nt, hsa; identical to SEQ ID NO: 223140

SEQ ID NO: 693109 - RNA, 64 nt, hsa; identical to SEQ ID NO: 223141

SEQ ID NO: 693110 - RNA, 64 nt, hsa; identical to SEQ ID NO: 223142

SEQ ID NO: 693111 - RNA, 64 nt, hsa; identical to SEQ ID NO: 223143

SEQ ID NO: 693112 - RNA, 64 nt, hsa; identical to SEQ ID NO: 223144

SEQ ID NO: 693113 - RNA, 64 nt, hsa; identical to SEQ ID NO: 208878

SEQ ID NO: 693114 - RNA, 64 nt, hsa; identical to SEQ ID NO: 208879

SEQ ID NO: 693115 - RNA, 64 nt, hsa; identical to SEQ ID NO: 208880

SEQ ID NO: 693116 - RNA, 64 nt, hsa; identical to SEQ ID NO: 208881

SEQ ID NO: 693117 - RNA, 64 nt, hsa
uauuugugcuugaagguguuuuugauauuuggaaacaguauaagccauuuggagucaugauugg

SEQ ID NO: 693118 - RNA, 64 nt, hsa
auugcacugaaugauauauuauuagggcauguuaacaguauaccaguaacagcacuuuaucuca

SEQ ID NO: 693119 - RNA, 64 nt, hsa
gggggcaaugaugaaacuuuguacaguauaugaaacaguauauuaacccuaaaaccuagauguu

SEQ ID NO: 693120 - RNA, 64 nt, hsa
aauuccaagguugggggcaaugaugaaacuuuguacaguauaugaaacaguauauuaacccuaa

SEQ ID NO: 693121 - RNA, 64 nt, hsa
ucuguauaacuugugauuccagggcuguuugucaacaguauacaaaagaauugugccucuccca

SEQ ID NO: 693122 - RNA, 64 nt, hsa
gggacaacucuguggccugggggacaucugugucacaguauaggauugccauucagguguuuug

SEQ ID NO: 693123 - RNA, 64 nt, hsa
ucugugacccacuuaccuugcaucucacagguagacaguauauaacuaacaaccaaagacuaca

SEQ ID NO: 693124 - RNA, 64 nt, hsa
caaccagauugucagcuccuugagggcaagagccacaguauauuucccuguuucuuccacagug

SEQ ID NO: 693125 - RNA, 64 nt, hsa
uucuuuuuuuccuagagccuucagaugagagggaacaguauauucuauugcacgucuacaauuc

SEQ ID NO: 693126 - RNA, 64 nt, hsa
cccaugaccaccauucacuuaaauuuuuaaaagaacaguauauucuuuuuuuccuagagccuuc

SEQ ID NO: 693127 - RNA, 64 nt, hsa
uaaugagaacaccuuugcccugaagucaguucucacaguauagaagagaacuuaaagagggaaa

SEQ ID NO: 693128 - RNA, 64 nt, hsa
agcaugauacuggcauaacaacagacacauaggaacaguauagacaacccagaaacaaauucau

SEQ ID NO: 693129 - RNA, 64 nt, hsa
uauauuaaaacaguauauacauauguguguauauacaguauauacauauauauauuuucacuug

SEQ ID NO: 693130 - RNA, 64 nt, hsa
auauauauacauauauauuuguuaauauauuaaaacaguauauacauauguguguauauacagu

SEQ ID NO: 693131 - RNA, 64 nt, hsa
ucuccauaguuuaaaaucgaauagugccaucaucacaguauauuagucaaauagaagcuucauc

SEQ ID NO: 693132 - RNA, 64 nt, hsa
uaacuaaaacaugaaaaguaaaccuccagcuuccacaguauauuaccugccguugcaugcauuu

SEQ ID NO: 693133 - RNA, 64 nt, hsa
ucaugcaauauauggcauauuuugauacaagaauacaguauauaauaaucacaucaggguaaau

SEQ ID NO: 693134 - RNA, 64 nt, hsa
ccaccuuacucaaggguguacguaaaacaugguaacaguauacuauuugguaacauaauggauu

SEQ ID NO: 693135 - RNA, 64 nt, hsa
accuuaacucaccccucagcaaauaccuaugucaacaguauaaguuaccauuuacucuauaauc

SEQ ID NO: 693136 - RNA, 64 nt, hsa
auauauaguuaugcauacauacacacacacacauacaguauauucuuuccucaaaaggguuaag

SEQ ID NO: 693137 - RNA, 64 nt, hsa; identical to SEQ ID NO: 84807

SEQ ID NO: 693138 - RNA, 64 nt, hsa; identical to SEQ ID NO: 84808

SEQ ID NO: 693139 - RNA, 64 nt, hsa; identical to SEQ ID NO: 539759

SEQ ID NO: 693140 - RNA, 64 nt, hsa; identical to SEQ ID NO: 539760

SEQ ID NO: 693141 - RNA, 64 nt, hsa; identical to SEQ ID NO: 539761

SEQ ID NO: 693142 - RNA, 64 nt, hsa; identical to SEQ ID NO: 539762

SEQ ID NO: 693143 - RNA, 64 nt, hsa; identical to SEQ ID NO: 539763

SEQ ID NO: 693144 - RNA, 64 nt, hsa; identical to SEQ ID NO: 539764

SEQ ID NO: 693145 - RNA, 64 nt, hsa; identical to SEQ ID NO: 539765

SEQ ID NO: 693146 - RNA, 64 nt, hsa; identical to SEQ ID NO: 539766

SEQ ID NO: 693147 - RNA, 64 nt, hsa; identical to SEQ ID NO: 539767

SEQ ID NO: 693148 - RNA, 64 nt, hsa; identical to SEQ ID NO: 539768

SEQ ID NO: 693149 - RNA, 64 nt, hsa; identical to SEQ ID NO: 539769

SEQ ID NO: 693150 - RNA, 64 nt, hsa; identical to SEQ ID NO: 539770

SEQ ID NO: 693151 - RNA, 64 nt, hsa; identical to SEQ ID NO: 539771

SEQ ID NO: 693152 - RNA, 64 nt, hsa; identical to SEQ ID NO: 539772

SEQ ID NO: 693153 - RNA, 64 nt, hsa; identical to SEQ ID NO: 539773

SEQ ID NO: 693154 - RNA, 64 nt, hsa; identical to SEQ ID NO: 539774

SEQ ID NO: 693155 - RNA, 64 nt, hsa; identical to SEQ ID NO: 539775

SEQ ID NO: 693156 - RNA, 64 nt, hsa; identical to SEQ ID NO: 539776

SEQ ID NO: 693157 - RNA, 64 nt, hsa; identical to SEQ ID NO: 539777

SEQ ID NO: 693158 - RNA, 64 nt, hsa; identical to SEQ ID NO: 539778

SEQ ID NO: 693159 - RNA, 64 nt, hsa; identical to SEQ ID NO: 539779

SEQ ID NO: 693160 - RNA, 64 nt, hsa; identical to SEQ ID NO: 539780

SEQ ID NO: 693161 - RNA, 64 nt, hsa; identical to SEQ ID NO: 539781

SEQ ID NO: 693162 - RNA, 64 nt, hsa; identical to SEQ ID NO: 539782

SEQ ID NO: 693163 - RNA, 64 nt, hsa; identical to SEQ ID NO: 539783

SEQ ID NO: 693164 - RNA, 64 nt, hsa; identical to SEQ ID NO: 539784

SEQ ID NO: 693165 - RNA, 64 nt, hsa; identical to SEQ ID NO: 539785

SEQ ID NO: 693166 - RNA, 64 nt, hsa; identical to SEQ ID NO: 539786

SEQ ID NO: 693167 - RNA, 64 nt, hsa; identical to SEQ ID NO: 539787

SEQ ID NO: 693168 - RNA, 64 nt, hsa; identical to SEQ ID NO: 539788

SEQ ID NO: 693169 - RNA, 64 nt, hsa; identical to SEQ ID NO: 81719

SEQ ID NO: 693170 - RNA, 64 nt, hsa; identical to SEQ ID NO: 81720

SEQ ID NO: 693171 - RNA, 64 nt, hsa; identical to SEQ ID NO: 81721

SEQ ID NO: 693172 - RNA, 64 nt, hsa; identical to SEQ ID NO: 81722

SEQ ID NO: 693173 - RNA, 64 nt, hsa; identical to SEQ ID NO: 81723

SEQ ID NO: 693174 - RNA, 64 nt, hsa; identical to SEQ ID NO: 81724

SEQ ID NO: 693175 - RNA, 64 nt, hsa; identical to SEQ ID NO: 81725

SEQ ID NO: 693176 - RNA, 64 nt, hsa; identical to SEQ ID NO: 81726

SEQ ID NO: 693177 - RNA, 64 nt, hsa; identical to SEQ ID NO: 81727

SEQ ID NO: 693178 - RNA, 64 nt, hsa; identical to SEQ ID NO: 81728

SEQ ID NO: 693179 - RNA, 64 nt, hsa; identical to SEQ ID NO: 81729

SEQ ID NO: 693180 - RNA, 64 nt, hsa; identical to SEQ ID NO: 81730

SEQ ID NO: 693181 - RNA, 64 nt, hsa; identical to SEQ ID NO: 81731

SEQ ID NO: 693182 - RNA, 64 nt, hsa; identical to SEQ ID NO: 81732

SEQ ID NO: 693183 - RNA, 64 nt, hsa; identical to SEQ ID NO: 81733

SEQ ID NO: 693184 - RNA, 64 nt, hsa; identical to SEQ ID NO: 81734

SEQ ID NO: 693185 - RNA, 64 nt, hsa
guguuuucuuugaagugcccucuccuaaugcagaggccuugaagcuuacaguauacacuugaaa

SEQ ID NO: 693186 - RNA, 64 nt, hsa
gauaaauuacagucaaagauugugucaccucaaaggccuugaagaauauauuuucuuggugaau

SEQ ID NO: 693187 - RNA, 64 nt, hsa
aguaguaccauuuugauuagucugaauguuuucaggccuugaaauaaauuuugacuaagugaua

SEQ ID NO: 693188 - RNA, 64 nt, hsa
augaaauaguuauaaaauuauuuuuaauauuuaaggccuugaaauuauauuccaaggcaaaucu

SEQ ID NO: 693189 - RNA, 50 nt, hsa
gccuggccagccuccugugaggccuugauggggccauccagcuccgcagg

SEQ ID NO: 693190 - RNA, 64 nt, hsa
cccaggggcaccacgccugacucuccaucacccaggccuugaugccgagcgggaguagaguguu

SEQ ID NO: 693191 - RNA, 64 nt, hsa
uggcaaacuggccuugaucaguguccguauguaaggccuugagaggacccugcaggcagucagc

SEQ ID NO: 693192 - RNA, 64 nt, hsa
gcauggcuggcaggggcagcugcuguggcaaacuggccuugaucaguguccguauguaaggccu

SEQ ID NO: 693193 - RNA, 64 nt, hsa
agugcagugaugcaaucacagcucaccucagugcggccuugaacuccuggacucaaucgauccu

SEQ ID NO: 693194 - RNA, 64 nt, hsa
agugcagugaugcaaucacagcucaccucagugcggccuugaacuccuggacucaauugauccu

SEQ ID NO: 693195 - RNA, 64 nt, hsa; identical to SEQ ID NO: 106040

SEQ ID NO: 693196 - RNA, 64 nt, hsa; identical to SEQ ID NO: 106041

SEQ ID NO: 693197 - RNA, 64 nt, hsa; identical to SEQ ID NO: 106042

SEQ ID NO: 693198 - RNA, 64 nt, hsa; identical to SEQ ID NO: 106043

SEQ ID NO: 693199 - RNA, 64 nt, hsa; identical to SEQ ID NO: 106044

SEQ ID NO: 693200 - RNA, 64 nt, hsa; identical to SEQ ID NO: 106045

SEQ ID NO: 693201 - RNA, 64 nt, hsa; identical to SEQ ID NO: 106046

SEQ ID NO: 693202 - RNA, 64 nt, hsa; identical to SEQ ID NO: 106047

SEQ ID NO: 693203 - RNA, 64 nt, hsa; identical to SEQ ID NO: 106048

SEQ ID NO: 693204 - RNA, 64 nt, hsa; identical to SEQ ID NO: 106049

SEQ ID NO: 693205 - RNA, 64 nt, hsa; identical to SEQ ID NO: 106050

SEQ ID NO: 693206 - RNA, 64 nt, hsa; identical to SEQ ID NO: 106051

SEQ ID NO: 693207 - RNA, 64 nt, hsa; identical to SEQ ID NO: 106052

SEQ ID NO: 693208 - RNA, 64 nt, hsa; identical to SEQ ID NO: 106053

SEQ ID NO: 693209 - RNA, 64 nt, hsa; identical to SEQ ID NO: 106054

SEQ ID NO: 693210 - RNA, 64 nt, hsa; identical to SEQ ID NO: 106055

SEQ ID NO: 693211 - RNA, 64 nt, hsa; identical to SEQ ID NO: 106056

SEQ ID NO: 693212 - RNA, 64 nt, hsa; identical to SEQ ID NO: 106057

SEQ ID NO: 693213 - RNA, 64 nt, hsa; identical to SEQ ID NO: 106058

SEQ ID NO: 693214 - RNA, 64 nt, hsa; identical to SEQ ID NO: 106059

SEQ ID NO: 693215 - RNA, 64 nt, hsa; identical to SEQ ID NO: 106060

SEQ ID NO: 693216 - RNA, 64 nt, hsa; identical to SEQ ID NO: 106061

SEQ ID NO: 693217 - RNA, 64 nt, hsa; identical to SEQ ID NO: 106062

SEQ ID NO: 693218 - RNA, 64 nt, hsa; identical to SEQ ID NO: 106063

SEQ ID NO: 693219 - RNA, 64 nt, hsa; identical to SEQ ID NO: 106064

SEQ ID NO: 693220 - RNA, 64 nt, hsa; identical to SEQ ID NO: 106065

SEQ ID NO: 693221 - RNA, 64 nt, hsa; identical to SEQ ID NO: 106066

SEQ ID NO: 693222 - RNA, 64 nt, hsa; identical to SEQ ID NO: 106067

SEQ ID NO: 693223 - RNA, 64 nt, hsa; identical to SEQ ID NO: 106068

SEQ ID NO: 693224 - RNA, 64 nt, hsa; identical to SEQ ID NO: 106069

SEQ ID NO: 693225 - RNA, 64 nt, hsa; identical to SEQ ID NO: 106070

SEQ ID NO: 693226 - RNA, 64 nt, hsa; identical to SEQ ID NO: 106071

SEQ ID NO: 693227 - RNA, 64 nt, hsa; identical to SEQ ID NO: 106072

SEQ ID NO: 693228 - RNA, 64 nt, hsa; identical to SEQ ID NO: 106073

SEQ ID NO: 693229 - RNA, 64 nt, hsa; identical to SEQ ID NO: 106074

SEQ ID NO: 693230 - RNA, 64 nt, hsa; identical to SEQ ID NO: 106075

SEQ ID NO: 693231 - RNA, 64 nt, hsa; identical to SEQ ID NO: 106076

SEQ ID NO: 693232 - RNA, 64 nt, hsa; identical to SEQ ID NO: 106077

SEQ ID NO: 693233 - RNA, 64 nt, hsa; identical to SEQ ID NO: 106078

SEQ ID NO: 693234 - RNA, 64 nt, hsa; identical to SEQ ID NO: 106079

SEQ ID NO: 693235 - RNA, 64 nt, hsa; identical to SEQ ID NO: 106080

SEQ ID NO: 693236 - RNA, 64 nt, hsa; identical to SEQ ID NO: 106081

SEQ ID NO: 693237 - RNA, 64 nt, hsa; identical to SEQ ID NO: 106082

SEQ ID NO: 693238 - RNA, 64 nt, hsa; identical to SEQ ID NO: 106083

SEQ ID NO: 693239 - RNA, 64 nt, hsa; identical to SEQ ID NO: 106084

SEQ ID NO: 693240 - RNA, 64 nt, hsa; identical to SEQ ID NO: 106085

SEQ ID NO: 693241 - RNA, 64 nt, hsa; identical to SEQ ID NO: 106086

SEQ ID NO: 693242 - RNA, 64 nt, hsa; identical to SEQ ID NO: 106087

SEQ ID NO: 693243 - RNA, 64 nt, hsa; identical to SEQ ID NO: 106088

SEQ ID NO: 693244 - RNA, 64 nt, hsa; identical to SEQ ID NO: 124377

SEQ ID NO: 693245 - RNA, 64 nt, hsa; identical to SEQ ID NO: 124378

SEQ ID NO: 693246 - RNA, 64 nt, hsa; identical to SEQ ID NO: 124379

SEQ ID NO: 693247 - RNA, 64 nt, hsa; identical to SEQ ID NO: 124380

SEQ ID NO: 693248 - RNA, 64 nt, hsa; identical to SEQ ID NO: 124381

SEQ ID NO: 693249 - RNA, 64 nt, hsa; identical to SEQ ID NO: 124382

SEQ ID NO: 693250 - RNA, 64 nt, hsa; identical to SEQ ID NO: 124383

SEQ ID NO: 693251 - RNA, 64 nt, hsa; identical to SEQ ID NO: 124384

SEQ ID NO: 693252 - RNA, 55 nt, hsa; identical to SEQ ID NO: 194635

SEQ ID NO: 693253 - RNA, 64 nt, hsa; identical to SEQ ID NO: 417042

SEQ ID NO: 693254 - RNA, 64 nt, hsa; identical to SEQ ID NO: 417043

SEQ ID NO: 693255 - RNA, 64 nt, hsa; identical to SEQ ID NO: 417044

SEQ ID NO: 693256 - RNA, 64 nt, hsa; identical to SEQ ID NO: 417045

SEQ ID NO: 693257 - RNA, 64 nt, hsa; identical to SEQ ID NO: 417046

SEQ ID NO: 693258 - RNA, 64 nt, hsa; identical to SEQ ID NO: 417047

SEQ ID NO: 693259 - RNA, 64 nt, hsa; identical to SEQ ID NO: 417048

SEQ ID NO: 693260 - RNA, 64 nt, hsa; identical to SEQ ID NO: 417049

SEQ ID NO: 693261 - RNA, 64 nt, hsa; identical to SEQ ID NO: 417050

SEQ ID NO: 693262 - RNA, 64 nt, hsa; identical to SEQ ID NO: 417051

SEQ ID NO: 693263 - RNA, 64 nt, hsa; identical to SEQ ID NO: 417052

SEQ ID NO: 693264 - RNA, 64 nt, hsa; identical to SEQ ID NO: 417053

SEQ ID NO: 693265 - RNA, 64 nt, hsa; identical to SEQ ID NO: 417054

SEQ ID NO: 693266 - RNA, 64 nt, hsa; identical to SEQ ID NO: 417055

SEQ ID NO: 693267 - RNA, 64 nt, hsa; identical to SEQ ID NO: 417056

SEQ ID NO: 693268 - RNA, 64 nt, hsa; identical to SEQ ID NO: 417057

SEQ ID NO: 693269 - RNA, 64 nt, hsa; identical to SEQ ID NO: 417058

SEQ ID NO: 693270 - RNA, 64 nt, hsa; identical to SEQ ID NO: 417059

SEQ ID NO: 693271 - RNA, 64 nt, hsa; identical to SEQ ID NO: 417060

SEQ ID NO: 693272 - RNA, 64 nt, hsa; identical to SEQ ID NO: 417061

SEQ ID NO: 693273 - RNA, 64 nt, hsa; identical to SEQ ID NO: 417062

SEQ ID NO: 693274 - RNA, 64 nt, hsa; identical to SEQ ID NO: 417063

SEQ ID NO: 693275 - RNA, 64 nt, hsa; identical to SEQ ID NO: 417064

SEQ ID NO: 693276 - RNA, 64 nt, hsa; identical to SEQ ID NO: 417065

SEQ ID NO: 693277 - RNA, 64 nt, hsa; identical to SEQ ID NO: 417066

SEQ ID NO: 693278 - RNA, 64 nt, hsa; identical to SEQ ID NO: 417067

SEQ ID NO: 693279 - RNA, 64 nt, hsa; identical to SEQ ID NO: 417068

SEQ ID NO: 693280 - RNA, 64 nt, hsa; identical to SEQ ID NO: 417069

SEQ ID NO: 693281 - RNA, 64 nt, hsa; identical to SEQ ID NO: 417070

SEQ ID NO: 693282 - RNA, 64 nt, hsa; identical to SEQ ID NO: 417071

SEQ ID NO: 693283 - RNA, 64 nt, hsa; identical to SEQ ID NO: 417072

SEQ ID NO: 693284 - RNA, 64 nt, hsa; identical to SEQ ID NO: 417073

SEQ ID NO: 693285 - RNA, 64 nt, hsa; identical to SEQ ID NO: 417074

SEQ ID NO: 693286 - RNA, 64 nt, hsa; identical to SEQ ID NO: 417075

SEQ ID NO: 693287 - RNA, 64 nt, hsa; identical to SEQ ID NO: 417076

SEQ ID NO: 693288 - RNA, 64 nt, hsa; identical to SEQ ID NO: 417077

SEQ ID NO: 693289 - RNA, 64 nt, hsa; identical to SEQ ID NO: 417078

SEQ ID NO: 693290 - RNA, 64 nt, hsa; identical to SEQ ID NO: 417079

SEQ ID NO: 693291 - RNA, 64 nt, hsa; identical to SEQ ID NO: 417080

SEQ ID NO: 693292 - RNA, 64 nt, hsa; identical to SEQ ID NO: 417081

SEQ ID NO: 693293 - RNA, 64 nt, hsa
gaacccugcuccguuggucagcguuacuaucaucucggaucauauggagcucaugucagccgug

SEQ ID NO: 693294 - RNA, 64 nt, hsa
uuggugcagcuccaggucauuccuggggugggaaucggaucaucccugacucagcuuuuaccuu

SEQ ID NO: 693295 - RNA, 64 nt, hsa
cuuucuaccuucuuuccaggacaacuaaacuaccucggaucaagccaccaaauauggcauaucc

SEQ ID NO: 693296 - RNA, 64 nt, hsa
uuauguaauguguuuuaaaagcgccaguaaaccaucggaucaauuggaaagaaggcaacucuuc

SEQ ID NO: 693297 - RNA, 64 nt, hsa
guaagcagggcuggcuucgcccgcguucucgucgucggaucaaggagcgcggcggcguuuugga

SEQ ID NO: 693298 - RNA, 64 nt, hsa
gccauucauugguauuuuaaagaaccacuugaaaucggaucauuuuauuuaaaaauaaaaaaug

SEQ ID NO: 693299 - RNA, 64 nt, hsa
gcuugccaaggaacagcccacguggacaugccagucggaucaugaguucaccugauggcauucg

SEQ ID NO: 693300 - RNA, 64 nt, hsa
ccucauguggaugggcaagaagagagcggccaucucggaucauaaucuccuuggugcugauuaa

SEQ ID NO: 693301 - RNA, 64 nt, hsa
caaagcugcccaaccggguagugccccucacccaucggaucacugccuucuuccuccucuugcc

SEQ ID NO: 693302 - RNA, 64 nt, hsa
ccaauuugugcuucagggggauaaucuccuucucucggaucauugugauggaugcuggaaccuc

SEQ ID NO: 693303 - RNA, 64 nt, hsa
gccagcugaucagagaugcugcaaagagaaccuuucggaucacucguuuacaagccuuuucuaa

SEQ ID NO: 693304 - RNA, 64 nt, hsa
ccuguaaucccagcacuuugggaggcugaggaggucggaucaugaggucaagaguucgagacca

SEQ ID NO: 693305 - RNA, 64 nt, hsa
gugagcuccggccccaccucgugaacacaaagccucggaucagccuugagagaggccacacuac

SEQ ID NO: 693306 - RNA, 64 nt, hsa
uccugcccaggagagccagcccucccuguccuccucggaucaccgagaguagccgagagccugc

SEQ ID NO: 693307 - RNA, 64 nt, hsa
gacaaauaucauuacagcacguuaacuuuuccauucggaucauuaucuguaugauguggugugg

SEQ ID NO: 693308 - RNA, 64 nt, hsa
ggguugugcagaagcuuagcauaugcccuuguguucggaucaggcccacagggcugcucaaaga

SEQ ID NO: 693309 - RNA, 64 nt, hsa
gaaauuuuaaaaacuuuaaaaaauacugauaaauucggaucaaauuugggggaauaaaaaauau

SEQ ID NO: 693310 - RNA, 64 nt, hsa
gacccugcagggcaagucaggggccaggaugcccucggaucagggccgggaugggaggggucag

SEQ ID NO: 693311 - RNA, 64 nt, hsa
acguuccuuguccaaggggccauguuauugcugcucggaucacuagugaaaauccagaugaggu

SEQ ID NO: 693312 - RNA, 64 nt, hsa
aagaagacuaaguagccccagagauaagaccuccucggaucauugucccuucuuauguagugau

SEQ ID NO: 693313 - RNA, 64 nt, hsa
aaaaacaguaaaagcuuaugcauuuggcaaagucucggaucagggucuacgggaccgaggaccu

SEQ ID NO: 693314 - RNA, 64 nt, hsa
gcuacagcuugcucucugagaccuggggcuucacucggaucacgcccuccugggcacaggucac

SEQ ID NO: 693315 - RNA, 64 nt, hsa
cuaaaauacauaccaagagaaaaauaccuugccaucggaucaucaacaagucuucuauuuacaa

SEQ ID NO: 693316 - RNA, 64 nt, hsa
ccugguuguguguccccuugcagccgacacggucucggaucaggcucccaggagccugcccagc

SEQ ID NO: 693317 - RNA, 64 nt, hsa
cacaucuuguuuccuauagaaauguucuguauucucggaucaauuuccaaaugcuuuacuuuuu

SEQ ID NO: 693318 - RNA, 64 nt, hsa
ggaggaccauuuugcgaguguagcccuguuucacucggaucagguuggcacggccgccugcgug

SEQ ID NO: 693319 - RNA, 64 nt, hsa
acaaccguccccggccccugccccgcccccaagcucggaucacaugaaggagacagcagcaccc

SEQ ID NO: 693320 - RNA, 64 nt, hsa; identical to SEQ ID NO: 139090

SEQ ID NO: 693321 - RNA, 64 nt, hsa; identical to SEQ ID NO: 139091

SEQ ID NO: 693322 - RNA, 64 nt, hsa; identical to SEQ ID NO: 139092

SEQ ID NO: 693323 - RNA, 64 nt, hsa; identical to SEQ ID NO: 139093

SEQ ID NO: 693324 - RNA, 64 nt, hsa; identical to SEQ ID NO: 139094

SEQ ID NO: 693325 - RNA, 64 nt, hsa; identical to SEQ ID NO: 139095

SEQ ID NO: 693326 - RNA, 64 nt, hsa; identical to SEQ ID NO: 139096

SEQ ID NO: 693327 - RNA, 64 nt, hsa; identical to SEQ ID NO: 139097

SEQ ID NO: 693328 - RNA, 64 nt, hsa; identical to SEQ ID NO: 139098

SEQ ID NO: 693329 - RNA, 64 nt, hsa; identical to SEQ ID NO: 139099

SEQ ID NO: 693330 - RNA, 64 nt, hsa; identical to SEQ ID NO: 139100

SEQ ID NO: 693331 - RNA, 64 nt, hsa; identical to SEQ ID NO: 139101

SEQ ID NO: 693332 - RNA, 64 nt, hsa; identical to SEQ ID NO: 139102

SEQ ID NO: 693333 - RNA, 64 nt, hsa; identical to SEQ ID NO: 139103

SEQ ID NO: 693334 - RNA, 64 nt, hsa; identical to SEQ ID NO: 139104

SEQ ID NO: 693335 - RNA, 64 nt, hsa; identical to SEQ ID NO: 139105

SEQ ID NO: 693336 - RNA, 64 nt, hsa; identical to SEQ ID NO: 139106

SEQ ID NO: 693337 - RNA, 64 nt, hsa; identical to SEQ ID NO: 139107

SEQ ID NO: 693338 - RNA, 64 nt, hsa; identical to SEQ ID NO: 139108

SEQ ID NO: 693339 - RNA, 64 nt, hsa; identical to SEQ ID NO: 139109

SEQ ID NO: 693340 - RNA, 64 nt, hsa; identical to SEQ ID NO: 139110

SEQ ID NO: 693341 - RNA, 64 nt, hsa; identical to SEQ ID NO: 139111

SEQ ID NO: 693342 - RNA, 64 nt, hsa; identical to SEQ ID NO: 139112

SEQ ID NO: 693343 - RNA, 64 nt, hsa; identical to SEQ ID NO: 139113

SEQ ID NO: 693344 - RNA, 64 nt, hsa; identical to SEQ ID NO: 139114

SEQ ID NO: 693345 - RNA, 64 nt, hsa; identical to SEQ ID NO: 139115

SEQ ID NO: 693346 - RNA, 52 nt, hsa; identical to SEQ ID NO: 112167

SEQ ID NO: 693347 - RNA, 64 nt, hsa; identical to SEQ ID NO: 139117

SEQ ID NO: 693348 - RNA, 64 nt, hsa; identical to SEQ ID NO: 139118

SEQ ID NO: 693349 - RNA, 64 nt, hsa; identical to SEQ ID NO: 139119

SEQ ID NO: 693350 - RNA, 64 nt, hsa; identical to SEQ ID NO: 139120

SEQ ID NO: 693351 - RNA, 64 nt, hsa; identical to SEQ ID NO: 139121

SEQ ID NO: 693352 - RNA, 64 nt, hsa; identical to SEQ ID NO: 139122

SEQ ID NO: 693353 - RNA, 64 nt, hsa; identical to SEQ ID NO: 139123

SEQ ID NO: 693354 - RNA, 64 nt, hsa; identical to SEQ ID NO: 139124

SEQ ID NO: 693355 - RNA, 64 nt, hsa; identical to SEQ ID NO: 139125

SEQ ID NO: 693356 - RNA, 64 nt, hsa; identical to SEQ ID NO: 139126

SEQ ID NO: 693357 - RNA, 64 nt, hsa; identical to SEQ ID NO: 139127

SEQ ID NO: 693358 - RNA, 64 nt, hsa; identical to SEQ ID NO: 139128

SEQ ID NO: 693359 - RNA, 64 nt, hsa; identical to SEQ ID NO: 139129

SEQ ID NO: 693360 - RNA, 64 nt, hsa; identical to SEQ ID NO: 139130

SEQ ID NO: 693361 - RNA, 64 nt, hsa; identical to SEQ ID NO: 139131

SEQ ID NO: 693362 - RNA, 64 nt, hsa
gacauuugaccuuugacauuugaccuuugcagugucaugugagggcgucaguauagaggccuuu

SEQ ID NO: 693363 - RNA, 64 nt, hsa
uguaauccagacaccuaauucuucaguucacuacucaugugauacugauucccacauuaagguu

SEQ ID NO: 693364 - RNA, 64 nt, hsa
cuucugagcauuccuaaauaucugcuuagaaauaucaugugauaaagagggaccuucuuaauac

SEQ ID NO: 693365 - RNA, 64 nt, hsa
aaaugucuuaaauaauuuaaccauaaauuuucugucaugugauacuggaauaugggauacuuuu

SEQ ID NO: 693366 - RNA, 63 nt, hsa
uggagaauaaagagaccucaauaaacaagaauaaucaugugaacguggaaucuguuuucucac

SEQ ID NO: 693367 - RNA, 64 nt, hsa
ccugccccucgagucgauggugucccgcaucuacucaugugaacuggccuuggcgagggcuggu

SEQ ID NO: 693368 - RNA, 64 nt, hsa
guaaagccuucucucgaaucucaucccucacucuucaugugagaagucacacaggggagaaacc

SEQ ID NO: 693369 - RNA, 64 nt, hsa
auuuucuaggaucuuucaaaaaugauuauaaaauucaugugaaauagaaguguaugaauugcug

SEQ ID NO: 693370 - RNA, 64 nt, hsa
uuuauggacacugagcuugaacuucauauaucagucaugugacacaaaauaucauucuucuuuu

SEQ ID NO: 693371 - RNA, 64 nt, hsa
guuguucucuaguucuacggguuugauuauuuagucaugugaaaaauauugauuacucacacau

SEQ ID NO: 693372 - RNA, 64 nt, hsa
ugaaccugcuuauaccuaagggcaggagcaagccccucacaaugcagcugcauggguuuuuagu

SEQ ID NO: 693373 - RNA, 64 nt, hsa
cuccguuguagggguuacagaacagucguucccgccucacaaccugguaaggauccaucucuuc

SEQ ID NO: 693374 - RNA, 64 nt, hsa
ccggagggccugcucccggccccccugcacucugccucacaaaggucuauauuauauaaaucua

SEQ ID NO: 693375 - RNA, 64 nt, hsa
ugagcugcugcugucacuccuccaccgagggaggccucacaaaccacaggacgcugcaacgggu

SEQ ID NO: 693376 - RNA, 64 nt, hsa
gccccuugcccuccccugccccucacaacagucaccucacaaaccugaauggucugaagaagga

SEQ ID NO: 693377 - RNA, 64 nt, hsa
gcaccugccacucugccccuugcccuccccugccccucacaacagucaccucacaaaccugaau

SEQ ID NO: 693378 - RNA, 64 nt, hsa; identical to SEQ ID NO: 434003

SEQ ID NO: 693379 - RNA, 64 nt, hsa; identical to SEQ ID NO: 434004

SEQ ID NO: 693380 - RNA, 64 nt, hsa; identical to SEQ ID NO: 434005

SEQ ID NO: 693381 - RNA, 64 nt, hsa; identical to SEQ ID NO: 434006

SEQ ID NO: 693382 - RNA, 64 nt, hsa; identical to SEQ ID NO: 434007

SEQ ID NO: 693383 - RNA, 64 nt, hsa; identical to SEQ ID NO: 434008

SEQ ID NO: 693384 - RNA, 64 nt, hsa; identical to SEQ ID NO: 434009

SEQ ID NO: 693385 - RNA, 64 nt, hsa; identical to SEQ ID NO: 434010

SEQ ID NO: 693386 - RNA, 64 nt, hsa; identical to SEQ ID NO: 434011

SEQ ID NO: 693387 - RNA, 64 nt, hsa; identical to SEQ ID NO: 434012

SEQ ID NO: 693388 - RNA, 64 nt, hsa; identical to SEQ ID NO: 434013

SEQ ID NO: 693389 - RNA, 64 nt, hsa; identical to SEQ ID NO: 434014

SEQ ID NO: 693390 - RNA, 64 nt, hsa; identical to SEQ ID NO: 434015

SEQ ID NO: 693391 - RNA, 64 nt, hsa; identical to SEQ ID NO: 434016

SEQ ID NO: 693392 - RNA, 64 nt, hsa; identical to SEQ ID NO: 434017

SEQ ID NO: 693393 - RNA, 64 nt, hsa; identical to SEQ ID NO: 434018

SEQ ID NO: 693394 - RNA, 64 nt, hsa; identical to SEQ ID NO: 434019

SEQ ID NO: 693395 - RNA, 64 nt, hsa; identical to SEQ ID NO: 434020

SEQ ID NO: 693396 - RNA, 64 nt, hsa; identical to SEQ ID NO: 434021

SEQ ID NO: 693397 - RNA, 64 nt, hsa; identical to SEQ ID NO: 434022

SEQ ID NO: 693398 - RNA, 64 nt, hsa; identical to SEQ ID NO: 434023

SEQ ID NO: 693399 - RNA, 64 nt, hsa; identical to SEQ ID NO: 434024

SEQ ID NO: 693400 - RNA, 64 nt, hsa; identical to SEQ ID NO: 434025

SEQ ID NO: 693401 - RNA, 64 nt, hsa; identical to SEQ ID NO: 434026

SEQ ID NO: 693402 - RNA, 64 nt, hsa; identical to SEQ ID NO: 434027

SEQ ID NO: 693403 - RNA, 64 nt, hsa; identical to SEQ ID NO: 434028

SEQ ID NO: 693404 - RNA, 64 nt, hsa; identical to SEQ ID NO: 434029

SEQ ID NO: 693405 - RNA, 64 nt, hsa; identical to SEQ ID NO: 434030

SEQ ID NO: 693406 - RNA, 64 nt, hsa; identical to SEQ ID NO: 434031

SEQ ID NO: 693407 - RNA, 64 nt, hsa; identical to SEQ ID NO: 434032

SEQ ID NO: 693408 - RNA, 64 nt, hsa; identical to SEQ ID NO: 434033

SEQ ID NO: 693409 - RNA, 64 nt, hsa; identical to SEQ ID NO: 434034

SEQ ID NO: 693410 - RNA, 64 nt, hsa; identical to SEQ ID NO: 434035

SEQ ID NO: 693411 - RNA, 64 nt, hsa; identical to SEQ ID NO: 434036

SEQ ID NO: 693412 - RNA, 64 nt, hsa; identical to SEQ ID NO: 434037

SEQ ID NO: 693413 - RNA, 64 nt, hsa; identical to SEQ ID NO: 434038

SEQ ID NO: 693414 - RNA, 64 nt, hsa; identical to SEQ ID NO: 434039

SEQ ID NO: 693415 - RNA, 64 nt, hsa; identical to SEQ ID NO: 434040

SEQ ID NO: 693416 - RNA, 64 nt, hsa; identical to SEQ ID NO: 434041

SEQ ID NO: 693417 - RNA, 64 nt, hsa; identical to SEQ ID NO: 434042

SEQ ID NO: 693418 - RNA, 64 nt, hsa; identical to SEQ ID NO: 434043

SEQ ID NO: 693419 - RNA, 64 nt, hsa; identical to SEQ ID NO: 434044

SEQ ID NO: 693420 - RNA, 64 nt, hsa
aaggcagagaaagggacaaugauaguagagugauauggagcaagagauauuuugggcauguggg

SEQ ID NO: 693421 - RNA, 64 nt, hsa
uuucuguuuccuguaccaguaggagaucagaaaaauggagcaaagugguagguacuuuuuguga

SEQ ID NO: 693422 - RNA, 64 nt, hsa
ggcgugcugggcauggggccugcucacagacagcauggagcagggaugggcugucugugcccau

SEQ ID NO: 693423 - RNA, 64 nt, hsa
ucaguggagggagacccagcauagccaggccaguauggagcaccucacgcacagcucucagaag

SEQ ID NO: 693424 - RNA, 64 nt, hsa
cagcagcaggccaggccuuccuguccaggucugcauggagcacucggugacccagagcagggac

SEQ ID NO: 693425 - RNA, 64 nt, hsa
caaggcccagugcucuuccugcccaccagggaccauggagcaguggcacccuauggggcuauga

SEQ ID NO: 693426 - RNA, 64 nt, hsa
auacuuuuuuaaaaguaggaaccacaaucuuuauauggagcagcuuguuauaucugauuuucau

SEQ ID NO: 693427 - RNA, 64 nt, hsa
agcauuuuuuacacuaucauugaggaauaauuacauggagcaugaaauuugggccuccaguaua

SEQ ID NO: 693428 - RNA, 64 nt, hsa
aacacguggaauggaacaguggcuagagguauggauggagcaaggucaaauaugagcugaugga

SEQ ID NO: 693429 - RNA, 64 nt, hsa
cgccucggccucccaaagugcugggauuacaggcauggagcaccgugccuggccaagauucuuu

SEQ ID NO: 693430 - RNA, 64 nt, hsa
ucuccgggaugaggcccuggcagaggugaaggacauggagcagcugcuggcccuugggaaggag

SEQ ID NO: 693431 - RNA, 64 nt, hsa
caucuccguccugcccaccuucuuaagaggcgagauggagcaggcccaucugccucugcccuuu

SEQ ID NO: 693432 - RNA, 64 nt, hsa
cugaacugugcuguuggaaaaugagagcgaucacauggagcaguaauggagcaaagaccagcca

SEQ ID NO: 693433 - RNA, 64 nt, hsa
uguuggaaaaugagagcgaucacauggagcaguaauggagcaaagaccagccaucccaguugag

SEQ ID NO: 693434 - RNA, 64 nt, hsa; identical to SEQ ID NO: 117299

SEQ ID NO: 693435 - RNA, 64 nt, hsa; identical to SEQ ID NO: 117300

SEQ ID NO: 693436 - RNA, 64 nt, hsa; identical to SEQ ID NO: 117301

SEQ ID NO: 693437 - RNA, 64 nt, hsa; identical to SEQ ID NO: 117302

SEQ ID NO: 693438 - RNA, 64 nt, hsa; identical to SEQ ID NO: 117303

SEQ ID NO: 693439 - RNA, 64 nt, hsa; identical to SEQ ID NO: 117304

SEQ ID NO: 693440 - RNA, 64 nt, hsa; identical to SEQ ID NO: 117305

SEQ ID NO: 693441 - RNA, 64 nt, hsa; identical to SEQ ID NO: 117306

SEQ ID NO: 693442 - RNA, 64 nt, hsa; identical to SEQ ID NO: 117307

SEQ ID NO: 693443 - RNA, 64 nt, hsa; identical to SEQ ID NO: 117308

SEQ ID NO: 693444 - RNA, 64 nt, hsa; identical to SEQ ID NO: 117309

SEQ ID NO: 693445 - RNA, 64 nt, hsa; identical to SEQ ID NO: 117310

SEQ ID NO: 693446 - RNA, 64 nt, hsa; identical to SEQ ID NO: 117311

SEQ ID NO: 693447 - RNA, 64 nt, hsa; identical to SEQ ID NO: 117312

SEQ ID NO: 693448 - RNA, 64 nt, hsa; identical to SEQ ID NO: 117313

SEQ ID NO: 693449 - RNA, 64 nt, hsa; identical to SEQ ID NO: 117314

SEQ ID NO: 693450 - RNA, 64 nt, hsa; identical to SEQ ID NO: 117315

SEQ ID NO: 693451 - RNA, 64 nt, hsa; identical to SEQ ID NO: 117316

SEQ ID NO: 693452 - RNA, 64 nt, hsa; identical to SEQ ID NO: 117317

SEQ ID NO: 693453 - RNA, 64 nt, hsa; identical to SEQ ID NO: 117318

SEQ ID NO: 693454 - RNA, 64 nt, hsa; identical to SEQ ID NO: 117319

SEQ ID NO: 693455 - RNA, 64 nt, hsa; identical to SEQ ID NO: 117320

SEQ ID NO: 693456 - RNA, 64 nt, hsa; identical to SEQ ID NO: 117321

SEQ ID NO: 693457 - RNA, 64 nt, hsa; identical to SEQ ID NO: 117322

SEQ ID NO: 693458 - RNA, 64 nt, hsa; identical to SEQ ID NO: 117323

SEQ ID NO: 693459 - RNA, 64 nt, hsa; identical to SEQ ID NO: 117324

SEQ ID NO: 693460 - RNA, 64 nt, hsa; identical to SEQ ID NO: 117325

SEQ ID NO: 693461 - RNA, 64 nt, hsa; identical to SEQ ID NO: 117326

SEQ ID NO: 693462 - RNA, 64 nt, hsa; identical to SEQ ID NO: 117327

SEQ ID NO: 693463 - RNA, 64 nt, hsa; identical to SEQ ID NO: 117328

SEQ ID NO: 693464 - RNA, 64 nt, hsa
ccucuacuguccucauugacuuguuugaaccuuagugccuuacccuguccucuucccaguucuc

SEQ ID NO: 693465 - RNA, 64 nt, hsa
agugaguucuaaaaggcaugcccacaucucuuucgugccuuaaggauagugagaugcacacuua

SEQ ID NO: 693466 - RNA, 64 nt, hsa
ggucagauauuugagaauaggggauuuuuuugaugugccuuaaauuauaccaaagauuacuaau

SEQ ID NO: 693467 - RNA, 58 nt, hsa; identical to SEQ ID NO: 174552

SEQ ID NO: 693468 - RNA, 64 nt, hsa
cguggaguguggggaagcugcugucucccaggaagugccuuacucaucccgcaaccagucagcg

SEQ ID NO: 693469 - RNA, 64 nt, hsa
cuaaaguauuuguuuuuauuuguaccauccacuugugccuuacuguauccugugucauguccaa

SEQ ID NO: 693470 - RNA, 64 nt, hsa
cuugcacauuuguacauauacuuaauguuuucaagugccuuaauuguuuaaaaucucuggcuuc

SEQ ID NO: 693471 - RNA, 64 nt, hsa
aaagcaucuuaugucauugagaauauaaagaacagugccuuagaagacagugaaagguaagcuc

SEQ ID NO: 693472 - RNA, 64 nt, hsa
cacccccuacacuucaguugagggaaaagcucaagugccuuaggcccguggaccacagucuugg

SEQ ID NO: 693473 - RNA, 64 nt, hsa
gggacuucugccacagugacaauggaauuguguugugccuuacuucagagguggucucuucuuu

SEQ ID NO: 693474 - RNA, 64 nt, hsa
ucugcuagucuguaagcuccuuaagaguaggguugugccuuauucaacugcauacauagcuccu

SEQ ID NO: 693475 - RNA, 64 nt, hsa
gccuuauucaacugcauacauagcuccuagcacagugccuuauucgguaggcaucuaagcacau

SEQ ID NO: 693476 - RNA, 64 nt, hsa
gcccuucuggcaccccugggguucaauacuggaagugccuuauuuaaccagaccaucagggcau

SEQ ID NO: 693477 - RNA, 64 nt, hsa
gguuuauucauugaaacacgguugaccugaacucgugccuuaggaauuaaugcccccuuaugga

SEQ ID NO: 693478 - RNA, 64 nt, hsa
uuuugugaaaauuuugaauuagcuuucauaugaagugccuuaaguagacucuucauuuacuuuu

SEQ ID NO: 693479 - RNA, 64 nt, hsa
aaauaguuaaucauuuaaccaaagaagauguguagugccuuaacaagcaauccucugucaaaau

SEQ ID NO: 693480 - RNA, 63 nt, hsa; identical to SEQ ID NO: 349836

SEQ ID NO: 693481 - RNA, 63 nt, hsa; identical to SEQ ID NO: 349837

SEQ ID NO: 693482 - RNA, 63 nt, hsa; identical to SEQ ID NO: 349838

SEQ ID NO: 693483 - RNA, 63 nt, hsa; identical to SEQ ID NO: 349839

SEQ ID NO: 693484 - RNA, 63 nt, hsa; identical to SEQ ID NO: 349840

SEQ ID NO: 693485 - RNA, 63 nt, hsa; identical to SEQ ID NO: 349841

SEQ ID NO: 693486 - RNA, 63 nt, hsa; identical to SEQ ID NO: 349842

SEQ ID NO: 693487 - RNA, 63 nt, hsa; identical to SEQ ID NO: 349843

SEQ ID NO: 693488 - RNA, 63 nt, hsa; identical to SEQ ID NO: 349844

SEQ ID NO: 693489 - RNA, 63 nt, hsa; identical to SEQ ID NO: 349845

SEQ ID NO: 693490 - RNA, 63 nt, hsa; identical to SEQ ID NO: 349846

SEQ ID NO: 693491 - RNA, 63 nt, hsa; identical to SEQ ID NO: 349847

SEQ ID NO: 693492 - RNA, 63 nt, hsa; identical to SEQ ID NO: 349848

SEQ ID NO: 693493 - RNA, 63 nt, hsa; identical to SEQ ID NO: 349849

SEQ ID NO: 693494 - RNA, 63 nt, hsa; identical to SEQ ID NO: 349850

SEQ ID NO: 693495 - RNA, 63 nt, hsa; identical to SEQ ID NO: 349851

SEQ ID NO: 693496 - RNA, 63 nt, hsa; identical to SEQ ID NO: 349852

SEQ ID NO: 693497 - RNA, 63 nt, hsa; identical to SEQ ID NO: 349853

SEQ ID NO: 693498 - RNA, 63 nt, hsa; identical to SEQ ID NO: 349854

SEQ ID NO: 693499 - RNA, 63 nt, hsa; identical to SEQ ID NO: 349855

SEQ ID NO: 693500 - RNA, 63 nt, hsa; identical to SEQ ID NO: 349856

SEQ ID NO: 693501 - RNA, 63 nt, hsa; identical to SEQ ID NO: 349857

SEQ ID NO: 693502 - RNA, 63 nt, hsa; identical to SEQ ID NO: 349858

SEQ ID NO: 693503 - RNA, 63 nt, hsa; identical to SEQ ID NO: 349859

SEQ ID NO: 693504 - RNA, 63 nt, hsa; identical to SEQ ID NO: 349860

SEQ ID NO: 693505 - RNA, 63 nt, hsa; identical to SEQ ID NO: 349861

SEQ ID NO: 693506 - RNA, 63 nt, hsa; identical to SEQ ID NO: 349862

SEQ ID NO: 693507 - RNA, 63 nt, hsa; identical to SEQ ID NO: 349863

SEQ ID NO: 693508 - RNA, 63 nt, hsa; identical to SEQ ID NO: 349864

SEQ ID NO: 693509 - RNA, 63 nt, hsa; identical to SEQ ID NO: 349865

SEQ ID NO: 693510 - RNA, 63 nt, hsa; identical to SEQ ID NO: 349866

SEQ ID NO: 693511 - RNA, 63 nt, hsa; identical to SEQ ID NO: 349867

SEQ ID NO: 693512 - RNA, 63 nt, hsa; identical to SEQ ID NO: 349868

SEQ ID NO: 693513 - RNA, 63 nt, hsa; identical to SEQ ID NO: 349869

SEQ ID NO: 693514 - RNA, 63 nt, hsa; identical to SEQ ID NO: 349870

SEQ ID NO: 693515 - RNA, 63 nt, hsa; identical to SEQ ID NO: 349871

SEQ ID NO: 693516 - RNA, 63 nt, hsa; identical to SEQ ID NO: 349872

SEQ ID NO: 693517 - RNA, 63 nt, hsa; identical to SEQ ID NO: 349873

SEQ ID NO: 693518 - RNA, 63 nt, hsa; identical to SEQ ID NO: 349874

SEQ ID NO: 693519 - RNA, 63 nt, hsa; identical to SEQ ID NO: 349875

SEQ ID NO: 693520 - RNA, 63 nt, hsa; identical to SEQ ID NO: 349876

SEQ ID NO: 693521 - RNA, 63 nt, hsa; identical to SEQ ID NO: 349877

SEQ ID NO: 693522 - RNA, 63 nt, hsa; identical to SEQ ID NO: 349878

SEQ ID NO: 693523 - RNA, 63 nt, hsa; identical to SEQ ID NO: 349879

SEQ ID NO: 693524 - RNA, 63 nt, hsa; identical to SEQ ID NO: 349880

SEQ ID NO: 693525 - RNA, 63 nt, hsa; identical to SEQ ID NO: 349881

SEQ ID NO: 693526 - RNA, 63 nt, hsa; identical to SEQ ID NO: 349882

SEQ ID NO: 693527 - RNA, 63 nt, hsa; identical to SEQ ID NO: 349883

SEQ ID NO: 693528 - RNA, 63 nt, hsa; identical to SEQ ID NO: 349884

SEQ ID NO: 693529 - RNA, 63 nt, hsa; identical to SEQ ID NO: 349885

SEQ ID NO: 693530 - RNA, 63 nt, hsa; identical to SEQ ID NO: 349886

SEQ ID NO: 693531 - RNA, 63 nt, hsa; identical to SEQ ID NO: 349887

SEQ ID NO: 693532 - RNA, 63 nt, hsa; identical to SEQ ID NO: 349888

SEQ ID NO: 693533 - RNA, 63 nt, hsa; identical to SEQ ID NO: 349889

SEQ ID NO: 693534 - RNA, 63 nt, hsa; identical to SEQ ID NO: 349890

SEQ ID NO: 693535 - RNA, 63 nt, hsa; identical to SEQ ID NO: 349891

SEQ ID NO: 693536 - RNA, 63 nt, hsa; identical to SEQ ID NO: 349892

SEQ ID NO: 693537 - RNA, 63 nt, hsa; identical to SEQ ID NO: 349893

SEQ ID NO: 693538 - RNA, 63 nt, hsa; identical to SEQ ID NO: 349894

SEQ ID NO: 693539 - RNA, 63 nt, hsa; identical to SEQ ID NO: 349895

SEQ ID NO: 693540 - RNA, 63 nt, hsa; identical to SEQ ID NO: 349896

SEQ ID NO: 693541 - RNA, 63 nt, hsa; identical to SEQ ID NO: 349897

SEQ ID NO: 693542 - RNA, 63 nt, hsa; identical to SEQ ID NO: 349898

SEQ ID NO: 693543 - RNA, 63 nt, hsa; identical to SEQ ID NO: 349899

SEQ ID NO: 693544 - RNA, 63 nt, hsa; identical to SEQ ID NO: 349900

SEQ ID NO: 693545 - RNA, 63 nt, hsa; identical to SEQ ID NO: 349901

SEQ ID NO: 693546 - RNA, 63 nt, hsa; identical to SEQ ID NO: 349902

SEQ ID NO: 693547 - RNA, 63 nt, hsa; identical to SEQ ID NO: 349903

SEQ ID NO: 693548 - RNA, 63 nt, hsa; identical to SEQ ID NO: 349904

SEQ ID NO: 693549 - RNA, 63 nt, hsa; identical to SEQ ID NO: 349905

SEQ ID NO: 693550 - RNA, 63 nt, hsa; identical to SEQ ID NO: 349906

SEQ ID NO: 693551 - RNA, 63 nt, hsa; identical to SEQ ID NO: 349907

SEQ ID NO: 693552 - RNA, 63 nt, hsa; identical to SEQ ID NO: 349908

SEQ ID NO: 693553 - RNA, 63 nt, hsa; identical to SEQ ID NO: 349909

SEQ ID NO: 693554 - RNA, 63 nt, hsa; identical to SEQ ID NO: 349910

SEQ ID NO: 693555 - RNA, 63 nt, hsa; identical to SEQ ID NO: 349911

SEQ ID NO: 693556 - RNA, 63 nt, hsa; identical to SEQ ID NO: 349912

SEQ ID NO: 693557 - RNA, 63 nt, hsa; identical to SEQ ID NO: 349913

SEQ ID NO: 693558 - RNA, 63 nt, hsa; identical to SEQ ID NO: 349914

SEQ ID NO: 693559 - RNA, 63 nt, hsa; identical to SEQ ID NO: 349915

SEQ ID NO: 693560 - RNA, 63 nt, hsa; identical to SEQ ID NO: 349916

SEQ ID NO: 693561 - RNA, 63 nt, hsa; identical to SEQ ID NO: 349917

SEQ ID NO: 693562 - RNA, 63 nt, hsa; identical to SEQ ID NO: 349918

SEQ ID NO: 693563 - RNA, 63 nt, hsa; identical to SEQ ID NO: 349919

SEQ ID NO: 693564 - RNA, 63 nt, hsa; identical to SEQ ID NO: 349920

SEQ ID NO: 693565 - RNA, 63 nt, hsa; identical to SEQ ID NO: 349921

SEQ ID NO: 693566 - RNA, 63 nt, hsa; identical to SEQ ID NO: 349922

SEQ ID NO: 693567 - RNA, 63 nt, hsa; identical to SEQ ID NO: 349923

SEQ ID NO: 693568 - RNA, 63 nt, hsa; identical to SEQ ID NO: 349924

SEQ ID NO: 693569 - RNA, 63 nt, hsa; identical to SEQ ID NO: 349925

SEQ ID NO: 693570 - RNA, 63 nt, hsa; identical to SEQ ID NO: 349926

SEQ ID NO: 693571 - RNA, 63 nt, hsa; identical to SEQ ID NO: 349927

SEQ ID NO: 693572 - RNA, 63 nt, hsa; identical to SEQ ID NO: 349928

SEQ ID NO: 693573 - RNA, 63 nt, hsa; identical to SEQ ID NO: 349929

SEQ ID NO: 693574 - RNA, 63 nt, hsa; identical to SEQ ID NO: 349930

SEQ ID NO: 693575 - RNA, 63 nt, hsa; identical to SEQ ID NO: 349931

SEQ ID NO: 693576 - RNA, 63 nt, hsa; identical to SEQ ID NO: 349932

SEQ ID NO: 693577 - RNA, 63 nt, hsa; identical to SEQ ID NO: 349933

SEQ ID NO: 693578 - RNA, 63 nt, hsa; identical to SEQ ID NO: 349934

SEQ ID NO: 693579 - RNA, 63 nt, hsa; identical to SEQ ID NO: 349935

SEQ ID NO: 693580 - RNA, 63 nt, hsa; identical to SEQ ID NO: 349936

SEQ ID NO: 693581 - RNA, 63 nt, hsa; identical to SEQ ID NO: 349937

SEQ ID NO: 693582 - RNA, 63 nt, hsa; identical to SEQ ID NO: 349938

SEQ ID NO: 693583 - RNA, 63 nt, hsa; identical to SEQ ID NO: 349939

SEQ ID NO: 693584 - RNA, 63 nt, hsa; identical to SEQ ID NO: 349940

SEQ ID NO: 693585 - RNA, 63 nt, hsa; identical to SEQ ID NO: 349941

SEQ ID NO: 693586 - RNA, 63 nt, hsa; identical to SEQ ID NO: 349942

SEQ ID NO: 693587 - RNA, 63 nt, hsa; identical to SEQ ID NO: 349943

SEQ ID NO: 693588 - RNA, 63 nt, hsa; identical to SEQ ID NO: 349944

SEQ ID NO: 693589 - RNA, 63 nt, hsa; identical to SEQ ID NO: 349945

SEQ ID NO: 693590 - RNA, 63 nt, hsa; identical to SEQ ID NO: 349946

SEQ ID NO: 693591 - RNA, 63 nt, hsa; identical to SEQ ID NO: 349947

SEQ ID NO: 693592 - RNA, 63 nt, hsa; identical to SEQ ID NO: 349948

SEQ ID NO: 693593 - RNA, 63 nt, hsa; identical to SEQ ID NO: 349949

SEQ ID NO: 693594 - RNA, 63 nt, hsa; identical to SEQ ID NO: 349950

SEQ ID NO: 693595 - RNA, 52 nt, hsa; identical to SEQ ID NO: 349951

SEQ ID NO: 693596 - RNA, 63 nt, hsa; identical to SEQ ID NO: 349952

SEQ ID NO: 693597 - RNA, 63 nt, hsa; identical to SEQ ID NO: 349953

SEQ ID NO: 693598 - RNA, 63 nt, hsa; identical to SEQ ID NO: 349954

SEQ ID NO: 693599 - RNA, 63 nt, hsa; identical to SEQ ID NO: 349955

SEQ ID NO: 693600 - RNA, 63 nt, hsa; identical to SEQ ID NO: 349956

SEQ ID NO: 693601 - RNA, 63 nt, hsa; identical to SEQ ID NO: 349957

SEQ ID NO: 693602 - RNA, 63 nt, hsa; identical to SEQ ID NO: 349958

SEQ ID NO: 693603 - RNA, 63 nt, hsa; identical to SEQ ID NO: 349958

SEQ ID NO: 693604 - RNA, 63 nt, hsa; identical to SEQ ID NO: 349960

SEQ ID NO: 693605 - RNA, 63 nt, hsa; identical to SEQ ID NO: 349961

SEQ ID NO: 693606 - RNA, 63 nt, hsa; identical to SEQ ID NO: 349962

SEQ ID NO: 693607 - RNA, 63 nt, hsa; identical to SEQ ID NO: 349963

SEQ ID NO: 693608 - RNA, 63 nt, hsa; identical to SEQ ID NO: 349964

SEQ ID NO: 693609 - RNA, 63 nt, hsa; identical to SEQ ID NO: 349965

SEQ ID NO: 693610 - RNA, 63 nt, hsa; identical to SEQ ID NO: 349966

SEQ ID NO: 693611 - RNA, 63 nt, hsa; identical to SEQ ID NO: 349967

SEQ ID NO: 693612 - RNA, 63 nt, hsa; identical to SEQ ID NO: 349968

SEQ ID NO: 693613 - RNA, 63 nt, hsa; identical to SEQ ID NO: 349969

SEQ ID NO: 693614 - RNA, 63 nt, hsa; identical to SEQ ID NO: 349970

SEQ ID NO: 693615 - RNA, 63 nt, hsa; identical to SEQ ID NO: 349971

SEQ ID NO: 693616 - RNA, 63 nt, hsa; identical to SEQ ID NO: 349972

SEQ ID NO: 693617 - RNA, 63 nt, hsa; identical to SEQ ID NO: 349973

SEQ ID NO: 693618 - RNA, 63 nt, hsa; identical to SEQ ID NO: 349974

SEQ ID NO: 693619 - RNA, 63 nt, hsa; identical to SEQ ID NO: 349975

SEQ ID NO: 693620 - RNA, 63 nt, hsa; identical to SEQ ID NO: 349976

SEQ ID NO: 693621 - RNA, 63 nt, hsa; identical to SEQ ID NO: 349977

SEQ ID NO: 693622 - RNA, 63 nt, hsa; identical to SEQ ID NO: 349978

SEQ ID NO: 693623 - RNA, 63 nt, hsa; identical to SEQ ID NO: 349979

SEQ ID NO: 693624 - RNA, 63 nt, hsa; identical to SEQ ID NO: 349980

SEQ ID NO: 693625 - RNA, 63 nt, hsa; identical to SEQ ID NO: 349981

SEQ ID NO: 693626 - RNA, 63 nt, hsa; identical to SEQ ID NO: 349982

SEQ ID NO: 693627 - RNA, 63 nt, hsa; identical to SEQ ID NO: 349983

SEQ ID NO: 693628 - RNA, 63 nt, hsa; identical to SEQ ID NO: 349984

SEQ ID NO: 693629 - RNA, 63 nt, hsa; identical to SEQ ID NO: 349985

SEQ ID NO: 693630 - RNA, 63 nt, hsa; identical to SEQ ID NO: 349986

SEQ ID NO: 693631 - RNA, 63 nt, hsa; identical to SEQ ID NO: 349987

SEQ ID NO: 693632 - RNA, 63 nt, hsa; identical to SEQ ID NO: 349988

SEQ ID NO: 693633 - RNA, 63 nt, hsa; identical to SEQ ID NO: 349989

SEQ ID NO: 693634 - RNA, 63 nt, hsa; identical to SEQ ID NO: 349990

SEQ ID NO: 693635 - RNA, 63 nt, hsa; identical to SEQ ID NO: 349991

SEQ ID NO: 693636 - RNA, 63 nt, hsa; identical to SEQ ID NO: 349992

SEQ ID NO: 693637 - RNA, 63 nt, hsa; identical to SEQ ID NO: 349993

SEQ ID NO: 693638 - RNA, 63 nt, hsa; identical to SEQ ID NO: 349994

SEQ ID NO: 693639 - RNA, 63 nt, hsa; identical to SEQ ID NO: 349995

SEQ ID NO: 693640 - RNA, 63 nt, hsa; identical to SEQ ID NO: 349996

SEQ ID NO: 693641 - RNA, 63 nt, hsa; identical to SEQ ID NO: 349997

SEQ ID NO: 693642 - RNA, 63 nt, hsa; identical to SEQ ID NO: 349998

SEQ ID NO: 693643 - RNA, 63 nt, hsa; identical to SEQ ID NO: 349999

SEQ ID NO: 693644 - RNA, 63 nt, hsa; identical to SEQ ID NO: 350000

SEQ ID NO: 693645 - RNA, 63 nt, hsa; identical to SEQ ID NO: 350001

SEQ ID NO: 693646 - RNA, 63 nt, hsa; identical to SEQ ID NO: 350002

SEQ ID NO: 693647 - RNA, 63 nt, hsa; identical to SEQ ID NO: 350003

SEQ ID NO: 693648 - RNA, 63 nt, hsa; identical to SEQ ID NO: 350004

SEQ ID NO: 693649 - RNA, 63 nt, hsa; identical to SEQ ID NO: 350005

SEQ ID NO: 693650 - RNA, 63 nt, hsa; identical to SEQ ID NO: 350006

SEQ ID NO: 693651 - RNA, 63 nt, hsa; identical to SEQ ID NO: 350007

SEQ ID NO: 693652 - RNA, 63 nt, hsa; identical to SEQ ID NO: 350008

SEQ ID NO: 693653 - RNA, 63 nt, hsa; identical to SEQ ID NO: 350009

SEQ ID NO: 693654 - RNA, 63 nt, hsa; identical to SEQ ID NO: 350010

SEQ ID NO: 693655 - RNA, 63 nt, hsa; identical to SEQ ID NO: 350011

SEQ ID NO: 693656 - RNA, 63 nt, hsa; identical to SEQ ID NO: 350012

SEQ ID NO: 693657 - RNA, 63 nt, hsa; identical to SEQ ID NO: 350013

SEQ ID NO: 693658 - RNA, 63 nt, hsa; identical to SEQ ID NO: 350014

SEQ ID NO: 693659 - RNA, 63 nt, hsa; identical to SEQ ID NO: 350015

SEQ ID NO: 693660 - RNA, 63 nt, hsa; identical to SEQ ID NO: 350016

SEQ ID NO: 693661 - RNA, 63 nt, hsa; identical to SEQ ID NO: 350017

SEQ ID NO: 693662 - RNA, 63 nt, hsa; identical to SEQ ID NO: 350018

SEQ ID NO: 693663 - RNA, 63 nt, hsa; identical to SEQ ID NO: 350019

SEQ ID NO: 693664 - RNA, 63 nt, hsa; identical to SEQ ID NO: 350020

SEQ ID NO: 693665 - RNA, 63 nt, hsa; identical to SEQ ID NO: 350021

SEQ ID NO: 693666 - RNA, 63 nt, hsa; identical to SEQ ID NO: 350022

SEQ ID NO: 693667 - RNA, 63 nt, hsa; identical to SEQ ID NO: 350023

SEQ ID NO: 693668 - RNA, 63 nt, hsa; identical to SEQ ID NO: 350024

SEQ ID NO: 693669 - RNA, 63 nt, hsa; identical to SEQ ID NO: 350025

SEQ ID NO: 693670 - RNA, 63 nt, hsa; identical to SEQ ID NO: 350026

SEQ ID NO: 693671 - RNA, 63 nt, hsa; identical to SEQ ID NO: 350027

SEQ ID NO: 693672 - RNA, 63 nt, hsa; identical to SEQ ID NO: 350028

SEQ ID NO: 693673 - RNA, 63 nt, hsa; identical to SEQ ID NO: 350029

SEQ ID NO: 693674 - RNA, 63 nt, hsa; identical to SEQ ID NO: 350030

SEQ ID NO: 693675 - RNA, 63 nt, hsa; identical to SEQ ID NO: 350031

SEQ ID NO: 693676 - RNA, 63 nt, hsa; identical to SEQ ID NO: 350032

SEQ ID NO: 693677 - RNA, 63 nt, hsa; identical to SEQ ID NO: 350033

SEQ ID NO: 693678 - RNA, 63 nt, hsa; identical to SEQ ID NO: 350034

SEQ ID NO: 693679 - RNA, 63 nt, hsa; identical to SEQ ID NO: 350035

SEQ ID NO: 693680 - RNA, 63 nt, hsa; identical to SEQ ID NO: 350036

SEQ ID NO: 693681 - RNA, 63 nt, hsa; identical to SEQ ID NO: 350037

SEQ ID NO: 693682 - RNA, 63 nt, hsa; identical to SEQ ID NO: 350038

SEQ ID NO: 693683 - RNA, 63 nt, hsa; identical to SEQ ID NO: 350039

SEQ ID NO: 693684 - RNA, 63 nt, hsa; identical to SEQ ID NO: 350040

SEQ ID NO: 693685 - RNA, 63 nt, hsa; identical to SEQ ID NO: 350041

SEQ ID NO: 693686 - RNA, 63 nt, hsa; identical to SEQ ID NO: 350042

SEQ ID NO: 693687 - RNA, 63 nt, hsa; identical to SEQ ID NO: 350043

SEQ ID NO: 693688 - RNA, 63 nt, hsa; identical to SEQ ID NO: 350044

SEQ ID NO: 693689 - RNA, 63 nt, hsa; identical to SEQ ID NO: 350045

SEQ ID NO: 693690 - RNA, 63 nt, hsa; identical to SEQ ID NO: 350046

SEQ ID NO: 693691 - RNA, 63 nt, hsa; identical to SEQ ID NO: 350047

SEQ ID NO: 693692 - RNA, 63 nt, hsa; identical to SEQ ID NO: 350048

SEQ ID NO: 693693 - RNA, 63 nt, hsa; identical to SEQ ID NO: 350049

SEQ ID NO: 693694 - RNA, 63 nt, hsa; identical to SEQ ID NO: 350050

SEQ ID NO: 693695 - RNA, 63 nt, hsa; identical to SEQ ID NO: 350051

SEQ ID NO: 693696 - RNA, 63 nt, hsa; identical to SEQ ID NO: 350052

SEQ ID NO: 693697 - RNA, 63 nt, hsa; identical to SEQ ID NO: 350053

SEQ ID NO: 693698 - RNA, 63 nt, hsa; identical to SEQ ID NO: 350054

SEQ ID NO: 693699 - RNA, 63 nt, hsa; identical to SEQ ID NO: 350055

SEQ ID NO: 693700 - RNA, 63 nt, hsa; identical to SEQ ID NO: 350056

SEQ ID NO: 693701 - RNA, 63 nt, hsa; identical to SEQ ID NO: 350057

SEQ ID NO: 693702 - RNA, 63 nt, hsa; identical to SEQ ID NO: 350058

SEQ ID NO: 693703 - RNA, 63 nt, hsa; identical to SEQ ID NO: 350059

SEQ ID NO: 693704 - RNA, 63 nt, hsa; identical to SEQ ID NO: 350060

SEQ ID NO: 693705 - RNA, 63 nt, hsa; identical to SEQ ID NO: 350061

SEQ ID NO: 693706 - RNA, 63 nt, hsa; identical to SEQ ID NO: 350062

SEQ ID NO: 693707 - RNA, 63 nt, hsa; identical to SEQ ID NO: 350063

SEQ ID NO: 693708 - RNA, 63 nt, hsa; identical to SEQ ID NO: 350064

SEQ ID NO: 693709 - RNA, 63 nt, hsa; identical to SEQ ID NO: 350065

SEQ ID NO: 693710 - RNA, 63 nt, hsa; identical to SEQ ID NO: 350066

SEQ ID NO: 693711 - RNA, 63 nt, hsa; identical to SEQ ID NO: 350067

SEQ ID NO: 693712 - RNA, 63 nt, hsa; identical to SEQ ID NO: 350068

SEQ ID NO: 693713 - RNA, 63 nt, hsa; identical to SEQ ID NO: 350069

SEQ ID NO: 693714 - RNA, 63 nt, hsa; identical to SEQ ID NO: 350070

SEQ ID NO: 693715 - RNA, 63 nt, hsa; identical to SEQ ID NO: 350071

SEQ ID NO: 693716 - RNA, 63 nt, hsa; identical to SEQ ID NO: 350072

SEQ ID NO: 693717 - RNA, 63 nt, hsa; identical to SEQ ID NO: 350073

SEQ ID NO: 693718 - RNA, 63 nt, hsa; identical to SEQ ID NO: 350074

SEQ ID NO: 693719 - RNA, 63 nt, hsa; identical to SEQ ID NO: 350075

SEQ ID NO: 693720 - RNA, 62 nt, hsa; identical to SEQ ID NO: 350076

SEQ ID NO: 693721 - RNA, 63 nt, hsa; identical to SEQ ID NO: 350077

SEQ ID NO: 693722 - RNA, 63 nt, hsa; identical to SEQ ID NO: 350078

SEQ ID NO: 693723 - RNA, 63 nt, hsa; identical to SEQ ID NO: 350079

SEQ ID NO: 693724 - RNA, 63 nt, hsa; identical to SEQ ID NO: 350080

SEQ ID NO: 693725 - RNA, 63 nt, hsa; identical to SEQ ID NO: 350081

SEQ ID NO: 693726 - RNA, 63 nt, hsa; identical to SEQ ID NO: 350082

SEQ ID NO: 693727 - RNA, 63 nt, hsa; identical to SEQ ID NO: 350083

SEQ ID NO: 693728 - RNA, 63 nt, hsa; identical to SEQ ID NO: 350084

SEQ ID NO: 693729 - RNA, 63 nt, hsa; identical to SEQ ID NO: 350085

SEQ ID NO: 693730 - RNA, 63 nt, hsa; identical to SEQ ID NO: 350086

SEQ ID NO: 693731 - RNA, 63 nt, hsa; identical to SEQ ID NO: 350087

SEQ ID NO: 693732 - RNA, 63 nt, hsa; identical to SEQ ID NO: 350088

SEQ ID NO: 693733 - RNA, 63 nt, hsa; identical to SEQ ID NO: 350089

SEQ ID NO: 693734 - RNA, 63 nt, hsa; identical to SEQ ID NO: 350090

SEQ ID NO: 693735 - RNA, 63 nt, hsa; identical to SEQ ID NO: 350091

SEQ ID NO: 693736 - RNA, 63 nt, hsa; identical to SEQ ID NO: 350092

SEQ ID NO: 693737 - RNA, 63 nt, hsa; identical to SEQ ID NO: 350093

SEQ ID NO: 693738 - RNA, 63 nt, hsa; identical to SEQ ID NO: 350094

SEQ ID NO: 693739 - RNA, 63 nt, hsa; identical to SEQ ID NO: 350095

SEQ ID NO: 693740 - RNA, 63 nt, hsa; identical to SEQ ID NO: 350096

SEQ ID NO: 693741 - RNA, 63 nt, hsa; identical to SEQ ID NO: 350097

SEQ ID NO: 693742 - RNA, 63 nt, hsa; identical to SEQ ID NO: 350098

SEQ ID NO: 693743 - RNA, 63 nt, hsa; identical to SEQ ID NO: 350099

SEQ ID NO: 693744 - RNA, 63 nt, hsa; identical to SEQ ID NO: 350100

SEQ ID NO: 693745 - RNA, 63 nt, hsa; identical to SEQ ID NO: 350101

SEQ ID NO: 693746 - RNA, 63 nt, hsa; identical to SEQ ID NO: 350102

SEQ ID NO: 693747 - RNA, 63 nt, hsa; identical to SEQ ID NO: 350103

SEQ ID NO: 693748 - RNA, 63 nt, hsa; identical to SEQ ID NO: 350104

SEQ ID NO: 693749 - RNA, 63 nt, hsa; identical to SEQ ID NO: 350105

SEQ ID NO: 693750 - RNA, 63 nt, hsa; identical to SEQ ID NO: 350106

SEQ ID NO: 693751 - RNA, 63 nt, hsa; identical to SEQ ID NO: 350107

SEQ ID NO: 693752 - RNA, 63 nt, hsa; identical to SEQ ID NO: 350108

SEQ ID NO: 693753 - RNA, 63 nt, hsa; identical to SEQ ID NO: 350109

SEQ ID NO: 693754 - RNA, 63 nt, hsa; identical to SEQ ID NO: 350110

SEQ ID NO: 693755 - RNA, 63 nt, hsa; identical to SEQ ID NO: 350111

SEQ ID NO: 693756 - RNA, 63 nt, hsa; identical to SEQ ID NO: 350112

SEQ ID NO: 693757 - RNA, 63 nt, hsa; identical to SEQ ID NO: 350113

SEQ ID NO: 693758 - RNA, 63 nt, hsa; identical to SEQ ID NO: 350114

SEQ ID NO: 693759 - RNA, 63 nt, hsa; identical to SEQ ID NO: 350115

SEQ ID NO: 693760 - RNA, 63 nt, hsa; identical to SEQ ID NO: 350116

SEQ ID NO: 693761 - RNA, 63 nt, hsa; identical to SEQ ID NO: 350117

SEQ ID NO: 693762 - RNA, 63 nt, hsa; identical to SEQ ID NO: 350118

SEQ ID NO: 693763 - RNA, 63 nt, hsa; identical to SEQ ID NO: 350119

SEQ ID NO: 693764 - RNA, 63 nt, hsa; identical to SEQ ID NO: 350120

SEQ ID NO: 693765 - RNA, 63 nt, hsa; identical to SEQ ID NO: 350121

SEQ ID NO: 693766 - RNA, 63 nt, hsa; identical to SEQ ID NO: 350122

SEQ ID NO: 693767 - RNA, 63 nt, hsa; identical to SEQ ID NO: 350123

SEQ ID NO: 693768 - RNA, 63 nt, hsa; identical to SEQ ID NO: 350124

SEQ ID NO: 693769 - RNA, 63 nt, hsa; identical to SEQ ID NO: 350125

SEQ ID NO: 693770 - RNA, 63 nt, hsa; identical to SEQ ID NO: 350126

SEQ ID NO: 693771 - RNA, 63 nt, hsa; identical to SEQ ID NO: 350127

SEQ ID NO: 693772 - RNA, 63 nt, hsa; identical to SEQ ID NO: 350128

SEQ ID NO: 693773 - RNA, 63 nt, hsa; identical to SEQ ID NO: 350129

SEQ ID NO: 693774 - RNA, 63 nt, hsa; identical to SEQ ID NO: 350130

SEQ ID NO: 693775 - RNA, 63 nt, hsa; identical to SEQ ID NO: 350131

SEQ ID NO: 693776 - RNA, 63 nt, hsa; identical to SEQ ID NO: 350132

SEQ ID NO: 693777 - RNA, 63 nt, hsa; identical to SEQ ID NO: 350133

SEQ ID NO: 693778 - RNA, 63 nt, hsa; identical to SEQ ID NO: 350134

SEQ ID NO: 693779 - RNA, 63 nt, hsa; identical to SEQ ID NO: 350135

SEQ ID NO: 693780 - RNA, 63 nt, hsa; identical to SEQ ID NO: 350136

SEQ ID NO: 693781 - RNA, 63 nt, hsa; identical to SEQ ID NO: 350137

SEQ ID NO: 693782 - RNA, 63 nt, hsa; identical to SEQ ID NO: 350138

SEQ ID NO: 693783 - RNA, 63 nt, hsa; identical to SEQ ID NO: 350139

SEQ ID NO: 693784 - RNA, 63 nt, hsa; identical to SEQ ID NO: 350140

SEQ ID NO: 693785 - RNA, 63 nt, hsa; identical to SEQ ID NO: 350141

SEQ ID NO: 693786 - RNA, 63 nt, hsa; identical to SEQ ID NO: 350142

SEQ ID NO: 693787 - RNA, 63 nt, hsa; identical to SEQ ID NO: 350143

SEQ ID NO: 693788 - RNA, 63 nt, hsa; identical to SEQ ID NO: 350144

SEQ ID NO: 693789 - RNA, 63 nt, hsa; identical to SEQ ID NO: 350145

SEQ ID NO: 693790 - RNA, 63 nt, hsa; identical to SEQ ID NO: 350146

SEQ ID NO: 693791 - RNA, 63 nt, hsa; identical to SEQ ID NO: 350147

SEQ ID NO: 693792 - RNA, 63 nt, hsa; identical to SEQ ID NO: 350148

SEQ ID NO: 693793 - RNA, 63 nt, hsa; identical to SEQ ID NO: 350149

SEQ ID NO: 693794 - RNA, 63 nt, hsa; identical to SEQ ID NO: 350150

SEQ ID NO: 693795 - RNA, 63 nt, hsa; identical to SEQ ID NO: 350151

SEQ ID NO: 693796 - RNA, 63 nt, hsa; identical to SEQ ID NO: 350152

SEQ ID NO: 693797 - RNA, 63 nt, hsa; identical to SEQ ID NO: 350153

SEQ ID NO: 693798 - RNA, 60 nt, hsa; identical to SEQ ID NO: 350154

SEQ ID NO: 693799 - RNA, 63 nt, hsa; identical to SEQ ID NO: 350155

SEQ ID NO: 693800 - RNA, 63 nt, hsa; identical to SEQ ID NO: 350156

SEQ ID NO: 693801 - RNA, 63 nt, hsa; identical to SEQ ID NO: 350157

SEQ ID NO: 693802 - RNA, 63 nt, hsa; identical to SEQ ID NO: 350158

SEQ ID NO: 693803 - RNA, 63 nt, hsa; identical to SEQ ID NO: 350159

SEQ ID NO: 693804 - RNA, 63 nt, hsa; identical to SEQ ID NO: 350160

SEQ ID NO: 693805 - RNA, 63 nt, hsa; identical to SEQ ID NO: 350161

SEQ ID NO: 693806 - RNA, 63 nt, hsa; identical to SEQ ID NO: 350162

SEQ ID NO: 693807 - RNA, 63 nt, hsa; identical to SEQ ID NO: 350163

SEQ ID NO: 693808 - RNA, 63 nt, hsa; identical to SEQ ID NO: 350164

SEQ ID NO: 693809 - RNA, 63 nt, hsa; identical to SEQ ID NO: 350165

SEQ ID NO: 693810 - RNA, 63 nt, hsa; identical to SEQ ID NO: 350166

SEQ ID NO: 693811 - RNA, 63 nt, hsa; identical to SEQ ID NO: 350167

SEQ ID NO: 693812 - RNA, 63 nt, hsa; identical to SEQ ID NO: 350168

SEQ ID NO: 693813 - RNA, 63 nt, hsa; identical to SEQ ID NO: 350169

SEQ ID NO: 693814 - RNA, 63 nt, hsa; identical to SEQ ID NO: 350170

SEQ ID NO: 693815 - RNA, 63 nt, hsa; identical to SEQ ID NO: 350171

SEQ ID NO: 693816 - RNA, 63 nt, hsa; identical to SEQ ID NO: 350172

SEQ ID NO: 693817 - RNA, 63 nt, hsa; identical to SEQ ID NO: 350173

SEQ ID NO: 693818 - RNA, 63 nt, hsa; identical to SEQ ID NO: 350174

SEQ ID NO: 693819 - RNA, 63 nt, hsa; identical to SEQ ID NO: 350175

SEQ ID NO: 693820 - RNA, 63 nt, hsa; identical to SEQ ID NO: 350176

SEQ ID NO: 693821 - RNA, 63 nt, hsa; identical to SEQ ID NO: 350177

SEQ ID NO: 693822 - RNA, 63 nt, hsa; identical to SEQ ID NO: 350178

SEQ ID NO: 693823 - RNA, 63 nt, hsa; identical to SEQ ID NO: 350179

SEQ ID NO: 693824 - RNA, 63 nt, hsa; identical to SEQ ID NO: 350180

SEQ ID NO: 693825 - RNA, 63 nt, hsa; identical to SEQ ID NO: 350181

SEQ ID NO: 693826 - RNA, 63 nt, hsa; identical to SEQ ID NO: 350182

SEQ ID NO: 693827 - RNA, 63 nt, hsa; identical to SEQ ID NO: 350183

SEQ ID NO: 693828 - RNA, 63 nt, hsa; identical to SEQ ID NO: 350184

SEQ ID NO: 693829 - RNA, 63 nt, hsa; identical to SEQ ID NO: 350184

SEQ ID NO: 693830 - RNA, 63 nt, hsa; identical to SEQ ID NO: 350186

SEQ ID NO: 693831 - RNA, 63 nt, hsa; identical to SEQ ID NO: 350187

SEQ ID NO: 693832 - RNA, 63 nt, hsa; identical to SEQ ID NO: 350188

SEQ ID NO: 693833 - RNA, 63 nt, hsa; identical to SEQ ID NO: 350189

SEQ ID NO: 693834 - RNA, 63 nt, hsa; identical to SEQ ID NO: 350190

SEQ ID NO: 693835 - RNA, 63 nt, hsa; identical to SEQ ID NO: 350191

SEQ ID NO: 693836 - RNA, 63 nt, hsa; identical to SEQ ID NO: 350192

SEQ ID NO: 693837 - RNA, 63 nt, hsa; identical to SEQ ID NO: 350193

SEQ ID NO: 693838 - RNA, 63 nt, hsa; identical to SEQ ID NO: 350194

SEQ ID NO: 693839 - RNA, 63 nt, hsa; identical to SEQ ID NO: 350195

SEQ ID NO: 693840 - RNA, 63 nt, hsa; identical to SEQ ID NO: 350196

SEQ ID NO: 693841 - RNA, 63 nt, hsa; identical to SEQ ID NO: 350197

SEQ ID NO: 693842 - RNA, 63 nt, hsa; identical to SEQ ID NO: 350198

SEQ ID NO: 693843 - RNA, 63 nt, hsa; identical to SEQ ID NO: 350199

SEQ ID NO: 693844 - RNA, 63 nt, hsa; identical to SEQ ID NO: 350200

SEQ ID NO: 693845 - RNA, 63 nt, hsa; identical to SEQ ID NO: 350201

SEQ ID NO: 693846 - RNA, 63 nt, hsa; identical to SEQ ID NO: 350202

SEQ ID NO: 693847 - RNA, 61 nt, hsa; identical to SEQ ID NO: 350203

SEQ ID NO: 693848 - RNA, 63 nt, hsa; identical to SEQ ID NO: 350204

SEQ ID NO: 693849 - RNA, 63 nt, hsa; identical to SEQ ID NO: 350205

SEQ ID NO: 693850 - RNA, 63 nt, hsa; identical to SEQ ID NO: 350206

SEQ ID NO: 693851 - RNA, 63 nt, hsa; identical to SEQ ID NO: 350207

SEQ ID NO: 693852 - RNA, 63 nt, hsa; identical to SEQ ID NO: 350208

SEQ ID NO: 693853 - RNA, 63 nt, hsa; identical to SEQ ID NO: 350209

SEQ ID NO: 693854 - RNA, 63 nt, hsa; identical to SEQ ID NO: 350210

SEQ ID NO: 693855 - RNA, 63 nt, hsa; identical to SEQ ID NO: 350211

SEQ ID NO: 693856 - RNA, 63 nt, hsa; identical to SEQ ID NO: 350212

SEQ ID NO: 693857 - RNA, 63 nt, hsa; identical to SEQ ID NO: 350213

SEQ ID NO: 693858 - RNA, 63 nt, hsa; identical to SEQ ID NO: 350214

SEQ ID NO: 693859 - RNA, 63 nt, hsa; identical to SEQ ID NO: 350215

SEQ ID NO: 693860 - RNA, 63 nt, hsa; identical to SEQ ID NO: 350216

SEQ ID NO: 693861 - RNA, 63 nt, hsa; identical to SEQ ID NO: 350217

SEQ ID NO: 693862 - RNA, 63 nt, hsa; identical to SEQ ID NO: 350218

SEQ ID NO: 693863 - RNA, 63 nt, hsa; identical to SEQ ID NO: 350219

SEQ ID NO: 693864 - RNA, 63 nt, hsa; identical to SEQ ID NO: 350220

SEQ ID NO: 693865 - RNA, 63 nt, hsa; identical to SEQ ID NO: 350221

SEQ ID NO: 693866 - RNA, 63 nt, hsa; identical to SEQ ID NO: 350222

SEQ ID NO: 693867 - RNA, 63 nt, hsa; identical to SEQ ID NO: 350223

SEQ ID NO: 693868 - RNA, 63 nt, hsa; identical to SEQ ID NO: 350224

SEQ ID NO: 693869 - RNA, 63 nt, hsa; identical to SEQ ID NO: 350225

SEQ ID NO: 693870 - RNA, 63 nt, hsa; identical to SEQ ID NO: 350226

SEQ ID NO: 693871 - RNA, 63 nt, hsa; identical to SEQ ID NO: 350227

SEQ ID NO: 693872 - RNA, 63 nt, hsa; identical to SEQ ID NO: 350228

SEQ ID NO: 693873 - RNA, 63 nt, hsa; identical to SEQ ID NO: 350229

SEQ ID NO: 693874 - RNA, 63 nt, hsa; identical to SEQ ID NO: 350230

SEQ ID NO: 693875 - RNA, 63 nt, hsa; identical to SEQ ID NO: 350231

SEQ ID NO: 693876 - RNA, 63 nt, hsa; identical to SEQ ID NO: 350232

SEQ ID NO: 693877 - RNA, 63 nt, hsa; identical to SEQ ID NO: 350233

SEQ ID NO: 693878 - RNA, 63 nt, hsa; identical to SEQ ID NO: 350234

SEQ ID NO: 693879 - RNA, 63 nt, hsa; identical to SEQ ID NO: 350234

SEQ ID NO: 693880 - RNA, 63 nt, hsa; identical to SEQ ID NO: 350236

SEQ ID NO: 693881 - RNA, 64 nt, hsa
augccgagucgcggcccugcucagccggaagaggcucccggaccuggauguacagggcagucuc

SEQ ID NO: 693882 - RNA, 64 nt, hsa
ucauggcccccugcuuccugcuccuuggagcuggcucccggaccuugcccaccauccaugcagu

SEQ ID NO: 693883 - RNA, 64 nt, hsa
ccuuggguucccugagcuguccagaccccaccaucucccggaccccagggagguggccauugcc

SEQ ID NO: 693884 - RNA, 64 nt, hsa
caaaccugcuguuggcccgggagagccccagaggcucccggagacugcagccuccugugguugg

SEQ ID NO: 693885 - RNA, 64 nt, hsa
augugaggaugcaaaagaaaugaugauaacauuuugagauaaggccaaggagacguggaguagg

SEQ ID NO: 693886 - RNA, 64 nt, hsa
aaaucugagguuucccguugguuguuaauuugguugagauaaacauuccuuuuuaaggaaaagu

SEQ ID NO: 693887 - RNA, 64 nt, hsa
uuuuccacuacacaacugccuuccugacagguucugagauaaguguuauguuuguagauagagu

SEQ ID NO: 693888 - RNA, 64 nt, hsa
auauguauuuucuucuugaauuucacuggccuaaugagauaauacucuuaucuuuggcucuacc

SEQ ID NO: 693889 - RNA, 64 nt, hsa
uuauacuggugagaaauccuagaaaucugaagagugagauaaagccuuuaaaugguugucacac

SEQ ID NO: 693890 - RNA, 64 nt, hsa
gcucacacuuuauugcuaggaaagcauuuauacuugagauaaauuauacaaauauaaagacugu

SEQ ID NO: 693891 - RNA, 64 nt, hsa; identical to SEQ ID NO: 271308

SEQ ID NO: 693892 - RNA, 64 nt, hsa; identical to SEQ ID NO: 271309

SEQ ID NO: 693893 - RNA, 64 nt, hsa; identical to SEQ ID NO: 271310

SEQ ID NO: 693894 - RNA, 64 nt, hsa; identical to SEQ ID NO: 271311

SEQ ID NO: 693895 - RNA, 64 nt, hsa; identical to SEQ ID NO: 271312

SEQ ID NO: 693896 - RNA, 64 nt, hsa; identical to SEQ ID NO: 271313

SEQ ID NO: 693897 - RNA, 64 nt, hsa; identical to SEQ ID NO: 271314

SEQ ID NO: 693898 - RNA, 64 nt, hsa; identical to SEQ ID NO: 271315

SEQ ID NO: 693899 - RNA, 64 nt, hsa; identical to SEQ ID NO: 271316

SEQ ID NO: 693900 - RNA, 64 nt, hsa; identical to SEQ ID NO: 271317

SEQ ID NO: 693901 - RNA, 64 nt, hsa; identical to SEQ ID NO: 271318

SEQ ID NO: 693902 - RNA, 64 nt, hsa; identical to SEQ ID NO: 271319

SEQ ID NO: 693903 - RNA, 64 nt, hsa; identical to SEQ ID NO: 271320

SEQ ID NO: 693904 - RNA, 64 nt, hsa; identical to SEQ ID NO: 271321

SEQ ID NO: 693905 - RNA, 64 nt, hsa; identical to SEQ ID NO: 271322

SEQ ID NO: 693906 - RNA, 64 nt, hsa; identical to SEQ ID NO: 271323

SEQ ID NO: 693907 - RNA, 64 nt, hsa; identical to SEQ ID NO: 271324

SEQ ID NO: 693908 - RNA, 64 nt, hsa; identical to SEQ ID NO: 271325

SEQ ID NO: 693909 - RNA, 64 nt, hsa; identical to SEQ ID NO: 271326

SEQ ID NO: 693910 - RNA, 64 nt, hsa; identical to SEQ ID NO: 271327

SEQ ID NO: 693911 - RNA, 64 nt, hsa; identical to SEQ ID NO: 271328

SEQ ID NO: 693912 - RNA, 64 nt, hsa; identical to SEQ ID NO: 271329

SEQ ID NO: 693913 - RNA, 64 nt, hsa; identical to SEQ ID NO: 271330

SEQ ID NO: 693914 - RNA, 64 nt, hsa; identical to SEQ ID NO: 271331

SEQ ID NO: 693915 - RNA, 64 nt, hsa; identical to SEQ ID NO: 271332

SEQ ID NO: 693916 - RNA, 64 nt, hsa; identical to SEQ ID NO: 271333

SEQ ID NO: 693917 - RNA, 64 nt, hsa; identical to SEQ ID NO: 271334

SEQ ID NO: 693918 - RNA, 64 nt, hsa; identical to SEQ ID NO: 271335

SEQ ID NO: 693919 - RNA, 59 nt, hsa; identical to SEQ ID NO: 271336

SEQ ID NO: 693920 - RNA, 64 nt, hsa; identical to SEQ ID NO: 271337

SEQ ID NO: 693921 - RNA, 64 nt, hsa; identical to SEQ ID NO: 271338

SEQ ID NO: 693922 - RNA, 64 nt, hsa; identical to SEQ ID NO: 271339

SEQ ID NO: 693923 - RNA, 64 nt, hsa; identical to SEQ ID NO: 271340

SEQ ID NO: 693924 - RNA, 64 nt, hsa; identical to SEQ ID NO: 221220

SEQ ID NO: 693925 - RNA, 64 nt, hsa; identical to SEQ ID NO: 221221

SEQ ID NO: 693926 - RNA, 64 nt, hsa; identical to SEQ ID NO: 221222

SEQ ID NO: 693927 - RNA, 64 nt, hsa; identical to SEQ ID NO: 221223

SEQ ID NO: 693928 - RNA, 64 nt, hsa; identical to SEQ ID NO: 221224

SEQ ID NO: 693929 - RNA, 64 nt, hsa; identical to SEQ ID NO: 221225

SEQ ID NO: 693930 - RNA, 64 nt, hsa; identical to SEQ ID NO: 221226

SEQ ID NO: 693931 - RNA, 64 nt, hsa; identical to SEQ ID NO: 221227

SEQ ID NO: 693932 - RNA, 64 nt, hsa; identical to SEQ ID NO: 221228

SEQ ID NO: 693933 - RNA, 64 nt, hsa; identical to SEQ ID NO: 221229

SEQ ID NO: 693934 - RNA, 64 nt, hsa; identical to SEQ ID NO: 221230

SEQ ID NO: 693935 - RNA, 64 nt, hsa; identical to SEQ ID NO: 221231

SEQ ID NO: 693936 - RNA, 64 nt, hsa; identical to SEQ ID NO: 221232

SEQ ID NO: 693937 - RNA, 64 nt, hsa; identical to SEQ ID NO: 221233

SEQ ID NO: 693938 - RNA, 64 nt, hsa; identical to SEQ ID NO: 221234

SEQ ID NO: 693939 - RNA, 64 nt, hsa; identical to SEQ ID NO: 221235

SEQ ID NO: 693940 - RNA, 64 nt, hsa; identical to SEQ ID NO: 221236

SEQ ID NO: 693941 - RNA, 64 nt, hsa; identical to SEQ ID NO: 221237

SEQ ID NO: 693942 - RNA, 64 nt, hsa; identical to SEQ ID NO: 221238

SEQ ID NO: 693943 - RNA, 64 nt, hsa; identical to SEQ ID NO: 221239

SEQ ID NO: 693944 - RNA, 64 nt, hsa; identical to SEQ ID NO: 221240

SEQ ID NO: 693945 - RNA, 64 nt, hsa; identical to SEQ ID NO: 221241

SEQ ID NO: 693946 - RNA, 64 nt, hsa; identical to SEQ ID NO: 221242

SEQ ID NO: 693947 - RNA, 64 nt, hsa; identical to SEQ ID NO: 221243

SEQ ID NO: 693948 - RNA, 64 nt, hsa; identical to SEQ ID NO: 221244

SEQ ID NO: 693949 - RNA, 64 nt, hsa; identical to SEQ ID NO: 221245

SEQ ID NO: 693950 - RNA, 64 nt, hsa; identical to SEQ ID NO: 221246

SEQ ID NO: 693951 - RNA, 64 nt, hsa; identical to SEQ ID NO: 221247

SEQ ID NO: 693952 - RNA, 64 nt, hsa; identical to SEQ ID NO: 221248

SEQ ID NO: 693953 - RNA, 64 nt, hsa; identical to SEQ ID NO: 221249

SEQ ID NO: 693954 - RNA, 64 nt, hsa; identical to SEQ ID NO: 221250

SEQ ID NO: 693955 - RNA, 64 nt, hsa; identical to SEQ ID NO: 221251

SEQ ID NO: 693956 - RNA, 64 nt, hsa; identical to SEQ ID NO: 221252

SEQ ID NO: 693957 - RNA, 64 nt, hsa; identical to SEQ ID NO: 221253

SEQ ID NO: 693958 - RNA, 64 nt, hsa; identical to SEQ ID NO: 221254

SEQ ID NO: 693959 - RNA, 64 nt, hsa; identical to SEQ ID NO: 221255

SEQ ID NO: 693960 - RNA, 64 nt, hsa; identical to SEQ ID NO: 221256

SEQ ID NO: 693961 - RNA, 64 nt, hsa; identical to SEQ ID NO: 221257

SEQ ID NO: 693962 - RNA, 64 nt, hsa; identical to SEQ ID NO: 221258

SEQ ID NO: 693963 - RNA, 64 nt, hsa; identical to SEQ ID NO: 221259

SEQ ID NO: 693964 - RNA, 64 nt, hsa; identical to SEQ ID NO: 221260

SEQ ID NO: 693965 - RNA, 64 nt, hsa; identical to SEQ ID NO: 221261

SEQ ID NO: 693966 - RNA, 64 nt, hsa; identical to SEQ ID NO: 221262

SEQ ID NO: 693967 - RNA, 64 nt, hsa; identical to SEQ ID NO: 221263

SEQ ID NO: 693968 - RNA, 64 nt, hsa; identical to SEQ ID NO: 221264

SEQ ID NO: 693969 - RNA, 64 nt, hsa; identical to SEQ ID NO: 221265

SEQ ID NO: 693970 - RNA, 64 nt, hsa; identical to SEQ ID NO: 221266

SEQ ID NO: 693971 - RNA, 54 nt, hsa; identical to SEQ ID NO: 221267

SEQ ID NO: 693972 - RNA, 64 nt, hsa; identical to SEQ ID NO: 221268

SEQ ID NO: 693973 - RNA, 64 nt, hsa; identical to SEQ ID NO: 221269

SEQ ID NO: 693974 - RNA, 64 nt, hsa; identical to SEQ ID NO: 221270

SEQ ID NO: 693975 - RNA, 64 nt, hsa; identical to SEQ ID NO: 221271

SEQ ID NO: 693976 - RNA, 64 nt, hsa; identical to SEQ ID NO: 221272

SEQ ID NO: 693977 - RNA, 64 nt, hsa; identical to SEQ ID NO: 221273

SEQ ID NO: 693978 - RNA, 64 nt, hsa; identical to SEQ ID NO: 312464

SEQ ID NO: 693979 - RNA, 64 nt, hsa; identical to SEQ ID NO: 312465

SEQ ID NO: 693980 - RNA, 64 nt, hsa; identical to SEQ ID NO: 312466

SEQ ID NO: 693981 - RNA, 64 nt, hsa; identical to SEQ ID NO: 312467

SEQ ID NO: 693982 - RNA, 64 nt, hsa; identical to SEQ ID NO: 312468

SEQ ID NO: 693983 - RNA, 64 nt, hsa; identical to SEQ ID NO: 312469

SEQ ID NO: 693984 - RNA, 64 nt, hsa; identical to SEQ ID NO: 312470

SEQ ID NO: 693985 - RNA, 64 nt, hsa; identical to SEQ ID NO: 312471

SEQ ID NO: 693986 - RNA, 64 nt, hsa; identical to SEQ ID NO: 312472

SEQ ID NO: 693987 - RNA, 64 nt, hsa; identical to SEQ ID NO: 312473

SEQ ID NO: 693988 - RNA, 64 nt, hsa; identical to SEQ ID NO: 312474

SEQ ID NO: 693989 - RNA, 64 nt, hsa; identical to SEQ ID NO: 312475

SEQ ID NO: 693990 - RNA, 64 nt, hsa; identical to SEQ ID NO: 312476

SEQ ID NO: 693991 - RNA, 64 nt, hsa; identical to SEQ ID NO: 312477

SEQ ID NO: 693992 - RNA, 64 nt, hsa; identical to SEQ ID NO: 312478

SEQ ID NO: 693993 - RNA, 64 nt, hsa; identical to SEQ ID NO: 312479

SEQ ID NO: 693994 - RNA, 64 nt, hsa; identical to SEQ ID NO: 312480

SEQ ID NO: 693995 - RNA, 64 nt, hsa; identical to SEQ ID NO: 312481

SEQ ID NO: 693996 - RNA, 64 nt, hsa; identical to SEQ ID NO: 312482

SEQ ID NO: 693997 - RNA, 64 nt, hsa; identical to SEQ ID NO: 312483

SEQ ID NO: 693998 - RNA, 64 nt, hsa; identical to SEQ ID NO: 312484

SEQ ID NO: 693999 - RNA, 64 nt, hsa; identical to SEQ ID NO: 312485

SEQ ID NO: 694000 - RNA, 64 nt, hsa; identical to SEQ ID NO: 312486

SEQ ID NO: 694001 - RNA, 64 nt, hsa; identical to SEQ ID NO: 312487

SEQ ID NO: 694002 - RNA, 64 nt, hsa; identical to SEQ ID NO: 312488

SEQ ID NO: 694003 - RNA, 64 nt, hsa; identical to SEQ ID NO: 312489

SEQ ID NO: 694004 - RNA, 64 nt, hsa; identical to SEQ ID NO: 312490

SEQ ID NO: 694005 - RNA, 64 nt, hsa; identical to SEQ ID NO: 312491

SEQ ID NO: 694006 - RNA, 64 nt, hsa; identical to SEQ ID NO: 312492

SEQ ID NO: 694007 - RNA, 64 nt, hsa; identical to SEQ ID NO: 312493

SEQ ID NO: 694008 - RNA, 64 nt, hsa; identical to SEQ ID NO: 312494

SEQ ID NO: 694009 - RNA, 64 nt, hsa; identical to SEQ ID NO: 312495

SEQ ID NO: 694010 - RNA, 64 nt, hsa; identical to SEQ ID NO: 312496

SEQ ID NO: 694011 - RNA, 64 nt, hsa; identical to SEQ ID NO: 312497

SEQ ID NO: 694012 - RNA, 64 nt, hsa; identical to SEQ ID NO: 312498

SEQ ID NO: 694013 - RNA, 64 nt, hsa; identical to SEQ ID NO: 312499

SEQ ID NO: 694014 - RNA, 64 nt, hsa; identical to SEQ ID NO: 312500

SEQ ID NO: 694015 - RNA, 64 nt, hsa; identical to SEQ ID NO: 312501

SEQ ID NO: 694016 - RNA, 64 nt, hsa; identical to SEQ ID NO: 312502

SEQ ID NO: 694017 - RNA, 64 nt, hsa; identical to SEQ ID NO: 312503

SEQ ID NO: 694018 - RNA, 64 nt, hsa; identical to SEQ ID NO: 312504

SEQ ID NO: 694019 - RNA, 64 nt, hsa; identical to SEQ ID NO: 312505

SEQ ID NO: 694020 - RNA, 64 nt, hsa; identical to SEQ ID NO: 312506

SEQ ID NO: 694021 - RNA, 64 nt, hsa; identical to SEQ ID NO: 312507

SEQ ID NO: 694022 - RNA, 64 nt, hsa; identical to SEQ ID NO: 312508

SEQ ID NO: 694023 - RNA, 64 nt, hsa; identical to SEQ ID NO: 312509

SEQ ID NO: 694024 - RNA, 64 nt, hsa; identical to SEQ ID NO: 312510

SEQ ID NO: 694025 - RNA, 64 nt, hsa; identical to SEQ ID NO: 312511

SEQ ID NO: 694026 - RNA, 64 nt, hsa; identical to SEQ ID NO: 312512

SEQ ID NO: 694027 - RNA, 64 nt, hsa; identical to SEQ ID NO: 374631

SEQ ID NO: 694028 - RNA, 64 nt, hsa; identical to SEQ ID NO: 374632

SEQ ID NO: 694029 - RNA, 64 nt, hsa; identical to SEQ ID NO: 374633

SEQ ID NO: 694030 - RNA, 64 nt, hsa; identical to SEQ ID NO: 374634

SEQ ID NO: 694031 - RNA, 64 nt, hsa; identical to SEQ ID NO: 374635

SEQ ID NO: 694032 - RNA, 64 nt, hsa; identical to SEQ ID NO: 374636

SEQ ID NO: 694033 - RNA, 64 nt, hsa; identical to SEQ ID NO: 374637

SEQ ID NO: 694034 - RNA, 64 nt, hsa; identical to SEQ ID NO: 374638

SEQ ID NO: 694035 - RNA, 64 nt, hsa; identical to SEQ ID NO: 374639

SEQ ID NO: 694036 - RNA, 64 nt, hsa; identical to SEQ ID NO: 374640

SEQ ID NO: 694037 - RNA, 64 nt, hsa; identical to SEQ ID NO: 374641

SEQ ID NO: 694038 - RNA, 64 nt, hsa; identical to SEQ ID NO: 374642

SEQ ID NO: 694039 - RNA, 64 nt, hsa; identical to SEQ ID NO: 312464

SEQ ID NO: 694040 - RNA, 64 nt, hsa; identical to SEQ ID NO: 312465

SEQ ID NO: 694041 - RNA, 64 nt, hsa; identical to SEQ ID NO: 312466

SEQ ID NO: 694042 - RNA, 64 nt, hsa; identical to SEQ ID NO: 312467

SEQ ID NO: 694043 - RNA, 64 nt, hsa; identical to SEQ ID NO: 312468

SEQ ID NO: 694044 - RNA, 64 nt, hsa; identical to SEQ ID NO: 312469

SEQ ID NO: 694045 - RNA, 64 nt, hsa; identical to SEQ ID NO: 312470

SEQ ID NO: 694046 - RNA, 64 nt, hsa; identical to SEQ ID NO: 312471

SEQ ID NO: 694047 - RNA, 64 nt, hsa; identical to SEQ ID NO: 312472

SEQ ID NO: 694048 - RNA, 64 nt, hsa; identical to SEQ ID NO: 312473

SEQ ID NO: 694049 - RNA, 64 nt, hsa; identical to SEQ ID NO: 312474

SEQ ID NO: 694050 - RNA, 64 nt, hsa; identical to SEQ ID NO: 312475

SEQ ID NO: 694051 - RNA, 64 nt, hsa; identical to SEQ ID NO: 312476

SEQ ID NO: 694052 - RNA, 64 nt, hsa; identical to SEQ ID NO: 312477

SEQ ID NO: 694053 - RNA, 64 nt, hsa; identical to SEQ ID NO: 312478

SEQ ID NO: 694054 - RNA, 64 nt, hsa; identical to SEQ ID NO: 312479

SEQ ID NO: 694055 - RNA, 64 nt, hsa; identical to SEQ ID NO: 312480

SEQ ID NO: 694056 - RNA, 64 nt, hsa; identical to SEQ ID NO: 312481

SEQ ID NO: 694057 - RNA, 64 nt, hsa; identical to SEQ ID NO: 312482

SEQ ID NO: 694058 - RNA, 64 nt, hsa; identical to SEQ ID NO: 312483

SEQ ID NO: 694059 - RNA, 64 nt, hsa; identical to SEQ ID NO: 312484

SEQ ID NO: 694060 - RNA, 64 nt, hsa; identical to SEQ ID NO: 312485

SEQ ID NO: 694061 - RNA, 64 nt, hsa; identical to SEQ ID NO: 312486

SEQ ID NO: 694062 - RNA, 64 nt, hsa; identical to SEQ ID NO: 312487

SEQ ID NO: 694063 - RNA, 64 nt, hsa; identical to SEQ ID NO: 312488

SEQ ID NO: 694064 - RNA, 64 nt, hsa; identical to SEQ ID NO: 312489

SEQ ID NO: 694065 - RNA, 64 nt, hsa; identical to SEQ ID NO: 312490

SEQ ID NO: 694066 - RNA, 64 nt, hsa; identical to SEQ ID NO: 312491

SEQ ID NO: 694067 - RNA, 64 nt, hsa; identical to SEQ ID NO: 312492

SEQ ID NO: 694068 - RNA, 64 nt, hsa; identical to SEQ ID NO: 312493

SEQ ID NO: 694069 - RNA, 64 nt, hsa; identical to SEQ ID NO: 312494

SEQ ID NO: 694070 - RNA, 64 nt, hsa; identical to SEQ ID NO: 312495

SEQ ID NO: 694071 - RNA, 64 nt, hsa; identical to SEQ ID NO: 312496

SEQ ID NO: 694072 - RNA, 64 nt, hsa; identical to SEQ ID NO: 312497

SEQ ID NO: 694073 - RNA, 64 nt, hsa; identical to SEQ ID NO: 312498

SEQ ID NO: 694074 - RNA, 64 nt, hsa; identical to SEQ ID NO: 312499

SEQ ID NO: 694075 - RNA, 64 nt, hsa; identical to SEQ ID NO: 312500

SEQ ID NO: 694076 - RNA, 64 nt, hsa; identical to SEQ ID NO: 312501

SEQ ID NO: 694077 - RNA, 64 nt, hsa; identical to SEQ ID NO: 312502

SEQ ID NO: 694078 - RNA, 64 nt, hsa; identical to SEQ ID NO: 312503

SEQ ID NO: 694079 - RNA, 64 nt, hsa; identical to SEQ ID NO: 312504

SEQ ID NO: 694080 - RNA, 64 nt, hsa; identical to SEQ ID NO: 312505

SEQ ID NO: 694081 - RNA, 64 nt, hsa; identical to SEQ ID NO: 312506

SEQ ID NO: 694082 - RNA, 64 nt, hsa; identical to SEQ ID NO: 312507

SEQ ID NO: 694083 - RNA, 64 nt, hsa; identical to SEQ ID NO: 312508

SEQ ID NO: 694084 - RNA, 64 nt, hsa; identical to SEQ ID NO: 312509

SEQ ID NO: 694085 - RNA, 64 nt, hsa; identical to SEQ ID NO: 312510

SEQ ID NO: 694086 - RNA, 64 nt, hsa; identical to SEQ ID NO: 312511

SEQ ID NO: 694087 - RNA, 64 nt, hsa; identical to SEQ ID NO: 312512

SEQ ID NO: 694088 - RNA, 64 nt, hsa; identical to SEQ ID NO: 374631

SEQ ID NO: 694089 - RNA, 64 nt, hsa; identical to SEQ ID NO: 374632

SEQ ID NO: 694090 - RNA, 64 nt, hsa; identical to SEQ ID NO: 374633

SEQ ID NO: 694091 - RNA, 64 nt, hsa; identical to SEQ ID NO: 374634

SEQ ID NO: 694092 - RNA, 64 nt, hsa; identical to SEQ ID NO: 374635

SEQ ID NO: 694093 - RNA, 64 nt, hsa; identical to SEQ ID NO: 374636

SEQ ID NO: 694094 - RNA, 64 nt, hsa; identical to SEQ ID NO: 374637

SEQ ID NO: 694095 - RNA, 64 nt, hsa; identical to SEQ ID NO: 374638

SEQ ID NO: 694096 - RNA, 64 nt, hsa; identical to SEQ ID NO: 374639

SEQ ID NO: 694097 - RNA, 64 nt, hsa; identical to SEQ ID NO: 374640

SEQ ID NO: 694098 - RNA, 64 nt, hsa; identical to SEQ ID NO: 374641

SEQ ID NO: 694099 - RNA, 64 nt, hsa; identical to SEQ ID NO: 374642

SEQ ID NO: 694100 - RNA, 63 nt, hsa
gcuacuccuuccuguagagcagaaauuguauuuugcacgaacaugcaguuauugaagauuagg

SEQ ID NO: 694101 - RNA, 63 nt, hsa
gaggguguaaguauuccaccagcccgcugagugugcacgaaauguucgcagugcaacaaaaag

SEQ ID NO: 694102 - RNA, 63 nt, hsa
uauauuagagucagagacuaaugguggcuuaaaugcacgaaugucuuuuuuuuuaaaacuguc

SEQ ID NO: 694103 - RNA, 63 nt, hsa
uuccuuugguugccauauggaauggccauggaaugcacgaagucacaaugcaccauccaugag

SEQ ID NO: 694104 - RNA, 63 nt, hsa
gaaacccguaggcacggacacacccagucucaaugcacgaaguuggagaaccugacagggcug

SEQ ID NO: 694105 - RNA, 63 nt, hsa
gcgugcugcagcgacaggcggcagcacagcaccugcacgaacacccgccgaaacugcugcgag

SEQ ID NO: 694106 - RNA, 63 nt, hsa
cugggcugguacaggccucagccuugcccucaaugcacgaaagguggcccaggagagaggauc

SEQ ID NO: 694107 - RNA, 63 nt, hsa
ugucacuuuuuaugcuauuucuguauauaaaggugcacgaagguaaaaaguauuuuuucaagu

SEQ ID NO: 694108 - RNA, 63 nt, hsa
gugaaagacaugagugcccucccaaagucugagugcacgaaaauuucucucuugccuugagga

SEQ ID NO: 694109 - RNA, 63 nt, hsa
aaaacugaaucaagaaaugaaugcuccaugaaaugcacgaagucuguuuuaaugacaagguga

SEQ ID NO: 694110 - RNA, 63 nt, hsa
gugcuggugccaaccucugguggccguaccugaugcacgaacaccccgccuaccuguacucgu

SEQ ID NO: 694111 - RNA, 63 nt, hsa
auuaggguggcuguccaucccuggauagcuauuugcacgaaucauggacauaaauccaaguug

SEQ ID NO: 694112 - RNA, 63 nt, hsa
cuuuguauucucuguccagggcuucagauauuuugcacgaauuuuaaaacauggcaauaaaug

SEQ ID NO: 694113 - RNA, 63 nt, hsa
gaugugaguugcacagcuaugaaggcuguacacugcacgaauggaagaggcaccugucccaga

SEQ ID NO: 694114 - RNA, 63 nt, hsa
cccaacacaugccuucccuccccagccacaccgugcacgaagggggcacaggagaggagaggg

SEQ ID NO: 694115 - RNA, 63 nt, hsa
guccagaaccuggaaccuagaggccuuucucucugcacgaaaaacagguaguuugcagucuga

SEQ ID NO: 694116 - RNA, 63 nt, hsa
uguacuguaauuuugaauggaacugaaaaauuaugcacgaauaaaguacuuuucucaugccau

SEQ ID NO: 694117 - RNA, 63 nt, hsa
ucagcugccaauaauaucuaauauuuuucaucaugcacgaauuaauaaucaucauacucuaga

SEQ ID NO: 694118 - RNA, 63 nt, hsa
ucuggaauccacuaugguuuaccuugaguggccugcacgaacaugacagcccugaucuguauu

SEQ ID NO: 694119 - RNA, 63 nt, hsa
uaguugaaguacaaauuaauaggccuuaugauaugcacgaauuuuacuauagauaauauaugu

SEQ ID NO: 694120 - RNA, 63 nt, hsa
uguuggcgcucggggcgagaugcugcccuucuuugcacgaagccuggccucuugcuuggcgug

SEQ ID NO: 694121 - RNA, 63 nt, hsa
gguagugcagcuguggguggaggcuggggugucugcacgaagucaggccagcguccuccucca

SEQ ID NO: 694122 - RNA, 63 nt, hsa
gaagggauguuuuguaagaacuaccaacaguuuugcacgaacaaugucuuuuaaauuaaaaua

SEQ ID NO: 694123 - RNA, 63 nt, hsa
uguguguguauguuucuuagccccuuggauuccugcacgaaguggcugaugggaaccauuuca

SEQ ID NO: 694124 - RNA, 63 nt, hsa
gggcuggguuaacguuuucucagggaaccacaaugcacgaaagaggaacugggguugcuaacc

SEQ ID NO: 694125 - RNA, 63 nt, hsa
acagccuucagcacaggcaacuguuacugagucugcacgaacuuagauaaugaggugcagggu

SEQ ID NO: 694126 - RNA, 63 nt, hsa
aucccauauuguuuggagacuuccagauggcucugcacgaaggagaaccacgcauuuaugaag

SEQ ID NO: 694127 - RNA, 63 nt, hsa
uggcucccuguuggcuacgcagggaugggcaguugcacgaaggcaugaauguauuguaaauaa

SEQ ID NO: 694128 - RNA, 63 nt, hsa
agacuuuccaaauauggaacuaacuggagaaggugcacgaaggagacaccacuuggggaccuc

SEQ ID NO: 694129 - RNA, 63 nt, hsa
uggucaaagugaggggaaaaaagcacgaccuacugcacgaagggaagauccaagcuucgaaag

SEQ ID NO: 694130 - RNA, 63 nt, hsa
cugagaaaggagacgaugaacguguagcugacaugcacgaaguuuaauuuacucauguccacg

SEQ ID NO: 694131 - RNA, 63 nt, hsa
cccuucaggcucuguugcucccuccucugcagcugcacgaaggcgccaucuggugucugcaug

SEQ ID NO: 694132 - RNA, 63 nt, hsa
ucccuggccuccagagguggcgugggcuggcuuugcacgaagguugugcugggagaccggacc

SEQ ID NO: 694133 - RNA, 63 nt, hsa
ucauucuaaugaaagaaaaugugaccaaagaaaugcacgaaaugugaaguucuuugucacugu

SEQ ID NO: 694134 - RNA, 63 nt, hsa
uuucccgguuauguguagggaacagcagagugaugcacgaacuuugaacauucguuaugggga

SEQ ID NO: 694135 - RNA, 63 nt, hsa
ugugggucccugacaaagaagagcuacgcucugugcacgaagucaagaaccaaacagcucagg

SEQ ID NO: 694136 - RNA, 63 nt, hsa
uuguggcacaaaaagggaacauguuuuacucuuugcacgaaacuuucauuguuaauguauauu

SEQ ID NO: 694137 - RNA, 63 nt, hsa
ugaaaugccucuucuuuauguacaaagauuauuugcacgaacuggacugugugcaacgcuuuu

SEQ ID NO: 694138 - RNA, 63 nt, hsa
gagccaacagaugugucagccaggauugaccuuugcacgaacaccaagugucugcaaguaaac

SEQ ID NO: 694139 - RNA, 63 nt, hsa
ccaggccccgcgggccgggcuccaggaagggccugcacgaacccuacagcgagagugacgaug

SEQ ID NO: 694140 - RNA, 63 nt, hsa
ggaggucccgcagaagcuacagcugccaggucaugcacgaagggagcaccguggagaagacgg

SEQ ID NO: 694141 - RNA, 64 nt, hsa; identical to SEQ ID NO: 53883

SEQ ID NO: 694142 - RNA, 64 nt, hsa; identical to SEQ ID NO: 53884

SEQ ID NO: 694143 - RNA, 64 nt, hsa; identical to SEQ ID NO: 53885

SEQ ID NO: 694144 - RNA, 64 nt, hsa; identical to SEQ ID NO: 53886

SEQ ID NO: 694145 - RNA, 64 nt, hsa; identical to SEQ ID NO: 53887

SEQ ID NO: 694146 - RNA, 64 nt, hsa; identical to SEQ ID NO: 53888

SEQ ID NO: 694147 - RNA, 64 nt, hsa; identical to SEQ ID NO: 53889

SEQ ID NO: 694148 - RNA, 64 nt, hsa; identical to SEQ ID NO: 53890

SEQ ID NO: 694149 - RNA, 64 nt, hsa; identical to SEQ ID NO: 53891

SEQ ID NO: 694150 - RNA, 64 nt, hsa; identical to SEQ ID NO: 53892

SEQ ID NO: 694151 - RNA, 64 nt, hsa; identical to SEQ ID NO: 53893

SEQ ID NO: 694152 - RNA, 64 nt, hsa; identical to SEQ ID NO: 53894

SEQ ID NO: 694153 - RNA, 64 nt, hsa; identical to SEQ ID NO: 53895

SEQ ID NO: 694154 - RNA, 64 nt, hsa; identical to SEQ ID NO: 53896

SEQ ID NO: 694155 - RNA, 64 nt, hsa; identical to SEQ ID NO: 53897

SEQ ID NO: 694156 - RNA, 64 nt, hsa; identical to SEQ ID NO: 53898

SEQ ID NO: 694157 - RNA, 64 nt, hsa; identical to SEQ ID NO: 53899

SEQ ID NO: 694158 - RNA, 64 nt, hsa; identical to SEQ ID NO: 53900

SEQ ID NO: 694159 - RNA, 64 nt, hsa; identical to SEQ ID NO: 53901

SEQ ID NO: 694160 - RNA, 64 nt, hsa; identical to SEQ ID NO: 53902

SEQ ID NO: 694161 - RNA, 64 nt, hsa; identical to SEQ ID NO: 53903

SEQ ID NO: 694162 - RNA, 64 nt, hsa; identical to SEQ ID NO: 53904

SEQ ID NO: 694163 - RNA, 64 nt, hsa; identical to SEQ ID NO: 53905

SEQ ID NO: 694164 - RNA, 64 nt, hsa; identical to SEQ ID NO: 53906

SEQ ID NO: 694165 - RNA, 64 nt, hsa; identical to SEQ ID NO: 53907

SEQ ID NO: 694166 - RNA, 64 nt, hsa; identical to SEQ ID NO: 53908

SEQ ID NO: 694167 - RNA, 64 nt, hsa; identical to SEQ ID NO: 53909

SEQ ID NO: 694168 - RNA, 64 nt, hsa; identical to SEQ ID NO: 53910

SEQ ID NO: 694169 - RNA, 64 nt, hsa; identical to SEQ ID NO: 53911

SEQ ID NO: 694170 - RNA, 64 nt, hsa; identical to SEQ ID NO: 53912

SEQ ID NO: 694171 - RNA, 64 nt, hsa; identical to SEQ ID NO: 53913

SEQ ID NO: 694172 - RNA, 64 nt, hsa; identical to SEQ ID NO: 53914

SEQ ID NO: 694173 - RNA, 64 nt, hsa; identical to SEQ ID NO: 53915

SEQ ID NO: 694174 - RNA, 64 nt, hsa; identical to SEQ ID NO: 53916

SEQ ID NO: 694175 - RNA, 64 nt, hsa; identical to SEQ ID NO: 53917

SEQ ID NO: 694176 - RNA, 64 nt, hsa; identical to SEQ ID NO: 53918

SEQ ID NO: 694177 - RNA, 64 nt, hsa; identical to SEQ ID NO: 53919

SEQ ID NO: 694178 - RNA, 64 nt, hsa; identical to SEQ ID NO: 53920

SEQ ID NO: 694179 - RNA, 64 nt, hsa; identical to SEQ ID NO: 53921

SEQ ID NO: 694180 - RNA, 64 nt, hsa; identical to SEQ ID NO: 53922

SEQ ID NO: 694181 - RNA, 64 nt, hsa; identical to SEQ ID NO: 53923

SEQ ID NO: 694182 - RNA, 64 nt, hsa; identical to SEQ ID NO: 53965

SEQ ID NO: 694183 - RNA, 64 nt, hsa; identical to SEQ ID NO: 53966

SEQ ID NO: 694184 - RNA, 64 nt, hsa; identical to SEQ ID NO: 53967

SEQ ID NO: 694185 - RNA, 64 nt, hsa; identical to SEQ ID NO: 53968

SEQ ID NO: 694186 - RNA, 64 nt, hsa; identical to SEQ ID NO: 53969

SEQ ID NO: 694187 - RNA, 64 nt, hsa; identical to SEQ ID NO: 53970

SEQ ID NO: 694188 - RNA, 64 nt, hsa; identical to SEQ ID NO: 53971

SEQ ID NO: 694189 - RNA, 64 nt, hsa; identical to SEQ ID NO: 53972

SEQ ID NO: 694190 - RNA, 64 nt, hsa; identical to SEQ ID NO: 53973

SEQ ID NO: 694191 - RNA, 64 nt, hsa; identical to SEQ ID NO: 53974

SEQ ID NO: 694192 - RNA, 64 nt, hsa; identical to SEQ ID NO: 53975

SEQ ID NO: 694193 - RNA, 64 nt, hsa; identical to SEQ ID NO: 53976

SEQ ID NO: 694194 - RNA, 64 nt, hsa; identical to SEQ ID NO: 53977

SEQ ID NO: 694195 - RNA, 64 nt, hsa; identical to SEQ ID NO: 53978

SEQ ID NO: 694196 - RNA, 64 nt, hsa; identical to SEQ ID NO: 53979

SEQ ID NO: 694197 - RNA, 64 nt, hsa; identical to SEQ ID NO: 53980

SEQ ID NO: 694198 - RNA, 64 nt, hsa; identical to SEQ ID NO: 53981

SEQ ID NO: 694199 - RNA, 64 nt, hsa; identical to SEQ ID NO: 53982

SEQ ID NO: 694200 - RNA, 64 nt, hsa; identical to SEQ ID NO: 53983

SEQ ID NO: 694201 - RNA, 64 nt, hsa; identical to SEQ ID NO: 53984

SEQ ID NO: 694202 - RNA, 64 nt, hsa; identical to SEQ ID NO: 53985

SEQ ID NO: 694203 - RNA, 64 nt, hsa; identical to SEQ ID NO: 53986

SEQ ID NO: 694204 - RNA, 64 nt, hsa; identical to SEQ ID NO: 53987

SEQ ID NO: 694205 - RNA, 64 nt, hsa; identical to SEQ ID NO: 53988

SEQ ID NO: 694206 - RNA, 64 nt, hsa; identical to SEQ ID NO: 53989

SEQ ID NO: 694207 - RNA, 64 nt, hsa; identical to SEQ ID NO: 53990

SEQ ID NO: 694208 - RNA, 64 nt, hsa; identical to SEQ ID NO: 53991

SEQ ID NO: 694209 - RNA, 64 nt, hsa; identical to SEQ ID NO: 53992

SEQ ID NO: 694210 - RNA, 64 nt, hsa; identical to SEQ ID NO: 53993

SEQ ID NO: 694211 - RNA, 64 nt, hsa; identical to SEQ ID NO: 53994

SEQ ID NO: 694212 - RNA, 64 nt, hsa; identical to SEQ ID NO: 53995

SEQ ID NO: 694213 - RNA, 64 nt, hsa; identical to SEQ ID NO: 53996

SEQ ID NO: 694214 - RNA, 64 nt, hsa; identical to SEQ ID NO: 53997

SEQ ID NO: 694215 - RNA, 64 nt, hsa; identical to SEQ ID NO: 53998

SEQ ID NO: 694216 - RNA, 64 nt, hsa; identical to SEQ ID NO: 53999

SEQ ID NO: 694217 - RNA, 64 nt, hsa; identical to SEQ ID NO: 54000

SEQ ID NO: 694218 - RNA, 64 nt, hsa; identical to SEQ ID NO: 54001

SEQ ID NO: 694219 - RNA, 64 nt, hsa; identical to SEQ ID NO: 54002

SEQ ID NO: 694220 - RNA, 64 nt, hsa; identical to SEQ ID NO: 54003

SEQ ID NO: 694221 - RNA, 64 nt, hsa; identical to SEQ ID NO: 54004

SEQ ID NO: 694222 - RNA, 64 nt, hsa; identical to SEQ ID NO: 54005

SEQ ID NO: 694223 - RNA, 64 nt, hsa; identical to SEQ ID NO: 54006

SEQ ID NO: 694224 - RNA, 64 nt, hsa; identical to SEQ ID NO: 54007

SEQ ID NO: 694225 - RNA, 64 nt, hsa; identical to SEQ ID NO: 54008

SEQ ID NO: 694226 - RNA, 64 nt, hsa; identical to SEQ ID NO: 54009

SEQ ID NO: 694227 - RNA, 64 nt, hsa; identical to SEQ ID NO: 54010

SEQ ID NO: 694228 - RNA, 64 nt, hsa; identical to SEQ ID NO: 54011

SEQ ID NO: 694229 - RNA, 64 nt, hsa; identical to SEQ ID NO: 54012

SEQ ID NO: 694230 - RNA, 64 nt, hsa; identical to SEQ ID NO: 54013

SEQ ID NO: 694231 - RNA, 64 nt, hsa; identical to SEQ ID NO: 54014

SEQ ID NO: 694232 - RNA, 64 nt, hsa; identical to SEQ ID NO: 54015

SEQ ID NO: 694233 - RNA, 64 nt, hsa; identical to SEQ ID NO: 54016

SEQ ID NO: 694234 - RNA, 64 nt, hsa; identical to SEQ ID NO: 54017

SEQ ID NO: 694235 - RNA, 64 nt, hsa; identical to SEQ ID NO: 54018

SEQ ID NO: 694236 - RNA, 64 nt, hsa; identical to SEQ ID NO: 54019

SEQ ID NO: 694237 - RNA, 64 nt, hsa; identical to SEQ ID NO: 54020

SEQ ID NO: 694238 - RNA, 64 nt, hsa; identical to SEQ ID NO: 54021

SEQ ID NO: 694239 - RNA, 64 nt, hsa; identical to SEQ ID NO: 54022

SEQ ID NO: 694240 - RNA, 64 nt, hsa; identical to SEQ ID NO: 54023

SEQ ID NO: 694241 - RNA, 64 nt, hsa; identical to SEQ ID NO: 54024

SEQ ID NO: 694242 - RNA, 64 nt, hsa; identical to SEQ ID NO: 54025

SEQ ID NO: 694243 - RNA, 64 nt, hsa; identical to SEQ ID NO: 54026

SEQ ID NO: 694244 - RNA, 64 nt, hsa; identical to SEQ ID NO: 54027

SEQ ID NO: 694245 - RNA, 64 nt, hsa; identical to SEQ ID NO: 54028

SEQ ID NO: 694246 - RNA, 64 nt, hsa; identical to SEQ ID NO: 54029

SEQ ID NO: 694247 - RNA, 64 nt, hsa; identical to SEQ ID NO: 54030

SEQ ID NO: 694248 - RNA, 64 nt, hsa; identical to SEQ ID NO: 54031

SEQ ID NO: 694249 - RNA, 64 nt, hsa; identical to SEQ ID NO: 54032

SEQ ID NO: 694250 - RNA, 64 nt, hsa; identical to SEQ ID NO: 54033

SEQ ID NO: 694251 - RNA, 64 nt, hsa; identical to SEQ ID NO: 54034

SEQ ID NO: 694252 - RNA, 64 nt, hsa; identical to SEQ ID NO: 54035

SEQ ID NO: 694253 - RNA, 64 nt, hsa; identical to SEQ ID NO: 54036

SEQ ID NO: 694254 - RNA, 64 nt, hsa; identical to SEQ ID NO: 54037

SEQ ID NO: 694255 - RNA, 64 nt, hsa; identical to SEQ ID NO: 54038

SEQ ID NO: 694256 - RNA, 64 nt, hsa; identical to SEQ ID NO: 54039

SEQ ID NO: 694257 - RNA, 64 nt, hsa; identical to SEQ ID NO: 54040

SEQ ID NO: 694258 - RNA, 64 nt, hsa; identical to SEQ ID NO: 54041

SEQ ID NO: 694259 - RNA, 64 nt, hsa; identical to SEQ ID NO: 54042

SEQ ID NO: 694260 - RNA, 64 nt, hsa; identical to SEQ ID NO: 54043

SEQ ID NO: 694261 - RNA, 64 nt, hsa; identical to SEQ ID NO: 54044

SEQ ID NO: 694262 - RNA, 64 nt, hsa; identical to SEQ ID NO: 54045

SEQ ID NO: 694263 - RNA, 64 nt, hsa; identical to SEQ ID NO: 54046

SEQ ID NO: 694264 - RNA, 64 nt, hsa; identical to SEQ ID NO: 54047

SEQ ID NO: 694265 - RNA, 64 nt, hsa; identical to SEQ ID NO: 54048

SEQ ID NO: 694266 - RNA, 64 nt, hsa; identical to SEQ ID NO: 54049

SEQ ID NO: 694267 - RNA, 64 nt, hsa; identical to SEQ ID NO: 54050

SEQ ID NO: 694268 - RNA, 64 nt, hsa; identical to SEQ ID NO: 54051

SEQ ID NO: 694269 - RNA, 64 nt, hsa; identical to SEQ ID NO: 54052

SEQ ID NO: 694270 - RNA, 64 nt, hsa; identical to SEQ ID NO: 54053

SEQ ID NO: 694271 - RNA, 64 nt, hsa; identical to SEQ ID NO: 54054

SEQ ID NO: 694272 - RNA, 64 nt, hsa; identical to SEQ ID NO: 54055

SEQ ID NO: 694273 - RNA, 64 nt, hsa; identical to SEQ ID NO: 54056

SEQ ID NO: 694274 - RNA, 64 nt, hsa; identical to SEQ ID NO: 54057

SEQ ID NO: 694275 - RNA, 64 nt, hsa; identical to SEQ ID NO: 54058

SEQ ID NO: 694276 - RNA, 64 nt, hsa; identical to SEQ ID NO: 54059

SEQ ID NO: 694277 - RNA, 64 nt, hsa; identical to SEQ ID NO: 54060

SEQ ID NO: 694278 - RNA, 64 nt, hsa; identical to SEQ ID NO: 54061

SEQ ID NO: 694279 - RNA, 64 nt, hsa; identical to SEQ ID NO: 54062

SEQ ID NO: 694280 - RNA, 64 nt, hsa; identical to SEQ ID NO: 54063

SEQ ID NO: 694281 - RNA, 64 nt, hsa; identical to SEQ ID NO: 54064

SEQ ID NO: 694282 - RNA, 64 nt, hsa; identical to SEQ ID NO: 54065

SEQ ID NO: 694283 - RNA, 64 nt, hsa; identical to SEQ ID NO: 54066

SEQ ID NO: 694284 - RNA, 64 nt, hsa; identical to SEQ ID NO: 54067

SEQ ID NO: 694285 - RNA, 64 nt, hsa; identical to SEQ ID NO: 54068

SEQ ID NO: 694286 - RNA, 64 nt, hsa; identical to SEQ ID NO: 54069

SEQ ID NO: 694287 - RNA, 64 nt, hsa; identical to SEQ ID NO: 54070

SEQ ID NO: 694288 - RNA, 64 nt, hsa; identical to SEQ ID NO: 54071

SEQ ID NO: 694289 - RNA, 64 nt, hsa; identical to SEQ ID NO: 54072

SEQ ID NO: 694290 - RNA, 64 nt, hsa; identical to SEQ ID NO: 54073

SEQ ID NO: 694291 - RNA, 64 nt, hsa; identical to SEQ ID NO: 54074

SEQ ID NO: 694292 - RNA, 64 nt, hsa; identical to SEQ ID NO: 54075

SEQ ID NO: 694293 - RNA, 64 nt, hsa; identical to SEQ ID NO: 54076

SEQ ID NO: 694294 - RNA, 64 nt, hsa; identical to SEQ ID NO: 54077

SEQ ID NO: 694295 - RNA, 64 nt, hsa; identical to SEQ ID NO: 54078

SEQ ID NO: 694296 - RNA, 64 nt, hsa; identical to SEQ ID NO: 54079

SEQ ID NO: 694297 - RNA, 64 nt, hsa; identical to SEQ ID NO: 54080

SEQ ID NO: 694298 - RNA, 64 nt, hsa; identical to SEQ ID NO: 54081

SEQ ID NO: 694299 - RNA, 64 nt, hsa; identical to SEQ ID NO: 54082

SEQ ID NO: 694300 - RNA, 64 nt, hsa; identical to SEQ ID NO: 54083

SEQ ID NO: 694301 - RNA, 64 nt, hsa; identical to SEQ ID NO: 54084

SEQ ID NO: 694302 - RNA, 64 nt, hsa; identical to SEQ ID NO: 54085

SEQ ID NO: 694303 - RNA, 64 nt, hsa; identical to SEQ ID NO: 54086

SEQ ID NO: 694304 - RNA, 53 nt, hsa; identical to SEQ ID NO: 54087

SEQ ID NO: 694305 - RNA, 64 nt, hsa; identical to SEQ ID NO: 54088

SEQ ID NO: 694306 - RNA, 64 nt, hsa; identical to SEQ ID NO: 54089

SEQ ID NO: 694307 - RNA, 64 nt, hsa; identical to SEQ ID NO: 54090

SEQ ID NO: 694308 - RNA, 64 nt, hsa; identical to SEQ ID NO: 54091

SEQ ID NO: 694309 - RNA, 64 nt, hsa; identical to SEQ ID NO: 54092

SEQ ID NO: 694310 - RNA, 64 nt, hsa; identical to SEQ ID NO: 54093

SEQ ID NO: 694311 - RNA, 64 nt, hsa; identical to SEQ ID NO: 54094

SEQ ID NO: 694312 - RNA, 64 nt, hsa; identical to SEQ ID NO: 54095

SEQ ID NO: 694313 - RNA, 64 nt, hsa; identical to SEQ ID NO: 54096

SEQ ID NO: 694314 - RNA, 64 nt, hsa; identical to SEQ ID NO: 54097

SEQ ID NO: 694315 - RNA, 64 nt, hsa; identical to SEQ ID NO: 54098

SEQ ID NO: 694316 - RNA, 64 nt, hsa; identical to SEQ ID NO: 54099

SEQ ID NO: 694317 - RNA, 64 nt, hsa; identical to SEQ ID NO: 54100

SEQ ID NO: 694318 - RNA, 64 nt, hsa; identical to SEQ ID NO: 54101

SEQ ID NO: 694319 - RNA, 64 nt, hsa; identical to SEQ ID NO: 54102

SEQ ID NO: 694320 - RNA, 64 nt, hsa; identical to SEQ ID NO: 54103

SEQ ID NO: 694321 - RNA, 64 nt, hsa; identical to SEQ ID NO: 54104

SEQ ID NO: 694322 - RNA, 64 nt, hsa; identical to SEQ ID NO: 54105

SEQ ID NO: 694323 - RNA, 64 nt, hsa; identical to SEQ ID NO: 54106

SEQ ID NO: 694324 - RNA, 64 nt, hsa; identical to SEQ ID NO: 54107

SEQ ID NO: 694325 - RNA, 64 nt, hsa; identical to SEQ ID NO: 54108

SEQ ID NO: 694326 - RNA, 64 nt, hsa; identical to SEQ ID NO: 54109

SEQ ID NO: 694327 - RNA, 64 nt, hsa; identical to SEQ ID NO: 54110

SEQ ID NO: 694328 - RNA, 64 nt, hsa; identical to SEQ ID NO: 54111

SEQ ID NO: 694329 - RNA, 64 nt, hsa; identical to SEQ ID NO: 54112

SEQ ID NO: 694330 - RNA, 64 nt, hsa; identical to SEQ ID NO: 54113

SEQ ID NO: 694331 - RNA, 64 nt, hsa; identical to SEQ ID NO: 54114

SEQ ID NO: 694332 - RNA, 64 nt, hsa; identical to SEQ ID NO: 54115

SEQ ID NO: 694333 - RNA, 64 nt, hsa; identical to SEQ ID NO: 54116

SEQ ID NO: 694334 - RNA, 64 nt, hsa; identical to SEQ ID NO: 54117

SEQ ID NO: 694335 - RNA, 64 nt, hsa; identical to SEQ ID NO: 54118

SEQ ID NO: 694336 - RNA, 64 nt, hsa; identical to SEQ ID NO: 54119

SEQ ID NO: 694337 - RNA, 64 nt, hsa; identical to SEQ ID NO: 54120

SEQ ID NO: 694338 - RNA, 64 nt, hsa; identical to SEQ ID NO: 54121

SEQ ID NO: 694339 - RNA, 64 nt, hsa; identical to SEQ ID NO: 54122

SEQ ID NO: 694340 - RNA, 64 nt, hsa; identical to SEQ ID NO: 54123

SEQ ID NO: 694341 - RNA, 64 nt, hsa; identical to SEQ ID NO: 54124

SEQ ID NO: 694342 - RNA, 64 nt, hsa; identical to SEQ ID NO: 54125

SEQ ID NO: 694343 - RNA, 64 nt, hsa; identical to SEQ ID NO: 54126

SEQ ID NO: 694344 - RNA, 64 nt, hsa; identical to SEQ ID NO: 54127

SEQ ID NO: 694345 - RNA, 64 nt, hsa; identical to SEQ ID NO: 54128

SEQ ID NO: 694346 - RNA, 64 nt, hsa; identical to SEQ ID NO: 54129

SEQ ID NO: 694347 - RNA, 64 nt, hsa; identical to SEQ ID NO: 54130

SEQ ID NO: 694348 - RNA, 64 nt, hsa; identical to SEQ ID NO: 54131

SEQ ID NO: 694349 - RNA, 64 nt, hsa; identical to SEQ ID NO: 54132

SEQ ID NO: 694350 - RNA, 64 nt, hsa; identical to SEQ ID NO: 54133

SEQ ID NO: 694351 - RNA, 64 nt, hsa; identical to SEQ ID NO: 54134

SEQ ID NO: 694352 - RNA, 64 nt, hsa; identical to SEQ ID NO: 54135

SEQ ID NO: 694353 - RNA, 64 nt, hsa; identical to SEQ ID NO: 54136

SEQ ID NO: 694354 - RNA, 64 nt, hsa; identical to SEQ ID NO: 54137

SEQ ID NO: 694355 - RNA, 64 nt, hsa; identical to SEQ ID NO: 54138

SEQ ID NO: 694356 - RNA, 64 nt, hsa; identical to SEQ ID NO: 54139

SEQ ID NO: 694357 - RNA, 64 nt, hsa; identical to SEQ ID NO: 54140

SEQ ID NO: 694358 - RNA, 64 nt, hsa; identical to SEQ ID NO: 54141

SEQ ID NO: 694359 - RNA, 64 nt, hsa; identical to SEQ ID NO: 54142

SEQ ID NO: 694360 - RNA, 64 nt, hsa; identical to SEQ ID NO: 54143

SEQ ID NO: 694361 - RNA, 64 nt, hsa; identical to SEQ ID NO: 54144

SEQ ID NO: 694362 - RNA, 64 nt, hsa; identical to SEQ ID NO: 54145

SEQ ID NO: 694363 - RNA, 64 nt, hsa; identical to SEQ ID NO: 54146

SEQ ID NO: 694364 - RNA, 64 nt, hsa; identical to SEQ ID NO: 54147

SEQ ID NO: 694365 - RNA, 64 nt, hsa; identical to SEQ ID NO: 54148

SEQ ID NO: 694366 - RNA, 52 nt, hsa; identical to SEQ ID NO: 54149

SEQ ID NO: 694367 - RNA, 64 nt, hsa; identical to SEQ ID NO: 54150

SEQ ID NO: 694368 - RNA, 64 nt, hsa; identical to SEQ ID NO: 54151

SEQ ID NO: 694369 - RNA, 64 nt, hsa; identical to SEQ ID NO: 54152

SEQ ID NO: 694370 - RNA, 64 nt, hsa; identical to SEQ ID NO: 54153

SEQ ID NO: 694371 - RNA, 64 nt, hsa; identical to SEQ ID NO: 54154

SEQ ID NO: 694372 - RNA, 64 nt, hsa; identical to SEQ ID NO: 54155

SEQ ID NO: 694373 - RNA, 64 nt, hsa; identical to SEQ ID NO: 54156

SEQ ID NO: 694374 - RNA, 64 nt, hsa; identical to SEQ ID NO: 54157

SEQ ID NO: 694375 - RNA, 64 nt, hsa; identical to SEQ ID NO: 54158

SEQ ID NO: 694376 - RNA, 64 nt, hsa; identical to SEQ ID NO: 54159

SEQ ID NO: 694377 - RNA, 64 nt, hsa; identical to SEQ ID NO: 54160

SEQ ID NO: 694378 - RNA, 64 nt, hsa; identical to SEQ ID NO: 54161

SEQ ID NO: 694379 - RNA, 64 nt, hsa; identical to SEQ ID NO: 54162

SEQ ID NO: 694380 - RNA, 64 nt, hsa; identical to SEQ ID NO: 54163

SEQ ID NO: 694381 - RNA, 64 nt, hsa; identical to SEQ ID NO: 54164

SEQ ID NO: 694382 - RNA, 64 nt, hsa; identical to SEQ ID NO: 54165

SEQ ID NO: 694383 - RNA, 64 nt, hsa; identical to SEQ ID NO: 54166

SEQ ID NO: 694384 - RNA, 64 nt, hsa; identical to SEQ ID NO: 54167

SEQ ID NO: 694385 - RNA, 64 nt, hsa; identical to SEQ ID NO: 54168

SEQ ID NO: 694386 - RNA, 64 nt, hsa; identical to SEQ ID NO: 54169

SEQ ID NO: 694387 - RNA, 64 nt, hsa; identical to SEQ ID NO: 54170

SEQ ID NO: 694388 - RNA, 64 nt, hsa; identical to SEQ ID NO: 54171

SEQ ID NO: 694389 - RNA, 64 nt, hsa; identical to SEQ ID NO: 54172

SEQ ID NO: 694390 - RNA, 64 nt, hsa; identical to SEQ ID NO: 54173

SEQ ID NO: 694391 - RNA, 64 nt, hsa; identical to SEQ ID NO: 54174

SEQ ID NO: 694392 - RNA, 64 nt, hsa; identical to SEQ ID NO: 54175

SEQ ID NO: 694393 - RNA, 64 nt, hsa; identical to SEQ ID NO: 54176

SEQ ID NO: 694394 - RNA, 64 nt, hsa; identical to SEQ ID NO: 54177

SEQ ID NO: 694395 - RNA, 64 nt, hsa; identical to SEQ ID NO: 54178

SEQ ID NO: 694396 - RNA, 64 nt, hsa; identical to SEQ ID NO: 54179

SEQ ID NO: 694397 - RNA, 64 nt, hsa; identical to SEQ ID NO: 54180

SEQ ID NO: 694398 - RNA, 64 nt, hsa; identical to SEQ ID NO: 54181

SEQ ID NO: 694399 - RNA, 64 nt, hsa; identical to SEQ ID NO: 54182

SEQ ID NO: 694400 - RNA, 64 nt, hsa; identical to SEQ ID NO: 54183

SEQ ID NO: 694401 - RNA, 64 nt, hsa; identical to SEQ ID NO: 54184

SEQ ID NO: 694402 - RNA, 64 nt, hsa; identical to SEQ ID NO: 54185

SEQ ID NO: 694403 - RNA, 64 nt, hsa; identical to SEQ ID NO: 54186

SEQ ID NO: 694404 - RNA, 64 nt, hsa; identical to SEQ ID NO: 54187

SEQ ID NO: 694405 - RNA, 64 nt, hsa; identical to SEQ ID NO: 54188

SEQ ID NO: 694406 - RNA, 64 nt, hsa; identical to SEQ ID NO: 54189

SEQ ID NO: 694407 - RNA, 64 nt, hsa; identical to SEQ ID NO: 54190

SEQ ID NO: 694408 - RNA, 64 nt, hsa; identical to SEQ ID NO: 54191

SEQ ID NO: 694409 - RNA, 64 nt, hsa; identical to SEQ ID NO: 54192

SEQ ID NO: 694410 - RNA, 64 nt, hsa; identical to SEQ ID NO: 54193

SEQ ID NO: 694411 - RNA, 64 nt, hsa; identical to SEQ ID NO: 54194

SEQ ID NO: 694412 - RNA, 64 nt, hsa; identical to SEQ ID NO: 54195

SEQ ID NO: 694413 - RNA, 64 nt, hsa; identical to SEQ ID NO: 54196

SEQ ID NO: 694414 - RNA, 64 nt, hsa; identical to SEQ ID NO: 54197

SEQ ID NO: 694415 - RNA, 64 nt, hsa; identical to SEQ ID NO: 54198

SEQ ID NO: 694416 - RNA, 64 nt, hsa; identical to SEQ ID NO: 54199

SEQ ID NO: 694417 - RNA, 64 nt, hsa; identical to SEQ ID NO: 54200

SEQ ID NO: 694418 - RNA, 64 nt, hsa; identical to SEQ ID NO: 54201

SEQ ID NO: 694419 - RNA, 64 nt, hsa; identical to SEQ ID NO: 54202

SEQ ID NO: 694420 - RNA, 64 nt, hsa; identical to SEQ ID NO: 54203

SEQ ID NO: 694421 - RNA, 64 nt, hsa; identical to SEQ ID NO: 54204

SEQ ID NO: 694422 - RNA, 64 nt, hsa; identical to SEQ ID NO: 54205

SEQ ID NO: 694423 - RNA, 64 nt, hsa; identical to SEQ ID NO: 54206

SEQ ID NO: 694424 - RNA, 64 nt, hsa; identical to SEQ ID NO: 54207

SEQ ID NO: 694425 - RNA, 64 nt, hsa; identical to SEQ ID NO: 54208

SEQ ID NO: 694426 - RNA, 64 nt, hsa; identical to SEQ ID NO: 54209

SEQ ID NO: 694427 - RNA, 64 nt, hsa; identical to SEQ ID NO: 54210

SEQ ID NO: 694428 - RNA, 64 nt, hsa; identical to SEQ ID NO: 54211

SEQ ID NO: 694429 - RNA, 64 nt, hsa; identical to SEQ ID NO: 54212

SEQ ID NO: 694430 - RNA, 64 nt, hsa; identical to SEQ ID NO: 54213

SEQ ID NO: 694431 - RNA, 64 nt, hsa; identical to SEQ ID NO: 54214

SEQ ID NO: 694432 - RNA, 64 nt, hsa; identical to SEQ ID NO: 54215

SEQ ID NO: 694433 - RNA, 64 nt, hsa; identical to SEQ ID NO: 54216

SEQ ID NO: 694434 - RNA, 64 nt, hsa; identical to SEQ ID NO: 54217

SEQ ID NO: 694435 - RNA, 64 nt, hsa; identical to SEQ ID NO: 54218

SEQ ID NO: 694436 - RNA, 64 nt, hsa; identical to SEQ ID NO: 54219

SEQ ID NO: 694437 - RNA, 64 nt, hsa; identical to SEQ ID NO: 54220

SEQ ID NO: 694438 - RNA, 64 nt, hsa; identical to SEQ ID NO: 54221

SEQ ID NO: 694439 - RNA, 64 nt, hsa; identical to SEQ ID NO: 54222

SEQ ID NO: 694440 - RNA, 64 nt, hsa; identical to SEQ ID NO: 54223

SEQ ID NO: 694441 - RNA, 64 nt, hsa; identical to SEQ ID NO: 54224

SEQ ID NO: 694442 - RNA, 64 nt, hsa; identical to SEQ ID NO: 54225

SEQ ID NO: 694443 - RNA, 64 nt, hsa; identical to SEQ ID NO: 54226

SEQ ID NO: 694444 - RNA, 64 nt, hsa; identical to SEQ ID NO: 54227

SEQ ID NO: 694445 - RNA, 64 nt, hsa; identical to SEQ ID NO: 54228

SEQ ID NO: 694446 - RNA, 64 nt, hsa; identical to SEQ ID NO: 54229

SEQ ID NO: 694447 - RNA, 64 nt, hsa; identical to SEQ ID NO: 54230

SEQ ID NO: 694448 - RNA, 64 nt, hsa; identical to SEQ ID NO: 54231

SEQ ID NO: 694449 - RNA, 64 nt, hsa; identical to SEQ ID NO: 54232

SEQ ID NO: 694450 - RNA, 64 nt, hsa; identical to SEQ ID NO: 54233

SEQ ID NO: 694451 - RNA, 64 nt, hsa; identical to SEQ ID NO: 54234

SEQ ID NO: 694452 - RNA, 64 nt, hsa; identical to SEQ ID NO: 54235

SEQ ID NO: 694453 - RNA, 64 nt, hsa; identical to SEQ ID NO: 54236

SEQ ID NO: 694454 - RNA, 61 nt, hsa
ugccucccaccgcuuuauuucuuucgguuucggaugcaaaacaaaaaauuuuaaaagaaaa

SEQ ID NO: 694455 - RNA, 61 nt, hsa
agauauuaaguaugcaauuacuuguauuauaggaugcaaggucaucauauguaaaugccuu

SEQ ID NO: 694456 - RNA, 61 nt, hsa
uaccacaugguggagggauggaggaacuacaggaugcaauucuucuucuaccaaugggcaa

SEQ ID NO: 694457 - RNA, 61 nt, hsa
gaguguaggacacugagccauccgugggucaggaugcaauuauuuauaaaagucuccaggu

SEQ ID NO: 694458 - RNA, 61 nt, hsa
gauauuacuucgcuauuaaauaaagaaaauuggaugcaagacaauggagaaacuuuaaaac

SEQ ID NO: 694459 - RNA, 61 nt, hsa
aauuuucuuuuuaauuacuuuagagagcuagggaugcaaauguuuucaguuagaaagccuu

SEQ ID NO: 694460 - RNA, 61 nt, hsa
acguggaagucaguuuaauugccagagagaaggaugcaaucacuagguaaaaugagguuuu

SEQ ID NO: 694461 - RNA, 61 nt, hsa
aauuuuaaagucaguguacugcaaggaagcuggaugcaagauagauacuauauuaaacugu

SEQ ID NO: 694462 - RNA, 61 nt, hsa
gguuggggcuggguggucuggauuauggccuggaugcaauaaaguacugugacaguagcca

SEQ ID NO: 694463 - RNA, 61 nt, hsa
ugaagcucagagggagaugggcaauugacagggaugcaauccagggugggauuucuugagg

SEQ ID NO: 694464 - RNA, 61 nt, hsa
uuagaagaguuuaaaaucucccaggccuuuaggaugcaauaggauauuaugccuugguuug

SEQ ID NO: 694465 - RNA, 61 nt, hsa
uggaguaaagugugggauuguuguuuugcugggaugcaaauaacuaaaugcuuuggugguu

SEQ ID NO: 694466 - RNA, 61 nt, hsa
gugauccuacuauaugacggaaacuuuggcuggaugcaagagcuuuaaauugguagaaaag

SEQ ID NO: 694467 - RNA, 61 nt, hsa
auagcuaauuuuagcuaucuguaaccaagauggaugcaaagaggcuagugccucagagaga

SEQ ID NO: 694468 - RNA, 61 nt, hsa
caauaguugaagggaaggugcauauuaucacggaugcaauuuauguugugugccagucugg

SEQ ID NO: 694469 - RNA, 61 nt, hsa
agcagcacacccugcaggcggaguuuucagaggaugcaauuuuggaucccgaauuuugaug

SEQ ID NO: 694470 - RNA, 61 nt, hsa
aaaucacuguaauacuucauuguguuguacuggaugcaaagcuagaaaauauugcaauaaa

SEQ ID NO: 694471 - RNA, 61 nt, hsa
cucucuaagauuuaguaagugaaaaaaaguaggaugcaagaguuuuuauaguugauuccau

SEQ ID NO: 694472 - RNA, 61 nt, hsa
uuacuggccacaagcccuguauucucaacagggaugcaaauugguucuucaguaaggauaa

SEQ ID NO: 694473 - RNA, 61 nt, hsa
uccuuugauuucccacugaagauaccccaaaggaugcaagugccuacaguauuaucaggag

SEQ ID NO: 694474 - RNA, 61 nt, hsa
ucuauaaccaggcccuggcaaagugcaaacaggaugcaacugcaguggcacaaaggucacu

SEQ ID NO: 694475 - RNA, 61 nt, hsa
gggaggccugccugcuagaauccuaaugugaggaugcaaaagaaaugaugauaacauuuug

SEQ ID NO: 694476 - RNA, 61 nt, hsa
ggcaauaagauacccgcuacaaacugugauuggaugcaaaaucucuuagcuucuuucacga

SEQ ID NO: 694477 - RNA, 61 nt, hsa
aaauaagaaaccaagggauaaaacuguucauggaugcaacucaaauucagaugauccucaa

SEQ ID NO: 694478 - RNA, 61 nt, hsa
uagaugaguucucuaugugaccaauuuuacuggaugcaauugacaggacccgucaucauaa

SEQ ID NO: 694479 - RNA, 61 nt, hsa
ugcauauucgcuccuaagggaggcucugaggggaugcaacaaaaugauccuuaugaugucc

SEQ ID NO: 694480 - RNA, 61 nt, hsa
uuugaaccuguugugguaaagaucuuguacaggaugcaaacuaaaaaccuaaucccugcca

SEQ ID NO: 694481 - RNA, 61 nt, hsa
agagugagcuacagagccgagcaauauuuauggaugcaacacgcauggucaacccucaggg

SEQ ID NO: 694482 - RNA, 61 nt, hsa
aacaugccuccugcccugcuaaagacagugcggaugcaagagcaccuggccaagcgagagc

SEQ ID NO: 694483 - RNA, 61 nt, hsa
cucuucauauuuauaugggggggagggcgcuggaugcaaaaguugaagaucgugaugcuau

SEQ ID NO: 694484 - RNA, 61 nt, hsa
guauuuacccagaggauuuuccuaugguuggggaugcaaauauuagaaaacagauuguauu

SEQ ID NO: 694485 - RNA, 61 nt, hsa
acugauguuuguguuacucaaaaaaacuacuggaugcaaacuguuauguaaaucugagauu

SEQ ID NO: 694486 - RNA, 61 nt, hsa
ggagaugaaugaucaaagugaaacaauguuuggaugcaacgcagaauaaaagaauauaaga

SEQ ID NO: 694487 - RNA, 61 nt, hsa
aguucuuaaguuucgguuuuuuuuaaaaacaggaugcaacuuaaacuuuucuuugcaucaa

SEQ ID NO: 694488 - RNA, 61 nt, hsa
uuggagcccuuuugcagucagcagcaucuauggaugcaaauccagccacagcagacaauca

SEQ ID NO: 694489 - RNA, 61 nt, hsa
cccccgacucccuccccagaucuguccugggggaugcaaauaaagccugcucucccaaggu

SEQ ID NO: 694490 - RNA, 61 nt, hsa
ggaucauuuuuauguagcaugauuuuccuugggaugcaaaucuuaaaacaguccuuuaaua

SEQ ID NO: 694491 - RNA, 61 nt, hsa
ucauuuuuuuaacacauaacuagaaaccugaggaugcaacaaauauuuauauauuugaaua

SEQ ID NO: 694492 - RNA, 61 nt, hsa
uuggaaauacuguguuuaaagcuuuuucucuggaugcaaaaaaagauaagaauaucaggaa

SEQ ID NO: 694493 - RNA, 61 nt, hsa
gccaagguguauguguuuaagggggugugauggaugcaaagggaaugaggaauucagcacu

SEQ ID NO: 694494 - RNA, 61 nt, hsa
aaugaaguauuuuguguagaagguuaaauuaggaugcaaaacagaucugccauuccuuuuu

SEQ ID NO: 694495 - RNA, 61 nt, hsa
guguaacaguacucucaugcaauuuuuuucaggaugcaaaggcaauuauucuuuguaagcg

SEQ ID NO: 694496 - RNA, 61 nt, hsa
ucaaagcauaagguccauggugguggaaaauggaugcaagugauucuaaguuuguggauuu

SEQ ID NO: 694497 - RNA, 61 nt, hsa
ugaauaucaguuuuagaauaguuucucugguggaugcaaugauguuucugaaacugcuaug

SEQ ID NO: 694498 - RNA, 61 nt, hsa
gccaaauaucaagaugugaaggacuaauucaggaugcaaaaacguuauugggggguuguaa

SEQ ID NO: 694499 - RNA, 61 nt, hsa
ggguuguaaauaucaacuauucaacaguuuaggaugcaauuacgaguguaaacugugugcc

SEQ ID NO: 694500 - RNA, 61 nt, hsa
augcuuuaccauauaucaggaauuauauccaggaugcaauacucagacacuagcuuuuuuc

SEQ ID NO: 694501 - RNA, 61 nt, hsa
cuaucaguagcaguauuguuacuucuuuccaggaugcaaggucuauuaucccaacagaaga

SEQ ID NO: 694502 - RNA, 61 nt, hsa
cuuuaacguaugaggaagguuguccugcuacggaugcaauucaauucuuccuuuuuuauua

SEQ ID NO: 694503 - RNA, 61 nt, hsa
auuuaguguaucuuuuaauguuguaugucugggaugcaaguauugcuaaauauguuagccc

SEQ ID NO: 694504 - RNA, 61 nt, hsa
ucacagcagacacgcuagacagcauaguccuggaugcaaccuggaggaagggaggcccaug

SEQ ID NO: 694505 - RNA, 61 nt, hsa
accccgucccccuccagacuggcaguuucaaggaugcaaauugcauugcaaaaucaaacug

SEQ ID NO: 694506 - RNA, 61 nt, hsa
guuucuaguuucuuaaauagcccacaccccuggaugcaaaaaggcaggguuauuuuuaccc

SEQ ID NO: 694507 - RNA, 61 nt, hsa
guggaaggaaaaugugaaugaaaguagugcuggaugcaauuacuccugaaccccaccuagg

SEQ ID NO: 694508 - RNA, 61 nt, hsa
caccaggcagugugcuuccuuccuugcaugaggaugcaagaugcaacaguuugucuuucac

SEQ ID NO: 694509 - RNA, 61 nt, hsa
ugugacuuuauuagcagcugacuuucaaaguggaugcaauuuuucuuucuuuuguugggga

SEQ ID NO: 694510 - RNA, 61 nt, hsa
aaagaggcacagagccaaauugguagaggaaggaugcaaaguauaaauuuguguaauauua

SEQ ID NO: 694511 - RNA, 61 nt, hsa
cacaagaaaaucauguccuuuucagcaacauggaugcaacuagaggcuauuauccuaagca

SEQ ID NO: 694512 - RNA, 61 nt, hsa
uacuugcaugggguaacccaguaauacugugggaugcaacuucuagggcauggcugccucc

SEQ ID NO: 694513 - RNA, 61 nt, hsa
gagccaauaucccuuacuuuaacccuuucugggaugcaauacuaggaaguaaagugaagaa

SEQ ID NO: 694514 - RNA, 61 nt, hsa
cucacccauggcccacccaggccuggagcugggaugcaauguaggcugagggaaagacguc

SEQ ID NO: 694515 - RNA, 61 nt, hsa
cuucgacugugacauacaaguccauuaucugggaugcaaccacucaacaacuauccuauuc

SEQ ID NO: 694516 - RNA, 61 nt, hsa
gucagccucagcaacaaacauuuccuaaaugggaugcaaaaagaaacugaaugauguugaa

SEQ ID NO: 694517 - RNA, 61 nt, hsa
cuacucagcccucuccugcggccacaucaacggaugcaagucacagucuuaacacagccug

SEQ ID NO: 694518 - RNA, 61 nt, hsa
cgcggggagugaggaggggucagggggcuaaggaugcaaccucugacguucugcgccuucc

SEQ ID NO: 694519 - RNA, 61 nt, hsa
ugcccuggcuacagaacauggaagccccuagggaugcaaguggacuugggcagaggagguc

SEQ ID NO: 694520 - RNA, 61 nt, hsa
aauggccgugcaagcuuaggcuggggauucuggaugcaacgucuuuacaaccuuaccuaga

SEQ ID NO: 694521 - RNA, 61 nt, hsa
uagccauauacccaggcucugcaguaucgaaggaugcaaauguugacauagauggaagcuc

SEQ ID NO: 694522 - RNA, 61 nt, hsa
ucuugauugcuagaguuuuuguuaguacuuuggaugcaauuaaaacuaugugcuaucacau

SEQ ID NO: 694523 - RNA, 61 nt, hsa
uccuaaauucauagaguggauauuaggauuaggaugcaaaaauaaaugcuuaaccaacacu

SEQ ID NO: 694524 - RNA, 61 nt, hsa
cagcuaacauggguuagguuuaaaccaugggggaugcaaccccuuugcguuucauauguag

SEQ ID NO: 694525 - RNA, 61 nt, hsa
ucuccuugaugucugugaucaaaccaugacaggaugcaaccacaacacacggcuaugauca

SEQ ID NO: 694526 - RNA, 61 nt, hsa
ccagaaugaccugaugaggaaaucuucaauaggaugcaaagaucaaugcaaaaauuguuau

SEQ ID NO: 694527 - RNA, 61 nt, hsa
ucugaguguaaacuacaugguagguugugaaggaugcaaauaucgaaucaaucauuuuuua

SEQ ID NO: 694528 - RNA, 61 nt, hsa
uagcuguuccucauggccaugacuggaacagggaugcaaccucuuucuacacaagcacagu

SEQ ID NO: 694529 - RNA, 61 nt, hsa
auuucugagugaagugcacgucuugggaaagggaugcaaucccugaaaccaggugcuuccu

SEQ ID NO: 694530 - RNA, 61 nt, hsa
cggggccucaggcuucucagcugggaagagaggaugcaagaccagacugaagaacacgguu

SEQ ID NO: 694531 - RNA, 61 nt, hsa
auuuuaauggcuauauuauauuccauuuaauggaugcaacucaguuuauuuaaccauuccc

SEQ ID NO: 694532 - RNA, 61 nt, hsa
gucagguccacaccuauguccagggcaccagggaugcaauuccauguggaugucaccaaac

SEQ ID NO: 694533 - RNA, 61 nt, hsa
gucagggccuugggcaagacauugggcucuaggaugcaauuggcaaauacguccccguuac

SEQ ID NO: 694534 - RNA, 61 nt, hsa
uuuuguacaaaucuguauuguauuaauuucuggaugcaauuuuucaaauauuaaaauuaua

SEQ ID NO: 694535 - RNA, 61 nt, hsa
agcacaacaggaaagccugggaggguuguugggaugcaaggaggugaugaaaaggagacag

SEQ ID NO: 694536 - RNA, 61 nt, hsa
cccagaagccuccggcggcccaggauucuaaggaugcaauccucgaggaaaauuagucgau

SEQ ID NO: 694537 - RNA, 61 nt, hsa
cacccaaaugaagugugaacgugauguuuucggaugcaaacucagcucagggauucauuuu

SEQ ID NO: 694538 - RNA, 61 nt, hsa
cagagagccagcagccuugggauacuaaugaggaugcaacuggcuuauugguaugaaauag

SEQ ID NO: 694539 - RNA, 61 nt, hsa
uuuuuguauuucagagaaaauucagguaccaggaugcaauggauuuauuugauucagggga

SEQ ID NO: 694540 - RNA, 61 nt, hsa
uuuucuucuggucacaaaauaaagaaauuugggaugcaaaguaccuaaagaucucugaucc

SEQ ID NO: 694541 - RNA, 61 nt, hsa
agaugcagagaaagcuaaaugugggaaucauggaugcaaagaagaauuuggcuuuuugaaa

SEQ ID NO: 694542 - RNA, 61 nt, hsa
gugggaggaucuauugagcccuggaauucgaggaugcaauuaauugugguugugucacagu

SEQ ID NO: 694543 - RNA, 61 nt, hsa
guggugcuucugccauuagacgcaguuaggaggaugcaacugcaaaucuaaaauuacgaag

SEQ ID NO: 694544 - RNA, 61 nt, hsa
ucuggaaccugaggcggcugcuugaaccuuuggaugcaaaugucgaugcuuaagaaaaccg

SEQ ID NO: 694545 - RNA, 61 nt, hsa
agagacauaugggccauaccccuuaaccccgggaugcaagguagcauggguccaagagaca

SEQ ID NO: 694546 - RNA, 61 nt, hsa
aagagaugaaauaaauuaagcaguagauccaggaugcaaaauccucccaauuccugugcau

SEQ ID NO: 694547 - RNA, 61 nt, hsa
uuucaugaucaucauuaacaguuuguccuuaggaugcaaaugaaaaugugaauacauaccu

SEQ ID NO: 694548 - RNA, 61 nt, hsa
guaacacacccucccugcuccaagugcaccaggaugcaaaugcacagaauucaccaggggc

SEQ ID NO: 694549 - RNA, 61 nt, hsa
cgggcuggguguucacgugugucugugucauggaugcaaugcaggcccuggaggacugugc

SEQ ID NO: 694550 - RNA, 61 nt, hsa
gccugggguugacuggguuagagaagaaccgggaugcaaggagcugccugugacaccuggc

SEQ ID NO: 694551 - RNA, 61 nt, hsa
gggucaggaguugaauuuggggugggaggauggaugcaacugaagcagagugugggugccc

SEQ ID NO: 694552 - RNA, 61 nt, hsa
ugcugagcauucauuuugcguccucuggguuggaugcaaugugagaggauggcaugccaga

SEQ ID NO: 694553 - RNA, 61 nt, hsa
ugaauuguaaaugaacuuaaaaauagaauguggaugcaaaauaucacauaagacaucauga

SEQ ID NO: 694554 - RNA, 61 nt, hsa
aacgcccugagagucccggauguccgaggcgggaugcaaaccaucccguccugagcacggg

SEQ ID NO: 694555 - RNA, 61 nt, hsa
gccaaaccagcagaacauucuucucuucaaaggaugcaauaguagaaagcuacuuauuuua

SEQ ID NO: 694556 - RNA, 61 nt, hsa
acauguuucaagacgcuguguuagacacuagggaugcaaagaugaaugagauaaggccuca

SEQ ID NO: 694557 - RNA, 61 nt, hsa
uaucgaccaucacccucccccgcgugaacugggaugcaaguugcuaaccgaugugaacgca

SEQ ID NO: 694558 - RNA, 61 nt, hsa
aauguuauaauuuauauagugugguugaacaggaugcaaucuuuuguugucuaaaggugcu

SEQ ID NO: 694559 - RNA, 61 nt, hsa
cuccaagcccacuugaaaagucacacugaaaggaugcaaauagccgucugcgauuuuggcg

SEQ ID NO: 694560 - RNA, 56 nt, hsa
ucgauauugaugccauuuaaagggauggaugcaaccuagcuuaacaguauaaugcu

SEQ ID NO: 694561 - RNA, 61 nt, hsa
uucaugguguuuucagggaacacagaaaugcggaugcaaaacaacuuuugacagaggccca

SEQ ID NO: 694562 - RNA, 61 nt, hsa
agagacacggucuggacagcccaaggcgccaggaugcaaccugcuuucaccagacugcaga

SEQ ID NO: 694563 - RNA, 61 nt, hsa
ccuguauccggagcugugcugggcacugaggggaugcaacaaaauuaggagaggauccuug

SEQ ID NO: 694564 - RNA, 61 nt, hsa
ggcccagaggagcuggugcugaccuagcuagggaugcaagagugagcaagcagcaccccca

SEQ ID NO: 694565 - RNA, 61 nt, hsa
guggaugguccagagccuccacccacagaggggaugcaaagggcaggugagucaagaaccg

SEQ ID NO: 694566 - RNA, 61 nt, hsa
cugucuccaaggcccaggacacuugucagaaggaugcaaaaaaagaaaaaaguacauccac

SEQ ID NO: 694567 - RNA, 54 nt, hsa
gcccggaaguccacggcugagccaggaugcaaggcuccugguccuguuugcagc

SEQ ID NO: 694568 - RNA, 61 nt, hsa
ggguuucuucuugaagcagcuccugcaaaagggaugcaaagaggucccagggaccugcccc

SEQ ID NO: 694569 - RNA, 61 nt, hsa
cuaacgaagcaugcgugucucuucaucuacaggaugcaauaggcugauuguauuuaaaaau

SEQ ID NO: 694570 - RNA, 61 nt, hsa
ggagcucccagucgcauggagcgguguucauggaugcaacagacccuggcuucuggagucc

SEQ ID NO: 694571 - RNA, 61 nt, hsa
guuuuauaaaauaaauuugccacauaauaugggaugcaauaaccaacaaagcugcuaagug

SEQ ID NO: 694572 - RNA, 61 nt, hsa
uuaggcaguaucauuuccauuuuauaaguagggaugcaaaauccgugucacuaaacuagug

SEQ ID NO: 694573 - RNA, 61 nt, hsa
ucucacaccguaucuagggacagaggcaucuggaugcaaacgcgggguuuguuaggggcgg

SEQ ID NO: 694574 - RNA, 61 nt, hsa
gugugauggagagucucugccgugccaucugggaugcaaaccgucccuguguuccccacgu

SEQ ID NO: 694575 - RNA, 61 nt, hsa
aggggcccguuucugguugaaaucaagguuaggaugcaacugagaaaauaaaagacugcac

SEQ ID NO: 694576 - RNA, 61 nt, hsa
uuucaggucgugauaaugagcuccuaugaaaggaugcaauauaaugacccgcuuuucuaga

SEQ ID NO: 694577 - RNA, 61 nt, hsa
uggagaccagggacaggagagccagcaggguggaugcaaggggccucuacccacaccugga

SEQ ID NO: 694578 - RNA, 61 nt, hsa
ggagaggagcuggguugaagcggacugcugcggaugcaacucccagcuugcccaccgcggg

SEQ ID NO: 694579 - RNA, 61 nt, hsa
guccugacuuugggcgcuggguauuggaaauggaugcaaaguacaauguguuuuucuccag

SEQ ID NO: 694580 - RNA, 61 nt, hsa
acuauuuuucaguugagaaagaaauuuuugaggaugcaaagcuuuucugugaagacaaguc

SEQ ID NO: 694581 - RNA, 61 nt, hsa
ugggauggcaccuauauuggcugauaauugaggaugcaaacauuccauucauuagugugau

SEQ ID NO: 694582 - RNA, 61 nt, hsa
auccaccaugaucaagugggcuucaucccugggaugcaaggcugguucaacauacgcaaau

SEQ ID NO: 694583 - RNA, 61 nt, hsa
acuacaaaccacugcuuaacgaaauaaaagaggaugcaaagaaauggaagagcauuccaug

SEQ ID NO: 694584 - RNA, 61 nt, hsa
gaaugagaagugagaagguuuuuauacucugggaugcaaccgacauguucaaauguuugaa

SEQ ID NO: 694585 - RNA, 61 nt, hsa
cuguguuagggaaaauauggaacuucucccuggaugcaaaaccuaugaguauauuaauauu

SEQ ID NO: 694586 - RNA, 61 nt, hsa
cuguugcaggaagccccuccuguuagcagcgggaugcaagaugcugucucggggcucuccu

SEQ ID NO: 694587 - RNA, 61 nt, hsa
aggaguuguugaacccacugcuaggaagcaaggaugcaacaagaugaugcugagcgugaac

SEQ ID NO: 694588 - RNA, 61 nt, hsa
aggguucagagaaccaggguucaaagcccagggaugcaaagguugcagugaguugagucau

SEQ ID NO: 694589 - RNA, 61 nt, hsa
aaaucuauagaaauacaaaaugaaauaaaaaggaugcaaaucagucacagagcuggaaaca

SEQ ID NO: 694590 - RNA, 61 nt, hsa
gugacacccccagaccucuggaggagacaauggaugcaaacagcccacacaggaaagacaa

SEQ ID NO: 694591 - RNA, 61 nt, hsa
caguauuuauuauaaauuacuaccgugacugggaugcaagagaauuaggacuauaauuuuc

SEQ ID NO: 694592 - RNA, 61 nt, hsa
ggccucacugcugcgcaagggguggggccgaggaugcaaguccaggcagagcggcgcaggc

SEQ ID NO: 694593 - RNA, 61 nt, hsa
gucugguuuaaggcacagguaaacugaguguggaugcaaaaguaccaggagcuagcuuuua

SEQ ID NO: 694594 - RNA, 61 nt, hsa
cuuuaagcacugaugauuuucuuauauaugaggaugcaaagcauucaagaguuucagccug

SEQ ID NO: 694595 - RNA, 61 nt, hsa
uggaauuuugguugggguggggggagaggagggaugcaacucgcccuguuuggcaucuaau

SEQ ID NO: 694596 - RNA, 61 nt, hsa
aauaugccagaacuacagacaacagcccacaggaugcaaaagugcuuugccaucuuaaaaa

SEQ ID NO: 694597 - RNA, 61 nt, hsa
guccugauggagcaagaggcccacgccuaggggaugcaagaacaacccguuucuuaaaugu

SEQ ID NO: 694598 - RNA, 61 nt, hsa
ucccucccauccuacucucacagaagggccuggaugcaagguuacccuugagcugugugcc

SEQ ID NO: 694599 - RNA, 61 nt, hsa
auucuaaaucuguuccauuaucuucucuguaggaugcaaaacauccaguuguaauguauaa

SEQ ID NO: 694600 - RNA, 61 nt, hsa
gauuaggauuuuaacauaugaauuuugggggggaugcaaucauucagcccauaauacccuc

SEQ ID NO: 694601 - RNA, 61 nt, hsa
uaugaguguauguguuuauguaacuuccuguggaugcaaauagauucagagaaauuuagag

SEQ ID NO: 694602 - RNA, 61 nt, hsa
agacuggcaagaaaagaguuaaggcaaaaaaggaugcaacaauucucccgggacucugcau

SEQ ID NO: 694603 - RNA, 61 nt, hsa
gaggauguggccugguucaaaguaaagcagaggaugcaacaaauguggccaagccuaucaa

SEQ ID NO: 694604 - RNA, 61 nt, hsa
uugauaaccauccuuuggggcagcauuccagggaugcaaaaugugcuaguccaugaccuuu

SEQ ID NO: 694605 - RNA, 61 nt, hsa
gugaucauuugcacuuguuaccucuuaauauggaugcaacuuauuaaaaauguuggccugg

SEQ ID NO: 694606 - RNA, 61 nt, hsa
uaauucugaccaauaaaaaaauaagucaggaggaugcaauuguugaaagcuuugaaauaaa

SEQ ID NO: 694607 - RNA, 64 nt, hsa
cccugccucccaccgcuuuauuucuuucgguuucggaugcaaaacaaaaaauuuuaaaagaaaa

SEQ ID NO: 694608 - RNA, 64 nt, hsa
uacagauauuaaguaugcaauuacuuguauuauaggaugcaaggucaucauauguaaaugccuu

SEQ ID NO: 694609 - RNA, 64 nt, hsa
ucuuaccacaugguggagggauggaggaacuacaggaugcaauucuucuucuaccaaugggcaa

SEQ ID NO: 694610 - RNA, 64 nt, hsa
uaugaguguaggacacugagccauccgugggucaggaugcaauuauuuauaaaagucuccaggu

SEQ ID NO: 694611 - RNA, 64 nt, hsa
ugugauauuacuucgcuauuaaauaaagaaaauuggaugcaagacaauggagaaacuuuaaaac

SEQ ID NO: 694612 - RNA, 64 nt, hsa
uguaauuuucuuuuuaauuacuuuagagagcuagggaugcaaauguuuucaguuagaaagccuu

SEQ ID NO: 694613 - RNA, 64 nt, hsa
gacacguggaagucaguuuaauugccagagagaaggaugcaaucacuagguaaaaugagguuuu

SEQ ID NO: 694614 - RNA, 64 nt, hsa
uuuaauuuuaaagucaguguacugcaaggaagcuggaugcaagauagauacuauauuaaacugu

SEQ ID NO: 694615 - RNA, 64 nt, hsa
ugggguuggggcuggguggucuggauuauggccuggaugcaauaaaguacugugacaguagcca

SEQ ID NO: 694616 - RNA, 64 nt, hsa
guuugaagcucagagggagaugggcaauugacagggaugcaauccagggugggauuucuugagg

SEQ ID NO: 694617 - RNA, 64 nt, hsa
accuuagaagaguuuaaaaucucccaggccuuuaggaugcaauaggauauuaugccuugguuug

SEQ ID NO: 694618 - RNA, 64 nt, hsa
ugauggaguaaagugugggauuguuguuuugcugggaugcaaauaacuaaaugcuuuggugguu

SEQ ID NO: 694619 - RNA, 64 nt, hsa
agagugauccuacuauaugacggaaacuuuggcuggaugcaagagcuuuaaauugguagaaaag

SEQ ID NO: 694620 - RNA, 64 nt, hsa
uuuauagcuaauuuuagcuaucuguaaccaagauggaugcaaagaggcuagugccucagagaga

SEQ ID NO: 694621 - RNA, 64 nt, hsa
aagcaauaguugaagggaaggugcauauuaucacggaugcaauuuauguugugugccagucugg

SEQ ID NO: 694622 - RNA, 64 nt, hsa; identical to SEQ ID NO: 461318

SEQ ID NO: 694623 - RNA, 64 nt, hsa; identical to SEQ ID NO: 461319

SEQ ID NO: 694624 - RNA, 64 nt, hsa
aaacucucuaagauuuaguaagugaaaaaaaguaggaugcaagaguuuuuauaguugauuccau

SEQ ID NO: 694625 - RNA, 64 nt, hsa
uuauuacuggccacaagcccuguauucucaacagggaugcaaauugguucuucaguaaggauaa

SEQ ID NO: 694626 - RNA, 64 nt, hsa
caguccuuugauuucccacugaagauaccccaaaggaugcaagugccuacaguauuaucaggag

SEQ ID NO: 694627 - RNA, 64 nt, hsa
uugucuauaaccaggcccuggcaaagugcaaacaggaugcaacugcaguggcacaaaggucacu

SEQ ID NO: 694628 - RNA, 64 nt, hsa
cuugggaggccugccugcuagaauccuaaugugaggaugcaaaagaaaugaugauaacauuuug

SEQ ID NO: 694629 - RNA, 64 nt, hsa
auuggcaauaagauacccgcuacaaacugugauuggaugcaaaaucucuuagcuucuuucacga

SEQ ID NO: 694630 - RNA, 64 nt, hsa
cgcaaauaagaaaccaagggauaaaacuguucauggaugcaacucaaauucagaugauccucaa

SEQ ID NO: 694631 - RNA, 64 nt, hsa
uuuuagaugaguucucuaugugaccaauuuuacuggaugcaauugacaggacccgucaucauaa

SEQ ID NO: 694632 - RNA, 64 nt, hsa
uucugcauauucgcuccuaagggaggcucugaggggaugcaacaaaaugauccuuaugaugucc

SEQ ID NO: 694633 - RNA, 64 nt, hsa
ugauuugaaccuguugugguaaagaucuuguacaggaugcaaacuaaaaaccuaaucccugcca

SEQ ID NO: 694634 - RNA, 64 nt, hsa
uggagagugagcuacagagccgagcaauauuuauggaugcaacacgcauggucaacccucaggg

SEQ ID NO: 694635 - RNA, 64 nt, hsa
cccaacaugccuccugcccugcuaaagacagugcggaugcaagagcaccuggccaagcgagagc

SEQ ID NO: 694636 - RNA, 64 nt, hsa
uuucucuucauauuuauaugggggggagggcgcuggaugcaaaaguugaagaucgugaugcuau

SEQ ID NO: 694637 - RNA, 64 nt, hsa
gagguauuuacccagaggauuuuccuaugguuggggaugcaaauauuagaaaacagauuguauu

SEQ ID NO: 694638 - RNA, 64 nt, hsa
uauacugauguuuguguuacucaaaaaaacuacuggaugcaaacuguuauguaaaucugagauu

SEQ ID NO: 694639 - RNA, 64 nt, hsa
uauggagaugaaugaucaaagugaaacaauguuuggaugcaacgcagaauaaaagaauauaaga

SEQ ID NO: 694640 - RNA, 64 nt, hsa
uucaguucuuaaguuucgguuuuuuuuaaaaacaggaugcaacuuaaacuuuucuuugcaucaa

SEQ ID NO: 694641 - RNA, 64 nt, hsa
uucuuggagcccuuuugcagucagcagcaucuauggaugcaaauccagccacagcagacaauca

SEQ ID NO: 694642 - RNA, 64 nt, hsa
aaucccccgacucccuccccagaucuguccugggggaugcaaauaaagccugcucucccaaggu

SEQ ID NO: 694643 - RNA, 64 nt, hsa
cuuggaucauuuuuauguagcaugauuuuccuugggaugcaaaucuuaaaacaguccuuuaaua

SEQ ID NO: 694644 - RNA, 64 nt, hsa
auaucauuuuuuuaacacauaacuagaaaccugaggaugcaacaaauauuuauauauuugaaua

SEQ ID NO: 694645 - RNA, 62 nt, hsa
uuuggaaauacuguguuuaaagcuuuuucucuggaugcaaaaaaagauaagaauaucaggaa

SEQ ID NO: 694646 - RNA, 64 nt, hsa
caugccaagguguauguguuuaagggggugugauggaugcaaagggaaugaggaauucagcacu

SEQ ID NO: 694647 - RNA, 64 nt, hsa
uuuaaugaaguauuuuguguagaagguuaaauuaggaugcaaaacagaucugccauuccuuuuu

SEQ ID NO: 694648 - RNA, 64 nt, hsa
acaguguaacaguacucucaugcaauuuuuuucaggaugcaaaggcaauuauucuuuguaagcg

SEQ ID NO: 694649 - RNA, 64 nt, hsa
aguucaaagcauaagguccauggugguggaaaauggaugcaagugauucuaaguuuguggauuu

SEQ ID NO: 694650 - RNA, 64 nt, hsa
gugugaauaucaguuuuagaauaguuucucugguggaugcaaugauguuucugaaacugcuaug

SEQ ID NO: 694651 - RNA, 64 nt, hsa; identical to SEQ ID NO: 461320

SEQ ID NO: 694652 - RNA, 64 nt, hsa; identical to SEQ ID NO: 461321

SEQ ID NO: 694653 - RNA, 64 nt, hsa
uuuaugcuuuaccauauaucaggaauuauauccaggaugcaauacucagacacuagcuuuuuuc

SEQ ID NO: 694654 - RNA, 64 nt, hsa
cuucuaucaguagcaguauuguuacuucuuuccaggaugcaaggucuauuaucccaacagaaga

SEQ ID NO: 694655 - RNA, 64 nt, hsa
ccucuuuaacguaugaggaagguuguccugcuacggaugcaauucaauucuuccuuuuuuauua

SEQ ID NO: 694656 - RNA, 64 nt, hsa
agaauuuaguguaucuuuuaauguuguaugucugggaugcaaguauugcuaaauauguuagccc

SEQ ID NO: 694657 - RNA, 64 nt, hsa
aagucacagcagacacgcuagacagcauaguccuggaugcaaccuggaggaagggaggcccaug

SEQ ID NO: 694658 - RNA, 64 nt, hsa
gcuaccccgucccccuccagacuggcaguuucaaggaugcaaauugcauugcaaaaucaaacug

SEQ ID NO: 694659 - RNA, 64 nt, hsa
gcuguuucuaguuucuuaaauagcccacaccccuggaugcaaaaaggcaggguuauuuuuaccc

SEQ ID NO: 694660 - RNA, 64 nt, hsa
guuguggaaggaaaaugugaaugaaaguagugcuggaugcaauuacuccugaaccccaccuagg

SEQ ID NO: 694661 - RNA, 64 nt, hsa
gcucaccaggcagugugcuuccuuccuugcaugaggaugcaagaugcaacaguuugucuuucac

SEQ ID NO: 694662 - RNA, 64 nt, hsa
uacugugacuuuauuagcagcugacuuucaaaguggaugcaauuuuucuuucuuuuguugggga

SEQ ID NO: 694663 - RNA, 64 nt, hsa
uucaaagaggcacagagccaaauugguagaggaaggaugcaaaguauaaauuuguguaauauua

SEQ ID NO: 694664 - RNA, 64 nt, hsa
aaacacaagaaaaucauguccuuuucagcaacauggaugcaacuagaggcuauuauccuaagca

SEQ ID NO: 694665 - RNA, 64 nt, hsa
aauuacuugcaugggguaacccaguaauacugugggaugcaacuucuagggcauggcugccucc

SEQ ID NO: 694666 - RNA, 64 nt, hsa
caggagccaauaucccuuacuuuaacccuuucugggaugcaauacuaggaaguaaagugaagaa

SEQ ID NO: 694667 - RNA, 64 nt, hsa
cuucucacccauggcccacccaggccuggagcugggaugcaauguaggcugagggaaagacguc

SEQ ID NO: 694668 - RNA, 64 nt, hsa
auacuucgacugugacauacaaguccauuaucugggaugcaaccacucaacaacuauccuauuc

SEQ ID NO: 694669 - RNA, 64 nt, hsa
uuugucagccucagcaacaaacauuuccuaaaugggaugcaaaaagaaacugaaugauguugaa

SEQ ID NO: 694670 - RNA, 64 nt, hsa
cuacuacucagcccucuccugcggccacaucaacggaugcaagucacagucuuaacacagccug

SEQ ID NO: 694671 - RNA, 64 nt, hsa
cagcgcggggagugaggaggggucagggggcuaaggaugcaaccucugacguucugcgccuucc

SEQ ID NO: 694672 - RNA, 64 nt, hsa
ccuugcccuggcuacagaacauggaagccccuagggaugcaaguggacuugggcagaggagguc

SEQ ID NO: 694673 - RNA, 64 nt, hsa
caaaauggccgugcaagcuuaggcuggggauucuggaugcaacgucuuuacaaccuuaccuaga

SEQ ID NO: 694674 - RNA, 64 nt, hsa
guguagccauauacccaggcucugcaguaucgaaggaugcaaauguugacauagauggaagcuc

SEQ ID NO: 694675 - RNA, 64 nt, hsa
cauucuugauugcuagaguuuuuguuaguacuuuggaugcaauuaaaacuaugugcuaucacau

SEQ ID NO: 694676 - RNA, 64 nt, hsa
agguccuaaauucauagaguggauauuaggauuaggaugcaaaaauaaaugcuuaaccaacacu

SEQ ID NO: 694677 - RNA, 64 nt, hsa
uugcagcuaacauggguuagguuuaaaccaugggggaugcaaccccuuugcguuucauauguag

SEQ ID NO: 694678 - RNA, 64 nt, hsa
acaucuccuugaugucugugaucaaaccaugacaggaugcaaccacaacacacggcuaugauca

SEQ ID NO: 694679 - RNA, 64 nt, hsa
ccaccagaaugaccugaugaggaaaucuucaauaggaugcaaagaucaaugcaaaaauuguuau

SEQ ID NO: 694680 - RNA, 64 nt, hsa
ggcucugaguguaaacuacaugguagguugugaaggaugcaaauaucgaaucaaucauuuuuua

SEQ ID NO: 694681 - RNA, 64 nt, hsa
ucauagcuguuccucauggccaugacuggaacagggaugcaaccucuuucuacacaagcacagu

SEQ ID NO: 694682 - RNA, 64 nt, hsa
ugcauuucugagugaagugcacgucuugggaaagggaugcaaucccugaaaccaggugcuuccu

SEQ ID NO: 694683 - RNA, 64 nt, hsa
acucggggccucaggcuucucagcugggaagagaggaugcaagaccagacugaagaacacgguu

SEQ ID NO: 694684 - RNA, 64 nt, hsa
auaauuuuaauggcuauauuauauuccauuuaauggaugcaacucaguuuauuuaaccauuccc

SEQ ID NO: 694685 - RNA, 64 nt, hsa
gcagucagguccacaccuauguccagggcaccagggaugcaauuccauguggaugucaccaaac

SEQ ID NO: 694686 - RNA, 64 nt, hsa
cuagucagggccuugggcaagacauugggcucuaggaugcaauuggcaaauacguccccguuac

SEQ ID NO: 694687 - RNA, 64 nt, hsa
cuuuuuuguacaaaucuguauuguauuaauuucuggaugcaauuuuucaaauauuaaaauuaua

SEQ ID NO: 694688 - RNA, 64 nt, hsa
uugagcacaacaggaaagccugggaggguuguugggaugcaaggaggugaugaaaaggagacag

SEQ ID NO: 694689 - RNA, 64 nt, hsa
uagcccagaagccuccggcggcccaggauucuaaggaugcaauccucgaggaaaauuagucgau

SEQ ID NO: 694690 - RNA, 64 nt, hsa
uuucacccaaaugaagugugaacgugauguuuucggaugcaaacucagcucagggauucauuuu

SEQ ID NO: 694691 - RNA, 64 nt, hsa
gcccagagagccagcagccuugggauacuaaugaggaugcaacuggcuuauugguaugaaauag

SEQ ID NO: 694692 - RNA, 64 nt, hsa
uuuuuuuuguauuucagagaaaauucagguaccaggaugcaauggauuuauuugauucagggga

SEQ ID NO: 694693 - RNA, 64 nt, hsa
auauuuucuucuggucacaaaauaaagaaauuugggaugcaaaguaccuaaagaucucugaucc

SEQ ID NO: 694694 - RNA, 64 nt, hsa
gccagaugcagagaaagcuaaaugugggaaucauggaugcaaagaagaauuuggcuuuuugaaa

SEQ ID NO: 694695 - RNA, 64 nt, hsa
gaggugggaggaucuauugagcccuggaauucgaggaugcaauuaauugugguugugucacagu

SEQ ID NO: 694696 - RNA, 64 nt, hsa
aagguggugcuucugccauuagacgcaguuaggaggaugcaacugcaaaucuaaaauuacgaag

SEQ ID NO: 694697 - RNA, 64 nt, hsa
gccucuggaaccugaggcggcugcuugaaccuuuggaugcaaaugucgaugcuuaagaaaaccg

SEQ ID NO: 694698 - RNA, 64 nt, hsa
gccagagacauaugggccauaccccuuaaccccgggaugcaagguagcauggguccaagagaca

SEQ ID NO: 694699 - RNA, 64 nt, hsa
uuaaagagaugaaauaaauuaagcaguagauccaggaugcaaaauccucccaauuccugugcau

SEQ ID NO: 694700 - RNA, 64 nt, hsa
guuuuucaugaucaucauuaacaguuuguccuuaggaugcaaaugaaaaugugaauacauaccu

SEQ ID NO: 694701 - RNA, 64 nt, hsa
ucaguaacacacccucccugcuccaagugcaccaggaugcaaaugcacagaauucaccaggggc

SEQ ID NO: 694702 - RNA, 64 nt, hsa
cggcgggcuggguguucacgugugucugugucauggaugcaaugcaggcccuggaggacugugc

SEQ ID NO: 694703 - RNA, 64 nt, hsa
ugagccugggguugacuggguuagagaagaaccgggaugcaaggagcugccugugacaccuggc

SEQ ID NO: 694704 - RNA, 64 nt, hsa
auugggucaggaguugaauuuggggugggaggauggaugcaacugaagcagagugugggugccc

SEQ ID NO: 694705 - RNA, 64 nt, hsa
acaugcugagcauucauuuugcguccucuggguuggaugcaaugugagaggauggcaugccaga

SEQ ID NO: 694706 - RNA, 64 nt, hsa
uucugaauuguaaaugaacuuaaaaauagaauguggaugcaaaauaucacauaagacaucauga

SEQ ID NO: 694707 - RNA, 64 nt, hsa
ucaaacgcccugagagucccggauguccgaggcgggaugcaaaccaucccguccugagcacggg

SEQ ID NO: 694708 - RNA, 64 nt, hsa
guggccaaaccagcagaacauucuucucuucaaaggaugcaauaguagaaagcuacuuauuuua

SEQ ID NO: 694709 - RNA, 64 nt, hsa
ucaacauguuucaagacgcuguguuagacacuagggaugcaaagaugaaugagauaaggccuca

SEQ ID NO: 694710 - RNA, 64 nt, hsa
aaauaucgaccaucacccucccccgcgugaacugggaugcaaguugcuaaccgaugugaacgca

SEQ ID NO: 694711 - RNA, 64 nt, hsa
acaaauguuauaauuuauauagugugguugaacaggaugcaaucuuuuguugucuaaaggugcu

SEQ ID NO: 694712 - RNA, 64 nt, hsa
agucuccaagcccacuugaaaagucacacugaaaggaugcaaauagccgucugcgauuuuggcg

SEQ ID NO: 694713 - RNA, 56 nt, hsa; identical to SEQ ID NO: 694560

SEQ ID NO: 694714 - RNA, 64 nt, hsa
uauuucaugguguuuucagggaacacagaaaugcggaugcaaaacaacuuuugacagaggccca

SEQ ID NO: 694715 - RNA, 64 nt, hsa
ccgagagacacggucuggacagcccaaggcgccaggaugcaaccugcuuucaccagacugcaga

SEQ ID NO: 694716 - RNA, 64 nt, hsa
ugcccuguauccggagcugugcugggcacugaggggaugcaacaaaauuaggagaggauccuug

SEQ ID NO: 694717 - RNA, 64 nt, hsa
uggggcccagaggagcuggugcugaccuagcuagggaugcaagagugagcaagcagcaccccca

SEQ ID NO: 694718 - RNA, 64 nt, hsa
uggguggaugguccagagccuccacccacagaggggaugcaaagggcaggugagucaagaaccg

SEQ ID NO: 694719 - RNA, 64 nt, hsa
guucugucuccaaggcccaggacacuugucagaaggaugcaaaaaaagaaaaaaguacauccac

SEQ ID NO: 694720 - RNA, 54 nt, hsa; identical to SEQ ID NO: 694567

SEQ ID NO: 694721 - RNA, 64 nt, hsa
gccggguuucuucuugaagcagcuccugcaaaagggaugcaaagaggucccagggaccugcccc

SEQ ID NO: 694722 - RNA, 64 nt, hsa
guucuaacgaagcaugcgugucucuucaucuacaggaugcaauaggcugauuguauuuaaaaau

SEQ ID NO: 694723 - RNA, 64 nt, hsa
ggcggagcucccagucgcauggagcgguguucauggaugcaacagacccuggcuucuggagucc

SEQ ID NO: 694724 - RNA, 64 nt, hsa
aauguuuuauaaaauaaauuugccacauaauaugggaugcaauaaccaacaaagcugcuaagug

SEQ ID NO: 694725 - RNA, 64 nt, hsa
gauuuaggcaguaucauuuccauuuuauaaguagggaugcaaaauccgugucacuaaacuagug

SEQ ID NO: 694726 - RNA, 64 nt, hsa
aguucucacaccguaucuagggacagaggcaucuggaugcaaacgcgggguuuguuaggggcgg

SEQ ID NO: 694727 - RNA, 64 nt, hsa
gcagugugauggagagucucugccgugccaucugggaugcaaaccgucccuguguuccccacgu

SEQ ID NO: 694728 - RNA, 64 nt, hsa
aacaggggcccguuucugguugaaaucaagguuaggaugcaacugagaaaauaaaagacugcac

SEQ ID NO: 694729 - RNA, 64 nt, hsa
aucuuucaggucgugauaaugagcuccuaugaaaggaugcaauauaaugacccgcuuuucuaga

SEQ ID NO: 694730 - RNA, 64 nt, hsa
ugguggagaccagggacaggagagccagcaggguggaugcaaggggccucuacccacaccugga

SEQ ID NO: 694731 - RNA, 64 nt, hsa
gguggagaggagcuggguugaagcggacugcugcggaugcaacucccagcuugcccaccgcggg

SEQ ID NO: 694732 - RNA, 64 nt, hsa
augguccugacuuugggcgcuggguauuggaaauggaugcaaaguacaauguguuuuucuccag

SEQ ID NO: 694733 - RNA, 64 nt, hsa
gcuacuauuuuucaguugagaaagaaauuuuugaggaugcaaagcuuuucugugaagacaaguc

SEQ ID NO: 694734 - RNA, 64 nt, hsa
cuuugggauggcaccuauauuggcugauaauugaggaugcaaacauuccauucauuagugugau

SEQ ID NO: 694735 - RNA, 64 nt, hsa; identical to SEQ ID NO: 461322

SEQ ID NO: 694736 - RNA, 64 nt, hsa; identical to SEQ ID NO: 461323

SEQ ID NO: 694737 - RNA, 64 nt, hsa
ucugaaugagaagugagaagguuuuuauacucugggaugcaaccgacauguucaaauguuugaa

SEQ ID NO: 694738 - RNA, 64 nt, hsa
ccucuguguuagggaaaauauggaacuucucccuggaugcaaaaccuaugaguauauuaauauu

SEQ ID NO: 694739 - RNA, 64 nt, hsa
guccuguugcaggaagccccuccuguuagcagcgggaugcaagaugcugucucggggcucuccu

SEQ ID NO: 694740 - RNA, 64 nt, hsa
augaggaguuguugaacccacugcuaggaagcaaggaugcaacaagaugaugcugagcgugaac

SEQ ID NO: 694741 - RNA, 64 nt, hsa
acuaggguucagagaaccaggguucaaagcccagggaugcaaagguugcagugaguugagucau

SEQ ID NO: 694742 - RNA, 64 nt, hsa
ccuaaaucuauagaaauacaaaaugaaauaaaaaggaugcaaaucagucacagagcuggaaaca

SEQ ID NO: 694743 - RNA, 64 nt, hsa
ggagugacacccccagaccucuggaggagacaauggaugcaaacagcccacacaggaaagacaa

SEQ ID NO: 694744 - RNA, 64 nt, hsa
aaacaguauuuauuauaaauuacuaccgugacugggaugcaagagaauuaggacuauaauuuuc

SEQ ID NO: 694745 - RNA, 64 nt, hsa
gggggccucacugcugcgcaagggguggggccgaggaugcaaguccaggcagagcggcgcaggc

SEQ ID NO: 694746 - RNA, 64 nt, hsa
gaagucugguuuaaggcacagguaaacugaguguggaugcaaaaguaccaggagcuagcuuuua

SEQ ID NO: 694747 - RNA, 64 nt, hsa
gaucuuuaagcacugaugauuuucuuauauaugaggaugcaaagcauucaagaguuucagccug

SEQ ID NO: 694748 - RNA, 64 nt, hsa
guguggaauuuugguugggguggggggagaggagggaugcaacucgcccuguuuggcaucuaau

SEQ ID NO: 694749 - RNA, 64 nt, hsa
ugcaauaugccagaacuacagacaacagcccacaggaugcaaaagugcuuugccaucuuaaaaa

SEQ ID NO: 694750 - RNA, 64 nt, hsa
caaguccugauggagcaagaggcccacgccuaggggaugcaagaacaacccguuucuuaaaugu

SEQ ID NO: 694751 - RNA, 64 nt, hsa
aacucccucccauccuacucucacagaagggccuggaugcaagguuacccuugagcugugugcc

SEQ ID NO: 694752 - RNA, 64 nt, hsa
uugauucuaaaucuguuccauuaucuucucuguaggaugcaaaacauccaguuguaauguauaa

SEQ ID NO: 694753 - RNA, 64 nt, hsa
gaggauuaggauuuuaacauaugaauuuugggggggaugcaaucauucagcccauaauacccuc

SEQ ID NO: 694754 - RNA, 64 nt, hsa
auguaugaguguauguguuuauguaacuuccuguggaugcaaauagauucagagaaauuuagag

SEQ ID NO: 694755 - RNA, 64 nt, hsa
gaaagacuggcaagaaaagaguuaaggcaaaaaaggaugcaacaauucucccgggacucugcau

SEQ ID NO: 694756 - RNA, 64 nt, hsa
acagaggauguggccugguucaaaguaaagcagaggaugcaacaaauguggccaagccuaucaa

SEQ ID NO: 694757 - RNA, 64 nt, hsa
agauugauaaccauccuuuggggcagcauuccagggaugcaaaaugugcuaguccaugaccuuu

SEQ ID NO: 694758 - RNA, 64 nt, hsa
uaugugaucauuugcacuuguuaccucuuaauauggaugcaacuuauuaaaaauguuggccugg

SEQ ID NO: 694759 - RNA, 64 nt, hsa
ucuuaauucugaccaauaaaaaaauaagucaggaggaugcaauuguugaaagcuuugaaauaaa

SEQ ID NO: 694760 - RNA, 64 nt, hsa; identical to SEQ ID NO: 570311

SEQ ID NO: 694761 - RNA, 64 nt, hsa; identical to SEQ ID NO: 570312

SEQ ID NO: 694762 - RNA, 64 nt, hsa; identical to SEQ ID NO: 570313

SEQ ID NO: 694763 - RNA, 64 nt, hsa; identical to SEQ ID NO: 570314

SEQ ID NO: 694764 - RNA, 56 nt, hsa; identical to SEQ ID NO: 570315

SEQ ID NO: 694765 - RNA, 64 nt, hsa; identical to SEQ ID NO: 570316

SEQ ID NO: 694766 - RNA, 64 nt, hsa; identical to SEQ ID NO: 570317

SEQ ID NO: 694767 - RNA, 64 nt, hsa; identical to SEQ ID NO: 570318

SEQ ID NO: 694768 - RNA, 64 nt, hsa; identical to SEQ ID NO: 570319

SEQ ID NO: 694769 - RNA, 64 nt, hsa; identical to SEQ ID NO: 570320

SEQ ID NO: 694770 - RNA, 64 nt, hsa; identical to SEQ ID NO: 570321

SEQ ID NO: 694771 - RNA, 64 nt, hsa; identical to SEQ ID NO: 570322

SEQ ID NO: 694772 - RNA, 64 nt, hsa; identical to SEQ ID NO: 570323

SEQ ID NO: 694773 - RNA, 64 nt, hsa; identical to SEQ ID NO: 570324

SEQ ID NO: 694774 - RNA, 64 nt, hsa; identical to SEQ ID NO: 311803

SEQ ID NO: 694775 - RNA, 64 nt, hsa; identical to SEQ ID NO: 311804

SEQ ID NO: 694776 - RNA, 64 nt, hsa; identical to SEQ ID NO: 311805

SEQ ID NO: 694777 - RNA, 64 nt, hsa; identical to SEQ ID NO: 311806

SEQ ID NO: 694778 - RNA, 64 nt, hsa; identical to SEQ ID NO: 311807

SEQ ID NO: 694779 - RNA, 64 nt, hsa; identical to SEQ ID NO: 311808

SEQ ID NO: 694780 - RNA, 64 nt, hsa; identical to SEQ ID NO: 311809

SEQ ID NO: 694781 - RNA, 64 nt, hsa; identical to SEQ ID NO: 311810

SEQ ID NO: 694782 - RNA, 64 nt, hsa; identical to SEQ ID NO: 311811

SEQ ID NO: 694783 - RNA, 64 nt, hsa; identical to SEQ ID NO: 311812

SEQ ID NO: 694784 - RNA, 64 nt, hsa; identical to SEQ ID NO: 311813

SEQ ID NO: 694785 - RNA, 64 nt, hsa; identical to SEQ ID NO: 311814

SEQ ID NO: 694786 - RNA, 64 nt, hsa; identical to SEQ ID NO: 311815

SEQ ID NO: 694787 - RNA, 64 nt, hsa; identical to SEQ ID NO: 311816

SEQ ID NO: 694788 - RNA, 64 nt, hsa; identical to SEQ ID NO: 311817

SEQ ID NO: 694789 - RNA, 64 nt, hsa; identical to SEQ ID NO: 311818

SEQ ID NO: 694790 - RNA, 64 nt, hsa; identical to SEQ ID NO: 311819

SEQ ID NO: 694791 - RNA, 64 nt, hsa; identical to SEQ ID NO: 311820

SEQ ID NO: 694792 - RNA, 64 nt, hsa; identical to SEQ ID NO: 311821

SEQ ID NO: 694793 - RNA, 64 nt, hsa; identical to SEQ ID NO: 311822

SEQ ID NO: 694794 - RNA, 64 nt, hsa; identical to SEQ ID NO: 311823

SEQ ID NO: 694795 - RNA, 64 nt, hsa; identical to SEQ ID NO: 311824

SEQ ID NO: 694796 - RNA, 64 nt, hsa; identical to SEQ ID NO: 311825

SEQ ID NO: 694797 - RNA, 64 nt, hsa; identical to SEQ ID NO: 311824

SEQ ID NO: 694798 - RNA, 64 nt, hsa; identical to SEQ ID NO: 311824

SEQ ID NO: 694799 - RNA, 64 nt, hsa; identical to SEQ ID NO: 311828

SEQ ID NO: 694800 - RNA, 64 nt, hsa; identical to SEQ ID NO: 311829

SEQ ID NO: 694801 - RNA, 64 nt, hsa; identical to SEQ ID NO: 311830

SEQ ID NO: 694802 - RNA, 64 nt, hsa; identical to SEQ ID NO: 311831

SEQ ID NO: 694803 - RNA, 64 nt, hsa; identical to SEQ ID NO: 311832

SEQ ID NO: 694804 - RNA, 64 nt, hsa; identical to SEQ ID NO: 311833

SEQ ID NO: 694805 - RNA, 64 nt, hsa; identical to SEQ ID NO: 311834

SEQ ID NO: 694806 - RNA, 64 nt, hsa; identical to SEQ ID NO: 311835

SEQ ID NO: 694807 - RNA, 64 nt, hsa; identical to SEQ ID NO: 311836

SEQ ID NO: 694808 - RNA, 64 nt, hsa; identical to SEQ ID NO: 311837

SEQ ID NO: 694809 - RNA, 64 nt, hsa; identical to SEQ ID NO: 311838

SEQ ID NO: 694810 - RNA, 64 nt, hsa; identical to SEQ ID NO: 311839

SEQ ID NO: 694811 - RNA, 64 nt, hsa; identical to SEQ ID NO: 311840

SEQ ID NO: 694812 - RNA, 64 nt, hsa; identical to SEQ ID NO: 311841

SEQ ID NO: 694813 - RNA, 64 nt, hsa; identical to SEQ ID NO: 311842

SEQ ID NO: 694814 - RNA, 64 nt, hsa; identical to SEQ ID NO: 311843

SEQ ID NO: 694815 - RNA, 64 nt, hsa; identical to SEQ ID NO: 311844

SEQ ID NO: 694816 - RNA, 64 nt, hsa; identical to SEQ ID NO: 311845

SEQ ID NO: 694817 - RNA, 64 nt, hsa; identical to SEQ ID NO: 311846

SEQ ID NO: 694818 - RNA, 63 nt, hsa
cuacccugucccaagccgagggggccgguggaaugacuugagcagcucugggaguggggaaaa

SEQ ID NO: 694819 - RNA, 63 nt, hsa
ggcugccuuuuguuuacacugguuauuuauuuaugacuugaaauaguuuaaggagcuaaacag

SEQ ID NO: 694820 - RNA, 63 nt, hsa
gagcuccaagugugccccagccacugagccuugugacuugagcagauguccgaagccguuucu

SEQ ID NO: 694821 - RNA, 63 nt, hsa
uaugggagacuagguuuuaacuggguggccccaugacuugauugccuucuacuggaagauugg

SEQ ID NO: 694822 - RNA, 63 nt, hsa
ucuguagcugccaucacagugaguuggcagaagugacuugagcauuucucugucugauuugag

SEQ ID NO: 694823 - RNA, 63 nt, hsa
uguuggaaaaugauguauaagucuaaguccucuugacuugaccauaagaucauggaaaacaga

SEQ ID NO: 694824 - RNA, 63 nt, hsa
gagggcuagggaaagggauauggaguucuuacuugacuugaaugugcaccugagggugcuuug

SEQ ID NO: 694825 - RNA, 63 nt, hsa
cgccuuccgaaauaagguguaaaaacagauauuugacuugagaacaaaagccaaguguaaauu

SEQ ID NO: 694826 - RNA, 63 nt, hsa
uaugauggccacagccuaaaguacacacggcugugacuugauucaaaagaaaauguuauaaga

SEQ ID NO: 694827 - RNA, 63 nt, hsa
acacucugaaacaaugagaaaaauacuaaaaauugacuugaguuauuucaauuugccuucauu

SEQ ID NO: 694828 - RNA, 63 nt, hsa
guauugccaugaugucacccuggccauguguacugacuugaggagaucuugcaacauggccau

SEQ ID NO: 694829 - RNA, 63 nt, hsa
aggguuaaaaauuuaacugguuuuuacuacugaugacuugauuuaaaaaaaauacaaagaugc

SEQ ID NO: 694830 - RNA, 63 nt, hsa
ugaaguuacccucugaaaaauauuuugucucucugacuugauuucuauaaaugcuuuuaaaaa

SEQ ID NO: 694831 - RNA, 63 nt, hsa
ccgccucuggacuaucuccccagaccagcagccugacuugacuuuugaguccuagggaugcug

SEQ ID NO: 694832 - RNA, 63 nt, hsa
cugggauacauuuggaaauguggucaucaaagaugacuugaaaugaggccuacucuaaagaau

SEQ ID NO: 694833 - RNA, 63 nt, hsa
acaacgaagaaacagauaaaagauacccaauuuugacuugauuucaugcaucauuuggauuuu

SEQ ID NO: 694834 - RNA, 63 nt, hsa
uugcuuuguuauauuuuauugcuacaaggggugugacuugauaaugauuuccucugaauuaua

SEQ ID NO: 694835 - RNA, 63 nt, hsa
aauaaaaaccaucucaauaauuaaguuggcagaugacuugaucuccgacauuuucaccacuau

SEQ ID NO: 694836 - RNA, 63 nt, hsa
gcagagcuucuaccaaacuucaacauggagggcugacuugaagcucccugucccccucacucu

SEQ ID NO: 694837 - RNA, 63 nt, hsa
ugagugagauaauuaugggagugguaagaauuaugacuugaauucuucuuugauuguguugca

SEQ ID NO: 694838 - RNA, 63 nt, hsa
guuuuguguuggaaaaaagaccugaauuucuaaugacuugauuuucuauuuucucccuaccca

SEQ ID NO: 694839 - RNA, 63 nt, hsa
uccaggcaccaucuguucuccccagggaccugcugacuugaaugccagcccuugcuccucugu

SEQ ID NO: 694840 - RNA, 63 nt, hsa
gaaaacagggucugggacauuagucguuauauuugacuugaaaagaaagaaaccaagugcgcu

SEQ ID NO: 694841 - RNA, 63 nt, hsa
cucccuauuguagauagaagggaaggaaacuguugacuugagcuuggcuaaauuuccugaagg

SEQ ID NO: 694842 - RNA, 63 nt, hsa
uauuucucugaaagaucguuuuggggacaaaagugacuugacauguccaauuucauuucagaa

SEQ ID NO: 694843 - RNA, 63 nt, hsa
cuguguucaguagaaggaaauguaaacgaaggcugacuugauugugccauuuagagggaacuc

SEQ ID NO: 694844 - RNA, 63 nt, hsa
ucaguuugaaagacaaugaaaaaugguuuuguaugacuugaauaguuuguauaguauauaauc

SEQ ID NO: 694845 - RNA, 63 nt, hsa
ucugguuggagcuucucacagccacucaaacccugacuugauuugacaacugggcccuguugg

SEQ ID NO: 694846 - RNA, 63 nt, hsa
uaacaagagacagccaaggaccuacaagacaguugacuugauuuugcacaguguaacagcgca

SEQ ID NO: 694847 - RNA, 63 nt, hsa
uucuuccucuuacuccuuaggauaaagguaaguugacuugaacaacuuucuuuugcacuggga

SEQ ID NO: 694848 - RNA, 63 nt, hsa
accucaggggcuguacuauuccucugcagagcuugacuugaugagguuugagguacaagggga

SEQ ID NO: 694849 - RNA, 63 nt, hsa
cccccuaccucccaccaccaccaugaaguuuggugacuugaggcuggagcucccucuguuacc

SEQ ID NO: 694850 - RNA, 63 nt, hsa
ggguucauuuaaauuugucugaaucauuagucuugacuugaagugaacaaaacacccuuugcc

SEQ ID NO: 694851 - RNA, 63 nt, hsa
uauuucucugucagcccugccacauaucacuaaugacuugaacuugggcaucuggcucccuuu

SEQ ID NO: 694852 - RNA, 63 nt, hsa
uguacaaggagguauugagaggaacccuacuguugacuugaaaauaaauagguuccaugugua

SEQ ID NO: 694853 - RNA, 63 nt, hsa
acaaaaagucaaaugagacaauggacgugucaaugacuugaaaaaaagucacauccagcaaau

SEQ ID NO: 694854 - RNA, 63 nt, hsa
gagcccagaaaugucuuuugcaggcccacguucugacuugaagcuuucgugggcauguugcca

SEQ ID NO: 694855 - RNA, 63 nt, hsa
ugauaaaaucuccaccuggucauucauugugugugacuugauaccuguuaacuugccccuuag

SEQ ID NO: 694856 - RNA, 63 nt, hsa
uugugcacuugcuuaguggauuguauuggauugugacuugauguacagcgcuaagaccuuacu

SEQ ID NO: 694857 - RNA, 63 nt, hsa
uggauuucuuuguuggugccuugggaaacagucugacuugaacccuaagugccuuuggagagu

SEQ ID NO: 694858 - RNA, 63 nt, hsa
uugggggugguaacuaaaaucaaaagaaaugauugacuugagggucucuguuugguaagaaua

SEQ ID NO: 694859 - RNA, 63 nt, hsa
aaaaaaaaugagguaaacuguauuuaaaaccuuugacuugagucugcugguaaagcuucugaa

SEQ ID NO: 694860 - RNA, 63 nt, hsa
uauaagguagcuuaauaaacuaaguaaaacguaugacuugaguacaaaaggauuguuuuaauc

SEQ ID NO: 694861 - RNA, 63 nt, hsa
uugucuggauggcugguuuugagguuuuaaaccugacuugaaauaguaacaccaaacaugauu

SEQ ID NO: 694862 - RNA, 63 nt, hsa
ugacagcuguaauauggucuucauguuuaucagugacuugacuacaaguaaagcagaaaacag

SEQ ID NO: 694863 - RNA, 63 nt, hsa
ccugucugugcucagacauagagaaguacuaccugacuugagucaaugcacccaagaagaaaa

SEQ ID NO: 694864 - RNA, 63 nt, hsa
cuaaauagaguaucauccaaauaauggggccuaugacuugaaugaauagaaaugaauaagcug

SEQ ID NO: 694865 - RNA, 63 nt, hsa
gugacuaaaaugaaacaagacaguugaauugugugacuugaagauuaccaaugauuuugaggc

SEQ ID NO: 694866 - RNA, 63 nt, hsa
uaguucuauuuuuaguuuuuacccuaacuacucugacuugaucauuuaacauucuguguaugu

SEQ ID NO: 694867 - RNA, 63 nt, hsa
ugaaagggcucuaaagaaggaacuaccaaaaccugacuugaaaugccauuucuuuuaaccuuc

SEQ ID NO: 694868 - RNA, 63 nt, hsa
auuuacauuagaguauaccuuuuaguaauaaaaugacuugaaaucauauuauuuuuaaaagcc

SEQ ID NO: 694869 - RNA, 63 nt, hsa
cauggcccacauuccaacuuaccauguacuuagugacuugacugagaaguuaggguagaaaac

SEQ ID NO: 694870 - RNA, 63 nt, hsa
uugcaaggaagccacagcuggugguaucugaguugacuugacagaacacugucuugaagacaa

SEQ ID NO: 694871 - RNA, 63 nt, hsa
aaucuguccuguugauuuuguuuuccuugcccaugacuugaacaacuguguuuuaaaguacug

SEQ ID NO: 694872 - RNA, 63 nt, hsa
ccugugugccugggucagccgcaucacagacaaugacuugacaugaaaugucagcugugcugg

SEQ ID NO: 694873 - RNA, 63 nt, hsa
aguccuuugacgacguguuguguuuucugauguugacuugaguuccauuuaguagcaucucuu

SEQ ID NO: 694874 - RNA, 63 nt, hsa
caucugcagaggcaagaaaaauauuugacauugugacuugacuguggaagaugaugguugcau

SEQ ID NO: 694875 - RNA, 63 nt, hsa
cuaccguggucacugcguagccucuuuuucuucugacuugagagcucccccagucagaucuca

SEQ ID NO: 694876 - RNA, 63 nt, hsa
acaacuuaacugaguacuccagaugacaguaacugacuugaagauggaaaaauaucaaaauag

SEQ ID NO: 694877 - RNA, 63 nt, hsa
caaugcaggacaacucuguaaucaagaauuuuuugacuugaaggcaguacuuauagaccuuau

SEQ ID NO: 694878 - RNA, 63 nt, hsa
cacccucucaguggucauuucugagcaucuuccugacuugaacaccuucuacagcaaacucuu

SEQ ID NO: 694879 - RNA, 63 nt, hsa
agaacccauuugccuugaugagcuugccuuuugugacuugacacuggggacguggaguggcgg

SEQ ID NO: 694880 - RNA, 63 nt, hsa
uaagaaaaaguauaaauuagcaagaaaggagagugacuugauuugcuuuuggaaaaagaaaug

SEQ ID NO: 694881 - RNA, 63 nt, hsa
cagaagcuucaaaaucugaaucuuuuugagcacugacuugaccccacaaguggaaaauucccc

SEQ ID NO: 694882 - RNA, 63 nt, hsa
ugagaagugaauacauggaagaguuuuuaagugugacuugaaaaauaugccaaaaaaugagag

SEQ ID NO: 694883 - RNA, 63 nt, hsa
uucuauccuuagcuuuggcauuauugacuggauugacuugaacaagucacuuaacuucuacaa

SEQ ID NO: 694884 - RNA, 63 nt, hsa
gaugggauucugcucauuuuauuaaaaagcuacugacuugacugucauccuguucuuguuagc

SEQ ID NO: 694885 - RNA, 63 nt, hsa
ggauagauaugcacugaaacauguggucuggucugacuugagagaaaaggaauguugcacaag

SEQ ID NO: 694886 - RNA, 63 nt, hsa
aacuaacuuguauuuagucugcuuagaggacugugacuugaaaauuuuuauauaccaaugagc

SEQ ID NO: 694887 - RNA, 63 nt, hsa
cucuguuugucuuaaguugcacugggggauuucugacuugaggcccaucucuccagccagcca

SEQ ID NO: 694888 - RNA, 63 nt, hsa
uucucuuugcaagagaggggcauuacugucaccugacuugaggagcuguuuuguuguuguugu

SEQ ID NO: 694889 - RNA, 63 nt, hsa
uaaauuaauuuagacagaaaagcaaauagcaauugacuugaaaauaagaaguggagccgaagg

SEQ ID NO: 694890 - RNA, 63 nt, hsa
acaggaggggcggacgguuagcuuuggaaaaaaugacuugauuaaucugauucgccaaauaaa

SEQ ID NO: 694891 - RNA, 63 nt, hsa
ucauuauagaguccaguagcuuaauacugacacugacuugauacagcaugaaguuucuagugc

SEQ ID NO: 694892 - RNA, 63 nt, hsa
uuacuauaacuuuguaaauuaacuuaauuuugcugacuugacuccuguggcuucuggaccccu

SEQ ID NO: 694893 - RNA, 63 nt, hsa
caguagguguugggcaggaauuggugagauuccugacuugauaccuugcuaaauggacaugua

SEQ ID NO: 694894 - RNA, 63 nt, hsa
ggggaauaugugcacgcuuguucagccuuaaugugacuugaagauguggaggacaucaacuuu

SEQ ID NO: 694895 - RNA, 63 nt, hsa
uaauuuuagugagaagauuaauacucaaggaccugacuugauaauuacuuauuuguguuuuuc

SEQ ID NO: 694896 - RNA, 63 nt, hsa
uuuggaacacuacucuuacauguauaaagugauugacuugacuuucuagcuucccuuguccgg

SEQ ID NO: 694897 - RNA, 63 nt, hsa
guagaugggauuauaggcaugugccacggugccugacuugaguuucuuauucuagaacacuug

SEQ ID NO: 694898 - RNA, 63 nt, hsa
uggaagccauugucuaaucaacucuaucauuagugacuugaugucucauaccuuaauuuugua

SEQ ID NO: 694899 - RNA, 63 nt, hsa
uaauguuuugcuuugcauuuuagguucagauuaugacuugauugaaauaaaugugccuauaca

SEQ ID NO: 694900 - RNA, 63 nt, hsa
uguuuuuguucugcauuaaggccuuuuuugcuuugacuugaaauaaguucuuugacagagcau

SEQ ID NO: 694901 - RNA, 63 nt, hsa
guaccucacuuuauuucaguuaacaagauacuuugacuugaaguguuuuuaguguaucccuau

SEQ ID NO: 694902 - RNA, 63 nt, hsa
ucgaaagaaaaugggcccuaggggucacuguacugacuugagggugauuaacagagagggcac

SEQ ID NO: 694903 - RNA, 63 nt, hsa
uauuggagagugaauccccacaguugcuuuuugugacuugauucaaaugaggcacucauuauu

SEQ ID NO: 694904 - RNA, 63 nt, hsa
uaauuugagcucguauuuaccccugcugauaagugacuugagaguucccgguuuuuuccucuu

SEQ ID NO: 694905 - RNA, 63 nt, hsa
ucuggcagaauugaggaggaagagguggcccucugacuugacaagccuucuguucugcccagg

SEQ ID NO: 694906 - RNA, 63 nt, hsa
uucugagcauuuuaauauacuugaaaacaacauugacuugaaaaauuucagaacauuuuucag

SEQ ID NO: 694907 - RNA, 63 nt, hsa
cuuauaaaaaaauucuccaacaaaaauacuuguugacuugauguuuuaucacuucucuaagua

SEQ ID NO: 694908 - RNA, 63 nt, hsa
agccuucaguagguaguaaagacuuaaugugcaugacuugauguuauauguagagauauauau

SEQ ID NO: 694909 - RNA, 63 nt, hsa
uguauguacagauaucauuucuuguguaugccaugacuugaaaaaguuugggaagcucuuuag

SEQ ID NO: 694910 - RNA, 63 nt, hsa
aaugggcaagaaggauucuccucauuccucucuugacuugagaaugaucagucaauaggcccu

SEQ ID NO: 694911 - RNA, 63 nt, hsa
uauaugucaaagcaggggaguaugcaaaaguucugacuugacuuuagucugcaaaaugaggaa

SEQ ID NO: 694912 - RNA, 63 nt, hsa
uccuaacuaccgucuuuuugcuaggacuuaaacugacuugaguguggcaaaaaguuaacaaaa

SEQ ID NO: 694913 - RNA, 56 nt, hsa; identical to SEQ ID NO: 570315

SEQ ID NO: 694914 - RNA, 63 nt, hsa
auggguuuuuaaguagaaccuaggguuucuaauugacuugauuucuggaaaugaaaacccgcg

SEQ ID NO: 694915 - RNA, 63 nt, hsa
uagcaguagauggugcuacuggcuuucauuugcugacuugauuauucccuuucucuuaaaaac

SEQ ID NO: 694916 - RNA, 63 nt, hsa
guuauaugcaagcacuaugcccuuuuauauaagugacuugaacaucugugcccgauuuuagua

SEQ ID NO: 694917 - RNA, 63 nt, hsa
agcucugauauauaucugguacauguuugauaaugacuugauuguuauuauaaguacuuauua

SEQ ID NO: 694918 - RNA, 63 nt, hsa
acugaauuguaaagauaaaucccuuuugaagaaugacuugacacuuccacucuagguagaucc

SEQ ID NO: 694919 - RNA, 63 nt, hsa
uggcacauagcugugagguacccuaugaguuguugacuugaaaacauggaacugcacagggca

SEQ ID NO: 694920 - RNA, 63 nt, hsa
cuuucuuauguuggcuaaacaguacuuaacaguugacuugaaauuuuguucucugagccaaag

SEQ ID NO: 694921 - RNA, 63 nt, hsa
agaaccccagaggucaccaacauguuuauaucuugacuugacuuuuuuaugcaugcaaaucau

SEQ ID NO: 694922 - RNA, 63 nt, hsa
uuucuuguaacaucugagauuagaaguuuaagaugacuugaccccaaaccuuuguuuauguaa

SEQ ID NO: 694923 - RNA, 63 nt, hsa
gugcaagaauggagaagcaugggauuugcauuaugacuugaacugggcuuauaucuaauaaua

SEQ ID NO: 694924 - RNA, 63 nt, hsa
uccuuuucaaaauaaaagugacaauuguagcauugacuugaagugagacaugguuauagauaa

SEQ ID NO: 694925 - RNA, 63 nt, hsa
agcaggugaaaccuuaggagaugauccagucacugacuugauugagggauaagugugauuuag

SEQ ID NO: 694926 - RNA, 63 nt, hsa
caaguaaaaggcaaaagauauaaauuuuauaauugacuugaguacuuuaagccuuguuuaaaa

SEQ ID NO: 694927 - RNA, 63 nt, hsa
caauauaaaauaaucuuccuguugaaugcuucaugacuugaauucuacuuugauaaaaacauu

SEQ ID NO: 694928 - RNA, 63 nt, hsa
cuagugauugaauucuacuuuugccaucugaauugacuugaaugucuuaaaacagguaaauac

SEQ ID NO: 694929 - RNA, 63 nt, hsa
auugaacagcaaaguaggauucaucauuccauaugacuugaguuacaccagaccuguucugcc

SEQ ID NO: 694930 - RNA, 63 nt, hsa
gaguacauaugguagacaauuugccuuaggaagugacuugaauguacaaagauacuugaugca

SEQ ID NO: 694931 - RNA, 63 nt, hsa
uuaaagcuaaaaugccaguaaauaaaagugcuaugacuugagcuaagauauuugacuccaaug

SEQ ID NO: 694932 - RNA, 63 nt, hsa
cuacaguuucauacauuuucuccagugacguguugacuugaaacuucaggcagauuaaaagaa

SEQ ID NO: 694933 - RNA, 63 nt, hsa
uagauuaauggggguugcuacuguuuaauucagugacuugaucuuuuuaauguccaaaaucca

SEQ ID NO: 694934 - RNA, 63 nt, hsa
ugcuugauaaucuugaacauugaacuuaauagaugacuugacaagguagagaucugauauuuu

SEQ ID NO: 694935 - RNA, 63 nt, hsa
uauuuucaucuuaaugguauagugaaaagacauugacuugagaugauacuaaggaagcuuugg

SEQ ID NO: 694936 - RNA, 63 nt, hsa
aauuuaggcuacaugagauuuugccuuuugugcugacuugacagcuucacuucugccuaagau

SEQ ID NO: 694937 - RNA, 63 nt, hsa
uuuacucugaggauaaggucacaaaguagggugugacuugaaaguaucgugaccauguggccc

SEQ ID NO: 694938 - RNA, 63 nt, hsa
ucuuggggggaggggugauaaggauuuuauuguugacuugaaacccccgaugacaaaagacuc

SEQ ID NO: 694939 - RNA, 63 nt, hsa
uuaaggaagauuuuucaagaaacugcaaguuuuugacuugaaggaaagaaagaggaaggcugg

SEQ ID NO: 694940 - RNA, 63 nt, hsa
guaagguuaauacuuucaguuaaacagcauguuugacuugauuccaucauggugcucuuaaau

SEQ ID NO: 694941 - RNA, 63 nt, hsa
uauagauucacauacacauauguauauacaggcugacuugaucuagaacauuaaauccgcccu

SEQ ID NO: 694942 - RNA, 63 nt, hsa
uauaucauaaaccaacacaguaauugccuuacaugacuugaaagauauaaacagaucuucuau

SEQ ID NO: 694943 - RNA, 63 nt, hsa
acagaggugauaugcuugaucuacacagagaugugacuugaucuguagcaccaaugcaaugua

SEQ ID NO: 694944 - RNA, 63 nt, hsa
uuaacacuuuagugccugacugcuguucuuuacugacuugauucagucacucguagcuuuauu

SEQ ID NO: 694945 - RNA, 63 nt, hsa
caugaugauuuaaaagaacuaaugagaauauuuugacuugacuucaauuacuaaguauuuugu

SEQ ID NO: 694946 - RNA, 63 nt, hsa
aaagcugccagcuaacaguaauucuuccauaguugacuugaacuucugaugcuuuuauugccc

SEQ ID NO: 694947 - RNA, 63 nt, hsa
ucaagugacaguaaaaggauuuguucccuucagugacuugaguguuuuaguuaugcauaagua

SEQ ID NO: 694948 - RNA, 63 nt, hsa
aaccuugcugaauuaaucugaauagcaacugucugacuugauaacuccagugccaguauagug

SEQ ID NO: 694949 - RNA, 63 nt, hsa
gagaggcaagaguuguuccugcccuucccuuugugacuugaagaacccugacuuuguuucugc

SEQ ID NO: 694950 - RNA, 63 nt, hsa
cuccuuggccuguccccagauuccuucccugguugacuugacucaugcuuguuucacuuucac

SEQ ID NO: 694951 - RNA, 63 nt, hsa
cauguauauuaugaccuucuguguuuuuguuucugacuugaauaauuuaucaaugguguugaa

SEQ ID NO: 694952 - RNA, 63 nt, hsa
ugagccauugcaccuggccaagaagagacaucuugacuugagccugaagacuauguacagaga

SEQ ID NO: 694953 - RNA, 63 nt, hsa
guuuugcuguagcaauaaaaugaccaagugcaaugacuugauuuaauaaaaucauauuuuaaa

SEQ ID NO: 694954 - RNA, 63 nt, hsa
ugauaaaauaauuucucaccuauuuugugugugugacuugaaauucaguaguaaaagaauuuc

SEQ ID NO: 694955 - RNA, 63 nt, hsa
gccccaaaguagggugggaaguuuuccucuaaaugacuugaugguugccaaaucccuugcacc

SEQ ID NO: 694956 - RNA, 63 nt, hsa
gacgcuuaaauacagcuuuuggauuggacaaaaugacuugaagacuuacagcaaauccuuugu

SEQ ID NO: 694957 - RNA, 63 nt, hsa
ugucagaugaaaaaacugaagcucaaaaaggguugacuugaccauacagcuaaugcugacaga

SEQ ID NO: 694958 - RNA, 63 nt, hsa
cuuuguucguaaacaauaucccaauagauuuguugacuugaggucugguuugguuuuguuuuu

SEQ ID NO: 694959 - RNA, 63 nt, hsa
acagaagugaugucuguaggucacauuaaauacugacuugagcagugggugacacaacacagu

SEQ ID NO: 694960 - RNA, 63 nt, hsa
uggggcauuggcaaucaacaaaugcaaugcuugugacuugacgugauaaaaguucauuuauug

SEQ ID NO: 694961 - RNA, 63 nt, hsa
ucauuguauaauguguauuucuuaggagauggcugacuugauugaucuacgcuaaguggagac

SEQ ID NO: 694962 - RNA, 63 nt, hsa
uaacuaugaaccaagcagugugguggccacuggugacuugaaaauauagagaaaaaaaaaacc

SEQ ID NO: 694963 - RNA, 63 nt, hsa
cugcaguccgcacaagcugugaggcagaaaacuugacuugaagcagccuugaagagugaguuc

SEQ ID NO: 694964 - RNA, 63 nt, hsa
uaccuccuguaacuaaagcauuuguuuaugaguugacuugagagaagggcugaucucagagcc

SEQ ID NO: 694965 - RNA, 63 nt, hsa
aagcugacucuucucaaucaucugugggucauuugacuugauuuuuuaagcuacccugaauuu

SEQ ID NO: 694966 - RNA, 63 nt, hsa
aacucuaaaguagcacaagccuccuucaaugcuugacuugaauggauuuaugacguaccguug

SEQ ID NO: 694967 - RNA, 63 nt, hsa
guaaagucuugucuggugacccagagaucaccaugacuugaggcacaaaucacuguggggaaa

SEQ ID NO: 694968 - RNA, 60 nt, hsa
gaccacgcccuuuaaccuaagaccugccugugacuugaggguuaagaagaaagaggaaug

SEQ ID NO: 694969 - RNA, 63 nt, hsa
uuacuguuucauugcauaacaugguagcaucugugacuugaaugagcagcacuuugcaacuuc

SEQ ID NO: 694970 - RNA, 63 nt, hsa
ucuaauuauaugggaaccagaauagauaaauuuugacuugaaaaauauucauguagaucaagu

SEQ ID NO: 694971 - RNA, 63 nt, hsa
gagcgagacuccgucucaaaaaaaaaaguuaaaugacuugaguacccaaaagaaaugucguga

SEQ ID NO: 694972 - RNA, 63 nt, hsa
cuguaacuacaaugaugguaaagccauguuaaaugacuugauuguacuuggaguaauugcaca

SEQ ID NO: 694973 - RNA, 63 nt, hsa
aggagcaaacaaggcuucauauucuuuuuaaaaugacuugaaauuuuauuauaaauuuccaua

SEQ ID NO: 694974 - RNA, 63 nt, hsa
uauuuaaauacucauuguugcuauuucacuuuuugacuugacuuuuauauuucuuuaaaaaau

SEQ ID NO: 694975 - RNA, 63 nt, hsa
gcacaguaggaccucagaaaaguacccaaaugcugacuugaucaugaacuacugcaggaaucc

SEQ ID NO: 694976 - RNA, 63 nt, hsa
gcguuucgcucuccuuguaggcugaagucagucugacuugaaggggccugguuuggaucuaag

SEQ ID NO: 694977 - RNA, 63 nt, hsa
agacuuguuucugcucucauuuuugucaucgucugacuugaagauucagacaccuucucccca

SEQ ID NO: 694978 - RNA, 63 nt, hsa
uugguucuucaacuaagcucuugcagagugagaugacuugaaauaaaaauguucuaugaauau

SEQ ID NO: 694979 - RNA, 63 nt, hsa
gucuuuuuuaaauauuuucuuacugcuuuauagugacuugauuugguuucuguuguguuuuug

SEQ ID NO: 694980 - RNA, 63 nt, hsa
ggaaauuuucugcuaaagcaaaccccuguucucugacuugacaacuuggccccggacuguggg

SEQ ID NO: 694981 - RNA, 63 nt, hsa
aaggaaggagaaugagggguacgggacuagauaugacuugaaauagauugaggcucauuuggu

SEQ ID NO: 694982 - RNA, 63 nt, hsa
guggguggaggcagccagggcuuaccuguacacugacuugagaccaguugaauaaaagugcac

SEQ ID NO: 694983 - RNA, 63 nt, hsa
uuucccuuuuagaaucaguguaucagugaccuaugacuugaggagaaacuuuuaauucgaaga

SEQ ID NO: 694984 - RNA, 63 nt, hsa
auuccagcacuuugggaggcuaaggcgggaggaugacuugaggccaggaguuggagaccagcc

SEQ ID NO: 694985 - RNA, 63 nt, hsa
ucccauuauguacuuuauucagaauguagaagcugacuugaaaggcauccuugguacuaagug

SEQ ID NO: 694986 - RNA, 63 nt, hsa
aauuagaagcuucuccuuaaccuguauugauacugacuugaauuauuuucuaaaauuaagagc

SEQ ID NO: 694987 - RNA, 63 nt, hsa
gagcuuaggaggggcggagacgcucacaucgucugacuugagucgccacugauuguggcaaca

SEQ ID NO: 694988 - RNA, 63 nt, hsa
aaucgacagugucucagaacugaauaacugcagugacuugaugcucuaaaacaguguaggauu

SEQ ID NO: 694989 - RNA, 63 nt, hsa
aagcucuaucauauucugaaacaagaauuagaaugacuugagaacgggcaaauaacaaagcaa

SEQ ID NO: 694990 - RNA, 63 nt, hsa
uuauaccaguccauuuuguuuauucuguggaauugacuugacaaagcaugaagauauucccag

SEQ ID NO: 694991 - RNA, 63 nt, hsa
uaaauacuugcuagcuuaugugccauuaaaaaaugacuugauuuggcuuacagaccaguuugg

SEQ ID NO: 694992 - RNA, 63 nt, hsa
cccccaggaagccuucccugcccaccccaucuaugacuugagccaggucugguccgugguguc

SEQ ID NO: 694993 - RNA, 63 nt, hsa
aaacccugcuccaaucugucacauaaaagucugugacuugaaguuuagucagcacccccacca

SEQ ID NO: 694994 - RNA, 63 nt, hsa
gacuuacaguggaguagaacgagccagaguuccugacuugagcagguggauuugggcccaggc

SEQ ID NO: 694995 - RNA, 63 nt, hsa
ucauauuuugcguaacugcucuacacuacuguuugacuugaucuucuucuggggguuagggag

SEQ ID NO: 694996 - RNA, 63 nt, hsa
uuguaaguaacaauauguaaucaaacuucuaggugacuugagaguggaaccuccuauaucauu

SEQ ID NO: 694997 - RNA, 63 nt, hsa
uguaagguacagcagcuccgguuucuauuauugugacuugaaugucaggauucaagggcucag

SEQ ID NO: 694998 - RNA, 63 nt, hsa
gacuagacaugcuaaccuccagguuuuuauauaugacuugagucugcuguaauuggcagcaga

SEQ ID NO: 694999 - RNA, 63 nt, hsa
uuggcaagguagcaauaccaguuucaaacuuggugacuugauccacuaugccuuaaugguuuc

SEQ ID NO: 695000 - RNA, 63 nt, hsa
gaauaauuuuaccaaaacaagcuauuugaguuuugacuugacaaggcaaaacaugacagugga

SEQ ID NO: 695001 - RNA, 63 nt, hsa
auuaauggguaaacuaagaaguguuauaggcaaugacuugaaaugguuuuuaaauuguaugga

SEQ ID NO: 695002 - RNA, 63 nt, hsa
uaaagcuggugggaccuaaugucaccuuaauucugacuugaacuggaagcauuuuaagaaauc

SEQ ID NO: 695003 - RNA, 63 nt, hsa
guucuugucuaauccauguagcuuuuuguucaaugacuugaucaucugcuuccuuuuugaauu

SEQ ID NO: 695004 - RNA, 63 nt, hsa
ugauaggaauauuugagaaagauugauccuguuugacuugaggacuuauuuuguucacaggca

SEQ ID NO: 695005 - RNA, 63 nt, hsa
gcuggcaaaaggccuguacucaggcauuugcuuugacuugauguugccaagggacugaggcca

SEQ ID NO: 695006 - RNA, 63 nt, hsa
agcugccaaaugacuucaaaaggcuggggugggugacuugacugugagacuggauuauaacau

SEQ ID NO: 695007 - RNA, 63 nt, hsa
ucccuuuccaagccugccuggacggcuguucugugacuugacaguggcucccccagccccaaa

SEQ ID NO: 695008 - RNA, 63 nt, hsa
augacacuuuuaaaauaaauucucuccuaaugaugacuugagcccugccacucaaugggagaa

SEQ ID NO: 695009 - RNA, 63 nt, hsa
uuugcucugucucguucuuuacacagaguucacugacuugaaguauacucaguuaaaaucggg

SEQ ID NO: 695010 - RNA, 63 nt, hsa
auccuaauucacaauaacaauggcauuaagguuugacuugaguugguucuuaguauuauuuau

SEQ ID NO: 695011 - RNA, 63 nt, hsa
gucaucuaccuaaagacacauuaagccagaauuugacuugacgggauggcuuacaaguccugc

SEQ ID NO: 695012 - RNA, 63 nt, hsa
agcguggugcacccaucagucacgcaggaggacugacuugacagacgaaagacaagcccggau

SEQ ID NO: 695013 - RNA, 63 nt, hsa
cucucagcuucaacaggugacaggcugcuuucgugacuugauauuggugucauagcauuuggc

SEQ ID NO: 695014 - RNA, 63 nt, hsa
aguguguacauacuguaaauaugugugauugcuugacuugaaaagguuugaauucugaauguu

SEQ ID NO: 695015 - RNA, 63 nt, hsa
aucuucaccugcccgccccugagucagccuccuugacuugauagcuugaagaauccuuuucca

SEQ ID NO: 695016 - RNA, 63 nt, hsa
cuaggaaacaguggcaauaaauuuuucagauguugacuugaguaaauauaucaccacuauugc

SEQ ID NO: 695017 - RNA, 63 nt, hsa
aaaggauaaaaaugugaacgaaguuuaacauucugacuugauaaagcuuuaauaauguacagu

SEQ ID NO: 695018 - RNA, 63 nt, hsa
gaagcuuuuaaacauuacacuugagaucagucaugacuugauauucagguaaauuuucuuuuc

SEQ ID NO: 695019 - RNA, 63 nt, hsa
ccuauaaaacacaugccaaucuguuagcaguccugacuugauuuaauaaaaaccaaggagagc

SEQ ID NO: 695020 - RNA, 63 nt, hsa
uucuugugucuguuauuggagucuggccaggguugacuugagcugagacaccagaugcucacg

SEQ ID NO: 695021 - RNA, 63 nt, hsa
gcuucuucaguggaccaagcugcaaugcaguauugacuugacagagccucuacuucugucuca

SEQ ID NO: 695022 - RNA, 63 nt, hsa
aaauagcacauuuauaagaaccgcaaugaaaacugacuugaaauaaugcuuguaaucaggaaa

SEQ ID NO: 695023 - RNA, 63 nt, hsa
uucaaacuuuuaauacaguuuuugaguuuugugugacuugaauuuuuaaucuuucuguaaaau

SEQ ID NO: 695024 - RNA, 63 nt, hsa
aaauuggauaauguacuuucuucucaagauucaugacuugauagaacaauacuuucaguuaug

SEQ ID NO: 695025 - RNA, 63 nt, hsa
aacuugccaugcuucugcaugcagauucuucacugacuugaauugagaugggcaagggaaaag

SEQ ID NO: 695026 - RNA, 63 nt, hsa
cuuuugcccuuacuggaugacucucagaggacaugacuugacauaguaacauuaguaaacugu

SEQ ID NO: 695027 - RNA, 63 nt, hsa
aguaauuugggcuaaaaaauggaaagauguugaugacuugaagugaugcaagaauggacaagu

SEQ ID NO: 695028 - RNA, 63 nt, hsa
ugggagauuuggauuugaauguggacuuguaaaugacuugaccuugccaucuguguucaaggu

SEQ ID NO: 695029 - RNA, 63 nt, hsa
ccuccuugcuuaucgucccuguuuugagggcuaugacuugaguuuuuguuucccauguucucu

SEQ ID NO: 695030 - RNA, 63 nt, hsa
aauaaaaaauauuaagaggaaauccccauccugugacuugagucccuuaagucuacaggggcu

SEQ ID NO: 695031 - RNA, 63 nt, hsa
cugagcaugcucuucuaggcugacucccagcccugacuugaaaccauuagcgcuaacuugcuc

SEQ ID NO: 695032 - RNA, 63 nt, hsa
uugaaauauccagacuuguagggaagaaaacaaugacuugacgaccuuaaaaaggguuagauu

SEQ ID NO: 695033 - RNA, 63 nt, hsa
ggagauuuaauaaccagggcuacccagaaaaagugacuugauaacaugguaccaauaaguaag

SEQ ID NO: 695034 - RNA, 63 nt, hsa
gacagggcuccuccugcuugccucagggcugccugacuugaauggcguuggaccucggggauu

SEQ ID NO: 695035 - RNA, 63 nt, hsa
ccagauguuuccuaaagaaguuuccagaaacuuugacuugaaauguuugcagaucaacuauaa

SEQ ID NO: 695036 - RNA, 63 nt, hsa
uuucauuuuaaaccagagcaaguaacauauuagugacuugaaucuucauaaguuaaaguaaaa

SEQ ID NO: 695037 - RNA, 63 nt, hsa
gugcuauggaaccaaucuugaacauacaugcauugacuugacaaguuacugaguaagcagcau

SEQ ID NO: 695038 - RNA, 63 nt, hsa
cuucaacguugguaugauaaugauaacuuguuuugacuugaauaaaguacuacaucagugugg

SEQ ID NO: 695039 - RNA, 63 nt, hsa
ggauugggggauccgggagggugggguugucucugacuugacauuaaaaaguguuccaugucc

SEQ ID NO: 695040 - RNA, 63 nt, hsa
ucuuugugggggcucucaggcuuggcacagcccugacuugaacucugggugacccugggcacc

SEQ ID NO: 695041 - RNA, 63 nt, hsa
gcuuaucucccuaacccugaaaugcugugagcuugacuugacucccaacccuaccaugcucca

SEQ ID NO: 695042 - RNA, 63 nt, hsa
cucggcacuucugugggagcuauucauacacagugacuugauguucuuggaggaucaacaaaa

SEQ ID NO: 695043 - RNA, 63 nt, hsa
caagcaauguaugaucuguuugaaacaaauauaugacuugaaaaggaucuuagguguaguaga

SEQ ID NO: 695044 - RNA, 63 nt, hsa
cuugaaggaagaagucuaagagugaaguaggugugacuugaacuagauugcaugcuuccuccu

SEQ ID NO: 695045 - RNA, 63 nt, hsa
gcugaagccgucccuggcagagcccucgugcauugacuugacagccucuccggcagcacaggc

SEQ ID NO: 695046 - RNA, 63 nt, hsa
cuuuccgcaugauaaauuuauguaauauuugacugacuugaccguaaguauguuacuuguaua

SEQ ID NO: 695047 - RNA, 63 nt, hsa
ugucuccacagccacacaaccagagggugcacaugacuugaucccuaugaccaagucaaguug

SEQ ID NO: 695048 - RNA, 63 nt, hsa
uguaagcaggagcacccugucuucucuggucuuugacuugauuaaaguaucuccgcuuucuug

SEQ ID NO: 695049 - RNA, 63 nt, hsa
uuuguacaaggacacuaagacaguguagccugcugacuugagaauguucuguaaggacuggaa

SEQ ID NO: 695050 - RNA, 63 nt, hsa
ggguaagugaagguuaauuccagaagagaggaaugacuugaaggcaaaggaaacuaaggaagg

SEQ ID NO: 695051 - RNA, 63 nt, hsa
aauuugaagggcaauugcgugugaaaauugaugugacuugauuuacacaauagucagaaaaca

SEQ ID NO: 695052 - RNA, 63 nt, hsa
auuuaaaaaaucaaauuuuucucuucaccuuuaugacuugacauuuccuugaucuguuggagg

SEQ ID NO: 695053 - RNA, 63 nt, hsa
auagggucauauugugaaugucucacuacaaaaugacuugaguccagugaaaucucauuaggg

SEQ ID NO: 695054 - RNA, 63 nt, hsa
gaguaacguacaaguauauuuucuaucuucuggugacuugagcuugagcucugacaggcaugg

SEQ ID NO: 695055 - RNA, 63 nt, hsa
uuccugagcaucuuauggaaauuaccccaccuuugacuugaagaaaccuucaucuaaagcaag

SEQ ID NO: 695056 - RNA, 63 nt, hsa
accaaaauaggcauccuuacaaaucaggaagacugacuugacacguuuguaaaugguagaacg

SEQ ID NO: 695057 - RNA, 63 nt, hsa
uugguaguggaauagugaauacuuacuauaauuugacuugaauauguagcucauccuuuacac

SEQ ID NO: 695058 - RNA, 63 nt, hsa
cgacucauucuccauuuugcuuugguuuugucuugacuugacuugacuuuggggguaaagucu

SEQ ID NO: 695059 - RNA, 63 nt, hsa
cauucuccauuuugcuuugguuuugucuugacuugacuugacuuuggggguaaagucuuucac

SEQ ID NO: 695060 - RNA, 63 nt, hsa
cuuugagcuuuagcuguuagaaaggaacccccgugacuugacacagcuuucacagcuggcugc

SEQ ID NO: 695061 - RNA, 63 nt, hsa
guuuaccauugaugacuucgccucugcaucuacugacuugauuuuucauucugccacuccauc

SEQ ID NO: 695062 - RNA, 63 nt, hsa
caccaccucuuugggccuggcucccugggaaugugacuugagcccagagugaacacucuuggu

SEQ ID NO: 695063 - RNA, 63 nt, hsa
gucaucuugccucccuaccuuccacaugccccaugacuugaugcaguuuuaauacuuguaauu

SEQ ID NO: 695064 - RNA, 63 nt, hsa
ugacauguauuuuuuugugacguguauuuuuugugacuugaagcuaucauauagauccuguau

SEQ ID NO: 695065 - RNA, 63 nt, hsa
ugugcacuaugagauuggagaaaugaauuaaguugacuugaaauuauuuuacuuuuauuaauc

SEQ ID NO: 695066 - RNA, 63 nt, hsa
gacauuugaauuaauguaaauauauguaaucugugacuugauauuuuguuuuauuuggcuauu

SEQ ID NO: 695067 - RNA, 63 nt, hsa
ucucccaaaugacugucucuaucuucaugagugugacuugagguguugggaugggugagggag

SEQ ID NO: 695068 - RNA, 63 nt, hsa
uuccugaugcuugacuaauugagguguuaauucugacuugagaaucuuuuucaugaaugauuu

SEQ ID NO: 695069 - RNA, 63 nt, hsa
auauauacauauauauauauacacauauauauaugacuugaaaauuaagauuuaauacuuuaa

SEQ ID NO: 695070 - RNA, 63 nt, hsa
aauugaucaaacugauggauacccuaaguacccugacuugaucauuacaccuucuaugcaugc

SEQ ID NO: 695071 - RNA, 63 nt, hsa
uuuagcuuugcuuuugaaauacauuguaagauuugacuugagguuuuugacacuuaaguacau

SEQ ID NO: 695072 - RNA, 63 nt, hsa
ccuuucugcaaagugcacugaauugcugaaaguugacuugagucuuguccuauuccucaguuc

SEQ ID NO: 695073 - RNA, 63 nt, hsa
ggacuuggcuuucuuacaugaugcgguaacuugugacuugagucuuuuucccuaauuugcuag

SEQ ID NO: 695074 - RNA, 63 nt, hsa
uuucaggguuuuaaacacuaaucacaaacugaaugacuugacuucaaaagcaacaaccuuaaa

SEQ ID NO: 695075 - RNA, 63 nt, hsa
aauuuuaaucagcucccucauuuauuaacucucugacuugaugcaaguuacuuaaccucucug

SEQ ID NO: 695076 - RNA, 63 nt, hsa
aaucaaaucacaaauguuuaaccacuuugcugcugacuugaguuauuuauccaaauauauuaa

SEQ ID NO: 695077 - RNA, 63 nt, hsa
aguaugugcuauaaguagaggagcgcuaacuccugacuugagcuaauuaugaaaaugcagccc

SEQ ID NO: 695078 - RNA, 63 nt, hsa
gagguuucucuuuaaugcauuuugcguguuugcugacuugagcauuuuugauuaguucgugca

SEQ ID NO: 695079 - RNA, 63 nt, hsa
uguaagguucagcagcucugguuucuauuacggugacuugaaugucagauucaagggcccggc

SEQ ID NO: 695080 - RNA, 63 nt, hsa
agccuccuccuccuuuuuuuuuuuuucccaaguugacuugacuuugcuuuuuuccccccaagu

SEQ ID NO: 695081 - RNA, 63 nt, hsa
ugaggaggagagagugaggguuuugcuauugacugacuugaacgauggcuucuccucaagcug

SEQ ID NO: 695082 - RNA, 63 nt, hsa
accauuguuuauaaacaguuaugaaaaaugcugugacuugaaaucuuucccacaucucccaag

SEQ ID NO: 695083 - RNA, 63 nt, hsa
uagcauagacauuaaagauaacucucuggaaaaugacuugacuaaggcucucaugaaauucaa

SEQ ID NO: 695084 - RNA, 63 nt, hsa
cauucuucugacucuagaugggacacuugacagugacuugaaacauuugcauauucaggaaug

SEQ ID NO: 695085 - RNA, 63 nt, hsa
gcacagccagcuucucugaccaguaauccggggugacuugagggucugcaaaggcauagaacu

SEQ ID NO: 695086 - RNA, 63 nt, hsa
uacaaaauucuugagcaucugcaaacuaaaaauugacuugagguuuuuuuuuuccuagucauu

SEQ ID NO: 695087 - RNA, 63 nt, hsa
cuggaaaguugggucuuuuucccuuacauugggugacuugauuggcccccucucaugauuccu

SEQ ID NO: 695088 - RNA, 63 nt, hsa
ggcaccugccuguuuuuguuggugcacagagauugacuugauucagagagacaauucacucca

SEQ ID NO: 695089 - RNA, 63 nt, hsa
uagcuuccaugccuauaaagucugguaccagacugacuugaaauucauaaacaaguuguccaa

SEQ ID NO: 695090 - RNA, 63 nt, hsa
augggauuccuauugugaagucauuuaaaauaaugacuugaauuucucagaaauuucaggagc

SEQ ID NO: 695091 - RNA, 63 nt, hsa
caaauggaacauuucauuauaacgugaucacuuugacuugagcaaaugguuuaauuuuuaucu

SEQ ID NO: 695092 - RNA, 63 nt, hsa
aaaauauuauaaaucuauagaaaauaaacuguuugacuugaaucauuucugaauaaguaaauc

SEQ ID NO: 695093 - RNA, 63 nt, hsa
ggaacuauaaaucacuaggcgguugccuuguuuugacuugagacacccaagaggaacagucau

SEQ ID NO: 695094 - RNA, 63 nt, hsa
aguucagggaggcccuucccacccugugaggcuugacuugaucuggauuggggaugacaggaa

SEQ ID NO: 695095 - RNA, 63 nt, hsa
ugaauauucugacucugaaagaagacagucccuugacuugaaguaaugguacagacuggcucc

SEQ ID NO: 695096 - RNA, 63 nt, hsa
cauuaccaggcacuccgccacccacaugccaacugacuugaugcuuaauaaaacugcugcugc

SEQ ID NO: 695097 - RNA, 63 nt, hsa
cauuaauacagauugaaguauuuuauucuuuuuugacuugaaaaauuauauuucauauugcaa

SEQ ID NO: 695098 - RNA, 63 nt, hsa
ugcugaacauuauguagcagaccugcuuaacuuugacuugaaauguaccugaugaacaaaacu

SEQ ID NO: 695099 - RNA, 63 nt, hsa
cuaauuggaaauuuucccaauaccccaccgugaugacuugaaauauaaucagcgcuggcaauu

SEQ ID NO: 695100 - RNA, 63 nt, hsa
auauuaaauaugugagugacaauaaaacaauuuugacuugaaucuuacucuguucuucuuugu

SEQ ID NO: 695101 - RNA, 63 nt, hsa
cagccccuuuuuacuggggcaguuucguuauuuugacuugaugccuuuugaauaacuuucaau

SEQ ID NO: 695102 - RNA, 63 nt, hsa
aauuuucccugaauguuuaaagaucaugacauaugacuugaucuucugggagcaggaacaaug

SEQ ID NO: 695103 - RNA, 63 nt, hsa
uuuaaaacucaaucagucuuuccuuugagcuagugacuugaaaagaaagagagaaggaaaaga

SEQ ID NO: 695104 - RNA, 63 nt, hsa
uuuugcacugaagauagagaccaccuuuuugagugacuugagcccaaaggcaagcguauauca

SEQ ID NO: 695105 - RNA, 56 nt, hsa
acucgcccaagugugacugacuaccuugacuugaaaugcucuuuugcacaaggaaa

SEQ ID NO: 695106 - RNA, 63 nt, hsa
gguccuucccugauggccuuuggacccagggccugacuugagccacuccuuccuucaggacuc

SEQ ID NO: 695107 - RNA, 63 nt, hsa
aauugaauuuucucccuaauaagauuauuaauuugacuugaaaacugcuggaacaauagugau

SEQ ID NO: 695108 - RNA, 63 nt, hsa
cuuuccccaccauuugaaucugggcuggcacugugacuugauuugaucaauagaauguggaag

SEQ ID NO: 695109 - RNA, 63 nt, hsa
uggcaccuagguaagagcagagcugcggcucggugacuugauacuuggggcagcccgaugcug

SEQ ID NO: 695110 - RNA, 63 nt, hsa
uuccuguuuuucuuucugcuaucuguuggugccugacuugauggccucauuuggggaaaagug

SEQ ID NO: 695111 - RNA, 63 nt, hsa
gaggggugggggucccaggacgugccucauacaugacuugagcuugucaguccacugaguuuc

SEQ ID NO: 695112 - RNA, 63 nt, hsa
guuucaugaauagaauauccaauagagauaagcugacuugaaucauuuugagcaauuuugccc

SEQ ID NO: 695113 - RNA, 63 nt, hsa
uugaacauucaugacugaacugaaaacaagccaugacuugagaaacaaauaauuuguauaccc

SEQ ID NO: 695114 - RNA, 63 nt, hsa
aaaccuuucuggccuguuaugauucugaacauuugacuugaaccacaagugaaucuuucuccu

SEQ ID NO: 695115 - RNA, 63 nt, hsa
aauaugcauuuaagguuccuccaugucuuuuugugacuugauagcucauuuuuuauugcugaa

SEQ ID NO: 695116 - RNA, 63 nt, hsa
ggauggagccaaccuggguauucacaacaggccugacuugauacuaagugauuaguuuuccaa

SEQ ID NO: 695117 - RNA, 63 nt, hsa
guagagcugagagaaacaggcucucaggguaccugacuugaggggaaucguuucaugaagcug

SEQ ID NO: 695118 - RNA, 63 nt, hsa
ugacuucauauacguaagacuggugccuaagaaugacuugaauguuaucaguacuaccacaga

SEQ ID NO: 695119 - RNA, 63 nt, hsa
uuguuaagaccugucuacauuguuauaugugugugacuugaguaauguuaucaacguuuuugu

SEQ ID NO: 695120 - RNA, 63 nt, hsa
ccaucaacagcuaauuaauccaaagauaguauuugacuugauuggaaaauguuaggauggacc

SEQ ID NO: 695121 - RNA, 63 nt, hsa
gcccaugcuaaugguagccacccugguucuuguugacuugagggaccuggcugucuucccugu

SEQ ID NO: 695122 - RNA, 63 nt, hsa
agauggaacaauaaaagacguugccuauaacagugacuugauugccaaggaauguaaauuacc

SEQ ID NO: 695123 - RNA, 63 nt, hsa
ccuuuuuuuccccuagauuaaggauacuuuccuugacuugagacuuguggucuucaggaaaac

SEQ ID NO: 695124 - RNA, 63 nt, hsa
agccuccaaaagaaaccagcccugcccacgccuugacuugagcccauugaaacugaucuugag

SEQ ID NO: 695125 - RNA, 63 nt, hsa
gccccuaaaaggaccuguuuuuaucuaccugugugacuugaaguggccauaugcugucagggg

SEQ ID NO: 695126 - RNA, 63 nt, hsa
guguacaggguccuuuugcaauaaaacugguuaugacuugauccaaguguuuaacaauugggg

SEQ ID NO: 695127 - RNA, 63 nt, hsa
agaaauccucaugccuuucaagacuucugugaaugacuugaauuuuuuauucccugccuaggg

SEQ ID NO: 695128 - RNA, 63 nt, hsa
agaaacagaaaagaaagacguucuugauuuuggugacuugacuuauggaggcuggaaagcccu

SEQ ID NO: 695129 - RNA, 63 nt, hsa
gccucuaugaucuuagcucauaaaaauauaauaugacuugauaaagcaacuaaacucuuucca

SEQ ID NO: 695130 - RNA, 63 nt, hsa
uugucagcugccaauagcaaaugaaguuaugggugacuugaaauaccaaaaccugaggagugg

SEQ ID NO: 695131 - RNA, 63 nt, hsa
uaaauuacuccagugaauaauagcaguauaauaugacuugauaauauuuuuguaaacuuguag

SEQ ID NO: 695132 - RNA, 63 nt, hsa
ggucuguaguugacuccaagucucugugagcagugacuugaaccaaacacaccaggaauaauc

SEQ ID NO: 695133 - RNA, 63 nt, hsa
guuccagcuacuugggaggcugaggugggaaaaugacuugagcccaggaggaggaggcugcag

SEQ ID NO: 695134 - RNA, 63 nt, hsa
aauuuauugaauuuuacuguuacacauaguuuuugacuugaauuaaaauacuagacaaagcag

SEQ ID NO: 695135 - RNA, 63 nt, hsa
aaauucauagagaagagaauagaguggaugaugugacuugaaguuuuugcagcuuauuuuuuc

SEQ ID NO: 695136 - RNA, 63 nt, hsa
gagaauuguaacauagcaugacaaauuuuguguugacuugaaaggaaucacaccauuauuccu

SEQ ID NO: 695137 - RNA, 63 nt, hsa
cuugugugcuagauuaaaagugagacagagacuugacuugauccucugagcucaagcuauuga

SEQ ID NO: 695138 - RNA, 63 nt, hsa
uucuuccuaacauuggucagcagaugacacuggugacuugacccuuccuagacaccugguuga

SEQ ID NO: 695139 - RNA, 63 nt, hsa
guuccagcuacucaggaggcugaggugggaggaugacuugaacgcaggaggcugaggcugcag

SEQ ID NO: 695140 - RNA, 63 nt, hsa
ccugcccugagcggggaugcaguguugcacugaugacuugaccagccccucccccaauaaacu

SEQ ID NO: 695141 - RNA, 63 nt, hsa
ucccugccaccccuccuaguggggacuagugaaugacuugaccugugaccucaauacaauaaa

SEQ ID NO: 695142 - RNA, 63 nt, hsa
acuggcaggaagcacaccgggguuaacacugguugacuugaauaggauuauucgauuuuuaaa

SEQ ID NO: 695143 - RNA, 63 nt, hsa
uccuuuguuccaaagggaaaaaauugacagcagugacuugaaaaugauucugcucccuuugaa

SEQ ID NO: 695144 - RNA, 63 nt, hsa
cuagguccggugccaauaaauccuuguggaaucugacuugaggggcagugaaggcagucuugg

SEQ ID NO: 695145 - RNA, 63 nt, hsa
aagcauuaauugacauuggagucaauucagcauugacuugaguuuguguugacuuaacauuga

SEQ ID NO: 695146 - RNA, 63 nt, hsa
aagcuuuaauugacauuagagccaaauaggcauugacuugagauugaguugacuuaaccuuga

SEQ ID NO: 695147 - RNA, 63 nt, hsa
gcuguguucccuuguuggugaggaaauuaauuaugacuugauaaauagaacauguuuuaagaa

SEQ ID NO: 695148 - RNA, 63 nt, hsa
gaccuuguuggugagaaaauuaaacuuuacauuugacuugauuuguuuuagaaagucuaggga

SEQ ID NO: 695149 - RNA, 63 nt, hsa
gacugcuugggcucaaguccuggcucugcugcgugacuugagcaaguuaauuccucucucugu

SEQ ID NO: 695150 - RNA, 63 nt, hsa
gcccgcggauugaaaaacagaaacacaaaacuuugacuugacuugcgaagugaagcaggguuu

SEQ ID NO: 695151 - RNA, 63 nt, hsa
caguugccuuuuuuuuuuuuucguacucaucacugacuugaagcuuaguaucuggcuuccuua

SEQ ID NO: 695152 - RNA, 63 nt, hsa
gcacaucuccccuucccuaacaguuccuguucuugacuugaagagaauugacccgugggggac

SEQ ID NO: 695153 - RNA, 63 nt, hsa
aucucagcacuuuggguggccaaggcgggcagaugacuugaggucaggaguucgagaccagcc

SEQ ID NO: 695154 - RNA, 63 nt, hsa
aagcauuaauugacacuagagucaguccagcauugacuugaguuuguguugacuuaacauuga

SEQ ID NO: 695155 - RNA, 63 nt, hsa
cccccagguuggggcuggguccacccuguccuaugacuugaucacuuuugcacauucccuggc

SEQ ID NO: 695156 - RNA, 63 nt, hsa
acacagaguauuauuacuuuugccagguuuuucugacuugauuucuguaauuuccagaaaccc

SEQ ID NO: 695157 - RNA, 63 nt, hsa
auucgggcuuguguucucccucucauuuuagucugacuugacuauuguuuuuccuuucuggcg

SEQ ID NO: 695158 - RNA, 63 nt, hsa
uucacagaaaaagcaugaugggaaaauauuuccugacuugaguguuccuuuuuaaaugugaau

SEQ ID NO: 695159 - RNA, 63 nt, hsa
ccgacuucaucccaaaggacagccgccuggagaugacuugaggccuuacuuaaacccagcucc

SEQ ID NO: 695160 - RNA, 63 nt, hsa
ugaguuucuggagaauuuuuggauggugauuaaugacuugacuggcugcucuucccagagcug

SEQ ID NO: 695161 - RNA, 63 nt, hsa
cccacucacuaccuuggcgucguuuuuugggucugacuugacucgucaacugcuggucucucc

SEQ ID NO: 695162 - RNA, 63 nt, hsa
gucagaacugaagaguaaaucuacuuguuuaaaugacuugacagugguagugcuccauuuaau

SEQ ID NO: 695163 - RNA, 63 nt, hsa
cugucccugccgcggccccagccuugaccuguuugacuugagcgagagggaggaagggcgcgc

SEQ ID NO: 695164 - RNA, 63 nt, hsa
aacaaaaaaugguuaaaugaggucugcugaaguugacuugaaaacacacuugacccucaggca

SEQ ID NO: 695165 - RNA, 63 nt, hsa
gcaucucuauaucuagauauggacauaguaaaaugacuugaaacauuucuauaauaucuaccu

SEQ ID NO: 695166 - RNA, 63 nt, hsa
aucgagcacugucagaaucuggugggcagccccugacuugaaccacucccacgugcugccucc

SEQ ID NO: 695167 - RNA, 63 nt, hsa
uaacccaucggcaucuuccaggaauccgccgagugacuugaggaagaugcuaacgcaguaagg

SEQ ID NO: 695168 - RNA, 63 nt, hsa
ccucuccgcaaggugguagcaggaaaagguccuugacuugaugaauuuggucugccucugagc

SEQ ID NO: 695169 - RNA, 63 nt, hsa
ugagcauggagcugucaccucucagcugcuggaugacuugagaugaaaaaggagagacaugga

SEQ ID NO: 695170 - RNA, 63 nt, hsa
gugaguggggacccaugauguaugggucucaccugacuugaggugaauuuuggagugaagggc

SEQ ID NO: 695171 - RNA, 63 nt, hsa
aggauagguggcagggcagaaacugggcagcccugacuugauagcagcagggggagcucccaa

SEQ ID NO: 695172 - RNA, 63 nt, hsa
gaaaaaaaggggaaguuggggauaggcagauguugacuugaggaguuaaugugaucuuugggg

SEQ ID NO: 695173 - RNA, 63 nt, hsa
guaaugguaccauauauuuuuuaaaauacauauugacuugaauugugaggcaauaagauaccu

SEQ ID NO: 695174 - RNA, 63 nt, hsa
aucugacaaaacuggcaacaucuuacagacuacugacuugaagacaaccucuuuuauauuucu

SEQ ID NO: 695175 - RNA, 63 nt, hsa
uucauuuuauugucuuaguuuguauauuuucugugacuugaaauaaacuuugaacacaauuuu

SEQ ID NO: 695176 - RNA, 63 nt, hsa
ggguuuuuguguguaugugauuuucaaaauucaugacuugaagugcaaggacagaucuagaug

SEQ ID NO: 695177 - RNA, 63 nt, hsa
ugguuugucccagucuaacguguugauaaaaugugacuugacgguugagacaaaaaauacagu

SEQ ID NO: 695178 - RNA, 63 nt, hsa
caaauacagguuuucugacauuaacuuaugugaugacuugaucgaggcaggcuuuuccagcau

SEQ ID NO: 695179 - RNA, 63 nt, hsa
gaaacuaauaaugaaaaagcauagcuguuaaacugacuugauuuuuuucuuaucaauauuuuc

SEQ ID NO: 695180 - RNA, 63 nt, hsa
auuaugaauggccuacuguucuauuauuuguuuugacuugaauuuauccaccaaagacuucau

SEQ ID NO: 695181 - RNA, 63 nt, hsa
aguguucauugucauugaccucagcagcaaauuugacuugaauucacuuaggaucgcaggaau

SEQ ID NO: 695182 - RNA, 64 nt, hsa
aggccagugucuuccucaccugggugggucccacacuugugaccucaguuuuaggaccaagauc

SEQ ID NO: 695183 - RNA, 64 nt, hsa
gauucuuuaccaggcugugagccaguguuagauaacuugugaauggauauaaguuacuuuuaac

SEQ ID NO: 695184 - RNA, 64 nt, hsa
cuugacuugaccauaagaucauggaaaacagaugacuugugaaccccacaguguggaugugcaa

SEQ ID NO: 695185 - RNA, 64 nt, hsa
uuugaccugccagccucucauuucuucucccuccacuugugagcgcccccagcuuugcggcgcc

SEQ ID NO: 695186 - RNA, 64 nt, hsa
uuugcauuuccucugcccuuuuaacuaaacuaaaacuugugaauuuuaaauuauuaaggggggg

SEQ ID NO: 695187 - RNA, 64 nt, hsa
aucggauucccagaggugaaucagcuccucuccuacuugugacuagagggugguggagguaagg

SEQ ID NO: 695188 - RNA, 64 nt, hsa
ugagacugaaaauaauauagaaaaucucauugcuacuugugauuaucaaaaaaaguauguauuu

SEQ ID NO: 695189 - RNA, 64 nt, hsa
uuguaagcugcuaugcaaaugggcauuuauauaaacuugugauguuucuugucagaauucugag

SEQ ID NO: 695190 - RNA, 64 nt, hsa
cccugccacuguaauaucuauaaguacuuaagagacuugugagcaaaacauacuauuuauaaca

SEQ ID NO: 695191 - RNA, 64 nt, hsa
cugacucuguacugcucaguuucacucacaggaaacuugugacuuguguauuaucgucauugag

SEQ ID NO: 695192 - RNA, 64 nt, hsa
uggaauuugccuacugaaauaguuauagaugauuacuugugaugugaaacugaauugagcauga

SEQ ID NO: 695193 - RNA, 64 nt, hsa
caguggugcguuuauaauuggcuuaaagggauggacuugugauuggcugcaggaagaaacuuuu

SEQ ID NO: 695194 - RNA, 64 nt, hsa
ccaccuccuagaggugggcagcugggccccaccuacuugugacugaaggggcacaccacugccc

SEQ ID NO: 695195 - RNA, 64 nt, hsa
cauaguacuacuuauacuuacaguaguaaguuauacuugugagcccacagaguggcagacagca

SEQ ID NO: 695196 - RNA, 64 nt, hsa
ugcucccuucgaaggcccagauaagacagggaacacuugugagcacacagagcagcaucugaug

SEQ ID NO: 695197 - RNA, 64 nt, hsa
uuaaucuugcuucuucaucaggucuuucuccuguacuugugaucagaaauuaccuuugacgugc

SEQ ID NO: 695198 - RNA, 64 nt, hsa
cuuacaaauuccagcaugugacuuuggugccguuacuugugaaaaaucuauucuguugucuuug

SEQ ID NO: 695199 - RNA, 64 nt, hsa
acuauuucggccuuuugggggugggucuggccguacuugugauuucgaugguacgugacccucu

SEQ ID NO: 695200 - RNA, 64 nt, hsa
acugccuaccuuagcuaaccagaauuguucauagacuugugauaauaugguguuaugggaaaac

SEQ ID NO: 695201 - RNA, 64 nt, hsa
acucccucccgcucucucaaaaggaacuugggaaacuugugaaacccaggaaaaccuuuagucu

SEQ ID NO: 695202 - RNA, 64 nt, hsa
uuuucaucauuuuuguuuccuuuucuugaaucagacuugugauuuggggagagcaacuucaggg

SEQ ID NO: 695203 - RNA, 64 nt, hsa
cccuccaaaacaugacauaaacaauauuuuuugcacuugugauccuuggccccuuuccccauuc

SEQ ID NO: 695204 - RNA, 64 nt, hsa
ucuguucugccagagauggaaaaaauacagguauacuugugauauagucauggggcuucagugu

SEQ ID NO: 695205 - RNA, 64 nt, hsa
aauuugaggugaaugguuccuuauugucuaggccacuugugaagaauaugagucaguuauugcc

SEQ ID NO: 695206 - RNA, 64 nt, hsa
ggcuuagugauguaauuaugguuaguagagguacacuugugaauaaagaggguggguggguaua

SEQ ID NO: 695207 - RNA, 64 nt, hsa
aagucaguacuccuguugcggagaaaggagucauacuugugaagacuuuuaugucacuacucua

SEQ ID NO: 695208 - RNA, 64 nt, hsa
agagguccggguuuaguauaugucuugagaggagacuugugaauucccagacucugccuccugg

SEQ ID NO: 695209 - RNA, 64 nt, hsa
ccacuucaccuacaauauuguuaacuauuuguuaacuugugaauacgaauaaaugggauaaaga

SEQ ID NO: 695210 - RNA, 64 nt, hsa
guaaaacuugguugcauuauuuguggaggcucaaacuugugaagguuaauaccauaauuuuucc

SEQ ID NO: 695211 - RNA, 64 nt, hsa
cugucaagaguaucaaaugccaugcagcacuuaaacuugugauaaggaagaugaagggucuuca

SEQ ID NO: 695212 - RNA, 64 nt, hsa
gugggguuaugaaauuguagauguuuuuagaaaaacuugugaaugaaaaugaauccaaguguuu

SEQ ID NO: 695213 - RNA, 64 nt, hsa
cacguggauuucccagcugccccuaaauauauauacuugugaguggcaaaguggcacuaaugaa

SEQ ID NO: 695214 - RNA, 64 nt, hsa
aaguaccaaauaauaauaaugcuauacuuaaauuacuugugaaaaacaacacauuuuaaagauu

SEQ ID NO: 695215 - RNA, 64 nt, hsa
auguuaccucaucuucuuuuuuaaacuguacccaacuugugaggguacucugucuaauguauau

SEQ ID NO: 695216 - RNA, 64 nt, hsa
ucauuuuuccaggacaguuggauauugucaggccacuugugaccccagccauguagugagggug

SEQ ID NO: 695217 - RNA, 64 nt, hsa
auuccauuauguuuuaauguugucucugaagaugacuugugauuuuuuuuucuuuuuuuuaaac

SEQ ID NO: 695218 - RNA, 64 nt, hsa
gcaagcugacuuuuguaaugugcucaauacaaauacuugugaacuuuuaauauguugagugcuu

SEQ ID NO: 695219 - RNA, 64 nt, hsa
ugccccaugcuuaugguccccagcauuuacaguaacuugugaauguuaaguaucaucucuuauc

SEQ ID NO: 695220 - RNA, 64 nt, hsa
uuugagauugcuuacaccgugacaagaugccaucacuugugauguuaugaacuguuauaaacuc

SEQ ID NO: 695221 - RNA, 64 nt, hsa
cugguacaguguucugcuugauuuacaacauguaacuugugacuguacaauaaacauaagcaua

SEQ ID NO: 695222 - RNA, 64 nt, hsa
uggaagaaaggaucccccgugacggcucugccccacuugugaacgccaacccucagugcuuagc

SEQ ID NO: 695223 - RNA, 64 nt, hsa
aggguauccagcuguagauguucuuaucccccauacuugugaguucuugggguugcucacaaau

SEQ ID NO: 695224 - RNA, 64 nt, hsa
cuuaauccguuucuggaggaagaguaugacacccacuugugaugggguccuugugcggugggga

SEQ ID NO: 695225 - RNA, 64 nt, hsa
auguauuacuuugaauucagauuaauguucuacuacuugugacugagaaaaguuuaaugccggc

SEQ ID NO: 695226 - RNA, 64 nt, hsa
aagccaaguaaagguacuggguguuuuugugaccacuugugaauggguguauggagaacugaaa

SEQ ID NO: 695227 - RNA, 64 nt, hsa
uucauuuuaggcuauuggcuacugaguaaacuugacuugugagggguuuuuauuuuuacucauu

SEQ ID NO: 695228 - RNA, 64 nt, hsa
aauagacugagaauugagccuuaacuucagauuaacuugugagaaucaggaaaauuccuucaac

SEQ ID NO: 695229 - RNA, 64 nt, hsa
cugcauccaguuguucucggucauacuuuugaccacuugugacuggaguucaguggcccuggca

SEQ ID NO: 695230 - RNA, 64 nt, hsa
uaucuuguuuuucuauguauuucuuucugacuagacuugugauaugcguguguuuauguacaga

SEQ ID NO: 695231 - RNA, 64 nt, hsa
aggaguuggauuuguuaugucuguugcagugaggacuugugauucacugguaugaagaauuuuu

SEQ ID NO: 695232 - RNA, 64 nt, hsa
uguuauuccuuuguguccauguuauuucacucccacuugugagaacauggaauauuugguuucc

SEQ ID NO: 695233 - RNA, 64 nt, hsa
guuggugguguacagaacacacuuaaguguguuaacuugugacuucuuucaagucuaaaugauu

SEQ ID NO: 695234 - RNA, 64 nt, hsa
gagugagucuccccuuaauuagacugcaaaugucacuugugaugagugugccauuccaggauaa

SEQ ID NO: 695235 - RNA, 64 nt, hsa
cuuuucuuuauguaauugaugguuauugaaagguacuugugaagaaaauuauuuuaauugguau

SEQ ID NO: 695236 - RNA, 64 nt, hsa
agauugucaauuaaaaaugaguuuaaaauguuuaacuugugaucgagaccuacaugcaugucuu

SEQ ID NO: 695237 - RNA, 64 nt, hsa
cuucagccuggcaaguuacauguagaaagcccacacuugugaagguuuuguuuuacaaaucacu

SEQ ID NO: 695238 - RNA, 64 nt, hsa
guacagaauuaguacuuggugguuacuaacaucaacuugugacaucuagaacuagggcucuuag

SEQ ID NO: 695239 - RNA, 64 nt, hsa
cauuugucauauuaagaaaaaaaguuuaucuagcacuugugacauaccaauaauagaguuuauu

SEQ ID NO: 695240 - RNA, 64 nt, hsa
ugcuuguaaugcucacuuauguuuucucuguauaacuugugauuccagggcuguuugucaacag

SEQ ID NO: 695241 - RNA, 64 nt, hsa
aaaauggggccgcugaugugcaauaucaaagugaacuugugaguauuuuguguguguugaucuc

SEQ ID NO: 695242 - RNA, 64 nt, hsa
caaucuacuuuguuuaaaaaaggucugaaucaggacuugugaaaaccuguagugaaauaccuua

SEQ ID NO: 695243 - RNA, 64 nt, hsa
aagaagaaaacaaauaugacaguaugguagcuauacuugugaugucugacgcaugauggccuau

SEQ ID NO: 695244 - RNA, 64 nt, hsa
uggauauauaagagcaugaaauuuuuaaaaauacacuugugauuauaaaauuaaucacaaauuu

SEQ ID NO: 695245 - RNA, 64 nt, hsa
aaaggguaugaaagugccugccuuguuuauagccacuugugaguaaaaauuuuuuugcauuuuc

SEQ ID NO: 695246 - RNA, 64 nt, hsa
ugcggcuccuuagggcagaacagcugcauguggcacuugugacacucacucacccuucagggga

SEQ ID NO: 695247 - RNA, 64 nt, hsa
guguggcauugggcaaguaacuuuaccucucuggacuugugauaauaaaaguuccuaccucaug

SEQ ID NO: 695248 - RNA, 64 nt, hsa
ucuuugaaauuagcaccuuuguuauuuauguuguacuugugaaaacaguaaaauaguuuggaua

SEQ ID NO: 695249 - RNA, 64 nt, hsa
ccaaacuuuuauauaauauacagaaggcuaucacacuugugaaauucucuugucuaaucugaau

SEQ ID NO: 695250 - RNA, 64 nt, hsa
aaugugaauagccacaucuuaccuguaaagucuuacuugugauugugccaaacaaaaaaugugc

SEQ ID NO: 695251 - RNA, 64 nt, hsa
aagucaacuguggcaccaauucuaauguaauccaacuugugacuguuuuuuuuuguuuuguuuu

SEQ ID NO: 695252 - RNA, 64 nt, hsa
uguugaaauaagaaauacuuaauauugucaaauaacuugugauugucuugccaucaauaaaaua

SEQ ID NO: 695253 - RNA, 64 nt, hsa
aacuuuagaaaaauauugaagacauuguauuaccacuugugauucaaacaauuuugugguuaaa

SEQ ID NO: 695254 - RNA, 64 nt, hsa
caugaaaaacccagacuggagacuggaggguuacacuugugauuuauuagucaggcccuucaaa

SEQ ID NO: 695255 - RNA, 64 nt, hsa
cuucuuccugcugcucugauucugcauuugugguacuugugacuacguuuuuucaaauauagau

SEQ ID NO: 695256 - RNA, 64 nt, hsa
auaguuugggccauuggugcaugcacauauauuaacuugugacuaaagacagacauugcuuaaa

SEQ ID NO: 695257 - RNA, 64 nt, hsa
cagcaccccugcgguaggagugccgccucuacccacuugugaugggguacagaggcacuugcuc

SEQ ID NO: 695258 - RNA, 64 nt, hsa
uuccuggagacagaagagccgucaucagugucucacuugugauuuuuaucuggaaaaggaagaa

SEQ ID NO: 695259 - RNA, 64 nt, hsa
auauacccccccaugcagucuaaaaugcuucaguacuugugaaacacagcuguucuucuguucu

SEQ ID NO: 695260 - RNA, 64 nt, hsa
uuuguuuuaaaccaaacuacccaguauuccuugcacuugugaauguguugcacucugcuggaug

SEQ ID NO: 695261 - RNA, 64 nt, hsa
ugcuguuuuuauuauacaucaguuucuuuguauaacuugugaguuccauguguuuuguuuuuau

SEQ ID NO: 695262 - RNA, 64 nt, hsa
cgcaaaauggacuuuucauuugucaaguauugggacuugugauuuuuaauuauccagcauauag

SEQ ID NO: 695263 - RNA, 64 nt, hsa
guaaauguuggcugagaacaaucccuccccuugcacuugugaaaacacuuugagcgcuuuaaga

SEQ ID NO: 695264 - RNA, 64 nt, hsa
acagaaagaagaugccagaugacacuuaagaccuacuugugauauuuaaaugaugcaauaaaag

SEQ ID NO: 695265 - RNA, 64 nt, hsa
aguuuguauaguuggaauauuugucuuuguaauuacuugugauguuuuaaaauaaaaauuuuau

SEQ ID NO: 695266 - RNA, 64 nt, hsa
uggaaauccuucccuuuuaaagagaaaaugugacacuugugaaaaggcuuguaggaaagcuccu

SEQ ID NO: 695267 - RNA, 64 nt, hsa
aaaccacuugcuacaugacccaugaaaacccuagacuugugaccugaaauaaagaaaauacguu

SEQ ID NO: 695268 - RNA, 64 nt, hsa
ccaucgccaaguaagaaagugaagcaaaucagaaacuugugaaguggaaauguucuaaaggugg

SEQ ID NO: 695269 - RNA, 64 nt, hsa
aaagaaguugaaggcagcauuccucagcucugugacuugugacccuauuugaaguuucaggauu

SEQ ID NO: 695270 - RNA, 64 nt, hsa
aguauguaagaaguuuuaacauuuacuucacaggacuugugauuguguuaaauucucacuauug

SEQ ID NO: 695271 - RNA, 64 nt, hsa
acagauaaauauuaauuuuauuauaguuuuaaguacuugugaucauguacuuuuugauucuaaa

SEQ ID NO: 695272 - RNA, 64 nt, hsa
acuaauguaagaaauuguuauucuacuaauauuuacuugugauugugugacaaguguguuuaca

SEQ ID NO: 695273 - RNA, 64 nt, hsa
caaggagcuccgcucuacaacugguuuuuuuaggacuugugaggaacacagcaacggaaaucca

SEQ ID NO: 695274 - RNA, 64 nt, hsa
gcaccuucagaggacagccuugauucacuuguaaacuugugaaaaucugaacauaggggaguga

SEQ ID NO: 695275 - RNA, 64 nt, hsa
gccuuuuucuacuugccugcugaagcuuuggagcacuugugauugcaguuuucugccgcaaccc

SEQ ID NO: 695276 - RNA, 64 nt, hsa
uguacacacagaggcacaugugcaugcacacacaacuugugaacacacauuucuguuaaagaag

SEQ ID NO: 695277 - RNA, 64 nt, hsa
uaucuuucacaguagaacuagaaacaaaacccuaacuugugaaguugcuauuuauuuuucccug

SEQ ID NO: 695278 - RNA, 64 nt, hsa
cugcacaagagcacugcaguguuuuucauaauaaacuugugaacuaagaacugagaaggucaaa

SEQ ID NO: 695279 - RNA, 64 nt, hsa
cauuuuuaaaaauaauuaccaaggccucccuucuacuugugaguuuugaaauuguucuuuuuau

SEQ ID NO: 695280 - RNA, 64 nt, hsa
agguguuuauuaggcuucaggaucuuucccaugaacuugugauaucauuuugaaacccuucaau

SEQ ID NO: 695281 - RNA, 64 nt, hsa
agaaugcaguguucugauaccagugccaucauacacuugugauggaugggaacgcaagagauac

SEQ ID NO: 695282 - RNA, 64 nt, hsa
uugccuuugugugugauuuuaguuccacaugaugacuugugaacauuagggauuuaaaggaaaa

SEQ ID NO: 695283 - RNA, 64 nt, hsa
uaguuuuuaggugguuuuauauaacauuuuaauuacuugugauuuagauguauccauccuuuuu

SEQ ID NO: 695284 - RNA, 64 nt, hsa
aggacaggagccuuauaggcaaugccccagacugacuugugagugggguuuauggggaaaggga

SEQ ID NO: 695285 - RNA, 64 nt, hsa
ccccauggagccagcucccucuauuuauguuugcacuugugauuauuuauuauuuauuuauuau

SEQ ID NO: 695286 - RNA, 64 nt, hsa
ccgcccuaggcuuccugacuccauuaguuccgacacuugugaaacuccgagaagugcugugguc

SEQ ID NO: 695287 - RNA, 64 nt, hsa
gcagaaaugugugaaaccaaaaugaucacugccuacuugugauucaaaucuucagaguuuuccu

SEQ ID NO: 695288 - RNA, 64 nt, hsa
agaaaaaaccuuuuacuauaugaaacuuuacaacacuugugaaagcaacucaauuugguuuaug

SEQ ID NO: 695289 - RNA, 64 nt, hsa
caauaggaugauuuacuauaaauuucauccaacuacuugugaucucucucaccuacaucaauua

SEQ ID NO: 695290 - RNA, 64 nt, hsa
auuuuacaguguuucaauccagccauaaaaauuaacuugugauuuuuuuuuucccaaagucaug

SEQ ID NO: 695291 - RNA, 64 nt, hsa
cuuucuuuagaucugugcagccuuugcgugccaaacuugugaaauuccuuuuaccuuuuuugga

SEQ ID NO: 695292 - RNA, 64 nt, hsa
ggcacugaauucgucaacucuuuuuugugagccuacuugugaauauuaccucagauaccuguug

SEQ ID NO: 695293 - RNA, 64 nt, hsa
uaugaagcaggugcuggaacaggcccuggccccuacuugugaagcugcagauauagguaagaua

SEQ ID NO: 695294 - RNA, 64 nt, hsa
ugguuuuaaguagaugaaacaaccagaaacuuuuacuugugauacucuaccaugaaggaugcgg

SEQ ID NO: 695295 - RNA, 64 nt, hsa
caguguucacaacuaagaauaaauaccuagagcuacuugugagugaaucauuggcuucuagaaa

SEQ ID NO: 695296 - RNA, 64 nt, hsa
guguaaaauauauguuuucuagaugauuucugagacuugugaugacaaggaaccugaccuaacc

SEQ ID NO: 695297 - RNA, 64 nt, hsa
uguaccgauauguuuaugcccauucuucuuguguacuugugacucuuagcagcauggaagagaa

SEQ ID NO: 695298 - RNA, 64 nt, hsa
gugaccauaagaaugucccuccccaaacaaguaaacuugugaaaguuuaauuuggaauuagugg

SEQ ID NO: 695299 - RNA, 64 nt, hsa
ucaugugguacauugaagccucuuuuacaugucaacuugugacaaauacaaacaugugagauuu

SEQ ID NO: 695300 - RNA, 64 nt, hsa
uaaugguaauucuaugcaaguuuggaauuggaugacuugugaagaggcaguuuucuuauuugag

SEQ ID NO: 695301 - RNA, 64 nt, hsa
uauuucuauuuauaauauucagcaaaagugaaagacuugugaagcauaugacauucuauuuuug

SEQ ID NO: 695302 - RNA, 64 nt, hsa
uucgagcuacaugcaucuagggcggagaggcugcacuugugagagaaaauacuauuucaaguca

SEQ ID NO: 695303 - RNA, 64 nt, hsa
uccauucagugacauccacagauuaugcagcuauacuugugaaaucgugcaugaggccccaggg

SEQ ID NO: 695304 - RNA, 64 nt, hsa
auugaauaccuguuaaagaaaaauuacagaauaaacuugugacuggucuuguuuuacauuauau

SEQ ID NO: 695305 - RNA, 64 nt, hsa
agauaaauggggccuuuaaaaauaugaaaaacaaacuugugaaaauguauaaaagaugcaucug

SEQ ID NO: 695306 - RNA, 64 nt, hsa
uuuuuuuucuguuuuauaguuugcgcugcaugguacuugugaagcuuaaauauuuugaguguuc

SEQ ID NO: 695307 - RNA, 64 nt, hsa
uuuaccaacaauuuuuaaugaaaaggaaaauuauacuugugauucucguagugacauuuauauu

SEQ ID NO: 695308 - RNA, 64 nt, hsa
ucaucaauugcgaugcucccacaacucuuuacagacuugugaaaucuucaagaacaccuuuacu

SEQ ID NO: 695309 - RNA, 56 nt, hsa
uaucugaagaucuggaaugagaacugacuugugaaaccucagcgugaagggacaua

SEQ ID NO: 695310 - RNA, 64 nt, hsa
cagugauuucuuaagcaauuugaucuguaccuuuacuugugaaagguaugcuauauaauucagc

SEQ ID NO: 695311 - RNA, 64 nt, hsa
cuucucagucuuuucaguuucaucauuugcacaaacuugugagcaucagagggcugauggauuc

SEQ ID NO: 695312 - RNA, 64 nt, hsa
cucugggauuugccuuccuucauguccucuacacacuugugauuccuauucgauauuauguacg

SEQ ID NO: 695313 - RNA, 64 nt, hsa
gggagacagucuaggaauggagucucccacugcaacuugugaacuccaucauucauccaggacu

SEQ ID NO: 695314 - RNA, 64 nt, hsa
caguguauugguaauuuaaauuauuucaguuuuaacuugugaaagcuuauauuaugauuucugg

SEQ ID NO: 695315 - RNA, 64 nt, hsa
gucacagaagaaaaccacaaacuuguuuuacuggacuugugaauuuuugaguacauacuaugug

SEQ ID NO: 695316 - RNA, 64 nt, hsa
cuguugaucggccauagggcuuccauggguggaaacuugugagggaguuuguauuaggucuggu

SEQ ID NO: 695317 - RNA, 64 nt, hsa
ccguaaauaaggggaaaaggcaguuagcucaaggacuugugacggauccacuuugguguucaag

SEQ ID NO: 695318 - RNA, 64 nt, hsa
auaccgcaaaugucaugagaaguuugauucaguaacuugugauggaggauucuuugguaucuua

SEQ ID NO: 695319 - RNA, 64 nt, hsa
gaauacuuagauuuguagcuuaaucacauucuagacuugugaguugaaugacaaagcaguugaa

SEQ ID NO: 695320 - RNA, 64 nt, hsa
gagauuguaagaaaagcauuuuuuaaaagguaucacuugugaucauuuaucuuucuaaauucua

SEQ ID NO: 695321 - RNA, 64 nt, hsa
ugcccacccuccccaacccacauaccuccauuccacuugugacacccccucgacucccugguga

SEQ ID NO: 695322 - RNA, 64 nt, hsa
guugucuauagcuaugucuauaaacaaccugaagacuugugaaaucaauguuucuuuuuuaaaa

SEQ ID NO: 695323 - RNA, 64 nt, hsa
cauacauauuaaaucaaaguauauucuuaaaaguacuugugaaguaaaaucuuucuugugcauu

SEQ ID NO: 695324 - RNA, 64 nt, hsa
acuuuuguuaaguuuuuucuuguaaauuuucuuuacuugugaguaucaucuuguccuuuaaucc

SEQ ID NO: 695325 - RNA, 64 nt, hsa
ugauaauaggaaaagaaaaggacaaaaguccucaacuugugagcaauaugcuuucccuuuacac

SEQ ID NO: 695326 - RNA, 64 nt, hsa
ucaucauuuugaauaggaaaaggaauguagcucaacuugugauaaaaaugaagaaaagagucua

SEQ ID NO: 695327 - RNA, 64 nt, hsa
uucagcuuuuuguuguuuuguucuuggcuauaauacuugugacucaugaagaauuauguugaca

SEQ ID NO: 695328 - RNA, 64 nt, hsa
gcagcaaucugaaaucaucucuagucuugcuuucacuugugagcaguugucuucuaugauccca

SEQ ID NO: 695329 - RNA, 64 nt, hsa
auauuguugaagaacacuuccuggaacacuucucacuugugaugcuguacuaauuuuuuuuuuu

SEQ ID NO: 695330 - RNA, 64 nt, hsa
gucaagauccugguucuuauggguccaugaacacacuugugaccuuaguacuuggucauccagc

SEQ ID NO: 695331 - RNA, 64 nt, hsa
cuuguagggaacuggaaccagcccacaacugcacacuugugagcugucauggaaaccugauccc

SEQ ID NO: 695332 - RNA, 64 nt, hsa
ucuuagaauaauuuugaaugagaucuaccgacucacuugugagaauauuuuucacagauuaucu

SEQ ID NO: 695333 - RNA, 64 nt, hsa
uuuuucuuuguaauuuguaauuacaguuuuuguaacuugugauuauguuuuuaacuaaauuuac

SEQ ID NO: 695334 - RNA, 64 nt, hsa
gccgaggcgccauggggcguugcaucagcaggacacuugugagagcuuugugucgcuucucacu

SEQ ID NO: 695335 - RNA, 64 nt, hsa
agagcuaaagagucugcagcaggauuggagacugacuugugacugcgggcugggggggcauucc

SEQ ID NO: 695336 - RNA, 64 nt, hsa
ccacuaacuccuauagacuccuggagcuagaagcacuugugauucuuguuuuaauuuacugaug

SEQ ID NO: 695337 - RNA, 64 nt, hsa
gaagguacuucagcuuaaucugaaauauaauuuaacuugugaacuccuuggauaugauauuauu

SEQ ID NO: 695338 - RNA, 64 nt, hsa
cccaggcuuccucuucuuguaguccaucucccagacuugugacuauggcuuuucauucuucaau

SEQ ID NO: 695339 - RNA, 64 nt, hsa
cucacacaggaaacuucccuauacuggcagauacacuugugacugaaccaugcccaguuuaugc

SEQ ID NO: 695340 - RNA, 64 nt, hsa
ucucugcuucacacucaugcugauggcugaucuaacuugugaagaaugcccagaagaaccucag

SEQ ID NO: 695341 - RNA, 64 nt, hsa
acuagaaauuuggagaaagaacacuaacacauguacuugugauuuguucauguuauauuaaaac

SEQ ID NO: 695342 - RNA, 64 nt, hsa
acagaaauacucuguacuucugagagaacacaucacuugugaggauauucauugugagguucua

SEQ ID NO: 695343 - RNA, 64 nt, hsa
cauuaggaacuuuagcaugucaaaaugaauguuuacuugugaacucgauagagcaaggaaacca

SEQ ID NO: 695344 - RNA, 64 nt, hsa
ugaagaccaagggucccccuuguuaccugcccaaacuugugacugcaucccucuggagucuacc

SEQ ID NO: 695345 - RNA, 64 nt, hsa
ugaguguccagucgugugcaugaauuucaccccaacuugugacugcucacuuaugacgucuccc

SEQ ID NO: 695346 - RNA, 64 nt, hsa
uugagauuuuugguuuuuugauuucuauucccuaacuugugaagacaaugaaaaaucaggcaga

SEQ ID NO: 695347 - RNA, 64 nt, hsa
uuguuuugauuccaucauuaaugcacuuguggagacuugugauaagcugcugcuccuauauuuu

SEQ ID NO: 695348 - RNA, 64 nt, hsa
uaauaaugcuuuauguuauacauuaaauguaaagacuugugaauccauguuugauugacuuuca

SEQ ID NO: 695349 - RNA, 64 nt, hsa
gauuuuuucccuuuuuaugugggauauaguaguuacuugugacaagaauaauuuuggaauaauu

SEQ ID NO: 695350 - RNA, 64 nt, hsa
uggccaucucuucuuugucuaccauuucaaauugacuugugaauacucagagcaguuauuuuuc

SEQ ID NO: 695351 - RNA, 64 nt, hsa
cuuucaacauccugaauguuagaagccuucauacacuugugaaauugguuauacaguuucaaaa

SEQ ID NO: 695352 - RNA, 64 nt, hsa
cagucaaauauccuuccuaaaaacaugucauuccacuugugaaagaaaacacaaugugcauguu

SEQ ID NO: 695353 - RNA, 64 nt, hsa
gcuuaaauaucaaagcaguugucauuuggaagucacuugugaauagaugugcaaggggagcaca

SEQ ID NO: 695354 - RNA, 64 nt, hsa
uaaauuuuguucuauaugaauaaaaaggcaaauuacuugugaucauucugaagugccaaaggag

SEQ ID NO: 695355 - RNA, 64 nt, hsa
ucugguugcuguagcuccugccggaggcaugucuacuugugaucccggacagccgaacccaaga

SEQ ID NO: 695356 - RNA, 64 nt, hsa
uaaugaugauuauggaaugaauuuuaaugucccuacuugugaauaauuagcuuucucaaaugua

SEQ ID NO: 695357 - RNA, 64 nt, hsa
ucaggccuauuuguguaggcccauggaaaucacuacuugugaaguagagaugccuuuuugucua

SEQ ID NO: 695358 - RNA, 64 nt, hsa
uaccauccucugggccaacuguggaagcugcugcacuugugaagaauccugagcuuugauuccu

SEQ ID NO: 695359 - RNA, 64 nt, hsa
ucucucuguuacacacuaacaucaauggcuuuguacuugugaugagagauaaccuugcccuagu

SEQ ID NO: 695360 - RNA, 64 nt, hsa
uaagaacugucuuuagauuuucuuuacuuugauaacuugugauuguuuagcuuaagacccaaga

SEQ ID NO: 695361 - RNA, 64 nt, hsa
caugucuucuuaauugcugaaccuuacugcaaaaacuugugauguaagaaauuuguauggugug

SEQ ID NO: 695362 - RNA, 64 nt, hsa
cugguaccuucuuuuuggcugagaucuuucuuuuacuugugauauauucauauuacucguuuau

SEQ ID NO: 695363 - RNA, 64 nt, hsa
cuguaaaaugugauuuuuuacuuccacuuauaauacuugugauuggggagguuuguggaaauuc

SEQ ID NO: 695364 - RNA, 64 nt, hsa
ucacugcacugcaugcaaacaagaaacgugucacacuugugacgucgggcauucauauaggaag

SEQ ID NO: 695365 - RNA, 64 nt, hsa
aaguguauguaacuugcuuuaaauccauuaugcuacuugugaggcagaagaguuuucugugaag

SEQ ID NO: 695366 - RNA, 64 nt, hsa
cagcugcccuugaggagcacaggcagaagugugaacuugugaauguaauugaucuuuccuuccu

SEQ ID NO: 695367 - RNA, 64 nt, hsa
cacuucaugaagccucuggaaaacucuacaguauacuugugagagaaugagagugaaagggaca

SEQ ID NO: 695368 - RNA, 64 nt, hsa
cuauggacagaacuacauucuuucucgcauagugacuugugacaauuuagacuuggcauccagc

SEQ ID NO: 695369 - RNA, 60 nt, hsa
aaaucauugaggucuccugagaagaaagacacuugugacuucuauagacaauuuuuuuuu

SEQ ID NO: 695370 - RNA, 64 nt, hsa
uucuuuguuuucauagcuguguucuguggaggucacuugugaaucaggcagugucauggcagcc

SEQ ID NO: 695371 - RNA, 64 nt, hsa
cuguauaauauuucccuuaaauaugcauuauuuuacuugugaguuuuuuacugaauuaaucuga

SEQ ID NO: 695372 - RNA, 64 nt, hsa
cauuucugcugagcagaguuggagccagagaucuacuugugacuuguuggccuucuucccacau

SEQ ID NO: 695373 - RNA, 64 nt, hsa
cguuucugcugagcagaguuggagccagagaucuacuugugacuuguuggccuucuucccacau

SEQ ID NO: 695374 - RNA, 64 nt, hsa
ucauuguguuagccgggauggucuugaucuccugacuugugauccgccugccucggccucccaa

SEQ ID NO: 695375 - RNA, 64 nt, hsa
gaguuguuucagugcuagaucuuaccagcuaaagacuugugauaccacuauauaguauaguugu

SEQ ID NO: 695376 - RNA, 64 nt, hsa
agcgcuucacuccagguugguagcuucuuuggagacuugugauaacccugucaucaagguccug

SEQ ID NO: 695377 - RNA, 64 nt, hsa
uuugguuuaucuucuuuugaacaaaugacaucaaacuugugagguguuugcauguggccauuac

SEQ ID NO: 695378 - RNA, 64 nt, hsa
aagauaggacuuggcuuucuuacaugaugcgguaacuugugacuugagucuuuuucccuaauuu

SEQ ID NO: 695379 - RNA, 64 nt, hsa
ucugaucuucaagcaagaaaauaagcaguguuguacuugugaauuuugugauauuuuauguaau

SEQ ID NO: 695380 - RNA, 64 nt, hsa
uagugucuaucuuuaucauaaccugaugucccaaacuugugacaaguucuuuuggcaacugaag

SEQ ID NO: 695381 - RNA, 64 nt, hsa
aucacaauuauuuuuaaacuuucuauuuucaaauacuugugauuaauaaggcauucuaugauga

SEQ ID NO: 695382 - RNA, 64 nt, hsa
ccuuugcugacaagguuuugucuguuucaguuauacuugugaauugugaucuaacugcagaaag

SEQ ID NO: 695383 - RNA, 64 nt, hsa
ucaggagacuuuguauuuagaauauucauguaaaacuugugaacaagcuuucauuuugaucaaa

SEQ ID NO: 695384 - RNA, 64 nt, hsa
aaaauauuguaccauugaagaguuuggauguguaacuugugaugccuuagaaaaauauccuaag

SEQ ID NO: 695385 - RNA, 64 nt, hsa
ugucagucucccucugccaaccuccuagaaggacacuugugauuacauuagggcucaccccuuu

SEQ ID NO: 695386 - RNA, 64 nt, hsa
ugacaugcuucucuccugauuguuuuuauuuuaaacuugugauaggcauaucuaugaaaccuuu

SEQ ID NO: 695387 - RNA, 64 nt, hsa
uaaguaaacaugauauaaaaauauaugcugaauuacuugugaagaaugcauuuaaagcuauuuu

SEQ ID NO: 695388 - RNA, 64 nt, hsa
uuugacauuucaaaucagugcucauauacaguaaacuugugauagaaauuguauuuuauugcuu

SEQ ID NO: 695389 - RNA, 64 nt, hsa
ccauuaaaaaaacauuuuauuuugcaaccauucuacuugugaaaucacgcugacccuagccugu

SEQ ID NO: 695390 - RNA, 64 nt, hsa
guauuucauguugcacacccacucagcuccgugaacuugugagaacacagccgauucaccugag

SEQ ID NO: 695391 - RNA, 64 nt, hsa
uuccccuucaagugcacuuguuaaacugugaugaacuugugauuuuguguuuuacuugaccaaa

SEQ ID NO: 695392 - RNA, 64 nt, hsa
aaauuuaaacacuugaaugucaucaugguauccaacuugugacucauagggucugaacucacuc

SEQ ID NO: 695393 - RNA, 64 nt, hsa
cugguaagauuuagaccuaaaucgcaucaugccaacuugugacuuugagacuauucaucaagaa

SEQ ID NO: 695394 - RNA, 64 nt, hsa
ucagucuugauaucugagcuaucugggcucccuuacuugugaguaagggaucaugcucaccacu

SEQ ID NO: 695395 - RNA, 64 nt, hsa
ucuuagaacuccaagauguuccauaaguguuuuuacuugugaggaaugagaagccauccaugga

SEQ ID NO: 695396 - RNA, 64 nt, hsa
acgggcucaaagcuggauuagaaaggggagaggcacuugugacuuuguuugacucugugacuca

SEQ ID NO: 695397 - RNA, 64 nt, hsa
ggccccuguauccagauauuggacuuacugcuauacuugugauacuggguagcccagacuuuga

SEQ ID NO: 695398 - RNA, 64 nt, hsa
ggaguccugagguggugauuuggccaguguuuuaacuugugacaaguacucaggugugaggaca

SEQ ID NO: 695399 - RNA, 64 nt, hsa
cuagaauuuccacuuuggagaauacucaguuccaacuugugauuccugauagaacagacuuuac

SEQ ID NO: 695400 - RNA, 64 nt, hsa
cuucuugucuuuuuguggguucaagagcccucugacuugugaagaauuugcugcccucuuaaga

SEQ ID NO: 695401 - RNA, 64 nt, hsa
augaagaguuguauguuuuuggagugcuggagugacuugugaauuucugaauauuuucccuuca

SEQ ID NO: 695402 - RNA, 64 nt, hsa
cucuuccucucuuuugcucauccaccuucacaccacuugugagcugacccccaggaacagcuug

SEQ ID NO: 695403 - RNA, 64 nt, hsa
cccugcaggaaaacugaggcccuugggcaccucgacuugugaacgaguuguuggcugcucccuc

SEQ ID NO: 695404 - RNA, 64 nt, hsa
aauuuuaucccauuuuuaauauuuuggucuagcaacuugugauacauagaugacaauuuuguga

SEQ ID NO: 695405 - RNA, 64 nt, hsa
ugugcuaaaccaaguuaagucccauucaguggcaacuugugauagguaccugagugacggcaac

SEQ ID NO: 695406 - RNA, 64 nt, hsa
ugcuucgauaaaggaauuuggaguuuaaaaaucaacuugugaaaacaagguuguuuuugucuuu

SEQ ID NO: 695407 - RNA, 64 nt, hsa
uugaaauccuucccuuuuaaggagaaaaugugacacuugugaaaaagcuuguaagaaagccccu

SEQ ID NO: 695408 - RNA, 64 nt, hsa
ucacuuuguuucuuacauguguacuuuuuuguuuacuugugaaaauggccaucuuuaagcauau

SEQ ID NO: 695409 - RNA, 64 nt, hsa
ugugucuuuaaaugcugcuuuuucucaaaaugggacuugugacgguguaccugaggcccccauc

SEQ ID NO: 695410 - RNA, 64 nt, hsa
caauauaauuggguuuuaaauaguauaaaagaaaacuugugaucuauauaauuuauguaucacc

SEQ ID NO: 695411 - RNA, 64 nt, hsa
uucuccuaggaaauggugaagucuauuaggagccacuugugacuccaugaccuguuaaaaccag

SEQ ID NO: 695412 - RNA, 64 nt, hsa
ccaaaaaguuuuuuuaaaaaagcaaaggaagcauacuugugaacuaccuugcuagcuagccagc

SEQ ID NO: 695413 - RNA, 64 nt, hsa
uugcaggcugacuugcuaagucugacagugacaaacuugugagcuuacugcagucagucacaga

SEQ ID NO: 695414 - RNA, 64 nt, hsa
agaaaaggggagcacaaggccuuaauggacauugacuugugaaaacgcaaacaugaauaugguu

SEQ ID NO: 695415 - RNA, 64 nt, hsa
agggagccggagccugccuuguguuccuuuuuugacuugugacauuuuucaaacacauaauuaa

SEQ ID NO: 695416 - RNA, 64 nt, hsa
aagguagagguauuugggaaaguagccagugggcacuugugauaucuaaaaucuguuaucccag

SEQ ID NO: 695417 - RNA, 64 nt, hsa
cagccuucagauggcagaaguggaagaugagccuacuugugagcgaugugacuuuaaggaaaug

SEQ ID NO: 695418 - RNA, 64 nt, hsa
uguguguucuauggaggggcagggaaaagguggcacuugugaguguguguggauuggcaggggg

SEQ ID NO: 695419 - RNA, 64 nt, hsa
gugguaaaucaguguaaaagugucauauucucagacuugugaggcgguuuauagucagaaagau

SEQ ID NO: 695420 - RNA, 52 nt, hsa
gagggaaggcuugggguugaggacuugugaucagaaaaacugaagauggaag

SEQ ID NO: 695421 - RNA, 64 nt, hsa
aacucaacuugagagggaaggcuugggguugaggacuugugaucagaaaaacugaagauggaag

SEQ ID NO: 695422 - RNA, 64 nt, hsa
gacuccagugauucugcacugggcauuauggaagacuugugauagaucagagaagagucauguu

SEQ ID NO: 695423 - RNA, 64 nt, hsa
uagcccauguucgaccacaugcaccucgagcaacacuugugagccaugcucagccuaugucauc

SEQ ID NO: 695424 - RNA, 64 nt, hsa
uuuucuuuuuuuuuuuuuuuuuuuguggauggggacuugugaauuuuucuaaaggugcuauuua

SEQ ID NO: 695425 - RNA, 64 nt, hsa
ugcuuuguaguaaccccugcccagguauuuuuucacuugugaaaauaauuugagaaagaccuuu

SEQ ID NO: 695426 - RNA, 64 nt, hsa
guacuguuuaccauuuuucauucacuucucuuaaacuugugaaugcuucucacuuuuuuuuuuu

SEQ ID NO: 695427 - RNA, 64 nt, hsa
uaggguaaaaauauaguuuuugaggguauucccaacuugugaucuucuaccacuuuagagacau

SEQ ID NO: 695428 - RNA, 64 nt, hsa
agcuguuuugaaaugucccaguuuuacgacuguuacuugugaaucaguauugguggaugcuucc

SEQ ID NO: 695429 - RNA, 64 nt, hsa
cucuaccugccucaagaaggggcucagagcagagacuugugaauuccuuaguaacugugaguau

SEQ ID NO: 695430 - RNA, 64 nt, hsa
augaauuguuucuaacaaaccuugaucuguauauacuugugagggguuguuugguugccuaauu

SEQ ID NO: 695431 - RNA, 64 nt, hsa
gagcucccagaagccaagaguguuuaaaugugacacuugugagaaggcauuugccaaaccaagc

SEQ ID NO: 695432 - RNA, 64 nt, hsa
agaagagugcugucauuauuuccucuuaucaacaacuugugacaugagauuuuuuaagggcuuu

SEQ ID NO: 695433 - RNA, 64 nt, hsa
gcgacgucugcacggcccagacccaggauuccaaacuugugaacucgugacaaucacaaacuug

SEQ ID NO: 695434 - RNA, 64 nt, hsa
acccuguaagauaauuggcuuuaaauuacgagagacuugugauaggacaguaaaaccuagaguu

SEQ ID NO: 695435 - RNA, 64 nt, hsa
gagacuccuccgucucaaaaaaauaaauaaauaaacuugugagcuggccccaaccccuccuagg

SEQ ID NO: 695436 - RNA, 64 nt, hsa
guaaccucuccccuguaccugugccaagccuagcacuugugaugccuccaugccccgagggccc

SEQ ID NO: 695437 - RNA, 64 nt, hsa
auauucauuccuucauuacuuuuggaaaauucuuacuugugaauguuaaaaaugaaaaaaaaau

SEQ ID NO: 695438 - RNA, 64 nt, hsa
caagggucacugucuucacagaaaaaguuugcugacuugugauugagaccuacugucccauugu

SEQ ID NO: 695439 - RNA, 64 nt, hsa
uuuauugccacugcugagaaggcuguccuuccuaacuugugaggagaugaauccuuaauaauaa

SEQ ID NO: 695440 - RNA, 64 nt, hsa
ggagagcuuucuguuuuucuacauuuguuaggaaacuugugagcauucacacuacagagaaacu

SEQ ID NO: 695441 - RNA, 64 nt, hsa
gguggucagggaagaccucucugcagagguagugacuugugaugugagcugagaccucuguccu

SEQ ID NO: 695442 - RNA, 64 nt, hsa
ccucacuccagcauggugucuguuaccucuucccacuugugacaaugucuaguaagguccacuc

SEQ ID NO: 695443 - RNA, 64 nt, hsa
gauccuuccugggagccucacauucaagggucugacuugugagacccuugggaaaaaaugggca

SEQ ID NO: 695444 - RNA, 64 nt, hsa
guggggugggggcagaggagaggcggauacagaaacuugugagaaugugaugaacgcucugaac

SEQ ID NO: 695445 - RNA, 64 nt, hsa
ucguuuuccgccaggacccaaagauccaggaggcacuugugacuagccugccaauggacccaug

SEQ ID NO: 695446 - RNA, 64 nt, hsa
cugaaagucuagguuuggccagcuagguagacugacuugugagguauuuauuuauucauuugag

SEQ ID NO: 695447 - RNA, 64 nt, hsa
cuggguaugguggcacaugccuauagucucagcuacuugugaggcugaggcaggaggauucuuu

SEQ ID NO: 695448 - RNA, 64 nt, hsa
agcugccaggcagucaaaaacagaagcuuccccgacuugugagucccugagaugugcucuuguu

SEQ ID NO: 695449 - RNA, 64 nt, hsa
ugcugugcugcucgacgugagggugaaaugauugacuugugaccugccagguugcccgaugccc

SEQ ID NO: 695450 - RNA, 64 nt, hsa
agcacugacaguaacugccaagaauuguuaacacacuugugaugugucagccacagauucaccc

SEQ ID NO: 695451 - RNA, 64 nt, hsa
agguucugcuucacacuuguucuuugaccugcugacuugugacuugcagaaacauaggcaguag

SEQ ID NO: 695452 - RNA, 64 nt, hsa
aaagaccaguuuauaggguuggguuuuuuuuccaacuugugaaaagcaguuuagcugcaucugu

SEQ ID NO: 695453 - RNA, 64 nt, hsa
aguuaaccuagaaguauuuuugucucuuagaaauacuugugauuuuuauaauacaaaagggucu

SEQ ID NO: 695454 - RNA, 64 nt, hsa
gcaguccaucuagggaaugggacugugaggccauacuugugaaacgucuggacugcuauucuag

SEQ ID NO: 695455 - RNA, 64 nt, hsa
aauagggaccacaucuuauuugucucaaacagggacuugugaguacuuggcaaguuuugcagcc

SEQ ID NO: 695456 - RNA, 64 nt, hsa
ccaccugcaccuugagauguuucuguaaauggguacuugugaucacacuacgggaaucucugug

SEQ ID NO: 695457 - RNA, 64 nt, hsa
ggcaguaaguagguagagcaaaaauggugaagugacuugugaagacugaaguuugaugaagucu

SEQ ID NO: 695458 - RNA, 64 nt, hsa
guugaaugaguguguuuuguacauaacuucagauacuugugaacaugccuuauauuuguccaac

SEQ ID NO: 695459 - RNA, 64 nt, hsa
aaugugaaauguuuagggacaucuccaugcugucacuugugauuugcccucuuauguauuuugg

SEQ ID NO: 695460 - RNA, 64 nt, hsa
ccgagucacccagcuggucucauacauagacagcacuugugaaggauugaaugcagguuccagg

SEQ ID NO: 695461 - RNA, 64 nt, hsa
augagcuacuuuugaauuuuccaugacacucaugacuugugaugaagucauggauaugucuauc

SEQ ID NO: 695462 - RNA, 64 nt, hsa
cugacaaagucauccuccgucuaccagagcgugcacuugugauccuaaaauaagcuucaucucc

SEQ ID NO: 695463 - RNA, 64 nt, hsa
agagaaaaucacaugaaggagaccugggguccccacuugugagugcaacugcaaguaacucugg

SEQ ID NO: 695464 - RNA, 64 nt, hsa
agauccauguaaggggcuccucuucccaccuggaacuugugaguggggacccaugauguauggg

SEQ ID NO: 695465 - RNA, 64 nt, hsa
uuucuaucuaaagagagcuacacuugagaaggggacuugugaacucaaccacaaucuccucgag

SEQ ID NO: 695466 - RNA, 64 nt, hsa
guccacguccuaaagacaccucuccuuuacaaagacuugugaugcucuggggcuucuguggcca

SEQ ID NO: 695467 - RNA, 64 nt, hsa
uuccucagccuuucuuuuuugccaucacucuaccacuugugagcaaauugaguuaucagaauuc

SEQ ID NO: 695468 - RNA, 64 nt, hsa
aaagaagccaucaagucuuaaguuuuucauuucaacuugugaacguuucuucugaugugaagca

SEQ ID NO: 695469 - RNA, 64 nt, hsa
uguggaaccaggacuugguauuaagccuuucccaacuugugaauauagaauuugauaauacacu

SEQ ID NO: 695470 - RNA, 64 nt, hsa
aaaguaauugguucaggaggugucaauagguugaacuugugagaaggcacugaaucugccaucc

SEQ ID NO: 695471 - RNA, 64 nt, hsa
uacuagggagguucuuaaauccucauaucuggaaacuugugacguuuugacaccuuuccuauag

SEQ ID NO: 695472 - RNA, 64 nt, hsa
uauuaauuuucuagcuaugguauuacuauaucacacuugugaguauguauucaaauacuaagua

SEQ ID NO: 695473 - RNA, 64 nt, hsa
aaaaguacauuuguauauuacauauauggacauaacuugugaaggaugaaagaaaguacagccu

SEQ ID NO: 695474 - RNA, 64 nt, hsa
agggggugagguggaauggggugggggaacauggacuugugacuaacgaagcugguugcugcug

SEQ ID NO: 695475 - RNA, 64 nt, hsa
cuguuaugucuugaacuuuuccucaaagcauuacacuugugaauguauuuuugucuaauagggu

SEQ ID NO: 695476 - RNA, 64 nt, hsa
uuaaaugcauuaggggagcugccauuuagaggaaacuugugaauucuuucauaaagcagaaaac

SEQ ID NO: 695477 - RNA, 64 nt, hsa
aagcccacacuacccaaaacaaagaaugggaagcacuugugauaaagacaggcuccugagaaau

SEQ ID NO: 695478 - RNA, 64 nt, hsa
aaucugauauauuggacuucuucaaaauuuaaaaacuugugauuuaagaagaggaaaagauaag

SEQ ID NO: 695479 - RNA, 64 nt, hsa
uauuccccccuccuagcccugcaaguugcuagguacuugugaggcaguguacuggagaggggag

SEQ ID NO: 695480 - RNA, 64 nt, hsa
aauuuacuacaauauguacauuucuaagucaaacacuugugacuuuugcuuuaauuccaugaau

SEQ ID NO: 695481 - RNA, 64 nt, hsa
guauuuuuucacuuguugccuuaguacuaucaagacuugugaauauauuugaauguauguuguu

SEQ ID NO: 695482 - RNA, 64 nt, hsa
uccuaugagggauaauugcagaaagguuuuagagacuugugagguuccauaugauaauucuuua

SEQ ID NO: 695483 - RNA, 64 nt, hsa
uacuagggagguucuuaaauccucauaucuggaaacuugugaaguuuugacaccuuuccuauag

SEQ ID NO: 695484 - RNA, 64 nt, hsa; identical to SEQ ID NO: 695472

SEQ ID NO: 695485 - RNA, 59 nt, hsa
gguggaggugcccguuccuggaccucagcgagccugagccgggcccggccgcacgcuga

SEQ ID NO: 695486 - RNA, 59 nt, hsa
ccaagcacauugguccuaaaggggcugaagagccugaacugcaccuaacgggaaagaac

SEQ ID NO: 695487 - RNA, 59 nt, hsa
ggcacaugccuguaauuccagcugcuugggagccugaggcaggagaacugcuugaaccc

SEQ ID NO: 695488 - RNA, 59 nt, hsa
aaucaacagcauauugacacguuggagccgagccugaacaugccccucggccccagcac

SEQ ID NO: 695489 - RNA, 59 nt, hsa
uggugggcgaggguggcgcaugggaggccgagccugaauccuugccugugucugacggg

SEQ ID NO: 695490 - RNA, 59 nt, hsa
gcuguuuacauuguuuacuuacaaguaaggagccugaaauaaccuguaguuucgaaugc

SEQ ID NO: 695491 - RNA, 59 nt, hsa
uugagcaggaguugguaaauaaacuaauggagccugaaagacucaaugaaauuguggaa

SEQ ID NO: 695492 - RNA, 59 nt, hsa
uccuguuuuuccuaugcucugggugaauagagccugaugguauacuacugcuuugcgga

SEQ ID NO: 695493 - RNA, 59 nt, hsa
gaagaaacaguucccuguugaagaaaguagagccugacacugcucccacuuuggagacc

SEQ ID NO: 695494 - RNA, 59 nt, hsa
uguacuggguaugaguggaaggugauggagagccugauccugaagccucuacuugauga

SEQ ID NO: 695495 - RNA, 59 nt, hsa
cugcucauuguuguuugggcucagguauugagccugauggcccagguauugagggccuc

SEQ ID NO: 695496 - RNA, 59 nt, hsa
gacaggcauggaccugucuccagagagaggagccugaaguucguggggcgggacagcgu

SEQ ID NO: 695497 - RNA, 59 nt, hsa
aaucuuaggcuaccacauucuauuauugagagccugagauguuagccauaguggacaag

SEQ ID NO: 695498 - RNA, 59 nt, hsa
uuaaguacuaguagccuguuauugacugggagccugacugauguauuauauauauugua

SEQ ID NO: 695499 - RNA, 59 nt, hsa
accaggcacaccucagucuucuugacccagagccugaaaacuguuuucacuggguucca

SEQ ID NO: 695500 - RNA, 59 nt, hsa
aagguuaacaggcuguaguucugcagggagagccugaaguccugguaugggcucuugau

SEQ ID NO: 695501 - RNA, 59 nt, hsa
aucacaaaagguucuucuggugagugcaagagccugagacuggaaaagguggacuuguc

SEQ ID NO: 695502 - RNA, 59 nt, hsa
gagagacugugcugggaacauguaccacugagccugagauggggaugagggcagagaga

SEQ ID NO: 695503 - RNA, 59 nt, hsa
uugaggcuauaaaaauguccuugaguuuggagccugagcucuggugaaaugcugauaca

SEQ ID NO: 695504 - RNA, 59 nt, hsa
gcugcuucuguugugagcgaaucagccaagagccugaggcugaagggaaaaguacacag

SEQ ID NO: 695505 - RNA, 59 nt, hsa
gggcagaagaucugggaucaauuaagauggagccugaaggacuauggaaucuugcuugu

SEQ ID NO: 695506 - RNA, 59 nt, hsa
agaaccagcgccccgaugccugaggcugggagccugagccccuucagcuuugagggggg

SEQ ID NO: 695507 - RNA, 59 nt, hsa
auggagagacagagggggcgcgcgcacaggagccugacuccgcugggagagugcaggag

SEQ ID NO: 695508 - RNA, 59 nt, hsa
uucugucuuucacggugggcgcucggggggagccugaggaaaacccccuuagguaccug

SEQ ID NO: 695509 - RNA, 59 nt, hsa
ccauuaccuggaagguuucuguaccuugagagccugaaucagaggccgucgggaacgcc

SEQ ID NO: 695510 - RNA, 59 nt, hsa
ggggucuugucuaccaccuccccuggucagagccugagugggugcugguugcugugucu

SEQ ID NO: 695511 - RNA, 59 nt, hsa
ucuguugccuaccuggccugacccagucggagccugacaugguggagggaaagggagac

SEQ ID NO: 695512 - RNA, 59 nt, hsa
guuacccaggguccucauguccuuccuuagagccugaguggugugaggugacaggucuc

SEQ ID NO: 695513 - RNA, 59 nt, hsa
auaggguggcuggcagaggggacccccaggagccugaaggaaucugaaggcacuggaau

SEQ ID NO: 695514 - RNA, 59 nt, hsa
gcuucccguucagcgucacaucugcaguggagccugaaaaggcuccacauuaggucacc

SEQ ID NO: 695515 - RNA, 50 nt, hsa
aucuuggcucacguauuuaagagccugaauauuccagguaagaaaauaua

SEQ ID NO: 695516 - RNA, 59 nt, hsa
ccuucuucccaauagaagaauaagucauggagccugaagggugccuaguugacuuacug

SEQ ID NO: 695517 - RNA, 59 nt, hsa
gucugaauccuagagacagaaaguugacugagccugaaagggccaggucccagugcugg

SEQ ID NO: 695518 - RNA, 59 nt, hsa
ggcucagcagggagcugcuggagguaguagagccugaagucuugcaggacucacuggau

SEQ ID NO: 695519 - RNA, 59 nt, hsa
ggcucagcagggagcugcuggcugagaaagagccugaagucuugcaggacucacuggau

SEQ ID NO: 695520 - RNA, 54 nt, hsa; identical to SEQ ID NO: 128889

SEQ ID NO: 695521 - RNA, 59 nt, hsa
uacagauacugauucagugggucugcguagagccugagacugccauucuaacauguucc

SEQ ID NO: 695522 - RNA, 59 nt, hsa
aacaucugcucuugguuucugcugcccuggagccugacccucagucuccauucucccuc

SEQ ID NO: 695523 - RNA, 59 nt, hsa
cccgucccccucuggcuccagcuggccgggagccugaucaccugcccugcugaguccca

SEQ ID NO: 695524 - RNA, 59 nt, hsa
agcuaguaagauuacccugagcugcagcugagccugagccaaugggacaguuacacuug

SEQ ID NO: 695525 - RNA, 59 nt, hsa
gguaccaaaagaguauugauuaugaccuggagccugagcuuugggagaauauacaaagg

SEQ ID NO: 695526 - RNA, 59 nt, hsa
agaaauaccuccucccgcugacugccccagagccugaaagucucacccuuggagcccac

SEQ ID NO: 695527 - RNA, 59 nt, hsa
cccugagccccuugcgauaucaccaccaagagccugauaacugagcaggguggauccug

SEQ ID NO: 695528 - RNA, 59 nt, hsa
uagacuuggacaucucucuggcuucugaagagccugaagcuggccuggaccauuccugu

SEQ ID NO: 695529 - RNA, 58 nt, hsa
aaggccccaccuuacucugaaagcuggggagccugaacauucacuccuuguccuccau

SEQ ID NO: 695530 - RNA, 59 nt, hsa
ccacacccccuucuuaaaacuggggacaugagccugagcagaaagggugaagaagagcc

SEQ ID NO: 695531 - RNA, 59 nt, hsa
acuaaugaagauacgguugcuucaccuuggagccugaacaugacauuucuaaguggggu

SEQ ID NO: 695532 - RNA, 59 nt, hsa
gagaucugggaggucuccacugaggaugugagccugauuauccuauaggcagacguggg

SEQ ID NO: 695533 - RNA, 59 nt, hsa
guggcccagaguugcucagaauuggagcagagccugagacguaucugcagauccuguca

SEQ ID NO: 695534 - RNA, 59 nt, hsa
ggaaccugguacauccagucacuuugccagagccugagagagcgauguccucgguaagu

SEQ ID NO: 695535 - RNA, 59 nt, hsa
gagcuugaagagugaaaacuguugugaaugagccugaucauaaaacggaccaggccauu

SEQ ID NO: 695536 - RNA, 59 nt, hsa
ccaccgcccaccaccccuccugcuuccccgagccugacccuguuccgcccacuggcaau

SEQ ID NO: 695537 - RNA, 59 nt, hsa
aggagaggggcucgaugggcugggggaaggagccugaagguugccccugguugcauccc

SEQ ID NO: 695538 - RNA, 59 nt, hsa
uggagcaggagaguagcucauggcuccaggagccugaggccaugcaguugauggugagc

SEQ ID NO: 695539 - RNA, 59 nt, hsa
ggcuuggacucuuucccaucuccccuggggagccugaggagcccagcguccacucuuca

SEQ ID NO: 695540 - RNA, 59 nt, hsa
cagguugcugcaagcucagcugaaucugugagccugaggucuguuucaaauuucucccc

SEQ ID NO: 695541 - RNA, 59 nt, hsa
aggcauuuacuuuuggguaaaggagaguugagccugaauuaggaauguguacauuguag

SEQ ID NO: 695542 - RNA, 59 nt, hsa
acauuaaaaguuacauaaauauuaccagagagccugaugcucucugauagcugugccau

SEQ ID NO: 695543 - RNA, 59 nt, hsa
gcucuuggguccuucuagggcacugggaagagccugaagaugaggaaaaguuuggagga

SEQ ID NO: 695544 - RNA, 59 nt, hsa
gcccccaugcucggcuuccucacauucaggagccugacuuggaucagacuuggggcugc

SEQ ID NO: 695545 - RNA, 59 nt, hsa
aucuuugggaaauuuucuacccugcucuugagccugauaacccaugccaggucuuauag

SEQ ID NO: 695546 - RNA, 59 nt, hsa
uacgucaacuugguugcucugauaccccagagccugauugggggccucccggcccuggc

SEQ ID NO: 695547 - RNA, 59 nt, hsa
gcccacccuacagaaaguggaacagcccggagccugaugugaaaggaccacggguguug

SEQ ID NO: 695548 - RNA, 59 nt, hsa
aaaaauuaauaagacccagcuugaaaauugagccugauaacaagauuacaaauucacaa

SEQ ID NO: 695549 - RNA, 59 nt, hsa
cccaggaguccagcaaucauuggggaagagagccugaggcuggcaauccuugcccagaa

SEQ ID NO: 695550 - RNA, 59 nt, hsa
cucugcccaaacauaaagagaacucuggggagccugagccacaaaaauguuccuuuauu

SEQ ID NO: 695551 - RNA, 59 nt, hsa
gacuugaguuucuuauucuagaacacuuggagccugaacucugaccaggccccucacuu

SEQ ID NO: 695552 - RNA, 59 nt, hsa
aacuaauucuuuaaaaaaaaaaaaaaguugagccugaauuaaauguaauguuuccaagu

SEQ ID NO: 695553 - RNA, 59 nt, hsa
uccagaauuuuucaucaagaagguagcuugagccugaaaugcaaaacccauggaggaau

SEQ ID NO: 695554 - RNA, 59 nt, hsa
ugacuuaggguuugucacuccaccucauugagccugacuguucugcuccauaaaauagg

SEQ ID NO: 695555 - RNA, 59 nt, hsa
agauggggaaaccgagggcugguagggaugagccugagguuauacaggaguuagguggg

SEQ ID NO: 695556 - RNA, 59 nt, hsa
acagccgccgcuuccagaccauugacaucgagccugacaucgaagcccugcugucucaa

SEQ ID NO: 695557 - RNA, 59 nt, hsa
uauaaacuuuacuuuccagaugaagagcugagccugauucaaaugguuuuucugcuuua

SEQ ID NO: 695558 - RNA, 59 nt, hsa
cauuaaaguuaguggcaaaacuuaauuuggagccugauuuccuacugacuuccaauuua

SEQ ID NO: 695559 - RNA, 59 nt, hsa
cuggcgagucugcuuucuucuacugcccugagccugaacgcuucugcuuaaucugagaa

SEQ ID NO: 695560 - RNA, 59 nt, hsa
ucuucucaccauuuuaccucuuuuaacaggagccugagcacaagguuuaaugaggaagc

SEQ ID NO: 695561 - RNA, 59 nt, hsa
ggggccccucgacaucaccgucauugauggagccugaaccgugugcuccucggcagaug

SEQ ID NO: 695562 - RNA, 59 nt, hsa
cagggagugucugcaguccugguggggcugagccugaggccuuccagaaagcaggagca

SEQ ID NO: 695563 - RNA, 59 nt, hsa
uguugggaauugcaugccaucuccacccugagccugaccuuucugagugacaugggugu

SEQ ID NO: 695564 - RNA, 59 nt, hsa
gugggggaggucccugccaguguuuagaagagccugacuguguucagugccuuggagca

SEQ ID NO: 695565 - RNA, 59 nt, hsa
aaguuucaaagaagauaaaaaugcuugaagagccugagaguaaaaagauuaugcugcaa

SEQ ID NO: 695566 - RNA, 59 nt, hsa
uccuucuuuaccccgcugagacagugggagagccugaagcagaauccugguauucacca

SEQ ID NO: 695567 - RNA, 59 nt, hsa
cuaauaugcuuccugccauugcgcaaucugagccugagcaacuggaaacccccauuucu

SEQ ID NO: 695568 - RNA, 56 nt, hsa
agaggcccgacgaauggugauggggagagccugaaaggcaggcucuguuaccucuc

SEQ ID NO: 695569 - RNA, 59 nt, hsa
uucuuuugauaccuuugagaagagccacugagccugaguugaaauauuuuuagcuuagu

SEQ ID NO: 695570 - RNA, 59 nt, hsa
gcugccuguaacuugagaguagaugguuugagccugagcagagacaugacucagccugu

SEQ ID NO: 695571 - RNA, 59 nt, hsa
ugugaauugcuugguuguaauuaaauucugagccugauauugauaugguuuuaagaagc

SEQ ID NO: 695572 - RNA, 59 nt, hsa
gaaagguagaaggguuuauuuuauuaaaugagccugacuuagugacagugugugagcau

SEQ ID NO: 695573 - RNA, 59 nt, hsa
guaaggcaccccacagaaauuaacuuggagagccugagaaauucccaguggccuuggca

SEQ ID NO: 695574 - RNA, 59 nt, hsa
ccacgccggggccuccaccgccugggccugagccugaccgggccauucccaaauuuggg

SEQ ID NO: 695575 - RNA, 59 nt, hsa
ccauuggcugcgcuaacccccagcccacagagccugaauuuguaagcaacuugcuucua

SEQ ID NO: 695576 - RNA, 59 nt, hsa
uuucccugccagaggaaacugagcuggaggagccugagguccugccuuucauuggcuga

SEQ ID NO: 695577 - RNA, 59 nt, hsa
ugaucugccggcucucaguccccggggcagagccugauugacugugcuggcucaacuuc

SEQ ID NO: 695578 - RNA, 59 nt, hsa
aagugauggaacccucaggugcucuccgggagccugaaccuccugacugaggaacaugg

SEQ ID NO: 695579 - RNA, 59 nt, hsa
gaggccagugcccacuugcccaccgaccugagccugaguaaguggcugucaccugagcc

SEQ ID NO: 695580 - RNA, 59 nt, hsa
gcagccugagguguguccugggcuccucagagccugaagcaagcuuuuggaagccugca

SEQ ID NO: 695581 - RNA, 59 nt, hsa
agggcauuugaaagacugccagguagugcgagccugagauggucuggaggauucucucu

SEQ ID NO: 695582 - RNA, 59 nt, hsa
caccuggccaagaagagacaucuugacuugagccugaagacuauguacagagacugacc

SEQ ID NO: 695583 - RNA, 59 nt, hsa
cucucccuccucucagagcccucccucgagagccugagugcaccaugucuuguggccuc

SEQ ID NO: 695584 - RNA, 59 nt, hsa
cucuagaggcugagacgggagcaucucuugagccugagaaguggagauugcaauugagc

SEQ ID NO: 695585 - RNA, 59 nt, hsa
ugugucaguccucugguuauaguauauaagagccugaggaggucuggcaagauagaugg

SEQ ID NO: 695586 - RNA, 59 nt, hsa
aggcauuugacuccuacagcagaaguucugagccugaccacagaugguguguaaucuau

SEQ ID NO: 695587 - RNA, 59 nt, hsa
uaagguccucacugaagcuucucucucuggagccugaaguagugaugaguagucugggc

SEQ ID NO: 695588 - RNA, 59 nt, hsa
aagaauuagguaaauuaacaagucaucaugagccugaccaaaacaaaauuugaaauuaa

SEQ ID NO: 695589 - RNA, 59 nt, hsa
cucuguuguuagccuguagauccagaacggagccugaugugaugccuucacugguugau

SEQ ID NO: 695590 - RNA, 59 nt, hsa
ucaugauucauccucucuucagugagacugagccugauguguuaacaaauaggugaaga

SEQ ID NO: 695591 - RNA, 59 nt, hsa
uguauuugagacuaggauagcuucaucuugagccugagccuuagaaucuguagaggagc

SEQ ID NO: 695592 - RNA, 59 nt, hsa
aaggagcugaguuuggcaacaacccaagugagccugaagcagauucgccccagagccuc

SEQ ID NO: 695593 - RNA, 59 nt, hsa
gcucacaguccuguauuuggcagguuugggagccugaggggccaucucccugacacuca

SEQ ID NO: 695594 - RNA, 59 nt, hsa
uugccaggaauguuucagcugcaguugaagagccugacaagugaaguuguaaacacagu

SEQ ID NO: 695595 - RNA, 59 nt, hsa
aaccagaccuaucaggaacgcaccuuccagagccugaugaauagcaacagcaauuuccg

SEQ ID NO: 695596 - RNA, 59 nt, hsa
gagcuuggaagcuucuggugaccuuccaagagccugagagugagguggaauuauuuuaa

SEQ ID NO: 695597 - RNA, 59 nt, hsa
auaggccucccccacggugccuguguacggagccugaugacuucacugggagccuucug

SEQ ID NO: 695598 - RNA, 59 nt, hsa
gccuccagugacaccacuguccucaucuggagccugaagggucaagugcugucuaccau

SEQ ID NO: 695599 - RNA, 50 nt, hsa
augacauugaaauuguuuaagagccugauauucuuccuccaagaauuuga

SEQ ID NO: 695600 - RNA, 59 nt, hsa
cuuagugggagaguaacagaaugccuggagagccugacucugagcucuugaaguaguca

SEQ ID NO: 695601 - RNA, 59 nt, hsa
uucuuuuauaaaauuaucuuuuggaaccugagccugacauuggggggaagugggaggcc

SEQ ID NO: 695602 - RNA, 59 nt, hsa
uccacauuaauuaacaugucuaggagugggagccugacagacaccacuauuaaaaaaaa

SEQ ID NO: 695603 - RNA, 59 nt, hsa
cugagugcugcaccugccuucucgaucacgagccugagaacugcacgggggagcagccc

SEQ ID NO: 695604 - RNA, 59 nt, hsa
aggucaccugccgcccugugggagccgcagagccugacgcucagccccaggccagcugc

SEQ ID NO: 695605 - RNA, 59 nt, hsa
acacauugguccggggaccccucagugcagagccugaaguuggggguuuagggguggaa

SEQ ID NO: 695606 - RNA, 59 nt, hsa
acccuuaauuccuauuucuggguguuugcgagccugauugcuaucaugaaguaaaaauu

SEQ ID NO: 695607 - RNA, 59 nt, hsa
uuucuacugccugguagagcugccaucuugagccugaaauauaagaaauggucugguuu

SEQ ID NO: 695608 - RNA, 59 nt, hsa
uuuggagcagacuguuuuaaguugcucaggagccugauggaaccaugaaccgagacucu

SEQ ID NO: 695609 - RNA, 59 nt, hsa
agagaacggagcugggaaugugacugcuggagccugagagguggaggaguucugauccc

SEQ ID NO: 695610 - RNA, 59 nt, hsa
ccuuugugucagaaaaaggaaaccacagugagccugagagagacggcgauuuucgggcu

SEQ ID NO: 695611 - RNA, 59 nt, hsa
accaauagaaacauuuagcaguacguacagagccugacagcgcagcuccugaggacuuc

SEQ ID NO: 695612 - RNA, 59 nt, hsa
gcgggagggaggaaguacgacuaauguuggagccugaaacuauggaaaugcugcuaaaa

SEQ ID NO: 695613 - RNA, 59 nt, hsa
aaauaaaaauggauagguggugacccacugagccugaucauaauacgaagaccagcuuc

SEQ ID NO: 695614 - RNA, 59 nt, hsa
ggcaggcgccuguaaugccugcuacuugggagccugaggcagaagaauugcuugaagcu

SEQ ID NO: 695615 - RNA, 59 nt, hsa
ugucuucccaguguugguuugaacccugugagccugagacagagagggccaggcaccaa

SEQ ID NO: 695616 - RNA, 59 nt, hsa
ucaaugugccgaucaguggagucaguaucgagccugaccaccgcaagccaggaagcagg

SEQ ID NO: 695617 - RNA, 59 nt, hsa
acccuggaugcccagcaaggccacagaaagagccugauguccaugauccagguggcucu

SEQ ID NO: 695618 - RNA, 59 nt, hsa
acuccuguugacccuggaucccacccuuugagccugaccccacugcagccucugcccag

SEQ ID NO: 695619 - RNA, 59 nt, hsa
auagcaacaucaguuaugggagcugugaggagccugaucccaaguugaacacccaagac

SEQ ID NO: 695620 - RNA, 59 nt, hsa
caggaagcacuggacacagugauucugcagagccugagcugcugcugugguguggccca

SEQ ID NO: 695621 - RNA, 59 nt, hsa
gcggaccagaccugcccugcucugugacagagccugagacuuggaggugccagaggccc

SEQ ID NO: 695622 - RNA, 59 nt, hsa
gagugagauggcugagugaggguuauggggagccugagguuuuaugggccuguguaucc

SEQ ID NO: 695623 - RNA, 59 nt, hsa
gauccuucaugagaaaagccagccagguagagccugaagcugugaucacuccaguggug

SEQ ID NO: 695624 - RNA, 59 nt, hsa
ccuugagaguaggugacacggagaagccagagccugagcgugagugcaacaaaggccuc

SEQ ID NO: 695625 - RNA, 59 nt, hsa
acagcccuucuccuccaugggaggcccuggagccugauagaaaucagugguguggggca

SEQ ID NO: 695626 - RNA, 59 nt, hsa
uuccagaugucucaugcugcauagggcaggagccugaaaagcuaauuugagaagauaau

SEQ ID NO: 695627 - RNA, 59 nt, hsa
cuagucagagauugggagaaauacaagaugagccugaaucaucucauguaccugacagu

SEQ ID NO: 695628 - RNA, 59 nt, hsa
uucuccaggccugggcuacgggggagggagagccugaggcucugcucagggcccauuuc

SEQ ID NO: 695629 - RNA, 59 nt, hsa
ggagguggugaccucauucagucgguuaagagccugagcccugugaaguuaaacaccug

SEQ ID NO: 695630 - RNA, 59 nt, hsa
ugguccagagccucccuccagugacuguggagccugagaaggcccccgggccccagcau

SEQ ID NO: 695631 - RNA, 59 nt, hsa
gaaggccgugcagagcuggucacugaaaugagccugauaggauaggcuggagcauaaaa

SEQ ID NO: 695632 - RNA, 59 nt, hsa
guuuuauaaaucccucaaacgauugcugagagccugauuguggaaagaagugagaugca

SEQ ID NO: 695633 - RNA, 59 nt, hsa
uuuauguguuuuuaaacacuuuuuuaaaugagccugacaccuguguuucagcauuugga

SEQ ID NO: 695634 - RNA, 59 nt, hsa
cuguccugggagcuggagaggaugucagcgagccugacauugcccucccugaaugcauc

SEQ ID NO: 695635 - RNA, 59 nt, hsa
cucccaccgcagacaguguggaacagagugagccugagcugcccaaggcgaugcccuuu

SEQ ID NO: 695636 - RNA, 59 nt, hsa
uaauaacucuuucuucacagaguugcugggagccugagcaccuuucguuuuucggcuca

SEQ ID NO: 695637 - RNA, 59 nt, hsa
ccuuacuggcccacuucucucuccguagagagccugaaaaacugccccaaugccacggu

SEQ ID NO: 695638 - RNA, 59 nt, hsa
ugugcaagcacucacugugcucucugaaagagccugaggccgggcgugguggcucacgc

SEQ ID NO: 695639 - RNA, 59 nt, hsa
uuauuuugugcauuauauuuauauguuaagagccugagcuuagaaguauuuuuuucaaa

SEQ ID NO: 695640 - RNA, 59 nt, hsa
ccaggucccaauucccaaagcuccuggaagagccugaagacauugggaaaggcugggcc

SEQ ID NO: 695641 - RNA, 59 nt, hsa
caauccagcuauguuauauugaaaaaauagagccugagggaucuuuacuaguuauaaag

SEQ ID NO: 695642 - RNA, 59 nt, hsa
agauuugugauccaggccucacuuccuuugagccugaggcccuugguaaccucguggag

SEQ ID NO: 695643 - RNA, 59 nt, hsa
agccuuagagagcucccaucucaaucauugagccugaaggcuucaagcccaagaaugca

SEQ ID NO: 695644 - RNA, 59 nt, hsa
gagugggcuuuaaccaggagauaaaaauggagccugaagggaaucaggcaaggaaauga

SEQ ID NO: 695645 - RNA, 59 nt, hsa
cgguggugguggauagcaucacaagaaacgagccugaaaaucagguccagccgguccaa

SEQ ID NO: 695646 - RNA, 59 nt, hsa
aggcagccuggagucagccauggcucucugagccugaggauggaaaugggagaugggag

SEQ ID NO: 695647 - RNA, 59 nt, hsa
cccuuuucugccagacuacauuuuguggggagccugaggacucuggauucuuugagggg

SEQ ID NO: 695648 - RNA, 59 nt, hsa
ggagcagggcgggcauugggaccaguguggagccugagggugccugcccugcucuggag

SEQ ID NO: 695649 - RNA, 59 nt, hsa
ggcuggggugugcucccugaccaaugacagagccugaaaaugcccugucagccaauggc

SEQ ID NO: 695650 - RNA, 59 nt, hsa
uucucaguagcagaguccagugccuugcagagccugaagccuggggagaaggcccagcc

SEQ ID NO: 695651 - RNA, 59 nt, hsa
gagcuggagugaggaucaaacaggcccaggagccugaggaaauacccagucaguccucc

SEQ ID NO: 695652 - RNA, 59 nt, hsa
ccauuuuggguuaggagaagucaaguugggagccugaaauagugguucuuggaaaaaug

SEQ ID NO: 695653 - RNA, 59 nt, hsa
aucugcagaggguuaggagugggugacaagagccugaucucuuccuguuuuguacauag

SEQ ID NO: 695654 - RNA, 59 nt, hsa
aagccgggagacacucuaggucagugggggagccugagguacagagaagagugaggacu

SEQ ID NO: 695655 - RNA, 59 nt, hsa
augagaagaaaucuucagggugauuucuggagccugaaaagaauaaaaaacaaaaccaa

SEQ ID NO: 695656 - RNA, 59 nt, hsa
gaccuuccucuggggcucuaggguugcuggagccugagucagggcccagaggcugaguu

SEQ ID NO: 695657 - RNA, 59 nt, hsa
aggacagccccuuagguuugggaagggacgagccugaaggauucugucuuuacuggggu

SEQ ID NO: 695658 - RNA, 59 nt, hsa
cacacuugccaucuagggcuagcuugaaagagccugaggacugccuuuaacugaauuug

SEQ ID NO: 695659 - RNA, 59 nt, hsa
cucuggaugcccgggauggcaaugagguggagccugaugaugaccacuucuccauugug

SEQ ID NO: 695660 - RNA, 59 nt, hsa
cacgucagcuaccuggauauugaggagcugagccugaguggacucugccagugccuggu

SEQ ID NO: 695661 - RNA, 59 nt, hsa
ccaguaaauacaugcuuaacaaaaggaaugagccugaaguucauaaagaauacauauca

SEQ ID NO: 695662 - RNA, 59 nt, hsa
uuucaugcaggagcggggcaaguaagguugagccugacuguaaaccuagaacugcggaa

SEQ ID NO: 695663 - RNA, 59 nt, hsa
uuggaacgcacacugccguccaauguggagagccugaugggacaauacccuguuggaag

SEQ ID NO: 695664 - RNA, 59 nt, hsa
uugaagagggggcaguguguaaaaagaaagagccugacagaaugaguguaggaaggaag

SEQ ID NO: 695665 - RNA, 59 nt, hsa
gcgcggagagaggugcgccgugggcucaagagccugagugggugguuugcgaggaugag

SEQ ID NO: 695666 - RNA, 59 nt, hsa
caacugaaucaagugaggaagagggcucagagccugacucugagggguuccgccuccuc

SEQ ID NO: 695667 - RNA, 59 nt, hsa
uucagccacuucugacauuuuuacauaccgagccugagauugugugauuaucucaaauc

SEQ ID NO: 695668 - RNA, 59 nt, hsa
gcauuucaccccugaagucucuaaacucugagccugaaaagauuuguauuuaauacaca

SEQ ID NO: 695669 - RNA, 59 nt, hsa
agcuggauuggcuggggauaugguauaacgagccugagccuucuguacgugucugacac

SEQ ID NO: 695670 - RNA, 59 nt, hsa
augcaaugagcauccuuggaacagacugggagccugaucccaagaggcugcugaacugg

SEQ ID NO: 695671 - RNA, 59 nt, hsa
cugaagcaugugguacagaggcaagagcagagccugagaagcgucaggucccacuucug

SEQ ID NO: 695672 - RNA, 59 nt, hsa
aggcggccagcgugugcauggggcagauggagccugaucagguguacgaggggaucacc

SEQ ID NO: 695673 - RNA, 59 nt, hsa
ugcccgggcccuuccuccaagacccuacagagccugaggggcaccuuggcuuccgccug

SEQ ID NO: 695674 - RNA, 59 nt, hsa
caguucauuuggccauuuuggauuuuggagagccugaaacuuugauauguauguaauac

SEQ ID NO: 695675 - RNA, 59 nt, hsa
cugcuuggaaagucucucuucugaaccuggagccugaauacauuuucagagccaaauua

SEQ ID NO: 695676 - RNA, 59 nt, hsa
guugcugaccagcuggagugagggccucagagccugaccugagaguccguacucggcuu

SEQ ID NO: 695677 - RNA, 59 nt, hsa
aauuucauuuaaacuucuagguuaaguuugagccugaaauuuuaaugaagugcaauacu

SEQ ID NO: 695678 - RNA, 59 nt, hsa
uggaccacauccuaaccugagacaaugccgagccugagacaaacccgugacucagacuu

SEQ ID NO: 695679 - RNA, 59 nt, hsa
ucaccuaccccagggaacuuccaaggaaggagccugagccacuggggacuaagugggca

SEQ ID NO: 695680 - RNA, 59 nt, hsa
ggagaggcccgggucagagcccugggggugagccugaaggccacagagaaagaaccuug

SEQ ID NO: 695681 - RNA, 59 nt, hsa
cggcugcguagcuguggucccaggcccaggagccugagggggugucuaggugaucauuu

SEQ ID NO: 695682 - RNA, 59 nt, hsa
aaagucacuuugucugucuuguucaccuggagccugacacaccguagguacugaguaca

SEQ ID NO: 695683 - RNA, 59 nt, hsa
aaaaucugagacauggucacagccaagaggagccugagaagacaugacugcuagaugua

SEQ ID NO: 695684 - RNA, 59 nt, hsa
gauauuucuuguggcaggggguggucaaagagccugauugcugacccagucucaggccu

SEQ ID NO: 695685 - RNA, 59 nt, hsa
uggaguccggggaaagagagguggggggagagccugagguccccaagugaggggagucc

SEQ ID NO: 695686 - RNA, 59 nt, hsa
uauccaauuuacacagcaaguuaguaguugagccugaccaugagucuucugacucuguu

SEQ ID NO: 695687 - RNA, 59 nt, hsa
augggggcucggacuccagcucggagucugagccugaagagccccaaagcaggaagaag

SEQ ID NO: 695688 - RNA, 59 nt, hsa
uguaagagacacaaaugaagaagaacaaagagccugagaaagcagcaagaggacaugau

SEQ ID NO: 695689 - RNA, 59 nt, hsa
agcaaauccuggaaggcagacaaaaauaagagccugaagcaaugcuuacaauagauguc

SEQ ID NO: 695690 - RNA, 59 nt, hsa
uugcugacuccugauaaagaauauaaagugagccugauucuugaaaaaaucagaaccag

SEQ ID NO: 695691 - RNA, 59 nt, hsa
ccugucucuacaaaaaaaaaauuugccaagagccugagugacagagcaagaccccaucu

SEQ ID NO: 695692 - RNA, 59 nt, hsa
uggaccuggugccccugcucacugggcccgagccugaacugagccccagcgggcuggcg

SEQ ID NO: 695693 - RNA, 59 nt, hsa
gccaaugcugaagacacagcuccgcuugggagccugagaacccaggcuucccaggccag

SEQ ID NO: 695694 - RNA, 59 nt, hsa
uaagauggggaaacguccucgugagaugagagccugagccaggcagcagagcgcucgcu

SEQ ID NO: 695695 - RNA, 59 nt, hsa
cccugucuccaaagaucucccacaguguggagccugaacaagaagaggcuggggagggu

SEQ ID NO: 695696 - RNA, 59 nt, hsa
gaggaccuggagagcugggagaccaugaugagccugacuccccaugccccaccuuugcu

SEQ ID NO: 695697 - RNA, 59 nt, hsa
ucuguacugcucgggccgcccaggucacagagccugagcuucguagccaaagcagccug

SEQ ID NO: 695698 - RNA, 59 nt, hsa
aacagcuaggaucugcauuuucagguuccgagccugaccccuggaacugaccagcgcuc

SEQ ID NO: 695699 - RNA, 59 nt, hsa
ucagugacugacagaggauccggaucucagagccugagaccagguuuauuggggccugg

SEQ ID NO: 695700 - RNA, 59 nt, hsa
gcagccuuuggucuccuggaugggccuuugagccugauguuuacagugucugugugugu

SEQ ID NO: 695701 - RNA, 59 nt, hsa
agaugagcugggcagggcagggguggguggagccugacccuggagggcacugagcugga

SEQ ID NO: 695702 - RNA, 59 nt, hsa
cggggccucucuagggaagucugguuguagagccugaauaggcuccuggccccaugacc

SEQ ID NO: 695703 - RNA, 59 nt, hsa
uauugugugucgagaggcagcauuggaaagagccugauuuucuaaaauaugcaucaagu

SEQ ID NO: 695704 - RNA, 59 nt, hsa
guuuguaucaccaccuaugcuaucaacgugagccugauguggcucaguuuccggaaggu

SEQ ID NO: 695705 - RNA, 59 nt, hsa
cuaacccgcuuuuaccugagacaggcccugagccugaggccgcugguagacuuuuguua

SEQ ID NO: 695706 - RNA, 59 nt, hsa
uuucauccagggaaaugccucgagccauagagccugaaaucaucuuuguuggcucagaa

SEQ ID NO: 695707 - RNA, 59 nt, hsa
gagcaugucuuaccaaaaacagagagaacgagccugaauacagcagauguaggggacag

SEQ ID NO: 695708 - RNA, 59 nt, hsa
ugggaggagggcaggcaucggggagccgggagccugacccucaucuuucuuccaaacag

SEQ ID NO: 695709 - RNA, 59 nt, hsa
gguuaaggugggcauccuccagguacaacgagccugaagagccccuuucagugcagacg

SEQ ID NO: 695710 - RNA, 59 nt, hsa
aaauaaucaccauuuuugaaaccaaaccagagccugaguguugccuaauuuguuuuccc

SEQ ID NO: 695711 - RNA, 59 nt, hsa
gugaacuuggugggcccaggagggaacaggagccugagccagggcaauggcccugccac

SEQ ID NO: 695712 - RNA, 59 nt, hsa
cacauacccacacauuccagggcuggggugagccugacugccaggaccccaggucaggg

SEQ ID NO: 695713 - RNA, 59 nt, hsa
augucccgagaccuuagccuggcugaguggagccugagaccugcacaacagcucauggu

SEQ ID NO: 695714 - RNA, 59 nt, hsa
agcuggaaacuuccacuuccccaaccucagagccugacuguaaugaagagacuggcagc

SEQ ID NO: 695715 - RNA, 59 nt, hsa
aaguauuuggcuauuaacugccaaaacaagagccugauuuuuugaggccaguaauucgu

SEQ ID NO: 695716 - RNA, 59 nt, hsa
cucugagcuggggaggugggaggccaggcgagccugacucuguugaucuacccgugccu

SEQ ID NO: 695717 - RNA, 59 nt, hsa
gcaccgucuucuagagcccuggcccacccgagccugagggcuggcggggagcagcccug

SEQ ID NO: 695718 - RNA, 59 nt, hsa
guaccaagaaguuccugccuuuugucucugagccugauguguguaggggugauggaaag

SEQ ID NO: 695719 - RNA, 59 nt, hsa
caguguucauagcuuccugcaacuugacagagccugaguuugccucuuagugggagaau

SEQ ID NO: 695720 - RNA, 59 nt, hsa
cucucccaccuccuccccagaugggaggagagccugaggcccaagcaggacccgggggu

SEQ ID NO: 695721 - RNA, 59 nt, hsa
ugcugaaguggccucuccauauuccagcugagccugaaucugacucuugaggguugggg

SEQ ID NO: 695722 - RNA, 59 nt, hsa
uaguauuagcgugaugcuugggguuauuggagccugagcuugaccucaaacggguggcg

SEQ ID NO: 695723 - RNA, 59 nt, hsa
accucggugggcccaguggggaggagcaggagccugagccuugggaacaugcgugugac

SEQ ID NO: 695724 - RNA, 59 nt, hsa
accucagugggcccaguggggaggagcaggagccugagccuugggaacaugcgugugac

SEQ ID NO: 695725 - RNA, 59 nt, hsa
cauagcacugccucuuccagggccucugggagccugacagugcccagcaugaagguggg

SEQ ID NO: 695726 - RNA, 59 nt, hsa
ggcucacgccuguagucccagguacuugggagccugaggcaggaggauugcuugagcuc

SEQ ID NO: 695727 - RNA, 59 nt, hsa
ucagccugcagagaagaaagugaggccgggagccugagccugggcuggagccuucuccc

SEQ ID NO: 695728 - RNA, 59 nt, hsa
uuccuccaugcuugugaacugcacaacuugagccugacuguacaucucuuggauuuguu

SEQ ID NO: 695729 - RNA, 59 nt, hsa
ggcacgcaccuguagucccagcuacuugggagccugaggcaggagaaucgcuugaaccu

SEQ ID NO: 695730 - RNA, 59 nt, hsa
agccccgacugcccaccugagggcagggagagccugaccccauuggcccaggcccuggc

SEQ ID NO: 695731 - RNA, 59 nt, hsa
cugguacacgaagggaacugucugcccaggagccugagccucaggcuguuggagaagca

SEQ ID NO: 695732 - RNA, 59 nt, hsa
aaggacauagagguauauuggaagaggcagagccugaggugguaggaggaggacccugg

SEQ ID NO: 695733 - RNA, 59 nt, hsa
gguuucuucaggguaaacuagcaaugccugagccugaaccuuaauguggggccucaguu

SEQ ID NO: 695734 - RNA, 59 nt, hsa
caugaugagucugaaggcauuugcaggaugagccugaacugguugugcagaacaaacaa

SEQ ID NO: 695735 - RNA, 59 nt, hsa
cuagcugaugagggacagaaccagaacuagagccugagcccaacccacaucacuauucu

SEQ ID NO: 695736 - RNA, 59 nt, hsa
cggagggggacgccccacggggcccugcggagccugaagccggagagcaggcggcucuu

SEQ ID NO: 695737 - RNA, 59 nt, hsa
uccccaaguuggaccuugauauuuauucugagccugagcucagauaauauauuauauau

SEQ ID NO: 695738 - RNA, 59 nt, hsa
ucaccaaaugaugccacuucccagaggcagagccugagucacuggucacccuuaauauu

SEQ ID NO: 695739 - RNA, 59 nt, hsa
cuggcaggcuuccaaacugaggaaagcuggagccugacgucagagcuuuuaacucggac

SEQ ID NO: 695740 - RNA, 59 nt, hsa
ggcgcaugccuguaaucccagcuacuugggagccugaggcgggagaauugcuugaaccc

SEQ ID NO: 695741 - RNA, 59 nt, hsa
gguucaguaaagaaagaaauguguuaacugagccugaaucccuucugggaaguaauaau

SEQ ID NO: 695742 - RNA, 59 nt, hsa
cugcacccugacaggcacaccccacugaagagccugagucccaggaggccuccuggaag

SEQ ID NO: 695743 - RNA, 59 nt, hsa
acuccgcugccgacccugccugagcgcgggagccugaggaccggguggaggcggugggg

SEQ ID NO: 695744 - RNA, 59 nt, hsa
ccccagcccuggggauggggaaggacauggagccugagccagagaaccagcucugaguc

SEQ ID NO: 695745 - RNA, 59 nt, hsa
ucacaggccgaugggguaagacuucgagagagccugauccuggggucuucugagacucc

SEQ ID NO: 695746 - RNA, 59 nt, hsa
uucugugcucccuccugagaacccuuuaugagccugauuccucagucucaccagaauuc

SEQ ID NO: 695747 - RNA, 59 nt, hsa
gggggcggggccuacauuccaauggggcggagccugagcuaggggguguggccuggcug

SEQ ID NO: 695748 - RNA, 59 nt, hsa
gccuggacuccuguccagacaccuggugagagccugaggcugguguucagggcccugga

SEQ ID NO: 695749 - RNA, 59 nt, hsa
aaaaggcaugggccugaauucaggcugcagagccugacuccucccuguggcuacuuuug

SEQ ID NO: 695750 - RNA, 59 nt, hsa
gagcaggggucgccaaauguuuucuuaaagagccugauaguguauauguuaggcuuugu

SEQ ID NO: 695751 - RNA, 59 nt, hsa
gcuaccuccucaccuugcaggagggccgugagccugacuacucagaguacaaggaguuc

SEQ ID NO: 695752 - RNA, 59 nt, hsa
aggaaaaucacuccuacacgcuaucccuggagccugagacugggugccagcuucgccau

SEQ ID NO: 695753 - RNA, 59 nt, hsa
ucccagcccuggggacggggaaggacauggagccugagccagagaaccagcucugaguc

SEQ ID NO: 695754 - RNA, 59 nt, hsa
ggggagcccaaaucuagggagagacuccugagccugaggucccuggaaugagugugggu

SEQ ID NO: 695755 - RNA, 59 nt, hsa
agugugcaucuguagucucagcaacuuaggagccugaggcaggagaaugguuugaacac

SEQ ID NO: 695756 - RNA, 59 nt, hsa
ccagccagccugagcucuccugcaagacagagccugauguggcacggagugggguugcg

SEQ ID NO: 695757 - RNA, 59 nt, hsa
auaacccagagagggagcuggacuucagggagccugagugaugcuuucccaggagcagg

SEQ ID NO: 695758 - RNA, 59 nt, hsa
ucacacuuccagcgcccagguccaagucugagccugaccuccccuuggggaccuagccu

SEQ ID NO: 695759 - RNA, 59 nt, hsa
ugcucucugugcucaccuccuaggccauggagccugagggggccugcaccagguuugcu

SEQ ID NO: 695760 - RNA, 59 nt, hsa
cucaggaggcugaagcaggaggaucacuugagccugaguucaacacugcagugagcuau

SEQ ID NO: 695761 - RNA, 59 nt, hsa
agagguauuuaucuuuacuuuuaaacagugagccugaauuuuguugcuguuuugauuug

SEQ ID NO: 695762 - RNA, 59 nt, hsa
agcaugccacugagcaaggagagaugggugagccugaagauggucccuuugguuucugg

SEQ ID NO: 695763 - RNA, 59 nt, hsa
cagacuugaaaaugacaaaacccucaguugagccugagcccccggcgcgggggcugcua

SEQ ID NO: 695764 - RNA, 59 nt, hsa
auaagguuuuucagcaggaguuacacugggagccugagguccucaccuuccucucagua

SEQ ID NO: 695765 - RNA, 59 nt, hsa
cccagccucuccacucccccgccagaaaggagccugagugauucucuuuucuucuuguu

SEQ ID NO: 695766 - RNA, 59 nt, hsa
ggugggugccuguaaucccagcuacaugggagccugaggcaugagaaucacuugaacuc

SEQ ID NO: 695767 - RNA, 59 nt, hsa
caagcgcuucugcugaaaguucauaucuggagccugaugucuuaacgaauaaagguccc

SEQ ID NO: 695768 - RNA, 59 nt, hsa
aggcgccuguaccuggcccaggcuggccugagccugaugcugggggugccucuguggcg

SEQ ID NO: 695769 - RNA, 59 nt, hsa
cccuggaucugccaccuagcagacguggggagccugaccccaugccugucauggaaccc

SEQ ID NO: 695770 - RNA, 59 nt, hsa
ccccucuagagacccuccagcuaaaaacagagccugaguucagggacccaaguggugag

SEQ ID NO: 695771 - RNA, 59 nt, hsa
agccucagauuccaauagcucacucccuagagccugacgccggggccccugaccccuga

SEQ ID NO: 695772 - RNA, 59 nt, hsa
agccucagauuccaauaccucacuccccagagccugaugccggggccccugaccccuga

SEQ ID NO: 695773 - RNA, 59 nt, hsa
cuccaacucuccgugaggccccucucccagagccugacacacucuguggccgaacucua

SEQ ID NO: 695774 - RNA, 59 nt, hsa
gaccacgcagcagagucccccacgggccugagccugagagcucagaggauuccugccag

SEQ ID NO: 695775 - RNA, 59 nt, hsa
aacaacaaguacgcggccagcagcuaccugagccugacgcccgagcaguggaggucccg

SEQ ID NO: 695776 - RNA, 59 nt, hsa
gacgggcuuggcucccucucugccauacugagccugagguauuucauaucuccugcugu

SEQ ID NO: 695777 - RNA, 59 nt, hsa
agcucauagggaagaaagagcugcagcuggagccugacccucccuggaacagggagagg

SEQ ID NO: 695778 - RNA, 59 nt, hsa
ugucccccccacauaaagagagcuucucagagccugacugaagagcugacguuuugcuu

SEQ ID NO: 695779 - RNA, 59 nt, hsa
uguuacaaaccaccaaauaauacaguugugagccugaauacaggacugaacuccuauac

SEQ ID NO: 695780 - RNA, 59 nt, hsa
uuuauuuauuuuuugaaggccacugggaggagccugaccuaaccuuuuagggugguuag

SEQ ID NO: 695781 - RNA, 59 nt, hsa
acuucuuccccccauccucagacauuaaagagccugaaugccuuugagucacauggccc

SEQ ID NO: 695782 - RNA, 59 nt, hsa
uggaaggcaggaugaggagagguaugaaggagccugagccaugaagugggaagcccagu

SEQ ID NO: 695783 - RNA, 59 nt, hsa
aagucagacuuguauuauaagucaaggaugagccugaucuggggagagggccggggcuc

SEQ ID NO: 695784 - RNA, 59 nt, hsa
gguucccaggagggagaaagagaagacaagagccugaugcccaacuuuguguguguggg

SEQ ID NO: 695785 - RNA, 59 nt, hsa
uggacagucuucucuguugaucacagagggagccugaguacaggcuuggagaaauggcu

SEQ ID NO: 695786 - RNA, 59 nt, hsa
cagugagccaaacccgguggcugcuucaugagccugacugccucucgccugcucucagc

SEQ ID NO: 695787 - RNA, 59 nt, hsa
cucaggaggcugagaugagaggaucacuugagccugaggagguccaggccacagugauc

SEQ ID NO: 695788 - RNA, 64 nt, hsa
auauuugaaacagauuuuaaaaacuugaaaaauuacaggugagauuucuguuuaugccagauua

SEQ ID NO: 695789 - RNA, 64 nt, hsa
uaaccuggugacuggcucuuaucacuucuaguuuacaggugagggaaccaaguuucacagaggc

SEQ ID NO: 695790 - RNA, 64 nt, hsa
aauauacauuucacagauaaacuguaacaggugaacaggugaacacaaacaugagggaggguug

SEQ ID NO: 695791 - RNA, 64 nt, hsa
gauauauaaauauacauuucacagauaaacuguaacaggugaacaggugaacacaaacaugagg

SEQ ID NO: 695792 - RNA, 64 nt, hsa
gcuugcuagggaaccugcaugccuaguaagcgccacaggugacucugaugcaggcgccacagcc

SEQ ID NO: 695793 - RNA, 64 nt, hsa
accuuggacagaggucaauccuugaugcuccagcacaggugacgucacuaauugucacuuucca

SEQ ID NO: 695794 - RNA, 64 nt, hsa
aucccuccccucagccuccugaguagcugagacuacaggugagugccaccacacucagcuaauu

SEQ ID NO: 695795 - RNA, 64 nt, hsa
cucuccugccucagccucccgaguaguugggauuacaggugacugccaccgugcccggcuaaug

SEQ ID NO: 695796 - RNA, 64 nt, hsa
ugauuaucuuuuagagaaguauacugaaaaauguacaggugaaaugauauguuacugguauucg

SEQ ID NO: 695797 - RNA, 64 nt, hsa
gaugugaacccagugaucaguggaauugucaaguacaggugagcacuucuguguucccaagaag

SEQ ID NO: 695798 - RNA, 64 nt, hsa; identical to SEQ ID NO: 53319

SEQ ID NO: 695799 - RNA, 64 nt, hsa; identical to SEQ ID NO: 53320

SEQ ID NO: 695800 - RNA, 64 nt, hsa; identical to SEQ ID NO: 53321

SEQ ID NO: 695801 - RNA, 64 nt, hsa; identical to SEQ ID NO: 53322

SEQ ID NO: 695802 - RNA, 64 nt, hsa; identical to SEQ ID NO: 53323

SEQ ID NO: 695803 - RNA, 64 nt, hsa; identical to SEQ ID NO: 53324

SEQ ID NO: 695804 - RNA, 64 nt, hsa; identical to SEQ ID NO: 53325

SEQ ID NO: 695805 - RNA, 64 nt, hsa; identical to SEQ ID NO: 53326

SEQ ID NO: 695806 - RNA, 64 nt, hsa; identical to SEQ ID NO: 53327

SEQ ID NO: 695807 - RNA, 64 nt, hsa; identical to SEQ ID NO: 53328

SEQ ID NO: 695808 - RNA, 64 nt, hsa; identical to SEQ ID NO: 53329

SEQ ID NO: 695809 - RNA, 64 nt, hsa; identical to SEQ ID NO: 53330

SEQ ID NO: 695810 - RNA, 64 nt, hsa; identical to SEQ ID NO: 53331

SEQ ID NO: 695811 - RNA, 64 nt, hsa; identical to SEQ ID NO: 53332

SEQ ID NO: 695812 - RNA, 64 nt, hsa; identical to SEQ ID NO: 53333

SEQ ID NO: 695813 - RNA, 64 nt, hsa; identical to SEQ ID NO: 53334

SEQ ID NO: 695814 - RNA, 64 nt, hsa
cggcugugacuauacagaaccaggccuggcguugcuuccgcaccgguagcaguuguggauguca

SEQ ID NO: 695815 - RNA, 64 nt, hsa
acaauacauccuaugcuuucugugcagacuggugcuuccgcagaaaggagaugccaauucugcu

SEQ ID NO: 695816 - RNA, 64 nt, hsa
acaccugggcaggagugcucucaccacgaggcugcuuccgcagggaacccuggccugcccgcga

SEQ ID NO: 695817 - RNA, 64 nt, hsa
ggugugacaggguagaggaggugggagaugagaucuuccgcacaggaacacgccagucccccuu

SEQ ID NO: 695818 - RNA, 64 nt, hsa
gguagugcccaagccuggucguguugccaggaguggugacaagaaaugcagcuuacaucaaacg

SEQ ID NO: 695819 - RNA, 64 nt, hsa
uguuucuacaaaucucucucaaauguauuauuuuggugacaaaaaugaaggagcuuuguaaauu

SEQ ID NO: 695820 - RNA, 64 nt, hsa
uguuacagcaguuugccaaggcggggaccuaacuggugacaauugagccucuugacugguacuc

SEQ ID NO: 695821 - RNA, 64 nt, hsa
aguagucauucuuagccuugcuuuuguaaaguuaggugacaaguuauuccaugugaugcuugug

SEQ ID NO: 695822 - RNA, 64 nt, hsa
uuaucaguuguuauuguuaucccuugaaagcgagggugacaaaaacaacaaaacaccguuauaa

SEQ ID NO: 695823 - RNA, 64 nt, hsa
acguauaucuuaauucuggguugcuuguuuuuuaggugacaaaaauaaaauauuguauuuuaau

SEQ ID NO: 695824 - RNA, 64 nt, hsa
ucgggaagaaggggacaauggcagaacagguguuggugacaauugucaccaauuggauaaagca

SEQ ID NO: 695825 - RNA, 64 nt, hsa
gugagccgagaucgugccauugcacuccagccugggugacaaagcgagacuccaucucaaaaaa

SEQ ID NO: 695826 - RNA, 64 nt, hsa
gugagccaagauggcgccauugcacuccagccugggugacaagagugaaacuccaucucaaaaa

SEQ ID NO: 695827 - RNA, 64 nt, hsa
aguaagccaugauugcgccacugcacucagcccgggugacaaagcaagacccugucucagaaaa

SEQ ID NO: 695828 - RNA, 64 nt, hsa
gccacaggagaaaaaucuucaggaucuugggcuaggugacaaguucuuggacuuugccccgaaa

SEQ ID NO: 695829 - RNA, 64 nt, hsa
auacuguaugaucgcauuuauauaacauucuugaggugacaaaauuauugaaaugaagaacaga

SEQ ID NO: 695830 - RNA, 64 nt, hsa
uggaaaugcgugugaccugugaagugguguauugucacaguagcuuauuugaacuugagaccau

SEQ ID NO: 695831 - RNA, 64 nt, hsa
auuauggaaaauuacuuaaaacgugaauacaucaucacaguagaauuuauuaugagagcaugua

SEQ ID NO: 695832 - RNA, 64 nt, hsa
aaaguuuuaagaaaagauucauuuggaauuuuauucacaguauaaaauuuccucaccugaagua

SEQ ID NO: 695833 - RNA, 64 nt, hsa
uauaaaaguguccuaagcauauuagccaaucuuuucacaguagagcauacuuaaggcugcuugg

SEQ ID NO: 695834 - RNA, 64 nt, hsa
aaaaccuggccgucucuucuauucacaguacacgucacaguauugaugugauucaaaauguuuc

SEQ ID NO: 695835 - RNA, 64 nt, hsa
ucagugcuggccaaaaccuggccgucucuucuauucacaguacacgucacaguauugaugugau

SEQ ID NO: 695836 - RNA, 64 nt, hsa; identical to SEQ ID NO: 69124

SEQ ID NO: 695837 - RNA, 64 nt, hsa; identical to SEQ ID NO: 69125

SEQ ID NO: 695838 - RNA, 64 nt, hsa; identical to SEQ ID NO: 69126

SEQ ID NO: 695839 - RNA, 64 nt, hsa; identical to SEQ ID NO: 69127

SEQ ID NO: 695840 - RNA, 64 nt, hsa; identical to SEQ ID NO: 69128

SEQ ID NO: 695841 - RNA, 64 nt, hsa; identical to SEQ ID NO: 69129

SEQ ID NO: 695842 - RNA, 64 nt, hsa; identical to SEQ ID NO: 77130

SEQ ID NO: 695843 - RNA, 64 nt, hsa; identical to SEQ ID NO: 77131

SEQ ID NO: 695844 - RNA, 64 nt, hsa; identical to SEQ ID NO: 77132

SEQ ID NO: 695845 - RNA, 64 nt, hsa; identical to SEQ ID NO: 77133

SEQ ID NO: 695846 - RNA, 64 nt, hsa; identical to SEQ ID NO: 77134

SEQ ID NO: 695847 - RNA, 64 nt, hsa; identical to SEQ ID NO: 77135

SEQ ID NO: 695848 - RNA, 64 nt, hsa; identical to SEQ ID NO: 77136

SEQ ID NO: 695849 - RNA, 62 nt, hsa; identical to SEQ ID NO: 77137

SEQ ID NO: 695850 - RNA, 64 nt, hsa; identical to SEQ ID NO: 77138

SEQ ID NO: 695851 - RNA, 64 nt, hsa; identical to SEQ ID NO: 77139

SEQ ID NO: 695852 - RNA, 64 nt, hsa; identical to SEQ ID NO: 77140

SEQ ID NO: 695853 - RNA, 64 nt, hsa; identical to SEQ ID NO: 77141

SEQ ID NO: 695854 - RNA, 64 nt, hsa; identical to SEQ ID NO: 77142

SEQ ID NO: 695855 - RNA, 64 nt, hsa; identical to SEQ ID NO: 77143

SEQ ID NO: 695856 - RNA, 64 nt, hsa; identical to SEQ ID NO: 77144

SEQ ID NO: 695857 - RNA, 64 nt, hsa; identical to SEQ ID NO: 77145

SEQ ID NO: 695858 - RNA, 64 nt, hsa; identical to SEQ ID NO: 77146

SEQ ID NO: 695859 - RNA, 64 nt, hsa; identical to SEQ ID NO: 77147

SEQ ID NO: 695860 - RNA, 64 nt, hsa; identical to SEQ ID NO: 77148

SEQ ID NO: 695861 - RNA, 64 nt, hsa; identical to SEQ ID NO: 77149

SEQ ID NO: 695862 - RNA, 64 nt, hsa; identical to SEQ ID NO: 77150

SEQ ID NO: 695863 - RNA, 64 nt, hsa; identical to SEQ ID NO: 77151

SEQ ID NO: 695864 - RNA, 64 nt, hsa; identical to SEQ ID NO: 77152

SEQ ID NO: 695865 - RNA, 64 nt, hsa; identical to SEQ ID NO: 77153

SEQ ID NO: 695866 - RNA, 64 nt, hsa; identical to SEQ ID NO: 77154

SEQ ID NO: 695867 - RNA, 64 nt, hsa; identical to SEQ ID NO: 77155

SEQ ID NO: 695868 - RNA, 64 nt, hsa; identical to SEQ ID NO: 77156

SEQ ID NO: 695869 - RNA, 64 nt, hsa; identical to SEQ ID NO: 77157

SEQ ID NO: 695870 - RNA, 64 nt, hsa; identical to SEQ ID NO: 77158

SEQ ID NO: 695871 - RNA, 64 nt, hsa; identical to SEQ ID NO: 77159

SEQ ID NO: 695872 - RNA, 64 nt, hsa; identical to SEQ ID NO: 77160

SEQ ID NO: 695873 - RNA, 64 nt, hsa; identical to SEQ ID NO: 437863

SEQ ID NO: 695874 - RNA, 64 nt, hsa; identical to SEQ ID NO: 437864

SEQ ID NO: 695875 - RNA, 64 nt, hsa; identical to SEQ ID NO: 284748

SEQ ID NO: 695876 - RNA, 64 nt, hsa; identical to SEQ ID NO: 284749

SEQ ID NO: 695877 - RNA, 64 nt, hsa; identical to SEQ ID NO: 284750

SEQ ID NO: 695878 - RNA, 64 nt, hsa; identical to SEQ ID NO: 284751

SEQ ID NO: 695879 - RNA, 64 nt, hsa; identical to SEQ ID NO: 284752

SEQ ID NO: 695880 - RNA, 64 nt, hsa; identical to SEQ ID NO: 284753

SEQ ID NO: 695881 - RNA, 64 nt, hsa; identical to SEQ ID NO: 284754

SEQ ID NO: 695882 - RNA, 64 nt, hsa; identical to SEQ ID NO: 284755

SEQ ID NO: 695883 - RNA, 64 nt, hsa; identical to SEQ ID NO: 284756

SEQ ID NO: 695884 - RNA, 64 nt, hsa; identical to SEQ ID NO: 284757

SEQ ID NO: 695885 - RNA, 64 nt, hsa; identical to SEQ ID NO: 284758

SEQ ID NO: 695886 - RNA, 64 nt, hsa; identical to SEQ ID NO: 284759

SEQ ID NO: 695887 - RNA, 64 nt, hsa; identical to SEQ ID NO: 284760

SEQ ID NO: 695888 - RNA, 64 nt, hsa; identical to SEQ ID NO: 284761

SEQ ID NO: 695889 - RNA, 64 nt, hsa; identical to SEQ ID NO: 284762

SEQ ID NO: 695890 - RNA, 64 nt, hsa; identical to SEQ ID NO: 284763

SEQ ID NO: 695891 - RNA, 64 nt, hsa; identical to SEQ ID NO: 284764

SEQ ID NO: 695892 - RNA, 64 nt, hsa; identical to SEQ ID NO: 284765

SEQ ID NO: 695893 - RNA, 64 nt, hsa; identical to SEQ ID NO: 284766

SEQ ID NO: 695894 - RNA, 64 nt, hsa; identical to SEQ ID NO: 284767

SEQ ID NO: 695895 - RNA, 64 nt, hsa; identical to SEQ ID NO: 284768

SEQ ID NO: 695896 - RNA, 64 nt, hsa; identical to SEQ ID NO: 284769

SEQ ID NO: 695897 - RNA, 64 nt, hsa; identical to SEQ ID NO: 284770

SEQ ID NO: 695898 - RNA, 64 nt, hsa; identical to SEQ ID NO: 284771

SEQ ID NO: 695899 - RNA, 64 nt, hsa; identical to SEQ ID NO: 284772

SEQ ID NO: 695900 - RNA, 64 nt, hsa; identical to SEQ ID NO: 284773

SEQ ID NO: 695901 - RNA, 64 nt, hsa; identical to SEQ ID NO: 284774

SEQ ID NO: 695902 - RNA, 64 nt, hsa; identical to SEQ ID NO: 284775

SEQ ID NO: 695903 - RNA, 64 nt, hsa; identical to SEQ ID NO: 284776

SEQ ID NO: 695904 - RNA, 64 nt, hsa; identical to SEQ ID NO: 284777

SEQ ID NO: 695905 - RNA, 64 nt, hsa; identical to SEQ ID NO: 284778

SEQ ID NO: 695906 - RNA, 64 nt, hsa; identical to SEQ ID NO: 284779

SEQ ID NO: 695907 - RNA, 64 nt, hsa; identical to SEQ ID NO: 284780

SEQ ID NO: 695908 - RNA, 64 nt, hsa; identical to SEQ ID NO: 284781

SEQ ID NO: 695909 - RNA, 64 nt, hsa; identical to SEQ ID NO: 284782

SEQ ID NO: 695910 - RNA, 64 nt, hsa; identical to SEQ ID NO: 284783

SEQ ID NO: 695911 - RNA, 64 nt, hsa; identical to SEQ ID NO: 284784

SEQ ID NO: 695912 - RNA, 64 nt, hsa; identical to SEQ ID NO: 284785

SEQ ID NO: 695913 - RNA, 64 nt, hsa; identical to SEQ ID NO: 284786

SEQ ID NO: 695914 - RNA, 64 nt, hsa; identical to SEQ ID NO: 284787

SEQ ID NO: 695915 - RNA, 64 nt, hsa; identical to SEQ ID NO: 284788

SEQ ID NO: 695916 - RNA, 64 nt, hsa; identical to SEQ ID NO: 284789

SEQ ID NO: 695917 - RNA, 64 nt, hsa; identical to SEQ ID NO: 284790

SEQ ID NO: 695918 - RNA, 64 nt, hsa; identical to SEQ ID NO: 284791

SEQ ID NO: 695919 - RNA, 64 nt, hsa; identical to SEQ ID NO: 284792

SEQ ID NO: 695920 - RNA, 64 nt, hsa; identical to SEQ ID NO: 284793

SEQ ID NO: 695921 - RNA, 64 nt, hsa; identical to SEQ ID NO: 284794

SEQ ID NO: 695922 - RNA, 64 nt, hsa; identical to SEQ ID NO: 284795

SEQ ID NO: 695923 - RNA, 64 nt, hsa; identical to SEQ ID NO: 284796

SEQ ID NO: 695924 - RNA, 64 nt, hsa; identical to SEQ ID NO: 284797

SEQ ID NO: 695925 - RNA, 64 nt, hsa; identical to SEQ ID NO: 284798

SEQ ID NO: 695926 - RNA, 64 nt, hsa; identical to SEQ ID NO: 284799

SEQ ID NO: 695927 - RNA, 64 nt, hsa; identical to SEQ ID NO: 284800

SEQ ID NO: 695928 - RNA, 64 nt, hsa; identical to SEQ ID NO: 284801

SEQ ID NO: 695929 - RNA, 64 nt, hsa; identical to SEQ ID NO: 284802

SEQ ID NO: 695930 - RNA, 64 nt, hsa; identical to SEQ ID NO: 284803

SEQ ID NO: 695931 - RNA, 64 nt, hsa; identical to SEQ ID NO: 284804

SEQ ID NO: 695932 - RNA, 64 nt, hsa; identical to SEQ ID NO: 284805

SEQ ID NO: 695933 - RNA, 64 nt, hsa; identical to SEQ ID NO: 284806

SEQ ID NO: 695934 - RNA, 64 nt, hsa; identical to SEQ ID NO: 284807

SEQ ID NO: 695935 - RNA, 64 nt, hsa; identical to SEQ ID NO: 284808

SEQ ID NO: 695936 - RNA, 64 nt, hsa; identical to SEQ ID NO: 284809

SEQ ID NO: 695937 - RNA, 64 nt, hsa; identical to SEQ ID NO: 284810

SEQ ID NO: 695938 - RNA, 64 nt, hsa; identical to SEQ ID NO: 284811

SEQ ID NO: 695939 - RNA, 64 nt, hsa; identical to SEQ ID NO: 284812

SEQ ID NO: 695940 - RNA, 64 nt, hsa; identical to SEQ ID NO: 284813

SEQ ID NO: 695941 - RNA, 64 nt, hsa; identical to SEQ ID NO: 284814

SEQ ID NO: 695942 - RNA, 64 nt, hsa; identical to SEQ ID NO: 284815

SEQ ID NO: 695943 - RNA, 64 nt, hsa; identical to SEQ ID NO: 284816

SEQ ID NO: 695944 - RNA, 64 nt, hsa; identical to SEQ ID NO: 284817

SEQ ID NO: 695945 - RNA, 64 nt, hsa; identical to SEQ ID NO: 284818

SEQ ID NO: 695946 - RNA, 64 nt, hsa; identical to SEQ ID NO: 284819

SEQ ID NO: 695947 - RNA, 64 nt, hsa; identical to SEQ ID NO: 284820

SEQ ID NO: 695948 - RNA, 64 nt, hsa; identical to SEQ ID NO: 284821

SEQ ID NO: 695949 - RNA, 64 nt, hsa; identical to SEQ ID NO: 284822

SEQ ID NO: 695950 - RNA, 64 nt, hsa; identical to SEQ ID NO: 284823

SEQ ID NO: 695951 - RNA, 64 nt, hsa; identical to SEQ ID NO: 284824

SEQ ID NO: 695952 - RNA, 57 nt, hsa; identical to SEQ ID NO: 284825

SEQ ID NO: 695953 - RNA, 52 nt, hsa; identical to SEQ ID NO: 284826

SEQ ID NO: 695954 - RNA, 64 nt, hsa; identical to SEQ ID NO: 284827

SEQ ID NO: 695955 - RNA, 64 nt, hsa; identical to SEQ ID NO: 284828

SEQ ID NO: 695956 - RNA, 64 nt, hsa; identical to SEQ ID NO: 284829

SEQ ID NO: 695957 - RNA, 64 nt, hsa; identical to SEQ ID NO: 284830

SEQ ID NO: 695958 - RNA, 64 nt, hsa; identical to SEQ ID NO: 284831

SEQ ID NO: 695959 - RNA, 64 nt, hsa; identical to SEQ ID NO: 284832

SEQ ID NO: 695960 - RNA, 64 nt, hsa; identical to SEQ ID NO: 284833

SEQ ID NO: 695961 - RNA, 64 nt, hsa; identical to SEQ ID NO: 284834

SEQ ID NO: 695962 - RNA, 64 nt, hsa; identical to SEQ ID NO: 284835

SEQ ID NO: 695963 - RNA, 64 nt, hsa; identical to SEQ ID NO: 284836

SEQ ID NO: 695964 - RNA, 64 nt, hsa; identical to SEQ ID NO: 284837

SEQ ID NO: 695965 - RNA, 64 nt, hsa; identical to SEQ ID NO: 284838

SEQ ID NO: 695966 - RNA, 64 nt, hsa; identical to SEQ ID NO: 284839

SEQ ID NO: 695967 - RNA, 64 nt, hsa; identical to SEQ ID NO: 284840

SEQ ID NO: 695968 - RNA, 64 nt, hsa
auggaauaguauccccuuauguuuaguugaaauguccccuuaacuugauauaauguguuaugcu

SEQ ID NO: 695969 - RNA, 64 nt, hsa
aaucagccuaugccagggcuucaauggaauaguauccccuuauguuuaguugaaauguccccuu

SEQ ID NO: 695970 - RNA, 64 nt, hsa
auaucauuuccccccagucagcauuauuuaacacuccccuuaacugucuuugaacuuucucuuu

SEQ ID NO: 695971 - RNA, 64 nt, hsa
acuuugaugcauuuauuuuuagguguuuuuuuuuuccccuuaaaaaacuugaagugauaugcag

SEQ ID NO: 695972 - RNA, 64 nt, hsa
augagauuggauuugaccccuuggcucucaaguguccccuuagaucuagaacugcuccuuggug

SEQ ID NO: 695973 - RNA, 64 nt, hsa
gcaucugaagacuggguuuuuuuguuguuguuguuccccuuacagacaaaaugaagacuaucau

SEQ ID NO: 695974 - RNA, 64 nt, hsa
ugaagucuuucguagacaccccagagcacacacauccccuuaguccaccgguuagaugucucuc

SEQ ID NO: 695975 - RNA, 64 nt, hsa
gggaacacguccuaggcaggucugacgugaaaccuccccuuacccugaaccgugugacucugca

SEQ ID NO: 695976 - RNA, 64 nt, hsa
cauauugacaaaaugguuuccggaaauauuuguauccccuuacacugccaccagcaaggauaaa

SEQ ID NO: 695977 - RNA, 64 nt, hsa
ugcagcuguuuucacuuagcauaucgugggcaucuccccuuaugauuacuaaauauuuuauuuu

SEQ ID NO: 695978 - RNA, 64 nt, hsa
ucaacucugaaagagcaaaccuaacaggagaaaggacaaccaggaugaggaugucaccaacuga

SEQ ID NO: 695979 - RNA, 63 nt, hsa
ggagcccagcuuuuugguaaugccagcucaggugacaaccauuaugaucaaaaacugccuucc

SEQ ID NO: 695980 - RNA, 64 nt, hsa; identical to SEQ ID NO: 130376

SEQ ID NO: 695981 - RNA, 64 nt, hsa; identical to SEQ ID NO: 130377

SEQ ID NO: 695982 - RNA, 64 nt, hsa; identical to SEQ ID NO: 130378

SEQ ID NO: 695983 - RNA, 64 nt, hsa; identical to SEQ ID NO: 130379

SEQ ID NO: 695984 - RNA, 64 nt, hsa
cucccaaucaugucucuuuauguaaagacaguaacaugcaaacacuuuuaguuuacaucccuca

SEQ ID NO: 695985 - RNA, 64 nt, hsa
cauauuuuuguuaccuaaugcauccacugaugaacaugcaaacuuugggcauaaugugaacuaa

SEQ ID NO: 695986 - RNA, 64 nt, hsa
uuuuuuuucuuuuuccugcuguauaacuccuugccaugcaaacucucaagaggccaauauauuc

SEQ ID NO: 695987 - RNA, 64 nt, hsa
uguuugaaugagccucuuaaaauaaacuuagagccaugcaaaugccagcagcuuaauggauuuc

SEQ ID NO: 695988 - RNA, 64 nt, hsa
ggcaaagcuaucuuccccaaguggaaccucagugcaugcaaaucucugaugguggcuuccaggg

SEQ ID NO: 695989 - RNA, 64 nt, hsa
accagccauucagaaaacuucuuauagcuaccuucaugcaaaacuguuuucuucuuccuucuca

SEQ ID NO: 695990 - RNA, 64 nt, hsa
uugaaugaacuguaaaguacagccauaccuuggacaugcaaauauaaaucuauggagcauucuc

SEQ ID NO: 695991 - RNA, 64 nt, hsa
uucuugauguaauuuaucaccauaaaaaaaaacccaugcaaaccugagugagcacaggauuugc

SEQ ID NO: 695992 - RNA, 64 nt, hsa
gcucaucucugucccacuuggcaucagcuggcgucaugcaaagucaugcaaaggcugggaccac

SEQ ID NO: 695993 - RNA, 64 nt, hsa
gucccacuuggcaucagcuggcgucaugcaaagucaugcaaaggcugggaccacgugagaucau

SEQ ID NO: 695994 - RNA, 64 nt, hsa
gugggacgggcagcgguggggcacacccauuccacaugcaaagggcagaagcaaacccaguaaa

SEQ ID NO: 695995 - RNA, 64 nt, hsa
cccaggagaagccgccugagccacaaccuugcggcaugcaaaugagauggccgcuccaggccug

SEQ ID NO: 695996 - RNA, 64 nt, hsa; identical to SEQ ID NO: 433911

SEQ ID NO: 695997 - RNA, 64 nt, hsa; identical to SEQ ID NO: 433912

SEQ ID NO: 695998 - RNA, 64 nt, hsa; identical to SEQ ID NO: 433913

SEQ ID NO: 695999 - RNA, 64 nt, hsa; identical to SEQ ID NO: 433914

SEQ ID NO: 696000 - RNA, 64 nt, hsa; identical to SEQ ID NO: 433915

SEQ ID NO: 696001 - RNA, 64 nt, hsa; identical to SEQ ID NO: 433916

SEQ ID NO: 696002 - RNA, 64 nt, hsa; identical to SEQ ID NO: 433917

SEQ ID NO: 696003 - RNA, 64 nt, hsa; identical to SEQ ID NO: 433918

SEQ ID NO: 696004 - RNA, 64 nt, hsa; identical to SEQ ID NO: 433919

SEQ ID NO: 696005 - RNA, 64 nt, hsa; identical to SEQ ID NO: 433920

SEQ ID NO: 696006 - RNA, 64 nt, hsa; identical to SEQ ID NO: 433921

SEQ ID NO: 696007 - RNA, 64 nt, hsa; identical to SEQ ID NO: 433922

SEQ ID NO: 696008 - RNA, 64 nt, hsa; identical to SEQ ID NO: 433923

SEQ ID NO: 696009 - RNA, 61 nt, hsa; identical to SEQ ID NO: 433924

SEQ ID NO: 696010 - RNA, 64 nt, hsa; identical to SEQ ID NO: 433925

SEQ ID NO: 696011 - RNA, 60 nt, hsa; identical to SEQ ID NO: 433926

SEQ ID NO: 696012 - RNA, 64 nt, hsa; identical to SEQ ID NO: 433927

SEQ ID NO: 696013 - RNA, 64 nt, hsa; identical to SEQ ID NO: 433928

SEQ ID NO: 696014 - RNA, 64 nt, hsa; identical to SEQ ID NO: 433929

SEQ ID NO: 696015 - RNA, 64 nt, hsa; identical to SEQ ID NO: 433930

SEQ ID NO: 696016 - RNA, 64 nt, hsa; identical to SEQ ID NO: 433931

SEQ ID NO: 696017 - RNA, 64 nt, hsa; identical to SEQ ID NO: 433932

SEQ ID NO: 696018 - RNA, 64 nt, hsa; identical to SEQ ID NO: 433933

SEQ ID NO: 696019 - RNA, 64 nt, hsa; identical to SEQ ID NO: 433934

SEQ ID NO: 696020 - RNA, 64 nt, hsa; identical to SEQ ID NO: 433935

SEQ ID NO: 696021 - RNA, 64 nt, hsa; identical to SEQ ID NO: 433936

SEQ ID NO: 696022 - RNA, 64 nt, hsa; identical to SEQ ID NO: 433937

SEQ ID NO: 696023 - RNA, 64 nt, hsa; identical to SEQ ID NO: 433938

SEQ ID NO: 696024 - RNA, 64 nt, hsa; identical to SEQ ID NO: 433939

SEQ ID NO: 696025 - RNA, 64 nt, hsa; identical to SEQ ID NO: 433940

SEQ ID NO: 696026 - RNA, 64 nt, hsa; identical to SEQ ID NO: 433941

SEQ ID NO: 696027 - RNA, 64 nt, hsa; identical to SEQ ID NO: 433942

SEQ ID NO: 696028 - RNA, 64 nt, hsa; identical to SEQ ID NO: 158079

SEQ ID NO: 696029 - RNA, 64 nt, hsa; identical to SEQ ID NO: 158080

SEQ ID NO: 696030 - RNA, 64 nt, hsa; identical to SEQ ID NO: 158081

SEQ ID NO: 696031 - RNA, 64 nt, hsa; identical to SEQ ID NO: 158082

SEQ ID NO: 696032 - RNA, 64 nt, hsa; identical to SEQ ID NO: 158083

SEQ ID NO: 696033 - RNA, 64 nt, hsa; identical to SEQ ID NO: 158084

SEQ ID NO: 696034 - RNA, 64 nt, hsa; identical to SEQ ID NO: 158085

SEQ ID NO: 696035 - RNA, 64 nt, hsa; identical to SEQ ID NO: 158086

SEQ ID NO: 696036 - RNA, 64 nt, hsa; identical to SEQ ID NO: 158087

SEQ ID NO: 696037 - RNA, 64 nt, hsa
cacaagaccauuguacugcaauacuugaguauuuguguagcaaacagccucuuagguuggagag

SEQ ID NO: 696038 - RNA, 63 nt, hsa
uauugauacaaucuaauaaauaauguguuugacaguguagcagaaauaaugcuauguguucac

SEQ ID NO: 696039 - RNA, 64 nt, hsa
uuacuccuuugucgcuuauccagaaugaugcuauguguagcaucuugcuguaaauccuguacaa

SEQ ID NO: 696040 - RNA, 64 nt, hsa
uuucugcauuuaauagguuagaauguaaauuaaaguguagcaauagcaacaaaauauuuauucu

SEQ ID NO: 696041 - RNA, 64 nt, hsa
auugcagaaaaggcuucccuuggcucccaaggagguguagcaggugugagcaauauuagugcca

SEQ ID NO: 696042 - RNA, 64 nt, hsa
aauucuuccauacacaggugugcuucuagucaguguguagcaaggaaagccccguucacugcuc

SEQ ID NO: 696043 - RNA, 64 nt, hsa
caagauauuuggggaauaaaaauaacagcuugguguguagcaucugcagccacuuggcaaauga

SEQ ID NO: 696044 - RNA, 64 nt, hsa
ugaaaccugugacucagguuuaugaaugguguuuguguagcaacacauugugugcuauguuuau

SEQ ID NO: 696045 - RNA, 64 nt, hsa
uggcagcccccagcuccccucagugcugcugucaguguagcaaauaaagucaugauauuuuccu

SEQ ID NO: 696046 - RNA, 64 nt, hsa
ggguguggugaggguucuaggggaucucagauguguguagcacggagccugcuguguccugggu

SEQ ID NO: 696047 - RNA, 64 nt, hsa
agcaggccauacuguguuggggcaaaggugucccguguagcacucagauaaguauacagcgaca

SEQ ID NO: 696048 - RNA, 64 nt, hsa
caaccaaucguagauguuuuugcuguuccauucuguguagcaccauucaccacagcaggauagg

SEQ ID NO: 696049 - RNA, 64 nt, hsa
ugcugugcuggguuaacagcuuccuucccuuucuguguagcagucuugaaauguucuguuuaaa

SEQ ID NO: 696050 - RNA, 64 nt, hsa
aacacgagcacacucucuucgaacccaauuguggguguagcaaugaaagcaauaugauaugcug

SEQ ID NO: 696051 - RNA, 64 nt, hsa
uuuuuuuaccaacagcauacuuaacagacuugcuguguagcaguuuuuuucugguggaguugcu

SEQ ID NO: 696052 - RNA, 64 nt, hsa
gcaguauagaucugugcauagauauaugcauuaaguguagcaaaucgugauguaaauuuuuuac

SEQ ID NO: 696053 - RNA, 64 nt, hsa
uacuagcaaagacaugggcaccggaguaggucccguguagcaugcgggugcuguagagaaaauu

SEQ ID NO: 696054 - RNA, 64 nt, hsa
auaguaguuguuccuuagagcaauauguuguuacguguagcagaaauaaaguuuucuuugcuua

SEQ ID NO: 696055 - RNA, 64 nt, hsa
uuauaguuuaauaguaagggagauaacacagcauguguagcaccaguugauaauuggucucuag

SEQ ID NO: 696056 - RNA, 64 nt, hsa
aguguuauugaacuguaauucucucaauaacucaguguagcacuuuaaagucugaaggacagca

SEQ ID NO: 696057 - RNA, 64 nt, hsa
acuaagcauuuaaaagagaaucuaauuuuuaaagguguagcaccuuuuuuuuauucuucccaca

SEQ ID NO: 696058 - RNA, 64 nt, hsa
auagucacuguuuaaggaaaaaaguaauuaugagguguagcagauugcagaaaaacaggauuag

SEQ ID NO: 696059 - RNA, 64 nt, hsa
uagaaguguacggucacggucgccucaugaaaguguguagcagguggcucucaggaaaaauacc

SEQ ID NO: 696060 - RNA, 64 nt, hsa
uaggacaaacauagauaugacauuugcugccucaguguagcaauuggaaauauuuauaaguuau

SEQ ID NO: 696061 - RNA, 64 nt, hsa
uuuuuacuugaaauuaaauuuggcucuaaaguugguguagcagcaguugaucagacugaaaaac

SEQ ID NO: 696062 - RNA, 64 nt, hsa
uacuguauuuauaaacuuuguaccacaagagagaguguagcacccauuuuacagugccaugcac

SEQ ID NO: 696063 - RNA, 64 nt, hsa
ugcaugccuuucuaaagguaugcuagagucaccuguguagcauuguaauuauguacuaucaaac

SEQ ID NO: 696064 - RNA, 64 nt, hsa
agugaguuaucgugagaucugguaguuuaaaaguguguagcaccuccccacucucucuuucucc

SEQ ID NO: 696065 - RNA, 64 nt, hsa
gguacaaaggcaaaaggaccacagcaccacuuagguguagcauggauuuuaaacugcagucagu

SEQ ID NO: 696066 - RNA, 64 nt, hsa
uagguaacauguuaaugagggaaaauguuuaccaguguagcauuggaucaaaaaguuuaucaca

SEQ ID NO: 696067 - RNA, 64 nt, hsa
gacugugugcaccagucccagacacuuggcagaaguguagcagcguuacacaugugugcgaagc

SEQ ID NO: 696068 - RNA, 64 nt, hsa
ggcguguaucugguccuagugaagaggaaggccuguguagcagaaaggcuuugggccugagagg

SEQ ID NO: 696069 - RNA, 64 nt, hsa
uccugaaucuugggcccuuuugauugugaauacuguguagcaggaucuugagaguccuuguucu

SEQ ID NO: 696070 - RNA, 64 nt, hsa
gggacggguggugcuuaaaagaggaaggggaccaguguagcaacuugccagggaccccaccccu

SEQ ID NO: 696071 - RNA, 64 nt, hsa
gagauggaauucaagagagaagugucuccuccucguguagcagcuugagaagaggcuugggagu

SEQ ID NO: 696072 - RNA, 64 nt, hsa
agccucuuuccccgugucccguuggaucugagcuguguagcacuuguugcauuacaaagaaaaa

SEQ ID NO: 696073 - RNA, 64 nt, hsa
uguuuuaugguuucauguaacauacauauuccugguguagcacuuaacuccuuuuccacuuuaa

SEQ ID NO: 696074 - RNA, 64 nt, hsa
agguguauuacaucagguuuucaaaccagcccugguguagcagacacugcaacagaugccuccu

SEQ ID NO: 696075 - RNA, 64 nt, hsa
agagggcagaauccgcagcucucaucauugugauguguagcaugucugcccucugacuggacau

SEQ ID NO: 696076 - RNA, 64 nt, hsa
agaugagcccaaacuuucgaucuaggugggugauguguagcaguucaagggaagggugcugugu

SEQ ID NO: 696077 - RNA, 64 nt, hsa
aaugaacaguaauugccugguagguuugguguguguguagcauuguguguccaucuguuauaug

SEQ ID NO: 696078 - RNA, 64 nt, hsa
auuaaaagaaaacagcacagagaaguuaaaugcgguguagcaaaguuauggggucugcuugagg

SEQ ID NO: 696079 - RNA, 64 nt, hsa
uguccucuuccuuauuccucuagugguugaagcuguguagcauuuuaacauauauauauucaca

SEQ ID NO: 696080 - RNA, 64 nt, hsa
aacaucccaaggcugucccauaggguuggaaguuguguagcauucacucccuuaccuacuggca

SEQ ID NO: 696081 - RNA, 64 nt, hsa
auaucugaagcucucguucauuaauuuuaguccuguguagcagaauucaauuacgggaacuacc

SEQ ID NO: 696082 - RNA, 64 nt, hsa
cuuuuauuaucuaauacuaucuuacgucuaauuaguguagcauuuacaagaaagaaaaauuaag

SEQ ID NO: 696083 - RNA, 64 nt, hsa
cuguguacugcaguugguaugaccccucuaaggaguguagcaacuacagucuaaagcugguuua

SEQ ID NO: 696084 - RNA, 64 nt, hsa
ugauuuuuauccaugcgucaguuuuucccacccaguguagcauccuaaagauaaagccagaagc

SEQ ID NO: 696085 - RNA, 64 nt, hsa
uucagcagcaucuaucauguagauaaauucccagguguagcauuacagcuucugacuaauauag

SEQ ID NO: 696086 - RNA, 64 nt, hsa
ccuaggcagggcuggcuuucuuagcguguaacuuguguagcagcacagggcccacacuuagaag

SEQ ID NO: 696087 - RNA, 64 nt, hsa
aaaggaggccacaggagauuccugggagcacuggguguagcaaaacaaagccacucucugcuuc

SEQ ID NO: 696088 - RNA, 64 nt, hsa
gaagaagccuguaacacuccucugcgucuauccuguguagcauacuggcuucaccaucaauccu

SEQ ID NO: 696089 - RNA, 64 nt, hsa
uguaaauacaacagaacauuaauaaauaucucuuguguagcaccuuuuacuguagauuagugcu

SEQ ID NO: 696090 - RNA, 64 nt, hsa
cugggacuaugguacuaaauccaguagaugggcuguguagcaacucucccagggaacacacuag

SEQ ID NO: 696091 - RNA, 64 nt, hsa
gcggcuuccccaucgccuucuggggaggggcuccguguagcaacccagguguuguccgugucug

SEQ ID NO: 696092 - RNA, 64 nt, hsa
cuauaucaggaacaucccugagaaacgguuuuaaguguagcaacuacucuuccuuaauggacag

SEQ ID NO: 696093 - RNA, 64 nt, hsa
auauauucuguaaagugccauagucuuuuuuuauguguagcauauuuaaaaauauauauguaua

SEQ ID NO: 696094 - RNA, 64 nt, hsa
ccacaugcaaacacacacagccacauauauacauguguagcacagcgcuaaacacuguggaggc

SEQ ID NO: 696095 - RNA, 64 nt, hsa
cgaaggaaccauccuugguucucccagcuugguuguguagcaaucccucagcauuguuuuucuc

SEQ ID NO: 696096 - RNA, 64 nt, hsa
gugauuguaguuuaauacaggaacacacagggcuguguagcaugauaccaggcccaggagauca

SEQ ID NO: 696097 - RNA, 64 nt, hsa
acuggagagguccacagccuuguccagaguuccuguguagcacggggagcaaugauggagggag

SEQ ID NO: 696098 - RNA, 64 nt, hsa
cuugcugucugucucucucucaguacaguucaagguguagcaaguguacccacacagauagcau

SEQ ID NO: 696099 - RNA, 64 nt, hsa
uguuaauaagaccaaauuaaaaaggcuaguggcuguguagcauccucagugcaaaacccagcuc

SEQ ID NO: 696100 - RNA, 64 nt, hsa
ugcuaagcccaaagauuacauguugguguucaaaguguagcaaaaaaugauguauauuuauaaa

SEQ ID NO: 696101 - RNA, 64 nt, hsa
aaaggaaaaaaaaaucuucagaugcaaugguuuuguguagcaucuugucuaucauguuuuguaa

SEQ ID NO: 696102 - RNA, 64 nt, hsa
ucagugguauuuugcauuggaaaaaggaagcacuguguagcagugaauugucugcuuuccaccg

SEQ ID NO: 696103 - RNA, 64 nt, hsa
cgaggcucccagagcagccucugucaccgcuucuguguagcaaacauuaacgaugacaggggua

SEQ ID NO: 696104 - RNA, 64 nt, hsa
uauuuugaucaaacugugcaaacaguaguaccacguguagcauuuugaaacauuauuuuuuuuu

SEQ ID NO: 696105 - RNA, 64 nt, hsa
auucauaguaaaguucguuuuuuauauguuuccaguguagcagaucucuauauaaauauauaaa

SEQ ID NO: 696106 - RNA, 64 nt, hsa
auuugauuuuucuaaacuaucuaccauauuuuaaguguagcagcuuugacuuugcaauaacgug

SEQ ID NO: 696107 - RNA, 64 nt, hsa
agggucuggacaugcaucuccuaaaggaagaacuguguagcaccauugaucacaauguaacauu

SEQ ID NO: 696108 - RNA, 64 nt, hsa
gggaagucccuuauuuggaagagagaaaggauguguguagcacacacucaucauggauugcuca

SEQ ID NO: 696109 - RNA, 64 nt, hsa
ggaaauccauucagaaaugagcuaacagucuccaguguagcaggagagccagucacuucccucc

SEQ ID NO: 696110 - RNA, 64 nt, hsa
ggugacuguauaaaguuagugguauucagggacaguguagcaaguagcuuacaaggggacaauu

SEQ ID NO: 696111 - RNA, 64 nt, hsa
uuaggaauauuuuucucccccuaccccauaaauuguguagcacuuuuuauuccauuugcuuuca

SEQ ID NO: 696112 - RNA, 64 nt, hsa
ucauaccuaguuuuauaagcuguucuguaacauaguguagcaaaaaaaaaaguucaagucaugu

SEQ ID NO: 696113 - RNA, 64 nt, hsa
uuaaagucauuuguaauguuauuguauaguuauuguguagcacauaugguuugcacuguauagu

SEQ ID NO: 696114 - RNA, 64 nt, hsa
aauggaacaaaacucaucuggcugcaucccagguguguagcaaaguccacauguaaauuuauag

SEQ ID NO: 696115 - RNA, 64 nt, hsa
gcuguucuuggggagaaggagggaggucucgggaguguagcaccaugccaaccagcccugcgcg

SEQ ID NO: 696116 - RNA, 64 nt, hsa
cuuucuugcacauuaggaagcagaauauccuccaguguagcacagggggagaagugagaagugu

SEQ ID NO: 696117 - RNA, 64 nt, hsa
ggggucuuuucagucuucccucuccucaaaccuuguguagcauugcacaauauagaucucaguc

SEQ ID NO: 696118 - RNA, 64 nt, hsa
agacuuaggacucaugugcaguaaauauaaauaaguguagcaucagaagcaguaggaauggccg

SEQ ID NO: 696119 - RNA, 64 nt, hsa
uaaguugucuaugggcacaaaguuuucuucauuuguguagcaaacuucuugugaauguggauua

SEQ ID NO: 696120 - RNA, 64 nt, hsa
gcaaaaggcccugcucucuggaguguuguauauaguguagcaaaagaguauuuauacaucccac

SEQ ID NO: 696121 - RNA, 64 nt, hsa
agguguaugcaguugugaccccauguguggggaaguguagcaaggacggcugguggagggggaa

SEQ ID NO: 696122 - RNA, 64 nt, hsa
guauauguaaugguuauauguacucauguuccugguguagcaacgugugguauggcuacacaga

SEQ ID NO: 696123 - RNA, 51 nt, hsa
acuuugcccuggccgagugagguguagcagaaaaaggcugugcugcccuga

SEQ ID NO: 696124 - RNA, 64 nt, hsa
gcaaaaaaaauuuuuuagcaauuuuuguaaaacuguguagcauuuaaauuuccuauaccuucug

SEQ ID NO: 696125 - RNA, 64 nt, hsa
ccagaagaugucugcauuacucauugcuaaaaauguguagcacagaacugcacuaggauuaauu

SEQ ID NO: 696126 - RNA, 64 nt, hsa
uuuugagccaauuaagaaaauugccauuuuuaaaguguagcauuucaggguaaagacccaugaa

SEQ ID NO: 696127 - RNA, 64 nt, hsa
cuuaggggccaacaaggcuuccagcuggauguguguguagcauguaccuuauuauuuuuguuac

SEQ ID NO: 696128 - RNA, 64 nt, hsa
uguuuccccuuacugauaagcggccacuuuaggaguguagcaaauauagauugagcuauguuag

SEQ ID NO: 696129 - RNA, 64 nt, hsa
cuuggguguggguuccucuuguuuugguuauuuuguguagcaguuuaaucaguggauaacugag

SEQ ID NO: 696130 - RNA, 64 nt, hsa
gauucuggacagucagcucuucaucugcccaacuguguagcaucugcauugcccagucuuucau

SEQ ID NO: 696131 - RNA, 64 nt, hsa
uuucuguccuagcuggagguguaaaaugcacaauguguagcagguagaauacagcuccuuaucg

SEQ ID NO: 696132 - RNA, 64 nt, hsa
gagauaagaaacauaguuuuauacauuauguacaguguagcagugguuuugccuaguguuccaa

SEQ ID NO: 696133 - RNA, 64 nt, hsa
ccuuuaaagauacagugugaaaauuugcucggguguguagcaguaauuacacgaggcaaacagu

SEQ ID NO: 696134 - RNA, 64 nt, hsa
ugugguaagcuagguucauuccucaucaaggaauguguagcagauuguucacuguggaggaguu

SEQ ID NO: 696135 - RNA, 64 nt, hsa
cccaaguucagcuuuggaggcagaucuggaaacaguguagcagcauugguuuuccaaaaaaugu

SEQ ID NO: 696136 - RNA, 58 nt, hsa
aagaucugacucaagacugacucugauaguguagcauuuucccugggggaguuuuggu

SEQ ID NO: 696137 - RNA, 64 nt, hsa
aaaugauugucacacaugucacuguagccucuugguguagcaagcucacauacaaaauacuuuu

SEQ ID NO: 696138 - RNA, 64 nt, hsa
uaaugaucaguuuacuuucaguggauucagaauuguguagcaggauaaccuuguauuuuuccau

SEQ ID NO: 696139 - RNA, 64 nt, hsa
ggcgcucacuuaccucugacugccugggcgcugcguguagcaucuuggccuacaggacagauuu

SEQ ID NO: 696140 - RNA, 64 nt, hsa
caccggggccacuuccggcugccucuuugcuacuguguagcaccugcugcaacguugccugcug

SEQ ID NO: 696141 - RNA, 64 nt, hsa
gcugugaaguuuuaaggaauaaauaauauaauugguguagcacagugccuugcaugcaguaggc

SEQ ID NO: 696142 - RNA, 64 nt, hsa
accuuuuuuucucuccuaagacaccugcaauaaaguguagcacccugguacaucugugauguuu

SEQ ID NO: 696143 - RNA, 64 nt, hsa
cuuuucuuugaaauacaauaauuuauauagaaauguguagcagcaaauuauauuggggauuaga

SEQ ID NO: 696144 - RNA, 64 nt, hsa
ccaaccuggauggggguuuggggaaggagggcauguguagcagagaacuuaggggggccuccuu

SEQ ID NO: 696145 - RNA, 64 nt, hsa
cacuguagcuauuagcggcuccucgcccccaccaguguagcaucuuccucugcagaauaaaauc

SEQ ID NO: 696146 - RNA, 64 nt, hsa
cucaauaaauggccuauaugugcaaagaaagaauguguagcaaaugaaaauaccagaccaagaa

SEQ ID NO: 696147 - RNA, 64 nt, hsa
uccuuuucccuccaugcuccagguccaugcacagguguagcauguccugcuuccguuuuucaua

SEQ ID NO: 696148 - RNA, 64 nt, hsa
cugccauucccuucuacugcacugcccaagguguguguagcacaaacaguucucauuacaaagg

SEQ ID NO: 696149 - RNA, 64 nt, hsa
uacgagggcagucuuaacuuguguuaaggccuguguguagcauugaagguaaguaugaaggagu

SEQ ID NO: 696150 - RNA, 64 nt, hsa
gaauuacacugugggaaaacuaccauuguaauaaguguagcaaaaucuccuuagauaucugaaa

SEQ ID NO: 696151 - RNA, 64 nt, hsa
gagagaaugagagugaaagggacaaauaacaucuguguagcaguauuaugaaaauagcuugacc

SEQ ID NO: 696152 - RNA, 64 nt, hsa
caucagaaguuacaauaggcauaugggcaaaaugguguagcaggcucacuggccguuuguuuuu

SEQ ID NO: 696153 - RNA, 64 nt, hsa
uagaauuuucucccuuuauguaucucuaucgauuguguagcaauugacagagaauaacucagaa

SEQ ID NO: 696154 - RNA, 64 nt, hsa
aagauacucaucuuucuacauagacgggaacacgguguagcauggagauuaagcgugcuaacug

SEQ ID NO: 696155 - RNA, 64 nt, hsa
ugauauguaagcuugaccuaaagucaaaggaccuguguagcauuucagauugagcacuucacua

SEQ ID NO: 696156 - RNA, 64 nt, hsa
uucaccagugacagaugguuuccccauccacugaguguagcauccucagagguaggcaaguuug

SEQ ID NO: 696157 - RNA, 64 nt, hsa
auggacuucaggagcccuuacuugguuuugaucaguguagcaaauuagggaugaagaguucaaa

SEQ ID NO: 696158 - RNA, 64 nt, hsa
ggcuuuuucuaaagaggauggcagaacuuccaacguguagcaauacuauaagaaccaagguagc

SEQ ID NO: 696159 - RNA, 64 nt, hsa
uguuuuauagcuccaaaugguuuuuuuauucucaguguagcaacuguuugauuucuuucuggau

SEQ ID NO: 696160 - RNA, 64 nt, hsa
uacuuauaaugaaacuucauuaagguuucauucaguguagcaauuacugucuuuaaaaauuaag

SEQ ID NO: 696161 - RNA, 64 nt, hsa
uuuaaaacuguaaagcuguguauagaacuguuuuguguagcauggaaauauucugucagcuuuu

SEQ ID NO: 696162 - RNA, 64 nt, hsa
augaaaagguuuauauucacuauucuuuauuucaguguagcacuuuuagagccaaaaaaacuca

SEQ ID NO: 696163 - RNA, 64 nt, hsa
acagugaagggaaaagagucugugaaggugaucaguguagcaguaagacaucuaaaaucaagac

SEQ ID NO: 696164 - RNA, 64 nt, hsa
cagccauaacaaguuuacuuguggaaaagaaaagguguagcacuuucagaagaggcuaucaaag

SEQ ID NO: 696165 - RNA, 64 nt, hsa
guaugaaaacacugagaaggagaugaaggaguguguguagcauggggguguguacaacuuaaca

SEQ ID NO: 696166 - RNA, 64 nt, hsa
auugaaguaucagcuuguuugguacuaggugcaaguguagcaugucacaugugaccauguugga

SEQ ID NO: 696167 - RNA, 64 nt, hsa
cugagaaguggguucaggcgaagggugaagccauguguagcaguuccugccagugcagaucugg

SEQ ID NO: 696168 - RNA, 64 nt, hsa
acgucaguauuguuuuaaaguuucugucuguaaaguguagcaucauauauaaaaagaguuucgc

SEQ ID NO: 696169 - RNA, 53 nt, hsa
gcaggcccccuccccgcuaauagguguagcagagaucucgcuccuguguuucc

SEQ ID NO: 696170 - RNA, 64 nt, hsa
uuuaauuguaaaaugagaaccgauuuucaguuuaguguagcagcacacuuguucagguuugcau

SEQ ID NO: 696171 - RNA, 64 nt, hsa
cugugaaguuucugucauucguccagaucuguguguguagcaugugcugaggaagcacgugcug

SEQ ID NO: 696172 - RNA, 64 nt, hsa
aggaaaaucacaauuacaccacuuuagacccuauguguagcaggucacaacuuacccuugugug

SEQ ID NO: 696173 - RNA, 64 nt, hsa
acugcugugaggcagaggaaugauggagaaucuaguguagcagccuccaggcaggauucagcac

SEQ ID NO: 696174 - RNA, 64 nt, hsa
aaaagauuuauuagaaaauucucacgcugaacugguguagcauguggugcagcauucagugaaa

SEQ ID NO: 696175 - RNA, 64 nt, hsa
gaccuguggucuccaugccugugcccucacacagguguagcacacgcaugugcagauggcacca

SEQ ID NO: 696176 - RNA, 64 nt, hsa
guggaaccguuccugaaaggccaccaggcgcccaguguagcacggaagaugcccacgugccuga

SEQ ID NO: 696177 - RNA, 64 nt, hsa
ucacuggggucuguguggugcccaugaggacaaaguguagcagccuccugccugcuccaagaaa

SEQ ID NO: 696178 - RNA, 64 nt, hsa
gaauaagugaauguuucuuuauugcauaacuggcguguagcacaaagaaaaagccccuucucca

SEQ ID NO: 696179 - RNA, 64 nt, hsa
uucucuuauguauuuuugugcacuaggcgcaguuguguagcaguugaguaaugcugguuagcug

SEQ ID NO: 696180 - RNA, 64 nt, hsa
uuuugcagaaacuuuugagggucguugcaagacuguguagcaggccuaccaggucccuuucauc

SEQ ID NO: 696181 - RNA, 64 nt, hsa
acuguugcuaaaaaaagucauguaguuucauguaguguagcauccuuggcaucguuuuccaaaa

SEQ ID NO: 696182 - RNA, 64 nt, hsa
caucaacaggggagcuaaaguugaagccagcuguguguagcagcuguuaccugaagacgugcua

SEQ ID NO: 696183 - RNA, 64 nt, hsa
ggucuuaugcucauaagcaguucaugagugacaaguguagcaaaagccagccauauauuuucag

SEQ ID NO: 696184 - RNA, 64 nt, hsa
gcugugaauccccugggcagggggcgacaacuccguguagcauuaacccccguggcgggguccg

SEQ ID NO: 696185 - RNA, 64 nt, hsa
cagacuuacagaagaaguggcccuccauagacauguguagcaucaaaacacaaaggcccacacu

SEQ ID NO: 696186 - RNA, 64 nt, hsa
ugcaggccgguggguccacuccaacucccccugaguguagcagcacacuuuccauacaccaggu

SEQ ID NO: 696187 - RNA, 64 nt, hsa
aagucaauggagaagacagaaagguaaaaaucacguguagcaagaacaacucuuauuucacaaa

SEQ ID NO: 696188 - RNA, 64 nt, hsa
ucauugccauagcaucaugaugcaacacaucuacguguagcacuacgacguuauguuuggguaa

SEQ ID NO: 696189 - RNA, 64 nt, hsa
ugaacccagguuaggggcagaucagaagggcugcguguagcacccuuauggucuugcagaacac

SEQ ID NO: 696190 - RNA, 64 nt, hsa
cagucauucauccaggccacguuuccucugcggaguguagcagcccugccuuucauagcaggga

SEQ ID NO: 696191 - RNA, 64 nt, hsa
auuugcucucuacugauuggcugaaauccccgagguguagcaucuucucucccuugaaggcuga

SEQ ID NO: 696192 - RNA, 64 nt, hsa
uuacuuucagggggcugcuuuccugggccaggcuguguagcacuucccacccucaggcaugagu

SEQ ID NO: 696193 - RNA, 64 nt, hsa
cucugcucuugggaguguaaaaguugggaguguaguguagcaucuggggagacagcaggaucac

SEQ ID NO: 696194 - RNA, 64 nt, hsa
ccccaaccucccugacuuccuucaguaacugacaguguagcauuguucuugauuaguuuggcac

SEQ ID NO: 696195 - RNA, 64 nt, hsa
cuggaauauuguguaaacuaucugucuuacauuaguguagcauuuugcaauuuggggaacaucu

SEQ ID NO: 696196 - RNA, 64 nt, hsa
aagguggaugcacuucccgcaccuccagucuucuguguagcagcuuuaacccacguuugucugu

SEQ ID NO: 696197 - RNA, 64 nt, hsa
uguccugggcccugccacccgucugggcuccuuuguguagcauuaucagccucggucuggccuc

SEQ ID NO: 696198 - RNA, 64 nt, hsa
ccugcugagcuccaguauuuugauaguuaauuauuucaacuaauauaucuaugucuauaucauc

SEQ ID NO: 696199 - RNA, 64 nt, hsa
aaguagaggcaaugcaaagauucacauaguuuauuucaacuauuuauugaaugauuacuauaug

SEQ ID NO: 696200 - RNA, 64 nt, hsa; identical to SEQ ID NO: 343068

SEQ ID NO: 696201 - RNA, 64 nt, hsa; identical to SEQ ID NO: 343069

SEQ ID NO: 696202 - RNA, 64 nt, hsa; identical to SEQ ID NO: 343070

SEQ ID NO: 696203 - RNA, 64 nt, hsa; identical to SEQ ID NO: 343071

SEQ ID NO: 696204 - RNA, 64 nt, hsa; identical to SEQ ID NO: 343072

SEQ ID NO: 696205 - RNA, 64 nt, hsa; identical to SEQ ID NO: 343073

SEQ ID NO: 696206 - RNA, 64 nt, hsa; identical to SEQ ID NO: 411037

SEQ ID NO: 696207 - RNA, 64 nt, hsa; identical to SEQ ID NO: 411038

SEQ ID NO: 696208 - RNA, 64 nt, hsa; identical to SEQ ID NO: 411039

SEQ ID NO: 696209 - RNA, 64 nt, hsa; identical to SEQ ID NO: 411040

SEQ ID NO: 696210 - RNA, 64 nt, hsa; identical to SEQ ID NO: 411041

SEQ ID NO: 696211 - RNA, 64 nt, hsa; identical to SEQ ID NO: 411042

SEQ ID NO: 696212 - RNA, 64 nt, hsa; identical to SEQ ID NO: 411043

SEQ ID NO: 696213 - RNA, 64 nt, hsa; identical to SEQ ID NO: 411044

SEQ ID NO: 696214 - RNA, 64 nt, hsa; identical to SEQ ID NO: 411045

SEQ ID NO: 696215 - RNA, 64 nt, hsa; identical to SEQ ID NO: 411046

SEQ ID NO: 696216 - RNA, 64 nt, hsa; identical to SEQ ID NO: 411047

SEQ ID NO: 696217 - RNA, 64 nt, hsa; identical to SEQ ID NO: 411048

SEQ ID NO: 696218 - RNA, 64 nt, hsa; identical to SEQ ID NO: 411049

SEQ ID NO: 696219 - RNA, 64 nt, hsa; identical to SEQ ID NO: 411050

SEQ ID NO: 696220 - RNA, 64 nt, hsa; identical to SEQ ID NO: 411051

SEQ ID NO: 696221 - RNA, 64 nt, hsa; identical to SEQ ID NO: 411052

SEQ ID NO: 696222 - RNA, 64 nt, hsa; identical to SEQ ID NO: 411053

SEQ ID NO: 696223 - RNA, 64 nt, hsa; identical to SEQ ID NO: 411054

SEQ ID NO: 696224 - RNA, 64 nt, hsa; identical to SEQ ID NO: 411055

SEQ ID NO: 696225 - RNA, 64 nt, hsa; identical to SEQ ID NO: 411056

SEQ ID NO: 696226 - RNA, 64 nt, hsa; identical to SEQ ID NO: 411057

SEQ ID NO: 696227 - RNA, 64 nt, hsa; identical to SEQ ID NO: 411058

SEQ ID NO: 696228 - RNA, 64 nt, hsa; identical to SEQ ID NO: 411059

SEQ ID NO: 696229 - RNA, 64 nt, hsa; identical to SEQ ID NO: 411060

SEQ ID NO: 696230 - RNA, 64 nt, hsa; identical to SEQ ID NO: 411061

SEQ ID NO: 696231 - RNA, 64 nt, hsa; identical to SEQ ID NO: 411062

SEQ ID NO: 696232 - RNA, 64 nt, hsa; identical to SEQ ID NO: 411063

SEQ ID NO: 696233 - RNA, 64 nt, hsa; identical to SEQ ID NO: 411064

SEQ ID NO: 696234 - RNA, 64 nt, hsa; identical to SEQ ID NO: 411065

SEQ ID NO: 696235 - RNA, 64 nt, hsa; identical to SEQ ID NO: 411066

SEQ ID NO: 696236 - RNA, 64 nt, hsa; identical to SEQ ID NO: 411067

SEQ ID NO: 696237 - RNA, 64 nt, hsa; identical to SEQ ID NO: 411068

SEQ ID NO: 696238 - RNA, 64 nt, hsa; identical to SEQ ID NO: 411069

SEQ ID NO: 696239 - RNA, 64 nt, hsa; identical to SEQ ID NO: 411070

SEQ ID NO: 696240 - RNA, 64 nt, hsa; identical to SEQ ID NO: 411071

SEQ ID NO: 696241 - RNA, 64 nt, hsa; identical to SEQ ID NO: 411072

SEQ ID NO: 696242 - RNA, 64 nt, hsa; identical to SEQ ID NO: 411073

SEQ ID NO: 696243 - RNA, 64 nt, hsa; identical to SEQ ID NO: 411074

SEQ ID NO: 696244 - RNA, 64 nt, hsa; identical to SEQ ID NO: 411075

SEQ ID NO: 696245 - RNA, 64 nt, hsa; identical to SEQ ID NO: 411076

SEQ ID NO: 696246 - RNA, 64 nt, hsa; identical to SEQ ID NO: 411077

SEQ ID NO: 696247 - RNA, 64 nt, hsa; identical to SEQ ID NO: 411078

SEQ ID NO: 696248 - RNA, 64 nt, hsa; identical to SEQ ID NO: 411079

SEQ ID NO: 696249 - RNA, 64 nt, hsa; identical to SEQ ID NO: 411080

SEQ ID NO: 696250 - RNA, 64 nt, hsa; identical to SEQ ID NO: 411081

SEQ ID NO: 696251 - RNA, 64 nt, hsa; identical to SEQ ID NO: 411082

SEQ ID NO: 696252 - RNA, 64 nt, hsa; identical to SEQ ID NO: 411083

SEQ ID NO: 696253 - RNA, 64 nt, hsa; identical to SEQ ID NO: 411084

SEQ ID NO: 696254 - RNA, 64 nt, hsa; identical to SEQ ID NO: 411085

SEQ ID NO: 696255 - RNA, 64 nt, hsa; identical to SEQ ID NO: 411086

SEQ ID NO: 696256 - RNA, 64 nt, hsa; identical to SEQ ID NO: 411087

SEQ ID NO: 696257 - RNA, 64 nt, hsa; identical to SEQ ID NO: 411088

SEQ ID NO: 696258 - RNA, 62 nt, hsa
guguguccaguuuggccuccugcccaaacuguccauuccagcagcuccugcccccuucucug

SEQ ID NO: 696259 - RNA, 62 nt, hsa
ugccccauccucucucugaagccagggcccuuccauuccauuuagccuuuggaucauccugg

SEQ ID NO: 696260 - RNA, 62 nt, hsa
gauugccuguuucugauuugcugcucuucaucccauuccaggcagccucugucaggccuuca

SEQ ID NO: 696261 - RNA, 62 nt, hsa
ccuggaauugccagcugacaucuugaauccuuccauuccacacagaaugcaaccaagucaca

SEQ ID NO: 696262 - RNA, 62 nt, hsa
ucaggucaaaccaagccaagagcacccuguccccauuccaaggggccagcagcacuuuggcc

SEQ ID NO: 696263 - RNA, 62 nt, hsa
agggugauggguagagcuuuccagaaccuucuccauuccagaaucucugccccuguguaauc

SEQ ID NO: 696264 - RNA, 62 nt, hsa
auccgcacugcccuugggacuuccgaagugaaccauuccaccagaaccuuugauucugcaca

SEQ ID NO: 696265 - RNA, 62 nt, hsa
ggagcacauuuuguggaccugguuccaccuuuccauuccaaaccaccuguuuccccuuccau

SEQ ID NO: 696266 - RNA, 62 nt, hsa
ugugcaaucuuugcuucuuguaggcuaucgccccauuccagcggagacuuauguaggaggga

SEQ ID NO: 696267 - RNA, 62 nt, hsa
acaccaggcacccucugccacuuagacauaauccauuccacucauuauuccagcaaacacuu

SEQ ID NO: 696268 - RNA, 62 nt, hsa
caccauuaaaacauuugacuuaaauuguuugaccauuccaguugguguacuguucugauuuu

SEQ ID NO: 696269 - RNA, 62 nt, hsa
aaggacugcuucugcccucugccugccagugcccauuccacugugaggugucauucccugca

SEQ ID NO: 696270 - RNA, 62 nt, hsa
uccagauugguuuaaccaauuacucguccccgccauuccagggauugauucucaccagcguu

SEQ ID NO: 696271 - RNA, 62 nt, hsa
ugccucccacugaauggcaguuuccaggaccuccauuccacucaucucuggccugagugaca

SEQ ID NO: 696272 - RNA, 64 nt, hsa; identical to SEQ ID NO: 579631

SEQ ID NO: 696273 - RNA, 64 nt, hsa; identical to SEQ ID NO: 579632

SEQ ID NO: 696274 - RNA, 64 nt, hsa; identical to SEQ ID NO: 579633

SEQ ID NO: 696275 - RNA, 64 nt, hsa; identical to SEQ ID NO: 579634

SEQ ID NO: 696276 - RNA, 64 nt, hsa; identical to SEQ ID NO: 579635

SEQ ID NO: 696277 - RNA, 64 nt, hsa; identical to SEQ ID NO: 579636

SEQ ID NO: 696278 - RNA, 62 nt, hsa; identical to SEQ ID NO: 275089

SEQ ID NO: 696279 - RNA, 64 nt, hsa; identical to SEQ ID NO: 579638

SEQ ID NO: 696280 - RNA, 64 nt, hsa; identical to SEQ ID NO: 579639

SEQ ID NO: 696281 - RNA, 64 nt, hsa; identical to SEQ ID NO: 579640

SEQ ID NO: 696282 - RNA, 64 nt, hsa; identical to SEQ ID NO: 579641

SEQ ID NO: 696283 - RNA, 64 nt, hsa; identical to SEQ ID NO: 579642

SEQ ID NO: 696284 - RNA, 64 nt, hsa; identical to SEQ ID NO: 579643

SEQ ID NO: 696285 - RNA, 64 nt, hsa; identical to SEQ ID NO: 579644

SEQ ID NO: 696286 - RNA, 64 nt, hsa; identical to SEQ ID NO: 579645

SEQ ID NO: 696287 - RNA, 64 nt, hsa; identical to SEQ ID NO: 579646

SEQ ID NO: 696288 - RNA, 64 nt, hsa; identical to SEQ ID NO: 579647

SEQ ID NO: 696289 - RNA, 64 nt, hsa; identical to SEQ ID NO: 579648

SEQ ID NO: 696290 - RNA, 64 nt, hsa; identical to SEQ ID NO: 579649

SEQ ID NO: 696291 - RNA, 64 nt, hsa; identical to SEQ ID NO: 579650

SEQ ID NO: 696292 - RNA, 64 nt, hsa; identical to SEQ ID NO: 579651

SEQ ID NO: 696293 - RNA, 64 nt, hsa; identical to SEQ ID NO: 579652

SEQ ID NO: 696294 - RNA, 64 nt, hsa
uauuuaacuaaggcccaaccgauuuccauaauguagcaguuaccguguucaccucacacuaagg

SEQ ID NO: 696295 - RNA, 64 nt, hsa
acaugauugcugacuuggauaauucauuauuaccagcaguuaugaaggaaauauugcuaaaaug

SEQ ID NO: 696296 - RNA, 64 nt, hsa
uaauuuauuguuuuaaauuaauuuuuuagcagauagcaguuagcacuuaaucuguaaauugaau

SEQ ID NO: 696297 - RNA, 64 nt, hsa
ugagacaaaaguugaggacuuggugaaaggaaauagcaguuacagcaaaaccucagugauuaca

SEQ ID NO: 696298 - RNA, 64 nt, hsa
cuuuuagauaaaucaaaugagccaucagugaggcagcaguuacuucaaggauaugauauguuaa

SEQ ID NO: 696299 - RNA, 64 nt, hsa
uugggaggcugaggugggcauaucaccugaggucagcaguuaaagaccagccugaccaaaaugg

SEQ ID NO: 696300 - RNA, 64 nt, hsa
accucaaagaauauuugcacaugcuucugaucucagcaguuauaauaaagaggauuaaacccuu

SEQ ID NO: 696301 - RNA, 64 nt, hsa
cuucaaguaaacaaagcaauauucaggauggagaagcaguuagugacuggcuagaggucucuug

SEQ ID NO: 696302 - RNA, 64 nt, hsa
aaacagcuuaaauucuucaagaaagaauuccugcagcaguuauucccuuaccugaaggcuucaa

SEQ ID NO: 696303 - RNA, 64 nt, hsa
uauauggcauaugaauaccaggauagcuuuauaaagcaguuaguuaguuaguuacucacucuag

SEQ ID NO: 696304 - RNA, 64 nt, hsa
aaauugggacucaacucuuugaaaacaccuauugagcaguuauaccuguugagcaguuuacuuc

SEQ ID NO: 696305 - RNA, 64 nt, hsa
acaagacaacuacaguuccugccuuugcugagacagcaguuacacuaacccuuaauuaucuuac

SEQ ID NO: 696306 - RNA, 64 nt, hsa; identical to SEQ ID NO: 80199

SEQ ID NO: 696307 - RNA, 64 nt, hsa; identical to SEQ ID NO: 80200

SEQ ID NO: 696308 - RNA, 64 nt, hsa; identical to SEQ ID NO: 80201

SEQ ID NO: 696309 - RNA, 64 nt, hsa; identical to SEQ ID NO: 80202

SEQ ID NO: 696310 - RNA, 64 nt, hsa; identical to SEQ ID NO: 80203

SEQ ID NO: 696311 - RNA, 64 nt, hsa; identical to SEQ ID NO: 80204

SEQ ID NO: 696312 - RNA, 64 nt, hsa; identical to SEQ ID NO: 80205

SEQ ID NO: 696313 - RNA, 64 nt, hsa; identical to SEQ ID NO: 80206

SEQ ID NO: 696314 - RNA, 64 nt, hsa; identical to SEQ ID NO: 80207

SEQ ID NO: 696315 - RNA, 64 nt, hsa; identical to SEQ ID NO: 80208

SEQ ID NO: 696316 - RNA, 64 nt, hsa; identical to SEQ ID NO: 80209

SEQ ID NO: 696317 - RNA, 64 nt, hsa; identical to SEQ ID NO: 80210

SEQ ID NO: 696318 - RNA, 64 nt, hsa; identical to SEQ ID NO: 80211

SEQ ID NO: 696319 - RNA, 64 nt, hsa; identical to SEQ ID NO: 80212

SEQ ID NO: 696320 - RNA, 64 nt, hsa; identical to SEQ ID NO: 80213

SEQ ID NO: 696321 - RNA, 64 nt, hsa; identical to SEQ ID NO: 80214

SEQ ID NO: 696322 - RNA, 64 nt, hsa; identical to SEQ ID NO: 80215

SEQ ID NO: 696323 - RNA, 64 nt, hsa; identical to SEQ ID NO: 80216

SEQ ID NO: 696324 - RNA, 64 nt, hsa; identical to SEQ ID NO: 80217

SEQ ID NO: 696325 - RNA, 64 nt, hsa; identical to SEQ ID NO: 80218

SEQ ID NO: 696326 - RNA, 64 nt, hsa; identical to SEQ ID NO: 80219

SEQ ID NO: 696327 - RNA, 64 nt, hsa; identical to SEQ ID NO: 80220

SEQ ID NO: 696328 - RNA, 64 nt, hsa; identical to SEQ ID NO: 80221

SEQ ID NO: 696329 - RNA, 64 nt, hsa; identical to SEQ ID NO: 80222

SEQ ID NO: 696330 - RNA, 64 nt, hsa; identical to SEQ ID NO: 80223

SEQ ID NO: 696331 - RNA, 64 nt, hsa; identical to SEQ ID NO: 80224

SEQ ID NO: 696332 - RNA, 64 nt, hsa; identical to SEQ ID NO: 80225

SEQ ID NO: 696333 - RNA, 64 nt, hsa; identical to SEQ ID NO: 80226

SEQ ID NO: 696334 - RNA, 64 nt, hsa; identical to SEQ ID NO: 80227

SEQ ID NO: 696335 - RNA, 64 nt, hsa; identical to SEQ ID NO: 80228

SEQ ID NO: 696336 - RNA, 64 nt, hsa; identical to SEQ ID NO: 80229

SEQ ID NO: 696337 - RNA, 64 nt, hsa; identical to SEQ ID NO: 80230

SEQ ID NO: 696338 - RNA, 64 nt, hsa; identical to SEQ ID NO: 80231

SEQ ID NO: 696339 - RNA, 52 nt, hsa; identical to SEQ ID NO: 80232

SEQ ID NO: 696340 - RNA, 64 nt, hsa; identical to SEQ ID NO: 80233

SEQ ID NO: 696341 - RNA, 64 nt, hsa; identical to SEQ ID NO: 80234

SEQ ID NO: 696342 - RNA, 64 nt, hsa; identical to SEQ ID NO: 80235

SEQ ID NO: 696343 - RNA, 64 nt, hsa; identical to SEQ ID NO: 80236

SEQ ID NO: 696344 - RNA, 64 nt, hsa; identical to SEQ ID NO: 80237

SEQ ID NO: 696345 - RNA, 64 nt, hsa; identical to SEQ ID NO: 80238

SEQ ID NO: 696346 - RNA, 64 nt, hsa; identical to SEQ ID NO: 80239

SEQ ID NO: 696347 - RNA, 64 nt, hsa; identical to SEQ ID NO: 80240

SEQ ID NO: 696348 - RNA, 64 nt, hsa; identical to SEQ ID NO: 80241

SEQ ID NO: 696349 - RNA, 64 nt, hsa; identical to SEQ ID NO: 80242

SEQ ID NO: 696350 - RNA, 64 nt, hsa; identical to SEQ ID NO: 80243

SEQ ID NO: 696351 - RNA, 64 nt, hsa; identical to SEQ ID NO: 80244

SEQ ID NO: 696352 - RNA, 64 nt, hsa; identical to SEQ ID NO: 80245

SEQ ID NO: 696353 - RNA, 64 nt, hsa; identical to SEQ ID NO: 80246

SEQ ID NO: 696354 - RNA, 64 nt, hsa; identical to SEQ ID NO: 80247

SEQ ID NO: 696355 - RNA, 64 nt, hsa; identical to SEQ ID NO: 80248

SEQ ID NO: 696356 - RNA, 64 nt, hsa; identical to SEQ ID NO: 80249

SEQ ID NO: 696357 - RNA, 64 nt, hsa; identical to SEQ ID NO: 80250

SEQ ID NO: 696358 - RNA, 64 nt, hsa; identical to SEQ ID NO: 80251

SEQ ID NO: 696359 - RNA, 64 nt, hsa; identical to SEQ ID NO: 80252

SEQ ID NO: 696360 - RNA, 64 nt, hsa; identical to SEQ ID NO: 80253

SEQ ID NO: 696361 - RNA, 64 nt, hsa; identical to SEQ ID NO: 80254

SEQ ID NO: 696362 - RNA, 64 nt, hsa; identical to SEQ ID NO: 80255

SEQ ID NO: 696363 - RNA, 64 nt, hsa; identical to SEQ ID NO: 80256

SEQ ID NO: 696364 - RNA, 64 nt, hsa; identical to SEQ ID NO: 80257

SEQ ID NO: 696365 - RNA, 64 nt, hsa; identical to SEQ ID NO: 80258

SEQ ID NO: 696366 - RNA, 64 nt, hsa; identical to SEQ ID NO: 80259

SEQ ID NO: 696367 - RNA, 64 nt, hsa; identical to SEQ ID NO: 80260

SEQ ID NO: 696368 - RNA, 64 nt, hsa; identical to SEQ ID NO: 80261

SEQ ID NO: 696369 - RNA, 64 nt, hsa; identical to SEQ ID NO: 80262

SEQ ID NO: 696370 - RNA, 64 nt, hsa; identical to SEQ ID NO: 80263

SEQ ID NO: 696371 - RNA, 64 nt, hsa; identical to SEQ ID NO: 80264

SEQ ID NO: 696372 - RNA, 64 nt, hsa; identical to SEQ ID NO: 80265

SEQ ID NO: 696373 - RNA, 64 nt, hsa; identical to SEQ ID NO: 80266

SEQ ID NO: 696374 - RNA, 64 nt, hsa; identical to SEQ ID NO: 80267

SEQ ID NO: 696375 - RNA, 64 nt, hsa; identical to SEQ ID NO: 80268

SEQ ID NO: 696376 - RNA, 64 nt, hsa; identical to SEQ ID NO: 80269

SEQ ID NO: 696377 - RNA, 64 nt, hsa; identical to SEQ ID NO: 80270

SEQ ID NO: 696378 - RNA, 64 nt, hsa; identical to SEQ ID NO: 80271

SEQ ID NO: 696379 - RNA, 64 nt, hsa; identical to SEQ ID NO: 80272

SEQ ID NO: 696380 - RNA, 64 nt, hsa; identical to SEQ ID NO: 80273

SEQ ID NO: 696381 - RNA, 64 nt, hsa; identical to SEQ ID NO: 80274

SEQ ID NO: 696382 - RNA, 64 nt, hsa; identical to SEQ ID NO: 80275

SEQ ID NO: 696383 - RNA, 64 nt, hsa; identical to SEQ ID NO: 80276

SEQ ID NO: 696384 - RNA, 64 nt, hsa; identical to SEQ ID NO: 80277

SEQ ID NO: 696385 - RNA, 64 nt, hsa; identical to SEQ ID NO: 80278

SEQ ID NO: 696386 - RNA, 64 nt, hsa; identical to SEQ ID NO: 80279

SEQ ID NO: 696387 - RNA, 64 nt, hsa; identical to SEQ ID NO: 80280

SEQ ID NO: 696388 - RNA, 64 nt, hsa; identical to SEQ ID NO: 80281

SEQ ID NO: 696389 - RNA, 64 nt, hsa; identical to SEQ ID NO: 80282

SEQ ID NO: 696390 - RNA, 64 nt, hsa; identical to SEQ ID NO: 80283

SEQ ID NO: 696391 - RNA, 64 nt, hsa; identical to SEQ ID NO: 80284

SEQ ID NO: 696392 - RNA, 64 nt, hsa; identical to SEQ ID NO: 80285

SEQ ID NO: 696393 - RNA, 64 nt, hsa; identical to SEQ ID NO: 80286

SEQ ID NO: 696394 - RNA, 64 nt, hsa; identical to SEQ ID NO: 80287

SEQ ID NO: 696395 - RNA, 64 nt, hsa; identical to SEQ ID NO: 80288

SEQ ID NO: 696396 - RNA, 64 nt, hsa; identical to SEQ ID NO: 80289

SEQ ID NO: 696397 - RNA, 64 nt, hsa; identical to SEQ ID NO: 80290

SEQ ID NO: 696398 - RNA, 64 nt, hsa; identical to SEQ ID NO: 80291

SEQ ID NO: 696399 - RNA, 64 nt, hsa; identical to SEQ ID NO: 80292

SEQ ID NO: 696400 - RNA, 64 nt, hsa; identical to SEQ ID NO: 80293

SEQ ID NO: 696401 - RNA, 64 nt, hsa; identical to SEQ ID NO: 80294

SEQ ID NO: 696402 - RNA, 64 nt, hsa; identical to SEQ ID NO: 80295

SEQ ID NO: 696403 - RNA, 64 nt, hsa; identical to SEQ ID NO: 80296

SEQ ID NO: 696404 - RNA, 64 nt, hsa; identical to SEQ ID NO: 80297

SEQ ID NO: 696405 - RNA, 64 nt, hsa; identical to SEQ ID NO: 80298

SEQ ID NO: 696406 - RNA, 64 nt, hsa; identical to SEQ ID NO: 80299

SEQ ID NO: 696407 - RNA, 64 nt, hsa; identical to SEQ ID NO: 80300

SEQ ID NO: 696408 - RNA, 64 nt, hsa; identical to SEQ ID NO: 80301

SEQ ID NO: 696409 - RNA, 64 nt, hsa; identical to SEQ ID NO: 80302

SEQ ID NO: 696410 - RNA, 64 nt, hsa; identical to SEQ ID NO: 80303

SEQ ID NO: 696411 - RNA, 64 nt, hsa; identical to SEQ ID NO: 80304

SEQ ID NO: 696412 - RNA, 64 nt, hsa; identical to SEQ ID NO: 80305

SEQ ID NO: 696413 - RNA, 64 nt, hsa; identical to SEQ ID NO: 80306

SEQ ID NO: 696414 - RNA, 64 nt, hsa; identical to SEQ ID NO: 80307

SEQ ID NO: 696415 - RNA, 64 nt, hsa; identical to SEQ ID NO: 80308

SEQ ID NO: 696416 - RNA, 64 nt, hsa; identical to SEQ ID NO: 80309

SEQ ID NO: 696417 - RNA, 64 nt, hsa; identical to SEQ ID NO: 80310

SEQ ID NO: 696418 - RNA, 64 nt, hsa; identical to SEQ ID NO: 80311

SEQ ID NO: 696419 - RNA, 64 nt, hsa; identical to SEQ ID NO: 80312

SEQ ID NO: 696420 - RNA, 64 nt, hsa; identical to SEQ ID NO: 80313

SEQ ID NO: 696421 - RNA, 64 nt, hsa; identical to SEQ ID NO: 80314

SEQ ID NO: 696422 - RNA, 64 nt, hsa; identical to SEQ ID NO: 80315

SEQ ID NO: 696423 - RNA, 64 nt, hsa; identical to SEQ ID NO: 80316

SEQ ID NO: 696424 - RNA, 64 nt, hsa; identical to SEQ ID NO: 80317

SEQ ID NO: 696425 - RNA, 64 nt, hsa; identical to SEQ ID NO: 80318

SEQ ID NO: 696426 - RNA, 64 nt, hsa; identical to SEQ ID NO: 80319

SEQ ID NO: 696427 - RNA, 64 nt, hsa; identical to SEQ ID NO: 80320

SEQ ID NO: 696428 - RNA, 64 nt, hsa; identical to SEQ ID NO: 80321

SEQ ID NO: 696429 - RNA, 64 nt, hsa; identical to SEQ ID NO: 80322

SEQ ID NO: 696430 - RNA, 64 nt, hsa; identical to SEQ ID NO: 80323

SEQ ID NO: 696431 - RNA, 64 nt, hsa; identical to SEQ ID NO: 80324

SEQ ID NO: 696432 - RNA, 51 nt, hsa; identical to SEQ ID NO: 80325

SEQ ID NO: 696433 - RNA, 64 nt, hsa; identical to SEQ ID NO: 80326

SEQ ID NO: 696434 - RNA, 64 nt, hsa; identical to SEQ ID NO: 80327

SEQ ID NO: 696435 - RNA, 64 nt, hsa; identical to SEQ ID NO: 80328

SEQ ID NO: 696436 - RNA, 64 nt, hsa; identical to SEQ ID NO: 80329

SEQ ID NO: 696437 - RNA, 64 nt, hsa; identical to SEQ ID NO: 80330

SEQ ID NO: 696438 - RNA, 62 nt, hsa; identical to SEQ ID NO: 80331

SEQ ID NO: 696439 - RNA, 64 nt, hsa; identical to SEQ ID NO: 80332

SEQ ID NO: 696440 - RNA, 64 nt, hsa; identical to SEQ ID NO: 80333

SEQ ID NO: 696441 - RNA, 64 nt, hsa; identical to SEQ ID NO: 80334

SEQ ID NO: 696442 - RNA, 54 nt, hsa; identical to SEQ ID NO: 80335

SEQ ID NO: 696443 - RNA, 64 nt, hsa; identical to SEQ ID NO: 80336

SEQ ID NO: 696444 - RNA, 64 nt, hsa; identical to SEQ ID NO: 80337

SEQ ID NO: 696445 - RNA, 64 nt, hsa; identical to SEQ ID NO: 80338

SEQ ID NO: 696446 - RNA, 64 nt, hsa; identical to SEQ ID NO: 80339

SEQ ID NO: 696447 - RNA, 64 nt, hsa; identical to SEQ ID NO: 80340

SEQ ID NO: 696448 - RNA, 64 nt, hsa; identical to SEQ ID NO: 80341

SEQ ID NO: 696449 - RNA, 64 nt, hsa; identical to SEQ ID NO: 80342

SEQ ID NO: 696450 - RNA, 64 nt, hsa; identical to SEQ ID NO: 80343

SEQ ID NO: 696451 - RNA, 64 nt, hsa; identical to SEQ ID NO: 80344

SEQ ID NO: 696452 - RNA, 64 nt, hsa; identical to SEQ ID NO: 80345

SEQ ID NO: 696453 - RNA, 64 nt, hsa; identical to SEQ ID NO: 80346

SEQ ID NO: 696454 - RNA, 64 nt, hsa; identical to SEQ ID NO: 80347

SEQ ID NO: 696455 - RNA, 64 nt, hsa; identical to SEQ ID NO: 80348

SEQ ID NO: 696456 - RNA, 64 nt, hsa; identical to SEQ ID NO: 80349

SEQ ID NO: 696457 - RNA, 64 nt, hsa; identical to SEQ ID NO: 80350

SEQ ID NO: 696458 - RNA, 64 nt, hsa; identical to SEQ ID NO: 80351

SEQ ID NO: 696459 - RNA, 59 nt, hsa; identical to SEQ ID NO: 80352

SEQ ID NO: 696460 - RNA, 64 nt, hsa; identical to SEQ ID NO: 80353

SEQ ID NO: 696461 - RNA, 64 nt, hsa; identical to SEQ ID NO: 80354

SEQ ID NO: 696462 - RNA, 64 nt, hsa; identical to SEQ ID NO: 80355

SEQ ID NO: 696463 - RNA, 64 nt, hsa; identical to SEQ ID NO: 80356

SEQ ID NO: 696464 - RNA, 64 nt, hsa; identical to SEQ ID NO: 80357

SEQ ID NO: 696465 - RNA, 64 nt, hsa; identical to SEQ ID NO: 80358

SEQ ID NO: 696466 - RNA, 64 nt, hsa; identical to SEQ ID NO: 80359

SEQ ID NO: 696467 - RNA, 64 nt, hsa; identical to SEQ ID NO: 80360

SEQ ID NO: 696468 - RNA, 64 nt, hsa; identical to SEQ ID NO: 80361

SEQ ID NO: 696469 - RNA, 64 nt, hsa; identical to SEQ ID NO: 80362

SEQ ID NO: 696470 - RNA, 64 nt, hsa; identical to SEQ ID NO: 80363

SEQ ID NO: 696471 - RNA, 64 nt, hsa; identical to SEQ ID NO: 80364

SEQ ID NO: 696472 - RNA, 64 nt, hsa; identical to SEQ ID NO: 80365

SEQ ID NO: 696473 - RNA, 64 nt, hsa; identical to SEQ ID NO: 80366

SEQ ID NO: 696474 - RNA, 64 nt, hsa; identical to SEQ ID NO: 80367

SEQ ID NO: 696475 - RNA, 64 nt, hsa; identical to SEQ ID NO: 80368

SEQ ID NO: 696476 - RNA, 64 nt, hsa; identical to SEQ ID NO: 80369

SEQ ID NO: 696477 - RNA, 64 nt, hsa; identical to SEQ ID NO: 80370

SEQ ID NO: 696478 - RNA, 64 nt, hsa; identical to SEQ ID NO: 80371

SEQ ID NO: 696479 - RNA, 64 nt, hsa; identical to SEQ ID NO: 80372

SEQ ID NO: 696480 - RNA, 64 nt, hsa; identical to SEQ ID NO: 80373

SEQ ID NO: 696481 - RNA, 64 nt, hsa; identical to SEQ ID NO: 80374

SEQ ID NO: 696482 - RNA, 64 nt, hsa; identical to SEQ ID NO: 80375

SEQ ID NO: 696483 - RNA, 64 nt, hsa; identical to SEQ ID NO: 80376

SEQ ID NO: 696484 - RNA, 64 nt, hsa; identical to SEQ ID NO: 80377

SEQ ID NO: 696485 - RNA, 64 nt, hsa; identical to SEQ ID NO: 80378

SEQ ID NO: 696486 - RNA, 64 nt, hsa; identical to SEQ ID NO: 80379

SEQ ID NO: 696487 - RNA, 64 nt, hsa; identical to SEQ ID NO: 80380

SEQ ID NO: 696488 - RNA, 64 nt, hsa; identical to SEQ ID NO: 80381

SEQ ID NO: 696489 - RNA, 64 nt, hsa; identical to SEQ ID NO: 80382

SEQ ID NO: 696490 - RNA, 64 nt, hsa; identical to SEQ ID NO: 80383

SEQ ID NO: 696491 - RNA, 64 nt, hsa; identical to SEQ ID NO: 80384

SEQ ID NO: 696492 - RNA, 64 nt, hsa; identical to SEQ ID NO: 80385

SEQ ID NO: 696493 - RNA, 64 nt, hsa; identical to SEQ ID NO: 80386

SEQ ID NO: 696494 - RNA, 64 nt, hsa; identical to SEQ ID NO: 80387

SEQ ID NO: 696495 - RNA, 64 nt, hsa; identical to SEQ ID NO: 80388

SEQ ID NO: 696496 - RNA, 64 nt, hsa; identical to SEQ ID NO: 80389

SEQ ID NO: 696497 - RNA, 64 nt, hsa; identical to SEQ ID NO: 80390

SEQ ID NO: 696498 - RNA, 64 nt, hsa; identical to SEQ ID NO: 80391

SEQ ID NO: 696499 - RNA, 53 nt, hsa; identical to SEQ ID NO: 80392

SEQ ID NO: 696500 - RNA, 64 nt, hsa; identical to SEQ ID NO: 80393

SEQ ID NO: 696501 - RNA, 64 nt, hsa; identical to SEQ ID NO: 80394

SEQ ID NO: 696502 - RNA, 64 nt, hsa; identical to SEQ ID NO: 80395

SEQ ID NO: 696503 - RNA, 64 nt, hsa; identical to SEQ ID NO: 80396

SEQ ID NO: 696504 - RNA, 64 nt, hsa; identical to SEQ ID NO: 80397

SEQ ID NO: 696505 - RNA, 64 nt, hsa; identical to SEQ ID NO: 80398

SEQ ID NO: 696506 - RNA, 64 nt, hsa; identical to SEQ ID NO: 80399

SEQ ID NO: 696507 - RNA, 64 nt, hsa; identical to SEQ ID NO: 80400

SEQ ID NO: 696508 - RNA, 64 nt, hsa; identical to SEQ ID NO: 80401

SEQ ID NO: 696509 - RNA, 64 nt, hsa; identical to SEQ ID NO: 80402

SEQ ID NO: 696510 - RNA, 64 nt, hsa; identical to SEQ ID NO: 80403

SEQ ID NO: 696511 - RNA, 64 nt, hsa; identical to SEQ ID NO: 80404

SEQ ID NO: 696512 - RNA, 64 nt, hsa; identical to SEQ ID NO: 80405

SEQ ID NO: 696513 - RNA, 64 nt, hsa; identical to SEQ ID NO: 80406

SEQ ID NO: 696514 - RNA, 64 nt, hsa; identical to SEQ ID NO: 80407

SEQ ID NO: 696515 - RNA, 64 nt, hsa; identical to SEQ ID NO: 80408

SEQ ID NO: 696516 - RNA, 64 nt, hsa; identical to SEQ ID NO: 80409

SEQ ID NO: 696517 - RNA, 64 nt, hsa; identical to SEQ ID NO: 80410

SEQ ID NO: 696518 - RNA, 64 nt, hsa; identical to SEQ ID NO: 80411

SEQ ID NO: 696519 - RNA, 64 nt, hsa; identical to SEQ ID NO: 80412

SEQ ID NO: 696520 - RNA, 64 nt, hsa; identical to SEQ ID NO: 80413

SEQ ID NO: 696521 - RNA, 64 nt, hsa; identical to SEQ ID NO: 80414

SEQ ID NO: 696522 - RNA, 64 nt, hsa; identical to SEQ ID NO: 80415

SEQ ID NO: 696523 - RNA, 64 nt, hsa; identical to SEQ ID NO: 80416

SEQ ID NO: 696524 - RNA, 64 nt, hsa; identical to SEQ ID NO: 80417

SEQ ID NO: 696525 - RNA, 64 nt, hsa; identical to SEQ ID NO: 80418

SEQ ID NO: 696526 - RNA, 64 nt, hsa; identical to SEQ ID NO: 144868

SEQ ID NO: 696527 - RNA, 64 nt, hsa; identical to SEQ ID NO: 144869

SEQ ID NO: 696528 - RNA, 64 nt, hsa; identical to SEQ ID NO: 144870

SEQ ID NO: 696529 - RNA, 64 nt, hsa; identical to SEQ ID NO: 144871

SEQ ID NO: 696530 - RNA, 64 nt, hsa; identical to SEQ ID NO: 144872

SEQ ID NO: 696531 - RNA, 64 nt, hsa; identical to SEQ ID NO: 144873

SEQ ID NO: 696532 - RNA, 64 nt, hsa; identical to SEQ ID NO: 144874

SEQ ID NO: 696533 - RNA, 64 nt, hsa; identical to SEQ ID NO: 144875

SEQ ID NO: 696534 - RNA, 64 nt, hsa; identical to SEQ ID NO: 144876

SEQ ID NO: 696535 - RNA, 64 nt, hsa; identical to SEQ ID NO: 144877

SEQ ID NO: 696536 - RNA, 64 nt, hsa; identical to SEQ ID NO: 144878

SEQ ID NO: 696537 - RNA, 64 nt, hsa; identical to SEQ ID NO: 144879

SEQ ID NO: 696538 - RNA, 64 nt, hsa; identical to SEQ ID NO: 144880

SEQ ID NO: 696539 - RNA, 64 nt, hsa; identical to SEQ ID NO: 144881

SEQ ID NO: 696540 - RNA, 64 nt, hsa; identical to SEQ ID NO: 144882

SEQ ID NO: 696541 - RNA, 64 nt, hsa; identical to SEQ ID NO: 144883

SEQ ID NO: 696542 - RNA, 64 nt, hsa; identical to SEQ ID NO: 144884

SEQ ID NO: 696543 - RNA, 64 nt, hsa; identical to SEQ ID NO: 144885

SEQ ID NO: 696544 - RNA, 64 nt, hsa; identical to SEQ ID NO: 144886

SEQ ID NO: 696545 - RNA, 64 nt, hsa; identical to SEQ ID NO: 144887

SEQ ID NO: 696546 - RNA, 64 nt, hsa; identical to SEQ ID NO: 144888

SEQ ID NO: 696547 - RNA, 64 nt, hsa; identical to SEQ ID NO: 144889

SEQ ID NO: 696548 - RNA, 64 nt, hsa; identical to SEQ ID NO: 144890

SEQ ID NO: 696549 - RNA, 64 nt, hsa; identical to SEQ ID NO: 144891

SEQ ID NO: 696550 - RNA, 64 nt, hsa; identical to SEQ ID NO: 144892

SEQ ID NO: 696551 - RNA, 64 nt, hsa; identical to SEQ ID NO: 144893

SEQ ID NO: 696552 - RNA, 64 nt, hsa; identical to SEQ ID NO: 144894

SEQ ID NO: 696553 - RNA, 64 nt, hsa; identical to SEQ ID NO: 144895

SEQ ID NO: 696554 - RNA, 64 nt, hsa; identical to SEQ ID NO: 144896

SEQ ID NO: 696555 - RNA, 64 nt, hsa; identical to SEQ ID NO: 144897

SEQ ID NO: 696556 - RNA, 64 nt, hsa; identical to SEQ ID NO: 144898

SEQ ID NO: 696557 - RNA, 64 nt, hsa; identical to SEQ ID NO: 144899

SEQ ID NO: 696558 - RNA, 64 nt, hsa; identical to SEQ ID NO: 144900

SEQ ID NO: 696559 - RNA, 64 nt, hsa; identical to SEQ ID NO: 144901

SEQ ID NO: 696560 - RNA, 64 nt, hsa; identical to SEQ ID NO: 144902

SEQ ID NO: 696561 - RNA, 64 nt, hsa; identical to SEQ ID NO: 144903

SEQ ID NO: 696562 - RNA, 64 nt, hsa; identical to SEQ ID NO: 144904

SEQ ID NO: 696563 - RNA, 64 nt, hsa; identical to SEQ ID NO: 144905

SEQ ID NO: 696564 - RNA, 64 nt, hsa; identical to SEQ ID NO: 144906

SEQ ID NO: 696565 - RNA, 64 nt, hsa; identical to SEQ ID NO: 144907

SEQ ID NO: 696566 - RNA, 64 nt, hsa; identical to SEQ ID NO: 496651

SEQ ID NO: 696567 - RNA, 64 nt, hsa; identical to SEQ ID NO: 496652

SEQ ID NO: 696568 - RNA, 64 nt, hsa; identical to SEQ ID NO: 496653

SEQ ID NO: 696569 - RNA, 64 nt, hsa; identical to SEQ ID NO: 496654

SEQ ID NO: 696570 - RNA, 64 nt, hsa; identical to SEQ ID NO: 496655

SEQ ID NO: 696571 - RNA, 64 nt, hsa; identical to SEQ ID NO: 496656

SEQ ID NO: 696572 - RNA, 64 nt, hsa; identical to SEQ ID NO: 496657

SEQ ID NO: 696573 - RNA, 64 nt, hsa; identical to SEQ ID NO: 496658

SEQ ID NO: 696574 - RNA, 64 nt, hsa; identical to SEQ ID NO: 496659

SEQ ID NO: 696575 - RNA, 64 nt, hsa; identical to SEQ ID NO: 496660

SEQ ID NO: 696576 - RNA, 64 nt, hsa; identical to SEQ ID NO: 496661

SEQ ID NO: 696577 - RNA, 64 nt, hsa; identical to SEQ ID NO: 496662

SEQ ID NO: 696578 - RNA, 64 nt, hsa; identical to SEQ ID NO: 496663

SEQ ID NO: 696579 - RNA, 64 nt, hsa; identical to SEQ ID NO: 496664

SEQ ID NO: 696580 - RNA, 64 nt, hsa; identical to SEQ ID NO: 496665

SEQ ID NO: 696581 - RNA, 64 nt, hsa; identical to SEQ ID NO: 496665

SEQ ID NO: 696582 - RNA, 64 nt, hsa
cucuuuguggaaaaagaaacaggguuuugaacucuguuaacauuugaaaaauauauuuucaaau

SEQ ID NO: 696583 - RNA, 64 nt, hsa
uuucauuuuuacgagaguuugaaaauagacacacuguuaacacuucugccaguuuuuucugauc

SEQ ID NO: 696584 - RNA, 64 nt, hsa
uccaaucugaaguauugcacaucugaacugggacuguuaacacugaugccaauacagugugggg

SEQ ID NO: 696585 - RNA, 64 nt, hsa
agaaauuaacaggccacagguuucuuuaaagcuguguuaacauaucuugccuuaaaaugugugu

SEQ ID NO: 696586 - RNA, 64 nt, hsa
caaagagaaacucauuuuuuuaaagugaaauauuuguuaacagcccauugaacauacuuuuaaa

SEQ ID NO: 696587 - RNA, 64 nt, hsa
cagacauuuuugguugucacaacuggugggaugcuguuaacaucuagaggauagaggccagggu

SEQ ID NO: 696588 - RNA, 64 nt, hsa
gaauuuuuaaucacacggaucucaaauucacaaauguuaacauggauaagugaucauggugugc

SEQ ID NO: 696589 - RNA, 64 nt, hsa
uuuuagaauuaauuuuccaaaccacuaugcuuaauguuaacaugauucuguuuguuaauauuuu

SEQ ID NO: 696590 - RNA, 64 nt, hsa
gaaaggggaauucugugauggcaaaugaaaaaaauguuaacauuugguagacaugugcuuugac

SEQ ID NO: 696591 - RNA, 64 nt, hsa
gccauucugccguagcuagauguucugugggguuuguuaacauggaacuacucagcuuucuuuc

SEQ ID NO: 696592 - RNA, 64 nt, hsa
cuaaaagcugaaaaucucaguuuaaaaaucaaaauguuaacacaaagcuaagauucaucagagc

SEQ ID NO: 696593 - RNA, 64 nt, hsa
cauugauguagacuugucagauuauucugaguauuguuaacagugccuuuucgauggaaucaca

SEQ ID NO: 696594 - RNA, 64 nt, hsa
ggcuuaucacaaaaaucauuucaucaguaaaccuuguuaacauuuuguacuggugacccaccuc

SEQ ID NO: 696595 - RNA, 64 nt, hsa
gucuuuguauucuauaguauguucugagauauaauguuaacauuguucauaacaaaaaaugcua

SEQ ID NO: 696596 - RNA, 64 nt, hsa
uuuaugugaguagcauuucccuaucuugcaguucuguuaacaugaaaauggcauuuuuccauaa

SEQ ID NO: 696597 - RNA, 64 nt, hsa
uuuuuuauuuuuucaacuucaagguauuaacagcuguuaacacuuaaaaaguacugccacauau

SEQ ID NO: 696598 - RNA, 64 nt, hsa
aucaaaauacuauauuuauagaaguaaucuucucuguuaacagccaagauuugcuguuagaaau

SEQ ID NO: 696599 - RNA, 64 nt, hsa
uuucagcugacauuuccaccagcccucucauacuuguuaacaauugguaucuuugaguauuuac

SEQ ID NO: 696600 - RNA, 64 nt, hsa; identical to SEQ ID NO: 520367

SEQ ID NO: 696601 - RNA, 64 nt, hsa; identical to SEQ ID NO: 520368

SEQ ID NO: 696602 - RNA, 64 nt, hsa; identical to SEQ ID NO: 520394

SEQ ID NO: 696603 - RNA, 64 nt, hsa; identical to SEQ ID NO: 520395

SEQ ID NO: 696604 - RNA, 64 nt, hsa; identical to SEQ ID NO: 520405

SEQ ID NO: 696605 - RNA, 64 nt, hsa; identical to SEQ ID NO: 520406

SEQ ID NO: 696606 - RNA, 64 nt, hsa; identical to SEQ ID NO: 520425

SEQ ID NO: 696607 - RNA, 64 nt, hsa; identical to SEQ ID NO: 520426

SEQ ID NO: 696608 - RNA, 64 nt, hsa; identical to SEQ ID NO: 520427

SEQ ID NO: 696609 - RNA, 64 nt, hsa; identical to SEQ ID NO: 520428

SEQ ID NO: 696610 - RNA, 64 nt, hsa; identical to SEQ ID NO: 520431

SEQ ID NO: 696611 - RNA, 64 nt, hsa; identical to SEQ ID NO: 520432

SEQ ID NO: 696612 - RNA, 64 nt, hsa; identical to SEQ ID NO: 520447

SEQ ID NO: 696613 - RNA, 64 nt, hsa; identical to SEQ ID NO: 520448

SEQ ID NO: 696614 - RNA, 64 nt, hsa; identical to SEQ ID NO: 520468

SEQ ID NO: 696615 - RNA, 64 nt, hsa; identical to SEQ ID NO: 520469

SEQ ID NO: 696616 - RNA, 64 nt, hsa; identical to SEQ ID NO: 520476

SEQ ID NO: 696617 - RNA, 59 nt, hsa; identical to SEQ ID NO: 520477

SEQ ID NO: 696618 - RNA, 64 nt, hsa; identical to SEQ ID NO: 520485

SEQ ID NO: 696619 - RNA, 64 nt, hsa; identical to SEQ ID NO: 520486

SEQ ID NO: 696620 - RNA, 64 nt, hsa; identical to SEQ ID NO: 520510

SEQ ID NO: 696621 - RNA, 64 nt, hsa; identical to SEQ ID NO: 520511

SEQ ID NO: 696622 - RNA, 64 nt, hsa; identical to SEQ ID NO: 520529

SEQ ID NO: 696623 - RNA, 64 nt, hsa; identical to SEQ ID NO: 520530

SEQ ID NO: 696624 - RNA, 64 nt, hsa; identical to SEQ ID NO: 520594

SEQ ID NO: 696625 - RNA, 64 nt, hsa; identical to SEQ ID NO: 520595

SEQ ID NO: 696626 - RNA, 64 nt, hsa; identical to SEQ ID NO: 520618

SEQ ID NO: 696627 - RNA, 64 nt, hsa; identical to SEQ ID NO: 520619

SEQ ID NO: 696628 - RNA, 64 nt, hsa; identical to SEQ ID NO: 520631

SEQ ID NO: 696629 - RNA, 64 nt, hsa; identical to SEQ ID NO: 520632

SEQ ID NO: 696630 - RNA, 64 nt, hsa; identical to SEQ ID NO: 520633

SEQ ID NO: 696631 - RNA, 64 nt, hsa; identical to SEQ ID NO: 520648

SEQ ID NO: 696632 - RNA, 64 nt, hsa; identical to SEQ ID NO: 520649

SEQ ID NO: 696633 - RNA, 64 nt, hsa; identical to SEQ ID NO: 520651

SEQ ID NO: 696634 - RNA, 64 nt, hsa; identical to SEQ ID NO: 520652

SEQ ID NO: 696635 - RNA, 64 nt, hsa; identical to SEQ ID NO: 520663

SEQ ID NO: 696636 - RNA, 64 nt, hsa; identical to SEQ ID NO: 520664

SEQ ID NO: 696637 - RNA, 64 nt, hsa; identical to SEQ ID NO: 520683

SEQ ID NO: 696638 - RNA, 64 nt, hsa; identical to SEQ ID NO: 520684

SEQ ID NO: 696639 - RNA, 64 nt, hsa; identical to SEQ ID NO: 101831

SEQ ID NO: 696640 - RNA, 64 nt, hsa; identical to SEQ ID NO: 101832

SEQ ID NO: 696641 - RNA, 64 nt, hsa; identical to SEQ ID NO: 101833

SEQ ID NO: 696642 - RNA, 64 nt, hsa; identical to SEQ ID NO: 101834

SEQ ID NO: 696643 - RNA, 61 nt, hsa; identical to SEQ ID NO: 101835

SEQ ID NO: 696644 - RNA, 64 nt, hsa; identical to SEQ ID NO: 101836

SEQ ID NO: 696645 - RNA, 64 nt, hsa; identical to SEQ ID NO: 101837

SEQ ID NO: 696646 - RNA, 64 nt, hsa; identical to SEQ ID NO: 101838

SEQ ID NO: 696647 - RNA, 64 nt, hsa; identical to SEQ ID NO: 101839

SEQ ID NO: 696648 - RNA, 64 nt, hsa; identical to SEQ ID NO: 101840

SEQ ID NO: 696649 - RNA, 64 nt, hsa; identical to SEQ ID NO: 101841

SEQ ID NO: 696650 - RNA, 64 nt, hsa; identical to SEQ ID NO: 101842

SEQ ID NO: 696651 - RNA, 64 nt, hsa; identical to SEQ ID NO: 101843

SEQ ID NO: 696652 - RNA, 64 nt, hsa; identical to SEQ ID NO: 101844

SEQ ID NO: 696653 - RNA, 64 nt, hsa; identical to SEQ ID NO: 101845

SEQ ID NO: 696654 - RNA, 64 nt, hsa; identical to SEQ ID NO: 101846

SEQ ID NO: 696655 - RNA, 64 nt, hsa; identical to SEQ ID NO: 101847

SEQ ID NO: 696656 - RNA, 64 nt, hsa; identical to SEQ ID NO: 101848

SEQ ID NO: 696657 - RNA, 64 nt, hsa; identical to SEQ ID NO: 101849

SEQ ID NO: 696658 - RNA, 64 nt, hsa; identical to SEQ ID NO: 101850

SEQ ID NO: 696659 - RNA, 64 nt, hsa; identical to SEQ ID NO: 101851

SEQ ID NO: 696660 - RNA, 64 nt, hsa; identical to SEQ ID NO: 101852

SEQ ID NO: 696661 - RNA, 64 nt, hsa; identical to SEQ ID NO: 101853

SEQ ID NO: 696662 - RNA, 64 nt, hsa; identical to SEQ ID NO: 101854

SEQ ID NO: 696663 - RNA, 64 nt, hsa
gauccauuagggaucgaggugcuacacuggccuccagggauaagccuggggcuacuguugcugg

SEQ ID NO: 696664 - RNA, 64 nt, hsa
cuggaauaccuuccuucuuaaaaucugaucauggcagggauaugcagggcacuuuuuacuauuu

SEQ ID NO: 696665 - RNA, 64 nt, hsa
gccugcucuucccauguuggccucugcaaccacacagggauauuucugcuaugcaccagccuca

SEQ ID NO: 696666 - RNA, 64 nt, hsa
agaagcagauccuggcccucccgcccccaccccucagggauauuuaaaacuuauuuuauauacc

SEQ ID NO: 696667 - RNA, 64 nt, hsa
uuucuugugcuucagcuacuagaaagguuuaauucagggauaagucccaauugaguaguucaag

SEQ ID NO: 696668 - RNA, 64 nt, hsa
uaaguuucauauauagucauaugucacuuaaugacagggauauguucugagacaugucacuugg

SEQ ID NO: 696669 - RNA, 64 nt, hsa
gcugauccuucuuuucacuuucugucaaugucaccagggauaaggugggacaaugggggguggg

SEQ ID NO: 696670 - RNA, 64 nt, hsa
gggcgcugagcucaggcccagaacuggcugauuucagggauacccaggacgcgugaaacacaga

SEQ ID NO: 696671 - RNA, 64 nt, hsa
aucuuucuucuuaguuuacagugaaauauuaucucagggauauuuuuuuuuuuuuuuugagacg

SEQ ID NO: 696672 - RNA, 64 nt, hsa
gauuacaggcgugagccaccgcgcccggccaucucagggauauuuaaacaaaggaagaggaaau

SEQ ID NO: 696673 - RNA, 64 nt, hsa
ccuucugggccagaggcaccaucccuucuggccauccaucaaguccaucaaggcccagcccugc

SEQ ID NO: 696674 - RNA, 64 nt, hsa
ccagaggcaccaucccuucuggccauccaucaaguccaucaaggcccagcccugcugagaaaug

SEQ ID NO: 696675 - RNA, 64 nt, hsa
gaguauuugagauuggccaagcagaacuaugaaguccaucaaguaagucaaagaucaucguuuc

SEQ ID NO: 696676 - RNA, 64 nt, hsa
agcagccugaacagacuaagacggggguguugcuuccaucaaaggauguacuaaguuguggauu

SEQ ID NO: 696677 - RNA, 64 nt, hsa
uucaaaguaagagucagcuuuuucuccccauuugggacaucaagccuagcauguaagacuuaaa

SEQ ID NO: 696678 - RNA, 64 nt, hsa
uuucugaugaucauugcuggcaugaagcuguugcggacaucauucugcaacccgguuuaccagu

SEQ ID NO: 696679 - RNA, 64 nt, hsa
uucuugaugguaacuucucagagcagggcgauugggacaucaccagccagagcacaggaagcca

SEQ ID NO: 696680 - RNA, 64 nt, hsa
uuaccagaggauccccgagagccacaccagcucuggacaucaccgccccuggaacuggggccac

SEQ ID NO: 696681 - RNA, 64 nt, hsa; identical to SEQ ID NO: 415046

SEQ ID NO: 696682 - RNA, 64 nt, hsa; identical to SEQ ID NO: 415047

SEQ ID NO: 696683 - RNA, 64 nt, hsa
gaggugcacugggaggcuccccuucuauuuggggcuugaugacuuucuuuuuguagcuggggcu

SEQ ID NO: 696684 - RNA, 64 nt, hsa
cagcuuguaggggaggggcuccuuuccauaaauccuugaugauugacaacacccauuuuuccuu

SEQ ID NO: 696685 - RNA, 64 nt, hsa
auucaucuuuguugaaucuguugugcagauuuuucuugaugagcauucuguuuuuuuuucuuug

SEQ ID NO: 696686 - RNA, 64 nt, hsa
ugaaguggaauuugggguugcucuuggaaguggccuugaugaggauccuuuacaacuauucaga

SEQ ID NO: 696687 - RNA, 64 nt, hsa
uccccugccagggcucgggcgcuguggcuccugccuugaugaagcccguguccugccuugauga

SEQ ID NO: 696688 - RNA, 64 nt, hsa
uguggcuccugccuugaugaagcccguguccugccuugaugaagccugugccaccugcaagugc

SEQ ID NO: 696689 - RNA, 64 nt, hsa
ccucaaauuuauuacaaauuuaguauuuuuaguacuugaugacucuaauuacaugaaugcaccu

SEQ ID NO: 696690 - RNA, 64 nt, hsa
guuuggagucagaaccuggguaugacucuguggccuugaugaagcaaguuacuuaaacucuuga

SEQ ID NO: 696691 - RNA, 64 nt, hsa
aaguuacaggucacuuuaaaagcaaacaguaccacuugaugauuuugcauaaaauuaugcauug

SEQ ID NO: 696692 - RNA, 64 nt, hsa
aauugguauuuugcugaaaauuccuagaaaacugcuugaugacaauaaaaaguaaauaaaagca

SEQ ID NO: 696693 - RNA, 64 nt, hsa
uccuuuuaugcucaccugacauuaauuaucuauccuugaugauguguuuaaacugaguagcaga

SEQ ID NO: 696694 - RNA, 64 nt, hsa
ucuccgcaaggugguagcaggaaaagguccuugacuugaugaauuuggucugccucugagccac

SEQ ID NO: 696695 - RNA, 64 nt, hsa; identical to SEQ ID NO: 53319

SEQ ID NO: 696696 - RNA, 64 nt, hsa; identical to SEQ ID NO: 53320

SEQ ID NO: 696697 - RNA, 64 nt, hsa; identical to SEQ ID NO: 53321

SEQ ID NO: 696698 - RNA, 64 nt, hsa; identical to SEQ ID NO: 53322

SEQ ID NO: 696699 - RNA, 64 nt, hsa; identical to SEQ ID NO: 53323

SEQ ID NO: 696700 - RNA, 64 nt, hsa; identical to SEQ ID NO: 53324

SEQ ID NO: 696701 - RNA, 64 nt, hsa; identical to SEQ ID NO: 53325

SEQ ID NO: 696702 - RNA, 64 nt, hsa; identical to SEQ ID NO: 53326

SEQ ID NO: 696703 - RNA, 64 nt, hsa; identical to SEQ ID NO: 53327

SEQ ID NO: 696704 - RNA, 64 nt, hsa; identical to SEQ ID NO: 53328

SEQ ID NO: 696705 - RNA, 64 nt, hsa; identical to SEQ ID NO: 53329

SEQ ID NO: 696706 - RNA, 64 nt, hsa; identical to SEQ ID NO: 53330

SEQ ID NO: 696707 - RNA, 64 nt, hsa; identical to SEQ ID NO: 53331

SEQ ID NO: 696708 - RNA, 64 nt, hsa; identical to SEQ ID NO: 53332

SEQ ID NO: 696709 - RNA, 64 nt, hsa; identical to SEQ ID NO: 53333

SEQ ID NO: 696710 - RNA, 64 nt, hsa; identical to SEQ ID NO: 53334

SEQ ID NO: 696711 - RNA, 64 nt, hsa; identical to SEQ ID NO: 257776

SEQ ID NO: 696712 - RNA, 64 nt, hsa; identical to SEQ ID NO: 257777

SEQ ID NO: 696713 - RNA, 64 nt, hsa
acaaauuuuacucaaguuuaaauuguauaaaacugcuuagaaaccugaaauuuuauagugugua

SEQ ID NO: 696714 - RNA, 64 nt, hsa
gaaaacuggcaagagaauugaugagguauuaguggcuuagaagaauuaguaauauaaguuggga

SEQ ID NO: 696715 - RNA, 64 nt, hsa
aaaagagaauugggggcuuagggucggaacccaagcuuagaacuuuaagcaacaagaccaccac

SEQ ID NO: 696716 - RNA, 64 nt, hsa
ucgcccuacuauucaguggcgagaaauaaaguuugcuuagaaaagaaacauggucuccuucuug

SEQ ID NO: 696717 - RNA, 64 nt, hsa
cugcagaaggaucugaaagaucuaaacauggugugcuuagaaacugcagauuuuagaucuaaug

SEQ ID NO: 696718 - RNA, 64 nt, hsa
uuaauucaaauaccaaauaguuuacauagggccagcuuagaaauagauacuaaauccagagcua

SEQ ID NO: 696719 - RNA, 64 nt, hsa
auguacucugcacagggggagugaaguaauauuggcuuagaagacuucaccuuuuguuuuucau

SEQ ID NO: 696720 - RNA, 64 nt, hsa
gagcguggacuugaugcagugaugacaaaucauugcuuagaauuaauguuuucaaaugugcaac

SEQ ID NO: 696721 - RNA, 64 nt, hsa
gaaugacauaccugggcucaggggaagcaagggggcuuagaauuugugggguauucccaaaagg

SEQ ID NO: 696722 - RNA, 64 nt, hsa
aacugcucugcacuguuuaauccauuuccaaggggcuuagaaaagcuaacaagggugugucccc

SEQ ID NO: 696723 - RNA, 64 nt, hsa
agagcauucuuuuccucaaaacgagcugcauaauucuuggaauuuaugucuuaccacauggugg

SEQ ID NO: 696724 - RNA, 64 nt, hsa
cuugcucaggagagggaauaacgcaggucccuuuucuuggaaggcuuguacuauggccaugaca

SEQ ID NO: 696725 - RNA, 64 nt, hsa
guagggcuucugcagagccauguuugagccaaggucuuggaaggcauugccccaugggcucagg

SEQ ID NO: 696726 - RNA, 64 nt, hsa
ggccuucccgggggcuuuuugccugaggcugcacucuuggaaggcguggggagaguucugccug

SEQ ID NO: 696727 - RNA, 64 nt, hsa
uaaaaaauauuuucaaagugaagcugagagagaaucuuggaaacacacauaccuguugaucaug

SEQ ID NO: 696728 - RNA, 64 nt, hsa
cucuuuccugucuccucuccucugaucuguucuuucuuggaacaccacccaagaacgucaccuc

SEQ ID NO: 696729 - RNA, 64 nt, hsa
uauccugcucagaaccauucacauuuaauucaauucuuggaaaaaauuaaagcuuuuugcccac

SEQ ID NO: 696730 - RNA, 64 nt, hsa
caugauguugcauuaauaguuguuuuugucccuuucuuggaaauguuaaugccaaaguugccug

SEQ ID NO: 696731 - RNA, 64 nt, hsa
gguuuccuguccagcuucuuggaaaggagcucacucuuggaaagacugaucuuuccaaaauauu

SEQ ID NO: 696732 - RNA, 64 nt, hsa
ucagauccacauuuauuggguuuccuguccagcuucuuggaaaggagcucacucuuggaaagac

SEQ ID NO: 696733 - RNA, 64 nt, hsa
cauguuggacuuucacagugugaucucucaccugucuuggaaacuccuucauaaagccgcucuu

SEQ ID NO: 696734 - RNA, 64 nt, hsa
cccaacuuuccaaaucuggauaaagcugugggauucuuggaagcagcuugaguguuuucaucuu

SEQ ID NO: 696735 - RNA, 64 nt, hsa
aaaagauauuucagucuaggaaagauuuuccuucucuuggaaugugaagaucugucgauucauc

SEQ ID NO: 696736 - RNA, 64 nt, hsa
gggccccuuucugaucucaccauuucaccaugcaucuuggaauucaguaagugcauauccuaac

SEQ ID NO: 696737 - RNA, 64 nt, hsa
uucaaaauuguacacaguuugcuaauuagaaauaucuuggaaagccucauggucacuaauuuuc

SEQ ID NO: 696738 - RNA, 64 nt, hsa
uuucuuuuucuuuugaaaaguuaucuacugcccuucuuggaaguuugcaggauuggaugggaac

SEQ ID NO: 696739 - RNA, 64 nt, hsa
aguggcuggaagaaccacugucuagagcaacuuuucuuggaacugucccagcuaccaagucaga

SEQ ID NO: 696740 - RNA, 64 nt, hsa
cuagauggaccccagcauuuaagugaccuucugaucuuggaaaaacagcgucuuccuucuuuau

SEQ ID NO: 696741 - RNA, 64 nt, hsa
augaggaauuucaugaugauuuaggaauuuucucucuuggaaaaggcuuccccugugaugaaaa

SEQ ID NO: 696742 - RNA, 64 nt, hsa
guaucaacuagcauuggaaaauacauaucacuauucuuggaauauuuauggucagucuacuuuu

SEQ ID NO: 696743 - RNA, 64 nt, hsa
guuuaccgauggaugggcuagagaucuugucguuucuuggaagucacagggaagauugaagaga

SEQ ID NO: 696744 - RNA, 64 nt, hsa
ugccagaaugagcaaccucaaggaauugaacacuucuuggaaaaucuagguaauucaagcccuc

SEQ ID NO: 696745 - RNA, 64 nt, hsa
gcccaauaggcucagcucaugaugacagaacacaucuuggaaagacugacucuguuauguaacu

SEQ ID NO: 696746 - RNA, 64 nt, hsa
uagaugaauacucaggcuaaccuaguggaugugaucuuggaacuuccaugauuauccacuuaaa

SEQ ID NO: 696747 - RNA, 64 nt, hsa
gcuuaauaauuaauggcuacauagcaaggcaucgucuuggaaccggagaauuuucucuagacua

SEQ ID NO: 696748 - RNA, 64 nt, hsa
accaucugccuuaaauuuccucuguuuuucacauucuuggaaauauaucauuguuuugcaaauu

SEQ ID NO: 696749 - RNA, 64 nt, hsa
ugcacuccagccugggcaccaaugugagaaccugucuuggaaaaaaaaaaaaagaaacauguuu

SEQ ID NO: 696750 - RNA, 64 nt, hsa
ccagggcucuccuguugguaguuccugcuuuucuucuuggaaauuccucguggaccucgagauc

SEQ ID NO: 696751 - RNA, 64 nt, hsa
ucaaaaaaaaucuuaaccugcagcaggcuguuugucuuggaagcuuuuguuugagcuuauaaga

SEQ ID NO: 696752 - RNA, 64 nt, hsa
uaauaagcuacagaacuaauauucugcaaaugucucuuggaacacacugccuuaaacagauauu

SEQ ID NO: 696753 - RNA, 64 nt, hsa
gggcuaauugccaccaauuucagccugccacgauucuuggaaauaugucuuccaagugccaucc

SEQ ID NO: 696754 - RNA, 64 nt, hsa
ccucaacuaccucuucucacugucagugacaccaucuuggaauaccuuugggaagcagcaggaa

SEQ ID NO: 696755 - RNA, 64 nt, hsa
acccuaaauauguuuacauaccauuaagauaugauucauguaacaauguuaaauuaauuauaau

SEQ ID NO: 696756 - RNA, 64 nt, hsa
acaugaaauucaacuuuccaaauaaaaguucuacuucauguaauccaaaaauguuuguauucug

SEQ ID NO: 696757 - RNA, 64 nt, hsa
gugccuguuaacaagaauacugaccagaaugcucuucauguagcuuauacaguugguucacuuc

SEQ ID NO: 696758 - RNA, 64 nt, hsa
auaaauaauguuggugaggauaaaguacagauauuucauguagaauuaauugcuaguuaugaug

SEQ ID NO: 696759 - RNA, 64 nt, hsa
uuuaucucaagauaggaagaaaauuuccuccacauucauguacaaugauguaaauauuucaaua

SEQ ID NO: 696760 - RNA, 64 nt, hsa
uccagacuuaaaacaugaugaguugagcucuaucuucauguacucauccugaauccuuauuuuu

SEQ ID NO: 696761 - RNA, 64 nt, hsa
cauuucugcucagauuccccccaucuccauugcauucauguacuacccucagucuacacucaca

SEQ ID NO: 696762 - RNA, 64 nt, hsa
ccucugggaaacagaccuuuuucucucuuacugcuucauguaauuuuguaucaccucuucacaa

SEQ ID NO: 696763 - RNA, 64 nt, hsa
auaacauucaauuugcuauuuacaaaugaaguauuucauguaauauaagugaacaacuggaaau

SEQ ID NO: 696764 - RNA, 64 nt, hsa
cuguucacauccaguugucuaaaggaugagauuuuucauguaucuuauagucacucauucuucg

SEQ ID NO: 696765 - RNA, 64 nt, hsa
uuucaagcuaagcuuauugaauucuuuuaccacuuucauguaagcugguaggggauuuuugaga

SEQ ID NO: 696766 - RNA, 64 nt, hsa
uucaaacucauaaacucaguauuuuaacucaaaauucauguaacaagauagccaaaagcauagg

SEQ ID NO: 696767 - RNA, 64 nt, hsa
cuugauuguauacugucuuuuaauccuucauuguuucauguaugaaguuuuuaaucacccccua

SEQ ID NO: 696768 - RNA, 64 nt, hsa
auaaacuugaugaauauuauaugugaggaaaacuuucauguauagcacucauugcuucagacag

SEQ ID NO: 696769 - RNA, 64 nt, hsa
ugaauggacuuuucaacuacuuucucuacagcuuuucauguaaauuagucuugguucugaaacu

SEQ ID NO: 696770 - RNA, 64 nt, hsa
uccaagcauaauuguuaagaacacguguauuaaauucauguaaguggaauaaaaguuuuaugaa

SEQ ID NO: 696771 - RNA, 64 nt, hsa
augcaggaaaaaugaauugcuugguauucauuacuucauguauaucaagcacagcaguaaaaca

SEQ ID NO: 696772 - RNA, 64 nt, hsa
gguauuaaagauuuaaagucucuuaggaauauuauucauguaacuccauggcauaaauaguugu

SEQ ID NO: 696773 - RNA, 64 nt, hsa
uuaaggguguacauuuugauguugaacaucaguuuucauguagacuuaggacucaugugcagua

SEQ ID NO: 696774 - RNA, 64 nt, hsa
gcagcauuuauuuuaugauauaaugaaauguucguucauguauauacauuuuuaaaagugcuuu

SEQ ID NO: 696775 - RNA, 64 nt, hsa
uacauguggauaucuaugaaugguaauguuuuccuucauguaagugccuauucagaguuucaga

SEQ ID NO: 696776 - RNA, 64 nt, hsa
augaggguguccuaaagauccugauguccaugacuucauguaguucaggcacagaaagaauagc

SEQ ID NO: 696777 - RNA, 64 nt, hsa
ggaccuugcugcauccugcacagcaggguucaguuucauguaucuuugucuuuuccucuagaac

SEQ ID NO: 696778 - RNA, 64 nt, hsa
uggauuuguaaaucaagcugaaacuuuuuugauguucauguacucauaugucuuguagguggua

SEQ ID NO: 696779 - RNA, 64 nt, hsa
uuuauauacacauauguacaugaauauauauauauucauguaucuuguauauaaaauauaggca

SEQ ID NO: 696780 - RNA, 64 nt, hsa
gaauguacuggguugaaugguguccucuccaaaauucauguacuuccuggagccucaguaugug

SEQ ID NO: 696781 - RNA, 64 nt, hsa
ccuucaauaaacacaaaauugguuucaaaauguuuucauguaaaaauaaauuaacuuuucugua

SEQ ID NO: 696782 - RNA, 64 nt, hsa
agauaauuccagcagaauccgucuaagaagaccuuucauguacuucccuaggacuagaugcaua

SEQ ID NO: 696783 - RNA, 64 nt, hsa
uugauagauauuacauggacuaaauuuugucaauuucauguaauuuacccuuugcaauaaaaau

SEQ ID NO: 696784 - RNA, 64 nt, hsa
cugcagcuuguccuuuugcccacauagggccuauuucauguacuguuaguuuucucuggggacu

SEQ ID NO: 696785 - RNA, 64 nt, hsa
cagagagaaggagcucaaaagauacuugaugucuuucauguaaguuuaccuggucuuuuccuau

SEQ ID NO: 696786 - RNA, 64 nt, hsa
ccucuggcucgguuuccuuucuuuggucugauacuucauguauuugaauauaguuaaaucguau

SEQ ID NO: 696787 - RNA, 64 nt, hsa
uugugaugugacuaaaagccacuuugugacucccuucauguaauccucuuuuccuccccacucc

SEQ ID NO: 696788 - RNA, 64 nt, hsa
gugugucacaucacauauugugcagcuguugguuuucauguagugcccugcgauggaaauuaga

SEQ ID NO: 696789 - RNA, 64 nt, hsa
ucauguagugcccugcgauggaaauuagauauauuucauguauuuuuccauugaagguggaguu

SEQ ID NO: 696790 - RNA, 64 nt, hsa
gcaggauuugaaacuuggagagcuguuuucucauuucauguacacuugccccaaauugucuuug

SEQ ID NO: 696791 - RNA, 64 nt, hsa
uuguaccaaggucacuuaucuaacaaaauaacccuucauguauuuuaaauuuauuugacaaguc

SEQ ID NO: 696792 - RNA, 64 nt, hsa
ucaccuauuguacaaagaaauugcgauguauauuuucauguaauuugauuuuggaauucuguca

SEQ ID NO: 696793 - RNA, 64 nt, hsa
auagcacaacaugauccggauaauauauauacuguucauguacauccacaaauacaccuuguac

SEQ ID NO: 696794 - RNA, 64 nt, hsa; identical to SEQ ID NO: 58182

SEQ ID NO: 696795 - RNA, 64 nt, hsa; identical to SEQ ID NO: 58183

SEQ ID NO: 696796 - RNA, 64 nt, hsa; identical to SEQ ID NO: 58184

SEQ ID NO: 696797 - RNA, 64 nt, hsa; identical to SEQ ID NO: 58185

SEQ ID NO: 696798 - RNA, 64 nt, hsa; identical to SEQ ID NO: 58186

SEQ ID NO: 696799 - RNA, 64 nt, hsa; identical to SEQ ID NO: 58187

SEQ ID NO: 696800 - RNA, 64 nt, hsa; identical to SEQ ID NO: 58188

SEQ ID NO: 696801 - RNA, 64 nt, hsa; identical to SEQ ID NO: 58189

SEQ ID NO: 696802 - RNA, 64 nt, hsa; identical to SEQ ID NO: 58190

SEQ ID NO: 696803 - RNA, 64 nt, hsa; identical to SEQ ID NO: 58191

SEQ ID NO: 696804 - RNA, 64 nt, hsa; identical to SEQ ID NO: 58192

SEQ ID NO: 696805 - RNA, 64 nt, hsa; identical to SEQ ID NO: 58193

SEQ ID NO: 696806 - RNA, 64 nt, hsa; identical to SEQ ID NO: 58194

SEQ ID NO: 696807 - RNA, 64 nt, hsa; identical to SEQ ID NO: 58195

SEQ ID NO: 696808 - RNA, 64 nt, hsa; identical to SEQ ID NO: 58196

SEQ ID NO: 696809 - RNA, 64 nt, hsa; identical to SEQ ID NO: 58197

SEQ ID NO: 696810 - RNA, 64 nt, hsa; identical to SEQ ID NO: 58198

SEQ ID NO: 696811 - RNA, 64 nt, hsa; identical to SEQ ID NO: 58199

SEQ ID NO: 696812 - RNA, 64 nt, hsa; identical to SEQ ID NO: 58200

SEQ ID NO: 696813 - RNA, 64 nt, hsa; identical to SEQ ID NO: 58201

SEQ ID NO: 696814 - RNA, 64 nt, hsa; identical to SEQ ID NO: 58202

SEQ ID NO: 696815 - RNA, 64 nt, hsa; identical to SEQ ID NO: 58203

SEQ ID NO: 696816 - RNA, 64 nt, hsa; identical to SEQ ID NO: 58204

SEQ ID NO: 696817 - RNA, 64 nt, hsa; identical to SEQ ID NO: 58205

SEQ ID NO: 696818 - RNA, 64 nt, hsa; identical to SEQ ID NO: 58206

SEQ ID NO: 696819 - RNA, 64 nt, hsa; identical to SEQ ID NO: 58207

SEQ ID NO: 696820 - RNA, 64 nt, hsa; identical to SEQ ID NO: 58208

SEQ ID NO: 696821 - RNA, 64 nt, hsa; identical to SEQ ID NO: 58209

SEQ ID NO: 696822 - RNA, 64 nt, hsa; identical to SEQ ID NO: 58210

SEQ ID NO: 696823 - RNA, 64 nt, hsa; identical to SEQ ID NO: 58211

SEQ ID NO: 696824 - RNA, 64 nt, hsa; identical to SEQ ID NO: 58212

SEQ ID NO: 696825 - RNA, 64 nt, hsa; identical to SEQ ID NO: 58213

SEQ ID NO: 696826 - RNA, 64 nt, hsa; identical to SEQ ID NO: 58214

SEQ ID NO: 696827 - RNA, 64 nt, hsa; identical to SEQ ID NO: 58215

SEQ ID NO: 696828 - RNA, 64 nt, hsa; identical to SEQ ID NO: 87706

SEQ ID NO: 696829 - RNA, 64 nt, hsa; identical to SEQ ID NO: 87707

SEQ ID NO: 696830 - RNA, 64 nt, hsa; identical to SEQ ID NO: 87708

SEQ ID NO: 696831 - RNA, 64 nt, hsa; identical to SEQ ID NO: 87709

SEQ ID NO: 696832 - RNA, 64 nt, hsa; identical to SEQ ID NO: 87710

SEQ ID NO: 696833 - RNA, 64 nt, hsa; identical to SEQ ID NO: 87711

SEQ ID NO: 696834 - RNA, 64 nt, hsa; identical to SEQ ID NO: 87712

SEQ ID NO: 696835 - RNA, 64 nt, hsa; identical to SEQ ID NO: 87713

SEQ ID NO: 696836 - RNA, 64 nt, hsa; identical to SEQ ID NO: 87714

SEQ ID NO: 696837 - RNA, 64 nt, hsa; identical to SEQ ID NO: 87715

SEQ ID NO: 696838 - RNA, 64 nt, hsa; identical to SEQ ID NO: 87716

SEQ ID NO: 696839 - RNA, 64 nt, hsa; identical to SEQ ID NO: 87717

SEQ ID NO: 696840 - RNA, 64 nt, hsa; identical to SEQ ID NO: 87718

SEQ ID NO: 696841 - RNA, 64 nt, hsa; identical to SEQ ID NO: 87719

SEQ ID NO: 696842 - RNA, 64 nt, hsa; identical to SEQ ID NO: 87720

SEQ ID NO: 696843 - RNA, 64 nt, hsa; identical to SEQ ID NO: 87721

SEQ ID NO: 696844 - RNA, 64 nt, hsa; identical to SEQ ID NO: 87722

SEQ ID NO: 696845 - RNA, 64 nt, hsa; identical to SEQ ID NO: 87723

SEQ ID NO: 696846 - RNA, 64 nt, hsa; identical to SEQ ID NO: 87724

SEQ ID NO: 696847 - RNA, 64 nt, hsa; identical to SEQ ID NO: 87725

SEQ ID NO: 696848 - RNA, 64 nt, hsa; identical to SEQ ID NO: 87726

SEQ ID NO: 696849 - RNA, 64 nt, hsa; identical to SEQ ID NO: 87727

SEQ ID NO: 696850 - RNA, 64 nt, hsa; identical to SEQ ID NO: 87728

SEQ ID NO: 696851 - RNA, 64 nt, hsa; identical to SEQ ID NO: 87729

SEQ ID NO: 696852 - RNA, 64 nt, hsa; identical to SEQ ID NO: 87730

SEQ ID NO: 696853 - RNA, 64 nt, hsa; identical to SEQ ID NO: 87731

SEQ ID NO: 696854 - RNA, 64 nt, hsa; identical to SEQ ID NO: 87732

SEQ ID NO: 696855 - RNA, 64 nt, hsa; identical to SEQ ID NO: 87733

SEQ ID NO: 696856 - RNA, 64 nt, hsa; identical to SEQ ID NO: 87734

SEQ ID NO: 696857 - RNA, 64 nt, hsa; identical to SEQ ID NO: 87735

SEQ ID NO: 696858 - RNA, 64 nt, hsa; identical to SEQ ID NO: 87736

SEQ ID NO: 696859 - RNA, 64 nt, hsa; identical to SEQ ID NO: 87737

SEQ ID NO: 696860 - RNA, 64 nt, hsa; identical to SEQ ID NO: 87738

SEQ ID NO: 696861 - RNA, 64 nt, hsa; identical to SEQ ID NO: 87739

SEQ ID NO: 696862 - RNA, 64 nt, hsa; identical to SEQ ID NO: 87740

SEQ ID NO: 696863 - RNA, 64 nt, hsa; identical to SEQ ID NO: 87741

SEQ ID NO: 696864 - RNA, 64 nt, hsa; identical to SEQ ID NO: 87742

SEQ ID NO: 696865 - RNA, 64 nt, hsa; identical to SEQ ID NO: 87743

SEQ ID NO: 696866 - RNA, 64 nt, hsa; identical to SEQ ID NO: 87744

SEQ ID NO: 696867 - RNA, 64 nt, hsa; identical to SEQ ID NO: 87745

SEQ ID NO: 696868 - RNA, 64 nt, hsa; identical to SEQ ID NO: 87746

SEQ ID NO: 696869 - RNA, 64 nt, hsa; identical to SEQ ID NO: 87747

SEQ ID NO: 696870 - RNA, 64 nt, hsa; identical to SEQ ID NO: 87748

SEQ ID NO: 696871 - RNA, 64 nt, hsa; identical to SEQ ID NO: 87749

SEQ ID NO: 696872 - RNA, 64 nt, hsa; identical to SEQ ID NO: 87750

SEQ ID NO: 696873 - RNA, 64 nt, hsa; identical to SEQ ID NO: 87751

SEQ ID NO: 696874 - RNA, 64 nt, hsa; identical to SEQ ID NO: 87752

SEQ ID NO: 696875 - RNA, 64 nt, hsa; identical to SEQ ID NO: 87753

SEQ ID NO: 696876 - RNA, 64 nt, hsa; identical to SEQ ID NO: 87754

SEQ ID NO: 696877 - RNA, 64 nt, hsa; identical to SEQ ID NO: 87755

SEQ ID NO: 696878 - RNA, 64 nt, hsa; identical to SEQ ID NO: 87756

SEQ ID NO: 696879 - RNA, 63 nt, hsa; identical to SEQ ID NO: 87757

SEQ ID NO: 696880 - RNA, 64 nt, hsa; identical to SEQ ID NO: 87758

SEQ ID NO: 696881 - RNA, 64 nt, hsa; identical to SEQ ID NO: 235822

SEQ ID NO: 696882 - RNA, 64 nt, hsa; identical to SEQ ID NO: 235823

SEQ ID NO: 696883 - RNA, 64 nt, hsa; identical to SEQ ID NO: 235824

SEQ ID NO: 696884 - RNA, 64 nt, hsa; identical to SEQ ID NO: 235825

SEQ ID NO: 696885 - RNA, 64 nt, hsa; identical to SEQ ID NO: 235826

SEQ ID NO: 696886 - RNA, 64 nt, hsa; identical to SEQ ID NO: 235827

SEQ ID NO: 696887 - RNA, 64 nt, hsa; identical to SEQ ID NO: 235828

SEQ ID NO: 696888 - RNA, 64 nt, hsa; identical to SEQ ID NO: 235829

SEQ ID NO: 696889 - RNA, 64 nt, hsa; identical to SEQ ID NO: 235830

SEQ ID NO: 696890 - RNA, 64 nt, hsa; identical to SEQ ID NO: 235831

SEQ ID NO: 696891 - RNA, 64 nt, hsa; identical to SEQ ID NO: 235832

SEQ ID NO: 696892 - RNA, 64 nt, hsa; identical to SEQ ID NO: 235833

SEQ ID NO: 696893 - RNA, 64 nt, hsa; identical to SEQ ID NO: 235834

SEQ ID NO: 696894 - RNA, 64 nt, hsa; identical to SEQ ID NO: 235835

SEQ ID NO: 696895 - RNA, 64 nt, hsa; identical to SEQ ID NO: 235836

SEQ ID NO: 696896 - RNA, 64 nt, hsa; identical to SEQ ID NO: 235837

SEQ ID NO: 696897 - RNA, 64 nt, hsa; identical to SEQ ID NO: 235838

SEQ ID NO: 696898 - RNA, 64 nt, hsa; identical to SEQ ID NO: 235839

SEQ ID NO: 696899 - RNA, 64 nt, hsa; identical to SEQ ID NO: 235840

SEQ ID NO: 696900 - RNA, 64 nt, hsa; identical to SEQ ID NO: 235841

SEQ ID NO: 696901 - RNA, 64 nt, hsa; identical to SEQ ID NO: 235842

SEQ ID NO: 696902 - RNA, 64 nt, hsa; identical to SEQ ID NO: 235843

SEQ ID NO: 696903 - RNA, 64 nt, hsa; identical to SEQ ID NO: 235844

SEQ ID NO: 696904 - RNA, 64 nt, hsa; identical to SEQ ID NO: 235845

SEQ ID NO: 696905 - RNA, 55 nt, hsa; identical to SEQ ID NO: 235846

SEQ ID NO: 696906 - RNA, 64 nt, hsa; identical to SEQ ID NO: 235847

SEQ ID NO: 696907 - RNA, 64 nt, hsa; identical to SEQ ID NO: 235848

SEQ ID NO: 696908 - RNA, 64 nt, hsa; identical to SEQ ID NO: 235849

SEQ ID NO: 696909 - RNA, 64 nt, hsa; identical to SEQ ID NO: 235850

SEQ ID NO: 696910 - RNA, 64 nt, hsa; identical to SEQ ID NO: 235851

SEQ ID NO: 696911 - RNA, 64 nt, hsa; identical to SEQ ID NO: 235852

SEQ ID NO: 696912 - RNA, 64 nt, hsa; identical to SEQ ID NO: 235853

SEQ ID NO: 696913 - RNA, 64 nt, hsa; identical to SEQ ID NO: 235854

SEQ ID NO: 696914 - RNA, 64 nt, hsa; identical to SEQ ID NO: 235855

SEQ ID NO: 696915 - RNA, 64 nt, hsa; identical to SEQ ID NO: 235856

SEQ ID NO: 696916 - RNA, 64 nt, hsa; identical to SEQ ID NO: 235857

SEQ ID NO: 696917 - RNA, 64 nt, hsa; identical to SEQ ID NO: 235858

SEQ ID NO: 696918 - RNA, 64 nt, hsa; identical to SEQ ID NO: 235859

SEQ ID NO: 696919 - RNA, 64 nt, hsa; identical to SEQ ID NO: 235860

SEQ ID NO: 696920 - RNA, 64 nt, hsa; identical to SEQ ID NO: 235861

SEQ ID NO: 696921 - RNA, 64 nt, hsa; identical to SEQ ID NO: 235862

SEQ ID NO: 696922 - RNA, 64 nt, hsa; identical to SEQ ID NO: 235863

SEQ ID NO: 696923 - RNA, 64 nt, hsa; identical to SEQ ID NO: 235864

SEQ ID NO: 696924 - RNA, 64 nt, hsa; identical to SEQ ID NO: 235865

SEQ ID NO: 696925 - RNA, 64 nt, hsa; identical to SEQ ID NO: 235866

SEQ ID NO: 696926 - RNA, 64 nt, hsa; identical to SEQ ID NO: 235867

SEQ ID NO: 696927 - RNA, 64 nt, hsa; identical to SEQ ID NO: 235868

SEQ ID NO: 696928 - RNA, 64 nt, hsa; identical to SEQ ID NO: 235869

SEQ ID NO: 696929 - RNA, 64 nt, hsa; identical to SEQ ID NO: 235870

SEQ ID NO: 696930 - RNA, 64 nt, hsa; identical to SEQ ID NO: 235871

SEQ ID NO: 696931 - RNA, 64 nt, hsa; identical to SEQ ID NO: 235872

SEQ ID NO: 696932 - RNA, 64 nt, hsa; identical to SEQ ID NO: 235873

SEQ ID NO: 696933 - RNA, 64 nt, hsa; identical to SEQ ID NO: 235874

SEQ ID NO: 696934 - RNA, 64 nt, hsa; identical to SEQ ID NO: 235875

SEQ ID NO: 696935 - RNA, 64 nt, hsa; identical to SEQ ID NO: 235876

SEQ ID NO: 696936 - RNA, 64 nt, hsa; identical to SEQ ID NO: 235877

SEQ ID NO: 696937 - RNA, 64 nt, hsa; identical to SEQ ID NO: 235878

SEQ ID NO: 696938 - RNA, 64 nt, hsa; identical to SEQ ID NO: 235879

SEQ ID NO: 696939 - RNA, 64 nt, hsa; identical to SEQ ID NO: 235880

SEQ ID NO: 696940 - RNA, 64 nt, hsa; identical to SEQ ID NO: 235881

SEQ ID NO: 696941 - RNA, 64 nt, hsa; identical to SEQ ID NO: 235882

SEQ ID NO: 696942 - RNA, 64 nt, hsa; identical to SEQ ID NO: 235883

SEQ ID NO: 696943 - RNA, 64 nt, hsa; identical to SEQ ID NO: 235884

SEQ ID NO: 696944 - RNA, 64 nt, hsa; identical to SEQ ID NO: 235885

SEQ ID NO: 696945 - RNA, 64 nt, hsa; identical to SEQ ID NO: 235886

SEQ ID NO: 696946 - RNA, 61 nt, hsa
cauauggggggccgugcacaccccaaacccugagcuucacacuuaaacucauggggagggc

SEQ ID NO: 696947 - RNA, 61 nt, hsa
cugcccugucccggguuugcgcgcugcuacagagcuucacgcucuccgcuccaccccuuag

SEQ ID NO: 696948 - RNA, 61 nt, hsa
acaaggucaucaugcuccacagaagcuuccugagcuucaaggugaucaagguauggcggcc

SEQ ID NO: 696949 - RNA, 61 nt, hsa
ucugcaacccgguuuaccaguuuauuaacuugagcuucacugucaucuuuuuccacuuuga

SEQ ID NO: 696950 - RNA, 61 nt, hsa
auggcaugauuuaaggcuucuuuucaccugagagcuucaguucuucugcagaauggcugca

SEQ ID NO: 696951 - RNA, 61 nt, hsa
ucagucuuccacacacaaaaaauaccucacagagcuucaccaaaucacagauucaggagga

SEQ ID NO: 696952 - RNA, 61 nt, hsa
ccaagcuggccuugaaccccuugccucaagugagcuucaaccuuagccuccugaguagcca

SEQ ID NO: 696953 - RNA, 61 nt, hsa
ugcaucuaacuguucaucucuguuauaaauggagcuucagcccucugggucagagacugac

SEQ ID NO: 696954 - RNA, 61 nt, hsa
acuccaaagauguaacucuagccucuugccugagcuucagacucgcgucccacugcccaca

SEQ ID NO: 696955 - RNA, 61 nt, hsa
aggccugaagggauaagauugugucucuauagagcuucaaagcauacaggucaauuaagaa

SEQ ID NO: 696956 - RNA, 64 nt, hsa
uauguugaaugcuuaaagcaaggcauaccuguccuagcaggaucugcccacaccucggccguac

SEQ ID NO: 696957 - RNA, 64 nt, hsa
gguuguuuuuuuuuuuuuuucuccauucugaaaauagcaggacauuuaccucuuaaauaaacuu

SEQ ID NO: 696958 - RNA, 64 nt, hsa
gacaaaggcuucccagagccaccaaaaaccuucuuagcaggacagcugugagaggcaucagaac

SEQ ID NO: 696959 - RNA, 64 nt, hsa
augcaccuugaucucacccucacuccaaggcacauagcaggaucacucccuagcuucucugagc

SEQ ID NO: 696960 - RNA, 64 nt, hsa
guuacuguguggauacaggaaggcucugaguggcuagcaggacccucccuuggcuucgcccucc

SEQ ID NO: 696961 - RNA, 64 nt, hsa
gguuugaggguccaagggacaaggaggagaagccuagcaggauuucagaugcaggagagagacc

SEQ ID NO: 696962 - RNA, 64 nt, hsa; identical to SEQ ID NO: 154299

SEQ ID NO: 696963 - RNA, 64 nt, hsa; identical to SEQ ID NO: 154300

SEQ ID NO: 696964 - RNA, 64 nt, hsa; identical to SEQ ID NO: 154301

SEQ ID NO: 696965 - RNA, 64 nt, hsa; identical to SEQ ID NO: 154302

SEQ ID NO: 696966 - RNA, 64 nt, hsa; identical to SEQ ID NO: 154303

SEQ ID NO: 696967 - RNA, 64 nt, hsa; identical to SEQ ID NO: 154304

SEQ ID NO: 696968 - RNA, 64 nt, hsa; identical to SEQ ID NO: 154305

SEQ ID NO: 696969 - RNA, 64 nt, hsa; identical to SEQ ID NO: 154306

SEQ ID NO: 696970 - RNA, 64 nt, hsa; identical to SEQ ID NO: 154307

SEQ ID NO: 696971 - RNA, 64 nt, hsa; identical to SEQ ID NO: 154308

SEQ ID NO: 696972 - RNA, 64 nt, hsa; identical to SEQ ID NO: 154309

SEQ ID NO: 696973 - RNA, 64 nt, hsa; identical to SEQ ID NO: 154310

SEQ ID NO: 696974 - RNA, 64 nt, hsa; identical to SEQ ID NO: 154311

SEQ ID NO: 696975 - RNA, 64 nt, hsa; identical to SEQ ID NO: 154312

SEQ ID NO: 696976 - RNA, 64 nt, hsa; identical to SEQ ID NO: 154313

SEQ ID NO: 696977 - RNA, 54 nt, hsa; identical to SEQ ID NO: 154314

SEQ ID NO: 696978 - RNA, 64 nt, hsa; identical to SEQ ID NO: 154315

SEQ ID NO: 696979 - RNA, 64 nt, hsa; identical to SEQ ID NO: 154316

SEQ ID NO: 696980 - RNA, 64 nt, hsa; identical to SEQ ID NO: 154317

SEQ ID NO: 696981 - RNA, 64 nt, hsa; identical to SEQ ID NO: 154318

SEQ ID NO: 696982 - RNA, 64 nt, hsa; identical to SEQ ID NO: 154319

SEQ ID NO: 696983 - RNA, 64 nt, hsa; identical to SEQ ID NO: 154320

SEQ ID NO: 696984 - RNA, 64 nt, hsa; identical to SEQ ID NO: 154321

SEQ ID NO: 696985 - RNA, 64 nt, hsa; identical to SEQ ID NO: 154322

SEQ ID NO: 696986 - RNA, 64 nt, hsa; identical to SEQ ID NO: 154323

SEQ ID NO: 696987 - RNA, 64 nt, hsa; identical to SEQ ID NO: 154324

SEQ ID NO: 696988 - RNA, 64 nt, hsa; identical to SEQ ID NO: 154325

SEQ ID NO: 696989 - RNA, 64 nt, hsa; identical to SEQ ID NO: 154326

SEQ ID NO: 696990 - RNA, 64 nt, hsa; identical to SEQ ID NO: 154327

SEQ ID NO: 696991 - RNA, 64 nt, hsa; identical to SEQ ID NO: 154328

SEQ ID NO: 696992 - RNA, 64 nt, hsa; identical to SEQ ID NO: 154329

SEQ ID NO: 696993 - RNA, 64 nt, hsa; identical to SEQ ID NO: 154330

SEQ ID NO: 696994 - RNA, 64 nt, hsa; identical to SEQ ID NO: 154331

SEQ ID NO: 696995 - RNA, 64 nt, hsa; identical to SEQ ID NO: 154332

SEQ ID NO: 696996 - RNA, 64 nt, hsa; identical to SEQ ID NO: 154333

SEQ ID NO: 696997 - RNA, 64 nt, hsa; identical to SEQ ID NO: 154334

SEQ ID NO: 696998 - RNA, 64 nt, hsa; identical to SEQ ID NO: 154335

SEQ ID NO: 696999 - RNA, 64 nt, hsa; identical to SEQ ID NO: 154336

SEQ ID NO: 697000 - RNA, 64 nt, hsa; identical to SEQ ID NO: 154337

SEQ ID NO: 697001 - RNA, 64 nt, hsa; identical to SEQ ID NO: 154338

SEQ ID NO: 697002 - RNA, 64 nt, hsa; identical to SEQ ID NO: 154339

SEQ ID NO: 697003 - RNA, 64 nt, hsa; identical to SEQ ID NO: 154340

SEQ ID NO: 697004 - RNA, 64 nt, hsa; identical to SEQ ID NO: 154341

SEQ ID NO: 697005 - RNA, 64 nt, hsa; identical to SEQ ID NO: 154342

SEQ ID NO: 697006 - RNA, 64 nt, hsa; identical to SEQ ID NO: 154343

SEQ ID NO: 697007 - RNA, 64 nt, hsa; identical to SEQ ID NO: 154344

SEQ ID NO: 697008 - RNA, 64 nt, hsa; identical to SEQ ID NO: 154345

SEQ ID NO: 697009 - RNA, 55 nt, hsa; identical to SEQ ID NO: 154346

SEQ ID NO: 697010 - RNA, 64 nt, hsa; identical to SEQ ID NO: 154347

SEQ ID NO: 697011 - RNA, 64 nt, hsa; identical to SEQ ID NO: 154348

SEQ ID NO: 697012 - RNA, 64 nt, hsa; identical to SEQ ID NO: 154349

SEQ ID NO: 697013 - RNA, 64 nt, hsa; identical to SEQ ID NO: 154350

SEQ ID NO: 697014 - RNA, 64 nt, hsa; identical to SEQ ID NO: 154351

SEQ ID NO: 697015 - RNA, 64 nt, hsa; identical to SEQ ID NO: 154352

SEQ ID NO: 697016 - RNA, 64 nt, hsa; identical to SEQ ID NO: 154353

SEQ ID NO: 697017 - RNA, 64 nt, hsa; identical to SEQ ID NO: 154354

SEQ ID NO: 697018 - RNA, 64 nt, hsa; identical to SEQ ID NO: 154355

SEQ ID NO: 697019 - RNA, 64 nt, hsa; identical to SEQ ID NO: 154356

SEQ ID NO: 697020 - RNA, 64 nt, hsa
uaaguuuucggcucugaagaacugacacuagcuagauuuguauucagagugugagagcaagcuc

SEQ ID NO: 697021 - RNA, 64 nt, hsa
uaagcuaccuaauccucugaaaacuguuuucucugauuuguauuuagauuccuccccccauuau

SEQ ID NO: 697022 - RNA, 64 nt, hsa
cacuauuuacugaaaaguucauccuuuccccagugauuuguaacacugccucuuucauaaauua

SEQ ID NO: 697023 - RNA, 64 nt, hsa
ucaaacaaacccaagagcauugaaauuuugauuggauuuguauugaauuuauagauuaaucugg

SEQ ID NO: 697024 - RNA, 64 nt, hsa
gacauuugaguuauacucugugcugccugagcaagauuuguagaaucauauaauuaccuuuuca

SEQ ID NO: 697025 - RNA, 64 nt, hsa
uagcauaguaugcuacuauugcuacuucuggugugauuuguaauguuucuuaaucauuggacau

SEQ ID NO: 697026 - RNA, 64 nt, hsa
cucuguagcuuuucagaagaagcaauuuaccuuggauuuguaaaucaagcugaaacuuuuuuga

SEQ ID NO: 697027 - RNA, 64 nt, hsa
aaauacugauuucuuccauggauuauuuuuauaugauuuguacaaauuuuuucugaaauuuaaa

SEQ ID NO: 697028 - RNA, 64 nt, hsa
uauugugaauucuuuuucacugcaagaguaacaggauuuguagccuugugcuucuugcuaagag

SEQ ID NO: 697029 - RNA, 64 nt, hsa
cugaacugaucccaggugaacgguuuauugccuagauuuguacucagaggaauuuuuuuuguuu

SEQ ID NO: 697030 - RNA, 64 nt, hsa
gaagagcccauuaucaacuuuuaaaagugaauuugauuuguacccaccaggagaaauacaguug

SEQ ID NO: 697031 - RNA, 64 nt, hsa
aaguauuuugguauuuuaaggucucaugauuagggauuuguagccucagguuugaaucagucac

SEQ ID NO: 697032 - RNA, 64 nt, hsa
uauguacuuggauuguuucuuuuugaaaagugaggauuuguauuuucucaucuauucuuuuugg

SEQ ID NO: 697033 - RNA, 64 nt, hsa
uaugcauuguauauugcaauuuauuacugucagagauuuguagacaguuucuuauuuucauauu

SEQ ID NO: 697034 - RNA, 64 nt, hsa
uccaagccugcuguuuugaacccacagcaguggagauuuguauucuuauuuacaguuguguacu

SEQ ID NO: 697035 - RNA, 64 nt, hsa
guuuuguguaauaauuauuuguaaauauuauuuagauuuguauuuagacaugauuuauaucuaa

SEQ ID NO: 697036 - RNA, 64 nt, hsa
caggauuuuucauuaggagagaccugucguuaaggauuuguagguauaauugcuuagccuccau

SEQ ID NO: 697037 - RNA, 64 nt, hsa
cauauuucaaacacaacuagauggggcucugaaagauuuguaucucugugcuugaacuugaaug

SEQ ID NO: 697038 - RNA, 64 nt, hsa
aguaccuaauuuguucaauguauaacauucucaggauuuguaacacuuaaaugaucagacagaa

SEQ ID NO: 697039 - RNA, 64 nt, hsa
uauaaugucagagacucauguuuaauacauaggugauuuguaccucagaguauuuuuuaaagga

SEQ ID NO: 697040 - RNA, 64 nt, hsa
aaaaggugcuacgguagugaugaaauuauaaguagauuuguaguuugucccauuuauuauuuua

SEQ ID NO: 697041 - RNA, 64 nt, hsa
uucugacacuugugguauaguauuaguggaaagugauuuguaauaugauuuuauauccaccuac

SEQ ID NO: 697042 - RNA, 64 nt, hsa
cuuucucguggguaaauauacccacagguucuaugauuuguagcucuagguuucuugaugauca

SEQ ID NO: 697043 - RNA, 64 nt, hsa; identical to SEQ ID NO: 48360

SEQ ID NO: 697044 - RNA, 64 nt, hsa; identical to SEQ ID NO: 48361

SEQ ID NO: 697045 - RNA, 64 nt, hsa; identical to SEQ ID NO: 48362

SEQ ID NO: 697046 - RNA, 64 nt, hsa; identical to SEQ ID NO: 48363

SEQ ID NO: 697047 - RNA, 64 nt, hsa; identical to SEQ ID NO: 48364

SEQ ID NO: 697048 - RNA, 64 nt, hsa; identical to SEQ ID NO: 48365

SEQ ID NO: 697049 - RNA, 64 nt, hsa; identical to SEQ ID NO: 48366

SEQ ID NO: 697050 - RNA, 64 nt, hsa; identical to SEQ ID NO: 48367

SEQ ID NO: 697051 - RNA, 64 nt, hsa; identical to SEQ ID NO: 48368

SEQ ID NO: 697052 - RNA, 64 nt, hsa; identical to SEQ ID NO: 48369

SEQ ID NO: 697053 - RNA, 64 nt, hsa; identical to SEQ ID NO: 48370

SEQ ID NO: 697054 - RNA, 64 nt, hsa; identical to SEQ ID NO: 48371

SEQ ID NO: 697055 - RNA, 64 nt, hsa; identical to SEQ ID NO: 48372

SEQ ID NO: 697056 - RNA, 64 nt, hsa; identical to SEQ ID NO: 48373

SEQ ID NO: 697057 - RNA, 64 nt, hsa; identical to SEQ ID NO: 48374

SEQ ID NO: 697058 - RNA, 64 nt, hsa; identical to SEQ ID NO: 48375

SEQ ID NO: 697059 - RNA, 64 nt, hsa; identical to SEQ ID NO: 48376

SEQ ID NO: 697060 - RNA, 64 nt, hsa; identical to SEQ ID NO: 48377

SEQ ID NO: 697061 - RNA, 64 nt, hsa; identical to SEQ ID NO: 48378

SEQ ID NO: 697062 - RNA, 64 nt, hsa; identical to SEQ ID NO: 48379

SEQ ID NO: 697063 - RNA, 64 nt, hsa; identical to SEQ ID NO: 48380

SEQ ID NO: 697064 - RNA, 64 nt, hsa; identical to SEQ ID NO: 48381

SEQ ID NO: 697065 - RNA, 64 nt, hsa; identical to SEQ ID NO: 48382

SEQ ID NO: 697066 - RNA, 64 nt, hsa; identical to SEQ ID NO: 48383

SEQ ID NO: 697067 - RNA, 64 nt, hsa; identical to SEQ ID NO: 48384

SEQ ID NO: 697068 - RNA, 64 nt, hsa; identical to SEQ ID NO: 48385

SEQ ID NO: 697069 - RNA, 64 nt, hsa; identical to SEQ ID NO: 48386

SEQ ID NO: 697070 - RNA, 64 nt, hsa; identical to SEQ ID NO: 48387

SEQ ID NO: 697071 - RNA, 64 nt, hsa; identical to SEQ ID NO: 48388

SEQ ID NO: 697072 - RNA, 64 nt, hsa; identical to SEQ ID NO: 48389

SEQ ID NO: 697073 - RNA, 64 nt, hsa; identical to SEQ ID NO: 48390

SEQ ID NO: 697074 - RNA, 64 nt, hsa; identical to SEQ ID NO: 48391

SEQ ID NO: 697075 - RNA, 64 nt, hsa; identical to SEQ ID NO: 48392

SEQ ID NO: 697076 - RNA, 64 nt, hsa; identical to SEQ ID NO: 48393

SEQ ID NO: 697077 - RNA, 64 nt, hsa; identical to SEQ ID NO: 48394

SEQ ID NO: 697078 - RNA, 64 nt, hsa; identical to SEQ ID NO: 48395

SEQ ID NO: 697079 - RNA, 64 nt, hsa; identical to SEQ ID NO: 48396

SEQ ID NO: 697080 - RNA, 64 nt, hsa; identical to SEQ ID NO: 48397

SEQ ID NO: 697081 - RNA, 64 nt, hsa; identical to SEQ ID NO: 48398

SEQ ID NO: 697082 - RNA, 64 nt, hsa; identical to SEQ ID NO: 48399

SEQ ID NO: 697083 - RNA, 64 nt, hsa; identical to SEQ ID NO: 48400

SEQ ID NO: 697084 - RNA, 64 nt, hsa; identical to SEQ ID NO: 48401

SEQ ID NO: 697085 - RNA, 64 nt, hsa; identical to SEQ ID NO: 48402

SEQ ID NO: 697086 - RNA, 64 nt, hsa; identical to SEQ ID NO: 48403

SEQ ID NO: 697087 - RNA, 64 nt, hsa; identical to SEQ ID NO: 48404

SEQ ID NO: 697088 - RNA, 64 nt, hsa; identical to SEQ ID NO: 48405

SEQ ID NO: 697089 - RNA, 64 nt, hsa; identical to SEQ ID NO: 48406

SEQ ID NO: 697090 - RNA, 64 nt, hsa; identical to SEQ ID NO: 48407

SEQ ID NO: 697091 - RNA, 64 nt, hsa; identical to SEQ ID NO: 48408

SEQ ID NO: 697092 - RNA, 64 nt, hsa; identical to SEQ ID NO: 48409

SEQ ID NO: 697093 - RNA, 64 nt, hsa; identical to SEQ ID NO: 48410

SEQ ID NO: 697094 - RNA, 64 nt, hsa; identical to SEQ ID NO: 48411

SEQ ID NO: 697095 - RNA, 64 nt, hsa; identical to SEQ ID NO: 48412

SEQ ID NO: 697096 - RNA, 64 nt, hsa; identical to SEQ ID NO: 48413

SEQ ID NO: 697097 - RNA, 64 nt, hsa; identical to SEQ ID NO: 48414

SEQ ID NO: 697098 - RNA, 64 nt, hsa; identical to SEQ ID NO: 48415

SEQ ID NO: 697099 - RNA, 64 nt, hsa; identical to SEQ ID NO: 48416

SEQ ID NO: 697100 - RNA, 64 nt, hsa; identical to SEQ ID NO: 48417

SEQ ID NO: 697101 - RNA, 64 nt, hsa; identical to SEQ ID NO: 48418

SEQ ID NO: 697102 - RNA, 64 nt, hsa; identical to SEQ ID NO: 48419

SEQ ID NO: 697103 - RNA, 64 nt, hsa; identical to SEQ ID NO: 48420

SEQ ID NO: 697104 - RNA, 64 nt, hsa; identical to SEQ ID NO: 48421

SEQ ID NO: 697105 - RNA, 64 nt, hsa; identical to SEQ ID NO: 48422

SEQ ID NO: 697106 - RNA, 64 nt, hsa; identical to SEQ ID NO: 48423

SEQ ID NO: 697107 - RNA, 64 nt, hsa; identical to SEQ ID NO: 48424

SEQ ID NO: 697108 - RNA, 64 nt, hsa; identical to SEQ ID NO: 48425

SEQ ID NO: 697109 - RNA, 64 nt, hsa; identical to SEQ ID NO: 48426

SEQ ID NO: 697110 - RNA, 64 nt, hsa; identical to SEQ ID NO: 48427

SEQ ID NO: 697111 - RNA, 64 nt, hsa; identical to SEQ ID NO: 48428

SEQ ID NO: 697112 - RNA, 64 nt, hsa; identical to SEQ ID NO: 48429

SEQ ID NO: 697113 - RNA, 64 nt, hsa; identical to SEQ ID NO: 48430

SEQ ID NO: 697114 - RNA, 64 nt, hsa; identical to SEQ ID NO: 48431

SEQ ID NO: 697115 - RNA, 64 nt, hsa; identical to SEQ ID NO: 48432

SEQ ID NO: 697116 - RNA, 64 nt, hsa; identical to SEQ ID NO: 48433

SEQ ID NO: 697117 - RNA, 64 nt, hsa; identical to SEQ ID NO: 48434

SEQ ID NO: 697118 - RNA, 64 nt, hsa; identical to SEQ ID NO: 48435

SEQ ID NO: 697119 - RNA, 64 nt, hsa; identical to SEQ ID NO: 48436

SEQ ID NO: 697120 - RNA, 64 nt, hsa; identical to SEQ ID NO: 48437

SEQ ID NO: 697121 - RNA, 64 nt, hsa; identical to SEQ ID NO: 48438

SEQ ID NO: 697122 - RNA, 64 nt, hsa; identical to SEQ ID NO: 48439

SEQ ID NO: 697123 - RNA, 64 nt, hsa; identical to SEQ ID NO: 48440

SEQ ID NO: 697124 - RNA, 64 nt, hsa; identical to SEQ ID NO: 48441

SEQ ID NO: 697125 - RNA, 64 nt, hsa; identical to SEQ ID NO: 48442

SEQ ID NO: 697126 - RNA, 64 nt, hsa; identical to SEQ ID NO: 48443

SEQ ID NO: 697127 - RNA, 64 nt, hsa; identical to SEQ ID NO: 48444

SEQ ID NO: 697128 - RNA, 64 nt, hsa; identical to SEQ ID NO: 48445

SEQ ID NO: 697129 - RNA, 64 nt, hsa; identical to SEQ ID NO: 48446

SEQ ID NO: 697130 - RNA, 64 nt, hsa; identical to SEQ ID NO: 48447

SEQ ID NO: 697131 - RNA, 64 nt, hsa; identical to SEQ ID NO: 48448

SEQ ID NO: 697132 - RNA, 64 nt, hsa; identical to SEQ ID NO: 48449

SEQ ID NO: 697133 - RNA, 64 nt, hsa; identical to SEQ ID NO: 48450

SEQ ID NO: 697134 - RNA, 64 nt, hsa; identical to SEQ ID NO: 48451

SEQ ID NO: 697135 - RNA, 64 nt, hsa; identical to SEQ ID NO: 48452

SEQ ID NO: 697136 - RNA, 64 nt, hsa; identical to SEQ ID NO: 48453

SEQ ID NO: 697137 - RNA, 64 nt, hsa; identical to SEQ ID NO: 48454

SEQ ID NO: 697138 - RNA, 64 nt, hsa; identical to SEQ ID NO: 48455

SEQ ID NO: 697139 - RNA, 64 nt, hsa; identical to SEQ ID NO: 48456

SEQ ID NO: 697140 - RNA, 64 nt, hsa; identical to SEQ ID NO: 48457

SEQ ID NO: 697141 - RNA, 64 nt, hsa; identical to SEQ ID NO: 48458

SEQ ID NO: 697142 - RNA, 64 nt, hsa; identical to SEQ ID NO: 48459

SEQ ID NO: 697143 - RNA, 64 nt, hsa; identical to SEQ ID NO: 48460

SEQ ID NO: 697144 - RNA, 64 nt, hsa; identical to SEQ ID NO: 48461

SEQ ID NO: 697145 - RNA, 64 nt, hsa; identical to SEQ ID NO: 48462

SEQ ID NO: 697146 - RNA, 64 nt, hsa; identical to SEQ ID NO: 48463

SEQ ID NO: 697147 - RNA, 64 nt, hsa; identical to SEQ ID NO: 48464

SEQ ID NO: 697148 - RNA, 64 nt, hsa; identical to SEQ ID NO: 48465

SEQ ID NO: 697149 - RNA, 64 nt, hsa; identical to SEQ ID NO: 48466

SEQ ID NO: 697150 - RNA, 64 nt, hsa; identical to SEQ ID NO: 48467

SEQ ID NO: 697151 - RNA, 64 nt, hsa; identical to SEQ ID NO: 48468

SEQ ID NO: 697152 - RNA, 64 nt, hsa; identical to SEQ ID NO: 48469

SEQ ID NO: 697153 - RNA, 64 nt, hsa; identical to SEQ ID NO: 48470

SEQ ID NO: 697154 - RNA, 64 nt, hsa; identical to SEQ ID NO: 48471

SEQ ID NO: 697155 - RNA, 64 nt, hsa; identical to SEQ ID NO: 48472

SEQ ID NO: 697156 - RNA, 64 nt, hsa; identical to SEQ ID NO: 48473

SEQ ID NO: 697157 - RNA, 64 nt, hsa; identical to SEQ ID NO: 48474

SEQ ID NO: 697158 - RNA, 64 nt, hsa; identical to SEQ ID NO: 48475

SEQ ID NO: 697159 - RNA, 64 nt, hsa; identical to SEQ ID NO: 48476

SEQ ID NO: 697160 - RNA, 64 nt, hsa; identical to SEQ ID NO: 48477

SEQ ID NO: 697161 - RNA, 64 nt, hsa; identical to SEQ ID NO: 48478

SEQ ID NO: 697162 - RNA, 64 nt, hsa; identical to SEQ ID NO: 48479

SEQ ID NO: 697163 - RNA, 64 nt, hsa; identical to SEQ ID NO: 48480

SEQ ID NO: 697164 - RNA, 64 nt, hsa; identical to SEQ ID NO: 48481

SEQ ID NO: 697165 - RNA, 64 nt, hsa; identical to SEQ ID NO: 48482

SEQ ID NO: 697166 - RNA, 64 nt, hsa; identical to SEQ ID NO: 48483

SEQ ID NO: 697167 - RNA, 64 nt, hsa; identical to SEQ ID NO: 48484

SEQ ID NO: 697168 - RNA, 64 nt, hsa; identical to SEQ ID NO: 48485

SEQ ID NO: 697169 - RNA, 64 nt, hsa; identical to SEQ ID NO: 48486

SEQ ID NO: 697170 - RNA, 64 nt, hsa; identical to SEQ ID NO: 48487

SEQ ID NO: 697171 - RNA, 64 nt, hsa; identical to SEQ ID NO: 48488

SEQ ID NO: 697172 - RNA, 64 nt, hsa; identical to SEQ ID NO: 48489

SEQ ID NO: 697173 - RNA, 64 nt, hsa; identical to SEQ ID NO: 48490

SEQ ID NO: 697174 - RNA, 64 nt, hsa; identical to SEQ ID NO: 48491

SEQ ID NO: 697175 - RNA, 64 nt, hsa; identical to SEQ ID NO: 48492

SEQ ID NO: 697176 - RNA, 64 nt, hsa; identical to SEQ ID NO: 48493

SEQ ID NO: 697177 - RNA, 64 nt, hsa; identical to SEQ ID NO: 48494

SEQ ID NO: 697178 - RNA, 64 nt, hsa; identical to SEQ ID NO: 48495

SEQ ID NO: 697179 - RNA, 64 nt, hsa; identical to SEQ ID NO: 48496

SEQ ID NO: 697180 - RNA, 64 nt, hsa; identical to SEQ ID NO: 48497

SEQ ID NO: 697181 - RNA, 64 nt, hsa; identical to SEQ ID NO: 48498

SEQ ID NO: 697182 - RNA, 64 nt, hsa; identical to SEQ ID NO: 277422

SEQ ID NO: 697183 - RNA, 64 nt, hsa; identical to SEQ ID NO: 277423

SEQ ID NO: 697184 - RNA, 64 nt, hsa; identical to SEQ ID NO: 277424

SEQ ID NO: 697185 - RNA, 64 nt, hsa; identical to SEQ ID NO: 277425

SEQ ID NO: 697186 - RNA, 64 nt, hsa; identical to SEQ ID NO: 277426

SEQ ID NO: 697187 - RNA, 64 nt, hsa; identical to SEQ ID NO: 277427

SEQ ID NO: 697188 - RNA, 64 nt, hsa; identical to SEQ ID NO: 277428

SEQ ID NO: 697189 - RNA, 64 nt, hsa; identical to SEQ ID NO: 277429

SEQ ID NO: 697190 - RNA, 64 nt, hsa; identical to SEQ ID NO: 277430

SEQ ID NO: 697191 - RNA, 64 nt, hsa; identical to SEQ ID NO: 277431

SEQ ID NO: 697192 - RNA, 64 nt, hsa; identical to SEQ ID NO: 277432

SEQ ID NO: 697193 - RNA, 64 nt, hsa; identical to SEQ ID NO: 277433

SEQ ID NO: 697194 - RNA, 64 nt, hsa; identical to SEQ ID NO: 277434

SEQ ID NO: 697195 - RNA, 64 nt, hsa; identical to SEQ ID NO: 277435

SEQ ID NO: 697196 - RNA, 64 nt, hsa; identical to SEQ ID NO: 277436

SEQ ID NO: 697197 - RNA, 64 nt, hsa; identical to SEQ ID NO: 277437

SEQ ID NO: 697198 - RNA, 64 nt, hsa; identical to SEQ ID NO: 277438

SEQ ID NO: 697199 - RNA, 64 nt, hsa; identical to SEQ ID NO: 277439

SEQ ID NO: 697200 - RNA, 64 nt, hsa; identical to SEQ ID NO: 277440

SEQ ID NO: 697201 - RNA, 64 nt, hsa; identical to SEQ ID NO: 277441

SEQ ID NO: 697202 - RNA, 64 nt, hsa; identical to SEQ ID NO: 277442

SEQ ID NO: 697203 - RNA, 64 nt, hsa; identical to SEQ ID NO: 277443

SEQ ID NO: 697204 - RNA, 64 nt, hsa; identical to SEQ ID NO: 277444

SEQ ID NO: 697205 - RNA, 64 nt, hsa; identical to SEQ ID NO: 277445

SEQ ID NO: 697206 - RNA, 64 nt, hsa; identical to SEQ ID NO: 277446

SEQ ID NO: 697207 - RNA, 64 nt, hsa; identical to SEQ ID NO: 277447

SEQ ID NO: 697208 - RNA, 64 nt, hsa; identical to SEQ ID NO: 277448

SEQ ID NO: 697209 - RNA, 64 nt, hsa; identical to SEQ ID NO: 45025

SEQ ID NO: 697210 - RNA, 64 nt, hsa; identical to SEQ ID NO: 45026

SEQ ID NO: 697211 - RNA, 64 nt, hsa; identical to SEQ ID NO: 45027

SEQ ID NO: 697212 - RNA, 64 nt, hsa; identical to SEQ ID NO: 45028

SEQ ID NO: 697213 - RNA, 64 nt, hsa; identical to SEQ ID NO: 45029

SEQ ID NO: 697214 - RNA, 64 nt, hsa; identical to SEQ ID NO: 45030

SEQ ID NO: 697215 - RNA, 64 nt, hsa; identical to SEQ ID NO: 45031

SEQ ID NO: 697216 - RNA, 64 nt, hsa; identical to SEQ ID NO: 45032

SEQ ID NO: 697217 - RNA, 64 nt, hsa; identical to SEQ ID NO: 45033

SEQ ID NO: 697218 - RNA, 64 nt, hsa; identical to SEQ ID NO: 45034

SEQ ID NO: 697219 - RNA, 64 nt, hsa; identical to SEQ ID NO: 45035

SEQ ID NO: 697220 - RNA, 64 nt, hsa; identical to SEQ ID NO: 45036

SEQ ID NO: 697221 - RNA, 64 nt, hsa; identical to SEQ ID NO: 45037

SEQ ID NO: 697222 - RNA, 64 nt, hsa; identical to SEQ ID NO: 45038

SEQ ID NO: 697223 - RNA, 64 nt, hsa; identical to SEQ ID NO: 45039

SEQ ID NO: 697224 - RNA, 64 nt, hsa; identical to SEQ ID NO: 45040

SEQ ID NO: 697225 - RNA, 64 nt, hsa; identical to SEQ ID NO: 45041

SEQ ID NO: 697226 - RNA, 64 nt, hsa; identical to SEQ ID NO: 45042

SEQ ID NO: 697227 - RNA, 64 nt, hsa; identical to SEQ ID NO: 45043

SEQ ID NO: 697228 - RNA, 64 nt, hsa; identical to SEQ ID NO: 45044

SEQ ID NO: 697229 - RNA, 64 nt, hsa; identical to SEQ ID NO: 45045

SEQ ID NO: 697230 - RNA, 64 nt, hsa; identical to SEQ ID NO: 45046

SEQ ID NO: 697231 - RNA, 64 nt, hsa; identical to SEQ ID NO: 45047

SEQ ID NO: 697232 - RNA, 64 nt, hsa; identical to SEQ ID NO: 45048

SEQ ID NO: 697233 - RNA, 64 nt, hsa; identical to SEQ ID NO: 45049

SEQ ID NO: 697234 - RNA, 64 nt, hsa; identical to SEQ ID NO: 45050

SEQ ID NO: 697235 - RNA, 64 nt, hsa; identical to SEQ ID NO: 45051

SEQ ID NO: 697236 - RNA, 64 nt, hsa; identical to SEQ ID NO: 45052

SEQ ID NO: 697237 - RNA, 64 nt, hsa; identical to SEQ ID NO: 45053

SEQ ID NO: 697238 - RNA, 64 nt, hsa; identical to SEQ ID NO: 45054

SEQ ID NO: 697239 - RNA, 64 nt, hsa; identical to SEQ ID NO: 45055

SEQ ID NO: 697240 - RNA, 64 nt, hsa; identical to SEQ ID NO: 45056

SEQ ID NO: 697241 - RNA, 64 nt, hsa; identical to SEQ ID NO: 45057

SEQ ID NO: 697242 - RNA, 64 nt, hsa; identical to SEQ ID NO: 45058

SEQ ID NO: 697243 - RNA, 64 nt, hsa; identical to SEQ ID NO: 45059

SEQ ID NO: 697244 - RNA, 64 nt, hsa; identical to SEQ ID NO: 45060

SEQ ID NO: 697245 - RNA, 64 nt, hsa; identical to SEQ ID NO: 45061

SEQ ID NO: 697246 - RNA, 64 nt, hsa; identical to SEQ ID NO: 45062

SEQ ID NO: 697247 - RNA, 64 nt, hsa; identical to SEQ ID NO: 45063

SEQ ID NO: 697248 - RNA, 64 nt, hsa; identical to SEQ ID NO: 45064

SEQ ID NO: 697249 - RNA, 64 nt, hsa; identical to SEQ ID NO: 45065

SEQ ID NO: 697250 - RNA, 64 nt, hsa; identical to SEQ ID NO: 45066

SEQ ID NO: 697251 - RNA, 64 nt, hsa
auauacaauauacaaacauaugcccauuccugugauagcauacaaauucaaacauacagaaaca

SEQ ID NO: 697252 - RNA, 64 nt, hsa
uaugaggaguguguauguaccugugguauaccaaauagcauacauguacacacaaaaaugugug

SEQ ID NO: 697253 - RNA, 64 nt, hsa
uaaugaguagugcuguucauauuacuuuaguucuauagcauacuugcaucuuuaacaugcuauc

SEQ ID NO: 697254 - RNA, 64 nt, hsa
uagcccagaacaguuuaaugguacuuacugagcuauagcauagcugcuuaguuguuuuugagau

SEQ ID NO: 697255 - RNA, 64 nt, hsa
gcucugcccacaaacaggcgucccuuucccucuggauaacaacaaaagcaagccgggaggcugg

SEQ ID NO: 697256 - RNA, 64 nt, hsa
ccuucuauuacaugcaaaaaaucauuguuuuuaagauaacaaaaguagggaauaaacaagcuga

SEQ ID NO: 697257 - RNA, 64 nt, hsa
aaauauacccaugugaaauaauaauuggauuauggauaacaagagagugaaagccaaagcacuu

SEQ ID NO: 697258 - RNA, 64 nt, hsa
ccuuucccaguuagguuugcuuuuugaccaaaaagauaacaaauaccagguauggcaaguugug

SEQ ID NO: 697259 - RNA, 64 nt, hsa; identical to SEQ ID NO: 379229

SEQ ID NO: 697260 - RNA, 64 nt, hsa; identical to SEQ ID NO: 379230

SEQ ID NO: 697261 - RNA, 64 nt, hsa; identical to SEQ ID NO: 379231

SEQ ID NO: 697262 - RNA, 64 nt, hsa; identical to SEQ ID NO: 379232

SEQ ID NO: 697263 - RNA, 64 nt, hsa; identical to SEQ ID NO: 379233

SEQ ID NO: 697264 - RNA, 64 nt, hsa; identical to SEQ ID NO: 379234

SEQ ID NO: 697265 - RNA, 64 nt, hsa; identical to SEQ ID NO: 379235

SEQ ID NO: 697266 - RNA, 64 nt, hsa; identical to SEQ ID NO: 379236

SEQ ID NO: 697267 - RNA, 64 nt, hsa; identical to SEQ ID NO: 379237

SEQ ID NO: 697268 - RNA, 64 nt, hsa; identical to SEQ ID NO: 379238

SEQ ID NO: 697269 - RNA, 64 nt, hsa; identical to SEQ ID NO: 379239

SEQ ID NO: 697270 - RNA, 64 nt, hsa; identical to SEQ ID NO: 379240

SEQ ID NO: 697271 - RNA, 64 nt, hsa; identical to SEQ ID NO: 379241

SEQ ID NO: 697272 - RNA, 64 nt, hsa; identical to SEQ ID NO: 379242

SEQ ID NO: 697273 - RNA, 64 nt, hsa; identical to SEQ ID NO: 379243

SEQ ID NO: 697274 - RNA, 64 nt, hsa; identical to SEQ ID NO: 379244

SEQ ID NO: 697275 - RNA, 64 nt, hsa; identical to SEQ ID NO: 379245

SEQ ID NO: 697276 - RNA, 64 nt, hsa; identical to SEQ ID NO: 379246

SEQ ID NO: 697277 - RNA, 64 nt, hsa; identical to SEQ ID NO: 379247

SEQ ID NO: 697278 - RNA, 64 nt, hsa; identical to SEQ ID NO: 379248

SEQ ID NO: 697279 - RNA, 64 nt, hsa; identical to SEQ ID NO: 379249

SEQ ID NO: 697280 - RNA, 64 nt, hsa; identical to SEQ ID NO: 379250

SEQ ID NO: 697281 - RNA, 64 nt, hsa; identical to SEQ ID NO: 379251

SEQ ID NO: 697282 - RNA, 64 nt, hsa; identical to SEQ ID NO: 379252

SEQ ID NO: 697283 - RNA, 64 nt, hsa; identical to SEQ ID NO: 379253

SEQ ID NO: 697284 - RNA, 64 nt, hsa; identical to SEQ ID NO: 379254

SEQ ID NO: 697285 - RNA, 64 nt, hsa; identical to SEQ ID NO: 379255

SEQ ID NO: 697286 - RNA, 64 nt, hsa; identical to SEQ ID NO: 379256

SEQ ID NO: 697287 - RNA, 64 nt, hsa; identical to SEQ ID NO: 379257

SEQ ID NO: 697288 - RNA, 64 nt, hsa; identical to SEQ ID NO: 379258

SEQ ID NO: 697289 - RNA, 64 nt, hsa; identical to SEQ ID NO: 379259

SEQ ID NO: 697290 - RNA, 59 nt, hsa
ugugaagaggaggaaaagugaaucacggagagagaaaggaaaggauagaaucacaggcu

SEQ ID NO: 697291 - RNA, 59 nt, hsa
ccagcuauacuuacuugcacaguggauuggagagaaaggauucuccagugugcacacuc

SEQ ID NO: 697292 - RNA, 59 nt, hsa
ccgagugacacaugagagcuguaugaauugagagaaaaggcaacaaguagcauucuuca

SEQ ID NO: 697293 - RNA, 59 nt, hsa
ugcucuauuauacccugauagagaugggggagagaaaggaauguuuuugauggugguuu

SEQ ID NO: 697294 - RNA, 59 nt, hsa
uguguguguguguguguguguggcagagagagagaaagagagagagagagagaaauucu

SEQ ID NO: 697295 - RNA, 59 nt, hsa
uguggcagagagagagaaagagagagagagagagaaauucuguuaaaaucuauucugug

SEQ ID NO: 697296 - RNA, 59 nt, hsa
cgcagaccuccccagccccuagcccaggagagagaaagccaggcagguagccaggggga

SEQ ID NO: 697297 - RNA, 59 nt, hsa
gcuggaggugggagcaggagauugagaaggagagaaagugggugagaugcuggagaaga

SEQ ID NO: 697298 - RNA, 59 nt, hsa
cccuccccuccccugcugcaggggcucuggagagaaacaauaaagagauucacacacaa

SEQ ID NO: 697299 - RNA, 59 nt, hsa
gucagcuuuucgucuaguaacuuaagugagagagaaagggcagcgccacagaagccccu

SEQ ID NO: 697300 - RNA, 59 nt, hsa
accggaguagggggugggagagggaagaggagagaaaauacagggacuuugaaccuagg

SEQ ID NO: 697301 - RNA, 59 nt, hsa
uuauuuguaugcuucaaaaaaaaaaaaaagagagaaacaaaaaagugugacauuacaga

SEQ ID NO: 697302 - RNA, 59 nt, hsa
aguuccguucugagagaaaaagagagagagagagaaaaagaccaugcugcauacauucu

SEQ ID NO: 697303 - RNA, 59 nt, hsa
aaacauguugcuguuuccaguuccguucugagagaaaaagagagagagagagaaaaaga

SEQ ID NO: 697304 - RNA, 59 nt, hsa
aacauagacuggaggagguaauccauggagagagaaaaagaagagggcucaggacaagg

SEQ ID NO: 697305 - RNA, 59 nt, hsa
gggguuuugccagggaaguaaaaggaguugagagaaagaugggucaguucagaagacau

SEQ ID NO: 697306 - RNA, 59 nt, hsa
acuuuuugcacuucuguauauagucaaaagagagaaaccuguauaauaguaagaucuua

SEQ ID NO: 697307 - RNA, 59 nt, hsa
acugcauguuuaaaacuucaacaaaaaaagagagaaagaacuauacuaagaacauauau

SEQ ID NO: 697308 - RNA, 59 nt, hsa
caagaaaagagaaaauauuaaaacgaggagagagaaaaauaauauuaacacaaaaaaau

SEQ ID NO: 697309 - RNA, 59 nt, hsa
agcaaacaaaaaaaucgaaagacaaacgggagagaaaaagaggaagggaacuuauuucu

SEQ ID NO: 697310 - RNA, 59 nt, hsa
ccuugauaaacauaagagaauucauaccggagagaaacuguacaaaugugaagaauaug

SEQ ID NO: 697311 - RNA, 59 nt, hsa
ucaaugcuuaauaaauauaauucaugcuggagagaaacuucacaugugaaccguguggc

SEQ ID NO: 697312 - RNA, 59 nt, hsa
cuuuguuaaacauaagagaauuuauaccagagagaaacccuacacauguaaagaaugug

SEQ ID NO: 697313 - RNA, 59 nt, hsa
ccacagccaggaggggccuuucccaccuggagagaaacuuccagaccagccccucauac

SEQ ID NO: 697314 - RNA, 59 nt, hsa
ccacagccaagaggggccuuucucaccuggagagaaauuuccagaccauccccucucac

SEQ ID NO: 697315 - RNA, 59 nt, hsa
ccacagccaagagaagccuuuccagccuggagagaaacuuccagaccagcccucucacu

SEQ ID NO: 697316 - RNA, 59 nt, hsa
ccacagccaggagaggccuuucccaccuggagagaaacuuccagaccagccccucauac

SEQ ID NO: 697317 - RNA, 59 nt, hsa
ccacagccaagaggggccuuucucaccuggagagaaacuuccagaccagccccucacac

SEQ ID NO: 697318 - RNA, 59 nt, hsa
ccaccgccaggagaggccuuucccaccgggagagaaacuuccagaccagccccucacac

SEQ ID NO: 697319 - RNA, 59 nt, hsa
ccacagccaggagaggccuuucccaccgggagagaaacuuccagaccagcccucucacu

SEQ ID NO: 697320 - RNA, 59 nt, hsa
ccacagccaggagagaccuuuucugccuggagagaaacuuucagaccagccccacacac

SEQ ID NO: 697321 - RNA, 59 nt, hsa
ccacagccaggagaggccuuucccaccuggagagaaacuuccagaccagccccucucac

SEQ ID NO: 697322 - RNA, 59 nt, hsa
uuuaaugaugaaaaguuacacauuuuuuggagagaaaagucuuagcugaagguaaauca

SEQ ID NO: 697323 - RNA, 59 nt, hsa
aaaugcauaagguuaguacaagaucaguagagagaaagucaaagauuacagaagugcug

SEQ ID NO: 697324 - RNA, 59 nt, hsa
uuuaagccuucaaauuacauuaucaacaugagagaaaucaccaacaaagaagauguuca

SEQ ID NO: 697325 - RNA, 59 nt, hsa
aaagcauacaucaugauuauggcaaagaggagagaaagaaauuuauuuuacauugacau

SEQ ID NO: 697326 - RNA, 59 nt, hsa
gagagcacaaagauaacgcaggagagagagagagaaagaaugagaaagaaaaggaaugc

SEQ ID NO: 697327 - RNA, 59 nt, hsa
aaugacagagaguucuggugagauacccagagagaaaaagagagagcagggugggguaa

SEQ ID NO: 697328 - RNA, 59 nt, hsa
caggaaauucuguuuauguucuugcagcagagagaaauaaaacuccuugaaaccagcuc

SEQ ID NO: 697329 - RNA, 59 nt, hsa
cacgaacaaaccaaggaaaucuaaguuucgagagaaaggagggcaacuucuacucuuca

SEQ ID NO: 697330 - RNA, 59 nt, hsa
cuucuccaaacgauuagucuaaauuuucagagagaaauagauaaaacacgccacagccu

SEQ ID NO: 697331 - RNA, 59 nt, hsa
ugcaucuagggcggagaggcugcacuugugagagaaaauacuauuucaagucauauucu

SEQ ID NO: 697332 - RNA, 59 nt, hsa
gcuuacuacacauaggaaaauucauacuggagagaaacuacaaaugugaagaauguguu

SEQ ID NO: 697333 - RNA, 59 nt, hsa
cauaccuuacuauacagaaauucauacuggagagaaagccuacaauugugaagaaugug

SEQ ID NO: 697334 - RNA, 59 nt, hsa
cuugcuacauauaagacaguuuauacuuugagagaaacccugcaaaugugaauaaugug

SEQ ID NO: 697335 - RNA, 59 nt, hsa
acuuacugaacauaagaaaauuuacacuagagagaaagccuacaaaugugaagaaugug

SEQ ID NO: 697336 - RNA, 59 nt, hsa
ccuuauuacacauaagauaauucauagcggagagaaaccccacaaaugugaagaaugug

SEQ ID NO: 697337 - RNA, 59 nt, hsa
ucuuacugcacauaagaucauucauacuggagagaaaccuuacaaaugugaggaaugug

SEQ ID NO: 697338 - RNA, 59 nt, hsa
ccuuacuaaacacaagaagauucauacuagagagaaacccuacaaaugugaagaaugug

SEQ ID NO: 697339 - RNA, 59 nt, hsa
cuuuacuaugcauaagaaaauucaaacuggagagaaacucuacaaaugugaagaaugug

SEQ ID NO: 697340 - RNA, 59 nt, hsa
aaaacuucuuacaccuaaaauucaugcaggagagaaacaccacaaaugugaaaaauuug

SEQ ID NO: 697341 - RNA, 59 nt, hsa
ccuuucugcacauaauauaauucauacuggagagaaaccccacaaauaugaagaaugug

SEQ ID NO: 697342 - RNA, 59 nt, hsa
ucuuauucagcaucaaagaauucacacaggagagaaagcacaugaauguaaugaaugug

SEQ ID NO: 697343 - RNA, 59 nt, hsa
cauugcucagcaucagauaauucacaccagagagaaacccucugaaugugacgaaugaa

SEQ ID NO: 697344 - RNA, 59 nt, hsa
uucaggcuuuacccaacaucgaaauaauggagagaaaauuguugauuauuuguuuauga

SEQ ID NO: 697345 - RNA, 59 nt, hsa
acucauugaacacaagaaaauucauacuggagagaaaccuuacaagugugaagaaugug

SEQ ID NO: 697346 - RNA, 59 nt, hsa
ccuuauuggacauaagagaauucauacuggagagaaacccuacaaaugugaagaaugug

SEQ ID NO: 697347 - RNA, 59 nt, hsa
uuuccccauuuuucucuuucuuguagaaggagagaaaccaugcucucuagcaacauuga

SEQ ID NO: 697348 - RNA, 59 nt, hsa
agagggagggagagagaaagacgaagggagagagaaagcaguuuccaaggauauguuuc

SEQ ID NO: 697349 - RNA, 59 nt, hsa
gaagagaaaugggaaagaagagggagggagagagaaagacgaagggagagagaaagcag

SEQ ID NO: 697350 - RNA, 59 nt, hsa
agugccauccuuuaaucauagacuuugaggagagaaagcauaaaaauauagcauauaau

SEQ ID NO: 697351 - RNA, 59 nt, hsa
guaacagcguaauuaaacacaucauggaggagagaaacuuaaaauuaaaauaguauuuu

SEQ ID NO: 697352 - RNA, 59 nt, hsa
aaacacgaaagaaaagucaggaagguagagagagaaaaagggagggaaggagaaagaau

SEQ ID NO: 697353 - RNA, 59 nt, hsa
ggaggaaagucauuccugccuaauccaucgagagaaagaggcuuacgaaaaacuuugcc

SEQ ID NO: 697354 - RNA, 59 nt, hsa
acagagagaaggagaaagagggagggagagagagaaagagagagaaagagagagagaga

SEQ ID NO: 697355 - RNA, 59 nt, hsa
ggagaaagagggagggagagagagaaagagagagaaagagagagagagagagagagaga

SEQ ID NO: 697356 - RNA, 59 nt, hsa
agagagagaaagagagagagagagagagagagagaaagcugaacgugcacucugacaag

SEQ ID NO: 697357 - RNA, 59 nt, hsa
cucuaucccuucuccuguccaggggcccagagagaaacacaccuaccccuggccuugcc

SEQ ID NO: 697358 - RNA, 59 nt, hsa
uuuccguggcuggggguagacuuaauaaagagagaaauucaagaacugcuugcuuuauu

SEQ ID NO: 697359 - RNA, 59 nt, hsa
uaacugccuaaaauguucuccuuagaugugagagaaagagaaaucagaaaaauuaauuc

SEQ ID NO: 697360 - RNA, 59 nt, hsa
uaaaauaagaaagcccuaaaauacuauuggagagaaaaaauuaacuagguugcuacuuu

SEQ ID NO: 697361 - RNA, 59 nt, hsa
agagagguuggaaggggugguuggaaggggagagaaacugagauggcccucugugacuc

SEQ ID NO: 697362 - RNA, 59 nt, hsa
gcucugggacgugugggcccuggggagaggagagaaagggcucccaccugccagucccu

SEQ ID NO: 697363 - RNA, 59 nt, hsa
ggguaccuaucccagccacguuucagagggagagaaaugcuacaguugauccucaucug

SEQ ID NO: 697364 - RNA, 59 nt, hsa
uggcuggcuuuccuuagcagcaagaacuugagagaaaaacacaucugucucugcaaugc

SEQ ID NO: 697365 - RNA, 59 nt, hsa
gggauauauuaagauauuuuuguacauaagagagaaagagagagaaaaauuuauagaag

SEQ ID NO: 697366 - RNA, 59 nt, hsa
aagauauuuuuguacauaagagagaaagagagagaaaaauuuauagaaguuuuguacaa

SEQ ID NO: 697367 - RNA, 59 nt, hsa
aagaauaaaaacuaccaaagugauauacagagagaaaaaaagacuuagagaagaggaag

SEQ ID NO: 697368 - RNA, 59 nt, hsa
cuuucugacacuuuugaggaugcaugugggagagaaacccuauugaggcagugacuguu

SEQ ID NO: 697369 - RNA, 59 nt, hsa
aaauagcugcccuuaaagaguuguuagcagagagaaaaauaacagugaaugugcuccug

SEQ ID NO: 697370 - RNA, 59 nt, hsa
uacacucagcaauaauuagaaaaaaaggagagagaaaagugauuuaaacaggguggauu

SEQ ID NO: 697371 - RNA, 59 nt, hsa
gugcuuuuuauuguaauucaacagcuauagagagaaagauaacuuauuguguguuugau

SEQ ID NO: 697372 - RNA, 59 nt, hsa
uguggcagagagugugcaugugagaaagcgagagaaagaggaacugaaggacgcgguua

SEQ ID NO: 697373 - RNA, 59 nt, hsa
aguaagugaaagggugccugcgcugacgugagagaaaggaaucuguaaacaguggaaac

SEQ ID NO: 697374 - RNA, 59 nt, hsa
uuaccuaggagcauguaagagaaagaagggagagaaaagguugcaucugcaggaugccu

SEQ ID NO: 697375 - RNA, 59 nt, hsa
agaaucagauuaucucuuuuuuucuaaaggagagaaagacuuagaacauacacagaucc

SEQ ID NO: 697376 - RNA, 59 nt, hsa
uauagacuugagaauguuuuucucuaaaugagagaaagacuuagaauguacacagaucc

SEQ ID NO: 697377 - RNA, 59 nt, hsa
ugguuuggcaugcgguauggaaauucuaagagagaaaguuuuaaggcaaugaaucacag

SEQ ID NO: 697378 - RNA, 59 nt, hsa
ugccuuaagccaccuccccaggacuuacggagagaaauaaggggauguaaccagcaaug

SEQ ID NO: 697379 - RNA, 59 nt, hsa
acaucaccccaaggacaacggcagaaguagagagaaacuaccuaccucacuucaaauua

SEQ ID NO: 697380 - RNA, 59 nt, hsa
cucggcuacuuuuguaaacuucagauuuggagagaaacacgaaagucugaauccugacc

SEQ ID NO: 697381 - RNA, 59 nt, hsa
agugagagagagaaagagagugagagagagagagaaagagagagagagaugcuguugaa

SEQ ID NO: 697382 - RNA, 59 nt, hsa
accaguuuccagagagccagagagugagagagagaaagagagugagagagagagagaaa

SEQ ID NO: 697383 - RNA, 59 nt, hsa
aggagagagagacagaggaggcagagagggagagaaacagaggagacagagagggagag

SEQ ID NO: 697384 - RNA, 59 nt, hsa
gaggagggagagagauggagaggaggggagagagaaagagagguggggagaggggagag

SEQ ID NO: 697385 - RNA, 59 nt, hsa
auuucaaauacaugaaaaaucuuacacuggagagaaacccuaugaguguaagcaaugug

SEQ ID NO: 697386 - RNA, 59 nt, hsa
ucuucgauuucauaaaaggacacacacuggagagaaacccugugaauguaagaaaugua

SEQ ID NO: 697387 - RNA, 59 nt, hsa
ccuuugaauacaugcaagaacacacaauggagagaaacccuaugaauguaaagaaugca

SEQ ID NO: 697388 - RNA, 59 nt, hsa
uuuucaauaucaugaaaggacucacaugggagagaaacccuaugaguguaugccaagug

SEQ ID NO: 697389 - RNA, 59 nt, hsa
auuucaaacacaugaaaaaauucacacuggagagaaacccuauaaaugcaagcaaugug

SEQ ID NO: 697390 - RNA, 59 nt, hsa
ccuuucaauuuaugaaaggacacacacuggagagaaacccuaugaauguaagaaaugug

SEQ ID NO: 697391 - RNA, 59 nt, hsa
ucguuugaauacaugcaaaacacacacuggagagaaaccuaugaauguaaggaaugcaa

SEQ ID NO: 697392 - RNA, 59 nt, hsa
auuucgaagacaugaaaaaacucacacuggagagaaacccuauaaaugcaugccaugug

SEQ ID NO: 697393 - RNA, 59 nt, hsa
cuuucaguaucaugaaaggacucacacuggagagaaacccuaugaguguaagcaaugug

SEQ ID NO: 697394 - RNA, 59 nt, hsa
caccuucgaaggcaugguaggacucacuggagagaaacccuaugaguguaaggaaugug

SEQ ID NO: 697395 - RNA, 59 nt, hsa
cuuuugguaccaugaaaggacucacacuggagagaaacccuaugaguguaagcaaugug

SEQ ID NO: 697396 - RNA, 59 nt, hsa
ccuucgaauccaugguagaacucacacuggagagaaacccuaugaguguaaggaaugug

SEQ ID NO: 697397 - RNA, 59 nt, hsa
auuucaaauaccugaaaaaucuuacacuggagagaaacccuaugaguguaagcaaugug

SEQ ID NO: 697398 - RNA, 59 nt, hsa
uuuucgauaacaugaaaggacucacacuggagagaaacccuaugaguguaagcaaugug

SEQ ID NO: 697399 - RNA, 59 nt, hsa
aaaacacaaagcacaggucaggauccucugagagaaaaucaacauugcaccacguaggg

SEQ ID NO: 697400 - RNA, 59 nt, hsa
gggcaacaggagauguggggacguguuaggagagaaaaaaaaaaaaacaaaaauauaua

SEQ ID NO: 697401 - RNA, 59 nt, hsa
accaacacaagaucaaaaaggaaaaggacgagagaaaaauuauuuuuaagauaauuaaa

SEQ ID NO: 697402 - RNA, 59 nt, hsa
cugaccgugcugaacagacccccccacacgagagaaaauaaaggagcaauaaagucacg

SEQ ID NO: 697403 - RNA, 59 nt, hsa
ccuuaauacacauaagauaauuaaugcuggagagaaacccuacaaaugugaagaaugug

SEQ ID NO: 697404 - RNA, 59 nt, hsa
ccuuacuaaauauaagauaauucauauuggagagaaauucuacagaugugaagaaugug

SEQ ID NO: 697405 - RNA, 59 nt, hsa
cauuaguaaacauaagauaauucauacuggagagaaaaccuacaaaugugaggaaugug

SEQ ID NO: 697406 - RNA, 59 nt, hsa
ccuuacuacacauuagauaauucaugcuggagagaaacccuacaaaugugaaaaaugug

SEQ ID NO: 697407 - RNA, 59 nt, hsa
ucaacuccuaguaaacauaauuaaugauggagagaaaccauacaacugugaagaaugug

SEQ ID NO: 697408 - RNA, 59 nt, hsa
aacuuuauugaacaaaauaauucauacaggagagaaacccuacaaaugugaagaaugug

SEQ ID NO: 697409 - RNA, 59 nt, hsa
uuuuacuaaacauaagaaaauucauacuggagagaaacccuaugauugugaaaaauaug

SEQ ID NO: 697410 - RNA, 59 nt, hsa
ccugcuucaacaucacaguauucauacuggagagaaaccuuacgaauguauuaaaugug

SEQ ID NO: 697411 - RNA, 59 nt, hsa
ucuuacugcccaucaaagaguacauaauggagagaaacccaauagugugguaagugugg

SEQ ID NO: 697412 - RNA, 59 nt, hsa
ucucauuacacaucagaaaauucacacuggagagaaaccuuaugaaugcagugaaugug

SEQ ID NO: 697413 - RNA, 59 nt, hsa
ccucacugaacaugagaaaauucauacuggagagaaaccuuaucauuguaaucaaugug

SEQ ID NO: 697414 - RNA, 59 nt, hsa
ucuucuugagcaugaaaaaauucauacuggagagaaaccauucaaauguaaugaaugug

SEQ ID NO: 697415 - RNA, 59 nt, hsa
ggacagagugagacccugucugaaagaaagagagaaagaaagaaagaaagagagagaaa

SEQ ID NO: 697416 - RNA, 59 nt, hsa
aaagaaagagagaaagaaagaaagaaagagagagaaagaaagaaagaaagaaagggaaa

SEQ ID NO: 697417 - RNA, 59 nt, hsa
ggaaggaaaaagaaagagaaagagagagagagagaaagaaaaagaaagaaaaguaagaa

SEQ ID NO: 697418 - RNA, 59 nt, hsa
ccuugcaugucaucauagacuucauacuggagagaaaccuuacaaaugugaagcaugug

SEQ ID NO: 697419 - RNA, 59 nt, hsa
ccuuaaaagacauaggagaauucauacuggagagaaaccuuacaaguguaaugagugug

SEQ ID NO: 697420 - RNA, 59 nt, hsa
ccuugcaguucaucagugaacucauacuggagagaaaccuuacaaaugucaugacugug

SEQ ID NO: 697421 - RNA, 59 nt, hsa
cuaugcaaaacauaggagaauucaugcaggagagaaaugucacaagugugaugaguguu

SEQ ID NO: 697422 - RNA, 59 nt, hsa
ccucauuagacaucagagaaucccuacuggagagaaaucuuacaaaugucaucagugug

SEQ ID NO: 697423 - RNA, 59 nt, hsa
uuggagcacugagcaccauuuggaagcuugagagaaaccaaaauuaaagagagaaagag

SEQ ID NO: 697424 - RNA, 59 nt, hsa
uuggaagcuugagagaaaccaaaauuaaagagagaaagagagagcgugcacgcuccugc

SEQ ID NO: 697425 - RNA, 59 nt, hsa
accccagugucacagggcgagcuguucuggagagaaaaccaucugucguggcugagcgg

SEQ ID NO: 697426 - RNA, 59 nt, hsa
ggucuggugauggcagggauggggggagagagagaaaauccacaaauuccaaugucaca

SEQ ID NO: 697427 - RNA, 59 nt, hsa
cagaaacccgagaaagagagagacagagagagagaaaaaaaaucacccaccaccccccc

SEQ ID NO: 697428 - RNA, 59 nt, hsa
ccuuaauguguguaugugaacucacauuggagagaaacccugcaauuuaaaugguaugg

SEQ ID NO: 697429 - RNA, 59 nt, hsa
ccuuaccaaacacaucagaaaucucacuggagagaaacuguaugaauguagagaaucug

SEQ ID NO: 697430 - RNA, 59 nt, hsa
cuugagaaauaaagggacagaguacaaaagagagaaauuuuaaagcuggguguccgggg

SEQ ID NO: 697431 - RNA, 59 nt, hsa
uuccucaccccaccugugaacuccuaccagagagaaaccuuuuguauguaaagaauuug

SEQ ID NO: 697432 - RNA, 59 nt, hsa
cuuucgagugcacaugagaaugcacacuggagagaaaccuuauaaauguaaggauugug

SEQ ID NO: 697433 - RNA, 59 nt, hsa
uauucauauacaugaacgaauucauacuggagagaaacccuaugaauguaaagaaugug

SEQ ID NO: 697434 - RNA, 59 nt, hsa
uuuccagauacaugaaagaacccacacuggagagaaaccuuaugaauguaaacagugug

SEQ ID NO: 697435 - RNA, 59 nt, hsa
agcucaaagacaugaaaggacucauacuggagagaaacccuacaaauguaaggaaugug

SEQ ID NO: 697436 - RNA, 59 nt, hsa
ugcucaaagacaugaaaagacucauacuggagagaaacccuacaaaugcaaggaaugug

SEQ ID NO: 697437 - RNA, 59 nt, hsa
ugcucaaaaacaugaaaaggcucauacuggagagaaacccuacaaauguaaggaaugug

SEQ ID NO: 697438 - RNA, 59 nt, hsa
ccuucuacaacaugaaagaauucacacucgagagaaaccuuaugaagguaaacaaugug

SEQ ID NO: 697439 - RNA, 59 nt, hsa
uugucuaagacaugaaaaaacucacacuggagagaaacucuguacauguaaacaaugug

SEQ ID NO: 697440 - RNA, 59 nt, hsa
auuucguaugcaugaaagaacucacucuggagagaaacuauaugaauguaagcaguguu

SEQ ID NO: 697441 - RNA, 59 nt, hsa
cuuuuaaagacaccugagaauauauacuggagagaaacuauaaagaaaauucuauaucc

SEQ ID NO: 697442 - RNA, 59 nt, hsa
cuuuuggauguaugagaguacuuacgcuggagagaaauucaaggaauguaaacggugug

SEQ ID NO: 697443 - RNA, 59 nt, hsa
ucuuacuaaacauaaaaaaacuuaaacuggagagaaacuacaaagcuggaagacaucac

SEQ ID NO: 697444 - RNA, 59 nt, hsa
ccuuaugaaacaaaagauaauucauacuagagagaaacccuacaaauguaaagaaugug

SEQ ID NO: 697445 - RNA, 59 nt, hsa
uuuauuaaaacacaagauaauucauacuggagagaaauccuacaaaugugauaaaugug

SEQ ID NO: 697446 - RNA, 59 nt, hsa
gcuuacuacauauaagacaacucauacuggagagaaaccaugcaugugugaagaaugug

SEQ ID NO: 697447 - RNA, 59 nt, hsa
ccuuguggaacauaagagaauucauacuggagagaaacccuacaaaugcgaagaaugug

SEQ ID NO: 697448 - RNA, 59 nt, hsa
cuuuauuacacauaagaaaauucaugcuggagagaaacacuacaaacgugaagaaugug

SEQ ID NO: 697449 - RNA, 59 nt, hsa
gucuaguaaacauaagaaaauucauacuggagagaaaaucuacaaaggugaagaaugug

SEQ ID NO: 697450 - RNA, 59 nt, hsa
cuaugcaaaacauaggagaauuuauacaggagagaaaccucacaagugugaugauugug

SEQ ID NO: 697451 - RNA, 59 nt, hsa
uauugcaggucaucggugaacucauacuggagagaaaccuuacaaaugucaugacugug

SEQ ID NO: 697452 - RNA, 59 nt, hsa
ccuggaacaacauacuggacuucacacuggagagaaaccuuacaaguguaaugagugug

SEQ ID NO: 697453 - RNA, 59 nt, hsa
accuuaaagacauaggagaauuuauacuggagagaaagcuuacaaauguaagguuucug

SEQ ID NO: 697454 - RNA, 59 nt, hsa
cuaugcaaaacauaggagaauucauacaggagagaaaccucacaugugugaugauugug

SEQ ID NO: 697455 - RNA, 59 nt, hsa
cauugcaguucauugacacacucauacuggagagaaaccuuacaaaugucaugacugug

SEQ ID NO: 697456 - RNA, 59 nt, hsa
cuaugcaaaacauaggaggauucauacaggagagaaacucacaagugugaugauugugg

SEQ ID NO: 697457 - RNA, 59 nt, hsa
uauugcuauucaucaucgaacucaugcuggagagaaaccuuauaaaugucaugauugug

SEQ ID NO: 697458 - RNA, 59 nt, hsa
ccuggcacaccauacuagaauucacacuggagagaaaccuuacaagugcaaugagugug

SEQ ID NO: 697459 - RNA, 59 nt, hsa
ccuuguaauucaaaaggcaauucguauuggagagaaacccuacaaguguaaugaaugug

SEQ ID NO: 697460 - RNA, 59 nt, hsa
ccuggcaaaacauauuagaauucaaacuggagagaaaccuuacaaaugugaugagugug

SEQ ID NO: 697461 - RNA, 59 nt, hsa
ccuuguaagucacaaagccauucauacuggagagaaacuuuacaaguguaaugaaugug

SEQ ID NO: 697462 - RNA, 59 nt, hsa
ccuuguauaccaucauagacuucauaguggagagaaaccuuaaaaguguaaugagugug

SEQ ID NO: 697463 - RNA, 59 nt, hsa
cuaugcaaaacauaggaggauucauacaggagagaaaccucacaagugugaugauugug

SEQ ID NO: 697464 - RNA, 59 nt, hsa
ccuugcauuucacuggugaacucaugcuggagagaaaccuuauaaaugucaugauugag

SEQ ID NO: 697465 - RNA, 59 nt, hsa
cguggcaccccauacuagaauucacacuggagagaaaccuuacaagugcaaugagugug

SEQ ID NO: 697466 - RNA, 59 nt, hsa
ucaaaauucacaccuuguaauucauaguggagagaaaccuuacaagcacaaugaaugug

SEQ ID NO: 697467 - RNA, 59 nt, hsa
ucuggcaaaacauacuagaauucacacuggagagaaacucauuauaaguguaaugagug

SEQ ID NO: 697468 - RNA, 59 nt, hsa
cuuugcacaucaccauagacuucauacuggagagaaaccuuacaaaugggaggaaugug

SEQ ID NO: 697469 - RNA, 59 nt, hsa
cccuguaagucauaaggcaauucauacuggagagaaaccuuacaagcauaaugaaugug

SEQ ID NO: 697470 - RNA, 59 nt, hsa
uuuuuuaaacaaaugaugcugagaauaaggagagaaaugaauguagagagagguagaga

SEQ ID NO: 697471 - RNA, 59 nt, hsa
ggagagaaaugaauguagagagagguagagagagaaauaugaacucuaacaaaggacug

SEQ ID NO: 697472 - RNA, 59 nt, hsa
agaccugccagaagauuaaaaaaaagaaugagagaaaagcccaguuaguggugugcaaa

SEQ ID NO: 697473 - RNA, 59 nt, hsa
ucuuagaaucucuuaugaaaaaaugaucagagagaaaagugggguuuuguuuccccacc

SEQ ID NO: 697474 - RNA, 59 nt, hsa
cugagcgagucucuagagggugagaauuugagagaaauaguaauuugauuauuucauuc

SEQ ID NO: 697475 - RNA, 59 nt, hsa
uuucuuuuacaaaagaauauuacauauuugagagaaaauauuucuauuaaugguuuaau

SEQ ID NO: 697476 - RNA, 59 nt, hsa
ucaagugaggacuucaucacauaugacacgagagaaaaguaagagcugguucuaaaauc

SEQ ID NO: 697477 - RNA, 59 nt, hsa
auccagaggugccuucagggcaaagaauagagagaaagggagccgcugugcuggugggg

SEQ ID NO: 697478 - RNA, 59 nt, hsa
gauuggcauuaguuaccacagccugcccagagagaaacuaucuucucccaacauuuacu

SEQ ID NO: 697479 - RNA, 59 nt, hsa
guuacaaccgcuguaaaaugacggagagagagagaaagaaucccagacauuaacgguau

SEQ ID NO: 697480 - RNA, 64 nt, hsa; identical to SEQ ID NO: 444750

SEQ ID NO: 697481 - RNA, 64 nt, hsa; identical to SEQ ID NO: 444751

SEQ ID NO: 697482 - RNA, 64 nt, hsa; identical to SEQ ID NO: 444752

SEQ ID NO: 697483 - RNA, 64 nt, hsa; identical to SEQ ID NO: 444753

SEQ ID NO: 697484 - RNA, 60 nt, hsa; identical to SEQ ID NO: 444754

SEQ ID NO: 697485 - RNA, 64 nt, hsa; identical to SEQ ID NO: 444755

SEQ ID NO: 697486 - RNA, 64 nt, hsa; identical to SEQ ID NO: 444756

SEQ ID NO: 697487 - RNA, 64 nt, hsa; identical to SEQ ID NO: 444757

SEQ ID NO: 697488 - RNA, 64 nt, hsa; identical to SEQ ID NO: 444758

SEQ ID NO: 697489 - RNA, 64 nt, hsa; identical to SEQ ID NO: 444759

SEQ ID NO: 697490 - RNA, 64 nt, hsa; identical to SEQ ID NO: 444760

SEQ ID NO: 697491 - RNA, 64 nt, hsa; identical to SEQ ID NO: 444761

SEQ ID NO: 697492 - RNA, 52 nt, hsa; identical to SEQ ID NO: 444762

SEQ ID NO: 697493 - RNA, 64 nt, hsa; identical to SEQ ID NO: 444763

SEQ ID NO: 697494 - RNA, 64 nt, hsa; identical to SEQ ID NO: 444764

SEQ ID NO: 697495 - RNA, 64 nt, hsa; identical to SEQ ID NO: 444765

SEQ ID NO: 697496 - RNA, 64 nt, hsa; identical to SEQ ID NO: 444766

SEQ ID NO: 697497 - RNA, 64 nt, hsa; identical to SEQ ID NO: 444767

SEQ ID NO: 697498 - RNA, 64 nt, hsa; identical to SEQ ID NO: 444768

SEQ ID NO: 697499 - RNA, 64 nt, hsa; identical to SEQ ID NO: 444769

SEQ ID NO: 697500 - RNA, 64 nt, hsa; identical to SEQ ID NO: 444770

SEQ ID NO: 697501 - RNA, 64 nt, hsa; identical to SEQ ID NO: 444771

SEQ ID NO: 697502 - RNA, 64 nt, hsa; identical to SEQ ID NO: 444772

SEQ ID NO: 697503 - RNA, 64 nt, hsa; identical to SEQ ID NO: 444773

SEQ ID NO: 697504 - RNA, 64 nt, hsa; identical to SEQ ID NO: 444774

SEQ ID NO: 697505 - RNA, 64 nt, hsa; identical to SEQ ID NO: 444775

SEQ ID NO: 697506 - RNA, 64 nt, hsa; identical to SEQ ID NO: 444776

SEQ ID NO: 697507 - RNA, 64 nt, hsa; identical to SEQ ID NO: 444777

SEQ ID NO: 697508 - RNA, 64 nt, hsa; identical to SEQ ID NO: 444778

SEQ ID NO: 697509 - RNA, 64 nt, hsa; identical to SEQ ID NO: 444779

SEQ ID NO: 697510 - RNA, 64 nt, hsa; identical to SEQ ID NO: 444780

SEQ ID NO: 697511 - RNA, 64 nt, hsa; identical to SEQ ID NO: 444781

SEQ ID NO: 697512 - RNA, 64 nt, hsa; identical to SEQ ID NO: 444782

SEQ ID NO: 697513 - RNA, 64 nt, hsa; identical to SEQ ID NO: 444783

SEQ ID NO: 697514 - RNA, 64 nt, hsa; identical to SEQ ID NO: 444784

SEQ ID NO: 697515 - RNA, 64 nt, hsa; identical to SEQ ID NO: 444785

SEQ ID NO: 697516 - RNA, 64 nt, hsa; identical to SEQ ID NO: 444786

SEQ ID NO: 697517 - RNA, 64 nt, hsa; identical to SEQ ID NO: 444787

SEQ ID NO: 697518 - RNA, 64 nt, hsa; identical to SEQ ID NO: 444788

SEQ ID NO: 697519 - RNA, 60 nt, hsa; identical to SEQ ID NO: 444789

SEQ ID NO: 697520 - RNA, 64 nt, hsa; identical to SEQ ID NO: 444790

SEQ ID NO: 697521 - RNA, 64 nt, hsa; identical to SEQ ID NO: 444791

SEQ ID NO: 697522 - RNA, 64 nt, hsa; identical to SEQ ID NO: 444792

SEQ ID NO: 697523 - RNA, 64 nt, hsa; identical to SEQ ID NO: 444793

SEQ ID NO: 697524 - RNA, 64 nt, hsa; identical to SEQ ID NO: 444794

SEQ ID NO: 697525 - RNA, 64 nt, hsa; identical to SEQ ID NO: 444795

SEQ ID NO: 697526 - RNA, 64 nt, hsa; identical to SEQ ID NO: 444796

SEQ ID NO: 697527 - RNA, 64 nt, hsa; identical to SEQ ID NO: 444797

SEQ ID NO: 697528 - RNA, 64 nt, hsa; identical to SEQ ID NO: 444798

SEQ ID NO: 697529 - RNA, 64 nt, hsa; identical to SEQ ID NO: 444799

SEQ ID NO: 697530 - RNA, 64 nt, hsa; identical to SEQ ID NO: 444800

SEQ ID NO: 697531 - RNA, 64 nt, hsa; identical to SEQ ID NO: 444801

SEQ ID NO: 697532 - RNA, 64 nt, hsa; identical to SEQ ID NO: 444802

SEQ ID NO: 697533 - RNA, 64 nt, hsa; identical to SEQ ID NO: 444803

SEQ ID NO: 697534 - RNA, 64 nt, hsa; identical to SEQ ID NO: 444804

SEQ ID NO: 697535 - RNA, 64 nt, hsa; identical to SEQ ID NO: 444805

SEQ ID NO: 697536 - RNA, 64 nt, hsa; identical to SEQ ID NO: 444806

SEQ ID NO: 697537 - RNA, 60 nt, hsa; identical to SEQ ID NO: 444807

SEQ ID NO: 697538 - RNA, 64 nt, hsa; identical to SEQ ID NO: 444808

SEQ ID NO: 697539 - RNA, 64 nt, hsa; identical to SEQ ID NO: 444809

SEQ ID NO: 697540 - RNA, 64 nt, hsa; identical to SEQ ID NO: 444810

SEQ ID NO: 697541 - RNA, 64 nt, hsa; identical to SEQ ID NO: 444811

SEQ ID NO: 697542 - RNA, 64 nt, hsa; identical to SEQ ID NO: 444812

SEQ ID NO: 697543 - RNA, 51 nt, hsa; identical to SEQ ID NO: 444813

SEQ ID NO: 697544 - RNA, 64 nt, hsa; identical to SEQ ID NO: 444814

SEQ ID NO: 697545 - RNA, 64 nt, hsa; identical to SEQ ID NO: 444815

SEQ ID NO: 697546 - RNA, 64 nt, hsa; identical to SEQ ID NO: 444816

SEQ ID NO: 697547 - RNA, 64 nt, hsa; identical to SEQ ID NO: 444817

SEQ ID NO: 697548 - RNA, 64 nt, hsa; identical to SEQ ID NO: 444818

SEQ ID NO: 697549 - RNA, 62 nt, hsa; identical to SEQ ID NO: 444819

SEQ ID NO: 697550 - RNA, 64 nt, hsa; identical to SEQ ID NO: 444820

SEQ ID NO: 697551 - RNA, 64 nt, hsa; identical to SEQ ID NO: 444821

SEQ ID NO: 697552 - RNA, 64 nt, hsa; identical to SEQ ID NO: 444822

SEQ ID NO: 697553 - RNA, 64 nt, hsa; identical to SEQ ID NO: 444823

SEQ ID NO: 697554 - RNA, 64 nt, hsa; identical to SEQ ID NO: 444824

SEQ ID NO: 697555 - RNA, 64 nt, hsa; identical to SEQ ID NO: 444825

SEQ ID NO: 697556 - RNA, 64 nt, hsa; identical to SEQ ID NO: 444826

SEQ ID NO: 697557 - RNA, 64 nt, hsa; identical to SEQ ID NO: 444827

SEQ ID NO: 697558 - RNA, 64 nt, hsa; identical to SEQ ID NO: 444828

SEQ ID NO: 697559 - RNA, 64 nt, hsa; identical to SEQ ID NO: 444829

SEQ ID NO: 697560 - RNA, 64 nt, hsa; identical to SEQ ID NO: 444830

SEQ ID NO: 697561 - RNA, 64 nt, hsa; identical to SEQ ID NO: 444831

SEQ ID NO: 697562 - RNA, 64 nt, hsa; identical to SEQ ID NO: 444832

SEQ ID NO: 697563 - RNA, 64 nt, hsa; identical to SEQ ID NO: 444833

SEQ ID NO: 697564 - RNA, 64 nt, hsa; identical to SEQ ID NO: 444834

SEQ ID NO: 697565 - RNA, 64 nt, hsa; identical to SEQ ID NO: 444835

SEQ ID NO: 697566 - RNA, 64 nt, hsa; identical to SEQ ID NO: 444836

SEQ ID NO: 697567 - RNA, 64 nt, hsa; identical to SEQ ID NO: 444837

SEQ ID NO: 697568 - RNA, 64 nt, hsa; identical to SEQ ID NO: 444838

SEQ ID NO: 697569 - RNA, 64 nt, hsa; identical to SEQ ID NO: 444839

SEQ ID NO: 697570 - RNA, 64 nt, hsa; identical to SEQ ID NO: 444840

SEQ ID NO: 697571 - RNA, 64 nt, hsa; identical to SEQ ID NO: 444841

SEQ ID NO: 697572 - RNA, 64 nt, hsa; identical to SEQ ID NO: 444842

SEQ ID NO: 697573 - RNA, 64 nt, hsa; identical to SEQ ID NO: 444843

SEQ ID NO: 697574 - RNA, 64 nt, hsa; identical to SEQ ID NO: 444844

SEQ ID NO: 697575 - RNA, 64 nt, hsa; identical to SEQ ID NO: 444845

SEQ ID NO: 697576 - RNA, 64 nt, hsa; identical to SEQ ID NO: 444846

SEQ ID NO: 697577 - RNA, 64 nt, hsa; identical to SEQ ID NO: 444847

SEQ ID NO: 697578 - RNA, 64 nt, hsa; identical to SEQ ID NO: 444848

SEQ ID NO: 697579 - RNA, 64 nt, hsa; identical to SEQ ID NO: 444849

SEQ ID NO: 697580 - RNA, 64 nt, hsa; identical to SEQ ID NO: 444850

SEQ ID NO: 697581 - RNA, 64 nt, hsa; identical to SEQ ID NO: 444851

SEQ ID NO: 697582 - RNA, 64 nt, hsa; identical to SEQ ID NO: 444852

SEQ ID NO: 697583 - RNA, 64 nt, hsa; identical to SEQ ID NO: 334387

SEQ ID NO: 697584 - RNA, 64 nt, hsa; identical to SEQ ID NO: 334388

SEQ ID NO: 697585 - RNA, 64 nt, hsa; identical to SEQ ID NO: 334389

SEQ ID NO: 697586 - RNA, 64 nt, hsa; identical to SEQ ID NO: 334390

SEQ ID NO: 697587 - RNA, 64 nt, hsa; identical to SEQ ID NO: 334391

SEQ ID NO: 697588 - RNA, 64 nt, hsa; identical to SEQ ID NO: 334392

SEQ ID NO: 697589 - RNA, 64 nt, hsa; identical to SEQ ID NO: 334393

SEQ ID NO: 697590 - RNA, 64 nt, hsa; identical to SEQ ID NO: 334394

SEQ ID NO: 697591 - RNA, 64 nt, hsa; identical to SEQ ID NO: 334395

SEQ ID NO: 697592 - RNA, 64 nt, hsa; identical to SEQ ID NO: 334396

SEQ ID NO: 697593 - RNA, 64 nt, hsa; identical to SEQ ID NO: 334397

SEQ ID NO: 697594 - RNA, 64 nt, hsa; identical to SEQ ID NO: 334398

SEQ ID NO: 697595 - RNA, 64 nt, hsa
ccuggaucagugggguguauucagagcaccucuccagaugcaccaugcaugcucacagucccuu

SEQ ID NO: 697596 - RNA, 64 nt, hsa
gagcaaauuaggaaaauguacccuucgcuugaggcagaugcagcccuucccccgagugcauggc

SEQ ID NO: 697597 - RNA, 64 nt, hsa
ccaauagaaacacaacagccacaaaugcaggccacagaugcaaauauuuaacuucccaguagcc

SEQ ID NO: 697598 - RNA, 64 nt, hsa
auuuguaugguuuaguggagucugguuauuuugacagaugcauguuuuuuuuaaauagaugcaa

SEQ ID NO: 697599 - RNA, 64 nt, hsa
cuaaaucaugugacguuuugacuggcuugagauucagaugcauaauuuuuaauuauaauuauug

SEQ ID NO: 697600 - RNA, 64 nt, hsa
uguaccuuuugagacuauguauuuauauuuggaucagaugcauauuuauuaauguacagucacu

SEQ ID NO: 697601 - RNA, 64 nt, hsa
uuuucagaacucauccaguccuuguaaucuuaaacagaugcaaauccuaccccugcccuuaaug

SEQ ID NO: 697602 - RNA, 64 nt, hsa
ucucacuuugaaagaaagacuccguaaucuuaaacagaugcaaauccaauuaggcggccaagua

SEQ ID NO: 697603 - RNA, 64 nt, hsa
gaagagaagaagaaaaucaaccagcaggaaaguacagaugcagccgugcaggagccgagccagu

SEQ ID NO: 697604 - RNA, 64 nt, hsa
auguuugucaaaaaguggaucuucuuggagcgagcagaugcaaucucuugucucacaugcuagc

SEQ ID NO: 697605 - RNA, 64 nt, hsa
gcauaagcuacacaggaugugcuucugcagccuacagaugcagaaccagaaugagggggacaau

SEQ ID NO: 697606 - RNA, 64 nt, hsa
cccaggggagggguguugucuggaagggcagguucagaugcagccuuccagauuuagaggcacu

SEQ ID NO: 697607 - RNA, 64 nt, hsa
cuuuaaacugcggucaaaagauuuuucuagccaucagaugcaauuacgaugucucagagcucug

SEQ ID NO: 697608 - RNA, 64 nt, hsa
uugugggcacaccugggauguggaagcugaggaccagaugcacacaaggcauugcucuguuugc

SEQ ID NO: 697609 - RNA, 64 nt, hsa
cauaacaauaccucgaauuuccaaaagaggucaccagaugcacaugggccgcaaaacacacagu

SEQ ID NO: 697610 - RNA, 64 nt, hsa
uuucuccugcacuuggcuugcagugagaugcucccagaugcauuuguccagugccccaucaugg

SEQ ID NO: 697611 - RNA, 64 nt, hsa
augggugccaagugccagggggcggaguccccagcagaugcauccuggccaucuguugcgugga

SEQ ID NO: 697612 - RNA, 64 nt, hsa
uauauccagcauauucauaacuagagccauaucacagaugcauucaucauaauaauuccagaca

SEQ ID NO: 697613 - RNA, 64 nt, hsa
caccgaugcacacgcacauagagauaugcacacacagaugcacacacagauauacacauggaug

SEQ ID NO: 697614 - RNA, 64 nt, hsa
cacaccaaugcgcacacacaccgauguacacacacagaugcacacacagaugcacacacaccga

SEQ ID NO: 697615 - RNA, 64 nt, hsa
cacacacaccgauguacacacacagaugcacacacagaugcacacacaccgaugcugacuccau

SEQ ID NO: 697616 - RNA, 64 nt, hsa
aaagacacgcagauuacauuugauaaauguuacacagaugcauuugugcauuugaauacucugu

SEQ ID NO: 697617 - RNA, 64 nt, hsa
uauagagagacucugggccacccucaaacaccgucagaugcauuagcagcccacugcaugggac

SEQ ID NO: 697618 - RNA, 64 nt, hsa
gccgagcauuguggauuagccugaggcuuaaaaucagaugcaugucugguaagaugaccacugu

SEQ ID NO: 697619 - RNA, 64 nt, hsa
guccugcucauugucuugaguuucuaaccaugugcagaugcaagcguucaggaguaggaauuaa

SEQ ID NO: 697620 - RNA, 64 nt, hsa
gaaucagcugugcucaauagccaaccucccuguccagaugcagcuauuuugguaucuccuauca

SEQ ID NO: 697621 - RNA, 64 nt, hsa
uggaagaaaaagauucagccaaguggggaggugacagaugcacaauuaugaaaccugguuguac

SEQ ID NO: 697622 - RNA, 64 nt, hsa
uaaaaauagaaucucacugauagccugcaagaaacagaugcagugccugcuuccguaucagucc

SEQ ID NO: 697623 - RNA, 64 nt, hsa
gaaggccagagagccgcgcaguucucugcaggugcagaugcaggcaguggagguggccugagca

SEQ ID NO: 697624 - RNA, 64 nt, hsa
gacguuuccccucucucuaacucuggguaucccacagaugcaaaagggagaauaaaccugaaua

SEQ ID NO: 697625 - RNA, 64 nt, hsa
ccgcuggucaagaagccaacagucauguggcucgcagaugcauccugcaucccagucccccucc

SEQ ID NO: 697626 - RNA, 64 nt, hsa; identical to SEQ ID NO: 380102

SEQ ID NO: 697627 - RNA, 64 nt, hsa; identical to SEQ ID NO: 380103

SEQ ID NO: 697628 - RNA, 64 nt, hsa; identical to SEQ ID NO: 380104

SEQ ID NO: 697629 - RNA, 64 nt, hsa; identical to SEQ ID NO: 380105

SEQ ID NO: 697630 - RNA, 64 nt, hsa; identical to SEQ ID NO: 380106

SEQ ID NO: 697631 - RNA, 64 nt, hsa; identical to SEQ ID NO: 380107

SEQ ID NO: 697632 - RNA, 64 nt, hsa; identical to SEQ ID NO: 380108

SEQ ID NO: 697633 - RNA, 64 nt, hsa; identical to SEQ ID NO: 380109

SEQ ID NO: 697634 - RNA, 64 nt, hsa; identical to SEQ ID NO: 380110

SEQ ID NO: 697635 - RNA, 64 nt, hsa; identical to SEQ ID NO: 380111

SEQ ID NO: 697636 - RNA, 64 nt, hsa; identical to SEQ ID NO: 380112

SEQ ID NO: 697637 - RNA, 64 nt, hsa; identical to SEQ ID NO: 380113

SEQ ID NO: 697638 - RNA, 64 nt, hsa; identical to SEQ ID NO: 380114

SEQ ID NO: 697639 - RNA, 64 nt, hsa; identical to SEQ ID NO: 380115

SEQ ID NO: 697640 - RNA, 58 nt, hsa; identical to SEQ ID NO: 380116

SEQ ID NO: 697641 - RNA, 64 nt, hsa; identical to SEQ ID NO: 380117

SEQ ID NO: 697642 - RNA, 64 nt, hsa; identical to SEQ ID NO: 380118

SEQ ID NO: 697643 - RNA, 64 nt, hsa; identical to SEQ ID NO: 380119

SEQ ID NO: 697644 - RNA, 64 nt, hsa; identical to SEQ ID NO: 380120

SEQ ID NO: 697645 - RNA, 64 nt, hsa; identical to SEQ ID NO: 380121

SEQ ID NO: 697646 - RNA, 64 nt, hsa; identical to SEQ ID NO: 380122

SEQ ID NO: 697647 - RNA, 64 nt, hsa; identical to SEQ ID NO: 380123

SEQ ID NO: 697648 - RNA, 64 nt, hsa; identical to SEQ ID NO: 380124

SEQ ID NO: 697649 - RNA, 64 nt, hsa; identical to SEQ ID NO: 380125

SEQ ID NO: 697650 - RNA, 64 nt, hsa; identical to SEQ ID NO: 380126

SEQ ID NO: 697651 - RNA, 64 nt, hsa; identical to SEQ ID NO: 380127

SEQ ID NO: 697652 - RNA, 64 nt, hsa; identical to SEQ ID NO: 380128

SEQ ID NO: 697653 - RNA, 64 nt, hsa; identical to SEQ ID NO: 380129

SEQ ID NO: 697654 - RNA, 64 nt, hsa; identical to SEQ ID NO: 380130

SEQ ID NO: 697655 - RNA, 64 nt, hsa; identical to SEQ ID NO: 380131

SEQ ID NO: 697656 - RNA, 64 nt, hsa; identical to SEQ ID NO: 380132

SEQ ID NO: 697657 - RNA, 64 nt, hsa; identical to SEQ ID NO: 380133

SEQ ID NO: 697658 - RNA, 64 nt, hsa; identical to SEQ ID NO: 380134

SEQ ID NO: 697659 - RNA, 64 nt, hsa; identical to SEQ ID NO: 380135

SEQ ID NO: 697660 - RNA, 64 nt, hsa; identical to SEQ ID NO: 380136

SEQ ID NO: 697661 - RNA, 64 nt, hsa; identical to SEQ ID NO: 380137

SEQ ID NO: 697662 - RNA, 64 nt, hsa; identical to SEQ ID NO: 380138

SEQ ID NO: 697663 - RNA, 64 nt, hsa; identical to SEQ ID NO: 380139

SEQ ID NO: 697664 - RNA, 64 nt, hsa; identical to SEQ ID NO: 380140

SEQ ID NO: 697665 - RNA, 64 nt, hsa; identical to SEQ ID NO: 380141

SEQ ID NO: 697666 - RNA, 64 nt, hsa; identical to SEQ ID NO: 380142

SEQ ID NO: 697667 - RNA, 64 nt, hsa; identical to SEQ ID NO: 380143

SEQ ID NO: 697668 - RNA, 64 nt, hsa; identical to SEQ ID NO: 380144

SEQ ID NO: 697669 - RNA, 64 nt, hsa; identical to SEQ ID NO: 380145

SEQ ID NO: 697670 - RNA, 64 nt, hsa; identical to SEQ ID NO: 380146

SEQ ID NO: 697671 - RNA, 64 nt, hsa; identical to SEQ ID NO: 380147

SEQ ID NO: 697672 - RNA, 59 nt, hsa; identical to SEQ ID NO: 380148

SEQ ID NO: 697673 - RNA, 64 nt, hsa; identical to SEQ ID NO: 380149

SEQ ID NO: 697674 - RNA, 64 nt, hsa; identical to SEQ ID NO: 380150

SEQ ID NO: 697675 - RNA, 64 nt, hsa; identical to SEQ ID NO: 380151

SEQ ID NO: 697676 - RNA, 64 nt, hsa; identical to SEQ ID NO: 380152

SEQ ID NO: 697677 - RNA, 64 nt, hsa; identical to SEQ ID NO: 380153

SEQ ID NO: 697678 - RNA, 64 nt, hsa; identical to SEQ ID NO: 380154

SEQ ID NO: 697679 - RNA, 64 nt, hsa; identical to SEQ ID NO: 380155

SEQ ID NO: 697680 - RNA, 64 nt, hsa; identical to SEQ ID NO: 380156

SEQ ID NO: 697681 - RNA, 64 nt, hsa; identical to SEQ ID NO: 380157

SEQ ID NO: 697682 - RNA, 64 nt, hsa; identical to SEQ ID NO: 380158

SEQ ID NO: 697683 - RNA, 64 nt, hsa; identical to SEQ ID NO: 380159

SEQ ID NO: 697684 - RNA, 64 nt, hsa; identical to SEQ ID NO: 380160

SEQ ID NO: 697685 - RNA, 64 nt, hsa; identical to SEQ ID NO: 380161

SEQ ID NO: 697686 - RNA, 54 nt, hsa; identical to SEQ ID NO: 380162

SEQ ID NO: 697687 - RNA, 64 nt, hsa; identical to SEQ ID NO: 380163

SEQ ID NO: 697688 - RNA, 64 nt, hsa; identical to SEQ ID NO: 380164

SEQ ID NO: 697689 - RNA, 64 nt, hsa; identical to SEQ ID NO: 380165

SEQ ID NO: 697690 - RNA, 64 nt, hsa; identical to SEQ ID NO: 380166

SEQ ID NO: 697691 - RNA, 64 nt, hsa; identical to SEQ ID NO: 380167

SEQ ID NO: 697692 - RNA, 64 nt, hsa; identical to SEQ ID NO: 380168

SEQ ID NO: 697693 - RNA, 64 nt, hsa; identical to SEQ ID NO: 380169

SEQ ID NO: 697694 - RNA, 64 nt, hsa; identical to SEQ ID NO: 380170

SEQ ID NO: 697695 - RNA, 64 nt, hsa; identical to SEQ ID NO: 380171

SEQ ID NO: 697696 - RNA, 64 nt, hsa; identical to SEQ ID NO: 380172

SEQ ID NO: 697697 - RNA, 64 nt, hsa; identical to SEQ ID NO: 380173

SEQ ID NO: 697698 - RNA, 64 nt, hsa; identical to SEQ ID NO: 380174

SEQ ID NO: 697699 - RNA, 64 nt, hsa; identical to SEQ ID NO: 380175

SEQ ID NO: 697700 - RNA, 64 nt, hsa; identical to SEQ ID NO: 380176

SEQ ID NO: 697701 - RNA, 64 nt, hsa; identical to SEQ ID NO: 380177

SEQ ID NO: 697702 - RNA, 64 nt, hsa; identical to SEQ ID NO: 380178

SEQ ID NO: 697703 - RNA, 64 nt, hsa; identical to SEQ ID NO: 380179

SEQ ID NO: 697704 - RNA, 64 nt, hsa; identical to SEQ ID NO: 380180

SEQ ID NO: 697705 - RNA, 64 nt, hsa; identical to SEQ ID NO: 380181

SEQ ID NO: 697706 - RNA, 64 nt, hsa; identical to SEQ ID NO: 380182

SEQ ID NO: 697707 - RNA, 64 nt, hsa; identical to SEQ ID NO: 380183

SEQ ID NO: 697708 - RNA, 64 nt, hsa; identical to SEQ ID NO: 380184

SEQ ID NO: 697709 - RNA, 64 nt, hsa; identical to SEQ ID NO: 380185

SEQ ID NO: 697710 - RNA, 64 nt, hsa; identical to SEQ ID NO: 380186

SEQ ID NO: 697711 - RNA, 64 nt, hsa; identical to SEQ ID NO: 380187

SEQ ID NO: 697712 - RNA, 64 nt, hsa; identical to SEQ ID NO: 380188

SEQ ID NO: 697713 - RNA, 64 nt, hsa; identical to SEQ ID NO: 380189

SEQ ID NO: 697714 - RNA, 64 nt, hsa; identical to SEQ ID NO: 380190

SEQ ID NO: 697715 - RNA, 64 nt, hsa; identical to SEQ ID NO: 380191

SEQ ID NO: 697716 - RNA, 64 nt, hsa; identical to SEQ ID NO: 380192

SEQ ID NO: 697717 - RNA, 64 nt, hsa; identical to SEQ ID NO: 380193

SEQ ID NO: 697718 - RNA, 64 nt, hsa; identical to SEQ ID NO: 380194

SEQ ID NO: 697719 - RNA, 64 nt, hsa; identical to SEQ ID NO: 380195

SEQ ID NO: 697720 - RNA, 58 nt, hsa; identical to SEQ ID NO: 380196

SEQ ID NO: 697721 - RNA, 64 nt, hsa; identical to SEQ ID NO: 380197

SEQ ID NO: 697722 - RNA, 64 nt, hsa; identical to SEQ ID NO: 380198

SEQ ID NO: 697723 - RNA, 64 nt, hsa; identical to SEQ ID NO: 380199

SEQ ID NO: 697724 - RNA, 64 nt, hsa; identical to SEQ ID NO: 380200

SEQ ID NO: 697725 - RNA, 64 nt, hsa; identical to SEQ ID NO: 380201

SEQ ID NO: 697726 - RNA, 64 nt, hsa; identical to SEQ ID NO: 380202

SEQ ID NO: 697727 - RNA, 64 nt, hsa; identical to SEQ ID NO: 380203

SEQ ID NO: 697728 - RNA, 64 nt, hsa; identical to SEQ ID NO: 380204

SEQ ID NO: 697729 - RNA, 64 nt, hsa; identical to SEQ ID NO: 380205

SEQ ID NO: 697730 - RNA, 64 nt, hsa; identical to SEQ ID NO: 380206

SEQ ID NO: 697731 - RNA, 64 nt, hsa; identical to SEQ ID NO: 380207

SEQ ID NO: 697732 - RNA, 64 nt, hsa; identical to SEQ ID NO: 380208

SEQ ID NO: 697733 - RNA, 64 nt, hsa; identical to SEQ ID NO: 380209

SEQ ID NO: 697734 - RNA, 63 nt, hsa; identical to SEQ ID NO: 380210

SEQ ID NO: 697735 - RNA, 64 nt, hsa; identical to SEQ ID NO: 380211

SEQ ID NO: 697736 - RNA, 64 nt, hsa; identical to SEQ ID NO: 380212

SEQ ID NO: 697737 - RNA, 64 nt, hsa; identical to SEQ ID NO: 380213

SEQ ID NO: 697738 - RNA, 64 nt, hsa; identical to SEQ ID NO: 380214

SEQ ID NO: 697739 - RNA, 64 nt, hsa; identical to SEQ ID NO: 380215

SEQ ID NO: 697740 - RNA, 64 nt, hsa; identical to SEQ ID NO: 380216

SEQ ID NO: 697741 - RNA, 64 nt, hsa; identical to SEQ ID NO: 380217

SEQ ID NO: 697742 - RNA, 64 nt, hsa; identical to SEQ ID NO: 380218

SEQ ID NO: 697743 - RNA, 64 nt, hsa; identical to SEQ ID NO: 380219

SEQ ID NO: 697744 - RNA, 64 nt, hsa; identical to SEQ ID NO: 380220

SEQ ID NO: 697745 - RNA, 64 nt, hsa; identical to SEQ ID NO: 380221

SEQ ID NO: 697746 - RNA, 64 nt, hsa; identical to SEQ ID NO: 380222

SEQ ID NO: 697747 - RNA, 64 nt, hsa; identical to SEQ ID NO: 380223

SEQ ID NO: 697748 - RNA, 64 nt, hsa; identical to SEQ ID NO: 380224

SEQ ID NO: 697749 - RNA, 64 nt, hsa; identical to SEQ ID NO: 380225

SEQ ID NO: 697750 - RNA, 64 nt, hsa; identical to SEQ ID NO: 380226

SEQ ID NO: 697751 - RNA, 64 nt, hsa; identical to SEQ ID NO: 380227

SEQ ID NO: 697752 - RNA, 64 nt, hsa; identical to SEQ ID NO: 380228

SEQ ID NO: 697753 - RNA, 64 nt, hsa; identical to SEQ ID NO: 380229

SEQ ID NO: 697754 - RNA, 64 nt, hsa; identical to SEQ ID NO: 380230

SEQ ID NO: 697755 - RNA, 64 nt, hsa; identical to SEQ ID NO: 380231

SEQ ID NO: 697756 - RNA, 64 nt, hsa; identical to SEQ ID NO: 380232

SEQ ID NO: 697757 - RNA, 64 nt, hsa; identical to SEQ ID NO: 380233

SEQ ID NO: 697758 - RNA, 64 nt, hsa; identical to SEQ ID NO: 380234

SEQ ID NO: 697759 - RNA, 64 nt, hsa; identical to SEQ ID NO: 380235

SEQ ID NO: 697760 - RNA, 51 nt, hsa; identical to SEQ ID NO: 380236

SEQ ID NO: 697761 - RNA, 64 nt, hsa; identical to SEQ ID NO: 380237

SEQ ID NO: 697762 - RNA, 64 nt, hsa; identical to SEQ ID NO: 380238

SEQ ID NO: 697763 - RNA, 64 nt, hsa; identical to SEQ ID NO: 380239

SEQ ID NO: 697764 - RNA, 64 nt, hsa; identical to SEQ ID NO: 380240

SEQ ID NO: 697765 - RNA, 64 nt, hsa; identical to SEQ ID NO: 380241

SEQ ID NO: 697766 - RNA, 64 nt, hsa; identical to SEQ ID NO: 380242

SEQ ID NO: 697767 - RNA, 64 nt, hsa; identical to SEQ ID NO: 380243

SEQ ID NO: 697768 - RNA, 64 nt, hsa; identical to SEQ ID NO: 380244

SEQ ID NO: 697769 - RNA, 64 nt, hsa; identical to SEQ ID NO: 380245

SEQ ID NO: 697770 - RNA, 64 nt, hsa; identical to SEQ ID NO: 380246

SEQ ID NO: 697771 - RNA, 64 nt, hsa; identical to SEQ ID NO: 380247

SEQ ID NO: 697772 - RNA, 64 nt, hsa; identical to SEQ ID NO: 380248

SEQ ID NO: 697773 - RNA, 64 nt, hsa; identical to SEQ ID NO: 380249

SEQ ID NO: 697774 - RNA, 64 nt, hsa; identical to SEQ ID NO: 380250

SEQ ID NO: 697775 - RNA, 64 nt, hsa; identical to SEQ ID NO: 380251

SEQ ID NO: 697776 - RNA, 64 nt, hsa; identical to SEQ ID NO: 380252

SEQ ID NO: 697777 - RNA, 64 nt, hsa; identical to SEQ ID NO: 380253

SEQ ID NO: 697778 - RNA, 64 nt, hsa; identical to SEQ ID NO: 380254

SEQ ID NO: 697779 - RNA, 64 nt, hsa; identical to SEQ ID NO: 380255

SEQ ID NO: 697780 - RNA, 64 nt, hsa; identical to SEQ ID NO: 380256

SEQ ID NO: 697781 - RNA, 64 nt, hsa; identical to SEQ ID NO: 380257

SEQ ID NO: 697782 - RNA, 64 nt, hsa; identical to SEQ ID NO: 380258

SEQ ID NO: 697783 - RNA, 64 nt, hsa; identical to SEQ ID NO: 380259

SEQ ID NO: 697784 - RNA, 64 nt, hsa; identical to SEQ ID NO: 380260

SEQ ID NO: 697785 - RNA, 64 nt, hsa; identical to SEQ ID NO: 380261

SEQ ID NO: 697786 - RNA, 64 nt, hsa; identical to SEQ ID NO: 380262

SEQ ID NO: 697787 - RNA, 64 nt, hsa; identical to SEQ ID NO: 380263

SEQ ID NO: 697788 - RNA, 64 nt, hsa; identical to SEQ ID NO: 380264

SEQ ID NO: 697789 - RNA, 64 nt, hsa; identical to SEQ ID NO: 380265

SEQ ID NO: 697790 - RNA, 64 nt, hsa; identical to SEQ ID NO: 380266

SEQ ID NO: 697791 - RNA, 64 nt, hsa; identical to SEQ ID NO: 380267

SEQ ID NO: 697792 - RNA, 64 nt, hsa; identical to SEQ ID NO: 380268

SEQ ID NO: 697793 - RNA, 64 nt, hsa; identical to SEQ ID NO: 380269

SEQ ID NO: 697794 - RNA, 64 nt, hsa; identical to SEQ ID NO: 380270

SEQ ID NO: 697795 - RNA, 64 nt, hsa; identical to SEQ ID NO: 380271

SEQ ID NO: 697796 - RNA, 64 nt, hsa; identical to SEQ ID NO: 380272

SEQ ID NO: 697797 - RNA, 64 nt, hsa; identical to SEQ ID NO: 380273

SEQ ID NO: 697798 - RNA, 64 nt, hsa; identical to SEQ ID NO: 380274

SEQ ID NO: 697799 - RNA, 64 nt, hsa; identical to SEQ ID NO: 380275

SEQ ID NO: 697800 - RNA, 64 nt, hsa; identical to SEQ ID NO: 380276

SEQ ID NO: 697801 - RNA, 64 nt, hsa; identical to SEQ ID NO: 380277

SEQ ID NO: 697802 - RNA, 64 nt, hsa; identical to SEQ ID NO: 380278

SEQ ID NO: 697803 - RNA, 64 nt, hsa; identical to SEQ ID NO: 380279

SEQ ID NO: 697804 - RNA, 50 nt, hsa; identical to SEQ ID NO: 380280

SEQ ID NO: 697805 - RNA, 64 nt, hsa; identical to SEQ ID NO: 380281

SEQ ID NO: 697806 - RNA, 63 nt, hsa; identical to SEQ ID NO: 380282

SEQ ID NO: 697807 - RNA, 64 nt, hsa; identical to SEQ ID NO: 380283

SEQ ID NO: 697808 - RNA, 64 nt, hsa; identical to SEQ ID NO: 380284

SEQ ID NO: 697809 - RNA, 64 nt, hsa; identical to SEQ ID NO: 380285

SEQ ID NO: 697810 - RNA, 64 nt, hsa; identical to SEQ ID NO: 380286

SEQ ID NO: 697811 - RNA, 64 nt, hsa; identical to SEQ ID NO: 380287

SEQ ID NO: 697812 - RNA, 64 nt, hsa; identical to SEQ ID NO: 380288

SEQ ID NO: 697813 - RNA, 64 nt, hsa; identical to SEQ ID NO: 380289

SEQ ID NO: 697814 - RNA, 64 nt, hsa; identical to SEQ ID NO: 380290

SEQ ID NO: 697815 - RNA, 64 nt, hsa; identical to SEQ ID NO: 380291

SEQ ID NO: 697816 - RNA, 64 nt, hsa; identical to SEQ ID NO: 380292

SEQ ID NO: 697817 - RNA, 64 nt, hsa; identical to SEQ ID NO: 380293

SEQ ID NO: 697818 - RNA, 64 nt, hsa; identical to SEQ ID NO: 380294

SEQ ID NO: 697819 - RNA, 64 nt, hsa; identical to SEQ ID NO: 380295

SEQ ID NO: 697820 - RNA, 64 nt, hsa; identical to SEQ ID NO: 380296

SEQ ID NO: 697821 - RNA, 64 nt, hsa; identical to SEQ ID NO: 380297

SEQ ID NO: 697822 - RNA, 64 nt, hsa; identical to SEQ ID NO: 380298

SEQ ID NO: 697823 - RNA, 64 nt, hsa; identical to SEQ ID NO: 380299

SEQ ID NO: 697824 - RNA, 64 nt, hsa; identical to SEQ ID NO: 380300

SEQ ID NO: 697825 - RNA, 64 nt, hsa; identical to SEQ ID NO: 380301

SEQ ID NO: 697826 - RNA, 64 nt, hsa; identical to SEQ ID NO: 380302

SEQ ID NO: 697827 - RNA, 64 nt, hsa; identical to SEQ ID NO: 380303

SEQ ID NO: 697828 - RNA, 64 nt, hsa; identical to SEQ ID NO: 380304

SEQ ID NO: 697829 - RNA, 64 nt, hsa; identical to SEQ ID NO: 380304

SEQ ID NO: 697830 - RNA, 64 nt, hsa; identical to SEQ ID NO: 380306

SEQ ID NO: 697831 - RNA, 64 nt, hsa; identical to SEQ ID NO: 380307

SEQ ID NO: 697832 - RNA, 64 nt, hsa; identical to SEQ ID NO: 380308

SEQ ID NO: 697833 - RNA, 64 nt, hsa; identical to SEQ ID NO: 380309

SEQ ID NO: 697834 - RNA, 64 nt, hsa; identical to SEQ ID NO: 380310

SEQ ID NO: 697835 - RNA, 64 nt, hsa; identical to SEQ ID NO: 380311

SEQ ID NO: 697836 - RNA, 64 nt, hsa; identical to SEQ ID NO: 110917

SEQ ID NO: 697837 - RNA, 64 nt, hsa; identical to SEQ ID NO: 110918

SEQ ID NO: 697838 - RNA, 64 nt, hsa; identical to SEQ ID NO: 110919

SEQ ID NO: 697839 - RNA, 64 nt, hsa; identical to SEQ ID NO: 110920

SEQ ID NO: 697840 - RNA, 64 nt, hsa; identical to SEQ ID NO: 110921

SEQ ID NO: 697841 - RNA, 64 nt, hsa; identical to SEQ ID NO: 110922

SEQ ID NO: 697842 - RNA, 64 nt, hsa; identical to SEQ ID NO: 110923

SEQ ID NO: 697843 - RNA, 64 nt, hsa; identical to SEQ ID NO: 110924

SEQ ID NO: 697844 - RNA, 64 nt, hsa; identical to SEQ ID NO: 110925

SEQ ID NO: 697845 - RNA, 64 nt, hsa; identical to SEQ ID NO: 110926

SEQ ID NO: 697846 - RNA, 64 nt, hsa; identical to SEQ ID NO: 110927

SEQ ID NO: 697847 - RNA, 64 nt, hsa; identical to SEQ ID NO: 110928

SEQ ID NO: 697848 - RNA, 61 nt, hsa; identical to SEQ ID NO: 110929

SEQ ID NO: 697849 - RNA, 64 nt, hsa; identical to SEQ ID NO: 110930

SEQ ID NO: 697850 - RNA, 64 nt, hsa; identical to SEQ ID NO: 110931

SEQ ID NO: 697851 - RNA, 64 nt, hsa; identical to SEQ ID NO: 110932

SEQ ID NO: 697852 - RNA, 64 nt, hsa; identical to SEQ ID NO: 110933

SEQ ID NO: 697853 - RNA, 64 nt, hsa; identical to SEQ ID NO: 110934

SEQ ID NO: 697854 - RNA, 64 nt, hsa; identical to SEQ ID NO: 110935

SEQ ID NO: 697855 - RNA, 64 nt, hsa; identical to SEQ ID NO: 110936

SEQ ID NO: 697856 - RNA, 64 nt, hsa; identical to SEQ ID NO: 110937

SEQ ID NO: 697857 - RNA, 64 nt, hsa; identical to SEQ ID NO: 110938

SEQ ID NO: 697858 - RNA, 64 nt, hsa; identical to SEQ ID NO: 110939

SEQ ID NO: 697859 - RNA, 64 nt, hsa; identical to SEQ ID NO: 110940

SEQ ID NO: 697860 - RNA, 64 nt, hsa; identical to SEQ ID NO: 110941

SEQ ID NO: 697861 - RNA, 64 nt, hsa; identical to SEQ ID NO: 110942

SEQ ID NO: 697862 - RNA, 64 nt, hsa; identical to SEQ ID NO: 110943

SEQ ID NO: 697863 - RNA, 64 nt, hsa; identical to SEQ ID NO: 110944

SEQ ID NO: 697864 - RNA, 64 nt, hsa; identical to SEQ ID NO: 110945

SEQ ID NO: 697865 - RNA, 64 nt, hsa; identical to SEQ ID NO: 110946

SEQ ID NO: 697866 - RNA, 64 nt, hsa; identical to SEQ ID NO: 110947

SEQ ID NO: 697867 - RNA, 64 nt, hsa; identical to SEQ ID NO: 110948

SEQ ID NO: 697868 - RNA, 64 nt, hsa; identical to SEQ ID NO: 110949

SEQ ID NO: 697869 - RNA, 64 nt, hsa; identical to SEQ ID NO: 110950

SEQ ID NO: 697870 - RNA, 64 nt, hsa; identical to SEQ ID NO: 110951

SEQ ID NO: 697871 - RNA, 64 nt, hsa; identical to SEQ ID NO: 110952

SEQ ID NO: 697872 - RNA, 64 nt, hsa; identical to SEQ ID NO: 110953

SEQ ID NO: 697873 - RNA, 64 nt, hsa; identical to SEQ ID NO: 110954

SEQ ID NO: 697874 - RNA, 64 nt, hsa; identical to SEQ ID NO: 110955

SEQ ID NO: 697875 - RNA, 64 nt, hsa; identical to SEQ ID NO: 110956

SEQ ID NO: 697876 - RNA, 64 nt, hsa; identical to SEQ ID NO: 110957

SEQ ID NO: 697877 - RNA, 64 nt, hsa; identical to SEQ ID NO: 110958

SEQ ID NO: 697878 - RNA, 64 nt, hsa; identical to SEQ ID NO: 110959

SEQ ID NO: 697879 - RNA, 64 nt, hsa; identical to SEQ ID NO: 110960

SEQ ID NO: 697880 - RNA, 64 nt, hsa; identical to SEQ ID NO: 110961

SEQ ID NO: 697881 - RNA, 64 nt, hsa; identical to SEQ ID NO: 110962

SEQ ID NO: 697882 - RNA, 64 nt, hsa; identical to SEQ ID NO: 110963

SEQ ID NO: 697883 - RNA, 64 nt, hsa; identical to SEQ ID NO: 110964

SEQ ID NO: 697884 - RNA, 64 nt, hsa; identical to SEQ ID NO: 110965

SEQ ID NO: 697885 - RNA, 64 nt, hsa; identical to SEQ ID NO: 110966

SEQ ID NO: 697886 - RNA, 64 nt, hsa; identical to SEQ ID NO: 110967

SEQ ID NO: 697887 - RNA, 64 nt, hsa; identical to SEQ ID NO: 110968

SEQ ID NO: 697888 - RNA, 64 nt, hsa; identical to SEQ ID NO: 110969

SEQ ID NO: 697889 - RNA, 64 nt, hsa; identical to SEQ ID NO: 110970

SEQ ID NO: 697890 - RNA, 64 nt, hsa; identical to SEQ ID NO: 110971

SEQ ID NO: 697891 - RNA, 64 nt, hsa; identical to SEQ ID NO: 110972

SEQ ID NO: 697892 - RNA, 64 nt, hsa; identical to SEQ ID NO: 110973

SEQ ID NO: 697893 - RNA, 64 nt, hsa; identical to SEQ ID NO: 110974

SEQ ID NO: 697894 - RNA, 64 nt, hsa; identical to SEQ ID NO: 110975

SEQ ID NO: 697895 - RNA, 64 nt, hsa; identical to SEQ ID NO: 110976

SEQ ID NO: 697896 - RNA, 64 nt, hsa; identical to SEQ ID NO: 110977

SEQ ID NO: 697897 - RNA, 64 nt, hsa; identical to SEQ ID NO: 110978

SEQ ID NO: 697898 - RNA, 64 nt, hsa; identical to SEQ ID NO: 110979

SEQ ID NO: 697899 - RNA, 64 nt, hsa; identical to SEQ ID NO: 110980

SEQ ID NO: 697900 - RNA, 64 nt, hsa; identical to SEQ ID NO: 432758

SEQ ID NO: 697901 - RNA, 64 nt, hsa; identical to SEQ ID NO: 432759

SEQ ID NO: 697902 - RNA, 64 nt, hsa; identical to SEQ ID NO: 432760

SEQ ID NO: 697903 - RNA, 64 nt, hsa; identical to SEQ ID NO: 432761

SEQ ID NO: 697904 - RNA, 64 nt, hsa
aacuguuggucucacucugucucucuaccuggucaucuucaaggcuaagaaaacaaacaagcua

SEQ ID NO: 697905 - RNA, 64 nt, hsa
aacagguggaggaaagggguugcaggugaccagcaucuucaaucuaguuaccaccagcuuggcu

SEQ ID NO: 697906 - RNA, 64 nt, hsa
cuugucagauauccugugcuuccagaguauuuuuaucuucaauuuuauuuaauuuuguuucauu

SEQ ID NO: 697907 - RNA, 64 nt, hsa
caauaaauaugaugaccuugauaguuuuaaugaaaucuucaauucuugcagcuguguuuuggaa

SEQ ID NO: 697908 - RNA, 64 nt, hsa
cucagaaugcuuucaaggguaaccagauuuaagaaucuucaaacaauacacuguuaccuuuuga

SEQ ID NO: 697909 - RNA, 64 nt, hsa
ugcuucagaauuggaauguuuauauuauguagaaaucuucaaagguagcauuauuaaauagcaa

SEQ ID NO: 697910 - RNA, 64 nt, hsa
agggguuuaaaccucuuucuucugcuuuuuccugaucuucaaaccucaaagagccaaguuaaaa

SEQ ID NO: 697911 - RNA, 64 nt, hsa
aguucucuuguaugauaauuugguauuuacucaaaucuucaauuucuugccagggugggaagua

SEQ ID NO: 697912 - RNA, 64 nt, hsa
uuuaaggugaaagcauuugacccagggugucuucaucuucaauuuggguuuaauguuauagaaa

SEQ ID NO: 697913 - RNA, 64 nt, hsa
gaacuguaccauaauuauguugaagguagaagugaucuucaaagagauggccauuaacuuagca

SEQ ID NO: 697914 - RNA, 64 nt, hsa
aggcagugcuugaaugagaaaaggcuccuggugcaucuucaaaaugaguccuaaagaacauacu

SEQ ID NO: 697915 - RNA, 61 nt, hsa
aaggaggcuguuccugcuaaucucccaugucaucuucaaccuucuucagaagcucacugcu

SEQ ID NO: 697916 - RNA, 64 nt, hsa
aguaaauggggaaauuaacaggacuuucuucuucaucuucaaacucuucagaagcagcaacagg

SEQ ID NO: 697917 - RNA, 64 nt, hsa
ucuucuucacuucuuccuuguaauuauacuuaagaucuucaauuucuucaaaaaaugaaggauc

SEQ ID NO: 697918 - RNA, 64 nt, hsa
gaucugaauuuggagaggacauggggaagaaucaaucuucaacagauaaucuuuaaguacagac

SEQ ID NO: 697919 - RNA, 64 nt, hsa
cagcuauacuaaaauaaaacuuuauaugcuaauuaucuucaagggucuuucuaaaauaaaaggg

SEQ ID NO: 697920 - RNA, 64 nt, hsa
agaccuuaauggaauaauggguccagaaaacaugaucuucaauggguacuacaacuaauaggug

SEQ ID NO: 697921 - RNA, 64 nt, hsa
aagucaguauacuuuuggaugcucaaaaugccauaucuucaaccaguaggaguuguuucaaguu

SEQ ID NO: 697922 - RNA, 64 nt, hsa
aggaggaggacgaaggccuagacucagcugaaggaucuucaaagcaggaugaagaccuagacuu

SEQ ID NO: 697923 - RNA, 64 nt, hsa
uagacuuaccugaaggccuagacucagcugaaggaucuucaaagcaggaugaagaccuagacuu

SEQ ID NO: 697924 - RNA, 64 nt, hsa
caaagcaggaugaagaccuagacuuaccugaaggaucuucaaagcagaaugaagaccuaggcuu

SEQ ID NO: 697925 - RNA, 64 nt, hsa
caaagcagaaugaagaccuaggcuuaccugaaggaucuucaaagcaggaugaagaccuagacuu

SEQ ID NO: 697926 - RNA, 64 nt, hsa; identical to SEQ ID NO: 172497

SEQ ID NO: 697927 - RNA, 64 nt, hsa; identical to SEQ ID NO: 172498

SEQ ID NO: 697928 - RNA, 64 nt, hsa
cuuaauaccaauuucucugaguuucuugaaaugucuuuaaaacagacauuuuucucaccaaaca

SEQ ID NO: 697929 - RNA, 64 nt, hsa
uguauacauuuuaggaaauguuacuuuuguuaaucuuuaaaaaauacaccuaaugaaagacauu

SEQ ID NO: 697930 - RNA, 64 nt, hsa
gaucugcaauucaguucaacacaaguuuguugagcuuuaaaauguauuugaaguaauauuuaaa

SEQ ID NO: 697931 - RNA, 64 nt, hsa
cauguacaguguuacauuauauauguauugugaacuuuaaaagacuauuuugauaaauuuauaa

SEQ ID NO: 697932 - RNA, 64 nt, hsa
gagccaauuugaguuaguuuugcauccuggggggcuuuaaaauacagcaugcagugaaagauca

SEQ ID NO: 697933 - RNA, 64 nt, hsa
gaaugucagucagucucuguaguuaaaacuuuuucuuuaaaauucaauuaagguacuucucccu

SEQ ID NO: 697934 - RNA, 64 nt, hsa
gaaugucagucagucucuguaguuaaaacuuuuucuuuaaaauucaauuaaguuacaccagaau

SEQ ID NO: 697935 - RNA, 52 nt, hsa
cuacaaaggagcacaaaugagccuuuaaaaaccaauucugagacugaacuuu

SEQ ID NO: 697936 - RNA, 64 nt, hsa
aagggacugcaauuauucaguauuuuuuucuuuccuuuaaaaaaauauaucugaaguuucuugu

SEQ ID NO: 697937 - RNA, 64 nt, hsa
agauugaaaaaugggcuuccuaauggguuaaauccuuuaaaacaaggaguugugggggaagggu

SEQ ID NO: 697938 - RNA, 64 nt, hsa
cuugguuuccagagggucuggacugguuugggugcuuuaaaauagauauuuaguucaguggugc

SEQ ID NO: 697939 - RNA, 64 nt, hsa
uuauauguucuuuuuaacaaauauuguguacaaccuuuaaaacaucaauguuuggaucaaaaca

SEQ ID NO: 697940 - RNA, 64 nt, hsa
uguccaauuucauuucagaauaaaaagcuagcaucuuuaaaaaucucagauugcuugcuuacag

SEQ ID NO: 697941 - RNA, 64 nt, hsa
acuguguaaaguuucuaauucacaacauuaauuccuuuaaaauacacagccuucugccucugua

SEQ ID NO: 697942 - RNA, 64 nt, hsa
uaaccaaugaugguguuugcuucuaggauauacacuuuaaaagaacucacugucccaguggugg

SEQ ID NO: 697943 - RNA, 64 nt, hsa
uuuucuuucacuguacuuaaauuuaguguuaguacuuuaaaauuuuuaauuuaccagucuuuaa

SEQ ID NO: 697944 - RNA, 64 nt, hsa
uucauagacuauuuccuuuuucaucuuugucauucuuuaaaaguguauguacugguuacaucaa

SEQ ID NO: 697945 - RNA, 64 nt, hsa
ggaggcaaacugcacaagcuuguaaaugguucgucuuuaaaauguacauaaguggaacauuuaa

SEQ ID NO: 697946 - RNA, 64 nt, hsa
acagccaggagcuaauuguucaagaaguguugaacuuuaaaaagacaagaccacuuguugaaau

SEQ ID NO: 697947 - RNA, 64 nt, hsa
gguuucuacagcaacccuagauauaaaauuguggcuuuaaaaaugcaugaaaccaccuuuaauu

SEQ ID NO: 697948 - RNA, 64 nt, hsa
uuacaaauuaaaaaaacauuuuuuucuugguagucuuuaaaaauuaggggauugaaaggaucca

SEQ ID NO: 697949 - RNA, 64 nt, hsa
aacauuuugcauguguaaagcuucaugaaguucucuuuaaaaaauaccaaagcuuguuuauuuc

SEQ ID NO: 697950 - RNA, 64 nt, hsa
uuauucuuaauaauuauuaaucccuucaaugaaacuuuaaaaaaacugaauuuuuauacauggc

SEQ ID NO: 697951 - RNA, 64 nt, hsa
ugugguuccagcucaacuuuuaauauauugucuccuuuaaaacuaucaugguuauaauucuauu

SEQ ID NO: 697952 - RNA, 64 nt, hsa
acuucaguuuugccaagugcaaugguguugccuucuuuaaaaaaugccguuuucuuacacuacc

SEQ ID NO: 697953 - RNA, 64 nt, hsa
ugagauucaagugaauggaaggaaaaccacaugccuuuaaaacuaaacuguaauaauuaccugg

SEQ ID NO: 697954 - RNA, 64 nt, hsa
cuaaauuuugguaccauaccaacuggaauuuaggcuuuaaaaauaauguuucaaggccaggugu

SEQ ID NO: 697955 - RNA, 64 nt, hsa
auuaugcuaaguuaaaauacaguuuaguuauuugcuuuaaaauaaacucuucuuuuuuucuuua

SEQ ID NO: 697956 - RNA, 64 nt, hsa
aacugaaauuugcugcugauauguugaguuuguucuuuaaaaaauagcucauauaucucaucuu

SEQ ID NO: 697957 - RNA, 64 nt, hsa
uagugcuuucugauuacucgcauucuguuucuugcuuuaaaagaagaguaaagacaagaguguu

SEQ ID NO: 697958 - RNA, 64 nt, hsa
auaaaucuauuuucuucagacuucugcaauaguucuuuaaaaucacaacaguuagcaagcugac

SEQ ID NO: 697959 - RNA, 64 nt, hsa
auacuguauaguaaaaguuggucuaauaguagaacuuuaaaauuuuuucuuauugugaggaauc

SEQ ID NO: 697960 - RNA, 64 nt, hsa
gcauauggaugugaagugaaaauauuagccuuaacuuuaaaauuuggguguuugauaguguuua

SEQ ID NO: 697961 - RNA, 64 nt, hsa
aaguuuauuuugugaugcccucuugguuuugauacuuuaaaaucuguggcacccguucuacaug

SEQ ID NO: 697962 - RNA, 64 nt, hsa
uuuuuuaacagauagaauuuguauuuuuauuguacuuuaaaaagauuuauguaauagguauaua

SEQ ID NO: 697963 - RNA, 64 nt, hsa
uuauuuagauucacuuaacaaacaaauuuuucugcuuuaaaaaugucuuauugucccaagugua

SEQ ID NO: 697964 - RNA, 64 nt, hsa
agauuuaauauuacagauaaaauguaaacuguuucuuuaaaauuggggcuucaacuuuggaauu

SEQ ID NO: 697965 - RNA, 64 nt, hsa
aacugaaauuugcugcugauauguugaguuuguucuuuaaaaaauaucucauauaucucgucuu

SEQ ID NO: 697966 - RNA, 64 nt, hsa
auugugcuaaguuaaaauacaguuuaguuauuugcuuuaaaauaaacucuucuuuuuuucuuua

SEQ ID NO: 697967 - RNA, 64 nt, hsa; identical to SEQ ID NO: 697954

SEQ ID NO: 697968 - RNA, 64 nt, hsa
ucuaguuuguauuuuucucucagauauuuuucuucuuuaaaaaucuuucccagaaguugguucc

SEQ ID NO: 697969 - RNA, 64 nt, hsa
ucuuugcaacugauuuugcaaaaaaaaauuguagcuuuaaaauaacagggucuaaguauuuuaa

SEQ ID NO: 697970 - RNA, 64 nt, hsa
ugcuggcaccugcuauacuggaguauugcuaugucuuuaaaaaauuuuuuuuauuauauuuuau

SEQ ID NO: 697971 - RNA, 64 nt, hsa
guucuuuuauaaauguaauaaggaauaucuugcucuuuaaaauuuauuaggauuuuuaugagua

SEQ ID NO: 697972 - RNA, 64 nt, hsa
aacuaacaaacacccaaacuguuuggauugauugcuuuaaaaaacaaaccuggcucuuaccuuu

SEQ ID NO: 697973 - RNA, 64 nt, hsa
caaauggggcauucaaguugugagcucagaauuacuuuaaaaggagguaacagccagccauuac

SEQ ID NO: 697974 - RNA, 64 nt, hsa
ugcauuuuacuuguuuaugauggcauaaccauugcuuuaaaauguuuagacaguagaauauuga

SEQ ID NO: 697975 - RNA, 64 nt, hsa
uugccuuuugcauaagccucuuuauaacauguaucuuuaaaacaauuaagucuuuaggaaugug

SEQ ID NO: 697976 - RNA, 64 nt, hsa
aaaauuuuaaaacuauuuuuauauuuuuuuaaaucuuuaaaaauuuuaauuacugugauauuga

SEQ ID NO: 697977 - RNA, 64 nt, hsa
aaguacauuuuaugucguuuaauauaauuauuuacuuuaaaaauuguacuucagaacaucagau

SEQ ID NO: 697978 - RNA, 64 nt, hsa
ccaucuuaaaugacagugaauugacccauguucccuuuaaaauuaaaaaaaagaagagccuugu

SEQ ID NO: 697979 - RNA, 64 nt, hsa
gaaccuuaaccucucuaagccacagcuucuucaucuuuaaaauaaggauaauaaucauucuuuc

SEQ ID NO: 697980 - RNA, 64 nt, hsa
auauauugaaauaaagaauuauguaaaagccauucuuuaaaauauuuauagcauaaauauaugu

SEQ ID NO: 697981 - RNA, 64 nt, hsa
uuguuagcaugcugcuugguuuucuuacuuagugcuuuaaaauguuuuuuuuuauguuuaagag

SEQ ID NO: 697982 - RNA, 64 nt, hsa
uugugugcauuuuuuucucccucuuuaaaaaacccuuuaaaagaaaaaaaaaaguagauagugc

SEQ ID NO: 697983 - RNA, 64 nt, hsa
cuauucacugcuuugugugcauuuuuuucucccucuuuaaaaaacccuuuaaaagaaaaaaaaa

SEQ ID NO: 697984 - RNA, 64 nt, hsa
auuaagcuugagauuguucugaaaguaucaauugcuuuaaaacuguuguaaguacaguuggcaa

SEQ ID NO: 697985 - RNA, 64 nt, hsa
uaguuguuuuauccauuaucaucuuugauuaagacuuuaaaaaaaugcuauuuccaguuaaugc

SEQ ID NO: 697986 - RNA, 64 nt, hsa
gagugugcuaggauaccugaaaccugaugguuaucuuuaaaauuaaugguuuuucuccugaaau

SEQ ID NO: 697987 - RNA, 64 nt, hsa
acagaaauguucuacaucucugaaugaccucugacuuuaaaaaaguuuuuauuugcauggcugu

SEQ ID NO: 697988 - RNA, 64 nt, hsa
cacuccagccugggcaauauagcaagaccccauccuuuaaaaaauuuuagaacuuuuuuaaaau

SEQ ID NO: 697989 - RNA, 64 nt, hsa
auaaugcacagggcuugagcuuucugucauuugacuuuaaaaggaaguuucauucauauuuauc

SEQ ID NO: 697990 - RNA, 64 nt, hsa
agucccaucuccacuauuuagaaauguucucagacuuuaaaauaaugcacagggcuugagcuuu

SEQ ID NO: 697991 - RNA, 64 nt, hsa
uccuuuucucugagaguuuuaauacuuucaaggacuuuaaaaaaauaaucauguuugaauuguu

SEQ ID NO: 697992 - RNA, 64 nt, hsa
aacacauuagucacaagaaucccugauugcugcacuuuaaaaaauucuuuaccuuuuccuugag

SEQ ID NO: 697993 - RNA, 64 nt, hsa
aauaauuaaacauuuggaacauuugaauuugaaacuuuaaaaaaauguuguacgaaauuuuacu

SEQ ID NO: 697994 - RNA, 64 nt, hsa
aguaccaaaugcuuuaaaaacuauuuaacuugagcuuuaaaaaucauuguauggauaguaaaau

SEQ ID NO: 697995 - RNA, 64 nt, hsa
ucaaaaacuguauugaugacaguaguaccaaaugcuuuaaaaacuauuuaacuugagcuuuaaa

SEQ ID NO: 697996 - RNA, 64 nt, hsa
guuuauauuuuuuucaccuuuuaaacaaaaaauucuuuaaaauauuuuaaugcauucuuuugaa

SEQ ID NO: 697997 - RNA, 64 nt, hsa
acuuacaaaaacuugcagcaguaguuuguucuugcuuuaaaauuucguuuuugguuuagauuau

SEQ ID NO: 697998 - RNA, 64 nt, hsa
uucugaguugaccaauaaauaaaaauaccacuuucuuuaaaaaagccuagggaauugaagcucu

SEQ ID NO: 697999 - RNA, 64 nt, hsa
aaaaaagaaaagaaaaagcagcauccuuauauuucuuuaaaauacauagaaauaaaguuaguaa

SEQ ID NO: 698000 - RNA, 64 nt, hsa
aaaauaauaguggcccugaaggaauaaauuccagcuuuaaaaaccaagucugaggaaauauuug

SEQ ID NO: 698001 - RNA, 64 nt, hsa
gaauuauuguauuuaaaaaaaaacuaauacuuaucuuuaaaauaguaaauaggauuuuaaacag

SEQ ID NO: 698002 - RNA, 64 nt, hsa
cagaucaaauacuaauaaacaauuagaaaucuuacuuuaaaaaacuuauaacucacuugucuuc

SEQ ID NO: 698003 - RNA, 64 nt, hsa
ggcucccaucaugccauuuuuuguucauuuuaaucuuuaaaaaauaaaaauuaggcauauuaau

SEQ ID NO: 698004 - RNA, 64 nt, hsa
auagauguugaaaauacacgaauuuagauacaagcuuuaaaaccaguuuauuuauaaauaaaac

SEQ ID NO: 698005 - RNA, 64 nt, hsa
uuuucaguccuucucccaacccccugcaaauugucuuuaaaacaacaacacauaaggaaucuga

SEQ ID NO: 698006 - RNA, 64 nt, hsa
aagccaauguauuaauuuuuuuuugcauggagggcuuuaaaauuugugcucuuuuucauauuuu

SEQ ID NO: 698007 - RNA, 64 nt, hsa
agauagguuuagccuuuaaguguauguuuuuauacuuuaaaauaagaaauauaaccuuuuaagc

SEQ ID NO: 698008 - RNA, 64 nt, hsa
aagcacacuaaccccucggaaguuguuuuaccuacuuuaaaaguuuuaauggauugcaccucug

SEQ ID NO: 698009 - RNA, 64 nt, hsa
ugguguuuaacuaagggccauccaaccauccaaccuuuaaaaaacaaaacgaaagugcuucuca

SEQ ID NO: 698010 - RNA, 64 nt, hsa
cauauauuauuugcagugcaguauagaauaggcacuuuaaaacacucuuuccccgcaccccagc

SEQ ID NO: 698011 - RNA, 64 nt, hsa
ucuauaauuuccauuuacuuaagacuuaaugagacuuuaaaagcauuuuuuaaccuccuaagua

SEQ ID NO: 698012 - RNA, 64 nt, hsa
gaacugaugcgacuuguuuugcugcuugguagcacuuuaaaaaauuuuuugauuaaugaagaaa

SEQ ID NO: 698013 - RNA, 64 nt, hsa
gcacuccagccugggugacagagcaauacccugucuuuaaaaauaaaagcuauuacuuggcaaa

SEQ ID NO: 698014 - RNA, 64 nt, hsa
uauuauucccauuuuacaaauaauguaacugaggcuuuaaaaagccaagacaucugcccaaagu

SEQ ID NO: 698015 - RNA, 64 nt, hsa
gcuugaagccauuuauagacgagcuucaaagcaacuuuaaaagauucuucuguagaaguaugag

SEQ ID NO: 698016 - RNA, 64 nt, hsa
uauacauuuuguuucucucauaagaccauauucccuuuaaaagaguaagcuucaauaugugaau

SEQ ID NO: 698017 - RNA, 64 nt, hsa
acugaguuaauaauguaaauaaguguguggccuucuuuaaaauagcuggcuaacauaggaggca

SEQ ID NO: 698018 - RNA, 64 nt, hsa
ugcaccaaagcaucggcaaaaacaauacuauauucuuuaaaagugcucagguagccaaggcccu

SEQ ID NO: 698019 - RNA, 64 nt, hsa
agcagaaauagaaauacaagacugguaaacaugccuuuaaaaauauauauauuuucaacuagua

SEQ ID NO: 698020 - RNA, 64 nt, hsa
aaaggauucaaacgcaacucaaaucugugcuggacuuuaaaaaaacaauucaggaccaaauuuu

SEQ ID NO: 698021 - RNA, 64 nt, hsa
aaaguuuuaaacgaaauacugcucuguccagaggcuuuaaaacuggugcaauuacagcaaaaag

SEQ ID NO: 698022 - RNA, 64 nt, hsa
ugcuccuucuuagcaaucaauauuuuucugcauucuuuaaaagacaagagaauuugguuauaaa

SEQ ID NO: 698023 - RNA, 64 nt, hsa
auaggaaaaaagaaauacgucucauucuucaauacuuuaaaauggcuuuuuccagugugcuccu

SEQ ID NO: 698024 - RNA, 64 nt, hsa
caaguuuguauauugaauuacauuaaggaguguucuuuaaaaagagaaauaaauauacaauuac

SEQ ID NO: 698025 - RNA, 64 nt, hsa
ggacacuagguugccacagaccuaugcuaggugucuuuaaaaaauuaaggugacaaagcacaug

SEQ ID NO: 698026 - RNA, 64 nt, hsa
aacuaaaauuguuagguaaguuauuuauauauaacuuuaaaagaaguagaagauuuuuuggaga

SEQ ID NO: 698027 - RNA, 64 nt, hsa
uguugauugugcuuuuauguaauaaaaugcaguacuuuaaaacauuuagauugugugugaacuu

SEQ ID NO: 698028 - RNA, 64 nt, hsa
ccaguucaaaguuugcuuaguuacaacaaagcaccuuuaaaaaaaauacauuuuaaaaaaacau

SEQ ID NO: 698029 - RNA, 64 nt, hsa
auacaccaaggaaacuggauccagaauuccuaaacuuuaaaaugguacugucugcggaguggag

SEQ ID NO: 698030 - RNA, 64 nt, hsa
aaaaugcuaauuauuucccugauuaggaaaguuucuuuaaaaaacacguaauuuugccuagugc

SEQ ID NO: 698031 - RNA, 64 nt, hsa
auuaccaagaaaauauugaguuuaccugauuaaacuuuaaaaguuaauuguagauuuaaauugu

SEQ ID NO: 698032 - RNA, 64 nt, hsa
auuuuguuuaauauugguugaacaagaaaucugacuuuaaaagauuauuaaggagaauauuccu

SEQ ID NO: 698033 - RNA, 64 nt, hsa
uuaaaaaaauuggaaacgguuuucuuagccccagcuuuaaaagcuagagaucucagagaaauag

SEQ ID NO: 698034 - RNA, 64 nt, hsa
auguuacacugaucuaaaggacauauauauaacccuuuaaaaaaaaaaucacugccucauucuu

SEQ ID NO: 698035 - RNA, 64 nt, hsa
auacuuuaugcucucugaaauguaugacacccagcuuuaaaacaaacaaacaaacaaacaaaaa

SEQ ID NO: 698036 - RNA, 64 nt, hsa
uaaagacgugccaaugaauuauuggaauaucacacuuuaaaaaccgccuuguaaguucugggga

SEQ ID NO: 698037 - RNA, 64 nt, hsa
guguugauaaaaacuaauuuuagaaguuugaagacuuuaaaacauuucauacuacuauuguuuu

SEQ ID NO: 698038 - RNA, 64 nt, hsa
uuccagugucuucgccacauaaaauagccauuuucuuuaaaauaguuuuggacuaacgaagcug

SEQ ID NO: 698039 - RNA, 64 nt, hsa
cucauuuuaacaaauaugaccgagucuaguuuuucuuuaaaaggauaguuuaugaguaaucuuu

SEQ ID NO: 698040 - RNA, 64 nt, hsa
uaguuuuucuuuaaaaggauaguuuaugaguaaucuuuaaaaccauuuccauaccaucuguaua

SEQ ID NO: 698041 - RNA, 64 nt, hsa
uauuaccacauaguauuuuuauguuacccaucaucuuuaaaaacauuauaggcugggcauggug

SEQ ID NO: 698042 - RNA, 64 nt, hsa
guugauagaaaauauuaguuucagaauuacccuccuuuaaaaaauaagagacuauuuguuuucu

SEQ ID NO: 698043 - RNA, 64 nt, hsa
uuuaauuucuaugaauaaaagaaauuuuuaaaaacuuuaaaauuuuaaauauuagucaaaauac

SEQ ID NO: 698044 - RNA, 64 nt, hsa
aacucucuccagaaaauggauggagauaacuugucuuuaaaacuguaggccagccuuagccacu

SEQ ID NO: 698045 - RNA, 64 nt, hsa
ucuuccaaagagauggcaauaugcugggcaucuacuuuaaaacaaaguugucugauuuuugcaa

SEQ ID NO: 698046 - RNA, 64 nt, hsa
aaauuuauauagcucucauguauugaaggugcuacuuuaaaaacuguguuaauguacuugcaaa

SEQ ID NO: 698047 - RNA, 64 nt, hsa
ccuccugccuuuaguucuaaaugguucugaauagcuuuaaaagaugaauaagaaaaaagaucaa

SEQ ID NO: 698048 - RNA, 64 nt, hsa
auugugacuguacuuaaugccacugaacuguacacuuuaaaauggaaaauuuauauguauuuuu

SEQ ID NO: 698049 - RNA, 64 nt, hsa
gacugauuguauauaguaagaaaagaucaaaagacuuuaaaaccuaaaugacuuuugacauaca

SEQ ID NO: 698050 - RNA, 64 nt, hsa
augaaaucagugggaagcagaacaacagaaggaacuuuaaaagcaacaagcaauuauguaccau

SEQ ID NO: 698051 - RNA, 64 nt, hsa
agauauaccaaaaagucuuauaauaggaauuuaacuuuaaaaacccacuuauugauaccuuacc

SEQ ID NO: 698052 - RNA, 64 nt, hsa
uaauaaacaagacacaacguuuuuauacaacauacuuuaaaauauuaaggaguuuucuuaauuu

SEQ ID NO: 698053 - RNA, 64 nt, hsa
ugaagcuucaguauaccauguuugcauaguuuaucuuuaaaaacaacuuuaaagguucuuuugu

SEQ ID NO: 698054 - RNA, 64 nt, hsa
acguagcugcaguuguccacgauggauauugguucuuuaaaauauaucugaaaguaguagucag

SEQ ID NO: 698055 - RNA, 64 nt, hsa
aaaaaugaaaagcaauacaacuuuaccauaaagccuuuaaaaccaguaacgugcugcucaagga

SEQ ID NO: 698056 - RNA, 64 nt, hsa
agcuaacaucuuuacguacuguaacugcucagagcuuuaaaaguaucuuuaacaauugucuuaa

SEQ ID NO: 698057 - RNA, 64 nt, hsa
cagaauaccuaagcugcuucuuuaacauagagaucuuuaaaaagggaaggucaagcaaagaacu

SEQ ID NO: 698058 - RNA, 64 nt, hsa
uaauaugaucaaaguuaagcaauagugguaaaaucuuuaaaacuagauucuugcuucugauaug

SEQ ID NO: 698059 - RNA, 64 nt, hsa
caagggugggagguuuuuagaagaguauauaucucuuuaaaaaaaaacagaaagaaaaauauuu

SEQ ID NO: 698060 - RNA, 64 nt, hsa
gugcccuagaugaccauuuuuauuuuagugccuacuuuaaaacaguauaaaaauuucugcuuuu

SEQ ID NO: 698061 - RNA, 64 nt, hsa
aguguccuaaauauuaauauccuguaauaaagcucuuuaaaaugaaauuguccuuugauuuuuu

SEQ ID NO: 698062 - RNA, 64 nt, hsa
ugaaagacaguaugagaaaaauauucaaguaacacuuuaaaaccaguuacccaaaaucugauua

SEQ ID NO: 698063 - RNA, 64 nt, hsa
uuaucaguuuucaauagauuaaauaaaaugauuacuuuaaaaauaauaaaauuuaucuaauuua

SEQ ID NO: 698064 - RNA, 64 nt, hsa
aaaguauaaaacauuaaaaauaacccuagauauacuuuaaaauaauguuauauuuaugcuaaaa

SEQ ID NO: 698065 - RNA, 64 nt, hsa
ugggagacacuaguaguauauguuuguaauguuacuuuaaaauuaucuuuuuauuuuauaaggc

SEQ ID NO: 698066 - RNA, 64 nt, hsa
uauuagugguuuacaaugcgcuuuagacauauuucuuuaaaaugcaagcagugagaaauaagac

SEQ ID NO: 698067 - RNA, 64 nt, hsa
cccuaccuauccugaauggucugucauugucugccuuuaaaauccuuccucuuucuuccuccuc

SEQ ID NO: 698068 - RNA, 64 nt, hsa
ucucuccuuaguugaugagacuguguuuaucucccuuuaaaacccuaccuauccugaauggucu

SEQ ID NO: 698069 - RNA, 64 nt, hsa
aaaguguuguuuucaaagccaucuuuaaauaguucuuuaaaaauaggucuuuuuuuuauauuuu

SEQ ID NO: 698070 - RNA, 64 nt, hsa
aaauuaaccuuugugcaauaccaagaaaauagcucuuuaaaagaaugucuuuguaugucucaag

SEQ ID NO: 698071 - RNA, 64 nt, hsa
guacuucuuuuugugagcuuacuugccuggauugcuuuaaaauuaaccuuugugcaauaccaag

SEQ ID NO: 698072 - RNA, 64 nt, hsa
uucagaauaggauaauuagguauucgaauuuugucuuuaaaauucaugugguuucuaugcaaag

SEQ ID NO: 698073 - RNA, 64 nt, hsa
ggcucgacuauagaaaacuccacugacugucgggcuuuaaaaagggaagaaacugcugagcuug

SEQ ID NO: 698074 - RNA, 64 nt, hsa
cuuugugcugggaacucuacaucuagcaauuucucuuuaaaaccauaucagagaugcauacaaa

SEQ ID NO: 698075 - RNA, 64 nt, hsa
aaggauaugguagcauuuuauaguacuaguuuugcuuuaaaaugcuauguaaauauacaaaaaa

SEQ ID NO: 698076 - RNA, 64 nt, hsa
aacuccauggcauaaauaguuguauuuuuguguacuuuaaaaucaacuuauaacugugagaugu

SEQ ID NO: 698077 - RNA, 64 nt, hsa
ggaaauuccauacucagauaucagucugcuagaacuuuaaaaugaaggacaaauccuguuaaag

SEQ ID NO: 698078 - RNA, 64 nt, hsa
aaaugaaacaagccgucuuacaagucguuauugccuuuaaaaaucuguuccguuuuuuucccag

SEQ ID NO: 698079 - RNA, 64 nt, hsa
caguuauccucaaaaacaucagcgaugucugaaccuuuaaaacaucuguuagagcaaaauuaaa

SEQ ID NO: 698080 - RNA, 64 nt, hsa
guccagaauucuauuuuaaccugauguugagcaccuuuaaaauguucguauguguguugcacua

SEQ ID NO: 698081 - RNA, 64 nt, hsa
accacucuccacuccacgaggaugugaaacgguucuuuaaaaugggauuuuagagccucgggaa

SEQ ID NO: 698082 - RNA, 64 nt, hsa
cuaucugcugcaccuucacucuccaggguacaugcuuuaaaaccgacccgcaacaaguauugga

SEQ ID NO: 698083 - RNA, 64 nt, hsa
agcccgaagucugcugcugugcagcauggaauuccuuuaaaaaggugcacuacaguuuuagcgg

SEQ ID NO: 698084 - RNA, 64 nt, hsa
aguuugugucaugagaauguaagucuuuuuucuacuuuaaaauuuaguagguucacugaguaac

SEQ ID NO: 698085 - RNA, 64 nt, hsa
guguuuuacuuuugaauguuacaaaaggaaauaacuuuaaaacuauucucaagagaaaauauuc

SEQ ID NO: 698086 - RNA, 64 nt, hsa
uuauuguuugaagcgaguuaauauucucaguugucuuuaaaaaucaguuacucuaauuccaggu

SEQ ID NO: 698087 - RNA, 64 nt, hsa
uuuuauuacugaacuagcaacuagccuuuuccaccuuuaaaaguugugccaagucauaaucaua

SEQ ID NO: 698088 - RNA, 64 nt, hsa
ggcauuuucucuacacacucacccucuuccaguucuuuaaaaacguuuaugauauuaagaucaa

SEQ ID NO: 698089 - RNA, 64 nt, hsa
ugcaagagccacauuuacaaacaacaaacuugaucuuuaaaaauguuuuuaaaacucucugagu

SEQ ID NO: 698090 - RNA, 64 nt, hsa
uguuuuguuccaaucaacuuagcaagucuuucaacuuuaaaauuaucaaucuuugauaugauca

SEQ ID NO: 698091 - RNA, 64 nt, hsa
agugaucugauccauaguauccuaugccuauacacuuuaaaauguauauacauuuuagacaaaa

SEQ ID NO: 698092 - RNA, 64 nt, hsa
cuuuuauaaaaaacccuuuguucauauuucuucccuuuaaaauauguaaugucaaaaaugacuc

SEQ ID NO: 698093 - RNA, 64 nt, hsa
agcaugcaucuguuuauucuauaguuauuaaguucuuuaaaauguaaagccaugcuggaaaaua

SEQ ID NO: 698094 - RNA, 64 nt, hsa
gggcauccucuuuuuccaacuuggcugcaggaaucuuuaaaagaugcuuuuaacagagucugaa

SEQ ID NO: 698095 - RNA, 64 nt, hsa
cuuaagcaaaagaaaaagauuacccaaaaacugucuuuaaaagagagagagagaaaaaaaaaau

SEQ ID NO: 698096 - RNA, 64 nt, hsa
ucgguuccgaugaauucuuauccccugccccuuccuuuaaaaaacuuagugacaaaauagacaa

SEQ ID NO: 698097 - RNA, 64 nt, hsa
aaaauagucuauauuuuaaccugcauaaaaaggucuuuaaaauauuguugaacacuugaagcca

SEQ ID NO: 698098 - RNA, 64 nt, hsa
cccccuaguuugugagaaacaucucaauaaagugcuuuaaaaagauuguguuaccagaauauuu

SEQ ID NO: 698099 - RNA, 64 nt, hsa
ugauuaccaccuucgaagcuauauauuuugcauacuuuaaaaucaccuaacuuggacugcuuga

SEQ ID NO: 698100 - RNA, 64 nt, hsa
acagaaauugcuuuuaaaaaauaucuggaacuaucuuuaaaaaaacuuuauuaauaaucaugua

SEQ ID NO: 698101 - RNA, 64 nt, hsa
accuaccaaaaaauggaaaagaauuuuacaugcacuuuaaaauaguaaaauggaaagugaauuu

SEQ ID NO: 698102 - RNA, 64 nt, hsa
uucauacuucgggaauauuuuauaaguaauauaucuuuaaaagaaaauuacccuuugacuuuua

SEQ ID NO: 698103 - RNA, 64 nt, hsa
cuuuuuaugucugucaucauucugcccccuuugccuuuaaaacuuacaaaaauacguguuuguu

SEQ ID NO: 698104 - RNA, 64 nt, hsa
uucucaaucuuagcuacauauuagccuggcagagcuuuaaaaaauugauaccuggguccuauuc

SEQ ID NO: 698105 - RNA, 64 nt, hsa
ucaacuucaacuugcauucucagaaugauagugccuuuaaaaauuuuuuuauuuuuuaaagcau

SEQ ID NO: 698106 - RNA, 64 nt, hsa
cauuguuggaccaugacauaguauacucaacugacuuuaaaacuauggucaacuucaacuugca

SEQ ID NO: 698107 - RNA, 64 nt, hsa
uuguaaauguuaaucuuucucaaaugugcacauucuuuaaaaguguguuccuaaguagaaauac

SEQ ID NO: 698108 - RNA, 64 nt, hsa
ccauguuauaaugccauuagcaguuacuuaaaugcuuuaaaaauugcugauuaguuuucaaugu

SEQ ID NO: 698109 - RNA, 64 nt, hsa
cuaccugugcugaaauuugggggaaguuuagguccuuuaaaaaaacauauuaaucauugacuac

SEQ ID NO: 698110 - RNA, 64 nt, hsa
uauuuaaaguagaaauuuaauuuguagauauaaccuuuaaaaauuuucucauuaagacaauguu

SEQ ID NO: 698111 - RNA, 64 nt, hsa
acaaccuuggaaaaguuauuucccuuuguaauaccuuuaaaaauccagaguauuauauucauuu

SEQ ID NO: 698112 - RNA, 64 nt, hsa
gaucuauucuucagauauucaaaaacauuuuuugcuuuaaaaugcauaucuuuaauuggguguu

SEQ ID NO: 698113 - RNA, 64 nt, hsa
uaaaucuuaaaauugcugaauuuacccucauauucuuuaaaaaacuuaaagcauuaugaaugua

SEQ ID NO: 698114 - RNA, 64 nt, hsa
cagcuucuuuauuuccuccuaauggaaacauuaucuuuaaaaguugcauauaggaaauauacau

SEQ ID NO: 698115 - RNA, 64 nt, hsa
aaguauaguuaaaacauuuguucuacaaauuaaccuuuaaaaauauaauuacugcuaaaaauag

SEQ ID NO: 698116 - RNA, 64 nt, hsa
aaacaucaaauaaaaauggaaaaaaugaucauggcuuuaaaaaaaaaacaaaaacacacacaca

SEQ ID NO: 698117 - RNA, 64 nt, hsa
uuggguaucacguaaaauuuuuuccaaaggguuacuuuaaaaaucuguuaccacaauuaugaga

SEQ ID NO: 698118 - RNA, 64 nt, hsa
uauaacccccuauuuucaggggguuaaaaaucagcuuuaaaaaaauacauaaaaauuucaucuu

SEQ ID NO: 698119 - RNA, 64 nt, hsa
ucaaugcuauuaacaguaucagguaaaaaguacacuuuaaaauauuuuaaucaggcagaguuuu

SEQ ID NO: 698120 - RNA, 64 nt, hsa
cuuucccaaaaucaaaguagacuaaagcagccaucuuuaaaauccaggaucaucaaugcuauua

SEQ ID NO: 698121 - RNA, 64 nt, hsa
gcuuaucuuugaaacaauauuauuuugaaauuggcuuuaaaauaaaaccauucagauugaaauu

SEQ ID NO: 698122 - RNA, 64 nt, hsa
aaucaauuuauaaagggguaauucauuaauuacacuuuaaaauuggaaagugggauaagaaauc

SEQ ID NO: 698123 - RNA, 64 nt, hsa
accucaaaugcaauacuuuggguugguuucuuuccuuuaaaaaaauuuguauaaaacuggaagu

SEQ ID NO: 698124 - RNA, 64 nt, hsa
gauaaucugggaaagacaccaaaucaugggcucacuuuaaaaaaagaaagaauaaaaaaaccuu

SEQ ID NO: 698125 - RNA, 64 nt, hsa
aaaacacaaaaaauaaaaaaccccuacaaaaaaacuuuaaaaaaaauggcagcaaaggguaguu

SEQ ID NO: 698126 - RNA, 64 nt, hsa
ccauuuguaucuaauguguacaguguaaaauugacuuuaaaaauauugcagugcuauuuuuucu

SEQ ID NO: 698127 - RNA, 64 nt, hsa
ugggaaaggggucaccgugucugacaaaguguaacuuuaaaaagcacguugauuuuuuacaaau

SEQ ID NO: 698128 - RNA, 64 nt, hsa
ggguucccacaaccgaguucuaguucccugaggucuuuaaaaacaaaaacagaauguuguacgu

SEQ ID NO: 698129 - RNA, 64 nt, hsa
ggauaccuuuuucuuauacuuucuccuaggaaaacuuuaaaacuuuaaaaaggcaaaccuacca

SEQ ID NO: 698130 - RNA, 64 nt, hsa
uuuucuuauacuuucuccuaggaaaacuuuaaaacuuuaaaaaggcaaaccuaccaauaggaau

SEQ ID NO: 698131 - RNA, 64 nt, hsa
uucgguggaagauacgaaaagggugugcaauuuccuuuaaaauuuacacgugggaaacauuugu

SEQ ID NO: 698132 - RNA, 64 nt, hsa
aucauucaaaauguggagaauuuaauggcuaaaucuuuaaaagccaaugcaacccacccaauug

SEQ ID NO: 698133 - RNA, 64 nt, hsa
cugguacuuuuaucugucuuugaaagugucugaacuuuaaaaaguuuacauuuuguuucaaaua

SEQ ID NO: 698134 - RNA, 64 nt, hsa
uaauauuccacuccgcagugcaaacaaucucuuccuuuaaaaaggaauaauaauacaauauuua

SEQ ID NO: 698135 - RNA, 64 nt, hsa
auuuuauugaauauaauggccucuuaaaaauuaucuuuaaaacuuacuaugguauauauuuuga

SEQ ID NO: 698136 - RNA, 64 nt, hsa
cugauacuuauuuauaacauuguaaaugauaugucuuuaaaaugauucacuuuuauuguauaau

SEQ ID NO: 698137 - RNA, 64 nt, hsa
aaacacauuugaauauuguguauuucauacuauucuuuaaaaguaaucuuauguccuuuccuac

SEQ ID NO: 698138 - RNA, 64 nt, hsa
cuguuaacaugaaaauggcauuuuuccauaauagcuuuaaaauaauuuuuuaguaauuauuaca

SEQ ID NO: 698139 - RNA, 64 nt, hsa
uacuuuuguuuuaaaaggcuaaaauguuugugugcuuuaaaauucuuaaugaauucacuggcau

SEQ ID NO: 698140 - RNA, 64 nt, hsa
cacagccucaucauuagcaacuuuauauacacagcuuuaaaaaauuugcuuuaaacuguuucag

SEQ ID NO: 698141 - RNA, 64 nt, hsa
gugggaggauuauaaauagagacuuuccuuaagacuuuaaaaauguauuuaaaacuauuuuuua

SEQ ID NO: 698142 - RNA, 64 nt, hsa
uuuuuuauuaaauacuuugugauuuccuauuaagcuuuaaaauaaaucauuguguaaaacacca

SEQ ID NO: 698143 - RNA, 64 nt, hsa
acaaucauuuauaaugaaucaauguuccaguuagcuuuaaaagguauacggugcuaauuaguaa

SEQ ID NO: 698144 - RNA, 64 nt, hsa
auuuggucguaaugaaaauaauuuguaaaauguccuuuaaaaguuuaaugauacuucugauguu

SEQ ID NO: 698145 - RNA, 64 nt, hsa
auuacuuguuaacuucuuacagcaguaguaccuucuuuaaaaaaaaaaaagaaucugcgguauu

SEQ ID NO: 698146 - RNA, 64 nt, hsa
agcugauuuuuuaaaaauuuaaguuuuguaagagcuuuaaaauauuuucacagauaaaaaauug

SEQ ID NO: 698147 - RNA, 64 nt, hsa
gugugcuuuaguacauagccacaaguucuucauucuuuaaaauguuuugacagaucaucucaua

SEQ ID NO: 698148 - RNA, 64 nt, hsa
caugacuguuguuugcacuauauuaucaugucuucuuuaaaaguaaauauuuuugguuucugua

SEQ ID NO: 698149 - RNA, 64 nt, hsa
acuuuuugcuuugcuuuggauaagaaauccuuaccuuuaaaaaaagcuucuagucuccauaacc

SEQ ID NO: 698150 - RNA, 64 nt, hsa
aacugcuucuaauccuuccuuugcuaaaucucaccuuuaaaaacgaaggugacucacuuugcuu

SEQ ID NO: 698151 - RNA, 64 nt, hsa
aauuucauuuuguaaaguuaaaugucagcauucccuuuaaaaguguccauuguucuuugaaagu

SEQ ID NO: 698152 - RNA, 64 nt, hsa
uaaggaugggaacauuuaaauuaaguuaaugggccuuuaaaaaaaaaaaaaggaaacacucaua

SEQ ID NO: 698153 - RNA, 64 nt, hsa
uuaucaaaaaauucuuugucuaauauauuggagucuuuaaaaguguugaagaauaaaauauuaa

SEQ ID NO: 698154 - RNA, 64 nt, hsa
uucuaguauuuucuuauuucacuuuuacaccuaucuuuaaaaggaauuuaaauuuuguuuauau

SEQ ID NO: 698155 - RNA, 64 nt, hsa
acaggacagcgggaaaaaucgaugagcgccaccucuuuaaaaacucacuuacguuuguccuuuu

SEQ ID NO: 698156 - RNA, 64 nt, hsa
auaugcucuuuuaaauguuugguuuauauauuuucuuuaaaaauccugggcuggcacauugacu

SEQ ID NO: 698157 - RNA, 64 nt, hsa
aaaugugauuauuuauauuuauguugaaagcggacuuuaaaaaaaauaaugugcuguaacacag

SEQ ID NO: 698158 - RNA, 64 nt, hsa
gcagcauugucaguacagaccagugguucucaaacuuuaaaaugccucagcaucacuugggagc

SEQ ID NO: 698159 - RNA, 64 nt, hsa
gaggaacuuuacacugaccagcuuuaaaacaguacuuuaaaaggaaaagccuguuacuguuuau

SEQ ID NO: 698160 - RNA, 64 nt, hsa
aaugcacagaccugaggaacuuuacacugaccagcuuuaaaacaguacuuuaaaaggaaaagcc

SEQ ID NO: 698161 - RNA, 64 nt, hsa
aaugaugaauguuacagguuaauaaaguuaauaccuuuaaaaacuuggugaaauuccauuacag

SEQ ID NO: 698162 - RNA, 64 nt, hsa
guuucugacccauuuugacaguuuuuauauacuccuuuaaaaugaugaauguuacagguuaaua

SEQ ID NO: 698163 - RNA, 64 nt, hsa
gcugugaaccugccaauccgcuguaacaacucugcuuuaaaacaaaaccaaacaaaacuuuaaa

SEQ ID NO: 698164 - RNA, 64 nt, hsa
uaacaacucugcuuuaaaacaaaaccaaacaaaacuuuaaaaaaaaaugugugauccagcuuuc

SEQ ID NO: 698165 - RNA, 64 nt, hsa
uuacucuucaguuaagccuuuggaaacagcucgacuuuaaaaagcuccaaaugcagcuuuaaaa

SEQ ID NO: 698166 - RNA, 64 nt, hsa
gaaacagcucgacuuuaaaaagcuccaaaugcagcuuuaaaaaauuaaucugggccagaauuuc

SEQ ID NO: 698167 - RNA, 64 nt, hsa
uaugcacauuauaaugguuacaucugcuuuuugucuuuaaaauaaaaaaaaaaaucagagaaaa

SEQ ID NO: 698168 - RNA, 64 nt, hsa
caugcuaucaguuuuuuggggcaggggagaugaacuuuaaaaaaaaaaaaaaaacuucauuggc

SEQ ID NO: 698169 - RNA, 64 nt, hsa
caacuucuuugaugaauguaacccaauuuuacuucuuuaaaaagucucaauucaagcuggauua

SEQ ID NO: 698170 - RNA, 64 nt, hsa
agcacuugaaaaugggaagcgaugacaaaucugacuuuaaaaaaaaucuuugauuugcacuguu

SEQ ID NO: 698171 - RNA, 64 nt, hsa
guuuugaacuucccuuccuuaaaguacucuaaaccuuuaaaaaaaaaucugauuuaugcagcag

SEQ ID NO: 698172 - RNA, 64 nt, hsa
uaaggcagggacagcagucagaaucgacauaaagcuuuaaaaacucaagguuuuuucaaccuac

SEQ ID NO: 698173 - RNA, 64 nt, hsa
uuuugauucagcucauuaugaaaaacaucccaaacuuuaaaaugcgaaauuauugguuggugug

SEQ ID NO: 698174 - RNA, 64 nt, hsa
agaaucgauaaaaguucaucuuuggacagaaagccuuuaaaaaaaaaaucacucccucuucccc

SEQ ID NO: 698175 - RNA, 64 nt, hsa
auuaagugcuuuuuuuucaucacuugauuauuuucuuuaaaaucagcuauuacaggauauuuuu

SEQ ID NO: 698176 - RNA, 64 nt, hsa
augaauugaagugguugguacauggauaccuguucuuuaaaaggaaugugggagaugagucaag

SEQ ID NO: 698177 - RNA, 64 nt, hsa
aaaaugcacauuuaaagagaagcaucuaccacggcuuuaaaacaaaacaacucugagaugaaca

SEQ ID NO: 698178 - RNA, 64 nt, hsa
agaagauuaaacuuucauauugggcagugguucacuuuaaaacacacacauacacacacaaaac

SEQ ID NO: 698179 - RNA, 64 nt, hsa
cuaaugauuugcuucuauguccagaauauuuuaccuuuaaaaaaaugucauuggcaccauaaau

SEQ ID NO: 698180 - RNA, 64 nt, hsa
ggguauuuaagaaaaccuggagaauaaacucauacuuuaaaagaucacuucucuuuucaguucu

SEQ ID NO: 698181 - RNA, 64 nt, hsa
ucaauuuccauauguuacugaaucugaaaaacaucuuuaaaauucaaacaguuccauuuucucu

SEQ ID NO: 698182 - RNA, 64 nt, hsa
aaaugauacuuaaauaaagaaagugugaggucuacuuuaaaaaaauucaaaugaagagaaaaag

SEQ ID NO: 698183 - RNA, 64 nt, hsa
auaugaacacuggauaaccuaauuuuuuuuaaugcuuuaaaaaaauggcaaaaagacgucaggc

SEQ ID NO: 698184 - RNA, 64 nt, hsa
uguaguugcauuuuugcuaaaaaaaaaaaaaaaccuuuaaaaauuguuggauguguacaaaagu

SEQ ID NO: 698185 - RNA, 64 nt, hsa
guuacaggaaagccagccagaggaagugucagcacuuuaaaauucuagaccccaaaaaacuaca

SEQ ID NO: 698186 - RNA, 64 nt, hsa
uugcuuuugagauagauuguagucuggguagcaucuuuaaaauguaugugggcuuaacuguugu

SEQ ID NO: 698187 - RNA, 64 nt, hsa
gcuuuaaagggaaauuaaaccauucaugaauaaacuuuaaaaaugugaaguguccuuuuccuuu

SEQ ID NO: 698188 - RNA, 64 nt, hsa
gaagacuagugagauuucuguaauaauuuuaauucuuuaaaaagugaaagcuuguuguaaagau

SEQ ID NO: 698189 - RNA, 64 nt, hsa
gacauuccauacuaauauacauuguuuaugcuuucuuuaaaauaacuagaagaacauaaaagaa

SEQ ID NO: 698190 - RNA, 64 nt, hsa
agugucagcaaggugucuuggguuuauuuugguucuuuaaaaaagggaagucuugagguuuuag

SEQ ID NO: 698191 - RNA, 64 nt, hsa
acauauacacugaagaugaguuuuuaaucucuuacuuuaaaaagauuuauuuagaaucgugaau

SEQ ID NO: 698192 - RNA, 64 nt, hsa
aaaaaugugaaguagugaugguuuuugaaauaagcuuuaaaauauagggaucuugaaggcuccc

SEQ ID NO: 698193 - RNA, 64 nt, hsa
ucagaauguauuuuuacuacugcaaguuuuuggucuuuaaaaugucaaguagcaucucucucuu

SEQ ID NO: 698194 - RNA, 64 nt, hsa
ccaaaccuuaguugaaaucagacagaaagaaugucuuuaaaauauacaucuccucuccuuggag

SEQ ID NO: 698195 - RNA, 64 nt, hsa
ucacacagaagguacuaaugucagcucacguggccuuuaaaaaccuacuuccccgcccgcagga

SEQ ID NO: 698196 - RNA, 64 nt, hsa
caaacuaacgguagauaaauuuauuuguacauaacuuuaaaaggaguagaagauuuuuuggaag

SEQ ID NO: 698197 - RNA, 64 nt, hsa
uucuaaacauaaaauaaaucauacuggugaggaacuuuaaaaaugcgaaaaaugugacaaaauc

SEQ ID NO: 698198 - RNA, 64 nt, hsa
gggagaaauagaauggugcucuuaucuuucuugacuuuaaaaaaauuauuaaaaacaaaaaaaa

SEQ ID NO: 698199 - RNA, 64 nt, hsa
aucagaaugauauaaaggagauacauguuucuuccuuuaaaaaauaaacggaaguuacauuguu

SEQ ID NO: 698200 - RNA, 64 nt, hsa
aaauggauagauuguuuuagaguuauuuuguguccuuuaaaaaaaucccauuuaugcaauuuac

SEQ ID NO: 698201 - RNA, 64 nt, hsa
cagauaguauacacaucauaaacaaagaguagaacuuuaaaagaagguaaauaaucauacacag

SEQ ID NO: 698202 - RNA, 64 nt, hsa
uccuuuccugcguuuccuuugccauuuauuuauucuuuaaaaauaaacauuuugugguguguuu

SEQ ID NO: 698203 - RNA, 64 nt, hsa
aaagaaacccauacucuagucguuucugcauuuccuuuaaaaauagcaugggaucauauuuaaa

SEQ ID NO: 698204 - RNA, 64 nt, hsa
ccacugcacuccagccuggugacagcgugagacucuuuaaaaaaagaaauuaaaagaguugaga

SEQ ID NO: 698205 - RNA, 64 nt, hsa
aauuuguaugcaacagagaugcugcagcugaugccuuuaaaagguauucaucauggaagagcug

SEQ ID NO: 698206 - RNA, 64 nt, hsa
gggcugauguaaauguuuuacuuucaacuguguucuuuaaaauaaauccuaccugguuuuuaaa

SEQ ID NO: 698207 - RNA, 64 nt, hsa
aauauauuguuagauuaaaaccauuguauuaagacuuuaaaauguaagcauuguaauucugaaa

SEQ ID NO: 698208 - RNA, 64 nt, hsa
agucuuaaugggaacuuggcauuuuccugaugaucuuuaaaauguggucacuaaacucaggauu

SEQ ID NO: 698209 - RNA, 64 nt, hsa
gcauaugugugugcgugcgugugugcgcacauagcuuuaaaagaagacauucaaaauuugaugu

SEQ ID NO: 698210 - RNA, 64 nt, hsa
aaacuucuuagguguuccaggaauuaucaagugacuuuaaaaugacuuuuccaaccugcuuugu

SEQ ID NO: 698211 - RNA, 64 nt, hsa
agagagagauuagaaaacgacauuaggaauuucacuuuaaaaugcgcauuacaaacuucuuagg

SEQ ID NO: 698212 - RNA, 64 nt, hsa
agucuuuugggaaccaaaguauuuuacuguaaaucuuuaaaauaacagaauucagugcucuuuc

SEQ ID NO: 698213 - RNA, 64 nt, hsa
ugcauuauugauuuaaauaaugcugacacguacucuuuaaaaguguucuuuaacacugacuacu

SEQ ID NO: 698214 - RNA, 64 nt, hsa
aacaguaauauuugaagauuuguagaauauucaccuuuaaaacuaguuaguaugcauuuauaau

SEQ ID NO: 698215 - RNA, 64 nt, hsa
ccguucugguuuuucuauuacuuuuuauacuguacuuuaaaagcauuaggcugaaagaguuuau

SEQ ID NO: 698216 - RNA, 64 nt, hsa
aucaggacacaacagagggcagaggccccauuagcuuuaaaauguagccccagguuggagcugg

SEQ ID NO: 698217 - RNA, 64 nt, hsa
auuucucagcugggcaguaaucaauuuaaugguccuuuaaaaugucuguguauuaaaaauuuaa

SEQ ID NO: 698218 - RNA, 64 nt, hsa
uuagaggaggccaguaaugaucagaaccauuuuacuuuaaaauuaauaauauuguauuagagaa

SEQ ID NO: 698219 - RNA, 64 nt, hsa
ggugccucauagguguguggauaugaugacguuucuuuaaaauguauguauuuaacaaauacuu

SEQ ID NO: 698220 - RNA, 64 nt, hsa
gaauuguagaacuauguuauaguccagucuacuucuuuaaaaaccauuuaaacugcuagauagu

SEQ ID NO: 698221 - RNA, 64 nt, hsa
gaauaguccaauagaaaauucauucuuuauaggucuuuaaaaauuacuuuuauuauauuguuua

SEQ ID NO: 698222 - RNA, 64 nt, hsa
aucuuuuaguguuucagauaaccucucaaaaagacuuuaaaauaaugcuauuacacaaagcugc

SEQ ID NO: 698223 - RNA, 64 nt, hsa
uuaagagaauuuuuucuauuacuuauggaucaugcuuuaaaaugauuuuucuugauauuuauuu

SEQ ID NO: 698224 - RNA, 64 nt, hsa
gccuccagugcauccuuacuuagguauuauacuucuuuaaaaagcucugaagcugcuacaauag

SEQ ID NO: 698225 - RNA, 64 nt, hsa
ugauuccuuuuguccacuuauauaguuauuuucucuuuaaaaaaaaauuuuuuuuaauguauua

SEQ ID NO: 698226 - RNA, 64 nt, hsa
auuaauaaaaccauaaaugaaacacuugagcacacuuuaaaaaguacauaaauccaugagucca

SEQ ID NO: 698227 - RNA, 64 nt, hsa
aaaauaaaucauaguaauaauauugaacauucuacuuuaaaaauuauuaauaaaaccauaaaug

SEQ ID NO: 698228 - RNA, 64 nt, hsa
ugaagauggauugaagagaacguccaccuuaaggcuuuaaaagacagugaagcugggugcggug

SEQ ID NO: 698229 - RNA, 64 nt, hsa
guaucuuuagugcuucuuaccugguaacuugagacuuuaaaagaagaaacaaagaggggaagau

SEQ ID NO: 698230 - RNA, 64 nt, hsa
auuacauacacaucagccaucaacuaaaguuguacuuuaaaaauuuacuacaauauguacauuu

SEQ ID NO: 698231 - RNA, 64 nt, hsa
uauuaacacuacucaaagcaaaagugcugcagggcuuuaaaauucucuuccaaccauuuaucuu

SEQ ID NO: 698232 - RNA, 64 nt, hsa
uauaacauuucaguuacuuuucaguuaauuauuccuuuaaaaagaaaauacagcagaaccucac

SEQ ID NO: 698233 - RNA, 64 nt, hsa
caauuuuuuaaauguauuaauagagucaauggaacuuuaaaauauuuuaguagauuuuguaaag

SEQ ID NO: 698234 - RNA, 64 nt, hsa
guguguaauaacacauuguaaagaacagaaauuacuuuaaaaaauaaacagaaauggagaccug

SEQ ID NO: 698235 - RNA, 64 nt, hsa
auucuuuuuauaucuauaccuguuguguaagaaacuuuaaaacauuuguuauuuucucaccuuu

SEQ ID NO: 698236 - RNA, 64 nt, hsa
guaucuuuaguucuuccuaccuaguaacuugagacuuuaaaagaagaaacauggagaagaugug

SEQ ID NO: 698237 - RNA, 64 nt, hsa
ugaaggugguaugaagagaacguccacuuuaaggcuuuaaaagacagugaagcugguuguaggg

SEQ ID NO: 698238 - RNA, 64 nt, hsa
auaaaucauaguaauaauauuauugaacauucuacuuuaaaaauuauuaauaaaaccauaaaug

SEQ ID NO: 698239 - RNA, 64 nt, hsa
auuaauaaaaccauaaaugaaacacuugagcacacuuuaaaaaguacauaaacccaugagucca

SEQ ID NO: 698240 - RNA, 64 nt, hsa; identical to SEQ ID NO: 141970

SEQ ID NO: 698241 - RNA, 64 nt, hsa; identical to SEQ ID NO: 141971

SEQ ID NO: 698242 - RNA, 64 nt, hsa; identical to SEQ ID NO: 141972

SEQ ID NO: 698243 - RNA, 64 nt, hsa; identical to SEQ ID NO: 141973

SEQ ID NO: 698244 - RNA, 64 nt, hsa; identical to SEQ ID NO: 141974

SEQ ID NO: 698245 - RNA, 64 nt, hsa; identical to SEQ ID NO: 141975

SEQ ID NO: 698246 - RNA, 64 nt, hsa; identical to SEQ ID NO: 141976

SEQ ID NO: 698247 - RNA, 64 nt, hsa; identical to SEQ ID NO: 141977

SEQ ID NO: 698248 - RNA, 64 nt, hsa; identical to SEQ ID NO: 141978

SEQ ID NO: 698249 - RNA, 64 nt, hsa; identical to SEQ ID NO: 141979

SEQ ID NO: 698250 - RNA, 64 nt, hsa; identical to SEQ ID NO: 141980

SEQ ID NO: 698251 - RNA, 64 nt, hsa; identical to SEQ ID NO: 141981

SEQ ID NO: 698252 - RNA, 64 nt, hsa; identical to SEQ ID NO: 141982

SEQ ID NO: 698253 - RNA, 64 nt, hsa; identical to SEQ ID NO: 141983

SEQ ID NO: 698254 - RNA, 64 nt, hsa; identical to SEQ ID NO: 141984

SEQ ID NO: 698255 - RNA, 64 nt, hsa; identical to SEQ ID NO: 141985

SEQ ID NO: 698256 - RNA, 64 nt, hsa; identical to SEQ ID NO: 141986

SEQ ID NO: 698257 - RNA, 64 nt, hsa; identical to SEQ ID NO: 141987

SEQ ID NO: 698258 - RNA, 64 nt, hsa; identical to SEQ ID NO: 141988

SEQ ID NO: 698259 - RNA, 64 nt, hsa; identical to SEQ ID NO: 141989

SEQ ID NO: 698260 - RNA, 64 nt, hsa; identical to SEQ ID NO: 141990

SEQ ID NO: 698261 - RNA, 64 nt, hsa; identical to SEQ ID NO: 141991

SEQ ID NO: 698262 - RNA, 64 nt, hsa; identical to SEQ ID NO: 141992

SEQ ID NO: 698263 - RNA, 64 nt, hsa; identical to SEQ ID NO: 141993

SEQ ID NO: 698264 - RNA, 64 nt, hsa; identical to SEQ ID NO: 141994

SEQ ID NO: 698265 - RNA, 64 nt, hsa; identical to SEQ ID NO: 141995

SEQ ID NO: 698266 - RNA, 64 nt, hsa; identical to SEQ ID NO: 141996

SEQ ID NO: 698267 - RNA, 64 nt, hsa; identical to SEQ ID NO: 141997

SEQ ID NO: 698268 - RNA, 64 nt, hsa; identical to SEQ ID NO: 141998

SEQ ID NO: 698269 - RNA, 64 nt, hsa; identical to SEQ ID NO: 141999

SEQ ID NO: 698270 - RNA, 64 nt, hsa; identical to SEQ ID NO: 142000

SEQ ID NO: 698271 - RNA, 64 nt, hsa; identical to SEQ ID NO: 142001

SEQ ID NO: 698272 - RNA, 64 nt, hsa; identical to SEQ ID NO: 142002

SEQ ID NO: 698273 - RNA, 64 nt, hsa; identical to SEQ ID NO: 142003

SEQ ID NO: 698274 - RNA, 64 nt, hsa; identical to SEQ ID NO: 142004

SEQ ID NO: 698275 - RNA, 64 nt, hsa; identical to SEQ ID NO: 142005

SEQ ID NO: 698276 - RNA, 64 nt, hsa; identical to SEQ ID NO: 142006

SEQ ID NO: 698277 - RNA, 64 nt, hsa; identical to SEQ ID NO: 142007

SEQ ID NO: 698278 - RNA, 64 nt, hsa; identical to SEQ ID NO: 142008

SEQ ID NO: 698279 - RNA, 64 nt, hsa; identical to SEQ ID NO: 142009

SEQ ID NO: 698280 - RNA, 64 nt, hsa; identical to SEQ ID NO: 142010

SEQ ID NO: 698281 - RNA, 64 nt, hsa; identical to SEQ ID NO: 142011

SEQ ID NO: 698282 - RNA, 64 nt, hsa; identical to SEQ ID NO: 142012

SEQ ID NO: 698283 - RNA, 64 nt, hsa; identical to SEQ ID NO: 142013

SEQ ID NO: 698284 - RNA, 64 nt, hsa; identical to SEQ ID NO: 142014

SEQ ID NO: 698285 - RNA, 64 nt, hsa; identical to SEQ ID NO: 142015

SEQ ID NO: 698286 - RNA, 64 nt, hsa; identical to SEQ ID NO: 142016

SEQ ID NO: 698287 - RNA, 64 nt, hsa; identical to SEQ ID NO: 142017

SEQ ID NO: 698288 - RNA, 64 nt, hsa; identical to SEQ ID NO: 142018

SEQ ID NO: 698289 - RNA, 64 nt, hsa; identical to SEQ ID NO: 142019

SEQ ID NO: 698290 - RNA, 64 nt, hsa; identical to SEQ ID NO: 142020

SEQ ID NO: 698291 - RNA, 64 nt, hsa; identical to SEQ ID NO: 142021

SEQ ID NO: 698292 - RNA, 64 nt, hsa; identical to SEQ ID NO: 142022

SEQ ID NO: 698293 - RNA, 64 nt, hsa; identical to SEQ ID NO: 142023

SEQ ID NO: 698294 - RNA, 64 nt, hsa; identical to SEQ ID NO: 142024

SEQ ID NO: 698295 - RNA, 64 nt, hsa; identical to SEQ ID NO: 142025

SEQ ID NO: 698296 - RNA, 64 nt, hsa; identical to SEQ ID NO: 142026

SEQ ID NO: 698297 - RNA, 64 nt, hsa; identical to SEQ ID NO: 142027

SEQ ID NO: 698298 - RNA, 64 nt, hsa; identical to SEQ ID NO: 142028

SEQ ID NO: 698299 - RNA, 64 nt, hsa; identical to SEQ ID NO: 142029

SEQ ID NO: 698300 - RNA, 64 nt, hsa; identical to SEQ ID NO: 142030

SEQ ID NO: 698301 - RNA, 64 nt, hsa; identical to SEQ ID NO: 142031

SEQ ID NO: 698302 - RNA, 64 nt, hsa; identical to SEQ ID NO: 142032

SEQ ID NO: 698303 - RNA, 64 nt, hsa; identical to SEQ ID NO: 142033

SEQ ID NO: 698304 - RNA, 64 nt, hsa; identical to SEQ ID NO: 142034

SEQ ID NO: 698305 - RNA, 64 nt, hsa; identical to SEQ ID NO: 142035

SEQ ID NO: 698306 - RNA, 64 nt, hsa; identical to SEQ ID NO: 142036

SEQ ID NO: 698307 - RNA, 64 nt, hsa; identical to SEQ ID NO: 142037

SEQ ID NO: 698308 - RNA, 64 nt, hsa; identical to SEQ ID NO: 142038

SEQ ID NO: 698309 - RNA, 64 nt, hsa; identical to SEQ ID NO: 142039

SEQ ID NO: 698310 - RNA, 64 nt, hsa; identical to SEQ ID NO: 142040

SEQ ID NO: 698311 - RNA, 64 nt, hsa; identical to SEQ ID NO: 142041

SEQ ID NO: 698312 - RNA, 64 nt, hsa; identical to SEQ ID NO: 142042

SEQ ID NO: 698313 - RNA, 64 nt, hsa; identical to SEQ ID NO: 142043

SEQ ID NO: 698314 - RNA, 64 nt, hsa; identical to SEQ ID NO: 142044

SEQ ID NO: 698315 - RNA, 62 nt, hsa
ugacuucaguugagggcaagucucuggaaaagaggcuguaggcaucuggcagcuaccaugca

SEQ ID NO: 698316 - RNA, 62 nt, hsa
agucaauauugucaguacuuugcuuugauugaaggcuguagagcugaguuaccaaaauuucu

SEQ ID NO: 698317 - RNA, 64 nt, hsa
gccccuagauguugccacauucacaucuccuugauggccuuagaucucuugacuagucaaggac

SEQ ID NO: 698318 - RNA, 64 nt, hsa
aaaucuuugguuguguggaugccuguguucagaguggccuuaucuugaccucaguucuggauuu

SEQ ID NO: 698319 - RNA, 64 nt, hsa
aagaaaaugcaucaucaguuugcuauuucccugauggccuuaauuuuagaguggucuuggauua

SEQ ID NO: 698320 - RNA, 64 nt, hsa
aacauguuuaggcaacuagucagaaaaccagcuauggccuuacagaaagggaaaaauuaaccca

SEQ ID NO: 698321 - RNA, 64 nt, hsa
cagcugccacacccccgacacuccugcuguccacuggccuuagcuccugcaaguuccccagugu

SEQ ID NO: 698322 - RNA, 64 nt, hsa
ccacugcaauuccuccuagggcugcacaaucauguggccuuagggcacacuguccugcauccag

SEQ ID NO: 698323 - RNA, 64 nt, hsa; identical to SEQ ID NO: 585264

SEQ ID NO: 698324 - RNA, 64 nt, hsa; identical to SEQ ID NO: 585265

SEQ ID NO: 698325 - RNA, 64 nt, hsa; identical to SEQ ID NO: 585266

SEQ ID NO: 698326 - RNA, 64 nt, hsa; identical to SEQ ID NO: 585267

SEQ ID NO: 698327 - RNA, 64 nt, hsa; identical to SEQ ID NO: 585268

SEQ ID NO: 698328 - RNA, 64 nt, hsa; identical to SEQ ID NO: 585269

SEQ ID NO: 698329 - RNA, 64 nt, hsa; identical to SEQ ID NO: 585270

SEQ ID NO: 698330 - RNA, 64 nt, hsa; identical to SEQ ID NO: 585270

SEQ ID NO: 698331 - RNA, 64 nt, hsa; identical to SEQ ID NO: 585272

SEQ ID NO: 698332 - RNA, 64 nt, hsa; identical to SEQ ID NO: 585273

SEQ ID NO: 698333 - RNA, 64 nt, hsa; identical to SEQ ID NO: 585274

SEQ ID NO: 698334 - RNA, 64 nt, hsa; identical to SEQ ID NO: 585275

SEQ ID NO: 698335 - RNA, 64 nt, hsa; identical to SEQ ID NO: 585276

SEQ ID NO: 698336 - RNA, 64 nt, hsa; identical to SEQ ID NO: 585277

SEQ ID NO: 698337 - RNA, 64 nt, hsa; identical to SEQ ID NO: 585278

SEQ ID NO: 698338 - RNA, 64 nt, hsa; identical to SEQ ID NO: 585279

SEQ ID NO: 698339 - RNA, 64 nt, hsa; identical to SEQ ID NO: 585280

SEQ ID NO: 698340 - RNA, 64 nt, hsa; identical to SEQ ID NO: 585281

SEQ ID NO: 698341 - RNA, 64 nt, hsa; identical to SEQ ID NO: 585282

SEQ ID NO: 698342 - RNA, 64 nt, hsa; identical to SEQ ID NO: 585283

SEQ ID NO: 698343 - RNA, 64 nt, hsa; identical to SEQ ID NO: 585284

SEQ ID NO: 698344 - RNA, 64 nt, hsa; identical to SEQ ID NO: 585285

SEQ ID NO: 698345 - RNA, 64 nt, hsa; identical to SEQ ID NO: 585286

SEQ ID NO: 698346 - RNA, 64 nt, hsa; identical to SEQ ID NO: 585287

SEQ ID NO: 698347 - RNA, 64 nt, hsa; identical to SEQ ID NO: 585288

SEQ ID NO: 698348 - RNA, 64 nt, hsa; identical to SEQ ID NO: 585289

SEQ ID NO: 698349 - RNA, 64 nt, hsa; identical to SEQ ID NO: 585290

SEQ ID NO: 698350 - RNA, 64 nt, hsa; identical to SEQ ID NO: 585291

SEQ ID NO: 698351 - RNA, 64 nt, hsa; identical to SEQ ID NO: 585292

SEQ ID NO: 698352 - RNA, 64 nt, hsa; identical to SEQ ID NO: 585293

SEQ ID NO: 698353 - RNA, 64 nt, hsa; identical to SEQ ID NO: 585294

SEQ ID NO: 698354 - RNA, 64 nt, hsa; identical to SEQ ID NO: 585295

SEQ ID NO: 698355 - RNA, 64 nt, hsa; identical to SEQ ID NO: 585296

SEQ ID NO: 698356 - RNA, 64 nt, hsa; identical to SEQ ID NO: 585297

SEQ ID NO: 698357 - RNA, 64 nt, hsa; identical to SEQ ID NO: 585298

SEQ ID NO: 698358 - RNA, 64 nt, hsa; identical to SEQ ID NO: 585299

SEQ ID NO: 698359 - RNA, 64 nt, hsa; identical to SEQ ID NO: 50853

SEQ ID NO: 698360 - RNA, 64 nt, hsa; identical to SEQ ID NO: 50854

SEQ ID NO: 698361 - RNA, 64 nt, hsa; identical to SEQ ID NO: 50855

SEQ ID NO: 698362 - RNA, 64 nt, hsa; identical to SEQ ID NO: 50856

SEQ ID NO: 698363 - RNA, 64 nt, hsa; identical to SEQ ID NO: 50857

SEQ ID NO: 698364 - RNA, 64 nt, hsa; identical to SEQ ID NO: 50858

SEQ ID NO: 698365 - RNA, 64 nt, hsa; identical to SEQ ID NO: 50859

SEQ ID NO: 698366 - RNA, 64 nt, hsa; identical to SEQ ID NO: 50860

SEQ ID NO: 698367 - RNA, 64 nt, hsa; identical to SEQ ID NO: 50861

SEQ ID NO: 698368 - RNA, 64 nt, hsa; identical to SEQ ID NO: 50862

SEQ ID NO: 698369 - RNA, 64 nt, hsa; identical to SEQ ID NO: 50863

SEQ ID NO: 698370 - RNA, 64 nt, hsa; identical to SEQ ID NO: 50864

SEQ ID NO: 698371 - RNA, 64 nt, hsa; identical to SEQ ID NO: 50865

SEQ ID NO: 698372 - RNA, 64 nt, hsa; identical to SEQ ID NO: 50866

SEQ ID NO: 698373 - RNA, 64 nt, hsa; identical to SEQ ID NO: 50867

SEQ ID NO: 698374 - RNA, 64 nt, hsa; identical to SEQ ID NO: 50868

SEQ ID NO: 698375 - RNA, 64 nt, hsa; identical to SEQ ID NO: 50869

SEQ ID NO: 698376 - RNA, 64 nt, hsa; identical to SEQ ID NO: 50870

SEQ ID NO: 698377 - RNA, 64 nt, hsa; identical to SEQ ID NO: 50871

SEQ ID NO: 698378 - RNA, 64 nt, hsa; identical to SEQ ID NO: 50872

SEQ ID NO: 698379 - RNA, 64 nt, hsa; identical to SEQ ID NO: 50873

SEQ ID NO: 698380 - RNA, 64 nt, hsa; identical to SEQ ID NO: 50874

SEQ ID NO: 698381 - RNA, 64 nt, hsa; identical to SEQ ID NO: 50875

SEQ ID NO: 698382 - RNA, 64 nt, hsa; identical to SEQ ID NO: 50876

SEQ ID NO: 698383 - RNA, 64 nt, hsa; identical to SEQ ID NO: 50877

SEQ ID NO: 698384 - RNA, 64 nt, hsa; identical to SEQ ID NO: 50878

SEQ ID NO: 698385 - RNA, 64 nt, hsa; identical to SEQ ID NO: 50879

SEQ ID NO: 698386 - RNA, 64 nt, hsa; identical to SEQ ID NO: 50880

SEQ ID NO: 698387 - RNA, 64 nt, hsa; identical to SEQ ID NO: 50881

SEQ ID NO: 698388 - RNA, 64 nt, hsa; identical to SEQ ID NO: 50882

SEQ ID NO: 698389 - RNA, 64 nt, hsa; identical to SEQ ID NO: 50883

SEQ ID NO: 698390 - RNA, 64 nt, hsa; identical to SEQ ID NO: 50884

SEQ ID NO: 698391 - RNA, 64 nt, hsa; identical to SEQ ID NO: 50885

SEQ ID NO: 698392 - RNA, 64 nt, hsa; identical to SEQ ID NO: 50886

SEQ ID NO: 698393 - RNA, 64 nt, hsa; identical to SEQ ID NO: 50887

SEQ ID NO: 698394 - RNA, 64 nt, hsa; identical to SEQ ID NO: 50888

SEQ ID NO: 698395 - RNA, 64 nt, hsa; identical to SEQ ID NO: 50889

SEQ ID NO: 698396 - RNA, 64 nt, hsa; identical to SEQ ID NO: 50890

SEQ ID NO: 698397 - RNA, 64 nt, hsa; identical to SEQ ID NO: 50891

SEQ ID NO: 698398 - RNA, 64 nt, hsa; identical to SEQ ID NO: 50892

SEQ ID NO: 698399 - RNA, 64 nt, hsa; identical to SEQ ID NO: 50893

SEQ ID NO: 698400 - RNA, 64 nt, hsa; identical to SEQ ID NO: 50894

SEQ ID NO: 698401 - RNA, 64 nt, hsa; identical to SEQ ID NO: 50895

SEQ ID NO: 698402 - RNA, 64 nt, hsa; identical to SEQ ID NO: 50896

SEQ ID NO: 698403 - RNA, 64 nt, hsa; identical to SEQ ID NO: 50897

SEQ ID NO: 698404 - RNA, 64 nt, hsa; identical to SEQ ID NO: 50898

SEQ ID NO: 698405 - RNA, 64 nt, hsa; identical to SEQ ID NO: 50899

SEQ ID NO: 698406 - RNA, 64 nt, hsa; identical to SEQ ID NO: 50900

SEQ ID NO: 698407 - RNA, 64 nt, hsa; identical to SEQ ID NO: 50901

SEQ ID NO: 698408 - RNA, 64 nt, hsa; identical to SEQ ID NO: 50902

SEQ ID NO: 698409 - RNA, 64 nt, hsa; identical to SEQ ID NO: 50903

SEQ ID NO: 698410 - RNA, 64 nt, hsa; identical to SEQ ID NO: 50904

SEQ ID NO: 698411 - RNA, 64 nt, hsa; identical to SEQ ID NO: 50905

SEQ ID NO: 698412 - RNA, 64 nt, hsa; identical to SEQ ID NO: 50906

SEQ ID NO: 698413 - RNA, 64 nt, hsa; identical to SEQ ID NO: 50907

SEQ ID NO: 698414 - RNA, 64 nt, hsa; identical to SEQ ID NO: 50908

SEQ ID NO: 698415 - RNA, 64 nt, hsa; identical to SEQ ID NO: 50909

SEQ ID NO: 698416 - RNA, 64 nt, hsa; identical to SEQ ID NO: 50910

SEQ ID NO: 698417 - RNA, 64 nt, hsa; identical to SEQ ID NO: 50911

SEQ ID NO: 698418 - RNA, 64 nt, hsa; identical to SEQ ID NO: 50912

SEQ ID NO: 698419 - RNA, 64 nt, hsa; identical to SEQ ID NO: 50913

SEQ ID NO: 698420 - RNA, 64 nt, hsa; identical to SEQ ID NO: 50914

SEQ ID NO: 698421 - RNA, 64 nt, hsa; identical to SEQ ID NO: 50915

SEQ ID NO: 698422 - RNA, 64 nt, hsa; identical to SEQ ID NO: 50916

SEQ ID NO: 698423 - RNA, 64 nt, hsa; identical to SEQ ID NO: 50917

SEQ ID NO: 698424 - RNA, 64 nt, hsa; identical to SEQ ID NO: 50918

SEQ ID NO: 698425 - RNA, 64 nt, hsa; identical to SEQ ID NO: 50919

SEQ ID NO: 698426 - RNA, 64 nt, hsa; identical to SEQ ID NO: 50920

SEQ ID NO: 698427 - RNA, 64 nt, hsa; identical to SEQ ID NO: 50921

SEQ ID NO: 698428 - RNA, 64 nt, hsa; identical to SEQ ID NO: 50922

SEQ ID NO: 698429 - RNA, 64 nt, hsa; identical to SEQ ID NO: 50923

SEQ ID NO: 698430 - RNA, 64 nt, hsa; identical to SEQ ID NO: 50924

SEQ ID NO: 698431 - RNA, 64 nt, hsa; identical to SEQ ID NO: 50925

SEQ ID NO: 698432 - RNA, 64 nt, hsa; identical to SEQ ID NO: 50926

SEQ ID NO: 698433 - RNA, 64 nt, hsa; identical to SEQ ID NO: 50927

SEQ ID NO: 698434 - RNA, 64 nt, hsa; identical to SEQ ID NO: 50928

SEQ ID NO: 698435 - RNA, 64 nt, hsa; identical to SEQ ID NO: 25175

SEQ ID NO: 698436 - RNA, 64 nt, hsa; identical to SEQ ID NO: 25176

SEQ ID NO: 698437 - RNA, 64 nt, hsa; identical to SEQ ID NO: 25177

SEQ ID NO: 698438 - RNA, 64 nt, hsa; identical to SEQ ID NO: 25178

SEQ ID NO: 698439 - RNA, 64 nt, hsa; identical to SEQ ID NO: 25179

SEQ ID NO: 698440 - RNA, 64 nt, hsa; identical to SEQ ID NO: 25180

SEQ ID NO: 698441 - RNA, 64 nt, hsa; identical to SEQ ID NO: 25181

SEQ ID NO: 698442 - RNA, 64 nt, hsa; identical to SEQ ID NO: 25182

SEQ ID NO: 698443 - RNA, 64 nt, hsa; identical to SEQ ID NO: 25183

SEQ ID NO: 698444 - RNA, 64 nt, hsa; identical to SEQ ID NO: 25184

SEQ ID NO: 698445 - RNA, 64 nt, hsa; identical to SEQ ID NO: 25185

SEQ ID NO: 698446 - RNA, 64 nt, hsa; identical to SEQ ID NO: 25186

SEQ ID NO: 698447 - RNA, 64 nt, hsa; identical to SEQ ID NO: 25187

SEQ ID NO: 698448 - RNA, 64 nt, hsa; identical to SEQ ID NO: 25188

SEQ ID NO: 698449 - RNA, 64 nt, hsa; identical to SEQ ID NO: 25189

SEQ ID NO: 698450 - RNA, 64 nt, hsa; identical to SEQ ID NO: 25190

SEQ ID NO: 698451 - RNA, 64 nt, hsa; identical to SEQ ID NO: 25191

SEQ ID NO: 698452 - RNA, 64 nt, hsa; identical to SEQ ID NO: 25192

SEQ ID NO: 698453 - RNA, 64 nt, hsa; identical to SEQ ID NO: 25193

SEQ ID NO: 698454 - RNA, 64 nt, hsa; identical to SEQ ID NO: 25194

SEQ ID NO: 698455 - RNA, 64 nt, hsa; identical to SEQ ID NO: 25195

SEQ ID NO: 698456 - RNA, 64 nt, hsa; identical to SEQ ID NO: 25196

SEQ ID NO: 698457 - RNA, 64 nt, hsa; identical to SEQ ID NO: 25197

SEQ ID NO: 698458 - RNA, 64 nt, hsa; identical to SEQ ID NO: 25198

SEQ ID NO: 698459 - RNA, 64 nt, hsa; identical to SEQ ID NO: 25199

SEQ ID NO: 698460 - RNA, 64 nt, hsa; identical to SEQ ID NO: 25200

SEQ ID NO: 698461 - RNA, 64 nt, hsa; identical to SEQ ID NO: 25201

SEQ ID NO: 698462 - RNA, 64 nt, hsa; identical to SEQ ID NO: 25202

SEQ ID NO: 698463 - RNA, 64 nt, hsa; identical to SEQ ID NO: 25203

SEQ ID NO: 698464 - RNA, 64 nt, hsa; identical to SEQ ID NO: 25204

SEQ ID NO: 698465 - RNA, 64 nt, hsa; identical to SEQ ID NO: 25205

SEQ ID NO: 698466 - RNA, 64 nt, hsa; identical to SEQ ID NO: 25206

SEQ ID NO: 698467 - RNA, 64 nt, hsa; identical to SEQ ID NO: 25207

SEQ ID NO: 698468 - RNA, 64 nt, hsa; identical to SEQ ID NO: 25208

SEQ ID NO: 698469 - RNA, 64 nt, hsa; identical to SEQ ID NO: 25209

SEQ ID NO: 698470 - RNA, 64 nt, hsa; identical to SEQ ID NO: 25210

SEQ ID NO: 698471 - RNA, 64 nt, hsa; identical to SEQ ID NO: 25211

SEQ ID NO: 698472 - RNA, 64 nt, hsa; identical to SEQ ID NO: 25212

SEQ ID NO: 698473 - RNA, 64 nt, hsa; identical to SEQ ID NO: 25213

SEQ ID NO: 698474 - RNA, 64 nt, hsa; identical to SEQ ID NO: 25214

SEQ ID NO: 698475 - RNA, 64 nt, hsa; identical to SEQ ID NO: 25215

SEQ ID NO: 698476 - RNA, 64 nt, hsa; identical to SEQ ID NO: 25216

SEQ ID NO: 698477 - RNA, 64 nt, hsa; identical to SEQ ID NO: 25217

SEQ ID NO: 698478 - RNA, 64 nt, hsa; identical to SEQ ID NO: 25218

SEQ ID NO: 698479 - RNA, 64 nt, hsa; identical to SEQ ID NO: 25219

SEQ ID NO: 698480 - RNA, 64 nt, hsa; identical to SEQ ID NO: 25220

SEQ ID NO: 698481 - RNA, 64 nt, hsa; identical to SEQ ID NO: 25221

SEQ ID NO: 698482 - RNA, 64 nt, hsa; identical to SEQ ID NO: 25222

SEQ ID NO: 698483 - RNA, 64 nt, hsa; identical to SEQ ID NO: 25223

SEQ ID NO: 698484 - RNA, 64 nt, hsa; identical to SEQ ID NO: 25224

SEQ ID NO: 698485 - RNA, 64 nt, hsa; identical to SEQ ID NO: 25225

SEQ ID NO: 698486 - RNA, 64 nt, hsa; identical to SEQ ID NO: 25226

SEQ ID NO: 698487 - RNA, 64 nt, hsa; identical to SEQ ID NO: 25227

SEQ ID NO: 698488 - RNA, 64 nt, hsa; identical to SEQ ID NO: 25228

SEQ ID NO: 698489 - RNA, 64 nt, hsa; identical to SEQ ID NO: 25229

SEQ ID NO: 698490 - RNA, 64 nt, hsa; identical to SEQ ID NO: 25230

SEQ ID NO: 698491 - RNA, 64 nt, hsa; identical to SEQ ID NO: 25231

SEQ ID NO: 698492 - RNA, 64 nt, hsa; identical to SEQ ID NO: 25232

SEQ ID NO: 698493 - RNA, 64 nt, hsa; identical to SEQ ID NO: 25233

SEQ ID NO: 698494 - RNA, 64 nt, hsa; identical to SEQ ID NO: 25234

SEQ ID NO: 698495 - RNA, 64 nt, hsa; identical to SEQ ID NO: 25235

SEQ ID NO: 698496 - RNA, 64 nt, hsa; identical to SEQ ID NO: 25236

SEQ ID NO: 698497 - RNA, 64 nt, hsa; identical to SEQ ID NO: 25237

SEQ ID NO: 698498 - RNA, 64 nt, hsa; identical to SEQ ID NO: 25238

SEQ ID NO: 698499 - RNA, 64 nt, hsa; identical to SEQ ID NO: 25239

SEQ ID NO: 698500 - RNA, 64 nt, hsa; identical to SEQ ID NO: 25240

SEQ ID NO: 698501 - RNA, 64 nt, hsa; identical to SEQ ID NO: 25241

SEQ ID NO: 698502 - RNA, 64 nt, hsa; identical to SEQ ID NO: 25242

SEQ ID NO: 698503 - RNA, 64 nt, hsa; identical to SEQ ID NO: 25243

SEQ ID NO: 698504 - RNA, 64 nt, hsa; identical to SEQ ID NO: 25244

SEQ ID NO: 698505 - RNA, 64 nt, hsa; identical to SEQ ID NO: 25245

SEQ ID NO: 698506 - RNA, 64 nt, hsa; identical to SEQ ID NO: 25246

SEQ ID NO: 698507 - RNA, 64 nt, hsa; identical to SEQ ID NO: 25247

SEQ ID NO: 698508 - RNA, 64 nt, hsa; identical to SEQ ID NO: 25248

SEQ ID NO: 698509 - RNA, 64 nt, hsa; identical to SEQ ID NO: 25249

SEQ ID NO: 698510 - RNA, 64 nt, hsa; identical to SEQ ID NO: 25250

SEQ ID NO: 698511 - RNA, 64 nt, hsa; identical to SEQ ID NO: 25251

SEQ ID NO: 698512 - RNA, 64 nt, hsa; identical to SEQ ID NO: 25252

SEQ ID NO: 698513 - RNA, 64 nt, hsa; identical to SEQ ID NO: 25253

SEQ ID NO: 698514 - RNA, 64 nt, hsa; identical to SEQ ID NO: 25254

SEQ ID NO: 698515 - RNA, 64 nt, hsa; identical to SEQ ID NO: 25255

SEQ ID NO: 698516 - RNA, 64 nt, hsa; identical to SEQ ID NO: 25256

SEQ ID NO: 698517 - RNA, 64 nt, hsa; identical to SEQ ID NO: 25257

SEQ ID NO: 698518 - RNA, 64 nt, hsa; identical to SEQ ID NO: 25258

SEQ ID NO: 698519 - RNA, 64 nt, hsa; identical to SEQ ID NO: 25259

SEQ ID NO: 698520 - RNA, 64 nt, hsa; identical to SEQ ID NO: 25260

SEQ ID NO: 698521 - RNA, 64 nt, hsa; identical to SEQ ID NO: 25261

SEQ ID NO: 698522 - RNA, 64 nt, hsa; identical to SEQ ID NO: 25262

SEQ ID NO: 698523 - RNA, 64 nt, hsa; identical to SEQ ID NO: 25263

SEQ ID NO: 698524 - RNA, 64 nt, hsa; identical to SEQ ID NO: 25264

SEQ ID NO: 698525 - RNA, 63 nt, hsa; identical to SEQ ID NO: 25265

SEQ ID NO: 698526 - RNA, 64 nt, hsa; identical to SEQ ID NO: 25266

SEQ ID NO: 698527 - RNA, 64 nt, hsa; identical to SEQ ID NO: 25267

SEQ ID NO: 698528 - RNA, 64 nt, hsa; identical to SEQ ID NO: 25268

SEQ ID NO: 698529 - RNA, 64 nt, hsa; identical to SEQ ID NO: 25269

SEQ ID NO: 698530 - RNA, 64 nt, hsa; identical to SEQ ID NO: 25270

SEQ ID NO: 698531 - RNA, 64 nt, hsa; identical to SEQ ID NO: 25271

SEQ ID NO: 698532 - RNA, 64 nt, hsa; identical to SEQ ID NO: 25272

SEQ ID NO: 698533 - RNA, 64 nt, hsa; identical to SEQ ID NO: 25273

SEQ ID NO: 698534 - RNA, 64 nt, hsa; identical to SEQ ID NO: 25274

SEQ ID NO: 698535 - RNA, 64 nt, hsa; identical to SEQ ID NO: 25275

SEQ ID NO: 698536 - RNA, 64 nt, hsa; identical to SEQ ID NO: 25276

SEQ ID NO: 698537 - RNA, 64 nt, hsa; identical to SEQ ID NO: 25277

SEQ ID NO: 698538 - RNA, 64 nt, hsa; identical to SEQ ID NO: 25278

SEQ ID NO: 698539 - RNA, 64 nt, hsa; identical to SEQ ID NO: 25279

SEQ ID NO: 698540 - RNA, 64 nt, hsa; identical to SEQ ID NO: 25280

SEQ ID NO: 698541 - RNA, 64 nt, hsa; identical to SEQ ID NO: 25281

SEQ ID NO: 698542 - RNA, 64 nt, hsa; identical to SEQ ID NO: 25282

SEQ ID NO: 698543 - RNA, 64 nt, hsa; identical to SEQ ID NO: 25283

SEQ ID NO: 698544 - RNA, 64 nt, hsa; identical to SEQ ID NO: 25284

SEQ ID NO: 698545 - RNA, 64 nt, hsa; identical to SEQ ID NO: 25285

SEQ ID NO: 698546 - RNA, 64 nt, hsa; identical to SEQ ID NO: 25286

SEQ ID NO: 698547 - RNA, 64 nt, hsa; identical to SEQ ID NO: 25287

SEQ ID NO: 698548 - RNA, 64 nt, hsa; identical to SEQ ID NO: 25288

SEQ ID NO: 698549 - RNA, 64 nt, hsa; identical to SEQ ID NO: 25289

SEQ ID NO: 698550 - RNA, 64 nt, hsa; identical to SEQ ID NO: 25290

SEQ ID NO: 698551 - RNA, 64 nt, hsa; identical to SEQ ID NO: 25291

SEQ ID NO: 698552 - RNA, 64 nt, hsa; identical to SEQ ID NO: 25292

SEQ ID NO: 698553 - RNA, 64 nt, hsa; identical to SEQ ID NO: 25293

SEQ ID NO: 698554 - RNA, 64 nt, hsa; identical to SEQ ID NO: 25294

SEQ ID NO: 698555 - RNA, 64 nt, hsa; identical to SEQ ID NO: 25295

SEQ ID NO: 698556 - RNA, 64 nt, hsa; identical to SEQ ID NO: 25296

SEQ ID NO: 698557 - RNA, 64 nt, hsa; identical to SEQ ID NO: 25297

SEQ ID NO: 698558 - RNA, 64 nt, hsa; identical to SEQ ID NO: 25298

SEQ ID NO: 698559 - RNA, 64 nt, hsa; identical to SEQ ID NO: 25299

SEQ ID NO: 698560 - RNA, 64 nt, hsa; identical to SEQ ID NO: 25300

SEQ ID NO: 698561 - RNA, 64 nt, hsa; identical to SEQ ID NO: 25301

SEQ ID NO: 698562 - RNA, 64 nt, hsa; identical to SEQ ID NO: 25302

SEQ ID NO: 698563 - RNA, 64 nt, hsa; identical to SEQ ID NO: 25303

SEQ ID NO: 698564 - RNA, 64 nt, hsa; identical to SEQ ID NO: 25304

SEQ ID NO: 698565 - RNA, 64 nt, hsa; identical to SEQ ID NO: 25305

SEQ ID NO: 698566 - RNA, 64 nt, hsa; identical to SEQ ID NO: 25306

SEQ ID NO: 698567 - RNA, 64 nt, hsa; identical to SEQ ID NO: 25307

SEQ ID NO: 698568 - RNA, 64 nt, hsa; identical to SEQ ID NO: 25308

SEQ ID NO: 698569 - RNA, 64 nt, hsa; identical to SEQ ID NO: 25309

SEQ ID NO: 698570 - RNA, 64 nt, hsa; identical to SEQ ID NO: 25310

SEQ ID NO: 698571 - RNA, 64 nt, hsa; identical to SEQ ID NO: 25311

SEQ ID NO: 698572 - RNA, 64 nt, hsa; identical to SEQ ID NO: 25312

SEQ ID NO: 698573 - RNA, 64 nt, hsa; identical to SEQ ID NO: 25313

SEQ ID NO: 698574 - RNA, 64 nt, hsa; identical to SEQ ID NO: 25314

SEQ ID NO: 698575 - RNA, 64 nt, hsa; identical to SEQ ID NO: 25315

SEQ ID NO: 698576 - RNA, 64 nt, hsa; identical to SEQ ID NO: 25316

SEQ ID NO: 698577 - RNA, 64 nt, hsa; identical to SEQ ID NO: 25317

SEQ ID NO: 698578 - RNA, 64 nt, hsa; identical to SEQ ID NO: 25318

SEQ ID NO: 698579 - RNA, 64 nt, hsa; identical to SEQ ID NO: 25319

SEQ ID NO: 698580 - RNA, 64 nt, hsa; identical to SEQ ID NO: 25320

SEQ ID NO: 698581 - RNA, 64 nt, hsa; identical to SEQ ID NO: 25321

SEQ ID NO: 698582 - RNA, 64 nt, hsa; identical to SEQ ID NO: 25322

SEQ ID NO: 698583 - RNA, 64 nt, hsa; identical to SEQ ID NO: 25323

SEQ ID NO: 698584 - RNA, 64 nt, hsa; identical to SEQ ID NO: 25324

SEQ ID NO: 698585 - RNA, 64 nt, hsa; identical to SEQ ID NO: 25325

SEQ ID NO: 698586 - RNA, 64 nt, hsa; identical to SEQ ID NO: 25326

SEQ ID NO: 698587 - RNA, 64 nt, hsa; identical to SEQ ID NO: 25327

SEQ ID NO: 698588 - RNA, 64 nt, hsa; identical to SEQ ID NO: 25328

SEQ ID NO: 698589 - RNA, 64 nt, hsa; identical to SEQ ID NO: 25329

SEQ ID NO: 698590 - RNA, 64 nt, hsa; identical to SEQ ID NO: 25330

SEQ ID NO: 698591 - RNA, 64 nt, hsa; identical to SEQ ID NO: 25331

SEQ ID NO: 698592 - RNA, 64 nt, hsa; identical to SEQ ID NO: 25332

SEQ ID NO: 698593 - RNA, 64 nt, hsa; identical to SEQ ID NO: 25333

SEQ ID NO: 698594 - RNA, 64 nt, hsa; identical to SEQ ID NO: 25334

SEQ ID NO: 698595 - RNA, 64 nt, hsa; identical to SEQ ID NO: 25335

SEQ ID NO: 698596 - RNA, 64 nt, hsa; identical to SEQ ID NO: 25336

SEQ ID NO: 698597 - RNA, 64 nt, hsa; identical to SEQ ID NO: 25337

SEQ ID NO: 698598 - RNA, 64 nt, hsa; identical to SEQ ID NO: 25338

SEQ ID NO: 698599 - RNA, 64 nt, hsa; identical to SEQ ID NO: 25339

SEQ ID NO: 698600 - RNA, 64 nt, hsa; identical to SEQ ID NO: 25340

SEQ ID NO: 698601 - RNA, 64 nt, hsa; identical to SEQ ID NO: 25341

SEQ ID NO: 698602 - RNA, 64 nt, hsa; identical to SEQ ID NO: 25342

SEQ ID NO: 698603 - RNA, 64 nt, hsa; identical to SEQ ID NO: 25343

SEQ ID NO: 698604 - RNA, 64 nt, hsa; identical to SEQ ID NO: 25344

SEQ ID NO: 698605 - RNA, 64 nt, hsa; identical to SEQ ID NO: 25345

SEQ ID NO: 698606 - RNA, 64 nt, hsa; identical to SEQ ID NO: 25346

SEQ ID NO: 698607 - RNA, 64 nt, hsa; identical to SEQ ID NO: 25347

SEQ ID NO: 698608 - RNA, 64 nt, hsa; identical to SEQ ID NO: 25348

SEQ ID NO: 698609 - RNA, 64 nt, hsa; identical to SEQ ID NO: 25349

SEQ ID NO: 698610 - RNA, 64 nt, hsa; identical to SEQ ID NO: 25350

SEQ ID NO: 698611 - RNA, 64 nt, hsa; identical to SEQ ID NO: 25351

SEQ ID NO: 698612 - RNA, 64 nt, hsa; identical to SEQ ID NO: 25352

SEQ ID NO: 698613 - RNA, 64 nt, hsa; identical to SEQ ID NO: 25353

SEQ ID NO: 698614 - RNA, 64 nt, hsa; identical to SEQ ID NO: 25354

SEQ ID NO: 698615 - RNA, 64 nt, hsa; identical to SEQ ID NO: 25355

SEQ ID NO: 698616 - RNA, 64 nt, hsa; identical to SEQ ID NO: 25356

SEQ ID NO: 698617 - RNA, 64 nt, hsa; identical to SEQ ID NO: 25357

SEQ ID NO: 698618 - RNA, 64 nt, hsa; identical to SEQ ID NO: 25358

SEQ ID NO: 698619 - RNA, 64 nt, hsa; identical to SEQ ID NO: 25359

SEQ ID NO: 698620 - RNA, 64 nt, hsa; identical to SEQ ID NO: 25360

SEQ ID NO: 698621 - RNA, 64 nt, hsa; identical to SEQ ID NO: 25361

SEQ ID NO: 698622 - RNA, 64 nt, hsa; identical to SEQ ID NO: 25362

SEQ ID NO: 698623 - RNA, 64 nt, hsa; identical to SEQ ID NO: 25363

SEQ ID NO: 698624 - RNA, 64 nt, hsa; identical to SEQ ID NO: 25364

SEQ ID NO: 698625 - RNA, 64 nt, hsa; identical to SEQ ID NO: 25365

SEQ ID NO: 698626 - RNA, 64 nt, hsa; identical to SEQ ID NO: 25366

SEQ ID NO: 698627 - RNA, 64 nt, hsa; identical to SEQ ID NO: 25367

SEQ ID NO: 698628 - RNA, 64 nt, hsa; identical to SEQ ID NO: 25368

SEQ ID NO: 698629 - RNA, 64 nt, hsa; identical to SEQ ID NO: 25369

SEQ ID NO: 698630 - RNA, 64 nt, hsa; identical to SEQ ID NO: 25370

SEQ ID NO: 698631 - RNA, 64 nt, hsa; identical to SEQ ID NO: 25371

SEQ ID NO: 698632 - RNA, 64 nt, hsa; identical to SEQ ID NO: 25372

SEQ ID NO: 698633 - RNA, 64 nt, hsa; identical to SEQ ID NO: 25373

SEQ ID NO: 698634 - RNA, 64 nt, hsa; identical to SEQ ID NO: 25374

SEQ ID NO: 698635 - RNA, 64 nt, hsa; identical to SEQ ID NO: 25375

SEQ ID NO: 698636 - RNA, 64 nt, hsa; identical to SEQ ID NO: 25376

SEQ ID NO: 698637 - RNA, 64 nt, hsa; identical to SEQ ID NO: 25377

SEQ ID NO: 698638 - RNA, 64 nt, hsa; identical to SEQ ID NO: 25378

SEQ ID NO: 698639 - RNA, 64 nt, hsa; identical to SEQ ID NO: 25379

SEQ ID NO: 698640 - RNA, 64 nt, hsa; identical to SEQ ID NO: 25380

SEQ ID NO: 698641 - RNA, 64 nt, hsa; identical to SEQ ID NO: 25381

SEQ ID NO: 698642 - RNA, 64 nt, hsa; identical to SEQ ID NO: 25382

SEQ ID NO: 698643 - RNA, 64 nt, hsa; identical to SEQ ID NO: 25383

SEQ ID NO: 698644 - RNA, 64 nt, hsa; identical to SEQ ID NO: 25384

SEQ ID NO: 698645 - RNA, 64 nt, hsa; identical to SEQ ID NO: 25385

SEQ ID NO: 698646 - RNA, 64 nt, hsa; identical to SEQ ID NO: 25386

SEQ ID NO: 698647 - RNA, 64 nt, hsa; identical to SEQ ID NO: 25387

SEQ ID NO: 698648 - RNA, 64 nt, hsa; identical to SEQ ID NO: 25388

SEQ ID NO: 698649 - RNA, 64 nt, hsa; identical to SEQ ID NO: 25389

SEQ ID NO: 698650 - RNA, 64 nt, hsa; identical to SEQ ID NO: 25390

SEQ ID NO: 698651 - RNA, 64 nt, hsa; identical to SEQ ID NO: 25391

SEQ ID NO: 698652 - RNA, 64 nt, hsa; identical to SEQ ID NO: 25392

SEQ ID NO: 698653 - RNA, 64 nt, hsa; identical to SEQ ID NO: 25393

SEQ ID NO: 698654 - RNA, 64 nt, hsa; identical to SEQ ID NO: 25394

SEQ ID NO: 698655 - RNA, 64 nt, hsa; identical to SEQ ID NO: 25395

SEQ ID NO: 698656 - RNA, 64 nt, hsa; identical to SEQ ID NO: 25396

SEQ ID NO: 698657 - RNA, 64 nt, hsa; identical to SEQ ID NO: 25397

SEQ ID NO: 698658 - RNA, 64 nt, hsa; identical to SEQ ID NO: 25398

SEQ ID NO: 698659 - RNA, 64 nt, hsa; identical to SEQ ID NO: 25399

SEQ ID NO: 698660 - RNA, 64 nt, hsa; identical to SEQ ID NO: 25400

SEQ ID NO: 698661 - RNA, 64 nt, hsa; identical to SEQ ID NO: 25401

SEQ ID NO: 698662 - RNA, 64 nt, hsa; identical to SEQ ID NO: 25402

SEQ ID NO: 698663 - RNA, 64 nt, hsa; identical to SEQ ID NO: 25403

SEQ ID NO: 698664 - RNA, 64 nt, hsa; identical to SEQ ID NO: 25404

SEQ ID NO: 698665 - RNA, 64 nt, hsa; identical to SEQ ID NO: 25405

SEQ ID NO: 698666 - RNA, 64 nt, hsa; identical to SEQ ID NO: 25406

SEQ ID NO: 698667 - RNA, 64 nt, hsa; identical to SEQ ID NO: 25407

SEQ ID NO: 698668 - RNA, 64 nt, hsa; identical to SEQ ID NO: 25408

SEQ ID NO: 698669 - RNA, 64 nt, hsa; identical to SEQ ID NO: 25409

SEQ ID NO: 698670 - RNA, 64 nt, hsa; identical to SEQ ID NO: 25410

SEQ ID NO: 698671 - RNA, 64 nt, hsa; identical to SEQ ID NO: 25411

SEQ ID NO: 698672 - RNA, 64 nt, hsa; identical to SEQ ID NO: 25412

SEQ ID NO: 698673 - RNA, 64 nt, hsa; identical to SEQ ID NO: 25413

SEQ ID NO: 698674 - RNA, 64 nt, hsa; identical to SEQ ID NO: 25414

SEQ ID NO: 698675 - RNA, 64 nt, hsa; identical to SEQ ID NO: 25415

SEQ ID NO: 698676 - RNA, 64 nt, hsa; identical to SEQ ID NO: 25416

SEQ ID NO: 698677 - RNA, 64 nt, hsa; identical to SEQ ID NO: 25417

SEQ ID NO: 698678 - RNA, 64 nt, hsa; identical to SEQ ID NO: 25418

SEQ ID NO: 698679 - RNA, 64 nt, hsa; identical to SEQ ID NO: 25419

SEQ ID NO: 698680 - RNA, 64 nt, hsa; identical to SEQ ID NO: 25420

SEQ ID NO: 698681 - RNA, 64 nt, hsa; identical to SEQ ID NO: 25421

SEQ ID NO: 698682 - RNA, 64 nt, hsa; identical to SEQ ID NO: 25422

SEQ ID NO: 698683 - RNA, 64 nt, hsa; identical to SEQ ID NO: 25423

SEQ ID NO: 698684 - RNA, 64 nt, hsa; identical to SEQ ID NO: 25424

SEQ ID NO: 698685 - RNA, 64 nt, hsa; identical to SEQ ID NO: 25425

SEQ ID NO: 698686 - RNA, 64 nt, hsa; identical to SEQ ID NO: 25426

SEQ ID NO: 698687 - RNA, 64 nt, hsa; identical to SEQ ID NO: 25427

SEQ ID NO: 698688 - RNA, 64 nt, hsa; identical to SEQ ID NO: 25428

SEQ ID NO: 698689 - RNA, 64 nt, hsa; identical to SEQ ID NO: 25429

SEQ ID NO: 698690 - RNA, 64 nt, hsa; identical to SEQ ID NO: 25430

SEQ ID NO: 698691 - RNA, 64 nt, hsa; identical to SEQ ID NO: 25431

SEQ ID NO: 698692 - RNA, 64 nt, hsa; identical to SEQ ID NO: 25432

SEQ ID NO: 698693 - RNA, 64 nt, hsa; identical to SEQ ID NO: 25433

SEQ ID NO: 698694 - RNA, 64 nt, hsa; identical to SEQ ID NO: 25434

SEQ ID NO: 698695 - RNA, 64 nt, hsa; identical to SEQ ID NO: 25435

SEQ ID NO: 698696 - RNA, 64 nt, hsa; identical to SEQ ID NO: 25436

SEQ ID NO: 698697 - RNA, 64 nt, hsa; identical to SEQ ID NO: 25437

SEQ ID NO: 698698 - RNA, 64 nt, hsa; identical to SEQ ID NO: 25438

SEQ ID NO: 698699 - RNA, 64 nt, hsa; identical to SEQ ID NO: 25439

SEQ ID NO: 698700 - RNA, 64 nt, hsa; identical to SEQ ID NO: 25440

SEQ ID NO: 698701 - RNA, 64 nt, hsa; identical to SEQ ID NO: 25441

SEQ ID NO: 698702 - RNA, 64 nt, hsa; identical to SEQ ID NO: 25442

SEQ ID NO: 698703 - RNA, 64 nt, hsa; identical to SEQ ID NO: 25443

SEQ ID NO: 698704 - RNA, 64 nt, hsa; identical to SEQ ID NO: 25444

SEQ ID NO: 698705 - RNA, 64 nt, hsa; identical to SEQ ID NO: 25445

SEQ ID NO: 698706 - RNA, 64 nt, hsa; identical to SEQ ID NO: 25446

SEQ ID NO: 698707 - RNA, 64 nt, hsa; identical to SEQ ID NO: 25447

SEQ ID NO: 698708 - RNA, 64 nt, hsa; identical to SEQ ID NO: 25448

SEQ ID NO: 698709 - RNA, 64 nt, hsa; identical to SEQ ID NO: 25449

SEQ ID NO: 698710 - RNA, 64 nt, hsa; identical to SEQ ID NO: 25450

SEQ ID NO: 698711 - RNA, 64 nt, hsa; identical to SEQ ID NO: 25451

SEQ ID NO: 698712 - RNA, 64 nt, hsa; identical to SEQ ID NO: 25452

SEQ ID NO: 698713 - RNA, 64 nt, hsa; identical to SEQ ID NO: 25453

SEQ ID NO: 698714 - RNA, 64 nt, hsa; identical to SEQ ID NO: 25454

SEQ ID NO: 698715 - RNA, 64 nt, hsa; identical to SEQ ID NO: 25455

SEQ ID NO: 698716 - RNA, 64 nt, hsa; identical to SEQ ID NO: 25456

SEQ ID NO: 698717 - RNA, 64 nt, hsa; identical to SEQ ID NO: 25457

SEQ ID NO: 698718 - RNA, 64 nt, hsa; identical to SEQ ID NO: 25458

SEQ ID NO: 698719 - RNA, 64 nt, hsa; identical to SEQ ID NO: 25459

SEQ ID NO: 698720 - RNA, 64 nt, hsa; identical to SEQ ID NO: 25460

SEQ ID NO: 698721 - RNA, 64 nt, hsa; identical to SEQ ID NO: 25461

SEQ ID NO: 698722 - RNA, 64 nt, hsa; identical to SEQ ID NO: 25462

SEQ ID NO: 698723 - RNA, 64 nt, hsa; identical to SEQ ID NO: 25463

SEQ ID NO: 698724 - RNA, 64 nt, hsa; identical to SEQ ID NO: 25464

SEQ ID NO: 698725 - RNA, 64 nt, hsa; identical to SEQ ID NO: 25465

SEQ ID NO: 698726 - RNA, 64 nt, hsa; identical to SEQ ID NO: 25466

SEQ ID NO: 698727 - RNA, 64 nt, hsa; identical to SEQ ID NO: 25467

SEQ ID NO: 698728 - RNA, 64 nt, hsa; identical to SEQ ID NO: 25468

SEQ ID NO: 698729 - RNA, 64 nt, hsa; identical to SEQ ID NO: 25469

SEQ ID NO: 698730 - RNA, 64 nt, hsa; identical to SEQ ID NO: 25470

SEQ ID NO: 698731 - RNA, 64 nt, hsa; identical to SEQ ID NO: 25471

SEQ ID NO: 698732 - RNA, 64 nt, hsa; identical to SEQ ID NO: 25472

SEQ ID NO: 698733 - RNA, 64 nt, hsa; identical to SEQ ID NO: 25473

SEQ ID NO: 698734 - RNA, 64 nt, hsa; identical to SEQ ID NO: 25474

SEQ ID NO: 698735 - RNA, 64 nt, hsa; identical to SEQ ID NO: 25475

SEQ ID NO: 698736 - RNA, 64 nt, hsa; identical to SEQ ID NO: 25476

SEQ ID NO: 698737 - RNA, 64 nt, hsa; identical to SEQ ID NO: 25477

SEQ ID NO: 698738 - RNA, 64 nt, hsa; identical to SEQ ID NO: 25478

SEQ ID NO: 698739 - RNA, 64 nt, hsa; identical to SEQ ID NO: 25479

SEQ ID NO: 698740 - RNA, 64 nt, hsa; identical to SEQ ID NO: 25480

SEQ ID NO: 698741 - RNA, 64 nt, hsa; identical to SEQ ID NO: 25481

SEQ ID NO: 698742 - RNA, 64 nt, hsa; identical to SEQ ID NO: 25482

SEQ ID NO: 698743 - RNA, 64 nt, hsa; identical to SEQ ID NO: 25483

SEQ ID NO: 698744 - RNA, 64 nt, hsa; identical to SEQ ID NO: 25484

SEQ ID NO: 698745 - RNA, 64 nt, hsa; identical to SEQ ID NO: 25485

SEQ ID NO: 698746 - RNA, 64 nt, hsa; identical to SEQ ID NO: 25486

SEQ ID NO: 698747 - RNA, 64 nt, hsa; identical to SEQ ID NO: 25487

SEQ ID NO: 698748 - RNA, 64 nt, hsa; identical to SEQ ID NO: 25488

SEQ ID NO: 698749 - RNA, 64 nt, hsa; identical to SEQ ID NO: 25489

SEQ ID NO: 698750 - RNA, 64 nt, hsa; identical to SEQ ID NO: 25490

SEQ ID NO: 698751 - RNA, 64 nt, hsa; identical to SEQ ID NO: 25491

SEQ ID NO: 698752 - RNA, 64 nt, hsa; identical to SEQ ID NO: 25492

SEQ ID NO: 698753 - RNA, 64 nt, hsa; identical to SEQ ID NO: 25493

SEQ ID NO: 698754 - RNA, 64 nt, hsa; identical to SEQ ID NO: 25494

SEQ ID NO: 698755 - RNA, 64 nt, hsa; identical to SEQ ID NO: 25495

SEQ ID NO: 698756 - RNA, 64 nt, hsa; identical to SEQ ID NO: 25496

SEQ ID NO: 698757 - RNA, 64 nt, hsa; identical to SEQ ID NO: 25497

SEQ ID NO: 698758 - RNA, 64 nt, hsa; identical to SEQ ID NO: 25498

SEQ ID NO: 698759 - RNA, 64 nt, hsa; identical to SEQ ID NO: 25499

SEQ ID NO: 698760 - RNA, 64 nt, hsa; identical to SEQ ID NO: 25500

SEQ ID NO: 698761 - RNA, 64 nt, hsa; identical to SEQ ID NO: 25501

SEQ ID NO: 698762 - RNA, 64 nt, hsa; identical to SEQ ID NO: 25502

SEQ ID NO: 698763 - RNA, 64 nt, hsa; identical to SEQ ID NO: 25503

SEQ ID NO: 698764 - RNA, 64 nt, hsa; identical to SEQ ID NO: 25504

SEQ ID NO: 698765 - RNA, 64 nt, hsa; identical to SEQ ID NO: 25505

SEQ ID NO: 698766 - RNA, 64 nt, hsa; identical to SEQ ID NO: 25506

SEQ ID NO: 698767 - RNA, 64 nt, hsa; identical to SEQ ID NO: 25507

SEQ ID NO: 698768 - RNA, 64 nt, hsa; identical to SEQ ID NO: 25508

SEQ ID NO: 698769 - RNA, 64 nt, hsa; identical to SEQ ID NO: 25509

SEQ ID NO: 698770 - RNA, 64 nt, hsa; identical to SEQ ID NO: 25510

SEQ ID NO: 698771 - RNA, 64 nt, hsa; identical to SEQ ID NO: 25511

SEQ ID NO: 698772 - RNA, 64 nt, hsa; identical to SEQ ID NO: 25512

SEQ ID NO: 698773 - RNA, 64 nt, hsa; identical to SEQ ID NO: 25513

SEQ ID NO: 698774 - RNA, 64 nt, hsa; identical to SEQ ID NO: 25514

SEQ ID NO: 698775 - RNA, 64 nt, hsa; identical to SEQ ID NO: 25515

SEQ ID NO: 698776 - RNA, 64 nt, hsa; identical to SEQ ID NO: 25516

SEQ ID NO: 698777 - RNA, 64 nt, hsa; identical to SEQ ID NO: 25517

SEQ ID NO: 698778 - RNA, 64 nt, hsa; identical to SEQ ID NO: 25518

SEQ ID NO: 698779 - RNA, 64 nt, hsa; identical to SEQ ID NO: 25519

SEQ ID NO: 698780 - RNA, 64 nt, hsa; identical to SEQ ID NO: 25520

SEQ ID NO: 698781 - RNA, 64 nt, hsa; identical to SEQ ID NO: 25521

SEQ ID NO: 698782 - RNA, 64 nt, hsa; identical to SEQ ID NO: 25522

SEQ ID NO: 698783 - RNA, 64 nt, hsa; identical to SEQ ID NO: 25523

SEQ ID NO: 698784 - RNA, 64 nt, hsa; identical to SEQ ID NO: 25524

SEQ ID NO: 698785 - RNA, 64 nt, hsa; identical to SEQ ID NO: 25525

SEQ ID NO: 698786 - RNA, 64 nt, hsa; identical to SEQ ID NO: 25526

SEQ ID NO: 698787 - RNA, 64 nt, hsa; identical to SEQ ID NO: 25527

SEQ ID NO: 698788 - RNA, 64 nt, hsa; identical to SEQ ID NO: 25528

SEQ ID NO: 698789 - RNA, 64 nt, hsa; identical to SEQ ID NO: 25529

SEQ ID NO: 698790 - RNA, 64 nt, hsa; identical to SEQ ID NO: 25530

SEQ ID NO: 698791 - RNA, 64 nt, hsa; identical to SEQ ID NO: 25531

SEQ ID NO: 698792 - RNA, 64 nt, hsa; identical to SEQ ID NO: 25532

SEQ ID NO: 698793 - RNA, 64 nt, hsa; identical to SEQ ID NO: 25533

SEQ ID NO: 698794 - RNA, 64 nt, hsa; identical to SEQ ID NO: 25534

SEQ ID NO: 698795 - RNA, 64 nt, hsa; identical to SEQ ID NO: 25535

SEQ ID NO: 698796 - RNA, 64 nt, hsa; identical to SEQ ID NO: 25536

SEQ ID NO: 698797 - RNA, 64 nt, hsa; identical to SEQ ID NO: 25537

SEQ ID NO: 698798 - RNA, 64 nt, hsa; identical to SEQ ID NO: 25538

SEQ ID NO: 698799 - RNA, 64 nt, hsa; identical to SEQ ID NO: 25539

SEQ ID NO: 698800 - RNA, 64 nt, hsa; identical to SEQ ID NO: 25540

SEQ ID NO: 698801 - RNA, 64 nt, hsa; identical to SEQ ID NO: 25541

SEQ ID NO: 698802 - RNA, 64 nt, hsa; identical to SEQ ID NO: 25542

SEQ ID NO: 698803 - RNA, 64 nt, hsa; identical to SEQ ID NO: 25543

SEQ ID NO: 698804 - RNA, 64 nt, hsa; identical to SEQ ID NO: 25544

SEQ ID NO: 698805 - RNA, 64 nt, hsa; identical to SEQ ID NO: 25545

SEQ ID NO: 698806 - RNA, 64 nt, hsa; identical to SEQ ID NO: 25546

SEQ ID NO: 698807 - RNA, 64 nt, hsa; identical to SEQ ID NO: 25547

SEQ ID NO: 698808 - RNA, 64 nt, hsa; identical to SEQ ID NO: 25548

SEQ ID NO: 698809 - RNA, 64 nt, hsa; identical to SEQ ID NO: 25549

SEQ ID NO: 698810 - RNA, 64 nt, hsa; identical to SEQ ID NO: 25550

SEQ ID NO: 698811 - RNA, 64 nt, hsa; identical to SEQ ID NO: 25551

SEQ ID NO: 698812 - RNA, 64 nt, hsa; identical to SEQ ID NO: 25552

SEQ ID NO: 698813 - RNA, 64 nt, hsa; identical to SEQ ID NO: 25553

SEQ ID NO: 698814 - RNA, 64 nt, hsa; identical to SEQ ID NO: 25554

SEQ ID NO: 698815 - RNA, 64 nt, hsa; identical to SEQ ID NO: 25555

SEQ ID NO: 698816 - RNA, 64 nt, hsa; identical to SEQ ID NO: 25556

SEQ ID NO: 698817 - RNA, 64 nt, hsa; identical to SEQ ID NO: 25557

SEQ ID NO: 698818 - RNA, 64 nt, hsa; identical to SEQ ID NO: 25558

SEQ ID NO: 698819 - RNA, 64 nt, hsa; identical to SEQ ID NO: 25559

SEQ ID NO: 698820 - RNA, 64 nt, hsa; identical to SEQ ID NO: 25560

SEQ ID NO: 698821 - RNA, 63 nt, hsa; identical to SEQ ID NO: 25561

SEQ ID NO: 698822 - RNA, 62 nt, hsa; identical to SEQ ID NO: 25562

SEQ ID NO: 698823 - RNA, 64 nt, hsa; identical to SEQ ID NO: 25563

SEQ ID NO: 698824 - RNA, 64 nt, hsa; identical to SEQ ID NO: 25564

SEQ ID NO: 698825 - RNA, 64 nt, hsa; identical to SEQ ID NO: 25565

SEQ ID NO: 698826 - RNA, 64 nt, hsa; identical to SEQ ID NO: 25566

SEQ ID NO: 698827 - RNA, 64 nt, hsa; identical to SEQ ID NO: 25567

SEQ ID NO: 698828 - RNA, 64 nt, hsa; identical to SEQ ID NO: 25568

SEQ ID NO: 698829 - RNA, 64 nt, hsa; identical to SEQ ID NO: 25569

SEQ ID NO: 698830 - RNA, 64 nt, hsa; identical to SEQ ID NO: 25570

SEQ ID NO: 698831 - RNA, 64 nt, hsa; identical to SEQ ID NO: 25571

SEQ ID NO: 698832 - RNA, 64 nt, hsa; identical to SEQ ID NO: 25572

SEQ ID NO: 698833 - RNA, 64 nt, hsa; identical to SEQ ID NO: 25573

SEQ ID NO: 698834 - RNA, 64 nt, hsa; identical to SEQ ID NO: 25574

SEQ ID NO: 698835 - RNA, 64 nt, hsa; identical to SEQ ID NO: 25575

SEQ ID NO: 698836 - RNA, 64 nt, hsa; identical to SEQ ID NO: 25576

SEQ ID NO: 698837 - RNA, 64 nt, hsa; identical to SEQ ID NO: 25577

SEQ ID NO: 698838 - RNA, 64 nt, hsa; identical to SEQ ID NO: 25578

SEQ ID NO: 698839 - RNA, 64 nt, hsa; identical to SEQ ID NO: 25579

SEQ ID NO: 698840 - RNA, 64 nt, hsa; identical to SEQ ID NO: 25580

SEQ ID NO: 698841 - RNA, 64 nt, hsa; identical to SEQ ID NO: 25581

SEQ ID NO: 698842 - RNA, 64 nt, hsa; identical to SEQ ID NO: 25582

SEQ ID NO: 698843 - RNA, 64 nt, hsa; identical to SEQ ID NO: 25583

SEQ ID NO: 698844 - RNA, 64 nt, hsa; identical to SEQ ID NO: 25584

SEQ ID NO: 698845 - RNA, 64 nt, hsa; identical to SEQ ID NO: 25585

SEQ ID NO: 698846 - RNA, 64 nt, hsa; identical to SEQ ID NO: 25586

SEQ ID NO: 698847 - RNA, 64 nt, hsa; identical to SEQ ID NO: 25587

SEQ ID NO: 698848 - RNA, 64 nt, hsa; identical to SEQ ID NO: 25588

SEQ ID NO: 698849 - RNA, 64 nt, hsa; identical to SEQ ID NO: 25589

SEQ ID NO: 698850 - RNA, 64 nt, hsa; identical to SEQ ID NO: 25590

SEQ ID NO: 698851 - RNA, 64 nt, hsa; identical to SEQ ID NO: 25591

SEQ ID NO: 698852 - RNA, 64 nt, hsa; identical to SEQ ID NO: 25592

SEQ ID NO: 698853 - RNA, 64 nt, hsa; identical to SEQ ID NO: 25593

SEQ ID NO: 698854 - RNA, 64 nt, hsa; identical to SEQ ID NO: 25594

SEQ ID NO: 698855 - RNA, 64 nt, hsa; identical to SEQ ID NO: 25595

SEQ ID NO: 698856 - RNA, 64 nt, hsa; identical to SEQ ID NO: 25596

SEQ ID NO: 698857 - RNA, 64 nt, hsa; identical to SEQ ID NO: 25597

SEQ ID NO: 698858 - RNA, 64 nt, hsa; identical to SEQ ID NO: 25598

SEQ ID NO: 698859 - RNA, 64 nt, hsa; identical to SEQ ID NO: 25599

SEQ ID NO: 698860 - RNA, 64 nt, hsa; identical to SEQ ID NO: 25600

SEQ ID NO: 698861 - RNA, 64 nt, hsa; identical to SEQ ID NO: 25601

SEQ ID NO: 698862 - RNA, 64 nt, hsa; identical to SEQ ID NO: 25602

SEQ ID NO: 698863 - RNA, 64 nt, hsa; identical to SEQ ID NO: 25603

SEQ ID NO: 698864 - RNA, 64 nt, hsa; identical to SEQ ID NO: 25604

SEQ ID NO: 698865 - RNA, 64 nt, hsa; identical to SEQ ID NO: 25605

SEQ ID NO: 698866 - RNA, 64 nt, hsa; identical to SEQ ID NO: 25606

SEQ ID NO: 698867 - RNA, 64 nt, hsa; identical to SEQ ID NO: 25607

SEQ ID NO: 698868 - RNA, 64 nt, hsa; identical to SEQ ID NO: 25608

SEQ ID NO: 698869 - RNA, 64 nt, hsa; identical to SEQ ID NO: 25609

SEQ ID NO: 698870 - RNA, 64 nt, hsa; identical to SEQ ID NO: 25610

SEQ ID NO: 698871 - RNA, 64 nt, hsa; identical to SEQ ID NO: 25611

SEQ ID NO: 698872 - RNA, 64 nt, hsa; identical to SEQ ID NO: 25612

SEQ ID NO: 698873 - RNA, 64 nt, hsa; identical to SEQ ID NO: 25613

SEQ ID NO: 698874 - RNA, 64 nt, hsa; identical to SEQ ID NO: 25614

SEQ ID NO: 698875 - RNA, 64 nt, hsa; identical to SEQ ID NO: 25615

SEQ ID NO: 698876 - RNA, 64 nt, hsa; identical to SEQ ID NO: 25616

SEQ ID NO: 698877 - RNA, 64 nt, hsa; identical to SEQ ID NO: 25617

SEQ ID NO: 698878 - RNA, 64 nt, hsa; identical to SEQ ID NO: 25618

SEQ ID NO: 698879 - RNA, 64 nt, hsa; identical to SEQ ID NO: 25619

SEQ ID NO: 698880 - RNA, 64 nt, hsa; identical to SEQ ID NO: 25620

SEQ ID NO: 698881 - RNA, 64 nt, hsa; identical to SEQ ID NO: 25621

SEQ ID NO: 698882 - RNA, 64 nt, hsa; identical to SEQ ID NO: 25622

SEQ ID NO: 698883 - RNA, 64 nt, hsa; identical to SEQ ID NO: 25623

SEQ ID NO: 698884 - RNA, 64 nt, hsa; identical to SEQ ID NO: 25624

SEQ ID NO: 698885 - RNA, 64 nt, hsa; identical to SEQ ID NO: 25625

SEQ ID NO: 698886 - RNA, 64 nt, hsa; identical to SEQ ID NO: 25626

SEQ ID NO: 698887 - RNA, 64 nt, hsa; identical to SEQ ID NO: 25627

SEQ ID NO: 698888 - RNA, 64 nt, hsa; identical to SEQ ID NO: 25628

SEQ ID NO: 698889 - RNA, 64 nt, hsa; identical to SEQ ID NO: 25629

SEQ ID NO: 698890 - RNA, 64 nt, hsa; identical to SEQ ID NO: 25630

SEQ ID NO: 698891 - RNA, 64 nt, hsa; identical to SEQ ID NO: 25631

SEQ ID NO: 698892 - RNA, 64 nt, hsa; identical to SEQ ID NO: 25632

SEQ ID NO: 698893 - RNA, 64 nt, hsa; identical to SEQ ID NO: 25633

SEQ ID NO: 698894 - RNA, 64 nt, hsa; identical to SEQ ID NO: 25634

SEQ ID NO: 698895 - RNA, 64 nt, hsa; identical to SEQ ID NO: 25635

SEQ ID NO: 698896 - RNA, 64 nt, hsa; identical to SEQ ID NO: 25636

SEQ ID NO: 698897 - RNA, 64 nt, hsa; identical to SEQ ID NO: 25637

SEQ ID NO: 698898 - RNA, 64 nt, hsa; identical to SEQ ID NO: 25638

SEQ ID NO: 698899 - RNA, 64 nt, hsa; identical to SEQ ID NO: 25639

SEQ ID NO: 698900 - RNA, 64 nt, hsa; identical to SEQ ID NO: 25640

SEQ ID NO: 698901 - RNA, 64 nt, hsa; identical to SEQ ID NO: 25641

SEQ ID NO: 698902 - RNA, 64 nt, hsa; identical to SEQ ID NO: 25642

SEQ ID NO: 698903 - RNA, 64 nt, hsa; identical to SEQ ID NO: 25643

SEQ ID NO: 698904 - RNA, 64 nt, hsa; identical to SEQ ID NO: 25644

SEQ ID NO: 698905 - RNA, 64 nt, hsa; identical to SEQ ID NO: 25645

SEQ ID NO: 698906 - RNA, 64 nt, hsa; identical to SEQ ID NO: 25646

SEQ ID NO: 698907 - RNA, 64 nt, hsa; identical to SEQ ID NO: 25647

SEQ ID NO: 698908 - RNA, 64 nt, hsa; identical to SEQ ID NO: 25648

SEQ ID NO: 698909 - RNA, 64 nt, hsa; identical to SEQ ID NO: 25649

SEQ ID NO: 698910 - RNA, 64 nt, hsa; identical to SEQ ID NO: 25650

SEQ ID NO: 698911 - RNA, 64 nt, hsa; identical to SEQ ID NO: 25651

SEQ ID NO: 698912 - RNA, 64 nt, hsa; identical to SEQ ID NO: 25652

SEQ ID NO: 698913 - RNA, 64 nt, hsa; identical to SEQ ID NO: 25653

SEQ ID NO: 698914 - RNA, 64 nt, hsa; identical to SEQ ID NO: 25654

SEQ ID NO: 698915 - RNA, 64 nt, hsa; identical to SEQ ID NO: 25655

SEQ ID NO: 698916 - RNA, 64 nt, hsa; identical to SEQ ID NO: 25656

SEQ ID NO: 698917 - RNA, 64 nt, hsa; identical to SEQ ID NO: 25657

SEQ ID NO: 698918 - RNA, 64 nt, hsa; identical to SEQ ID NO: 25658

SEQ ID NO: 698919 - RNA, 64 nt, hsa; identical to SEQ ID NO: 25659

SEQ ID NO: 698920 - RNA, 64 nt, hsa; identical to SEQ ID NO: 25660

SEQ ID NO: 698921 - RNA, 64 nt, hsa; identical to SEQ ID NO: 25661

SEQ ID NO: 698922 - RNA, 64 nt, hsa; identical to SEQ ID NO: 25662

SEQ ID NO: 698923 - RNA, 64 nt, hsa; identical to SEQ ID NO: 25663

SEQ ID NO: 698924 - RNA, 64 nt, hsa; identical to SEQ ID NO: 25664

SEQ ID NO: 698925 - RNA, 64 nt, hsa; identical to SEQ ID NO: 25665

SEQ ID NO: 698926 - RNA, 64 nt, hsa; identical to SEQ ID NO: 25666

SEQ ID NO: 698927 - RNA, 64 nt, hsa; identical to SEQ ID NO: 25667

SEQ ID NO: 698928 - RNA, 64 nt, hsa; identical to SEQ ID NO: 25668

SEQ ID NO: 698929 - RNA, 64 nt, hsa; identical to SEQ ID NO: 25669

SEQ ID NO: 698930 - RNA, 64 nt, hsa; identical to SEQ ID NO: 25670

SEQ ID NO: 698931 - RNA, 64 nt, hsa; identical to SEQ ID NO: 25671

SEQ ID NO: 698932 - RNA, 64 nt, hsa; identical to SEQ ID NO: 25672

SEQ ID NO: 698933 - RNA, 64 nt, hsa; identical to SEQ ID NO: 25673

SEQ ID NO: 698934 - RNA, 64 nt, hsa; identical to SEQ ID NO: 25674

SEQ ID NO: 698935 - RNA, 64 nt, hsa; identical to SEQ ID NO: 25675

SEQ ID NO: 698936 - RNA, 64 nt, hsa; identical to SEQ ID NO: 25676

SEQ ID NO: 698937 - RNA, 64 nt, hsa; identical to SEQ ID NO: 25677

SEQ ID NO: 698938 - RNA, 64 nt, hsa; identical to SEQ ID NO: 25678

SEQ ID NO: 698939 - RNA, 64 nt, hsa; identical to SEQ ID NO: 25679

SEQ ID NO: 698940 - RNA, 64 nt, hsa; identical to SEQ ID NO: 25680

SEQ ID NO: 698941 - RNA, 64 nt, hsa; identical to SEQ ID NO: 25681

SEQ ID NO: 698942 - RNA, 64 nt, hsa; identical to SEQ ID NO: 25682

SEQ ID NO: 698943 - RNA, 64 nt, hsa; identical to SEQ ID NO: 25683

SEQ ID NO: 698944 - RNA, 64 nt, hsa; identical to SEQ ID NO: 25684

SEQ ID NO: 698945 - RNA, 64 nt, hsa; identical to SEQ ID NO: 25685

SEQ ID NO: 698946 - RNA, 64 nt, hsa; identical to SEQ ID NO: 25686

SEQ ID NO: 698947 - RNA, 64 nt, hsa; identical to SEQ ID NO: 25687

SEQ ID NO: 698948 - RNA, 64 nt, hsa; identical to SEQ ID NO: 25688

SEQ ID NO: 698949 - RNA, 64 nt, hsa; identical to SEQ ID NO: 25689

SEQ ID NO: 698950 - RNA, 64 nt, hsa; identical to SEQ ID NO: 25690

SEQ ID NO: 698951 - RNA, 64 nt, hsa; identical to SEQ ID NO: 25691

SEQ ID NO: 698952 - RNA, 64 nt, hsa; identical to SEQ ID NO: 25692

SEQ ID NO: 698953 - RNA, 64 nt, hsa; identical to SEQ ID NO: 25693

SEQ ID NO: 698954 - RNA, 64 nt, hsa; identical to SEQ ID NO: 25694

SEQ ID NO: 698955 - RNA, 64 nt, hsa; identical to SEQ ID NO: 25695

SEQ ID NO: 698956 - RNA, 64 nt, hsa; identical to SEQ ID NO: 25696

SEQ ID NO: 698957 - RNA, 64 nt, hsa; identical to SEQ ID NO: 25697

SEQ ID NO: 698958 - RNA, 64 nt, hsa; identical to SEQ ID NO: 25698

SEQ ID NO: 698959 - RNA, 64 nt, hsa; identical to SEQ ID NO: 25699

SEQ ID NO: 698960 - RNA, 64 nt, hsa; identical to SEQ ID NO: 25700

SEQ ID NO: 698961 - RNA, 64 nt, hsa; identical to SEQ ID NO: 25701

SEQ ID NO: 698962 - RNA, 64 nt, hsa; identical to SEQ ID NO: 25702

SEQ ID NO: 698963 - RNA, 64 nt, hsa; identical to SEQ ID NO: 25703

SEQ ID NO: 698964 - RNA, 64 nt, hsa; identical to SEQ ID NO: 25704

SEQ ID NO: 698965 - RNA, 64 nt, hsa; identical to SEQ ID NO: 25705

SEQ ID NO: 698966 - RNA, 64 nt, hsa; identical to SEQ ID NO: 25706

SEQ ID NO: 698967 - RNA, 64 nt, hsa; identical to SEQ ID NO: 25707

SEQ ID NO: 698968 - RNA, 64 nt, hsa; identical to SEQ ID NO: 25708

SEQ ID NO: 698969 - RNA, 64 nt, hsa; identical to SEQ ID NO: 25709

SEQ ID NO: 698970 - RNA, 64 nt, hsa; identical to SEQ ID NO: 25710

SEQ ID NO: 698971 - RNA, 64 nt, hsa; identical to SEQ ID NO: 25711

SEQ ID NO: 698972 - RNA, 64 nt, hsa; identical to SEQ ID NO: 25712

SEQ ID NO: 698973 - RNA, 64 nt, hsa; identical to SEQ ID NO: 25713

SEQ ID NO: 698974 - RNA, 64 nt, hsa; identical to SEQ ID NO: 25714

SEQ ID NO: 698975 - RNA, 64 nt, hsa; identical to SEQ ID NO: 25715

SEQ ID NO: 698976 - RNA, 64 nt, hsa; identical to SEQ ID NO: 25716

SEQ ID NO: 698977 - RNA, 64 nt, hsa; identical to SEQ ID NO: 25717

SEQ ID NO: 698978 - RNA, 64 nt, hsa; identical to SEQ ID NO: 25718

SEQ ID NO: 698979 - RNA, 64 nt, hsa; identical to SEQ ID NO: 25719

SEQ ID NO: 698980 - RNA, 64 nt, hsa; identical to SEQ ID NO: 25720

SEQ ID NO: 698981 - RNA, 64 nt, hsa; identical to SEQ ID NO: 25721

SEQ ID NO: 698982 - RNA, 64 nt, hsa; identical to SEQ ID NO: 25722

SEQ ID NO: 698983 - RNA, 64 nt, hsa; identical to SEQ ID NO: 25723

SEQ ID NO: 698984 - RNA, 64 nt, hsa; identical to SEQ ID NO: 25724

SEQ ID NO: 698985 - RNA, 64 nt, hsa; identical to SEQ ID NO: 25725

SEQ ID NO: 698986 - RNA, 64 nt, hsa; identical to SEQ ID NO: 25726

SEQ ID NO: 698987 - RNA, 64 nt, hsa; identical to SEQ ID NO: 25727

SEQ ID NO: 698988 - RNA, 64 nt, hsa; identical to SEQ ID NO: 25728

SEQ ID NO: 698989 - RNA, 64 nt, hsa; identical to SEQ ID NO: 25729

SEQ ID NO: 698990 - RNA, 64 nt, hsa; identical to SEQ ID NO: 25730

SEQ ID NO: 698991 - RNA, 64 nt, hsa; identical to SEQ ID NO: 25731

SEQ ID NO: 698992 - RNA, 64 nt, hsa; identical to SEQ ID NO: 25732

SEQ ID NO: 698993 - RNA, 64 nt, hsa; identical to SEQ ID NO: 25733

SEQ ID NO: 698994 - RNA, 64 nt, hsa; identical to SEQ ID NO: 25734

SEQ ID NO: 698995 - RNA, 64 nt, hsa; identical to SEQ ID NO: 25735

SEQ ID NO: 698996 - RNA, 64 nt, hsa; identical to SEQ ID NO: 25736

SEQ ID NO: 698997 - RNA, 64 nt, hsa; identical to SEQ ID NO: 25737

SEQ ID NO: 698998 - RNA, 64 nt, hsa; identical to SEQ ID NO: 25738

SEQ ID NO: 698999 - RNA, 64 nt, hsa; identical to SEQ ID NO: 25739

SEQ ID NO: 699000 - RNA, 64 nt, hsa; identical to SEQ ID NO: 25740

SEQ ID NO: 699001 - RNA, 64 nt, hsa; identical to SEQ ID NO: 25741

SEQ ID NO: 699002 - RNA, 64 nt, hsa; identical to SEQ ID NO: 25742

SEQ ID NO: 699003 - RNA, 64 nt, hsa; identical to SEQ ID NO: 25743

SEQ ID NO: 699004 - RNA, 64 nt, hsa; identical to SEQ ID NO: 25744

SEQ ID NO: 699005 - RNA, 64 nt, hsa; identical to SEQ ID NO: 25745

SEQ ID NO: 699006 - RNA, 64 nt, hsa; identical to SEQ ID NO: 25746

SEQ ID NO: 699007 - RNA, 64 nt, hsa; identical to SEQ ID NO: 25747

SEQ ID NO: 699008 - RNA, 64 nt, hsa; identical to SEQ ID NO: 25748

SEQ ID NO: 699009 - RNA, 64 nt, hsa; identical to SEQ ID NO: 25749

SEQ ID NO: 699010 - RNA, 64 nt, hsa; identical to SEQ ID NO: 25750

SEQ ID NO: 699011 - RNA, 64 nt, hsa; identical to SEQ ID NO: 25751

SEQ ID NO: 699012 - RNA, 64 nt, hsa; identical to SEQ ID NO: 25752

SEQ ID NO: 699013 - RNA, 64 nt, hsa; identical to SEQ ID NO: 25753

SEQ ID NO: 699014 - RNA, 64 nt, hsa; identical to SEQ ID NO: 25754

SEQ ID NO: 699015 - RNA, 64 nt, hsa; identical to SEQ ID NO: 25755

SEQ ID NO: 699016 - RNA, 64 nt, hsa; identical to SEQ ID NO: 25756

SEQ ID NO: 699017 - RNA, 64 nt, hsa; identical to SEQ ID NO: 25757

SEQ ID NO: 699018 - RNA, 64 nt, hsa; identical to SEQ ID NO: 25758

SEQ ID NO: 699019 - RNA, 64 nt, hsa; identical to SEQ ID NO: 25759

SEQ ID NO: 699020 - RNA, 64 nt, hsa; identical to SEQ ID NO: 25760

SEQ ID NO: 699021 - RNA, 64 nt, hsa; identical to SEQ ID NO: 25761

SEQ ID NO: 699022 - RNA, 64 nt, hsa; identical to SEQ ID NO: 25762

SEQ ID NO: 699023 - RNA, 64 nt, hsa; identical to SEQ ID NO: 25763

SEQ ID NO: 699024 - RNA, 64 nt, hsa; identical to SEQ ID NO: 25764

SEQ ID NO: 699025 - RNA, 64 nt, hsa; identical to SEQ ID NO: 25765

SEQ ID NO: 699026 - RNA, 64 nt, hsa; identical to SEQ ID NO: 25766

SEQ ID NO: 699027 - RNA, 64 nt, hsa; identical to SEQ ID NO: 25767

SEQ ID NO: 699028 - RNA, 64 nt, hsa; identical to SEQ ID NO: 25768

SEQ ID NO: 699029 - RNA, 64 nt, hsa; identical to SEQ ID NO: 25769

SEQ ID NO: 699030 - RNA, 64 nt, hsa; identical to SEQ ID NO: 25770

SEQ ID NO: 699031 - RNA, 64 nt, hsa; identical to SEQ ID NO: 25771

SEQ ID NO: 699032 - RNA, 64 nt, hsa; identical to SEQ ID NO: 25772

SEQ ID NO: 699033 - RNA, 64 nt, hsa; identical to SEQ ID NO: 25773

SEQ ID NO: 699034 - RNA, 64 nt, hsa; identical to SEQ ID NO: 25774

SEQ ID NO: 699035 - RNA, 64 nt, hsa; identical to SEQ ID NO: 25775

SEQ ID NO: 699036 - RNA, 64 nt, hsa; identical to SEQ ID NO: 25776

SEQ ID NO: 699037 - RNA, 64 nt, hsa; identical to SEQ ID NO: 25777

SEQ ID NO: 699038 - RNA, 64 nt, hsa; identical to SEQ ID NO: 25778

SEQ ID NO: 699039 - RNA, 64 nt, hsa; identical to SEQ ID NO: 25779

SEQ ID NO: 699040 - RNA, 64 nt, hsa; identical to SEQ ID NO: 25780

SEQ ID NO: 699041 - RNA, 64 nt, hsa; identical to SEQ ID NO: 25781

SEQ ID NO: 699042 - RNA, 64 nt, hsa; identical to SEQ ID NO: 25782

SEQ ID NO: 699043 - RNA, 64 nt, hsa; identical to SEQ ID NO: 25783

SEQ ID NO: 699044 - RNA, 64 nt, hsa; identical to SEQ ID NO: 25784

SEQ ID NO: 699045 - RNA, 64 nt, hsa; identical to SEQ ID NO: 25785

SEQ ID NO: 699046 - RNA, 64 nt, hsa; identical to SEQ ID NO: 25786

SEQ ID NO: 699047 - RNA, 64 nt, hsa; identical to SEQ ID NO: 25787

SEQ ID NO: 699048 - RNA, 64 nt, hsa; identical to SEQ ID NO: 25788

SEQ ID NO: 699049 - RNA, 64 nt, hsa; identical to SEQ ID NO: 25789

SEQ ID NO: 699050 - RNA, 64 nt, hsa; identical to SEQ ID NO: 25790

SEQ ID NO: 699051 - RNA, 64 nt, hsa; identical to SEQ ID NO: 25791

SEQ ID NO: 699052 - RNA, 64 nt, hsa; identical to SEQ ID NO: 25792

SEQ ID NO: 699053 - RNA, 64 nt, hsa; identical to SEQ ID NO: 25793

SEQ ID NO: 699054 - RNA, 64 nt, hsa; identical to SEQ ID NO: 25794

SEQ ID NO: 699055 - RNA, 64 nt, hsa; identical to SEQ ID NO: 25795

SEQ ID NO: 699056 - RNA, 64 nt, hsa; identical to SEQ ID NO: 25796

SEQ ID NO: 699057 - RNA, 64 nt, hsa; identical to SEQ ID NO: 25797

SEQ ID NO: 699058 - RNA, 64 nt, hsa; identical to SEQ ID NO: 25798

SEQ ID NO: 699059 - RNA, 64 nt, hsa; identical to SEQ ID NO: 25799

SEQ ID NO: 699060 - RNA, 64 nt, hsa; identical to SEQ ID NO: 25800

SEQ ID NO: 699061 - RNA, 64 nt, hsa; identical to SEQ ID NO: 25801

SEQ ID NO: 699062 - RNA, 64 nt, hsa; identical to SEQ ID NO: 25802

SEQ ID NO: 699063 - RNA, 64 nt, hsa; identical to SEQ ID NO: 25803

SEQ ID NO: 699064 - RNA, 64 nt, hsa; identical to SEQ ID NO: 25804

SEQ ID NO: 699065 - RNA, 64 nt, hsa; identical to SEQ ID NO: 25805

SEQ ID NO: 699066 - RNA, 64 nt, hsa; identical to SEQ ID NO: 25806

SEQ ID NO: 699067 - RNA, 64 nt, hsa; identical to SEQ ID NO: 25807

SEQ ID NO: 699068 - RNA, 64 nt, hsa; identical to SEQ ID NO: 25808

SEQ ID NO: 699069 - RNA, 64 nt, hsa; identical to SEQ ID NO: 25809

SEQ ID NO: 699070 - RNA, 64 nt, hsa; identical to SEQ ID NO: 25810

SEQ ID NO: 699071 - RNA, 64 nt, hsa; identical to SEQ ID NO: 25811

SEQ ID NO: 699072 - RNA, 64 nt, hsa; identical to SEQ ID NO: 25812

SEQ ID NO: 699073 - RNA, 64 nt, hsa; identical to SEQ ID NO: 25813

SEQ ID NO: 699074 - RNA, 64 nt, hsa; identical to SEQ ID NO: 25814

SEQ ID NO: 699075 - RNA, 64 nt, hsa; identical to SEQ ID NO: 25815

SEQ ID NO: 699076 - RNA, 64 nt, hsa; identical to SEQ ID NO: 25816

SEQ ID NO: 699077 - RNA, 64 nt, hsa; identical to SEQ ID NO: 25817

SEQ ID NO: 699078 - RNA, 64 nt, hsa; identical to SEQ ID NO: 25818

SEQ ID NO: 699079 - RNA, 64 nt, hsa; identical to SEQ ID NO: 25819

SEQ ID NO: 699080 - RNA, 64 nt, hsa; identical to SEQ ID NO: 25820

SEQ ID NO: 699081 - RNA, 64 nt, hsa; identical to SEQ ID NO: 25821

SEQ ID NO: 699082 - RNA, 62 nt, hsa; identical to SEQ ID NO: 25822

SEQ ID NO: 699083 - RNA, 64 nt, hsa; identical to SEQ ID NO: 25823

SEQ ID NO: 699084 - RNA, 64 nt, hsa; identical to SEQ ID NO: 25824

SEQ ID NO: 699085 - RNA, 64 nt, hsa; identical to SEQ ID NO: 25825

SEQ ID NO: 699086 - RNA, 64 nt, hsa; identical to SEQ ID NO: 25826

SEQ ID NO: 699087 - RNA, 64 nt, hsa; identical to SEQ ID NO: 25827

SEQ ID NO: 699088 - RNA, 64 nt, hsa; identical to SEQ ID NO: 25828

SEQ ID NO: 699089 - RNA, 64 nt, hsa; identical to SEQ ID NO: 25829

SEQ ID NO: 699090 - RNA, 64 nt, hsa; identical to SEQ ID NO: 25830

SEQ ID NO: 699091 - RNA, 64 nt, hsa; identical to SEQ ID NO: 25831

SEQ ID NO: 699092 - RNA, 64 nt, hsa; identical to SEQ ID NO: 25832

SEQ ID NO: 699093 - RNA, 64 nt, hsa; identical to SEQ ID NO: 25833

SEQ ID NO: 699094 - RNA, 64 nt, hsa; identical to SEQ ID NO: 25834

SEQ ID NO: 699095 - RNA, 64 nt, hsa; identical to SEQ ID NO: 25835

SEQ ID NO: 699096 - RNA, 64 nt, hsa; identical to SEQ ID NO: 25836

SEQ ID NO: 699097 - RNA, 64 nt, hsa; identical to SEQ ID NO: 25837

SEQ ID NO: 699098 - RNA, 64 nt, hsa; identical to SEQ ID NO: 25838

SEQ ID NO: 699099 - RNA, 64 nt, hsa; identical to SEQ ID NO: 25839

SEQ ID NO: 699100 - RNA, 64 nt, hsa; identical to SEQ ID NO: 25840

SEQ ID NO: 699101 - RNA, 64 nt, hsa; identical to SEQ ID NO: 25841

SEQ ID NO: 699102 - RNA, 64 nt, hsa; identical to SEQ ID NO: 25842

SEQ ID NO: 699103 - RNA, 64 nt, hsa; identical to SEQ ID NO: 25843

SEQ ID NO: 699104 - RNA, 64 nt, hsa; identical to SEQ ID NO: 25844

SEQ ID NO: 699105 - RNA, 64 nt, hsa; identical to SEQ ID NO: 25845

SEQ ID NO: 699106 - RNA, 64 nt, hsa; identical to SEQ ID NO: 25846

SEQ ID NO: 699107 - RNA, 64 nt, hsa; identical to SEQ ID NO: 25847

SEQ ID NO: 699108 - RNA, 64 nt, hsa; identical to SEQ ID NO: 25848

SEQ ID NO: 699109 - RNA, 64 nt, hsa; identical to SEQ ID NO: 25849

SEQ ID NO: 699110 - RNA, 64 nt, hsa; identical to SEQ ID NO: 25850

SEQ ID NO: 699111 - RNA, 64 nt, hsa; identical to SEQ ID NO: 25851

SEQ ID NO: 699112 - RNA, 64 nt, hsa; identical to SEQ ID NO: 25852

SEQ ID NO: 699113 - RNA, 64 nt, hsa; identical to SEQ ID NO: 25853

SEQ ID NO: 699114 - RNA, 64 nt, hsa; identical to SEQ ID NO: 25854

SEQ ID NO: 699115 - RNA, 64 nt, hsa; identical to SEQ ID NO: 25855

SEQ ID NO: 699116 - RNA, 64 nt, hsa; identical to SEQ ID NO: 25856

SEQ ID NO: 699117 - RNA, 64 nt, hsa; identical to SEQ ID NO: 25857

SEQ ID NO: 699118 - RNA, 64 nt, hsa; identical to SEQ ID NO: 25858

SEQ ID NO: 699119 - RNA, 64 nt, hsa; identical to SEQ ID NO: 25859

SEQ ID NO: 699120 - RNA, 64 nt, hsa; identical to SEQ ID NO: 25860

SEQ ID NO: 699121 - RNA, 64 nt, hsa; identical to SEQ ID NO: 25861

SEQ ID NO: 699122 - RNA, 64 nt, hsa; identical to SEQ ID NO: 25862

SEQ ID NO: 699123 - RNA, 64 nt, hsa; identical to SEQ ID NO: 25863

SEQ ID NO: 699124 - RNA, 64 nt, hsa; identical to SEQ ID NO: 25864

SEQ ID NO: 699125 - RNA, 64 nt, hsa; identical to SEQ ID NO: 25865

SEQ ID NO: 699126 - RNA, 64 nt, hsa; identical to SEQ ID NO: 25866

SEQ ID NO: 699127 - RNA, 64 nt, hsa; identical to SEQ ID NO: 25867

SEQ ID NO: 699128 - RNA, 64 nt, hsa; identical to SEQ ID NO: 25868

SEQ ID NO: 699129 - RNA, 64 nt, hsa; identical to SEQ ID NO: 25869

SEQ ID NO: 699130 - RNA, 64 nt, hsa; identical to SEQ ID NO: 25870

SEQ ID NO: 699131 - RNA, 64 nt, hsa; identical to SEQ ID NO: 25871

SEQ ID NO: 699132 - RNA, 64 nt, hsa; identical to SEQ ID NO: 25872

SEQ ID NO: 699133 - RNA, 64 nt, hsa; identical to SEQ ID NO: 25873

SEQ ID NO: 699134 - RNA, 64 nt, hsa; identical to SEQ ID NO: 25874

SEQ ID NO: 699135 - RNA, 64 nt, hsa; identical to SEQ ID NO: 25875

SEQ ID NO: 699136 - RNA, 64 nt, hsa; identical to SEQ ID NO: 25876

SEQ ID NO: 699137 - RNA, 64 nt, hsa; identical to SEQ ID NO: 25877

SEQ ID NO: 699138 - RNA, 64 nt, hsa; identical to SEQ ID NO: 25878

SEQ ID NO: 699139 - RNA, 64 nt, hsa; identical to SEQ ID NO: 25879

SEQ ID NO: 699140 - RNA, 64 nt, hsa; identical to SEQ ID NO: 25880

SEQ ID NO: 699141 - RNA, 64 nt, hsa; identical to SEQ ID NO: 25881

SEQ ID NO: 699142 - RNA, 64 nt, hsa; identical to SEQ ID NO: 25882

SEQ ID NO: 699143 - RNA, 64 nt, hsa; identical to SEQ ID NO: 25883

SEQ ID NO: 699144 - RNA, 64 nt, hsa; identical to SEQ ID NO: 25884

SEQ ID NO: 699145 - RNA, 64 nt, hsa; identical to SEQ ID NO: 25885

SEQ ID NO: 699146 - RNA, 64 nt, hsa; identical to SEQ ID NO: 25886

SEQ ID NO: 699147 - RNA, 64 nt, hsa; identical to SEQ ID NO: 25887

SEQ ID NO: 699148 - RNA, 64 nt, hsa; identical to SEQ ID NO: 25888

SEQ ID NO: 699149 - RNA, 64 nt, hsa; identical to SEQ ID NO: 25889

SEQ ID NO: 699150 - RNA, 64 nt, hsa; identical to SEQ ID NO: 25890

SEQ ID NO: 699151 - RNA, 64 nt, hsa; identical to SEQ ID NO: 25891

SEQ ID NO: 699152 - RNA, 64 nt, hsa; identical to SEQ ID NO: 25892

SEQ ID NO: 699153 - RNA, 64 nt, hsa; identical to SEQ ID NO: 25893

SEQ ID NO: 699154 - RNA, 64 nt, hsa; identical to SEQ ID NO: 25894

SEQ ID NO: 699155 - RNA, 64 nt, hsa; identical to SEQ ID NO: 25895

SEQ ID NO: 699156 - RNA, 64 nt, hsa; identical to SEQ ID NO: 25896

SEQ ID NO: 699157 - RNA, 64 nt, hsa; identical to SEQ ID NO: 25897

SEQ ID NO: 699158 - RNA, 64 nt, hsa; identical to SEQ ID NO: 25898

SEQ ID NO: 699159 - RNA, 64 nt, hsa; identical to SEQ ID NO: 25899

SEQ ID NO: 699160 - RNA, 64 nt, hsa; identical to SEQ ID NO: 25900

SEQ ID NO: 699161 - RNA, 64 nt, hsa; identical to SEQ ID NO: 25901

SEQ ID NO: 699162 - RNA, 64 nt, hsa; identical to SEQ ID NO: 25902

SEQ ID NO: 699163 - RNA, 64 nt, hsa; identical to SEQ ID NO: 25903

SEQ ID NO: 699164 - RNA, 64 nt, hsa; identical to SEQ ID NO: 25904

SEQ ID NO: 699165 - RNA, 64 nt, hsa; identical to SEQ ID NO: 25905

SEQ ID NO: 699166 - RNA, 64 nt, hsa; identical to SEQ ID NO: 25906

SEQ ID NO: 699167 - RNA, 64 nt, hsa; identical to SEQ ID NO: 25907

SEQ ID NO: 699168 - RNA, 64 nt, hsa; identical to SEQ ID NO: 25908

SEQ ID NO: 699169 - RNA, 64 nt, hsa; identical to SEQ ID NO: 25909

SEQ ID NO: 699170 - RNA, 64 nt, hsa; identical to SEQ ID NO: 25910

SEQ ID NO: 699171 - RNA, 64 nt, hsa; identical to SEQ ID NO: 25911

SEQ ID NO: 699172 - RNA, 64 nt, hsa; identical to SEQ ID NO: 25912

SEQ ID NO: 699173 - RNA, 64 nt, hsa; identical to SEQ ID NO: 25913

SEQ ID NO: 699174 - RNA, 64 nt, hsa; identical to SEQ ID NO: 25914

SEQ ID NO: 699175 - RNA, 64 nt, hsa; identical to SEQ ID NO: 25915

SEQ ID NO: 699176 - RNA, 64 nt, hsa; identical to SEQ ID NO: 25916

SEQ ID NO: 699177 - RNA, 64 nt, hsa; identical to SEQ ID NO: 25917

SEQ ID NO: 699178 - RNA, 64 nt, hsa; identical to SEQ ID NO: 25918

SEQ ID NO: 699179 - RNA, 64 nt, hsa; identical to SEQ ID NO: 25919

SEQ ID NO: 699180 - RNA, 64 nt, hsa; identical to SEQ ID NO: 25920

SEQ ID NO: 699181 - RNA, 64 nt, hsa; identical to SEQ ID NO: 25921

SEQ ID NO: 699182 - RNA, 64 nt, hsa; identical to SEQ ID NO: 25922

SEQ ID NO: 699183 - RNA, 64 nt, hsa; identical to SEQ ID NO: 25923

SEQ ID NO: 699184 - RNA, 64 nt, hsa; identical to SEQ ID NO: 25924

SEQ ID NO: 699185 - RNA, 64 nt, hsa; identical to SEQ ID NO: 25925

SEQ ID NO: 699186 - RNA, 64 nt, hsa; identical to SEQ ID NO: 25926

SEQ ID NO: 699187 - RNA, 64 nt, hsa; identical to SEQ ID NO: 25927

SEQ ID NO: 699188 - RNA, 64 nt, hsa; identical to SEQ ID NO: 25928

SEQ ID NO: 699189 - RNA, 64 nt, hsa; identical to SEQ ID NO: 25929

SEQ ID NO: 699190 - RNA, 64 nt, hsa; identical to SEQ ID NO: 25930

SEQ ID NO: 699191 - RNA, 64 nt, hsa; identical to SEQ ID NO: 25931

SEQ ID NO: 699192 - RNA, 64 nt, hsa; identical to SEQ ID NO: 25932

SEQ ID NO: 699193 - RNA, 64 nt, hsa; identical to SEQ ID NO: 25933

SEQ ID NO: 699194 - RNA, 64 nt, hsa; identical to SEQ ID NO: 25934

SEQ ID NO: 699195 - RNA, 64 nt, hsa; identical to SEQ ID NO: 25935

SEQ ID NO: 699196 - RNA, 64 nt, hsa; identical to SEQ ID NO: 25936

SEQ ID NO: 699197 - RNA, 64 nt, hsa; identical to SEQ ID NO: 25937

SEQ ID NO: 699198 - RNA, 64 nt, hsa; identical to SEQ ID NO: 25938

SEQ ID NO: 699199 - RNA, 64 nt, hsa; identical to SEQ ID NO: 25939

SEQ ID NO: 699200 - RNA, 64 nt, hsa; identical to SEQ ID NO: 25940

SEQ ID NO: 699201 - RNA, 64 nt, hsa; identical to SEQ ID NO: 25941

SEQ ID NO: 699202 - RNA, 64 nt, hsa; identical to SEQ ID NO: 25942

SEQ ID NO: 699203 - RNA, 64 nt, hsa; identical to SEQ ID NO: 25943

SEQ ID NO: 699204 - RNA, 64 nt, hsa; identical to SEQ ID NO: 25944

SEQ ID NO: 699205 - RNA, 64 nt, hsa; identical to SEQ ID NO: 25945

SEQ ID NO: 699206 - RNA, 64 nt, hsa; identical to SEQ ID NO: 25946

SEQ ID NO: 699207 - RNA, 64 nt, hsa; identical to SEQ ID NO: 25947

SEQ ID NO: 699208 - RNA, 64 nt, hsa; identical to SEQ ID NO: 25948

SEQ ID NO: 699209 - RNA, 64 nt, hsa; identical to SEQ ID NO: 25949

SEQ ID NO: 699210 - RNA, 64 nt, hsa; identical to SEQ ID NO: 25950

SEQ ID NO: 699211 - RNA, 64 nt, hsa; identical to SEQ ID NO: 25951

SEQ ID NO: 699212 - RNA, 64 nt, hsa; identical to SEQ ID NO: 25952

SEQ ID NO: 699213 - RNA, 64 nt, hsa; identical to SEQ ID NO: 25953

SEQ ID NO: 699214 - RNA, 64 nt, hsa; identical to SEQ ID NO: 25954

SEQ ID NO: 699215 - RNA, 64 nt, hsa; identical to SEQ ID NO: 25955

SEQ ID NO: 699216 - RNA, 64 nt, hsa; identical to SEQ ID NO: 25956

SEQ ID NO: 699217 - RNA, 64 nt, hsa; identical to SEQ ID NO: 25957

SEQ ID NO: 699218 - RNA, 64 nt, hsa; identical to SEQ ID NO: 25958

SEQ ID NO: 699219 - RNA, 64 nt, hsa; identical to SEQ ID NO: 25959

SEQ ID NO: 699220 - RNA, 64 nt, hsa; identical to SEQ ID NO: 25960

SEQ ID NO: 699221 - RNA, 64 nt, hsa; identical to SEQ ID NO: 25961

SEQ ID NO: 699222 - RNA, 64 nt, hsa; identical to SEQ ID NO: 25962

SEQ ID NO: 699223 - RNA, 64 nt, hsa; identical to SEQ ID NO: 25963

SEQ ID NO: 699224 - RNA, 64 nt, hsa; identical to SEQ ID NO: 25964

SEQ ID NO: 699225 - RNA, 64 nt, hsa; identical to SEQ ID NO: 25965

SEQ ID NO: 699226 - RNA, 64 nt, hsa; identical to SEQ ID NO: 25966

SEQ ID NO: 699227 - RNA, 64 nt, hsa; identical to SEQ ID NO: 25967

SEQ ID NO: 699228 - RNA, 64 nt, hsa; identical to SEQ ID NO: 25968

SEQ ID NO: 699229 - RNA, 64 nt, hsa; identical to SEQ ID NO: 25969

SEQ ID NO: 699230 - RNA, 64 nt, hsa; identical to SEQ ID NO: 25970

SEQ ID NO: 699231 - RNA, 64 nt, hsa; identical to SEQ ID NO: 25971

SEQ ID NO: 699232 - RNA, 64 nt, hsa; identical to SEQ ID NO: 25972

SEQ ID NO: 699233 - RNA, 64 nt, hsa; identical to SEQ ID NO: 25973

SEQ ID NO: 699234 - RNA, 64 nt, hsa; identical to SEQ ID NO: 25974

SEQ ID NO: 699235 - RNA, 64 nt, hsa; identical to SEQ ID NO: 25975

SEQ ID NO: 699236 - RNA, 64 nt, hsa; identical to SEQ ID NO: 25976

SEQ ID NO: 699237 - RNA, 64 nt, hsa; identical to SEQ ID NO: 25977

SEQ ID NO: 699238 - RNA, 64 nt, hsa; identical to SEQ ID NO: 25978

SEQ ID NO: 699239 - RNA, 64 nt, hsa; identical to SEQ ID NO: 25979

SEQ ID NO: 699240 - RNA, 64 nt, hsa; identical to SEQ ID NO: 25980

SEQ ID NO: 699241 - RNA, 64 nt, hsa; identical to SEQ ID NO: 25981

SEQ ID NO: 699242 - RNA, 64 nt, hsa; identical to SEQ ID NO: 25982

SEQ ID NO: 699243 - RNA, 64 nt, hsa; identical to SEQ ID NO: 25983

SEQ ID NO: 699244 - RNA, 64 nt, hsa; identical to SEQ ID NO: 25984

SEQ ID NO: 699245 - RNA, 64 nt, hsa; identical to SEQ ID NO: 25985

SEQ ID NO: 699246 - RNA, 64 nt, hsa; identical to SEQ ID NO: 25986

SEQ ID NO: 699247 - RNA, 64 nt, hsa; identical to SEQ ID NO: 25987

SEQ ID NO: 699248 - RNA, 64 nt, hsa; identical to SEQ ID NO: 25988

SEQ ID NO: 699249 - RNA, 64 nt, hsa; identical to SEQ ID NO: 25989

SEQ ID NO: 699250 - RNA, 64 nt, hsa; identical to SEQ ID NO: 25990

SEQ ID NO: 699251 - RNA, 64 nt, hsa; identical to SEQ ID NO: 25991

SEQ ID NO: 699252 - RNA, 64 nt, hsa; identical to SEQ ID NO: 25992

SEQ ID NO: 699253 - RNA, 64 nt, hsa; identical to SEQ ID NO: 25993

SEQ ID NO: 699254 - RNA, 64 nt, hsa; identical to SEQ ID NO: 25994

SEQ ID NO: 699255 - RNA, 64 nt, hsa; identical to SEQ ID NO: 25995

SEQ ID NO: 699256 - RNA, 64 nt, hsa; identical to SEQ ID NO: 25996

SEQ ID NO: 699257 - RNA, 64 nt, hsa; identical to SEQ ID NO: 25997

SEQ ID NO: 699258 - RNA, 64 nt, hsa; identical to SEQ ID NO: 25998

SEQ ID NO: 699259 - RNA, 64 nt, hsa; identical to SEQ ID NO: 25999

SEQ ID NO: 699260 - RNA, 64 nt, hsa; identical to SEQ ID NO: 26000

SEQ ID NO: 699261 - RNA, 64 nt, hsa; identical to SEQ ID NO: 26001

SEQ ID NO: 699262 - RNA, 64 nt, hsa; identical to SEQ ID NO: 26002

SEQ ID NO: 699263 - RNA, 64 nt, hsa; identical to SEQ ID NO: 26003

SEQ ID NO: 699264 - RNA, 64 nt, hsa; identical to SEQ ID NO: 26004

SEQ ID NO: 699265 - RNA, 64 nt, hsa; identical to SEQ ID NO: 26005

SEQ ID NO: 699266 - RNA, 64 nt, hsa; identical to SEQ ID NO: 26006

SEQ ID NO: 699267 - RNA, 64 nt, hsa; identical to SEQ ID NO: 26007

SEQ ID NO: 699268 - RNA, 64 nt, hsa; identical to SEQ ID NO: 26008

SEQ ID NO: 699269 - RNA, 64 nt, hsa; identical to SEQ ID NO: 26009

SEQ ID NO: 699270 - RNA, 64 nt, hsa; identical to SEQ ID NO: 26010

SEQ ID NO: 699271 - RNA, 64 nt, hsa; identical to SEQ ID NO: 26011

SEQ ID NO: 699272 - RNA, 64 nt, hsa; identical to SEQ ID NO: 26012

SEQ ID NO: 699273 - RNA, 64 nt, hsa; identical to SEQ ID NO: 26013

SEQ ID NO: 699274 - RNA, 64 nt, hsa; identical to SEQ ID NO: 26014

SEQ ID NO: 699275 - RNA, 64 nt, hsa; identical to SEQ ID NO: 26015

SEQ ID NO: 699276 - RNA, 64 nt, hsa; identical to SEQ ID NO: 26016

SEQ ID NO: 699277 - RNA, 64 nt, hsa; identical to SEQ ID NO: 26017

SEQ ID NO: 699278 - RNA, 64 nt, hsa; identical to SEQ ID NO: 26018

SEQ ID NO: 699279 - RNA, 64 nt, hsa; identical to SEQ ID NO: 26019

SEQ ID NO: 699280 - RNA, 64 nt, hsa; identical to SEQ ID NO: 26020

SEQ ID NO: 699281 - RNA, 64 nt, hsa; identical to SEQ ID NO: 26021

SEQ ID NO: 699282 - RNA, 64 nt, hsa; identical to SEQ ID NO: 26022

SEQ ID NO: 699283 - RNA, 64 nt, hsa; identical to SEQ ID NO: 26023

SEQ ID NO: 699284 - RNA, 64 nt, hsa; identical to SEQ ID NO: 26024

SEQ ID NO: 699285 - RNA, 64 nt, hsa; identical to SEQ ID NO: 26025

SEQ ID NO: 699286 - RNA, 64 nt, hsa; identical to SEQ ID NO: 26026

SEQ ID NO: 699287 - RNA, 64 nt, hsa; identical to SEQ ID NO: 26027

SEQ ID NO: 699288 - RNA, 64 nt, hsa; identical to SEQ ID NO: 26028

SEQ ID NO: 699289 - RNA, 64 nt, hsa; identical to SEQ ID NO: 26029

SEQ ID NO: 699290 - RNA, 64 nt, hsa; identical to SEQ ID NO: 26030

SEQ ID NO: 699291 - RNA, 64 nt, hsa; identical to SEQ ID NO: 26031

SEQ ID NO: 699292 - RNA, 64 nt, hsa; identical to SEQ ID NO: 26032

SEQ ID NO: 699293 - RNA, 64 nt, hsa; identical to SEQ ID NO: 26033

SEQ ID NO: 699294 - RNA, 64 nt, hsa; identical to SEQ ID NO: 26034

SEQ ID NO: 699295 - RNA, 64 nt, hsa; identical to SEQ ID NO: 26035

SEQ ID NO: 699296 - RNA, 64 nt, hsa; identical to SEQ ID NO: 26036

SEQ ID NO: 699297 - RNA, 64 nt, hsa; identical to SEQ ID NO: 26037

SEQ ID NO: 699298 - RNA, 64 nt, hsa; identical to SEQ ID NO: 26038

SEQ ID NO: 699299 - RNA, 64 nt, hsa; identical to SEQ ID NO: 26039

SEQ ID NO: 699300 - RNA, 64 nt, hsa; identical to SEQ ID NO: 26040

SEQ ID NO: 699301 - RNA, 64 nt, hsa; identical to SEQ ID NO: 26041

SEQ ID NO: 699302 - RNA, 64 nt, hsa; identical to SEQ ID NO: 26042

SEQ ID NO: 699303 - RNA, 64 nt, hsa; identical to SEQ ID NO: 26043

SEQ ID NO: 699304 - RNA, 64 nt, hsa; identical to SEQ ID NO: 26044

SEQ ID NO: 699305 - RNA, 64 nt, hsa; identical to SEQ ID NO: 26045

SEQ ID NO: 699306 - RNA, 64 nt, hsa; identical to SEQ ID NO: 26046

SEQ ID NO: 699307 - RNA, 64 nt, hsa; identical to SEQ ID NO: 26047

SEQ ID NO: 699308 - RNA, 64 nt, hsa; identical to SEQ ID NO: 26048

SEQ ID NO: 699309 - RNA, 64 nt, hsa; identical to SEQ ID NO: 26049

SEQ ID NO: 699310 - RNA, 64 nt, hsa; identical to SEQ ID NO: 26050

SEQ ID NO: 699311 - RNA, 64 nt, hsa; identical to SEQ ID NO: 26051

SEQ ID NO: 699312 - RNA, 64 nt, hsa; identical to SEQ ID NO: 26052

SEQ ID NO: 699313 - RNA, 64 nt, hsa; identical to SEQ ID NO: 26053

SEQ ID NO: 699314 - RNA, 64 nt, hsa; identical to SEQ ID NO: 26054

SEQ ID NO: 699315 - RNA, 64 nt, hsa; identical to SEQ ID NO: 26055

SEQ ID NO: 699316 - RNA, 64 nt, hsa; identical to SEQ ID NO: 26056

SEQ ID NO: 699317 - RNA, 64 nt, hsa; identical to SEQ ID NO: 26057

SEQ ID NO: 699318 - RNA, 64 nt, hsa; identical to SEQ ID NO: 26058

SEQ ID NO: 699319 - RNA, 64 nt, hsa; identical to SEQ ID NO: 26059

SEQ ID NO: 699320 - RNA, 64 nt, hsa; identical to SEQ ID NO: 26060

SEQ ID NO: 699321 - RNA, 64 nt, hsa; identical to SEQ ID NO: 26061

SEQ ID NO: 699322 - RNA, 64 nt, hsa; identical to SEQ ID NO: 26062

SEQ ID NO: 699323 - RNA, 64 nt, hsa; identical to SEQ ID NO: 26063

SEQ ID NO: 699324 - RNA, 64 nt, hsa; identical to SEQ ID NO: 26064

SEQ ID NO: 699325 - RNA, 64 nt, hsa; identical to SEQ ID NO: 26065

SEQ ID NO: 699326 - RNA, 64 nt, hsa; identical to SEQ ID NO: 26066

SEQ ID NO: 699327 - RNA, 64 nt, hsa; identical to SEQ ID NO: 26067

SEQ ID NO: 699328 - RNA, 64 nt, hsa; identical to SEQ ID NO: 26068

SEQ ID NO: 699329 - RNA, 64 nt, hsa; identical to SEQ ID NO: 26069

SEQ ID NO: 699330 - RNA, 64 nt, hsa; identical to SEQ ID NO: 26070

SEQ ID NO: 699331 - RNA, 64 nt, hsa; identical to SEQ ID NO: 26071

SEQ ID NO: 699332 - RNA, 64 nt, hsa; identical to SEQ ID NO: 26072

SEQ ID NO: 699333 - RNA, 64 nt, hsa; identical to SEQ ID NO: 26073

SEQ ID NO: 699334 - RNA, 64 nt, hsa; identical to SEQ ID NO: 26074

SEQ ID NO: 699335 - RNA, 64 nt, hsa; identical to SEQ ID NO: 26075

SEQ ID NO: 699336 - RNA, 64 nt, hsa; identical to SEQ ID NO: 26076

SEQ ID NO: 699337 - RNA, 64 nt, hsa; identical to SEQ ID NO: 26077

SEQ ID NO: 699338 - RNA, 64 nt, hsa; identical to SEQ ID NO: 26078

SEQ ID NO: 699339 - RNA, 64 nt, hsa; identical to SEQ ID NO: 26079

SEQ ID NO: 699340 - RNA, 64 nt, hsa; identical to SEQ ID NO: 26080

SEQ ID NO: 699341 - RNA, 64 nt, hsa; identical to SEQ ID NO: 26081

SEQ ID NO: 699342 - RNA, 64 nt, hsa; identical to SEQ ID NO: 26082

SEQ ID NO: 699343 - RNA, 64 nt, hsa; identical to SEQ ID NO: 26083

SEQ ID NO: 699344 - RNA, 64 nt, hsa; identical to SEQ ID NO: 26084

SEQ ID NO: 699345 - RNA, 64 nt, hsa; identical to SEQ ID NO: 26085

SEQ ID NO: 699346 - RNA, 64 nt, hsa; identical to SEQ ID NO: 26086

SEQ ID NO: 699347 - RNA, 64 nt, hsa; identical to SEQ ID NO: 26087

SEQ ID NO: 699348 - RNA, 64 nt, hsa; identical to SEQ ID NO: 26088

SEQ ID NO: 699349 - RNA, 64 nt, hsa; identical to SEQ ID NO: 26089

SEQ ID NO: 699350 - RNA, 64 nt, hsa; identical to SEQ ID NO: 26090

SEQ ID NO: 699351 - RNA, 64 nt, hsa; identical to SEQ ID NO: 26091

SEQ ID NO: 699352 - RNA, 64 nt, hsa; identical to SEQ ID NO: 26092

SEQ ID NO: 699353 - RNA, 64 nt, hsa; identical to SEQ ID NO: 26093

SEQ ID NO: 699354 - RNA, 64 nt, hsa; identical to SEQ ID NO: 26094

SEQ ID NO: 699355 - RNA, 64 nt, hsa; identical to SEQ ID NO: 26095

SEQ ID NO: 699356 - RNA, 64 nt, hsa; identical to SEQ ID NO: 26096

SEQ ID NO: 699357 - RNA, 64 nt, hsa; identical to SEQ ID NO: 26097

SEQ ID NO: 699358 - RNA, 64 nt, hsa; identical to SEQ ID NO: 26098

SEQ ID NO: 699359 - RNA, 64 nt, hsa; identical to SEQ ID NO: 26099

SEQ ID NO: 699360 - RNA, 64 nt, hsa; identical to SEQ ID NO: 26100

SEQ ID NO: 699361 - RNA, 64 nt, hsa; identical to SEQ ID NO: 26101

SEQ ID NO: 699362 - RNA, 64 nt, hsa; identical to SEQ ID NO: 26102

SEQ ID NO: 699363 - RNA, 64 nt, hsa; identical to SEQ ID NO: 26103

SEQ ID NO: 699364 - RNA, 64 nt, hsa; identical to SEQ ID NO: 26104

SEQ ID NO: 699365 - RNA, 64 nt, hsa; identical to SEQ ID NO: 26105

SEQ ID NO: 699366 - RNA, 64 nt, hsa; identical to SEQ ID NO: 26106

SEQ ID NO: 699367 - RNA, 64 nt, hsa; identical to SEQ ID NO: 26107

SEQ ID NO: 699368 - RNA, 64 nt, hsa; identical to SEQ ID NO: 26108

SEQ ID NO: 699369 - RNA, 64 nt, hsa; identical to SEQ ID NO: 26109

SEQ ID NO: 699370 - RNA, 64 nt, hsa; identical to SEQ ID NO: 26110

SEQ ID NO: 699371 - RNA, 64 nt, hsa; identical to SEQ ID NO: 26111

SEQ ID NO: 699372 - RNA, 64 nt, hsa; identical to SEQ ID NO: 26112

SEQ ID NO: 699373 - RNA, 64 nt, hsa; identical to SEQ ID NO: 26113

SEQ ID NO: 699374 - RNA, 64 nt, hsa; identical to SEQ ID NO: 26114

SEQ ID NO: 699375 - RNA, 64 nt, hsa; identical to SEQ ID NO: 26115

SEQ ID NO: 699376 - RNA, 64 nt, hsa; identical to SEQ ID NO: 26116

SEQ ID NO: 699377 - RNA, 64 nt, hsa; identical to SEQ ID NO: 26117

SEQ ID NO: 699378 - RNA, 64 nt, hsa; identical to SEQ ID NO: 26118

SEQ ID NO: 699379 - RNA, 64 nt, hsa; identical to SEQ ID NO: 26119

SEQ ID NO: 699380 - RNA, 64 nt, hsa; identical to SEQ ID NO: 26120

SEQ ID NO: 699381 - RNA, 64 nt, hsa; identical to SEQ ID NO: 26121

SEQ ID NO: 699382 - RNA, 64 nt, hsa; identical to SEQ ID NO: 26122

SEQ ID NO: 699383 - RNA, 64 nt, hsa; identical to SEQ ID NO: 26123

SEQ ID NO: 699384 - RNA, 64 nt, hsa; identical to SEQ ID NO: 26124

SEQ ID NO: 699385 - RNA, 64 nt, hsa; identical to SEQ ID NO: 26125

SEQ ID NO: 699386 - RNA, 64 nt, hsa; identical to SEQ ID NO: 26126

SEQ ID NO: 699387 - RNA, 64 nt, hsa; identical to SEQ ID NO: 26127

SEQ ID NO: 699388 - RNA, 64 nt, hsa; identical to SEQ ID NO: 26128

SEQ ID NO: 699389 - RNA, 64 nt, hsa; identical to SEQ ID NO: 26129

SEQ ID NO: 699390 - RNA, 64 nt, hsa; identical to SEQ ID NO: 26130

SEQ ID NO: 699391 - RNA, 64 nt, hsa; identical to SEQ ID NO: 26131

SEQ ID NO: 699392 - RNA, 64 nt, hsa; identical to SEQ ID NO: 26132

SEQ ID NO: 699393 - RNA, 64 nt, hsa; identical to SEQ ID NO: 26133

SEQ ID NO: 699394 - RNA, 64 nt, hsa; identical to SEQ ID NO: 26134

SEQ ID NO: 699395 - RNA, 64 nt, hsa; identical to SEQ ID NO: 26135

SEQ ID NO: 699396 - RNA, 64 nt, hsa; identical to SEQ ID NO: 26136

SEQ ID NO: 699397 - RNA, 64 nt, hsa; identical to SEQ ID NO: 26137

SEQ ID NO: 699398 - RNA, 64 nt, hsa; identical to SEQ ID NO: 26138

SEQ ID NO: 699399 - RNA, 64 nt, hsa; identical to SEQ ID NO: 26139

SEQ ID NO: 699400 - RNA, 64 nt, hsa; identical to SEQ ID NO: 26140

SEQ ID NO: 699401 - RNA, 64 nt, hsa; identical to SEQ ID NO: 26141

SEQ ID NO: 699402 - RNA, 64 nt, hsa; identical to SEQ ID NO: 26142

SEQ ID NO: 699403 - RNA, 64 nt, hsa; identical to SEQ ID NO: 26143

SEQ ID NO: 699404 - RNA, 64 nt, hsa; identical to SEQ ID NO: 26144

SEQ ID NO: 699405 - RNA, 64 nt, hsa; identical to SEQ ID NO: 26145

SEQ ID NO: 699406 - RNA, 64 nt, hsa; identical to SEQ ID NO: 26146

SEQ ID NO: 699407 - RNA, 64 nt, hsa; identical to SEQ ID NO: 26147

SEQ ID NO: 699408 - RNA, 64 nt, hsa; identical to SEQ ID NO: 26148

SEQ ID NO: 699409 - RNA, 64 nt, hsa; identical to SEQ ID NO: 26149

SEQ ID NO: 699410 - RNA, 64 nt, hsa; identical to SEQ ID NO: 26150

SEQ ID NO: 699411 - RNA, 64 nt, hsa; identical to SEQ ID NO: 26151

SEQ ID NO: 699412 - RNA, 64 nt, hsa; identical to SEQ ID NO: 26152

SEQ ID NO: 699413 - RNA, 64 nt, hsa; identical to SEQ ID NO: 26153

SEQ ID NO: 699414 - RNA, 64 nt, hsa; identical to SEQ ID NO: 26154

SEQ ID NO: 699415 - RNA, 64 nt, hsa; identical to SEQ ID NO: 26155

SEQ ID NO: 699416 - RNA, 64 nt, hsa; identical to SEQ ID NO: 26156

SEQ ID NO: 699417 - RNA, 64 nt, hsa; identical to SEQ ID NO: 26157

SEQ ID NO: 699418 - RNA, 64 nt, hsa; identical to SEQ ID NO: 26158

SEQ ID NO: 699419 - RNA, 64 nt, hsa; identical to SEQ ID NO: 26159

SEQ ID NO: 699420 - RNA, 64 nt, hsa; identical to SEQ ID NO: 26160

SEQ ID NO: 699421 - RNA, 64 nt, hsa; identical to SEQ ID NO: 26161

SEQ ID NO: 699422 - RNA, 64 nt, hsa; identical to SEQ ID NO: 26162

SEQ ID NO: 699423 - RNA, 64 nt, hsa; identical to SEQ ID NO: 26163

SEQ ID NO: 699424 - RNA, 64 nt, hsa; identical to SEQ ID NO: 26164

SEQ ID NO: 699425 - RNA, 64 nt, hsa; identical to SEQ ID NO: 26165

SEQ ID NO: 699426 - RNA, 64 nt, hsa; identical to SEQ ID NO: 26166

SEQ ID NO: 699427 - RNA, 64 nt, hsa; identical to SEQ ID NO: 26167

SEQ ID NO: 699428 - RNA, 64 nt, hsa; identical to SEQ ID NO: 26168

SEQ ID NO: 699429 - RNA, 64 nt, hsa; identical to SEQ ID NO: 26169

SEQ ID NO: 699430 - RNA, 64 nt, hsa; identical to SEQ ID NO: 26170

SEQ ID NO: 699431 - RNA, 64 nt, hsa; identical to SEQ ID NO: 26171

SEQ ID NO: 699432 - RNA, 64 nt, hsa; identical to SEQ ID NO: 26172

SEQ ID NO: 699433 - RNA, 64 nt, hsa; identical to SEQ ID NO: 26173

SEQ ID NO: 699434 - RNA, 64 nt, hsa; identical to SEQ ID NO: 26174

SEQ ID NO: 699435 - RNA, 64 nt, hsa; identical to SEQ ID NO: 26175

SEQ ID NO: 699436 - RNA, 64 nt, hsa; identical to SEQ ID NO: 26176

SEQ ID NO: 699437 - RNA, 64 nt, hsa; identical to SEQ ID NO: 26177

SEQ ID NO: 699438 - RNA, 64 nt, hsa; identical to SEQ ID NO: 26178

SEQ ID NO: 699439 - RNA, 64 nt, hsa; identical to SEQ ID NO: 26179

SEQ ID NO: 699440 - RNA, 64 nt, hsa; identical to SEQ ID NO: 26180

SEQ ID NO: 699441 - RNA, 64 nt, hsa; identical to SEQ ID NO: 26181

SEQ ID NO: 699442 - RNA, 64 nt, hsa; identical to SEQ ID NO: 26182

SEQ ID NO: 699443 - RNA, 64 nt, hsa; identical to SEQ ID NO: 26183

SEQ ID NO: 699444 - RNA, 64 nt, hsa; identical to SEQ ID NO: 26184

SEQ ID NO: 699445 - RNA, 64 nt, hsa; identical to SEQ ID NO: 26185

SEQ ID NO: 699446 - RNA, 64 nt, hsa; identical to SEQ ID NO: 26186

SEQ ID NO: 699447 - RNA, 64 nt, hsa; identical to SEQ ID NO: 26187

SEQ ID NO: 699448 - RNA, 64 nt, hsa; identical to SEQ ID NO: 26188

SEQ ID NO: 699449 - RNA, 64 nt, hsa; identical to SEQ ID NO: 26189

SEQ ID NO: 699450 - RNA, 64 nt, hsa; identical to SEQ ID NO: 26190

SEQ ID NO: 699451 - RNA, 64 nt, hsa; identical to SEQ ID NO: 26191

SEQ ID NO: 699452 - RNA, 62 nt, hsa; identical to SEQ ID NO: 26192

SEQ ID NO: 699453 - RNA, 61 nt, hsa; identical to SEQ ID NO: 26193

SEQ ID NO: 699454 - RNA, 64 nt, hsa; identical to SEQ ID NO: 26194

SEQ ID NO: 699455 - RNA, 64 nt, hsa; identical to SEQ ID NO: 26195

SEQ ID NO: 699456 - RNA, 64 nt, hsa; identical to SEQ ID NO: 26196

SEQ ID NO: 699457 - RNA, 64 nt, hsa; identical to SEQ ID NO: 26197

SEQ ID NO: 699458 - RNA, 64 nt, hsa; identical to SEQ ID NO: 26198

SEQ ID NO: 699459 - RNA, 64 nt, hsa; identical to SEQ ID NO: 26199

SEQ ID NO: 699460 - RNA, 64 nt, hsa; identical to SEQ ID NO: 26200

SEQ ID NO: 699461 - RNA, 64 nt, hsa; identical to SEQ ID NO: 26201

SEQ ID NO: 699462 - RNA, 64 nt, hsa; identical to SEQ ID NO: 26202

SEQ ID NO: 699463 - RNA, 64 nt, hsa; identical to SEQ ID NO: 26203

SEQ ID NO: 699464 - RNA, 64 nt, hsa; identical to SEQ ID NO: 26204

SEQ ID NO: 699465 - RNA, 64 nt, hsa; identical to SEQ ID NO: 26205

SEQ ID NO: 699466 - RNA, 64 nt, hsa; identical to SEQ ID NO: 26206

SEQ ID NO: 699467 - RNA, 64 nt, hsa; identical to SEQ ID NO: 26207

SEQ ID NO: 699468 - RNA, 64 nt, hsa; identical to SEQ ID NO: 26208

SEQ ID NO: 699469 - RNA, 64 nt, hsa; identical to SEQ ID NO: 26209

SEQ ID NO: 699470 - RNA, 64 nt, hsa; identical to SEQ ID NO: 26210

SEQ ID NO: 699471 - RNA, 64 nt, hsa; identical to SEQ ID NO: 26211

SEQ ID NO: 699472 - RNA, 64 nt, hsa; identical to SEQ ID NO: 26212

SEQ ID NO: 699473 - RNA, 64 nt, hsa; identical to SEQ ID NO: 26213

SEQ ID NO: 699474 - RNA, 64 nt, hsa; identical to SEQ ID NO: 26214

SEQ ID NO: 699475 - RNA, 64 nt, hsa; identical to SEQ ID NO: 26215

SEQ ID NO: 699476 - RNA, 64 nt, hsa; identical to SEQ ID NO: 26216

SEQ ID NO: 699477 - RNA, 64 nt, hsa; identical to SEQ ID NO: 26217

SEQ ID NO: 699478 - RNA, 64 nt, hsa; identical to SEQ ID NO: 26218

SEQ ID NO: 699479 - RNA, 64 nt, hsa; identical to SEQ ID NO: 26219

SEQ ID NO: 699480 - RNA, 64 nt, hsa; identical to SEQ ID NO: 26220

SEQ ID NO: 699481 - RNA, 64 nt, hsa; identical to SEQ ID NO: 26221

SEQ ID NO: 699482 - RNA, 64 nt, hsa; identical to SEQ ID NO: 26222

SEQ ID NO: 699483 - RNA, 64 nt, hsa; identical to SEQ ID NO: 26223

SEQ ID NO: 699484 - RNA, 64 nt, hsa; identical to SEQ ID NO: 26224

SEQ ID NO: 699485 - RNA, 64 nt, hsa; identical to SEQ ID NO: 26225

SEQ ID NO: 699486 - RNA, 64 nt, hsa; identical to SEQ ID NO: 26226

SEQ ID NO: 699487 - RNA, 64 nt, hsa; identical to SEQ ID NO: 26227

SEQ ID NO: 699488 - RNA, 64 nt, hsa; identical to SEQ ID NO: 26228

SEQ ID NO: 699489 - RNA, 64 nt, hsa; identical to SEQ ID NO: 26229

SEQ ID NO: 699490 - RNA, 64 nt, hsa; identical to SEQ ID NO: 26230

SEQ ID NO: 699491 - RNA, 64 nt, hsa; identical to SEQ ID NO: 26231

SEQ ID NO: 699492 - RNA, 64 nt, hsa; identical to SEQ ID NO: 26232

SEQ ID NO: 699493 - RNA, 64 nt, hsa; identical to SEQ ID NO: 26233

SEQ ID NO: 699494 - RNA, 64 nt, hsa; identical to SEQ ID NO: 26234

SEQ ID NO: 699495 - RNA, 64 nt, hsa; identical to SEQ ID NO: 26235

SEQ ID NO: 699496 - RNA, 64 nt, hsa; identical to SEQ ID NO: 26236

SEQ ID NO: 699497 - RNA, 64 nt, hsa; identical to SEQ ID NO: 26237

SEQ ID NO: 699498 - RNA, 64 nt, hsa; identical to SEQ ID NO: 26238

SEQ ID NO: 699499 - RNA, 64 nt, hsa; identical to SEQ ID NO: 26239

SEQ ID NO: 699500 - RNA, 64 nt, hsa; identical to SEQ ID NO: 26240

SEQ ID NO: 699501 - RNA, 64 nt, hsa; identical to SEQ ID NO: 26241

SEQ ID NO: 699502 - RNA, 64 nt, hsa; identical to SEQ ID NO: 26242

SEQ ID NO: 699503 - RNA, 64 nt, hsa; identical to SEQ ID NO: 26243

SEQ ID NO: 699504 - RNA, 64 nt, hsa; identical to SEQ ID NO: 26244

SEQ ID NO: 699505 - RNA, 64 nt, hsa; identical to SEQ ID NO: 26245

SEQ ID NO: 699506 - RNA, 64 nt, hsa; identical to SEQ ID NO: 26246

SEQ ID NO: 699507 - RNA, 64 nt, hsa; identical to SEQ ID NO: 26247

SEQ ID NO: 699508 - RNA, 64 nt, hsa; identical to SEQ ID NO: 26248

SEQ ID NO: 699509 - RNA, 64 nt, hsa; identical to SEQ ID NO: 26249

SEQ ID NO: 699510 - RNA, 64 nt, hsa; identical to SEQ ID NO: 26250

SEQ ID NO: 699511 - RNA, 64 nt, hsa; identical to SEQ ID NO: 26251

SEQ ID NO: 699512 - RNA, 64 nt, hsa; identical to SEQ ID NO: 26252

SEQ ID NO: 699513 - RNA, 64 nt, hsa; identical to SEQ ID NO: 26253

SEQ ID NO: 699514 - RNA, 64 nt, hsa; identical to SEQ ID NO: 26254

SEQ ID NO: 699515 - RNA, 64 nt, hsa; identical to SEQ ID NO: 26255

SEQ ID NO: 699516 - RNA, 64 nt, hsa; identical to SEQ ID NO: 26256

SEQ ID NO: 699517 - RNA, 64 nt, hsa; identical to SEQ ID NO: 26257

SEQ ID NO: 699518 - RNA, 64 nt, hsa; identical to SEQ ID NO: 26258

SEQ ID NO: 699519 - RNA, 64 nt, hsa; identical to SEQ ID NO: 26259

SEQ ID NO: 699520 - RNA, 64 nt, hsa; identical to SEQ ID NO: 26260

SEQ ID NO: 699521 - RNA, 64 nt, hsa; identical to SEQ ID NO: 26261

SEQ ID NO: 699522 - RNA, 64 nt, hsa; identical to SEQ ID NO: 26262

SEQ ID NO: 699523 - RNA, 64 nt, hsa; identical to SEQ ID NO: 26263

SEQ ID NO: 699524 - RNA, 64 nt, hsa; identical to SEQ ID NO: 26264

SEQ ID NO: 699525 - RNA, 64 nt, hsa; identical to SEQ ID NO: 26265

SEQ ID NO: 699526 - RNA, 64 nt, hsa; identical to SEQ ID NO: 26266

SEQ ID NO: 699527 - RNA, 64 nt, hsa; identical to SEQ ID NO: 26267

SEQ ID NO: 699528 - RNA, 64 nt, hsa; identical to SEQ ID NO: 26268

SEQ ID NO: 699529 - RNA, 64 nt, hsa; identical to SEQ ID NO: 26269

SEQ ID NO: 699530 - RNA, 64 nt, hsa; identical to SEQ ID NO: 26270

SEQ ID NO: 699531 - RNA, 64 nt, hsa; identical to SEQ ID NO: 26271

SEQ ID NO: 699532 - RNA, 64 nt, hsa; identical to SEQ ID NO: 26272

SEQ ID NO: 699533 - RNA, 64 nt, hsa; identical to SEQ ID NO: 26273

SEQ ID NO: 699534 - RNA, 64 nt, hsa; identical to SEQ ID NO: 26274

SEQ ID NO: 699535 - RNA, 64 nt, hsa; identical to SEQ ID NO: 26275

SEQ ID NO: 699536 - RNA, 64 nt, hsa; identical to SEQ ID NO: 26276

SEQ ID NO: 699537 - RNA, 64 nt, hsa; identical to SEQ ID NO: 26277

SEQ ID NO: 699538 - RNA, 64 nt, hsa; identical to SEQ ID NO: 26278

SEQ ID NO: 699539 - RNA, 64 nt, hsa; identical to SEQ ID NO: 26279

SEQ ID NO: 699540 - RNA, 64 nt, hsa; identical to SEQ ID NO: 26280

SEQ ID NO: 699541 - RNA, 64 nt, hsa; identical to SEQ ID NO: 26281

SEQ ID NO: 699542 - RNA, 64 nt, hsa; identical to SEQ ID NO: 26282

SEQ ID NO: 699543 - RNA, 64 nt, hsa; identical to SEQ ID NO: 26283

SEQ ID NO: 699544 - RNA, 64 nt, hsa; identical to SEQ ID NO: 26284

SEQ ID NO: 699545 - RNA, 64 nt, hsa; identical to SEQ ID NO: 26285

SEQ ID NO: 699546 - RNA, 64 nt, hsa; identical to SEQ ID NO: 26286

SEQ ID NO: 699547 - RNA, 64 nt, hsa; identical to SEQ ID NO: 26287

SEQ ID NO: 699548 - RNA, 64 nt, hsa; identical to SEQ ID NO: 26288

SEQ ID NO: 699549 - RNA, 64 nt, hsa; identical to SEQ ID NO: 26289

SEQ ID NO: 699550 - RNA, 64 nt, hsa; identical to SEQ ID NO: 26290

SEQ ID NO: 699551 - RNA, 64 nt, hsa; identical to SEQ ID NO: 26291

SEQ ID NO: 699552 - RNA, 64 nt, hsa; identical to SEQ ID NO: 26292

SEQ ID NO: 699553 - RNA, 64 nt, hsa; identical to SEQ ID NO: 26293

SEQ ID NO: 699554 - RNA, 64 nt, hsa; identical to SEQ ID NO: 26294

SEQ ID NO: 699555 - RNA, 64 nt, hsa; identical to SEQ ID NO: 26295

SEQ ID NO: 699556 - RNA, 64 nt, hsa; identical to SEQ ID NO: 26296

SEQ ID NO: 699557 - RNA, 64 nt, hsa; identical to SEQ ID NO: 26297

SEQ ID NO: 699558 - RNA, 64 nt, hsa; identical to SEQ ID NO: 26298

SEQ ID NO: 699559 - RNA, 64 nt, hsa; identical to SEQ ID NO: 26299

SEQ ID NO: 699560 - RNA, 64 nt, hsa; identical to SEQ ID NO: 26300

SEQ ID NO: 699561 - RNA, 64 nt, hsa; identical to SEQ ID NO: 26301

SEQ ID NO: 699562 - RNA, 64 nt, hsa; identical to SEQ ID NO: 26302

SEQ ID NO: 699563 - RNA, 64 nt, hsa; identical to SEQ ID NO: 26303

SEQ ID NO: 699564 - RNA, 64 nt, hsa; identical to SEQ ID NO: 26304

SEQ ID NO: 699565 - RNA, 64 nt, hsa; identical to SEQ ID NO: 26305

SEQ ID NO: 699566 - RNA, 64 nt, hsa; identical to SEQ ID NO: 26306

SEQ ID NO: 699567 - RNA, 64 nt, hsa; identical to SEQ ID NO: 26307

SEQ ID NO: 699568 - RNA, 64 nt, hsa; identical to SEQ ID NO: 26308

SEQ ID NO: 699569 - RNA, 64 nt, hsa; identical to SEQ ID NO: 26309

SEQ ID NO: 699570 - RNA, 64 nt, hsa; identical to SEQ ID NO: 26310

SEQ ID NO: 699571 - RNA, 64 nt, hsa; identical to SEQ ID NO: 26311

SEQ ID NO: 699572 - RNA, 64 nt, hsa; identical to SEQ ID NO: 26312

SEQ ID NO: 699573 - RNA, 64 nt, hsa; identical to SEQ ID NO: 26313

SEQ ID NO: 699574 - RNA, 64 nt, hsa; identical to SEQ ID NO: 26314

SEQ ID NO: 699575 - RNA, 64 nt, hsa; identical to SEQ ID NO: 26315

SEQ ID NO: 699576 - RNA, 64 nt, hsa; identical to SEQ ID NO: 26316

SEQ ID NO: 699577 - RNA, 64 nt, hsa; identical to SEQ ID NO: 26317

SEQ ID NO: 699578 - RNA, 64 nt, hsa; identical to SEQ ID NO: 26318

SEQ ID NO: 699579 - RNA, 64 nt, hsa; identical to SEQ ID NO: 26319

SEQ ID NO: 699580 - RNA, 64 nt, hsa; identical to SEQ ID NO: 26320

SEQ ID NO: 699581 - RNA, 64 nt, hsa; identical to SEQ ID NO: 26321

SEQ ID NO: 699582 - RNA, 64 nt, hsa; identical to SEQ ID NO: 26322

SEQ ID NO: 699583 - RNA, 64 nt, hsa; identical to SEQ ID NO: 26323

SEQ ID NO: 699584 - RNA, 64 nt, hsa; identical to SEQ ID NO: 26324

SEQ ID NO: 699585 - RNA, 64 nt, hsa; identical to SEQ ID NO: 26325

SEQ ID NO: 699586 - RNA, 64 nt, hsa; identical to SEQ ID NO: 26326

SEQ ID NO: 699587 - RNA, 64 nt, hsa; identical to SEQ ID NO: 26327

SEQ ID NO: 699588 - RNA, 64 nt, hsa; identical to SEQ ID NO: 26328

SEQ ID NO: 699589 - RNA, 64 nt, hsa; identical to SEQ ID NO: 26329

SEQ ID NO: 699590 - RNA, 64 nt, hsa; identical to SEQ ID NO: 26330

SEQ ID NO: 699591 - RNA, 64 nt, hsa; identical to SEQ ID NO: 26331

SEQ ID NO: 699592 - RNA, 64 nt, hsa; identical to SEQ ID NO: 26332

SEQ ID NO: 699593 - RNA, 64 nt, hsa; identical to SEQ ID NO: 26333

SEQ ID NO: 699594 - RNA, 64 nt, hsa; identical to SEQ ID NO: 26334

SEQ ID NO: 699595 - RNA, 64 nt, hsa; identical to SEQ ID NO: 26335

SEQ ID NO: 699596 - RNA, 64 nt, hsa; identical to SEQ ID NO: 26336

SEQ ID NO: 699597 - RNA, 64 nt, hsa; identical to SEQ ID NO: 26337

SEQ ID NO: 699598 - RNA, 64 nt, hsa; identical to SEQ ID NO: 26338

SEQ ID NO: 699599 - RNA, 64 nt, hsa; identical to SEQ ID NO: 26339

SEQ ID NO: 699600 - RNA, 64 nt, hsa; identical to SEQ ID NO: 26340

SEQ ID NO: 699601 - RNA, 64 nt, hsa; identical to SEQ ID NO: 26341

SEQ ID NO: 699602 - RNA, 64 nt, hsa; identical to SEQ ID NO: 26342

SEQ ID NO: 699603 - RNA, 64 nt, hsa; identical to SEQ ID NO: 26343

SEQ ID NO: 699604 - RNA, 64 nt, hsa; identical to SEQ ID NO: 26344

SEQ ID NO: 699605 - RNA, 64 nt, hsa; identical to SEQ ID NO: 26345

SEQ ID NO: 699606 - RNA, 64 nt, hsa; identical to SEQ ID NO: 26346

SEQ ID NO: 699607 - RNA, 64 nt, hsa; identical to SEQ ID NO: 26347

SEQ ID NO: 699608 - RNA, 64 nt, hsa; identical to SEQ ID NO: 26348

SEQ ID NO: 699609 - RNA, 64 nt, hsa; identical to SEQ ID NO: 26349

SEQ ID NO: 699610 - RNA, 64 nt, hsa; identical to SEQ ID NO: 26350

SEQ ID NO: 699611 - RNA, 64 nt, hsa; identical to SEQ ID NO: 26351

SEQ ID NO: 699612 - RNA, 64 nt, hsa; identical to SEQ ID NO: 26352

SEQ ID NO: 699613 - RNA, 64 nt, hsa; identical to SEQ ID NO: 26353

SEQ ID NO: 699614 - RNA, 64 nt, hsa; identical to SEQ ID NO: 26354

SEQ ID NO: 699615 - RNA, 64 nt, hsa; identical to SEQ ID NO: 26355

SEQ ID NO: 699616 - RNA, 64 nt, hsa; identical to SEQ ID NO: 26356

SEQ ID NO: 699617 - RNA, 64 nt, hsa; identical to SEQ ID NO: 26357

SEQ ID NO: 699618 - RNA, 64 nt, hsa; identical to SEQ ID NO: 26358

SEQ ID NO: 699619 - RNA, 64 nt, hsa; identical to SEQ ID NO: 26359

SEQ ID NO: 699620 - RNA, 64 nt, hsa; identical to SEQ ID NO: 26360

SEQ ID NO: 699621 - RNA, 64 nt, hsa; identical to SEQ ID NO: 26361

SEQ ID NO: 699622 - RNA, 64 nt, hsa; identical to SEQ ID NO: 26362

SEQ ID NO: 699623 - RNA, 64 nt, hsa; identical to SEQ ID NO: 26363

SEQ ID NO: 699624 - RNA, 64 nt, hsa; identical to SEQ ID NO: 26364

SEQ ID NO: 699625 - RNA, 64 nt, hsa; identical to SEQ ID NO: 26365

SEQ ID NO: 699626 - RNA, 64 nt, hsa; identical to SEQ ID NO: 26366

SEQ ID NO: 699627 - RNA, 64 nt, hsa; identical to SEQ ID NO: 26367

SEQ ID NO: 699628 - RNA, 64 nt, hsa; identical to SEQ ID NO: 26368

SEQ ID NO: 699629 - RNA, 64 nt, hsa; identical to SEQ ID NO: 26369

SEQ ID NO: 699630 - RNA, 64 nt, hsa; identical to SEQ ID NO: 26370

SEQ ID NO: 699631 - RNA, 64 nt, hsa; identical to SEQ ID NO: 26371

SEQ ID NO: 699632 - RNA, 64 nt, hsa; identical to SEQ ID NO: 26372

SEQ ID NO: 699633 - RNA, 64 nt, hsa; identical to SEQ ID NO: 26373

SEQ ID NO: 699634 - RNA, 64 nt, hsa; identical to SEQ ID NO: 26374

SEQ ID NO: 699635 - RNA, 64 nt, hsa; identical to SEQ ID NO: 26375

SEQ ID NO: 699636 - RNA, 64 nt, hsa; identical to SEQ ID NO: 26376

SEQ ID NO: 699637 - RNA, 64 nt, hsa; identical to SEQ ID NO: 26377

SEQ ID NO: 699638 - RNA, 64 nt, hsa; identical to SEQ ID NO: 26378

SEQ ID NO: 699639 - RNA, 64 nt, hsa; identical to SEQ ID NO: 26379

SEQ ID NO: 699640 - RNA, 64 nt, hsa; identical to SEQ ID NO: 26380

SEQ ID NO: 699641 - RNA, 64 nt, hsa; identical to SEQ ID NO: 26381

SEQ ID NO: 699642 - RNA, 64 nt, hsa; identical to SEQ ID NO: 26382

SEQ ID NO: 699643 - RNA, 64 nt, hsa; identical to SEQ ID NO: 26383

SEQ ID NO: 699644 - RNA, 64 nt, hsa; identical to SEQ ID NO: 26384

SEQ ID NO: 699645 - RNA, 64 nt, hsa; identical to SEQ ID NO: 26385

SEQ ID NO: 699646 - RNA, 64 nt, hsa; identical to SEQ ID NO: 26386

SEQ ID NO: 699647 - RNA, 64 nt, hsa; identical to SEQ ID NO: 26387

SEQ ID NO: 699648 - RNA, 64 nt, hsa; identical to SEQ ID NO: 26388

SEQ ID NO: 699649 - RNA, 64 nt, hsa; identical to SEQ ID NO: 26389

SEQ ID NO: 699650 - RNA, 64 nt, hsa; identical to SEQ ID NO: 26390

SEQ ID NO: 699651 - RNA, 64 nt, hsa; identical to SEQ ID NO: 26391

SEQ ID NO: 699652 - RNA, 64 nt, hsa; identical to SEQ ID NO: 26392

SEQ ID NO: 699653 - RNA, 64 nt, hsa; identical to SEQ ID NO: 26393

SEQ ID NO: 699654 - RNA, 64 nt, hsa; identical to SEQ ID NO: 26394

SEQ ID NO: 699655 - RNA, 64 nt, hsa; identical to SEQ ID NO: 26395

SEQ ID NO: 699656 - RNA, 64 nt, hsa; identical to SEQ ID NO: 26396

SEQ ID NO: 699657 - RNA, 64 nt, hsa; identical to SEQ ID NO: 26397

SEQ ID NO: 699658 - RNA, 64 nt, hsa; identical to SEQ ID NO: 26398

SEQ ID NO: 699659 - RNA, 64 nt, hsa; identical to SEQ ID NO: 26399

SEQ ID NO: 699660 - RNA, 64 nt, hsa; identical to SEQ ID NO: 26400

SEQ ID NO: 699661 - RNA, 64 nt, hsa; identical to SEQ ID NO: 26401

SEQ ID NO: 699662 - RNA, 64 nt, hsa; identical to SEQ ID NO: 26402

SEQ ID NO: 699663 - RNA, 64 nt, hsa; identical to SEQ ID NO: 26403

SEQ ID NO: 699664 - RNA, 64 nt, hsa; identical to SEQ ID NO: 26404

SEQ ID NO: 699665 - RNA, 64 nt, hsa; identical to SEQ ID NO: 26405

SEQ ID NO: 699666 - RNA, 64 nt, hsa; identical to SEQ ID NO: 26406

SEQ ID NO: 699667 - RNA, 64 nt, hsa; identical to SEQ ID NO: 26407

SEQ ID NO: 699668 - RNA, 64 nt, hsa; identical to SEQ ID NO: 26408

SEQ ID NO: 699669 - RNA, 64 nt, hsa; identical to SEQ ID NO: 26409

SEQ ID NO: 699670 - RNA, 64 nt, hsa; identical to SEQ ID NO: 26410

SEQ ID NO: 699671 - RNA, 64 nt, hsa; identical to SEQ ID NO: 26411

SEQ ID NO: 699672 - RNA, 64 nt, hsa; identical to SEQ ID NO: 26412

SEQ ID NO: 699673 - RNA, 64 nt, hsa; identical to SEQ ID NO: 26413

SEQ ID NO: 699674 - RNA, 64 nt, hsa; identical to SEQ ID NO: 26414

SEQ ID NO: 699675 - RNA, 64 nt, hsa; identical to SEQ ID NO: 26415

SEQ ID NO: 699676 - RNA, 64 nt, hsa; identical to SEQ ID NO: 26416

SEQ ID NO: 699677 - RNA, 64 nt, hsa; identical to SEQ ID NO: 26417

SEQ ID NO: 699678 - RNA, 64 nt, hsa; identical to SEQ ID NO: 26418

SEQ ID NO: 699679 - RNA, 64 nt, hsa; identical to SEQ ID NO: 26419

SEQ ID NO: 699680 - RNA, 64 nt, hsa; identical to SEQ ID NO: 26420

SEQ ID NO: 699681 - RNA, 64 nt, hsa; identical to SEQ ID NO: 26421

SEQ ID NO: 699682 - RNA, 64 nt, hsa; identical to SEQ ID NO: 26422

SEQ ID NO: 699683 - RNA, 64 nt, hsa; identical to SEQ ID NO: 26423

SEQ ID NO: 699684 - RNA, 64 nt, hsa; identical to SEQ ID NO: 26424

SEQ ID NO: 699685 - RNA, 64 nt, hsa; identical to SEQ ID NO: 26425

SEQ ID NO: 699686 - RNA, 64 nt, hsa; identical to SEQ ID NO: 26426

SEQ ID NO: 699687 - RNA, 64 nt, hsa; identical to SEQ ID NO: 26427

SEQ ID NO: 699688 - RNA, 64 nt, hsa; identical to SEQ ID NO: 26428

SEQ ID NO: 699689 - RNA, 64 nt, hsa; identical to SEQ ID NO: 26429

SEQ ID NO: 699690 - RNA, 64 nt, hsa; identical to SEQ ID NO: 26430

SEQ ID NO: 699691 - RNA, 64 nt, hsa; identical to SEQ ID NO: 26431

SEQ ID NO: 699692 - RNA, 64 nt, hsa; identical to SEQ ID NO: 26432

SEQ ID NO: 699693 - RNA, 64 nt, hsa; identical to SEQ ID NO: 26433

SEQ ID NO: 699694 - RNA, 64 nt, hsa; identical to SEQ ID NO: 26434

SEQ ID NO: 699695 - RNA, 64 nt, hsa; identical to SEQ ID NO: 26435

SEQ ID NO: 699696 - RNA, 64 nt, hsa; identical to SEQ ID NO: 26436

SEQ ID NO: 699697 - RNA, 64 nt, hsa; identical to SEQ ID NO: 26437

SEQ ID NO: 699698 - RNA, 64 nt, hsa; identical to SEQ ID NO: 26438

SEQ ID NO: 699699 - RNA, 64 nt, hsa; identical to SEQ ID NO: 26439

SEQ ID NO: 699700 - RNA, 64 nt, hsa; identical to SEQ ID NO: 26440

SEQ ID NO: 699701 - RNA, 64 nt, hsa; identical to SEQ ID NO: 26441

SEQ ID NO: 699702 - RNA, 64 nt, hsa; identical to SEQ ID NO: 26442

SEQ ID NO: 699703 - RNA, 64 nt, hsa; identical to SEQ ID NO: 26443

SEQ ID NO: 699704 - RNA, 64 nt, hsa; identical to SEQ ID NO: 26444

SEQ ID NO: 699705 - RNA, 64 nt, hsa; identical to SEQ ID NO: 26445

SEQ ID NO: 699706 - RNA, 64 nt, hsa; identical to SEQ ID NO: 26446

SEQ ID NO: 699707 - RNA, 64 nt, hsa; identical to SEQ ID NO: 26447

SEQ ID NO: 699708 - RNA, 64 nt, hsa; identical to SEQ ID NO: 26448

SEQ ID NO: 699709 - RNA, 64 nt, hsa; identical to SEQ ID NO: 26449

SEQ ID NO: 699710 - RNA, 64 nt, hsa; identical to SEQ ID NO: 26450

SEQ ID NO: 699711 - RNA, 64 nt, hsa; identical to SEQ ID NO: 26451

SEQ ID NO: 699712 - RNA, 64 nt, hsa; identical to SEQ ID NO: 26452

SEQ ID NO: 699713 - RNA, 64 nt, hsa; identical to SEQ ID NO: 26453

SEQ ID NO: 699714 - RNA, 64 nt, hsa; identical to SEQ ID NO: 26454

SEQ ID NO: 699715 - RNA, 64 nt, hsa; identical to SEQ ID NO: 26455

SEQ ID NO: 699716 - RNA, 64 nt, hsa; identical to SEQ ID NO: 26456

SEQ ID NO: 699717 - RNA, 64 nt, hsa; identical to SEQ ID NO: 26457

SEQ ID NO: 699718 - RNA, 64 nt, hsa; identical to SEQ ID NO: 26458

SEQ ID NO: 699719 - RNA, 64 nt, hsa; identical to SEQ ID NO: 26459

SEQ ID NO: 699720 - RNA, 64 nt, hsa; identical to SEQ ID NO: 26460

SEQ ID NO: 699721 - RNA, 64 nt, hsa; identical to SEQ ID NO: 26461

SEQ ID NO: 699722 - RNA, 64 nt, hsa; identical to SEQ ID NO: 26462

SEQ ID NO: 699723 - RNA, 64 nt, hsa; identical to SEQ ID NO: 26463

SEQ ID NO: 699724 - RNA, 64 nt, hsa; identical to SEQ ID NO: 26464

SEQ ID NO: 699725 - RNA, 64 nt, hsa; identical to SEQ ID NO: 26465

SEQ ID NO: 699726 - RNA, 64 nt, hsa; identical to SEQ ID NO: 26466

SEQ ID NO: 699727 - RNA, 64 nt, hsa; identical to SEQ ID NO: 26467

SEQ ID NO: 699728 - RNA, 64 nt, hsa; identical to SEQ ID NO: 26468

SEQ ID NO: 699729 - RNA, 64 nt, hsa; identical to SEQ ID NO: 26469

SEQ ID NO: 699730 - RNA, 64 nt, hsa; identical to SEQ ID NO: 26470

SEQ ID NO: 699731 - RNA, 64 nt, hsa; identical to SEQ ID NO: 26471

SEQ ID NO: 699732 - RNA, 64 nt, hsa; identical to SEQ ID NO: 26472

SEQ ID NO: 699733 - RNA, 64 nt, hsa; identical to SEQ ID NO: 26473

SEQ ID NO: 699734 - RNA, 64 nt, hsa; identical to SEQ ID NO: 26474

SEQ ID NO: 699735 - RNA, 64 nt, hsa; identical to SEQ ID NO: 26475

SEQ ID NO: 699736 - RNA, 64 nt, hsa; identical to SEQ ID NO: 26476

SEQ ID NO: 699737 - RNA, 64 nt, hsa; identical to SEQ ID NO: 26477

SEQ ID NO: 699738 - RNA, 64 nt, hsa; identical to SEQ ID NO: 26478

SEQ ID NO: 699739 - RNA, 64 nt, hsa; identical to SEQ ID NO: 26479

SEQ ID NO: 699740 - RNA, 64 nt, hsa; identical to SEQ ID NO: 26480

SEQ ID NO: 699741 - RNA, 64 nt, hsa; identical to SEQ ID NO: 26481

SEQ ID NO: 699742 - RNA, 63 nt, hsa; identical to SEQ ID NO: 26482

SEQ ID NO: 699743 - RNA, 63 nt, hsa; identical to SEQ ID NO: 26483

SEQ ID NO: 699744 - RNA, 64 nt, hsa; identical to SEQ ID NO: 26484

SEQ ID NO: 699745 - RNA, 64 nt, hsa; identical to SEQ ID NO: 26485

SEQ ID NO: 699746 - RNA, 64 nt, hsa; identical to SEQ ID NO: 26486

SEQ ID NO: 699747 - RNA, 64 nt, hsa; identical to SEQ ID NO: 26487

SEQ ID NO: 699748 - RNA, 64 nt, hsa; identical to SEQ ID NO: 26488

SEQ ID NO: 699749 - RNA, 64 nt, hsa; identical to SEQ ID NO: 26489

SEQ ID NO: 699750 - RNA, 64 nt, hsa; identical to SEQ ID NO: 26490

SEQ ID NO: 699751 - RNA, 64 nt, hsa; identical to SEQ ID NO: 26491

SEQ ID NO: 699752 - RNA, 64 nt, hsa; identical to SEQ ID NO: 26492

SEQ ID NO: 699753 - RNA, 64 nt, hsa; identical to SEQ ID NO: 26493

SEQ ID NO: 699754 - RNA, 64 nt, hsa; identical to SEQ ID NO: 26494

SEQ ID NO: 699755 - RNA, 64 nt, hsa; identical to SEQ ID NO: 26495

SEQ ID NO: 699756 - RNA, 64 nt, hsa; identical to SEQ ID NO: 26496

SEQ ID NO: 699757 - RNA, 64 nt, hsa; identical to SEQ ID NO: 26497

SEQ ID NO: 699758 - RNA, 64 nt, hsa; identical to SEQ ID NO: 26498

SEQ ID NO: 699759 - RNA, 64 nt, hsa; identical to SEQ ID NO: 26499

SEQ ID NO: 699760 - RNA, 64 nt, hsa; identical to SEQ ID NO: 26500

SEQ ID NO: 699761 - RNA, 64 nt, hsa; identical to SEQ ID NO: 26501

SEQ ID NO: 699762 - RNA, 64 nt, hsa; identical to SEQ ID NO: 26502

SEQ ID NO: 699763 - RNA, 64 nt, hsa; identical to SEQ ID NO: 26503

SEQ ID NO: 699764 - RNA, 64 nt, hsa; identical to SEQ ID NO: 26504

SEQ ID NO: 699765 - RNA, 64 nt, hsa; identical to SEQ ID NO: 26505

SEQ ID NO: 699766 - RNA, 64 nt, hsa; identical to SEQ ID NO: 26506

SEQ ID NO: 699767 - RNA, 64 nt, hsa; identical to SEQ ID NO: 26507

SEQ ID NO: 699768 - RNA, 64 nt, hsa; identical to SEQ ID NO: 26508

SEQ ID NO: 699769 - RNA, 64 nt, hsa; identical to SEQ ID NO: 26509

SEQ ID NO: 699770 - RNA, 64 nt, hsa; identical to SEQ ID NO: 26510

SEQ ID NO: 699771 - RNA, 64 nt, hsa; identical to SEQ ID NO: 26511

SEQ ID NO: 699772 - RNA, 64 nt, hsa; identical to SEQ ID NO: 26512

SEQ ID NO: 699773 - RNA, 64 nt, hsa; identical to SEQ ID NO: 26513

SEQ ID NO: 699774 - RNA, 64 nt, hsa; identical to SEQ ID NO: 26514

SEQ ID NO: 699775 - RNA, 64 nt, hsa; identical to SEQ ID NO: 26515

SEQ ID NO: 699776 - RNA, 64 nt, hsa; identical to SEQ ID NO: 26516

SEQ ID NO: 699777 - RNA, 64 nt, hsa; identical to SEQ ID NO: 26517

SEQ ID NO: 699778 - RNA, 64 nt, hsa; identical to SEQ ID NO: 26518

SEQ ID NO: 699779 - RNA, 64 nt, hsa; identical to SEQ ID NO: 26519

SEQ ID NO: 699780 - RNA, 64 nt, hsa; identical to SEQ ID NO: 26520

SEQ ID NO: 699781 - RNA, 64 nt, hsa; identical to SEQ ID NO: 26521

SEQ ID NO: 699782 - RNA, 64 nt, hsa; identical to SEQ ID NO: 26522

SEQ ID NO: 699783 - RNA, 64 nt, hsa; identical to SEQ ID NO: 26523

SEQ ID NO: 699784 - RNA, 64 nt, hsa; identical to SEQ ID NO: 26524

SEQ ID NO: 699785 - RNA, 64 nt, hsa; identical to SEQ ID NO: 26525

SEQ ID NO: 699786 - RNA, 64 nt, hsa; identical to SEQ ID NO: 26526

SEQ ID NO: 699787 - RNA, 64 nt, hsa; identical to SEQ ID NO: 26527

SEQ ID NO: 699788 - RNA, 64 nt, hsa; identical to SEQ ID NO: 26528

SEQ ID NO: 699789 - RNA, 64 nt, hsa; identical to SEQ ID NO: 26529

SEQ ID NO: 699790 - RNA, 64 nt, hsa; identical to SEQ ID NO: 26530

SEQ ID NO: 699791 - RNA, 64 nt, hsa; identical to SEQ ID NO: 26531

SEQ ID NO: 699792 - RNA, 64 nt, hsa; identical to SEQ ID NO: 26532

SEQ ID NO: 699793 - RNA, 64 nt, hsa; identical to SEQ ID NO: 26533

SEQ ID NO: 699794 - RNA, 64 nt, hsa; identical to SEQ ID NO: 26534

SEQ ID NO: 699795 - RNA, 64 nt, hsa; identical to SEQ ID NO: 26535

SEQ ID NO: 699796 - RNA, 64 nt, hsa; identical to SEQ ID NO: 26536

SEQ ID NO: 699797 - RNA, 64 nt, hsa; identical to SEQ ID NO: 26537

SEQ ID NO: 699798 - RNA, 64 nt, hsa; identical to SEQ ID NO: 26538

SEQ ID NO: 699799 - RNA, 64 nt, hsa; identical to SEQ ID NO: 26539

SEQ ID NO: 699800 - RNA, 64 nt, hsa; identical to SEQ ID NO: 26540

SEQ ID NO: 699801 - RNA, 64 nt, hsa; identical to SEQ ID NO: 26541

SEQ ID NO: 699802 - RNA, 64 nt, hsa; identical to SEQ ID NO: 26542

SEQ ID NO: 699803 - RNA, 64 nt, hsa; identical to SEQ ID NO: 26543

SEQ ID NO: 699804 - RNA, 64 nt, hsa; identical to SEQ ID NO: 26544

SEQ ID NO: 699805 - RNA, 64 nt, hsa; identical to SEQ ID NO: 26545

SEQ ID NO: 699806 - RNA, 64 nt, hsa; identical to SEQ ID NO: 26546

SEQ ID NO: 699807 - RNA, 64 nt, hsa; identical to SEQ ID NO: 26547

SEQ ID NO: 699808 - RNA, 64 nt, hsa; identical to SEQ ID NO: 26548

SEQ ID NO: 699809 - RNA, 64 nt, hsa; identical to SEQ ID NO: 26549

SEQ ID NO: 699810 - RNA, 64 nt, hsa; identical to SEQ ID NO: 26550

SEQ ID NO: 699811 - RNA, 64 nt, hsa; identical to SEQ ID NO: 26551

SEQ ID NO: 699812 - RNA, 64 nt, hsa; identical to SEQ ID NO: 26552

SEQ ID NO: 699813 - RNA, 64 nt, hsa; identical to SEQ ID NO: 26553

SEQ ID NO: 699814 - RNA, 64 nt, hsa; identical to SEQ ID NO: 26554

SEQ ID NO: 699815 - RNA, 64 nt, hsa; identical to SEQ ID NO: 26555

SEQ ID NO: 699816 - RNA, 64 nt, hsa; identical to SEQ ID NO: 26556

SEQ ID NO: 699817 - RNA, 64 nt, hsa; identical to SEQ ID NO: 26557

SEQ ID NO: 699818 - RNA, 64 nt, hsa; identical to SEQ ID NO: 26558

SEQ ID NO: 699819 - RNA, 50 nt, hsa; identical to SEQ ID NO: 26559

SEQ ID NO: 699820 - RNA, 51 nt, hsa; identical to SEQ ID NO: 26560

SEQ ID NO: 699821 - RNA, 52 nt, hsa; identical to SEQ ID NO: 26561

SEQ ID NO: 699822 - RNA, 53 nt, hsa; identical to SEQ ID NO: 26562

SEQ ID NO: 699823 - RNA, 54 nt, hsa; identical to SEQ ID NO: 26563

SEQ ID NO: 699824 - RNA, 64 nt, hsa; identical to SEQ ID NO: 26564

SEQ ID NO: 699825 - RNA, 64 nt, hsa; identical to SEQ ID NO: 26565

SEQ ID NO: 699826 - RNA, 64 nt, hsa; identical to SEQ ID NO: 26566

SEQ ID NO: 699827 - RNA, 64 nt, hsa; identical to SEQ ID NO: 26567

SEQ ID NO: 699828 - RNA, 64 nt, hsa; identical to SEQ ID NO: 26568

SEQ ID NO: 699829 - RNA, 64 nt, hsa; identical to SEQ ID NO: 26569

SEQ ID NO: 699830 - RNA, 64 nt, hsa; identical to SEQ ID NO: 26570

SEQ ID NO: 699831 - RNA, 64 nt, hsa; identical to SEQ ID NO: 26571

SEQ ID NO: 699832 - RNA, 64 nt, hsa; identical to SEQ ID NO: 26572

SEQ ID NO: 699833 - RNA, 64 nt, hsa; identical to SEQ ID NO: 26573

SEQ ID NO: 699834 - RNA, 64 nt, hsa; identical to SEQ ID NO: 26574

SEQ ID NO: 699835 - RNA, 64 nt, hsa; identical to SEQ ID NO: 26575

SEQ ID NO: 699836 - RNA, 64 nt, hsa; identical to SEQ ID NO: 26576

SEQ ID NO: 699837 - RNA, 64 nt, hsa; identical to SEQ ID NO: 26577

SEQ ID NO: 699838 - RNA, 64 nt, hsa; identical to SEQ ID NO: 26578

SEQ ID NO: 699839 - RNA, 64 nt, hsa; identical to SEQ ID NO: 26579

SEQ ID NO: 699840 - RNA, 64 nt, hsa; identical to SEQ ID NO: 26580

SEQ ID NO: 699841 - RNA, 64 nt, hsa; identical to SEQ ID NO: 26581

SEQ ID NO: 699842 - RNA, 64 nt, hsa; identical to SEQ ID NO: 26582

SEQ ID NO: 699843 - RNA, 64 nt, hsa; identical to SEQ ID NO: 26583

SEQ ID NO: 699844 - RNA, 64 nt, hsa; identical to SEQ ID NO: 26584

SEQ ID NO: 699845 - RNA, 64 nt, hsa; identical to SEQ ID NO: 26585

SEQ ID NO: 699846 - RNA, 64 nt, hsa; identical to SEQ ID NO: 26586

SEQ ID NO: 699847 - RNA, 64 nt, hsa; identical to SEQ ID NO: 26587

SEQ ID NO: 699848 - RNA, 64 nt, hsa; identical to SEQ ID NO: 26588

SEQ ID NO: 699849 - RNA, 64 nt, hsa; identical to SEQ ID NO: 26589

SEQ ID NO: 699850 - RNA, 64 nt, hsa; identical to SEQ ID NO: 26590

SEQ ID NO: 699851 - RNA, 64 nt, hsa; identical to SEQ ID NO: 26591

SEQ ID NO: 699852 - RNA, 64 nt, hsa; identical to SEQ ID NO: 26592

SEQ ID NO: 699853 - RNA, 64 nt, hsa; identical to SEQ ID NO: 26593

SEQ ID NO: 699854 - RNA, 64 nt, hsa; identical to SEQ ID NO: 26594

SEQ ID NO: 699855 - RNA, 64 nt, hsa; identical to SEQ ID NO: 26595

SEQ ID NO: 699856 - RNA, 64 nt, hsa; identical to SEQ ID NO: 26596

SEQ ID NO: 699857 - RNA, 64 nt, hsa; identical to SEQ ID NO: 26597

SEQ ID NO: 699858 - RNA, 64 nt, hsa; identical to SEQ ID NO: 26598

SEQ ID NO: 699859 - RNA, 64 nt, hsa; identical to SEQ ID NO: 26599

SEQ ID NO: 699860 - RNA, 64 nt, hsa; identical to SEQ ID NO: 26600

SEQ ID NO: 699861 - RNA, 64 nt, hsa; identical to SEQ ID NO: 26601

SEQ ID NO: 699862 - RNA, 64 nt, hsa; identical to SEQ ID NO: 26602

SEQ ID NO: 699863 - RNA, 64 nt, hsa; identical to SEQ ID NO: 26603

SEQ ID NO: 699864 - RNA, 64 nt, hsa; identical to SEQ ID NO: 26604

SEQ ID NO: 699865 - RNA, 64 nt, hsa; identical to SEQ ID NO: 26605

SEQ ID NO: 699866 - RNA, 64 nt, hsa; identical to SEQ ID NO: 26606

SEQ ID NO: 699867 - RNA, 64 nt, hsa; identical to SEQ ID NO: 26607

SEQ ID NO: 699868 - RNA, 64 nt, hsa; identical to SEQ ID NO: 26608

SEQ ID NO: 699869 - RNA, 64 nt, hsa; identical to SEQ ID NO: 26609

SEQ ID NO: 699870 - RNA, 64 nt, hsa; identical to SEQ ID NO: 26610

SEQ ID NO: 699871 - RNA, 64 nt, hsa; identical to SEQ ID NO: 26611

SEQ ID NO: 699872 - RNA, 64 nt, hsa; identical to SEQ ID NO: 26612

SEQ ID NO: 699873 - RNA, 64 nt, hsa; identical to SEQ ID NO: 26613

SEQ ID NO: 699874 - RNA, 64 nt, hsa; identical to SEQ ID NO: 26614

SEQ ID NO: 699875 - RNA, 64 nt, hsa; identical to SEQ ID NO: 26615

SEQ ID NO: 699876 - RNA, 64 nt, hsa; identical to SEQ ID NO: 26616

SEQ ID NO: 699877 - RNA, 64 nt, hsa; identical to SEQ ID NO: 26617

SEQ ID NO: 699878 - RNA, 64 nt, hsa; identical to SEQ ID NO: 26618

SEQ ID NO: 699879 - RNA, 64 nt, hsa; identical to SEQ ID NO: 26619

SEQ ID NO: 699880 - RNA, 64 nt, hsa; identical to SEQ ID NO: 26620

SEQ ID NO: 699881 - RNA, 64 nt, hsa; identical to SEQ ID NO: 26621

SEQ ID NO: 699882 - RNA, 64 nt, hsa; identical to SEQ ID NO: 26622

SEQ ID NO: 699883 - RNA, 64 nt, hsa; identical to SEQ ID NO: 26623

SEQ ID NO: 699884 - RNA, 64 nt, hsa; identical to SEQ ID NO: 26624

SEQ ID NO: 699885 - RNA, 64 nt, hsa; identical to SEQ ID NO: 26625

SEQ ID NO: 699886 - RNA, 64 nt, hsa; identical to SEQ ID NO: 26626

SEQ ID NO: 699887 - RNA, 64 nt, hsa; identical to SEQ ID NO: 26627

SEQ ID NO: 699888 - RNA, 64 nt, hsa; identical to SEQ ID NO: 26628

SEQ ID NO: 699889 - RNA, 64 nt, hsa; identical to SEQ ID NO: 26629

SEQ ID NO: 699890 - RNA, 64 nt, hsa; identical to SEQ ID NO: 26630

SEQ ID NO: 699891 - RNA, 64 nt, hsa; identical to SEQ ID NO: 26631

SEQ ID NO: 699892 - RNA, 64 nt, hsa; identical to SEQ ID NO: 26632

SEQ ID NO: 699893 - RNA, 64 nt, hsa; identical to SEQ ID NO: 26633

SEQ ID NO: 699894 - RNA, 64 nt, hsa; identical to SEQ ID NO: 26634

SEQ ID NO: 699895 - RNA, 64 nt, hsa; identical to SEQ ID NO: 26635

SEQ ID NO: 699896 - RNA, 64 nt, hsa; identical to SEQ ID NO: 26636

SEQ ID NO: 699897 - RNA, 64 nt, hsa; identical to SEQ ID NO: 26637

SEQ ID NO: 699898 - RNA, 64 nt, hsa; identical to SEQ ID NO: 26638

SEQ ID NO: 699899 - RNA, 64 nt, hsa; identical to SEQ ID NO: 26639

SEQ ID NO: 699900 - RNA, 64 nt, hsa; identical to SEQ ID NO: 26640

SEQ ID NO: 699901 - RNA, 64 nt, hsa; identical to SEQ ID NO: 26641

SEQ ID NO: 699902 - RNA, 64 nt, hsa; identical to SEQ ID NO: 26642

SEQ ID NO: 699903 - RNA, 64 nt, hsa; identical to SEQ ID NO: 26643

SEQ ID NO: 699904 - RNA, 64 nt, hsa; identical to SEQ ID NO: 26644

SEQ ID NO: 699905 - RNA, 64 nt, hsa; identical to SEQ ID NO: 26645

SEQ ID NO: 699906 - RNA, 64 nt, hsa; identical to SEQ ID NO: 26646

SEQ ID NO: 699907 - RNA, 64 nt, hsa; identical to SEQ ID NO: 26647

SEQ ID NO: 699908 - RNA, 64 nt, hsa; identical to SEQ ID NO: 26648

SEQ ID NO: 699909 - RNA, 64 nt, hsa; identical to SEQ ID NO: 26649

SEQ ID NO: 699910 - RNA, 64 nt, hsa; identical to SEQ ID NO: 26650

SEQ ID NO: 699911 - RNA, 64 nt, hsa; identical to SEQ ID NO: 26651

SEQ ID NO: 699912 - RNA, 64 nt, hsa; identical to SEQ ID NO: 26652

SEQ ID NO: 699913 - RNA, 64 nt, hsa; identical to SEQ ID NO: 26653

SEQ ID NO: 699914 - RNA, 64 nt, hsa; identical to SEQ ID NO: 26654

SEQ ID NO: 699915 - RNA, 59 nt, hsa; identical to SEQ ID NO: 26655

SEQ ID NO: 699916 - RNA, 60 nt, hsa; identical to SEQ ID NO: 26656

SEQ ID NO: 699917 - RNA, 64 nt, hsa; identical to SEQ ID NO: 26657

SEQ ID NO: 699918 - RNA, 64 nt, hsa; identical to SEQ ID NO: 26658

SEQ ID NO: 699919 - RNA, 64 nt, hsa; identical to SEQ ID NO: 26659

SEQ ID NO: 699920 - RNA, 64 nt, hsa; identical to SEQ ID NO: 26660

SEQ ID NO: 699921 - RNA, 64 nt, hsa; identical to SEQ ID NO: 26661

SEQ ID NO: 699922 - RNA, 64 nt, hsa; identical to SEQ ID NO: 26662

SEQ ID NO: 699923 - RNA, 64 nt, hsa; identical to SEQ ID NO: 26663

SEQ ID NO: 699924 - RNA, 64 nt, hsa; identical to SEQ ID NO: 26664

SEQ ID NO: 699925 - RNA, 64 nt, hsa; identical to SEQ ID NO: 26665

SEQ ID NO: 699926 - RNA, 64 nt, hsa; identical to SEQ ID NO: 26666

SEQ ID NO: 699927 - RNA, 64 nt, hsa; identical to SEQ ID NO: 26667

SEQ ID NO: 699928 - RNA, 64 nt, hsa; identical to SEQ ID NO: 26668

SEQ ID NO: 699929 - RNA, 64 nt, hsa; identical to SEQ ID NO: 26669

SEQ ID NO: 699930 - RNA, 64 nt, hsa; identical to SEQ ID NO: 26670

SEQ ID NO: 699931 - RNA, 64 nt, hsa; identical to SEQ ID NO: 26671

SEQ ID NO: 699932 - RNA, 64 nt, hsa; identical to SEQ ID NO: 26672

SEQ ID NO: 699933 - RNA, 64 nt, hsa; identical to SEQ ID NO: 26673

SEQ ID NO: 699934 - RNA, 64 nt, hsa; identical to SEQ ID NO: 26674

SEQ ID NO: 699935 - RNA, 64 nt, hsa; identical to SEQ ID NO: 26675

SEQ ID NO: 699936 - RNA, 64 nt, hsa; identical to SEQ ID NO: 26676

SEQ ID NO: 699937 - RNA, 64 nt, hsa; identical to SEQ ID NO: 26677

SEQ ID NO: 699938 - RNA, 64 nt, hsa; identical to SEQ ID NO: 26678

SEQ ID NO: 699939 - RNA, 64 nt, hsa; identical to SEQ ID NO: 26679

SEQ ID NO: 699940 - RNA, 64 nt, hsa; identical to SEQ ID NO: 26680

SEQ ID NO: 699941 - RNA, 64 nt, hsa; identical to SEQ ID NO: 26681

SEQ ID NO: 699942 - RNA, 64 nt, hsa; identical to SEQ ID NO: 26682

SEQ ID NO: 699943 - RNA, 64 nt, hsa; identical to SEQ ID NO: 26683

SEQ ID NO: 699944 - RNA, 64 nt, hsa; identical to SEQ ID NO: 26684

SEQ ID NO: 699945 - RNA, 64 nt, hsa; identical to SEQ ID NO: 26685

SEQ ID NO: 699946 - RNA, 64 nt, hsa; identical to SEQ ID NO: 26686

SEQ ID NO: 699947 - RNA, 64 nt, hsa; identical to SEQ ID NO: 26687

SEQ ID NO: 699948 - RNA, 64 nt, hsa; identical to SEQ ID NO: 26688

SEQ ID NO: 699949 - RNA, 64 nt, hsa; identical to SEQ ID NO: 26689

SEQ ID NO: 699950 - RNA, 64 nt, hsa; identical to SEQ ID NO: 26690

SEQ ID NO: 699951 - RNA, 64 nt, hsa; identical to SEQ ID NO: 26691

SEQ ID NO: 699952 - RNA, 64 nt, hsa; identical to SEQ ID NO: 26692

SEQ ID NO: 699953 - RNA, 64 nt, hsa; identical to SEQ ID NO: 26693

SEQ ID NO: 699954 - RNA, 64 nt, hsa; identical to SEQ ID NO: 26694

SEQ ID NO: 699955 - RNA, 64 nt, hsa; identical to SEQ ID NO: 26695

SEQ ID NO: 699956 - RNA, 64 nt, hsa; identical to SEQ ID NO: 26696

SEQ ID NO: 699957 - RNA, 64 nt, hsa; identical to SEQ ID NO: 26697

SEQ ID NO: 699958 - RNA, 64 nt, hsa; identical to SEQ ID NO: 26698

SEQ ID NO: 699959 - RNA, 64 nt, hsa; identical to SEQ ID NO: 26699

SEQ ID NO: 699960 - RNA, 64 nt, hsa; identical to SEQ ID NO: 26700

SEQ ID NO: 699961 - RNA, 64 nt, hsa; identical to SEQ ID NO: 26701

SEQ ID NO: 699962 - RNA, 64 nt, hsa; identical to SEQ ID NO: 26702

SEQ ID NO: 699963 - RNA, 64 nt, hsa; identical to SEQ ID NO: 26703

SEQ ID NO: 699964 - RNA, 64 nt, hsa; identical to SEQ ID NO: 26704

SEQ ID NO: 699965 - RNA, 64 nt, hsa; identical to SEQ ID NO: 26705

SEQ ID NO: 699966 - RNA, 64 nt, hsa; identical to SEQ ID NO: 26706

SEQ ID NO: 699967 - RNA, 64 nt, hsa; identical to SEQ ID NO: 26707

SEQ ID NO: 699968 - RNA, 64 nt, hsa; identical to SEQ ID NO: 26708

SEQ ID NO: 699969 - RNA, 64 nt, hsa; identical to SEQ ID NO: 26709

SEQ ID NO: 699970 - RNA, 64 nt, hsa; identical to SEQ ID NO: 26710

SEQ ID NO: 699971 - RNA, 64 nt, hsa; identical to SEQ ID NO: 26711

SEQ ID NO: 699972 - RNA, 64 nt, hsa; identical to SEQ ID NO: 26712

SEQ ID NO: 699973 - RNA, 64 nt, hsa; identical to SEQ ID NO: 26713

SEQ ID NO: 699974 - RNA, 64 nt, hsa; identical to SEQ ID NO: 26714

SEQ ID NO: 699975 - RNA, 64 nt, hsa; identical to SEQ ID NO: 26715

SEQ ID NO: 699976 - RNA, 64 nt, hsa; identical to SEQ ID NO: 26716

SEQ ID NO: 699977 - RNA, 64 nt, hsa; identical to SEQ ID NO: 26717

SEQ ID NO: 699978 - RNA, 64 nt, hsa; identical to SEQ ID NO: 26718

SEQ ID NO: 699979 - RNA, 64 nt, hsa; identical to SEQ ID NO: 26719

SEQ ID NO: 699980 - RNA, 64 nt, hsa; identical to SEQ ID NO: 26720

SEQ ID NO: 699981 - RNA, 64 nt, hsa; identical to SEQ ID NO: 26721

SEQ ID NO: 699982 - RNA, 64 nt, hsa; identical to SEQ ID NO: 26722

SEQ ID NO: 699983 - RNA, 64 nt, hsa; identical to SEQ ID NO: 26723

SEQ ID NO: 699984 - RNA, 64 nt, hsa; identical to SEQ ID NO: 26724

SEQ ID NO: 699985 - RNA, 64 nt, hsa; identical to SEQ ID NO: 26725

SEQ ID NO: 699986 - RNA, 64 nt, hsa; identical to SEQ ID NO: 26726

SEQ ID NO: 699987 - RNA, 64 nt, hsa; identical to SEQ ID NO: 26727

SEQ ID NO: 699988 - RNA, 64 nt, hsa; identical to SEQ ID NO: 26728

SEQ ID NO: 699989 - RNA, 64 nt, hsa; identical to SEQ ID NO: 26729

SEQ ID NO: 699990 - RNA, 64 nt, hsa; identical to SEQ ID NO: 26730

SEQ ID NO: 699991 - RNA, 64 nt, hsa; identical to SEQ ID NO: 26731

SEQ ID NO: 699992 - RNA, 64 nt, hsa; identical to SEQ ID NO: 26732

SEQ ID NO: 699993 - RNA, 64 nt, hsa; identical to SEQ ID NO: 26733

SEQ ID NO: 699994 - RNA, 64 nt, hsa; identical to SEQ ID NO: 26734

SEQ ID NO: 699995 - RNA, 64 nt, hsa; identical to SEQ ID NO: 26735

SEQ ID NO: 699996 - RNA, 64 nt, hsa; identical to SEQ ID NO: 26736

SEQ ID NO: 699997 - RNA, 64 nt, hsa; identical to SEQ ID NO: 26737

SEQ ID NO: 699998 - RNA, 64 nt, hsa; identical to SEQ ID NO: 26738

SEQ ID NO: 699999 - RNA, 64 nt, hsa; identical to SEQ ID NO: 26739

SEQ ID NO: 700000 - RNA, 64 nt, hsa; identical to SEQ ID NO: 26740

SEQ ID NO: 700001 - RNA, 64 nt, hsa; identical to SEQ ID NO: 26741

SEQ ID NO: 700002 - RNA, 64 nt, hsa; identical to SEQ ID NO: 26742

SEQ ID NO: 700003 - RNA, 64 nt, hsa; identical to SEQ ID NO: 26743

SEQ ID NO: 700004 - RNA, 64 nt, hsa; identical to SEQ ID NO: 26744

SEQ ID NO: 700005 - RNA, 64 nt, hsa; identical to SEQ ID NO: 26745

SEQ ID NO: 700006 - RNA, 64 nt, hsa; identical to SEQ ID NO: 26746

SEQ ID NO: 700007 - RNA, 64 nt, hsa; identical to SEQ ID NO: 26747

SEQ ID NO: 700008 - RNA, 64 nt, hsa; identical to SEQ ID NO: 26748

SEQ ID NO: 700009 - RNA, 64 nt, hsa; identical to SEQ ID NO: 26749

SEQ ID NO: 700010 - RNA, 64 nt, hsa; identical to SEQ ID NO: 26750

SEQ ID NO: 700011 - RNA, 64 nt, hsa; identical to SEQ ID NO: 26751

SEQ ID NO: 700012 - RNA, 64 nt, hsa; identical to SEQ ID NO: 26752

SEQ ID NO: 700013 - RNA, 64 nt, hsa; identical to SEQ ID NO: 26753

SEQ ID NO: 700014 - RNA, 64 nt, hsa; identical to SEQ ID NO: 26754

SEQ ID NO: 700015 - RNA, 64 nt, hsa; identical to SEQ ID NO: 26755

SEQ ID NO: 700016 - RNA, 64 nt, hsa; identical to SEQ ID NO: 26756

SEQ ID NO: 700017 - RNA, 64 nt, hsa; identical to SEQ ID NO: 26757

SEQ ID NO: 700018 - RNA, 64 nt, hsa; identical to SEQ ID NO: 26758

SEQ ID NO: 700019 - RNA, 64 nt, hsa; identical to SEQ ID NO: 26759

SEQ ID NO: 700020 - RNA, 64 nt, hsa; identical to SEQ ID NO: 26760

SEQ ID NO: 700021 - RNA, 64 nt, hsa; identical to SEQ ID NO: 26761

SEQ ID NO: 700022 - RNA, 64 nt, hsa; identical to SEQ ID NO: 26762

SEQ ID NO: 700023 - RNA, 64 nt, hsa; identical to SEQ ID NO: 26763

SEQ ID NO: 700024 - RNA, 64 nt, hsa; identical to SEQ ID NO: 26764

SEQ ID NO: 700025 - RNA, 64 nt, hsa; identical to SEQ ID NO: 26765

SEQ ID NO: 700026 - RNA, 64 nt, hsa; identical to SEQ ID NO: 26766

SEQ ID NO: 700027 - RNA, 64 nt, hsa; identical to SEQ ID NO: 26767

SEQ ID NO: 700028 - RNA, 64 nt, hsa; identical to SEQ ID NO: 26768

SEQ ID NO: 700029 - RNA, 64 nt, hsa; identical to SEQ ID NO: 26769

SEQ ID NO: 700030 - RNA, 64 nt, hsa; identical to SEQ ID NO: 26770

SEQ ID NO: 700031 - RNA, 64 nt, hsa; identical to SEQ ID NO: 26771

SEQ ID NO: 700032 - RNA, 64 nt, hsa; identical to SEQ ID NO: 26772

SEQ ID NO: 700033 - RNA, 64 nt, hsa; identical to SEQ ID NO: 26773

SEQ ID NO: 700034 - RNA, 64 nt, hsa; identical to SEQ ID NO: 26774

SEQ ID NO: 700035 - RNA, 64 nt, hsa; identical to SEQ ID NO: 26775

SEQ ID NO: 700036 - RNA, 64 nt, hsa; identical to SEQ ID NO: 26776

SEQ ID NO: 700037 - RNA, 64 nt, hsa; identical to SEQ ID NO: 26777

SEQ ID NO: 700038 - RNA, 64 nt, hsa; identical to SEQ ID NO: 26778

SEQ ID NO: 700039 - RNA, 64 nt, hsa; identical to SEQ ID NO: 26779

SEQ ID NO: 700040 - RNA, 64 nt, hsa; identical to SEQ ID NO: 26780

SEQ ID NO: 700041 - RNA, 64 nt, hsa; identical to SEQ ID NO: 26781

SEQ ID NO: 700042 - RNA, 64 nt, hsa; identical to SEQ ID NO: 26782

SEQ ID NO: 700043 - RNA, 64 nt, hsa; identical to SEQ ID NO: 26783

SEQ ID NO: 700044 - RNA, 64 nt, hsa; identical to SEQ ID NO: 26784

SEQ ID NO: 700045 - RNA, 64 nt, hsa; identical to SEQ ID NO: 26785

SEQ ID NO: 700046 - RNA, 64 nt, hsa; identical to SEQ ID NO: 26786

SEQ ID NO: 700047 - RNA, 64 nt, hsa; identical to SEQ ID NO: 26787

SEQ ID NO: 700048 - RNA, 64 nt, hsa; identical to SEQ ID NO: 26788

SEQ ID NO: 700049 - RNA, 64 nt, hsa; identical to SEQ ID NO: 26789

SEQ ID NO: 700050 - RNA, 64 nt, hsa; identical to SEQ ID NO: 26790

SEQ ID NO: 700051 - RNA, 64 nt, hsa; identical to SEQ ID NO: 26791

SEQ ID NO: 700052 - RNA, 64 nt, hsa; identical to SEQ ID NO: 26792

SEQ ID NO: 700053 - RNA, 64 nt, hsa; identical to SEQ ID NO: 26793

SEQ ID NO: 700054 - RNA, 64 nt, hsa; identical to SEQ ID NO: 26794

SEQ ID NO: 700055 - RNA, 64 nt, hsa; identical to SEQ ID NO: 26795

SEQ ID NO: 700056 - RNA, 64 nt, hsa; identical to SEQ ID NO: 26796

SEQ ID NO: 700057 - RNA, 64 nt, hsa; identical to SEQ ID NO: 26797

SEQ ID NO: 700058 - RNA, 64 nt, hsa; identical to SEQ ID NO: 26798

SEQ ID NO: 700059 - RNA, 64 nt, hsa; identical to SEQ ID NO: 26799

SEQ ID NO: 700060 - RNA, 64 nt, hsa; identical to SEQ ID NO: 26800

SEQ ID NO: 700061 - RNA, 64 nt, hsa; identical to SEQ ID NO: 26801

SEQ ID NO: 700062 - RNA, 64 nt, hsa; identical to SEQ ID NO: 26802

SEQ ID NO: 700063 - RNA, 64 nt, hsa; identical to SEQ ID NO: 26803

SEQ ID NO: 700064 - RNA, 64 nt, hsa; identical to SEQ ID NO: 26804

SEQ ID NO: 700065 - RNA, 64 nt, hsa; identical to SEQ ID NO: 26805

SEQ ID NO: 700066 - RNA, 64 nt, hsa; identical to SEQ ID NO: 26806

SEQ ID NO: 700067 - RNA, 64 nt, hsa; identical to SEQ ID NO: 26807

SEQ ID NO: 700068 - RNA, 64 nt, hsa; identical to SEQ ID NO: 26808

SEQ ID NO: 700069 - RNA, 64 nt, hsa; identical to SEQ ID NO: 26809

SEQ ID NO: 700070 - RNA, 64 nt, hsa; identical to SEQ ID NO: 26810

SEQ ID NO: 700071 - RNA, 64 nt, hsa; identical to SEQ ID NO: 26811

SEQ ID NO: 700072 - RNA, 64 nt, hsa; identical to SEQ ID NO: 26812

SEQ ID NO: 700073 - RNA, 64 nt, hsa; identical to SEQ ID NO: 26813

SEQ ID NO: 700074 - RNA, 64 nt, hsa; identical to SEQ ID NO: 26814

SEQ ID NO: 700075 - RNA, 64 nt, hsa; identical to SEQ ID NO: 26815

SEQ ID NO: 700076 - RNA, 64 nt, hsa; identical to SEQ ID NO: 26816

SEQ ID NO: 700077 - RNA, 64 nt, hsa; identical to SEQ ID NO: 26817

SEQ ID NO: 700078 - RNA, 64 nt, hsa; identical to SEQ ID NO: 26818

SEQ ID NO: 700079 - RNA, 64 nt, hsa; identical to SEQ ID NO: 26819

SEQ ID NO: 700080 - RNA, 64 nt, hsa; identical to SEQ ID NO: 26820

SEQ ID NO: 700081 - RNA, 64 nt, hsa; identical to SEQ ID NO: 26821

SEQ ID NO: 700082 - RNA, 64 nt, hsa; identical to SEQ ID NO: 26822

SEQ ID NO: 700083 - RNA, 64 nt, hsa; identical to SEQ ID NO: 26823

SEQ ID NO: 700084 - RNA, 64 nt, hsa; identical to SEQ ID NO: 26824

SEQ ID NO: 700085 - RNA, 64 nt, hsa; identical to SEQ ID NO: 26825

SEQ ID NO: 700086 - RNA, 64 nt, hsa; identical to SEQ ID NO: 26826

SEQ ID NO: 700087 - RNA, 64 nt, hsa; identical to SEQ ID NO: 26827

SEQ ID NO: 700088 - RNA, 64 nt, hsa; identical to SEQ ID NO: 26828

SEQ ID NO: 700089 - RNA, 64 nt, hsa; identical to SEQ ID NO: 26829

SEQ ID NO: 700090 - RNA, 64 nt, hsa; identical to SEQ ID NO: 26830

SEQ ID NO: 700091 - RNA, 64 nt, hsa; identical to SEQ ID NO: 26831

SEQ ID NO: 700092 - RNA, 64 nt, hsa; identical to SEQ ID NO: 26832

SEQ ID NO: 700093 - RNA, 64 nt, hsa; identical to SEQ ID NO: 26833

SEQ ID NO: 700094 - RNA, 64 nt, hsa; identical to SEQ ID NO: 26834

SEQ ID NO: 700095 - RNA, 64 nt, hsa; identical to SEQ ID NO: 26835

SEQ ID NO: 700096 - RNA, 64 nt, hsa; identical to SEQ ID NO: 26836

SEQ ID NO: 700097 - RNA, 64 nt, hsa; identical to SEQ ID NO: 26837

SEQ ID NO: 700098 - RNA, 64 nt, hsa; identical to SEQ ID NO: 26838

SEQ ID NO: 700099 - RNA, 64 nt, hsa; identical to SEQ ID NO: 26839

SEQ ID NO: 700100 - RNA, 64 nt, hsa; identical to SEQ ID NO: 26840

SEQ ID NO: 700101 - RNA, 64 nt, hsa; identical to SEQ ID NO: 26841

SEQ ID NO: 700102 - RNA, 64 nt, hsa; identical to SEQ ID NO: 26842

SEQ ID NO: 700103 - RNA, 64 nt, hsa; identical to SEQ ID NO: 26843

SEQ ID NO: 700104 - RNA, 64 nt, hsa; identical to SEQ ID NO: 26844

SEQ ID NO: 700105 - RNA, 64 nt, hsa; identical to SEQ ID NO: 26845

SEQ ID NO: 700106 - RNA, 64 nt, hsa; identical to SEQ ID NO: 26846

SEQ ID NO: 700107 - RNA, 64 nt, hsa; identical to SEQ ID NO: 26847

SEQ ID NO: 700108 - RNA, 64 nt, hsa; identical to SEQ ID NO: 26848

SEQ ID NO: 700109 - RNA, 64 nt, hsa; identical to SEQ ID NO: 26849

SEQ ID NO: 700110 - RNA, 64 nt, hsa; identical to SEQ ID NO: 26850

SEQ ID NO: 700111 - RNA, 64 nt, hsa; identical to SEQ ID NO: 26851

SEQ ID NO: 700112 - RNA, 64 nt, hsa; identical to SEQ ID NO: 26852

SEQ ID NO: 700113 - RNA, 64 nt, hsa; identical to SEQ ID NO: 26853

SEQ ID NO: 700114 - RNA, 64 nt, hsa; identical to SEQ ID NO: 26854

SEQ ID NO: 700115 - RNA, 64 nt, hsa; identical to SEQ ID NO: 26855

SEQ ID NO: 700116 - RNA, 64 nt, hsa; identical to SEQ ID NO: 26856

SEQ ID NO: 700117 - RNA, 64 nt, hsa; identical to SEQ ID NO: 26857

SEQ ID NO: 700118 - RNA, 64 nt, hsa; identical to SEQ ID NO: 26858

SEQ ID NO: 700119 - RNA, 64 nt, hsa; identical to SEQ ID NO: 26859

SEQ ID NO: 700120 - RNA, 64 nt, hsa; identical to SEQ ID NO: 26860

SEQ ID NO: 700121 - RNA, 64 nt, hsa; identical to SEQ ID NO: 26861

SEQ ID NO: 700122 - RNA, 64 nt, hsa; identical to SEQ ID NO: 26862

SEQ ID NO: 700123 - RNA, 55 nt, hsa; identical to SEQ ID NO: 26863

SEQ ID NO: 700124 - RNA, 54 nt, hsa; identical to SEQ ID NO: 26864

SEQ ID NO: 700125 - RNA, 53 nt, hsa; identical to SEQ ID NO: 26865

SEQ ID NO: 700126 - RNA, 64 nt, hsa; identical to SEQ ID NO: 26866

SEQ ID NO: 700127 - RNA, 64 nt, hsa; identical to SEQ ID NO: 26867

SEQ ID NO: 700128 - RNA, 64 nt, hsa; identical to SEQ ID NO: 26868

SEQ ID NO: 700129 - RNA, 64 nt, hsa; identical to SEQ ID NO: 26869

SEQ ID NO: 700130 - RNA, 64 nt, hsa; identical to SEQ ID NO: 26870

SEQ ID NO: 700131 - RNA, 64 nt, hsa; identical to SEQ ID NO: 26871

SEQ ID NO: 700132 - RNA, 64 nt, hsa; identical to SEQ ID NO: 26872

SEQ ID NO: 700133 - RNA, 64 nt, hsa; identical to SEQ ID NO: 26873

SEQ ID NO: 700134 - RNA, 64 nt, hsa; identical to SEQ ID NO: 26874

SEQ ID NO: 700135 - RNA, 64 nt, hsa; identical to SEQ ID NO: 26875

SEQ ID NO: 700136 - RNA, 64 nt, hsa; identical to SEQ ID NO: 26876

SEQ ID NO: 700137 - RNA, 64 nt, hsa; identical to SEQ ID NO: 26877

SEQ ID NO: 700138 - RNA, 64 nt, hsa; identical to SEQ ID NO: 26878

SEQ ID NO: 700139 - RNA, 64 nt, hsa; identical to SEQ ID NO: 26879

SEQ ID NO: 700140 - RNA, 64 nt, hsa; identical to SEQ ID NO: 26880

SEQ ID NO: 700141 - RNA, 64 nt, hsa; identical to SEQ ID NO: 26881

SEQ ID NO: 700142 - RNA, 64 nt, hsa; identical to SEQ ID NO: 26882

SEQ ID NO: 700143 - RNA, 64 nt, hsa; identical to SEQ ID NO: 26883

SEQ ID NO: 700144 - RNA, 64 nt, hsa; identical to SEQ ID NO: 26884

SEQ ID NO: 700145 - RNA, 64 nt, hsa; identical to SEQ ID NO: 26885

SEQ ID NO: 700146 - RNA, 64 nt, hsa; identical to SEQ ID NO: 26886

SEQ ID NO: 700147 - RNA, 64 nt, hsa; identical to SEQ ID NO: 26887

SEQ ID NO: 700148 - RNA, 64 nt, hsa; identical to SEQ ID NO: 26888

SEQ ID NO: 700149 - RNA, 64 nt, hsa; identical to SEQ ID NO: 26889

SEQ ID NO: 700150 - RNA, 64 nt, hsa; identical to SEQ ID NO: 26890

SEQ ID NO: 700151 - RNA, 64 nt, hsa; identical to SEQ ID NO: 26891

SEQ ID NO: 700152 - RNA, 64 nt, hsa; identical to SEQ ID NO: 26892

SEQ ID NO: 700153 - RNA, 64 nt, hsa; identical to SEQ ID NO: 26893

SEQ ID NO: 700154 - RNA, 64 nt, hsa; identical to SEQ ID NO: 26894

SEQ ID NO: 700155 - RNA, 64 nt, hsa; identical to SEQ ID NO: 26895

SEQ ID NO: 700156 - RNA, 64 nt, hsa; identical to SEQ ID NO: 26896

SEQ ID NO: 700157 - RNA, 64 nt, hsa; identical to SEQ ID NO: 26897

SEQ ID NO: 700158 - RNA, 64 nt, hsa; identical to SEQ ID NO: 26898

SEQ ID NO: 700159 - RNA, 64 nt, hsa; identical to SEQ ID NO: 26899

SEQ ID NO: 700160 - RNA, 64 nt, hsa; identical to SEQ ID NO: 26900

SEQ ID NO: 700161 - RNA, 64 nt, hsa; identical to SEQ ID NO: 26901

SEQ ID NO: 700162 - RNA, 64 nt, hsa; identical to SEQ ID NO: 26902

SEQ ID NO: 700163 - RNA, 64 nt, hsa; identical to SEQ ID NO: 26903

SEQ ID NO: 700164 - RNA, 64 nt, hsa; identical to SEQ ID NO: 26904

SEQ ID NO: 700165 - RNA, 64 nt, hsa; identical to SEQ ID NO: 26905

SEQ ID NO: 700166 - RNA, 64 nt, hsa; identical to SEQ ID NO: 26906

SEQ ID NO: 700167 - RNA, 64 nt, hsa; identical to SEQ ID NO: 26907

SEQ ID NO: 700168 - RNA, 64 nt, hsa; identical to SEQ ID NO: 26908

SEQ ID NO: 700169 - RNA, 64 nt, hsa; identical to SEQ ID NO: 26909

SEQ ID NO: 700170 - RNA, 64 nt, hsa; identical to SEQ ID NO: 26910

SEQ ID NO: 700171 - RNA, 64 nt, hsa; identical to SEQ ID NO: 26911

SEQ ID NO: 700172 - RNA, 64 nt, hsa; identical to SEQ ID NO: 26912

SEQ ID NO: 700173 - RNA, 64 nt, hsa; identical to SEQ ID NO: 26913

SEQ ID NO: 700174 - RNA, 64 nt, hsa; identical to SEQ ID NO: 26914

SEQ ID NO: 700175 - RNA, 64 nt, hsa; identical to SEQ ID NO: 26915

SEQ ID NO: 700176 - RNA, 64 nt, hsa; identical to SEQ ID NO: 26916

SEQ ID NO: 700177 - RNA, 64 nt, hsa; identical to SEQ ID NO: 26917

SEQ ID NO: 700178 - RNA, 64 nt, hsa; identical to SEQ ID NO: 26918

SEQ ID NO: 700179 - RNA, 64 nt, hsa; identical to SEQ ID NO: 26919

SEQ ID NO: 700180 - RNA, 64 nt, hsa; identical to SEQ ID NO: 26920

SEQ ID NO: 700181 - RNA, 64 nt, hsa; identical to SEQ ID NO: 26921

SEQ ID NO: 700182 - RNA, 64 nt, hsa; identical to SEQ ID NO: 26922

SEQ ID NO: 700183 - RNA, 64 nt, hsa; identical to SEQ ID NO: 26923

SEQ ID NO: 700184 - RNA, 64 nt, hsa; identical to SEQ ID NO: 26924

SEQ ID NO: 700185 - RNA, 64 nt, hsa; identical to SEQ ID NO: 26925

SEQ ID NO: 700186 - RNA, 64 nt, hsa; identical to SEQ ID NO: 26926

SEQ ID NO: 700187 - RNA, 64 nt, hsa; identical to SEQ ID NO: 26927

SEQ ID NO: 700188 - RNA, 64 nt, hsa; identical to SEQ ID NO: 26928

SEQ ID NO: 700189 - RNA, 64 nt, hsa; identical to SEQ ID NO: 26929

SEQ ID NO: 700190 - RNA, 64 nt, hsa; identical to SEQ ID NO: 26930

SEQ ID NO: 700191 - RNA, 64 nt, hsa; identical to SEQ ID NO: 26931

SEQ ID NO: 700192 - RNA, 64 nt, hsa; identical to SEQ ID NO: 26932

SEQ ID NO: 700193 - RNA, 64 nt, hsa; identical to SEQ ID NO: 26933

SEQ ID NO: 700194 - RNA, 64 nt, hsa; identical to SEQ ID NO: 26934

SEQ ID NO: 700195 - RNA, 64 nt, hsa; identical to SEQ ID NO: 26935

SEQ ID NO: 700196 - RNA, 64 nt, hsa; identical to SEQ ID NO: 26936

SEQ ID NO: 700197 - RNA, 64 nt, hsa; identical to SEQ ID NO: 26937

SEQ ID NO: 700198 - RNA, 64 nt, hsa; identical to SEQ ID NO: 26938

SEQ ID NO: 700199 - RNA, 64 nt, hsa; identical to SEQ ID NO: 26939

SEQ ID NO: 700200 - RNA, 64 nt, hsa; identical to SEQ ID NO: 26940

SEQ ID NO: 700201 - RNA, 64 nt, hsa; identical to SEQ ID NO: 26941

SEQ ID NO: 700202 - RNA, 64 nt, hsa; identical to SEQ ID NO: 26942

SEQ ID NO: 700203 - RNA, 64 nt, hsa; identical to SEQ ID NO: 26943

SEQ ID NO: 700204 - RNA, 64 nt, hsa; identical to SEQ ID NO: 26944

SEQ ID NO: 700205 - RNA, 64 nt, hsa; identical to SEQ ID NO: 26945

SEQ ID NO: 700206 - RNA, 64 nt, hsa; identical to SEQ ID NO: 26946

SEQ ID NO: 700207 - RNA, 64 nt, hsa; identical to SEQ ID NO: 26947

SEQ ID NO: 700208 - RNA, 64 nt, hsa; identical to SEQ ID NO: 26948

SEQ ID NO: 700209 - RNA, 64 nt, hsa; identical to SEQ ID NO: 26949

SEQ ID NO: 700210 - RNA, 64 nt, hsa; identical to SEQ ID NO: 26950

SEQ ID NO: 700211 - RNA, 64 nt, hsa; identical to SEQ ID NO: 26951

SEQ ID NO: 700212 - RNA, 64 nt, hsa; identical to SEQ ID NO: 26952

SEQ ID NO: 700213 - RNA, 64 nt, hsa; identical to SEQ ID NO: 26953

SEQ ID NO: 700214 - RNA, 64 nt, hsa; identical to SEQ ID NO: 26954

SEQ ID NO: 700215 - RNA, 64 nt, hsa; identical to SEQ ID NO: 26955

SEQ ID NO: 700216 - RNA, 64 nt, hsa; identical to SEQ ID NO: 26956

SEQ ID NO: 700217 - RNA, 64 nt, hsa; identical to SEQ ID NO: 26957

SEQ ID NO: 700218 - RNA, 64 nt, hsa; identical to SEQ ID NO: 26958

SEQ ID NO: 700219 - RNA, 64 nt, hsa; identical to SEQ ID NO: 26959

SEQ ID NO: 700220 - RNA, 64 nt, hsa; identical to SEQ ID NO: 26960

SEQ ID NO: 700221 - RNA, 64 nt, hsa; identical to SEQ ID NO: 26961

SEQ ID NO: 700222 - RNA, 64 nt, hsa; identical to SEQ ID NO: 26962

SEQ ID NO: 700223 - RNA, 64 nt, hsa; identical to SEQ ID NO: 26963

SEQ ID NO: 700224 - RNA, 64 nt, hsa; identical to SEQ ID NO: 26964

SEQ ID NO: 700225 - RNA, 64 nt, hsa; identical to SEQ ID NO: 26965

SEQ ID NO: 700226 - RNA, 64 nt, hsa; identical to SEQ ID NO: 26966

SEQ ID NO: 700227 - RNA, 64 nt, hsa; identical to SEQ ID NO: 26967

SEQ ID NO: 700228 - RNA, 64 nt, hsa; identical to SEQ ID NO: 26968

SEQ ID NO: 700229 - RNA, 64 nt, hsa; identical to SEQ ID NO: 26969

SEQ ID NO: 700230 - RNA, 64 nt, hsa; identical to SEQ ID NO: 26970

SEQ ID NO: 700231 - RNA, 64 nt, hsa; identical to SEQ ID NO: 26971

SEQ ID NO: 700232 - RNA, 64 nt, hsa; identical to SEQ ID NO: 26972

SEQ ID NO: 700233 - RNA, 64 nt, hsa; identical to SEQ ID NO: 26973

SEQ ID NO: 700234 - RNA, 64 nt, hsa; identical to SEQ ID NO: 26974

SEQ ID NO: 700235 - RNA, 64 nt, hsa; identical to SEQ ID NO: 26975

SEQ ID NO: 700236 - RNA, 64 nt, hsa; identical to SEQ ID NO: 26976

SEQ ID NO: 700237 - RNA, 64 nt, hsa; identical to SEQ ID NO: 26977

SEQ ID NO: 700238 - RNA, 64 nt, hsa; identical to SEQ ID NO: 26978

SEQ ID NO: 700239 - RNA, 64 nt, hsa; identical to SEQ ID NO: 26979

SEQ ID NO: 700240 - RNA, 64 nt, hsa; identical to SEQ ID NO: 26980

SEQ ID NO: 700241 - RNA, 64 nt, hsa; identical to SEQ ID NO: 26981

SEQ ID NO: 700242 - RNA, 64 nt, hsa; identical to SEQ ID NO: 26982

SEQ ID NO: 700243 - RNA, 64 nt, hsa; identical to SEQ ID NO: 26983

SEQ ID NO: 700244 - RNA, 64 nt, hsa; identical to SEQ ID NO: 26984

SEQ ID NO: 700245 - RNA, 64 nt, hsa; identical to SEQ ID NO: 26985

SEQ ID NO: 700246 - RNA, 64 nt, hsa; identical to SEQ ID NO: 26986

SEQ ID NO: 700247 - RNA, 64 nt, hsa; identical to SEQ ID NO: 26987

SEQ ID NO: 700248 - RNA, 64 nt, hsa; identical to SEQ ID NO: 26988

SEQ ID NO: 700249 - RNA, 64 nt, hsa; identical to SEQ ID NO: 26989

SEQ ID NO: 700250 - RNA, 64 nt, hsa; identical to SEQ ID NO: 26990

SEQ ID NO: 700251 - RNA, 64 nt, hsa; identical to SEQ ID NO: 26991

SEQ ID NO: 700252 - RNA, 64 nt, hsa; identical to SEQ ID NO: 26992

SEQ ID NO: 700253 - RNA, 64 nt, hsa; identical to SEQ ID NO: 26993

SEQ ID NO: 700254 - RNA, 64 nt, hsa; identical to SEQ ID NO: 26994

SEQ ID NO: 700255 - RNA, 64 nt, hsa; identical to SEQ ID NO: 26995

SEQ ID NO: 700256 - RNA, 64 nt, hsa; identical to SEQ ID NO: 26996

SEQ ID NO: 700257 - RNA, 64 nt, hsa; identical to SEQ ID NO: 26997

SEQ ID NO: 700258 - RNA, 64 nt, hsa; identical to SEQ ID NO: 26998

SEQ ID NO: 700259 - RNA, 64 nt, hsa; identical to SEQ ID NO: 26999

SEQ ID NO: 700260 - RNA, 64 nt, hsa; identical to SEQ ID NO: 27000

SEQ ID NO: 700261 - RNA, 64 nt, hsa; identical to SEQ ID NO: 27001

SEQ ID NO: 700262 - RNA, 64 nt, hsa; identical to SEQ ID NO: 27002

SEQ ID NO: 700263 - RNA, 64 nt, hsa; identical to SEQ ID NO: 27003

SEQ ID NO: 700264 - RNA, 64 nt, hsa; identical to SEQ ID NO: 27004

SEQ ID NO: 700265 - RNA, 64 nt, hsa; identical to SEQ ID NO: 27005

SEQ ID NO: 700266 - RNA, 64 nt, hsa; identical to SEQ ID NO: 27006

SEQ ID NO: 700267 - RNA, 64 nt, hsa; identical to SEQ ID NO: 27007

SEQ ID NO: 700268 - RNA, 64 nt, hsa; identical to SEQ ID NO: 27008

SEQ ID NO: 700269 - RNA, 64 nt, hsa; identical to SEQ ID NO: 27009

SEQ ID NO: 700270 - RNA, 64 nt, hsa; identical to SEQ ID NO: 27010

SEQ ID NO: 700271 - RNA, 64 nt, hsa; identical to SEQ ID NO: 27011

SEQ ID NO: 700272 - RNA, 64 nt, hsa; identical to SEQ ID NO: 27012

SEQ ID NO: 700273 - RNA, 64 nt, hsa; identical to SEQ ID NO: 27013

SEQ ID NO: 700274 - RNA, 64 nt, hsa; identical to SEQ ID NO: 27014

SEQ ID NO: 700275 - RNA, 64 nt, hsa; identical to SEQ ID NO: 27015

SEQ ID NO: 700276 - RNA, 64 nt, hsa; identical to SEQ ID NO: 27016

SEQ ID NO: 700277 - RNA, 64 nt, hsa; identical to SEQ ID NO: 27017

SEQ ID NO: 700278 - RNA, 64 nt, hsa; identical to SEQ ID NO: 27018

SEQ ID NO: 700279 - RNA, 64 nt, hsa; identical to SEQ ID NO: 27019

SEQ ID NO: 700280 - RNA, 64 nt, hsa; identical to SEQ ID NO: 27020

SEQ ID NO: 700281 - RNA, 64 nt, hsa; identical to SEQ ID NO: 27021

SEQ ID NO: 700282 - RNA, 64 nt, hsa; identical to SEQ ID NO: 27022

SEQ ID NO: 700283 - RNA, 64 nt, hsa; identical to SEQ ID NO: 27023

SEQ ID NO: 700284 - RNA, 64 nt, hsa; identical to SEQ ID NO: 27024

SEQ ID NO: 700285 - RNA, 64 nt, hsa; identical to SEQ ID NO: 27025

SEQ ID NO: 700286 - RNA, 64 nt, hsa; identical to SEQ ID NO: 27026

SEQ ID NO: 700287 - RNA, 64 nt, hsa; identical to SEQ ID NO: 27027

SEQ ID NO: 700288 - RNA, 64 nt, hsa; identical to SEQ ID NO: 27028

SEQ ID NO: 700289 - RNA, 64 nt, hsa; identical to SEQ ID NO: 27029

SEQ ID NO: 700290 - RNA, 64 nt, hsa; identical to SEQ ID NO: 27030

SEQ ID NO: 700291 - RNA, 64 nt, hsa; identical to SEQ ID NO: 27031

SEQ ID NO: 700292 - RNA, 64 nt, hsa; identical to SEQ ID NO: 27032

SEQ ID NO: 700293 - RNA, 64 nt, hsa; identical to SEQ ID NO: 27033

SEQ ID NO: 700294 - RNA, 64 nt, hsa; identical to SEQ ID NO: 27034

SEQ ID NO: 700295 - RNA, 64 nt, hsa; identical to SEQ ID NO: 27035

SEQ ID NO: 700296 - RNA, 64 nt, hsa; identical to SEQ ID NO: 27036

SEQ ID NO: 700297 - RNA, 64 nt, hsa; identical to SEQ ID NO: 27037

SEQ ID NO: 700298 - RNA, 64 nt, hsa; identical to SEQ ID NO: 27038

SEQ ID NO: 700299 - RNA, 64 nt, hsa; identical to SEQ ID NO: 27039

SEQ ID NO: 700300 - RNA, 64 nt, hsa; identical to SEQ ID NO: 27040

SEQ ID NO: 700301 - RNA, 64 nt, hsa; identical to SEQ ID NO: 27041

SEQ ID NO: 700302 - RNA, 64 nt, hsa; identical to SEQ ID NO: 27042

SEQ ID NO: 700303 - RNA, 64 nt, hsa; identical to SEQ ID NO: 27043

SEQ ID NO: 700304 - RNA, 64 nt, hsa; identical to SEQ ID NO: 27044

SEQ ID NO: 700305 - RNA, 64 nt, hsa; identical to SEQ ID NO: 27045

SEQ ID NO: 700306 - RNA, 64 nt, hsa; identical to SEQ ID NO: 27046

SEQ ID NO: 700307 - RNA, 64 nt, hsa; identical to SEQ ID NO: 27047

SEQ ID NO: 700308 - RNA, 64 nt, hsa; identical to SEQ ID NO: 27048

SEQ ID NO: 700309 - RNA, 64 nt, hsa; identical to SEQ ID NO: 27049

SEQ ID NO: 700310 - RNA, 64 nt, hsa; identical to SEQ ID NO: 27050

SEQ ID NO: 700311 - RNA, 64 nt, hsa; identical to SEQ ID NO: 27051

SEQ ID NO: 700312 - RNA, 64 nt, hsa; identical to SEQ ID NO: 27052

SEQ ID NO: 700313 - RNA, 64 nt, hsa; identical to SEQ ID NO: 27053

SEQ ID NO: 700314 - RNA, 64 nt, hsa; identical to SEQ ID NO: 27054

SEQ ID NO: 700315 - RNA, 64 nt, hsa; identical to SEQ ID NO: 27055

SEQ ID NO: 700316 - RNA, 64 nt, hsa; identical to SEQ ID NO: 27056

SEQ ID NO: 700317 - RNA, 64 nt, hsa; identical to SEQ ID NO: 27057

SEQ ID NO: 700318 - RNA, 64 nt, hsa; identical to SEQ ID NO: 27058

SEQ ID NO: 700319 - RNA, 64 nt, hsa; identical to SEQ ID NO: 27059

SEQ ID NO: 700320 - RNA, 64 nt, hsa; identical to SEQ ID NO: 27060

SEQ ID NO: 700321 - RNA, 64 nt, hsa; identical to SEQ ID NO: 27061

SEQ ID NO: 700322 - RNA, 64 nt, hsa; identical to SEQ ID NO: 27062

SEQ ID NO: 700323 - RNA, 64 nt, hsa; identical to SEQ ID NO: 27063

SEQ ID NO: 700324 - RNA, 64 nt, hsa; identical to SEQ ID NO: 27064

SEQ ID NO: 700325 - RNA, 64 nt, hsa; identical to SEQ ID NO: 27065

SEQ ID NO: 700326 - RNA, 64 nt, hsa; identical to SEQ ID NO: 27066

SEQ ID NO: 700327 - RNA, 64 nt, hsa; identical to SEQ ID NO: 27067

SEQ ID NO: 700328 - RNA, 64 nt, hsa; identical to SEQ ID NO: 27068

SEQ ID NO: 700329 - RNA, 64 nt, hsa; identical to SEQ ID NO: 27069

SEQ ID NO: 700330 - RNA, 64 nt, hsa; identical to SEQ ID NO: 27070

SEQ ID NO: 700331 - RNA, 64 nt, hsa; identical to SEQ ID NO: 27071

SEQ ID NO: 700332 - RNA, 64 nt, hsa; identical to SEQ ID NO: 27072

SEQ ID NO: 700333 - RNA, 64 nt, hsa; identical to SEQ ID NO: 27073

SEQ ID NO: 700334 - RNA, 64 nt, hsa; identical to SEQ ID NO: 27074

SEQ ID NO: 700335 - RNA, 64 nt, hsa; identical to SEQ ID NO: 27075

SEQ ID NO: 700336 - RNA, 64 nt, hsa; identical to SEQ ID NO: 27076

SEQ ID NO: 700337 - RNA, 64 nt, hsa; identical to SEQ ID NO: 27077

SEQ ID NO: 700338 - RNA, 64 nt, hsa; identical to SEQ ID NO: 27078

SEQ ID NO: 700339 - RNA, 64 nt, hsa; identical to SEQ ID NO: 27079

SEQ ID NO: 700340 - RNA, 64 nt, hsa; identical to SEQ ID NO: 27080

SEQ ID NO: 700341 - RNA, 64 nt, hsa; identical to SEQ ID NO: 27081

SEQ ID NO: 700342 - RNA, 64 nt, hsa; identical to SEQ ID NO: 27082

SEQ ID NO: 700343 - RNA, 64 nt, hsa; identical to SEQ ID NO: 27083

SEQ ID NO: 700344 - RNA, 64 nt, hsa; identical to SEQ ID NO: 27084

SEQ ID NO: 700345 - RNA, 64 nt, hsa; identical to SEQ ID NO: 27085

SEQ ID NO: 700346 - RNA, 64 nt, hsa; identical to SEQ ID NO: 27086

SEQ ID NO: 700347 - RNA, 64 nt, hsa; identical to SEQ ID NO: 27087

SEQ ID NO: 700348 - RNA, 64 nt, hsa; identical to SEQ ID NO: 27088

SEQ ID NO: 700349 - RNA, 64 nt, hsa; identical to SEQ ID NO: 27089

SEQ ID NO: 700350 - RNA, 64 nt, hsa; identical to SEQ ID NO: 27090

SEQ ID NO: 700351 - RNA, 64 nt, hsa; identical to SEQ ID NO: 27091

SEQ ID NO: 700352 - RNA, 64 nt, hsa; identical to SEQ ID NO: 27092

SEQ ID NO: 700353 - RNA, 64 nt, hsa; identical to SEQ ID NO: 27093

SEQ ID NO: 700354 - RNA, 64 nt, hsa; identical to SEQ ID NO: 27094

SEQ ID NO: 700355 - RNA, 64 nt, hsa; identical to SEQ ID NO: 27095

SEQ ID NO: 700356 - RNA, 64 nt, hsa; identical to SEQ ID NO: 27096

SEQ ID NO: 700357 - RNA, 64 nt, hsa; identical to SEQ ID NO: 27097

SEQ ID NO: 700358 - RNA, 64 nt, hsa; identical to SEQ ID NO: 27098

SEQ ID NO: 700359 - RNA, 64 nt, hsa; identical to SEQ ID NO: 27099

SEQ ID NO: 700360 - RNA, 64 nt, hsa; identical to SEQ ID NO: 27100

SEQ ID NO: 700361 - RNA, 64 nt, hsa; identical to SEQ ID NO: 27101

SEQ ID NO: 700362 - RNA, 64 nt, hsa; identical to SEQ ID NO: 27102

SEQ ID NO: 700363 - RNA, 64 nt, hsa; identical to SEQ ID NO: 27103

SEQ ID NO: 700364 - RNA, 64 nt, hsa; identical to SEQ ID NO: 27104

SEQ ID NO: 700365 - RNA, 64 nt, hsa; identical to SEQ ID NO: 27105

SEQ ID NO: 700366 - RNA, 64 nt, hsa; identical to SEQ ID NO: 27106

SEQ ID NO: 700367 - RNA, 64 nt, hsa; identical to SEQ ID NO: 27107

SEQ ID NO: 700368 - RNA, 64 nt, hsa; identical to SEQ ID NO: 27108

SEQ ID NO: 700369 - RNA, 64 nt, hsa; identical to SEQ ID NO: 27109

SEQ ID NO: 700370 - RNA, 64 nt, hsa; identical to SEQ ID NO: 27110

SEQ ID NO: 700371 - RNA, 64 nt, hsa; identical to SEQ ID NO: 27111

SEQ ID NO: 700372 - RNA, 64 nt, hsa; identical to SEQ ID NO: 27112

SEQ ID NO: 700373 - RNA, 64 nt, hsa; identical to SEQ ID NO: 27113

SEQ ID NO: 700374 - RNA, 64 nt, hsa; identical to SEQ ID NO: 27114

SEQ ID NO: 700375 - RNA, 64 nt, hsa; identical to SEQ ID NO: 27115

SEQ ID NO: 700376 - RNA, 64 nt, hsa; identical to SEQ ID NO: 27116

SEQ ID NO: 700377 - RNA, 64 nt, hsa; identical to SEQ ID NO: 27117

SEQ ID NO: 700378 - RNA, 64 nt, hsa; identical to SEQ ID NO: 27118

SEQ ID NO: 700379 - RNA, 64 nt, hsa; identical to SEQ ID NO: 27119

SEQ ID NO: 700380 - RNA, 64 nt, hsa; identical to SEQ ID NO: 27120

SEQ ID NO: 700381 - RNA, 64 nt, hsa; identical to SEQ ID NO: 27121

SEQ ID NO: 700382 - RNA, 64 nt, hsa; identical to SEQ ID NO: 27122

SEQ ID NO: 700383 - RNA, 64 nt, hsa; identical to SEQ ID NO: 27123

SEQ ID NO: 700384 - RNA, 64 nt, hsa; identical to SEQ ID NO: 27124

SEQ ID NO: 700385 - RNA, 64 nt, hsa; identical to SEQ ID NO: 27125

SEQ ID NO: 700386 - RNA, 64 nt, hsa; identical to SEQ ID NO: 27126

SEQ ID NO: 700387 - RNA, 64 nt, hsa; identical to SEQ ID NO: 27127

SEQ ID NO: 700388 - RNA, 64 nt, hsa; identical to SEQ ID NO: 27128

SEQ ID NO: 700389 - RNA, 64 nt, hsa; identical to SEQ ID NO: 27129

SEQ ID NO: 700390 - RNA, 64 nt, hsa; identical to SEQ ID NO: 27130

SEQ ID NO: 700391 - RNA, 64 nt, hsa; identical to SEQ ID NO: 27131

SEQ ID NO: 700392 - RNA, 64 nt, hsa; identical to SEQ ID NO: 27132

SEQ ID NO: 700393 - RNA, 64 nt, hsa; identical to SEQ ID NO: 27133

SEQ ID NO: 700394 - RNA, 64 nt, hsa; identical to SEQ ID NO: 27134

SEQ ID NO: 700395 - RNA, 64 nt, hsa; identical to SEQ ID NO: 27135

SEQ ID NO: 700396 - RNA, 64 nt, hsa; identical to SEQ ID NO: 27136

SEQ ID NO: 700397 - RNA, 64 nt, hsa; identical to SEQ ID NO: 27137

SEQ ID NO: 700398 - RNA, 64 nt, hsa; identical to SEQ ID NO: 27138

SEQ ID NO: 700399 - RNA, 64 nt, hsa; identical to SEQ ID NO: 27139

SEQ ID NO: 700400 - RNA, 64 nt, hsa; identical to SEQ ID NO: 27140

SEQ ID NO: 700401 - RNA, 64 nt, hsa; identical to SEQ ID NO: 27141

SEQ ID NO: 700402 - RNA, 64 nt, hsa; identical to SEQ ID NO: 27142

SEQ ID NO: 700403 - RNA, 64 nt, hsa; identical to SEQ ID NO: 27143

SEQ ID NO: 700404 - RNA, 64 nt, hsa; identical to SEQ ID NO: 27144

SEQ ID NO: 700405 - RNA, 64 nt, hsa; identical to SEQ ID NO: 27145

SEQ ID NO: 700406 - RNA, 64 nt, hsa; identical to SEQ ID NO: 27146

SEQ ID NO: 700407 - RNA, 64 nt, hsa; identical to SEQ ID NO: 27147

SEQ ID NO: 700408 - RNA, 64 nt, hsa; identical to SEQ ID NO: 27148

SEQ ID NO: 700409 - RNA, 64 nt, hsa; identical to SEQ ID NO: 27149

SEQ ID NO: 700410 - RNA, 64 nt, hsa; identical to SEQ ID NO: 27150

SEQ ID NO: 700411 - RNA, 64 nt, hsa; identical to SEQ ID NO: 27151

SEQ ID NO: 700412 - RNA, 64 nt, hsa; identical to SEQ ID NO: 27152

SEQ ID NO: 700413 - RNA, 64 nt, hsa; identical to SEQ ID NO: 27153

SEQ ID NO: 700414 - RNA, 64 nt, hsa; identical to SEQ ID NO: 27154

SEQ ID NO: 700415 - RNA, 64 nt, hsa; identical to SEQ ID NO: 27155

SEQ ID NO: 700416 - RNA, 64 nt, hsa; identical to SEQ ID NO: 27156

SEQ ID NO: 700417 - RNA, 64 nt, hsa; identical to SEQ ID NO: 27157

SEQ ID NO: 700418 - RNA, 64 nt, hsa; identical to SEQ ID NO: 27158

SEQ ID NO: 700419 - RNA, 64 nt, hsa; identical to SEQ ID NO: 27159

SEQ ID NO: 700420 - RNA, 64 nt, hsa; identical to SEQ ID NO: 27160

SEQ ID NO: 700421 - RNA, 64 nt, hsa; identical to SEQ ID NO: 27161

SEQ ID NO: 700422 - RNA, 64 nt, hsa; identical to SEQ ID NO: 27162

SEQ ID NO: 700423 - RNA, 64 nt, hsa; identical to SEQ ID NO: 27163

SEQ ID NO: 700424 - RNA, 64 nt, hsa; identical to SEQ ID NO: 27164

SEQ ID NO: 700425 - RNA, 64 nt, hsa; identical to SEQ ID NO: 27165

SEQ ID NO: 700426 - RNA, 64 nt, hsa; identical to SEQ ID NO: 27166

SEQ ID NO: 700427 - RNA, 64 nt, hsa; identical to SEQ ID NO: 27167

SEQ ID NO: 700428 - RNA, 64 nt, hsa; identical to SEQ ID NO: 27168

SEQ ID NO: 700429 - RNA, 64 nt, hsa; identical to SEQ ID NO: 27169

SEQ ID NO: 700430 - RNA, 64 nt, hsa; identical to SEQ ID NO: 27170

SEQ ID NO: 700431 - RNA, 64 nt, hsa; identical to SEQ ID NO: 27171

SEQ ID NO: 700432 - RNA, 64 nt, hsa; identical to SEQ ID NO: 27172

SEQ ID NO: 700433 - RNA, 64 nt, hsa; identical to SEQ ID NO: 27173

SEQ ID NO: 700434 - RNA, 64 nt, hsa; identical to SEQ ID NO: 27174

SEQ ID NO: 700435 - RNA, 64 nt, hsa; identical to SEQ ID NO: 27175

SEQ ID NO: 700436 - RNA, 64 nt, hsa; identical to SEQ ID NO: 27176

SEQ ID NO: 700437 - RNA, 64 nt, hsa; identical to SEQ ID NO: 27177

SEQ ID NO: 700438 - RNA, 64 nt, hsa; identical to SEQ ID NO: 27178

SEQ ID NO: 700439 - RNA, 64 nt, hsa; identical to SEQ ID NO: 27179

SEQ ID NO: 700440 - RNA, 64 nt, hsa; identical to SEQ ID NO: 27180

SEQ ID NO: 700441 - RNA, 64 nt, hsa; identical to SEQ ID NO: 27181

SEQ ID NO: 700442 - RNA, 64 nt, hsa; identical to SEQ ID NO: 27182

SEQ ID NO: 700443 - RNA, 64 nt, hsa; identical to SEQ ID NO: 27183

SEQ ID NO: 700444 - RNA, 64 nt, hsa; identical to SEQ ID NO: 27184

SEQ ID NO: 700445 - RNA, 64 nt, hsa; identical to SEQ ID NO: 27185

SEQ ID NO: 700446 - RNA, 64 nt, hsa; identical to SEQ ID NO: 27186

SEQ ID NO: 700447 - RNA, 64 nt, hsa; identical to SEQ ID NO: 27187

SEQ ID NO: 700448 - RNA, 64 nt, hsa; identical to SEQ ID NO: 27188

SEQ ID NO: 700449 - RNA, 64 nt, hsa; identical to SEQ ID NO: 27189

SEQ ID NO: 700450 - RNA, 64 nt, hsa; identical to SEQ ID NO: 27190

SEQ ID NO: 700451 - RNA, 64 nt, hsa; identical to SEQ ID NO: 27191

SEQ ID NO: 700452 - RNA, 64 nt, hsa; identical to SEQ ID NO: 27192

SEQ ID NO: 700453 - RNA, 64 nt, hsa; identical to SEQ ID NO: 27193

SEQ ID NO: 700454 - RNA, 64 nt, hsa; identical to SEQ ID NO: 27194

SEQ ID NO: 700455 - RNA, 64 nt, hsa; identical to SEQ ID NO: 27195

SEQ ID NO: 700456 - RNA, 64 nt, hsa; identical to SEQ ID NO: 27196

SEQ ID NO: 700457 - RNA, 64 nt, hsa; identical to SEQ ID NO: 27197

SEQ ID NO: 700458 - RNA, 64 nt, hsa; identical to SEQ ID NO: 27198

SEQ ID NO: 700459 - RNA, 64 nt, hsa; identical to SEQ ID NO: 27199

SEQ ID NO: 700460 - RNA, 64 nt, hsa; identical to SEQ ID NO: 27200

SEQ ID NO: 700461 - RNA, 64 nt, hsa; identical to SEQ ID NO: 27201

SEQ ID NO: 700462 - RNA, 64 nt, hsa; identical to SEQ ID NO: 27202

SEQ ID NO: 700463 - RNA, 64 nt, hsa; identical to SEQ ID NO: 27203

SEQ ID NO: 700464 - RNA, 64 nt, hsa; identical to SEQ ID NO: 27204

SEQ ID NO: 700465 - RNA, 64 nt, hsa; identical to SEQ ID NO: 27205

SEQ ID NO: 700466 - RNA, 64 nt, hsa; identical to SEQ ID NO: 27206

SEQ ID NO: 700467 - RNA, 64 nt, hsa; identical to SEQ ID NO: 27207

SEQ ID NO: 700468 - RNA, 64 nt, hsa; identical to SEQ ID NO: 27208

SEQ ID NO: 700469 - RNA, 64 nt, hsa; identical to SEQ ID NO: 27209

SEQ ID NO: 700470 - RNA, 64 nt, hsa; identical to SEQ ID NO: 27210

SEQ ID NO: 700471 - RNA, 64 nt, hsa; identical to SEQ ID NO: 27211

SEQ ID NO: 700472 - RNA, 64 nt, hsa; identical to SEQ ID NO: 27212

SEQ ID NO: 700473 - RNA, 64 nt, hsa; identical to SEQ ID NO: 27213

SEQ ID NO: 700474 - RNA, 64 nt, hsa; identical to SEQ ID NO: 27214

SEQ ID NO: 700475 - RNA, 64 nt, hsa; identical to SEQ ID NO: 27215

SEQ ID NO: 700476 - RNA, 64 nt, hsa; identical to SEQ ID NO: 27216

SEQ ID NO: 700477 - RNA, 64 nt, hsa; identical to SEQ ID NO: 27217

SEQ ID NO: 700478 - RNA, 64 nt, hsa; identical to SEQ ID NO: 27218

SEQ ID NO: 700479 - RNA, 64 nt, hsa; identical to SEQ ID NO: 27219

SEQ ID NO: 700480 - RNA, 64 nt, hsa; identical to SEQ ID NO: 27220

SEQ ID NO: 700481 - RNA, 64 nt, hsa; identical to SEQ ID NO: 27221

SEQ ID NO: 700482 - RNA, 64 nt, hsa; identical to SEQ ID NO: 27222

SEQ ID NO: 700483 - RNA, 64 nt, hsa; identical to SEQ ID NO: 27223

SEQ ID NO: 700484 - RNA, 64 nt, hsa; identical to SEQ ID NO: 27224

SEQ ID NO: 700485 - RNA, 64 nt, hsa; identical to SEQ ID NO: 27225

SEQ ID NO: 700486 - RNA, 64 nt, hsa; identical to SEQ ID NO: 27226

SEQ ID NO: 700487 - RNA, 64 nt, hsa; identical to SEQ ID NO: 27227

SEQ ID NO: 700488 - RNA, 64 nt, hsa; identical to SEQ ID NO: 27228

SEQ ID NO: 700489 - RNA, 64 nt, hsa; identical to SEQ ID NO: 27229

SEQ ID NO: 700490 - RNA, 64 nt, hsa; identical to SEQ ID NO: 27230

SEQ ID NO: 700491 - RNA, 64 nt, hsa; identical to SEQ ID NO: 27231

SEQ ID NO: 700492 - RNA, 64 nt, hsa; identical to SEQ ID NO: 27232

SEQ ID NO: 700493 - RNA, 64 nt, hsa; identical to SEQ ID NO: 27233

SEQ ID NO: 700494 - RNA, 64 nt, hsa; identical to SEQ ID NO: 27234

SEQ ID NO: 700495 - RNA, 64 nt, hsa; identical to SEQ ID NO: 27235

SEQ ID NO: 700496 - RNA, 64 nt, hsa; identical to SEQ ID NO: 27236

SEQ ID NO: 700497 - RNA, 64 nt, hsa; identical to SEQ ID NO: 27237

SEQ ID NO: 700498 - RNA, 64 nt, hsa; identical to SEQ ID NO: 27238

SEQ ID NO: 700499 - RNA, 64 nt, hsa; identical to SEQ ID NO: 27239

SEQ ID NO: 700500 - RNA, 64 nt, hsa; identical to SEQ ID NO: 27240

SEQ ID NO: 700501 - RNA, 64 nt, hsa; identical to SEQ ID NO: 27241

SEQ ID NO: 700502 - RNA, 64 nt, hsa; identical to SEQ ID NO: 27242

SEQ ID NO: 700503 - RNA, 64 nt, hsa; identical to SEQ ID NO: 27243

SEQ ID NO: 700504 - RNA, 64 nt, hsa; identical to SEQ ID NO: 27244

SEQ ID NO: 700505 - RNA, 64 nt, hsa; identical to SEQ ID NO: 27245

SEQ ID NO: 700506 - RNA, 64 nt, hsa; identical to SEQ ID NO: 27246

SEQ ID NO: 700507 - RNA, 64 nt, hsa; identical to SEQ ID NO: 27247

SEQ ID NO: 700508 - RNA, 64 nt, hsa; identical to SEQ ID NO: 27248

SEQ ID NO: 700509 - RNA, 64 nt, hsa; identical to SEQ ID NO: 27249

SEQ ID NO: 700510 - RNA, 64 nt, hsa; identical to SEQ ID NO: 27250

SEQ ID NO: 700511 - RNA, 64 nt, hsa; identical to SEQ ID NO: 27251

SEQ ID NO: 700512 - RNA, 64 nt, hsa; identical to SEQ ID NO: 27252

SEQ ID NO: 700513 - RNA, 64 nt, hsa; identical to SEQ ID NO: 27253

SEQ ID NO: 700514 - RNA, 64 nt, hsa; identical to SEQ ID NO: 27254

SEQ ID NO: 700515 - RNA, 64 nt, hsa; identical to SEQ ID NO: 27255

SEQ ID NO: 700516 - RNA, 64 nt, hsa; identical to SEQ ID NO: 27256

SEQ ID NO: 700517 - RNA, 64 nt, hsa; identical to SEQ ID NO: 27257

SEQ ID NO: 700518 - RNA, 64 nt, hsa; identical to SEQ ID NO: 27258

SEQ ID NO: 700519 - RNA, 64 nt, hsa; identical to SEQ ID NO: 27259

SEQ ID NO: 700520 - RNA, 64 nt, hsa; identical to SEQ ID NO: 27260

SEQ ID NO: 700521 - RNA, 64 nt, hsa; identical to SEQ ID NO: 27261

SEQ ID NO: 700522 - RNA, 64 nt, hsa; identical to SEQ ID NO: 27262

SEQ ID NO: 700523 - RNA, 64 nt, hsa; identical to SEQ ID NO: 27263

SEQ ID NO: 700524 - RNA, 64 nt, hsa; identical to SEQ ID NO: 27264

SEQ ID NO: 700525 - RNA, 64 nt, hsa; identical to SEQ ID NO: 27265

SEQ ID NO: 700526 - RNA, 64 nt, hsa; identical to SEQ ID NO: 27266

SEQ ID NO: 700527 - RNA, 64 nt, hsa; identical to SEQ ID NO: 27267

SEQ ID NO: 700528 - RNA, 64 nt, hsa; identical to SEQ ID NO: 27268

SEQ ID NO: 700529 - RNA, 64 nt, hsa; identical to SEQ ID NO: 27269

SEQ ID NO: 700530 - RNA, 64 nt, hsa; identical to SEQ ID NO: 27270

SEQ ID NO: 700531 - RNA, 64 nt, hsa; identical to SEQ ID NO: 27271

SEQ ID NO: 700532 - RNA, 64 nt, hsa; identical to SEQ ID NO: 27272

SEQ ID NO: 700533 - RNA, 64 nt, hsa; identical to SEQ ID NO: 27273

SEQ ID NO: 700534 - RNA, 64 nt, hsa; identical to SEQ ID NO: 27274

SEQ ID NO: 700535 - RNA, 64 nt, hsa; identical to SEQ ID NO: 27275

SEQ ID NO: 700536 - RNA, 64 nt, hsa; identical to SEQ ID NO: 27276

SEQ ID NO: 700537 - RNA, 64 nt, hsa; identical to SEQ ID NO: 27277

SEQ ID NO: 700538 - RNA, 64 nt, hsa; identical to SEQ ID NO: 27278

SEQ ID NO: 700539 - RNA, 64 nt, hsa; identical to SEQ ID NO: 27279

SEQ ID NO: 700540 - RNA, 64 nt, hsa; identical to SEQ ID NO: 27280

SEQ ID NO: 700541 - RNA, 64 nt, hsa; identical to SEQ ID NO: 27281

SEQ ID NO: 700542 - RNA, 64 nt, hsa; identical to SEQ ID NO: 27282

SEQ ID NO: 700543 - RNA, 64 nt, hsa; identical to SEQ ID NO: 27283

SEQ ID NO: 700544 - RNA, 64 nt, hsa; identical to SEQ ID NO: 27284

SEQ ID NO: 700545 - RNA, 64 nt, hsa; identical to SEQ ID NO: 27285

SEQ ID NO: 700546 - RNA, 64 nt, hsa; identical to SEQ ID NO: 27286

SEQ ID NO: 700547 - RNA, 64 nt, hsa; identical to SEQ ID NO: 27287

SEQ ID NO: 700548 - RNA, 64 nt, hsa; identical to SEQ ID NO: 27288

SEQ ID NO: 700549 - RNA, 64 nt, hsa; identical to SEQ ID NO: 27289

SEQ ID NO: 700550 - RNA, 64 nt, hsa; identical to SEQ ID NO: 27290

SEQ ID NO: 700551 - RNA, 64 nt, hsa; identical to SEQ ID NO: 27291

SEQ ID NO: 700552 - RNA, 64 nt, hsa; identical to SEQ ID NO: 27292

SEQ ID NO: 700553 - RNA, 64 nt, hsa; identical to SEQ ID NO: 27293

SEQ ID NO: 700554 - RNA, 64 nt, hsa; identical to SEQ ID NO: 27294

SEQ ID NO: 700555 - RNA, 64 nt, hsa; identical to SEQ ID NO: 27295

SEQ ID NO: 700556 - RNA, 64 nt, hsa; identical to SEQ ID NO: 27296

SEQ ID NO: 700557 - RNA, 64 nt, hsa; identical to SEQ ID NO: 27297

SEQ ID NO: 700558 - RNA, 64 nt, hsa; identical to SEQ ID NO: 27298

SEQ ID NO: 700559 - RNA, 64 nt, hsa; identical to SEQ ID NO: 27299

SEQ ID NO: 700560 - RNA, 64 nt, hsa; identical to SEQ ID NO: 27300

SEQ ID NO: 700561 - RNA, 64 nt, hsa; identical to SEQ ID NO: 27301

SEQ ID NO: 700562 - RNA, 64 nt, hsa; identical to SEQ ID NO: 27302

SEQ ID NO: 700563 - RNA, 64 nt, hsa; identical to SEQ ID NO: 27303

SEQ ID NO: 700564 - RNA, 64 nt, hsa; identical to SEQ ID NO: 27304

SEQ ID NO: 700565 - RNA, 64 nt, hsa; identical to SEQ ID NO: 27305

SEQ ID NO: 700566 - RNA, 64 nt, hsa; identical to SEQ ID NO: 27306

SEQ ID NO: 700567 - RNA, 64 nt, hsa; identical to SEQ ID NO: 27307

SEQ ID NO: 700568 - RNA, 64 nt, hsa; identical to SEQ ID NO: 27308

SEQ ID NO: 700569 - RNA, 64 nt, hsa; identical to SEQ ID NO: 27309

SEQ ID NO: 700570 - RNA, 64 nt, hsa; identical to SEQ ID NO: 27310

SEQ ID NO: 700571 - RNA, 64 nt, hsa; identical to SEQ ID NO: 27311

SEQ ID NO: 700572 - RNA, 64 nt, hsa; identical to SEQ ID NO: 27312

SEQ ID NO: 700573 - RNA, 63 nt, hsa; identical to SEQ ID NO: 27313

SEQ ID NO: 700574 - RNA, 64 nt, hsa; identical to SEQ ID NO: 27314

SEQ ID NO: 700575 - RNA, 64 nt, hsa; identical to SEQ ID NO: 27315

SEQ ID NO: 700576 - RNA, 64 nt, hsa; identical to SEQ ID NO: 27316

SEQ ID NO: 700577 - RNA, 64 nt, hsa; identical to SEQ ID NO: 27317

SEQ ID NO: 700578 - RNA, 64 nt, hsa; identical to SEQ ID NO: 27318

SEQ ID NO: 700579 - RNA, 64 nt, hsa; identical to SEQ ID NO: 27319

SEQ ID NO: 700580 - RNA, 64 nt, hsa; identical to SEQ ID NO: 27320

SEQ ID NO: 700581 - RNA, 64 nt, hsa; identical to SEQ ID NO: 27321

SEQ ID NO: 700582 - RNA, 64 nt, hsa; identical to SEQ ID NO: 27322

SEQ ID NO: 700583 - RNA, 64 nt, hsa; identical to SEQ ID NO: 27323

SEQ ID NO: 700584 - RNA, 64 nt, hsa; identical to SEQ ID NO: 27324

SEQ ID NO: 700585 - RNA, 64 nt, hsa; identical to SEQ ID NO: 27325

SEQ ID NO: 700586 - RNA, 64 nt, hsa; identical to SEQ ID NO: 27326

SEQ ID NO: 700587 - RNA, 64 nt, hsa; identical to SEQ ID NO: 27327

SEQ ID NO: 700588 - RNA, 64 nt, hsa; identical to SEQ ID NO: 27328

SEQ ID NO: 700589 - RNA, 64 nt, hsa; identical to SEQ ID NO: 27329

SEQ ID NO: 700590 - RNA, 64 nt, hsa; identical to SEQ ID NO: 27330

SEQ ID NO: 700591 - RNA, 64 nt, hsa; identical to SEQ ID NO: 27331

SEQ ID NO: 700592 - RNA, 64 nt, hsa; identical to SEQ ID NO: 27332

SEQ ID NO: 700593 - RNA, 64 nt, hsa; identical to SEQ ID NO: 27333

SEQ ID NO: 700594 - RNA, 64 nt, hsa; identical to SEQ ID NO: 27334

SEQ ID NO: 700595 - RNA, 64 nt, hsa; identical to SEQ ID NO: 27335

SEQ ID NO: 700596 - RNA, 64 nt, hsa; identical to SEQ ID NO: 27336

SEQ ID NO: 700597 - RNA, 64 nt, hsa; identical to SEQ ID NO: 27337

SEQ ID NO: 700598 - RNA, 64 nt, hsa; identical to SEQ ID NO: 27338

SEQ ID NO: 700599 - RNA, 64 nt, hsa; identical to SEQ ID NO: 27339

SEQ ID NO: 700600 - RNA, 64 nt, hsa; identical to SEQ ID NO: 27340

SEQ ID NO: 700601 - RNA, 64 nt, hsa; identical to SEQ ID NO: 27341

SEQ ID NO: 700602 - RNA, 64 nt, hsa; identical to SEQ ID NO: 27342

SEQ ID NO: 700603 - RNA, 64 nt, hsa; identical to SEQ ID NO: 27343

SEQ ID NO: 700604 - RNA, 64 nt, hsa; identical to SEQ ID NO: 27344

SEQ ID NO: 700605 - RNA, 64 nt, hsa; identical to SEQ ID NO: 27345

SEQ ID NO: 700606 - RNA, 64 nt, hsa; identical to SEQ ID NO: 27346

SEQ ID NO: 700607 - RNA, 64 nt, hsa; identical to SEQ ID NO: 27347

SEQ ID NO: 700608 - RNA, 64 nt, hsa; identical to SEQ ID NO: 27348

SEQ ID NO: 700609 - RNA, 64 nt, hsa; identical to SEQ ID NO: 27349

SEQ ID NO: 700610 - RNA, 64 nt, hsa; identical to SEQ ID NO: 27350

SEQ ID NO: 700611 - RNA, 64 nt, hsa; identical to SEQ ID NO: 27351

SEQ ID NO: 700612 - RNA, 64 nt, hsa; identical to SEQ ID NO: 27352

SEQ ID NO: 700613 - RNA, 64 nt, hsa; identical to SEQ ID NO: 27353

SEQ ID NO: 700614 - RNA, 64 nt, hsa; identical to SEQ ID NO: 27354

SEQ ID NO: 700615 - RNA, 64 nt, hsa; identical to SEQ ID NO: 27355

SEQ ID NO: 700616 - RNA, 64 nt, hsa; identical to SEQ ID NO: 27356

SEQ ID NO: 700617 - RNA, 64 nt, hsa; identical to SEQ ID NO: 27357

SEQ ID NO: 700618 - RNA, 64 nt, hsa; identical to SEQ ID NO: 27358

SEQ ID NO: 700619 - RNA, 64 nt, hsa; identical to SEQ ID NO: 27359

SEQ ID NO: 700620 - RNA, 64 nt, hsa; identical to SEQ ID NO: 27360

SEQ ID NO: 700621 - RNA, 64 nt, hsa; identical to SEQ ID NO: 27361

SEQ ID NO: 700622 - RNA, 64 nt, hsa; identical to SEQ ID NO: 27362

SEQ ID NO: 700623 - RNA, 64 nt, hsa; identical to SEQ ID NO: 27363

SEQ ID NO: 700624 - RNA, 64 nt, hsa; identical to SEQ ID NO: 27364

SEQ ID NO: 700625 - RNA, 64 nt, hsa; identical to SEQ ID NO: 27365

SEQ ID NO: 700626 - RNA, 64 nt, hsa; identical to SEQ ID NO: 27366

SEQ ID NO: 700627 - RNA, 64 nt, hsa; identical to SEQ ID NO: 27367

SEQ ID NO: 700628 - RNA, 64 nt, hsa; identical to SEQ ID NO: 27368

SEQ ID NO: 700629 - RNA, 64 nt, hsa; identical to SEQ ID NO: 27369

SEQ ID NO: 700630 - RNA, 64 nt, hsa; identical to SEQ ID NO: 27370

SEQ ID NO: 700631 - RNA, 64 nt, hsa; identical to SEQ ID NO: 27371

SEQ ID NO: 700632 - RNA, 64 nt, hsa; identical to SEQ ID NO: 27372

SEQ ID NO: 700633 - RNA, 64 nt, hsa; identical to SEQ ID NO: 27373

SEQ ID NO: 700634 - RNA, 64 nt, hsa; identical to SEQ ID NO: 27374

SEQ ID NO: 700635 - RNA, 64 nt, hsa; identical to SEQ ID NO: 27375

SEQ ID NO: 700636 - RNA, 64 nt, hsa; identical to SEQ ID NO: 27376

SEQ ID NO: 700637 - RNA, 64 nt, hsa; identical to SEQ ID NO: 27377

SEQ ID NO: 700638 - RNA, 64 nt, hsa; identical to SEQ ID NO: 27378

SEQ ID NO: 700639 - RNA, 64 nt, hsa; identical to SEQ ID NO: 27379

SEQ ID NO: 700640 - RNA, 64 nt, hsa; identical to SEQ ID NO: 27380

SEQ ID NO: 700641 - RNA, 64 nt, hsa; identical to SEQ ID NO: 27381

SEQ ID NO: 700642 - RNA, 64 nt, hsa; identical to SEQ ID NO: 27382

SEQ ID NO: 700643 - RNA, 64 nt, hsa; identical to SEQ ID NO: 27383

SEQ ID NO: 700644 - RNA, 64 nt, hsa; identical to SEQ ID NO: 27384

SEQ ID NO: 700645 - RNA, 64 nt, hsa; identical to SEQ ID NO: 27385

SEQ ID NO: 700646 - RNA, 64 nt, hsa; identical to SEQ ID NO: 27386

SEQ ID NO: 700647 - RNA, 64 nt, hsa; identical to SEQ ID NO: 27387

SEQ ID NO: 700648 - RNA, 64 nt, hsa; identical to SEQ ID NO: 27388

SEQ ID NO: 700649 - RNA, 64 nt, hsa; identical to SEQ ID NO: 27389

SEQ ID NO: 700650 - RNA, 64 nt, hsa; identical to SEQ ID NO: 27390

SEQ ID NO: 700651 - RNA, 64 nt, hsa; identical to SEQ ID NO: 27391

SEQ ID NO: 700652 - RNA, 64 nt, hsa; identical to SEQ ID NO: 27392

SEQ ID NO: 700653 - RNA, 64 nt, hsa; identical to SEQ ID NO: 27393

SEQ ID NO: 700654 - RNA, 64 nt, hsa; identical to SEQ ID NO: 27394

SEQ ID NO: 700655 - RNA, 64 nt, hsa; identical to SEQ ID NO: 27395

SEQ ID NO: 700656 - RNA, 64 nt, hsa; identical to SEQ ID NO: 27396

SEQ ID NO: 700657 - RNA, 64 nt, hsa; identical to SEQ ID NO: 27397

SEQ ID NO: 700658 - RNA, 64 nt, hsa; identical to SEQ ID NO: 27398

SEQ ID NO: 700659 - RNA, 64 nt, hsa; identical to SEQ ID NO: 27399

SEQ ID NO: 700660 - RNA, 64 nt, hsa; identical to SEQ ID NO: 27400

SEQ ID NO: 700661 - RNA, 64 nt, hsa; identical to SEQ ID NO: 27401

SEQ ID NO: 700662 - RNA, 64 nt, hsa; identical to SEQ ID NO: 27402

SEQ ID NO: 700663 - RNA, 64 nt, hsa; identical to SEQ ID NO: 27403

SEQ ID NO: 700664 - RNA, 64 nt, hsa; identical to SEQ ID NO: 27404

SEQ ID NO: 700665 - RNA, 64 nt, hsa; identical to SEQ ID NO: 27405

SEQ ID NO: 700666 - RNA, 64 nt, hsa; identical to SEQ ID NO: 27406

SEQ ID NO: 700667 - RNA, 64 nt, hsa; identical to SEQ ID NO: 27407

SEQ ID NO: 700668 - RNA, 64 nt, hsa; identical to SEQ ID NO: 27408

SEQ ID NO: 700669 - RNA, 64 nt, hsa; identical to SEQ ID NO: 27409

SEQ ID NO: 700670 - RNA, 64 nt, hsa; identical to SEQ ID NO: 27410

SEQ ID NO: 700671 - RNA, 64 nt, hsa; identical to SEQ ID NO: 27411

SEQ ID NO: 700672 - RNA, 64 nt, hsa; identical to SEQ ID NO: 27412

SEQ ID NO: 700673 - RNA, 64 nt, hsa; identical to SEQ ID NO: 27413

SEQ ID NO: 700674 - RNA, 64 nt, hsa; identical to SEQ ID NO: 27414

SEQ ID NO: 700675 - RNA, 64 nt, hsa; identical to SEQ ID NO: 27415

SEQ ID NO: 700676 - RNA, 64 nt, hsa; identical to SEQ ID NO: 27416

SEQ ID NO: 700677 - RNA, 64 nt, hsa; identical to SEQ ID NO: 27417

SEQ ID NO: 700678 - RNA, 64 nt, hsa; identical to SEQ ID NO: 27418

SEQ ID NO: 700679 - RNA, 64 nt, hsa; identical to SEQ ID NO: 27419

SEQ ID NO: 700680 - RNA, 64 nt, hsa; identical to SEQ ID NO: 27420

SEQ ID NO: 700681 - RNA, 64 nt, hsa; identical to SEQ ID NO: 27421

SEQ ID NO: 700682 - RNA, 64 nt, hsa; identical to SEQ ID NO: 27422

SEQ ID NO: 700683 - RNA, 64 nt, hsa; identical to SEQ ID NO: 27423

SEQ ID NO: 700684 - RNA, 64 nt, hsa; identical to SEQ ID NO: 27424

SEQ ID NO: 700685 - RNA, 64 nt, hsa; identical to SEQ ID NO: 27425

SEQ ID NO: 700686 - RNA, 64 nt, hsa; identical to SEQ ID NO: 27426

SEQ ID NO: 700687 - RNA, 64 nt, hsa; identical to SEQ ID NO: 27427

SEQ ID NO: 700688 - RNA, 64 nt, hsa; identical to SEQ ID NO: 27428

SEQ ID NO: 700689 - RNA, 64 nt, hsa; identical to SEQ ID NO: 27429

SEQ ID NO: 700690 - RNA, 64 nt, hsa; identical to SEQ ID NO: 27430

SEQ ID NO: 700691 - RNA, 64 nt, hsa; identical to SEQ ID NO: 27431

SEQ ID NO: 700692 - RNA, 64 nt, hsa; identical to SEQ ID NO: 27432

SEQ ID NO: 700693 - RNA, 64 nt, hsa; identical to SEQ ID NO: 27433

SEQ ID NO: 700694 - RNA, 64 nt, hsa; identical to SEQ ID NO: 27434

SEQ ID NO: 700695 - RNA, 64 nt, hsa; identical to SEQ ID NO: 27435

SEQ ID NO: 700696 - RNA, 64 nt, hsa; identical to SEQ ID NO: 27436

SEQ ID NO: 700697 - RNA, 64 nt, hsa; identical to SEQ ID NO: 27437

SEQ ID NO: 700698 - RNA, 64 nt, hsa; identical to SEQ ID NO: 27438

SEQ ID NO: 700699 - RNA, 64 nt, hsa; identical to SEQ ID NO: 27439

SEQ ID NO: 700700 - RNA, 64 nt, hsa; identical to SEQ ID NO: 27440

SEQ ID NO: 700701 - RNA, 64 nt, hsa; identical to SEQ ID NO: 27441

SEQ ID NO: 700702 - RNA, 64 nt, hsa; identical to SEQ ID NO: 27442

SEQ ID NO: 700703 - RNA, 64 nt, hsa; identical to SEQ ID NO: 27443

SEQ ID NO: 700704 - RNA, 64 nt, hsa; identical to SEQ ID NO: 27444

SEQ ID NO: 700705 - RNA, 64 nt, hsa; identical to SEQ ID NO: 27445

SEQ ID NO: 700706 - RNA, 64 nt, hsa; identical to SEQ ID NO: 27446

SEQ ID NO: 700707 - RNA, 64 nt, hsa; identical to SEQ ID NO: 27447

SEQ ID NO: 700708 - RNA, 64 nt, hsa; identical to SEQ ID NO: 27448

SEQ ID NO: 700709 - RNA, 64 nt, hsa; identical to SEQ ID NO: 27449

SEQ ID NO: 700710 - RNA, 64 nt, hsa; identical to SEQ ID NO: 27450

SEQ ID NO: 700711 - RNA, 64 nt, hsa; identical to SEQ ID NO: 27451

SEQ ID NO: 700712 - RNA, 64 nt, hsa; identical to SEQ ID NO: 27452

SEQ ID NO: 700713 - RNA, 64 nt, hsa; identical to SEQ ID NO: 27453

SEQ ID NO: 700714 - RNA, 64 nt, hsa; identical to SEQ ID NO: 27454

SEQ ID NO: 700715 - RNA, 64 nt, hsa; identical to SEQ ID NO: 27455

SEQ ID NO: 700716 - RNA, 64 nt, hsa; identical to SEQ ID NO: 27456

SEQ ID NO: 700717 - RNA, 64 nt, hsa; identical to SEQ ID NO: 27457

SEQ ID NO: 700718 - RNA, 64 nt, hsa; identical to SEQ ID NO: 27458

SEQ ID NO: 700719 - RNA, 64 nt, hsa; identical to SEQ ID NO: 27459

SEQ ID NO: 700720 - RNA, 64 nt, hsa; identical to SEQ ID NO: 27460

SEQ ID NO: 700721 - RNA, 64 nt, hsa; identical to SEQ ID NO: 27461

SEQ ID NO: 700722 - RNA, 64 nt, hsa; identical to SEQ ID NO: 27462

SEQ ID NO: 700723 - RNA, 64 nt, hsa; identical to SEQ ID NO: 27463

SEQ ID NO: 700724 - RNA, 64 nt, hsa; identical to SEQ ID NO: 27464

SEQ ID NO: 700725 - RNA, 64 nt, hsa; identical to SEQ ID NO: 27465

SEQ ID NO: 700726 - RNA, 64 nt, hsa; identical to SEQ ID NO: 27466

SEQ ID NO: 700727 - RNA, 64 nt, hsa; identical to SEQ ID NO: 27467

SEQ ID NO: 700728 - RNA, 64 nt, hsa; identical to SEQ ID NO: 27468

SEQ ID NO: 700729 - RNA, 64 nt, hsa; identical to SEQ ID NO: 27469

SEQ ID NO: 700730 - RNA, 64 nt, hsa; identical to SEQ ID NO: 27470

SEQ ID NO: 700731 - RNA, 64 nt, hsa; identical to SEQ ID NO: 27471

SEQ ID NO: 700732 - RNA, 64 nt, hsa; identical to SEQ ID NO: 27472

SEQ ID NO: 700733 - RNA, 64 nt, hsa; identical to SEQ ID NO: 27473

SEQ ID NO: 700734 - RNA, 64 nt, hsa; identical to SEQ ID NO: 27474

SEQ ID NO: 700735 - RNA, 64 nt, hsa; identical to SEQ ID NO: 27475

SEQ ID NO: 700736 - RNA, 64 nt, hsa; identical to SEQ ID NO: 27476

SEQ ID NO: 700737 - RNA, 64 nt, hsa; identical to SEQ ID NO: 27477

SEQ ID NO: 700738 - RNA, 64 nt, hsa; identical to SEQ ID NO: 27478

SEQ ID NO: 700739 - RNA, 64 nt, hsa; identical to SEQ ID NO: 27479

SEQ ID NO: 700740 - RNA, 64 nt, hsa; identical to SEQ ID NO: 27480

SEQ ID NO: 700741 - RNA, 64 nt, hsa; identical to SEQ ID NO: 27481

SEQ ID NO: 700742 - RNA, 64 nt, hsa; identical to SEQ ID NO: 27482

SEQ ID NO: 700743 - RNA, 64 nt, hsa; identical to SEQ ID NO: 27483

SEQ ID NO: 700744 - RNA, 64 nt, hsa; identical to SEQ ID NO: 27484

SEQ ID NO: 700745 - RNA, 64 nt, hsa; identical to SEQ ID NO: 27485

SEQ ID NO: 700746 - RNA, 64 nt, hsa; identical to SEQ ID NO: 27486

SEQ ID NO: 700747 - RNA, 64 nt, hsa; identical to SEQ ID NO: 27487

SEQ ID NO: 700748 - RNA, 64 nt, hsa; identical to SEQ ID NO: 27488

SEQ ID NO: 700749 - RNA, 64 nt, hsa; identical to SEQ ID NO: 27489

SEQ ID NO: 700750 - RNA, 64 nt, hsa; identical to SEQ ID NO: 27490

SEQ ID NO: 700751 - RNA, 64 nt, hsa; identical to SEQ ID NO: 27491

SEQ ID NO: 700752 - RNA, 64 nt, hsa; identical to SEQ ID NO: 27492

SEQ ID NO: 700753 - RNA, 64 nt, hsa; identical to SEQ ID NO: 27493

SEQ ID NO: 700754 - RNA, 64 nt, hsa; identical to SEQ ID NO: 27494

SEQ ID NO: 700755 - RNA, 64 nt, hsa; identical to SEQ ID NO: 27495

SEQ ID NO: 700756 - RNA, 64 nt, hsa; identical to SEQ ID NO: 27496

SEQ ID NO: 700757 - RNA, 64 nt, hsa; identical to SEQ ID NO: 27497

SEQ ID NO: 700758 - RNA, 64 nt, hsa; identical to SEQ ID NO: 27498

SEQ ID NO: 700759 - RNA, 64 nt, hsa; identical to SEQ ID NO: 27499

SEQ ID NO: 700760 - RNA, 64 nt, hsa; identical to SEQ ID NO: 27500

SEQ ID NO: 700761 - RNA, 64 nt, hsa; identical to SEQ ID NO: 27501

SEQ ID NO: 700762 - RNA, 64 nt, hsa; identical to SEQ ID NO: 27502

SEQ ID NO: 700763 - RNA, 64 nt, hsa; identical to SEQ ID NO: 27503

SEQ ID NO: 700764 - RNA, 64 nt, hsa; identical to SEQ ID NO: 27504

SEQ ID NO: 700765 - RNA, 64 nt, hsa; identical to SEQ ID NO: 27505

SEQ ID NO: 700766 - RNA, 64 nt, hsa; identical to SEQ ID NO: 27506

SEQ ID NO: 700767 - RNA, 64 nt, hsa; identical to SEQ ID NO: 27507

SEQ ID NO: 700768 - RNA, 64 nt, hsa; identical to SEQ ID NO: 27508

SEQ ID NO: 700769 - RNA, 64 nt, hsa; identical to SEQ ID NO: 27509

SEQ ID NO: 700770 - RNA, 64 nt, hsa; identical to SEQ ID NO: 27510

SEQ ID NO: 700771 - RNA, 64 nt, hsa; identical to SEQ ID NO: 27511

SEQ ID NO: 700772 - RNA, 64 nt, hsa; identical to SEQ ID NO: 27512

SEQ ID NO: 700773 - RNA, 64 nt, hsa; identical to SEQ ID NO: 27513

SEQ ID NO: 700774 - RNA, 64 nt, hsa; identical to SEQ ID NO: 27514

SEQ ID NO: 700775 - RNA, 64 nt, hsa; identical to SEQ ID NO: 27515

SEQ ID NO: 700776 - RNA, 64 nt, hsa; identical to SEQ ID NO: 27516

SEQ ID NO: 700777 - RNA, 64 nt, hsa; identical to SEQ ID NO: 27517

SEQ ID NO: 700778 - RNA, 64 nt, hsa; identical to SEQ ID NO: 27518

SEQ ID NO: 700779 - RNA, 64 nt, hsa; identical to SEQ ID NO: 27519

SEQ ID NO: 700780 - RNA, 64 nt, hsa; identical to SEQ ID NO: 27520

SEQ ID NO: 700781 - RNA, 64 nt, hsa; identical to SEQ ID NO: 27521

SEQ ID NO: 700782 - RNA, 64 nt, hsa; identical to SEQ ID NO: 27522

SEQ ID NO: 700783 - RNA, 64 nt, hsa; identical to SEQ ID NO: 27523

SEQ ID NO: 700784 - RNA, 64 nt, hsa; identical to SEQ ID NO: 27524

SEQ ID NO: 700785 - RNA, 64 nt, hsa; identical to SEQ ID NO: 27525

SEQ ID NO: 700786 - RNA, 64 nt, hsa; identical to SEQ ID NO: 27526

SEQ ID NO: 700787 - RNA, 64 nt, hsa; identical to SEQ ID NO: 27527

SEQ ID NO: 700788 - RNA, 64 nt, hsa; identical to SEQ ID NO: 27528

SEQ ID NO: 700789 - RNA, 64 nt, hsa; identical to SEQ ID NO: 27529

SEQ ID NO: 700790 - RNA, 64 nt, hsa; identical to SEQ ID NO: 27530

SEQ ID NO: 700791 - RNA, 64 nt, hsa; identical to SEQ ID NO: 27531

SEQ ID NO: 700792 - RNA, 64 nt, hsa; identical to SEQ ID NO: 27532

SEQ ID NO: 700793 - RNA, 64 nt, hsa; identical to SEQ ID NO: 27533

SEQ ID NO: 700794 - RNA, 64 nt, hsa; identical to SEQ ID NO: 27534

SEQ ID NO: 700795 - RNA, 64 nt, hsa; identical to SEQ ID NO: 27535

SEQ ID NO: 700796 - RNA, 64 nt, hsa; identical to SEQ ID NO: 27536

SEQ ID NO: 700797 - RNA, 64 nt, hsa; identical to SEQ ID NO: 27537

SEQ ID NO: 700798 - RNA, 64 nt, hsa; identical to SEQ ID NO: 27538

SEQ ID NO: 700799 - RNA, 64 nt, hsa; identical to SEQ ID NO: 27539

SEQ ID NO: 700800 - RNA, 64 nt, hsa; identical to SEQ ID NO: 27540

SEQ ID NO: 700801 - RNA, 64 nt, hsa; identical to SEQ ID NO: 27541

SEQ ID NO: 700802 - RNA, 64 nt, hsa; identical to SEQ ID NO: 27542

SEQ ID NO: 700803 - RNA, 64 nt, hsa; identical to SEQ ID NO: 27543

SEQ ID NO: 700804 - RNA, 64 nt, hsa; identical to SEQ ID NO: 27544

SEQ ID NO: 700805 - RNA, 64 nt, hsa; identical to SEQ ID NO: 27545

SEQ ID NO: 700806 - RNA, 64 nt, hsa; identical to SEQ ID NO: 27546

SEQ ID NO: 700807 - RNA, 64 nt, hsa; identical to SEQ ID NO: 27547

SEQ ID NO: 700808 - RNA, 64 nt, hsa; identical to SEQ ID NO: 27548

SEQ ID NO: 700809 - RNA, 64 nt, hsa; identical to SEQ ID NO: 27549

SEQ ID NO: 700810 - RNA, 64 nt, hsa; identical to SEQ ID NO: 27550

SEQ ID NO: 700811 - RNA, 64 nt, hsa; identical to SEQ ID NO: 27551

SEQ ID NO: 700812 - RNA, 64 nt, hsa; identical to SEQ ID NO: 27552

SEQ ID NO: 700813 - RNA, 64 nt, hsa; identical to SEQ ID NO: 27553

SEQ ID NO: 700814 - RNA, 64 nt, hsa; identical to SEQ ID NO: 27554

SEQ ID NO: 700815 - RNA, 64 nt, hsa; identical to SEQ ID NO: 27555

SEQ ID NO: 700816 - RNA, 64 nt, hsa; identical to SEQ ID NO: 27556

SEQ ID NO: 700817 - RNA, 64 nt, hsa; identical to SEQ ID NO: 27557

SEQ ID NO: 700818 - RNA, 64 nt, hsa; identical to SEQ ID NO: 27558

SEQ ID NO: 700819 - RNA, 64 nt, hsa; identical to SEQ ID NO: 27559

SEQ ID NO: 700820 - RNA, 64 nt, hsa; identical to SEQ ID NO: 27560

SEQ ID NO: 700821 - RNA, 64 nt, hsa; identical to SEQ ID NO: 27561

SEQ ID NO: 700822 - RNA, 64 nt, hsa; identical to SEQ ID NO: 27562

SEQ ID NO: 700823 - RNA, 64 nt, hsa; identical to SEQ ID NO: 27563

SEQ ID NO: 700824 - RNA, 64 nt, hsa; identical to SEQ ID NO: 27564

SEQ ID NO: 700825 - RNA, 64 nt, hsa; identical to SEQ ID NO: 27565

SEQ ID NO: 700826 - RNA, 64 nt, hsa; identical to SEQ ID NO: 27566

SEQ ID NO: 700827 - RNA, 64 nt, hsa; identical to SEQ ID NO: 27567

SEQ ID NO: 700828 - RNA, 64 nt, hsa; identical to SEQ ID NO: 27568

SEQ ID NO: 700829 - RNA, 64 nt, hsa; identical to SEQ ID NO: 27569

SEQ ID NO: 700830 - RNA, 64 nt, hsa; identical to SEQ ID NO: 27570

SEQ ID NO: 700831 - RNA, 64 nt, hsa; identical to SEQ ID NO: 27571

SEQ ID NO: 700832 - RNA, 64 nt, hsa; identical to SEQ ID NO: 27572

SEQ ID NO: 700833 - RNA, 64 nt, hsa; identical to SEQ ID NO: 27573

SEQ ID NO: 700834 - RNA, 64 nt, hsa; identical to SEQ ID NO: 27574

SEQ ID NO: 700835 - RNA, 64 nt, hsa; identical to SEQ ID NO: 27575

SEQ ID NO: 700836 - RNA, 64 nt, hsa; identical to SEQ ID NO: 27576

SEQ ID NO: 700837 - RNA, 64 nt, hsa; identical to SEQ ID NO: 27577

SEQ ID NO: 700838 - RNA, 64 nt, hsa; identical to SEQ ID NO: 27578

SEQ ID NO: 700839 - RNA, 64 nt, hsa; identical to SEQ ID NO: 27579

SEQ ID NO: 700840 - RNA, 64 nt, hsa; identical to SEQ ID NO: 27580

SEQ ID NO: 700841 - RNA, 64 nt, hsa; identical to SEQ ID NO: 27581

SEQ ID NO: 700842 - RNA, 64 nt, hsa; identical to SEQ ID NO: 27582

SEQ ID NO: 700843 - RNA, 64 nt, hsa; identical to SEQ ID NO: 27583

SEQ ID NO: 700844 - RNA, 64 nt, hsa; identical to SEQ ID NO: 27584

SEQ ID NO: 700845 - RNA, 64 nt, hsa; identical to SEQ ID NO: 27585

SEQ ID NO: 700846 - RNA, 64 nt, hsa; identical to SEQ ID NO: 27586

SEQ ID NO: 700847 - RNA, 64 nt, hsa; identical to SEQ ID NO: 27587

SEQ ID NO: 700848 - RNA, 64 nt, hsa; identical to SEQ ID NO: 27588

SEQ ID NO: 700849 - RNA, 64 nt, hsa; identical to SEQ ID NO: 27589

SEQ ID NO: 700850 - RNA, 64 nt, hsa; identical to SEQ ID NO: 27590

SEQ ID NO: 700851 - RNA, 64 nt, hsa; identical to SEQ ID NO: 27591

SEQ ID NO: 700852 - RNA, 64 nt, hsa; identical to SEQ ID NO: 27592

SEQ ID NO: 700853 - RNA, 64 nt, hsa; identical to SEQ ID NO: 27593

SEQ ID NO: 700854 - RNA, 64 nt, hsa; identical to SEQ ID NO: 27594

SEQ ID NO: 700855 - RNA, 64 nt, hsa; identical to SEQ ID NO: 27595

SEQ ID NO: 700856 - RNA, 64 nt, hsa; identical to SEQ ID NO: 27596

SEQ ID NO: 700857 - RNA, 64 nt, hsa; identical to SEQ ID NO: 27597

SEQ ID NO: 700858 - RNA, 64 nt, hsa; identical to SEQ ID NO: 27598

SEQ ID NO: 700859 - RNA, 64 nt, hsa; identical to SEQ ID NO: 27599

SEQ ID NO: 700860 - RNA, 64 nt, hsa; identical to SEQ ID NO: 27600

SEQ ID NO: 700861 - RNA, 64 nt, hsa; identical to SEQ ID NO: 27601

SEQ ID NO: 700862 - RNA, 64 nt, hsa; identical to SEQ ID NO: 27602

SEQ ID NO: 700863 - RNA, 64 nt, hsa; identical to SEQ ID NO: 27603

SEQ ID NO: 700864 - RNA, 64 nt, hsa; identical to SEQ ID NO: 27604

SEQ ID NO: 700865 - RNA, 64 nt, hsa; identical to SEQ ID NO: 27605

SEQ ID NO: 700866 - RNA, 64 nt, hsa; identical to SEQ ID NO: 27606

SEQ ID NO: 700867 - RNA, 64 nt, hsa; identical to SEQ ID NO: 27607

SEQ ID NO: 700868 - RNA, 64 nt, hsa; identical to SEQ ID NO: 27608

SEQ ID NO: 700869 - RNA, 64 nt, hsa; identical to SEQ ID NO: 27609

SEQ ID NO: 700870 - RNA, 64 nt, hsa; identical to SEQ ID NO: 27610

SEQ ID NO: 700871 - RNA, 64 nt, hsa; identical to SEQ ID NO: 27611

SEQ ID NO: 700872 - RNA, 64 nt, hsa; identical to SEQ ID NO: 27612

SEQ ID NO: 700873 - RNA, 64 nt, hsa; identical to SEQ ID NO: 27613

SEQ ID NO: 700874 - RNA, 64 nt, hsa; identical to SEQ ID NO: 27614

SEQ ID NO: 700875 - RNA, 64 nt, hsa; identical to SEQ ID NO: 27615

SEQ ID NO: 700876 - RNA, 64 nt, hsa; identical to SEQ ID NO: 27616

SEQ ID NO: 700877 - RNA, 64 nt, hsa; identical to SEQ ID NO: 27617

SEQ ID NO: 700878 - RNA, 64 nt, hsa; identical to SEQ ID NO: 27618

SEQ ID NO: 700879 - RNA, 64 nt, hsa; identical to SEQ ID NO: 27619

SEQ ID NO: 700880 - RNA, 64 nt, hsa; identical to SEQ ID NO: 27620

SEQ ID NO: 700881 - RNA, 64 nt, hsa; identical to SEQ ID NO: 27621

SEQ ID NO: 700882 - RNA, 64 nt, hsa; identical to SEQ ID NO: 27622

SEQ ID NO: 700883 - RNA, 64 nt, hsa; identical to SEQ ID NO: 27623

SEQ ID NO: 700884 - RNA, 64 nt, hsa; identical to SEQ ID NO: 27624

SEQ ID NO: 700885 - RNA, 64 nt, hsa; identical to SEQ ID NO: 27625

SEQ ID NO: 700886 - RNA, 64 nt, hsa; identical to SEQ ID NO: 27626

SEQ ID NO: 700887 - RNA, 64 nt, hsa; identical to SEQ ID NO: 27627

SEQ ID NO: 700888 - RNA, 64 nt, hsa; identical to SEQ ID NO: 27628

SEQ ID NO: 700889 - RNA, 64 nt, hsa; identical to SEQ ID NO: 27629

SEQ ID NO: 700890 - RNA, 64 nt, hsa; identical to SEQ ID NO: 27630

SEQ ID NO: 700891 - RNA, 64 nt, hsa; identical to SEQ ID NO: 27631

SEQ ID NO: 700892 - RNA, 64 nt, hsa; identical to SEQ ID NO: 27632

SEQ ID NO: 700893 - RNA, 64 nt, hsa; identical to SEQ ID NO: 27633

SEQ ID NO: 700894 - RNA, 64 nt, hsa; identical to SEQ ID NO: 27634

SEQ ID NO: 700895 - RNA, 64 nt, hsa; identical to SEQ ID NO: 27635

SEQ ID NO: 700896 - RNA, 64 nt, hsa; identical to SEQ ID NO: 27636

SEQ ID NO: 700897 - RNA, 64 nt, hsa; identical to SEQ ID NO: 27637

SEQ ID NO: 700898 - RNA, 64 nt, hsa; identical to SEQ ID NO: 27638

SEQ ID NO: 700899 - RNA, 64 nt, hsa; identical to SEQ ID NO: 27639

SEQ ID NO: 700900 - RNA, 64 nt, hsa; identical to SEQ ID NO: 27640

SEQ ID NO: 700901 - RNA, 64 nt, hsa; identical to SEQ ID NO: 27641

SEQ ID NO: 700902 - RNA, 64 nt, hsa; identical to SEQ ID NO: 27642

SEQ ID NO: 700903 - RNA, 64 nt, hsa; identical to SEQ ID NO: 27643

SEQ ID NO: 700904 - RNA, 64 nt, hsa; identical to SEQ ID NO: 27644

SEQ ID NO: 700905 - RNA, 64 nt, hsa; identical to SEQ ID NO: 27645

SEQ ID NO: 700906 - RNA, 64 nt, hsa; identical to SEQ ID NO: 27646

SEQ ID NO: 700907 - RNA, 64 nt, hsa; identical to SEQ ID NO: 27647

SEQ ID NO: 700908 - RNA, 64 nt, hsa; identical to SEQ ID NO: 27648

SEQ ID NO: 700909 - RNA, 64 nt, hsa; identical to SEQ ID NO: 27649

SEQ ID NO: 700910 - RNA, 64 nt, hsa; identical to SEQ ID NO: 27650

SEQ ID NO: 700911 - RNA, 64 nt, hsa; identical to SEQ ID NO: 27651

SEQ ID NO: 700912 - RNA, 64 nt, hsa; identical to SEQ ID NO: 27652

SEQ ID NO: 700913 - RNA, 64 nt, hsa; identical to SEQ ID NO: 27653

SEQ ID NO: 700914 - RNA, 64 nt, hsa; identical to SEQ ID NO: 27654

SEQ ID NO: 700915 - RNA, 64 nt, hsa; identical to SEQ ID NO: 27655

SEQ ID NO: 700916 - RNA, 64 nt, hsa; identical to SEQ ID NO: 27656

SEQ ID NO: 700917 - RNA, 64 nt, hsa; identical to SEQ ID NO: 27657

SEQ ID NO: 700918 - RNA, 64 nt, hsa; identical to SEQ ID NO: 27658

SEQ ID NO: 700919 - RNA, 64 nt, hsa; identical to SEQ ID NO: 27659

SEQ ID NO: 700920 - RNA, 64 nt, hsa; identical to SEQ ID NO: 27660

SEQ ID NO: 700921 - RNA, 64 nt, hsa; identical to SEQ ID NO: 27661

SEQ ID NO: 700922 - RNA, 64 nt, hsa; identical to SEQ ID NO: 27662

SEQ ID NO: 700923 - RNA, 64 nt, hsa; identical to SEQ ID NO: 27663

SEQ ID NO: 700924 - RNA, 64 nt, hsa; identical to SEQ ID NO: 27664

SEQ ID NO: 700925 - RNA, 64 nt, hsa; identical to SEQ ID NO: 27665

SEQ ID NO: 700926 - RNA, 64 nt, hsa; identical to SEQ ID NO: 27666

SEQ ID NO: 700927 - RNA, 64 nt, hsa; identical to SEQ ID NO: 27667

SEQ ID NO: 700928 - RNA, 64 nt, hsa; identical to SEQ ID NO: 27668

SEQ ID NO: 700929 - RNA, 64 nt, hsa; identical to SEQ ID NO: 27669

SEQ ID NO: 700930 - RNA, 64 nt, hsa; identical to SEQ ID NO: 27670

SEQ ID NO: 700931 - RNA, 64 nt, hsa; identical to SEQ ID NO: 27671

SEQ ID NO: 700932 - RNA, 64 nt, hsa; identical to SEQ ID NO: 27672

SEQ ID NO: 700933 - RNA, 64 nt, hsa; identical to SEQ ID NO: 27673

SEQ ID NO: 700934 - RNA, 64 nt, hsa; identical to SEQ ID NO: 27674

SEQ ID NO: 700935 - RNA, 64 nt, hsa; identical to SEQ ID NO: 27675

SEQ ID NO: 700936 - RNA, 64 nt, hsa; identical to SEQ ID NO: 27676

SEQ ID NO: 700937 - RNA, 64 nt, hsa; identical to SEQ ID NO: 27677

SEQ ID NO: 700938 - RNA, 64 nt, hsa; identical to SEQ ID NO: 27678

SEQ ID NO: 700939 - RNA, 64 nt, hsa; identical to SEQ ID NO: 27679

SEQ ID NO: 700940 - RNA, 64 nt, hsa; identical to SEQ ID NO: 27680

SEQ ID NO: 700941 - RNA, 64 nt, hsa; identical to SEQ ID NO: 27681

SEQ ID NO: 700942 - RNA, 64 nt, hsa; identical to SEQ ID NO: 27682

SEQ ID NO: 700943 - RNA, 64 nt, hsa; identical to SEQ ID NO: 27683

SEQ ID NO: 700944 - RNA, 64 nt, hsa; identical to SEQ ID NO: 27684

SEQ ID NO: 700945 - RNA, 64 nt, hsa; identical to SEQ ID NO: 27685

SEQ ID NO: 700946 - RNA, 64 nt, hsa; identical to SEQ ID NO: 27686

SEQ ID NO: 700947 - RNA, 64 nt, hsa; identical to SEQ ID NO: 27687

SEQ ID NO: 700948 - RNA, 64 nt, hsa; identical to SEQ ID NO: 27688

SEQ ID NO: 700949 - RNA, 64 nt, hsa; identical to SEQ ID NO: 27689

SEQ ID NO: 700950 - RNA, 64 nt, hsa; identical to SEQ ID NO: 27690

SEQ ID NO: 700951 - RNA, 64 nt, hsa; identical to SEQ ID NO: 27691

SEQ ID NO: 700952 - RNA, 64 nt, hsa; identical to SEQ ID NO: 27692

SEQ ID NO: 700953 - RNA, 64 nt, hsa; identical to SEQ ID NO: 27693

SEQ ID NO: 700954 - RNA, 64 nt, hsa; identical to SEQ ID NO: 27694

SEQ ID NO: 700955 - RNA, 64 nt, hsa; identical to SEQ ID NO: 27695

SEQ ID NO: 700956 - RNA, 64 nt, hsa; identical to SEQ ID NO: 27696

SEQ ID NO: 700957 - RNA, 64 nt, hsa; identical to SEQ ID NO: 27697

SEQ ID NO: 700958 - RNA, 64 nt, hsa; identical to SEQ ID NO: 27698

SEQ ID NO: 700959 - RNA, 64 nt, hsa; identical to SEQ ID NO: 27699

SEQ ID NO: 700960 - RNA, 64 nt, hsa; identical to SEQ ID NO: 27700

SEQ ID NO: 700961 - RNA, 64 nt, hsa; identical to SEQ ID NO: 27701

SEQ ID NO: 700962 - RNA, 64 nt, hsa; identical to SEQ ID NO: 27702

SEQ ID NO: 700963 - RNA, 64 nt, hsa; identical to SEQ ID NO: 27703

SEQ ID NO: 700964 - RNA, 64 nt, hsa; identical to SEQ ID NO: 27704

SEQ ID NO: 700965 - RNA, 64 nt, hsa; identical to SEQ ID NO: 27705

SEQ ID NO: 700966 - RNA, 64 nt, hsa; identical to SEQ ID NO: 27706

SEQ ID NO: 700967 - RNA, 64 nt, hsa; identical to SEQ ID NO: 27707

SEQ ID NO: 700968 - RNA, 64 nt, hsa; identical to SEQ ID NO: 27708

SEQ ID NO: 700969 - RNA, 64 nt, hsa; identical to SEQ ID NO: 27709

SEQ ID NO: 700970 - RNA, 64 nt, hsa; identical to SEQ ID NO: 27710

SEQ ID NO: 700971 - RNA, 64 nt, hsa; identical to SEQ ID NO: 27711

SEQ ID NO: 700972 - RNA, 64 nt, hsa; identical to SEQ ID NO: 27712

SEQ ID NO: 700973 - RNA, 64 nt, hsa; identical to SEQ ID NO: 27713

SEQ ID NO: 700974 - RNA, 64 nt, hsa; identical to SEQ ID NO: 27714

SEQ ID NO: 700975 - RNA, 64 nt, hsa; identical to SEQ ID NO: 27715

SEQ ID NO: 700976 - RNA, 64 nt, hsa; identical to SEQ ID NO: 27716

SEQ ID NO: 700977 - RNA, 64 nt, hsa; identical to SEQ ID NO: 27717

SEQ ID NO: 700978 - RNA, 64 nt, hsa; identical to SEQ ID NO: 27718

SEQ ID NO: 700979 - RNA, 64 nt, hsa; identical to SEQ ID NO: 27719

SEQ ID NO: 700980 - RNA, 64 nt, hsa; identical to SEQ ID NO: 27720

SEQ ID NO: 700981 - RNA, 64 nt, hsa; identical to SEQ ID NO: 27721

SEQ ID NO: 700982 - RNA, 64 nt, hsa; identical to SEQ ID NO: 27722

SEQ ID NO: 700983 - RNA, 64 nt, hsa; identical to SEQ ID NO: 27723

SEQ ID NO: 700984 - RNA, 64 nt, hsa; identical to SEQ ID NO: 27724

SEQ ID NO: 700985 - RNA, 64 nt, hsa; identical to SEQ ID NO: 27725

SEQ ID NO: 700986 - RNA, 64 nt, hsa; identical to SEQ ID NO: 27726

SEQ ID NO: 700987 - RNA, 64 nt, hsa; identical to SEQ ID NO: 27727

SEQ ID NO: 700988 - RNA, 64 nt, hsa; identical to SEQ ID NO: 27728

SEQ ID NO: 700989 - RNA, 64 nt, hsa; identical to SEQ ID NO: 27729

SEQ ID NO: 700990 - RNA, 64 nt, hsa; identical to SEQ ID NO: 27730

SEQ ID NO: 700991 - RNA, 64 nt, hsa; identical to SEQ ID NO: 27731

SEQ ID NO: 700992 - RNA, 64 nt, hsa; identical to SEQ ID NO: 27732

SEQ ID NO: 700993 - RNA, 64 nt, hsa; identical to SEQ ID NO: 27733

SEQ ID NO: 700994 - RNA, 64 nt, hsa; identical to SEQ ID NO: 27734

SEQ ID NO: 700995 - RNA, 64 nt, hsa; identical to SEQ ID NO: 27735

SEQ ID NO: 700996 - RNA, 64 nt, hsa; identical to SEQ ID NO: 27736

SEQ ID NO: 700997 - RNA, 64 nt, hsa; identical to SEQ ID NO: 27737

SEQ ID NO: 700998 - RNA, 64 nt, hsa; identical to SEQ ID NO: 27738

SEQ ID NO: 700999 - RNA, 64 nt, hsa; identical to SEQ ID NO: 27739

SEQ ID NO: 701000 - RNA, 64 nt, hsa; identical to SEQ ID NO: 27740

SEQ ID NO: 701001 - RNA, 64 nt, hsa; identical to SEQ ID NO: 27741

SEQ ID NO: 701002 - RNA, 64 nt, hsa; identical to SEQ ID NO: 27742

SEQ ID NO: 701003 - RNA, 64 nt, hsa; identical to SEQ ID NO: 27743

SEQ ID NO: 701004 - RNA, 64 nt, hsa; identical to SEQ ID NO: 27744

SEQ ID NO: 701005 - RNA, 64 nt, hsa; identical to SEQ ID NO: 27745

SEQ ID NO: 701006 - RNA, 64 nt, hsa; identical to SEQ ID NO: 27746

SEQ ID NO: 701007 - RNA, 64 nt, hsa; identical to SEQ ID NO: 27747

SEQ ID NO: 701008 - RNA, 64 nt, hsa; identical to SEQ ID NO: 27748

SEQ ID NO: 701009 - RNA, 64 nt, hsa; identical to SEQ ID NO: 27749

SEQ ID NO: 701010 - RNA, 64 nt, hsa; identical to SEQ ID NO: 27750

SEQ ID NO: 701011 - RNA, 64 nt, hsa; identical to SEQ ID NO: 27751

SEQ ID NO: 701012 - RNA, 64 nt, hsa; identical to SEQ ID NO: 27752

SEQ ID NO: 701013 - RNA, 64 nt, hsa; identical to SEQ ID NO: 27753

SEQ ID NO: 701014 - RNA, 64 nt, hsa; identical to SEQ ID NO: 27754

SEQ ID NO: 701015 - RNA, 64 nt, hsa; identical to SEQ ID NO: 27755

SEQ ID NO: 701016 - RNA, 64 nt, hsa; identical to SEQ ID NO: 27756

SEQ ID NO: 701017 - RNA, 64 nt, hsa; identical to SEQ ID NO: 27757

SEQ ID NO: 701018 - RNA, 64 nt, hsa; identical to SEQ ID NO: 27758

SEQ ID NO: 701019 - RNA, 64 nt, hsa; identical to SEQ ID NO: 27759

SEQ ID NO: 701020 - RNA, 64 nt, hsa; identical to SEQ ID NO: 27760

SEQ ID NO: 701021 - RNA, 64 nt, hsa; identical to SEQ ID NO: 27761

SEQ ID NO: 701022 - RNA, 64 nt, hsa; identical to SEQ ID NO: 27762

SEQ ID NO: 701023 - RNA, 64 nt, hsa; identical to SEQ ID NO: 27763

SEQ ID NO: 701024 - RNA, 64 nt, hsa; identical to SEQ ID NO: 27764

SEQ ID NO: 701025 - RNA, 64 nt, hsa; identical to SEQ ID NO: 27765

SEQ ID NO: 701026 - RNA, 64 nt, hsa; identical to SEQ ID NO: 27766

SEQ ID NO: 701027 - RNA, 64 nt, hsa; identical to SEQ ID NO: 27767

SEQ ID NO: 701028 - RNA, 64 nt, hsa; identical to SEQ ID NO: 27768

SEQ ID NO: 701029 - RNA, 64 nt, hsa; identical to SEQ ID NO: 27769

SEQ ID NO: 701030 - RNA, 64 nt, hsa; identical to SEQ ID NO: 27770

SEQ ID NO: 701031 - RNA, 64 nt, hsa; identical to SEQ ID NO: 27771

SEQ ID NO: 701032 - RNA, 64 nt, hsa; identical to SEQ ID NO: 27772

SEQ ID NO: 701033 - RNA, 64 nt, hsa; identical to SEQ ID NO: 27773

SEQ ID NO: 701034 - RNA, 64 nt, hsa; identical to SEQ ID NO: 27774

SEQ ID NO: 701035 - RNA, 64 nt, hsa; identical to SEQ ID NO: 27775

SEQ ID NO: 701036 - RNA, 64 nt, hsa; identical to SEQ ID NO: 27776

SEQ ID NO: 701037 - RNA, 64 nt, hsa; identical to SEQ ID NO: 27777

SEQ ID NO: 701038 - RNA, 64 nt, hsa; identical to SEQ ID NO: 27778

SEQ ID NO: 701039 - RNA, 64 nt, hsa; identical to SEQ ID NO: 27779

SEQ ID NO: 701040 - RNA, 64 nt, hsa; identical to SEQ ID NO: 27780

SEQ ID NO: 701041 - RNA, 64 nt, hsa; identical to SEQ ID NO: 27781

SEQ ID NO: 701042 - RNA, 64 nt, hsa; identical to SEQ ID NO: 27782

SEQ ID NO: 701043 - RNA, 64 nt, hsa; identical to SEQ ID NO: 27783

SEQ ID NO: 701044 - RNA, 64 nt, hsa; identical to SEQ ID NO: 27784

SEQ ID NO: 701045 - RNA, 64 nt, hsa; identical to SEQ ID NO: 27785

SEQ ID NO: 701046 - RNA, 64 nt, hsa; identical to SEQ ID NO: 27786

SEQ ID NO: 701047 - RNA, 64 nt, hsa; identical to SEQ ID NO: 27787

SEQ ID NO: 701048 - RNA, 64 nt, hsa; identical to SEQ ID NO: 27788

SEQ ID NO: 701049 - RNA, 64 nt, hsa; identical to SEQ ID NO: 27789

SEQ ID NO: 701050 - RNA, 64 nt, hsa; identical to SEQ ID NO: 27790

SEQ ID NO: 701051 - RNA, 64 nt, hsa; identical to SEQ ID NO: 27791

SEQ ID NO: 701052 - RNA, 64 nt, hsa; identical to SEQ ID NO: 27792

SEQ ID NO: 701053 - RNA, 64 nt, hsa; identical to SEQ ID NO: 27793

SEQ ID NO: 701054 - RNA, 64 nt, hsa; identical to SEQ ID NO: 27794

SEQ ID NO: 701055 - RNA, 64 nt, hsa; identical to SEQ ID NO: 27795

SEQ ID NO: 701056 - RNA, 64 nt, hsa; identical to SEQ ID NO: 27796

SEQ ID NO: 701057 - RNA, 64 nt, hsa; identical to SEQ ID NO: 27797

SEQ ID NO: 701058 - RNA, 64 nt, hsa; identical to SEQ ID NO: 27798

SEQ ID NO: 701059 - RNA, 64 nt, hsa; identical to SEQ ID NO: 27799

SEQ ID NO: 701060 - RNA, 64 nt, hsa; identical to SEQ ID NO: 27800

SEQ ID NO: 701061 - RNA, 64 nt, hsa; identical to SEQ ID NO: 27801

SEQ ID NO: 701062 - RNA, 64 nt, hsa; identical to SEQ ID NO: 27802

SEQ ID NO: 701063 - RNA, 64 nt, hsa; identical to SEQ ID NO: 27803

SEQ ID NO: 701064 - RNA, 64 nt, hsa; identical to SEQ ID NO: 27804

SEQ ID NO: 701065 - RNA, 64 nt, hsa; identical to SEQ ID NO: 27805

SEQ ID NO: 701066 - RNA, 64 nt, hsa; identical to SEQ ID NO: 27806

SEQ ID NO: 701067 - RNA, 64 nt, hsa; identical to SEQ ID NO: 27807

SEQ ID NO: 701068 - RNA, 64 nt, hsa; identical to SEQ ID NO: 27808

SEQ ID NO: 701069 - RNA, 64 nt, hsa; identical to SEQ ID NO: 27809

SEQ ID NO: 701070 - RNA, 64 nt, hsa; identical to SEQ ID NO: 27810

SEQ ID NO: 701071 - RNA, 64 nt, hsa; identical to SEQ ID NO: 27811

SEQ ID NO: 701072 - RNA, 64 nt, hsa; identical to SEQ ID NO: 27812

SEQ ID NO: 701073 - RNA, 64 nt, hsa; identical to SEQ ID NO: 27813

SEQ ID NO: 701074 - RNA, 64 nt, hsa; identical to SEQ ID NO: 27814

SEQ ID NO: 701075 - RNA, 64 nt, hsa; identical to SEQ ID NO: 27815

SEQ ID NO: 701076 - RNA, 64 nt, hsa; identical to SEQ ID NO: 27816

SEQ ID NO: 701077 - RNA, 64 nt, hsa; identical to SEQ ID NO: 27817

SEQ ID NO: 701078 - RNA, 64 nt, hsa; identical to SEQ ID NO: 27818

SEQ ID NO: 701079 - RNA, 64 nt, hsa; identical to SEQ ID NO: 27819

SEQ ID NO: 701080 - RNA, 64 nt, hsa; identical to SEQ ID NO: 27820

SEQ ID NO: 701081 - RNA, 64 nt, hsa; identical to SEQ ID NO: 27821

SEQ ID NO: 701082 - RNA, 64 nt, hsa; identical to SEQ ID NO: 27822

SEQ ID NO: 701083 - RNA, 64 nt, hsa; identical to SEQ ID NO: 27823

SEQ ID NO: 701084 - RNA, 64 nt, hsa; identical to SEQ ID NO: 27824

SEQ ID NO: 701085 - RNA, 64 nt, hsa; identical to SEQ ID NO: 27825

SEQ ID NO: 701086 - RNA, 64 nt, hsa; identical to SEQ ID NO: 27826

SEQ ID NO: 701087 - RNA, 64 nt, hsa; identical to SEQ ID NO: 27827

SEQ ID NO: 701088 - RNA, 64 nt, hsa; identical to SEQ ID NO: 27828

SEQ ID NO: 701089 - RNA, 64 nt, hsa; identical to SEQ ID NO: 27829

SEQ ID NO: 701090 - RNA, 64 nt, hsa; identical to SEQ ID NO: 27830

SEQ ID NO: 701091 - RNA, 64 nt, hsa; identical to SEQ ID NO: 27831

SEQ ID NO: 701092 - RNA, 64 nt, hsa; identical to SEQ ID NO: 27832

SEQ ID NO: 701093 - RNA, 64 nt, hsa; identical to SEQ ID NO: 27833

SEQ ID NO: 701094 - RNA, 64 nt, hsa; identical to SEQ ID NO: 27834

SEQ ID NO: 701095 - RNA, 64 nt, hsa; identical to SEQ ID NO: 27835

SEQ ID NO: 701096 - RNA, 64 nt, hsa; identical to SEQ ID NO: 27836

SEQ ID NO: 701097 - RNA, 64 nt, hsa; identical to SEQ ID NO: 27837

SEQ ID NO: 701098 - RNA, 64 nt, hsa; identical to SEQ ID NO: 27838

SEQ ID NO: 701099 - RNA, 64 nt, hsa; identical to SEQ ID NO: 27839

SEQ ID NO: 701100 - RNA, 64 nt, hsa; identical to SEQ ID NO: 27840

SEQ ID NO: 701101 - RNA, 64 nt, hsa; identical to SEQ ID NO: 27841

SEQ ID NO: 701102 - RNA, 64 nt, hsa; identical to SEQ ID NO: 27842

SEQ ID NO: 701103 - RNA, 64 nt, hsa; identical to SEQ ID NO: 27843

SEQ ID NO: 701104 - RNA, 64 nt, hsa; identical to SEQ ID NO: 27844

SEQ ID NO: 701105 - RNA, 64 nt, hsa; identical to SEQ ID NO: 27845

SEQ ID NO: 701106 - RNA, 64 nt, hsa; identical to SEQ ID NO: 27846

SEQ ID NO: 701107 - RNA, 64 nt, hsa; identical to SEQ ID NO: 27847

SEQ ID NO: 701108 - RNA, 64 nt, hsa; identical to SEQ ID NO: 27848

SEQ ID NO: 701109 - RNA, 64 nt, hsa; identical to SEQ ID NO: 27849

SEQ ID NO: 701110 - RNA, 64 nt, hsa; identical to SEQ ID NO: 27850

SEQ ID NO: 701111 - RNA, 64 nt, hsa; identical to SEQ ID NO: 27851

SEQ ID NO: 701112 - RNA, 64 nt, hsa; identical to SEQ ID NO: 27852

SEQ ID NO: 701113 - RNA, 64 nt, hsa; identical to SEQ ID NO: 27853

SEQ ID NO: 701114 - RNA, 64 nt, hsa; identical to SEQ ID NO: 27854

SEQ ID NO: 701115 - RNA, 64 nt, hsa; identical to SEQ ID NO: 27855

SEQ ID NO: 701116 - RNA, 64 nt, hsa; identical to SEQ ID NO: 27856

SEQ ID NO: 701117 - RNA, 64 nt, hsa; identical to SEQ ID NO: 27857

SEQ ID NO: 701118 - RNA, 64 nt, hsa; identical to SEQ ID NO: 27858

SEQ ID NO: 701119 - RNA, 64 nt, hsa; identical to SEQ ID NO: 27859

SEQ ID NO: 701120 - RNA, 64 nt, hsa; identical to SEQ ID NO: 27860

SEQ ID NO: 701121 - RNA, 64 nt, hsa; identical to SEQ ID NO: 27861

SEQ ID NO: 701122 - RNA, 64 nt, hsa; identical to SEQ ID NO: 27862

SEQ ID NO: 701123 - RNA, 64 nt, hsa; identical to SEQ ID NO: 27863

SEQ ID NO: 701124 - RNA, 64 nt, hsa; identical to SEQ ID NO: 27864

SEQ ID NO: 701125 - RNA, 64 nt, hsa; identical to SEQ ID NO: 27865

SEQ ID NO: 701126 - RNA, 64 nt, hsa; identical to SEQ ID NO: 27866

SEQ ID NO: 701127 - RNA, 64 nt, hsa; identical to SEQ ID NO: 27867

SEQ ID NO: 701128 - RNA, 64 nt, hsa; identical to SEQ ID NO: 27868

SEQ ID NO: 701129 - RNA, 64 nt, hsa; identical to SEQ ID NO: 27869

SEQ ID NO: 701130 - RNA, 64 nt, hsa; identical to SEQ ID NO: 27870

SEQ ID NO: 701131 - RNA, 64 nt, hsa; identical to SEQ ID NO: 27871

SEQ ID NO: 701132 - RNA, 64 nt, hsa; identical to SEQ ID NO: 27872

SEQ ID NO: 701133 - RNA, 64 nt, hsa; identical to SEQ ID NO: 27873

SEQ ID NO: 701134 - RNA, 64 nt, hsa; identical to SEQ ID NO: 27874

SEQ ID NO: 701135 - RNA, 64 nt, hsa; identical to SEQ ID NO: 27875

SEQ ID NO: 701136 - RNA, 64 nt, hsa; identical to SEQ ID NO: 27876

SEQ ID NO: 701137 - RNA, 64 nt, hsa; identical to SEQ ID NO: 27877

SEQ ID NO: 701138 - RNA, 64 nt, hsa; identical to SEQ ID NO: 27878

SEQ ID NO: 701139 - RNA, 64 nt, hsa; identical to SEQ ID NO: 27879

SEQ ID NO: 701140 - RNA, 64 nt, hsa; identical to SEQ ID NO: 27880

SEQ ID NO: 701141 - RNA, 64 nt, hsa; identical to SEQ ID NO: 27881

SEQ ID NO: 701142 - RNA, 64 nt, hsa; identical to SEQ ID NO: 27882

SEQ ID NO: 701143 - RNA, 64 nt, hsa; identical to SEQ ID NO: 27883

SEQ ID NO: 701144 - RNA, 64 nt, hsa; identical to SEQ ID NO: 27884

SEQ ID NO: 701145 - RNA, 64 nt, hsa; identical to SEQ ID NO: 27885

SEQ ID NO: 701146 - RNA, 64 nt, hsa; identical to SEQ ID NO: 27886

SEQ ID NO: 701147 - RNA, 64 nt, hsa; identical to SEQ ID NO: 27887

SEQ ID NO: 701148 - RNA, 64 nt, hsa; identical to SEQ ID NO: 27888

SEQ ID NO: 701149 - RNA, 64 nt, hsa; identical to SEQ ID NO: 27889

SEQ ID NO: 701150 - RNA, 64 nt, hsa; identical to SEQ ID NO: 27890

SEQ ID NO: 701151 - RNA, 64 nt, hsa; identical to SEQ ID NO: 27891

SEQ ID NO: 701152 - RNA, 64 nt, hsa; identical to SEQ ID NO: 27892

SEQ ID NO: 701153 - RNA, 64 nt, hsa; identical to SEQ ID NO: 27893

SEQ ID NO: 701154 - RNA, 64 nt, hsa; identical to SEQ ID NO: 27894

SEQ ID NO: 701155 - RNA, 64 nt, hsa; identical to SEQ ID NO: 27895

SEQ ID NO: 701156 - RNA, 64 nt, hsa; identical to SEQ ID NO: 27896

SEQ ID NO: 701157 - RNA, 64 nt, hsa; identical to SEQ ID NO: 27897

SEQ ID NO: 701158 - RNA, 64 nt, hsa; identical to SEQ ID NO: 27898

SEQ ID NO: 701159 - RNA, 64 nt, hsa; identical to SEQ ID NO: 27899

SEQ ID NO: 701160 - RNA, 55 nt, hsa; identical to SEQ ID NO: 27900

SEQ ID NO: 701161 - RNA, 54 nt, hsa; identical to SEQ ID NO: 27901

SEQ ID NO: 701162 - RNA, 53 nt, hsa; identical to SEQ ID NO: 27902

SEQ ID NO: 701163 - RNA, 52 nt, hsa; identical to SEQ ID NO: 27903

SEQ ID NO: 701164 - RNA, 51 nt, hsa; identical to SEQ ID NO: 27904

SEQ ID NO: 701165 - RNA, 50 nt, hsa; identical to SEQ ID NO: 27905

SEQ ID NO: 701166 - RNA, 64 nt, hsa; identical to SEQ ID NO: 27906

SEQ ID NO: 701167 - RNA, 64 nt, hsa; identical to SEQ ID NO: 27907

SEQ ID NO: 701168 - RNA, 64 nt, hsa; identical to SEQ ID NO: 27908

SEQ ID NO: 701169 - RNA, 64 nt, hsa; identical to SEQ ID NO: 27909

SEQ ID NO: 701170 - RNA, 64 nt, hsa; identical to SEQ ID NO: 27910

SEQ ID NO: 701171 - RNA, 64 nt, hsa; identical to SEQ ID NO: 27911

SEQ ID NO: 701172 - RNA, 64 nt, hsa; identical to SEQ ID NO: 27912

SEQ ID NO: 701173 - RNA, 64 nt, hsa; identical to SEQ ID NO: 27913

SEQ ID NO: 701174 - RNA, 64 nt, hsa; identical to SEQ ID NO: 27914

SEQ ID NO: 701175 - RNA, 64 nt, hsa; identical to SEQ ID NO: 27915

SEQ ID NO: 701176 - RNA, 64 nt, hsa; identical to SEQ ID NO: 27916

SEQ ID NO: 701177 - RNA, 64 nt, hsa; identical to SEQ ID NO: 27917

SEQ ID NO: 701178 - RNA, 64 nt, hsa; identical to SEQ ID NO: 27918

SEQ ID NO: 701179 - RNA, 64 nt, hsa; identical to SEQ ID NO: 27919

SEQ ID NO: 701180 - RNA, 64 nt, hsa; identical to SEQ ID NO: 27920

SEQ ID NO: 701181 - RNA, 64 nt, hsa; identical to SEQ ID NO: 27921

SEQ ID NO: 701182 - RNA, 64 nt, hsa; identical to SEQ ID NO: 27922

SEQ ID NO: 701183 - RNA, 64 nt, hsa; identical to SEQ ID NO: 27923

SEQ ID NO: 701184 - RNA, 64 nt, hsa; identical to SEQ ID NO: 27924

SEQ ID NO: 701185 - RNA, 64 nt, hsa; identical to SEQ ID NO: 27925

SEQ ID NO: 701186 - RNA, 64 nt, hsa; identical to SEQ ID NO: 27926

SEQ ID NO: 701187 - RNA, 64 nt, hsa; identical to SEQ ID NO: 27927

SEQ ID NO: 701188 - RNA, 64 nt, hsa; identical to SEQ ID NO: 27928

SEQ ID NO: 701189 - RNA, 64 nt, hsa; identical to SEQ ID NO: 27929

SEQ ID NO: 701190 - RNA, 64 nt, hsa; identical to SEQ ID NO: 27930

SEQ ID NO: 701191 - RNA, 64 nt, hsa; identical to SEQ ID NO: 27931

SEQ ID NO: 701192 - RNA, 64 nt, hsa; identical to SEQ ID NO: 27932

SEQ ID NO: 701193 - RNA, 64 nt, hsa; identical to SEQ ID NO: 27933

SEQ ID NO: 701194 - RNA, 64 nt, hsa; identical to SEQ ID NO: 27934

SEQ ID NO: 701195 - RNA, 64 nt, hsa; identical to SEQ ID NO: 27935

SEQ ID NO: 701196 - RNA, 64 nt, hsa; identical to SEQ ID NO: 27936

SEQ ID NO: 701197 - RNA, 64 nt, hsa; identical to SEQ ID NO: 27937

SEQ ID NO: 701198 - RNA, 64 nt, hsa; identical to SEQ ID NO: 27938

SEQ ID NO: 701199 - RNA, 64 nt, hsa; identical to SEQ ID NO: 27939

SEQ ID NO: 701200 - RNA, 64 nt, hsa; identical to SEQ ID NO: 27940

SEQ ID NO: 701201 - RNA, 64 nt, hsa; identical to SEQ ID NO: 27941

SEQ ID NO: 701202 - RNA, 64 nt, hsa; identical to SEQ ID NO: 27942

SEQ ID NO: 701203 - RNA, 64 nt, hsa; identical to SEQ ID NO: 27943

SEQ ID NO: 701204 - RNA, 64 nt, hsa; identical to SEQ ID NO: 27944

SEQ ID NO: 701205 - RNA, 64 nt, hsa; identical to SEQ ID NO: 27945

SEQ ID NO: 701206 - RNA, 64 nt, hsa; identical to SEQ ID NO: 27946

SEQ ID NO: 701207 - RNA, 64 nt, hsa; identical to SEQ ID NO: 27947

SEQ ID NO: 701208 - RNA, 64 nt, hsa; identical to SEQ ID NO: 27948

SEQ ID NO: 701209 - RNA, 64 nt, hsa; identical to SEQ ID NO: 27949

SEQ ID NO: 701210 - RNA, 64 nt, hsa; identical to SEQ ID NO: 27950

SEQ ID NO: 701211 - RNA, 64 nt, hsa; identical to SEQ ID NO: 27951

SEQ ID NO: 701212 - RNA, 64 nt, hsa; identical to SEQ ID NO: 27952

SEQ ID NO: 701213 - RNA, 64 nt, hsa; identical to SEQ ID NO: 27953

SEQ ID NO: 701214 - RNA, 64 nt, hsa; identical to SEQ ID NO: 27954

SEQ ID NO: 701215 - RNA, 64 nt, hsa; identical to SEQ ID NO: 27955

SEQ ID NO: 701216 - RNA, 64 nt, hsa; identical to SEQ ID NO: 27956

SEQ ID NO: 701217 - RNA, 64 nt, hsa; identical to SEQ ID NO: 27957

SEQ ID NO: 701218 - RNA, 64 nt, hsa; identical to SEQ ID NO: 27958

SEQ ID NO: 701219 - RNA, 64 nt, hsa; identical to SEQ ID NO: 27959

SEQ ID NO: 701220 - RNA, 64 nt, hsa; identical to SEQ ID NO: 27960

SEQ ID NO: 701221 - RNA, 64 nt, hsa; identical to SEQ ID NO: 27961

SEQ ID NO: 701222 - RNA, 64 nt, hsa; identical to SEQ ID NO: 27962

SEQ ID NO: 701223 - RNA, 64 nt, hsa; identical to SEQ ID NO: 27963

SEQ ID NO: 701224 - RNA, 64 nt, hsa; identical to SEQ ID NO: 27964

SEQ ID NO: 701225 - RNA, 64 nt, hsa; identical to SEQ ID NO: 27965

SEQ ID NO: 701226 - RNA, 64 nt, hsa; identical to SEQ ID NO: 27966

SEQ ID NO: 701227 - RNA, 64 nt, hsa; identical to SEQ ID NO: 27967

SEQ ID NO: 701228 - RNA, 64 nt, hsa; identical to SEQ ID NO: 27968

SEQ ID NO: 701229 - RNA, 64 nt, hsa; identical to SEQ ID NO: 27969

SEQ ID NO: 701230 - RNA, 64 nt, hsa; identical to SEQ ID NO: 27970

SEQ ID NO: 701231 - RNA, 64 nt, hsa; identical to SEQ ID NO: 27971

SEQ ID NO: 701232 - RNA, 64 nt, hsa; identical to SEQ ID NO: 27972

SEQ ID NO: 701233 - RNA, 64 nt, hsa; identical to SEQ ID NO: 27973

SEQ ID NO: 701234 - RNA, 64 nt, hsa; identical to SEQ ID NO: 27974

SEQ ID NO: 701235 - RNA, 64 nt, hsa; identical to SEQ ID NO: 27975

SEQ ID NO: 701236 - RNA, 64 nt, hsa; identical to SEQ ID NO: 27976

SEQ ID NO: 701237 - RNA, 64 nt, hsa; identical to SEQ ID NO: 27977

SEQ ID NO: 701238 - RNA, 64 nt, hsa; identical to SEQ ID NO: 27978

SEQ ID NO: 701239 - RNA, 64 nt, hsa; identical to SEQ ID NO: 27979

SEQ ID NO: 701240 - RNA, 64 nt, hsa; identical to SEQ ID NO: 27980

SEQ ID NO: 701241 - RNA, 64 nt, hsa; identical to SEQ ID NO: 27981

SEQ ID NO: 701242 - RNA, 64 nt, hsa; identical to SEQ ID NO: 27982

SEQ ID NO: 701243 - RNA, 64 nt, hsa; identical to SEQ ID NO: 27983

SEQ ID NO: 701244 - RNA, 64 nt, hsa; identical to SEQ ID NO: 27984

SEQ ID NO: 701245 - RNA, 64 nt, hsa; identical to SEQ ID NO: 27985

SEQ ID NO: 701246 - RNA, 64 nt, hsa; identical to SEQ ID NO: 27986

SEQ ID NO: 701247 - RNA, 64 nt, hsa; identical to SEQ ID NO: 27987

SEQ ID NO: 701248 - RNA, 64 nt, hsa; identical to SEQ ID NO: 27988

SEQ ID NO: 701249 - RNA, 64 nt, hsa; identical to SEQ ID NO: 27989

SEQ ID NO: 701250 - RNA, 64 nt, hsa; identical to SEQ ID NO: 27990

SEQ ID NO: 701251 - RNA, 64 nt, hsa; identical to SEQ ID NO: 27991

SEQ ID NO: 701252 - RNA, 64 nt, hsa; identical to SEQ ID NO: 27992

SEQ ID NO: 701253 - RNA, 64 nt, hsa; identical to SEQ ID NO: 27993

SEQ ID NO: 701254 - RNA, 64 nt, hsa; identical to SEQ ID NO: 27994

SEQ ID NO: 701255 - RNA, 64 nt, hsa; identical to SEQ ID NO: 27995

SEQ ID NO: 701256 - RNA, 64 nt, hsa; identical to SEQ ID NO: 27996

SEQ ID NO: 701257 - RNA, 64 nt, hsa; identical to SEQ ID NO: 27997

SEQ ID NO: 701258 - RNA, 64 nt, hsa; identical to SEQ ID NO: 27998

SEQ ID NO: 701259 - RNA, 64 nt, hsa; identical to SEQ ID NO: 27999

SEQ ID NO: 701260 - RNA, 64 nt, hsa; identical to SEQ ID NO: 28000

SEQ ID NO: 701261 - RNA, 64 nt, hsa; identical to SEQ ID NO: 28001

SEQ ID NO: 701262 - RNA, 64 nt, hsa; identical to SEQ ID NO: 28002

SEQ ID NO: 701263 - RNA, 64 nt, hsa; identical to SEQ ID NO: 28003

SEQ ID NO: 701264 - RNA, 64 nt, hsa; identical to SEQ ID NO: 28004

SEQ ID NO: 701265 - RNA, 64 nt, hsa; identical to SEQ ID NO: 28005

SEQ ID NO: 701266 - RNA, 64 nt, hsa; identical to SEQ ID NO: 28006

SEQ ID NO: 701267 - RNA, 64 nt, hsa; identical to SEQ ID NO: 28007

SEQ ID NO: 701268 - RNA, 64 nt, hsa; identical to SEQ ID NO: 28008

SEQ ID NO: 701269 - RNA, 64 nt, hsa; identical to SEQ ID NO: 28009

SEQ ID NO: 701270 - RNA, 64 nt, hsa; identical to SEQ ID NO: 28010

SEQ ID NO: 701271 - RNA, 64 nt, hsa; identical to SEQ ID NO: 28011

SEQ ID NO: 701272 - RNA, 64 nt, hsa; identical to SEQ ID NO: 28012

SEQ ID NO: 701273 - RNA, 64 nt, hsa; identical to SEQ ID NO: 28013

SEQ ID NO: 701274 - RNA, 64 nt, hsa; identical to SEQ ID NO: 28014

SEQ ID NO: 701275 - RNA, 64 nt, hsa; identical to SEQ ID NO: 28015

SEQ ID NO: 701276 - RNA, 64 nt, hsa; identical to SEQ ID NO: 28016

SEQ ID NO: 701277 - RNA, 64 nt, hsa; identical to SEQ ID NO: 28017

SEQ ID NO: 701278 - RNA, 64 nt, hsa; identical to SEQ ID NO: 28018

SEQ ID NO: 701279 - RNA, 64 nt, hsa; identical to SEQ ID NO: 28019

SEQ ID NO: 701280 - RNA, 64 nt, hsa; identical to SEQ ID NO: 28020

SEQ ID NO: 701281 - RNA, 64 nt, hsa; identical to SEQ ID NO: 28021

SEQ ID NO: 701282 - RNA, 64 nt, hsa; identical to SEQ ID NO: 28022

SEQ ID NO: 701283 - RNA, 64 nt, hsa; identical to SEQ ID NO: 28023

SEQ ID NO: 701284 - RNA, 64 nt, hsa; identical to SEQ ID NO: 28024

SEQ ID NO: 701285 - RNA, 64 nt, hsa; identical to SEQ ID NO: 28025

SEQ ID NO: 701286 - RNA, 64 nt, hsa; identical to SEQ ID NO: 28026

SEQ ID NO: 701287 - RNA, 64 nt, hsa; identical to SEQ ID NO: 28027

SEQ ID NO: 701288 - RNA, 64 nt, hsa; identical to SEQ ID NO: 28028

SEQ ID NO: 701289 - RNA, 64 nt, hsa; identical to SEQ ID NO: 28029

SEQ ID NO: 701290 - RNA, 64 nt, hsa; identical to SEQ ID NO: 28030

SEQ ID NO: 701291 - RNA, 64 nt, hsa; identical to SEQ ID NO: 28031

SEQ ID NO: 701292 - RNA, 64 nt, hsa; identical to SEQ ID NO: 28032

SEQ ID NO: 701293 - RNA, 64 nt, hsa; identical to SEQ ID NO: 28033

SEQ ID NO: 701294 - RNA, 64 nt, hsa; identical to SEQ ID NO: 28034

SEQ ID NO: 701295 - RNA, 64 nt, hsa; identical to SEQ ID NO: 28035

SEQ ID NO: 701296 - RNA, 64 nt, hsa; identical to SEQ ID NO: 28036

SEQ ID NO: 701297 - RNA, 64 nt, hsa; identical to SEQ ID NO: 28037

SEQ ID NO: 701298 - RNA, 64 nt, hsa; identical to SEQ ID NO: 28038

SEQ ID NO: 701299 - RNA, 64 nt, hsa; identical to SEQ ID NO: 28039

SEQ ID NO: 701300 - RNA, 64 nt, hsa; identical to SEQ ID NO: 28040

SEQ ID NO: 701301 - RNA, 64 nt, hsa; identical to SEQ ID NO: 28041

SEQ ID NO: 701302 - RNA, 64 nt, hsa; identical to SEQ ID NO: 28042

SEQ ID NO: 701303 - RNA, 64 nt, hsa; identical to SEQ ID NO: 28043

SEQ ID NO: 701304 - RNA, 64 nt, hsa; identical to SEQ ID NO: 28044

SEQ ID NO: 701305 - RNA, 64 nt, hsa; identical to SEQ ID NO: 28045

SEQ ID NO: 701306 - RNA, 64 nt, hsa; identical to SEQ ID NO: 28046

SEQ ID NO: 701307 - RNA, 64 nt, hsa; identical to SEQ ID NO: 28047

SEQ ID NO: 701308 - RNA, 64 nt, hsa; identical to SEQ ID NO: 28048

SEQ ID NO: 701309 - RNA, 64 nt, hsa; identical to SEQ ID NO: 28049

SEQ ID NO: 701310 - RNA, 64 nt, hsa; identical to SEQ ID NO: 28050

SEQ ID NO: 701311 - RNA, 64 nt, hsa; identical to SEQ ID NO: 28051

SEQ ID NO: 701312 - RNA, 64 nt, hsa; identical to SEQ ID NO: 28052

SEQ ID NO: 701313 - RNA, 64 nt, hsa; identical to SEQ ID NO: 28053

SEQ ID NO: 701314 - RNA, 64 nt, hsa; identical to SEQ ID NO: 28054

SEQ ID NO: 701315 - RNA, 64 nt, hsa; identical to SEQ ID NO: 28055

SEQ ID NO: 701316 - RNA, 64 nt, hsa; identical to SEQ ID NO: 28056

SEQ ID NO: 701317 - RNA, 64 nt, hsa; identical to SEQ ID NO: 28057

SEQ ID NO: 701318 - RNA, 64 nt, hsa; identical to SEQ ID NO: 28058

SEQ ID NO: 701319 - RNA, 64 nt, hsa; identical to SEQ ID NO: 28059

SEQ ID NO: 701320 - RNA, 64 nt, hsa; identical to SEQ ID NO: 28060

SEQ ID NO: 701321 - RNA, 64 nt, hsa; identical to SEQ ID NO: 28061

SEQ ID NO: 701322 - RNA, 64 nt, hsa; identical to SEQ ID NO: 28062

SEQ ID NO: 701323 - RNA, 64 nt, hsa; identical to SEQ ID NO: 28063

SEQ ID NO: 701324 - RNA, 64 nt, hsa; identical to SEQ ID NO: 28064

SEQ ID NO: 701325 - RNA, 64 nt, hsa; identical to SEQ ID NO: 28065

SEQ ID NO: 701326 - RNA, 64 nt, hsa; identical to SEQ ID NO: 28066

SEQ ID NO: 701327 - RNA, 64 nt, hsa; identical to SEQ ID NO: 28067

SEQ ID NO: 701328 - RNA, 64 nt, hsa; identical to SEQ ID NO: 28068

SEQ ID NO: 701329 - RNA, 64 nt, hsa; identical to SEQ ID NO: 28069

SEQ ID NO: 701330 - RNA, 64 nt, hsa; identical to SEQ ID NO: 28070

SEQ ID NO: 701331 - RNA, 64 nt, hsa; identical to SEQ ID NO: 28071

SEQ ID NO: 701332 - RNA, 64 nt, hsa; identical to SEQ ID NO: 28072

SEQ ID NO: 701333 - RNA, 64 nt, hsa; identical to SEQ ID NO: 28073

SEQ ID NO: 701334 - RNA, 64 nt, hsa; identical to SEQ ID NO: 28074

SEQ ID NO: 701335 - RNA, 64 nt, hsa; identical to SEQ ID NO: 28075

SEQ ID NO: 701336 - RNA, 64 nt, hsa; identical to SEQ ID NO: 28076

SEQ ID NO: 701337 - RNA, 64 nt, hsa; identical to SEQ ID NO: 28077

SEQ ID NO: 701338 - RNA, 64 nt, hsa; identical to SEQ ID NO: 28078

SEQ ID NO: 701339 - RNA, 64 nt, hsa; identical to SEQ ID NO: 28079

SEQ ID NO: 701340 - RNA, 64 nt, hsa; identical to SEQ ID NO: 28080

SEQ ID NO: 701341 - RNA, 64 nt, hsa; identical to SEQ ID NO: 28081

SEQ ID NO: 701342 - RNA, 64 nt, hsa; identical to SEQ ID NO: 28082

SEQ ID NO: 701343 - RNA, 64 nt, hsa; identical to SEQ ID NO: 28083

SEQ ID NO: 701344 - RNA, 64 nt, hsa; identical to SEQ ID NO: 28084

SEQ ID NO: 701345 - RNA, 64 nt, hsa; identical to SEQ ID NO: 28085

SEQ ID NO: 701346 - RNA, 64 nt, hsa; identical to SEQ ID NO: 28086

SEQ ID NO: 701347 - RNA, 64 nt, hsa; identical to SEQ ID NO: 28087

SEQ ID NO: 701348 - RNA, 64 nt, hsa; identical to SEQ ID NO: 28088

SEQ ID NO: 701349 - RNA, 64 nt, hsa; identical to SEQ ID NO: 28089

SEQ ID NO: 701350 - RNA, 64 nt, hsa; identical to SEQ ID NO: 28090

SEQ ID NO: 701351 - RNA, 64 nt, hsa; identical to SEQ ID NO: 28091

SEQ ID NO: 701352 - RNA, 64 nt, hsa; identical to SEQ ID NO: 28092

SEQ ID NO: 701353 - RNA, 64 nt, hsa; identical to SEQ ID NO: 28093

SEQ ID NO: 701354 - RNA, 64 nt, hsa; identical to SEQ ID NO: 28094

SEQ ID NO: 701355 - RNA, 64 nt, hsa; identical to SEQ ID NO: 28095

SEQ ID NO: 701356 - RNA, 64 nt, hsa; identical to SEQ ID NO: 28096

SEQ ID NO: 701357 - RNA, 64 nt, hsa; identical to SEQ ID NO: 28097

SEQ ID NO: 701358 - RNA, 64 nt, hsa; identical to SEQ ID NO: 28098

SEQ ID NO: 701359 - RNA, 64 nt, hsa; identical to SEQ ID NO: 28099

SEQ ID NO: 701360 - RNA, 64 nt, hsa; identical to SEQ ID NO: 28100

SEQ ID NO: 701361 - RNA, 64 nt, hsa; identical to SEQ ID NO: 28101

SEQ ID NO: 701362 - RNA, 64 nt, hsa; identical to SEQ ID NO: 28102

SEQ ID NO: 701363 - RNA, 64 nt, hsa; identical to SEQ ID NO: 28103

SEQ ID NO: 701364 - RNA, 64 nt, hsa; identical to SEQ ID NO: 28104

SEQ ID NO: 701365 - RNA, 64 nt, hsa; identical to SEQ ID NO: 28105

SEQ ID NO: 701366 - RNA, 64 nt, hsa; identical to SEQ ID NO: 28106

SEQ ID NO: 701367 - RNA, 64 nt, hsa; identical to SEQ ID NO: 28107

SEQ ID NO: 701368 - RNA, 64 nt, hsa; identical to SEQ ID NO: 28108

SEQ ID NO: 701369 - RNA, 64 nt, hsa; identical to SEQ ID NO: 28109

SEQ ID NO: 701370 - RNA, 64 nt, hsa; identical to SEQ ID NO: 28110

SEQ ID NO: 701371 - RNA, 64 nt, hsa; identical to SEQ ID NO: 28111

SEQ ID NO: 701372 - RNA, 64 nt, hsa; identical to SEQ ID NO: 28112

SEQ ID NO: 701373 - RNA, 64 nt, hsa; identical to SEQ ID NO: 28113

SEQ ID NO: 701374 - RNA, 64 nt, hsa; identical to SEQ ID NO: 28114

SEQ ID NO: 701375 - RNA, 64 nt, hsa; identical to SEQ ID NO: 28115

SEQ ID NO: 701376 - RNA, 64 nt, hsa; identical to SEQ ID NO: 28116

SEQ ID NO: 701377 - RNA, 64 nt, hsa; identical to SEQ ID NO: 28117

SEQ ID NO: 701378 - RNA, 64 nt, hsa; identical to SEQ ID NO: 28118

SEQ ID NO: 701379 - RNA, 64 nt, hsa; identical to SEQ ID NO: 28119

SEQ ID NO: 701380 - RNA, 64 nt, hsa; identical to SEQ ID NO: 28120

SEQ ID NO: 701381 - RNA, 64 nt, hsa; identical to SEQ ID NO: 28121

SEQ ID NO: 701382 - RNA, 64 nt, hsa; identical to SEQ ID NO: 28122

SEQ ID NO: 701383 - RNA, 64 nt, hsa; identical to SEQ ID NO: 28123

SEQ ID NO: 701384 - RNA, 64 nt, hsa; identical to SEQ ID NO: 28124

SEQ ID NO: 701385 - RNA, 64 nt, hsa; identical to SEQ ID NO: 28125

SEQ ID NO: 701386 - RNA, 64 nt, hsa; identical to SEQ ID NO: 28126

SEQ ID NO: 701387 - RNA, 64 nt, hsa; identical to SEQ ID NO: 28127

SEQ ID NO: 701388 - RNA, 64 nt, hsa; identical to SEQ ID NO: 28128

SEQ ID NO: 701389 - RNA, 64 nt, hsa; identical to SEQ ID NO: 28129

SEQ ID NO: 701390 - RNA, 64 nt, hsa; identical to SEQ ID NO: 28130

SEQ ID NO: 701391 - RNA, 64 nt, hsa; identical to SEQ ID NO: 28131

SEQ ID NO: 701392 - RNA, 64 nt, hsa; identical to SEQ ID NO: 28132

SEQ ID NO: 701393 - RNA, 64 nt, hsa; identical to SEQ ID NO: 28133

SEQ ID NO: 701394 - RNA, 64 nt, hsa; identical to SEQ ID NO: 28134

SEQ ID NO: 701395 - RNA, 64 nt, hsa; identical to SEQ ID NO: 28135

SEQ ID NO: 701396 - RNA, 64 nt, hsa; identical to SEQ ID NO: 28136

SEQ ID NO: 701397 - RNA, 64 nt, hsa; identical to SEQ ID NO: 28137

SEQ ID NO: 701398 - RNA, 64 nt, hsa; identical to SEQ ID NO: 28138

SEQ ID NO: 701399 - RNA, 64 nt, hsa; identical to SEQ ID NO: 28139

SEQ ID NO: 701400 - RNA, 64 nt, hsa; identical to SEQ ID NO: 28140

SEQ ID NO: 701401 - RNA, 64 nt, hsa; identical to SEQ ID NO: 28141

SEQ ID NO: 701402 - RNA, 64 nt, hsa; identical to SEQ ID NO: 28142

SEQ ID NO: 701403 - RNA, 64 nt, hsa; identical to SEQ ID NO: 28143

SEQ ID NO: 701404 - RNA, 64 nt, hsa; identical to SEQ ID NO: 28144

SEQ ID NO: 701405 - RNA, 64 nt, hsa; identical to SEQ ID NO: 28145

SEQ ID NO: 701406 - RNA, 64 nt, hsa; identical to SEQ ID NO: 28146

SEQ ID NO: 701407 - RNA, 64 nt, hsa; identical to SEQ ID NO: 28147

SEQ ID NO: 701408 - RNA, 64 nt, hsa; identical to SEQ ID NO: 28148

SEQ ID NO: 701409 - RNA, 64 nt, hsa; identical to SEQ ID NO: 28149

SEQ ID NO: 701410 - RNA, 64 nt, hsa; identical to SEQ ID NO: 28150

SEQ ID NO: 701411 - RNA, 64 nt, hsa; identical to SEQ ID NO: 28151

SEQ ID NO: 701412 - RNA, 64 nt, hsa; identical to SEQ ID NO: 28152

SEQ ID NO: 701413 - RNA, 64 nt, hsa; identical to SEQ ID NO: 28153

SEQ ID NO: 701414 - RNA, 64 nt, hsa; identical to SEQ ID NO: 28154

SEQ ID NO: 701415 - RNA, 64 nt, hsa; identical to SEQ ID NO: 28155

SEQ ID NO: 701416 - RNA, 64 nt, hsa; identical to SEQ ID NO: 28156

SEQ ID NO: 701417 - RNA, 64 nt, hsa; identical to SEQ ID NO: 28157

SEQ ID NO: 701418 - RNA, 64 nt, hsa; identical to SEQ ID NO: 28158

SEQ ID NO: 701419 - RNA, 64 nt, hsa; identical to SEQ ID NO: 28159

SEQ ID NO: 701420 - RNA, 64 nt, hsa; identical to SEQ ID NO: 28160

SEQ ID NO: 701421 - RNA, 64 nt, hsa; identical to SEQ ID NO: 28161

SEQ ID NO: 701422 - RNA, 64 nt, hsa; identical to SEQ ID NO: 28162

SEQ ID NO: 701423 - RNA, 64 nt, hsa; identical to SEQ ID NO: 28163

SEQ ID NO: 701424 - RNA, 64 nt, hsa; identical to SEQ ID NO: 28164

SEQ ID NO: 701425 - RNA, 64 nt, hsa; identical to SEQ ID NO: 28165

SEQ ID NO: 701426 - RNA, 64 nt, hsa; identical to SEQ ID NO: 28166

SEQ ID NO: 701427 - RNA, 64 nt, hsa; identical to SEQ ID NO: 28167

SEQ ID NO: 701428 - RNA, 64 nt, hsa; identical to SEQ ID NO: 28168

SEQ ID NO: 701429 - RNA, 64 nt, hsa; identical to SEQ ID NO: 28169

SEQ ID NO: 701430 - RNA, 64 nt, hsa; identical to SEQ ID NO: 28170

SEQ ID NO: 701431 - RNA, 64 nt, hsa; identical to SEQ ID NO: 28171

SEQ ID NO: 701432 - RNA, 64 nt, hsa; identical to SEQ ID NO: 28172

SEQ ID NO: 701433 - RNA, 64 nt, hsa; identical to SEQ ID NO: 28173

SEQ ID NO: 701434 - RNA, 64 nt, hsa; identical to SEQ ID NO: 28174

SEQ ID NO: 701435 - RNA, 64 nt, hsa; identical to SEQ ID NO: 28175

SEQ ID NO: 701436 - RNA, 64 nt, hsa; identical to SEQ ID NO: 28176

SEQ ID NO: 701437 - RNA, 64 nt, hsa; identical to SEQ ID NO: 28177

SEQ ID NO: 701438 - RNA, 64 nt, hsa; identical to SEQ ID NO: 28178

SEQ ID NO: 701439 - RNA, 64 nt, hsa; identical to SEQ ID NO: 28179

SEQ ID NO: 701440 - RNA, 64 nt, hsa; identical to SEQ ID NO: 28180

SEQ ID NO: 701441 - RNA, 64 nt, hsa; identical to SEQ ID NO: 28181

SEQ ID NO: 701442 - RNA, 64 nt, hsa; identical to SEQ ID NO: 28182

SEQ ID NO: 701443 - RNA, 64 nt, hsa; identical to SEQ ID NO: 28183

SEQ ID NO: 701444 - RNA, 64 nt, hsa; identical to SEQ ID NO: 28184

SEQ ID NO: 701445 - RNA, 64 nt, hsa; identical to SEQ ID NO: 28185

SEQ ID NO: 701446 - RNA, 64 nt, hsa; identical to SEQ ID NO: 28186

SEQ ID NO: 701447 - RNA, 64 nt, hsa; identical to SEQ ID NO: 28187

SEQ ID NO: 701448 - RNA, 64 nt, hsa; identical to SEQ ID NO: 28188

SEQ ID NO: 701449 - RNA, 64 nt, hsa; identical to SEQ ID NO: 28189

SEQ ID NO: 701450 - RNA, 64 nt, hsa; identical to SEQ ID NO: 28190

SEQ ID NO: 701451 - RNA, 64 nt, hsa; identical to SEQ ID NO: 28191

SEQ ID NO: 701452 - RNA, 64 nt, hsa; identical to SEQ ID NO: 28192

SEQ ID NO: 701453 - RNA, 64 nt, hsa; identical to SEQ ID NO: 28193

SEQ ID NO: 701454 - RNA, 64 nt, hsa; identical to SEQ ID NO: 28194

SEQ ID NO: 701455 - RNA, 64 nt, hsa; identical to SEQ ID NO: 28195

SEQ ID NO: 701456 - RNA, 64 nt, hsa; identical to SEQ ID NO: 28196

SEQ ID NO: 701457 - RNA, 64 nt, hsa; identical to SEQ ID NO: 28197

SEQ ID NO: 701458 - RNA, 64 nt, hsa; identical to SEQ ID NO: 28198

SEQ ID NO: 701459 - RNA, 64 nt, hsa; identical to SEQ ID NO: 28199

SEQ ID NO: 701460 - RNA, 64 nt, hsa; identical to SEQ ID NO: 28200

SEQ ID NO: 701461 - RNA, 64 nt, hsa; identical to SEQ ID NO: 28201

SEQ ID NO: 701462 - RNA, 64 nt, hsa; identical to SEQ ID NO: 28202

SEQ ID NO: 701463 - RNA, 64 nt, hsa; identical to SEQ ID NO: 28203

SEQ ID NO: 701464 - RNA, 64 nt, hsa; identical to SEQ ID NO: 28204

SEQ ID NO: 701465 - RNA, 64 nt, hsa; identical to SEQ ID NO: 28205

SEQ ID NO: 701466 - RNA, 64 nt, hsa; identical to SEQ ID NO: 28206

SEQ ID NO: 701467 - RNA, 64 nt, hsa; identical to SEQ ID NO: 28207

SEQ ID NO: 701468 - RNA, 64 nt, hsa; identical to SEQ ID NO: 28208

SEQ ID NO: 701469 - RNA, 64 nt, hsa; identical to SEQ ID NO: 28209

SEQ ID NO: 701470 - RNA, 64 nt, hsa; identical to SEQ ID NO: 28210

SEQ ID NO: 701471 - RNA, 64 nt, hsa; identical to SEQ ID NO: 28211

SEQ ID NO: 701472 - RNA, 64 nt, hsa; identical to SEQ ID NO: 28212

SEQ ID NO: 701473 - RNA, 64 nt, hsa; identical to SEQ ID NO: 28213

SEQ ID NO: 701474 - RNA, 64 nt, hsa; identical to SEQ ID NO: 28214

SEQ ID NO: 701475 - RNA, 64 nt, hsa; identical to SEQ ID NO: 28215

SEQ ID NO: 701476 - RNA, 64 nt, hsa; identical to SEQ ID NO: 28216

SEQ ID NO: 701477 - RNA, 64 nt, hsa; identical to SEQ ID NO: 28217

SEQ ID NO: 701478 - RNA, 64 nt, hsa; identical to SEQ ID NO: 28218

SEQ ID NO: 701479 - RNA, 64 nt, hsa; identical to SEQ ID NO: 28219

SEQ ID NO: 701480 - RNA, 64 nt, hsa; identical to SEQ ID NO: 28220

SEQ ID NO: 701481 - RNA, 64 nt, hsa; identical to SEQ ID NO: 28221

SEQ ID NO: 701482 - RNA, 64 nt, hsa; identical to SEQ ID NO: 28222

SEQ ID NO: 701483 - RNA, 64 nt, hsa; identical to SEQ ID NO: 28223

SEQ ID NO: 701484 - RNA, 64 nt, hsa; identical to SEQ ID NO: 28224

SEQ ID NO: 701485 - RNA, 64 nt, hsa; identical to SEQ ID NO: 28225

SEQ ID NO: 701486 - RNA, 64 nt, hsa; identical to SEQ ID NO: 28226

SEQ ID NO: 701487 - RNA, 64 nt, hsa; identical to SEQ ID NO: 28227

SEQ ID NO: 701488 - RNA, 64 nt, hsa; identical to SEQ ID NO: 28228

SEQ ID NO: 701489 - RNA, 64 nt, hsa; identical to SEQ ID NO: 28229

SEQ ID NO: 701490 - RNA, 64 nt, hsa; identical to SEQ ID NO: 28230

SEQ ID NO: 701491 - RNA, 64 nt, hsa; identical to SEQ ID NO: 28231

SEQ ID NO: 701492 - RNA, 64 nt, hsa; identical to SEQ ID NO: 28232

SEQ ID NO: 701493 - RNA, 64 nt, hsa; identical to SEQ ID NO: 28233

SEQ ID NO: 701494 - RNA, 64 nt, hsa; identical to SEQ ID NO: 28234

SEQ ID NO: 701495 - RNA, 64 nt, hsa; identical to SEQ ID NO: 28235

SEQ ID NO: 701496 - RNA, 64 nt, hsa; identical to SEQ ID NO: 28236

SEQ ID NO: 701497 - RNA, 64 nt, hsa; identical to SEQ ID NO: 28237

SEQ ID NO: 701498 - RNA, 64 nt, hsa; identical to SEQ ID NO: 28238

SEQ ID NO: 701499 - RNA, 64 nt, hsa; identical to SEQ ID NO: 28239

SEQ ID NO: 701500 - RNA, 64 nt, hsa; identical to SEQ ID NO: 28240

SEQ ID NO: 701501 - RNA, 64 nt, hsa; identical to SEQ ID NO: 28241

SEQ ID NO: 701502 - RNA, 64 nt, hsa; identical to SEQ ID NO: 28242

SEQ ID NO: 701503 - RNA, 64 nt, hsa; identical to SEQ ID NO: 28243

SEQ ID NO: 701504 - RNA, 64 nt, hsa; identical to SEQ ID NO: 28244

SEQ ID NO: 701505 - RNA, 64 nt, hsa; identical to SEQ ID NO: 28245

SEQ ID NO: 701506 - RNA, 64 nt, hsa; identical to SEQ ID NO: 28246

SEQ ID NO: 701507 - RNA, 64 nt, hsa; identical to SEQ ID NO: 28247

SEQ ID NO: 701508 - RNA, 64 nt, hsa; identical to SEQ ID NO: 28248

SEQ ID NO: 701509 - RNA, 64 nt, hsa; identical to SEQ ID NO: 28249

SEQ ID NO: 701510 - RNA, 64 nt, hsa; identical to SEQ ID NO: 28250

SEQ ID NO: 701511 - RNA, 64 nt, hsa; identical to SEQ ID NO: 28251

SEQ ID NO: 701512 - RNA, 64 nt, hsa; identical to SEQ ID NO: 28252

SEQ ID NO: 701513 - RNA, 64 nt, hsa; identical to SEQ ID NO: 28253

SEQ ID NO: 701514 - RNA, 64 nt, hsa; identical to SEQ ID NO: 28254

SEQ ID NO: 701515 - RNA, 64 nt, hsa; identical to SEQ ID NO: 28255

SEQ ID NO: 701516 - RNA, 64 nt, hsa; identical to SEQ ID NO: 28256

SEQ ID NO: 701517 - RNA, 64 nt, hsa; identical to SEQ ID NO: 28257

SEQ ID NO: 701518 - RNA, 64 nt, hsa; identical to SEQ ID NO: 28258

SEQ ID NO: 701519 - RNA, 64 nt, hsa; identical to SEQ ID NO: 28259

SEQ ID NO: 701520 - RNA, 64 nt, hsa; identical to SEQ ID NO: 28260

SEQ ID NO: 701521 - RNA, 64 nt, hsa; identical to SEQ ID NO: 28261

SEQ ID NO: 701522 - RNA, 64 nt, hsa; identical to SEQ ID NO: 28262

SEQ ID NO: 701523 - RNA, 64 nt, hsa; identical to SEQ ID NO: 28263

SEQ ID NO: 701524 - RNA, 64 nt, hsa; identical to SEQ ID NO: 28264

SEQ ID NO: 701525 - RNA, 64 nt, hsa; identical to SEQ ID NO: 28265

SEQ ID NO: 701526 - RNA, 64 nt, hsa; identical to SEQ ID NO: 28266

SEQ ID NO: 701527 - RNA, 64 nt, hsa; identical to SEQ ID NO: 28267

SEQ ID NO: 701528 - RNA, 64 nt, hsa; identical to SEQ ID NO: 28268

SEQ ID NO: 701529 - RNA, 64 nt, hsa; identical to SEQ ID NO: 28269

SEQ ID NO: 701530 - RNA, 64 nt, hsa; identical to SEQ ID NO: 28270

SEQ ID NO: 701531 - RNA, 64 nt, hsa; identical to SEQ ID NO: 28271

SEQ ID NO: 701532 - RNA, 64 nt, hsa; identical to SEQ ID NO: 28272

SEQ ID NO: 701533 - RNA, 64 nt, hsa; identical to SEQ ID NO: 28273

SEQ ID NO: 701534 - RNA, 64 nt, hsa; identical to SEQ ID NO: 28274

SEQ ID NO: 701535 - RNA, 64 nt, hsa; identical to SEQ ID NO: 28275

SEQ ID NO: 701536 - RNA, 64 nt, hsa; identical to SEQ ID NO: 28276

SEQ ID NO: 701537 - RNA, 64 nt, hsa; identical to SEQ ID NO: 28277

SEQ ID NO: 701538 - RNA, 64 nt, hsa; identical to SEQ ID NO: 28278

SEQ ID NO: 701539 - RNA, 64 nt, hsa; identical to SEQ ID NO: 28279

SEQ ID NO: 701540 - RNA, 64 nt, hsa; identical to SEQ ID NO: 28280

SEQ ID NO: 701541 - RNA, 64 nt, hsa; identical to SEQ ID NO: 28281

SEQ ID NO: 701542 - RNA, 64 nt, hsa; identical to SEQ ID NO: 28282

SEQ ID NO: 701543 - RNA, 64 nt, hsa; identical to SEQ ID NO: 28283

SEQ ID NO: 701544 - RNA, 64 nt, hsa; identical to SEQ ID NO: 28284

SEQ ID NO: 701545 - RNA, 64 nt, hsa; identical to SEQ ID NO: 28285

SEQ ID NO: 701546 - RNA, 64 nt, hsa; identical to SEQ ID NO: 28286

SEQ ID NO: 701547 - RNA, 64 nt, hsa; identical to SEQ ID NO: 28287

SEQ ID NO: 701548 - RNA, 64 nt, hsa; identical to SEQ ID NO: 28288

SEQ ID NO: 701549 - RNA, 64 nt, hsa; identical to SEQ ID NO: 28289

SEQ ID NO: 701550 - RNA, 64 nt, hsa; identical to SEQ ID NO: 28290

SEQ ID NO: 701551 - RNA, 64 nt, hsa; identical to SEQ ID NO: 28291

SEQ ID NO: 701552 - RNA, 64 nt, hsa; identical to SEQ ID NO: 28292

SEQ ID NO: 701553 - RNA, 64 nt, hsa; identical to SEQ ID NO: 28293

SEQ ID NO: 701554 - RNA, 64 nt, hsa; identical to SEQ ID NO: 28294

SEQ ID NO: 701555 - RNA, 64 nt, hsa; identical to SEQ ID NO: 28295

SEQ ID NO: 701556 - RNA, 64 nt, hsa; identical to SEQ ID NO: 28296

SEQ ID NO: 701557 - RNA, 64 nt, hsa; identical to SEQ ID NO: 28297

SEQ ID NO: 701558 - RNA, 64 nt, hsa; identical to SEQ ID NO: 28298

SEQ ID NO: 701559 - RNA, 64 nt, hsa; identical to SEQ ID NO: 28299

SEQ ID NO: 701560 - RNA, 64 nt, hsa; identical to SEQ ID NO: 28300

SEQ ID NO: 701561 - RNA, 64 nt, hsa; identical to SEQ ID NO: 28301

SEQ ID NO: 701562 - RNA, 64 nt, hsa; identical to SEQ ID NO: 28302

SEQ ID NO: 701563 - RNA, 64 nt, hsa; identical to SEQ ID NO: 28303

SEQ ID NO: 701564 - RNA, 64 nt, hsa; identical to SEQ ID NO: 28304

SEQ ID NO: 701565 - RNA, 64 nt, hsa; identical to SEQ ID NO: 28305

SEQ ID NO: 701566 - RNA, 64 nt, hsa; identical to SEQ ID NO: 28306

SEQ ID NO: 701567 - RNA, 64 nt, hsa; identical to SEQ ID NO: 28307

SEQ ID NO: 701568 - RNA, 64 nt, hsa; identical to SEQ ID NO: 28308

SEQ ID NO: 701569 - RNA, 64 nt, hsa; identical to SEQ ID NO: 28309

SEQ ID NO: 701570 - RNA, 64 nt, hsa; identical to SEQ ID NO: 28310

SEQ ID NO: 701571 - RNA, 64 nt, hsa; identical to SEQ ID NO: 28311

SEQ ID NO: 701572 - RNA, 64 nt, hsa; identical to SEQ ID NO: 28312

SEQ ID NO: 701573 - RNA, 64 nt, hsa; identical to SEQ ID NO: 28313

SEQ ID NO: 701574 - RNA, 64 nt, hsa; identical to SEQ ID NO: 28314

SEQ ID NO: 701575 - RNA, 64 nt, hsa; identical to SEQ ID NO: 28315

SEQ ID NO: 701576 - RNA, 64 nt, hsa; identical to SEQ ID NO: 28316

SEQ ID NO: 701577 - RNA, 64 nt, hsa; identical to SEQ ID NO: 28317

SEQ ID NO: 701578 - RNA, 64 nt, hsa; identical to SEQ ID NO: 28318

SEQ ID NO: 701579 - RNA, 64 nt, hsa; identical to SEQ ID NO: 28319

SEQ ID NO: 701580 - RNA, 64 nt, hsa; identical to SEQ ID NO: 28320

SEQ ID NO: 701581 - RNA, 64 nt, hsa; identical to SEQ ID NO: 28321

SEQ ID NO: 701582 - RNA, 64 nt, hsa; identical to SEQ ID NO: 28322

SEQ ID NO: 701583 - RNA, 64 nt, hsa; identical to SEQ ID NO: 28323

SEQ ID NO: 701584 - RNA, 64 nt, hsa; identical to SEQ ID NO: 28324

SEQ ID NO: 701585 - RNA, 64 nt, hsa; identical to SEQ ID NO: 28325

SEQ ID NO: 701586 - RNA, 64 nt, hsa; identical to SEQ ID NO: 28326

SEQ ID NO: 701587 - RNA, 64 nt, hsa; identical to SEQ ID NO: 28327

SEQ ID NO: 701588 - RNA, 64 nt, hsa; identical to SEQ ID NO: 28328

SEQ ID NO: 701589 - RNA, 64 nt, hsa; identical to SEQ ID NO: 28329

SEQ ID NO: 701590 - RNA, 64 nt, hsa; identical to SEQ ID NO: 28330

SEQ ID NO: 701591 - RNA, 64 nt, hsa; identical to SEQ ID NO: 28331

SEQ ID NO: 701592 - RNA, 64 nt, hsa; identical to SEQ ID NO: 28332

SEQ ID NO: 701593 - RNA, 64 nt, hsa; identical to SEQ ID NO: 28333

SEQ ID NO: 701594 - RNA, 64 nt, hsa; identical to SEQ ID NO: 28334

SEQ ID NO: 701595 - RNA, 64 nt, hsa; identical to SEQ ID NO: 28335

SEQ ID NO: 701596 - RNA, 64 nt, hsa; identical to SEQ ID NO: 28336

SEQ ID NO: 701597 - RNA, 64 nt, hsa; identical to SEQ ID NO: 28337

SEQ ID NO: 701598 - RNA, 64 nt, hsa; identical to SEQ ID NO: 28338

SEQ ID NO: 701599 - RNA, 64 nt, hsa; identical to SEQ ID NO: 28339

SEQ ID NO: 701600 - RNA, 64 nt, hsa; identical to SEQ ID NO: 28340

SEQ ID NO: 701601 - RNA, 64 nt, hsa; identical to SEQ ID NO: 28341

SEQ ID NO: 701602 - RNA, 64 nt, hsa; identical to SEQ ID NO: 28342

SEQ ID NO: 701603 - RNA, 64 nt, hsa; identical to SEQ ID NO: 28343

SEQ ID NO: 701604 - RNA, 64 nt, hsa; identical to SEQ ID NO: 28344

SEQ ID NO: 701605 - RNA, 64 nt, hsa; identical to SEQ ID NO: 28345

SEQ ID NO: 701606 - RNA, 64 nt, hsa; identical to SEQ ID NO: 28346

SEQ ID NO: 701607 - RNA, 64 nt, hsa; identical to SEQ ID NO: 28347

SEQ ID NO: 701608 - RNA, 64 nt, hsa; identical to SEQ ID NO: 28348

SEQ ID NO: 701609 - RNA, 64 nt, hsa; identical to SEQ ID NO: 28349

SEQ ID NO: 701610 - RNA, 64 nt, hsa; identical to SEQ ID NO: 28350

SEQ ID NO: 701611 - RNA, 64 nt, hsa; identical to SEQ ID NO: 28351

SEQ ID NO: 701612 - RNA, 64 nt, hsa; identical to SEQ ID NO: 28352

SEQ ID NO: 701613 - RNA, 64 nt, hsa; identical to SEQ ID NO: 28353

SEQ ID NO: 701614 - RNA, 64 nt, hsa; identical to SEQ ID NO: 28354

SEQ ID NO: 701615 - RNA, 64 nt, hsa; identical to SEQ ID NO: 28355

SEQ ID NO: 701616 - RNA, 64 nt, hsa; identical to SEQ ID NO: 28356

SEQ ID NO: 701617 - RNA, 64 nt, hsa; identical to SEQ ID NO: 28357

SEQ ID NO: 701618 - RNA, 64 nt, hsa; identical to SEQ ID NO: 28358

SEQ ID NO: 701619 - RNA, 64 nt, hsa; identical to SEQ ID NO: 28359

SEQ ID NO: 701620 - RNA, 64 nt, hsa; identical to SEQ ID NO: 28360

SEQ ID NO: 701621 - RNA, 64 nt, hsa; identical to SEQ ID NO: 28361

SEQ ID NO: 701622 - RNA, 64 nt, hsa; identical to SEQ ID NO: 28362

SEQ ID NO: 701623 - RNA, 64 nt, hsa; identical to SEQ ID NO: 28363

SEQ ID NO: 701624 - RNA, 64 nt, hsa; identical to SEQ ID NO: 28364

SEQ ID NO: 701625 - RNA, 64 nt, hsa; identical to SEQ ID NO: 28365

SEQ ID NO: 701626 - RNA, 64 nt, hsa; identical to SEQ ID NO: 28366

SEQ ID NO: 701627 - RNA, 64 nt, hsa; identical to SEQ ID NO: 28367

SEQ ID NO: 701628 - RNA, 64 nt, hsa; identical to SEQ ID NO: 28368

SEQ ID NO: 701629 - RNA, 64 nt, hsa; identical to SEQ ID NO: 28369

SEQ ID NO: 701630 - RNA, 64 nt, hsa; identical to SEQ ID NO: 28370

SEQ ID NO: 701631 - RNA, 64 nt, hsa; identical to SEQ ID NO: 28371

SEQ ID NO: 701632 - RNA, 64 nt, hsa; identical to SEQ ID NO: 28372

SEQ ID NO: 701633 - RNA, 64 nt, hsa; identical to SEQ ID NO: 28373

SEQ ID NO: 701634 - RNA, 64 nt, hsa; identical to SEQ ID NO: 28374

SEQ ID NO: 701635 - RNA, 64 nt, hsa; identical to SEQ ID NO: 28375

SEQ ID NO: 701636 - RNA, 64 nt, hsa; identical to SEQ ID NO: 28376

SEQ ID NO: 701637 - RNA, 64 nt, hsa; identical to SEQ ID NO: 28377

SEQ ID NO: 701638 - RNA, 64 nt, hsa; identical to SEQ ID NO: 28378

SEQ ID NO: 701639 - RNA, 64 nt, hsa; identical to SEQ ID NO: 28379

SEQ ID NO: 701640 - RNA, 64 nt, hsa; identical to SEQ ID NO: 28380

SEQ ID NO: 701641 - RNA, 64 nt, hsa; identical to SEQ ID NO: 28381

SEQ ID NO: 701642 - RNA, 64 nt, hsa; identical to SEQ ID NO: 28382

SEQ ID NO: 701643 - RNA, 64 nt, hsa; identical to SEQ ID NO: 28383

SEQ ID NO: 701644 - RNA, 64 nt, hsa; identical to SEQ ID NO: 28384

SEQ ID NO: 701645 - RNA, 64 nt, hsa; identical to SEQ ID NO: 28385

SEQ ID NO: 701646 - RNA, 64 nt, hsa; identical to SEQ ID NO: 28386

SEQ ID NO: 701647 - RNA, 64 nt, hsa; identical to SEQ ID NO: 28387

SEQ ID NO: 701648 - RNA, 64 nt, hsa; identical to SEQ ID NO: 28388

SEQ ID NO: 701649 - RNA, 64 nt, hsa; identical to SEQ ID NO: 28389

SEQ ID NO: 701650 - RNA, 64 nt, hsa; identical to SEQ ID NO: 28390

SEQ ID NO: 701651 - RNA, 64 nt, hsa; identical to SEQ ID NO: 28391

SEQ ID NO: 701652 - RNA, 64 nt, hsa; identical to SEQ ID NO: 28392

SEQ ID NO: 701653 - RNA, 64 nt, hsa; identical to SEQ ID NO: 28393

SEQ ID NO: 701654 - RNA, 64 nt, hsa; identical to SEQ ID NO: 28394

SEQ ID NO: 701655 - RNA, 64 nt, hsa; identical to SEQ ID NO: 28395

SEQ ID NO: 701656 - RNA, 64 nt, hsa; identical to SEQ ID NO: 28396

SEQ ID NO: 701657 - RNA, 64 nt, hsa; identical to SEQ ID NO: 28397

SEQ ID NO: 701658 - RNA, 64 nt, hsa; identical to SEQ ID NO: 28398

SEQ ID NO: 701659 - RNA, 64 nt, hsa; identical to SEQ ID NO: 28399

SEQ ID NO: 701660 - RNA, 64 nt, hsa; identical to SEQ ID NO: 28400

SEQ ID NO: 701661 - RNA, 64 nt, hsa; identical to SEQ ID NO: 28401

SEQ ID NO: 701662 - RNA, 64 nt, hsa; identical to SEQ ID NO: 28402

SEQ ID NO: 701663 - RNA, 64 nt, hsa; identical to SEQ ID NO: 28403

SEQ ID NO: 701664 - RNA, 64 nt, hsa; identical to SEQ ID NO: 28404

SEQ ID NO: 701665 - RNA, 64 nt, hsa; identical to SEQ ID NO: 28405

SEQ ID NO: 701666 - RNA, 64 nt, hsa; identical to SEQ ID NO: 28406

SEQ ID NO: 701667 - RNA, 64 nt, hsa; identical to SEQ ID NO: 28407

SEQ ID NO: 701668 - RNA, 64 nt, hsa; identical to SEQ ID NO: 28408

SEQ ID NO: 701669 - RNA, 64 nt, hsa; identical to SEQ ID NO: 28409

SEQ ID NO: 701670 - RNA, 64 nt, hsa; identical to SEQ ID NO: 28410

SEQ ID NO: 701671 - RNA, 64 nt, hsa; identical to SEQ ID NO: 28411

SEQ ID NO: 701672 - RNA, 64 nt, hsa; identical to SEQ ID NO: 28412

SEQ ID NO: 701673 - RNA, 64 nt, hsa; identical to SEQ ID NO: 28413

SEQ ID NO: 701674 - RNA, 64 nt, hsa; identical to SEQ ID NO: 28414

SEQ ID NO: 701675 - RNA, 64 nt, hsa; identical to SEQ ID NO: 28415

SEQ ID NO: 701676 - RNA, 64 nt, hsa; identical to SEQ ID NO: 28416

SEQ ID NO: 701677 - RNA, 64 nt, hsa; identical to SEQ ID NO: 28417

SEQ ID NO: 701678 - RNA, 64 nt, hsa; identical to SEQ ID NO: 28418

SEQ ID NO: 701679 - RNA, 64 nt, hsa; identical to SEQ ID NO: 28419

SEQ ID NO: 701680 - RNA, 64 nt, hsa; identical to SEQ ID NO: 28420

SEQ ID NO: 701681 - RNA, 64 nt, hsa; identical to SEQ ID NO: 28421

SEQ ID NO: 701682 - RNA, 64 nt, hsa; identical to SEQ ID NO: 28422

SEQ ID NO: 701683 - RNA, 64 nt, hsa; identical to SEQ ID NO: 28423

SEQ ID NO: 701684 - RNA, 64 nt, hsa; identical to SEQ ID NO: 28424

SEQ ID NO: 701685 - RNA, 64 nt, hsa; identical to SEQ ID NO: 28425

SEQ ID NO: 701686 - RNA, 64 nt, hsa; identical to SEQ ID NO: 28426

SEQ ID NO: 701687 - RNA, 64 nt, hsa; identical to SEQ ID NO: 28427

SEQ ID NO: 701688 - RNA, 64 nt, hsa; identical to SEQ ID NO: 28428

SEQ ID NO: 701689 - RNA, 64 nt, hsa; identical to SEQ ID NO: 28429

SEQ ID NO: 701690 - RNA, 64 nt, hsa; identical to SEQ ID NO: 28430

SEQ ID NO: 701691 - RNA, 64 nt, hsa; identical to SEQ ID NO: 28431

SEQ ID NO: 701692 - RNA, 64 nt, hsa; identical to SEQ ID NO: 28432

SEQ ID NO: 701693 - RNA, 64 nt, hsa; identical to SEQ ID NO: 28433

SEQ ID NO: 701694 - RNA, 64 nt, hsa; identical to SEQ ID NO: 28434

SEQ ID NO: 701695 - RNA, 64 nt, hsa; identical to SEQ ID NO: 28435

SEQ ID NO: 701696 - RNA, 64 nt, hsa; identical to SEQ ID NO: 28436

SEQ ID NO: 701697 - RNA, 64 nt, hsa; identical to SEQ ID NO: 28437

SEQ ID NO: 701698 - RNA, 64 nt, hsa; identical to SEQ ID NO: 28438

SEQ ID NO: 701699 - RNA, 64 nt, hsa; identical to SEQ ID NO: 28439

SEQ ID NO: 701700 - RNA, 64 nt, hsa; identical to SEQ ID NO: 28440

SEQ ID NO: 701701 - RNA, 64 nt, hsa; identical to SEQ ID NO: 28441

SEQ ID NO: 701702 - RNA, 64 nt, hsa; identical to SEQ ID NO: 28442

SEQ ID NO: 701703 - RNA, 64 nt, hsa; identical to SEQ ID NO: 28443

SEQ ID NO: 701704 - RNA, 64 nt, hsa; identical to SEQ ID NO: 28444

SEQ ID NO: 701705 - RNA, 64 nt, hsa; identical to SEQ ID NO: 28445

SEQ ID NO: 701706 - RNA, 64 nt, hsa; identical to SEQ ID NO: 28446

SEQ ID NO: 701707 - RNA, 64 nt, hsa; identical to SEQ ID NO: 28447

SEQ ID NO: 701708 - RNA, 64 nt, hsa; identical to SEQ ID NO: 28448

SEQ ID NO: 701709 - RNA, 64 nt, hsa; identical to SEQ ID NO: 28449

SEQ ID NO: 701710 - RNA, 64 nt, hsa; identical to SEQ ID NO: 28450

SEQ ID NO: 701711 - RNA, 64 nt, hsa; identical to SEQ ID NO: 28451

SEQ ID NO: 701712 - RNA, 64 nt, hsa; identical to SEQ ID NO: 28452

SEQ ID NO: 701713 - RNA, 64 nt, hsa; identical to SEQ ID NO: 28453

SEQ ID NO: 701714 - RNA, 64 nt, hsa; identical to SEQ ID NO: 28454

SEQ ID NO: 701715 - RNA, 64 nt, hsa; identical to SEQ ID NO: 28455

SEQ ID NO: 701716 - RNA, 64 nt, hsa; identical to SEQ ID NO: 28456

SEQ ID NO: 701717 - RNA, 64 nt, hsa; identical to SEQ ID NO: 28457

SEQ ID NO: 701718 - RNA, 64 nt, hsa; identical to SEQ ID NO: 28458

SEQ ID NO: 701719 - RNA, 64 nt, hsa; identical to SEQ ID NO: 28459

SEQ ID NO: 701720 - RNA, 64 nt, hsa; identical to SEQ ID NO: 28460

SEQ ID NO: 701721 - RNA, 64 nt, hsa; identical to SEQ ID NO: 28461

SEQ ID NO: 701722 - RNA, 64 nt, hsa; identical to SEQ ID NO: 28462

SEQ ID NO: 701723 - RNA, 64 nt, hsa; identical to SEQ ID NO: 28463

SEQ ID NO: 701724 - RNA, 64 nt, hsa; identical to SEQ ID NO: 28464

SEQ ID NO: 701725 - RNA, 64 nt, hsa; identical to SEQ ID NO: 28465

SEQ ID NO: 701726 - RNA, 64 nt, hsa; identical to SEQ ID NO: 28466

SEQ ID NO: 701727 - RNA, 64 nt, hsa; identical to SEQ ID NO: 28467

SEQ ID NO: 701728 - RNA, 64 nt, hsa; identical to SEQ ID NO: 28468

SEQ ID NO: 701729 - RNA, 64 nt, hsa; identical to SEQ ID NO: 28469

SEQ ID NO: 701730 - RNA, 64 nt, hsa; identical to SEQ ID NO: 28470

SEQ ID NO: 701731 - RNA, 64 nt, hsa; identical to SEQ ID NO: 28471

SEQ ID NO: 701732 - RNA, 64 nt, hsa; identical to SEQ ID NO: 28472

SEQ ID NO: 701733 - RNA, 64 nt, hsa; identical to SEQ ID NO: 28473

SEQ ID NO: 701734 - RNA, 64 nt, hsa; identical to SEQ ID NO: 28474

SEQ ID NO: 701735 - RNA, 64 nt, hsa; identical to SEQ ID NO: 28475

SEQ ID NO: 701736 - RNA, 64 nt, hsa; identical to SEQ ID NO: 28476

SEQ ID NO: 701737 - RNA, 64 nt, hsa; identical to SEQ ID NO: 28477

SEQ ID NO: 701738 - RNA, 64 nt, hsa; identical to SEQ ID NO: 28478

SEQ ID NO: 701739 - RNA, 64 nt, hsa; identical to SEQ ID NO: 28479

SEQ ID NO: 701740 - RNA, 64 nt, hsa; identical to SEQ ID NO: 28480

SEQ ID NO: 701741 - RNA, 64 nt, hsa; identical to SEQ ID NO: 28481

SEQ ID NO: 701742 - RNA, 64 nt, hsa; identical to SEQ ID NO: 28482

SEQ ID NO: 701743 - RNA, 64 nt, hsa; identical to SEQ ID NO: 28483

SEQ ID NO: 701744 - RNA, 64 nt, hsa; identical to SEQ ID NO: 28484

SEQ ID NO: 701745 - RNA, 64 nt, hsa; identical to SEQ ID NO: 28485

SEQ ID NO: 701746 - RNA, 64 nt, hsa; identical to SEQ ID NO: 28486

SEQ ID NO: 701747 - RNA, 64 nt, hsa; identical to SEQ ID NO: 28487

SEQ ID NO: 701748 - RNA, 64 nt, hsa; identical to SEQ ID NO: 28488

SEQ ID NO: 701749 - RNA, 64 nt, hsa; identical to SEQ ID NO: 28489

SEQ ID NO: 701750 - RNA, 64 nt, hsa; identical to SEQ ID NO: 28490

SEQ ID NO: 701751 - RNA, 51 nt, hsa; identical to SEQ ID NO: 28491

SEQ ID NO: 701752 - RNA, 50 nt, hsa; identical to SEQ ID NO: 28492

SEQ ID NO: 701753 - RNA, 64 nt, hsa; identical to SEQ ID NO: 28493

SEQ ID NO: 701754 - RNA, 64 nt, hsa; identical to SEQ ID NO: 28494

SEQ ID NO: 701755 - RNA, 64 nt, hsa; identical to SEQ ID NO: 28495

SEQ ID NO: 701756 - RNA, 64 nt, hsa; identical to SEQ ID NO: 28496

SEQ ID NO: 701757 - RNA, 64 nt, hsa; identical to SEQ ID NO: 28497

SEQ ID NO: 701758 - RNA, 64 nt, hsa; identical to SEQ ID NO: 28498

SEQ ID NO: 701759 - RNA, 64 nt, hsa; identical to SEQ ID NO: 28499

SEQ ID NO: 701760 - RNA, 64 nt, hsa; identical to SEQ ID NO: 28500

SEQ ID NO: 701761 - RNA, 64 nt, hsa; identical to SEQ ID NO: 28501

SEQ ID NO: 701762 - RNA, 64 nt, hsa; identical to SEQ ID NO: 28502

SEQ ID NO: 701763 - RNA, 64 nt, hsa; identical to SEQ ID NO: 28503

SEQ ID NO: 701764 - RNA, 64 nt, hsa; identical to SEQ ID NO: 28504

SEQ ID NO: 701765 - RNA, 64 nt, hsa; identical to SEQ ID NO: 28505

SEQ ID NO: 701766 - RNA, 64 nt, hsa; identical to SEQ ID NO: 28506

SEQ ID NO: 701767 - RNA, 64 nt, hsa; identical to SEQ ID NO: 28507

SEQ ID NO: 701768 - RNA, 64 nt, hsa; identical to SEQ ID NO: 28508

SEQ ID NO: 701769 - RNA, 64 nt, hsa; identical to SEQ ID NO: 28509

SEQ ID NO: 701770 - RNA, 64 nt, hsa; identical to SEQ ID NO: 28510

SEQ ID NO: 701771 - RNA, 64 nt, hsa; identical to SEQ ID NO: 28511

SEQ ID NO: 701772 - RNA, 64 nt, hsa; identical to SEQ ID NO: 28512

SEQ ID NO: 701773 - RNA, 64 nt, hsa; identical to SEQ ID NO: 28513

SEQ ID NO: 701774 - RNA, 64 nt, hsa; identical to SEQ ID NO: 28514

SEQ ID NO: 701775 - RNA, 64 nt, hsa; identical to SEQ ID NO: 28515

SEQ ID NO: 701776 - RNA, 64 nt, hsa; identical to SEQ ID NO: 28516

SEQ ID NO: 701777 - RNA, 64 nt, hsa; identical to SEQ ID NO: 28517

SEQ ID NO: 701778 - RNA, 64 nt, hsa; identical to SEQ ID NO: 28518

SEQ ID NO: 701779 - RNA, 64 nt, hsa; identical to SEQ ID NO: 28519

SEQ ID NO: 701780 - RNA, 64 nt, hsa; identical to SEQ ID NO: 28520

SEQ ID NO: 701781 - RNA, 64 nt, hsa; identical to SEQ ID NO: 28521

SEQ ID NO: 701782 - RNA, 64 nt, hsa; identical to SEQ ID NO: 28522

SEQ ID NO: 701783 - RNA, 64 nt, hsa; identical to SEQ ID NO: 28523

SEQ ID NO: 701784 - RNA, 64 nt, hsa; identical to SEQ ID NO: 28524

SEQ ID NO: 701785 - RNA, 64 nt, hsa; identical to SEQ ID NO: 28525

SEQ ID NO: 701786 - RNA, 64 nt, hsa; identical to SEQ ID NO: 28526

SEQ ID NO: 701787 - RNA, 64 nt, hsa; identical to SEQ ID NO: 28527

SEQ ID NO: 701788 - RNA, 64 nt, hsa; identical to SEQ ID NO: 28528

SEQ ID NO: 701789 - RNA, 64 nt, hsa; identical to SEQ ID NO: 28529

SEQ ID NO: 701790 - RNA, 64 nt, hsa; identical to SEQ ID NO: 28530

SEQ ID NO: 701791 - RNA, 64 nt, hsa; identical to SEQ ID NO: 28531

SEQ ID NO: 701792 - RNA, 64 nt, hsa; identical to SEQ ID NO: 28532

SEQ ID NO: 701793 - RNA, 64 nt, hsa; identical to SEQ ID NO: 28533

SEQ ID NO: 701794 - RNA, 64 nt, hsa; identical to SEQ ID NO: 28534

SEQ ID NO: 701795 - RNA, 64 nt, hsa; identical to SEQ ID NO: 28535

SEQ ID NO: 701796 - RNA, 64 nt, hsa; identical to SEQ ID NO: 28536

SEQ ID NO: 701797 - RNA, 64 nt, hsa; identical to SEQ ID NO: 28537

SEQ ID NO: 701798 - RNA, 64 nt, hsa; identical to SEQ ID NO: 28538

SEQ ID NO: 701799 - RNA, 64 nt, hsa; identical to SEQ ID NO: 28539

SEQ ID NO: 701800 - RNA, 64 nt, hsa; identical to SEQ ID NO: 28540

SEQ ID NO: 701801 - RNA, 64 nt, hsa; identical to SEQ ID NO: 28541

SEQ ID NO: 701802 - RNA, 64 nt, hsa; identical to SEQ ID NO: 28542

SEQ ID NO: 701803 - RNA, 64 nt, hsa; identical to SEQ ID NO: 28543

SEQ ID NO: 701804 - RNA, 64 nt, hsa; identical to SEQ ID NO: 28544

SEQ ID NO: 701805 - RNA, 64 nt, hsa; identical to SEQ ID NO: 28545

SEQ ID NO: 701806 - RNA, 64 nt, hsa; identical to SEQ ID NO: 28546

SEQ ID NO: 701807 - RNA, 64 nt, hsa; identical to SEQ ID NO: 28547

SEQ ID NO: 701808 - RNA, 64 nt, hsa; identical to SEQ ID NO: 28548

SEQ ID NO: 701809 - RNA, 64 nt, hsa; identical to SEQ ID NO: 28549

SEQ ID NO: 701810 - RNA, 64 nt, hsa; identical to SEQ ID NO: 28550

SEQ ID NO: 701811 - RNA, 64 nt, hsa; identical to SEQ ID NO: 28551

SEQ ID NO: 701812 - RNA, 64 nt, hsa; identical to SEQ ID NO: 28552

SEQ ID NO: 701813 - RNA, 64 nt, hsa; identical to SEQ ID NO: 28553

SEQ ID NO: 701814 - RNA, 64 nt, hsa; identical to SEQ ID NO: 28554

SEQ ID NO: 701815 - RNA, 64 nt, hsa; identical to SEQ ID NO: 28555

SEQ ID NO: 701816 - RNA, 64 nt, hsa; identical to SEQ ID NO: 28556

SEQ ID NO: 701817 - RNA, 64 nt, hsa; identical to SEQ ID NO: 28557

SEQ ID NO: 701818 - RNA, 64 nt, hsa; identical to SEQ ID NO: 28558

SEQ ID NO: 701819 - RNA, 64 nt, hsa; identical to SEQ ID NO: 28559

SEQ ID NO: 701820 - RNA, 64 nt, hsa; identical to SEQ ID NO: 28560

SEQ ID NO: 701821 - RNA, 64 nt, hsa; identical to SEQ ID NO: 28561

SEQ ID NO: 701822 - RNA, 64 nt, hsa; identical to SEQ ID NO: 28562

SEQ ID NO: 701823 - RNA, 64 nt, hsa; identical to SEQ ID NO: 28563

SEQ ID NO: 701824 - RNA, 64 nt, hsa; identical to SEQ ID NO: 28564

SEQ ID NO: 701825 - RNA, 64 nt, hsa; identical to SEQ ID NO: 28565

SEQ ID NO: 701826 - RNA, 64 nt, hsa; identical to SEQ ID NO: 28566

SEQ ID NO: 701827 - RNA, 64 nt, hsa; identical to SEQ ID NO: 28567

SEQ ID NO: 701828 - RNA, 64 nt, hsa; identical to SEQ ID NO: 28568

SEQ ID NO: 701829 - RNA, 64 nt, hsa; identical to SEQ ID NO: 28569

SEQ ID NO: 701830 - RNA, 64 nt, hsa; identical to SEQ ID NO: 28570

SEQ ID NO: 701831 - RNA, 64 nt, hsa; identical to SEQ ID NO: 28571

SEQ ID NO: 701832 - RNA, 64 nt, hsa; identical to SEQ ID NO: 28572

SEQ ID NO: 701833 - RNA, 64 nt, hsa; identical to SEQ ID NO: 28573

SEQ ID NO: 701834 - RNA, 64 nt, hsa; identical to SEQ ID NO: 28574

SEQ ID NO: 701835 - RNA, 64 nt, hsa; identical to SEQ ID NO: 28575

SEQ ID NO: 701836 - RNA, 64 nt, hsa; identical to SEQ ID NO: 28576

SEQ ID NO: 701837 - RNA, 64 nt, hsa; identical to SEQ ID NO: 28577

SEQ ID NO: 701838 - RNA, 64 nt, hsa; identical to SEQ ID NO: 28578

SEQ ID NO: 701839 - RNA, 64 nt, hsa; identical to SEQ ID NO: 28579

SEQ ID NO: 701840 - RNA, 64 nt, hsa; identical to SEQ ID NO: 28580

SEQ ID NO: 701841 - RNA, 64 nt, hsa; identical to SEQ ID NO: 28581

SEQ ID NO: 701842 - RNA, 64 nt, hsa; identical to SEQ ID NO: 28582

SEQ ID NO: 701843 - RNA, 64 nt, hsa; identical to SEQ ID NO: 28583

SEQ ID NO: 701844 - RNA, 64 nt, hsa; identical to SEQ ID NO: 28584

SEQ ID NO: 701845 - RNA, 64 nt, hsa; identical to SEQ ID NO: 28585

SEQ ID NO: 701846 - RNA, 64 nt, hsa; identical to SEQ ID NO: 28586

SEQ ID NO: 701847 - RNA, 64 nt, hsa; identical to SEQ ID NO: 28587

SEQ ID NO: 701848 - RNA, 64 nt, hsa; identical to SEQ ID NO: 28588

SEQ ID NO: 701849 - RNA, 64 nt, hsa; identical to SEQ ID NO: 28589

SEQ ID NO: 701850 - RNA, 64 nt, hsa; identical to SEQ ID NO: 28590

SEQ ID NO: 701851 - RNA, 64 nt, hsa; identical to SEQ ID NO: 28591

SEQ ID NO: 701852 - RNA, 64 nt, hsa; identical to SEQ ID NO: 28592

SEQ ID NO: 701853 - RNA, 64 nt, hsa; identical to SEQ ID NO: 28593

SEQ ID NO: 701854 - RNA, 64 nt, hsa; identical to SEQ ID NO: 28594

SEQ ID NO: 701855 - RNA, 64 nt, hsa; identical to SEQ ID NO: 28595

SEQ ID NO: 701856 - RNA, 64 nt, hsa; identical to SEQ ID NO: 28596

SEQ ID NO: 701857 - RNA, 64 nt, hsa; identical to SEQ ID NO: 28597

SEQ ID NO: 701858 - RNA, 64 nt, hsa; identical to SEQ ID NO: 28598

SEQ ID NO: 701859 - RNA, 64 nt, hsa; identical to SEQ ID NO: 28599

SEQ ID NO: 701860 - RNA, 64 nt, hsa; identical to SEQ ID NO: 28600

SEQ ID NO: 701861 - RNA, 64 nt, hsa; identical to SEQ ID NO: 28601

SEQ ID NO: 701862 - RNA, 64 nt, hsa; identical to SEQ ID NO: 28602

SEQ ID NO: 701863 - RNA, 64 nt, hsa; identical to SEQ ID NO: 28603

SEQ ID NO: 701864 - RNA, 64 nt, hsa; identical to SEQ ID NO: 28604

SEQ ID NO: 701865 - RNA, 64 nt, hsa; identical to SEQ ID NO: 28605

SEQ ID NO: 701866 - RNA, 64 nt, hsa; identical to SEQ ID NO: 28606

SEQ ID NO: 701867 - RNA, 64 nt, hsa; identical to SEQ ID NO: 28607

SEQ ID NO: 701868 - RNA, 64 nt, hsa; identical to SEQ ID NO: 28608

SEQ ID NO: 701869 - RNA, 64 nt, hsa; identical to SEQ ID NO: 28609

SEQ ID NO: 701870 - RNA, 64 nt, hsa; identical to SEQ ID NO: 28610

SEQ ID NO: 701871 - RNA, 64 nt, hsa; identical to SEQ ID NO: 28611

SEQ ID NO: 701872 - RNA, 64 nt, hsa; identical to SEQ ID NO: 28612

SEQ ID NO: 701873 - RNA, 64 nt, hsa; identical to SEQ ID NO: 28613

SEQ ID NO: 701874 - RNA, 64 nt, hsa; identical to SEQ ID NO: 28614

SEQ ID NO: 701875 - RNA, 64 nt, hsa; identical to SEQ ID NO: 28615

SEQ ID NO: 701876 - RNA, 64 nt, hsa; identical to SEQ ID NO: 28616

SEQ ID NO: 701877 - RNA, 64 nt, hsa; identical to SEQ ID NO: 28617

SEQ ID NO: 701878 - RNA, 64 nt, hsa; identical to SEQ ID NO: 28618

SEQ ID NO: 701879 - RNA, 64 nt, hsa; identical to SEQ ID NO: 28619

SEQ ID NO: 701880 - RNA, 64 nt, hsa; identical to SEQ ID NO: 28620

SEQ ID NO: 701881 - RNA, 64 nt, hsa; identical to SEQ ID NO: 28549

SEQ ID NO: 701882 - RNA, 64 nt, hsa; identical to SEQ ID NO: 28622

SEQ ID NO: 701883 - RNA, 64 nt, hsa; identical to SEQ ID NO: 28623

SEQ ID NO: 701884 - RNA, 64 nt, hsa; identical to SEQ ID NO: 28624

SEQ ID NO: 701885 - RNA, 64 nt, hsa; identical to SEQ ID NO: 28625

SEQ ID NO: 701886 - RNA, 64 nt, hsa; identical to SEQ ID NO: 28626

SEQ ID NO: 701887 - RNA, 64 nt, hsa; identical to SEQ ID NO: 28627

SEQ ID NO: 701888 - RNA, 64 nt, hsa; identical to SEQ ID NO: 28628

SEQ ID NO: 701889 - RNA, 64 nt, hsa; identical to SEQ ID NO: 28629

SEQ ID NO: 701890 - RNA, 64 nt, hsa; identical to SEQ ID NO: 28630

SEQ ID NO: 701891 - RNA, 64 nt, hsa; identical to SEQ ID NO: 28631

SEQ ID NO: 701892 - RNA, 64 nt, hsa; identical to SEQ ID NO: 28632

SEQ ID NO: 701893 - RNA, 64 nt, hsa; identical to SEQ ID NO: 28633

SEQ ID NO: 701894 - RNA, 64 nt, hsa; identical to SEQ ID NO: 28634

SEQ ID NO: 701895 - RNA, 64 nt, hsa; identical to SEQ ID NO: 28635

SEQ ID NO: 701896 - RNA, 64 nt, hsa; identical to SEQ ID NO: 28636

SEQ ID NO: 701897 - RNA, 64 nt, hsa; identical to SEQ ID NO: 28637

SEQ ID NO: 701898 - RNA, 64 nt, hsa; identical to SEQ ID NO: 28638

SEQ ID NO: 701899 - RNA, 64 nt, hsa; identical to SEQ ID NO: 28639

SEQ ID NO: 701900 - RNA, 64 nt, hsa; identical to SEQ ID NO: 28640

SEQ ID NO: 701901 - RNA, 64 nt, hsa; identical to SEQ ID NO: 28641

SEQ ID NO: 701902 - RNA, 64 nt, hsa; identical to SEQ ID NO: 28642

SEQ ID NO: 701903 - RNA, 64 nt, hsa; identical to SEQ ID NO: 28643

SEQ ID NO: 701904 - RNA, 64 nt, hsa; identical to SEQ ID NO: 28644

SEQ ID NO: 701905 - RNA, 64 nt, hsa; identical to SEQ ID NO: 28645

SEQ ID NO: 701906 - RNA, 64 nt, hsa; identical to SEQ ID NO: 28646

SEQ ID NO: 701907 - RNA, 64 nt, hsa; identical to SEQ ID NO: 28647

SEQ ID NO: 701908 - RNA, 64 nt, hsa; identical to SEQ ID NO: 28648

SEQ ID NO: 701909 - RNA, 64 nt, hsa; identical to SEQ ID NO: 28649

SEQ ID NO: 701910 - RNA, 64 nt, hsa; identical to SEQ ID NO: 28650

SEQ ID NO: 701911 - RNA, 64 nt, hsa; identical to SEQ ID NO: 28651

SEQ ID NO: 701912 - RNA, 64 nt, hsa; identical to SEQ ID NO: 28652

SEQ ID NO: 701913 - RNA, 64 nt, hsa; identical to SEQ ID NO: 28653

SEQ ID NO: 701914 - RNA, 64 nt, hsa; identical to SEQ ID NO: 28654

SEQ ID NO: 701915 - RNA, 64 nt, hsa; identical to SEQ ID NO: 28655

SEQ ID NO: 701916 - RNA, 64 nt, hsa; identical to SEQ ID NO: 28656

SEQ ID NO: 701917 - RNA, 64 nt, hsa; identical to SEQ ID NO: 28657

SEQ ID NO: 701918 - RNA, 64 nt, hsa; identical to SEQ ID NO: 28658

SEQ ID NO: 701919 - RNA, 64 nt, hsa; identical to SEQ ID NO: 28659

SEQ ID NO: 701920 - RNA, 64 nt, hsa; identical to SEQ ID NO: 28660

SEQ ID NO: 701921 - RNA, 64 nt, hsa; identical to SEQ ID NO: 28661

SEQ ID NO: 701922 - RNA, 64 nt, hsa; identical to SEQ ID NO: 28662

SEQ ID NO: 701923 - RNA, 64 nt, hsa; identical to SEQ ID NO: 28663

SEQ ID NO: 701924 - RNA, 64 nt, hsa; identical to SEQ ID NO: 28664

SEQ ID NO: 701925 - RNA, 64 nt, hsa; identical to SEQ ID NO: 28665

SEQ ID NO: 701926 - RNA, 64 nt, hsa; identical to SEQ ID NO: 28666

SEQ ID NO: 701927 - RNA, 64 nt, hsa; identical to SEQ ID NO: 28667

SEQ ID NO: 701928 - RNA, 64 nt, hsa; identical to SEQ ID NO: 28668

SEQ ID NO: 701929 - RNA, 64 nt, hsa; identical to SEQ ID NO: 28669

SEQ ID NO: 701930 - RNA, 64 nt, hsa; identical to SEQ ID NO: 28670

SEQ ID NO: 701931 - RNA, 64 nt, hsa; identical to SEQ ID NO: 28671

SEQ ID NO: 701932 - RNA, 64 nt, hsa; identical to SEQ ID NO: 28672

SEQ ID NO: 701933 - RNA, 64 nt, hsa; identical to SEQ ID NO: 28673

SEQ ID NO: 701934 - RNA, 64 nt, hsa; identical to SEQ ID NO: 28674

SEQ ID NO: 701935 - RNA, 64 nt, hsa; identical to SEQ ID NO: 28675

SEQ ID NO: 701936 - RNA, 64 nt, hsa; identical to SEQ ID NO: 28676

SEQ ID NO: 701937 - RNA, 64 nt, hsa; identical to SEQ ID NO: 28677

SEQ ID NO: 701938 - RNA, 64 nt, hsa; identical to SEQ ID NO: 28678

SEQ ID NO: 701939 - RNA, 64 nt, hsa; identical to SEQ ID NO: 28679

SEQ ID NO: 701940 - RNA, 64 nt, hsa; identical to SEQ ID NO: 28680

SEQ ID NO: 701941 - RNA, 64 nt, hsa; identical to SEQ ID NO: 28681

SEQ ID NO: 701942 - RNA, 64 nt, hsa; identical to SEQ ID NO: 28682

SEQ ID NO: 701943 - RNA, 64 nt, hsa; identical to SEQ ID NO: 28683

SEQ ID NO: 701944 - RNA, 64 nt, hsa; identical to SEQ ID NO: 28684

SEQ ID NO: 701945 - RNA, 64 nt, hsa; identical to SEQ ID NO: 28685

SEQ ID NO: 701946 - RNA, 64 nt, hsa; identical to SEQ ID NO: 28686

SEQ ID NO: 701947 - RNA, 64 nt, hsa; identical to SEQ ID NO: 28687

SEQ ID NO: 701948 - RNA, 64 nt, hsa; identical to SEQ ID NO: 28688

SEQ ID NO: 701949 - RNA, 64 nt, hsa; identical to SEQ ID NO: 28689

SEQ ID NO: 701950 - RNA, 64 nt, hsa; identical to SEQ ID NO: 28690

SEQ ID NO: 701951 - RNA, 64 nt, hsa; identical to SEQ ID NO: 28691

SEQ ID NO: 701952 - RNA, 64 nt, hsa; identical to SEQ ID NO: 28692

SEQ ID NO: 701953 - RNA, 64 nt, hsa; identical to SEQ ID NO: 28693

SEQ ID NO: 701954 - RNA, 64 nt, hsa; identical to SEQ ID NO: 28694

SEQ ID NO: 701955 - RNA, 64 nt, hsa; identical to SEQ ID NO: 28695

SEQ ID NO: 701956 - RNA, 64 nt, hsa; identical to SEQ ID NO: 28696

SEQ ID NO: 701957 - RNA, 64 nt, hsa; identical to SEQ ID NO: 28697

SEQ ID NO: 701958 - RNA, 64 nt, hsa; identical to SEQ ID NO: 28698

SEQ ID NO: 701959 - RNA, 64 nt, hsa; identical to SEQ ID NO: 28699

SEQ ID NO: 701960 - RNA, 64 nt, hsa; identical to SEQ ID NO: 28700

SEQ ID NO: 701961 - RNA, 64 nt, hsa; identical to SEQ ID NO: 28701

SEQ ID NO: 701962 - RNA, 64 nt, hsa; identical to SEQ ID NO: 28702

SEQ ID NO: 701963 - RNA, 64 nt, hsa; identical to SEQ ID NO: 28703

SEQ ID NO: 701964 - RNA, 64 nt, hsa; identical to SEQ ID NO: 28704

SEQ ID NO: 701965 - RNA, 64 nt, hsa; identical to SEQ ID NO: 28705

SEQ ID NO: 701966 - RNA, 64 nt, hsa; identical to SEQ ID NO: 28706

SEQ ID NO: 701967 - RNA, 64 nt, hsa; identical to SEQ ID NO: 28707

SEQ ID NO: 701968 - RNA, 64 nt, hsa; identical to SEQ ID NO: 28708

SEQ ID NO: 701969 - RNA, 64 nt, hsa; identical to SEQ ID NO: 28709

SEQ ID NO: 701970 - RNA, 64 nt, hsa; identical to SEQ ID NO: 28710

SEQ ID NO: 701971 - RNA, 64 nt, hsa; identical to SEQ ID NO: 28711

SEQ ID NO: 701972 - RNA, 64 nt, hsa; identical to SEQ ID NO: 28712

SEQ ID NO: 701973 - RNA, 64 nt, hsa; identical to SEQ ID NO: 28713

SEQ ID NO: 701974 - RNA, 64 nt, hsa; identical to SEQ ID NO: 28714

SEQ ID NO: 701975 - RNA, 64 nt, hsa; identical to SEQ ID NO: 28715

SEQ ID NO: 701976 - RNA, 64 nt, hsa; identical to SEQ ID NO: 28716

SEQ ID NO: 701977 - RNA, 64 nt, hsa; identical to SEQ ID NO: 28717

SEQ ID NO: 701978 - RNA, 64 nt, hsa; identical to SEQ ID NO: 28718

SEQ ID NO: 701979 - RNA, 64 nt, hsa; identical to SEQ ID NO: 28719

SEQ ID NO: 701980 - RNA, 64 nt, hsa; identical to SEQ ID NO: 28720

SEQ ID NO: 701981 - RNA, 64 nt, hsa; identical to SEQ ID NO: 28721

SEQ ID NO: 701982 - RNA, 64 nt, hsa; identical to SEQ ID NO: 28722

SEQ ID NO: 701983 - RNA, 64 nt, hsa; identical to SEQ ID NO: 28723

SEQ ID NO: 701984 - RNA, 64 nt, hsa; identical to SEQ ID NO: 28724

SEQ ID NO: 701985 - RNA, 64 nt, hsa; identical to SEQ ID NO: 28725

SEQ ID NO: 701986 - RNA, 64 nt, hsa; identical to SEQ ID NO: 28726

SEQ ID NO: 701987 - RNA, 64 nt, hsa; identical to SEQ ID NO: 28727

SEQ ID NO: 701988 - RNA, 64 nt, hsa; identical to SEQ ID NO: 28728

SEQ ID NO: 701989 - RNA, 64 nt, hsa; identical to SEQ ID NO: 28729

SEQ ID NO: 701990 - RNA, 64 nt, hsa; identical to SEQ ID NO: 28730

SEQ ID NO: 701991 - RNA, 64 nt, hsa; identical to SEQ ID NO: 28731

SEQ ID NO: 701992 - RNA, 64 nt, hsa; identical to SEQ ID NO: 28732

SEQ ID NO: 701993 - RNA, 64 nt, hsa; identical to SEQ ID NO: 28733

SEQ ID NO: 701994 - RNA, 64 nt, hsa; identical to SEQ ID NO: 28734

SEQ ID NO: 701995 - RNA, 64 nt, hsa; identical to SEQ ID NO: 28735

SEQ ID NO: 701996 - RNA, 64 nt, hsa; identical to SEQ ID NO: 28736

SEQ ID NO: 701997 - RNA, 64 nt, hsa; identical to SEQ ID NO: 28737

SEQ ID NO: 701998 - RNA, 64 nt, hsa; identical to SEQ ID NO: 28738

SEQ ID NO: 701999 - RNA, 64 nt, hsa; identical to SEQ ID NO: 28739

SEQ ID NO: 702000 - RNA, 64 nt, hsa; identical to SEQ ID NO: 28740

SEQ ID NO: 702001 - RNA, 64 nt, hsa; identical to SEQ ID NO: 28741

SEQ ID NO: 702002 - RNA, 64 nt, hsa; identical to SEQ ID NO: 28742

SEQ ID NO: 702003 - RNA, 64 nt, hsa; identical to SEQ ID NO: 28743

SEQ ID NO: 702004 - RNA, 64 nt, hsa; identical to SEQ ID NO: 28744

SEQ ID NO: 702005 - RNA, 64 nt, hsa; identical to SEQ ID NO: 28745

SEQ ID NO: 702006 - RNA, 64 nt, hsa; identical to SEQ ID NO: 28746

SEQ ID NO: 702007 - RNA, 64 nt, hsa; identical to SEQ ID NO: 28747

SEQ ID NO: 702008 - RNA, 64 nt, hsa; identical to SEQ ID NO: 28748

SEQ ID NO: 702009 - RNA, 64 nt, hsa; identical to SEQ ID NO: 28749

SEQ ID NO: 702010 - RNA, 64 nt, hsa; identical to SEQ ID NO: 28750

SEQ ID NO: 702011 - RNA, 64 nt, hsa; identical to SEQ ID NO: 28751

SEQ ID NO: 702012 - RNA, 64 nt, hsa; identical to SEQ ID NO: 28752

SEQ ID NO: 702013 - RNA, 64 nt, hsa; identical to SEQ ID NO: 28753

SEQ ID NO: 702014 - RNA, 64 nt, hsa; identical to SEQ ID NO: 28754

SEQ ID NO: 702015 - RNA, 64 nt, hsa; identical to SEQ ID NO: 28755

SEQ ID NO: 702016 - RNA, 64 nt, hsa; identical to SEQ ID NO: 28756

SEQ ID NO: 702017 - RNA, 64 nt, hsa; identical to SEQ ID NO: 28757

SEQ ID NO: 702018 - RNA, 64 nt, hsa; identical to SEQ ID NO: 28758

SEQ ID NO: 702019 - RNA, 64 nt, hsa; identical to SEQ ID NO: 28759

SEQ ID NO: 702020 - RNA, 64 nt, hsa; identical to SEQ ID NO: 28760

SEQ ID NO: 702021 - RNA, 64 nt, hsa; identical to SEQ ID NO: 28761

SEQ ID NO: 702022 - RNA, 64 nt, hsa; identical to SEQ ID NO: 28762

SEQ ID NO: 702023 - RNA, 64 nt, hsa; identical to SEQ ID NO: 28763

SEQ ID NO: 702024 - RNA, 64 nt, hsa; identical to SEQ ID NO: 28764

SEQ ID NO: 702025 - RNA, 64 nt, hsa; identical to SEQ ID NO: 28765

SEQ ID NO: 702026 - RNA, 64 nt, hsa; identical to SEQ ID NO: 28766

SEQ ID NO: 702027 - RNA, 64 nt, hsa; identical to SEQ ID NO: 28767

SEQ ID NO: 702028 - RNA, 64 nt, hsa; identical to SEQ ID NO: 28768

SEQ ID NO: 702029 - RNA, 64 nt, hsa; identical to SEQ ID NO: 28769

SEQ ID NO: 702030 - RNA, 64 nt, hsa; identical to SEQ ID NO: 28770

SEQ ID NO: 702031 - RNA, 64 nt, hsa; identical to SEQ ID NO: 28771

SEQ ID NO: 702032 - RNA, 64 nt, hsa; identical to SEQ ID NO: 28772

SEQ ID NO: 702033 - RNA, 64 nt, hsa; identical to SEQ ID NO: 28773

SEQ ID NO: 702034 - RNA, 64 nt, hsa; identical to SEQ ID NO: 28774

SEQ ID NO: 702035 - RNA, 64 nt, hsa; identical to SEQ ID NO: 28775

SEQ ID NO: 702036 - RNA, 64 nt, hsa; identical to SEQ ID NO: 28776

SEQ ID NO: 702037 - RNA, 64 nt, hsa; identical to SEQ ID NO: 28777

SEQ ID NO: 702038 - RNA, 64 nt, hsa; identical to SEQ ID NO: 28778

SEQ ID NO: 702039 - RNA, 64 nt, hsa; identical to SEQ ID NO: 28779

SEQ ID NO: 702040 - RNA, 64 nt, hsa; identical to SEQ ID NO: 28780

SEQ ID NO: 702041 - RNA, 64 nt, hsa; identical to SEQ ID NO: 28781

SEQ ID NO: 702042 - RNA, 64 nt, hsa; identical to SEQ ID NO: 28782

SEQ ID NO: 702043 - RNA, 64 nt, hsa; identical to SEQ ID NO: 28783

SEQ ID NO: 702044 - RNA, 64 nt, hsa; identical to SEQ ID NO: 28784

SEQ ID NO: 702045 - RNA, 64 nt, hsa; identical to SEQ ID NO: 28785

SEQ ID NO: 702046 - RNA, 64 nt, hsa; identical to SEQ ID NO: 28786

SEQ ID NO: 702047 - RNA, 64 nt, hsa; identical to SEQ ID NO: 28787

SEQ ID NO: 702048 - RNA, 64 nt, hsa; identical to SEQ ID NO: 28788

SEQ ID NO: 702049 - RNA, 64 nt, hsa; identical to SEQ ID NO: 28789

SEQ ID NO: 702050 - RNA, 64 nt, hsa; identical to SEQ ID NO: 28790

SEQ ID NO: 702051 - RNA, 64 nt, hsa; identical to SEQ ID NO: 28791

SEQ ID NO: 702052 - RNA, 64 nt, hsa; identical to SEQ ID NO: 28792

SEQ ID NO: 702053 - RNA, 64 nt, hsa; identical to SEQ ID NO: 28793

SEQ ID NO: 702054 - RNA, 64 nt, hsa; identical to SEQ ID NO: 28794

SEQ ID NO: 702055 - RNA, 64 nt, hsa; identical to SEQ ID NO: 28795

SEQ ID NO: 702056 - RNA, 64 nt, hsa; identical to SEQ ID NO: 28796

SEQ ID NO: 702057 - RNA, 64 nt, hsa; identical to SEQ ID NO: 28797

SEQ ID NO: 702058 - RNA, 64 nt, hsa; identical to SEQ ID NO: 28798

SEQ ID NO: 702059 - RNA, 64 nt, hsa; identical to SEQ ID NO: 28799

SEQ ID NO: 702060 - RNA, 64 nt, hsa; identical to SEQ ID NO: 28800

SEQ ID NO: 702061 - RNA, 64 nt, hsa; identical to SEQ ID NO: 28801

SEQ ID NO: 702062 - RNA, 64 nt, hsa; identical to SEQ ID NO: 28802

SEQ ID NO: 702063 - RNA, 64 nt, hsa; identical to SEQ ID NO: 28803

SEQ ID NO: 702064 - RNA, 64 nt, hsa; identical to SEQ ID NO: 28804

SEQ ID NO: 702065 - RNA, 64 nt, hsa; identical to SEQ ID NO: 28805

SEQ ID NO: 702066 - RNA, 64 nt, hsa; identical to SEQ ID NO: 28806

SEQ ID NO: 702067 - RNA, 64 nt, hsa; identical to SEQ ID NO: 28807

SEQ ID NO: 702068 - RNA, 64 nt, hsa; identical to SEQ ID NO: 28808

SEQ ID NO: 702069 - RNA, 64 nt, hsa; identical to SEQ ID NO: 28809

SEQ ID NO: 702070 - RNA, 64 nt, hsa; identical to SEQ ID NO: 28810

SEQ ID NO: 702071 - RNA, 64 nt, hsa; identical to SEQ ID NO: 28811

SEQ ID NO: 702072 - RNA, 64 nt, hsa; identical to SEQ ID NO: 28812

SEQ ID NO: 702073 - RNA, 64 nt, hsa; identical to SEQ ID NO: 28813

SEQ ID NO: 702074 - RNA, 64 nt, hsa; identical to SEQ ID NO: 28814

SEQ ID NO: 702075 - RNA, 64 nt, hsa; identical to SEQ ID NO: 28815

SEQ ID NO: 702076 - RNA, 64 nt, hsa; identical to SEQ ID NO: 28816

SEQ ID NO: 702077 - RNA, 64 nt, hsa; identical to SEQ ID NO: 28817

SEQ ID NO: 702078 - RNA, 64 nt, hsa; identical to SEQ ID NO: 28818

SEQ ID NO: 702079 - RNA, 64 nt, hsa; identical to SEQ ID NO: 28819

SEQ ID NO: 702080 - RNA, 64 nt, hsa; identical to SEQ ID NO: 28820

SEQ ID NO: 702081 - RNA, 64 nt, hsa; identical to SEQ ID NO: 28821

SEQ ID NO: 702082 - RNA, 64 nt, hsa; identical to SEQ ID NO: 28822

SEQ ID NO: 702083 - RNA, 64 nt, hsa; identical to SEQ ID NO: 28823

SEQ ID NO: 702084 - RNA, 64 nt, hsa; identical to SEQ ID NO: 28824

SEQ ID NO: 702085 - RNA, 64 nt, hsa; identical to SEQ ID NO: 28825

SEQ ID NO: 702086 - RNA, 64 nt, hsa; identical to SEQ ID NO: 28826

SEQ ID NO: 702087 - RNA, 64 nt, hsa; identical to SEQ ID NO: 28827

SEQ ID NO: 702088 - RNA, 64 nt, hsa; identical to SEQ ID NO: 28828

SEQ ID NO: 702089 - RNA, 64 nt, hsa; identical to SEQ ID NO: 28829

SEQ ID NO: 702090 - RNA, 64 nt, hsa; identical to SEQ ID NO: 28830

SEQ ID NO: 702091 - RNA, 64 nt, hsa; identical to SEQ ID NO: 28831

SEQ ID NO: 702092 - RNA, 64 nt, hsa; identical to SEQ ID NO: 28832

SEQ ID NO: 702093 - RNA, 64 nt, hsa; identical to SEQ ID NO: 28833

SEQ ID NO: 702094 - RNA, 64 nt, hsa; identical to SEQ ID NO: 28834

SEQ ID NO: 702095 - RNA, 64 nt, hsa; identical to SEQ ID NO: 28835

SEQ ID NO: 702096 - RNA, 64 nt, hsa; identical to SEQ ID NO: 28836

SEQ ID NO: 702097 - RNA, 64 nt, hsa; identical to SEQ ID NO: 28837

SEQ ID NO: 702098 - RNA, 64 nt, hsa; identical to SEQ ID NO: 28838

SEQ ID NO: 702099 - RNA, 64 nt, hsa; identical to SEQ ID NO: 28839

SEQ ID NO: 702100 - RNA, 64 nt, hsa; identical to SEQ ID NO: 28840

SEQ ID NO: 702101 - RNA, 64 nt, hsa; identical to SEQ ID NO: 28841

SEQ ID NO: 702102 - RNA, 64 nt, hsa; identical to SEQ ID NO: 28842

SEQ ID NO: 702103 - RNA, 64 nt, hsa; identical to SEQ ID NO: 28843

SEQ ID NO: 702104 - RNA, 64 nt, hsa; identical to SEQ ID NO: 28844

SEQ ID NO: 702105 - RNA, 64 nt, hsa; identical to SEQ ID NO: 28845

SEQ ID NO: 702106 - RNA, 64 nt, hsa; identical to SEQ ID NO: 28846

SEQ ID NO: 702107 - RNA, 64 nt, hsa; identical to SEQ ID NO: 28847

SEQ ID NO: 702108 - RNA, 64 nt, hsa; identical to SEQ ID NO: 28848

SEQ ID NO: 702109 - RNA, 64 nt, hsa; identical to SEQ ID NO: 28849

SEQ ID NO: 702110 - RNA, 64 nt, hsa; identical to SEQ ID NO: 28850

SEQ ID NO: 702111 - RNA, 64 nt, hsa; identical to SEQ ID NO: 28851

SEQ ID NO: 702112 - RNA, 64 nt, hsa; identical to SEQ ID NO: 28852

SEQ ID NO: 702113 - RNA, 64 nt, hsa; identical to SEQ ID NO: 28853

SEQ ID NO: 702114 - RNA, 64 nt, hsa; identical to SEQ ID NO: 28854

SEQ ID NO: 702115 - RNA, 64 nt, hsa; identical to SEQ ID NO: 28855

SEQ ID NO: 702116 - RNA, 64 nt, hsa; identical to SEQ ID NO: 28856

SEQ ID NO: 702117 - RNA, 64 nt, hsa; identical to SEQ ID NO: 28857

SEQ ID NO: 702118 - RNA, 63 nt, hsa; identical to SEQ ID NO: 28858

SEQ ID NO: 702119 - RNA, 62 nt, hsa; identical to SEQ ID NO: 28859

SEQ ID NO: 702120 - RNA, 64 nt, hsa; identical to SEQ ID NO: 28860

SEQ ID NO: 702121 - RNA, 64 nt, hsa; identical to SEQ ID NO: 28861

SEQ ID NO: 702122 - RNA, 64 nt, hsa; identical to SEQ ID NO: 28862

SEQ ID NO: 702123 - RNA, 64 nt, hsa; identical to SEQ ID NO: 28863

SEQ ID NO: 702124 - RNA, 64 nt, hsa; identical to SEQ ID NO: 28864

SEQ ID NO: 702125 - RNA, 64 nt, hsa; identical to SEQ ID NO: 28865

SEQ ID NO: 702126 - RNA, 64 nt, hsa; identical to SEQ ID NO: 28866

SEQ ID NO: 702127 - RNA, 64 nt, hsa; identical to SEQ ID NO: 28867

SEQ ID NO: 702128 - RNA, 64 nt, hsa; identical to SEQ ID NO: 28868

SEQ ID NO: 702129 - RNA, 64 nt, hsa; identical to SEQ ID NO: 28869

SEQ ID NO: 702130 - RNA, 64 nt, hsa; identical to SEQ ID NO: 28870

SEQ ID NO: 702131 - RNA, 64 nt, hsa; identical to SEQ ID NO: 28871

SEQ ID NO: 702132 - RNA, 64 nt, hsa; identical to SEQ ID NO: 28872

SEQ ID NO: 702133 - RNA, 64 nt, hsa; identical to SEQ ID NO: 28873

SEQ ID NO: 702134 - RNA, 64 nt, hsa; identical to SEQ ID NO: 28874

SEQ ID NO: 702135 - RNA, 64 nt, hsa; identical to SEQ ID NO: 28875

SEQ ID NO: 702136 - RNA, 64 nt, hsa; identical to SEQ ID NO: 28876

SEQ ID NO: 702137 - RNA, 64 nt, hsa; identical to SEQ ID NO: 28877

SEQ ID NO: 702138 - RNA, 64 nt, hsa; identical to SEQ ID NO: 28878

SEQ ID NO: 702139 - RNA, 64 nt, hsa; identical to SEQ ID NO: 28879

SEQ ID NO: 702140 - RNA, 64 nt, hsa; identical to SEQ ID NO: 28880

SEQ ID NO: 702141 - RNA, 64 nt, hsa; identical to SEQ ID NO: 28881

SEQ ID NO: 702142 - RNA, 64 nt, hsa; identical to SEQ ID NO: 28882

SEQ ID NO: 702143 - RNA, 64 nt, hsa; identical to SEQ ID NO: 28883

SEQ ID NO: 702144 - RNA, 64 nt, hsa; identical to SEQ ID NO: 28884

SEQ ID NO: 702145 - RNA, 64 nt, hsa; identical to SEQ ID NO: 28885

SEQ ID NO: 702146 - RNA, 64 nt, hsa; identical to SEQ ID NO: 28886

SEQ ID NO: 702147 - RNA, 64 nt, hsa; identical to SEQ ID NO: 28887

SEQ ID NO: 702148 - RNA, 64 nt, hsa; identical to SEQ ID NO: 28888

SEQ ID NO: 702149 - RNA, 64 nt, hsa; identical to SEQ ID NO: 28889

SEQ ID NO: 702150 - RNA, 64 nt, hsa; identical to SEQ ID NO: 28890

SEQ ID NO: 702151 - RNA, 64 nt, hsa; identical to SEQ ID NO: 28891

SEQ ID NO: 702152 - RNA, 64 nt, hsa; identical to SEQ ID NO: 28892

SEQ ID NO: 702153 - RNA, 64 nt, hsa; identical to SEQ ID NO: 28893

SEQ ID NO: 702154 - RNA, 64 nt, hsa; identical to SEQ ID NO: 28894

SEQ ID NO: 702155 - RNA, 64 nt, hsa; identical to SEQ ID NO: 28895

SEQ ID NO: 702156 - RNA, 64 nt, hsa; identical to SEQ ID NO: 28896

SEQ ID NO: 702157 - RNA, 64 nt, hsa; identical to SEQ ID NO: 28897

SEQ ID NO: 702158 - RNA, 64 nt, hsa; identical to SEQ ID NO: 28898

SEQ ID NO: 702159 - RNA, 64 nt, hsa; identical to SEQ ID NO: 28899

SEQ ID NO: 702160 - RNA, 64 nt, hsa; identical to SEQ ID NO: 28900

SEQ ID NO: 702161 - RNA, 64 nt, hsa; identical to SEQ ID NO: 28901

SEQ ID NO: 702162 - RNA, 64 nt, hsa; identical to SEQ ID NO: 28902

SEQ ID NO: 702163 - RNA, 64 nt, hsa; identical to SEQ ID NO: 28903

SEQ ID NO: 702164 - RNA, 64 nt, hsa; identical to SEQ ID NO: 28904

SEQ ID NO: 702165 - RNA, 64 nt, hsa; identical to SEQ ID NO: 28905

SEQ ID NO: 702166 - RNA, 64 nt, hsa; identical to SEQ ID NO: 28906

SEQ ID NO: 702167 - RNA, 64 nt, hsa; identical to SEQ ID NO: 28907

SEQ ID NO: 702168 - RNA, 64 nt, hsa; identical to SEQ ID NO: 28908

SEQ ID NO: 702169 - RNA, 64 nt, hsa; identical to SEQ ID NO: 28909

SEQ ID NO: 702170 - RNA, 64 nt, hsa; identical to SEQ ID NO: 28910

SEQ ID NO: 702171 - RNA, 64 nt, hsa; identical to SEQ ID NO: 28911

SEQ ID NO: 702172 - RNA, 64 nt, hsa; identical to SEQ ID NO: 28912

SEQ ID NO: 702173 - RNA, 64 nt, hsa; identical to SEQ ID NO: 28913

SEQ ID NO: 702174 - RNA, 64 nt, hsa; identical to SEQ ID NO: 28914

SEQ ID NO: 702175 - RNA, 64 nt, hsa; identical to SEQ ID NO: 28915

SEQ ID NO: 702176 - RNA, 64 nt, hsa; identical to SEQ ID NO: 28916

SEQ ID NO: 702177 - RNA, 64 nt, hsa; identical to SEQ ID NO: 28917

SEQ ID NO: 702178 - RNA, 64 nt, hsa; identical to SEQ ID NO: 28918

SEQ ID NO: 702179 - RNA, 64 nt, hsa; identical to SEQ ID NO: 28919

SEQ ID NO: 702180 - RNA, 64 nt, hsa; identical to SEQ ID NO: 28920

SEQ ID NO: 702181 - RNA, 64 nt, hsa; identical to SEQ ID NO: 28921

SEQ ID NO: 702182 - RNA, 64 nt, hsa; identical to SEQ ID NO: 28922

SEQ ID NO: 702183 - RNA, 64 nt, hsa; identical to SEQ ID NO: 28923

SEQ ID NO: 702184 - RNA, 64 nt, hsa; identical to SEQ ID NO: 28924

SEQ ID NO: 702185 - RNA, 64 nt, hsa; identical to SEQ ID NO: 28925

SEQ ID NO: 702186 - RNA, 64 nt, hsa; identical to SEQ ID NO: 28926

SEQ ID NO: 702187 - RNA, 64 nt, hsa; identical to SEQ ID NO: 28927

SEQ ID NO: 702188 - RNA, 64 nt, hsa; identical to SEQ ID NO: 28928

SEQ ID NO: 702189 - RNA, 64 nt, hsa; identical to SEQ ID NO: 28929

SEQ ID NO: 702190 - RNA, 64 nt, hsa; identical to SEQ ID NO: 28930

SEQ ID NO: 702191 - RNA, 64 nt, hsa; identical to SEQ ID NO: 28931

SEQ ID NO: 702192 - RNA, 64 nt, hsa; identical to SEQ ID NO: 28932

SEQ ID NO: 702193 - RNA, 64 nt, hsa; identical to SEQ ID NO: 28933

SEQ ID NO: 702194 - RNA, 64 nt, hsa; identical to SEQ ID NO: 28934

SEQ ID NO: 702195 - RNA, 64 nt, hsa; identical to SEQ ID NO: 28935

SEQ ID NO: 702196 - RNA, 64 nt, hsa; identical to SEQ ID NO: 28936

SEQ ID NO: 702197 - RNA, 64 nt, hsa; identical to SEQ ID NO: 28937

SEQ ID NO: 702198 - RNA, 64 nt, hsa; identical to SEQ ID NO: 28938

SEQ ID NO: 702199 - RNA, 64 nt, hsa; identical to SEQ ID NO: 28939

SEQ ID NO: 702200 - RNA, 64 nt, hsa; identical to SEQ ID NO: 28940

SEQ ID NO: 702201 - RNA, 64 nt, hsa; identical to SEQ ID NO: 28941

SEQ ID NO: 702202 - RNA, 64 nt, hsa; identical to SEQ ID NO: 28942

SEQ ID NO: 702203 - RNA, 64 nt, hsa; identical to SEQ ID NO: 28943

SEQ ID NO: 702204 - RNA, 64 nt, hsa; identical to SEQ ID NO: 28944

SEQ ID NO: 702205 - RNA, 64 nt, hsa; identical to SEQ ID NO: 28945

SEQ ID NO: 702206 - RNA, 64 nt, hsa; identical to SEQ ID NO: 28946

SEQ ID NO: 702207 - RNA, 64 nt, hsa; identical to SEQ ID NO: 28947

SEQ ID NO: 702208 - RNA, 64 nt, hsa; identical to SEQ ID NO: 28948

SEQ ID NO: 702209 - RNA, 64 nt, hsa; identical to SEQ ID NO: 28949

SEQ ID NO: 702210 - RNA, 64 nt, hsa; identical to SEQ ID NO: 28950

SEQ ID NO: 702211 - RNA, 64 nt, hsa; identical to SEQ ID NO: 28951

SEQ ID NO: 702212 - RNA, 64 nt, hsa; identical to SEQ ID NO: 28952

SEQ ID NO: 702213 - RNA, 64 nt, hsa; identical to SEQ ID NO: 28953

SEQ ID NO: 702214 - RNA, 64 nt, hsa; identical to SEQ ID NO: 28954

SEQ ID NO: 702215 - RNA, 64 nt, hsa; identical to SEQ ID NO: 28955

SEQ ID NO: 702216 - RNA, 64 nt, hsa; identical to SEQ ID NO: 28956

SEQ ID NO: 702217 - RNA, 64 nt, hsa; identical to SEQ ID NO: 28957

SEQ ID NO: 702218 - RNA, 64 nt, hsa; identical to SEQ ID NO: 28958

SEQ ID NO: 702219 - RNA, 64 nt, hsa; identical to SEQ ID NO: 28959

SEQ ID NO: 702220 - RNA, 64 nt, hsa; identical to SEQ ID NO: 28960

SEQ ID NO: 702221 - RNA, 64 nt, hsa; identical to SEQ ID NO: 28961

SEQ ID NO: 702222 - RNA, 64 nt, hsa; identical to SEQ ID NO: 28962

SEQ ID NO: 702223 - RNA, 64 nt, hsa; identical to SEQ ID NO: 28963

SEQ ID NO: 702224 - RNA, 64 nt, hsa; identical to SEQ ID NO: 28964

SEQ ID NO: 702225 - RNA, 64 nt, hsa; identical to SEQ ID NO: 28965

SEQ ID NO: 702226 - RNA, 64 nt, hsa; identical to SEQ ID NO: 28966

SEQ ID NO: 702227 - RNA, 64 nt, hsa; identical to SEQ ID NO: 28967

SEQ ID NO: 702228 - RNA, 64 nt, hsa; identical to SEQ ID NO: 28968

SEQ ID NO: 702229 - RNA, 64 nt, hsa; identical to SEQ ID NO: 28969

SEQ ID NO: 702230 - RNA, 64 nt, hsa; identical to SEQ ID NO: 28970

SEQ ID NO: 702231 - RNA, 64 nt, hsa; identical to SEQ ID NO: 28971

SEQ ID NO: 702232 - RNA, 64 nt, hsa; identical to SEQ ID NO: 28972

SEQ ID NO: 702233 - RNA, 64 nt, hsa; identical to SEQ ID NO: 28973

SEQ ID NO: 702234 - RNA, 64 nt, hsa; identical to SEQ ID NO: 28974

SEQ ID NO: 702235 - RNA, 64 nt, hsa; identical to SEQ ID NO: 28975

SEQ ID NO: 702236 - RNA, 64 nt, hsa; identical to SEQ ID NO: 28976

SEQ ID NO: 702237 - RNA, 64 nt, hsa; identical to SEQ ID NO: 28977

SEQ ID NO: 702238 - RNA, 64 nt, hsa; identical to SEQ ID NO: 28978

SEQ ID NO: 702239 - RNA, 64 nt, hsa; identical to SEQ ID NO: 28979

SEQ ID NO: 702240 - RNA, 64 nt, hsa; identical to SEQ ID NO: 28980

SEQ ID NO: 702241 - RNA, 64 nt, hsa; identical to SEQ ID NO: 28981

SEQ ID NO: 702242 - RNA, 64 nt, hsa; identical to SEQ ID NO: 28982

SEQ ID NO: 702243 - RNA, 64 nt, hsa; identical to SEQ ID NO: 28983

SEQ ID NO: 702244 - RNA, 64 nt, hsa; identical to SEQ ID NO: 28984

SEQ ID NO: 702245 - RNA, 64 nt, hsa; identical to SEQ ID NO: 28985

SEQ ID NO: 702246 - RNA, 64 nt, hsa; identical to SEQ ID NO: 28986

SEQ ID NO: 702247 - RNA, 64 nt, hsa; identical to SEQ ID NO: 28987

SEQ ID NO: 702248 - RNA, 64 nt, hsa; identical to SEQ ID NO: 28988

SEQ ID NO: 702249 - RNA, 64 nt, hsa; identical to SEQ ID NO: 28989

SEQ ID NO: 702250 - RNA, 64 nt, hsa; identical to SEQ ID NO: 28990

SEQ ID NO: 702251 - RNA, 64 nt, hsa; identical to SEQ ID NO: 28991

SEQ ID NO: 702252 - RNA, 64 nt, hsa; identical to SEQ ID NO: 28992

SEQ ID NO: 702253 - RNA, 64 nt, hsa; identical to SEQ ID NO: 28993

SEQ ID NO: 702254 - RNA, 64 nt, hsa; identical to SEQ ID NO: 28994

SEQ ID NO: 702255 - RNA, 64 nt, hsa; identical to SEQ ID NO: 28995

SEQ ID NO: 702256 - RNA, 64 nt, hsa; identical to SEQ ID NO: 28996

SEQ ID NO: 702257 - RNA, 64 nt, hsa; identical to SEQ ID NO: 28997

SEQ ID NO: 702258 - RNA, 64 nt, hsa; identical to SEQ ID NO: 28998

SEQ ID NO: 702259 - RNA, 64 nt, hsa; identical to SEQ ID NO: 28999

SEQ ID NO: 702260 - RNA, 64 nt, hsa; identical to SEQ ID NO: 29000

SEQ ID NO: 702261 - RNA, 64 nt, hsa; identical to SEQ ID NO: 29001

SEQ ID NO: 702262 - RNA, 64 nt, hsa; identical to SEQ ID NO: 29002

SEQ ID NO: 702263 - RNA, 64 nt, hsa; identical to SEQ ID NO: 29003

SEQ ID NO: 702264 - RNA, 64 nt, hsa; identical to SEQ ID NO: 29004

SEQ ID NO: 702265 - RNA, 64 nt, hsa; identical to SEQ ID NO: 29005

SEQ ID NO: 702266 - RNA, 64 nt, hsa; identical to SEQ ID NO: 29006

SEQ ID NO: 702267 - RNA, 64 nt, hsa; identical to SEQ ID NO: 29007

SEQ ID NO: 702268 - RNA, 64 nt, hsa; identical to SEQ ID NO: 29008

SEQ ID NO: 702269 - RNA, 64 nt, hsa; identical to SEQ ID NO: 29009

SEQ ID NO: 702270 - RNA, 64 nt, hsa; identical to SEQ ID NO: 29010

SEQ ID NO: 702271 - RNA, 64 nt, hsa; identical to SEQ ID NO: 29011

SEQ ID NO: 702272 - RNA, 64 nt, hsa; identical to SEQ ID NO: 29012

SEQ ID NO: 702273 - RNA, 64 nt, hsa; identical to SEQ ID NO: 29013

SEQ ID NO: 702274 - RNA, 64 nt, hsa; identical to SEQ ID NO: 29014

SEQ ID NO: 702275 - RNA, 64 nt, hsa; identical to SEQ ID NO: 29015

SEQ ID NO: 702276 - RNA, 64 nt, hsa; identical to SEQ ID NO: 29016

SEQ ID NO: 702277 - RNA, 64 nt, hsa; identical to SEQ ID NO: 29017

SEQ ID NO: 702278 - RNA, 64 nt, hsa; identical to SEQ ID NO: 29018

SEQ ID NO: 702279 - RNA, 64 nt, hsa; identical to SEQ ID NO: 29019

SEQ ID NO: 702280 - RNA, 64 nt, hsa; identical to SEQ ID NO: 29020

SEQ ID NO: 702281 - RNA, 64 nt, hsa; identical to SEQ ID NO: 29021

SEQ ID NO: 702282 - RNA, 64 nt, hsa; identical to SEQ ID NO: 29022

SEQ ID NO: 702283 - RNA, 64 nt, hsa; identical to SEQ ID NO: 29023

SEQ ID NO: 702284 - RNA, 64 nt, hsa; identical to SEQ ID NO: 29024

SEQ ID NO: 702285 - RNA, 64 nt, hsa; identical to SEQ ID NO: 29025

SEQ ID NO: 702286 - RNA, 64 nt, hsa; identical to SEQ ID NO: 29026

SEQ ID NO: 702287 - RNA, 64 nt, hsa; identical to SEQ ID NO: 29027

SEQ ID NO: 702288 - RNA, 64 nt, hsa; identical to SEQ ID NO: 29028

SEQ ID NO: 702289 - RNA, 64 nt, hsa; identical to SEQ ID NO: 29029

SEQ ID NO: 702290 - RNA, 64 nt, hsa; identical to SEQ ID NO: 29030

SEQ ID NO: 702291 - RNA, 64 nt, hsa; identical to SEQ ID NO: 29031

SEQ ID NO: 702292 - RNA, 64 nt, hsa; identical to SEQ ID NO: 29032

SEQ ID NO: 702293 - RNA, 64 nt, hsa; identical to SEQ ID NO: 29033

SEQ ID NO: 702294 - RNA, 64 nt, hsa; identical to SEQ ID NO: 29034

SEQ ID NO: 702295 - RNA, 64 nt, hsa; identical to SEQ ID NO: 29035

SEQ ID NO: 702296 - RNA, 64 nt, hsa; identical to SEQ ID NO: 29036

SEQ ID NO: 702297 - RNA, 64 nt, hsa; identical to SEQ ID NO: 29037

SEQ ID NO: 702298 - RNA, 64 nt, hsa; identical to SEQ ID NO: 29038

SEQ ID NO: 702299 - RNA, 64 nt, hsa; identical to SEQ ID NO: 29039

SEQ ID NO: 702300 - RNA, 64 nt, hsa; identical to SEQ ID NO: 29040

SEQ ID NO: 702301 - RNA, 64 nt, hsa; identical to SEQ ID NO: 29041

SEQ ID NO: 702302 - RNA, 64 nt, hsa; identical to SEQ ID NO: 29042

SEQ ID NO: 702303 - RNA, 64 nt, hsa; identical to SEQ ID NO: 29043

SEQ ID NO: 702304 - RNA, 64 nt, hsa; identical to SEQ ID NO: 29044

SEQ ID NO: 702305 - RNA, 64 nt, hsa; identical to SEQ ID NO: 29045

SEQ ID NO: 702306 - RNA, 64 nt, hsa; identical to SEQ ID NO: 29046

SEQ ID NO: 702307 - RNA, 64 nt, hsa; identical to SEQ ID NO: 29047

SEQ ID NO: 702308 - RNA, 64 nt, hsa; identical to SEQ ID NO: 29048

SEQ ID NO: 702309 - RNA, 64 nt, hsa; identical to SEQ ID NO: 29049

SEQ ID NO: 702310 - RNA, 64 nt, hsa; identical to SEQ ID NO: 29050

SEQ ID NO: 702311 - RNA, 64 nt, hsa; identical to SEQ ID NO: 29051

SEQ ID NO: 702312 - RNA, 64 nt, hsa; identical to SEQ ID NO: 29052

SEQ ID NO: 702313 - RNA, 64 nt, hsa; identical to SEQ ID NO: 29053

SEQ ID NO: 702314 - RNA, 64 nt, hsa; identical to SEQ ID NO: 29054

SEQ ID NO: 702315 - RNA, 64 nt, hsa; identical to SEQ ID NO: 29055

SEQ ID NO: 702316 - RNA, 64 nt, hsa; identical to SEQ ID NO: 29056

SEQ ID NO: 702317 - RNA, 64 nt, hsa; identical to SEQ ID NO: 29057

SEQ ID NO: 702318 - RNA, 64 nt, hsa; identical to SEQ ID NO: 29058

SEQ ID NO: 702319 - RNA, 64 nt, hsa; identical to SEQ ID NO: 29059

SEQ ID NO: 702320 - RNA, 64 nt, hsa; identical to SEQ ID NO: 29060

SEQ ID NO: 702321 - RNA, 64 nt, hsa; identical to SEQ ID NO: 29061

SEQ ID NO: 702322 - RNA, 64 nt, hsa; identical to SEQ ID NO: 29062

SEQ ID NO: 702323 - RNA, 64 nt, hsa; identical to SEQ ID NO: 29063

SEQ ID NO: 702324 - RNA, 64 nt, hsa; identical to SEQ ID NO: 29064

SEQ ID NO: 702325 - RNA, 64 nt, hsa; identical to SEQ ID NO: 29065

SEQ ID NO: 702326 - RNA, 64 nt, hsa; identical to SEQ ID NO: 29066

SEQ ID NO: 702327 - RNA, 64 nt, hsa; identical to SEQ ID NO: 29067

SEQ ID NO: 702328 - RNA, 64 nt, hsa; identical to SEQ ID NO: 29068

SEQ ID NO: 702329 - RNA, 64 nt, hsa; identical to SEQ ID NO: 29069

SEQ ID NO: 702330 - RNA, 64 nt, hsa; identical to SEQ ID NO: 29070

SEQ ID NO: 702331 - RNA, 64 nt, hsa; identical to SEQ ID NO: 29071

SEQ ID NO: 702332 - RNA, 64 nt, hsa; identical to SEQ ID NO: 29072

SEQ ID NO: 702333 - RNA, 64 nt, hsa; identical to SEQ ID NO: 29073

SEQ ID NO: 702334 - RNA, 64 nt, hsa; identical to SEQ ID NO: 29074

SEQ ID NO: 702335 - RNA, 64 nt, hsa; identical to SEQ ID NO: 29075

SEQ ID NO: 702336 - RNA, 64 nt, hsa; identical to SEQ ID NO: 29076

SEQ ID NO: 702337 - RNA, 64 nt, hsa; identical to SEQ ID NO: 29077

SEQ ID NO: 702338 - RNA, 64 nt, hsa; identical to SEQ ID NO: 29078

SEQ ID NO: 702339 - RNA, 64 nt, hsa; identical to SEQ ID NO: 29079

SEQ ID NO: 702340 - RNA, 64 nt, hsa; identical to SEQ ID NO: 29080

SEQ ID NO: 702341 - RNA, 64 nt, hsa; identical to SEQ ID NO: 29081

SEQ ID NO: 702342 - RNA, 64 nt, hsa; identical to SEQ ID NO: 29082

SEQ ID NO: 702343 - RNA, 64 nt, hsa; identical to SEQ ID NO: 29083

SEQ ID NO: 702344 - RNA, 64 nt, hsa; identical to SEQ ID NO: 29084

SEQ ID NO: 702345 - RNA, 64 nt, hsa; identical to SEQ ID NO: 29085

SEQ ID NO: 702346 - RNA, 64 nt, hsa; identical to SEQ ID NO: 29086

SEQ ID NO: 702347 - RNA, 64 nt, hsa; identical to SEQ ID NO: 29087

SEQ ID NO: 702348 - RNA, 64 nt, hsa; identical to SEQ ID NO: 29088

SEQ ID NO: 702349 - RNA, 64 nt, hsa; identical to SEQ ID NO: 29089

SEQ ID NO: 702350 - RNA, 64 nt, hsa; identical to SEQ ID NO: 29090

SEQ ID NO: 702351 - RNA, 64 nt, hsa; identical to SEQ ID NO: 29091

SEQ ID NO: 702352 - RNA, 64 nt, hsa; identical to SEQ ID NO: 29092

SEQ ID NO: 702353 - RNA, 64 nt, hsa; identical to SEQ ID NO: 29093

SEQ ID NO: 702354 - RNA, 64 nt, hsa; identical to SEQ ID NO: 29094

SEQ ID NO: 702355 - RNA, 64 nt, hsa; identical to SEQ ID NO: 29095

SEQ ID NO: 702356 - RNA, 64 nt, hsa; identical to SEQ ID NO: 29096

SEQ ID NO: 702357 - RNA, 64 nt, hsa; identical to SEQ ID NO: 29097

SEQ ID NO: 702358 - RNA, 64 nt, hsa; identical to SEQ ID NO: 29098

SEQ ID NO: 702359 - RNA, 64 nt, hsa; identical to SEQ ID NO: 29099

SEQ ID NO: 702360 - RNA, 64 nt, hsa; identical to SEQ ID NO: 29100

SEQ ID NO: 702361 - RNA, 64 nt, hsa; identical to SEQ ID NO: 29101

SEQ ID NO: 702362 - RNA, 64 nt, hsa; identical to SEQ ID NO: 29102

SEQ ID NO: 702363 - RNA, 64 nt, hsa; identical to SEQ ID NO: 29103

SEQ ID NO: 702364 - RNA, 64 nt, hsa; identical to SEQ ID NO: 29104

SEQ ID NO: 702365 - RNA, 62 nt, hsa; identical to SEQ ID NO: 29105

SEQ ID NO: 702366 - RNA, 63 nt, hsa; identical to SEQ ID NO: 29106

SEQ ID NO: 702367 - RNA, 64 nt, hsa; identical to SEQ ID NO: 29107

SEQ ID NO: 702368 - RNA, 64 nt, hsa; identical to SEQ ID NO: 29108

SEQ ID NO: 702369 - RNA, 64 nt, hsa; identical to SEQ ID NO: 29109

SEQ ID NO: 702370 - RNA, 64 nt, hsa; identical to SEQ ID NO: 29110

SEQ ID NO: 702371 - RNA, 64 nt, hsa; identical to SEQ ID NO: 29111

SEQ ID NO: 702372 - RNA, 64 nt, hsa; identical to SEQ ID NO: 29112

SEQ ID NO: 702373 - RNA, 64 nt, hsa; identical to SEQ ID NO: 29113

SEQ ID NO: 702374 - RNA, 64 nt, hsa; identical to SEQ ID NO: 29114

SEQ ID NO: 702375 - RNA, 64 nt, hsa; identical to SEQ ID NO: 29115

SEQ ID NO: 702376 - RNA, 64 nt, hsa; identical to SEQ ID NO: 29116

SEQ ID NO: 702377 - RNA, 64 nt, hsa; identical to SEQ ID NO: 29117

SEQ ID NO: 702378 - RNA, 64 nt, hsa; identical to SEQ ID NO: 29118

SEQ ID NO: 702379 - RNA, 64 nt, hsa; identical to SEQ ID NO: 29119

SEQ ID NO: 702380 - RNA, 64 nt, hsa; identical to SEQ ID NO: 29120

SEQ ID NO: 702381 - RNA, 64 nt, hsa; identical to SEQ ID NO: 29121

SEQ ID NO: 702382 - RNA, 64 nt, hsa; identical to SEQ ID NO: 29122

SEQ ID NO: 702383 - RNA, 64 nt, hsa; identical to SEQ ID NO: 29123

SEQ ID NO: 702384 - RNA, 64 nt, hsa; identical to SEQ ID NO: 29124

SEQ ID NO: 702385 - RNA, 64 nt, hsa; identical to SEQ ID NO: 29125

SEQ ID NO: 702386 - RNA, 64 nt, hsa; identical to SEQ ID NO: 29126

SEQ ID NO: 702387 - RNA, 64 nt, hsa; identical to SEQ ID NO: 29127

SEQ ID NO: 702388 - RNA, 64 nt, hsa; identical to SEQ ID NO: 29128

SEQ ID NO: 702389 - RNA, 64 nt, hsa; identical to SEQ ID NO: 29129

SEQ ID NO: 702390 - RNA, 64 nt, hsa; identical to SEQ ID NO: 29130

SEQ ID NO: 702391 - RNA, 64 nt, hsa; identical to SEQ ID NO: 29131

SEQ ID NO: 702392 - RNA, 64 nt, hsa; identical to SEQ ID NO: 29132

SEQ ID NO: 702393 - RNA, 64 nt, hsa; identical to SEQ ID NO: 29133

SEQ ID NO: 702394 - RNA, 64 nt, hsa; identical to SEQ ID NO: 29134

SEQ ID NO: 702395 - RNA, 64 nt, hsa; identical to SEQ ID NO: 29135

SEQ ID NO: 702396 - RNA, 64 nt, hsa; identical to SEQ ID NO: 29136

SEQ ID NO: 702397 - RNA, 64 nt, hsa; identical to SEQ ID NO: 29137

SEQ ID NO: 702398 - RNA, 64 nt, hsa; identical to SEQ ID NO: 29138

SEQ ID NO: 702399 - RNA, 64 nt, hsa; identical to SEQ ID NO: 29139

SEQ ID NO: 702400 - RNA, 64 nt, hsa; identical to SEQ ID NO: 29140

SEQ ID NO: 702401 - RNA, 64 nt, hsa; identical to SEQ ID NO: 29141

SEQ ID NO: 702402 - RNA, 64 nt, hsa; identical to SEQ ID NO: 29142

SEQ ID NO: 702403 - RNA, 64 nt, hsa; identical to SEQ ID NO: 29143

SEQ ID NO: 702404 - RNA, 64 nt, hsa; identical to SEQ ID NO: 29144

SEQ ID NO: 702405 - RNA, 64 nt, hsa; identical to SEQ ID NO: 29145

SEQ ID NO: 702406 - RNA, 64 nt, hsa; identical to SEQ ID NO: 29146

SEQ ID NO: 702407 - RNA, 64 nt, hsa; identical to SEQ ID NO: 29147

SEQ ID NO: 702408 - RNA, 64 nt, hsa; identical to SEQ ID NO: 29148

SEQ ID NO: 702409 - RNA, 64 nt, hsa; identical to SEQ ID NO: 29149

SEQ ID NO: 702410 - RNA, 64 nt, hsa; identical to SEQ ID NO: 29150

SEQ ID NO: 702411 - RNA, 64 nt, hsa; identical to SEQ ID NO: 29151

SEQ ID NO: 702412 - RNA, 64 nt, hsa; identical to SEQ ID NO: 29152

SEQ ID NO: 702413 - RNA, 64 nt, hsa; identical to SEQ ID NO: 29153

SEQ ID NO: 702414 - RNA, 64 nt, hsa; identical to SEQ ID NO: 29154

SEQ ID NO: 702415 - RNA, 64 nt, hsa; identical to SEQ ID NO: 29155

SEQ ID NO: 702416 - RNA, 64 nt, hsa; identical to SEQ ID NO: 29156

SEQ ID NO: 702417 - RNA, 64 nt, hsa; identical to SEQ ID NO: 29157

SEQ ID NO: 702418 - RNA, 64 nt, hsa; identical to SEQ ID NO: 29158

SEQ ID NO: 702419 - RNA, 64 nt, hsa; identical to SEQ ID NO: 29159

SEQ ID NO: 702420 - RNA, 64 nt, hsa; identical to SEQ ID NO: 29160

SEQ ID NO: 702421 - RNA, 64 nt, hsa; identical to SEQ ID NO: 29161

SEQ ID NO: 702422 - RNA, 64 nt, hsa; identical to SEQ ID NO: 29162

SEQ ID NO: 702423 - RNA, 64 nt, hsa; identical to SEQ ID NO: 29163

SEQ ID NO: 702424 - RNA, 64 nt, hsa; identical to SEQ ID NO: 29164

SEQ ID NO: 702425 - RNA, 64 nt, hsa; identical to SEQ ID NO: 29165

SEQ ID NO: 702426 - RNA, 64 nt, hsa; identical to SEQ ID NO: 29166

SEQ ID NO: 702427 - RNA, 64 nt, hsa; identical to SEQ ID NO: 29167

SEQ ID NO: 702428 - RNA, 64 nt, hsa; identical to SEQ ID NO: 29168

SEQ ID NO: 702429 - RNA, 64 nt, hsa; identical to SEQ ID NO: 29169

SEQ ID NO: 702430 - RNA, 64 nt, hsa; identical to SEQ ID NO: 29170

SEQ ID NO: 702431 - RNA, 64 nt, hsa; identical to SEQ ID NO: 29171

SEQ ID NO: 702432 - RNA, 64 nt, hsa; identical to SEQ ID NO: 29172

SEQ ID NO: 702433 - RNA, 64 nt, hsa; identical to SEQ ID NO: 29173

SEQ ID NO: 702434 - RNA, 64 nt, hsa; identical to SEQ ID NO: 29174

SEQ ID NO: 702435 - RNA, 64 nt, hsa; identical to SEQ ID NO: 29175

SEQ ID NO: 702436 - RNA, 64 nt, hsa; identical to SEQ ID NO: 29176

SEQ ID NO: 702437 - RNA, 64 nt, hsa; identical to SEQ ID NO: 29177

SEQ ID NO: 702438 - RNA, 64 nt, hsa; identical to SEQ ID NO: 29178

SEQ ID NO: 702439 - RNA, 64 nt, hsa; identical to SEQ ID NO: 29179

SEQ ID NO: 702440 - RNA, 64 nt, hsa; identical to SEQ ID NO: 29180

SEQ ID NO: 702441 - RNA, 64 nt, hsa; identical to SEQ ID NO: 29181

SEQ ID NO: 702442 - RNA, 64 nt, hsa; identical to SEQ ID NO: 29182

SEQ ID NO: 702443 - RNA, 64 nt, hsa; identical to SEQ ID NO: 29183

SEQ ID NO: 702444 - RNA, 64 nt, hsa; identical to SEQ ID NO: 29184

SEQ ID NO: 702445 - RNA, 64 nt, hsa; identical to SEQ ID NO: 29185

SEQ ID NO: 702446 - RNA, 64 nt, hsa; identical to SEQ ID NO: 29186

SEQ ID NO: 702447 - RNA, 64 nt, hsa; identical to SEQ ID NO: 29187

SEQ ID NO: 702448 - RNA, 64 nt, hsa; identical to SEQ ID NO: 29188

SEQ ID NO: 702449 - RNA, 64 nt, hsa; identical to SEQ ID NO: 29189

SEQ ID NO: 702450 - RNA, 64 nt, hsa; identical to SEQ ID NO: 29190

SEQ ID NO: 702451 - RNA, 64 nt, hsa; identical to SEQ ID NO: 29191

SEQ ID NO: 702452 - RNA, 64 nt, hsa; identical to SEQ ID NO: 29192

SEQ ID NO: 702453 - RNA, 64 nt, hsa; identical to SEQ ID NO: 29193

SEQ ID NO: 702454 - RNA, 64 nt, hsa; identical to SEQ ID NO: 29194

SEQ ID NO: 702455 - RNA, 64 nt, hsa; identical to SEQ ID NO: 29195

SEQ ID NO: 702456 - RNA, 64 nt, hsa; identical to SEQ ID NO: 29196

SEQ ID NO: 702457 - RNA, 64 nt, hsa; identical to SEQ ID NO: 29197

SEQ ID NO: 702458 - RNA, 64 nt, hsa; identical to SEQ ID NO: 29198

SEQ ID NO: 702459 - RNA, 64 nt, hsa; identical to SEQ ID NO: 29199

SEQ ID NO: 702460 - RNA, 64 nt, hsa; identical to SEQ ID NO: 29200

SEQ ID NO: 702461 - RNA, 64 nt, hsa; identical to SEQ ID NO: 29201

SEQ ID NO: 702462 - RNA, 64 nt, hsa; identical to SEQ ID NO: 29202

SEQ ID NO: 702463 - RNA, 64 nt, hsa; identical to SEQ ID NO: 29203

SEQ ID NO: 702464 - RNA, 64 nt, hsa; identical to SEQ ID NO: 29204

SEQ ID NO: 702465 - RNA, 64 nt, hsa; identical to SEQ ID NO: 29205

SEQ ID NO: 702466 - RNA, 64 nt, hsa; identical to SEQ ID NO: 29206

SEQ ID NO: 702467 - RNA, 64 nt, hsa; identical to SEQ ID NO: 29207

SEQ ID NO: 702468 - RNA, 64 nt, hsa; identical to SEQ ID NO: 29208

SEQ ID NO: 702469 - RNA, 64 nt, hsa; identical to SEQ ID NO: 29209

SEQ ID NO: 702470 - RNA, 64 nt, hsa; identical to SEQ ID NO: 29210

SEQ ID NO: 702471 - RNA, 64 nt, hsa; identical to SEQ ID NO: 29211

SEQ ID NO: 702472 - RNA, 64 nt, hsa; identical to SEQ ID NO: 29212

SEQ ID NO: 702473 - RNA, 64 nt, hsa; identical to SEQ ID NO: 29213

SEQ ID NO: 702474 - RNA, 64 nt, hsa; identical to SEQ ID NO: 29214

SEQ ID NO: 702475 - RNA, 64 nt, hsa; identical to SEQ ID NO: 29215

SEQ ID NO: 702476 - RNA, 64 nt, hsa; identical to SEQ ID NO: 29216

SEQ ID NO: 702477 - RNA, 64 nt, hsa; identical to SEQ ID NO: 29217

SEQ ID NO: 702478 - RNA, 64 nt, hsa; identical to SEQ ID NO: 29218

SEQ ID NO: 702479 - RNA, 64 nt, hsa; identical to SEQ ID NO: 29219

SEQ ID NO: 702480 - RNA, 64 nt, hsa; identical to SEQ ID NO: 29220

SEQ ID NO: 702481 - RNA, 64 nt, hsa; identical to SEQ ID NO: 29221

SEQ ID NO: 702482 - RNA, 64 nt, hsa; identical to SEQ ID NO: 29222

SEQ ID NO: 702483 - RNA, 64 nt, hsa; identical to SEQ ID NO: 29223

SEQ ID NO: 702484 - RNA, 64 nt, hsa; identical to SEQ ID NO: 29224

SEQ ID NO: 702485 - RNA, 64 nt, hsa; identical to SEQ ID NO: 29225

SEQ ID NO: 702486 - RNA, 64 nt, hsa; identical to SEQ ID NO: 29226

SEQ ID NO: 702487 - RNA, 64 nt, hsa; identical to SEQ ID NO: 29227

SEQ ID NO: 702488 - RNA, 64 nt, hsa; identical to SEQ ID NO: 29228

SEQ ID NO: 702489 - RNA, 64 nt, hsa; identical to SEQ ID NO: 29229

SEQ ID NO: 702490 - RNA, 64 nt, hsa; identical to SEQ ID NO: 29230

SEQ ID NO: 702491 - RNA, 64 nt, hsa; identical to SEQ ID NO: 29231

SEQ ID NO: 702492 - RNA, 64 nt, hsa; identical to SEQ ID NO: 29232

SEQ ID NO: 702493 - RNA, 64 nt, hsa; identical to SEQ ID NO: 29233

SEQ ID NO: 702494 - RNA, 64 nt, hsa; identical to SEQ ID NO: 29234

SEQ ID NO: 702495 - RNA, 64 nt, hsa; identical to SEQ ID NO: 29235

SEQ ID NO: 702496 - RNA, 64 nt, hsa; identical to SEQ ID NO: 29236

SEQ ID NO: 702497 - RNA, 64 nt, hsa; identical to SEQ ID NO: 29237

SEQ ID NO: 702498 - RNA, 64 nt, hsa; identical to SEQ ID NO: 29238

SEQ ID NO: 702499 - RNA, 64 nt, hsa; identical to SEQ ID NO: 29239

SEQ ID NO: 702500 - RNA, 64 nt, hsa; identical to SEQ ID NO: 29240

SEQ ID NO: 702501 - RNA, 64 nt, hsa; identical to SEQ ID NO: 29241

SEQ ID NO: 702502 - RNA, 64 nt, hsa; identical to SEQ ID NO: 29242

SEQ ID NO: 702503 - RNA, 64 nt, hsa; identical to SEQ ID NO: 29243

SEQ ID NO: 702504 - RNA, 64 nt, hsa; identical to SEQ ID NO: 29244

SEQ ID NO: 702505 - RNA, 64 nt, hsa; identical to SEQ ID NO: 29245

SEQ ID NO: 702506 - RNA, 64 nt, hsa; identical to SEQ ID NO: 29246

SEQ ID NO: 702507 - RNA, 64 nt, hsa; identical to SEQ ID NO: 29247

SEQ ID NO: 702508 - RNA, 64 nt, hsa; identical to SEQ ID NO: 29248

SEQ ID NO: 702509 - RNA, 64 nt, hsa; identical to SEQ ID NO: 29249

SEQ ID NO: 702510 - RNA, 64 nt, hsa; identical to SEQ ID NO: 29250

SEQ ID NO: 702511 - RNA, 64 nt, hsa; identical to SEQ ID NO: 29251

SEQ ID NO: 702512 - RNA, 64 nt, hsa; identical to SEQ ID NO: 29252

SEQ ID NO: 702513 - RNA, 64 nt, hsa; identical to SEQ ID NO: 29253

SEQ ID NO: 702514 - RNA, 64 nt, hsa; identical to SEQ ID NO: 29254

SEQ ID NO: 702515 - RNA, 64 nt, hsa; identical to SEQ ID NO: 29255

SEQ ID NO: 702516 - RNA, 64 nt, hsa; identical to SEQ ID NO: 29256

SEQ ID NO: 702517 - RNA, 64 nt, hsa; identical to SEQ ID NO: 29257

SEQ ID NO: 702518 - RNA, 64 nt, hsa; identical to SEQ ID NO: 29258

SEQ ID NO: 702519 - RNA, 64 nt, hsa; identical to SEQ ID NO: 29259

SEQ ID NO: 702520 - RNA, 64 nt, hsa; identical to SEQ ID NO: 29260

SEQ ID NO: 702521 - RNA, 64 nt, hsa; identical to SEQ ID NO: 29261

SEQ ID NO: 702522 - RNA, 64 nt, hsa; identical to SEQ ID NO: 29262

SEQ ID NO: 702523 - RNA, 64 nt, hsa; identical to SEQ ID NO: 29263

SEQ ID NO: 702524 - RNA, 64 nt, hsa; identical to SEQ ID NO: 29264

SEQ ID NO: 702525 - RNA, 64 nt, hsa; identical to SEQ ID NO: 29265

SEQ ID NO: 702526 - RNA, 64 nt, hsa; identical to SEQ ID NO: 29266

SEQ ID NO: 702527 - RNA, 64 nt, hsa; identical to SEQ ID NO: 29267

SEQ ID NO: 702528 - RNA, 64 nt, hsa; identical to SEQ ID NO: 29268

SEQ ID NO: 702529 - RNA, 64 nt, hsa; identical to SEQ ID NO: 29269

SEQ ID NO: 702530 - RNA, 64 nt, hsa; identical to SEQ ID NO: 29270

SEQ ID NO: 702531 - RNA, 64 nt, hsa; identical to SEQ ID NO: 29271

SEQ ID NO: 702532 - RNA, 64 nt, hsa; identical to SEQ ID NO: 29272

SEQ ID NO: 702533 - RNA, 64 nt, hsa; identical to SEQ ID NO: 29273

SEQ ID NO: 702534 - RNA, 64 nt, hsa; identical to SEQ ID NO: 29274

SEQ ID NO: 702535 - RNA, 64 nt, hsa; identical to SEQ ID NO: 29275

SEQ ID NO: 702536 - RNA, 64 nt, hsa; identical to SEQ ID NO: 29276

SEQ ID NO: 702537 - RNA, 64 nt, hsa; identical to SEQ ID NO: 29277

SEQ ID NO: 702538 - RNA, 64 nt, hsa; identical to SEQ ID NO: 29278

SEQ ID NO: 702539 - RNA, 64 nt, hsa; identical to SEQ ID NO: 29279

SEQ ID NO: 702540 - RNA, 64 nt, hsa; identical to SEQ ID NO: 29280

SEQ ID NO: 702541 - RNA, 64 nt, hsa; identical to SEQ ID NO: 29281

SEQ ID NO: 702542 - RNA, 64 nt, hsa; identical to SEQ ID NO: 29282

SEQ ID NO: 702543 - RNA, 64 nt, hsa; identical to SEQ ID NO: 29283

SEQ ID NO: 702544 - RNA, 64 nt, hsa; identical to SEQ ID NO: 29284

SEQ ID NO: 702545 - RNA, 64 nt, hsa; identical to SEQ ID NO: 29285

SEQ ID NO: 702546 - RNA, 64 nt, hsa; identical to SEQ ID NO: 29286

SEQ ID NO: 702547 - RNA, 64 nt, hsa; identical to SEQ ID NO: 29287

SEQ ID NO: 702548 - RNA, 64 nt, hsa; identical to SEQ ID NO: 29288

SEQ ID NO: 702549 - RNA, 64 nt, hsa; identical to SEQ ID NO: 29289

SEQ ID NO: 702550 - RNA, 64 nt, hsa; identical to SEQ ID NO: 29290

SEQ ID NO: 702551 - RNA, 64 nt, hsa; identical to SEQ ID NO: 29291

SEQ ID NO: 702552 - RNA, 64 nt, hsa; identical to SEQ ID NO: 29292

SEQ ID NO: 702553 - RNA, 64 nt, hsa; identical to SEQ ID NO: 29293

SEQ ID NO: 702554 - RNA, 64 nt, hsa; identical to SEQ ID NO: 29294

SEQ ID NO: 702555 - RNA, 64 nt, hsa; identical to SEQ ID NO: 29295

SEQ ID NO: 702556 - RNA, 64 nt, hsa; identical to SEQ ID NO: 29296

SEQ ID NO: 702557 - RNA, 64 nt, hsa; identical to SEQ ID NO: 29297

SEQ ID NO: 702558 - RNA, 64 nt, hsa; identical to SEQ ID NO: 29298

SEQ ID NO: 702559 - RNA, 64 nt, hsa; identical to SEQ ID NO: 29299

SEQ ID NO: 702560 - RNA, 64 nt, hsa; identical to SEQ ID NO: 29300

SEQ ID NO: 702561 - RNA, 64 nt, hsa; identical to SEQ ID NO: 29301

SEQ ID NO: 702562 - RNA, 64 nt, hsa; identical to SEQ ID NO: 29302

SEQ ID NO: 702563 - RNA, 64 nt, hsa; identical to SEQ ID NO: 29303

SEQ ID NO: 702564 - RNA, 64 nt, hsa; identical to SEQ ID NO: 29304

SEQ ID NO: 702565 - RNA, 64 nt, hsa; identical to SEQ ID NO: 29305

SEQ ID NO: 702566 - RNA, 64 nt, hsa; identical to SEQ ID NO: 29306

SEQ ID NO: 702567 - RNA, 64 nt, hsa; identical to SEQ ID NO: 29307

SEQ ID NO: 702568 - RNA, 64 nt, hsa; identical to SEQ ID NO: 29308

SEQ ID NO: 702569 - RNA, 64 nt, hsa; identical to SEQ ID NO: 29309

SEQ ID NO: 702570 - RNA, 64 nt, hsa; identical to SEQ ID NO: 29310

SEQ ID NO: 702571 - RNA, 64 nt, hsa; identical to SEQ ID NO: 29311

SEQ ID NO: 702572 - RNA, 64 nt, hsa; identical to SEQ ID NO: 29312

SEQ ID NO: 702573 - RNA, 64 nt, hsa; identical to SEQ ID NO: 29313

SEQ ID NO: 702574 - RNA, 64 nt, hsa; identical to SEQ ID NO: 29314

SEQ ID NO: 702575 - RNA, 64 nt, hsa; identical to SEQ ID NO: 29315

SEQ ID NO: 702576 - RNA, 64 nt, hsa; identical to SEQ ID NO: 29316

SEQ ID NO: 702577 - RNA, 64 nt, hsa; identical to SEQ ID NO: 29317

SEQ ID NO: 702578 - RNA, 64 nt, hsa; identical to SEQ ID NO: 29318

SEQ ID NO: 702579 - RNA, 64 nt, hsa; identical to SEQ ID NO: 29319

SEQ ID NO: 702580 - RNA, 64 nt, hsa; identical to SEQ ID NO: 29320

SEQ ID NO: 702581 - RNA, 64 nt, hsa; identical to SEQ ID NO: 29321

SEQ ID NO: 702582 - RNA, 64 nt, hsa; identical to SEQ ID NO: 29322

SEQ ID NO: 702583 - RNA, 64 nt, hsa; identical to SEQ ID NO: 29323

SEQ ID NO: 702584 - RNA, 64 nt, hsa; identical to SEQ ID NO: 29324

SEQ ID NO: 702585 - RNA, 64 nt, hsa; identical to SEQ ID NO: 29325

SEQ ID NO: 702586 - RNA, 64 nt, hsa; identical to SEQ ID NO: 29326

SEQ ID NO: 702587 - RNA, 64 nt, hsa; identical to SEQ ID NO: 29327

SEQ ID NO: 702588 - RNA, 64 nt, hsa; identical to SEQ ID NO: 29328

SEQ ID NO: 702589 - RNA, 64 nt, hsa; identical to SEQ ID NO: 29329

SEQ ID NO: 702590 - RNA, 64 nt, hsa; identical to SEQ ID NO: 29330

SEQ ID NO: 702591 - RNA, 64 nt, hsa; identical to SEQ ID NO: 29331

SEQ ID NO: 702592 - RNA, 64 nt, hsa; identical to SEQ ID NO: 29332

SEQ ID NO: 702593 - RNA, 64 nt, hsa; identical to SEQ ID NO: 29333

SEQ ID NO: 702594 - RNA, 64 nt, hsa; identical to SEQ ID NO: 29334

SEQ ID NO: 702595 - RNA, 64 nt, hsa; identical to SEQ ID NO: 29335

SEQ ID NO: 702596 - RNA, 64 nt, hsa; identical to SEQ ID NO: 29336

SEQ ID NO: 702597 - RNA, 64 nt, hsa; identical to SEQ ID NO: 29337

SEQ ID NO: 702598 - RNA, 64 nt, hsa; identical to SEQ ID NO: 29338

SEQ ID NO: 702599 - RNA, 64 nt, hsa; identical to SEQ ID NO: 29339

SEQ ID NO: 702600 - RNA, 64 nt, hsa; identical to SEQ ID NO: 29340

SEQ ID NO: 702601 - RNA, 64 nt, hsa; identical to SEQ ID NO: 29341

SEQ ID NO: 702602 - RNA, 64 nt, hsa; identical to SEQ ID NO: 29342

SEQ ID NO: 702603 - RNA, 64 nt, hsa; identical to SEQ ID NO: 29343

SEQ ID NO: 702604 - RNA, 64 nt, hsa; identical to SEQ ID NO: 29344

SEQ ID NO: 702605 - RNA, 64 nt, hsa; identical to SEQ ID NO: 29345

SEQ ID NO: 702606 - RNA, 64 nt, hsa; identical to SEQ ID NO: 29346

SEQ ID NO: 702607 - RNA, 64 nt, hsa; identical to SEQ ID NO: 29347

SEQ ID NO: 702608 - RNA, 64 nt, hsa; identical to SEQ ID NO: 29348

SEQ ID NO: 702609 - RNA, 64 nt, hsa; identical to SEQ ID NO: 29349

SEQ ID NO: 702610 - RNA, 64 nt, hsa; identical to SEQ ID NO: 29350

SEQ ID NO: 702611 - RNA, 64 nt, hsa; identical to SEQ ID NO: 29351

SEQ ID NO: 702612 - RNA, 64 nt, hsa; identical to SEQ ID NO: 29352

SEQ ID NO: 702613 - RNA, 64 nt, hsa; identical to SEQ ID NO: 29353

SEQ ID NO: 702614 - RNA, 64 nt, hsa; identical to SEQ ID NO: 29354

SEQ ID NO: 702615 - RNA, 64 nt, hsa; identical to SEQ ID NO: 29355

SEQ ID NO: 702616 - RNA, 64 nt, hsa; identical to SEQ ID NO: 29356

SEQ ID NO: 702617 - RNA, 64 nt, hsa; identical to SEQ ID NO: 29357

SEQ ID NO: 702618 - RNA, 64 nt, hsa; identical to SEQ ID NO: 29358

SEQ ID NO: 702619 - RNA, 64 nt, hsa; identical to SEQ ID NO: 29359

SEQ ID NO: 702620 - RNA, 64 nt, hsa; identical to SEQ ID NO: 29360

SEQ ID NO: 702621 - RNA, 64 nt, hsa; identical to SEQ ID NO: 29361

SEQ ID NO: 702622 - RNA, 64 nt, hsa; identical to SEQ ID NO: 29362

SEQ ID NO: 702623 - RNA, 64 nt, hsa; identical to SEQ ID NO: 29363

SEQ ID NO: 702624 - RNA, 64 nt, hsa; identical to SEQ ID NO: 29364

SEQ ID NO: 702625 - RNA, 64 nt, hsa; identical to SEQ ID NO: 29365

SEQ ID NO: 702626 - RNA, 64 nt, hsa; identical to SEQ ID NO: 29366

SEQ ID NO: 702627 - RNA, 64 nt, hsa; identical to SEQ ID NO: 29367

SEQ ID NO: 702628 - RNA, 64 nt, hsa; identical to SEQ ID NO: 29368

SEQ ID NO: 702629 - RNA, 64 nt, hsa; identical to SEQ ID NO: 29369

SEQ ID NO: 702630 - RNA, 64 nt, hsa; identical to SEQ ID NO: 29370

SEQ ID NO: 702631 - RNA, 64 nt, hsa; identical to SEQ ID NO: 29371

SEQ ID NO: 702632 - RNA, 64 nt, hsa; identical to SEQ ID NO: 29372

SEQ ID NO: 702633 - RNA, 64 nt, hsa; identical to SEQ ID NO: 29373

SEQ ID NO: 702634 - RNA, 64 nt, hsa; identical to SEQ ID NO: 29374

SEQ ID NO: 702635 - RNA, 64 nt, hsa; identical to SEQ ID NO: 29375

SEQ ID NO: 702636 - RNA, 64 nt, hsa; identical to SEQ ID NO: 29376

SEQ ID NO: 702637 - RNA, 64 nt, hsa; identical to SEQ ID NO: 29377

SEQ ID NO: 702638 - RNA, 64 nt, hsa; identical to SEQ ID NO: 29378

SEQ ID NO: 702639 - RNA, 64 nt, hsa; identical to SEQ ID NO: 29379

SEQ ID NO: 702640 - RNA, 64 nt, hsa; identical to SEQ ID NO: 29380

SEQ ID NO: 702641 - RNA, 64 nt, hsa; identical to SEQ ID NO: 29381

SEQ ID NO: 702642 - RNA, 64 nt, hsa; identical to SEQ ID NO: 29382

SEQ ID NO: 702643 - RNA, 64 nt, hsa; identical to SEQ ID NO: 29383

SEQ ID NO: 702644 - RNA, 64 nt, hsa; identical to SEQ ID NO: 29384

SEQ ID NO: 702645 - RNA, 64 nt, hsa; identical to SEQ ID NO: 29385

SEQ ID NO: 702646 - RNA, 64 nt, hsa; identical to SEQ ID NO: 29386

SEQ ID NO: 702647 - RNA, 64 nt, hsa; identical to SEQ ID NO: 29387

SEQ ID NO: 702648 - RNA, 64 nt, hsa; identical to SEQ ID NO: 29388

SEQ ID NO: 702649 - RNA, 64 nt, hsa; identical to SEQ ID NO: 29389

SEQ ID NO: 702650 - RNA, 64 nt, hsa; identical to SEQ ID NO: 29390

SEQ ID NO: 702651 - RNA, 64 nt, hsa; identical to SEQ ID NO: 29391

SEQ ID NO: 702652 - RNA, 64 nt, hsa; identical to SEQ ID NO: 29392

SEQ ID NO: 702653 - RNA, 64 nt, hsa; identical to SEQ ID NO: 29393

SEQ ID NO: 702654 - RNA, 64 nt, hsa; identical to SEQ ID NO: 29394

SEQ ID NO: 702655 - RNA, 64 nt, hsa; identical to SEQ ID NO: 29395

SEQ ID NO: 702656 - RNA, 64 nt, hsa; identical to SEQ ID NO: 29396

SEQ ID NO: 702657 - RNA, 64 nt, hsa; identical to SEQ ID NO: 29397

SEQ ID NO: 702658 - RNA, 64 nt, hsa; identical to SEQ ID NO: 29398

SEQ ID NO: 702659 - RNA, 64 nt, hsa; identical to SEQ ID NO: 29399

SEQ ID NO: 702660 - RNA, 64 nt, hsa; identical to SEQ ID NO: 29400

SEQ ID NO: 702661 - RNA, 64 nt, hsa; identical to SEQ ID NO: 29401

SEQ ID NO: 702662 - RNA, 64 nt, hsa; identical to SEQ ID NO: 29402

SEQ ID NO: 702663 - RNA, 64 nt, hsa; identical to SEQ ID NO: 29403

SEQ ID NO: 702664 - RNA, 64 nt, hsa; identical to SEQ ID NO: 29404

SEQ ID NO: 702665 - RNA, 64 nt, hsa; identical to SEQ ID NO: 29405

SEQ ID NO: 702666 - RNA, 64 nt, hsa; identical to SEQ ID NO: 29406

SEQ ID NO: 702667 - RNA, 64 nt, hsa; identical to SEQ ID NO: 29407

SEQ ID NO: 702668 - RNA, 64 nt, hsa; identical to SEQ ID NO: 29408

SEQ ID NO: 702669 - RNA, 64 nt, hsa; identical to SEQ ID NO: 29409

SEQ ID NO: 702670 - RNA, 64 nt, hsa; identical to SEQ ID NO: 29410

SEQ ID NO: 702671 - RNA, 64 nt, hsa; identical to SEQ ID NO: 29411

SEQ ID NO: 702672 - RNA, 64 nt, hsa; identical to SEQ ID NO: 29412

SEQ ID NO: 702673 - RNA, 64 nt, hsa; identical to SEQ ID NO: 29413

SEQ ID NO: 702674 - RNA, 64 nt, hsa; identical to SEQ ID NO: 29414

SEQ ID NO: 702675 - RNA, 64 nt, hsa; identical to SEQ ID NO: 29415

SEQ ID NO: 702676 - RNA, 64 nt, hsa; identical to SEQ ID NO: 29416

SEQ ID NO: 702677 - RNA, 64 nt, hsa; identical to SEQ ID NO: 29417

SEQ ID NO: 702678 - RNA, 64 nt, hsa; identical to SEQ ID NO: 29418

SEQ ID NO: 702679 - RNA, 64 nt, hsa; identical to SEQ ID NO: 29419

SEQ ID NO: 702680 - RNA, 64 nt, hsa; identical to SEQ ID NO: 29420

SEQ ID NO: 702681 - RNA, 64 nt, hsa; identical to SEQ ID NO: 29421

SEQ ID NO: 702682 - RNA, 64 nt, hsa; identical to SEQ ID NO: 29422

SEQ ID NO: 702683 - RNA, 64 nt, hsa; identical to SEQ ID NO: 29423

SEQ ID NO: 702684 - RNA, 64 nt, hsa; identical to SEQ ID NO: 29424

SEQ ID NO: 702685 - RNA, 64 nt, hsa; identical to SEQ ID NO: 29425

SEQ ID NO: 702686 - RNA, 64 nt, hsa; identical to SEQ ID NO: 29426

SEQ ID NO: 702687 - RNA, 64 nt, hsa; identical to SEQ ID NO: 29427

SEQ ID NO: 702688 - RNA, 64 nt, hsa; identical to SEQ ID NO: 29428

SEQ ID NO: 702689 - RNA, 64 nt, hsa; identical to SEQ ID NO: 29429

SEQ ID NO: 702690 - RNA, 64 nt, hsa; identical to SEQ ID NO: 29430

SEQ ID NO: 702691 - RNA, 64 nt, hsa; identical to SEQ ID NO: 29431

SEQ ID NO: 702692 - RNA, 64 nt, hsa; identical to SEQ ID NO: 29432

SEQ ID NO: 702693 - RNA, 64 nt, hsa; identical to SEQ ID NO: 29433

SEQ ID NO: 702694 - RNA, 64 nt, hsa; identical to SEQ ID NO: 29434

SEQ ID NO: 702695 - RNA, 64 nt, hsa; identical to SEQ ID NO: 29435

SEQ ID NO: 702696 - RNA, 64 nt, hsa; identical to SEQ ID NO: 29436

SEQ ID NO: 702697 - RNA, 64 nt, hsa; identical to SEQ ID NO: 29437

SEQ ID NO: 702698 - RNA, 64 nt, hsa; identical to SEQ ID NO: 29438

SEQ ID NO: 702699 - RNA, 64 nt, hsa; identical to SEQ ID NO: 29439

SEQ ID NO: 702700 - RNA, 64 nt, hsa; identical to SEQ ID NO: 29440

SEQ ID NO: 702701 - RNA, 64 nt, hsa; identical to SEQ ID NO: 29441

SEQ ID NO: 702702 - RNA, 64 nt, hsa; identical to SEQ ID NO: 29442

SEQ ID NO: 702703 - RNA, 64 nt, hsa; identical to SEQ ID NO: 29443

SEQ ID NO: 702704 - RNA, 64 nt, hsa; identical to SEQ ID NO: 29444

SEQ ID NO: 702705 - RNA, 64 nt, hsa; identical to SEQ ID NO: 29445

SEQ ID NO: 702706 - RNA, 64 nt, hsa; identical to SEQ ID NO: 29446

SEQ ID NO: 702707 - RNA, 64 nt, hsa; identical to SEQ ID NO: 29447

SEQ ID NO: 702708 - RNA, 64 nt, hsa; identical to SEQ ID NO: 29448

SEQ ID NO: 702709 - RNA, 64 nt, hsa; identical to SEQ ID NO: 29449

SEQ ID NO: 702710 - RNA, 64 nt, hsa; identical to SEQ ID NO: 29450

SEQ ID NO: 702711 - RNA, 64 nt, hsa; identical to SEQ ID NO: 29451

SEQ ID NO: 702712 - RNA, 64 nt, hsa; identical to SEQ ID NO: 29452

SEQ ID NO: 702713 - RNA, 64 nt, hsa; identical to SEQ ID NO: 29453

SEQ ID NO: 702714 - RNA, 64 nt, hsa; identical to SEQ ID NO: 29454

SEQ ID NO: 702715 - RNA, 64 nt, hsa; identical to SEQ ID NO: 29455

SEQ ID NO: 702716 - RNA, 64 nt, hsa; identical to SEQ ID NO: 29456

SEQ ID NO: 702717 - RNA, 64 nt, hsa; identical to SEQ ID NO: 29457

SEQ ID NO: 702718 - RNA, 64 nt, hsa; identical to SEQ ID NO: 29458

SEQ ID NO: 702719 - RNA, 64 nt, hsa; identical to SEQ ID NO: 29459

SEQ ID NO: 702720 - RNA, 64 nt, hsa; identical to SEQ ID NO: 29460

SEQ ID NO: 702721 - RNA, 64 nt, hsa; identical to SEQ ID NO: 29461

SEQ ID NO: 702722 - RNA, 64 nt, hsa; identical to SEQ ID NO: 29462

SEQ ID NO: 702723 - RNA, 64 nt, hsa; identical to SEQ ID NO: 29463

SEQ ID NO: 702724 - RNA, 64 nt, hsa; identical to SEQ ID NO: 29464

SEQ ID NO: 702725 - RNA, 64 nt, hsa; identical to SEQ ID NO: 29465

SEQ ID NO: 702726 - RNA, 64 nt, hsa; identical to SEQ ID NO: 29466

SEQ ID NO: 702727 - RNA, 64 nt, hsa; identical to SEQ ID NO: 29467

SEQ ID NO: 702728 - RNA, 64 nt, hsa; identical to SEQ ID NO: 29468

SEQ ID NO: 702729 - RNA, 64 nt, hsa; identical to SEQ ID NO: 29469

SEQ ID NO: 702730 - RNA, 64 nt, hsa; identical to SEQ ID NO: 29470

SEQ ID NO: 702731 - RNA, 64 nt, hsa; identical to SEQ ID NO: 29471

SEQ ID NO: 702732 - RNA, 64 nt, hsa; identical to SEQ ID NO: 29472

SEQ ID NO: 702733 - RNA, 64 nt, hsa; identical to SEQ ID NO: 29473

SEQ ID NO: 702734 - RNA, 64 nt, hsa; identical to SEQ ID NO: 29474

SEQ ID NO: 702735 - RNA, 64 nt, hsa; identical to SEQ ID NO: 29475

SEQ ID NO: 702736 - RNA, 64 nt, hsa; identical to SEQ ID NO: 29476

SEQ ID NO: 702737 - RNA, 64 nt, hsa; identical to SEQ ID NO: 29477

SEQ ID NO: 702738 - RNA, 64 nt, hsa; identical to SEQ ID NO: 29478

SEQ ID NO: 702739 - RNA, 64 nt, hsa; identical to SEQ ID NO: 29479

SEQ ID NO: 702740 - RNA, 64 nt, hsa; identical to SEQ ID NO: 29480

SEQ ID NO: 702741 - RNA, 64 nt, hsa; identical to SEQ ID NO: 29481

SEQ ID NO: 702742 - RNA, 64 nt, hsa; identical to SEQ ID NO: 29482

SEQ ID NO: 702743 - RNA, 64 nt, hsa; identical to SEQ ID NO: 29483

SEQ ID NO: 702744 - RNA, 64 nt, hsa; identical to SEQ ID NO: 29484

SEQ ID NO: 702745 - RNA, 64 nt, hsa; identical to SEQ ID NO: 29485

SEQ ID NO: 702746 - RNA, 64 nt, hsa; identical to SEQ ID NO: 29486

SEQ ID NO: 702747 - RNA, 64 nt, hsa; identical to SEQ ID NO: 29487

SEQ ID NO: 702748 - RNA, 64 nt, hsa; identical to SEQ ID NO: 29488

SEQ ID NO: 702749 - RNA, 64 nt, hsa; identical to SEQ ID NO: 29489

SEQ ID NO: 702750 - RNA, 64 nt, hsa; identical to SEQ ID NO: 29490

SEQ ID NO: 702751 - RNA, 64 nt, hsa; identical to SEQ ID NO: 29491

SEQ ID NO: 702752 - RNA, 64 nt, hsa; identical to SEQ ID NO: 29492

SEQ ID NO: 702753 - RNA, 64 nt, hsa; identical to SEQ ID NO: 29493

SEQ ID NO: 702754 - RNA, 64 nt, hsa; identical to SEQ ID NO: 29494

SEQ ID NO: 702755 - RNA, 64 nt, hsa; identical to SEQ ID NO: 29495

SEQ ID NO: 702756 - RNA, 64 nt, hsa; identical to SEQ ID NO: 29496

SEQ ID NO: 702757 - RNA, 64 nt, hsa; identical to SEQ ID NO: 29497

SEQ ID NO: 702758 - RNA, 64 nt, hsa; identical to SEQ ID NO: 29498

SEQ ID NO: 702759 - RNA, 64 nt, hsa; identical to SEQ ID NO: 29499

SEQ ID NO: 702760 - RNA, 64 nt, hsa; identical to SEQ ID NO: 29500

SEQ ID NO: 702761 - RNA, 64 nt, hsa; identical to SEQ ID NO: 29501

SEQ ID NO: 702762 - RNA, 64 nt, hsa; identical to SEQ ID NO: 29502

SEQ ID NO: 702763 - RNA, 64 nt, hsa; identical to SEQ ID NO: 29503

SEQ ID NO: 702764 - RNA, 64 nt, hsa; identical to SEQ ID NO: 29504

SEQ ID NO: 702765 - RNA, 64 nt, hsa; identical to SEQ ID NO: 29505

SEQ ID NO: 702766 - RNA, 64 nt, hsa; identical to SEQ ID NO: 29506

SEQ ID NO: 702767 - RNA, 64 nt, hsa; identical to SEQ ID NO: 29507

SEQ ID NO: 702768 - RNA, 64 nt, hsa; identical to SEQ ID NO: 29508

SEQ ID NO: 702769 - RNA, 64 nt, hsa; identical to SEQ ID NO: 29509

SEQ ID NO: 702770 - RNA, 64 nt, hsa; identical to SEQ ID NO: 29510

SEQ ID NO: 702771 - RNA, 64 nt, hsa; identical to SEQ ID NO: 29511

SEQ ID NO: 702772 - RNA, 64 nt, hsa; identical to SEQ ID NO: 29512

SEQ ID NO: 702773 - RNA, 64 nt, hsa; identical to SEQ ID NO: 29513

SEQ ID NO: 702774 - RNA, 54 nt, hsa; identical to SEQ ID NO: 29514

SEQ ID NO: 702775 - RNA, 64 nt, hsa; identical to SEQ ID NO: 29515

SEQ ID NO: 702776 - RNA, 64 nt, hsa; identical to SEQ ID NO: 29516

SEQ ID NO: 702777 - RNA, 64 nt, hsa; identical to SEQ ID NO: 29517

SEQ ID NO: 702778 - RNA, 64 nt, hsa; identical to SEQ ID NO: 29518

SEQ ID NO: 702779 - RNA, 64 nt, hsa; identical to SEQ ID NO: 29519

SEQ ID NO: 702780 - RNA, 64 nt, hsa; identical to SEQ ID NO: 29520

SEQ ID NO: 702781 - RNA, 64 nt, hsa; identical to SEQ ID NO: 29521

SEQ ID NO: 702782 - RNA, 64 nt, hsa; identical to SEQ ID NO: 29522

SEQ ID NO: 702783 - RNA, 64 nt, hsa; identical to SEQ ID NO: 29523

SEQ ID NO: 702784 - RNA, 64 nt, hsa; identical to SEQ ID NO: 29524

SEQ ID NO: 702785 - RNA, 64 nt, hsa; identical to SEQ ID NO: 29525

SEQ ID NO: 702786 - RNA, 64 nt, hsa; identical to SEQ ID NO: 29526

SEQ ID NO: 702787 - RNA, 64 nt, hsa; identical to SEQ ID NO: 29527

SEQ ID NO: 702788 - RNA, 64 nt, hsa; identical to SEQ ID NO: 29528

SEQ ID NO: 702789 - RNA, 64 nt, hsa; identical to SEQ ID NO: 29529

SEQ ID NO: 702790 - RNA, 64 nt, hsa; identical to SEQ ID NO: 29530

SEQ ID NO: 702791 - RNA, 64 nt, hsa; identical to SEQ ID NO: 29531

SEQ ID NO: 702792 - RNA, 64 nt, hsa; identical to SEQ ID NO: 29532

SEQ ID NO: 702793 - RNA, 64 nt, hsa; identical to SEQ ID NO: 29533

SEQ ID NO: 702794 - RNA, 64 nt, hsa; identical to SEQ ID NO: 29534

SEQ ID NO: 702795 - RNA, 64 nt, hsa; identical to SEQ ID NO: 29535

SEQ ID NO: 702796 - RNA, 64 nt, hsa; identical to SEQ ID NO: 29536

SEQ ID NO: 702797 - RNA, 64 nt, hsa; identical to SEQ ID NO: 29537

SEQ ID NO: 702798 - RNA, 64 nt, hsa; identical to SEQ ID NO: 29538

SEQ ID NO: 702799 - RNA, 64 nt, hsa; identical to SEQ ID NO: 29539

SEQ ID NO: 702800 - RNA, 64 nt, hsa; identical to SEQ ID NO: 29540

SEQ ID NO: 702801 - RNA, 64 nt, hsa; identical to SEQ ID NO: 29541

SEQ ID NO: 702802 - RNA, 64 nt, hsa; identical to SEQ ID NO: 29542

SEQ ID NO: 702803 - RNA, 64 nt, hsa; identical to SEQ ID NO: 29543

SEQ ID NO: 702804 - RNA, 64 nt, hsa; identical to SEQ ID NO: 29544

SEQ ID NO: 702805 - RNA, 64 nt, hsa; identical to SEQ ID NO: 29545

SEQ ID NO: 702806 - RNA, 64 nt, hsa; identical to SEQ ID NO: 29546

SEQ ID NO: 702807 - RNA, 64 nt, hsa; identical to SEQ ID NO: 29547

SEQ ID NO: 702808 - RNA, 64 nt, hsa; identical to SEQ ID NO: 29548

SEQ ID NO: 702809 - RNA, 64 nt, hsa; identical to SEQ ID NO: 29549

SEQ ID NO: 702810 - RNA, 64 nt, hsa; identical to SEQ ID NO: 29550

SEQ ID NO: 702811 - RNA, 64 nt, hsa; identical to SEQ ID NO: 29551

SEQ ID NO: 702812 - RNA, 64 nt, hsa; identical to SEQ ID NO: 29552

SEQ ID NO: 702813 - RNA, 64 nt, hsa; identical to SEQ ID NO: 29553

SEQ ID NO: 702814 - RNA, 64 nt, hsa; identical to SEQ ID NO: 29554

SEQ ID NO: 702815 - RNA, 64 nt, hsa; identical to SEQ ID NO: 29555

SEQ ID NO: 702816 - RNA, 64 nt, hsa; identical to SEQ ID NO: 29556

SEQ ID NO: 702817 - RNA, 64 nt, hsa; identical to SEQ ID NO: 29557

SEQ ID NO: 702818 - RNA, 64 nt, hsa; identical to SEQ ID NO: 29558

SEQ ID NO: 702819 - RNA, 64 nt, hsa; identical to SEQ ID NO: 29559

SEQ ID NO: 702820 - RNA, 64 nt, hsa; identical to SEQ ID NO: 29560

SEQ ID NO: 702821 - RNA, 64 nt, hsa; identical to SEQ ID NO: 29561

SEQ ID NO: 702822 - RNA, 64 nt, hsa; identical to SEQ ID NO: 29562

SEQ ID NO: 702823 - RNA, 64 nt, hsa; identical to SEQ ID NO: 29563

SEQ ID NO: 702824 - RNA, 64 nt, hsa; identical to SEQ ID NO: 29564

SEQ ID NO: 702825 - RNA, 64 nt, hsa; identical to SEQ ID NO: 29565

SEQ ID NO: 702826 - RNA, 64 nt, hsa; identical to SEQ ID NO: 29566

SEQ ID NO: 702827 - RNA, 64 nt, hsa; identical to SEQ ID NO: 29567

SEQ ID NO: 702828 - RNA, 64 nt, hsa; identical to SEQ ID NO: 29568

SEQ ID NO: 702829 - RNA, 64 nt, hsa; identical to SEQ ID NO: 29569

SEQ ID NO: 702830 - RNA, 64 nt, hsa; identical to SEQ ID NO: 29570

SEQ ID NO: 702831 - RNA, 64 nt, hsa; identical to SEQ ID NO: 29571

SEQ ID NO: 702832 - RNA, 64 nt, hsa; identical to SEQ ID NO: 29572

SEQ ID NO: 702833 - RNA, 64 nt, hsa; identical to SEQ ID NO: 29573

SEQ ID NO: 702834 - RNA, 64 nt, hsa; identical to SEQ ID NO: 29574

SEQ ID NO: 702835 - RNA, 64 nt, hsa; identical to SEQ ID NO: 29575

SEQ ID NO: 702836 - RNA, 64 nt, hsa; identical to SEQ ID NO: 29576

SEQ ID NO: 702837 - RNA, 64 nt, hsa; identical to SEQ ID NO: 29577

SEQ ID NO: 702838 - RNA, 64 nt, hsa; identical to SEQ ID NO: 29578

SEQ ID NO: 702839 - RNA, 64 nt, hsa; identical to SEQ ID NO: 29579

SEQ ID NO: 702840 - RNA, 64 nt, hsa; identical to SEQ ID NO: 29580

SEQ ID NO: 702841 - RNA, 64 nt, hsa; identical to SEQ ID NO: 29581

SEQ ID NO: 702842 - RNA, 64 nt, hsa; identical to SEQ ID NO: 29582

SEQ ID NO: 702843 - RNA, 64 nt, hsa; identical to SEQ ID NO: 29583

SEQ ID NO: 702844 - RNA, 64 nt, hsa; identical to SEQ ID NO: 29584

SEQ ID NO: 702845 - RNA, 64 nt, hsa; identical to SEQ ID NO: 29585

SEQ ID NO: 702846 - RNA, 64 nt, hsa; identical to SEQ ID NO: 29586

SEQ ID NO: 702847 - RNA, 64 nt, hsa; identical to SEQ ID NO: 29587

SEQ ID NO: 702848 - RNA, 64 nt, hsa; identical to SEQ ID NO: 29588

SEQ ID NO: 702849 - RNA, 64 nt, hsa; identical to SEQ ID NO: 29589

SEQ ID NO: 702850 - RNA, 64 nt, hsa; identical to SEQ ID NO: 29590

SEQ ID NO: 702851 - RNA, 64 nt, hsa; identical to SEQ ID NO: 29591

SEQ ID NO: 702852 - RNA, 64 nt, hsa; identical to SEQ ID NO: 29592

SEQ ID NO: 702853 - RNA, 64 nt, hsa; identical to SEQ ID NO: 29593

SEQ ID NO: 702854 - RNA, 64 nt, hsa; identical to SEQ ID NO: 29594

SEQ ID NO: 702855 - RNA, 64 nt, hsa; identical to SEQ ID NO: 29595

SEQ ID NO: 702856 - RNA, 64 nt, hsa; identical to SEQ ID NO: 29596

SEQ ID NO: 702857 - RNA, 64 nt, hsa; identical to SEQ ID NO: 29597

SEQ ID NO: 702858 - RNA, 64 nt, hsa; identical to SEQ ID NO: 29598

SEQ ID NO: 702859 - RNA, 64 nt, hsa; identical to SEQ ID NO: 29599

SEQ ID NO: 702860 - RNA, 64 nt, hsa; identical to SEQ ID NO: 29600

SEQ ID NO: 702861 - RNA, 64 nt, hsa; identical to SEQ ID NO: 29601

SEQ ID NO: 702862 - RNA, 64 nt, hsa; identical to SEQ ID NO: 29602

SEQ ID NO: 702863 - RNA, 64 nt, hsa; identical to SEQ ID NO: 29603

SEQ ID NO: 702864 - RNA, 64 nt, hsa; identical to SEQ ID NO: 29604

SEQ ID NO: 702865 - RNA, 64 nt, hsa; identical to SEQ ID NO: 29605

SEQ ID NO: 702866 - RNA, 64 nt, hsa; identical to SEQ ID NO: 29606

SEQ ID NO: 702867 - RNA, 64 nt, hsa; identical to SEQ ID NO: 29607

SEQ ID NO: 702868 - RNA, 64 nt, hsa; identical to SEQ ID NO: 29608

SEQ ID NO: 702869 - RNA, 64 nt, hsa; identical to SEQ ID NO: 29609

SEQ ID NO: 702870 - RNA, 64 nt, hsa; identical to SEQ ID NO: 29610

SEQ ID NO: 702871 - RNA, 64 nt, hsa; identical to SEQ ID NO: 29611

SEQ ID NO: 702872 - RNA, 64 nt, hsa; identical to SEQ ID NO: 29612

SEQ ID NO: 702873 - RNA, 64 nt, hsa; identical to SEQ ID NO: 29613

SEQ ID NO: 702874 - RNA, 64 nt, hsa; identical to SEQ ID NO: 29614

SEQ ID NO: 702875 - RNA, 64 nt, hsa; identical to SEQ ID NO: 29615

SEQ ID NO: 702876 - RNA, 64 nt, hsa; identical to SEQ ID NO: 29616

SEQ ID NO: 702877 - RNA, 64 nt, hsa; identical to SEQ ID NO: 29617

SEQ ID NO: 702878 - RNA, 64 nt, hsa; identical to SEQ ID NO: 29618

SEQ ID NO: 702879 - RNA, 64 nt, hsa; identical to SEQ ID NO: 29619

SEQ ID NO: 702880 - RNA, 64 nt, hsa; identical to SEQ ID NO: 29620

SEQ ID NO: 702881 - RNA, 64 nt, hsa; identical to SEQ ID NO: 29621

SEQ ID NO: 702882 - RNA, 64 nt, hsa; identical to SEQ ID NO: 29622

SEQ ID NO: 702883 - RNA, 64 nt, hsa; identical to SEQ ID NO: 29623

SEQ ID NO: 702884 - RNA, 64 nt, hsa; identical to SEQ ID NO: 29624

SEQ ID NO: 702885 - RNA, 64 nt, hsa; identical to SEQ ID NO: 29625

SEQ ID NO: 702886 - RNA, 64 nt, hsa; identical to SEQ ID NO: 29626

SEQ ID NO: 702887 - RNA, 64 nt, hsa; identical to SEQ ID NO: 29627

SEQ ID NO: 702888 - RNA, 64 nt, hsa; identical to SEQ ID NO: 29628

SEQ ID NO: 702889 - RNA, 64 nt, hsa; identical to SEQ ID NO: 29629

SEQ ID NO: 702890 - RNA, 64 nt, hsa; identical to SEQ ID NO: 29630

SEQ ID NO: 702891 - RNA, 64 nt, hsa; identical to SEQ ID NO: 29631

SEQ ID NO: 702892 - RNA, 64 nt, hsa; identical to SEQ ID NO: 29632

SEQ ID NO: 702893 - RNA, 64 nt, hsa; identical to SEQ ID NO: 29633

SEQ ID NO: 702894 - RNA, 64 nt, hsa; identical to SEQ ID NO: 29634

SEQ ID NO: 702895 - RNA, 64 nt, hsa; identical to SEQ ID NO: 29635

SEQ ID NO: 702896 - RNA, 64 nt, hsa; identical to SEQ ID NO: 29636

SEQ ID NO: 702897 - RNA, 64 nt, hsa; identical to SEQ ID NO: 29637

SEQ ID NO: 702898 - RNA, 64 nt, hsa; identical to SEQ ID NO: 29638

SEQ ID NO: 702899 - RNA, 64 nt, hsa; identical to SEQ ID NO: 29639

SEQ ID NO: 702900 - RNA, 64 nt, hsa; identical to SEQ ID NO: 29640

SEQ ID NO: 702901 - RNA, 64 nt, hsa; identical to SEQ ID NO: 29641

SEQ ID NO: 702902 - RNA, 64 nt, hsa; identical to SEQ ID NO: 29642

SEQ ID NO: 702903 - RNA, 64 nt, hsa; identical to SEQ ID NO: 29643

SEQ ID NO: 702904 - RNA, 64 nt, hsa; identical to SEQ ID NO: 29644

SEQ ID NO: 702905 - RNA, 64 nt, hsa; identical to SEQ ID NO: 29645

SEQ ID NO: 702906 - RNA, 64 nt, hsa; identical to SEQ ID NO: 29646

SEQ ID NO: 702907 - RNA, 64 nt, hsa; identical to SEQ ID NO: 29647

SEQ ID NO: 702908 - RNA, 64 nt, hsa; identical to SEQ ID NO: 29648

SEQ ID NO: 702909 - RNA, 64 nt, hsa; identical to SEQ ID NO: 29649

SEQ ID NO: 702910 - RNA, 64 nt, hsa; identical to SEQ ID NO: 29650

SEQ ID NO: 702911 - RNA, 64 nt, hsa; identical to SEQ ID NO: 29651

SEQ ID NO: 702912 - RNA, 64 nt, hsa; identical to SEQ ID NO: 29652

SEQ ID NO: 702913 - RNA, 64 nt, hsa; identical to SEQ ID NO: 29653

SEQ ID NO: 702914 - RNA, 64 nt, hsa; identical to SEQ ID NO: 29654

SEQ ID NO: 702915 - RNA, 64 nt, hsa; identical to SEQ ID NO: 29655

SEQ ID NO: 702916 - RNA, 64 nt, hsa; identical to SEQ ID NO: 29656

SEQ ID NO: 702917 - RNA, 64 nt, hsa; identical to SEQ ID NO: 29657

SEQ ID NO: 702918 - RNA, 64 nt, hsa; identical to SEQ ID NO: 29658

SEQ ID NO: 702919 - RNA, 64 nt, hsa; identical to SEQ ID NO: 29659

SEQ ID NO: 702920 - RNA, 64 nt, hsa; identical to SEQ ID NO: 29660

SEQ ID NO: 702921 - RNA, 64 nt, hsa; identical to SEQ ID NO: 29661

SEQ ID NO: 702922 - RNA, 64 nt, hsa; identical to SEQ ID NO: 29662

SEQ ID NO: 702923 - RNA, 64 nt, hsa; identical to SEQ ID NO: 29663

SEQ ID NO: 702924 - RNA, 64 nt, hsa; identical to SEQ ID NO: 29664

SEQ ID NO: 702925 - RNA, 64 nt, hsa; identical to SEQ ID NO: 29665

SEQ ID NO: 702926 - RNA, 64 nt, hsa; identical to SEQ ID NO: 29666

SEQ ID NO: 702927 - RNA, 64 nt, hsa; identical to SEQ ID NO: 29667

SEQ ID NO: 702928 - RNA, 64 nt, hsa; identical to SEQ ID NO: 29668

SEQ ID NO: 702929 - RNA, 64 nt, hsa; identical to SEQ ID NO: 29669

SEQ ID NO: 702930 - RNA, 64 nt, hsa; identical to SEQ ID NO: 29670

SEQ ID NO: 702931 - RNA, 64 nt, hsa; identical to SEQ ID NO: 29671

SEQ ID NO: 702932 - RNA, 64 nt, hsa; identical to SEQ ID NO: 29672

SEQ ID NO: 702933 - RNA, 64 nt, hsa; identical to SEQ ID NO: 29673

SEQ ID NO: 702934 - RNA, 64 nt, hsa; identical to SEQ ID NO: 29674

SEQ ID NO: 702935 - RNA, 64 nt, hsa; identical to SEQ ID NO: 29675

SEQ ID NO: 702936 - RNA, 64 nt, hsa; identical to SEQ ID NO: 29676

SEQ ID NO: 702937 - RNA, 64 nt, hsa; identical to SEQ ID NO: 29677

SEQ ID NO: 702938 - RNA, 64 nt, hsa; identical to SEQ ID NO: 29678

SEQ ID NO: 702939 - RNA, 64 nt, hsa; identical to SEQ ID NO: 29679

SEQ ID NO: 702940 - RNA, 64 nt, hsa; identical to SEQ ID NO: 29680

SEQ ID NO: 702941 - RNA, 64 nt, hsa; identical to SEQ ID NO: 29681

SEQ ID NO: 702942 - RNA, 64 nt, hsa; identical to SEQ ID NO: 29682

SEQ ID NO: 702943 - RNA, 64 nt, hsa; identical to SEQ ID NO: 29683

SEQ ID NO: 702944 - RNA, 64 nt, hsa; identical to SEQ ID NO: 29684

SEQ ID NO: 702945 - RNA, 64 nt, hsa; identical to SEQ ID NO: 29685

SEQ ID NO: 702946 - RNA, 64 nt, hsa; identical to SEQ ID NO: 29686

SEQ ID NO: 702947 - RNA, 64 nt, hsa; identical to SEQ ID NO: 29687

SEQ ID NO: 702948 - RNA, 64 nt, hsa; identical to SEQ ID NO: 29688

SEQ ID NO: 702949 - RNA, 64 nt, hsa; identical to SEQ ID NO: 29689

SEQ ID NO: 702950 - RNA, 64 nt, hsa; identical to SEQ ID NO: 29690

SEQ ID NO: 702951 - RNA, 64 nt, hsa; identical to SEQ ID NO: 29691

SEQ ID NO: 702952 - RNA, 64 nt, hsa; identical to SEQ ID NO: 29692

SEQ ID NO: 702953 - RNA, 64 nt, hsa; identical to SEQ ID NO: 29693

SEQ ID NO: 702954 - RNA, 64 nt, hsa; identical to SEQ ID NO: 29694

SEQ ID NO: 702955 - RNA, 64 nt, hsa; identical to SEQ ID NO: 29695

SEQ ID NO: 702956 - RNA, 64 nt, hsa; identical to SEQ ID NO: 29696

SEQ ID NO: 702957 - RNA, 64 nt, hsa; identical to SEQ ID NO: 29697

SEQ ID NO: 702958 - RNA, 64 nt, hsa; identical to SEQ ID NO: 29698

SEQ ID NO: 702959 - RNA, 64 nt, hsa; identical to SEQ ID NO: 29699

SEQ ID NO: 702960 - RNA, 64 nt, hsa; identical to SEQ ID NO: 29700

SEQ ID NO: 702961 - RNA, 64 nt, hsa; identical to SEQ ID NO: 29701

SEQ ID NO: 702962 - RNA, 64 nt, hsa; identical to SEQ ID NO: 29702

SEQ ID NO: 702963 - RNA, 64 nt, hsa; identical to SEQ ID NO: 29703

SEQ ID NO: 702964 - RNA, 64 nt, hsa; identical to SEQ ID NO: 29704

SEQ ID NO: 702965 - RNA, 64 nt, hsa; identical to SEQ ID NO: 29705

SEQ ID NO: 702966 - RNA, 64 nt, hsa; identical to SEQ ID NO: 29706

SEQ ID NO: 702967 - RNA, 64 nt, hsa; identical to SEQ ID NO: 29707

SEQ ID NO: 702968 - RNA, 64 nt, hsa; identical to SEQ ID NO: 29708

SEQ ID NO: 702969 - RNA, 64 nt, hsa; identical to SEQ ID NO: 29709

SEQ ID NO: 702970 - RNA, 64 nt, hsa; identical to SEQ ID NO: 29710

SEQ ID NO: 702971 - RNA, 64 nt, hsa; identical to SEQ ID NO: 29711

SEQ ID NO: 702972 - RNA, 64 nt, hsa; identical to SEQ ID NO: 29712

SEQ ID NO: 702973 - RNA, 64 nt, hsa; identical to SEQ ID NO: 29713

SEQ ID NO: 702974 - RNA, 64 nt, hsa; identical to SEQ ID NO: 29714

SEQ ID NO: 702975 - RNA, 64 nt, hsa; identical to SEQ ID NO: 29715

SEQ ID NO: 702976 - RNA, 64 nt, hsa; identical to SEQ ID NO: 29716

SEQ ID NO: 702977 - RNA, 64 nt, hsa; identical to SEQ ID NO: 29717

SEQ ID NO: 702978 - RNA, 64 nt, hsa; identical to SEQ ID NO: 29718

SEQ ID NO: 702979 - RNA, 64 nt, hsa; identical to SEQ ID NO: 29719

SEQ ID NO: 702980 - RNA, 64 nt, hsa; identical to SEQ ID NO: 29720

SEQ ID NO: 702981 - RNA, 64 nt, hsa; identical to SEQ ID NO: 29721

SEQ ID NO: 702982 - RNA, 64 nt, hsa; identical to SEQ ID NO: 29722

SEQ ID NO: 702983 - RNA, 64 nt, hsa; identical to SEQ ID NO: 29723

SEQ ID NO: 702984 - RNA, 64 nt, hsa; identical to SEQ ID NO: 29724

SEQ ID NO: 702985 - RNA, 64 nt, hsa; identical to SEQ ID NO: 29725

SEQ ID NO: 702986 - RNA, 64 nt, hsa; identical to SEQ ID NO: 29726

SEQ ID NO: 702987 - RNA, 64 nt, hsa; identical to SEQ ID NO: 29727

SEQ ID NO: 702988 - RNA, 64 nt, hsa; identical to SEQ ID NO: 29728

SEQ ID NO: 702989 - RNA, 64 nt, hsa; identical to SEQ ID NO: 29729

SEQ ID NO: 702990 - RNA, 64 nt, hsa; identical to SEQ ID NO: 29730

SEQ ID NO: 702991 - RNA, 64 nt, hsa; identical to SEQ ID NO: 29731

SEQ ID NO: 702992 - RNA, 64 nt, hsa; identical to SEQ ID NO: 29732

SEQ ID NO: 702993 - RNA, 64 nt, hsa; identical to SEQ ID NO: 29733

SEQ ID NO: 702994 - RNA, 64 nt, hsa; identical to SEQ ID NO: 29734

SEQ ID NO: 702995 - RNA, 64 nt, hsa; identical to SEQ ID NO: 29735

SEQ ID NO: 702996 - RNA, 64 nt, hsa; identical to SEQ ID NO: 29736

SEQ ID NO: 702997 - RNA, 64 nt, hsa; identical to SEQ ID NO: 29737

SEQ ID NO: 702998 - RNA, 64 nt, hsa; identical to SEQ ID NO: 29738

SEQ ID NO: 702999 - RNA, 64 nt, hsa; identical to SEQ ID NO: 29739

SEQ ID NO: 703000 - RNA, 64 nt, hsa; identical to SEQ ID NO: 29740

SEQ ID NO: 703001 - RNA, 64 nt, hsa; identical to SEQ ID NO: 29741

SEQ ID NO: 703002 - RNA, 64 nt, hsa; identical to SEQ ID NO: 29742

SEQ ID NO: 703003 - RNA, 64 nt, hsa; identical to SEQ ID NO: 29743

SEQ ID NO: 703004 - RNA, 64 nt, hsa; identical to SEQ ID NO: 29744

SEQ ID NO: 703005 - RNA, 64 nt, hsa; identical to SEQ ID NO: 29745

SEQ ID NO: 703006 - RNA, 64 nt, hsa; identical to SEQ ID NO: 29746

SEQ ID NO: 703007 - RNA, 64 nt, hsa; identical to SEQ ID NO: 29747

SEQ ID NO: 703008 - RNA, 64 nt, hsa; identical to SEQ ID NO: 29748

SEQ ID NO: 703009 - RNA, 64 nt, hsa; identical to SEQ ID NO: 29749

SEQ ID NO: 703010 - RNA, 64 nt, hsa; identical to SEQ ID NO: 29750

SEQ ID NO: 703011 - RNA, 64 nt, hsa; identical to SEQ ID NO: 29751

SEQ ID NO: 703012 - RNA, 64 nt, hsa; identical to SEQ ID NO: 29752

SEQ ID NO: 703013 - RNA, 64 nt, hsa; identical to SEQ ID NO: 29753

SEQ ID NO: 703014 - RNA, 64 nt, hsa; identical to SEQ ID NO: 29754

SEQ ID NO: 703015 - RNA, 64 nt, hsa; identical to SEQ ID NO: 29755

SEQ ID NO: 703016 - RNA, 64 nt, hsa; identical to SEQ ID NO: 29756

SEQ ID NO: 703017 - RNA, 64 nt, hsa; identical to SEQ ID NO: 29757

SEQ ID NO: 703018 - RNA, 64 nt, hsa; identical to SEQ ID NO: 29758

SEQ ID NO: 703019 - RNA, 64 nt, hsa; identical to SEQ ID NO: 29759

SEQ ID NO: 703020 - RNA, 64 nt, hsa; identical to SEQ ID NO: 29760

SEQ ID NO: 703021 - RNA, 64 nt, hsa; identical to SEQ ID NO: 29761

SEQ ID NO: 703022 - RNA, 64 nt, hsa; identical to SEQ ID NO: 29762

SEQ ID NO: 703023 - RNA, 64 nt, hsa; identical to SEQ ID NO: 29763

SEQ ID NO: 703024 - RNA, 64 nt, hsa; identical to SEQ ID NO: 29764

SEQ ID NO: 703025 - RNA, 64 nt, hsa; identical to SEQ ID NO: 29765

SEQ ID NO: 703026 - RNA, 64 nt, hsa; identical to SEQ ID NO: 29766

SEQ ID NO: 703027 - RNA, 64 nt, hsa; identical to SEQ ID NO: 29767

SEQ ID NO: 703028 - RNA, 64 nt, hsa; identical to SEQ ID NO: 29768

SEQ ID NO: 703029 - RNA, 64 nt, hsa; identical to SEQ ID NO: 29769

SEQ ID NO: 703030 - RNA, 64 nt, hsa; identical to SEQ ID NO: 29770

SEQ ID NO: 703031 - RNA, 64 nt, hsa; identical to SEQ ID NO: 29771

SEQ ID NO: 703032 - RNA, 64 nt, hsa; identical to SEQ ID NO: 29772

SEQ ID NO: 703033 - RNA, 64 nt, hsa; identical to SEQ ID NO: 29773

SEQ ID NO: 703034 - RNA, 64 nt, hsa; identical to SEQ ID NO: 29774

SEQ ID NO: 703035 - RNA, 64 nt, hsa; identical to SEQ ID NO: 29775

SEQ ID NO: 703036 - RNA, 64 nt, hsa; identical to SEQ ID NO: 29776

SEQ ID NO: 703037 - RNA, 64 nt, hsa; identical to SEQ ID NO: 29777

SEQ ID NO: 703038 - RNA, 64 nt, hsa; identical to SEQ ID NO: 29778

SEQ ID NO: 703039 - RNA, 64 nt, hsa; identical to SEQ ID NO: 29779

SEQ ID NO: 703040 - RNA, 64 nt, hsa; identical to SEQ ID NO: 29780

SEQ ID NO: 703041 - RNA, 64 nt, hsa; identical to SEQ ID NO: 29781

SEQ ID NO: 703042 - RNA, 64 nt, hsa; identical to SEQ ID NO: 29782

SEQ ID NO: 703043 - RNA, 64 nt, hsa; identical to SEQ ID NO: 29783

SEQ ID NO: 703044 - RNA, 64 nt, hsa; identical to SEQ ID NO: 29784

SEQ ID NO: 703045 - RNA, 64 nt, hsa; identical to SEQ ID NO: 29785

SEQ ID NO: 703046 - RNA, 64 nt, hsa; identical to SEQ ID NO: 29786

SEQ ID NO: 703047 - RNA, 64 nt, hsa; identical to SEQ ID NO: 29787

SEQ ID NO: 703048 - RNA, 64 nt, hsa; identical to SEQ ID NO: 29788

SEQ ID NO: 703049 - RNA, 64 nt, hsa; identical to SEQ ID NO: 29789

SEQ ID NO: 703050 - RNA, 64 nt, hsa; identical to SEQ ID NO: 29790

SEQ ID NO: 703051 - RNA, 64 nt, hsa; identical to SEQ ID NO: 29791

SEQ ID NO: 703052 - RNA, 64 nt, hsa; identical to SEQ ID NO: 29792

SEQ ID NO: 703053 - RNA, 64 nt, hsa; identical to SEQ ID NO: 29793

SEQ ID NO: 703054 - RNA, 64 nt, hsa; identical to SEQ ID NO: 29794

SEQ ID NO: 703055 - RNA, 64 nt, hsa; identical to SEQ ID NO: 29795

SEQ ID NO: 703056 - RNA, 64 nt, hsa; identical to SEQ ID NO: 29796

SEQ ID NO: 703057 - RNA, 64 nt, hsa; identical to SEQ ID NO: 29797

SEQ ID NO: 703058 - RNA, 64 nt, hsa; identical to SEQ ID NO: 29798

SEQ ID NO: 703059 - RNA, 64 nt, hsa; identical to SEQ ID NO: 29799

SEQ ID NO: 703060 - RNA, 64 nt, hsa; identical to SEQ ID NO: 29800

SEQ ID NO: 703061 - RNA, 64 nt, hsa; identical to SEQ ID NO: 29801

SEQ ID NO: 703062 - RNA, 64 nt, hsa; identical to SEQ ID NO: 29802

SEQ ID NO: 703063 - RNA, 64 nt, hsa; identical to SEQ ID NO: 29803

SEQ ID NO: 703064 - RNA, 64 nt, hsa; identical to SEQ ID NO: 29804

SEQ ID NO: 703065 - RNA, 64 nt, hsa; identical to SEQ ID NO: 29805

SEQ ID NO: 703066 - RNA, 64 nt, hsa; identical to SEQ ID NO: 29806

SEQ ID NO: 703067 - RNA, 64 nt, hsa; identical to SEQ ID NO: 29807

SEQ ID NO: 703068 - RNA, 64 nt, hsa; identical to SEQ ID NO: 29808

SEQ ID NO: 703069 - RNA, 64 nt, hsa; identical to SEQ ID NO: 29809

SEQ ID NO: 703070 - RNA, 64 nt, hsa; identical to SEQ ID NO: 29810

SEQ ID NO: 703071 - RNA, 64 nt, hsa; identical to SEQ ID NO: 29811

SEQ ID NO: 703072 - RNA, 64 nt, hsa; identical to SEQ ID NO: 29812

SEQ ID NO: 703073 - RNA, 64 nt, hsa; identical to SEQ ID NO: 29813

SEQ ID NO: 703074 - RNA, 64 nt, hsa; identical to SEQ ID NO: 29814

SEQ ID NO: 703075 - RNA, 64 nt, hsa; identical to SEQ ID NO: 29815

SEQ ID NO: 703076 - RNA, 64 nt, hsa; identical to SEQ ID NO: 29816

SEQ ID NO: 703077 - RNA, 64 nt, hsa; identical to SEQ ID NO: 29817

SEQ ID NO: 703078 - RNA, 64 nt, hsa; identical to SEQ ID NO: 29818

SEQ ID NO: 703079 - RNA, 64 nt, hsa; identical to SEQ ID NO: 29819

SEQ ID NO: 703080 - RNA, 64 nt, hsa; identical to SEQ ID NO: 29820

SEQ ID NO: 703081 - RNA, 64 nt, hsa; identical to SEQ ID NO: 29821

SEQ ID NO: 703082 - RNA, 64 nt, hsa; identical to SEQ ID NO: 29822

SEQ ID NO: 703083 - RNA, 64 nt, hsa; identical to SEQ ID NO: 29823

SEQ ID NO: 703084 - RNA, 64 nt, hsa; identical to SEQ ID NO: 29824

SEQ ID NO: 703085 - RNA, 64 nt, hsa; identical to SEQ ID NO: 29825

SEQ ID NO: 703086 - RNA, 64 nt, hsa; identical to SEQ ID NO: 29826

SEQ ID NO: 703087 - RNA, 64 nt, hsa; identical to SEQ ID NO: 29827

SEQ ID NO: 703088 - RNA, 64 nt, hsa; identical to SEQ ID NO: 29828

SEQ ID NO: 703089 - RNA, 64 nt, hsa; identical to SEQ ID NO: 29829

SEQ ID NO: 703090 - RNA, 64 nt, hsa; identical to SEQ ID NO: 29830

SEQ ID NO: 703091 - RNA, 64 nt, hsa; identical to SEQ ID NO: 29831

SEQ ID NO: 703092 - RNA, 64 nt, hsa; identical to SEQ ID NO: 29832

SEQ ID NO: 703093 - RNA, 64 nt, hsa; identical to SEQ ID NO: 29833

SEQ ID NO: 703094 - RNA, 64 nt, hsa; identical to SEQ ID NO: 29834

SEQ ID NO: 703095 - RNA, 64 nt, hsa; identical to SEQ ID NO: 29835

SEQ ID NO: 703096 - RNA, 64 nt, hsa; identical to SEQ ID NO: 29836

SEQ ID NO: 703097 - RNA, 64 nt, hsa; identical to SEQ ID NO: 29837

SEQ ID NO: 703098 - RNA, 64 nt, hsa; identical to SEQ ID NO: 29838

SEQ ID NO: 703099 - RNA, 64 nt, hsa; identical to SEQ ID NO: 29839

SEQ ID NO: 703100 - RNA, 64 nt, hsa; identical to SEQ ID NO: 29840

SEQ ID NO: 703101 - RNA, 64 nt, hsa; identical to SEQ ID NO: 29841

SEQ ID NO: 703102 - RNA, 64 nt, hsa; identical to SEQ ID NO: 29842

SEQ ID NO: 703103 - RNA, 64 nt, hsa; identical to SEQ ID NO: 29843

SEQ ID NO: 703104 - RNA, 64 nt, hsa; identical to SEQ ID NO: 29844

SEQ ID NO: 703105 - RNA, 64 nt, hsa; identical to SEQ ID NO: 29845

SEQ ID NO: 703106 - RNA, 64 nt, hsa; identical to SEQ ID NO: 29846

SEQ ID NO: 703107 - RNA, 64 nt, hsa; identical to SEQ ID NO: 29847

SEQ ID NO: 703108 - RNA, 64 nt, hsa; identical to SEQ ID NO: 29848

SEQ ID NO: 703109 - RNA, 64 nt, hsa; identical to SEQ ID NO: 29849

SEQ ID NO: 703110 - RNA, 64 nt, hsa; identical to SEQ ID NO: 29850

SEQ ID NO: 703111 - RNA, 64 nt, hsa; identical to SEQ ID NO: 29851

SEQ ID NO: 703112 - RNA, 64 nt, hsa; identical to SEQ ID NO: 29852

SEQ ID NO: 703113 - RNA, 64 nt, hsa; identical to SEQ ID NO: 29853

SEQ ID NO: 703114 - RNA, 64 nt, hsa; identical to SEQ ID NO: 29854

SEQ ID NO: 703115 - RNA, 64 nt, hsa; identical to SEQ ID NO: 29855

SEQ ID NO: 703116 - RNA, 64 nt, hsa; identical to SEQ ID NO: 29856

SEQ ID NO: 703117 - RNA, 64 nt, hsa; identical to SEQ ID NO: 29857

SEQ ID NO: 703118 - RNA, 64 nt, hsa; identical to SEQ ID NO: 29858

SEQ ID NO: 703119 - RNA, 64 nt, hsa; identical to SEQ ID NO: 29859

SEQ ID NO: 703120 - RNA, 64 nt, hsa; identical to SEQ ID NO: 29860

SEQ ID NO: 703121 - RNA, 64 nt, hsa; identical to SEQ ID NO: 29861

SEQ ID NO: 703122 - RNA, 64 nt, hsa; identical to SEQ ID NO: 29862

SEQ ID NO: 703123 - RNA, 64 nt, hsa; identical to SEQ ID NO: 29863

SEQ ID NO: 703124 - RNA, 64 nt, hsa; identical to SEQ ID NO: 29864

SEQ ID NO: 703125 - RNA, 64 nt, hsa; identical to SEQ ID NO: 29865

SEQ ID NO: 703126 - RNA, 64 nt, hsa; identical to SEQ ID NO: 29866

SEQ ID NO: 703127 - RNA, 64 nt, hsa; identical to SEQ ID NO: 29867

SEQ ID NO: 703128 - RNA, 64 nt, hsa; identical to SEQ ID NO: 29868

SEQ ID NO: 703129 - RNA, 64 nt, hsa; identical to SEQ ID NO: 29869

SEQ ID NO: 703130 - RNA, 64 nt, hsa; identical to SEQ ID NO: 29870

SEQ ID NO: 703131 - RNA, 64 nt, hsa; identical to SEQ ID NO: 29871

SEQ ID NO: 703132 - RNA, 64 nt, hsa; identical to SEQ ID NO: 29872

SEQ ID NO: 703133 - RNA, 64 nt, hsa; identical to SEQ ID NO: 29873

SEQ ID NO: 703134 - RNA, 64 nt, hsa; identical to SEQ ID NO: 29874

SEQ ID NO: 703135 - RNA, 64 nt, hsa; identical to SEQ ID NO: 29875

SEQ ID NO: 703136 - RNA, 64 nt, hsa; identical to SEQ ID NO: 29876

SEQ ID NO: 703137 - RNA, 64 nt, hsa; identical to SEQ ID NO: 29877

SEQ ID NO: 703138 - RNA, 64 nt, hsa; identical to SEQ ID NO: 29878

SEQ ID NO: 703139 - RNA, 64 nt, hsa; identical to SEQ ID NO: 29879

SEQ ID NO: 703140 - RNA, 64 nt, hsa; identical to SEQ ID NO: 29880

SEQ ID NO: 703141 - RNA, 64 nt, hsa; identical to SEQ ID NO: 29881

SEQ ID NO: 703142 - RNA, 64 nt, hsa; identical to SEQ ID NO: 29882

SEQ ID NO: 703143 - RNA, 64 nt, hsa; identical to SEQ ID NO: 29883

SEQ ID NO: 703144 - RNA, 64 nt, hsa; identical to SEQ ID NO: 29884

SEQ ID NO: 703145 - RNA, 64 nt, hsa; identical to SEQ ID NO: 29885

SEQ ID NO: 703146 - RNA, 64 nt, hsa; identical to SEQ ID NO: 29886

SEQ ID NO: 703147 - RNA, 64 nt, hsa; identical to SEQ ID NO: 29887

SEQ ID NO: 703148 - RNA, 64 nt, hsa; identical to SEQ ID NO: 29888

SEQ ID NO: 703149 - RNA, 64 nt, hsa; identical to SEQ ID NO: 29889

SEQ ID NO: 703150 - RNA, 64 nt, hsa; identical to SEQ ID NO: 29890

SEQ ID NO: 703151 - RNA, 64 nt, hsa; identical to SEQ ID NO: 29891

SEQ ID NO: 703152 - RNA, 64 nt, hsa; identical to SEQ ID NO: 29892

SEQ ID NO: 703153 - RNA, 64 nt, hsa; identical to SEQ ID NO: 29893

SEQ ID NO: 703154 - RNA, 64 nt, hsa; identical to SEQ ID NO: 29894

SEQ ID NO: 703155 - RNA, 64 nt, hsa; identical to SEQ ID NO: 29895

SEQ ID NO: 703156 - RNA, 64 nt, hsa; identical to SEQ ID NO: 29896

SEQ ID NO: 703157 - RNA, 64 nt, hsa; identical to SEQ ID NO: 29897

SEQ ID NO: 703158 - RNA, 64 nt, hsa; identical to SEQ ID NO: 29898

SEQ ID NO: 703159 - RNA, 64 nt, hsa; identical to SEQ ID NO: 29899

SEQ ID NO: 703160 - RNA, 64 nt, hsa; identical to SEQ ID NO: 29900

SEQ ID NO: 703161 - RNA, 64 nt, hsa; identical to SEQ ID NO: 29901

SEQ ID NO: 703162 - RNA, 64 nt, hsa; identical to SEQ ID NO: 29902

SEQ ID NO: 703163 - RNA, 64 nt, hsa; identical to SEQ ID NO: 29903

SEQ ID NO: 703164 - RNA, 64 nt, hsa; identical to SEQ ID NO: 29904

SEQ ID NO: 703165 - RNA, 64 nt, hsa; identical to SEQ ID NO: 29905

SEQ ID NO: 703166 - RNA, 64 nt, hsa; identical to SEQ ID NO: 29906

SEQ ID NO: 703167 - RNA, 64 nt, hsa; identical to SEQ ID NO: 29907

SEQ ID NO: 703168 - RNA, 64 nt, hsa; identical to SEQ ID NO: 29908

SEQ ID NO: 703169 - RNA, 64 nt, hsa; identical to SEQ ID NO: 29909

SEQ ID NO: 703170 - RNA, 64 nt, hsa; identical to SEQ ID NO: 29910

SEQ ID NO: 703171 - RNA, 64 nt, hsa; identical to SEQ ID NO: 29911

SEQ ID NO: 703172 - RNA, 64 nt, hsa; identical to SEQ ID NO: 29912

SEQ ID NO: 703173 - RNA, 64 nt, hsa; identical to SEQ ID NO: 29913

SEQ ID NO: 703174 - RNA, 64 nt, hsa; identical to SEQ ID NO: 29914

SEQ ID NO: 703175 - RNA, 64 nt, hsa; identical to SEQ ID NO: 29915

SEQ ID NO: 703176 - RNA, 64 nt, hsa; identical to SEQ ID NO: 29916

SEQ ID NO: 703177 - RNA, 64 nt, hsa; identical to SEQ ID NO: 29917

SEQ ID NO: 703178 - RNA, 64 nt, hsa; identical to SEQ ID NO: 29918

SEQ ID NO: 703179 - RNA, 64 nt, hsa; identical to SEQ ID NO: 29919

SEQ ID NO: 703180 - RNA, 64 nt, hsa; identical to SEQ ID NO: 29920

SEQ ID NO: 703181 - RNA, 64 nt, hsa; identical to SEQ ID NO: 29921

SEQ ID NO: 703182 - RNA, 64 nt, hsa; identical to SEQ ID NO: 29922

SEQ ID NO: 703183 - RNA, 64 nt, hsa; identical to SEQ ID NO: 29923

SEQ ID NO: 703184 - RNA, 64 nt, hsa; identical to SEQ ID NO: 29924

SEQ ID NO: 703185 - RNA, 64 nt, hsa; identical to SEQ ID NO: 29925

SEQ ID NO: 703186 - RNA, 64 nt, hsa; identical to SEQ ID NO: 29926

SEQ ID NO: 703187 - RNA, 64 nt, hsa; identical to SEQ ID NO: 29927

SEQ ID NO: 703188 - RNA, 64 nt, hsa; identical to SEQ ID NO: 29928

SEQ ID NO: 703189 - RNA, 64 nt, hsa; identical to SEQ ID NO: 29929

SEQ ID NO: 703190 - RNA, 64 nt, hsa; identical to SEQ ID NO: 29930

SEQ ID NO: 703191 - RNA, 64 nt, hsa; identical to SEQ ID NO: 29931

SEQ ID NO: 703192 - RNA, 64 nt, hsa; identical to SEQ ID NO: 29932

SEQ ID NO: 703193 - RNA, 64 nt, hsa; identical to SEQ ID NO: 29933

SEQ ID NO: 703194 - RNA, 64 nt, hsa; identical to SEQ ID NO: 29934

SEQ ID NO: 703195 - RNA, 64 nt, hsa; identical to SEQ ID NO: 29935

SEQ ID NO: 703196 - RNA, 64 nt, hsa; identical to SEQ ID NO: 29936

SEQ ID NO: 703197 - RNA, 64 nt, hsa; identical to SEQ ID NO: 29937

SEQ ID NO: 703198 - RNA, 64 nt, hsa; identical to SEQ ID NO: 29938

SEQ ID NO: 703199 - RNA, 64 nt, hsa; identical to SEQ ID NO: 29939

SEQ ID NO: 703200 - RNA, 64 nt, hsa; identical to SEQ ID NO: 29940

SEQ ID NO: 703201 - RNA, 64 nt, hsa; identical to SEQ ID NO: 29941

SEQ ID NO: 703202 - RNA, 64 nt, hsa; identical to SEQ ID NO: 29942

SEQ ID NO: 703203 - RNA, 64 nt, hsa; identical to SEQ ID NO: 29943

SEQ ID NO: 703204 - RNA, 64 nt, hsa; identical to SEQ ID NO: 29944

SEQ ID NO: 703205 - RNA, 64 nt, hsa; identical to SEQ ID NO: 29945

SEQ ID NO: 703206 - RNA, 64 nt, hsa; identical to SEQ ID NO: 29946

SEQ ID NO: 703207 - RNA, 64 nt, hsa; identical to SEQ ID NO: 29947

SEQ ID NO: 703208 - RNA, 64 nt, hsa; identical to SEQ ID NO: 29948

SEQ ID NO: 703209 - RNA, 64 nt, hsa; identical to SEQ ID NO: 29949

SEQ ID NO: 703210 - RNA, 64 nt, hsa; identical to SEQ ID NO: 29950

SEQ ID NO: 703211 - RNA, 64 nt, hsa; identical to SEQ ID NO: 29951

SEQ ID NO: 703212 - RNA, 64 nt, hsa; identical to SEQ ID NO: 29952

SEQ ID NO: 703213 - RNA, 64 nt, hsa; identical to SEQ ID NO: 29953

SEQ ID NO: 703214 - RNA, 64 nt, hsa; identical to SEQ ID NO: 29954

SEQ ID NO: 703215 - RNA, 64 nt, hsa; identical to SEQ ID NO: 29955

SEQ ID NO: 703216 - RNA, 64 nt, hsa; identical to SEQ ID NO: 29956

SEQ ID NO: 703217 - RNA, 64 nt, hsa; identical to SEQ ID NO: 29957

SEQ ID NO: 703218 - RNA, 64 nt, hsa; identical to SEQ ID NO: 29958

SEQ ID NO: 703219 - RNA, 64 nt, hsa; identical to SEQ ID NO: 29959

SEQ ID NO: 703220 - RNA, 64 nt, hsa; identical to SEQ ID NO: 29960

SEQ ID NO: 703221 - RNA, 64 nt, hsa; identical to SEQ ID NO: 29961

SEQ ID NO: 703222 - RNA, 64 nt, hsa; identical to SEQ ID NO: 29962

SEQ ID NO: 703223 - RNA, 64 nt, hsa; identical to SEQ ID NO: 29963

SEQ ID NO: 703224 - RNA, 64 nt, hsa; identical to SEQ ID NO: 29964

SEQ ID NO: 703225 - RNA, 64 nt, hsa; identical to SEQ ID NO: 29965

SEQ ID NO: 703226 - RNA, 64 nt, hsa; identical to SEQ ID NO: 29966

SEQ ID NO: 703227 - RNA, 64 nt, hsa; identical to SEQ ID NO: 29967

SEQ ID NO: 703228 - RNA, 64 nt, hsa; identical to SEQ ID NO: 29968

SEQ ID NO: 703229 - RNA, 64 nt, hsa; identical to SEQ ID NO: 29969

SEQ ID NO: 703230 - RNA, 64 nt, hsa; identical to SEQ ID NO: 29970

SEQ ID NO: 703231 - RNA, 64 nt, hsa; identical to SEQ ID NO: 29971

SEQ ID NO: 703232 - RNA, 64 nt, hsa; identical to SEQ ID NO: 29972

SEQ ID NO: 703233 - RNA, 64 nt, hsa; identical to SEQ ID NO: 29973

SEQ ID NO: 703234 - RNA, 64 nt, hsa; identical to SEQ ID NO: 29974

SEQ ID NO: 703235 - RNA, 64 nt, hsa; identical to SEQ ID NO: 29975

SEQ ID NO: 703236 - RNA, 64 nt, hsa; identical to SEQ ID NO: 29976

SEQ ID NO: 703237 - RNA, 64 nt, hsa; identical to SEQ ID NO: 29977

SEQ ID NO: 703238 - RNA, 64 nt, hsa; identical to SEQ ID NO: 29978

SEQ ID NO: 703239 - RNA, 64 nt, hsa; identical to SEQ ID NO: 29979

SEQ ID NO: 703240 - RNA, 64 nt, hsa; identical to SEQ ID NO: 29980

SEQ ID NO: 703241 - RNA, 64 nt, hsa; identical to SEQ ID NO: 29981

SEQ ID NO: 703242 - RNA, 64 nt, hsa; identical to SEQ ID NO: 29982

SEQ ID NO: 703243 - RNA, 64 nt, hsa; identical to SEQ ID NO: 29983

SEQ ID NO: 703244 - RNA, 64 nt, hsa; identical to SEQ ID NO: 29984

SEQ ID NO: 703245 - RNA, 64 nt, hsa; identical to SEQ ID NO: 29985

SEQ ID NO: 703246 - RNA, 64 nt, hsa; identical to SEQ ID NO: 29986

SEQ ID NO: 703247 - RNA, 64 nt, hsa; identical to SEQ ID NO: 29987

SEQ ID NO: 703248 - RNA, 64 nt, hsa; identical to SEQ ID NO: 29988

SEQ ID NO: 703249 - RNA, 64 nt, hsa; identical to SEQ ID NO: 29989

SEQ ID NO: 703250 - RNA, 64 nt, hsa; identical to SEQ ID NO: 29990

SEQ ID NO: 703251 - RNA, 64 nt, hsa; identical to SEQ ID NO: 29991

SEQ ID NO: 703252 - RNA, 64 nt, hsa; identical to SEQ ID NO: 29992

SEQ ID NO: 703253 - RNA, 64 nt, hsa; identical to SEQ ID NO: 29993

SEQ ID NO: 703254 - RNA, 64 nt, hsa; identical to SEQ ID NO: 29994

SEQ ID NO: 703255 - RNA, 64 nt, hsa; identical to SEQ ID NO: 29995

SEQ ID NO: 703256 - RNA, 64 nt, hsa; identical to SEQ ID NO: 29996

SEQ ID NO: 703257 - RNA, 64 nt, hsa; identical to SEQ ID NO: 29997

SEQ ID NO: 703258 - RNA, 64 nt, hsa; identical to SEQ ID NO: 29998

SEQ ID NO: 703259 - RNA, 64 nt, hsa; identical to SEQ ID NO: 29999

SEQ ID NO: 703260 - RNA, 64 nt, hsa; identical to SEQ ID NO: 30000

SEQ ID NO: 703261 - RNA, 64 nt, hsa; identical to SEQ ID NO: 30001

SEQ ID NO: 703262 - RNA, 64 nt, hsa; identical to SEQ ID NO: 30002

SEQ ID NO: 703263 - RNA, 64 nt, hsa; identical to SEQ ID NO: 30003

SEQ ID NO: 703264 - RNA, 64 nt, hsa; identical to SEQ ID NO: 30004

SEQ ID NO: 703265 - RNA, 64 nt, hsa; identical to SEQ ID NO: 30005

SEQ ID NO: 703266 - RNA, 64 nt, hsa; identical to SEQ ID NO: 30006

SEQ ID NO: 703267 - RNA, 64 nt, hsa; identical to SEQ ID NO: 30007

SEQ ID NO: 703268 - RNA, 64 nt, hsa; identical to SEQ ID NO: 30008

SEQ ID NO: 703269 - RNA, 64 nt, hsa; identical to SEQ ID NO: 30009

SEQ ID NO: 703270 - RNA, 64 nt, hsa; identical to SEQ ID NO: 30010

SEQ ID NO: 703271 - RNA, 64 nt, hsa; identical to SEQ ID NO: 30011

SEQ ID NO: 703272 - RNA, 64 nt, hsa; identical to SEQ ID NO: 30012

SEQ ID NO: 703273 - RNA, 64 nt, hsa; identical to SEQ ID NO: 30013

SEQ ID NO: 703274 - RNA, 64 nt, hsa; identical to SEQ ID NO: 30014

SEQ ID NO: 703275 - RNA, 64 nt, hsa; identical to SEQ ID NO: 30015

SEQ ID NO: 703276 - RNA, 64 nt, hsa; identical to SEQ ID NO: 30016

SEQ ID NO: 703277 - RNA, 64 nt, hsa; identical to SEQ ID NO: 30017

SEQ ID NO: 703278 - RNA, 64 nt, hsa; identical to SEQ ID NO: 30018

SEQ ID NO: 703279 - RNA, 64 nt, hsa; identical to SEQ ID NO: 30019

SEQ ID NO: 703280 - RNA, 64 nt, hsa; identical to SEQ ID NO: 30020

SEQ ID NO: 703281 - RNA, 64 nt, hsa; identical to SEQ ID NO: 30021

SEQ ID NO: 703282 - RNA, 64 nt, hsa; identical to SEQ ID NO: 30022

SEQ ID NO: 703283 - RNA, 64 nt, hsa; identical to SEQ ID NO: 30023

SEQ ID NO: 703284 - RNA, 64 nt, hsa; identical to SEQ ID NO: 30024

SEQ ID NO: 703285 - RNA, 64 nt, hsa; identical to SEQ ID NO: 30025

SEQ ID NO: 703286 - RNA, 64 nt, hsa; identical to SEQ ID NO: 30026

SEQ ID NO: 703287 - RNA, 64 nt, hsa; identical to SEQ ID NO: 30027

SEQ ID NO: 703288 - RNA, 64 nt, hsa; identical to SEQ ID NO: 30028

SEQ ID NO: 703289 - RNA, 64 nt, hsa; identical to SEQ ID NO: 30029

SEQ ID NO: 703290 - RNA, 64 nt, hsa; identical to SEQ ID NO: 30030

SEQ ID NO: 703291 - RNA, 64 nt, hsa; identical to SEQ ID NO: 30031

SEQ ID NO: 703292 - RNA, 64 nt, hsa; identical to SEQ ID NO: 30032

SEQ ID NO: 703293 - RNA, 64 nt, hsa; identical to SEQ ID NO: 30033

SEQ ID NO: 703294 - RNA, 64 nt, hsa; identical to SEQ ID NO: 30034

SEQ ID NO: 703295 - RNA, 64 nt, hsa; identical to SEQ ID NO: 30035

SEQ ID NO: 703296 - RNA, 64 nt, hsa; identical to SEQ ID NO: 30036

SEQ ID NO: 703297 - RNA, 64 nt, hsa; identical to SEQ ID NO: 30037

SEQ ID NO: 703298 - RNA, 64 nt, hsa; identical to SEQ ID NO: 30038

SEQ ID NO: 703299 - RNA, 64 nt, hsa; identical to SEQ ID NO: 30039

SEQ ID NO: 703300 - RNA, 64 nt, hsa; identical to SEQ ID NO: 30040

SEQ ID NO: 703301 - RNA, 64 nt, hsa; identical to SEQ ID NO: 30041

SEQ ID NO: 703302 - RNA, 64 nt, hsa; identical to SEQ ID NO: 30042

SEQ ID NO: 703303 - RNA, 64 nt, hsa; identical to SEQ ID NO: 30043

SEQ ID NO: 703304 - RNA, 64 nt, hsa; identical to SEQ ID NO: 30044

SEQ ID NO: 703305 - RNA, 64 nt, hsa; identical to SEQ ID NO: 30045

SEQ ID NO: 703306 - RNA, 64 nt, hsa; identical to SEQ ID NO: 30046

SEQ ID NO: 703307 - RNA, 64 nt, hsa; identical to SEQ ID NO: 30047

SEQ ID NO: 703308 - RNA, 64 nt, hsa; identical to SEQ ID NO: 30048

SEQ ID NO: 703309 - RNA, 64 nt, hsa; identical to SEQ ID NO: 30049

SEQ ID NO: 703310 - RNA, 64 nt, hsa; identical to SEQ ID NO: 30050

SEQ ID NO: 703311 - RNA, 64 nt, hsa; identical to SEQ ID NO: 30051

SEQ ID NO: 703312 - RNA, 64 nt, hsa; identical to SEQ ID NO: 30052

SEQ ID NO: 703313 - RNA, 64 nt, hsa; identical to SEQ ID NO: 30053

SEQ ID NO: 703314 - RNA, 64 nt, hsa; identical to SEQ ID NO: 30054

SEQ ID NO: 703315 - RNA, 64 nt, hsa; identical to SEQ ID NO: 30055

SEQ ID NO: 703316 - RNA, 64 nt, hsa; identical to SEQ ID NO: 30056

SEQ ID NO: 703317 - RNA, 64 nt, hsa; identical to SEQ ID NO: 30057

SEQ ID NO: 703318 - RNA, 64 nt, hsa; identical to SEQ ID NO: 30058

SEQ ID NO: 703319 - RNA, 64 nt, hsa; identical to SEQ ID NO: 30059

SEQ ID NO: 703320 - RNA, 64 nt, hsa; identical to SEQ ID NO: 30060

SEQ ID NO: 703321 - RNA, 64 nt, hsa; identical to SEQ ID NO: 30061

SEQ ID NO: 703322 - RNA, 64 nt, hsa; identical to SEQ ID NO: 30062

SEQ ID NO: 703323 - RNA, 64 nt, hsa; identical to SEQ ID NO: 30063

SEQ ID NO: 703324 - RNA, 64 nt, hsa; identical to SEQ ID NO: 30064

SEQ ID NO: 703325 - RNA, 64 nt, hsa; identical to SEQ ID NO: 30065

SEQ ID NO: 703326 - RNA, 64 nt, hsa; identical to SEQ ID NO: 30066

SEQ ID NO: 703327 - RNA, 64 nt, hsa; identical to SEQ ID NO: 30067

SEQ ID NO: 703328 - RNA, 64 nt, hsa; identical to SEQ ID NO: 30068

SEQ ID NO: 703329 - RNA, 64 nt, hsa; identical to SEQ ID NO: 30069

SEQ ID NO: 703330 - RNA, 64 nt, hsa; identical to SEQ ID NO: 30070

SEQ ID NO: 703331 - RNA, 64 nt, hsa; identical to SEQ ID NO: 30071

SEQ ID NO: 703332 - RNA, 64 nt, hsa; identical to SEQ ID NO: 30072

SEQ ID NO: 703333 - RNA, 64 nt, hsa; identical to SEQ ID NO: 30073

SEQ ID NO: 703334 - RNA, 64 nt, hsa; identical to SEQ ID NO: 30074

SEQ ID NO: 703335 - RNA, 64 nt, hsa; identical to SEQ ID NO: 30075

SEQ ID NO: 703336 - RNA, 64 nt, hsa; identical to SEQ ID NO: 30076

SEQ ID NO: 703337 - RNA, 64 nt, hsa; identical to SEQ ID NO: 30077

SEQ ID NO: 703338 - RNA, 64 nt, hsa; identical to SEQ ID NO: 30078

SEQ ID NO: 703339 - RNA, 64 nt, hsa; identical to SEQ ID NO: 30079

SEQ ID NO: 703340 - RNA, 64 nt, hsa; identical to SEQ ID NO: 30080

SEQ ID NO: 703341 - RNA, 64 nt, hsa; identical to SEQ ID NO: 30081

SEQ ID NO: 703342 - RNA, 64 nt, hsa; identical to SEQ ID NO: 30082

SEQ ID NO: 703343 - RNA, 64 nt, hsa; identical to SEQ ID NO: 30083

SEQ ID NO: 703344 - RNA, 64 nt, hsa; identical to SEQ ID NO: 30084

SEQ ID NO: 703345 - RNA, 64 nt, hsa; identical to SEQ ID NO: 30085

SEQ ID NO: 703346 - RNA, 64 nt, hsa; identical to SEQ ID NO: 30086

SEQ ID NO: 703347 - RNA, 64 nt, hsa; identical to SEQ ID NO: 30087

SEQ ID NO: 703348 - RNA, 64 nt, hsa; identical to SEQ ID NO: 30088

SEQ ID NO: 703349 - RNA, 64 nt, hsa; identical to SEQ ID NO: 30089

SEQ ID NO: 703350 - RNA, 64 nt, hsa; identical to SEQ ID NO: 30090

SEQ ID NO: 703351 - RNA, 64 nt, hsa; identical to SEQ ID NO: 30091

SEQ ID NO: 703352 - RNA, 64 nt, hsa; identical to SEQ ID NO: 30092

SEQ ID NO: 703353 - RNA, 64 nt, hsa; identical to SEQ ID NO: 30093

SEQ ID NO: 703354 - RNA, 64 nt, hsa; identical to SEQ ID NO: 30094

SEQ ID NO: 703355 - RNA, 64 nt, hsa; identical to SEQ ID NO: 30095

SEQ ID NO: 703356 - RNA, 64 nt, hsa; identical to SEQ ID NO: 30096

SEQ ID NO: 703357 - RNA, 64 nt, hsa; identical to SEQ ID NO: 30097

SEQ ID NO: 703358 - RNA, 64 nt, hsa; identical to SEQ ID NO: 30098

SEQ ID NO: 703359 - RNA, 64 nt, hsa; identical to SEQ ID NO: 30099

SEQ ID NO: 703360 - RNA, 64 nt, hsa; identical to SEQ ID NO: 30100

SEQ ID NO: 703361 - RNA, 64 nt, hsa; identical to SEQ ID NO: 30101

SEQ ID NO: 703362 - RNA, 64 nt, hsa; identical to SEQ ID NO: 30102

SEQ ID NO: 703363 - RNA, 64 nt, hsa; identical to SEQ ID NO: 30103

SEQ ID NO: 703364 - RNA, 64 nt, hsa; identical to SEQ ID NO: 30104

SEQ ID NO: 703365 - RNA, 64 nt, hsa; identical to SEQ ID NO: 30105

SEQ ID NO: 703366 - RNA, 64 nt, hsa; identical to SEQ ID NO: 30106

SEQ ID NO: 703367 - RNA, 64 nt, hsa; identical to SEQ ID NO: 30107

SEQ ID NO: 703368 - RNA, 64 nt, hsa; identical to SEQ ID NO: 30108

SEQ ID NO: 703369 - RNA, 64 nt, hsa; identical to SEQ ID NO: 30109

SEQ ID NO: 703370 - RNA, 64 nt, hsa; identical to SEQ ID NO: 30110

SEQ ID NO: 703371 - RNA, 64 nt, hsa; identical to SEQ ID NO: 30111

SEQ ID NO: 703372 - RNA, 64 nt, hsa; identical to SEQ ID NO: 30112

SEQ ID NO: 703373 - RNA, 64 nt, hsa; identical to SEQ ID NO: 30113

SEQ ID NO: 703374 - RNA, 64 nt, hsa; identical to SEQ ID NO: 30114

SEQ ID NO: 703375 - RNA, 52 nt, hsa; identical to SEQ ID NO: 30115

SEQ ID NO: 703376 - RNA, 64 nt, hsa; identical to SEQ ID NO: 30116

SEQ ID NO: 703377 - RNA, 64 nt, hsa; identical to SEQ ID NO: 30117

SEQ ID NO: 703378 - RNA, 64 nt, hsa; identical to SEQ ID NO: 30118

SEQ ID NO: 703379 - RNA, 64 nt, hsa; identical to SEQ ID NO: 30119

SEQ ID NO: 703380 - RNA, 64 nt, hsa; identical to SEQ ID NO: 30120

SEQ ID NO: 703381 - RNA, 64 nt, hsa; identical to SEQ ID NO: 30121

SEQ ID NO: 703382 - RNA, 64 nt, hsa; identical to SEQ ID NO: 30122

SEQ ID NO: 703383 - RNA, 64 nt, hsa; identical to SEQ ID NO: 30123

SEQ ID NO: 703384 - RNA, 64 nt, hsa; identical to SEQ ID NO: 30124

SEQ ID NO: 703385 - RNA, 64 nt, hsa; identical to SEQ ID NO: 30125

SEQ ID NO: 703386 - RNA, 64 nt, hsa; identical to SEQ ID NO: 30126

SEQ ID NO: 703387 - RNA, 64 nt, hsa; identical to SEQ ID NO: 30127

SEQ ID NO: 703388 - RNA, 64 nt, hsa; identical to SEQ ID NO: 30128

SEQ ID NO: 703389 - RNA, 64 nt, hsa; identical to SEQ ID NO: 30129

SEQ ID NO: 703390 - RNA, 64 nt, hsa; identical to SEQ ID NO: 30130

SEQ ID NO: 703391 - RNA, 64 nt, hsa; identical to SEQ ID NO: 30131

SEQ ID NO: 703392 - RNA, 64 nt, hsa; identical to SEQ ID NO: 30132

SEQ ID NO: 703393 - RNA, 64 nt, hsa; identical to SEQ ID NO: 30133

SEQ ID NO: 703394 - RNA, 64 nt, hsa; identical to SEQ ID NO: 30134

SEQ ID NO: 703395 - RNA, 64 nt, hsa; identical to SEQ ID NO: 30135

SEQ ID NO: 703396 - RNA, 64 nt, hsa; identical to SEQ ID NO: 30136

SEQ ID NO: 703397 - RNA, 64 nt, hsa; identical to SEQ ID NO: 30137

SEQ ID NO: 703398 - RNA, 64 nt, hsa; identical to SEQ ID NO: 30138

SEQ ID NO: 703399 - RNA, 64 nt, hsa; identical to SEQ ID NO: 30139

SEQ ID NO: 703400 - RNA, 64 nt, hsa; identical to SEQ ID NO: 30140

SEQ ID NO: 703401 - RNA, 64 nt, hsa; identical to SEQ ID NO: 30141

SEQ ID NO: 703402 - RNA, 64 nt, hsa; identical to SEQ ID NO: 30142

SEQ ID NO: 703403 - RNA, 64 nt, hsa; identical to SEQ ID NO: 30143

SEQ ID NO: 703404 - RNA, 64 nt, hsa; identical to SEQ ID NO: 30144

SEQ ID NO: 703405 - RNA, 64 nt, hsa; identical to SEQ ID NO: 30145

SEQ ID NO: 703406 - RNA, 64 nt, hsa; identical to SEQ ID NO: 30146

SEQ ID NO: 703407 - RNA, 64 nt, hsa; identical to SEQ ID NO: 30147

SEQ ID NO: 703408 - RNA, 64 nt, hsa; identical to SEQ ID NO: 30148

SEQ ID NO: 703409 - RNA, 64 nt, hsa; identical to SEQ ID NO: 30149

SEQ ID NO: 703410 - RNA, 64 nt, hsa; identical to SEQ ID NO: 30150

SEQ ID NO: 703411 - RNA, 64 nt, hsa; identical to SEQ ID NO: 30151

SEQ ID NO: 703412 - RNA, 64 nt, hsa; identical to SEQ ID NO: 30152

SEQ ID NO: 703413 - RNA, 64 nt, hsa; identical to SEQ ID NO: 30153

SEQ ID NO: 703414 - RNA, 64 nt, hsa; identical to SEQ ID NO: 30154

SEQ ID NO: 703415 - RNA, 64 nt, hsa; identical to SEQ ID NO: 30155

SEQ ID NO: 703416 - RNA, 64 nt, hsa; identical to SEQ ID NO: 30156

SEQ ID NO: 703417 - RNA, 64 nt, hsa; identical to SEQ ID NO: 30157

SEQ ID NO: 703418 - RNA, 64 nt, hsa; identical to SEQ ID NO: 30158

SEQ ID NO: 703419 - RNA, 64 nt, hsa; identical to SEQ ID NO: 30159

SEQ ID NO: 703420 - RNA, 64 nt, hsa; identical to SEQ ID NO: 30160

SEQ ID NO: 703421 - RNA, 64 nt, hsa; identical to SEQ ID NO: 30161

SEQ ID NO: 703422 - RNA, 64 nt, hsa; identical to SEQ ID NO: 30162

SEQ ID NO: 703423 - RNA, 64 nt, hsa; identical to SEQ ID NO: 30163

SEQ ID NO: 703424 - RNA, 64 nt, hsa; identical to SEQ ID NO: 30164

SEQ ID NO: 703425 - RNA, 64 nt, hsa; identical to SEQ ID NO: 30165

SEQ ID NO: 703426 - RNA, 64 nt, hsa; identical to SEQ ID NO: 30166

SEQ ID NO: 703427 - RNA, 64 nt, hsa; identical to SEQ ID NO: 30167

SEQ ID NO: 703428 - RNA, 64 nt, hsa; identical to SEQ ID NO: 30168

SEQ ID NO: 703429 - RNA, 64 nt, hsa; identical to SEQ ID NO: 30169

SEQ ID NO: 703430 - RNA, 64 nt, hsa; identical to SEQ ID NO: 30170

SEQ ID NO: 703431 - RNA, 64 nt, hsa; identical to SEQ ID NO: 30171

SEQ ID NO: 703432 - RNA, 64 nt, hsa; identical to SEQ ID NO: 30172

SEQ ID NO: 703433 - RNA, 64 nt, hsa; identical to SEQ ID NO: 30173

SEQ ID NO: 703434 - RNA, 64 nt, hsa; identical to SEQ ID NO: 30174

SEQ ID NO: 703435 - RNA, 64 nt, hsa; identical to SEQ ID NO: 30175

SEQ ID NO: 703436 - RNA, 64 nt, hsa; identical to SEQ ID NO: 30176

SEQ ID NO: 703437 - RNA, 64 nt, hsa; identical to SEQ ID NO: 30177

SEQ ID NO: 703438 - RNA, 64 nt, hsa; identical to SEQ ID NO: 30178

SEQ ID NO: 703439 - RNA, 64 nt, hsa; identical to SEQ ID NO: 30179

SEQ ID NO: 703440 - RNA, 64 nt, hsa; identical to SEQ ID NO: 30180

SEQ ID NO: 703441 - RNA, 64 nt, hsa; identical to SEQ ID NO: 30181

SEQ ID NO: 703442 - RNA, 64 nt, hsa; identical to SEQ ID NO: 30182

SEQ ID NO: 703443 - RNA, 64 nt, hsa; identical to SEQ ID NO: 30183

SEQ ID NO: 703444 - RNA, 64 nt, hsa; identical to SEQ ID NO: 30184

SEQ ID NO: 703445 - RNA, 64 nt, hsa; identical to SEQ ID NO: 30185

SEQ ID NO: 703446 - RNA, 64 nt, hsa; identical to SEQ ID NO: 30186

SEQ ID NO: 703447 - RNA, 64 nt, hsa; identical to SEQ ID NO: 30187

SEQ ID NO: 703448 - RNA, 64 nt, hsa; identical to SEQ ID NO: 30188

SEQ ID NO: 703449 - RNA, 64 nt, hsa; identical to SEQ ID NO: 30189

SEQ ID NO: 703450 - RNA, 64 nt, hsa; identical to SEQ ID NO: 30190

SEQ ID NO: 703451 - RNA, 64 nt, hsa; identical to SEQ ID NO: 30191

SEQ ID NO: 703452 - RNA, 64 nt, hsa; identical to SEQ ID NO: 30192

SEQ ID NO: 703453 - RNA, 64 nt, hsa; identical to SEQ ID NO: 30193

SEQ ID NO: 703454 - RNA, 64 nt, hsa; identical to SEQ ID NO: 30194

SEQ ID NO: 703455 - RNA, 64 nt, hsa; identical to SEQ ID NO: 30195

SEQ ID NO: 703456 - RNA, 64 nt, hsa; identical to SEQ ID NO: 30196

SEQ ID NO: 703457 - RNA, 64 nt, hsa; identical to SEQ ID NO: 30197

SEQ ID NO: 703458 - RNA, 64 nt, hsa; identical to SEQ ID NO: 30198

SEQ ID NO: 703459 - RNA, 64 nt, hsa; identical to SEQ ID NO: 30199

SEQ ID NO: 703460 - RNA, 64 nt, hsa; identical to SEQ ID NO: 30200

SEQ ID NO: 703461 - RNA, 64 nt, hsa; identical to SEQ ID NO: 30201

SEQ ID NO: 703462 - RNA, 64 nt, hsa; identical to SEQ ID NO: 30202

SEQ ID NO: 703463 - RNA, 64 nt, hsa; identical to SEQ ID NO: 30203

SEQ ID NO: 703464 - RNA, 64 nt, hsa; identical to SEQ ID NO: 30204

SEQ ID NO: 703465 - RNA, 64 nt, hsa; identical to SEQ ID NO: 30205

SEQ ID NO: 703466 - RNA, 64 nt, hsa; identical to SEQ ID NO: 30206

SEQ ID NO: 703467 - RNA, 64 nt, hsa; identical to SEQ ID NO: 30207

SEQ ID NO: 703468 - RNA, 64 nt, hsa; identical to SEQ ID NO: 30208

SEQ ID NO: 703469 - RNA, 64 nt, hsa; identical to SEQ ID NO: 30209

SEQ ID NO: 703470 - RNA, 64 nt, hsa; identical to SEQ ID NO: 30210

SEQ ID NO: 703471 - RNA, 64 nt, hsa; identical to SEQ ID NO: 30211

SEQ ID NO: 703472 - RNA, 64 nt, hsa; identical to SEQ ID NO: 30212

SEQ ID NO: 703473 - RNA, 64 nt, hsa; identical to SEQ ID NO: 30213

SEQ ID NO: 703474 - RNA, 64 nt, hsa; identical to SEQ ID NO: 30214

SEQ ID NO: 703475 - RNA, 64 nt, hsa; identical to SEQ ID NO: 30215

SEQ ID NO: 703476 - RNA, 64 nt, hsa; identical to SEQ ID NO: 30216

SEQ ID NO: 703477 - RNA, 64 nt, hsa; identical to SEQ ID NO: 30217

SEQ ID NO: 703478 - RNA, 64 nt, hsa; identical to SEQ ID NO: 30218

SEQ ID NO: 703479 - RNA, 64 nt, hsa; identical to SEQ ID NO: 30219

SEQ ID NO: 703480 - RNA, 64 nt, hsa; identical to SEQ ID NO: 30220

SEQ ID NO: 703481 - RNA, 64 nt, hsa; identical to SEQ ID NO: 30221

SEQ ID NO: 703482 - RNA, 64 nt, hsa; identical to SEQ ID NO: 30222

SEQ ID NO: 703483 - RNA, 64 nt, hsa; identical to SEQ ID NO: 30223

SEQ ID NO: 703484 - RNA, 64 nt, hsa; identical to SEQ ID NO: 30224

SEQ ID NO: 703485 - RNA, 64 nt, hsa; identical to SEQ ID NO: 30225

SEQ ID NO: 703486 - RNA, 64 nt, hsa; identical to SEQ ID NO: 30226

SEQ ID NO: 703487 - RNA, 64 nt, hsa; identical to SEQ ID NO: 30227

SEQ ID NO: 703488 - RNA, 64 nt, hsa; identical to SEQ ID NO: 30228

SEQ ID NO: 703489 - RNA, 64 nt, hsa; identical to SEQ ID NO: 30229

SEQ ID NO: 703490 - RNA, 64 nt, hsa; identical to SEQ ID NO: 30230

SEQ ID NO: 703491 - RNA, 64 nt, hsa; identical to SEQ ID NO: 30231

SEQ ID NO: 703492 - RNA, 64 nt, hsa; identical to SEQ ID NO: 30232

SEQ ID NO: 703493 - RNA, 64 nt, hsa; identical to SEQ ID NO: 30233

SEQ ID NO: 703494 - RNA, 64 nt, hsa; identical to SEQ ID NO: 30234

SEQ ID NO: 703495 - RNA, 64 nt, hsa; identical to SEQ ID NO: 30235

SEQ ID NO: 703496 - RNA, 64 nt, hsa; identical to SEQ ID NO: 30236

SEQ ID NO: 703497 - RNA, 64 nt, hsa; identical to SEQ ID NO: 30237

SEQ ID NO: 703498 - RNA, 64 nt, hsa; identical to SEQ ID NO: 30238

SEQ ID NO: 703499 - RNA, 64 nt, hsa; identical to SEQ ID NO: 30239

SEQ ID NO: 703500 - RNA, 64 nt, hsa; identical to SEQ ID NO: 30240

SEQ ID NO: 703501 - RNA, 64 nt, hsa; identical to SEQ ID NO: 30241

SEQ ID NO: 703502 - RNA, 64 nt, hsa; identical to SEQ ID NO: 30242

SEQ ID NO: 703503 - RNA, 64 nt, hsa; identical to SEQ ID NO: 30243

SEQ ID NO: 703504 - RNA, 64 nt, hsa; identical to SEQ ID NO: 30244

SEQ ID NO: 703505 - RNA, 64 nt, hsa; identical to SEQ ID NO: 30245

SEQ ID NO: 703506 - RNA, 64 nt, hsa; identical to SEQ ID NO: 30246

SEQ ID NO: 703507 - RNA, 64 nt, hsa; identical to SEQ ID NO: 30247

SEQ ID NO: 703508 - RNA, 64 nt, hsa; identical to SEQ ID NO: 30248

SEQ ID NO: 703509 - RNA, 64 nt, hsa; identical to SEQ ID NO: 30249

SEQ ID NO: 703510 - RNA, 64 nt, hsa; identical to SEQ ID NO: 30250

SEQ ID NO: 703511 - RNA, 64 nt, hsa; identical to SEQ ID NO: 30251

SEQ ID NO: 703512 - RNA, 64 nt, hsa; identical to SEQ ID NO: 30252

SEQ ID NO: 703513 - RNA, 64 nt, hsa; identical to SEQ ID NO: 30253

SEQ ID NO: 703514 - RNA, 64 nt, hsa; identical to SEQ ID NO: 30254

SEQ ID NO: 703515 - RNA, 64 nt, hsa; identical to SEQ ID NO: 30255

SEQ ID NO: 703516 - RNA, 63 nt, hsa; identical to SEQ ID NO: 30256

SEQ ID NO: 703517 - RNA, 64 nt, hsa; identical to SEQ ID NO: 30257

SEQ ID NO: 703518 - RNA, 64 nt, hsa; identical to SEQ ID NO: 30258

SEQ ID NO: 703519 - RNA, 64 nt, hsa; identical to SEQ ID NO: 30259

SEQ ID NO: 703520 - RNA, 64 nt, hsa; identical to SEQ ID NO: 30260

SEQ ID NO: 703521 - RNA, 64 nt, hsa; identical to SEQ ID NO: 30261

SEQ ID NO: 703522 - RNA, 64 nt, hsa; identical to SEQ ID NO: 30262

SEQ ID NO: 703523 - RNA, 64 nt, hsa; identical to SEQ ID NO: 30263

SEQ ID NO: 703524 - RNA, 64 nt, hsa; identical to SEQ ID NO: 30264

SEQ ID NO: 703525 - RNA, 64 nt, hsa; identical to SEQ ID NO: 30265

SEQ ID NO: 703526 - RNA, 64 nt, hsa; identical to SEQ ID NO: 30266

SEQ ID NO: 703527 - RNA, 64 nt, hsa; identical to SEQ ID NO: 30267

SEQ ID NO: 703528 - RNA, 64 nt, hsa; identical to SEQ ID NO: 30268

SEQ ID NO: 703529 - RNA, 64 nt, hsa; identical to SEQ ID NO: 30269

SEQ ID NO: 703530 - RNA, 64 nt, hsa; identical to SEQ ID NO: 30270

SEQ ID NO: 703531 - RNA, 64 nt, hsa; identical to SEQ ID NO: 30271

SEQ ID NO: 703532 - RNA, 64 nt, hsa; identical to SEQ ID NO: 30272

SEQ ID NO: 703533 - RNA, 64 nt, hsa; identical to SEQ ID NO: 30273

SEQ ID NO: 703534 - RNA, 64 nt, hsa; identical to SEQ ID NO: 30274

SEQ ID NO: 703535 - RNA, 64 nt, hsa; identical to SEQ ID NO: 30275

SEQ ID NO: 703536 - RNA, 64 nt, hsa; identical to SEQ ID NO: 30276

SEQ ID NO: 703537 - RNA, 64 nt, hsa; identical to SEQ ID NO: 30277

SEQ ID NO: 703538 - RNA, 64 nt, hsa; identical to SEQ ID NO: 30278

SEQ ID NO: 703539 - RNA, 64 nt, hsa; identical to SEQ ID NO: 30279

SEQ ID NO: 703540 - RNA, 64 nt, hsa; identical to SEQ ID NO: 30280

SEQ ID NO: 703541 - RNA, 64 nt, hsa; identical to SEQ ID NO: 30281

SEQ ID NO: 703542 - RNA, 64 nt, hsa; identical to SEQ ID NO: 30282

SEQ ID NO: 703543 - RNA, 64 nt, hsa; identical to SEQ ID NO: 30283

SEQ ID NO: 703544 - RNA, 64 nt, hsa; identical to SEQ ID NO: 30284

SEQ ID NO: 703545 - RNA, 64 nt, hsa; identical to SEQ ID NO: 30285

SEQ ID NO: 703546 - RNA, 64 nt, hsa; identical to SEQ ID NO: 30286

SEQ ID NO: 703547 - RNA, 64 nt, hsa; identical to SEQ ID NO: 30287

SEQ ID NO: 703548 - RNA, 64 nt, hsa; identical to SEQ ID NO: 30288

SEQ ID NO: 703549 - RNA, 64 nt, hsa; identical to SEQ ID NO: 30289

SEQ ID NO: 703550 - RNA, 64 nt, hsa; identical to SEQ ID NO: 30290

SEQ ID NO: 703551 - RNA, 64 nt, hsa; identical to SEQ ID NO: 30291

SEQ ID NO: 703552 - RNA, 64 nt, hsa; identical to SEQ ID NO: 30292

SEQ ID NO: 703553 - RNA, 64 nt, hsa; identical to SEQ ID NO: 30293

SEQ ID NO: 703554 - RNA, 64 nt, hsa; identical to SEQ ID NO: 30294

SEQ ID NO: 703555 - RNA, 64 nt, hsa; identical to SEQ ID NO: 30295

SEQ ID NO: 703556 - RNA, 64 nt, hsa; identical to SEQ ID NO: 30296

SEQ ID NO: 703557 - RNA, 64 nt, hsa; identical to SEQ ID NO: 30297

SEQ ID NO: 703558 - RNA, 64 nt, hsa; identical to SEQ ID NO: 30298

SEQ ID NO: 703559 - RNA, 64 nt, hsa; identical to SEQ ID NO: 30299

SEQ ID NO: 703560 - RNA, 64 nt, hsa; identical to SEQ ID NO: 30300

SEQ ID NO: 703561 - RNA, 64 nt, hsa; identical to SEQ ID NO: 30301

SEQ ID NO: 703562 - RNA, 64 nt, hsa; identical to SEQ ID NO: 30302

SEQ ID NO: 703563 - RNA, 64 nt, hsa; identical to SEQ ID NO: 30303

SEQ ID NO: 703564 - RNA, 64 nt, hsa; identical to SEQ ID NO: 30304

SEQ ID NO: 703565 - RNA, 64 nt, hsa; identical to SEQ ID NO: 30305

SEQ ID NO: 703566 - RNA, 64 nt, hsa; identical to SEQ ID NO: 30306

SEQ ID NO: 703567 - RNA, 64 nt, hsa; identical to SEQ ID NO: 30307

SEQ ID NO: 703568 - RNA, 64 nt, hsa; identical to SEQ ID NO: 30308

SEQ ID NO: 703569 - RNA, 64 nt, hsa; identical to SEQ ID NO: 30309

SEQ ID NO: 703570 - RNA, 64 nt, hsa; identical to SEQ ID NO: 30310

SEQ ID NO: 703571 - RNA, 64 nt, hsa; identical to SEQ ID NO: 30311

SEQ ID NO: 703572 - RNA, 64 nt, hsa; identical to SEQ ID NO: 30312

SEQ ID NO: 703573 - RNA, 64 nt, hsa; identical to SEQ ID NO: 30313

SEQ ID NO: 703574 - RNA, 64 nt, hsa; identical to SEQ ID NO: 30314

SEQ ID NO: 703575 - RNA, 64 nt, hsa; identical to SEQ ID NO: 30315

SEQ ID NO: 703576 - RNA, 64 nt, hsa; identical to SEQ ID NO: 30316

SEQ ID NO: 703577 - RNA, 64 nt, hsa; identical to SEQ ID NO: 30317

SEQ ID NO: 703578 - RNA, 64 nt, hsa; identical to SEQ ID NO: 30318

SEQ ID NO: 703579 - RNA, 64 nt, hsa; identical to SEQ ID NO: 30319

SEQ ID NO: 703580 - RNA, 64 nt, hsa; identical to SEQ ID NO: 30320

SEQ ID NO: 703581 - RNA, 64 nt, hsa; identical to SEQ ID NO: 30321

SEQ ID NO: 703582 - RNA, 64 nt, hsa; identical to SEQ ID NO: 30322

SEQ ID NO: 703583 - RNA, 64 nt, hsa; identical to SEQ ID NO: 30323

SEQ ID NO: 703584 - RNA, 64 nt, hsa; identical to SEQ ID NO: 30324

SEQ ID NO: 703585 - RNA, 64 nt, hsa; identical to SEQ ID NO: 30325

SEQ ID NO: 703586 - RNA, 64 nt, hsa; identical to SEQ ID NO: 30326

SEQ ID NO: 703587 - RNA, 64 nt, hsa; identical to SEQ ID NO: 30327

SEQ ID NO: 703588 - RNA, 64 nt, hsa; identical to SEQ ID NO: 30328

SEQ ID NO: 703589 - RNA, 64 nt, hsa; identical to SEQ ID NO: 30329

SEQ ID NO: 703590 - RNA, 64 nt, hsa; identical to SEQ ID NO: 30330

SEQ ID NO: 703591 - RNA, 64 nt, hsa; identical to SEQ ID NO: 30331

SEQ ID NO: 703592 - RNA, 64 nt, hsa; identical to SEQ ID NO: 30332

SEQ ID NO: 703593 - RNA, 64 nt, hsa; identical to SEQ ID NO: 30333

SEQ ID NO: 703594 - RNA, 64 nt, hsa; identical to SEQ ID NO: 30334

SEQ ID NO: 703595 - RNA, 64 nt, hsa; identical to SEQ ID NO: 30335

SEQ ID NO: 703596 - RNA, 64 nt, hsa; identical to SEQ ID NO: 30336

SEQ ID NO: 703597 - RNA, 64 nt, hsa; identical to SEQ ID NO: 30337

SEQ ID NO: 703598 - RNA, 64 nt, hsa; identical to SEQ ID NO: 30338

SEQ ID NO: 703599 - RNA, 64 nt, hsa; identical to SEQ ID NO: 30339

SEQ ID NO: 703600 - RNA, 64 nt, hsa; identical to SEQ ID NO: 30340

SEQ ID NO: 703601 - RNA, 64 nt, hsa; identical to SEQ ID NO: 30341

SEQ ID NO: 703602 - RNA, 64 nt, hsa; identical to SEQ ID NO: 30342

SEQ ID NO: 703603 - RNA, 64 nt, hsa; identical to SEQ ID NO: 30343

SEQ ID NO: 703604 - RNA, 64 nt, hsa; identical to SEQ ID NO: 30344

SEQ ID NO: 703605 - RNA, 64 nt, hsa; identical to SEQ ID NO: 30345

SEQ ID NO: 703606 - RNA, 64 nt, hsa; identical to SEQ ID NO: 30346

SEQ ID NO: 703607 - RNA, 64 nt, hsa; identical to SEQ ID NO: 30347

SEQ ID NO: 703608 - RNA, 64 nt, hsa; identical to SEQ ID NO: 30348

SEQ ID NO: 703609 - RNA, 64 nt, hsa; identical to SEQ ID NO: 30349

SEQ ID NO: 703610 - RNA, 64 nt, hsa; identical to SEQ ID NO: 30350

SEQ ID NO: 703611 - RNA, 64 nt, hsa; identical to SEQ ID NO: 30351

SEQ ID NO: 703612 - RNA, 64 nt, hsa; identical to SEQ ID NO: 30352

SEQ ID NO: 703613 - RNA, 64 nt, hsa; identical to SEQ ID NO: 30353

SEQ ID NO: 703614 - RNA, 64 nt, hsa; identical to SEQ ID NO: 30354

SEQ ID NO: 703615 - RNA, 64 nt, hsa; identical to SEQ ID NO: 30355

SEQ ID NO: 703616 - RNA, 64 nt, hsa; identical to SEQ ID NO: 30356

SEQ ID NO: 703617 - RNA, 64 nt, hsa; identical to SEQ ID NO: 30357

SEQ ID NO: 703618 - RNA, 64 nt, hsa; identical to SEQ ID NO: 30358

SEQ ID NO: 703619 - RNA, 64 nt, hsa; identical to SEQ ID NO: 30359

SEQ ID NO: 703620 - RNA, 64 nt, hsa; identical to SEQ ID NO: 30360

SEQ ID NO: 703621 - RNA, 64 nt, hsa; identical to SEQ ID NO: 30361

SEQ ID NO: 703622 - RNA, 64 nt, hsa; identical to SEQ ID NO: 30362

SEQ ID NO: 703623 - RNA, 64 nt, hsa; identical to SEQ ID NO: 30363

SEQ ID NO: 703624 - RNA, 64 nt, hsa; identical to SEQ ID NO: 30364

SEQ ID NO: 703625 - RNA, 64 nt, hsa; identical to SEQ ID NO: 30365

SEQ ID NO: 703626 - RNA, 64 nt, hsa; identical to SEQ ID NO: 30366

SEQ ID NO: 703627 - RNA, 64 nt, hsa; identical to SEQ ID NO: 30367

SEQ ID NO: 703628 - RNA, 64 nt, hsa; identical to SEQ ID NO: 30368

SEQ ID NO: 703629 - RNA, 64 nt, hsa; identical to SEQ ID NO: 30369

SEQ ID NO: 703630 - RNA, 64 nt, hsa; identical to SEQ ID NO: 30370

SEQ ID NO: 703631 - RNA, 64 nt, hsa; identical to SEQ ID NO: 30371

SEQ ID NO: 703632 - RNA, 64 nt, hsa; identical to SEQ ID NO: 30372

SEQ ID NO: 703633 - RNA, 64 nt, hsa; identical to SEQ ID NO: 30373

SEQ ID NO: 703634 - RNA, 64 nt, hsa; identical to SEQ ID NO: 30374

SEQ ID NO: 703635 - RNA, 64 nt, hsa; identical to SEQ ID NO: 30375

SEQ ID NO: 703636 - RNA, 64 nt, hsa; identical to SEQ ID NO: 30376

SEQ ID NO: 703637 - RNA, 64 nt, hsa; identical to SEQ ID NO: 30377

SEQ ID NO: 703638 - RNA, 64 nt, hsa; identical to SEQ ID NO: 30378

SEQ ID NO: 703639 - RNA, 64 nt, hsa; identical to SEQ ID NO: 30379

SEQ ID NO: 703640 - RNA, 64 nt, hsa; identical to SEQ ID NO: 30380

SEQ ID NO: 703641 - RNA, 64 nt, hsa; identical to SEQ ID NO: 30381

SEQ ID NO: 703642 - RNA, 64 nt, hsa; identical to SEQ ID NO: 30382

SEQ ID NO: 703643 - RNA, 64 nt, hsa; identical to SEQ ID NO: 30383

SEQ ID NO: 703644 - RNA, 64 nt, hsa; identical to SEQ ID NO: 30384

SEQ ID NO: 703645 - RNA, 64 nt, hsa; identical to SEQ ID NO: 30385

SEQ ID NO: 703646 - RNA, 64 nt, hsa; identical to SEQ ID NO: 30386

SEQ ID NO: 703647 - RNA, 64 nt, hsa; identical to SEQ ID NO: 30387

SEQ ID NO: 703648 - RNA, 64 nt, hsa; identical to SEQ ID NO: 30388

SEQ ID NO: 703649 - RNA, 64 nt, hsa; identical to SEQ ID NO: 30389

SEQ ID NO: 703650 - RNA, 64 nt, hsa; identical to SEQ ID NO: 30390

SEQ ID NO: 703651 - RNA, 64 nt, hsa; identical to SEQ ID NO: 30391

SEQ ID NO: 703652 - RNA, 64 nt, hsa; identical to SEQ ID NO: 30392

SEQ ID NO: 703653 - RNA, 64 nt, hsa; identical to SEQ ID NO: 30393

SEQ ID NO: 703654 - RNA, 64 nt, hsa; identical to SEQ ID NO: 30394

SEQ ID NO: 703655 - RNA, 64 nt, hsa; identical to SEQ ID NO: 30395

SEQ ID NO: 703656 - RNA, 64 nt, hsa; identical to SEQ ID NO: 30396

SEQ ID NO: 703657 - RNA, 64 nt, hsa; identical to SEQ ID NO: 30397

SEQ ID NO: 703658 - RNA, 64 nt, hsa; identical to SEQ ID NO: 30398

SEQ ID NO: 703659 - RNA, 64 nt, hsa; identical to SEQ ID NO: 30399

SEQ ID NO: 703660 - RNA, 64 nt, hsa; identical to SEQ ID NO: 30400

SEQ ID NO: 703661 - RNA, 64 nt, hsa; identical to SEQ ID NO: 30401

SEQ ID NO: 703662 - RNA, 64 nt, hsa; identical to SEQ ID NO: 30402

SEQ ID NO: 703663 - RNA, 64 nt, hsa; identical to SEQ ID NO: 30403

SEQ ID NO: 703664 - RNA, 64 nt, hsa; identical to SEQ ID NO: 30404

SEQ ID NO: 703665 - RNA, 64 nt, hsa; identical to SEQ ID NO: 30405

SEQ ID NO: 703666 - RNA, 64 nt, hsa; identical to SEQ ID NO: 30406

SEQ ID NO: 703667 - RNA, 64 nt, hsa; identical to SEQ ID NO: 30407

SEQ ID NO: 703668 - RNA, 64 nt, hsa; identical to SEQ ID NO: 30408

SEQ ID NO: 703669 - RNA, 64 nt, hsa; identical to SEQ ID NO: 30409

SEQ ID NO: 703670 - RNA, 64 nt, hsa; identical to SEQ ID NO: 30410

SEQ ID NO: 703671 - RNA, 64 nt, hsa; identical to SEQ ID NO: 30411

SEQ ID NO: 703672 - RNA, 64 nt, hsa; identical to SEQ ID NO: 30412

SEQ ID NO: 703673 - RNA, 64 nt, hsa; identical to SEQ ID NO: 30413

SEQ ID NO: 703674 - RNA, 64 nt, hsa; identical to SEQ ID NO: 30414

SEQ ID NO: 703675 - RNA, 64 nt, hsa; identical to SEQ ID NO: 30415

SEQ ID NO: 703676 - RNA, 64 nt, hsa; identical to SEQ ID NO: 30416

SEQ ID NO: 703677 - RNA, 64 nt, hsa; identical to SEQ ID NO: 30417

SEQ ID NO: 703678 - RNA, 64 nt, hsa; identical to SEQ ID NO: 30418

SEQ ID NO: 703679 - RNA, 64 nt, hsa; identical to SEQ ID NO: 30419

SEQ ID NO: 703680 - RNA, 64 nt, hsa; identical to SEQ ID NO: 30420

SEQ ID NO: 703681 - RNA, 64 nt, hsa; identical to SEQ ID NO: 30421

SEQ ID NO: 703682 - RNA, 64 nt, hsa; identical to SEQ ID NO: 30422

SEQ ID NO: 703683 - RNA, 64 nt, hsa; identical to SEQ ID NO: 30423

SEQ ID NO: 703684 - RNA, 64 nt, hsa; identical to SEQ ID NO: 30424

SEQ ID NO: 703685 - RNA, 64 nt, hsa; identical to SEQ ID NO: 30425

SEQ ID NO: 703686 - RNA, 64 nt, hsa; identical to SEQ ID NO: 30426

SEQ ID NO: 703687 - RNA, 64 nt, hsa; identical to SEQ ID NO: 30427

SEQ ID NO: 703688 - RNA, 64 nt, hsa; identical to SEQ ID NO: 30428

SEQ ID NO: 703689 - RNA, 64 nt, hsa; identical to SEQ ID NO: 30429

SEQ ID NO: 703690 - RNA, 64 nt, hsa; identical to SEQ ID NO: 30430

SEQ ID NO: 703691 - RNA, 64 nt, hsa; identical to SEQ ID NO: 30431

SEQ ID NO: 703692 - RNA, 64 nt, hsa; identical to SEQ ID NO: 30432

SEQ ID NO: 703693 - RNA, 64 nt, hsa; identical to SEQ ID NO: 30433

SEQ ID NO: 703694 - RNA, 64 nt, hsa; identical to SEQ ID NO: 30434

SEQ ID NO: 703695 - RNA, 64 nt, hsa; identical to SEQ ID NO: 30435

SEQ ID NO: 703696 - RNA, 64 nt, hsa; identical to SEQ ID NO: 30436

SEQ ID NO: 703697 - RNA, 64 nt, hsa; identical to SEQ ID NO: 30437

SEQ ID NO: 703698 - RNA, 64 nt, hsa; identical to SEQ ID NO: 30438

SEQ ID NO: 703699 - RNA, 64 nt, hsa; identical to SEQ ID NO: 30439

SEQ ID NO: 703700 - RNA, 64 nt, hsa; identical to SEQ ID NO: 30440

SEQ ID NO: 703701 - RNA, 64 nt, hsa; identical to SEQ ID NO: 30441

SEQ ID NO: 703702 - RNA, 64 nt, hsa; identical to SEQ ID NO: 30442

SEQ ID NO: 703703 - RNA, 64 nt, hsa; identical to SEQ ID NO: 30443

SEQ ID NO: 703704 - RNA, 64 nt, hsa; identical to SEQ ID NO: 30444

SEQ ID NO: 703705 - RNA, 64 nt, hsa; identical to SEQ ID NO: 30445

SEQ ID NO: 703706 - RNA, 64 nt, hsa; identical to SEQ ID NO: 30446

SEQ ID NO: 703707 - RNA, 64 nt, hsa; identical to SEQ ID NO: 30447

SEQ ID NO: 703708 - RNA, 64 nt, hsa; identical to SEQ ID NO: 30448

SEQ ID NO: 703709 - RNA, 64 nt, hsa; identical to SEQ ID NO: 30449

SEQ ID NO: 703710 - RNA, 64 nt, hsa; identical to SEQ ID NO: 30450

SEQ ID NO: 703711 - RNA, 64 nt, hsa; identical to SEQ ID NO: 30451

SEQ ID NO: 703712 - RNA, 64 nt, hsa; identical to SEQ ID NO: 30452

SEQ ID NO: 703713 - RNA, 64 nt, hsa; identical to SEQ ID NO: 30453

SEQ ID NO: 703714 - RNA, 64 nt, hsa; identical to SEQ ID NO: 30454

SEQ ID NO: 703715 - RNA, 64 nt, hsa; identical to SEQ ID NO: 30455

SEQ ID NO: 703716 - RNA, 64 nt, hsa; identical to SEQ ID NO: 30456

SEQ ID NO: 703717 - RNA, 64 nt, hsa; identical to SEQ ID NO: 30457

SEQ ID NO: 703718 - RNA, 64 nt, hsa; identical to SEQ ID NO: 30458

SEQ ID NO: 703719 - RNA, 64 nt, hsa; identical to SEQ ID NO: 30459

SEQ ID NO: 703720 - RNA, 64 nt, hsa; identical to SEQ ID NO: 30460

SEQ ID NO: 703721 - RNA, 64 nt, hsa; identical to SEQ ID NO: 30461

SEQ ID NO: 703722 - RNA, 64 nt, hsa; identical to SEQ ID NO: 30462

SEQ ID NO: 703723 - RNA, 64 nt, hsa; identical to SEQ ID NO: 30463

SEQ ID NO: 703724 - RNA, 64 nt, hsa; identical to SEQ ID NO: 30464

SEQ ID NO: 703725 - RNA, 64 nt, hsa; identical to SEQ ID NO: 30465

SEQ ID NO: 703726 - RNA, 64 nt, hsa; identical to SEQ ID NO: 30466

SEQ ID NO: 703727 - RNA, 64 nt, hsa; identical to SEQ ID NO: 30467

SEQ ID NO: 703728 - RNA, 64 nt, hsa; identical to SEQ ID NO: 30468

SEQ ID NO: 703729 - RNA, 64 nt, hsa; identical to SEQ ID NO: 30469

SEQ ID NO: 703730 - RNA, 64 nt, hsa; identical to SEQ ID NO: 30470

SEQ ID NO: 703731 - RNA, 64 nt, hsa; identical to SEQ ID NO: 30471

SEQ ID NO: 703732 - RNA, 64 nt, hsa; identical to SEQ ID NO: 30472

SEQ ID NO: 703733 - RNA, 64 nt, hsa; identical to SEQ ID NO: 30473

SEQ ID NO: 703734 - RNA, 64 nt, hsa; identical to SEQ ID NO: 30474

SEQ ID NO: 703735 - RNA, 64 nt, hsa; identical to SEQ ID NO: 30475

SEQ ID NO: 703736 - RNA, 64 nt, hsa; identical to SEQ ID NO: 30476

SEQ ID NO: 703737 - RNA, 64 nt, hsa; identical to SEQ ID NO: 30477

SEQ ID NO: 703738 - RNA, 64 nt, hsa; identical to SEQ ID NO: 30478

SEQ ID NO: 703739 - RNA, 64 nt, hsa; identical to SEQ ID NO: 30479

SEQ ID NO: 703740 - RNA, 64 nt, hsa; identical to SEQ ID NO: 30480

SEQ ID NO: 703741 - RNA, 64 nt, hsa; identical to SEQ ID NO: 30481

SEQ ID NO: 703742 - RNA, 64 nt, hsa; identical to SEQ ID NO: 30482

SEQ ID NO: 703743 - RNA, 64 nt, hsa; identical to SEQ ID NO: 30483

SEQ ID NO: 703744 - RNA, 64 nt, hsa; identical to SEQ ID NO: 30484

SEQ ID NO: 703745 - RNA, 64 nt, hsa; identical to SEQ ID NO: 30485

SEQ ID NO: 703746 - RNA, 64 nt, hsa; identical to SEQ ID NO: 30486

SEQ ID NO: 703747 - RNA, 64 nt, hsa; identical to SEQ ID NO: 30487

SEQ ID NO: 703748 - RNA, 64 nt, hsa; identical to SEQ ID NO: 30488

SEQ ID NO: 703749 - RNA, 64 nt, hsa; identical to SEQ ID NO: 30489

SEQ ID NO: 703750 - RNA, 64 nt, hsa; identical to SEQ ID NO: 30490

SEQ ID NO: 703751 - RNA, 64 nt, hsa; identical to SEQ ID NO: 30491

SEQ ID NO: 703752 - RNA, 64 nt, hsa; identical to SEQ ID NO: 30492

SEQ ID NO: 703753 - RNA, 64 nt, hsa; identical to SEQ ID NO: 30493

SEQ ID NO: 703754 - RNA, 64 nt, hsa; identical to SEQ ID NO: 30494

SEQ ID NO: 703755 - RNA, 64 nt, hsa; identical to SEQ ID NO: 30495

SEQ ID NO: 703756 - RNA, 64 nt, hsa; identical to SEQ ID NO: 30496

SEQ ID NO: 703757 - RNA, 64 nt, hsa; identical to SEQ ID NO: 30497

SEQ ID NO: 703758 - RNA, 64 nt, hsa; identical to SEQ ID NO: 30498

SEQ ID NO: 703759 - RNA, 64 nt, hsa; identical to SEQ ID NO: 30499

SEQ ID NO: 703760 - RNA, 64 nt, hsa; identical to SEQ ID NO: 30500

SEQ ID NO: 703761 - RNA, 64 nt, hsa; identical to SEQ ID NO: 30501

SEQ ID NO: 703762 - RNA, 64 nt, hsa; identical to SEQ ID NO: 30502

SEQ ID NO: 703763 - RNA, 64 nt, hsa; identical to SEQ ID NO: 30503

SEQ ID NO: 703764 - RNA, 64 nt, hsa; identical to SEQ ID NO: 30504

SEQ ID NO: 703765 - RNA, 64 nt, hsa; identical to SEQ ID NO: 30505

SEQ ID NO: 703766 - RNA, 64 nt, hsa; identical to SEQ ID NO: 30506

SEQ ID NO: 703767 - RNA, 64 nt, hsa; identical to SEQ ID NO: 30507

SEQ ID NO: 703768 - RNA, 64 nt, hsa; identical to SEQ ID NO: 30508

SEQ ID NO: 703769 - RNA, 64 nt, hsa; identical to SEQ ID NO: 30509

SEQ ID NO: 703770 - RNA, 64 nt, hsa; identical to SEQ ID NO: 30510

SEQ ID NO: 703771 - RNA, 64 nt, hsa; identical to SEQ ID NO: 30511

SEQ ID NO: 703772 - RNA, 64 nt, hsa; identical to SEQ ID NO: 30512

SEQ ID NO: 703773 - RNA, 64 nt, hsa; identical to SEQ ID NO: 30513

SEQ ID NO: 703774 - RNA, 64 nt, hsa; identical to SEQ ID NO: 30514

SEQ ID NO: 703775 - RNA, 64 nt, hsa; identical to SEQ ID NO: 30515

SEQ ID NO: 703776 - RNA, 64 nt, hsa; identical to SEQ ID NO: 30516

SEQ ID NO: 703777 - RNA, 64 nt, hsa; identical to SEQ ID NO: 30517

SEQ ID NO: 703778 - RNA, 64 nt, hsa; identical to SEQ ID NO: 30518

SEQ ID NO: 703779 - RNA, 64 nt, hsa; identical to SEQ ID NO: 30519

SEQ ID NO: 703780 - RNA, 64 nt, hsa; identical to SEQ ID NO: 30520

SEQ ID NO: 703781 - RNA, 64 nt, hsa; identical to SEQ ID NO: 30521

SEQ ID NO: 703782 - RNA, 64 nt, hsa; identical to SEQ ID NO: 30522

SEQ ID NO: 703783 - RNA, 64 nt, hsa; identical to SEQ ID NO: 30523

SEQ ID NO: 703784 - RNA, 63 nt, hsa; identical to SEQ ID NO: 30524

SEQ ID NO: 703785 - RNA, 62 nt, hsa; identical to SEQ ID NO: 30525

SEQ ID NO: 703786 - RNA, 64 nt, hsa; identical to SEQ ID NO: 30526

SEQ ID NO: 703787 - RNA, 64 nt, hsa; identical to SEQ ID NO: 30527

SEQ ID NO: 703788 - RNA, 64 nt, hsa; identical to SEQ ID NO: 30528

SEQ ID NO: 703789 - RNA, 64 nt, hsa; identical to SEQ ID NO: 30529

SEQ ID NO: 703790 - RNA, 64 nt, hsa; identical to SEQ ID NO: 30530

SEQ ID NO: 703791 - RNA, 64 nt, hsa; identical to SEQ ID NO: 30531

SEQ ID NO: 703792 - RNA, 64 nt, hsa; identical to SEQ ID NO: 30532

SEQ ID NO: 703793 - RNA, 64 nt, hsa; identical to SEQ ID NO: 30533

SEQ ID NO: 703794 - RNA, 64 nt, hsa; identical to SEQ ID NO: 30534

SEQ ID NO: 703795 - RNA, 64 nt, hsa; identical to SEQ ID NO: 30535

SEQ ID NO: 703796 - RNA, 64 nt, hsa; identical to SEQ ID NO: 30536

SEQ ID NO: 703797 - RNA, 64 nt, hsa; identical to SEQ ID NO: 30537

SEQ ID NO: 703798 - RNA, 64 nt, hsa; identical to SEQ ID NO: 30538

SEQ ID NO: 703799 - RNA, 64 nt, hsa; identical to SEQ ID NO: 30539

SEQ ID NO: 703800 - RNA, 64 nt, hsa; identical to SEQ ID NO: 30540

SEQ ID NO: 703801 - RNA, 64 nt, hsa; identical to SEQ ID NO: 30541

SEQ ID NO: 703802 - RNA, 64 nt, hsa; identical to SEQ ID NO: 30542

SEQ ID NO: 703803 - RNA, 64 nt, hsa; identical to SEQ ID NO: 30543

SEQ ID NO: 703804 - RNA, 64 nt, hsa; identical to SEQ ID NO: 30544

SEQ ID NO: 703805 - RNA, 64 nt, hsa; identical to SEQ ID NO: 30545

SEQ ID NO: 703806 - RNA, 64 nt, hsa; identical to SEQ ID NO: 30546

SEQ ID NO: 703807 - RNA, 64 nt, hsa; identical to SEQ ID NO: 30547

SEQ ID NO: 703808 - RNA, 64 nt, hsa; identical to SEQ ID NO: 30548

SEQ ID NO: 703809 - RNA, 64 nt, hsa; identical to SEQ ID NO: 30549

SEQ ID NO: 703810 - RNA, 64 nt, hsa; identical to SEQ ID NO: 30550

SEQ ID NO: 703811 - RNA, 64 nt, hsa; identical to SEQ ID NO: 30551

SEQ ID NO: 703812 - RNA, 64 nt, hsa; identical to SEQ ID NO: 30552

SEQ ID NO: 703813 - RNA, 64 nt, hsa; identical to SEQ ID NO: 30553

SEQ ID NO: 703814 - RNA, 64 nt, hsa; identical to SEQ ID NO: 30554

SEQ ID NO: 703815 - RNA, 64 nt, hsa; identical to SEQ ID NO: 30555

SEQ ID NO: 703816 - RNA, 64 nt, hsa; identical to SEQ ID NO: 30556

SEQ ID NO: 703817 - RNA, 64 nt, hsa; identical to SEQ ID NO: 30557

SEQ ID NO: 703818 - RNA, 64 nt, hsa; identical to SEQ ID NO: 30558

SEQ ID NO: 703819 - RNA, 64 nt, hsa; identical to SEQ ID NO: 30559

SEQ ID NO: 703820 - RNA, 64 nt, hsa; identical to SEQ ID NO: 30560

SEQ ID NO: 703821 - RNA, 64 nt, hsa; identical to SEQ ID NO: 30561

SEQ ID NO: 703822 - RNA, 64 nt, hsa; identical to SEQ ID NO: 30562

SEQ ID NO: 703823 - RNA, 64 nt, hsa; identical to SEQ ID NO: 30563

SEQ ID NO: 703824 - RNA, 64 nt, hsa; identical to SEQ ID NO: 30564

SEQ ID NO: 703825 - RNA, 64 nt, hsa; identical to SEQ ID NO: 30565

SEQ ID NO: 703826 - RNA, 64 nt, hsa; identical to SEQ ID NO: 30566

SEQ ID NO: 703827 - RNA, 64 nt, hsa; identical to SEQ ID NO: 30567

SEQ ID NO: 703828 - RNA, 64 nt, hsa; identical to SEQ ID NO: 30568

SEQ ID NO: 703829 - RNA, 64 nt, hsa; identical to SEQ ID NO: 30569

SEQ ID NO: 703830 - RNA, 64 nt, hsa; identical to SEQ ID NO: 30570

SEQ ID NO: 703831 - RNA, 64 nt, hsa; identical to SEQ ID NO: 30571

SEQ ID NO: 703832 - RNA, 64 nt, hsa; identical to SEQ ID NO: 30572

SEQ ID NO: 703833 - RNA, 64 nt, hsa; identical to SEQ ID NO: 30573

SEQ ID NO: 703834 - RNA, 64 nt, hsa; identical to SEQ ID NO: 30574

SEQ ID NO: 703835 - RNA, 64 nt, hsa; identical to SEQ ID NO: 30575

SEQ ID NO: 703836 - RNA, 64 nt, hsa; identical to SEQ ID NO: 30576

SEQ ID NO: 703837 - RNA, 64 nt, hsa; identical to SEQ ID NO: 30577

SEQ ID NO: 703838 - RNA, 64 nt, hsa; identical to SEQ ID NO: 30578

SEQ ID NO: 703839 - RNA, 64 nt, hsa; identical to SEQ ID NO: 30579

SEQ ID NO: 703840 - RNA, 64 nt, hsa; identical to SEQ ID NO: 30580

SEQ ID NO: 703841 - RNA, 64 nt, hsa; identical to SEQ ID NO: 30581

SEQ ID NO: 703842 - RNA, 64 nt, hsa; identical to SEQ ID NO: 30582

SEQ ID NO: 703843 - RNA, 64 nt, hsa; identical to SEQ ID NO: 30583

SEQ ID NO: 703844 - RNA, 64 nt, hsa; identical to SEQ ID NO: 30584

SEQ ID NO: 703845 - RNA, 64 nt, hsa; identical to SEQ ID NO: 30585

SEQ ID NO: 703846 - RNA, 64 nt, hsa; identical to SEQ ID NO: 30586

SEQ ID NO: 703847 - RNA, 64 nt, hsa; identical to SEQ ID NO: 30587

SEQ ID NO: 703848 - RNA, 64 nt, hsa; identical to SEQ ID NO: 30588

SEQ ID NO: 703849 - RNA, 64 nt, hsa; identical to SEQ ID NO: 30589

SEQ ID NO: 703850 - RNA, 64 nt, hsa; identical to SEQ ID NO: 30590

SEQ ID NO: 703851 - RNA, 64 nt, hsa; identical to SEQ ID NO: 30591

SEQ ID NO: 703852 - RNA, 64 nt, hsa; identical to SEQ ID NO: 30592

SEQ ID NO: 703853 - RNA, 64 nt, hsa; identical to SEQ ID NO: 30593

SEQ ID NO: 703854 - RNA, 64 nt, hsa; identical to SEQ ID NO: 30594

SEQ ID NO: 703855 - RNA, 64 nt, hsa; identical to SEQ ID NO: 30595

SEQ ID NO: 703856 - RNA, 64 nt, hsa; identical to SEQ ID NO: 30596

SEQ ID NO: 703857 - RNA, 64 nt, hsa; identical to SEQ ID NO: 30597

SEQ ID NO: 703858 - RNA, 64 nt, hsa; identical to SEQ ID NO: 30598

SEQ ID NO: 703859 - RNA, 64 nt, hsa; identical to SEQ ID NO: 30599

SEQ ID NO: 703860 - RNA, 64 nt, hsa; identical to SEQ ID NO: 30600

SEQ ID NO: 703861 - RNA, 64 nt, hsa; identical to SEQ ID NO: 30601

SEQ ID NO: 703862 - RNA, 64 nt, hsa; identical to SEQ ID NO: 30602

SEQ ID NO: 703863 - RNA, 64 nt, hsa; identical to SEQ ID NO: 30603

SEQ ID NO: 703864 - RNA, 64 nt, hsa; identical to SEQ ID NO: 30604

SEQ ID NO: 703865 - RNA, 64 nt, hsa; identical to SEQ ID NO: 30605

SEQ ID NO: 703866 - RNA, 64 nt, hsa; identical to SEQ ID NO: 30606

SEQ ID NO: 703867 - RNA, 64 nt, hsa; identical to SEQ ID NO: 30607

SEQ ID NO: 703868 - RNA, 64 nt, hsa; identical to SEQ ID NO: 30608

SEQ ID NO: 703869 - RNA, 64 nt, hsa; identical to SEQ ID NO: 30609

SEQ ID NO: 703870 - RNA, 64 nt, hsa; identical to SEQ ID NO: 30610

SEQ ID NO: 703871 - RNA, 64 nt, hsa; identical to SEQ ID NO: 30611

SEQ ID NO: 703872 - RNA, 64 nt, hsa; identical to SEQ ID NO: 30612

SEQ ID NO: 703873 - RNA, 64 nt, hsa; identical to SEQ ID NO: 30613

SEQ ID NO: 703874 - RNA, 64 nt, hsa; identical to SEQ ID NO: 30614

SEQ ID NO: 703875 - RNA, 64 nt, hsa; identical to SEQ ID NO: 30615

SEQ ID NO: 703876 - RNA, 64 nt, hsa; identical to SEQ ID NO: 30616

SEQ ID NO: 703877 - RNA, 64 nt, hsa; identical to SEQ ID NO: 30617

SEQ ID NO: 703878 - RNA, 64 nt, hsa; identical to SEQ ID NO: 30618

SEQ ID NO: 703879 - RNA, 64 nt, hsa; identical to SEQ ID NO: 30619

SEQ ID NO: 703880 - RNA, 64 nt, hsa; identical to SEQ ID NO: 30620

SEQ ID NO: 703881 - RNA, 64 nt, hsa; identical to SEQ ID NO: 30621

SEQ ID NO: 703882 - RNA, 64 nt, hsa; identical to SEQ ID NO: 30622

SEQ ID NO: 703883 - RNA, 64 nt, hsa; identical to SEQ ID NO: 30623

SEQ ID NO: 703884 - RNA, 64 nt, hsa; identical to SEQ ID NO: 30624

SEQ ID NO: 703885 - RNA, 64 nt, hsa; identical to SEQ ID NO: 30625

SEQ ID NO: 703886 - RNA, 64 nt, hsa; identical to SEQ ID NO: 30626

SEQ ID NO: 703887 - RNA, 64 nt, hsa; identical to SEQ ID NO: 30627

SEQ ID NO: 703888 - RNA, 64 nt, hsa; identical to SEQ ID NO: 30628

SEQ ID NO: 703889 - RNA, 64 nt, hsa; identical to SEQ ID NO: 30629

SEQ ID NO: 703890 - RNA, 64 nt, hsa; identical to SEQ ID NO: 30630

SEQ ID NO: 703891 - RNA, 64 nt, hsa; identical to SEQ ID NO: 30631

SEQ ID NO: 703892 - RNA, 64 nt, hsa; identical to SEQ ID NO: 30632

SEQ ID NO: 703893 - RNA, 64 nt, hsa; identical to SEQ ID NO: 30633

SEQ ID NO: 703894 - RNA, 64 nt, hsa; identical to SEQ ID NO: 30634

SEQ ID NO: 703895 - RNA, 64 nt, hsa; identical to SEQ ID NO: 30635

SEQ ID NO: 703896 - RNA, 64 nt, hsa; identical to SEQ ID NO: 30636

SEQ ID NO: 703897 - RNA, 64 nt, hsa; identical to SEQ ID NO: 30637

SEQ ID NO: 703898 - RNA, 64 nt, hsa; identical to SEQ ID NO: 30638

SEQ ID NO: 703899 - RNA, 64 nt, hsa; identical to SEQ ID NO: 30639

SEQ ID NO: 703900 - RNA, 64 nt, hsa; identical to SEQ ID NO: 30640

SEQ ID NO: 703901 - RNA, 64 nt, hsa; identical to SEQ ID NO: 30641

SEQ ID NO: 703902 - RNA, 64 nt, hsa; identical to SEQ ID NO: 30642

SEQ ID NO: 703903 - RNA, 64 nt, hsa; identical to SEQ ID NO: 30643

SEQ ID NO: 703904 - RNA, 64 nt, hsa; identical to SEQ ID NO: 30644

SEQ ID NO: 703905 - RNA, 64 nt, hsa; identical to SEQ ID NO: 30645

SEQ ID NO: 703906 - RNA, 64 nt, hsa; identical to SEQ ID NO: 30646

SEQ ID NO: 703907 - RNA, 64 nt, hsa; identical to SEQ ID NO: 30647

SEQ ID NO: 703908 - RNA, 64 nt, hsa; identical to SEQ ID NO: 30648

SEQ ID NO: 703909 - RNA, 64 nt, hsa; identical to SEQ ID NO: 30649

SEQ ID NO: 703910 - RNA, 64 nt, hsa; identical to SEQ ID NO: 30650

SEQ ID NO: 703911 - RNA, 64 nt, hsa; identical to SEQ ID NO: 30651

SEQ ID NO: 703912 - RNA, 64 nt, hsa; identical to SEQ ID NO: 30652

SEQ ID NO: 703913 - RNA, 64 nt, hsa; identical to SEQ ID NO: 30653

SEQ ID NO: 703914 - RNA, 64 nt, hsa; identical to SEQ ID NO: 30654

SEQ ID NO: 703915 - RNA, 64 nt, hsa; identical to SEQ ID NO: 30655

SEQ ID NO: 703916 - RNA, 64 nt, hsa; identical to SEQ ID NO: 30656

SEQ ID NO: 703917 - RNA, 64 nt, hsa; identical to SEQ ID NO: 30657

SEQ ID NO: 703918 - RNA, 64 nt, hsa; identical to SEQ ID NO: 30658

SEQ ID NO: 703919 - RNA, 64 nt, hsa; identical to SEQ ID NO: 30659

SEQ ID NO: 703920 - RNA, 64 nt, hsa; identical to SEQ ID NO: 30660

SEQ ID NO: 703921 - RNA, 62 nt, hsa; identical to SEQ ID NO: 30661

SEQ ID NO: 703922 - RNA, 63 nt, hsa; identical to SEQ ID NO: 30662

SEQ ID NO: 703923 - RNA, 64 nt, hsa; identical to SEQ ID NO: 30663

SEQ ID NO: 703924 - RNA, 64 nt, hsa; identical to SEQ ID NO: 30664

SEQ ID NO: 703925 - RNA, 64 nt, hsa; identical to SEQ ID NO: 30665

SEQ ID NO: 703926 - RNA, 64 nt, hsa; identical to SEQ ID NO: 30666

SEQ ID NO: 703927 - RNA, 64 nt, hsa; identical to SEQ ID NO: 30667

SEQ ID NO: 703928 - RNA, 64 nt, hsa; identical to SEQ ID NO: 30668

SEQ ID NO: 703929 - RNA, 64 nt, hsa; identical to SEQ ID NO: 30669

SEQ ID NO: 703930 - RNA, 64 nt, hsa; identical to SEQ ID NO: 30670

SEQ ID NO: 703931 - RNA, 64 nt, hsa; identical to SEQ ID NO: 30671

SEQ ID NO: 703932 - RNA, 64 nt, hsa; identical to SEQ ID NO: 30672

SEQ ID NO: 703933 - RNA, 64 nt, hsa; identical to SEQ ID NO: 30673

SEQ ID NO: 703934 - RNA, 64 nt, hsa; identical to SEQ ID NO: 30674

SEQ ID NO: 703935 - RNA, 64 nt, hsa; identical to SEQ ID NO: 30675

SEQ ID NO: 703936 - RNA, 64 nt, hsa; identical to SEQ ID NO: 30676

SEQ ID NO: 703937 - RNA, 64 nt, hsa; identical to SEQ ID NO: 30677

SEQ ID NO: 703938 - RNA, 64 nt, hsa; identical to SEQ ID NO: 30678

SEQ ID NO: 703939 - RNA, 64 nt, hsa; identical to SEQ ID NO: 30679

SEQ ID NO: 703940 - RNA, 64 nt, hsa; identical to SEQ ID NO: 30680

SEQ ID NO: 703941 - RNA, 64 nt, hsa; identical to SEQ ID NO: 30681

SEQ ID NO: 703942 - RNA, 64 nt, hsa; identical to SEQ ID NO: 30682

SEQ ID NO: 703943 - RNA, 64 nt, hsa; identical to SEQ ID NO: 30683

SEQ ID NO: 703944 - RNA, 64 nt, hsa; identical to SEQ ID NO: 30684

SEQ ID NO: 703945 - RNA, 64 nt, hsa; identical to SEQ ID NO: 30685

SEQ ID NO: 703946 - RNA, 64 nt, hsa; identical to SEQ ID NO: 30686

SEQ ID NO: 703947 - RNA, 64 nt, hsa; identical to SEQ ID NO: 30687

SEQ ID NO: 703948 - RNA, 64 nt, hsa; identical to SEQ ID NO: 30688

SEQ ID NO: 703949 - RNA, 64 nt, hsa; identical to SEQ ID NO: 30689

SEQ ID NO: 703950 - RNA, 64 nt, hsa; identical to SEQ ID NO: 30690

SEQ ID NO: 703951 - RNA, 64 nt, hsa; identical to SEQ ID NO: 30691

SEQ ID NO: 703952 - RNA, 64 nt, hsa; identical to SEQ ID NO: 30692

SEQ ID NO: 703953 - RNA, 64 nt, hsa; identical to SEQ ID NO: 30693

SEQ ID NO: 703954 - RNA, 64 nt, hsa; identical to SEQ ID NO: 30694

SEQ ID NO: 703955 - RNA, 64 nt, hsa; identical to SEQ ID NO: 30695

SEQ ID NO: 703956 - RNA, 64 nt, hsa; identical to SEQ ID NO: 30696

SEQ ID NO: 703957 - RNA, 64 nt, hsa; identical to SEQ ID NO: 30697

SEQ ID NO: 703958 - RNA, 64 nt, hsa; identical to SEQ ID NO: 30698

SEQ ID NO: 703959 - RNA, 64 nt, hsa; identical to SEQ ID NO: 30699

SEQ ID NO: 703960 - RNA, 64 nt, hsa; identical to SEQ ID NO: 30700

SEQ ID NO: 703961 - RNA, 64 nt, hsa; identical to SEQ ID NO: 30701

SEQ ID NO: 703962 - RNA, 64 nt, hsa; identical to SEQ ID NO: 30702

SEQ ID NO: 703963 - RNA, 64 nt, hsa; identical to SEQ ID NO: 30703

SEQ ID NO: 703964 - RNA, 64 nt, hsa; identical to SEQ ID NO: 30704

SEQ ID NO: 703965 - RNA, 64 nt, hsa; identical to SEQ ID NO: 30705

SEQ ID NO: 703966 - RNA, 64 nt, hsa; identical to SEQ ID NO: 30706

SEQ ID NO: 703967 - RNA, 64 nt, hsa; identical to SEQ ID NO: 30707

SEQ ID NO: 703968 - RNA, 64 nt, hsa; identical to SEQ ID NO: 30708

SEQ ID NO: 703969 - RNA, 64 nt, hsa; identical to SEQ ID NO: 30709

SEQ ID NO: 703970 - RNA, 64 nt, hsa; identical to SEQ ID NO: 30710

SEQ ID NO: 703971 - RNA, 64 nt, hsa; identical to SEQ ID NO: 30711

SEQ ID NO: 703972 - RNA, 64 nt, hsa; identical to SEQ ID NO: 30712

SEQ ID NO: 703973 - RNA, 64 nt, hsa; identical to SEQ ID NO: 30713

SEQ ID NO: 703974 - RNA, 64 nt, hsa; identical to SEQ ID NO: 30714

SEQ ID NO: 703975 - RNA, 64 nt, hsa; identical to SEQ ID NO: 30715

SEQ ID NO: 703976 - RNA, 64 nt, hsa; identical to SEQ ID NO: 30716

SEQ ID NO: 703977 - RNA, 64 nt, hsa; identical to SEQ ID NO: 30717

SEQ ID NO: 703978 - RNA, 64 nt, hsa; identical to SEQ ID NO: 30718

SEQ ID NO: 703979 - RNA, 64 nt, hsa; identical to SEQ ID NO: 30719

SEQ ID NO: 703980 - RNA, 64 nt, hsa; identical to SEQ ID NO: 30720

SEQ ID NO: 703981 - RNA, 64 nt, hsa; identical to SEQ ID NO: 30721

SEQ ID NO: 703982 - RNA, 58 nt, hsa; identical to SEQ ID NO: 30722

SEQ ID NO: 703983 - RNA, 64 nt, hsa; identical to SEQ ID NO: 30723

SEQ ID NO: 703984 - RNA, 64 nt, hsa; identical to SEQ ID NO: 30724

SEQ ID NO: 703985 - RNA, 64 nt, hsa; identical to SEQ ID NO: 30725

SEQ ID NO: 703986 - RNA, 64 nt, hsa; identical to SEQ ID NO: 30726

SEQ ID NO: 703987 - RNA, 64 nt, hsa; identical to SEQ ID NO: 30727

SEQ ID NO: 703988 - RNA, 64 nt, hsa; identical to SEQ ID NO: 30728

SEQ ID NO: 703989 - RNA, 64 nt, hsa; identical to SEQ ID NO: 30729

SEQ ID NO: 703990 - RNA, 64 nt, hsa; identical to SEQ ID NO: 30730

SEQ ID NO: 703991 - RNA, 64 nt, hsa; identical to SEQ ID NO: 30731

SEQ ID NO: 703992 - RNA, 64 nt, hsa; identical to SEQ ID NO: 30732

SEQ ID NO: 703993 - RNA, 64 nt, hsa; identical to SEQ ID NO: 30733

SEQ ID NO: 703994 - RNA, 64 nt, hsa; identical to SEQ ID NO: 30734

SEQ ID NO: 703995 - RNA, 64 nt, hsa; identical to SEQ ID NO: 30735

SEQ ID NO: 703996 - RNA, 64 nt, hsa; identical to SEQ ID NO: 30736

SEQ ID NO: 703997 - RNA, 64 nt, hsa; identical to SEQ ID NO: 30737

SEQ ID NO: 703998 - RNA, 64 nt, hsa; identical to SEQ ID NO: 30738

SEQ ID NO: 703999 - RNA, 64 nt, hsa; identical to SEQ ID NO: 30739

SEQ ID NO: 704000 - RNA, 64 nt, hsa; identical to SEQ ID NO: 30740

SEQ ID NO: 704001 - RNA, 64 nt, hsa; identical to SEQ ID NO: 30741

SEQ ID NO: 704002 - RNA, 64 nt, hsa; identical to SEQ ID NO: 30742

SEQ ID NO: 704003 - RNA, 64 nt, hsa; identical to SEQ ID NO: 30743

SEQ ID NO: 704004 - RNA, 64 nt, hsa; identical to SEQ ID NO: 30744

SEQ ID NO: 704005 - RNA, 64 nt, hsa; identical to SEQ ID NO: 30745

SEQ ID NO: 704006 - RNA, 64 nt, hsa; identical to SEQ ID NO: 30746

SEQ ID NO: 704007 - RNA, 64 nt, hsa; identical to SEQ ID NO: 30747

SEQ ID NO: 704008 - RNA, 64 nt, hsa; identical to SEQ ID NO: 30748

SEQ ID NO: 704009 - RNA, 64 nt, hsa; identical to SEQ ID NO: 30749

SEQ ID NO: 704010 - RNA, 64 nt, hsa; identical to SEQ ID NO: 30750

SEQ ID NO: 704011 - RNA, 64 nt, hsa; identical to SEQ ID NO: 30751

SEQ ID NO: 704012 - RNA, 64 nt, hsa; identical to SEQ ID NO: 30752

SEQ ID NO: 704013 - RNA, 64 nt, hsa; identical to SEQ ID NO: 30753

SEQ ID NO: 704014 - RNA, 64 nt, hsa; identical to SEQ ID NO: 30754

SEQ ID NO: 704015 - RNA, 64 nt, hsa; identical to SEQ ID NO: 30755

SEQ ID NO: 704016 - RNA, 64 nt, hsa; identical to SEQ ID NO: 30756

SEQ ID NO: 704017 - RNA, 64 nt, hsa; identical to SEQ ID NO: 30757

SEQ ID NO: 704018 - RNA, 64 nt, hsa; identical to SEQ ID NO: 30758

SEQ ID NO: 704019 - RNA, 64 nt, hsa; identical to SEQ ID NO: 30759

SEQ ID NO: 704020 - RNA, 64 nt, hsa; identical to SEQ ID NO: 30760

SEQ ID NO: 704021 - RNA, 64 nt, hsa; identical to SEQ ID NO: 30761

SEQ ID NO: 704022 - RNA, 64 nt, hsa; identical to SEQ ID NO: 30762

SEQ ID NO: 704023 - RNA, 64 nt, hsa; identical to SEQ ID NO: 30763

SEQ ID NO: 704024 - RNA, 64 nt, hsa; identical to SEQ ID NO: 30764

SEQ ID NO: 704025 - RNA, 64 nt, hsa; identical to SEQ ID NO: 30765

SEQ ID NO: 704026 - RNA, 64 nt, hsa; identical to SEQ ID NO: 30766

SEQ ID NO: 704027 - RNA, 64 nt, hsa; identical to SEQ ID NO: 30767

SEQ ID NO: 704028 - RNA, 64 nt, hsa; identical to SEQ ID NO: 30768

SEQ ID NO: 704029 - RNA, 64 nt, hsa; identical to SEQ ID NO: 30769

SEQ ID NO: 704030 - RNA, 64 nt, hsa; identical to SEQ ID NO: 30770

SEQ ID NO: 704031 - RNA, 64 nt, hsa; identical to SEQ ID NO: 30771

SEQ ID NO: 704032 - RNA, 64 nt, hsa; identical to SEQ ID NO: 30772

SEQ ID NO: 704033 - RNA, 64 nt, hsa; identical to SEQ ID NO: 30773

SEQ ID NO: 704034 - RNA, 64 nt, hsa; identical to SEQ ID NO: 30774

SEQ ID NO: 704035 - RNA, 64 nt, hsa; identical to SEQ ID NO: 30775

SEQ ID NO: 704036 - RNA, 64 nt, hsa; identical to SEQ ID NO: 30776

SEQ ID NO: 704037 - RNA, 64 nt, hsa; identical to SEQ ID NO: 30777

SEQ ID NO: 704038 - RNA, 64 nt, hsa; identical to SEQ ID NO: 30778

SEQ ID NO: 704039 - RNA, 64 nt, hsa; identical to SEQ ID NO: 30779

SEQ ID NO: 704040 - RNA, 64 nt, hsa; identical to SEQ ID NO: 30780

SEQ ID NO: 704041 - RNA, 64 nt, hsa; identical to SEQ ID NO: 30781

SEQ ID NO: 704042 - RNA, 64 nt, hsa; identical to SEQ ID NO: 30782

SEQ ID NO: 704043 - RNA, 64 nt, hsa; identical to SEQ ID NO: 30783

SEQ ID NO: 704044 - RNA, 64 nt, hsa; identical to SEQ ID NO: 30784

SEQ ID NO: 704045 - RNA, 64 nt, hsa; identical to SEQ ID NO: 30785

SEQ ID NO: 704046 - RNA, 64 nt, hsa; identical to SEQ ID NO: 30786

SEQ ID NO: 704047 - RNA, 64 nt, hsa; identical to SEQ ID NO: 30787

SEQ ID NO: 704048 - RNA, 64 nt, hsa; identical to SEQ ID NO: 30788

SEQ ID NO: 704049 - RNA, 64 nt, hsa; identical to SEQ ID NO: 30789

SEQ ID NO: 704050 - RNA, 64 nt, hsa; identical to SEQ ID NO: 30790

SEQ ID NO: 704051 - RNA, 64 nt, hsa; identical to SEQ ID NO: 30791

SEQ ID NO: 704052 - RNA, 64 nt, hsa; identical to SEQ ID NO: 30792

SEQ ID NO: 704053 - RNA, 64 nt, hsa; identical to SEQ ID NO: 30793

SEQ ID NO: 704054 - RNA, 64 nt, hsa; identical to SEQ ID NO: 30794

SEQ ID NO: 704055 - RNA, 64 nt, hsa; identical to SEQ ID NO: 30795

SEQ ID NO: 704056 - RNA, 64 nt, hsa; identical to SEQ ID NO: 30796

SEQ ID NO: 704057 - RNA, 64 nt, hsa; identical to SEQ ID NO: 30797

SEQ ID NO: 704058 - RNA, 64 nt, hsa; identical to SEQ ID NO: 30798

SEQ ID NO: 704059 - RNA, 64 nt, hsa; identical to SEQ ID NO: 30799

SEQ ID NO: 704060 - RNA, 64 nt, hsa; identical to SEQ ID NO: 30800

SEQ ID NO: 704061 - RNA, 64 nt, hsa; identical to SEQ ID NO: 30801

SEQ ID NO: 704062 - RNA, 64 nt, hsa; identical to SEQ ID NO: 30802

SEQ ID NO: 704063 - RNA, 64 nt, hsa; identical to SEQ ID NO: 30803

SEQ ID NO: 704064 - RNA, 64 nt, hsa; identical to SEQ ID NO: 30804

SEQ ID NO: 704065 - RNA, 64 nt, hsa; identical to SEQ ID NO: 30805

SEQ ID NO: 704066 - RNA, 64 nt, hsa; identical to SEQ ID NO: 30806

SEQ ID NO: 704067 - RNA, 64 nt, hsa; identical to SEQ ID NO: 30807

SEQ ID NO: 704068 - RNA, 64 nt, hsa; identical to SEQ ID NO: 30808

SEQ ID NO: 704069 - RNA, 64 nt, hsa; identical to SEQ ID NO: 30809

SEQ ID NO: 704070 - RNA, 64 nt, hsa; identical to SEQ ID NO: 30810

SEQ ID NO: 704071 - RNA, 64 nt, hsa; identical to SEQ ID NO: 30811

SEQ ID NO: 704072 - RNA, 64 nt, hsa; identical to SEQ ID NO: 30812

SEQ ID NO: 704073 - RNA, 64 nt, hsa; identical to SEQ ID NO: 30813

SEQ ID NO: 704074 - RNA, 64 nt, hsa; identical to SEQ ID NO: 30814

SEQ ID NO: 704075 - RNA, 64 nt, hsa; identical to SEQ ID NO: 30815

SEQ ID NO: 704076 - RNA, 64 nt, hsa; identical to SEQ ID NO: 30816

SEQ ID NO: 704077 - RNA, 64 nt, hsa; identical to SEQ ID NO: 30817

SEQ ID NO: 704078 - RNA, 64 nt, hsa; identical to SEQ ID NO: 30818

SEQ ID NO: 704079 - RNA, 64 nt, hsa; identical to SEQ ID NO: 30819

SEQ ID NO: 704080 - RNA, 64 nt, hsa; identical to SEQ ID NO: 30820

SEQ ID NO: 704081 - RNA, 64 nt, hsa; identical to SEQ ID NO: 30821

SEQ ID NO: 704082 - RNA, 64 nt, hsa; identical to SEQ ID NO: 30822

SEQ ID NO: 704083 - RNA, 64 nt, hsa; identical to SEQ ID NO: 30823

SEQ ID NO: 704084 - RNA, 64 nt, hsa; identical to SEQ ID NO: 30824

SEQ ID NO: 704085 - RNA, 64 nt, hsa; identical to SEQ ID NO: 30825

SEQ ID NO: 704086 - RNA, 64 nt, hsa; identical to SEQ ID NO: 30826

SEQ ID NO: 704087 - RNA, 64 nt, hsa; identical to SEQ ID NO: 30827

SEQ ID NO: 704088 - RNA, 64 nt, hsa; identical to SEQ ID NO: 30828

SEQ ID NO: 704089 - RNA, 64 nt, hsa; identical to SEQ ID NO: 30829

SEQ ID NO: 704090 - RNA, 64 nt, hsa; identical to SEQ ID NO: 30830

SEQ ID NO: 704091 - RNA, 64 nt, hsa; identical to SEQ ID NO: 30831

SEQ ID NO: 704092 - RNA, 64 nt, hsa; identical to SEQ ID NO: 30832

SEQ ID NO: 704093 - RNA, 64 nt, hsa; identical to SEQ ID NO: 30833

SEQ ID NO: 704094 - RNA, 64 nt, hsa; identical to SEQ ID NO: 30834

SEQ ID NO: 704095 - RNA, 64 nt, hsa; identical to SEQ ID NO: 30835

SEQ ID NO: 704096 - RNA, 64 nt, hsa; identical to SEQ ID NO: 30836

SEQ ID NO: 704097 - RNA, 64 nt, hsa; identical to SEQ ID NO: 30837

SEQ ID NO: 704098 - RNA, 64 nt, hsa; identical to SEQ ID NO: 30838

SEQ ID NO: 704099 - RNA, 64 nt, hsa; identical to SEQ ID NO: 30839

SEQ ID NO: 704100 - RNA, 64 nt, hsa; identical to SEQ ID NO: 30840

SEQ ID NO: 704101 - RNA, 64 nt, hsa; identical to SEQ ID NO: 30841

SEQ ID NO: 704102 - RNA, 64 nt, hsa; identical to SEQ ID NO: 30842

SEQ ID NO: 704103 - RNA, 64 nt, hsa; identical to SEQ ID NO: 30843

SEQ ID NO: 704104 - RNA, 64 nt, hsa; identical to SEQ ID NO: 30844

SEQ ID NO: 704105 - RNA, 64 nt, hsa; identical to SEQ ID NO: 30845

SEQ ID NO: 704106 - RNA, 64 nt, hsa; identical to SEQ ID NO: 30846

SEQ ID NO: 704107 - RNA, 64 nt, hsa; identical to SEQ ID NO: 30847

SEQ ID NO: 704108 - RNA, 64 nt, hsa; identical to SEQ ID NO: 30848

SEQ ID NO: 704109 - RNA, 64 nt, hsa; identical to SEQ ID NO: 30849

SEQ ID NO: 704110 - RNA, 64 nt, hsa; identical to SEQ ID NO: 30850

SEQ ID NO: 704111 - RNA, 64 nt, hsa; identical to SEQ ID NO: 30851

SEQ ID NO: 704112 - RNA, 64 nt, hsa; identical to SEQ ID NO: 30852

SEQ ID NO: 704113 - RNA, 64 nt, hsa; identical to SEQ ID NO: 30853

SEQ ID NO: 704114 - RNA, 64 nt, hsa; identical to SEQ ID NO: 30854

SEQ ID NO: 704115 - RNA, 64 nt, hsa; identical to SEQ ID NO: 30855

SEQ ID NO: 704116 - RNA, 64 nt, hsa; identical to SEQ ID NO: 30856

SEQ ID NO: 704117 - RNA, 64 nt, hsa; identical to SEQ ID NO: 30857

SEQ ID NO: 704118 - RNA, 64 nt, hsa; identical to SEQ ID NO: 30858

SEQ ID NO: 704119 - RNA, 64 nt, hsa; identical to SEQ ID NO: 30859

SEQ ID NO: 704120 - RNA, 64 nt, hsa; identical to SEQ ID NO: 30860

SEQ ID NO: 704121 - RNA, 64 nt, hsa; identical to SEQ ID NO: 30861

SEQ ID NO: 704122 - RNA, 64 nt, hsa; identical to SEQ ID NO: 30862

SEQ ID NO: 704123 - RNA, 64 nt, hsa; identical to SEQ ID NO: 30863

SEQ ID NO: 704124 - RNA, 64 nt, hsa; identical to SEQ ID NO: 30864

SEQ ID NO: 704125 - RNA, 64 nt, hsa; identical to SEQ ID NO: 30865

SEQ ID NO: 704126 - RNA, 64 nt, hsa; identical to SEQ ID NO: 30866

SEQ ID NO: 704127 - RNA, 64 nt, hsa; identical to SEQ ID NO: 30867

SEQ ID NO: 704128 - RNA, 64 nt, hsa; identical to SEQ ID NO: 30868

SEQ ID NO: 704129 - RNA, 64 nt, hsa; identical to SEQ ID NO: 30869

SEQ ID NO: 704130 - RNA, 64 nt, hsa; identical to SEQ ID NO: 30870

SEQ ID NO: 704131 - RNA, 64 nt, hsa; identical to SEQ ID NO: 30871

SEQ ID NO: 704132 - RNA, 64 nt, hsa; identical to SEQ ID NO: 30872

SEQ ID NO: 704133 - RNA, 64 nt, hsa; identical to SEQ ID NO: 30873

SEQ ID NO: 704134 - RNA, 64 nt, hsa; identical to SEQ ID NO: 30874

SEQ ID NO: 704135 - RNA, 64 nt, hsa; identical to SEQ ID NO: 30875

SEQ ID NO: 704136 - RNA, 64 nt, hsa; identical to SEQ ID NO: 30876

SEQ ID NO: 704137 - RNA, 64 nt, hsa; identical to SEQ ID NO: 30877

SEQ ID NO: 704138 - RNA, 64 nt, hsa; identical to SEQ ID NO: 30878

SEQ ID NO: 704139 - RNA, 64 nt, hsa; identical to SEQ ID NO: 30879

SEQ ID NO: 704140 - RNA, 64 nt, hsa; identical to SEQ ID NO: 30880

SEQ ID NO: 704141 - RNA, 64 nt, hsa; identical to SEQ ID NO: 30881

SEQ ID NO: 704142 - RNA, 64 nt, hsa; identical to SEQ ID NO: 30882

SEQ ID NO: 704143 - RNA, 64 nt, hsa; identical to SEQ ID NO: 30883

SEQ ID NO: 704144 - RNA, 64 nt, hsa; identical to SEQ ID NO: 30884

SEQ ID NO: 704145 - RNA, 64 nt, hsa; identical to SEQ ID NO: 30885

SEQ ID NO: 704146 - RNA, 64 nt, hsa; identical to SEQ ID NO: 30886

SEQ ID NO: 704147 - RNA, 64 nt, hsa; identical to SEQ ID NO: 30887

SEQ ID NO: 704148 - RNA, 64 nt, hsa; identical to SEQ ID NO: 30888

SEQ ID NO: 704149 - RNA, 64 nt, hsa; identical to SEQ ID NO: 30889

SEQ ID NO: 704150 - RNA, 64 nt, hsa; identical to SEQ ID NO: 30890

SEQ ID NO: 704151 - RNA, 64 nt, hsa; identical to SEQ ID NO: 30891

SEQ ID NO: 704152 - RNA, 64 nt, hsa; identical to SEQ ID NO: 30892

SEQ ID NO: 704153 - RNA, 64 nt, hsa; identical to SEQ ID NO: 30893

SEQ ID NO: 704154 - RNA, 64 nt, hsa; identical to SEQ ID NO: 30894

SEQ ID NO: 704155 - RNA, 64 nt, hsa; identical to SEQ ID NO: 30895

SEQ ID NO: 704156 - RNA, 64 nt, hsa; identical to SEQ ID NO: 30896

SEQ ID NO: 704157 - RNA, 64 nt, hsa; identical to SEQ ID NO: 30897

SEQ ID NO: 704158 - RNA, 64 nt, hsa; identical to SEQ ID NO: 30898

SEQ ID NO: 704159 - RNA, 64 nt, hsa; identical to SEQ ID NO: 30899

SEQ ID NO: 704160 - RNA, 64 nt, hsa; identical to SEQ ID NO: 30900

SEQ ID NO: 704161 - RNA, 64 nt, hsa; identical to SEQ ID NO: 30901

SEQ ID NO: 704162 - RNA, 64 nt, hsa; identical to SEQ ID NO: 30902

SEQ ID NO: 704163 - RNA, 64 nt, hsa; identical to SEQ ID NO: 30903

SEQ ID NO: 704164 - RNA, 64 nt, hsa; identical to SEQ ID NO: 30904

SEQ ID NO: 704165 - RNA, 64 nt, hsa; identical to SEQ ID NO: 30905

SEQ ID NO: 704166 - RNA, 64 nt, hsa; identical to SEQ ID NO: 30906

SEQ ID NO: 704167 - RNA, 64 nt, hsa; identical to SEQ ID NO: 30907

SEQ ID NO: 704168 - RNA, 64 nt, hsa; identical to SEQ ID NO: 30908

SEQ ID NO: 704169 - RNA, 64 nt, hsa; identical to SEQ ID NO: 30909

SEQ ID NO: 704170 - RNA, 64 nt, hsa; identical to SEQ ID NO: 30910

SEQ ID NO: 704171 - RNA, 64 nt, hsa; identical to SEQ ID NO: 30911

SEQ ID NO: 704172 - RNA, 64 nt, hsa; identical to SEQ ID NO: 30912

SEQ ID NO: 704173 - RNA, 64 nt, hsa; identical to SEQ ID NO: 30913

SEQ ID NO: 704174 - RNA, 64 nt, hsa; identical to SEQ ID NO: 30914

SEQ ID NO: 704175 - RNA, 64 nt, hsa; identical to SEQ ID NO: 30915

SEQ ID NO: 704176 - RNA, 64 nt, hsa; identical to SEQ ID NO: 30916

SEQ ID NO: 704177 - RNA, 64 nt, hsa; identical to SEQ ID NO: 30917

SEQ ID NO: 704178 - RNA, 64 nt, hsa; identical to SEQ ID NO: 30918

SEQ ID NO: 704179 - RNA, 64 nt, hsa; identical to SEQ ID NO: 30919

SEQ ID NO: 704180 - RNA, 64 nt, hsa; identical to SEQ ID NO: 30920

SEQ ID NO: 704181 - RNA, 64 nt, hsa; identical to SEQ ID NO: 30921

SEQ ID NO: 704182 - RNA, 64 nt, hsa; identical to SEQ ID NO: 30922

SEQ ID NO: 704183 - RNA, 64 nt, hsa; identical to SEQ ID NO: 30923

SEQ ID NO: 704184 - RNA, 64 nt, hsa; identical to SEQ ID NO: 30924

SEQ ID NO: 704185 - RNA, 64 nt, hsa; identical to SEQ ID NO: 30925

SEQ ID NO: 704186 - RNA, 64 nt, hsa; identical to SEQ ID NO: 30926

SEQ ID NO: 704187 - RNA, 64 nt, hsa; identical to SEQ ID NO: 30927

SEQ ID NO: 704188 - RNA, 64 nt, hsa; identical to SEQ ID NO: 30928

SEQ ID NO: 704189 - RNA, 64 nt, hsa; identical to SEQ ID NO: 30929

SEQ ID NO: 704190 - RNA, 64 nt, hsa; identical to SEQ ID NO: 30930

SEQ ID NO: 704191 - RNA, 64 nt, hsa; identical to SEQ ID NO: 30931

SEQ ID NO: 704192 - RNA, 64 nt, hsa; identical to SEQ ID NO: 30932

SEQ ID NO: 704193 - RNA, 64 nt, hsa; identical to SEQ ID NO: 30933

SEQ ID NO: 704194 - RNA, 64 nt, hsa; identical to SEQ ID NO: 30934

SEQ ID NO: 704195 - RNA, 64 nt, hsa; identical to SEQ ID NO: 30935

SEQ ID NO: 704196 - RNA, 64 nt, hsa; identical to SEQ ID NO: 30936

SEQ ID NO: 704197 - RNA, 64 nt, hsa; identical to SEQ ID NO: 30937

SEQ ID NO: 704198 - RNA, 64 nt, hsa; identical to SEQ ID NO: 30938

SEQ ID NO: 704199 - RNA, 64 nt, hsa; identical to SEQ ID NO: 30939

SEQ ID NO: 704200 - RNA, 64 nt, hsa; identical to SEQ ID NO: 30940

SEQ ID NO: 704201 - RNA, 64 nt, hsa; identical to SEQ ID NO: 30941

SEQ ID NO: 704202 - RNA, 64 nt, hsa; identical to SEQ ID NO: 30942

SEQ ID NO: 704203 - RNA, 64 nt, hsa; identical to SEQ ID NO: 30943

SEQ ID NO: 704204 - RNA, 64 nt, hsa; identical to SEQ ID NO: 30944

SEQ ID NO: 704205 - RNA, 64 nt, hsa; identical to SEQ ID NO: 30945

SEQ ID NO: 704206 - RNA, 64 nt, hsa; identical to SEQ ID NO: 30946

SEQ ID NO: 704207 - RNA, 64 nt, hsa; identical to SEQ ID NO: 30947

SEQ ID NO: 704208 - RNA, 64 nt, hsa; identical to SEQ ID NO: 30948

SEQ ID NO: 704209 - RNA, 64 nt, hsa; identical to SEQ ID NO: 30949

SEQ ID NO: 704210 - RNA, 64 nt, hsa; identical to SEQ ID NO: 30950

SEQ ID NO: 704211 - RNA, 64 nt, hsa; identical to SEQ ID NO: 30951

SEQ ID NO: 704212 - RNA, 64 nt, hsa; identical to SEQ ID NO: 30952

SEQ ID NO: 704213 - RNA, 64 nt, hsa; identical to SEQ ID NO: 30953

SEQ ID NO: 704214 - RNA, 64 nt, hsa; identical to SEQ ID NO: 30954

SEQ ID NO: 704215 - RNA, 64 nt, hsa; identical to SEQ ID NO: 30955

SEQ ID NO: 704216 - RNA, 64 nt, hsa; identical to SEQ ID NO: 30956

SEQ ID NO: 704217 - RNA, 64 nt, hsa; identical to SEQ ID NO: 30957

SEQ ID NO: 704218 - RNA, 64 nt, hsa; identical to SEQ ID NO: 30958

SEQ ID NO: 704219 - RNA, 64 nt, hsa; identical to SEQ ID NO: 30959

SEQ ID NO: 704220 - RNA, 64 nt, hsa; identical to SEQ ID NO: 30960

SEQ ID NO: 704221 - RNA, 64 nt, hsa; identical to SEQ ID NO: 30961

SEQ ID NO: 704222 - RNA, 64 nt, hsa; identical to SEQ ID NO: 30962

SEQ ID NO: 704223 - RNA, 64 nt, hsa; identical to SEQ ID NO: 30963

SEQ ID NO: 704224 - RNA, 64 nt, hsa; identical to SEQ ID NO: 30964

SEQ ID NO: 704225 - RNA, 64 nt, hsa; identical to SEQ ID NO: 30965

SEQ ID NO: 704226 - RNA, 64 nt, hsa; identical to SEQ ID NO: 30966

SEQ ID NO: 704227 - RNA, 64 nt, hsa; identical to SEQ ID NO: 30967

SEQ ID NO: 704228 - RNA, 64 nt, hsa; identical to SEQ ID NO: 30968

SEQ ID NO: 704229 - RNA, 64 nt, hsa; identical to SEQ ID NO: 30969

SEQ ID NO: 704230 - RNA, 64 nt, hsa; identical to SEQ ID NO: 30970

SEQ ID NO: 704231 - RNA, 64 nt, hsa; identical to SEQ ID NO: 30971

SEQ ID NO: 704232 - RNA, 64 nt, hsa; identical to SEQ ID NO: 30972

SEQ ID NO: 704233 - RNA, 64 nt, hsa; identical to SEQ ID NO: 30973

SEQ ID NO: 704234 - RNA, 64 nt, hsa; identical to SEQ ID NO: 30974

SEQ ID NO: 704235 - RNA, 64 nt, hsa; identical to SEQ ID NO: 30975

SEQ ID NO: 704236 - RNA, 64 nt, hsa; identical to SEQ ID NO: 30976

SEQ ID NO: 704237 - RNA, 64 nt, hsa; identical to SEQ ID NO: 30977

SEQ ID NO: 704238 - RNA, 64 nt, hsa; identical to SEQ ID NO: 30978

SEQ ID NO: 704239 - RNA, 64 nt, hsa; identical to SEQ ID NO: 30979

SEQ ID NO: 704240 - RNA, 64 nt, hsa; identical to SEQ ID NO: 30980

SEQ ID NO: 704241 - RNA, 64 nt, hsa; identical to SEQ ID NO: 30981

SEQ ID NO: 704242 - RNA, 64 nt, hsa; identical to SEQ ID NO: 30982

SEQ ID NO: 704243 - RNA, 64 nt, hsa; identical to SEQ ID NO: 30983

SEQ ID NO: 704244 - RNA, 64 nt, hsa; identical to SEQ ID NO: 30984

SEQ ID NO: 704245 - RNA, 60 nt, hsa; identical to SEQ ID NO: 30985

SEQ ID NO: 704246 - RNA, 61 nt, hsa; identical to SEQ ID NO: 30986

SEQ ID NO: 704247 - RNA, 64 nt, hsa; identical to SEQ ID NO: 30987

SEQ ID NO: 704248 - RNA, 64 nt, hsa; identical to SEQ ID NO: 30988

SEQ ID NO: 704249 - RNA, 64 nt, hsa; identical to SEQ ID NO: 30989

SEQ ID NO: 704250 - RNA, 64 nt, hsa; identical to SEQ ID NO: 30990

SEQ ID NO: 704251 - RNA, 64 nt, hsa; identical to SEQ ID NO: 30991

SEQ ID NO: 704252 - RNA, 64 nt, hsa; identical to SEQ ID NO: 30992

SEQ ID NO: 704253 - RNA, 64 nt, hsa; identical to SEQ ID NO: 30993

SEQ ID NO: 704254 - RNA, 64 nt, hsa; identical to SEQ ID NO: 30994

SEQ ID NO: 704255 - RNA, 64 nt, hsa; identical to SEQ ID NO: 30995

SEQ ID NO: 704256 - RNA, 64 nt, hsa; identical to SEQ ID NO: 30996

SEQ ID NO: 704257 - RNA, 64 nt, hsa; identical to SEQ ID NO: 30997

SEQ ID NO: 704258 - RNA, 64 nt, hsa; identical to SEQ ID NO: 30998

SEQ ID NO: 704259 - RNA, 64 nt, hsa; identical to SEQ ID NO: 30999

SEQ ID NO: 704260 - RNA, 64 nt, hsa; identical to SEQ ID NO: 31000

SEQ ID NO: 704261 - RNA, 64 nt, hsa; identical to SEQ ID NO: 31001

SEQ ID NO: 704262 - RNA, 64 nt, hsa; identical to SEQ ID NO: 31002

SEQ ID NO: 704263 - RNA, 64 nt, hsa; identical to SEQ ID NO: 31003

SEQ ID NO: 704264 - RNA, 64 nt, hsa; identical to SEQ ID NO: 31004

SEQ ID NO: 704265 - RNA, 64 nt, hsa; identical to SEQ ID NO: 31005

SEQ ID NO: 704266 - RNA, 64 nt, hsa; identical to SEQ ID NO: 31006

SEQ ID NO: 704267 - RNA, 64 nt, hsa; identical to SEQ ID NO: 31007

SEQ ID NO: 704268 - RNA, 64 nt, hsa; identical to SEQ ID NO: 31008

SEQ ID NO: 704269 - RNA, 64 nt, hsa; identical to SEQ ID NO: 31009

SEQ ID NO: 704270 - RNA, 64 nt, hsa; identical to SEQ ID NO: 31010

SEQ ID NO: 704271 - RNA, 64 nt, hsa; identical to SEQ ID NO: 31011

SEQ ID NO: 704272 - RNA, 64 nt, hsa; identical to SEQ ID NO: 31012

SEQ ID NO: 704273 - RNA, 64 nt, hsa; identical to SEQ ID NO: 31013

SEQ ID NO: 704274 - RNA, 64 nt, hsa; identical to SEQ ID NO: 31014

SEQ ID NO: 704275 - RNA, 64 nt, hsa; identical to SEQ ID NO: 31015

SEQ ID NO: 704276 - RNA, 64 nt, hsa; identical to SEQ ID NO: 31016

SEQ ID NO: 704277 - RNA, 64 nt, hsa; identical to SEQ ID NO: 31017

SEQ ID NO: 704278 - RNA, 64 nt, hsa; identical to SEQ ID NO: 31018

SEQ ID NO: 704279 - RNA, 64 nt, hsa; identical to SEQ ID NO: 31019

SEQ ID NO: 704280 - RNA, 64 nt, hsa; identical to SEQ ID NO: 31020

SEQ ID NO: 704281 - RNA, 64 nt, hsa; identical to SEQ ID NO: 31021

SEQ ID NO: 704282 - RNA, 64 nt, hsa; identical to SEQ ID NO: 31022

SEQ ID NO: 704283 - RNA, 64 nt, hsa; identical to SEQ ID NO: 31023

SEQ ID NO: 704284 - RNA, 64 nt, hsa; identical to SEQ ID NO: 31024

SEQ ID NO: 704285 - RNA, 64 nt, hsa; identical to SEQ ID NO: 31025

SEQ ID NO: 704286 - RNA, 64 nt, hsa; identical to SEQ ID NO: 31026

SEQ ID NO: 704287 - RNA, 64 nt, hsa; identical to SEQ ID NO: 31027

SEQ ID NO: 704288 - RNA, 64 nt, hsa; identical to SEQ ID NO: 31028

SEQ ID NO: 704289 - RNA, 64 nt, hsa; identical to SEQ ID NO: 31029

SEQ ID NO: 704290 - RNA, 64 nt, hsa; identical to SEQ ID NO: 31030

SEQ ID NO: 704291 - RNA, 64 nt, hsa; identical to SEQ ID NO: 31031

SEQ ID NO: 704292 - RNA, 64 nt, hsa; identical to SEQ ID NO: 31032

SEQ ID NO: 704293 - RNA, 64 nt, hsa; identical to SEQ ID NO: 31033

SEQ ID NO: 704294 - RNA, 64 nt, hsa; identical to SEQ ID NO: 31034

SEQ ID NO: 704295 - RNA, 64 nt, hsa; identical to SEQ ID NO: 31035

SEQ ID NO: 704296 - RNA, 64 nt, hsa; identical to SEQ ID NO: 31036

SEQ ID NO: 704297 - RNA, 64 nt, hsa; identical to SEQ ID NO: 31037

SEQ ID NO: 704298 - RNA, 64 nt, hsa; identical to SEQ ID NO: 31038

SEQ ID NO: 704299 - RNA, 64 nt, hsa; identical to SEQ ID NO: 31039

SEQ ID NO: 704300 - RNA, 64 nt, hsa; identical to SEQ ID NO: 31040

SEQ ID NO: 704301 - RNA, 64 nt, hsa; identical to SEQ ID NO: 31041

SEQ ID NO: 704302 - RNA, 64 nt, hsa; identical to SEQ ID NO: 31042

SEQ ID NO: 704303 - RNA, 64 nt, hsa; identical to SEQ ID NO: 31043

SEQ ID NO: 704304 - RNA, 64 nt, hsa; identical to SEQ ID NO: 31044

SEQ ID NO: 704305 - RNA, 64 nt, hsa; identical to SEQ ID NO: 31045

SEQ ID NO: 704306 - RNA, 64 nt, hsa; identical to SEQ ID NO: 31046

SEQ ID NO: 704307 - RNA, 64 nt, hsa; identical to SEQ ID NO: 31047

SEQ ID NO: 704308 - RNA, 64 nt, hsa; identical to SEQ ID NO: 31048

SEQ ID NO: 704309 - RNA, 64 nt, hsa; identical to SEQ ID NO: 31049

SEQ ID NO: 704310 - RNA, 64 nt, hsa; identical to SEQ ID NO: 31050

SEQ ID NO: 704311 - RNA, 64 nt, hsa; identical to SEQ ID NO: 31051

SEQ ID NO: 704312 - RNA, 64 nt, hsa; identical to SEQ ID NO: 31052

SEQ ID NO: 704313 - RNA, 64 nt, hsa; identical to SEQ ID NO: 31053

SEQ ID NO: 704314 - RNA, 64 nt, hsa; identical to SEQ ID NO: 31054

SEQ ID NO: 704315 - RNA, 64 nt, hsa; identical to SEQ ID NO: 31055

SEQ ID NO: 704316 - RNA, 64 nt, hsa; identical to SEQ ID NO: 31056

SEQ ID NO: 704317 - RNA, 64 nt, hsa; identical to SEQ ID NO: 31057

SEQ ID NO: 704318 - RNA, 64 nt, hsa; identical to SEQ ID NO: 31058

SEQ ID NO: 704319 - RNA, 64 nt, hsa; identical to SEQ ID NO: 31059

SEQ ID NO: 704320 - RNA, 64 nt, hsa; identical to SEQ ID NO: 31060

SEQ ID NO: 704321 - RNA, 64 nt, hsa; identical to SEQ ID NO: 31061

SEQ ID NO: 704322 - RNA, 64 nt, hsa; identical to SEQ ID NO: 31062

SEQ ID NO: 704323 - RNA, 64 nt, hsa; identical to SEQ ID NO: 31063

SEQ ID NO: 704324 - RNA, 64 nt, hsa; identical to SEQ ID NO: 31064

SEQ ID NO: 704325 - RNA, 64 nt, hsa; identical to SEQ ID NO: 31065

SEQ ID NO: 704326 - RNA, 64 nt, hsa; identical to SEQ ID NO: 31066

SEQ ID NO: 704327 - RNA, 64 nt, hsa; identical to SEQ ID NO: 31067

SEQ ID NO: 704328 - RNA, 64 nt, hsa; identical to SEQ ID NO: 31068

SEQ ID NO: 704329 - RNA, 64 nt, hsa; identical to SEQ ID NO: 31069

SEQ ID NO: 704330 - RNA, 64 nt, hsa; identical to SEQ ID NO: 31070

SEQ ID NO: 704331 - RNA, 64 nt, hsa; identical to SEQ ID NO: 31071

SEQ ID NO: 704332 - RNA, 64 nt, hsa; identical to SEQ ID NO: 31072

SEQ ID NO: 704333 - RNA, 64 nt, hsa; identical to SEQ ID NO: 31073

SEQ ID NO: 704334 - RNA, 64 nt, hsa; identical to SEQ ID NO: 31074

SEQ ID NO: 704335 - RNA, 64 nt, hsa; identical to SEQ ID NO: 31075

SEQ ID NO: 704336 - RNA, 64 nt, hsa; identical to SEQ ID NO: 31076

SEQ ID NO: 704337 - RNA, 64 nt, hsa; identical to SEQ ID NO: 31077

SEQ ID NO: 704338 - RNA, 64 nt, hsa; identical to SEQ ID NO: 31078

SEQ ID NO: 704339 - RNA, 64 nt, hsa; identical to SEQ ID NO: 31079

SEQ ID NO: 704340 - RNA, 64 nt, hsa; identical to SEQ ID NO: 31080

SEQ ID NO: 704341 - RNA, 64 nt, hsa; identical to SEQ ID NO: 31081

SEQ ID NO: 704342 - RNA, 64 nt, hsa; identical to SEQ ID NO: 31082

SEQ ID NO: 704343 - RNA, 64 nt, hsa; identical to SEQ ID NO: 31083

SEQ ID NO: 704344 - RNA, 64 nt, hsa; identical to SEQ ID NO: 31084

SEQ ID NO: 704345 - RNA, 64 nt, hsa; identical to SEQ ID NO: 31085

SEQ ID NO: 704346 - RNA, 64 nt, hsa; identical to SEQ ID NO: 31086

SEQ ID NO: 704347 - RNA, 64 nt, hsa; identical to SEQ ID NO: 31087

SEQ ID NO: 704348 - RNA, 64 nt, hsa; identical to SEQ ID NO: 31088

SEQ ID NO: 704349 - RNA, 64 nt, hsa; identical to SEQ ID NO: 31089

SEQ ID NO: 704350 - RNA, 64 nt, hsa; identical to SEQ ID NO: 31090

SEQ ID NO: 704351 - RNA, 64 nt, hsa; identical to SEQ ID NO: 31091

SEQ ID NO: 704352 - RNA, 64 nt, hsa; identical to SEQ ID NO: 31092

SEQ ID NO: 704353 - RNA, 64 nt, hsa; identical to SEQ ID NO: 31093

SEQ ID NO: 704354 - RNA, 64 nt, hsa; identical to SEQ ID NO: 31094

SEQ ID NO: 704355 - RNA, 64 nt, hsa; identical to SEQ ID NO: 31095

SEQ ID NO: 704356 - RNA, 64 nt, hsa; identical to SEQ ID NO: 31096

SEQ ID NO: 704357 - RNA, 64 nt, hsa; identical to SEQ ID NO: 31097

SEQ ID NO: 704358 - RNA, 64 nt, hsa; identical to SEQ ID NO: 31098

SEQ ID NO: 704359 - RNA, 64 nt, hsa; identical to SEQ ID NO: 31099

SEQ ID NO: 704360 - RNA, 64 nt, hsa; identical to SEQ ID NO: 31100

SEQ ID NO: 704361 - RNA, 64 nt, hsa; identical to SEQ ID NO: 31101

SEQ ID NO: 704362 - RNA, 64 nt, hsa; identical to SEQ ID NO: 31102

SEQ ID NO: 704363 - RNA, 64 nt, hsa; identical to SEQ ID NO: 31103

SEQ ID NO: 704364 - RNA, 64 nt, hsa; identical to SEQ ID NO: 31104

SEQ ID NO: 704365 - RNA, 64 nt, hsa; identical to SEQ ID NO: 31105

SEQ ID NO: 704366 - RNA, 64 nt, hsa; identical to SEQ ID NO: 31106

SEQ ID NO: 704367 - RNA, 64 nt, hsa; identical to SEQ ID NO: 31107

SEQ ID NO: 704368 - RNA, 64 nt, hsa; identical to SEQ ID NO: 31108

SEQ ID NO: 704369 - RNA, 64 nt, hsa; identical to SEQ ID NO: 31109

SEQ ID NO: 704370 - RNA, 64 nt, hsa; identical to SEQ ID NO: 31110

SEQ ID NO: 704371 - RNA, 64 nt, hsa; identical to SEQ ID NO: 31111

SEQ ID NO: 704372 - RNA, 64 nt, hsa; identical to SEQ ID NO: 31112

SEQ ID NO: 704373 - RNA, 64 nt, hsa; identical to SEQ ID NO: 31113

SEQ ID NO: 704374 - RNA, 64 nt, hsa; identical to SEQ ID NO: 31114

SEQ ID NO: 704375 - RNA, 64 nt, hsa; identical to SEQ ID NO: 31115

SEQ ID NO: 704376 - RNA, 64 nt, hsa; identical to SEQ ID NO: 31116

SEQ ID NO: 704377 - RNA, 64 nt, hsa; identical to SEQ ID NO: 31117

SEQ ID NO: 704378 - RNA, 64 nt, hsa; identical to SEQ ID NO: 31118

SEQ ID NO: 704379 - RNA, 64 nt, hsa; identical to SEQ ID NO: 31119

SEQ ID NO: 704380 - RNA, 64 nt, hsa; identical to SEQ ID NO: 31120

SEQ ID NO: 704381 - RNA, 64 nt, hsa; identical to SEQ ID NO: 31121

SEQ ID NO: 704382 - RNA, 64 nt, hsa; identical to SEQ ID NO: 31122

SEQ ID NO: 704383 - RNA, 64 nt, hsa; identical to SEQ ID NO: 31123

SEQ ID NO: 704384 - RNA, 64 nt, hsa; identical to SEQ ID NO: 31124

SEQ ID NO: 704385 - RNA, 64 nt, hsa; identical to SEQ ID NO: 31125

SEQ ID NO: 704386 - RNA, 64 nt, hsa; identical to SEQ ID NO: 31126

SEQ ID NO: 704387 - RNA, 64 nt, hsa; identical to SEQ ID NO: 31127

SEQ ID NO: 704388 - RNA, 64 nt, hsa; identical to SEQ ID NO: 31128

SEQ ID NO: 704389 - RNA, 64 nt, hsa; identical to SEQ ID NO: 31129

SEQ ID NO: 704390 - RNA, 64 nt, hsa; identical to SEQ ID NO: 31130

SEQ ID NO: 704391 - RNA, 64 nt, hsa; identical to SEQ ID NO: 31131

SEQ ID NO: 704392 - RNA, 64 nt, hsa; identical to SEQ ID NO: 31132

SEQ ID NO: 704393 - RNA, 64 nt, hsa; identical to SEQ ID NO: 31133

SEQ ID NO: 704394 - RNA, 64 nt, hsa; identical to SEQ ID NO: 31134

SEQ ID NO: 704395 - RNA, 64 nt, hsa; identical to SEQ ID NO: 31135

SEQ ID NO: 704396 - RNA, 64 nt, hsa; identical to SEQ ID NO: 31136

SEQ ID NO: 704397 - RNA, 64 nt, hsa; identical to SEQ ID NO: 31137

SEQ ID NO: 704398 - RNA, 64 nt, hsa; identical to SEQ ID NO: 31138

SEQ ID NO: 704399 - RNA, 64 nt, hsa; identical to SEQ ID NO: 31139

SEQ ID NO: 704400 - RNA, 64 nt, hsa; identical to SEQ ID NO: 31140

SEQ ID NO: 704401 - RNA, 64 nt, hsa; identical to SEQ ID NO: 31141

SEQ ID NO: 704402 - RNA, 64 nt, hsa; identical to SEQ ID NO: 31142

SEQ ID NO: 704403 - RNA, 64 nt, hsa; identical to SEQ ID NO: 31143

SEQ ID NO: 704404 - RNA, 64 nt, hsa; identical to SEQ ID NO: 31144

SEQ ID NO: 704405 - RNA, 64 nt, hsa; identical to SEQ ID NO: 31145

SEQ ID NO: 704406 - RNA, 64 nt, hsa; identical to SEQ ID NO: 31146

SEQ ID NO: 704407 - RNA, 64 nt, hsa; identical to SEQ ID NO: 31147

SEQ ID NO: 704408 - RNA, 64 nt, hsa; identical to SEQ ID NO: 31148

SEQ ID NO: 704409 - RNA, 64 nt, hsa; identical to SEQ ID NO: 31149

SEQ ID NO: 704410 - RNA, 64 nt, hsa; identical to SEQ ID NO: 31150

SEQ ID NO: 704411 - RNA, 64 nt, hsa; identical to SEQ ID NO: 31151

SEQ ID NO: 704412 - RNA, 64 nt, hsa; identical to SEQ ID NO: 31152

SEQ ID NO: 704413 - RNA, 64 nt, hsa; identical to SEQ ID NO: 31153

SEQ ID NO: 704414 - RNA, 64 nt, hsa; identical to SEQ ID NO: 31154

SEQ ID NO: 704415 - RNA, 64 nt, hsa; identical to SEQ ID NO: 31155

SEQ ID NO: 704416 - RNA, 64 nt, hsa; identical to SEQ ID NO: 31156

SEQ ID NO: 704417 - RNA, 64 nt, hsa; identical to SEQ ID NO: 31157

SEQ ID NO: 704418 - RNA, 64 nt, hsa; identical to SEQ ID NO: 31158

SEQ ID NO: 704419 - RNA, 64 nt, hsa; identical to SEQ ID NO: 31159

SEQ ID NO: 704420 - RNA, 64 nt, hsa; identical to SEQ ID NO: 31160

SEQ ID NO: 704421 - RNA, 64 nt, hsa; identical to SEQ ID NO: 31161

SEQ ID NO: 704422 - RNA, 64 nt, hsa; identical to SEQ ID NO: 31162

SEQ ID NO: 704423 - RNA, 64 nt, hsa; identical to SEQ ID NO: 31163

SEQ ID NO: 704424 - RNA, 64 nt, hsa; identical to SEQ ID NO: 31164

SEQ ID NO: 704425 - RNA, 64 nt, hsa; identical to SEQ ID NO: 31165

SEQ ID NO: 704426 - RNA, 64 nt, hsa; identical to SEQ ID NO: 31166

SEQ ID NO: 704427 - RNA, 64 nt, hsa; identical to SEQ ID NO: 31167

SEQ ID NO: 704428 - RNA, 64 nt, hsa; identical to SEQ ID NO: 31168

SEQ ID NO: 704429 - RNA, 64 nt, hsa; identical to SEQ ID NO: 31169

SEQ ID NO: 704430 - RNA, 64 nt, hsa; identical to SEQ ID NO: 31170

SEQ ID NO: 704431 - RNA, 64 nt, hsa; identical to SEQ ID NO: 31171

SEQ ID NO: 704432 - RNA, 64 nt, hsa; identical to SEQ ID NO: 31172

SEQ ID NO: 704433 - RNA, 64 nt, hsa; identical to SEQ ID NO: 31173

SEQ ID NO: 704434 - RNA, 64 nt, hsa; identical to SEQ ID NO: 31174

SEQ ID NO: 704435 - RNA, 64 nt, hsa; identical to SEQ ID NO: 31175

SEQ ID NO: 704436 - RNA, 64 nt, hsa; identical to SEQ ID NO: 31176

SEQ ID NO: 704437 - RNA, 64 nt, hsa; identical to SEQ ID NO: 31177

SEQ ID NO: 704438 - RNA, 64 nt, hsa; identical to SEQ ID NO: 31178

SEQ ID NO: 704439 - RNA, 64 nt, hsa; identical to SEQ ID NO: 31179

SEQ ID NO: 704440 - RNA, 64 nt, hsa; identical to SEQ ID NO: 31180

SEQ ID NO: 704441 - RNA, 64 nt, hsa; identical to SEQ ID NO: 31181

SEQ ID NO: 704442 - RNA, 64 nt, hsa; identical to SEQ ID NO: 31182

SEQ ID NO: 704443 - RNA, 64 nt, hsa; identical to SEQ ID NO: 31183

SEQ ID NO: 704444 - RNA, 64 nt, hsa; identical to SEQ ID NO: 31184

SEQ ID NO: 704445 - RNA, 64 nt, hsa; identical to SEQ ID NO: 31185

SEQ ID NO: 704446 - RNA, 64 nt, hsa; identical to SEQ ID NO: 31186

SEQ ID NO: 704447 - RNA, 64 nt, hsa; identical to SEQ ID NO: 31187

SEQ ID NO: 704448 - RNA, 64 nt, hsa; identical to SEQ ID NO: 31188

SEQ ID NO: 704449 - RNA, 64 nt, hsa; identical to SEQ ID NO: 31189

SEQ ID NO: 704450 - RNA, 64 nt, hsa; identical to SEQ ID NO: 31190

SEQ ID NO: 704451 - RNA, 64 nt, hsa; identical to SEQ ID NO: 31191

SEQ ID NO: 704452 - RNA, 64 nt, hsa; identical to SEQ ID NO: 31192

SEQ ID NO: 704453 - RNA, 64 nt, hsa; identical to SEQ ID NO: 31193

SEQ ID NO: 704454 - RNA, 64 nt, hsa; identical to SEQ ID NO: 31194

SEQ ID NO: 704455 - RNA, 64 nt, hsa; identical to SEQ ID NO: 31195

SEQ ID NO: 704456 - RNA, 64 nt, hsa; identical to SEQ ID NO: 31196

SEQ ID NO: 704457 - RNA, 64 nt, hsa; identical to SEQ ID NO: 31197

SEQ ID NO: 704458 - RNA, 64 nt, hsa; identical to SEQ ID NO: 31198

SEQ ID NO: 704459 - RNA, 64 nt, hsa; identical to SEQ ID NO: 31199

SEQ ID NO: 704460 - RNA, 64 nt, hsa; identical to SEQ ID NO: 31200

SEQ ID NO: 704461 - RNA, 64 nt, hsa; identical to SEQ ID NO: 31201

SEQ ID NO: 704462 - RNA, 64 nt, hsa; identical to SEQ ID NO: 31202

SEQ ID NO: 704463 - RNA, 64 nt, hsa; identical to SEQ ID NO: 31203

SEQ ID NO: 704464 - RNA, 64 nt, hsa; identical to SEQ ID NO: 31204

SEQ ID NO: 704465 - RNA, 64 nt, hsa; identical to SEQ ID NO: 31205

SEQ ID NO: 704466 - RNA, 64 nt, hsa; identical to SEQ ID NO: 31206

SEQ ID NO: 704467 - RNA, 64 nt, hsa; identical to SEQ ID NO: 31207

SEQ ID NO: 704468 - RNA, 64 nt, hsa; identical to SEQ ID NO: 31208

SEQ ID NO: 704469 - RNA, 64 nt, hsa; identical to SEQ ID NO: 31209

SEQ ID NO: 704470 - RNA, 64 nt, hsa; identical to SEQ ID NO: 31210

SEQ ID NO: 704471 - RNA, 64 nt, hsa; identical to SEQ ID NO: 31211

SEQ ID NO: 704472 - RNA, 64 nt, hsa; identical to SEQ ID NO: 31212

SEQ ID NO: 704473 - RNA, 64 nt, hsa; identical to SEQ ID NO: 31213

SEQ ID NO: 704474 - RNA, 64 nt, hsa; identical to SEQ ID NO: 31214

SEQ ID NO: 704475 - RNA, 64 nt, hsa; identical to SEQ ID NO: 31215

SEQ ID NO: 704476 - RNA, 64 nt, hsa; identical to SEQ ID NO: 31216

SEQ ID NO: 704477 - RNA, 64 nt, hsa; identical to SEQ ID NO: 31217

SEQ ID NO: 704478 - RNA, 64 nt, hsa; identical to SEQ ID NO: 31218

SEQ ID NO: 704479 - RNA, 64 nt, hsa; identical to SEQ ID NO: 31219

SEQ ID NO: 704480 - RNA, 64 nt, hsa; identical to SEQ ID NO: 31220

SEQ ID NO: 704481 - RNA, 64 nt, hsa; identical to SEQ ID NO: 31221

SEQ ID NO: 704482 - RNA, 64 nt, hsa; identical to SEQ ID NO: 31222

SEQ ID NO: 704483 - RNA, 64 nt, hsa; identical to SEQ ID NO: 31223

SEQ ID NO: 704484 - RNA, 64 nt, hsa; identical to SEQ ID NO: 31224

SEQ ID NO: 704485 - RNA, 64 nt, hsa; identical to SEQ ID NO: 31225

SEQ ID NO: 704486 - RNA, 64 nt, hsa; identical to SEQ ID NO: 31226

SEQ ID NO: 704487 - RNA, 64 nt, hsa; identical to SEQ ID NO: 31227

SEQ ID NO: 704488 - RNA, 64 nt, hsa; identical to SEQ ID NO: 31228

SEQ ID NO: 704489 - RNA, 64 nt, hsa; identical to SEQ ID NO: 31229

SEQ ID NO: 704490 - RNA, 64 nt, hsa; identical to SEQ ID NO: 31230

SEQ ID NO: 704491 - RNA, 64 nt, hsa; identical to SEQ ID NO: 31231

SEQ ID NO: 704492 - RNA, 64 nt, hsa; identical to SEQ ID NO: 31232

SEQ ID NO: 704493 - RNA, 64 nt, hsa; identical to SEQ ID NO: 31233

SEQ ID NO: 704494 - RNA, 64 nt, hsa; identical to SEQ ID NO: 31234

SEQ ID NO: 704495 - RNA, 64 nt, hsa; identical to SEQ ID NO: 31235

SEQ ID NO: 704496 - RNA, 64 nt, hsa; identical to SEQ ID NO: 31236

SEQ ID NO: 704497 - RNA, 64 nt, hsa; identical to SEQ ID NO: 31237

SEQ ID NO: 704498 - RNA, 64 nt, hsa; identical to SEQ ID NO: 31238

SEQ ID NO: 704499 - RNA, 64 nt, hsa; identical to SEQ ID NO: 31239

SEQ ID NO: 704500 - RNA, 64 nt, hsa; identical to SEQ ID NO: 31240

SEQ ID NO: 704501 - RNA, 62 nt, hsa; identical to SEQ ID NO: 31241

SEQ ID NO: 704502 - RNA, 63 nt, hsa; identical to SEQ ID NO: 31242

SEQ ID NO: 704503 - RNA, 64 nt, hsa; identical to SEQ ID NO: 31243

SEQ ID NO: 704504 - RNA, 64 nt, hsa; identical to SEQ ID NO: 31244

SEQ ID NO: 704505 - RNA, 64 nt, hsa; identical to SEQ ID NO: 31245

SEQ ID NO: 704506 - RNA, 64 nt, hsa; identical to SEQ ID NO: 31246

SEQ ID NO: 704507 - RNA, 64 nt, hsa; identical to SEQ ID NO: 31247

SEQ ID NO: 704508 - RNA, 64 nt, hsa; identical to SEQ ID NO: 31248

SEQ ID NO: 704509 - RNA, 64 nt, hsa; identical to SEQ ID NO: 31249

SEQ ID NO: 704510 - RNA, 64 nt, hsa; identical to SEQ ID NO: 31250

SEQ ID NO: 704511 - RNA, 64 nt, hsa; identical to SEQ ID NO: 31251

SEQ ID NO: 704512 - RNA, 64 nt, hsa; identical to SEQ ID NO: 31252

SEQ ID NO: 704513 - RNA, 64 nt, hsa; identical to SEQ ID NO: 31253

SEQ ID NO: 704514 - RNA, 64 nt, hsa; identical to SEQ ID NO: 31254

SEQ ID NO: 704515 - RNA, 64 nt, hsa; identical to SEQ ID NO: 31255

SEQ ID NO: 704516 - RNA, 64 nt, hsa; identical to SEQ ID NO: 31256

SEQ ID NO: 704517 - RNA, 64 nt, hsa; identical to SEQ ID NO: 31257

SEQ ID NO: 704518 - RNA, 64 nt, hsa; identical to SEQ ID NO: 31258

SEQ ID NO: 704519 - RNA, 64 nt, hsa; identical to SEQ ID NO: 31259

SEQ ID NO: 704520 - RNA, 64 nt, hsa; identical to SEQ ID NO: 31260

SEQ ID NO: 704521 - RNA, 64 nt, hsa; identical to SEQ ID NO: 31261

SEQ ID NO: 704522 - RNA, 64 nt, hsa; identical to SEQ ID NO: 31262

SEQ ID NO: 704523 - RNA, 64 nt, hsa; identical to SEQ ID NO: 31263

SEQ ID NO: 704524 - RNA, 64 nt, hsa; identical to SEQ ID NO: 31264

SEQ ID NO: 704525 - RNA, 64 nt, hsa; identical to SEQ ID NO: 31265

SEQ ID NO: 704526 - RNA, 64 nt, hsa; identical to SEQ ID NO: 31266

SEQ ID NO: 704527 - RNA, 64 nt, hsa; identical to SEQ ID NO: 31267

SEQ ID NO: 704528 - RNA, 64 nt, hsa; identical to SEQ ID NO: 31268

SEQ ID NO: 704529 - RNA, 64 nt, hsa; identical to SEQ ID NO: 31269

SEQ ID NO: 704530 - RNA, 64 nt, hsa; identical to SEQ ID NO: 31270

SEQ ID NO: 704531 - RNA, 64 nt, hsa; identical to SEQ ID NO: 31271

SEQ ID NO: 704532 - RNA, 64 nt, hsa; identical to SEQ ID NO: 31272

SEQ ID NO: 704533 - RNA, 64 nt, hsa; identical to SEQ ID NO: 31273

SEQ ID NO: 704534 - RNA, 64 nt, hsa; identical to SEQ ID NO: 31274

SEQ ID NO: 704535 - RNA, 64 nt, hsa; identical to SEQ ID NO: 31275

SEQ ID NO: 704536 - RNA, 64 nt, hsa; identical to SEQ ID NO: 31276

SEQ ID NO: 704537 - RNA, 64 nt, hsa; identical to SEQ ID NO: 31277

SEQ ID NO: 704538 - RNA, 64 nt, hsa; identical to SEQ ID NO: 31278

SEQ ID NO: 704539 - RNA, 64 nt, hsa; identical to SEQ ID NO: 31279

SEQ ID NO: 704540 - RNA, 64 nt, hsa; identical to SEQ ID NO: 31280

SEQ ID NO: 704541 - RNA, 64 nt, hsa; identical to SEQ ID NO: 31281

SEQ ID NO: 704542 - RNA, 64 nt, hsa; identical to SEQ ID NO: 31282

SEQ ID NO: 704543 - RNA, 64 nt, hsa; identical to SEQ ID NO: 31283

SEQ ID NO: 704544 - RNA, 64 nt, hsa; identical to SEQ ID NO: 31284

SEQ ID NO: 704545 - RNA, 64 nt, hsa; identical to SEQ ID NO: 31285

SEQ ID NO: 704546 - RNA, 64 nt, hsa; identical to SEQ ID NO: 31286

SEQ ID NO: 704547 - RNA, 64 nt, hsa; identical to SEQ ID NO: 31287

SEQ ID NO: 704548 - RNA, 64 nt, hsa; identical to SEQ ID NO: 31288

SEQ ID NO: 704549 - RNA, 64 nt, hsa; identical to SEQ ID NO: 31289

SEQ ID NO: 704550 - RNA, 64 nt, hsa; identical to SEQ ID NO: 31290

SEQ ID NO: 704551 - RNA, 64 nt, hsa; identical to SEQ ID NO: 31291

SEQ ID NO: 704552 - RNA, 64 nt, hsa; identical to SEQ ID NO: 31292

SEQ ID NO: 704553 - RNA, 64 nt, hsa; identical to SEQ ID NO: 31293

SEQ ID NO: 704554 - RNA, 64 nt, hsa; identical to SEQ ID NO: 31294

SEQ ID NO: 704555 - RNA, 64 nt, hsa; identical to SEQ ID NO: 31295

SEQ ID NO: 704556 - RNA, 64 nt, hsa; identical to SEQ ID NO: 31296

SEQ ID NO: 704557 - RNA, 64 nt, hsa; identical to SEQ ID NO: 31297

SEQ ID NO: 704558 - RNA, 64 nt, hsa; identical to SEQ ID NO: 31298

SEQ ID NO: 704559 - RNA, 64 nt, hsa; identical to SEQ ID NO: 31299

SEQ ID NO: 704560 - RNA, 64 nt, hsa; identical to SEQ ID NO: 31300

SEQ ID NO: 704561 - RNA, 64 nt, hsa; identical to SEQ ID NO: 31301

SEQ ID NO: 704562 - RNA, 64 nt, hsa; identical to SEQ ID NO: 31302

SEQ ID NO: 704563 - RNA, 64 nt, hsa; identical to SEQ ID NO: 31303

SEQ ID NO: 704564 - RNA, 64 nt, hsa; identical to SEQ ID NO: 31304

SEQ ID NO: 704565 - RNA, 64 nt, hsa; identical to SEQ ID NO: 31305

SEQ ID NO: 704566 - RNA, 64 nt, hsa; identical to SEQ ID NO: 31306

SEQ ID NO: 704567 - RNA, 64 nt, hsa; identical to SEQ ID NO: 31307

SEQ ID NO: 704568 - RNA, 64 nt, hsa; identical to SEQ ID NO: 31308

SEQ ID NO: 704569 - RNA, 64 nt, hsa; identical to SEQ ID NO: 31309

SEQ ID NO: 704570 - RNA, 64 nt, hsa; identical to SEQ ID NO: 31310

SEQ ID NO: 704571 - RNA, 64 nt, hsa; identical to SEQ ID NO: 31311

SEQ ID NO: 704572 - RNA, 64 nt, hsa; identical to SEQ ID NO: 31312

SEQ ID NO: 704573 - RNA, 64 nt, hsa; identical to SEQ ID NO: 31313

SEQ ID NO: 704574 - RNA, 64 nt, hsa; identical to SEQ ID NO: 31314

SEQ ID NO: 704575 - RNA, 64 nt, hsa; identical to SEQ ID NO: 31315

SEQ ID NO: 704576 - RNA, 64 nt, hsa; identical to SEQ ID NO: 31316

SEQ ID NO: 704577 - RNA, 64 nt, hsa; identical to SEQ ID NO: 31317

SEQ ID NO: 704578 - RNA, 64 nt, hsa; identical to SEQ ID NO: 31318

SEQ ID NO: 704579 - RNA, 64 nt, hsa; identical to SEQ ID NO: 31319

SEQ ID NO: 704580 - RNA, 64 nt, hsa; identical to SEQ ID NO: 31320

SEQ ID NO: 704581 - RNA, 64 nt, hsa; identical to SEQ ID NO: 31321

SEQ ID NO: 704582 - RNA, 64 nt, hsa; identical to SEQ ID NO: 31322

SEQ ID NO: 704583 - RNA, 64 nt, hsa; identical to SEQ ID NO: 31323

SEQ ID NO: 704584 - RNA, 64 nt, hsa; identical to SEQ ID NO: 31324

SEQ ID NO: 704585 - RNA, 64 nt, hsa; identical to SEQ ID NO: 31325

SEQ ID NO: 704586 - RNA, 64 nt, hsa; identical to SEQ ID NO: 31326

SEQ ID NO: 704587 - RNA, 64 nt, hsa; identical to SEQ ID NO: 31327

SEQ ID NO: 704588 - RNA, 64 nt, hsa; identical to SEQ ID NO: 31328

SEQ ID NO: 704589 - RNA, 64 nt, hsa; identical to SEQ ID NO: 31329

SEQ ID NO: 704590 - RNA, 64 nt, hsa; identical to SEQ ID NO: 31330

SEQ ID NO: 704591 - RNA, 64 nt, hsa; identical to SEQ ID NO: 31331

SEQ ID NO: 704592 - RNA, 64 nt, hsa; identical to SEQ ID NO: 31332

SEQ ID NO: 704593 - RNA, 64 nt, hsa; identical to SEQ ID NO: 31333

SEQ ID NO: 704594 - RNA, 64 nt, hsa; identical to SEQ ID NO: 31334

SEQ ID NO: 704595 - RNA, 64 nt, hsa; identical to SEQ ID NO: 31335

SEQ ID NO: 704596 - RNA, 64 nt, hsa; identical to SEQ ID NO: 31336

SEQ ID NO: 704597 - RNA, 64 nt, hsa; identical to SEQ ID NO: 31337

SEQ ID NO: 704598 - RNA, 64 nt, hsa; identical to SEQ ID NO: 31338

SEQ ID NO: 704599 - RNA, 64 nt, hsa; identical to SEQ ID NO: 31339

SEQ ID NO: 704600 - RNA, 64 nt, hsa; identical to SEQ ID NO: 31340

SEQ ID NO: 704601 - RNA, 64 nt, hsa; identical to SEQ ID NO: 31341

SEQ ID NO: 704602 - RNA, 64 nt, hsa; identical to SEQ ID NO: 31342

SEQ ID NO: 704603 - RNA, 64 nt, hsa; identical to SEQ ID NO: 31343

SEQ ID NO: 704604 - RNA, 64 nt, hsa; identical to SEQ ID NO: 31344

SEQ ID NO: 704605 - RNA, 64 nt, hsa; identical to SEQ ID NO: 31345

SEQ ID NO: 704606 - RNA, 64 nt, hsa; identical to SEQ ID NO: 31346

SEQ ID NO: 704607 - RNA, 64 nt, hsa; identical to SEQ ID NO: 31347

SEQ ID NO: 704608 - RNA, 64 nt, hsa; identical to SEQ ID NO: 31348

SEQ ID NO: 704609 - RNA, 64 nt, hsa; identical to SEQ ID NO: 31349

SEQ ID NO: 704610 - RNA, 64 nt, hsa; identical to SEQ ID NO: 31350

SEQ ID NO: 704611 - RNA, 64 nt, hsa; identical to SEQ ID NO: 31351

SEQ ID NO: 704612 - RNA, 64 nt, hsa; identical to SEQ ID NO: 31352

SEQ ID NO: 704613 - RNA, 64 nt, hsa; identical to SEQ ID NO: 31353

SEQ ID NO: 704614 - RNA, 64 nt, hsa; identical to SEQ ID NO: 31354

SEQ ID NO: 704615 - RNA, 64 nt, hsa; identical to SEQ ID NO: 31355

SEQ ID NO: 704616 - RNA, 64 nt, hsa; identical to SEQ ID NO: 31356

SEQ ID NO: 704617 - RNA, 64 nt, hsa; identical to SEQ ID NO: 31357

SEQ ID NO: 704618 - RNA, 64 nt, hsa; identical to SEQ ID NO: 31358

SEQ ID NO: 704619 - RNA, 64 nt, hsa; identical to SEQ ID NO: 31359

SEQ ID NO: 704620 - RNA, 64 nt, hsa; identical to SEQ ID NO: 31360

SEQ ID NO: 704621 - RNA, 64 nt, hsa; identical to SEQ ID NO: 31361

SEQ ID NO: 704622 - RNA, 64 nt, hsa; identical to SEQ ID NO: 31362

SEQ ID NO: 704623 - RNA, 64 nt, hsa; identical to SEQ ID NO: 31363

SEQ ID NO: 704624 - RNA, 64 nt, hsa; identical to SEQ ID NO: 31364

SEQ ID NO: 704625 - RNA, 64 nt, hsa; identical to SEQ ID NO: 31365

SEQ ID NO: 704626 - RNA, 64 nt, hsa; identical to SEQ ID NO: 31366

SEQ ID NO: 704627 - RNA, 64 nt, hsa; identical to SEQ ID NO: 31367

SEQ ID NO: 704628 - RNA, 64 nt, hsa; identical to SEQ ID NO: 31368

SEQ ID NO: 704629 - RNA, 64 nt, hsa; identical to SEQ ID NO: 31369

SEQ ID NO: 704630 - RNA, 64 nt, hsa; identical to SEQ ID NO: 31370

SEQ ID NO: 704631 - RNA, 64 nt, hsa; identical to SEQ ID NO: 31371

SEQ ID NO: 704632 - RNA, 64 nt, hsa; identical to SEQ ID NO: 31372

SEQ ID NO: 704633 - RNA, 64 nt, hsa; identical to SEQ ID NO: 31373

SEQ ID NO: 704634 - RNA, 64 nt, hsa; identical to SEQ ID NO: 31374

SEQ ID NO: 704635 - RNA, 64 nt, hsa; identical to SEQ ID NO: 31375

SEQ ID NO: 704636 - RNA, 64 nt, hsa; identical to SEQ ID NO: 31376

SEQ ID NO: 704637 - RNA, 64 nt, hsa; identical to SEQ ID NO: 31377

SEQ ID NO: 704638 - RNA, 64 nt, hsa; identical to SEQ ID NO: 31378

SEQ ID NO: 704639 - RNA, 64 nt, hsa; identical to SEQ ID NO: 31379

SEQ ID NO: 704640 - RNA, 64 nt, hsa; identical to SEQ ID NO: 31380

SEQ ID NO: 704641 - RNA, 64 nt, hsa; identical to SEQ ID NO: 31381

SEQ ID NO: 704642 - RNA, 64 nt, hsa; identical to SEQ ID NO: 31382

SEQ ID NO: 704643 - RNA, 64 nt, hsa; identical to SEQ ID NO: 31383

SEQ ID NO: 704644 - RNA, 64 nt, hsa; identical to SEQ ID NO: 31384

SEQ ID NO: 704645 - RNA, 64 nt, hsa; identical to SEQ ID NO: 31385

SEQ ID NO: 704646 - RNA, 64 nt, hsa; identical to SEQ ID NO: 31386

SEQ ID NO: 704647 - RNA, 64 nt, hsa; identical to SEQ ID NO: 31387

SEQ ID NO: 704648 - RNA, 64 nt, hsa; identical to SEQ ID NO: 31388

SEQ ID NO: 704649 - RNA, 64 nt, hsa; identical to SEQ ID NO: 31389

SEQ ID NO: 704650 - RNA, 64 nt, hsa; identical to SEQ ID NO: 31390

SEQ ID NO: 704651 - RNA, 64 nt, hsa; identical to SEQ ID NO: 31391

SEQ ID NO: 704652 - RNA, 64 nt, hsa; identical to SEQ ID NO: 31392

SEQ ID NO: 704653 - RNA, 64 nt, hsa; identical to SEQ ID NO: 31393

SEQ ID NO: 704654 - RNA, 64 nt, hsa; identical to SEQ ID NO: 31394

SEQ ID NO: 704655 - RNA, 64 nt, hsa; identical to SEQ ID NO: 31395

SEQ ID NO: 704656 - RNA, 64 nt, hsa; identical to SEQ ID NO: 31396

SEQ ID NO: 704657 - RNA, 64 nt, hsa; identical to SEQ ID NO: 31397

SEQ ID NO: 704658 - RNA, 64 nt, hsa; identical to SEQ ID NO: 31398

SEQ ID NO: 704659 - RNA, 64 nt, hsa; identical to SEQ ID NO: 31399

SEQ ID NO: 704660 - RNA, 64 nt, hsa; identical to SEQ ID NO: 31400

SEQ ID NO: 704661 - RNA, 64 nt, hsa; identical to SEQ ID NO: 31401

SEQ ID NO: 704662 - RNA, 64 nt, hsa; identical to SEQ ID NO: 31402

SEQ ID NO: 704663 - RNA, 64 nt, hsa; identical to SEQ ID NO: 31403

SEQ ID NO: 704664 - RNA, 64 nt, hsa; identical to SEQ ID NO: 31404

SEQ ID NO: 704665 - RNA, 64 nt, hsa; identical to SEQ ID NO: 31405

SEQ ID NO: 704666 - RNA, 64 nt, hsa; identical to SEQ ID NO: 31406

SEQ ID NO: 704667 - RNA, 64 nt, hsa; identical to SEQ ID NO: 31407

SEQ ID NO: 704668 - RNA, 64 nt, hsa; identical to SEQ ID NO: 31408

SEQ ID NO: 704669 - RNA, 64 nt, hsa; identical to SEQ ID NO: 31409

SEQ ID NO: 704670 - RNA, 64 nt, hsa; identical to SEQ ID NO: 31410

SEQ ID NO: 704671 - RNA, 64 nt, hsa; identical to SEQ ID NO: 31411

SEQ ID NO: 704672 - RNA, 64 nt, hsa; identical to SEQ ID NO: 31412

SEQ ID NO: 704673 - RNA, 64 nt, hsa; identical to SEQ ID NO: 31413

SEQ ID NO: 704674 - RNA, 64 nt, hsa; identical to SEQ ID NO: 31414

SEQ ID NO: 704675 - RNA, 64 nt, hsa; identical to SEQ ID NO: 31415

SEQ ID NO: 704676 - RNA, 64 nt, hsa; identical to SEQ ID NO: 31416

SEQ ID NO: 704677 - RNA, 64 nt, hsa; identical to SEQ ID NO: 31417

SEQ ID NO: 704678 - RNA, 64 nt, hsa; identical to SEQ ID NO: 31418

SEQ ID NO: 704679 - RNA, 64 nt, hsa; identical to SEQ ID NO: 31419

SEQ ID NO: 704680 - RNA, 64 nt, hsa; identical to SEQ ID NO: 31420

SEQ ID NO: 704681 - RNA, 64 nt, hsa; identical to SEQ ID NO: 31421

SEQ ID NO: 704682 - RNA, 64 nt, hsa; identical to SEQ ID NO: 31422

SEQ ID NO: 704683 - RNA, 64 nt, hsa; identical to SEQ ID NO: 31423

SEQ ID NO: 704684 - RNA, 64 nt, hsa; identical to SEQ ID NO: 31424

SEQ ID NO: 704685 - RNA, 64 nt, hsa; identical to SEQ ID NO: 31425

SEQ ID NO: 704686 - RNA, 64 nt, hsa; identical to SEQ ID NO: 31426

SEQ ID NO: 704687 - RNA, 64 nt, hsa; identical to SEQ ID NO: 31427

SEQ ID NO: 704688 - RNA, 64 nt, hsa; identical to SEQ ID NO: 31428

SEQ ID NO: 704689 - RNA, 64 nt, hsa; identical to SEQ ID NO: 31429

SEQ ID NO: 704690 - RNA, 64 nt, hsa; identical to SEQ ID NO: 31430

SEQ ID NO: 704691 - RNA, 64 nt, hsa; identical to SEQ ID NO: 31431

SEQ ID NO: 704692 - RNA, 64 nt, hsa; identical to SEQ ID NO: 31432

SEQ ID NO: 704693 - RNA, 64 nt, hsa; identical to SEQ ID NO: 31433

SEQ ID NO: 704694 - RNA, 64 nt, hsa; identical to SEQ ID NO: 31434

SEQ ID NO: 704695 - RNA, 64 nt, hsa; identical to SEQ ID NO: 31435

SEQ ID NO: 704696 - RNA, 64 nt, hsa; identical to SEQ ID NO: 31436

SEQ ID NO: 704697 - RNA, 64 nt, hsa; identical to SEQ ID NO: 31437

SEQ ID NO: 704698 - RNA, 64 nt, hsa; identical to SEQ ID NO: 31438

SEQ ID NO: 704699 - RNA, 64 nt, hsa; identical to SEQ ID NO: 31439

SEQ ID NO: 704700 - RNA, 64 nt, hsa; identical to SEQ ID NO: 31440

SEQ ID NO: 704701 - RNA, 64 nt, hsa; identical to SEQ ID NO: 31441

SEQ ID NO: 704702 - RNA, 64 nt, hsa; identical to SEQ ID NO: 31442

SEQ ID NO: 704703 - RNA, 64 nt, hsa; identical to SEQ ID NO: 31443

SEQ ID NO: 704704 - RNA, 64 nt, hsa; identical to SEQ ID NO: 31444

SEQ ID NO: 704705 - RNA, 64 nt, hsa; identical to SEQ ID NO: 31445

SEQ ID NO: 704706 - RNA, 64 nt, hsa; identical to SEQ ID NO: 31446

SEQ ID NO: 704707 - RNA, 64 nt, hsa; identical to SEQ ID NO: 31447

SEQ ID NO: 704708 - RNA, 64 nt, hsa; identical to SEQ ID NO: 31448

SEQ ID NO: 704709 - RNA, 64 nt, hsa; identical to SEQ ID NO: 31449

SEQ ID NO: 704710 - RNA, 64 nt, hsa; identical to SEQ ID NO: 31450

SEQ ID NO: 704711 - RNA, 64 nt, hsa; identical to SEQ ID NO: 31451

SEQ ID NO: 704712 - RNA, 64 nt, hsa; identical to SEQ ID NO: 31452

SEQ ID NO: 704713 - RNA, 64 nt, hsa; identical to SEQ ID NO: 31453

SEQ ID NO: 704714 - RNA, 64 nt, hsa; identical to SEQ ID NO: 31454

SEQ ID NO: 704715 - RNA, 64 nt, hsa; identical to SEQ ID NO: 31455

SEQ ID NO: 704716 - RNA, 64 nt, hsa; identical to SEQ ID NO: 31456

SEQ ID NO: 704717 - RNA, 64 nt, hsa; identical to SEQ ID NO: 31457

SEQ ID NO: 704718 - RNA, 64 nt, hsa; identical to SEQ ID NO: 31458

SEQ ID NO: 704719 - RNA, 64 nt, hsa; identical to SEQ ID NO: 31459

SEQ ID NO: 704720 - RNA, 64 nt, hsa; identical to SEQ ID NO: 31460

SEQ ID NO: 704721 - RNA, 64 nt, hsa; identical to SEQ ID NO: 31461

SEQ ID NO: 704722 - RNA, 64 nt, hsa; identical to SEQ ID NO: 31462

SEQ ID NO: 704723 - RNA, 64 nt, hsa; identical to SEQ ID NO: 31463

SEQ ID NO: 704724 - RNA, 64 nt, hsa; identical to SEQ ID NO: 31464

SEQ ID NO: 704725 - RNA, 64 nt, hsa; identical to SEQ ID NO: 31465

SEQ ID NO: 704726 - RNA, 64 nt, hsa; identical to SEQ ID NO: 31466

SEQ ID NO: 704727 - RNA, 64 nt, hsa; identical to SEQ ID NO: 31467

SEQ ID NO: 704728 - RNA, 64 nt, hsa; identical to SEQ ID NO: 31468

SEQ ID NO: 704729 - RNA, 64 nt, hsa; identical to SEQ ID NO: 31469

SEQ ID NO: 704730 - RNA, 64 nt, hsa; identical to SEQ ID NO: 31470

SEQ ID NO: 704731 - RNA, 64 nt, hsa; identical to SEQ ID NO: 31471

SEQ ID NO: 704732 - RNA, 64 nt, hsa; identical to SEQ ID NO: 31472

SEQ ID NO: 704733 - RNA, 64 nt, hsa; identical to SEQ ID NO: 31473

SEQ ID NO: 704734 - RNA, 64 nt, hsa; identical to SEQ ID NO: 31474

SEQ ID NO: 704735 - RNA, 64 nt, hsa; identical to SEQ ID NO: 31475

SEQ ID NO: 704736 - RNA, 64 nt, hsa; identical to SEQ ID NO: 31476

SEQ ID NO: 704737 - RNA, 64 nt, hsa; identical to SEQ ID NO: 31477

SEQ ID NO: 704738 - RNA, 64 nt, hsa; identical to SEQ ID NO: 31478

SEQ ID NO: 704739 - RNA, 64 nt, hsa; identical to SEQ ID NO: 31479

SEQ ID NO: 704740 - RNA, 64 nt, hsa; identical to SEQ ID NO: 31480

SEQ ID NO: 704741 - RNA, 64 nt, hsa; identical to SEQ ID NO: 31481

SEQ ID NO: 704742 - RNA, 64 nt, hsa; identical to SEQ ID NO: 31482

SEQ ID NO: 704743 - RNA, 64 nt, hsa; identical to SEQ ID NO: 31483

SEQ ID NO: 704744 - RNA, 64 nt, hsa; identical to SEQ ID NO: 31484

SEQ ID NO: 704745 - RNA, 64 nt, hsa; identical to SEQ ID NO: 31485

SEQ ID NO: 704746 - RNA, 64 nt, hsa; identical to SEQ ID NO: 31486

SEQ ID NO: 704747 - RNA, 64 nt, hsa; identical to SEQ ID NO: 31487

SEQ ID NO: 704748 - RNA, 64 nt, hsa; identical to SEQ ID NO: 31488

SEQ ID NO: 704749 - RNA, 64 nt, hsa; identical to SEQ ID NO: 31489

SEQ ID NO: 704750 - RNA, 64 nt, hsa; identical to SEQ ID NO: 31490

SEQ ID NO: 704751 - RNA, 64 nt, hsa; identical to SEQ ID NO: 31491

SEQ ID NO: 704752 - RNA, 64 nt, hsa; identical to SEQ ID NO: 31492

SEQ ID NO: 704753 - RNA, 64 nt, hsa; identical to SEQ ID NO: 31493

SEQ ID NO: 704754 - RNA, 64 nt, hsa; identical to SEQ ID NO: 31494

SEQ ID NO: 704755 - RNA, 64 nt, hsa; identical to SEQ ID NO: 31495

SEQ ID NO: 704756 - RNA, 64 nt, hsa; identical to SEQ ID NO: 31496

SEQ ID NO: 704757 - RNA, 64 nt, hsa; identical to SEQ ID NO: 31497

SEQ ID NO: 704758 - RNA, 64 nt, hsa; identical to SEQ ID NO: 31498

SEQ ID NO: 704759 - RNA, 64 nt, hsa; identical to SEQ ID NO: 31499

SEQ ID NO: 704760 - RNA, 64 nt, hsa; identical to SEQ ID NO: 31500

SEQ ID NO: 704761 - RNA, 64 nt, hsa; identical to SEQ ID NO: 31501

SEQ ID NO: 704762 - RNA, 64 nt, hsa; identical to SEQ ID NO: 31502

SEQ ID NO: 704763 - RNA, 64 nt, hsa; identical to SEQ ID NO: 31503

SEQ ID NO: 704764 - RNA, 64 nt, hsa; identical to SEQ ID NO: 31504

SEQ ID NO: 704765 - RNA, 64 nt, hsa; identical to SEQ ID NO: 31505

SEQ ID NO: 704766 - RNA, 64 nt, hsa; identical to SEQ ID NO: 31506

SEQ ID NO: 704767 - RNA, 64 nt, hsa; identical to SEQ ID NO: 31507

SEQ ID NO: 704768 - RNA, 64 nt, hsa; identical to SEQ ID NO: 31508

SEQ ID NO: 704769 - RNA, 64 nt, hsa; identical to SEQ ID NO: 31509

SEQ ID NO: 704770 - RNA, 64 nt, hsa; identical to SEQ ID NO: 31510

SEQ ID NO: 704771 - RNA, 64 nt, hsa; identical to SEQ ID NO: 31511

SEQ ID NO: 704772 - RNA, 64 nt, hsa; identical to SEQ ID NO: 31512

SEQ ID NO: 704773 - RNA, 64 nt, hsa; identical to SEQ ID NO: 31513

SEQ ID NO: 704774 - RNA, 64 nt, hsa; identical to SEQ ID NO: 31514

SEQ ID NO: 704775 - RNA, 64 nt, hsa; identical to SEQ ID NO: 31515

SEQ ID NO: 704776 - RNA, 64 nt, hsa; identical to SEQ ID NO: 31516

SEQ ID NO: 704777 - RNA, 64 nt, hsa; identical to SEQ ID NO: 31517

SEQ ID NO: 704778 - RNA, 64 nt, hsa; identical to SEQ ID NO: 31518

SEQ ID NO: 704779 - RNA, 64 nt, hsa; identical to SEQ ID NO: 31519

SEQ ID NO: 704780 - RNA, 64 nt, hsa; identical to SEQ ID NO: 31520

SEQ ID NO: 704781 - RNA, 64 nt, hsa; identical to SEQ ID NO: 31521

SEQ ID NO: 704782 - RNA, 64 nt, hsa; identical to SEQ ID NO: 31522

SEQ ID NO: 704783 - RNA, 64 nt, hsa; identical to SEQ ID NO: 31523

SEQ ID NO: 704784 - RNA, 64 nt, hsa; identical to SEQ ID NO: 31524

SEQ ID NO: 704785 - RNA, 64 nt, hsa; identical to SEQ ID NO: 31525

SEQ ID NO: 704786 - RNA, 64 nt, hsa; identical to SEQ ID NO: 31526

SEQ ID NO: 704787 - RNA, 64 nt, hsa; identical to SEQ ID NO: 31527

SEQ ID NO: 704788 - RNA, 64 nt, hsa; identical to SEQ ID NO: 31528

SEQ ID NO: 704789 - RNA, 64 nt, hsa; identical to SEQ ID NO: 31529

SEQ ID NO: 704790 - RNA, 64 nt, hsa; identical to SEQ ID NO: 31530

SEQ ID NO: 704791 - RNA, 64 nt, hsa; identical to SEQ ID NO: 31531

SEQ ID NO: 704792 - RNA, 64 nt, hsa; identical to SEQ ID NO: 31532

SEQ ID NO: 704793 - RNA, 64 nt, hsa; identical to SEQ ID NO: 31533

SEQ ID NO: 704794 - RNA, 64 nt, hsa; identical to SEQ ID NO: 31534

SEQ ID NO: 704795 - RNA, 64 nt, hsa; identical to SEQ ID NO: 31535

SEQ ID NO: 704796 - RNA, 64 nt, hsa; identical to SEQ ID NO: 31536

SEQ ID NO: 704797 - RNA, 64 nt, hsa; identical to SEQ ID NO: 31537

SEQ ID NO: 704798 - RNA, 64 nt, hsa; identical to SEQ ID NO: 31538

SEQ ID NO: 704799 - RNA, 64 nt, hsa; identical to SEQ ID NO: 31539

SEQ ID NO: 704800 - RNA, 64 nt, hsa; identical to SEQ ID NO: 31540

SEQ ID NO: 704801 - RNA, 64 nt, hsa; identical to SEQ ID NO: 31541

SEQ ID NO: 704802 - RNA, 64 nt, hsa; identical to SEQ ID NO: 31542

SEQ ID NO: 704803 - RNA, 64 nt, hsa; identical to SEQ ID NO: 31543

SEQ ID NO: 704804 - RNA, 64 nt, hsa; identical to SEQ ID NO: 31544

SEQ ID NO: 704805 - RNA, 64 nt, hsa; identical to SEQ ID NO: 31545

SEQ ID NO: 704806 - RNA, 64 nt, hsa; identical to SEQ ID NO: 31546

SEQ ID NO: 704807 - RNA, 64 nt, hsa; identical to SEQ ID NO: 31547

SEQ ID NO: 704808 - RNA, 64 nt, hsa; identical to SEQ ID NO: 31548

SEQ ID NO: 704809 - RNA, 64 nt, hsa; identical to SEQ ID NO: 31549

SEQ ID NO: 704810 - RNA, 64 nt, hsa; identical to SEQ ID NO: 31550

SEQ ID NO: 704811 - RNA, 64 nt, hsa; identical to SEQ ID NO: 31551

SEQ ID NO: 704812 - RNA, 64 nt, hsa; identical to SEQ ID NO: 31552

SEQ ID NO: 704813 - RNA, 64 nt, hsa; identical to SEQ ID NO: 31553

SEQ ID NO: 704814 - RNA, 64 nt, hsa; identical to SEQ ID NO: 31554

SEQ ID NO: 704815 - RNA, 64 nt, hsa; identical to SEQ ID NO: 31555

SEQ ID NO: 704816 - RNA, 64 nt, hsa; identical to SEQ ID NO: 31556

SEQ ID NO: 704817 - RNA, 50 nt, hsa; identical to SEQ ID NO: 31557

SEQ ID NO: 704818 - RNA, 51 nt, hsa; identical to SEQ ID NO: 31558

SEQ ID NO: 704819 - RNA, 64 nt, hsa; identical to SEQ ID NO: 31559

SEQ ID NO: 704820 - RNA, 64 nt, hsa; identical to SEQ ID NO: 31560

SEQ ID NO: 704821 - RNA, 64 nt, hsa; identical to SEQ ID NO: 31561

SEQ ID NO: 704822 - RNA, 64 nt, hsa; identical to SEQ ID NO: 31562

SEQ ID NO: 704823 - RNA, 64 nt, hsa; identical to SEQ ID NO: 31563

SEQ ID NO: 704824 - RNA, 64 nt, hsa; identical to SEQ ID NO: 31564

SEQ ID NO: 704825 - RNA, 64 nt, hsa; identical to SEQ ID NO: 31565

SEQ ID NO: 704826 - RNA, 64 nt, hsa; identical to SEQ ID NO: 31566

SEQ ID NO: 704827 - RNA, 64 nt, hsa; identical to SEQ ID NO: 31567

SEQ ID NO: 704828 - RNA, 64 nt, hsa; identical to SEQ ID NO: 31568

SEQ ID NO: 704829 - RNA, 64 nt, hsa; identical to SEQ ID NO: 31569

SEQ ID NO: 704830 - RNA, 64 nt, hsa; identical to SEQ ID NO: 31570

SEQ ID NO: 704831 - RNA, 64 nt, hsa; identical to SEQ ID NO: 31571

SEQ ID NO: 704832 - RNA, 64 nt, hsa; identical to SEQ ID NO: 31572

SEQ ID NO: 704833 - RNA, 64 nt, hsa; identical to SEQ ID NO: 31573

SEQ ID NO: 704834 - RNA, 64 nt, hsa; identical to SEQ ID NO: 31574

SEQ ID NO: 704835 - RNA, 64 nt, hsa; identical to SEQ ID NO: 31575

SEQ ID NO: 704836 - RNA, 64 nt, hsa; identical to SEQ ID NO: 31576

SEQ ID NO: 704837 - RNA, 64 nt, hsa; identical to SEQ ID NO: 31577

SEQ ID NO: 704838 - RNA, 64 nt, hsa; identical to SEQ ID NO: 31578

SEQ ID NO: 704839 - RNA, 64 nt, hsa; identical to SEQ ID NO: 31579

SEQ ID NO: 704840 - RNA, 64 nt, hsa; identical to SEQ ID NO: 31580

SEQ ID NO: 704841 - RNA, 64 nt, hsa; identical to SEQ ID NO: 31581

SEQ ID NO: 704842 - RNA, 64 nt, hsa; identical to SEQ ID NO: 31582

SEQ ID NO: 704843 - RNA, 64 nt, hsa; identical to SEQ ID NO: 31583

SEQ ID NO: 704844 - RNA, 64 nt, hsa; identical to SEQ ID NO: 31584

SEQ ID NO: 704845 - RNA, 64 nt, hsa; identical to SEQ ID NO: 31585

SEQ ID NO: 704846 - RNA, 64 nt, hsa; identical to SEQ ID NO: 31586

SEQ ID NO: 704847 - RNA, 64 nt, hsa; identical to SEQ ID NO: 31587

SEQ ID NO: 704848 - RNA, 64 nt, hsa; identical to SEQ ID NO: 31588

SEQ ID NO: 704849 - RNA, 64 nt, hsa; identical to SEQ ID NO: 31589

SEQ ID NO: 704850 - RNA, 64 nt, hsa; identical to SEQ ID NO: 31590

SEQ ID NO: 704851 - RNA, 64 nt, hsa; identical to SEQ ID NO: 31591

SEQ ID NO: 704852 - RNA, 64 nt, hsa; identical to SEQ ID NO: 31592

SEQ ID NO: 704853 - RNA, 64 nt, hsa; identical to SEQ ID NO: 31593

SEQ ID NO: 704854 - RNA, 64 nt, hsa; identical to SEQ ID NO: 31594

SEQ ID NO: 704855 - RNA, 64 nt, hsa; identical to SEQ ID NO: 31595

SEQ ID NO: 704856 - RNA, 64 nt, hsa; identical to SEQ ID NO: 31596

SEQ ID NO: 704857 - RNA, 64 nt, hsa; identical to SEQ ID NO: 31597

SEQ ID NO: 704858 - RNA, 64 nt, hsa; identical to SEQ ID NO: 31598

SEQ ID NO: 704859 - RNA, 64 nt, hsa; identical to SEQ ID NO: 31599

SEQ ID NO: 704860 - RNA, 64 nt, hsa; identical to SEQ ID NO: 31600

SEQ ID NO: 704861 - RNA, 64 nt, hsa; identical to SEQ ID NO: 31601

SEQ ID NO: 704862 - RNA, 64 nt, hsa; identical to SEQ ID NO: 31602

SEQ ID NO: 704863 - RNA, 64 nt, hsa; identical to SEQ ID NO: 31603

SEQ ID NO: 704864 - RNA, 64 nt, hsa; identical to SEQ ID NO: 31604

SEQ ID NO: 704865 - RNA, 64 nt, hsa; identical to SEQ ID NO: 31605

SEQ ID NO: 704866 - RNA, 64 nt, hsa; identical to SEQ ID NO: 31606

SEQ ID NO: 704867 - RNA, 64 nt, hsa; identical to SEQ ID NO: 31607

SEQ ID NO: 704868 - RNA, 64 nt, hsa; identical to SEQ ID NO: 31608

SEQ ID NO: 704869 - RNA, 64 nt, hsa; identical to SEQ ID NO: 31609

SEQ ID NO: 704870 - RNA, 64 nt, hsa; identical to SEQ ID NO: 31610

SEQ ID NO: 704871 - RNA, 64 nt, hsa; identical to SEQ ID NO: 31611

SEQ ID NO: 704872 - RNA, 64 nt, hsa; identical to SEQ ID NO: 31612

SEQ ID NO: 704873 - RNA, 64 nt, hsa; identical to SEQ ID NO: 31613

SEQ ID NO: 704874 - RNA, 64 nt, hsa; identical to SEQ ID NO: 31614

SEQ ID NO: 704875 - RNA, 64 nt, hsa; identical to SEQ ID NO: 31615

SEQ ID NO: 704876 - RNA, 64 nt, hsa; identical to SEQ ID NO: 31616

SEQ ID NO: 704877 - RNA, 64 nt, hsa; identical to SEQ ID NO: 31617

SEQ ID NO: 704878 - RNA, 64 nt, hsa; identical to SEQ ID NO: 31618

SEQ ID NO: 704879 - RNA, 64 nt, hsa; identical to SEQ ID NO: 31619

SEQ ID NO: 704880 - RNA, 64 nt, hsa; identical to SEQ ID NO: 31620

SEQ ID NO: 704881 - RNA, 64 nt, hsa; identical to SEQ ID NO: 31621

SEQ ID NO: 704882 - RNA, 55 nt, hsa; identical to SEQ ID NO: 31622

SEQ ID NO: 704883 - RNA, 54 nt, hsa; identical to SEQ ID NO: 31623

SEQ ID NO: 704884 - RNA, 64 nt, hsa; identical to SEQ ID NO: 31624

SEQ ID NO: 704885 - RNA, 64 nt, hsa; identical to SEQ ID NO: 31625

SEQ ID NO: 704886 - RNA, 64 nt, hsa; identical to SEQ ID NO: 31626

SEQ ID NO: 704887 - RNA, 64 nt, hsa; identical to SEQ ID NO: 31627

SEQ ID NO: 704888 - RNA, 64 nt, hsa; identical to SEQ ID NO: 31628

SEQ ID NO: 704889 - RNA, 64 nt, hsa; identical to SEQ ID NO: 31629

SEQ ID NO: 704890 - RNA, 64 nt, hsa; identical to SEQ ID NO: 31630

SEQ ID NO: 704891 - RNA, 64 nt, hsa; identical to SEQ ID NO: 31631

SEQ ID NO: 704892 - RNA, 64 nt, hsa; identical to SEQ ID NO: 31632

SEQ ID NO: 704893 - RNA, 64 nt, hsa; identical to SEQ ID NO: 31633

SEQ ID NO: 704894 - RNA, 64 nt, hsa; identical to SEQ ID NO: 31634

SEQ ID NO: 704895 - RNA, 64 nt, hsa; identical to SEQ ID NO: 31635

SEQ ID NO: 704896 - RNA, 64 nt, hsa; identical to SEQ ID NO: 31636

SEQ ID NO: 704897 - RNA, 64 nt, hsa; identical to SEQ ID NO: 31637

SEQ ID NO: 704898 - RNA, 64 nt, hsa; identical to SEQ ID NO: 31638

SEQ ID NO: 704899 - RNA, 64 nt, hsa; identical to SEQ ID NO: 31639

SEQ ID NO: 704900 - RNA, 64 nt, hsa; identical to SEQ ID NO: 31640

SEQ ID NO: 704901 - RNA, 64 nt, hsa; identical to SEQ ID NO: 31641

SEQ ID NO: 704902 - RNA, 64 nt, hsa; identical to SEQ ID NO: 31642

SEQ ID NO: 704903 - RNA, 64 nt, hsa; identical to SEQ ID NO: 31643

SEQ ID NO: 704904 - RNA, 64 nt, hsa; identical to SEQ ID NO: 31644

SEQ ID NO: 704905 - RNA, 64 nt, hsa; identical to SEQ ID NO: 31645

SEQ ID NO: 704906 - RNA, 64 nt, hsa; identical to SEQ ID NO: 31646

SEQ ID NO: 704907 - RNA, 64 nt, hsa; identical to SEQ ID NO: 31647

SEQ ID NO: 704908 - RNA, 64 nt, hsa; identical to SEQ ID NO: 31648

SEQ ID NO: 704909 - RNA, 64 nt, hsa; identical to SEQ ID NO: 31649

SEQ ID NO: 704910 - RNA, 64 nt, hsa; identical to SEQ ID NO: 31650

SEQ ID NO: 704911 - RNA, 64 nt, hsa; identical to SEQ ID NO: 31651

SEQ ID NO: 704912 - RNA, 64 nt, hsa; identical to SEQ ID NO: 31652

SEQ ID NO: 704913 - RNA, 64 nt, hsa; identical to SEQ ID NO: 31653

SEQ ID NO: 704914 - RNA, 64 nt, hsa; identical to SEQ ID NO: 31654

SEQ ID NO: 704915 - RNA, 64 nt, hsa; identical to SEQ ID NO: 31655

SEQ ID NO: 704916 - RNA, 64 nt, hsa; identical to SEQ ID NO: 31656

SEQ ID NO: 704917 - RNA, 64 nt, hsa; identical to SEQ ID NO: 31657

SEQ ID NO: 704918 - RNA, 64 nt, hsa; identical to SEQ ID NO: 31658

SEQ ID NO: 704919 - RNA, 64 nt, hsa; identical to SEQ ID NO: 31659

SEQ ID NO: 704920 - RNA, 64 nt, hsa; identical to SEQ ID NO: 31660

SEQ ID NO: 704921 - RNA, 64 nt, hsa; identical to SEQ ID NO: 31661

SEQ ID NO: 704922 - RNA, 64 nt, hsa; identical to SEQ ID NO: 31662

SEQ ID NO: 704923 - RNA, 64 nt, hsa; identical to SEQ ID NO: 31663

SEQ ID NO: 704924 - RNA, 64 nt, hsa; identical to SEQ ID NO: 31664

SEQ ID NO: 704925 - RNA, 64 nt, hsa; identical to SEQ ID NO: 31665

SEQ ID NO: 704926 - RNA, 64 nt, hsa; identical to SEQ ID NO: 31666

SEQ ID NO: 704927 - RNA, 64 nt, hsa; identical to SEQ ID NO: 31667

SEQ ID NO: 704928 - RNA, 64 nt, hsa; identical to SEQ ID NO: 31668

SEQ ID NO: 704929 - RNA, 64 nt, hsa; identical to SEQ ID NO: 31669

SEQ ID NO: 704930 - RNA, 64 nt, hsa; identical to SEQ ID NO: 31670

SEQ ID NO: 704931 - RNA, 64 nt, hsa; identical to SEQ ID NO: 31671

SEQ ID NO: 704932 - RNA, 64 nt, hsa; identical to SEQ ID NO: 31672

SEQ ID NO: 704933 - RNA, 64 nt, hsa; identical to SEQ ID NO: 31673

SEQ ID NO: 704934 - RNA, 60 nt, hsa; identical to SEQ ID NO: 31674

SEQ ID NO: 704935 - RNA, 64 nt, hsa; identical to SEQ ID NO: 31675

SEQ ID NO: 704936 - RNA, 64 nt, hsa; identical to SEQ ID NO: 31676

SEQ ID NO: 704937 - RNA, 64 nt, hsa; identical to SEQ ID NO: 31677

SEQ ID NO: 704938 - RNA, 64 nt, hsa; identical to SEQ ID NO: 31678

SEQ ID NO: 704939 - RNA, 64 nt, hsa; identical to SEQ ID NO: 31679

SEQ ID NO: 704940 - RNA, 64 nt, hsa; identical to SEQ ID NO: 31680

SEQ ID NO: 704941 - RNA, 64 nt, hsa; identical to SEQ ID NO: 31681

SEQ ID NO: 704942 - RNA, 64 nt, hsa; identical to SEQ ID NO: 31682

SEQ ID NO: 704943 - RNA, 64 nt, hsa; identical to SEQ ID NO: 31683

SEQ ID NO: 704944 - RNA, 64 nt, hsa; identical to SEQ ID NO: 31684

SEQ ID NO: 704945 - RNA, 64 nt, hsa; identical to SEQ ID NO: 31685

SEQ ID NO: 704946 - RNA, 64 nt, hsa; identical to SEQ ID NO: 31686

SEQ ID NO: 704947 - RNA, 64 nt, hsa; identical to SEQ ID NO: 31687

SEQ ID NO: 704948 - RNA, 64 nt, hsa; identical to SEQ ID NO: 31688

SEQ ID NO: 704949 - RNA, 64 nt, hsa; identical to SEQ ID NO: 31689

SEQ ID NO: 704950 - RNA, 64 nt, hsa; identical to SEQ ID NO: 31690

SEQ ID NO: 704951 - RNA, 64 nt, hsa; identical to SEQ ID NO: 31691

SEQ ID NO: 704952 - RNA, 64 nt, hsa; identical to SEQ ID NO: 31692

SEQ ID NO: 704953 - RNA, 64 nt, hsa; identical to SEQ ID NO: 31693

SEQ ID NO: 704954 - RNA, 64 nt, hsa; identical to SEQ ID NO: 31694

SEQ ID NO: 704955 - RNA, 64 nt, hsa; identical to SEQ ID NO: 31695

SEQ ID NO: 704956 - RNA, 64 nt, hsa; identical to SEQ ID NO: 31696

SEQ ID NO: 704957 - RNA, 64 nt, hsa; identical to SEQ ID NO: 31697

SEQ ID NO: 704958 - RNA, 64 nt, hsa; identical to SEQ ID NO: 31698

SEQ ID NO: 704959 - RNA, 64 nt, hsa; identical to SEQ ID NO: 31699

SEQ ID NO: 704960 - RNA, 64 nt, hsa; identical to SEQ ID NO: 31700

SEQ ID NO: 704961 - RNA, 64 nt, hsa; identical to SEQ ID NO: 31701

SEQ ID NO: 704962 - RNA, 64 nt, hsa; identical to SEQ ID NO: 31702

SEQ ID NO: 704963 - RNA, 64 nt, hsa; identical to SEQ ID NO: 31703

SEQ ID NO: 704964 - RNA, 64 nt, hsa; identical to SEQ ID NO: 31704

SEQ ID NO: 704965 - RNA, 64 nt, hsa; identical to SEQ ID NO: 31705

SEQ ID NO: 704966 - RNA, 64 nt, hsa; identical to SEQ ID NO: 31706

SEQ ID NO: 704967 - RNA, 64 nt, hsa; identical to SEQ ID NO: 31707

SEQ ID NO: 704968 - RNA, 64 nt, hsa; identical to SEQ ID NO: 31708

SEQ ID NO: 704969 - RNA, 64 nt, hsa; identical to SEQ ID NO: 31709

SEQ ID NO: 704970 - RNA, 64 nt, hsa; identical to SEQ ID NO: 31710

SEQ ID NO: 704971 - RNA, 64 nt, hsa; identical to SEQ ID NO: 31711

SEQ ID NO: 704972 - RNA, 64 nt, hsa; identical to SEQ ID NO: 31712

SEQ ID NO: 704973 - RNA, 64 nt, hsa; identical to SEQ ID NO: 31713

SEQ ID NO: 704974 - RNA, 64 nt, hsa; identical to SEQ ID NO: 31714

SEQ ID NO: 704975 - RNA, 64 nt, hsa; identical to SEQ ID NO: 31715

SEQ ID NO: 704976 - RNA, 64 nt, hsa; identical to SEQ ID NO: 31716

SEQ ID NO: 704977 - RNA, 64 nt, hsa; identical to SEQ ID NO: 31717

SEQ ID NO: 704978 - RNA, 64 nt, hsa; identical to SEQ ID NO: 31718

SEQ ID NO: 704979 - RNA, 64 nt, hsa; identical to SEQ ID NO: 31719

SEQ ID NO: 704980 - RNA, 64 nt, hsa; identical to SEQ ID NO: 31720

SEQ ID NO: 704981 - RNA, 64 nt, hsa; identical to SEQ ID NO: 31721

SEQ ID NO: 704982 - RNA, 64 nt, hsa; identical to SEQ ID NO: 31722

SEQ ID NO: 704983 - RNA, 64 nt, hsa; identical to SEQ ID NO: 31723

SEQ ID NO: 704984 - RNA, 64 nt, hsa; identical to SEQ ID NO: 31724

SEQ ID NO: 704985 - RNA, 64 nt, hsa; identical to SEQ ID NO: 31725

SEQ ID NO: 704986 - RNA, 64 nt, hsa; identical to SEQ ID NO: 31726

SEQ ID NO: 704987 - RNA, 64 nt, hsa; identical to SEQ ID NO: 31727

SEQ ID NO: 704988 - RNA, 64 nt, hsa; identical to SEQ ID NO: 31728

SEQ ID NO: 704989 - RNA, 64 nt, hsa; identical to SEQ ID NO: 31729

SEQ ID NO: 704990 - RNA, 64 nt, hsa; identical to SEQ ID NO: 31730

SEQ ID NO: 704991 - RNA, 64 nt, hsa; identical to SEQ ID NO: 31731

SEQ ID NO: 704992 - RNA, 64 nt, hsa; identical to SEQ ID NO: 31732

SEQ ID NO: 704993 - RNA, 64 nt, hsa; identical to SEQ ID NO: 31733

SEQ ID NO: 704994 - RNA, 64 nt, hsa; identical to SEQ ID NO: 31734

SEQ ID NO: 704995 - RNA, 64 nt, hsa; identical to SEQ ID NO: 31735

SEQ ID NO: 704996 - RNA, 64 nt, hsa; identical to SEQ ID NO: 31736

SEQ ID NO: 704997 - RNA, 64 nt, hsa; identical to SEQ ID NO: 31737

SEQ ID NO: 704998 - RNA, 64 nt, hsa; identical to SEQ ID NO: 31738

SEQ ID NO: 704999 - RNA, 64 nt, hsa; identical to SEQ ID NO: 31739

SEQ ID NO: 705000 - RNA, 64 nt, hsa; identical to SEQ ID NO: 31740

SEQ ID NO: 705001 - RNA, 64 nt, hsa; identical to SEQ ID NO: 31741

SEQ ID NO: 705002 - RNA, 64 nt, hsa; identical to SEQ ID NO: 31742

SEQ ID NO: 705003 - RNA, 64 nt, hsa; identical to SEQ ID NO: 31743

SEQ ID NO: 705004 - RNA, 64 nt, hsa; identical to SEQ ID NO: 31744

SEQ ID NO: 705005 - RNA, 64 nt, hsa; identical to SEQ ID NO: 31745

SEQ ID NO: 705006 - RNA, 64 nt, hsa; identical to SEQ ID NO: 31746

SEQ ID NO: 705007 - RNA, 64 nt, hsa; identical to SEQ ID NO: 31747

SEQ ID NO: 705008 - RNA, 64 nt, hsa; identical to SEQ ID NO: 31748

SEQ ID NO: 705009 - RNA, 64 nt, hsa; identical to SEQ ID NO: 31749

SEQ ID NO: 705010 - RNA, 64 nt, hsa; identical to SEQ ID NO: 31750

SEQ ID NO: 705011 - RNA, 64 nt, hsa; identical to SEQ ID NO: 31751

SEQ ID NO: 705012 - RNA, 64 nt, hsa; identical to SEQ ID NO: 31752

SEQ ID NO: 705013 - RNA, 64 nt, hsa; identical to SEQ ID NO: 31753

SEQ ID NO: 705014 - RNA, 64 nt, hsa; identical to SEQ ID NO: 31754

SEQ ID NO: 705015 - RNA, 64 nt, hsa; identical to SEQ ID NO: 31755

SEQ ID NO: 705016 - RNA, 64 nt, hsa; identical to SEQ ID NO: 31756

SEQ ID NO: 705017 - RNA, 64 nt, hsa; identical to SEQ ID NO: 31757

SEQ ID NO: 705018 - RNA, 64 nt, hsa; identical to SEQ ID NO: 31758

SEQ ID NO: 705019 - RNA, 64 nt, hsa; identical to SEQ ID NO: 31759

SEQ ID NO: 705020 - RNA, 64 nt, hsa; identical to SEQ ID NO: 31760

SEQ ID NO: 705021 - RNA, 64 nt, hsa; identical to SEQ ID NO: 31761

SEQ ID NO: 705022 - RNA, 64 nt, hsa; identical to SEQ ID NO: 31762

SEQ ID NO: 705023 - RNA, 64 nt, hsa; identical to SEQ ID NO: 31763

SEQ ID NO: 705024 - RNA, 64 nt, hsa; identical to SEQ ID NO: 31764

SEQ ID NO: 705025 - RNA, 64 nt, hsa; identical to SEQ ID NO: 31765

SEQ ID NO: 705026 - RNA, 64 nt, hsa; identical to SEQ ID NO: 31766

SEQ ID NO: 705027 - RNA, 64 nt, hsa; identical to SEQ ID NO: 31767

SEQ ID NO: 705028 - RNA, 64 nt, hsa; identical to SEQ ID NO: 31768

SEQ ID NO: 705029 - RNA, 64 nt, hsa; identical to SEQ ID NO: 31769

SEQ ID NO: 705030 - RNA, 64 nt, hsa; identical to SEQ ID NO: 31770

SEQ ID NO: 705031 - RNA, 64 nt, hsa; identical to SEQ ID NO: 31771

SEQ ID NO: 705032 - RNA, 64 nt, hsa; identical to SEQ ID NO: 31772

SEQ ID NO: 705033 - RNA, 64 nt, hsa; identical to SEQ ID NO: 31773

SEQ ID NO: 705034 - RNA, 64 nt, hsa; identical to SEQ ID NO: 31774

SEQ ID NO: 705035 - RNA, 64 nt, hsa; identical to SEQ ID NO: 31775

SEQ ID NO: 705036 - RNA, 64 nt, hsa; identical to SEQ ID NO: 31776

SEQ ID NO: 705037 - RNA, 64 nt, hsa; identical to SEQ ID NO: 31777

SEQ ID NO: 705038 - RNA, 64 nt, hsa; identical to SEQ ID NO: 31778

SEQ ID NO: 705039 - RNA, 64 nt, hsa; identical to SEQ ID NO: 31779

SEQ ID NO: 705040 - RNA, 64 nt, hsa; identical to SEQ ID NO: 31780

SEQ ID NO: 705041 - RNA, 64 nt, hsa; identical to SEQ ID NO: 31781

SEQ ID NO: 705042 - RNA, 64 nt, hsa; identical to SEQ ID NO: 31782

SEQ ID NO: 705043 - RNA, 64 nt, hsa; identical to SEQ ID NO: 31783

SEQ ID NO: 705044 - RNA, 64 nt, hsa; identical to SEQ ID NO: 31784

SEQ ID NO: 705045 - RNA, 64 nt, hsa; identical to SEQ ID NO: 31785

SEQ ID NO: 705046 - RNA, 64 nt, hsa; identical to SEQ ID NO: 31786

SEQ ID NO: 705047 - RNA, 64 nt, hsa; identical to SEQ ID NO: 31787

SEQ ID NO: 705048 - RNA, 64 nt, hsa; identical to SEQ ID NO: 31788

SEQ ID NO: 705049 - RNA, 64 nt, hsa; identical to SEQ ID NO: 31789

SEQ ID NO: 705050 - RNA, 64 nt, hsa; identical to SEQ ID NO: 31790

SEQ ID NO: 705051 - RNA, 64 nt, hsa; identical to SEQ ID NO: 31791

SEQ ID NO: 705052 - RNA, 64 nt, hsa; identical to SEQ ID NO: 31792

SEQ ID NO: 705053 - RNA, 64 nt, hsa; identical to SEQ ID NO: 31793

SEQ ID NO: 705054 - RNA, 64 nt, hsa; identical to SEQ ID NO: 31794

SEQ ID NO: 705055 - RNA, 64 nt, hsa; identical to SEQ ID NO: 31795

SEQ ID NO: 705056 - RNA, 64 nt, hsa; identical to SEQ ID NO: 31796

SEQ ID NO: 705057 - RNA, 64 nt, hsa; identical to SEQ ID NO: 31797

SEQ ID NO: 705058 - RNA, 64 nt, hsa; identical to SEQ ID NO: 31798

SEQ ID NO: 705059 - RNA, 64 nt, hsa; identical to SEQ ID NO: 31799

SEQ ID NO: 705060 - RNA, 64 nt, hsa; identical to SEQ ID NO: 31800

SEQ ID NO: 705061 - RNA, 64 nt, hsa; identical to SEQ ID NO: 31801

SEQ ID NO: 705062 - RNA, 64 nt, hsa; identical to SEQ ID NO: 31802

SEQ ID NO: 705063 - RNA, 64 nt, hsa; identical to SEQ ID NO: 31803

SEQ ID NO: 705064 - RNA, 64 nt, hsa; identical to SEQ ID NO: 31804

SEQ ID NO: 705065 - RNA, 64 nt, hsa; identical to SEQ ID NO: 31805

SEQ ID NO: 705066 - RNA, 64 nt, hsa; identical to SEQ ID NO: 31806

SEQ ID NO: 705067 - RNA, 64 nt, hsa; identical to SEQ ID NO: 31807

SEQ ID NO: 705068 - RNA, 64 nt, hsa; identical to SEQ ID NO: 31808

SEQ ID NO: 705069 - RNA, 64 nt, hsa; identical to SEQ ID NO: 31809

SEQ ID NO: 705070 - RNA, 64 nt, hsa; identical to SEQ ID NO: 31810

SEQ ID NO: 705071 - RNA, 64 nt, hsa; identical to SEQ ID NO: 31811

SEQ ID NO: 705072 - RNA, 64 nt, hsa; identical to SEQ ID NO: 31812

SEQ ID NO: 705073 - RNA, 64 nt, hsa; identical to SEQ ID NO: 31813

SEQ ID NO: 705074 - RNA, 64 nt, hsa; identical to SEQ ID NO: 31814

SEQ ID NO: 705075 - RNA, 64 nt, hsa; identical to SEQ ID NO: 31815

SEQ ID NO: 705076 - RNA, 64 nt, hsa; identical to SEQ ID NO: 31816

SEQ ID NO: 705077 - RNA, 64 nt, hsa; identical to SEQ ID NO: 31817

SEQ ID NO: 705078 - RNA, 64 nt, hsa; identical to SEQ ID NO: 31818

SEQ ID NO: 705079 - RNA, 64 nt, hsa; identical to SEQ ID NO: 31819

SEQ ID NO: 705080 - RNA, 64 nt, hsa; identical to SEQ ID NO: 31820

SEQ ID NO: 705081 - RNA, 64 nt, hsa; identical to SEQ ID NO: 31821

SEQ ID NO: 705082 - RNA, 64 nt, hsa; identical to SEQ ID NO: 31822

SEQ ID NO: 705083 - RNA, 64 nt, hsa; identical to SEQ ID NO: 31823

SEQ ID NO: 705084 - RNA, 64 nt, hsa; identical to SEQ ID NO: 31824

SEQ ID NO: 705085 - RNA, 64 nt, hsa; identical to SEQ ID NO: 31825

SEQ ID NO: 705086 - RNA, 64 nt, hsa; identical to SEQ ID NO: 31826

SEQ ID NO: 705087 - RNA, 64 nt, hsa; identical to SEQ ID NO: 31827

SEQ ID NO: 705088 - RNA, 64 nt, hsa; identical to SEQ ID NO: 31828

SEQ ID NO: 705089 - RNA, 64 nt, hsa; identical to SEQ ID NO: 31829

SEQ ID NO: 705090 - RNA, 64 nt, hsa; identical to SEQ ID NO: 31830

SEQ ID NO: 705091 - RNA, 64 nt, hsa; identical to SEQ ID NO: 31831

SEQ ID NO: 705092 - RNA, 64 nt, hsa; identical to SEQ ID NO: 31832

SEQ ID NO: 705093 - RNA, 64 nt, hsa; identical to SEQ ID NO: 31833

SEQ ID NO: 705094 - RNA, 64 nt, hsa; identical to SEQ ID NO: 31834

SEQ ID NO: 705095 - RNA, 64 nt, hsa; identical to SEQ ID NO: 31835

SEQ ID NO: 705096 - RNA, 64 nt, hsa; identical to SEQ ID NO: 31836

SEQ ID NO: 705097 - RNA, 64 nt, hsa; identical to SEQ ID NO: 31837

SEQ ID NO: 705098 - RNA, 64 nt, hsa; identical to SEQ ID NO: 31838

SEQ ID NO: 705099 - RNA, 64 nt, hsa; identical to SEQ ID NO: 31839

SEQ ID NO: 705100 - RNA, 64 nt, hsa; identical to SEQ ID NO: 31840

SEQ ID NO: 705101 - RNA, 64 nt, hsa; identical to SEQ ID NO: 31841

SEQ ID NO: 705102 - RNA, 64 nt, hsa; identical to SEQ ID NO: 31842

SEQ ID NO: 705103 - RNA, 64 nt, hsa; identical to SEQ ID NO: 31843

SEQ ID NO: 705104 - RNA, 64 nt, hsa; identical to SEQ ID NO: 31844

SEQ ID NO: 705105 - RNA, 64 nt, hsa; identical to SEQ ID NO: 31845

SEQ ID NO: 705106 - RNA, 64 nt, hsa; identical to SEQ ID NO: 31846

SEQ ID NO: 705107 - RNA, 64 nt, hsa; identical to SEQ ID NO: 31847

SEQ ID NO: 705108 - RNA, 64 nt, hsa; identical to SEQ ID NO: 31848

SEQ ID NO: 705109 - RNA, 64 nt, hsa; identical to SEQ ID NO: 31849

SEQ ID NO: 705110 - RNA, 64 nt, hsa; identical to SEQ ID NO: 31850

SEQ ID NO: 705111 - RNA, 64 nt, hsa; identical to SEQ ID NO: 31851

SEQ ID NO: 705112 - RNA, 64 nt, hsa; identical to SEQ ID NO: 31852

SEQ ID NO: 705113 - RNA, 64 nt, hsa; identical to SEQ ID NO: 31853

SEQ ID NO: 705114 - RNA, 64 nt, hsa; identical to SEQ ID NO: 31854

SEQ ID NO: 705115 - RNA, 64 nt, hsa; identical to SEQ ID NO: 31855

SEQ ID NO: 705116 - RNA, 64 nt, hsa; identical to SEQ ID NO: 31856

SEQ ID NO: 705117 - RNA, 64 nt, hsa; identical to SEQ ID NO: 31857

SEQ ID NO: 705118 - RNA, 64 nt, hsa; identical to SEQ ID NO: 31858

SEQ ID NO: 705119 - RNA, 64 nt, hsa; identical to SEQ ID NO: 31859

SEQ ID NO: 705120 - RNA, 64 nt, hsa; identical to SEQ ID NO: 31860

SEQ ID NO: 705121 - RNA, 64 nt, hsa; identical to SEQ ID NO: 31861

SEQ ID NO: 705122 - RNA, 64 nt, hsa; identical to SEQ ID NO: 31862

SEQ ID NO: 705123 - RNA, 64 nt, hsa; identical to SEQ ID NO: 31863

SEQ ID NO: 705124 - RNA, 64 nt, hsa; identical to SEQ ID NO: 31864

SEQ ID NO: 705125 - RNA, 64 nt, hsa; identical to SEQ ID NO: 31865

SEQ ID NO: 705126 - RNA, 64 nt, hsa; identical to SEQ ID NO: 31866

SEQ ID NO: 705127 - RNA, 64 nt, hsa; identical to SEQ ID NO: 31867

SEQ ID NO: 705128 - RNA, 64 nt, hsa; identical to SEQ ID NO: 31868

SEQ ID NO: 705129 - RNA, 64 nt, hsa; identical to SEQ ID NO: 31869

SEQ ID NO: 705130 - RNA, 64 nt, hsa; identical to SEQ ID NO: 31870

SEQ ID NO: 705131 - RNA, 64 nt, hsa; identical to SEQ ID NO: 31871

SEQ ID NO: 705132 - RNA, 64 nt, hsa; identical to SEQ ID NO: 31872

SEQ ID NO: 705133 - RNA, 64 nt, hsa; identical to SEQ ID NO: 31873

SEQ ID NO: 705134 - RNA, 64 nt, hsa; identical to SEQ ID NO: 31874

SEQ ID NO: 705135 - RNA, 64 nt, hsa; identical to SEQ ID NO: 31875

SEQ ID NO: 705136 - RNA, 64 nt, hsa; identical to SEQ ID NO: 31876

SEQ ID NO: 705137 - RNA, 64 nt, hsa; identical to SEQ ID NO: 31877

SEQ ID NO: 705138 - RNA, 64 nt, hsa; identical to SEQ ID NO: 31878

SEQ ID NO: 705139 - RNA, 64 nt, hsa; identical to SEQ ID NO: 31879

SEQ ID NO: 705140 - RNA, 64 nt, hsa; identical to SEQ ID NO: 31880

SEQ ID NO: 705141 - RNA, 64 nt, hsa; identical to SEQ ID NO: 31881

SEQ ID NO: 705142 - RNA, 64 nt, hsa; identical to SEQ ID NO: 31882

SEQ ID NO: 705143 - RNA, 64 nt, hsa; identical to SEQ ID NO: 31883

SEQ ID NO: 705144 - RNA, 64 nt, hsa; identical to SEQ ID NO: 31884

SEQ ID NO: 705145 - RNA, 64 nt, hsa; identical to SEQ ID NO: 31885

SEQ ID NO: 705146 - RNA, 64 nt, hsa; identical to SEQ ID NO: 31886

SEQ ID NO: 705147 - RNA, 64 nt, hsa; identical to SEQ ID NO: 31887

SEQ ID NO: 705148 - RNA, 64 nt, hsa; identical to SEQ ID NO: 31888

SEQ ID NO: 705149 - RNA, 64 nt, hsa; identical to SEQ ID NO: 31889

SEQ ID NO: 705150 - RNA, 64 nt, hsa; identical to SEQ ID NO: 31890

SEQ ID NO: 705151 - RNA, 64 nt, hsa; identical to SEQ ID NO: 31891

SEQ ID NO: 705152 - RNA, 64 nt, hsa; identical to SEQ ID NO: 31892

SEQ ID NO: 705153 - RNA, 64 nt, hsa; identical to SEQ ID NO: 31893

SEQ ID NO: 705154 - RNA, 64 nt, hsa; identical to SEQ ID NO: 31894

SEQ ID NO: 705155 - RNA, 64 nt, hsa; identical to SEQ ID NO: 31895

SEQ ID NO: 705156 - RNA, 64 nt, hsa; identical to SEQ ID NO: 31896

SEQ ID NO: 705157 - RNA, 64 nt, hsa; identical to SEQ ID NO: 31897

SEQ ID NO: 705158 - RNA, 64 nt, hsa; identical to SEQ ID NO: 31898

SEQ ID NO: 705159 - RNA, 64 nt, hsa; identical to SEQ ID NO: 31899

SEQ ID NO: 705160 - RNA, 64 nt, hsa; identical to SEQ ID NO: 31900

SEQ ID NO: 705161 - RNA, 64 nt, hsa; identical to SEQ ID NO: 31901

SEQ ID NO: 705162 - RNA, 64 nt, hsa; identical to SEQ ID NO: 31902

SEQ ID NO: 705163 - RNA, 64 nt, hsa; identical to SEQ ID NO: 31903

SEQ ID NO: 705164 - RNA, 64 nt, hsa; identical to SEQ ID NO: 31904

SEQ ID NO: 705165 - RNA, 64 nt, hsa; identical to SEQ ID NO: 31905

SEQ ID NO: 705166 - RNA, 64 nt, hsa; identical to SEQ ID NO: 31906

SEQ ID NO: 705167 - RNA, 64 nt, hsa; identical to SEQ ID NO: 31907

SEQ ID NO: 705168 - RNA, 64 nt, hsa; identical to SEQ ID NO: 31908

SEQ ID NO: 705169 - RNA, 64 nt, hsa; identical to SEQ ID NO: 31909

SEQ ID NO: 705170 - RNA, 64 nt, hsa; identical to SEQ ID NO: 31910

SEQ ID NO: 705171 - RNA, 64 nt, hsa; identical to SEQ ID NO: 31911

SEQ ID NO: 705172 - RNA, 64 nt, hsa; identical to SEQ ID NO: 31912

SEQ ID NO: 705173 - RNA, 64 nt, hsa; identical to SEQ ID NO: 31913

SEQ ID NO: 705174 - RNA, 64 nt, hsa; identical to SEQ ID NO: 31914

SEQ ID NO: 705175 - RNA, 64 nt, hsa; identical to SEQ ID NO: 31915

SEQ ID NO: 705176 - RNA, 64 nt, hsa; identical to SEQ ID NO: 31916

SEQ ID NO: 705177 - RNA, 64 nt, hsa; identical to SEQ ID NO: 31917

SEQ ID NO: 705178 - RNA, 64 nt, hsa; identical to SEQ ID NO: 31918

SEQ ID NO: 705179 - RNA, 64 nt, hsa; identical to SEQ ID NO: 31919

SEQ ID NO: 705180 - RNA, 64 nt, hsa; identical to SEQ ID NO: 31920

SEQ ID NO: 705181 - RNA, 64 nt, hsa; identical to SEQ ID NO: 31921

SEQ ID NO: 705182 - RNA, 64 nt, hsa; identical to SEQ ID NO: 31922

SEQ ID NO: 705183 - RNA, 64 nt, hsa; identical to SEQ ID NO: 31923

SEQ ID NO: 705184 - RNA, 64 nt, hsa; identical to SEQ ID NO: 31924

SEQ ID NO: 705185 - RNA, 64 nt, hsa; identical to SEQ ID NO: 31925

SEQ ID NO: 705186 - RNA, 64 nt, hsa; identical to SEQ ID NO: 31926

SEQ ID NO: 705187 - RNA, 64 nt, hsa; identical to SEQ ID NO: 31927

SEQ ID NO: 705188 - RNA, 64 nt, hsa; identical to SEQ ID NO: 31928

SEQ ID NO: 705189 - RNA, 64 nt, hsa; identical to SEQ ID NO: 31929

SEQ ID NO: 705190 - RNA, 64 nt, hsa; identical to SEQ ID NO: 31930

SEQ ID NO: 705191 - RNA, 64 nt, hsa; identical to SEQ ID NO: 31931

SEQ ID NO: 705192 - RNA, 64 nt, hsa; identical to SEQ ID NO: 31932

SEQ ID NO: 705193 - RNA, 64 nt, hsa; identical to SEQ ID NO: 31933

SEQ ID NO: 705194 - RNA, 64 nt, hsa; identical to SEQ ID NO: 31934

SEQ ID NO: 705195 - RNA, 64 nt, hsa; identical to SEQ ID NO: 31935

SEQ ID NO: 705196 - RNA, 64 nt, hsa; identical to SEQ ID NO: 31936

SEQ ID NO: 705197 - RNA, 64 nt, hsa; identical to SEQ ID NO: 31937

SEQ ID NO: 705198 - RNA, 64 nt, hsa; identical to SEQ ID NO: 31938

SEQ ID NO: 705199 - RNA, 64 nt, hsa; identical to SEQ ID NO: 31939

SEQ ID NO: 705200 - RNA, 64 nt, hsa; identical to SEQ ID NO: 31940

SEQ ID NO: 705201 - RNA, 64 nt, hsa; identical to SEQ ID NO: 31941

SEQ ID NO: 705202 - RNA, 64 nt, hsa; identical to SEQ ID NO: 31942

SEQ ID NO: 705203 - RNA, 64 nt, hsa; identical to SEQ ID NO: 31943

SEQ ID NO: 705204 - RNA, 64 nt, hsa; identical to SEQ ID NO: 31944

SEQ ID NO: 705205 - RNA, 64 nt, hsa; identical to SEQ ID NO: 31945

SEQ ID NO: 705206 - RNA, 64 nt, hsa; identical to SEQ ID NO: 31946

SEQ ID NO: 705207 - RNA, 64 nt, hsa; identical to SEQ ID NO: 31947

SEQ ID NO: 705208 - RNA, 64 nt, hsa; identical to SEQ ID NO: 31948

SEQ ID NO: 705209 - RNA, 64 nt, hsa; identical to SEQ ID NO: 31949

SEQ ID NO: 705210 - RNA, 64 nt, hsa; identical to SEQ ID NO: 31950

SEQ ID NO: 705211 - RNA, 64 nt, hsa; identical to SEQ ID NO: 31951

SEQ ID NO: 705212 - RNA, 64 nt, hsa; identical to SEQ ID NO: 31952

SEQ ID NO: 705213 - RNA, 64 nt, hsa; identical to SEQ ID NO: 31953

SEQ ID NO: 705214 - RNA, 64 nt, hsa; identical to SEQ ID NO: 31954

SEQ ID NO: 705215 - RNA, 64 nt, hsa; identical to SEQ ID NO: 31955

SEQ ID NO: 705216 - RNA, 64 nt, hsa; identical to SEQ ID NO: 31956

SEQ ID NO: 705217 - RNA, 64 nt, hsa; identical to SEQ ID NO: 31957

SEQ ID NO: 705218 - RNA, 64 nt, hsa; identical to SEQ ID NO: 31958

SEQ ID NO: 705219 - RNA, 64 nt, hsa; identical to SEQ ID NO: 31959

SEQ ID NO: 705220 - RNA, 64 nt, hsa; identical to SEQ ID NO: 31960

SEQ ID NO: 705221 - RNA, 64 nt, hsa; identical to SEQ ID NO: 31961

SEQ ID NO: 705222 - RNA, 64 nt, hsa; identical to SEQ ID NO: 31962

SEQ ID NO: 705223 - RNA, 64 nt, hsa; identical to SEQ ID NO: 31963

SEQ ID NO: 705224 - RNA, 64 nt, hsa; identical to SEQ ID NO: 31964

SEQ ID NO: 705225 - RNA, 64 nt, hsa; identical to SEQ ID NO: 31965

SEQ ID NO: 705226 - RNA, 64 nt, hsa; identical to SEQ ID NO: 31966

SEQ ID NO: 705227 - RNA, 64 nt, hsa; identical to SEQ ID NO: 31967

SEQ ID NO: 705228 - RNA, 64 nt, hsa; identical to SEQ ID NO: 31968

SEQ ID NO: 705229 - RNA, 64 nt, hsa; identical to SEQ ID NO: 31969

SEQ ID NO: 705230 - RNA, 64 nt, hsa; identical to SEQ ID NO: 31970

SEQ ID NO: 705231 - RNA, 64 nt, hsa; identical to SEQ ID NO: 31971

SEQ ID NO: 705232 - RNA, 64 nt, hsa; identical to SEQ ID NO: 31972

SEQ ID NO: 705233 - RNA, 64 nt, hsa; identical to SEQ ID NO: 31973

SEQ ID NO: 705234 - RNA, 64 nt, hsa; identical to SEQ ID NO: 31974

SEQ ID NO: 705235 - RNA, 64 nt, hsa; identical to SEQ ID NO: 31975

SEQ ID NO: 705236 - RNA, 64 nt, hsa; identical to SEQ ID NO: 31976

SEQ ID NO: 705237 - RNA, 64 nt, hsa; identical to SEQ ID NO: 31977

SEQ ID NO: 705238 - RNA, 64 nt, hsa; identical to SEQ ID NO: 31978

SEQ ID NO: 705239 - RNA, 64 nt, hsa; identical to SEQ ID NO: 31979

SEQ ID NO: 705240 - RNA, 64 nt, hsa; identical to SEQ ID NO: 31980

SEQ ID NO: 705241 - RNA, 64 nt, hsa; identical to SEQ ID NO: 31981

SEQ ID NO: 705242 - RNA, 64 nt, hsa; identical to SEQ ID NO: 31982

SEQ ID NO: 705243 - RNA, 64 nt, hsa; identical to SEQ ID NO: 31983

SEQ ID NO: 705244 - RNA, 64 nt, hsa; identical to SEQ ID NO: 31984

SEQ ID NO: 705245 - RNA, 64 nt, hsa; identical to SEQ ID NO: 31985

SEQ ID NO: 705246 - RNA, 64 nt, hsa; identical to SEQ ID NO: 31986

SEQ ID NO: 705247 - RNA, 64 nt, hsa; identical to SEQ ID NO: 31987

SEQ ID NO: 705248 - RNA, 64 nt, hsa; identical to SEQ ID NO: 31988

SEQ ID NO: 705249 - RNA, 64 nt, hsa; identical to SEQ ID NO: 31989

SEQ ID NO: 705250 - RNA, 64 nt, hsa; identical to SEQ ID NO: 31990

SEQ ID NO: 705251 - RNA, 64 nt, hsa; identical to SEQ ID NO: 31991

SEQ ID NO: 705252 - RNA, 64 nt, hsa; identical to SEQ ID NO: 31992

SEQ ID NO: 705253 - RNA, 64 nt, hsa; identical to SEQ ID NO: 31993

SEQ ID NO: 705254 - RNA, 64 nt, hsa; identical to SEQ ID NO: 31994

SEQ ID NO: 705255 - RNA, 64 nt, hsa; identical to SEQ ID NO: 31995

SEQ ID NO: 705256 - RNA, 64 nt, hsa; identical to SEQ ID NO: 31996

SEQ ID NO: 705257 - RNA, 64 nt, hsa; identical to SEQ ID NO: 31997

SEQ ID NO: 705258 - RNA, 64 nt, hsa; identical to SEQ ID NO: 31998

SEQ ID NO: 705259 - RNA, 64 nt, hsa; identical to SEQ ID NO: 31999

SEQ ID NO: 705260 - RNA, 64 nt, hsa; identical to SEQ ID NO: 32000

SEQ ID NO: 705261 - RNA, 64 nt, hsa; identical to SEQ ID NO: 32001

SEQ ID NO: 705262 - RNA, 64 nt, hsa; identical to SEQ ID NO: 32002

SEQ ID NO: 705263 - RNA, 64 nt, hsa; identical to SEQ ID NO: 32003

SEQ ID NO: 705264 - RNA, 64 nt, hsa; identical to SEQ ID NO: 32004

SEQ ID NO: 705265 - RNA, 64 nt, hsa; identical to SEQ ID NO: 32005

SEQ ID NO: 705266 - RNA, 64 nt, hsa; identical to SEQ ID NO: 32006

SEQ ID NO: 705267 - RNA, 64 nt, hsa; identical to SEQ ID NO: 32007

SEQ ID NO: 705268 - RNA, 64 nt, hsa; identical to SEQ ID NO: 32008

SEQ ID NO: 705269 - RNA, 64 nt, hsa; identical to SEQ ID NO: 32009

SEQ ID NO: 705270 - RNA, 64 nt, hsa; identical to SEQ ID NO: 32010

SEQ ID NO: 705271 - RNA, 64 nt, hsa; identical to SEQ ID NO: 32011

SEQ ID NO: 705272 - RNA, 64 nt, hsa; identical to SEQ ID NO: 32012

SEQ ID NO: 705273 - RNA, 64 nt, hsa; identical to SEQ ID NO: 32013

SEQ ID NO: 705274 - RNA, 64 nt, hsa; identical to SEQ ID NO: 32014

SEQ ID NO: 705275 - RNA, 64 nt, hsa; identical to SEQ ID NO: 32015

SEQ ID NO: 705276 - RNA, 64 nt, hsa; identical to SEQ ID NO: 32016

SEQ ID NO: 705277 - RNA, 64 nt, hsa; identical to SEQ ID NO: 32017

SEQ ID NO: 705278 - RNA, 64 nt, hsa; identical to SEQ ID NO: 32018

SEQ ID NO: 705279 - RNA, 64 nt, hsa; identical to SEQ ID NO: 32019

SEQ ID NO: 705280 - RNA, 64 nt, hsa; identical to SEQ ID NO: 32020

SEQ ID NO: 705281 - RNA, 64 nt, hsa; identical to SEQ ID NO: 32021

SEQ ID NO: 705282 - RNA, 64 nt, hsa; identical to SEQ ID NO: 32022

SEQ ID NO: 705283 - RNA, 64 nt, hsa; identical to SEQ ID NO: 32023

SEQ ID NO: 705284 - RNA, 64 nt, hsa; identical to SEQ ID NO: 32024

SEQ ID NO: 705285 - RNA, 64 nt, hsa; identical to SEQ ID NO: 32025

SEQ ID NO: 705286 - RNA, 64 nt, hsa; identical to SEQ ID NO: 32026

SEQ ID NO: 705287 - RNA, 64 nt, hsa; identical to SEQ ID NO: 32027

SEQ ID NO: 705288 - RNA, 64 nt, hsa; identical to SEQ ID NO: 32028

SEQ ID NO: 705289 - RNA, 64 nt, hsa; identical to SEQ ID NO: 32029

SEQ ID NO: 705290 - RNA, 64 nt, hsa; identical to SEQ ID NO: 32030

SEQ ID NO: 705291 - RNA, 64 nt, hsa; identical to SEQ ID NO: 32031

SEQ ID NO: 705292 - RNA, 64 nt, hsa; identical to SEQ ID NO: 32032

SEQ ID NO: 705293 - RNA, 64 nt, hsa; identical to SEQ ID NO: 32033

SEQ ID NO: 705294 - RNA, 64 nt, hsa; identical to SEQ ID NO: 32034

SEQ ID NO: 705295 - RNA, 64 nt, hsa; identical to SEQ ID NO: 32035

SEQ ID NO: 705296 - RNA, 64 nt, hsa; identical to SEQ ID NO: 32036

SEQ ID NO: 705297 - RNA, 64 nt, hsa; identical to SEQ ID NO: 32037

SEQ ID NO: 705298 - RNA, 64 nt, hsa; identical to SEQ ID NO: 32038

SEQ ID NO: 705299 - RNA, 64 nt, hsa; identical to SEQ ID NO: 32039

SEQ ID NO: 705300 - RNA, 64 nt, hsa; identical to SEQ ID NO: 32040

SEQ ID NO: 705301 - RNA, 64 nt, hsa; identical to SEQ ID NO: 32041

SEQ ID NO: 705302 - RNA, 64 nt, hsa; identical to SEQ ID NO: 32042

SEQ ID NO: 705303 - RNA, 64 nt, hsa; identical to SEQ ID NO: 32043

SEQ ID NO: 705304 - RNA, 63 nt, hsa; identical to SEQ ID NO: 32044

SEQ ID NO: 705305 - RNA, 64 nt, hsa; identical to SEQ ID NO: 32045

SEQ ID NO: 705306 - RNA, 64 nt, hsa; identical to SEQ ID NO: 32046

SEQ ID NO: 705307 - RNA, 64 nt, hsa; identical to SEQ ID NO: 32047

SEQ ID NO: 705308 - RNA, 64 nt, hsa; identical to SEQ ID NO: 32048

SEQ ID NO: 705309 - RNA, 64 nt, hsa; identical to SEQ ID NO: 32049

SEQ ID NO: 705310 - RNA, 64 nt, hsa; identical to SEQ ID NO: 32050

SEQ ID NO: 705311 - RNA, 64 nt, hsa; identical to SEQ ID NO: 32051

SEQ ID NO: 705312 - RNA, 64 nt, hsa; identical to SEQ ID NO: 32052

SEQ ID NO: 705313 - RNA, 64 nt, hsa; identical to SEQ ID NO: 32053

SEQ ID NO: 705314 - RNA, 64 nt, hsa; identical to SEQ ID NO: 32054

SEQ ID NO: 705315 - RNA, 64 nt, hsa; identical to SEQ ID NO: 32055

SEQ ID NO: 705316 - RNA, 64 nt, hsa; identical to SEQ ID NO: 32056

SEQ ID NO: 705317 - RNA, 64 nt, hsa; identical to SEQ ID NO: 32057

SEQ ID NO: 705318 - RNA, 64 nt, hsa; identical to SEQ ID NO: 32058

SEQ ID NO: 705319 - RNA, 64 nt, hsa; identical to SEQ ID NO: 32059

SEQ ID NO: 705320 - RNA, 64 nt, hsa; identical to SEQ ID NO: 32060

SEQ ID NO: 705321 - RNA, 64 nt, hsa; identical to SEQ ID NO: 32061

SEQ ID NO: 705322 - RNA, 64 nt, hsa; identical to SEQ ID NO: 32062

SEQ ID NO: 705323 - RNA, 64 nt, hsa; identical to SEQ ID NO: 32063

SEQ ID NO: 705324 - RNA, 64 nt, hsa; identical to SEQ ID NO: 32064

SEQ ID NO: 705325 - RNA, 64 nt, hsa; identical to SEQ ID NO: 32065

SEQ ID NO: 705326 - RNA, 64 nt, hsa; identical to SEQ ID NO: 32066

SEQ ID NO: 705327 - RNA, 64 nt, hsa; identical to SEQ ID NO: 32067

SEQ ID NO: 705328 - RNA, 64 nt, hsa; identical to SEQ ID NO: 32068

SEQ ID NO: 705329 - RNA, 64 nt, hsa; identical to SEQ ID NO: 32069

SEQ ID NO: 705330 - RNA, 64 nt, hsa; identical to SEQ ID NO: 32070

SEQ ID NO: 705331 - RNA, 64 nt, hsa; identical to SEQ ID NO: 32071

SEQ ID NO: 705332 - RNA, 64 nt, hsa; identical to SEQ ID NO: 32072

SEQ ID NO: 705333 - RNA, 64 nt, hsa; identical to SEQ ID NO: 32073

SEQ ID NO: 705334 - RNA, 64 nt, hsa; identical to SEQ ID NO: 32074

SEQ ID NO: 705335 - RNA, 64 nt, hsa; identical to SEQ ID NO: 32075

SEQ ID NO: 705336 - RNA, 64 nt, hsa; identical to SEQ ID NO: 32076

SEQ ID NO: 705337 - RNA, 64 nt, hsa; identical to SEQ ID NO: 32077

SEQ ID NO: 705338 - RNA, 64 nt, hsa; identical to SEQ ID NO: 32078

SEQ ID NO: 705339 - RNA, 64 nt, hsa; identical to SEQ ID NO: 32079

SEQ ID NO: 705340 - RNA, 64 nt, hsa; identical to SEQ ID NO: 32080

SEQ ID NO: 705341 - RNA, 64 nt, hsa; identical to SEQ ID NO: 32081

SEQ ID NO: 705342 - RNA, 64 nt, hsa; identical to SEQ ID NO: 32082

SEQ ID NO: 705343 - RNA, 64 nt, hsa; identical to SEQ ID NO: 32083

SEQ ID NO: 705344 - RNA, 64 nt, hsa; identical to SEQ ID NO: 32084

SEQ ID NO: 705345 - RNA, 64 nt, hsa; identical to SEQ ID NO: 32085

SEQ ID NO: 705346 - RNA, 64 nt, hsa; identical to SEQ ID NO: 32086

SEQ ID NO: 705347 - RNA, 64 nt, hsa; identical to SEQ ID NO: 32087

SEQ ID NO: 705348 - RNA, 64 nt, hsa; identical to SEQ ID NO: 32088

SEQ ID NO: 705349 - RNA, 64 nt, hsa; identical to SEQ ID NO: 32089

SEQ ID NO: 705350 - RNA, 64 nt, hsa; identical to SEQ ID NO: 32090

SEQ ID NO: 705351 - RNA, 64 nt, hsa; identical to SEQ ID NO: 32091

SEQ ID NO: 705352 - RNA, 64 nt, hsa; identical to SEQ ID NO: 32092

SEQ ID NO: 705353 - RNA, 64 nt, hsa; identical to SEQ ID NO: 32093

SEQ ID NO: 705354 - RNA, 64 nt, hsa; identical to SEQ ID NO: 32094

SEQ ID NO: 705355 - RNA, 64 nt, hsa; identical to SEQ ID NO: 32095

SEQ ID NO: 705356 - RNA, 64 nt, hsa; identical to SEQ ID NO: 32096

SEQ ID NO: 705357 - RNA, 64 nt, hsa; identical to SEQ ID NO: 32097

SEQ ID NO: 705358 - RNA, 64 nt, hsa; identical to SEQ ID NO: 32098

SEQ ID NO: 705359 - RNA, 64 nt, hsa; identical to SEQ ID NO: 32099

SEQ ID NO: 705360 - RNA, 64 nt, hsa; identical to SEQ ID NO: 32100

SEQ ID NO: 705361 - RNA, 64 nt, hsa; identical to SEQ ID NO: 32101

SEQ ID NO: 705362 - RNA, 64 nt, hsa; identical to SEQ ID NO: 32102

SEQ ID NO: 705363 - RNA, 64 nt, hsa; identical to SEQ ID NO: 32103

SEQ ID NO: 705364 - RNA, 64 nt, hsa; identical to SEQ ID NO: 32104

SEQ ID NO: 705365 - RNA, 64 nt, hsa; identical to SEQ ID NO: 32105

SEQ ID NO: 705366 - RNA, 64 nt, hsa; identical to SEQ ID NO: 32106

SEQ ID NO: 705367 - RNA, 64 nt, hsa; identical to SEQ ID NO: 32107

SEQ ID NO: 705368 - RNA, 64 nt, hsa; identical to SEQ ID NO: 32108

SEQ ID NO: 705369 - RNA, 64 nt, hsa; identical to SEQ ID NO: 32109

SEQ ID NO: 705370 - RNA, 64 nt, hsa; identical to SEQ ID NO: 32110

SEQ ID NO: 705371 - RNA, 64 nt, hsa; identical to SEQ ID NO: 32111

SEQ ID NO: 705372 - RNA, 64 nt, hsa; identical to SEQ ID NO: 32112

SEQ ID NO: 705373 - RNA, 64 nt, hsa; identical to SEQ ID NO: 32113

SEQ ID NO: 705374 - RNA, 64 nt, hsa; identical to SEQ ID NO: 32114

SEQ ID NO: 705375 - RNA, 64 nt, hsa; identical to SEQ ID NO: 32115

SEQ ID NO: 705376 - RNA, 64 nt, hsa; identical to SEQ ID NO: 32116

SEQ ID NO: 705377 - RNA, 64 nt, hsa; identical to SEQ ID NO: 32117

SEQ ID NO: 705378 - RNA, 64 nt, hsa; identical to SEQ ID NO: 32118

SEQ ID NO: 705379 - RNA, 64 nt, hsa; identical to SEQ ID NO: 32119

SEQ ID NO: 705380 - RNA, 64 nt, hsa; identical to SEQ ID NO: 32120

SEQ ID NO: 705381 - RNA, 64 nt, hsa; identical to SEQ ID NO: 32121

SEQ ID NO: 705382 - RNA, 64 nt, hsa; identical to SEQ ID NO: 32122

SEQ ID NO: 705383 - RNA, 64 nt, hsa; identical to SEQ ID NO: 32123

SEQ ID NO: 705384 - RNA, 64 nt, hsa; identical to SEQ ID NO: 32124

SEQ ID NO: 705385 - RNA, 64 nt, hsa; identical to SEQ ID NO: 32125

SEQ ID NO: 705386 - RNA, 64 nt, hsa; identical to SEQ ID NO: 32126

SEQ ID NO: 705387 - RNA, 64 nt, hsa; identical to SEQ ID NO: 32127

SEQ ID NO: 705388 - RNA, 64 nt, hsa; identical to SEQ ID NO: 32128

SEQ ID NO: 705389 - RNA, 64 nt, hsa; identical to SEQ ID NO: 32129

SEQ ID NO: 705390 - RNA, 64 nt, hsa; identical to SEQ ID NO: 32130

SEQ ID NO: 705391 - RNA, 64 nt, hsa; identical to SEQ ID NO: 32131

SEQ ID NO: 705392 - RNA, 64 nt, hsa; identical to SEQ ID NO: 32132

SEQ ID NO: 705393 - RNA, 64 nt, hsa; identical to SEQ ID NO: 32133

SEQ ID NO: 705394 - RNA, 64 nt, hsa; identical to SEQ ID NO: 32134

SEQ ID NO: 705395 - RNA, 64 nt, hsa; identical to SEQ ID NO: 32135

SEQ ID NO: 705396 - RNA, 64 nt, hsa; identical to SEQ ID NO: 32136

SEQ ID NO: 705397 - RNA, 64 nt, hsa; identical to SEQ ID NO: 32137

SEQ ID NO: 705398 - RNA, 64 nt, hsa; identical to SEQ ID NO: 32138

SEQ ID NO: 705399 - RNA, 64 nt, hsa; identical to SEQ ID NO: 32139

SEQ ID NO: 705400 - RNA, 64 nt, hsa; identical to SEQ ID NO: 32140

SEQ ID NO: 705401 - RNA, 64 nt, hsa; identical to SEQ ID NO: 32141

SEQ ID NO: 705402 - RNA, 64 nt, hsa; identical to SEQ ID NO: 32142

SEQ ID NO: 705403 - RNA, 64 nt, hsa; identical to SEQ ID NO: 32143

SEQ ID NO: 705404 - RNA, 64 nt, hsa; identical to SEQ ID NO: 32144

SEQ ID NO: 705405 - RNA, 64 nt, hsa; identical to SEQ ID NO: 32145

SEQ ID NO: 705406 - RNA, 64 nt, hsa; identical to SEQ ID NO: 32146

SEQ ID NO: 705407 - RNA, 64 nt, hsa; identical to SEQ ID NO: 32147

SEQ ID NO: 705408 - RNA, 64 nt, hsa; identical to SEQ ID NO: 32148

SEQ ID NO: 705409 - RNA, 64 nt, hsa; identical to SEQ ID NO: 32149

SEQ ID NO: 705410 - RNA, 64 nt, hsa; identical to SEQ ID NO: 32150

SEQ ID NO: 705411 - RNA, 64 nt, hsa; identical to SEQ ID NO: 32151

SEQ ID NO: 705412 - RNA, 64 nt, hsa; identical to SEQ ID NO: 32152

SEQ ID NO: 705413 - RNA, 64 nt, hsa; identical to SEQ ID NO: 32153

SEQ ID NO: 705414 - RNA, 64 nt, hsa; identical to SEQ ID NO: 32154

SEQ ID NO: 705415 - RNA, 64 nt, hsa; identical to SEQ ID NO: 32155

SEQ ID NO: 705416 - RNA, 64 nt, hsa; identical to SEQ ID NO: 32156

SEQ ID NO: 705417 - RNA, 64 nt, hsa; identical to SEQ ID NO: 32157

SEQ ID NO: 705418 - RNA, 64 nt, hsa; identical to SEQ ID NO: 32158

SEQ ID NO: 705419 - RNA, 64 nt, hsa; identical to SEQ ID NO: 32159

SEQ ID NO: 705420 - RNA, 64 nt, hsa; identical to SEQ ID NO: 32160

SEQ ID NO: 705421 - RNA, 64 nt, hsa; identical to SEQ ID NO: 32161

SEQ ID NO: 705422 - RNA, 64 nt, hsa; identical to SEQ ID NO: 32162

SEQ ID NO: 705423 - RNA, 64 nt, hsa; identical to SEQ ID NO: 32163

SEQ ID NO: 705424 - RNA, 64 nt, hsa; identical to SEQ ID NO: 32164

SEQ ID NO: 705425 - RNA, 64 nt, hsa; identical to SEQ ID NO: 32165

SEQ ID NO: 705426 - RNA, 64 nt, hsa; identical to SEQ ID NO: 32166

SEQ ID NO: 705427 - RNA, 64 nt, hsa; identical to SEQ ID NO: 32167

SEQ ID NO: 705428 - RNA, 64 nt, hsa; identical to SEQ ID NO: 32168

SEQ ID NO: 705429 - RNA, 64 nt, hsa; identical to SEQ ID NO: 32169

SEQ ID NO: 705430 - RNA, 64 nt, hsa; identical to SEQ ID NO: 32170

SEQ ID NO: 705431 - RNA, 64 nt, hsa; identical to SEQ ID NO: 32171

SEQ ID NO: 705432 - RNA, 64 nt, hsa; identical to SEQ ID NO: 32172

SEQ ID NO: 705433 - RNA, 64 nt, hsa; identical to SEQ ID NO: 32173

SEQ ID NO: 705434 - RNA, 64 nt, hsa; identical to SEQ ID NO: 32174

SEQ ID NO: 705435 - RNA, 64 nt, hsa; identical to SEQ ID NO: 32175

SEQ ID NO: 705436 - RNA, 64 nt, hsa; identical to SEQ ID NO: 32176

SEQ ID NO: 705437 - RNA, 64 nt, hsa; identical to SEQ ID NO: 32177

SEQ ID NO: 705438 - RNA, 64 nt, hsa; identical to SEQ ID NO: 32178

SEQ ID NO: 705439 - RNA, 64 nt, hsa; identical to SEQ ID NO: 32179

SEQ ID NO: 705440 - RNA, 64 nt, hsa; identical to SEQ ID NO: 32180

SEQ ID NO: 705441 - RNA, 64 nt, hsa; identical to SEQ ID NO: 32181

SEQ ID NO: 705442 - RNA, 64 nt, hsa; identical to SEQ ID NO: 32182

SEQ ID NO: 705443 - RNA, 64 nt, hsa; identical to SEQ ID NO: 32183

SEQ ID NO: 705444 - RNA, 64 nt, hsa; identical to SEQ ID NO: 32184

SEQ ID NO: 705445 - RNA, 64 nt, hsa; identical to SEQ ID NO: 32185

SEQ ID NO: 705446 - RNA, 64 nt, hsa; identical to SEQ ID NO: 32186

SEQ ID NO: 705447 - RNA, 64 nt, hsa; identical to SEQ ID NO: 32187

SEQ ID NO: 705448 - RNA, 64 nt, hsa; identical to SEQ ID NO: 32188

SEQ ID NO: 705449 - RNA, 64 nt, hsa; identical to SEQ ID NO: 32189

SEQ ID NO: 705450 - RNA, 64 nt, hsa; identical to SEQ ID NO: 32190

SEQ ID NO: 705451 - RNA, 64 nt, hsa; identical to SEQ ID NO: 32191

SEQ ID NO: 705452 - RNA, 64 nt, hsa; identical to SEQ ID NO: 32192

SEQ ID NO: 705453 - RNA, 64 nt, hsa; identical to SEQ ID NO: 32193

SEQ ID NO: 705454 - RNA, 64 nt, hsa; identical to SEQ ID NO: 32194

SEQ ID NO: 705455 - RNA, 64 nt, hsa; identical to SEQ ID NO: 32195

SEQ ID NO: 705456 - RNA, 64 nt, hsa; identical to SEQ ID NO: 32196

SEQ ID NO: 705457 - RNA, 64 nt, hsa; identical to SEQ ID NO: 32197

SEQ ID NO: 705458 - RNA, 64 nt, hsa; identical to SEQ ID NO: 32198

SEQ ID NO: 705459 - RNA, 64 nt, hsa; identical to SEQ ID NO: 32199

SEQ ID NO: 705460 - RNA, 64 nt, hsa; identical to SEQ ID NO: 32200

SEQ ID NO: 705461 - RNA, 64 nt, hsa; identical to SEQ ID NO: 32201

SEQ ID NO: 705462 - RNA, 64 nt, hsa; identical to SEQ ID NO: 32202

SEQ ID NO: 705463 - RNA, 64 nt, hsa; identical to SEQ ID NO: 32203

SEQ ID NO: 705464 - RNA, 64 nt, hsa; identical to SEQ ID NO: 32204

SEQ ID NO: 705465 - RNA, 64 nt, hsa; identical to SEQ ID NO: 32205

SEQ ID NO: 705466 - RNA, 64 nt, hsa; identical to SEQ ID NO: 32206

SEQ ID NO: 705467 - RNA, 64 nt, hsa; identical to SEQ ID NO: 32207

SEQ ID NO: 705468 - RNA, 64 nt, hsa; identical to SEQ ID NO: 32208

SEQ ID NO: 705469 - RNA, 64 nt, hsa; identical to SEQ ID NO: 32209

SEQ ID NO: 705470 - RNA, 64 nt, hsa; identical to SEQ ID NO: 32210

SEQ ID NO: 705471 - RNA, 64 nt, hsa; identical to SEQ ID NO: 32211

SEQ ID NO: 705472 - RNA, 64 nt, hsa; identical to SEQ ID NO: 32212

SEQ ID NO: 705473 - RNA, 64 nt, hsa; identical to SEQ ID NO: 32213

SEQ ID NO: 705474 - RNA, 64 nt, hsa; identical to SEQ ID NO: 32214

SEQ ID NO: 705475 - RNA, 64 nt, hsa; identical to SEQ ID NO: 32215

SEQ ID NO: 705476 - RNA, 64 nt, hsa; identical to SEQ ID NO: 32216

SEQ ID NO: 705477 - RNA, 64 nt, hsa; identical to SEQ ID NO: 32217

SEQ ID NO: 705478 - RNA, 64 nt, hsa; identical to SEQ ID NO: 32218

SEQ ID NO: 705479 - RNA, 64 nt, hsa; identical to SEQ ID NO: 32219

SEQ ID NO: 705480 - RNA, 64 nt, hsa; identical to SEQ ID NO: 32220

SEQ ID NO: 705481 - RNA, 64 nt, hsa; identical to SEQ ID NO: 32221

SEQ ID NO: 705482 - RNA, 64 nt, hsa; identical to SEQ ID NO: 32222

SEQ ID NO: 705483 - RNA, 64 nt, hsa; identical to SEQ ID NO: 32223

SEQ ID NO: 705484 - RNA, 64 nt, hsa; identical to SEQ ID NO: 32224

SEQ ID NO: 705485 - RNA, 64 nt, hsa; identical to SEQ ID NO: 32225

SEQ ID NO: 705486 - RNA, 64 nt, hsa; identical to SEQ ID NO: 32226

SEQ ID NO: 705487 - RNA, 64 nt, hsa; identical to SEQ ID NO: 32227

SEQ ID NO: 705488 - RNA, 64 nt, hsa; identical to SEQ ID NO: 32228

SEQ ID NO: 705489 - RNA, 64 nt, hsa; identical to SEQ ID NO: 32229

SEQ ID NO: 705490 - RNA, 64 nt, hsa; identical to SEQ ID NO: 32230

SEQ ID NO: 705491 - RNA, 64 nt, hsa; identical to SEQ ID NO: 32231

SEQ ID NO: 705492 - RNA, 64 nt, hsa; identical to SEQ ID NO: 32232

SEQ ID NO: 705493 - RNA, 64 nt, hsa; identical to SEQ ID NO: 32233

SEQ ID NO: 705494 - RNA, 64 nt, hsa; identical to SEQ ID NO: 32234

SEQ ID NO: 705495 - RNA, 64 nt, hsa; identical to SEQ ID NO: 32235

SEQ ID NO: 705496 - RNA, 64 nt, hsa; identical to SEQ ID NO: 32236

SEQ ID NO: 705497 - RNA, 64 nt, hsa; identical to SEQ ID NO: 32237

SEQ ID NO: 705498 - RNA, 64 nt, hsa; identical to SEQ ID NO: 32238

SEQ ID NO: 705499 - RNA, 64 nt, hsa; identical to SEQ ID NO: 32239

SEQ ID NO: 705500 - RNA, 64 nt, hsa; identical to SEQ ID NO: 32240

SEQ ID NO: 705501 - RNA, 64 nt, hsa; identical to SEQ ID NO: 32241

SEQ ID NO: 705502 - RNA, 64 nt, hsa; identical to SEQ ID NO: 32242

SEQ ID NO: 705503 - RNA, 64 nt, hsa; identical to SEQ ID NO: 32243

SEQ ID NO: 705504 - RNA, 64 nt, hsa; identical to SEQ ID NO: 32244

SEQ ID NO: 705505 - RNA, 64 nt, hsa; identical to SEQ ID NO: 32245

SEQ ID NO: 705506 - RNA, 64 nt, hsa; identical to SEQ ID NO: 32246

SEQ ID NO: 705507 - RNA, 64 nt, hsa; identical to SEQ ID NO: 32247

SEQ ID NO: 705508 - RNA, 64 nt, hsa; identical to SEQ ID NO: 32248

SEQ ID NO: 705509 - RNA, 64 nt, hsa; identical to SEQ ID NO: 32249

SEQ ID NO: 705510 - RNA, 64 nt, hsa; identical to SEQ ID NO: 32250

SEQ ID NO: 705511 - RNA, 64 nt, hsa; identical to SEQ ID NO: 32251

SEQ ID NO: 705512 - RNA, 64 nt, hsa; identical to SEQ ID NO: 32252

SEQ ID NO: 705513 - RNA, 64 nt, hsa; identical to SEQ ID NO: 32253

SEQ ID NO: 705514 - RNA, 64 nt, hsa; identical to SEQ ID NO: 32254

SEQ ID NO: 705515 - RNA, 64 nt, hsa; identical to SEQ ID NO: 32255

SEQ ID NO: 705516 - RNA, 64 nt, hsa; identical to SEQ ID NO: 32256

SEQ ID NO: 705517 - RNA, 64 nt, hsa; identical to SEQ ID NO: 32257

SEQ ID NO: 705518 - RNA, 64 nt, hsa; identical to SEQ ID NO: 32258

SEQ ID NO: 705519 - RNA, 64 nt, hsa; identical to SEQ ID NO: 32259

SEQ ID NO: 705520 - RNA, 64 nt, hsa; identical to SEQ ID NO: 32260

SEQ ID NO: 705521 - RNA, 64 nt, hsa; identical to SEQ ID NO: 32261

SEQ ID NO: 705522 - RNA, 64 nt, hsa; identical to SEQ ID NO: 32262

SEQ ID NO: 705523 - RNA, 64 nt, hsa; identical to SEQ ID NO: 32263

SEQ ID NO: 705524 - RNA, 64 nt, hsa; identical to SEQ ID NO: 32264

SEQ ID NO: 705525 - RNA, 64 nt, hsa; identical to SEQ ID NO: 32265

SEQ ID NO: 705526 - RNA, 64 nt, hsa; identical to SEQ ID NO: 32266

SEQ ID NO: 705527 - RNA, 64 nt, hsa; identical to SEQ ID NO: 32267

SEQ ID NO: 705528 - RNA, 64 nt, hsa; identical to SEQ ID NO: 32268

SEQ ID NO: 705529 - RNA, 64 nt, hsa; identical to SEQ ID NO: 32269

SEQ ID NO: 705530 - RNA, 64 nt, hsa; identical to SEQ ID NO: 32270

SEQ ID NO: 705531 - RNA, 64 nt, hsa; identical to SEQ ID NO: 32271

SEQ ID NO: 705532 - RNA, 64 nt, hsa; identical to SEQ ID NO: 32272

SEQ ID NO: 705533 - RNA, 64 nt, hsa; identical to SEQ ID NO: 32273

SEQ ID NO: 705534 - RNA, 64 nt, hsa; identical to SEQ ID NO: 32274

SEQ ID NO: 705535 - RNA, 64 nt, hsa; identical to SEQ ID NO: 32275

SEQ ID NO: 705536 - RNA, 64 nt, hsa; identical to SEQ ID NO: 32276

SEQ ID NO: 705537 - RNA, 64 nt, hsa; identical to SEQ ID NO: 32277

SEQ ID NO: 705538 - RNA, 64 nt, hsa; identical to SEQ ID NO: 32278

SEQ ID NO: 705539 - RNA, 64 nt, hsa; identical to SEQ ID NO: 32279

SEQ ID NO: 705540 - RNA, 64 nt, hsa; identical to SEQ ID NO: 32280

SEQ ID NO: 705541 - RNA, 64 nt, hsa; identical to SEQ ID NO: 32281

SEQ ID NO: 705542 - RNA, 64 nt, hsa; identical to SEQ ID NO: 32282

SEQ ID NO: 705543 - RNA, 64 nt, hsa; identical to SEQ ID NO: 32283

SEQ ID NO: 705544 - RNA, 64 nt, hsa; identical to SEQ ID NO: 32284

SEQ ID NO: 705545 - RNA, 64 nt, hsa; identical to SEQ ID NO: 32285

SEQ ID NO: 705546 - RNA, 64 nt, hsa; identical to SEQ ID NO: 32286

SEQ ID NO: 705547 - RNA, 64 nt, hsa; identical to SEQ ID NO: 32287

SEQ ID NO: 705548 - RNA, 64 nt, hsa; identical to SEQ ID NO: 32288

SEQ ID NO: 705549 - RNA, 64 nt, hsa; identical to SEQ ID NO: 32289

SEQ ID NO: 705550 - RNA, 64 nt, hsa; identical to SEQ ID NO: 32290

SEQ ID NO: 705551 - RNA, 64 nt, hsa; identical to SEQ ID NO: 32291

SEQ ID NO: 705552 - RNA, 64 nt, hsa; identical to SEQ ID NO: 32292

SEQ ID NO: 705553 - RNA, 64 nt, hsa; identical to SEQ ID NO: 32293

SEQ ID NO: 705554 - RNA, 64 nt, hsa; identical to SEQ ID NO: 32294

SEQ ID NO: 705555 - RNA, 64 nt, hsa; identical to SEQ ID NO: 32295

SEQ ID NO: 705556 - RNA, 64 nt, hsa; identical to SEQ ID NO: 32296

SEQ ID NO: 705557 - RNA, 64 nt, hsa; identical to SEQ ID NO: 32297

SEQ ID NO: 705558 - RNA, 64 nt, hsa; identical to SEQ ID NO: 32298

SEQ ID NO: 705559 - RNA, 64 nt, hsa; identical to SEQ ID NO: 32299

SEQ ID NO: 705560 - RNA, 64 nt, hsa; identical to SEQ ID NO: 32300

SEQ ID NO: 705561 - RNA, 64 nt, hsa; identical to SEQ ID NO: 32301

SEQ ID NO: 705562 - RNA, 64 nt, hsa; identical to SEQ ID NO: 32302

SEQ ID NO: 705563 - RNA, 64 nt, hsa; identical to SEQ ID NO: 32303

SEQ ID NO: 705564 - RNA, 64 nt, hsa; identical to SEQ ID NO: 32304

SEQ ID NO: 705565 - RNA, 64 nt, hsa; identical to SEQ ID NO: 32305

SEQ ID NO: 705566 - RNA, 64 nt, hsa; identical to SEQ ID NO: 32306

SEQ ID NO: 705567 - RNA, 64 nt, hsa; identical to SEQ ID NO: 32307

SEQ ID NO: 705568 - RNA, 64 nt, hsa; identical to SEQ ID NO: 32308

SEQ ID NO: 705569 - RNA, 64 nt, hsa; identical to SEQ ID NO: 32309

SEQ ID NO: 705570 - RNA, 64 nt, hsa; identical to SEQ ID NO: 32310

SEQ ID NO: 705571 - RNA, 64 nt, hsa; identical to SEQ ID NO: 32311

SEQ ID NO: 705572 - RNA, 64 nt, hsa; identical to SEQ ID NO: 32312

SEQ ID NO: 705573 - RNA, 64 nt, hsa; identical to SEQ ID NO: 32313

SEQ ID NO: 705574 - RNA, 64 nt, hsa; identical to SEQ ID NO: 32314

SEQ ID NO: 705575 - RNA, 64 nt, hsa; identical to SEQ ID NO: 32315

SEQ ID NO: 705576 - RNA, 64 nt, hsa; identical to SEQ ID NO: 32316

SEQ ID NO: 705577 - RNA, 64 nt, hsa; identical to SEQ ID NO: 32317

SEQ ID NO: 705578 - RNA, 64 nt, hsa; identical to SEQ ID NO: 32318

SEQ ID NO: 705579 - RNA, 64 nt, hsa; identical to SEQ ID NO: 32319

SEQ ID NO: 705580 - RNA, 64 nt, hsa; identical to SEQ ID NO: 32320

SEQ ID NO: 705581 - RNA, 64 nt, hsa; identical to SEQ ID NO: 32321

SEQ ID NO: 705582 - RNA, 64 nt, hsa; identical to SEQ ID NO: 32322

SEQ ID NO: 705583 - RNA, 64 nt, hsa; identical to SEQ ID NO: 32323

SEQ ID NO: 705584 - RNA, 64 nt, hsa; identical to SEQ ID NO: 32324

SEQ ID NO: 705585 - RNA, 64 nt, hsa; identical to SEQ ID NO: 32325

SEQ ID NO: 705586 - RNA, 64 nt, hsa; identical to SEQ ID NO: 32326

SEQ ID NO: 705587 - RNA, 64 nt, hsa; identical to SEQ ID NO: 32327

SEQ ID NO: 705588 - RNA, 64 nt, hsa; identical to SEQ ID NO: 32328

SEQ ID NO: 705589 - RNA, 64 nt, hsa; identical to SEQ ID NO: 32329

SEQ ID NO: 705590 - RNA, 64 nt, hsa; identical to SEQ ID NO: 32330

SEQ ID NO: 705591 - RNA, 64 nt, hsa; identical to SEQ ID NO: 32331

SEQ ID NO: 705592 - RNA, 64 nt, hsa; identical to SEQ ID NO: 32332

SEQ ID NO: 705593 - RNA, 64 nt, hsa; identical to SEQ ID NO: 32333

SEQ ID NO: 705594 - RNA, 64 nt, hsa; identical to SEQ ID NO: 32334

SEQ ID NO: 705595 - RNA, 64 nt, hsa; identical to SEQ ID NO: 32335

SEQ ID NO: 705596 - RNA, 64 nt, hsa; identical to SEQ ID NO: 32336

SEQ ID NO: 705597 - RNA, 64 nt, hsa; identical to SEQ ID NO: 32337

SEQ ID NO: 705598 - RNA, 64 nt, hsa; identical to SEQ ID NO: 32338

SEQ ID NO: 705599 - RNA, 64 nt, hsa; identical to SEQ ID NO: 32339

SEQ ID NO: 705600 - RNA, 64 nt, hsa; identical to SEQ ID NO: 32340

SEQ ID NO: 705601 - RNA, 64 nt, hsa; identical to SEQ ID NO: 32341

SEQ ID NO: 705602 - RNA, 64 nt, hsa; identical to SEQ ID NO: 32342

SEQ ID NO: 705603 - RNA, 64 nt, hsa; identical to SEQ ID NO: 32343

SEQ ID NO: 705604 - RNA, 64 nt, hsa; identical to SEQ ID NO: 32344

SEQ ID NO: 705605 - RNA, 64 nt, hsa; identical to SEQ ID NO: 32345

SEQ ID NO: 705606 - RNA, 64 nt, hsa; identical to SEQ ID NO: 32346

SEQ ID NO: 705607 - RNA, 64 nt, hsa; identical to SEQ ID NO: 32347

SEQ ID NO: 705608 - RNA, 64 nt, hsa; identical to SEQ ID NO: 32348

SEQ ID NO: 705609 - RNA, 64 nt, hsa; identical to SEQ ID NO: 32349

SEQ ID NO: 705610 - RNA, 64 nt, hsa; identical to SEQ ID NO: 32350

SEQ ID NO: 705611 - RNA, 64 nt, hsa; identical to SEQ ID NO: 32351

SEQ ID NO: 705612 - RNA, 64 nt, hsa; identical to SEQ ID NO: 32352

SEQ ID NO: 705613 - RNA, 64 nt, hsa; identical to SEQ ID NO: 32353

SEQ ID NO: 705614 - RNA, 64 nt, hsa; identical to SEQ ID NO: 32354

SEQ ID NO: 705615 - RNA, 64 nt, hsa; identical to SEQ ID NO: 32355

SEQ ID NO: 705616 - RNA, 64 nt, hsa; identical to SEQ ID NO: 32356

SEQ ID NO: 705617 - RNA, 64 nt, hsa; identical to SEQ ID NO: 32357

SEQ ID NO: 705618 - RNA, 64 nt, hsa; identical to SEQ ID NO: 32358

SEQ ID NO: 705619 - RNA, 64 nt, hsa; identical to SEQ ID NO: 32359

SEQ ID NO: 705620 - RNA, 64 nt, hsa; identical to SEQ ID NO: 32360

SEQ ID NO: 705621 - RNA, 64 nt, hsa; identical to SEQ ID NO: 32361

SEQ ID NO: 705622 - RNA, 64 nt, hsa; identical to SEQ ID NO: 32362

SEQ ID NO: 705623 - RNA, 64 nt, hsa; identical to SEQ ID NO: 32363

SEQ ID NO: 705624 - RNA, 64 nt, hsa; identical to SEQ ID NO: 32364

SEQ ID NO: 705625 - RNA, 64 nt, hsa; identical to SEQ ID NO: 32365

SEQ ID NO: 705626 - RNA, 64 nt, hsa; identical to SEQ ID NO: 32366

SEQ ID NO: 705627 - RNA, 64 nt, hsa; identical to SEQ ID NO: 32367

SEQ ID NO: 705628 - RNA, 64 nt, hsa; identical to SEQ ID NO: 32368

SEQ ID NO: 705629 - RNA, 64 nt, hsa; identical to SEQ ID NO: 32369

SEQ ID NO: 705630 - RNA, 64 nt, hsa; identical to SEQ ID NO: 32370

SEQ ID NO: 705631 - RNA, 64 nt, hsa; identical to SEQ ID NO: 32371

SEQ ID NO: 705632 - RNA, 64 nt, hsa; identical to SEQ ID NO: 32372

SEQ ID NO: 705633 - RNA, 64 nt, hsa; identical to SEQ ID NO: 32373

SEQ ID NO: 705634 - RNA, 64 nt, hsa; identical to SEQ ID NO: 32374

SEQ ID NO: 705635 - RNA, 64 nt, hsa; identical to SEQ ID NO: 32375

SEQ ID NO: 705636 - RNA, 64 nt, hsa; identical to SEQ ID NO: 32376

SEQ ID NO: 705637 - RNA, 64 nt, hsa; identical to SEQ ID NO: 32377

SEQ ID NO: 705638 - RNA, 64 nt, hsa; identical to SEQ ID NO: 32378

SEQ ID NO: 705639 - RNA, 64 nt, hsa; identical to SEQ ID NO: 32379

SEQ ID NO: 705640 - RNA, 64 nt, hsa; identical to SEQ ID NO: 32380

SEQ ID NO: 705641 - RNA, 64 nt, hsa; identical to SEQ ID NO: 32381

SEQ ID NO: 705642 - RNA, 64 nt, hsa; identical to SEQ ID NO: 32382

SEQ ID NO: 705643 - RNA, 64 nt, hsa; identical to SEQ ID NO: 32383

SEQ ID NO: 705644 - RNA, 64 nt, hsa; identical to SEQ ID NO: 32384

SEQ ID NO: 705645 - RNA, 64 nt, hsa; identical to SEQ ID NO: 32385

SEQ ID NO: 705646 - RNA, 64 nt, hsa; identical to SEQ ID NO: 32386

SEQ ID NO: 705647 - RNA, 64 nt, hsa; identical to SEQ ID NO: 32387

SEQ ID NO: 705648 - RNA, 64 nt, hsa; identical to SEQ ID NO: 32388

SEQ ID NO: 705649 - RNA, 64 nt, hsa; identical to SEQ ID NO: 32389

SEQ ID NO: 705650 - RNA, 64 nt, hsa; identical to SEQ ID NO: 32390

SEQ ID NO: 705651 - RNA, 64 nt, hsa; identical to SEQ ID NO: 32391

SEQ ID NO: 705652 - RNA, 64 nt, hsa; identical to SEQ ID NO: 32392

SEQ ID NO: 705653 - RNA, 64 nt, hsa; identical to SEQ ID NO: 32393

SEQ ID NO: 705654 - RNA, 64 nt, hsa; identical to SEQ ID NO: 32394

SEQ ID NO: 705655 - RNA, 64 nt, hsa; identical to SEQ ID NO: 32395

SEQ ID NO: 705656 - RNA, 64 nt, hsa; identical to SEQ ID NO: 32396

SEQ ID NO: 705657 - RNA, 64 nt, hsa; identical to SEQ ID NO: 32397

SEQ ID NO: 705658 - RNA, 64 nt, hsa; identical to SEQ ID NO: 32398

SEQ ID NO: 705659 - RNA, 64 nt, hsa; identical to SEQ ID NO: 32399

SEQ ID NO: 705660 - RNA, 64 nt, hsa; identical to SEQ ID NO: 32400

SEQ ID NO: 705661 - RNA, 64 nt, hsa; identical to SEQ ID NO: 32401

SEQ ID NO: 705662 - RNA, 64 nt, hsa; identical to SEQ ID NO: 32402

SEQ ID NO: 705663 - RNA, 64 nt, hsa; identical to SEQ ID NO: 32403

SEQ ID NO: 705664 - RNA, 64 nt, hsa; identical to SEQ ID NO: 32404

SEQ ID NO: 705665 - RNA, 64 nt, hsa; identical to SEQ ID NO: 32405

SEQ ID NO: 705666 - RNA, 64 nt, hsa; identical to SEQ ID NO: 32406

SEQ ID NO: 705667 - RNA, 64 nt, hsa; identical to SEQ ID NO: 32407

SEQ ID NO: 705668 - RNA, 64 nt, hsa; identical to SEQ ID NO: 32408

SEQ ID NO: 705669 - RNA, 64 nt, hsa; identical to SEQ ID NO: 32409

SEQ ID NO: 705670 - RNA, 64 nt, hsa; identical to SEQ ID NO: 32410

SEQ ID NO: 705671 - RNA, 64 nt, hsa; identical to SEQ ID NO: 32411

SEQ ID NO: 705672 - RNA, 64 nt, hsa; identical to SEQ ID NO: 32412

SEQ ID NO: 705673 - RNA, 64 nt, hsa; identical to SEQ ID NO: 32413

SEQ ID NO: 705674 - RNA, 64 nt, hsa; identical to SEQ ID NO: 32414

SEQ ID NO: 705675 - RNA, 64 nt, hsa; identical to SEQ ID NO: 32415

SEQ ID NO: 705676 - RNA, 64 nt, hsa; identical to SEQ ID NO: 32416

SEQ ID NO: 705677 - RNA, 64 nt, hsa; identical to SEQ ID NO: 32417

SEQ ID NO: 705678 - RNA, 64 nt, hsa; identical to SEQ ID NO: 32418

SEQ ID NO: 705679 - RNA, 64 nt, hsa; identical to SEQ ID NO: 32419

SEQ ID NO: 705680 - RNA, 64 nt, hsa; identical to SEQ ID NO: 32420

SEQ ID NO: 705681 - RNA, 64 nt, hsa; identical to SEQ ID NO: 32421

SEQ ID NO: 705682 - RNA, 64 nt, hsa; identical to SEQ ID NO: 32422

SEQ ID NO: 705683 - RNA, 64 nt, hsa; identical to SEQ ID NO: 32423

SEQ ID NO: 705684 - RNA, 64 nt, hsa; identical to SEQ ID NO: 32424

SEQ ID NO: 705685 - RNA, 64 nt, hsa; identical to SEQ ID NO: 32425

SEQ ID NO: 705686 - RNA, 64 nt, hsa; identical to SEQ ID NO: 32426

SEQ ID NO: 705687 - RNA, 64 nt, hsa; identical to SEQ ID NO: 32427

SEQ ID NO: 705688 - RNA, 64 nt, hsa; identical to SEQ ID NO: 32428

SEQ ID NO: 705689 - RNA, 64 nt, hsa; identical to SEQ ID NO: 32429

SEQ ID NO: 705690 - RNA, 64 nt, hsa; identical to SEQ ID NO: 32430

SEQ ID NO: 705691 - RNA, 64 nt, hsa; identical to SEQ ID NO: 32431

SEQ ID NO: 705692 - RNA, 64 nt, hsa; identical to SEQ ID NO: 32432

SEQ ID NO: 705693 - RNA, 64 nt, hsa; identical to SEQ ID NO: 32433

SEQ ID NO: 705694 - RNA, 64 nt, hsa; identical to SEQ ID NO: 32434

SEQ ID NO: 705695 - RNA, 64 nt, hsa; identical to SEQ ID NO: 32435

SEQ ID NO: 705696 - RNA, 64 nt, hsa; identical to SEQ ID NO: 32436

SEQ ID NO: 705697 - RNA, 64 nt, hsa; identical to SEQ ID NO: 32437

SEQ ID NO: 705698 - RNA, 64 nt, hsa; identical to SEQ ID NO: 32438

SEQ ID NO: 705699 - RNA, 64 nt, hsa; identical to SEQ ID NO: 32439

SEQ ID NO: 705700 - RNA, 64 nt, hsa; identical to SEQ ID NO: 32440

SEQ ID NO: 705701 - RNA, 64 nt, hsa; identical to SEQ ID NO: 32441

SEQ ID NO: 705702 - RNA, 64 nt, hsa; identical to SEQ ID NO: 32442

SEQ ID NO: 705703 - RNA, 64 nt, hsa; identical to SEQ ID NO: 32443

SEQ ID NO: 705704 - RNA, 64 nt, hsa; identical to SEQ ID NO: 32444

SEQ ID NO: 705705 - RNA, 64 nt, hsa; identical to SEQ ID NO: 32445

SEQ ID NO: 705706 - RNA, 64 nt, hsa; identical to SEQ ID NO: 32446

SEQ ID NO: 705707 - RNA, 64 nt, hsa; identical to SEQ ID NO: 32447

SEQ ID NO: 705708 - RNA, 64 nt, hsa; identical to SEQ ID NO: 32448

SEQ ID NO: 705709 - RNA, 64 nt, hsa; identical to SEQ ID NO: 32449

SEQ ID NO: 705710 - RNA, 64 nt, hsa; identical to SEQ ID NO: 32450

SEQ ID NO: 705711 - RNA, 64 nt, hsa; identical to SEQ ID NO: 32451

SEQ ID NO: 705712 - RNA, 64 nt, hsa; identical to SEQ ID NO: 32452

SEQ ID NO: 705713 - RNA, 64 nt, hsa; identical to SEQ ID NO: 32453

SEQ ID NO: 705714 - RNA, 64 nt, hsa; identical to SEQ ID NO: 32454

SEQ ID NO: 705715 - RNA, 64 nt, hsa; identical to SEQ ID NO: 32455

SEQ ID NO: 705716 - RNA, 64 nt, hsa; identical to SEQ ID NO: 32456

SEQ ID NO: 705717 - RNA, 64 nt, hsa; identical to SEQ ID NO: 32457

SEQ ID NO: 705718 - RNA, 64 nt, hsa; identical to SEQ ID NO: 32458

SEQ ID NO: 705719 - RNA, 64 nt, hsa; identical to SEQ ID NO: 32459

SEQ ID NO: 705720 - RNA, 64 nt, hsa; identical to SEQ ID NO: 32460

SEQ ID NO: 705721 - RNA, 64 nt, hsa; identical to SEQ ID NO: 32461

SEQ ID NO: 705722 - RNA, 64 nt, hsa; identical to SEQ ID NO: 32462

SEQ ID NO: 705723 - RNA, 64 nt, hsa; identical to SEQ ID NO: 32463

SEQ ID NO: 705724 - RNA, 64 nt, hsa; identical to SEQ ID NO: 32464

SEQ ID NO: 705725 - RNA, 64 nt, hsa; identical to SEQ ID NO: 32465

SEQ ID NO: 705726 - RNA, 64 nt, hsa; identical to SEQ ID NO: 32466

SEQ ID NO: 705727 - RNA, 64 nt, hsa; identical to SEQ ID NO: 32467

SEQ ID NO: 705728 - RNA, 64 nt, hsa; identical to SEQ ID NO: 32468

SEQ ID NO: 705729 - RNA, 64 nt, hsa; identical to SEQ ID NO: 32469

SEQ ID NO: 705730 - RNA, 64 nt, hsa; identical to SEQ ID NO: 32470

SEQ ID NO: 705731 - RNA, 64 nt, hsa; identical to SEQ ID NO: 32471

SEQ ID NO: 705732 - RNA, 64 nt, hsa; identical to SEQ ID NO: 32472

SEQ ID NO: 705733 - RNA, 64 nt, hsa; identical to SEQ ID NO: 32473

SEQ ID NO: 705734 - RNA, 64 nt, hsa; identical to SEQ ID NO: 32474

SEQ ID NO: 705735 - RNA, 64 nt, hsa; identical to SEQ ID NO: 32475

SEQ ID NO: 705736 - RNA, 64 nt, hsa; identical to SEQ ID NO: 32476

SEQ ID NO: 705737 - RNA, 64 nt, hsa; identical to SEQ ID NO: 32477

SEQ ID NO: 705738 - RNA, 64 nt, hsa; identical to SEQ ID NO: 32478

SEQ ID NO: 705739 - RNA, 64 nt, hsa; identical to SEQ ID NO: 32479

SEQ ID NO: 705740 - RNA, 64 nt, hsa; identical to SEQ ID NO: 32480

SEQ ID NO: 705741 - RNA, 64 nt, hsa; identical to SEQ ID NO: 32481

SEQ ID NO: 705742 - RNA, 64 nt, hsa; identical to SEQ ID NO: 32482

SEQ ID NO: 705743 - RNA, 64 nt, hsa; identical to SEQ ID NO: 32483

SEQ ID NO: 705744 - RNA, 64 nt, hsa; identical to SEQ ID NO: 32484

SEQ ID NO: 705745 - RNA, 64 nt, hsa; identical to SEQ ID NO: 32485

SEQ ID NO: 705746 - RNA, 64 nt, hsa; identical to SEQ ID NO: 32486

SEQ ID NO: 705747 - RNA, 64 nt, hsa; identical to SEQ ID NO: 32487

SEQ ID NO: 705748 - RNA, 64 nt, hsa; identical to SEQ ID NO: 32488

SEQ ID NO: 705749 - RNA, 64 nt, hsa; identical to SEQ ID NO: 32489

SEQ ID NO: 705750 - RNA, 64 nt, hsa; identical to SEQ ID NO: 32490

SEQ ID NO: 705751 - RNA, 64 nt, hsa; identical to SEQ ID NO: 32491

SEQ ID NO: 705752 - RNA, 64 nt, hsa; identical to SEQ ID NO: 32492

SEQ ID NO: 705753 - RNA, 64 nt, hsa; identical to SEQ ID NO: 32493

SEQ ID NO: 705754 - RNA, 64 nt, hsa; identical to SEQ ID NO: 32494

SEQ ID NO: 705755 - RNA, 64 nt, hsa; identical to SEQ ID NO: 32495

SEQ ID NO: 705756 - RNA, 64 nt, hsa; identical to SEQ ID NO: 32496

SEQ ID NO: 705757 - RNA, 64 nt, hsa; identical to SEQ ID NO: 32497

SEQ ID NO: 705758 - RNA, 64 nt, hsa; identical to SEQ ID NO: 32498

SEQ ID NO: 705759 - RNA, 64 nt, hsa; identical to SEQ ID NO: 32499

SEQ ID NO: 705760 - RNA, 64 nt, hsa; identical to SEQ ID NO: 32500

SEQ ID NO: 705761 - RNA, 64 nt, hsa; identical to SEQ ID NO: 32501

SEQ ID NO: 705762 - RNA, 64 nt, hsa; identical to SEQ ID NO: 32502

SEQ ID NO: 705763 - RNA, 64 nt, hsa; identical to SEQ ID NO: 32503

SEQ ID NO: 705764 - RNA, 64 nt, hsa; identical to SEQ ID NO: 32504

SEQ ID NO: 705765 - RNA, 64 nt, hsa; identical to SEQ ID NO: 32505

SEQ ID NO: 705766 - RNA, 64 nt, hsa; identical to SEQ ID NO: 32506

SEQ ID NO: 705767 - RNA, 64 nt, hsa; identical to SEQ ID NO: 32507

SEQ ID NO: 705768 - RNA, 64 nt, hsa; identical to SEQ ID NO: 32508

SEQ ID NO: 705769 - RNA, 64 nt, hsa; identical to SEQ ID NO: 32509

SEQ ID NO: 705770 - RNA, 64 nt, hsa; identical to SEQ ID NO: 32510

SEQ ID NO: 705771 - RNA, 64 nt, hsa; identical to SEQ ID NO: 32511

SEQ ID NO: 705772 - RNA, 64 nt, hsa; identical to SEQ ID NO: 32512

SEQ ID NO: 705773 - RNA, 64 nt, hsa; identical to SEQ ID NO: 32513

SEQ ID NO: 705774 - RNA, 64 nt, hsa; identical to SEQ ID NO: 32514

SEQ ID NO: 705775 - RNA, 64 nt, hsa; identical to SEQ ID NO: 32515

SEQ ID NO: 705776 - RNA, 64 nt, hsa; identical to SEQ ID NO: 32516

SEQ ID NO: 705777 - RNA, 64 nt, hsa; identical to SEQ ID NO: 32517

SEQ ID NO: 705778 - RNA, 64 nt, hsa; identical to SEQ ID NO: 32518

SEQ ID NO: 705779 - RNA, 64 nt, hsa; identical to SEQ ID NO: 32519

SEQ ID NO: 705780 - RNA, 64 nt, hsa; identical to SEQ ID NO: 32520

SEQ ID NO: 705781 - RNA, 64 nt, hsa; identical to SEQ ID NO: 32521

SEQ ID NO: 705782 - RNA, 64 nt, hsa; identical to SEQ ID NO: 32522

SEQ ID NO: 705783 - RNA, 64 nt, hsa; identical to SEQ ID NO: 32523

SEQ ID NO: 705784 - RNA, 64 nt, hsa; identical to SEQ ID NO: 32524

SEQ ID NO: 705785 - RNA, 64 nt, hsa; identical to SEQ ID NO: 32525

SEQ ID NO: 705786 - RNA, 64 nt, hsa; identical to SEQ ID NO: 32526

SEQ ID NO: 705787 - RNA, 64 nt, hsa; identical to SEQ ID NO: 32527

SEQ ID NO: 705788 - RNA, 64 nt, hsa; identical to SEQ ID NO: 32528

SEQ ID NO: 705789 - RNA, 64 nt, hsa; identical to SEQ ID NO: 32529

SEQ ID NO: 705790 - RNA, 64 nt, hsa; identical to SEQ ID NO: 32530

SEQ ID NO: 705791 - RNA, 64 nt, hsa; identical to SEQ ID NO: 32531

SEQ ID NO: 705792 - RNA, 64 nt, hsa; identical to SEQ ID NO: 32532

SEQ ID NO: 705793 - RNA, 64 nt, hsa; identical to SEQ ID NO: 32533

SEQ ID NO: 705794 - RNA, 64 nt, hsa; identical to SEQ ID NO: 32534

SEQ ID NO: 705795 - RNA, 64 nt, hsa; identical to SEQ ID NO: 32535

SEQ ID NO: 705796 - RNA, 64 nt, hsa; identical to SEQ ID NO: 32536

SEQ ID NO: 705797 - RNA, 64 nt, hsa; identical to SEQ ID NO: 32537

SEQ ID NO: 705798 - RNA, 64 nt, hsa; identical to SEQ ID NO: 32538

SEQ ID NO: 705799 - RNA, 64 nt, hsa; identical to SEQ ID NO: 32539

SEQ ID NO: 705800 - RNA, 64 nt, hsa; identical to SEQ ID NO: 32540

SEQ ID NO: 705801 - RNA, 64 nt, hsa; identical to SEQ ID NO: 32541

SEQ ID NO: 705802 - RNA, 64 nt, hsa; identical to SEQ ID NO: 32542

SEQ ID NO: 705803 - RNA, 64 nt, hsa; identical to SEQ ID NO: 32543

SEQ ID NO: 705804 - RNA, 64 nt, hsa; identical to SEQ ID NO: 32544

SEQ ID NO: 705805 - RNA, 64 nt, hsa; identical to SEQ ID NO: 32545

SEQ ID NO: 705806 - RNA, 64 nt, hsa; identical to SEQ ID NO: 32546

SEQ ID NO: 705807 - RNA, 64 nt, hsa; identical to SEQ ID NO: 32547

SEQ ID NO: 705808 - RNA, 64 nt, hsa; identical to SEQ ID NO: 32548

SEQ ID NO: 705809 - RNA, 64 nt, hsa; identical to SEQ ID NO: 32549

SEQ ID NO: 705810 - RNA, 64 nt, hsa; identical to SEQ ID NO: 32550

SEQ ID NO: 705811 - RNA, 64 nt, hsa; identical to SEQ ID NO: 32551

SEQ ID NO: 705812 - RNA, 64 nt, hsa; identical to SEQ ID NO: 32552

SEQ ID NO: 705813 - RNA, 64 nt, hsa; identical to SEQ ID NO: 32553

SEQ ID NO: 705814 - RNA, 64 nt, hsa; identical to SEQ ID NO: 32554

SEQ ID NO: 705815 - RNA, 64 nt, hsa; identical to SEQ ID NO: 32555

SEQ ID NO: 705816 - RNA, 64 nt, hsa; identical to SEQ ID NO: 32556

SEQ ID NO: 705817 - RNA, 64 nt, hsa; identical to SEQ ID NO: 32557

SEQ ID NO: 705818 - RNA, 64 nt, hsa; identical to SEQ ID NO: 32558

SEQ ID NO: 705819 - RNA, 64 nt, hsa; identical to SEQ ID NO: 32559

SEQ ID NO: 705820 - RNA, 63 nt, hsa; identical to SEQ ID NO: 32560

SEQ ID NO: 705821 - RNA, 64 nt, hsa; identical to SEQ ID NO: 32561

SEQ ID NO: 705822 - RNA, 64 nt, hsa; identical to SEQ ID NO: 32562

SEQ ID NO: 705823 - RNA, 64 nt, hsa; identical to SEQ ID NO: 32563

SEQ ID NO: 705824 - RNA, 64 nt, hsa; identical to SEQ ID NO: 32564

SEQ ID NO: 705825 - RNA, 64 nt, hsa; identical to SEQ ID NO: 32565

SEQ ID NO: 705826 - RNA, 64 nt, hsa; identical to SEQ ID NO: 32566

SEQ ID NO: 705827 - RNA, 64 nt, hsa; identical to SEQ ID NO: 32567

SEQ ID NO: 705828 - RNA, 64 nt, hsa; identical to SEQ ID NO: 32568

SEQ ID NO: 705829 - RNA, 64 nt, hsa; identical to SEQ ID NO: 32569

SEQ ID NO: 705830 - RNA, 64 nt, hsa; identical to SEQ ID NO: 32570

SEQ ID NO: 705831 - RNA, 64 nt, hsa; identical to SEQ ID NO: 32571

SEQ ID NO: 705832 - RNA, 64 nt, hsa; identical to SEQ ID NO: 32572

SEQ ID NO: 705833 - RNA, 64 nt, hsa; identical to SEQ ID NO: 32573

SEQ ID NO: 705834 - RNA, 64 nt, hsa; identical to SEQ ID NO: 32574

SEQ ID NO: 705835 - RNA, 64 nt, hsa; identical to SEQ ID NO: 32575

SEQ ID NO: 705836 - RNA, 64 nt, hsa; identical to SEQ ID NO: 32576

SEQ ID NO: 705837 - RNA, 64 nt, hsa; identical to SEQ ID NO: 32577

SEQ ID NO: 705838 - RNA, 64 nt, hsa; identical to SEQ ID NO: 32578

SEQ ID NO: 705839 - RNA, 64 nt, hsa; identical to SEQ ID NO: 32579

SEQ ID NO: 705840 - RNA, 64 nt, hsa; identical to SEQ ID NO: 32580

SEQ ID NO: 705841 - RNA, 64 nt, hsa; identical to SEQ ID NO: 32581

SEQ ID NO: 705842 - RNA, 64 nt, hsa; identical to SEQ ID NO: 32582

SEQ ID NO: 705843 - RNA, 64 nt, hsa; identical to SEQ ID NO: 32583

SEQ ID NO: 705844 - RNA, 64 nt, hsa; identical to SEQ ID NO: 32584

SEQ ID NO: 705845 - RNA, 64 nt, hsa; identical to SEQ ID NO: 32585

SEQ ID NO: 705846 - RNA, 64 nt, hsa; identical to SEQ ID NO: 32586

SEQ ID NO: 705847 - RNA, 64 nt, hsa; identical to SEQ ID NO: 32587

SEQ ID NO: 705848 - RNA, 64 nt, hsa; identical to SEQ ID NO: 32588

SEQ ID NO: 705849 - RNA, 64 nt, hsa; identical to SEQ ID NO: 32589

SEQ ID NO: 705850 - RNA, 64 nt, hsa; identical to SEQ ID NO: 32590

SEQ ID NO: 705851 - RNA, 64 nt, hsa; identical to SEQ ID NO: 32591

SEQ ID NO: 705852 - RNA, 64 nt, hsa; identical to SEQ ID NO: 32592

SEQ ID NO: 705853 - RNA, 64 nt, hsa; identical to SEQ ID NO: 32593

SEQ ID NO: 705854 - RNA, 64 nt, hsa; identical to SEQ ID NO: 32594

SEQ ID NO: 705855 - RNA, 64 nt, hsa; identical to SEQ ID NO: 32595

SEQ ID NO: 705856 - RNA, 64 nt, hsa; identical to SEQ ID NO: 32596

SEQ ID NO: 705857 - RNA, 64 nt, hsa; identical to SEQ ID NO: 32597

SEQ ID NO: 705858 - RNA, 64 nt, hsa; identical to SEQ ID NO: 32598

SEQ ID NO: 705859 - RNA, 64 nt, hsa; identical to SEQ ID NO: 32599

SEQ ID NO: 705860 - RNA, 64 nt, hsa; identical to SEQ ID NO: 32600

SEQ ID NO: 705861 - RNA, 64 nt, hsa; identical to SEQ ID NO: 32601

SEQ ID NO: 705862 - RNA, 64 nt, hsa; identical to SEQ ID NO: 32602

SEQ ID NO: 705863 - RNA, 64 nt, hsa; identical to SEQ ID NO: 32603

SEQ ID NO: 705864 - RNA, 64 nt, hsa; identical to SEQ ID NO: 32604

SEQ ID NO: 705865 - RNA, 64 nt, hsa; identical to SEQ ID NO: 32605

SEQ ID NO: 705866 - RNA, 64 nt, hsa; identical to SEQ ID NO: 32606

SEQ ID NO: 705867 - RNA, 64 nt, hsa; identical to SEQ ID NO: 32607

SEQ ID NO: 705868 - RNA, 64 nt, hsa; identical to SEQ ID NO: 32608

SEQ ID NO: 705869 - RNA, 64 nt, hsa; identical to SEQ ID NO: 32609

SEQ ID NO: 705870 - RNA, 64 nt, hsa; identical to SEQ ID NO: 32610

SEQ ID NO: 705871 - RNA, 64 nt, hsa; identical to SEQ ID NO: 32611

SEQ ID NO: 705872 - RNA, 64 nt, hsa; identical to SEQ ID NO: 32612

SEQ ID NO: 705873 - RNA, 64 nt, hsa; identical to SEQ ID NO: 32613

SEQ ID NO: 705874 - RNA, 64 nt, hsa; identical to SEQ ID NO: 32614

SEQ ID NO: 705875 - RNA, 64 nt, hsa; identical to SEQ ID NO: 32615

SEQ ID NO: 705876 - RNA, 64 nt, hsa; identical to SEQ ID NO: 32616

SEQ ID NO: 705877 - RNA, 64 nt, hsa; identical to SEQ ID NO: 32617

SEQ ID NO: 705878 - RNA, 64 nt, hsa; identical to SEQ ID NO: 32618

SEQ ID NO: 705879 - RNA, 64 nt, hsa; identical to SEQ ID NO: 32619

SEQ ID NO: 705880 - RNA, 64 nt, hsa; identical to SEQ ID NO: 32620

SEQ ID NO: 705881 - RNA, 64 nt, hsa; identical to SEQ ID NO: 32621

SEQ ID NO: 705882 - RNA, 64 nt, hsa; identical to SEQ ID NO: 32622

SEQ ID NO: 705883 - RNA, 64 nt, hsa; identical to SEQ ID NO: 32623

SEQ ID NO: 705884 - RNA, 64 nt, hsa; identical to SEQ ID NO: 32624

SEQ ID NO: 705885 - RNA, 64 nt, hsa; identical to SEQ ID NO: 32625

SEQ ID NO: 705886 - RNA, 64 nt, hsa; identical to SEQ ID NO: 32626

SEQ ID NO: 705887 - RNA, 64 nt, hsa; identical to SEQ ID NO: 32627

SEQ ID NO: 705888 - RNA, 64 nt, hsa; identical to SEQ ID NO: 32628

SEQ ID NO: 705889 - RNA, 64 nt, hsa; identical to SEQ ID NO: 32629

SEQ ID NO: 705890 - RNA, 64 nt, hsa; identical to SEQ ID NO: 32630

SEQ ID NO: 705891 - RNA, 64 nt, hsa; identical to SEQ ID NO: 32631

SEQ ID NO: 705892 - RNA, 64 nt, hsa; identical to SEQ ID NO: 32632

SEQ ID NO: 705893 - RNA, 64 nt, hsa; identical to SEQ ID NO: 32633

SEQ ID NO: 705894 - RNA, 64 nt, hsa; identical to SEQ ID NO: 32634

SEQ ID NO: 705895 - RNA, 64 nt, hsa; identical to SEQ ID NO: 32635

SEQ ID NO: 705896 - RNA, 64 nt, hsa; identical to SEQ ID NO: 32636

SEQ ID NO: 705897 - RNA, 64 nt, hsa; identical to SEQ ID NO: 32637

SEQ ID NO: 705898 - RNA, 64 nt, hsa; identical to SEQ ID NO: 32638

SEQ ID NO: 705899 - RNA, 64 nt, hsa; identical to SEQ ID NO: 32639

SEQ ID NO: 705900 - RNA, 64 nt, hsa; identical to SEQ ID NO: 32640

SEQ ID NO: 705901 - RNA, 64 nt, hsa; identical to SEQ ID NO: 32641

SEQ ID NO: 705902 - RNA, 64 nt, hsa; identical to SEQ ID NO: 32642

SEQ ID NO: 705903 - RNA, 64 nt, hsa; identical to SEQ ID NO: 32643

SEQ ID NO: 705904 - RNA, 64 nt, hsa; identical to SEQ ID NO: 32644

SEQ ID NO: 705905 - RNA, 64 nt, hsa; identical to SEQ ID NO: 32645

SEQ ID NO: 705906 - RNA, 64 nt, hsa; identical to SEQ ID NO: 32646

SEQ ID NO: 705907 - RNA, 64 nt, hsa; identical to SEQ ID NO: 32647

SEQ ID NO: 705908 - RNA, 64 nt, hsa; identical to SEQ ID NO: 32648

SEQ ID NO: 705909 - RNA, 64 nt, hsa; identical to SEQ ID NO: 32649

SEQ ID NO: 705910 - RNA, 64 nt, hsa; identical to SEQ ID NO: 32650

SEQ ID NO: 705911 - RNA, 64 nt, hsa; identical to SEQ ID NO: 32651

SEQ ID NO: 705912 - RNA, 64 nt, hsa; identical to SEQ ID NO: 32652

SEQ ID NO: 705913 - RNA, 64 nt, hsa; identical to SEQ ID NO: 32653

SEQ ID NO: 705914 - RNA, 64 nt, hsa; identical to SEQ ID NO: 32654

SEQ ID NO: 705915 - RNA, 64 nt, hsa; identical to SEQ ID NO: 32655

SEQ ID NO: 705916 - RNA, 64 nt, hsa; identical to SEQ ID NO: 32656

SEQ ID NO: 705917 - RNA, 64 nt, hsa; identical to SEQ ID NO: 32657

SEQ ID NO: 705918 - RNA, 64 nt, hsa; identical to SEQ ID NO: 32658

SEQ ID NO: 705919 - RNA, 64 nt, hsa; identical to SEQ ID NO: 32659

SEQ ID NO: 705920 - RNA, 64 nt, hsa; identical to SEQ ID NO: 32660

SEQ ID NO: 705921 - RNA, 64 nt, hsa; identical to SEQ ID NO: 32661

SEQ ID NO: 705922 - RNA, 64 nt, hsa; identical to SEQ ID NO: 32662

SEQ ID NO: 705923 - RNA, 64 nt, hsa; identical to SEQ ID NO: 32663

SEQ ID NO: 705924 - RNA, 64 nt, hsa; identical to SEQ ID NO: 32664

SEQ ID NO: 705925 - RNA, 64 nt, hsa; identical to SEQ ID NO: 32665

SEQ ID NO: 705926 - RNA, 64 nt, hsa; identical to SEQ ID NO: 32666

SEQ ID NO: 705927 - RNA, 64 nt, hsa; identical to SEQ ID NO: 32667

SEQ ID NO: 705928 - RNA, 64 nt, hsa; identical to SEQ ID NO: 32668

SEQ ID NO: 705929 - RNA, 64 nt, hsa; identical to SEQ ID NO: 32669

SEQ ID NO: 705930 - RNA, 64 nt, hsa; identical to SEQ ID NO: 32670

SEQ ID NO: 705931 - RNA, 64 nt, hsa; identical to SEQ ID NO: 32671

SEQ ID NO: 705932 - RNA, 64 nt, hsa; identical to SEQ ID NO: 32672

SEQ ID NO: 705933 - RNA, 64 nt, hsa; identical to SEQ ID NO: 32673

SEQ ID NO: 705934 - RNA, 64 nt, hsa; identical to SEQ ID NO: 32674

SEQ ID NO: 705935 - RNA, 64 nt, hsa; identical to SEQ ID NO: 32675

SEQ ID NO: 705936 - RNA, 64 nt, hsa; identical to SEQ ID NO: 32676

SEQ ID NO: 705937 - RNA, 64 nt, hsa; identical to SEQ ID NO: 32677

SEQ ID NO: 705938 - RNA, 64 nt, hsa; identical to SEQ ID NO: 32678

SEQ ID NO: 705939 - RNA, 64 nt, hsa; identical to SEQ ID NO: 32679

SEQ ID NO: 705940 - RNA, 64 nt, hsa; identical to SEQ ID NO: 32680

SEQ ID NO: 705941 - RNA, 64 nt, hsa; identical to SEQ ID NO: 32681

SEQ ID NO: 705942 - RNA, 64 nt, hsa; identical to SEQ ID NO: 32682

SEQ ID NO: 705943 - RNA, 64 nt, hsa; identical to SEQ ID NO: 32683

SEQ ID NO: 705944 - RNA, 64 nt, hsa; identical to SEQ ID NO: 32684

SEQ ID NO: 705945 - RNA, 64 nt, hsa; identical to SEQ ID NO: 32685

SEQ ID NO: 705946 - RNA, 64 nt, hsa; identical to SEQ ID NO: 32686

SEQ ID NO: 705947 - RNA, 64 nt, hsa; identical to SEQ ID NO: 32687

SEQ ID NO: 705948 - RNA, 64 nt, hsa; identical to SEQ ID NO: 32688

SEQ ID NO: 705949 - RNA, 64 nt, hsa; identical to SEQ ID NO: 32689

SEQ ID NO: 705950 - RNA, 64 nt, hsa; identical to SEQ ID NO: 32690

SEQ ID NO: 705951 - RNA, 64 nt, hsa; identical to SEQ ID NO: 32691

SEQ ID NO: 705952 - RNA, 64 nt, hsa; identical to SEQ ID NO: 32692

SEQ ID NO: 705953 - RNA, 64 nt, hsa; identical to SEQ ID NO: 32693

SEQ ID NO: 705954 - RNA, 64 nt, hsa; identical to SEQ ID NO: 32694

SEQ ID NO: 705955 - RNA, 64 nt, hsa; identical to SEQ ID NO: 32695

SEQ ID NO: 705956 - RNA, 64 nt, hsa; identical to SEQ ID NO: 32696

SEQ ID NO: 705957 - RNA, 64 nt, hsa; identical to SEQ ID NO: 32697

SEQ ID NO: 705958 - RNA, 64 nt, hsa; identical to SEQ ID NO: 32698

SEQ ID NO: 705959 - RNA, 64 nt, hsa; identical to SEQ ID NO: 32699

SEQ ID NO: 705960 - RNA, 64 nt, hsa; identical to SEQ ID NO: 32700

SEQ ID NO: 705961 - RNA, 64 nt, hsa; identical to SEQ ID NO: 32701

SEQ ID NO: 705962 - RNA, 64 nt, hsa; identical to SEQ ID NO: 32702

SEQ ID NO: 705963 - RNA, 64 nt, hsa; identical to SEQ ID NO: 32703

SEQ ID NO: 705964 - RNA, 64 nt, hsa; identical to SEQ ID NO: 32704

SEQ ID NO: 705965 - RNA, 64 nt, hsa; identical to SEQ ID NO: 32705

SEQ ID NO: 705966 - RNA, 64 nt, hsa; identical to SEQ ID NO: 32706

SEQ ID NO: 705967 - RNA, 64 nt, hsa; identical to SEQ ID NO: 32707

SEQ ID NO: 705968 - RNA, 64 nt, hsa; identical to SEQ ID NO: 32708

SEQ ID NO: 705969 - RNA, 64 nt, hsa; identical to SEQ ID NO: 32709

SEQ ID NO: 705970 - RNA, 64 nt, hsa; identical to SEQ ID NO: 32710

SEQ ID NO: 705971 - RNA, 64 nt, hsa; identical to SEQ ID NO: 32711

SEQ ID NO: 705972 - RNA, 64 nt, hsa; identical to SEQ ID NO: 32712

SEQ ID NO: 705973 - RNA, 64 nt, hsa; identical to SEQ ID NO: 32713

SEQ ID NO: 705974 - RNA, 64 nt, hsa; identical to SEQ ID NO: 32714

SEQ ID NO: 705975 - RNA, 64 nt, hsa; identical to SEQ ID NO: 32715

SEQ ID NO: 705976 - RNA, 64 nt, hsa; identical to SEQ ID NO: 32716

SEQ ID NO: 705977 - RNA, 64 nt, hsa; identical to SEQ ID NO: 32717

SEQ ID NO: 705978 - RNA, 64 nt, hsa; identical to SEQ ID NO: 32718

SEQ ID NO: 705979 - RNA, 64 nt, hsa; identical to SEQ ID NO: 32719

SEQ ID NO: 705980 - RNA, 64 nt, hsa; identical to SEQ ID NO: 32720

SEQ ID NO: 705981 - RNA, 64 nt, hsa; identical to SEQ ID NO: 32721

SEQ ID NO: 705982 - RNA, 64 nt, hsa; identical to SEQ ID NO: 32722

SEQ ID NO: 705983 - RNA, 64 nt, hsa; identical to SEQ ID NO: 32723

SEQ ID NO: 705984 - RNA, 64 nt, hsa; identical to SEQ ID NO: 32724

SEQ ID NO: 705985 - RNA, 64 nt, hsa; identical to SEQ ID NO: 32725

SEQ ID NO: 705986 - RNA, 64 nt, hsa; identical to SEQ ID NO: 32726

SEQ ID NO: 705987 - RNA, 64 nt, hsa; identical to SEQ ID NO: 32727

SEQ ID NO: 705988 - RNA, 64 nt, hsa; identical to SEQ ID NO: 32728

SEQ ID NO: 705989 - RNA, 64 nt, hsa; identical to SEQ ID NO: 32729

SEQ ID NO: 705990 - RNA, 64 nt, hsa; identical to SEQ ID NO: 32730

SEQ ID NO: 705991 - RNA, 64 nt, hsa; identical to SEQ ID NO: 32731

SEQ ID NO: 705992 - RNA, 64 nt, hsa; identical to SEQ ID NO: 32732

SEQ ID NO: 705993 - RNA, 64 nt, hsa; identical to SEQ ID NO: 32733

SEQ ID NO: 705994 - RNA, 64 nt, hsa; identical to SEQ ID NO: 32734

SEQ ID NO: 705995 - RNA, 64 nt, hsa; identical to SEQ ID NO: 32735

SEQ ID NO: 705996 - RNA, 64 nt, hsa; identical to SEQ ID NO: 32736

SEQ ID NO: 705997 - RNA, 64 nt, hsa; identical to SEQ ID NO: 32737

SEQ ID NO: 705998 - RNA, 64 nt, hsa; identical to SEQ ID NO: 32738

SEQ ID NO: 705999 - RNA, 64 nt, hsa; identical to SEQ ID NO: 32739

SEQ ID NO: 706000 - RNA, 64 nt, hsa; identical to SEQ ID NO: 32740

SEQ ID NO: 706001 - RNA, 64 nt, hsa; identical to SEQ ID NO: 32741

SEQ ID NO: 706002 - RNA, 64 nt, hsa; identical to SEQ ID NO: 32742

SEQ ID NO: 706003 - RNA, 64 nt, hsa; identical to SEQ ID NO: 32743

SEQ ID NO: 706004 - RNA, 64 nt, hsa; identical to SEQ ID NO: 32744

SEQ ID NO: 706005 - RNA, 64 nt, hsa; identical to SEQ ID NO: 32745

SEQ ID NO: 706006 - RNA, 64 nt, hsa; identical to SEQ ID NO: 32746

SEQ ID NO: 706007 - RNA, 64 nt, hsa; identical to SEQ ID NO: 32747

SEQ ID NO: 706008 - RNA, 64 nt, hsa; identical to SEQ ID NO: 32748

SEQ ID NO: 706009 - RNA, 64 nt, hsa; identical to SEQ ID NO: 32749

SEQ ID NO: 706010 - RNA, 64 nt, hsa; identical to SEQ ID NO: 32750

SEQ ID NO: 706011 - RNA, 64 nt, hsa; identical to SEQ ID NO: 32751

SEQ ID NO: 706012 - RNA, 64 nt, hsa; identical to SEQ ID NO: 32752

SEQ ID NO: 706013 - RNA, 64 nt, hsa; identical to SEQ ID NO: 32753

SEQ ID NO: 706014 - RNA, 64 nt, hsa; identical to SEQ ID NO: 32754

SEQ ID NO: 706015 - RNA, 64 nt, hsa; identical to SEQ ID NO: 32755

SEQ ID NO: 706016 - RNA, 64 nt, hsa; identical to SEQ ID NO: 32756

SEQ ID NO: 706017 - RNA, 64 nt, hsa; identical to SEQ ID NO: 32757

SEQ ID NO: 706018 - RNA, 64 nt, hsa; identical to SEQ ID NO: 32758

SEQ ID NO: 706019 - RNA, 64 nt, hsa; identical to SEQ ID NO: 32759

SEQ ID NO: 706020 - RNA, 64 nt, hsa; identical to SEQ ID NO: 32760

SEQ ID NO: 706021 - RNA, 64 nt, hsa; identical to SEQ ID NO: 32761

SEQ ID NO: 706022 - RNA, 64 nt, hsa; identical to SEQ ID NO: 32762

SEQ ID NO: 706023 - RNA, 64 nt, hsa; identical to SEQ ID NO: 32763

SEQ ID NO: 706024 - RNA, 64 nt, hsa; identical to SEQ ID NO: 32764

SEQ ID NO: 706025 - RNA, 64 nt, hsa; identical to SEQ ID NO: 32765

SEQ ID NO: 706026 - RNA, 64 nt, hsa; identical to SEQ ID NO: 32766

SEQ ID NO: 706027 - RNA, 64 nt, hsa; identical to SEQ ID NO: 32767

SEQ ID NO: 706028 - RNA, 64 nt, hsa; identical to SEQ ID NO: 32768

SEQ ID NO: 706029 - RNA, 64 nt, hsa; identical to SEQ ID NO: 32769

SEQ ID NO: 706030 - RNA, 64 nt, hsa; identical to SEQ ID NO: 32770

SEQ ID NO: 706031 - RNA, 64 nt, hsa; identical to SEQ ID NO: 32771

SEQ ID NO: 706032 - RNA, 64 nt, hsa; identical to SEQ ID NO: 32772

SEQ ID NO: 706033 - RNA, 64 nt, hsa; identical to SEQ ID NO: 32773

SEQ ID NO: 706034 - RNA, 64 nt, hsa; identical to SEQ ID NO: 32774

SEQ ID NO: 706035 - RNA, 64 nt, hsa; identical to SEQ ID NO: 32775

SEQ ID NO: 706036 - RNA, 64 nt, hsa; identical to SEQ ID NO: 32776

SEQ ID NO: 706037 - RNA, 64 nt, hsa; identical to SEQ ID NO: 32777

SEQ ID NO: 706038 - RNA, 64 nt, hsa; identical to SEQ ID NO: 32778

SEQ ID NO: 706039 - RNA, 64 nt, hsa; identical to SEQ ID NO: 32779

SEQ ID NO: 706040 - RNA, 64 nt, hsa; identical to SEQ ID NO: 32780

SEQ ID NO: 706041 - RNA, 64 nt, hsa; identical to SEQ ID NO: 32781

SEQ ID NO: 706042 - RNA, 64 nt, hsa; identical to SEQ ID NO: 32782

SEQ ID NO: 706043 - RNA, 64 nt, hsa; identical to SEQ ID NO: 32783

SEQ ID NO: 706044 - RNA, 64 nt, hsa; identical to SEQ ID NO: 32784

SEQ ID NO: 706045 - RNA, 64 nt, hsa; identical to SEQ ID NO: 32785

SEQ ID NO: 706046 - RNA, 64 nt, hsa; identical to SEQ ID NO: 32786

SEQ ID NO: 706047 - RNA, 64 nt, hsa; identical to SEQ ID NO: 32787

SEQ ID NO: 706048 - RNA, 64 nt, hsa; identical to SEQ ID NO: 32788

SEQ ID NO: 706049 - RNA, 64 nt, hsa; identical to SEQ ID NO: 32789

SEQ ID NO: 706050 - RNA, 64 nt, hsa; identical to SEQ ID NO: 32790

SEQ ID NO: 706051 - RNA, 64 nt, hsa; identical to SEQ ID NO: 32791

SEQ ID NO: 706052 - RNA, 64 nt, hsa; identical to SEQ ID NO: 32792

SEQ ID NO: 706053 - RNA, 64 nt, hsa; identical to SEQ ID NO: 32793

SEQ ID NO: 706054 - RNA, 64 nt, hsa; identical to SEQ ID NO: 32794

SEQ ID NO: 706055 - RNA, 64 nt, hsa; identical to SEQ ID NO: 32795

SEQ ID NO: 706056 - RNA, 64 nt, hsa; identical to SEQ ID NO: 32796

SEQ ID NO: 706057 - RNA, 64 nt, hsa; identical to SEQ ID NO: 32797

SEQ ID NO: 706058 - RNA, 64 nt, hsa; identical to SEQ ID NO: 32798

SEQ ID NO: 706059 - RNA, 64 nt, hsa; identical to SEQ ID NO: 32799

SEQ ID NO: 706060 - RNA, 64 nt, hsa; identical to SEQ ID NO: 32800

SEQ ID NO: 706061 - RNA, 64 nt, hsa; identical to SEQ ID NO: 32801

SEQ ID NO: 706062 - RNA, 64 nt, hsa; identical to SEQ ID NO: 32802

SEQ ID NO: 706063 - RNA, 64 nt, hsa; identical to SEQ ID NO: 32803

SEQ ID NO: 706064 - RNA, 64 nt, hsa; identical to SEQ ID NO: 32804

SEQ ID NO: 706065 - RNA, 64 nt, hsa; identical to SEQ ID NO: 32805

SEQ ID NO: 706066 - RNA, 64 nt, hsa; identical to SEQ ID NO: 32806

SEQ ID NO: 706067 - RNA, 64 nt, hsa; identical to SEQ ID NO: 32807

SEQ ID NO: 706068 - RNA, 64 nt, hsa; identical to SEQ ID NO: 32808

SEQ ID NO: 706069 - RNA, 64 nt, hsa; identical to SEQ ID NO: 32809

SEQ ID NO: 706070 - RNA, 64 nt, hsa; identical to SEQ ID NO: 32810

SEQ ID NO: 706071 - RNA, 64 nt, hsa; identical to SEQ ID NO: 32811

SEQ ID NO: 706072 - RNA, 64 nt, hsa; identical to SEQ ID NO: 32812

SEQ ID NO: 706073 - RNA, 64 nt, hsa; identical to SEQ ID NO: 32813

SEQ ID NO: 706074 - RNA, 64 nt, hsa; identical to SEQ ID NO: 32814

SEQ ID NO: 706075 - RNA, 64 nt, hsa; identical to SEQ ID NO: 32815

SEQ ID NO: 706076 - RNA, 64 nt, hsa; identical to SEQ ID NO: 32816

SEQ ID NO: 706077 - RNA, 64 nt, hsa; identical to SEQ ID NO: 32817

SEQ ID NO: 706078 - RNA, 64 nt, hsa; identical to SEQ ID NO: 32818

SEQ ID NO: 706079 - RNA, 64 nt, hsa; identical to SEQ ID NO: 32819

SEQ ID NO: 706080 - RNA, 64 nt, hsa; identical to SEQ ID NO: 32820

SEQ ID NO: 706081 - RNA, 64 nt, hsa; identical to SEQ ID NO: 32821

SEQ ID NO: 706082 - RNA, 64 nt, hsa; identical to SEQ ID NO: 32822

SEQ ID NO: 706083 - RNA, 64 nt, hsa; identical to SEQ ID NO: 32823

SEQ ID NO: 706084 - RNA, 64 nt, hsa; identical to SEQ ID NO: 32824

SEQ ID NO: 706085 - RNA, 64 nt, hsa; identical to SEQ ID NO: 32825

SEQ ID NO: 706086 - RNA, 64 nt, hsa; identical to SEQ ID NO: 32826

SEQ ID NO: 706087 - RNA, 64 nt, hsa; identical to SEQ ID NO: 32827

SEQ ID NO: 706088 - RNA, 64 nt, hsa; identical to SEQ ID NO: 32828

SEQ ID NO: 706089 - RNA, 64 nt, hsa; identical to SEQ ID NO: 32829

SEQ ID NO: 706090 - RNA, 64 nt, hsa; identical to SEQ ID NO: 32830

SEQ ID NO: 706091 - RNA, 64 nt, hsa; identical to SEQ ID NO: 32831

SEQ ID NO: 706092 - RNA, 64 nt, hsa; identical to SEQ ID NO: 32832

SEQ ID NO: 706093 - RNA, 64 nt, hsa; identical to SEQ ID NO: 32833

SEQ ID NO: 706094 - RNA, 64 nt, hsa; identical to SEQ ID NO: 32834

SEQ ID NO: 706095 - RNA, 64 nt, hsa; identical to SEQ ID NO: 32835

SEQ ID NO: 706096 - RNA, 64 nt, hsa; identical to SEQ ID NO: 32836

SEQ ID NO: 706097 - RNA, 64 nt, hsa; identical to SEQ ID NO: 32837

SEQ ID NO: 706098 - RNA, 64 nt, hsa; identical to SEQ ID NO: 32838

SEQ ID NO: 706099 - RNA, 64 nt, hsa; identical to SEQ ID NO: 32839

SEQ ID NO: 706100 - RNA, 64 nt, hsa; identical to SEQ ID NO: 32840

SEQ ID NO: 706101 - RNA, 64 nt, hsa; identical to SEQ ID NO: 32841

SEQ ID NO: 706102 - RNA, 64 nt, hsa; identical to SEQ ID NO: 32842

SEQ ID NO: 706103 - RNA, 64 nt, hsa; identical to SEQ ID NO: 32843

SEQ ID NO: 706104 - RNA, 64 nt, hsa; identical to SEQ ID NO: 32844

SEQ ID NO: 706105 - RNA, 64 nt, hsa; identical to SEQ ID NO: 32845

SEQ ID NO: 706106 - RNA, 64 nt, hsa; identical to SEQ ID NO: 32846

SEQ ID NO: 706107 - RNA, 64 nt, hsa; identical to SEQ ID NO: 32847

SEQ ID NO: 706108 - RNA, 64 nt, hsa; identical to SEQ ID NO: 32848

SEQ ID NO: 706109 - RNA, 64 nt, hsa; identical to SEQ ID NO: 32849

SEQ ID NO: 706110 - RNA, 64 nt, hsa; identical to SEQ ID NO: 32850

SEQ ID NO: 706111 - RNA, 64 nt, hsa; identical to SEQ ID NO: 32851

SEQ ID NO: 706112 - RNA, 53 nt, hsa; identical to SEQ ID NO: 32852

SEQ ID NO: 706113 - RNA, 52 nt, hsa; identical to SEQ ID NO: 32853

SEQ ID NO: 706114 - RNA, 51 nt, hsa; identical to SEQ ID NO: 32854

SEQ ID NO: 706115 - RNA, 50 nt, hsa; identical to SEQ ID NO: 32855

SEQ ID NO: 706116 - RNA, 64 nt, hsa; identical to SEQ ID NO: 32856

SEQ ID NO: 706117 - RNA, 64 nt, hsa; identical to SEQ ID NO: 32857

SEQ ID NO: 706118 - RNA, 64 nt, hsa; identical to SEQ ID NO: 32858

SEQ ID NO: 706119 - RNA, 64 nt, hsa; identical to SEQ ID NO: 32859

SEQ ID NO: 706120 - RNA, 64 nt, hsa; identical to SEQ ID NO: 32860

SEQ ID NO: 706121 - RNA, 64 nt, hsa; identical to SEQ ID NO: 32861

SEQ ID NO: 706122 - RNA, 64 nt, hsa; identical to SEQ ID NO: 32862

SEQ ID NO: 706123 - RNA, 64 nt, hsa; identical to SEQ ID NO: 32863

SEQ ID NO: 706124 - RNA, 64 nt, hsa; identical to SEQ ID NO: 32864

SEQ ID NO: 706125 - RNA, 64 nt, hsa; identical to SEQ ID NO: 32865

SEQ ID NO: 706126 - RNA, 64 nt, hsa; identical to SEQ ID NO: 32866

SEQ ID NO: 706127 - RNA, 64 nt, hsa; identical to SEQ ID NO: 32867

SEQ ID NO: 706128 - RNA, 64 nt, hsa; identical to SEQ ID NO: 32868

SEQ ID NO: 706129 - RNA, 64 nt, hsa; identical to SEQ ID NO: 32869

SEQ ID NO: 706130 - RNA, 64 nt, hsa; identical to SEQ ID NO: 32870

SEQ ID NO: 706131 - RNA, 64 nt, hsa; identical to SEQ ID NO: 32871

SEQ ID NO: 706132 - RNA, 64 nt, hsa; identical to SEQ ID NO: 32872

SEQ ID NO: 706133 - RNA, 64 nt, hsa; identical to SEQ ID NO: 32873

SEQ ID NO: 706134 - RNA, 64 nt, hsa; identical to SEQ ID NO: 32874

SEQ ID NO: 706135 - RNA, 64 nt, hsa; identical to SEQ ID NO: 32875

SEQ ID NO: 706136 - RNA, 64 nt, hsa; identical to SEQ ID NO: 32876

SEQ ID NO: 706137 - RNA, 64 nt, hsa; identical to SEQ ID NO: 32877

SEQ ID NO: 706138 - RNA, 64 nt, hsa; identical to SEQ ID NO: 32878

SEQ ID NO: 706139 - RNA, 64 nt, hsa; identical to SEQ ID NO: 32879

SEQ ID NO: 706140 - RNA, 64 nt, hsa; identical to SEQ ID NO: 32880

SEQ ID NO: 706141 - RNA, 64 nt, hsa; identical to SEQ ID NO: 32881

SEQ ID NO: 706142 - RNA, 64 nt, hsa; identical to SEQ ID NO: 32882

SEQ ID NO: 706143 - RNA, 64 nt, hsa; identical to SEQ ID NO: 32883

SEQ ID NO: 706144 - RNA, 64 nt, hsa; identical to SEQ ID NO: 32884

SEQ ID NO: 706145 - RNA, 64 nt, hsa; identical to SEQ ID NO: 32885

SEQ ID NO: 706146 - RNA, 64 nt, hsa; identical to SEQ ID NO: 32886

SEQ ID NO: 706147 - RNA, 64 nt, hsa; identical to SEQ ID NO: 32887

SEQ ID NO: 706148 - RNA, 64 nt, hsa; identical to SEQ ID NO: 32888

SEQ ID NO: 706149 - RNA, 64 nt, hsa; identical to SEQ ID NO: 32889

SEQ ID NO: 706150 - RNA, 64 nt, hsa; identical to SEQ ID NO: 32890

SEQ ID NO: 706151 - RNA, 64 nt, hsa; identical to SEQ ID NO: 32891

SEQ ID NO: 706152 - RNA, 64 nt, hsa; identical to SEQ ID NO: 32892

SEQ ID NO: 706153 - RNA, 64 nt, hsa; identical to SEQ ID NO: 32893

SEQ ID NO: 706154 - RNA, 64 nt, hsa; identical to SEQ ID NO: 32894

SEQ ID NO: 706155 - RNA, 64 nt, hsa; identical to SEQ ID NO: 32895

SEQ ID NO: 706156 - RNA, 64 nt, hsa; identical to SEQ ID NO: 32896

SEQ ID NO: 706157 - RNA, 64 nt, hsa; identical to SEQ ID NO: 32897

SEQ ID NO: 706158 - RNA, 64 nt, hsa; identical to SEQ ID NO: 32898

SEQ ID NO: 706159 - RNA, 64 nt, hsa; identical to SEQ ID NO: 32899

SEQ ID NO: 706160 - RNA, 64 nt, hsa; identical to SEQ ID NO: 32900

SEQ ID NO: 706161 - RNA, 64 nt, hsa; identical to SEQ ID NO: 32901

SEQ ID NO: 706162 - RNA, 64 nt, hsa; identical to SEQ ID NO: 32902

SEQ ID NO: 706163 - RNA, 64 nt, hsa; identical to SEQ ID NO: 32903

SEQ ID NO: 706164 - RNA, 64 nt, hsa; identical to SEQ ID NO: 32904

SEQ ID NO: 706165 - RNA, 64 nt, hsa; identical to SEQ ID NO: 32905

SEQ ID NO: 706166 - RNA, 64 nt, hsa; identical to SEQ ID NO: 32906

SEQ ID NO: 706167 - RNA, 64 nt, hsa; identical to SEQ ID NO: 32907

SEQ ID NO: 706168 - RNA, 64 nt, hsa; identical to SEQ ID NO: 32908

SEQ ID NO: 706169 - RNA, 64 nt, hsa; identical to SEQ ID NO: 32909

SEQ ID NO: 706170 - RNA, 64 nt, hsa; identical to SEQ ID NO: 32910

SEQ ID NO: 706171 - RNA, 64 nt, hsa; identical to SEQ ID NO: 32911

SEQ ID NO: 706172 - RNA, 64 nt, hsa; identical to SEQ ID NO: 32912

SEQ ID NO: 706173 - RNA, 64 nt, hsa; identical to SEQ ID NO: 32913

SEQ ID NO: 706174 - RNA, 64 nt, hsa; identical to SEQ ID NO: 32914

SEQ ID NO: 706175 - RNA, 64 nt, hsa; identical to SEQ ID NO: 32915

SEQ ID NO: 706176 - RNA, 64 nt, hsa; identical to SEQ ID NO: 32916

SEQ ID NO: 706177 - RNA, 64 nt, hsa; identical to SEQ ID NO: 32917

SEQ ID NO: 706178 - RNA, 64 nt, hsa; identical to SEQ ID NO: 32918

SEQ ID NO: 706179 - RNA, 64 nt, hsa; identical to SEQ ID NO: 32919

SEQ ID NO: 706180 - RNA, 64 nt, hsa; identical to SEQ ID NO: 32920

SEQ ID NO: 706181 - RNA, 64 nt, hsa; identical to SEQ ID NO: 32921

SEQ ID NO: 706182 - RNA, 64 nt, hsa; identical to SEQ ID NO: 32922

SEQ ID NO: 706183 - RNA, 64 nt, hsa; identical to SEQ ID NO: 32923

SEQ ID NO: 706184 - RNA, 64 nt, hsa; identical to SEQ ID NO: 32924

SEQ ID NO: 706185 - RNA, 64 nt, hsa; identical to SEQ ID NO: 32925

SEQ ID NO: 706186 - RNA, 64 nt, hsa; identical to SEQ ID NO: 32926

SEQ ID NO: 706187 - RNA, 64 nt, hsa; identical to SEQ ID NO: 32927

SEQ ID NO: 706188 - RNA, 64 nt, hsa; identical to SEQ ID NO: 32928

SEQ ID NO: 706189 - RNA, 64 nt, hsa; identical to SEQ ID NO: 32929

SEQ ID NO: 706190 - RNA, 64 nt, hsa; identical to SEQ ID NO: 32930

SEQ ID NO: 706191 - RNA, 64 nt, hsa; identical to SEQ ID NO: 32931

SEQ ID NO: 706192 - RNA, 64 nt, hsa; identical to SEQ ID NO: 32932

SEQ ID NO: 706193 - RNA, 64 nt, hsa; identical to SEQ ID NO: 32933

SEQ ID NO: 706194 - RNA, 64 nt, hsa; identical to SEQ ID NO: 32934

SEQ ID NO: 706195 - RNA, 64 nt, hsa; identical to SEQ ID NO: 32935

SEQ ID NO: 706196 - RNA, 64 nt, hsa; identical to SEQ ID NO: 32936

SEQ ID NO: 706197 - RNA, 64 nt, hsa; identical to SEQ ID NO: 32937

SEQ ID NO: 706198 - RNA, 64 nt, hsa; identical to SEQ ID NO: 32938

SEQ ID NO: 706199 - RNA, 64 nt, hsa; identical to SEQ ID NO: 32939

SEQ ID NO: 706200 - RNA, 64 nt, hsa; identical to SEQ ID NO: 32940

SEQ ID NO: 706201 - RNA, 64 nt, hsa; identical to SEQ ID NO: 32941

SEQ ID NO: 706202 - RNA, 64 nt, hsa; identical to SEQ ID NO: 32942

SEQ ID NO: 706203 - RNA, 64 nt, hsa; identical to SEQ ID NO: 32943

SEQ ID NO: 706204 - RNA, 64 nt, hsa; identical to SEQ ID NO: 32944

SEQ ID NO: 706205 - RNA, 64 nt, hsa; identical to SEQ ID NO: 32945

SEQ ID NO: 706206 - RNA, 64 nt, hsa; identical to SEQ ID NO: 32946

SEQ ID NO: 706207 - RNA, 64 nt, hsa; identical to SEQ ID NO: 32947

SEQ ID NO: 706208 - RNA, 64 nt, hsa; identical to SEQ ID NO: 32948

SEQ ID NO: 706209 - RNA, 64 nt, hsa; identical to SEQ ID NO: 32949

SEQ ID NO: 706210 - RNA, 64 nt, hsa; identical to SEQ ID NO: 32950

SEQ ID NO: 706211 - RNA, 64 nt, hsa; identical to SEQ ID NO: 32951

SEQ ID NO: 706212 - RNA, 64 nt, hsa; identical to SEQ ID NO: 32952

SEQ ID NO: 706213 - RNA, 64 nt, hsa; identical to SEQ ID NO: 32953

SEQ ID NO: 706214 - RNA, 64 nt, hsa; identical to SEQ ID NO: 32954

SEQ ID NO: 706215 - RNA, 64 nt, hsa; identical to SEQ ID NO: 32955

SEQ ID NO: 706216 - RNA, 64 nt, hsa; identical to SEQ ID NO: 32956

SEQ ID NO: 706217 - RNA, 64 nt, hsa; identical to SEQ ID NO: 32957

SEQ ID NO: 706218 - RNA, 64 nt, hsa; identical to SEQ ID NO: 32958

SEQ ID NO: 706219 - RNA, 64 nt, hsa; identical to SEQ ID NO: 32959

SEQ ID NO: 706220 - RNA, 64 nt, hsa; identical to SEQ ID NO: 32960

SEQ ID NO: 706221 - RNA, 64 nt, hsa; identical to SEQ ID NO: 32961

SEQ ID NO: 706222 - RNA, 64 nt, hsa; identical to SEQ ID NO: 32962

SEQ ID NO: 706223 - RNA, 64 nt, hsa; identical to SEQ ID NO: 32963

SEQ ID NO: 706224 - RNA, 64 nt, hsa; identical to SEQ ID NO: 32964

SEQ ID NO: 706225 - RNA, 64 nt, hsa; identical to SEQ ID NO: 32965

SEQ ID NO: 706226 - RNA, 64 nt, hsa; identical to SEQ ID NO: 32966

SEQ ID NO: 706227 - RNA, 64 nt, hsa; identical to SEQ ID NO: 32967

SEQ ID NO: 706228 - RNA, 64 nt, hsa; identical to SEQ ID NO: 32968

SEQ ID NO: 706229 - RNA, 64 nt, hsa; identical to SEQ ID NO: 32969

SEQ ID NO: 706230 - RNA, 64 nt, hsa; identical to SEQ ID NO: 32970

SEQ ID NO: 706231 - RNA, 64 nt, hsa; identical to SEQ ID NO: 32971

SEQ ID NO: 706232 - RNA, 64 nt, hsa; identical to SEQ ID NO: 32972

SEQ ID NO: 706233 - RNA, 64 nt, hsa; identical to SEQ ID NO: 32973

SEQ ID NO: 706234 - RNA, 64 nt, hsa; identical to SEQ ID NO: 32974

SEQ ID NO: 706235 - RNA, 64 nt, hsa; identical to SEQ ID NO: 32975

SEQ ID NO: 706236 - RNA, 64 nt, hsa; identical to SEQ ID NO: 32976

SEQ ID NO: 706237 - RNA, 64 nt, hsa; identical to SEQ ID NO: 32977

SEQ ID NO: 706238 - RNA, 64 nt, hsa; identical to SEQ ID NO: 32978

SEQ ID NO: 706239 - RNA, 64 nt, hsa; identical to SEQ ID NO: 32979

SEQ ID NO: 706240 - RNA, 64 nt, hsa; identical to SEQ ID NO: 32980

SEQ ID NO: 706241 - RNA, 64 nt, hsa; identical to SEQ ID NO: 32981

SEQ ID NO: 706242 - RNA, 64 nt, hsa; identical to SEQ ID NO: 32982

SEQ ID NO: 706243 - RNA, 64 nt, hsa; identical to SEQ ID NO: 32983

SEQ ID NO: 706244 - RNA, 64 nt, hsa; identical to SEQ ID NO: 32984

SEQ ID NO: 706245 - RNA, 64 nt, hsa; identical to SEQ ID NO: 32985

SEQ ID NO: 706246 - RNA, 64 nt, hsa; identical to SEQ ID NO: 32986

SEQ ID NO: 706247 - RNA, 64 nt, hsa; identical to SEQ ID NO: 32987

SEQ ID NO: 706248 - RNA, 64 nt, hsa; identical to SEQ ID NO: 32988

SEQ ID NO: 706249 - RNA, 64 nt, hsa; identical to SEQ ID NO: 32989

SEQ ID NO: 706250 - RNA, 64 nt, hsa; identical to SEQ ID NO: 32990

SEQ ID NO: 706251 - RNA, 64 nt, hsa; identical to SEQ ID NO: 32991

SEQ ID NO: 706252 - RNA, 64 nt, hsa; identical to SEQ ID NO: 32992

SEQ ID NO: 706253 - RNA, 64 nt, hsa; identical to SEQ ID NO: 32993

SEQ ID NO: 706254 - RNA, 64 nt, hsa; identical to SEQ ID NO: 32994

SEQ ID NO: 706255 - RNA, 64 nt, hsa; identical to SEQ ID NO: 32995

SEQ ID NO: 706256 - RNA, 64 nt, hsa; identical to SEQ ID NO: 32996

SEQ ID NO: 706257 - RNA, 64 nt, hsa; identical to SEQ ID NO: 32997

SEQ ID NO: 706258 - RNA, 64 nt, hsa; identical to SEQ ID NO: 32998

SEQ ID NO: 706259 - RNA, 64 nt, hsa; identical to SEQ ID NO: 32999

SEQ ID NO: 706260 - RNA, 64 nt, hsa; identical to SEQ ID NO: 33000

SEQ ID NO: 706261 - RNA, 64 nt, hsa; identical to SEQ ID NO: 33001

SEQ ID NO: 706262 - RNA, 64 nt, hsa; identical to SEQ ID NO: 33002

SEQ ID NO: 706263 - RNA, 64 nt, hsa; identical to SEQ ID NO: 33003

SEQ ID NO: 706264 - RNA, 64 nt, hsa; identical to SEQ ID NO: 33004

SEQ ID NO: 706265 - RNA, 64 nt, hsa; identical to SEQ ID NO: 33005

SEQ ID NO: 706266 - RNA, 64 nt, hsa; identical to SEQ ID NO: 33006

SEQ ID NO: 706267 - RNA, 64 nt, hsa; identical to SEQ ID NO: 33007

SEQ ID NO: 706268 - RNA, 64 nt, hsa; identical to SEQ ID NO: 33008

SEQ ID NO: 706269 - RNA, 64 nt, hsa; identical to SEQ ID NO: 33009

SEQ ID NO: 706270 - RNA, 64 nt, hsa; identical to SEQ ID NO: 33010

SEQ ID NO: 706271 - RNA, 64 nt, hsa; identical to SEQ ID NO: 33011

SEQ ID NO: 706272 - RNA, 64 nt, hsa; identical to SEQ ID NO: 33012

SEQ ID NO: 706273 - RNA, 64 nt, hsa; identical to SEQ ID NO: 33013

SEQ ID NO: 706274 - RNA, 64 nt, hsa; identical to SEQ ID NO: 33014

SEQ ID NO: 706275 - RNA, 64 nt, hsa; identical to SEQ ID NO: 33015

SEQ ID NO: 706276 - RNA, 64 nt, hsa; identical to SEQ ID NO: 33016

SEQ ID NO: 706277 - RNA, 64 nt, hsa; identical to SEQ ID NO: 33017

SEQ ID NO: 706278 - RNA, 64 nt, hsa; identical to SEQ ID NO: 33018

SEQ ID NO: 706279 - RNA, 64 nt, hsa; identical to SEQ ID NO: 33019

SEQ ID NO: 706280 - RNA, 64 nt, hsa; identical to SEQ ID NO: 33020

SEQ ID NO: 706281 - RNA, 64 nt, hsa; identical to SEQ ID NO: 33021

SEQ ID NO: 706282 - RNA, 64 nt, hsa; identical to SEQ ID NO: 33022

SEQ ID NO: 706283 - RNA, 64 nt, hsa; identical to SEQ ID NO: 33023

SEQ ID NO: 706284 - RNA, 64 nt, hsa; identical to SEQ ID NO: 33024

SEQ ID NO: 706285 - RNA, 64 nt, hsa; identical to SEQ ID NO: 33025

SEQ ID NO: 706286 - RNA, 64 nt, hsa; identical to SEQ ID NO: 33026

SEQ ID NO: 706287 - RNA, 64 nt, hsa; identical to SEQ ID NO: 33027

SEQ ID NO: 706288 - RNA, 64 nt, hsa; identical to SEQ ID NO: 33028

SEQ ID NO: 706289 - RNA, 64 nt, hsa; identical to SEQ ID NO: 33029

SEQ ID NO: 706290 - RNA, 64 nt, hsa; identical to SEQ ID NO: 33030

SEQ ID NO: 706291 - RNA, 64 nt, hsa; identical to SEQ ID NO: 33031

SEQ ID NO: 706292 - RNA, 64 nt, hsa; identical to SEQ ID NO: 33032

SEQ ID NO: 706293 - RNA, 64 nt, hsa; identical to SEQ ID NO: 33033

SEQ ID NO: 706294 - RNA, 64 nt, hsa; identical to SEQ ID NO: 33034

SEQ ID NO: 706295 - RNA, 64 nt, hsa; identical to SEQ ID NO: 33035

SEQ ID NO: 706296 - RNA, 64 nt, hsa; identical to SEQ ID NO: 33036

SEQ ID NO: 706297 - RNA, 64 nt, hsa; identical to SEQ ID NO: 33037

SEQ ID NO: 706298 - RNA, 64 nt, hsa; identical to SEQ ID NO: 33038

SEQ ID NO: 706299 - RNA, 64 nt, hsa; identical to SEQ ID NO: 33039

SEQ ID NO: 706300 - RNA, 64 nt, hsa; identical to SEQ ID NO: 33040

SEQ ID NO: 706301 - RNA, 64 nt, hsa; identical to SEQ ID NO: 33041

SEQ ID NO: 706302 - RNA, 64 nt, hsa; identical to SEQ ID NO: 33042

SEQ ID NO: 706303 - RNA, 64 nt, hsa; identical to SEQ ID NO: 33043

SEQ ID NO: 706304 - RNA, 64 nt, hsa; identical to SEQ ID NO: 33044

SEQ ID NO: 706305 - RNA, 64 nt, hsa; identical to SEQ ID NO: 33045

SEQ ID NO: 706306 - RNA, 64 nt, hsa; identical to SEQ ID NO: 33046

SEQ ID NO: 706307 - RNA, 64 nt, hsa; identical to SEQ ID NO: 33047

SEQ ID NO: 706308 - RNA, 64 nt, hsa; identical to SEQ ID NO: 33048

SEQ ID NO: 706309 - RNA, 64 nt, hsa; identical to SEQ ID NO: 33049

SEQ ID NO: 706310 - RNA, 64 nt, hsa; identical to SEQ ID NO: 33050

SEQ ID NO: 706311 - RNA, 64 nt, hsa; identical to SEQ ID NO: 33051

SEQ ID NO: 706312 - RNA, 64 nt, hsa; identical to SEQ ID NO: 33052

SEQ ID NO: 706313 - RNA, 64 nt, hsa; identical to SEQ ID NO: 33053

SEQ ID NO: 706314 - RNA, 64 nt, hsa; identical to SEQ ID NO: 33054

SEQ ID NO: 706315 - RNA, 64 nt, hsa; identical to SEQ ID NO: 33055

SEQ ID NO: 706316 - RNA, 64 nt, hsa; identical to SEQ ID NO: 33056

SEQ ID NO: 706317 - RNA, 64 nt, hsa; identical to SEQ ID NO: 33057

SEQ ID NO: 706318 - RNA, 64 nt, hsa; identical to SEQ ID NO: 33058

SEQ ID NO: 706319 - RNA, 64 nt, hsa; identical to SEQ ID NO: 33059

SEQ ID NO: 706320 - RNA, 64 nt, hsa; identical to SEQ ID NO: 33060

SEQ ID NO: 706321 - RNA, 64 nt, hsa; identical to SEQ ID NO: 33061

SEQ ID NO: 706322 - RNA, 64 nt, hsa; identical to SEQ ID NO: 33062

SEQ ID NO: 706323 - RNA, 64 nt, hsa; identical to SEQ ID NO: 33063

SEQ ID NO: 706324 - RNA, 64 nt, hsa; identical to SEQ ID NO: 33064

SEQ ID NO: 706325 - RNA, 64 nt, hsa; identical to SEQ ID NO: 33065

SEQ ID NO: 706326 - RNA, 64 nt, hsa; identical to SEQ ID NO: 33066

SEQ ID NO: 706327 - RNA, 58 nt, hsa; identical to SEQ ID NO: 33067

SEQ ID NO: 706328 - RNA, 59 nt, hsa; identical to SEQ ID NO: 33068

SEQ ID NO: 706329 - RNA, 60 nt, hsa; identical to SEQ ID NO: 33069

SEQ ID NO: 706330 - RNA, 61 nt, hsa; identical to SEQ ID NO: 33070

SEQ ID NO: 706331 - RNA, 64 nt, hsa; identical to SEQ ID NO: 33071

SEQ ID NO: 706332 - RNA, 64 nt, hsa; identical to SEQ ID NO: 33072

SEQ ID NO: 706333 - RNA, 64 nt, hsa; identical to SEQ ID NO: 33073

SEQ ID NO: 706334 - RNA, 64 nt, hsa; identical to SEQ ID NO: 33074

SEQ ID NO: 706335 - RNA, 64 nt, hsa; identical to SEQ ID NO: 33075

SEQ ID NO: 706336 - RNA, 64 nt, hsa; identical to SEQ ID NO: 33076

SEQ ID NO: 706337 - RNA, 64 nt, hsa; identical to SEQ ID NO: 33077

SEQ ID NO: 706338 - RNA, 64 nt, hsa; identical to SEQ ID NO: 33078

SEQ ID NO: 706339 - RNA, 64 nt, hsa; identical to SEQ ID NO: 33079

SEQ ID NO: 706340 - RNA, 64 nt, hsa; identical to SEQ ID NO: 33080

SEQ ID NO: 706341 - RNA, 64 nt, hsa; identical to SEQ ID NO: 33081

SEQ ID NO: 706342 - RNA, 64 nt, hsa; identical to SEQ ID NO: 33082

SEQ ID NO: 706343 - RNA, 64 nt, hsa; identical to SEQ ID NO: 33083

SEQ ID NO: 706344 - RNA, 64 nt, hsa; identical to SEQ ID NO: 33084

SEQ ID NO: 706345 - RNA, 64 nt, hsa; identical to SEQ ID NO: 33085

SEQ ID NO: 706346 - RNA, 64 nt, hsa; identical to SEQ ID NO: 33086

SEQ ID NO: 706347 - RNA, 64 nt, hsa; identical to SEQ ID NO: 33087

SEQ ID NO: 706348 - RNA, 64 nt, hsa; identical to SEQ ID NO: 33088

SEQ ID NO: 706349 - RNA, 64 nt, hsa; identical to SEQ ID NO: 33089

SEQ ID NO: 706350 - RNA, 64 nt, hsa; identical to SEQ ID NO: 33090

SEQ ID NO: 706351 - RNA, 64 nt, hsa; identical to SEQ ID NO: 33091

SEQ ID NO: 706352 - RNA, 64 nt, hsa; identical to SEQ ID NO: 33092

SEQ ID NO: 706353 - RNA, 64 nt, hsa; identical to SEQ ID NO: 33093

SEQ ID NO: 706354 - RNA, 64 nt, hsa; identical to SEQ ID NO: 33094

SEQ ID NO: 706355 - RNA, 64 nt, hsa; identical to SEQ ID NO: 33095

SEQ ID NO: 706356 - RNA, 64 nt, hsa; identical to SEQ ID NO: 33096

SEQ ID NO: 706357 - RNA, 64 nt, hsa; identical to SEQ ID NO: 33097

SEQ ID NO: 706358 - RNA, 64 nt, hsa; identical to SEQ ID NO: 33098

SEQ ID NO: 706359 - RNA, 64 nt, hsa; identical to SEQ ID NO: 33099

SEQ ID NO: 706360 - RNA, 64 nt, hsa; identical to SEQ ID NO: 33100

SEQ ID NO: 706361 - RNA, 64 nt, hsa; identical to SEQ ID NO: 33101

SEQ ID NO: 706362 - RNA, 64 nt, hsa; identical to SEQ ID NO: 33102

SEQ ID NO: 706363 - RNA, 64 nt, hsa; identical to SEQ ID NO: 33103

SEQ ID NO: 706364 - RNA, 64 nt, hsa; identical to SEQ ID NO: 33104

SEQ ID NO: 706365 - RNA, 64 nt, hsa; identical to SEQ ID NO: 33105

SEQ ID NO: 706366 - RNA, 64 nt, hsa; identical to SEQ ID NO: 33106

SEQ ID NO: 706367 - RNA, 64 nt, hsa; identical to SEQ ID NO: 33107

SEQ ID NO: 706368 - RNA, 64 nt, hsa; identical to SEQ ID NO: 33108

SEQ ID NO: 706369 - RNA, 64 nt, hsa; identical to SEQ ID NO: 33109

SEQ ID NO: 706370 - RNA, 64 nt, hsa; identical to SEQ ID NO: 33110

SEQ ID NO: 706371 - RNA, 64 nt, hsa; identical to SEQ ID NO: 33111

SEQ ID NO: 706372 - RNA, 64 nt, hsa; identical to SEQ ID NO: 33112

SEQ ID NO: 706373 - RNA, 64 nt, hsa; identical to SEQ ID NO: 33113

SEQ ID NO: 706374 - RNA, 64 nt, hsa; identical to SEQ ID NO: 33114

SEQ ID NO: 706375 - RNA, 64 nt, hsa; identical to SEQ ID NO: 33115

SEQ ID NO: 706376 - RNA, 64 nt, hsa; identical to SEQ ID NO: 33116

SEQ ID NO: 706377 - RNA, 64 nt, hsa; identical to SEQ ID NO: 33117

SEQ ID NO: 706378 - RNA, 64 nt, hsa; identical to SEQ ID NO: 33118

SEQ ID NO: 706379 - RNA, 64 nt, hsa; identical to SEQ ID NO: 33119

SEQ ID NO: 706380 - RNA, 64 nt, hsa; identical to SEQ ID NO: 33120

SEQ ID NO: 706381 - RNA, 64 nt, hsa; identical to SEQ ID NO: 33121

SEQ ID NO: 706382 - RNA, 64 nt, hsa; identical to SEQ ID NO: 33122

SEQ ID NO: 706383 - RNA, 64 nt, hsa; identical to SEQ ID NO: 33123

SEQ ID NO: 706384 - RNA, 64 nt, hsa; identical to SEQ ID NO: 33124

SEQ ID NO: 706385 - RNA, 64 nt, hsa; identical to SEQ ID NO: 33125

SEQ ID NO: 706386 - RNA, 64 nt, hsa; identical to SEQ ID NO: 33126

SEQ ID NO: 706387 - RNA, 64 nt, hsa; identical to SEQ ID NO: 33127

SEQ ID NO: 706388 - RNA, 64 nt, hsa; identical to SEQ ID NO: 33128

SEQ ID NO: 706389 - RNA, 64 nt, hsa; identical to SEQ ID NO: 33129

SEQ ID NO: 706390 - RNA, 64 nt, hsa; identical to SEQ ID NO: 33130

SEQ ID NO: 706391 - RNA, 64 nt, hsa; identical to SEQ ID NO: 33131

SEQ ID NO: 706392 - RNA, 64 nt, hsa; identical to SEQ ID NO: 33132

SEQ ID NO: 706393 - RNA, 64 nt, hsa; identical to SEQ ID NO: 33133

SEQ ID NO: 706394 - RNA, 64 nt, hsa; identical to SEQ ID NO: 33134

SEQ ID NO: 706395 - RNA, 64 nt, hsa; identical to SEQ ID NO: 33135

SEQ ID NO: 706396 - RNA, 64 nt, hsa; identical to SEQ ID NO: 33136

SEQ ID NO: 706397 - RNA, 64 nt, hsa; identical to SEQ ID NO: 33137

SEQ ID NO: 706398 - RNA, 64 nt, hsa; identical to SEQ ID NO: 33138

SEQ ID NO: 706399 - RNA, 64 nt, hsa; identical to SEQ ID NO: 33139

SEQ ID NO: 706400 - RNA, 64 nt, hsa; identical to SEQ ID NO: 33140

SEQ ID NO: 706401 - RNA, 64 nt, hsa; identical to SEQ ID NO: 33141

SEQ ID NO: 706402 - RNA, 64 nt, hsa; identical to SEQ ID NO: 33142

SEQ ID NO: 706403 - RNA, 64 nt, hsa; identical to SEQ ID NO: 33143

SEQ ID NO: 706404 - RNA, 64 nt, hsa; identical to SEQ ID NO: 33144

SEQ ID NO: 706405 - RNA, 64 nt, hsa; identical to SEQ ID NO: 33145

SEQ ID NO: 706406 - RNA, 64 nt, hsa; identical to SEQ ID NO: 33146

SEQ ID NO: 706407 - RNA, 64 nt, hsa; identical to SEQ ID NO: 33147

SEQ ID NO: 706408 - RNA, 64 nt, hsa; identical to SEQ ID NO: 33148

SEQ ID NO: 706409 - RNA, 64 nt, hsa; identical to SEQ ID NO: 33149

SEQ ID NO: 706410 - RNA, 64 nt, hsa; identical to SEQ ID NO: 33150

SEQ ID NO: 706411 - RNA, 64 nt, hsa; identical to SEQ ID NO: 33151

SEQ ID NO: 706412 - RNA, 64 nt, hsa; identical to SEQ ID NO: 33152

SEQ ID NO: 706413 - RNA, 64 nt, hsa; identical to SEQ ID NO: 33153

SEQ ID NO: 706414 - RNA, 64 nt, hsa; identical to SEQ ID NO: 33154

SEQ ID NO: 706415 - RNA, 64 nt, hsa; identical to SEQ ID NO: 33155

SEQ ID NO: 706416 - RNA, 64 nt, hsa; identical to SEQ ID NO: 33156

SEQ ID NO: 706417 - RNA, 64 nt, hsa; identical to SEQ ID NO: 33157

SEQ ID NO: 706418 - RNA, 64 nt, hsa; identical to SEQ ID NO: 33158

SEQ ID NO: 706419 - RNA, 64 nt, hsa; identical to SEQ ID NO: 33159

SEQ ID NO: 706420 - RNA, 64 nt, hsa; identical to SEQ ID NO: 33160

SEQ ID NO: 706421 - RNA, 64 nt, hsa; identical to SEQ ID NO: 33161

SEQ ID NO: 706422 - RNA, 64 nt, hsa; identical to SEQ ID NO: 33162

SEQ ID NO: 706423 - RNA, 64 nt, hsa; identical to SEQ ID NO: 33163

SEQ ID NO: 706424 - RNA, 64 nt, hsa; identical to SEQ ID NO: 33164

SEQ ID NO: 706425 - RNA, 64 nt, hsa; identical to SEQ ID NO: 33165

SEQ ID NO: 706426 - RNA, 64 nt, hsa; identical to SEQ ID NO: 33166

SEQ ID NO: 706427 - RNA, 64 nt, hsa; identical to SEQ ID NO: 33167

SEQ ID NO: 706428 - RNA, 64 nt, hsa; identical to SEQ ID NO: 33168

SEQ ID NO: 706429 - RNA, 64 nt, hsa; identical to SEQ ID NO: 33169

SEQ ID NO: 706430 - RNA, 64 nt, hsa; identical to SEQ ID NO: 33170

SEQ ID NO: 706431 - RNA, 64 nt, hsa; identical to SEQ ID NO: 33171

SEQ ID NO: 706432 - RNA, 64 nt, hsa; identical to SEQ ID NO: 33172

SEQ ID NO: 706433 - RNA, 64 nt, hsa; identical to SEQ ID NO: 33173

SEQ ID NO: 706434 - RNA, 64 nt, hsa; identical to SEQ ID NO: 33174

SEQ ID NO: 706435 - RNA, 64 nt, hsa; identical to SEQ ID NO: 33175

SEQ ID NO: 706436 - RNA, 64 nt, hsa; identical to SEQ ID NO: 33176

SEQ ID NO: 706437 - RNA, 64 nt, hsa; identical to SEQ ID NO: 33177

SEQ ID NO: 706438 - RNA, 64 nt, hsa; identical to SEQ ID NO: 33178

SEQ ID NO: 706439 - RNA, 64 nt, hsa; identical to SEQ ID NO: 33179

SEQ ID NO: 706440 - RNA, 64 nt, hsa; identical to SEQ ID NO: 33180

SEQ ID NO: 706441 - RNA, 64 nt, hsa; identical to SEQ ID NO: 33181

SEQ ID NO: 706442 - RNA, 64 nt, hsa; identical to SEQ ID NO: 33182

SEQ ID NO: 706443 - RNA, 64 nt, hsa; identical to SEQ ID NO: 33183

SEQ ID NO: 706444 - RNA, 64 nt, hsa; identical to SEQ ID NO: 33184

SEQ ID NO: 706445 - RNA, 64 nt, hsa; identical to SEQ ID NO: 33185

SEQ ID NO: 706446 - RNA, 64 nt, hsa; identical to SEQ ID NO: 33186

SEQ ID NO: 706447 - RNA, 64 nt, hsa; identical to SEQ ID NO: 33187

SEQ ID NO: 706448 - RNA, 64 nt, hsa; identical to SEQ ID NO: 33188

SEQ ID NO: 706449 - RNA, 64 nt, hsa; identical to SEQ ID NO: 33189

SEQ ID NO: 706450 - RNA, 64 nt, hsa; identical to SEQ ID NO: 33190

SEQ ID NO: 706451 - RNA, 64 nt, hsa; identical to SEQ ID NO: 33191

SEQ ID NO: 706452 - RNA, 64 nt, hsa; identical to SEQ ID NO: 33192

SEQ ID NO: 706453 - RNA, 64 nt, hsa; identical to SEQ ID NO: 33193

SEQ ID NO: 706454 - RNA, 64 nt, hsa; identical to SEQ ID NO: 33194

SEQ ID NO: 706455 - RNA, 64 nt, hsa; identical to SEQ ID NO: 33195

SEQ ID NO: 706456 - RNA, 64 nt, hsa; identical to SEQ ID NO: 33196

SEQ ID NO: 706457 - RNA, 64 nt, hsa; identical to SEQ ID NO: 33197

SEQ ID NO: 706458 - RNA, 64 nt, hsa; identical to SEQ ID NO: 33198

SEQ ID NO: 706459 - RNA, 64 nt, hsa; identical to SEQ ID NO: 33199

SEQ ID NO: 706460 - RNA, 64 nt, hsa; identical to SEQ ID NO: 33200

SEQ ID NO: 706461 - RNA, 64 nt, hsa; identical to SEQ ID NO: 33201

SEQ ID NO: 706462 - RNA, 64 nt, hsa; identical to SEQ ID NO: 33202

SEQ ID NO: 706463 - RNA, 64 nt, hsa; identical to SEQ ID NO: 33203

SEQ ID NO: 706464 - RNA, 64 nt, hsa; identical to SEQ ID NO: 33204

SEQ ID NO: 706465 - RNA, 64 nt, hsa; identical to SEQ ID NO: 33205

SEQ ID NO: 706466 - RNA, 64 nt, hsa; identical to SEQ ID NO: 33206

SEQ ID NO: 706467 - RNA, 64 nt, hsa; identical to SEQ ID NO: 33207

SEQ ID NO: 706468 - RNA, 64 nt, hsa; identical to SEQ ID NO: 33208

SEQ ID NO: 706469 - RNA, 64 nt, hsa; identical to SEQ ID NO: 33209

SEQ ID NO: 706470 - RNA, 64 nt, hsa; identical to SEQ ID NO: 33210

SEQ ID NO: 706471 - RNA, 64 nt, hsa; identical to SEQ ID NO: 33211

SEQ ID NO: 706472 - RNA, 64 nt, hsa; identical to SEQ ID NO: 33212

SEQ ID NO: 706473 - RNA, 64 nt, hsa; identical to SEQ ID NO: 33213

SEQ ID NO: 706474 - RNA, 64 nt, hsa; identical to SEQ ID NO: 33214

SEQ ID NO: 706475 - RNA, 64 nt, hsa; identical to SEQ ID NO: 33215

SEQ ID NO: 706476 - RNA, 64 nt, hsa; identical to SEQ ID NO: 33216

SEQ ID NO: 706477 - RNA, 64 nt, hsa; identical to SEQ ID NO: 33217

SEQ ID NO: 706478 - RNA, 64 nt, hsa; identical to SEQ ID NO: 33218

SEQ ID NO: 706479 - RNA, 64 nt, hsa; identical to SEQ ID NO: 33219

SEQ ID NO: 706480 - RNA, 64 nt, hsa; identical to SEQ ID NO: 33220

SEQ ID NO: 706481 - RNA, 64 nt, hsa; identical to SEQ ID NO: 33221

SEQ ID NO: 706482 - RNA, 64 nt, hsa; identical to SEQ ID NO: 33222

SEQ ID NO: 706483 - RNA, 64 nt, hsa; identical to SEQ ID NO: 33223

SEQ ID NO: 706484 - RNA, 64 nt, hsa; identical to SEQ ID NO: 33224

SEQ ID NO: 706485 - RNA, 64 nt, hsa; identical to SEQ ID NO: 33225

SEQ ID NO: 706486 - RNA, 64 nt, hsa; identical to SEQ ID NO: 33226

SEQ ID NO: 706487 - RNA, 64 nt, hsa; identical to SEQ ID NO: 33227

SEQ ID NO: 706488 - RNA, 64 nt, hsa; identical to SEQ ID NO: 33228

SEQ ID NO: 706489 - RNA, 64 nt, hsa; identical to SEQ ID NO: 33229

SEQ ID NO: 706490 - RNA, 62 nt, hsa; identical to SEQ ID NO: 33230

SEQ ID NO: 706491 - RNA, 64 nt, hsa; identical to SEQ ID NO: 33231

SEQ ID NO: 706492 - RNA, 64 nt, hsa; identical to SEQ ID NO: 33232

SEQ ID NO: 706493 - RNA, 64 nt, hsa; identical to SEQ ID NO: 33233

SEQ ID NO: 706494 - RNA, 64 nt, hsa; identical to SEQ ID NO: 33234

SEQ ID NO: 706495 - RNA, 64 nt, hsa; identical to SEQ ID NO: 33235

SEQ ID NO: 706496 - RNA, 64 nt, hsa; identical to SEQ ID NO: 33236

SEQ ID NO: 706497 - RNA, 64 nt, hsa; identical to SEQ ID NO: 33237

SEQ ID NO: 706498 - RNA, 64 nt, hsa; identical to SEQ ID NO: 33238

SEQ ID NO: 706499 - RNA, 64 nt, hsa; identical to SEQ ID NO: 33239

SEQ ID NO: 706500 - RNA, 64 nt, hsa; identical to SEQ ID NO: 33240

SEQ ID NO: 706501 - RNA, 64 nt, hsa; identical to SEQ ID NO: 33241

SEQ ID NO: 706502 - RNA, 64 nt, hsa; identical to SEQ ID NO: 33242

SEQ ID NO: 706503 - RNA, 64 nt, hsa; identical to SEQ ID NO: 33243

SEQ ID NO: 706504 - RNA, 64 nt, hsa; identical to SEQ ID NO: 33244

SEQ ID NO: 706505 - RNA, 64 nt, hsa; identical to SEQ ID NO: 33245

SEQ ID NO: 706506 - RNA, 64 nt, hsa; identical to SEQ ID NO: 33246

SEQ ID NO: 706507 - RNA, 64 nt, hsa; identical to SEQ ID NO: 33247

SEQ ID NO: 706508 - RNA, 64 nt, hsa; identical to SEQ ID NO: 33248

SEQ ID NO: 706509 - RNA, 64 nt, hsa; identical to SEQ ID NO: 33249

SEQ ID NO: 706510 - RNA, 64 nt, hsa; identical to SEQ ID NO: 33250

SEQ ID NO: 706511 - RNA, 64 nt, hsa; identical to SEQ ID NO: 33251

SEQ ID NO: 706512 - RNA, 64 nt, hsa; identical to SEQ ID NO: 33252

SEQ ID NO: 706513 - RNA, 64 nt, hsa; identical to SEQ ID NO: 33253

SEQ ID NO: 706514 - RNA, 64 nt, hsa; identical to SEQ ID NO: 33254

SEQ ID NO: 706515 - RNA, 64 nt, hsa; identical to SEQ ID NO: 33255

SEQ ID NO: 706516 - RNA, 64 nt, hsa; identical to SEQ ID NO: 33256

SEQ ID NO: 706517 - RNA, 64 nt, hsa; identical to SEQ ID NO: 33257

SEQ ID NO: 706518 - RNA, 64 nt, hsa; identical to SEQ ID NO: 33258

SEQ ID NO: 706519 - RNA, 64 nt, hsa; identical to SEQ ID NO: 33259

SEQ ID NO: 706520 - RNA, 64 nt, hsa; identical to SEQ ID NO: 33260

SEQ ID NO: 706521 - RNA, 64 nt, hsa; identical to SEQ ID NO: 33261

SEQ ID NO: 706522 - RNA, 64 nt, hsa; identical to SEQ ID NO: 33262

SEQ ID NO: 706523 - RNA, 64 nt, hsa; identical to SEQ ID NO: 33263

SEQ ID NO: 706524 - RNA, 64 nt, hsa; identical to SEQ ID NO: 33264

SEQ ID NO: 706525 - RNA, 64 nt, hsa; identical to SEQ ID NO: 33265

SEQ ID NO: 706526 - RNA, 64 nt, hsa; identical to SEQ ID NO: 33266

SEQ ID NO: 706527 - RNA, 64 nt, hsa; identical to SEQ ID NO: 33267

SEQ ID NO: 706528 - RNA, 64 nt, hsa; identical to SEQ ID NO: 33268

SEQ ID NO: 706529 - RNA, 64 nt, hsa; identical to SEQ ID NO: 33269

SEQ ID NO: 706530 - RNA, 64 nt, hsa; identical to SEQ ID NO: 33270

SEQ ID NO: 706531 - RNA, 64 nt, hsa; identical to SEQ ID NO: 33271

SEQ ID NO: 706532 - RNA, 64 nt, hsa; identical to SEQ ID NO: 33272

SEQ ID NO: 706533 - RNA, 64 nt, hsa; identical to SEQ ID NO: 33273

SEQ ID NO: 706534 - RNA, 64 nt, hsa; identical to SEQ ID NO: 33274

SEQ ID NO: 706535 - RNA, 64 nt, hsa; identical to SEQ ID NO: 33275

SEQ ID NO: 706536 - RNA, 64 nt, hsa; identical to SEQ ID NO: 33276

SEQ ID NO: 706537 - RNA, 64 nt, hsa; identical to SEQ ID NO: 33277

SEQ ID NO: 706538 - RNA, 64 nt, hsa; identical to SEQ ID NO: 33278

SEQ ID NO: 706539 - RNA, 64 nt, hsa; identical to SEQ ID NO: 33279

SEQ ID NO: 706540 - RNA, 64 nt, hsa; identical to SEQ ID NO: 33280

SEQ ID NO: 706541 - RNA, 64 nt, hsa; identical to SEQ ID NO: 33281

SEQ ID NO: 706542 - RNA, 64 nt, hsa; identical to SEQ ID NO: 33282

SEQ ID NO: 706543 - RNA, 64 nt, hsa; identical to SEQ ID NO: 33283

SEQ ID NO: 706544 - RNA, 64 nt, hsa; identical to SEQ ID NO: 33284

SEQ ID NO: 706545 - RNA, 64 nt, hsa; identical to SEQ ID NO: 33285

SEQ ID NO: 706546 - RNA, 64 nt, hsa; identical to SEQ ID NO: 33286

SEQ ID NO: 706547 - RNA, 64 nt, hsa; identical to SEQ ID NO: 33287

SEQ ID NO: 706548 - RNA, 64 nt, hsa; identical to SEQ ID NO: 33288

SEQ ID NO: 706549 - RNA, 64 nt, hsa; identical to SEQ ID NO: 33289

SEQ ID NO: 706550 - RNA, 64 nt, hsa; identical to SEQ ID NO: 33290

SEQ ID NO: 706551 - RNA, 64 nt, hsa; identical to SEQ ID NO: 33291

SEQ ID NO: 706552 - RNA, 64 nt, hsa; identical to SEQ ID NO: 33292

SEQ ID NO: 706553 - RNA, 64 nt, hsa; identical to SEQ ID NO: 33293

SEQ ID NO: 706554 - RNA, 64 nt, hsa; identical to SEQ ID NO: 33294

SEQ ID NO: 706555 - RNA, 64 nt, hsa; identical to SEQ ID NO: 33295

SEQ ID NO: 706556 - RNA, 64 nt, hsa; identical to SEQ ID NO: 33296

SEQ ID NO: 706557 - RNA, 64 nt, hsa; identical to SEQ ID NO: 33297

SEQ ID NO: 706558 - RNA, 64 nt, hsa; identical to SEQ ID NO: 33298

SEQ ID NO: 706559 - RNA, 64 nt, hsa; identical to SEQ ID NO: 33299

SEQ ID NO: 706560 - RNA, 64 nt, hsa; identical to SEQ ID NO: 33300

SEQ ID NO: 706561 - RNA, 64 nt, hsa; identical to SEQ ID NO: 33301

SEQ ID NO: 706562 - RNA, 64 nt, hsa; identical to SEQ ID NO: 33302

SEQ ID NO: 706563 - RNA, 64 nt, hsa; identical to SEQ ID NO: 33303

SEQ ID NO: 706564 - RNA, 64 nt, hsa; identical to SEQ ID NO: 33304

SEQ ID NO: 706565 - RNA, 64 nt, hsa; identical to SEQ ID NO: 33305

SEQ ID NO: 706566 - RNA, 64 nt, hsa; identical to SEQ ID NO: 33306

SEQ ID NO: 706567 - RNA, 64 nt, hsa; identical to SEQ ID NO: 33307

SEQ ID NO: 706568 - RNA, 64 nt, hsa; identical to SEQ ID NO: 33308

SEQ ID NO: 706569 - RNA, 64 nt, hsa; identical to SEQ ID NO: 33309

SEQ ID NO: 706570 - RNA, 64 nt, hsa; identical to SEQ ID NO: 33310

SEQ ID NO: 706571 - RNA, 64 nt, hsa; identical to SEQ ID NO: 33311

SEQ ID NO: 706572 - RNA, 64 nt, hsa; identical to SEQ ID NO: 33312

SEQ ID NO: 706573 - RNA, 64 nt, hsa; identical to SEQ ID NO: 33313

SEQ ID NO: 706574 - RNA, 64 nt, hsa; identical to SEQ ID NO: 33314

SEQ ID NO: 706575 - RNA, 64 nt, hsa; identical to SEQ ID NO: 33315

SEQ ID NO: 706576 - RNA, 64 nt, hsa; identical to SEQ ID NO: 33316

SEQ ID NO: 706577 - RNA, 64 nt, hsa; identical to SEQ ID NO: 33317

SEQ ID NO: 706578 - RNA, 64 nt, hsa; identical to SEQ ID NO: 33318

SEQ ID NO: 706579 - RNA, 64 nt, hsa; identical to SEQ ID NO: 33319

SEQ ID NO: 706580 - RNA, 64 nt, hsa; identical to SEQ ID NO: 33320

SEQ ID NO: 706581 - RNA, 64 nt, hsa; identical to SEQ ID NO: 33321

SEQ ID NO: 706582 - RNA, 64 nt, hsa; identical to SEQ ID NO: 33322

SEQ ID NO: 706583 - RNA, 64 nt, hsa; identical to SEQ ID NO: 33323

SEQ ID NO: 706584 - RNA, 64 nt, hsa; identical to SEQ ID NO: 33324

SEQ ID NO: 706585 - RNA, 64 nt, hsa; identical to SEQ ID NO: 33325

SEQ ID NO: 706586 - RNA, 64 nt, hsa; identical to SEQ ID NO: 33326

SEQ ID NO: 706587 - RNA, 64 nt, hsa; identical to SEQ ID NO: 33327

SEQ ID NO: 706588 - RNA, 64 nt, hsa; identical to SEQ ID NO: 33328

SEQ ID NO: 706589 - RNA, 64 nt, hsa; identical to SEQ ID NO: 33329

SEQ ID NO: 706590 - RNA, 64 nt, hsa; identical to SEQ ID NO: 33330

SEQ ID NO: 706591 - RNA, 64 nt, hsa; identical to SEQ ID NO: 33331

SEQ ID NO: 706592 - RNA, 64 nt, hsa; identical to SEQ ID NO: 33332

SEQ ID NO: 706593 - RNA, 64 nt, hsa; identical to SEQ ID NO: 33333

SEQ ID NO: 706594 - RNA, 64 nt, hsa; identical to SEQ ID NO: 33334

SEQ ID NO: 706595 - RNA, 64 nt, hsa; identical to SEQ ID NO: 33335

SEQ ID NO: 706596 - RNA, 64 nt, hsa; identical to SEQ ID NO: 33336

SEQ ID NO: 706597 - RNA, 64 nt, hsa; identical to SEQ ID NO: 33337

SEQ ID NO: 706598 - RNA, 64 nt, hsa; identical to SEQ ID NO: 33338

SEQ ID NO: 706599 - RNA, 64 nt, hsa; identical to SEQ ID NO: 33339

SEQ ID NO: 706600 - RNA, 64 nt, hsa; identical to SEQ ID NO: 33340

SEQ ID NO: 706601 - RNA, 64 nt, hsa; identical to SEQ ID NO: 33341

SEQ ID NO: 706602 - RNA, 64 nt, hsa; identical to SEQ ID NO: 33342

SEQ ID NO: 706603 - RNA, 64 nt, hsa; identical to SEQ ID NO: 33343

SEQ ID NO: 706604 - RNA, 64 nt, hsa; identical to SEQ ID NO: 33344

SEQ ID NO: 706605 - RNA, 64 nt, hsa; identical to SEQ ID NO: 33345

SEQ ID NO: 706606 - RNA, 64 nt, hsa; identical to SEQ ID NO: 33346

SEQ ID NO: 706607 - RNA, 64 nt, hsa; identical to SEQ ID NO: 33347

SEQ ID NO: 706608 - RNA, 64 nt, hsa; identical to SEQ ID NO: 33348

SEQ ID NO: 706609 - RNA, 64 nt, hsa; identical to SEQ ID NO: 33349

SEQ ID NO: 706610 - RNA, 64 nt, hsa; identical to SEQ ID NO: 33350

SEQ ID NO: 706611 - RNA, 64 nt, hsa; identical to SEQ ID NO: 33351

SEQ ID NO: 706612 - RNA, 64 nt, hsa; identical to SEQ ID NO: 33352

SEQ ID NO: 706613 - RNA, 64 nt, hsa; identical to SEQ ID NO: 33353

SEQ ID NO: 706614 - RNA, 64 nt, hsa; identical to SEQ ID NO: 33354

SEQ ID NO: 706615 - RNA, 64 nt, hsa; identical to SEQ ID NO: 33355

SEQ ID NO: 706616 - RNA, 64 nt, hsa; identical to SEQ ID NO: 33356

SEQ ID NO: 706617 - RNA, 64 nt, hsa; identical to SEQ ID NO: 33357

SEQ ID NO: 706618 - RNA, 64 nt, hsa; identical to SEQ ID NO: 33358

SEQ ID NO: 706619 - RNA, 64 nt, hsa; identical to SEQ ID NO: 33359

SEQ ID NO: 706620 - RNA, 64 nt, hsa; identical to SEQ ID NO: 33360

SEQ ID NO: 706621 - RNA, 64 nt, hsa; identical to SEQ ID NO: 33361

SEQ ID NO: 706622 - RNA, 64 nt, hsa; identical to SEQ ID NO: 33362

SEQ ID NO: 706623 - RNA, 64 nt, hsa; identical to SEQ ID NO: 33363

SEQ ID NO: 706624 - RNA, 64 nt, hsa; identical to SEQ ID NO: 33364

SEQ ID NO: 706625 - RNA, 64 nt, hsa; identical to SEQ ID NO: 33365

SEQ ID NO: 706626 - RNA, 64 nt, hsa; identical to SEQ ID NO: 33366

SEQ ID NO: 706627 - RNA, 64 nt, hsa; identical to SEQ ID NO: 33367

SEQ ID NO: 706628 - RNA, 64 nt, hsa; identical to SEQ ID NO: 33368

SEQ ID NO: 706629 - RNA, 64 nt, hsa; identical to SEQ ID NO: 33369

SEQ ID NO: 706630 - RNA, 64 nt, hsa; identical to SEQ ID NO: 33370

SEQ ID NO: 706631 - RNA, 64 nt, hsa; identical to SEQ ID NO: 33371

SEQ ID NO: 706632 - RNA, 64 nt, hsa; identical to SEQ ID NO: 33372

SEQ ID NO: 706633 - RNA, 64 nt, hsa; identical to SEQ ID NO: 33373

SEQ ID NO: 706634 - RNA, 64 nt, hsa; identical to SEQ ID NO: 33374

SEQ ID NO: 706635 - RNA, 64 nt, hsa; identical to SEQ ID NO: 33375

SEQ ID NO: 706636 - RNA, 64 nt, hsa; identical to SEQ ID NO: 33376

SEQ ID NO: 706637 - RNA, 64 nt, hsa; identical to SEQ ID NO: 33377

SEQ ID NO: 706638 - RNA, 64 nt, hsa; identical to SEQ ID NO: 33378

SEQ ID NO: 706639 - RNA, 64 nt, hsa; identical to SEQ ID NO: 33379

SEQ ID NO: 706640 - RNA, 64 nt, hsa; identical to SEQ ID NO: 33380

SEQ ID NO: 706641 - RNA, 64 nt, hsa; identical to SEQ ID NO: 33381

SEQ ID NO: 706642 - RNA, 64 nt, hsa; identical to SEQ ID NO: 33382

SEQ ID NO: 706643 - RNA, 64 nt, hsa; identical to SEQ ID NO: 33383

SEQ ID NO: 706644 - RNA, 64 nt, hsa; identical to SEQ ID NO: 33384

SEQ ID NO: 706645 - RNA, 64 nt, hsa; identical to SEQ ID NO: 33385

SEQ ID NO: 706646 - RNA, 64 nt, hsa; identical to SEQ ID NO: 33386

SEQ ID NO: 706647 - RNA, 64 nt, hsa; identical to SEQ ID NO: 33387

SEQ ID NO: 706648 - RNA, 64 nt, hsa; identical to SEQ ID NO: 33388

SEQ ID NO: 706649 - RNA, 64 nt, hsa; identical to SEQ ID NO: 33389

SEQ ID NO: 706650 - RNA, 64 nt, hsa; identical to SEQ ID NO: 33390

SEQ ID NO: 706651 - RNA, 64 nt, hsa; identical to SEQ ID NO: 33391

SEQ ID NO: 706652 - RNA, 64 nt, hsa; identical to SEQ ID NO: 33392

SEQ ID NO: 706653 - RNA, 64 nt, hsa; identical to SEQ ID NO: 33393

SEQ ID NO: 706654 - RNA, 64 nt, hsa; identical to SEQ ID NO: 33394

SEQ ID NO: 706655 - RNA, 64 nt, hsa; identical to SEQ ID NO: 33395

SEQ ID NO: 706656 - RNA, 64 nt, hsa; identical to SEQ ID NO: 33396

SEQ ID NO: 706657 - RNA, 64 nt, hsa; identical to SEQ ID NO: 33397

SEQ ID NO: 706658 - RNA, 64 nt, hsa; identical to SEQ ID NO: 33398

SEQ ID NO: 706659 - RNA, 64 nt, hsa; identical to SEQ ID NO: 33399

SEQ ID NO: 706660 - RNA, 64 nt, hsa; identical to SEQ ID NO: 33400

SEQ ID NO: 706661 - RNA, 64 nt, hsa; identical to SEQ ID NO: 33401

SEQ ID NO: 706662 - RNA, 64 nt, hsa; identical to SEQ ID NO: 33402

SEQ ID NO: 706663 - RNA, 64 nt, hsa; identical to SEQ ID NO: 33403

SEQ ID NO: 706664 - RNA, 64 nt, hsa; identical to SEQ ID NO: 33404

SEQ ID NO: 706665 - RNA, 64 nt, hsa; identical to SEQ ID NO: 33405

SEQ ID NO: 706666 - RNA, 64 nt, hsa; identical to SEQ ID NO: 33406

SEQ ID NO: 706667 - RNA, 64 nt, hsa; identical to SEQ ID NO: 33407

SEQ ID NO: 706668 - RNA, 64 nt, hsa; identical to SEQ ID NO: 33408

SEQ ID NO: 706669 - RNA, 64 nt, hsa; identical to SEQ ID NO: 33409

SEQ ID NO: 706670 - RNA, 64 nt, hsa; identical to SEQ ID NO: 33410

SEQ ID NO: 706671 - RNA, 64 nt, hsa; identical to SEQ ID NO: 33411

SEQ ID NO: 706672 - RNA, 64 nt, hsa; identical to SEQ ID NO: 33412

SEQ ID NO: 706673 - RNA, 64 nt, hsa; identical to SEQ ID NO: 33413

SEQ ID NO: 706674 - RNA, 64 nt, hsa; identical to SEQ ID NO: 33414

SEQ ID NO: 706675 - RNA, 64 nt, hsa; identical to SEQ ID NO: 33415

SEQ ID NO: 706676 - RNA, 64 nt, hsa; identical to SEQ ID NO: 33416

SEQ ID NO: 706677 - RNA, 64 nt, hsa; identical to SEQ ID NO: 33417

SEQ ID NO: 706678 - RNA, 64 nt, hsa; identical to SEQ ID NO: 33418

SEQ ID NO: 706679 - RNA, 64 nt, hsa; identical to SEQ ID NO: 33419

SEQ ID NO: 706680 - RNA, 64 nt, hsa; identical to SEQ ID NO: 33420

SEQ ID NO: 706681 - RNA, 64 nt, hsa; identical to SEQ ID NO: 33421

SEQ ID NO: 706682 - RNA, 64 nt, hsa; identical to SEQ ID NO: 33422

SEQ ID NO: 706683 - RNA, 64 nt, hsa; identical to SEQ ID NO: 33423

SEQ ID NO: 706684 - RNA, 64 nt, hsa; identical to SEQ ID NO: 33424

SEQ ID NO: 706685 - RNA, 64 nt, hsa; identical to SEQ ID NO: 33425

SEQ ID NO: 706686 - RNA, 64 nt, hsa; identical to SEQ ID NO: 33426

SEQ ID NO: 706687 - RNA, 64 nt, hsa; identical to SEQ ID NO: 33427

SEQ ID NO: 706688 - RNA, 64 nt, hsa; identical to SEQ ID NO: 33428

SEQ ID NO: 706689 - RNA, 64 nt, hsa; identical to SEQ ID NO: 33429

SEQ ID NO: 706690 - RNA, 64 nt, hsa; identical to SEQ ID NO: 33430

SEQ ID NO: 706691 - RNA, 64 nt, hsa; identical to SEQ ID NO: 33431

SEQ ID NO: 706692 - RNA, 64 nt, hsa; identical to SEQ ID NO: 33432

SEQ ID NO: 706693 - RNA, 63 nt, hsa; identical to SEQ ID NO: 33433

SEQ ID NO: 706694 - RNA, 62 nt, hsa; identical to SEQ ID NO: 33434

SEQ ID NO: 706695 - RNA, 64 nt, hsa; identical to SEQ ID NO: 33435

SEQ ID NO: 706696 - RNA, 64 nt, hsa; identical to SEQ ID NO: 33436

SEQ ID NO: 706697 - RNA, 64 nt, hsa; identical to SEQ ID NO: 33437

SEQ ID NO: 706698 - RNA, 64 nt, hsa; identical to SEQ ID NO: 33438

SEQ ID NO: 706699 - RNA, 64 nt, hsa; identical to SEQ ID NO: 33439

SEQ ID NO: 706700 - RNA, 64 nt, hsa; identical to SEQ ID NO: 33440

SEQ ID NO: 706701 - RNA, 64 nt, hsa; identical to SEQ ID NO: 33441

SEQ ID NO: 706702 - RNA, 64 nt, hsa; identical to SEQ ID NO: 33442

SEQ ID NO: 706703 - RNA, 64 nt, hsa; identical to SEQ ID NO: 33443

SEQ ID NO: 706704 - RNA, 64 nt, hsa; identical to SEQ ID NO: 33444

SEQ ID NO: 706705 - RNA, 64 nt, hsa; identical to SEQ ID NO: 33445

SEQ ID NO: 706706 - RNA, 64 nt, hsa; identical to SEQ ID NO: 33446

SEQ ID NO: 706707 - RNA, 64 nt, hsa; identical to SEQ ID NO: 33447

SEQ ID NO: 706708 - RNA, 64 nt, hsa; identical to SEQ ID NO: 33448

SEQ ID NO: 706709 - RNA, 64 nt, hsa; identical to SEQ ID NO: 33449

SEQ ID NO: 706710 - RNA, 64 nt, hsa; identical to SEQ ID NO: 33450

SEQ ID NO: 706711 - RNA, 64 nt, hsa; identical to SEQ ID NO: 33451

SEQ ID NO: 706712 - RNA, 64 nt, hsa; identical to SEQ ID NO: 33452

SEQ ID NO: 706713 - RNA, 64 nt, hsa; identical to SEQ ID NO: 33453

SEQ ID NO: 706714 - RNA, 64 nt, hsa; identical to SEQ ID NO: 33454

SEQ ID NO: 706715 - RNA, 64 nt, hsa; identical to SEQ ID NO: 33455

SEQ ID NO: 706716 - RNA, 64 nt, hsa; identical to SEQ ID NO: 33456

SEQ ID NO: 706717 - RNA, 64 nt, hsa; identical to SEQ ID NO: 33457

SEQ ID NO: 706718 - RNA, 64 nt, hsa; identical to SEQ ID NO: 33458

SEQ ID NO: 706719 - RNA, 64 nt, hsa; identical to SEQ ID NO: 33459

SEQ ID NO: 706720 - RNA, 64 nt, hsa; identical to SEQ ID NO: 33460

SEQ ID NO: 706721 - RNA, 64 nt, hsa; identical to SEQ ID NO: 33461

SEQ ID NO: 706722 - RNA, 64 nt, hsa; identical to SEQ ID NO: 33462

SEQ ID NO: 706723 - RNA, 64 nt, hsa; identical to SEQ ID NO: 33463

SEQ ID NO: 706724 - RNA, 64 nt, hsa; identical to SEQ ID NO: 33464

SEQ ID NO: 706725 - RNA, 64 nt, hsa; identical to SEQ ID NO: 33465

SEQ ID NO: 706726 - RNA, 64 nt, hsa; identical to SEQ ID NO: 33466

SEQ ID NO: 706727 - RNA, 64 nt, hsa; identical to SEQ ID NO: 33467

SEQ ID NO: 706728 - RNA, 64 nt, hsa; identical to SEQ ID NO: 33468

SEQ ID NO: 706729 - RNA, 64 nt, hsa; identical to SEQ ID NO: 33469

SEQ ID NO: 706730 - RNA, 64 nt, hsa; identical to SEQ ID NO: 33470

SEQ ID NO: 706731 - RNA, 64 nt, hsa; identical to SEQ ID NO: 33471

SEQ ID NO: 706732 - RNA, 64 nt, hsa; identical to SEQ ID NO: 33472

SEQ ID NO: 706733 - RNA, 64 nt, hsa; identical to SEQ ID NO: 33473

SEQ ID NO: 706734 - RNA, 64 nt, hsa; identical to SEQ ID NO: 33474

SEQ ID NO: 706735 - RNA, 64 nt, hsa; identical to SEQ ID NO: 33475

SEQ ID NO: 706736 - RNA, 64 nt, hsa; identical to SEQ ID NO: 33476

SEQ ID NO: 706737 - RNA, 64 nt, hsa; identical to SEQ ID NO: 33477

SEQ ID NO: 706738 - RNA, 64 nt, hsa; identical to SEQ ID NO: 33478

SEQ ID NO: 706739 - RNA, 64 nt, hsa; identical to SEQ ID NO: 33479

SEQ ID NO: 706740 - RNA, 64 nt, hsa; identical to SEQ ID NO: 33480

SEQ ID NO: 706741 - RNA, 64 nt, hsa; identical to SEQ ID NO: 33481

SEQ ID NO: 706742 - RNA, 64 nt, hsa; identical to SEQ ID NO: 33482

SEQ ID NO: 706743 - RNA, 64 nt, hsa; identical to SEQ ID NO: 33483

SEQ ID NO: 706744 - RNA, 64 nt, hsa; identical to SEQ ID NO: 33484

SEQ ID NO: 706745 - RNA, 64 nt, hsa; identical to SEQ ID NO: 33485

SEQ ID NO: 706746 - RNA, 64 nt, hsa; identical to SEQ ID NO: 33486

SEQ ID NO: 706747 - RNA, 64 nt, hsa; identical to SEQ ID NO: 33487

SEQ ID NO: 706748 - RNA, 64 nt, hsa; identical to SEQ ID NO: 33488

SEQ ID NO: 706749 - RNA, 64 nt, hsa; identical to SEQ ID NO: 33489

SEQ ID NO: 706750 - RNA, 64 nt, hsa; identical to SEQ ID NO: 33490

SEQ ID NO: 706751 - RNA, 64 nt, hsa; identical to SEQ ID NO: 33491

SEQ ID NO: 706752 - RNA, 64 nt, hsa; identical to SEQ ID NO: 33492

SEQ ID NO: 706753 - RNA, 64 nt, hsa; identical to SEQ ID NO: 33493

SEQ ID NO: 706754 - RNA, 64 nt, hsa; identical to SEQ ID NO: 33494

SEQ ID NO: 706755 - RNA, 64 nt, hsa; identical to SEQ ID NO: 33495

SEQ ID NO: 706756 - RNA, 64 nt, hsa; identical to SEQ ID NO: 33496

SEQ ID NO: 706757 - RNA, 64 nt, hsa; identical to SEQ ID NO: 33497

SEQ ID NO: 706758 - RNA, 64 nt, hsa; identical to SEQ ID NO: 33498

SEQ ID NO: 706759 - RNA, 64 nt, hsa; identical to SEQ ID NO: 33499

SEQ ID NO: 706760 - RNA, 64 nt, hsa; identical to SEQ ID NO: 33500

SEQ ID NO: 706761 - RNA, 64 nt, hsa; identical to SEQ ID NO: 33501

SEQ ID NO: 706762 - RNA, 64 nt, hsa; identical to SEQ ID NO: 33502

SEQ ID NO: 706763 - RNA, 64 nt, hsa; identical to SEQ ID NO: 33503

SEQ ID NO: 706764 - RNA, 64 nt, hsa; identical to SEQ ID NO: 33504

SEQ ID NO: 706765 - RNA, 64 nt, hsa; identical to SEQ ID NO: 33505

SEQ ID NO: 706766 - RNA, 64 nt, hsa; identical to SEQ ID NO: 33506

SEQ ID NO: 706767 - RNA, 64 nt, hsa; identical to SEQ ID NO: 33507

SEQ ID NO: 706768 - RNA, 64 nt, hsa; identical to SEQ ID NO: 33508

SEQ ID NO: 706769 - RNA, 64 nt, hsa; identical to SEQ ID NO: 33509

SEQ ID NO: 706770 - RNA, 64 nt, hsa; identical to SEQ ID NO: 33510

SEQ ID NO: 706771 - RNA, 64 nt, hsa; identical to SEQ ID NO: 33511

SEQ ID NO: 706772 - RNA, 64 nt, hsa; identical to SEQ ID NO: 33512

SEQ ID NO: 706773 - RNA, 64 nt, hsa; identical to SEQ ID NO: 33513

SEQ ID NO: 706774 - RNA, 64 nt, hsa; identical to SEQ ID NO: 33514

SEQ ID NO: 706775 - RNA, 64 nt, hsa; identical to SEQ ID NO: 33515

SEQ ID NO: 706776 - RNA, 64 nt, hsa; identical to SEQ ID NO: 33516

SEQ ID NO: 706777 - RNA, 64 nt, hsa; identical to SEQ ID NO: 33517

SEQ ID NO: 706778 - RNA, 64 nt, hsa; identical to SEQ ID NO: 33518

SEQ ID NO: 706779 - RNA, 64 nt, hsa; identical to SEQ ID NO: 33519

SEQ ID NO: 706780 - RNA, 64 nt, hsa; identical to SEQ ID NO: 33520

SEQ ID NO: 706781 - RNA, 64 nt, hsa; identical to SEQ ID NO: 33521

SEQ ID NO: 706782 - RNA, 64 nt, hsa; identical to SEQ ID NO: 33522

SEQ ID NO: 706783 - RNA, 64 nt, hsa; identical to SEQ ID NO: 33523

SEQ ID NO: 706784 - RNA, 64 nt, hsa; identical to SEQ ID NO: 33524

SEQ ID NO: 706785 - RNA, 64 nt, hsa; identical to SEQ ID NO: 33525

SEQ ID NO: 706786 - RNA, 64 nt, hsa; identical to SEQ ID NO: 33526

SEQ ID NO: 706787 - RNA, 64 nt, hsa; identical to SEQ ID NO: 33527

SEQ ID NO: 706788 - RNA, 64 nt, hsa; identical to SEQ ID NO: 33528

SEQ ID NO: 706789 - RNA, 64 nt, hsa; identical to SEQ ID NO: 33529

SEQ ID NO: 706790 - RNA, 64 nt, hsa; identical to SEQ ID NO: 33530

SEQ ID NO: 706791 - RNA, 64 nt, hsa; identical to SEQ ID NO: 33531

SEQ ID NO: 706792 - RNA, 64 nt, hsa; identical to SEQ ID NO: 33532

SEQ ID NO: 706793 - RNA, 64 nt, hsa; identical to SEQ ID NO: 33533

SEQ ID NO: 706794 - RNA, 64 nt, hsa; identical to SEQ ID NO: 33534

SEQ ID NO: 706795 - RNA, 64 nt, hsa; identical to SEQ ID NO: 33535

SEQ ID NO: 706796 - RNA, 64 nt, hsa; identical to SEQ ID NO: 33536

SEQ ID NO: 706797 - RNA, 64 nt, hsa; identical to SEQ ID NO: 33537

SEQ ID NO: 706798 - RNA, 64 nt, hsa; identical to SEQ ID NO: 33538

SEQ ID NO: 706799 - RNA, 64 nt, hsa; identical to SEQ ID NO: 33539

SEQ ID NO: 706800 - RNA, 64 nt, hsa; identical to SEQ ID NO: 33540

SEQ ID NO: 706801 - RNA, 64 nt, hsa; identical to SEQ ID NO: 33541

SEQ ID NO: 706802 - RNA, 64 nt, hsa; identical to SEQ ID NO: 33542

SEQ ID NO: 706803 - RNA, 64 nt, hsa; identical to SEQ ID NO: 33543

SEQ ID NO: 706804 - RNA, 64 nt, hsa; identical to SEQ ID NO: 33544

SEQ ID NO: 706805 - RNA, 64 nt, hsa; identical to SEQ ID NO: 33545

SEQ ID NO: 706806 - RNA, 64 nt, hsa; identical to SEQ ID NO: 33546

SEQ ID NO: 706807 - RNA, 64 nt, hsa; identical to SEQ ID NO: 33547

SEQ ID NO: 706808 - RNA, 64 nt, hsa; identical to SEQ ID NO: 33548

SEQ ID NO: 706809 - RNA, 64 nt, hsa; identical to SEQ ID NO: 33549

SEQ ID NO: 706810 - RNA, 64 nt, hsa; identical to SEQ ID NO: 33550

SEQ ID NO: 706811 - RNA, 64 nt, hsa; identical to SEQ ID NO: 33551

SEQ ID NO: 706812 - RNA, 64 nt, hsa; identical to SEQ ID NO: 33552

SEQ ID NO: 706813 - RNA, 64 nt, hsa; identical to SEQ ID NO: 33553

SEQ ID NO: 706814 - RNA, 64 nt, hsa; identical to SEQ ID NO: 33554

SEQ ID NO: 706815 - RNA, 64 nt, hsa; identical to SEQ ID NO: 33555

SEQ ID NO: 706816 - RNA, 64 nt, hsa; identical to SEQ ID NO: 33556

SEQ ID NO: 706817 - RNA, 64 nt, hsa; identical to SEQ ID NO: 33557

SEQ ID NO: 706818 - RNA, 64 nt, hsa; identical to SEQ ID NO: 33558

SEQ ID NO: 706819 - RNA, 64 nt, hsa; identical to SEQ ID NO: 33559

SEQ ID NO: 706820 - RNA, 64 nt, hsa; identical to SEQ ID NO: 33560

SEQ ID NO: 706821 - RNA, 64 nt, hsa; identical to SEQ ID NO: 33561

SEQ ID NO: 706822 - RNA, 64 nt, hsa; identical to SEQ ID NO: 33562

SEQ ID NO: 706823 - RNA, 64 nt, hsa; identical to SEQ ID NO: 33563

SEQ ID NO: 706824 - RNA, 64 nt, hsa; identical to SEQ ID NO: 33564

SEQ ID NO: 706825 - RNA, 64 nt, hsa; identical to SEQ ID NO: 33565

SEQ ID NO: 706826 - RNA, 64 nt, hsa; identical to SEQ ID NO: 33566

SEQ ID NO: 706827 - RNA, 64 nt, hsa; identical to SEQ ID NO: 33567

SEQ ID NO: 706828 - RNA, 64 nt, hsa; identical to SEQ ID NO: 33568

SEQ ID NO: 706829 - RNA, 64 nt, hsa; identical to SEQ ID NO: 33569

SEQ ID NO: 706830 - RNA, 64 nt, hsa; identical to SEQ ID NO: 33570

SEQ ID NO: 706831 - RNA, 64 nt, hsa; identical to SEQ ID NO: 33571

SEQ ID NO: 706832 - RNA, 64 nt, hsa; identical to SEQ ID NO: 33572

SEQ ID NO: 706833 - RNA, 64 nt, hsa; identical to SEQ ID NO: 33573

SEQ ID NO: 706834 - RNA, 64 nt, hsa; identical to SEQ ID NO: 33574

SEQ ID NO: 706835 - RNA, 64 nt, hsa; identical to SEQ ID NO: 33575

SEQ ID NO: 706836 - RNA, 64 nt, hsa; identical to SEQ ID NO: 33576

SEQ ID NO: 706837 - RNA, 64 nt, hsa; identical to SEQ ID NO: 33577

SEQ ID NO: 706838 - RNA, 64 nt, hsa; identical to SEQ ID NO: 33578

SEQ ID NO: 706839 - RNA, 64 nt, hsa; identical to SEQ ID NO: 33579

SEQ ID NO: 706840 - RNA, 64 nt, hsa; identical to SEQ ID NO: 33580

SEQ ID NO: 706841 - RNA, 64 nt, hsa; identical to SEQ ID NO: 33581

SEQ ID NO: 706842 - RNA, 64 nt, hsa; identical to SEQ ID NO: 33582

SEQ ID NO: 706843 - RNA, 64 nt, hsa; identical to SEQ ID NO: 33583

SEQ ID NO: 706844 - RNA, 64 nt, hsa; identical to SEQ ID NO: 33584

SEQ ID NO: 706845 - RNA, 64 nt, hsa; identical to SEQ ID NO: 33585

SEQ ID NO: 706846 - RNA, 64 nt, hsa; identical to SEQ ID NO: 33586

SEQ ID NO: 706847 - RNA, 64 nt, hsa; identical to SEQ ID NO: 33587

SEQ ID NO: 706848 - RNA, 64 nt, hsa; identical to SEQ ID NO: 33588

SEQ ID NO: 706849 - RNA, 64 nt, hsa; identical to SEQ ID NO: 33589

SEQ ID NO: 706850 - RNA, 64 nt, hsa; identical to SEQ ID NO: 33590

SEQ ID NO: 706851 - RNA, 64 nt, hsa; identical to SEQ ID NO: 33591

SEQ ID NO: 706852 - RNA, 64 nt, hsa; identical to SEQ ID NO: 33592

SEQ ID NO: 706853 - RNA, 64 nt, hsa; identical to SEQ ID NO: 33593

SEQ ID NO: 706854 - RNA, 64 nt, hsa; identical to SEQ ID NO: 33594

SEQ ID NO: 706855 - RNA, 64 nt, hsa; identical to SEQ ID NO: 33595

SEQ ID NO: 706856 - RNA, 64 nt, hsa; identical to SEQ ID NO: 33596

SEQ ID NO: 706857 - RNA, 64 nt, hsa; identical to SEQ ID NO: 33597

SEQ ID NO: 706858 - RNA, 64 nt, hsa; identical to SEQ ID NO: 33598

SEQ ID NO: 706859 - RNA, 64 nt, hsa; identical to SEQ ID NO: 33599

SEQ ID NO: 706860 - RNA, 64 nt, hsa; identical to SEQ ID NO: 33600

SEQ ID NO: 706861 - RNA, 64 nt, hsa; identical to SEQ ID NO: 33601

SEQ ID NO: 706862 - RNA, 64 nt, hsa; identical to SEQ ID NO: 33602

SEQ ID NO: 706863 - RNA, 64 nt, hsa; identical to SEQ ID NO: 33603

SEQ ID NO: 706864 - RNA, 64 nt, hsa; identical to SEQ ID NO: 33604

SEQ ID NO: 706865 - RNA, 64 nt, hsa; identical to SEQ ID NO: 33605

SEQ ID NO: 706866 - RNA, 64 nt, hsa; identical to SEQ ID NO: 33606

SEQ ID NO: 706867 - RNA, 64 nt, hsa; identical to SEQ ID NO: 33607

SEQ ID NO: 706868 - RNA, 64 nt, hsa; identical to SEQ ID NO: 33608

SEQ ID NO: 706869 - RNA, 64 nt, hsa; identical to SEQ ID NO: 33609

SEQ ID NO: 706870 - RNA, 64 nt, hsa; identical to SEQ ID NO: 33610

SEQ ID NO: 706871 - RNA, 64 nt, hsa; identical to SEQ ID NO: 33611

SEQ ID NO: 706872 - RNA, 64 nt, hsa; identical to SEQ ID NO: 33612

SEQ ID NO: 706873 - RNA, 64 nt, hsa; identical to SEQ ID NO: 33613

SEQ ID NO: 706874 - RNA, 64 nt, hsa; identical to SEQ ID NO: 33614

SEQ ID NO: 706875 - RNA, 64 nt, hsa; identical to SEQ ID NO: 33615

SEQ ID NO: 706876 - RNA, 64 nt, hsa; identical to SEQ ID NO: 33616

SEQ ID NO: 706877 - RNA, 64 nt, hsa; identical to SEQ ID NO: 33617

SEQ ID NO: 706878 - RNA, 64 nt, hsa; identical to SEQ ID NO: 33618

SEQ ID NO: 706879 - RNA, 64 nt, hsa; identical to SEQ ID NO: 33619

SEQ ID NO: 706880 - RNA, 64 nt, hsa; identical to SEQ ID NO: 33620

SEQ ID NO: 706881 - RNA, 64 nt, hsa; identical to SEQ ID NO: 33621

SEQ ID NO: 706882 - RNA, 64 nt, hsa; identical to SEQ ID NO: 33622

SEQ ID NO: 706883 - RNA, 64 nt, hsa; identical to SEQ ID NO: 33623

SEQ ID NO: 706884 - RNA, 64 nt, hsa; identical to SEQ ID NO: 33624

SEQ ID NO: 706885 - RNA, 64 nt, hsa; identical to SEQ ID NO: 33625

SEQ ID NO: 706886 - RNA, 64 nt, hsa; identical to SEQ ID NO: 33626

SEQ ID NO: 706887 - RNA, 64 nt, hsa; identical to SEQ ID NO: 33627

SEQ ID NO: 706888 - RNA, 64 nt, hsa; identical to SEQ ID NO: 33628

SEQ ID NO: 706889 - RNA, 64 nt, hsa; identical to SEQ ID NO: 33629

SEQ ID NO: 706890 - RNA, 64 nt, hsa; identical to SEQ ID NO: 33630

SEQ ID NO: 706891 - RNA, 64 nt, hsa; identical to SEQ ID NO: 33631

SEQ ID NO: 706892 - RNA, 64 nt, hsa; identical to SEQ ID NO: 33632

SEQ ID NO: 706893 - RNA, 64 nt, hsa; identical to SEQ ID NO: 33633

SEQ ID NO: 706894 - RNA, 64 nt, hsa; identical to SEQ ID NO: 33634

SEQ ID NO: 706895 - RNA, 64 nt, hsa; identical to SEQ ID NO: 33635

SEQ ID NO: 706896 - RNA, 64 nt, hsa; identical to SEQ ID NO: 33636

SEQ ID NO: 706897 - RNA, 64 nt, hsa; identical to SEQ ID NO: 33637

SEQ ID NO: 706898 - RNA, 64 nt, hsa; identical to SEQ ID NO: 33638

SEQ ID NO: 706899 - RNA, 64 nt, hsa; identical to SEQ ID NO: 33639

SEQ ID NO: 706900 - RNA, 64 nt, hsa; identical to SEQ ID NO: 33640

SEQ ID NO: 706901 - RNA, 64 nt, hsa; identical to SEQ ID NO: 33641

SEQ ID NO: 706902 - RNA, 64 nt, hsa; identical to SEQ ID NO: 33642

SEQ ID NO: 706903 - RNA, 64 nt, hsa; identical to SEQ ID NO: 33643

SEQ ID NO: 706904 - RNA, 64 nt, hsa; identical to SEQ ID NO: 33644

SEQ ID NO: 706905 - RNA, 64 nt, hsa; identical to SEQ ID NO: 33645

SEQ ID NO: 706906 - RNA, 64 nt, hsa; identical to SEQ ID NO: 33646

SEQ ID NO: 706907 - RNA, 64 nt, hsa; identical to SEQ ID NO: 33647

SEQ ID NO: 706908 - RNA, 64 nt, hsa; identical to SEQ ID NO: 33648

SEQ ID NO: 706909 - RNA, 64 nt, hsa; identical to SEQ ID NO: 33649

SEQ ID NO: 706910 - RNA, 64 nt, hsa; identical to SEQ ID NO: 33650

SEQ ID NO: 706911 - RNA, 64 nt, hsa; identical to SEQ ID NO: 33651

SEQ ID NO: 706912 - RNA, 64 nt, hsa; identical to SEQ ID NO: 33652

SEQ ID NO: 706913 - RNA, 64 nt, hsa; identical to SEQ ID NO: 33653

SEQ ID NO: 706914 - RNA, 64 nt, hsa; identical to SEQ ID NO: 33654

SEQ ID NO: 706915 - RNA, 64 nt, hsa; identical to SEQ ID NO: 33655

SEQ ID NO: 706916 - RNA, 64 nt, hsa; identical to SEQ ID NO: 33656

SEQ ID NO: 706917 - RNA, 64 nt, hsa; identical to SEQ ID NO: 33657

SEQ ID NO: 706918 - RNA, 64 nt, hsa; identical to SEQ ID NO: 33658

SEQ ID NO: 706919 - RNA, 64 nt, hsa; identical to SEQ ID NO: 33659

SEQ ID NO: 706920 - RNA, 64 nt, hsa; identical to SEQ ID NO: 33660

SEQ ID NO: 706921 - RNA, 64 nt, hsa; identical to SEQ ID NO: 33661

SEQ ID NO: 706922 - RNA, 64 nt, hsa; identical to SEQ ID NO: 33662

SEQ ID NO: 706923 - RNA, 64 nt, hsa; identical to SEQ ID NO: 33663

SEQ ID NO: 706924 - RNA, 64 nt, hsa; identical to SEQ ID NO: 33664

SEQ ID NO: 706925 - RNA, 64 nt, hsa; identical to SEQ ID NO: 33665

SEQ ID NO: 706926 - RNA, 64 nt, hsa; identical to SEQ ID NO: 33666

SEQ ID NO: 706927 - RNA, 64 nt, hsa; identical to SEQ ID NO: 33667

SEQ ID NO: 706928 - RNA, 64 nt, hsa; identical to SEQ ID NO: 33668

SEQ ID NO: 706929 - RNA, 64 nt, hsa; identical to SEQ ID NO: 33669

SEQ ID NO: 706930 - RNA, 64 nt, hsa; identical to SEQ ID NO: 33670

SEQ ID NO: 706931 - RNA, 64 nt, hsa; identical to SEQ ID NO: 33671

SEQ ID NO: 706932 - RNA, 64 nt, hsa; identical to SEQ ID NO: 33672

SEQ ID NO: 706933 - RNA, 64 nt, hsa; identical to SEQ ID NO: 33673

SEQ ID NO: 706934 - RNA, 64 nt, hsa; identical to SEQ ID NO: 33674

SEQ ID NO: 706935 - RNA, 64 nt, hsa; identical to SEQ ID NO: 33675

SEQ ID NO: 706936 - RNA, 64 nt, hsa; identical to SEQ ID NO: 33676

SEQ ID NO: 706937 - RNA, 64 nt, hsa; identical to SEQ ID NO: 33677

SEQ ID NO: 706938 - RNA, 64 nt, hsa; identical to SEQ ID NO: 33678

SEQ ID NO: 706939 - RNA, 64 nt, hsa; identical to SEQ ID NO: 33679

SEQ ID NO: 706940 - RNA, 64 nt, hsa; identical to SEQ ID NO: 33680

SEQ ID NO: 706941 - RNA, 64 nt, hsa; identical to SEQ ID NO: 33681

SEQ ID NO: 706942 - RNA, 64 nt, hsa; identical to SEQ ID NO: 33682

SEQ ID NO: 706943 - RNA, 64 nt, hsa; identical to SEQ ID NO: 33683

SEQ ID NO: 706944 - RNA, 64 nt, hsa; identical to SEQ ID NO: 33684

SEQ ID NO: 706945 - RNA, 64 nt, hsa; identical to SEQ ID NO: 33685

SEQ ID NO: 706946 - RNA, 64 nt, hsa; identical to SEQ ID NO: 33686

SEQ ID NO: 706947 - RNA, 64 nt, hsa; identical to SEQ ID NO: 33687

SEQ ID NO: 706948 - RNA, 64 nt, hsa; identical to SEQ ID NO: 33688

SEQ ID NO: 706949 - RNA, 64 nt, hsa; identical to SEQ ID NO: 33689

SEQ ID NO: 706950 - RNA, 64 nt, hsa; identical to SEQ ID NO: 33690

SEQ ID NO: 706951 - RNA, 64 nt, hsa; identical to SEQ ID NO: 33691

SEQ ID NO: 706952 - RNA, 64 nt, hsa; identical to SEQ ID NO: 33692

SEQ ID NO: 706953 - RNA, 64 nt, hsa; identical to SEQ ID NO: 33693

SEQ ID NO: 706954 - RNA, 64 nt, hsa; identical to SEQ ID NO: 33694

SEQ ID NO: 706955 - RNA, 64 nt, hsa; identical to SEQ ID NO: 33695

SEQ ID NO: 706956 - RNA, 64 nt, hsa; identical to SEQ ID NO: 33696

SEQ ID NO: 706957 - RNA, 64 nt, hsa; identical to SEQ ID NO: 33697

SEQ ID NO: 706958 - RNA, 64 nt, hsa; identical to SEQ ID NO: 33698

SEQ ID NO: 706959 - RNA, 64 nt, hsa; identical to SEQ ID NO: 33699

SEQ ID NO: 706960 - RNA, 64 nt, hsa; identical to SEQ ID NO: 33700

SEQ ID NO: 706961 - RNA, 64 nt, hsa; identical to SEQ ID NO: 33701

SEQ ID NO: 706962 - RNA, 64 nt, hsa; identical to SEQ ID NO: 33702

SEQ ID NO: 706963 - RNA, 64 nt, hsa; identical to SEQ ID NO: 33703

SEQ ID NO: 706964 - RNA, 64 nt, hsa; identical to SEQ ID NO: 33704

SEQ ID NO: 706965 - RNA, 64 nt, hsa; identical to SEQ ID NO: 33705

SEQ ID NO: 706966 - RNA, 64 nt, hsa; identical to SEQ ID NO: 33706

SEQ ID NO: 706967 - RNA, 64 nt, hsa; identical to SEQ ID NO: 33707

SEQ ID NO: 706968 - RNA, 64 nt, hsa; identical to SEQ ID NO: 33708

SEQ ID NO: 706969 - RNA, 64 nt, hsa; identical to SEQ ID NO: 33709

SEQ ID NO: 706970 - RNA, 64 nt, hsa; identical to SEQ ID NO: 33710

SEQ ID NO: 706971 - RNA, 64 nt, hsa; identical to SEQ ID NO: 33711

SEQ ID NO: 706972 - RNA, 64 nt, hsa; identical to SEQ ID NO: 33712

SEQ ID NO: 706973 - RNA, 64 nt, hsa; identical to SEQ ID NO: 33713

SEQ ID NO: 706974 - RNA, 64 nt, hsa; identical to SEQ ID NO: 33714

SEQ ID NO: 706975 - RNA, 64 nt, hsa; identical to SEQ ID NO: 33715

SEQ ID NO: 706976 - RNA, 64 nt, hsa; identical to SEQ ID NO: 33716

SEQ ID NO: 706977 - RNA, 64 nt, hsa; identical to SEQ ID NO: 33717

SEQ ID NO: 706978 - RNA, 64 nt, hsa; identical to SEQ ID NO: 33718

SEQ ID NO: 706979 - RNA, 64 nt, hsa; identical to SEQ ID NO: 33719

SEQ ID NO: 706980 - RNA, 64 nt, hsa; identical to SEQ ID NO: 33720

SEQ ID NO: 706981 - RNA, 64 nt, hsa; identical to SEQ ID NO: 33721

SEQ ID NO: 706982 - RNA, 64 nt, hsa; identical to SEQ ID NO: 33722

SEQ ID NO: 706983 - RNA, 64 nt, hsa; identical to SEQ ID NO: 33723

SEQ ID NO: 706984 - RNA, 64 nt, hsa; identical to SEQ ID NO: 33724

SEQ ID NO: 706985 - RNA, 64 nt, hsa; identical to SEQ ID NO: 33725

SEQ ID NO: 706986 - RNA, 64 nt, hsa; identical to SEQ ID NO: 33726

SEQ ID NO: 706987 - RNA, 64 nt, hsa; identical to SEQ ID NO: 33727

SEQ ID NO: 706988 - RNA, 64 nt, hsa; identical to SEQ ID NO: 33728

SEQ ID NO: 706989 - RNA, 64 nt, hsa; identical to SEQ ID NO: 33729

SEQ ID NO: 706990 - RNA, 64 nt, hsa; identical to SEQ ID NO: 33730

SEQ ID NO: 706991 - RNA, 64 nt, hsa; identical to SEQ ID NO: 33731

SEQ ID NO: 706992 - RNA, 64 nt, hsa; identical to SEQ ID NO: 33732

SEQ ID NO: 706993 - RNA, 64 nt, hsa; identical to SEQ ID NO: 33733

SEQ ID NO: 706994 - RNA, 64 nt, hsa; identical to SEQ ID NO: 33734

SEQ ID NO: 706995 - RNA, 64 nt, hsa; identical to SEQ ID NO: 33735

SEQ ID NO: 706996 - RNA, 64 nt, hsa; identical to SEQ ID NO: 33736

SEQ ID NO: 706997 - RNA, 64 nt, hsa; identical to SEQ ID NO: 33737

SEQ ID NO: 706998 - RNA, 64 nt, hsa; identical to SEQ ID NO: 33738

SEQ ID NO: 706999 - RNA, 64 nt, hsa; identical to SEQ ID NO: 33739

SEQ ID NO: 707000 - RNA, 64 nt, hsa; identical to SEQ ID NO: 33740

SEQ ID NO: 707001 - RNA, 64 nt, hsa; identical to SEQ ID NO: 33741

SEQ ID NO: 707002 - RNA, 64 nt, hsa; identical to SEQ ID NO: 33742

SEQ ID NO: 707003 - RNA, 64 nt, hsa; identical to SEQ ID NO: 33743

SEQ ID NO: 707004 - RNA, 64 nt, hsa; identical to SEQ ID NO: 33744

SEQ ID NO: 707005 - RNA, 64 nt, hsa; identical to SEQ ID NO: 33745

SEQ ID NO: 707006 - RNA, 64 nt, hsa; identical to SEQ ID NO: 33746

SEQ ID NO: 707007 - RNA, 64 nt, hsa; identical to SEQ ID NO: 33747

SEQ ID NO: 707008 - RNA, 64 nt, hsa; identical to SEQ ID NO: 33748

SEQ ID NO: 707009 - RNA, 64 nt, hsa; identical to SEQ ID NO: 33749

SEQ ID NO: 707010 - RNA, 64 nt, hsa; identical to SEQ ID NO: 33750

SEQ ID NO: 707011 - RNA, 64 nt, hsa; identical to SEQ ID NO: 33751

SEQ ID NO: 707012 - RNA, 64 nt, hsa; identical to SEQ ID NO: 33752

SEQ ID NO: 707013 - RNA, 64 nt, hsa; identical to SEQ ID NO: 33753

SEQ ID NO: 707014 - RNA, 64 nt, hsa; identical to SEQ ID NO: 33754

SEQ ID NO: 707015 - RNA, 64 nt, hsa; identical to SEQ ID NO: 33755

SEQ ID NO: 707016 - RNA, 64 nt, hsa; identical to SEQ ID NO: 33756

SEQ ID NO: 707017 - RNA, 64 nt, hsa; identical to SEQ ID NO: 33757

SEQ ID NO: 707018 - RNA, 64 nt, hsa; identical to SEQ ID NO: 33758

SEQ ID NO: 707019 - RNA, 64 nt, hsa; identical to SEQ ID NO: 33759

SEQ ID NO: 707020 - RNA, 64 nt, hsa; identical to SEQ ID NO: 33760

SEQ ID NO: 707021 - RNA, 64 nt, hsa; identical to SEQ ID NO: 33761

SEQ ID NO: 707022 - RNA, 64 nt, hsa; identical to SEQ ID NO: 33762

SEQ ID NO: 707023 - RNA, 64 nt, hsa; identical to SEQ ID NO: 33763

SEQ ID NO: 707024 - RNA, 64 nt, hsa; identical to SEQ ID NO: 33764

SEQ ID NO: 707025 - RNA, 64 nt, hsa; identical to SEQ ID NO: 33765

SEQ ID NO: 707026 - RNA, 64 nt, hsa; identical to SEQ ID NO: 33766

SEQ ID NO: 707027 - RNA, 64 nt, hsa; identical to SEQ ID NO: 33767

SEQ ID NO: 707028 - RNA, 64 nt, hsa; identical to SEQ ID NO: 33768

SEQ ID NO: 707029 - RNA, 64 nt, hsa; identical to SEQ ID NO: 33769

SEQ ID NO: 707030 - RNA, 64 nt, hsa; identical to SEQ ID NO: 33770

SEQ ID NO: 707031 - RNA, 64 nt, hsa; identical to SEQ ID NO: 33771

SEQ ID NO: 707032 - RNA, 64 nt, hsa; identical to SEQ ID NO: 33772

SEQ ID NO: 707033 - RNA, 64 nt, hsa; identical to SEQ ID NO: 33773

SEQ ID NO: 707034 - RNA, 64 nt, hsa; identical to SEQ ID NO: 33774

SEQ ID NO: 707035 - RNA, 64 nt, hsa; identical to SEQ ID NO: 33775

SEQ ID NO: 707036 - RNA, 64 nt, hsa; identical to SEQ ID NO: 33776

SEQ ID NO: 707037 - RNA, 64 nt, hsa; identical to SEQ ID NO: 33777

SEQ ID NO: 707038 - RNA, 64 nt, hsa; identical to SEQ ID NO: 33778

SEQ ID NO: 707039 - RNA, 64 nt, hsa; identical to SEQ ID NO: 33779

SEQ ID NO: 707040 - RNA, 64 nt, hsa; identical to SEQ ID NO: 33780

SEQ ID NO: 707041 - RNA, 64 nt, hsa; identical to SEQ ID NO: 33781

SEQ ID NO: 707042 - RNA, 64 nt, hsa; identical to SEQ ID NO: 33782

SEQ ID NO: 707043 - RNA, 64 nt, hsa; identical to SEQ ID NO: 33783

SEQ ID NO: 707044 - RNA, 64 nt, hsa; identical to SEQ ID NO: 33784

SEQ ID NO: 707045 - RNA, 64 nt, hsa; identical to SEQ ID NO: 33785

SEQ ID NO: 707046 - RNA, 64 nt, hsa; identical to SEQ ID NO: 33786

SEQ ID NO: 707047 - RNA, 64 nt, hsa; identical to SEQ ID NO: 33787

SEQ ID NO: 707048 - RNA, 64 nt, hsa; identical to SEQ ID NO: 33788

SEQ ID NO: 707049 - RNA, 64 nt, hsa; identical to SEQ ID NO: 33789

SEQ ID NO: 707050 - RNA, 64 nt, hsa; identical to SEQ ID NO: 33790

SEQ ID NO: 707051 - RNA, 64 nt, hsa; identical to SEQ ID NO: 33791

SEQ ID NO: 707052 - RNA, 64 nt, hsa; identical to SEQ ID NO: 33792

SEQ ID NO: 707053 - RNA, 64 nt, hsa; identical to SEQ ID NO: 33793

SEQ ID NO: 707054 - RNA, 64 nt, hsa; identical to SEQ ID NO: 33794

SEQ ID NO: 707055 - RNA, 64 nt, hsa; identical to SEQ ID NO: 33795

SEQ ID NO: 707056 - RNA, 64 nt, hsa; identical to SEQ ID NO: 33796

SEQ ID NO: 707057 - RNA, 64 nt, hsa; identical to SEQ ID NO: 33797

SEQ ID NO: 707058 - RNA, 64 nt, hsa; identical to SEQ ID NO: 33798

SEQ ID NO: 707059 - RNA, 64 nt, hsa; identical to SEQ ID NO: 33799

SEQ ID NO: 707060 - RNA, 64 nt, hsa; identical to SEQ ID NO: 33800

SEQ ID NO: 707061 - RNA, 64 nt, hsa; identical to SEQ ID NO: 33801

SEQ ID NO: 707062 - RNA, 64 nt, hsa; identical to SEQ ID NO: 33802

SEQ ID NO: 707063 - RNA, 64 nt, hsa; identical to SEQ ID NO: 33803

SEQ ID NO: 707064 - RNA, 64 nt, hsa; identical to SEQ ID NO: 33804

SEQ ID NO: 707065 - RNA, 64 nt, hsa; identical to SEQ ID NO: 33805

SEQ ID NO: 707066 - RNA, 64 nt, hsa; identical to SEQ ID NO: 33806

SEQ ID NO: 707067 - RNA, 64 nt, hsa; identical to SEQ ID NO: 33807

SEQ ID NO: 707068 - RNA, 64 nt, hsa; identical to SEQ ID NO: 33808

SEQ ID NO: 707069 - RNA, 64 nt, hsa; identical to SEQ ID NO: 33809

SEQ ID NO: 707070 - RNA, 64 nt, hsa; identical to SEQ ID NO: 33810

SEQ ID NO: 707071 - RNA, 64 nt, hsa; identical to SEQ ID NO: 33811

SEQ ID NO: 707072 - RNA, 64 nt, hsa; identical to SEQ ID NO: 33812

SEQ ID NO: 707073 - RNA, 64 nt, hsa; identical to SEQ ID NO: 33813

SEQ ID NO: 707074 - RNA, 64 nt, hsa; identical to SEQ ID NO: 33814

SEQ ID NO: 707075 - RNA, 64 nt, hsa; identical to SEQ ID NO: 33815

SEQ ID NO: 707076 - RNA, 64 nt, hsa; identical to SEQ ID NO: 33816

SEQ ID NO: 707077 - RNA, 64 nt, hsa; identical to SEQ ID NO: 33817

SEQ ID NO: 707078 - RNA, 64 nt, hsa; identical to SEQ ID NO: 33818

SEQ ID NO: 707079 - RNA, 64 nt, hsa; identical to SEQ ID NO: 33819

SEQ ID NO: 707080 - RNA, 64 nt, hsa; identical to SEQ ID NO: 33820

SEQ ID NO: 707081 - RNA, 64 nt, hsa; identical to SEQ ID NO: 33821

SEQ ID NO: 707082 - RNA, 64 nt, hsa; identical to SEQ ID NO: 33822

SEQ ID NO: 707083 - RNA, 64 nt, hsa; identical to SEQ ID NO: 33823

SEQ ID NO: 707084 - RNA, 64 nt, hsa; identical to SEQ ID NO: 33824

SEQ ID NO: 707085 - RNA, 64 nt, hsa; identical to SEQ ID NO: 33825

SEQ ID NO: 707086 - RNA, 64 nt, hsa; identical to SEQ ID NO: 33826

SEQ ID NO: 707087 - RNA, 64 nt, hsa; identical to SEQ ID NO: 33827

SEQ ID NO: 707088 - RNA, 64 nt, hsa; identical to SEQ ID NO: 33828

SEQ ID NO: 707089 - RNA, 64 nt, hsa; identical to SEQ ID NO: 33829

SEQ ID NO: 707090 - RNA, 64 nt, hsa; identical to SEQ ID NO: 33830

SEQ ID NO: 707091 - RNA, 64 nt, hsa; identical to SEQ ID NO: 33831

SEQ ID NO: 707092 - RNA, 64 nt, hsa; identical to SEQ ID NO: 33832

SEQ ID NO: 707093 - RNA, 64 nt, hsa; identical to SEQ ID NO: 33833

SEQ ID NO: 707094 - RNA, 64 nt, hsa; identical to SEQ ID NO: 33834

SEQ ID NO: 707095 - RNA, 64 nt, hsa; identical to SEQ ID NO: 33835

SEQ ID NO: 707096 - RNA, 64 nt, hsa; identical to SEQ ID NO: 33836

SEQ ID NO: 707097 - RNA, 64 nt, hsa; identical to SEQ ID NO: 33837

SEQ ID NO: 707098 - RNA, 64 nt, hsa; identical to SEQ ID NO: 33838

SEQ ID NO: 707099 - RNA, 64 nt, hsa; identical to SEQ ID NO: 33839

SEQ ID NO: 707100 - RNA, 64 nt, hsa; identical to SEQ ID NO: 33840

SEQ ID NO: 707101 - RNA, 64 nt, hsa; identical to SEQ ID NO: 33841

SEQ ID NO: 707102 - RNA, 64 nt, hsa; identical to SEQ ID NO: 33842

SEQ ID NO: 707103 - RNA, 64 nt, hsa; identical to SEQ ID NO: 33843

SEQ ID NO: 707104 - RNA, 64 nt, hsa; identical to SEQ ID NO: 33844

SEQ ID NO: 707105 - RNA, 64 nt, hsa; identical to SEQ ID NO: 33845

SEQ ID NO: 707106 - RNA, 64 nt, hsa; identical to SEQ ID NO: 33846

SEQ ID NO: 707107 - RNA, 64 nt, hsa; identical to SEQ ID NO: 33847

SEQ ID NO: 707108 - RNA, 64 nt, hsa; identical to SEQ ID NO: 33848

SEQ ID NO: 707109 - RNA, 64 nt, hsa; identical to SEQ ID NO: 33849

SEQ ID NO: 707110 - RNA, 64 nt, hsa; identical to SEQ ID NO: 33850

SEQ ID NO: 707111 - RNA, 64 nt, hsa; identical to SEQ ID NO: 33851

SEQ ID NO: 707112 - RNA, 64 nt, hsa; identical to SEQ ID NO: 33852

SEQ ID NO: 707113 - RNA, 64 nt, hsa; identical to SEQ ID NO: 33853

SEQ ID NO: 707114 - RNA, 64 nt, hsa; identical to SEQ ID NO: 33854

SEQ ID NO: 707115 - RNA, 64 nt, hsa; identical to SEQ ID NO: 33855

SEQ ID NO: 707116 - RNA, 64 nt, hsa; identical to SEQ ID NO: 33856

SEQ ID NO: 707117 - RNA, 64 nt, hsa; identical to SEQ ID NO: 33857

SEQ ID NO: 707118 - RNA, 64 nt, hsa; identical to SEQ ID NO: 33858

SEQ ID NO: 707119 - RNA, 64 nt, hsa; identical to SEQ ID NO: 33859

SEQ ID NO: 707120 - RNA, 64 nt, hsa; identical to SEQ ID NO: 33860

SEQ ID NO: 707121 - RNA, 64 nt, hsa; identical to SEQ ID NO: 33861

SEQ ID NO: 707122 - RNA, 64 nt, hsa; identical to SEQ ID NO: 33862

SEQ ID NO: 707123 - RNA, 64 nt, hsa; identical to SEQ ID NO: 33863

SEQ ID NO: 707124 - RNA, 64 nt, hsa; identical to SEQ ID NO: 33864

SEQ ID NO: 707125 - RNA, 64 nt, hsa; identical to SEQ ID NO: 33865

SEQ ID NO: 707126 - RNA, 64 nt, hsa; identical to SEQ ID NO: 33866

SEQ ID NO: 707127 - RNA, 64 nt, hsa; identical to SEQ ID NO: 33867

SEQ ID NO: 707128 - RNA, 64 nt, hsa; identical to SEQ ID NO: 33868

SEQ ID NO: 707129 - RNA, 64 nt, hsa; identical to SEQ ID NO: 33869

SEQ ID NO: 707130 - RNA, 64 nt, hsa; identical to SEQ ID NO: 33870

SEQ ID NO: 707131 - RNA, 64 nt, hsa; identical to SEQ ID NO: 33871

SEQ ID NO: 707132 - RNA, 64 nt, hsa; identical to SEQ ID NO: 33872

SEQ ID NO: 707133 - RNA, 64 nt, hsa; identical to SEQ ID NO: 33873

SEQ ID NO: 707134 - RNA, 64 nt, hsa; identical to SEQ ID NO: 33874

SEQ ID NO: 707135 - RNA, 64 nt, hsa; identical to SEQ ID NO: 33875

SEQ ID NO: 707136 - RNA, 64 nt, hsa; identical to SEQ ID NO: 33876

SEQ ID NO: 707137 - RNA, 64 nt, hsa; identical to SEQ ID NO: 33877

SEQ ID NO: 707138 - RNA, 64 nt, hsa; identical to SEQ ID NO: 33878

SEQ ID NO: 707139 - RNA, 64 nt, hsa; identical to SEQ ID NO: 33879

SEQ ID NO: 707140 - RNA, 64 nt, hsa; identical to SEQ ID NO: 33880

SEQ ID NO: 707141 - RNA, 64 nt, hsa; identical to SEQ ID NO: 33881

SEQ ID NO: 707142 - RNA, 64 nt, hsa; identical to SEQ ID NO: 33882

SEQ ID NO: 707143 - RNA, 64 nt, hsa; identical to SEQ ID NO: 33883

SEQ ID NO: 707144 - RNA, 64 nt, hsa; identical to SEQ ID NO: 33884

SEQ ID NO: 707145 - RNA, 64 nt, hsa; identical to SEQ ID NO: 33885

SEQ ID NO: 707146 - RNA, 64 nt, hsa; identical to SEQ ID NO: 33886

SEQ ID NO: 707147 - RNA, 64 nt, hsa; identical to SEQ ID NO: 33887

SEQ ID NO: 707148 - RNA, 64 nt, hsa; identical to SEQ ID NO: 33888

SEQ ID NO: 707149 - RNA, 64 nt, hsa; identical to SEQ ID NO: 33889

SEQ ID NO: 707150 - RNA, 64 nt, hsa; identical to SEQ ID NO: 33890

SEQ ID NO: 707151 - RNA, 64 nt, hsa; identical to SEQ ID NO: 33891

SEQ ID NO: 707152 - RNA, 64 nt, hsa; identical to SEQ ID NO: 33892

SEQ ID NO: 707153 - RNA, 64 nt, hsa; identical to SEQ ID NO: 33893

SEQ ID NO: 707154 - RNA, 64 nt, hsa; identical to SEQ ID NO: 33894

SEQ ID NO: 707155 - RNA, 64 nt, hsa; identical to SEQ ID NO: 33895

SEQ ID NO: 707156 - RNA, 64 nt, hsa; identical to SEQ ID NO: 33896

SEQ ID NO: 707157 - RNA, 64 nt, hsa; identical to SEQ ID NO: 33897

SEQ ID NO: 707158 - RNA, 64 nt, hsa; identical to SEQ ID NO: 33898

SEQ ID NO: 707159 - RNA, 64 nt, hsa; identical to SEQ ID NO: 33899

SEQ ID NO: 707160 - RNA, 64 nt, hsa; identical to SEQ ID NO: 33900

SEQ ID NO: 707161 - RNA, 64 nt, hsa; identical to SEQ ID NO: 33901

SEQ ID NO: 707162 - RNA, 64 nt, hsa; identical to SEQ ID NO: 33902

SEQ ID NO: 707163 - RNA, 64 nt, hsa; identical to SEQ ID NO: 33903

SEQ ID NO: 707164 - RNA, 64 nt, hsa; identical to SEQ ID NO: 33904

SEQ ID NO: 707165 - RNA, 64 nt, hsa; identical to SEQ ID NO: 33905

SEQ ID NO: 707166 - RNA, 64 nt, hsa; identical to SEQ ID NO: 33906

SEQ ID NO: 707167 - RNA, 64 nt, hsa; identical to SEQ ID NO: 33907

SEQ ID NO: 707168 - RNA, 64 nt, hsa; identical to SEQ ID NO: 33908

SEQ ID NO: 707169 - RNA, 64 nt, hsa; identical to SEQ ID NO: 33909

SEQ ID NO: 707170 - RNA, 64 nt, hsa; identical to SEQ ID NO: 33910

SEQ ID NO: 707171 - RNA, 64 nt, hsa; identical to SEQ ID NO: 33911

SEQ ID NO: 707172 - RNA, 64 nt, hsa; identical to SEQ ID NO: 33912

SEQ ID NO: 707173 - RNA, 64 nt, hsa; identical to SEQ ID NO: 33913

SEQ ID NO: 707174 - RNA, 64 nt, hsa; identical to SEQ ID NO: 33914

SEQ ID NO: 707175 - RNA, 64 nt, hsa; identical to SEQ ID NO: 33915

SEQ ID NO: 707176 - RNA, 64 nt, hsa; identical to SEQ ID NO: 33916

SEQ ID NO: 707177 - RNA, 64 nt, hsa; identical to SEQ ID NO: 33917

SEQ ID NO: 707178 - RNA, 64 nt, hsa; identical to SEQ ID NO: 33918

SEQ ID NO: 707179 - RNA, 64 nt, hsa; identical to SEQ ID NO: 33919

SEQ ID NO: 707180 - RNA, 64 nt, hsa; identical to SEQ ID NO: 33920

SEQ ID NO: 707181 - RNA, 64 nt, hsa; identical to SEQ ID NO: 33921

SEQ ID NO: 707182 - RNA, 64 nt, hsa; identical to SEQ ID NO: 33922

SEQ ID NO: 707183 - RNA, 64 nt, hsa; identical to SEQ ID NO: 33923

SEQ ID NO: 707184 - RNA, 64 nt, hsa; identical to SEQ ID NO: 33924

SEQ ID NO: 707185 - RNA, 64 nt, hsa; identical to SEQ ID NO: 33925

SEQ ID NO: 707186 - RNA, 64 nt, hsa; identical to SEQ ID NO: 33926

SEQ ID NO: 707187 - RNA, 64 nt, hsa; identical to SEQ ID NO: 33927

SEQ ID NO: 707188 - RNA, 64 nt, hsa; identical to SEQ ID NO: 33928

SEQ ID NO: 707189 - RNA, 64 nt, hsa; identical to SEQ ID NO: 33929

SEQ ID NO: 707190 - RNA, 64 nt, hsa; identical to SEQ ID NO: 33930

SEQ ID NO: 707191 - RNA, 64 nt, hsa; identical to SEQ ID NO: 33931

SEQ ID NO: 707192 - RNA, 64 nt, hsa; identical to SEQ ID NO: 33932

SEQ ID NO: 707193 - RNA, 64 nt, hsa; identical to SEQ ID NO: 33933

SEQ ID NO: 707194 - RNA, 64 nt, hsa; identical to SEQ ID NO: 33934

SEQ ID NO: 707195 - RNA, 64 nt, hsa; identical to SEQ ID NO: 33935

SEQ ID NO: 707196 - RNA, 64 nt, hsa; identical to SEQ ID NO: 33936

SEQ ID NO: 707197 - RNA, 64 nt, hsa; identical to SEQ ID NO: 33937

SEQ ID NO: 707198 - RNA, 64 nt, hsa; identical to SEQ ID NO: 33938

SEQ ID NO: 707199 - RNA, 64 nt, hsa; identical to SEQ ID NO: 33939

SEQ ID NO: 707200 - RNA, 64 nt, hsa; identical to SEQ ID NO: 33940

SEQ ID NO: 707201 - RNA, 64 nt, hsa; identical to SEQ ID NO: 33941

SEQ ID NO: 707202 - RNA, 64 nt, hsa; identical to SEQ ID NO: 33942

SEQ ID NO: 707203 - RNA, 64 nt, hsa; identical to SEQ ID NO: 33943

SEQ ID NO: 707204 - RNA, 64 nt, hsa; identical to SEQ ID NO: 33944

SEQ ID NO: 707205 - RNA, 64 nt, hsa; identical to SEQ ID NO: 33945

SEQ ID NO: 707206 - RNA, 64 nt, hsa; identical to SEQ ID NO: 33946

SEQ ID NO: 707207 - RNA, 64 nt, hsa; identical to SEQ ID NO: 33947

SEQ ID NO: 707208 - RNA, 64 nt, hsa; identical to SEQ ID NO: 33948

SEQ ID NO: 707209 - RNA, 64 nt, hsa; identical to SEQ ID NO: 33949

SEQ ID NO: 707210 - RNA, 64 nt, hsa; identical to SEQ ID NO: 33950

SEQ ID NO: 707211 - RNA, 64 nt, hsa; identical to SEQ ID NO: 33951

SEQ ID NO: 707212 - RNA, 64 nt, hsa; identical to SEQ ID NO: 33952

SEQ ID NO: 707213 - RNA, 63 nt, hsa; identical to SEQ ID NO: 33953

SEQ ID NO: 707214 - RNA, 62 nt, hsa; identical to SEQ ID NO: 33954

SEQ ID NO: 707215 - RNA, 64 nt, hsa; identical to SEQ ID NO: 33955

SEQ ID NO: 707216 - RNA, 64 nt, hsa; identical to SEQ ID NO: 33956

SEQ ID NO: 707217 - RNA, 64 nt, hsa; identical to SEQ ID NO: 33957

SEQ ID NO: 707218 - RNA, 64 nt, hsa; identical to SEQ ID NO: 33958

SEQ ID NO: 707219 - RNA, 64 nt, hsa; identical to SEQ ID NO: 33959

SEQ ID NO: 707220 - RNA, 64 nt, hsa; identical to SEQ ID NO: 33960

SEQ ID NO: 707221 - RNA, 64 nt, hsa; identical to SEQ ID NO: 33961

SEQ ID NO: 707222 - RNA, 64 nt, hsa; identical to SEQ ID NO: 33962

SEQ ID NO: 707223 - RNA, 64 nt, hsa; identical to SEQ ID NO: 33963

SEQ ID NO: 707224 - RNA, 64 nt, hsa; identical to SEQ ID NO: 33964

SEQ ID NO: 707225 - RNA, 64 nt, hsa; identical to SEQ ID NO: 33965

SEQ ID NO: 707226 - RNA, 64 nt, hsa; identical to SEQ ID NO: 33966

SEQ ID NO: 707227 - RNA, 64 nt, hsa; identical to SEQ ID NO: 33967

SEQ ID NO: 707228 - RNA, 64 nt, hsa; identical to SEQ ID NO: 33968

SEQ ID NO: 707229 - RNA, 64 nt, hsa; identical to SEQ ID NO: 33969

SEQ ID NO: 707230 - RNA, 64 nt, hsa; identical to SEQ ID NO: 33970

SEQ ID NO: 707231 - RNA, 64 nt, hsa; identical to SEQ ID NO: 33971

SEQ ID NO: 707232 - RNA, 64 nt, hsa; identical to SEQ ID NO: 33972

SEQ ID NO: 707233 - RNA, 64 nt, hsa; identical to SEQ ID NO: 33973

SEQ ID NO: 707234 - RNA, 64 nt, hsa; identical to SEQ ID NO: 33974

SEQ ID NO: 707235 - RNA, 64 nt, hsa; identical to SEQ ID NO: 33975

SEQ ID NO: 707236 - RNA, 64 nt, hsa; identical to SEQ ID NO: 33976

SEQ ID NO: 707237 - RNA, 64 nt, hsa; identical to SEQ ID NO: 33977

SEQ ID NO: 707238 - RNA, 64 nt, hsa; identical to SEQ ID NO: 33978

SEQ ID NO: 707239 - RNA, 64 nt, hsa; identical to SEQ ID NO: 33979

SEQ ID NO: 707240 - RNA, 64 nt, hsa; identical to SEQ ID NO: 33980

SEQ ID NO: 707241 - RNA, 64 nt, hsa; identical to SEQ ID NO: 33981

SEQ ID NO: 707242 - RNA, 64 nt, hsa; identical to SEQ ID NO: 33982

SEQ ID NO: 707243 - RNA, 64 nt, hsa; identical to SEQ ID NO: 33983

SEQ ID NO: 707244 - RNA, 64 nt, hsa; identical to SEQ ID NO: 33984

SEQ ID NO: 707245 - RNA, 64 nt, hsa; identical to SEQ ID NO: 33985

SEQ ID NO: 707246 - RNA, 64 nt, hsa; identical to SEQ ID NO: 33986

SEQ ID NO: 707247 - RNA, 64 nt, hsa; identical to SEQ ID NO: 33987

SEQ ID NO: 707248 - RNA, 64 nt, hsa; identical to SEQ ID NO: 33988

SEQ ID NO: 707249 - RNA, 64 nt, hsa; identical to SEQ ID NO: 33989

SEQ ID NO: 707250 - RNA, 64 nt, hsa; identical to SEQ ID NO: 33990

SEQ ID NO: 707251 - RNA, 64 nt, hsa; identical to SEQ ID NO: 33991

SEQ ID NO: 707252 - RNA, 64 nt, hsa; identical to SEQ ID NO: 33992

SEQ ID NO: 707253 - RNA, 64 nt, hsa; identical to SEQ ID NO: 33993

SEQ ID NO: 707254 - RNA, 64 nt, hsa; identical to SEQ ID NO: 33994

SEQ ID NO: 707255 - RNA, 64 nt, hsa; identical to SEQ ID NO: 33995

SEQ ID NO: 707256 - RNA, 64 nt, hsa; identical to SEQ ID NO: 33996

SEQ ID NO: 707257 - RNA, 64 nt, hsa; identical to SEQ ID NO: 33997

SEQ ID NO: 707258 - RNA, 64 nt, hsa; identical to SEQ ID NO: 33998

SEQ ID NO: 707259 - RNA, 64 nt, hsa; identical to SEQ ID NO: 33999

SEQ ID NO: 707260 - RNA, 64 nt, hsa; identical to SEQ ID NO: 34000

SEQ ID NO: 707261 - RNA, 64 nt, hsa; identical to SEQ ID NO: 34001

SEQ ID NO: 707262 - RNA, 64 nt, hsa; identical to SEQ ID NO: 34002

SEQ ID NO: 707263 - RNA, 64 nt, hsa; identical to SEQ ID NO: 34003

SEQ ID NO: 707264 - RNA, 64 nt, hsa; identical to SEQ ID NO: 34004

SEQ ID NO: 707265 - RNA, 64 nt, hsa; identical to SEQ ID NO: 34005

SEQ ID NO: 707266 - RNA, 64 nt, hsa; identical to SEQ ID NO: 34006

SEQ ID NO: 707267 - RNA, 64 nt, hsa; identical to SEQ ID NO: 34007

SEQ ID NO: 707268 - RNA, 64 nt, hsa; identical to SEQ ID NO: 34008

SEQ ID NO: 707269 - RNA, 64 nt, hsa; identical to SEQ ID NO: 34009

SEQ ID NO: 707270 - RNA, 64 nt, hsa; identical to SEQ ID NO: 34010

SEQ ID NO: 707271 - RNA, 64 nt, hsa; identical to SEQ ID NO: 34011

SEQ ID NO: 707272 - RNA, 64 nt, hsa; identical to SEQ ID NO: 34012

SEQ ID NO: 707273 - RNA, 64 nt, hsa; identical to SEQ ID NO: 34013

SEQ ID NO: 707274 - RNA, 64 nt, hsa; identical to SEQ ID NO: 34014

SEQ ID NO: 707275 - RNA, 64 nt, hsa; identical to SEQ ID NO: 34015

SEQ ID NO: 707276 - RNA, 64 nt, hsa; identical to SEQ ID NO: 34016

SEQ ID NO: 707277 - RNA, 64 nt, hsa; identical to SEQ ID NO: 34017

SEQ ID NO: 707278 - RNA, 64 nt, hsa; identical to SEQ ID NO: 34018

SEQ ID NO: 707279 - RNA, 64 nt, hsa; identical to SEQ ID NO: 34019

SEQ ID NO: 707280 - RNA, 64 nt, hsa; identical to SEQ ID NO: 34020

SEQ ID NO: 707281 - RNA, 64 nt, hsa; identical to SEQ ID NO: 34021

SEQ ID NO: 707282 - RNA, 64 nt, hsa; identical to SEQ ID NO: 34022

SEQ ID NO: 707283 - RNA, 64 nt, hsa; identical to SEQ ID NO: 34023

SEQ ID NO: 707284 - RNA, 64 nt, hsa; identical to SEQ ID NO: 34024

SEQ ID NO: 707285 - RNA, 64 nt, hsa; identical to SEQ ID NO: 34025

SEQ ID NO: 707286 - RNA, 64 nt, hsa; identical to SEQ ID NO: 34026

SEQ ID NO: 707287 - RNA, 64 nt, hsa; identical to SEQ ID NO: 34027

SEQ ID NO: 707288 - RNA, 64 nt, hsa; identical to SEQ ID NO: 34028

SEQ ID NO: 707289 - RNA, 64 nt, hsa; identical to SEQ ID NO: 34029

SEQ ID NO: 707290 - RNA, 64 nt, hsa; identical to SEQ ID NO: 34030

SEQ ID NO: 707291 - RNA, 64 nt, hsa; identical to SEQ ID NO: 34031

SEQ ID NO: 707292 - RNA, 64 nt, hsa; identical to SEQ ID NO: 34032

SEQ ID NO: 707293 - RNA, 64 nt, hsa; identical to SEQ ID NO: 34033

SEQ ID NO: 707294 - RNA, 64 nt, hsa; identical to SEQ ID NO: 34034

SEQ ID NO: 707295 - RNA, 64 nt, hsa; identical to SEQ ID NO: 34035

SEQ ID NO: 707296 - RNA, 64 nt, hsa; identical to SEQ ID NO: 34036

SEQ ID NO: 707297 - RNA, 64 nt, hsa; identical to SEQ ID NO: 34037

SEQ ID NO: 707298 - RNA, 64 nt, hsa; identical to SEQ ID NO: 34038

SEQ ID NO: 707299 - RNA, 64 nt, hsa; identical to SEQ ID NO: 34039

SEQ ID NO: 707300 - RNA, 64 nt, hsa; identical to SEQ ID NO: 34040

SEQ ID NO: 707301 - RNA, 64 nt, hsa; identical to SEQ ID NO: 34041

SEQ ID NO: 707302 - RNA, 64 nt, hsa; identical to SEQ ID NO: 34042

SEQ ID NO: 707303 - RNA, 64 nt, hsa; identical to SEQ ID NO: 34043

SEQ ID NO: 707304 - RNA, 64 nt, hsa; identical to SEQ ID NO: 34044

SEQ ID NO: 707305 - RNA, 64 nt, hsa; identical to SEQ ID NO: 34045

SEQ ID NO: 707306 - RNA, 64 nt, hsa; identical to SEQ ID NO: 34046

SEQ ID NO: 707307 - RNA, 64 nt, hsa; identical to SEQ ID NO: 34047

SEQ ID NO: 707308 - RNA, 64 nt, hsa; identical to SEQ ID NO: 34048

SEQ ID NO: 707309 - RNA, 64 nt, hsa; identical to SEQ ID NO: 34049

SEQ ID NO: 707310 - RNA, 64 nt, hsa; identical to SEQ ID NO: 34050

SEQ ID NO: 707311 - RNA, 64 nt, hsa; identical to SEQ ID NO: 34051

SEQ ID NO: 707312 - RNA, 64 nt, hsa; identical to SEQ ID NO: 34052

SEQ ID NO: 707313 - RNA, 64 nt, hsa; identical to SEQ ID NO: 34053

SEQ ID NO: 707314 - RNA, 64 nt, hsa; identical to SEQ ID NO: 34054

SEQ ID NO: 707315 - RNA, 64 nt, hsa; identical to SEQ ID NO: 34055

SEQ ID NO: 707316 - RNA, 64 nt, hsa; identical to SEQ ID NO: 34056

SEQ ID NO: 707317 - RNA, 64 nt, hsa; identical to SEQ ID NO: 34057

SEQ ID NO: 707318 - RNA, 64 nt, hsa; identical to SEQ ID NO: 34058

SEQ ID NO: 707319 - RNA, 64 nt, hsa; identical to SEQ ID NO: 34059

SEQ ID NO: 707320 - RNA, 64 nt, hsa; identical to SEQ ID NO: 34060

SEQ ID NO: 707321 - RNA, 64 nt, hsa; identical to SEQ ID NO: 34061

SEQ ID NO: 707322 - RNA, 64 nt, hsa; identical to SEQ ID NO: 34062

SEQ ID NO: 707323 - RNA, 64 nt, hsa; identical to SEQ ID NO: 34063

SEQ ID NO: 707324 - RNA, 64 nt, hsa; identical to SEQ ID NO: 34064

SEQ ID NO: 707325 - RNA, 64 nt, hsa; identical to SEQ ID NO: 34065

SEQ ID NO: 707326 - RNA, 64 nt, hsa; identical to SEQ ID NO: 34066

SEQ ID NO: 707327 - RNA, 64 nt, hsa; identical to SEQ ID NO: 34067

SEQ ID NO: 707328 - RNA, 64 nt, hsa; identical to SEQ ID NO: 34068

SEQ ID NO: 707329 - RNA, 64 nt, hsa; identical to SEQ ID NO: 34069

SEQ ID NO: 707330 - RNA, 64 nt, hsa; identical to SEQ ID NO: 34070

SEQ ID NO: 707331 - RNA, 64 nt, hsa; identical to SEQ ID NO: 34071

SEQ ID NO: 707332 - RNA, 64 nt, hsa; identical to SEQ ID NO: 34072

SEQ ID NO: 707333 - RNA, 64 nt, hsa; identical to SEQ ID NO: 34073

SEQ ID NO: 707334 - RNA, 64 nt, hsa; identical to SEQ ID NO: 34074

SEQ ID NO: 707335 - RNA, 64 nt, hsa; identical to SEQ ID NO: 34075

SEQ ID NO: 707336 - RNA, 64 nt, hsa; identical to SEQ ID NO: 34076

SEQ ID NO: 707337 - RNA, 64 nt, hsa; identical to SEQ ID NO: 34077

SEQ ID NO: 707338 - RNA, 64 nt, hsa; identical to SEQ ID NO: 34078

SEQ ID NO: 707339 - RNA, 64 nt, hsa; identical to SEQ ID NO: 34079

SEQ ID NO: 707340 - RNA, 64 nt, hsa; identical to SEQ ID NO: 34080

SEQ ID NO: 707341 - RNA, 64 nt, hsa; identical to SEQ ID NO: 34081

SEQ ID NO: 707342 - RNA, 64 nt, hsa; identical to SEQ ID NO: 34082

SEQ ID NO: 707343 - RNA, 64 nt, hsa; identical to SEQ ID NO: 34083

SEQ ID NO: 707344 - RNA, 64 nt, hsa; identical to SEQ ID NO: 34084

SEQ ID NO: 707345 - RNA, 64 nt, hsa; identical to SEQ ID NO: 34085

SEQ ID NO: 707346 - RNA, 64 nt, hsa; identical to SEQ ID NO: 34086

SEQ ID NO: 707347 - RNA, 64 nt, hsa; identical to SEQ ID NO: 34087

SEQ ID NO: 707348 - RNA, 64 nt, hsa; identical to SEQ ID NO: 34088

SEQ ID NO: 707349 - RNA, 64 nt, hsa; identical to SEQ ID NO: 34089

SEQ ID NO: 707350 - RNA, 64 nt, hsa; identical to SEQ ID NO: 34090

SEQ ID NO: 707351 - RNA, 64 nt, hsa; identical to SEQ ID NO: 34091

SEQ ID NO: 707352 - RNA, 64 nt, hsa; identical to SEQ ID NO: 34092

SEQ ID NO: 707353 - RNA, 64 nt, hsa; identical to SEQ ID NO: 34093

SEQ ID NO: 707354 - RNA, 64 nt, hsa; identical to SEQ ID NO: 34094

SEQ ID NO: 707355 - RNA, 64 nt, hsa; identical to SEQ ID NO: 34095

SEQ ID NO: 707356 - RNA, 64 nt, hsa; identical to SEQ ID NO: 34096

SEQ ID NO: 707357 - RNA, 64 nt, hsa; identical to SEQ ID NO: 34097

SEQ ID NO: 707358 - RNA, 64 nt, hsa; identical to SEQ ID NO: 34098

SEQ ID NO: 707359 - RNA, 64 nt, hsa; identical to SEQ ID NO: 34099

SEQ ID NO: 707360 - RNA, 64 nt, hsa; identical to SEQ ID NO: 34100

SEQ ID NO: 707361 - RNA, 64 nt, hsa; identical to SEQ ID NO: 34101

SEQ ID NO: 707362 - RNA, 64 nt, hsa; identical to SEQ ID NO: 34102

SEQ ID NO: 707363 - RNA, 64 nt, hsa; identical to SEQ ID NO: 34103

SEQ ID NO: 707364 - RNA, 64 nt, hsa; identical to SEQ ID NO: 34104

SEQ ID NO: 707365 - RNA, 64 nt, hsa; identical to SEQ ID NO: 34105

SEQ ID NO: 707366 - RNA, 64 nt, hsa; identical to SEQ ID NO: 34106

SEQ ID NO: 707367 - RNA, 64 nt, hsa; identical to SEQ ID NO: 34107

SEQ ID NO: 707368 - RNA, 64 nt, hsa; identical to SEQ ID NO: 34108

SEQ ID NO: 707369 - RNA, 64 nt, hsa; identical to SEQ ID NO: 34109

SEQ ID NO: 707370 - RNA, 64 nt, hsa; identical to SEQ ID NO: 34110

SEQ ID NO: 707371 - RNA, 64 nt, hsa; identical to SEQ ID NO: 34111

SEQ ID NO: 707372 - RNA, 64 nt, hsa; identical to SEQ ID NO: 34112

SEQ ID NO: 707373 - RNA, 64 nt, hsa; identical to SEQ ID NO: 34113

SEQ ID NO: 707374 - RNA, 64 nt, hsa; identical to SEQ ID NO: 34114

SEQ ID NO: 707375 - RNA, 64 nt, hsa; identical to SEQ ID NO: 34115

SEQ ID NO: 707376 - RNA, 64 nt, hsa; identical to SEQ ID NO: 34116

SEQ ID NO: 707377 - RNA, 64 nt, hsa; identical to SEQ ID NO: 34117

SEQ ID NO: 707378 - RNA, 64 nt, hsa; identical to SEQ ID NO: 34118

SEQ ID NO: 707379 - RNA, 64 nt, hsa; identical to SEQ ID NO: 34119

SEQ ID NO: 707380 - RNA, 64 nt, hsa; identical to SEQ ID NO: 34120

SEQ ID NO: 707381 - RNA, 64 nt, hsa; identical to SEQ ID NO: 34121

SEQ ID NO: 707382 - RNA, 64 nt, hsa; identical to SEQ ID NO: 34122

SEQ ID NO: 707383 - RNA, 64 nt, hsa; identical to SEQ ID NO: 34123

SEQ ID NO: 707384 - RNA, 64 nt, hsa; identical to SEQ ID NO: 34124

SEQ ID NO: 707385 - RNA, 64 nt, hsa; identical to SEQ ID NO: 34125

SEQ ID NO: 707386 - RNA, 64 nt, hsa; identical to SEQ ID NO: 34126

SEQ ID NO: 707387 - RNA, 64 nt, hsa; identical to SEQ ID NO: 34127

SEQ ID NO: 707388 - RNA, 64 nt, hsa; identical to SEQ ID NO: 34128

SEQ ID NO: 707389 - RNA, 64 nt, hsa; identical to SEQ ID NO: 34129

SEQ ID NO: 707390 - RNA, 64 nt, hsa; identical to SEQ ID NO: 34130

SEQ ID NO: 707391 - RNA, 64 nt, hsa; identical to SEQ ID NO: 34131

SEQ ID NO: 707392 - RNA, 64 nt, hsa; identical to SEQ ID NO: 34132

SEQ ID NO: 707393 - RNA, 64 nt, hsa; identical to SEQ ID NO: 34133

SEQ ID NO: 707394 - RNA, 64 nt, hsa; identical to SEQ ID NO: 34134

SEQ ID NO: 707395 - RNA, 64 nt, hsa; identical to SEQ ID NO: 34135

SEQ ID NO: 707396 - RNA, 64 nt, hsa; identical to SEQ ID NO: 34136

SEQ ID NO: 707397 - RNA, 64 nt, hsa; identical to SEQ ID NO: 34137

SEQ ID NO: 707398 - RNA, 64 nt, hsa; identical to SEQ ID NO: 34138

SEQ ID NO: 707399 - RNA, 64 nt, hsa; identical to SEQ ID NO: 34139

SEQ ID NO: 707400 - RNA, 64 nt, hsa; identical to SEQ ID NO: 34140

SEQ ID NO: 707401 - RNA, 64 nt, hsa; identical to SEQ ID NO: 34141

SEQ ID NO: 707402 - RNA, 64 nt, hsa; identical to SEQ ID NO: 34142

SEQ ID NO: 707403 - RNA, 64 nt, hsa; identical to SEQ ID NO: 34143

SEQ ID NO: 707404 - RNA, 64 nt, hsa; identical to SEQ ID NO: 34144

SEQ ID NO: 707405 - RNA, 64 nt, hsa; identical to SEQ ID NO: 34145

SEQ ID NO: 707406 - RNA, 64 nt, hsa; identical to SEQ ID NO: 34146

SEQ ID NO: 707407 - RNA, 64 nt, hsa; identical to SEQ ID NO: 34147

SEQ ID NO: 707408 - RNA, 64 nt, hsa; identical to SEQ ID NO: 34148

SEQ ID NO: 707409 - RNA, 64 nt, hsa; identical to SEQ ID NO: 34149

SEQ ID NO: 707410 - RNA, 64 nt, hsa; identical to SEQ ID NO: 34150

SEQ ID NO: 707411 - RNA, 64 nt, hsa; identical to SEQ ID NO: 34151

SEQ ID NO: 707412 - RNA, 64 nt, hsa; identical to SEQ ID NO: 34152

SEQ ID NO: 707413 - RNA, 64 nt, hsa; identical to SEQ ID NO: 34153

SEQ ID NO: 707414 - RNA, 64 nt, hsa; identical to SEQ ID NO: 34154

SEQ ID NO: 707415 - RNA, 64 nt, hsa; identical to SEQ ID NO: 34155

SEQ ID NO: 707416 - RNA, 64 nt, hsa; identical to SEQ ID NO: 34156

SEQ ID NO: 707417 - RNA, 64 nt, hsa; identical to SEQ ID NO: 34157

SEQ ID NO: 707418 - RNA, 64 nt, hsa; identical to SEQ ID NO: 34158

SEQ ID NO: 707419 - RNA, 64 nt, hsa; identical to SEQ ID NO: 34159

SEQ ID NO: 707420 - RNA, 64 nt, hsa; identical to SEQ ID NO: 34160

SEQ ID NO: 707421 - RNA, 64 nt, hsa; identical to SEQ ID NO: 34161

SEQ ID NO: 707422 - RNA, 64 nt, hsa; identical to SEQ ID NO: 34162

SEQ ID NO: 707423 - RNA, 64 nt, hsa; identical to SEQ ID NO: 34163

SEQ ID NO: 707424 - RNA, 64 nt, hsa; identical to SEQ ID NO: 34164

SEQ ID NO: 707425 - RNA, 64 nt, hsa; identical to SEQ ID NO: 34165

SEQ ID NO: 707426 - RNA, 64 nt, hsa; identical to SEQ ID NO: 34166

SEQ ID NO: 707427 - RNA, 64 nt, hsa; identical to SEQ ID NO: 34167

SEQ ID NO: 707428 - RNA, 64 nt, hsa; identical to SEQ ID NO: 34168

SEQ ID NO: 707429 - RNA, 64 nt, hsa; identical to SEQ ID NO: 34169

SEQ ID NO: 707430 - RNA, 64 nt, hsa; identical to SEQ ID NO: 34170

SEQ ID NO: 707431 - RNA, 64 nt, hsa; identical to SEQ ID NO: 34171

SEQ ID NO: 707432 - RNA, 64 nt, hsa; identical to SEQ ID NO: 34172

SEQ ID NO: 707433 - RNA, 64 nt, hsa; identical to SEQ ID NO: 34173

SEQ ID NO: 707434 - RNA, 64 nt, hsa; identical to SEQ ID NO: 34174

SEQ ID NO: 707435 - RNA, 64 nt, hsa; identical to SEQ ID NO: 34175

SEQ ID NO: 707436 - RNA, 64 nt, hsa; identical to SEQ ID NO: 34176

SEQ ID NO: 707437 - RNA, 64 nt, hsa; identical to SEQ ID NO: 34177

SEQ ID NO: 707438 - RNA, 64 nt, hsa; identical to SEQ ID NO: 34178

SEQ ID NO: 707439 - RNA, 64 nt, hsa; identical to SEQ ID NO: 34179

SEQ ID NO: 707440 - RNA, 64 nt, hsa; identical to SEQ ID NO: 34180

SEQ ID NO: 707441 - RNA, 64 nt, hsa; identical to SEQ ID NO: 34181

SEQ ID NO: 707442 - RNA, 64 nt, hsa; identical to SEQ ID NO: 34182

SEQ ID NO: 707443 - RNA, 64 nt, hsa; identical to SEQ ID NO: 34183

SEQ ID NO: 707444 - RNA, 64 nt, hsa; identical to SEQ ID NO: 34184

SEQ ID NO: 707445 - RNA, 64 nt, hsa; identical to SEQ ID NO: 34185

SEQ ID NO: 707446 - RNA, 64 nt, hsa; identical to SEQ ID NO: 34186

SEQ ID NO: 707447 - RNA, 64 nt, hsa; identical to SEQ ID NO: 34187

SEQ ID NO: 707448 - RNA, 64 nt, hsa; identical to SEQ ID NO: 34188

SEQ ID NO: 707449 - RNA, 63 nt, hsa; identical to SEQ ID NO: 34189

SEQ ID NO: 707450 - RNA, 64 nt, hsa; identical to SEQ ID NO: 34190

SEQ ID NO: 707451 - RNA, 64 nt, hsa; identical to SEQ ID NO: 34191

SEQ ID NO: 707452 - RNA, 64 nt, hsa; identical to SEQ ID NO: 34192

SEQ ID NO: 707453 - RNA, 64 nt, hsa; identical to SEQ ID NO: 34193

SEQ ID NO: 707454 - RNA, 64 nt, hsa; identical to SEQ ID NO: 34194

SEQ ID NO: 707455 - RNA, 64 nt, hsa; identical to SEQ ID NO: 34195

SEQ ID NO: 707456 - RNA, 64 nt, hsa; identical to SEQ ID NO: 34196

SEQ ID NO: 707457 - RNA, 64 nt, hsa; identical to SEQ ID NO: 34197

SEQ ID NO: 707458 - RNA, 64 nt, hsa; identical to SEQ ID NO: 34198

SEQ ID NO: 707459 - RNA, 64 nt, hsa; identical to SEQ ID NO: 34199

SEQ ID NO: 707460 - RNA, 64 nt, hsa; identical to SEQ ID NO: 34200

SEQ ID NO: 707461 - RNA, 64 nt, hsa; identical to SEQ ID NO: 34201

SEQ ID NO: 707462 - RNA, 64 nt, hsa; identical to SEQ ID NO: 34202

SEQ ID NO: 707463 - RNA, 64 nt, hsa; identical to SEQ ID NO: 34203

SEQ ID NO: 707464 - RNA, 64 nt, hsa; identical to SEQ ID NO: 34204

SEQ ID NO: 707465 - RNA, 64 nt, hsa; identical to SEQ ID NO: 34205

SEQ ID NO: 707466 - RNA, 64 nt, hsa; identical to SEQ ID NO: 34206

SEQ ID NO: 707467 - RNA, 64 nt, hsa; identical to SEQ ID NO: 34207

SEQ ID NO: 707468 - RNA, 64 nt, hsa; identical to SEQ ID NO: 34208

SEQ ID NO: 707469 - RNA, 64 nt, hsa; identical to SEQ ID NO: 34209

SEQ ID NO: 707470 - RNA, 64 nt, hsa; identical to SEQ ID NO: 34210

SEQ ID NO: 707471 - RNA, 64 nt, hsa; identical to SEQ ID NO: 34211

SEQ ID NO: 707472 - RNA, 64 nt, hsa; identical to SEQ ID NO: 34212

SEQ ID NO: 707473 - RNA, 64 nt, hsa; identical to SEQ ID NO: 34213

SEQ ID NO: 707474 - RNA, 64 nt, hsa; identical to SEQ ID NO: 34214

SEQ ID NO: 707475 - RNA, 64 nt, hsa; identical to SEQ ID NO: 34215

SEQ ID NO: 707476 - RNA, 64 nt, hsa; identical to SEQ ID NO: 34216

SEQ ID NO: 707477 - RNA, 64 nt, hsa; identical to SEQ ID NO: 34217

SEQ ID NO: 707478 - RNA, 64 nt, hsa; identical to SEQ ID NO: 34218

SEQ ID NO: 707479 - RNA, 64 nt, hsa; identical to SEQ ID NO: 34219

SEQ ID NO: 707480 - RNA, 64 nt, hsa; identical to SEQ ID NO: 34220

SEQ ID NO: 707481 - RNA, 64 nt, hsa; identical to SEQ ID NO: 34221

SEQ ID NO: 707482 - RNA, 64 nt, hsa; identical to SEQ ID NO: 34222

SEQ ID NO: 707483 - RNA, 64 nt, hsa; identical to SEQ ID NO: 34223

SEQ ID NO: 707484 - RNA, 64 nt, hsa; identical to SEQ ID NO: 34224

SEQ ID NO: 707485 - RNA, 64 nt, hsa; identical to SEQ ID NO: 34225

SEQ ID NO: 707486 - RNA, 64 nt, hsa; identical to SEQ ID NO: 34226

SEQ ID NO: 707487 - RNA, 64 nt, hsa; identical to SEQ ID NO: 34227

SEQ ID NO: 707488 - RNA, 64 nt, hsa; identical to SEQ ID NO: 34228

SEQ ID NO: 707489 - RNA, 64 nt, hsa; identical to SEQ ID NO: 34229

SEQ ID NO: 707490 - RNA, 64 nt, hsa; identical to SEQ ID NO: 34230

SEQ ID NO: 707491 - RNA, 64 nt, hsa; identical to SEQ ID NO: 34231

SEQ ID NO: 707492 - RNA, 64 nt, hsa; identical to SEQ ID NO: 34232

SEQ ID NO: 707493 - RNA, 64 nt, hsa; identical to SEQ ID NO: 34233

SEQ ID NO: 707494 - RNA, 64 nt, hsa; identical to SEQ ID NO: 34234

SEQ ID NO: 707495 - RNA, 64 nt, hsa; identical to SEQ ID NO: 34235

SEQ ID NO: 707496 - RNA, 64 nt, hsa; identical to SEQ ID NO: 34236

SEQ ID NO: 707497 - RNA, 64 nt, hsa; identical to SEQ ID NO: 34237

SEQ ID NO: 707498 - RNA, 64 nt, hsa; identical to SEQ ID NO: 34238

SEQ ID NO: 707499 - RNA, 64 nt, hsa; identical to SEQ ID NO: 34239

SEQ ID NO: 707500 - RNA, 64 nt, hsa; identical to SEQ ID NO: 34240

SEQ ID NO: 707501 - RNA, 64 nt, hsa; identical to SEQ ID NO: 34241

SEQ ID NO: 707502 - RNA, 64 nt, hsa; identical to SEQ ID NO: 34242

SEQ ID NO: 707503 - RNA, 64 nt, hsa; identical to SEQ ID NO: 34243

SEQ ID NO: 707504 - RNA, 64 nt, hsa; identical to SEQ ID NO: 34244

SEQ ID NO: 707505 - RNA, 64 nt, hsa; identical to SEQ ID NO: 34245

SEQ ID NO: 707506 - RNA, 64 nt, hsa; identical to SEQ ID NO: 34246

SEQ ID NO: 707507 - RNA, 64 nt, hsa; identical to SEQ ID NO: 34247

SEQ ID NO: 707508 - RNA, 64 nt, hsa; identical to SEQ ID NO: 34248

SEQ ID NO: 707509 - RNA, 64 nt, hsa; identical to SEQ ID NO: 34249

SEQ ID NO: 707510 - RNA, 64 nt, hsa; identical to SEQ ID NO: 34250

SEQ ID NO: 707511 - RNA, 64 nt, hsa; identical to SEQ ID NO: 34251

SEQ ID NO: 707512 - RNA, 64 nt, hsa; identical to SEQ ID NO: 34252

SEQ ID NO: 707513 - RNA, 64 nt, hsa; identical to SEQ ID NO: 34253

SEQ ID NO: 707514 - RNA, 64 nt, hsa; identical to SEQ ID NO: 34254

SEQ ID NO: 707515 - RNA, 64 nt, hsa; identical to SEQ ID NO: 34255

SEQ ID NO: 707516 - RNA, 64 nt, hsa; identical to SEQ ID NO: 34256

SEQ ID NO: 707517 - RNA, 64 nt, hsa; identical to SEQ ID NO: 34257

SEQ ID NO: 707518 - RNA, 63 nt, hsa; identical to SEQ ID NO: 34258

SEQ ID NO: 707519 - RNA, 64 nt, hsa; identical to SEQ ID NO: 34259

SEQ ID NO: 707520 - RNA, 64 nt, hsa; identical to SEQ ID NO: 34260

SEQ ID NO: 707521 - RNA, 64 nt, hsa; identical to SEQ ID NO: 34261

SEQ ID NO: 707522 - RNA, 64 nt, hsa; identical to SEQ ID NO: 34262

SEQ ID NO: 707523 - RNA, 64 nt, hsa; identical to SEQ ID NO: 34263

SEQ ID NO: 707524 - RNA, 64 nt, hsa; identical to SEQ ID NO: 34264

SEQ ID NO: 707525 - RNA, 64 nt, hsa; identical to SEQ ID NO: 34265

SEQ ID NO: 707526 - RNA, 64 nt, hsa; identical to SEQ ID NO: 34266

SEQ ID NO: 707527 - RNA, 64 nt, hsa; identical to SEQ ID NO: 34267

SEQ ID NO: 707528 - RNA, 64 nt, hsa; identical to SEQ ID NO: 34268

SEQ ID NO: 707529 - RNA, 64 nt, hsa; identical to SEQ ID NO: 34269

SEQ ID NO: 707530 - RNA, 64 nt, hsa; identical to SEQ ID NO: 34270

SEQ ID NO: 707531 - RNA, 64 nt, hsa; identical to SEQ ID NO: 34271

SEQ ID NO: 707532 - RNA, 64 nt, hsa; identical to SEQ ID NO: 34272

SEQ ID NO: 707533 - RNA, 64 nt, hsa; identical to SEQ ID NO: 34273

SEQ ID NO: 707534 - RNA, 64 nt, hsa; identical to SEQ ID NO: 34274

SEQ ID NO: 707535 - RNA, 64 nt, hsa; identical to SEQ ID NO: 34275

SEQ ID NO: 707536 - RNA, 64 nt, hsa; identical to SEQ ID NO: 34276

SEQ ID NO: 707537 - RNA, 64 nt, hsa; identical to SEQ ID NO: 34277

SEQ ID NO: 707538 - RNA, 64 nt, hsa; identical to SEQ ID NO: 34278

SEQ ID NO: 707539 - RNA, 64 nt, hsa; identical to SEQ ID NO: 34279

SEQ ID NO: 707540 - RNA, 64 nt, hsa; identical to SEQ ID NO: 34280

SEQ ID NO: 707541 - RNA, 64 nt, hsa; identical to SEQ ID NO: 34281

SEQ ID NO: 707542 - RNA, 64 nt, hsa; identical to SEQ ID NO: 34282

SEQ ID NO: 707543 - RNA, 64 nt, hsa; identical to SEQ ID NO: 34283

SEQ ID NO: 707544 - RNA, 64 nt, hsa; identical to SEQ ID NO: 34284

SEQ ID NO: 707545 - RNA, 64 nt, hsa; identical to SEQ ID NO: 34285

SEQ ID NO: 707546 - RNA, 64 nt, hsa; identical to SEQ ID NO: 34286

SEQ ID NO: 707547 - RNA, 64 nt, hsa; identical to SEQ ID NO: 34287

SEQ ID NO: 707548 - RNA, 64 nt, hsa; identical to SEQ ID NO: 34288

SEQ ID NO: 707549 - RNA, 64 nt, hsa; identical to SEQ ID NO: 34289

SEQ ID NO: 707550 - RNA, 64 nt, hsa; identical to SEQ ID NO: 34290

SEQ ID NO: 707551 - RNA, 64 nt, hsa; identical to SEQ ID NO: 34291

SEQ ID NO: 707552 - RNA, 64 nt, hsa; identical to SEQ ID NO: 34292

SEQ ID NO: 707553 - RNA, 64 nt, hsa; identical to SEQ ID NO: 34293

SEQ ID NO: 707554 - RNA, 64 nt, hsa; identical to SEQ ID NO: 34294

SEQ ID NO: 707555 - RNA, 64 nt, hsa; identical to SEQ ID NO: 34295

SEQ ID NO: 707556 - RNA, 64 nt, hsa; identical to SEQ ID NO: 34296

SEQ ID NO: 707557 - RNA, 64 nt, hsa; identical to SEQ ID NO: 34297

SEQ ID NO: 707558 - RNA, 64 nt, hsa; identical to SEQ ID NO: 34298

SEQ ID NO: 707559 - RNA, 64 nt, hsa; identical to SEQ ID NO: 34299

SEQ ID NO: 707560 - RNA, 64 nt, hsa; identical to SEQ ID NO: 34300

SEQ ID NO: 707561 - RNA, 64 nt, hsa; identical to SEQ ID NO: 34301

SEQ ID NO: 707562 - RNA, 64 nt, hsa; identical to SEQ ID NO: 34302

SEQ ID NO: 707563 - RNA, 64 nt, hsa; identical to SEQ ID NO: 34303

SEQ ID NO: 707564 - RNA, 64 nt, hsa; identical to SEQ ID NO: 34304

SEQ ID NO: 707565 - RNA, 64 nt, hsa; identical to SEQ ID NO: 34305

SEQ ID NO: 707566 - RNA, 64 nt, hsa; identical to SEQ ID NO: 34306

SEQ ID NO: 707567 - RNA, 64 nt, hsa; identical to SEQ ID NO: 34307

SEQ ID NO: 707568 - RNA, 64 nt, hsa; identical to SEQ ID NO: 34308

SEQ ID NO: 707569 - RNA, 64 nt, hsa; identical to SEQ ID NO: 34309

SEQ ID NO: 707570 - RNA, 64 nt, hsa; identical to SEQ ID NO: 34310

SEQ ID NO: 707571 - RNA, 64 nt, hsa; identical to SEQ ID NO: 34311

SEQ ID NO: 707572 - RNA, 64 nt, hsa; identical to SEQ ID NO: 34312

SEQ ID NO: 707573 - RNA, 64 nt, hsa; identical to SEQ ID NO: 34313

SEQ ID NO: 707574 - RNA, 64 nt, hsa; identical to SEQ ID NO: 34314

SEQ ID NO: 707575 - RNA, 64 nt, hsa; identical to SEQ ID NO: 34315

SEQ ID NO: 707576 - RNA, 64 nt, hsa; identical to SEQ ID NO: 34316

SEQ ID NO: 707577 - RNA, 64 nt, hsa; identical to SEQ ID NO: 34317

SEQ ID NO: 707578 - RNA, 64 nt, hsa; identical to SEQ ID NO: 34318

SEQ ID NO: 707579 - RNA, 64 nt, hsa; identical to SEQ ID NO: 34319

SEQ ID NO: 707580 - RNA, 64 nt, hsa; identical to SEQ ID NO: 34320

SEQ ID NO: 707581 - RNA, 64 nt, hsa; identical to SEQ ID NO: 34321

SEQ ID NO: 707582 - RNA, 64 nt, hsa; identical to SEQ ID NO: 34322

SEQ ID NO: 707583 - RNA, 64 nt, hsa; identical to SEQ ID NO: 34323

SEQ ID NO: 707584 - RNA, 64 nt, hsa; identical to SEQ ID NO: 34324

SEQ ID NO: 707585 - RNA, 64 nt, hsa; identical to SEQ ID NO: 34325

SEQ ID NO: 707586 - RNA, 64 nt, hsa; identical to SEQ ID NO: 34326

SEQ ID NO: 707587 - RNA, 64 nt, hsa; identical to SEQ ID NO: 34327

SEQ ID NO: 707588 - RNA, 64 nt, hsa; identical to SEQ ID NO: 34328

SEQ ID NO: 707589 - RNA, 64 nt, hsa; identical to SEQ ID NO: 34329

SEQ ID NO: 707590 - RNA, 64 nt, hsa; identical to SEQ ID NO: 34330

SEQ ID NO: 707591 - RNA, 64 nt, hsa; identical to SEQ ID NO: 34331

SEQ ID NO: 707592 - RNA, 64 nt, hsa; identical to SEQ ID NO: 34332

SEQ ID NO: 707593 - RNA, 64 nt, hsa; identical to SEQ ID NO: 34333

SEQ ID NO: 707594 - RNA, 64 nt, hsa; identical to SEQ ID NO: 34334

SEQ ID NO: 707595 - RNA, 64 nt, hsa; identical to SEQ ID NO: 34335

SEQ ID NO: 707596 - RNA, 64 nt, hsa; identical to SEQ ID NO: 34336

SEQ ID NO: 707597 - RNA, 64 nt, hsa; identical to SEQ ID NO: 34337

SEQ ID NO: 707598 - RNA, 64 nt, hsa; identical to SEQ ID NO: 34338

SEQ ID NO: 707599 - RNA, 64 nt, hsa; identical to SEQ ID NO: 34339

SEQ ID NO: 707600 - RNA, 64 nt, hsa; identical to SEQ ID NO: 34340

SEQ ID NO: 707601 - RNA, 64 nt, hsa; identical to SEQ ID NO: 34341

SEQ ID NO: 707602 - RNA, 64 nt, hsa; identical to SEQ ID NO: 34342

SEQ ID NO: 707603 - RNA, 64 nt, hsa; identical to SEQ ID NO: 34343

SEQ ID NO: 707604 - RNA, 64 nt, hsa; identical to SEQ ID NO: 34344

SEQ ID NO: 707605 - RNA, 64 nt, hsa; identical to SEQ ID NO: 34345

SEQ ID NO: 707606 - RNA, 64 nt, hsa; identical to SEQ ID NO: 34346

SEQ ID NO: 707607 - RNA, 64 nt, hsa; identical to SEQ ID NO: 34347

SEQ ID NO: 707608 - RNA, 64 nt, hsa; identical to SEQ ID NO: 34348

SEQ ID NO: 707609 - RNA, 64 nt, hsa; identical to SEQ ID NO: 34349

SEQ ID NO: 707610 - RNA, 64 nt, hsa; identical to SEQ ID NO: 34350

SEQ ID NO: 707611 - RNA, 64 nt, hsa; identical to SEQ ID NO: 34351

SEQ ID NO: 707612 - RNA, 64 nt, hsa; identical to SEQ ID NO: 34352

SEQ ID NO: 707613 - RNA, 64 nt, hsa; identical to SEQ ID NO: 34353

SEQ ID NO: 707614 - RNA, 64 nt, hsa; identical to SEQ ID NO: 34354

SEQ ID NO: 707615 - RNA, 64 nt, hsa; identical to SEQ ID NO: 34355

SEQ ID NO: 707616 - RNA, 64 nt, hsa; identical to SEQ ID NO: 34356

SEQ ID NO: 707617 - RNA, 64 nt, hsa; identical to SEQ ID NO: 34357

SEQ ID NO: 707618 - RNA, 64 nt, hsa; identical to SEQ ID NO: 34358

SEQ ID NO: 707619 - RNA, 64 nt, hsa; identical to SEQ ID NO: 34359

SEQ ID NO: 707620 - RNA, 64 nt, hsa; identical to SEQ ID NO: 34360

SEQ ID NO: 707621 - RNA, 64 nt, hsa; identical to SEQ ID NO: 34361

SEQ ID NO: 707622 - RNA, 64 nt, hsa; identical to SEQ ID NO: 34362

SEQ ID NO: 707623 - RNA, 64 nt, hsa; identical to SEQ ID NO: 34363

SEQ ID NO: 707624 - RNA, 64 nt, hsa; identical to SEQ ID NO: 34364

SEQ ID NO: 707625 - RNA, 64 nt, hsa; identical to SEQ ID NO: 34365

SEQ ID NO: 707626 - RNA, 64 nt, hsa; identical to SEQ ID NO: 34366

SEQ ID NO: 707627 - RNA, 64 nt, hsa; identical to SEQ ID NO: 34367

SEQ ID NO: 707628 - RNA, 64 nt, hsa; identical to SEQ ID NO: 34368

SEQ ID NO: 707629 - RNA, 64 nt, hsa; identical to SEQ ID NO: 34369

SEQ ID NO: 707630 - RNA, 64 nt, hsa; identical to SEQ ID NO: 34370

SEQ ID NO: 707631 - RNA, 64 nt, hsa; identical to SEQ ID NO: 34371

SEQ ID NO: 707632 - RNA, 64 nt, hsa; identical to SEQ ID NO: 34372

SEQ ID NO: 707633 - RNA, 64 nt, hsa; identical to SEQ ID NO: 34373

SEQ ID NO: 707634 - RNA, 64 nt, hsa; identical to SEQ ID NO: 34374

SEQ ID NO: 707635 - RNA, 64 nt, hsa; identical to SEQ ID NO: 34375

SEQ ID NO: 707636 - RNA, 64 nt, hsa; identical to SEQ ID NO: 34376

SEQ ID NO: 707637 - RNA, 64 nt, hsa; identical to SEQ ID NO: 34377

SEQ ID NO: 707638 - RNA, 64 nt, hsa; identical to SEQ ID NO: 34378

SEQ ID NO: 707639 - RNA, 64 nt, hsa; identical to SEQ ID NO: 34379

SEQ ID NO: 707640 - RNA, 64 nt, hsa; identical to SEQ ID NO: 34380

SEQ ID NO: 707641 - RNA, 64 nt, hsa; identical to SEQ ID NO: 34381

SEQ ID NO: 707642 - RNA, 64 nt, hsa; identical to SEQ ID NO: 34382

SEQ ID NO: 707643 - RNA, 64 nt, hsa; identical to SEQ ID NO: 34383

SEQ ID NO: 707644 - RNA, 64 nt, hsa; identical to SEQ ID NO: 34384

SEQ ID NO: 707645 - RNA, 64 nt, hsa; identical to SEQ ID NO: 34385

SEQ ID NO: 707646 - RNA, 64 nt, hsa; identical to SEQ ID NO: 34386

SEQ ID NO: 707647 - RNA, 64 nt, hsa; identical to SEQ ID NO: 34387

SEQ ID NO: 707648 - RNA, 64 nt, hsa; identical to SEQ ID NO: 34388

SEQ ID NO: 707649 - RNA, 64 nt, hsa; identical to SEQ ID NO: 34389

SEQ ID NO: 707650 - RNA, 64 nt, hsa; identical to SEQ ID NO: 34390

SEQ ID NO: 707651 - RNA, 64 nt, hsa; identical to SEQ ID NO: 34391

SEQ ID NO: 707652 - RNA, 64 nt, hsa; identical to SEQ ID NO: 34392

SEQ ID NO: 707653 - RNA, 64 nt, hsa; identical to SEQ ID NO: 34393

SEQ ID NO: 707654 - RNA, 64 nt, hsa; identical to SEQ ID NO: 34394

SEQ ID NO: 707655 - RNA, 64 nt, hsa; identical to SEQ ID NO: 34395

SEQ ID NO: 707656 - RNA, 64 nt, hsa; identical to SEQ ID NO: 34396

SEQ ID NO: 707657 - RNA, 64 nt, hsa; identical to SEQ ID NO: 34397

SEQ ID NO: 707658 - RNA, 64 nt, hsa; identical to SEQ ID NO: 34398

SEQ ID NO: 707659 - RNA, 64 nt, hsa; identical to SEQ ID NO: 34399

SEQ ID NO: 707660 - RNA, 64 nt, hsa; identical to SEQ ID NO: 34400

SEQ ID NO: 707661 - RNA, 64 nt, hsa; identical to SEQ ID NO: 34401

SEQ ID NO: 707662 - RNA, 64 nt, hsa; identical to SEQ ID NO: 34402

SEQ ID NO: 707663 - RNA, 64 nt, hsa; identical to SEQ ID NO: 34403

SEQ ID NO: 707664 - RNA, 64 nt, hsa; identical to SEQ ID NO: 34404

SEQ ID NO: 707665 - RNA, 64 nt, hsa; identical to SEQ ID NO: 34405

SEQ ID NO: 707666 - RNA, 64 nt, hsa; identical to SEQ ID NO: 34406

SEQ ID NO: 707667 - RNA, 64 nt, hsa; identical to SEQ ID NO: 34407

SEQ ID NO: 707668 - RNA, 64 nt, hsa; identical to SEQ ID NO: 34408

SEQ ID NO: 707669 - RNA, 64 nt, hsa; identical to SEQ ID NO: 34409

SEQ ID NO: 707670 - RNA, 64 nt, hsa; identical to SEQ ID NO: 34410

SEQ ID NO: 707671 - RNA, 64 nt, hsa; identical to SEQ ID NO: 34411

SEQ ID NO: 707672 - RNA, 64 nt, hsa; identical to SEQ ID NO: 34412

SEQ ID NO: 707673 - RNA, 64 nt, hsa; identical to SEQ ID NO: 34413

SEQ ID NO: 707674 - RNA, 64 nt, hsa; identical to SEQ ID NO: 34414

SEQ ID NO: 707675 - RNA, 64 nt, hsa; identical to SEQ ID NO: 34415

SEQ ID NO: 707676 - RNA, 64 nt, hsa; identical to SEQ ID NO: 34416

SEQ ID NO: 707677 - RNA, 64 nt, hsa; identical to SEQ ID NO: 34417

SEQ ID NO: 707678 - RNA, 64 nt, hsa; identical to SEQ ID NO: 34418

SEQ ID NO: 707679 - RNA, 64 nt, hsa; identical to SEQ ID NO: 34419

SEQ ID NO: 707680 - RNA, 64 nt, hsa; identical to SEQ ID NO: 34420

SEQ ID NO: 707681 - RNA, 64 nt, hsa; identical to SEQ ID NO: 34421

SEQ ID NO: 707682 - RNA, 64 nt, hsa; identical to SEQ ID NO: 34422

SEQ ID NO: 707683 - RNA, 64 nt, hsa; identical to SEQ ID NO: 34423

SEQ ID NO: 707684 - RNA, 64 nt, hsa; identical to SEQ ID NO: 34424

SEQ ID NO: 707685 - RNA, 64 nt, hsa; identical to SEQ ID NO: 34425

SEQ ID NO: 707686 - RNA, 64 nt, hsa; identical to SEQ ID NO: 34426

SEQ ID NO: 707687 - RNA, 64 nt, hsa; identical to SEQ ID NO: 34427

SEQ ID NO: 707688 - RNA, 64 nt, hsa; identical to SEQ ID NO: 34428

SEQ ID NO: 707689 - RNA, 64 nt, hsa; identical to SEQ ID NO: 34429

SEQ ID NO: 707690 - RNA, 64 nt, hsa; identical to SEQ ID NO: 34430

SEQ ID NO: 707691 - RNA, 64 nt, hsa; identical to SEQ ID NO: 34431

SEQ ID NO: 707692 - RNA, 64 nt, hsa; identical to SEQ ID NO: 34432

SEQ ID NO: 707693 - RNA, 64 nt, hsa; identical to SEQ ID NO: 34433

SEQ ID NO: 707694 - RNA, 64 nt, hsa; identical to SEQ ID NO: 34434

SEQ ID NO: 707695 - RNA, 64 nt, hsa; identical to SEQ ID NO: 34435

SEQ ID NO: 707696 - RNA, 64 nt, hsa; identical to SEQ ID NO: 34436

SEQ ID NO: 707697 - RNA, 64 nt, hsa; identical to SEQ ID NO: 34437

SEQ ID NO: 707698 - RNA, 64 nt, hsa; identical to SEQ ID NO: 34438

SEQ ID NO: 707699 - RNA, 64 nt, hsa; identical to SEQ ID NO: 34439

SEQ ID NO: 707700 - RNA, 64 nt, hsa; identical to SEQ ID NO: 34440

SEQ ID NO: 707701 - RNA, 64 nt, hsa; identical to SEQ ID NO: 34441

SEQ ID NO: 707702 - RNA, 64 nt, hsa; identical to SEQ ID NO: 34442

SEQ ID NO: 707703 - RNA, 64 nt, hsa; identical to SEQ ID NO: 34443

SEQ ID NO: 707704 - RNA, 64 nt, hsa; identical to SEQ ID NO: 34444

SEQ ID NO: 707705 - RNA, 64 nt, hsa; identical to SEQ ID NO: 34445

SEQ ID NO: 707706 - RNA, 64 nt, hsa; identical to SEQ ID NO: 34446

SEQ ID NO: 707707 - RNA, 64 nt, hsa; identical to SEQ ID NO: 34447

SEQ ID NO: 707708 - RNA, 64 nt, hsa; identical to SEQ ID NO: 34448

SEQ ID NO: 707709 - RNA, 64 nt, hsa; identical to SEQ ID NO: 34449

SEQ ID NO: 707710 - RNA, 64 nt, hsa; identical to SEQ ID NO: 34450

SEQ ID NO: 707711 - RNA, 64 nt, hsa; identical to SEQ ID NO: 34451

SEQ ID NO: 707712 - RNA, 64 nt, hsa; identical to SEQ ID NO: 34452

SEQ ID NO: 707713 - RNA, 64 nt, hsa; identical to SEQ ID NO: 34453

SEQ ID NO: 707714 - RNA, 64 nt, hsa; identical to SEQ ID NO: 34454

SEQ ID NO: 707715 - RNA, 64 nt, hsa; identical to SEQ ID NO: 34455

SEQ ID NO: 707716 - RNA, 64 nt, hsa; identical to SEQ ID NO: 34456

SEQ ID NO: 707717 - RNA, 64 nt, hsa; identical to SEQ ID NO: 34457

SEQ ID NO: 707718 - RNA, 64 nt, hsa; identical to SEQ ID NO: 34458

SEQ ID NO: 707719 - RNA, 64 nt, hsa; identical to SEQ ID NO: 34459

SEQ ID NO: 707720 - RNA, 64 nt, hsa; identical to SEQ ID NO: 34460

SEQ ID NO: 707721 - RNA, 56 nt, hsa; identical to SEQ ID NO: 34461

SEQ ID NO: 707722 - RNA, 64 nt, hsa; identical to SEQ ID NO: 34462

SEQ ID NO: 707723 - RNA, 64 nt, hsa; identical to SEQ ID NO: 34463

SEQ ID NO: 707724 - RNA, 64 nt, hsa; identical to SEQ ID NO: 34464

SEQ ID NO: 707725 - RNA, 64 nt, hsa; identical to SEQ ID NO: 34465

SEQ ID NO: 707726 - RNA, 64 nt, hsa; identical to SEQ ID NO: 34466

SEQ ID NO: 707727 - RNA, 64 nt, hsa; identical to SEQ ID NO: 34467

SEQ ID NO: 707728 - RNA, 64 nt, hsa; identical to SEQ ID NO: 34468

SEQ ID NO: 707729 - RNA, 64 nt, hsa; identical to SEQ ID NO: 34469

SEQ ID NO: 707730 - RNA, 64 nt, hsa; identical to SEQ ID NO: 34470

SEQ ID NO: 707731 - RNA, 64 nt, hsa; identical to SEQ ID NO: 34471

SEQ ID NO: 707732 - RNA, 64 nt, hsa; identical to SEQ ID NO: 34472

SEQ ID NO: 707733 - RNA, 64 nt, hsa; identical to SEQ ID NO: 34473

SEQ ID NO: 707734 - RNA, 64 nt, hsa; identical to SEQ ID NO: 34474

SEQ ID NO: 707735 - RNA, 64 nt, hsa; identical to SEQ ID NO: 34475

SEQ ID NO: 707736 - RNA, 64 nt, hsa; identical to SEQ ID NO: 34476

SEQ ID NO: 707737 - RNA, 64 nt, hsa; identical to SEQ ID NO: 34477

SEQ ID NO: 707738 - RNA, 64 nt, hsa; identical to SEQ ID NO: 34478

SEQ ID NO: 707739 - RNA, 64 nt, hsa; identical to SEQ ID NO: 34479

SEQ ID NO: 707740 - RNA, 64 nt, hsa; identical to SEQ ID NO: 34480

SEQ ID NO: 707741 - RNA, 64 nt, hsa; identical to SEQ ID NO: 34481

SEQ ID NO: 707742 - RNA, 64 nt, hsa; identical to SEQ ID NO: 34482

SEQ ID NO: 707743 - RNA, 64 nt, hsa; identical to SEQ ID NO: 34483

SEQ ID NO: 707744 - RNA, 64 nt, hsa; identical to SEQ ID NO: 34484

SEQ ID NO: 707745 - RNA, 64 nt, hsa; identical to SEQ ID NO: 34485

SEQ ID NO: 707746 - RNA, 64 nt, hsa; identical to SEQ ID NO: 34486

SEQ ID NO: 707747 - RNA, 64 nt, hsa; identical to SEQ ID NO: 34487

SEQ ID NO: 707748 - RNA, 64 nt, hsa; identical to SEQ ID NO: 34488

SEQ ID NO: 707749 - RNA, 64 nt, hsa; identical to SEQ ID NO: 34489

SEQ ID NO: 707750 - RNA, 64 nt, hsa; identical to SEQ ID NO: 34490

SEQ ID NO: 707751 - RNA, 64 nt, hsa; identical to SEQ ID NO: 34491

SEQ ID NO: 707752 - RNA, 64 nt, hsa; identical to SEQ ID NO: 34492

SEQ ID NO: 707753 - RNA, 64 nt, hsa; identical to SEQ ID NO: 34493

SEQ ID NO: 707754 - RNA, 64 nt, hsa; identical to SEQ ID NO: 34494

SEQ ID NO: 707755 - RNA, 64 nt, hsa; identical to SEQ ID NO: 34495

SEQ ID NO: 707756 - RNA, 64 nt, hsa; identical to SEQ ID NO: 34496

SEQ ID NO: 707757 - RNA, 64 nt, hsa; identical to SEQ ID NO: 34497

SEQ ID NO: 707758 - RNA, 64 nt, hsa; identical to SEQ ID NO: 34498

SEQ ID NO: 707759 - RNA, 64 nt, hsa; identical to SEQ ID NO: 34499

SEQ ID NO: 707760 - RNA, 64 nt, hsa; identical to SEQ ID NO: 34500

SEQ ID NO: 707761 - RNA, 64 nt, hsa; identical to SEQ ID NO: 34501

SEQ ID NO: 707762 - RNA, 64 nt, hsa; identical to SEQ ID NO: 34502

SEQ ID NO: 707763 - RNA, 64 nt, hsa; identical to SEQ ID NO: 34503

SEQ ID NO: 707764 - RNA, 64 nt, hsa; identical to SEQ ID NO: 34504

SEQ ID NO: 707765 - RNA, 64 nt, hsa; identical to SEQ ID NO: 34505

SEQ ID NO: 707766 - RNA, 64 nt, hsa; identical to SEQ ID NO: 34506

SEQ ID NO: 707767 - RNA, 64 nt, hsa; identical to SEQ ID NO: 34507

SEQ ID NO: 707768 - RNA, 64 nt, hsa; identical to SEQ ID NO: 34508

SEQ ID NO: 707769 - RNA, 64 nt, hsa; identical to SEQ ID NO: 34509

SEQ ID NO: 707770 - RNA, 64 nt, hsa; identical to SEQ ID NO: 34510

SEQ ID NO: 707771 - RNA, 64 nt, hsa; identical to SEQ ID NO: 34511

SEQ ID NO: 707772 - RNA, 64 nt, hsa; identical to SEQ ID NO: 34512

SEQ ID NO: 707773 - RNA, 64 nt, hsa; identical to SEQ ID NO: 34513

SEQ ID NO: 707774 - RNA, 64 nt, hsa; identical to SEQ ID NO: 34514

SEQ ID NO: 707775 - RNA, 64 nt, hsa; identical to SEQ ID NO: 34515

SEQ ID NO: 707776 - RNA, 64 nt, hsa; identical to SEQ ID NO: 34516

SEQ ID NO: 707777 - RNA, 64 nt, hsa; identical to SEQ ID NO: 34517

SEQ ID NO: 707778 - RNA, 64 nt, hsa; identical to SEQ ID NO: 34518

SEQ ID NO: 707779 - RNA, 64 nt, hsa; identical to SEQ ID NO: 34519

SEQ ID NO: 707780 - RNA, 64 nt, hsa; identical to SEQ ID NO: 34520

SEQ ID NO: 707781 - RNA, 64 nt, hsa; identical to SEQ ID NO: 34521

SEQ ID NO: 707782 - RNA, 64 nt, hsa; identical to SEQ ID NO: 34522

SEQ ID NO: 707783 - RNA, 64 nt, hsa; identical to SEQ ID NO: 34523

SEQ ID NO: 707784 - RNA, 64 nt, hsa; identical to SEQ ID NO: 34524

SEQ ID NO: 707785 - RNA, 64 nt, hsa; identical to SEQ ID NO: 34525

SEQ ID NO: 707786 - RNA, 64 nt, hsa; identical to SEQ ID NO: 34526

SEQ ID NO: 707787 - RNA, 64 nt, hsa; identical to SEQ ID NO: 34527

SEQ ID NO: 707788 - RNA, 64 nt, hsa; identical to SEQ ID NO: 34528

SEQ ID NO: 707789 - RNA, 64 nt, hsa; identical to SEQ ID NO: 34529

SEQ ID NO: 707790 - RNA, 64 nt, hsa; identical to SEQ ID NO: 34530

SEQ ID NO: 707791 - RNA, 64 nt, hsa; identical to SEQ ID NO: 34531

SEQ ID NO: 707792 - RNA, 64 nt, hsa; identical to SEQ ID NO: 34532

SEQ ID NO: 707793 - RNA, 64 nt, hsa; identical to SEQ ID NO: 34533

SEQ ID NO: 707794 - RNA, 64 nt, hsa; identical to SEQ ID NO: 34534

SEQ ID NO: 707795 - RNA, 64 nt, hsa; identical to SEQ ID NO: 34535

SEQ ID NO: 707796 - RNA, 64 nt, hsa; identical to SEQ ID NO: 34536

SEQ ID NO: 707797 - RNA, 64 nt, hsa; identical to SEQ ID NO: 34537

SEQ ID NO: 707798 - RNA, 64 nt, hsa; identical to SEQ ID NO: 34538

SEQ ID NO: 707799 - RNA, 64 nt, hsa; identical to SEQ ID NO: 34539

SEQ ID NO: 707800 - RNA, 64 nt, hsa; identical to SEQ ID NO: 34540

SEQ ID NO: 707801 - RNA, 64 nt, hsa; identical to SEQ ID NO: 34541

SEQ ID NO: 707802 - RNA, 64 nt, hsa; identical to SEQ ID NO: 34542

SEQ ID NO: 707803 - RNA, 64 nt, hsa; identical to SEQ ID NO: 34543

SEQ ID NO: 707804 - RNA, 64 nt, hsa; identical to SEQ ID NO: 34544

SEQ ID NO: 707805 - RNA, 64 nt, hsa; identical to SEQ ID NO: 34545

SEQ ID NO: 707806 - RNA, 64 nt, hsa; identical to SEQ ID NO: 34546

SEQ ID NO: 707807 - RNA, 64 nt, hsa; identical to SEQ ID NO: 34547

SEQ ID NO: 707808 - RNA, 64 nt, hsa; identical to SEQ ID NO: 34548

SEQ ID NO: 707809 - RNA, 64 nt, hsa; identical to SEQ ID NO: 34549

SEQ ID NO: 707810 - RNA, 64 nt, hsa; identical to SEQ ID NO: 34550

SEQ ID NO: 707811 - RNA, 64 nt, hsa; identical to SEQ ID NO: 34551

SEQ ID NO: 707812 - RNA, 64 nt, hsa; identical to SEQ ID NO: 34552

SEQ ID NO: 707813 - RNA, 64 nt, hsa; identical to SEQ ID NO: 34553

SEQ ID NO: 707814 - RNA, 64 nt, hsa; identical to SEQ ID NO: 34554

SEQ ID NO: 707815 - RNA, 64 nt, hsa; identical to SEQ ID NO: 34555

SEQ ID NO: 707816 - RNA, 64 nt, hsa; identical to SEQ ID NO: 34556

SEQ ID NO: 707817 - RNA, 64 nt, hsa; identical to SEQ ID NO: 34557

SEQ ID NO: 707818 - RNA, 64 nt, hsa; identical to SEQ ID NO: 34558

SEQ ID NO: 707819 - RNA, 64 nt, hsa; identical to SEQ ID NO: 34559

SEQ ID NO: 707820 - RNA, 64 nt, hsa; identical to SEQ ID NO: 34560

SEQ ID NO: 707821 - RNA, 64 nt, hsa; identical to SEQ ID NO: 34561

SEQ ID NO: 707822 - RNA, 64 nt, hsa; identical to SEQ ID NO: 34562

SEQ ID NO: 707823 - RNA, 64 nt, hsa; identical to SEQ ID NO: 34563

SEQ ID NO: 707824 - RNA, 64 nt, hsa; identical to SEQ ID NO: 34564

SEQ ID NO: 707825 - RNA, 64 nt, hsa; identical to SEQ ID NO: 34565

SEQ ID NO: 707826 - RNA, 64 nt, hsa; identical to SEQ ID NO: 34566

SEQ ID NO: 707827 - RNA, 64 nt, hsa; identical to SEQ ID NO: 34567

SEQ ID NO: 707828 - RNA, 64 nt, hsa; identical to SEQ ID NO: 34568

SEQ ID NO: 707829 - RNA, 64 nt, hsa; identical to SEQ ID NO: 34569

SEQ ID NO: 707830 - RNA, 64 nt, hsa; identical to SEQ ID NO: 34570

SEQ ID NO: 707831 - RNA, 64 nt, hsa; identical to SEQ ID NO: 34571

SEQ ID NO: 707832 - RNA, 64 nt, hsa; identical to SEQ ID NO: 34572

SEQ ID NO: 707833 - RNA, 64 nt, hsa; identical to SEQ ID NO: 34573

SEQ ID NO: 707834 - RNA, 64 nt, hsa; identical to SEQ ID NO: 34574

SEQ ID NO: 707835 - RNA, 64 nt, hsa; identical to SEQ ID NO: 34575

SEQ ID NO: 707836 - RNA, 64 nt, hsa; identical to SEQ ID NO: 34576

SEQ ID NO: 707837 - RNA, 64 nt, hsa; identical to SEQ ID NO: 34577

SEQ ID NO: 707838 - RNA, 64 nt, hsa; identical to SEQ ID NO: 34578

SEQ ID NO: 707839 - RNA, 64 nt, hsa; identical to SEQ ID NO: 34579

SEQ ID NO: 707840 - RNA, 64 nt, hsa; identical to SEQ ID NO: 34580

SEQ ID NO: 707841 - RNA, 64 nt, hsa; identical to SEQ ID NO: 34581

SEQ ID NO: 707842 - RNA, 64 nt, hsa; identical to SEQ ID NO: 34582

SEQ ID NO: 707843 - RNA, 64 nt, hsa; identical to SEQ ID NO: 34583

SEQ ID NO: 707844 - RNA, 64 nt, hsa; identical to SEQ ID NO: 34584

SEQ ID NO: 707845 - RNA, 64 nt, hsa; identical to SEQ ID NO: 34585

SEQ ID NO: 707846 - RNA, 64 nt, hsa; identical to SEQ ID NO: 34586

SEQ ID NO: 707847 - RNA, 64 nt, hsa; identical to SEQ ID NO: 34587

SEQ ID NO: 707848 - RNA, 64 nt, hsa; identical to SEQ ID NO: 34588

SEQ ID NO: 707849 - RNA, 64 nt, hsa; identical to SEQ ID NO: 34589

SEQ ID NO: 707850 - RNA, 64 nt, hsa; identical to SEQ ID NO: 34590

SEQ ID NO: 707851 - RNA, 64 nt, hsa; identical to SEQ ID NO: 34591

SEQ ID NO: 707852 - RNA, 64 nt, hsa; identical to SEQ ID NO: 34592

SEQ ID NO: 707853 - RNA, 64 nt, hsa; identical to SEQ ID NO: 34593

SEQ ID NO: 707854 - RNA, 64 nt, hsa; identical to SEQ ID NO: 34594

SEQ ID NO: 707855 - RNA, 64 nt, hsa; identical to SEQ ID NO: 34595

SEQ ID NO: 707856 - RNA, 64 nt, hsa; identical to SEQ ID NO: 34596

SEQ ID NO: 707857 - RNA, 64 nt, hsa; identical to SEQ ID NO: 34597

SEQ ID NO: 707858 - RNA, 64 nt, hsa; identical to SEQ ID NO: 34598

SEQ ID NO: 707859 - RNA, 64 nt, hsa; identical to SEQ ID NO: 34599

SEQ ID NO: 707860 - RNA, 64 nt, hsa; identical to SEQ ID NO: 34600

SEQ ID NO: 707861 - RNA, 64 nt, hsa; identical to SEQ ID NO: 34601

SEQ ID NO: 707862 - RNA, 64 nt, hsa; identical to SEQ ID NO: 34602

SEQ ID NO: 707863 - RNA, 64 nt, hsa; identical to SEQ ID NO: 34603

SEQ ID NO: 707864 - RNA, 64 nt, hsa; identical to SEQ ID NO: 34604

SEQ ID NO: 707865 - RNA, 64 nt, hsa; identical to SEQ ID NO: 34605

SEQ ID NO: 707866 - RNA, 64 nt, hsa; identical to SEQ ID NO: 34606

SEQ ID NO: 707867 - RNA, 64 nt, hsa; identical to SEQ ID NO: 34607

SEQ ID NO: 707868 - RNA, 64 nt, hsa; identical to SEQ ID NO: 34608

SEQ ID NO: 707869 - RNA, 64 nt, hsa; identical to SEQ ID NO: 34609

SEQ ID NO: 707870 - RNA, 64 nt, hsa; identical to SEQ ID NO: 34610

SEQ ID NO: 707871 - RNA, 64 nt, hsa; identical to SEQ ID NO: 34611

SEQ ID NO: 707872 - RNA, 64 nt, hsa; identical to SEQ ID NO: 34612

SEQ ID NO: 707873 - RNA, 64 nt, hsa; identical to SEQ ID NO: 34613

SEQ ID NO: 707874 - RNA, 64 nt, hsa; identical to SEQ ID NO: 34614

SEQ ID NO: 707875 - RNA, 64 nt, hsa; identical to SEQ ID NO: 34615

SEQ ID NO: 707876 - RNA, 64 nt, hsa; identical to SEQ ID NO: 34616

SEQ ID NO: 707877 - RNA, 64 nt, hsa; identical to SEQ ID NO: 34617

SEQ ID NO: 707878 - RNA, 64 nt, hsa; identical to SEQ ID NO: 34618

SEQ ID NO: 707879 - RNA, 64 nt, hsa; identical to SEQ ID NO: 34619

SEQ ID NO: 707880 - RNA, 64 nt, hsa; identical to SEQ ID NO: 34620

SEQ ID NO: 707881 - RNA, 64 nt, hsa; identical to SEQ ID NO: 34621

SEQ ID NO: 707882 - RNA, 64 nt, hsa; identical to SEQ ID NO: 34622

SEQ ID NO: 707883 - RNA, 64 nt, hsa; identical to SEQ ID NO: 34623

SEQ ID NO: 707884 - RNA, 64 nt, hsa; identical to SEQ ID NO: 34624

SEQ ID NO: 707885 - RNA, 64 nt, hsa; identical to SEQ ID NO: 34625

SEQ ID NO: 707886 - RNA, 64 nt, hsa; identical to SEQ ID NO: 34626

SEQ ID NO: 707887 - RNA, 64 nt, hsa; identical to SEQ ID NO: 34627

SEQ ID NO: 707888 - RNA, 64 nt, hsa; identical to SEQ ID NO: 34628

SEQ ID NO: 707889 - RNA, 64 nt, hsa; identical to SEQ ID NO: 34629

SEQ ID NO: 707890 - RNA, 64 nt, hsa; identical to SEQ ID NO: 34630

SEQ ID NO: 707891 - RNA, 64 nt, hsa; identical to SEQ ID NO: 34631

SEQ ID NO: 707892 - RNA, 64 nt, hsa; identical to SEQ ID NO: 34632

SEQ ID NO: 707893 - RNA, 64 nt, hsa; identical to SEQ ID NO: 34633

SEQ ID NO: 707894 - RNA, 64 nt, hsa; identical to SEQ ID NO: 34634

SEQ ID NO: 707895 - RNA, 64 nt, hsa; identical to SEQ ID NO: 34635

SEQ ID NO: 707896 - RNA, 64 nt, hsa; identical to SEQ ID NO: 34636

SEQ ID NO: 707897 - RNA, 64 nt, hsa; identical to SEQ ID NO: 34637

SEQ ID NO: 707898 - RNA, 64 nt, hsa; identical to SEQ ID NO: 34638

SEQ ID NO: 707899 - RNA, 64 nt, hsa; identical to SEQ ID NO: 34639

SEQ ID NO: 707900 - RNA, 64 nt, hsa; identical to SEQ ID NO: 34640

SEQ ID NO: 707901 - RNA, 64 nt, hsa; identical to SEQ ID NO: 34641

SEQ ID NO: 707902 - RNA, 64 nt, hsa; identical to SEQ ID NO: 34642

SEQ ID NO: 707903 - RNA, 64 nt, hsa; identical to SEQ ID NO: 34643

SEQ ID NO: 707904 - RNA, 64 nt, hsa; identical to SEQ ID NO: 34644

SEQ ID NO: 707905 - RNA, 64 nt, hsa; identical to SEQ ID NO: 34645

SEQ ID NO: 707906 - RNA, 64 nt, hsa; identical to SEQ ID NO: 34646

SEQ ID NO: 707907 - RNA, 64 nt, hsa; identical to SEQ ID NO: 34647

SEQ ID NO: 707908 - RNA, 64 nt, hsa; identical to SEQ ID NO: 34648

SEQ ID NO: 707909 - RNA, 64 nt, hsa; identical to SEQ ID NO: 34649

SEQ ID NO: 707910 - RNA, 64 nt, hsa; identical to SEQ ID NO: 34650

SEQ ID NO: 707911 - RNA, 64 nt, hsa; identical to SEQ ID NO: 34651

SEQ ID NO: 707912 - RNA, 64 nt, hsa; identical to SEQ ID NO: 34652

SEQ ID NO: 707913 - RNA, 64 nt, hsa; identical to SEQ ID NO: 34653

SEQ ID NO: 707914 - RNA, 64 nt, hsa; identical to SEQ ID NO: 34654

SEQ ID NO: 707915 - RNA, 64 nt, hsa; identical to SEQ ID NO: 34655

SEQ ID NO: 707916 - RNA, 64 nt, hsa; identical to SEQ ID NO: 34656

SEQ ID NO: 707917 - RNA, 64 nt, hsa; identical to SEQ ID NO: 34657

SEQ ID NO: 707918 - RNA, 64 nt, hsa; identical to SEQ ID NO: 34658

SEQ ID NO: 707919 - RNA, 64 nt, hsa; identical to SEQ ID NO: 34659

SEQ ID NO: 707920 - RNA, 64 nt, hsa; identical to SEQ ID NO: 34660

SEQ ID NO: 707921 - RNA, 64 nt, hsa; identical to SEQ ID NO: 34661

SEQ ID NO: 707922 - RNA, 64 nt, hsa; identical to SEQ ID NO: 34662

SEQ ID NO: 707923 - RNA, 64 nt, hsa; identical to SEQ ID NO: 34663

SEQ ID NO: 707924 - RNA, 64 nt, hsa; identical to SEQ ID NO: 34664

SEQ ID NO: 707925 - RNA, 64 nt, hsa; identical to SEQ ID NO: 34665

SEQ ID NO: 707926 - RNA, 64 nt, hsa; identical to SEQ ID NO: 34666

SEQ ID NO: 707927 - RNA, 64 nt, hsa; identical to SEQ ID NO: 34667

SEQ ID NO: 707928 - RNA, 64 nt, hsa; identical to SEQ ID NO: 34668

SEQ ID NO: 707929 - RNA, 64 nt, hsa; identical to SEQ ID NO: 34669

SEQ ID NO: 707930 - RNA, 64 nt, hsa; identical to SEQ ID NO: 34670

SEQ ID NO: 707931 - RNA, 64 nt, hsa; identical to SEQ ID NO: 34671

SEQ ID NO: 707932 - RNA, 64 nt, hsa; identical to SEQ ID NO: 34672

SEQ ID NO: 707933 - RNA, 64 nt, hsa; identical to SEQ ID NO: 34673

SEQ ID NO: 707934 - RNA, 64 nt, hsa; identical to SEQ ID NO: 34674

SEQ ID NO: 707935 - RNA, 64 nt, hsa; identical to SEQ ID NO: 34675

SEQ ID NO: 707936 - RNA, 64 nt, hsa; identical to SEQ ID NO: 34676

SEQ ID NO: 707937 - RNA, 64 nt, hsa; identical to SEQ ID NO: 34677

SEQ ID NO: 707938 - RNA, 64 nt, hsa; identical to SEQ ID NO: 34678

SEQ ID NO: 707939 - RNA, 64 nt, hsa; identical to SEQ ID NO: 34679

SEQ ID NO: 707940 - RNA, 64 nt, hsa; identical to SEQ ID NO: 34680

SEQ ID NO: 707941 - RNA, 64 nt, hsa; identical to SEQ ID NO: 34681

SEQ ID NO: 707942 - RNA, 64 nt, hsa; identical to SEQ ID NO: 34682

SEQ ID NO: 707943 - RNA, 64 nt, hsa; identical to SEQ ID NO: 34683

SEQ ID NO: 707944 - RNA, 64 nt, hsa; identical to SEQ ID NO: 34684

SEQ ID NO: 707945 - RNA, 64 nt, hsa; identical to SEQ ID NO: 34685

SEQ ID NO: 707946 - RNA, 64 nt, hsa; identical to SEQ ID NO: 34686

SEQ ID NO: 707947 - RNA, 64 nt, hsa; identical to SEQ ID NO: 34687

SEQ ID NO: 707948 - RNA, 64 nt, hsa; identical to SEQ ID NO: 34688

SEQ ID NO: 707949 - RNA, 64 nt, hsa; identical to SEQ ID NO: 34689

SEQ ID NO: 707950 - RNA, 64 nt, hsa; identical to SEQ ID NO: 34690

SEQ ID NO: 707951 - RNA, 64 nt, hsa; identical to SEQ ID NO: 34691

SEQ ID NO: 707952 - RNA, 64 nt, hsa; identical to SEQ ID NO: 34692

SEQ ID NO: 707953 - RNA, 64 nt, hsa; identical to SEQ ID NO: 34693

SEQ ID NO: 707954 - RNA, 64 nt, hsa; identical to SEQ ID NO: 34694

SEQ ID NO: 707955 - RNA, 64 nt, hsa; identical to SEQ ID NO: 34695

SEQ ID NO: 707956 - RNA, 64 nt, hsa; identical to SEQ ID NO: 34696

SEQ ID NO: 707957 - RNA, 64 nt, hsa; identical to SEQ ID NO: 34697

SEQ ID NO: 707958 - RNA, 64 nt, hsa; identical to SEQ ID NO: 34698

SEQ ID NO: 707959 - RNA, 64 nt, hsa; identical to SEQ ID NO: 34699

SEQ ID NO: 707960 - RNA, 64 nt, hsa; identical to SEQ ID NO: 34700

SEQ ID NO: 707961 - RNA, 64 nt, hsa; identical to SEQ ID NO: 34701

SEQ ID NO: 707962 - RNA, 64 nt, hsa; identical to SEQ ID NO: 34702

SEQ ID NO: 707963 - RNA, 64 nt, hsa; identical to SEQ ID NO: 34703

SEQ ID NO: 707964 - RNA, 64 nt, hsa; identical to SEQ ID NO: 34704

SEQ ID NO: 707965 - RNA, 64 nt, hsa; identical to SEQ ID NO: 34705

SEQ ID NO: 707966 - RNA, 64 nt, hsa; identical to SEQ ID NO: 34706

SEQ ID NO: 707967 - RNA, 64 nt, hsa; identical to SEQ ID NO: 34707

SEQ ID NO: 707968 - RNA, 64 nt, hsa; identical to SEQ ID NO: 34708

SEQ ID NO: 707969 - RNA, 64 nt, hsa; identical to SEQ ID NO: 34709

SEQ ID NO: 707970 - RNA, 64 nt, hsa; identical to SEQ ID NO: 34710

SEQ ID NO: 707971 - RNA, 64 nt, hsa; identical to SEQ ID NO: 34711

SEQ ID NO: 707972 - RNA, 64 nt, hsa; identical to SEQ ID NO: 34712

SEQ ID NO: 707973 - RNA, 64 nt, hsa; identical to SEQ ID NO: 34713

SEQ ID NO: 707974 - RNA, 64 nt, hsa; identical to SEQ ID NO: 34714

SEQ ID NO: 707975 - RNA, 64 nt, hsa; identical to SEQ ID NO: 34715

SEQ ID NO: 707976 - RNA, 64 nt, hsa; identical to SEQ ID NO: 34716

SEQ ID NO: 707977 - RNA, 64 nt, hsa; identical to SEQ ID NO: 34717

SEQ ID NO: 707978 - RNA, 64 nt, hsa; identical to SEQ ID NO: 34718

SEQ ID NO: 707979 - RNA, 64 nt, hsa; identical to SEQ ID NO: 34719

SEQ ID NO: 707980 - RNA, 64 nt, hsa; identical to SEQ ID NO: 34720

SEQ ID NO: 707981 - RNA, 64 nt, hsa; identical to SEQ ID NO: 34721

SEQ ID NO: 707982 - RNA, 64 nt, hsa; identical to SEQ ID NO: 34722

SEQ ID NO: 707983 - RNA, 64 nt, hsa; identical to SEQ ID NO: 34723

SEQ ID NO: 707984 - RNA, 64 nt, hsa; identical to SEQ ID NO: 34724

SEQ ID NO: 707985 - RNA, 64 nt, hsa; identical to SEQ ID NO: 34725

SEQ ID NO: 707986 - RNA, 64 nt, hsa; identical to SEQ ID NO: 34726

SEQ ID NO: 707987 - RNA, 64 nt, hsa; identical to SEQ ID NO: 34727

SEQ ID NO: 707988 - RNA, 64 nt, hsa; identical to SEQ ID NO: 34728

SEQ ID NO: 707989 - RNA, 64 nt, hsa; identical to SEQ ID NO: 34729

SEQ ID NO: 707990 - RNA, 64 nt, hsa; identical to SEQ ID NO: 34730

SEQ ID NO: 707991 - RNA, 64 nt, hsa; identical to SEQ ID NO: 34731

SEQ ID NO: 707992 - RNA, 64 nt, hsa; identical to SEQ ID NO: 34732

SEQ ID NO: 707993 - RNA, 64 nt, hsa; identical to SEQ ID NO: 34733

SEQ ID NO: 707994 - RNA, 64 nt, hsa; identical to SEQ ID NO: 34734

SEQ ID NO: 707995 - RNA, 64 nt, hsa; identical to SEQ ID NO: 34735

SEQ ID NO: 707996 - RNA, 64 nt, hsa; identical to SEQ ID NO: 34736

SEQ ID NO: 707997 - RNA, 64 nt, hsa; identical to SEQ ID NO: 34737

SEQ ID NO: 707998 - RNA, 64 nt, hsa; identical to SEQ ID NO: 34738

SEQ ID NO: 707999 - RNA, 64 nt, hsa; identical to SEQ ID NO: 34739

SEQ ID NO: 708000 - RNA, 64 nt, hsa; identical to SEQ ID NO: 34740

SEQ ID NO: 708001 - RNA, 64 nt, hsa; identical to SEQ ID NO: 34741

SEQ ID NO: 708002 - RNA, 63 nt, hsa; identical to SEQ ID NO: 34742

SEQ ID NO: 708003 - RNA, 62 nt, hsa; identical to SEQ ID NO: 34743

SEQ ID NO: 708004 - RNA, 64 nt, hsa; identical to SEQ ID NO: 34744

SEQ ID NO: 708005 - RNA, 64 nt, hsa; identical to SEQ ID NO: 34745

SEQ ID NO: 708006 - RNA, 64 nt, hsa; identical to SEQ ID NO: 34746

SEQ ID NO: 708007 - RNA, 64 nt, hsa; identical to SEQ ID NO: 34747

SEQ ID NO: 708008 - RNA, 64 nt, hsa; identical to SEQ ID NO: 34748

SEQ ID NO: 708009 - RNA, 64 nt, hsa; identical to SEQ ID NO: 34749

SEQ ID NO: 708010 - RNA, 64 nt, hsa; identical to SEQ ID NO: 34750

SEQ ID NO: 708011 - RNA, 64 nt, hsa; identical to SEQ ID NO: 34751

SEQ ID NO: 708012 - RNA, 64 nt, hsa; identical to SEQ ID NO: 34752

SEQ ID NO: 708013 - RNA, 64 nt, hsa; identical to SEQ ID NO: 34753

SEQ ID NO: 708014 - RNA, 64 nt, hsa; identical to SEQ ID NO: 34754

SEQ ID NO: 708015 - RNA, 64 nt, hsa; identical to SEQ ID NO: 34755

SEQ ID NO: 708016 - RNA, 64 nt, hsa; identical to SEQ ID NO: 34756

SEQ ID NO: 708017 - RNA, 64 nt, hsa; identical to SEQ ID NO: 34757

SEQ ID NO: 708018 - RNA, 64 nt, hsa; identical to SEQ ID NO: 34758

SEQ ID NO: 708019 - RNA, 64 nt, hsa; identical to SEQ ID NO: 34759

SEQ ID NO: 708020 - RNA, 64 nt, hsa; identical to SEQ ID NO: 34760

SEQ ID NO: 708021 - RNA, 64 nt, hsa; identical to SEQ ID NO: 34761

SEQ ID NO: 708022 - RNA, 64 nt, hsa; identical to SEQ ID NO: 34762

SEQ ID NO: 708023 - RNA, 64 nt, hsa; identical to SEQ ID NO: 34763

SEQ ID NO: 708024 - RNA, 64 nt, hsa; identical to SEQ ID NO: 34764

SEQ ID NO: 708025 - RNA, 64 nt, hsa; identical to SEQ ID NO: 34765

SEQ ID NO: 708026 - RNA, 64 nt, hsa; identical to SEQ ID NO: 34766

SEQ ID NO: 708027 - RNA, 64 nt, hsa; identical to SEQ ID NO: 34767

SEQ ID NO: 708028 - RNA, 64 nt, hsa; identical to SEQ ID NO: 34768

SEQ ID NO: 708029 - RNA, 64 nt, hsa; identical to SEQ ID NO: 34769

SEQ ID NO: 708030 - RNA, 64 nt, hsa; identical to SEQ ID NO: 34770

SEQ ID NO: 708031 - RNA, 64 nt, hsa; identical to SEQ ID NO: 34771

SEQ ID NO: 708032 - RNA, 64 nt, hsa; identical to SEQ ID NO: 34772

SEQ ID NO: 708033 - RNA, 64 nt, hsa; identical to SEQ ID NO: 34773

SEQ ID NO: 708034 - RNA, 64 nt, hsa; identical to SEQ ID NO: 34774

SEQ ID NO: 708035 - RNA, 64 nt, hsa; identical to SEQ ID NO: 34775

SEQ ID NO: 708036 - RNA, 64 nt, hsa; identical to SEQ ID NO: 34776

SEQ ID NO: 708037 - RNA, 64 nt, hsa; identical to SEQ ID NO: 34777

SEQ ID NO: 708038 - RNA, 64 nt, hsa; identical to SEQ ID NO: 34778

SEQ ID NO: 708039 - RNA, 64 nt, hsa; identical to SEQ ID NO: 34779

SEQ ID NO: 708040 - RNA, 64 nt, hsa; identical to SEQ ID NO: 34780

SEQ ID NO: 708041 - RNA, 64 nt, hsa; identical to SEQ ID NO: 34781

SEQ ID NO: 708042 - RNA, 64 nt, hsa; identical to SEQ ID NO: 34782

SEQ ID NO: 708043 - RNA, 64 nt, hsa; identical to SEQ ID NO: 34783

SEQ ID NO: 708044 - RNA, 64 nt, hsa; identical to SEQ ID NO: 34784

SEQ ID NO: 708045 - RNA, 64 nt, hsa; identical to SEQ ID NO: 34785

SEQ ID NO: 708046 - RNA, 64 nt, hsa; identical to SEQ ID NO: 34786

SEQ ID NO: 708047 - RNA, 64 nt, hsa; identical to SEQ ID NO: 34787

SEQ ID NO: 708048 - RNA, 64 nt, hsa; identical to SEQ ID NO: 34788

SEQ ID NO: 708049 - RNA, 64 nt, hsa; identical to SEQ ID NO: 34789

SEQ ID NO: 708050 - RNA, 64 nt, hsa; identical to SEQ ID NO: 34790

SEQ ID NO: 708051 - RNA, 64 nt, hsa; identical to SEQ ID NO: 34791

SEQ ID NO: 708052 - RNA, 64 nt, hsa; identical to SEQ ID NO: 34792

SEQ ID NO: 708053 - RNA, 64 nt, hsa; identical to SEQ ID NO: 34793

SEQ ID NO: 708054 - RNA, 64 nt, hsa; identical to SEQ ID NO: 34794

SEQ ID NO: 708055 - RNA, 64 nt, hsa; identical to SEQ ID NO: 34795

SEQ ID NO: 708056 - RNA, 64 nt, hsa; identical to SEQ ID NO: 34796

SEQ ID NO: 708057 - RNA, 64 nt, hsa; identical to SEQ ID NO: 34797

SEQ ID NO: 708058 - RNA, 64 nt, hsa; identical to SEQ ID NO: 34798

SEQ ID NO: 708059 - RNA, 64 nt, hsa; identical to SEQ ID NO: 34799

SEQ ID NO: 708060 - RNA, 64 nt, hsa; identical to SEQ ID NO: 34800

SEQ ID NO: 708061 - RNA, 64 nt, hsa; identical to SEQ ID NO: 34801

SEQ ID NO: 708062 - RNA, 64 nt, hsa; identical to SEQ ID NO: 34802

SEQ ID NO: 708063 - RNA, 64 nt, hsa; identical to SEQ ID NO: 34803

SEQ ID NO: 708064 - RNA, 64 nt, hsa; identical to SEQ ID NO: 34804

SEQ ID NO: 708065 - RNA, 64 nt, hsa; identical to SEQ ID NO: 34805

SEQ ID NO: 708066 - RNA, 64 nt, hsa; identical to SEQ ID NO: 34806

SEQ ID NO: 708067 - RNA, 64 nt, hsa; identical to SEQ ID NO: 34807

SEQ ID NO: 708068 - RNA, 64 nt, hsa; identical to SEQ ID NO: 34808

SEQ ID NO: 708069 - RNA, 64 nt, hsa; identical to SEQ ID NO: 34809

SEQ ID NO: 708070 - RNA, 64 nt, hsa; identical to SEQ ID NO: 34810

SEQ ID NO: 708071 - RNA, 64 nt, hsa; identical to SEQ ID NO: 34811

SEQ ID NO: 708072 - RNA, 64 nt, hsa; identical to SEQ ID NO: 34812

SEQ ID NO: 708073 - RNA, 64 nt, hsa; identical to SEQ ID NO: 34813

SEQ ID NO: 708074 - RNA, 64 nt, hsa; identical to SEQ ID NO: 34814

SEQ ID NO: 708075 - RNA, 64 nt, hsa; identical to SEQ ID NO: 34815

SEQ ID NO: 708076 - RNA, 64 nt, hsa; identical to SEQ ID NO: 34816

SEQ ID NO: 708077 - RNA, 64 nt, hsa; identical to SEQ ID NO: 34817

SEQ ID NO: 708078 - RNA, 64 nt, hsa; identical to SEQ ID NO: 34818

SEQ ID NO: 708079 - RNA, 64 nt, hsa; identical to SEQ ID NO: 34819

SEQ ID NO: 708080 - RNA, 64 nt, hsa; identical to SEQ ID NO: 34820

SEQ ID NO: 708081 - RNA, 64 nt, hsa; identical to SEQ ID NO: 34821

SEQ ID NO: 708082 - RNA, 64 nt, hsa; identical to SEQ ID NO: 34822

SEQ ID NO: 708083 - RNA, 64 nt, hsa; identical to SEQ ID NO: 34823

SEQ ID NO: 708084 - RNA, 64 nt, hsa; identical to SEQ ID NO: 34824

SEQ ID NO: 708085 - RNA, 64 nt, hsa; identical to SEQ ID NO: 34825

SEQ ID NO: 708086 - RNA, 64 nt, hsa; identical to SEQ ID NO: 34826

SEQ ID NO: 708087 - RNA, 64 nt, hsa; identical to SEQ ID NO: 34827

SEQ ID NO: 708088 - RNA, 64 nt, hsa; identical to SEQ ID NO: 34828

SEQ ID NO: 708089 - RNA, 64 nt, hsa; identical to SEQ ID NO: 34829

SEQ ID NO: 708090 - RNA, 64 nt, hsa; identical to SEQ ID NO: 34830

SEQ ID NO: 708091 - RNA, 64 nt, hsa; identical to SEQ ID NO: 34831

SEQ ID NO: 708092 - RNA, 64 nt, hsa; identical to SEQ ID NO: 34832

SEQ ID NO: 708093 - RNA, 64 nt, hsa; identical to SEQ ID NO: 34833

SEQ ID NO: 708094 - RNA, 64 nt, hsa; identical to SEQ ID NO: 34834

SEQ ID NO: 708095 - RNA, 64 nt, hsa; identical to SEQ ID NO: 34835

SEQ ID NO: 708096 - RNA, 64 nt, hsa; identical to SEQ ID NO: 34836

SEQ ID NO: 708097 - RNA, 64 nt, hsa; identical to SEQ ID NO: 34837

SEQ ID NO: 708098 - RNA, 64 nt, hsa; identical to SEQ ID NO: 34838

SEQ ID NO: 708099 - RNA, 64 nt, hsa; identical to SEQ ID NO: 34839

SEQ ID NO: 708100 - RNA, 64 nt, hsa; identical to SEQ ID NO: 34840

SEQ ID NO: 708101 - RNA, 64 nt, hsa; identical to SEQ ID NO: 34841

SEQ ID NO: 708102 - RNA, 64 nt, hsa; identical to SEQ ID NO: 34842

SEQ ID NO: 708103 - RNA, 64 nt, hsa; identical to SEQ ID NO: 34843

SEQ ID NO: 708104 - RNA, 64 nt, hsa; identical to SEQ ID NO: 34844

SEQ ID NO: 708105 - RNA, 64 nt, hsa; identical to SEQ ID NO: 34845

SEQ ID NO: 708106 - RNA, 64 nt, hsa; identical to SEQ ID NO: 34846

SEQ ID NO: 708107 - RNA, 64 nt, hsa; identical to SEQ ID NO: 34847

SEQ ID NO: 708108 - RNA, 64 nt, hsa; identical to SEQ ID NO: 34848

SEQ ID NO: 708109 - RNA, 64 nt, hsa; identical to SEQ ID NO: 34849

SEQ ID NO: 708110 - RNA, 64 nt, hsa; identical to SEQ ID NO: 34850

SEQ ID NO: 708111 - RNA, 64 nt, hsa; identical to SEQ ID NO: 34851

SEQ ID NO: 708112 - RNA, 64 nt, hsa; identical to SEQ ID NO: 34852

SEQ ID NO: 708113 - RNA, 64 nt, hsa; identical to SEQ ID NO: 34853

SEQ ID NO: 708114 - RNA, 64 nt, hsa; identical to SEQ ID NO: 34854

SEQ ID NO: 708115 - RNA, 64 nt, hsa; identical to SEQ ID NO: 34855

SEQ ID NO: 708116 - RNA, 64 nt, hsa; identical to SEQ ID NO: 34856

SEQ ID NO: 708117 - RNA, 64 nt, hsa; identical to SEQ ID NO: 34857

SEQ ID NO: 708118 - RNA, 63 nt, hsa; identical to SEQ ID NO: 34858

SEQ ID NO: 708119 - RNA, 64 nt, hsa; identical to SEQ ID NO: 34859

SEQ ID NO: 708120 - RNA, 64 nt, hsa; identical to SEQ ID NO: 34860

SEQ ID NO: 708121 - RNA, 64 nt, hsa; identical to SEQ ID NO: 34861

SEQ ID NO: 708122 - RNA, 64 nt, hsa; identical to SEQ ID NO: 34862

SEQ ID NO: 708123 - RNA, 64 nt, hsa; identical to SEQ ID NO: 34863

SEQ ID NO: 708124 - RNA, 64 nt, hsa; identical to SEQ ID NO: 34864

SEQ ID NO: 708125 - RNA, 64 nt, hsa; identical to SEQ ID NO: 34865

SEQ ID NO: 708126 - RNA, 64 nt, hsa; identical to SEQ ID NO: 34866

SEQ ID NO: 708127 - RNA, 64 nt, hsa; identical to SEQ ID NO: 34867

SEQ ID NO: 708128 - RNA, 64 nt, hsa; identical to SEQ ID NO: 34868

SEQ ID NO: 708129 - RNA, 64 nt, hsa; identical to SEQ ID NO: 34869

SEQ ID NO: 708130 - RNA, 64 nt, hsa; identical to SEQ ID NO: 34870

SEQ ID NO: 708131 - RNA, 64 nt, hsa; identical to SEQ ID NO: 34871

SEQ ID NO: 708132 - RNA, 64 nt, hsa; identical to SEQ ID NO: 34872

SEQ ID NO: 708133 - RNA, 64 nt, hsa; identical to SEQ ID NO: 34873

SEQ ID NO: 708134 - RNA, 64 nt, hsa; identical to SEQ ID NO: 34874

SEQ ID NO: 708135 - RNA, 64 nt, hsa; identical to SEQ ID NO: 34875

SEQ ID NO: 708136 - RNA, 64 nt, hsa; identical to SEQ ID NO: 34876

SEQ ID NO: 708137 - RNA, 64 nt, hsa; identical to SEQ ID NO: 34877

SEQ ID NO: 708138 - RNA, 64 nt, hsa; identical to SEQ ID NO: 34878

SEQ ID NO: 708139 - RNA, 64 nt, hsa; identical to SEQ ID NO: 34879

SEQ ID NO: 708140 - RNA, 64 nt, hsa; identical to SEQ ID NO: 34880

SEQ ID NO: 708141 - RNA, 64 nt, hsa; identical to SEQ ID NO: 34881

SEQ ID NO: 708142 - RNA, 64 nt, hsa; identical to SEQ ID NO: 34882

SEQ ID NO: 708143 - RNA, 64 nt, hsa; identical to SEQ ID NO: 34883

SEQ ID NO: 708144 - RNA, 64 nt, hsa; identical to SEQ ID NO: 34884

SEQ ID NO: 708145 - RNA, 64 nt, hsa; identical to SEQ ID NO: 34885

SEQ ID NO: 708146 - RNA, 64 nt, hsa; identical to SEQ ID NO: 34886

SEQ ID NO: 708147 - RNA, 64 nt, hsa; identical to SEQ ID NO: 34887

SEQ ID NO: 708148 - RNA, 64 nt, hsa; identical to SEQ ID NO: 34888

SEQ ID NO: 708149 - RNA, 64 nt, hsa; identical to SEQ ID NO: 34889

SEQ ID NO: 708150 - RNA, 64 nt, hsa; identical to SEQ ID NO: 34890

SEQ ID NO: 708151 - RNA, 64 nt, hsa; identical to SEQ ID NO: 34891

SEQ ID NO: 708152 - RNA, 64 nt, hsa; identical to SEQ ID NO: 34892

SEQ ID NO: 708153 - RNA, 64 nt, hsa; identical to SEQ ID NO: 34893

SEQ ID NO: 708154 - RNA, 64 nt, hsa; identical to SEQ ID NO: 34894

SEQ ID NO: 708155 - RNA, 64 nt, hsa; identical to SEQ ID NO: 34895

SEQ ID NO: 708156 - RNA, 64 nt, hsa; identical to SEQ ID NO: 34896

SEQ ID NO: 708157 - RNA, 64 nt, hsa; identical to SEQ ID NO: 34897

SEQ ID NO: 708158 - RNA, 64 nt, hsa; identical to SEQ ID NO: 34898

SEQ ID NO: 708159 - RNA, 64 nt, hsa; identical to SEQ ID NO: 34899

SEQ ID NO: 708160 - RNA, 64 nt, hsa; identical to SEQ ID NO: 34900

SEQ ID NO: 708161 - RNA, 64 nt, hsa; identical to SEQ ID NO: 34901

SEQ ID NO: 708162 - RNA, 64 nt, hsa; identical to SEQ ID NO: 34902

SEQ ID NO: 708163 - RNA, 64 nt, hsa; identical to SEQ ID NO: 34903

SEQ ID NO: 708164 - RNA, 64 nt, hsa; identical to SEQ ID NO: 34904

SEQ ID NO: 708165 - RNA, 64 nt, hsa; identical to SEQ ID NO: 34905

SEQ ID NO: 708166 - RNA, 64 nt, hsa; identical to SEQ ID NO: 34906

SEQ ID NO: 708167 - RNA, 64 nt, hsa; identical to SEQ ID NO: 34907

SEQ ID NO: 708168 - RNA, 64 nt, hsa; identical to SEQ ID NO: 34908

SEQ ID NO: 708169 - RNA, 64 nt, hsa; identical to SEQ ID NO: 34909

SEQ ID NO: 708170 - RNA, 64 nt, hsa; identical to SEQ ID NO: 34910

SEQ ID NO: 708171 - RNA, 64 nt, hsa; identical to SEQ ID NO: 34911

SEQ ID NO: 708172 - RNA, 64 nt, hsa; identical to SEQ ID NO: 34912

SEQ ID NO: 708173 - RNA, 64 nt, hsa; identical to SEQ ID NO: 34913

SEQ ID NO: 708174 - RNA, 64 nt, hsa; identical to SEQ ID NO: 34914

SEQ ID NO: 708175 - RNA, 64 nt, hsa; identical to SEQ ID NO: 34915

SEQ ID NO: 708176 - RNA, 64 nt, hsa; identical to SEQ ID NO: 34916

SEQ ID NO: 708177 - RNA, 64 nt, hsa; identical to SEQ ID NO: 34917

SEQ ID NO: 708178 - RNA, 64 nt, hsa; identical to SEQ ID NO: 34918

SEQ ID NO: 708179 - RNA, 64 nt, hsa; identical to SEQ ID NO: 34919

SEQ ID NO: 708180 - RNA, 64 nt, hsa; identical to SEQ ID NO: 34920

SEQ ID NO: 708181 - RNA, 64 nt, hsa; identical to SEQ ID NO: 34921

SEQ ID NO: 708182 - RNA, 64 nt, hsa; identical to SEQ ID NO: 34922

SEQ ID NO: 708183 - RNA, 64 nt, hsa; identical to SEQ ID NO: 34923

SEQ ID NO: 708184 - RNA, 64 nt, hsa; identical to SEQ ID NO: 34924

SEQ ID NO: 708185 - RNA, 64 nt, hsa; identical to SEQ ID NO: 34925

SEQ ID NO: 708186 - RNA, 64 nt, hsa; identical to SEQ ID NO: 34926

SEQ ID NO: 708187 - RNA, 64 nt, hsa; identical to SEQ ID NO: 34927

SEQ ID NO: 708188 - RNA, 64 nt, hsa; identical to SEQ ID NO: 34928

SEQ ID NO: 708189 - RNA, 63 nt, hsa; identical to SEQ ID NO: 34929

SEQ ID NO: 708190 - RNA, 64 nt, hsa; identical to SEQ ID NO: 34930

SEQ ID NO: 708191 - RNA, 64 nt, hsa; identical to SEQ ID NO: 34931

SEQ ID NO: 708192 - RNA, 64 nt, hsa; identical to SEQ ID NO: 34932

SEQ ID NO: 708193 - RNA, 64 nt, hsa; identical to SEQ ID NO: 34933

SEQ ID NO: 708194 - RNA, 64 nt, hsa; identical to SEQ ID NO: 34934

SEQ ID NO: 708195 - RNA, 64 nt, hsa; identical to SEQ ID NO: 34935

SEQ ID NO: 708196 - RNA, 64 nt, hsa; identical to SEQ ID NO: 34936

SEQ ID NO: 708197 - RNA, 64 nt, hsa; identical to SEQ ID NO: 34937

SEQ ID NO: 708198 - RNA, 64 nt, hsa; identical to SEQ ID NO: 34938

SEQ ID NO: 708199 - RNA, 64 nt, hsa; identical to SEQ ID NO: 34939

SEQ ID NO: 708200 - RNA, 64 nt, hsa; identical to SEQ ID NO: 34940

SEQ ID NO: 708201 - RNA, 64 nt, hsa; identical to SEQ ID NO: 34941

SEQ ID NO: 708202 - RNA, 64 nt, hsa; identical to SEQ ID NO: 34942

SEQ ID NO: 708203 - RNA, 64 nt, hsa; identical to SEQ ID NO: 34943

SEQ ID NO: 708204 - RNA, 64 nt, hsa; identical to SEQ ID NO: 34944

SEQ ID NO: 708205 - RNA, 64 nt, hsa; identical to SEQ ID NO: 34945

SEQ ID NO: 708206 - RNA, 64 nt, hsa; identical to SEQ ID NO: 34946

SEQ ID NO: 708207 - RNA, 64 nt, hsa; identical to SEQ ID NO: 34947

SEQ ID NO: 708208 - RNA, 64 nt, hsa; identical to SEQ ID NO: 34948

SEQ ID NO: 708209 - RNA, 64 nt, hsa; identical to SEQ ID NO: 34949

SEQ ID NO: 708210 - RNA, 64 nt, hsa; identical to SEQ ID NO: 34950

SEQ ID NO: 708211 - RNA, 64 nt, hsa; identical to SEQ ID NO: 34951

SEQ ID NO: 708212 - RNA, 64 nt, hsa; identical to SEQ ID NO: 34952

SEQ ID NO: 708213 - RNA, 64 nt, hsa; identical to SEQ ID NO: 34953

SEQ ID NO: 708214 - RNA, 64 nt, hsa; identical to SEQ ID NO: 34954

SEQ ID NO: 708215 - RNA, 64 nt, hsa; identical to SEQ ID NO: 34955

SEQ ID NO: 708216 - RNA, 64 nt, hsa; identical to SEQ ID NO: 34956

SEQ ID NO: 708217 - RNA, 64 nt, hsa; identical to SEQ ID NO: 34957

SEQ ID NO: 708218 - RNA, 64 nt, hsa; identical to SEQ ID NO: 34958

SEQ ID NO: 708219 - RNA, 64 nt, hsa; identical to SEQ ID NO: 34959

SEQ ID NO: 708220 - RNA, 64 nt, hsa; identical to SEQ ID NO: 34960

SEQ ID NO: 708221 - RNA, 64 nt, hsa; identical to SEQ ID NO: 34961

SEQ ID NO: 708222 - RNA, 64 nt, hsa; identical to SEQ ID NO: 34962

SEQ ID NO: 708223 - RNA, 64 nt, hsa; identical to SEQ ID NO: 34963

SEQ ID NO: 708224 - RNA, 64 nt, hsa; identical to SEQ ID NO: 34964

SEQ ID NO: 708225 - RNA, 64 nt, hsa; identical to SEQ ID NO: 34965

SEQ ID NO: 708226 - RNA, 64 nt, hsa; identical to SEQ ID NO: 34966

SEQ ID NO: 708227 - RNA, 64 nt, hsa; identical to SEQ ID NO: 34967

SEQ ID NO: 708228 - RNA, 64 nt, hsa; identical to SEQ ID NO: 34968

SEQ ID NO: 708229 - RNA, 64 nt, hsa; identical to SEQ ID NO: 34969

SEQ ID NO: 708230 - RNA, 64 nt, hsa; identical to SEQ ID NO: 34970

SEQ ID NO: 708231 - RNA, 64 nt, hsa; identical to SEQ ID NO: 34971

SEQ ID NO: 708232 - RNA, 64 nt, hsa; identical to SEQ ID NO: 34972

SEQ ID NO: 708233 - RNA, 64 nt, hsa; identical to SEQ ID NO: 34973

SEQ ID NO: 708234 - RNA, 64 nt, hsa; identical to SEQ ID NO: 34974

SEQ ID NO: 708235 - RNA, 64 nt, hsa; identical to SEQ ID NO: 34975

SEQ ID NO: 708236 - RNA, 64 nt, hsa; identical to SEQ ID NO: 34976

SEQ ID NO: 708237 - RNA, 64 nt, hsa; identical to SEQ ID NO: 34977

SEQ ID NO: 708238 - RNA, 64 nt, hsa; identical to SEQ ID NO: 34978

SEQ ID NO: 708239 - RNA, 64 nt, hsa; identical to SEQ ID NO: 34979

SEQ ID NO: 708240 - RNA, 64 nt, hsa; identical to SEQ ID NO: 34980

SEQ ID NO: 708241 - RNA, 64 nt, hsa; identical to SEQ ID NO: 34981

SEQ ID NO: 708242 - RNA, 64 nt, hsa; identical to SEQ ID NO: 34982

SEQ ID NO: 708243 - RNA, 64 nt, hsa; identical to SEQ ID NO: 34983

SEQ ID NO: 708244 - RNA, 64 nt, hsa; identical to SEQ ID NO: 34984

SEQ ID NO: 708245 - RNA, 64 nt, hsa; identical to SEQ ID NO: 34985

SEQ ID NO: 708246 - RNA, 64 nt, hsa; identical to SEQ ID NO: 34986

SEQ ID NO: 708247 - RNA, 64 nt, hsa; identical to SEQ ID NO: 34987

SEQ ID NO: 708248 - RNA, 64 nt, hsa; identical to SEQ ID NO: 34988

SEQ ID NO: 708249 - RNA, 64 nt, hsa; identical to SEQ ID NO: 34989

SEQ ID NO: 708250 - RNA, 64 nt, hsa; identical to SEQ ID NO: 34990

SEQ ID NO: 708251 - RNA, 64 nt, hsa; identical to SEQ ID NO: 34991

SEQ ID NO: 708252 - RNA, 64 nt, hsa; identical to SEQ ID NO: 34992

SEQ ID NO: 708253 - RNA, 64 nt, hsa; identical to SEQ ID NO: 34993

SEQ ID NO: 708254 - RNA, 64 nt, hsa; identical to SEQ ID NO: 34994

SEQ ID NO: 708255 - RNA, 64 nt, hsa; identical to SEQ ID NO: 34995

SEQ ID NO: 708256 - RNA, 64 nt, hsa; identical to SEQ ID NO: 34996

SEQ ID NO: 708257 - RNA, 64 nt, hsa; identical to SEQ ID NO: 34997

SEQ ID NO: 708258 - RNA, 64 nt, hsa; identical to SEQ ID NO: 34998

SEQ ID NO: 708259 - RNA, 64 nt, hsa; identical to SEQ ID NO: 34999

SEQ ID NO: 708260 - RNA, 64 nt, hsa; identical to SEQ ID NO: 35000

SEQ ID NO: 708261 - RNA, 64 nt, hsa; identical to SEQ ID NO: 35001

SEQ ID NO: 708262 - RNA, 64 nt, hsa; identical to SEQ ID NO: 35002

SEQ ID NO: 708263 - RNA, 64 nt, hsa; identical to SEQ ID NO: 35003

SEQ ID NO: 708264 - RNA, 64 nt, hsa; identical to SEQ ID NO: 35004

SEQ ID NO: 708265 - RNA, 64 nt, hsa; identical to SEQ ID NO: 35005

SEQ ID NO: 708266 - RNA, 64 nt, hsa; identical to SEQ ID NO: 35006

SEQ ID NO: 708267 - RNA, 64 nt, hsa; identical to SEQ ID NO: 35007

SEQ ID NO: 708268 - RNA, 64 nt, hsa; identical to SEQ ID NO: 35008

SEQ ID NO: 708269 - RNA, 64 nt, hsa; identical to SEQ ID NO: 35009

SEQ ID NO: 708270 - RNA, 64 nt, hsa; identical to SEQ ID NO: 35010

SEQ ID NO: 708271 - RNA, 64 nt, hsa; identical to SEQ ID NO: 35011

SEQ ID NO: 708272 - RNA, 64 nt, hsa; identical to SEQ ID NO: 35012

SEQ ID NO: 708273 - RNA, 64 nt, hsa; identical to SEQ ID NO: 35013

SEQ ID NO: 708274 - RNA, 64 nt, hsa; identical to SEQ ID NO: 35014

SEQ ID NO: 708275 - RNA, 64 nt, hsa; identical to SEQ ID NO: 35015

SEQ ID NO: 708276 - RNA, 64 nt, hsa; identical to SEQ ID NO: 35016

SEQ ID NO: 708277 - RNA, 64 nt, hsa; identical to SEQ ID NO: 35017

SEQ ID NO: 708278 - RNA, 64 nt, hsa; identical to SEQ ID NO: 35018

SEQ ID NO: 708279 - RNA, 64 nt, hsa; identical to SEQ ID NO: 35019

SEQ ID NO: 708280 - RNA, 64 nt, hsa; identical to SEQ ID NO: 35020

SEQ ID NO: 708281 - RNA, 64 nt, hsa; identical to SEQ ID NO: 35021

SEQ ID NO: 708282 - RNA, 64 nt, hsa; identical to SEQ ID NO: 35022

SEQ ID NO: 708283 - RNA, 64 nt, hsa; identical to SEQ ID NO: 35023

SEQ ID NO: 708284 - RNA, 64 nt, hsa; identical to SEQ ID NO: 35024

SEQ ID NO: 708285 - RNA, 64 nt, hsa; identical to SEQ ID NO: 35025

SEQ ID NO: 708286 - RNA, 64 nt, hsa; identical to SEQ ID NO: 35026

SEQ ID NO: 708287 - RNA, 64 nt, hsa; identical to SEQ ID NO: 35027

SEQ ID NO: 708288 - RNA, 64 nt, hsa; identical to SEQ ID NO: 35028

SEQ ID NO: 708289 - RNA, 64 nt, hsa; identical to SEQ ID NO: 35029

SEQ ID NO: 708290 - RNA, 64 nt, hsa; identical to SEQ ID NO: 35030

SEQ ID NO: 708291 - RNA, 64 nt, hsa; identical to SEQ ID NO: 35031

SEQ ID NO: 708292 - RNA, 64 nt, hsa; identical to SEQ ID NO: 35032

SEQ ID NO: 708293 - RNA, 64 nt, hsa; identical to SEQ ID NO: 35033

SEQ ID NO: 708294 - RNA, 64 nt, hsa; identical to SEQ ID NO: 35034

SEQ ID NO: 708295 - RNA, 64 nt, hsa; identical to SEQ ID NO: 35035

SEQ ID NO: 708296 - RNA, 64 nt, hsa; identical to SEQ ID NO: 35036

SEQ ID NO: 708297 - RNA, 64 nt, hsa; identical to SEQ ID NO: 35037

SEQ ID NO: 708298 - RNA, 64 nt, hsa; identical to SEQ ID NO: 35038

SEQ ID NO: 708299 - RNA, 64 nt, hsa; identical to SEQ ID NO: 35039

SEQ ID NO: 708300 - RNA, 64 nt, hsa; identical to SEQ ID NO: 35040

SEQ ID NO: 708301 - RNA, 64 nt, hsa; identical to SEQ ID NO: 35041

SEQ ID NO: 708302 - RNA, 64 nt, hsa; identical to SEQ ID NO: 35042

SEQ ID NO: 708303 - RNA, 64 nt, hsa; identical to SEQ ID NO: 35043

SEQ ID NO: 708304 - RNA, 64 nt, hsa; identical to SEQ ID NO: 35044

SEQ ID NO: 708305 - RNA, 64 nt, hsa; identical to SEQ ID NO: 35045

SEQ ID NO: 708306 - RNA, 64 nt, hsa; identical to SEQ ID NO: 35046

SEQ ID NO: 708307 - RNA, 64 nt, hsa; identical to SEQ ID NO: 35047

SEQ ID NO: 708308 - RNA, 64 nt, hsa; identical to SEQ ID NO: 35048

SEQ ID NO: 708309 - RNA, 64 nt, hsa; identical to SEQ ID NO: 35049

SEQ ID NO: 708310 - RNA, 64 nt, hsa; identical to SEQ ID NO: 35050

SEQ ID NO: 708311 - RNA, 64 nt, hsa; identical to SEQ ID NO: 35051

SEQ ID NO: 708312 - RNA, 64 nt, hsa; identical to SEQ ID NO: 35052

SEQ ID NO: 708313 - RNA, 64 nt, hsa; identical to SEQ ID NO: 35053

SEQ ID NO: 708314 - RNA, 64 nt, hsa; identical to SEQ ID NO: 35054

SEQ ID NO: 708315 - RNA, 64 nt, hsa; identical to SEQ ID NO: 35055

SEQ ID NO: 708316 - RNA, 64 nt, hsa; identical to SEQ ID NO: 35056

SEQ ID NO: 708317 - RNA, 64 nt, hsa; identical to SEQ ID NO: 35057

SEQ ID NO: 708318 - RNA, 64 nt, hsa; identical to SEQ ID NO: 35058

SEQ ID NO: 708319 - RNA, 64 nt, hsa; identical to SEQ ID NO: 35059

SEQ ID NO: 708320 - RNA, 64 nt, hsa; identical to SEQ ID NO: 35060

SEQ ID NO: 708321 - RNA, 64 nt, hsa; identical to SEQ ID NO: 35061

SEQ ID NO: 708322 - RNA, 64 nt, hsa; identical to SEQ ID NO: 35062

SEQ ID NO: 708323 - RNA, 64 nt, hsa; identical to SEQ ID NO: 35063

SEQ ID NO: 708324 - RNA, 64 nt, hsa; identical to SEQ ID NO: 35064

SEQ ID NO: 708325 - RNA, 64 nt, hsa; identical to SEQ ID NO: 35065

SEQ ID NO: 708326 - RNA, 64 nt, hsa; identical to SEQ ID NO: 35066

SEQ ID NO: 708327 - RNA, 64 nt, hsa; identical to SEQ ID NO: 35067

SEQ ID NO: 708328 - RNA, 64 nt, hsa; identical to SEQ ID NO: 35068

SEQ ID NO: 708329 - RNA, 64 nt, hsa; identical to SEQ ID NO: 35069

SEQ ID NO: 708330 - RNA, 64 nt, hsa; identical to SEQ ID NO: 35070

SEQ ID NO: 708331 - RNA, 64 nt, hsa; identical to SEQ ID NO: 35071

SEQ ID NO: 708332 - RNA, 64 nt, hsa; identical to SEQ ID NO: 35072

SEQ ID NO: 708333 - RNA, 64 nt, hsa; identical to SEQ ID NO: 35073

SEQ ID NO: 708334 - RNA, 64 nt, hsa; identical to SEQ ID NO: 35074

SEQ ID NO: 708335 - RNA, 64 nt, hsa; identical to SEQ ID NO: 35075

SEQ ID NO: 708336 - RNA, 64 nt, hsa; identical to SEQ ID NO: 35076

SEQ ID NO: 708337 - RNA, 64 nt, hsa; identical to SEQ ID NO: 35077

SEQ ID NO: 708338 - RNA, 64 nt, hsa; identical to SEQ ID NO: 35078

SEQ ID NO: 708339 - RNA, 64 nt, hsa; identical to SEQ ID NO: 35079

SEQ ID NO: 708340 - RNA, 64 nt, hsa; identical to SEQ ID NO: 35080

SEQ ID NO: 708341 - RNA, 64 nt, hsa; identical to SEQ ID NO: 35081

SEQ ID NO: 708342 - RNA, 64 nt, hsa; identical to SEQ ID NO: 35082

SEQ ID NO: 708343 - RNA, 64 nt, hsa; identical to SEQ ID NO: 35083

SEQ ID NO: 708344 - RNA, 64 nt, hsa; identical to SEQ ID NO: 35084

SEQ ID NO: 708345 - RNA, 64 nt, hsa; identical to SEQ ID NO: 35085

SEQ ID NO: 708346 - RNA, 64 nt, hsa; identical to SEQ ID NO: 35086

SEQ ID NO: 708347 - RNA, 64 nt, hsa; identical to SEQ ID NO: 35087

SEQ ID NO: 708348 - RNA, 64 nt, hsa; identical to SEQ ID NO: 35088

SEQ ID NO: 708349 - RNA, 64 nt, hsa; identical to SEQ ID NO: 35089

SEQ ID NO: 708350 - RNA, 64 nt, hsa; identical to SEQ ID NO: 35090

SEQ ID NO: 708351 - RNA, 64 nt, hsa; identical to SEQ ID NO: 35091

SEQ ID NO: 708352 - RNA, 64 nt, hsa; identical to SEQ ID NO: 35092

SEQ ID NO: 708353 - RNA, 64 nt, hsa; identical to SEQ ID NO: 35093

SEQ ID NO: 708354 - RNA, 64 nt, hsa; identical to SEQ ID NO: 35094

SEQ ID NO: 708355 - RNA, 64 nt, hsa; identical to SEQ ID NO: 35095

SEQ ID NO: 708356 - RNA, 64 nt, hsa; identical to SEQ ID NO: 35096

SEQ ID NO: 708357 - RNA, 64 nt, hsa; identical to SEQ ID NO: 35097

SEQ ID NO: 708358 - RNA, 64 nt, hsa; identical to SEQ ID NO: 35098

SEQ ID NO: 708359 - RNA, 64 nt, hsa; identical to SEQ ID NO: 35099

SEQ ID NO: 708360 - RNA, 64 nt, hsa; identical to SEQ ID NO: 35100

SEQ ID NO: 708361 - RNA, 64 nt, hsa; identical to SEQ ID NO: 35101

SEQ ID NO: 708362 - RNA, 64 nt, hsa; identical to SEQ ID NO: 35102

SEQ ID NO: 708363 - RNA, 64 nt, hsa; identical to SEQ ID NO: 35103

SEQ ID NO: 708364 - RNA, 64 nt, hsa; identical to SEQ ID NO: 35104

SEQ ID NO: 708365 - RNA, 64 nt, hsa; identical to SEQ ID NO: 35105

SEQ ID NO: 708366 - RNA, 64 nt, hsa; identical to SEQ ID NO: 35106

SEQ ID NO: 708367 - RNA, 64 nt, hsa; identical to SEQ ID NO: 35107

SEQ ID NO: 708368 - RNA, 64 nt, hsa; identical to SEQ ID NO: 35108

SEQ ID NO: 708369 - RNA, 64 nt, hsa; identical to SEQ ID NO: 35109

SEQ ID NO: 708370 - RNA, 64 nt, hsa; identical to SEQ ID NO: 35110

SEQ ID NO: 708371 - RNA, 64 nt, hsa; identical to SEQ ID NO: 35111

SEQ ID NO: 708372 - RNA, 64 nt, hsa; identical to SEQ ID NO: 35112

SEQ ID NO: 708373 - RNA, 64 nt, hsa; identical to SEQ ID NO: 35113

SEQ ID NO: 708374 - RNA, 64 nt, hsa; identical to SEQ ID NO: 35114

SEQ ID NO: 708375 - RNA, 64 nt, hsa; identical to SEQ ID NO: 35115

SEQ ID NO: 708376 - RNA, 64 nt, hsa; identical to SEQ ID NO: 35116

SEQ ID NO: 708377 - RNA, 64 nt, hsa; identical to SEQ ID NO: 35117

SEQ ID NO: 708378 - RNA, 64 nt, hsa; identical to SEQ ID NO: 35118

SEQ ID NO: 708379 - RNA, 64 nt, hsa; identical to SEQ ID NO: 35119

SEQ ID NO: 708380 - RNA, 64 nt, hsa; identical to SEQ ID NO: 35120

SEQ ID NO: 708381 - RNA, 64 nt, hsa; identical to SEQ ID NO: 35121

SEQ ID NO: 708382 - RNA, 64 nt, hsa; identical to SEQ ID NO: 35122

SEQ ID NO: 708383 - RNA, 64 nt, hsa; identical to SEQ ID NO: 35123

SEQ ID NO: 708384 - RNA, 64 nt, hsa; identical to SEQ ID NO: 35124

SEQ ID NO: 708385 - RNA, 64 nt, hsa; identical to SEQ ID NO: 35125

SEQ ID NO: 708386 - RNA, 64 nt, hsa; identical to SEQ ID NO: 35126

SEQ ID NO: 708387 - RNA, 64 nt, hsa; identical to SEQ ID NO: 35127

SEQ ID NO: 708388 - RNA, 64 nt, hsa; identical to SEQ ID NO: 35128

SEQ ID NO: 708389 - RNA, 64 nt, hsa; identical to SEQ ID NO: 35129

SEQ ID NO: 708390 - RNA, 64 nt, hsa; identical to SEQ ID NO: 35130

SEQ ID NO: 708391 - RNA, 64 nt, hsa; identical to SEQ ID NO: 35131

SEQ ID NO: 708392 - RNA, 64 nt, hsa; identical to SEQ ID NO: 35132

SEQ ID NO: 708393 - RNA, 64 nt, hsa; identical to SEQ ID NO: 35133

SEQ ID NO: 708394 - RNA, 64 nt, hsa; identical to SEQ ID NO: 35134

SEQ ID NO: 708395 - RNA, 64 nt, hsa; identical to SEQ ID NO: 35135

SEQ ID NO: 708396 - RNA, 64 nt, hsa; identical to SEQ ID NO: 35136

SEQ ID NO: 708397 - RNA, 64 nt, hsa; identical to SEQ ID NO: 35137

SEQ ID NO: 708398 - RNA, 64 nt, hsa; identical to SEQ ID NO: 35138

SEQ ID NO: 708399 - RNA, 64 nt, hsa; identical to SEQ ID NO: 35139

SEQ ID NO: 708400 - RNA, 64 nt, hsa; identical to SEQ ID NO: 35140

SEQ ID NO: 708401 - RNA, 64 nt, hsa; identical to SEQ ID NO: 35141

SEQ ID NO: 708402 - RNA, 64 nt, hsa; identical to SEQ ID NO: 35142

SEQ ID NO: 708403 - RNA, 64 nt, hsa; identical to SEQ ID NO: 35143

SEQ ID NO: 708404 - RNA, 64 nt, hsa; identical to SEQ ID NO: 35144

SEQ ID NO: 708405 - RNA, 64 nt, hsa; identical to SEQ ID NO: 35145

SEQ ID NO: 708406 - RNA, 64 nt, hsa; identical to SEQ ID NO: 35146

SEQ ID NO: 708407 - RNA, 64 nt, hsa; identical to SEQ ID NO: 35147

SEQ ID NO: 708408 - RNA, 64 nt, hsa; identical to SEQ ID NO: 35148

SEQ ID NO: 708409 - RNA, 64 nt, hsa; identical to SEQ ID NO: 35149

SEQ ID NO: 708410 - RNA, 64 nt, hsa; identical to SEQ ID NO: 35150

SEQ ID NO: 708411 - RNA, 64 nt, hsa; identical to SEQ ID NO: 35151

SEQ ID NO: 708412 - RNA, 64 nt, hsa; identical to SEQ ID NO: 35152

SEQ ID NO: 708413 - RNA, 64 nt, hsa; identical to SEQ ID NO: 35153

SEQ ID NO: 708414 - RNA, 64 nt, hsa; identical to SEQ ID NO: 35154

SEQ ID NO: 708415 - RNA, 64 nt, hsa; identical to SEQ ID NO: 35155

SEQ ID NO: 708416 - RNA, 64 nt, hsa; identical to SEQ ID NO: 35156

SEQ ID NO: 708417 - RNA, 64 nt, hsa; identical to SEQ ID NO: 35157

SEQ ID NO: 708418 - RNA, 64 nt, hsa; identical to SEQ ID NO: 35158

SEQ ID NO: 708419 - RNA, 64 nt, hsa; identical to SEQ ID NO: 35159

SEQ ID NO: 708420 - RNA, 64 nt, hsa; identical to SEQ ID NO: 35160

SEQ ID NO: 708421 - RNA, 64 nt, hsa; identical to SEQ ID NO: 35161

SEQ ID NO: 708422 - RNA, 64 nt, hsa; identical to SEQ ID NO: 35162

SEQ ID NO: 708423 - RNA, 64 nt, hsa; identical to SEQ ID NO: 35163

SEQ ID NO: 708424 - RNA, 64 nt, hsa; identical to SEQ ID NO: 35164

SEQ ID NO: 708425 - RNA, 64 nt, hsa; identical to SEQ ID NO: 35165

SEQ ID NO: 708426 - RNA, 64 nt, hsa; identical to SEQ ID NO: 35166

SEQ ID NO: 708427 - RNA, 64 nt, hsa; identical to SEQ ID NO: 35167

SEQ ID NO: 708428 - RNA, 64 nt, hsa; identical to SEQ ID NO: 35168

SEQ ID NO: 708429 - RNA, 64 nt, hsa; identical to SEQ ID NO: 35169

SEQ ID NO: 708430 - RNA, 64 nt, hsa; identical to SEQ ID NO: 35170

SEQ ID NO: 708431 - RNA, 64 nt, hsa; identical to SEQ ID NO: 35171

SEQ ID NO: 708432 - RNA, 64 nt, hsa; identical to SEQ ID NO: 35172

SEQ ID NO: 708433 - RNA, 64 nt, hsa; identical to SEQ ID NO: 35173

SEQ ID NO: 708434 - RNA, 64 nt, hsa; identical to SEQ ID NO: 35174

SEQ ID NO: 708435 - RNA, 64 nt, hsa; identical to SEQ ID NO: 35175

SEQ ID NO: 708436 - RNA, 64 nt, hsa; identical to SEQ ID NO: 35176

SEQ ID NO: 708437 - RNA, 64 nt, hsa; identical to SEQ ID NO: 35177

SEQ ID NO: 708438 - RNA, 64 nt, hsa; identical to SEQ ID NO: 35178

SEQ ID NO: 708439 - RNA, 64 nt, hsa; identical to SEQ ID NO: 35179

SEQ ID NO: 708440 - RNA, 64 nt, hsa; identical to SEQ ID NO: 35180

SEQ ID NO: 708441 - RNA, 64 nt, hsa; identical to SEQ ID NO: 35181

SEQ ID NO: 708442 - RNA, 64 nt, hsa; identical to SEQ ID NO: 35182

SEQ ID NO: 708443 - RNA, 64 nt, hsa; identical to SEQ ID NO: 35183

SEQ ID NO: 708444 - RNA, 64 nt, hsa; identical to SEQ ID NO: 35184

SEQ ID NO: 708445 - RNA, 64 nt, hsa; identical to SEQ ID NO: 35185

SEQ ID NO: 708446 - RNA, 64 nt, hsa; identical to SEQ ID NO: 35186

SEQ ID NO: 708447 - RNA, 64 nt, hsa; identical to SEQ ID NO: 35187

SEQ ID NO: 708448 - RNA, 64 nt, hsa; identical to SEQ ID NO: 35188

SEQ ID NO: 708449 - RNA, 64 nt, hsa; identical to SEQ ID NO: 35189

SEQ ID NO: 708450 - RNA, 64 nt, hsa; identical to SEQ ID NO: 35190

SEQ ID NO: 708451 - RNA, 64 nt, hsa; identical to SEQ ID NO: 35191

SEQ ID NO: 708452 - RNA, 64 nt, hsa; identical to SEQ ID NO: 35192

SEQ ID NO: 708453 - RNA, 64 nt, hsa; identical to SEQ ID NO: 35193

SEQ ID NO: 708454 - RNA, 64 nt, hsa; identical to SEQ ID NO: 35194

SEQ ID NO: 708455 - RNA, 64 nt, hsa; identical to SEQ ID NO: 35195

SEQ ID NO: 708456 - RNA, 64 nt, hsa; identical to SEQ ID NO: 35196

SEQ ID NO: 708457 - RNA, 64 nt, hsa; identical to SEQ ID NO: 35197

SEQ ID NO: 708458 - RNA, 64 nt, hsa; identical to SEQ ID NO: 35198

SEQ ID NO: 708459 - RNA, 64 nt, hsa; identical to SEQ ID NO: 35199

SEQ ID NO: 708460 - RNA, 64 nt, hsa; identical to SEQ ID NO: 35200

SEQ ID NO: 708461 - RNA, 64 nt, hsa; identical to SEQ ID NO: 35201

SEQ ID NO: 708462 - RNA, 64 nt, hsa; identical to SEQ ID NO: 35202

SEQ ID NO: 708463 - RNA, 64 nt, hsa; identical to SEQ ID NO: 35203

SEQ ID NO: 708464 - RNA, 64 nt, hsa; identical to SEQ ID NO: 35204

SEQ ID NO: 708465 - RNA, 64 nt, hsa; identical to SEQ ID NO: 35205

SEQ ID NO: 708466 - RNA, 64 nt, hsa; identical to SEQ ID NO: 35206

SEQ ID NO: 708467 - RNA, 64 nt, hsa; identical to SEQ ID NO: 35207

SEQ ID NO: 708468 - RNA, 64 nt, hsa; identical to SEQ ID NO: 35208

SEQ ID NO: 708469 - RNA, 64 nt, hsa; identical to SEQ ID NO: 35209

SEQ ID NO: 708470 - RNA, 64 nt, hsa; identical to SEQ ID NO: 35210

SEQ ID NO: 708471 - RNA, 64 nt, hsa; identical to SEQ ID NO: 35211

SEQ ID NO: 708472 - RNA, 64 nt, hsa; identical to SEQ ID NO: 35212

SEQ ID NO: 708473 - RNA, 64 nt, hsa; identical to SEQ ID NO: 35213

SEQ ID NO: 708474 - RNA, 64 nt, hsa; identical to SEQ ID NO: 35214

SEQ ID NO: 708475 - RNA, 64 nt, hsa; identical to SEQ ID NO: 35215

SEQ ID NO: 708476 - RNA, 64 nt, hsa; identical to SEQ ID NO: 35216

SEQ ID NO: 708477 - RNA, 64 nt, hsa; identical to SEQ ID NO: 35217

SEQ ID NO: 708478 - RNA, 64 nt, hsa; identical to SEQ ID NO: 35218

SEQ ID NO: 708479 - RNA, 64 nt, hsa; identical to SEQ ID NO: 35219

SEQ ID NO: 708480 - RNA, 64 nt, hsa; identical to SEQ ID NO: 35220

SEQ ID NO: 708481 - RNA, 64 nt, hsa; identical to SEQ ID NO: 35221

SEQ ID NO: 708482 - RNA, 64 nt, hsa; identical to SEQ ID NO: 35222

SEQ ID NO: 708483 - RNA, 64 nt, hsa; identical to SEQ ID NO: 35223

SEQ ID NO: 708484 - RNA, 64 nt, hsa; identical to SEQ ID NO: 35224

SEQ ID NO: 708485 - RNA, 64 nt, hsa; identical to SEQ ID NO: 35225

SEQ ID NO: 708486 - RNA, 64 nt, hsa; identical to SEQ ID NO: 35226

SEQ ID NO: 708487 - RNA, 64 nt, hsa; identical to SEQ ID NO: 35227

SEQ ID NO: 708488 - RNA, 64 nt, hsa; identical to SEQ ID NO: 35228

SEQ ID NO: 708489 - RNA, 64 nt, hsa; identical to SEQ ID NO: 35229

SEQ ID NO: 708490 - RNA, 64 nt, hsa; identical to SEQ ID NO: 35230

SEQ ID NO: 708491 - RNA, 64 nt, hsa; identical to SEQ ID NO: 35231

SEQ ID NO: 708492 - RNA, 64 nt, hsa; identical to SEQ ID NO: 35232

SEQ ID NO: 708493 - RNA, 64 nt, hsa; identical to SEQ ID NO: 35233

SEQ ID NO: 708494 - RNA, 64 nt, hsa; identical to SEQ ID NO: 35234

SEQ ID NO: 708495 - RNA, 64 nt, hsa; identical to SEQ ID NO: 35235

SEQ ID NO: 708496 - RNA, 64 nt, hsa; identical to SEQ ID NO: 35236

SEQ ID NO: 708497 - RNA, 64 nt, hsa; identical to SEQ ID NO: 35237

SEQ ID NO: 708498 - RNA, 64 nt, hsa; identical to SEQ ID NO: 35238

SEQ ID NO: 708499 - RNA, 64 nt, hsa; identical to SEQ ID NO: 35239

SEQ ID NO: 708500 - RNA, 64 nt, hsa; identical to SEQ ID NO: 35240

SEQ ID NO: 708501 - RNA, 64 nt, hsa; identical to SEQ ID NO: 35241

SEQ ID NO: 708502 - RNA, 64 nt, hsa; identical to SEQ ID NO: 35242

SEQ ID NO: 708503 - RNA, 64 nt, hsa; identical to SEQ ID NO: 35243

SEQ ID NO: 708504 - RNA, 64 nt, hsa; identical to SEQ ID NO: 35244

SEQ ID NO: 708505 - RNA, 64 nt, hsa; identical to SEQ ID NO: 35245

SEQ ID NO: 708506 - RNA, 64 nt, hsa; identical to SEQ ID NO: 35246

SEQ ID NO: 708507 - RNA, 64 nt, hsa; identical to SEQ ID NO: 35247

SEQ ID NO: 708508 - RNA, 64 nt, hsa; identical to SEQ ID NO: 35248

SEQ ID NO: 708509 - RNA, 64 nt, hsa; identical to SEQ ID NO: 35249

SEQ ID NO: 708510 - RNA, 64 nt, hsa; identical to SEQ ID NO: 35250

SEQ ID NO: 708511 - RNA, 64 nt, hsa; identical to SEQ ID NO: 35251

SEQ ID NO: 708512 - RNA, 64 nt, hsa; identical to SEQ ID NO: 35252

SEQ ID NO: 708513 - RNA, 64 nt, hsa; identical to SEQ ID NO: 35253

SEQ ID NO: 708514 - RNA, 64 nt, hsa; identical to SEQ ID NO: 35254

SEQ ID NO: 708515 - RNA, 64 nt, hsa; identical to SEQ ID NO: 35255

SEQ ID NO: 708516 - RNA, 64 nt, hsa; identical to SEQ ID NO: 35256

SEQ ID NO: 708517 - RNA, 64 nt, hsa; identical to SEQ ID NO: 35257

SEQ ID NO: 708518 - RNA, 64 nt, hsa; identical to SEQ ID NO: 35258

SEQ ID NO: 708519 - RNA, 64 nt, hsa; identical to SEQ ID NO: 35259

SEQ ID NO: 708520 - RNA, 64 nt, hsa; identical to SEQ ID NO: 35260

SEQ ID NO: 708521 - RNA, 64 nt, hsa; identical to SEQ ID NO: 35261

SEQ ID NO: 708522 - RNA, 64 nt, hsa; identical to SEQ ID NO: 35262

SEQ ID NO: 708523 - RNA, 64 nt, hsa; identical to SEQ ID NO: 35263

SEQ ID NO: 708524 - RNA, 64 nt, hsa; identical to SEQ ID NO: 35264

SEQ ID NO: 708525 - RNA, 64 nt, hsa; identical to SEQ ID NO: 35265

SEQ ID NO: 708526 - RNA, 64 nt, hsa; identical to SEQ ID NO: 35266

SEQ ID NO: 708527 - RNA, 64 nt, hsa; identical to SEQ ID NO: 35267

SEQ ID NO: 708528 - RNA, 64 nt, hsa; identical to SEQ ID NO: 35268

SEQ ID NO: 708529 - RNA, 64 nt, hsa; identical to SEQ ID NO: 35269

SEQ ID NO: 708530 - RNA, 64 nt, hsa; identical to SEQ ID NO: 35270

SEQ ID NO: 708531 - RNA, 64 nt, hsa; identical to SEQ ID NO: 35271

SEQ ID NO: 708532 - RNA, 64 nt, hsa; identical to SEQ ID NO: 35272

SEQ ID NO: 708533 - RNA, 64 nt, hsa; identical to SEQ ID NO: 35273

SEQ ID NO: 708534 - RNA, 64 nt, hsa; identical to SEQ ID NO: 35274

SEQ ID NO: 708535 - RNA, 64 nt, hsa; identical to SEQ ID NO: 35275

SEQ ID NO: 708536 - RNA, 64 nt, hsa; identical to SEQ ID NO: 35276

SEQ ID NO: 708537 - RNA, 64 nt, hsa; identical to SEQ ID NO: 35277

SEQ ID NO: 708538 - RNA, 64 nt, hsa; identical to SEQ ID NO: 35278

SEQ ID NO: 708539 - RNA, 64 nt, hsa; identical to SEQ ID NO: 35279

SEQ ID NO: 708540 - RNA, 64 nt, hsa; identical to SEQ ID NO: 35280

SEQ ID NO: 708541 - RNA, 64 nt, hsa; identical to SEQ ID NO: 35281

SEQ ID NO: 708542 - RNA, 64 nt, hsa; identical to SEQ ID NO: 35282

SEQ ID NO: 708543 - RNA, 64 nt, hsa; identical to SEQ ID NO: 35283

SEQ ID NO: 708544 - RNA, 64 nt, hsa; identical to SEQ ID NO: 35284

SEQ ID NO: 708545 - RNA, 64 nt, hsa; identical to SEQ ID NO: 35285

SEQ ID NO: 708546 - RNA, 64 nt, hsa; identical to SEQ ID NO: 35286

SEQ ID NO: 708547 - RNA, 64 nt, hsa; identical to SEQ ID NO: 35287

SEQ ID NO: 708548 - RNA, 64 nt, hsa; identical to SEQ ID NO: 35288

SEQ ID NO: 708549 - RNA, 64 nt, hsa; identical to SEQ ID NO: 35289

SEQ ID NO: 708550 - RNA, 64 nt, hsa; identical to SEQ ID NO: 35290

SEQ ID NO: 708551 - RNA, 64 nt, hsa; identical to SEQ ID NO: 35291

SEQ ID NO: 708552 - RNA, 64 nt, hsa; identical to SEQ ID NO: 35292

SEQ ID NO: 708553 - RNA, 64 nt, hsa; identical to SEQ ID NO: 35293

SEQ ID NO: 708554 - RNA, 64 nt, hsa; identical to SEQ ID NO: 35294

SEQ ID NO: 708555 - RNA, 64 nt, hsa; identical to SEQ ID NO: 35295

SEQ ID NO: 708556 - RNA, 64 nt, hsa; identical to SEQ ID NO: 35296

SEQ ID NO: 708557 - RNA, 64 nt, hsa; identical to SEQ ID NO: 35297

SEQ ID NO: 708558 - RNA, 64 nt, hsa; identical to SEQ ID NO: 35298

SEQ ID NO: 708559 - RNA, 64 nt, hsa; identical to SEQ ID NO: 35299

SEQ ID NO: 708560 - RNA, 64 nt, hsa; identical to SEQ ID NO: 35300

SEQ ID NO: 708561 - RNA, 64 nt, hsa; identical to SEQ ID NO: 35301

SEQ ID NO: 708562 - RNA, 64 nt, hsa; identical to SEQ ID NO: 35302

SEQ ID NO: 708563 - RNA, 64 nt, hsa; identical to SEQ ID NO: 35303

SEQ ID NO: 708564 - RNA, 64 nt, hsa; identical to SEQ ID NO: 35304

SEQ ID NO: 708565 - RNA, 64 nt, hsa; identical to SEQ ID NO: 35305

SEQ ID NO: 708566 - RNA, 64 nt, hsa; identical to SEQ ID NO: 35306

SEQ ID NO: 708567 - RNA, 64 nt, hsa; identical to SEQ ID NO: 35307

SEQ ID NO: 708568 - RNA, 64 nt, hsa; identical to SEQ ID NO: 35308

SEQ ID NO: 708569 - RNA, 64 nt, hsa; identical to SEQ ID NO: 35309

SEQ ID NO: 708570 - RNA, 64 nt, hsa; identical to SEQ ID NO: 35310

SEQ ID NO: 708571 - RNA, 64 nt, hsa; identical to SEQ ID NO: 35311

SEQ ID NO: 708572 - RNA, 64 nt, hsa; identical to SEQ ID NO: 35312

SEQ ID NO: 708573 - RNA, 64 nt, hsa; identical to SEQ ID NO: 35313

SEQ ID NO: 708574 - RNA, 64 nt, hsa; identical to SEQ ID NO: 35314

SEQ ID NO: 708575 - RNA, 64 nt, hsa; identical to SEQ ID NO: 35315

SEQ ID NO: 708576 - RNA, 64 nt, hsa; identical to SEQ ID NO: 35316

SEQ ID NO: 708577 - RNA, 64 nt, hsa; identical to SEQ ID NO: 35317

SEQ ID NO: 708578 - RNA, 64 nt, hsa; identical to SEQ ID NO: 35318

SEQ ID NO: 708579 - RNA, 64 nt, hsa; identical to SEQ ID NO: 35319

SEQ ID NO: 708580 - RNA, 64 nt, hsa; identical to SEQ ID NO: 35320

SEQ ID NO: 708581 - RNA, 64 nt, hsa; identical to SEQ ID NO: 35321

SEQ ID NO: 708582 - RNA, 64 nt, hsa; identical to SEQ ID NO: 35322

SEQ ID NO: 708583 - RNA, 64 nt, hsa; identical to SEQ ID NO: 35323

SEQ ID NO: 708584 - RNA, 64 nt, hsa; identical to SEQ ID NO: 35324

SEQ ID NO: 708585 - RNA, 64 nt, hsa; identical to SEQ ID NO: 35325

SEQ ID NO: 708586 - RNA, 64 nt, hsa; identical to SEQ ID NO: 35326

SEQ ID NO: 708587 - RNA, 64 nt, hsa; identical to SEQ ID NO: 35327

SEQ ID NO: 708588 - RNA, 64 nt, hsa; identical to SEQ ID NO: 35328

SEQ ID NO: 708589 - RNA, 64 nt, hsa; identical to SEQ ID NO: 35329

SEQ ID NO: 708590 - RNA, 64 nt, hsa; identical to SEQ ID NO: 35330

SEQ ID NO: 708591 - RNA, 64 nt, hsa; identical to SEQ ID NO: 35331

SEQ ID NO: 708592 - RNA, 64 nt, hsa; identical to SEQ ID NO: 35332

SEQ ID NO: 708593 - RNA, 64 nt, hsa; identical to SEQ ID NO: 35333

SEQ ID NO: 708594 - RNA, 64 nt, hsa; identical to SEQ ID NO: 35334

SEQ ID NO: 708595 - RNA, 64 nt, hsa; identical to SEQ ID NO: 35335

SEQ ID NO: 708596 - RNA, 64 nt, hsa; identical to SEQ ID NO: 35336

SEQ ID NO: 708597 - RNA, 64 nt, hsa; identical to SEQ ID NO: 35337

SEQ ID NO: 708598 - RNA, 64 nt, hsa; identical to SEQ ID NO: 35338

SEQ ID NO: 708599 - RNA, 64 nt, hsa; identical to SEQ ID NO: 35339

SEQ ID NO: 708600 - RNA, 64 nt, hsa; identical to SEQ ID NO: 35340

SEQ ID NO: 708601 - RNA, 64 nt, hsa; identical to SEQ ID NO: 35341

SEQ ID NO: 708602 - RNA, 64 nt, hsa; identical to SEQ ID NO: 35342

SEQ ID NO: 708603 - RNA, 64 nt, hsa; identical to SEQ ID NO: 35343

SEQ ID NO: 708604 - RNA, 64 nt, hsa; identical to SEQ ID NO: 35344

SEQ ID NO: 708605 - RNA, 64 nt, hsa; identical to SEQ ID NO: 35345

SEQ ID NO: 708606 - RNA, 64 nt, hsa; identical to SEQ ID NO: 35346

SEQ ID NO: 708607 - RNA, 64 nt, hsa; identical to SEQ ID NO: 35347

SEQ ID NO: 708608 - RNA, 64 nt, hsa; identical to SEQ ID NO: 35348

SEQ ID NO: 708609 - RNA, 64 nt, hsa; identical to SEQ ID NO: 35349

SEQ ID NO: 708610 - RNA, 64 nt, hsa; identical to SEQ ID NO: 35350

SEQ ID NO: 708611 - RNA, 64 nt, hsa; identical to SEQ ID NO: 35351

SEQ ID NO: 708612 - RNA, 64 nt, hsa; identical to SEQ ID NO: 35352

SEQ ID NO: 708613 - RNA, 64 nt, hsa; identical to SEQ ID NO: 35353

SEQ ID NO: 708614 - RNA, 64 nt, hsa; identical to SEQ ID NO: 35354

SEQ ID NO: 708615 - RNA, 64 nt, hsa; identical to SEQ ID NO: 35355

SEQ ID NO: 708616 - RNA, 64 nt, hsa; identical to SEQ ID NO: 35356

SEQ ID NO: 708617 - RNA, 64 nt, hsa; identical to SEQ ID NO: 35357

SEQ ID NO: 708618 - RNA, 64 nt, hsa; identical to SEQ ID NO: 35358

SEQ ID NO: 708619 - RNA, 64 nt, hsa; identical to SEQ ID NO: 35359

SEQ ID NO: 708620 - RNA, 64 nt, hsa; identical to SEQ ID NO: 35360

SEQ ID NO: 708621 - RNA, 64 nt, hsa; identical to SEQ ID NO: 35361

SEQ ID NO: 708622 - RNA, 64 nt, hsa; identical to SEQ ID NO: 35362

SEQ ID NO: 708623 - RNA, 64 nt, hsa; identical to SEQ ID NO: 35363

SEQ ID NO: 708624 - RNA, 64 nt, hsa; identical to SEQ ID NO: 35364

SEQ ID NO: 708625 - RNA, 64 nt, hsa; identical to SEQ ID NO: 35365

SEQ ID NO: 708626 - RNA, 64 nt, hsa; identical to SEQ ID NO: 35366

SEQ ID NO: 708627 - RNA, 64 nt, hsa; identical to SEQ ID NO: 35367

SEQ ID NO: 708628 - RNA, 64 nt, hsa; identical to SEQ ID NO: 35368

SEQ ID NO: 708629 - RNA, 64 nt, hsa; identical to SEQ ID NO: 35369

SEQ ID NO: 708630 - RNA, 64 nt, hsa; identical to SEQ ID NO: 35370

SEQ ID NO: 708631 - RNA, 64 nt, hsa; identical to SEQ ID NO: 35371

SEQ ID NO: 708632 - RNA, 64 nt, hsa; identical to SEQ ID NO: 35372

SEQ ID NO: 708633 - RNA, 64 nt, hsa; identical to SEQ ID NO: 35373

SEQ ID NO: 708634 - RNA, 64 nt, hsa; identical to SEQ ID NO: 35374

SEQ ID NO: 708635 - RNA, 64 nt, hsa; identical to SEQ ID NO: 35375

SEQ ID NO: 708636 - RNA, 64 nt, hsa; identical to SEQ ID NO: 35376

SEQ ID NO: 708637 - RNA, 64 nt, hsa; identical to SEQ ID NO: 35377

SEQ ID NO: 708638 - RNA, 64 nt, hsa; identical to SEQ ID NO: 35378

SEQ ID NO: 708639 - RNA, 64 nt, hsa; identical to SEQ ID NO: 35379

SEQ ID NO: 708640 - RNA, 64 nt, hsa; identical to SEQ ID NO: 35380

SEQ ID NO: 708641 - RNA, 64 nt, hsa; identical to SEQ ID NO: 35381

SEQ ID NO: 708642 - RNA, 64 nt, hsa; identical to SEQ ID NO: 35382

SEQ ID NO: 708643 - RNA, 64 nt, hsa; identical to SEQ ID NO: 35383

SEQ ID NO: 708644 - RNA, 64 nt, hsa; identical to SEQ ID NO: 35384

SEQ ID NO: 708645 - RNA, 64 nt, hsa; identical to SEQ ID NO: 35385

SEQ ID NO: 708646 - RNA, 64 nt, hsa; identical to SEQ ID NO: 35386

SEQ ID NO: 708647 - RNA, 64 nt, hsa; identical to SEQ ID NO: 35387

SEQ ID NO: 708648 - RNA, 64 nt, hsa; identical to SEQ ID NO: 35388

SEQ ID NO: 708649 - RNA, 64 nt, hsa; identical to SEQ ID NO: 35389

SEQ ID NO: 708650 - RNA, 64 nt, hsa; identical to SEQ ID NO: 35390

SEQ ID NO: 708651 - RNA, 64 nt, hsa; identical to SEQ ID NO: 35391

SEQ ID NO: 708652 - RNA, 64 nt, hsa; identical to SEQ ID NO: 35392

SEQ ID NO: 708653 - RNA, 64 nt, hsa; identical to SEQ ID NO: 35393

SEQ ID NO: 708654 - RNA, 64 nt, hsa; identical to SEQ ID NO: 35394

SEQ ID NO: 708655 - RNA, 64 nt, hsa; identical to SEQ ID NO: 35395

SEQ ID NO: 708656 - RNA, 64 nt, hsa; identical to SEQ ID NO: 35396

SEQ ID NO: 708657 - RNA, 64 nt, hsa; identical to SEQ ID NO: 35397

SEQ ID NO: 708658 - RNA, 64 nt, hsa; identical to SEQ ID NO: 35398

SEQ ID NO: 708659 - RNA, 64 nt, hsa; identical to SEQ ID NO: 35399

SEQ ID NO: 708660 - RNA, 64 nt, hsa; identical to SEQ ID NO: 35400

SEQ ID NO: 708661 - RNA, 64 nt, hsa; identical to SEQ ID NO: 35401

SEQ ID NO: 708662 - RNA, 64 nt, hsa; identical to SEQ ID NO: 35402

SEQ ID NO: 708663 - RNA, 64 nt, hsa; identical to SEQ ID NO: 35403

SEQ ID NO: 708664 - RNA, 64 nt, hsa; identical to SEQ ID NO: 35404

SEQ ID NO: 708665 - RNA, 64 nt, hsa; identical to SEQ ID NO: 35405

SEQ ID NO: 708666 - RNA, 64 nt, hsa; identical to SEQ ID NO: 35406

SEQ ID NO: 708667 - RNA, 64 nt, hsa; identical to SEQ ID NO: 35407

SEQ ID NO: 708668 - RNA, 64 nt, hsa; identical to SEQ ID NO: 35408

SEQ ID NO: 708669 - RNA, 64 nt, hsa; identical to SEQ ID NO: 35409

SEQ ID NO: 708670 - RNA, 64 nt, hsa; identical to SEQ ID NO: 35410

SEQ ID NO: 708671 - RNA, 64 nt, hsa; identical to SEQ ID NO: 35411

SEQ ID NO: 708672 - RNA, 64 nt, hsa; identical to SEQ ID NO: 35412

SEQ ID NO: 708673 - RNA, 64 nt, hsa; identical to SEQ ID NO: 35413

SEQ ID NO: 708674 - RNA, 64 nt, hsa; identical to SEQ ID NO: 35414

SEQ ID NO: 708675 - RNA, 64 nt, hsa; identical to SEQ ID NO: 35415

SEQ ID NO: 708676 - RNA, 64 nt, hsa; identical to SEQ ID NO: 35416

SEQ ID NO: 708677 - RNA, 64 nt, hsa; identical to SEQ ID NO: 35417

SEQ ID NO: 708678 - RNA, 64 nt, hsa; identical to SEQ ID NO: 35418

SEQ ID NO: 708679 - RNA, 64 nt, hsa; identical to SEQ ID NO: 35419

SEQ ID NO: 708680 - RNA, 64 nt, hsa; identical to SEQ ID NO: 35420

SEQ ID NO: 708681 - RNA, 64 nt, hsa; identical to SEQ ID NO: 35421

SEQ ID NO: 708682 - RNA, 64 nt, hsa; identical to SEQ ID NO: 35422

SEQ ID NO: 708683 - RNA, 64 nt, hsa; identical to SEQ ID NO: 35423

SEQ ID NO: 708684 - RNA, 64 nt, hsa; identical to SEQ ID NO: 35424

SEQ ID NO: 708685 - RNA, 64 nt, hsa; identical to SEQ ID NO: 35425

SEQ ID NO: 708686 - RNA, 64 nt, hsa; identical to SEQ ID NO: 35426

SEQ ID NO: 708687 - RNA, 64 nt, hsa; identical to SEQ ID NO: 35427

SEQ ID NO: 708688 - RNA, 64 nt, hsa; identical to SEQ ID NO: 35428

SEQ ID NO: 708689 - RNA, 64 nt, hsa; identical to SEQ ID NO: 35429

SEQ ID NO: 708690 - RNA, 64 nt, hsa; identical to SEQ ID NO: 35430

SEQ ID NO: 708691 - RNA, 64 nt, hsa; identical to SEQ ID NO: 35431

SEQ ID NO: 708692 - RNA, 64 nt, hsa; identical to SEQ ID NO: 35432

SEQ ID NO: 708693 - RNA, 64 nt, hsa; identical to SEQ ID NO: 35433

SEQ ID NO: 708694 - RNA, 64 nt, hsa; identical to SEQ ID NO: 35434

SEQ ID NO: 708695 - RNA, 64 nt, hsa; identical to SEQ ID NO: 35435

SEQ ID NO: 708696 - RNA, 64 nt, hsa; identical to SEQ ID NO: 35436

SEQ ID NO: 708697 - RNA, 64 nt, hsa; identical to SEQ ID NO: 35437

SEQ ID NO: 708698 - RNA, 64 nt, hsa; identical to SEQ ID NO: 35438

SEQ ID NO: 708699 - RNA, 64 nt, hsa; identical to SEQ ID NO: 35439

SEQ ID NO: 708700 - RNA, 64 nt, hsa; identical to SEQ ID NO: 35440

SEQ ID NO: 708701 - RNA, 64 nt, hsa; identical to SEQ ID NO: 35441

SEQ ID NO: 708702 - RNA, 64 nt, hsa; identical to SEQ ID NO: 35442

SEQ ID NO: 708703 - RNA, 64 nt, hsa; identical to SEQ ID NO: 35443

SEQ ID NO: 708704 - RNA, 64 nt, hsa; identical to SEQ ID NO: 35444

SEQ ID NO: 708705 - RNA, 64 nt, hsa; identical to SEQ ID NO: 35445

SEQ ID NO: 708706 - RNA, 64 nt, hsa; identical to SEQ ID NO: 35446

SEQ ID NO: 708707 - RNA, 64 nt, hsa; identical to SEQ ID NO: 35447

SEQ ID NO: 708708 - RNA, 64 nt, hsa; identical to SEQ ID NO: 35448

SEQ ID NO: 708709 - RNA, 64 nt, hsa; identical to SEQ ID NO: 35449

SEQ ID NO: 708710 - RNA, 64 nt, hsa; identical to SEQ ID NO: 35450

SEQ ID NO: 708711 - RNA, 64 nt, hsa; identical to SEQ ID NO: 35451

SEQ ID NO: 708712 - RNA, 64 nt, hsa; identical to SEQ ID NO: 35452

SEQ ID NO: 708713 - RNA, 64 nt, hsa; identical to SEQ ID NO: 35453

SEQ ID NO: 708714 - RNA, 64 nt, hsa; identical to SEQ ID NO: 35454

SEQ ID NO: 708715 - RNA, 64 nt, hsa; identical to SEQ ID NO: 35455

SEQ ID NO: 708716 - RNA, 64 nt, hsa; identical to SEQ ID NO: 35456

SEQ ID NO: 708717 - RNA, 64 nt, hsa; identical to SEQ ID NO: 35457

SEQ ID NO: 708718 - RNA, 64 nt, hsa; identical to SEQ ID NO: 35458

SEQ ID NO: 708719 - RNA, 64 nt, hsa; identical to SEQ ID NO: 35459

SEQ ID NO: 708720 - RNA, 64 nt, hsa; identical to SEQ ID NO: 35460

SEQ ID NO: 708721 - RNA, 64 nt, hsa; identical to SEQ ID NO: 35461

SEQ ID NO: 708722 - RNA, 64 nt, hsa; identical to SEQ ID NO: 35462

SEQ ID NO: 708723 - RNA, 64 nt, hsa; identical to SEQ ID NO: 35463

SEQ ID NO: 708724 - RNA, 64 nt, hsa; identical to SEQ ID NO: 35464

SEQ ID NO: 708725 - RNA, 64 nt, hsa; identical to SEQ ID NO: 35465

SEQ ID NO: 708726 - RNA, 64 nt, hsa; identical to SEQ ID NO: 35466

SEQ ID NO: 708727 - RNA, 64 nt, hsa; identical to SEQ ID NO: 35467

SEQ ID NO: 708728 - RNA, 64 nt, hsa; identical to SEQ ID NO: 35468

SEQ ID NO: 708729 - RNA, 64 nt, hsa; identical to SEQ ID NO: 35469

SEQ ID NO: 708730 - RNA, 64 nt, hsa; identical to SEQ ID NO: 35470

SEQ ID NO: 708731 - RNA, 64 nt, hsa; identical to SEQ ID NO: 35471

SEQ ID NO: 708732 - RNA, 64 nt, hsa; identical to SEQ ID NO: 35472

SEQ ID NO: 708733 - RNA, 64 nt, hsa; identical to SEQ ID NO: 35473

SEQ ID NO: 708734 - RNA, 64 nt, hsa; identical to SEQ ID NO: 35474

SEQ ID NO: 708735 - RNA, 64 nt, hsa; identical to SEQ ID NO: 35475

SEQ ID NO: 708736 - RNA, 64 nt, hsa; identical to SEQ ID NO: 35476

SEQ ID NO: 708737 - RNA, 64 nt, hsa; identical to SEQ ID NO: 35477

SEQ ID NO: 708738 - RNA, 64 nt, hsa; identical to SEQ ID NO: 35478

SEQ ID NO: 708739 - RNA, 64 nt, hsa; identical to SEQ ID NO: 35479

SEQ ID NO: 708740 - RNA, 61 nt, hsa; identical to SEQ ID NO: 35480

SEQ ID NO: 708741 - RNA, 60 nt, hsa; identical to SEQ ID NO: 35481

SEQ ID NO: 708742 - RNA, 59 nt, hsa; identical to SEQ ID NO: 35482

SEQ ID NO: 708743 - RNA, 58 nt, hsa; identical to SEQ ID NO: 35483

SEQ ID NO: 708744 - RNA, 57 nt, hsa; identical to SEQ ID NO: 35484

SEQ ID NO: 708745 - RNA, 64 nt, hsa; identical to SEQ ID NO: 35485

SEQ ID NO: 708746 - RNA, 64 nt, hsa; identical to SEQ ID NO: 35486

SEQ ID NO: 708747 - RNA, 64 nt, hsa; identical to SEQ ID NO: 35487

SEQ ID NO: 708748 - RNA, 64 nt, hsa; identical to SEQ ID NO: 35488

SEQ ID NO: 708749 - RNA, 64 nt, hsa; identical to SEQ ID NO: 35489

SEQ ID NO: 708750 - RNA, 64 nt, hsa; identical to SEQ ID NO: 35490

SEQ ID NO: 708751 - RNA, 64 nt, hsa; identical to SEQ ID NO: 35491

SEQ ID NO: 708752 - RNA, 64 nt, hsa; identical to SEQ ID NO: 35492

SEQ ID NO: 708753 - RNA, 64 nt, hsa; identical to SEQ ID NO: 35493

SEQ ID NO: 708754 - RNA, 64 nt, hsa; identical to SEQ ID NO: 35494

SEQ ID NO: 708755 - RNA, 64 nt, hsa; identical to SEQ ID NO: 35495

SEQ ID NO: 708756 - RNA, 64 nt, hsa; identical to SEQ ID NO: 35496

SEQ ID NO: 708757 - RNA, 64 nt, hsa; identical to SEQ ID NO: 35497

SEQ ID NO: 708758 - RNA, 64 nt, hsa; identical to SEQ ID NO: 35498

SEQ ID NO: 708759 - RNA, 64 nt, hsa; identical to SEQ ID NO: 35499

SEQ ID NO: 708760 - RNA, 64 nt, hsa; identical to SEQ ID NO: 35500

SEQ ID NO: 708761 - RNA, 64 nt, hsa; identical to SEQ ID NO: 35501

SEQ ID NO: 708762 - RNA, 64 nt, hsa; identical to SEQ ID NO: 35502

SEQ ID NO: 708763 - RNA, 64 nt, hsa; identical to SEQ ID NO: 35503

SEQ ID NO: 708764 - RNA, 64 nt, hsa; identical to SEQ ID NO: 35504

SEQ ID NO: 708765 - RNA, 64 nt, hsa; identical to SEQ ID NO: 35505

SEQ ID NO: 708766 - RNA, 64 nt, hsa; identical to SEQ ID NO: 35506

SEQ ID NO: 708767 - RNA, 64 nt, hsa; identical to SEQ ID NO: 35507

SEQ ID NO: 708768 - RNA, 64 nt, hsa; identical to SEQ ID NO: 35508

SEQ ID NO: 708769 - RNA, 64 nt, hsa; identical to SEQ ID NO: 35509

SEQ ID NO: 708770 - RNA, 64 nt, hsa; identical to SEQ ID NO: 35510

SEQ ID NO: 708771 - RNA, 64 nt, hsa; identical to SEQ ID NO: 35511

SEQ ID NO: 708772 - RNA, 64 nt, hsa; identical to SEQ ID NO: 35512

SEQ ID NO: 708773 - RNA, 64 nt, hsa; identical to SEQ ID NO: 35513

SEQ ID NO: 708774 - RNA, 64 nt, hsa; identical to SEQ ID NO: 35514

SEQ ID NO: 708775 - RNA, 64 nt, hsa; identical to SEQ ID NO: 35515

SEQ ID NO: 708776 - RNA, 64 nt, hsa; identical to SEQ ID NO: 35516

SEQ ID NO: 708777 - RNA, 64 nt, hsa; identical to SEQ ID NO: 35517

SEQ ID NO: 708778 - RNA, 64 nt, hsa; identical to SEQ ID NO: 35518

SEQ ID NO: 708779 - RNA, 64 nt, hsa; identical to SEQ ID NO: 35519

SEQ ID NO: 708780 - RNA, 64 nt, hsa; identical to SEQ ID NO: 35520

SEQ ID NO: 708781 - RNA, 64 nt, hsa; identical to SEQ ID NO: 35521

SEQ ID NO: 708782 - RNA, 64 nt, hsa; identical to SEQ ID NO: 35522

SEQ ID NO: 708783 - RNA, 64 nt, hsa; identical to SEQ ID NO: 35523

SEQ ID NO: 708784 - RNA, 64 nt, hsa; identical to SEQ ID NO: 35524

SEQ ID NO: 708785 - RNA, 64 nt, hsa; identical to SEQ ID NO: 35525

SEQ ID NO: 708786 - RNA, 64 nt, hsa; identical to SEQ ID NO: 35526

SEQ ID NO: 708787 - RNA, 64 nt, hsa; identical to SEQ ID NO: 35527

SEQ ID NO: 708788 - RNA, 64 nt, hsa; identical to SEQ ID NO: 35528

SEQ ID NO: 708789 - RNA, 64 nt, hsa; identical to SEQ ID NO: 35529

SEQ ID NO: 708790 - RNA, 64 nt, hsa; identical to SEQ ID NO: 35530

SEQ ID NO: 708791 - RNA, 64 nt, hsa; identical to SEQ ID NO: 35531

SEQ ID NO: 708792 - RNA, 64 nt, hsa; identical to SEQ ID NO: 35532

SEQ ID NO: 708793 - RNA, 64 nt, hsa; identical to SEQ ID NO: 35533

SEQ ID NO: 708794 - RNA, 64 nt, hsa; identical to SEQ ID NO: 35534

SEQ ID NO: 708795 - RNA, 64 nt, hsa; identical to SEQ ID NO: 35535

SEQ ID NO: 708796 - RNA, 64 nt, hsa; identical to SEQ ID NO: 35536

SEQ ID NO: 708797 - RNA, 64 nt, hsa; identical to SEQ ID NO: 35537

SEQ ID NO: 708798 - RNA, 64 nt, hsa; identical to SEQ ID NO: 35538

SEQ ID NO: 708799 - RNA, 64 nt, hsa; identical to SEQ ID NO: 35539

SEQ ID NO: 708800 - RNA, 64 nt, hsa; identical to SEQ ID NO: 35540

SEQ ID NO: 708801 - RNA, 64 nt, hsa; identical to SEQ ID NO: 35541

SEQ ID NO: 708802 - RNA, 64 nt, hsa; identical to SEQ ID NO: 35542

SEQ ID NO: 708803 - RNA, 64 nt, hsa; identical to SEQ ID NO: 35543

SEQ ID NO: 708804 - RNA, 64 nt, hsa; identical to SEQ ID NO: 35544

SEQ ID NO: 708805 - RNA, 64 nt, hsa; identical to SEQ ID NO: 35545

SEQ ID NO: 708806 - RNA, 64 nt, hsa; identical to SEQ ID NO: 35546

SEQ ID NO: 708807 - RNA, 64 nt, hsa; identical to SEQ ID NO: 35547

SEQ ID NO: 708808 - RNA, 64 nt, hsa; identical to SEQ ID NO: 35548

SEQ ID NO: 708809 - RNA, 64 nt, hsa; identical to SEQ ID NO: 35549

SEQ ID NO: 708810 - RNA, 64 nt, hsa; identical to SEQ ID NO: 35550

SEQ ID NO: 708811 - RNA, 64 nt, hsa; identical to SEQ ID NO: 35551

SEQ ID NO: 708812 - RNA, 64 nt, hsa; identical to SEQ ID NO: 35552

SEQ ID NO: 708813 - RNA, 64 nt, hsa; identical to SEQ ID NO: 35553

SEQ ID NO: 708814 - RNA, 64 nt, hsa; identical to SEQ ID NO: 35554

SEQ ID NO: 708815 - RNA, 64 nt, hsa; identical to SEQ ID NO: 35555

SEQ ID NO: 708816 - RNA, 64 nt, hsa; identical to SEQ ID NO: 35556

SEQ ID NO: 708817 - RNA, 64 nt, hsa; identical to SEQ ID NO: 35557

SEQ ID NO: 708818 - RNA, 64 nt, hsa; identical to SEQ ID NO: 35558

SEQ ID NO: 708819 - RNA, 64 nt, hsa; identical to SEQ ID NO: 35559

SEQ ID NO: 708820 - RNA, 64 nt, hsa; identical to SEQ ID NO: 35560

SEQ ID NO: 708821 - RNA, 64 nt, hsa; identical to SEQ ID NO: 35561

SEQ ID NO: 708822 - RNA, 64 nt, hsa; identical to SEQ ID NO: 35562

SEQ ID NO: 708823 - RNA, 64 nt, hsa; identical to SEQ ID NO: 35563

SEQ ID NO: 708824 - RNA, 64 nt, hsa; identical to SEQ ID NO: 35564

SEQ ID NO: 708825 - RNA, 64 nt, hsa; identical to SEQ ID NO: 35565

SEQ ID NO: 708826 - RNA, 64 nt, hsa; identical to SEQ ID NO: 35566

SEQ ID NO: 708827 - RNA, 64 nt, hsa; identical to SEQ ID NO: 35567

SEQ ID NO: 708828 - RNA, 64 nt, hsa; identical to SEQ ID NO: 35568

SEQ ID NO: 708829 - RNA, 64 nt, hsa; identical to SEQ ID NO: 35569

SEQ ID NO: 708830 - RNA, 64 nt, hsa; identical to SEQ ID NO: 35570

SEQ ID NO: 708831 - RNA, 64 nt, hsa; identical to SEQ ID NO: 35571

SEQ ID NO: 708832 - RNA, 64 nt, hsa; identical to SEQ ID NO: 35572

SEQ ID NO: 708833 - RNA, 64 nt, hsa; identical to SEQ ID NO: 35573

SEQ ID NO: 708834 - RNA, 64 nt, hsa; identical to SEQ ID NO: 35574

SEQ ID NO: 708835 - RNA, 64 nt, hsa; identical to SEQ ID NO: 35575

SEQ ID NO: 708836 - RNA, 64 nt, hsa; identical to SEQ ID NO: 35576

SEQ ID NO: 708837 - RNA, 64 nt, hsa; identical to SEQ ID NO: 35577

SEQ ID NO: 708838 - RNA, 64 nt, hsa; identical to SEQ ID NO: 35578

SEQ ID NO: 708839 - RNA, 64 nt, hsa; identical to SEQ ID NO: 35579

SEQ ID NO: 708840 - RNA, 64 nt, hsa; identical to SEQ ID NO: 35580

SEQ ID NO: 708841 - RNA, 64 nt, hsa; identical to SEQ ID NO: 35581

SEQ ID NO: 708842 - RNA, 64 nt, hsa; identical to SEQ ID NO: 35582

SEQ ID NO: 708843 - RNA, 64 nt, hsa; identical to SEQ ID NO: 35583

SEQ ID NO: 708844 - RNA, 64 nt, hsa; identical to SEQ ID NO: 35584

SEQ ID NO: 708845 - RNA, 64 nt, hsa; identical to SEQ ID NO: 35585

SEQ ID NO: 708846 - RNA, 64 nt, hsa; identical to SEQ ID NO: 35586

SEQ ID NO: 708847 - RNA, 64 nt, hsa; identical to SEQ ID NO: 35587

SEQ ID NO: 708848 - RNA, 64 nt, hsa; identical to SEQ ID NO: 35588

SEQ ID NO: 708849 - RNA, 64 nt, hsa; identical to SEQ ID NO: 35589

SEQ ID NO: 708850 - RNA, 64 nt, hsa; identical to SEQ ID NO: 35590

SEQ ID NO: 708851 - RNA, 64 nt, hsa; identical to SEQ ID NO: 35591

SEQ ID NO: 708852 - RNA, 64 nt, hsa; identical to SEQ ID NO: 35592

SEQ ID NO: 708853 - RNA, 64 nt, hsa; identical to SEQ ID NO: 35593

SEQ ID NO: 708854 - RNA, 64 nt, hsa; identical to SEQ ID NO: 35594

SEQ ID NO: 708855 - RNA, 64 nt, hsa; identical to SEQ ID NO: 35595

SEQ ID NO: 708856 - RNA, 64 nt, hsa; identical to SEQ ID NO: 35596

SEQ ID NO: 708857 - RNA, 64 nt, hsa; identical to SEQ ID NO: 35597

SEQ ID NO: 708858 - RNA, 64 nt, hsa; identical to SEQ ID NO: 35598

SEQ ID NO: 708859 - RNA, 64 nt, hsa; identical to SEQ ID NO: 35599

SEQ ID NO: 708860 - RNA, 64 nt, hsa; identical to SEQ ID NO: 35600

SEQ ID NO: 708861 - RNA, 64 nt, hsa; identical to SEQ ID NO: 35601

SEQ ID NO: 708862 - RNA, 64 nt, hsa; identical to SEQ ID NO: 35602

SEQ ID NO: 708863 - RNA, 64 nt, hsa; identical to SEQ ID NO: 35603

SEQ ID NO: 708864 - RNA, 64 nt, hsa; identical to SEQ ID NO: 35604

SEQ ID NO: 708865 - RNA, 64 nt, hsa; identical to SEQ ID NO: 35605

SEQ ID NO: 708866 - RNA, 64 nt, hsa; identical to SEQ ID NO: 35606

SEQ ID NO: 708867 - RNA, 64 nt, hsa; identical to SEQ ID NO: 35607

SEQ ID NO: 708868 - RNA, 64 nt, hsa; identical to SEQ ID NO: 35608

SEQ ID NO: 708869 - RNA, 64 nt, hsa; identical to SEQ ID NO: 35609

SEQ ID NO: 708870 - RNA, 64 nt, hsa; identical to SEQ ID NO: 35610

SEQ ID NO: 708871 - RNA, 64 nt, hsa; identical to SEQ ID NO: 35611

SEQ ID NO: 708872 - RNA, 64 nt, hsa; identical to SEQ ID NO: 35612

SEQ ID NO: 708873 - RNA, 64 nt, hsa; identical to SEQ ID NO: 35613

SEQ ID NO: 708874 - RNA, 64 nt, hsa; identical to SEQ ID NO: 35614

SEQ ID NO: 708875 - RNA, 64 nt, hsa; identical to SEQ ID NO: 35615

SEQ ID NO: 708876 - RNA, 64 nt, hsa; identical to SEQ ID NO: 35616

SEQ ID NO: 708877 - RNA, 64 nt, hsa; identical to SEQ ID NO: 35617

SEQ ID NO: 708878 - RNA, 64 nt, hsa; identical to SEQ ID NO: 35618

SEQ ID NO: 708879 - RNA, 64 nt, hsa; identical to SEQ ID NO: 35619

SEQ ID NO: 708880 - RNA, 64 nt, hsa; identical to SEQ ID NO: 35620

SEQ ID NO: 708881 - RNA, 64 nt, hsa; identical to SEQ ID NO: 35621

SEQ ID NO: 708882 - RNA, 64 nt, hsa; identical to SEQ ID NO: 35622

SEQ ID NO: 708883 - RNA, 64 nt, hsa; identical to SEQ ID NO: 35623

SEQ ID NO: 708884 - RNA, 64 nt, hsa; identical to SEQ ID NO: 35624

SEQ ID NO: 708885 - RNA, 64 nt, hsa; identical to SEQ ID NO: 35625

SEQ ID NO: 708886 - RNA, 64 nt, hsa; identical to SEQ ID NO: 35626

SEQ ID NO: 708887 - RNA, 64 nt, hsa; identical to SEQ ID NO: 35627

SEQ ID NO: 708888 - RNA, 64 nt, hsa; identical to SEQ ID NO: 35628

SEQ ID NO: 708889 - RNA, 64 nt, hsa; identical to SEQ ID NO: 35629

SEQ ID NO: 708890 - RNA, 64 nt, hsa; identical to SEQ ID NO: 35630

SEQ ID NO: 708891 - RNA, 64 nt, hsa; identical to SEQ ID NO: 35631

SEQ ID NO: 708892 - RNA, 64 nt, hsa; identical to SEQ ID NO: 35632

SEQ ID NO: 708893 - RNA, 64 nt, hsa; identical to SEQ ID NO: 35633

SEQ ID NO: 708894 - RNA, 64 nt, hsa; identical to SEQ ID NO: 35634

SEQ ID NO: 708895 - RNA, 64 nt, hsa; identical to SEQ ID NO: 35635

SEQ ID NO: 708896 - RNA, 64 nt, hsa; identical to SEQ ID NO: 35636

SEQ ID NO: 708897 - RNA, 64 nt, hsa; identical to SEQ ID NO: 35637

SEQ ID NO: 708898 - RNA, 64 nt, hsa; identical to SEQ ID NO: 35638

SEQ ID NO: 708899 - RNA, 64 nt, hsa; identical to SEQ ID NO: 35639

SEQ ID NO: 708900 - RNA, 64 nt, hsa; identical to SEQ ID NO: 35640

SEQ ID NO: 708901 - RNA, 64 nt, hsa; identical to SEQ ID NO: 35641

SEQ ID NO: 708902 - RNA, 64 nt, hsa; identical to SEQ ID NO: 35642

SEQ ID NO: 708903 - RNA, 64 nt, hsa; identical to SEQ ID NO: 35643

SEQ ID NO: 708904 - RNA, 64 nt, hsa; identical to SEQ ID NO: 35644

SEQ ID NO: 708905 - RNA, 64 nt, hsa; identical to SEQ ID NO: 35645

SEQ ID NO: 708906 - RNA, 64 nt, hsa; identical to SEQ ID NO: 35646

SEQ ID NO: 708907 - RNA, 64 nt, hsa; identical to SEQ ID NO: 35647

SEQ ID NO: 708908 - RNA, 64 nt, hsa; identical to SEQ ID NO: 35648

SEQ ID NO: 708909 - RNA, 64 nt, hsa; identical to SEQ ID NO: 35649

SEQ ID NO: 708910 - RNA, 64 nt, hsa; identical to SEQ ID NO: 35650

SEQ ID NO: 708911 - RNA, 64 nt, hsa; identical to SEQ ID NO: 35651

SEQ ID NO: 708912 - RNA, 64 nt, hsa; identical to SEQ ID NO: 35652

SEQ ID NO: 708913 - RNA, 64 nt, hsa; identical to SEQ ID NO: 35653

SEQ ID NO: 708914 - RNA, 64 nt, hsa; identical to SEQ ID NO: 35654

SEQ ID NO: 708915 - RNA, 64 nt, hsa; identical to SEQ ID NO: 35655

SEQ ID NO: 708916 - RNA, 64 nt, hsa; identical to SEQ ID NO: 35656

SEQ ID NO: 708917 - RNA, 64 nt, hsa; identical to SEQ ID NO: 35657

SEQ ID NO: 708918 - RNA, 64 nt, hsa; identical to SEQ ID NO: 35658

SEQ ID NO: 708919 - RNA, 64 nt, hsa; identical to SEQ ID NO: 35659

SEQ ID NO: 708920 - RNA, 64 nt, hsa; identical to SEQ ID NO: 35660

SEQ ID NO: 708921 - RNA, 64 nt, hsa; identical to SEQ ID NO: 35661

SEQ ID NO: 708922 - RNA, 64 nt, hsa; identical to SEQ ID NO: 35662

SEQ ID NO: 708923 - RNA, 64 nt, hsa; identical to SEQ ID NO: 35663

SEQ ID NO: 708924 - RNA, 64 nt, hsa; identical to SEQ ID NO: 35664

SEQ ID NO: 708925 - RNA, 64 nt, hsa; identical to SEQ ID NO: 35665

SEQ ID NO: 708926 - RNA, 64 nt, hsa; identical to SEQ ID NO: 35666

SEQ ID NO: 708927 - RNA, 64 nt, hsa; identical to SEQ ID NO: 35667

SEQ ID NO: 708928 - RNA, 64 nt, hsa; identical to SEQ ID NO: 35668

SEQ ID NO: 708929 - RNA, 64 nt, hsa; identical to SEQ ID NO: 35669

SEQ ID NO: 708930 - RNA, 64 nt, hsa; identical to SEQ ID NO: 35670

SEQ ID NO: 708931 - RNA, 64 nt, hsa; identical to SEQ ID NO: 35671

SEQ ID NO: 708932 - RNA, 64 nt, hsa; identical to SEQ ID NO: 35672

SEQ ID NO: 708933 - RNA, 64 nt, hsa; identical to SEQ ID NO: 35673

SEQ ID NO: 708934 - RNA, 64 nt, hsa; identical to SEQ ID NO: 35674

SEQ ID NO: 708935 - RNA, 64 nt, hsa; identical to SEQ ID NO: 35675

SEQ ID NO: 708936 - RNA, 64 nt, hsa; identical to SEQ ID NO: 35676

SEQ ID NO: 708937 - RNA, 64 nt, hsa; identical to SEQ ID NO: 35677

SEQ ID NO: 708938 - RNA, 64 nt, hsa; identical to SEQ ID NO: 35678

SEQ ID NO: 708939 - RNA, 64 nt, hsa; identical to SEQ ID NO: 35679

SEQ ID NO: 708940 - RNA, 64 nt, hsa; identical to SEQ ID NO: 35680

SEQ ID NO: 708941 - RNA, 64 nt, hsa; identical to SEQ ID NO: 35681

SEQ ID NO: 708942 - RNA, 64 nt, hsa; identical to SEQ ID NO: 35682

SEQ ID NO: 708943 - RNA, 64 nt, hsa; identical to SEQ ID NO: 35683

SEQ ID NO: 708944 - RNA, 64 nt, hsa; identical to SEQ ID NO: 35684

SEQ ID NO: 708945 - RNA, 64 nt, hsa; identical to SEQ ID NO: 35685

SEQ ID NO: 708946 - RNA, 64 nt, hsa; identical to SEQ ID NO: 35686

SEQ ID NO: 708947 - RNA, 64 nt, hsa; identical to SEQ ID NO: 35687

SEQ ID NO: 708948 - RNA, 64 nt, hsa; identical to SEQ ID NO: 35688

SEQ ID NO: 708949 - RNA, 64 nt, hsa; identical to SEQ ID NO: 35689

SEQ ID NO: 708950 - RNA, 64 nt, hsa; identical to SEQ ID NO: 35690

SEQ ID NO: 708951 - RNA, 64 nt, hsa; identical to SEQ ID NO: 35691

SEQ ID NO: 708952 - RNA, 64 nt, hsa; identical to SEQ ID NO: 35692

SEQ ID NO: 708953 - RNA, 64 nt, hsa; identical to SEQ ID NO: 35693

SEQ ID NO: 708954 - RNA, 64 nt, hsa; identical to SEQ ID NO: 35694

SEQ ID NO: 708955 - RNA, 64 nt, hsa; identical to SEQ ID NO: 35695

SEQ ID NO: 708956 - RNA, 64 nt, hsa; identical to SEQ ID NO: 35696

SEQ ID NO: 708957 - RNA, 64 nt, hsa; identical to SEQ ID NO: 35697

SEQ ID NO: 708958 - RNA, 64 nt, hsa; identical to SEQ ID NO: 35698

SEQ ID NO: 708959 - RNA, 64 nt, hsa; identical to SEQ ID NO: 35699

SEQ ID NO: 708960 - RNA, 64 nt, hsa; identical to SEQ ID NO: 35700

SEQ ID NO: 708961 - RNA, 64 nt, hsa; identical to SEQ ID NO: 35701

SEQ ID NO: 708962 - RNA, 64 nt, hsa; identical to SEQ ID NO: 35702

SEQ ID NO: 708963 - RNA, 64 nt, hsa; identical to SEQ ID NO: 35703

SEQ ID NO: 708964 - RNA, 64 nt, hsa; identical to SEQ ID NO: 35704

SEQ ID NO: 708965 - RNA, 64 nt, hsa; identical to SEQ ID NO: 35705

SEQ ID NO: 708966 - RNA, 64 nt, hsa; identical to SEQ ID NO: 35706

SEQ ID NO: 708967 - RNA, 64 nt, hsa; identical to SEQ ID NO: 35707

SEQ ID NO: 708968 - RNA, 64 nt, hsa; identical to SEQ ID NO: 35708

SEQ ID NO: 708969 - RNA, 64 nt, hsa; identical to SEQ ID NO: 35709

SEQ ID NO: 708970 - RNA, 64 nt, hsa; identical to SEQ ID NO: 35710

SEQ ID NO: 708971 - RNA, 64 nt, hsa; identical to SEQ ID NO: 35711

SEQ ID NO: 708972 - RNA, 64 nt, hsa; identical to SEQ ID NO: 35712

SEQ ID NO: 708973 - RNA, 64 nt, hsa; identical to SEQ ID NO: 35713

SEQ ID NO: 708974 - RNA, 64 nt, hsa; identical to SEQ ID NO: 35714

SEQ ID NO: 708975 - RNA, 64 nt, hsa; identical to SEQ ID NO: 35715

SEQ ID NO: 708976 - RNA, 64 nt, hsa; identical to SEQ ID NO: 35716

SEQ ID NO: 708977 - RNA, 64 nt, hsa; identical to SEQ ID NO: 35717

SEQ ID NO: 708978 - RNA, 64 nt, hsa; identical to SEQ ID NO: 35718

SEQ ID NO: 708979 - RNA, 64 nt, hsa; identical to SEQ ID NO: 35719

SEQ ID NO: 708980 - RNA, 64 nt, hsa; identical to SEQ ID NO: 35720

SEQ ID NO: 708981 - RNA, 64 nt, hsa; identical to SEQ ID NO: 35721

SEQ ID NO: 708982 - RNA, 64 nt, hsa; identical to SEQ ID NO: 35722

SEQ ID NO: 708983 - RNA, 64 nt, hsa; identical to SEQ ID NO: 35723

SEQ ID NO: 708984 - RNA, 64 nt, hsa; identical to SEQ ID NO: 35724

SEQ ID NO: 708985 - RNA, 64 nt, hsa; identical to SEQ ID NO: 35725

SEQ ID NO: 708986 - RNA, 64 nt, hsa; identical to SEQ ID NO: 35726

SEQ ID NO: 708987 - RNA, 64 nt, hsa; identical to SEQ ID NO: 35727

SEQ ID NO: 708988 - RNA, 64 nt, hsa; identical to SEQ ID NO: 35728

SEQ ID NO: 708989 - RNA, 64 nt, hsa; identical to SEQ ID NO: 35729

SEQ ID NO: 708990 - RNA, 64 nt, hsa; identical to SEQ ID NO: 35730

SEQ ID NO: 708991 - RNA, 64 nt, hsa; identical to SEQ ID NO: 35731

SEQ ID NO: 708992 - RNA, 64 nt, hsa; identical to SEQ ID NO: 35732

SEQ ID NO: 708993 - RNA, 64 nt, hsa; identical to SEQ ID NO: 35733

SEQ ID NO: 708994 - RNA, 64 nt, hsa; identical to SEQ ID NO: 35734

SEQ ID NO: 708995 - RNA, 64 nt, hsa; identical to SEQ ID NO: 35735

SEQ ID NO: 708996 - RNA, 64 nt, hsa; identical to SEQ ID NO: 35736

SEQ ID NO: 708997 - RNA, 64 nt, hsa; identical to SEQ ID NO: 35737

SEQ ID NO: 708998 - RNA, 64 nt, hsa; identical to SEQ ID NO: 35738

SEQ ID NO: 708999 - RNA, 64 nt, hsa; identical to SEQ ID NO: 35739

SEQ ID NO: 709000 - RNA, 64 nt, hsa; identical to SEQ ID NO: 35740

SEQ ID NO: 709001 - RNA, 64 nt, hsa; identical to SEQ ID NO: 35741

SEQ ID NO: 709002 - RNA, 64 nt, hsa; identical to SEQ ID NO: 35742

SEQ ID NO: 709003 - RNA, 64 nt, hsa; identical to SEQ ID NO: 35743

SEQ ID NO: 709004 - RNA, 64 nt, hsa; identical to SEQ ID NO: 35744

SEQ ID NO: 709005 - RNA, 64 nt, hsa; identical to SEQ ID NO: 35745

SEQ ID NO: 709006 - RNA, 64 nt, hsa; identical to SEQ ID NO: 35746

SEQ ID NO: 709007 - RNA, 64 nt, hsa; identical to SEQ ID NO: 35747

SEQ ID NO: 709008 - RNA, 64 nt, hsa; identical to SEQ ID NO: 35748

SEQ ID NO: 709009 - RNA, 64 nt, hsa; identical to SEQ ID NO: 35749

SEQ ID NO: 709010 - RNA, 64 nt, hsa; identical to SEQ ID NO: 35750

SEQ ID NO: 709011 - RNA, 64 nt, hsa; identical to SEQ ID NO: 35751

SEQ ID NO: 709012 - RNA, 64 nt, hsa; identical to SEQ ID NO: 35752

SEQ ID NO: 709013 - RNA, 64 nt, hsa; identical to SEQ ID NO: 35753

SEQ ID NO: 709014 - RNA, 64 nt, hsa; identical to SEQ ID NO: 35754

SEQ ID NO: 709015 - RNA, 64 nt, hsa; identical to SEQ ID NO: 35755

SEQ ID NO: 709016 - RNA, 64 nt, hsa; identical to SEQ ID NO: 35756

SEQ ID NO: 709017 - RNA, 64 nt, hsa; identical to SEQ ID NO: 35757

SEQ ID NO: 709018 - RNA, 64 nt, hsa; identical to SEQ ID NO: 35758

SEQ ID NO: 709019 - RNA, 64 nt, hsa; identical to SEQ ID NO: 35759

SEQ ID NO: 709020 - RNA, 64 nt, hsa; identical to SEQ ID NO: 35760

SEQ ID NO: 709021 - RNA, 64 nt, hsa; identical to SEQ ID NO: 35761

SEQ ID NO: 709022 - RNA, 64 nt, hsa; identical to SEQ ID NO: 35762

SEQ ID NO: 709023 - RNA, 64 nt, hsa; identical to SEQ ID NO: 35763

SEQ ID NO: 709024 - RNA, 64 nt, hsa; identical to SEQ ID NO: 35764

SEQ ID NO: 709025 - RNA, 64 nt, hsa; identical to SEQ ID NO: 35765

SEQ ID NO: 709026 - RNA, 64 nt, hsa; identical to SEQ ID NO: 35766

SEQ ID NO: 709027 - RNA, 64 nt, hsa; identical to SEQ ID NO: 35767

SEQ ID NO: 709028 - RNA, 64 nt, hsa; identical to SEQ ID NO: 35768

SEQ ID NO: 709029 - RNA, 64 nt, hsa; identical to SEQ ID NO: 35769

SEQ ID NO: 709030 - RNA, 64 nt, hsa; identical to SEQ ID NO: 35770

SEQ ID NO: 709031 - RNA, 64 nt, hsa; identical to SEQ ID NO: 35771

SEQ ID NO: 709032 - RNA, 64 nt, hsa; identical to SEQ ID NO: 35772

SEQ ID NO: 709033 - RNA, 64 nt, hsa; identical to SEQ ID NO: 35773

SEQ ID NO: 709034 - RNA, 64 nt, hsa; identical to SEQ ID NO: 35774

SEQ ID NO: 709035 - RNA, 64 nt, hsa; identical to SEQ ID NO: 35775

SEQ ID NO: 709036 - RNA, 64 nt, hsa; identical to SEQ ID NO: 35776

SEQ ID NO: 709037 - RNA, 64 nt, hsa; identical to SEQ ID NO: 35777

SEQ ID NO: 709038 - RNA, 64 nt, hsa; identical to SEQ ID NO: 35778

SEQ ID NO: 709039 - RNA, 64 nt, hsa; identical to SEQ ID NO: 35779

SEQ ID NO: 709040 - RNA, 64 nt, hsa; identical to SEQ ID NO: 35780

SEQ ID NO: 709041 - RNA, 64 nt, hsa; identical to SEQ ID NO: 35781

SEQ ID NO: 709042 - RNA, 64 nt, hsa; identical to SEQ ID NO: 35782

SEQ ID NO: 709043 - RNA, 64 nt, hsa; identical to SEQ ID NO: 35783

SEQ ID NO: 709044 - RNA, 64 nt, hsa; identical to SEQ ID NO: 35784

SEQ ID NO: 709045 - RNA, 64 nt, hsa; identical to SEQ ID NO: 35785

SEQ ID NO: 709046 - RNA, 64 nt, hsa; identical to SEQ ID NO: 35786

SEQ ID NO: 709047 - RNA, 64 nt, hsa; identical to SEQ ID NO: 35787

SEQ ID NO: 709048 - RNA, 64 nt, hsa; identical to SEQ ID NO: 35788

SEQ ID NO: 709049 - RNA, 64 nt, hsa; identical to SEQ ID NO: 35789

SEQ ID NO: 709050 - RNA, 64 nt, hsa; identical to SEQ ID NO: 35790

SEQ ID NO: 709051 - RNA, 64 nt, hsa; identical to SEQ ID NO: 35791

SEQ ID NO: 709052 - RNA, 64 nt, hsa; identical to SEQ ID NO: 35792

SEQ ID NO: 709053 - RNA, 64 nt, hsa; identical to SEQ ID NO: 35793

SEQ ID NO: 709054 - RNA, 64 nt, hsa; identical to SEQ ID NO: 35794

SEQ ID NO: 709055 - RNA, 64 nt, hsa; identical to SEQ ID NO: 35795

SEQ ID NO: 709056 - RNA, 64 nt, hsa; identical to SEQ ID NO: 35796

SEQ ID NO: 709057 - RNA, 64 nt, hsa; identical to SEQ ID NO: 35797

SEQ ID NO: 709058 - RNA, 64 nt, hsa; identical to SEQ ID NO: 35798

SEQ ID NO: 709059 - RNA, 64 nt, hsa; identical to SEQ ID NO: 35799

SEQ ID NO: 709060 - RNA, 64 nt, hsa; identical to SEQ ID NO: 35800

SEQ ID NO: 709061 - RNA, 64 nt, hsa; identical to SEQ ID NO: 35801

SEQ ID NO: 709062 - RNA, 64 nt, hsa; identical to SEQ ID NO: 35802

SEQ ID NO: 709063 - RNA, 64 nt, hsa; identical to SEQ ID NO: 35803

SEQ ID NO: 709064 - RNA, 64 nt, hsa; identical to SEQ ID NO: 35804

SEQ ID NO: 709065 - RNA, 64 nt, hsa; identical to SEQ ID NO: 35805

SEQ ID NO: 709066 - RNA, 64 nt, hsa; identical to SEQ ID NO: 35806

SEQ ID NO: 709067 - RNA, 64 nt, hsa; identical to SEQ ID NO: 35807

SEQ ID NO: 709068 - RNA, 64 nt, hsa; identical to SEQ ID NO: 35808

SEQ ID NO: 709069 - RNA, 64 nt, hsa; identical to SEQ ID NO: 35809

SEQ ID NO: 709070 - RNA, 64 nt, hsa; identical to SEQ ID NO: 35810

SEQ ID NO: 709071 - RNA, 64 nt, hsa; identical to SEQ ID NO: 35811

SEQ ID NO: 709072 - RNA, 64 nt, hsa; identical to SEQ ID NO: 35812

SEQ ID NO: 709073 - RNA, 64 nt, hsa; identical to SEQ ID NO: 35813

SEQ ID NO: 709074 - RNA, 64 nt, hsa; identical to SEQ ID NO: 35814

SEQ ID NO: 709075 - RNA, 64 nt, hsa; identical to SEQ ID NO: 35815

SEQ ID NO: 709076 - RNA, 64 nt, hsa; identical to SEQ ID NO: 35816

SEQ ID NO: 709077 - RNA, 64 nt, hsa; identical to SEQ ID NO: 35817

SEQ ID NO: 709078 - RNA, 64 nt, hsa; identical to SEQ ID NO: 35818

SEQ ID NO: 709079 - RNA, 64 nt, hsa; identical to SEQ ID NO: 35819

SEQ ID NO: 709080 - RNA, 64 nt, hsa; identical to SEQ ID NO: 35820

SEQ ID NO: 709081 - RNA, 64 nt, hsa; identical to SEQ ID NO: 35821

SEQ ID NO: 709082 - RNA, 64 nt, hsa; identical to SEQ ID NO: 35822

SEQ ID NO: 709083 - RNA, 64 nt, hsa; identical to SEQ ID NO: 35823

SEQ ID NO: 709084 - RNA, 64 nt, hsa; identical to SEQ ID NO: 35824

SEQ ID NO: 709085 - RNA, 64 nt, hsa; identical to SEQ ID NO: 35825

SEQ ID NO: 709086 - RNA, 64 nt, hsa; identical to SEQ ID NO: 35826

SEQ ID NO: 709087 - RNA, 64 nt, hsa; identical to SEQ ID NO: 35827

SEQ ID NO: 709088 - RNA, 64 nt, hsa; identical to SEQ ID NO: 35828

SEQ ID NO: 709089 - RNA, 64 nt, hsa; identical to SEQ ID NO: 35829

SEQ ID NO: 709090 - RNA, 64 nt, hsa; identical to SEQ ID NO: 35830

SEQ ID NO: 709091 - RNA, 64 nt, hsa; identical to SEQ ID NO: 35831

SEQ ID NO: 709092 - RNA, 64 nt, hsa; identical to SEQ ID NO: 35832

SEQ ID NO: 709093 - RNA, 64 nt, hsa; identical to SEQ ID NO: 35833

SEQ ID NO: 709094 - RNA, 64 nt, hsa; identical to SEQ ID NO: 35834

SEQ ID NO: 709095 - RNA, 64 nt, hsa; identical to SEQ ID NO: 35835

SEQ ID NO: 709096 - RNA, 64 nt, hsa; identical to SEQ ID NO: 35836

SEQ ID NO: 709097 - RNA, 64 nt, hsa; identical to SEQ ID NO: 35837

SEQ ID NO: 709098 - RNA, 64 nt, hsa; identical to SEQ ID NO: 35838

SEQ ID NO: 709099 - RNA, 64 nt, hsa; identical to SEQ ID NO: 35839

SEQ ID NO: 709100 - RNA, 64 nt, hsa; identical to SEQ ID NO: 35840

SEQ ID NO: 709101 - RNA, 64 nt, hsa; identical to SEQ ID NO: 35841

SEQ ID NO: 709102 - RNA, 64 nt, hsa; identical to SEQ ID NO: 35842

SEQ ID NO: 709103 - RNA, 64 nt, hsa; identical to SEQ ID NO: 35843

SEQ ID NO: 709104 - RNA, 64 nt, hsa; identical to SEQ ID NO: 35844

SEQ ID NO: 709105 - RNA, 64 nt, hsa; identical to SEQ ID NO: 35845

SEQ ID NO: 709106 - RNA, 64 nt, hsa; identical to SEQ ID NO: 35846

SEQ ID NO: 709107 - RNA, 64 nt, hsa; identical to SEQ ID NO: 35847

SEQ ID NO: 709108 - RNA, 64 nt, hsa; identical to SEQ ID NO: 35848

SEQ ID NO: 709109 - RNA, 64 nt, hsa; identical to SEQ ID NO: 35849

SEQ ID NO: 709110 - RNA, 64 nt, hsa; identical to SEQ ID NO: 35850

SEQ ID NO: 709111 - RNA, 64 nt, hsa; identical to SEQ ID NO: 35851

SEQ ID NO: 709112 - RNA, 64 nt, hsa; identical to SEQ ID NO: 35852

SEQ ID NO: 709113 - RNA, 64 nt, hsa; identical to SEQ ID NO: 35853

SEQ ID NO: 709114 - RNA, 64 nt, hsa; identical to SEQ ID NO: 35854

SEQ ID NO: 709115 - RNA, 64 nt, hsa; identical to SEQ ID NO: 35855

SEQ ID NO: 709116 - RNA, 64 nt, hsa; identical to SEQ ID NO: 35856

SEQ ID NO: 709117 - RNA, 64 nt, hsa; identical to SEQ ID NO: 35857

SEQ ID NO: 709118 - RNA, 64 nt, hsa; identical to SEQ ID NO: 35858

SEQ ID NO: 709119 - RNA, 64 nt, hsa; identical to SEQ ID NO: 35859

SEQ ID NO: 709120 - RNA, 64 nt, hsa; identical to SEQ ID NO: 35860

SEQ ID NO: 709121 - RNA, 64 nt, hsa; identical to SEQ ID NO: 35861

SEQ ID NO: 709122 - RNA, 64 nt, hsa; identical to SEQ ID NO: 35862

SEQ ID NO: 709123 - RNA, 64 nt, hsa; identical to SEQ ID NO: 35863

SEQ ID NO: 709124 - RNA, 64 nt, hsa; identical to SEQ ID NO: 35864

SEQ ID NO: 709125 - RNA, 64 nt, hsa; identical to SEQ ID NO: 35865

SEQ ID NO: 709126 - RNA, 64 nt, hsa; identical to SEQ ID NO: 35866

SEQ ID NO: 709127 - RNA, 64 nt, hsa; identical to SEQ ID NO: 35867

SEQ ID NO: 709128 - RNA, 64 nt, hsa; identical to SEQ ID NO: 35868

SEQ ID NO: 709129 - RNA, 64 nt, hsa; identical to SEQ ID NO: 35869

SEQ ID NO: 709130 - RNA, 64 nt, hsa; identical to SEQ ID NO: 35870

SEQ ID NO: 709131 - RNA, 64 nt, hsa; identical to SEQ ID NO: 35871

SEQ ID NO: 709132 - RNA, 64 nt, hsa; identical to SEQ ID NO: 35872

SEQ ID NO: 709133 - RNA, 64 nt, hsa; identical to SEQ ID NO: 35873

SEQ ID NO: 709134 - RNA, 64 nt, hsa; identical to SEQ ID NO: 35874

SEQ ID NO: 709135 - RNA, 64 nt, hsa; identical to SEQ ID NO: 35875

SEQ ID NO: 709136 - RNA, 64 nt, hsa; identical to SEQ ID NO: 35876

SEQ ID NO: 709137 - RNA, 64 nt, hsa; identical to SEQ ID NO: 35877

SEQ ID NO: 709138 - RNA, 64 nt, hsa; identical to SEQ ID NO: 35878

SEQ ID NO: 709139 - RNA, 64 nt, hsa; identical to SEQ ID NO: 35879

SEQ ID NO: 709140 - RNA, 64 nt, hsa; identical to SEQ ID NO: 35880

SEQ ID NO: 709141 - RNA, 64 nt, hsa; identical to SEQ ID NO: 35881

SEQ ID NO: 709142 - RNA, 64 nt, hsa; identical to SEQ ID NO: 35882

SEQ ID NO: 709143 - RNA, 64 nt, hsa; identical to SEQ ID NO: 35883

SEQ ID NO: 709144 - RNA, 64 nt, hsa; identical to SEQ ID NO: 35884

SEQ ID NO: 709145 - RNA, 64 nt, hsa; identical to SEQ ID NO: 35885

SEQ ID NO: 709146 - RNA, 64 nt, hsa; identical to SEQ ID NO: 35886

SEQ ID NO: 709147 - RNA, 64 nt, hsa; identical to SEQ ID NO: 35887

SEQ ID NO: 709148 - RNA, 64 nt, hsa; identical to SEQ ID NO: 35888

SEQ ID NO: 709149 - RNA, 64 nt, hsa; identical to SEQ ID NO: 35889

SEQ ID NO: 709150 - RNA, 64 nt, hsa; identical to SEQ ID NO: 35890

SEQ ID NO: 709151 - RNA, 64 nt, hsa; identical to SEQ ID NO: 35891

SEQ ID NO: 709152 - RNA, 64 nt, hsa; identical to SEQ ID NO: 35892

SEQ ID NO: 709153 - RNA, 64 nt, hsa; identical to SEQ ID NO: 35893

SEQ ID NO: 709154 - RNA, 64 nt, hsa; identical to SEQ ID NO: 35894

SEQ ID NO: 709155 - RNA, 64 nt, hsa; identical to SEQ ID NO: 35895

SEQ ID NO: 709156 - RNA, 64 nt, hsa; identical to SEQ ID NO: 35896

SEQ ID NO: 709157 - RNA, 64 nt, hsa; identical to SEQ ID NO: 35897

SEQ ID NO: 709158 - RNA, 64 nt, hsa; identical to SEQ ID NO: 35898

SEQ ID NO: 709159 - RNA, 64 nt, hsa; identical to SEQ ID NO: 35899

SEQ ID NO: 709160 - RNA, 64 nt, hsa; identical to SEQ ID NO: 35900

SEQ ID NO: 709161 - RNA, 64 nt, hsa; identical to SEQ ID NO: 35901

SEQ ID NO: 709162 - RNA, 64 nt, hsa; identical to SEQ ID NO: 35902

SEQ ID NO: 709163 - RNA, 64 nt, hsa; identical to SEQ ID NO: 35903

SEQ ID NO: 709164 - RNA, 64 nt, hsa; identical to SEQ ID NO: 35904

SEQ ID NO: 709165 - RNA, 64 nt, hsa; identical to SEQ ID NO: 35905

SEQ ID NO: 709166 - RNA, 64 nt, hsa; identical to SEQ ID NO: 35906

SEQ ID NO: 709167 - RNA, 64 nt, hsa; identical to SEQ ID NO: 35907

SEQ ID NO: 709168 - RNA, 64 nt, hsa; identical to SEQ ID NO: 35908

SEQ ID NO: 709169 - RNA, 64 nt, hsa; identical to SEQ ID NO: 35909

SEQ ID NO: 709170 - RNA, 64 nt, hsa; identical to SEQ ID NO: 35910

SEQ ID NO: 709171 - RNA, 64 nt, hsa; identical to SEQ ID NO: 35911

SEQ ID NO: 709172 - RNA, 64 nt, hsa; identical to SEQ ID NO: 35912

SEQ ID NO: 709173 - RNA, 64 nt, hsa; identical to SEQ ID NO: 35913

SEQ ID NO: 709174 - RNA, 64 nt, hsa; identical to SEQ ID NO: 35914

SEQ ID NO: 709175 - RNA, 64 nt, hsa; identical to SEQ ID NO: 35915

SEQ ID NO: 709176 - RNA, 64 nt, hsa; identical to SEQ ID NO: 35916

SEQ ID NO: 709177 - RNA, 64 nt, hsa; identical to SEQ ID NO: 35917

SEQ ID NO: 709178 - RNA, 64 nt, hsa; identical to SEQ ID NO: 35918

SEQ ID NO: 709179 - RNA, 64 nt, hsa; identical to SEQ ID NO: 35919

SEQ ID NO: 709180 - RNA, 64 nt, hsa; identical to SEQ ID NO: 35920

SEQ ID NO: 709181 - RNA, 64 nt, hsa; identical to SEQ ID NO: 35921

SEQ ID NO: 709182 - RNA, 64 nt, hsa; identical to SEQ ID NO: 35922

SEQ ID NO: 709183 - RNA, 64 nt, hsa; identical to SEQ ID NO: 35923

SEQ ID NO: 709184 - RNA, 64 nt, hsa; identical to SEQ ID NO: 35924

SEQ ID NO: 709185 - RNA, 64 nt, hsa; identical to SEQ ID NO: 35925

SEQ ID NO: 709186 - RNA, 64 nt, hsa; identical to SEQ ID NO: 35926

SEQ ID NO: 709187 - RNA, 64 nt, hsa; identical to SEQ ID NO: 35927

SEQ ID NO: 709188 - RNA, 64 nt, hsa; identical to SEQ ID NO: 35928

SEQ ID NO: 709189 - RNA, 64 nt, hsa; identical to SEQ ID NO: 35929

SEQ ID NO: 709190 - RNA, 64 nt, hsa; identical to SEQ ID NO: 35930

SEQ ID NO: 709191 - RNA, 64 nt, hsa; identical to SEQ ID NO: 35931

SEQ ID NO: 709192 - RNA, 64 nt, hsa; identical to SEQ ID NO: 35932

SEQ ID NO: 709193 - RNA, 64 nt, hsa; identical to SEQ ID NO: 35933

SEQ ID NO: 709194 - RNA, 64 nt, hsa; identical to SEQ ID NO: 35934

SEQ ID NO: 709195 - RNA, 64 nt, hsa; identical to SEQ ID NO: 35935

SEQ ID NO: 709196 - RNA, 64 nt, hsa; identical to SEQ ID NO: 35936

SEQ ID NO: 709197 - RNA, 64 nt, hsa; identical to SEQ ID NO: 35937

SEQ ID NO: 709198 - RNA, 64 nt, hsa; identical to SEQ ID NO: 35938

SEQ ID NO: 709199 - RNA, 64 nt, hsa; identical to SEQ ID NO: 35939

SEQ ID NO: 709200 - RNA, 64 nt, hsa; identical to SEQ ID NO: 35940

SEQ ID NO: 709201 - RNA, 64 nt, hsa; identical to SEQ ID NO: 35941

SEQ ID NO: 709202 - RNA, 64 nt, hsa; identical to SEQ ID NO: 35942

SEQ ID NO: 709203 - RNA, 64 nt, hsa; identical to SEQ ID NO: 35943

SEQ ID NO: 709204 - RNA, 64 nt, hsa; identical to SEQ ID NO: 35944

SEQ ID NO: 709205 - RNA, 64 nt, hsa; identical to SEQ ID NO: 35945

SEQ ID NO: 709206 - RNA, 64 nt, hsa; identical to SEQ ID NO: 35946

SEQ ID NO: 709207 - RNA, 64 nt, hsa; identical to SEQ ID NO: 35947

SEQ ID NO: 709208 - RNA, 64 nt, hsa; identical to SEQ ID NO: 35948

SEQ ID NO: 709209 - RNA, 64 nt, hsa; identical to SEQ ID NO: 35949

SEQ ID NO: 709210 - RNA, 64 nt, hsa; identical to SEQ ID NO: 35950

SEQ ID NO: 709211 - RNA, 64 nt, hsa; identical to SEQ ID NO: 35951

SEQ ID NO: 709212 - RNA, 64 nt, hsa; identical to SEQ ID NO: 35952

SEQ ID NO: 709213 - RNA, 64 nt, hsa; identical to SEQ ID NO: 35953

SEQ ID NO: 709214 - RNA, 64 nt, hsa; identical to SEQ ID NO: 35954

SEQ ID NO: 709215 - RNA, 64 nt, hsa; identical to SEQ ID NO: 35955

SEQ ID NO: 709216 - RNA, 64 nt, hsa; identical to SEQ ID NO: 35956

SEQ ID NO: 709217 - RNA, 64 nt, hsa; identical to SEQ ID NO: 35957

SEQ ID NO: 709218 - RNA, 64 nt, hsa; identical to SEQ ID NO: 35958

SEQ ID NO: 709219 - RNA, 64 nt, hsa; identical to SEQ ID NO: 35959

SEQ ID NO: 709220 - RNA, 64 nt, hsa; identical to SEQ ID NO: 35960

SEQ ID NO: 709221 - RNA, 64 nt, hsa; identical to SEQ ID NO: 35961

SEQ ID NO: 709222 - RNA, 64 nt, hsa; identical to SEQ ID NO: 35962

SEQ ID NO: 709223 - RNA, 64 nt, hsa; identical to SEQ ID NO: 35963

SEQ ID NO: 709224 - RNA, 64 nt, hsa; identical to SEQ ID NO: 35964

SEQ ID NO: 709225 - RNA, 64 nt, hsa; identical to SEQ ID NO: 35965

SEQ ID NO: 709226 - RNA, 64 nt, hsa; identical to SEQ ID NO: 35966

SEQ ID NO: 709227 - RNA, 64 nt, hsa; identical to SEQ ID NO: 35967

SEQ ID NO: 709228 - RNA, 64 nt, hsa; identical to SEQ ID NO: 35968

SEQ ID NO: 709229 - RNA, 64 nt, hsa; identical to SEQ ID NO: 35969

SEQ ID NO: 709230 - RNA, 64 nt, hsa; identical to SEQ ID NO: 35970

SEQ ID NO: 709231 - RNA, 64 nt, hsa; identical to SEQ ID NO: 35971

SEQ ID NO: 709232 - RNA, 64 nt, hsa; identical to SEQ ID NO: 35972

SEQ ID NO: 709233 - RNA, 64 nt, hsa; identical to SEQ ID NO: 35973

SEQ ID NO: 709234 - RNA, 64 nt, hsa; identical to SEQ ID NO: 35974

SEQ ID NO: 709235 - RNA, 64 nt, hsa; identical to SEQ ID NO: 35975

SEQ ID NO: 709236 - RNA, 64 nt, hsa; identical to SEQ ID NO: 35976

SEQ ID NO: 709237 - RNA, 64 nt, hsa; identical to SEQ ID NO: 35977

SEQ ID NO: 709238 - RNA, 64 nt, hsa; identical to SEQ ID NO: 35978

SEQ ID NO: 709239 - RNA, 64 nt, hsa; identical to SEQ ID NO: 35979

SEQ ID NO: 709240 - RNA, 64 nt, hsa; identical to SEQ ID NO: 35980

SEQ ID NO: 709241 - RNA, 64 nt, hsa; identical to SEQ ID NO: 35981

SEQ ID NO: 709242 - RNA, 64 nt, hsa; identical to SEQ ID NO: 35982

SEQ ID NO: 709243 - RNA, 64 nt, hsa; identical to SEQ ID NO: 35983

SEQ ID NO: 709244 - RNA, 64 nt, hsa; identical to SEQ ID NO: 35984

SEQ ID NO: 709245 - RNA, 64 nt, hsa; identical to SEQ ID NO: 35985

SEQ ID NO: 709246 - RNA, 64 nt, hsa; identical to SEQ ID NO: 35986

SEQ ID NO: 709247 - RNA, 64 nt, hsa; identical to SEQ ID NO: 35987

SEQ ID NO: 709248 - RNA, 64 nt, hsa; identical to SEQ ID NO: 35988

SEQ ID NO: 709249 - RNA, 64 nt, hsa; identical to SEQ ID NO: 35989

SEQ ID NO: 709250 - RNA, 64 nt, hsa; identical to SEQ ID NO: 35990

SEQ ID NO: 709251 - RNA, 64 nt, hsa; identical to SEQ ID NO: 35991

SEQ ID NO: 709252 - RNA, 64 nt, hsa; identical to SEQ ID NO: 35992

SEQ ID NO: 709253 - RNA, 64 nt, hsa; identical to SEQ ID NO: 35993

SEQ ID NO: 709254 - RNA, 64 nt, hsa; identical to SEQ ID NO: 35994

SEQ ID NO: 709255 - RNA, 64 nt, hsa; identical to SEQ ID NO: 35995

SEQ ID NO: 709256 - RNA, 64 nt, hsa; identical to SEQ ID NO: 35996

SEQ ID NO: 709257 - RNA, 64 nt, hsa; identical to SEQ ID NO: 35997

SEQ ID NO: 709258 - RNA, 64 nt, hsa; identical to SEQ ID NO: 35998

SEQ ID NO: 709259 - RNA, 64 nt, hsa; identical to SEQ ID NO: 35999

SEQ ID NO: 709260 - RNA, 64 nt, hsa; identical to SEQ ID NO: 36000

SEQ ID NO: 709261 - RNA, 64 nt, hsa; identical to SEQ ID NO: 36001

SEQ ID NO: 709262 - RNA, 64 nt, hsa; identical to SEQ ID NO: 36002

SEQ ID NO: 709263 - RNA, 64 nt, hsa; identical to SEQ ID NO: 36003

SEQ ID NO: 709264 - RNA, 64 nt, hsa; identical to SEQ ID NO: 36004

SEQ ID NO: 709265 - RNA, 64 nt, hsa; identical to SEQ ID NO: 36005

SEQ ID NO: 709266 - RNA, 64 nt, hsa; identical to SEQ ID NO: 36006

SEQ ID NO: 709267 - RNA, 64 nt, hsa; identical to SEQ ID NO: 36007

SEQ ID NO: 709268 - RNA, 64 nt, hsa; identical to SEQ ID NO: 36008

SEQ ID NO: 709269 - RNA, 64 nt, hsa; identical to SEQ ID NO: 36009

SEQ ID NO: 709270 - RNA, 64 nt, hsa; identical to SEQ ID NO: 36010

SEQ ID NO: 709271 - RNA, 64 nt, hsa; identical to SEQ ID NO: 36011

SEQ ID NO: 709272 - RNA, 64 nt, hsa; identical to SEQ ID NO: 36012

SEQ ID NO: 709273 - RNA, 64 nt, hsa; identical to SEQ ID NO: 36013

SEQ ID NO: 709274 - RNA, 64 nt, hsa; identical to SEQ ID NO: 36014

SEQ ID NO: 709275 - RNA, 64 nt, hsa; identical to SEQ ID NO: 36015

SEQ ID NO: 709276 - RNA, 64 nt, hsa; identical to SEQ ID NO: 36016

SEQ ID NO: 709277 - RNA, 64 nt, hsa; identical to SEQ ID NO: 36017

SEQ ID NO: 709278 - RNA, 64 nt, hsa; identical to SEQ ID NO: 36018

SEQ ID NO: 709279 - RNA, 64 nt, hsa; identical to SEQ ID NO: 36019

SEQ ID NO: 709280 - RNA, 64 nt, hsa; identical to SEQ ID NO: 36020

SEQ ID NO: 709281 - RNA, 64 nt, hsa; identical to SEQ ID NO: 36021

SEQ ID NO: 709282 - RNA, 64 nt, hsa; identical to SEQ ID NO: 36022

SEQ ID NO: 709283 - RNA, 64 nt, hsa; identical to SEQ ID NO: 36023

SEQ ID NO: 709284 - RNA, 64 nt, hsa; identical to SEQ ID NO: 36024

SEQ ID NO: 709285 - RNA, 64 nt, hsa; identical to SEQ ID NO: 36025

SEQ ID NO: 709286 - RNA, 64 nt, hsa; identical to SEQ ID NO: 36026

SEQ ID NO: 709287 - RNA, 64 nt, hsa; identical to SEQ ID NO: 36027

SEQ ID NO: 709288 - RNA, 64 nt, hsa; identical to SEQ ID NO: 36028

SEQ ID NO: 709289 - RNA, 64 nt, hsa; identical to SEQ ID NO: 36029

SEQ ID NO: 709290 - RNA, 64 nt, hsa; identical to SEQ ID NO: 36030

SEQ ID NO: 709291 - RNA, 64 nt, hsa; identical to SEQ ID NO: 36031

SEQ ID NO: 709292 - RNA, 64 nt, hsa; identical to SEQ ID NO: 36032

SEQ ID NO: 709293 - RNA, 64 nt, hsa; identical to SEQ ID NO: 36033

SEQ ID NO: 709294 - RNA, 64 nt, hsa; identical to SEQ ID NO: 36034

SEQ ID NO: 709295 - RNA, 64 nt, hsa; identical to SEQ ID NO: 36035

SEQ ID NO: 709296 - RNA, 64 nt, hsa; identical to SEQ ID NO: 36036

SEQ ID NO: 709297 - RNA, 64 nt, hsa; identical to SEQ ID NO: 36037

SEQ ID NO: 709298 - RNA, 64 nt, hsa; identical to SEQ ID NO: 36038

SEQ ID NO: 709299 - RNA, 64 nt, hsa; identical to SEQ ID NO: 36039

SEQ ID NO: 709300 - RNA, 64 nt, hsa; identical to SEQ ID NO: 36040

SEQ ID NO: 709301 - RNA, 64 nt, hsa; identical to SEQ ID NO: 36041

SEQ ID NO: 709302 - RNA, 64 nt, hsa; identical to SEQ ID NO: 36042

SEQ ID NO: 709303 - RNA, 64 nt, hsa; identical to SEQ ID NO: 36043

SEQ ID NO: 709304 - RNA, 64 nt, hsa; identical to SEQ ID NO: 36044

SEQ ID NO: 709305 - RNA, 64 nt, hsa; identical to SEQ ID NO: 36045

SEQ ID NO: 709306 - RNA, 64 nt, hsa; identical to SEQ ID NO: 36046

SEQ ID NO: 709307 - RNA, 64 nt, hsa; identical to SEQ ID NO: 36047

SEQ ID NO: 709308 - RNA, 64 nt, hsa; identical to SEQ ID NO: 36048

SEQ ID NO: 709309 - RNA, 64 nt, hsa; identical to SEQ ID NO: 36049

SEQ ID NO: 709310 - RNA, 64 nt, hsa; identical to SEQ ID NO: 36050

SEQ ID NO: 709311 - RNA, 64 nt, hsa; identical to SEQ ID NO: 36051

SEQ ID NO: 709312 - RNA, 64 nt, hsa; identical to SEQ ID NO: 36052

SEQ ID NO: 709313 - RNA, 64 nt, hsa; identical to SEQ ID NO: 36053

SEQ ID NO: 709314 - RNA, 64 nt, hsa; identical to SEQ ID NO: 36054

SEQ ID NO: 709315 - RNA, 64 nt, hsa; identical to SEQ ID NO: 36055

SEQ ID NO: 709316 - RNA, 64 nt, hsa; identical to SEQ ID NO: 36056

SEQ ID NO: 709317 - RNA, 64 nt, hsa; identical to SEQ ID NO: 36057

SEQ ID NO: 709318 - RNA, 64 nt, hsa; identical to SEQ ID NO: 36058

SEQ ID NO: 709319 - RNA, 64 nt, hsa; identical to SEQ ID NO: 36059

SEQ ID NO: 709320 - RNA, 64 nt, hsa; identical to SEQ ID NO: 36060

SEQ ID NO: 709321 - RNA, 64 nt, hsa; identical to SEQ ID NO: 36061

SEQ ID NO: 709322 - RNA, 64 nt, hsa; identical to SEQ ID NO: 36062

SEQ ID NO: 709323 - RNA, 64 nt, hsa; identical to SEQ ID NO: 36063

SEQ ID NO: 709324 - RNA, 64 nt, hsa; identical to SEQ ID NO: 36064

SEQ ID NO: 709325 - RNA, 64 nt, hsa; identical to SEQ ID NO: 36065

SEQ ID NO: 709326 - RNA, 64 nt, hsa; identical to SEQ ID NO: 36066

SEQ ID NO: 709327 - RNA, 64 nt, hsa; identical to SEQ ID NO: 36067

SEQ ID NO: 709328 - RNA, 64 nt, hsa; identical to SEQ ID NO: 36068

SEQ ID NO: 709329 - RNA, 64 nt, hsa; identical to SEQ ID NO: 36069

SEQ ID NO: 709330 - RNA, 64 nt, hsa; identical to SEQ ID NO: 36070

SEQ ID NO: 709331 - RNA, 64 nt, hsa; identical to SEQ ID NO: 36071

SEQ ID NO: 709332 - RNA, 64 nt, hsa; identical to SEQ ID NO: 36072

SEQ ID NO: 709333 - RNA, 64 nt, hsa; identical to SEQ ID NO: 36073

SEQ ID NO: 709334 - RNA, 64 nt, hsa; identical to SEQ ID NO: 36074

SEQ ID NO: 709335 - RNA, 64 nt, hsa; identical to SEQ ID NO: 36075

SEQ ID NO: 709336 - RNA, 64 nt, hsa; identical to SEQ ID NO: 36076

SEQ ID NO: 709337 - RNA, 64 nt, hsa; identical to SEQ ID NO: 36077

SEQ ID NO: 709338 - RNA, 64 nt, hsa; identical to SEQ ID NO: 36078

SEQ ID NO: 709339 - RNA, 64 nt, hsa; identical to SEQ ID NO: 36079

SEQ ID NO: 709340 - RNA, 64 nt, hsa; identical to SEQ ID NO: 36080

SEQ ID NO: 709341 - RNA, 64 nt, hsa; identical to SEQ ID NO: 36081

SEQ ID NO: 709342 - RNA, 64 nt, hsa; identical to SEQ ID NO: 36082

SEQ ID NO: 709343 - RNA, 64 nt, hsa; identical to SEQ ID NO: 36083

SEQ ID NO: 709344 - RNA, 64 nt, hsa; identical to SEQ ID NO: 36084

SEQ ID NO: 709345 - RNA, 64 nt, hsa; identical to SEQ ID NO: 36085

SEQ ID NO: 709346 - RNA, 64 nt, hsa; identical to SEQ ID NO: 36086

SEQ ID NO: 709347 - RNA, 64 nt, hsa; identical to SEQ ID NO: 36087

SEQ ID NO: 709348 - RNA, 64 nt, hsa; identical to SEQ ID NO: 36088

SEQ ID NO: 709349 - RNA, 64 nt, hsa; identical to SEQ ID NO: 36089

SEQ ID NO: 709350 - RNA, 64 nt, hsa; identical to SEQ ID NO: 36090

SEQ ID NO: 709351 - RNA, 64 nt, hsa; identical to SEQ ID NO: 36091

SEQ ID NO: 709352 - RNA, 64 nt, hsa; identical to SEQ ID NO: 36092

SEQ ID NO: 709353 - RNA, 64 nt, hsa; identical to SEQ ID NO: 36093

SEQ ID NO: 709354 - RNA, 64 nt, hsa; identical to SEQ ID NO: 36094

SEQ ID NO: 709355 - RNA, 64 nt, hsa; identical to SEQ ID NO: 36095

SEQ ID NO: 709356 - RNA, 64 nt, hsa; identical to SEQ ID NO: 36096

SEQ ID NO: 709357 - RNA, 64 nt, hsa; identical to SEQ ID NO: 36097

SEQ ID NO: 709358 - RNA, 64 nt, hsa; identical to SEQ ID NO: 36098

SEQ ID NO: 709359 - RNA, 64 nt, hsa; identical to SEQ ID NO: 36099

SEQ ID NO: 709360 - RNA, 64 nt, hsa; identical to SEQ ID NO: 36100

SEQ ID NO: 709361 - RNA, 64 nt, hsa; identical to SEQ ID NO: 36101

SEQ ID NO: 709362 - RNA, 64 nt, hsa; identical to SEQ ID NO: 36102

SEQ ID NO: 709363 - RNA, 64 nt, hsa; identical to SEQ ID NO: 36103

SEQ ID NO: 709364 - RNA, 64 nt, hsa; identical to SEQ ID NO: 36104

SEQ ID NO: 709365 - RNA, 64 nt, hsa; identical to SEQ ID NO: 36105

SEQ ID NO: 709366 - RNA, 64 nt, hsa; identical to SEQ ID NO: 36106

SEQ ID NO: 709367 - RNA, 64 nt, hsa; identical to SEQ ID NO: 36107

SEQ ID NO: 709368 - RNA, 64 nt, hsa; identical to SEQ ID NO: 36108

SEQ ID NO: 709369 - RNA, 64 nt, hsa; identical to SEQ ID NO: 36109

SEQ ID NO: 709370 - RNA, 64 nt, hsa; identical to SEQ ID NO: 36110

SEQ ID NO: 709371 - RNA, 64 nt, hsa; identical to SEQ ID NO: 36111

SEQ ID NO: 709372 - RNA, 64 nt, hsa; identical to SEQ ID NO: 36112

SEQ ID NO: 709373 - RNA, 64 nt, hsa; identical to SEQ ID NO: 36113

SEQ ID NO: 709374 - RNA, 64 nt, hsa; identical to SEQ ID NO: 36114

SEQ ID NO: 709375 - RNA, 64 nt, hsa; identical to SEQ ID NO: 36115

SEQ ID NO: 709376 - RNA, 64 nt, hsa; identical to SEQ ID NO: 36116

SEQ ID NO: 709377 - RNA, 64 nt, hsa; identical to SEQ ID NO: 36117

SEQ ID NO: 709378 - RNA, 64 nt, hsa; identical to SEQ ID NO: 36118

SEQ ID NO: 709379 - RNA, 64 nt, hsa; identical to SEQ ID NO: 36119

SEQ ID NO: 709380 - RNA, 64 nt, hsa; identical to SEQ ID NO: 36120

SEQ ID NO: 709381 - RNA, 62 nt, hsa; identical to SEQ ID NO: 36121

SEQ ID NO: 709382 - RNA, 63 nt, hsa; identical to SEQ ID NO: 36122

SEQ ID NO: 709383 - RNA, 64 nt, hsa; identical to SEQ ID NO: 36123

SEQ ID NO: 709384 - RNA, 64 nt, hsa; identical to SEQ ID NO: 36124

SEQ ID NO: 709385 - RNA, 64 nt, hsa; identical to SEQ ID NO: 36125

SEQ ID NO: 709386 - RNA, 64 nt, hsa; identical to SEQ ID NO: 36126

SEQ ID NO: 709387 - RNA, 64 nt, hsa; identical to SEQ ID NO: 36127

SEQ ID NO: 709388 - RNA, 64 nt, hsa; identical to SEQ ID NO: 36128

SEQ ID NO: 709389 - RNA, 64 nt, hsa; identical to SEQ ID NO: 36129

SEQ ID NO: 709390 - RNA, 64 nt, hsa; identical to SEQ ID NO: 36130

SEQ ID NO: 709391 - RNA, 64 nt, hsa; identical to SEQ ID NO: 36131

SEQ ID NO: 709392 - RNA, 64 nt, hsa; identical to SEQ ID NO: 36132

SEQ ID NO: 709393 - RNA, 64 nt, hsa; identical to SEQ ID NO: 36133

SEQ ID NO: 709394 - RNA, 64 nt, hsa; identical to SEQ ID NO: 36134

SEQ ID NO: 709395 - RNA, 64 nt, hsa; identical to SEQ ID NO: 36135

SEQ ID NO: 709396 - RNA, 64 nt, hsa; identical to SEQ ID NO: 36136

SEQ ID NO: 709397 - RNA, 64 nt, hsa; identical to SEQ ID NO: 36137

SEQ ID NO: 709398 - RNA, 64 nt, hsa; identical to SEQ ID NO: 36138

SEQ ID NO: 709399 - RNA, 64 nt, hsa; identical to SEQ ID NO: 36139

SEQ ID NO: 709400 - RNA, 64 nt, hsa; identical to SEQ ID NO: 36140

SEQ ID NO: 709401 - RNA, 64 nt, hsa; identical to SEQ ID NO: 36141

SEQ ID NO: 709402 - RNA, 64 nt, hsa; identical to SEQ ID NO: 36142

SEQ ID NO: 709403 - RNA, 64 nt, hsa; identical to SEQ ID NO: 36143

SEQ ID NO: 709404 - RNA, 64 nt, hsa; identical to SEQ ID NO: 36144

SEQ ID NO: 709405 - RNA, 64 nt, hsa; identical to SEQ ID NO: 36145

SEQ ID NO: 709406 - RNA, 64 nt, hsa; identical to SEQ ID NO: 36146

SEQ ID NO: 709407 - RNA, 64 nt, hsa; identical to SEQ ID NO: 36147

SEQ ID NO: 709408 - RNA, 64 nt, hsa; identical to SEQ ID NO: 36148

SEQ ID NO: 709409 - RNA, 64 nt, hsa; identical to SEQ ID NO: 36149

SEQ ID NO: 709410 - RNA, 64 nt, hsa; identical to SEQ ID NO: 36150

SEQ ID NO: 709411 - RNA, 64 nt, hsa; identical to SEQ ID NO: 36151

SEQ ID NO: 709412 - RNA, 64 nt, hsa; identical to SEQ ID NO: 36152

SEQ ID NO: 709413 - RNA, 64 nt, hsa; identical to SEQ ID NO: 36153

SEQ ID NO: 709414 - RNA, 64 nt, hsa; identical to SEQ ID NO: 36154

SEQ ID NO: 709415 - RNA, 64 nt, hsa; identical to SEQ ID NO: 36155

SEQ ID NO: 709416 - RNA, 64 nt, hsa; identical to SEQ ID NO: 36156

SEQ ID NO: 709417 - RNA, 64 nt, hsa; identical to SEQ ID NO: 36157

SEQ ID NO: 709418 - RNA, 64 nt, hsa; identical to SEQ ID NO: 36158

SEQ ID NO: 709419 - RNA, 64 nt, hsa; identical to SEQ ID NO: 36159

SEQ ID NO: 709420 - RNA, 64 nt, hsa; identical to SEQ ID NO: 36160

SEQ ID NO: 709421 - RNA, 64 nt, hsa; identical to SEQ ID NO: 36161

SEQ ID NO: 709422 - RNA, 64 nt, hsa; identical to SEQ ID NO: 36162

SEQ ID NO: 709423 - RNA, 64 nt, hsa; identical to SEQ ID NO: 36163

SEQ ID NO: 709424 - RNA, 64 nt, hsa; identical to SEQ ID NO: 36164

SEQ ID NO: 709425 - RNA, 64 nt, hsa; identical to SEQ ID NO: 36165

SEQ ID NO: 709426 - RNA, 64 nt, hsa; identical to SEQ ID NO: 36166

SEQ ID NO: 709427 - RNA, 64 nt, hsa; identical to SEQ ID NO: 36167

SEQ ID NO: 709428 - RNA, 64 nt, hsa; identical to SEQ ID NO: 36168

SEQ ID NO: 709429 - RNA, 64 nt, hsa; identical to SEQ ID NO: 36169

SEQ ID NO: 709430 - RNA, 64 nt, hsa; identical to SEQ ID NO: 36170

SEQ ID NO: 709431 - RNA, 64 nt, hsa; identical to SEQ ID NO: 36171

SEQ ID NO: 709432 - RNA, 64 nt, hsa; identical to SEQ ID NO: 36172

SEQ ID NO: 709433 - RNA, 64 nt, hsa; identical to SEQ ID NO: 36173

SEQ ID NO: 709434 - RNA, 64 nt, hsa; identical to SEQ ID NO: 36174

SEQ ID NO: 709435 - RNA, 64 nt, hsa; identical to SEQ ID NO: 36175

SEQ ID NO: 709436 - RNA, 64 nt, hsa; identical to SEQ ID NO: 36176

SEQ ID NO: 709437 - RNA, 64 nt, hsa; identical to SEQ ID NO: 36177

SEQ ID NO: 709438 - RNA, 64 nt, hsa; identical to SEQ ID NO: 36178

SEQ ID NO: 709439 - RNA, 64 nt, hsa; identical to SEQ ID NO: 36179

SEQ ID NO: 709440 - RNA, 64 nt, hsa; identical to SEQ ID NO: 36180

SEQ ID NO: 709441 - RNA, 64 nt, hsa; identical to SEQ ID NO: 36181

SEQ ID NO: 709442 - RNA, 64 nt, hsa; identical to SEQ ID NO: 36182

SEQ ID NO: 709443 - RNA, 64 nt, hsa; identical to SEQ ID NO: 36183

SEQ ID NO: 709444 - RNA, 64 nt, hsa; identical to SEQ ID NO: 36184

SEQ ID NO: 709445 - RNA, 64 nt, hsa; identical to SEQ ID NO: 36185

SEQ ID NO: 709446 - RNA, 64 nt, hsa; identical to SEQ ID NO: 36186

SEQ ID NO: 709447 - RNA, 64 nt, hsa; identical to SEQ ID NO: 36187

SEQ ID NO: 709448 - RNA, 64 nt, hsa; identical to SEQ ID NO: 36188

SEQ ID NO: 709449 - RNA, 64 nt, hsa; identical to SEQ ID NO: 36189

SEQ ID NO: 709450 - RNA, 64 nt, hsa; identical to SEQ ID NO: 36190

SEQ ID NO: 709451 - RNA, 64 nt, hsa; identical to SEQ ID NO: 36191

SEQ ID NO: 709452 - RNA, 64 nt, hsa; identical to SEQ ID NO: 36192

SEQ ID NO: 709453 - RNA, 64 nt, hsa; identical to SEQ ID NO: 36193

SEQ ID NO: 709454 - RNA, 64 nt, hsa; identical to SEQ ID NO: 36194

SEQ ID NO: 709455 - RNA, 64 nt, hsa; identical to SEQ ID NO: 36195

SEQ ID NO: 709456 - RNA, 64 nt, hsa; identical to SEQ ID NO: 36196

SEQ ID NO: 709457 - RNA, 64 nt, hsa; identical to SEQ ID NO: 36197

SEQ ID NO: 709458 - RNA, 64 nt, hsa; identical to SEQ ID NO: 36198

SEQ ID NO: 709459 - RNA, 64 nt, hsa; identical to SEQ ID NO: 36199

SEQ ID NO: 709460 - RNA, 64 nt, hsa; identical to SEQ ID NO: 36200

SEQ ID NO: 709461 - RNA, 64 nt, hsa; identical to SEQ ID NO: 36201

SEQ ID NO: 709462 - RNA, 64 nt, hsa; identical to SEQ ID NO: 36202

SEQ ID NO: 709463 - RNA, 64 nt, hsa; identical to SEQ ID NO: 36203

SEQ ID NO: 709464 - RNA, 64 nt, hsa; identical to SEQ ID NO: 36204

SEQ ID NO: 709465 - RNA, 64 nt, hsa; identical to SEQ ID NO: 36205

SEQ ID NO: 709466 - RNA, 64 nt, hsa; identical to SEQ ID NO: 36206

SEQ ID NO: 709467 - RNA, 64 nt, hsa; identical to SEQ ID NO: 36207

SEQ ID NO: 709468 - RNA, 64 nt, hsa; identical to SEQ ID NO: 36208

SEQ ID NO: 709469 - RNA, 64 nt, hsa; identical to SEQ ID NO: 36209

SEQ ID NO: 709470 - RNA, 64 nt, hsa; identical to SEQ ID NO: 36210

SEQ ID NO: 709471 - RNA, 64 nt, hsa; identical to SEQ ID NO: 36211

SEQ ID NO: 709472 - RNA, 64 nt, hsa; identical to SEQ ID NO: 36212

SEQ ID NO: 709473 - RNA, 64 nt, hsa; identical to SEQ ID NO: 36213

SEQ ID NO: 709474 - RNA, 64 nt, hsa; identical to SEQ ID NO: 36214

SEQ ID NO: 709475 - RNA, 64 nt, hsa; identical to SEQ ID NO: 36215

SEQ ID NO: 709476 - RNA, 64 nt, hsa; identical to SEQ ID NO: 36216

SEQ ID NO: 709477 - RNA, 64 nt, hsa; identical to SEQ ID NO: 36217

SEQ ID NO: 709478 - RNA, 64 nt, hsa; identical to SEQ ID NO: 36218

SEQ ID NO: 709479 - RNA, 64 nt, hsa; identical to SEQ ID NO: 36219

SEQ ID NO: 709480 - RNA, 64 nt, hsa; identical to SEQ ID NO: 36220

SEQ ID NO: 709481 - RNA, 64 nt, hsa; identical to SEQ ID NO: 36221

SEQ ID NO: 709482 - RNA, 64 nt, hsa; identical to SEQ ID NO: 36222

SEQ ID NO: 709483 - RNA, 64 nt, hsa; identical to SEQ ID NO: 36223

SEQ ID NO: 709484 - RNA, 64 nt, hsa; identical to SEQ ID NO: 36224

SEQ ID NO: 709485 - RNA, 64 nt, hsa; identical to SEQ ID NO: 36225

SEQ ID NO: 709486 - RNA, 64 nt, hsa; identical to SEQ ID NO: 36226

SEQ ID NO: 709487 - RNA, 64 nt, hsa; identical to SEQ ID NO: 36227

SEQ ID NO: 709488 - RNA, 64 nt, hsa; identical to SEQ ID NO: 36228

SEQ ID NO: 709489 - RNA, 64 nt, hsa; identical to SEQ ID NO: 36229

SEQ ID NO: 709490 - RNA, 64 nt, hsa; identical to SEQ ID NO: 36230

SEQ ID NO: 709491 - RNA, 64 nt, hsa; identical to SEQ ID NO: 36231

SEQ ID NO: 709492 - RNA, 64 nt, hsa; identical to SEQ ID NO: 36232

SEQ ID NO: 709493 - RNA, 64 nt, hsa; identical to SEQ ID NO: 36233

SEQ ID NO: 709494 - RNA, 64 nt, hsa; identical to SEQ ID NO: 36234

SEQ ID NO: 709495 - RNA, 64 nt, hsa; identical to SEQ ID NO: 36235

SEQ ID NO: 709496 - RNA, 64 nt, hsa; identical to SEQ ID NO: 36236

SEQ ID NO: 709497 - RNA, 64 nt, hsa; identical to SEQ ID NO: 36237

SEQ ID NO: 709498 - RNA, 64 nt, hsa; identical to SEQ ID NO: 36238

SEQ ID NO: 709499 - RNA, 64 nt, hsa; identical to SEQ ID NO: 36239

SEQ ID NO: 709500 - RNA, 64 nt, hsa; identical to SEQ ID NO: 36240

SEQ ID NO: 709501 - RNA, 64 nt, hsa; identical to SEQ ID NO: 36241

SEQ ID NO: 709502 - RNA, 64 nt, hsa; identical to SEQ ID NO: 36242

SEQ ID NO: 709503 - RNA, 64 nt, hsa; identical to SEQ ID NO: 36243

SEQ ID NO: 709504 - RNA, 64 nt, hsa; identical to SEQ ID NO: 36244

SEQ ID NO: 709505 - RNA, 64 nt, hsa; identical to SEQ ID NO: 36245

SEQ ID NO: 709506 - RNA, 64 nt, hsa; identical to SEQ ID NO: 36246

SEQ ID NO: 709507 - RNA, 64 nt, hsa; identical to SEQ ID NO: 36247

SEQ ID NO: 709508 - RNA, 64 nt, hsa; identical to SEQ ID NO: 36248

SEQ ID NO: 709509 - RNA, 64 nt, hsa; identical to SEQ ID NO: 36249

SEQ ID NO: 709510 - RNA, 64 nt, hsa; identical to SEQ ID NO: 36250

SEQ ID NO: 709511 - RNA, 64 nt, hsa; identical to SEQ ID NO: 36251

SEQ ID NO: 709512 - RNA, 64 nt, hsa; identical to SEQ ID NO: 36252

SEQ ID NO: 709513 - RNA, 64 nt, hsa; identical to SEQ ID NO: 36253

SEQ ID NO: 709514 - RNA, 64 nt, hsa; identical to SEQ ID NO: 36254

SEQ ID NO: 709515 - RNA, 64 nt, hsa; identical to SEQ ID NO: 36255

SEQ ID NO: 709516 - RNA, 64 nt, hsa; identical to SEQ ID NO: 36256

SEQ ID NO: 709517 - RNA, 64 nt, hsa; identical to SEQ ID NO: 36257

SEQ ID NO: 709518 - RNA, 64 nt, hsa; identical to SEQ ID NO: 36258

SEQ ID NO: 709519 - RNA, 64 nt, hsa; identical to SEQ ID NO: 36259

SEQ ID NO: 709520 - RNA, 64 nt, hsa; identical to SEQ ID NO: 36260

SEQ ID NO: 709521 - RNA, 64 nt, hsa; identical to SEQ ID NO: 36261

SEQ ID NO: 709522 - RNA, 64 nt, hsa; identical to SEQ ID NO: 36262

SEQ ID NO: 709523 - RNA, 64 nt, hsa; identical to SEQ ID NO: 36263

SEQ ID NO: 709524 - RNA, 64 nt, hsa; identical to SEQ ID NO: 36264

SEQ ID NO: 709525 - RNA, 64 nt, hsa; identical to SEQ ID NO: 36265

SEQ ID NO: 709526 - RNA, 64 nt, hsa; identical to SEQ ID NO: 36266

SEQ ID NO: 709527 - RNA, 64 nt, hsa; identical to SEQ ID NO: 36267

SEQ ID NO: 709528 - RNA, 64 nt, hsa; identical to SEQ ID NO: 36268

SEQ ID NO: 709529 - RNA, 64 nt, hsa; identical to SEQ ID NO: 36269

SEQ ID NO: 709530 - RNA, 64 nt, hsa; identical to SEQ ID NO: 36270

SEQ ID NO: 709531 - RNA, 64 nt, hsa; identical to SEQ ID NO: 36271

SEQ ID NO: 709532 - RNA, 64 nt, hsa; identical to SEQ ID NO: 36272

SEQ ID NO: 709533 - RNA, 64 nt, hsa; identical to SEQ ID NO: 36273

SEQ ID NO: 709534 - RNA, 64 nt, hsa; identical to SEQ ID NO: 36274

SEQ ID NO: 709535 - RNA, 64 nt, hsa; identical to SEQ ID NO: 36275

SEQ ID NO: 709536 - RNA, 64 nt, hsa; identical to SEQ ID NO: 36276

SEQ ID NO: 709537 - RNA, 64 nt, hsa; identical to SEQ ID NO: 36277

SEQ ID NO: 709538 - RNA, 64 nt, hsa; identical to SEQ ID NO: 36278

SEQ ID NO: 709539 - RNA, 64 nt, hsa; identical to SEQ ID NO: 36279

SEQ ID NO: 709540 - RNA, 64 nt, hsa; identical to SEQ ID NO: 36280

SEQ ID NO: 709541 - RNA, 64 nt, hsa; identical to SEQ ID NO: 36281

SEQ ID NO: 709542 - RNA, 64 nt, hsa; identical to SEQ ID NO: 36282

SEQ ID NO: 709543 - RNA, 64 nt, hsa; identical to SEQ ID NO: 36283

SEQ ID NO: 709544 - RNA, 64 nt, hsa; identical to SEQ ID NO: 36284

SEQ ID NO: 709545 - RNA, 64 nt, hsa; identical to SEQ ID NO: 36285

SEQ ID NO: 709546 - RNA, 64 nt, hsa; identical to SEQ ID NO: 36286

SEQ ID NO: 709547 - RNA, 64 nt, hsa; identical to SEQ ID NO: 36287

SEQ ID NO: 709548 - RNA, 64 nt, hsa; identical to SEQ ID NO: 36288

SEQ ID NO: 709549 - RNA, 64 nt, hsa; identical to SEQ ID NO: 36289

SEQ ID NO: 709550 - RNA, 64 nt, hsa; identical to SEQ ID NO: 36290

SEQ ID NO: 709551 - RNA, 64 nt, hsa; identical to SEQ ID NO: 36291

SEQ ID NO: 709552 - RNA, 64 nt, hsa; identical to SEQ ID NO: 36292

SEQ ID NO: 709553 - RNA, 64 nt, hsa; identical to SEQ ID NO: 36293

SEQ ID NO: 709554 - RNA, 64 nt, hsa; identical to SEQ ID NO: 36294

SEQ ID NO: 709555 - RNA, 64 nt, hsa; identical to SEQ ID NO: 36295

SEQ ID NO: 709556 - RNA, 64 nt, hsa; identical to SEQ ID NO: 36296

SEQ ID NO: 709557 - RNA, 64 nt, hsa; identical to SEQ ID NO: 36297

SEQ ID NO: 709558 - RNA, 64 nt, hsa; identical to SEQ ID NO: 36298

SEQ ID NO: 709559 - RNA, 64 nt, hsa; identical to SEQ ID NO: 36299

SEQ ID NO: 709560 - RNA, 64 nt, hsa; identical to SEQ ID NO: 36300

SEQ ID NO: 709561 - RNA, 64 nt, hsa; identical to SEQ ID NO: 36301

SEQ ID NO: 709562 - RNA, 64 nt, hsa; identical to SEQ ID NO: 36302

SEQ ID NO: 709563 - RNA, 64 nt, hsa; identical to SEQ ID NO: 36303

SEQ ID NO: 709564 - RNA, 64 nt, hsa; identical to SEQ ID NO: 36304

SEQ ID NO: 709565 - RNA, 64 nt, hsa; identical to SEQ ID NO: 36305

SEQ ID NO: 709566 - RNA, 64 nt, hsa; identical to SEQ ID NO: 36306

SEQ ID NO: 709567 - RNA, 64 nt, hsa; identical to SEQ ID NO: 36307

SEQ ID NO: 709568 - RNA, 64 nt, hsa; identical to SEQ ID NO: 36308

SEQ ID NO: 709569 - RNA, 64 nt, hsa; identical to SEQ ID NO: 36309

SEQ ID NO: 709570 - RNA, 64 nt, hsa; identical to SEQ ID NO: 36310

SEQ ID NO: 709571 - RNA, 64 nt, hsa; identical to SEQ ID NO: 36311

SEQ ID NO: 709572 - RNA, 64 nt, hsa; identical to SEQ ID NO: 36312

SEQ ID NO: 709573 - RNA, 64 nt, hsa; identical to SEQ ID NO: 36313

SEQ ID NO: 709574 - RNA, 64 nt, hsa; identical to SEQ ID NO: 36314

SEQ ID NO: 709575 - RNA, 64 nt, hsa; identical to SEQ ID NO: 36315

SEQ ID NO: 709576 - RNA, 64 nt, hsa; identical to SEQ ID NO: 36316

SEQ ID NO: 709577 - RNA, 64 nt, hsa; identical to SEQ ID NO: 36317

SEQ ID NO: 709578 - RNA, 64 nt, hsa; identical to SEQ ID NO: 36318

SEQ ID NO: 709579 - RNA, 64 nt, hsa; identical to SEQ ID NO: 36319

SEQ ID NO: 709580 - RNA, 64 nt, hsa; identical to SEQ ID NO: 36320

SEQ ID NO: 709581 - RNA, 64 nt, hsa; identical to SEQ ID NO: 36321

SEQ ID NO: 709582 - RNA, 64 nt, hsa; identical to SEQ ID NO: 36322

SEQ ID NO: 709583 - RNA, 64 nt, hsa; identical to SEQ ID NO: 36323

SEQ ID NO: 709584 - RNA, 64 nt, hsa; identical to SEQ ID NO: 36324

SEQ ID NO: 709585 - RNA, 64 nt, hsa; identical to SEQ ID NO: 36325

SEQ ID NO: 709586 - RNA, 64 nt, hsa; identical to SEQ ID NO: 36326

SEQ ID NO: 709587 - RNA, 64 nt, hsa; identical to SEQ ID NO: 36327

SEQ ID NO: 709588 - RNA, 64 nt, hsa; identical to SEQ ID NO: 36328

SEQ ID NO: 709589 - RNA, 64 nt, hsa; identical to SEQ ID NO: 36329

SEQ ID NO: 709590 - RNA, 64 nt, hsa; identical to SEQ ID NO: 36330

SEQ ID NO: 709591 - RNA, 64 nt, hsa; identical to SEQ ID NO: 36331

SEQ ID NO: 709592 - RNA, 64 nt, hsa; identical to SEQ ID NO: 36332

SEQ ID NO: 709593 - RNA, 64 nt, hsa; identical to SEQ ID NO: 36333

SEQ ID NO: 709594 - RNA, 64 nt, hsa; identical to SEQ ID NO: 36334

SEQ ID NO: 709595 - RNA, 64 nt, hsa; identical to SEQ ID NO: 36335

SEQ ID NO: 709596 - RNA, 64 nt, hsa; identical to SEQ ID NO: 36336

SEQ ID NO: 709597 - RNA, 64 nt, hsa; identical to SEQ ID NO: 36337

SEQ ID NO: 709598 - RNA, 64 nt, hsa; identical to SEQ ID NO: 36338

SEQ ID NO: 709599 - RNA, 64 nt, hsa; identical to SEQ ID NO: 36339

SEQ ID NO: 709600 - RNA, 64 nt, hsa; identical to SEQ ID NO: 36340

SEQ ID NO: 709601 - RNA, 64 nt, hsa; identical to SEQ ID NO: 36341

SEQ ID NO: 709602 - RNA, 64 nt, hsa; identical to SEQ ID NO: 36342

SEQ ID NO: 709603 - RNA, 64 nt, hsa; identical to SEQ ID NO: 36343

SEQ ID NO: 709604 - RNA, 64 nt, hsa; identical to SEQ ID NO: 36344

SEQ ID NO: 709605 - RNA, 64 nt, hsa; identical to SEQ ID NO: 36345

SEQ ID NO: 709606 - RNA, 64 nt, hsa; identical to SEQ ID NO: 36346

SEQ ID NO: 709607 - RNA, 64 nt, hsa; identical to SEQ ID NO: 36347

SEQ ID NO: 709608 - RNA, 64 nt, hsa; identical to SEQ ID NO: 36348

SEQ ID NO: 709609 - RNA, 64 nt, hsa; identical to SEQ ID NO: 36349

SEQ ID NO: 709610 - RNA, 64 nt, hsa; identical to SEQ ID NO: 36350

SEQ ID NO: 709611 - RNA, 64 nt, hsa; identical to SEQ ID NO: 36351

SEQ ID NO: 709612 - RNA, 64 nt, hsa; identical to SEQ ID NO: 36352

SEQ ID NO: 709613 - RNA, 64 nt, hsa; identical to SEQ ID NO: 36353

SEQ ID NO: 709614 - RNA, 64 nt, hsa; identical to SEQ ID NO: 36354

SEQ ID NO: 709615 - RNA, 64 nt, hsa; identical to SEQ ID NO: 36355

SEQ ID NO: 709616 - RNA, 64 nt, hsa; identical to SEQ ID NO: 36356

SEQ ID NO: 709617 - RNA, 64 nt, hsa; identical to SEQ ID NO: 36357

SEQ ID NO: 709618 - RNA, 64 nt, hsa; identical to SEQ ID NO: 36358

SEQ ID NO: 709619 - RNA, 64 nt, hsa; identical to SEQ ID NO: 36359

SEQ ID NO: 709620 - RNA, 64 nt, hsa; identical to SEQ ID NO: 36360

SEQ ID NO: 709621 - RNA, 64 nt, hsa; identical to SEQ ID NO: 36361

SEQ ID NO: 709622 - RNA, 64 nt, hsa; identical to SEQ ID NO: 36362

SEQ ID NO: 709623 - RNA, 64 nt, hsa; identical to SEQ ID NO: 36363

SEQ ID NO: 709624 - RNA, 64 nt, hsa; identical to SEQ ID NO: 36364

SEQ ID NO: 709625 - RNA, 64 nt, hsa; identical to SEQ ID NO: 36365

SEQ ID NO: 709626 - RNA, 64 nt, hsa; identical to SEQ ID NO: 36366

SEQ ID NO: 709627 - RNA, 64 nt, hsa; identical to SEQ ID NO: 36367

SEQ ID NO: 709628 - RNA, 64 nt, hsa; identical to SEQ ID NO: 36368

SEQ ID NO: 709629 - RNA, 64 nt, hsa; identical to SEQ ID NO: 36369

SEQ ID NO: 709630 - RNA, 64 nt, hsa; identical to SEQ ID NO: 36370

SEQ ID NO: 709631 - RNA, 64 nt, hsa; identical to SEQ ID NO: 36371

SEQ ID NO: 709632 - RNA, 64 nt, hsa; identical to SEQ ID NO: 36372

SEQ ID NO: 709633 - RNA, 64 nt, hsa; identical to SEQ ID NO: 36373

SEQ ID NO: 709634 - RNA, 64 nt, hsa; identical to SEQ ID NO: 36374

SEQ ID NO: 709635 - RNA, 64 nt, hsa; identical to SEQ ID NO: 36375

SEQ ID NO: 709636 - RNA, 64 nt, hsa; identical to SEQ ID NO: 36376

SEQ ID NO: 709637 - RNA, 64 nt, hsa; identical to SEQ ID NO: 36377

SEQ ID NO: 709638 - RNA, 64 nt, hsa; identical to SEQ ID NO: 36378

SEQ ID NO: 709639 - RNA, 64 nt, hsa; identical to SEQ ID NO: 36379

SEQ ID NO: 709640 - RNA, 64 nt, hsa; identical to SEQ ID NO: 36380

SEQ ID NO: 709641 - RNA, 64 nt, hsa; identical to SEQ ID NO: 36381

SEQ ID NO: 709642 - RNA, 64 nt, hsa; identical to SEQ ID NO: 36382

SEQ ID NO: 709643 - RNA, 64 nt, hsa; identical to SEQ ID NO: 36383

SEQ ID NO: 709644 - RNA, 64 nt, hsa; identical to SEQ ID NO: 36384

SEQ ID NO: 709645 - RNA, 64 nt, hsa; identical to SEQ ID NO: 36385

SEQ ID NO: 709646 - RNA, 64 nt, hsa; identical to SEQ ID NO: 36386

SEQ ID NO: 709647 - RNA, 64 nt, hsa; identical to SEQ ID NO: 36387

SEQ ID NO: 709648 - RNA, 64 nt, hsa; identical to SEQ ID NO: 36388

SEQ ID NO: 709649 - RNA, 64 nt, hsa; identical to SEQ ID NO: 36389

SEQ ID NO: 709650 - RNA, 64 nt, hsa; identical to SEQ ID NO: 36390

SEQ ID NO: 709651 - RNA, 64 nt, hsa; identical to SEQ ID NO: 36391

SEQ ID NO: 709652 - RNA, 64 nt, hsa; identical to SEQ ID NO: 36392

SEQ ID NO: 709653 - RNA, 64 nt, hsa; identical to SEQ ID NO: 36393

SEQ ID NO: 709654 - RNA, 64 nt, hsa; identical to SEQ ID NO: 36394

SEQ ID NO: 709655 - RNA, 64 nt, hsa; identical to SEQ ID NO: 36395

SEQ ID NO: 709656 - RNA, 64 nt, hsa; identical to SEQ ID NO: 36396

SEQ ID NO: 709657 - RNA, 64 nt, hsa; identical to SEQ ID NO: 36397

SEQ ID NO: 709658 - RNA, 64 nt, hsa; identical to SEQ ID NO: 36398

SEQ ID NO: 709659 - RNA, 64 nt, hsa; identical to SEQ ID NO: 36399

SEQ ID NO: 709660 - RNA, 64 nt, hsa; identical to SEQ ID NO: 36400

SEQ ID NO: 709661 - RNA, 64 nt, hsa; identical to SEQ ID NO: 36401

SEQ ID NO: 709662 - RNA, 64 nt, hsa; identical to SEQ ID NO: 36402

SEQ ID NO: 709663 - RNA, 64 nt, hsa; identical to SEQ ID NO: 36403

SEQ ID NO: 709664 - RNA, 64 nt, hsa; identical to SEQ ID NO: 36404

SEQ ID NO: 709665 - RNA, 64 nt, hsa; identical to SEQ ID NO: 36405

SEQ ID NO: 709666 - RNA, 64 nt, hsa; identical to SEQ ID NO: 36406

SEQ ID NO: 709667 - RNA, 64 nt, hsa; identical to SEQ ID NO: 36407

SEQ ID NO: 709668 - RNA, 64 nt, hsa; identical to SEQ ID NO: 36408

SEQ ID NO: 709669 - RNA, 64 nt, hsa; identical to SEQ ID NO: 36409

SEQ ID NO: 709670 - RNA, 64 nt, hsa; identical to SEQ ID NO: 36410

SEQ ID NO: 709671 - RNA, 64 nt, hsa; identical to SEQ ID NO: 36411

SEQ ID NO: 709672 - RNA, 64 nt, hsa; identical to SEQ ID NO: 36412

SEQ ID NO: 709673 - RNA, 64 nt, hsa; identical to SEQ ID NO: 36413

SEQ ID NO: 709674 - RNA, 64 nt, hsa; identical to SEQ ID NO: 36414

SEQ ID NO: 709675 - RNA, 64 nt, hsa; identical to SEQ ID NO: 36415

SEQ ID NO: 709676 - RNA, 64 nt, hsa; identical to SEQ ID NO: 36416

SEQ ID NO: 709677 - RNA, 64 nt, hsa; identical to SEQ ID NO: 36417

SEQ ID NO: 709678 - RNA, 64 nt, hsa; identical to SEQ ID NO: 36418

SEQ ID NO: 709679 - RNA, 64 nt, hsa; identical to SEQ ID NO: 36419

SEQ ID NO: 709680 - RNA, 64 nt, hsa; identical to SEQ ID NO: 36420

SEQ ID NO: 709681 - RNA, 64 nt, hsa; identical to SEQ ID NO: 36421

SEQ ID NO: 709682 - RNA, 64 nt, hsa; identical to SEQ ID NO: 36422

SEQ ID NO: 709683 - RNA, 64 nt, hsa; identical to SEQ ID NO: 36423

SEQ ID NO: 709684 - RNA, 64 nt, hsa; identical to SEQ ID NO: 36424

SEQ ID NO: 709685 - RNA, 64 nt, hsa; identical to SEQ ID NO: 36425

SEQ ID NO: 709686 - RNA, 64 nt, hsa; identical to SEQ ID NO: 36426

SEQ ID NO: 709687 - RNA, 64 nt, hsa; identical to SEQ ID NO: 36427

SEQ ID NO: 709688 - RNA, 64 nt, hsa; identical to SEQ ID NO: 36428

SEQ ID NO: 709689 - RNA, 64 nt, hsa; identical to SEQ ID NO: 36429

SEQ ID NO: 709690 - RNA, 64 nt, hsa; identical to SEQ ID NO: 36430

SEQ ID NO: 709691 - RNA, 64 nt, hsa; identical to SEQ ID NO: 36431

SEQ ID NO: 709692 - RNA, 64 nt, hsa; identical to SEQ ID NO: 36432

SEQ ID NO: 709693 - RNA, 64 nt, hsa; identical to SEQ ID NO: 36433

SEQ ID NO: 709694 - RNA, 64 nt, hsa; identical to SEQ ID NO: 36434

SEQ ID NO: 709695 - RNA, 64 nt, hsa; identical to SEQ ID NO: 36435

SEQ ID NO: 709696 - RNA, 64 nt, hsa; identical to SEQ ID NO: 36436

SEQ ID NO: 709697 - RNA, 64 nt, hsa; identical to SEQ ID NO: 36437

SEQ ID NO: 709698 - RNA, 64 nt, hsa; identical to SEQ ID NO: 36438

SEQ ID NO: 709699 - RNA, 64 nt, hsa; identical to SEQ ID NO: 36439

SEQ ID NO: 709700 - RNA, 64 nt, hsa; identical to SEQ ID NO: 36440

SEQ ID NO: 709701 - RNA, 64 nt, hsa; identical to SEQ ID NO: 36441

SEQ ID NO: 709702 - RNA, 64 nt, hsa; identical to SEQ ID NO: 36442

SEQ ID NO: 709703 - RNA, 64 nt, hsa; identical to SEQ ID NO: 36443

SEQ ID NO: 709704 - RNA, 64 nt, hsa; identical to SEQ ID NO: 36444

SEQ ID NO: 709705 - RNA, 64 nt, hsa; identical to SEQ ID NO: 36445

SEQ ID NO: 709706 - RNA, 64 nt, hsa; identical to SEQ ID NO: 36446

SEQ ID NO: 709707 - RNA, 64 nt, hsa; identical to SEQ ID NO: 36447

SEQ ID NO: 709708 - RNA, 64 nt, hsa; identical to SEQ ID NO: 36448

SEQ ID NO: 709709 - RNA, 64 nt, hsa; identical to SEQ ID NO: 36449

SEQ ID NO: 709710 - RNA, 64 nt, hsa; identical to SEQ ID NO: 36450

SEQ ID NO: 709711 - RNA, 64 nt, hsa; identical to SEQ ID NO: 36451

SEQ ID NO: 709712 - RNA, 64 nt, hsa; identical to SEQ ID NO: 36452

SEQ ID NO: 709713 - RNA, 64 nt, hsa; identical to SEQ ID NO: 36453

SEQ ID NO: 709714 - RNA, 64 nt, hsa; identical to SEQ ID NO: 36454

SEQ ID NO: 709715 - RNA, 64 nt, hsa; identical to SEQ ID NO: 36455

SEQ ID NO: 709716 - RNA, 64 nt, hsa; identical to SEQ ID NO: 36456

SEQ ID NO: 709717 - RNA, 64 nt, hsa; identical to SEQ ID NO: 36457

SEQ ID NO: 709718 - RNA, 64 nt, hsa; identical to SEQ ID NO: 36458

SEQ ID NO: 709719 - RNA, 64 nt, hsa; identical to SEQ ID NO: 36459

SEQ ID NO: 709720 - RNA, 64 nt, hsa; identical to SEQ ID NO: 36460

SEQ ID NO: 709721 - RNA, 64 nt, hsa; identical to SEQ ID NO: 36461

SEQ ID NO: 709722 - RNA, 64 nt, hsa; identical to SEQ ID NO: 36462

SEQ ID NO: 709723 - RNA, 64 nt, hsa; identical to SEQ ID NO: 36463

SEQ ID NO: 709724 - RNA, 64 nt, hsa; identical to SEQ ID NO: 36464

SEQ ID NO: 709725 - RNA, 64 nt, hsa; identical to SEQ ID NO: 36465

SEQ ID NO: 709726 - RNA, 64 nt, hsa; identical to SEQ ID NO: 36466

SEQ ID NO: 709727 - RNA, 64 nt, hsa; identical to SEQ ID NO: 36467

SEQ ID NO: 709728 - RNA, 64 nt, hsa; identical to SEQ ID NO: 36468

SEQ ID NO: 709729 - RNA, 64 nt, hsa; identical to SEQ ID NO: 36469

SEQ ID NO: 709730 - RNA, 64 nt, hsa; identical to SEQ ID NO: 36470

SEQ ID NO: 709731 - RNA, 64 nt, hsa; identical to SEQ ID NO: 36471

SEQ ID NO: 709732 - RNA, 64 nt, hsa; identical to SEQ ID NO: 36472

SEQ ID NO: 709733 - RNA, 64 nt, hsa; identical to SEQ ID NO: 36473

SEQ ID NO: 709734 - RNA, 64 nt, hsa; identical to SEQ ID NO: 36474

SEQ ID NO: 709735 - RNA, 64 nt, hsa; identical to SEQ ID NO: 36475

SEQ ID NO: 709736 - RNA, 64 nt, hsa; identical to SEQ ID NO: 36476

SEQ ID NO: 709737 - RNA, 64 nt, hsa; identical to SEQ ID NO: 36477

SEQ ID NO: 709738 - RNA, 64 nt, hsa; identical to SEQ ID NO: 36478

SEQ ID NO: 709739 - RNA, 64 nt, hsa; identical to SEQ ID NO: 36479

SEQ ID NO: 709740 - RNA, 64 nt, hsa; identical to SEQ ID NO: 36480

SEQ ID NO: 709741 - RNA, 64 nt, hsa; identical to SEQ ID NO: 36481

SEQ ID NO: 709742 - RNA, 64 nt, hsa; identical to SEQ ID NO: 36482

SEQ ID NO: 709743 - RNA, 64 nt, hsa; identical to SEQ ID NO: 36483

SEQ ID NO: 709744 - RNA, 64 nt, hsa; identical to SEQ ID NO: 36484

SEQ ID NO: 709745 - RNA, 64 nt, hsa; identical to SEQ ID NO: 36485

SEQ ID NO: 709746 - RNA, 64 nt, hsa; identical to SEQ ID NO: 36486

SEQ ID NO: 709747 - RNA, 64 nt, hsa; identical to SEQ ID NO: 36487

SEQ ID NO: 709748 - RNA, 64 nt, hsa; identical to SEQ ID NO: 36488

SEQ ID NO: 709749 - RNA, 64 nt, hsa; identical to SEQ ID NO: 36489

SEQ ID NO: 709750 - RNA, 64 nt, hsa; identical to SEQ ID NO: 36490

SEQ ID NO: 709751 - RNA, 64 nt, hsa; identical to SEQ ID NO: 36491

SEQ ID NO: 709752 - RNA, 64 nt, hsa; identical to SEQ ID NO: 36492

SEQ ID NO: 709753 - RNA, 64 nt, hsa; identical to SEQ ID NO: 36493

SEQ ID NO: 709754 - RNA, 64 nt, hsa; identical to SEQ ID NO: 36494

SEQ ID NO: 709755 - RNA, 64 nt, hsa; identical to SEQ ID NO: 36495

SEQ ID NO: 709756 - RNA, 64 nt, hsa; identical to SEQ ID NO: 36496

SEQ ID NO: 709757 - RNA, 64 nt, hsa; identical to SEQ ID NO: 36497

SEQ ID NO: 709758 - RNA, 64 nt, hsa; identical to SEQ ID NO: 36498

SEQ ID NO: 709759 - RNA, 64 nt, hsa; identical to SEQ ID NO: 36499

SEQ ID NO: 709760 - RNA, 64 nt, hsa; identical to SEQ ID NO: 36500

SEQ ID NO: 709761 - RNA, 64 nt, hsa; identical to SEQ ID NO: 36501

SEQ ID NO: 709762 - RNA, 64 nt, hsa; identical to SEQ ID NO: 36502

SEQ ID NO: 709763 - RNA, 64 nt, hsa; identical to SEQ ID NO: 36503

SEQ ID NO: 709764 - RNA, 64 nt, hsa; identical to SEQ ID NO: 36504

SEQ ID NO: 709765 - RNA, 64 nt, hsa; identical to SEQ ID NO: 36505

SEQ ID NO: 709766 - RNA, 64 nt, hsa; identical to SEQ ID NO: 36506

SEQ ID NO: 709767 - RNA, 64 nt, hsa; identical to SEQ ID NO: 36507

SEQ ID NO: 709768 - RNA, 64 nt, hsa; identical to SEQ ID NO: 36508

SEQ ID NO: 709769 - RNA, 64 nt, hsa; identical to SEQ ID NO: 36509

SEQ ID NO: 709770 - RNA, 64 nt, hsa; identical to SEQ ID NO: 36510

SEQ ID NO: 709771 - RNA, 64 nt, hsa; identical to SEQ ID NO: 36511

SEQ ID NO: 709772 - RNA, 64 nt, hsa; identical to SEQ ID NO: 36512

SEQ ID NO: 709773 - RNA, 64 nt, hsa; identical to SEQ ID NO: 36513

SEQ ID NO: 709774 - RNA, 64 nt, hsa; identical to SEQ ID NO: 36514

SEQ ID NO: 709775 - RNA, 64 nt, hsa; identical to SEQ ID NO: 36515

SEQ ID NO: 709776 - RNA, 64 nt, hsa; identical to SEQ ID NO: 36516

SEQ ID NO: 709777 - RNA, 64 nt, hsa; identical to SEQ ID NO: 36517

SEQ ID NO: 709778 - RNA, 64 nt, hsa; identical to SEQ ID NO: 36518

SEQ ID NO: 709779 - RNA, 64 nt, hsa; identical to SEQ ID NO: 36519

SEQ ID NO: 709780 - RNA, 64 nt, hsa; identical to SEQ ID NO: 36520

SEQ ID NO: 709781 - RNA, 64 nt, hsa; identical to SEQ ID NO: 36521

SEQ ID NO: 709782 - RNA, 64 nt, hsa; identical to SEQ ID NO: 36522

SEQ ID NO: 709783 - RNA, 64 nt, hsa; identical to SEQ ID NO: 36523

SEQ ID NO: 709784 - RNA, 64 nt, hsa; identical to SEQ ID NO: 36524

SEQ ID NO: 709785 - RNA, 64 nt, hsa; identical to SEQ ID NO: 36525

SEQ ID NO: 709786 - RNA, 64 nt, hsa; identical to SEQ ID NO: 36526

SEQ ID NO: 709787 - RNA, 64 nt, hsa; identical to SEQ ID NO: 36527

SEQ ID NO: 709788 - RNA, 64 nt, hsa; identical to SEQ ID NO: 36528

SEQ ID NO: 709789 - RNA, 64 nt, hsa; identical to SEQ ID NO: 36529

SEQ ID NO: 709790 - RNA, 64 nt, hsa; identical to SEQ ID NO: 36530

SEQ ID NO: 709791 - RNA, 64 nt, hsa; identical to SEQ ID NO: 36531

SEQ ID NO: 709792 - RNA, 64 nt, hsa; identical to SEQ ID NO: 36532

SEQ ID NO: 709793 - RNA, 64 nt, hsa; identical to SEQ ID NO: 36533

SEQ ID NO: 709794 - RNA, 64 nt, hsa; identical to SEQ ID NO: 36534

SEQ ID NO: 709795 - RNA, 64 nt, hsa; identical to SEQ ID NO: 36535

SEQ ID NO: 709796 - RNA, 64 nt, hsa; identical to SEQ ID NO: 36536

SEQ ID NO: 709797 - RNA, 64 nt, hsa; identical to SEQ ID NO: 36537

SEQ ID NO: 709798 - RNA, 64 nt, hsa; identical to SEQ ID NO: 36538

SEQ ID NO: 709799 - RNA, 64 nt, hsa; identical to SEQ ID NO: 36539

SEQ ID NO: 709800 - RNA, 64 nt, hsa; identical to SEQ ID NO: 36540

SEQ ID NO: 709801 - RNA, 64 nt, hsa; identical to SEQ ID NO: 36541

SEQ ID NO: 709802 - RNA, 64 nt, hsa; identical to SEQ ID NO: 36542

SEQ ID NO: 709803 - RNA, 64 nt, hsa; identical to SEQ ID NO: 36543

SEQ ID NO: 709804 - RNA, 64 nt, hsa; identical to SEQ ID NO: 36544

SEQ ID NO: 709805 - RNA, 64 nt, hsa; identical to SEQ ID NO: 36545

SEQ ID NO: 709806 - RNA, 64 nt, hsa; identical to SEQ ID NO: 36546

SEQ ID NO: 709807 - RNA, 64 nt, hsa; identical to SEQ ID NO: 36547

SEQ ID NO: 709808 - RNA, 64 nt, hsa; identical to SEQ ID NO: 36548

SEQ ID NO: 709809 - RNA, 64 nt, hsa; identical to SEQ ID NO: 36549

SEQ ID NO: 709810 - RNA, 64 nt, hsa; identical to SEQ ID NO: 36550

SEQ ID NO: 709811 - RNA, 64 nt, hsa; identical to SEQ ID NO: 36551

SEQ ID NO: 709812 - RNA, 64 nt, hsa; identical to SEQ ID NO: 36552

SEQ ID NO: 709813 - RNA, 64 nt, hsa; identical to SEQ ID NO: 36553

SEQ ID NO: 709814 - RNA, 64 nt, hsa; identical to SEQ ID NO: 36554

SEQ ID NO: 709815 - RNA, 64 nt, hsa; identical to SEQ ID NO: 36555

SEQ ID NO: 709816 - RNA, 64 nt, hsa; identical to SEQ ID NO: 36556

SEQ ID NO: 709817 - RNA, 64 nt, hsa; identical to SEQ ID NO: 36557

SEQ ID NO: 709818 - RNA, 64 nt, hsa; identical to SEQ ID NO: 36558

SEQ ID NO: 709819 - RNA, 64 nt, hsa; identical to SEQ ID NO: 36559

SEQ ID NO: 709820 - RNA, 64 nt, hsa; identical to SEQ ID NO: 36560

SEQ ID NO: 709821 - RNA, 64 nt, hsa; identical to SEQ ID NO: 36561

SEQ ID NO: 709822 - RNA, 64 nt, hsa; identical to SEQ ID NO: 36562

SEQ ID NO: 709823 - RNA, 64 nt, hsa; identical to SEQ ID NO: 36563

SEQ ID NO: 709824 - RNA, 64 nt, hsa; identical to SEQ ID NO: 36564

SEQ ID NO: 709825 - RNA, 64 nt, hsa; identical to SEQ ID NO: 36565

SEQ ID NO: 709826 - RNA, 64 nt, hsa; identical to SEQ ID NO: 36566

SEQ ID NO: 709827 - RNA, 64 nt, hsa; identical to SEQ ID NO: 36567

SEQ ID NO: 709828 - RNA, 64 nt, hsa; identical to SEQ ID NO: 36568

SEQ ID NO: 709829 - RNA, 64 nt, hsa; identical to SEQ ID NO: 36569

SEQ ID NO: 709830 - RNA, 64 nt, hsa; identical to SEQ ID NO: 36570

SEQ ID NO: 709831 - RNA, 64 nt, hsa; identical to SEQ ID NO: 36571

SEQ ID NO: 709832 - RNA, 64 nt, hsa; identical to SEQ ID NO: 36572

SEQ ID NO: 709833 - RNA, 64 nt, hsa; identical to SEQ ID NO: 36573

SEQ ID NO: 709834 - RNA, 64 nt, hsa; identical to SEQ ID NO: 36574

SEQ ID NO: 709835 - RNA, 64 nt, hsa; identical to SEQ ID NO: 36575

SEQ ID NO: 709836 - RNA, 64 nt, hsa; identical to SEQ ID NO: 36576

SEQ ID NO: 709837 - RNA, 64 nt, hsa; identical to SEQ ID NO: 36577

SEQ ID NO: 709838 - RNA, 64 nt, hsa; identical to SEQ ID NO: 36578

SEQ ID NO: 709839 - RNA, 64 nt, hsa; identical to SEQ ID NO: 36579

SEQ ID NO: 709840 - RNA, 64 nt, hsa; identical to SEQ ID NO: 36580

SEQ ID NO: 709841 - RNA, 64 nt, hsa; identical to SEQ ID NO: 36581

SEQ ID NO: 709842 - RNA, 64 nt, hsa; identical to SEQ ID NO: 36582

SEQ ID NO: 709843 - RNA, 64 nt, hsa; identical to SEQ ID NO: 36583

SEQ ID NO: 709844 - RNA, 64 nt, hsa; identical to SEQ ID NO: 36584

SEQ ID NO: 709845 - RNA, 64 nt, hsa; identical to SEQ ID NO: 36585

SEQ ID NO: 709846 - RNA, 64 nt, hsa; identical to SEQ ID NO: 36586

SEQ ID NO: 709847 - RNA, 64 nt, hsa; identical to SEQ ID NO: 36587

SEQ ID NO: 709848 - RNA, 64 nt, hsa; identical to SEQ ID NO: 36588

SEQ ID NO: 709849 - RNA, 64 nt, hsa; identical to SEQ ID NO: 36589

SEQ ID NO: 709850 - RNA, 64 nt, hsa; identical to SEQ ID NO: 36590

SEQ ID NO: 709851 - RNA, 64 nt, hsa; identical to SEQ ID NO: 36591

SEQ ID NO: 709852 - RNA, 64 nt, hsa; identical to SEQ ID NO: 36592

SEQ ID NO: 709853 - RNA, 64 nt, hsa; identical to SEQ ID NO: 36593

SEQ ID NO: 709854 - RNA, 64 nt, hsa; identical to SEQ ID NO: 36594

SEQ ID NO: 709855 - RNA, 64 nt, hsa; identical to SEQ ID NO: 36595

SEQ ID NO: 709856 - RNA, 64 nt, hsa; identical to SEQ ID NO: 36596

SEQ ID NO: 709857 - RNA, 64 nt, hsa; identical to SEQ ID NO: 36597

SEQ ID NO: 709858 - RNA, 64 nt, hsa; identical to SEQ ID NO: 36598

SEQ ID NO: 709859 - RNA, 64 nt, hsa; identical to SEQ ID NO: 36599

SEQ ID NO: 709860 - RNA, 64 nt, hsa; identical to SEQ ID NO: 36600

SEQ ID NO: 709861 - RNA, 64 nt, hsa; identical to SEQ ID NO: 36601

SEQ ID NO: 709862 - RNA, 64 nt, hsa; identical to SEQ ID NO: 36602

SEQ ID NO: 709863 - RNA, 64 nt, hsa; identical to SEQ ID NO: 36603

SEQ ID NO: 709864 - RNA, 64 nt, hsa; identical to SEQ ID NO: 36604

SEQ ID NO: 709865 - RNA, 64 nt, hsa; identical to SEQ ID NO: 36605

SEQ ID NO: 709866 - RNA, 64 nt, hsa; identical to SEQ ID NO: 36606

SEQ ID NO: 709867 - RNA, 64 nt, hsa; identical to SEQ ID NO: 36607

SEQ ID NO: 709868 - RNA, 64 nt, hsa; identical to SEQ ID NO: 36608

SEQ ID NO: 709869 - RNA, 64 nt, hsa; identical to SEQ ID NO: 36609

SEQ ID NO: 709870 - RNA, 64 nt, hsa; identical to SEQ ID NO: 36610

SEQ ID NO: 709871 - RNA, 64 nt, hsa; identical to SEQ ID NO: 36611

SEQ ID NO: 709872 - RNA, 64 nt, hsa; identical to SEQ ID NO: 36612

SEQ ID NO: 709873 - RNA, 64 nt, hsa; identical to SEQ ID NO: 36613

SEQ ID NO: 709874 - RNA, 64 nt, hsa; identical to SEQ ID NO: 36614

SEQ ID NO: 709875 - RNA, 64 nt, hsa; identical to SEQ ID NO: 36615

SEQ ID NO: 709876 - RNA, 64 nt, hsa; identical to SEQ ID NO: 36616

SEQ ID NO: 709877 - RNA, 64 nt, hsa; identical to SEQ ID NO: 36617

SEQ ID NO: 709878 - RNA, 64 nt, hsa; identical to SEQ ID NO: 36618

SEQ ID NO: 709879 - RNA, 64 nt, hsa; identical to SEQ ID NO: 36619

SEQ ID NO: 709880 - RNA, 64 nt, hsa; identical to SEQ ID NO: 36620

SEQ ID NO: 709881 - RNA, 64 nt, hsa; identical to SEQ ID NO: 36621

SEQ ID NO: 709882 - RNA, 64 nt, hsa; identical to SEQ ID NO: 36622

SEQ ID NO: 709883 - RNA, 64 nt, hsa; identical to SEQ ID NO: 36623

SEQ ID NO: 709884 - RNA, 64 nt, hsa; identical to SEQ ID NO: 36624

SEQ ID NO: 709885 - RNA, 64 nt, hsa; identical to SEQ ID NO: 36625

SEQ ID NO: 709886 - RNA, 64 nt, hsa; identical to SEQ ID NO: 36626

SEQ ID NO: 709887 - RNA, 64 nt, hsa; identical to SEQ ID NO: 36627

SEQ ID NO: 709888 - RNA, 64 nt, hsa; identical to SEQ ID NO: 36628

SEQ ID NO: 709889 - RNA, 64 nt, hsa; identical to SEQ ID NO: 36629

SEQ ID NO: 709890 - RNA, 64 nt, hsa; identical to SEQ ID NO: 36630

SEQ ID NO: 709891 - RNA, 64 nt, hsa; identical to SEQ ID NO: 36631

SEQ ID NO: 709892 - RNA, 64 nt, hsa; identical to SEQ ID NO: 36632

SEQ ID NO: 709893 - RNA, 64 nt, hsa; identical to SEQ ID NO: 36633

SEQ ID NO: 709894 - RNA, 64 nt, hsa; identical to SEQ ID NO: 36634

SEQ ID NO: 709895 - RNA, 64 nt, hsa; identical to SEQ ID NO: 36635

SEQ ID NO: 709896 - RNA, 64 nt, hsa; identical to SEQ ID NO: 36636

SEQ ID NO: 709897 - RNA, 64 nt, hsa; identical to SEQ ID NO: 36637

SEQ ID NO: 709898 - RNA, 64 nt, hsa; identical to SEQ ID NO: 36638

SEQ ID NO: 709899 - RNA, 64 nt, hsa; identical to SEQ ID NO: 36639

SEQ ID NO: 709900 - RNA, 64 nt, hsa; identical to SEQ ID NO: 36640

SEQ ID NO: 709901 - RNA, 64 nt, hsa; identical to SEQ ID NO: 36641

SEQ ID NO: 709902 - RNA, 64 nt, hsa; identical to SEQ ID NO: 36642

SEQ ID NO: 709903 - RNA, 64 nt, hsa; identical to SEQ ID NO: 36643

SEQ ID NO: 709904 - RNA, 64 nt, hsa; identical to SEQ ID NO: 36644

SEQ ID NO: 709905 - RNA, 64 nt, hsa; identical to SEQ ID NO: 36645

SEQ ID NO: 709906 - RNA, 64 nt, hsa; identical to SEQ ID NO: 36646

SEQ ID NO: 709907 - RNA, 64 nt, hsa; identical to SEQ ID NO: 36647

SEQ ID NO: 709908 - RNA, 64 nt, hsa; identical to SEQ ID NO: 36648

SEQ ID NO: 709909 - RNA, 64 nt, hsa; identical to SEQ ID NO: 36649

SEQ ID NO: 709910 - RNA, 64 nt, hsa; identical to SEQ ID NO: 36650

SEQ ID NO: 709911 - RNA, 64 nt, hsa; identical to SEQ ID NO: 36651

SEQ ID NO: 709912 - RNA, 64 nt, hsa; identical to SEQ ID NO: 36652

SEQ ID NO: 709913 - RNA, 64 nt, hsa; identical to SEQ ID NO: 36653

SEQ ID NO: 709914 - RNA, 64 nt, hsa; identical to SEQ ID NO: 36654

SEQ ID NO: 709915 - RNA, 64 nt, hsa; identical to SEQ ID NO: 36655

SEQ ID NO: 709916 - RNA, 64 nt, hsa; identical to SEQ ID NO: 36656

SEQ ID NO: 709917 - RNA, 64 nt, hsa; identical to SEQ ID NO: 36657

SEQ ID NO: 709918 - RNA, 64 nt, hsa; identical to SEQ ID NO: 36658

SEQ ID NO: 709919 - RNA, 64 nt, hsa; identical to SEQ ID NO: 36659

SEQ ID NO: 709920 - RNA, 64 nt, hsa; identical to SEQ ID NO: 36660

SEQ ID NO: 709921 - RNA, 64 nt, hsa; identical to SEQ ID NO: 36661

SEQ ID NO: 709922 - RNA, 64 nt, hsa; identical to SEQ ID NO: 36662

SEQ ID NO: 709923 - RNA, 64 nt, hsa; identical to SEQ ID NO: 36663

SEQ ID NO: 709924 - RNA, 64 nt, hsa; identical to SEQ ID NO: 36664

SEQ ID NO: 709925 - RNA, 64 nt, hsa; identical to SEQ ID NO: 36665

SEQ ID NO: 709926 - RNA, 64 nt, hsa; identical to SEQ ID NO: 36666

SEQ ID NO: 709927 - RNA, 64 nt, hsa; identical to SEQ ID NO: 36667

SEQ ID NO: 709928 - RNA, 64 nt, hsa; identical to SEQ ID NO: 36668

SEQ ID NO: 709929 - RNA, 64 nt, hsa; identical to SEQ ID NO: 36669

SEQ ID NO: 709930 - RNA, 64 nt, hsa; identical to SEQ ID NO: 36670

SEQ ID NO: 709931 - RNA, 64 nt, hsa; identical to SEQ ID NO: 36671

SEQ ID NO: 709932 - RNA, 64 nt, hsa; identical to SEQ ID NO: 36672

SEQ ID NO: 709933 - RNA, 64 nt, hsa; identical to SEQ ID NO: 36673

SEQ ID NO: 709934 - RNA, 64 nt, hsa; identical to SEQ ID NO: 36674

SEQ ID NO: 709935 - RNA, 64 nt, hsa; identical to SEQ ID NO: 36675

SEQ ID NO: 709936 - RNA, 64 nt, hsa; identical to SEQ ID NO: 36676

SEQ ID NO: 709937 - RNA, 64 nt, hsa; identical to SEQ ID NO: 36677

SEQ ID NO: 709938 - RNA, 64 nt, hsa; identical to SEQ ID NO: 36678

SEQ ID NO: 709939 - RNA, 64 nt, hsa; identical to SEQ ID NO: 36679

SEQ ID NO: 709940 - RNA, 64 nt, hsa; identical to SEQ ID NO: 36680

SEQ ID NO: 709941 - RNA, 64 nt, hsa; identical to SEQ ID NO: 36681

SEQ ID NO: 709942 - RNA, 64 nt, hsa; identical to SEQ ID NO: 36682

SEQ ID NO: 709943 - RNA, 64 nt, hsa; identical to SEQ ID NO: 36683

SEQ ID NO: 709944 - RNA, 64 nt, hsa; identical to SEQ ID NO: 36684

SEQ ID NO: 709945 - RNA, 64 nt, hsa; identical to SEQ ID NO: 36685

SEQ ID NO: 709946 - RNA, 64 nt, hsa; identical to SEQ ID NO: 36686

SEQ ID NO: 709947 - RNA, 64 nt, hsa; identical to SEQ ID NO: 36687

SEQ ID NO: 709948 - RNA, 64 nt, hsa; identical to SEQ ID NO: 36688

SEQ ID NO: 709949 - RNA, 64 nt, hsa; identical to SEQ ID NO: 36689

SEQ ID NO: 709950 - RNA, 64 nt, hsa; identical to SEQ ID NO: 36690

SEQ ID NO: 709951 - RNA, 64 nt, hsa; identical to SEQ ID NO: 36691

SEQ ID NO: 709952 - RNA, 64 nt, hsa; identical to SEQ ID NO: 36692

SEQ ID NO: 709953 - RNA, 64 nt, hsa; identical to SEQ ID NO: 36693

SEQ ID NO: 709954 - RNA, 64 nt, hsa; identical to SEQ ID NO: 36694

SEQ ID NO: 709955 - RNA, 64 nt, hsa; identical to SEQ ID NO: 36695

SEQ ID NO: 709956 - RNA, 64 nt, hsa; identical to SEQ ID NO: 36696

SEQ ID NO: 709957 - RNA, 64 nt, hsa; identical to SEQ ID NO: 36697

SEQ ID NO: 709958 - RNA, 64 nt, hsa; identical to SEQ ID NO: 36698

SEQ ID NO: 709959 - RNA, 64 nt, hsa; identical to SEQ ID NO: 36699

SEQ ID NO: 709960 - RNA, 64 nt, hsa; identical to SEQ ID NO: 36700

SEQ ID NO: 709961 - RNA, 64 nt, hsa; identical to SEQ ID NO: 36701

SEQ ID NO: 709962 - RNA, 64 nt, hsa; identical to SEQ ID NO: 36702

SEQ ID NO: 709963 - RNA, 64 nt, hsa; identical to SEQ ID NO: 36703

SEQ ID NO: 709964 - RNA, 64 nt, hsa; identical to SEQ ID NO: 36704

SEQ ID NO: 709965 - RNA, 64 nt, hsa; identical to SEQ ID NO: 36705

SEQ ID NO: 709966 - RNA, 64 nt, hsa; identical to SEQ ID NO: 36706

SEQ ID NO: 709967 - RNA, 64 nt, hsa; identical to SEQ ID NO: 36707

SEQ ID NO: 709968 - RNA, 64 nt, hsa; identical to SEQ ID NO: 36708

SEQ ID NO: 709969 - RNA, 64 nt, hsa; identical to SEQ ID NO: 36709

SEQ ID NO: 709970 - RNA, 64 nt, hsa; identical to SEQ ID NO: 36710

SEQ ID NO: 709971 - RNA, 64 nt, hsa; identical to SEQ ID NO: 36711

SEQ ID NO: 709972 - RNA, 64 nt, hsa; identical to SEQ ID NO: 36712

SEQ ID NO: 709973 - RNA, 64 nt, hsa; identical to SEQ ID NO: 36713

SEQ ID NO: 709974 - RNA, 64 nt, hsa; identical to SEQ ID NO: 36714

SEQ ID NO: 709975 - RNA, 64 nt, hsa; identical to SEQ ID NO: 36715

SEQ ID NO: 709976 - RNA, 64 nt, hsa; identical to SEQ ID NO: 36716

SEQ ID NO: 709977 - RNA, 64 nt, hsa; identical to SEQ ID NO: 36717

SEQ ID NO: 709978 - RNA, 64 nt, hsa; identical to SEQ ID NO: 36718

SEQ ID NO: 709979 - RNA, 64 nt, hsa; identical to SEQ ID NO: 36719

SEQ ID NO: 709980 - RNA, 64 nt, hsa; identical to SEQ ID NO: 36720

SEQ ID NO: 709981 - RNA, 64 nt, hsa; identical to SEQ ID NO: 36721

SEQ ID NO: 709982 - RNA, 64 nt, hsa; identical to SEQ ID NO: 36722

SEQ ID NO: 709983 - RNA, 64 nt, hsa; identical to SEQ ID NO: 36723

SEQ ID NO: 709984 - RNA, 64 nt, hsa; identical to SEQ ID NO: 36724

SEQ ID NO: 709985 - RNA, 64 nt, hsa; identical to SEQ ID NO: 36725

SEQ ID NO: 709986 - RNA, 64 nt, hsa; identical to SEQ ID NO: 36726

SEQ ID NO: 709987 - RNA, 64 nt, hsa; identical to SEQ ID NO: 36727

SEQ ID NO: 709988 - RNA, 64 nt, hsa; identical to SEQ ID NO: 36728

SEQ ID NO: 709989 - RNA, 64 nt, hsa; identical to SEQ ID NO: 36729

SEQ ID NO: 709990 - RNA, 64 nt, hsa; identical to SEQ ID NO: 36730

SEQ ID NO: 709991 - RNA, 64 nt, hsa; identical to SEQ ID NO: 36731

SEQ ID NO: 709992 - RNA, 64 nt, hsa; identical to SEQ ID NO: 36732

SEQ ID NO: 709993 - RNA, 64 nt, hsa; identical to SEQ ID NO: 36733

SEQ ID NO: 709994 - RNA, 64 nt, hsa; identical to SEQ ID NO: 36734

SEQ ID NO: 709995 - RNA, 64 nt, hsa; identical to SEQ ID NO: 36735

SEQ ID NO: 709996 - RNA, 64 nt, hsa; identical to SEQ ID NO: 36736

SEQ ID NO: 709997 - RNA, 64 nt, hsa; identical to SEQ ID NO: 36737

SEQ ID NO: 709998 - RNA, 64 nt, hsa; identical to SEQ ID NO: 36738

SEQ ID NO: 709999 - RNA, 64 nt, hsa; identical to SEQ ID NO: 36739

SEQ ID NO: 710000 - RNA, 64 nt, hsa; identical to SEQ ID NO: 36740

SEQ ID NO: 710001 - RNA, 64 nt, hsa; identical to SEQ ID NO: 36741

SEQ ID NO: 710002 - RNA, 64 nt, hsa; identical to SEQ ID NO: 36742

SEQ ID NO: 710003 - RNA, 64 nt, hsa; identical to SEQ ID NO: 36743

SEQ ID NO: 710004 - RNA, 64 nt, hsa; identical to SEQ ID NO: 36744

SEQ ID NO: 710005 - RNA, 64 nt, hsa; identical to SEQ ID NO: 36745

SEQ ID NO: 710006 - RNA, 64 nt, hsa; identical to SEQ ID NO: 36746

SEQ ID NO: 710007 - RNA, 64 nt, hsa; identical to SEQ ID NO: 36747

SEQ ID NO: 710008 - RNA, 64 nt, hsa; identical to SEQ ID NO: 36748

SEQ ID NO: 710009 - RNA, 64 nt, hsa; identical to SEQ ID NO: 36749

SEQ ID NO: 710010 - RNA, 64 nt, hsa; identical to SEQ ID NO: 36750

SEQ ID NO: 710011 - RNA, 64 nt, hsa; identical to SEQ ID NO: 36751

SEQ ID NO: 710012 - RNA, 64 nt, hsa; identical to SEQ ID NO: 36752

SEQ ID NO: 710013 - RNA, 64 nt, hsa; identical to SEQ ID NO: 36753

SEQ ID NO: 710014 - RNA, 64 nt, hsa; identical to SEQ ID NO: 36754

SEQ ID NO: 710015 - RNA, 64 nt, hsa; identical to SEQ ID NO: 36755

SEQ ID NO: 710016 - RNA, 64 nt, hsa; identical to SEQ ID NO: 36756

SEQ ID NO: 710017 - RNA, 64 nt, hsa; identical to SEQ ID NO: 36757

SEQ ID NO: 710018 - RNA, 64 nt, hsa; identical to SEQ ID NO: 36758

SEQ ID NO: 710019 - RNA, 64 nt, hsa; identical to SEQ ID NO: 36759

SEQ ID NO: 710020 - RNA, 64 nt, hsa; identical to SEQ ID NO: 36760

SEQ ID NO: 710021 - RNA, 64 nt, hsa; identical to SEQ ID NO: 36761

SEQ ID NO: 710022 - RNA, 64 nt, hsa; identical to SEQ ID NO: 36762

SEQ ID NO: 710023 - RNA, 64 nt, hsa; identical to SEQ ID NO: 36763

SEQ ID NO: 710024 - RNA, 64 nt, hsa; identical to SEQ ID NO: 36764

SEQ ID NO: 710025 - RNA, 64 nt, hsa; identical to SEQ ID NO: 36765

SEQ ID NO: 710026 - RNA, 64 nt, hsa; identical to SEQ ID NO: 36766

SEQ ID NO: 710027 - RNA, 64 nt, hsa; identical to SEQ ID NO: 36767

SEQ ID NO: 710028 - RNA, 64 nt, hsa; identical to SEQ ID NO: 36768

SEQ ID NO: 710029 - RNA, 64 nt, hsa; identical to SEQ ID NO: 36769

SEQ ID NO: 710030 - RNA, 64 nt, hsa; identical to SEQ ID NO: 36770

SEQ ID NO: 710031 - RNA, 64 nt, hsa; identical to SEQ ID NO: 36771

SEQ ID NO: 710032 - RNA, 64 nt, hsa; identical to SEQ ID NO: 36772

SEQ ID NO: 710033 - RNA, 64 nt, hsa; identical to SEQ ID NO: 36773

SEQ ID NO: 710034 - RNA, 64 nt, hsa; identical to SEQ ID NO: 36774

SEQ ID NO: 710035 - RNA, 64 nt, hsa; identical to SEQ ID NO: 36775

SEQ ID NO: 710036 - RNA, 61 nt, hsa; identical to SEQ ID NO: 36776

SEQ ID NO: 710037 - RNA, 62 nt, hsa; identical to SEQ ID NO: 36777

SEQ ID NO: 710038 - RNA, 64 nt, hsa; identical to SEQ ID NO: 36778

SEQ ID NO: 710039 - RNA, 64 nt, hsa; identical to SEQ ID NO: 36779

SEQ ID NO: 710040 - RNA, 64 nt, hsa; identical to SEQ ID NO: 36780

SEQ ID NO: 710041 - RNA, 64 nt, hsa; identical to SEQ ID NO: 36781

SEQ ID NO: 710042 - RNA, 64 nt, hsa; identical to SEQ ID NO: 36782

SEQ ID NO: 710043 - RNA, 64 nt, hsa; identical to SEQ ID NO: 36783

SEQ ID NO: 710044 - RNA, 64 nt, hsa; identical to SEQ ID NO: 36784

SEQ ID NO: 710045 - RNA, 64 nt, hsa; identical to SEQ ID NO: 36785

SEQ ID NO: 710046 - RNA, 64 nt, hsa; identical to SEQ ID NO: 36786

SEQ ID NO: 710047 - RNA, 64 nt, hsa; identical to SEQ ID NO: 36787

SEQ ID NO: 710048 - RNA, 64 nt, hsa; identical to SEQ ID NO: 36788

SEQ ID NO: 710049 - RNA, 64 nt, hsa; identical to SEQ ID NO: 36789

SEQ ID NO: 710050 - RNA, 64 nt, hsa; identical to SEQ ID NO: 36790

SEQ ID NO: 710051 - RNA, 64 nt, hsa; identical to SEQ ID NO: 36791

SEQ ID NO: 710052 - RNA, 64 nt, hsa; identical to SEQ ID NO: 36792

SEQ ID NO: 710053 - RNA, 64 nt, hsa; identical to SEQ ID NO: 36793

SEQ ID NO: 710054 - RNA, 64 nt, hsa; identical to SEQ ID NO: 36794

SEQ ID NO: 710055 - RNA, 64 nt, hsa; identical to SEQ ID NO: 36795

SEQ ID NO: 710056 - RNA, 64 nt, hsa; identical to SEQ ID NO: 36796

SEQ ID NO: 710057 - RNA, 64 nt, hsa; identical to SEQ ID NO: 36797

SEQ ID NO: 710058 - RNA, 64 nt, hsa; identical to SEQ ID NO: 36798

SEQ ID NO: 710059 - RNA, 64 nt, hsa; identical to SEQ ID NO: 36799

SEQ ID NO: 710060 - RNA, 64 nt, hsa; identical to SEQ ID NO: 36800

SEQ ID NO: 710061 - RNA, 64 nt, hsa; identical to SEQ ID NO: 36801

SEQ ID NO: 710062 - RNA, 64 nt, hsa; identical to SEQ ID NO: 36802

SEQ ID NO: 710063 - RNA, 64 nt, hsa; identical to SEQ ID NO: 36803

SEQ ID NO: 710064 - RNA, 64 nt, hsa; identical to SEQ ID NO: 36804

SEQ ID NO: 710065 - RNA, 64 nt, hsa; identical to SEQ ID NO: 36805

SEQ ID NO: 710066 - RNA, 64 nt, hsa; identical to SEQ ID NO: 36806

SEQ ID NO: 710067 - RNA, 64 nt, hsa; identical to SEQ ID NO: 36807

SEQ ID NO: 710068 - RNA, 64 nt, hsa; identical to SEQ ID NO: 36808

SEQ ID NO: 710069 - RNA, 64 nt, hsa; identical to SEQ ID NO: 36809

SEQ ID NO: 710070 - RNA, 64 nt, hsa; identical to SEQ ID NO: 36810

SEQ ID NO: 710071 - RNA, 64 nt, hsa; identical to SEQ ID NO: 36811

SEQ ID NO: 710072 - RNA, 64 nt, hsa; identical to SEQ ID NO: 36812

SEQ ID NO: 710073 - RNA, 64 nt, hsa; identical to SEQ ID NO: 36813

SEQ ID NO: 710074 - RNA, 64 nt, hsa; identical to SEQ ID NO: 36814

SEQ ID NO: 710075 - RNA, 64 nt, hsa; identical to SEQ ID NO: 36815

SEQ ID NO: 710076 - RNA, 64 nt, hsa; identical to SEQ ID NO: 36816

SEQ ID NO: 710077 - RNA, 64 nt, hsa; identical to SEQ ID NO: 36817

SEQ ID NO: 710078 - RNA, 64 nt, hsa; identical to SEQ ID NO: 36818

SEQ ID NO: 710079 - RNA, 64 nt, hsa; identical to SEQ ID NO: 36819

SEQ ID NO: 710080 - RNA, 64 nt, hsa; identical to SEQ ID NO: 36820

SEQ ID NO: 710081 - RNA, 64 nt, hsa; identical to SEQ ID NO: 36821

SEQ ID NO: 710082 - RNA, 64 nt, hsa; identical to SEQ ID NO: 36822

SEQ ID NO: 710083 - RNA, 64 nt, hsa; identical to SEQ ID NO: 36823

SEQ ID NO: 710084 - RNA, 64 nt, hsa; identical to SEQ ID NO: 36824

SEQ ID NO: 710085 - RNA, 64 nt, hsa; identical to SEQ ID NO: 36825

SEQ ID NO: 710086 - RNA, 64 nt, hsa; identical to SEQ ID NO: 36826

SEQ ID NO: 710087 - RNA, 64 nt, hsa; identical to SEQ ID NO: 36827

SEQ ID NO: 710088 - RNA, 64 nt, hsa; identical to SEQ ID NO: 36828

SEQ ID NO: 710089 - RNA, 64 nt, hsa; identical to SEQ ID NO: 36829

SEQ ID NO: 710090 - RNA, 64 nt, hsa; identical to SEQ ID NO: 36830

SEQ ID NO: 710091 - RNA, 64 nt, hsa; identical to SEQ ID NO: 36831

SEQ ID NO: 710092 - RNA, 64 nt, hsa; identical to SEQ ID NO: 36832

SEQ ID NO: 710093 - RNA, 64 nt, hsa; identical to SEQ ID NO: 36833

SEQ ID NO: 710094 - RNA, 64 nt, hsa; identical to SEQ ID NO: 36834

SEQ ID NO: 710095 - RNA, 64 nt, hsa; identical to SEQ ID NO: 36835

SEQ ID NO: 710096 - RNA, 64 nt, hsa; identical to SEQ ID NO: 36836

SEQ ID NO: 710097 - RNA, 64 nt, hsa; identical to SEQ ID NO: 36837

SEQ ID NO: 710098 - RNA, 64 nt, hsa; identical to SEQ ID NO: 36838

SEQ ID NO: 710099 - RNA, 64 nt, hsa; identical to SEQ ID NO: 36839

SEQ ID NO: 710100 - RNA, 64 nt, hsa; identical to SEQ ID NO: 36840

SEQ ID NO: 710101 - RNA, 64 nt, hsa; identical to SEQ ID NO: 36841

SEQ ID NO: 710102 - RNA, 64 nt, hsa; identical to SEQ ID NO: 36842

SEQ ID NO: 710103 - RNA, 64 nt, hsa; identical to SEQ ID NO: 36843

SEQ ID NO: 710104 - RNA, 64 nt, hsa; identical to SEQ ID NO: 36844

SEQ ID NO: 710105 - RNA, 64 nt, hsa; identical to SEQ ID NO: 36845

SEQ ID NO: 710106 - RNA, 64 nt, hsa; identical to SEQ ID NO: 36846

SEQ ID NO: 710107 - RNA, 64 nt, hsa; identical to SEQ ID NO: 36847

SEQ ID NO: 710108 - RNA, 64 nt, hsa; identical to SEQ ID NO: 36848

SEQ ID NO: 710109 - RNA, 64 nt, hsa; identical to SEQ ID NO: 36849

SEQ ID NO: 710110 - RNA, 64 nt, hsa; identical to SEQ ID NO: 36850

SEQ ID NO: 710111 - RNA, 64 nt, hsa; identical to SEQ ID NO: 36851

SEQ ID NO: 710112 - RNA, 64 nt, hsa; identical to SEQ ID NO: 36852

SEQ ID NO: 710113 - RNA, 64 nt, hsa; identical to SEQ ID NO: 36853

SEQ ID NO: 710114 - RNA, 64 nt, hsa; identical to SEQ ID NO: 36854

SEQ ID NO: 710115 - RNA, 64 nt, hsa; identical to SEQ ID NO: 36855

SEQ ID NO: 710116 - RNA, 64 nt, hsa; identical to SEQ ID NO: 36856

SEQ ID NO: 710117 - RNA, 64 nt, hsa; identical to SEQ ID NO: 36857

SEQ ID NO: 710118 - RNA, 64 nt, hsa; identical to SEQ ID NO: 36858

SEQ ID NO: 710119 - RNA, 64 nt, hsa; identical to SEQ ID NO: 36859

SEQ ID NO: 710120 - RNA, 64 nt, hsa; identical to SEQ ID NO: 36860

SEQ ID NO: 710121 - RNA, 64 nt, hsa; identical to SEQ ID NO: 36861

SEQ ID NO: 710122 - RNA, 64 nt, hsa; identical to SEQ ID NO: 36862

SEQ ID NO: 710123 - RNA, 64 nt, hsa; identical to SEQ ID NO: 36863

SEQ ID NO: 710124 - RNA, 64 nt, hsa; identical to SEQ ID NO: 36864

SEQ ID NO: 710125 - RNA, 64 nt, hsa; identical to SEQ ID NO: 36865

SEQ ID NO: 710126 - RNA, 64 nt, hsa; identical to SEQ ID NO: 36866

SEQ ID NO: 710127 - RNA, 64 nt, hsa; identical to SEQ ID NO: 36867

SEQ ID NO: 710128 - RNA, 64 nt, hsa; identical to SEQ ID NO: 36868

SEQ ID NO: 710129 - RNA, 64 nt, hsa; identical to SEQ ID NO: 36869

SEQ ID NO: 710130 - RNA, 64 nt, hsa; identical to SEQ ID NO: 36870

SEQ ID NO: 710131 - RNA, 64 nt, hsa; identical to SEQ ID NO: 36871

SEQ ID NO: 710132 - RNA, 64 nt, hsa; identical to SEQ ID NO: 36872

SEQ ID NO: 710133 - RNA, 64 nt, hsa; identical to SEQ ID NO: 36873

SEQ ID NO: 710134 - RNA, 64 nt, hsa; identical to SEQ ID NO: 36874

SEQ ID NO: 710135 - RNA, 64 nt, hsa; identical to SEQ ID NO: 36875

SEQ ID NO: 710136 - RNA, 64 nt, hsa; identical to SEQ ID NO: 36876

SEQ ID NO: 710137 - RNA, 64 nt, hsa; identical to SEQ ID NO: 36877

SEQ ID NO: 710138 - RNA, 64 nt, hsa; identical to SEQ ID NO: 36878

SEQ ID NO: 710139 - RNA, 64 nt, hsa; identical to SEQ ID NO: 36879

SEQ ID NO: 710140 - RNA, 64 nt, hsa; identical to SEQ ID NO: 36880

SEQ ID NO: 710141 - RNA, 64 nt, hsa; identical to SEQ ID NO: 36881

SEQ ID NO: 710142 - RNA, 64 nt, hsa; identical to SEQ ID NO: 36882

SEQ ID NO: 710143 - RNA, 64 nt, hsa; identical to SEQ ID NO: 36883

SEQ ID NO: 710144 - RNA, 64 nt, hsa; identical to SEQ ID NO: 36884

SEQ ID NO: 710145 - RNA, 64 nt, hsa; identical to SEQ ID NO: 36885

SEQ ID NO: 710146 - RNA, 64 nt, hsa; identical to SEQ ID NO: 36886

SEQ ID NO: 710147 - RNA, 64 nt, hsa; identical to SEQ ID NO: 36887

SEQ ID NO: 710148 - RNA, 64 nt, hsa; identical to SEQ ID NO: 36888

SEQ ID NO: 710149 - RNA, 64 nt, hsa; identical to SEQ ID NO: 36889

SEQ ID NO: 710150 - RNA, 64 nt, hsa; identical to SEQ ID NO: 36890

SEQ ID NO: 710151 - RNA, 64 nt, hsa; identical to SEQ ID NO: 36891

SEQ ID NO: 710152 - RNA, 64 nt, hsa; identical to SEQ ID NO: 36892

SEQ ID NO: 710153 - RNA, 64 nt, hsa; identical to SEQ ID NO: 36893

SEQ ID NO: 710154 - RNA, 64 nt, hsa; identical to SEQ ID NO: 36894

SEQ ID NO: 710155 - RNA, 64 nt, hsa; identical to SEQ ID NO: 36895

SEQ ID NO: 710156 - RNA, 64 nt, hsa; identical to SEQ ID NO: 36896

SEQ ID NO: 710157 - RNA, 64 nt, hsa; identical to SEQ ID NO: 36897

SEQ ID NO: 710158 - RNA, 64 nt, hsa; identical to SEQ ID NO: 36898

SEQ ID NO: 710159 - RNA, 64 nt, hsa; identical to SEQ ID NO: 36899

SEQ ID NO: 710160 - RNA, 64 nt, hsa; identical to SEQ ID NO: 36900

SEQ ID NO: 710161 - RNA, 64 nt, hsa; identical to SEQ ID NO: 36901

SEQ ID NO: 710162 - RNA, 64 nt, hsa; identical to SEQ ID NO: 36902

SEQ ID NO: 710163 - RNA, 64 nt, hsa; identical to SEQ ID NO: 36903

SEQ ID NO: 710164 - RNA, 64 nt, hsa; identical to SEQ ID NO: 36904

SEQ ID NO: 710165 - RNA, 64 nt, hsa; identical to SEQ ID NO: 36905

SEQ ID NO: 710166 - RNA, 64 nt, hsa; identical to SEQ ID NO: 36906

SEQ ID NO: 710167 - RNA, 64 nt, hsa; identical to SEQ ID NO: 36907

SEQ ID NO: 710168 - RNA, 64 nt, hsa; identical to SEQ ID NO: 36908

SEQ ID NO: 710169 - RNA, 64 nt, hsa; identical to SEQ ID NO: 36909

SEQ ID NO: 710170 - RNA, 64 nt, hsa; identical to SEQ ID NO: 36910

SEQ ID NO: 710171 - RNA, 64 nt, hsa; identical to SEQ ID NO: 36911

SEQ ID NO: 710172 - RNA, 64 nt, hsa; identical to SEQ ID NO: 36912

SEQ ID NO: 710173 - RNA, 64 nt, hsa; identical to SEQ ID NO: 36913

SEQ ID NO: 710174 - RNA, 64 nt, hsa; identical to SEQ ID NO: 36914

SEQ ID NO: 710175 - RNA, 64 nt, hsa; identical to SEQ ID NO: 36915

SEQ ID NO: 710176 - RNA, 64 nt, hsa; identical to SEQ ID NO: 36916

SEQ ID NO: 710177 - RNA, 64 nt, hsa; identical to SEQ ID NO: 36917

SEQ ID NO: 710178 - RNA, 64 nt, hsa; identical to SEQ ID NO: 36918

SEQ ID NO: 710179 - RNA, 64 nt, hsa; identical to SEQ ID NO: 36919

SEQ ID NO: 710180 - RNA, 64 nt, hsa; identical to SEQ ID NO: 36920

SEQ ID NO: 710181 - RNA, 64 nt, hsa; identical to SEQ ID NO: 36921

SEQ ID NO: 710182 - RNA, 64 nt, hsa; identical to SEQ ID NO: 36922

SEQ ID NO: 710183 - RNA, 64 nt, hsa; identical to SEQ ID NO: 36923

SEQ ID NO: 710184 - RNA, 64 nt, hsa; identical to SEQ ID NO: 36924

SEQ ID NO: 710185 - RNA, 64 nt, hsa; identical to SEQ ID NO: 36925

SEQ ID NO: 710186 - RNA, 64 nt, hsa; identical to SEQ ID NO: 36926

SEQ ID NO: 710187 - RNA, 64 nt, hsa; identical to SEQ ID NO: 36927

SEQ ID NO: 710188 - RNA, 64 nt, hsa; identical to SEQ ID NO: 36928

SEQ ID NO: 710189 - RNA, 64 nt, hsa; identical to SEQ ID NO: 36929

SEQ ID NO: 710190 - RNA, 64 nt, hsa; identical to SEQ ID NO: 36930

SEQ ID NO: 710191 - RNA, 64 nt, hsa; identical to SEQ ID NO: 36931

SEQ ID NO: 710192 - RNA, 64 nt, hsa; identical to SEQ ID NO: 36932

SEQ ID NO: 710193 - RNA, 64 nt, hsa; identical to SEQ ID NO: 36933

SEQ ID NO: 710194 - RNA, 64 nt, hsa; identical to SEQ ID NO: 36934

SEQ ID NO: 710195 - RNA, 64 nt, hsa; identical to SEQ ID NO: 36935

SEQ ID NO: 710196 - RNA, 64 nt, hsa; identical to SEQ ID NO: 36936

SEQ ID NO: 710197 - RNA, 64 nt, hsa; identical to SEQ ID NO: 36937

SEQ ID NO: 710198 - RNA, 64 nt, hsa; identical to SEQ ID NO: 36938

SEQ ID NO: 710199 - RNA, 64 nt, hsa; identical to SEQ ID NO: 36939

SEQ ID NO: 710200 - RNA, 64 nt, hsa; identical to SEQ ID NO: 36940

SEQ ID NO: 710201 - RNA, 64 nt, hsa; identical to SEQ ID NO: 36941

SEQ ID NO: 710202 - RNA, 64 nt, hsa; identical to SEQ ID NO: 36942

SEQ ID NO: 710203 - RNA, 64 nt, hsa; identical to SEQ ID NO: 36943

SEQ ID NO: 710204 - RNA, 64 nt, hsa; identical to SEQ ID NO: 36944

SEQ ID NO: 710205 - RNA, 64 nt, hsa; identical to SEQ ID NO: 36945

SEQ ID NO: 710206 - RNA, 64 nt, hsa; identical to SEQ ID NO: 36946

SEQ ID NO: 710207 - RNA, 64 nt, hsa; identical to SEQ ID NO: 36947

SEQ ID NO: 710208 - RNA, 64 nt, hsa; identical to SEQ ID NO: 36948

SEQ ID NO: 710209 - RNA, 64 nt, hsa; identical to SEQ ID NO: 36949

SEQ ID NO: 710210 - RNA, 64 nt, hsa; identical to SEQ ID NO: 36950

SEQ ID NO: 710211 - RNA, 64 nt, hsa; identical to SEQ ID NO: 36951

SEQ ID NO: 710212 - RNA, 64 nt, hsa; identical to SEQ ID NO: 36952

SEQ ID NO: 710213 - RNA, 64 nt, hsa; identical to SEQ ID NO: 36953

SEQ ID NO: 710214 - RNA, 64 nt, hsa; identical to SEQ ID NO: 36954

SEQ ID NO: 710215 - RNA, 64 nt, hsa; identical to SEQ ID NO: 36955

SEQ ID NO: 710216 - RNA, 64 nt, hsa; identical to SEQ ID NO: 36956

SEQ ID NO: 710217 - RNA, 64 nt, hsa; identical to SEQ ID NO: 36957

SEQ ID NO: 710218 - RNA, 64 nt, hsa; identical to SEQ ID NO: 36958

SEQ ID NO: 710219 - RNA, 64 nt, hsa; identical to SEQ ID NO: 36959

SEQ ID NO: 710220 - RNA, 64 nt, hsa; identical to SEQ ID NO: 36960

SEQ ID NO: 710221 - RNA, 64 nt, hsa; identical to SEQ ID NO: 36961

SEQ ID NO: 710222 - RNA, 64 nt, hsa; identical to SEQ ID NO: 36962

SEQ ID NO: 710223 - RNA, 64 nt, hsa; identical to SEQ ID NO: 36963

SEQ ID NO: 710224 - RNA, 64 nt, hsa; identical to SEQ ID NO: 36964

SEQ ID NO: 710225 - RNA, 64 nt, hsa; identical to SEQ ID NO: 36965

SEQ ID NO: 710226 - RNA, 64 nt, hsa; identical to SEQ ID NO: 36966

SEQ ID NO: 710227 - RNA, 64 nt, hsa; identical to SEQ ID NO: 36967

SEQ ID NO: 710228 - RNA, 64 nt, hsa; identical to SEQ ID NO: 36968

SEQ ID NO: 710229 - RNA, 64 nt, hsa; identical to SEQ ID NO: 36969

SEQ ID NO: 710230 - RNA, 64 nt, hsa; identical to SEQ ID NO: 36970

SEQ ID NO: 710231 - RNA, 64 nt, hsa; identical to SEQ ID NO: 36971

SEQ ID NO: 710232 - RNA, 64 nt, hsa; identical to SEQ ID NO: 36972

SEQ ID NO: 710233 - RNA, 64 nt, hsa; identical to SEQ ID NO: 36973

SEQ ID NO: 710234 - RNA, 64 nt, hsa; identical to SEQ ID NO: 36974

SEQ ID NO: 710235 - RNA, 64 nt, hsa; identical to SEQ ID NO: 36975

SEQ ID NO: 710236 - RNA, 64 nt, hsa; identical to SEQ ID NO: 36976

SEQ ID NO: 710237 - RNA, 64 nt, hsa; identical to SEQ ID NO: 36977

SEQ ID NO: 710238 - RNA, 64 nt, hsa; identical to SEQ ID NO: 36978

SEQ ID NO: 710239 - RNA, 64 nt, hsa; identical to SEQ ID NO: 36979

SEQ ID NO: 710240 - RNA, 64 nt, hsa; identical to SEQ ID NO: 36980

SEQ ID NO: 710241 - RNA, 64 nt, hsa; identical to SEQ ID NO: 36981

SEQ ID NO: 710242 - RNA, 64 nt, hsa; identical to SEQ ID NO: 36982

SEQ ID NO: 710243 - RNA, 64 nt, hsa; identical to SEQ ID NO: 36983

SEQ ID NO: 710244 - RNA, 64 nt, hsa; identical to SEQ ID NO: 36984

SEQ ID NO: 710245 - RNA, 64 nt, hsa; identical to SEQ ID NO: 36985

SEQ ID NO: 710246 - RNA, 64 nt, hsa; identical to SEQ ID NO: 36986

SEQ ID NO: 710247 - RNA, 64 nt, hsa; identical to SEQ ID NO: 36987

SEQ ID NO: 710248 - RNA, 64 nt, hsa; identical to SEQ ID NO: 36988

SEQ ID NO: 710249 - RNA, 64 nt, hsa; identical to SEQ ID NO: 36989

SEQ ID NO: 710250 - RNA, 64 nt, hsa; identical to SEQ ID NO: 36990

SEQ ID NO: 710251 - RNA, 64 nt, hsa; identical to SEQ ID NO: 36991

SEQ ID NO: 710252 - RNA, 64 nt, hsa; identical to SEQ ID NO: 36992

SEQ ID NO: 710253 - RNA, 64 nt, hsa; identical to SEQ ID NO: 36993

SEQ ID NO: 710254 - RNA, 64 nt, hsa; identical to SEQ ID NO: 36994

SEQ ID NO: 710255 - RNA, 64 nt, hsa; identical to SEQ ID NO: 36995

SEQ ID NO: 710256 - RNA, 64 nt, hsa; identical to SEQ ID NO: 36996

SEQ ID NO: 710257 - RNA, 64 nt, hsa; identical to SEQ ID NO: 36997

SEQ ID NO: 710258 - RNA, 64 nt, hsa; identical to SEQ ID NO: 36998

SEQ ID NO: 710259 - RNA, 64 nt, hsa; identical to SEQ ID NO: 36999

SEQ ID NO: 710260 - RNA, 64 nt, hsa; identical to SEQ ID NO: 37000

SEQ ID NO: 710261 - RNA, 64 nt, hsa; identical to SEQ ID NO: 37001

SEQ ID NO: 710262 - RNA, 64 nt, hsa; identical to SEQ ID NO: 37002

SEQ ID NO: 710263 - RNA, 64 nt, hsa; identical to SEQ ID NO: 37003

SEQ ID NO: 710264 - RNA, 64 nt, hsa; identical to SEQ ID NO: 37004

SEQ ID NO: 710265 - RNA, 64 nt, hsa; identical to SEQ ID NO: 37005

SEQ ID NO: 710266 - RNA, 64 nt, hsa; identical to SEQ ID NO: 37006

SEQ ID NO: 710267 - RNA, 64 nt, hsa; identical to SEQ ID NO: 37007

SEQ ID NO: 710268 - RNA, 64 nt, hsa; identical to SEQ ID NO: 37008

SEQ ID NO: 710269 - RNA, 64 nt, hsa; identical to SEQ ID NO: 37009

SEQ ID NO: 710270 - RNA, 64 nt, hsa; identical to SEQ ID NO: 37010

SEQ ID NO: 710271 - RNA, 64 nt, hsa; identical to SEQ ID NO: 37011

SEQ ID NO: 710272 - RNA, 64 nt, hsa; identical to SEQ ID NO: 37012

SEQ ID NO: 710273 - RNA, 64 nt, hsa; identical to SEQ ID NO: 37013

SEQ ID NO: 710274 - RNA, 64 nt, hsa; identical to SEQ ID NO: 37014

SEQ ID NO: 710275 - RNA, 64 nt, hsa; identical to SEQ ID NO: 37015

SEQ ID NO: 710276 - RNA, 64 nt, hsa; identical to SEQ ID NO: 37016

SEQ ID NO: 710277 - RNA, 64 nt, hsa; identical to SEQ ID NO: 37017

SEQ ID NO: 710278 - RNA, 64 nt, hsa; identical to SEQ ID NO: 37018

SEQ ID NO: 710279 - RNA, 64 nt, hsa; identical to SEQ ID NO: 37019

SEQ ID NO: 710280 - RNA, 64 nt, hsa; identical to SEQ ID NO: 37020

SEQ ID NO: 710281 - RNA, 64 nt, hsa; identical to SEQ ID NO: 37021

SEQ ID NO: 710282 - RNA, 64 nt, hsa; identical to SEQ ID NO: 37022

SEQ ID NO: 710283 - RNA, 64 nt, hsa; identical to SEQ ID NO: 37023

SEQ ID NO: 710284 - RNA, 64 nt, hsa; identical to SEQ ID NO: 37024

SEQ ID NO: 710285 - RNA, 64 nt, hsa; identical to SEQ ID NO: 37025

SEQ ID NO: 710286 - RNA, 64 nt, hsa; identical to SEQ ID NO: 37026

SEQ ID NO: 710287 - RNA, 64 nt, hsa; identical to SEQ ID NO: 37027

SEQ ID NO: 710288 - RNA, 64 nt, hsa; identical to SEQ ID NO: 37028

SEQ ID NO: 710289 - RNA, 64 nt, hsa; identical to SEQ ID NO: 37029

SEQ ID NO: 710290 - RNA, 64 nt, hsa; identical to SEQ ID NO: 37030

SEQ ID NO: 710291 - RNA, 64 nt, hsa; identical to SEQ ID NO: 37031

SEQ ID NO: 710292 - RNA, 64 nt, hsa; identical to SEQ ID NO: 37032

SEQ ID NO: 710293 - RNA, 64 nt, hsa; identical to SEQ ID NO: 37033

SEQ ID NO: 710294 - RNA, 64 nt, hsa; identical to SEQ ID NO: 37034

SEQ ID NO: 710295 - RNA, 64 nt, hsa; identical to SEQ ID NO: 37035

SEQ ID NO: 710296 - RNA, 64 nt, hsa; identical to SEQ ID NO: 37036

SEQ ID NO: 710297 - RNA, 64 nt, hsa; identical to SEQ ID NO: 37037

SEQ ID NO: 710298 - RNA, 64 nt, hsa; identical to SEQ ID NO: 37038

SEQ ID NO: 710299 - RNA, 64 nt, hsa; identical to SEQ ID NO: 37039

SEQ ID NO: 710300 - RNA, 64 nt, hsa; identical to SEQ ID NO: 37040

SEQ ID NO: 710301 - RNA, 64 nt, hsa; identical to SEQ ID NO: 37041

SEQ ID NO: 710302 - RNA, 64 nt, hsa; identical to SEQ ID NO: 37042

SEQ ID NO: 710303 - RNA, 64 nt, hsa; identical to SEQ ID NO: 37043

SEQ ID NO: 710304 - RNA, 64 nt, hsa; identical to SEQ ID NO: 37044

SEQ ID NO: 710305 - RNA, 64 nt, hsa; identical to SEQ ID NO: 37045

SEQ ID NO: 710306 - RNA, 64 nt, hsa; identical to SEQ ID NO: 37046

SEQ ID NO: 710307 - RNA, 64 nt, hsa; identical to SEQ ID NO: 37047

SEQ ID NO: 710308 - RNA, 64 nt, hsa; identical to SEQ ID NO: 37048

SEQ ID NO: 710309 - RNA, 64 nt, hsa; identical to SEQ ID NO: 37049

SEQ ID NO: 710310 - RNA, 64 nt, hsa; identical to SEQ ID NO: 37050

SEQ ID NO: 710311 - RNA, 64 nt, hsa; identical to SEQ ID NO: 37051

SEQ ID NO: 710312 - RNA, 64 nt, hsa; identical to SEQ ID NO: 37052

SEQ ID NO: 710313 - RNA, 64 nt, hsa; identical to SEQ ID NO: 37053

SEQ ID NO: 710314 - RNA, 64 nt, hsa; identical to SEQ ID NO: 37054

SEQ ID NO: 710315 - RNA, 64 nt, hsa; identical to SEQ ID NO: 37055

SEQ ID NO: 710316 - RNA, 64 nt, hsa; identical to SEQ ID NO: 37056

SEQ ID NO: 710317 - RNA, 64 nt, hsa; identical to SEQ ID NO: 37057

SEQ ID NO: 710318 - RNA, 64 nt, hsa; identical to SEQ ID NO: 37058

SEQ ID NO: 710319 - RNA, 64 nt, hsa; identical to SEQ ID NO: 37059

SEQ ID NO: 710320 - RNA, 64 nt, hsa; identical to SEQ ID NO: 37060

SEQ ID NO: 710321 - RNA, 64 nt, hsa; identical to SEQ ID NO: 37061

SEQ ID NO: 710322 - RNA, 64 nt, hsa; identical to SEQ ID NO: 37062

SEQ ID NO: 710323 - RNA, 64 nt, hsa; identical to SEQ ID NO: 37063

SEQ ID NO: 710324 - RNA, 64 nt, hsa; identical to SEQ ID NO: 37064

SEQ ID NO: 710325 - RNA, 64 nt, hsa; identical to SEQ ID NO: 37065

SEQ ID NO: 710326 - RNA, 64 nt, hsa; identical to SEQ ID NO: 37066

SEQ ID NO: 710327 - RNA, 64 nt, hsa; identical to SEQ ID NO: 37067

SEQ ID NO: 710328 - RNA, 64 nt, hsa; identical to SEQ ID NO: 37068

SEQ ID NO: 710329 - RNA, 64 nt, hsa; identical to SEQ ID NO: 37069

SEQ ID NO: 710330 - RNA, 64 nt, hsa; identical to SEQ ID NO: 37070

SEQ ID NO: 710331 - RNA, 64 nt, hsa; identical to SEQ ID NO: 37071

SEQ ID NO: 710332 - RNA, 64 nt, hsa; identical to SEQ ID NO: 37072

SEQ ID NO: 710333 - RNA, 64 nt, hsa; identical to SEQ ID NO: 37073

SEQ ID NO: 710334 - RNA, 64 nt, hsa; identical to SEQ ID NO: 37074

SEQ ID NO: 710335 - RNA, 64 nt, hsa; identical to SEQ ID NO: 37075

SEQ ID NO: 710336 - RNA, 64 nt, hsa; identical to SEQ ID NO: 37076

SEQ ID NO: 710337 - RNA, 64 nt, hsa; identical to SEQ ID NO: 37077

SEQ ID NO: 710338 - RNA, 64 nt, hsa; identical to SEQ ID NO: 37078

SEQ ID NO: 710339 - RNA, 64 nt, hsa; identical to SEQ ID NO: 37079

SEQ ID NO: 710340 - RNA, 64 nt, hsa; identical to SEQ ID NO: 37080

SEQ ID NO: 710341 - RNA, 64 nt, hsa; identical to SEQ ID NO: 37081

SEQ ID NO: 710342 - RNA, 64 nt, hsa; identical to SEQ ID NO: 37082

SEQ ID NO: 710343 - RNA, 64 nt, hsa; identical to SEQ ID NO: 37083

SEQ ID NO: 710344 - RNA, 64 nt, hsa; identical to SEQ ID NO: 37084

SEQ ID NO: 710345 - RNA, 64 nt, hsa; identical to SEQ ID NO: 37085

SEQ ID NO: 710346 - RNA, 64 nt, hsa; identical to SEQ ID NO: 37086

SEQ ID NO: 710347 - RNA, 64 nt, hsa; identical to SEQ ID NO: 37087

SEQ ID NO: 710348 - RNA, 64 nt, hsa; identical to SEQ ID NO: 37088

SEQ ID NO: 710349 - RNA, 64 nt, hsa; identical to SEQ ID NO: 37089

SEQ ID NO: 710350 - RNA, 64 nt, hsa; identical to SEQ ID NO: 37090

SEQ ID NO: 710351 - RNA, 64 nt, hsa; identical to SEQ ID NO: 37091

SEQ ID NO: 710352 - RNA, 64 nt, hsa; identical to SEQ ID NO: 37092

SEQ ID NO: 710353 - RNA, 64 nt, hsa; identical to SEQ ID NO: 37093

SEQ ID NO: 710354 - RNA, 64 nt, hsa; identical to SEQ ID NO: 37094

SEQ ID NO: 710355 - RNA, 64 nt, hsa; identical to SEQ ID NO: 37095

SEQ ID NO: 710356 - RNA, 64 nt, hsa; identical to SEQ ID NO: 37096

SEQ ID NO: 710357 - RNA, 64 nt, hsa; identical to SEQ ID NO: 37097

SEQ ID NO: 710358 - RNA, 64 nt, hsa; identical to SEQ ID NO: 37098

SEQ ID NO: 710359 - RNA, 64 nt, hsa; identical to SEQ ID NO: 37099

SEQ ID NO: 710360 - RNA, 64 nt, hsa; identical to SEQ ID NO: 37100

SEQ ID NO: 710361 - RNA, 64 nt, hsa; identical to SEQ ID NO: 37101

SEQ ID NO: 710362 - RNA, 64 nt, hsa; identical to SEQ ID NO: 37102

SEQ ID NO: 710363 - RNA, 64 nt, hsa; identical to SEQ ID NO: 37103

SEQ ID NO: 710364 - RNA, 64 nt, hsa; identical to SEQ ID NO: 37104

SEQ ID NO: 710365 - RNA, 64 nt, hsa; identical to SEQ ID NO: 37105

SEQ ID NO: 710366 - RNA, 64 nt, hsa; identical to SEQ ID NO: 37106

SEQ ID NO: 710367 - RNA, 64 nt, hsa; identical to SEQ ID NO: 37107

SEQ ID NO: 710368 - RNA, 64 nt, hsa; identical to SEQ ID NO: 37108

SEQ ID NO: 710369 - RNA, 64 nt, hsa; identical to SEQ ID NO: 37109

SEQ ID NO: 710370 - RNA, 64 nt, hsa; identical to SEQ ID NO: 37110

SEQ ID NO: 710371 - RNA, 64 nt, hsa; identical to SEQ ID NO: 37111

SEQ ID NO: 710372 - RNA, 64 nt, hsa; identical to SEQ ID NO: 37112

SEQ ID NO: 710373 - RNA, 64 nt, hsa; identical to SEQ ID NO: 37113

SEQ ID NO: 710374 - RNA, 64 nt, hsa; identical to SEQ ID NO: 37114

SEQ ID NO: 710375 - RNA, 64 nt, hsa; identical to SEQ ID NO: 37115

SEQ ID NO: 710376 - RNA, 64 nt, hsa; identical to SEQ ID NO: 37116

SEQ ID NO: 710377 - RNA, 64 nt, hsa; identical to SEQ ID NO: 37117

SEQ ID NO: 710378 - RNA, 64 nt, hsa; identical to SEQ ID NO: 37118

SEQ ID NO: 710379 - RNA, 64 nt, hsa; identical to SEQ ID NO: 37119

SEQ ID NO: 710380 - RNA, 64 nt, hsa; identical to SEQ ID NO: 37120

SEQ ID NO: 710381 - RNA, 64 nt, hsa; identical to SEQ ID NO: 37121

SEQ ID NO: 710382 - RNA, 64 nt, hsa; identical to SEQ ID NO: 37122

SEQ ID NO: 710383 - RNA, 64 nt, hsa; identical to SEQ ID NO: 37123

SEQ ID NO: 710384 - RNA, 64 nt, hsa; identical to SEQ ID NO: 37124

SEQ ID NO: 710385 - RNA, 64 nt, hsa; identical to SEQ ID NO: 37125

SEQ ID NO: 710386 - RNA, 64 nt, hsa; identical to SEQ ID NO: 37126

SEQ ID NO: 710387 - RNA, 64 nt, hsa; identical to SEQ ID NO: 37127

SEQ ID NO: 710388 - RNA, 64 nt, hsa; identical to SEQ ID NO: 37128

SEQ ID NO: 710389 - RNA, 64 nt, hsa; identical to SEQ ID NO: 37129

SEQ ID NO: 710390 - RNA, 64 nt, hsa; identical to SEQ ID NO: 37130

SEQ ID NO: 710391 - RNA, 64 nt, hsa; identical to SEQ ID NO: 37131

SEQ ID NO: 710392 - RNA, 64 nt, hsa; identical to SEQ ID NO: 37132

SEQ ID NO: 710393 - RNA, 64 nt, hsa; identical to SEQ ID NO: 37133

SEQ ID NO: 710394 - RNA, 64 nt, hsa; identical to SEQ ID NO: 37134

SEQ ID NO: 710395 - RNA, 64 nt, hsa; identical to SEQ ID NO: 37135

SEQ ID NO: 710396 - RNA, 64 nt, hsa; identical to SEQ ID NO: 37136

SEQ ID NO: 710397 - RNA, 64 nt, hsa; identical to SEQ ID NO: 37137

SEQ ID NO: 710398 - RNA, 64 nt, hsa; identical to SEQ ID NO: 37138

SEQ ID NO: 710399 - RNA, 64 nt, hsa; identical to SEQ ID NO: 37139

SEQ ID NO: 710400 - RNA, 64 nt, hsa; identical to SEQ ID NO: 37140

SEQ ID NO: 710401 - RNA, 64 nt, hsa; identical to SEQ ID NO: 37141

SEQ ID NO: 710402 - RNA, 64 nt, hsa; identical to SEQ ID NO: 37142

SEQ ID NO: 710403 - RNA, 64 nt, hsa; identical to SEQ ID NO: 37143

SEQ ID NO: 710404 - RNA, 64 nt, hsa; identical to SEQ ID NO: 37144

SEQ ID NO: 710405 - RNA, 64 nt, hsa; identical to SEQ ID NO: 37145

SEQ ID NO: 710406 - RNA, 64 nt, hsa; identical to SEQ ID NO: 37146

SEQ ID NO: 710407 - RNA, 64 nt, hsa; identical to SEQ ID NO: 37147

SEQ ID NO: 710408 - RNA, 64 nt, hsa; identical to SEQ ID NO: 37148

SEQ ID NO: 710409 - RNA, 64 nt, hsa; identical to SEQ ID NO: 37149

SEQ ID NO: 710410 - RNA, 64 nt, hsa; identical to SEQ ID NO: 37150

SEQ ID NO: 710411 - RNA, 64 nt, hsa; identical to SEQ ID NO: 37151

SEQ ID NO: 710412 - RNA, 63 nt, hsa; identical to SEQ ID NO: 37152

SEQ ID NO: 710413 - RNA, 62 nt, hsa; identical to SEQ ID NO: 37153

SEQ ID NO: 710414 - RNA, 64 nt, hsa; identical to SEQ ID NO: 37154

SEQ ID NO: 710415 - RNA, 64 nt, hsa; identical to SEQ ID NO: 37155

SEQ ID NO: 710416 - RNA, 64 nt, hsa; identical to SEQ ID NO: 37156

SEQ ID NO: 710417 - RNA, 64 nt, hsa; identical to SEQ ID NO: 37157

SEQ ID NO: 710418 - RNA, 64 nt, hsa; identical to SEQ ID NO: 37158

SEQ ID NO: 710419 - RNA, 64 nt, hsa; identical to SEQ ID NO: 37159

SEQ ID NO: 710420 - RNA, 64 nt, hsa; identical to SEQ ID NO: 37160

SEQ ID NO: 710421 - RNA, 64 nt, hsa; identical to SEQ ID NO: 37161

SEQ ID NO: 710422 - RNA, 64 nt, hsa; identical to SEQ ID NO: 37162

SEQ ID NO: 710423 - RNA, 64 nt, hsa; identical to SEQ ID NO: 37163

SEQ ID NO: 710424 - RNA, 64 nt, hsa; identical to SEQ ID NO: 37164

SEQ ID NO: 710425 - RNA, 64 nt, hsa; identical to SEQ ID NO: 37165

SEQ ID NO: 710426 - RNA, 64 nt, hsa; identical to SEQ ID NO: 37166

SEQ ID NO: 710427 - RNA, 64 nt, hsa; identical to SEQ ID NO: 37167

SEQ ID NO: 710428 - RNA, 64 nt, hsa; identical to SEQ ID NO: 37168

SEQ ID NO: 710429 - RNA, 64 nt, hsa; identical to SEQ ID NO: 37169

SEQ ID NO: 710430 - RNA, 64 nt, hsa; identical to SEQ ID NO: 37170

SEQ ID NO: 710431 - RNA, 64 nt, hsa; identical to SEQ ID NO: 37171

SEQ ID NO: 710432 - RNA, 64 nt, hsa; identical to SEQ ID NO: 37172

SEQ ID NO: 710433 - RNA, 64 nt, hsa; identical to SEQ ID NO: 37173

SEQ ID NO: 710434 - RNA, 64 nt, hsa; identical to SEQ ID NO: 37174

SEQ ID NO: 710435 - RNA, 64 nt, hsa; identical to SEQ ID NO: 37175

SEQ ID NO: 710436 - RNA, 64 nt, hsa; identical to SEQ ID NO: 37176

SEQ ID NO: 710437 - RNA, 64 nt, hsa; identical to SEQ ID NO: 37177

SEQ ID NO: 710438 - RNA, 64 nt, hsa; identical to SEQ ID NO: 37178

SEQ ID NO: 710439 - RNA, 64 nt, hsa; identical to SEQ ID NO: 37179

SEQ ID NO: 710440 - RNA, 64 nt, hsa; identical to SEQ ID NO: 37180

SEQ ID NO: 710441 - RNA, 64 nt, hsa; identical to SEQ ID NO: 37181

SEQ ID NO: 710442 - RNA, 64 nt, hsa; identical to SEQ ID NO: 37182

SEQ ID NO: 710443 - RNA, 64 nt, hsa; identical to SEQ ID NO: 37183

SEQ ID NO: 710444 - RNA, 64 nt, hsa; identical to SEQ ID NO: 37184

SEQ ID NO: 710445 - RNA, 64 nt, hsa; identical to SEQ ID NO: 37185

SEQ ID NO: 710446 - RNA, 64 nt, hsa; identical to SEQ ID NO: 37186

SEQ ID NO: 710447 - RNA, 64 nt, hsa; identical to SEQ ID NO: 37187

SEQ ID NO: 710448 - RNA, 64 nt, hsa; identical to SEQ ID NO: 37188

SEQ ID NO: 710449 - RNA, 64 nt, hsa; identical to SEQ ID NO: 37189

SEQ ID NO: 710450 - RNA, 64 nt, hsa; identical to SEQ ID NO: 37190

SEQ ID NO: 710451 - RNA, 64 nt, hsa; identical to SEQ ID NO: 37191

SEQ ID NO: 710452 - RNA, 64 nt, hsa; identical to SEQ ID NO: 37192

SEQ ID NO: 710453 - RNA, 64 nt, hsa; identical to SEQ ID NO: 37193

SEQ ID NO: 710454 - RNA, 64 nt, hsa; identical to SEQ ID NO: 37194

SEQ ID NO: 710455 - RNA, 64 nt, hsa; identical to SEQ ID NO: 37195

SEQ ID NO: 710456 - RNA, 64 nt, hsa; identical to SEQ ID NO: 37196

SEQ ID NO: 710457 - RNA, 64 nt, hsa; identical to SEQ ID NO: 37197

SEQ ID NO: 710458 - RNA, 64 nt, hsa; identical to SEQ ID NO: 37198

SEQ ID NO: 710459 - RNA, 64 nt, hsa; identical to SEQ ID NO: 37199

SEQ ID NO: 710460 - RNA, 64 nt, hsa; identical to SEQ ID NO: 37200

SEQ ID NO: 710461 - RNA, 64 nt, hsa; identical to SEQ ID NO: 37201

SEQ ID NO: 710462 - RNA, 64 nt, hsa; identical to SEQ ID NO: 37202

SEQ ID NO: 710463 - RNA, 64 nt, hsa; identical to SEQ ID NO: 37203

SEQ ID NO: 710464 - RNA, 64 nt, hsa; identical to SEQ ID NO: 37204

SEQ ID NO: 710465 - RNA, 64 nt, hsa; identical to SEQ ID NO: 37205

SEQ ID NO: 710466 - RNA, 64 nt, hsa; identical to SEQ ID NO: 37206

SEQ ID NO: 710467 - RNA, 64 nt, hsa; identical to SEQ ID NO: 37207

SEQ ID NO: 710468 - RNA, 64 nt, hsa; identical to SEQ ID NO: 37208

SEQ ID NO: 710469 - RNA, 64 nt, hsa; identical to SEQ ID NO: 37209

SEQ ID NO: 710470 - RNA, 64 nt, hsa; identical to SEQ ID NO: 37210

SEQ ID NO: 710471 - RNA, 64 nt, hsa; identical to SEQ ID NO: 37211

SEQ ID NO: 710472 - RNA, 64 nt, hsa; identical to SEQ ID NO: 37212

SEQ ID NO: 710473 - RNA, 64 nt, hsa; identical to SEQ ID NO: 37213

SEQ ID NO: 710474 - RNA, 64 nt, hsa; identical to SEQ ID NO: 37214

SEQ ID NO: 710475 - RNA, 64 nt, hsa; identical to SEQ ID NO: 37215

SEQ ID NO: 710476 - RNA, 64 nt, hsa; identical to SEQ ID NO: 37216

SEQ ID NO: 710477 - RNA, 64 nt, hsa; identical to SEQ ID NO: 37217

SEQ ID NO: 710478 - RNA, 64 nt, hsa; identical to SEQ ID NO: 37218

SEQ ID NO: 710479 - RNA, 64 nt, hsa; identical to SEQ ID NO: 37219

SEQ ID NO: 710480 - RNA, 64 nt, hsa; identical to SEQ ID NO: 37220

SEQ ID NO: 710481 - RNA, 64 nt, hsa; identical to SEQ ID NO: 37221

SEQ ID NO: 710482 - RNA, 64 nt, hsa; identical to SEQ ID NO: 37222

SEQ ID NO: 710483 - RNA, 64 nt, hsa; identical to SEQ ID NO: 37223

SEQ ID NO: 710484 - RNA, 64 nt, hsa; identical to SEQ ID NO: 37224

SEQ ID NO: 710485 - RNA, 64 nt, hsa; identical to SEQ ID NO: 37225

SEQ ID NO: 710486 - RNA, 64 nt, hsa; identical to SEQ ID NO: 37226

SEQ ID NO: 710487 - RNA, 64 nt, hsa; identical to SEQ ID NO: 37227

SEQ ID NO: 710488 - RNA, 64 nt, hsa; identical to SEQ ID NO: 37228

SEQ ID NO: 710489 - RNA, 64 nt, hsa; identical to SEQ ID NO: 37229

SEQ ID NO: 710490 - RNA, 64 nt, hsa; identical to SEQ ID NO: 37230

SEQ ID NO: 710491 - RNA, 64 nt, hsa; identical to SEQ ID NO: 37231

SEQ ID NO: 710492 - RNA, 64 nt, hsa; identical to SEQ ID NO: 37232

SEQ ID NO: 710493 - RNA, 64 nt, hsa; identical to SEQ ID NO: 37233

SEQ ID NO: 710494 - RNA, 64 nt, hsa; identical to SEQ ID NO: 37234

SEQ ID NO: 710495 - RNA, 64 nt, hsa; identical to SEQ ID NO: 37235

SEQ ID NO: 710496 - RNA, 64 nt, hsa; identical to SEQ ID NO: 37236

SEQ ID NO: 710497 - RNA, 64 nt, hsa; identical to SEQ ID NO: 37237

SEQ ID NO: 710498 - RNA, 64 nt, hsa; identical to SEQ ID NO: 37238

SEQ ID NO: 710499 - RNA, 64 nt, hsa; identical to SEQ ID NO: 37239

SEQ ID NO: 710500 - RNA, 64 nt, hsa; identical to SEQ ID NO: 37240

SEQ ID NO: 710501 - RNA, 64 nt, hsa; identical to SEQ ID NO: 37241

SEQ ID NO: 710502 - RNA, 64 nt, hsa; identical to SEQ ID NO: 37242

SEQ ID NO: 710503 - RNA, 64 nt, hsa; identical to SEQ ID NO: 37243

SEQ ID NO: 710504 - RNA, 64 nt, hsa; identical to SEQ ID NO: 37244

SEQ ID NO: 710505 - RNA, 64 nt, hsa; identical to SEQ ID NO: 37245

SEQ ID NO: 710506 - RNA, 64 nt, hsa; identical to SEQ ID NO: 37246

SEQ ID NO: 710507 - RNA, 64 nt, hsa; identical to SEQ ID NO: 37247

SEQ ID NO: 710508 - RNA, 64 nt, hsa; identical to SEQ ID NO: 37248

SEQ ID NO: 710509 - RNA, 64 nt, hsa; identical to SEQ ID NO: 37249

SEQ ID NO: 710510 - RNA, 64 nt, hsa; identical to SEQ ID NO: 37250

SEQ ID NO: 710511 - RNA, 64 nt, hsa; identical to SEQ ID NO: 37251

SEQ ID NO: 710512 - RNA, 64 nt, hsa; identical to SEQ ID NO: 37252

SEQ ID NO: 710513 - RNA, 64 nt, hsa; identical to SEQ ID NO: 37253

SEQ ID NO: 710514 - RNA, 64 nt, hsa; identical to SEQ ID NO: 37254

SEQ ID NO: 710515 - RNA, 64 nt, hsa; identical to SEQ ID NO: 37255

SEQ ID NO: 710516 - RNA, 64 nt, hsa; identical to SEQ ID NO: 37256

SEQ ID NO: 710517 - RNA, 64 nt, hsa; identical to SEQ ID NO: 37257

SEQ ID NO: 710518 - RNA, 64 nt, hsa; identical to SEQ ID NO: 37258

SEQ ID NO: 710519 - RNA, 64 nt, hsa; identical to SEQ ID NO: 37259

SEQ ID NO: 710520 - RNA, 64 nt, hsa; identical to SEQ ID NO: 37260

SEQ ID NO: 710521 - RNA, 64 nt, hsa; identical to SEQ ID NO: 37261

SEQ ID NO: 710522 - RNA, 64 nt, hsa; identical to SEQ ID NO: 37262

SEQ ID NO: 710523 - RNA, 64 nt, hsa; identical to SEQ ID NO: 37263

SEQ ID NO: 710524 - RNA, 64 nt, hsa; identical to SEQ ID NO: 37264

SEQ ID NO: 710525 - RNA, 64 nt, hsa; identical to SEQ ID NO: 37265

SEQ ID NO: 710526 - RNA, 64 nt, hsa; identical to SEQ ID NO: 37266

SEQ ID NO: 710527 - RNA, 64 nt, hsa; identical to SEQ ID NO: 37267

SEQ ID NO: 710528 - RNA, 64 nt, hsa; identical to SEQ ID NO: 37268

SEQ ID NO: 710529 - RNA, 64 nt, hsa; identical to SEQ ID NO: 37269

SEQ ID NO: 710530 - RNA, 64 nt, hsa; identical to SEQ ID NO: 37270

SEQ ID NO: 710531 - RNA, 64 nt, hsa; identical to SEQ ID NO: 37271

SEQ ID NO: 710532 - RNA, 64 nt, hsa; identical to SEQ ID NO: 37272

SEQ ID NO: 710533 - RNA, 64 nt, hsa; identical to SEQ ID NO: 37273

SEQ ID NO: 710534 - RNA, 64 nt, hsa; identical to SEQ ID NO: 37274

SEQ ID NO: 710535 - RNA, 64 nt, hsa; identical to SEQ ID NO: 37275

SEQ ID NO: 710536 - RNA, 64 nt, hsa; identical to SEQ ID NO: 37276

SEQ ID NO: 710537 - RNA, 64 nt, hsa; identical to SEQ ID NO: 37277

SEQ ID NO: 710538 - RNA, 64 nt, hsa; identical to SEQ ID NO: 37278

SEQ ID NO: 710539 - RNA, 64 nt, hsa; identical to SEQ ID NO: 37279

SEQ ID NO: 710540 - RNA, 64 nt, hsa; identical to SEQ ID NO: 37280

SEQ ID NO: 710541 - RNA, 64 nt, hsa; identical to SEQ ID NO: 37281

SEQ ID NO: 710542 - RNA, 64 nt, hsa; identical to SEQ ID NO: 37282

SEQ ID NO: 710543 - RNA, 64 nt, hsa; identical to SEQ ID NO: 37283

SEQ ID NO: 710544 - RNA, 64 nt, hsa; identical to SEQ ID NO: 37284

SEQ ID NO: 710545 - RNA, 64 nt, hsa; identical to SEQ ID NO: 37285

SEQ ID NO: 710546 - RNA, 64 nt, hsa; identical to SEQ ID NO: 37286

SEQ ID NO: 710547 - RNA, 64 nt, hsa; identical to SEQ ID NO: 37287

SEQ ID NO: 710548 - RNA, 64 nt, hsa; identical to SEQ ID NO: 37288

SEQ ID NO: 710549 - RNA, 64 nt, hsa; identical to SEQ ID NO: 37289

SEQ ID NO: 710550 - RNA, 64 nt, hsa; identical to SEQ ID NO: 37290

SEQ ID NO: 710551 - RNA, 64 nt, hsa; identical to SEQ ID NO: 37291

SEQ ID NO: 710552 - RNA, 64 nt, hsa; identical to SEQ ID NO: 37292

SEQ ID NO: 710553 - RNA, 64 nt, hsa; identical to SEQ ID NO: 37293

SEQ ID NO: 710554 - RNA, 64 nt, hsa; identical to SEQ ID NO: 37294

SEQ ID NO: 710555 - RNA, 64 nt, hsa; identical to SEQ ID NO: 37295

SEQ ID NO: 710556 - RNA, 64 nt, hsa; identical to SEQ ID NO: 37296

SEQ ID NO: 710557 - RNA, 64 nt, hsa; identical to SEQ ID NO: 37297

SEQ ID NO: 710558 - RNA, 64 nt, hsa; identical to SEQ ID NO: 37298

SEQ ID NO: 710559 - RNA, 64 nt, hsa; identical to SEQ ID NO: 37299

SEQ ID NO: 710560 - RNA, 64 nt, hsa; identical to SEQ ID NO: 37300

SEQ ID NO: 710561 - RNA, 64 nt, hsa; identical to SEQ ID NO: 37301

SEQ ID NO: 710562 - RNA, 64 nt, hsa; identical to SEQ ID NO: 37302

SEQ ID NO: 710563 - RNA, 64 nt, hsa; identical to SEQ ID NO: 37303

SEQ ID NO: 710564 - RNA, 64 nt, hsa; identical to SEQ ID NO: 37304

SEQ ID NO: 710565 - RNA, 64 nt, hsa; identical to SEQ ID NO: 37305

SEQ ID NO: 710566 - RNA, 64 nt, hsa; identical to SEQ ID NO: 37306

SEQ ID NO: 710567 - RNA, 64 nt, hsa; identical to SEQ ID NO: 37307

SEQ ID NO: 710568 - RNA, 64 nt, hsa; identical to SEQ ID NO: 37308

SEQ ID NO: 710569 - RNA, 64 nt, hsa; identical to SEQ ID NO: 37309

SEQ ID NO: 710570 - RNA, 64 nt, hsa; identical to SEQ ID NO: 37310

SEQ ID NO: 710571 - RNA, 64 nt, hsa; identical to SEQ ID NO: 37311

SEQ ID NO: 710572 - RNA, 64 nt, hsa; identical to SEQ ID NO: 37312

SEQ ID NO: 710573 - RNA, 64 nt, hsa; identical to SEQ ID NO: 37313

SEQ ID NO: 710574 - RNA, 64 nt, hsa; identical to SEQ ID NO: 37314

SEQ ID NO: 710575 - RNA, 64 nt, hsa; identical to SEQ ID NO: 37315

SEQ ID NO: 710576 - RNA, 64 nt, hsa; identical to SEQ ID NO: 37316

SEQ ID NO: 710577 - RNA, 64 nt, hsa; identical to SEQ ID NO: 37317

SEQ ID NO: 710578 - RNA, 64 nt, hsa; identical to SEQ ID NO: 37318

SEQ ID NO: 710579 - RNA, 64 nt, hsa; identical to SEQ ID NO: 37319

SEQ ID NO: 710580 - RNA, 64 nt, hsa; identical to SEQ ID NO: 37320

SEQ ID NO: 710581 - RNA, 64 nt, hsa; identical to SEQ ID NO: 37321

SEQ ID NO: 710582 - RNA, 64 nt, hsa; identical to SEQ ID NO: 37322

SEQ ID NO: 710583 - RNA, 64 nt, hsa; identical to SEQ ID NO: 37323

SEQ ID NO: 710584 - RNA, 64 nt, hsa; identical to SEQ ID NO: 37324

SEQ ID NO: 710585 - RNA, 64 nt, hsa; identical to SEQ ID NO: 37325

SEQ ID NO: 710586 - RNA, 64 nt, hsa; identical to SEQ ID NO: 37326

SEQ ID NO: 710587 - RNA, 64 nt, hsa; identical to SEQ ID NO: 37327

SEQ ID NO: 710588 - RNA, 64 nt, hsa; identical to SEQ ID NO: 37328

SEQ ID NO: 710589 - RNA, 64 nt, hsa; identical to SEQ ID NO: 37329

SEQ ID NO: 710590 - RNA, 64 nt, hsa; identical to SEQ ID NO: 37330

SEQ ID NO: 710591 - RNA, 64 nt, hsa; identical to SEQ ID NO: 37331

SEQ ID NO: 710592 - RNA, 64 nt, hsa; identical to SEQ ID NO: 37332

SEQ ID NO: 710593 - RNA, 64 nt, hsa; identical to SEQ ID NO: 37333

SEQ ID NO: 710594 - RNA, 64 nt, hsa; identical to SEQ ID NO: 37334

SEQ ID NO: 710595 - RNA, 64 nt, hsa; identical to SEQ ID NO: 37335

SEQ ID NO: 710596 - RNA, 64 nt, hsa; identical to SEQ ID NO: 37336

SEQ ID NO: 710597 - RNA, 64 nt, hsa; identical to SEQ ID NO: 37337

SEQ ID NO: 710598 - RNA, 64 nt, hsa; identical to SEQ ID NO: 37338

SEQ ID NO: 710599 - RNA, 64 nt, hsa; identical to SEQ ID NO: 37339

SEQ ID NO: 710600 - RNA, 64 nt, hsa; identical to SEQ ID NO: 37340

SEQ ID NO: 710601 - RNA, 64 nt, hsa; identical to SEQ ID NO: 37341

SEQ ID NO: 710602 - RNA, 64 nt, hsa; identical to SEQ ID NO: 37342

SEQ ID NO: 710603 - RNA, 64 nt, hsa; identical to SEQ ID NO: 37343

SEQ ID NO: 710604 - RNA, 64 nt, hsa; identical to SEQ ID NO: 37344

SEQ ID NO: 710605 - RNA, 64 nt, hsa; identical to SEQ ID NO: 37345

SEQ ID NO: 710606 - RNA, 64 nt, hsa; identical to SEQ ID NO: 37346

SEQ ID NO: 710607 - RNA, 64 nt, hsa; identical to SEQ ID NO: 37347

SEQ ID NO: 710608 - RNA, 64 nt, hsa; identical to SEQ ID NO: 37348

SEQ ID NO: 710609 - RNA, 64 nt, hsa; identical to SEQ ID NO: 37349

SEQ ID NO: 710610 - RNA, 64 nt, hsa; identical to SEQ ID NO: 37350

SEQ ID NO: 710611 - RNA, 64 nt, hsa; identical to SEQ ID NO: 37351

SEQ ID NO: 710612 - RNA, 64 nt, hsa; identical to SEQ ID NO: 37352

SEQ ID NO: 710613 - RNA, 64 nt, hsa; identical to SEQ ID NO: 37353

SEQ ID NO: 710614 - RNA, 64 nt, hsa; identical to SEQ ID NO: 37354

SEQ ID NO: 710615 - RNA, 64 nt, hsa; identical to SEQ ID NO: 37355

SEQ ID NO: 710616 - RNA, 64 nt, hsa; identical to SEQ ID NO: 37356

SEQ ID NO: 710617 - RNA, 64 nt, hsa; identical to SEQ ID NO: 37357

SEQ ID NO: 710618 - RNA, 64 nt, hsa; identical to SEQ ID NO: 37358

SEQ ID NO: 710619 - RNA, 64 nt, hsa; identical to SEQ ID NO: 37359

SEQ ID NO: 710620 - RNA, 64 nt, hsa; identical to SEQ ID NO: 37360

SEQ ID NO: 710621 - RNA, 64 nt, hsa; identical to SEQ ID NO: 37361

SEQ ID NO: 710622 - RNA, 64 nt, hsa; identical to SEQ ID NO: 37362

SEQ ID NO: 710623 - RNA, 64 nt, hsa; identical to SEQ ID NO: 37363

SEQ ID NO: 710624 - RNA, 64 nt, hsa; identical to SEQ ID NO: 37364

SEQ ID NO: 710625 - RNA, 64 nt, hsa; identical to SEQ ID NO: 37365

SEQ ID NO: 710626 - RNA, 64 nt, hsa; identical to SEQ ID NO: 37366

SEQ ID NO: 710627 - RNA, 64 nt, hsa; identical to SEQ ID NO: 37367

SEQ ID NO: 710628 - RNA, 64 nt, hsa; identical to SEQ ID NO: 37368

SEQ ID NO: 710629 - RNA, 64 nt, hsa; identical to SEQ ID NO: 37369

SEQ ID NO: 710630 - RNA, 64 nt, hsa; identical to SEQ ID NO: 37370

SEQ ID NO: 710631 - RNA, 64 nt, hsa; identical to SEQ ID NO: 37371

SEQ ID NO: 710632 - RNA, 64 nt, hsa; identical to SEQ ID NO: 37372

SEQ ID NO: 710633 - RNA, 64 nt, hsa; identical to SEQ ID NO: 37373

SEQ ID NO: 710634 - RNA, 64 nt, hsa; identical to SEQ ID NO: 37374

SEQ ID NO: 710635 - RNA, 64 nt, hsa; identical to SEQ ID NO: 37375

SEQ ID NO: 710636 - RNA, 64 nt, hsa; identical to SEQ ID NO: 37376

SEQ ID NO: 710637 - RNA, 64 nt, hsa; identical to SEQ ID NO: 37377

SEQ ID NO: 710638 - RNA, 64 nt, hsa; identical to SEQ ID NO: 37378

SEQ ID NO: 710639 - RNA, 64 nt, hsa; identical to SEQ ID NO: 37379

SEQ ID NO: 710640 - RNA, 64 nt, hsa; identical to SEQ ID NO: 37380

SEQ ID NO: 710641 - RNA, 64 nt, hsa; identical to SEQ ID NO: 37381

SEQ ID NO: 710642 - RNA, 64 nt, hsa; identical to SEQ ID NO: 37382

SEQ ID NO: 710643 - RNA, 64 nt, hsa; identical to SEQ ID NO: 37383

SEQ ID NO: 710644 - RNA, 64 nt, hsa; identical to SEQ ID NO: 37384

SEQ ID NO: 710645 - RNA, 64 nt, hsa; identical to SEQ ID NO: 37385

SEQ ID NO: 710646 - RNA, 64 nt, hsa; identical to SEQ ID NO: 37386

SEQ ID NO: 710647 - RNA, 64 nt, hsa; identical to SEQ ID NO: 37387

SEQ ID NO: 710648 - RNA, 64 nt, hsa; identical to SEQ ID NO: 37388

SEQ ID NO: 710649 - RNA, 64 nt, hsa; identical to SEQ ID NO: 37389

SEQ ID NO: 710650 - RNA, 64 nt, hsa; identical to SEQ ID NO: 37390

SEQ ID NO: 710651 - RNA, 64 nt, hsa; identical to SEQ ID NO: 37391

SEQ ID NO: 710652 - RNA, 64 nt, hsa; identical to SEQ ID NO: 37392

SEQ ID NO: 710653 - RNA, 64 nt, hsa; identical to SEQ ID NO: 37393

SEQ ID NO: 710654 - RNA, 64 nt, hsa; identical to SEQ ID NO: 37394

SEQ ID NO: 710655 - RNA, 64 nt, hsa; identical to SEQ ID NO: 37395

SEQ ID NO: 710656 - RNA, 64 nt, hsa; identical to SEQ ID NO: 37396

SEQ ID NO: 710657 - RNA, 64 nt, hsa; identical to SEQ ID NO: 37397

SEQ ID NO: 710658 - RNA, 64 nt, hsa; identical to SEQ ID NO: 37398

SEQ ID NO: 710659 - RNA, 64 nt, hsa; identical to SEQ ID NO: 37399

SEQ ID NO: 710660 - RNA, 64 nt, hsa; identical to SEQ ID NO: 37400

SEQ ID NO: 710661 - RNA, 64 nt, hsa; identical to SEQ ID NO: 37401

SEQ ID NO: 710662 - RNA, 64 nt, hsa; identical to SEQ ID NO: 37402

SEQ ID NO: 710663 - RNA, 64 nt, hsa; identical to SEQ ID NO: 37403

SEQ ID NO: 710664 - RNA, 64 nt, hsa; identical to SEQ ID NO: 37404

SEQ ID NO: 710665 - RNA, 64 nt, hsa; identical to SEQ ID NO: 37405

SEQ ID NO: 710666 - RNA, 64 nt, hsa; identical to SEQ ID NO: 37406

SEQ ID NO: 710667 - RNA, 64 nt, hsa; identical to SEQ ID NO: 37407

SEQ ID NO: 710668 - RNA, 64 nt, hsa; identical to SEQ ID NO: 37408

SEQ ID NO: 710669 - RNA, 64 nt, hsa; identical to SEQ ID NO: 37409

SEQ ID NO: 710670 - RNA, 64 nt, hsa; identical to SEQ ID NO: 37410

SEQ ID NO: 710671 - RNA, 64 nt, hsa; identical to SEQ ID NO: 37411

SEQ ID NO: 710672 - RNA, 64 nt, hsa; identical to SEQ ID NO: 37412

SEQ ID NO: 710673 - RNA, 64 nt, hsa; identical to SEQ ID NO: 37413

SEQ ID NO: 710674 - RNA, 64 nt, hsa; identical to SEQ ID NO: 37414

SEQ ID NO: 710675 - RNA, 64 nt, hsa; identical to SEQ ID NO: 37415

SEQ ID NO: 710676 - RNA, 64 nt, hsa; identical to SEQ ID NO: 37416

SEQ ID NO: 710677 - RNA, 64 nt, hsa; identical to SEQ ID NO: 37417

SEQ ID NO: 710678 - RNA, 64 nt, hsa; identical to SEQ ID NO: 37418

SEQ ID NO: 710679 - RNA, 64 nt, hsa; identical to SEQ ID NO: 37419

SEQ ID NO: 710680 - RNA, 64 nt, hsa; identical to SEQ ID NO: 37420

SEQ ID NO: 710681 - RNA, 64 nt, hsa; identical to SEQ ID NO: 37421

SEQ ID NO: 710682 - RNA, 64 nt, hsa; identical to SEQ ID NO: 37422

SEQ ID NO: 710683 - RNA, 64 nt, hsa; identical to SEQ ID NO: 37423

SEQ ID NO: 710684 - RNA, 64 nt, hsa; identical to SEQ ID NO: 37424

SEQ ID NO: 710685 - RNA, 64 nt, hsa; identical to SEQ ID NO: 37425

SEQ ID NO: 710686 - RNA, 64 nt, hsa; identical to SEQ ID NO: 37426

SEQ ID NO: 710687 - RNA, 64 nt, hsa; identical to SEQ ID NO: 37427

SEQ ID NO: 710688 - RNA, 64 nt, hsa; identical to SEQ ID NO: 37428

SEQ ID NO: 710689 - RNA, 64 nt, hsa; identical to SEQ ID NO: 37429

SEQ ID NO: 710690 - RNA, 64 nt, hsa; identical to SEQ ID NO: 37430

SEQ ID NO: 710691 - RNA, 64 nt, hsa; identical to SEQ ID NO: 37431

SEQ ID NO: 710692 - RNA, 64 nt, hsa; identical to SEQ ID NO: 37432

SEQ ID NO: 710693 - RNA, 64 nt, hsa; identical to SEQ ID NO: 37433

SEQ ID NO: 710694 - RNA, 64 nt, hsa; identical to SEQ ID NO: 37434

SEQ ID NO: 710695 - RNA, 64 nt, hsa; identical to SEQ ID NO: 37435

SEQ ID NO: 710696 - RNA, 64 nt, hsa; identical to SEQ ID NO: 37436

SEQ ID NO: 710697 - RNA, 64 nt, hsa; identical to SEQ ID NO: 37437

SEQ ID NO: 710698 - RNA, 64 nt, hsa; identical to SEQ ID NO: 37438

SEQ ID NO: 710699 - RNA, 64 nt, hsa; identical to SEQ ID NO: 37439

SEQ ID NO: 710700 - RNA, 64 nt, hsa; identical to SEQ ID NO: 37440

SEQ ID NO: 710701 - RNA, 64 nt, hsa; identical to SEQ ID NO: 37441

SEQ ID NO: 710702 - RNA, 64 nt, hsa; identical to SEQ ID NO: 37442

SEQ ID NO: 710703 - RNA, 64 nt, hsa; identical to SEQ ID NO: 37443

SEQ ID NO: 710704 - RNA, 64 nt, hsa; identical to SEQ ID NO: 37444

SEQ ID NO: 710705 - RNA, 64 nt, hsa; identical to SEQ ID NO: 37445

SEQ ID NO: 710706 - RNA, 64 nt, hsa; identical to SEQ ID NO: 37446

SEQ ID NO: 710707 - RNA, 64 nt, hsa; identical to SEQ ID NO: 37447

SEQ ID NO: 710708 - RNA, 64 nt, hsa; identical to SEQ ID NO: 37448

SEQ ID NO: 710709 - RNA, 64 nt, hsa; identical to SEQ ID NO: 37449

SEQ ID NO: 710710 - RNA, 64 nt, hsa; identical to SEQ ID NO: 37450

SEQ ID NO: 710711 - RNA, 64 nt, hsa; identical to SEQ ID NO: 37451

SEQ ID NO: 710712 - RNA, 64 nt, hsa; identical to SEQ ID NO: 37452

SEQ ID NO: 710713 - RNA, 64 nt, hsa; identical to SEQ ID NO: 37453

SEQ ID NO: 710714 - RNA, 64 nt, hsa; identical to SEQ ID NO: 37454

SEQ ID NO: 710715 - RNA, 64 nt, hsa; identical to SEQ ID NO: 37455

SEQ ID NO: 710716 - RNA, 64 nt, hsa; identical to SEQ ID NO: 37456

SEQ ID NO: 710717 - RNA, 64 nt, hsa; identical to SEQ ID NO: 37457

SEQ ID NO: 710718 - RNA, 64 nt, hsa; identical to SEQ ID NO: 37458

SEQ ID NO: 710719 - RNA, 64 nt, hsa; identical to SEQ ID NO: 37459

SEQ ID NO: 710720 - RNA, 64 nt, hsa; identical to SEQ ID NO: 37460

SEQ ID NO: 710721 - RNA, 64 nt, hsa; identical to SEQ ID NO: 37461

SEQ ID NO: 710722 - RNA, 64 nt, hsa; identical to SEQ ID NO: 37462

SEQ ID NO: 710723 - RNA, 64 nt, hsa; identical to SEQ ID NO: 37463

SEQ ID NO: 710724 - RNA, 64 nt, hsa; identical to SEQ ID NO: 37464

SEQ ID NO: 710725 - RNA, 64 nt, hsa; identical to SEQ ID NO: 37465

SEQ ID NO: 710726 - RNA, 64 nt, hsa; identical to SEQ ID NO: 37466

SEQ ID NO: 710727 - RNA, 64 nt, hsa; identical to SEQ ID NO: 37467

SEQ ID NO: 710728 - RNA, 64 nt, hsa; identical to SEQ ID NO: 37468

SEQ ID NO: 710729 - RNA, 64 nt, hsa; identical to SEQ ID NO: 37469

SEQ ID NO: 710730 - RNA, 64 nt, hsa; identical to SEQ ID NO: 37470

SEQ ID NO: 710731 - RNA, 64 nt, hsa; identical to SEQ ID NO: 37471

SEQ ID NO: 710732 - RNA, 64 nt, hsa; identical to SEQ ID NO: 37472

SEQ ID NO: 710733 - RNA, 64 nt, hsa; identical to SEQ ID NO: 37473

SEQ ID NO: 710734 - RNA, 64 nt, hsa; identical to SEQ ID NO: 37474

SEQ ID NO: 710735 - RNA, 64 nt, hsa; identical to SEQ ID NO: 37475

SEQ ID NO: 710736 - RNA, 64 nt, hsa; identical to SEQ ID NO: 37476

SEQ ID NO: 710737 - RNA, 64 nt, hsa; identical to SEQ ID NO: 37477

SEQ ID NO: 710738 - RNA, 64 nt, hsa; identical to SEQ ID NO: 37478

SEQ ID NO: 710739 - RNA, 64 nt, hsa; identical to SEQ ID NO: 37479

SEQ ID NO: 710740 - RNA, 64 nt, hsa; identical to SEQ ID NO: 37480

SEQ ID NO: 710741 - RNA, 64 nt, hsa; identical to SEQ ID NO: 37481

SEQ ID NO: 710742 - RNA, 64 nt, hsa; identical to SEQ ID NO: 37482

SEQ ID NO: 710743 - RNA, 64 nt, hsa; identical to SEQ ID NO: 37483

SEQ ID NO: 710744 - RNA, 64 nt, hsa; identical to SEQ ID NO: 37484

SEQ ID NO: 710745 - RNA, 64 nt, hsa; identical to SEQ ID NO: 37485

SEQ ID NO: 710746 - RNA, 64 nt, hsa; identical to SEQ ID NO: 37486

SEQ ID NO: 710747 - RNA, 64 nt, hsa; identical to SEQ ID NO: 37487

SEQ ID NO: 710748 - RNA, 64 nt, hsa; identical to SEQ ID NO: 37488

SEQ ID NO: 710749 - RNA, 64 nt, hsa; identical to SEQ ID NO: 37489

SEQ ID NO: 710750 - RNA, 64 nt, hsa; identical to SEQ ID NO: 37490

SEQ ID NO: 710751 - RNA, 64 nt, hsa; identical to SEQ ID NO: 37491

SEQ ID NO: 710752 - RNA, 64 nt, hsa; identical to SEQ ID NO: 37492

SEQ ID NO: 710753 - RNA, 64 nt, hsa; identical to SEQ ID NO: 37493

SEQ ID NO: 710754 - RNA, 64 nt, hsa; identical to SEQ ID NO: 37494

SEQ ID NO: 710755 - RNA, 64 nt, hsa; identical to SEQ ID NO: 37495

SEQ ID NO: 710756 - RNA, 64 nt, hsa; identical to SEQ ID NO: 37496

SEQ ID NO: 710757 - RNA, 64 nt, hsa; identical to SEQ ID NO: 37497

SEQ ID NO: 710758 - RNA, 64 nt, hsa; identical to SEQ ID NO: 37498

SEQ ID NO: 710759 - RNA, 64 nt, hsa; identical to SEQ ID NO: 37499

SEQ ID NO: 710760 - RNA, 64 nt, hsa; identical to SEQ ID NO: 37500

SEQ ID NO: 710761 - RNA, 64 nt, hsa; identical to SEQ ID NO: 37501

SEQ ID NO: 710762 - RNA, 64 nt, hsa; identical to SEQ ID NO: 37502

SEQ ID NO: 710763 - RNA, 64 nt, hsa; identical to SEQ ID NO: 37503

SEQ ID NO: 710764 - RNA, 64 nt, hsa; identical to SEQ ID NO: 37504

SEQ ID NO: 710765 - RNA, 64 nt, hsa; identical to SEQ ID NO: 37505

SEQ ID NO: 710766 - RNA, 64 nt, hsa; identical to SEQ ID NO: 37506

SEQ ID NO: 710767 - RNA, 64 nt, hsa; identical to SEQ ID NO: 37507

SEQ ID NO: 710768 - RNA, 64 nt, hsa; identical to SEQ ID NO: 37508

SEQ ID NO: 710769 - RNA, 64 nt, hsa; identical to SEQ ID NO: 37509

SEQ ID NO: 710770 - RNA, 64 nt, hsa; identical to SEQ ID NO: 37510

SEQ ID NO: 710771 - RNA, 64 nt, hsa; identical to SEQ ID NO: 37511

SEQ ID NO: 710772 - RNA, 64 nt, hsa; identical to SEQ ID NO: 37512

SEQ ID NO: 710773 - RNA, 64 nt, hsa; identical to SEQ ID NO: 37513

SEQ ID NO: 710774 - RNA, 64 nt, hsa; identical to SEQ ID NO: 37514

SEQ ID NO: 710775 - RNA, 64 nt, hsa; identical to SEQ ID NO: 37515

SEQ ID NO: 710776 - RNA, 64 nt, hsa; identical to SEQ ID NO: 37516

SEQ ID NO: 710777 - RNA, 64 nt, hsa; identical to SEQ ID NO: 37517

SEQ ID NO: 710778 - RNA, 64 nt, hsa; identical to SEQ ID NO: 37518

SEQ ID NO: 710779 - RNA, 64 nt, hsa; identical to SEQ ID NO: 37272

SEQ ID NO: 710780 - RNA, 64 nt, hsa; identical to SEQ ID NO: 37520

SEQ ID NO: 710781 - RNA, 64 nt, hsa; identical to SEQ ID NO: 37521

SEQ ID NO: 710782 - RNA, 64 nt, hsa; identical to SEQ ID NO: 37522

SEQ ID NO: 710783 - RNA, 64 nt, hsa; identical to SEQ ID NO: 37523

SEQ ID NO: 710784 - RNA, 64 nt, hsa; identical to SEQ ID NO: 37524

SEQ ID NO: 710785 - RNA, 64 nt, hsa; identical to SEQ ID NO: 37525

SEQ ID NO: 710786 - RNA, 64 nt, hsa; identical to SEQ ID NO: 37526

SEQ ID NO: 710787 - RNA, 64 nt, hsa; identical to SEQ ID NO: 147936

SEQ ID NO: 710788 - RNA, 64 nt, hsa; identical to SEQ ID NO: 147937

SEQ ID NO: 710789 - RNA, 64 nt, hsa; identical to SEQ ID NO: 147938

SEQ ID NO: 710790 - RNA, 64 nt, hsa; identical to SEQ ID NO: 147939

SEQ ID NO: 710791 - RNA, 64 nt, hsa; identical to SEQ ID NO: 147940

SEQ ID NO: 710792 - RNA, 64 nt, hsa; identical to SEQ ID NO: 147941

SEQ ID NO: 710793 - RNA, 64 nt, hsa; identical to SEQ ID NO: 212638

SEQ ID NO: 710794 - RNA, 64 nt, hsa; identical to SEQ ID NO: 212639

SEQ ID NO: 710795 - RNA, 64 nt, hsa; identical to SEQ ID NO: 212640

SEQ ID NO: 710796 - RNA, 64 nt, hsa; identical to SEQ ID NO: 212641

SEQ ID NO: 710797 - RNA, 64 nt, hsa; identical to SEQ ID NO: 212642

SEQ ID NO: 710798 - RNA, 64 nt, hsa; identical to SEQ ID NO: 212643

SEQ ID NO: 710799 - RNA, 64 nt, hsa; identical to SEQ ID NO: 212644

SEQ ID NO: 710800 - RNA, 64 nt, hsa; identical to SEQ ID NO: 212645

SEQ ID NO: 710801 - RNA, 64 nt, hsa; identical to SEQ ID NO: 212646

SEQ ID NO: 710802 - RNA, 64 nt, hsa; identical to SEQ ID NO: 212647

SEQ ID NO: 710803 - RNA, 64 nt, hsa; identical to SEQ ID NO: 212648

SEQ ID NO: 710804 - RNA, 64 nt, hsa; identical to SEQ ID NO: 212649

SEQ ID NO: 710805 - RNA, 64 nt, hsa; identical to SEQ ID NO: 212650

SEQ ID NO: 710806 - RNA, 64 nt, hsa; identical to SEQ ID NO: 212651

SEQ ID NO: 710807 - RNA, 64 nt, hsa; identical to SEQ ID NO: 212652

SEQ ID NO: 710808 - RNA, 64 nt, hsa; identical to SEQ ID NO: 212653

SEQ ID NO: 710809 - RNA, 64 nt, hsa; identical to SEQ ID NO: 212654

SEQ ID NO: 710810 - RNA, 64 nt, hsa; identical to SEQ ID NO: 212655

SEQ ID NO: 710811 - RNA, 64 nt, hsa; identical to SEQ ID NO: 212656

SEQ ID NO: 710812 - RNA, 64 nt, hsa; identical to SEQ ID NO: 212657

SEQ ID NO: 710813 - RNA, 64 nt, hsa; identical to SEQ ID NO: 212658

SEQ ID NO: 710814 - RNA, 64 nt, hsa; identical to SEQ ID NO: 212659

SEQ ID NO: 710815 - RNA, 64 nt, hsa; identical to SEQ ID NO: 212660

SEQ ID NO: 710816 - RNA, 64 nt, hsa; identical to SEQ ID NO: 212661

SEQ ID NO: 710817 - RNA, 64 nt, hsa; identical to SEQ ID NO: 212662

SEQ ID NO: 710818 - RNA, 64 nt, hsa; identical to SEQ ID NO: 212663

SEQ ID NO: 710819 - RNA, 64 nt, hsa; identical to SEQ ID NO: 212664

SEQ ID NO: 710820 - RNA, 64 nt, hsa; identical to SEQ ID NO: 212665

SEQ ID NO: 710821 - RNA, 64 nt, hsa; identical to SEQ ID NO: 212666

SEQ ID NO: 710822 - RNA, 62 nt, hsa; identical to SEQ ID NO: 212667

SEQ ID NO: 710823 - RNA, 64 nt, hsa; identical to SEQ ID NO: 212668

SEQ ID NO: 710824 - RNA, 64 nt, hsa; identical to SEQ ID NO: 212669

SEQ ID NO: 710825 - RNA, 64 nt, hsa; identical to SEQ ID NO: 212670

SEQ ID NO: 710826 - RNA, 64 nt, hsa; identical to SEQ ID NO: 212671

SEQ ID NO: 710827 - RNA, 64 nt, hsa; identical to SEQ ID NO: 212672

SEQ ID NO: 710828 - RNA, 64 nt, hsa; identical to SEQ ID NO: 212673

SEQ ID NO: 710829 - RNA, 64 nt, hsa; identical to SEQ ID NO: 212674

SEQ ID NO: 710830 - RNA, 64 nt, hsa; identical to SEQ ID NO: 212675

SEQ ID NO: 710831 - RNA, 64 nt, hsa; identical to SEQ ID NO: 212676

SEQ ID NO: 710832 - RNA, 64 nt, hsa; identical to SEQ ID NO: 212677

SEQ ID NO: 710833 - RNA, 64 nt, hsa; identical to SEQ ID NO: 212678

SEQ ID NO: 710834 - RNA, 64 nt, hsa; identical to SEQ ID NO: 212679

SEQ ID NO: 710835 - RNA, 64 nt, hsa
guauggcaaauggauaaaauauuguggcaucaacuacuuuuaaaguagaaaagcuauccauuuu

SEQ ID NO: 710836 - RNA, 64 nt, hsa
auugaaauaaagccucuuaaaaugaaaaaucauauacuuuuaacaucacuuuuaagcuaauaaa

SEQ ID NO: 710837 - RNA, 64 nt, hsa
aaaaucucaacuauaaccaguuuagcuuuuuccuuacuuuuaaaauaaaauuuuuuacuuuuaa

SEQ ID NO: 710838 - RNA, 64 nt, hsa
uuagcuuuuuccuuacuuuuaaaauaaaauuuuuuacuuuuaacuauuuuuuuaguuaauauuu

SEQ ID NO: 710839 - RNA, 64 nt, hsa
uuuuagggacaaagacauuuuggaaauugucaguuacuuuuagaaagaaaacacugcagaaaua

SEQ ID NO: 710840 - RNA, 64 nt, hsa
auuaucaacuagagauauuuauaaaugaaguauauacuuuuaaaacauguaaguuauacuaauu

SEQ ID NO: 710841 - RNA, 64 nt, hsa
guagacuuucaaaaugagugauuuguuagcuugguacuuuuaaguuugugguacagauccucca

SEQ ID NO: 710842 - RNA, 64 nt, hsa
ucaaaugaucuguucugcacugagccaagcaaguuacuuuuaaaacugguggcaccacucauuu

SEQ ID NO: 710843 - RNA, 64 nt, hsa
caguuuuauagauugcacaucauucuuuaaggcauacuuuuaccucaggaaacuuacucuagua

SEQ ID NO: 710844 - RNA, 64 nt, hsa
acucauuacgucgucauucuuguuacaucacucauacuuuuagcugcaaccacacuaauucaca

SEQ ID NO: 710845 - RNA, 64 nt, hsa
ugucauugaauuguagguuuccuuuuuuuuucuuuacuuuuaaauuuuaacuuuuaaaaucuau

SEQ ID NO: 710846 - RNA, 64 nt, hsa
ugguuaauugccuuguaaauuuugcgugucuguauacuuuuauaccaacuuauuguaggcucuu

SEQ ID NO: 710847 - RNA, 64 nt, hsa
cuucugcacagagcauaaugugaaguuuuauaccuacuuuuaaaauucugcuuuccagaaacaa

SEQ ID NO: 710848 - RNA, 64 nt, hsa
uuuuuuuuccauuuuugcacuuaacagugaugaauacuuuuacguuggaauccuccuucuagcu

SEQ ID NO: 710849 - RNA, 64 nt, hsa
uaaaguaaugagaauaaaaauguuggcccaaaauuacuuuuauaaauaaauaauuccaaaauaa

SEQ ID NO: 710850 - RNA, 64 nt, hsa
uuuaacaauuaaaugccuauuuuguuauauguuauacuuuuauucuuaauucugaauuuugaca

SEQ ID NO: 710851 - RNA, 64 nt, hsa
caggucuaaaauacuacauugucacuguaagcuauacuuuuaaaauauuuauuuuuuuuaaagu

SEQ ID NO: 710852 - RNA, 64 nt, hsa
cagauauuauguauaucuucuagccuuuauucuguacuuuuaauguacauauuucugucuugcg

SEQ ID NO: 710853 - RNA, 64 nt, hsa
acaucaaaaagguauauacuuuuuaaaaaaaauuuacuuuuauugauguguacucuuccuauug

SEQ ID NO: 710854 - RNA, 64 nt, hsa
uuauuuaucacacuguuguaaugauguuuugagauacuuuuauaacaaaauuaacaucaaaaag

SEQ ID NO: 710855 - RNA, 64 nt, hsa
aaauuaauguucugacaguugugaucgccuggaguacuuuuagacuuuuagcauucguuuuuua

SEQ ID NO: 710856 - RNA, 64 nt, hsa
caaacaguguaacagguccuucccagauuuaggguacuuuuauugauggauauguuuuccuuuu

SEQ ID NO: 710857 - RNA, 64 nt, hsa
uauguuuaaaaucugaauggcaguacuagcucuauacuuuuaauacugcuuuguauuuuauaug

SEQ ID NO: 710858 - RNA, 64 nt, hsa
uguauuuaagaauuuucuguuuuaaugcauguuauacuuuuauguaggauuccaaaccuucccu

SEQ ID NO: 710859 - RNA, 64 nt, hsa
uaagugcaaaaugguauauaauguguacuuuuucuacuuuuaggaaaauuuaaugagagcuuau

SEQ ID NO: 710860 - RNA, 64 nt, hsa
aggcauuuugaaaaacuuucaaccuguaaaaaguuacuuuuaucuuggauuuauuaugaagaac

SEQ ID NO: 710861 - RNA, 64 nt, hsa
accaugugccaucuguacauauuacuguugcauuuacuuuuaauaaagcuuguggccccuuuua

SEQ ID NO: 710862 - RNA, 64 nt, hsa
cuucuugugauugcugccauaauucuaaguuauuuacuuuuaccacuauuuaaguuaucaacuu

SEQ ID NO: 710863 - RNA, 64 nt, hsa
uuugguguguuacauagccauguuucuauuaguuuacuuuuaaaucucaaauuuaaguuauuau

SEQ ID NO: 710864 - RNA, 64 nt, hsa
guuuauauacuuauuauuuuaucuuuaagcaugcuacuuuuacuuggccaauauuuucuuaugu

SEQ ID NO: 710865 - RNA, 64 nt, hsa
auuaaauuauuguuaauaauauaacauauaagaauacuuuuauuaaaauaaccaugcaacaaua

SEQ ID NO: 710866 - RNA, 64 nt, hsa
caaaaccaauauauaauuuggcugcugauuggcuuacuuuuagauuuaaaguuacuuuggguau

SEQ ID NO: 710867 - RNA, 64 nt, hsa
ccccuauggaugaucuuuaggaaaagcagcccuuuacuuuuaauacaggcuuuaaugaacuaua

SEQ ID NO: 710868 - RNA, 64 nt, hsa
cucaauuuuucauauugcaaagaguagcuuuuuguacuuuuauuacugagagaucuucauauac

SEQ ID NO: 710869 - RNA, 64 nt, hsa
uucuucaugugcaaagugacuauuuguucuauaauacuuuuauguguguuauaucaaauguguc

SEQ ID NO: 710870 - RNA, 64 nt, hsa
uguaugauauguaaaacagauuuuuuguagagcuuacuuuuauuauuaaauguauugagguauu

SEQ ID NO: 710871 - RNA, 64 nt, hsa
ccacugagaagcuagacuuucaugcgggagaggcuacuuuuaugugucgucuuccggggaaggg

SEQ ID NO: 710872 - RNA, 64 nt, hsa
caguuccugccuauaauggucucagagaggguccuacuuuuagguuuucccaggacaggacagu

SEQ ID NO: 710873 - RNA, 64 nt, hsa
aggguaguggggugcauuugguuuucaaauuggguacuuuuaacacuuuagugccugacugcug

SEQ ID NO: 710874 - RNA, 64 nt, hsa
acuuuggacuaauuuaaaaaagaaucccaguuuuuacuuuuacuggauggugaaauugguugcu

SEQ ID NO: 710875 - RNA, 64 nt, hsa
uguguguguguguguauauauauauauauauuuuuacuuuuauccucuuaccgaagguuacacu

SEQ ID NO: 710876 - RNA, 64 nt, hsa
guccuccucagucagaauagaaaaguaacugaaauacuuuuaccuuucuguccuugauaaaaua

SEQ ID NO: 710877 - RNA, 64 nt, hsa
gaugucucugacaaagugugucucaaaaauaauauacuuuuacauuaaagaaauuuaauguuuc

SEQ ID NO: 710878 - RNA, 64 nt, hsa
uuuuagugcacuuaauauuagcuugcuuaaggcauacuuuuaaucaaguagaacaaaaacuauu

SEQ ID NO: 710879 - RNA, 64 nt, hsa
gcucgcccaaagagauacaaccuaauccccaaccuacuuuuaguuuuuuuguuuuuuuuuuaug

SEQ ID NO: 710880 - RNA, 64 nt, hsa
aggcugccugcacccccucccuuucccuuaacucuacuuuuacauccccaaaccaccuuuguca

SEQ ID NO: 710881 - RNA, 64 nt, hsa
uaaauaucauuucucaagugagugaguuccccucuacuuuuagccuuccacccaaacuggaagc

SEQ ID NO: 710882 - RNA, 64 nt, hsa
uuauaaaguugcuggauagaagaaaaauaacuuguacuuuuauuucugacuuuuagaaaccuag

SEQ ID NO: 710883 - RNA, 64 nt, hsa
ccucuucugggcauuuaagcugguauguuagugcuacuuuuaagauuguggagucugaguuaau

SEQ ID NO: 710884 - RNA, 64 nt, hsa
ggagacuagaguaucuaguuuuuaguauuuaaacuacuuuuaauuauuuauauugauacucucu

SEQ ID NO: 710885 - RNA, 64 nt, hsa
auuugcccugaguauuaaagcuagcuuagcaaaauacuuuuaaaaacauauugguaaaugauac

SEQ ID NO: 710886 - RNA, 64 nt, hsa
ugaauacaggcuuucuagagaucuuuuucauuaauacuuuuaaauaccuuucagguaguuacau

SEQ ID NO: 710887 - RNA, 64 nt, hsa
gguuuuuuaaaauaacuggcaaaugcuaugcuucuacuuuuaaaauuugugguaauacccagaa

SEQ ID NO: 710888 - RNA, 64 nt, hsa
agauuuuuuaaaaugcuuuuuuaauauuaaaauguacuuuuacauucuuaaucuuuuuuuagaa

SEQ ID NO: 710889 - RNA, 64 nt, hsa
cuuauuugcgugcacugacaaaauucuauuuguuuacuuuuauauuaaugguaauaaaauagau

SEQ ID NO: 710890 - RNA, 64 nt, hsa
uugaaauagaaauaguucuuuaaaaauauuucucuacuuuuaaaacaagauacuuaauauuuuu

SEQ ID NO: 710891 - RNA, 64 nt, hsa
acuuuuuucuuuuaaauuauuaaagugucuuuuauacuuuuaugaaaucauugguagcccccca

SEQ ID NO: 710892 - RNA, 64 nt, hsa
uucuuuagcucuugugauaagauuuucuuuuuuuuacuuuuauacaaaggcagcaucuuugaau

SEQ ID NO: 710893 - RNA, 64 nt, hsa
cauguaauuauuucugcuguuauauaaagugccauacuuuuaauaaaggaaaauguacauauga

SEQ ID NO: 710894 - RNA, 64 nt, hsa
auuaagggcuuacagaacauguugaaacuuuuuuuacuuuuauugggaauaaggaauguuugca

SEQ ID NO: 710895 - RNA, 64 nt, hsa
cucuacuguaguacauuucaggaucuagaaguuuuacuuuuauaaagaugguguccggaagaug

SEQ ID NO: 710896 - RNA, 51 nt, hsa
cccagaguggguggcagugaauacuuuuaacuuuuauucuccuucagagca

SEQ ID NO: 710897 - RNA, 64 nt, hsa
ccaacuaauauaaaauaccauuguuaaagaaugguacuuuuauaaacauuaguguauuuauuuc

SEQ ID NO: 710898 - RNA, 64 nt, hsa
uaucagugauugccauuagacuguugaauacuguuacuuuuauauagaacccaaggaaugccuu

SEQ ID NO: 710899 - RNA, 64 nt, hsa
gacccuuuuuguaaaugucaaggacauuuggauuuacuuuuacagaauauugaaaagauaagac

SEQ ID NO: 710900 - RNA, 64 nt, hsa
gaauguucauuaauguaaauuguauuuauuuuuauacuuuuauuuucacuaguuuugcuucuag

SEQ ID NO: 710901 - RNA, 64 nt, hsa
uaccuccaaagauauuuucaggauaggcuuuguauacuuuuauugguuauuuagaauccagugg

SEQ ID NO: 710902 - RNA, 64 nt, hsa
agaggcuuuagauuauuauuuuagauccuacauauacuuuuaucaguagaaugauuucauuuag

SEQ ID NO: 710903 - RNA, 64 nt, hsa
uagaaacugaacaucaagaaccccaccaaaauauuacuuuuaaaaacaaugacaaaccacacaa

SEQ ID NO: 710904 - RNA, 64 nt, hsa
uauuggauuuacuucuuauauugagucagaugcauacuuuuagauuugcauuggggaaaaugua

SEQ ID NO: 710905 - RNA, 64 nt, hsa
uuauauuuguauauuuacaguuacaaaacaaauguacuuuuaccuuuuauuucugacccugugu

SEQ ID NO: 710906 - RNA, 64 nt, hsa
uauuauucccuugcucauauaacuuuaaaaauaauacuuuuagcucuaauagcucaagaacaca

SEQ ID NO: 710907 - RNA, 64 nt, hsa
agccgucuaugggauuaaaagacacgugaaaugauacuuuuauuauucccuugcucauauaacu

SEQ ID NO: 710908 - RNA, 64 nt, hsa
gaacaauuuuaaauuuauuuuuuauuauguaacauacuuuuauuaaaauauauacuuauauaau

SEQ ID NO: 710909 - RNA, 64 nt, hsa
auuuauccuuuguauuacaagcaacccaguuuuauacuuuuaguuauuuuaaaauguaaaauua

SEQ ID NO: 710910 - RNA, 64 nt, hsa
uuauaaguaaauuaaaauuaguauauuuuacuaauacuuuuauauaaaaugcaguauauuuuuu

SEQ ID NO: 710911 - RNA, 64 nt, hsa; identical to SEQ ID NO: 585938

SEQ ID NO: 710912 - RNA, 64 nt, hsa; identical to SEQ ID NO: 585939

SEQ ID NO: 710913 - RNA, 64 nt, hsa; identical to SEQ ID NO: 585975

SEQ ID NO: 710914 - RNA, 64 nt, hsa; identical to SEQ ID NO: 585976

SEQ ID NO: 710915 - RNA, 64 nt, hsa; identical to SEQ ID NO: 585989

SEQ ID NO: 710916 - RNA, 64 nt, hsa; identical to SEQ ID NO: 585990

SEQ ID NO: 710917 - RNA, 64 nt, hsa; identical to SEQ ID NO: 586015

SEQ ID NO: 710918 - RNA, 64 nt, hsa; identical to SEQ ID NO: 586016

SEQ ID NO: 710919 - RNA, 64 nt, hsa; identical to SEQ ID NO: 586033

SEQ ID NO: 710920 - RNA, 64 nt, hsa; identical to SEQ ID NO: 586034

SEQ ID NO: 710921 - RNA, 64 nt, hsa; identical to SEQ ID NO: 586055

SEQ ID NO: 710922 - RNA, 64 nt, hsa; identical to SEQ ID NO: 586056

SEQ ID NO: 710923 - RNA, 64 nt, hsa; identical to SEQ ID NO: 586149

SEQ ID NO: 710924 - RNA, 64 nt, hsa; identical to SEQ ID NO: 586150

SEQ ID NO: 710925 - RNA, 64 nt, hsa; identical to SEQ ID NO: 586153

SEQ ID NO: 710926 - RNA, 64 nt, hsa; identical to SEQ ID NO: 586154

SEQ ID NO: 710927 - RNA, 64 nt, hsa; identical to SEQ ID NO: 586176

SEQ ID NO: 710928 - RNA, 64 nt, hsa; identical to SEQ ID NO: 586177

SEQ ID NO: 710929 - RNA, 64 nt, hsa; identical to SEQ ID NO: 586192

SEQ ID NO: 710930 - RNA, 64 nt, hsa; identical to SEQ ID NO: 586193

SEQ ID NO: 710931 - RNA, 64 nt, hsa; identical to SEQ ID NO: 586220

SEQ ID NO: 710932 - RNA, 64 nt, hsa; identical to SEQ ID NO: 586221

SEQ ID NO: 710933 - RNA, 64 nt, hsa; identical to SEQ ID NO: 586224

SEQ ID NO: 710934 - RNA, 64 nt, hsa; identical to SEQ ID NO: 586225

SEQ ID NO: 710935 - RNA, 64 nt, hsa; identical to SEQ ID NO: 318013

SEQ ID NO: 710936 - RNA, 64 nt, hsa; identical to SEQ ID NO: 318014

SEQ ID NO: 710937 - RNA, 64 nt, hsa; identical to SEQ ID NO: 318015

SEQ ID NO: 710938 - RNA, 64 nt, hsa; identical to SEQ ID NO: 318016

SEQ ID NO: 710939 - RNA, 64 nt, hsa; identical to SEQ ID NO: 318017

SEQ ID NO: 710940 - RNA, 64 nt, hsa; identical to SEQ ID NO: 318018

SEQ ID NO: 710941 - RNA, 64 nt, hsa; identical to SEQ ID NO: 318019

SEQ ID NO: 710942 - RNA, 64 nt, hsa; identical to SEQ ID NO: 318020

SEQ ID NO: 710943 - RNA, 64 nt, hsa; identical to SEQ ID NO: 318021

SEQ ID NO: 710944 - RNA, 64 nt, hsa; identical to SEQ ID NO: 318022

SEQ ID NO: 710945 - RNA, 64 nt, hsa; identical to SEQ ID NO: 318023

SEQ ID NO: 710946 - RNA, 64 nt, hsa; identical to SEQ ID NO: 318024

SEQ ID NO: 710947 - RNA, 64 nt, hsa; identical to SEQ ID NO: 318025

SEQ ID NO: 710948 - RNA, 64 nt, hsa; identical to SEQ ID NO: 318026

SEQ ID NO: 710949 - RNA, 64 nt, hsa; identical to SEQ ID NO: 318027

SEQ ID NO: 710950 - RNA, 64 nt, hsa; identical to SEQ ID NO: 318028

SEQ ID NO: 710951 - RNA, 59 nt, hsa; identical to SEQ ID NO: 658163

SEQ ID NO: 710952 - RNA, 64 nt, hsa; identical to SEQ ID NO: 658164

SEQ ID NO: 710953 - RNA, 64 nt, hsa; identical to SEQ ID NO: 658165

SEQ ID NO: 710954 - RNA, 64 nt, hsa; identical to SEQ ID NO: 658166

SEQ ID NO: 710955 - RNA, 64 nt, hsa; identical to SEQ ID NO: 658167

SEQ ID NO: 710956 - RNA, 64 nt, hsa; identical to SEQ ID NO: 658168

SEQ ID NO: 710957 - RNA, 64 nt, hsa; identical to SEQ ID NO: 658169

SEQ ID NO: 710958 - RNA, 50 nt, hsa; identical to SEQ ID NO: 658170

SEQ ID NO: 710959 - RNA, 64 nt, hsa; identical to SEQ ID NO: 658171

SEQ ID NO: 710960 - RNA, 64 nt, hsa; identical to SEQ ID NO: 658172

SEQ ID NO: 710961 - RNA, 52 nt, hsa; identical to SEQ ID NO: 658173

SEQ ID NO: 710962 - RNA, 64 nt, hsa; identical to SEQ ID NO: 658174

SEQ ID NO: 710963 - RNA, 64 nt, hsa; identical to SEQ ID NO: 658175

SEQ ID NO: 710964 - RNA, 64 nt, hsa; identical to SEQ ID NO: 658176

SEQ ID NO: 710965 - RNA, 64 nt, hsa; identical to SEQ ID NO: 658177

SEQ ID NO: 710966 - RNA, 64 nt, hsa; identical to SEQ ID NO: 658178

SEQ ID NO: 710967 - RNA, 64 nt, hsa; identical to SEQ ID NO: 658179

SEQ ID NO: 710968 - RNA, 64 nt, hsa; identical to SEQ ID NO: 658180

SEQ ID NO: 710969 - RNA, 64 nt, hsa; identical to SEQ ID NO: 80933

SEQ ID NO: 710970 - RNA, 64 nt, hsa; identical to SEQ ID NO: 80934

SEQ ID NO: 710971 - RNA, 64 nt, hsa; identical to SEQ ID NO: 80935

SEQ ID NO: 710972 - RNA, 64 nt, hsa; identical to SEQ ID NO: 80936

SEQ ID NO: 710973 - RNA, 64 nt, hsa; identical to SEQ ID NO: 80937

SEQ ID NO: 710974 - RNA, 64 nt, hsa; identical to SEQ ID NO: 80938

SEQ ID NO: 710975 - RNA, 64 nt, hsa; identical to SEQ ID NO: 80939

SEQ ID NO: 710976 - RNA, 64 nt, hsa; identical to SEQ ID NO: 80940

SEQ ID NO: 710977 - RNA, 64 nt, hsa; identical to SEQ ID NO: 80941

SEQ ID NO: 710978 - RNA, 64 nt, hsa; identical to SEQ ID NO: 80942

SEQ ID NO: 710979 - RNA, 64 nt, hsa; identical to SEQ ID NO: 80943

SEQ ID NO: 710980 - RNA, 64 nt, hsa; identical to SEQ ID NO: 80944

SEQ ID NO: 710981 - RNA, 64 nt, hsa; identical to SEQ ID NO: 80945

SEQ ID NO: 710982 - RNA, 64 nt, hsa; identical to SEQ ID NO: 80946

SEQ ID NO: 710983 - RNA, 64 nt, hsa; identical to SEQ ID NO: 80947

SEQ ID NO: 710984 - RNA, 64 nt, hsa; identical to SEQ ID NO: 80948

SEQ ID NO: 710985 - RNA, 64 nt, hsa; identical to SEQ ID NO: 80949

SEQ ID NO: 710986 - RNA, 64 nt, hsa; identical to SEQ ID NO: 80950

SEQ ID NO: 710987 - RNA, 64 nt, hsa; identical to SEQ ID NO: 80951

SEQ ID NO: 710988 - RNA, 64 nt, hsa; identical to SEQ ID NO: 80952

SEQ ID NO: 710989 - RNA, 64 nt, hsa; identical to SEQ ID NO: 80953

SEQ ID NO: 710990 - RNA, 64 nt, hsa; identical to SEQ ID NO: 80954

SEQ ID NO: 710991 - RNA, 63 nt, hsa; identical to SEQ ID NO: 80955

SEQ ID NO: 710992 - RNA, 64 nt, hsa; identical to SEQ ID NO: 80956

SEQ ID NO: 710993 - RNA, 64 nt, hsa; identical to SEQ ID NO: 80957

SEQ ID NO: 710994 - RNA, 64 nt, hsa; identical to SEQ ID NO: 80958

SEQ ID NO: 710995 - RNA, 64 nt, hsa; identical to SEQ ID NO: 80959

SEQ ID NO: 710996 - RNA, 64 nt, hsa; identical to SEQ ID NO: 80960

SEQ ID NO: 710997 - RNA, 64 nt, hsa; identical to SEQ ID NO: 80961

SEQ ID NO: 710998 - RNA, 64 nt, hsa; identical to SEQ ID NO: 80962

SEQ ID NO: 710999 - RNA, 64 nt, hsa; identical to SEQ ID NO: 80963

SEQ ID NO: 711000 - RNA, 64 nt, hsa; identical to SEQ ID NO: 80964

SEQ ID NO: 711001 - RNA, 64 nt, hsa; identical to SEQ ID NO: 80965

SEQ ID NO: 711002 - RNA, 64 nt, hsa; identical to SEQ ID NO: 80966

SEQ ID NO: 711003 - RNA, 64 nt, hsa; identical to SEQ ID NO: 80967

SEQ ID NO: 711004 - RNA, 64 nt, hsa; identical to SEQ ID NO: 80968

SEQ ID NO: 711005 - RNA, 64 nt, hsa; identical to SEQ ID NO: 80969

SEQ ID NO: 711006 - RNA, 64 nt, hsa; identical to SEQ ID NO: 80970

SEQ ID NO: 711007 - RNA, 64 nt, hsa; identical to SEQ ID NO: 80971

SEQ ID NO: 711008 - RNA, 64 nt, hsa; identical to SEQ ID NO: 80972

SEQ ID NO: 711009 - RNA, 64 nt, hsa; identical to SEQ ID NO: 80973

SEQ ID NO: 711010 - RNA, 64 nt, hsa; identical to SEQ ID NO: 80974

SEQ ID NO: 711011 - RNA, 64 nt, hsa; identical to SEQ ID NO: 80975

SEQ ID NO: 711012 - RNA, 64 nt, hsa; identical to SEQ ID NO: 80976

SEQ ID NO: 711013 - RNA, 64 nt, hsa; identical to SEQ ID NO: 80977

SEQ ID NO: 711014 - RNA, 64 nt, hsa; identical to SEQ ID NO: 80978

SEQ ID NO: 711015 - RNA, 64 nt, hsa; identical to SEQ ID NO: 80979

SEQ ID NO: 711016 - RNA, 64 nt, hsa; identical to SEQ ID NO: 80980

SEQ ID NO: 711017 - RNA, 64 nt, hsa; identical to SEQ ID NO: 80981

SEQ ID NO: 711018 - RNA, 64 nt, hsa; identical to SEQ ID NO: 80982

SEQ ID NO: 711019 - RNA, 64 nt, hsa; identical to SEQ ID NO: 80983

SEQ ID NO: 711020 - RNA, 64 nt, hsa; identical to SEQ ID NO: 80984

SEQ ID NO: 711021 - RNA, 64 nt, hsa; identical to SEQ ID NO: 80985

SEQ ID NO: 711022 - RNA, 64 nt, hsa; identical to SEQ ID NO: 80986

SEQ ID NO: 711023 - RNA, 64 nt, hsa; identical to SEQ ID NO: 80987

SEQ ID NO: 711024 - RNA, 64 nt, hsa; identical to SEQ ID NO: 80988

SEQ ID NO: 711025 - RNA, 64 nt, hsa; identical to SEQ ID NO: 80989

SEQ ID NO: 711026 - RNA, 64 nt, hsa; identical to SEQ ID NO: 80990

SEQ ID NO: 711027 - RNA, 64 nt, hsa; identical to SEQ ID NO: 80991

SEQ ID NO: 711028 - RNA, 64 nt, hsa; identical to SEQ ID NO: 80992

SEQ ID NO: 711029 - RNA, 64 nt, hsa; identical to SEQ ID NO: 80993

SEQ ID NO: 711030 - RNA, 64 nt, hsa; identical to SEQ ID NO: 80994

SEQ ID NO: 711031 - RNA, 64 nt, hsa; identical to SEQ ID NO: 80995

SEQ ID NO: 711032 - RNA, 64 nt, hsa; identical to SEQ ID NO: 80996

SEQ ID NO: 711033 - RNA, 64 nt, hsa; identical to SEQ ID NO: 80997

SEQ ID NO: 711034 - RNA, 64 nt, hsa; identical to SEQ ID NO: 80998

SEQ ID NO: 711035 - RNA, 64 nt, hsa; identical to SEQ ID NO: 80999

SEQ ID NO: 711036 - RNA, 64 nt, hsa; identical to SEQ ID NO: 81000

SEQ ID NO: 711037 - RNA, 64 nt, hsa; identical to SEQ ID NO: 81001

SEQ ID NO: 711038 - RNA, 64 nt, hsa; identical to SEQ ID NO: 81002

SEQ ID NO: 711039 - RNA, 64 nt, hsa; identical to SEQ ID NO: 81003

SEQ ID NO: 711040 - RNA, 64 nt, hsa; identical to SEQ ID NO: 81004

SEQ ID NO: 711041 - RNA, 64 nt, hsa; identical to SEQ ID NO: 81005

SEQ ID NO: 711042 - RNA, 64 nt, hsa; identical to SEQ ID NO: 81006

SEQ ID NO: 711043 - RNA, 64 nt, hsa; identical to SEQ ID NO: 81007

SEQ ID NO: 711044 - RNA, 64 nt, hsa; identical to SEQ ID NO: 81008

SEQ ID NO: 711045 - RNA, 64 nt, hsa; identical to SEQ ID NO: 81009

SEQ ID NO: 711046 - RNA, 64 nt, hsa; identical to SEQ ID NO: 81010

SEQ ID NO: 711047 - RNA, 64 nt, hsa; identical to SEQ ID NO: 81011

SEQ ID NO: 711048 - RNA, 64 nt, hsa; identical to SEQ ID NO: 81012

SEQ ID NO: 711049 - RNA, 64 nt, hsa; identical to SEQ ID NO: 81013

SEQ ID NO: 711050 - RNA, 64 nt, hsa; identical to SEQ ID NO: 81014

SEQ ID NO: 711051 - RNA, 64 nt, hsa; identical to SEQ ID NO: 81015

SEQ ID NO: 711052 - RNA, 64 nt, hsa; identical to SEQ ID NO: 81016

SEQ ID NO: 711053 - RNA, 64 nt, hsa; identical to SEQ ID NO: 81017

SEQ ID NO: 711054 - RNA, 64 nt, hsa; identical to SEQ ID NO: 81018

SEQ ID NO: 711055 - RNA, 64 nt, hsa; identical to SEQ ID NO: 81019

SEQ ID NO: 711056 - RNA, 64 nt, hsa; identical to SEQ ID NO: 81020

SEQ ID NO: 711057 - RNA, 64 nt, hsa; identical to SEQ ID NO: 81021

SEQ ID NO: 711058 - RNA, 64 nt, hsa; identical to SEQ ID NO: 81022

SEQ ID NO: 711059 - RNA, 64 nt, hsa; identical to SEQ ID NO: 81023

SEQ ID NO: 711060 - RNA, 64 nt, hsa; identical to SEQ ID NO: 81024

SEQ ID NO: 711061 - RNA, 64 nt, hsa; identical to SEQ ID NO: 81025

SEQ ID NO: 711062 - RNA, 64 nt, hsa; identical to SEQ ID NO: 81026

SEQ ID NO: 711063 - RNA, 64 nt, hsa; identical to SEQ ID NO: 81027

SEQ ID NO: 711064 - RNA, 64 nt, hsa; identical to SEQ ID NO: 81028

SEQ ID NO: 711065 - RNA, 64 nt, hsa; identical to SEQ ID NO: 81029

SEQ ID NO: 711066 - RNA, 64 nt, hsa; identical to SEQ ID NO: 81030

SEQ ID NO: 711067 - RNA, 64 nt, hsa; identical to SEQ ID NO: 81031

SEQ ID NO: 711068 - RNA, 64 nt, hsa; identical to SEQ ID NO: 81032

SEQ ID NO: 711069 - RNA, 64 nt, hsa; identical to SEQ ID NO: 81033

SEQ ID NO: 711070 - RNA, 64 nt, hsa; identical to SEQ ID NO: 81034

SEQ ID NO: 711071 - RNA, 64 nt, hsa; identical to SEQ ID NO: 81035

SEQ ID NO: 711072 - RNA, 64 nt, hsa; identical to SEQ ID NO: 81036

SEQ ID NO: 711073 - RNA, 64 nt, hsa; identical to SEQ ID NO: 81037

SEQ ID NO: 711074 - RNA, 64 nt, hsa; identical to SEQ ID NO: 81038

SEQ ID NO: 711075 - RNA, 64 nt, hsa; identical to SEQ ID NO: 81039

SEQ ID NO: 711076 - RNA, 64 nt, hsa; identical to SEQ ID NO: 81040

SEQ ID NO: 711077 - RNA, 64 nt, hsa; identical to SEQ ID NO: 81041

SEQ ID NO: 711078 - RNA, 64 nt, hsa; identical to SEQ ID NO: 81042

SEQ ID NO: 711079 - RNA, 64 nt, hsa
aaauuuuuuacacguuugcagaggugcaaucaaauggaauuaagucucucgacuuuggaaggaa

SEQ ID NO: 711080 - RNA, 64 nt, hsa
acauauauauauauauauauguaugaaacccgcauggaauuaucuguaugaaaucaaggugcgc

SEQ ID NO: 711081 - RNA, 64 nt, hsa
auauuucucuuugauuauuuauuccucuugauuguggaauuaauuugauugcuugcuaauggua

SEQ ID NO: 711082 - RNA, 64 nt, hsa
cugcauugugcuagcauggaagaaucaugggcuuuggaauuaaacccauuugguggaauuaaac

SEQ ID NO: 711083 - RNA, 64 nt, hsa
aagaaucaugggcuuuggaauuaaacccauuugguggaauuaaacccauuugguuucaaauccc

SEQ ID NO: 711084 - RNA, 64 nt, hsa
uccaacuuaaaaaggcaaaaccuuaccuuggaauuggaauuacuguaaacagccuacugaaaau

SEQ ID NO: 711085 - RNA, 64 nt, hsa
ucacaaaaaaaguaauuguaaacuaguacuauuauggaauuacucuacuguucuuucuuuaaua

SEQ ID NO: 711086 - RNA, 64 nt, hsa
accccaggcagacucagacacagggaaggaggcuuggaauuaggaugggaucgcgagagagaug

SEQ ID NO: 711087 - RNA, 51 nt, hsa
uuguucacuuucuaacuugauuggaauuaggaaagguaagaaucgccuuaa

SEQ ID NO: 711088 - RNA, 64 nt, hsa
aauauggaaauuacugaaauaagacgguguauaauggaauuaacacccaaaauaaguagaacac

SEQ ID NO: 711089 - RNA, 64 nt, hsa
aguugaauuuugaaaagagucaguccuuguuugcuggaauuagaauguuaauguccuaguauua

SEQ ID NO: 711090 - RNA, 64 nt, hsa
uccauguaaaucuagaucuuuggagcaauuaagauggaauuacaauuucuagggagcauuuuaa

SEQ ID NO: 711091 - RNA, 64 nt, hsa
uuuuggcuuuuucauaauuuuaugucuuacaguauggaauuauaauacgaaaaucuuuauauga

SEQ ID NO: 711092 - RNA, 64 nt, hsa
auauaauauauucgauagaaaugaaaaucugccguggaauuaacuaauaaguaguaacaauaaa

SEQ ID NO: 711093 - RNA, 64 nt, hsa
guaauaaaucaacaaauaauuuuugauugacugguggaauuagauuuacuaaauaaaaauggcu

SEQ ID NO: 711094 - RNA, 64 nt, hsa
gauuauuuucuguauuuuaguauauaguauaaaauggaauuauuggguuaaaguacuuuuauua

SEQ ID NO: 711095 - RNA, 64 nt, hsa
gggauugucaccaguuguaccaauuugaagaaccuggaauuaguagaauucuagaaguuuacuu

SEQ ID NO: 711096 - RNA, 64 nt, hsa
guauaaucuguagagccuccauggcucuaaaauuuggaauuaacuucucuugccuuaagagcug

SEQ ID NO: 711097 - RNA, 64 nt, hsa
caagcaauucuccugccucagccucucgagcagcuggaauuacaggcacgugccacgacaccca

SEQ ID NO: 711098 - RNA, 64 nt, hsa
uccuacuuauacuuccccaaaaaacaagcuuuacuggaauuaauggaaaauauuaugucaaucu

SEQ ID NO: 711099 - RNA, 64 nt, hsa
caagugauucuccugucucagccucccaaguagcuggaauuacagggacccgccaccacgcccg

SEQ ID NO: 711100 - RNA, 64 nt, hsa
gaaggaaaaaccugagccuaucuggcugggaugguggaauuaagcacaaggucacauucucugu

SEQ ID NO: 711101 - RNA, 64 nt, hsa
aggugauccacucgccccuuggcucccaaagugcuggaauuacaggcauuagccaccaugccug

SEQ ID NO: 711102 - RNA, 64 nt, hsa
caggcaauucucuugcaucagccucgcgaguaguuggaauuauaggcaugugccaccacaccca

SEQ ID NO: 711103 - RNA, 64 nt, hsa; identical to SEQ ID NO: 275791

SEQ ID NO: 711104 - RNA, 64 nt, hsa; identical to SEQ ID NO: 275792

SEQ ID NO: 711105 - RNA, 64 nt, hsa; identical to SEQ ID NO: 275793

SEQ ID NO: 711106 - RNA, 64 nt, hsa; identical to SEQ ID NO: 275794

SEQ ID NO: 711107 - RNA, 64 nt, hsa; identical to SEQ ID NO: 275795

SEQ ID NO: 711108 - RNA, 64 nt, hsa; identical to SEQ ID NO: 275796

SEQ ID NO: 711109 - RNA, 64 nt, hsa; identical to SEQ ID NO: 275797

SEQ ID NO: 711110 - RNA, 64 nt, hsa; identical to SEQ ID NO: 275798

SEQ ID NO: 711111 - RNA, 64 nt, hsa; identical to SEQ ID NO: 275799

SEQ ID NO: 711112 - RNA, 64 nt, hsa; identical to SEQ ID NO: 275800

SEQ ID NO: 711113 - RNA, 64 nt, hsa; identical to SEQ ID NO: 275801

SEQ ID NO: 711114 - RNA, 64 nt, hsa; identical to SEQ ID NO: 275802

SEQ ID NO: 711115 - RNA, 64 nt, hsa; identical to SEQ ID NO: 275803

SEQ ID NO: 711116 - RNA, 64 nt, hsa; identical to SEQ ID NO: 275804

SEQ ID NO: 711117 - RNA, 64 nt, hsa; identical to SEQ ID NO: 275805

SEQ ID NO: 711118 - RNA, 64 nt, hsa; identical to SEQ ID NO: 275806

SEQ ID NO: 711119 - RNA, 64 nt, hsa; identical to SEQ ID NO: 275807

SEQ ID NO: 711120 - RNA, 64 nt, hsa; identical to SEQ ID NO: 275808

SEQ ID NO: 711121 - RNA, 64 nt, hsa; identical to SEQ ID NO: 275809

SEQ ID NO: 711122 - RNA, 64 nt, hsa; identical to SEQ ID NO: 275810

SEQ ID NO: 711123 - RNA, 64 nt, hsa; identical to SEQ ID NO: 275811

SEQ ID NO: 711124 - RNA, 64 nt, hsa; identical to SEQ ID NO: 275812

SEQ ID NO: 711125 - RNA, 64 nt, hsa; identical to SEQ ID NO: 275813

SEQ ID NO: 711126 - RNA, 64 nt, hsa; identical to SEQ ID NO: 275814

SEQ ID NO: 711127 - RNA, 64 nt, hsa; identical to SEQ ID NO: 275815

SEQ ID NO: 711128 - RNA, 64 nt, hsa; identical to SEQ ID NO: 275816

SEQ ID NO: 711129 - RNA, 64 nt, hsa; identical to SEQ ID NO: 275817

SEQ ID NO: 711130 - RNA, 64 nt, hsa; identical to SEQ ID NO: 275818

SEQ ID NO: 711131 - RNA, 64 nt, hsa; identical to SEQ ID NO: 275819

SEQ ID NO: 711132 - RNA, 64 nt, hsa; identical to SEQ ID NO: 275820

SEQ ID NO: 711133 - RNA, 64 nt, hsa; identical to SEQ ID NO: 275821

SEQ ID NO: 711134 - RNA, 64 nt, hsa; identical to SEQ ID NO: 275822

SEQ ID NO: 711135 - RNA, 64 nt, hsa; identical to SEQ ID NO: 275823

SEQ ID NO: 711136 - RNA, 64 nt, hsa; identical to SEQ ID NO: 275824

SEQ ID NO: 711137 - RNA, 64 nt, hsa; identical to SEQ ID NO: 275825

SEQ ID NO: 711138 - RNA, 64 nt, hsa; identical to SEQ ID NO: 275826

SEQ ID NO: 711139 - RNA, 64 nt, hsa; identical to SEQ ID NO: 275827

SEQ ID NO: 711140 - RNA, 64 nt, hsa; identical to SEQ ID NO: 275828

SEQ ID NO: 711141 - RNA, 64 nt, hsa; identical to SEQ ID NO: 275829

SEQ ID NO: 711142 - RNA, 64 nt, hsa; identical to SEQ ID NO: 275830

SEQ ID NO: 711143 - RNA, 64 nt, hsa; identical to SEQ ID NO: 275831

SEQ ID NO: 711144 - RNA, 64 nt, hsa; identical to SEQ ID NO: 275832

SEQ ID NO: 711145 - RNA, 64 nt, hsa; identical to SEQ ID NO: 275833

SEQ ID NO: 711146 - RNA, 64 nt, hsa; identical to SEQ ID NO: 275834

SEQ ID NO: 711147 - RNA, 64 nt, hsa; identical to SEQ ID NO: 275835

SEQ ID NO: 711148 - RNA, 64 nt, hsa; identical to SEQ ID NO: 275836

SEQ ID NO: 711149 - RNA, 64 nt, hsa; identical to SEQ ID NO: 275837

SEQ ID NO: 711150 - RNA, 64 nt, hsa; identical to SEQ ID NO: 275838

SEQ ID NO: 711151 - RNA, 64 nt, hsa; identical to SEQ ID NO: 275839

SEQ ID NO: 711152 - RNA, 64 nt, hsa; identical to SEQ ID NO: 275840

SEQ ID NO: 711153 - RNA, 62 nt, hsa
ugaggccucaucuugaaccagaccuuaacgaccaaacccagaccaugccaaaguccagucug

SEQ ID NO: 711154 - RNA, 62 nt, hsa
ggcugucaggaaacguguuuuauguuaagucacaaacccacuugacuucuggguacuggaau

SEQ ID NO: 711155 - RNA, 62 nt, hsa
aaccuuggagagggaaugcugauugucuugaccaaacccacagccugucucuucucuuguuu

SEQ ID NO: 711156 - RNA, 62 nt, hsa
ugggcaauuugugcuaaaacuaggugaguugccaaacccaaggcaucuuaccaacagcuggu

SEQ ID NO: 711157 - RNA, 62 nt, hsa
caguuaaggugaauauguauuguaucacaaaacaaacccaauauccagaugaauauccgaga

SEQ ID NO: 711158 - RNA, 62 nt, hsa
acuggcucauccgcccuacuucccaucccacacaaacccaauuguaaauaacauaugacuuc

SEQ ID NO: 711159 - RNA, 62 nt, hsa
ucagauucugccuguuuucaagauggcagucccaaacccaacaacuguuggccacacugaaa

SEQ ID NO: 711160 - RNA, 62 nt, hsa
gagggugucuccccaagccaggcacaccugcacaaacccagagccgacccucagcugccuuc

SEQ ID NO: 711161 - RNA, 62 nt, hsa
cauuaggggccuugccaaggucuaccuuagagcaaacccaguaccucagacaggaaagucgg

SEQ ID NO: 711162 - RNA, 62 nt, hsa
caagagaaaugauccuauccaaagcugauucacaaacccacgcucaccugacagccgaggga

SEQ ID NO: 711163 - RNA, 62 nt, hsa
ugaagggaagcccauucuaaacuccuuuccugcaaacccauuuccagcuccuaguagcuuuc

SEQ ID NO: 711164 - RNA, 62 nt, hsa
acccauccaauggauugugcaaauccccuccccaaacccacccauaccagcuagaaucacuu

SEQ ID NO: 711165 - RNA, 62 nt, hsa
ggugcacccaccuguuuucugaaacacacgagcaaacccagagguggauguuaugaacagcu

SEQ ID NO: 711166 - RNA, 62 nt, hsa
gaccaccagaggaggaugugugggauuguaggcaaacccaccuguggcaucacugaaaauaa

SEQ ID NO: 711167 - RNA, 62 nt, hsa
ccccaacccauccucauccccaacuacagccccaaacccagccccagacuaauccacagcca

SEQ ID NO: 711168 - RNA, 62 nt, hsa
ccccaacucauccucauccccaacugcagccccaaacccaacccagggccauccccaaaccc

SEQ ID NO: 711169 - RNA, 62 nt, hsa
cugcagccccaaacccaacccagggccauccccaaacccauccccaagccaaacucaacacc

SEQ ID NO: 711170 - RNA, 62 nt, hsa
uccugcgggacagccagcguaugcuaauguugcaaacccaugauaauguauguggaauaucc

SEQ ID NO: 711171 - RNA, 54 nt, hsa; identical to SEQ ID NO: 175380

SEQ ID NO: 711172 - RNA, 62 nt, hsa
caucaucacauucagggcuauuuuuucccccacaaacccaagggcaggggccacucuuagcu

SEQ ID NO: 711173 - RNA, 62 nt, hsa
gugaagcaaggagcuuagauaagacacccccucaaacccauucccucuccaggagaccuacc

SEQ ID NO: 711174 - RNA, 64 nt, hsa
guucuucucauuucauuauguuucuuccaaggaaacaggagagacugaauuaauaauucucucu

SEQ ID NO: 711175 - RNA, 64 nt, hsa
agaggucauuucuggaauggacucagaccuuuaaacaggagaguugagcacuuccagucaguuu

SEQ ID NO: 711176 - RNA, 64 nt, hsa
cacugauuuacgaguaagcugaugagagcaaugaacaggagaaggagggagagagccaaauguc

SEQ ID NO: 711177 - RNA, 64 nt, hsa
acuuauugcucuccuucugagucaggacauguguacaggagaccaagaacaaugaguauuagaa

SEQ ID NO: 711178 - RNA, 64 nt, hsa
ugaagcacaucuguaggcaagauggcugagaaauacaggagaggcgucugcuuuuggaaaggaa

SEQ ID NO: 711179 - RNA, 64 nt, hsa
uauaaagaugauacaaccaugauuugcaacuguaacaggagaccauuuauuauaagcguaccug

SEQ ID NO: 711180 - RNA, 64 nt, hsa
accuucugcuguuuguuccaggcucaccuuuagaacaggagacuugagcuugaccuaaggauau

SEQ ID NO: 711181 - RNA, 64 nt, hsa
agcaauuauuauauugaaggcuuuaauaaaggccacaggagacauuacuauagcauagauuguc

SEQ ID NO: 711182 - RNA, 64 nt, hsa
ucuccugcuucuuuagaccucuucuaucuuuguuacaggagaggaccuguggauagacuuaguu

SEQ ID NO: 711183 - RNA, 64 nt, hsa
ucaccuaaauaaaaauugaaagcaaguggauuacacaggagaaccauuaugaacauuuauuuag

SEQ ID NO: 711184 - RNA, 64 nt, hsa
accccagcagccgacucgaccccaggagcagaguacaggagacaccauggggagagacccuggu

SEQ ID NO: 711185 - RNA, 64 nt, hsa
aacgcagagcaguccagaaccaguggcagcuacaacaggagaagcaucugcagcaucuggcgga

SEQ ID NO: 711186 - RNA, 64 nt, hsa
uuaggaaggcaccaaagaaccuccucugcacuaaacaggagaauggaaagaaaagucuccauug

SEQ ID NO: 711187 - RNA, 64 nt, hsa
cauccuuaaccaacuagguaccgugaguuuacauacaggagaaugauggaaggaagggaggaag

SEQ ID NO: 711188 - RNA, 64 nt, hsa
ugcgccuguaaucccagcuacucgggcagcugagacaggagaaucacuugaacccaggaggcag

SEQ ID NO: 711189 - RNA, 64 nt, hsa
uguauuuguuagagauaauuucugaagucuauacacaggagaugauauaucuggaauguccuuu

SEQ ID NO: 711190 - RNA, 64 nt, hsa
aguuucauccuaugcaaaacauaggaggauucauacaggagagaaacucacaagugugaugauu

SEQ ID NO: 711191 - RNA, 64 nt, hsa
acaaaguugucagucacaaaucacagcuugaaagacaggagaauucauacuggagaaaaaacau

SEQ ID NO: 711192 - RNA, 63 nt, hsa
aaggcaucuuucugaauuucauucucuugaaggugcugccaccccuuggcacuguggaacugc

SEQ ID NO: 711193 - RNA, 63 nt, hsa
cacuuccugccccaacugcaggaaugcugacaaugcugccaugcccaccaucggguguaggug

SEQ ID NO: 711194 - RNA, 63 nt, hsa
aguuucuguugcugccaaaguaauguggcucucugcugccacccugugcugcugaggugcgua

SEQ ID NO: 711195 - RNA, 63 nt, hsa
cauggggcugccgggcuggccgccaguuucuguugcugccaaaguaauguggcucucugcugc

SEQ ID NO: 711196 - RNA, 63 nt, hsa
cucccagcggggcucccugagcucucaaggagaugcugccaucacugggaggcucagaggacc

SEQ ID NO: 711197 - RNA, 63 nt, hsa
auuuaaugagcgugggccuggaccuuccccagaugcugccaggcagccccuccccaagccuca

SEQ ID NO: 711198 - RNA, 63 nt, hsa
cugccugcugcucccuuuuucugucucuguccaugcugccauguuucucugcugccaaauugg

SEQ ID NO: 711199 - RNA, 63 nt, hsa
uuuucugucucuguccaugcugccauguuucucugcugccaaauugggccccuuggccccuuc

SEQ ID NO: 711200 - RNA, 63 nt, hsa
uggaccccagggacuugccuuccccacccacucugcugccagcaggcccagggaucccugacc

SEQ ID NO: 711201 - RNA, 63 nt, hsa
gccacaguucugggagccuucaacccuggcucaugcugccauagucuccacggugcccuucac

SEQ ID NO: 711202 - RNA, 63 nt, hsa
ucuguggcauguuugaccuguggcaggacucgcugcugccaggugagucaccgccuguccugc

SEQ ID NO: 711203 - RNA, 63 nt, hsa
ugccaucucugucucccugggugccagcagcccugcugccaugugcacugggguggcacugga

SEQ ID NO: 711204 - RNA, 63 nt, hsa
gccugugggcagccgcgccagcugccgggacacugcugccagaccugcccccaggguaagucu

SEQ ID NO: 711205 - RNA, 63 nt, hsa
aggcaggccagggcugcgcaucaguggacacauugcugccaggaagagcugcgacggugaggc

SEQ ID NO: 711206 - RNA, 63 nt, hsa
ucucccaaguuccagagccucuccgggccucagugcugccaucuguacaaugguggagugagu

SEQ ID NO: 711207 - RNA, 63 nt, hsa
ugggccgggaguacaagcugcccauggacgaccugcugccacuucucaucuacguggugucgc

SEQ ID NO: 711208 - RNA, 63 nt, hsa
ccacagaccuaauauauguccggacagcuuggaugcugccacguaaggucacugcuguggcga

SEQ ID NO: 711209 - RNA, 63 nt, hsa
aagaccuggagggcagccacacagcuggacggaugcugccacaucugggcauacagugucugg

SEQ ID NO: 711210 - RNA, 63 nt, hsa
ucaugacuugggggugcuacuagaagccaggaaugcugccaaacauucuaccaugcacagcac

SEQ ID NO: 711211 - RNA, 63 nt, hsa
ugaaaaugaacuuuuguuucuaaaguuggaccuugcugccaugacuguuuaguuuacagaaac

SEQ ID NO: 711212 - RNA, 63 nt, hsa
ggaauacuuuuacuacucagaaaugaauuuaugugcugccauuugcuauaaaguugaacuuug

SEQ ID NO: 711213 - RNA, 63 nt, hsa
ucagaaaaccuaccaaacaaaaacaucagaagcugcugccauaaugacuauuuucuacuguag

SEQ ID NO: 711214 - RNA, 63 nt, hsa
uuggcucugauuugaaaucgggagaaacagagcugcugccaaugggaucuuuuagguaacucc

SEQ ID NO: 711215 - RNA, 63 nt, hsa
uagcuuccgugugucugugcagugcccaugagcugcugccaaugggaucuuucagguaccccc

SEQ ID NO: 711216 - RNA, 63 nt, hsa
ggaucgcccugcuggcugccggcaccgcccuccugcugccagagacgaggcaggcacagcugc

SEQ ID NO: 711217 - RNA, 63 nt, hsa
gggaguaucgaacccucugccuagggccggaguugcugccaguacccgcucccucugcucauc

SEQ ID NO: 711218 - RNA, 63 nt, hsa
cccguaccgccaacucgggucacaccugaacgcugcugccagccgaugccccagcccugcacg

SEQ ID NO: 711219 - RNA, 63 nt, hsa
ucgccacaccuacuggggcaucuggcuggugccugcugccauggccagcccccacucucaccc

SEQ ID NO: 711220 - RNA, 63 nt, hsa
cucccuucuuuaccuucauuucauccuguuggcugcugccaccaaaucugucuagaauccugc

SEQ ID NO: 711221 - RNA, 63 nt, hsa
caauaaauauuuguuugggugguuugugagccuugcugccaaguccugccuuugggucgacau

SEQ ID NO: 711222 - RNA, 63 nt, hsa
auugugcugccauuugauuuuucuaaccuugaaugcugccaguguggaguggguaauccaggc

SEQ ID NO: 711223 - RNA, 63 nt, hsa
aauuccagaagaagagaagcugcugaccaauugugcugccauuugauuuuucuaaccuugaau

SEQ ID NO: 711224 - RNA, 63 nt, hsa
ugccauccucccacuugcagugcaggaucccacugcugccaaagagaugggacaaggaaccuc

SEQ ID NO: 711225 - RNA, 63 nt, hsa
ccagaccuggacuccaaggccggccugcgcacuugcugccaccagaaacuggaggacaugauc

SEQ ID NO: 711226 - RNA, 63 nt, hsa
acagagaaaggggcuguggugcuuguugguugaugcugccauguaagcuggacuccugggacu

SEQ ID NO: 711227 - RNA, 63 nt, hsa
ucaacagcgcucaugucucuuggcccagucaggugcugccagguuuagauaggaaaguacaug

SEQ ID NO: 711228 - RNA, 63 nt, hsa
aaugccugaccuuugagaugcucaguucucuggugcugccaaaagaugcuuccaugguccgug

SEQ ID NO: 711229 - RNA, 63 nt, hsa
ggucaacccacgcagaagaaacagaagaacucaugcugccagauagauagaaaaagaagcaug

SEQ ID NO: 711230 - RNA, 63 nt, hsa
guucaaagucuacuagcucgcauuaguuucuguugcugccaacagaucugaacuaaugcuaac

SEQ ID NO: 711231 - RNA, 63 nt, hsa
agcucuucacuaugacaguaaaggcucucugccugcugccaaggccugugacuuucuaaccug

SEQ ID NO: 711232 - RNA, 63 nt, hsa
aaacuccccguuccugcguaguccgcuuucucuugcugccacauucuaaaggcuugauauuuu

SEQ ID NO: 711233 - RNA, 63 nt, hsa
caagcuggcgugugccagggcucgagucccacgugcugccaacucaaacauagccuccuuccc

SEQ ID NO: 711234 - RNA, 63 nt, hsa
ccggcuccccuaaagguagaagauacucgagcaugcugccaggggagcuggauggugaaacac

SEQ ID NO: 711235 - RNA, 63 nt, hsa
ugugccuguuaugaaugaaaaauccauccacucugcugccauucacagccuaauuuucuggag

SEQ ID NO: 711236 - RNA, 63 nt, hsa
gccuuuucagcugcacuauuuaauuaugguaccugcugccacucaucacagagcccuucuugg

SEQ ID NO: 711237 - RNA, 63 nt, hsa
gaugggccaagggaaggcuaucagagacccuggugcugccaccugccccuacucaagugucua

SEQ ID NO: 711238 - RNA, 63 nt, hsa
aagggagggccuggggagccccacccuagcccuugcugccacaccacauugccucaacaaccg

SEQ ID NO: 711239 - RNA, 63 nt, hsa
aaacguggugucaucugaugcauuuggaccauaugcugccagacugcagaacgggggagccgg

SEQ ID NO: 711240 - RNA, 63 nt, hsa
agccuagcgaugccgcuggccagaccgugaccaugcugccagugugcucgccaugagcugggu

SEQ ID NO: 711241 - RNA, 63 nt, hsa
cagucuccuuggugauuaagguccugcuugaacugcugccaacuccaugucagggaagucgcu

SEQ ID NO: 711242 - RNA, 63 nt, hsa
aaggucuauggcucaugucugaaaaaugccugcugcugccaaguuagcuauugggagcaaucu

SEQ ID NO: 711243 - RNA, 63 nt, hsa
ccacaaccugucucccaguccugcucucaccccugcugccacacacaugcccugagcagccag

SEQ ID NO: 711244 - RNA, 63 nt, hsa
ucugcacuagggcucugugcuggaacccaggcaugcugccagccuuuucucuggaucugucag

SEQ ID NO: 711245 - RNA, 63 nt, hsa
uccugcugcaucuccaguugcugccgccccaacugcugccagaccaugugcugccgcccaacc

SEQ ID NO: 711246 - RNA, 63 nt, hsa
accugcugccaccccagcuauugcauuuccagcugcugccagccuuccugcaguaucucuagc

SEQ ID NO: 711247 - RNA, 63 nt, hsa
aucugcuggcaaaccaccugcuacaggaccaccugcugccaccccagcuauugcauuuccagc

SEQ ID NO: 711248 - RNA, 63 nt, hsa
ccacugugcugaggcccugcagugucugcucacugcugccaucuucgcugcuagucaggguuc

SEQ ID NO: 711249 - RNA, 63 nt, hsa
gauuccuguguggggagaagcucaguggccguuugcugccacugacaaggauuucacaugcag

SEQ ID NO: 711250 - RNA, 63 nt, hsa
acggaaaacagaccucggggcuggcguaaacccugcugccaggcccucuccccacugccccaa

SEQ ID NO: 711251 - RNA, 63 nt, hsa
caguaaccaaacacauacauggauuuugccaagugcugccaguagccaaaacaaagucuuuuu

SEQ ID NO: 711252 - RNA, 63 nt, hsa
gagccuacugcugcucuccacucaacuggccucugcugccaggccacugccugucucugcuuc

SEQ ID NO: 711253 - RNA, 63 nt, hsa
cugagccucccuggagaagguauuuuauaugucugcugccagcugcuggucuccacacccuca

SEQ ID NO: 711254 - RNA, 63 nt, hsa
uggggagaugcugccagcacacaggggcccuccugcugccagcagguuggggugguuaagucu

SEQ ID NO: 711255 - RNA, 63 nt, hsa
ugggugcaggugagccggcguguccuggggagaugcugccagcacacaggggcccuccugcug

SEQ ID NO: 711256 - RNA, 63 nt, hsa
cugcugccaggcuuacaucuucccagagaacuaugcugccacuucacauccacucaccacauc

SEQ ID NO: 711257 - RNA, 63 nt, hsa
gaccacccauagcccugcugcugccaccugcccugcugccaggcuuacaucuucccagagaac

SEQ ID NO: 711258 - RNA, 63 nt, hsa
guuacaaacugcgcagaccacccauagcccugcugcugccaccugcccugcugccaggcuuac

SEQ ID NO: 711259 - RNA, 63 nt, hsa
ccagaaacacccacaggcaugucccaugugagcugcugccaugaacugucaaguguguguugu

SEQ ID NO: 711260 - RNA, 63 nt, hsa
aguccccagaacucugccugcccuuuguccuccugcugccaguaccagccccacccuguuuug

SEQ ID NO: 711261 - RNA, 64 nt, hsa; identical to SEQ ID NO: 417144

SEQ ID NO: 711262 - RNA, 64 nt, hsa; identical to SEQ ID NO: 417145

SEQ ID NO: 711263 - RNA, 64 nt, hsa; identical to SEQ ID NO: 166123

SEQ ID NO: 711264 - RNA, 64 nt, hsa; identical to SEQ ID NO: 166124

SEQ ID NO: 711265 - RNA, 64 nt, hsa; identical to SEQ ID NO: 166125

SEQ ID NO: 711266 - RNA, 64 nt, hsa; identical to SEQ ID NO: 166126

SEQ ID NO: 711267 - RNA, 64 nt, hsa; identical to SEQ ID NO: 166127

SEQ ID NO: 711268 - RNA, 64 nt, hsa; identical to SEQ ID NO: 166128

SEQ ID NO: 711269 - RNA, 64 nt, hsa; identical to SEQ ID NO: 166129

SEQ ID NO: 711270 - RNA, 64 nt, hsa; identical to SEQ ID NO: 166130

SEQ ID NO: 711271 - RNA, 64 nt, hsa; identical to SEQ ID NO: 166131

SEQ ID NO: 711272 - RNA, 64 nt, hsa; identical to SEQ ID NO: 166132

SEQ ID NO: 711273 - RNA, 64 nt, hsa; identical to SEQ ID NO: 166133

SEQ ID NO: 711274 - RNA, 64 nt, hsa; identical to SEQ ID NO: 166134

SEQ ID NO: 711275 - RNA, 64 nt, hsa; identical to SEQ ID NO: 166135

SEQ ID NO: 711276 - RNA, 64 nt, hsa; identical to SEQ ID NO: 166136

SEQ ID NO: 711277 - RNA, 64 nt, hsa; identical to SEQ ID NO: 166137

SEQ ID NO: 711278 - RNA, 64 nt, hsa; identical to SEQ ID NO: 166138

SEQ ID NO: 711279 - RNA, 64 nt, hsa; identical to SEQ ID NO: 166139

SEQ ID NO: 711280 - RNA, 64 nt, hsa; identical to SEQ ID NO: 166140

SEQ ID NO: 711281 - RNA, 64 nt, hsa; identical to SEQ ID NO: 166141

SEQ ID NO: 711282 - RNA, 64 nt, hsa; identical to SEQ ID NO: 166142

SEQ ID NO: 711283 - RNA, 64 nt, hsa; identical to SEQ ID NO: 166143

SEQ ID NO: 711284 - RNA, 64 nt, hsa; identical to SEQ ID NO: 166144

SEQ ID NO: 711285 - RNA, 64 nt, hsa; identical to SEQ ID NO: 166145

SEQ ID NO: 711286 - RNA, 64 nt, hsa; identical to SEQ ID NO: 166146

SEQ ID NO: 711287 - RNA, 64 nt, hsa; identical to SEQ ID NO: 166147

SEQ ID NO: 711288 - RNA, 64 nt, hsa; identical to SEQ ID NO: 166148

SEQ ID NO: 711289 - RNA, 64 nt, hsa; identical to SEQ ID NO: 166149

SEQ ID NO: 711290 - RNA, 64 nt, hsa
guugaugguugacaaagcuugcuucacuccaucagagaaugacuaucaauuuuuuuuuaacugu

SEQ ID NO: 711291 - RNA, 64 nt, hsa
uguacaugaaagaguacaccaugugaagagaagagagaaugauugaaaauguuuuaguauagaa

SEQ ID NO: 711292 - RNA, 64 nt, hsa
gugaaaggcacgucuuacauggcgguggacaagagagaaugagaacuaagugaaaagggaaacc

SEQ ID NO: 711293 - RNA, 64 nt, hsa
cccucuauaaauagauuacccaagguuuuucagugagaaugaaacauaccaccuuguuggcucu

SEQ ID NO: 711294 - RNA, 64 nt, hsa
gcccucucacacagacgugacguccugccagaaagagaaugaaugacagaaaaaaaaaagagag

SEQ ID NO: 711295 - RNA, 64 nt, hsa
ggacauggagugacuaucggggcgggccaaccccgagaaugaagauuggaaaaaggaaaaaaaa

SEQ ID NO: 711296 - RNA, 64 nt, hsa
auaacagagccuucacauuguguaauauuuguaugagaaugacucaagcucuuugagaacauuc

SEQ ID NO: 711297 - RNA, 64 nt, hsa
uuagcauucugagaugagugucagguuuucaggagagaaugaguuggggugagcccagagucug

SEQ ID NO: 711298 - RNA, 64 nt, hsa
cuggggucuuccgagugagcugguuuaauacucugagaaugagcagggagauccagagaaugaa

SEQ ID NO: 711299 - RNA, 64 nt, hsa
gguuuaauacucugagaaugagcagggagauccagagaaugaaucccugaccgcaucaccuaaa

SEQ ID NO: 711300 - RNA, 64 nt, hsa
acccaugaagguaacuaacggaaggaaaaacuaagagaaugaaaaguauuugccucuggaaaga

SEQ ID NO: 711301 - RNA, 64 nt, hsa
aauacuccagcaaaaugaaggaguacacaaaccagagaaugacaugaauccagcaaauaggauc

SEQ ID NO: 711302 - RNA, 64 nt, hsa
auuagaacuuaaugcagacauauaaaguaacauugagaaugacaacuaaaacauuccauuguua

SEQ ID NO: 711303 - RNA, 64 nt, hsa
cuuuuauaccacuauuauauaucagagaaagauugagaaugaauaagccaaaaagaaaauuguu

SEQ ID NO: 711304 - RNA, 64 nt, hsa
acgagcagacauucucuguagaagguaauggucugagaaugaaaagguguuugauggacauguu

SEQ ID NO: 711305 - RNA, 64 nt, hsa
ucaccuuauuacugauuggguagagggggaaaaggagaaugaugaugauaguuuccuucugucu

SEQ ID NO: 711306 - RNA, 64 nt, hsa
uuuucccaucucugcaagcagggauaacgguaaugagaaugauaauaaucauuauaugcagacc

SEQ ID NO: 711307 - RNA, 64 nt, hsa
agaacaaccaaagcagcuuacagacgccugaacggagaaugaaguguuucaaguaagcgagucu

SEQ ID NO: 711308 - RNA, 64 nt, hsa
gcaccuuaauauuaauggacuguuucagguaaaagagaaugaauguaugauugugaacugugaa

SEQ ID NO: 711309 - RNA, 64 nt, hsa
aaaagagaaugaauguaugauugugaacugugaagagaaugaugcaggauccuauuuaguuacu

SEQ ID NO: 711310 - RNA, 64 nt, hsa
uaggaggcuguggguuuuauucaacuacgguugggagaaugagaccuggagucauguugaaggu

SEQ ID NO: 711311 - RNA, 64 nt, hsa
cgaaaucuuagugcccacggaggccucgagcagagagaaugaaagucuuuuuuuuuuuuuuuuu

SEQ ID NO: 711312 - RNA, 64 nt, hsa
uaggguucucacagcgucauccaugaucguaagggagaaugacauucugcuugagggagggaau

SEQ ID NO: 711313 - RNA, 64 nt, hsa
ccuuuccuuucugaaaauaaaguuuugugcuuuggagaaugacucgugagcacaucuuuaggga

SEQ ID NO: 711314 - RNA, 64 nt, hsa
ccauugcacagauggggaaacugaggcuuaggaagagaaugaaacuuguggagagcuuauacag

SEQ ID NO: 711315 - RNA, 64 nt, hsa
gacauuuccaagcagacuguuugucacgucuucugagaaugacuuucagucucucugaaaauga

SEQ ID NO: 711316 - RNA, 64 nt, hsa
uuccuauaacuuggacgaugaccaggcggcuugggagaaugagcugcagaagaugacccggggg

SEQ ID NO: 711317 - RNA, 64 nt, hsa
gcagaggagccucucaccuccuguccucugacaugagaaugaaaccaggaauggacuuggaguu

SEQ ID NO: 711318 - RNA, 64 nt, hsa
aauaacugccacaugugggaaguaggggaguaaggagaaugaauuccaaucugugauuaaaagu

SEQ ID NO: 711319 - RNA, 64 nt, hsa
ugacaaaugugaagcuggccaaaagucggaaaaugagaaugaggguaauccuggagaaauugug

SEQ ID NO: 711320 - RNA, 64 nt, hsa
agagccagaggucagugcugaagacguggaccgggagaaugaguacauaagcaggcuggcucag

SEQ ID NO: 711321 - RNA, 64 nt, hsa
uugacuccagagccgcuuuauggagcucaugcaggagaaugagcggguggagaaacuggaaugu

SEQ ID NO: 711322 - RNA, 64 nt, hsa
cacuuaaguuauuuaugcaaaaguuuuucuuguagagaaugacaauguuaauauugcuuuauga

SEQ ID NO: 711323 - RNA, 64 nt, hsa
augggcagaggugagagagagagagagaaagagagagaaugaaugcaguugcauugauucagug

SEQ ID NO: 711324 - RNA, 64 nt, hsa
uacugaaagacuugguuaucaagucuuuuggggagagaaugacauuuuuuuuuugagacagagu

SEQ ID NO: 711325 - RNA, 64 nt, hsa
cugggauuacaggugugagccaccgcgcccggccgagaaugacaucuuaaagccaccauugcgu

SEQ ID NO: 711326 - RNA, 64 nt, hsa; identical to SEQ ID NO: 579602

SEQ ID NO: 711327 - RNA, 64 nt, hsa; identical to SEQ ID NO: 579603

SEQ ID NO: 711328 - RNA, 64 nt, hsa; identical to SEQ ID NO: 579604

SEQ ID NO: 711329 - RNA, 64 nt, hsa; identical to SEQ ID NO: 579605

SEQ ID NO: 711330 - RNA, 64 nt, hsa; identical to SEQ ID NO: 579606

SEQ ID NO: 711331 - RNA, 64 nt, hsa; identical to SEQ ID NO: 579607

SEQ ID NO: 711332 - RNA, 64 nt, hsa; identical to SEQ ID NO: 579608

SEQ ID NO: 711333 - RNA, 64 nt, hsa; identical to SEQ ID NO: 579609

SEQ ID NO: 711334 - RNA, 64 nt, hsa; identical to SEQ ID NO: 579610

SEQ ID NO: 711335 - RNA, 60 nt, hsa; identical to SEQ ID NO: 579611

SEQ ID NO: 711336 - RNA, 64 nt, hsa
uucaugagcagcugcuugaguucaggaaguucacuguuagaaauaggcuuuguuagcugacuag

SEQ ID NO: 711337 - RNA, 64 nt, hsa
gauauugcagaugacuugcuuacuguauuugcauuguuagaaaacaguuuguagacaaugauuc

SEQ ID NO: 711338 - RNA, 64 nt, hsa
gcuacuuuguuagaaaauacugaguggaauaacuuguuagaaugaggguuaaacuuugaggaau

SEQ ID NO: 711339 - RNA, 64 nt, hsa
uccuuccaaagacuguuaggcauuugugcuacuuuguuagaaaauacugaguggaauaacuugu

SEQ ID NO: 711340 - RNA, 64 nt, hsa
ucauuagaagaacuugauaaaagacucaaauaaauguuagaaagagcccguaauuuuaggacuc

SEQ ID NO: 711341 - RNA, 64 nt, hsa
gagucacuuugaaauaguuaauucaacagcaccauguuagaaauauauuggcagccaagacucu

SEQ ID NO: 711342 - RNA, 64 nt, hsa
uaucuuuucucacauucagacuuacacuuaaugguguuagaaaucaacaaaacuccuuuuuaaa

SEQ ID NO: 711343 - RNA, 64 nt, hsa
uagguauauacugacaaggcuucaggaaaaaaguuguuagaagauuuuuuaauguauaauaaag

SEQ ID NO: 711344 - RNA, 64 nt, hsa
gcuuuauuuauuaaaccauauuauuugauuacuguguuagaauuucauaagcaauaauuaaaug

SEQ ID NO: 711345 - RNA, 64 nt, hsa
uucaaaagaaauagcaugauugaagauacaucucuguuagaacauugguauccuuuuugugcca

SEQ ID NO: 711346 - RNA, 64 nt, hsa
uuccgcaccuccugaggcccuggaugauucuaauuguuagaaauucuaauuguuagaaauccuu

SEQ ID NO: 711347 - RNA, 64 nt, hsa
gcccuggaugauucuaauuguuagaaauucuaauuguuagaaauccuuccuuauaaugaaugaa

SEQ ID NO: 711348 - RNA, 64 nt, hsa
uucauuucuguaaauuccuauguagaaggcucaguguuagaaauaaaguuauucuacuaguugc

SEQ ID NO: 711349 - RNA, 51 nt, hsa
aagcucuuucaacauccugaauguuagaagccuucauacacuugugaaauu

SEQ ID NO: 711350 - RNA, 64 nt, hsa
cuuauuuacucagcuuaccuuuuugagaaacgauuguuagaaauugacgauguguuuguuccag

SEQ ID NO: 711351 - RNA, 64 nt, hsa
uaaaaaguaaagaaaguugcauccagaaggguuuuguuagaaugaauacauuuauauuaggacu

SEQ ID NO: 711352 - RNA, 64 nt, hsa; identical to SEQ ID NO: 496651

SEQ ID NO: 711353 - RNA, 64 nt, hsa; identical to SEQ ID NO: 496652

SEQ ID NO: 711354 - RNA, 64 nt, hsa; identical to SEQ ID NO: 496653

SEQ ID NO: 711355 - RNA, 64 nt, hsa; identical to SEQ ID NO: 496654

SEQ ID NO: 711356 - RNA, 64 nt, hsa; identical to SEQ ID NO: 496655

SEQ ID NO: 711357 - RNA, 64 nt, hsa; identical to SEQ ID NO: 496656

SEQ ID NO: 711358 - RNA, 64 nt, hsa; identical to SEQ ID NO: 496657

SEQ ID NO: 711359 - RNA, 64 nt, hsa; identical to SEQ ID NO: 496658

SEQ ID NO: 711360 - RNA, 64 nt, hsa; identical to SEQ ID NO: 496659

SEQ ID NO: 711361 - RNA, 64 nt, hsa; identical to SEQ ID NO: 496660

SEQ ID NO: 711362 - RNA, 64 nt, hsa; identical to SEQ ID NO: 496661

SEQ ID NO: 711363 - RNA, 64 nt, hsa; identical to SEQ ID NO: 496662

SEQ ID NO: 711364 - RNA, 64 nt, hsa; identical to SEQ ID NO: 496663

SEQ ID NO: 711365 - RNA, 64 nt, hsa; identical to SEQ ID NO: 496664

SEQ ID NO: 711366 - RNA, 64 nt, hsa; identical to SEQ ID NO: 496665

SEQ ID NO: 711367 - RNA, 64 nt, hsa; identical to SEQ ID NO: 496665

SEQ ID NO: 711368 - RNA, 52 nt, hsa; identical to SEQ ID NO: 305420

SEQ ID NO: 711369 - RNA, 64 nt, hsa; identical to SEQ ID NO: 305421

SEQ ID NO: 711370 - RNA, 64 nt, hsa
agcuguucugggaauggcuggucuucauauucccaguggagaggggaacaaguggggcugggca

SEQ ID NO: 711371 - RNA, 64 nt, hsa
ccuguccucaugcggcuuauguuuucuggaggaaaguggagacacaaguccuuggcuuuagggc

SEQ ID NO: 711372 - RNA, 64 nt, hsa
gucaucccaggacacuugaggcccaaggagguggaguggagagugggcucggguacaugggagc

SEQ ID NO: 711373 - RNA, 64 nt, hsa
acacugcacgugggcguaguggggagcacccuggaguggagaugauugucagcgggcucacaug

SEQ ID NO: 711374 - RNA, 64 nt, hsa
ucagaaaggcuuagccaaggccacaucugggaagaguggagaaauuugccacuugacgaucacg

SEQ ID NO: 711375 - RNA, 64 nt, hsa
cagugucccacccuucacuucccgagggcgggugaguggagagcagagccaggagcucuggcag

SEQ ID NO: 711376 - RNA, 64 nt, hsa
aggaguggagaaugggagggcucgggcuacugagaguggagaugggggcgggggugguggugaa

SEQ ID NO: 711377 - RNA, 64 nt, hsa
cacgguucuugacuuaguggaauugggucgaaggaguggagaaugggagggcucgggcuacuga

SEQ ID NO: 711378 - RNA, 64 nt, hsa
uaaugcugaggcuauugcugaauaauggcuaucaaguggagaugugcuuugacugcaugcaugg

SEQ ID NO: 711379 - RNA, 64 nt, hsa
uuaugggucuccagaaacucugccagccagccucaguggagaagcuuccucuaccaccagcuau

SEQ ID NO: 711380 - RNA, 64 nt, hsa
cucuuugggugcacggugucaaagugugggcaggaguggagagcuggugcccucaggaggagac

SEQ ID NO: 711381 - RNA, 64 nt, hsa
ugugcuuugccugccucagccucauggucagagcaguggagacuggagcccuguuugcacguuc

SEQ ID NO: 711382 - RNA, 64 nt, hsa
aagugauucacucauccugagacuuucuuuuugcaguggagagagagaauaaucuaguuggggc

SEQ ID NO: 711383 - RNA, 64 nt, hsa
uuaauuaaggggugaugauuugcaagagaaaauuaguggagagucacauagguaaaucauuauu

SEQ ID NO: 711384 - RNA, 64 nt, hsa
uguaaaacaaggauaauacugaacuguaaggguuaguggagaguuuuuaauuaaaagaaugugu

SEQ ID NO: 711385 - RNA, 64 nt, hsa
cucaaucuucagcuacagggaaugaguaacuuugaguggagaagaaacaaacauaguggguaua

SEQ ID NO: 711386 - RNA, 64 nt, hsa
gcaccaccaugcccggcuaauuuuuuguauuuuuaguggagacaggguuucaccauguuggcca

SEQ ID NO: 711387 - RNA, 64 nt, hsa
ugugccaccauaccuggguaauuuuugcauuuuuaguggagagggaguuucaccauguuggcca

SEQ ID NO: 711388 - RNA, 64 nt, hsa
aauggcaugaaccugggaggcagagcuugcagugaguggagaugcgccacugcacuccagccug

SEQ ID NO: 711389 - RNA, 64 nt, hsa
aacuuggcugucauuuuucuuccauuauagugugaguggagacugcccccccuccccaacauau

SEQ ID NO: 711390 - RNA, 64 nt, hsa
uauacaugucuaucaaacccagacuugcuuccguaguggagacuugcuuuucagaacauaggga

SEQ ID NO: 711391 - RNA, 64 nt, hsa
aaguaucaugucuccuuuaacuagcauaccccgaaguggagaagggugcagcaggcucaaaggc

SEQ ID NO: 711392 - RNA, 64 nt, hsa; identical to SEQ ID NO: 418746

SEQ ID NO: 711393 - RNA, 64 nt, hsa; identical to SEQ ID NO: 418747

SEQ ID NO: 711394 - RNA, 64 nt, hsa; identical to SEQ ID NO: 418748

SEQ ID NO: 711395 - RNA, 64 nt, hsa; identical to SEQ ID NO: 418749

SEQ ID NO: 711396 - RNA, 64 nt, hsa; identical to SEQ ID NO: 418750

SEQ ID NO: 711397 - RNA, 64 nt, hsa; identical to SEQ ID NO: 418751

SEQ ID NO: 711398 - RNA, 64 nt, hsa; identical to SEQ ID NO: 418752

SEQ ID NO: 711399 - RNA, 64 nt, hsa; identical to SEQ ID NO: 418753

SEQ ID NO: 711400 - RNA, 64 nt, hsa; identical to SEQ ID NO: 418754

SEQ ID NO: 711401 - RNA, 64 nt, hsa; identical to SEQ ID NO: 418755

SEQ ID NO: 711402 - RNA, 64 nt, hsa; identical to SEQ ID NO: 418756

SEQ ID NO: 711403 - RNA, 64 nt, hsa; identical to SEQ ID NO: 418757

SEQ ID NO: 711404 - RNA, 64 nt, hsa; identical to SEQ ID NO: 418758

SEQ ID NO: 711405 - RNA, 64 nt, hsa; identical to SEQ ID NO: 418759

SEQ ID NO: 711406 - RNA, 64 nt, hsa; identical to SEQ ID NO: 418760

SEQ ID NO: 711407 - RNA, 64 nt, hsa; identical to SEQ ID NO: 418761

SEQ ID NO: 711408 - RNA, 64 nt, hsa; identical to SEQ ID NO: 418762

SEQ ID NO: 711409 - RNA, 64 nt, hsa; identical to SEQ ID NO: 418763

SEQ ID NO: 711410 - RNA, 64 nt, hsa; identical to SEQ ID NO: 418764

SEQ ID NO: 711411 - RNA, 64 nt, hsa; identical to SEQ ID NO: 418765

SEQ ID NO: 711412 - RNA, 64 nt, hsa; identical to SEQ ID NO: 418766

SEQ ID NO: 711413 - RNA, 64 nt, hsa; identical to SEQ ID NO: 418767

SEQ ID NO: 711414 - RNA, 64 nt, hsa; identical to SEQ ID NO: 418768

SEQ ID NO: 711415 - RNA, 64 nt, hsa; identical to SEQ ID NO: 418769

SEQ ID NO: 711416 - RNA, 64 nt, hsa; identical to SEQ ID NO: 418770

SEQ ID NO: 711417 - RNA, 64 nt, hsa; identical to SEQ ID NO: 418771

SEQ ID NO: 711418 - RNA, 64 nt, hsa; identical to SEQ ID NO: 418772

SEQ ID NO: 711419 - RNA, 64 nt, hsa; identical to SEQ ID NO: 418773

SEQ ID NO: 711420 - RNA, 64 nt, hsa; identical to SEQ ID NO: 418774

SEQ ID NO: 711421 - RNA, 64 nt, hsa; identical to SEQ ID NO: 418775

SEQ ID NO: 711422 - RNA, 64 nt, hsa; identical to SEQ ID NO: 418776

SEQ ID NO: 711423 - RNA, 64 nt, hsa; identical to SEQ ID NO: 418777

SEQ ID NO: 711424 - RNA, 64 nt, hsa; identical to SEQ ID NO: 418778

SEQ ID NO: 711425 - RNA, 64 nt, hsa; identical to SEQ ID NO: 418779

SEQ ID NO: 711426 - RNA, 64 nt, hsa; identical to SEQ ID NO: 418780

SEQ ID NO: 711427 - RNA, 64 nt, hsa; identical to SEQ ID NO: 418781

SEQ ID NO: 711428 - RNA, 64 nt, hsa; identical to SEQ ID NO: 418782

SEQ ID NO: 711429 - RNA, 64 nt, hsa; identical to SEQ ID NO: 418783

SEQ ID NO: 711430 - RNA, 64 nt, hsa; identical to SEQ ID NO: 418784

SEQ ID NO: 711431 - RNA, 64 nt, hsa; identical to SEQ ID NO: 418785

SEQ ID NO: 711432 - RNA, 64 nt, hsa; identical to SEQ ID NO: 418786

SEQ ID NO: 711433 - RNA, 64 nt, hsa; identical to SEQ ID NO: 418787

SEQ ID NO: 711434 - RNA, 64 nt, hsa; identical to SEQ ID NO: 418788

SEQ ID NO: 711435 - RNA, 64 nt, hsa; identical to SEQ ID NO: 418789

SEQ ID NO: 711436 - RNA, 64 nt, hsa; identical to SEQ ID NO: 418790

SEQ ID NO: 711437 - RNA, 64 nt, hsa; identical to SEQ ID NO: 418791

SEQ ID NO: 711438 - RNA, 64 nt, hsa; identical to SEQ ID NO: 418792

SEQ ID NO: 711439 - RNA, 64 nt, hsa; identical to SEQ ID NO: 418793

SEQ ID NO: 711440 - RNA, 64 nt, hsa; identical to SEQ ID NO: 418794

SEQ ID NO: 711441 - RNA, 64 nt, hsa; identical to SEQ ID NO: 418795

SEQ ID NO: 711442 - RNA, 64 nt, hsa; identical to SEQ ID NO: 418796

SEQ ID NO: 711443 - RNA, 64 nt, hsa; identical to SEQ ID NO: 418797

SEQ ID NO: 711444 - RNA, 64 nt, hsa; identical to SEQ ID NO: 418798

SEQ ID NO: 711445 - RNA, 64 nt, hsa; identical to SEQ ID NO: 418799

SEQ ID NO: 711446 - RNA, 64 nt, hsa; identical to SEQ ID NO: 418800

SEQ ID NO: 711447 - RNA, 64 nt, hsa
ugucaaguuggguucacuugccaugcaggaagaggcccacuagagggcccaucaggcaguguua

SEQ ID NO: 711448 - RNA, 64 nt, hsa
uaugguagggugcucagcagcaucccuggccucugcccacuagacaucagaagcacucccccag

SEQ ID NO: 711449 - RNA, 64 nt, hsa
agaauccgaccacuuuccaauccagugccaauuggcccacuaagcauccuaaaggugaaugugc

SEQ ID NO: 711450 - RNA, 64 nt, hsa
uuuugcuuucaccaauugauuccuucuucuuuuagcccacuauuaaaacauuucuuacugaaug

SEQ ID NO: 711451 - RNA, 64 nt, hsa
ucuguucauucacugcacaagauauuuauugagugcccacuacgugccaggcacuguugcugag

SEQ ID NO: 711452 - RNA, 64 nt, hsa
uguguuggcgcuuugcuuuggucuaucuuugagcgcccacuagacccacuggacucaccucccc

SEQ ID NO: 711453 - RNA, 64 nt, hsa
cgucgagaccaccagagcuaccuccccggggacagcccacuaagguucugccucagccuccuga

SEQ ID NO: 711454 - RNA, 64 nt, hsa
ggcuccccuggucuccuccccguagccacucucugcccacuaccuaugcuucuagaaagccccu

SEQ ID NO: 711455 - RNA, 64 nt, hsa
auuaagcuuaaauaauacguaaugggacuagauggcccacuaagccacuguuauuuuccuuccu

SEQ ID NO: 711456 - RNA, 64 nt, hsa
auuuauaaacuaacuggaacugagaaauucucaugcccacuaaaggaaaagcuaauucuauugc

SEQ ID NO: 711457 - RNA, 64 nt, hsa
cgggagucuccucacugccacuaaaauccacccagcccacuaacugaggagcuaguguuaaucc

SEQ ID NO: 711458 - RNA, 64 nt, hsa
ucugggacaggacaccuuggguuuguggacugcagcccacuaugauguuauuacuucucuggcc

SEQ ID NO: 711459 - RNA, 64 nt, hsa
cauuauguuuggaauugcuuucuauaagaaaauugcccacuacuacuaacuugaucaacaauga

SEQ ID NO: 711460 - RNA, 64 nt, hsa
ccuaaccugccucuggccccaguucguuuccucugcccacuaaucccugcgcaggacuucccag

SEQ ID NO: 711461 - RNA, 57 nt, hsa
ucccauuugagcagcugugagcugagcgcccacuagaggggcacccaccaguugcug

SEQ ID NO: 711462 - RNA, 64 nt, hsa
gggcagaggagggguggucaggaugggcuggggggcccacuagcagcccccagcaucucccacc

SEQ ID NO: 711463 - RNA, 64 nt, hsa
aguacuuauuaauugagucccuaaggaauauucagcccacuacauagauagcuuuuuuuuuuuu

SEQ ID NO: 711464 - RNA, 64 nt, hsa
caacuggugucuuaccccaaaucagaccaucugagcccacuacuaucaaacaaacaaacaaaaa

SEQ ID NO: 711465 - RNA, 64 nt, hsa
aagcaaauuucuaucagccuugcuaaagcuaggggcccacuaaauauuuuuaucggcuaggcgu

SEQ ID NO: 711466 - RNA, 64 nt, hsa
cucuugaagcuguucagaagccgcuugccgcggggcccacuaggcggggcggggguugggaccc

SEQ ID NO: 711467 - RNA, 64 nt, hsa
gcgugggacguggucagggcagggcucauucauugcccacuaggaucccacuggcgaagauggu

SEQ ID NO: 711468 - RNA, 64 nt, hsa
ccggcuucuccgcaggcuuuccucuuccccaguggcccacuaaugguaucacuccgagucucaa

SEQ ID NO: 711469 - RNA, 64 nt, hsa
agaggacacugauuaguugucaauacuuuagcaagcccacuaaagauaacuauauuccuuuugc

SEQ ID NO: 711470 - RNA, 64 nt, hsa
caucagcccccacaauuugucagagcugaagccagcccacuacccacccccacuacagcauugu

SEQ ID NO: 711471 - RNA, 64 nt, hsa
uccugaacuggaugucccuaaaagcaaauaaacugcccacuaucucuacucuagugcucucuuu

SEQ ID NO: 711472 - RNA, 64 nt, hsa
guccuucgguucuuacugagucacagacucgccugcccacuacguguccuggguucucucuacu

SEQ ID NO: 711473 - RNA, 64 nt, hsa
gauuuggugugauaccuuguguuugcuuacauuggcccacuauauauacauauauauuuaugua

SEQ ID NO: 711474 - RNA, 64 nt, hsa
uuuuucucuucagaccuucaccugacuggaucaagcccacuaacaucgaggaggacagucugca

SEQ ID NO: 711475 - RNA, 64 nt, hsa
accuguuaccuugugaaguugcuguuggcacauagcccacuaggaaaccaagaaguuugacugg

SEQ ID NO: 711476 - RNA, 64 nt, hsa
cuguguuuggagacggccaagugaaggagccagugcccacuauggcccugggagagccagaccc

SEQ ID NO: 711477 - RNA, 64 nt, hsa
gcccuugagcuccccaaaaaccucacccgaggcugcccacuauggucaucuuuuucucuaaaau

SEQ ID NO: 711478 - RNA, 64 nt, hsa
uucucccccagccacccucugccccugugguagagcccacuauaggcccaggcgccuuacgugc

SEQ ID NO: 711479 - RNA, 64 nt, hsa
ugagcugcacggaaggaauaagaagacaaauggcgcccacuaguggggaauccgcacucacaaa

SEQ ID NO: 711480 - RNA, 64 nt, hsa
ucaagugaaccuucaaaaacaaaagccaaauuuggcccacuauggucuuaaugcuaaaugcuca

SEQ ID NO: 711481 - RNA, 64 nt, hsa
gcccgaguagagggcaucccggagcccccagccugcccacuacauccagccuguggcuuugccc

SEQ ID NO: 711482 - RNA, 64 nt, hsa
cuaaagugaaaugggacagugccuugcagucuuugcccacuauacauaggcuaaggcuaagcuc

SEQ ID NO: 711483 - RNA, 64 nt, hsa
ccugcccagacuuucuauccagccucacugagcugcccacuacuggaagggaacugggccucgg

SEQ ID NO: 711484 - RNA, 64 nt, hsa
ugcacagaccccuguguucugugggugaacaacugcccacuaaccagacuggaaaacccagaaa

SEQ ID NO: 711485 - RNA, 64 nt, hsa
uuguuccaagaaugauaugaaaggugaagaagaggcccacuagaggcuucauacugagacccag

SEQ ID NO: 711486 - RNA, 64 nt, hsa
gguuugacaaaugacaguccaucagacagaucuggcccacuacccauuuuuguauccugcaagc

SEQ ID NO: 711487 - RNA, 64 nt, hsa
agugaugcaagcaucaugauaagauaugugugaagcccacuaggaaauaaaucauucucuucuc

SEQ ID NO: 711488 - RNA, 64 nt, hsa
gcagaggccccuuuaguauuauggacugggcaaagcccacuauaaacuauaggagaaagaaguu

SEQ ID NO: 711489 - RNA, 64 nt, hsa
uaggaccugccacacaagcagccguggacacaacgcccacuaccaccucccacauggaaaugua

SEQ ID NO: 711490 - RNA, 64 nt, hsa
auugugaaauauggaauuauuucugacacaugaagcccacuaaacuaugcuuucuuauaaugca

SEQ ID NO: 711491 - RNA, 64 nt, hsa
gccagaggagcuuguaacucuuuauccucauggugcccacuacgagucauacucuuccccaugc

SEQ ID NO: 711492 - RNA, 64 nt, hsa
gaaaugcuaacaucccugccugguagccagacuagcccacuaaagcuccccuguaaaugggggc

SEQ ID NO: 711493 - RNA, 64 nt, hsa
caaagagcucuuuuuuagcucucuuaaaugaagugcccacuaagaaguuccacuuaacacauga

SEQ ID NO: 711494 - RNA, 64 nt, hsa
ucaggcacggacagggcacaugauaccaacugcugcccacuacggcacgccgcaccggagcacg

SEQ ID NO: 711495 - RNA, 64 nt, hsa
aucaauauguggaacuucuuuaagcauucagugugcccacuaaaugccagccacaccuccacuu

SEQ ID NO: 711496 - RNA, 64 nt, hsa
ugccucagccucccgagcagcugggauuacaggcgcccacuaauuuuuguauucuuaguagaaa

SEQ ID NO: 711497 - RNA, 64 nt, hsa
gguugggcaauagucugcuuccacggugaucagagcccacuagcaggcuaagauuucuaaagua

SEQ ID NO: 711498 - RNA, 64 nt, hsa
augaacaagucugcuaccucuucauccccaggaagcccacuacauaguuuggaaacaucacucu

SEQ ID NO: 711499 - RNA, 64 nt, hsa
ggccugggugcagguuaacuucuuguuaucaggagcccacuaugcagaggccaaaggucggcag

SEQ ID NO: 711500 - RNA, 64 nt, hsa
cucuaagaaccuucuauucacauccauggauugggcccacuacucauagcagcuccugaggcag

SEQ ID NO: 711501 - RNA, 64 nt, hsa
uaaacucagaaauacccaaagcaggccugcuuaagcccacuaccuggcauauaaacuuauagua

SEQ ID NO: 711502 - RNA, 64 nt, hsa
ggguuagggaccuauuuuuaacacuagggggcuggcccacuaggagggcuggcccuaagauaca

SEQ ID NO: 711503 - RNA, 64 nt, hsa
uuugacuuacaguauaaccauguagccaauuguggcccacuaaaaucuacagaaguuaaugugg

SEQ ID NO: 711504 - RNA, 64 nt, hsa
ugaucauuccagcuccucugggcucuggccucaggcccacuaaugauccugcuacccucuugaa

SEQ ID NO: 711505 - RNA, 64 nt, hsa
gggucggcacacugucaguacaucaggcacaugggcccacuaggcugggguuucugguuuuguu

SEQ ID NO: 711506 - RNA, 64 nt, hsa
gcugcaaaccacuguaccugccucagucaggccugcccacuaugggcagaccucucgcucagcc

SEQ ID NO: 711507 - RNA, 64 nt, hsa
gcugugagagaggagcagguccucagcccaugccgcccacuaggccucagaccacaggggaggg

SEQ ID NO: 711508 - RNA, 64 nt, hsa
agcuccuuuggcugggccaagaaggaucuagucugcccacuacauucucaaacaagaggacuug

SEQ ID NO: 711509 - RNA, 64 nt, hsa
agccguggggggaagcacauaaucccgccccagggcccacuagcauccacugauuggaccuuau

SEQ ID NO: 711510 - RNA, 64 nt, hsa
acuagaucaggcagggauccauucccuguccccugcccacuaccuucaggccauuuagaguugu

SEQ ID NO: 711511 - RNA, 64 nt, hsa
ggguuuuuuauucuuuggaguagaaaagaauggagcccacuaauauuauauuuuucuucugaaa

SEQ ID NO: 711512 - RNA, 64 nt, hsa
cagccaccaccugccccgccucguccacgccugcgcccacuaucaucccugcuccagcugcccc

SEQ ID NO: 711513 - RNA, 64 nt, hsa
cugaggguucugaaaucaauguggucccucucuugcccacuaaacaaagaugguuguucggggu

SEQ ID NO: 711514 - RNA, 64 nt, hsa
agaaacaguuugggaagaaaaggaaaagaaucccgcccacuaagacgcgaccccucagacaggg

SEQ ID NO: 711515 - RNA, 64 nt, hsa
gaggugggcuuugugguuugcgucccuaaagugagcccacuacugguugcuuguccauggccaa

SEQ ID NO: 711516 - RNA, 64 nt, hsa
guacaguagcuggcuauucacaggcaucaucauagcccacuagucucauauuauuuuccuuuug

SEQ ID NO: 711517 - RNA, 64 nt, hsa
aagcuccucacuggaggccuuaucccuucguggagcccacuaggugccgaccccucagaauaua

SEQ ID NO: 711518 - RNA, 64 nt, hsa
cugaccaccagacaauuacugcauuuuuccagaagcccacuauugccuuuguagugcuuucggc

SEQ ID NO: 711519 - RNA, 64 nt, hsa
uaugucacugggaccaucacccagaugauguccugcccacuaaaagaauugugacauaacgcug

SEQ ID NO: 711520 - RNA, 64 nt, hsa
ccuuuuauuuuucuauuaccuugcuaccaaacaguuuagauagcaauauaauagcaaaaaagca

SEQ ID NO: 711521 - RNA, 64 nt, hsa
aacuaucaugguuauaauucuauugggaaagacuuuuagauaacaaagauuucaaauguuaaaa

SEQ ID NO: 711522 - RNA, 64 nt, hsa
gauagguaacauguuuguaaccauauaguauccuuuuagauacaaaagcuuauuuucauuauua

SEQ ID NO: 711523 - RNA, 64 nt, hsa
ugaauguacaaagacccacacuauugagacagcuuuuagauacuuuuuuguccauucuaaaagu

SEQ ID NO: 711524 - RNA, 64 nt, hsa
agaaaauguuacugaacuauugacugaaaguaaauuuagauaaaauacagcuuuuuuccuuaug

SEQ ID NO: 711525 - RNA, 64 nt, hsa
uacauauugaccaauggccucugaaaaagcacauuuuagauacugaaauugaaggaaagaaaau

SEQ ID NO: 711526 - RNA, 64 nt, hsa
gguuaggaaguugauuauuauuuaguuggaggccuuuagauauuauucauucauuuacucauuc

SEQ ID NO: 711527 - RNA, 64 nt, hsa
uuugcauaauagaaauuaccagaguuguucugucuuuagauaagguuugaaccaaagcucaaaa

SEQ ID NO: 711528 - RNA, 64 nt, hsa
ugggcuccugcccaguuuggguacugugcugauuuuuagauauacagagauaaaaauagccccu

SEQ ID NO: 711529 - RNA, 64 nt, hsa
cccuaccuucaaaaauauauauaacaucucuccauuuagauaaaguauauucuuccccagggaa

SEQ ID NO: 711530 - RNA, 64 nt, hsa
auuuagggcaggagugagaggucucucuuccugauuuagauaugcaaaagcugguauguucagu

SEQ ID NO: 711531 - RNA, 64 nt, hsa
gauuacaguguagcuugcccaccgcauuugucguuuuagauacuuugcuagccggccacuuugg

SEQ ID NO: 711532 - RNA, 64 nt, hsa
auuuuuuuuuaaguaggaccaaaggaaaacaagauuuagauagucugacuuugcuuuugaacaa

SEQ ID NO: 711533 - RNA, 64 nt, hsa
uccuaauucgugggguuuuuuuuuguaaaaacaguuuagauaauccugaaugcaaucauuaacu

SEQ ID NO: 711534 - RNA, 64 nt, hsa
agaauuuaaaccaaauuaaaacugacagaggacauuuagauacauaauaaaauucgagcuacau

SEQ ID NO: 711535 - RNA, 64 nt, hsa
uaaauuuaauuuaccaaauauuguuaauuaaaauuuuagauacuuaacauuuauuuaacuuaaa

SEQ ID NO: 711536 - RNA, 64 nt, hsa
ccaggcuccaugcuuugaaaaccacuggucuagcuuuagauaggauauugagccaauuuaaaua

SEQ ID NO: 711537 - RNA, 64 nt, hsa
uucagaaaauguaguuuacaagaauaaagauuucuuuagauagguuguugagccaauuuaagua

SEQ ID NO: 711538 - RNA, 64 nt, hsa
ccaggaaaaaaaaaaaaaaaaaguccuguucuucuuuagauaaacaagagacauuuucauaauu

SEQ ID NO: 711539 - RNA, 64 nt, hsa
uacaacuaauacuauuauuauccuucuuuuuuuauuuagauaauucuuuuaauuuaaacaaagg

SEQ ID NO: 711540 - RNA, 64 nt, hsa
acugcuuuguuucauuucauaaacaaacucugcauuuagauaacuauuaaagguuguuaagaug

SEQ ID NO: 711541 - RNA, 64 nt, hsa
ggauguaacuugaugugagcaguaguaaaccuguuuuagauaucauacuguuaauauuuuauug

SEQ ID NO: 711542 - RNA, 64 nt, hsa
uuagucugguggacuggacuaauuacuugaaggauuuagauagaguauuugcacugcugaagag

SEQ ID NO: 711543 - RNA, 64 nt, hsa
uuuugcuuacccuaagagagguuuucuucuuauuuuuagauaauucaagugcuuagauaaauua

SEQ ID NO: 711544 - RNA, 64 nt, hsa
uuuuagaaaaauaaauaaauauuuauagaccucuuuuagauauuuuaauaaaggauccuuugga

SEQ ID NO: 711545 - RNA, 64 nt, hsa
aagccaucacaaaacacuauaagacugaccaaaauuuagauaaccuuugaaccacgauuuuuuu

SEQ ID NO: 711546 - RNA, 64 nt, hsa
cuuguucaaaaacagaggccagcacagaugacauuuuagauacacucuaaauugagaauggugu

SEQ ID NO: 711547 - RNA, 64 nt, hsa
acugagucucugaagaccacagggacagggucucuuuagauagcaagucucaccauucccuuuu

SEQ ID NO: 711548 - RNA, 64 nt, hsa
cuuuuaacaguuacagcaauaaagaauaguuaguacuccaaaaauauuauauuuaagaugcuca

SEQ ID NO: 711549 - RNA, 64 nt, hsa
uucuuuccucugcucacuuuaagaacuuuuaccgacuccaaaaaucucaggaauuaaacuuuua

SEQ ID NO: 711550 - RNA, 64 nt, hsa
cgugauuagugaaaggaagauaaacguggauguuacuccaaaacuucguuuaaugaaugcuuaa

SEQ ID NO: 711551 - RNA, 64 nt, hsa
aaaacaaacaauaccugaaugcucuguagccuaaacuccaaacauccucuuccauauggaucca

SEQ ID NO: 711552 - RNA, 64 nt, hsa
auggcaccgcccugcaucccuaauaccaaaucugacuccaaaauuguggggugugacauacaag

SEQ ID NO: 711553 - RNA, 64 nt, hsa
cauuacuacgccuccccacacgcccagaccccucacuccaaaauccuacuggcuguagcagaga

SEQ ID NO: 711554 - RNA, 64 nt, hsa
gacgaccugacccaggggacagcagcaggagacuacuccaaagguggcuaugcuggaucaucgc

SEQ ID NO: 711555 - RNA, 64 nt, hsa
acauggugguggucgaagucagcagacacuagacacuccaaagacaacaggcccucccucugcc

SEQ ID NO: 711556 - RNA, 64 nt, hsa
cuaaguaagcaacuuaaguugcuuuaacaaacuaacuccaaaucucaguuuccugauaaagaua

SEQ ID NO: 711557 - RNA, 64 nt, hsa
gcuauuuaggguaggcuaacagcugugacaguacacuccaaaauguauaauuacguaaacacau

SEQ ID NO: 711558 - RNA, 64 nt, hsa
aucucaguucagaggcaacgaaacuggacucauuacuccaaauaaacauggacuuuuacaaaac

SEQ ID NO: 711559 - RNA, 64 nt, hsa
caugaggcuuuaauauguaaaagugaaagaguucacuccaaaucaguagagaguaauauugaag

SEQ ID NO: 711560 - RNA, 64 nt, hsa
ugucuacauguuccuaaaucuuuacuccaaaacaacuccaaaaacaacucacaaagcaugaacc

SEQ ID NO: 711561 - RNA, 64 nt, hsa
aauauucucuuugucuacauguuccuaaaucuuuacuccaaaacaacuccaaaaacaacucaca

SEQ ID NO: 711562 - RNA, 64 nt, hsa
aauauuauuacuccaaagaacgaaaguuaacaaaacuccaaagcaaaaacccuuuuaauggagg

SEQ ID NO: 711563 - RNA, 64 nt, hsa
uguauucagcgccauacacaagagaaauauuauuacuccaaagaacgaaaguuaacaaaacucc

SEQ ID NO: 711564 - RNA, 64 nt, hsa; identical to SEQ ID NO: 71901

SEQ ID NO: 711565 - RNA, 64 nt, hsa; identical to SEQ ID NO: 71902

SEQ ID NO: 711566 - RNA, 64 nt, hsa; identical to SEQ ID NO: 71903

SEQ ID NO: 711567 - RNA, 64 nt, hsa; identical to SEQ ID NO: 71904

SEQ ID NO: 711568 - RNA, 64 nt, hsa; identical to SEQ ID NO: 71905

SEQ ID NO: 711569 - RNA, 64 nt, hsa; identical to SEQ ID NO: 71906

SEQ ID NO: 711570 - RNA, 64 nt, hsa; identical to SEQ ID NO: 71907

SEQ ID NO: 711571 - RNA, 64 nt, hsa; identical to SEQ ID NO: 71908

SEQ ID NO: 711572 - RNA, 64 nt, hsa; identical to SEQ ID NO: 71909

SEQ ID NO: 711573 - RNA, 64 nt, hsa; identical to SEQ ID NO: 71910

SEQ ID NO: 711574 - RNA, 64 nt, hsa; identical to SEQ ID NO: 71911

SEQ ID NO: 711575 - RNA, 64 nt, hsa; identical to SEQ ID NO: 71912

SEQ ID NO: 711576 - RNA, 64 nt, hsa; identical to SEQ ID NO: 71913

SEQ ID NO: 711577 - RNA, 64 nt, hsa; identical to SEQ ID NO: 71914

SEQ ID NO: 711578 - RNA, 64 nt, hsa; identical to SEQ ID NO: 71915

SEQ ID NO: 711579 - RNA, 64 nt, hsa; identical to SEQ ID NO: 71916

SEQ ID NO: 711580 - RNA, 64 nt, hsa; identical to SEQ ID NO: 71917

SEQ ID NO: 711581 - RNA, 64 nt, hsa; identical to SEQ ID NO: 71918

SEQ ID NO: 711582 - RNA, 64 nt, hsa; identical to SEQ ID NO: 71919

SEQ ID NO: 711583 - RNA, 64 nt, hsa; identical to SEQ ID NO: 71920

SEQ ID NO: 711584 - RNA, 64 nt, hsa; identical to SEQ ID NO: 71921

SEQ ID NO: 711585 - RNA, 64 nt, hsa; identical to SEQ ID NO: 71922

SEQ ID NO: 711586 - RNA, 64 nt, hsa; identical to SEQ ID NO: 71923

SEQ ID NO: 711587 - RNA, 64 nt, hsa; identical to SEQ ID NO: 71924

SEQ ID NO: 711588 - RNA, 64 nt, hsa; identical to SEQ ID NO: 71925

SEQ ID NO: 711589 - RNA, 64 nt, hsa; identical to SEQ ID NO: 71926

SEQ ID NO: 711590 - RNA, 64 nt, hsa; identical to SEQ ID NO: 71927

SEQ ID NO: 711591 - RNA, 64 nt, hsa; identical to SEQ ID NO: 71928

SEQ ID NO: 711592 - RNA, 64 nt, hsa; identical to SEQ ID NO: 71929

SEQ ID NO: 711593 - RNA, 64 nt, hsa; identical to SEQ ID NO: 71930

SEQ ID NO: 711594 - RNA, 64 nt, hsa; identical to SEQ ID NO: 71931

SEQ ID NO: 711595 - RNA, 64 nt, hsa; identical to SEQ ID NO: 71932

SEQ ID NO: 711596 - RNA, 64 nt, hsa; identical to SEQ ID NO: 71933

SEQ ID NO: 711597 - RNA, 64 nt, hsa; identical to SEQ ID NO: 71934

SEQ ID NO: 711598 - RNA, 64 nt, hsa; identical to SEQ ID NO: 71935

SEQ ID NO: 711599 - RNA, 64 nt, hsa; identical to SEQ ID NO: 71936

SEQ ID NO: 711600 - RNA, 64 nt, hsa; identical to SEQ ID NO: 71937

SEQ ID NO: 711601 - RNA, 64 nt, hsa; identical to SEQ ID NO: 71938

SEQ ID NO: 711602 - RNA, 64 nt, hsa; identical to SEQ ID NO: 71939

SEQ ID NO: 711603 - RNA, 64 nt, hsa; identical to SEQ ID NO: 71940

SEQ ID NO: 711604 - RNA, 61 nt, hsa
auugucaagcuccuaaaggguucauuuggccccuccucaaagacuaauguccccaugugaa

SEQ ID NO: 711605 - RNA, 61 nt, hsa
cccacaccccacccucccuucccuucauaccccuccucaacguucuuuuacuuuauacuuu

SEQ ID NO: 711606 - RNA, 61 nt, hsa
uuggagcacaauggugaagcacacuccccucccuccucaccugggguccaauguucugucu

SEQ ID NO: 711607 - RNA, 61 nt, hsa
ucaccagcuucuugcucagggagacuuccgcccuccucacugaggcaacaugaagcccgag

SEQ ID NO: 711608 - RNA, 61 nt, hsa
cccuggcugaacagugcucugccucuaacucccuccucacacuccagaauuacccuuccuc

SEQ ID NO: 711609 - RNA, 61 nt, hsa
gccucggaggcuccucccucugccucauccuccuccucauucagaccaaucuuaguuucua

SEQ ID NO: 711610 - RNA, 61 nt, hsa
ggggcucucagggcugggaggaccccagugcccuccucagaagaagcacaugggcuccugc

SEQ ID NO: 711611 - RNA, 61 nt, hsa
cucacuugggggagcacagggccccgcugggccuccucaccaacggcagugccaaaaucag

SEQ ID NO: 711612 - RNA, 61 nt, hsa
accuggggcucuugauccuggcacugcuggcccuccucacccuacuggguguuguucuggc

SEQ ID NO: 711613 - RNA, 61 nt, hsa
ucccagcccaguccccgcgcgcgucccucuuccuccucauacuuucccuugacugagagcu

SEQ ID NO: 711614 - RNA, 61 nt, hsa
cuuaauuauuauuuguguuuuaauuuaaacaccuccucauguacauacccuggccgccccc

SEQ ID NO: 711615 - RNA, 61 nt, hsa
gcauuuuuauuuuaugaaauacuauuuaaagccuccucaucccguguucuccuuuuccucu

SEQ ID NO: 711616 - RNA, 61 nt, hsa
ggaccaguagaggacacggaggguucagaccccuccucagacccuccccacaucugaaacu

SEQ ID NO: 711617 - RNA, 61 nt, hsa
cguguuaaguccugguuccccaccugcugccccuccucaacacagagccccucccgccgcc

SEQ ID NO: 711618 - RNA, 61 nt, hsa
gcuugcugacuuagccuccucccaaagucccccuccucagccagccuccuugugagagugg

SEQ ID NO: 711619 - RNA, 61 nt, hsa
caaggagggaagagucccagugaacucggccccuccucaaugggcuuucccccaacucagg

SEQ ID NO: 711620 - RNA, 61 nt, hsa
uuuacccagcaugacuuuccuuaggaggcccccuccucacgcuagaguaaaagucccaguu

SEQ ID NO: 711621 - RNA, 61 nt, hsa
gaacaucccgcuucugaagcugcugcagcucccuccucagggaucacacugccgucaccca

SEQ ID NO: 711622 - RNA, 61 nt, hsa
gcccccaagaugccgcagcuccagggcucuuccuccucaccagaaaucccugggcuuccac

SEQ ID NO: 711623 - RNA, 61 nt, hsa
uuuauuccccagugggcaguuacugagcuuuccuccucagagccaugcuggcagcccuggg

SEQ ID NO: 711624 - RNA, 61 nt, hsa
aggguccuggggacggcagaggauaaagcccccuccucacaucccucuauugcggauccac

SEQ ID NO: 711625 - RNA, 61 nt, hsa
guacccggguaaagugggggccucaacugugccuccucagguggauggaagguucugggug

SEQ ID NO: 711626 - RNA, 61 nt, hsa
ugggcccagccagauaauacaugauaaucucccuccucaagguuuuuaauauuaaacacau

SEQ ID NO: 711627 - RNA, 61 nt, hsa
uccuacccaggcugccuggccggggccacugccuccucagcaugcaggaggcugcccugua

SEQ ID NO: 711628 - RNA, 61 nt, hsa
gugacagcagaccuggcuguguugccccucuccuccucacuauucucaccaggccauggga

SEQ ID NO: 711629 - RNA, 61 nt, hsa
acagaucuccccacuacauuaaucccgugcuccuccucacugccauuauaguuuauugugu

SEQ ID NO: 711630 - RNA, 61 nt, hsa
cuguuuccgcuacuauauuaugcccaguguuccuccucaccccacguccuggggucaggcc

SEQ ID NO: 711631 - RNA, 61 nt, hsa
ucccaucucuacccagucucaggccugcuuaccuccucacagcccaugaagaccccuucuc

SEQ ID NO: 711632 - RNA, 61 nt, hsa
ggaggacgcuguggggugagguccagggcugccuccucauggagcugugugugagcaggcg

SEQ ID NO: 711633 - RNA, 61 nt, hsa
cuguagaacugcagaccugugcuguuugaugccuccucacugucccgucacuccugggaag

SEQ ID NO: 711634 - RNA, 61 nt, hsa
acccaccacacacccacacaugccagaggucccuccucacagaggagagggccugugucug

SEQ ID NO: 711635 - RNA, 61 nt, hsa
ugcauugagcaggcccaccugcuucccagaaccuccucacuagggcugagcaccuucucug

SEQ ID NO: 711636 - RNA, 61 nt, hsa
agugugagcggggcuuuagccggaagucaguccuccucauucaccagaggacacacagggg

SEQ ID NO: 711637 - RNA, 61 nt, hsa
gagugugggagggcuuuagccggaagucagaccuccucagucaccagaggacacacacagg

SEQ ID NO: 711638 - RNA, 61 nt, hsa
cuccuuucaugucccugugccccccaguucuccuccucagccuuuuccuccucaguuuucu

SEQ ID NO: 711639 - RNA, 61 nt, hsa
ugugccccccaguucuccuccucagccuuuuccuccucaguuuucucuuuaaaacugugaa

SEQ ID NO: 711640 - RNA, 61 nt, hsa
aucaccaucgcccuagggaccaagacugaauccuccucacaaacuggggggaaaccgaagg

SEQ ID NO: 711641 - RNA, 61 nt, hsa
ugaagaucuccguggcugccauucccuucuuccuccucaucaccaucgcccuagggaccaa

SEQ ID NO: 711642 - RNA, 61 nt, hsa
gcgugaaccccagggaacagcgggucccuucccuccucagacacaagccaccucagcuugu

SEQ ID NO: 711643 - RNA, 61 nt, hsa
cccagccuucagugugggcugcugaagcuauccuccucaggccucagggaugaccuccugc

SEQ ID NO: 711644 - RNA, 61 nt, hsa
accugcucuucaccaacauccugcugcucaaccuccucaucgccauguucaagugagcgcc

SEQ ID NO: 711645 - RNA, 61 nt, hsa
acggccgccccgccgcgccgccccccuucauccuccucagccaccugcagcucuucaucaa

SEQ ID NO: 711646 - RNA, 64 nt, hsa
ucauaauaagcaaauuauuggcuucuuucuucuagacuaaaagaaauuaaagagaugaaacaau

SEQ ID NO: 711647 - RNA, 64 nt, hsa
auaucauuaauuuuauaucaggauucauguaagagacuaaaaaugauccauagugguuaguacu

SEQ ID NO: 711648 - RNA, 64 nt, hsa
uaccuagagagugaaacccguacaaugagauaaagacuaaaaagagaaaucccuuccuauauac

SEQ ID NO: 711649 - RNA, 64 nt, hsa
ccaaucuuuuuucuaaaaauuaugcuggggucucgacuaaaacugaauuugaauuggaaaauuc

SEQ ID NO: 711650 - RNA, 64 nt, hsa
ucuuuuucuagagaggaguugcuuaaaccaaugggacuaaaaccugaugggacaauaacgccuu

SEQ ID NO: 711651 - RNA, 64 nt, hsa
guacucugucaucgaagagaccagcucugacacagacuaaaagcaucaccugcucaacucucaa

SEQ ID NO: 711652 - RNA, 64 nt, hsa
cccccugcccccucaccuuuuuggguagguaaaagacuaaaagccauauggauuuuaacugaua

SEQ ID NO: 711653 - RNA, 64 nt, hsa
aggauaguacacguuccccaggcccauaacagaggacuaaaaucucugaauuuuaaagacacag

SEQ ID NO: 711654 - RNA, 64 nt, hsa
ggucaggguuuuuguguuguuuucaaauaaguuugacuaaaauaaguuuggcugacaguuuuug

SEQ ID NO: 711655 - RNA, 64 nt, hsa
caaauuccauauguaaugccauugggagaguauugacuaaaauaucauucgucagggaaauaua

SEQ ID NO: 711656 - RNA, 64 nt, hsa; identical to SEQ ID NO: 583228

SEQ ID NO: 711657 - RNA, 64 nt, hsa; identical to SEQ ID NO: 583229

SEQ ID NO: 711658 - RNA, 64 nt, hsa; identical to SEQ ID NO: 583230

SEQ ID NO: 711659 - RNA, 64 nt, hsa; identical to SEQ ID NO: 583231

SEQ ID NO: 711660 - RNA, 64 nt, hsa; identical to SEQ ID NO: 583232

SEQ ID NO: 711661 - RNA, 64 nt, hsa; identical to SEQ ID NO: 583233

SEQ ID NO: 711662 - RNA, 64 nt, hsa; identical to SEQ ID NO: 583234

SEQ ID NO: 711663 - RNA, 64 nt, hsa; identical to SEQ ID NO: 583235

SEQ ID NO: 711664 - RNA, 64 nt, hsa; identical to SEQ ID NO: 583236

SEQ ID NO: 711665 - RNA, 64 nt, hsa; identical to SEQ ID NO: 583237

SEQ ID NO: 711666 - RNA, 64 nt, hsa; identical to SEQ ID NO: 583238

SEQ ID NO: 711667 - RNA, 64 nt, hsa; identical to SEQ ID NO: 583239

SEQ ID NO: 711668 - RNA, 64 nt, hsa; identical to SEQ ID NO: 583240

SEQ ID NO: 711669 - RNA, 64 nt, hsa; identical to SEQ ID NO: 583241

SEQ ID NO: 711670 - RNA, 64 nt, hsa; identical to SEQ ID NO: 583242

SEQ ID NO: 711671 - RNA, 64 nt, hsa; identical to SEQ ID NO: 583243

SEQ ID NO: 711672 - RNA, 64 nt, hsa; identical to SEQ ID NO: 583244

SEQ ID NO: 711673 - RNA, 64 nt, hsa; identical to SEQ ID NO: 583245

SEQ ID NO: 711674 - RNA, 64 nt, hsa; identical to SEQ ID NO: 583246

SEQ ID NO: 711675 - RNA, 64 nt, hsa; identical to SEQ ID NO: 583247

SEQ ID NO: 711676 - RNA, 64 nt, hsa; identical to SEQ ID NO: 583248

SEQ ID NO: 711677 - RNA, 64 nt, hsa; identical to SEQ ID NO: 583249

SEQ ID NO: 711678 - RNA, 64 nt, hsa; identical to SEQ ID NO: 583250

SEQ ID NO: 711679 - RNA, 64 nt, hsa; identical to SEQ ID NO: 583251

SEQ ID NO: 711680 - RNA, 64 nt, hsa; identical to SEQ ID NO: 583252

SEQ ID NO: 711681 - RNA, 64 nt, hsa; identical to SEQ ID NO: 583253

SEQ ID NO: 711682 - RNA, 64 nt, hsa; identical to SEQ ID NO: 583254

SEQ ID NO: 711683 - RNA, 64 nt, hsa; identical to SEQ ID NO: 583255

SEQ ID NO: 711684 - RNA, 64 nt, hsa; identical to SEQ ID NO: 583256

SEQ ID NO: 711685 - RNA, 64 nt, hsa; identical to SEQ ID NO: 583257

SEQ ID NO: 711686 - RNA, 64 nt, hsa; identical to SEQ ID NO: 583258

SEQ ID NO: 711687 - RNA, 64 nt, hsa; identical to SEQ ID NO: 583259

SEQ ID NO: 711688 - RNA, 64 nt, hsa; identical to SEQ ID NO: 583260

SEQ ID NO: 711689 - RNA, 64 nt, hsa; identical to SEQ ID NO: 583261

SEQ ID NO: 711690 - RNA, 64 nt, hsa; identical to SEQ ID NO: 583262

SEQ ID NO: 711691 - RNA, 64 nt, hsa; identical to SEQ ID NO: 583263

SEQ ID NO: 711692 - RNA, 64 nt, hsa; identical to SEQ ID NO: 583264

SEQ ID NO: 711693 - RNA, 64 nt, hsa; identical to SEQ ID NO: 583265

SEQ ID NO: 711694 - RNA, 64 nt, hsa; identical to SEQ ID NO: 583266

SEQ ID NO: 711695 - RNA, 64 nt, hsa; identical to SEQ ID NO: 583267

SEQ ID NO: 711696 - RNA, 64 nt, hsa; identical to SEQ ID NO: 583268

SEQ ID NO: 711697 - RNA, 64 nt, hsa; identical to SEQ ID NO: 583269

SEQ ID NO: 711698 - RNA, 64 nt, hsa; identical to SEQ ID NO: 583270

SEQ ID NO: 711699 - RNA, 64 nt, hsa; identical to SEQ ID NO: 583271

SEQ ID NO: 711700 - RNA, 64 nt, hsa; identical to SEQ ID NO: 583272

SEQ ID NO: 711701 - RNA, 64 nt, hsa; identical to SEQ ID NO: 583273

SEQ ID NO: 711702 - RNA, 64 nt, hsa; identical to SEQ ID NO: 583274

SEQ ID NO: 711703 - RNA, 64 nt, hsa; identical to SEQ ID NO: 583275

SEQ ID NO: 711704 - RNA, 64 nt, hsa; identical to SEQ ID NO: 583276

SEQ ID NO: 711705 - RNA, 64 nt, hsa; identical to SEQ ID NO: 110360

SEQ ID NO: 711706 - RNA, 64 nt, hsa; identical to SEQ ID NO: 110361

SEQ ID NO: 711707 - RNA, 64 nt, hsa; identical to SEQ ID NO: 110362

SEQ ID NO: 711708 - RNA, 64 nt, hsa; identical to SEQ ID NO: 110363

SEQ ID NO: 711709 - RNA, 64 nt, hsa; identical to SEQ ID NO: 110364

SEQ ID NO: 711710 - RNA, 64 nt, hsa; identical to SEQ ID NO: 110365

SEQ ID NO: 711711 - RNA, 64 nt, hsa; identical to SEQ ID NO: 110366

SEQ ID NO: 711712 - RNA, 64 nt, hsa; identical to SEQ ID NO: 110367

SEQ ID NO: 711713 - RNA, 64 nt, hsa; identical to SEQ ID NO: 110368

SEQ ID NO: 711714 - RNA, 64 nt, hsa; identical to SEQ ID NO: 110369

SEQ ID NO: 711715 - RNA, 64 nt, hsa; identical to SEQ ID NO: 110370

SEQ ID NO: 711716 - RNA, 64 nt, hsa; identical to SEQ ID NO: 110371

SEQ ID NO: 711717 - RNA, 64 nt, hsa; identical to SEQ ID NO: 110372

SEQ ID NO: 711718 - RNA, 64 nt, hsa; identical to SEQ ID NO: 110373

SEQ ID NO: 711719 - RNA, 64 nt, hsa; identical to SEQ ID NO: 110374

SEQ ID NO: 711720 - RNA, 64 nt, hsa; identical to SEQ ID NO: 110375

SEQ ID NO: 711721 - RNA, 64 nt, hsa; identical to SEQ ID NO: 110376

SEQ ID NO: 711722 - RNA, 64 nt, hsa; identical to SEQ ID NO: 110377

SEQ ID NO: 711723 - RNA, 64 nt, hsa; identical to SEQ ID NO: 110378

SEQ ID NO: 711724 - RNA, 64 nt, hsa; identical to SEQ ID NO: 110379

SEQ ID NO: 711725 - RNA, 64 nt, hsa; identical to SEQ ID NO: 110380

SEQ ID NO: 711726 - RNA, 64 nt, hsa; identical to SEQ ID NO: 165842

SEQ ID NO: 711727 - RNA, 64 nt, hsa; identical to SEQ ID NO: 165843

SEQ ID NO: 711728 - RNA, 64 nt, hsa; identical to SEQ ID NO: 298981

SEQ ID NO: 711729 - RNA, 64 nt, hsa; identical to SEQ ID NO: 298982

SEQ ID NO: 711730 - RNA, 64 nt, hsa; identical to SEQ ID NO: 298983

SEQ ID NO: 711731 - RNA, 64 nt, hsa; identical to SEQ ID NO: 298984

SEQ ID NO: 711732 - RNA, 64 nt, hsa; identical to SEQ ID NO: 298985

SEQ ID NO: 711733 - RNA, 64 nt, hsa; identical to SEQ ID NO: 298986

SEQ ID NO: 711734 - RNA, 64 nt, hsa; identical to SEQ ID NO: 298987

SEQ ID NO: 711735 - RNA, 64 nt, hsa; identical to SEQ ID NO: 298988

SEQ ID NO: 711736 - RNA, 64 nt, hsa; identical to SEQ ID NO: 298989

SEQ ID NO: 711737 - RNA, 64 nt, hsa; identical to SEQ ID NO: 298990

SEQ ID NO: 711738 - RNA, 64 nt, hsa; identical to SEQ ID NO: 298991

SEQ ID NO: 711739 - RNA, 64 nt, hsa; identical to SEQ ID NO: 298992

SEQ ID NO: 711740 - RNA, 64 nt, hsa; identical to SEQ ID NO: 298993

SEQ ID NO: 711741 - RNA, 64 nt, hsa; identical to SEQ ID NO: 298994

SEQ ID NO: 711742 - RNA, 64 nt, hsa; identical to SEQ ID NO: 298995

SEQ ID NO: 711743 - RNA, 64 nt, hsa; identical to SEQ ID NO: 298996

SEQ ID NO: 711744 - RNA, 64 nt, hsa; identical to SEQ ID NO: 298997

SEQ ID NO: 711745 - RNA, 64 nt, hsa; identical to SEQ ID NO: 298998

SEQ ID NO: 711746 - RNA, 64 nt, hsa; identical to SEQ ID NO: 298999

SEQ ID NO: 711747 - RNA, 64 nt, hsa; identical to SEQ ID NO: 299000

SEQ ID NO: 711748 - RNA, 64 nt, hsa; identical to SEQ ID NO: 299001

SEQ ID NO: 711749 - RNA, 64 nt, hsa; identical to SEQ ID NO: 299002

SEQ ID NO: 711750 - RNA, 64 nt, hsa; identical to SEQ ID NO: 299003

SEQ ID NO: 711751 - RNA, 64 nt, hsa; identical to SEQ ID NO: 299004

SEQ ID NO: 711752 - RNA, 64 nt, hsa; identical to SEQ ID NO: 299005

SEQ ID NO: 711753 - RNA, 64 nt, hsa; identical to SEQ ID NO: 299006

SEQ ID NO: 711754 - RNA, 64 nt, hsa; identical to SEQ ID NO: 299007

SEQ ID NO: 711755 - RNA, 64 nt, hsa; identical to SEQ ID NO: 299008

SEQ ID NO: 711756 - RNA, 64 nt, hsa; identical to SEQ ID NO: 299009

SEQ ID NO: 711757 - RNA, 64 nt, hsa; identical to SEQ ID NO: 299010

SEQ ID NO: 711758 - RNA, 64 nt, hsa; identical to SEQ ID NO: 299011

SEQ ID NO: 711759 - RNA, 64 nt, hsa; identical to SEQ ID NO: 299012

SEQ ID NO: 711760 - RNA, 64 nt, hsa; identical to SEQ ID NO: 299013

SEQ ID NO: 711761 - RNA, 64 nt, hsa; identical to SEQ ID NO: 299014

SEQ ID NO: 711762 - RNA, 64 nt, hsa; identical to SEQ ID NO: 299015

SEQ ID NO: 711763 - RNA, 64 nt, hsa; identical to SEQ ID NO: 299016

SEQ ID NO: 711764 - RNA, 64 nt, hsa; identical to SEQ ID NO: 299017

SEQ ID NO: 711765 - RNA, 64 nt, hsa; identical to SEQ ID NO: 299018

SEQ ID NO: 711766 - RNA, 64 nt, hsa; identical to SEQ ID NO: 299019

SEQ ID NO: 711767 - RNA, 64 nt, hsa; identical to SEQ ID NO: 299020

SEQ ID NO: 711768 - RNA, 64 nt, hsa; identical to SEQ ID NO: 299021

SEQ ID NO: 711769 - RNA, 64 nt, hsa; identical to SEQ ID NO: 299022

SEQ ID NO: 711770 - RNA, 64 nt, hsa; identical to SEQ ID NO: 299023

SEQ ID NO: 711771 - RNA, 64 nt, hsa; identical to SEQ ID NO: 299024

SEQ ID NO: 711772 - RNA, 64 nt, hsa; identical to SEQ ID NO: 299025

SEQ ID NO: 711773 - RNA, 64 nt, hsa; identical to SEQ ID NO: 299026

SEQ ID NO: 711774 - RNA, 64 nt, hsa; identical to SEQ ID NO: 299027

SEQ ID NO: 711775 - RNA, 64 nt, hsa; identical to SEQ ID NO: 299028

SEQ ID NO: 711776 - RNA, 64 nt, hsa; identical to SEQ ID NO: 299029

SEQ ID NO: 711777 - RNA, 64 nt, hsa; identical to SEQ ID NO: 299030

SEQ ID NO: 711778 - RNA, 64 nt, hsa; identical to SEQ ID NO: 299031

SEQ ID NO: 711779 - RNA, 64 nt, hsa; identical to SEQ ID NO: 299032

SEQ ID NO: 711780 - RNA, 64 nt, hsa; identical to SEQ ID NO: 299033

SEQ ID NO: 711781 - RNA, 64 nt, hsa; identical to SEQ ID NO: 299034

SEQ ID NO: 711782 - RNA, 64 nt, hsa; identical to SEQ ID NO: 299035

SEQ ID NO: 711783 - RNA, 64 nt, hsa; identical to SEQ ID NO: 299036

SEQ ID NO: 711784 - RNA, 64 nt, hsa; identical to SEQ ID NO: 299037

SEQ ID NO: 711785 - RNA, 64 nt, hsa; identical to SEQ ID NO: 299038

SEQ ID NO: 711786 - RNA, 64 nt, hsa; identical to SEQ ID NO: 299039

SEQ ID NO: 711787 - RNA, 64 nt, hsa; identical to SEQ ID NO: 299040

SEQ ID NO: 711788 - RNA, 64 nt, hsa; identical to SEQ ID NO: 299041

SEQ ID NO: 711789 - RNA, 64 nt, hsa; identical to SEQ ID NO: 164859

SEQ ID NO: 711790 - RNA, 64 nt, hsa; identical to SEQ ID NO: 164860

SEQ ID NO: 711791 - RNA, 64 nt, hsa; identical to SEQ ID NO: 164861

SEQ ID NO: 711792 - RNA, 64 nt, hsa; identical to SEQ ID NO: 164862

SEQ ID NO: 711793 - RNA, 64 nt, hsa; identical to SEQ ID NO: 164863

SEQ ID NO: 711794 - RNA, 64 nt, hsa; identical to SEQ ID NO: 164864

SEQ ID NO: 711795 - RNA, 64 nt, hsa; identical to SEQ ID NO: 164865

SEQ ID NO: 711796 - RNA, 64 nt, hsa; identical to SEQ ID NO: 164866

SEQ ID NO: 711797 - RNA, 64 nt, hsa; identical to SEQ ID NO: 164867

SEQ ID NO: 711798 - RNA, 64 nt, hsa; identical to SEQ ID NO: 164868

SEQ ID NO: 711799 - RNA, 64 nt, hsa; identical to SEQ ID NO: 164869

SEQ ID NO: 711800 - RNA, 64 nt, hsa; identical to SEQ ID NO: 164870

SEQ ID NO: 711801 - RNA, 64 nt, hsa; identical to SEQ ID NO: 164871

SEQ ID NO: 711802 - RNA, 64 nt, hsa; identical to SEQ ID NO: 164872

SEQ ID NO: 711803 - RNA, 64 nt, hsa; identical to SEQ ID NO: 164873

SEQ ID NO: 711804 - RNA, 64 nt, hsa; identical to SEQ ID NO: 164874

SEQ ID NO: 711805 - RNA, 64 nt, hsa; identical to SEQ ID NO: 164875

SEQ ID NO: 711806 - RNA, 64 nt, hsa; identical to SEQ ID NO: 164876

SEQ ID NO: 711807 - RNA, 64 nt, hsa; identical to SEQ ID NO: 164877

SEQ ID NO: 711808 - RNA, 64 nt, hsa; identical to SEQ ID NO: 164878

SEQ ID NO: 711809 - RNA, 64 nt, hsa; identical to SEQ ID NO: 164879

SEQ ID NO: 711810 - RNA, 64 nt, hsa; identical to SEQ ID NO: 164880

SEQ ID NO: 711811 - RNA, 64 nt, hsa; identical to SEQ ID NO: 164881

SEQ ID NO: 711812 - RNA, 64 nt, hsa; identical to SEQ ID NO: 164882

SEQ ID NO: 711813 - RNA, 64 nt, hsa; identical to SEQ ID NO: 164883

SEQ ID NO: 711814 - RNA, 64 nt, hsa; identical to SEQ ID NO: 164884

SEQ ID NO: 711815 - RNA, 64 nt, hsa; identical to SEQ ID NO: 164885

SEQ ID NO: 711816 - RNA, 64 nt, hsa; identical to SEQ ID NO: 164886

SEQ ID NO: 711817 - RNA, 64 nt, hsa; identical to SEQ ID NO: 141970

SEQ ID NO: 711818 - RNA, 64 nt, hsa; identical to SEQ ID NO: 141971

SEQ ID NO: 711819 - RNA, 64 nt, hsa; identical to SEQ ID NO: 141972

SEQ ID NO: 711820 - RNA, 64 nt, hsa; identical to SEQ ID NO: 141973

SEQ ID NO: 711821 - RNA, 64 nt, hsa; identical to SEQ ID NO: 141974

SEQ ID NO: 711822 - RNA, 64 nt, hsa; identical to SEQ ID NO: 141975

SEQ ID NO: 711823 - RNA, 64 nt, hsa; identical to SEQ ID NO: 141976

SEQ ID NO: 711824 - RNA, 64 nt, hsa; identical to SEQ ID NO: 141977

SEQ ID NO: 711825 - RNA, 64 nt, hsa; identical to SEQ ID NO: 141978

SEQ ID NO: 711826 - RNA, 64 nt, hsa; identical to SEQ ID NO: 141979

SEQ ID NO: 711827 - RNA, 64 nt, hsa; identical to SEQ ID NO: 141980

SEQ ID NO: 711828 - RNA, 64 nt, hsa; identical to SEQ ID NO: 141981

SEQ ID NO: 711829 - RNA, 64 nt, hsa; identical to SEQ ID NO: 141982

SEQ ID NO: 711830 - RNA, 64 nt, hsa; identical to SEQ ID NO: 141983

SEQ ID NO: 711831 - RNA, 64 nt, hsa; identical to SEQ ID NO: 141984

SEQ ID NO: 711832 - RNA, 64 nt, hsa; identical to SEQ ID NO: 141985

SEQ ID NO: 711833 - RNA, 64 nt, hsa; identical to SEQ ID NO: 141986

SEQ ID NO: 711834 - RNA, 64 nt, hsa; identical to SEQ ID NO: 141987

SEQ ID NO: 711835 - RNA, 64 nt, hsa; identical to SEQ ID NO: 141988

SEQ ID NO: 711836 - RNA, 64 nt, hsa; identical to SEQ ID NO: 141989

SEQ ID NO: 711837 - RNA, 64 nt, hsa; identical to SEQ ID NO: 141990

SEQ ID NO: 711838 - RNA, 64 nt, hsa; identical to SEQ ID NO: 141991

SEQ ID NO: 711839 - RNA, 64 nt, hsa; identical to SEQ ID NO: 141992

SEQ ID NO: 711840 - RNA, 64 nt, hsa; identical to SEQ ID NO: 141993

SEQ ID NO: 711841 - RNA, 64 nt, hsa; identical to SEQ ID NO: 141994

SEQ ID NO: 711842 - RNA, 64 nt, hsa; identical to SEQ ID NO: 141995

SEQ ID NO: 711843 - RNA, 64 nt, hsa; identical to SEQ ID NO: 141996

SEQ ID NO: 711844 - RNA, 64 nt, hsa; identical to SEQ ID NO: 141997

SEQ ID NO: 711845 - RNA, 64 nt, hsa; identical to SEQ ID NO: 141998

SEQ ID NO: 711846 - RNA, 64 nt, hsa; identical to SEQ ID NO: 141999

SEQ ID NO: 711847 - RNA, 64 nt, hsa; identical to SEQ ID NO: 142000

SEQ ID NO: 711848 - RNA, 64 nt, hsa; identical to SEQ ID NO: 142001

SEQ ID NO: 711849 - RNA, 64 nt, hsa; identical to SEQ ID NO: 142002

SEQ ID NO: 711850 - RNA, 64 nt, hsa; identical to SEQ ID NO: 142003

SEQ ID NO: 711851 - RNA, 64 nt, hsa; identical to SEQ ID NO: 142004

SEQ ID NO: 711852 - RNA, 64 nt, hsa; identical to SEQ ID NO: 142005

SEQ ID NO: 711853 - RNA, 64 nt, hsa; identical to SEQ ID NO: 142006

SEQ ID NO: 711854 - RNA, 64 nt, hsa; identical to SEQ ID NO: 142007

SEQ ID NO: 711855 - RNA, 64 nt, hsa; identical to SEQ ID NO: 142008

SEQ ID NO: 711856 - RNA, 64 nt, hsa; identical to SEQ ID NO: 142009

SEQ ID NO: 711857 - RNA, 64 nt, hsa; identical to SEQ ID NO: 142010

SEQ ID NO: 711858 - RNA, 64 nt, hsa; identical to SEQ ID NO: 142011

SEQ ID NO: 711859 - RNA, 64 nt, hsa; identical to SEQ ID NO: 142012

SEQ ID NO: 711860 - RNA, 64 nt, hsa; identical to SEQ ID NO: 142013

SEQ ID NO: 711861 - RNA, 64 nt, hsa; identical to SEQ ID NO: 142014

SEQ ID NO: 711862 - RNA, 64 nt, hsa; identical to SEQ ID NO: 142015

SEQ ID NO: 711863 - RNA, 64 nt, hsa; identical to SEQ ID NO: 142016

SEQ ID NO: 711864 - RNA, 64 nt, hsa; identical to SEQ ID NO: 142017

SEQ ID NO: 711865 - RNA, 64 nt, hsa; identical to SEQ ID NO: 142018

SEQ ID NO: 711866 - RNA, 64 nt, hsa; identical to SEQ ID NO: 142019

SEQ ID NO: 711867 - RNA, 64 nt, hsa; identical to SEQ ID NO: 142020

SEQ ID NO: 711868 - RNA, 64 nt, hsa; identical to SEQ ID NO: 142021

SEQ ID NO: 711869 - RNA, 64 nt, hsa; identical to SEQ ID NO: 142022

SEQ ID NO: 711870 - RNA, 64 nt, hsa; identical to SEQ ID NO: 142023

SEQ ID NO: 711871 - RNA, 64 nt, hsa; identical to SEQ ID NO: 142024

SEQ ID NO: 711872 - RNA, 64 nt, hsa; identical to SEQ ID NO: 142025

SEQ ID NO: 711873 - RNA, 64 nt, hsa; identical to SEQ ID NO: 142026

SEQ ID NO: 711874 - RNA, 64 nt, hsa; identical to SEQ ID NO: 142027

SEQ ID NO: 711875 - RNA, 64 nt, hsa; identical to SEQ ID NO: 142028

SEQ ID NO: 711876 - RNA, 64 nt, hsa; identical to SEQ ID NO: 142029

SEQ ID NO: 711877 - RNA, 64 nt, hsa; identical to SEQ ID NO: 142030

SEQ ID NO: 711878 - RNA, 64 nt, hsa; identical to SEQ ID NO: 142031

SEQ ID NO: 711879 - RNA, 64 nt, hsa; identical to SEQ ID NO: 142032

SEQ ID NO: 711880 - RNA, 64 nt, hsa; identical to SEQ ID NO: 142033

SEQ ID NO: 711881 - RNA, 64 nt, hsa; identical to SEQ ID NO: 142034

SEQ ID NO: 711882 - RNA, 64 nt, hsa; identical to SEQ ID NO: 142035

SEQ ID NO: 711883 - RNA, 64 nt, hsa; identical to SEQ ID NO: 142036

SEQ ID NO: 711884 - RNA, 64 nt, hsa; identical to SEQ ID NO: 142037

SEQ ID NO: 711885 - RNA, 64 nt, hsa; identical to SEQ ID NO: 142038

SEQ ID NO: 711886 - RNA, 64 nt, hsa; identical to SEQ ID NO: 142039

SEQ ID NO: 711887 - RNA, 64 nt, hsa; identical to SEQ ID NO: 142040

SEQ ID NO: 711888 - RNA, 64 nt, hsa; identical to SEQ ID NO: 142041

SEQ ID NO: 711889 - RNA, 64 nt, hsa; identical to SEQ ID NO: 142042

SEQ ID NO: 711890 - RNA, 64 nt, hsa; identical to SEQ ID NO: 142043

SEQ ID NO: 711891 - RNA, 64 nt, hsa; identical to SEQ ID NO: 142044

SEQ ID NO: 711892 - RNA, 59 nt, hsa
caaaauaaggacuucaauccaaaguuuggacaguagauggacuucucagaacuuugcaa

SEQ ID NO: 711893 - RNA, 59 nt, hsa
agcaacaguuuucuguauugugcaacuuuacaguagauuucaccuuuguuucauuauua

SEQ ID NO: 711894 - RNA, 59 nt, hsa
aaaauggagagcuauguaacagauacacuacaguagaagaacuuacuucugaaaugaag

SEQ ID NO: 711895 - RNA, 58 nt, hsa
guuggacagccugggugugaauggcaagacaguagaugagucugguuaagcgagguca

SEQ ID NO: 711896 - RNA, 64 nt, hsa
cuacgugauauuugaagggaaggauaaguguugcuuucaguaguuauugccaauauuguuguug

SEQ ID NO: 711897 - RNA, 64 nt, hsa
cauggggaugacaauuugauuauuacaauuuaguuuucaguaaucaaaaagauuucuaugaauu

SEQ ID NO: 711898 - RNA, 64 nt, hsa
cuacugauccguaaaugauaaccacugcaaauuuuuucaguauaaaauuuuucacugcaaaaaa

SEQ ID NO: 711899 - RNA, 64 nt, hsa
uuuuuucaguauaaaauuuuucacugcaaaaaaauuucaguagaaaauaaggaugcagggccag

SEQ ID NO: 711900 - RNA, 64 nt, hsa
acaauuaaguuguuaauaacugugauuuuguaaauuucaguaauucauuuaaaugauguuucag

SEQ ID NO: 711901 - RNA, 64 nt, hsa
auuuuguaaauuucaguaauucauuuaaaugauguuucaguagauauauucuagcauauuaaga

SEQ ID NO: 711902 - RNA, 64 nt, hsa
acauaacauagucucccuugaaauucccucccuuuuucaguagaggauaaauagggugacucca

SEQ ID NO: 711903 - RNA, 64 nt, hsa
auacaccaacaugagacaucaguagucaguugguuuucaguaaagcuuguuccaaguuguucuc

SEQ ID NO: 711904 - RNA, 64 nt, hsa
uguacagugaaaagggaacauucuugcuguguuuuuucaguaagacuuucaggcacuucuuccc

SEQ ID NO: 711905 - RNA, 64 nt, hsa
uucuguggcuuuuuccuuucgauaaaccaucagauuucaguaguacauuugggaaaagaagggg

SEQ ID NO: 711906 - RNA, 64 nt, hsa
uacacuacuggcuuaagugaugacucuuucagauuuucaguauuuuauacaacuacugccacau

SEQ ID NO: 711907 - RNA, 64 nt, hsa
aaaguaaaacaacaggcuuugccaaguggaugcuuuucaguaacagugaaguggagugaauacc

SEQ ID NO: 711908 - RNA, 64 nt, hsa
auauuacaagggccccaguguuaaugucuuagauuuucaguauuugaacuuauuuuuuuaaauu

SEQ ID NO: 711909 - RNA, 64 nt, hsa
aaaaaaaaaaaaaaaagaaagccacacuuauucuuuucaguaaccugcuagugcacaggcugua

SEQ ID NO: 711910 - RNA, 64 nt, hsa
gcaaguagccaugcuuugguuguguguuuggccuuuucaguauuagacaaucauucuacaagag

SEQ ID NO: 711911 - RNA, 64 nt, hsa
cuaacacuaauggcaauuuacuuaugguauuuauuuucaguaguaaagacccagcuugaaugua

SEQ ID NO: 711912 - RNA, 64 nt, hsa
auuuagagaaggagccuaaacugaauuuguguuauuucaguaaaaguuauggaguuaugggucu

SEQ ID NO: 711913 - RNA, 64 nt, hsa
aaauucugguaacuuuuugagaguauuggauaauuuucaguaccugcgcaauccuugauuuaau

SEQ ID NO: 711914 - RNA, 64 nt, hsa
ggccaucugccauggugaggugagcgugaucucuuuucaguauaguaguuaacauuuucuagua

SEQ ID NO: 711915 - RNA, 64 nt, hsa
auccucucugguucucuuacuuuuaggacccuuuuuucaguaaguaauuuguuuauuagccagg

SEQ ID NO: 711916 - RNA, 64 nt, hsa
auuacuuccaaguuuucaugauguaugggaagauuuucaguagguguauuauauucacgguacc

SEQ ID NO: 711917 - RNA, 64 nt, hsa
uuuaacuggacccuauuaugccuuuuaaaaauaauuucaguaacccauaaauacauguuguaaa

SEQ ID NO: 711918 - RNA, 64 nt, hsa
gucccucucugauucacuuaguaaucuauccucuuuucaguauuacaugugcuuaaucucagau

SEQ ID NO: 711919 - RNA, 64 nt, hsa
uguuuuaaagaggcaacaaaagcuuguggugccauuucaguaaccacgguguuguuuuagaugc

SEQ ID NO: 711920 - RNA, 64 nt, hsa
ugauaaaugagcuagauggcucaauauguaagguuuucaguaguuuacccuccggaacccaagu

SEQ ID NO: 711921 - RNA, 64 nt, hsa
uaguauuguuugauguaguuaaccuuaaguuauuuuucaguaauuucuucacaaaucaagauuc

SEQ ID NO: 711922 - RNA, 64 nt, hsa
aaauuuagacaaaacaaugucauuuaguagaauauuucaguauuuaaguggaauuucaguauac

SEQ ID NO: 711923 - RNA, 64 nt, hsa
ucauuuaguagaauauuucaguauuuaaguggaauuucaguauacuguacuauccuuuauaagu

SEQ ID NO: 711924 - RNA, 64 nt, hsa
uuauugcuuuauuuauuggacgaauaaaguacuguuucaguacauucagagaacuagauaaaag

SEQ ID NO: 711925 - RNA, 64 nt, hsa
uggagagaaauucaggagcaccuagcuacuucauuuucaguaagaacaauuuuuauugcuuuau

SEQ ID NO: 711926 - RNA, 64 nt, hsa
guggcucuuuaauuccugaccucuucauucuccuuuucaguauaaccuccccuaugcucaugcc

SEQ ID NO: 711927 - RNA, 64 nt, hsa
aagcagaaguagcugcuuuuuagcaauagaauuguuucaguauuuugcugcuguuuaaugcgca

SEQ ID NO: 711928 - RNA, 64 nt, hsa
gugugucauuauacauuaauuguacaauaugcauuuucaguaaaauauuugaaaacuguaaaug

SEQ ID NO: 711929 - RNA, 64 nt, hsa
cugaagucagaccucauuuuauaucagagaacccuuucaguauagugaaucagaaacuccugcc

SEQ ID NO: 711930 - RNA, 64 nt, hsa
aaauuugggucagaacacaaauuugaagaugacuuuucaguauaugauggguauuuacauuuga

SEQ ID NO: 711931 - RNA, 64 nt, hsa
gguuagauaaugugucuaguuguuugcaugccaauuucaguagccucaguuauucaaccuagga

SEQ ID NO: 711932 - RNA, 64 nt, hsa
auuuccaaagagaagaacuagcagagaaauuguauuucaguaauuuuaagcuccuucugucuug

SEQ ID NO: 711933 - RNA, 64 nt, hsa
uuucuuucuuucauaugaucaauucuguugguauuuucaguaucucauuucucaaagcuaaaga

SEQ ID NO: 711934 - RNA, 64 nt, hsa
cauuuguagagcuacaaaagguauccuuucuuauuuucaguagucagaauuuuaucuagaaauc

SEQ ID NO: 711935 - RNA, 64 nt, hsa
ucaacaauaaaucuaacccuaguuguaucccuccuuucaguauuuuucacuuguugccccaaau

SEQ ID NO: 711936 - RNA, 64 nt, hsa
cagucuaagcaggcaaagguaacugaugacuaaauuucaguagcuacuuucauuggauugaccc

SEQ ID NO: 711937 - RNA, 64 nt, hsa
uucacauucagaacccagcaaccuggaguccaauuuucaguauuuuaacuaccucaauaaugcu

SEQ ID NO: 711938 - RNA, 64 nt, hsa
guguucagacagagccuauuacaagucucauaaauuucaguaaacaaucacaaauuauuuuggc

SEQ ID NO: 711939 - RNA, 64 nt, hsa
agaccucuugauacaaacaauagaaaauuguggcuuucaguaccaagaguuucuauuaucucca

SEQ ID NO: 711940 - RNA, 64 nt, hsa
ggaaaaaauauuuucucuaagauagaagaaguuauuucaguauuagcuauaggugcuaccuacc

SEQ ID NO: 711941 - RNA, 64 nt, hsa
gaguugugaggagaaagaagaaaauggcugcccauuucaguacccuuucaaagguaucucugcc

SEQ ID NO: 711942 - RNA, 64 nt, hsa
guuggguuuuagaucucuuuucauuugucaaccuuuucaguaaagcccucuguuacaucacugu

SEQ ID NO: 711943 - RNA, 64 nt, hsa
uuccagaagccagcaguauuucaguaucacaguguuucaguaauuugccuccaugauucuagug

SEQ ID NO: 711944 - RNA, 64 nt, hsa
acaugucagaagauuauuccagaagccagcaguauuucaguaucacaguguuucaguaauuugc

SEQ ID NO: 711945 - RNA, 64 nt, hsa
aucuguaaucguuaaguacccaugaaagaauguguuucaguaucagugcuuuuuugguacuuua

SEQ ID NO: 711946 - RNA, 64 nt, hsa
ucaugaucaagguuuccuuaaauuuagcauugcauuucaguacugacuguguaagcuaaauugc

SEQ ID NO: 711947 - RNA, 64 nt, hsa
gguguguacuuuuuaggggguggggcucuggcuuuuucaguaaacauaacuauuuuaagguuaa

SEQ ID NO: 711948 - RNA, 64 nt, hsa
ucaauuguuugcucauuuguauugcugcguaguauuucaguauuucauuguauaccacaauuuu

SEQ ID NO: 711949 - RNA, 64 nt, hsa
uuguuugguucuuguaaaaaacuuggauuuuuuuuuucaguaacugguauuauguuuucucuua

SEQ ID NO: 711950 - RNA, 64 nt, hsa
auacaaaauuucacagauuauuugugugugucuguuucaguauauuuggauugggacucuaagc

SEQ ID NO: 711951 - RNA, 64 nt, hsa
gugaggcaauugauugaguauauuucccuucuuauuucaguaauacucuauuuuuuuucaugaa

SEQ ID NO: 711952 - RNA, 64 nt, hsa
aaccuuuccuaagagauuugguaugugaggauacuuucaguaccacuccuaccauucauuuuuc

SEQ ID NO: 711953 - RNA, 64 nt, hsa
aaugucucaaaugucucguaucaguuuuaguguuuuucaguauuagggaaagguaauauaaaaa

SEQ ID NO: 711954 - RNA, 64 nt, hsa
uguuagaucucuuuaguaaacauacaaauguguuuuucaguaggcuucaauuacaaacaguuaa

SEQ ID NO: 711955 - RNA, 55 nt, hsa; identical to SEQ ID NO: 316954

SEQ ID NO: 711956 - RNA, 64 nt, hsa; identical to SEQ ID NO: 316955

SEQ ID NO: 711957 - RNA, 64 nt, hsa; identical to SEQ ID NO: 316956

SEQ ID NO: 711958 - RNA, 64 nt, hsa; identical to SEQ ID NO: 316957

SEQ ID NO: 711959 - RNA, 64 nt, hsa; identical to SEQ ID NO: 316958

SEQ ID NO: 711960 - RNA, 64 nt, hsa; identical to SEQ ID NO: 316959

SEQ ID NO: 711961 - RNA, 64 nt, hsa; identical to SEQ ID NO: 316960

SEQ ID NO: 711962 - RNA, 64 nt, hsa; identical to SEQ ID NO: 316961

SEQ ID NO: 711963 - RNA, 64 nt, hsa; identical to SEQ ID NO: 316962

SEQ ID NO: 711964 - RNA, 64 nt, hsa; identical to SEQ ID NO: 316963

SEQ ID NO: 711965 - RNA, 64 nt, hsa; identical to SEQ ID NO: 316964

SEQ ID NO: 711966 - RNA, 64 nt, hsa; identical to SEQ ID NO: 316965

SEQ ID NO: 711967 - RNA, 64 nt, hsa; identical to SEQ ID NO: 316966

SEQ ID NO: 711968 - RNA, 64 nt, hsa; identical to SEQ ID NO: 316967

SEQ ID NO: 711969 - RNA, 64 nt, hsa; identical to SEQ ID NO: 316968

SEQ ID NO: 711970 - RNA, 64 nt, hsa; identical to SEQ ID NO: 316969

SEQ ID NO: 711971 - RNA, 64 nt, hsa; identical to SEQ ID NO: 316970

SEQ ID NO: 711972 - RNA, 64 nt, hsa; identical to SEQ ID NO: 316971

SEQ ID NO: 711973 - RNA, 64 nt, hsa; identical to SEQ ID NO: 316972

SEQ ID NO: 711974 - RNA, 64 nt, hsa; identical to SEQ ID NO: 316973

SEQ ID NO: 711975 - RNA, 64 nt, hsa; identical to SEQ ID NO: 316974

SEQ ID NO: 711976 - RNA, 64 nt, hsa; identical to SEQ ID NO: 316975

SEQ ID NO: 711977 - RNA, 64 nt, hsa; identical to SEQ ID NO: 316976

SEQ ID NO: 711978 - RNA, 64 nt, hsa; identical to SEQ ID NO: 316977

SEQ ID NO: 711979 - RNA, 64 nt, hsa; identical to SEQ ID NO: 316978

SEQ ID NO: 711980 - RNA, 64 nt, hsa; identical to SEQ ID NO: 316979

SEQ ID NO: 711981 - RNA, 64 nt, hsa; identical to SEQ ID NO: 316980

SEQ ID NO: 711982 - RNA, 64 nt, hsa; identical to SEQ ID NO: 316981

SEQ ID NO: 711983 - RNA, 64 nt, hsa; identical to SEQ ID NO: 316982

SEQ ID NO: 711984 - RNA, 64 nt, hsa; identical to SEQ ID NO: 316983

SEQ ID NO: 711985 - RNA, 64 nt, hsa; identical to SEQ ID NO: 316984

SEQ ID NO: 711986 - RNA, 64 nt, hsa; identical to SEQ ID NO: 316985

SEQ ID NO: 711987 - RNA, 64 nt, hsa; identical to SEQ ID NO: 316986

SEQ ID NO: 711988 - RNA, 64 nt, hsa; identical to SEQ ID NO: 316987

SEQ ID NO: 711989 - RNA, 64 nt, hsa; identical to SEQ ID NO: 316988

SEQ ID NO: 711990 - RNA, 64 nt, hsa; identical to SEQ ID NO: 316989

SEQ ID NO: 711991 - RNA, 64 nt, hsa; identical to SEQ ID NO: 316990

SEQ ID NO: 711992 - RNA, 64 nt, hsa; identical to SEQ ID NO: 316991

SEQ ID NO: 711993 - RNA, 64 nt, hsa; identical to SEQ ID NO: 316992

SEQ ID NO: 711994 - RNA, 64 nt, hsa; identical to SEQ ID NO: 316993

SEQ ID NO: 711995 - RNA, 64 nt, hsa; identical to SEQ ID NO: 316994

SEQ ID NO: 711996 - RNA, 64 nt, hsa; identical to SEQ ID NO: 344312

SEQ ID NO: 711997 - RNA, 64 nt, hsa; identical to SEQ ID NO: 344313

SEQ ID NO: 711998 - RNA, 64 nt, hsa; identical to SEQ ID NO: 344314

SEQ ID NO: 711999 - RNA, 64 nt, hsa; identical to SEQ ID NO: 344315

SEQ ID NO: 712000 - RNA, 64 nt, hsa; identical to SEQ ID NO: 344316

SEQ ID NO: 712001 - RNA, 64 nt, hsa; identical to SEQ ID NO: 344317

SEQ ID NO: 712002 - RNA, 64 nt, hsa; identical to SEQ ID NO: 344318

SEQ ID NO: 712003 - RNA, 64 nt, hsa; identical to SEQ ID NO: 344319

SEQ ID NO: 712004 - RNA, 64 nt, hsa; identical to SEQ ID NO: 344320

SEQ ID NO: 712005 - RNA, 64 nt, hsa; identical to SEQ ID NO: 344321

SEQ ID NO: 712006 - RNA, 64 nt, hsa; identical to SEQ ID NO: 344322

SEQ ID NO: 712007 - RNA, 58 nt, hsa; identical to SEQ ID NO: 344323

SEQ ID NO: 712008 - RNA, 64 nt, hsa; identical to SEQ ID NO: 344324

SEQ ID NO: 712009 - RNA, 64 nt, hsa; identical to SEQ ID NO: 365319

SEQ ID NO: 712010 - RNA, 64 nt, hsa; identical to SEQ ID NO: 365320

SEQ ID NO: 712011 - RNA, 64 nt, hsa; identical to SEQ ID NO: 365321

SEQ ID NO: 712012 - RNA, 64 nt, hsa; identical to SEQ ID NO: 365322

SEQ ID NO: 712013 - RNA, 64 nt, hsa; identical to SEQ ID NO: 365323

SEQ ID NO: 712014 - RNA, 64 nt, hsa; identical to SEQ ID NO: 365324

SEQ ID NO: 712015 - RNA, 64 nt, hsa; identical to SEQ ID NO: 365325

SEQ ID NO: 712016 - RNA, 64 nt, hsa; identical to SEQ ID NO: 365326

SEQ ID NO: 712017 - RNA, 64 nt, hsa; identical to SEQ ID NO: 365327

SEQ ID NO: 712018 - RNA, 64 nt, hsa; identical to SEQ ID NO: 365328

SEQ ID NO: 712019 - RNA, 64 nt, hsa; identical to SEQ ID NO: 365329

SEQ ID NO: 712020 - RNA, 64 nt, hsa; identical to SEQ ID NO: 365330

SEQ ID NO: 712021 - RNA, 64 nt, hsa
uuguauuguuuagugucaguguaucauuuaguauuuguaucacuguaccauuuaguguuguaua

SEQ ID NO: 712022 - RNA, 64 nt, hsa
auuuaauauugguuaucaccauacaguuuaauauuuguaucauuugguucauuguaucguuuag

SEQ ID NO: 712023 - RNA, 64 nt, hsa
uaaaucuuuaauaauuuauauguagguaauauuuuuguaucacaaugcauuauuuuuuuccucc

SEQ ID NO: 712024 - RNA, 64 nt, hsa
augcuuuaaacauucucauguguaauauauguuuuuguaucaaaaacacucauauauuucaaga

SEQ ID NO: 712025 - RNA, 64 nt, hsa
cucacuaaccauucgacugagcacacuuucauauuuguaucagcuuuugugcuaaaacucucua

SEQ ID NO: 712026 - RNA, 64 nt, hsa
gaaaauucacugcuauaagaaagguggagucaguuuguaucaguuaauaggauguucauauucc

SEQ ID NO: 712027 - RNA, 64 nt, hsa
agcuguuggcuguuuuuuuuguuguuuguucauuuuguaucaguauaaucuacgauucuguuag

SEQ ID NO: 712028 - RNA, 64 nt, hsa
guauauagaaaugcauuagacuuguacauugaucuuguaucaagcaacuuagaucaguuaacuu

SEQ ID NO: 712029 - RNA, 64 nt, hsa
gguucaagggaaauuaaaugauauggacccuaauuuguaucauucugaguugauugugugguuu

SEQ ID NO: 712030 - RNA, 64 nt, hsa
uuaaaacuuguguggaaaaaacuaacuuauaauuuuguaucacacacccuggauauguguucug

SEQ ID NO: 712031 - RNA, 64 nt, hsa
gccagaaacaagggacagugaaacacccagagacuuguaucagcaggaagccauugccauucug

SEQ ID NO: 712032 - RNA, 64 nt, hsa
auuucuuuucacaaguuaauauagggauggcuguuuguaucagccaugguucuuucugguggaa

SEQ ID NO: 712033 - RNA, 64 nt, hsa
auuuauuuuuuaaaacucaaagagggaaagagccuuguaucauaugugaacauuguaucauagg

SEQ ID NO: 712034 - RNA, 64 nt, hsa
aaagagggaaagagccuuguaucauaugugaacauuguaucauagguaauguuguacagacccu

SEQ ID NO: 712035 - RNA, 64 nt, hsa; identical to SEQ ID NO: 168067

SEQ ID NO: 712036 - RNA, 64 nt, hsa; identical to SEQ ID NO: 168068

SEQ ID NO: 712037 - RNA, 64 nt, hsa; identical to SEQ ID NO: 168069

SEQ ID NO: 712038 - RNA, 64 nt, hsa; identical to SEQ ID NO: 168070

SEQ ID NO: 712039 - RNA, 64 nt, hsa; identical to SEQ ID NO: 168071

SEQ ID NO: 712040 - RNA, 64 nt, hsa; identical to SEQ ID NO: 168072

SEQ ID NO: 712041 - RNA, 64 nt, hsa; identical to SEQ ID NO: 168073

SEQ ID NO: 712042 - RNA, 64 nt, hsa; identical to SEQ ID NO: 168074

SEQ ID NO: 712043 - RNA, 64 nt, hsa; identical to SEQ ID NO: 168075

SEQ ID NO: 712044 - RNA, 64 nt, hsa; identical to SEQ ID NO: 168076

SEQ ID NO: 712045 - RNA, 64 nt, hsa; identical to SEQ ID NO: 168077

SEQ ID NO: 712046 - RNA, 64 nt, hsa; identical to SEQ ID NO: 168078

SEQ ID NO: 712047 - RNA, 64 nt, hsa; identical to SEQ ID NO: 168079

SEQ ID NO: 712048 - RNA, 64 nt, hsa; identical to SEQ ID NO: 168080

SEQ ID NO: 712049 - RNA, 64 nt, hsa; identical to SEQ ID NO: 196485

SEQ ID NO: 712050 - RNA, 64 nt, hsa; identical to SEQ ID NO: 196486

SEQ ID NO: 712051 - RNA, 64 nt, hsa; identical to SEQ ID NO: 196487

SEQ ID NO: 712052 - RNA, 64 nt, hsa; identical to SEQ ID NO: 196488

SEQ ID NO: 712053 - RNA, 64 nt, hsa; identical to SEQ ID NO: 196489

SEQ ID NO: 712054 - RNA, 64 nt, hsa; identical to SEQ ID NO: 196490

SEQ ID NO: 712055 - RNA, 64 nt, hsa; identical to SEQ ID NO: 196491

SEQ ID NO: 712056 - RNA, 64 nt, hsa; identical to SEQ ID NO: 196492

SEQ ID NO: 712057 - RNA, 64 nt, hsa; identical to SEQ ID NO: 196493

SEQ ID NO: 712058 - RNA, 64 nt, hsa; identical to SEQ ID NO: 196494

SEQ ID NO: 712059 - RNA, 64 nt, hsa; identical to SEQ ID NO: 196495

SEQ ID NO: 712060 - RNA, 64 nt, hsa; identical to SEQ ID NO: 196496

SEQ ID NO: 712061 - RNA, 64 nt, hsa; identical to SEQ ID NO: 196497

SEQ ID NO: 712062 - RNA, 64 nt, hsa; identical to SEQ ID NO: 196498

SEQ ID NO: 712063 - RNA, 64 nt, hsa; identical to SEQ ID NO: 196499

SEQ ID NO: 712064 - RNA, 64 nt, hsa; identical to SEQ ID NO: 196500

SEQ ID NO: 712065 - RNA, 64 nt, hsa; identical to SEQ ID NO: 196501

SEQ ID NO: 712066 - RNA, 64 nt, hsa; identical to SEQ ID NO: 196502

SEQ ID NO: 712067 - RNA, 64 nt, hsa; identical to SEQ ID NO: 196503

SEQ ID NO: 712068 - RNA, 64 nt, hsa; identical to SEQ ID NO: 196504

SEQ ID NO: 712069 - RNA, 64 nt, hsa; identical to SEQ ID NO: 196505

SEQ ID NO: 712070 - RNA, 64 nt, hsa; identical to SEQ ID NO: 196506

SEQ ID NO: 712071 - RNA, 64 nt, hsa; identical to SEQ ID NO: 196507

SEQ ID NO: 712072 - RNA, 64 nt, hsa; identical to SEQ ID NO: 196508

SEQ ID NO: 712073 - RNA, 64 nt, hsa; identical to SEQ ID NO: 196509

SEQ ID NO: 712074 - RNA, 64 nt, hsa; identical to SEQ ID NO: 196510

SEQ ID NO: 712075 - RNA, 64 nt, hsa; identical to SEQ ID NO: 196511

SEQ ID NO: 712076 - RNA, 64 nt, hsa; identical to SEQ ID NO: 196512

SEQ ID NO: 712077 - RNA, 64 nt, hsa; identical to SEQ ID NO: 196513

SEQ ID NO: 712078 - RNA, 64 nt, hsa; identical to SEQ ID NO: 196514

SEQ ID NO: 712079 - RNA, 64 nt, hsa; identical to SEQ ID NO: 196515

SEQ ID NO: 712080 - RNA, 64 nt, hsa; identical to SEQ ID NO: 196516

SEQ ID NO: 712081 - RNA, 64 nt, hsa; identical to SEQ ID NO: 196517

SEQ ID NO: 712082 - RNA, 64 nt, hsa; identical to SEQ ID NO: 196518

SEQ ID NO: 712083 - RNA, 64 nt, hsa; identical to SEQ ID NO: 196519

SEQ ID NO: 712084 - RNA, 64 nt, hsa; identical to SEQ ID NO: 196520

SEQ ID NO: 712085 - RNA, 64 nt, hsa; identical to SEQ ID NO: 196521

SEQ ID NO: 712086 - RNA, 64 nt, hsa; identical to SEQ ID NO: 196522

SEQ ID NO: 712087 - RNA, 64 nt, hsa; identical to SEQ ID NO: 196523

SEQ ID NO: 712088 - RNA, 64 nt, hsa; identical to SEQ ID NO: 196524

SEQ ID NO: 712089 - RNA, 64 nt, hsa; identical to SEQ ID NO: 196525

SEQ ID NO: 712090 - RNA, 64 nt, hsa; identical to SEQ ID NO: 196526

SEQ ID NO: 712091 - RNA, 64 nt, hsa; identical to SEQ ID NO: 196527

SEQ ID NO: 712092 - RNA, 64 nt, hsa; identical to SEQ ID NO: 196528

SEQ ID NO: 712093 - RNA, 64 nt, hsa; identical to SEQ ID NO: 196529

SEQ ID NO: 712094 - RNA, 64 nt, hsa; identical to SEQ ID NO: 196530

SEQ ID NO: 712095 - RNA, 64 nt, hsa; identical to SEQ ID NO: 196531

SEQ ID NO: 712096 - RNA, 64 nt, hsa; identical to SEQ ID NO: 196532

SEQ ID NO: 712097 - RNA, 64 nt, hsa; identical to SEQ ID NO: 196533

SEQ ID NO: 712098 - RNA, 64 nt, hsa; identical to SEQ ID NO: 196534

SEQ ID NO: 712099 - RNA, 64 nt, hsa; identical to SEQ ID NO: 196535

SEQ ID NO: 712100 - RNA, 64 nt, hsa; identical to SEQ ID NO: 196536

SEQ ID NO: 712101 - RNA, 64 nt, hsa; identical to SEQ ID NO: 196537

SEQ ID NO: 712102 - RNA, 64 nt, hsa; identical to SEQ ID NO: 196538

SEQ ID NO: 712103 - RNA, 64 nt, hsa; identical to SEQ ID NO: 196539

SEQ ID NO: 712104 - RNA, 64 nt, hsa; identical to SEQ ID NO: 196540

SEQ ID NO: 712105 - RNA, 64 nt, hsa; identical to SEQ ID NO: 196541

SEQ ID NO: 712106 - RNA, 64 nt, hsa; identical to SEQ ID NO: 196542

SEQ ID NO: 712107 - RNA, 64 nt, hsa; identical to SEQ ID NO: 196543

SEQ ID NO: 712108 - RNA, 64 nt, hsa; identical to SEQ ID NO: 196544

SEQ ID NO: 712109 - RNA, 64 nt, hsa; identical to SEQ ID NO: 196545

SEQ ID NO: 712110 - RNA, 64 nt, hsa; identical to SEQ ID NO: 196546

SEQ ID NO: 712111 - RNA, 64 nt, hsa; identical to SEQ ID NO: 196547

SEQ ID NO: 712112 - RNA, 64 nt, hsa; identical to SEQ ID NO: 196548

SEQ ID NO: 712113 - RNA, 64 nt, hsa; identical to SEQ ID NO: 196549

SEQ ID NO: 712114 - RNA, 64 nt, hsa; identical to SEQ ID NO: 196550

SEQ ID NO: 712115 - RNA, 64 nt, hsa; identical to SEQ ID NO: 196551

SEQ ID NO: 712116 - RNA, 64 nt, hsa; identical to SEQ ID NO: 196551

SEQ ID NO: 712117 - RNA, 64 nt, hsa; identical to SEQ ID NO: 196553

SEQ ID NO: 712118 - RNA, 64 nt, hsa; identical to SEQ ID NO: 196554

SEQ ID NO: 712119 - RNA, 64 nt, hsa; identical to SEQ ID NO: 196555

SEQ ID NO: 712120 - RNA, 64 nt, hsa; identical to SEQ ID NO: 196556

SEQ ID NO: 712121 - RNA, 64 nt, hsa; identical to SEQ ID NO: 196557

SEQ ID NO: 712122 - RNA, 64 nt, hsa; identical to SEQ ID NO: 196558

SEQ ID NO: 712123 - RNA, 64 nt, hsa; identical to SEQ ID NO: 196559

SEQ ID NO: 712124 - RNA, 64 nt, hsa; identical to SEQ ID NO: 196560

SEQ ID NO: 712125 - RNA, 64 nt, hsa; identical to SEQ ID NO: 196561

SEQ ID NO: 712126 - RNA, 64 nt, hsa; identical to SEQ ID NO: 196562

SEQ ID NO: 712127 - RNA, 64 nt, hsa; identical to SEQ ID NO: 196563

SEQ ID NO: 712128 - RNA, 64 nt, hsa; identical to SEQ ID NO: 196564

SEQ ID NO: 712129 - RNA, 64 nt, hsa; identical to SEQ ID NO: 196565

SEQ ID NO: 712130 - RNA, 64 nt, hsa; identical to SEQ ID NO: 196566

SEQ ID NO: 712131 - RNA, 64 nt, hsa; identical to SEQ ID NO: 196567

SEQ ID NO: 712132 - RNA, 64 nt, hsa; identical to SEQ ID NO: 196568

SEQ ID NO: 712133 - RNA, 64 nt, hsa; identical to SEQ ID NO: 196569

SEQ ID NO: 712134 - RNA, 64 nt, hsa; identical to SEQ ID NO: 196570

SEQ ID NO: 712135 - RNA, 64 nt, hsa; identical to SEQ ID NO: 196571

SEQ ID NO: 712136 - RNA, 64 nt, hsa; identical to SEQ ID NO: 196572

SEQ ID NO: 712137 - RNA, 64 nt, hsa
ggguugggaaaaaguggaaggcauaagcauagaaauauuuuaggauauuuuaggauaugugaau

SEQ ID NO: 712138 - RNA, 64 nt, hsa
aaaguggaaggcauaagcauagaaauauuuuaggauauuuuaggauaugugaauaaagcuagac

SEQ ID NO: 712139 - RNA, 64 nt, hsa
uuucauugacagcugacauaauucauugagugaaauauuuuaagccaaaaaaaaauucccuuuu

SEQ ID NO: 712140 - RNA, 64 nt, hsa
ccacuguuuugaacuaccacaaaaguauaaaugaauauuuuaaugccacaaucuuuccuguugc

SEQ ID NO: 712141 - RNA, 64 nt, hsa
ucuccuguggaaaucccaauugcuugaauuacugauauuuuagaauagacuuuuuaaaaugcca

SEQ ID NO: 712142 - RNA, 64 nt, hsa
uggauaauguugcaacuacuuguuaugcauauaaauauuuuacuuuuucacauguauagauugc

SEQ ID NO: 712143 - RNA, 64 nt, hsa
cauguuaauaaauuuaaaacaucauucguauaaaauauuuuaauuuucuuguauuucauuuaga

SEQ ID NO: 712144 - RNA, 64 nt, hsa
uauauugcuuugaaguaagucucaauaaggcaauauauuuuagggcaucuuucuucuuaucucu

SEQ ID NO: 712145 - RNA, 64 nt, hsa
auuuacaaaacaaggaaaaugcuguaaauauugcauauuuuauguauuuggaccaaaagguuac

SEQ ID NO: 712146 - RNA, 64 nt, hsa
ucaguaaacuuucuguggaagggccagagaguaaauauuuuaggcuuugcagcccauacggucu

SEQ ID NO: 712147 - RNA, 64 nt, hsa
uuuaacaguucagaauaggggcauuuauuuuaucauauuuuaggguggguuaggaguauccuuu

SEQ ID NO: 712148 - RNA, 64 nt, hsa
auauauuaauuuuuguguaaugaaugccaacaguauauuuuauaugauuuacuuaugugaggaa

SEQ ID NO: 712149 - RNA, 64 nt, hsa
auuaaugaaagaacauuguuauauucugcgugguauauuuuaaaguuuaagaaggcauguuaaa

SEQ ID NO: 712150 - RNA, 64 nt, hsa
cuuauauaauaagugcauguaggaauugcaaaaaauauuuuaaaaauuuauuacugaauuuaaa

SEQ ID NO: 712151 - RNA, 64 nt, hsa
aaaauauuuuaaaaauuuauuacugaauuuaaaaauauuuuagaaguuuuguaauggugguguu

SEQ ID NO: 712152 - RNA, 64 nt, hsa
aauauuuuagaaguuuuguaauggugguguuuuaauauuuuacauaauuaaauauguacauauu

SEQ ID NO: 712153 - RNA, 64 nt, hsa
acacaaauaacagcuuucuuauucagugaaaaagauauuuuauuucugauguuuuauuugcacu

SEQ ID NO: 712154 - RNA, 64 nt, hsa
ucuauuugguuugcuuuuuuuuuuuugcuuuguuauauuuuauugcuacaaggggugugacuug

SEQ ID NO: 712155 - RNA, 64 nt, hsa
gucuguauucaauaugguauaaaauauaaaaacuauauuuuaacuuagugaaauauuuuacuau

SEQ ID NO: 712156 - RNA, 64 nt, hsa
auaaaauauaaaaacuauauuuuaacuuagugaaauauuuuacuauuucucuacuucagacaaa

SEQ ID NO: 712157 - RNA, 64 nt, hsa
agaaacacuaguguuuaguuuuacaguaacccucauauuuuaaugguguuacagcauuugcaaa

SEQ ID NO: 712158 - RNA, 64 nt, hsa
aucuggguuaucaacauuuucucaaaugcugucaauauuuuacuguaauuuauguucuuauauu

SEQ ID NO: 712159 - RNA, 64 nt, hsa
guuugcauguaagagaccaggauauguaacucuuauauuuuaaguguauacauauuguguauau

SEQ ID NO: 712160 - RNA, 64 nt, hsa
uauauaguccagucuucauuuuacauacacacacauauuuuacacacacacacauuuuacacac

SEQ ID NO: 712161 - RNA, 64 nt, hsa
cuucucuguguuuucugguuuaaaagcugcacuuauauuuuagccuuauuauuuucuguaguuc

SEQ ID NO: 712162 - RNA, 64 nt, hsa
uugaauuuucuucagacaaaacugcucuugugcaauauuuuaugcucagugagcaaauugugua

SEQ ID NO: 712163 - RNA, 64 nt, hsa
auauauauauauauauauauauauauauauauauauauuuuacagucuuaucugccuuuuuauc

SEQ ID NO: 712164 - RNA, 64 nt, hsa
auaacaaauuucccacuucucccuguuucuaaacauauuuuauauauuaagauguuuguucuug

SEQ ID NO: 712165 - RNA, 64 nt, hsa
aguagacacacugugggaggaucugagcuuggugauauuuuauccccaagauaugacaccaagg

SEQ ID NO: 712166 - RNA, 64 nt, hsa
aaagguaugagggaaagagagucugagaauuaaaauauuuuaguauaagcaauuggcugugaug

SEQ ID NO: 712167 - RNA, 64 nt, hsa
uucugaaaguaucagcuacugauccagccacuggauauuuuauauccucccuuuuccuuaagca

SEQ ID NO: 712168 - RNA, 64 nt, hsa
uuggaacugcauucuuuuaaaguuuuauaugcauauauuuuagggcuguagacuuacuuuccua

SEQ ID NO: 712169 - RNA, 64 nt, hsa
acuuugugccuuugaccaucucuuaggucuaaugauauuuuaugcaaacaguucuuggaccccu

SEQ ID NO: 712170 - RNA, 64 nt, hsa
aaaaugaggauuaguaauauaaugaccugcuaauauauuuuaagaacauguuuuaaaaagauac

SEQ ID NO: 712171 - RNA, 64 nt, hsa
ucaauggauggauuaauauuuaucccccuuugggauauuuuaaaaucuacuaaaaugaggauua

SEQ ID NO: 712172 - RNA, 64 nt, hsa
ucugauacaugauguucaauuuuaucuuuagguaauauuuuauaucauagauuaaaauuuauag

SEQ ID NO: 712173 - RNA, 64 nt, hsa
agaaaccacuauuucaugaaaagcauggaauauuauauuuuauuguucauaauuaaugaauaaa

SEQ ID NO: 712174 - RNA, 64 nt, hsa
uauuuucagguuuuguauuuucuuuucuuguggaauauuuuaauuaauauagcauggcaccuca

SEQ ID NO: 712175 - RNA, 64 nt, hsa
gaagcaaauuauucaguaggugccucuguaccaaauauuuuauggaauaucuaaauacuaaaau

SEQ ID NO: 712176 - RNA, 64 nt, hsa
uugguugauuguuuauauaaaacacacuaaaauuauauuuuaaaaguuuacugccaugaaauac

SEQ ID NO: 712177 - RNA, 64 nt, hsa
agagaaaugugaagauaagaugaacuaaacaaacauauuuuagagcauggaucucgaagcagaa

SEQ ID NO: 712178 - RNA, 64 nt, hsa
cuuugucuacagaacaauuaguaauacccaaguaauauuuuaauuacuuuugcagcuguuacag

SEQ ID NO: 712179 - RNA, 64 nt, hsa
uguucagaucaaagaccaaaacauuuucuuaaauauauuuuauguaauauuuuauuuguauaca

SEQ ID NO: 712180 - RNA, 64 nt, hsa
agaccaaaacauuuucuuaaauauauuuuauguaauauuuuauuuguauacaguguuguugaug

SEQ ID NO: 712181 - RNA, 64 nt, hsa
caguguuguugaugaaauauuuaacuagagcaugauauuuuaaauguuaagguguaacauaugu

SEQ ID NO: 712182 - RNA, 64 nt, hsa
guauacaguguacaauguguauuucuucaaccauauauuuuaaaaagacguacauagaaacuua

SEQ ID NO: 712183 - RNA, 64 nt, hsa
uuuuuucaacuccuauuguguuucuuugugugugauauuuuaaucaaaagugguugaguuguua

SEQ ID NO: 712184 - RNA, 64 nt, hsa
cugcaaacuuuuucuguaaagggccgguuuauaaauauuuuagacuuugcaggcuauaauauau

SEQ ID NO: 712185 - RNA, 64 nt, hsa
uauccuaaauauguuaucaaguauuuagaguucuauauuuuaaagauauauguguucauguauu

SEQ ID NO: 712186 - RNA, 64 nt, hsa
gaucgaaccaaaaaaaaucauuuaaacuuuaaaaauauuuuaaauggacuuuggggagacauuu

SEQ ID NO: 712187 - RNA, 64 nt, hsa
uuggcccuucaagcaaccuagcuaaaaggugcugauauuuuauuuaguacugccaacuucaagu

SEQ ID NO: 712188 - RNA, 64 nt, hsa
uauaaccaaaugaaauauauuuaaaauauauugaauauuuuauauuguuauauccugacaagau

SEQ ID NO: 712189 - RNA, 64 nt, hsa
auauuuuauauuguuauauccugacaagauuauaauauuuuaauguacuaauauuucuguaauu

SEQ ID NO: 712190 - RNA, 64 nt, hsa
uaaaggugaaauugcauacacagauauguaguacauauuuuaaaaguuuuaucuuaaauugauu

SEQ ID NO: 712191 - RNA, 64 nt, hsa
aaagacauuuuuuccccauuuuuugaaauagagaauauuuuauuauuuuugugaaaauagaguu

SEQ ID NO: 712192 - RNA, 64 nt, hsa
gcacacuuuuggcucuuuuugguauauguucuuuauauuuuaaugugaguauauacacuaagaa

SEQ ID NO: 712193 - RNA, 64 nt, hsa
gauguaaauguugaugaaaaugcaauugggguuaauauuuuaagaauucuuuaguauauucuug

SEQ ID NO: 712194 - RNA, 64 nt, hsa
uuauuugcauauuuguaaaaacuguuaggucuuuauauuuuaaaguguaauaccaguuuuguua

SEQ ID NO: 712195 - RNA, 64 nt, hsa
agcuauagaguugggaaaaaauauuuccacuuagauauuuuacaugguuuuguuuaaaauuacc

SEQ ID NO: 712196 - RNA, 64 nt, hsa
uuucaaccuguaaucaacauaaaauuuuaaugagauauuuuauauuauuuuuugguacugaauc

SEQ ID NO: 712197 - RNA, 64 nt, hsa
ugugagccccauauacaauuuuuacauuucuaauauauuuuaaacaagugaaguuaauaugcau

SEQ ID NO: 712198 - RNA, 64 nt, hsa
acccugauuuuaauugugaaauuauaugauucauauauuuuaugaaucagaauaaccuucaaau

SEQ ID NO: 712199 - RNA, 64 nt, hsa
uuggugguuuuauucuaucgguauaaaggcauugauauuuuagaugcacccguguuuguaaaaa

SEQ ID NO: 712200 - RNA, 64 nt, hsa
aguauugcuaugucuuuaaaaaauuuuuuuuauuauauuuuauuuuuuugagacagggucuuga

SEQ ID NO: 712201 - RNA, 64 nt, hsa
acugaauagaaaacuuugagaauaauauauauauauauuuuaaauguuuucacugacucauuga

SEQ ID NO: 712202 - RNA, 64 nt, hsa
cuguaaugugcaauaugcuuugcaacuguagaugauauuuuauguuuaaucuguaaauaagaaa

SEQ ID NO: 712203 - RNA, 64 nt, hsa
cagagcaagacucugucucaaaaaaaaaaauacaauauuuuaacaaugugcccucuuaagugug

SEQ ID NO: 712204 - RNA, 64 nt, hsa
acuugguguuuauguugcaaucugguugugauuuauauuuuaaagcuuggugcuaaaccacaau

SEQ ID NO: 712205 - RNA, 64 nt, hsa
uugucccacuguuguuuucauugaguuuggauuuauauuuuaaauguucgaaugaaaguaugau

SEQ ID NO: 712206 - RNA, 64 nt, hsa
guaaaagggagugaauugguuuaaaaauauauguauauuuuaaacuuuguuguguguaggaaac

SEQ ID NO: 712207 - RNA, 64 nt, hsa
uucuguuuuuuuuucuuugugagcacuggcuucuauauuuuauuucauauuuaugaauuauaaa

SEQ ID NO: 712208 - RNA, 64 nt, hsa
aaaaucuuaaauaauguacuguuuagaaauauacauauuuuauacaaaauuauaaagaaagcau

SEQ ID NO: 712209 - RNA, 64 nt, hsa
aauuuuuuuucaugcuuuaucaauagcccaggauauauuuuauuuuuagaauuuugugaaacag

SEQ ID NO: 712210 - RNA, 64 nt, hsa
cuucaucaaugagugugauccaguuuuucauaagauauuuuauuuugaaauggaaauuaauguc

SEQ ID NO: 712211 - RNA, 64 nt, hsa
uccaauuuuccuucagauauuuuuaauauuaaauauauuuuagugacagagugccaacuucuuu

SEQ ID NO: 712212 - RNA, 64 nt, hsa
gagaugaaugugccaagcaaaaccacaacuguguauauuuuaaagcacaucauggcuuuaagua

SEQ ID NO: 712213 - RNA, 64 nt, hsa
cacaugaauauucguauuguuaacuaaaugauuuauauuuuacugauuuaauauuacaguguaa

SEQ ID NO: 712214 - RNA, 64 nt, hsa
uugccaagucuucuguaaagaugucuaggacgaaauauuuuaugugcuaaugcauguauuugua

SEQ ID NO: 712215 - RNA, 64 nt, hsa
uuuuacaucuuugauauaaagcacugccauauuuauauuuuaaaaggaaauuagacauuuuaua

SEQ ID NO: 712216 - RNA, 64 nt, hsa
cuuuccauguuuuaaauguaugauuauauagcacauauuuuauuaguuguuuaauaagagguaa

SEQ ID NO: 712217 - RNA, 64 nt, hsa
cuguauuucuuuucuacacauugauggacuuuuaauauuuuauucucauuuaauauaaaccuca

SEQ ID NO: 712218 - RNA, 64 nt, hsa
auguuuuggguauggcuuuggaauaaaucauuuuauauuuuauuugaauaucagaaccauuuuu

SEQ ID NO: 712219 - RNA, 64 nt, hsa
acaaauuacagaauagcuaaauaauuuuuuaaaaauauuuuacaguuguaaaaaauauccauca

SEQ ID NO: 712220 - RNA, 64 nt, hsa
uuuuaauuauucauucauggcaauuuaaaaagucauauuuuaagugggauuuguuuuuccugaa

SEQ ID NO: 712221 - RNA, 64 nt, hsa
aaaguuuuuuuuuaaugacugugcuaaagaaaugauauuuuauugcuuugauuucucccaaaga

SEQ ID NO: 712222 - RNA, 64 nt, hsa
cucuuuguuuuguacaguucuguuagauguuguuauauuuuaaaaguuuaauuuaaaaaauuua

SEQ ID NO: 712223 - RNA, 64 nt, hsa
gagaggcaaaccaguccuacccaauuugauuugaauauuuuaaauuauggaacugcuaaauaga

SEQ ID NO: 712224 - RNA, 64 nt, hsa
augagaucuagagaacacgucuucuaaaaggggcauauuuuauauuagugaagagguauuacug

SEQ ID NO: 712225 - RNA, 64 nt, hsa
uaaaaauaaaugguuaaaagguuuuauguuauguauauuuuaccacaauaaaugcaaaaaauaa

SEQ ID NO: 712226 - RNA, 64 nt, hsa
auaaaaaugguuaaaaugguaaauuuuguuauguauauuuuaucauaauuuaaaaaauauaucu

SEQ ID NO: 712227 - RNA, 64 nt, hsa
cagaaucuggccaauuuaaguuuguauuuuaaaaauauuuuaugcauguuaaguauggucgcag

SEQ ID NO: 712228 - RNA, 64 nt, hsa
ugguguuugccuaauuuauaccgguuuucacuguauauuuuaaugaacuuugauugguuacuuu

SEQ ID NO: 712229 - RNA, 64 nt, hsa
ucucuuuagagcauuuuuaaugcaacuagccccuauauuuuaauguaagaguuacucugcaauc

SEQ ID NO: 712230 - RNA, 64 nt, hsa
uagcauuuauauauuuguguauggaaaacacuugauauuuuaucccuguugcaucuggcugcac

SEQ ID NO: 712231 - RNA, 64 nt, hsa
uagguaaacaccuucagcuuaaauuuuucguuaaauauuuuaguuuauuuuauuguuaucuucc

SEQ ID NO: 712232 - RNA, 64 nt, hsa
aaauaggucauuaacuugaaacucuuaucaaaauauauuuuaccaguuuccagaauuuccagua

SEQ ID NO: 712233 - RNA, 64 nt, hsa
ccccagucuugaugguauauugaacagacugaauauauuuuaccauuacagggcuaaaaggagu

SEQ ID NO: 712234 - RNA, 64 nt, hsa
guuuucaaguguuuuauaauuaaaucauaauagcauauuuuaaaaucaaucuuccuaaaagguc

SEQ ID NO: 712235 - RNA, 64 nt, hsa
aaaucaaucuuccuaaaaggucugcuuuuauuguauauuuuauuuaacaauaggcacuggguuu

SEQ ID NO: 712236 - RNA, 64 nt, hsa
aacaauaggcacuggguuuguguuacauauuuauauauuuuauuuuauuuuuauaauauagaca

SEQ ID NO: 712237 - RNA, 64 nt, hsa
uuuuuucuaggacuuugguuacuauacauauuguauauuuuaagaauucuuuauacaauuuuaa

SEQ ID NO: 712238 - RNA, 64 nt, hsa
guauuuuuuuuaauauuauauggaccaucugauuauauuuuauuuauucaucuauuuaugguau

SEQ ID NO: 712239 - RNA, 64 nt, hsa
cacuugugcauauacauaguacuuugaauaauguauauuuuaaauuggaccucacaaaucuugu

SEQ ID NO: 712240 - RNA, 64 nt, hsa
ugggaguuuuuuuaagguuuaauaacuaaggggaauauuuuaaaauuaagagagcagcaaauga

SEQ ID NO: 712241 - RNA, 64 nt, hsa
uauuaggaguaccauaauucugguagcuaaauauauauuuuagauagaugaagaagcuagaaaa

SEQ ID NO: 712242 - RNA, 64 nt, hsa
acacuguuaucuucacuuuuauaagaaauaggaaauauuuuaauguuucuuggggaauauguua

SEQ ID NO: 712243 - RNA, 64 nt, hsa
gguaaaauuuugaagacauuguuaacauuaaaaaauauuuuaaaguugucuacaaaucugagcc

SEQ ID NO: 712244 - RNA, 64 nt, hsa
uagcuauagguucuucucucccuaagaacauuagauauuuuaguuuuccagaacaaaagcuuua

SEQ ID NO: 712245 - RNA, 64 nt, hsa
aaguuucagcaggcagcuuuaucucaaccuggacauauuuuaagauucagcauuugaaagauuu

SEQ ID NO: 712246 - RNA, 64 nt, hsa
cuuacauaaacauacuuaaaagguuuucuuuaagauauuuuauuuuuccauuuaaagguggaca

SEQ ID NO: 712247 - RNA, 64 nt, hsa
uagcagcaaugcagauuuggugaauauuuaauauauauuuuaguauguauuucacuuuaugacu

SEQ ID NO: 712248 - RNA, 64 nt, hsa
acuuuuaaagacaaacauaacuauuuagcagagaauauuuuaauaaaugcaaaacaacagcugg

SEQ ID NO: 712249 - RNA, 64 nt, hsa
aagcugggcaaugccuauuuuauuucuuuguuggauauuuuaguucauacaaagcagaguacuu

SEQ ID NO: 712250 - RNA, 64 nt, hsa
aaugcuauauguauuguauacuuguauuuucaggauauuuuauuuuuuuugccauacagauaaa

SEQ ID NO: 712251 - RNA, 64 nt, hsa
aucuuuauuuucuuuaacauguaauaaagcucacauauuuuacauuacuaaaaauggauuugaa

SEQ ID NO: 712252 - RNA, 64 nt, hsa
cauccguuauaucuaauuuuguauauguuuaaaaauauuuuauuguaacuuugacaaauaaauu

SEQ ID NO: 712253 - RNA, 64 nt, hsa
ucuuaaauaucauagagcacugugauucauuuuuauauuuuauugcuuugaaugcucaaacuau

SEQ ID NO: 712254 - RNA, 64 nt, hsa
acuaauuuggcucuuucugcucacuaaaaaucauauauuuuacagauuuauuuuguuucuggag

SEQ ID NO: 712255 - RNA, 64 nt, hsa
uuucauuuuaaacauccuaaauuuauauuuuauuauauuuuauacauuucaauugauuguacua

SEQ ID NO: 712256 - RNA, 64 nt, hsa
ucauguuucauuucauuuuaaacauccuaaauuuauauuuuauuauauuuuauacauuucaauu

SEQ ID NO: 712257 - RNA, 64 nt, hsa
ucagaaaaacauuagaauguaaucgugaauuugcauauuuuagauuguagaaaaguaaauauaa

SEQ ID NO: 712258 - RNA, 64 nt, hsa
uuauuuguuacuaaagcuauauuucugauaaaaaauauuuuaggauaauugccuacagagggau

SEQ ID NO: 712259 - RNA, 64 nt, hsa
cauuugcauucaauuuacagguaccaguacguacauauuuuaauagaaagauacaaccuuuuua

SEQ ID NO: 712260 - RNA, 64 nt, hsa
agugucucuucaagguuuuacuugauuuaauuugauauuuuacugguuuaccaguaagguguau

SEQ ID NO: 712261 - RNA, 64 nt, hsa
aagaggcaugaacuuguccuaacaaugucaaagaauauuuuaaagguauaccaguuaaaguagu

SEQ ID NO: 712262 - RNA, 64 nt, hsa
uuuucucucucucucuuuuuuuuuuuuacuuuacauauuuuauacaaugucauucauaacuaug

SEQ ID NO: 712263 - RNA, 64 nt, hsa
uuuguaauuauuuucuuuauuguugguaaacuccauauuuuaaaaauuuaccuguauacauagu

SEQ ID NO: 712264 - RNA, 51 nt, hsa
aaaagaaaauggagaaaugaaauauuuuaugaaagaaaauaauaacaauua

SEQ ID NO: 712265 - RNA, 64 nt, hsa
gucaugcauuauccaaaaacaauaccaaaaagacauauuuuauaaaaugacaaaaaauauuuua

SEQ ID NO: 712266 - RNA, 64 nt, hsa
uaccaaaaagacauauuuuauaaaaugacaaaaaauauuuuacauaauuacucauuuuuguuga

SEQ ID NO: 712267 - RNA, 64 nt, hsa
uuugugaauuugucaacuuucgagcaucaaacaaauauuuuacuuaaauuuuauuuuaucuuau

SEQ ID NO: 712268 - RNA, 64 nt, hsa
agaucuaccauuaauagaaaauaaacuaaaccuuauauuuuauuuuugccaaaauauuuuauua

SEQ ID NO: 712269 - RNA, 64 nt, hsa
aauaaacuaaaccuuauauuuuauuuuugccaaaauauuuuauuauaaaauaugaccaaaauau

SEQ ID NO: 712270 - RNA, 64 nt, hsa
uuauuagaacaaaagguguuuaaggaugaacuaaauauuuuaauugagcauuuauauggauaau

SEQ ID NO: 712271 - RNA, 64 nt, hsa
uguaagcccauauguauuuacauccagagucauaauauuuuaaauaaacaaucaugcagaaacu

SEQ ID NO: 712272 - RNA, 64 nt, hsa
ucucuuucagcuauuuuauuuaauauugugucagauauuuuacaagguaugaccuaauuaaaaa

SEQ ID NO: 712273 - RNA, 64 nt, hsa
uaugaaaaugccaguaacguuuauuuaaaacaaaauauuuuaauuuuuaaauuuucccuuaaaa

SEQ ID NO: 712274 - RNA, 64 nt, hsa
cccugacauuaaaugcugaggcuuuaauacacacauauuuuaucccaaguuuauaauggugguc

SEQ ID NO: 712275 - RNA, 64 nt, hsa
ggaaaaaggauguguaaugguguacacagucuguauauuuuaauaaugcagagcuauagucuca

SEQ ID NO: 712276 - RNA, 64 nt, hsa
cuuuguuauagaugguauccuuuaccccuucuuaauauuuuacagcaguacguuuuuuuguaac

SEQ ID NO: 712277 - RNA, 64 nt, hsa
caggaugugugcuucaguugcucuguguauuuugauauuuuaauuuagagguuuuguuugcuuu

SEQ ID NO: 712278 - RNA, 64 nt, hsa
aaaaguacugaaaaaugcuuuuuaguacuuuuucauauuuuauacauuuauuuuccgaauguau

SEQ ID NO: 712279 - RNA, 64 nt, hsa
ccauuuauacccuguaaagccguuuuagaauguaauauuuuagguaauccaaaauguacuaaau

SEQ ID NO: 712280 - RNA, 64 nt, hsa
aaagaaaauccaaauaaagcccaccuagaaauagauauuuuauuauauaugugcuauagauaua

SEQ ID NO: 712281 - RNA, 64 nt, hsa
cuuuuucuuuugaaaauauauauucacaauuuuaauauuuuaauuuauuuuuuacuauuuaacc

SEQ ID NO: 712282 - RNA, 64 nt, hsa
uaugcaaaaguuuaauuuuuauauaugucauacuauauuuuaaauaguuaaaaaagacaaaaga

SEQ ID NO: 712283 - RNA, 64 nt, hsa
ccacuuccccaccacugaaauaucuuauuucacaauauuuuaacugauuuuuaauccaaaacua

SEQ ID NO: 712284 - RNA, 64 nt, hsa
agcuuuuauuuccuggauaguaacuggucaggauauauuuuaaugauauuugaaacuaaucuua

SEQ ID NO: 712285 - RNA, 64 nt, hsa
cauuauucuacaaaugcauucuguugagcacuaaauauuuuaguugguuuuauguuaacauugu

SEQ ID NO: 712286 - RNA, 64 nt, hsa
uaguugcucuccuuuuuucuuuuuuuugucgugcauauuuuauuucuguaguuucugguuagcu

SEQ ID NO: 712287 - RNA, 64 nt, hsa
aaccauuuaagacuacuuuucuuauagguaguugauauuuuaaaaacuuuagauuuaaugucua

SEQ ID NO: 712288 - RNA, 64 nt, hsa
agcuuucugaaagauugggcuuuaaaauaaaauaauauuuuaauauugaaccauuuuuuaacuu

SEQ ID NO: 712289 - RNA, 64 nt, hsa
guuugucuguaaugaaugguuaaaaauaaggguuauauuuuacccucaaaugcguuuuuguacu

SEQ ID NO: 712290 - RNA, 64 nt, hsa
ccaccgugccuggccuauuuuauuauauuguaauauauuuuauuauauuagccaccaugccugu

SEQ ID NO: 712291 - RNA, 64 nt, hsa
ccaccaugccuguccuauuuucuuauguuuuaauauauuuuaauauauuacaugugcaguaauu

SEQ ID NO: 712292 - RNA, 64 nt, hsa
uggagcagacagaaaagauauagcaaaugaagaaauauuuuaaggaaaccuauuugaaaaaaaa

SEQ ID NO: 712293 - RNA, 64 nt, hsa
uggauguuuuugaaguaucuaaaauaguagcagaauauuuuauacuugguccuugcaauggugu

SEQ ID NO: 712294 - RNA, 64 nt, hsa
uuucuuuuuuguuauuuuaucuugaaaacgguacauauuuuaguauuugugcagaaaaacaagu

SEQ ID NO: 712295 - RNA, 64 nt, hsa
uuuugaaaagaugaaccaaaggauuugacugcuaauauuuuauuccuuacacuuuuuuucugaa

SEQ ID NO: 712296 - RNA, 64 nt, hsa
cauauuaauuuacuugaauuugucauaaagcuaaauauuuuauauguuuucaaagauuauuuuu

SEQ ID NO: 712297 - RNA, 64 nt, hsa
auuaacuagucauaacuguuuauacaccacucucauauuuuagugaucaauaugaagacagcua

SEQ ID NO: 712298 - RNA, 64 nt, hsa
guuucacccaaaugccugagacugcuugaaagauauauuuuaaguggugcacuaauuagugaau

SEQ ID NO: 712299 - RNA, 64 nt, hsa
uugaauaggauaaauuuucagagggcugccuaaaauauuuuauuucuagcauccugauucugga

SEQ ID NO: 712300 - RNA, 64 nt, hsa
auguguuugucucuuaaagcauuggugaaaucacauauuuuauauucagcauaaaggagaauaa

SEQ ID NO: 712301 - RNA, 64 nt, hsa
uguuuaguguuucugcuuuacagugcugaauuccauauuuuagaagcuaugaaaguccuuuuau

SEQ ID NO: 712302 - RNA, 64 nt, hsa
uuaaguuuagcacuguaucagaaugaagaaacuaauauuuuacauaaaaacuaauacuuucaau

SEQ ID NO: 712303 - RNA, 64 nt, hsa
ucagucuaauuguuuugacuguuauagaaaccaaauauuuuacuguuucuuuuaaggacuaaua

SEQ ID NO: 712304 - RNA, 64 nt, hsa
guaaaauacauccuuuaaauauauaucuaagcauauauuuuaaaaggagcaaaaauaaaaccaa

SEQ ID NO: 712305 - RNA, 64 nt, hsa
aaaaccaaaguguuaguaaauuuugauuuauuagauauuuuagaaaaauaauagaauucugaag

SEQ ID NO: 712306 - RNA, 64 nt, hsa
aaucuauuuuuacugaauaaaguaauuauggaaaauauuuuaaacucuagaagcuucaauaaug

SEQ ID NO: 712307 - RNA, 64 nt, hsa
ugccauaccaaggucauaauuccuuccgugagaaauauuuuagugggguaacaaaaagaauugc

SEQ ID NO: 712308 - RNA, 64 nt, hsa
cauguaugauccagaaaauagguacgguuuuaaaauauuuuauauagaaaagcuacaaaguaaa

SEQ ID NO: 712309 - RNA, 64 nt, hsa
ucuuuuuuugguuuuaaagguuuuuguuaauguaauauuuuaauagcaaagauaucaugacucu

SEQ ID NO: 712310 - RNA, 64 nt, hsa
gggucaggcauuuuauaucaagggugcucugaacauauuuuauuuuuuaaaaaaacuauguuug

SEQ ID NO: 712311 - RNA, 64 nt, hsa
uuccucaugucuuugagauuugaucaguuugugaauauuuuaugcuuugaugauauagugagaa

SEQ ID NO: 712312 - RNA, 64 nt, hsa
uucuugggaaauuuauuuucuacgcuauucaaagauauuuuaaauaauauuuuaaaaacaugaa

SEQ ID NO: 712313 - RNA, 64 nt, hsa
uuauuuucuacgcuauucaaagauauuuuaaauaauauuuuaaaaacaugaaauuuuuuuuuca

SEQ ID NO: 712314 - RNA, 64 nt, hsa
uauguuauauucaauaucuuuucagaugcagucuauauuuuaugcugaguuuuaaaaaugaaau

SEQ ID NO: 712315 - RNA, 64 nt, hsa
aguuuuuaaaauaaugcuacaaucuucauaacuaauauuuuaauggggagugacugcuuaauug

SEQ ID NO: 712316 - RNA, 64 nt, hsa
cugggauuacaggcuugagccaccgcgcccggcuauauuuuaucuuuuaucuuuuucuuugaca

SEQ ID NO: 712317 - RNA, 64 nt, hsa
uagccuuauaaaaaagguuguaaaauguacauuuauauuuuaucuuuuuuuuuuuuuuuuuucu

SEQ ID NO: 712318 - RNA, 64 nt, hsa
aucuauuuuuguagauauuuuauauaaaaaugaaauauuuuaacauuuuaugggucagucaacu

SEQ ID NO: 712319 - RNA, 64 nt, hsa
gucugguuuuuguaaauguuaucuauuuuuguagauauuuuauauaaaaaugaaauauuuuaac

SEQ ID NO: 712320 - RNA, 64 nt, hsa
uucuguaauauuuacaauguauuaagcccacaguauauuuuauuucaauguaauuaaacuguua

SEQ ID NO: 712321 - RNA, 64 nt, hsa
uagauuucucacacucuaacuguauauuuguaugauauuuuaaaaucuccuaaaugcugggcaa

SEQ ID NO: 712322 - RNA, 64 nt, hsa
uuuuugguuuuaaaucacuguacaguguuauuugauauuuuaauuuauuuuuugauugacuaga

SEQ ID NO: 712323 - RNA, 64 nt, hsa
ugacauuaggaaauuuaggauaaauaguugacauauauuuuauauccucuucuguugaaugcag

SEQ ID NO: 712324 - RNA, 64 nt, hsa
uauucuauauugcaaugauuuuuuuagcauuuuaauauuuuaauauauauuguaaaauuuagac

SEQ ID NO: 712325 - RNA, 64 nt, hsa
gcugguguguucuuuugcauguaaacugccauuuauauuuuagaaaacuauuguauagaaugga

SEQ ID NO: 712326 - RNA, 64 nt, hsa
gccaauaguggcugaguuucgcacuugauuuucaauauuuuauaguaagaaaugacaaacugcu

SEQ ID NO: 712327 - RNA, 64 nt, hsa
caguaguaaaccuguuuuagauaucauacuguuaauauuuuauugaaaauuuauuucagagcgg

SEQ ID NO: 712328 - RNA, 64 nt, hsa
uuuuauuuauuucuguaagauauccauuaaauaaauauuuuaguggaaaugaaaauuguggaau

SEQ ID NO: 712329 - RNA, 64 nt, hsa
cuuuagcacaugauucaccaauaucuuguuaguaauauuuuaaguagauggugaauuauauuaa

SEQ ID NO: 712330 - RNA, 64 nt, hsa
cacauuuuuuucuaccuauaacacucuaggauguauauuuuauauaaaguauucuuuuucuuuu

SEQ ID NO: 712331 - RNA, 64 nt, hsa
uuuccuaaauccaaccauuuucauuaauucaggcauauuuuaacuccacugcuuaccuacuuuc

SEQ ID NO: 712332 - RNA, 64 nt, hsa
acauaggaggcaaugugugagacuuggggguucaauauuuuauauagaagaguuaauaagcaca

SEQ ID NO: 712333 - RNA, 64 nt, hsa
caaauguauuuuuucuugugcauauuauaaaaauauauuuuaugagcucuuacucaaauaaaua

SEQ ID NO: 712334 - RNA, 64 nt, hsa
uagcugaauauaucuuuauacauauguaaagccaauauuuuagaauaaguauuuuaguauaaau

SEQ ID NO: 712335 - RNA, 64 nt, hsa
aagccaauauuuuagaauaaguauuuuaguauaaauauuuuaguaaaauacuauaaaaauaaaa

SEQ ID NO: 712336 - RNA, 64 nt, hsa
acauaccaagacccccgucucuuuaaaaauauauauauuuuaaauauacuuaaauauauauuuc

SEQ ID NO: 712337 - RNA, 64 nt, hsa
aauauauauuucuaauaucuuuaaauauauauauauauuuuaaagaccaauuuaugggagaauu

SEQ ID NO: 712338 - RNA, 64 nt, hsa
guuuaugguuaaaaguuuuugaagugucucaaaaauauuuuacuaacuguaacccuaaaauuga

SEQ ID NO: 712339 - RNA, 64 nt, hsa
auuugaguagaaaaucacuuaccagugagcauauauauuuuaaaauacuuucuuuggauauugu

SEQ ID NO: 712340 - RNA, 64 nt, hsa
ucaauuuguggauuugauauccuggauauuuauuauauuuuauguaaugcugcauuucuauuug

SEQ ID NO: 712341 - RNA, 64 nt, hsa
ucuuguuuuuaauauucaugcauguauauucaucauauuuuacaagguuccugguaaaaauuac

SEQ ID NO: 712342 - RNA, 64 nt, hsa
gagauauaucuauuuucaauucaacuacagaaauauauuuuauuggccgggugcgguggcucau

SEQ ID NO: 712343 - RNA, 64 nt, hsa
uccgucucaaaaacaaaaaaaaaagaaaagaaauauauuuuauucauucacauuaggucacugu

SEQ ID NO: 712344 - RNA, 64 nt, hsa
agugguuagguuuggaaaagagaugaugaugguaauauuuuauuugugcuuuuuaagccauuuc

SEQ ID NO: 712345 - RNA, 64 nt, hsa
uguugaauguucuauaucuuauuaguuaauuuguauauuuuauuaguauuuuggaaauagcaua

SEQ ID NO: 712346 - RNA, 64 nt, hsa
aauaugaaauacauguuguagauauguaaaaugaauauuuuagucuccuuauuacauauauguu

SEQ ID NO: 712347 - RNA, 64 nt, hsa
agacuguugauacuauaaacaucagugaaucauuauauuuuaaaacagaaaagggcuucucaga

SEQ ID NO: 712348 - RNA, 64 nt, hsa
uuuaaaugcaugaaauguaauugauuuauuuguaauauuuuaaaugguauaauaaacucagaua

SEQ ID NO: 712349 - RNA, 64 nt, hsa
ucgcugcagcagcuuucuuucaucuuuauagcauauauuuuauuuuuaaaaaaacuagggggaa

SEQ ID NO: 712350 - RNA, 64 nt, hsa
gagagcuaauuuuuuucaaaggugauuguaagucauauuuuauauagcauuuugcuugauuauu

SEQ ID NO: 712351 - RNA, 64 nt, hsa
uuauaaagauucuaaacauguaucugagcugguaauauuuuaaaaucuccauuauuuguguaaa

SEQ ID NO: 712352 - RNA, 64 nt, hsa
augauguauuagaaauauuuuacucagacuuuaaauauuuuaaaucucagauugguuauucaga

SEQ ID NO: 712353 - RNA, 64 nt, hsa
gucucaaaacuguucuguucaugauguauuagaaauauuuuacucagacuuuaaauauuuuaaa

SEQ ID NO: 712354 - RNA, 64 nt, hsa
aaaaaugugaaaaaaauuauucaugcucucauauauauuuuaaaaacacuacuuuugcuuuuuu

SEQ ID NO: 712355 - RNA, 64 nt, hsa
ucagauaucauacugauuuuuaagucaacacuauauauuuuaugaucuuuucagugugauggca

SEQ ID NO: 712356 - RNA, 64 nt, hsa
aagucugccuguuuaguaaguggcaauuccauacauauuuuagaguuuuuucuaucuaaaauua

SEQ ID NO: 712357 - RNA, 64 nt, hsa
uugcaauuucauuguaaaaugaacaaauacauaaauauuuuaagaaaaauuuaaguuuauucag

SEQ ID NO: 712358 - RNA, 64 nt, hsa
aggaucauacacaugacuuauaccucucauuuaaauauuuuauaguauaaaguauuuauggaaa

SEQ ID NO: 712359 - RNA, 64 nt, hsa
augcuuaauaaauacuuuaauaagauaugggaaaauauuuuaauaaaacaaggaaaacauaaug

SEQ ID NO: 712360 - RNA, 64 nt, hsa
acuguucuaagaagcaggcaguugauguauguuuauauuuuaagucagcugucaaggggagacc

SEQ ID NO: 712361 - RNA, 64 nt, hsa
uguugauuugguauaaaguuuuuccaauucauuuauauuuuacaaaugcuagauauuggucugg

SEQ ID NO: 712362 - RNA, 64 nt, hsa
uaaaaguacaauguuuagacugcuaugguaauacauauuuuaaauucuaaaagcauacacaaug

SEQ ID NO: 712363 - RNA, 64 nt, hsa
augggagagcuauaaauggcagagcuauguguaaauauuuuaagagcaugcagccaucuuggug

SEQ ID NO: 712364 - RNA, 64 nt, hsa
guuuuuguguaucaauauuuuguacuuuuagggaauauuuuauuuuuuaguuauuugugucaaa

SEQ ID NO: 712365 - RNA, 64 nt, hsa
uaauguuaauaugaagguaauaaauagcuuacugauauuuuauggaugcagacaauccaugcac

SEQ ID NO: 712366 - RNA, 64 nt, hsa
aguuaucaauauuuuaagaucauucuguauauacauauuuuaaauuaugcaagcaaacuaggag

SEQ ID NO: 712367 - RNA, 64 nt, hsa
aucuucagggcugugaauuccauacuaguuaucaauauuuuaagaucauucuguauauacauau

SEQ ID NO: 712368 - RNA, 64 nt, hsa
caaggggagggagcagaagcacuuauguuuacggauauuuuaaacucuguuagagagcagccuu

SEQ ID NO: 712369 - RNA, 64 nt, hsa
cugagggcuggggguugggggagucagcaugauuauauuuuaauguagaaaaugugacaucugg

SEQ ID NO: 712370 - RNA, 64 nt, hsa
uuuacauauccaauuccaguaacucucaaauucaauauuuuauucaaacucuguugaggcauuu

SEQ ID NO: 712371 - RNA, 64 nt, hsa
gcacaacaaaaaaauauccugggcaauaaaaaaaauauuuuaaaccagcuuuggagccacuuuu

SEQ ID NO: 712372 - RNA, 64 nt, hsa
gugucccuggauauggaauaagcagguauaaaaaauauuuuaauuauaguuuuguuauaaauau

SEQ ID NO: 712373 - RNA, 64 nt, hsa
uuagucauucaacaaaucccauaaguauguguuaauauuuuaauuguguaaaacucauuuguua

SEQ ID NO: 712374 - RNA, 64 nt, hsa
cauguaaguaagccauuuuuauuugccuuucuagauauuuuauuuuauuguggaaaacuguaaa

SEQ ID NO: 712375 - RNA, 64 nt, hsa
cuuagugaacauuacauuuucagaauagauccuaauauuuuauugagggccuaugugcuaaaaa

SEQ ID NO: 712376 - RNA, 64 nt, hsa
caagcaauuauguaccauauauacacuguagcaaauauuuuauauuugagagucuuuacagcuu

SEQ ID NO: 712377 - RNA, 64 nt, hsa
uccugcaaagcugaaacugauuagaaaauucuuuauauuuuaaaauagcucuuucucauuuuua

SEQ ID NO: 712378 - RNA, 64 nt, hsa
uuuauauaggucccaaauuauaauugucaaauauauauuuuaaauuaauaaaaguugucauucu

SEQ ID NO: 712379 - RNA, 64 nt, hsa
ugugaaacuaucuugaauuugcaaauauaguguuauauuuuauaaaguuuuguaaaaucccaaa

SEQ ID NO: 712380 - RNA, 64 nt, hsa
ucaaccuuuauugacuuuguuuuuacaauaaaaaauauuuuacaacuuacuuucuguucucugu

SEQ ID NO: 712381 - RNA, 64 nt, hsa
aaaauuaguacuguuuuauugagagaauuuaguuauauuuuaaaucagaaguaugggucagauc

SEQ ID NO: 712382 - RNA, 64 nt, hsa
guuuguaauuucagguuuuuuacauuuuaacaaaauauuuuaaaaguuauaaacuaaccucaga

SEQ ID NO: 712383 - RNA, 64 nt, hsa
uuuaauuugcuaaauauuuuaacaaguuuguuauauauuuuauuuaauuuaaaagaaaucucuu

SEQ ID NO: 712384 - RNA, 64 nt, hsa
cacuuauuacaaagacaaacguuuaauuugcuaaauauuuuaacaaguuuguuauauauuuuau

SEQ ID NO: 712385 - RNA, 64 nt, hsa
uaccugccuucaaaauaguuuagggaccaccaccauauuuuauuuuguuuuuauuuuugaacau

SEQ ID NO: 712386 - RNA, 64 nt, hsa
uuugaggggaggauuauugcuaugaaugaaaaaaauauuuuagcuuagacuaagcuaccugccu

SEQ ID NO: 712387 - RNA, 64 nt, hsa
gucauauauagccucaauugaguuuuuuaugacaauauuuuaacauaccucucucucuacauau

SEQ ID NO: 712388 - RNA, 64 nt, hsa
ccaguaaaaccauucaaucaauaauugguaaauaauauuuuaaaauuguuuuuaaucuguauag

SEQ ID NO: 712389 - RNA, 64 nt, hsa
ugcaaauacagcuccaaaaauauuaaauguauauauauuuuaaaaugccugaggaaauacauuu

SEQ ID NO: 712390 - RNA, 64 nt, hsa
ccagcuaaaauugugugccauuuaaaaacugaaaauauuuuaaaauuauuugucuauauucuaa

SEQ ID NO: 712391 - RNA, 64 nt, hsa
gugcacacugaauagucuaaucuacauguaacacauauuuuagugugauuuucuauacucuaau

SEQ ID NO: 712392 - RNA, 64 nt, hsa
guaccacuugauauaaaaaggauauccauaaugaauauuuuauacugcauccuuuacauuagcc

SEQ ID NO: 712393 - RNA, 64 nt, hsa
aaguguauuuauuguuacaagucuauucucuauuauauuuuauuuacucugcgguuauaaaaau

SEQ ID NO: 712394 - RNA, 64 nt, hsa
aaugcucauucuuuguagaacaaaaauguauuaaauauuuuaaaaauugcucugugauacuuaa

SEQ ID NO: 712395 - RNA, 64 nt, hsa
agagggauaacaaugcugauuacuaccuuuuaaaauauuuuagauaaaugcacagcaccacagc

SEQ ID NO: 712396 - RNA, 64 nt, hsa
uuuaagcacucuagaaacaaugaagcuucuuggcauauuuuaaggagcucccaaaauguguuac

SEQ ID NO: 712397 - RNA, 64 nt, hsa
uacuguguuucaacauaauaaauauaauagaaaaauauuuuauuuguauuguuguauaaaauau

SEQ ID NO: 712398 - RNA, 64 nt, hsa
cuauccaaaauaccuauuuuaaauuuuuaauacaauauuuuauuuuaauauaaacaucugucag

SEQ ID NO: 712399 - RNA, 64 nt, hsa
uuuucccaccuugacaccaggcaauguaguuagcauauuuuauguaccaugguuauaugauuaa

SEQ ID NO: 712400 - RNA, 64 nt, hsa
aacacagugaauuuguagaguggggguauuugacauauuuuacaggguggaguguacuauauac

SEQ ID NO: 712401 - RNA, 64 nt, hsa
aguucugaaggggaaauauaacaucuaugguuauauauuuuaaaaacuuagauuauaggcugua

SEQ ID NO: 712402 - RNA, 64 nt, hsa
aaagagaugauguagauuuuucggauggguggguauauuuuauuuuccaguuuauuuucauauu

SEQ ID NO: 712403 - RNA, 64 nt, hsa
caagcagaggcaggaagagcuagucuuagcauuuauauuuuaauaggaaguugacucccagcau

SEQ ID NO: 712404 - RNA, 64 nt, hsa
uuuuagugugauucuuuguugcagaaaugucaauauauuuuaugacaugguucccuacuaggga

SEQ ID NO: 712405 - RNA, 64 nt, hsa
uucauucaauuucagaucacugguacuuggauagauauuuuaaauauuuggaagguguucaaua

SEQ ID NO: 712406 - RNA, 64 nt, hsa
gauucuguacauuuauuugggagaaaauuuuaucauauuuuaggcuuuucuaaauauuagauaa

SEQ ID NO: 712407 - RNA, 64 nt, hsa
accuuuaaaguguguaguaaaguaucaggauacuauauuuuaggucuuaauacacacaguuaug

SEQ ID NO: 712408 - RNA, 64 nt, hsa
aucuuguuuuggugguuuuagugauuuuaauaauauauuuuaaauauuuuuucuuuucuauugu

SEQ ID NO: 712409 - RNA, 64 nt, hsa
aaaauguaacucuauauauucuauaugauuguaaauauuuuauacaacaauacaaauaaaauau

SEQ ID NO: 712410 - RNA, 64 nt, hsa
uucagaggcuuauuguuuucucuguauuuaccuaauauuuuauaacuuuuaugaaucagaauaa

SEQ ID NO: 712411 - RNA, 64 nt, hsa
ucauagucaauacaaguauuuuuaaaaaugucuaauauuuuaucaaaucuaaauaacauagcua

SEQ ID NO: 712412 - RNA, 64 nt, hsa
gcaguggagcaaauuggucauuuuuuaaaaaaauauauuuuaaccuacagucaccaguuuucau

SEQ ID NO: 712413 - RNA, 64 nt, hsa
cacuauuuuugcuauuuuauaccauauagcaacgauauuuuaacagauucucaagcaaauuuuc

SEQ ID NO: 712414 - RNA, 64 nt, hsa
augcuguggaugaaaauaacuuacuagagaauguauauuuuaugacaagaauguguaucuguug

SEQ ID NO: 712415 - RNA, 64 nt, hsa
ucauuuguguucucuuaaaauagaguuugaacaaauauuuuaaaggugcaaaauaccauuagaa

SEQ ID NO: 712416 - RNA, 64 nt, hsa
ccaucuuagaucggagugugaaguaaauuaugguauauuuuauguaacauuuuaauguuuaugc

SEQ ID NO: 712417 - RNA, 64 nt, hsa
uuauagaaacaaguaauagcaagaaaauugauguauauuuuaaugauacauuaaaauucccuuu

SEQ ID NO: 712418 - RNA, 64 nt, hsa
agucauuucuaauuuaguugucaaaaacauauacauauuuuaacauuaguuuuuuugaaaacuc

SEQ ID NO: 712419 - RNA, 64 nt, hsa
caaauaaaaugaaauaugaguuucaauacuuuuuauauuuuaauauuuccauucauuaauauua

SEQ ID NO: 712420 - RNA, 64 nt, hsa
uccguaaauuucauuugcagugguuagucaucagauauuuuagccaccuacacaaaagcaaacu

SEQ ID NO: 712421 - RNA, 64 nt, hsa
agaaaauugaacaaauguaauggaucaauuuaaaauauuuuauuucuuaaaagccuuuuuugcc

SEQ ID NO: 712422 - RNA, 64 nt, hsa
uaaucuuguuaauacuuguuauauggacccuaagauauuuuauuacagaguuuuuaauuaguga

SEQ ID NO: 712423 - RNA, 64 nt, hsa
aauuagugaaaaauucaugaauaccauagagaaaauauuuuagaauuuaauguuucuuauauuu

SEQ ID NO: 712424 - RNA, 64 nt, hsa
cuuccuugccuaugcccuugccuucuaguuccaaauauuuuagccagcuucacuguggcaauag

SEQ ID NO: 712425 - RNA, 64 nt, hsa
uaacucaggugugauuuuugaaaaugucucuguaauauuuuaucuucuuuaaaaaaaagggggg

SEQ ID NO: 712426 - RNA, 64 nt, hsa
aauuuauguauacaagaaauuguaggcauuaaaaauauuuuauugauauuuuugcugguuugca

SEQ ID NO: 712427 - RNA, 64 nt, hsa
aucuaaaaaaauucauuuuuauaucgaagaaaaaauauuuuauucaaacauuagauuugaaaga

SEQ ID NO: 712428 - RNA, 64 nt, hsa
ccugguguagacuuaaaaaacuacauguuugugaauauuuuauaauguggaaugaucauugaaa

SEQ ID NO: 712429 - RNA, 64 nt, hsa
auucauuuuuauuuaaaugcacaguauuuccccuauauuuuaguccuuccauuccuagagacaa

SEQ ID NO: 712430 - RNA, 64 nt, hsa
gaagacaugggccaucccuccgcuuuagggaagcauauuuuaaaccuaaacguugaacuucuuc

SEQ ID NO: 712431 - RNA, 64 nt, hsa
caggauacuacagguggccugcugaggcugccccauauuuuagaaaauguaaaaauggugguuu

SEQ ID NO: 712432 - RNA, 64 nt, hsa
guuuaaauaguuguacagauaguuuauaagcacaauauuuuaagaaaaaaaaguggcuggucua

SEQ ID NO: 712433 - RNA, 64 nt, hsa
auuguuacauaguuaaaugugcuauauauccuuaauauuuuauauugauccugcaaaaucuguu

SEQ ID NO: 712434 - RNA, 64 nt, hsa
uguggaaugucaaugccaggauuucucauuaacaauauuuuaucucaacuuugguuccugugau

SEQ ID NO: 712435 - RNA, 64 nt, hsa
gaaaugacauuuuuauacuaaaacaaacaccaaaauauuuuagaauaaauucuuagaaaguuuu

SEQ ID NO: 712436 - RNA, 64 nt, hsa
uuaguucauuuaauuuuaauuuuauauuuugugaauauuuuaagaacuguagagcugcuuucaa

SEQ ID NO: 712437 - RNA, 64 nt, hsa
cucugcaaaacuguuuacauauuuauugguuuacauauuuuauugguuuauuucuauccccugu

SEQ ID NO: 712438 - RNA, 64 nt, hsa
ggaugagauccaagucuaaacacaaaauucauuuauauuuuauauauaccuuguucacauaccc

SEQ ID NO: 712439 - RNA, 64 nt, hsa
auugguuggcagugccagcuggcucuuuuuuuuaauauuuuauuauuuuuguuaacuuuauuau

SEQ ID NO: 712440 - RNA, 64 nt, hsa
ucucucuaagaauuaaauaaucuuuucuagcuuaauauuuuaauucuaauucaaacaacucuga

SEQ ID NO: 712441 - RNA, 64 nt, hsa
ccugcauauuuuuauguaaaucucuaaauuuaaaauauuuuaaguacauuuauuuuugguguuu

SEQ ID NO: 712442 - RNA, 64 nt, hsa
ucugguauuuaggcuggcaauauauauauuaaccauauuuuaaaaguaccaauuuuguuuuuac

SEQ ID NO: 712443 - RNA, 64 nt, hsa
cauauauguuucccuuuucauuagcugaaugaggauauuuuaagaaguugaaagagaauuuauu

SEQ ID NO: 712444 - RNA, 64 nt, hsa
ucuccaaacguugcuuagaugcuucaaaauuagcauauuuuaaguuuaccaguauaaaauacca

SEQ ID NO: 712445 - RNA, 64 nt, hsa
agcacuucauucaauuaaaauacaugaauuuuaaauauuuuacaugaugugaauaggcaugaua

SEQ ID NO: 712446 - RNA, 64 nt, hsa
gcuuucaaaucuuuuuuuaaaaaaauaguguaaaauauuuuaauaagccaaagccauguggaau

SEQ ID NO: 712447 - RNA, 64 nt, hsa
cuuaacacaaaguauaacucuguagaguuggugaauauuuuagggaaauauuagcaaaaugcau

SEQ ID NO: 712448 - RNA, 64 nt, hsa
aagaagaaaucaucucuacaauguagacaacauuauauuuuauagaauuuguuugaaauugagg

SEQ ID NO: 712449 - RNA, 64 nt, hsa
ugaaguauuguaccagaguauuaaaagauauguaauauuuuauugauaaaucuauccuuuaaaa

SEQ ID NO: 712450 - RNA, 64 nt, hsa
uuuuguauauuuuuguaacaaaauauaaaugaagauauuuuaccaugaagagauugcacuuauc

SEQ ID NO: 712451 - RNA, 64 nt, hsa
cuuauccuugagaacagucuaaauauaaaugaagauauuuuaccaugaagagauugcacuuauc

SEQ ID NO: 712452 - RNA, 64 nt, hsa
ugaccuauauucuugcaaauuauguuaauuuuucauauuuuaguuugauuuuagacaauuauuu

SEQ ID NO: 712453 - RNA, 64 nt, hsa
aucaacaagccaacagacaagaaggagcgaaaguauauuuuauuugauggugauguggaugcuc

SEQ ID NO: 712454 - RNA, 64 nt, hsa
uuuuauuuuuucuuguuuuuggcuugauauuacuauauuuuaacugaauagccagagcaucuaa

SEQ ID NO: 712455 - RNA, 64 nt, hsa
cauauauaaaacagauguuauguaagaauguuguauauuuuaacauaaaucauuuagagaaauu

SEQ ID NO: 712456 - RNA, 64 nt, hsa
guauuucugguaauaagaagcacuuaauuuacacauauuuuaauccugugaaagauuccacaua

SEQ ID NO: 712457 - RNA, 64 nt, hsa
auagggcaugugaaauguuaaguuacagcaauagauauuuuauuuguauuucauguuaguacuu

SEQ ID NO: 712458 - RNA, 64 nt, hsa
uccacguguauguuguuuucauuugguccaaauaauauuuuauuuguauggguaucuucuaaga

SEQ ID NO: 712459 - RNA, 64 nt, hsa
uuuucaugauauuagaacaaauggguuuuugguuauauuuuauauuugucaauauaauuuuugu

SEQ ID NO: 712460 - RNA, 64 nt, hsa
cuaauacaugguuuaaagucacagccguuugaauauauuuuaucuugguaguacauuuucuccc

SEQ ID NO: 712461 - RNA, 64 nt, hsa
ccagguagaggauucaagacucaauguggaaaaaauauuuuaaacuacugauugaauguuaaug

SEQ ID NO: 712462 - RNA, 64 nt, hsa
guaaaaugcucaugaagguuuugaaugccaaaagauauuuuagaaucaauuuauaaagggguaa

SEQ ID NO: 712463 - RNA, 64 nt, hsa
agaaaaacucauucagaaaucauggauuuuaaaaauauuuuacugcagccaaguuuucauuuca

SEQ ID NO: 712464 - RNA, 64 nt, hsa
uauguuuuucugugugucaguuuucauaguauccauauuuuauuacuguuuauuacuuccauga

SEQ ID NO: 712465 - RNA, 64 nt, hsa
agucacucuuaauuaauaucuguauccuggaacaauauuuuaugguuauguuuuucuguguguc

SEQ ID NO: 712466 - RNA, 64 nt, hsa
auaaauuccaagucuuuucaccugucaggcaugcauauuuuaauaucuguuuggauagucagaa

SEQ ID NO: 712467 - RNA, 64 nt, hsa
aaaauaugaguuguuacuuuguuucuucgaugucauauuuuauguguaauauauauguaaaggg

SEQ ID NO: 712468 - RNA, 64 nt, hsa
acuguuagagcaaguauacucaaucaacuugcugauauuuuaguaguuaacagcuuccgagccu

SEQ ID NO: 712469 - RNA, 64 nt, hsa
gcuaaauacaaugacauuugcuuuuaaaagguggauauuuuauuucugcuuuuugaaaauacuu

SEQ ID NO: 712470 - RNA, 64 nt, hsa
aaaaauaguucuuuuaauucuuucaccuuaaagcauauuuuaugucucaaaaguauaaaaaacu

SEQ ID NO: 712471 - RNA, 64 nt, hsa
acacauacauauauauacuauauauggaugaaacauauuuuaauguuguuuacuuuuuuaaaua

SEQ ID NO: 712472 - RNA, 64 nt, hsa
uugaaguauuuugacuuuugagauugaauguaaaauauuuuaaauuugggaucaucgccuguuc

SEQ ID NO: 712473 - RNA, 64 nt, hsa
aauauuaugucagcuuuaacauauaauauuuugaauauuuuagcuauauuuaguggcuuucugc

SEQ ID NO: 712474 - RNA, 64 nt, hsa
uuucauaauguaaaucauauuuuuguuauuugccauauuuuauuugaagugauaaaauuuuaua

SEQ ID NO: 712475 - RNA, 64 nt, hsa
cacaaauaccaauucuuauucauacuuugaaacuauauuuuacccuagacugccuugguucaaa

SEQ ID NO: 712476 - RNA, 64 nt, hsa
uugguuauuuuauauagcauauucuuuaucuuggauauuuuaugaauaaaguauaguuauuuua

SEQ ID NO: 712477 - RNA, 64 nt, hsa
ugguaacuaguauuuacagcuaaccuaucuauucauauuuuacauauauauauauauauauaca

SEQ ID NO: 712478 - RNA, 64 nt, hsa
ugugguuuguuuuggcacuguuuuaaaaacucaaauauuuuaaacauuuguuaaguuggagcuu

SEQ ID NO: 712479 - RNA, 64 nt, hsa
aaauuagaaaaagaaaacuuuucuuuuuuauuauauauuuuaguguaaguuaaguuaaacuucu

SEQ ID NO: 712480 - RNA, 64 nt, hsa
aacaugggaaugauaauauauauuuuuucuuuuaauauuuuauuuuucuuuuuaugccacuuug

SEQ ID NO: 712481 - RNA, 64 nt, hsa
acaccauacagaacaguacuggacaaaaggggugauauuuuaaauuuacuaucccagaaacagg

SEQ ID NO: 712482 - RNA, 64 nt, hsa
guauacggugcuaauuaguaaaauauugaaggcaauauuuuacugcuagcuugcaaaguuauga

SEQ ID NO: 712483 - RNA, 64 nt, hsa
cuuuuauauagaacccaaggaaugccuuccugucauauuuuagccaaaacaacugguuauaugc

SEQ ID NO: 712484 - RNA, 64 nt, hsa
gcauguguguuugcuagcucacuuguccaugaaaauauuuuaugauauuaaagaaaaucuuuug

SEQ ID NO: 712485 - RNA, 64 nt, hsa
gaaaaaaaaguuacguuaaaaaccaaaaaacuacauauuuuauuauagaaaaaguauuuuuucu

SEQ ID NO: 712486 - RNA, 64 nt, hsa
uauauuuuauuuucaagguucauuguuuaaugaaauauuuuauucuugcauuuccauaaggaaa

SEQ ID NO: 712487 - RNA, 64 nt, hsa
auuaucuuuuuagcaaaaugguuucuuaauguuuauauuuuauuuucaagguucauuguuuaau

SEQ ID NO: 712488 - RNA, 64 nt, hsa
gaaauuuuucuguuaaauuuuaaauccagaaagcauauuuuauaaacuuaugcagagcacuuuu

SEQ ID NO: 712489 - RNA, 64 nt, hsa
gaauuuccuccuguagucauauauuauguacauaauauuuuagaaucauaccuaugacuuguuu

SEQ ID NO: 712490 - RNA, 64 nt, hsa
uuacuuugucccaggcaugcagagaaagauggugauauuuuaggccaggaguauaccuugcuau

SEQ ID NO: 712491 - RNA, 64 nt, hsa
agaauauacauacuuugcuguuuucuucccucaaauauuuuacuauuuguuuuauuuggaguua

SEQ ID NO: 712492 - RNA, 64 nt, hsa
uaacaacuaaacaggagccauuucaaggcgggagauauuuuaaacacccaaaauguugggucug

SEQ ID NO: 712493 - RNA, 64 nt, hsa
uuccaacuuucauugaaaaugccauaucuauaccauauuuuauucgagucacugaugauguaau

SEQ ID NO: 712494 - RNA, 64 nt, hsa
gagaugaaucaaaaaauaccccuaguaaugcuuuauauuuuaauacugcaaaagcuuuacaaau

SEQ ID NO: 712495 - RNA, 64 nt, hsa
cuuggaccaauugauaauauuucugacuguauuaauauuuuagugcuauaaaauacuaugugaa

SEQ ID NO: 712496 - RNA, 64 nt, hsa
acugugcagggaggaaaccauguauagcuuguacauauuuuaaaccagaccuucucacgaacug

SEQ ID NO: 712497 - RNA, 64 nt, hsa
aguauuuucuuuagcuagcuuaaaaagaaaacauauauuuuauguaaaaacacauacauggcca

SEQ ID NO: 712498 - RNA, 64 nt, hsa
auuaaaauuuugcaauauauuguguauuggucugauauuuuaguauauaguagaacauacuuuu

SEQ ID NO: 712499 - RNA, 64 nt, hsa
auauuaaauauuuugcuuuuuagacagcuguaggauauuuuauuucauggguauaccauaacuu

SEQ ID NO: 712500 - RNA, 64 nt, hsa
uuggaaaggagcuaguagcuuuaaggccaccaccauauuuuacuuuuuuaggauuuuucccccu

SEQ ID NO: 712501 - RNA, 64 nt, hsa
uuuaggagccagguagguuaccugcuuacacacuauauuuuaauugaauucaaacuaucaagca

SEQ ID NO: 712502 - RNA, 64 nt, hsa
aagucugugauuggggauuugcguuauaaaaugaauauuuuaaaaagcaacagcccuaauagcc

SEQ ID NO: 712503 - RNA, 64 nt, hsa
ggacuccucacaggcgguggaaauaauuaauaccauauuuuauacaucuccagagccuuucauc

SEQ ID NO: 712504 - RNA, 64 nt, hsa
uguacuuuacugagcaaaguuuaaaaaacaaaguauauuuuauuuuaugauaaagggccuuuaa

SEQ ID NO: 712505 - RNA, 64 nt, hsa
cacccagcauauuuucuauucagugauauaaagcauauuuuauucuauauuauuacaaaaacgg

SEQ ID NO: 712506 - RNA, 64 nt, hsa
uauauacauguuuuucuuuuacaugcauauauauauauuuuauuuuauuuuauguuuuuuggag

SEQ ID NO: 712507 - RNA, 64 nt, hsa
ccaaaacugauucagauuuucauacuuuaaugaaauauuuuauaauuugcaaauuuuuaaguaa

SEQ ID NO: 712508 - RNA, 64 nt, hsa
guugcaguaacuaaccaccaauguuaacaucuucauauuuuauauuccuaauaacagugaugac

SEQ ID NO: 712509 - RNA, 64 nt, hsa
augagccauucagucuuugcucacuauauauuuaauauuuuauuauuguuguuauuguuauuau

SEQ ID NO: 712510 - RNA, 64 nt, hsa
uuguuuccuuuuucagauaucuuggacaaaucacauauuuuaaaauuuguucuuguauuuauug

SEQ ID NO: 712511 - RNA, 64 nt, hsa
auuuucuuuucccccauuaaucaguucauuagaaauauuuuaaaaucagcuauuuugugaagcc

SEQ ID NO: 712512 - RNA, 64 nt, hsa
ugcucaccucaaacaguacaaagaaagugguuccauauuuuacaaacagaagaguagcaucaga

SEQ ID NO: 712513 - RNA, 64 nt, hsa
gacuauuuuuuuuucaaaguaggcaauucuuuguauauuuuaaggcaaauaaucacuucaccuc

SEQ ID NO: 712514 - RNA, 64 nt, hsa
uaaagaaauugugcuuuuggcaacaguguuaaccauauuuuauuauaaaauaguuucagucauc

SEQ ID NO: 712515 - RNA, 64 nt, hsa
acaggugugagccaccacacugggccaaugcuuaauauuuuaauguaucucaacaauaaaacca

SEQ ID NO: 712516 - RNA, 64 nt, hsa
uuuuuuuugauuuuuguuuuuuugcagcuugcugauauuuuauauaaaaaagaaaagcaaagca

SEQ ID NO: 712517 - RNA, 64 nt, hsa
aaaagcaaagcaaaagagaagcugauagucuugaauauuuuauuuuuuuaaugaaaagaaaaaa

SEQ ID NO: 712518 - RNA, 64 nt, hsa
ucagccagcuuuucccaccaguggugcuguugagauauuuuaaaauauugccuccguuuuaucg

SEQ ID NO: 712519 - RNA, 64 nt, hsa
gagcuuguuagcuucuaauuauaucuuaauaaauauauuuuauuacuagagcaagauggguuuu

SEQ ID NO: 712520 - RNA, 64 nt, hsa
uagauauacaaucuggaaaaauauuccugugcccauauuuuaauguaauuguauaacugggagc

SEQ ID NO: 712521 - RNA, 64 nt, hsa
guucuagagucagaacagguggacuuugcuuugaauauuuuagaugggacaaaaauuguucauc

SEQ ID NO: 712522 - RNA, 64 nt, hsa
uaaccauguucuuuccugucucuuuccauuuaagauauuuuauuugaauacugauaaacauuuu

SEQ ID NO: 712523 - RNA, 64 nt, hsa
ucugaacaucuggaugccuguuguuuuacuguguauauuuuauuuuuaauauauuaacuuugug

SEQ ID NO: 712524 - RNA, 64 nt, hsa
acuuggccaacugauguuuacaaaccagacuuuuauauuuuaauuuuacagauuuuacuacaug

SEQ ID NO: 712525 - RNA, 64 nt, hsa
auuguuguuguugaaaguccagcuuuuuugagguauauuuuaaauguuuuaaggaugcuucuaa

SEQ ID NO: 712526 - RNA, 64 nt, hsa
ggcauucuguagguuuauagaagguuuagccuucauauuuuaauugcuuguauacacaacagcu

SEQ ID NO: 712527 - RNA, 64 nt, hsa
cuuuuauguugguuuuaaaagguaaaugcuuaccauauuuuauaauugagaacucuuacauagu

SEQ ID NO: 712528 - RNA, 64 nt, hsa
gcaacuuuuuaggaauaccucuuuauacgucuacauauuuuaguauauaaaaauagauaaugcu

SEQ ID NO: 712529 - RNA, 64 nt, hsa
cugcucuuucaaauaacucuaaugaauauucaagauauuuuagccuuuuaaaaaguugagauuu

SEQ ID NO: 712530 - RNA, 64 nt, hsa
aacaugccuaauguuuucuuaaugaugacaacaaauauuuuaaaacugcauuuaucauuuuuua

SEQ ID NO: 712531 - RNA, 64 nt, hsa
gaaauauaaauucuaaauuauauuuguuauaacuauauuuuauguuguauguuaucaggagcca

SEQ ID NO: 712532 - RNA, 64 nt, hsa
cuuacuuuugcuccuuuauacagaauuauuaacuauauuuuacuaacuaaaaaacucuaguauu

SEQ ID NO: 712533 - RNA, 64 nt, hsa
caggugugagccaccaugccuggccugcuuugacauauuuuauaguguguuaauuacaaauagu

SEQ ID NO: 712534 - RNA, 64 nt, hsa
aagauuuaauacagugcuuuuuuuccucuuugaaauauuuuacuuuaauaccagugccuuuucu

SEQ ID NO: 712535 - RNA, 64 nt, hsa
ccuuauccacauagccugaggguaauuuuauacgauauuuuaaauaguuguguacaugaagcau

SEQ ID NO: 712536 - RNA, 64 nt, hsa
uaaugcacuuuuuauuuuauaauuuuguauugaaauauuuuagaaauguugauuaauuuuggug

SEQ ID NO: 712537 - RNA, 64 nt, hsa
uacuugaaucuuugugggguacagguugaucuuuauauuuuacugguuguuuuaaaaauucuag

SEQ ID NO: 712538 - RNA, 64 nt, hsa
gucauaucuguguguuuguaaaguuauuuuuuuaauauuuuaagauuacaauuuuaacaaaugu

SEQ ID NO: 712539 - RNA, 64 nt, hsa
uuuuuuuaauuuccauaugggcuaaagaauccaaauauuuuaaaaaucugucucucuuuucuuc

SEQ ID NO: 712540 - RNA, 64 nt, hsa
gaccccuaauuauuuuguaucuuuuuucauauaaauauuuuacagauuaugaaguauucauuau

SEQ ID NO: 712541 - RNA, 64 nt, hsa
acuuaauuucauuuauaaguaaauuaaaauuaguauauuuuacuaauacuuuuauauaaaaugc

SEQ ID NO: 712542 - RNA, 64 nt, hsa
ucuugaauaauuauaauuauucuuuauaauaaaaauauuuuaauuauagcauguuuguguaaug

SEQ ID NO: 712543 - RNA, 64 nt, hsa
uuccucuuauuaauacuauaaauccaucucaagcauauuuuaaaauaaugagagauggaggaaa

SEQ ID NO: 712544 - RNA, 64 nt, hsa
ccaaaaaaucacacaaauauauuuuaaaauguaaauauuuuaucgcuucuguuuucucaguugu

SEQ ID NO: 712545 - RNA, 64 nt, hsa
gcucuuuuauaaccccccaaaaaaucacacaaauauauuuuaaaauguaaauauuuuaucgcuu

SEQ ID NO: 712546 - RNA, 64 nt, hsa
gaguuuauuaguacaugggcuuagugaccacaaaauauuuuauuaagaaacuguuucaaaaaua

SEQ ID NO: 712547 - RNA, 64 nt, hsa
uuuuagagaagauggccaccagcuggcuuccuagauauuuuaaacuuuuguucuuuaauaugcu

SEQ ID NO: 712548 - RNA, 64 nt, hsa
uguaaauuuugcacaguuacuuguucauauguaaauauuuuacuuucagaaaugaaguuuuuaa

SEQ ID NO: 712549 - RNA, 64 nt, hsa
aguuaaaagagaugaaaaccuuuucagcauaaauauauuuuacuugcacuguguuuuuuagcua

SEQ ID NO: 712550 - RNA, 64 nt, hsa
cucuugugaauuuggaucuuuuuacuuugagcauauauuuuagaauauguguauguuaaaggau

SEQ ID NO: 712551 - RNA, 64 nt, hsa
ucuaugcaauucccauaugguuuuuuuuuaaaucauauuuuauucauuuucucccuuuagcaau

SEQ ID NO: 712552 - RNA, 64 nt, hsa
gccugcagaaguuuaauaauuugacuuuuuucuaauauuuuaguuugaaagaaaauuucuuccc

SEQ ID NO: 712553 - RNA, 64 nt, hsa
uuucaguuauaaaacaucuauuuugaaucuguaaauauuuuaaauguuuuauuaaggcauguaa

SEQ ID NO: 712554 - RNA, 64 nt, hsa
aacaaugcaauaaaaccacuaaacuuuuguguccauauuuuacugagaccauguuucauuaaaa

SEQ ID NO: 712555 - RNA, 64 nt, hsa
caacucauuagcuagugaagauauucauguaaauauauuuuaggauuguaauuaauuuugaaaa

SEQ ID NO: 712556 - RNA, 64 nt, hsa
auucuuucacuugaaaaaacuccaaaauuccacaauauuuuaguaguuaacuuccuauucuuuc

SEQ ID NO: 712557 - RNA, 64 nt, hsa
uuuccccuucuuugaaaagguagaagagaaaggaauauuuuaaaccuuuuuggcuuaaacagaa

SEQ ID NO: 712558 - RNA, 64 nt, hsa
auauguccacccauugauuuuuaaagcuuuugugauauuuuagcauuuugaaagacuuucacag

SEQ ID NO: 712559 - RNA, 64 nt, hsa
cagaaagugguuuagacauucuugauuaguuuccauauuuuaaguagcugcagucuuucauguu

SEQ ID NO: 712560 - RNA, 64 nt, hsa
guuuucaacguuuacauucaauccaagccuuuguauauuuuagagcugugcaacacuuuaaguc

SEQ ID NO: 712561 - RNA, 64 nt, hsa
uuuauguguuuauucuuuauauagauaguauuuuauauuuuauucucacccgaaguauucacac

SEQ ID NO: 712562 - RNA, 64 nt, hsa
gguguuuacauaaauacuauguuuuacaguuuucauauuuuaaaauauuaauaaaguuaaauca

SEQ ID NO: 712563 - RNA, 64 nt, hsa
uaacauuauauugauuguguuccccucaagcaucauauuuuacauuuuuuuaucaucuuuuaaa

SEQ ID NO: 712564 - RNA, 64 nt, hsa
acuuuugugaccacuauuuuagaaacuuuauuuaauauuuuaauguuuucagucauugcuuugg

SEQ ID NO: 712565 - RNA, 64 nt, hsa
uuucaaaaaauacugccguuacugucuuuuaugcauauuuuagccugaaauuuugaagcgucuu

SEQ ID NO: 712566 - RNA, 64 nt, hsa
aucuuaaaaacucaggauugauguaagcacuggaauauuuuauuuguagaaauguguaucgcaa

SEQ ID NO: 712567 - RNA, 64 nt, hsa
uccaaaauaauauugugguaauuguaaguagugcauauuuuaucuuaaaaacucaggauugaug

SEQ ID NO: 712568 - RNA, 64 nt, hsa
gguguuuacauaaauacuauguuuuacaguuuucauauuuuaaaauauuaauaaaguuaaucgc

SEQ ID NO: 712569 - RNA, 64 nt, hsa
agcaguuuuuguuuuguagacaguucccauaaaaauauuuuaucagaauugcagaacuguagua

SEQ ID NO: 712570 - RNA, 64 nt, hsa
aagauuauaguuauuaauauugauaccucugauaauauuuuauucuuaaaucuucagugauucc

SEQ ID NO: 712571 - RNA, 64 nt, hsa
agacuaacagaugaagucucucauuugcuugaagauauuuuacaaaauaccaacuguucuauau

SEQ ID NO: 712572 - RNA, 64 nt, hsa
agaauauguuauacccuuauuuuguguuaaggauauauuuuauuaugugaaugguuuuguuuuu

SEQ ID NO: 712573 - RNA, 64 nt, hsa
cauucuaauuauauuuuaaaugaaauguuacagcauauuuuaagcaacucuuuuuaucuauaau

SEQ ID NO: 712574 - RNA, 64 nt, hsa
uuaauaauuucaauguggaccagacauucuaauuauauuuuaaaugaaauguuacagcauauuu

SEQ ID NO: 712575 - RNA, 64 nt, hsa
gauuugugauuuaaugacaguugaauaaucaaaaauauuuuauuaggcccccaaaauuuaauag

SEQ ID NO: 712576 - RNA, 64 nt, hsa
uuaaauguauuaauagagucaauggaacuuuaaaauauuuuaguagauuuuguaaagucaguaa

SEQ ID NO: 712577 - RNA, 64 nt, hsa
uuuacaaugcuuucuaccugaaauguguagcuuuauauuuuauggcauucuaguauuuuugugu

SEQ ID NO: 712578 - RNA, 64 nt, hsa
aaucucuuugguuuugauuucuugcauauuuuauauauuuuacaaugcuuucuaccugaaaugu

SEQ ID NO: 712579 - RNA, 64 nt, hsa
ucuaagaaaaaucucuuugguuuugauuucuugcauauuuuauauauuuuacaaugcuuucuac

SEQ ID NO: 712580 - RNA, 64 nt, hsa; identical to SEQ ID NO: 120942

SEQ ID NO: 712581 - RNA, 64 nt, hsa; identical to SEQ ID NO: 120943

SEQ ID NO: 712582 - RNA, 64 nt, hsa; identical to SEQ ID NO: 120944

SEQ ID NO: 712583 - RNA, 64 nt, hsa; identical to SEQ ID NO: 120945

SEQ ID NO: 712584 - RNA, 64 nt, hsa; identical to SEQ ID NO: 120946

SEQ ID NO: 712585 - RNA, 64 nt, hsa; identical to SEQ ID NO: 120947

SEQ ID NO: 712586 - RNA, 64 nt, hsa; identical to SEQ ID NO: 120948

SEQ ID NO: 712587 - RNA, 64 nt, hsa; identical to SEQ ID NO: 120949

SEQ ID NO: 712588 - RNA, 64 nt, hsa; identical to SEQ ID NO: 120950

SEQ ID NO: 712589 - RNA, 64 nt, hsa; identical to SEQ ID NO: 120951

SEQ ID NO: 712590 - RNA, 64 nt, hsa; identical to SEQ ID NO: 120952

SEQ ID NO: 712591 - RNA, 64 nt, hsa; identical to SEQ ID NO: 120953

SEQ ID NO: 712592 - RNA, 64 nt, hsa; identical to SEQ ID NO: 120954

SEQ ID NO: 712593 - RNA, 64 nt, hsa; identical to SEQ ID NO: 120955

SEQ ID NO: 712594 - RNA, 64 nt, hsa; identical to SEQ ID NO: 120956

SEQ ID NO: 712595 - RNA, 64 nt, hsa; identical to SEQ ID NO: 120957

SEQ ID NO: 712596 - RNA, 64 nt, hsa; identical to SEQ ID NO: 120958

SEQ ID NO: 712597 - RNA, 64 nt, hsa; identical to SEQ ID NO: 120959

SEQ ID NO: 712598 - RNA, 64 nt, hsa; identical to SEQ ID NO: 120960

SEQ ID NO: 712599 - RNA, 64 nt, hsa; identical to SEQ ID NO: 120961

SEQ ID NO: 712600 - RNA, 64 nt, hsa; identical to SEQ ID NO: 120962

SEQ ID NO: 712601 - RNA, 64 nt, hsa; identical to SEQ ID NO: 120963

SEQ ID NO: 712602 - RNA, 64 nt, hsa; identical to SEQ ID NO: 120964

SEQ ID NO: 712603 - RNA, 62 nt, hsa; identical to SEQ ID NO: 120965

SEQ ID NO: 712604 - RNA, 64 nt, hsa; identical to SEQ ID NO: 120966

SEQ ID NO: 712605 - RNA, 64 nt, hsa; identical to SEQ ID NO: 120967

SEQ ID NO: 712606 - RNA, 64 nt, hsa; identical to SEQ ID NO: 120968

SEQ ID NO: 712607 - RNA, 64 nt, hsa; identical to SEQ ID NO: 120969

SEQ ID NO: 712608 - RNA, 64 nt, hsa; identical to SEQ ID NO: 120970

SEQ ID NO: 712609 - RNA, 64 nt, hsa; identical to SEQ ID NO: 120971

SEQ ID NO: 712610 - RNA, 63 nt, hsa
uuuccauuuguuugugacaucucuuauuucuuucagggguaucuuguaauucucauuauauau

SEQ ID NO: 712611 - RNA, 63 nt, hsa
aauuuuuaauuuuuuuaacuuuuauuuuagauucagggguauaugugcagguuuguuacauag

SEQ ID NO: 712612 - RNA, 63 nt, hsa
uaggaacuauuaggaaugucaggacuuuaucagcagggguaaaacuaccaccuggccuagccu

SEQ ID NO: 712613 - RNA, 63 nt, hsa
ucaaaagcaagcuaguuacuuccuagauaccaacagggguacagguauugauuaaagacggcu

SEQ ID NO: 712614 - RNA, 63 nt, hsa
agcugcaugcaccacaggggcaaugcaccuuugcagggguaccuucuggccccaacccuugac

SEQ ID NO: 712615 - RNA, 63 nt, hsa
ggacacuguggagcucugcccagaugaccuuuucagggguaacaccccagcugcuugagagaa

SEQ ID NO: 712616 - RNA, 64 nt, hsa
aguagacucugcucccuagcccugagcaggaggcugggagcagcucuguuuccuaauucaggac

SEQ ID NO: 712617 - RNA, 64 nt, hsa
ugguccaagaggcuaccugcuccaaggcggagggugggagcaggugugccagggcucagggcuc

SEQ ID NO: 712618 - RNA, 64 nt, hsa
uuuaccccugaguuccuuacuguucccccaagccugggagcagucuaucccccaacccugccau

SEQ ID NO: 712619 - RNA, 64 nt, hsa
agaaacccaugaaaaggaggccacaggagauuccugggagcacuggguguagcaaaacaaagcc

SEQ ID NO: 712620 - RNA, 64 nt, hsa
gccuauuuaugguuauucguuuuaguaaguucugugggagcaagguauuuaaaaucaaaacuaa

SEQ ID NO: 712621 - RNA, 64 nt, hsa
uaguacugggaaaugggagcacaguacugggaaaugggagcauaguacugggaaaccccagacc

SEQ ID NO: 712622 - RNA, 64 nt, hsa
caguacucggaaaugggagcauaguacugggaaaugggagcacaguacugggaaaugggagcau

SEQ ID NO: 712623 - RNA, 64 nt, hsa
guacugggaaaggggaguucacaguacucggaaaugggagcauaguacugggaaaugggagcac

SEQ ID NO: 712624 - RNA, 64 nt, hsa
guacugagaaaugggagcacacaguacugggaaaugggagcacaguacugggaaaugggagccc

SEQ ID NO: 712625 - RNA, 64 nt, hsa
caguacugggaaaugggcauacaguacugagaaaugggagcacacaguacugggaaaugggagc

SEQ ID NO: 712626 - RNA, 64 nt, hsa
caguacugagaaaugggaguacacuacugagaaaugggagcacaguacugggaaaugggcauac

SEQ ID NO: 712627 - RNA, 64 nt, hsa
caguacugggaagugggagcacaguacugagaagugggagcacaguacugagaaaugggaguac

SEQ ID NO: 712628 - RNA, 64 nt, hsa
caguauugggaaaugggagcacaguacugggaagugggagcacaguacugagaagugggagcac

SEQ ID NO: 712629 - RNA, 64 nt, hsa
cagcacugcaaaaugggagcacaguauugggaaaugggagcacaguacugggaagugggagcac

SEQ ID NO: 712630 - RNA, 64 nt, hsa
guacugggaaaugggggcucacagcacugcaaaaugggagcacaguauugggaaaugggagcac

SEQ ID NO: 712631 - RNA, 64 nt, hsa
caguacuaggaaaugggagcacaguacugggaaaugggagcacaguacugggaaaugggggcuc

SEQ ID NO: 712632 - RNA, 64 nt, hsa
caguacugggaaaugggagcacaguacuaggaaaugggagcacaguacugggaaaugggagcac

SEQ ID NO: 712633 - RNA, 64 nt, hsa
guuggcucacaccugugagcacaguacugggaaaugggagcacaguacuaggaaaugggagcac

SEQ ID NO: 712634 - RNA, 64 nt, hsa
cagcuuucccuccucgcuggccugggcacccuccugggagcaggccuuccucccucccaccccc

SEQ ID NO: 712635 - RNA, 64 nt, hsa
accucuguccacugcccagggaggggccuggggcugggagcagucccgguuuagccugaggucc

SEQ ID NO: 712636 - RNA, 64 nt, hsa
agcacagugaagaccaugggagcacccuggcaccugggagcacagugaagacccugagagcauc

SEQ ID NO: 712637 - RNA, 56 nt, hsa
agugucugggagcacagugaagaccaugggagcacccuggcaccugggagcacagu

SEQ ID NO: 712638 - RNA, 64 nt, hsa
gaacaccgcugccacuguggcuccaggaggcccuugggagcaugaggagagcuggacucgcuca

SEQ ID NO: 712639 - RNA, 64 nt, hsa
ugguguagacggccuggccuguaccccaacggucugggagcaccugucuguuguagaaaacacc

SEQ ID NO: 712640 - RNA, 64 nt, hsa
aauccggcugggagcaugaccuuggcgucuguucugggagcacggaugauaagcucuggaagcu

SEQ ID NO: 712641 - RNA, 64 nt, hsa
ccucaucacggcggcgaggcuacgacaauccggcugggagcaugaccuuggcgucuguucuggg

SEQ ID NO: 712642 - RNA, 64 nt, hsa
ccauugaaaagcaaguaauacagccugugcuaauugggagcacuugaacaauuuuguuccauuc

SEQ ID NO: 712643 - RNA, 64 nt, hsa
ugagaacccaaaucauguuuauaaaauaggacgcugggagcaguugcaggccacagugaagugu

SEQ ID NO: 712644 - RNA, 64 nt, hsa; identical to SEQ ID NO: 303515

SEQ ID NO: 712645 - RNA, 64 nt, hsa; identical to SEQ ID NO: 303516

SEQ ID NO: 712646 - RNA, 64 nt, hsa; identical to SEQ ID NO: 303517

SEQ ID NO: 712647 - RNA, 64 nt, hsa; identical to SEQ ID NO: 303518

SEQ ID NO: 712648 - RNA, 64 nt, hsa; identical to SEQ ID NO: 303519

SEQ ID NO: 712649 - RNA, 64 nt, hsa; identical to SEQ ID NO: 303520

SEQ ID NO: 712650 - RNA, 64 nt, hsa; identical to SEQ ID NO: 303521

SEQ ID NO: 712651 - RNA, 64 nt, hsa; identical to SEQ ID NO: 303522

SEQ ID NO: 712652 - RNA, 64 nt, hsa; identical to SEQ ID NO: 303523

SEQ ID NO: 712653 - RNA, 64 nt, hsa; identical to SEQ ID NO: 303524

SEQ ID NO: 712654 - RNA, 64 nt, hsa; identical to SEQ ID NO: 303525

SEQ ID NO: 712655 - RNA, 64 nt, hsa; identical to SEQ ID NO: 303526

SEQ ID NO: 712656 - RNA, 64 nt, hsa; identical to SEQ ID NO: 303527

SEQ ID NO: 712657 - RNA, 64 nt, hsa; identical to SEQ ID NO: 303528

SEQ ID NO: 712658 - RNA, 64 nt, hsa; identical to SEQ ID NO: 200782

SEQ ID NO: 712659 - RNA, 64 nt, hsa; identical to SEQ ID NO: 200783

SEQ ID NO: 712660 - RNA, 64 nt, hsa; identical to SEQ ID NO: 200784

SEQ ID NO: 712661 - RNA, 64 nt, hsa; identical to SEQ ID NO: 200785

SEQ ID NO: 712662 - RNA, 64 nt, hsa; identical to SEQ ID NO: 200786

SEQ ID NO: 712663 - RNA, 64 nt, hsa; identical to SEQ ID NO: 200787

SEQ ID NO: 712664 - RNA, 64 nt, hsa; identical to SEQ ID NO: 200788

SEQ ID NO: 712665 - RNA, 64 nt, hsa; identical to SEQ ID NO: 200789

SEQ ID NO: 712666 - RNA, 64 nt, hsa; identical to SEQ ID NO: 200790

SEQ ID NO: 712667 - RNA, 64 nt, hsa; identical to SEQ ID NO: 200791

SEQ ID NO: 712668 - RNA, 64 nt, hsa; identical to SEQ ID NO: 200792

SEQ ID NO: 712669 - RNA, 64 nt, hsa; identical to SEQ ID NO: 200793

SEQ ID NO: 712670 - RNA, 64 nt, hsa; identical to SEQ ID NO: 200794

SEQ ID NO: 712671 - RNA, 64 nt, hsa; identical to SEQ ID NO: 200795

SEQ ID NO: 712672 - RNA, 64 nt, hsa; identical to SEQ ID NO: 200796

SEQ ID NO: 712673 - RNA, 64 nt, hsa; identical to SEQ ID NO: 200797

SEQ ID NO: 712674 - RNA, 64 nt, hsa; identical to SEQ ID NO: 563739

SEQ ID NO: 712675 - RNA, 64 nt, hsa; identical to SEQ ID NO: 563740

SEQ ID NO: 712676 - RNA, 64 nt, hsa; identical to SEQ ID NO: 563741

SEQ ID NO: 712677 - RNA, 64 nt, hsa; identical to SEQ ID NO: 563742

SEQ ID NO: 712678 - RNA, 64 nt, hsa; identical to SEQ ID NO: 563743

SEQ ID NO: 712679 - RNA, 64 nt, hsa; identical to SEQ ID NO: 563744

SEQ ID NO: 712680 - RNA, 64 nt, hsa; identical to SEQ ID NO: 563745

SEQ ID NO: 712681 - RNA, 64 nt, hsa; identical to SEQ ID NO: 563746

SEQ ID NO: 712682 - RNA, 64 nt, hsa; identical to SEQ ID NO: 563747

SEQ ID NO: 712683 - RNA, 64 nt, hsa; identical to SEQ ID NO: 563748

SEQ ID NO: 712684 - RNA, 64 nt, hsa; identical to SEQ ID NO: 563749

SEQ ID NO: 712685 - RNA, 64 nt, hsa; identical to SEQ ID NO: 563750

SEQ ID NO: 712686 - RNA, 64 nt, hsa; identical to SEQ ID NO: 563751

SEQ ID NO: 712687 - RNA, 64 nt, hsa; identical to SEQ ID NO: 563752

SEQ ID NO: 712688 - RNA, 64 nt, hsa; identical to SEQ ID NO: 563753

SEQ ID NO: 712689 - RNA, 64 nt, hsa; identical to SEQ ID NO: 563754

SEQ ID NO: 712690 - RNA, 64 nt, hsa; identical to SEQ ID NO: 563755

SEQ ID NO: 712691 - RNA, 64 nt, hsa; identical to SEQ ID NO: 563756

SEQ ID NO: 712692 - RNA, 64 nt, hsa; identical to SEQ ID NO: 563757

SEQ ID NO: 712693 - RNA, 64 nt, hsa; identical to SEQ ID NO: 563758

SEQ ID NO: 712694 - RNA, 64 nt, hsa; identical to SEQ ID NO: 563759

SEQ ID NO: 712695 - RNA, 64 nt, hsa; identical to SEQ ID NO: 563760

SEQ ID NO: 712696 - RNA, 64 nt, hsa; identical to SEQ ID NO: 563761

SEQ ID NO: 712697 - RNA, 64 nt, hsa; identical to SEQ ID NO: 563762

SEQ ID NO: 712698 - RNA, 64 nt, hsa; identical to SEQ ID NO: 563763

SEQ ID NO: 712699 - RNA, 64 nt, hsa; identical to SEQ ID NO: 563764

SEQ ID NO: 712700 - RNA, 64 nt, hsa; identical to SEQ ID NO: 563765

SEQ ID NO: 712701 - RNA, 64 nt, hsa; identical to SEQ ID NO: 563766

SEQ ID NO: 712702 - RNA, 64 nt, hsa; identical to SEQ ID NO: 563767

SEQ ID NO: 712703 - RNA, 64 nt, hsa; identical to SEQ ID NO: 563768

SEQ ID NO: 712704 - RNA, 64 nt, hsa; identical to SEQ ID NO: 563769

SEQ ID NO: 712705 - RNA, 64 nt, hsa; identical to SEQ ID NO: 563770

SEQ ID NO: 712706 - RNA, 64 nt, hsa; identical to SEQ ID NO: 563771

SEQ ID NO: 712707 - RNA, 64 nt, hsa; identical to SEQ ID NO: 563772

SEQ ID NO: 712708 - RNA, 64 nt, hsa; identical to SEQ ID NO: 563773

SEQ ID NO: 712709 - RNA, 64 nt, hsa; identical to SEQ ID NO: 563774

SEQ ID NO: 712710 - RNA, 64 nt, hsa; identical to SEQ ID NO: 563775

SEQ ID NO: 712711 - RNA, 64 nt, hsa; identical to SEQ ID NO: 563776

SEQ ID NO: 712712 - RNA, 64 nt, hsa; identical to SEQ ID NO: 563777

SEQ ID NO: 712713 - RNA, 64 nt, hsa; identical to SEQ ID NO: 563778

SEQ ID NO: 712714 - RNA, 64 nt, hsa; identical to SEQ ID NO: 563779

SEQ ID NO: 712715 - RNA, 64 nt, hsa; identical to SEQ ID NO: 563780

SEQ ID NO: 712716 - RNA, 64 nt, hsa; identical to SEQ ID NO: 563781

SEQ ID NO: 712717 - RNA, 64 nt, hsa; identical to SEQ ID NO: 563782

SEQ ID NO: 712718 - RNA, 64 nt, hsa; identical to SEQ ID NO: 563783

SEQ ID NO: 712719 - RNA, 64 nt, hsa; identical to SEQ ID NO: 563784

SEQ ID NO: 712720 - RNA, 64 nt, hsa; identical to SEQ ID NO: 563785

SEQ ID NO: 712721 - RNA, 64 nt, hsa; identical to SEQ ID NO: 563786

SEQ ID NO: 712722 - RNA, 64 nt, hsa; identical to SEQ ID NO: 563787

SEQ ID NO: 712723 - RNA, 64 nt, hsa; identical to SEQ ID NO: 563788

SEQ ID NO: 712724 - RNA, 64 nt, hsa; identical to SEQ ID NO: 563789

SEQ ID NO: 712725 - RNA, 64 nt, hsa; identical to SEQ ID NO: 563790

SEQ ID NO: 712726 - RNA, 64 nt, hsa; identical to SEQ ID NO: 563791

SEQ ID NO: 712727 - RNA, 64 nt, hsa; identical to SEQ ID NO: 563792

SEQ ID NO: 712728 - RNA, 64 nt, hsa; identical to SEQ ID NO: 563793

SEQ ID NO: 712729 - RNA, 64 nt, hsa; identical to SEQ ID NO: 563794

SEQ ID NO: 712730 - RNA, 64 nt, hsa; identical to SEQ ID NO: 563795

SEQ ID NO: 712731 - RNA, 64 nt, hsa; identical to SEQ ID NO: 563796

SEQ ID NO: 712732 - RNA, 64 nt, hsa; identical to SEQ ID NO: 563797

SEQ ID NO: 712733 - RNA, 64 nt, hsa; identical to SEQ ID NO: 563798

SEQ ID NO: 712734 - RNA, 64 nt, hsa; identical to SEQ ID NO: 563799

SEQ ID NO: 712735 - RNA, 64 nt, hsa; identical to SEQ ID NO: 563800

SEQ ID NO: 712736 - RNA, 64 nt, hsa; identical to SEQ ID NO: 563801

SEQ ID NO: 712737 - RNA, 64 nt, hsa; identical to SEQ ID NO: 563802

SEQ ID NO: 712738 - RNA, 64 nt, hsa; identical to SEQ ID NO: 563803

SEQ ID NO: 712739 - RNA, 64 nt, hsa; identical to SEQ ID NO: 563803

SEQ ID NO: 712740 - RNA, 64 nt, hsa; identical to SEQ ID NO: 563803

SEQ ID NO: 712741 - RNA, 64 nt, hsa; identical to SEQ ID NO: 563803

SEQ ID NO: 712742 - RNA, 64 nt, hsa; identical to SEQ ID NO: 563807

SEQ ID NO: 712743 - RNA, 64 nt, hsa; identical to SEQ ID NO: 563808

SEQ ID NO: 712744 - RNA, 64 nt, hsa; identical to SEQ ID NO: 563809

SEQ ID NO: 712745 - RNA, 64 nt, hsa; identical to SEQ ID NO: 563810

SEQ ID NO: 712746 - RNA, 64 nt, hsa; identical to SEQ ID NO: 563811

SEQ ID NO: 712747 - RNA, 64 nt, hsa; identical to SEQ ID NO: 563812

SEQ ID NO: 712748 - RNA, 64 nt, hsa; identical to SEQ ID NO: 563813

SEQ ID NO: 712749 - RNA, 64 nt, hsa; identical to SEQ ID NO: 563814

SEQ ID NO: 712750 - RNA, 64 nt, hsa; identical to SEQ ID NO: 563815

SEQ ID NO: 712751 - RNA, 64 nt, hsa; identical to SEQ ID NO: 563816

SEQ ID NO: 712752 - RNA, 64 nt, hsa; identical to SEQ ID NO: 563817

SEQ ID NO: 712753 - RNA, 64 nt, hsa; identical to SEQ ID NO: 332610

SEQ ID NO: 712754 - RNA, 64 nt, hsa; identical to SEQ ID NO: 332611

SEQ ID NO: 712755 - RNA, 64 nt, hsa; identical to SEQ ID NO: 332612

SEQ ID NO: 712756 - RNA, 64 nt, hsa; identical to SEQ ID NO: 332613

SEQ ID NO: 712757 - RNA, 64 nt, hsa; identical to SEQ ID NO: 332614

SEQ ID NO: 712758 - RNA, 64 nt, hsa; identical to SEQ ID NO: 332615

SEQ ID NO: 712759 - RNA, 64 nt, hsa; identical to SEQ ID NO: 332616

SEQ ID NO: 712760 - RNA, 64 nt, hsa; identical to SEQ ID NO: 332617

SEQ ID NO: 712761 - RNA, 64 nt, hsa; identical to SEQ ID NO: 332618

SEQ ID NO: 712762 - RNA, 64 nt, hsa; identical to SEQ ID NO: 332619

SEQ ID NO: 712763 - RNA, 64 nt, hsa; identical to SEQ ID NO: 332620

SEQ ID NO: 712764 - RNA, 64 nt, hsa; identical to SEQ ID NO: 332621

SEQ ID NO: 712765 - RNA, 64 nt, hsa; identical to SEQ ID NO: 332622

SEQ ID NO: 712766 - RNA, 64 nt, hsa; identical to SEQ ID NO: 332623

SEQ ID NO: 712767 - RNA, 64 nt, hsa
uccucccuccucucuaaauguaguccccucuccuccaucuaaaggcaacauuccuuacccauua

SEQ ID NO: 712768 - RNA, 64 nt, hsa
gauuaugaagaaauacuugagcaauuucagaaaaccaucuaagugcuggaggaaccacgcuucc

SEQ ID NO: 712769 - RNA, 64 nt, hsa
gucaagcuuguggaaaaagauuuagcaggcuagaccaucuaaguagccauuuucgaacaguaug

SEQ ID NO: 712770 - RNA, 64 nt, hsa
uaggcugguagcuucuauguaauucgcaaugauuccaucuaaauaaaaguucuaugaucugcaa

SEQ ID NO: 712771 - RNA, 64 nt, hsa
cuacuguaauagaucagcauccaaaagcaggaacccaucuaaaccagaaggaagcccucucaga

SEQ ID NO: 712772 - RNA, 64 nt, hsa
uccugcccugccuuccuccugccuguagcccagcccaucuaaauggaagcugggaauugccccu

SEQ ID NO: 712773 - RNA, 64 nt, hsa
aacaggaauaagugguagccuugcuuucugagcaccaucuaaagaauuuuaaaccucugcauua

SEQ ID NO: 712774 - RNA, 64 nt, hsa
cugcaggccauccugggaguaaagggcugccuucccaucuaauuuauuguaaagucauauaguc

SEQ ID NO: 712775 - RNA, 64 nt, hsa
uccccauaucccaaggcgaagcgcugagauucuuccaucuaaaaaacccucgacccgaaacccu

SEQ ID NO: 712776 - RNA, 64 nt, hsa
ugugucaucuuguugccauggaguugugaucaucccaucuaagcugcagcuuccugucaacacu

SEQ ID NO: 712777 - RNA, 64 nt, hsa
uccaaaguaaauccugaacaaaaccuaaacacagccaucuaacucauuaccuuaaaagacauuc

SEQ ID NO: 712778 - RNA, 64 nt, hsa
gguuaguggauggaaggggcugacagacagcccuccaucuaaacugcccccucugcccugcggg

SEQ ID NO: 712779 - RNA, 64 nt, hsa
aguuuucauuaauccagaaggaugaacauggucaccaucuaacuauucaggaauuguagucuga

SEQ ID NO: 712780 - RNA, 64 nt, hsa
aacaaauuaugccucuuuaaguccuugaaagucuccaucuaaagaggaaaaguuuguuggaaca

SEQ ID NO: 712781 - RNA, 64 nt, hsa
acccuuccccgugcucagacagugcaccgcugucccaucuaaagaaaccugucaggaauacgag

SEQ ID NO: 712782 - RNA, 64 nt, hsa
uguaaaaucucuguuguggugggcauagguggcaccaucuaaagaaaagaggucuuguuuuuug

SEQ ID NO: 712783 - RNA, 64 nt, hsa
gaauagcugggacuagaagcaugcaccaccaugcccaucuaauauuuguauuuuuaguagagac

SEQ ID NO: 712784 - RNA, 64 nt, hsa
uuuaucccgaucuccuggaaggcuguugugauuuccaucuaagaaaugagggucuugagaauca

SEQ ID NO: 712785 - RNA, 52 nt, hsa
cugaagauaauuuacagugaccccaucuaaauaaaauacugcuuuugcaaac

SEQ ID NO: 712786 - RNA, 64 nt, hsa
guucaaauauauaagagccaaacucuuuuccauuccaucuaaaauguuuucauuuaguacucuu

SEQ ID NO: 712787 - RNA, 64 nt, hsa
gcccuuguucuuaggcccgucugcccgccuuccuccaucuaaccuuuccuguuuuauccgcagc

SEQ ID NO: 712788 - RNA, 64 nt, hsa
gucuguaaaguguaaccuaggaaagauaauucaaccaucuaaucaaaauggaucuggauuacua

SEQ ID NO: 712789 - RNA, 64 nt, hsa
cuuuuaaguuauuaauuuuuuaaaaugugcuucuccaucuaaauuuugcuuagucuacaucuca

SEQ ID NO: 712790 - RNA, 64 nt, hsa
aagguauacuaaauaauauaucaacaacuaauggccaucuaaugcuaugcuggauaugaacuuu

SEQ ID NO: 712791 - RNA, 64 nt, hsa
auccagaggaacaagcaugucucucugccaagauccaucuaaacuggagugauguuagcagacc

SEQ ID NO: 712792 - RNA, 64 nt, hsa
uauuguaauuguuuuggggugccacagacugcauccaucuaagacagugagcuuaguugaugug

SEQ ID NO: 712793 - RNA, 64 nt, hsa
ugcagccaccaccuccugagcucaagugauccucccaucuaagcccccaaguagcuaggacuac

SEQ ID NO: 712794 - RNA, 64 nt, hsa
gauuagcuggugcuauaggcaugcaccaccacguccaucuaaauuucuuuauuauuuguagaga

SEQ ID NO: 712795 - RNA, 64 nt, hsa
aguuaaaaaaaaacccacuaugcuauaaguuaggccaucuaaaacagauuauuaaagagguuca

SEQ ID NO: 712796 - RNA, 64 nt, hsa
acuuuucuucucuuugaggcacuaccuggcagcaccaucuaaaccuguaucaucugcugugguc

SEQ ID NO: 712797 - RNA, 64 nt, hsa
acaaagcccaccaggaagauccaggauaaucucuccaucuaaaguuccuucaucauccuggaag

SEQ ID NO: 712798 - RNA, 64 nt, hsa
ccuagccaggaauacccauuugauuuccagggugccaucuaauccugggcuguacauguggaua

SEQ ID NO: 712799 - RNA, 64 nt, hsa
agaauugcaaccggaaccauuuuuuuuccuguuaccaucuaagaacucugugguuuauuauuaa

SEQ ID NO: 712800 - RNA, 64 nt, hsa
uccacagugaagaugguugacuagugacacagccccaucuaaagaaucccuuucuguaugucug

SEQ ID NO: 712801 - RNA, 64 nt, hsa
uuuguuuagcauuucaagcuuuuauguauccaucccaucuaaaaacucuucaaacuccacuugu

SEQ ID NO: 712802 - RNA, 64 nt, hsa
uuagucgucuuuccuacaacauuuuagcuuuugcccaucuaaagcacaauuaaaauuaggcuac

SEQ ID NO: 712803 - RNA, 64 nt, hsa
acuaccuuguacccccaucaaaaucccaccugaaccaucuaauccuauaaacauaaagggguaa

SEQ ID NO: 712804 - RNA, 64 nt, hsa
ccuggguugggaguuagugcauaucaucagcccuccaucuaaugugauugcuaagaugugcagg

SEQ ID NO: 712805 - RNA, 64 nt, hsa
cacauuaucuaaaccauuuuguaguuccaaaaacccaucuaaauuucuugaguuccugaauuuu

SEQ ID NO: 712806 - RNA, 64 nt, hsa
uguccucaggcgguuucaucuuuguugauucugcccaucuaagucauaagcuucucaaaugcaa

SEQ ID NO: 712807 - RNA, 64 nt, hsa
ucccuuugagucaugaugacagauggugugaaaaccaucuaaguuugcuuuugaccaucaccuc

SEQ ID NO: 712808 - RNA, 64 nt, hsa
uuaugcaaaaaaaaauguuuuuguccuugugaguccaucuaacaucauaauuaaucauguggcu

SEQ ID NO: 712809 - RNA, 64 nt, hsa
gaugauugauuagugccucuuucugcaaacuuuuccaucuaaaaaaaaaaauguuuuuuuuaag

SEQ ID NO: 712810 - RNA, 64 nt, hsa
guuaugcuggauuccacagugaaaucauuuaaaaccaucuaaauaaaccacuauauauuuuaug

SEQ ID NO: 712811 - RNA, 64 nt, hsa
acagccucacacuugaaagacgguguuugguuucccaucuaaucaacuuaagggaagccggcau

SEQ ID NO: 712812 - RNA, 64 nt, hsa
cuugaauccauuagccaggcuugggaugaaaggaccaucuaaaaucaugcuagucuaaaccaug

SEQ ID NO: 712813 - RNA, 64 nt, hsa
agacaggaagguggugcuuacauccuuaaaggcaccaucuaauagcggguuacuuucacauaca

SEQ ID NO: 712814 - RNA, 64 nt, hsa
ggcuuuuacuucuuuuuuauauguaaauaauaagccaucuaaguguaaaaguggcucauaucuu

SEQ ID NO: 712815 - RNA, 64 nt, hsa
uaagccacccggcuaccuaauuccucaguaaccuccaucuaaaaucuccaaggaagcaauaaau

SEQ ID NO: 712816 - RNA, 64 nt, hsa
gaggaagagauacaucauuuuuuaguauuaaggaccaucuaagacagcucuauuuuuuuuuugc

SEQ ID NO: 712817 - RNA, 64 nt, hsa
uggaccuuggauuuuuauuuuggcaauuguaacuccaucuaaucaagaaagaauaaaaguuuau

SEQ ID NO: 712818 - RNA, 64 nt, hsa
uagagagcccagaaaucaaccugcacaccuaccgccaucuaaucuucaauagaaaugggcaaug

SEQ ID NO: 712819 - RNA, 64 nt, hsa
ugacgaaguuuucugauguggcaaaggauauuucccaucuaauaccaguuucucauuuauauuu

SEQ ID NO: 712820 - RNA, 64 nt, hsa
aaacagccaaacaagcuuaaccaauuagaaaccaccaucuaaccucuaacuagguccuuucaac

SEQ ID NO: 712821 - RNA, 64 nt, hsa
accugacacucaagaguggcuagcuacacagaguccaucuaauuuuugcaacuuccuguggcca

SEQ ID NO: 712822 - RNA, 64 nt, hsa
acugucaauccauugauuuaucuccuccugucccccaucuaaaauacccaugcugcuuuucuga

SEQ ID NO: 712823 - RNA, 64 nt, hsa
uuuacaagaugaaauaauagauaaaagcuauacuccaucuaaaauaagacaugccugaaauuug

SEQ ID NO: 712824 - RNA, 64 nt, hsa
aaaacugaaacccaguccuucaagcaucagcuucccaucuaaagaugcacguuagaugaagaua

SEQ ID NO: 712825 - RNA, 64 nt, hsa
gaauguguuucuuucugguuaaaaaaaggaaaaaccaucuaagaaaauauauauguauguaugu

SEQ ID NO: 712826 - RNA, 61 nt, hsa
acgaugacauuuugugcuaaauuugcauauaccaucuaaaauccuuuuuuaaaaaaauuua

SEQ ID NO: 712827 - RNA, 64 nt, hsa
uagguacugugcccaggaaggcugggugaagugaccaucuaaauugcaggauggugaaauuauc

SEQ ID NO: 712828 - RNA, 64 nt, hsa
caaaaguauuuugaaaaaucauguauacccucacccaucuaaguugauaucuaaaauuuuaucu

SEQ ID NO: 712829 - RNA, 64 nt, hsa
aucaugaacagguuaaagauaagauuucaagaagccaucuaagaauacagaaccaaauuggauc

SEQ ID NO: 712830 - RNA, 64 nt, hsa
aaaucuuaauuuccaaguuauacuuguucuagguccaucuaaauggucuacagagaacuucagu

SEQ ID NO: 712831 - RNA, 64 nt, hsa
acaugcuguucucucuguugagauugccuuauuuccaucuaacauucucucuccugcuauucug

SEQ ID NO: 712832 - RNA, 64 nt, hsa
uucaacuauaacugcuguuuucugacuaaaauaaccaucuaaccacuuguuucuaaggcacugc

SEQ ID NO: 712833 - RNA, 64 nt, hsa
uuugcccuaucauuuauuuacaucuauguaucuaccaucuaaucuaugcauguauguaggcaau

SEQ ID NO: 712834 - RNA, 64 nt, hsa
ggguggggaaggcagagaucucuguuauucugguccaucuaaugauguaacuucuuucaguuau

SEQ ID NO: 712835 - RNA, 64 nt, hsa
uuucuaacacaacaaagugggaccaucucuauucccaucuaagccacucaaauugcugagugcu

SEQ ID NO: 712836 - RNA, 64 nt, hsa
auuuaacuuuaaaaacccacuuauugauaccuuaccaucuaaaaugugugauuuuuauagucuc

SEQ ID NO: 712837 - RNA, 64 nt, hsa
ucugaaucguaccuggauucugugccuaccugcuccaucuaaagcagaaaacuccacaacuaag

SEQ ID NO: 712838 - RNA, 64 nt, hsa
uuuuucuaccaaagaucacagaccagaaaaaguuccaucuaaaauaucaugcccaggaaagcac

SEQ ID NO: 712839 - RNA, 64 nt, hsa
gcuuauuucuaacuauuaggaggaaugugcuuuuccaucuaaaauacucaccaaaauauaguua

SEQ ID NO: 712840 - RNA, 64 nt, hsa
gguucugccuucaaggguuguuggaaaauaguccccaucuaauauguauaggagcucuuaaaaa

SEQ ID NO: 712841 - RNA, 64 nt, hsa
gucuugucucacuuuggacugggacaguggaugcccaucuaaaaguuaagugucauuucuuuua

SEQ ID NO: 712842 - RNA, 64 nt, hsa
uuuaguuauuccuuucuuuacccaccuaaacuauccaucuaauccaggauucccucacucuuuu

SEQ ID NO: 712843 - RNA, 64 nt, hsa
ccagcguuuauucuuuuuuccuuuuuucagaucaccaucuaaguuacaucuuuagcucaggucc

SEQ ID NO: 712844 - RNA, 64 nt, hsa
aaauugggaaacaguuguuagcaaacccuuucaaccaucuaaaugaaaacacacaaauugaaaa

SEQ ID NO: 712845 - RNA, 64 nt, hsa
ugcugugacuaauccaauauacucagaauguuauccaucuaaagcauuuuucauaucucaacua

SEQ ID NO: 712846 - RNA, 64 nt, hsa
uggaaggcugggaaacuccuggaagacaugauaaccaucuaauccaguaaggagaaacagagag

SEQ ID NO: 712847 - RNA, 64 nt, hsa
gaguaagaccuguuguuuuggaaggucugcuccaccaucuaagagcacuguuuuuuuuuuuuug

SEQ ID NO: 712848 - RNA, 64 nt, hsa
ucaguuucuuagggauggacuauggcccagucccccaucuaaguggugcuuugcaaaugucuug

SEQ ID NO: 712849 - RNA, 64 nt, hsa
gagcgggugcuacacccggcaagacagagcgucuccaucuaaaauuccuagggcaagcuuccaa

SEQ ID NO: 712850 - RNA, 64 nt, hsa
uaccacuuaccuaugagguaaugcuuguuaucuuccaucuaauaaaaaucugcugcagaugugu

SEQ ID NO: 712851 - RNA, 64 nt, hsa
aauguuucucaacugguuucuacugagcaaaauaccaucuaaaaggagaaugugaauaguugua

SEQ ID NO: 712852 - RNA, 64 nt, hsa
aaaaggucuuuaaaauauuguugaacacuugaagccaucuaaaguaaaaagggaauuaugaguu

SEQ ID NO: 712853 - RNA, 64 nt, hsa
uugccgcagcacaaucccguggacagagcuuacuccaucuaacucguuuucaagugcaugauuu

SEQ ID NO: 712854 - RNA, 64 nt, hsa
aaugccguagugacuugcuguggaccaaguccuuccaucuaauagaagcuccaggggcuccuuc

SEQ ID NO: 712855 - RNA, 64 nt, hsa
ggcagaaccuggaggugucagaggcucaacuccuccaucuaaccagcaggcucccagagucccc

SEQ ID NO: 712856 - RNA, 64 nt, hsa
aggcaccaccaacuagacauguguucauaaauucccaucuaagaaacacugggaggcacagcag

SEQ ID NO: 712857 - RNA, 64 nt, hsa
uuguugcuuaaucccugcagcauucaagguuaauccaucuaagugacauuuuugaaauuccagc

SEQ ID NO: 712858 - RNA, 64 nt, hsa
cuguuuuagauuuuuuuuuuuuuuccuuuucuagccaucuaaauugacucuuccaauauagguc

SEQ ID NO: 712859 - RNA, 64 nt, hsa
uuuugccaaauacacugacauuuaaaauagugauccaucuaaauuuuuuucagcuggguuuuga

SEQ ID NO: 712860 - RNA, 64 nt, hsa
ugccacuguggaaacagguucuagauuucauacuccaucuaaagucauuuuucaguuacaugua

SEQ ID NO: 712861 - RNA, 64 nt, hsa
ucuuuuacuuuauacucacuuaaaaucaagaaucccaucuaaaacacauagguaccuuaucuga

SEQ ID NO: 712862 - RNA, 64 nt, hsa
ucugcauaccccccgccccccaacguguagcucuccaucuaaguuuuggauaaacugaaguggc

SEQ ID NO: 712863 - RNA, 64 nt, hsa
caaacagcaauuugauucuguacuuuuaauuuggccaucuaaacugugcaguggucuaccucuu

SEQ ID NO: 712864 - RNA, 64 nt, hsa
auauuucccaguacuuuucacaaucauuuuuuacccaucuaacucuauguuuuguggcuucccg

SEQ ID NO: 712865 - RNA, 64 nt, hsa
cagcugccaucuuagaugugcucuuuggggaagcccaucuaacaggaggacauugguuuggggg

SEQ ID NO: 712866 - RNA, 64 nt, hsa
gagaucucuccucagcuggaaugaggaauguaguccaucuaaacugcuugcuaggcucaauuac

SEQ ID NO: 712867 - RNA, 64 nt, hsa
cgucuuuucagucuacucuaccuaaagugcacuaccaucuaagaagacgagcagugaaaaccuu

SEQ ID NO: 712868 - RNA, 64 nt, hsa
augccaggaugaaugaagaguuuacuaaaaguaaccaucuaaagagcuuguggccaaaccagca

SEQ ID NO: 712869 - RNA, 64 nt, hsa
cagacaaugccauuucuccccaccacggaaccuuccaucuaagauuucuuccagggaaugccag

SEQ ID NO: 712870 - RNA, 64 nt, hsa
acaucuuggagaaccuuucuuacucauuucagucccaucuaaaaaugugucagcuauucuaaau

SEQ ID NO: 712871 - RNA, 64 nt, hsa
aauugagaaucuaaaccaagagaagugagacaaaccaucuaauaucuguaucaugcuauuaaua

SEQ ID NO: 712872 - RNA, 64 nt, hsa
gcuauauggcaaauagguaucaucaaugaguuaaccaucuaaaaauaaaagaguggaagcccua

SEQ ID NO: 712873 - RNA, 64 nt, hsa
uuuuauuucguuuuuguuuugauccagugcucucccaucuaacaacuaaacaggagccauuuca

SEQ ID NO: 712874 - RNA, 64 nt, hsa
gcgaccugcugagggcuugucugcucccacagcaccaucuaagaccccuccucuagaagugggg

SEQ ID NO: 712875 - RNA, 64 nt, hsa
ccagacuguuuuacaagagagaaauuagcauauuccaucuaauacaguaugauguaacuaaugu

SEQ ID NO: 712876 - RNA, 64 nt, hsa
uaacagucagaaccacuaaugggugucaucuuggccaucuaaacaucaucaauuucuaaaaaca

SEQ ID NO: 712877 - RNA, 64 nt, hsa
cuucuguucuuagcacugccagggucauugacuuccaucuaagcuugcaucaggaagauguucc

SEQ ID NO: 712878 - RNA, 64 nt, hsa
acgguuuccugccucccugagacccugaguccugccaucuaacugugaucauugcccuauccga

SEQ ID NO: 712879 - RNA, 64 nt, hsa
uuccggcugcccuuucuaggugauuggaaucagcccaucuaaagcagucuuuauaugcauuccg

SEQ ID NO: 712880 - RNA, 64 nt, hsa
acuugauggcucucaagaccuuagaaccccagaaccaucuaagacaugggauucagugaucaug

SEQ ID NO: 712881 - RNA, 64 nt, hsa
cugcccuaagggacuuaacuuguuugguaguuagccaucuaaugcuuguuuaugauauuucuug

SEQ ID NO: 712882 - RNA, 64 nt, hsa
uagagggcccagaaauaaagcuacacaccuacaaccaucuaaucuuugacaaaguugacaaaaa

SEQ ID NO: 712883 - RNA, 64 nt, hsa
ugagccacaaccuucuguaauucacuucauacauccaucuaaauggauaccuuuccauccccuc

SEQ ID NO: 712884 - RNA, 64 nt, hsa
ggaauuuaguauaaaggccaaucuguccugaaguccaucuaauguggugaaucacugaaagucu

SEQ ID NO: 712885 - RNA, 64 nt, hsa
uaguuuugccaauuaccaguagacacuaguggaaccaucuaacuggaacuuccucucuccuucc

SEQ ID NO: 712886 - RNA, 61 nt, hsa
agcgcccgacucacagaugagcgggagacagccaucuaaacagacucacuaacuauuggca

SEQ ID NO: 712887 - RNA, 64 nt, hsa
aaggaagagaaagaucaacucaccugcaguuaaaccaucuaaagagaagaaagaccacuggaga

SEQ ID NO: 712888 - RNA, 64 nt, hsa
cuguucucuuccacucuccuugcuacccagaaauccaucuaaauaccugcccugacaugcacac

SEQ ID NO: 712889 - RNA, 64 nt, hsa
gccgcgccuccuccucuguccacggaaccgcugcccaucuaaccuucguaaagaccugucuccu

SEQ ID NO: 712890 - RNA, 64 nt, hsa
acugcacuccagccugggcaacaagaacaaaacuccaucuaaagaagaaaaagaaaaacugaag

SEQ ID NO: 712891 - RNA, 64 nt, hsa
ucuauauuuauuauagcguuuaggcauuucuugaccaucuaaugaguguaaaacuguaccacug

SEQ ID NO: 712892 - RNA, 64 nt, hsa
cugccacugcacuccagccugggagggugagacuccaucuaaaaaaaauaaaauaaauggcaac

SEQ ID NO: 712893 - RNA, 64 nt, hsa
gaccuugggccauaauuucugagccucgguuuccccaucuaaggaacagauguggucguuccgc

SEQ ID NO: 712894 - RNA, 64 nt, hsa
gggcuccccugaauaucuucucugcucacuuccaccaucuaagaggaaaaggugaguugcucau

SEQ ID NO: 712895 - RNA, 64 nt, hsa
uuaguucaacaccaucaugguggauucauuuauaccaucuaauauaugacacacuguuguagua

SEQ ID NO: 712896 - RNA, 64 nt, hsa
acugaugaguaaacuugcauucacuuccuucaaaccaucuaauuuucuccugaaguuuuggcag

SEQ ID NO: 712897 - RNA, 64 nt, hsa
gugcuggguguuuucaccaccauccccccaucccccaucuaagaauccuaagaggcaggcgauc

SEQ ID NO: 712898 - RNA, 64 nt, hsa
caugcaacuguauuuauuuuugaugacaagacucccaucuaaaguuuuucuccugccugaucau

SEQ ID NO: 712899 - RNA, 64 nt, hsa
cuuuugauaggccauuagcauggggagauugaauccaucuaaucaggaguugggcugaguuugu

SEQ ID NO: 712900 - RNA, 64 nt, hsa
ugcuucauccagggagggagaaggcuuuucagcaccaucuaauguuuuaaaaggcacuaguuuu

SEQ ID NO: 712901 - RNA, 64 nt, hsa
cuguguuugaacuauaaaaagcaccggaucuuuuccaucuaauuccgcaaaaauugaucauuug

SEQ ID NO: 712902 - RNA, 64 nt, hsa
gaucacagccccacccuugucccucagcaacaucccaucuaagcauuccacacugcagggagga

SEQ ID NO: 712903 - RNA, 64 nt, hsa
agggaccagggagaugccacuaccccuugauuuuccaucuaaaaauauacauguuuauguaaac

SEQ ID NO: 712904 - RNA, 64 nt, hsa
caggcaauucuaagaucuuccacaaaacaucuagccaucuaaaauggagagaugaaucauucua

SEQ ID NO: 712905 - RNA, 64 nt, hsa; identical to SEQ ID NO: 272847

SEQ ID NO: 712906 - RNA, 64 nt, hsa; identical to SEQ ID NO: 272848

SEQ ID NO: 712907 - RNA, 64 nt, hsa; identical to SEQ ID NO: 272849

SEQ ID NO: 712908 - RNA, 64 nt, hsa; identical to SEQ ID NO: 272850

SEQ ID NO: 712909 - RNA, 64 nt, hsa; identical to SEQ ID NO: 272851

SEQ ID NO: 712910 - RNA, 64 nt, hsa; identical to SEQ ID NO: 272852

SEQ ID NO: 712911 - RNA, 64 nt, hsa; identical to SEQ ID NO: 272853

SEQ ID NO: 712912 - RNA, 64 nt, hsa; identical to SEQ ID NO: 272854

SEQ ID NO: 712913 - RNA, 64 nt, hsa; identical to SEQ ID NO: 272855

SEQ ID NO: 712914 - RNA, 64 nt, hsa; identical to SEQ ID NO: 272856

SEQ ID NO: 712915 - RNA, 64 nt, hsa; identical to SEQ ID NO: 272857

SEQ ID NO: 712916 - RNA, 64 nt, hsa; identical to SEQ ID NO: 272858

SEQ ID NO: 712917 - RNA, 64 nt, hsa; identical to SEQ ID NO: 272859

SEQ ID NO: 712918 - RNA, 64 nt, hsa; identical to SEQ ID NO: 379260

SEQ ID NO: 712919 - RNA, 64 nt, hsa; identical to SEQ ID NO: 379261

SEQ ID NO: 712920 - RNA, 64 nt, hsa; identical to SEQ ID NO: 379262

SEQ ID NO: 712921 - RNA, 64 nt, hsa; identical to SEQ ID NO: 379263

SEQ ID NO: 712922 - RNA, 64 nt, hsa; identical to SEQ ID NO: 379264

SEQ ID NO: 712923 - RNA, 64 nt, hsa; identical to SEQ ID NO: 379265

SEQ ID NO: 712924 - RNA, 64 nt, hsa; identical to SEQ ID NO: 379266

SEQ ID NO: 712925 - RNA, 64 nt, hsa; identical to SEQ ID NO: 379267

SEQ ID NO: 712926 - RNA, 64 nt, hsa; identical to SEQ ID NO: 379268

SEQ ID NO: 712927 - RNA, 64 nt, hsa; identical to SEQ ID NO: 379269

SEQ ID NO: 712928 - RNA, 64 nt, hsa; identical to SEQ ID NO: 379270

SEQ ID NO: 712929 - RNA, 64 nt, hsa; identical to SEQ ID NO: 379271

SEQ ID NO: 712930 - RNA, 64 nt, hsa; identical to SEQ ID NO: 379272

SEQ ID NO: 712931 - RNA, 64 nt, hsa; identical to SEQ ID NO: 379273

SEQ ID NO: 712932 - RNA, 64 nt, hsa
aaaugcuucauugaaagcuucaaaguuuauaugccuggugcacagugcuuagaaguaagcaauu

SEQ ID NO: 712933 - RNA, 64 nt, hsa
acuugucuccauguguauccaugcauuauauacccuggugcaaucacacgacugucaucuaaag

SEQ ID NO: 712934 - RNA, 64 nt, hsa
ccagcaagaucuggggcugcagagaacagaagagcuggugcacuuaauccagcucugcccuugg

SEQ ID NO: 712935 - RNA, 64 nt, hsa
cacacagugggugcugggccucgccccgaagcuucuggugcagcagccucuggugcugucuccg

SEQ ID NO: 712936 - RNA, 64 nt, hsa
aggucugccaggucagauggagacgcagaaccugcuggugcaagcugggcagguccugaccaac

SEQ ID NO: 712937 - RNA, 64 nt, hsa
ucccaggagcagugaguugugaguggaaagaaggcuggugcagacccagcugccuuagacagau

SEQ ID NO: 712938 - RNA, 64 nt, hsa
cacuggagacaagcaugagcuugagccccauggccuggugcagggcugcgugcauugaggccgc

SEQ ID NO: 712939 - RNA, 64 nt, hsa
gcuuccuuaagccauugcccuggcugggguugggcuggugcagcccagcuggcggaggggcgaa

SEQ ID NO: 712940 - RNA, 64 nt, hsa
gggagguccccaccccuccccuccaggagcaggccuggugcagcccacucugugccuggacauc

SEQ ID NO: 712941 - RNA, 64 nt, hsa
acucugagccaagccacuggggccaugcguaugacuggugcagggaggcaaggcccacauucuc

SEQ ID NO: 712942 - RNA, 64 nt, hsa
cccugaaccccccuaggugggcuggaaucagcaucuggugcaaagcucugugaccacugcugua

SEQ ID NO: 712943 - RNA, 64 nt, hsa
gcuguaccacauuaugcagagcacacaggacaggcuggugcaccuccaggcugugccaggaaac

SEQ ID NO: 712944 - RNA, 64 nt, hsa
aagcaagccuguccuuccugacccggcgguuaaccuggugcacuuuuguuccuuuguuaacugu

SEQ ID NO: 712945 - RNA, 64 nt, hsa
ucuucuacuguaucgccagugccuggaacagugucuggugcacauaauaggugcucaauaaaaa

SEQ ID NO: 712946 - RNA, 64 nt, hsa
ugugcugggcuagccugugaccccucgggacugccuggugcaggugguggcagcuggagggacc

SEQ ID NO: 712947 - RNA, 64 nt, hsa
aggguuuauuagucccugccagcagcuguccucccuggugcagguggccuggccagcccacugg

SEQ ID NO: 712948 - RNA, 64 nt, hsa
gcggaccccucacugugcgccugugcagggggugcuggugcacguggcaguguggauuuccagu

SEQ ID NO: 712949 - RNA, 64 nt, hsa
gggcugcaacuuuucuguugauccuggaauguagcuggugcagugagagggaaagagaauugaa

SEQ ID NO: 712950 - RNA, 64 nt, hsa
ccagcagcccaagggcuccagacacaccugaacacaucgugaugaugacguccucucaacucuc

SEQ ID NO: 712951 - RNA, 64 nt, hsa
uauuuugagauguuuuuuccuuacaaugugaacucaucgugaucuuggaaaucaauaaagucaa

SEQ ID NO: 712952 - RNA, 64 nt, hsa
gcgggcacaaacguccccaggcugggcucauucccaucgugagugagcccaggugaggacauag

SEQ ID NO: 712953 - RNA, 64 nt, hsa
ggcgcugcagguacuuccuccugauggccaagagcaucgugacccuucagggccagaaggaggg

SEQ ID NO: 712954 - RNA, 64 nt, hsa
acuccccaaaacaccccuuuccaguuacaauuagcaucgugauccaagcagaugccacauggaa

SEQ ID NO: 712955 - RNA, 64 nt, hsa
auuucagagaagggauaaauagaagccugcacagcaucgugaauuaacugaaguguuuaaaaag

SEQ ID NO: 712956 - RNA, 64 nt, hsa
cagcccuaggagucugcgagagccuccuugguuccaucgugaagccauaaacaggaaugccuuu

SEQ ID NO: 712957 - RNA, 64 nt, hsa
caccguguuagccaggauggucuugaucuccugacaucgugaucugucugccucggacucccaa

SEQ ID NO: 712958 - RNA, 64 nt, hsa
auaccagugacacccagucauccagcagcgucaacaucgugaugggccccucagccagggcugc

SEQ ID NO: 712959 - RNA, 64 nt, hsa
caggagggucccggcggaaagccagccccggacucaucgugacauugagaucccacuggagggu

SEQ ID NO: 712960 - RNA, 64 nt, hsa
uauguauuaacucuuaagugcaccuagcuuauuacaucgugaaagguacauuuaaaauauguua

SEQ ID NO: 712961 - RNA, 64 nt, hsa
ugagccagagaagacuugaucacaguucuccaagcaucgugauagcaaugcuuaaccccaggaa

SEQ ID NO: 712962 - RNA, 64 nt, hsa
cacacugccaccaucucaaagccaucccccuagccaucgugagcaucccagcggcaccgccauu

SEQ ID NO: 712963 - RNA, 64 nt, hsa
uuagcuuccaaauuaugcuuuauagcuguauaaacaucgugauuauauucaucuacuuagaaau

SEQ ID NO: 712964 - RNA, 64 nt, hsa
acgugcuagccauuuccagugucccaacuacugucaucgugagguuuucaucggcugugccauu

SEQ ID NO: 712965 - RNA, 64 nt, hsa
uggaaagcucugaccacuugaggccugaucugcccaucgugaagaagccuguaacacuccucug

SEQ ID NO: 712966 - RNA, 64 nt, hsa
acuuugacuuucccacuguugcuggagacaaagacaucgugaugagagaaaguucgcacaaucu

SEQ ID NO: 712967 - RNA, 64 nt, hsa
cuugggucucuuucccccaacuuuuccacauggucaucgugaaauaaaaaguccacucuggagu

SEQ ID NO: 712968 - RNA, 64 nt, hsa
cacgucuuuaaaagcaacaaaaauugaaauaagacaucgugaaaaucuugaccauuguugaaug

SEQ ID NO: 712969 - RNA, 64 nt, hsa
cccuuacuggcucagcccuggcugguuuuaccaucaucgugaugccacugggugaggcaggcaa

SEQ ID NO: 712970 - RNA, 64 nt, hsa
aauuguuugcauagaggaaggacaauaacccugccaucgugaguuaauguccgggcuggucaca

SEQ ID NO: 712971 - RNA, 64 nt, hsa
gggcaauauggauuauuuuuauaccaaggauuugcaucgugaauuacauuaaguuauuuggcaa

SEQ ID NO: 712972 - RNA, 64 nt, hsa
aagagucaucugcuugaaugugaagcaaacacagcaucgugaucacugagccaucauuuccugg

SEQ ID NO: 712973 - RNA, 64 nt, hsa
ucuaguucaguuaauucauccuguugaauugcaccaucgugaaagaugggaaaaaucgugauga

SEQ ID NO: 712974 - RNA, 64 nt, hsa
cuugaggucagaaguucaagaccagccugaccaacaucgugaaaugccgucuuuacaaaaaaau

SEQ ID NO: 712975 - RNA, 64 nt, hsa
gagucuucugauuggcagcuguggcugucucuaucaucgugacuguggacuucccugcuguugc

SEQ ID NO: 712976 - RNA, 64 nt, hsa
accagaucggugacuccuaaaaucugagacaggacaucgugacugcugguaguaauaugguggu

SEQ ID NO: 712977 - RNA, 64 nt, hsa
auaggcuggcaagagcuguuuuugcauccauuugcaucgugaagacuggcauuuugauacuuca

SEQ ID NO: 712978 - RNA, 64 nt, hsa
gaugccuuagacggggugugcaguauuuuagguacaucgugagcaaggagccugcauucccagg

SEQ ID NO: 712979 - RNA, 64 nt, hsa
cuugcauaggcgccuagaauggggcugaugagaacaucgugaccaucagaccuacuugggagag

SEQ ID NO: 712980 - RNA, 64 nt, hsa
ucaugugggugggaaguucccagggcaguggucacaucgugagaauuagcaggaaaggcggggc

SEQ ID NO: 712981 - RNA, 64 nt, hsa
aagagauagcaauguguuuuaaguugcgcaggcccaucgugauaaggaauuaggucacaaaugg

SEQ ID NO: 712982 - RNA, 64 nt, hsa
ggauccaggcguucuuuaggauccuuggauaccacaucgugaaaucuuuuauuuuuuuacucug

SEQ ID NO: 712983 - RNA, 64 nt, hsa
cgggcggucagggguucgagaccagucuggccaacaucgugaaacccugucucuacuaaaaaug

SEQ ID NO: 712984 - RNA, 64 nt, hsa
cuucugcuccagaacucuauccacuguauuuccacaucgugagucauuuuacuuuaaaagggaa

SEQ ID NO: 712985 - RNA, 64 nt, hsa
caguggagcagagggguuacccagauuucaaccucaucgugaacccuuaugagcccauaaggaa

SEQ ID NO: 712986 - RNA, 64 nt, hsa
ggccccagauccucacacccagggagcagcugcacaucgugaaagacugaggcagcguggaugg

SEQ ID NO: 712987 - RNA, 64 nt, hsa
uuccucauaacauuuaucuuuaguuuuaugaagucaucgugaccaauguuacaguaauuucugu

SEQ ID NO: 712988 - RNA, 64 nt, hsa
uaguuggggaauugugagaugaauggagaggccccaucgugaauuaaagaugcugaccugggga

SEQ ID NO: 712989 - RNA, 64 nt, hsa
aggugggcggaucacgaggucaggagaucgagaccaucgugacuaacacagugaaaccccgucu

SEQ ID NO: 712990 - RNA, 64 nt, hsa
aauaaaguuuaaaaaugcuuuuauaucaaaggugcaucgugaccaaauuguuuaagaaaaaaaa

SEQ ID NO: 712991 - RNA, 64 nt, hsa
gcucaggaggcuucugagcuucuccuguacugugcaucgugagggccagagacaggaauguaag

SEQ ID NO: 712992 - RNA, 64 nt, hsa
gauuuguaugugcucugggcucaugaagauauugcaucgugagcugcagcaguugcacucuuuu

SEQ ID NO: 712993 - RNA, 64 nt, hsa
aacuacuuuuuaauugcaauucuagguaauugugcaucgugaugugauugcuuggcuauugucu

SEQ ID NO: 712994 - RNA, 64 nt, hsa
ugccugccucaugcucucuauagaggaggauggucaucgugacagcagcagcucaaguuagcau

SEQ ID NO: 712995 - RNA, 64 nt, hsa
uaugauuccuguggggaaacaauuucauucucuccaucgugaaaauaagugaauaagagugaag

SEQ ID NO: 712996 - RNA, 64 nt, hsa
gcagguggggacccaacuccaccccaccugucuucaucgugaggcugccacagugccugacuac

SEQ ID NO: 712997 - RNA, 64 nt, hsa
ggcccuccagucagguucuguggguuuggaagcccaucgugaaaggggcugaccuuugccccuu

SEQ ID NO: 712998 - RNA, 64 nt, hsa
gacucugaccagagaucgagaccauccuagccaacaucgugaaaccccaucucuacuaaaaaua

SEQ ID NO: 712999 - RNA, 64 nt, hsa
uuuaggggccugggcuggggggauggggagggcacaucgugacuguguuuuucauaacuuaugu

SEQ ID NO: 713000 - RNA, 64 nt, hsa
cccaccccaccauguccccauuacaccagagggccaucgugacguagacaggaugccaggggcc

SEQ ID NO: 713001 - RNA, 53 nt, hsa
accagaaauccuaccgauaagcccaucgugacucaaaacucacuuguauaaua

SEQ ID NO: 713002 - RNA, 64 nt, hsa
cuguggacaguuuuucccaagaugucccaagccucaucgugacgaggcucuuaucccacuccau

SEQ ID NO: 713003 - RNA, 64 nt, hsa
ggcccagcugggucugacaaggacccagcugucacaucgugaauauuuaaauguccugucacua

SEQ ID NO: 713004 - RNA, 64 nt, hsa
agcagcugggggcuggagcccuguuucuuugugucaucgugagcaugugccccuucccaggggc

SEQ ID NO: 713005 - RNA, 64 nt, hsa
uuuugcaucuuaagucuuagaaauuaagauauuccaucgugaggaugagagagguccucagugu

SEQ ID NO: 713006 - RNA, 64 nt, hsa
aaauuaucccaguggaacuucaacccgggcuguccaucgugacauuccgccuccuuccaccaug

SEQ ID NO: 713007 - RNA, 64 nt, hsa
caaauaccuaaggaguccccaggagcuggcuggccaucgugauaggaucugucuguccuguaaa

SEQ ID NO: 713008 - RNA, 64 nt, hsa
uuuucuuuuuuuuuuuuuaauuuuuccccccaaccaucgugauuugucuuuucaugcagauuag

SEQ ID NO: 713009 - RNA, 64 nt, hsa
ucuugcagaaucugaaugugucuccugagacaagcaucgugauagaguucacagucuuaaaagu

SEQ ID NO: 713010 - RNA, 64 nt, hsa
ggccuuguccaucugauucaggagaucacugcuccaucgugaggagcccucugaauagcccccc

SEQ ID NO: 713011 - RNA, 64 nt, hsa
acuuaugcagaguaauauuuugguucaguuuuaacaucgugacaaugagggcuuuuucuagcaa

SEQ ID NO: 713012 - RNA, 64 nt, hsa
agaaaccagcuaaaucauggcaccuucaauuugccaucgugacgcagaccuguauaaauuaggu

SEQ ID NO: 713013 - RNA, 64 nt, hsa
aaacuauucugacuagagucagguuucucauauccaucgugauaggaaggccuaagaauggcaa

SEQ ID NO: 713014 - RNA, 63 nt, hsa
aaaugaaugaauaaacaugagcuugcgcuccuagccuagagauaaauccugacuggcaucucu

SEQ ID NO: 713015 - RNA, 64 nt, hsa
ugcagcuucuaacccaggaccaugaacucaggugccuagagaagccaggcagcuaaaggacaag

SEQ ID NO: 713016 - RNA, 64 nt, hsa
cgaggaugggcuugagcuguugagagauuucugcccuagagauggccuuuguauaugggggggu

SEQ ID NO: 713017 - RNA, 64 nt, hsa
agagaauagcacuugcaaaaauacagucuugguaccuagagacugucaugcagauaguauaauu

SEQ ID NO: 713018 - RNA, 64 nt, hsa
gauggguaauagagcaggcccguguccagucauaccuagagauuuguggggggauacugaaccu

SEQ ID NO: 713019 - RNA, 64 nt, hsa
gaaccaaguaaaaggaaacaugcuagaaaacgugccuagagaagacacuucaaccuuugccuua

SEQ ID NO: 713020 - RNA, 64 nt, hsa
cuuuauugcacaaccagccuggguucuaagaaagccuagagaauuucuuauugcccuguuagaa

SEQ ID NO: 713021 - RNA, 64 nt, hsa
uucuuauugcccuguuagaaaaauuaacugagcuccuagagaagaacaauccucauguaagcuu

SEQ ID NO: 713022 - RNA, 64 nt, hsa
uuuauuuuuaauccucuuaguuuuaaauauauugccuagagacucaguuacuacccaguuugug

SEQ ID NO: 713023 - RNA, 64 nt, hsa
uagaccauacauaucugacaucagaaaagcaggcccuagagagaaguauauacuaggguacuuu

SEQ ID NO: 713024 - RNA, 64 nt, hsa
aguuccuccaauucugaccgagugcugaucauucccuagagacaccaguaaccccgggcuuagc

SEQ ID NO: 713025 - RNA, 64 nt, hsa
uccuucaaucaagguuuccaggcagagcaaauacccuagagauucucugugauauaggaaauuu

SEQ ID NO: 713026 - RNA, 64 nt, hsa
ggaugaccuaugcaaucacaccgcuuaugaccauccuagagagggcccugagcaccagcuugau

SEQ ID NO: 713027 - RNA, 64 nt, hsa
gccaaaugccauuaaugcugcuuuauccuuaggcccuagagauacugaaaguccuggggcagua

SEQ ID NO: 713028 - RNA, 64 nt, hsa
guauguuuggaguuccaaaucugcaaguggccaaccuagagauucacuccuuaucuaugaagaa

SEQ ID NO: 713029 - RNA, 64 nt, hsa
caacagggcacaugacauauacaugguggcagguccuagagaugagauccacauccuaaaaaua

SEQ ID NO: 713030 - RNA, 64 nt, hsa
ucaucucauuuaauccucccuuccucccuauuaaccuagagauuguuuuuguuuuuuauucucc

SEQ ID NO: 713031 - RNA, 64 nt, hsa
ccuccccgcccucacccgccccacucccuccuaaccuagagauuguuacagaagcugaaauugc

SEQ ID NO: 713032 - RNA, 64 nt, hsa; identical to SEQ ID NO: 109292

SEQ ID NO: 713033 - RNA, 64 nt, hsa; identical to SEQ ID NO: 109293

SEQ ID NO: 713034 - RNA, 64 nt, hsa; identical to SEQ ID NO: 109294

SEQ ID NO: 713035 - RNA, 64 nt, hsa; identical to SEQ ID NO: 109295

SEQ ID NO: 713036 - RNA, 64 nt, hsa; identical to SEQ ID NO: 109296

SEQ ID NO: 713037 - RNA, 64 nt, hsa; identical to SEQ ID NO: 109297

SEQ ID NO: 713038 - RNA, 64 nt, hsa; identical to SEQ ID NO: 109298

SEQ ID NO: 713039 - RNA, 64 nt, hsa
ucuaacuucugaaacuuuuggagcuuguuuuugcccuugauagcacguauccuuagagaauaag

SEQ ID NO: 713040 - RNA, 64 nt, hsa
uuucaguuccccacccaacugacugaagucuugaccuugauaccaccugccugggcguucuacu

SEQ ID NO: 713041 - RNA, 64 nt, hsa
auugauagcaguacugugcugucuggaauaauguccuugauacugaguugggaccagacuggcu

SEQ ID NO: 713042 - RNA, 64 nt, hsa
uguuauuuagagaucaaggaaggaagucauccuuccuugauauauauacagccuuuggguacaa

SEQ ID NO: 713043 - RNA, 64 nt, hsa
aguuucaggccccaaaauaacacgagccccuccaccuugauagcuccuugauaucccaaucuug

SEQ ID NO: 713044 - RNA, 64 nt, hsa
ccaaaauaacacgagccccuccaccuugauagcuccuugauaucccaaucuugcaguccuaacu

SEQ ID NO: 713045 - RNA, 64 nt, hsa
agccccuaacucuacugccuuccacauauugguuccuugauacauuucauaugauaucagccaa

SEQ ID NO: 713046 - RNA, 64 nt, hsa; identical to SEQ ID NO: 125091

SEQ ID NO: 713047 - RNA, 64 nt, hsa; identical to SEQ ID NO: 125092

SEQ ID NO: 713048 - RNA, 64 nt, hsa; identical to SEQ ID NO: 125093

SEQ ID NO: 713049 - RNA, 64 nt, hsa; identical to SEQ ID NO: 125094

SEQ ID NO: 713050 - RNA, 64 nt, hsa; identical to SEQ ID NO: 125095

SEQ ID NO: 713051 - RNA, 64 nt, hsa; identical to SEQ ID NO: 125096

SEQ ID NO: 713052 - RNA, 64 nt, hsa; identical to SEQ ID NO: 125097

SEQ ID NO: 713053 - RNA, 64 nt, hsa; identical to SEQ ID NO: 125098

SEQ ID NO: 713054 - RNA, 64 nt, hsa; identical to SEQ ID NO: 125099

SEQ ID NO: 713055 - RNA, 64 nt, hsa; identical to SEQ ID NO: 125100

SEQ ID NO: 713056 - RNA, 64 nt, hsa; identical to SEQ ID NO: 125101

SEQ ID NO: 713057 - RNA, 64 nt, hsa; identical to SEQ ID NO: 125102

SEQ ID NO: 713058 - RNA, 64 nt, hsa; identical to SEQ ID NO: 125103

SEQ ID NO: 713059 - RNA, 64 nt, hsa; identical to SEQ ID NO: 125104

SEQ ID NO: 713060 - RNA, 64 nt, hsa; identical to SEQ ID NO: 125105

SEQ ID NO: 713061 - RNA, 64 nt, hsa; identical to SEQ ID NO: 125106

SEQ ID NO: 713062 - RNA, 64 nt, hsa; identical to SEQ ID NO: 125107

SEQ ID NO: 713063 - RNA, 64 nt, hsa; identical to SEQ ID NO: 125108

SEQ ID NO: 713064 - RNA, 64 nt, hsa; identical to SEQ ID NO: 125109

SEQ ID NO: 713065 - RNA, 64 nt, hsa; identical to SEQ ID NO: 125110

SEQ ID NO: 713066 - RNA, 64 nt, hsa; identical to SEQ ID NO: 125111

SEQ ID NO: 713067 - RNA, 64 nt, hsa; identical to SEQ ID NO: 125112

SEQ ID NO: 713068 - RNA, 64 nt, hsa; identical to SEQ ID NO: 125113

SEQ ID NO: 713069 - RNA, 64 nt, hsa; identical to SEQ ID NO: 125114

SEQ ID NO: 713070 - RNA, 64 nt, hsa; identical to SEQ ID NO: 125115

SEQ ID NO: 713071 - RNA, 64 nt, hsa; identical to SEQ ID NO: 125116

SEQ ID NO: 713072 - RNA, 64 nt, hsa; identical to SEQ ID NO: 125117

SEQ ID NO: 713073 - RNA, 64 nt, hsa; identical to SEQ ID NO: 125118

SEQ ID NO: 713074 - RNA, 64 nt, hsa; identical to SEQ ID NO: 125119

SEQ ID NO: 713075 - RNA, 64 nt, hsa; identical to SEQ ID NO: 125120

SEQ ID NO: 713076 - RNA, 64 nt, hsa; identical to SEQ ID NO: 125121

SEQ ID NO: 713077 - RNA, 64 nt, hsa; identical to SEQ ID NO: 125122

SEQ ID NO: 713078 - RNA, 64 nt, hsa; identical to SEQ ID NO: 125123

SEQ ID NO: 713079 - RNA, 64 nt, hsa; identical to SEQ ID NO: 125124

SEQ ID NO: 713080 - RNA, 64 nt, hsa; identical to SEQ ID NO: 125125

SEQ ID NO: 713081 - RNA, 64 nt, hsa; identical to SEQ ID NO: 125126

SEQ ID NO: 713082 - RNA, 64 nt, hsa; identical to SEQ ID NO: 125127

SEQ ID NO: 713083 - RNA, 64 nt, hsa; identical to SEQ ID NO: 125128

SEQ ID NO: 713084 - RNA, 64 nt, hsa; identical to SEQ ID NO: 125129

SEQ ID NO: 713085 - RNA, 64 nt, hsa; identical to SEQ ID NO: 125130

SEQ ID NO: 713086 - RNA, 64 nt, hsa; identical to SEQ ID NO: 125131

SEQ ID NO: 713087 - RNA, 64 nt, hsa; identical to SEQ ID NO: 125132

SEQ ID NO: 713088 - RNA, 64 nt, hsa; identical to SEQ ID NO: 125133

SEQ ID NO: 713089 - RNA, 64 nt, hsa; identical to SEQ ID NO: 125134

SEQ ID NO: 713090 - RNA, 64 nt, hsa; identical to SEQ ID NO: 125135

SEQ ID NO: 713091 - RNA, 64 nt, hsa; identical to SEQ ID NO: 125136

SEQ ID NO: 713092 - RNA, 64 nt, hsa; identical to SEQ ID NO: 125137

SEQ ID NO: 713093 - RNA, 64 nt, hsa; identical to SEQ ID NO: 125138

SEQ ID NO: 713094 - RNA, 64 nt, hsa; identical to SEQ ID NO: 125139

SEQ ID NO: 713095 - RNA, 64 nt, hsa; identical to SEQ ID NO: 125140

SEQ ID NO: 713096 - RNA, 64 nt, hsa; identical to SEQ ID NO: 125141

SEQ ID NO: 713097 - RNA, 64 nt, hsa; identical to SEQ ID NO: 125142

SEQ ID NO: 713098 - RNA, 64 nt, hsa; identical to SEQ ID NO: 125143

SEQ ID NO: 713099 - RNA, 64 nt, hsa; identical to SEQ ID NO: 125144

SEQ ID NO: 713100 - RNA, 64 nt, hsa; identical to SEQ ID NO: 125145

SEQ ID NO: 713101 - RNA, 64 nt, hsa; identical to SEQ ID NO: 125146

SEQ ID NO: 713102 - RNA, 64 nt, hsa; identical to SEQ ID NO: 125147

SEQ ID NO: 713103 - RNA, 64 nt, hsa; identical to SEQ ID NO: 125148

SEQ ID NO: 713104 - RNA, 64 nt, hsa; identical to SEQ ID NO: 125149

SEQ ID NO: 713105 - RNA, 64 nt, hsa; identical to SEQ ID NO: 125150

SEQ ID NO: 713106 - RNA, 64 nt, hsa; identical to SEQ ID NO: 125151

SEQ ID NO: 713107 - RNA, 64 nt, hsa; identical to SEQ ID NO: 125152

SEQ ID NO: 713108 - RNA, 64 nt, hsa; identical to SEQ ID NO: 125153

SEQ ID NO: 713109 - RNA, 64 nt, hsa; identical to SEQ ID NO: 125154

SEQ ID NO: 713110 - RNA, 64 nt, hsa; identical to SEQ ID NO: 125155

SEQ ID NO: 713111 - RNA, 64 nt, hsa; identical to SEQ ID NO: 125156

SEQ ID NO: 713112 - RNA, 64 nt, hsa; identical to SEQ ID NO: 125157

SEQ ID NO: 713113 - RNA, 64 nt, hsa; identical to SEQ ID NO: 125158

SEQ ID NO: 713114 - RNA, 64 nt, hsa; identical to SEQ ID NO: 125159

SEQ ID NO: 713115 - RNA, 64 nt, hsa; identical to SEQ ID NO: 125160

SEQ ID NO: 713116 - RNA, 64 nt, hsa; identical to SEQ ID NO: 125161

SEQ ID NO: 713117 - RNA, 64 nt, hsa; identical to SEQ ID NO: 125162

SEQ ID NO: 713118 - RNA, 64 nt, hsa; identical to SEQ ID NO: 125163

SEQ ID NO: 713119 - RNA, 64 nt, hsa; identical to SEQ ID NO: 125164

SEQ ID NO: 713120 - RNA, 64 nt, hsa; identical to SEQ ID NO: 125165

SEQ ID NO: 713121 - RNA, 64 nt, hsa; identical to SEQ ID NO: 125166

SEQ ID NO: 713122 - RNA, 64 nt, hsa; identical to SEQ ID NO: 125167

SEQ ID NO: 713123 - RNA, 64 nt, hsa; identical to SEQ ID NO: 125168

SEQ ID NO: 713124 - RNA, 64 nt, hsa; identical to SEQ ID NO: 125169

SEQ ID NO: 713125 - RNA, 64 nt, hsa; identical to SEQ ID NO: 125170

SEQ ID NO: 713126 - RNA, 64 nt, hsa; identical to SEQ ID NO: 125171

SEQ ID NO: 713127 - RNA, 64 nt, hsa; identical to SEQ ID NO: 125172

SEQ ID NO: 713128 - RNA, 64 nt, hsa; identical to SEQ ID NO: 125173

SEQ ID NO: 713129 - RNA, 64 nt, hsa; identical to SEQ ID NO: 125174

SEQ ID NO: 713130 - RNA, 64 nt, hsa; identical to SEQ ID NO: 125175

SEQ ID NO: 713131 - RNA, 64 nt, hsa; identical to SEQ ID NO: 125176

SEQ ID NO: 713132 - RNA, 64 nt, hsa; identical to SEQ ID NO: 125177

SEQ ID NO: 713133 - RNA, 64 nt, hsa; identical to SEQ ID NO: 125178

SEQ ID NO: 713134 - RNA, 64 nt, hsa; identical to SEQ ID NO: 125179

SEQ ID NO: 713135 - RNA, 64 nt, hsa; identical to SEQ ID NO: 125180

SEQ ID NO: 713136 - RNA, 64 nt, hsa; identical to SEQ ID NO: 125181

SEQ ID NO: 713137 - RNA, 64 nt, hsa; identical to SEQ ID NO: 125182

SEQ ID NO: 713138 - RNA, 64 nt, hsa; identical to SEQ ID NO: 125183

SEQ ID NO: 713139 - RNA, 64 nt, hsa; identical to SEQ ID NO: 125184

SEQ ID NO: 713140 - RNA, 64 nt, hsa; identical to SEQ ID NO: 125185

SEQ ID NO: 713141 - RNA, 64 nt, hsa; identical to SEQ ID NO: 125186

SEQ ID NO: 713142 - RNA, 64 nt, hsa; identical to SEQ ID NO: 125187

SEQ ID NO: 713143 - RNA, 64 nt, hsa; identical to SEQ ID NO: 125188

SEQ ID NO: 713144 - RNA, 64 nt, hsa; identical to SEQ ID NO: 125189

SEQ ID NO: 713145 - RNA, 58 nt, hsa; identical to SEQ ID NO: 125190

SEQ ID NO: 713146 - RNA, 64 nt, hsa; identical to SEQ ID NO: 125191

SEQ ID NO: 713147 - RNA, 64 nt, hsa; identical to SEQ ID NO: 125192

SEQ ID NO: 713148 - RNA, 64 nt, hsa; identical to SEQ ID NO: 125193

SEQ ID NO: 713149 - RNA, 64 nt, hsa; identical to SEQ ID NO: 125194

SEQ ID NO: 713150 - RNA, 64 nt, hsa; identical to SEQ ID NO: 125195

SEQ ID NO: 713151 - RNA, 64 nt, hsa; identical to SEQ ID NO: 125196

SEQ ID NO: 713152 - RNA, 64 nt, hsa; identical to SEQ ID NO: 125197

SEQ ID NO: 713153 - RNA, 64 nt, hsa; identical to SEQ ID NO: 125198

SEQ ID NO: 713154 - RNA, 64 nt, hsa; identical to SEQ ID NO: 125199

SEQ ID NO: 713155 - RNA, 64 nt, hsa; identical to SEQ ID NO: 125200

SEQ ID NO: 713156 - RNA, 64 nt, hsa; identical to SEQ ID NO: 125201

SEQ ID NO: 713157 - RNA, 64 nt, hsa; identical to SEQ ID NO: 125202

SEQ ID NO: 713158 - RNA, 64 nt, hsa; identical to SEQ ID NO: 125203

SEQ ID NO: 713159 - RNA, 64 nt, hsa; identical to SEQ ID NO: 125204

SEQ ID NO: 713160 - RNA, 64 nt, hsa; identical to SEQ ID NO: 125205

SEQ ID NO: 713161 - RNA, 64 nt, hsa; identical to SEQ ID NO: 125206

SEQ ID NO: 713162 - RNA, 64 nt, hsa; identical to SEQ ID NO: 125207

SEQ ID NO: 713163 - RNA, 64 nt, hsa; identical to SEQ ID NO: 125208

SEQ ID NO: 713164 - RNA, 64 nt, hsa; identical to SEQ ID NO: 125209

SEQ ID NO: 713165 - RNA, 64 nt, hsa; identical to SEQ ID NO: 125210

SEQ ID NO: 713166 - RNA, 64 nt, hsa; identical to SEQ ID NO: 125211

SEQ ID NO: 713167 - RNA, 64 nt, hsa; identical to SEQ ID NO: 125212

SEQ ID NO: 713168 - RNA, 64 nt, hsa; identical to SEQ ID NO: 125213

SEQ ID NO: 713169 - RNA, 64 nt, hsa; identical to SEQ ID NO: 125214

SEQ ID NO: 713170 - RNA, 64 nt, hsa; identical to SEQ ID NO: 125215

SEQ ID NO: 713171 - RNA, 64 nt, hsa; identical to SEQ ID NO: 125216

SEQ ID NO: 713172 - RNA, 64 nt, hsa; identical to SEQ ID NO: 125217

SEQ ID NO: 713173 - RNA, 64 nt, hsa; identical to SEQ ID NO: 125218

SEQ ID NO: 713174 - RNA, 64 nt, hsa; identical to SEQ ID NO: 125219

SEQ ID NO: 713175 - RNA, 64 nt, hsa; identical to SEQ ID NO: 125220

SEQ ID NO: 713176 - RNA, 64 nt, hsa; identical to SEQ ID NO: 125221

SEQ ID NO: 713177 - RNA, 64 nt, hsa; identical to SEQ ID NO: 125222

SEQ ID NO: 713178 - RNA, 64 nt, hsa; identical to SEQ ID NO: 125223

SEQ ID NO: 713179 - RNA, 64 nt, hsa; identical to SEQ ID NO: 125224

SEQ ID NO: 713180 - RNA, 64 nt, hsa; identical to SEQ ID NO: 125225

SEQ ID NO: 713181 - RNA, 64 nt, hsa; identical to SEQ ID NO: 125226

SEQ ID NO: 713182 - RNA, 64 nt, hsa; identical to SEQ ID NO: 125227

SEQ ID NO: 713183 - RNA, 64 nt, hsa; identical to SEQ ID NO: 125228

SEQ ID NO: 713184 - RNA, 64 nt, hsa; identical to SEQ ID NO: 125229

SEQ ID NO: 713185 - RNA, 64 nt, hsa; identical to SEQ ID NO: 125230

SEQ ID NO: 713186 - RNA, 64 nt, hsa; identical to SEQ ID NO: 125231

SEQ ID NO: 713187 - RNA, 64 nt, hsa; identical to SEQ ID NO: 125232

SEQ ID NO: 713188 - RNA, 64 nt, hsa; identical to SEQ ID NO: 125233

SEQ ID NO: 713189 - RNA, 64 nt, hsa; identical to SEQ ID NO: 125234

SEQ ID NO: 713190 - RNA, 64 nt, hsa; identical to SEQ ID NO: 125235

SEQ ID NO: 713191 - RNA, 64 nt, hsa; identical to SEQ ID NO: 125236

SEQ ID NO: 713192 - RNA, 64 nt, hsa; identical to SEQ ID NO: 125237

SEQ ID NO: 713193 - RNA, 64 nt, hsa; identical to SEQ ID NO: 125238

SEQ ID NO: 713194 - RNA, 64 nt, hsa; identical to SEQ ID NO: 125239

SEQ ID NO: 713195 - RNA, 64 nt, hsa; identical to SEQ ID NO: 125240

SEQ ID NO: 713196 - RNA, 64 nt, hsa; identical to SEQ ID NO: 125241

SEQ ID NO: 713197 - RNA, 64 nt, hsa; identical to SEQ ID NO: 125242

SEQ ID NO: 713198 - RNA, 64 nt, hsa; identical to SEQ ID NO: 125243

SEQ ID NO: 713199 - RNA, 64 nt, hsa; identical to SEQ ID NO: 125244

SEQ ID NO: 713200 - RNA, 64 nt, hsa; identical to SEQ ID NO: 125245

SEQ ID NO: 713201 - RNA, 64 nt, hsa; identical to SEQ ID NO: 125246

SEQ ID NO: 713202 - RNA, 64 nt, hsa; identical to SEQ ID NO: 125247

SEQ ID NO: 713203 - RNA, 64 nt, hsa; identical to SEQ ID NO: 125248

SEQ ID NO: 713204 - RNA, 64 nt, hsa; identical to SEQ ID NO: 125249

SEQ ID NO: 713205 - RNA, 64 nt, hsa; identical to SEQ ID NO: 125250

SEQ ID NO: 713206 - RNA, 64 nt, hsa; identical to SEQ ID NO: 125251

SEQ ID NO: 713207 - RNA, 64 nt, hsa; identical to SEQ ID NO: 125252

SEQ ID NO: 713208 - RNA, 64 nt, hsa; identical to SEQ ID NO: 125253

SEQ ID NO: 713209 - RNA, 64 nt, hsa; identical to SEQ ID NO: 125254

SEQ ID NO: 713210 - RNA, 64 nt, hsa; identical to SEQ ID NO: 125255

SEQ ID NO: 713211 - RNA, 64 nt, hsa; identical to SEQ ID NO: 125256

SEQ ID NO: 713212 - RNA, 64 nt, hsa; identical to SEQ ID NO: 125257

SEQ ID NO: 713213 - RNA, 64 nt, hsa; identical to SEQ ID NO: 125258

SEQ ID NO: 713214 - RNA, 64 nt, hsa; identical to SEQ ID NO: 125259

SEQ ID NO: 713215 - RNA, 64 nt, hsa; identical to SEQ ID NO: 125260

SEQ ID NO: 713216 - RNA, 64 nt, hsa; identical to SEQ ID NO: 125261

SEQ ID NO: 713217 - RNA, 64 nt, hsa; identical to SEQ ID NO: 125262

SEQ ID NO: 713218 - RNA, 64 nt, hsa; identical to SEQ ID NO: 125263

SEQ ID NO: 713219 - RNA, 64 nt, hsa; identical to SEQ ID NO: 125264

SEQ ID NO: 713220 - RNA, 64 nt, hsa; identical to SEQ ID NO: 125265

SEQ ID NO: 713221 - RNA, 64 nt, hsa; identical to SEQ ID NO: 125266

SEQ ID NO: 713222 - RNA, 64 nt, hsa; identical to SEQ ID NO: 125267

SEQ ID NO: 713223 - RNA, 64 nt, hsa; identical to SEQ ID NO: 125268

SEQ ID NO: 713224 - RNA, 64 nt, hsa; identical to SEQ ID NO: 125269

SEQ ID NO: 713225 - RNA, 64 nt, hsa; identical to SEQ ID NO: 125270

SEQ ID NO: 713226 - RNA, 64 nt, hsa; identical to SEQ ID NO: 125271

SEQ ID NO: 713227 - RNA, 64 nt, hsa; identical to SEQ ID NO: 125272

SEQ ID NO: 713228 - RNA, 64 nt, hsa; identical to SEQ ID NO: 125273

SEQ ID NO: 713229 - RNA, 64 nt, hsa; identical to SEQ ID NO: 125274

SEQ ID NO: 713230 - RNA, 64 nt, hsa; identical to SEQ ID NO: 125275

SEQ ID NO: 713231 - RNA, 64 nt, hsa; identical to SEQ ID NO: 125276

SEQ ID NO: 713232 - RNA, 64 nt, hsa; identical to SEQ ID NO: 125277

SEQ ID NO: 713233 - RNA, 64 nt, hsa; identical to SEQ ID NO: 125278

SEQ ID NO: 713234 - RNA, 64 nt, hsa; identical to SEQ ID NO: 125279

SEQ ID NO: 713235 - RNA, 63 nt, hsa; identical to SEQ ID NO: 125280

SEQ ID NO: 713236 - RNA, 64 nt, hsa; identical to SEQ ID NO: 125281

SEQ ID NO: 713237 - RNA, 64 nt, hsa; identical to SEQ ID NO: 125282

SEQ ID NO: 713238 - RNA, 64 nt, hsa; identical to SEQ ID NO: 125283

SEQ ID NO: 713239 - RNA, 64 nt, hsa; identical to SEQ ID NO: 125284

SEQ ID NO: 713240 - RNA, 64 nt, hsa; identical to SEQ ID NO: 125285

SEQ ID NO: 713241 - RNA, 64 nt, hsa; identical to SEQ ID NO: 125286

SEQ ID NO: 713242 - RNA, 64 nt, hsa; identical to SEQ ID NO: 125287

SEQ ID NO: 713243 - RNA, 64 nt, hsa; identical to SEQ ID NO: 125288

SEQ ID NO: 713244 - RNA, 64 nt, hsa; identical to SEQ ID NO: 125289

SEQ ID NO: 713245 - RNA, 64 nt, hsa; identical to SEQ ID NO: 125290

SEQ ID NO: 713246 - RNA, 64 nt, hsa; identical to SEQ ID NO: 125291

SEQ ID NO: 713247 - RNA, 64 nt, hsa; identical to SEQ ID NO: 125292

SEQ ID NO: 713248 - RNA, 64 nt, hsa; identical to SEQ ID NO: 125293

SEQ ID NO: 713249 - RNA, 64 nt, hsa; identical to SEQ ID NO: 125294

SEQ ID NO: 713250 - RNA, 64 nt, hsa; identical to SEQ ID NO: 125295

SEQ ID NO: 713251 - RNA, 64 nt, hsa; identical to SEQ ID NO: 125296

SEQ ID NO: 713252 - RNA, 64 nt, hsa; identical to SEQ ID NO: 125297

SEQ ID NO: 713253 - RNA, 64 nt, hsa; identical to SEQ ID NO: 606444

SEQ ID NO: 713254 - RNA, 64 nt, hsa; identical to SEQ ID NO: 606445

SEQ ID NO: 713255 - RNA, 64 nt, hsa; identical to SEQ ID NO: 606446

SEQ ID NO: 713256 - RNA, 64 nt, hsa; identical to SEQ ID NO: 606447

SEQ ID NO: 713257 - RNA, 64 nt, hsa; identical to SEQ ID NO: 606448

SEQ ID NO: 713258 - RNA, 64 nt, hsa; identical to SEQ ID NO: 606449

SEQ ID NO: 713259 - RNA, 64 nt, hsa; identical to SEQ ID NO: 606450

SEQ ID NO: 713260 - RNA, 64 nt, hsa; identical to SEQ ID NO: 606451

SEQ ID NO: 713261 - RNA, 64 nt, hsa; identical to SEQ ID NO: 606452

SEQ ID NO: 713262 - RNA, 64 nt, hsa; identical to SEQ ID NO: 606453

SEQ ID NO: 713263 - RNA, 64 nt, hsa; identical to SEQ ID NO: 606454

SEQ ID NO: 713264 - RNA, 64 nt, hsa; identical to SEQ ID NO: 606455

SEQ ID NO: 713265 - RNA, 64 nt, hsa; identical to SEQ ID NO: 606456

SEQ ID NO: 713266 - RNA, 64 nt, hsa; identical to SEQ ID NO: 606457

SEQ ID NO: 713267 - RNA, 64 nt, hsa; identical to SEQ ID NO: 606458

SEQ ID NO: 713268 - RNA, 64 nt, hsa; identical to SEQ ID NO: 606459

SEQ ID NO: 713269 - RNA, 64 nt, hsa; identical to SEQ ID NO: 606460

SEQ ID NO: 713270 - RNA, 64 nt, hsa; identical to SEQ ID NO: 606461

SEQ ID NO: 713271 - RNA, 64 nt, hsa; identical to SEQ ID NO: 606462

SEQ ID NO: 713272 - RNA, 64 nt, hsa; identical to SEQ ID NO: 606463

SEQ ID NO: 713273 - RNA, 64 nt, hsa; identical to SEQ ID NO: 606464

SEQ ID NO: 713274 - RNA, 64 nt, hsa; identical to SEQ ID NO: 606465

SEQ ID NO: 713275 - RNA, 64 nt, hsa; identical to SEQ ID NO: 606466

SEQ ID NO: 713276 - RNA, 64 nt, hsa; identical to SEQ ID NO: 606467

SEQ ID NO: 713277 - RNA, 64 nt, hsa; identical to SEQ ID NO: 606468

SEQ ID NO: 713278 - RNA, 64 nt, hsa; identical to SEQ ID NO: 606469

SEQ ID NO: 713279 - RNA, 64 nt, hsa; identical to SEQ ID NO: 606470

SEQ ID NO: 713280 - RNA, 64 nt, hsa; identical to SEQ ID NO: 606471

SEQ ID NO: 713281 - RNA, 64 nt, hsa; identical to SEQ ID NO: 606472

SEQ ID NO: 713282 - RNA, 64 nt, hsa; identical to SEQ ID NO: 606473

SEQ ID NO: 713283 - RNA, 64 nt, hsa; identical to SEQ ID NO: 606474

SEQ ID NO: 713284 - RNA, 64 nt, hsa; identical to SEQ ID NO: 606475

SEQ ID NO: 713285 - RNA, 64 nt, hsa; identical to SEQ ID NO: 606476

SEQ ID NO: 713286 - RNA, 64 nt, hsa; identical to SEQ ID NO: 606477

SEQ ID NO: 713287 - RNA, 64 nt, hsa; identical to SEQ ID NO: 606478

SEQ ID NO: 713288 - RNA, 64 nt, hsa; identical to SEQ ID NO: 606479

SEQ ID NO: 713289 - RNA, 64 nt, hsa; identical to SEQ ID NO: 421561

SEQ ID NO: 713290 - RNA, 64 nt, hsa; identical to SEQ ID NO: 421562

SEQ ID NO: 713291 - RNA, 64 nt, hsa; identical to SEQ ID NO: 421563

SEQ ID NO: 713292 - RNA, 64 nt, hsa; identical to SEQ ID NO: 421564

SEQ ID NO: 713293 - RNA, 64 nt, hsa; identical to SEQ ID NO: 421565

SEQ ID NO: 713294 - RNA, 64 nt, hsa; identical to SEQ ID NO: 421566

SEQ ID NO: 713295 - RNA, 64 nt, hsa; identical to SEQ ID NO: 421567

SEQ ID NO: 713296 - RNA, 64 nt, hsa; identical to SEQ ID NO: 421568

SEQ ID NO: 713297 - RNA, 64 nt, hsa; identical to SEQ ID NO: 421569

SEQ ID NO: 713298 - RNA, 64 nt, hsa; identical to SEQ ID NO: 421570

SEQ ID NO: 713299 - RNA, 64 nt, hsa; identical to SEQ ID NO: 421571

SEQ ID NO: 713300 - RNA, 64 nt, hsa; identical to SEQ ID NO: 421572

SEQ ID NO: 713301 - RNA, 64 nt, hsa; identical to SEQ ID NO: 421573

SEQ ID NO: 713302 - RNA, 64 nt, hsa; identical to SEQ ID NO: 421574

SEQ ID NO: 713303 - RNA, 64 nt, hsa; identical to SEQ ID NO: 421575

SEQ ID NO: 713304 - RNA, 64 nt, hsa; identical to SEQ ID NO: 421576

SEQ ID NO: 713305 - RNA, 64 nt, hsa; identical to SEQ ID NO: 421577

SEQ ID NO: 713306 - RNA, 64 nt, hsa; identical to SEQ ID NO: 421578

SEQ ID NO: 713307 - RNA, 64 nt, hsa; identical to SEQ ID NO: 421579

SEQ ID NO: 713308 - RNA, 64 nt, hsa; identical to SEQ ID NO: 421580

SEQ ID NO: 713309 - RNA, 64 nt, hsa; identical to SEQ ID NO: 421581

SEQ ID NO: 713310 - RNA, 64 nt, hsa; identical to SEQ ID NO: 421582

SEQ ID NO: 713311 - RNA, 64 nt, hsa; identical to SEQ ID NO: 421583

SEQ ID NO: 713312 - RNA, 64 nt, hsa; identical to SEQ ID NO: 334708

SEQ ID NO: 713313 - RNA, 64 nt, hsa; identical to SEQ ID NO: 334709

SEQ ID NO: 713314 - RNA, 64 nt, hsa; identical to SEQ ID NO: 334710

SEQ ID NO: 713315 - RNA, 64 nt, hsa; identical to SEQ ID NO: 334711

SEQ ID NO: 713316 - RNA, 64 nt, hsa; identical to SEQ ID NO: 334712

SEQ ID NO: 713317 - RNA, 64 nt, hsa; identical to SEQ ID NO: 334713

SEQ ID NO: 713318 - RNA, 64 nt, hsa; identical to SEQ ID NO: 334714

SEQ ID NO: 713319 - RNA, 64 nt, hsa; identical to SEQ ID NO: 334715

SEQ ID NO: 713320 - RNA, 64 nt, hsa; identical to SEQ ID NO: 334716

SEQ ID NO: 713321 - RNA, 64 nt, hsa; identical to SEQ ID NO: 334717

SEQ ID NO: 713322 - RNA, 64 nt, hsa; identical to SEQ ID NO: 334718

SEQ ID NO: 713323 - RNA, 64 nt, hsa; identical to SEQ ID NO: 334719

SEQ ID NO: 713324 - RNA, 64 nt, hsa; identical to SEQ ID NO: 334720

SEQ ID NO: 713325 - RNA, 64 nt, hsa; identical to SEQ ID NO: 334721

SEQ ID NO: 713326 - RNA, 64 nt, hsa; identical to SEQ ID NO: 334722

SEQ ID NO: 713327 - RNA, 64 nt, hsa; identical to SEQ ID NO: 334723

SEQ ID NO: 713328 - RNA, 64 nt, hsa; identical to SEQ ID NO: 334724

SEQ ID NO: 713329 - RNA, 64 nt, hsa; identical to SEQ ID NO: 334725

SEQ ID NO: 713330 - RNA, 64 nt, hsa; identical to SEQ ID NO: 334726

SEQ ID NO: 713331 - RNA, 64 nt, hsa; identical to SEQ ID NO: 334727

SEQ ID NO: 713332 - RNA, 64 nt, hsa; identical to SEQ ID NO: 334728

SEQ ID NO: 713333 - RNA, 64 nt, hsa; identical to SEQ ID NO: 334729

SEQ ID NO: 713334 - RNA, 64 nt, hsa; identical to SEQ ID NO: 334730

SEQ ID NO: 713335 - RNA, 64 nt, hsa; identical to SEQ ID NO: 334731

SEQ ID NO: 713336 - RNA, 64 nt, hsa; identical to SEQ ID NO: 334732

SEQ ID NO: 713337 - RNA, 64 nt, hsa; identical to SEQ ID NO: 334733

SEQ ID NO: 713338 - RNA, 64 nt, hsa; identical to SEQ ID NO: 334734

SEQ ID NO: 713339 - RNA, 64 nt, hsa; identical to SEQ ID NO: 334735

SEQ ID NO: 713340 - RNA, 64 nt, hsa; identical to SEQ ID NO: 334736

SEQ ID NO: 713341 - RNA, 64 nt, hsa; identical to SEQ ID NO: 334737

SEQ ID NO: 713342 - RNA, 64 nt, hsa; identical to SEQ ID NO: 334738

SEQ ID NO: 713343 - RNA, 64 nt, hsa; identical to SEQ ID NO: 334739

SEQ ID NO: 713344 - RNA, 64 nt, hsa; identical to SEQ ID NO: 334740

SEQ ID NO: 713345 - RNA, 64 nt, hsa; identical to SEQ ID NO: 334741

SEQ ID NO: 713346 - RNA, 64 nt, hsa; identical to SEQ ID NO: 334742

SEQ ID NO: 713347 - RNA, 64 nt, hsa; identical to SEQ ID NO: 334743

SEQ ID NO: 713348 - RNA, 64 nt, hsa; identical to SEQ ID NO: 334744

SEQ ID NO: 713349 - RNA, 64 nt, hsa; identical to SEQ ID NO: 334745

SEQ ID NO: 713350 - RNA, 64 nt, hsa; identical to SEQ ID NO: 334746

SEQ ID NO: 713351 - RNA, 64 nt, hsa; identical to SEQ ID NO: 334747

SEQ ID NO: 713352 - RNA, 64 nt, hsa; identical to SEQ ID NO: 334748

SEQ ID NO: 713353 - RNA, 64 nt, hsa; identical to SEQ ID NO: 334749

SEQ ID NO: 713354 - RNA, 64 nt, hsa; identical to SEQ ID NO: 334750

SEQ ID NO: 713355 - RNA, 64 nt, hsa; identical to SEQ ID NO: 334751

SEQ ID NO: 713356 - RNA, 64 nt, hsa; identical to SEQ ID NO: 334752

SEQ ID NO: 713357 - RNA, 64 nt, hsa; identical to SEQ ID NO: 334753

SEQ ID NO: 713358 - RNA, 64 nt, hsa; identical to SEQ ID NO: 334754

SEQ ID NO: 713359 - RNA, 64 nt, hsa; identical to SEQ ID NO: 334755

SEQ ID NO: 713360 - RNA, 64 nt, hsa; identical to SEQ ID NO: 334756

SEQ ID NO: 713361 - RNA, 64 nt, hsa; identical to SEQ ID NO: 334757

SEQ ID NO: 713362 - RNA, 64 nt, hsa; identical to SEQ ID NO: 334758

SEQ ID NO: 713363 - RNA, 64 nt, hsa; identical to SEQ ID NO: 334759

SEQ ID NO: 713364 - RNA, 64 nt, hsa; identical to SEQ ID NO: 334760

SEQ ID NO: 713365 - RNA, 64 nt, hsa; identical to SEQ ID NO: 334761

SEQ ID NO: 713366 - RNA, 64 nt, hsa; identical to SEQ ID NO: 334762

SEQ ID NO: 713367 - RNA, 64 nt, hsa; identical to SEQ ID NO: 334763

SEQ ID NO: 713368 - RNA, 64 nt, hsa; identical to SEQ ID NO: 334764

SEQ ID NO: 713369 - RNA, 64 nt, hsa; identical to SEQ ID NO: 334765

SEQ ID NO: 713370 - RNA, 64 nt, hsa; identical to SEQ ID NO: 334766

SEQ ID NO: 713371 - RNA, 64 nt, hsa; identical to SEQ ID NO: 334767

SEQ ID NO: 713372 - RNA, 64 nt, hsa; identical to SEQ ID NO: 334768

SEQ ID NO: 713373 - RNA, 64 nt, hsa; identical to SEQ ID NO: 334769

SEQ ID NO: 713374 - RNA, 64 nt, hsa; identical to SEQ ID NO: 334770

SEQ ID NO: 713375 - RNA, 64 nt, hsa; identical to SEQ ID NO: 334771

SEQ ID NO: 713376 - RNA, 64 nt, hsa; identical to SEQ ID NO: 334772

SEQ ID NO: 713377 - RNA, 64 nt, hsa; identical to SEQ ID NO: 348598

SEQ ID NO: 713378 - RNA, 64 nt, hsa; identical to SEQ ID NO: 348599

SEQ ID NO: 713379 - RNA, 64 nt, hsa; identical to SEQ ID NO: 348600

SEQ ID NO: 713380 - RNA, 64 nt, hsa; identical to SEQ ID NO: 348601

SEQ ID NO: 713381 - RNA, 64 nt, hsa; identical to SEQ ID NO: 348602

SEQ ID NO: 713382 - RNA, 64 nt, hsa; identical to SEQ ID NO: 348603

SEQ ID NO: 713383 - RNA, 64 nt, hsa; identical to SEQ ID NO: 348604

SEQ ID NO: 713384 - RNA, 64 nt, hsa; identical to SEQ ID NO: 348605

SEQ ID NO: 713385 - RNA, 64 nt, hsa; identical to SEQ ID NO: 348606

SEQ ID NO: 713386 - RNA, 64 nt, hsa; identical to SEQ ID NO: 348607

SEQ ID NO: 713387 - RNA, 64 nt, hsa; identical to SEQ ID NO: 348608

SEQ ID NO: 713388 - RNA, 64 nt, hsa; identical to SEQ ID NO: 348609

SEQ ID NO: 713389 - RNA, 64 nt, hsa; identical to SEQ ID NO: 348610

SEQ ID NO: 713390 - RNA, 64 nt, hsa; identical to SEQ ID NO: 348611

SEQ ID NO: 713391 - RNA, 64 nt, hsa; identical to SEQ ID NO: 348612

SEQ ID NO: 713392 - RNA, 64 nt, hsa; identical to SEQ ID NO: 348613

SEQ ID NO: 713393 - RNA, 64 nt, hsa; identical to SEQ ID NO: 348614

SEQ ID NO: 713394 - RNA, 64 nt, hsa; identical to SEQ ID NO: 348615

SEQ ID NO: 713395 - RNA, 64 nt, hsa; identical to SEQ ID NO: 348616

SEQ ID NO: 713396 - RNA, 64 nt, hsa; identical to SEQ ID NO: 348617

SEQ ID NO: 713397 - RNA, 64 nt, hsa
cucaagcuuuacugacuucaauuaucuguuuuuaaagacguagaagauuuauuuaauuugauau

SEQ ID NO: 713398 - RNA, 64 nt, hsa
gaaaaggauuuuauuauccuuaggaaugucauccaagacguagagcuugaaugugacguuauuu

SEQ ID NO: 713399 - RNA, 64 nt, hsa; identical to SEQ ID NO: 391843

SEQ ID NO: 713400 - RNA, 64 nt, hsa; identical to SEQ ID NO: 391844

SEQ ID NO: 713401 - RNA, 64 nt, hsa; identical to SEQ ID NO: 391845

SEQ ID NO: 713402 - RNA, 64 nt, hsa; identical to SEQ ID NO: 391846

SEQ ID NO: 713403 - RNA, 64 nt, hsa; identical to SEQ ID NO: 391847

SEQ ID NO: 713404 - RNA, 64 nt, hsa; identical to SEQ ID NO: 391848

SEQ ID NO: 713405 - RNA, 64 nt, hsa; identical to SEQ ID NO: 391849

SEQ ID NO: 713406 - RNA, 64 nt, hsa; identical to SEQ ID NO: 391850

SEQ ID NO: 713407 - RNA, 64 nt, hsa; identical to SEQ ID NO: 391851

SEQ ID NO: 713408 - RNA, 64 nt, hsa; identical to SEQ ID NO: 391852

SEQ ID NO: 713409 - RNA, 64 nt, hsa; identical to SEQ ID NO: 391853

SEQ ID NO: 713410 - RNA, 64 nt, hsa; identical to SEQ ID NO: 391854

SEQ ID NO: 713411 - RNA, 64 nt, hsa; identical to SEQ ID NO: 118026

SEQ ID NO: 713412 - RNA, 64 nt, hsa; identical to SEQ ID NO: 118027

SEQ ID NO: 713413 - RNA, 64 nt, hsa; identical to SEQ ID NO: 118028

SEQ ID NO: 713414 - RNA, 64 nt, hsa; identical to SEQ ID NO: 118029

SEQ ID NO: 713415 - RNA, 64 nt, hsa; identical to SEQ ID NO: 118030

SEQ ID NO: 713416 - RNA, 64 nt, hsa; identical to SEQ ID NO: 118031

SEQ ID NO: 713417 - RNA, 64 nt, hsa; identical to SEQ ID NO: 118032

SEQ ID NO: 713418 - RNA, 64 nt, hsa; identical to SEQ ID NO: 118033

SEQ ID NO: 713419 - RNA, 64 nt, hsa; identical to SEQ ID NO: 118034

SEQ ID NO: 713420 - RNA, 64 nt, hsa; identical to SEQ ID NO: 118035

SEQ ID NO: 713421 - RNA, 64 nt, hsa; identical to SEQ ID NO: 118036

SEQ ID NO: 713422 - RNA, 64 nt, hsa; identical to SEQ ID NO: 118037

SEQ ID NO: 713423 - RNA, 64 nt, hsa; identical to SEQ ID NO: 118038

SEQ ID NO: 713424 - RNA, 64 nt, hsa; identical to SEQ ID NO: 118039

SEQ ID NO: 713425 - RNA, 64 nt, hsa; identical to SEQ ID NO: 118040

SEQ ID NO: 713426 - RNA, 64 nt, hsa; identical to SEQ ID NO: 118041

SEQ ID NO: 713427 - RNA, 64 nt, hsa; identical to SEQ ID NO: 118042

SEQ ID NO: 713428 - RNA, 64 nt, hsa; identical to SEQ ID NO: 118043

SEQ ID NO: 713429 - RNA, 64 nt, hsa; identical to SEQ ID NO: 118044

SEQ ID NO: 713430 - RNA, 64 nt, hsa; identical to SEQ ID NO: 118045

SEQ ID NO: 713431 - RNA, 64 nt, hsa; identical to SEQ ID NO: 118046

SEQ ID NO: 713432 - RNA, 64 nt, hsa; identical to SEQ ID NO: 118047

SEQ ID NO: 713433 - RNA, 64 nt, hsa; identical to SEQ ID NO: 118048

SEQ ID NO: 713434 - RNA, 64 nt, hsa; identical to SEQ ID NO: 118049

SEQ ID NO: 713435 - RNA, 64 nt, hsa; identical to SEQ ID NO: 118050

SEQ ID NO: 713436 - RNA, 64 nt, hsa; identical to SEQ ID NO: 118051

SEQ ID NO: 713437 - RNA, 64 nt, hsa; identical to SEQ ID NO: 118052

SEQ ID NO: 713438 - RNA, 64 nt, hsa; identical to SEQ ID NO: 118053

SEQ ID NO: 713439 - RNA, 64 nt, hsa; identical to SEQ ID NO: 118054

SEQ ID NO: 713440 - RNA, 64 nt, hsa; identical to SEQ ID NO: 118055

SEQ ID NO: 713441 - RNA, 64 nt, hsa; identical to SEQ ID NO: 118056

SEQ ID NO: 713442 - RNA, 64 nt, hsa; identical to SEQ ID NO: 118057

SEQ ID NO: 713443 - RNA, 64 nt, hsa; identical to SEQ ID NO: 118058

SEQ ID NO: 713444 - RNA, 64 nt, hsa; identical to SEQ ID NO: 118059

SEQ ID NO: 713445 - RNA, 64 nt, hsa; identical to SEQ ID NO: 118060

SEQ ID NO: 713446 - RNA, 64 nt, hsa; identical to SEQ ID NO: 118061

SEQ ID NO: 713447 - RNA, 64 nt, hsa; identical to SEQ ID NO: 118062

SEQ ID NO: 713448 - RNA, 64 nt, hsa; identical to SEQ ID NO: 118063

SEQ ID NO: 713449 - RNA, 64 nt, hsa; identical to SEQ ID NO: 118064

SEQ ID NO: 713450 - RNA, 64 nt, hsa; identical to SEQ ID NO: 118065

SEQ ID NO: 713451 - RNA, 64 nt, hsa; identical to SEQ ID NO: 118066

SEQ ID NO: 713452 - RNA, 64 nt, hsa; identical to SEQ ID NO: 291116

SEQ ID NO: 713453 - RNA, 64 nt, hsa; identical to SEQ ID NO: 291117

SEQ ID NO: 713454 - RNA, 64 nt, hsa; identical to SEQ ID NO: 291118

SEQ ID NO: 713455 - RNA, 64 nt, hsa; identical to SEQ ID NO: 291119

SEQ ID NO: 713456 - RNA, 62 nt, hsa; identical to SEQ ID NO: 291120

SEQ ID NO: 713457 - RNA, 64 nt, hsa; identical to SEQ ID NO: 291121

SEQ ID NO: 713458 - RNA, 64 nt, hsa; identical to SEQ ID NO: 291122

SEQ ID NO: 713459 - RNA, 64 nt, hsa; identical to SEQ ID NO: 291123

SEQ ID NO: 713460 - RNA, 64 nt, hsa; identical to SEQ ID NO: 291124

SEQ ID NO: 713461 - RNA, 64 nt, hsa; identical to SEQ ID NO: 291125

SEQ ID NO: 713462 - RNA, 64 nt, hsa; identical to SEQ ID NO: 291126

SEQ ID NO: 713463 - RNA, 64 nt, hsa; identical to SEQ ID NO: 291127

SEQ ID NO: 713464 - RNA, 64 nt, hsa; identical to SEQ ID NO: 291128

SEQ ID NO: 713465 - RNA, 64 nt, hsa; identical to SEQ ID NO: 291129

SEQ ID NO: 713466 - RNA, 64 nt, hsa; identical to SEQ ID NO: 291130

SEQ ID NO: 713467 - RNA, 64 nt, hsa; identical to SEQ ID NO: 291131

SEQ ID NO: 713468 - RNA, 64 nt, hsa; identical to SEQ ID NO: 291132

SEQ ID NO: 713469 - RNA, 64 nt, hsa; identical to SEQ ID NO: 291133

SEQ ID NO: 713470 - RNA, 64 nt, hsa; identical to SEQ ID NO: 291134

SEQ ID NO: 713471 - RNA, 64 nt, hsa; identical to SEQ ID NO: 291135

SEQ ID NO: 713472 - RNA, 64 nt, hsa; identical to SEQ ID NO: 291136

SEQ ID NO: 713473 - RNA, 64 nt, hsa; identical to SEQ ID NO: 291137

SEQ ID NO: 713474 - RNA, 64 nt, hsa; identical to SEQ ID NO: 291138

SEQ ID NO: 713475 - RNA, 64 nt, hsa; identical to SEQ ID NO: 291139

SEQ ID NO: 713476 - RNA, 64 nt, hsa; identical to SEQ ID NO: 291140

SEQ ID NO: 713477 - RNA, 64 nt, hsa; identical to SEQ ID NO: 291141

SEQ ID NO: 713478 - RNA, 64 nt, hsa; identical to SEQ ID NO: 291142

SEQ ID NO: 713479 - RNA, 64 nt, hsa; identical to SEQ ID NO: 291143

SEQ ID NO: 713480 - RNA, 64 nt, hsa; identical to SEQ ID NO: 291144

SEQ ID NO: 713481 - RNA, 64 nt, hsa; identical to SEQ ID NO: 291145

SEQ ID NO: 713482 - RNA, 64 nt, hsa; identical to SEQ ID NO: 291146

SEQ ID NO: 713483 - RNA, 64 nt, hsa; identical to SEQ ID NO: 291147

SEQ ID NO: 713484 - RNA, 64 nt, hsa; identical to SEQ ID NO: 291148

SEQ ID NO: 713485 - RNA, 64 nt, hsa; identical to SEQ ID NO: 291149

SEQ ID NO: 713486 - RNA, 64 nt, hsa; identical to SEQ ID NO: 58312

SEQ ID NO: 713487 - RNA, 64 nt, hsa; identical to SEQ ID NO: 58313

SEQ ID NO: 713488 - RNA, 64 nt, hsa; identical to SEQ ID NO: 58314

SEQ ID NO: 713489 - RNA, 64 nt, hsa; identical to SEQ ID NO: 58315

SEQ ID NO: 713490 - RNA, 64 nt, hsa; identical to SEQ ID NO: 58316

SEQ ID NO: 713491 - RNA, 64 nt, hsa; identical to SEQ ID NO: 58317

SEQ ID NO: 713492 - RNA, 64 nt, hsa; identical to SEQ ID NO: 58318

SEQ ID NO: 713493 - RNA, 64 nt, hsa; identical to SEQ ID NO: 58319

SEQ ID NO: 713494 - RNA, 64 nt, hsa; identical to SEQ ID NO: 58320

SEQ ID NO: 713495 - RNA, 64 nt, hsa; identical to SEQ ID NO: 58321

SEQ ID NO: 713496 - RNA, 64 nt, hsa; identical to SEQ ID NO: 58322

SEQ ID NO: 713497 - RNA, 64 nt, hsa; identical to SEQ ID NO: 58323

SEQ ID NO: 713498 - RNA, 64 nt, hsa; identical to SEQ ID NO: 58324

SEQ ID NO: 713499 - RNA, 64 nt, hsa; identical to SEQ ID NO: 58325

SEQ ID NO: 713500 - RNA, 64 nt, hsa; identical to SEQ ID NO: 58326

SEQ ID NO: 713501 - RNA, 64 nt, hsa; identical to SEQ ID NO: 58327

SEQ ID NO: 713502 - RNA, 64 nt, hsa; identical to SEQ ID NO: 58328

SEQ ID NO: 713503 - RNA, 64 nt, hsa; identical to SEQ ID NO: 58329

SEQ ID NO: 713504 - RNA, 64 nt, hsa; identical to SEQ ID NO: 58330

SEQ ID NO: 713505 - RNA, 64 nt, hsa; identical to SEQ ID NO: 58331

SEQ ID NO: 713506 - RNA, 64 nt, hsa; identical to SEQ ID NO: 58332

SEQ ID NO: 713507 - RNA, 64 nt, hsa; identical to SEQ ID NO: 58333

SEQ ID NO: 713508 - RNA, 64 nt, hsa; identical to SEQ ID NO: 58334

SEQ ID NO: 713509 - RNA, 64 nt, hsa; identical to SEQ ID NO: 58335

SEQ ID NO: 713510 - RNA, 64 nt, hsa; identical to SEQ ID NO: 58336

SEQ ID NO: 713511 - RNA, 64 nt, hsa; identical to SEQ ID NO: 58337

SEQ ID NO: 713512 - RNA, 64 nt, hsa; identical to SEQ ID NO: 58338

SEQ ID NO: 713513 - RNA, 64 nt, hsa; identical to SEQ ID NO: 58339

SEQ ID NO: 713514 - RNA, 64 nt, hsa; identical to SEQ ID NO: 58340

SEQ ID NO: 713515 - RNA, 64 nt, hsa; identical to SEQ ID NO: 58341

SEQ ID NO: 713516 - RNA, 64 nt, hsa; identical to SEQ ID NO: 58342

SEQ ID NO: 713517 - RNA, 64 nt, hsa; identical to SEQ ID NO: 58343

SEQ ID NO: 713518 - RNA, 64 nt, hsa; identical to SEQ ID NO: 58344

SEQ ID NO: 713519 - RNA, 64 nt, hsa; identical to SEQ ID NO: 58345

SEQ ID NO: 713520 - RNA, 64 nt, hsa; identical to SEQ ID NO: 58346

SEQ ID NO: 713521 - RNA, 64 nt, hsa; identical to SEQ ID NO: 58347

SEQ ID NO: 713522 - RNA, 64 nt, hsa; identical to SEQ ID NO: 58348

SEQ ID NO: 713523 - RNA, 64 nt, hsa; identical to SEQ ID NO: 58349

SEQ ID NO: 713524 - RNA, 64 nt, hsa; identical to SEQ ID NO: 58350

SEQ ID NO: 713525 - RNA, 64 nt, hsa; identical to SEQ ID NO: 58351

SEQ ID NO: 713526 - RNA, 64 nt, hsa; identical to SEQ ID NO: 58352

SEQ ID NO: 713527 - RNA, 64 nt, hsa; identical to SEQ ID NO: 58353

SEQ ID NO: 713528 - RNA, 64 nt, hsa; identical to SEQ ID NO: 58354

SEQ ID NO: 713529 - RNA, 64 nt, hsa; identical to SEQ ID NO: 58355

SEQ ID NO: 713530 - RNA, 64 nt, hsa; identical to SEQ ID NO: 58356

SEQ ID NO: 713531 - RNA, 64 nt, hsa; identical to SEQ ID NO: 58357

SEQ ID NO: 713532 - RNA, 64 nt, hsa; identical to SEQ ID NO: 58358

SEQ ID NO: 713533 - RNA, 64 nt, hsa; identical to SEQ ID NO: 58359

SEQ ID NO: 713534 - RNA, 64 nt, hsa; identical to SEQ ID NO: 58360

SEQ ID NO: 713535 - RNA, 64 nt, hsa; identical to SEQ ID NO: 58361

SEQ ID NO: 713536 - RNA, 64 nt, hsa; identical to SEQ ID NO: 58362

SEQ ID NO: 713537 - RNA, 64 nt, hsa; identical to SEQ ID NO: 58363

SEQ ID NO: 713538 - RNA, 64 nt, hsa; identical to SEQ ID NO: 58364

SEQ ID NO: 713539 - RNA, 64 nt, hsa; identical to SEQ ID NO: 58365

SEQ ID NO: 713540 - RNA, 64 nt, hsa; identical to SEQ ID NO: 58366

SEQ ID NO: 713541 - RNA, 64 nt, hsa; identical to SEQ ID NO: 58367

SEQ ID NO: 713542 - RNA, 64 nt, hsa; identical to SEQ ID NO: 58368

SEQ ID NO: 713543 - RNA, 64 nt, hsa; identical to SEQ ID NO: 58369

SEQ ID NO: 713544 - RNA, 64 nt, hsa; identical to SEQ ID NO: 58370

SEQ ID NO: 713545 - RNA, 64 nt, hsa; identical to SEQ ID NO: 58371

SEQ ID NO: 713546 - RNA, 64 nt, hsa; identical to SEQ ID NO: 58372

SEQ ID NO: 713547 - RNA, 64 nt, hsa; identical to SEQ ID NO: 58373

SEQ ID NO: 713548 - RNA, 64 nt, hsa; identical to SEQ ID NO: 58374

SEQ ID NO: 713549 - RNA, 64 nt, hsa; identical to SEQ ID NO: 58375

SEQ ID NO: 713550 - RNA, 64 nt, hsa; identical to SEQ ID NO: 58376

SEQ ID NO: 713551 - RNA, 64 nt, hsa; identical to SEQ ID NO: 58377

SEQ ID NO: 713552 - RNA, 64 nt, hsa; identical to SEQ ID NO: 58378

SEQ ID NO: 713553 - RNA, 64 nt, hsa; identical to SEQ ID NO: 58379

SEQ ID NO: 713554 - RNA, 64 nt, hsa; identical to SEQ ID NO: 58380

SEQ ID NO: 713555 - RNA, 64 nt, hsa; identical to SEQ ID NO: 58381

SEQ ID NO: 713556 - RNA, 64 nt, hsa; identical to SEQ ID NO: 58382

SEQ ID NO: 713557 - RNA, 64 nt, hsa; identical to SEQ ID NO: 58383

SEQ ID NO: 713558 - RNA, 64 nt, hsa; identical to SEQ ID NO: 58384

SEQ ID NO: 713559 - RNA, 64 nt, hsa; identical to SEQ ID NO: 58385

SEQ ID NO: 713560 - RNA, 64 nt, hsa; identical to SEQ ID NO: 58386

SEQ ID NO: 713561 - RNA, 64 nt, hsa; identical to SEQ ID NO: 58387

SEQ ID NO: 713562 - RNA, 64 nt, hsa; identical to SEQ ID NO: 58388

SEQ ID NO: 713563 - RNA, 64 nt, hsa; identical to SEQ ID NO: 58389

SEQ ID NO: 713564 - RNA, 64 nt, hsa; identical to SEQ ID NO: 58390

SEQ ID NO: 713565 - RNA, 64 nt, hsa; identical to SEQ ID NO: 58391

SEQ ID NO: 713566 - RNA, 64 nt, hsa; identical to SEQ ID NO: 58392

SEQ ID NO: 713567 - RNA, 64 nt, hsa; identical to SEQ ID NO: 58393

SEQ ID NO: 713568 - RNA, 64 nt, hsa; identical to SEQ ID NO: 58394

SEQ ID NO: 713569 - RNA, 64 nt, hsa; identical to SEQ ID NO: 58395

SEQ ID NO: 713570 - RNA, 64 nt, hsa; identical to SEQ ID NO: 58396

SEQ ID NO: 713571 - RNA, 64 nt, hsa; identical to SEQ ID NO: 58397

SEQ ID NO: 713572 - RNA, 64 nt, hsa; identical to SEQ ID NO: 58398

SEQ ID NO: 713573 - RNA, 64 nt, hsa; identical to SEQ ID NO: 58399

SEQ ID NO: 713574 - RNA, 64 nt, hsa; identical to SEQ ID NO: 58400

SEQ ID NO: 713575 - RNA, 64 nt, hsa; identical to SEQ ID NO: 58401

SEQ ID NO: 713576 - RNA, 64 nt, hsa; identical to SEQ ID NO: 58402

SEQ ID NO: 713577 - RNA, 64 nt, hsa; identical to SEQ ID NO: 58403

SEQ ID NO: 713578 - RNA, 64 nt, hsa; identical to SEQ ID NO: 58404

SEQ ID NO: 713579 - RNA, 64 nt, hsa; identical to SEQ ID NO: 58405

SEQ ID NO: 713580 - RNA, 64 nt, hsa; identical to SEQ ID NO: 58406

SEQ ID NO: 713581 - RNA, 64 nt, hsa; identical to SEQ ID NO: 58407

SEQ ID NO: 713582 - RNA, 64 nt, hsa; identical to SEQ ID NO: 58408

SEQ ID NO: 713583 - RNA, 64 nt, hsa; identical to SEQ ID NO: 58409

SEQ ID NO: 713584 - RNA, 64 nt, hsa; identical to SEQ ID NO: 58410

SEQ ID NO: 713585 - RNA, 64 nt, hsa; identical to SEQ ID NO: 58411

SEQ ID NO: 713586 - RNA, 64 nt, hsa; identical to SEQ ID NO: 58412

SEQ ID NO: 713587 - RNA, 64 nt, hsa; identical to SEQ ID NO: 58413

SEQ ID NO: 713588 - RNA, 64 nt, hsa; identical to SEQ ID NO: 58414

SEQ ID NO: 713589 - RNA, 64 nt, hsa; identical to SEQ ID NO: 58415

SEQ ID NO: 713590 - RNA, 64 nt, hsa; identical to SEQ ID NO: 58416

SEQ ID NO: 713591 - RNA, 64 nt, hsa; identical to SEQ ID NO: 58417

SEQ ID NO: 713592 - RNA, 64 nt, hsa; identical to SEQ ID NO: 58418

SEQ ID NO: 713593 - RNA, 64 nt, hsa; identical to SEQ ID NO: 58419

SEQ ID NO: 713594 - RNA, 64 nt, hsa; identical to SEQ ID NO: 58420

SEQ ID NO: 713595 - RNA, 64 nt, hsa; identical to SEQ ID NO: 58421

SEQ ID NO: 713596 - RNA, 64 nt, hsa; identical to SEQ ID NO: 58422

SEQ ID NO: 713597 - RNA, 64 nt, hsa; identical to SEQ ID NO: 58423

SEQ ID NO: 713598 - RNA, 64 nt, hsa; identical to SEQ ID NO: 58424

SEQ ID NO: 713599 - RNA, 64 nt, hsa; identical to SEQ ID NO: 58425

SEQ ID NO: 713600 - RNA, 64 nt, hsa; identical to SEQ ID NO: 58426

SEQ ID NO: 713601 - RNA, 64 nt, hsa; identical to SEQ ID NO: 58427

SEQ ID NO: 713602 - RNA, 64 nt, hsa; identical to SEQ ID NO: 58428

SEQ ID NO: 713603 - RNA, 64 nt, hsa; identical to SEQ ID NO: 58429

SEQ ID NO: 713604 - RNA, 64 nt, hsa; identical to SEQ ID NO: 58430

SEQ ID NO: 713605 - RNA, 64 nt, hsa; identical to SEQ ID NO: 58431

SEQ ID NO: 713606 - RNA, 64 nt, hsa; identical to SEQ ID NO: 58432

SEQ ID NO: 713607 - RNA, 64 nt, hsa; identical to SEQ ID NO: 58433

SEQ ID NO: 713608 - RNA, 64 nt, hsa; identical to SEQ ID NO: 58434

SEQ ID NO: 713609 - RNA, 64 nt, hsa; identical to SEQ ID NO: 58435

SEQ ID NO: 713610 - RNA, 50 nt, hsa; identical to SEQ ID NO: 58436

SEQ ID NO: 713611 - RNA, 64 nt, hsa; identical to SEQ ID NO: 58437

SEQ ID NO: 713612 - RNA, 64 nt, hsa; identical to SEQ ID NO: 58438

SEQ ID NO: 713613 - RNA, 64 nt, hsa; identical to SEQ ID NO: 58439

SEQ ID NO: 713614 - RNA, 64 nt, hsa; identical to SEQ ID NO: 58440

SEQ ID NO: 713615 - RNA, 64 nt, hsa; identical to SEQ ID NO: 58441

SEQ ID NO: 713616 - RNA, 64 nt, hsa; identical to SEQ ID NO: 58442

SEQ ID NO: 713617 - RNA, 64 nt, hsa; identical to SEQ ID NO: 58443

SEQ ID NO: 713618 - RNA, 64 nt, hsa; identical to SEQ ID NO: 58444

SEQ ID NO: 713619 - RNA, 64 nt, hsa; identical to SEQ ID NO: 58445

SEQ ID NO: 713620 - RNA, 64 nt, hsa; identical to SEQ ID NO: 58446

SEQ ID NO: 713621 - RNA, 64 nt, hsa; identical to SEQ ID NO: 58447

SEQ ID NO: 713622 - RNA, 64 nt, hsa; identical to SEQ ID NO: 58448

SEQ ID NO: 713623 - RNA, 64 nt, hsa; identical to SEQ ID NO: 58449

SEQ ID NO: 713624 - RNA, 64 nt, hsa; identical to SEQ ID NO: 58450

SEQ ID NO: 713625 - RNA, 64 nt, hsa; identical to SEQ ID NO: 58451

SEQ ID NO: 713626 - RNA, 64 nt, hsa; identical to SEQ ID NO: 58452

SEQ ID NO: 713627 - RNA, 64 nt, hsa; identical to SEQ ID NO: 58453

SEQ ID NO: 713628 - RNA, 64 nt, hsa; identical to SEQ ID NO: 58454

SEQ ID NO: 713629 - RNA, 64 nt, hsa; identical to SEQ ID NO: 58455

SEQ ID NO: 713630 - RNA, 64 nt, hsa; identical to SEQ ID NO: 58456

SEQ ID NO: 713631 - RNA, 64 nt, hsa; identical to SEQ ID NO: 58457

SEQ ID NO: 713632 - RNA, 64 nt, hsa; identical to SEQ ID NO: 58458

SEQ ID NO: 713633 - RNA, 64 nt, hsa; identical to SEQ ID NO: 58459

SEQ ID NO: 713634 - RNA, 64 nt, hsa; identical to SEQ ID NO: 58460

SEQ ID NO: 713635 - RNA, 64 nt, hsa; identical to SEQ ID NO: 58461

SEQ ID NO: 713636 - RNA, 64 nt, hsa; identical to SEQ ID NO: 58462

SEQ ID NO: 713637 - RNA, 64 nt, hsa; identical to SEQ ID NO: 58463

SEQ ID NO: 713638 - RNA, 64 nt, hsa; identical to SEQ ID NO: 58464

SEQ ID NO: 713639 - RNA, 64 nt, hsa; identical to SEQ ID NO: 58465

SEQ ID NO: 713640 - RNA, 64 nt, hsa; identical to SEQ ID NO: 58466

SEQ ID NO: 713641 - RNA, 64 nt, hsa; identical to SEQ ID NO: 58467

SEQ ID NO: 713642 - RNA, 64 nt, hsa; identical to SEQ ID NO: 338143

SEQ ID NO: 713643 - RNA, 64 nt, hsa; identical to SEQ ID NO: 338144

SEQ ID NO: 713644 - RNA, 64 nt, hsa; identical to SEQ ID NO: 338145

SEQ ID NO: 713645 - RNA, 64 nt, hsa; identical to SEQ ID NO: 338146

SEQ ID NO: 713646 - RNA, 64 nt, hsa; identical to SEQ ID NO: 338147

SEQ ID NO: 713647 - RNA, 64 nt, hsa; identical to SEQ ID NO: 338148

SEQ ID NO: 713648 - RNA, 64 nt, hsa; identical to SEQ ID NO: 338149

SEQ ID NO: 713649 - RNA, 64 nt, hsa; identical to SEQ ID NO: 338150

SEQ ID NO: 713650 - RNA, 64 nt, hsa; identical to SEQ ID NO: 338151

SEQ ID NO: 713651 - RNA, 64 nt, hsa; identical to SEQ ID NO: 259948

SEQ ID NO: 713652 - RNA, 64 nt, hsa; identical to SEQ ID NO: 259949

SEQ ID NO: 713653 - RNA, 64 nt, hsa; identical to SEQ ID NO: 259950

SEQ ID NO: 713654 - RNA, 64 nt, hsa; identical to SEQ ID NO: 259951

SEQ ID NO: 713655 - RNA, 64 nt, hsa; identical to SEQ ID NO: 259952

SEQ ID NO: 713656 - RNA, 64 nt, hsa; identical to SEQ ID NO: 259953

SEQ ID NO: 713657 - RNA, 64 nt, hsa; identical to SEQ ID NO: 259954

SEQ ID NO: 713658 - RNA, 64 nt, hsa; identical to SEQ ID NO: 259955

SEQ ID NO: 713659 - RNA, 64 nt, hsa; identical to SEQ ID NO: 259956

SEQ ID NO: 713660 - RNA, 64 nt, hsa; identical to SEQ ID NO: 259957

SEQ ID NO: 713661 - RNA, 64 nt, hsa; identical to SEQ ID NO: 259958

SEQ ID NO: 713662 - RNA, 64 nt, hsa; identical to SEQ ID NO: 259959

SEQ ID NO: 713663 - RNA, 64 nt, hsa; identical to SEQ ID NO: 259960

SEQ ID NO: 713664 - RNA, 64 nt, hsa; identical to SEQ ID NO: 259961

SEQ ID NO: 713665 - RNA, 64 nt, hsa; identical to SEQ ID NO: 259962

SEQ ID NO: 713666 - RNA, 64 nt, hsa; identical to SEQ ID NO: 259963

SEQ ID NO: 713667 - RNA, 64 nt, hsa; identical to SEQ ID NO: 259964

SEQ ID NO: 713668 - RNA, 64 nt, hsa; identical to SEQ ID NO: 259965

SEQ ID NO: 713669 - RNA, 64 nt, hsa; identical to SEQ ID NO: 259966

SEQ ID NO: 713670 - RNA, 64 nt, hsa; identical to SEQ ID NO: 259967

SEQ ID NO: 713671 - RNA, 64 nt, hsa; identical to SEQ ID NO: 259968

SEQ ID NO: 713672 - RNA, 64 nt, hsa; identical to SEQ ID NO: 259969

SEQ ID NO: 713673 - RNA, 64 nt, hsa; identical to SEQ ID NO: 73185

SEQ ID NO: 713674 - RNA, 64 nt, hsa; identical to SEQ ID NO: 73186

SEQ ID NO: 713675 - RNA, 64 nt, hsa; identical to SEQ ID NO: 73187

SEQ ID NO: 713676 - RNA, 64 nt, hsa; identical to SEQ ID NO: 73188

SEQ ID NO: 713677 - RNA, 64 nt, hsa; identical to SEQ ID NO: 73189

SEQ ID NO: 713678 - RNA, 64 nt, hsa; identical to SEQ ID NO: 73190

SEQ ID NO: 713679 - RNA, 64 nt, hsa; identical to SEQ ID NO: 73191

SEQ ID NO: 713680 - RNA, 64 nt, hsa; identical to SEQ ID NO: 73192

SEQ ID NO: 713681 - RNA, 64 nt, hsa; identical to SEQ ID NO: 73193

SEQ ID NO: 713682 - RNA, 64 nt, hsa; identical to SEQ ID NO: 73194

SEQ ID NO: 713683 - RNA, 64 nt, hsa; identical to SEQ ID NO: 73195

SEQ ID NO: 713684 - RNA, 64 nt, hsa; identical to SEQ ID NO: 73196

SEQ ID NO: 713685 - RNA, 64 nt, hsa; identical to SEQ ID NO: 73197

SEQ ID NO: 713686 - RNA, 64 nt, hsa; identical to SEQ ID NO: 73198

SEQ ID NO: 713687 - RNA, 64 nt, hsa; identical to SEQ ID NO: 73199

SEQ ID NO: 713688 - RNA, 64 nt, hsa; identical to SEQ ID NO: 73200

SEQ ID NO: 713689 - RNA, 64 nt, hsa; identical to SEQ ID NO: 73201

SEQ ID NO: 713690 - RNA, 64 nt, hsa; identical to SEQ ID NO: 73202

SEQ ID NO: 713691 - RNA, 64 nt, hsa; identical to SEQ ID NO: 73203

SEQ ID NO: 713692 - RNA, 64 nt, hsa; identical to SEQ ID NO: 73204

SEQ ID NO: 713693 - RNA, 64 nt, hsa; identical to SEQ ID NO: 73205

SEQ ID NO: 713694 - RNA, 64 nt, hsa; identical to SEQ ID NO: 73206

SEQ ID NO: 713695 - RNA, 64 nt, hsa; identical to SEQ ID NO: 73207

SEQ ID NO: 713696 - RNA, 64 nt, hsa; identical to SEQ ID NO: 73208

SEQ ID NO: 713697 - RNA, 64 nt, hsa; identical to SEQ ID NO: 73209

SEQ ID NO: 713698 - RNA, 64 nt, hsa; identical to SEQ ID NO: 73210

SEQ ID NO: 713699 - RNA, 64 nt, hsa; identical to SEQ ID NO: 73211

SEQ ID NO: 713700 - RNA, 64 nt, hsa; identical to SEQ ID NO: 73212

SEQ ID NO: 713701 - RNA, 64 nt, hsa; identical to SEQ ID NO: 73213

SEQ ID NO: 713702 - RNA, 64 nt, hsa; identical to SEQ ID NO: 73214

SEQ ID NO: 713703 - RNA, 64 nt, hsa; identical to SEQ ID NO: 73215

SEQ ID NO: 713704 - RNA, 64 nt, hsa; identical to SEQ ID NO: 73216

SEQ ID NO: 713705 - RNA, 64 nt, hsa; identical to SEQ ID NO: 73217

SEQ ID NO: 713706 - RNA, 64 nt, hsa; identical to SEQ ID NO: 73218

SEQ ID NO: 713707 - RNA, 64 nt, hsa; identical to SEQ ID NO: 73219

SEQ ID NO: 713708 - RNA, 64 nt, hsa; identical to SEQ ID NO: 73220

SEQ ID NO: 713709 - RNA, 64 nt, hsa; identical to SEQ ID NO: 73221

SEQ ID NO: 713710 - RNA, 64 nt, hsa; identical to SEQ ID NO: 73222

SEQ ID NO: 713711 - RNA, 64 nt, hsa; identical to SEQ ID NO: 73223

SEQ ID NO: 713712 - RNA, 64 nt, hsa; identical to SEQ ID NO: 73224

SEQ ID NO: 713713 - RNA, 64 nt, hsa; identical to SEQ ID NO: 73225

SEQ ID NO: 713714 - RNA, 64 nt, hsa; identical to SEQ ID NO: 73226

SEQ ID NO: 713715 - RNA, 64 nt, hsa; identical to SEQ ID NO: 73227

SEQ ID NO: 713716 - RNA, 64 nt, hsa; identical to SEQ ID NO: 73228

SEQ ID NO: 713717 - RNA, 64 nt, hsa; identical to SEQ ID NO: 73229

SEQ ID NO: 713718 - RNA, 64 nt, hsa; identical to SEQ ID NO: 73230

SEQ ID NO: 713719 - RNA, 64 nt, hsa; identical to SEQ ID NO: 73231

SEQ ID NO: 713720 - RNA, 64 nt, hsa; identical to SEQ ID NO: 73232

SEQ ID NO: 713721 - RNA, 64 nt, hsa; identical to SEQ ID NO: 73233

SEQ ID NO: 713722 - RNA, 64 nt, hsa; identical to SEQ ID NO: 73234

SEQ ID NO: 713723 - RNA, 64 nt, hsa; identical to SEQ ID NO: 73235

SEQ ID NO: 713724 - RNA, 64 nt, hsa; identical to SEQ ID NO: 73236

SEQ ID NO: 713725 - RNA, 64 nt, hsa; identical to SEQ ID NO: 73237

SEQ ID NO: 713726 - RNA, 64 nt, hsa; identical to SEQ ID NO: 73238

SEQ ID NO: 713727 - RNA, 64 nt, hsa; identical to SEQ ID NO: 73239

SEQ ID NO: 713728 - RNA, 64 nt, hsa; identical to SEQ ID NO: 73240

SEQ ID NO: 713729 - RNA, 64 nt, hsa; identical to SEQ ID NO: 73241

SEQ ID NO: 713730 - RNA, 64 nt, hsa; identical to SEQ ID NO: 73242

SEQ ID NO: 713731 - RNA, 64 nt, hsa; identical to SEQ ID NO: 73243

SEQ ID NO: 713732 - RNA, 64 nt, hsa; identical to SEQ ID NO: 73244

SEQ ID NO: 713733 - RNA, 64 nt, hsa; identical to SEQ ID NO: 73245

SEQ ID NO: 713734 - RNA, 64 nt, hsa; identical to SEQ ID NO: 73246

SEQ ID NO: 713735 - RNA, 64 nt, hsa; identical to SEQ ID NO: 73247

SEQ ID NO: 713736 - RNA, 64 nt, hsa; identical to SEQ ID NO: 73248

SEQ ID NO: 713737 - RNA, 64 nt, hsa; identical to SEQ ID NO: 73249

SEQ ID NO: 713738 - RNA, 64 nt, hsa; identical to SEQ ID NO: 73250

SEQ ID NO: 713739 - RNA, 64 nt, hsa; identical to SEQ ID NO: 73251

SEQ ID NO: 713740 - RNA, 64 nt, hsa; identical to SEQ ID NO: 73252

SEQ ID NO: 713741 - RNA, 64 nt, hsa; identical to SEQ ID NO: 73253

SEQ ID NO: 713742 - RNA, 64 nt, hsa; identical to SEQ ID NO: 73254

SEQ ID NO: 713743 - RNA, 64 nt, hsa; identical to SEQ ID NO: 73255

SEQ ID NO: 713744 - RNA, 64 nt, hsa; identical to SEQ ID NO: 73256

SEQ ID NO: 713745 - RNA, 64 nt, hsa; identical to SEQ ID NO: 73257

SEQ ID NO: 713746 - RNA, 64 nt, hsa; identical to SEQ ID NO: 73258

SEQ ID NO: 713747 - RNA, 64 nt, hsa; identical to SEQ ID NO: 73259

SEQ ID NO: 713748 - RNA, 64 nt, hsa; identical to SEQ ID NO: 73260

SEQ ID NO: 713749 - RNA, 64 nt, hsa; identical to SEQ ID NO: 73261

SEQ ID NO: 713750 - RNA, 64 nt, hsa; identical to SEQ ID NO: 73262

SEQ ID NO: 713751 - RNA, 64 nt, hsa; identical to SEQ ID NO: 73263

SEQ ID NO: 713752 - RNA, 64 nt, hsa; identical to SEQ ID NO: 73264

SEQ ID NO: 713753 - RNA, 64 nt, hsa; identical to SEQ ID NO: 73265

SEQ ID NO: 713754 - RNA, 63 nt, hsa; identical to SEQ ID NO: 73266

SEQ ID NO: 713755 - RNA, 64 nt, hsa; identical to SEQ ID NO: 73267

SEQ ID NO: 713756 - RNA, 64 nt, hsa; identical to SEQ ID NO: 73268

SEQ ID NO: 713757 - RNA, 64 nt, hsa; identical to SEQ ID NO: 73269

SEQ ID NO: 713758 - RNA, 64 nt, hsa; identical to SEQ ID NO: 73270

SEQ ID NO: 713759 - RNA, 64 nt, hsa; identical to SEQ ID NO: 73271

SEQ ID NO: 713760 - RNA, 64 nt, hsa; identical to SEQ ID NO: 73272

SEQ ID NO: 713761 - RNA, 64 nt, hsa; identical to SEQ ID NO: 73273

SEQ ID NO: 713762 - RNA, 64 nt, hsa; identical to SEQ ID NO: 73274

SEQ ID NO: 713763 - RNA, 64 nt, hsa; identical to SEQ ID NO: 73275

SEQ ID NO: 713764 - RNA, 64 nt, hsa; identical to SEQ ID NO: 73276

SEQ ID NO: 713765 - RNA, 64 nt, hsa; identical to SEQ ID NO: 73277

SEQ ID NO: 713766 - RNA, 64 nt, hsa; identical to SEQ ID NO: 73278

SEQ ID NO: 713767 - RNA, 64 nt, hsa; identical to SEQ ID NO: 73279

SEQ ID NO: 713768 - RNA, 64 nt, hsa; identical to SEQ ID NO: 73280

SEQ ID NO: 713769 - RNA, 64 nt, hsa; identical to SEQ ID NO: 73281

SEQ ID NO: 713770 - RNA, 64 nt, hsa; identical to SEQ ID NO: 73282

SEQ ID NO: 713771 - RNA, 64 nt, hsa; identical to SEQ ID NO: 73283

SEQ ID NO: 713772 - RNA, 64 nt, hsa; identical to SEQ ID NO: 73284

SEQ ID NO: 713773 - RNA, 64 nt, hsa; identical to SEQ ID NO: 73285

SEQ ID NO: 713774 - RNA, 64 nt, hsa; identical to SEQ ID NO: 73286

SEQ ID NO: 713775 - RNA, 64 nt, hsa; identical to SEQ ID NO: 73287

SEQ ID NO: 713776 - RNA, 64 nt, hsa; identical to SEQ ID NO: 73288

SEQ ID NO: 713777 - RNA, 64 nt, hsa; identical to SEQ ID NO: 73289

SEQ ID NO: 713778 - RNA, 64 nt, hsa; identical to SEQ ID NO: 73290

SEQ ID NO: 713779 - RNA, 64 nt, hsa; identical to SEQ ID NO: 73291

SEQ ID NO: 713780 - RNA, 64 nt, hsa; identical to SEQ ID NO: 73292

SEQ ID NO: 713781 - RNA, 64 nt, hsa; identical to SEQ ID NO: 73293

SEQ ID NO: 713782 - RNA, 64 nt, hsa; identical to SEQ ID NO: 73294

SEQ ID NO: 713783 - RNA, 64 nt, hsa; identical to SEQ ID NO: 73295

SEQ ID NO: 713784 - RNA, 64 nt, hsa; identical to SEQ ID NO: 73296

SEQ ID NO: 713785 - RNA, 64 nt, hsa; identical to SEQ ID NO: 73297

SEQ ID NO: 713786 - RNA, 64 nt, hsa; identical to SEQ ID NO: 73298

SEQ ID NO: 713787 - RNA, 64 nt, hsa; identical to SEQ ID NO: 73299

SEQ ID NO: 713788 - RNA, 64 nt, hsa; identical to SEQ ID NO: 73300

SEQ ID NO: 713789 - RNA, 64 nt, hsa; identical to SEQ ID NO: 73301

SEQ ID NO: 713790 - RNA, 64 nt, hsa; identical to SEQ ID NO: 73302

SEQ ID NO: 713791 - RNA, 64 nt, hsa; identical to SEQ ID NO: 73303

SEQ ID NO: 713792 - RNA, 64 nt, hsa; identical to SEQ ID NO: 73304

SEQ ID NO: 713793 - RNA, 64 nt, hsa; identical to SEQ ID NO: 73305

SEQ ID NO: 713794 - RNA, 64 nt, hsa; identical to SEQ ID NO: 73306

SEQ ID NO: 713795 - RNA, 64 nt, hsa; identical to SEQ ID NO: 73307

SEQ ID NO: 713796 - RNA, 64 nt, hsa; identical to SEQ ID NO: 73308

SEQ ID NO: 713797 - RNA, 64 nt, hsa; identical to SEQ ID NO: 73309

SEQ ID NO: 713798 - RNA, 64 nt, hsa; identical to SEQ ID NO: 73310

SEQ ID NO: 713799 - RNA, 64 nt, hsa; identical to SEQ ID NO: 73311

SEQ ID NO: 713800 - RNA, 64 nt, hsa; identical to SEQ ID NO: 73312

SEQ ID NO: 713801 - RNA, 64 nt, hsa; identical to SEQ ID NO: 73313

SEQ ID NO: 713802 - RNA, 64 nt, hsa; identical to SEQ ID NO: 73314

SEQ ID NO: 713803 - RNA, 64 nt, hsa; identical to SEQ ID NO: 73315

SEQ ID NO: 713804 - RNA, 64 nt, hsa; identical to SEQ ID NO: 73316

SEQ ID NO: 713805 - RNA, 64 nt, hsa; identical to SEQ ID NO: 73317

SEQ ID NO: 713806 - RNA, 64 nt, hsa; identical to SEQ ID NO: 73318

SEQ ID NO: 713807 - RNA, 64 nt, hsa; identical to SEQ ID NO: 73319

SEQ ID NO: 713808 - RNA, 64 nt, hsa; identical to SEQ ID NO: 73320

SEQ ID NO: 713809 - RNA, 64 nt, hsa; identical to SEQ ID NO: 73311

SEQ ID NO: 713810 - RNA, 64 nt, hsa; identical to SEQ ID NO: 73312

SEQ ID NO: 713811 - RNA, 64 nt, hsa; identical to SEQ ID NO: 209022

SEQ ID NO: 713812 - RNA, 64 nt, hsa; identical to SEQ ID NO: 209023

SEQ ID NO: 713813 - RNA, 64 nt, hsa
ucucucuggcuaggcaggugugccgcaaauauuugacgaauagauggauggcagacauuaacug

SEQ ID NO: 713814 - RNA, 64 nt, hsa
ggaggagggcgcagggugggggguaucaaagaaggacgaauagcacccuaccuguggguguuug

SEQ ID NO: 713815 - RNA, 64 nt, hsa
aaaaguaauuagaauauuuucaacauaaagaaaagacgaauauuuaaggugacagauaucccaa

SEQ ID NO: 713816 - RNA, 64 nt, hsa
gaggaugagucccaagaagguucuuuggaaggaggacgaauagaauggaguaaugaaauucuug

SEQ ID NO: 713817 - RNA, 64 nt, hsa
auaauguugcaaagggagacuacagggaucucacgacgaauauucugauacaauacucaaccuc

SEQ ID NO: 713818 - RNA, 64 nt, hsa
uuucuaaagaaagcugugcucuucuguugacccagacgaauagggcacagcccuguaacugcac

SEQ ID NO: 713819 - RNA, 64 nt, hsa
agggaaggaaguguuuguguagaagagagagaaagacgaauagaguuaggaaaaggaagacaag

SEQ ID NO: 713820 - RNA, 64 nt, hsa
ucaguaagaacaauuuuuauugcuuuauuuauuggacgaauaaaguacuguuucaguacauuca

SEQ ID NO: 713821 - RNA, 64 nt, hsa
aaaaggucuccugcagaucugucugggcugugaugacgaauauuaugaaaugugccuuuucuga

SEQ ID NO: 713822 - RNA, 64 nt, hsa
cacucuccuucagggaaaauguuauguggaggaggacgaauaaauuuauuuuguuuuccuguuu

SEQ ID NO: 713823 - RNA, 64 nt, hsa
caauucauuuuuucccaugagaugaagcacaugugacgaauacggacuagauaaccucuaagaa

SEQ ID NO: 713824 - RNA, 64 nt, hsa
auggaauucguguuaugaaucugugcuggccauggacgaauaugaaugucacauuugaauucuu

SEQ ID NO: 713825 - RNA, 64 nt, hsa
cucccucccccuccuccccucuuuuacucuagacgacgaauaaagcccuguuagaggaugcggc

SEQ ID NO: 713826 - RNA, 64 nt, hsa
cagaggaaauuaugaauuacgccaugagguuuaugacgaauaaaugaaucacggcaauuucuua

SEQ ID NO: 713827 - RNA, 64 nt, hsa
ggauuggccggcagggugauaugacugauucaaggacgaauagcuucuuacauauucuagauau

SEQ ID NO: 713828 - RNA, 64 nt, hsa
cauaacguucaguugggauggaaaucuuccggaggacgaauagaguuuaauuacucauugcguc

SEQ ID NO: 713829 - RNA, 64 nt, hsa
agccucccugcuugaggauggaaggaugaaauuugacgaauauaucaaacgccuugcuucuuug

SEQ ID NO: 713830 - RNA, 64 nt, hsa
auaaaucaccugugugauaauauuuugaaucugagacgaauacaacuuuuaaaaauuguuuuua

SEQ ID NO: 713831 - RNA, 64 nt, hsa
uccaagucuccaccccuuucuagaccaauaaagagacgaauacaauuuucuaacucagcaaaug

SEQ ID NO: 713832 - RNA, 64 nt, hsa
auucuaguguguguuuagugauagauguagucuugacgaauauugcuuacuggugagguugagg

SEQ ID NO: 713833 - RNA, 64 nt, hsa
cuggaucugcaaaaagcccgcagccugcuucagagacgaauaguuguuucccugcuagccucag

SEQ ID NO: 713834 - RNA, 64 nt, hsa
caaugaaaaaagaaaacuucaggcugguacuccugacgaauauaggugccaaaauccucagcaa

SEQ ID NO: 713835 - RNA, 64 nt, hsa
uggaggaaacuuucuuucuuaauuccuauucucugacgaauaaagacuuacugccuacaagagg

SEQ ID NO: 713836 - RNA, 64 nt, hsa; identical to SEQ ID NO: 351043

SEQ ID NO: 713837 - RNA, 64 nt, hsa; identical to SEQ ID NO: 351044

SEQ ID NO: 713838 - RNA, 64 nt, hsa; identical to SEQ ID NO: 351045

SEQ ID NO: 713839 - RNA, 64 nt, hsa; identical to SEQ ID NO: 351046

SEQ ID NO: 713840 - RNA, 64 nt, hsa; identical to SEQ ID NO: 351047

SEQ ID NO: 713841 - RNA, 64 nt, hsa; identical to SEQ ID NO: 351048

SEQ ID NO: 713842 - RNA, 64 nt, hsa; identical to SEQ ID NO: 351049

SEQ ID NO: 713843 - RNA, 64 nt, hsa; identical to SEQ ID NO: 351050

SEQ ID NO: 713844 - RNA, 64 nt, hsa; identical to SEQ ID NO: 351051

SEQ ID NO: 713845 - RNA, 64 nt, hsa; identical to SEQ ID NO: 351052

SEQ ID NO: 713846 - RNA, 64 nt, hsa; identical to SEQ ID NO: 351053

SEQ ID NO: 713847 - RNA, 64 nt, hsa; identical to SEQ ID NO: 351054

SEQ ID NO: 713848 - RNA, 64 nt, hsa; identical to SEQ ID NO: 351055

SEQ ID NO: 713849 - RNA, 50 nt, hsa; identical to SEQ ID NO: 351056

SEQ ID NO: 713850 - RNA, 64 nt, hsa; identical to SEQ ID NO: 351057

SEQ ID NO: 713851 - RNA, 64 nt, hsa; identical to SEQ ID NO: 351058

SEQ ID NO: 713852 - RNA, 64 nt, hsa; identical to SEQ ID NO: 351059

SEQ ID NO: 713853 - RNA, 64 nt, hsa; identical to SEQ ID NO: 351060

SEQ ID NO: 713854 - RNA, 64 nt, hsa; identical to SEQ ID NO: 351061

SEQ ID NO: 713855 - RNA, 64 nt, hsa; identical to SEQ ID NO: 351062

SEQ ID NO: 713856 - RNA, 64 nt, hsa; identical to SEQ ID NO: 351063

SEQ ID NO: 713857 - RNA, 64 nt, hsa; identical to SEQ ID NO: 351064

SEQ ID NO: 713858 - RNA, 64 nt, hsa; identical to SEQ ID NO: 144190

SEQ ID NO: 713859 - RNA, 64 nt, hsa; identical to SEQ ID NO: 144191

SEQ ID NO: 713860 - RNA, 64 nt, hsa; identical to SEQ ID NO: 144192

SEQ ID NO: 713861 - RNA, 64 nt, hsa; identical to SEQ ID NO: 144193

SEQ ID NO: 713862 - RNA, 64 nt, hsa; identical to SEQ ID NO: 144194

SEQ ID NO: 713863 - RNA, 64 nt, hsa; identical to SEQ ID NO: 144195

SEQ ID NO: 713864 - RNA, 64 nt, hsa; identical to SEQ ID NO: 144196

SEQ ID NO: 713865 - RNA, 64 nt, hsa; identical to SEQ ID NO: 144197

SEQ ID NO: 713866 - RNA, 64 nt, hsa; identical to SEQ ID NO: 144198

SEQ ID NO: 713867 - RNA, 64 nt, hsa; identical to SEQ ID NO: 144199

SEQ ID NO: 713868 - RNA, 64 nt, hsa; identical to SEQ ID NO: 144200

SEQ ID NO: 713869 - RNA, 64 nt, hsa; identical to SEQ ID NO: 144201

SEQ ID NO: 713870 - RNA, 64 nt, hsa; identical to SEQ ID NO: 144202

SEQ ID NO: 713871 - RNA, 64 nt, hsa; identical to SEQ ID NO: 144203

SEQ ID NO: 713872 - RNA, 64 nt, hsa; identical to SEQ ID NO: 144204

SEQ ID NO: 713873 - RNA, 64 nt, hsa; identical to SEQ ID NO: 144205

SEQ ID NO: 713874 - RNA, 64 nt, hsa; identical to SEQ ID NO: 144206

SEQ ID NO: 713875 - RNA, 64 nt, hsa; identical to SEQ ID NO: 144207

SEQ ID NO: 713876 - RNA, 64 nt, hsa; identical to SEQ ID NO: 144208

SEQ ID NO: 713877 - RNA, 64 nt, hsa; identical to SEQ ID NO: 144209

SEQ ID NO: 713878 - RNA, 64 nt, hsa; identical to SEQ ID NO: 144210

SEQ ID NO: 713879 - RNA, 64 nt, hsa; identical to SEQ ID NO: 144211

SEQ ID NO: 713880 - RNA, 64 nt, hsa; identical to SEQ ID NO: 144212

SEQ ID NO: 713881 - RNA, 64 nt, hsa; identical to SEQ ID NO: 144213

SEQ ID NO: 713882 - RNA, 64 nt, hsa; identical to SEQ ID NO: 144214

SEQ ID NO: 713883 - RNA, 64 nt, hsa; identical to SEQ ID NO: 144215

SEQ ID NO: 713884 - RNA, 64 nt, hsa; identical to SEQ ID NO: 144216

SEQ ID NO: 713885 - RNA, 64 nt, hsa; identical to SEQ ID NO: 144217

SEQ ID NO: 713886 - RNA, 64 nt, hsa; identical to SEQ ID NO: 144218

SEQ ID NO: 713887 - RNA, 64 nt, hsa; identical to SEQ ID NO: 144219

SEQ ID NO: 713888 - RNA, 64 nt, hsa; identical to SEQ ID NO: 144220

SEQ ID NO: 713889 - RNA, 64 nt, hsa; identical to SEQ ID NO: 144221

SEQ ID NO: 713890 - RNA, 64 nt, hsa; identical to SEQ ID NO: 144222

SEQ ID NO: 713891 - RNA, 64 nt, hsa; identical to SEQ ID NO: 144223

SEQ ID NO: 713892 - RNA, 64 nt, hsa; identical to SEQ ID NO: 144224

SEQ ID NO: 713893 - RNA, 64 nt, hsa; identical to SEQ ID NO: 144225

SEQ ID NO: 713894 - RNA, 64 nt, hsa; identical to SEQ ID NO: 144226

SEQ ID NO: 713895 - RNA, 64 nt, hsa; identical to SEQ ID NO: 144227

SEQ ID NO: 713896 - RNA, 64 nt, hsa; identical to SEQ ID NO: 144228

SEQ ID NO: 713897 - RNA, 64 nt, hsa; identical to SEQ ID NO: 144229

SEQ ID NO: 713898 - RNA, 64 nt, hsa; identical to SEQ ID NO: 144230

SEQ ID NO: 713899 - RNA, 64 nt, hsa; identical to SEQ ID NO: 144231

SEQ ID NO: 713900 - RNA, 64 nt, hsa; identical to SEQ ID NO: 144232

SEQ ID NO: 713901 - RNA, 64 nt, hsa; identical to SEQ ID NO: 144233

SEQ ID NO: 713902 - RNA, 64 nt, hsa; identical to SEQ ID NO: 144234

SEQ ID NO: 713903 - RNA, 64 nt, hsa; identical to SEQ ID NO: 144235

SEQ ID NO: 713904 - RNA, 64 nt, hsa; identical to SEQ ID NO: 144236

SEQ ID NO: 713905 - RNA, 64 nt, hsa; identical to SEQ ID NO: 144237

SEQ ID NO: 713906 - RNA, 64 nt, hsa; identical to SEQ ID NO: 144238

SEQ ID NO: 713907 - RNA, 64 nt, hsa; identical to SEQ ID NO: 144239

SEQ ID NO: 713908 - RNA, 64 nt, hsa; identical to SEQ ID NO: 144240

SEQ ID NO: 713909 - RNA, 64 nt, hsa; identical to SEQ ID NO: 144241

SEQ ID NO: 713910 - RNA, 64 nt, hsa; identical to SEQ ID NO: 144242

SEQ ID NO: 713911 - RNA, 64 nt, hsa; identical to SEQ ID NO: 144243

SEQ ID NO: 713912 - RNA, 64 nt, hsa; identical to SEQ ID NO: 144244

SEQ ID NO: 713913 - RNA, 64 nt, hsa; identical to SEQ ID NO: 144245

SEQ ID NO: 713914 - RNA, 64 nt, hsa; identical to SEQ ID NO: 144246

SEQ ID NO: 713915 - RNA, 64 nt, hsa; identical to SEQ ID NO: 144247

SEQ ID NO: 713916 - RNA, 64 nt, hsa; identical to SEQ ID NO: 144248

SEQ ID NO: 713917 - RNA, 64 nt, hsa; identical to SEQ ID NO: 144249

SEQ ID NO: 713918 - RNA, 64 nt, hsa; identical to SEQ ID NO: 144250

SEQ ID NO: 713919 - RNA, 64 nt, hsa; identical to SEQ ID NO: 144251

SEQ ID NO: 713920 - RNA, 64 nt, hsa; identical to SEQ ID NO: 144252

SEQ ID NO: 713921 - RNA, 64 nt, hsa; identical to SEQ ID NO: 144253

SEQ ID NO: 713922 - RNA, 64 nt, hsa; identical to SEQ ID NO: 144254

SEQ ID NO: 713923 - RNA, 64 nt, hsa; identical to SEQ ID NO: 144255

SEQ ID NO: 713924 - RNA, 64 nt, hsa; identical to SEQ ID NO: 162095

SEQ ID NO: 713925 - RNA, 64 nt, hsa; identical to SEQ ID NO: 162096

SEQ ID NO: 713926 - RNA, 64 nt, hsa; identical to SEQ ID NO: 162097

SEQ ID NO: 713927 - RNA, 64 nt, hsa; identical to SEQ ID NO: 162098

SEQ ID NO: 713928 - RNA, 64 nt, hsa; identical to SEQ ID NO: 162099

SEQ ID NO: 713929 - RNA, 64 nt, hsa; identical to SEQ ID NO: 162100

SEQ ID NO: 713930 - RNA, 64 nt, hsa; identical to SEQ ID NO: 162101

SEQ ID NO: 713931 - RNA, 64 nt, hsa; identical to SEQ ID NO: 162102

SEQ ID NO: 713932 - RNA, 61 nt, hsa; identical to SEQ ID NO: 162103

SEQ ID NO: 713933 - RNA, 64 nt, hsa; identical to SEQ ID NO: 162104

SEQ ID NO: 713934 - RNA, 64 nt, hsa; identical to SEQ ID NO: 162105

SEQ ID NO: 713935 - RNA, 64 nt, hsa; identical to SEQ ID NO: 162106

SEQ ID NO: 713936 - RNA, 64 nt, hsa; identical to SEQ ID NO: 162107

SEQ ID NO: 713937 - RNA, 64 nt, hsa; identical to SEQ ID NO: 162108

SEQ ID NO: 713938 - RNA, 64 nt, hsa
uuggacuuccuggggccccgcugggauuucuucgcugcucuagcuggcaggacacaucccggcc

SEQ ID NO: 713939 - RNA, 64 nt, hsa
ccugagucggccccacaugggaaccuaguacucucugcucuagccaggagucugugcucuuuug

SEQ ID NO: 713940 - RNA, 64 nt, hsa
agaugcauggauacaaauuuccauagcuccggggcugcucuaacaguuugauaucagcagacgu

SEQ ID NO: 713941 - RNA, 64 nt, hsa
uuggaugcaucucuaauaccauguuugagcaccucugcucuagguugagaaugacauuuuauug

SEQ ID NO: 713942 - RNA, 64 nt, hsa
cugcacaugaaggugugugccuguggugugugggcugcucuaggagcagauacaggcugguaua

SEQ ID NO: 713943 - RNA, 64 nt, hsa
gcuagcuucaccaguuucuguuccuugugggaugcugcucuagggauacucagggggcuccugc

SEQ ID NO: 713944 - RNA, 64 nt, hsa
gacugggcauuuuucuuuuaaugaaauauguggacugcucuagcaaacccuauuuucagcuacu

SEQ ID NO: 713945 - RNA, 64 nt, hsa
cacaagaaacuuggucugcagucuggaagcuugucugcucuauagaaaugaaaaugcagcauga

SEQ ID NO: 713946 - RNA, 64 nt, hsa
uccagagaccccagcaacuggcccaggaugcaggcugcucuagagaccaaaggaacaccaggcc

SEQ ID NO: 713947 - RNA, 64 nt, hsa
agagagggcaagucagccaggaacugccuccucccugcucuacagcuaagaaaacaccauucca

SEQ ID NO: 713948 - RNA, 64 nt, hsa
aggaccuuuauuauuaaaauaaucauuuugaacccugcucuauccccugcccucuuccagcccc

SEQ ID NO: 713949 - RNA, 64 nt, hsa
gggagggcagagggugagucacagcccucuccgucugcucuagccaggggcgacguguccccag

SEQ ID NO: 713950 - RNA, 64 nt, hsa
cuucugacuuagauacugauuuuaaugccaguaucugcucuaaauauuuaugauaaaaaugcau

SEQ ID NO: 713951 - RNA, 64 nt, hsa
uacuaaucauagauccugaccagcauuuguaacacugcucuaacuaggacacagcaugcagcag

SEQ ID NO: 713952 - RNA, 64 nt, hsa; identical to SEQ ID NO: 76226

SEQ ID NO: 713953 - RNA, 64 nt, hsa; identical to SEQ ID NO: 76227

SEQ ID NO: 713954 - RNA, 64 nt, hsa; identical to SEQ ID NO: 76228

SEQ ID NO: 713955 - RNA, 64 nt, hsa; identical to SEQ ID NO: 76229

SEQ ID NO: 713956 - RNA, 64 nt, hsa; identical to SEQ ID NO: 76230

SEQ ID NO: 713957 - RNA, 64 nt, hsa; identical to SEQ ID NO: 76231

SEQ ID NO: 713958 - RNA, 64 nt, hsa; identical to SEQ ID NO: 76232

SEQ ID NO: 713959 - RNA, 64 nt, hsa; identical to SEQ ID NO: 76233

SEQ ID NO: 713960 - RNA, 64 nt, hsa; identical to SEQ ID NO: 76234

SEQ ID NO: 713961 - RNA, 64 nt, hsa; identical to SEQ ID NO: 76235

SEQ ID NO: 713962 - RNA, 64 nt, hsa; identical to SEQ ID NO: 76236

SEQ ID NO: 713963 - RNA, 64 nt, hsa; identical to SEQ ID NO: 76237

SEQ ID NO: 713964 - RNA, 64 nt, hsa; identical to SEQ ID NO: 76238

SEQ ID NO: 713965 - RNA, 64 nt, hsa; identical to SEQ ID NO: 76239

SEQ ID NO: 713966 - RNA, 64 nt, hsa; identical to SEQ ID NO: 76240

SEQ ID NO: 713967 - RNA, 64 nt, hsa; identical to SEQ ID NO: 76241

SEQ ID NO: 713968 - RNA, 64 nt, hsa; identical to SEQ ID NO: 76242

SEQ ID NO: 713969 - RNA, 64 nt, hsa; identical to SEQ ID NO: 76243

SEQ ID NO: 713970 - RNA, 64 nt, hsa; identical to SEQ ID NO: 476473

SEQ ID NO: 713971 - RNA, 64 nt, hsa; identical to SEQ ID NO: 476474

SEQ ID NO: 713972 - RNA, 64 nt, hsa; identical to SEQ ID NO: 476475

SEQ ID NO: 713973 - RNA, 63 nt, hsa; identical to SEQ ID NO: 476476

SEQ ID NO: 713974 - RNA, 64 nt, hsa; identical to SEQ ID NO: 476477

SEQ ID NO: 713975 - RNA, 64 nt, hsa; identical to SEQ ID NO: 476478

SEQ ID NO: 713976 - RNA, 64 nt, hsa; identical to SEQ ID NO: 476479

SEQ ID NO: 713977 - RNA, 64 nt, hsa; identical to SEQ ID NO: 476480

SEQ ID NO: 713978 - RNA, 64 nt, hsa; identical to SEQ ID NO: 476481

SEQ ID NO: 713979 - RNA, 64 nt, hsa; identical to SEQ ID NO: 476482

SEQ ID NO: 713980 - RNA, 64 nt, hsa; identical to SEQ ID NO: 476483

SEQ ID NO: 713981 - RNA, 64 nt, hsa; identical to SEQ ID NO: 476484

SEQ ID NO: 713982 - RNA, 64 nt, hsa; identical to SEQ ID NO: 476485

SEQ ID NO: 713983 - RNA, 64 nt, hsa; identical to SEQ ID NO: 476486

SEQ ID NO: 713984 - RNA, 64 nt, hsa; identical to SEQ ID NO: 476487

SEQ ID NO: 713985 - RNA, 64 nt, hsa; identical to SEQ ID NO: 476488

SEQ ID NO: 713986 - RNA, 64 nt, hsa; identical to SEQ ID NO: 476489

SEQ ID NO: 713987 - RNA, 64 nt, hsa; identical to SEQ ID NO: 476490

SEQ ID NO: 713988 - RNA, 64 nt, hsa; identical to SEQ ID NO: 476491

SEQ ID NO: 713989 - RNA, 64 nt, hsa; identical to SEQ ID NO: 476492

SEQ ID NO: 713990 - RNA, 64 nt, hsa; identical to SEQ ID NO: 476493

SEQ ID NO: 713991 - RNA, 64 nt, hsa; identical to SEQ ID NO: 476494

SEQ ID NO: 713992 - RNA, 64 nt, hsa; identical to SEQ ID NO: 476495

SEQ ID NO: 713993 - RNA, 64 nt, hsa; identical to SEQ ID NO: 476496

SEQ ID NO: 713994 - RNA, 64 nt, hsa; identical to SEQ ID NO: 476497

SEQ ID NO: 713995 - RNA, 64 nt, hsa; identical to SEQ ID NO: 476498

SEQ ID NO: 713996 - RNA, 64 nt, hsa; identical to SEQ ID NO: 476499

SEQ ID NO: 713997 - RNA, 64 nt, hsa; identical to SEQ ID NO: 476500

SEQ ID NO: 713998 - RNA, 64 nt, hsa; identical to SEQ ID NO: 476501

SEQ ID NO: 713999 - RNA, 64 nt, hsa; identical to SEQ ID NO: 476502

SEQ ID NO: 714000 - RNA, 64 nt, hsa; identical to SEQ ID NO: 476503

SEQ ID NO: 714001 - RNA, 64 nt, hsa; identical to SEQ ID NO: 476504

SEQ ID NO: 714002 - RNA, 64 nt, hsa; identical to SEQ ID NO: 476505

SEQ ID NO: 714003 - RNA, 64 nt, hsa; identical to SEQ ID NO: 476506

SEQ ID NO: 714004 - RNA, 64 nt, hsa; identical to SEQ ID NO: 476507

SEQ ID NO: 714005 - RNA, 64 nt, hsa; identical to SEQ ID NO: 476508

SEQ ID NO: 714006 - RNA, 64 nt, hsa; identical to SEQ ID NO: 476509

SEQ ID NO: 714007 - RNA, 64 nt, hsa; identical to SEQ ID NO: 476510

SEQ ID NO: 714008 - RNA, 64 nt, hsa; identical to SEQ ID NO: 476511

SEQ ID NO: 714009 - RNA, 64 nt, hsa; identical to SEQ ID NO: 476512

SEQ ID NO: 714010 - RNA, 64 nt, hsa; identical to SEQ ID NO: 476513

SEQ ID NO: 714011 - RNA, 64 nt, hsa; identical to SEQ ID NO: 476514

SEQ ID NO: 714012 - RNA, 64 nt, hsa; identical to SEQ ID NO: 476515

SEQ ID NO: 714013 - RNA, 64 nt, hsa; identical to SEQ ID NO: 476516

SEQ ID NO: 714014 - RNA, 64 nt, hsa; identical to SEQ ID NO: 476517

SEQ ID NO: 714015 - RNA, 59 nt, hsa; identical to SEQ ID NO: 476518

SEQ ID NO: 714016 - RNA, 64 nt, hsa; identical to SEQ ID NO: 476519

SEQ ID NO: 714017 - RNA, 64 nt, hsa; identical to SEQ ID NO: 476520

SEQ ID NO: 714018 - RNA, 64 nt, hsa; identical to SEQ ID NO: 476521

SEQ ID NO: 714019 - RNA, 64 nt, hsa; identical to SEQ ID NO: 476522

SEQ ID NO: 714020 - RNA, 64 nt, hsa; identical to SEQ ID NO: 476523

SEQ ID NO: 714021 - RNA, 64 nt, hsa; identical to SEQ ID NO: 476524

SEQ ID NO: 714022 - RNA, 64 nt, hsa; identical to SEQ ID NO: 476525

SEQ ID NO: 714023 - RNA, 64 nt, hsa; identical to SEQ ID NO: 476526

SEQ ID NO: 714024 - RNA, 64 nt, hsa; identical to SEQ ID NO: 476527

SEQ ID NO: 714025 - RNA, 64 nt, hsa; identical to SEQ ID NO: 476528

SEQ ID NO: 714026 - RNA, 64 nt, hsa; identical to SEQ ID NO: 476529

SEQ ID NO: 714027 - RNA, 64 nt, hsa; identical to SEQ ID NO: 476530

SEQ ID NO: 714028 - RNA, 64 nt, hsa; identical to SEQ ID NO: 476531

SEQ ID NO: 714029 - RNA, 64 nt, hsa; identical to SEQ ID NO: 476532

SEQ ID NO: 714030 - RNA, 64 nt, hsa; identical to SEQ ID NO: 476533

SEQ ID NO: 714031 - RNA, 64 nt, hsa; identical to SEQ ID NO: 476534

SEQ ID NO: 714032 - RNA, 64 nt, hsa; identical to SEQ ID NO: 476535

SEQ ID NO: 714033 - RNA, 64 nt, hsa; identical to SEQ ID NO: 476536

SEQ ID NO: 714034 - RNA, 64 nt, hsa; identical to SEQ ID NO: 476537

SEQ ID NO: 714035 - RNA, 64 nt, hsa; identical to SEQ ID NO: 476538

SEQ ID NO: 714036 - RNA, 64 nt, hsa; identical to SEQ ID NO: 476539

SEQ ID NO: 714037 - RNA, 64 nt, hsa; identical to SEQ ID NO: 476540

SEQ ID NO: 714038 - RNA, 64 nt, hsa; identical to SEQ ID NO: 476541

SEQ ID NO: 714039 - RNA, 64 nt, hsa; identical to SEQ ID NO: 476542

SEQ ID NO: 714040 - RNA, 64 nt, hsa; identical to SEQ ID NO: 476543

SEQ ID NO: 714041 - RNA, 64 nt, hsa; identical to SEQ ID NO: 476544

SEQ ID NO: 714042 - RNA, 64 nt, hsa; identical to SEQ ID NO: 476545

SEQ ID NO: 714043 - RNA, 64 nt, hsa; identical to SEQ ID NO: 476546

SEQ ID NO: 714044 - RNA, 64 nt, hsa; identical to SEQ ID NO: 476547

SEQ ID NO: 714045 - RNA, 64 nt, hsa; identical to SEQ ID NO: 476548

SEQ ID NO: 714046 - RNA, 64 nt, hsa; identical to SEQ ID NO: 476549

SEQ ID NO: 714047 - RNA, 64 nt, hsa; identical to SEQ ID NO: 476550

SEQ ID NO: 714048 - RNA, 64 nt, hsa; identical to SEQ ID NO: 476551

SEQ ID NO: 714049 - RNA, 64 nt, hsa; identical to SEQ ID NO: 476552

SEQ ID NO: 714050 - RNA, 64 nt, hsa; identical to SEQ ID NO: 476553

SEQ ID NO: 714051 - RNA, 64 nt, hsa; identical to SEQ ID NO: 476554

SEQ ID NO: 714052 - RNA, 64 nt, hsa; identical to SEQ ID NO: 307734

SEQ ID NO: 714053 - RNA, 64 nt, hsa; identical to SEQ ID NO: 307735

SEQ ID NO: 714054 - RNA, 64 nt, hsa; identical to SEQ ID NO: 307736

SEQ ID NO: 714055 - RNA, 64 nt, hsa; identical to SEQ ID NO: 307737

SEQ ID NO: 714056 - RNA, 64 nt, hsa; identical to SEQ ID NO: 307738

SEQ ID NO: 714057 - RNA, 64 nt, hsa; identical to SEQ ID NO: 307739

SEQ ID NO: 714058 - RNA, 64 nt, hsa; identical to SEQ ID NO: 307740

SEQ ID NO: 714059 - RNA, 64 nt, hsa; identical to SEQ ID NO: 307741

SEQ ID NO: 714060 - RNA, 59 nt, hsa; identical to SEQ ID NO: 307742

SEQ ID NO: 714061 - RNA, 64 nt, hsa; identical to SEQ ID NO: 307743

SEQ ID NO: 714062 - RNA, 64 nt, hsa; identical to SEQ ID NO: 307744

SEQ ID NO: 714063 - RNA, 64 nt, hsa; identical to SEQ ID NO: 307745

SEQ ID NO: 714064 - RNA, 64 nt, hsa; identical to SEQ ID NO: 307746

SEQ ID NO: 714065 - RNA, 64 nt, hsa; identical to SEQ ID NO: 307747

SEQ ID NO: 714066 - RNA, 64 nt, hsa; identical to SEQ ID NO: 307748

SEQ ID NO: 714067 - RNA, 64 nt, hsa; identical to SEQ ID NO: 307749

SEQ ID NO: 714068 - RNA, 64 nt, hsa; identical to SEQ ID NO: 307750

SEQ ID NO: 714069 - RNA, 64 nt, hsa; identical to SEQ ID NO: 307751

SEQ ID NO: 714070 - RNA, 64 nt, hsa; identical to SEQ ID NO: 307752

SEQ ID NO: 714071 - RNA, 64 nt, hsa; identical to SEQ ID NO: 307753

SEQ ID NO: 714072 - RNA, 64 nt, hsa; identical to SEQ ID NO: 307754

SEQ ID NO: 714073 - RNA, 64 nt, hsa; identical to SEQ ID NO: 307755

SEQ ID NO: 714074 - RNA, 64 nt, hsa; identical to SEQ ID NO: 307756

SEQ ID NO: 714075 - RNA, 64 nt, hsa; identical to SEQ ID NO: 307757

SEQ ID NO: 714076 - RNA, 64 nt, hsa; identical to SEQ ID NO: 307758

SEQ ID NO: 714077 - RNA, 64 nt, hsa; identical to SEQ ID NO: 307759

SEQ ID NO: 714078 - RNA, 64 nt, hsa; identical to SEQ ID NO: 307760

SEQ ID NO: 714079 - RNA, 64 nt, hsa; identical to SEQ ID NO: 307761

SEQ ID NO: 714080 - RNA, 64 nt, hsa; identical to SEQ ID NO: 307762

SEQ ID NO: 714081 - RNA, 64 nt, hsa; identical to SEQ ID NO: 307763

SEQ ID NO: 714082 - RNA, 64 nt, hsa; identical to SEQ ID NO: 307764

SEQ ID NO: 714083 - RNA, 64 nt, hsa; identical to SEQ ID NO: 307765

SEQ ID NO: 714084 - RNA, 64 nt, hsa; identical to SEQ ID NO: 307766

SEQ ID NO: 714085 - RNA, 64 nt, hsa; identical to SEQ ID NO: 307767

SEQ ID NO: 714086 - RNA, 64 nt, hsa; identical to SEQ ID NO: 307768

SEQ ID NO: 714087 - RNA, 64 nt, hsa; identical to SEQ ID NO: 307769

SEQ ID NO: 714088 - RNA, 64 nt, hsa; identical to SEQ ID NO: 307770

SEQ ID NO: 714089 - RNA, 64 nt, hsa; identical to SEQ ID NO: 307771

SEQ ID NO: 714090 - RNA, 64 nt, hsa; identical to SEQ ID NO: 307772

SEQ ID NO: 714091 - RNA, 64 nt, hsa; identical to SEQ ID NO: 307773

SEQ ID NO: 714092 - RNA, 64 nt, hsa; identical to SEQ ID NO: 307774

SEQ ID NO: 714093 - RNA, 64 nt, hsa; identical to SEQ ID NO: 307775

SEQ ID NO: 714094 - RNA, 64 nt, hsa; identical to SEQ ID NO: 307776

SEQ ID NO: 714095 - RNA, 64 nt, hsa; identical to SEQ ID NO: 307777

SEQ ID NO: 714096 - RNA, 64 nt, hsa; identical to SEQ ID NO: 307778

SEQ ID NO: 714097 - RNA, 64 nt, hsa; identical to SEQ ID NO: 307779

SEQ ID NO: 714098 - RNA, 64 nt, hsa; identical to SEQ ID NO: 307780

SEQ ID NO: 714099 - RNA, 64 nt, hsa; identical to SEQ ID NO: 307781

SEQ ID NO: 714100 - RNA, 64 nt, hsa; identical to SEQ ID NO: 307782

SEQ ID NO: 714101 - RNA, 64 nt, hsa; identical to SEQ ID NO: 307783

SEQ ID NO: 714102 - RNA, 64 nt, hsa; identical to SEQ ID NO: 307784

SEQ ID NO: 714103 - RNA, 64 nt, hsa; identical to SEQ ID NO: 307785

SEQ ID NO: 714104 - RNA, 64 nt, hsa; identical to SEQ ID NO: 307786

SEQ ID NO: 714105 - RNA, 64 nt, hsa; identical to SEQ ID NO: 307787

SEQ ID NO: 714106 - RNA, 64 nt, hsa; identical to SEQ ID NO: 307788

SEQ ID NO: 714107 - RNA, 64 nt, hsa; identical to SEQ ID NO: 307789

SEQ ID NO: 714108 - RNA, 64 nt, hsa; identical to SEQ ID NO: 307790

SEQ ID NO: 714109 - RNA, 64 nt, hsa; identical to SEQ ID NO: 307791

SEQ ID NO: 714110 - RNA, 64 nt, hsa; identical to SEQ ID NO: 307792

SEQ ID NO: 714111 - RNA, 64 nt, hsa; identical to SEQ ID NO: 307793

SEQ ID NO: 714112 - RNA, 64 nt, hsa; identical to SEQ ID NO: 307794

SEQ ID NO: 714113 - RNA, 64 nt, hsa; identical to SEQ ID NO: 307795

SEQ ID NO: 714114 - RNA, 64 nt, hsa; identical to SEQ ID NO: 307796

SEQ ID NO: 714115 - RNA, 62 nt, hsa; identical to SEQ ID NO: 307797

SEQ ID NO: 714116 - RNA, 64 nt, hsa; identical to SEQ ID NO: 307798

SEQ ID NO: 714117 - RNA, 64 nt, hsa; identical to SEQ ID NO: 307799

SEQ ID NO: 714118 - RNA, 64 nt, hsa; identical to SEQ ID NO: 307800

SEQ ID NO: 714119 - RNA, 64 nt, hsa; identical to SEQ ID NO: 307801

SEQ ID NO: 714120 - RNA, 64 nt, hsa; identical to SEQ ID NO: 307802

SEQ ID NO: 714121 - RNA, 64 nt, hsa; identical to SEQ ID NO: 307803

SEQ ID NO: 714122 - RNA, 64 nt, hsa; identical to SEQ ID NO: 307804

SEQ ID NO: 714123 - RNA, 64 nt, hsa; identical to SEQ ID NO: 307805

SEQ ID NO: 714124 - RNA, 64 nt, hsa; identical to SEQ ID NO: 307806

SEQ ID NO: 714125 - RNA, 64 nt, hsa; identical to SEQ ID NO: 307807

SEQ ID NO: 714126 - RNA, 64 nt, hsa; identical to SEQ ID NO: 307808

SEQ ID NO: 714127 - RNA, 64 nt, hsa; identical to SEQ ID NO: 307809

SEQ ID NO: 714128 - RNA, 64 nt, hsa
acgagcagucaucggacucacccgaucacagacgagcggucaccagaaucgcccgaucacagac

SEQ ID NO: 714129 - RNA, 64 nt, hsa
acgagcagucaucggacucacccgaucacagacgagcggucaccagacucgcccgaucacagac

SEQ ID NO: 714130 - RNA, 64 nt, hsa
acgagcagucaucggacucacccgaucacagacgagcggucaccggaaucgcccgaucacagac

SEQ ID NO: 714131 - RNA, 64 nt, hsa
gaaugugcgguucggaaucacccgaucacagacgagcggucaccggaaucgcccggucacagac

SEQ ID NO: 714132 - RNA, 64 nt, hsa; identical to SEQ ID NO: 156400

SEQ ID NO: 714133 - RNA, 64 nt, hsa; identical to SEQ ID NO: 156401

SEQ ID NO: 714134 - RNA, 64 nt, hsa; identical to SEQ ID NO: 156402

SEQ ID NO: 714135 - RNA, 64 nt, hsa; identical to SEQ ID NO: 156403

SEQ ID NO: 714136 - RNA, 64 nt, hsa; identical to SEQ ID NO: 156404

SEQ ID NO: 714137 - RNA, 64 nt, hsa; identical to SEQ ID NO: 156405

SEQ ID NO: 714138 - RNA, 64 nt, hsa; identical to SEQ ID NO: 156406

SEQ ID NO: 714139 - RNA, 64 nt, hsa; identical to SEQ ID NO: 156407

SEQ ID NO: 714140 - RNA, 64 nt, hsa; identical to SEQ ID NO: 156408

SEQ ID NO: 714141 - RNA, 64 nt, hsa; identical to SEQ ID NO: 156409

SEQ ID NO: 714142 - RNA, 64 nt, hsa; identical to SEQ ID NO: 156410

SEQ ID NO: 714143 - RNA, 64 nt, hsa; identical to SEQ ID NO: 156411

SEQ ID NO: 714144 - RNA, 64 nt, hsa; identical to SEQ ID NO: 156412

SEQ ID NO: 714145 - RNA, 64 nt, hsa; identical to SEQ ID NO: 156413

SEQ ID NO: 714146 - RNA, 64 nt, hsa; identical to SEQ ID NO: 156414

SEQ ID NO: 714147 - RNA, 64 nt, hsa; identical to SEQ ID NO: 156415

SEQ ID NO: 714148 - RNA, 64 nt, hsa; identical to SEQ ID NO: 156416

SEQ ID NO: 714149 - RNA, 64 nt, hsa; identical to SEQ ID NO: 156417

SEQ ID NO: 714150 - RNA, 64 nt, hsa; identical to SEQ ID NO: 156418

SEQ ID NO: 714151 - RNA, 64 nt, hsa; identical to SEQ ID NO: 156419

SEQ ID NO: 714152 - RNA, 64 nt, hsa; identical to SEQ ID NO: 156420

SEQ ID NO: 714153 - RNA, 56 nt, hsa; identical to SEQ ID NO: 156421

SEQ ID NO: 714154 - RNA, 64 nt, hsa; identical to SEQ ID NO: 156422

SEQ ID NO: 714155 - RNA, 64 nt, hsa; identical to SEQ ID NO: 156423

SEQ ID NO: 714156 - RNA, 64 nt, hsa; identical to SEQ ID NO: 156424

SEQ ID NO: 714157 - RNA, 64 nt, hsa; identical to SEQ ID NO: 156425

SEQ ID NO: 714158 - RNA, 64 nt, hsa; identical to SEQ ID NO: 156426

SEQ ID NO: 714159 - RNA, 64 nt, hsa; identical to SEQ ID NO: 156427

SEQ ID NO: 714160 - RNA, 64 nt, hsa; identical to SEQ ID NO: 156428

SEQ ID NO: 714161 - RNA, 64 nt, hsa; identical to SEQ ID NO: 156429

SEQ ID NO: 714162 - RNA, 64 nt, hsa; identical to SEQ ID NO: 156430

SEQ ID NO: 714163 - RNA, 64 nt, hsa; identical to SEQ ID NO: 156431

SEQ ID NO: 714164 - RNA, 64 nt, hsa; identical to SEQ ID NO: 156432

SEQ ID NO: 714165 - RNA, 64 nt, hsa; identical to SEQ ID NO: 156433

SEQ ID NO: 714166 - RNA, 64 nt, hsa; identical to SEQ ID NO: 156434

SEQ ID NO: 714167 - RNA, 64 nt, hsa; identical to SEQ ID NO: 156435

SEQ ID NO: 714168 - RNA, 64 nt, hsa; identical to SEQ ID NO: 156436

SEQ ID NO: 714169 - RNA, 64 nt, hsa; identical to SEQ ID NO: 361234

SEQ ID NO: 714170 - RNA, 64 nt, hsa; identical to SEQ ID NO: 361235

SEQ ID NO: 714171 - RNA, 64 nt, hsa; identical to SEQ ID NO: 361236

SEQ ID NO: 714172 - RNA, 64 nt, hsa; identical to SEQ ID NO: 361237

SEQ ID NO: 714173 - RNA, 64 nt, hsa; identical to SEQ ID NO: 361238

SEQ ID NO: 714174 - RNA, 64 nt, hsa; identical to SEQ ID NO: 361239

SEQ ID NO: 714175 - RNA, 64 nt, hsa; identical to SEQ ID NO: 564540

SEQ ID NO: 714176 - RNA, 64 nt, hsa; identical to SEQ ID NO: 564541

SEQ ID NO: 714177 - RNA, 64 nt, hsa; identical to SEQ ID NO: 564542

SEQ ID NO: 714178 - RNA, 64 nt, hsa; identical to SEQ ID NO: 564543

SEQ ID NO: 714179 - RNA, 64 nt, hsa; identical to SEQ ID NO: 564544

SEQ ID NO: 714180 - RNA, 64 nt, hsa; identical to SEQ ID NO: 564545

SEQ ID NO: 714181 - RNA, 64 nt, hsa; identical to SEQ ID NO: 564546

SEQ ID NO: 714182 - RNA, 64 nt, hsa; identical to SEQ ID NO: 564547

SEQ ID NO: 714183 - RNA, 64 nt, hsa; identical to SEQ ID NO: 564548

SEQ ID NO: 714184 - RNA, 64 nt, hsa; identical to SEQ ID NO: 564549

SEQ ID NO: 714185 - RNA, 64 nt, hsa; identical to SEQ ID NO: 564550

SEQ ID NO: 714186 - RNA, 64 nt, hsa; identical to SEQ ID NO: 564551

SEQ ID NO: 714187 - RNA, 64 nt, hsa; identical to SEQ ID NO: 564552

SEQ ID NO: 714188 - RNA, 64 nt, hsa; identical to SEQ ID NO: 564553

SEQ ID NO: 714189 - RNA, 64 nt, hsa; identical to SEQ ID NO: 564554

SEQ ID NO: 714190 - RNA, 64 nt, hsa; identical to SEQ ID NO: 564555

SEQ ID NO: 714191 - RNA, 64 nt, hsa; identical to SEQ ID NO: 564556

SEQ ID NO: 714192 - RNA, 64 nt, hsa; identical to SEQ ID NO: 564557

SEQ ID NO: 714193 - RNA, 64 nt, hsa; identical to SEQ ID NO: 564558

SEQ ID NO: 714194 - RNA, 64 nt, hsa; identical to SEQ ID NO: 564559

SEQ ID NO: 714195 - RNA, 64 nt, hsa; identical to SEQ ID NO: 564560

SEQ ID NO: 714196 - RNA, 64 nt, hsa; identical to SEQ ID NO: 564561

SEQ ID NO: 714197 - RNA, 64 nt, hsa; identical to SEQ ID NO: 564562

SEQ ID NO: 714198 - RNA, 64 nt, hsa; identical to SEQ ID NO: 564563

SEQ ID NO: 714199 - RNA, 64 nt, hsa; identical to SEQ ID NO: 564564

SEQ ID NO: 714200 - RNA, 64 nt, hsa; identical to SEQ ID NO: 564565

SEQ ID NO: 714201 - RNA, 64 nt, hsa; identical to SEQ ID NO: 564566

SEQ ID NO: 714202 - RNA, 64 nt, hsa; identical to SEQ ID NO: 564567

SEQ ID NO: 714203 - RNA, 64 nt, hsa; identical to SEQ ID NO: 564568

SEQ ID NO: 714204 - RNA, 64 nt, hsa; identical to SEQ ID NO: 564569

SEQ ID NO: 714205 - RNA, 64 nt, hsa; identical to SEQ ID NO: 564570

SEQ ID NO: 714206 - RNA, 64 nt, hsa; identical to SEQ ID NO: 564571

SEQ ID NO: 714207 - RNA, 64 nt, hsa; identical to SEQ ID NO: 564572

SEQ ID NO: 714208 - RNA, 64 nt, hsa; identical to SEQ ID NO: 564573

SEQ ID NO: 714209 - RNA, 64 nt, hsa; identical to SEQ ID NO: 564574

SEQ ID NO: 714210 - RNA, 64 nt, hsa; identical to SEQ ID NO: 564575

SEQ ID NO: 714211 - RNA, 64 nt, hsa; identical to SEQ ID NO: 564576

SEQ ID NO: 714212 - RNA, 64 nt, hsa
ucacucugucugguauaggcuaauuuugaagaacucccauaaguuucugcugcuucucccauaa

SEQ ID NO: 714213 - RNA, 64 nt, hsa
auuuugaagaacucccauaaguuucugcugcuucucccauaacugcugccaccaccaucagaau

SEQ ID NO: 714214 - RNA, 64 nt, hsa; identical to SEQ ID NO: 395904

SEQ ID NO: 714215 - RNA, 64 nt, hsa; identical to SEQ ID NO: 395905

SEQ ID NO: 714216 - RNA, 64 nt, hsa; identical to SEQ ID NO: 395906

SEQ ID NO: 714217 - RNA, 64 nt, hsa; identical to SEQ ID NO: 395907

SEQ ID NO: 714218 - RNA, 64 nt, hsa; identical to SEQ ID NO: 395908

SEQ ID NO: 714219 - RNA, 64 nt, hsa; identical to SEQ ID NO: 395909

SEQ ID NO: 714220 - RNA, 64 nt, hsa
aaagcaauggaaucuagaauucuuauaacaugaauaacaaaauguacagcaagccuauguaguu

SEQ ID NO: 714221 - RNA, 64 nt, hsa
aucuucuacauguaaaacauuucugaugauuuuuuaacaaaaaauauaugaauuucuucauuug

SEQ ID NO: 714222 - RNA, 64 nt, hsa
uaaauguccauccuccugcauuuguugauaccacuaacaaaaugcuuuguaacagacuugcggu

SEQ ID NO: 714223 - RNA, 64 nt, hsa
guauaguccaugauaucuaaggaguuggcaagcuuaacaaaacccauuuuuuauaaauguccau

SEQ ID NO: 714224 - RNA, 64 nt, hsa
cuuaagagaacuuaaagaacuggugauuuuuuuuuaacaaaaaaagggaccauugcaacuuuug

SEQ ID NO: 714225 - RNA, 64 nt, hsa
ggagaaaacugaugucuucuaugcauccgauucuuaacaaaacugcagggagcuugaaaaaaug

SEQ ID NO: 714226 - RNA, 64 nt, hsa
cauguauguauaaccuguugugaacaaucauacuuaacaaaacuacugaugguuuaugacaacg

SEQ ID NO: 714227 - RNA, 64 nt, hsa
gaauaaauaggcauaugauacccacuuggacuuuuaacaaaaguaaaggaauaaauuugcauau

SEQ ID NO: 714228 - RNA, 64 nt, hsa
acugcauaaguauuauuuuaggucauaaagguuauaacaaaauacauuuaacauugcuuucuuu

SEQ ID NO: 714229 - RNA, 64 nt, hsa
guugcuuagcacuuugcgcauuguguaaguuggguaacaaaaauggcaaaagaaaugcagauuu

SEQ ID NO: 714230 - RNA, 64 nt, hsa
ucagaagucagcuuguucacuguuagaaagaaacuaacaaaagagaacccagagcaaucuagaa

SEQ ID NO: 714231 - RNA, 64 nt, hsa
ggauuagaaccacuuucaaacauuggggccuucuuaacaaaagucuuugauaacuuaagaacca

SEQ ID NO: 714232 - RNA, 64 nt, hsa
gcauagcuaaaggcuaaacauauggcuuuaguaguaacaaaaggguucauagaaacuucauggu

SEQ ID NO: 714233 - RNA, 64 nt, hsa
ggagggaauaaaucaugacuuaucccauuuucaauaacaaaacgaaacuauggcacuaaccaaa

SEQ ID NO: 714234 - RNA, 64 nt, hsa
acaauacugaaugggaaaaguaucuaauauuuuguaacaaaaagaccuucauauuaucuguuuu

SEQ ID NO: 714235 - RNA, 64 nt, hsa
gaagcaagaagaaagccauuguguccucuacaauuaacaaaacuuaucucugauauacaaaggg

SEQ ID NO: 714236 - RNA, 64 nt, hsa
ucagugcuuguuuuuauuuucuugacacauuuauuaacaaaaugcaucauggaaaaaaaaaucu

SEQ ID NO: 714237 - RNA, 64 nt, hsa
caacuagagauuauaaagucucuaaagaaggcaauaacaaaauuuaucaagauauaguacuuuu

SEQ ID NO: 714238 - RNA, 64 nt, hsa
uccuaugagcccauaaggguucugugcuuagcauuaacaaaauaagguuuauagguaaagccaa

SEQ ID NO: 714239 - RNA, 64 nt, hsa
uuaugaauaggauauacuaauaaauacaaaguaauaacaaaagucaaagcaguguucuaaauaa

SEQ ID NO: 714240 - RNA, 62 nt, hsa
uguuaacuguucuuggaaaaaauaaaaacaucaguaacaaaagaaauuggcugccaucgucc

SEQ ID NO: 714241 - RNA, 64 nt, hsa
uuccaguuuuucuuuacuuucucccaguauguuuuaacaaaaaaaaaaaaaagcaggaaaaaag

SEQ ID NO: 714242 - RNA, 64 nt, hsa
uuguuacuuuuaaagggaauauggauaagcauaguaacaaaacccaccagaaucuaagcaguuu

SEQ ID NO: 714243 - RNA, 64 nt, hsa
ucaggcuauuuuaaaaaaacaauauuugcuucuauaacaaaaggaaacaaaucuaagaaucauu

SEQ ID NO: 714244 - RNA, 64 nt, hsa
aaguucuugaaaauauaugcauucuccuaaauauuaacaaaaaugauuuggggaaaugacaugg

SEQ ID NO: 714245 - RNA, 64 nt, hsa
cauucaccuguuuuauaugguuuaaaauucucuuuaacaaaauucagaaaauucaccugaaacg

SEQ ID NO: 714246 - RNA, 64 nt, hsa
gugaaacuccaucuccaaaaaaaaaaagaaaaaguaacaaaaggaaauuauuuguuuuugaaau

SEQ ID NO: 714247 - RNA, 64 nt, hsa
ggucaaaguaaauguauacaguuuuauuacaauguaacaaaaguugaaaaucaggcagaugugu

SEQ ID NO: 714248 - RNA, 64 nt, hsa
uccuaguaagaauugaaucuugagggaguaaugauaacaaaagguuucuugugacugguaacau

SEQ ID NO: 714249 - RNA, 64 nt, hsa
cacaaguauagaaaacucuuaaugauaaaacauuuaacaaaaucuauaacugugaagcuuaauu

SEQ ID NO: 714250 - RNA, 64 nt, hsa
ccaguggcuuuuaaagaaagcugguccucagcacuaacaaaaucacuacaauagccuagugcuu

SEQ ID NO: 714251 - RNA, 64 nt, hsa
uuuucaaagaauucuuuuuucccaaaaagaggaguaacaaaaugucauuucugaaagaggcuua

SEQ ID NO: 714252 - RNA, 64 nt, hsa
uaucugucuauaucauucauuacguguaaguauuuaacaaaaaagcauucuugaccaugaauga

SEQ ID NO: 714253 - RNA, 64 nt, hsa
uguuucuuucuuuccaaaaucagccuucugucuguaacaaaaauguacuuuauagagauggagg

SEQ ID NO: 714254 - RNA, 64 nt, hsa
acacuccccuuaacugucuuugaacuuucucuuuuaacaaaaaugucaagucuuuauaguugua

SEQ ID NO: 714255 - RNA, 64 nt, hsa
gcaaaacuuuguauaauucuguguuauuaacaguuaacaaaacuggagcaucugaauuacaucc

SEQ ID NO: 714256 - RNA, 64 nt, hsa
auggggggauuguuuauaaaguuuggguaauuuauaacaaaauuugcuaagguuugcuaaaaau

SEQ ID NO: 714257 - RNA, 64 nt, hsa
uucaauuuuaugauggagccucuuacagaaacauuaacaaaaugcaggaaucugccacauuucu

SEQ ID NO: 714258 - RNA, 64 nt, hsa
gaucucugaaaggccacagcuggagcaauuugaguaacaaaauaaaguaguauuggguuauaac

SEQ ID NO: 714259 - RNA, 64 nt, hsa
uggacuuuauuguccuguuucuaucaaauuggacuaacaaaaauugauauaauacauucaucac

SEQ ID NO: 714260 - RNA, 64 nt, hsa
uucagccaaacuguagaugaagagggcucugaucuaacaaaauaagguuauaugaguagauacu

SEQ ID NO: 714261 - RNA, 64 nt, hsa
uuuaguacucaauguuucuggacauucucuuugauaacaaaaaauaaauuuuaaaaaggaauuu

SEQ ID NO: 714262 - RNA, 64 nt, hsa
gaagugauacucuuuauuacaagaaacaaggaauuaacaaaaauaaggaacuuguugcuaccuu

SEQ ID NO: 714263 - RNA, 64 nt, hsa
gugauuaaaauccaaaacuuuagcuguauuucaguaacaaaaacauaccuuacuagacugugau

SEQ ID NO: 714264 - RNA, 64 nt, hsa
aaaacuauuaugaaagucaauaaaauagauaauuuaacaaaaguacaggauuagaacaugcuua

SEQ ID NO: 714265 - RNA, 64 nt, hsa
guaucuguuucauaugcuuuuaauuuuaaaggaauaacaaaacugucuggcucaacggcaaguu

SEQ ID NO: 714266 - RNA, 64 nt, hsa
aagcuagucauugagguauaugacaaaauguaaauaacaaaaaacugaaaucuaccaaaagagc

SEQ ID NO: 714267 - RNA, 64 nt, hsa
uugugugugugugguuuauaaauuuuacuacguguaacaaaagucugcuuuuccagcaugagca

SEQ ID NO: 714268 - RNA, 64 nt, hsa
uggccaaauauauaccgugaaaauugguuucauuuaacaaaagaucagaucccuccuucagcug

SEQ ID NO: 714269 - RNA, 64 nt, hsa
gaucuuugguuuuuuugucagguuuaauuucaguuaacaaaauguaaaacaugacauucccugc

SEQ ID NO: 714270 - RNA, 64 nt, hsa
acaaggaaauauagggaaaaguaguagacaaaauuaacaaaaucagacauguuauucaucccca

SEQ ID NO: 714271 - RNA, 64 nt, hsa
auaauucuacaagaauguuuccuuuuacuucaguuaacaaaagaaaacauuuaauaaacauuca

SEQ ID NO: 714272 - RNA, 64 nt, hsa
augaaguauggagguguguauguuuauauguauauaacaaaauauuuucauugugaccacucug

SEQ ID NO: 714273 - RNA, 64 nt, hsa
caauauuccuuauuaauacaaacacaaaaaucauuaacaaaaauauuagcaaacugaauccagc

SEQ ID NO: 714274 - RNA, 64 nt, hsa
caaaucaguuuccuuuuaacauaauuaaucccuuuaacaaaaagccgucuaugggauuaaaaga

SEQ ID NO: 714275 - RNA, 64 nt, hsa
guguuauuuuuguauauuguugagaaagaaacacuaacaaaaggaacaacgaguaauuuauaaa

SEQ ID NO: 714276 - RNA, 64 nt, hsa
cuuuggauacaagguuuggcaaaaaaaaaaauauuaacaaaauauucuguaagaaucaauuguc

SEQ ID NO: 714277 - RNA, 64 nt, hsa
ccuuuaucucuguaaaauuuauacacacaaaaauuaacaaaagauucuguaagaauuaauuggc

SEQ ID NO: 714278 - RNA, 64 nt, hsa
uuucuccucugcuaacuauucauauauguaacuguaacaaaaguguacuauguuaugcacacau

SEQ ID NO: 714279 - RNA, 64 nt, hsa
ugcaguucaguuacaagaugaaaucauguuuuuuuaacaaaagagauaaaauacaauugaagca

SEQ ID NO: 714280 - RNA, 64 nt, hsa; identical to SEQ ID NO: 484563

SEQ ID NO: 714281 - RNA, 64 nt, hsa; identical to SEQ ID NO: 484564

SEQ ID NO: 714282 - RNA, 64 nt, hsa; identical to SEQ ID NO: 484565

SEQ ID NO: 714283 - RNA, 64 nt, hsa; identical to SEQ ID NO: 484566

SEQ ID NO: 714284 - RNA, 64 nt, hsa; identical to SEQ ID NO: 484567

SEQ ID NO: 714285 - RNA, 64 nt, hsa; identical to SEQ ID NO: 484568

SEQ ID NO: 714286 - RNA, 64 nt, hsa; identical to SEQ ID NO: 484569

SEQ ID NO: 714287 - RNA, 64 nt, hsa; identical to SEQ ID NO: 484570

SEQ ID NO: 714288 - RNA, 64 nt, hsa; identical to SEQ ID NO: 484571

SEQ ID NO: 714289 - RNA, 64 nt, hsa; identical to SEQ ID NO: 484572

SEQ ID NO: 714290 - RNA, 64 nt, hsa; identical to SEQ ID NO: 484573

SEQ ID NO: 714291 - RNA, 64 nt, hsa; identical to SEQ ID NO: 484574

SEQ ID NO: 714292 - RNA, 64 nt, hsa; identical to SEQ ID NO: 484575

SEQ ID NO: 714293 - RNA, 64 nt, hsa; identical to SEQ ID NO: 484576

SEQ ID NO: 714294 - RNA, 64 nt, hsa; identical to SEQ ID NO: 484577

SEQ ID NO: 714295 - RNA, 64 nt, hsa; identical to SEQ ID NO: 484578

SEQ ID NO: 714296 - RNA, 64 nt, hsa; identical to SEQ ID NO: 484579

SEQ ID NO: 714297 - RNA, 64 nt, hsa; identical to SEQ ID NO: 484580

SEQ ID NO: 714298 - RNA, 64 nt, hsa; identical to SEQ ID NO: 484581

SEQ ID NO: 714299 - RNA, 64 nt, hsa; identical to SEQ ID NO: 484582

SEQ ID NO: 714300 - RNA, 64 nt, hsa; identical to SEQ ID NO: 484583

SEQ ID NO: 714301 - RNA, 64 nt, hsa; identical to SEQ ID NO: 484584

SEQ ID NO: 714302 - RNA, 64 nt, hsa; identical to SEQ ID NO: 484585

SEQ ID NO: 714303 - RNA, 64 nt, hsa; identical to SEQ ID NO: 484586

SEQ ID NO: 714304 - RNA, 64 nt, hsa; identical to SEQ ID NO: 484587

SEQ ID NO: 714305 - RNA, 64 nt, hsa; identical to SEQ ID NO: 484588

SEQ ID NO: 714306 - RNA, 64 nt, hsa; identical to SEQ ID NO: 484589

SEQ ID NO: 714307 - RNA, 64 nt, hsa; identical to SEQ ID NO: 484590

SEQ ID NO: 714308 - RNA, 64 nt, hsa; identical to SEQ ID NO: 484591

SEQ ID NO: 714309 - RNA, 64 nt, hsa; identical to SEQ ID NO: 484592

SEQ ID NO: 714310 - RNA, 64 nt, hsa; identical to SEQ ID NO: 484593

SEQ ID NO: 714311 - RNA, 64 nt, hsa; identical to SEQ ID NO: 484594

SEQ ID NO: 714312 - RNA, 64 nt, hsa; identical to SEQ ID NO: 484595

SEQ ID NO: 714313 - RNA, 64 nt, hsa; identical to SEQ ID NO: 484596

SEQ ID NO: 714314 - RNA, 64 nt, hsa; identical to SEQ ID NO: 484597

SEQ ID NO: 714315 - RNA, 64 nt, hsa; identical to SEQ ID NO: 484598

SEQ ID NO: 714316 - RNA, 64 nt, hsa; identical to SEQ ID NO: 484599

SEQ ID NO: 714317 - RNA, 64 nt, hsa; identical to SEQ ID NO: 484600

SEQ ID NO: 714318 - RNA, 58 nt, hsa; identical to SEQ ID NO: 165744

SEQ ID NO: 714319 - RNA, 64 nt, hsa; identical to SEQ ID NO: 484602

SEQ ID NO: 714320 - RNA, 64 nt, hsa; identical to SEQ ID NO: 484603

SEQ ID NO: 714321 - RNA, 64 nt, hsa; identical to SEQ ID NO: 484604

SEQ ID NO: 714322 - RNA, 64 nt, hsa; identical to SEQ ID NO: 484605

SEQ ID NO: 714323 - RNA, 64 nt, hsa; identical to SEQ ID NO: 484606

SEQ ID NO: 714324 - RNA, 64 nt, hsa; identical to SEQ ID NO: 484607

SEQ ID NO: 714325 - RNA, 64 nt, hsa; identical to SEQ ID NO: 484608

SEQ ID NO: 714326 - RNA, 64 nt, hsa; identical to SEQ ID NO: 484609

SEQ ID NO: 714327 - RNA, 64 nt, hsa
aaagacaguauuugcagugccgaugauauagagugacuuggagagagauucagaaguuaggggu

SEQ ID NO: 714328 - RNA, 64 nt, hsa
gggauugucuuuuuuuuuuuuaauuauuuucugagacuuggauuaauucaugguaucuugaguc

SEQ ID NO: 714329 - RNA, 64 nt, hsa
uagagcaggugguugaagagaucuucucuggucagacuuggaagaauuuccaaaacugaaguua

SEQ ID NO: 714330 - RNA, 64 nt, hsa
uauuuugagcuuuggguucucaguagugaauugagacuuggaggugacuuuucauguuuggagu

SEQ ID NO: 714331 - RNA, 64 nt, hsa
auugagaggccccugccacuuucaauaaagaccugacuuggagacaugcagguguguguggugg

SEQ ID NO: 714332 - RNA, 64 nt, hsa
uuguuuuuguucugagcuccauaagaacugugcugacuuggaaggugcccugugcuaugucgug

SEQ ID NO: 714333 - RNA, 64 nt, hsa
agcucagcagcagcagugagagggccuugggaaagacuuggaggguuuggcuuauacaagguga

SEQ ID NO: 714334 - RNA, 64 nt, hsa
uguucauguuuuagguaaaaaagcucacacauuugacuuggaagcaauguuugaacaaacucaa

SEQ ID NO: 714335 - RNA, 64 nt, hsa
cggggccgugggcucggcccggacccggcauucggacuuggacucgggaagggccuccuguccc

SEQ ID NO: 714336 - RNA, 64 nt, hsa
uagggccgugggcucggcccggaccuggcauccggacuuggacucggggccaugggcuuggccc

SEQ ID NO: 714337 - RNA, 64 nt, hsa
gaguuacagaguaauuaaaugggguguucacagugacuuggauacaccaauuagaaauuaaaua

SEQ ID NO: 714338 - RNA, 64 nt, hsa
auagaaccuggaauguuaggauuuugaaauguuagacuuggaaggggccuggucugucaacuag

SEQ ID NO: 714339 - RNA, 64 nt, hsa
gacuauggaucuggcagauucuuuauccuuuguggacuuggaggaauuauuagcuguggcacaa

SEQ ID NO: 714340 - RNA, 64 nt, hsa
gaaaaagguagcagugcuucucugguccucaagagacuuggauuuaaagguaggaugauguuuu

SEQ ID NO: 714341 - RNA, 64 nt, hsa
cugccuugcugggcccuucugggacugugcgcuggacuuggagccccuuggaguauggcuuuuc

SEQ ID NO: 714342 - RNA, 64 nt, hsa
ccggacacccccugggauggcucaaaggagucaggacuuggaaguggggacaucaggguagcug

SEQ ID NO: 714343 - RNA, 64 nt, hsa
gggugaagccagcugggcuccugagucugguggggacuuggagaaccuuuaugucuagcuaagg

SEQ ID NO: 714344 - RNA, 64 nt, hsa
caauccacacucuguaucuggcuacucugguggggacuuggagaaccuuuguguccacacucug

SEQ ID NO: 714345 - RNA, 64 nt, hsa
gacuggauuugcuggaagacuugauuuacuggaagacuuggagcuucuuggaagacauggauug

SEQ ID NO: 714346 - RNA, 64 nt, hsa
cuagauuuuucuggaagaacuagauuuacuggaagacuuggauuugguggaagacacagauuuu

SEQ ID NO: 714347 - RNA, 64 nt, hsa
uguccuauagaaaaugccauuaauaaauuauaugaacuacuauacauuauguauauuaauuaaa

SEQ ID NO: 714348 - RNA, 64 nt, hsa
gguggcauccaagucuuggaaaaccgugugaagcaacuacuauaaacuugagucaucccgacgu

SEQ ID NO: 714349 - RNA, 64 nt, hsa
ugucaguuaugaaauuauuauaauucagccuucaaacuacuacugaucaacuaaaggaaagcua

SEQ ID NO: 714350 - RNA, 64 nt, hsa
guggacgauguuugaugauuagacggucaucucuaacuacuaaacuaauaucugcauucuuguu

SEQ ID NO: 714351 - RNA, 63 nt, hsa
uggggggacccagcaaggacucagagagucagacagugccacuuggccacuugggguaaagcc

SEQ ID NO: 714352 - RNA, 63 nt, hsa
cagacagugccacuuggccacuugggguaaagccagugccagcaauaacaguuuaucaugcuc

SEQ ID NO: 714353 - RNA, 63 nt, hsa
ccacagccuugggcccuagguaccccagcugaucagugccaggagagaccagagccucuggag

SEQ ID NO: 714354 - RNA, 63 nt, hsa
acacccccuccucugagcucugaauaugggacccagugccaggagcuggaagacaagguguuu

SEQ ID NO: 714355 - RNA, 63 nt, hsa
aaccuuucccaagccuuccuggcccacaguggccagugccauaggcagugcuguggacaguag

SEQ ID NO: 714356 - RNA, 63 nt, hsa
ccagcaauacaugugcagggguugcugcuuucccagugccaggagaacccccgcuccgaguca

SEQ ID NO: 714357 - RNA, 63 nt, hsa
aucuggcauguguuucuuggauaggggccagugcagugccauccuacagguggcuggagcagc

SEQ ID NO: 714358 - RNA, 63 nt, hsa
gcacccaguccagaaggagcaauggcaccugggcagugccagggcuuaaagcccgcugcuccu

SEQ ID NO: 714359 - RNA, 63 nt, hsa
uggggcaguuuuaguucuuuauauuuagugggucagugccaagugcuaccacuucccaauaaa

SEQ ID NO: 714360 - RNA, 63 nt, hsa
gucucugaggcucuuuguggcaucagccuugcccagugccacacaguaucuccuggcguucua

SEQ ID NO: 714361 - RNA, 63 nt, hsa
uuguuaggaaaacccaugggccgccgccacacucagugccauggggaagcgggcgucuccccc

SEQ ID NO: 714362 - RNA, 63 nt, hsa
cccagggucuaacgguuaaggggacccacauaccagugccaagggggaugucaaguggugaug

SEQ ID NO: 714363 - RNA, 63 nt, hsa
agugauuccuuggugacagguugagggcagcuccagugccagcaauaggguggcacagaagcu

SEQ ID NO: 714364 - RNA, 63 nt, hsa
guggagcuggacuacggcggcaguauggaauuccagugccaggccagugaccucauucccgag

SEQ ID NO: 714365 - RNA, 63 nt, hsa
uucaccaccguauucucagucacuuccacuaaacagugccaguguuuuaagguucugucacac

SEQ ID NO: 714366 - RNA, 63 nt, hsa
gguuuguggcaggccuguguugagcaagacuaucagugccauuuuuuuucaacagcaugugcu

SEQ ID NO: 714367 - RNA, 63 nt, hsa
ggccuggccauagggcaagagcaggccuuacagcagugccacggugacccaagaggcaggguu

SEQ ID NO: 714368 - RNA, 63 nt, hsa
uugccacucagguugcaaaauuagcuaauccuucagugccagcacucagaagucuggcaggug

SEQ ID NO: 714369 - RNA, 63 nt, hsa
aauuucucaggauauuuuugcacugcugagaagcagugccauuaccaauuaauucuugccagg

SEQ ID NO: 714370 - RNA, 63 nt, hsa
gcuacuagaaugcagcuaaggaaagugaaauuucagugccaauuaauuaaaagauacacuguc

SEQ ID NO: 714371 - RNA, 63 nt, hsa
ccggugcuggccacaccagcccccuuucaccuccagugccacaauaaaccuguacccagcugu

SEQ ID NO: 714372 - RNA, 63 nt, hsa
ggcagcaacaacggcaagacucccgugugucaccagugccacaaggucauccgguggguggcc

SEQ ID NO: 714373 - RNA, 63 nt, hsa
auauaauacuaaucuaaacaguacuagaaauuacagugccaagagccaccaggaggcccagcc

SEQ ID NO: 714374 - RNA, 63 nt, hsa
gagguagagcaaugaucagaugggugcacagaccagugccaaucugaacauuguuaauggccu

SEQ ID NO: 714375 - RNA, 63 nt, hsa
uguuggugccauuuucagcaauuacggcuuugacagugccaccucuuugaugccaaaucagca

SEQ ID NO: 714376 - RNA, 63 nt, hsa
ccccucaccacauacccuuugccuuuuagaacucagugccauccugggugcccagggcagagc

SEQ ID NO: 714377 - RNA, 63 nt, hsa
ccuagcccuguggcuuccaccagucuccuccugcagugccacgugguggcauuucucgccuca

SEQ ID NO: 714378 - RNA, 63 nt, hsa
uuaaagcauucuuucuagguuauuuuggggggacagugccaaguccaucuuugcccagucaau

SEQ ID NO: 714379 - RNA, 63 nt, hsa
cauguuuaucauauauccuuaaguggacacauacagugccauguugaugugccucucaguuuu

SEQ ID NO: 714380 - RNA, 63 nt, hsa
gagggccuguccacacccuggauccccguaccacagugccagccaugcccuuccccugggcua

SEQ ID NO: 714381 - RNA, 63 nt, hsa
aggugccaaagagcaggccggccagggcuggggcagugccagacucugaucugaggaccccgu

SEQ ID NO: 714382 - RNA, 63 nt, hsa
aaaacagccacaauaaucagagauggagcaaaccagugccauccagucuuuaugcaaaugaaa

SEQ ID NO: 714383 - RNA, 54 nt, hsa; identical to SEQ ID NO: 248291

SEQ ID NO: 714384 - RNA, 63 nt, hsa
guugauguuuccugcccaaaggacacauuugggcagugccacccacuccuugggccccuagga

SEQ ID NO: 714385 - RNA, 63 nt, hsa
uccccugacaaucuggaagguuccuuuugcccucagugccagccaauccgggcaggacccucg

SEQ ID NO: 714386 - RNA, 63 nt, hsa
auuuccauuucagccaguggguagcugauaagccagugccagcauccagcaugagcagauguc

SEQ ID NO: 714387 - RNA, 63 nt, hsa
agcguuacugcucuccuucccuucaugauaagccagugccagcauccagcgugagcagacguc

SEQ ID NO: 714388 - RNA, 63 nt, hsa
cuccuggcugcaggcacccccagccagaacacgcagugccagccgugccccccaggcaccuuc

SEQ ID NO: 714389 - RNA, 63 nt, hsa
ggcaccuucucagccagcagcuccagcucagagcagugccagccccaccgcaacugcacggcc

SEQ ID NO: 714390 - RNA, 63 nt, hsa
augccccaccugcccugcuuccuggcuccuuaucagugccaugagggcagaggugcuaccugg

SEQ ID NO: 714391 - RNA, 63 nt, hsa
gaggcuagaacagagaagcccuuacuccugguucagugccacgcagggcagaggagagcagcu

SEQ ID NO: 714392 - RNA, 64 nt, hsa; identical to SEQ ID NO: 79348

SEQ ID NO: 714393 - RNA, 64 nt, hsa; identical to SEQ ID NO: 79349

SEQ ID NO: 714394 - RNA, 64 nt, hsa; identical to SEQ ID NO: 79350

SEQ ID NO: 714395 - RNA, 64 nt, hsa; identical to SEQ ID NO: 79351

SEQ ID NO: 714396 - RNA, 64 nt, hsa; identical to SEQ ID NO: 79352

SEQ ID NO: 714397 - RNA, 64 nt, hsa; identical to SEQ ID NO: 79353

SEQ ID NO: 714398 - RNA, 64 nt, hsa; identical to SEQ ID NO: 79354

SEQ ID NO: 714399 - RNA, 64 nt, hsa; identical to SEQ ID NO: 79355

SEQ ID NO: 714400 - RNA, 64 nt, hsa; identical to SEQ ID NO: 79356

SEQ ID NO: 714401 - RNA, 64 nt, hsa; identical to SEQ ID NO: 79357

SEQ ID NO: 714402 - RNA, 64 nt, hsa; identical to SEQ ID NO: 79358

SEQ ID NO: 714403 - RNA, 64 nt, hsa; identical to SEQ ID NO: 79359

SEQ ID NO: 714404 - RNA, 64 nt, hsa; identical to SEQ ID NO: 79360

SEQ ID NO: 714405 - RNA, 64 nt, hsa; identical to SEQ ID NO: 79361

SEQ ID NO: 714406 - RNA, 64 nt, hsa; identical to SEQ ID NO: 79362

SEQ ID NO: 714407 - RNA, 64 nt, hsa; identical to SEQ ID NO: 79363

SEQ ID NO: 714408 - RNA, 64 nt, hsa; identical to SEQ ID NO: 79364

SEQ ID NO: 714409 - RNA, 64 nt, hsa; identical to SEQ ID NO: 79365

SEQ ID NO: 714410 - RNA, 64 nt, hsa; identical to SEQ ID NO: 79366

SEQ ID NO: 714411 - RNA, 64 nt, hsa; identical to SEQ ID NO: 79367

SEQ ID NO: 714412 - RNA, 64 nt, hsa; identical to SEQ ID NO: 79368

SEQ ID NO: 714413 - RNA, 64 nt, hsa; identical to SEQ ID NO: 79369

SEQ ID NO: 714414 - RNA, 64 nt, hsa; identical to SEQ ID NO: 79370

SEQ ID NO: 714415 - RNA, 64 nt, hsa; identical to SEQ ID NO: 79371

SEQ ID NO: 714416 - RNA, 64 nt, hsa; identical to SEQ ID NO: 79372

SEQ ID NO: 714417 - RNA, 64 nt, hsa; identical to SEQ ID NO: 79373

SEQ ID NO: 714418 - RNA, 64 nt, hsa; identical to SEQ ID NO: 79374

SEQ ID NO: 714419 - RNA, 64 nt, hsa; identical to SEQ ID NO: 79375

SEQ ID NO: 714420 - RNA, 64 nt, hsa; identical to SEQ ID NO: 79376

SEQ ID NO: 714421 - RNA, 64 nt, hsa; identical to SEQ ID NO: 79377

SEQ ID NO: 714422 - RNA, 64 nt, hsa; identical to SEQ ID NO: 79378

SEQ ID NO: 714423 - RNA, 64 nt, hsa; identical to SEQ ID NO: 79379

SEQ ID NO: 714424 - RNA, 64 nt, hsa; identical to SEQ ID NO: 79380

SEQ ID NO: 714425 - RNA, 64 nt, hsa; identical to SEQ ID NO: 79381

SEQ ID NO: 714426 - RNA, 64 nt, hsa; identical to SEQ ID NO: 79382

SEQ ID NO: 714427 - RNA, 64 nt, hsa; identical to SEQ ID NO: 79383

SEQ ID NO: 714428 - RNA, 64 nt, hsa; identical to SEQ ID NO: 79384

SEQ ID NO: 714429 - RNA, 64 nt, hsa; identical to SEQ ID NO: 79385

SEQ ID NO: 714430 - RNA, 64 nt, hsa; identical to SEQ ID NO: 79386

SEQ ID NO: 714431 - RNA, 64 nt, hsa; identical to SEQ ID NO: 79387

SEQ ID NO: 714432 - RNA, 64 nt, hsa; identical to SEQ ID NO: 79388

SEQ ID NO: 714433 - RNA, 64 nt, hsa; identical to SEQ ID NO: 79389

SEQ ID NO: 714434 - RNA, 64 nt, hsa; identical to SEQ ID NO: 79390

SEQ ID NO: 714435 - RNA, 64 nt, hsa; identical to SEQ ID NO: 79391

SEQ ID NO: 714436 - RNA, 64 nt, hsa; identical to SEQ ID NO: 558415

SEQ ID NO: 714437 - RNA, 64 nt, hsa; identical to SEQ ID NO: 558416

SEQ ID NO: 714438 - RNA, 64 nt, hsa; identical to SEQ ID NO: 558417

SEQ ID NO: 714439 - RNA, 64 nt, hsa; identical to SEQ ID NO: 558418

SEQ ID NO: 714440 - RNA, 64 nt, hsa
accuccuacuucucuuucuuguaaugaaacucuucaccuuuaggagaccugggcaguccuguca

SEQ ID NO: 714441 - RNA, 64 nt, hsa
augcacacaaauagcuaaggagaauccacccaaacaccuuuaaaggauaggugucuguucauag

SEQ ID NO: 714442 - RNA, 64 nt, hsa
augucaagcagaauaauuugaagcuauuuacaaacaccuuuacuuuugcacuuuuaauucaaca

SEQ ID NO: 714443 - RNA, 64 nt, hsa
aguugugcaaagugaacauuguaacuacaccaaacaccuuuaguacaguccuugcauccauucu

SEQ ID NO: 714444 - RNA, 64 nt, hsa
aaaucuaagcuuagaagaaaaguuuagcguuaagcaccuuuaucuucaugaauaagcuucagcu

SEQ ID NO: 714445 - RNA, 64 nt, hsa
uugggauacuaaucccuagacauugccuucacuccaccuuuaguccuucugagcacucucucgg

SEQ ID NO: 714446 - RNA, 64 nt, hsa
ggucaacggagaauacuagcugcuccuuuuucaccaccuuuaccaauuuccuauuugaugguuu

SEQ ID NO: 714447 - RNA, 64 nt, hsa
acuucagaagcuccuaaaacagagacugaaaggccaccuuuaggauuucuuaguuucauuucaa

SEQ ID NO: 714448 - RNA, 64 nt, hsa
cuucagccuagggauaccugaagcuguugagcaacaccuuuaugaaauguugccagagcagcaa

SEQ ID NO: 714449 - RNA, 64 nt, hsa
gucacauuuccauguuucaacauuaguuugcauucaccuuuacaaaggccuuucuuuagaucug

SEQ ID NO: 714450 - RNA, 64 nt, hsa
gaaucucccacuucaguuucucguugauuguacucaccuuuauggaauccaaauacauccaaaa

SEQ ID NO: 714451 - RNA, 64 nt, hsa
caacucggaauauagcucuuuugaaaguacucgacaccuuuagauaagaauuaaaaccaaccua

SEQ ID NO: 714452 - RNA, 64 nt, hsa
cccucugagcugcacuucaccgcugaccuugccucaccuuuaaccccccaccugagccccagcu

SEQ ID NO: 714453 - RNA, 64 nt, hsa
agccccgcuucaccccuucugacucuggaaaccgcaccuuuaacuuugcagaccuuccuucacc

SEQ ID NO: 714454 - RNA, 64 nt, hsa
cuguuuugacagaaacugacaggaaucaaucaaaacaaucgaauuuugaauugaguaaagugca

SEQ ID NO: 714455 - RNA, 64 nt, hsa
cacggcucuucuucccacggcacuuucugauguaacaaucgaguguguguuuucccaacugcag

SEQ ID NO: 714456 - RNA, 64 nt, hsa
cggcuaugcuaacuugacaaaaaugacugaugcaacaaucgaguuauuagcauuucuuaguauu

SEQ ID NO: 714457 - RNA, 64 nt, hsa
gggggaaagccaaggucuggagaagcucccaggaacaaucgauggccuugcagcacucacacag

SEQ ID NO: 714458 - RNA, 64 nt, hsa
uugcugaacaaugguuaauuaagauauugcuaacacaaucgagugauaauacaguuuuacugca

SEQ ID NO: 714459 - RNA, 64 nt, hsa
acauugggccuugauuuuaaguuguuauauuuguacaaucgaguauuuuagaaauuacaugaaa

SEQ ID NO: 714460 - RNA, 64 nt, hsa
ggcauugccacaaaucagccaggugaaguuucacacaaucgaagacugcacaacuccuagaagg

SEQ ID NO: 714461 - RNA, 64 nt, hsa
ugauucccucucccacccaaggagaacguuugguacaaucgacauccuagccccacccagaggu

SEQ ID NO: 714462 - RNA, 64 nt, hsa
acuccgcugucggcacauucagcugagguucauuacaaucgagacugcaaugugaucuauguuu

SEQ ID NO: 714463 - RNA, 64 nt, hsa
acauaaauauuuucuauguguguuucaguggaugacaaucgagcagcagaagaauggugugccu

SEQ ID NO: 714464 - RNA, 64 nt, hsa
caggcugcugacuggccccacacugugccaccggacaaucgagaccacuucccauccaggccuc

SEQ ID NO: 714465 - RNA, 64 nt, hsa
ggcaaaacaacuuugauaugguacagucauuuugacaaucgauauuugaaucacaauauuugau

SEQ ID NO: 714466 - RNA, 64 nt, hsa
cagacgcugacaguucuucaggcauuucuauuucacaaucgaauugaacacauuggccaaauaa

SEQ ID NO: 714467 - RNA, 64 nt, hsa
agagaccugcauugcuuucuccugguuuuauuuaacaaucgacaaaugaaauucuuacagccug

SEQ ID NO: 714468 - RNA, 64 nt, hsa
gacugugcggaauuuaguggcaguggcuggaacgacaaucgaugugacguugacaauuacugga

SEQ ID NO: 714469 - RNA, 64 nt, hsa
gccaccgcgcccggccccuaaguuaauauuucaaacaaucgaagguaaaacaacauauuguguu

SEQ ID NO: 714470 - RNA, 64 nt, hsa
auccagaagguucguuagccagguggucccuucuacaaucgagcagcuccuuggacagacuguu

SEQ ID NO: 714471 - RNA, 64 nt, hsa
gaucucggccagccaaagacacacgacaaaagagacaaucgauauaauguggccuugaauuuua

SEQ ID NO: 714472 - RNA, 64 nt, hsa
augugccaagucugcagcacagugaccaaaucugacaaucgagcucuggaucaccacuugauua

SEQ ID NO: 714473 - RNA, 64 nt, hsa
ucccccaccuccccacuuuuuuccccaagacaagacaaucgaggucuggcuugagaacgaccuu

SEQ ID NO: 714474 - RNA, 64 nt, hsa
uagucccacaacugcaaaacgucuuacugaagcaacaaucgaaaaaugguucuguuuuaaaaag

SEQ ID NO: 714475 - RNA, 64 nt, hsa; identical to SEQ ID NO: 363148

SEQ ID NO: 714476 - RNA, 64 nt, hsa; identical to SEQ ID NO: 363149

SEQ ID NO: 714477 - RNA, 64 nt, hsa; identical to SEQ ID NO: 363150

SEQ ID NO: 714478 - RNA, 64 nt, hsa; identical to SEQ ID NO: 363151

SEQ ID NO: 714479 - RNA, 64 nt, hsa; identical to SEQ ID NO: 363152

SEQ ID NO: 714480 - RNA, 64 nt, hsa; identical to SEQ ID NO: 363153

SEQ ID NO: 714481 - RNA, 64 nt, hsa; identical to SEQ ID NO: 363154

SEQ ID NO: 714482 - RNA, 64 nt, hsa; identical to SEQ ID NO: 363155

SEQ ID NO: 714483 - RNA, 64 nt, hsa; identical to SEQ ID NO: 363156

SEQ ID NO: 714484 - RNA, 64 nt, hsa; identical to SEQ ID NO: 363157

SEQ ID NO: 714485 - RNA, 64 nt, hsa; identical to SEQ ID NO: 363158

SEQ ID NO: 714486 - RNA, 64 nt, hsa; identical to SEQ ID NO: 363159

SEQ ID NO: 714487 - RNA, 64 nt, hsa; identical to SEQ ID NO: 363160

SEQ ID NO: 714488 - RNA, 64 nt, hsa; identical to SEQ ID NO: 363161

SEQ ID NO: 714489 - RNA, 64 nt, hsa; identical to SEQ ID NO: 363162

SEQ ID NO: 714490 - RNA, 64 nt, hsa; identical to SEQ ID NO: 363163

SEQ ID NO: 714491 - RNA, 64 nt, hsa; identical to SEQ ID NO: 363164

SEQ ID NO: 714492 - RNA, 64 nt, hsa; identical to SEQ ID NO: 363165

SEQ ID NO: 714493 - RNA, 64 nt, hsa; identical to SEQ ID NO: 363166

SEQ ID NO: 714494 - RNA, 64 nt, hsa; identical to SEQ ID NO: 363167

SEQ ID NO: 714495 - RNA, 64 nt, hsa; identical to SEQ ID NO: 363168

SEQ ID NO: 714496 - RNA, 64 nt, hsa; identical to SEQ ID NO: 363169

SEQ ID NO: 714497 - RNA, 64 nt, hsa; identical to SEQ ID NO: 363170

SEQ ID NO: 714498 - RNA, 64 nt, hsa; identical to SEQ ID NO: 363171

SEQ ID NO: 714499 - RNA, 64 nt, hsa; identical to SEQ ID NO: 363172

SEQ ID NO: 714500 - RNA, 64 nt, hsa; identical to SEQ ID NO: 363173

SEQ ID NO: 714501 - RNA, 64 nt, hsa; identical to SEQ ID NO: 363174

SEQ ID NO: 714502 - RNA, 64 nt, hsa; identical to SEQ ID NO: 363175

SEQ ID NO: 714503 - RNA, 64 nt, hsa; identical to SEQ ID NO: 363176

SEQ ID NO: 714504 - RNA, 64 nt, hsa; identical to SEQ ID NO: 363177

SEQ ID NO: 714505 - RNA, 64 nt, hsa; identical to SEQ ID NO: 363178

SEQ ID NO: 714506 - RNA, 64 nt, hsa; identical to SEQ ID NO: 363179

SEQ ID NO: 714507 - RNA, 64 nt, hsa; identical to SEQ ID NO: 363180

SEQ ID NO: 714508 - RNA, 64 nt, hsa; identical to SEQ ID NO: 363181

SEQ ID NO: 714509 - RNA, 64 nt, hsa; identical to SEQ ID NO: 363182

SEQ ID NO: 714510 - RNA, 64 nt, hsa; identical to SEQ ID NO: 363183

SEQ ID NO: 714511 - RNA, 64 nt, hsa; identical to SEQ ID NO: 363184

SEQ ID NO: 714512 - RNA, 64 nt, hsa; identical to SEQ ID NO: 363185

SEQ ID NO: 714513 - RNA, 64 nt, hsa; identical to SEQ ID NO: 363186

SEQ ID NO: 714514 - RNA, 64 nt, hsa; identical to SEQ ID NO: 363187

SEQ ID NO: 714515 - RNA, 64 nt, hsa; identical to SEQ ID NO: 363188

SEQ ID NO: 714516 - RNA, 64 nt, hsa; identical to SEQ ID NO: 363189

SEQ ID NO: 714517 - RNA, 64 nt, hsa; identical to SEQ ID NO: 363190

SEQ ID NO: 714518 - RNA, 64 nt, hsa; identical to SEQ ID NO: 363191

SEQ ID NO: 714519 - RNA, 64 nt, hsa; identical to SEQ ID NO: 363192

SEQ ID NO: 714520 - RNA, 64 nt, hsa; identical to SEQ ID NO: 363193

SEQ ID NO: 714521 - RNA, 64 nt, hsa; identical to SEQ ID NO: 363194

SEQ ID NO: 714522 - RNA, 64 nt, hsa; identical to SEQ ID NO: 363195

SEQ ID NO: 714523 - RNA, 64 nt, hsa; identical to SEQ ID NO: 83158

SEQ ID NO: 714524 - RNA, 64 nt, hsa; identical to SEQ ID NO: 83159

SEQ ID NO: 714525 - RNA, 64 nt, hsa; identical to SEQ ID NO: 83160

SEQ ID NO: 714526 - RNA, 64 nt, hsa; identical to SEQ ID NO: 83161

SEQ ID NO: 714527 - RNA, 64 nt, hsa; identical to SEQ ID NO: 433812

SEQ ID NO: 714528 - RNA, 64 nt, hsa; identical to SEQ ID NO: 433813

SEQ ID NO: 714529 - RNA, 64 nt, hsa; identical to SEQ ID NO: 433814

SEQ ID NO: 714530 - RNA, 64 nt, hsa; identical to SEQ ID NO: 433815

SEQ ID NO: 714531 - RNA, 64 nt, hsa; identical to SEQ ID NO: 433816

SEQ ID NO: 714532 - RNA, 64 nt, hsa; identical to SEQ ID NO: 433817

SEQ ID NO: 714533 - RNA, 64 nt, hsa; identical to SEQ ID NO: 433818

SEQ ID NO: 714534 - RNA, 64 nt, hsa; identical to SEQ ID NO: 433819

SEQ ID NO: 714535 - RNA, 64 nt, hsa; identical to SEQ ID NO: 433820

SEQ ID NO: 714536 - RNA, 64 nt, hsa; identical to SEQ ID NO: 433821

SEQ ID NO: 714537 - RNA, 64 nt, hsa; identical to SEQ ID NO: 433822

SEQ ID NO: 714538 - RNA, 64 nt, hsa; identical to SEQ ID NO: 433823

SEQ ID NO: 714539 - RNA, 64 nt, hsa; identical to SEQ ID NO: 433824

SEQ ID NO: 714540 - RNA, 64 nt, hsa; identical to SEQ ID NO: 433825

SEQ ID NO: 714541 - RNA, 64 nt, hsa; identical to SEQ ID NO: 433826

SEQ ID NO: 714542 - RNA, 64 nt, hsa; identical to SEQ ID NO: 433827

SEQ ID NO: 714543 - RNA, 64 nt, hsa; identical to SEQ ID NO: 433828

SEQ ID NO: 714544 - RNA, 64 nt, hsa; identical to SEQ ID NO: 433829

SEQ ID NO: 714545 - RNA, 64 nt, hsa; identical to SEQ ID NO: 433830

SEQ ID NO: 714546 - RNA, 64 nt, hsa; identical to SEQ ID NO: 433831

SEQ ID NO: 714547 - RNA, 64 nt, hsa; identical to SEQ ID NO: 433832

SEQ ID NO: 714548 - RNA, 64 nt, hsa; identical to SEQ ID NO: 433833

SEQ ID NO: 714549 - RNA, 64 nt, hsa; identical to SEQ ID NO: 433834

SEQ ID NO: 714550 - RNA, 64 nt, hsa; identical to SEQ ID NO: 433835

SEQ ID NO: 714551 - RNA, 64 nt, hsa; identical to SEQ ID NO: 433836

SEQ ID NO: 714552 - RNA, 64 nt, hsa; identical to SEQ ID NO: 433837

SEQ ID NO: 714553 - RNA, 64 nt, hsa; identical to SEQ ID NO: 433838

SEQ ID NO: 714554 - RNA, 64 nt, hsa; identical to SEQ ID NO: 433839

SEQ ID NO: 714555 - RNA, 64 nt, hsa; identical to SEQ ID NO: 433840

SEQ ID NO: 714556 - RNA, 64 nt, hsa; identical to SEQ ID NO: 433841

SEQ ID NO: 714557 - RNA, 64 nt, hsa; identical to SEQ ID NO: 433842

SEQ ID NO: 714558 - RNA, 64 nt, hsa; identical to SEQ ID NO: 433843

SEQ ID NO: 714559 - RNA, 64 nt, hsa; identical to SEQ ID NO: 433844

SEQ ID NO: 714560 - RNA, 64 nt, hsa; identical to SEQ ID NO: 433845

SEQ ID NO: 714561 - RNA, 64 nt, hsa; identical to SEQ ID NO: 433846

SEQ ID NO: 714562 - RNA, 64 nt, hsa; identical to SEQ ID NO: 433847

SEQ ID NO: 714563 - RNA, 64 nt, hsa; identical to SEQ ID NO: 433848

SEQ ID NO: 714564 - RNA, 64 nt, hsa; identical to SEQ ID NO: 433849

SEQ ID NO: 714565 - RNA, 64 nt, hsa; identical to SEQ ID NO: 433850

SEQ ID NO: 714566 - RNA, 64 nt, hsa; identical to SEQ ID NO: 433851

SEQ ID NO: 714567 - RNA, 64 nt, hsa; identical to SEQ ID NO: 433852

SEQ ID NO: 714568 - RNA, 64 nt, hsa; identical to SEQ ID NO: 433853

SEQ ID NO: 714569 - RNA, 64 nt, hsa; identical to SEQ ID NO: 433854

SEQ ID NO: 714570 - RNA, 64 nt, hsa; identical to SEQ ID NO: 433855

SEQ ID NO: 714571 - RNA, 64 nt, hsa; identical to SEQ ID NO: 433856

SEQ ID NO: 714572 - RNA, 64 nt, hsa; identical to SEQ ID NO: 433857

SEQ ID NO: 714573 - RNA, 64 nt, hsa; identical to SEQ ID NO: 433858

SEQ ID NO: 714574 - RNA, 64 nt, hsa; identical to SEQ ID NO: 433859

SEQ ID NO: 714575 - RNA, 64 nt, hsa; identical to SEQ ID NO: 433860

SEQ ID NO: 714576 - RNA, 64 nt, hsa; identical to SEQ ID NO: 545246

SEQ ID NO: 714577 - RNA, 64 nt, hsa; identical to SEQ ID NO: 545247

SEQ ID NO: 714578 - RNA, 64 nt, hsa; identical to SEQ ID NO: 545248

SEQ ID NO: 714579 - RNA, 64 nt, hsa; identical to SEQ ID NO: 545249

SEQ ID NO: 714580 - RNA, 64 nt, hsa; identical to SEQ ID NO: 545250

SEQ ID NO: 714581 - RNA, 64 nt, hsa; identical to SEQ ID NO: 545251

SEQ ID NO: 714582 - RNA, 64 nt, hsa; identical to SEQ ID NO: 545252

SEQ ID NO: 714583 - RNA, 64 nt, hsa; identical to SEQ ID NO: 545253

SEQ ID NO: 714584 - RNA, 64 nt, hsa; identical to SEQ ID NO: 545254

SEQ ID NO: 714585 - RNA, 64 nt, hsa; identical to SEQ ID NO: 545255

SEQ ID NO: 714586 - RNA, 64 nt, hsa; identical to SEQ ID NO: 545256

SEQ ID NO: 714587 - RNA, 64 nt, hsa; identical to SEQ ID NO: 545257

SEQ ID NO: 714588 - RNA, 64 nt, hsa; identical to SEQ ID NO: 545258

SEQ ID NO: 714589 - RNA, 64 nt, hsa; identical to SEQ ID NO: 545259

SEQ ID NO: 714590 - RNA, 64 nt, hsa; identical to SEQ ID NO: 545260

SEQ ID NO: 714591 - RNA, 64 nt, hsa; identical to SEQ ID NO: 545261

SEQ ID NO: 714592 - RNA, 64 nt, hsa; identical to SEQ ID NO: 545262

SEQ ID NO: 714593 - RNA, 64 nt, hsa; identical to SEQ ID NO: 545263

SEQ ID NO: 714594 - RNA, 64 nt, hsa; identical to SEQ ID NO: 545264

SEQ ID NO: 714595 - RNA, 64 nt, hsa; identical to SEQ ID NO: 545265

SEQ ID NO: 714596 - RNA, 64 nt, hsa; identical to SEQ ID NO: 545266

SEQ ID NO: 714597 - RNA, 64 nt, hsa; identical to SEQ ID NO: 545267

SEQ ID NO: 714598 - RNA, 64 nt, hsa; identical to SEQ ID NO: 545268

SEQ ID NO: 714599 - RNA, 64 nt, hsa; identical to SEQ ID NO: 545269

SEQ ID NO: 714600 - RNA, 64 nt, hsa; identical to SEQ ID NO: 545270

SEQ ID NO: 714601 - RNA, 64 nt, hsa; identical to SEQ ID NO: 545271

SEQ ID NO: 714602 - RNA, 64 nt, hsa; identical to SEQ ID NO: 545272

SEQ ID NO: 714603 - RNA, 64 nt, hsa; identical to SEQ ID NO: 545273

SEQ ID NO: 714604 - RNA, 64 nt, hsa; identical to SEQ ID NO: 545274

SEQ ID NO: 714605 - RNA, 64 nt, hsa; identical to SEQ ID NO: 97332

SEQ ID NO: 714606 - RNA, 64 nt, hsa; identical to SEQ ID NO: 97333

SEQ ID NO: 714607 - RNA, 64 nt, hsa; identical to SEQ ID NO: 97334

SEQ ID NO: 714608 - RNA, 64 nt, hsa; identical to SEQ ID NO: 97335

SEQ ID NO: 714609 - RNA, 64 nt, hsa; identical to SEQ ID NO: 97336

SEQ ID NO: 714610 - RNA, 64 nt, hsa; identical to SEQ ID NO: 97337

SEQ ID NO: 714611 - RNA, 64 nt, hsa; identical to SEQ ID NO: 97338

SEQ ID NO: 714612 - RNA, 64 nt, hsa; identical to SEQ ID NO: 97339

SEQ ID NO: 714613 - RNA, 64 nt, hsa; identical to SEQ ID NO: 97340

SEQ ID NO: 714614 - RNA, 64 nt, hsa; identical to SEQ ID NO: 97341

SEQ ID NO: 714615 - RNA, 64 nt, hsa; identical to SEQ ID NO: 97342

SEQ ID NO: 714616 - RNA, 64 nt, hsa; identical to SEQ ID NO: 97343

SEQ ID NO: 714617 - RNA, 64 nt, hsa; identical to SEQ ID NO: 97344

SEQ ID NO: 714618 - RNA, 64 nt, hsa; identical to SEQ ID NO: 97345

SEQ ID NO: 714619 - RNA, 64 nt, hsa; identical to SEQ ID NO: 97346

SEQ ID NO: 714620 - RNA, 64 nt, hsa; identical to SEQ ID NO: 97347

SEQ ID NO: 714621 - RNA, 64 nt, hsa; identical to SEQ ID NO: 97348

SEQ ID NO: 714622 - RNA, 64 nt, hsa; identical to SEQ ID NO: 97349

SEQ ID NO: 714623 - RNA, 64 nt, hsa; identical to SEQ ID NO: 97350

SEQ ID NO: 714624 - RNA, 64 nt, hsa; identical to SEQ ID NO: 97351

SEQ ID NO: 714625 - RNA, 64 nt, hsa; identical to SEQ ID NO: 97352

SEQ ID NO: 714626 - RNA, 64 nt, hsa; identical to SEQ ID NO: 97353

SEQ ID NO: 714627 - RNA, 64 nt, hsa; identical to SEQ ID NO: 97354

SEQ ID NO: 714628 - RNA, 64 nt, hsa; identical to SEQ ID NO: 97355

SEQ ID NO: 714629 - RNA, 64 nt, hsa; identical to SEQ ID NO: 97356

SEQ ID NO: 714630 - RNA, 64 nt, hsa; identical to SEQ ID NO: 97357

SEQ ID NO: 714631 - RNA, 64 nt, hsa; identical to SEQ ID NO: 97358

SEQ ID NO: 714632 - RNA, 64 nt, hsa; identical to SEQ ID NO: 97359

SEQ ID NO: 714633 - RNA, 64 nt, hsa; identical to SEQ ID NO: 97360

SEQ ID NO: 714634 - RNA, 64 nt, hsa; identical to SEQ ID NO: 97361

SEQ ID NO: 714635 - RNA, 64 nt, hsa; identical to SEQ ID NO: 97362

SEQ ID NO: 714636 - RNA, 64 nt, hsa; identical to SEQ ID NO: 97363

SEQ ID NO: 714637 - RNA, 64 nt, hsa; identical to SEQ ID NO: 97364

SEQ ID NO: 714638 - RNA, 64 nt, hsa; identical to SEQ ID NO: 97365

SEQ ID NO: 714639 - RNA, 64 nt, hsa; identical to SEQ ID NO: 97366

SEQ ID NO: 714640 - RNA, 64 nt, hsa; identical to SEQ ID NO: 97367

SEQ ID NO: 714641 - RNA, 64 nt, hsa; identical to SEQ ID NO: 97368

SEQ ID NO: 714642 - RNA, 64 nt, hsa; identical to SEQ ID NO: 97369

SEQ ID NO: 714643 - RNA, 64 nt, hsa; identical to SEQ ID NO: 97370

SEQ ID NO: 714644 - RNA, 64 nt, hsa; identical to SEQ ID NO: 97371

SEQ ID NO: 714645 - RNA, 64 nt, hsa; identical to SEQ ID NO: 97372

SEQ ID NO: 714646 - RNA, 64 nt, hsa; identical to SEQ ID NO: 97373

SEQ ID NO: 714647 - RNA, 64 nt, hsa; identical to SEQ ID NO: 97374

SEQ ID NO: 714648 - RNA, 64 nt, hsa; identical to SEQ ID NO: 97375

SEQ ID NO: 714649 - RNA, 64 nt, hsa; identical to SEQ ID NO: 97376

SEQ ID NO: 714650 - RNA, 64 nt, hsa; identical to SEQ ID NO: 97377

SEQ ID NO: 714651 - RNA, 64 nt, hsa; identical to SEQ ID NO: 97378

SEQ ID NO: 714652 - RNA, 64 nt, hsa; identical to SEQ ID NO: 97379

SEQ ID NO: 714653 - RNA, 64 nt, hsa; identical to SEQ ID NO: 97380

SEQ ID NO: 714654 - RNA, 64 nt, hsa; identical to SEQ ID NO: 97381

SEQ ID NO: 714655 - RNA, 64 nt, hsa; identical to SEQ ID NO: 97382

SEQ ID NO: 714656 - RNA, 64 nt, hsa; identical to SEQ ID NO: 97383

SEQ ID NO: 714657 - RNA, 64 nt, hsa; identical to SEQ ID NO: 97384

SEQ ID NO: 714658 - RNA, 64 nt, hsa; identical to SEQ ID NO: 97385

SEQ ID NO: 714659 - RNA, 64 nt, hsa; identical to SEQ ID NO: 97386

SEQ ID NO: 714660 - RNA, 64 nt, hsa; identical to SEQ ID NO: 97387

SEQ ID NO: 714661 - RNA, 64 nt, hsa; identical to SEQ ID NO: 97388

SEQ ID NO: 714662 - RNA, 64 nt, hsa; identical to SEQ ID NO: 97389

SEQ ID NO: 714663 - RNA, 64 nt, hsa; identical to SEQ ID NO: 97390

SEQ ID NO: 714664 - RNA, 64 nt, hsa; identical to SEQ ID NO: 97391

SEQ ID NO: 714665 - RNA, 64 nt, hsa; identical to SEQ ID NO: 97392

SEQ ID NO: 714666 - RNA, 64 nt, hsa; identical to SEQ ID NO: 97393

SEQ ID NO: 714667 - RNA, 64 nt, hsa; identical to SEQ ID NO: 97394

SEQ ID NO: 714668 - RNA, 64 nt, hsa; identical to SEQ ID NO: 653567

SEQ ID NO: 714669 - RNA, 64 nt, hsa; identical to SEQ ID NO: 653568

SEQ ID NO: 714670 - RNA, 64 nt, hsa; identical to SEQ ID NO: 653569

SEQ ID NO: 714671 - RNA, 64 nt, hsa; identical to SEQ ID NO: 653570

SEQ ID NO: 714672 - RNA, 64 nt, hsa; identical to SEQ ID NO: 653571

SEQ ID NO: 714673 - RNA, 64 nt, hsa; identical to SEQ ID NO: 653572

SEQ ID NO: 714674 - RNA, 64 nt, hsa; identical to SEQ ID NO: 653573

SEQ ID NO: 714675 - RNA, 64 nt, hsa; identical to SEQ ID NO: 653574

SEQ ID NO: 714676 - RNA, 64 nt, hsa; identical to SEQ ID NO: 653575

SEQ ID NO: 714677 - RNA, 64 nt, hsa; identical to SEQ ID NO: 653576

SEQ ID NO: 714678 - RNA, 64 nt, hsa; identical to SEQ ID NO: 653577

SEQ ID NO: 714679 - RNA, 64 nt, hsa; identical to SEQ ID NO: 653578

SEQ ID NO: 714680 - RNA, 64 nt, hsa; identical to SEQ ID NO: 653579

SEQ ID NO: 714681 - RNA, 64 nt, hsa; identical to SEQ ID NO: 653580

SEQ ID NO: 714682 - RNA, 64 nt, hsa; identical to SEQ ID NO: 653581

SEQ ID NO: 714683 - RNA, 64 nt, hsa; identical to SEQ ID NO: 653582

SEQ ID NO: 714684 - RNA, 64 nt, hsa; identical to SEQ ID NO: 653583

SEQ ID NO: 714685 - RNA, 64 nt, hsa; identical to SEQ ID NO: 653584

SEQ ID NO: 714686 - RNA, 64 nt, hsa; identical to SEQ ID NO: 653585

SEQ ID NO: 714687 - RNA, 64 nt, hsa; identical to SEQ ID NO: 653586

SEQ ID NO: 714688 - RNA, 64 nt, hsa; identical to SEQ ID NO: 653587

SEQ ID NO: 714689 - RNA, 64 nt, hsa; identical to SEQ ID NO: 653588

SEQ ID NO: 714690 - RNA, 64 nt, hsa; identical to SEQ ID NO: 653589

SEQ ID NO: 714691 - RNA, 64 nt, hsa; identical to SEQ ID NO: 653590

SEQ ID NO: 714692 - RNA, 64 nt, hsa; identical to SEQ ID NO: 653591

SEQ ID NO: 714693 - RNA, 64 nt, hsa; identical to SEQ ID NO: 653592

SEQ ID NO: 714694 - RNA, 64 nt, hsa; identical to SEQ ID NO: 653593

SEQ ID NO: 714695 - RNA, 64 nt, hsa; identical to SEQ ID NO: 653594

SEQ ID NO: 714696 - RNA, 64 nt, hsa; identical to SEQ ID NO: 653595

SEQ ID NO: 714697 - RNA, 64 nt, hsa; identical to SEQ ID NO: 653596

SEQ ID NO: 714698 - RNA, 64 nt, hsa; identical to SEQ ID NO: 653597

SEQ ID NO: 714699 - RNA, 64 nt, hsa; identical to SEQ ID NO: 653598

SEQ ID NO: 714700 - RNA, 64 nt, hsa; identical to SEQ ID NO: 653599

SEQ ID NO: 714701 - RNA, 64 nt, hsa; identical to SEQ ID NO: 653600

SEQ ID NO: 714702 - RNA, 63 nt, hsa; identical to SEQ ID NO: 58102

SEQ ID NO: 714703 - RNA, 63 nt, hsa; identical to SEQ ID NO: 58103

SEQ ID NO: 714704 - RNA, 63 nt, hsa; identical to SEQ ID NO: 58104

SEQ ID NO: 714705 - RNA, 63 nt, hsa; identical to SEQ ID NO: 58105

SEQ ID NO: 714706 - RNA, 63 nt, hsa; identical to SEQ ID NO: 58106

SEQ ID NO: 714707 - RNA, 63 nt, hsa; identical to SEQ ID NO: 58107

SEQ ID NO: 714708 - RNA, 63 nt, hsa; identical to SEQ ID NO: 58108

SEQ ID NO: 714709 - RNA, 63 nt, hsa; identical to SEQ ID NO: 58109

SEQ ID NO: 714710 - RNA, 63 nt, hsa; identical to SEQ ID NO: 58110

SEQ ID NO: 714711 - RNA, 63 nt, hsa; identical to SEQ ID NO: 58111

SEQ ID NO: 714712 - RNA, 63 nt, hsa; identical to SEQ ID NO: 58112

SEQ ID NO: 714713 - RNA, 63 nt, hsa; identical to SEQ ID NO: 58113

SEQ ID NO: 714714 - RNA, 63 nt, hsa; identical to SEQ ID NO: 58114

SEQ ID NO: 714715 - RNA, 63 nt, hsa; identical to SEQ ID NO: 58115

SEQ ID NO: 714716 - RNA, 63 nt, hsa; identical to SEQ ID NO: 58116

SEQ ID NO: 714717 - RNA, 63 nt, hsa; identical to SEQ ID NO: 58117

SEQ ID NO: 714718 - RNA, 63 nt, hsa; identical to SEQ ID NO: 58118

SEQ ID NO: 714719 - RNA, 63 nt, hsa; identical to SEQ ID NO: 58119

SEQ ID NO: 714720 - RNA, 63 nt, hsa; identical to SEQ ID NO: 58120

SEQ ID NO: 714721 - RNA, 63 nt, hsa; identical to SEQ ID NO: 58121

SEQ ID NO: 714722 - RNA, 63 nt, hsa; identical to SEQ ID NO: 58122

SEQ ID NO: 714723 - RNA, 63 nt, hsa; identical to SEQ ID NO: 58123

SEQ ID NO: 714724 - RNA, 63 nt, hsa; identical to SEQ ID NO: 58124

SEQ ID NO: 714725 - RNA, 63 nt, hsa; identical to SEQ ID NO: 58125

SEQ ID NO: 714726 - RNA, 63 nt, hsa; identical to SEQ ID NO: 58126

SEQ ID NO: 714727 - RNA, 63 nt, hsa; identical to SEQ ID NO: 58127

SEQ ID NO: 714728 - RNA, 63 nt, hsa; identical to SEQ ID NO: 58128

SEQ ID NO: 714729 - RNA, 63 nt, hsa; identical to SEQ ID NO: 58129

SEQ ID NO: 714730 - RNA, 63 nt, hsa; identical to SEQ ID NO: 58130

SEQ ID NO: 714731 - RNA, 63 nt, hsa; identical to SEQ ID NO: 58131

SEQ ID NO: 714732 - RNA, 63 nt, hsa; identical to SEQ ID NO: 102980

SEQ ID NO: 714733 - RNA, 63 nt, hsa; identical to SEQ ID NO: 102981

SEQ ID NO: 714734 - RNA, 63 nt, hsa; identical to SEQ ID NO: 102982

SEQ ID NO: 714735 - RNA, 63 nt, hsa; identical to SEQ ID NO: 102983

SEQ ID NO: 714736 - RNA, 63 nt, hsa; identical to SEQ ID NO: 102984

SEQ ID NO: 714737 - RNA, 63 nt, hsa; identical to SEQ ID NO: 102985

SEQ ID NO: 714738 - RNA, 63 nt, hsa; identical to SEQ ID NO: 102986

SEQ ID NO: 714739 - RNA, 63 nt, hsa; identical to SEQ ID NO: 102987

SEQ ID NO: 714740 - RNA, 63 nt, hsa; identical to SEQ ID NO: 102988

SEQ ID NO: 714741 - RNA, 63 nt, hsa; identical to SEQ ID NO: 102989

SEQ ID NO: 714742 - RNA, 63 nt, hsa; identical to SEQ ID NO: 102990

SEQ ID NO: 714743 - RNA, 58 nt, hsa; identical to SEQ ID NO: 102991

SEQ ID NO: 714744 - RNA, 63 nt, hsa; identical to SEQ ID NO: 102992

SEQ ID NO: 714745 - RNA, 63 nt, hsa; identical to SEQ ID NO: 102993

SEQ ID NO: 714746 - RNA, 63 nt, hsa; identical to SEQ ID NO: 102994

SEQ ID NO: 714747 - RNA, 63 nt, hsa; identical to SEQ ID NO: 102995

SEQ ID NO: 714748 - RNA, 63 nt, hsa; identical to SEQ ID NO: 102996

SEQ ID NO: 714749 - RNA, 63 nt, hsa; identical to SEQ ID NO: 102997

SEQ ID NO: 714750 - RNA, 63 nt, hsa; identical to SEQ ID NO: 102998

SEQ ID NO: 714751 - RNA, 63 nt, hsa; identical to SEQ ID NO: 102999

SEQ ID NO: 714752 - RNA, 63 nt, hsa; identical to SEQ ID NO: 103000

SEQ ID NO: 714753 - RNA, 63 nt, hsa; identical to SEQ ID NO: 103001

SEQ ID NO: 714754 - RNA, 63 nt, hsa; identical to SEQ ID NO: 103002

SEQ ID NO: 714755 - RNA, 63 nt, hsa; identical to SEQ ID NO: 103003

SEQ ID NO: 714756 - RNA, 63 nt, hsa; identical to SEQ ID NO: 103004

SEQ ID NO: 714757 - RNA, 63 nt, hsa; identical to SEQ ID NO: 103005

SEQ ID NO: 714758 - RNA, 63 nt, hsa; identical to SEQ ID NO: 103006

SEQ ID NO: 714759 - RNA, 63 nt, hsa; identical to SEQ ID NO: 103007

SEQ ID NO: 714760 - RNA, 63 nt, hsa; identical to SEQ ID NO: 103008

SEQ ID NO: 714761 - RNA, 63 nt, hsa; identical to SEQ ID NO: 103009

SEQ ID NO: 714762 - RNA, 63 nt, hsa; identical to SEQ ID NO: 103010

SEQ ID NO: 714763 - RNA, 63 nt, hsa; identical to SEQ ID NO: 103011

SEQ ID NO: 714764 - RNA, 63 nt, hsa; identical to SEQ ID NO: 103012

SEQ ID NO: 714765 - RNA, 63 nt, hsa; identical to SEQ ID NO: 103013

SEQ ID NO: 714766 - RNA, 53 nt, hsa; identical to SEQ ID NO: 103014

SEQ ID NO: 714767 - RNA, 63 nt, hsa; identical to SEQ ID NO: 103015

SEQ ID NO: 714768 - RNA, 63 nt, hsa; identical to SEQ ID NO: 103016

SEQ ID NO: 714769 - RNA, 63 nt, hsa; identical to SEQ ID NO: 103017

SEQ ID NO: 714770 - RNA, 63 nt, hsa; identical to SEQ ID NO: 103018

SEQ ID NO: 714771 - RNA, 63 nt, hsa; identical to SEQ ID NO: 103019

SEQ ID NO: 714772 - RNA, 63 nt, hsa; identical to SEQ ID NO: 103020

SEQ ID NO: 714773 - RNA, 63 nt, hsa; identical to SEQ ID NO: 103021

SEQ ID NO: 714774 - RNA, 63 nt, hsa; identical to SEQ ID NO: 103022

SEQ ID NO: 714775 - RNA, 63 nt, hsa; identical to SEQ ID NO: 103023

SEQ ID NO: 714776 - RNA, 63 nt, hsa; identical to SEQ ID NO: 103024

SEQ ID NO: 714777 - RNA, 63 nt, hsa; identical to SEQ ID NO: 103025

SEQ ID NO: 714778 - RNA, 63 nt, hsa; identical to SEQ ID NO: 103026

SEQ ID NO: 714779 - RNA, 63 nt, hsa; identical to SEQ ID NO: 103027

SEQ ID NO: 714780 - RNA, 63 nt, hsa; identical to SEQ ID NO: 103028

SEQ ID NO: 714781 - RNA, 63 nt, hsa; identical to SEQ ID NO: 103029

SEQ ID NO: 714782 - RNA, 63 nt, hsa; identical to SEQ ID NO: 103030

SEQ ID NO: 714783 - RNA, 63 nt, hsa; identical to SEQ ID NO: 103031

SEQ ID NO: 714784 - RNA, 63 nt, hsa; identical to SEQ ID NO: 103032

SEQ ID NO: 714785 - RNA, 63 nt, hsa; identical to SEQ ID NO: 103033

SEQ ID NO: 714786 - RNA, 63 nt, hsa; identical to SEQ ID NO: 103034

SEQ ID NO: 714787 - RNA, 63 nt, hsa; identical to SEQ ID NO: 103035

SEQ ID NO: 714788 - RNA, 63 nt, hsa; identical to SEQ ID NO: 103036

SEQ ID NO: 714789 - RNA, 63 nt, hsa; identical to SEQ ID NO: 103037

SEQ ID NO: 714790 - RNA, 63 nt, hsa; identical to SEQ ID NO: 103038

SEQ ID NO: 714791 - RNA, 63 nt, hsa; identical to SEQ ID NO: 103039

SEQ ID NO: 714792 - RNA, 63 nt, hsa; identical to SEQ ID NO: 103040

SEQ ID NO: 714793 - RNA, 63 nt, hsa; identical to SEQ ID NO: 103041

SEQ ID NO: 714794 - RNA, 63 nt, hsa; identical to SEQ ID NO: 103042

SEQ ID NO: 714795 - RNA, 63 nt, hsa; identical to SEQ ID NO: 103043

SEQ ID NO: 714796 - RNA, 63 nt, hsa; identical to SEQ ID NO: 103044

SEQ ID NO: 714797 - RNA, 63 nt, hsa; identical to SEQ ID NO: 103045

SEQ ID NO: 714798 - RNA, 63 nt, hsa; identical to SEQ ID NO: 103046

SEQ ID NO: 714799 - RNA, 63 nt, hsa; identical to SEQ ID NO: 103047

SEQ ID NO: 714800 - RNA, 63 nt, hsa; identical to SEQ ID NO: 103048

SEQ ID NO: 714801 - RNA, 63 nt, hsa; identical to SEQ ID NO: 103049

SEQ ID NO: 714802 - RNA, 63 nt, hsa; identical to SEQ ID NO: 103050

SEQ ID NO: 714803 - RNA, 63 nt, hsa; identical to SEQ ID NO: 103051

SEQ ID NO: 714804 - RNA, 63 nt, hsa; identical to SEQ ID NO: 103052

SEQ ID NO: 714805 - RNA, 63 nt, hsa; identical to SEQ ID NO: 103053

SEQ ID NO: 714806 - RNA, 63 nt, hsa; identical to SEQ ID NO: 103054

SEQ ID NO: 714807 - RNA, 63 nt, hsa; identical to SEQ ID NO: 103055

SEQ ID NO: 714808 - RNA, 63 nt, hsa; identical to SEQ ID NO: 103056

SEQ ID NO: 714809 - RNA, 63 nt, hsa; identical to SEQ ID NO: 103057

SEQ ID NO: 714810 - RNA, 63 nt, hsa; identical to SEQ ID NO: 103058

SEQ ID NO: 714811 - RNA, 63 nt, hsa; identical to SEQ ID NO: 103059

SEQ ID NO: 714812 - RNA, 63 nt, hsa; identical to SEQ ID NO: 103060

SEQ ID NO: 714813 - RNA, 63 nt, hsa; identical to SEQ ID NO: 103061

SEQ ID NO: 714814 - RNA, 63 nt, hsa; identical to SEQ ID NO: 103062

SEQ ID NO: 714815 - RNA, 63 nt, hsa; identical to SEQ ID NO: 103063

SEQ ID NO: 714816 - RNA, 63 nt, hsa; identical to SEQ ID NO: 103064

SEQ ID NO: 714817 - RNA, 63 nt, hsa; identical to SEQ ID NO: 103065

SEQ ID NO: 714818 - RNA, 63 nt, hsa; identical to SEQ ID NO: 103066

SEQ ID NO: 714819 - RNA, 63 nt, hsa; identical to SEQ ID NO: 103067

SEQ ID NO: 714820 - RNA, 63 nt, hsa; identical to SEQ ID NO: 103068

SEQ ID NO: 714821 - RNA, 63 nt, hsa; identical to SEQ ID NO: 103069

SEQ ID NO: 714822 - RNA, 63 nt, hsa; identical to SEQ ID NO: 103070

SEQ ID NO: 714823 - RNA, 63 nt, hsa; identical to SEQ ID NO: 103071

SEQ ID NO: 714824 - RNA, 63 nt, hsa; identical to SEQ ID NO: 103072

SEQ ID NO: 714825 - RNA, 63 nt, hsa; identical to SEQ ID NO: 103073

SEQ ID NO: 714826 - RNA, 63 nt, hsa; identical to SEQ ID NO: 103074

SEQ ID NO: 714827 - RNA, 63 nt, hsa; identical to SEQ ID NO: 103075

SEQ ID NO: 714828 - RNA, 63 nt, hsa; identical to SEQ ID NO: 103076

SEQ ID NO: 714829 - RNA, 63 nt, hsa; identical to SEQ ID NO: 103077

SEQ ID NO: 714830 - RNA, 63 nt, hsa; identical to SEQ ID NO: 103078

SEQ ID NO: 714831 - RNA, 63 nt, hsa; identical to SEQ ID NO: 103079

SEQ ID NO: 714832 - RNA, 63 nt, hsa; identical to SEQ ID NO: 103080

SEQ ID NO: 714833 - RNA, 63 nt, hsa; identical to SEQ ID NO: 103081

SEQ ID NO: 714834 - RNA, 63 nt, hsa; identical to SEQ ID NO: 103082

SEQ ID NO: 714835 - RNA, 63 nt, hsa; identical to SEQ ID NO: 103083

SEQ ID NO: 714836 - RNA, 63 nt, hsa; identical to SEQ ID NO: 103084

SEQ ID NO: 714837 - RNA, 63 nt, hsa; identical to SEQ ID NO: 103085

SEQ ID NO: 714838 - RNA, 63 nt, hsa; identical to SEQ ID NO: 103086

SEQ ID NO: 714839 - RNA, 63 nt, hsa; identical to SEQ ID NO: 103087

SEQ ID NO: 714840 - RNA, 63 nt, hsa; identical to SEQ ID NO: 103088

SEQ ID NO: 714841 - RNA, 63 nt, hsa; identical to SEQ ID NO: 103089

SEQ ID NO: 714842 - RNA, 63 nt, hsa; identical to SEQ ID NO: 103090

SEQ ID NO: 714843 - RNA, 63 nt, hsa; identical to SEQ ID NO: 103091

SEQ ID NO: 714844 - RNA, 63 nt, hsa; identical to SEQ ID NO: 103092

SEQ ID NO: 714845 - RNA, 63 nt, hsa; identical to SEQ ID NO: 103093

SEQ ID NO: 714846 - RNA, 63 nt, hsa; identical to SEQ ID NO: 103094

SEQ ID NO: 714847 - RNA, 63 nt, hsa; identical to SEQ ID NO: 103095

SEQ ID NO: 714848 - RNA, 63 nt, hsa; identical to SEQ ID NO: 103096

SEQ ID NO: 714849 - RNA, 63 nt, hsa; identical to SEQ ID NO: 103097

SEQ ID NO: 714850 - RNA, 60 nt, hsa; identical to SEQ ID NO: 103098

SEQ ID NO: 714851 - RNA, 63 nt, hsa; identical to SEQ ID NO: 103099

SEQ ID NO: 714852 - RNA, 63 nt, hsa; identical to SEQ ID NO: 103100

SEQ ID NO: 714853 - RNA, 63 nt, hsa; identical to SEQ ID NO: 103101

SEQ ID NO: 714854 - RNA, 63 nt, hsa; identical to SEQ ID NO: 103102

SEQ ID NO: 714855 - RNA, 63 nt, hsa; identical to SEQ ID NO: 103103

SEQ ID NO: 714856 - RNA, 63 nt, hsa; identical to SEQ ID NO: 103104

SEQ ID NO: 714857 - RNA, 63 nt, hsa; identical to SEQ ID NO: 103105

SEQ ID NO: 714858 - RNA, 63 nt, hsa; identical to SEQ ID NO: 103106

SEQ ID NO: 714859 - RNA, 63 nt, hsa; identical to SEQ ID NO: 103107

SEQ ID NO: 714860 - RNA, 63 nt, hsa; identical to SEQ ID NO: 103108

SEQ ID NO: 714861 - RNA, 63 nt, hsa; identical to SEQ ID NO: 103109

SEQ ID NO: 714862 - RNA, 63 nt, hsa; identical to SEQ ID NO: 103110

SEQ ID NO: 714863 - RNA, 63 nt, hsa; identical to SEQ ID NO: 103111

SEQ ID NO: 714864 - RNA, 63 nt, hsa; identical to SEQ ID NO: 103112

SEQ ID NO: 714865 - RNA, 63 nt, hsa; identical to SEQ ID NO: 103113

SEQ ID NO: 714866 - RNA, 63 nt, hsa; identical to SEQ ID NO: 103114

SEQ ID NO: 714867 - RNA, 63 nt, hsa; identical to SEQ ID NO: 103115

SEQ ID NO: 714868 - RNA, 63 nt, hsa; identical to SEQ ID NO: 103116

SEQ ID NO: 714869 - RNA, 63 nt, hsa; identical to SEQ ID NO: 103117

SEQ ID NO: 714870 - RNA, 63 nt, hsa; identical to SEQ ID NO: 103118

SEQ ID NO: 714871 - RNA, 63 nt, hsa; identical to SEQ ID NO: 103119

SEQ ID NO: 714872 - RNA, 63 nt, hsa; identical to SEQ ID NO: 103120

SEQ ID NO: 714873 - RNA, 63 nt, hsa; identical to SEQ ID NO: 103121

SEQ ID NO: 714874 - RNA, 63 nt, hsa; identical to SEQ ID NO: 103122

SEQ ID NO: 714875 - RNA, 63 nt, hsa; identical to SEQ ID NO: 103123

SEQ ID NO: 714876 - RNA, 63 nt, hsa; identical to SEQ ID NO: 103124

SEQ ID NO: 714877 - RNA, 63 nt, hsa; identical to SEQ ID NO: 103125

SEQ ID NO: 714878 - RNA, 63 nt, hsa; identical to SEQ ID NO: 103126

SEQ ID NO: 714879 - RNA, 63 nt, hsa; identical to SEQ ID NO: 103127

SEQ ID NO: 714880 - RNA, 63 nt, hsa; identical to SEQ ID NO: 103128

SEQ ID NO: 714881 - RNA, 63 nt, hsa; identical to SEQ ID NO: 103129

SEQ ID NO: 714882 - RNA, 63 nt, hsa; identical to SEQ ID NO: 103130

SEQ ID NO: 714883 - RNA, 63 nt, hsa; identical to SEQ ID NO: 103131

SEQ ID NO: 714884 - RNA, 63 nt, hsa; identical to SEQ ID NO: 103132

SEQ ID NO: 714885 - RNA, 63 nt, hsa; identical to SEQ ID NO: 103133

SEQ ID NO: 714886 - RNA, 63 nt, hsa; identical to SEQ ID NO: 103134

SEQ ID NO: 714887 - RNA, 63 nt, hsa; identical to SEQ ID NO: 103135

SEQ ID NO: 714888 - RNA, 63 nt, hsa; identical to SEQ ID NO: 103136

SEQ ID NO: 714889 - RNA, 63 nt, hsa; identical to SEQ ID NO: 103137

SEQ ID NO: 714890 - RNA, 63 nt, hsa; identical to SEQ ID NO: 103138

SEQ ID NO: 714891 - RNA, 63 nt, hsa; identical to SEQ ID NO: 103139

SEQ ID NO: 714892 - RNA, 63 nt, hsa; identical to SEQ ID NO: 103140

SEQ ID NO: 714893 - RNA, 63 nt, hsa; identical to SEQ ID NO: 103141

SEQ ID NO: 714894 - RNA, 63 nt, hsa; identical to SEQ ID NO: 103142

SEQ ID NO: 714895 - RNA, 63 nt, hsa; identical to SEQ ID NO: 103143

SEQ ID NO: 714896 - RNA, 63 nt, hsa; identical to SEQ ID NO: 103144

SEQ ID NO: 714897 - RNA, 63 nt, hsa; identical to SEQ ID NO: 103145

SEQ ID NO: 714898 - RNA, 63 nt, hsa; identical to SEQ ID NO: 103146

SEQ ID NO: 714899 - RNA, 63 nt, hsa; identical to SEQ ID NO: 103147

SEQ ID NO: 714900 - RNA, 63 nt, hsa; identical to SEQ ID NO: 103148

SEQ ID NO: 714901 - RNA, 63 nt, hsa; identical to SEQ ID NO: 103149

SEQ ID NO: 714902 - RNA, 63 nt, hsa; identical to SEQ ID NO: 103150

SEQ ID NO: 714903 - RNA, 63 nt, hsa; identical to SEQ ID NO: 103151

SEQ ID NO: 714904 - RNA, 63 nt, hsa; identical to SEQ ID NO: 103152

SEQ ID NO: 714905 - RNA, 63 nt, hsa; identical to SEQ ID NO: 103153

SEQ ID NO: 714906 - RNA, 63 nt, hsa; identical to SEQ ID NO: 103154

SEQ ID NO: 714907 - RNA, 63 nt, hsa; identical to SEQ ID NO: 103155

SEQ ID NO: 714908 - RNA, 63 nt, hsa; identical to SEQ ID NO: 103156

SEQ ID NO: 714909 - RNA, 63 nt, hsa; identical to SEQ ID NO: 103157

SEQ ID NO: 714910 - RNA, 63 nt, hsa; identical to SEQ ID NO: 103158

SEQ ID NO: 714911 - RNA, 63 nt, hsa; identical to SEQ ID NO: 103159

SEQ ID NO: 714912 - RNA, 63 nt, hsa; identical to SEQ ID NO: 103160

SEQ ID NO: 714913 - RNA, 63 nt, hsa; identical to SEQ ID NO: 103161

SEQ ID NO: 714914 - RNA, 63 nt, hsa; identical to SEQ ID NO: 103162

SEQ ID NO: 714915 - RNA, 63 nt, hsa; identical to SEQ ID NO: 103163

SEQ ID NO: 714916 - RNA, 63 nt, hsa; identical to SEQ ID NO: 103164

SEQ ID NO: 714917 - RNA, 63 nt, hsa; identical to SEQ ID NO: 103165

SEQ ID NO: 714918 - RNA, 63 nt, hsa; identical to SEQ ID NO: 103166

SEQ ID NO: 714919 - RNA, 63 nt, hsa; identical to SEQ ID NO: 103167

SEQ ID NO: 714920 - RNA, 63 nt, hsa; identical to SEQ ID NO: 103168

SEQ ID NO: 714921 - RNA, 63 nt, hsa; identical to SEQ ID NO: 103169

SEQ ID NO: 714922 - RNA, 63 nt, hsa; identical to SEQ ID NO: 103170

SEQ ID NO: 714923 - RNA, 63 nt, hsa; identical to SEQ ID NO: 103171

SEQ ID NO: 714924 - RNA, 63 nt, hsa; identical to SEQ ID NO: 103172

SEQ ID NO: 714925 - RNA, 63 nt, hsa; identical to SEQ ID NO: 103173

SEQ ID NO: 714926 - RNA, 63 nt, hsa; identical to SEQ ID NO: 103174

SEQ ID NO: 714927 - RNA, 63 nt, hsa; identical to SEQ ID NO: 103175

SEQ ID NO: 714928 - RNA, 63 nt, hsa; identical to SEQ ID NO: 103176

SEQ ID NO: 714929 - RNA, 63 nt, hsa; identical to SEQ ID NO: 103177

SEQ ID NO: 714930 - RNA, 63 nt, hsa; identical to SEQ ID NO: 103178

SEQ ID NO: 714931 - RNA, 63 nt, hsa; identical to SEQ ID NO: 103179

SEQ ID NO: 714932 - RNA, 63 nt, hsa; identical to SEQ ID NO: 103180

SEQ ID NO: 714933 - RNA, 63 nt, hsa; identical to SEQ ID NO: 103181

SEQ ID NO: 714934 - RNA, 63 nt, hsa; identical to SEQ ID NO: 103182

SEQ ID NO: 714935 - RNA, 63 nt, hsa; identical to SEQ ID NO: 103183

SEQ ID NO: 714936 - RNA, 63 nt, hsa; identical to SEQ ID NO: 103184

SEQ ID NO: 714937 - RNA, 63 nt, hsa; identical to SEQ ID NO: 103185

SEQ ID NO: 714938 - RNA, 63 nt, hsa; identical to SEQ ID NO: 103186

SEQ ID NO: 714939 - RNA, 63 nt, hsa; identical to SEQ ID NO: 103187

SEQ ID NO: 714940 - RNA, 63 nt, hsa; identical to SEQ ID NO: 103188

SEQ ID NO: 714941 - RNA, 63 nt, hsa; identical to SEQ ID NO: 103189

SEQ ID NO: 714942 - RNA, 63 nt, hsa; identical to SEQ ID NO: 103190

SEQ ID NO: 714943 - RNA, 63 nt, hsa; identical to SEQ ID NO: 103191

SEQ ID NO: 714944 - RNA, 63 nt, hsa; identical to SEQ ID NO: 103192

SEQ ID NO: 714945 - RNA, 63 nt, hsa; identical to SEQ ID NO: 103193

SEQ ID NO: 714946 - RNA, 63 nt, hsa; identical to SEQ ID NO: 103194

SEQ ID NO: 714947 - RNA, 63 nt, hsa; identical to SEQ ID NO: 103195

SEQ ID NO: 714948 - RNA, 51 nt, hsa; identical to SEQ ID NO: 103196

SEQ ID NO: 714949 - RNA, 63 nt, hsa; identical to SEQ ID NO: 103197

SEQ ID NO: 714950 - RNA, 63 nt, hsa; identical to SEQ ID NO: 103198

SEQ ID NO: 714951 - RNA, 63 nt, hsa; identical to SEQ ID NO: 103199

SEQ ID NO: 714952 - RNA, 63 nt, hsa; identical to SEQ ID NO: 103200

SEQ ID NO: 714953 - RNA, 63 nt, hsa; identical to SEQ ID NO: 103201

SEQ ID NO: 714954 - RNA, 63 nt, hsa; identical to SEQ ID NO: 103202

SEQ ID NO: 714955 - RNA, 63 nt, hsa; identical to SEQ ID NO: 103203

SEQ ID NO: 714956 - RNA, 63 nt, hsa; identical to SEQ ID NO: 103204

SEQ ID NO: 714957 - RNA, 63 nt, hsa; identical to SEQ ID NO: 103205

SEQ ID NO: 714958 - RNA, 63 nt, hsa; identical to SEQ ID NO: 103206

SEQ ID NO: 714959 - RNA, 63 nt, hsa; identical to SEQ ID NO: 103207

SEQ ID NO: 714960 - RNA, 63 nt, hsa; identical to SEQ ID NO: 103208

SEQ ID NO: 714961 - RNA, 63 nt, hsa; identical to SEQ ID NO: 103209

SEQ ID NO: 714962 - RNA, 63 nt, hsa; identical to SEQ ID NO: 103210

SEQ ID NO: 714963 - RNA, 63 nt, hsa; identical to SEQ ID NO: 103211

SEQ ID NO: 714964 - RNA, 63 nt, hsa; identical to SEQ ID NO: 103212

SEQ ID NO: 714965 - RNA, 63 nt, hsa; identical to SEQ ID NO: 103213

SEQ ID NO: 714966 - RNA, 63 nt, hsa; identical to SEQ ID NO: 103214

SEQ ID NO: 714967 - RNA, 63 nt, hsa; identical to SEQ ID NO: 103215

SEQ ID NO: 714968 - RNA, 63 nt, hsa; identical to SEQ ID NO: 103216

SEQ ID NO: 714969 - RNA, 63 nt, hsa; identical to SEQ ID NO: 103217

SEQ ID NO: 714970 - RNA, 63 nt, hsa; identical to SEQ ID NO: 103218

SEQ ID NO: 714971 - RNA, 63 nt, hsa; identical to SEQ ID NO: 103219

SEQ ID NO: 714972 - RNA, 63 nt, hsa; identical to SEQ ID NO: 103220

SEQ ID NO: 714973 - RNA, 63 nt, hsa; identical to SEQ ID NO: 103221

SEQ ID NO: 714974 - RNA, 63 nt, hsa; identical to SEQ ID NO: 103222

SEQ ID NO: 714975 - RNA, 63 nt, hsa; identical to SEQ ID NO: 103223

SEQ ID NO: 714976 - RNA, 63 nt, hsa; identical to SEQ ID NO: 103224

SEQ ID NO: 714977 - RNA, 63 nt, hsa; identical to SEQ ID NO: 103225

SEQ ID NO: 714978 - RNA, 63 nt, hsa; identical to SEQ ID NO: 103226

SEQ ID NO: 714979 - RNA, 63 nt, hsa; identical to SEQ ID NO: 103227

SEQ ID NO: 714980 - RNA, 63 nt, hsa; identical to SEQ ID NO: 103228

SEQ ID NO: 714981 - RNA, 63 nt, hsa; identical to SEQ ID NO: 103229

SEQ ID NO: 714982 - RNA, 63 nt, hsa; identical to SEQ ID NO: 103230

SEQ ID NO: 714983 - RNA, 63 nt, hsa; identical to SEQ ID NO: 103231

SEQ ID NO: 714984 - RNA, 63 nt, hsa; identical to SEQ ID NO: 103232

SEQ ID NO: 714985 - RNA, 63 nt, hsa; identical to SEQ ID NO: 103233

SEQ ID NO: 714986 - RNA, 63 nt, hsa; identical to SEQ ID NO: 103234

SEQ ID NO: 714987 - RNA, 63 nt, hsa; identical to SEQ ID NO: 103235

SEQ ID NO: 714988 - RNA, 63 nt, hsa; identical to SEQ ID NO: 103236

SEQ ID NO: 714989 - RNA, 63 nt, hsa; identical to SEQ ID NO: 103237

SEQ ID NO: 714990 - RNA, 63 nt, hsa; identical to SEQ ID NO: 103238

SEQ ID NO: 714991 - RNA, 63 nt, hsa; identical to SEQ ID NO: 103239

SEQ ID NO: 714992 - RNA, 63 nt, hsa; identical to SEQ ID NO: 103240

SEQ ID NO: 714993 - RNA, 63 nt, hsa; identical to SEQ ID NO: 103241

SEQ ID NO: 714994 - RNA, 63 nt, hsa; identical to SEQ ID NO: 103242

SEQ ID NO: 714995 - RNA, 63 nt, hsa; identical to SEQ ID NO: 103243

SEQ ID NO: 714996 - RNA, 63 nt, hsa; identical to SEQ ID NO: 103244

SEQ ID NO: 714997 - RNA, 63 nt, hsa; identical to SEQ ID NO: 103245

SEQ ID NO: 714998 - RNA, 63 nt, hsa; identical to SEQ ID NO: 103246

SEQ ID NO: 714999 - RNA, 63 nt, hsa; identical to SEQ ID NO: 103247

SEQ ID NO: 715000 - RNA, 63 nt, hsa; identical to SEQ ID NO: 103248

SEQ ID NO: 715001 - RNA, 63 nt, hsa; identical to SEQ ID NO: 103249

SEQ ID NO: 715002 - RNA, 63 nt, hsa; identical to SEQ ID NO: 103250

SEQ ID NO: 715003 - RNA, 63 nt, hsa; identical to SEQ ID NO: 103251

SEQ ID NO: 715004 - RNA, 63 nt, hsa; identical to SEQ ID NO: 103252

SEQ ID NO: 715005 - RNA, 63 nt, hsa; identical to SEQ ID NO: 103253

SEQ ID NO: 715006 - RNA, 63 nt, hsa; identical to SEQ ID NO: 103254

SEQ ID NO: 715007 - RNA, 63 nt, hsa; identical to SEQ ID NO: 103255

SEQ ID NO: 715008 - RNA, 63 nt, hsa; identical to SEQ ID NO: 103256

SEQ ID NO: 715009 - RNA, 63 nt, hsa; identical to SEQ ID NO: 103257

SEQ ID NO: 715010 - RNA, 63 nt, hsa; identical to SEQ ID NO: 103258

SEQ ID NO: 715011 - RNA, 63 nt, hsa; identical to SEQ ID NO: 103259

SEQ ID NO: 715012 - RNA, 63 nt, hsa; identical to SEQ ID NO: 103260

SEQ ID NO: 715013 - RNA, 63 nt, hsa; identical to SEQ ID NO: 103261

SEQ ID NO: 715014 - RNA, 63 nt, hsa; identical to SEQ ID NO: 103262

SEQ ID NO: 715015 - RNA, 63 nt, hsa; identical to SEQ ID NO: 103263

SEQ ID NO: 715016 - RNA, 63 nt, hsa; identical to SEQ ID NO: 103264

SEQ ID NO: 715017 - RNA, 63 nt, hsa; identical to SEQ ID NO: 103265

SEQ ID NO: 715018 - RNA, 63 nt, hsa; identical to SEQ ID NO: 103266

SEQ ID NO: 715019 - RNA, 63 nt, hsa; identical to SEQ ID NO: 103267

SEQ ID NO: 715020 - RNA, 63 nt, hsa; identical to SEQ ID NO: 103268

SEQ ID NO: 715021 - RNA, 63 nt, hsa; identical to SEQ ID NO: 103269

SEQ ID NO: 715022 - RNA, 63 nt, hsa; identical to SEQ ID NO: 103270

SEQ ID NO: 715023 - RNA, 63 nt, hsa; identical to SEQ ID NO: 103271

SEQ ID NO: 715024 - RNA, 63 nt, hsa; identical to SEQ ID NO: 103272

SEQ ID NO: 715025 - RNA, 63 nt, hsa; identical to SEQ ID NO: 103273

SEQ ID NO: 715026 - RNA, 63 nt, hsa; identical to SEQ ID NO: 103274

SEQ ID NO: 715027 - RNA, 63 nt, hsa; identical to SEQ ID NO: 103275

SEQ ID NO: 715028 - RNA, 63 nt, hsa; identical to SEQ ID NO: 103276

SEQ ID NO: 715029 - RNA, 63 nt, hsa; identical to SEQ ID NO: 103277

SEQ ID NO: 715030 - RNA, 63 nt, hsa; identical to SEQ ID NO: 103278

SEQ ID NO: 715031 - RNA, 63 nt, hsa; identical to SEQ ID NO: 103279

SEQ ID NO: 715032 - RNA, 63 nt, hsa; identical to SEQ ID NO: 103280

SEQ ID NO: 715033 - RNA, 63 nt, hsa; identical to SEQ ID NO: 103281

SEQ ID NO: 715034 - RNA, 63 nt, hsa; identical to SEQ ID NO: 103282

SEQ ID NO: 715035 - RNA, 63 nt, hsa; identical to SEQ ID NO: 103283

SEQ ID NO: 715036 - RNA, 63 nt, hsa; identical to SEQ ID NO: 103284

SEQ ID NO: 715037 - RNA, 63 nt, hsa; identical to SEQ ID NO: 103285

SEQ ID NO: 715038 - RNA, 63 nt, hsa; identical to SEQ ID NO: 103286

SEQ ID NO: 715039 - RNA, 63 nt, hsa; identical to SEQ ID NO: 103287

SEQ ID NO: 715040 - RNA, 63 nt, hsa; identical to SEQ ID NO: 103288

SEQ ID NO: 715041 - RNA, 62 nt, hsa; identical to SEQ ID NO: 103289

SEQ ID NO: 715042 - RNA, 62 nt, hsa; identical to SEQ ID NO: 103290

SEQ ID NO: 715043 - RNA, 62 nt, hsa; identical to SEQ ID NO: 103291

SEQ ID NO: 715044 - RNA, 62 nt, hsa; identical to SEQ ID NO: 103292

SEQ ID NO: 715045 - RNA, 62 nt, hsa; identical to SEQ ID NO: 103293

SEQ ID NO: 715046 - RNA, 62 nt, hsa; identical to SEQ ID NO: 103294

SEQ ID NO: 715047 - RNA, 62 nt, hsa; identical to SEQ ID NO: 103295

SEQ ID NO: 715048 - RNA, 62 nt, hsa; identical to SEQ ID NO: 103296

SEQ ID NO: 715049 - RNA, 62 nt, hsa; identical to SEQ ID NO: 103297

SEQ ID NO: 715050 - RNA, 62 nt, hsa; identical to SEQ ID NO: 103298

SEQ ID NO: 715051 - RNA, 62 nt, hsa; identical to SEQ ID NO: 103299

SEQ ID NO: 715052 - RNA, 57 nt, hsa; identical to SEQ ID NO: 103300

SEQ ID NO: 715053 - RNA, 62 nt, hsa; identical to SEQ ID NO: 103301

SEQ ID NO: 715054 - RNA, 62 nt, hsa; identical to SEQ ID NO: 103302

SEQ ID NO: 715055 - RNA, 62 nt, hsa; identical to SEQ ID NO: 103303

SEQ ID NO: 715056 - RNA, 62 nt, hsa; identical to SEQ ID NO: 103304

SEQ ID NO: 715057 - RNA, 62 nt, hsa; identical to SEQ ID NO: 103305

SEQ ID NO: 715058 - RNA, 62 nt, hsa; identical to SEQ ID NO: 103306

SEQ ID NO: 715059 - RNA, 62 nt, hsa; identical to SEQ ID NO: 103307

SEQ ID NO: 715060 - RNA, 62 nt, hsa; identical to SEQ ID NO: 103308

SEQ ID NO: 715061 - RNA, 62 nt, hsa; identical to SEQ ID NO: 103309

SEQ ID NO: 715062 - RNA, 62 nt, hsa; identical to SEQ ID NO: 103310

SEQ ID NO: 715063 - RNA, 62 nt, hsa; identical to SEQ ID NO: 103311

SEQ ID NO: 715064 - RNA, 62 nt, hsa; identical to SEQ ID NO: 103312

SEQ ID NO: 715065 - RNA, 62 nt, hsa; identical to SEQ ID NO: 103313

SEQ ID NO: 715066 - RNA, 62 nt, hsa; identical to SEQ ID NO: 103314

SEQ ID NO: 715067 - RNA, 62 nt, hsa; identical to SEQ ID NO: 103315

SEQ ID NO: 715068 - RNA, 62 nt, hsa; identical to SEQ ID NO: 103316

SEQ ID NO: 715069 - RNA, 62 nt, hsa; identical to SEQ ID NO: 103317

SEQ ID NO: 715070 - RNA, 62 nt, hsa; identical to SEQ ID NO: 103318

SEQ ID NO: 715071 - RNA, 62 nt, hsa; identical to SEQ ID NO: 103319

SEQ ID NO: 715072 - RNA, 62 nt, hsa; identical to SEQ ID NO: 103320

SEQ ID NO: 715073 - RNA, 62 nt, hsa; identical to SEQ ID NO: 103321

SEQ ID NO: 715074 - RNA, 62 nt, hsa; identical to SEQ ID NO: 103322

SEQ ID NO: 715075 - RNA, 62 nt, hsa; identical to SEQ ID NO: 103323

SEQ ID NO: 715076 - RNA, 62 nt, hsa; identical to SEQ ID NO: 103324

SEQ ID NO: 715077 - RNA, 62 nt, hsa; identical to SEQ ID NO: 103325

SEQ ID NO: 715078 - RNA, 62 nt, hsa; identical to SEQ ID NO: 103326

SEQ ID NO: 715079 - RNA, 62 nt, hsa; identical to SEQ ID NO: 103327

SEQ ID NO: 715080 - RNA, 62 nt, hsa; identical to SEQ ID NO: 103328

SEQ ID NO: 715081 - RNA, 62 nt, hsa; identical to SEQ ID NO: 103329

SEQ ID NO: 715082 - RNA, 62 nt, hsa; identical to SEQ ID NO: 103330

SEQ ID NO: 715083 - RNA, 62 nt, hsa; identical to SEQ ID NO: 103331

SEQ ID NO: 715084 - RNA, 62 nt, hsa; identical to SEQ ID NO: 103332

SEQ ID NO: 715085 - RNA, 62 nt, hsa; identical to SEQ ID NO: 103333

SEQ ID NO: 715086 - RNA, 62 nt, hsa; identical to SEQ ID NO: 103334

SEQ ID NO: 715087 - RNA, 62 nt, hsa; identical to SEQ ID NO: 103335

SEQ ID NO: 715088 - RNA, 62 nt, hsa; identical to SEQ ID NO: 103336

SEQ ID NO: 715089 - RNA, 62 nt, hsa; identical to SEQ ID NO: 103337

SEQ ID NO: 715090 - RNA, 62 nt, hsa; identical to SEQ ID NO: 103338

SEQ ID NO: 715091 - RNA, 62 nt, hsa; identical to SEQ ID NO: 103339

SEQ ID NO: 715092 - RNA, 62 nt, hsa; identical to SEQ ID NO: 103340

SEQ ID NO: 715093 - RNA, 62 nt, hsa; identical to SEQ ID NO: 103341

SEQ ID NO: 715094 - RNA, 62 nt, hsa; identical to SEQ ID NO: 103342

SEQ ID NO: 715095 - RNA, 62 nt, hsa; identical to SEQ ID NO: 103343

SEQ ID NO: 715096 - RNA, 62 nt, hsa; identical to SEQ ID NO: 103344

SEQ ID NO: 715097 - RNA, 62 nt, hsa; identical to SEQ ID NO: 103345

SEQ ID NO: 715098 - RNA, 62 nt, hsa; identical to SEQ ID NO: 103346

SEQ ID NO: 715099 - RNA, 62 nt, hsa; identical to SEQ ID NO: 103347

SEQ ID NO: 715100 - RNA, 62 nt, hsa; identical to SEQ ID NO: 103348

SEQ ID NO: 715101 - RNA, 62 nt, hsa; identical to SEQ ID NO: 103349

SEQ ID NO: 715102 - RNA, 62 nt, hsa; identical to SEQ ID NO: 103350

SEQ ID NO: 715103 - RNA, 62 nt, hsa; identical to SEQ ID NO: 103351

SEQ ID NO: 715104 - RNA, 62 nt, hsa; identical to SEQ ID NO: 103352

SEQ ID NO: 715105 - RNA, 62 nt, hsa; identical to SEQ ID NO: 103353

SEQ ID NO: 715106 - RNA, 62 nt, hsa; identical to SEQ ID NO: 103354

SEQ ID NO: 715107 - RNA, 62 nt, hsa; identical to SEQ ID NO: 103355

SEQ ID NO: 715108 - RNA, 62 nt, hsa; identical to SEQ ID NO: 103356

SEQ ID NO: 715109 - RNA, 62 nt, hsa; identical to SEQ ID NO: 103357

SEQ ID NO: 715110 - RNA, 62 nt, hsa; identical to SEQ ID NO: 103358

SEQ ID NO: 715111 - RNA, 62 nt, hsa; identical to SEQ ID NO: 103359

SEQ ID NO: 715112 - RNA, 62 nt, hsa; identical to SEQ ID NO: 103360

SEQ ID NO: 715113 - RNA, 62 nt, hsa; identical to SEQ ID NO: 103361

SEQ ID NO: 715114 - RNA, 62 nt, hsa; identical to SEQ ID NO: 103362

SEQ ID NO: 715115 - RNA, 62 nt, hsa; identical to SEQ ID NO: 103363

SEQ ID NO: 715116 - RNA, 62 nt, hsa; identical to SEQ ID NO: 103364

SEQ ID NO: 715117 - RNA, 62 nt, hsa; identical to SEQ ID NO: 103365

SEQ ID NO: 715118 - RNA, 62 nt, hsa; identical to SEQ ID NO: 103366

SEQ ID NO: 715119 - RNA, 62 nt, hsa; identical to SEQ ID NO: 103367

SEQ ID NO: 715120 - RNA, 62 nt, hsa; identical to SEQ ID NO: 103368

SEQ ID NO: 715121 - RNA, 62 nt, hsa; identical to SEQ ID NO: 103369

SEQ ID NO: 715122 - RNA, 62 nt, hsa; identical to SEQ ID NO: 103370

SEQ ID NO: 715123 - RNA, 62 nt, hsa; identical to SEQ ID NO: 103371

SEQ ID NO: 715124 - RNA, 59 nt, hsa; identical to SEQ ID NO: 103372

SEQ ID NO: 715125 - RNA, 62 nt, hsa; identical to SEQ ID NO: 103373

SEQ ID NO: 715126 - RNA, 62 nt, hsa; identical to SEQ ID NO: 103374

SEQ ID NO: 715127 - RNA, 62 nt, hsa; identical to SEQ ID NO: 103375

SEQ ID NO: 715128 - RNA, 62 nt, hsa; identical to SEQ ID NO: 103376

SEQ ID NO: 715129 - RNA, 62 nt, hsa; identical to SEQ ID NO: 103377

SEQ ID NO: 715130 - RNA, 62 nt, hsa; identical to SEQ ID NO: 103378

SEQ ID NO: 715131 - RNA, 62 nt, hsa; identical to SEQ ID NO: 103379

SEQ ID NO: 715132 - RNA, 62 nt, hsa; identical to SEQ ID NO: 103380

SEQ ID NO: 715133 - RNA, 62 nt, hsa; identical to SEQ ID NO: 103381

SEQ ID NO: 715134 - RNA, 62 nt, hsa; identical to SEQ ID NO: 103382

SEQ ID NO: 715135 - RNA, 62 nt, hsa; identical to SEQ ID NO: 103383

SEQ ID NO: 715136 - RNA, 62 nt, hsa; identical to SEQ ID NO: 103384

SEQ ID NO: 715137 - RNA, 62 nt, hsa; identical to SEQ ID NO: 103385

SEQ ID NO: 715138 - RNA, 62 nt, hsa; identical to SEQ ID NO: 103386

SEQ ID NO: 715139 - RNA, 62 nt, hsa; identical to SEQ ID NO: 103387

SEQ ID NO: 715140 - RNA, 62 nt, hsa; identical to SEQ ID NO: 103388

SEQ ID NO: 715141 - RNA, 62 nt, hsa; identical to SEQ ID NO: 103389

SEQ ID NO: 715142 - RNA, 62 nt, hsa; identical to SEQ ID NO: 103390

SEQ ID NO: 715143 - RNA, 62 nt, hsa; identical to SEQ ID NO: 103391

SEQ ID NO: 715144 - RNA, 62 nt, hsa; identical to SEQ ID NO: 103392

SEQ ID NO: 715145 - RNA, 60 nt, hsa; identical to SEQ ID NO: 103393

SEQ ID NO: 715146 - RNA, 62 nt, hsa; identical to SEQ ID NO: 103394

SEQ ID NO: 715147 - RNA, 62 nt, hsa; identical to SEQ ID NO: 103395

SEQ ID NO: 715148 - RNA, 62 nt, hsa; identical to SEQ ID NO: 103396

SEQ ID NO: 715149 - RNA, 62 nt, hsa; identical to SEQ ID NO: 103397

SEQ ID NO: 715150 - RNA, 62 nt, hsa; identical to SEQ ID NO: 103398

SEQ ID NO: 715151 - RNA, 62 nt, hsa; identical to SEQ ID NO: 103399

SEQ ID NO: 715152 - RNA, 62 nt, hsa; identical to SEQ ID NO: 103400

SEQ ID NO: 715153 - RNA, 62 nt, hsa; identical to SEQ ID NO: 103401

SEQ ID NO: 715154 - RNA, 62 nt, hsa; identical to SEQ ID NO: 103402

SEQ ID NO: 715155 - RNA, 62 nt, hsa; identical to SEQ ID NO: 103403

SEQ ID NO: 715156 - RNA, 62 nt, hsa; identical to SEQ ID NO: 103404

SEQ ID NO: 715157 - RNA, 62 nt, hsa; identical to SEQ ID NO: 103405

SEQ ID NO: 715158 - RNA, 62 nt, hsa; identical to SEQ ID NO: 103406

SEQ ID NO: 715159 - RNA, 62 nt, hsa; identical to SEQ ID NO: 103407

SEQ ID NO: 715160 - RNA, 62 nt, hsa; identical to SEQ ID NO: 103408

SEQ ID NO: 715161 - RNA, 62 nt, hsa; identical to SEQ ID NO: 103409

SEQ ID NO: 715162 - RNA, 62 nt, hsa; identical to SEQ ID NO: 103410

SEQ ID NO: 715163 - RNA, 62 nt, hsa; identical to SEQ ID NO: 103411

SEQ ID NO: 715164 - RNA, 62 nt, hsa; identical to SEQ ID NO: 103412

SEQ ID NO: 715165 - RNA, 62 nt, hsa; identical to SEQ ID NO: 103413

SEQ ID NO: 715166 - RNA, 62 nt, hsa; identical to SEQ ID NO: 103414

SEQ ID NO: 715167 - RNA, 62 nt, hsa; identical to SEQ ID NO: 103415

SEQ ID NO: 715168 - RNA, 62 nt, hsa; identical to SEQ ID NO: 103416

SEQ ID NO: 715169 - RNA, 62 nt, hsa; identical to SEQ ID NO: 103417

SEQ ID NO: 715170 - RNA, 62 nt, hsa; identical to SEQ ID NO: 103418

SEQ ID NO: 715171 - RNA, 62 nt, hsa; identical to SEQ ID NO: 103419

SEQ ID NO: 715172 - RNA, 62 nt, hsa; identical to SEQ ID NO: 103420

SEQ ID NO: 715173 - RNA, 62 nt, hsa; identical to SEQ ID NO: 103421

SEQ ID NO: 715174 - RNA, 62 nt, hsa; identical to SEQ ID NO: 103422

SEQ ID NO: 715175 - RNA, 62 nt, hsa; identical to SEQ ID NO: 103423

SEQ ID NO: 715176 - RNA, 62 nt, hsa; identical to SEQ ID NO: 103424

SEQ ID NO: 715177 - RNA, 62 nt, hsa; identical to SEQ ID NO: 103425

SEQ ID NO: 715178 - RNA, 62 nt, hsa; identical to SEQ ID NO: 103426

SEQ ID NO: 715179 - RNA, 62 nt, hsa; identical to SEQ ID NO: 103427

SEQ ID NO: 715180 - RNA, 62 nt, hsa; identical to SEQ ID NO: 103428

SEQ ID NO: 715181 - RNA, 62 nt, hsa; identical to SEQ ID NO: 103429

SEQ ID NO: 715182 - RNA, 62 nt, hsa; identical to SEQ ID NO: 103430

SEQ ID NO: 715183 - RNA, 62 nt, hsa; identical to SEQ ID NO: 103431

SEQ ID NO: 715184 - RNA, 62 nt, hsa; identical to SEQ ID NO: 103432

SEQ ID NO: 715185 - RNA, 62 nt, hsa; identical to SEQ ID NO: 103433

SEQ ID NO: 715186 - RNA, 62 nt, hsa; identical to SEQ ID NO: 103434

SEQ ID NO: 715187 - RNA, 62 nt, hsa; identical to SEQ ID NO: 103435

SEQ ID NO: 715188 - RNA, 62 nt, hsa; identical to SEQ ID NO: 103436

SEQ ID NO: 715189 - RNA, 62 nt, hsa; identical to SEQ ID NO: 103437

SEQ ID NO: 715190 - RNA, 62 nt, hsa; identical to SEQ ID NO: 103438

SEQ ID NO: 715191 - RNA, 62 nt, hsa; identical to SEQ ID NO: 103439

SEQ ID NO: 715192 - RNA, 62 nt, hsa; identical to SEQ ID NO: 103440

SEQ ID NO: 715193 - RNA, 62 nt, hsa; identical to SEQ ID NO: 103441

SEQ ID NO: 715194 - RNA, 62 nt, hsa; identical to SEQ ID NO: 103442

SEQ ID NO: 715195 - RNA, 62 nt, hsa; identical to SEQ ID NO: 103443

SEQ ID NO: 715196 - RNA, 62 nt, hsa; identical to SEQ ID NO: 103444

SEQ ID NO: 715197 - RNA, 62 nt, hsa; identical to SEQ ID NO: 103445

SEQ ID NO: 715198 - RNA, 62 nt, hsa; identical to SEQ ID NO: 103446

SEQ ID NO: 715199 - RNA, 62 nt, hsa; identical to SEQ ID NO: 103447

SEQ ID NO: 715200 - RNA, 62 nt, hsa; identical to SEQ ID NO: 103448

SEQ ID NO: 715201 - RNA, 62 nt, hsa; identical to SEQ ID NO: 103449

SEQ ID NO: 715202 - RNA, 62 nt, hsa; identical to SEQ ID NO: 103450

SEQ ID NO: 715203 - RNA, 62 nt, hsa; identical to SEQ ID NO: 103451

SEQ ID NO: 715204 - RNA, 62 nt, hsa; identical to SEQ ID NO: 103452

SEQ ID NO: 715205 - RNA, 62 nt, hsa; identical to SEQ ID NO: 103453

SEQ ID NO: 715206 - RNA, 62 nt, hsa; identical to SEQ ID NO: 103454

SEQ ID NO: 715207 - RNA, 62 nt, hsa; identical to SEQ ID NO: 103455

SEQ ID NO: 715208 - RNA, 62 nt, hsa; identical to SEQ ID NO: 103456

SEQ ID NO: 715209 - RNA, 62 nt, hsa; identical to SEQ ID NO: 103457

SEQ ID NO: 715210 - RNA, 62 nt, hsa; identical to SEQ ID NO: 103458

SEQ ID NO: 715211 - RNA, 62 nt, hsa; identical to SEQ ID NO: 103459

SEQ ID NO: 715212 - RNA, 62 nt, hsa; identical to SEQ ID NO: 103460

SEQ ID NO: 715213 - RNA, 62 nt, hsa; identical to SEQ ID NO: 103461

SEQ ID NO: 715214 - RNA, 62 nt, hsa; identical to SEQ ID NO: 103462

SEQ ID NO: 715215 - RNA, 62 nt, hsa; identical to SEQ ID NO: 103463

SEQ ID NO: 715216 - RNA, 62 nt, hsa; identical to SEQ ID NO: 103464

SEQ ID NO: 715217 - RNA, 62 nt, hsa; identical to SEQ ID NO: 103465

SEQ ID NO: 715218 - RNA, 62 nt, hsa; identical to SEQ ID NO: 103466

SEQ ID NO: 715219 - RNA, 62 nt, hsa; identical to SEQ ID NO: 103467

SEQ ID NO: 715220 - RNA, 62 nt, hsa; identical to SEQ ID NO: 103468

SEQ ID NO: 715221 - RNA, 62 nt, hsa; identical to SEQ ID NO: 103469

SEQ ID NO: 715222 - RNA, 62 nt, hsa; identical to SEQ ID NO: 103470

SEQ ID NO: 715223 - RNA, 62 nt, hsa; identical to SEQ ID NO: 103471

SEQ ID NO: 715224 - RNA, 62 nt, hsa; identical to SEQ ID NO: 103472

SEQ ID NO: 715225 - RNA, 62 nt, hsa; identical to SEQ ID NO: 103473

SEQ ID NO: 715226 - RNA, 62 nt, hsa; identical to SEQ ID NO: 103474

SEQ ID NO: 715227 - RNA, 62 nt, hsa; identical to SEQ ID NO: 103475

SEQ ID NO: 715228 - RNA, 62 nt, hsa; identical to SEQ ID NO: 103476

SEQ ID NO: 715229 - RNA, 62 nt, hsa; identical to SEQ ID NO: 103477

SEQ ID NO: 715230 - RNA, 62 nt, hsa; identical to SEQ ID NO: 103478

SEQ ID NO: 715231 - RNA, 62 nt, hsa; identical to SEQ ID NO: 103479

SEQ ID NO: 715232 - RNA, 62 nt, hsa; identical to SEQ ID NO: 103480

SEQ ID NO: 715233 - RNA, 62 nt, hsa; identical to SEQ ID NO: 103481

SEQ ID NO: 715234 - RNA, 62 nt, hsa; identical to SEQ ID NO: 103482

SEQ ID NO: 715235 - RNA, 62 nt, hsa; identical to SEQ ID NO: 103483

SEQ ID NO: 715236 - RNA, 62 nt, hsa; identical to SEQ ID NO: 103484

SEQ ID NO: 715237 - RNA, 62 nt, hsa; identical to SEQ ID NO: 103485

SEQ ID NO: 715238 - RNA, 62 nt, hsa; identical to SEQ ID NO: 103486

SEQ ID NO: 715239 - RNA, 62 nt, hsa; identical to SEQ ID NO: 103487

SEQ ID NO: 715240 - RNA, 62 nt, hsa; identical to SEQ ID NO: 103488

SEQ ID NO: 715241 - RNA, 62 nt, hsa; identical to SEQ ID NO: 103489

SEQ ID NO: 715242 - RNA, 62 nt, hsa; identical to SEQ ID NO: 103490

SEQ ID NO: 715243 - RNA, 62 nt, hsa; identical to SEQ ID NO: 103491

SEQ ID NO: 715244 - RNA, 62 nt, hsa; identical to SEQ ID NO: 103492

SEQ ID NO: 715245 - RNA, 62 nt, hsa; identical to SEQ ID NO: 103493

SEQ ID NO: 715246 - RNA, 62 nt, hsa; identical to SEQ ID NO: 103494

SEQ ID NO: 715247 - RNA, 62 nt, hsa; identical to SEQ ID NO: 103495

SEQ ID NO: 715248 - RNA, 62 nt, hsa; identical to SEQ ID NO: 103496

SEQ ID NO: 715249 - RNA, 62 nt, hsa; identical to SEQ ID NO: 103497

SEQ ID NO: 715250 - RNA, 62 nt, hsa; identical to SEQ ID NO: 103498

SEQ ID NO: 715251 - RNA, 62 nt, hsa; identical to SEQ ID NO: 103499

SEQ ID NO: 715252 - RNA, 62 nt, hsa; identical to SEQ ID NO: 103500

SEQ ID NO: 715253 - RNA, 62 nt, hsa; identical to SEQ ID NO: 103501

SEQ ID NO: 715254 - RNA, 62 nt, hsa; identical to SEQ ID NO: 103502

SEQ ID NO: 715255 - RNA, 62 nt, hsa; identical to SEQ ID NO: 103503

SEQ ID NO: 715256 - RNA, 62 nt, hsa; identical to SEQ ID NO: 103504

SEQ ID NO: 715257 - RNA, 62 nt, hsa; identical to SEQ ID NO: 103505

SEQ ID NO: 715258 - RNA, 62 nt, hsa; identical to SEQ ID NO: 103506

SEQ ID NO: 715259 - RNA, 62 nt, hsa; identical to SEQ ID NO: 103507

SEQ ID NO: 715260 - RNA, 63 nt, hsa; identical to SEQ ID NO: 103508

SEQ ID NO: 715261 - RNA, 63 nt, hsa; identical to SEQ ID NO: 103509

SEQ ID NO: 715262 - RNA, 63 nt, hsa; identical to SEQ ID NO: 103510

SEQ ID NO: 715263 - RNA, 63 nt, hsa; identical to SEQ ID NO: 103511

SEQ ID NO: 715264 - RNA, 63 nt, hsa; identical to SEQ ID NO: 103512

SEQ ID NO: 715265 - RNA, 63 nt, hsa; identical to SEQ ID NO: 103513

SEQ ID NO: 715266 - RNA, 63 nt, hsa; identical to SEQ ID NO: 103514

SEQ ID NO: 715267 - RNA, 63 nt, hsa; identical to SEQ ID NO: 103515

SEQ ID NO: 715268 - RNA, 63 nt, hsa; identical to SEQ ID NO: 103516

SEQ ID NO: 715269 - RNA, 63 nt, hsa; identical to SEQ ID NO: 103517

SEQ ID NO: 715270 - RNA, 63 nt, hsa; identical to SEQ ID NO: 103518

SEQ ID NO: 715271 - RNA, 57 nt, hsa; identical to SEQ ID NO: 103300

SEQ ID NO: 715272 - RNA, 63 nt, hsa; identical to SEQ ID NO: 103520

SEQ ID NO: 715273 - RNA, 63 nt, hsa; identical to SEQ ID NO: 103521

SEQ ID NO: 715274 - RNA, 63 nt, hsa; identical to SEQ ID NO: 103522

SEQ ID NO: 715275 - RNA, 63 nt, hsa; identical to SEQ ID NO: 103523

SEQ ID NO: 715276 - RNA, 63 nt, hsa; identical to SEQ ID NO: 103524

SEQ ID NO: 715277 - RNA, 63 nt, hsa; identical to SEQ ID NO: 103525

SEQ ID NO: 715278 - RNA, 63 nt, hsa; identical to SEQ ID NO: 103526

SEQ ID NO: 715279 - RNA, 63 nt, hsa; identical to SEQ ID NO: 103527

SEQ ID NO: 715280 - RNA, 63 nt, hsa; identical to SEQ ID NO: 103528

SEQ ID NO: 715281 - RNA, 63 nt, hsa; identical to SEQ ID NO: 103529

SEQ ID NO: 715282 - RNA, 63 nt, hsa; identical to SEQ ID NO: 103530

SEQ ID NO: 715283 - RNA, 63 nt, hsa; identical to SEQ ID NO: 103531

SEQ ID NO: 715284 - RNA, 63 nt, hsa; identical to SEQ ID NO: 103532

SEQ ID NO: 715285 - RNA, 63 nt, hsa; identical to SEQ ID NO: 103533

SEQ ID NO: 715286 - RNA, 63 nt, hsa; identical to SEQ ID NO: 103534

SEQ ID NO: 715287 - RNA, 63 nt, hsa; identical to SEQ ID NO: 103535

SEQ ID NO: 715288 - RNA, 63 nt, hsa; identical to SEQ ID NO: 103536

SEQ ID NO: 715289 - RNA, 63 nt, hsa; identical to SEQ ID NO: 103537

SEQ ID NO: 715290 - RNA, 63 nt, hsa; identical to SEQ ID NO: 103538

SEQ ID NO: 715291 - RNA, 63 nt, hsa; identical to SEQ ID NO: 103539

SEQ ID NO: 715292 - RNA, 63 nt, hsa; identical to SEQ ID NO: 103540

SEQ ID NO: 715293 - RNA, 63 nt, hsa; identical to SEQ ID NO: 103541

SEQ ID NO: 715294 - RNA, 63 nt, hsa; identical to SEQ ID NO: 103542

SEQ ID NO: 715295 - RNA, 63 nt, hsa; identical to SEQ ID NO: 103543

SEQ ID NO: 715296 - RNA, 63 nt, hsa; identical to SEQ ID NO: 103544

SEQ ID NO: 715297 - RNA, 63 nt, hsa; identical to SEQ ID NO: 103545

SEQ ID NO: 715298 - RNA, 63 nt, hsa; identical to SEQ ID NO: 103546

SEQ ID NO: 715299 - RNA, 63 nt, hsa; identical to SEQ ID NO: 103547

SEQ ID NO: 715300 - RNA, 63 nt, hsa; identical to SEQ ID NO: 103548

SEQ ID NO: 715301 - RNA, 63 nt, hsa; identical to SEQ ID NO: 103549

SEQ ID NO: 715302 - RNA, 63 nt, hsa; identical to SEQ ID NO: 103550

SEQ ID NO: 715303 - RNA, 63 nt, hsa; identical to SEQ ID NO: 103551

SEQ ID NO: 715304 - RNA, 63 nt, hsa; identical to SEQ ID NO: 103552

SEQ ID NO: 715305 - RNA, 63 nt, hsa; identical to SEQ ID NO: 103553

SEQ ID NO: 715306 - RNA, 63 nt, hsa; identical to SEQ ID NO: 103554

SEQ ID NO: 715307 - RNA, 63 nt, hsa; identical to SEQ ID NO: 103555

SEQ ID NO: 715308 - RNA, 63 nt, hsa; identical to SEQ ID NO: 103556

SEQ ID NO: 715309 - RNA, 63 nt, hsa; identical to SEQ ID NO: 103557

SEQ ID NO: 715310 - RNA, 63 nt, hsa; identical to SEQ ID NO: 103558

SEQ ID NO: 715311 - RNA, 63 nt, hsa; identical to SEQ ID NO: 103559

SEQ ID NO: 715312 - RNA, 63 nt, hsa; identical to SEQ ID NO: 103560

SEQ ID NO: 715313 - RNA, 63 nt, hsa; identical to SEQ ID NO: 103561

SEQ ID NO: 715314 - RNA, 63 nt, hsa; identical to SEQ ID NO: 103562

SEQ ID NO: 715315 - RNA, 63 nt, hsa; identical to SEQ ID NO: 103563

SEQ ID NO: 715316 - RNA, 63 nt, hsa; identical to SEQ ID NO: 103564

SEQ ID NO: 715317 - RNA, 63 nt, hsa; identical to SEQ ID NO: 103565

SEQ ID NO: 715318 - RNA, 63 nt, hsa; identical to SEQ ID NO: 103566

SEQ ID NO: 715319 - RNA, 63 nt, hsa; identical to SEQ ID NO: 103567

SEQ ID NO: 715320 - RNA, 63 nt, hsa; identical to SEQ ID NO: 103568

SEQ ID NO: 715321 - RNA, 63 nt, hsa; identical to SEQ ID NO: 103569

SEQ ID NO: 715322 - RNA, 63 nt, hsa; identical to SEQ ID NO: 103570

SEQ ID NO: 715323 - RNA, 63 nt, hsa; identical to SEQ ID NO: 103571

SEQ ID NO: 715324 - RNA, 63 nt, hsa; identical to SEQ ID NO: 103572

SEQ ID NO: 715325 - RNA, 63 nt, hsa; identical to SEQ ID NO: 103573

SEQ ID NO: 715326 - RNA, 63 nt, hsa; identical to SEQ ID NO: 103574

SEQ ID NO: 715327 - RNA, 63 nt, hsa; identical to SEQ ID NO: 103575

SEQ ID NO: 715328 - RNA, 63 nt, hsa; identical to SEQ ID NO: 103576

SEQ ID NO: 715329 - RNA, 63 nt, hsa; identical to SEQ ID NO: 103577

SEQ ID NO: 715330 - RNA, 63 nt, hsa; identical to SEQ ID NO: 103578

SEQ ID NO: 715331 - RNA, 63 nt, hsa; identical to SEQ ID NO: 103579

SEQ ID NO: 715332 - RNA, 63 nt, hsa; identical to SEQ ID NO: 103580

SEQ ID NO: 715333 - RNA, 63 nt, hsa; identical to SEQ ID NO: 103581

SEQ ID NO: 715334 - RNA, 63 nt, hsa; identical to SEQ ID NO: 103582

SEQ ID NO: 715335 - RNA, 63 nt, hsa; identical to SEQ ID NO: 103583

SEQ ID NO: 715336 - RNA, 63 nt, hsa; identical to SEQ ID NO: 103584

SEQ ID NO: 715337 - RNA, 63 nt, hsa; identical to SEQ ID NO: 103585

SEQ ID NO: 715338 - RNA, 63 nt, hsa; identical to SEQ ID NO: 103586

SEQ ID NO: 715339 - RNA, 63 nt, hsa; identical to SEQ ID NO: 103587

SEQ ID NO: 715340 - RNA, 63 nt, hsa; identical to SEQ ID NO: 103588

SEQ ID NO: 715341 - RNA, 63 nt, hsa; identical to SEQ ID NO: 103589

SEQ ID NO: 715342 - RNA, 63 nt, hsa; identical to SEQ ID NO: 103590

SEQ ID NO: 715343 - RNA, 59 nt, hsa; identical to SEQ ID NO: 103372

SEQ ID NO: 715344 - RNA, 63 nt, hsa; identical to SEQ ID NO: 103592

SEQ ID NO: 715345 - RNA, 63 nt, hsa; identical to SEQ ID NO: 103593

SEQ ID NO: 715346 - RNA, 63 nt, hsa; identical to SEQ ID NO: 103594

SEQ ID NO: 715347 - RNA, 63 nt, hsa; identical to SEQ ID NO: 103595

SEQ ID NO: 715348 - RNA, 63 nt, hsa; identical to SEQ ID NO: 103596

SEQ ID NO: 715349 - RNA, 63 nt, hsa; identical to SEQ ID NO: 103597

SEQ ID NO: 715350 - RNA, 63 nt, hsa; identical to SEQ ID NO: 103598

SEQ ID NO: 715351 - RNA, 63 nt, hsa; identical to SEQ ID NO: 103599

SEQ ID NO: 715352 - RNA, 63 nt, hsa; identical to SEQ ID NO: 103600

SEQ ID NO: 715353 - RNA, 63 nt, hsa; identical to SEQ ID NO: 103601

SEQ ID NO: 715354 - RNA, 63 nt, hsa; identical to SEQ ID NO: 103602

SEQ ID NO: 715355 - RNA, 63 nt, hsa; identical to SEQ ID NO: 103603

SEQ ID NO: 715356 - RNA, 63 nt, hsa; identical to SEQ ID NO: 103604

SEQ ID NO: 715357 - RNA, 63 nt, hsa; identical to SEQ ID NO: 103605

SEQ ID NO: 715358 - RNA, 63 nt, hsa; identical to SEQ ID NO: 103606

SEQ ID NO: 715359 - RNA, 63 nt, hsa; identical to SEQ ID NO: 103607

SEQ ID NO: 715360 - RNA, 63 nt, hsa; identical to SEQ ID NO: 103608

SEQ ID NO: 715361 - RNA, 63 nt, hsa; identical to SEQ ID NO: 103609

SEQ ID NO: 715362 - RNA, 63 nt, hsa; identical to SEQ ID NO: 103610

SEQ ID NO: 715363 - RNA, 63 nt, hsa; identical to SEQ ID NO: 103611

SEQ ID NO: 715364 - RNA, 61 nt, hsa; identical to SEQ ID NO: 103612

SEQ ID NO: 715365 - RNA, 63 nt, hsa; identical to SEQ ID NO: 103613

SEQ ID NO: 715366 - RNA, 63 nt, hsa; identical to SEQ ID NO: 103614

SEQ ID NO: 715367 - RNA, 63 nt, hsa; identical to SEQ ID NO: 103615

SEQ ID NO: 715368 - RNA, 63 nt, hsa; identical to SEQ ID NO: 103616

SEQ ID NO: 715369 - RNA, 63 nt, hsa; identical to SEQ ID NO: 103617

SEQ ID NO: 715370 - RNA, 63 nt, hsa; identical to SEQ ID NO: 103618

SEQ ID NO: 715371 - RNA, 63 nt, hsa; identical to SEQ ID NO: 103619

SEQ ID NO: 715372 - RNA, 63 nt, hsa; identical to SEQ ID NO: 103620

SEQ ID NO: 715373 - RNA, 63 nt, hsa; identical to SEQ ID NO: 103621

SEQ ID NO: 715374 - RNA, 63 nt, hsa; identical to SEQ ID NO: 103622

SEQ ID NO: 715375 - RNA, 63 nt, hsa; identical to SEQ ID NO: 103623

SEQ ID NO: 715376 - RNA, 63 nt, hsa; identical to SEQ ID NO: 103624

SEQ ID NO: 715377 - RNA, 63 nt, hsa; identical to SEQ ID NO: 103625

SEQ ID NO: 715378 - RNA, 63 nt, hsa; identical to SEQ ID NO: 103626

SEQ ID NO: 715379 - RNA, 63 nt, hsa; identical to SEQ ID NO: 103627

SEQ ID NO: 715380 - RNA, 63 nt, hsa; identical to SEQ ID NO: 103628

SEQ ID NO: 715381 - RNA, 63 nt, hsa; identical to SEQ ID NO: 103629

SEQ ID NO: 715382 - RNA, 63 nt, hsa; identical to SEQ ID NO: 103630

SEQ ID NO: 715383 - RNA, 63 nt, hsa; identical to SEQ ID NO: 103631

SEQ ID NO: 715384 - RNA, 63 nt, hsa; identical to SEQ ID NO: 103632

SEQ ID NO: 715385 - RNA, 63 nt, hsa; identical to SEQ ID NO: 103633

SEQ ID NO: 715386 - RNA, 63 nt, hsa; identical to SEQ ID NO: 103634

SEQ ID NO: 715387 - RNA, 63 nt, hsa; identical to SEQ ID NO: 103635

SEQ ID NO: 715388 - RNA, 63 nt, hsa; identical to SEQ ID NO: 103636

SEQ ID NO: 715389 - RNA, 63 nt, hsa; identical to SEQ ID NO: 103637

SEQ ID NO: 715390 - RNA, 63 nt, hsa; identical to SEQ ID NO: 103638

SEQ ID NO: 715391 - RNA, 63 nt, hsa; identical to SEQ ID NO: 103639

SEQ ID NO: 715392 - RNA, 63 nt, hsa; identical to SEQ ID NO: 103640

SEQ ID NO: 715393 - RNA, 63 nt, hsa; identical to SEQ ID NO: 103641

SEQ ID NO: 715394 - RNA, 63 nt, hsa; identical to SEQ ID NO: 103642

SEQ ID NO: 715395 - RNA, 63 nt, hsa; identical to SEQ ID NO: 103643

SEQ ID NO: 715396 - RNA, 63 nt, hsa; identical to SEQ ID NO: 103644

SEQ ID NO: 715397 - RNA, 63 nt, hsa; identical to SEQ ID NO: 103645

SEQ ID NO: 715398 - RNA, 63 nt, hsa; identical to SEQ ID NO: 103646

SEQ ID NO: 715399 - RNA, 63 nt, hsa; identical to SEQ ID NO: 103647

SEQ ID NO: 715400 - RNA, 63 nt, hsa; identical to SEQ ID NO: 103648

SEQ ID NO: 715401 - RNA, 63 nt, hsa; identical to SEQ ID NO: 103649

SEQ ID NO: 715402 - RNA, 63 nt, hsa; identical to SEQ ID NO: 103650

SEQ ID NO: 715403 - RNA, 63 nt, hsa; identical to SEQ ID NO: 103651

SEQ ID NO: 715404 - RNA, 63 nt, hsa; identical to SEQ ID NO: 103652

SEQ ID NO: 715405 - RNA, 63 nt, hsa; identical to SEQ ID NO: 103653

SEQ ID NO: 715406 - RNA, 63 nt, hsa; identical to SEQ ID NO: 103654

SEQ ID NO: 715407 - RNA, 63 nt, hsa; identical to SEQ ID NO: 103655

SEQ ID NO: 715408 - RNA, 63 nt, hsa; identical to SEQ ID NO: 103656

SEQ ID NO: 715409 - RNA, 63 nt, hsa; identical to SEQ ID NO: 103657

SEQ ID NO: 715410 - RNA, 63 nt, hsa; identical to SEQ ID NO: 103658

SEQ ID NO: 715411 - RNA, 63 nt, hsa; identical to SEQ ID NO: 103659

SEQ ID NO: 715412 - RNA, 63 nt, hsa; identical to SEQ ID NO: 103660

SEQ ID NO: 715413 - RNA, 63 nt, hsa; identical to SEQ ID NO: 103661

SEQ ID NO: 715414 - RNA, 63 nt, hsa; identical to SEQ ID NO: 103662

SEQ ID NO: 715415 - RNA, 63 nt, hsa; identical to SEQ ID NO: 103663

SEQ ID NO: 715416 - RNA, 63 nt, hsa; identical to SEQ ID NO: 103664

SEQ ID NO: 715417 - RNA, 63 nt, hsa; identical to SEQ ID NO: 103665

SEQ ID NO: 715418 - RNA, 63 nt, hsa; identical to SEQ ID NO: 103666

SEQ ID NO: 715419 - RNA, 63 nt, hsa; identical to SEQ ID NO: 103667

SEQ ID NO: 715420 - RNA, 63 nt, hsa; identical to SEQ ID NO: 103668

SEQ ID NO: 715421 - RNA, 63 nt, hsa; identical to SEQ ID NO: 103669

SEQ ID NO: 715422 - RNA, 63 nt, hsa; identical to SEQ ID NO: 103670

SEQ ID NO: 715423 - RNA, 63 nt, hsa; identical to SEQ ID NO: 103671

SEQ ID NO: 715424 - RNA, 63 nt, hsa; identical to SEQ ID NO: 103672

SEQ ID NO: 715425 - RNA, 63 nt, hsa; identical to SEQ ID NO: 103673

SEQ ID NO: 715426 - RNA, 63 nt, hsa; identical to SEQ ID NO: 103674

SEQ ID NO: 715427 - RNA, 63 nt, hsa; identical to SEQ ID NO: 103675

SEQ ID NO: 715428 - RNA, 63 nt, hsa; identical to SEQ ID NO: 103676

SEQ ID NO: 715429 - RNA, 63 nt, hsa; identical to SEQ ID NO: 103677

SEQ ID NO: 715430 - RNA, 63 nt, hsa; identical to SEQ ID NO: 103678

SEQ ID NO: 715431 - RNA, 63 nt, hsa; identical to SEQ ID NO: 103679

SEQ ID NO: 715432 - RNA, 63 nt, hsa; identical to SEQ ID NO: 103680

SEQ ID NO: 715433 - RNA, 63 nt, hsa; identical to SEQ ID NO: 103681

SEQ ID NO: 715434 - RNA, 63 nt, hsa; identical to SEQ ID NO: 103682

SEQ ID NO: 715435 - RNA, 63 nt, hsa; identical to SEQ ID NO: 103683

SEQ ID NO: 715436 - RNA, 63 nt, hsa; identical to SEQ ID NO: 103684

SEQ ID NO: 715437 - RNA, 63 nt, hsa; identical to SEQ ID NO: 103685

SEQ ID NO: 715438 - RNA, 63 nt, hsa; identical to SEQ ID NO: 103686

SEQ ID NO: 715439 - RNA, 63 nt, hsa; identical to SEQ ID NO: 103687

SEQ ID NO: 715440 - RNA, 63 nt, hsa; identical to SEQ ID NO: 103688

SEQ ID NO: 715441 - RNA, 63 nt, hsa; identical to SEQ ID NO: 103689

SEQ ID NO: 715442 - RNA, 63 nt, hsa; identical to SEQ ID NO: 103690

SEQ ID NO: 715443 - RNA, 63 nt, hsa; identical to SEQ ID NO: 103691

SEQ ID NO: 715444 - RNA, 63 nt, hsa; identical to SEQ ID NO: 103692

SEQ ID NO: 715445 - RNA, 63 nt, hsa; identical to SEQ ID NO: 103693

SEQ ID NO: 715446 - RNA, 63 nt, hsa; identical to SEQ ID NO: 103694

SEQ ID NO: 715447 - RNA, 63 nt, hsa; identical to SEQ ID NO: 103695

SEQ ID NO: 715448 - RNA, 63 nt, hsa; identical to SEQ ID NO: 103696

SEQ ID NO: 715449 - RNA, 63 nt, hsa; identical to SEQ ID NO: 103697

SEQ ID NO: 715450 - RNA, 63 nt, hsa; identical to SEQ ID NO: 103698

SEQ ID NO: 715451 - RNA, 63 nt, hsa; identical to SEQ ID NO: 103699

SEQ ID NO: 715452 - RNA, 63 nt, hsa; identical to SEQ ID NO: 103700

SEQ ID NO: 715453 - RNA, 63 nt, hsa; identical to SEQ ID NO: 103701

SEQ ID NO: 715454 - RNA, 63 nt, hsa; identical to SEQ ID NO: 103702

SEQ ID NO: 715455 - RNA, 63 nt, hsa; identical to SEQ ID NO: 103703

SEQ ID NO: 715456 - RNA, 63 nt, hsa; identical to SEQ ID NO: 103704

SEQ ID NO: 715457 - RNA, 63 nt, hsa; identical to SEQ ID NO: 103705

SEQ ID NO: 715458 - RNA, 63 nt, hsa; identical to SEQ ID NO: 103706

SEQ ID NO: 715459 - RNA, 63 nt, hsa; identical to SEQ ID NO: 103707

SEQ ID NO: 715460 - RNA, 63 nt, hsa; identical to SEQ ID NO: 103708

SEQ ID NO: 715461 - RNA, 63 nt, hsa; identical to SEQ ID NO: 103709

SEQ ID NO: 715462 - RNA, 63 nt, hsa; identical to SEQ ID NO: 103710

SEQ ID NO: 715463 - RNA, 63 nt, hsa; identical to SEQ ID NO: 103711

SEQ ID NO: 715464 - RNA, 63 nt, hsa; identical to SEQ ID NO: 103712

SEQ ID NO: 715465 - RNA, 63 nt, hsa; identical to SEQ ID NO: 103713

SEQ ID NO: 715466 - RNA, 63 nt, hsa; identical to SEQ ID NO: 103714

SEQ ID NO: 715467 - RNA, 63 nt, hsa; identical to SEQ ID NO: 103715

SEQ ID NO: 715468 - RNA, 63 nt, hsa; identical to SEQ ID NO: 103716

SEQ ID NO: 715469 - RNA, 63 nt, hsa; identical to SEQ ID NO: 103717

SEQ ID NO: 715470 - RNA, 63 nt, hsa; identical to SEQ ID NO: 103718

SEQ ID NO: 715471 - RNA, 63 nt, hsa; identical to SEQ ID NO: 103719

SEQ ID NO: 715472 - RNA, 63 nt, hsa; identical to SEQ ID NO: 103720

SEQ ID NO: 715473 - RNA, 63 nt, hsa; identical to SEQ ID NO: 103721

SEQ ID NO: 715474 - RNA, 63 nt, hsa; identical to SEQ ID NO: 103722

SEQ ID NO: 715475 - RNA, 63 nt, hsa; identical to SEQ ID NO: 103723

SEQ ID NO: 715476 - RNA, 63 nt, hsa; identical to SEQ ID NO: 103724

SEQ ID NO: 715477 - RNA, 63 nt, hsa; identical to SEQ ID NO: 103725

SEQ ID NO: 715478 - RNA, 63 nt, hsa; identical to SEQ ID NO: 103726

SEQ ID NO: 715479 - RNA, 64 nt, hsa; identical to SEQ ID NO: 87480

SEQ ID NO: 715480 - RNA, 64 nt, hsa; identical to SEQ ID NO: 87481

SEQ ID NO: 715481 - RNA, 64 nt, hsa; identical to SEQ ID NO: 87482

SEQ ID NO: 715482 - RNA, 64 nt, hsa; identical to SEQ ID NO: 87483

SEQ ID NO: 715483 - RNA, 64 nt, hsa; identical to SEQ ID NO: 87484

SEQ ID NO: 715484 - RNA, 64 nt, hsa; identical to SEQ ID NO: 87485

SEQ ID NO: 715485 - RNA, 64 nt, hsa; identical to SEQ ID NO: 87486

SEQ ID NO: 715486 - RNA, 64 nt, hsa; identical to SEQ ID NO: 87487

SEQ ID NO: 715487 - RNA, 64 nt, hsa; identical to SEQ ID NO: 87488

SEQ ID NO: 715488 - RNA, 64 nt, hsa; identical to SEQ ID NO: 87489

SEQ ID NO: 715489 - RNA, 64 nt, hsa; identical to SEQ ID NO: 87490

SEQ ID NO: 715490 - RNA, 64 nt, hsa; identical to SEQ ID NO: 87491

SEQ ID NO: 715491 - RNA, 64 nt, hsa; identical to SEQ ID NO: 87492

SEQ ID NO: 715492 - RNA, 64 nt, hsa; identical to SEQ ID NO: 87493

SEQ ID NO: 715493 - RNA, 64 nt, hsa; identical to SEQ ID NO: 87494

SEQ ID NO: 715494 - RNA, 64 nt, hsa; identical to SEQ ID NO: 87495

SEQ ID NO: 715495 - RNA, 64 nt, hsa; identical to SEQ ID NO: 87496

SEQ ID NO: 715496 - RNA, 64 nt, hsa; identical to SEQ ID NO: 87497

SEQ ID NO: 715497 - RNA, 64 nt, hsa; identical to SEQ ID NO: 87498

SEQ ID NO: 715498 - RNA, 64 nt, hsa; identical to SEQ ID NO: 87499

SEQ ID NO: 715499 - RNA, 64 nt, hsa; identical to SEQ ID NO: 87500

SEQ ID NO: 715500 - RNA, 64 nt, hsa; identical to SEQ ID NO: 87501

SEQ ID NO: 715501 - RNA, 64 nt, hsa; identical to SEQ ID NO: 87502

SEQ ID NO: 715502 - RNA, 64 nt, hsa; identical to SEQ ID NO: 87503

SEQ ID NO: 715503 - RNA, 64 nt, hsa; identical to SEQ ID NO: 87504

SEQ ID NO: 715504 - RNA, 64 nt, hsa; identical to SEQ ID NO: 87505

SEQ ID NO: 715505 - RNA, 64 nt, hsa; identical to SEQ ID NO: 87506

SEQ ID NO: 715506 - RNA, 64 nt, hsa; identical to SEQ ID NO: 87507

SEQ ID NO: 715507 - RNA, 64 nt, hsa; identical to SEQ ID NO: 87508

SEQ ID NO: 715508 - RNA, 64 nt, hsa; identical to SEQ ID NO: 87509

SEQ ID NO: 715509 - RNA, 64 nt, hsa; identical to SEQ ID NO: 87510

SEQ ID NO: 715510 - RNA, 64 nt, hsa; identical to SEQ ID NO: 87511

SEQ ID NO: 715511 - RNA, 64 nt, hsa; identical to SEQ ID NO: 87512

SEQ ID NO: 715512 - RNA, 64 nt, hsa; identical to SEQ ID NO: 87513

SEQ ID NO: 715513 - RNA, 64 nt, hsa; identical to SEQ ID NO: 87514

SEQ ID NO: 715514 - RNA, 64 nt, hsa; identical to SEQ ID NO: 87515

SEQ ID NO: 715515 - RNA, 64 nt, hsa; identical to SEQ ID NO: 87516

SEQ ID NO: 715516 - RNA, 64 nt, hsa; identical to SEQ ID NO: 87517

SEQ ID NO: 715517 - RNA, 64 nt, hsa; identical to SEQ ID NO: 87518

SEQ ID NO: 715518 - RNA, 64 nt, hsa; identical to SEQ ID NO: 87519

SEQ ID NO: 715519 - RNA, 64 nt, hsa; identical to SEQ ID NO: 87520

SEQ ID NO: 715520 - RNA, 64 nt, hsa; identical to SEQ ID NO: 87521

SEQ ID NO: 715521 - RNA, 64 nt, hsa; identical to SEQ ID NO: 87522

SEQ ID NO: 715522 - RNA, 64 nt, hsa; identical to SEQ ID NO: 87523

SEQ ID NO: 715523 - RNA, 64 nt, hsa; identical to SEQ ID NO: 87524

SEQ ID NO: 715524 - RNA, 64 nt, hsa; identical to SEQ ID NO: 87525

SEQ ID NO: 715525 - RNA, 64 nt, hsa; identical to SEQ ID NO: 87526

SEQ ID NO: 715526 - RNA, 64 nt, hsa; identical to SEQ ID NO: 87527

SEQ ID NO: 715527 - RNA, 64 nt, hsa; identical to SEQ ID NO: 87528

SEQ ID NO: 715528 - RNA, 64 nt, hsa; identical to SEQ ID NO: 87529

SEQ ID NO: 715529 - RNA, 64 nt, hsa; identical to SEQ ID NO: 87530

SEQ ID NO: 715530 - RNA, 64 nt, hsa; identical to SEQ ID NO: 87531

SEQ ID NO: 715531 - RNA, 64 nt, hsa; identical to SEQ ID NO: 87532

SEQ ID NO: 715532 - RNA, 64 nt, hsa; identical to SEQ ID NO: 87533

SEQ ID NO: 715533 - RNA, 64 nt, hsa; identical to SEQ ID NO: 87534

SEQ ID NO: 715534 - RNA, 64 nt, hsa; identical to SEQ ID NO: 87535

SEQ ID NO: 715535 - RNA, 64 nt, hsa; identical to SEQ ID NO: 87536

SEQ ID NO: 715536 - RNA, 61 nt, hsa; identical to SEQ ID NO: 292803

SEQ ID NO: 715537 - RNA, 64 nt, hsa; identical to SEQ ID NO: 292804

SEQ ID NO: 715538 - RNA, 64 nt, hsa; identical to SEQ ID NO: 292805

SEQ ID NO: 715539 - RNA, 64 nt, hsa; identical to SEQ ID NO: 292806

SEQ ID NO: 715540 - RNA, 64 nt, hsa; identical to SEQ ID NO: 292807

SEQ ID NO: 715541 - RNA, 64 nt, hsa; identical to SEQ ID NO: 292808

SEQ ID NO: 715542 - RNA, 64 nt, hsa; identical to SEQ ID NO: 292809

SEQ ID NO: 715543 - RNA, 64 nt, hsa; identical to SEQ ID NO: 292810

SEQ ID NO: 715544 - RNA, 64 nt, hsa; identical to SEQ ID NO: 292811

SEQ ID NO: 715545 - RNA, 64 nt, hsa; identical to SEQ ID NO: 292812

SEQ ID NO: 715546 - RNA, 64 nt, hsa; identical to SEQ ID NO: 292813

SEQ ID NO: 715547 - RNA, 64 nt, hsa; identical to SEQ ID NO: 292814

SEQ ID NO: 715548 - RNA, 64 nt, hsa; identical to SEQ ID NO: 292815

SEQ ID NO: 715549 - RNA, 64 nt, hsa; identical to SEQ ID NO: 292816

SEQ ID NO: 715550 - RNA, 64 nt, hsa; identical to SEQ ID NO: 292817

SEQ ID NO: 715551 - RNA, 64 nt, hsa; identical to SEQ ID NO: 292818

SEQ ID NO: 715552 - RNA, 64 nt, hsa; identical to SEQ ID NO: 87480

SEQ ID NO: 715553 - RNA, 64 nt, hsa; identical to SEQ ID NO: 87481

SEQ ID NO: 715554 - RNA, 64 nt, hsa; identical to SEQ ID NO: 87482

SEQ ID NO: 715555 - RNA, 64 nt, hsa; identical to SEQ ID NO: 87483

SEQ ID NO: 715556 - RNA, 64 nt, hsa; identical to SEQ ID NO: 87484

SEQ ID NO: 715557 - RNA, 64 nt, hsa; identical to SEQ ID NO: 87485

SEQ ID NO: 715558 - RNA, 64 nt, hsa; identical to SEQ ID NO: 87486

SEQ ID NO: 715559 - RNA, 64 nt, hsa; identical to SEQ ID NO: 87487

SEQ ID NO: 715560 - RNA, 64 nt, hsa; identical to SEQ ID NO: 87488

SEQ ID NO: 715561 - RNA, 64 nt, hsa; identical to SEQ ID NO: 87489

SEQ ID NO: 715562 - RNA, 64 nt, hsa; identical to SEQ ID NO: 87490

SEQ ID NO: 715563 - RNA, 64 nt, hsa; identical to SEQ ID NO: 87491

SEQ ID NO: 715564 - RNA, 64 nt, hsa; identical to SEQ ID NO: 87492

SEQ ID NO: 715565 - RNA, 64 nt, hsa; identical to SEQ ID NO: 87493

SEQ ID NO: 715566 - RNA, 64 nt, hsa; identical to SEQ ID NO: 87494

SEQ ID NO: 715567 - RNA, 64 nt, hsa; identical to SEQ ID NO: 87495

SEQ ID NO: 715568 - RNA, 64 nt, hsa; identical to SEQ ID NO: 87496

SEQ ID NO: 715569 - RNA, 64 nt, hsa; identical to SEQ ID NO: 87497

SEQ ID NO: 715570 - RNA, 64 nt, hsa; identical to SEQ ID NO: 87498

SEQ ID NO: 715571 - RNA, 64 nt, hsa; identical to SEQ ID NO: 87499

SEQ ID NO: 715572 - RNA, 64 nt, hsa; identical to SEQ ID NO: 87500

SEQ ID NO: 715573 - RNA, 64 nt, hsa; identical to SEQ ID NO: 87501

SEQ ID NO: 715574 - RNA, 64 nt, hsa; identical to SEQ ID NO: 87502

SEQ ID NO: 715575 - RNA, 64 nt, hsa; identical to SEQ ID NO: 87503

SEQ ID NO: 715576 - RNA, 64 nt, hsa; identical to SEQ ID NO: 87504

SEQ ID NO: 715577 - RNA, 64 nt, hsa; identical to SEQ ID NO: 87505

SEQ ID NO: 715578 - RNA, 64 nt, hsa; identical to SEQ ID NO: 87506

SEQ ID NO: 715579 - RNA, 64 nt, hsa; identical to SEQ ID NO: 87507

SEQ ID NO: 715580 - RNA, 64 nt, hsa; identical to SEQ ID NO: 87508

SEQ ID NO: 715581 - RNA, 64 nt, hsa; identical to SEQ ID NO: 87509

SEQ ID NO: 715582 - RNA, 64 nt, hsa; identical to SEQ ID NO: 87510

SEQ ID NO: 715583 - RNA, 64 nt, hsa; identical to SEQ ID NO: 87511

SEQ ID NO: 715584 - RNA, 64 nt, hsa; identical to SEQ ID NO: 87512

SEQ ID NO: 715585 - RNA, 64 nt, hsa; identical to SEQ ID NO: 87513

SEQ ID NO: 715586 - RNA, 64 nt, hsa; identical to SEQ ID NO: 87514

SEQ ID NO: 715587 - RNA, 64 nt, hsa; identical to SEQ ID NO: 87515

SEQ ID NO: 715588 - RNA, 64 nt, hsa; identical to SEQ ID NO: 87516

SEQ ID NO: 715589 - RNA, 64 nt, hsa; identical to SEQ ID NO: 87517

SEQ ID NO: 715590 - RNA, 64 nt, hsa; identical to SEQ ID NO: 87518

SEQ ID NO: 715591 - RNA, 64 nt, hsa; identical to SEQ ID NO: 87519

SEQ ID NO: 715592 - RNA, 64 nt, hsa; identical to SEQ ID NO: 87520

SEQ ID NO: 715593 - RNA, 64 nt, hsa; identical to SEQ ID NO: 87521

SEQ ID NO: 715594 - RNA, 64 nt, hsa; identical to SEQ ID NO: 87522

SEQ ID NO: 715595 - RNA, 64 nt, hsa; identical to SEQ ID NO: 87523

SEQ ID NO: 715596 - RNA, 64 nt, hsa; identical to SEQ ID NO: 87524

SEQ ID NO: 715597 - RNA, 64 nt, hsa; identical to SEQ ID NO: 87525

SEQ ID NO: 715598 - RNA, 64 nt, hsa; identical to SEQ ID NO: 87526

SEQ ID NO: 715599 - RNA, 64 nt, hsa; identical to SEQ ID NO: 87527

SEQ ID NO: 715600 - RNA, 64 nt, hsa; identical to SEQ ID NO: 87528

SEQ ID NO: 715601 - RNA, 64 nt, hsa; identical to SEQ ID NO: 87529

SEQ ID NO: 715602 - RNA, 64 nt, hsa; identical to SEQ ID NO: 87530

SEQ ID NO: 715603 - RNA, 64 nt, hsa; identical to SEQ ID NO: 87531

SEQ ID NO: 715604 - RNA, 64 nt, hsa; identical to SEQ ID NO: 87532

SEQ ID NO: 715605 - RNA, 64 nt, hsa; identical to SEQ ID NO: 87533

SEQ ID NO: 715606 - RNA, 64 nt, hsa; identical to SEQ ID NO: 87534

SEQ ID NO: 715607 - RNA, 64 nt, hsa; identical to SEQ ID NO: 87535

SEQ ID NO: 715608 - RNA, 64 nt, hsa; identical to SEQ ID NO: 87536

SEQ ID NO: 715609 - RNA, 61 nt, hsa; identical to SEQ ID NO: 292803

SEQ ID NO: 715610 - RNA, 64 nt, hsa; identical to SEQ ID NO: 292804

SEQ ID NO: 715611 - RNA, 64 nt, hsa; identical to SEQ ID NO: 292805

SEQ ID NO: 715612 - RNA, 64 nt, hsa; identical to SEQ ID NO: 292806

SEQ ID NO: 715613 - RNA, 64 nt, hsa; identical to SEQ ID NO: 292807

SEQ ID NO: 715614 - RNA, 64 nt, hsa; identical to SEQ ID NO: 292808

SEQ ID NO: 715615 - RNA, 64 nt, hsa; identical to SEQ ID NO: 292809

SEQ ID NO: 715616 - RNA, 64 nt, hsa; identical to SEQ ID NO: 292810

SEQ ID NO: 715617 - RNA, 64 nt, hsa; identical to SEQ ID NO: 292811

SEQ ID NO: 715618 - RNA, 64 nt, hsa; identical to SEQ ID NO: 292812

SEQ ID NO: 715619 - RNA, 64 nt, hsa; identical to SEQ ID NO: 292813

SEQ ID NO: 715620 - RNA, 64 nt, hsa; identical to SEQ ID NO: 292814

SEQ ID NO: 715621 - RNA, 64 nt, hsa; identical to SEQ ID NO: 292815

SEQ ID NO: 715622 - RNA, 64 nt, hsa; identical to SEQ ID NO: 292816

SEQ ID NO: 715623 - RNA, 64 nt, hsa; identical to SEQ ID NO: 292817

SEQ ID NO: 715624 - RNA, 64 nt, hsa; identical to SEQ ID NO: 292818

SEQ ID NO: 715625 - RNA, 64 nt, hsa; identical to SEQ ID NO: 87480

SEQ ID NO: 715626 - RNA, 64 nt, hsa; identical to SEQ ID NO: 87481

SEQ ID NO: 715627 - RNA, 64 nt, hsa; identical to SEQ ID NO: 87482

SEQ ID NO: 715628 - RNA, 64 nt, hsa; identical to SEQ ID NO: 87483

SEQ ID NO: 715629 - RNA, 64 nt, hsa; identical to SEQ ID NO: 87484

SEQ ID NO: 715630 - RNA, 64 nt, hsa; identical to SEQ ID NO: 87485

SEQ ID NO: 715631 - RNA, 64 nt, hsa; identical to SEQ ID NO: 87486

SEQ ID NO: 715632 - RNA, 64 nt, hsa; identical to SEQ ID NO: 87487

SEQ ID NO: 715633 - RNA, 64 nt, hsa; identical to SEQ ID NO: 87488

SEQ ID NO: 715634 - RNA, 64 nt, hsa; identical to SEQ ID NO: 87489

SEQ ID NO: 715635 - RNA, 64 nt, hsa; identical to SEQ ID NO: 87490

SEQ ID NO: 715636 - RNA, 64 nt, hsa; identical to SEQ ID NO: 87491

SEQ ID NO: 715637 - RNA, 64 nt, hsa; identical to SEQ ID NO: 87492

SEQ ID NO: 715638 - RNA, 64 nt, hsa; identical to SEQ ID NO: 87493

SEQ ID NO: 715639 - RNA, 64 nt, hsa; identical to SEQ ID NO: 87494

SEQ ID NO: 715640 - RNA, 64 nt, hsa; identical to SEQ ID NO: 87495

SEQ ID NO: 715641 - RNA, 64 nt, hsa; identical to SEQ ID NO: 87496

SEQ ID NO: 715642 - RNA, 64 nt, hsa; identical to SEQ ID NO: 87497

SEQ ID NO: 715643 - RNA, 64 nt, hsa; identical to SEQ ID NO: 87498

SEQ ID NO: 715644 - RNA, 64 nt, hsa; identical to SEQ ID NO: 87499

SEQ ID NO: 715645 - RNA, 64 nt, hsa; identical to SEQ ID NO: 87500

SEQ ID NO: 715646 - RNA, 64 nt, hsa; identical to SEQ ID NO: 87501

SEQ ID NO: 715647 - RNA, 64 nt, hsa; identical to SEQ ID NO: 87502

SEQ ID NO: 715648 - RNA, 64 nt, hsa; identical to SEQ ID NO: 87503

SEQ ID NO: 715649 - RNA, 64 nt, hsa; identical to SEQ ID NO: 87504

SEQ ID NO: 715650 - RNA, 64 nt, hsa; identical to SEQ ID NO: 87505

SEQ ID NO: 715651 - RNA, 64 nt, hsa; identical to SEQ ID NO: 87506

SEQ ID NO: 715652 - RNA, 64 nt, hsa; identical to SEQ ID NO: 87507

SEQ ID NO: 715653 - RNA, 64 nt, hsa; identical to SEQ ID NO: 87508

SEQ ID NO: 715654 - RNA, 64 nt, hsa; identical to SEQ ID NO: 87509

SEQ ID NO: 715655 - RNA, 64 nt, hsa; identical to SEQ ID NO: 87510

SEQ ID NO: 715656 - RNA, 64 nt, hsa; identical to SEQ ID NO: 87511

SEQ ID NO: 715657 - RNA, 64 nt, hsa; identical to SEQ ID NO: 87512

SEQ ID NO: 715658 - RNA, 64 nt, hsa; identical to SEQ ID NO: 87513

SEQ ID NO: 715659 - RNA, 64 nt, hsa; identical to SEQ ID NO: 87514

SEQ ID NO: 715660 - RNA, 64 nt, hsa; identical to SEQ ID NO: 87515

SEQ ID NO: 715661 - RNA, 64 nt, hsa; identical to SEQ ID NO: 87516

SEQ ID NO: 715662 - RNA, 64 nt, hsa; identical to SEQ ID NO: 87517

SEQ ID NO: 715663 - RNA, 64 nt, hsa; identical to SEQ ID NO: 87518

SEQ ID NO: 715664 - RNA, 64 nt, hsa; identical to SEQ ID NO: 87519

SEQ ID NO: 715665 - RNA, 64 nt, hsa; identical to SEQ ID NO: 87520

SEQ ID NO: 715666 - RNA, 64 nt, hsa; identical to SEQ ID NO: 87521

SEQ ID NO: 715667 - RNA, 64 nt, hsa; identical to SEQ ID NO: 87522

SEQ ID NO: 715668 - RNA, 64 nt, hsa; identical to SEQ ID NO: 87523

SEQ ID NO: 715669 - RNA, 64 nt, hsa; identical to SEQ ID NO: 87524

SEQ ID NO: 715670 - RNA, 64 nt, hsa; identical to SEQ ID NO: 87525

SEQ ID NO: 715671 - RNA, 64 nt, hsa; identical to SEQ ID NO: 87526

SEQ ID NO: 715672 - RNA, 64 nt, hsa; identical to SEQ ID NO: 87527

SEQ ID NO: 715673 - RNA, 64 nt, hsa; identical to SEQ ID NO: 87528

SEQ ID NO: 715674 - RNA, 64 nt, hsa; identical to SEQ ID NO: 87529

SEQ ID NO: 715675 - RNA, 64 nt, hsa; identical to SEQ ID NO: 87530

SEQ ID NO: 715676 - RNA, 64 nt, hsa; identical to SEQ ID NO: 87531

SEQ ID NO: 715677 - RNA, 64 nt, hsa; identical to SEQ ID NO: 87532

SEQ ID NO: 715678 - RNA, 64 nt, hsa; identical to SEQ ID NO: 87533

SEQ ID NO: 715679 - RNA, 64 nt, hsa; identical to SEQ ID NO: 87534

SEQ ID NO: 715680 - RNA, 64 nt, hsa; identical to SEQ ID NO: 87535

SEQ ID NO: 715681 - RNA, 64 nt, hsa; identical to SEQ ID NO: 87536

SEQ ID NO: 715682 - RNA, 61 nt, hsa; identical to SEQ ID NO: 292803

SEQ ID NO: 715683 - RNA, 64 nt, hsa; identical to SEQ ID NO: 292804

SEQ ID NO: 715684 - RNA, 64 nt, hsa; identical to SEQ ID NO: 292805

SEQ ID NO: 715685 - RNA, 64 nt, hsa; identical to SEQ ID NO: 292806

SEQ ID NO: 715686 - RNA, 64 nt, hsa; identical to SEQ ID NO: 292807

SEQ ID NO: 715687 - RNA, 64 nt, hsa; identical to SEQ ID NO: 292808

SEQ ID NO: 715688 - RNA, 64 nt, hsa; identical to SEQ ID NO: 292809

SEQ ID NO: 715689 - RNA, 64 nt, hsa; identical to SEQ ID NO: 292810

SEQ ID NO: 715690 - RNA, 64 nt, hsa; identical to SEQ ID NO: 292811

SEQ ID NO: 715691 - RNA, 64 nt, hsa; identical to SEQ ID NO: 292812

SEQ ID NO: 715692 - RNA, 64 nt, hsa; identical to SEQ ID NO: 292813

SEQ ID NO: 715693 - RNA, 64 nt, hsa; identical to SEQ ID NO: 292814

SEQ ID NO: 715694 - RNA, 64 nt, hsa; identical to SEQ ID NO: 292815

SEQ ID NO: 715695 - RNA, 64 nt, hsa; identical to SEQ ID NO: 292816

SEQ ID NO: 715696 - RNA, 64 nt, hsa; identical to SEQ ID NO: 292817

SEQ ID NO: 715697 - RNA, 64 nt, hsa; identical to SEQ ID NO: 292818

SEQ ID NO: 715698 - RNA, 64 nt, hsa; identical to SEQ ID NO: 56427

SEQ ID NO: 715699 - RNA, 64 nt, hsa; identical to SEQ ID NO: 56428

SEQ ID NO: 715700 - RNA, 64 nt, hsa; identical to SEQ ID NO: 56429

SEQ ID NO: 715701 - RNA, 64 nt, hsa; identical to SEQ ID NO: 56430

SEQ ID NO: 715702 - RNA, 64 nt, hsa; identical to SEQ ID NO: 56431

SEQ ID NO: 715703 - RNA, 64 nt, hsa; identical to SEQ ID NO: 56432

SEQ ID NO: 715704 - RNA, 64 nt, hsa; identical to SEQ ID NO: 56433

SEQ ID NO: 715705 - RNA, 64 nt, hsa; identical to SEQ ID NO: 56434

SEQ ID NO: 715706 - RNA, 64 nt, hsa; identical to SEQ ID NO: 56435

SEQ ID NO: 715707 - RNA, 64 nt, hsa; identical to SEQ ID NO: 56436

SEQ ID NO: 715708 - RNA, 57 nt, hsa; identical to SEQ ID NO: 56437

SEQ ID NO: 715709 - RNA, 64 nt, hsa; identical to SEQ ID NO: 56438

SEQ ID NO: 715710 - RNA, 62 nt, hsa; identical to SEQ ID NO: 68749

SEQ ID NO: 715711 - RNA, 64 nt, hsa; identical to SEQ ID NO: 68750

SEQ ID NO: 715712 - RNA, 64 nt, hsa; identical to SEQ ID NO: 68751

SEQ ID NO: 715713 - RNA, 64 nt, hsa; identical to SEQ ID NO: 68752

SEQ ID NO: 715714 - RNA, 64 nt, hsa; identical to SEQ ID NO: 68753

SEQ ID NO: 715715 - RNA, 64 nt, hsa; identical to SEQ ID NO: 68754

SEQ ID NO: 715716 - RNA, 64 nt, hsa; identical to SEQ ID NO: 68755

SEQ ID NO: 715717 - RNA, 64 nt, hsa; identical to SEQ ID NO: 68756

SEQ ID NO: 715718 - RNA, 64 nt, hsa; identical to SEQ ID NO: 68757

SEQ ID NO: 715719 - RNA, 64 nt, hsa; identical to SEQ ID NO: 48749

SEQ ID NO: 715720 - RNA, 64 nt, hsa; identical to SEQ ID NO: 48750

SEQ ID NO: 715721 - RNA, 64 nt, hsa; identical to SEQ ID NO: 48751

SEQ ID NO: 715722 - RNA, 64 nt, hsa; identical to SEQ ID NO: 48752

SEQ ID NO: 715723 - RNA, 64 nt, hsa; identical to SEQ ID NO: 48753

SEQ ID NO: 715724 - RNA, 64 nt, hsa; identical to SEQ ID NO: 48754

SEQ ID NO: 715725 - RNA, 64 nt, hsa; identical to SEQ ID NO: 48755

SEQ ID NO: 715726 - RNA, 64 nt, hsa; identical to SEQ ID NO: 48756

SEQ ID NO: 715727 - RNA, 64 nt, hsa; identical to SEQ ID NO: 48757

SEQ ID NO: 715728 - RNA, 64 nt, hsa; identical to SEQ ID NO: 48758

SEQ ID NO: 715729 - RNA, 64 nt, hsa
cgccaggaggccacgggccacgggaagaaccaagcggugccagccacgagacgucaccaagaaa

SEQ ID NO: 715730 - RNA, 64 nt, hsa
caccuacacaggagucuucagacccagagaaggacggugccaagggccccaggggcagcaaggc

SEQ ID NO: 715731 - RNA, 64 nt, hsa
acacucagagcuagucaguacaugaacaguggugcggugccagucuguguccguugugaucaca

SEQ ID NO: 715732 - RNA, 64 nt, hsa
gacuguacaagcagaguacaacuacccgccuccccggugccagggcgccuguuggguuuggucc

SEQ ID NO: 715733 - RNA, 64 nt, hsa
uccagaugaugauucagaagcuaauuuuaaaaaacggugccagguaccacaacaguaacagaac

SEQ ID NO: 715734 - RNA, 64 nt, hsa
ugaaaaugcgccuccuccucggagacagacgcaucggugccaccuaguggcuggugggaguaac

SEQ ID NO: 715735 - RNA, 64 nt, hsa
ccuuggaguuaggagccacccugggagguugugccggugccaugcuccucccugugucuuguau

SEQ ID NO: 715736 - RNA, 64 nt, hsa
cccaacccagguuuaugcgucuccagggaagccucggugccagaguggugggcagaucugacca

SEQ ID NO: 715737 - RNA, 64 nt, hsa
ucuuaguucuaaagaaucuuggguuauuuuguagcggugccaguauuucaguagaugggauuuc

SEQ ID NO: 715738 - RNA, 64 nt, hsa
caccuccugcuggcuaccggggcaggcaugcacccggugccagccccgcucugggcaccaccug

SEQ ID NO: 715739 - RNA, 64 nt, hsa
cacccaaaggagcuccgccuggacuuuggcucagcggugccacugaggacccgugugacucgcc

SEQ ID NO: 715740 - RNA, 64 nt, hsa
uuuuuuaaagagauggaggcuggcucuguuggugcggugccaugaucauaguucacuauaaccu

SEQ ID NO: 715741 - RNA, 64 nt, hsa
cugcagagugccuucaaaacucagcuguuccagccggugccaaccugugaacuucccaccauau

SEQ ID NO: 715742 - RNA, 64 nt, hsa
uggaagcccggugucaugaaaugaaaccaaaccucggugccaucgcagaguauaaaaagaaggu

SEQ ID NO: 715743 - RNA, 64 nt, hsa
cugggaaaaggagguacacagccaucaugcgagucggugccaggggaccccccggagauccuga

SEQ ID NO: 715744 - RNA, 64 nt, hsa
ccacggccgaauagccgugagccggaauccugcacggugccaccuccacacucaccucaccucu

SEQ ID NO: 715745 - RNA, 64 nt, hsa
guaaagguuaaacuugaaaagaaauucuuaaucacggugccaaaauucauuuucuaacaccaug

SEQ ID NO: 715746 - RNA, 64 nt, hsa
guagcauuucauucuucucuagcuggugguuucacggugccagguuuucuggguguccaaagga

SEQ ID NO: 715747 - RNA, 64 nt, hsa
ggaugagaaagccugaggugccuggcaugcccaccggugccacucugcagccuccaccccuggc

SEQ ID NO: 715748 - RNA, 64 nt, hsa
uugaugucauuggccucucccaccgauuucauuacggugccacgcagucauggaucuggguagu

SEQ ID NO: 715749 - RNA, 64 nt, hsa
acacuugcucaguucaggcagcucugcuggagggcggugccaugccuaagccugugcacaugca

SEQ ID NO: 715750 - RNA, 64 nt, hsa
guuuccugacagccgcugcaauacacagucuugacggugccauccggguacucccuccucuuga

SEQ ID NO: 715751 - RNA, 64 nt, hsa
accgggugagcaacaggaggacgaggggccggggcggugccaggcuaccacaagaaccugcguc

SEQ ID NO: 715752 - RNA, 64 nt, hsa
ggcugugcccaccacccuucccagaacccucggacggugccagggccgcccgcguccucgccag

SEQ ID NO: 715753 - RNA, 64 nt, hsa
cuccuucuucuguuccauuucaguucaguuucagcggugccaaccucuuugcguuuccuuuuug

SEQ ID NO: 715754 - RNA, 64 nt, hsa
acuaacgacacauacaugaaauuuagcugguuaacggugccagaaaagucacuggacaaagaac

SEQ ID NO: 715755 - RNA, 64 nt, hsa
ccccauggcaggaacagccacuugcaucuggucccggugccacacugcggugcuuggugugguu

SEQ ID NO: 715756 - RNA, 64 nt, hsa
ugcaccuggggacccagagcgagauggguuuguucggugccagccgaccaagauugacuaguuu

SEQ ID NO: 715757 - RNA, 64 nt, hsa
uuccgugcucgagccguuuuuacccagcuggguacggugccacguucaggcacgugcacccggc

SEQ ID NO: 715758 - RNA, 64 nt, hsa
ucaaaaaaaaaauugguguucaugacucuguggucggugccagaggaaaauaggaacgacucua

SEQ ID NO: 715759 - RNA, 64 nt, hsa
gagcaucauuccuuucuaucugcugccagagccacggugccauuuacuccaaggacucacuuuc

SEQ ID NO: 715760 - RNA, 64 nt, hsa
aggaaggagacagacagcuggcaguuccucgccucggugccaucagggaggagccuuaaguucc

SEQ ID NO: 715761 - RNA, 64 nt, hsa
uggacaggcgggcucggaggcuacccgcuguggccggugccagcugcccuugcaggguggguga

SEQ ID NO: 715762 - RNA, 64 nt, hsa
uucugcacacucggccaguucccucuccaauguccggugccaucuuuccugaccuuuguuucuu

SEQ ID NO: 715763 - RNA, 64 nt, hsa
aggguuccgaaggcgccauccccggaccuaggaccggugccagcccugacuccgccgccccucu

SEQ ID NO: 715764 - RNA, 64 nt, hsa
aagaacagcaugaggacuugcugagacugccucacggugccaccaugcggaccggggggaggca

SEQ ID NO: 715765 - RNA, 64 nt, hsa
gcagcuggagaggaagccuggggcacguccugugcggugccaccaaggccccaccccugccccu

SEQ ID NO: 715766 - RNA, 64 nt, hsa
gugucuuuggaggugcugcuuaauaccaaacaugcggugccaugaagggacccuuuggggguug

SEQ ID NO: 715767 - RNA, 64 nt, hsa
ccccgggcacggccccagcuccguggggcucucacggugccaaucacaagacccaggguugugc

SEQ ID NO: 715768 - RNA, 64 nt, hsa
gauguugggaggagaaaccaucacaagauucccucggugccacagcugugcugaggaggccggg

SEQ ID NO: 715769 - RNA, 64 nt, hsa
cuaaaccucgugcuugugaacuccauacagaaaacggugccaucccugaacacggcuggccacu

SEQ ID NO: 715770 - RNA, 64 nt, hsa
uccuguggaaggcagaggcagugagggagguggacggugccagcugaggcugaggcaugcagca

SEQ ID NO: 715771 - RNA, 64 nt, hsa
ugaaaaaaaaguuuguuguauagucaaaacaaaucggugccacccggccgugacaaauccuagu

SEQ ID NO: 715772 - RNA, 64 nt, hsa
cuagcaaugaagguugggaagguuguucccuucccggugccagguccagauuucccuccaugau

SEQ ID NO: 715773 - RNA, 64 nt, hsa
ugaaccgcucuggucugcuccucagagagggcagcggugccaggccucaggucagggagaaugu

SEQ ID NO: 715774 - RNA, 62 nt, hsa
ucaaugaagaugagccguaacagcagccucggcggugccacccacugcacuggggccagcug

SEQ ID NO: 715775 - RNA, 64 nt, hsa
uuaauccaucuaagugacauuuuugaaauuccagcggugccacccaaucaugcccagcuucugu

SEQ ID NO: 715776 - RNA, 64 nt, hsa
cccucugcaacuacaaauagcagagugagccaggcggugccaaagcaagggcuaguugagacau

SEQ ID NO: 715777 - RNA, 64 nt, hsa
auucacaucucuucuugcauguaccuaagaggggcggugccauuguuugggggcuuggggggcu

SEQ ID NO: 715778 - RNA, 64 nt, hsa
gauguugcacuuggcuggcuuaugccucugagaucggugccacggcuguauuuauuucaguugu

SEQ ID NO: 715779 - RNA, 64 nt, hsa
uaagaauaugucagaagagugcucgguuagcccacggugccaaaacuccaaacaaguuccccgg

SEQ ID NO: 715780 - RNA, 64 nt, hsa
aggggacaggacagaaagccugcacugaggggugcggugccaacagggaaacucuucaccuccc

SEQ ID NO: 715781 - RNA, 64 nt, hsa
guacucauaugggauucccagaaaaccugccuaacggugccacugcugacaauggugaugaugg

SEQ ID NO: 715782 - RNA, 64 nt, hsa
ccacucucugugaauaccuacccccuucuggccacggugccauaccuguuucuuccugugacug

SEQ ID NO: 715783 - RNA, 64 nt, hsa
ugaagaagaagaaguugugaggacagcugccgcccggugccaccucgugguagacuaugacggu

SEQ ID NO: 715784 - RNA, 64 nt, hsa
gguaugugcaggauacaguguguuucaucuguuccggugccaagaaugagcaguguacuguggc

SEQ ID NO: 715785 - RNA, 64 nt, hsa
ggggcucaucgagggucucaggccgaggccacugcggugccagugccccccugaggacuagggc

SEQ ID NO: 715786 - RNA, 64 nt, hsa
gagcuccccuguuccccuucauugaaaaccaccacggugccaucucuuguguaugcagggcuau

SEQ ID NO: 715787 - RNA, 64 nt, hsa
gaacaccugugccucccugcucggccagcggccacggugccagagucaccaccuugccggccac

SEQ ID NO: 715788 - RNA, 64 nt, hsa
uguauuaagccuuaacacuuuucuuaagugcauucggugccaacauuuuuuagagcuguaccaa

SEQ ID NO: 715789 - RNA, 64 nt, hsa
aagagcagagaaaucaucaccaccuugggccccacggugccacgggcucaggcagcacaguagg

SEQ ID NO: 715790 - RNA, 64 nt, hsa
accugcaucuggggcccauacugguuggcucccgcggugccaugucugcagugugccccccagc

SEQ ID NO: 715791 - RNA, 64 nt, hsa
cgggggugcagcuucaacucucucggcgguagggcggugccauccccacccauagggcuggcuc

SEQ ID NO: 715792 - RNA, 64 nt, hsa
agcucagaaccacgggggucugugccggcagcaccggugccaucuuggcuuccacaaauuccag

SEQ ID NO: 715793 - RNA, 64 nt, hsa
agucuuugguuggaguguugugaaaguggacccgcggugccacuagauggcacuuggugccuag

SEQ ID NO: 715794 - RNA, 64 nt, hsa
auccccagacaucaccaggucuaauguuuacaaacggugccagcccggcucugaagccaagggc

SEQ ID NO: 715795 - RNA, 64 nt, hsa
uuaggaagggugaguggcugguuccagggugggccggugccagcuccgggguggacugaacagc

SEQ ID NO: 715796 - RNA, 64 nt, hsa
cacauugacauuuccauuacacacagcacugcugcggugccagggaccuagcgcaggacuuuug

SEQ ID NO: 715797 - RNA, 64 nt, hsa
ucauaaagcuuccgugacuucuaaaccaucaggucggugccauaagagaugcucaaaaaagcau

SEQ ID NO: 715798 - RNA, 64 nt, hsa
auggaguaauggauucaaagagauucugucuuaccggugccagucaguacuccagggaugggag

SEQ ID NO: 715799 - RNA, 64 nt, hsa
gagaggaccccucucuuaauacagcugcuuuucucggugccaaccucccucccccaagcucaga

SEQ ID NO: 715800 - RNA, 64 nt, hsa
cggggccugcaggccagucccacggcucugugcccggugccaucuuccauauccgggugcucaa

SEQ ID NO: 715801 - RNA, 64 nt, hsa
ucuuuccuugaaggggcgggcaccaggcuagguccggugccaauaaauccuuguggaaucugac

SEQ ID NO: 715802 - RNA, 64 nt, hsa
uggcaaaaggagccucacacccccaaggaggggacggugccacuuccagacaagacccacaaau

SEQ ID NO: 715803 - RNA, 64 nt, hsa
ggccaucaucugcugcuggggcccccccaccacgcggugccaggcccagugucccccaggccgu

SEQ ID NO: 715804 - RNA, 64 nt, hsa
aagggcaugaagcgaggacccgagggcagccucucggugccaagagccauccccgccaacagcc

SEQ ID NO: 715805 - RNA, 64 nt, hsa
ggcagugccagccacgggaaccaggagcgagagacggugccagaacgccggggcccggggcaac

SEQ ID NO: 715806 - RNA, 64 nt, hsa
guggacauagcuuccaaggagugcggccacaagccggugccagcaugagagcaggcacagaagg

SEQ ID NO: 715807 - RNA, 63 nt, hsa
ucgacuuucuuuccaacugagggcgcgccggcgcggugccagcgccgucugcccggccccgcc

SEQ ID NO: 715808 - RNA, 64 nt, hsa
uuccugucacucccggggcugucccuguacuacacggugccauggagccggggagagcggggaa

SEQ ID NO: 715809 - RNA, 64 nt, hsa
caggacugccagggaucggagugcgggccgcgcacggugccaggauuccgccgaggggaagccg

SEQ ID NO: 715810 - RNA, 64 nt, hsa
cagccucugagucccguggggccccggcucccaccggugccaaacccagccccugcggccguca

SEQ ID NO: 715811 - RNA, 64 nt, hsa
agcgacagagcaguugagaggacacucccguuuucggugccaucagugccccgucuacagcucc

SEQ ID NO: 715812 - RNA, 64 nt, hsa
cagcuuggagauccaggggcgcauggagaggccacggugccagagguucagggagaacagcugc

SEQ ID NO: 715813 - RNA, 64 nt, hsa
aggcccauuuuucaugugcuucacuuugauagaguuaauccauaaaauugcucuuuacuuuagc

SEQ ID NO: 715814 - RNA, 64 nt, hsa
gguuugauaaugcuuuuuaaguuguacagaaugcuuaauccaucuuauuacuguccugagccau

SEQ ID NO: 715815 - RNA, 64 nt, hsa
uuuuuuucagguuagugauuuuuuuguauacaauuuaauccaaauguuaugacauucagaaauc

SEQ ID NO: 715816 - RNA, 64 nt, hsa
cauggcuaaaucaaagcugccccugagaagagacuuaauccaagccugauuguacuaguggcau

SEQ ID NO: 715817 - RNA, 64 nt, hsa
gcaaugaguauaucaucaguacacuagcuuuuuauuaauccauguacacuguauaguaucuugc

SEQ ID NO: 715818 - RNA, 64 nt, hsa
ccuagcuggguguucaucauaacuuuccacagcuuuaauccacgccaaguuuguauauaacuga

SEQ ID NO: 715819 - RNA, 64 nt, hsa
guggcuucuggcaccuggcgggcuggugaccuuuuuaauccaggccccaucagcaucccacgau

SEQ ID NO: 715820 - RNA, 64 nt, hsa
aaauccacccagcccacuaacugaggagcuaguguuaauccagagaaccccccgcaaugugcuu

SEQ ID NO: 715821 - RNA, 64 nt, hsa
aaacuucugguguggccagguuuuagguaacuuuuuaauccaaaacuauugugccauaaauguu

SEQ ID NO: 715822 - RNA, 64 nt, hsa
uuaaaugcuuaugauauuuaaucauaaaaagggauuaauccaaccauuuucuaguaaagccaga

SEQ ID NO: 715823 - RNA, 64 nt, hsa
uguaucaguucuuuguuaggcaugaacgucuuuauuaauccaucauucuuuucuucauucaaca

SEQ ID NO: 715824 - RNA, 64 nt, hsa
gggauuugggggugaauuugucaauaucuggauuuuaauccagacaucucugcuaacaagccuu

SEQ ID NO: 715825 - RNA, 64 nt, hsa
uuuuacuagaaaauguauuacauuuuauuuuuucuuaauccaguucugcaaaaaugaccuauaa

SEQ ID NO: 715826 - RNA, 64 nt, hsa
aguugauuccucaaguuaugaaauacuuuuguacuuaauccauuucuugauuaaagugauugaa

SEQ ID NO: 715827 - RNA, 64 nt, hsa; identical to SEQ ID NO: 686451

SEQ ID NO: 715828 - RNA, 64 nt, hsa; identical to SEQ ID NO: 686452

SEQ ID NO: 715829 - RNA, 64 nt, hsa; identical to SEQ ID NO: 686453

SEQ ID NO: 715830 - RNA, 64 nt, hsa; identical to SEQ ID NO: 686454

SEQ ID NO: 715831 - RNA, 64 nt, hsa; identical to SEQ ID NO: 686455

SEQ ID NO: 715832 - RNA, 64 nt, hsa; identical to SEQ ID NO: 686456

SEQ ID NO: 715833 - RNA, 64 nt, hsa; identical to SEQ ID NO: 686457

SEQ ID NO: 715834 - RNA, 64 nt, hsa; identical to SEQ ID NO: 686458

SEQ ID NO: 715835 - RNA, 64 nt, hsa; identical to SEQ ID NO: 686459

SEQ ID NO: 715836 - RNA, 64 nt, hsa; identical to SEQ ID NO: 686460

SEQ ID NO: 715837 - RNA, 64 nt, hsa; identical to SEQ ID NO: 686461

SEQ ID NO: 715838 - RNA, 64 nt, hsa; identical to SEQ ID NO: 686462

SEQ ID NO: 715839 - RNA, 64 nt, hsa; identical to SEQ ID NO: 686463

SEQ ID NO: 715840 - RNA, 64 nt, hsa; identical to SEQ ID NO: 686464

SEQ ID NO: 715841 - RNA, 64 nt, hsa; identical to SEQ ID NO: 686465

SEQ ID NO: 715842 - RNA, 64 nt, hsa; identical to SEQ ID NO: 686466

SEQ ID NO: 715843 - RNA, 64 nt, hsa; identical to SEQ ID NO: 574523

SEQ ID NO: 715844 - RNA, 64 nt, hsa; identical to SEQ ID NO: 574524

SEQ ID NO: 715845 - RNA, 64 nt, hsa; identical to SEQ ID NO: 574525

SEQ ID NO: 715846 - RNA, 64 nt, hsa; identical to SEQ ID NO: 574526

SEQ ID NO: 715847 - RNA, 64 nt, hsa; identical to SEQ ID NO: 574527

SEQ ID NO: 715848 - RNA, 64 nt, hsa; identical to SEQ ID NO: 574528

SEQ ID NO: 715849 - RNA, 64 nt, hsa; identical to SEQ ID NO: 574529

SEQ ID NO: 715850 - RNA, 64 nt, hsa; identical to SEQ ID NO: 574530

SEQ ID NO: 715851 - RNA, 64 nt, hsa; identical to SEQ ID NO: 574531

SEQ ID NO: 715852 - RNA, 64 nt, hsa; identical to SEQ ID NO: 574532

SEQ ID NO: 715853 - RNA, 64 nt, hsa; identical to SEQ ID NO: 574533

SEQ ID NO: 715854 - RNA, 64 nt, hsa; identical to SEQ ID NO: 574534

SEQ ID NO: 715855 - RNA, 64 nt, hsa; identical to SEQ ID NO: 574535

SEQ ID NO: 715856 - RNA, 64 nt, hsa; identical to SEQ ID NO: 574536

SEQ ID NO: 715857 - RNA, 64 nt, hsa; identical to SEQ ID NO: 574537

SEQ ID NO: 715858 - RNA, 64 nt, hsa; identical to SEQ ID NO: 574538

SEQ ID NO: 715859 - RNA, 64 nt, hsa; identical to SEQ ID NO: 574539

SEQ ID NO: 715860 - RNA, 64 nt, hsa; identical to SEQ ID NO: 574540

SEQ ID NO: 715861 - RNA, 64 nt, hsa; identical to SEQ ID NO: 574541

SEQ ID NO: 715862 - RNA, 64 nt, hsa; identical to SEQ ID NO: 574542

SEQ ID NO: 715863 - RNA, 64 nt, hsa; identical to SEQ ID NO: 420267

SEQ ID NO: 715864 - RNA, 64 nt, hsa; identical to SEQ ID NO: 420268

SEQ ID NO: 715865 - RNA, 64 nt, hsa; identical to SEQ ID NO: 420269

SEQ ID NO: 715866 - RNA, 64 nt, hsa; identical to SEQ ID NO: 420270

SEQ ID NO: 715867 - RNA, 64 nt, hsa; identical to SEQ ID NO: 420271

SEQ ID NO: 715868 - RNA, 64 nt, hsa; identical to SEQ ID NO: 420272

SEQ ID NO: 715869 - RNA, 64 nt, hsa; identical to SEQ ID NO: 420273

SEQ ID NO: 715870 - RNA, 63 nt, hsa; identical to SEQ ID NO: 420274

SEQ ID NO: 715871 - RNA, 64 nt, hsa; identical to SEQ ID NO: 420275

SEQ ID NO: 715872 - RNA, 64 nt, hsa; identical to SEQ ID NO: 420276

SEQ ID NO: 715873 - RNA, 64 nt, hsa; identical to SEQ ID NO: 420277

SEQ ID NO: 715874 - RNA, 64 nt, hsa; identical to SEQ ID NO: 420278

SEQ ID NO: 715875 - RNA, 60 nt, hsa; identical to SEQ ID NO: 420279

SEQ ID NO: 715876 - RNA, 64 nt, hsa; identical to SEQ ID NO: 420280

SEQ ID NO: 715877 - RNA, 64 nt, hsa; identical to SEQ ID NO: 420281

SEQ ID NO: 715878 - RNA, 64 nt, hsa; identical to SEQ ID NO: 420282

SEQ ID NO: 715879 - RNA, 64 nt, hsa; identical to SEQ ID NO: 420283

SEQ ID NO: 715880 - RNA, 64 nt, hsa; identical to SEQ ID NO: 420284

SEQ ID NO: 715881 - RNA, 64 nt, hsa; identical to SEQ ID NO: 420285

SEQ ID NO: 715882 - RNA, 64 nt, hsa; identical to SEQ ID NO: 420286

SEQ ID NO: 715883 - RNA, 64 nt, hsa; identical to SEQ ID NO: 420287

SEQ ID NO: 715884 - RNA, 64 nt, hsa; identical to SEQ ID NO: 420288

SEQ ID NO: 715885 - RNA, 64 nt, hsa; identical to SEQ ID NO: 420289

SEQ ID NO: 715886 - RNA, 64 nt, hsa; identical to SEQ ID NO: 420290

SEQ ID NO: 715887 - RNA, 64 nt, hsa; identical to SEQ ID NO: 420291

SEQ ID NO: 715888 - RNA, 64 nt, hsa; identical to SEQ ID NO: 420292

SEQ ID NO: 715889 - RNA, 64 nt, hsa
gacacauucugaguaacaucagcaggaaugcucugaccaugagguggggguuuuggggugggcg

SEQ ID NO: 715890 - RNA, 64 nt, hsa
aguggaggagaggagaaauguccucauauuugaggaccaugaaacauuguagguauauaugggg

SEQ ID NO: 715891 - RNA, 64 nt, hsa
cuguagaaaugcucuuugaaaaagucuaucgacugaccaugaucaaucuagcauauguauguuc

SEQ ID NO: 715892 - RNA, 64 nt, hsa
acaccaucuucccaggcaaaagcaacaucugguugaccaugauuuuaauccagaacuuccucau

SEQ ID NO: 715893 - RNA, 64 nt, hsa
uuugauccuugaaaaugggaacuuugacagccaugaccaugaaacucacaaggcaacgcgauga

SEQ ID NO: 715894 - RNA, 64 nt, hsa
gaaauaggaugauguuugugagcaccagacucaagaccaugaccuucuuugauccuugaaaaug

SEQ ID NO: 715895 - RNA, 64 nt, hsa; identical to SEQ ID NO: 109257

SEQ ID NO: 715896 - RNA, 64 nt, hsa; identical to SEQ ID NO: 109258

SEQ ID NO: 715897 - RNA, 64 nt, hsa; identical to SEQ ID NO: 109259

SEQ ID NO: 715898 - RNA, 64 nt, hsa; identical to SEQ ID NO: 109260

SEQ ID NO: 715899 - RNA, 64 nt, hsa; identical to SEQ ID NO: 109261

SEQ ID NO: 715900 - RNA, 64 nt, hsa; identical to SEQ ID NO: 109262

SEQ ID NO: 715901 - RNA, 64 nt, hsa; identical to SEQ ID NO: 109263

SEQ ID NO: 715902 - RNA, 64 nt, hsa; identical to SEQ ID NO: 109264

SEQ ID NO: 715903 - RNA, 64 nt, hsa; identical to SEQ ID NO: 109265

SEQ ID NO: 715904 - RNA, 64 nt, hsa; identical to SEQ ID NO: 109266

SEQ ID NO: 715905 - RNA, 64 nt, hsa; identical to SEQ ID NO: 109267

SEQ ID NO: 715906 - RNA, 64 nt, hsa; identical to SEQ ID NO: 109268

SEQ ID NO: 715907 - RNA, 64 nt, hsa; identical to SEQ ID NO: 109269

SEQ ID NO: 715908 - RNA, 64 nt, hsa; identical to SEQ ID NO: 109270

SEQ ID NO: 715909 - RNA, 64 nt, hsa; identical to SEQ ID NO: 109271

SEQ ID NO: 715910 - RNA, 64 nt, hsa; identical to SEQ ID NO: 109272

SEQ ID NO: 715911 - RNA, 64 nt, hsa; identical to SEQ ID NO: 109273

SEQ ID NO: 715912 - RNA, 64 nt, hsa; identical to SEQ ID NO: 109274

SEQ ID NO: 715913 - RNA, 64 nt, hsa; identical to SEQ ID NO: 109275

SEQ ID NO: 715914 - RNA, 64 nt, hsa; identical to SEQ ID NO: 109276

SEQ ID NO: 715915 - RNA, 64 nt, hsa; identical to SEQ ID NO: 109277

SEQ ID NO: 715916 - RNA, 64 nt, hsa; identical to SEQ ID NO: 109278

SEQ ID NO: 715917 - RNA, 64 nt, hsa; identical to SEQ ID NO: 109279

SEQ ID NO: 715918 - RNA, 64 nt, hsa; identical to SEQ ID NO: 109280

SEQ ID NO: 715919 - RNA, 64 nt, hsa; identical to SEQ ID NO: 109281

SEQ ID NO: 715920 - RNA, 64 nt, hsa; identical to SEQ ID NO: 109282

SEQ ID NO: 715921 - RNA, 64 nt, hsa; identical to SEQ ID NO: 109283

SEQ ID NO: 715922 - RNA, 64 nt, hsa; identical to SEQ ID NO: 109284

SEQ ID NO: 715923 - RNA, 64 nt, hsa; identical to SEQ ID NO: 109285

SEQ ID NO: 715924 - RNA, 64 nt, hsa; identical to SEQ ID NO: 109286

SEQ ID NO: 715925 - RNA, 64 nt, hsa; identical to SEQ ID NO: 109287

SEQ ID NO: 715926 - RNA, 64 nt, hsa; identical to SEQ ID NO: 109288

SEQ ID NO: 715927 - RNA, 64 nt, hsa; identical to SEQ ID NO: 109289

SEQ ID NO: 715928 - RNA, 64 nt, hsa; identical to SEQ ID NO: 109290

SEQ ID NO: 715929 - RNA, 64 nt, hsa; identical to SEQ ID NO: 109291

SEQ ID NO: 715930 - RNA, 64 nt, hsa; identical to SEQ ID NO: 387874

SEQ ID NO: 715931 - RNA, 64 nt, hsa; identical to SEQ ID NO: 387875

SEQ ID NO: 715932 - RNA, 64 nt, hsa; identical to SEQ ID NO: 387876

SEQ ID NO: 715933 - RNA, 64 nt, hsa; identical to SEQ ID NO: 387877

SEQ ID NO: 715934 - RNA, 64 nt, hsa; identical to SEQ ID NO: 387878

SEQ ID NO: 715935 - RNA, 64 nt, hsa; identical to SEQ ID NO: 387879

SEQ ID NO: 715936 - RNA, 64 nt, hsa; identical to SEQ ID NO: 387880

SEQ ID NO: 715937 - RNA, 64 nt, hsa; identical to SEQ ID NO: 387881

SEQ ID NO: 715938 - RNA, 64 nt, hsa; identical to SEQ ID NO: 387882

SEQ ID NO: 715939 - RNA, 64 nt, hsa; identical to SEQ ID NO: 387883

SEQ ID NO: 715940 - RNA, 64 nt, hsa; identical to SEQ ID NO: 387884

SEQ ID NO: 715941 - RNA, 64 nt, hsa; identical to SEQ ID NO: 387885

SEQ ID NO: 715942 - RNA, 64 nt, hsa; identical to SEQ ID NO: 387886

SEQ ID NO: 715943 - RNA, 64 nt, hsa; identical to SEQ ID NO: 387887

SEQ ID NO: 715944 - RNA, 64 nt, hsa; identical to SEQ ID NO: 387888

SEQ ID NO: 715945 - RNA, 64 nt, hsa; identical to SEQ ID NO: 387889

SEQ ID NO: 715946 - RNA, 64 nt, hsa; identical to SEQ ID NO: 387890

SEQ ID NO: 715947 - RNA, 64 nt, hsa; identical to SEQ ID NO: 387891

SEQ ID NO: 715948 - RNA, 64 nt, hsa; identical to SEQ ID NO: 387892

SEQ ID NO: 715949 - RNA, 64 nt, hsa; identical to SEQ ID NO: 387893

SEQ ID NO: 715950 - RNA, 64 nt, hsa; identical to SEQ ID NO: 387894

SEQ ID NO: 715951 - RNA, 64 nt, hsa; identical to SEQ ID NO: 387895

SEQ ID NO: 715952 - RNA, 64 nt, hsa; identical to SEQ ID NO: 387896

SEQ ID NO: 715953 - RNA, 64 nt, hsa; identical to SEQ ID NO: 387897

SEQ ID NO: 715954 - RNA, 64 nt, hsa; identical to SEQ ID NO: 387898

SEQ ID NO: 715955 - RNA, 64 nt, hsa; identical to SEQ ID NO: 387899

SEQ ID NO: 715956 - RNA, 64 nt, hsa; identical to SEQ ID NO: 85822

SEQ ID NO: 715957 - RNA, 64 nt, hsa; identical to SEQ ID NO: 85823

SEQ ID NO: 715958 - RNA, 64 nt, hsa; identical to SEQ ID NO: 85824

SEQ ID NO: 715959 - RNA, 64 nt, hsa; identical to SEQ ID NO: 85825

SEQ ID NO: 715960 - RNA, 64 nt, hsa; identical to SEQ ID NO: 85826

SEQ ID NO: 715961 - RNA, 64 nt, hsa; identical to SEQ ID NO: 85827

SEQ ID NO: 715962 - RNA, 64 nt, hsa; identical to SEQ ID NO: 85828

SEQ ID NO: 715963 - RNA, 64 nt, hsa; identical to SEQ ID NO: 85829

SEQ ID NO: 715964 - RNA, 64 nt, hsa; identical to SEQ ID NO: 85830

SEQ ID NO: 715965 - RNA, 64 nt, hsa; identical to SEQ ID NO: 85831

SEQ ID NO: 715966 - RNA, 64 nt, hsa; identical to SEQ ID NO: 85832

SEQ ID NO: 715967 - RNA, 64 nt, hsa; identical to SEQ ID NO: 85833

SEQ ID NO: 715968 - RNA, 64 nt, hsa; identical to SEQ ID NO: 85834

SEQ ID NO: 715969 - RNA, 64 nt, hsa; identical to SEQ ID NO: 85835

SEQ ID NO: 715970 - RNA, 64 nt, hsa; identical to SEQ ID NO: 85836

SEQ ID NO: 715971 - RNA, 64 nt, hsa; identical to SEQ ID NO: 85837

SEQ ID NO: 715972 - RNA, 64 nt, hsa; identical to SEQ ID NO: 85838

SEQ ID NO: 715973 - RNA, 64 nt, hsa; identical to SEQ ID NO: 85839

SEQ ID NO: 715974 - RNA, 64 nt, hsa; identical to SEQ ID NO: 85840

SEQ ID NO: 715975 - RNA, 64 nt, hsa; identical to SEQ ID NO: 85841

SEQ ID NO: 715976 - RNA, 64 nt, hsa; identical to SEQ ID NO: 85842

SEQ ID NO: 715977 - RNA, 64 nt, hsa; identical to SEQ ID NO: 85843

SEQ ID NO: 715978 - RNA, 64 nt, hsa; identical to SEQ ID NO: 85844

SEQ ID NO: 715979 - RNA, 64 nt, hsa; identical to SEQ ID NO: 85845

SEQ ID NO: 715980 - RNA, 64 nt, hsa; identical to SEQ ID NO: 85846

SEQ ID NO: 715981 - RNA, 64 nt, hsa; identical to SEQ ID NO: 85847

SEQ ID NO: 715982 - RNA, 64 nt, hsa; identical to SEQ ID NO: 85848

SEQ ID NO: 715983 - RNA, 64 nt, hsa; identical to SEQ ID NO: 85849

SEQ ID NO: 715984 - RNA, 64 nt, hsa; identical to SEQ ID NO: 85850

SEQ ID NO: 715985 - RNA, 64 nt, hsa; identical to SEQ ID NO: 85851

SEQ ID NO: 715986 - RNA, 64 nt, hsa; identical to SEQ ID NO: 85852

SEQ ID NO: 715987 - RNA, 64 nt, hsa; identical to SEQ ID NO: 85853

SEQ ID NO: 715988 - RNA, 64 nt, hsa; identical to SEQ ID NO: 85854

SEQ ID NO: 715989 - RNA, 64 nt, hsa; identical to SEQ ID NO: 85855

SEQ ID NO: 715990 - RNA, 64 nt, hsa; identical to SEQ ID NO: 85856

SEQ ID NO: 715991 - RNA, 64 nt, hsa; identical to SEQ ID NO: 85857

SEQ ID NO: 715992 - RNA, 64 nt, hsa; identical to SEQ ID NO: 85858

SEQ ID NO: 715993 - RNA, 64 nt, hsa; identical to SEQ ID NO: 85370

SEQ ID NO: 715994 - RNA, 64 nt, hsa; identical to SEQ ID NO: 85371

SEQ ID NO: 715995 - RNA, 64 nt, hsa; identical to SEQ ID NO: 85372

SEQ ID NO: 715996 - RNA, 64 nt, hsa; identical to SEQ ID NO: 85373

SEQ ID NO: 715997 - RNA, 64 nt, hsa; identical to SEQ ID NO: 85374

SEQ ID NO: 715998 - RNA, 64 nt, hsa; identical to SEQ ID NO: 85375

SEQ ID NO: 715999 - RNA, 64 nt, hsa; identical to SEQ ID NO: 85376

SEQ ID NO: 716000 - RNA, 64 nt, hsa; identical to SEQ ID NO: 85377

SEQ ID NO: 716001 - RNA, 64 nt, hsa; identical to SEQ ID NO: 85378

SEQ ID NO: 716002 - RNA, 64 nt, hsa; identical to SEQ ID NO: 85379

SEQ ID NO: 716003 - RNA, 64 nt, hsa; identical to SEQ ID NO: 85380

SEQ ID NO: 716004 - RNA, 64 nt, hsa; identical to SEQ ID NO: 85381

SEQ ID NO: 716005 - RNA, 64 nt, hsa; identical to SEQ ID NO: 85382

SEQ ID NO: 716006 - RNA, 64 nt, hsa; identical to SEQ ID NO: 85383

SEQ ID NO: 716007 - RNA, 64 nt, hsa; identical to SEQ ID NO: 85384

SEQ ID NO: 716008 - RNA, 64 nt, hsa; identical to SEQ ID NO: 85385

SEQ ID NO: 716009 - RNA, 64 nt, hsa; identical to SEQ ID NO: 85386

SEQ ID NO: 716010 - RNA, 64 nt, hsa
gguaagggaccuucagggagagcugggcagacaggugggagauggagguagggcuggcuggagg

SEQ ID NO: 716011 - RNA, 64 nt, hsa
uaagggagucauugccuugggccugggaaucuaagugggagacaauauuaauuuggauccgauu

SEQ ID NO: 716012 - RNA, 64 nt, hsa
ggugccuguaaucccggcuauucagaaggccgaggugggagaauccguugaaccugggaggcgg

SEQ ID NO: 716013 - RNA, 64 nt, hsa
aagcagguucugcuugcaaagaggccucaguccagugggagaaacagaccugggcgcaaacaac

SEQ ID NO: 716014 - RNA, 64 nt, hsa
uuuccggggaaugugguaccccugacuguaaguggugggagagggagggggguuaauggaacug

SEQ ID NO: 716015 - RNA, 64 nt, hsa
acugcacaccuuccccauaaaauuuggagguggggugggagaaagagcuaaaaucaggcucagu

SEQ ID NO: 716016 - RNA, 64 nt, hsa
auggggugggggccagggccccccagggccuaucgugggagagccugggcaggaucccaucaga

SEQ ID NO: 716017 - RNA, 64 nt, hsa
auucugcacucugggauccacacccuuggacagggugggagaggggacacauggguguccaggg

SEQ ID NO: 716018 - RNA, 64 nt, hsa
ugggagaaccccaauucuagcacuccaggaaacugugggagaguguggggcaggcuccguccuc

SEQ ID NO: 716019 - RNA, 64 nt, hsa
agaggaggaacuccuggugccuuucugagccugcgugggagaaccccaauucuagcacuccagg

SEQ ID NO: 716020 - RNA, 64 nt, hsa
acacgcagcagagguuucccuugaagugcaagaggugggagaucaggcuguuccuuugcugcca

SEQ ID NO: 716021 - RNA, 64 nt, hsa
aaaaugcuuuguccauggggaagugcacagauaugugggagaaccuuacaaggcucuaaaauga

SEQ ID NO: 716022 - RNA, 64 nt, hsa
augugggagaaauaccugauucucccaaucugcagugggagagcuuugcugaauuccaucccaa

SEQ ID NO: 716023 - RNA, 64 nt, hsa
ccuauaggguccuccuucccuggcagccccccaugugggagaaauaccugauucucccaaucug

SEQ ID NO: 716024 - RNA, 64 nt, hsa
ugugaaaagagccaaguguuacauugagcuuggggugggagauggggaacaggcagugaggaag

SEQ ID NO: 716025 - RNA, 64 nt, hsa
ugagggugagggaacagccuggaugugagagccggugggagagaagggagcgcagccuucccag

SEQ ID NO: 716026 - RNA, 64 nt, hsa
cugcucugcacacauggacagggaccugggaaaggugggagagaugcugagcccagcgaauccu

SEQ ID NO: 716027 - RNA, 64 nt, hsa
aaagcucucugucaauuacaaggcuucuccuggcgugggagacgucuacagggaagacaccagc

SEQ ID NO: 716028 - RNA, 64 nt, hsa
uuaagggacuggagagaggugaagaauuuugcaggugggagauuuggauuugaauguggacuug

SEQ ID NO: 716029 - RNA, 64 nt, hsa
ccccuuuuucccaccgauucgguggcuggugaaggugggagaugugaacuccaauuaagggacu

SEQ ID NO: 716030 - RNA, 64 nt, hsa
ucuagagacugggguuucuucauagguuugaacagugggagauaccagaggugggaggagaaaa

SEQ ID NO: 716031 - RNA, 64 nt, hsa
agugucauacuuucugacacuuuugaggaugcaugugggagagaaacccuauugaggcagugac

SEQ ID NO: 716032 - RNA, 64 nt, hsa
ggacauccuuuccagcucaaacguggguagggaugugggagaauaagaaugugggagaaccaag

SEQ ID NO: 716033 - RNA, 64 nt, hsa
ucaaacguggguagggaugugggagaauaagaaugugggagaaccaagagaaaaaguggggcug

SEQ ID NO: 716034 - RNA, 64 nt, hsa
cgagggauagacagucuccaagaaaagugaaguggugggagagaauugcuuuuuucuuuuuuuu

SEQ ID NO: 716035 - RNA, 64 nt, hsa
ucauccggaugcuucggaccccacgccucugcaagugggagagacccgagcauccuccccaccc

SEQ ID NO: 716036 - RNA, 64 nt, hsa
ucaaacagaagcuuuucuuuggggaaggugauuugugggagacuaguguauuuuaaauuagcau

SEQ ID NO: 716037 - RNA, 64 nt, hsa
ugauaauacaguaaaagcuuucuuacccagcauagugggagaguggagauuaauuaaaauuguu

SEQ ID NO: 716038 - RNA, 64 nt, hsa
ugggcagaggggagaggaagcacaagaagugggagugggagaggaagccacgugcuggagagua

SEQ ID NO: 716039 - RNA, 64 nt, hsa
gugggucagugugccacccucugcagggcagccugugggagaagggacagcggguaaaaagaga

SEQ ID NO: 716040 - RNA, 64 nt, hsa
gagaccaaaucuuuguccgggaagcaagaagugggugggagaauguauccuguuuuugucaguu

SEQ ID NO: 716041 - RNA, 64 nt, hsa
ccugcaacuugacagagccugaguuugccucuuagugggagaaugagagagagcuguaguguca

SEQ ID NO: 716042 - RNA, 64 nt, hsa
aaucccacuccugagggagggggaagaagagagggugggagauucuccuccaguccugucucau

SEQ ID NO: 716043 - RNA, 64 nt, hsa
cgugugcagggcacacuggcagaggguaucugaagugggagaagaagcagguagaccaccuguc

SEQ ID NO: 716044 - RNA, 64 nt, hsa
gaccuucacucagcuguggauuugggggcacuuugugggagacuuggcuuuuuuuuuucuucug

SEQ ID NO: 716045 - RNA, 64 nt, hsa
cgcuucagaaccucaaaugaaagacugucuccucgugggagagcaccuggggccaucagaaaug

SEQ ID NO: 716046 - RNA, 64 nt, hsa
aagaggguccaggcuggaaaccugaacuuucugggugggagaaccagguggugccugccgaggu

SEQ ID NO: 716047 - RNA, 64 nt, hsa
agagacuagcuucagcuuuugcuauuuuuuuuaagugggagaagggugggcaguuaucacuggg

SEQ ID NO: 716048 - RNA, 64 nt, hsa
guguguauguuuagagcaacagagaaaaaaagaugugggagaggacauauaacuacuuaucucu

SEQ ID NO: 716049 - RNA, 64 nt, hsa
aauuuuaauccccaugugucagaggagggccuuggugggagaugacuggaucacgagggcagau

SEQ ID NO: 716050 - RNA, 64 nt, hsa
aguguugaaucacaguuacaacccacuggggcuggugggagaugcguuguaugggacuggaagc

SEQ ID NO: 716051 - RNA, 64 nt, hsa
gcauaagugaaucaugggcauuucccugagagcagugggagaggcccucugaguuggaaguuga

SEQ ID NO: 716052 - RNA, 64 nt, hsa
acgugggguggggcggugugacaggguagaggaggugggagaugagaucuuccgcacaggaaca

SEQ ID NO: 716053 - RNA, 64 nt, hsa
caggguguggacggggcagcgggcaugggucugugugggagacgugggguggggcggugugaca

SEQ ID NO: 716054 - RNA, 51 nt, hsa; identical to SEQ ID NO: 64820

SEQ ID NO: 716055 - RNA, 64 nt, hsa; identical to SEQ ID NO: 64821

SEQ ID NO: 716056 - RNA, 64 nt, hsa; identical to SEQ ID NO: 64822

SEQ ID NO: 716057 - RNA, 64 nt, hsa; identical to SEQ ID NO: 64823

SEQ ID NO: 716058 - RNA, 62 nt, hsa
gacuugaagcagaguucaccagugagcucaggugucucaaagaaggguggaaguucuaaugu

SEQ ID NO: 716059 - RNA, 62 nt, hsa
uauuuugcuucaaauaaacuuauuugaaaaguugucucaagucaaauggauucaucaccugu

SEQ ID NO: 716060 - RNA, 62 nt, hsa
cuagaauuccuuuuauaagauuuaauuguaauugucucaaagcaucaaauaauacaucuuua

SEQ ID NO: 716061 - RNA, 62 nt, hsa
cgguuuuuauccauccugucacccugagcaucugucucaaccugcugaggcacagacuucca

SEQ ID NO: 716062 - RNA, 62 nt, hsa
uguuucuccagaauggugccuguuucucucugugucucaaugccugggacuggagguugaua

SEQ ID NO: 716063 - RNA, 62 nt, hsa
augguuuuucaagucuauuuuuuuucuauguaugucucaauucucuuucaaaauuuuacaga

SEQ ID NO: 716064 - RNA, 62 nt, hsa
agauaggugacugaccacaaagaagaaaauucugucucaaaaauuaaagaauuuuguuuguu

SEQ ID NO: 716065 - RNA, 62 nt, hsa
augggaaucagaagaauaguauaccagggauuugucucaaaaaaguuaauuaauuuauagau

SEQ ID NO: 716066 - RNA, 62 nt, hsa
ugcacuccagccuggacaacagagcaagacucugucucaaaaaaaaaauaaaaaauaaaaaa

SEQ ID NO: 716067 - RNA, 62 nt, hsa
acugcacuccagcuugagcaacacagugauacugucucaauaaauaaauaaauagaagaaau

SEQ ID NO: 716068 - RNA, 62 nt, hsa
ugcccuccagccugggugacagagugagacccugucucaaaagcaaaacaaacagcaauaac

SEQ ID NO: 716069 - RNA, 62 nt, hsa
ugcacuccagccugggugacagagccagacucugucucaaaaaaaaaaaaaaagaaaagaaa

SEQ ID NO: 716070 - RNA, 62 nt, hsa
aaacaugcaaagaagaggaagucacagaaacaugucucaauucccaugugcugugacuguag

SEQ ID NO: 716071 - RNA, 62 nt, hsa
ugcaguccagccuaggcaacagagugagacuuugucucaaaaaaagagaaauuuuccuuaau

SEQ ID NO: 716072 - RNA, 62 nt, hsa
uauucagacauaguagauaguuucucuaaugcugucucaauugcuggccuuuggcuaccugu

SEQ ID NO: 716073 - RNA, 62 nt, hsa
agucauauaaacaaguauugauuuauauauuuugucucaaaaguggaaaaauuauauugucu

SEQ ID NO: 716074 - RNA, 62 nt, hsa
uacaaauguuaauuucugucuuuauaaaaauaugucucaaaagaacaaugugugacaaauug

SEQ ID NO: 716075 - RNA, 62 nt, hsa
cuacacuccagccugaugacagaccgagacacugucucaaaaaaauaaaaaaauucagauug

SEQ ID NO: 716076 - RNA, 62 nt, hsa
ugcauuccagccuggaugacagagcaaaacccugucucaaaaaaaugcagacuggccaggca

SEQ ID NO: 716077 - RNA, 62 nt, hsa
ugcacucuagucugggugacagagcgagacucugucucaaaaaaaaaaaaauaaagccgggc

SEQ ID NO: 716078 - RNA, 62 nt, hsa
gugugcuccagccugagcaacaagagcgaaacugucucaaaaaaaagaagaaaauaaauaaa

SEQ ID NO: 716079 - RNA, 62 nt, hsa
ugcacuccagccggggugacagagcgaaccucugucucaaaaaaaaaaaaagaaaaaagaaa

SEQ ID NO: 716080 - RNA, 62 nt, hsa
uguacuccagcuugggcaacagaguaagacucugucucaaaaaaaaaaaaacaaaaacaaac

SEQ ID NO: 716081 - RNA, 62 nt, hsa
gcauuccagccugggcaacaaaagcgaaacucugucucaaaaaagaaaaaaaagaaaaaaaa

SEQ ID NO: 716082 - RNA, 62 nt, hsa
gcacuccagccugggcaacaagagcgaaacucugucucaaaaaaaaaaaaaagaggugggug

SEQ ID NO: 716083 - RNA, 62 nt, hsa
acacucaagcuugggcaacgagagcaaaacucugucucaaaaaaaaaauuagccagaugugg

SEQ ID NO: 716084 - RNA, 62 nt, hsa
uguacuccagccuaggugacagagugagacccugucucaaaaauaaauaauaaauaaauaaa

SEQ ID NO: 716085 - RNA, 62 nt, hsa
auuccuauggaaagucgcggugaaugcgugcaugucucaauguccacaaaggauucuggcua

SEQ ID NO: 716086 - RNA, 62 nt, hsa
ugucuugucaucacaggcgccuauacagcuucugucucaauagggucagauauuuugcacug

SEQ ID NO: 716087 - RNA, 62 nt, hsa
cccccccagauaccaugucaggauauuuuuagugucucaaggccugaaucaccugaaucuga

SEQ ID NO: 716088 - RNA, 62 nt, hsa
aacucaagcccaacggcggugcugaccaaaaaugucucaaagucaacagcccaauaagaaug

SEQ ID NO: 716089 - RNA, 62 nt, hsa
guugucccuccccaucauccauuccugugaggugucucaaaccaaaguuaacagggagagga

SEQ ID NO: 716090 - RNA, 62 nt, hsa
auacuguucuacugcuucccucaguaucugaaugucucaauuuaaaacuugaagcucuuuag

SEQ ID NO: 716091 - RNA, 64 nt, hsa; identical to SEQ ID NO: 60102

SEQ ID NO: 716092 - RNA, 64 nt, hsa; identical to SEQ ID NO: 60103

SEQ ID NO: 716093 - RNA, 64 nt, hsa; identical to SEQ ID NO: 60104

SEQ ID NO: 716094 - RNA, 64 nt, hsa; identical to SEQ ID NO: 60105

SEQ ID NO: 716095 - RNA, 64 nt, hsa; identical to SEQ ID NO: 60106

SEQ ID NO: 716096 - RNA, 64 nt, hsa; identical to SEQ ID NO: 60107

SEQ ID NO: 716097 - RNA, 64 nt, hsa; identical to SEQ ID NO: 60108

SEQ ID NO: 716098 - RNA, 64 nt, hsa; identical to SEQ ID NO: 60109

SEQ ID NO: 716099 - RNA, 64 nt, hsa; identical to SEQ ID NO: 60110

SEQ ID NO: 716100 - RNA, 64 nt, hsa; identical to SEQ ID NO: 60111

SEQ ID NO: 716101 - RNA, 64 nt, hsa; identical to SEQ ID NO: 60112

SEQ ID NO: 716102 - RNA, 64 nt, hsa; identical to SEQ ID NO: 60113

SEQ ID NO: 716103 - RNA, 64 nt, hsa; identical to SEQ ID NO: 60114

SEQ ID NO: 716104 - RNA, 64 nt, hsa; identical to SEQ ID NO: 60115

SEQ ID NO: 716105 - RNA, 64 nt, hsa; identical to SEQ ID NO: 60116

SEQ ID NO: 716106 - RNA, 64 nt, hsa; identical to SEQ ID NO: 60117

SEQ ID NO: 716107 - RNA, 64 nt, hsa; identical to SEQ ID NO: 60118

SEQ ID NO: 716108 - RNA, 64 nt, hsa; identical to SEQ ID NO: 60119

SEQ ID NO: 716109 - RNA, 64 nt, hsa; identical to SEQ ID NO: 60120

SEQ ID NO: 716110 - RNA, 64 nt, hsa; identical to SEQ ID NO: 60121

SEQ ID NO: 716111 - RNA, 64 nt, hsa; identical to SEQ ID NO: 60122

SEQ ID NO: 716112 - RNA, 64 nt, hsa; identical to SEQ ID NO: 60123

SEQ ID NO: 716113 - RNA, 64 nt, hsa; identical to SEQ ID NO: 60124

SEQ ID NO: 716114 - RNA, 64 nt, hsa; identical to SEQ ID NO: 60125

SEQ ID NO: 716115 - RNA, 64 nt, hsa; identical to SEQ ID NO: 60126

SEQ ID NO: 716116 - RNA, 64 nt, hsa; identical to SEQ ID NO: 60127

SEQ ID NO: 716117 - RNA, 64 nt, hsa; identical to SEQ ID NO: 60128

SEQ ID NO: 716118 - RNA, 64 nt, hsa; identical to SEQ ID NO: 60129

SEQ ID NO: 716119 - RNA, 64 nt, hsa; identical to SEQ ID NO: 60130

SEQ ID NO: 716120 - RNA, 64 nt, hsa; identical to SEQ ID NO: 60131

SEQ ID NO: 716121 - RNA, 64 nt, hsa; identical to SEQ ID NO: 60132

SEQ ID NO: 716122 - RNA, 64 nt, hsa; identical to SEQ ID NO: 60133

SEQ ID NO: 716123 - RNA, 64 nt, hsa; identical to SEQ ID NO: 60134

SEQ ID NO: 716124 - RNA, 64 nt, hsa; identical to SEQ ID NO: 60135

SEQ ID NO: 716125 - RNA, 64 nt, hsa; identical to SEQ ID NO: 60136

SEQ ID NO: 716126 - RNA, 64 nt, hsa; identical to SEQ ID NO: 60137

SEQ ID NO: 716127 - RNA, 64 nt, hsa; identical to SEQ ID NO: 60138

SEQ ID NO: 716128 - RNA, 64 nt, hsa; identical to SEQ ID NO: 60139

SEQ ID NO: 716129 - RNA, 64 nt, hsa; identical to SEQ ID NO: 60140

SEQ ID NO: 716130 - RNA, 64 nt, hsa; identical to SEQ ID NO: 60141

SEQ ID NO: 716131 - RNA, 64 nt, hsa; identical to SEQ ID NO: 60142

SEQ ID NO: 716132 - RNA, 64 nt, hsa; identical to SEQ ID NO: 60143

SEQ ID NO: 716133 - RNA, 64 nt, hsa; identical to SEQ ID NO: 60144

SEQ ID NO: 716134 - RNA, 64 nt, hsa; identical to SEQ ID NO: 60145

SEQ ID NO: 716135 - RNA, 64 nt, hsa; identical to SEQ ID NO: 60146

SEQ ID NO: 716136 - RNA, 64 nt, hsa; identical to SEQ ID NO: 60147

SEQ ID NO: 716137 - RNA, 64 nt, hsa; identical to SEQ ID NO: 60148

SEQ ID NO: 716138 - RNA, 64 nt, hsa; identical to SEQ ID NO: 60149

SEQ ID NO: 716139 - RNA, 64 nt, hsa; identical to SEQ ID NO: 60150

SEQ ID NO: 716140 - RNA, 64 nt, hsa; identical to SEQ ID NO: 60151

SEQ ID NO: 716141 - RNA, 64 nt, hsa; identical to SEQ ID NO: 60152

SEQ ID NO: 716142 - RNA, 64 nt, hsa; identical to SEQ ID NO: 60153

SEQ ID NO: 716143 - RNA, 64 nt, hsa; identical to SEQ ID NO: 60154

SEQ ID NO: 716144 - RNA, 64 nt, hsa; identical to SEQ ID NO: 60155

SEQ ID NO: 716145 - RNA, 64 nt, hsa; identical to SEQ ID NO: 60156

SEQ ID NO: 716146 - RNA, 64 nt, hsa; identical to SEQ ID NO: 60157

SEQ ID NO: 716147 - RNA, 64 nt, hsa; identical to SEQ ID NO: 60158

SEQ ID NO: 716148 - RNA, 64 nt, hsa; identical to SEQ ID NO: 60159

SEQ ID NO: 716149 - RNA, 64 nt, hsa; identical to SEQ ID NO: 60160

SEQ ID NO: 716150 - RNA, 64 nt, hsa; identical to SEQ ID NO: 60161

SEQ ID NO: 716151 - RNA, 64 nt, hsa; identical to SEQ ID NO: 60162

SEQ ID NO: 716152 - RNA, 64 nt, hsa; identical to SEQ ID NO: 60163

SEQ ID NO: 716153 - RNA, 64 nt, hsa; identical to SEQ ID NO: 60164

SEQ ID NO: 716154 - RNA, 64 nt, hsa; identical to SEQ ID NO: 60165

SEQ ID NO: 716155 - RNA, 64 nt, hsa; identical to SEQ ID NO: 60166

SEQ ID NO: 716156 - RNA, 64 nt, hsa; identical to SEQ ID NO: 60167

SEQ ID NO: 716157 - RNA, 64 nt, hsa; identical to SEQ ID NO: 60168

SEQ ID NO: 716158 - RNA, 64 nt, hsa; identical to SEQ ID NO: 60169

SEQ ID NO: 716159 - RNA, 64 nt, hsa; identical to SEQ ID NO: 60170

SEQ ID NO: 716160 - RNA, 64 nt, hsa; identical to SEQ ID NO: 60171

SEQ ID NO: 716161 - RNA, 64 nt, hsa; identical to SEQ ID NO: 237342

SEQ ID NO: 716162 - RNA, 64 nt, hsa; identical to SEQ ID NO: 237343

SEQ ID NO: 716163 - RNA, 64 nt, hsa; identical to SEQ ID NO: 237344

SEQ ID NO: 716164 - RNA, 64 nt, hsa; identical to SEQ ID NO: 237345

SEQ ID NO: 716165 - RNA, 64 nt, hsa; identical to SEQ ID NO: 237346

SEQ ID NO: 716166 - RNA, 64 nt, hsa; identical to SEQ ID NO: 237347

SEQ ID NO: 716167 - RNA, 64 nt, hsa; identical to SEQ ID NO: 237348

SEQ ID NO: 716168 - RNA, 64 nt, hsa; identical to SEQ ID NO: 237349

SEQ ID NO: 716169 - RNA, 64 nt, hsa; identical to SEQ ID NO: 237350

SEQ ID NO: 716170 - RNA, 64 nt, hsa; identical to SEQ ID NO: 237351

SEQ ID NO: 716171 - RNA, 64 nt, hsa; identical to SEQ ID NO: 237352

SEQ ID NO: 716172 - RNA, 64 nt, hsa; identical to SEQ ID NO: 237353

SEQ ID NO: 716173 - RNA, 64 nt, hsa
uugcucugagcuuguuuccucaucugucaggagugccauuaaaggagaaaaaucacguagaaag

SEQ ID NO: 716174 - RNA, 64 nt, hsa
ucaggcaggaggacaucuuggcagugcuggcuuggccauuaaauggaaaccugaaggccauccu

SEQ ID NO: 716175 - RNA, 64 nt, hsa
accaucugaagaaacuucccaaguguaagacucugccauuaaaacauuaccgagaggggacuca

SEQ ID NO: 716176 - RNA, 64 nt, hsa
uuaucucaauuuaguuuguuauuuauccuagugggccauuaaaaacuaccacauguguuucugu

SEQ ID NO: 716177 - RNA, 64 nt, hsa
guguuguguuucauguucaagcuuaaucaaggcagccauuaauauacgaacugagcaugcuggg

SEQ ID NO: 716178 - RNA, 64 nt, hsa
aucuuugcucuuuggacugaauucuuaccauacugccauuaaaauaaauuugccaacuaguaau

SEQ ID NO: 716179 - RNA, 64 nt, hsa; identical to SEQ ID NO: 109572

SEQ ID NO: 716180 - RNA, 64 nt, hsa; identical to SEQ ID NO: 109573

SEQ ID NO: 716181 - RNA, 64 nt, hsa; identical to SEQ ID NO: 109574

SEQ ID NO: 716182 - RNA, 64 nt, hsa; identical to SEQ ID NO: 109575

SEQ ID NO: 716183 - RNA, 64 nt, hsa; identical to SEQ ID NO: 109576

SEQ ID NO: 716184 - RNA, 64 nt, hsa; identical to SEQ ID NO: 109577

SEQ ID NO: 716185 - RNA, 64 nt, hsa; identical to SEQ ID NO: 109578

SEQ ID NO: 716186 - RNA, 64 nt, hsa; identical to SEQ ID NO: 109579

SEQ ID NO: 716187 - RNA, 64 nt, hsa; identical to SEQ ID NO: 109580

SEQ ID NO: 716188 - RNA, 64 nt, hsa; identical to SEQ ID NO: 109581

SEQ ID NO: 716189 - RNA, 64 nt, hsa; identical to SEQ ID NO: 109582

SEQ ID NO: 716190 - RNA, 64 nt, hsa; identical to SEQ ID NO: 109583

SEQ ID NO: 716191 - RNA, 64 nt, hsa; identical to SEQ ID NO: 109584

SEQ ID NO: 716192 - RNA, 64 nt, hsa; identical to SEQ ID NO: 109585

SEQ ID NO: 716193 - RNA, 64 nt, hsa; identical to SEQ ID NO: 55558

SEQ ID NO: 716194 - RNA, 64 nt, hsa; identical to SEQ ID NO: 55559

SEQ ID NO: 716195 - RNA, 64 nt, hsa; identical to SEQ ID NO: 55560

SEQ ID NO: 716196 - RNA, 64 nt, hsa; identical to SEQ ID NO: 55561

SEQ ID NO: 716197 - RNA, 64 nt, hsa; identical to SEQ ID NO: 55562

SEQ ID NO: 716198 - RNA, 64 nt, hsa; identical to SEQ ID NO: 55563

SEQ ID NO: 716199 - RNA, 64 nt, hsa; identical to SEQ ID NO: 55564

SEQ ID NO: 716200 - RNA, 64 nt, hsa; identical to SEQ ID NO: 55565

SEQ ID NO: 716201 - RNA, 64 nt, hsa; identical to SEQ ID NO: 55566

SEQ ID NO: 716202 - RNA, 64 nt, hsa; identical to SEQ ID NO: 55567

SEQ ID NO: 716203 - RNA, 64 nt, hsa; identical to SEQ ID NO: 55568

SEQ ID NO: 716204 - RNA, 64 nt, hsa; identical to SEQ ID NO: 55569

SEQ ID NO: 716205 - RNA, 64 nt, hsa; identical to SEQ ID NO: 55570

SEQ ID NO: 716206 - RNA, 64 nt, hsa; identical to SEQ ID NO: 55571

SEQ ID NO: 716207 - RNA, 64 nt, hsa; identical to SEQ ID NO: 55572

SEQ ID NO: 716208 - RNA, 64 nt, hsa; identical to SEQ ID NO: 55573

SEQ ID NO: 716209 - RNA, 64 nt, hsa; identical to SEQ ID NO: 55574

SEQ ID NO: 716210 - RNA, 64 nt, hsa; identical to SEQ ID NO: 55575

SEQ ID NO: 716211 - RNA, 64 nt, hsa; identical to SEQ ID NO: 55576

SEQ ID NO: 716212 - RNA, 64 nt, hsa; identical to SEQ ID NO: 55577

SEQ ID NO: 716213 - RNA, 64 nt, hsa; identical to SEQ ID NO: 55578

SEQ ID NO: 716214 - RNA, 64 nt, hsa; identical to SEQ ID NO: 55579

SEQ ID NO: 716215 - RNA, 64 nt, hsa; identical to SEQ ID NO: 55580

SEQ ID NO: 716216 - RNA, 64 nt, hsa; identical to SEQ ID NO: 55581

SEQ ID NO: 716217 - RNA, 64 nt, hsa; identical to SEQ ID NO: 55582

SEQ ID NO: 716218 - RNA, 64 nt, hsa; identical to SEQ ID NO: 55583

SEQ ID NO: 716219 - RNA, 64 nt, hsa; identical to SEQ ID NO: 55584

SEQ ID NO: 716220 - RNA, 64 nt, hsa; identical to SEQ ID NO: 55585

SEQ ID NO: 716221 - RNA, 64 nt, hsa; identical to SEQ ID NO: 55586

SEQ ID NO: 716222 - RNA, 64 nt, hsa; identical to SEQ ID NO: 55587

SEQ ID NO: 716223 - RNA, 64 nt, hsa; identical to SEQ ID NO: 55588

SEQ ID NO: 716224 - RNA, 64 nt, hsa; identical to SEQ ID NO: 55589

SEQ ID NO: 716225 - RNA, 64 nt, hsa; identical to SEQ ID NO: 55590

SEQ ID NO: 716226 - RNA, 64 nt, hsa; identical to SEQ ID NO: 55591

SEQ ID NO: 716227 - RNA, 64 nt, hsa; identical to SEQ ID NO: 55592

SEQ ID NO: 716228 - RNA, 64 nt, hsa; identical to SEQ ID NO: 55593

SEQ ID NO: 716229 - RNA, 64 nt, hsa; identical to SEQ ID NO: 55594

SEQ ID NO: 716230 - RNA, 64 nt, hsa; identical to SEQ ID NO: 55595

SEQ ID NO: 716231 - RNA, 64 nt, hsa; identical to SEQ ID NO: 55596

SEQ ID NO: 716232 - RNA, 64 nt, hsa; identical to SEQ ID NO: 55597

SEQ ID NO: 716233 - RNA, 64 nt, hsa; identical to SEQ ID NO: 55598

SEQ ID NO: 716234 - RNA, 64 nt, hsa; identical to SEQ ID NO: 55599

SEQ ID NO: 716235 - RNA, 64 nt, hsa; identical to SEQ ID NO: 55600

SEQ ID NO: 716236 - RNA, 64 nt, hsa; identical to SEQ ID NO: 55601

SEQ ID NO: 716237 - RNA, 64 nt, hsa; identical to SEQ ID NO: 55602

SEQ ID NO: 716238 - RNA, 64 nt, hsa; identical to SEQ ID NO: 55603

SEQ ID NO: 716239 - RNA, 64 nt, hsa; identical to SEQ ID NO: 55604

SEQ ID NO: 716240 - RNA, 64 nt, hsa; identical to SEQ ID NO: 55605

SEQ ID NO: 716241 - RNA, 64 nt, hsa; identical to SEQ ID NO: 55606

SEQ ID NO: 716242 - RNA, 64 nt, hsa; identical to SEQ ID NO: 55607

SEQ ID NO: 716243 - RNA, 64 nt, hsa; identical to SEQ ID NO: 55608

SEQ ID NO: 716244 - RNA, 64 nt, hsa; identical to SEQ ID NO: 55609

SEQ ID NO: 716245 - RNA, 64 nt, hsa; identical to SEQ ID NO: 55610

SEQ ID NO: 716246 - RNA, 64 nt, hsa; identical to SEQ ID NO: 55611

SEQ ID NO: 716247 - RNA, 64 nt, hsa; identical to SEQ ID NO: 55612

SEQ ID NO: 716248 - RNA, 64 nt, hsa; identical to SEQ ID NO: 55613

SEQ ID NO: 716249 - RNA, 64 nt, hsa; identical to SEQ ID NO: 55614

SEQ ID NO: 716250 - RNA, 64 nt, hsa; identical to SEQ ID NO: 55615

SEQ ID NO: 716251 - RNA, 64 nt, hsa; identical to SEQ ID NO: 55616

SEQ ID NO: 716252 - RNA, 64 nt, hsa; identical to SEQ ID NO: 55617

SEQ ID NO: 716253 - RNA, 64 nt, hsa; identical to SEQ ID NO: 55618

SEQ ID NO: 716254 - RNA, 64 nt, hsa; identical to SEQ ID NO: 55619

SEQ ID NO: 716255 - RNA, 64 nt, hsa; identical to SEQ ID NO: 55620

SEQ ID NO: 716256 - RNA, 64 nt, hsa; identical to SEQ ID NO: 55621

SEQ ID NO: 716257 - RNA, 64 nt, hsa; identical to SEQ ID NO: 55622

SEQ ID NO: 716258 - RNA, 64 nt, hsa; identical to SEQ ID NO: 55623

SEQ ID NO: 716259 - RNA, 64 nt, hsa; identical to SEQ ID NO: 55624

SEQ ID NO: 716260 - RNA, 64 nt, hsa; identical to SEQ ID NO: 55625

SEQ ID NO: 716261 - RNA, 64 nt, hsa; identical to SEQ ID NO: 55626

SEQ ID NO: 716262 - RNA, 64 nt, hsa; identical to SEQ ID NO: 55627

SEQ ID NO: 716263 - RNA, 64 nt, hsa; identical to SEQ ID NO: 55628

SEQ ID NO: 716264 - RNA, 64 nt, hsa; identical to SEQ ID NO: 55629

SEQ ID NO: 716265 - RNA, 64 nt, hsa; identical to SEQ ID NO: 55630

SEQ ID NO: 716266 - RNA, 64 nt, hsa; identical to SEQ ID NO: 55631

SEQ ID NO: 716267 - RNA, 64 nt, hsa; identical to SEQ ID NO: 55632

SEQ ID NO: 716268 - RNA, 64 nt, hsa; identical to SEQ ID NO: 55633

SEQ ID NO: 716269 - RNA, 64 nt, hsa; identical to SEQ ID NO: 55634

SEQ ID NO: 716270 - RNA, 64 nt, hsa; identical to SEQ ID NO: 55635

SEQ ID NO: 716271 - RNA, 64 nt, hsa; identical to SEQ ID NO: 55636

SEQ ID NO: 716272 - RNA, 64 nt, hsa; identical to SEQ ID NO: 55637

SEQ ID NO: 716273 - RNA, 64 nt, hsa; identical to SEQ ID NO: 55638

SEQ ID NO: 716274 - RNA, 64 nt, hsa; identical to SEQ ID NO: 55639

SEQ ID NO: 716275 - RNA, 64 nt, hsa; identical to SEQ ID NO: 55640

SEQ ID NO: 716276 - RNA, 64 nt, hsa; identical to SEQ ID NO: 55641

SEQ ID NO: 716277 - RNA, 64 nt, hsa; identical to SEQ ID NO: 224102

SEQ ID NO: 716278 - RNA, 64 nt, hsa; identical to SEQ ID NO: 224103

SEQ ID NO: 716279 - RNA, 64 nt, hsa; identical to SEQ ID NO: 224104

SEQ ID NO: 716280 - RNA, 64 nt, hsa; identical to SEQ ID NO: 224105

SEQ ID NO: 716281 - RNA, 63 nt, hsa; identical to SEQ ID NO: 224106

SEQ ID NO: 716282 - RNA, 64 nt, hsa; identical to SEQ ID NO: 224107

SEQ ID NO: 716283 - RNA, 64 nt, hsa
uucuggaguagaagcugcuggaaggcaggccugagccauucaccacggacaggaagagcagcuc

SEQ ID NO: 716284 - RNA, 64 nt, hsa
gugccaggggccaugggcccaggacccagucuuggccauucaguugagugaggcugaaggcugg

SEQ ID NO: 716285 - RNA, 64 nt, hsa
aggucuucccuuaaaacuuugggcuguuggcugagccauucaaagagcaucaucuguucuucaa

SEQ ID NO: 716286 - RNA, 64 nt, hsa
cucccauaggagccuacacuaaguccaagugugagccauucacagacuagaacacaaggaggga

SEQ ID NO: 716287 - RNA, 64 nt, hsa; identical to SEQ ID NO: 72674

SEQ ID NO: 716288 - RNA, 64 nt, hsa; identical to SEQ ID NO: 72675

SEQ ID NO: 716289 - RNA, 64 nt, hsa; identical to SEQ ID NO: 72676

SEQ ID NO: 716290 - RNA, 64 nt, hsa; identical to SEQ ID NO: 72677

SEQ ID NO: 716291 - RNA, 64 nt, hsa; identical to SEQ ID NO: 72678

SEQ ID NO: 716292 - RNA, 64 nt, hsa; identical to SEQ ID NO: 72679

SEQ ID NO: 716293 - RNA, 64 nt, hsa; identical to SEQ ID NO: 72680

SEQ ID NO: 716294 - RNA, 64 nt, hsa; identical to SEQ ID NO: 72681

SEQ ID NO: 716295 - RNA, 64 nt, hsa; identical to SEQ ID NO: 72682

SEQ ID NO: 716296 - RNA, 64 nt, hsa; identical to SEQ ID NO: 72683

SEQ ID NO: 716297 - RNA, 64 nt, hsa; identical to SEQ ID NO: 72684

SEQ ID NO: 716298 - RNA, 64 nt, hsa; identical to SEQ ID NO: 72685

SEQ ID NO: 716299 - RNA, 64 nt, hsa; identical to SEQ ID NO: 72686

SEQ ID NO: 716300 - RNA, 64 nt, hsa; identical to SEQ ID NO: 72687

SEQ ID NO: 716301 - RNA, 64 nt, hsa; identical to SEQ ID NO: 72688

SEQ ID NO: 716302 - RNA, 64 nt, hsa; identical to SEQ ID NO: 72689

SEQ ID NO: 716303 - RNA, 64 nt, hsa; identical to SEQ ID NO: 72690

SEQ ID NO: 716304 - RNA, 64 nt, hsa; identical to SEQ ID NO: 72691

SEQ ID NO: 716305 - RNA, 64 nt, hsa; identical to SEQ ID NO: 72692

SEQ ID NO: 716306 - RNA, 64 nt, hsa; identical to SEQ ID NO: 72693

SEQ ID NO: 716307 - RNA, 64 nt, hsa; identical to SEQ ID NO: 72694

SEQ ID NO: 716308 - RNA, 64 nt, hsa; identical to SEQ ID NO: 72695

SEQ ID NO: 716309 - RNA, 64 nt, hsa; identical to SEQ ID NO: 72696

SEQ ID NO: 716310 - RNA, 64 nt, hsa; identical to SEQ ID NO: 72697

SEQ ID NO: 716311 - RNA, 64 nt, hsa; identical to SEQ ID NO: 72698

SEQ ID NO: 716312 - RNA, 64 nt, hsa; identical to SEQ ID NO: 72699

SEQ ID NO: 716313 - RNA, 64 nt, hsa; identical to SEQ ID NO: 72700

SEQ ID NO: 716314 - RNA, 64 nt, hsa; identical to SEQ ID NO: 72701

SEQ ID NO: 716315 - RNA, 64 nt, hsa; identical to SEQ ID NO: 72702

SEQ ID NO: 716316 - RNA, 64 nt, hsa; identical to SEQ ID NO: 72703

SEQ ID NO: 716317 - RNA, 64 nt, hsa; identical to SEQ ID NO: 72704

SEQ ID NO: 716318 - RNA, 64 nt, hsa; identical to SEQ ID NO: 72705

SEQ ID NO: 716319 - RNA, 64 nt, hsa; identical to SEQ ID NO: 72706

SEQ ID NO: 716320 - RNA, 64 nt, hsa; identical to SEQ ID NO: 72707

SEQ ID NO: 716321 - RNA, 64 nt, hsa; identical to SEQ ID NO: 72708

SEQ ID NO: 716322 - RNA, 64 nt, hsa; identical to SEQ ID NO: 72709

SEQ ID NO: 716323 - RNA, 64 nt, hsa; identical to SEQ ID NO: 72710

SEQ ID NO: 716324 - RNA, 64 nt, hsa; identical to SEQ ID NO: 72711

SEQ ID NO: 716325 - RNA, 64 nt, hsa; identical to SEQ ID NO: 72712

SEQ ID NO: 716326 - RNA, 64 nt, hsa; identical to SEQ ID NO: 72713

SEQ ID NO: 716327 - RNA, 64 nt, hsa; identical to SEQ ID NO: 72714

SEQ ID NO: 716328 - RNA, 64 nt, hsa; identical to SEQ ID NO: 72715

SEQ ID NO: 716329 - RNA, 64 nt, hsa; identical to SEQ ID NO: 72716

SEQ ID NO: 716330 - RNA, 64 nt, hsa; identical to SEQ ID NO: 72717

SEQ ID NO: 716331 - RNA, 64 nt, hsa; identical to SEQ ID NO: 72718

SEQ ID NO: 716332 - RNA, 64 nt, hsa; identical to SEQ ID NO: 72719

SEQ ID NO: 716333 - RNA, 64 nt, hsa; identical to SEQ ID NO: 233847

SEQ ID NO: 716334 - RNA, 64 nt, hsa; identical to SEQ ID NO: 233848

SEQ ID NO: 716335 - RNA, 64 nt, hsa; identical to SEQ ID NO: 233849

SEQ ID NO: 716336 - RNA, 64 nt, hsa; identical to SEQ ID NO: 233850

SEQ ID NO: 716337 - RNA, 64 nt, hsa; identical to SEQ ID NO: 233851

SEQ ID NO: 716338 - RNA, 64 nt, hsa; identical to SEQ ID NO: 233852

SEQ ID NO: 716339 - RNA, 64 nt, hsa; identical to SEQ ID NO: 233853

SEQ ID NO: 716340 - RNA, 64 nt, hsa; identical to SEQ ID NO: 233854

SEQ ID NO: 716341 - RNA, 64 nt, hsa; identical to SEQ ID NO: 233855

SEQ ID NO: 716342 - RNA, 64 nt, hsa; identical to SEQ ID NO: 233856

SEQ ID NO: 716343 - RNA, 64 nt, hsa; identical to SEQ ID NO: 233857

SEQ ID NO: 716344 - RNA, 64 nt, hsa; identical to SEQ ID NO: 233858

SEQ ID NO: 716345 - RNA, 64 nt, hsa; identical to SEQ ID NO: 233859

SEQ ID NO: 716346 - RNA, 64 nt, hsa; identical to SEQ ID NO: 233860

SEQ ID NO: 716347 - RNA, 64 nt, hsa; identical to SEQ ID NO: 233861

SEQ ID NO: 716348 - RNA, 64 nt, hsa; identical to SEQ ID NO: 233862

SEQ ID NO: 716349 - RNA, 64 nt, hsa; identical to SEQ ID NO: 233863

SEQ ID NO: 716350 - RNA, 64 nt, hsa; identical to SEQ ID NO: 233864

SEQ ID NO: 716351 - RNA, 64 nt, hsa; identical to SEQ ID NO: 233865

SEQ ID NO: 716352 - RNA, 64 nt, hsa; identical to SEQ ID NO: 233866

SEQ ID NO: 716353 - RNA, 64 nt, hsa; identical to SEQ ID NO: 233867

SEQ ID NO: 716354 - RNA, 64 nt, hsa; identical to SEQ ID NO: 233868

SEQ ID NO: 716355 - RNA, 64 nt, hsa; identical to SEQ ID NO: 233869

SEQ ID NO: 716356 - RNA, 64 nt, hsa; identical to SEQ ID NO: 233870

SEQ ID NO: 716357 - RNA, 64 nt, hsa; identical to SEQ ID NO: 233871

SEQ ID NO: 716358 - RNA, 64 nt, hsa; identical to SEQ ID NO: 233872

SEQ ID NO: 716359 - RNA, 64 nt, hsa; identical to SEQ ID NO: 233873

SEQ ID NO: 716360 - RNA, 64 nt, hsa; identical to SEQ ID NO: 233874

SEQ ID NO: 716361 - RNA, 64 nt, hsa; identical to SEQ ID NO: 233875

SEQ ID NO: 716362 - RNA, 64 nt, hsa; identical to SEQ ID NO: 233876

SEQ ID NO: 716363 - RNA, 64 nt, hsa; identical to SEQ ID NO: 233877

SEQ ID NO: 716364 - RNA, 64 nt, hsa; identical to SEQ ID NO: 233878

SEQ ID NO: 716365 - RNA, 64 nt, hsa; identical to SEQ ID NO: 233879

SEQ ID NO: 716366 - RNA, 64 nt, hsa; identical to SEQ ID NO: 233880

SEQ ID NO: 716367 - RNA, 64 nt, hsa; identical to SEQ ID NO: 233881

SEQ ID NO: 716368 - RNA, 64 nt, hsa; identical to SEQ ID NO: 233882

SEQ ID NO: 716369 - RNA, 64 nt, hsa; identical to SEQ ID NO: 233883

SEQ ID NO: 716370 - RNA, 64 nt, hsa; identical to SEQ ID NO: 233884

SEQ ID NO: 716371 - RNA, 64 nt, hsa; identical to SEQ ID NO: 233885

SEQ ID NO: 716372 - RNA, 64 nt, hsa; identical to SEQ ID NO: 233886

SEQ ID NO: 716373 - RNA, 64 nt, hsa; identical to SEQ ID NO: 233887

SEQ ID NO: 716374 - RNA, 64 nt, hsa; identical to SEQ ID NO: 233888

SEQ ID NO: 716375 - RNA, 64 nt, hsa; identical to SEQ ID NO: 233889

SEQ ID NO: 716376 - RNA, 64 nt, hsa; identical to SEQ ID NO: 233890

SEQ ID NO: 716377 - RNA, 64 nt, hsa; identical to SEQ ID NO: 233891

SEQ ID NO: 716378 - RNA, 64 nt, hsa; identical to SEQ ID NO: 233892

SEQ ID NO: 716379 - RNA, 64 nt, hsa; identical to SEQ ID NO: 233893

SEQ ID NO: 716380 - RNA, 64 nt, hsa; identical to SEQ ID NO: 233894

SEQ ID NO: 716381 - RNA, 64 nt, hsa; identical to SEQ ID NO: 233895

SEQ ID NO: 716382 - RNA, 64 nt, hsa; identical to SEQ ID NO: 233896

SEQ ID NO: 716383 - RNA, 64 nt, hsa; identical to SEQ ID NO: 233897

SEQ ID NO: 716384 - RNA, 64 nt, hsa; identical to SEQ ID NO: 233898

SEQ ID NO: 716385 - RNA, 64 nt, hsa; identical to SEQ ID NO: 233899

SEQ ID NO: 716386 - RNA, 64 nt, hsa; identical to SEQ ID NO: 233900

SEQ ID NO: 716387 - RNA, 64 nt, hsa; identical to SEQ ID NO: 233901

SEQ ID NO: 716388 - RNA, 64 nt, hsa; identical to SEQ ID NO: 233902

SEQ ID NO: 716389 - RNA, 64 nt, hsa; identical to SEQ ID NO: 233903

SEQ ID NO: 716390 - RNA, 64 nt, hsa; identical to SEQ ID NO: 233904

SEQ ID NO: 716391 - RNA, 64 nt, hsa; identical to SEQ ID NO: 233905

SEQ ID NO: 716392 - RNA, 64 nt, hsa; identical to SEQ ID NO: 233906

SEQ ID NO: 716393 - RNA, 64 nt, hsa; identical to SEQ ID NO: 233907

SEQ ID NO: 716394 - RNA, 64 nt, hsa; identical to SEQ ID NO: 233908

SEQ ID NO: 716395 - RNA, 64 nt, hsa; identical to SEQ ID NO: 233909

SEQ ID NO: 716396 - RNA, 64 nt, hsa; identical to SEQ ID NO: 233910

SEQ ID NO: 716397 - RNA, 64 nt, hsa; identical to SEQ ID NO: 233911

SEQ ID NO: 716398 - RNA, 64 nt, hsa; identical to SEQ ID NO: 233912

SEQ ID NO: 716399 - RNA, 64 nt, hsa; identical to SEQ ID NO: 233913

SEQ ID NO: 716400 - RNA, 64 nt, hsa; identical to SEQ ID NO: 233914

SEQ ID NO: 716401 - RNA, 64 nt, hsa; identical to SEQ ID NO: 233915

SEQ ID NO: 716402 - RNA, 64 nt, hsa; identical to SEQ ID NO: 233916

SEQ ID NO: 716403 - RNA, 64 nt, hsa; identical to SEQ ID NO: 233917

SEQ ID NO: 716404 - RNA, 64 nt, hsa; identical to SEQ ID NO: 233918

SEQ ID NO: 716405 - RNA, 64 nt, hsa; identical to SEQ ID NO: 233919

SEQ ID NO: 716406 - RNA, 64 nt, hsa; identical to SEQ ID NO: 233920

SEQ ID NO: 716407 - RNA, 64 nt, hsa; identical to SEQ ID NO: 233921

SEQ ID NO: 716408 - RNA, 64 nt, hsa; identical to SEQ ID NO: 233922

SEQ ID NO: 716409 - RNA, 64 nt, hsa; identical to SEQ ID NO: 233923

SEQ ID NO: 716410 - RNA, 64 nt, hsa; identical to SEQ ID NO: 233924

SEQ ID NO: 716411 - RNA, 64 nt, hsa; identical to SEQ ID NO: 233925

SEQ ID NO: 716412 - RNA, 64 nt, hsa; identical to SEQ ID NO: 233926

SEQ ID NO: 716413 - RNA, 64 nt, hsa; identical to SEQ ID NO: 233927

SEQ ID NO: 716414 - RNA, 64 nt, hsa; identical to SEQ ID NO: 233928

SEQ ID NO: 716415 - RNA, 64 nt, hsa; identical to SEQ ID NO: 233929

SEQ ID NO: 716416 - RNA, 64 nt, hsa; identical to SEQ ID NO: 233930

SEQ ID NO: 716417 - RNA, 64 nt, hsa; identical to SEQ ID NO: 233931

SEQ ID NO: 716418 - RNA, 64 nt, hsa; identical to SEQ ID NO: 233932

SEQ ID NO: 716419 - RNA, 64 nt, hsa; identical to SEQ ID NO: 233933

SEQ ID NO: 716420 - RNA, 64 nt, hsa; identical to SEQ ID NO: 233934

SEQ ID NO: 716421 - RNA, 64 nt, hsa; identical to SEQ ID NO: 233935

SEQ ID NO: 716422 - RNA, 64 nt, hsa; identical to SEQ ID NO: 233936

SEQ ID NO: 716423 - RNA, 64 nt, hsa; identical to SEQ ID NO: 233937

SEQ ID NO: 716424 - RNA, 64 nt, hsa; identical to SEQ ID NO: 233938

SEQ ID NO: 716425 - RNA, 64 nt, hsa; identical to SEQ ID NO: 233939

SEQ ID NO: 716426 - RNA, 64 nt, hsa; identical to SEQ ID NO: 233940

SEQ ID NO: 716427 - RNA, 64 nt, hsa; identical to SEQ ID NO: 233941

SEQ ID NO: 716428 - RNA, 64 nt, hsa; identical to SEQ ID NO: 233942

SEQ ID NO: 716429 - RNA, 64 nt, hsa; identical to SEQ ID NO: 233943

SEQ ID NO: 716430 - RNA, 64 nt, hsa; identical to SEQ ID NO: 233944

SEQ ID NO: 716431 - RNA, 64 nt, hsa; identical to SEQ ID NO: 233945

SEQ ID NO: 716432 - RNA, 64 nt, hsa; identical to SEQ ID NO: 233946

SEQ ID NO: 716433 - RNA, 64 nt, hsa; identical to SEQ ID NO: 233947

SEQ ID NO: 716434 - RNA, 64 nt, hsa; identical to SEQ ID NO: 233948

SEQ ID NO: 716435 - RNA, 64 nt, hsa; identical to SEQ ID NO: 233949

SEQ ID NO: 716436 - RNA, 64 nt, hsa; identical to SEQ ID NO: 233950

SEQ ID NO: 716437 - RNA, 64 nt, hsa; identical to SEQ ID NO: 233951

SEQ ID NO: 716438 - RNA, 64 nt, hsa; identical to SEQ ID NO: 233952

SEQ ID NO: 716439 - RNA, 64 nt, hsa; identical to SEQ ID NO: 233953

SEQ ID NO: 716440 - RNA, 64 nt, hsa; identical to SEQ ID NO: 233954

SEQ ID NO: 716441 - RNA, 64 nt, hsa; identical to SEQ ID NO: 233955

SEQ ID NO: 716442 - RNA, 64 nt, hsa; identical to SEQ ID NO: 233956

SEQ ID NO: 716443 - RNA, 64 nt, hsa; identical to SEQ ID NO: 233957

SEQ ID NO: 716444 - RNA, 64 nt, hsa; identical to SEQ ID NO: 233958

SEQ ID NO: 716445 - RNA, 64 nt, hsa; identical to SEQ ID NO: 233959

SEQ ID NO: 716446 - RNA, 64 nt, hsa; identical to SEQ ID NO: 233960

SEQ ID NO: 716447 - RNA, 64 nt, hsa; identical to SEQ ID NO: 233961

SEQ ID NO: 716448 - RNA, 64 nt, hsa; identical to SEQ ID NO: 233962

SEQ ID NO: 716449 - RNA, 64 nt, hsa; identical to SEQ ID NO: 233963

SEQ ID NO: 716450 - RNA, 64 nt, hsa; identical to SEQ ID NO: 233964

SEQ ID NO: 716451 - RNA, 64 nt, hsa; identical to SEQ ID NO: 233965

SEQ ID NO: 716452 - RNA, 64 nt, hsa; identical to SEQ ID NO: 233966

SEQ ID NO: 716453 - RNA, 64 nt, hsa; identical to SEQ ID NO: 233967

SEQ ID NO: 716454 - RNA, 64 nt, hsa; identical to SEQ ID NO: 233968

SEQ ID NO: 716455 - RNA, 64 nt, hsa; identical to SEQ ID NO: 233969

SEQ ID NO: 716456 - RNA, 64 nt, hsa; identical to SEQ ID NO: 233970

SEQ ID NO: 716457 - RNA, 64 nt, hsa; identical to SEQ ID NO: 233971

SEQ ID NO: 716458 - RNA, 64 nt, hsa; identical to SEQ ID NO: 233972

SEQ ID NO: 716459 - RNA, 64 nt, hsa; identical to SEQ ID NO: 142128

SEQ ID NO: 716460 - RNA, 64 nt, hsa; identical to SEQ ID NO: 142129

SEQ ID NO: 716461 - RNA, 64 nt, hsa; identical to SEQ ID NO: 142130

SEQ ID NO: 716462 - RNA, 64 nt, hsa; identical to SEQ ID NO: 142131

SEQ ID NO: 716463 - RNA, 64 nt, hsa; identical to SEQ ID NO: 142132

SEQ ID NO: 716464 - RNA, 64 nt, hsa; identical to SEQ ID NO: 142133

SEQ ID NO: 716465 - RNA, 64 nt, hsa; identical to SEQ ID NO: 142134

SEQ ID NO: 716466 - RNA, 64 nt, hsa; identical to SEQ ID NO: 142135

SEQ ID NO: 716467 - RNA, 64 nt, hsa; identical to SEQ ID NO: 142136

SEQ ID NO: 716468 - RNA, 64 nt, hsa; identical to SEQ ID NO: 142137

SEQ ID NO: 716469 - RNA, 64 nt, hsa
cacagagcagagaagcagagauguuccuugaacugcccacaaguuuucaauaacuuuuauuucu

SEQ ID NO: 716470 - RNA, 64 nt, hsa
uuuaaacccaugaguuuaugcccugggcuccuuagcccacaauaguguaauaaaagugccccgg

SEQ ID NO: 716471 - RNA, 64 nt, hsa
acuaaagaaagaaauucaaaaguagcuauuuggggcccacaaaaauaacuauuauuuuagccuu

SEQ ID NO: 716472 - RNA, 64 nt, hsa
aaggaaaugagaauaugauccccucuuccgaguugcccacaaacuugcuucuuugcuuuugcuc

SEQ ID NO: 716473 - RNA, 64 nt, hsa
cugcuucaguuguccuccacagcacugauuugcagcccacaagcuggcagguuuaucugucuca

SEQ ID NO: 716474 - RNA, 64 nt, hsa
gagaagauuaaaugugcaaaaccugcuugacugugcccacaaauccugauuguaggaauaaauu

SEQ ID NO: 716475 - RNA, 63 nt, hsa
cacaggcacugccccaggacaacacaacaaggacagucacaacaaggacaacaaggacacaac

SEQ ID NO: 716476 - RNA, 63 nt, hsa
acaacaaggacacaacacaacacacaacaaggacagucacaacaagccuagagccagaaagca

SEQ ID NO: 716477 - RNA, 63 nt, hsa
ggguaaaagcuccuucacaccccuuccaaaagucagucacagaccacugcaacaugccuuccc

SEQ ID NO: 716478 - RNA, 63 nt, hsa
ucagaaagauacagugauaauguguguaugaaucagucacaaugaauuuuacuugaauauugu

SEQ ID NO: 716479 - RNA, 63 nt, hsa
gggcaugauuuguaccauccacccauacccacacagucacagucacacacacauauguauuac

SEQ ID NO: 716480 - RNA, 63 nt, hsa
gauuuguaccauccacccauacccacacagucacagucacacacacauauguauuacuuacac

SEQ ID NO: 716481 - RNA, 63 nt, hsa
cuauuugguggaagauagauguucauauugaagcagucacauuuguacuguaguucaauaaaa

SEQ ID NO: 716482 - RNA, 63 nt, hsa
uuauaguaaaucauucaaggauucagaauuuugcagucacagaagaguguauuuauuauguag

SEQ ID NO: 716483 - RNA, 63 nt, hsa
aucuuacaaaugugaagacugugacaaaguugucagucacaaaucacagcuugaaagacagga

SEQ ID NO: 716484 - RNA, 63 nt, hsa
aaguguaaugaauguggcauaguuuuuaaucaacagucacaccuugcaagucaucauagucuu

SEQ ID NO: 716485 - RNA, 64 nt, hsa; identical to SEQ ID NO: 695984

SEQ ID NO: 716486 - RNA, 64 nt, hsa; identical to SEQ ID NO: 695985

SEQ ID NO: 716487 - RNA, 64 nt, hsa; identical to SEQ ID NO: 695986

SEQ ID NO: 716488 - RNA, 64 nt, hsa; identical to SEQ ID NO: 695987

SEQ ID NO: 716489 - RNA, 64 nt, hsa; identical to SEQ ID NO: 695988

SEQ ID NO: 716490 - RNA, 64 nt, hsa; identical to SEQ ID NO: 695989

SEQ ID NO: 716491 - RNA, 64 nt, hsa; identical to SEQ ID NO: 695990

SEQ ID NO: 716492 - RNA, 64 nt, hsa; identical to SEQ ID NO: 695991

SEQ ID NO: 716493 - RNA, 64 nt, hsa; identical to SEQ ID NO: 695992

SEQ ID NO: 716494 - RNA, 64 nt, hsa; identical to SEQ ID NO: 695993

SEQ ID NO: 716495 - RNA, 64 nt, hsa; identical to SEQ ID NO: 695994

SEQ ID NO: 716496 - RNA, 64 nt, hsa; identical to SEQ ID NO: 695995

SEQ ID NO: 716497 - RNA, 64 nt, hsa; identical to SEQ ID NO: 112922

SEQ ID NO: 716498 - RNA, 64 nt, hsa; identical to SEQ ID NO: 112923

SEQ ID NO: 716499 - RNA, 64 nt, hsa; identical to SEQ ID NO: 112924

SEQ ID NO: 716500 - RNA, 64 nt, hsa; identical to SEQ ID NO: 112925

SEQ ID NO: 716501 - RNA, 64 nt, hsa; identical to SEQ ID NO: 112926

SEQ ID NO: 716502 - RNA, 64 nt, hsa; identical to SEQ ID NO: 112927

SEQ ID NO: 716503 - RNA, 64 nt, hsa; identical to SEQ ID NO: 112928

SEQ ID NO: 716504 - RNA, 64 nt, hsa; identical to SEQ ID NO: 112929

SEQ ID NO: 716505 - RNA, 64 nt, hsa; identical to SEQ ID NO: 112930

SEQ ID NO: 716506 - RNA, 64 nt, hsa; identical to SEQ ID NO: 112931

SEQ ID NO: 716507 - RNA, 64 nt, hsa; identical to SEQ ID NO: 112932

SEQ ID NO: 716508 - RNA, 64 nt, hsa; identical to SEQ ID NO: 112933

SEQ ID NO: 716509 - RNA, 64 nt, hsa; identical to SEQ ID NO: 112934

SEQ ID NO: 716510 - RNA, 64 nt, hsa; identical to SEQ ID NO: 112935

SEQ ID NO: 716511 - RNA, 64 nt, hsa; identical to SEQ ID NO: 112936

SEQ ID NO: 716512 - RNA, 64 nt, hsa; identical to SEQ ID NO: 112937

SEQ ID NO: 716513 - RNA, 64 nt, hsa; identical to SEQ ID NO: 112938

SEQ ID NO: 716514 - RNA, 64 nt, hsa; identical to SEQ ID NO: 112939

SEQ ID NO: 716515 - RNA, 64 nt, hsa; identical to SEQ ID NO: 112940

SEQ ID NO: 716516 - RNA, 64 nt, hsa; identical to SEQ ID NO: 112941

SEQ ID NO: 716517 - RNA, 64 nt, hsa; identical to SEQ ID NO: 112942

SEQ ID NO: 716518 - RNA, 64 nt, hsa; identical to SEQ ID NO: 112943

SEQ ID NO: 716519 - RNA, 64 nt, hsa; identical to SEQ ID NO: 112944

SEQ ID NO: 716520 - RNA, 64 nt, hsa; identical to SEQ ID NO: 112945

SEQ ID NO: 716521 - RNA, 64 nt, hsa; identical to SEQ ID NO: 112946

SEQ ID NO: 716522 - RNA, 64 nt, hsa; identical to SEQ ID NO: 112947

SEQ ID NO: 716523 - RNA, 64 nt, hsa; identical to SEQ ID NO: 112948

SEQ ID NO: 716524 - RNA, 64 nt, hsa; identical to SEQ ID NO: 112949

SEQ ID NO: 716525 - RNA, 64 nt, hsa; identical to SEQ ID NO: 112950

SEQ ID NO: 716526 - RNA, 64 nt, hsa; identical to SEQ ID NO: 112951

SEQ ID NO: 716527 - RNA, 64 nt, hsa; identical to SEQ ID NO: 112952

SEQ ID NO: 716528 - RNA, 64 nt, hsa; identical to SEQ ID NO: 112953

SEQ ID NO: 716529 - RNA, 64 nt, hsa; identical to SEQ ID NO: 112954

SEQ ID NO: 716530 - RNA, 50 nt, hsa; identical to SEQ ID NO: 112955

SEQ ID NO: 716531 - RNA, 64 nt, hsa; identical to SEQ ID NO: 112956

SEQ ID NO: 716532 - RNA, 64 nt, hsa; identical to SEQ ID NO: 112957

SEQ ID NO: 716533 - RNA, 64 nt, hsa; identical to SEQ ID NO: 112958

SEQ ID NO: 716534 - RNA, 64 nt, hsa; identical to SEQ ID NO: 112959

SEQ ID NO: 716535 - RNA, 64 nt, hsa; identical to SEQ ID NO: 112960

SEQ ID NO: 716536 - RNA, 64 nt, hsa; identical to SEQ ID NO: 112961

SEQ ID NO: 716537 - RNA, 64 nt, hsa; identical to SEQ ID NO: 275490

SEQ ID NO: 716538 - RNA, 64 nt, hsa; identical to SEQ ID NO: 275491

SEQ ID NO: 716539 - RNA, 64 nt, hsa; identical to SEQ ID NO: 275492

SEQ ID NO: 716540 - RNA, 64 nt, hsa; identical to SEQ ID NO: 275493

SEQ ID NO: 716541 - RNA, 64 nt, hsa; identical to SEQ ID NO: 275494

SEQ ID NO: 716542 - RNA, 64 nt, hsa; identical to SEQ ID NO: 275495

SEQ ID NO: 716543 - RNA, 64 nt, hsa; identical to SEQ ID NO: 275496

SEQ ID NO: 716544 - RNA, 64 nt, hsa; identical to SEQ ID NO: 275497

SEQ ID NO: 716545 - RNA, 64 nt, hsa; identical to SEQ ID NO: 275498

SEQ ID NO: 716546 - RNA, 64 nt, hsa; identical to SEQ ID NO: 275499

SEQ ID NO: 716547 - RNA, 64 nt, hsa; identical to SEQ ID NO: 275500

SEQ ID NO: 716548 - RNA, 64 nt, hsa; identical to SEQ ID NO: 275501

SEQ ID NO: 716549 - RNA, 64 nt, hsa; identical to SEQ ID NO: 275502

SEQ ID NO: 716550 - RNA, 64 nt, hsa; identical to SEQ ID NO: 275503

SEQ ID NO: 716551 - RNA, 64 nt, hsa; identical to SEQ ID NO: 275504

SEQ ID NO: 716552 - RNA, 64 nt, hsa; identical to SEQ ID NO: 275505

SEQ ID NO: 716553 - RNA, 64 nt, hsa; identical to SEQ ID NO: 275506

SEQ ID NO: 716554 - RNA, 64 nt, hsa; identical to SEQ ID NO: 275507

SEQ ID NO: 716555 - RNA, 64 nt, hsa; identical to SEQ ID NO: 275508

SEQ ID NO: 716556 - RNA, 64 nt, hsa; identical to SEQ ID NO: 275509

SEQ ID NO: 716557 - RNA, 64 nt, hsa; identical to SEQ ID NO: 275510

SEQ ID NO: 716558 - RNA, 64 nt, hsa; identical to SEQ ID NO: 275511

SEQ ID NO: 716559 - RNA, 64 nt, hsa; identical to SEQ ID NO: 275512

SEQ ID NO: 716560 - RNA, 64 nt, hsa; identical to SEQ ID NO: 275513

SEQ ID NO: 716561 - RNA, 64 nt, hsa; identical to SEQ ID NO: 275514

SEQ ID NO: 716562 - RNA, 64 nt, hsa; identical to SEQ ID NO: 275515

SEQ ID NO: 716563 - RNA, 64 nt, hsa; identical to SEQ ID NO: 275516

SEQ ID NO: 716564 - RNA, 64 nt, hsa; identical to SEQ ID NO: 275517

SEQ ID NO: 716565 - RNA, 64 nt, hsa
ucccucugcaguuuuggggagaucagcugcaggauuuuaacaggaauguuuuggucauugcauu

SEQ ID NO: 716566 - RNA, 64 nt, hsa
uuccacauaaugaggagccaaagaaaucugauguuuuuaacaauuaaacugcuaauguuaaauu

SEQ ID NO: 716567 - RNA, 64 nt, hsa
cuuaaaaaucuuaaagucacaaaaggaaaaagguuuuuaacauuuacaugaguuaacauuuuuu

SEQ ID NO: 716568 - RNA, 64 nt, hsa
uuuccucuaugguaguuaaaauacagaauuagauuuuuaacaggugucauuugacuaaacguuu

SEQ ID NO: 716569 - RNA, 64 nt, hsa
uuuacaagauaaaauuggacuucauuuaguaucuuuuuaacagaauuacuuggaauaaugagau

SEQ ID NO: 716570 - RNA, 64 nt, hsa
acauuuaacagaucauuuauaaagcaggaguccauuuuaacacuuaccgacuuuuuuugguuug

SEQ ID NO: 716571 - RNA, 64 nt, hsa
uuuuaagccagguuacauucuaaaaauucuuaacuuuuaacauaauauuuuauaccaaagccaa

SEQ ID NO: 716572 - RNA, 64 nt, hsa
ugaacugccaggcccggccaaaauaaugcaccacuuuuaacagaacagacagaugaggacagag

SEQ ID NO: 716573 - RNA, 64 nt, hsa
uggacugaugggucugcuccaggccacauuuguuuuuuaacaguaacguggcuaggcuuccauu

SEQ ID NO: 716574 - RNA, 64 nt, hsa
aaguuuagccuuuacuugaauguauacuguagauuuuuaacaaagcgaguucuauauuuauuau

SEQ ID NO: 716575 - RNA, 64 nt, hsa
uaucugucaacaguuaauaaucauguuauguuaauuuuaacaugauugcugacuuggauaauuc

SEQ ID NO: 716576 - RNA, 64 nt, hsa
augaguauugggccuaauugcaacaccagucuguuuuuaacagguucuauuacccagaacuuuu

SEQ ID NO: 716577 - RNA, 64 nt, hsa
ccuauaaaagugaguguuuauaggacuaaaaaacuuuuaacaacuuuuuaaggaaauauuuuug

SEQ ID NO: 716578 - RNA, 64 nt, hsa
uaccaaaugucacaggagcugucucccagcucauuuuuaacacugaaaugacauuaggaucuaa

SEQ ID NO: 716579 - RNA, 64 nt, hsa
gaaacuagagugcauuuaaaauacucugucuucauuuuaacauguugaauggaauaacugcaua

SEQ ID NO: 716580 - RNA, 64 nt, hsa
gauuacagcgugagcuaccuggccccuccccaaauuuuaacaucagaucucaacauauuuguug

SEQ ID NO: 716581 - RNA, 64 nt, hsa
ugagaauaaauaggcauaugauacccacuuggacuuuuaacaaaaguaaaggaauaaauuugca

SEQ ID NO: 716582 - RNA, 64 nt, hsa
aacagauguauuuugcacagugcacuuaugucuauuuuaacaauccuccugcaucuguauuuua

SEQ ID NO: 716583 - RNA, 64 nt, hsa
aaucuggaagaaugacuguaucagucaauggggauuuuaacagacugccuugguacugccgagu

SEQ ID NO: 716584 - RNA, 64 nt, hsa
auccaguuuuaagaggagccacuuaucaaagagauuuuaacaguaguaagaaggcaaagaauaa

SEQ ID NO: 716585 - RNA, 64 nt, hsa
gauguuauugacauuauacacugaagucuuaacauuuuaacauuuauagugcuuauuugcaaaa

SEQ ID NO: 716586 - RNA, 64 nt, hsa
uacccugucaucaugcaaugaaauauuguuaucguuuuaacauagcucauuuauguagaaugaa

SEQ ID NO: 716587 - RNA, 64 nt, hsa
ggucugaaaugagaaacauacugacuuuuuaaaauuuuaacaguguacuucuuaggcuuucauu

SEQ ID NO: 716588 - RNA, 64 nt, hsa
uauaggaaucauuuuuaaaaaucuuuaaggagacuuuuaacaguccuucgugaauagagcaggc

SEQ ID NO: 716589 - RNA, 64 nt, hsa
augucaacuuuugacuaagaauuuuguuuuacuuuuuuaacauguguuaaacagagaaaggguc

SEQ ID NO: 716590 - RNA, 64 nt, hsa
auugguaacuaggauauguauauuuuaauagaauuuuuaacaaaacuucuuagaaaauuaaaau

SEQ ID NO: 716591 - RNA, 64 nt, hsa
ccuuuauacagagaauucuacaaguuugcaaauauuuuaacaauauuaaaugugcaauagaacu

SEQ ID NO: 716592 - RNA, 64 nt, hsa
uuauguuaaaccuuaauuuuuuuucuguaaucacuuuuaacacugcuaauagaaauuauguuuu

SEQ ID NO: 716593 - RNA, 64 nt, hsa
aguccccuggaauuacacagcuuuagugcugagcuuuuaacaggaaauguggcccuagguauua

SEQ ID NO: 716594 - RNA, 64 nt, hsa
aaguuacauuuagaucuauucugaagcuguucauuuuuaacaaauaaaauguuacagguuucac

SEQ ID NO: 716595 - RNA, 64 nt, hsa
uagccagauguguaucagauguuucacugacaguuuuuaacaauaaauucuuuucacuguauuu

SEQ ID NO: 716596 - RNA, 64 nt, hsa
gaaguacaaaaggaacuaugaaaaccagaacaaauuuuaacaaaaggacaaccacagagggaua

SEQ ID NO: 716597 - RNA, 64 nt, hsa
auuaacaguauauuguacugaucagcagcucucauuuuaacaucaguuaggcauaauauuucau

SEQ ID NO: 716598 - RNA, 64 nt, hsa
aaauuauauuaaaaggaagcggggaacauguauuuuuuaacauagaacagaagugacuucauuc

SEQ ID NO: 716599 - RNA, 64 nt, hsa
cgguuuccguagcaguuuugaaaccuuaguaccuuuuuaacagcaugugggugucagugucauu

SEQ ID NO: 716600 - RNA, 64 nt, hsa
agguaaaauuugcacacaaaacaucuuaggcacuuuuuaacauucucaaucaugggaauuuuaa

SEQ ID NO: 716601 - RNA, 64 nt, hsa
cugaaaacaacaacaacaaaaguccauucauauuuuuuaacaauuguauaagugcccaaguaau

SEQ ID NO: 716602 - RNA, 64 nt, hsa
gaaaaaaucuaaaggggagaguauucuuuaaaguuuuuaacauaagcuugucaaugcacaugua

SEQ ID NO: 716603 - RNA, 64 nt, hsa
agucgcagcacuaaaaauggaugacaucaaacauuuuuaacaaaaugauguacaaacuaaggac

SEQ ID NO: 716604 - RNA, 64 nt, hsa
uauuuguccagaaggaagcuuggcugagcuggccuuuuaacauaggaauguauuucguuggaaa

SEQ ID NO: 716605 - RNA, 64 nt, hsa
aguauuaaaauccauagacuaaaaucugagaauuuuuuaacauaugcaagucagccaaacauaa

SEQ ID NO: 716606 - RNA, 64 nt, hsa
agggucaagaagugacuuguucagaacacauuguuuuuaacagaaaaaaaaucuuuuuauaaaa

SEQ ID NO: 716607 - RNA, 64 nt, hsa
uuuaacagaaaaaaaaucuuuuuauaaaaugaacuuuuaacacuuggcucaaaccucuagguca

SEQ ID NO: 716608 - RNA, 64 nt, hsa
ugugagccaccgcacccaguugggaacaaagccuuuuuaacacacguaagggcccucaaaccgu

SEQ ID NO: 716609 - RNA, 64 nt, hsa
gcauugacguaucuuugaaauguucacagcagccuuuuaacaacaacugggugguccuuguagg

SEQ ID NO: 716610 - RNA, 64 nt, hsa
gauggguagagugggaauuuuuuccuaaucauguuuuuaacauuuuaaaauaaaauuuaauacu

SEQ ID NO: 716611 - RNA, 63 nt, hsa
uuuaauucacguuugggaauauugaaugaauccauuuuaacauaagcacuguggugccaucuu

SEQ ID NO: 716612 - RNA, 64 nt, hsa
ggucuccuuucuuacccaggacuccuuucuuccauuuuaacacuuccugguugcaagagggaug

SEQ ID NO: 716613 - RNA, 64 nt, hsa
ugaauuaaauaagccucuuccccuuaccgauccuuuuuaacacucucagguuuguuuguuuccc

SEQ ID NO: 716614 - RNA, 64 nt, hsa
aauuaagugaaaaucuucccuuuguuaaggagcuuuuuaacaagagugucuuugcuggguggug

SEQ ID NO: 716615 - RNA, 64 nt, hsa
uuaguacauggcagauugccuguaagucuguucauuuuaacaacauacagggcugggcacggug

SEQ ID NO: 716616 - RNA, 64 nt, hsa
cuuuuuaacaaaaauaaucuuaggauaagaauuauuuuaacaacauauaaaacuguuucaagcc

SEQ ID NO: 716617 - RNA, 64 nt, hsa
auacagcugagugggaaccggaaaccuauucucuuuuuaacaaaaauaaucuuaggauaagaau

SEQ ID NO: 716618 - RNA, 64 nt, hsa
aaaugcuuaggaucuucagacccaauagcucuaauuuuaacauuucuacccaauaagaggcucu

SEQ ID NO: 716619 - RNA, 64 nt, hsa
aaagauaggcauagacacauaauuaugcuuaagcuuuuaacagcauuuuaaccgcucuaaaaau

SEQ ID NO: 716620 - RNA, 64 nt, hsa
gcaaaugugugguaaacauucauauggccauuaauuuuaacauuaaaucguagguagggcaaug

SEQ ID NO: 716621 - RNA, 64 nt, hsa
ggacaaggcuucacauaaaaaauuauuucuucacuuuuaacacaaguuagaaauuauaucccau

SEQ ID NO: 716622 - RNA, 64 nt, hsa
aaauuuuuuuguuuguaauuucagguuuuuuacauuuuaacaaaauauuuuaaaaguuauaaac

SEQ ID NO: 716623 - RNA, 64 nt, hsa
auauauagccucaauugaguuuuuuaugacaauauuuuaacauaccucucucucuacauauaaa

SEQ ID NO: 716624 - RNA, 64 nt, hsa
aaauaagaaauacauuuuugacagaggcuuaauguuuuaacaaaagaguguggacauuuuuauu

SEQ ID NO: 716625 - RNA, 64 nt, hsa
uucaaugacuugaucaucugcuuccuuuuugaauuuuuaacagauaguaaguaaauuugguggu

SEQ ID NO: 716626 - RNA, 64 nt, hsa
gcuccuggagagcaguauugcuguaguaggaauguuuuaacagugucauaugaaaaagaacaaa

SEQ ID NO: 716627 - RNA, 64 nt, hsa
cccacacagguuuuauuacuguuauauacuauacuuuuaacaguacagacccuaaauuuuauua

SEQ ID NO: 716628 - RNA, 64 nt, hsa
auauacuuuugaauacaucacuguuggauagauguuuuaacaguuuuuucugguuuaaaaacca

SEQ ID NO: 716629 - RNA, 64 nt, hsa
ccgucuacauauaacacaaaacuuuuauaaauuauuuuaacaaagauuaaaauauacugcaggg

SEQ ID NO: 716630 - RNA, 64 nt, hsa
auugaaauuucuucuugguguauaguucugugaauuuuaacagaaagauuugugcaccacuacu

SEQ ID NO: 716631 - RNA, 64 nt, hsa
cuggaacauaaaagauuuuuucuuaacuuuuuuuuuuuaacacacuaaucuucaguuggaugaa

SEQ ID NO: 716632 - RNA, 64 nt, hsa
uucuaccuuuuaauuugaaaacaaggaaauuaaauuuuaacagaaaucuuuuaaguauguuaua

SEQ ID NO: 716633 - RNA, 64 nt, hsa
uuuuucuuaaaaaugaaaaaaaaaucaaagauuuuuuuaacaguucucagacuuaacuguugcc

SEQ ID NO: 716634 - RNA, 64 nt, hsa
ucuaagcagugaaauguaaugauaaagagggauauuuuaacauauuuccgaaugaaugacucau

SEQ ID NO: 716635 - RNA, 64 nt, hsa
auggcaucucaauauuuuugagaacuacauuuguuuuuaacauauguguuugagaaaagcauau

SEQ ID NO: 716636 - RNA, 64 nt, hsa
aacucauauugaaacuucaucuagucucuuaauuuuuuaacacuaaauucaagucauuuguuuu

SEQ ID NO: 716637 - RNA, 64 nt, hsa
cuuuuuauaaaaaagaacauuuuuccagugugguuuuuaacagauaauacauuucuuccacauu

SEQ ID NO: 716638 - RNA, 64 nt, hsa
uuauuucuuggugaaacaaaaguuuuaaaaguaguuuuaacaacuuuacacuggaaugauuuag

SEQ ID NO: 716639 - RNA, 64 nt, hsa
uucccaggauuccuuccaagucaguuacaggugguuuuaacagaaagcaucagcucugcuucgu

SEQ ID NO: 716640 - RNA, 64 nt, hsa
ugugagccaccacacccagccugggucucucuacuuuuaacacaucucucaucccuuucccagg

SEQ ID NO: 716641 - RNA, 64 nt, hsa
ugccuugauaaauauauaugaucauugaaauacuuuuuaacaaaaaacagauucuauauuauua

SEQ ID NO: 716642 - RNA, 64 nt, hsa
uauauccuauauaggaaacuaagcauuguauuuuuuuuaacaaaucuaaaaaagcacuaugaac

SEQ ID NO: 716643 - RNA, 64 nt, hsa
gcaauuacauggauacuuuuagauauauuuaaaauuuuaacauuggcaucuaaaguguuauuug

SEQ ID NO: 716644 - RNA, 64 nt, hsa
aaugcccacguaaauagcugucaucaucauuaucuuuuaacauuuugggggacuuuccaguuga

SEQ ID NO: 716645 - RNA, 64 nt, hsa
auaacugccaucuccaacuacauccuuaugauguuuuuaacaauaaaauuaaaacaacuguuaa

SEQ ID NO: 716646 - RNA, 64 nt, hsa
auguguacuuuuguccucaaaccuaguagcuggguuuuaacacucauggacauggucuuaauca

SEQ ID NO: 716647 - RNA, 64 nt, hsa
aaugauuucuuaugguuuauuuugaugaaaguucuuuuaacaugucuugaauguacacauaaag

SEQ ID NO: 716648 - RNA, 64 nt, hsa
gagggcauuuguuugagugugaguuuggaggccuuuuuaacaugcagacauacccauauuuaaa

SEQ ID NO: 716649 - RNA, 64 nt, hsa
uauguugauguguaaguucaccgcacaucccacuuuuuaacaaaacucaugaaugugcaguuug

SEQ ID NO: 716650 - RNA, 64 nt, hsa
auuuuacugcagcuuugaugugcauauuugaacuuuuuaacauuuguaacuuugguggcaaaga

SEQ ID NO: 716651 - RNA, 64 nt, hsa
ugucaguacagcguauauggaaaauucaaguuguuuuuaacauauucaaguauguucaguauaa

SEQ ID NO: 716652 - RNA, 64 nt, hsa
uuaacacuccccuuaacugucuuugaacuuucucuuuuaacaaaaaugucaagucuuuauaguu

SEQ ID NO: 716653 - RNA, 64 nt, hsa
gcaccacgaaauacauaugcagugccuuuuuuccuuuuaacauagguggcuagccaaaguuuag

SEQ ID NO: 716654 - RNA, 64 nt, hsa
acugagugcacuuuacaucuuuauuuaaauuuuuuuuuaacaucuuauguuuacaggcuuccug

SEQ ID NO: 716655 - RNA, 64 nt, hsa
uaugucucugguuaggaugaaguuaauuuuauguuuuuaacaugguauuuuugaaggagcuaau

SEQ ID NO: 716656 - RNA, 64 nt, hsa
auuauguaagcaaaaccaauaaaaauuuaaguuuuuuuaacaacuaccuuauuuuucacuguac

SEQ ID NO: 716657 - RNA, 64 nt, hsa
gcacagcacacuauuaaaauauuaaguguaauuauuuuaacacucacagcuacauaugacauuu

SEQ ID NO: 716658 - RNA, 64 nt, hsa
aauggguacagagaaaaaaaauuuaagaccaauauuuuaacaggauaauuugguuauuacucac

SEQ ID NO: 716659 - RNA, 64 nt, hsa
gaaaugcuuauuuuuaugacuauuuauuccaauguuuuaacaagaagcacagagauuuauagua

SEQ ID NO: 716660 - RNA, 64 nt, hsa
ugggugaauggauguguguugaauuuuaguuuucuuuuaacaugcauguugggugagaggggaa

SEQ ID NO: 716661 - RNA, 64 nt, hsa
uuaaaagaguugcauucuuauuauguaaggaugauuuuaacaacuuuuuaauauguaauucuuc

SEQ ID NO: 716662 - RNA, 64 nt, hsa
uaauuauuggcuuguuucauuuuuuuccuccaguuuuuaacaagaucacauaacuggcuuauuu

SEQ ID NO: 716663 - RNA, 64 nt, hsa
uccaguuuuuaacaagaucacauaacuggcuuauuuuuaacagcuuugucaaacuacaauuuac

SEQ ID NO: 716664 - RNA, 64 nt, hsa
auuuuuaauagccaaguaguucugcaaauaguucuuuuaacaauuugaccucucuccaaaacag

SEQ ID NO: 716665 - RNA, 64 nt, hsa
cuggaacugguuucuauuugucaaaucaguuuccuuuuaacauaauuaaucccuuuaacaaaaa

SEQ ID NO: 716666 - RNA, 64 nt, hsa
gauuuaguuuguagaauuuaauuuaaaauuuaaauuuuaacaaagugaugacacaacaauaugu

SEQ ID NO: 716667 - RNA, 64 nt, hsa
gcaagcaagaaagcagaaacuacuguucccuuuauuuuaacauuguacagacaauacagaaaug

SEQ ID NO: 716668 - RNA, 64 nt, hsa
agaaacccuacaaaugugaagaacguggccuggcuuuuaacaaauccucaacauuuacuaagca

SEQ ID NO: 716669 - RNA, 64 nt, hsa
agcgaaacuacaauccugaaugaugucacagugcuuuuaacaauaccucaaacuuuucuaaaca

SEQ ID NO: 716670 - RNA, 64 nt, hsa
uacccuuuauuuuuacuuccccuugacucauauguuuuaacaugauuuuaacaaacugcacuua

SEQ ID NO: 716671 - RNA, 64 nt, hsa
uuuacuuccccuugacucauauguuuuaacaugauuuuaacaaacugcacuuauuaagaaaugu

SEQ ID NO: 716672 - RNA, 64 nt, hsa
uaauuuucaaaaacucaaucaauguaauucaguauuuuaacaaaaggaaugaaaaauuaucauc

SEQ ID NO: 716673 - RNA, 64 nt, hsa
ccuguguccauguguucucauuguuauacgaacauuuuaacaauguuaauucuugcagaccaug

SEQ ID NO: 716674 - RNA, 64 nt, hsa
cgaagaaaaaagcaauacugaacaaaacaaaucauuuuaacaagaugacuacuagaaaacuaaa

SEQ ID NO: 716675 - RNA, 64 nt, hsa
uucagauuauaugugauguuaauauauucaaccuuuuuaacauguuaaauacuauugugcauuc

SEQ ID NO: 716676 - RNA, 64 nt, hsa
caaaugacuagucagaaccuugcuuaacaugagauuuuaacacaacaaugaaauuugccuuguc

SEQ ID NO: 716677 - RNA, 64 nt, hsa
uaacccucaucugcaauauuuucaccccuaaaauuuuuaacaggguuuccuuuuuuucucacga

SEQ ID NO: 716678 - RNA, 64 nt, hsa
aacagguuauauuguacaggaucaauauuuugcuuuuuaacaaggauauuuauguaauaagaaa

SEQ ID NO: 716679 - RNA, 64 nt, hsa
ccucuuaucuaggagcuguuuguaagcacgauuuuuuuaacagguuauauuguacaggaucaau

SEQ ID NO: 716680 - RNA, 64 nt, hsa
cuguauauugcauagcauuacacauuuaugccuauuuuaacauuaacuucuaaagaaguuuuuu

SEQ ID NO: 716681 - RNA, 64 nt, hsa
guggauacagucuugguucuccaucuguaauuuuuuuuaacaguuugcuauagcuuacugcuua

SEQ ID NO: 716682 - RNA, 64 nt, hsa
caaaguaagcaauggagguaacaaauauugugcauuuuaacaguaauauuugaagauuuguaga

SEQ ID NO: 716683 - RNA, 64 nt, hsa
aaaaacaaagcuaaccauauggcacuaauuuugauuuuaacauuaguguaacaaauaaggucgg

SEQ ID NO: 716684 - RNA, 64 nt, hsa
aaacaugugauuugcaaauuauuauuuuucuuuuuuuuaacaaauggaaguaaauuuguuucac

SEQ ID NO: 716685 - RNA, 64 nt, hsa
uuuucagacuacugaaaucccuguagcagagauguuuuaacauuauauuuugagagcuuugggu

SEQ ID NO: 716686 - RNA, 64 nt, hsa
aaggaaacuuaugcagaguaauauuuugguucaguuuuaacaucgugacaaugagggcuuuuuc

SEQ ID NO: 716687 - RNA, 64 nt, hsa
cuaaucagcauauuuuugucugaauacuugaacauuuuaacaguaacgcagguguagaaucaga

SEQ ID NO: 716688 - RNA, 64 nt, hsa; identical to SEQ ID NO: 99247

SEQ ID NO: 716689 - RNA, 64 nt, hsa; identical to SEQ ID NO: 99248

SEQ ID NO: 716690 - RNA, 64 nt, hsa; identical to SEQ ID NO: 99249

SEQ ID NO: 716691 - RNA, 64 nt, hsa; identical to SEQ ID NO: 99250

SEQ ID NO: 716692 - RNA, 64 nt, hsa; identical to SEQ ID NO: 99251

SEQ ID NO: 716693 - RNA, 64 nt, hsa; identical to SEQ ID NO: 99252

SEQ ID NO: 716694 - RNA, 64 nt, hsa; identical to SEQ ID NO: 99253

SEQ ID NO: 716695 - RNA, 64 nt, hsa; identical to SEQ ID NO: 99254

SEQ ID NO: 716696 - RNA, 64 nt, hsa; identical to SEQ ID NO: 99255

SEQ ID NO: 716697 - RNA, 64 nt, hsa; identical to SEQ ID NO: 99256

SEQ ID NO: 716698 - RNA, 64 nt, hsa; identical to SEQ ID NO: 99257

SEQ ID NO: 716699 - RNA, 64 nt, hsa; identical to SEQ ID NO: 99258

SEQ ID NO: 716700 - RNA, 64 nt, hsa; identical to SEQ ID NO: 99259

SEQ ID NO: 716701 - RNA, 64 nt, hsa; identical to SEQ ID NO: 99260

SEQ ID NO: 716702 - RNA, 64 nt, hsa; identical to SEQ ID NO: 99261

SEQ ID NO: 716703 - RNA, 64 nt, hsa; identical to SEQ ID NO: 99262

SEQ ID NO: 716704 - RNA, 64 nt, hsa; identical to SEQ ID NO: 99263

SEQ ID NO: 716705 - RNA, 64 nt, hsa; identical to SEQ ID NO: 99264

SEQ ID NO: 716706 - RNA, 64 nt, hsa; identical to SEQ ID NO: 99265

SEQ ID NO: 716707 - RNA, 64 nt, hsa; identical to SEQ ID NO: 99266

SEQ ID NO: 716708 - RNA, 64 nt, hsa; identical to SEQ ID NO: 99267

SEQ ID NO: 716709 - RNA, 64 nt, hsa; identical to SEQ ID NO: 99268

SEQ ID NO: 716710 - RNA, 64 nt, hsa; identical to SEQ ID NO: 99269

SEQ ID NO: 716711 - RNA, 64 nt, hsa; identical to SEQ ID NO: 99270

SEQ ID NO: 716712 - RNA, 64 nt, hsa; identical to SEQ ID NO: 99271

SEQ ID NO: 716713 - RNA, 64 nt, hsa; identical to SEQ ID NO: 133252

SEQ ID NO: 716714 - RNA, 64 nt, hsa; identical to SEQ ID NO: 133253

SEQ ID NO: 716715 - RNA, 64 nt, hsa; identical to SEQ ID NO: 133254

SEQ ID NO: 716716 - RNA, 64 nt, hsa; identical to SEQ ID NO: 133255

SEQ ID NO: 716717 - RNA, 64 nt, hsa; identical to SEQ ID NO: 133256

SEQ ID NO: 716718 - RNA, 64 nt, hsa; identical to SEQ ID NO: 133257

SEQ ID NO: 716719 - RNA, 64 nt, hsa; identical to SEQ ID NO: 133258

SEQ ID NO: 716720 - RNA, 64 nt, hsa; identical to SEQ ID NO: 133259

SEQ ID NO: 716721 - RNA, 64 nt, hsa; identical to SEQ ID NO: 133260

SEQ ID NO: 716722 - RNA, 64 nt, hsa; identical to SEQ ID NO: 133261

SEQ ID NO: 716723 - RNA, 64 nt, hsa; identical to SEQ ID NO: 133262

SEQ ID NO: 716724 - RNA, 57 nt, hsa; identical to SEQ ID NO: 133263

SEQ ID NO: 716725 - RNA, 64 nt, hsa; identical to SEQ ID NO: 133264

SEQ ID NO: 716726 - RNA, 64 nt, hsa; identical to SEQ ID NO: 133265

SEQ ID NO: 716727 - RNA, 64 nt, hsa; identical to SEQ ID NO: 133266

SEQ ID NO: 716728 - RNA, 64 nt, hsa; identical to SEQ ID NO: 133267

SEQ ID NO: 716729 - RNA, 64 nt, hsa; identical to SEQ ID NO: 133268

SEQ ID NO: 716730 - RNA, 64 nt, hsa; identical to SEQ ID NO: 133269

SEQ ID NO: 716731 - RNA, 64 nt, hsa; identical to SEQ ID NO: 133270

SEQ ID NO: 716732 - RNA, 64 nt, hsa; identical to SEQ ID NO: 366005

SEQ ID NO: 716733 - RNA, 64 nt, hsa; identical to SEQ ID NO: 366006

SEQ ID NO: 716734 - RNA, 64 nt, hsa; identical to SEQ ID NO: 366007

SEQ ID NO: 716735 - RNA, 64 nt, hsa; identical to SEQ ID NO: 366008

SEQ ID NO: 716736 - RNA, 64 nt, hsa; identical to SEQ ID NO: 366009

SEQ ID NO: 716737 - RNA, 64 nt, hsa; identical to SEQ ID NO: 366010

SEQ ID NO: 716738 - RNA, 64 nt, hsa; identical to SEQ ID NO: 366011

SEQ ID NO: 716739 - RNA, 64 nt, hsa; identical to SEQ ID NO: 366012

SEQ ID NO: 716740 - RNA, 64 nt, hsa; identical to SEQ ID NO: 366013

SEQ ID NO: 716741 - RNA, 64 nt, hsa; identical to SEQ ID NO: 366014

SEQ ID NO: 716742 - RNA, 64 nt, hsa; identical to SEQ ID NO: 366015

SEQ ID NO: 716743 - RNA, 64 nt, hsa; identical to SEQ ID NO: 366016

SEQ ID NO: 716744 - RNA, 64 nt, hsa; identical to SEQ ID NO: 366017

SEQ ID NO: 716745 - RNA, 64 nt, hsa; identical to SEQ ID NO: 366018

SEQ ID NO: 716746 - RNA, 64 nt, hsa; identical to SEQ ID NO: 366019

SEQ ID NO: 716747 - RNA, 64 nt, hsa; identical to SEQ ID NO: 366020

SEQ ID NO: 716748 - RNA, 64 nt, hsa; identical to SEQ ID NO: 366021

SEQ ID NO: 716749 - RNA, 64 nt, hsa; identical to SEQ ID NO: 366022

SEQ ID NO: 716750 - RNA, 64 nt, hsa; identical to SEQ ID NO: 366023

SEQ ID NO: 716751 - RNA, 64 nt, hsa; identical to SEQ ID NO: 366024

SEQ ID NO: 716752 - RNA, 64 nt, hsa
ucaaguaaagaagccauuuccacuacagugagaaagcccggaucccaacaguugucaaauugau

SEQ ID NO: 716753 - RNA, 64 nt, hsa
uagaaacucagcagaagcugguaaaaacauggggagcccggaggacaggcugcuguccagggca

SEQ ID NO: 716754 - RNA, 64 nt, hsa; identical to SEQ ID NO: 692338

SEQ ID NO: 716755 - RNA, 64 nt, hsa; identical to SEQ ID NO: 692339

SEQ ID NO: 716756 - RNA, 64 nt, hsa; identical to SEQ ID NO: 692340

SEQ ID NO: 716757 - RNA, 64 nt, hsa; identical to SEQ ID NO: 692341

SEQ ID NO: 716758 - RNA, 64 nt, hsa; identical to SEQ ID NO: 692342

SEQ ID NO: 716759 - RNA, 64 nt, hsa; identical to SEQ ID NO: 692343

SEQ ID NO: 716760 - RNA, 64 nt, hsa; identical to SEQ ID NO: 692344

SEQ ID NO: 716761 - RNA, 64 nt, hsa; identical to SEQ ID NO: 692345

SEQ ID NO: 716762 - RNA, 64 nt, hsa; identical to SEQ ID NO: 692346

SEQ ID NO: 716763 - RNA, 64 nt, hsa; identical to SEQ ID NO: 692347

SEQ ID NO: 716764 - RNA, 64 nt, hsa; identical to SEQ ID NO: 692348

SEQ ID NO: 716765 - RNA, 64 nt, hsa; identical to SEQ ID NO: 692349

SEQ ID NO: 716766 - RNA, 64 nt, hsa; identical to SEQ ID NO: 692350

SEQ ID NO: 716767 - RNA, 64 nt, hsa; identical to SEQ ID NO: 692351

SEQ ID NO: 716768 - RNA, 64 nt, hsa; identical to SEQ ID NO: 692352

SEQ ID NO: 716769 - RNA, 64 nt, hsa; identical to SEQ ID NO: 692353

SEQ ID NO: 716770 - RNA, 64 nt, hsa; identical to SEQ ID NO: 692354

SEQ ID NO: 716771 - RNA, 64 nt, hsa; identical to SEQ ID NO: 692355

SEQ ID NO: 716772 - RNA, 62 nt, hsa
uucagugucuucucagaaacaaccagcugagaaggcuacaagugacgacaaagauucuguuu

SEQ ID NO: 716773 - RNA, 62 nt, hsa
uucagugucuucucagaaacaaccagcugagaaggcuacaagugacgagaaagauucuguuu

SEQ ID NO: 716774 - RNA, 62 nt, hsa
uucagugucuucucagaaacaaccagccucaaaggcuacaagugacaagacagauucugcuu

SEQ ID NO: 716775 - RNA, 62 nt, hsa
uucagugucuucucagaaacaaccagccuugaaggcuacaacugacgaggaagacucuguuu

SEQ ID NO: 716776 - RNA, 62 nt, hsa
uucagugucuucucagaaacaaccagccuugaaggcuacaacugaugagaaagauucuguuu

SEQ ID NO: 716777 - RNA, 62 nt, hsa
uucagugucuucucggaaaaaaccagccuugaaggcuacaagugaugagaaggauucuuuuu

SEQ ID NO: 716778 - RNA, 62 nt, hsa
uucagugucuucugagaaaccaccaggcuugaaggcuacaagugaugagaaagauucuguuu

SEQ ID NO: 716779 - RNA, 62 nt, hsa
uaucuguuuuuauauuucuguuaaaauauaugaggcuacagaacuaaaaauuaaaaccucuu

SEQ ID NO: 716780 - RNA, 62 nt, hsa
aggcaggaggaucacuugagccccggaggucgaggcuacagugagccaagagugcacuacug

SEQ ID NO: 716781 - RNA, 64 nt, hsa; identical to SEQ ID NO: 216152

SEQ ID NO: 716782 - RNA, 64 nt, hsa; identical to SEQ ID NO: 216153

SEQ ID NO: 716783 - RNA, 64 nt, hsa; identical to SEQ ID NO: 216154

SEQ ID NO: 716784 - RNA, 64 nt, hsa; identical to SEQ ID NO: 216155

SEQ ID NO: 716785 - RNA, 64 nt, hsa; identical to SEQ ID NO: 216156

SEQ ID NO: 716786 - RNA, 64 nt, hsa; identical to SEQ ID NO: 216157

SEQ ID NO: 716787 - RNA, 64 nt, hsa; identical to SEQ ID NO: 216158

SEQ ID NO: 716788 - RNA, 64 nt, hsa; identical to SEQ ID NO: 216159

SEQ ID NO: 716789 - RNA, 64 nt, hsa; identical to SEQ ID NO: 270302

SEQ ID NO: 716790 - RNA, 64 nt, hsa; identical to SEQ ID NO: 270303

SEQ ID NO: 716791 - RNA, 64 nt, hsa; identical to SEQ ID NO: 270304

SEQ ID NO: 716792 - RNA, 64 nt, hsa; identical to SEQ ID NO: 270305

SEQ ID NO: 716793 - RNA, 64 nt, hsa; identical to SEQ ID NO: 270306

SEQ ID NO: 716794 - RNA, 64 nt, hsa; identical to SEQ ID NO: 270307

SEQ ID NO: 716795 - RNA, 64 nt, hsa
aaacuugguuaugucaguuccuguguguagacaguaaggaaaaaaaggcaugcuauguguuacg

SEQ ID NO: 716796 - RNA, 64 nt, hsa
ugcauuuucacccauucugugguucauuguaguuuaaggaaaccaagcauauagaugcauuagu

SEQ ID NO: 716797 - RNA, 64 nt, hsa
uuuaauucuucuucaguucauuaaaaguaacuacuaaggaaagguuaaaaacuuccccucaaaa

SEQ ID NO: 716798 - RNA, 64 nt, hsa
cuugguaacuauggcuuuauguuggguuacuguuuaaggaaaguugaucugggccuuuuuaaaa

SEQ ID NO: 716799 - RNA, 64 nt, hsa
uaaguaauugaccaaauggaaaaggggaaguaauuaaggaaauugguaaguggagguagucagg

SEQ ID NO: 716800 - RNA, 64 nt, hsa
cucaguaugcaaaaccugaaaucagaugccuauguaaggaaagugcuauucacccaguaaaccc

SEQ ID NO: 716801 - RNA, 64 nt, hsa
uucuccuaguugugugugggcaacagaaacaaguuaaggaaacaaaaauacuuauauauacaca

SEQ ID NO: 716802 - RNA, 64 nt, hsa
acuuuuaugucaaacucuucuguuucuccaaauauaaggaaaaaagacuaaagcaagagaucug

SEQ ID NO: 716803 - RNA, 64 nt, hsa
uguuuauaggacuaaaaaacuuuuaacaacuuuuuaaggaaauauuuuuguucuuauacaaaaa

SEQ ID NO: 716804 - RNA, 64 nt, hsa
aacaguacacaauuuauaaaguaaaaagauuuuauaaggaaaacaaauauaauaaccagugcug

SEQ ID NO: 716805 - RNA, 64 nt, hsa
agauaacaucaugaggugugggaaguccuaguuuuaaggaaaccacugaaauauagaugggaaa

SEQ ID NO: 716806 - RNA, 64 nt, hsa
cacaucagaaugauacagaguuagcagguuuuucuaaggaaaugccauucaaaugccuccuaac

SEQ ID NO: 716807 - RNA, 64 nt, hsa
uuauuugcauucuccuuguggauuuuuugucaccuaaggaaaugcauuugaugagugcuggaaa

SEQ ID NO: 716808 - RNA, 64 nt, hsa
cuucuuaaaaguguaaagaagccucauaagaucauaaggaaaauguauauaugcuuuucacagc

SEQ ID NO: 716809 - RNA, 64 nt, hsa
uguuaacaaugccaugaaagcauuuucuuucuccuaaggaaaagugaauuucuuaucagaauau

SEQ ID NO: 716810 - RNA, 64 nt, hsa
guauuagauccuauaaauugaacugauuuuuccauaaggaaaaugcuucuuuugagauuaauuc

SEQ ID NO: 716811 - RNA, 64 nt, hsa
uccuugaaugucuguugaugaaauagucacuguuuaaggaaaaaaguaauuaugagguguagca

SEQ ID NO: 716812 - RNA, 64 nt, hsa
ucuauauuguauguauguauauaaauacauagauuaaggaaauaggaaacugaaacucugugga

SEQ ID NO: 716813 - RNA, 64 nt, hsa
auaagugaauuuugugcucuuguuuguauuuuauuaaggaaaaugaaaauaaucuggcaucagu

SEQ ID NO: 716814 - RNA, 64 nt, hsa
aagauccuuauauuuacaucuaguauauaugugguaaggaaaugccgauucuucauuauaaaca

SEQ ID NO: 716815 - RNA, 64 nt, hsa
aaacuaaaaugucuuaauggcugugugacacacguaaggaaaggaaagggggucacgcacauca

SEQ ID NO: 716816 - RNA, 64 nt, hsa
uuuuuauuuguuauacaauggaagcacaauguuauaaggaaagguaauuuuaagcuaacaacca

SEQ ID NO: 716817 - RNA, 64 nt, hsa
ucuuugauuauuuaucaaaaaaguauaaaucuuuuaaggaaaauguuagaauuuuaaaguuuuu

SEQ ID NO: 716818 - RNA, 64 nt, hsa
auaaggacuuuuugauggaauuaaaugugggagguaaggaaaaggauuuagagguaaaaguaca

SEQ ID NO: 716819 - RNA, 64 nt, hsa
gguaaccaauccagugaauagaugugcccuuuuauaaggaaacuucugauguuuauuaaaaaaa

SEQ ID NO: 716820 - RNA, 64 nt, hsa
uccauuugccucuuccuuccuauuucccuuccgcuaaggaaaaaaauuggugucacauuuguaa

SEQ ID NO: 716821 - RNA, 64 nt, hsa
auuuuuaaaaauuuagcuucuagauuccauuugguaaggaaaucaauauuggaaguauugcuaa

SEQ ID NO: 716822 - RNA, 64 nt, hsa
auuuccauucuuaauuguaauuuuuuucuuuaaauaaggaaaccaauauaaucucauguauaaa

SEQ ID NO: 716823 - RNA, 64 nt, hsa
agccaccacgccuggcccaugaaccaaguguuuuuaaggaaacaaaacuauuuuuuuaaucauc

SEQ ID NO: 716824 - RNA, 64 nt, hsa
aauaauaauaaaaaaaaaagcccuuuaaacuuuguaaggaaauauuuuuugauuuugcguaaga

SEQ ID NO: 716825 - RNA, 64 nt, hsa
ugccacacuaauguuaccugguuuccuuuuaguuuaaggaaaaauuaggagaaagugaggugcu

SEQ ID NO: 716826 - RNA, 64 nt, hsa
cuacuugaccaagcaaaggggcugaaaaacugaauaaggaaacaacuuuauaagagaaacagug

SEQ ID NO: 716827 - RNA, 64 nt, hsa
aacuugcccacaugauaacucauguuugcuuuaauaaggaaaauauguuauuugagguuaauua

SEQ ID NO: 716828 - RNA, 64 nt, hsa
ucugaggacagauuagaaagacuucaggaaauucuaaggaaauuucuguaccuggagagagagu

SEQ ID NO: 716829 - RNA, 64 nt, hsa
uaaaucuaacagaggauuuucagaguagugaauguaaggaaagcuuaauggaucucucccaccu

SEQ ID NO: 716830 - RNA, 64 nt, hsa
aagcucuucuauccacccuuacgucagaugccucuaaggaaaauacacuagguaaguuaauuuu

SEQ ID NO: 716831 - RNA, 64 nt, hsa
uuuagacuucaaggaauuccaaugaugaagauuuuaaggaaaguauuuuauauucaacagguau

SEQ ID NO: 716832 - RNA, 64 nt, hsa
caugagaacaucuuaaaacuauguguaaauauauuaaggaaaguauagcuuuguaauuuaaauu

SEQ ID NO: 716833 - RNA, 64 nt, hsa
ggauguauuauugagaaguaaguugaagggcuuauaaggaaaaauguuuuauaacugaguaaua

SEQ ID NO: 716834 - RNA, 64 nt, hsa
gugucugucacugguuagggguaagaugaggggauaaggaaagagacuuuucaauaaguuguga

SEQ ID NO: 716835 - RNA, 64 nt, hsa
uuucuaaauuuauuuaaaugcuuagcaggaagcauaaggaaaagccaucggccuccaauaccca

SEQ ID NO: 716836 - RNA, 64 nt, hsa
uaaauuugugacaggauuguagcaaauuauuauuuaaggaaaauaaauuguguaaacauuuaau

SEQ ID NO: 716837 - RNA, 64 nt, hsa
agcuggaacaauucagauucacccgcccugaugcuaaggaaacccugacguauguacuagaugg

SEQ ID NO: 716838 - RNA, 64 nt, hsa
aaaaaaaaacaguaaaagugaaauauuacuguuuuaaggaaaacuaauuuaggguggcagccaa

SEQ ID NO: 716839 - RNA, 64 nt, hsa
cuuucaacagaaaaccaaaaccaaacgaaaugucuaaggaaaauguuuucuuaaugagaugaug

SEQ ID NO: 716840 - RNA, 64 nt, hsa
aagaaggaaauaucaucguauuucuuuuuuuuaauaaggaaaaaauaauauccauacagucaag

SEQ ID NO: 716841 - RNA, 64 nt, hsa
cuuccucugcaaaaagauuuaacaaauacauucauaaggaaauguguguuguaacaaauauauu

SEQ ID NO: 716842 - RNA, 64 nt, hsa
uuaccauaauuuaaucagucaauuugcagauagcuaaggaaaaucuuccaaaaucuguaggugc

SEQ ID NO: 716843 - RNA, 64 nt, hsa
agacagguaaauguuauauaauuguaggguuaguuaaggaaauuaguccauaaaauuggcaaga

SEQ ID NO: 716844 - RNA, 64 nt, hsa
cauuuuauacauuucaguggccuuuuuuuuuuuuuaaggaaaaaaaagcgcaaaaccaaguaca

SEQ ID NO: 716845 - RNA, 64 nt, hsa
augacugagaaaacuuguuuacagcuccagcauauaaggaaaguguucaaggccagauaugccu

SEQ ID NO: 716846 - RNA, 64 nt, hsa
aaagggaaaucaaauuaauuuuucucguuagacauaaggaaauuuaaggaaaaacagcuuuaag

SEQ ID NO: 716847 - RNA, 64 nt, hsa
caaauuaauuuuucucguuagacauaaggaaauuuaaggaaaaacagcuuuaagaacaguuacu

SEQ ID NO: 716848 - RNA, 64 nt, hsa
aggaucacaguuuuuaaaaggcaaacauuuucccuaaggaaacagacacaagcuuuccuagaga

SEQ ID NO: 716849 - RNA, 64 nt, hsa
uuguuuaaugaaauauuuuauucuugcauuuccauaaggaaagggaaagucaugaucauccuaa

SEQ ID NO: 716850 - RNA, 64 nt, hsa
agggugguaaauguaggagaaagagccuuggccuuaaggaaaucuuuacuccuguaagcaagag

SEQ ID NO: 716851 - RNA, 64 nt, hsa
uuucuguuuguaagacuuaagugaguuaggucuuuaaggaaagcaacgcuccucugaaaugcuu

SEQ ID NO: 716852 - RNA, 64 nt, hsa
uuuuuuaauugugguuguucugacgugugaaauuuaaggaaagagccauuuuuuaaaaaugccg

SEQ ID NO: 716853 - RNA, 64 nt, hsa
uaaagucuuucagcaacauucuuuauugucaucauaaggaaaaacuuuuaucgcaaugauaguc

SEQ ID NO: 716854 - RNA, 64 nt, hsa
aguugccgucuucacagacaaacuugaaagguauuaaggaaaaaauuccacauagcucugggcc

SEQ ID NO: 716855 - RNA, 64 nt, hsa
uaaaggaagauacuaguuuugcugaaaaugacauuaaggaaaguucugcuguuuuuagcaaaag

SEQ ID NO: 716856 - RNA, 64 nt, hsa
uagcaaggagccaacauaacagaugggcuggaaguaaggaaacauguaaugauaggcggacucc

SEQ ID NO: 716857 - RNA, 64 nt, hsa
uuacaguauuuuuaauugaaaguccuaauucuguuaaggaaaggaguugauuaaauuuuaaggu

SEQ ID NO: 716858 - RNA, 64 nt, hsa
uggguuggugcaaagaaguauaaacauauaucacuaaggaaaaagaaaguuugucuugcccuuc

SEQ ID NO: 716859 - RNA, 64 nt, hsa
gggaugcuucagguaggacaucaaggaaagccucuaaggaaaggaugcaugagcuaacaccuga

SEQ ID NO: 716860 - RNA, 64 nt, hsa
uuuuguuuuuuuuuuuaacugcuaaaucuuauuauaaggaaaccauacugaaaaccuuuccaag

SEQ ID NO: 716861 - RNA, 64 nt, hsa
acucuuagagguagguguauucccguuuuacagauaaggaaacugaggcccagagagcugaagu

SEQ ID NO: 716862 - RNA, 64 nt, hsa
aguaaagcuagacaaaggcccagaaaucauacuguaaggaaauguuauuggaagcugauuccca

SEQ ID NO: 716863 - RNA, 64 nt, hsa
uuuguggccaaauuggaugaaaaagaugaggcucuaaggaaaugguggcaugaagacccucucc

SEQ ID NO: 716864 - RNA, 64 nt, hsa
auggguuuauuuuuccagcauaaaccucagaauuuaaggaaagaaaaugaugucuguuguuaua

SEQ ID NO: 716865 - RNA, 64 nt, hsa
uugaauaugugacacacacacuccuaaguaccuuuaaggaaaauuaauaaaucauuaauaguua

SEQ ID NO: 716866 - RNA, 64 nt, hsa
uuucuucccaagugcuguuggguuuuuuucuucuuaaggaaaacguugucacuuuuauguuaua

SEQ ID NO: 716867 - RNA, 64 nt, hsa; identical to SEQ ID NO: 156143

SEQ ID NO: 716868 - RNA, 64 nt, hsa; identical to SEQ ID NO: 156144

SEQ ID NO: 716869 - RNA, 64 nt, hsa; identical to SEQ ID NO: 156145

SEQ ID NO: 716870 - RNA, 64 nt, hsa; identical to SEQ ID NO: 156146

SEQ ID NO: 716871 - RNA, 64 nt, hsa; identical to SEQ ID NO: 156147

SEQ ID NO: 716872 - RNA, 64 nt, hsa; identical to SEQ ID NO: 156148

SEQ ID NO: 716873 - RNA, 64 nt, hsa; identical to SEQ ID NO: 156149

SEQ ID NO: 716874 - RNA, 64 nt, hsa; identical to SEQ ID NO: 156150

SEQ ID NO: 716875 - RNA, 64 nt, hsa; identical to SEQ ID NO: 156151

SEQ ID NO: 716876 - RNA, 64 nt, hsa; identical to SEQ ID NO: 156152

SEQ ID NO: 716877 - RNA, 64 nt, hsa; identical to SEQ ID NO: 156153

SEQ ID NO: 716878 - RNA, 64 nt, hsa; identical to SEQ ID NO: 156154

SEQ ID NO: 716879 - RNA, 64 nt, hsa; identical to SEQ ID NO: 156155

SEQ ID NO: 716880 - RNA, 64 nt, hsa; identical to SEQ ID NO: 156156

SEQ ID NO: 716881 - RNA, 64 nt, hsa; identical to SEQ ID NO: 156157

SEQ ID NO: 716882 - RNA, 64 nt, hsa; identical to SEQ ID NO: 156158

SEQ ID NO: 716883 - RNA, 64 nt, hsa; identical to SEQ ID NO: 156159

SEQ ID NO: 716884 - RNA, 64 nt, hsa; identical to SEQ ID NO: 156160

SEQ ID NO: 716885 - RNA, 64 nt, hsa; identical to SEQ ID NO: 156161

SEQ ID NO: 716886 - RNA, 64 nt, hsa; identical to SEQ ID NO: 156162

SEQ ID NO: 716887 - RNA, 64 nt, hsa; identical to SEQ ID NO: 156163

SEQ ID NO: 716888 - RNA, 64 nt, hsa; identical to SEQ ID NO: 156164

SEQ ID NO: 716889 - RNA, 64 nt, hsa; identical to SEQ ID NO: 156165

SEQ ID NO: 716890 - RNA, 64 nt, hsa; identical to SEQ ID NO: 156166

SEQ ID NO: 716891 - RNA, 64 nt, hsa; identical to SEQ ID NO: 156167

SEQ ID NO: 716892 - RNA, 64 nt, hsa; identical to SEQ ID NO: 156168

SEQ ID NO: 716893 - RNA, 64 nt, hsa; identical to SEQ ID NO: 156169

SEQ ID NO: 716894 - RNA, 64 nt, hsa; identical to SEQ ID NO: 156170

SEQ ID NO: 716895 - RNA, 64 nt, hsa; identical to SEQ ID NO: 156171

SEQ ID NO: 716896 - RNA, 64 nt, hsa; identical to SEQ ID NO: 156172

SEQ ID NO: 716897 - RNA, 64 nt, hsa; identical to SEQ ID NO: 156173

SEQ ID NO: 716898 - RNA, 64 nt, hsa; identical to SEQ ID NO: 156174

SEQ ID NO: 716899 - RNA, 64 nt, hsa; identical to SEQ ID NO: 156175

SEQ ID NO: 716900 - RNA, 64 nt, hsa; identical to SEQ ID NO: 156176

SEQ ID NO: 716901 - RNA, 64 nt, hsa; identical to SEQ ID NO: 156177

SEQ ID NO: 716902 - RNA, 64 nt, hsa; identical to SEQ ID NO: 156178

SEQ ID NO: 716903 - RNA, 64 nt, hsa; identical to SEQ ID NO: 156179

SEQ ID NO: 716904 - RNA, 64 nt, hsa; identical to SEQ ID NO: 156180

SEQ ID NO: 716905 - RNA, 64 nt, hsa; identical to SEQ ID NO: 156181

SEQ ID NO: 716906 - RNA, 64 nt, hsa; identical to SEQ ID NO: 156182

SEQ ID NO: 716907 - RNA, 64 nt, hsa; identical to SEQ ID NO: 156183

SEQ ID NO: 716908 - RNA, 64 nt, hsa; identical to SEQ ID NO: 156184

SEQ ID NO: 716909 - RNA, 64 nt, hsa; identical to SEQ ID NO: 156185

SEQ ID NO: 716910 - RNA, 64 nt, hsa; identical to SEQ ID NO: 156186

SEQ ID NO: 716911 - RNA, 64 nt, hsa; identical to SEQ ID NO: 156187

SEQ ID NO: 716912 - RNA, 64 nt, hsa; identical to SEQ ID NO: 156188

SEQ ID NO: 716913 - RNA, 64 nt, hsa; identical to SEQ ID NO: 156189

SEQ ID NO: 716914 - RNA, 64 nt, hsa; identical to SEQ ID NO: 156190

SEQ ID NO: 716915 - RNA, 64 nt, hsa; identical to SEQ ID NO: 156191

SEQ ID NO: 716916 - RNA, 64 nt, hsa; identical to SEQ ID NO: 156192

SEQ ID NO: 716917 - RNA, 64 nt, hsa; identical to SEQ ID NO: 156193

SEQ ID NO: 716918 - RNA, 64 nt, hsa; identical to SEQ ID NO: 156194

SEQ ID NO: 716919 - RNA, 64 nt, hsa; identical to SEQ ID NO: 156195

SEQ ID NO: 716920 - RNA, 64 nt, hsa; identical to SEQ ID NO: 156196

SEQ ID NO: 716921 - RNA, 64 nt, hsa; identical to SEQ ID NO: 156197

SEQ ID NO: 716922 - RNA, 64 nt, hsa; identical to SEQ ID NO: 156198

SEQ ID NO: 716923 - RNA, 64 nt, hsa; identical to SEQ ID NO: 156199

SEQ ID NO: 716924 - RNA, 64 nt, hsa; identical to SEQ ID NO: 156200

SEQ ID NO: 716925 - RNA, 64 nt, hsa; identical to SEQ ID NO: 156201

SEQ ID NO: 716926 - RNA, 64 nt, hsa; identical to SEQ ID NO: 156202

SEQ ID NO: 716927 - RNA, 64 nt, hsa; identical to SEQ ID NO: 156203

SEQ ID NO: 716928 - RNA, 64 nt, hsa; identical to SEQ ID NO: 156204

SEQ ID NO: 716929 - RNA, 64 nt, hsa; identical to SEQ ID NO: 156205

SEQ ID NO: 716930 - RNA, 64 nt, hsa; identical to SEQ ID NO: 156206

SEQ ID NO: 716931 - RNA, 64 nt, hsa; identical to SEQ ID NO: 156207

SEQ ID NO: 716932 - RNA, 64 nt, hsa; identical to SEQ ID NO: 156208

SEQ ID NO: 716933 - RNA, 64 nt, hsa; identical to SEQ ID NO: 156209

SEQ ID NO: 716934 - RNA, 53 nt, hsa; identical to SEQ ID NO: 156210

SEQ ID NO: 716935 - RNA, 64 nt, hsa; identical to SEQ ID NO: 156211

SEQ ID NO: 716936 - RNA, 64 nt, hsa; identical to SEQ ID NO: 156212

SEQ ID NO: 716937 - RNA, 64 nt, hsa; identical to SEQ ID NO: 156213

SEQ ID NO: 716938 - RNA, 64 nt, hsa; identical to SEQ ID NO: 156214

SEQ ID NO: 716939 - RNA, 64 nt, hsa; identical to SEQ ID NO: 156215

SEQ ID NO: 716940 - RNA, 64 nt, hsa; identical to SEQ ID NO: 156216

SEQ ID NO: 716941 - RNA, 64 nt, hsa; identical to SEQ ID NO: 156217

SEQ ID NO: 716942 - RNA, 64 nt, hsa; identical to SEQ ID NO: 156218

SEQ ID NO: 716943 - RNA, 64 nt, hsa; identical to SEQ ID NO: 156219

SEQ ID NO: 716944 - RNA, 64 nt, hsa; identical to SEQ ID NO: 156220

SEQ ID NO: 716945 - RNA, 64 nt, hsa; identical to SEQ ID NO: 156221

SEQ ID NO: 716946 - RNA, 64 nt, hsa; identical to SEQ ID NO: 156222

SEQ ID NO: 716947 - RNA, 64 nt, hsa; identical to SEQ ID NO: 156223

SEQ ID NO: 716948 - RNA, 64 nt, hsa; identical to SEQ ID NO: 156224

SEQ ID NO: 716949 - RNA, 64 nt, hsa; identical to SEQ ID NO: 156225

SEQ ID NO: 716950 - RNA, 64 nt, hsa; identical to SEQ ID NO: 156226

SEQ ID NO: 716951 - RNA, 64 nt, hsa; identical to SEQ ID NO: 156227

SEQ ID NO: 716952 - RNA, 64 nt, hsa; identical to SEQ ID NO: 156228

SEQ ID NO: 716953 - RNA, 64 nt, hsa; identical to SEQ ID NO: 156229

SEQ ID NO: 716954 - RNA, 64 nt, hsa; identical to SEQ ID NO: 156230

SEQ ID NO: 716955 - RNA, 64 nt, hsa; identical to SEQ ID NO: 156231

SEQ ID NO: 716956 - RNA, 64 nt, hsa; identical to SEQ ID NO: 156232

SEQ ID NO: 716957 - RNA, 64 nt, hsa; identical to SEQ ID NO: 156233

SEQ ID NO: 716958 - RNA, 64 nt, hsa; identical to SEQ ID NO: 156234

SEQ ID NO: 716959 - RNA, 64 nt, hsa; identical to SEQ ID NO: 156235

SEQ ID NO: 716960 - RNA, 64 nt, hsa; identical to SEQ ID NO: 156236

SEQ ID NO: 716961 - RNA, 64 nt, hsa; identical to SEQ ID NO: 156237

SEQ ID NO: 716962 - RNA, 64 nt, hsa; identical to SEQ ID NO: 156238

SEQ ID NO: 716963 - RNA, 64 nt, hsa; identical to SEQ ID NO: 156239

SEQ ID NO: 716964 - RNA, 64 nt, hsa; identical to SEQ ID NO: 156240

SEQ ID NO: 716965 - RNA, 64 nt, hsa; identical to SEQ ID NO: 156241

SEQ ID NO: 716966 - RNA, 64 nt, hsa; identical to SEQ ID NO: 156242

SEQ ID NO: 716967 - RNA, 64 nt, hsa; identical to SEQ ID NO: 156243

SEQ ID NO: 716968 - RNA, 64 nt, hsa; identical to SEQ ID NO: 156244

SEQ ID NO: 716969 - RNA, 64 nt, hsa; identical to SEQ ID NO: 156245

SEQ ID NO: 716970 - RNA, 64 nt, hsa; identical to SEQ ID NO: 156246

SEQ ID NO: 716971 - RNA, 64 nt, hsa; identical to SEQ ID NO: 156247

SEQ ID NO: 716972 - RNA, 64 nt, hsa; identical to SEQ ID NO: 156248

SEQ ID NO: 716973 - RNA, 64 nt, hsa; identical to SEQ ID NO: 156249

SEQ ID NO: 716974 - RNA, 64 nt, hsa; identical to SEQ ID NO: 156250

SEQ ID NO: 716975 - RNA, 64 nt, hsa; identical to SEQ ID NO: 156251

SEQ ID NO: 716976 - RNA, 64 nt, hsa; identical to SEQ ID NO: 156252

SEQ ID NO: 716977 - RNA, 64 nt, hsa; identical to SEQ ID NO: 156253

SEQ ID NO: 716978 - RNA, 64 nt, hsa; identical to SEQ ID NO: 156254

SEQ ID NO: 716979 - RNA, 64 nt, hsa; identical to SEQ ID NO: 156255

SEQ ID NO: 716980 - RNA, 64 nt, hsa; identical to SEQ ID NO: 156256

SEQ ID NO: 716981 - RNA, 64 nt, hsa; identical to SEQ ID NO: 156257

SEQ ID NO: 716982 - RNA, 64 nt, hsa; identical to SEQ ID NO: 156258

SEQ ID NO: 716983 - RNA, 64 nt, hsa; identical to SEQ ID NO: 156259

SEQ ID NO: 716984 - RNA, 64 nt, hsa; identical to SEQ ID NO: 156260

SEQ ID NO: 716985 - RNA, 64 nt, hsa; identical to SEQ ID NO: 156261

SEQ ID NO: 716986 - RNA, 64 nt, hsa; identical to SEQ ID NO: 156262

SEQ ID NO: 716987 - RNA, 64 nt, hsa; identical to SEQ ID NO: 156263

SEQ ID NO: 716988 - RNA, 64 nt, hsa; identical to SEQ ID NO: 156264

SEQ ID NO: 716989 - RNA, 64 nt, hsa; identical to SEQ ID NO: 156265

SEQ ID NO: 716990 - RNA, 64 nt, hsa; identical to SEQ ID NO: 156266

SEQ ID NO: 716991 - RNA, 64 nt, hsa; identical to SEQ ID NO: 156267

SEQ ID NO: 716992 - RNA, 64 nt, hsa; identical to SEQ ID NO: 156268

SEQ ID NO: 716993 - RNA, 64 nt, hsa; identical to SEQ ID NO: 156269

SEQ ID NO: 716994 - RNA, 64 nt, hsa; identical to SEQ ID NO: 156270

SEQ ID NO: 716995 - RNA, 64 nt, hsa; identical to SEQ ID NO: 156271

SEQ ID NO: 716996 - RNA, 64 nt, hsa; identical to SEQ ID NO: 156272

SEQ ID NO: 716997 - RNA, 64 nt, hsa; identical to SEQ ID NO: 156273

SEQ ID NO: 716998 - RNA, 64 nt, hsa; identical to SEQ ID NO: 156274

SEQ ID NO: 716999 - RNA, 64 nt, hsa; identical to SEQ ID NO: 156275

SEQ ID NO: 717000 - RNA, 64 nt, hsa; identical to SEQ ID NO: 156276

SEQ ID NO: 717001 - RNA, 64 nt, hsa; identical to SEQ ID NO: 156277

SEQ ID NO: 717002 - RNA, 64 nt, hsa; identical to SEQ ID NO: 156278

SEQ ID NO: 717003 - RNA, 64 nt, hsa; identical to SEQ ID NO: 156279

SEQ ID NO: 717004 - RNA, 64 nt, hsa; identical to SEQ ID NO: 156280

SEQ ID NO: 717005 - RNA, 64 nt, hsa; identical to SEQ ID NO: 156281

SEQ ID NO: 717006 - RNA, 64 nt, hsa; identical to SEQ ID NO: 156282

SEQ ID NO: 717007 - RNA, 64 nt, hsa; identical to SEQ ID NO: 156283

SEQ ID NO: 717008 - RNA, 64 nt, hsa; identical to SEQ ID NO: 156284

SEQ ID NO: 717009 - RNA, 64 nt, hsa; identical to SEQ ID NO: 156285

SEQ ID NO: 717010 - RNA, 64 nt, hsa; identical to SEQ ID NO: 156286

SEQ ID NO: 717011 - RNA, 64 nt, hsa; identical to SEQ ID NO: 156287

SEQ ID NO: 717012 - RNA, 64 nt, hsa; identical to SEQ ID NO: 167467

SEQ ID NO: 717013 - RNA, 64 nt, hsa; identical to SEQ ID NO: 167468

SEQ ID NO: 717014 - RNA, 64 nt, hsa; identical to SEQ ID NO: 167469

SEQ ID NO: 717015 - RNA, 64 nt, hsa; identical to SEQ ID NO: 167470

SEQ ID NO: 717016 - RNA, 64 nt, hsa; identical to SEQ ID NO: 167471

SEQ ID NO: 717017 - RNA, 64 nt, hsa; identical to SEQ ID NO: 167472

SEQ ID NO: 717018 - RNA, 64 nt, hsa; identical to SEQ ID NO: 358154

SEQ ID NO: 717019 - RNA, 64 nt, hsa; identical to SEQ ID NO: 358155

SEQ ID NO: 717020 - RNA, 64 nt, hsa; identical to SEQ ID NO: 358156

SEQ ID NO: 717021 - RNA, 64 nt, hsa; identical to SEQ ID NO: 358157

SEQ ID NO: 717022 - RNA, 64 nt, hsa; identical to SEQ ID NO: 358158

SEQ ID NO: 717023 - RNA, 64 nt, hsa; identical to SEQ ID NO: 358159

SEQ ID NO: 717024 - RNA, 64 nt, hsa; identical to SEQ ID NO: 358160

SEQ ID NO: 717025 - RNA, 64 nt, hsa; identical to SEQ ID NO: 358161

SEQ ID NO: 717026 - RNA, 64 nt, hsa; identical to SEQ ID NO: 358162

SEQ ID NO: 717027 - RNA, 64 nt, hsa; identical to SEQ ID NO: 358163

SEQ ID NO: 717028 - RNA, 64 nt, hsa; identical to SEQ ID NO: 358164

SEQ ID NO: 717029 - RNA, 64 nt, hsa; identical to SEQ ID NO: 358165

SEQ ID NO: 717030 - RNA, 64 nt, hsa; identical to SEQ ID NO: 358166

SEQ ID NO: 717031 - RNA, 64 nt, hsa; identical to SEQ ID NO: 358167

SEQ ID NO: 717032 - RNA, 64 nt, hsa; identical to SEQ ID NO: 358168

SEQ ID NO: 717033 - RNA, 64 nt, hsa; identical to SEQ ID NO: 358169

SEQ ID NO: 717034 - RNA, 64 nt, hsa; identical to SEQ ID NO: 358170

SEQ ID NO: 717035 - RNA, 64 nt, hsa; identical to SEQ ID NO: 358171

SEQ ID NO: 717036 - RNA, 64 nt, hsa; identical to SEQ ID NO: 358172

SEQ ID NO: 717037 - RNA, 56 nt, hsa; identical to SEQ ID NO: 358173

SEQ ID NO: 717038 - RNA, 64 nt, hsa; identical to SEQ ID NO: 358174

SEQ ID NO: 717039 - RNA, 64 nt, hsa; identical to SEQ ID NO: 358175

SEQ ID NO: 717040 - RNA, 64 nt, hsa; identical to SEQ ID NO: 358176

SEQ ID NO: 717041 - RNA, 64 nt, hsa; identical to SEQ ID NO: 358177

SEQ ID NO: 717042 - RNA, 64 nt, hsa; identical to SEQ ID NO: 358178

SEQ ID NO: 717043 - RNA, 64 nt, hsa; identical to SEQ ID NO: 358179

SEQ ID NO: 717044 - RNA, 64 nt, hsa; identical to SEQ ID NO: 358180

SEQ ID NO: 717045 - RNA, 64 nt, hsa; identical to SEQ ID NO: 358181

SEQ ID NO: 717046 - RNA, 64 nt, hsa; identical to SEQ ID NO: 358182

SEQ ID NO: 717047 - RNA, 64 nt, hsa; identical to SEQ ID NO: 358183

SEQ ID NO: 717048 - RNA, 64 nt, hsa; identical to SEQ ID NO: 358184

SEQ ID NO: 717049 - RNA, 64 nt, hsa; identical to SEQ ID NO: 358185

SEQ ID NO: 717050 - RNA, 64 nt, hsa; identical to SEQ ID NO: 358186

SEQ ID NO: 717051 - RNA, 64 nt, hsa; identical to SEQ ID NO: 358187

SEQ ID NO: 717052 - RNA, 64 nt, hsa; identical to SEQ ID NO: 358188

SEQ ID NO: 717053 - RNA, 64 nt, hsa; identical to SEQ ID NO: 358189

SEQ ID NO: 717054 - RNA, 64 nt, hsa; identical to SEQ ID NO: 358190

SEQ ID NO: 717055 - RNA, 64 nt, hsa; identical to SEQ ID NO: 358191

SEQ ID NO: 717056 - RNA, 64 nt, hsa; identical to SEQ ID NO: 358192

SEQ ID NO: 717057 - RNA, 64 nt, hsa; identical to SEQ ID NO: 358193

SEQ ID NO: 717058 - RNA, 64 nt, hsa; identical to SEQ ID NO: 358194

SEQ ID NO: 717059 - RNA, 64 nt, hsa; identical to SEQ ID NO: 95478

SEQ ID NO: 717060 - RNA, 64 nt, hsa; identical to SEQ ID NO: 95479

SEQ ID NO: 717061 - RNA, 64 nt, hsa; identical to SEQ ID NO: 95480

SEQ ID NO: 717062 - RNA, 64 nt, hsa; identical to SEQ ID NO: 95481

SEQ ID NO: 717063 - RNA, 64 nt, hsa; identical to SEQ ID NO: 95482

SEQ ID NO: 717064 - RNA, 64 nt, hsa; identical to SEQ ID NO: 95483

SEQ ID NO: 717065 - RNA, 64 nt, hsa; identical to SEQ ID NO: 95484

SEQ ID NO: 717066 - RNA, 64 nt, hsa; identical to SEQ ID NO: 95485

SEQ ID NO: 717067 - RNA, 64 nt, hsa; identical to SEQ ID NO: 95486

SEQ ID NO: 717068 - RNA, 64 nt, hsa; identical to SEQ ID NO: 95487

SEQ ID NO: 717069 - RNA, 64 nt, hsa; identical to SEQ ID NO: 95488

SEQ ID NO: 717070 - RNA, 64 nt, hsa; identical to SEQ ID NO: 95489

SEQ ID NO: 717071 - RNA, 64 nt, hsa; identical to SEQ ID NO: 95490

SEQ ID NO: 717072 - RNA, 64 nt, hsa; identical to SEQ ID NO: 95491

SEQ ID NO: 717073 - RNA, 64 nt, hsa; identical to SEQ ID NO: 95492

SEQ ID NO: 717074 - RNA, 64 nt, hsa; identical to SEQ ID NO: 95493

SEQ ID NO: 717075 - RNA, 64 nt, hsa; identical to SEQ ID NO: 95494

SEQ ID NO: 717076 - RNA, 64 nt, hsa; identical to SEQ ID NO: 95495

SEQ ID NO: 717077 - RNA, 64 nt, hsa; identical to SEQ ID NO: 95496

SEQ ID NO: 717078 - RNA, 64 nt, hsa; identical to SEQ ID NO: 95497

SEQ ID NO: 717079 - RNA, 64 nt, hsa; identical to SEQ ID NO: 95498

SEQ ID NO: 717080 - RNA, 64 nt, hsa; identical to SEQ ID NO: 95499

SEQ ID NO: 717081 - RNA, 64 nt, hsa; identical to SEQ ID NO: 95500

SEQ ID NO: 717082 - RNA, 64 nt, hsa; identical to SEQ ID NO: 95501

SEQ ID NO: 717083 - RNA, 64 nt, hsa; identical to SEQ ID NO: 95502

SEQ ID NO: 717084 - RNA, 64 nt, hsa; identical to SEQ ID NO: 95503

SEQ ID NO: 717085 - RNA, 64 nt, hsa; identical to SEQ ID NO: 95504

SEQ ID NO: 717086 - RNA, 64 nt, hsa; identical to SEQ ID NO: 95505

SEQ ID NO: 717087 - RNA, 64 nt, hsa; identical to SEQ ID NO: 95506

SEQ ID NO: 717088 - RNA, 64 nt, hsa; identical to SEQ ID NO: 95507

SEQ ID NO: 717089 - RNA, 64 nt, hsa; identical to SEQ ID NO: 95508

SEQ ID NO: 717090 - RNA, 64 nt, hsa; identical to SEQ ID NO: 95509

SEQ ID NO: 717091 - RNA, 64 nt, hsa; identical to SEQ ID NO: 95510

SEQ ID NO: 717092 - RNA, 64 nt, hsa; identical to SEQ ID NO: 95511

SEQ ID NO: 717093 - RNA, 64 nt, hsa; identical to SEQ ID NO: 95512

SEQ ID NO: 717094 - RNA, 64 nt, hsa; identical to SEQ ID NO: 95513

SEQ ID NO: 717095 - RNA, 64 nt, hsa; identical to SEQ ID NO: 95514

SEQ ID NO: 717096 - RNA, 64 nt, hsa; identical to SEQ ID NO: 95515

SEQ ID NO: 717097 - RNA, 64 nt, hsa; identical to SEQ ID NO: 95516

SEQ ID NO: 717098 - RNA, 64 nt, hsa; identical to SEQ ID NO: 95517

SEQ ID NO: 717099 - RNA, 64 nt, hsa; identical to SEQ ID NO: 95518

SEQ ID NO: 717100 - RNA, 64 nt, hsa; identical to SEQ ID NO: 95519

SEQ ID NO: 717101 - RNA, 64 nt, hsa; identical to SEQ ID NO: 95520

SEQ ID NO: 717102 - RNA, 64 nt, hsa; identical to SEQ ID NO: 95521

SEQ ID NO: 717103 - RNA, 64 nt, hsa; identical to SEQ ID NO: 95522

SEQ ID NO: 717104 - RNA, 64 nt, hsa; identical to SEQ ID NO: 95523

SEQ ID NO: 717105 - RNA, 64 nt, hsa; identical to SEQ ID NO: 95524

SEQ ID NO: 717106 - RNA, 64 nt, hsa; identical to SEQ ID NO: 95525

SEQ ID NO: 717107 - RNA, 64 nt, hsa; identical to SEQ ID NO: 130466

SEQ ID NO: 717108 - RNA, 64 nt, hsa; identical to SEQ ID NO: 130467

SEQ ID NO: 717109 - RNA, 64 nt, hsa; identical to SEQ ID NO: 130468

SEQ ID NO: 717110 - RNA, 64 nt, hsa; identical to SEQ ID NO: 130469

SEQ ID NO: 717111 - RNA, 64 nt, hsa; identical to SEQ ID NO: 130470

SEQ ID NO: 717112 - RNA, 64 nt, hsa; identical to SEQ ID NO: 130471

SEQ ID NO: 717113 - RNA, 64 nt, hsa; identical to SEQ ID NO: 130472

SEQ ID NO: 717114 - RNA, 64 nt, hsa; identical to SEQ ID NO: 130473

SEQ ID NO: 717115 - RNA, 64 nt, hsa; identical to SEQ ID NO: 130474

SEQ ID NO: 717116 - RNA, 64 nt, hsa; identical to SEQ ID NO: 130475

SEQ ID NO: 717117 - RNA, 64 nt, hsa; identical to SEQ ID NO: 130476

SEQ ID NO: 717118 - RNA, 64 nt, hsa; identical to SEQ ID NO: 130477

SEQ ID NO: 717119 - RNA, 64 nt, hsa; identical to SEQ ID NO: 130478

SEQ ID NO: 717120 - RNA, 64 nt, hsa; identical to SEQ ID NO: 130479

SEQ ID NO: 717121 - RNA, 64 nt, hsa; identical to SEQ ID NO: 130480

SEQ ID NO: 717122 - RNA, 64 nt, hsa; identical to SEQ ID NO: 130481

SEQ ID NO: 717123 - RNA, 64 nt, hsa; identical to SEQ ID NO: 130482

SEQ ID NO: 717124 - RNA, 64 nt, hsa; identical to SEQ ID NO: 130483

SEQ ID NO: 717125 - RNA, 64 nt, hsa; identical to SEQ ID NO: 130484

SEQ ID NO: 717126 - RNA, 64 nt, hsa; identical to SEQ ID NO: 130485

SEQ ID NO: 717127 - RNA, 64 nt, hsa; identical to SEQ ID NO: 130486

SEQ ID NO: 717128 - RNA, 64 nt, hsa; identical to SEQ ID NO: 130487

SEQ ID NO: 717129 - RNA, 64 nt, hsa; identical to SEQ ID NO: 130488

SEQ ID NO: 717130 - RNA, 64 nt, hsa; identical to SEQ ID NO: 130489

SEQ ID NO: 717131 - RNA, 64 nt, hsa; identical to SEQ ID NO: 130490

SEQ ID NO: 717132 - RNA, 64 nt, hsa; identical to SEQ ID NO: 130491

SEQ ID NO: 717133 - RNA, 64 nt, hsa; identical to SEQ ID NO: 432969

SEQ ID NO: 717134 - RNA, 64 nt, hsa; identical to SEQ ID NO: 432970

SEQ ID NO: 717135 - RNA, 64 nt, hsa; identical to SEQ ID NO: 432971

SEQ ID NO: 717136 - RNA, 64 nt, hsa; identical to SEQ ID NO: 432972

SEQ ID NO: 717137 - RNA, 64 nt, hsa; identical to SEQ ID NO: 432973

SEQ ID NO: 717138 - RNA, 64 nt, hsa; identical to SEQ ID NO: 432974

SEQ ID NO: 717139 - RNA, 64 nt, hsa; identical to SEQ ID NO: 432975

SEQ ID NO: 717140 - RNA, 64 nt, hsa; identical to SEQ ID NO: 432976

SEQ ID NO: 717141 - RNA, 64 nt, hsa; identical to SEQ ID NO: 432977

SEQ ID NO: 717142 - RNA, 64 nt, hsa; identical to SEQ ID NO: 432978

SEQ ID NO: 717143 - RNA, 64 nt, hsa; identical to SEQ ID NO: 432979

SEQ ID NO: 717144 - RNA, 64 nt, hsa; identical to SEQ ID NO: 432980

SEQ ID NO: 717145 - RNA, 64 nt, hsa; identical to SEQ ID NO: 432981

SEQ ID NO: 717146 - RNA, 64 nt, hsa; identical to SEQ ID NO: 432982

SEQ ID NO: 717147 - RNA, 64 nt, hsa; identical to SEQ ID NO: 432983

SEQ ID NO: 717148 - RNA, 64 nt, hsa; identical to SEQ ID NO: 432984

SEQ ID NO: 717149 - RNA, 64 nt, hsa; identical to SEQ ID NO: 432985

SEQ ID NO: 717150 - RNA, 64 nt, hsa; identical to SEQ ID NO: 432986

SEQ ID NO: 717151 - RNA, 64 nt, hsa; identical to SEQ ID NO: 432987

SEQ ID NO: 717152 - RNA, 64 nt, hsa; identical to SEQ ID NO: 432988

SEQ ID NO: 717153 - RNA, 64 nt, hsa; identical to SEQ ID NO: 432989

SEQ ID NO: 717154 - RNA, 64 nt, hsa; identical to SEQ ID NO: 432990

SEQ ID NO: 717155 - RNA, 64 nt, hsa; identical to SEQ ID NO: 432991

SEQ ID NO: 717156 - RNA, 64 nt, hsa; identical to SEQ ID NO: 432992

SEQ ID NO: 717157 - RNA, 64 nt, hsa; identical to SEQ ID NO: 432993

SEQ ID NO: 717158 - RNA, 64 nt, hsa; identical to SEQ ID NO: 432994

SEQ ID NO: 717159 - RNA, 64 nt, hsa; identical to SEQ ID NO: 432995

SEQ ID NO: 717160 - RNA, 64 nt, hsa; identical to SEQ ID NO: 432996

SEQ ID NO: 717161 - RNA, 64 nt, hsa; identical to SEQ ID NO: 432997

SEQ ID NO: 717162 - RNA, 64 nt, hsa; identical to SEQ ID NO: 154777

SEQ ID NO: 717163 - RNA, 64 nt, hsa; identical to SEQ ID NO: 154778

SEQ ID NO: 717164 - RNA, 64 nt, hsa; identical to SEQ ID NO: 154779

SEQ ID NO: 717165 - RNA, 64 nt, hsa; identical to SEQ ID NO: 154780

SEQ ID NO: 717166 - RNA, 64 nt, hsa; identical to SEQ ID NO: 154781

SEQ ID NO: 717167 - RNA, 64 nt, hsa; identical to SEQ ID NO: 154782

SEQ ID NO: 717168 - RNA, 64 nt, hsa; identical to SEQ ID NO: 154783

SEQ ID NO: 717169 - RNA, 64 nt, hsa; identical to SEQ ID NO: 154784

SEQ ID NO: 717170 - RNA, 64 nt, hsa; identical to SEQ ID NO: 154785

SEQ ID NO: 717171 - RNA, 64 nt, hsa; identical to SEQ ID NO: 154786

SEQ ID NO: 717172 - RNA, 64 nt, hsa; identical to SEQ ID NO: 154787

SEQ ID NO: 717173 - RNA, 64 nt, hsa; identical to SEQ ID NO: 154788

SEQ ID NO: 717174 - RNA, 64 nt, hsa; identical to SEQ ID NO: 154789

SEQ ID NO: 717175 - RNA, 64 nt, hsa; identical to SEQ ID NO: 154790

SEQ ID NO: 717176 - RNA, 64 nt, hsa; identical to SEQ ID NO: 154791

SEQ ID NO: 717177 - RNA, 64 nt, hsa; identical to SEQ ID NO: 154792

SEQ ID NO: 717178 - RNA, 64 nt, hsa; identical to SEQ ID NO: 154793

SEQ ID NO: 717179 - RNA, 64 nt, hsa; identical to SEQ ID NO: 154794

SEQ ID NO: 717180 - RNA, 64 nt, hsa; identical to SEQ ID NO: 154795

SEQ ID NO: 717181 - RNA, 64 nt, hsa; identical to SEQ ID NO: 154796

SEQ ID NO: 717182 - RNA, 64 nt, hsa; identical to SEQ ID NO: 154797

SEQ ID NO: 717183 - RNA, 64 nt, hsa; identical to SEQ ID NO: 154798

SEQ ID NO: 717184 - RNA, 64 nt, hsa; identical to SEQ ID NO: 154799

SEQ ID NO: 717185 - RNA, 64 nt, hsa; identical to SEQ ID NO: 154800

SEQ ID NO: 717186 - RNA, 64 nt, hsa
gggagagguguucgguuuccccagccuguuaaugaacagccauacguguaagcuuuuucuugag

SEQ ID NO: 717187 - RNA, 64 nt, hsa
aaauaguaagcugguuuagaaacugacgagggcaaacagccaggacgcauuggagaggaauuug

SEQ ID NO: 717188 - RNA, 64 nt, hsa
augugccaaggugggguauuuaccacagcagcugaacagccaaaugcauggugcaguugacagc

SEQ ID NO: 717189 - RNA, 64 nt, hsa
gagaauuuaaaaauaagaaaauacauaagaccauaacagccaacagguggcaggaccaggacua

SEQ ID NO: 717190 - RNA, 64 nt, hsa
gguauucaaaaaugaauaacagccaaaaaugaauaacagccauuugauuuauguuucccucagu

SEQ ID NO: 717191 - RNA, 64 nt, hsa
aagcaguaauauuaacugguauucaaaaaugaauaacagccaaaaaugaauaacagccauuuga

SEQ ID NO: 717192 - RNA, 64 nt, hsa
cuccccuuggccaggacaugcugcugcuacugcuaacagccaauuuuauagacagagaaaguau

SEQ ID NO: 717193 - RNA, 64 nt, hsa
gaugugccugucacccccauuggacaagcuggggaacagccauagggggaccagcuucugccag

SEQ ID NO: 717194 - RNA, 64 nt, hsa
ggcgucagcaucuugacuuuuccccagcaucacaaacagccauuuccucgggcaccaaaguagg

SEQ ID NO: 717195 - RNA, 64 nt, hsa
ccccaucuucauguuacaaaccuggaaaggcuagaacagccauuaggcgucagcaucuugacuu

SEQ ID NO: 717196 - RNA, 64 nt, hsa
gagccauguaggaaaugcacugauugcauguuauuguggcaagaauauccuaaaugucauuaaa

SEQ ID NO: 717197 - RNA, 64 nt, hsa
aaugagcauuugaaauagauaauccuuuaagccuuguggcaaaauuuuuguggcuuuuguuuaa

SEQ ID NO: 717198 - RNA, 64 nt, hsa
ucauacuugagagaaauccuacaaauguaaagaauguggcaaaccuuuggaugauccacaaacc

SEQ ID NO: 717199 - RNA, 64 nt, hsa
caugcuggagggaagcccuacacauguggcagaauguggcaaagcauuuaauugguccucaaug

SEQ ID NO: 717200 - RNA, 64 nt, hsa
auucaugcuggagagaaacuucacaugugaaccguguggcaaagccuuuaaaugguccucaacc

SEQ ID NO: 717201 - RNA, 64 nt, hsa
uuauaccagagagaaacccuacacauguaaagaauguggcaaagccuucaauagguucucaacc

SEQ ID NO: 717202 - RNA, 64 nt, hsa
ugauauuggugagaagccacaaaaauaugaaaaauguggcaaagccuucaaaugcuugucacau

SEQ ID NO: 717203 - RNA, 64 nt, hsa
uucguacuggagagaauccuacaaaugugaaaaauguggcaaauccuuuaacugauccucaacu

SEQ ID NO: 717204 - RNA, 64 nt, hsa
ucauacuggagaaaagccauacaaaugagaagaauguggcaaugccuuuaaucaguccucacac

SEQ ID NO: 717205 - RNA, 64 nt, hsa
uuauacuggagaggaacucuauaguugugaagaauguggcaaagcuuuuaaccaauccucauac

SEQ ID NO: 717206 - RNA, 64 nt, hsa
ucauacuggagagaaagccuacaauugugaagaauguggcaaagcuuuuaaccuuccuuaaccc

SEQ ID NO: 717207 - RNA, 64 nt, hsa
ucauacuggaaagaaacccuacaaaugugaagucuguggcaaagcuuuuaacugauucucaacu

SEQ ID NO: 717208 - RNA, 64 nt, hsa
uauacuuugagagaaacccugcaaaugugaauaauguggcaauacuuuaaaccaauccucaaac

SEQ ID NO: 717209 - RNA, 64 nt, hsa
ccauacugaagaaaacuccuggaaguguaaaaaauguggcaacacuuuuaauaaaugcucaccc

SEQ ID NO: 717210 - RNA, 64 nt, hsa
uuacacuagagagaaagccuacaaaugugaagaauguggcaaagccuuuaaccaguuuucaacc

SEQ ID NO: 717211 - RNA, 64 nt, hsa
ucacaguggagaaaaacccuacaaaugugaagaauguggcaaagcuuuuaaccaguccucacac

SEQ ID NO: 717212 - RNA, 64 nt, hsa
ucauaguaaagagaaacccuacaaaugugaacaguguggcaaggucuuuaagaaguccucaacu

SEQ ID NO: 717213 - RNA, 64 nt, hsa
ucauacuggagagaaaccuuacaaaugugaggaauguggcaaagguuuuagccaacucucaaac

SEQ ID NO: 717214 - RNA, 64 nt, hsa
ucaaacuggagagaaacucuacaaaugugaagaauguggcaaagcuuuuaaccaagucucaaca

SEQ ID NO: 717215 - RNA, 64 nt, hsa
ucauacuggagagaaaccuuacaagugugaagaauguggcaaaacuucuaaccauuucucaacc

SEQ ID NO: 717216 - RNA, 64 nt, hsa
ucauacugaagagaaacaguacaaaugugaugaauguggcaaagcuucuaccugauccucaaaa

SEQ ID NO: 717217 - RNA, 64 nt, hsa
ucauacuggagagaaacccuacaaaugugaagaauguggcaaagcuuuuaaccaaucuucaaca

SEQ ID NO: 717218 - RNA, 64 nt, hsa
gacucuucuuggagauuuucacuugguccuagaauguggcaacguaguugugcucgccagaacg

SEQ ID NO: 717219 - RNA, 64 nt, hsa
ugaguaugcugacaccagaaacucagagccagcuuguggcaagcaguugggguggggggucucu

SEQ ID NO: 717220 - RNA, 64 nt, hsa
aaugcuacugaaacuuaccugagaaccauaggacuguggcaaacaaaaccaauucaugaaguga

SEQ ID NO: 717221 - RNA, 64 nt, hsa
ucaucacaauuagggaaugguuaguggucucuacuguggcaaaugccaacuguuggaauucacu

SEQ ID NO: 717222 - RNA, 54 nt, hsa
gagaaacccuacaaaugugaagauuguggcaaagccucuaacccguccugaauu

SEQ ID NO: 717223 - RNA, 64 nt, hsa
ucauacugaagaaaacuucuacaagugugaacaguguggcaaaacuuuuaaugaaugcucacac

SEQ ID NO: 717224 - RNA, 54 nt, hsa
aagagacuguacaaaagugaagaauguggcaaaggccuuuacugcuccuauucc

SEQ ID NO: 717225 - RNA, 64 nt, hsa
aggccuuuacugcuccuauucccuuacuaaagaauguggcaaagcuuuucaccaguacuuuacc

SEQ ID NO: 717226 - RNA, 64 nt, hsa
uaaugcuggagagaaacccuacaaaugugaagaauguggcaaagauuucuauugauucucauac

SEQ ID NO: 717227 - RNA, 64 nt, hsa
ucauauuggagagaaauucuacagaugugaagaauguggcaaaggcuuuaauuaguucucaucc

SEQ ID NO: 717228 - RNA, 64 nt, hsa
ucauaaaggagauaaauuauacaaaugugaagaauguggcaaagcuuuuaacaaauccucaucc

SEQ ID NO: 717229 - RNA, 64 nt, hsa
ucauacuggagagaaaaccuacaaaugugaggaauguggcaaagccuuuagccugucccuccaa

SEQ ID NO: 717230 - RNA, 64 nt, hsa
uuauacuggagagaagcccuacaaaugugaaaaauguggcaaaccuuuuaaccaauccucaacc

SEQ ID NO: 717231 - RNA, 64 nt, hsa
ucaugcuggagagaaacccuacaaaugugaaaaauguggcaaagcuuuuaaccaauuuucaaac

SEQ ID NO: 717232 - RNA, 64 nt, hsa
ucauacuggagaaaaaucuuacaaaugugaagaauguggcaaagccuuuauccaguccucaacu

SEQ ID NO: 717233 - RNA, 64 nt, hsa
uaaugauggagagaaaccauacaacugugaagaauguggcaaagcuuuuaaccaguccucaaac

SEQ ID NO: 717234 - RNA, 64 nt, hsa
ucauauuggaaaaauuuccuacaaguaagaacaauguggcaaaguuuuuaacuaauacaccuua

SEQ ID NO: 717235 - RNA, 51 nt, hsa
guaccuuacagauggaaugaauguggcaaaaucuuuaguuagaauucacac

SEQ ID NO: 717236 - RNA, 64 nt, hsa
ggacucaggagaaaaaccuuacaaauaucauaaauguggcaaagaauuuaguuugcauugaagc

SEQ ID NO: 717237 - RNA, 64 nt, hsa
ucauacuggagagaaaccuuacaaguguaaugaguguggcaaagccuuuagugaccagucaaca

SEQ ID NO: 717238 - RNA, 64 nt, hsa
ccauaaugaagagagaucuuccgaguguaauaaauguggcaaauuuuucagacaucguucauac

SEQ ID NO: 717239 - RNA, 64 nt, hsa
ucauacuggagagaaaccuuacaaaugucaugacuguggcaaggucuucagucaagcuucaucc

SEQ ID NO: 717240 - RNA, 64 nt, hsa
cccuacuggagagaaaucuuacaaaugucaucaguguggcaaggucuucaguccgaggucacuc

SEQ ID NO: 717241 - RNA, 64 nt, hsa
uucuuacuagaaaaacucuuacaagugugaagaauguggcaaaauuuuuaaugaauacucacac

SEQ ID NO: 717242 - RNA, 64 nt, hsa
ucauacuagagagaaacccuacaaauguaaagaauguggcaaagcauuuaacuggucccuaaau

SEQ ID NO: 717243 - RNA, 64 nt, hsa
ucauacuggagagaaauccuacaaaugugauaaauguggcaaagccuuuaacuggcucuuaauc

SEQ ID NO: 717244 - RNA, 64 nt, hsa
guucuuuguuaaaaaaaaaauuagauucuuaaaguguggcaaacauaaaauuugcaagaaaaug

SEQ ID NO: 717245 - RNA, 54 nt, hsa
gagaaacccuacaaaugugaaaaauguggcaaagccuuuuaccaguccucaacu

SEQ ID NO: 717246 - RNA, 64 nt, hsa
ucauacuggagggaauuccuauaauuguguggaauguggcaaagccuuuaaccaguccuuaagg

SEQ ID NO: 717247 - RNA, 64 nt, hsa
uuauacaggagggaaacccuacaaaugugaagaauguggcaagccuuuuagcuguuccucaauc

SEQ ID NO: 717248 - RNA, 64 nt, hsa
ucauacuggagagaaaaucuacaaaggugaagaauguggcaaagcuuuuaaacaguccucaauc

SEQ ID NO: 717249 - RNA, 64 nt, hsa
ucuugcuggugagaaaccuaacaaauguaaugaauguggcaaggucuucuggcacaauucucac

SEQ ID NO: 717250 - RNA, 64 nt, hsa
ccauagaggacagaaacuuuacuaauguacugaauguggcaaggucuuaagguaaaaucugaga

SEQ ID NO: 717251 - RNA, 64 nt, hsa
cuauacuggacagaaaucuuacaaaugucaucaguguggcaaggucuucaguccaagaucacuc

SEQ ID NO: 717252 - RNA, 64 nt, hsa
uuauacaggagagaaaccucacaagugugaugauuguggcaaagccuuugcuucacguucacac

SEQ ID NO: 717253 - RNA, 64 nt, hsa
ccauaaugaagagagaucuuacaaguguaauaaauguggcaaauuuuucagagaucguucacau

SEQ ID NO: 717254 - RNA, 64 nt, hsa
ucacacuggagagaaaccuuacaaguguaaugaguguggcaaagccuuuggcaagcagucaaca

SEQ ID NO: 717255 - RNA, 64 nt, hsa
cccuacuggacagaaaucuuacaaaugucagaaguguggcaaggucuugaguccgaggucacuc

SEQ ID NO: 717256 - RNA, 64 nt, hsa
ucauacaggagagaaaccucacaugugugaugauuguggcaaagccuuuacuucauguucacac

SEQ ID NO: 717257 - RNA, 64 nt, hsa; identical to SEQ ID NO: 717239

SEQ ID NO: 717258 - RNA, 64 nt, hsa
cuauaaugaauaaagaucuaacaaguguaauaaauguggcaaauuuuucagacaucauucauac

SEQ ID NO: 717259 - RNA, 64 nt, hsa
uucauacaggagagaaacucacaagugugaugauuguggcaaagcguuuacuucacauucacac

SEQ ID NO: 717260 - RNA, 64 nt, hsa
ucaugcuggagagaaaccuuauaaaugucaugauuguggcaaggucuucagucaaguuucaucc

SEQ ID NO: 717261 - RNA, 64 nt, hsa
ucacacuggagagaaaccuuacaagugcaaugaguguggcaaagccuuuagugggcagucacca

SEQ ID NO: 717262 - RNA, 64 nt, hsa
ucaaacuggagagaaaccuuacaaaugugaugaguguggcaacaccuuuggucaaaauucauac

SEQ ID NO: 717263 - RNA, 64 nt, hsa
ucauacuggagagaaacuuuacaaguguaaugaauguggcaagguuuuuaaucaaaaaacaacc

SEQ ID NO: 717264 - RNA, 64 nt, hsa
ucauaguggagagaaaccuuaaaaguguaaugaguguggcaacaccuuccaucacaauucaacc

SEQ ID NO: 717265 - RNA, 62 nt, hsa
auaguggagagaaaccuugaaaguguaaugaguguggcaagaccuucagucagaugucaaac

SEQ ID NO: 717266 - RNA, 64 nt, hsa
ucauacaggagagaaaccucacaagugugaugauuguggcaaagcguuuacuucacauucacac

SEQ ID NO: 717267 - RNA, 64 nt, hsa
auccacagugaagagaucuuacaaguguaauaaauguggcaaauuuuucagacaucguucaugc

SEQ ID NO: 717268 - RNA, 64 nt, hsa
ucacacuggagagaaaccuuacaagugcaaugaguguggcaaacccuuuagugggcagucacca

SEQ ID NO: 717269 - RNA, 64 nt, hsa
acacuggagagaaacucauuauaaguguaaugaguguggcaagaccguuggucaaaauucacac

SEQ ID NO: 717270 - RNA, 64 nt, hsa
ucauacuggagagaaaccuuacaagcauaaugaauguggcaagguuuuuaaucaaaaagcaacc

SEQ ID NO: 717271 - RNA, 62 nt, hsa
auaguggagagaagccuuaauaguguaaugaguguggcaagaccuuccaucacaauucaacc

SEQ ID NO: 717272 - RNA, 64 nt, hsa
ucaggcuuagacauucauggauaugcuuuucuuucauuaggaacauuuugcuggugaugaggaa

SEQ ID NO: 717273 - RNA, 64 nt, hsa
augaaaucuguuacucuacaaggaagguguucaucauuaggaggcagcuuuacuaagcuggugc

SEQ ID NO: 717274 - RNA, 64 nt, hsa
agaaauuauaccucaccaguauauaggagaguaccauuaggaauucuuaaugggaugaaaaccu

SEQ ID NO: 717275 - RNA, 64 nt, hsa
ucaguuaauacgugauagcuggagcgugacauuucauuaggaacagugaggcuaguugagaaau

SEQ ID NO: 717276 - RNA, 64 nt, hsa
uaaagauuugaaagagaaucucauauucccgaggcauuaggaagaaaggauuuaaucccuucaa

SEQ ID NO: 717277 - RNA, 64 nt, hsa
uguauuuaaaucauugcuauaauaaaguuaaguucauuaggaauauaaaaacuugcaguucuau

SEQ ID NO: 717278 - RNA, 64 nt, hsa
acuaauugaucguuuaaggcauaagauggucuagcauuaggaacaugugaagcuaaucugcuca

SEQ ID NO: 717279 - RNA, 64 nt, hsa
ucuuccugaugucacagccugagcauacucugugcauuaggaagaccugagugcauuucccacc

SEQ ID NO: 717280 - RNA, 64 nt, hsa; identical to SEQ ID NO: 250605

SEQ ID NO: 717281 - RNA, 64 nt, hsa; identical to SEQ ID NO: 250606

SEQ ID NO: 717282 - RNA, 64 nt, hsa; identical to SEQ ID NO: 250607

SEQ ID NO: 717283 - RNA, 64 nt, hsa; identical to SEQ ID NO: 250608

SEQ ID NO: 717284 - RNA, 64 nt, hsa; identical to SEQ ID NO: 250609

SEQ ID NO: 717285 - RNA, 64 nt, hsa; identical to SEQ ID NO: 250610

SEQ ID NO: 717286 - RNA, 64 nt, hsa; identical to SEQ ID NO: 84778

SEQ ID NO: 717287 - RNA, 64 nt, hsa; identical to SEQ ID NO: 84779

SEQ ID NO: 717288 - RNA, 64 nt, hsa; identical to SEQ ID NO: 84780

SEQ ID NO: 717289 - RNA, 64 nt, hsa; identical to SEQ ID NO: 84781

SEQ ID NO: 717290 - RNA, 64 nt, hsa; identical to SEQ ID NO: 84782

SEQ ID NO: 717291 - RNA, 64 nt, hsa; identical to SEQ ID NO: 84783

SEQ ID NO: 717292 - RNA, 64 nt, hsa; identical to SEQ ID NO: 84784

SEQ ID NO: 717293 - RNA, 64 nt, hsa; identical to SEQ ID NO: 84785

SEQ ID NO: 717294 - RNA, 64 nt, hsa; identical to SEQ ID NO: 84786

SEQ ID NO: 717295 - RNA, 64 nt, hsa; identical to SEQ ID NO: 84787

SEQ ID NO: 717296 - RNA, 64 nt, hsa; identical to SEQ ID NO: 84788

SEQ ID NO: 717297 - RNA, 64 nt, hsa; identical to SEQ ID NO: 84789

SEQ ID NO: 717298 - RNA, 64 nt, hsa; identical to SEQ ID NO: 47705

SEQ ID NO: 717299 - RNA, 64 nt, hsa; identical to SEQ ID NO: 47706

SEQ ID NO: 717300 - RNA, 64 nt, hsa; identical to SEQ ID NO: 47707

SEQ ID NO: 717301 - RNA, 64 nt, hsa; identical to SEQ ID NO: 47708

SEQ ID NO: 717302 - RNA, 64 nt, hsa; identical to SEQ ID NO: 47709

SEQ ID NO: 717303 - RNA, 53 nt, hsa; identical to SEQ ID NO: 47710

SEQ ID NO: 717304 - RNA, 64 nt, hsa; identical to SEQ ID NO: 283920

SEQ ID NO: 717305 - RNA, 64 nt, hsa; identical to SEQ ID NO: 283921

SEQ ID NO: 717306 - RNA, 64 nt, hsa; identical to SEQ ID NO: 283922

SEQ ID NO: 717307 - RNA, 64 nt, hsa; identical to SEQ ID NO: 283923

SEQ ID NO: 717308 - RNA, 64 nt, hsa; identical to SEQ ID NO: 283924

SEQ ID NO: 717309 - RNA, 64 nt, hsa; identical to SEQ ID NO: 283925

SEQ ID NO: 717310 - RNA, 64 nt, hsa; identical to SEQ ID NO: 283926

SEQ ID NO: 717311 - RNA, 64 nt, hsa; identical to SEQ ID NO: 283927

SEQ ID NO: 717312 - RNA, 64 nt, hsa; identical to SEQ ID NO: 283928

SEQ ID NO: 717313 - RNA, 64 nt, hsa; identical to SEQ ID NO: 283929

SEQ ID NO: 717314 - RNA, 64 nt, hsa; identical to SEQ ID NO: 283930

SEQ ID NO: 717315 - RNA, 64 nt, hsa; identical to SEQ ID NO: 283931

SEQ ID NO: 717316 - RNA, 64 nt, hsa; identical to SEQ ID NO: 283932

SEQ ID NO: 717317 - RNA, 64 nt, hsa; identical to SEQ ID NO: 283933

SEQ ID NO: 717318 - RNA, 64 nt, hsa; identical to SEQ ID NO: 283934

SEQ ID NO: 717319 - RNA, 64 nt, hsa; identical to SEQ ID NO: 283935

SEQ ID NO: 717320 - RNA, 64 nt, hsa; identical to SEQ ID NO: 283930

SEQ ID NO: 717321 - RNA, 64 nt, hsa; identical to SEQ ID NO: 283937

SEQ ID NO: 717322 - RNA, 64 nt, hsa; identical to SEQ ID NO: 283938

SEQ ID NO: 717323 - RNA, 64 nt, hsa; identical to SEQ ID NO: 283939

SEQ ID NO: 717324 - RNA, 64 nt, hsa; identical to SEQ ID NO: 283940

SEQ ID NO: 717325 - RNA, 64 nt, hsa; identical to SEQ ID NO: 283941

SEQ ID NO: 717326 - RNA, 64 nt, hsa; identical to SEQ ID NO: 283942

SEQ ID NO: 717327 - RNA, 64 nt, hsa; identical to SEQ ID NO: 283943

SEQ ID NO: 717328 - RNA, 64 nt, hsa; identical to SEQ ID NO: 283944

SEQ ID NO: 717329 - RNA, 60 nt, hsa; identical to SEQ ID NO: 283945

SEQ ID NO: 717330 - RNA, 64 nt, hsa; identical to SEQ ID NO: 283946

SEQ ID NO: 717331 - RNA, 64 nt, hsa; identical to SEQ ID NO: 283947

SEQ ID NO: 717332 - RNA, 64 nt, hsa; identical to SEQ ID NO: 283948

SEQ ID NO: 717333 - RNA, 64 nt, hsa; identical to SEQ ID NO: 283949

SEQ ID NO: 717334 - RNA, 64 nt, hsa; identical to SEQ ID NO: 283950

SEQ ID NO: 717335 - RNA, 64 nt, hsa; identical to SEQ ID NO: 283951

SEQ ID NO: 717336 - RNA, 64 nt, hsa; identical to SEQ ID NO: 283952

SEQ ID NO: 717337 - RNA, 64 nt, hsa; identical to SEQ ID NO: 283953

SEQ ID NO: 717338 - RNA, 64 nt, hsa; identical to SEQ ID NO: 283954

SEQ ID NO: 717339 - RNA, 64 nt, hsa; identical to SEQ ID NO: 283955

SEQ ID NO: 717340 - RNA, 64 nt, hsa; identical to SEQ ID NO: 283956

SEQ ID NO: 717341 - RNA, 64 nt, hsa; identical to SEQ ID NO: 283957

SEQ ID NO: 717342 - RNA, 64 nt, hsa; identical to SEQ ID NO: 283958

SEQ ID NO: 717343 - RNA, 64 nt, hsa; identical to SEQ ID NO: 283959

SEQ ID NO: 717344 - RNA, 64 nt, hsa; identical to SEQ ID NO: 283960

SEQ ID NO: 717345 - RNA, 64 nt, hsa; identical to SEQ ID NO: 283961

SEQ ID NO: 717346 - RNA, 64 nt, hsa; identical to SEQ ID NO: 283962

SEQ ID NO: 717347 - RNA, 64 nt, hsa; identical to SEQ ID NO: 283963

SEQ ID NO: 717348 - RNA, 64 nt, hsa; identical to SEQ ID NO: 283964

SEQ ID NO: 717349 - RNA, 64 nt, hsa; identical to SEQ ID NO: 283965

SEQ ID NO: 717350 - RNA, 64 nt, hsa; identical to SEQ ID NO: 283966

SEQ ID NO: 717351 - RNA, 64 nt, hsa; identical to SEQ ID NO: 283967

SEQ ID NO: 717352 - RNA, 64 nt, hsa; identical to SEQ ID NO: 283968

SEQ ID NO: 717353 - RNA, 64 nt, hsa; identical to SEQ ID NO: 283969

SEQ ID NO: 717354 - RNA, 64 nt, hsa; identical to SEQ ID NO: 283970

SEQ ID NO: 717355 - RNA, 64 nt, hsa; identical to SEQ ID NO: 283971

SEQ ID NO: 717356 - RNA, 64 nt, hsa; identical to SEQ ID NO: 283972

SEQ ID NO: 717357 - RNA, 64 nt, hsa; identical to SEQ ID NO: 283973

SEQ ID NO: 717358 - RNA, 64 nt, hsa; identical to SEQ ID NO: 283974

SEQ ID NO: 717359 - RNA, 64 nt, hsa; identical to SEQ ID NO: 283975

SEQ ID NO: 717360 - RNA, 64 nt, hsa; identical to SEQ ID NO: 283976

SEQ ID NO: 717361 - RNA, 64 nt, hsa; identical to SEQ ID NO: 283977

SEQ ID NO: 717362 - RNA, 64 nt, hsa; identical to SEQ ID NO: 283978

SEQ ID NO: 717363 - RNA, 64 nt, hsa; identical to SEQ ID NO: 283979

SEQ ID NO: 717364 - RNA, 64 nt, hsa; identical to SEQ ID NO: 283980

SEQ ID NO: 717365 - RNA, 64 nt, hsa; identical to SEQ ID NO: 283981

SEQ ID NO: 717366 - RNA, 64 nt, hsa; identical to SEQ ID NO: 283982

SEQ ID NO: 717367 - RNA, 64 nt, hsa; identical to SEQ ID NO: 283983

SEQ ID NO: 717368 - RNA, 64 nt, hsa; identical to SEQ ID NO: 283984

SEQ ID NO: 717369 - RNA, 64 nt, hsa
auggagcaaaacuguauaaacugauuuguaacuaacacuggaccauuggaucgauauuauaugc

SEQ ID NO: 717370 - RNA, 64 nt, hsa
ucacugugaaaaauaacaguccaccccaagucauacacuggacccagugccugcggggacagga

SEQ ID NO: 717371 - RNA, 64 nt, hsa
uuuggcucugguguuuucgccagacaauaaacuuacacuggaagcuuugauucacccuccacag

SEQ ID NO: 717372 - RNA, 64 nt, hsa
uagggcaguggcuauucacagaugugaugauagcacacuggagccucaaacucuuaggcucagg

SEQ ID NO: 717373 - RNA, 64 nt, hsa
cccuuggggaaggguggggagaaauauaggauagacacuggacauggcccauuggagcaccugg

SEQ ID NO: 717374 - RNA, 64 nt, hsa
guggcugcgcccccagcuucucucucccugucacacacuggaccccacuggcugagaaucuggg

SEQ ID NO: 717375 - RNA, 64 nt, hsa
ucagcuugggcuucuuccuccuccaucaccugaaacacuggaccuggggguagccccgccccag

SEQ ID NO: 717376 - RNA, 64 nt, hsa
ucugggacaagaaaaagaaaacacaagaauguauacacuggaagauuugggccuccugccugcc

SEQ ID NO: 717377 - RNA, 64 nt, hsa
gaugaggagguacagacacgugaccuuuuggugcacacuggagcuacuuggacaagaccagcau

SEQ ID NO: 717378 - RNA, 64 nt, hsa
uagggucaauaacccauuauaaaaugaucugauuacacuggacacucuuaggaaguaucaaaau

SEQ ID NO: 717379 - RNA, 64 nt, hsa
caaucagcauuguuauuuaucauuaagguauugaacacuggauugcaugguugaaugugucuuu

SEQ ID NO: 717380 - RNA, 64 nt, hsa
gggucaggaacacuacacugcacaggaagccuucacacuggaagggggaccugcgcccccacau

SEQ ID NO: 717381 - RNA, 64 nt, hsa
cgagcuccagcugccuuaggaggagucacagcauacacuggaacaggagcugggucagccucug

SEQ ID NO: 717382 - RNA, 64 nt, hsa
ucuuaauagguucaaaagcaaucuggucugaauaacacuggauuuguuucugugaucucugagg

SEQ ID NO: 717383 - RNA, 64 nt, hsa
cuugcugauuuucagacagggaagucucucuauuacacuggagcuguuuuauagauaagucaau

SEQ ID NO: 717384 - RNA, 64 nt, hsa
gaagcuucuacgcgcuagagaggaucaaggggccacacuggaccaugugaacagccauccugaa

SEQ ID NO: 717385 - RNA, 64 nt, hsa
ugugaacagccauccugaacugccaucagcuaccacacuggacucugcagggcagccauccugg

SEQ ID NO: 717386 - RNA, 64 nt, hsa
uguguuuaaacaaauguaauauuuuguacaagauacacuggagaacaaagggaacucaagauuc

SEQ ID NO: 717387 - RNA, 64 nt, hsa
ggccccucuggccagggccccuguggcuuccugcacacuggacaggugacuguaugguagagac

SEQ ID NO: 717388 - RNA, 64 nt, hsa
ucugccaagucauuucaaauacaugaaaaaucuuacacuggagagaaacccuaugaguguaagc

SEQ ID NO: 717389 - RNA, 64 nt, hsa
uccuucacuuccuuucgauaucaugaaaggacucacacuggagagaaccccuaugaguguaagc

SEQ ID NO: 717390 - RNA, 64 nt, hsa
ucugucaaaaaucuucgauuucauaaaaggacacacacuggagagaaacccugugaauguaaga

SEQ ID NO: 717391 - RNA, 64 nt, hsa
uugccuacuuccuuucauagacaugaaaagacucacacuggaaggaaacacuaugaaugcaagc

SEQ ID NO: 717392 - RNA, 64 nt, hsa
ucuucuaguucccuucaauaucaugaaaggacucacacuggagagaagcccuaugaauauaagc

SEQ ID NO: 717393 - RNA, 64 nt, hsa
ucagccucgcaccuucaaaugcauggaaggacucacacuggagaaaaacccuaugaauguaagc

SEQ ID NO: 717394 - RNA, 64 nt, hsa
ucugccaaguuauuucaaacacaugaaaaaauucacacuggagagaaacccuauaaaugcaagc

SEQ ID NO: 717395 - RNA, 64 nt, hsa
ucugucaagaaccuuucaauuuaugaaaggacacacacuggagagaaacccuaugaauguaaga

SEQ ID NO: 717396 - RNA, 64 nt, hsa
aucugccaagaucguuugaauacaugcaaaacacacacuggagagaaaccuaugaauguaagga

SEQ ID NO: 717397 - RNA, 64 nt, hsa
ucugccaagucauuucgaagacaugaaaaaacucacacuggagagaaacccuauaaaugcaugc

SEQ ID NO: 717398 - RNA, 64 nt, hsa
cuuuccaguuccuuucaguaucaugaaaggacucacacuggagagaaacccuaugaguguaagc

SEQ ID NO: 717399 - RNA, 64 nt, hsa
aguuccaguuccuuuugguaccaugaaaggacucacacuggagagaaacccuaugaguguaagc

SEQ ID NO: 717400 - RNA, 64 nt, hsa
ucugccccacaccuucgaauccaugguagaacucacacuggagagaaacccuaugaguguaagg

SEQ ID NO: 717401 - RNA, 64 nt, hsa
ucugccaagucauuucaaauaccugaaaaaucuuacacuggagagaaacccuaugaguguaagc

SEQ ID NO: 717402 - RNA, 64 nt, hsa
ucuuucacuucuuuucgauaacaugaaaggacucacacuggagagaaacccuaugaguguaagc

SEQ ID NO: 717403 - RNA, 64 nt, hsa
ucuaccucacaccuucgaaaacaugguaggacucacacuggauagaaaccaaagcaggugaauc

SEQ ID NO: 717404 - RNA, 64 nt, hsa
gguuccagacugguuggacuuguucgucuggacgacacuggaguggaacacugccucccacuuu

SEQ ID NO: 717405 - RNA, 64 nt, hsa
cacuuucuugggacuuggagggagguggaacagcacacuggacuucucccgucucuagggcugc

SEQ ID NO: 717406 - RNA, 64 nt, hsa
caccaacauauuguggcuggacagcaggcaguacacacuggagaaagacugaaugccgugaacg

SEQ ID NO: 717407 - RNA, 64 nt, hsa
uacuacuccacacuacuuagacaucauguaguucacacuggaaaaaggccacguaugugccuug

SEQ ID NO: 717408 - RNA, 64 nt, hsa
gacagcuguacacugaagagucaucagagaguucacacuggagaaagaccuuuugaaugcagca

SEQ ID NO: 717409 - RNA, 64 nt, hsa
uacaacuccagccucauuaaacaucggagaauucacacuggagagagaccuuaucagugcagug

SEQ ID NO: 717410 - RNA, 64 nt, hsa
ggaaauccguuagccacaccuccagucucauucaacacuggacaguuuacaauguggacaaugu

SEQ ID NO: 717411 - RNA, 64 nt, hsa
caaaggccuaacccuauucaacaccagaaaguuuacacuggagaaaggccuuagggugacaggu

SEQ ID NO: 717412 - RNA, 64 nt, hsa
agcuggcaauugaacaucauucaucuaaauaugcacacuggaggcaagaugagaauuccugaca

SEQ ID NO: 717413 - RNA, 64 nt, hsa
cgaaaaucuagccuuauuauacaucugagaguucacacuggagaaaggccuuaugagugcagug

SEQ ID NO: 717414 - RNA, 64 nt, hsa
gaaaacuccagccuuauuaaacacuugagaguucacacuggagaaaggccauaugaaugcauug

SEQ ID NO: 717415 - RNA, 64 nt, hsa
gauguggagguaauauuauuuuuucuucaauauaacacuggaggaaaccccuuaugaggaugcc

SEQ ID NO: 717416 - RNA, 64 nt, hsa
uuccuuacaggcuuucgagugcacaugagaaugcacacuggagagaaaccuuauaaauguaagg

SEQ ID NO: 717417 - RNA, 64 nt, hsa
acucuugcagguuuccagauacaugaaagaacccacacuggagagaaaccuuaugaauguaaac

SEQ ID NO: 717418 - RNA, 64 nt, hsa
ucuccuuuagguuuucaagcacaugaaaguacucacacuggagauaaacccuuugaguguaaaa

SEQ ID NO: 717419 - RNA, 64 nt, hsa
ucuucuguagguuuucaagcacaugaaagaacucacacuggagaaaaacccuaugaauguaaaa

SEQ ID NO: 717420 - RNA, 64 nt, hsa
ugucaacguucuuuccaaauacauggaaggacucacacuggagauaaacccuuuaaguguaaag

SEQ ID NO: 717421 - RNA, 64 nt, hsa
aauuuuuauuccuuucaaaaucaugaaauaucucacacuggagagaugcuguaugauauaagga

SEQ ID NO: 717422 - RNA, 64 nt, hsa
auuuccaguucccuuugauaucaugaauaaacuuacacuggacagaaacccuauaaauguaaau

SEQ ID NO: 717423 - RNA, 64 nt, hsa
cauuuuggucacuuaaagcaacaugaaaggauucacacuggagagaagccguaugaauguaagg

SEQ ID NO: 717424 - RNA, 64 nt, hsa
cauagcucaagcuuucgaagacacaugacaaugcacacuggagauggaccucacaaaaugcaag

SEQ ID NO: 717425 - RNA, 64 nt, hsa
uguuccaguacacugcaaagucaugaaagaacucacacuggagagaagaaacucuaugaaugca

SEQ ID NO: 717426 - RNA, 64 nt, hsa
gauuacaguucuugucuaagacaugaaaaaacucacacuggagagaaacucuguacauguaaac

SEQ ID NO: 717427 - RNA, 64 nt, hsa
aaugauucacacguggcaccccauacuagaauucacacuggagagaaaccuuacaagugcaaug

SEQ ID NO: 717428 - RNA, 64 nt, hsa
ucacaaauccagcuucaaauacauaggagaauucacacuggagaaaagccauagaaauguaagg

SEQ ID NO: 717429 - RNA, 64 nt, hsa
uauaaugcauaucuggcaaaacauacuagaauucacacuggagagaaacucauuauaaguguaa

SEQ ID NO: 717430 - RNA, 64 nt, hsa
uuuuuaacagaacguguauuuauuaauguucaaaacacuggaauuacaaaugagaagagucuac

SEQ ID NO: 717431 - RNA, 64 nt, hsa
uuuuuauuacuuaagacuuuaugggagagauuagacacuggagguuuuuaacagaacguguauu

SEQ ID NO: 717432 - RNA, 64 nt, hsa; identical to SEQ ID NO: 290815

SEQ ID NO: 717433 - RNA, 64 nt, hsa; identical to SEQ ID NO: 290816

SEQ ID NO: 717434 - RNA, 64 nt, hsa; identical to SEQ ID NO: 290817

SEQ ID NO: 717435 - RNA, 64 nt, hsa; identical to SEQ ID NO: 290818

SEQ ID NO: 717436 - RNA, 64 nt, hsa; identical to SEQ ID NO: 290819

SEQ ID NO: 717437 - RNA, 64 nt, hsa; identical to SEQ ID NO: 290820

SEQ ID NO: 717438 - RNA, 64 nt, hsa; identical to SEQ ID NO: 290821

SEQ ID NO: 717439 - RNA, 64 nt, hsa; identical to SEQ ID NO: 290822

SEQ ID NO: 717440 - RNA, 64 nt, hsa; identical to SEQ ID NO: 290823

SEQ ID NO: 717441 - RNA, 64 nt, hsa; identical to SEQ ID NO: 290824

SEQ ID NO: 717442 - RNA, 64 nt, hsa; identical to SEQ ID NO: 290825

SEQ ID NO: 717443 - RNA, 64 nt, hsa; identical to SEQ ID NO: 290826

SEQ ID NO: 717444 - RNA, 64 nt, hsa; identical to SEQ ID NO: 290827

SEQ ID NO: 717445 - RNA, 64 nt, hsa; identical to SEQ ID NO: 290828

SEQ ID NO: 717446 - RNA, 64 nt, hsa; identical to SEQ ID NO: 290829

SEQ ID NO: 717447 - RNA, 64 nt, hsa; identical to SEQ ID NO: 290830

SEQ ID NO: 717448 - RNA, 64 nt, hsa; identical to SEQ ID NO: 290831

SEQ ID NO: 717449 - RNA, 64 nt, hsa; identical to SEQ ID NO: 290832

SEQ ID NO: 717450 - RNA, 64 nt, hsa; identical to SEQ ID NO: 290833

SEQ ID NO: 717451 - RNA, 64 nt, hsa; identical to SEQ ID NO: 290834

SEQ ID NO: 717452 - RNA, 64 nt, hsa; identical to SEQ ID NO: 290835

SEQ ID NO: 717453 - RNA, 64 nt, hsa; identical to SEQ ID NO: 290836

SEQ ID NO: 717454 - RNA, 64 nt, hsa; identical to SEQ ID NO: 290837

SEQ ID NO: 717455 - RNA, 64 nt, hsa; identical to SEQ ID NO: 290838

SEQ ID NO: 717456 - RNA, 64 nt, hsa; identical to SEQ ID NO: 290839

SEQ ID NO: 717457 - RNA, 64 nt, hsa; identical to SEQ ID NO: 290840

SEQ ID NO: 717458 - RNA, 64 nt, hsa; identical to SEQ ID NO: 290841

SEQ ID NO: 717459 - RNA, 64 nt, hsa; identical to SEQ ID NO: 290842

SEQ ID NO: 717460 - RNA, 64 nt, hsa; identical to SEQ ID NO: 290843

SEQ ID NO: 717461 - RNA, 64 nt, hsa; identical to SEQ ID NO: 83829

SEQ ID NO: 717462 - RNA, 64 nt, hsa; identical to SEQ ID NO: 83830

SEQ ID NO: 717463 - RNA, 64 nt, hsa; identical to SEQ ID NO: 83831

SEQ ID NO: 717464 - RNA, 64 nt, hsa; identical to SEQ ID NO: 83832

SEQ ID NO: 717465 - RNA, 64 nt, hsa; identical to SEQ ID NO: 83833

SEQ ID NO: 717466 - RNA, 64 nt, hsa; identical to SEQ ID NO: 83834

SEQ ID NO: 717467 - RNA, 64 nt, hsa; identical to SEQ ID NO: 83835

SEQ ID NO: 717468 - RNA, 64 nt, hsa; identical to SEQ ID NO: 83836

SEQ ID NO: 717469 - RNA, 64 nt, hsa; identical to SEQ ID NO: 83837

SEQ ID NO: 717470 - RNA, 64 nt, hsa; identical to SEQ ID NO: 83838

SEQ ID NO: 717471 - RNA, 64 nt, hsa; identical to SEQ ID NO: 83839

SEQ ID NO: 717472 - RNA, 64 nt, hsa; identical to SEQ ID NO: 83840

SEQ ID NO: 717473 - RNA, 64 nt, hsa; identical to SEQ ID NO: 83841

SEQ ID NO: 717474 - RNA, 64 nt, hsa; identical to SEQ ID NO: 83842

SEQ ID NO: 717475 - RNA, 64 nt, hsa; identical to SEQ ID NO: 83843

SEQ ID NO: 717476 - RNA, 64 nt, hsa; identical to SEQ ID NO: 83844

SEQ ID NO: 717477 - RNA, 64 nt, hsa; identical to SEQ ID NO: 83845

SEQ ID NO: 717478 - RNA, 64 nt, hsa; identical to SEQ ID NO: 83846

SEQ ID NO: 717479 - RNA, 64 nt, hsa; identical to SEQ ID NO: 83847

SEQ ID NO: 717480 - RNA, 64 nt, hsa; identical to SEQ ID NO: 83848

SEQ ID NO: 717481 - RNA, 64 nt, hsa; identical to SEQ ID NO: 83849

SEQ ID NO: 717482 - RNA, 64 nt, hsa; identical to SEQ ID NO: 83850

SEQ ID NO: 717483 - RNA, 64 nt, hsa; identical to SEQ ID NO: 83851

SEQ ID NO: 717484 - RNA, 64 nt, hsa; identical to SEQ ID NO: 83852

SEQ ID NO: 717485 - RNA, 64 nt, hsa; identical to SEQ ID NO: 83853

SEQ ID NO: 717486 - RNA, 64 nt, hsa; identical to SEQ ID NO: 83854

SEQ ID NO: 717487 - RNA, 64 nt, hsa; identical to SEQ ID NO: 83855

SEQ ID NO: 717488 - RNA, 64 nt, hsa; identical to SEQ ID NO: 83856

SEQ ID NO: 717489 - RNA, 64 nt, hsa; identical to SEQ ID NO: 83857

SEQ ID NO: 717490 - RNA, 64 nt, hsa; identical to SEQ ID NO: 83858

SEQ ID NO: 717491 - RNA, 64 nt, hsa; identical to SEQ ID NO: 83859

SEQ ID NO: 717492 - RNA, 64 nt, hsa; identical to SEQ ID NO: 83860

SEQ ID NO: 717493 - RNA, 64 nt, hsa; identical to SEQ ID NO: 83861

SEQ ID NO: 717494 - RNA, 64 nt, hsa; identical to SEQ ID NO: 83862

SEQ ID NO: 717495 - RNA, 64 nt, hsa; identical to SEQ ID NO: 83863

SEQ ID NO: 717496 - RNA, 64 nt, hsa; identical to SEQ ID NO: 83864

SEQ ID NO: 717497 - RNA, 64 nt, hsa; identical to SEQ ID NO: 83865

SEQ ID NO: 717498 - RNA, 64 nt, hsa; identical to SEQ ID NO: 83866

SEQ ID NO: 717499 - RNA, 64 nt, hsa; identical to SEQ ID NO: 83867

SEQ ID NO: 717500 - RNA, 64 nt, hsa; identical to SEQ ID NO: 83868

SEQ ID NO: 717501 - RNA, 64 nt, hsa; identical to SEQ ID NO: 83869

SEQ ID NO: 717502 - RNA, 64 nt, hsa; identical to SEQ ID NO: 83870

SEQ ID NO: 717503 - RNA, 64 nt, hsa; identical to SEQ ID NO: 83871

SEQ ID NO: 717504 - RNA, 64 nt, hsa; identical to SEQ ID NO: 83872

SEQ ID NO: 717505 - RNA, 64 nt, hsa; identical to SEQ ID NO: 83873

SEQ ID NO: 717506 - RNA, 64 nt, hsa; identical to SEQ ID NO: 83874

SEQ ID NO: 717507 - RNA, 64 nt, hsa; identical to SEQ ID NO: 83875

SEQ ID NO: 717508 - RNA, 64 nt, hsa; identical to SEQ ID NO: 83876

SEQ ID NO: 717509 - RNA, 64 nt, hsa; identical to SEQ ID NO: 83877

SEQ ID NO: 717510 - RNA, 64 nt, hsa; identical to SEQ ID NO: 83878

SEQ ID NO: 717511 - RNA, 64 nt, hsa; identical to SEQ ID NO: 83879

SEQ ID NO: 717512 - RNA, 64 nt, hsa; identical to SEQ ID NO: 83880

SEQ ID NO: 717513 - RNA, 64 nt, hsa; identical to SEQ ID NO: 83881

SEQ ID NO: 717514 - RNA, 64 nt, hsa; identical to SEQ ID NO: 356088

SEQ ID NO: 717515 - RNA, 64 nt, hsa; identical to SEQ ID NO: 356089

SEQ ID NO: 717516 - RNA, 64 nt, hsa; identical to SEQ ID NO: 356090

SEQ ID NO: 717517 - RNA, 64 nt, hsa; identical to SEQ ID NO: 356091

SEQ ID NO: 717518 - RNA, 64 nt, hsa; identical to SEQ ID NO: 356092

SEQ ID NO: 717519 - RNA, 64 nt, hsa; identical to SEQ ID NO: 356093

SEQ ID NO: 717520 - RNA, 64 nt, hsa; identical to SEQ ID NO: 356094

SEQ ID NO: 717521 - RNA, 64 nt, hsa; identical to SEQ ID NO: 356095

SEQ ID NO: 717522 - RNA, 64 nt, hsa; identical to SEQ ID NO: 356096

SEQ ID NO: 717523 - RNA, 64 nt, hsa; identical to SEQ ID NO: 356097

SEQ ID NO: 717524 - RNA, 64 nt, hsa; identical to SEQ ID NO: 356098

SEQ ID NO: 717525 - RNA, 64 nt, hsa; identical to SEQ ID NO: 356099

SEQ ID NO: 717526 - RNA, 64 nt, hsa; identical to SEQ ID NO: 356100

SEQ ID NO: 717527 - RNA, 64 nt, hsa; identical to SEQ ID NO: 356101

SEQ ID NO: 717528 - RNA, 64 nt, hsa; identical to SEQ ID NO: 356102

SEQ ID NO: 717529 - RNA, 64 nt, hsa; identical to SEQ ID NO: 356103

SEQ ID NO: 717530 - RNA, 64 nt, hsa; identical to SEQ ID NO: 356104

SEQ ID NO: 717531 - RNA, 64 nt, hsa; identical to SEQ ID NO: 356105

SEQ ID NO: 717532 - RNA, 64 nt, hsa; identical to SEQ ID NO: 356106

SEQ ID NO: 717533 - RNA, 64 nt, hsa; identical to SEQ ID NO: 356107

SEQ ID NO: 717534 - RNA, 64 nt, hsa; identical to SEQ ID NO: 356108

SEQ ID NO: 717535 - RNA, 64 nt, hsa; identical to SEQ ID NO: 356109

SEQ ID NO: 717536 - RNA, 64 nt, hsa; identical to SEQ ID NO: 356110

SEQ ID NO: 717537 - RNA, 64 nt, hsa; identical to SEQ ID NO: 356111

SEQ ID NO: 717538 - RNA, 64 nt, hsa; identical to SEQ ID NO: 356112

SEQ ID NO: 717539 - RNA, 64 nt, hsa; identical to SEQ ID NO: 356113

SEQ ID NO: 717540 - RNA, 64 nt, hsa; identical to SEQ ID NO: 356114

SEQ ID NO: 717541 - RNA, 64 nt, hsa; identical to SEQ ID NO: 356115

SEQ ID NO: 717542 - RNA, 64 nt, hsa; identical to SEQ ID NO: 356116

SEQ ID NO: 717543 - RNA, 64 nt, hsa; identical to SEQ ID NO: 356117

SEQ ID NO: 717544 - RNA, 64 nt, hsa; identical to SEQ ID NO: 356118

SEQ ID NO: 717545 - RNA, 64 nt, hsa; identical to SEQ ID NO: 356119

SEQ ID NO: 717546 - RNA, 64 nt, hsa; identical to SEQ ID NO: 356120

SEQ ID NO: 717547 - RNA, 64 nt, hsa; identical to SEQ ID NO: 356121

SEQ ID NO: 717548 - RNA, 64 nt, hsa; identical to SEQ ID NO: 356122

SEQ ID NO: 717549 - RNA, 64 nt, hsa; identical to SEQ ID NO: 356123

SEQ ID NO: 717550 - RNA, 64 nt, hsa; identical to SEQ ID NO: 356124

SEQ ID NO: 717551 - RNA, 64 nt, hsa; identical to SEQ ID NO: 356125

SEQ ID NO: 717552 - RNA, 64 nt, hsa; identical to SEQ ID NO: 356126

SEQ ID NO: 717553 - RNA, 64 nt, hsa; identical to SEQ ID NO: 356127

SEQ ID NO: 717554 - RNA, 64 nt, hsa; identical to SEQ ID NO: 356128

SEQ ID NO: 717555 - RNA, 64 nt, hsa; identical to SEQ ID NO: 356129

SEQ ID NO: 717556 - RNA, 64 nt, hsa; identical to SEQ ID NO: 356130

SEQ ID NO: 717557 - RNA, 64 nt, hsa; identical to SEQ ID NO: 356131

SEQ ID NO: 717558 - RNA, 64 nt, hsa; identical to SEQ ID NO: 356132

SEQ ID NO: 717559 - RNA, 64 nt, hsa; identical to SEQ ID NO: 356133

SEQ ID NO: 717560 - RNA, 64 nt, hsa; identical to SEQ ID NO: 356134

SEQ ID NO: 717561 - RNA, 64 nt, hsa; identical to SEQ ID NO: 356135

SEQ ID NO: 717562 - RNA, 64 nt, hsa; identical to SEQ ID NO: 356136

SEQ ID NO: 717563 - RNA, 64 nt, hsa; identical to SEQ ID NO: 356137

SEQ ID NO: 717564 - RNA, 64 nt, hsa; identical to SEQ ID NO: 356138

SEQ ID NO: 717565 - RNA, 64 nt, hsa; identical to SEQ ID NO: 356139

SEQ ID NO: 717566 - RNA, 64 nt, hsa; identical to SEQ ID NO: 356140

SEQ ID NO: 717567 - RNA, 64 nt, hsa; identical to SEQ ID NO: 356141

SEQ ID NO: 717568 - RNA, 64 nt, hsa; identical to SEQ ID NO: 356142

SEQ ID NO: 717569 - RNA, 64 nt, hsa; identical to SEQ ID NO: 356143

SEQ ID NO: 717570 - RNA, 64 nt, hsa; identical to SEQ ID NO: 356144

SEQ ID NO: 717571 - RNA, 64 nt, hsa; identical to SEQ ID NO: 356145

SEQ ID NO: 717572 - RNA, 64 nt, hsa; identical to SEQ ID NO: 356146

SEQ ID NO: 717573 - RNA, 64 nt, hsa; identical to SEQ ID NO: 356147

SEQ ID NO: 717574 - RNA, 64 nt, hsa; identical to SEQ ID NO: 356148

SEQ ID NO: 717575 - RNA, 64 nt, hsa; identical to SEQ ID NO: 356149

SEQ ID NO: 717576 - RNA, 64 nt, hsa; identical to SEQ ID NO: 356150

SEQ ID NO: 717577 - RNA, 64 nt, hsa; identical to SEQ ID NO: 356151

SEQ ID NO: 717578 - RNA, 64 nt, hsa; identical to SEQ ID NO: 356152

SEQ ID NO: 717579 - RNA, 64 nt, hsa; identical to SEQ ID NO: 356153

SEQ ID NO: 717580 - RNA, 64 nt, hsa; identical to SEQ ID NO: 356154

SEQ ID NO: 717581 - RNA, 64 nt, hsa; identical to SEQ ID NO: 356155

SEQ ID NO: 717582 - RNA, 64 nt, hsa; identical to SEQ ID NO: 356156

SEQ ID NO: 717583 - RNA, 64 nt, hsa; identical to SEQ ID NO: 356157

SEQ ID NO: 717584 - RNA, 64 nt, hsa; identical to SEQ ID NO: 356158

SEQ ID NO: 717585 - RNA, 64 nt, hsa; identical to SEQ ID NO: 356159

SEQ ID NO: 717586 - RNA, 64 nt, hsa; identical to SEQ ID NO: 356160

SEQ ID NO: 717587 - RNA, 64 nt, hsa; identical to SEQ ID NO: 356161

SEQ ID NO: 717588 - RNA, 64 nt, hsa; identical to SEQ ID NO: 356162

SEQ ID NO: 717589 - RNA, 64 nt, hsa; identical to SEQ ID NO: 356163

SEQ ID NO: 717590 - RNA, 64 nt, hsa; identical to SEQ ID NO: 356164

SEQ ID NO: 717591 - RNA, 64 nt, hsa; identical to SEQ ID NO: 356165

SEQ ID NO: 717592 - RNA, 64 nt, hsa; identical to SEQ ID NO: 356166

SEQ ID NO: 717593 - RNA, 64 nt, hsa; identical to SEQ ID NO: 356167

SEQ ID NO: 717594 - RNA, 64 nt, hsa; identical to SEQ ID NO: 356168

SEQ ID NO: 717595 - RNA, 64 nt, hsa; identical to SEQ ID NO: 356169

SEQ ID NO: 717596 - RNA, 64 nt, hsa; identical to SEQ ID NO: 356170

SEQ ID NO: 717597 - RNA, 64 nt, hsa; identical to SEQ ID NO: 356171

SEQ ID NO: 717598 - RNA, 64 nt, hsa; identical to SEQ ID NO: 356172

SEQ ID NO: 717599 - RNA, 64 nt, hsa; identical to SEQ ID NO: 356173

SEQ ID NO: 717600 - RNA, 64 nt, hsa; identical to SEQ ID NO: 356174

SEQ ID NO: 717601 - RNA, 64 nt, hsa; identical to SEQ ID NO: 356175

SEQ ID NO: 717602 - RNA, 64 nt, hsa; identical to SEQ ID NO: 356176

SEQ ID NO: 717603 - RNA, 64 nt, hsa; identical to SEQ ID NO: 356177

SEQ ID NO: 717604 - RNA, 64 nt, hsa; identical to SEQ ID NO: 356178

SEQ ID NO: 717605 - RNA, 64 nt, hsa; identical to SEQ ID NO: 356179

SEQ ID NO: 717606 - RNA, 64 nt, hsa; identical to SEQ ID NO: 356180

SEQ ID NO: 717607 - RNA, 64 nt, hsa; identical to SEQ ID NO: 356181

SEQ ID NO: 717608 - RNA, 64 nt, hsa; identical to SEQ ID NO: 356182

SEQ ID NO: 717609 - RNA, 64 nt, hsa; identical to SEQ ID NO: 356183

SEQ ID NO: 717610 - RNA, 64 nt, hsa; identical to SEQ ID NO: 356184

SEQ ID NO: 717611 - RNA, 64 nt, hsa; identical to SEQ ID NO: 356185

SEQ ID NO: 717612 - RNA, 64 nt, hsa; identical to SEQ ID NO: 356186

SEQ ID NO: 717613 - RNA, 64 nt, hsa; identical to SEQ ID NO: 356187

SEQ ID NO: 717614 - RNA, 64 nt, hsa; identical to SEQ ID NO: 356188

SEQ ID NO: 717615 - RNA, 64 nt, hsa; identical to SEQ ID NO: 356189

SEQ ID NO: 717616 - RNA, 64 nt, hsa; identical to SEQ ID NO: 356190

SEQ ID NO: 717617 - RNA, 64 nt, hsa; identical to SEQ ID NO: 356191

SEQ ID NO: 717618 - RNA, 64 nt, hsa; identical to SEQ ID NO: 356192

SEQ ID NO: 717619 - RNA, 64 nt, hsa; identical to SEQ ID NO: 356193

SEQ ID NO: 717620 - RNA, 64 nt, hsa; identical to SEQ ID NO: 356194

SEQ ID NO: 717621 - RNA, 64 nt, hsa; identical to SEQ ID NO: 356195

SEQ ID NO: 717622 - RNA, 64 nt, hsa; identical to SEQ ID NO: 356196

SEQ ID NO: 717623 - RNA, 64 nt, hsa; identical to SEQ ID NO: 356197

SEQ ID NO: 717624 - RNA, 64 nt, hsa; identical to SEQ ID NO: 356198

SEQ ID NO: 717625 - RNA, 64 nt, hsa; identical to SEQ ID NO: 356199

SEQ ID NO: 717626 - RNA, 64 nt, hsa; identical to SEQ ID NO: 356200

SEQ ID NO: 717627 - RNA, 64 nt, hsa; identical to SEQ ID NO: 356201

SEQ ID NO: 717628 - RNA, 64 nt, hsa; identical to SEQ ID NO: 356202

SEQ ID NO: 717629 - RNA, 64 nt, hsa; identical to SEQ ID NO: 356203

SEQ ID NO: 717630 - RNA, 64 nt, hsa; identical to SEQ ID NO: 356204

SEQ ID NO: 717631 - RNA, 64 nt, hsa; identical to SEQ ID NO: 356205

SEQ ID NO: 717632 - RNA, 64 nt, hsa; identical to SEQ ID NO: 356206

SEQ ID NO: 717633 - RNA, 64 nt, hsa; identical to SEQ ID NO: 356207

SEQ ID NO: 717634 - RNA, 64 nt, hsa; identical to SEQ ID NO: 356208

SEQ ID NO: 717635 - RNA, 64 nt, hsa; identical to SEQ ID NO: 356209

SEQ ID NO: 717636 - RNA, 64 nt, hsa; identical to SEQ ID NO: 356210

SEQ ID NO: 717637 - RNA, 64 nt, hsa; identical to SEQ ID NO: 356211

SEQ ID NO: 717638 - RNA, 64 nt, hsa; identical to SEQ ID NO: 356212

SEQ ID NO: 717639 - RNA, 64 nt, hsa; identical to SEQ ID NO: 356213

SEQ ID NO: 717640 - RNA, 64 nt, hsa; identical to SEQ ID NO: 356214

SEQ ID NO: 717641 - RNA, 64 nt, hsa; identical to SEQ ID NO: 356215

SEQ ID NO: 717642 - RNA, 64 nt, hsa; identical to SEQ ID NO: 356216

SEQ ID NO: 717643 - RNA, 64 nt, hsa; identical to SEQ ID NO: 356217

SEQ ID NO: 717644 - RNA, 64 nt, hsa; identical to SEQ ID NO: 356218

SEQ ID NO: 717645 - RNA, 64 nt, hsa; identical to SEQ ID NO: 356219

SEQ ID NO: 717646 - RNA, 64 nt, hsa; identical to SEQ ID NO: 356220

SEQ ID NO: 717647 - RNA, 64 nt, hsa; identical to SEQ ID NO: 356221

SEQ ID NO: 717648 - RNA, 64 nt, hsa; identical to SEQ ID NO: 356222

SEQ ID NO: 717649 - RNA, 64 nt, hsa; identical to SEQ ID NO: 356223

SEQ ID NO: 717650 - RNA, 64 nt, hsa; identical to SEQ ID NO: 356224

SEQ ID NO: 717651 - RNA, 64 nt, hsa; identical to SEQ ID NO: 356225

SEQ ID NO: 717652 - RNA, 64 nt, hsa; identical to SEQ ID NO: 356226

SEQ ID NO: 717653 - RNA, 64 nt, hsa; identical to SEQ ID NO: 356227

SEQ ID NO: 717654 - RNA, 64 nt, hsa; identical to SEQ ID NO: 356228

SEQ ID NO: 717655 - RNA, 64 nt, hsa; identical to SEQ ID NO: 356229

SEQ ID NO: 717656 - RNA, 64 nt, hsa; identical to SEQ ID NO: 356230

SEQ ID NO: 717657 - RNA, 64 nt, hsa; identical to SEQ ID NO: 356231

SEQ ID NO: 717658 - RNA, 64 nt, hsa; identical to SEQ ID NO: 356232

SEQ ID NO: 717659 - RNA, 64 nt, hsa; identical to SEQ ID NO: 356233

SEQ ID NO: 717660 - RNA, 64 nt, hsa; identical to SEQ ID NO: 356234

SEQ ID NO: 717661 - RNA, 64 nt, hsa; identical to SEQ ID NO: 356235

SEQ ID NO: 717662 - RNA, 64 nt, hsa; identical to SEQ ID NO: 356236

SEQ ID NO: 717663 - RNA, 64 nt, hsa; identical to SEQ ID NO: 356237

SEQ ID NO: 717664 - RNA, 64 nt, hsa; identical to SEQ ID NO: 356238

SEQ ID NO: 717665 - RNA, 64 nt, hsa; identical to SEQ ID NO: 356239

SEQ ID NO: 717666 - RNA, 64 nt, hsa; identical to SEQ ID NO: 356240

SEQ ID NO: 717667 - RNA, 64 nt, hsa; identical to SEQ ID NO: 356241

SEQ ID NO: 717668 - RNA, 64 nt, hsa; identical to SEQ ID NO: 356242

SEQ ID NO: 717669 - RNA, 64 nt, hsa; identical to SEQ ID NO: 356243

SEQ ID NO: 717670 - RNA, 64 nt, hsa; identical to SEQ ID NO: 356244

SEQ ID NO: 717671 - RNA, 64 nt, hsa; identical to SEQ ID NO: 356245

SEQ ID NO: 717672 - RNA, 64 nt, hsa; identical to SEQ ID NO: 356246

SEQ ID NO: 717673 - RNA, 64 nt, hsa; identical to SEQ ID NO: 356247

SEQ ID NO: 717674 - RNA, 64 nt, hsa; identical to SEQ ID NO: 356248

SEQ ID NO: 717675 - RNA, 64 nt, hsa; identical to SEQ ID NO: 356249

SEQ ID NO: 717676 - RNA, 64 nt, hsa; identical to SEQ ID NO: 356250

SEQ ID NO: 717677 - RNA, 64 nt, hsa; identical to SEQ ID NO: 356251

SEQ ID NO: 717678 - RNA, 64 nt, hsa; identical to SEQ ID NO: 356252

SEQ ID NO: 717679 - RNA, 64 nt, hsa; identical to SEQ ID NO: 356253

SEQ ID NO: 717680 - RNA, 64 nt, hsa; identical to SEQ ID NO: 356254

SEQ ID NO: 717681 - RNA, 64 nt, hsa; identical to SEQ ID NO: 356255

SEQ ID NO: 717682 - RNA, 64 nt, hsa; identical to SEQ ID NO: 356256

SEQ ID NO: 717683 - RNA, 64 nt, hsa; identical to SEQ ID NO: 356257

SEQ ID NO: 717684 - RNA, 64 nt, hsa; identical to SEQ ID NO: 356258

SEQ ID NO: 717685 - RNA, 64 nt, hsa; identical to SEQ ID NO: 356259

SEQ ID NO: 717686 - RNA, 64 nt, hsa; identical to SEQ ID NO: 356260

SEQ ID NO: 717687 - RNA, 64 nt, hsa; identical to SEQ ID NO: 356261

SEQ ID NO: 717688 - RNA, 64 nt, hsa; identical to SEQ ID NO: 356262

SEQ ID NO: 717689 - RNA, 64 nt, hsa; identical to SEQ ID NO: 356263

SEQ ID NO: 717690 - RNA, 64 nt, hsa; identical to SEQ ID NO: 356264

SEQ ID NO: 717691 - RNA, 64 nt, hsa; identical to SEQ ID NO: 356265

SEQ ID NO: 717692 - RNA, 64 nt, hsa; identical to SEQ ID NO: 356266

SEQ ID NO: 717693 - RNA, 64 nt, hsa; identical to SEQ ID NO: 356267

SEQ ID NO: 717694 - RNA, 64 nt, hsa; identical to SEQ ID NO: 356268

SEQ ID NO: 717695 - RNA, 64 nt, hsa; identical to SEQ ID NO: 356269

SEQ ID NO: 717696 - RNA, 64 nt, hsa; identical to SEQ ID NO: 356270

SEQ ID NO: 717697 - RNA, 64 nt, hsa; identical to SEQ ID NO: 356271

SEQ ID NO: 717698 - RNA, 64 nt, hsa; identical to SEQ ID NO: 356272

SEQ ID NO: 717699 - RNA, 64 nt, hsa; identical to SEQ ID NO: 356273

SEQ ID NO: 717700 - RNA, 64 nt, hsa; identical to SEQ ID NO: 356274

SEQ ID NO: 717701 - RNA, 64 nt, hsa; identical to SEQ ID NO: 356275

SEQ ID NO: 717702 - RNA, 64 nt, hsa; identical to SEQ ID NO: 356276

SEQ ID NO: 717703 - RNA, 64 nt, hsa; identical to SEQ ID NO: 356277

SEQ ID NO: 717704 - RNA, 64 nt, hsa; identical to SEQ ID NO: 356278

SEQ ID NO: 717705 - RNA, 64 nt, hsa; identical to SEQ ID NO: 356279

SEQ ID NO: 717706 - RNA, 64 nt, hsa; identical to SEQ ID NO: 356280

SEQ ID NO: 717707 - RNA, 64 nt, hsa; identical to SEQ ID NO: 356281

SEQ ID NO: 717708 - RNA, 64 nt, hsa; identical to SEQ ID NO: 356270

SEQ ID NO: 717709 - RNA, 64 nt, hsa
cccuuucugguuuaaaaaaauggugcuugaugagggaagguagacucuucccuaggacugacga

SEQ ID NO: 717710 - RNA, 64 nt, hsa
ucuuugacccuuaugacugaaagaucaucaguuuggaagguacugguccaauuuauuuaggaag

SEQ ID NO: 717711 - RNA, 64 nt, hsa
cacaggggggaggcacuaagucaugguccuggcuggaagguacugaaggcuucugcagcuuugg

SEQ ID NO: 717712 - RNA, 64 nt, hsa
cuuuuucacuugggucucuggauuccugucauagggaagguauaucaggaggggaagaggccuu

SEQ ID NO: 717713 - RNA, 64 nt, hsa; identical to SEQ ID NO: 229025

SEQ ID NO: 717714 - RNA, 64 nt, hsa; identical to SEQ ID NO: 229026

SEQ ID NO: 717715 - RNA, 64 nt, hsa; identical to SEQ ID NO: 229027

SEQ ID NO: 717716 - RNA, 64 nt, hsa; identical to SEQ ID NO: 229028

SEQ ID NO: 717717 - RNA, 64 nt, hsa; identical to SEQ ID NO: 229029

SEQ ID NO: 717718 - RNA, 64 nt, hsa; identical to SEQ ID NO: 229030

SEQ ID NO: 717719 - RNA, 64 nt, hsa; identical to SEQ ID NO: 229031

SEQ ID NO: 717720 - RNA, 64 nt, hsa; identical to SEQ ID NO: 229032

SEQ ID NO: 717721 - RNA, 64 nt, hsa; identical to SEQ ID NO: 229033

SEQ ID NO: 717722 - RNA, 64 nt, hsa; identical to SEQ ID NO: 229034

SEQ ID NO: 717723 - RNA, 64 nt, hsa; identical to SEQ ID NO: 229035

SEQ ID NO: 717724 - RNA, 64 nt, hsa; identical to SEQ ID NO: 229036

SEQ ID NO: 717725 - RNA, 64 nt, hsa; identical to SEQ ID NO: 229037

SEQ ID NO: 717726 - RNA, 64 nt, hsa; identical to SEQ ID NO: 229038

SEQ ID NO: 717727 - RNA, 64 nt, hsa; identical to SEQ ID NO: 229039

SEQ ID NO: 717728 - RNA, 64 nt, hsa; identical to SEQ ID NO: 229040

SEQ ID NO: 717729 - RNA, 64 nt, hsa; identical to SEQ ID NO: 229041

SEQ ID NO: 717730 - RNA, 64 nt, hsa; identical to SEQ ID NO: 229042

SEQ ID NO: 717731 - RNA, 64 nt, hsa; identical to SEQ ID NO: 229043

SEQ ID NO: 717732 - RNA, 64 nt, hsa; identical to SEQ ID NO: 229044

SEQ ID NO: 717733 - RNA, 64 nt, hsa; identical to SEQ ID NO: 229045

SEQ ID NO: 717734 - RNA, 64 nt, hsa; identical to SEQ ID NO: 229046

SEQ ID NO: 717735 - RNA, 64 nt, hsa; identical to SEQ ID NO: 229047

SEQ ID NO: 717736 - RNA, 64 nt, hsa; identical to SEQ ID NO: 229048

SEQ ID NO: 717737 - RNA, 64 nt, hsa; identical to SEQ ID NO: 229049

SEQ ID NO: 717738 - RNA, 64 nt, hsa; identical to SEQ ID NO: 229050

SEQ ID NO: 717739 - RNA, 64 nt, hsa; identical to SEQ ID NO: 229051

SEQ ID NO: 717740 - RNA, 64 nt, hsa; identical to SEQ ID NO: 229052

SEQ ID NO: 717741 - RNA, 64 nt, hsa; identical to SEQ ID NO: 229053

SEQ ID NO: 717742 - RNA, 64 nt, hsa; identical to SEQ ID NO: 229054

SEQ ID NO: 717743 - RNA, 64 nt, hsa; identical to SEQ ID NO: 333348

SEQ ID NO: 717744 - RNA, 64 nt, hsa; identical to SEQ ID NO: 333349

SEQ ID NO: 717745 - RNA, 64 nt, hsa; identical to SEQ ID NO: 333350

SEQ ID NO: 717746 - RNA, 64 nt, hsa; identical to SEQ ID NO: 333351

SEQ ID NO: 717747 - RNA, 64 nt, hsa; identical to SEQ ID NO: 333352

SEQ ID NO: 717748 - RNA, 64 nt, hsa; identical to SEQ ID NO: 333353

SEQ ID NO: 717749 - RNA, 64 nt, hsa; identical to SEQ ID NO: 333354

SEQ ID NO: 717750 - RNA, 64 nt, hsa; identical to SEQ ID NO: 333355

SEQ ID NO: 717751 - RNA, 64 nt, hsa; identical to SEQ ID NO: 333356

SEQ ID NO: 717752 - RNA, 64 nt, hsa; identical to SEQ ID NO: 333357

SEQ ID NO: 717753 - RNA, 64 nt, hsa; identical to SEQ ID NO: 333358

SEQ ID NO: 717754 - RNA, 64 nt, hsa; identical to SEQ ID NO: 333359

SEQ ID NO: 717755 - RNA, 64 nt, hsa; identical to SEQ ID NO: 333360

SEQ ID NO: 717756 - RNA, 64 nt, hsa; identical to SEQ ID NO: 333361

SEQ ID NO: 717757 - RNA, 64 nt, hsa; identical to SEQ ID NO: 333362

SEQ ID NO: 717758 - RNA, 64 nt, hsa; identical to SEQ ID NO: 333363

SEQ ID NO: 717759 - RNA, 64 nt, hsa; identical to SEQ ID NO: 333364

SEQ ID NO: 717760 - RNA, 64 nt, hsa; identical to SEQ ID NO: 333365

SEQ ID NO: 717761 - RNA, 64 nt, hsa; identical to SEQ ID NO: 333366

SEQ ID NO: 717762 - RNA, 64 nt, hsa; identical to SEQ ID NO: 333367

SEQ ID NO: 717763 - RNA, 64 nt, hsa; identical to SEQ ID NO: 333368

SEQ ID NO: 717764 - RNA, 64 nt, hsa; identical to SEQ ID NO: 333369

SEQ ID NO: 717765 - RNA, 64 nt, hsa; identical to SEQ ID NO: 333370

SEQ ID NO: 717766 - RNA, 64 nt, hsa; identical to SEQ ID NO: 333371

SEQ ID NO: 717767 - RNA, 64 nt, hsa; identical to SEQ ID NO: 333372

SEQ ID NO: 717768 - RNA, 64 nt, hsa; identical to SEQ ID NO: 333373

SEQ ID NO: 717769 - RNA, 64 nt, hsa; identical to SEQ ID NO: 333374

SEQ ID NO: 717770 - RNA, 64 nt, hsa; identical to SEQ ID NO: 333375

SEQ ID NO: 717771 - RNA, 64 nt, hsa; identical to SEQ ID NO: 333376

SEQ ID NO: 717772 - RNA, 64 nt, hsa; identical to SEQ ID NO: 333377

SEQ ID NO: 717773 - RNA, 64 nt, hsa; identical to SEQ ID NO: 333378

SEQ ID NO: 717774 - RNA, 64 nt, hsa; identical to SEQ ID NO: 333379

SEQ ID NO: 717775 - RNA, 64 nt, hsa; identical to SEQ ID NO: 333380

SEQ ID NO: 717776 - RNA, 64 nt, hsa; identical to SEQ ID NO: 333381

SEQ ID NO: 717777 - RNA, 64 nt, hsa; identical to SEQ ID NO: 333382

SEQ ID NO: 717778 - RNA, 64 nt, hsa; identical to SEQ ID NO: 333383

SEQ ID NO: 717779 - RNA, 64 nt, hsa; identical to SEQ ID NO: 333384

SEQ ID NO: 717780 - RNA, 64 nt, hsa; identical to SEQ ID NO: 333385

SEQ ID NO: 717781 - RNA, 64 nt, hsa; identical to SEQ ID NO: 333386

SEQ ID NO: 717782 - RNA, 64 nt, hsa; identical to SEQ ID NO: 333387

SEQ ID NO: 717783 - RNA, 64 nt, hsa; identical to SEQ ID NO: 333388

SEQ ID NO: 717784 - RNA, 64 nt, hsa; identical to SEQ ID NO: 333389

SEQ ID NO: 717785 - RNA, 64 nt, hsa; identical to SEQ ID NO: 333390

SEQ ID NO: 717786 - RNA, 64 nt, hsa; identical to SEQ ID NO: 333391

SEQ ID NO: 717787 - RNA, 64 nt, hsa; identical to SEQ ID NO: 333392

SEQ ID NO: 717788 - RNA, 64 nt, hsa; identical to SEQ ID NO: 333393

SEQ ID NO: 717789 - RNA, 64 nt, hsa; identical to SEQ ID NO: 333394

SEQ ID NO: 717790 - RNA, 64 nt, hsa; identical to SEQ ID NO: 333395

SEQ ID NO: 717791 - RNA, 64 nt, hsa; identical to SEQ ID NO: 333396

SEQ ID NO: 717792 - RNA, 64 nt, hsa; identical to SEQ ID NO: 333397

SEQ ID NO: 717793 - RNA, 64 nt, hsa; identical to SEQ ID NO: 333398

SEQ ID NO: 717794 - RNA, 64 nt, hsa; identical to SEQ ID NO: 333399

SEQ ID NO: 717795 - RNA, 64 nt, hsa; identical to SEQ ID NO: 333400

SEQ ID NO: 717796 - RNA, 64 nt, hsa; identical to SEQ ID NO: 333401

SEQ ID NO: 717797 - RNA, 64 nt, hsa; identical to SEQ ID NO: 333402

SEQ ID NO: 717798 - RNA, 64 nt, hsa; identical to SEQ ID NO: 333403

SEQ ID NO: 717799 - RNA, 64 nt, hsa; identical to SEQ ID NO: 333404

SEQ ID NO: 717800 - RNA, 64 nt, hsa; identical to SEQ ID NO: 333405

SEQ ID NO: 717801 - RNA, 64 nt, hsa; identical to SEQ ID NO: 333406

SEQ ID NO: 717802 - RNA, 64 nt, hsa; identical to SEQ ID NO: 333407

SEQ ID NO: 717803 - RNA, 64 nt, hsa; identical to SEQ ID NO: 333408

SEQ ID NO: 717804 - RNA, 64 nt, hsa; identical to SEQ ID NO: 333409

SEQ ID NO: 717805 - RNA, 64 nt, hsa; identical to SEQ ID NO: 333410

SEQ ID NO: 717806 - RNA, 64 nt, hsa; identical to SEQ ID NO: 333411

SEQ ID NO: 717807 - RNA, 64 nt, hsa; identical to SEQ ID NO: 333412

SEQ ID NO: 717808 - RNA, 64 nt, hsa; identical to SEQ ID NO: 333413

SEQ ID NO: 717809 - RNA, 64 nt, hsa; identical to SEQ ID NO: 333414

SEQ ID NO: 717810 - RNA, 64 nt, hsa; identical to SEQ ID NO: 333415

SEQ ID NO: 717811 - RNA, 64 nt, hsa; identical to SEQ ID NO: 333416

SEQ ID NO: 717812 - RNA, 64 nt, hsa; identical to SEQ ID NO: 333417

SEQ ID NO: 717813 - RNA, 64 nt, hsa; identical to SEQ ID NO: 333418

SEQ ID NO: 717814 - RNA, 64 nt, hsa; identical to SEQ ID NO: 333419

SEQ ID NO: 717815 - RNA, 64 nt, hsa; identical to SEQ ID NO: 333420

SEQ ID NO: 717816 - RNA, 64 nt, hsa; identical to SEQ ID NO: 333421

SEQ ID NO: 717817 - RNA, 64 nt, hsa; identical to SEQ ID NO: 333422

SEQ ID NO: 717818 - RNA, 64 nt, hsa; identical to SEQ ID NO: 333423

SEQ ID NO: 717819 - RNA, 64 nt, hsa; identical to SEQ ID NO: 333424

SEQ ID NO: 717820 - RNA, 64 nt, hsa; identical to SEQ ID NO: 333425

SEQ ID NO: 717821 - RNA, 64 nt, hsa; identical to SEQ ID NO: 333426

SEQ ID NO: 717822 - RNA, 64 nt, hsa; identical to SEQ ID NO: 333427

SEQ ID NO: 717823 - RNA, 64 nt, hsa; identical to SEQ ID NO: 333428

SEQ ID NO: 717824 - RNA, 64 nt, hsa; identical to SEQ ID NO: 333429

SEQ ID NO: 717825 - RNA, 64 nt, hsa; identical to SEQ ID NO: 333430

SEQ ID NO: 717826 - RNA, 64 nt, hsa; identical to SEQ ID NO: 333431

SEQ ID NO: 717827 - RNA, 64 nt, hsa; identical to SEQ ID NO: 333432

SEQ ID NO: 717828 - RNA, 64 nt, hsa; identical to SEQ ID NO: 333433

SEQ ID NO: 717829 - RNA, 64 nt, hsa; identical to SEQ ID NO: 333434

SEQ ID NO: 717830 - RNA, 64 nt, hsa; identical to SEQ ID NO: 333435

SEQ ID NO: 717831 - RNA, 64 nt, hsa; identical to SEQ ID NO: 333436

SEQ ID NO: 717832 - RNA, 64 nt, hsa; identical to SEQ ID NO: 333437

SEQ ID NO: 717833 - RNA, 64 nt, hsa; identical to SEQ ID NO: 333438

SEQ ID NO: 717834 - RNA, 64 nt, hsa; identical to SEQ ID NO: 333439

SEQ ID NO: 717835 - RNA, 64 nt, hsa; identical to SEQ ID NO: 333440

SEQ ID NO: 717836 - RNA, 64 nt, hsa; identical to SEQ ID NO: 333441

SEQ ID NO: 717837 - RNA, 64 nt, hsa; identical to SEQ ID NO: 333442

SEQ ID NO: 717838 - RNA, 64 nt, hsa; identical to SEQ ID NO: 333443

SEQ ID NO: 717839 - RNA, 64 nt, hsa; identical to SEQ ID NO: 333444

SEQ ID NO: 717840 - RNA, 64 nt, hsa; identical to SEQ ID NO: 333445

SEQ ID NO: 717841 - RNA, 64 nt, hsa; identical to SEQ ID NO: 333446

SEQ ID NO: 717842 - RNA, 64 nt, hsa; identical to SEQ ID NO: 333447

SEQ ID NO: 717843 - RNA, 64 nt, hsa; identical to SEQ ID NO: 333448

SEQ ID NO: 717844 - RNA, 64 nt, hsa; identical to SEQ ID NO: 333449

SEQ ID NO: 717845 - RNA, 64 nt, hsa; identical to SEQ ID NO: 333450

SEQ ID NO: 717846 - RNA, 64 nt, hsa; identical to SEQ ID NO: 333451

SEQ ID NO: 717847 - RNA, 64 nt, hsa; identical to SEQ ID NO: 333452

SEQ ID NO: 717848 - RNA, 64 nt, hsa; identical to SEQ ID NO: 333453

SEQ ID NO: 717849 - RNA, 64 nt, hsa; identical to SEQ ID NO: 333454

SEQ ID NO: 717850 - RNA, 55 nt, hsa; identical to SEQ ID NO: 333455

SEQ ID NO: 717851 - RNA, 64 nt, hsa; identical to SEQ ID NO: 333456

SEQ ID NO: 717852 - RNA, 64 nt, hsa; identical to SEQ ID NO: 333457

SEQ ID NO: 717853 - RNA, 64 nt, hsa; identical to SEQ ID NO: 333458

SEQ ID NO: 717854 - RNA, 64 nt, hsa
aagggcaacugucuacugucugcuuauuuaagugacuauauauaaucaauucaucaagccaguu

SEQ ID NO: 717855 - RNA, 64 nt, hsa
uucuuaucuuuccacagagcuauuuacauccuggacuauauaacuuaaaagaaguaaaacguaa

SEQ ID NO: 717856 - RNA, 64 nt, hsa
ggggguauuugacauauuuuacaggguggaguguacuauauacuauuaccuuugaauguguuug

SEQ ID NO: 717857 - RNA, 64 nt, hsa
uuuuuuccuggauaucuguguauuuucaaauguuacuauauauuaaagcagaaauauaaccaaa

SEQ ID NO: 717858 - RNA, 64 nt, hsa
gggauuguaagaaaacuuuaauuaaaaauuaaagacuauauauaauuaaacuacucugcccugg

SEQ ID NO: 717859 - RNA, 64 nt, hsa
aaauaaauaaaaaaauaaauaaaaauaaaaauagacuauauauagucuuugaauucauuuauuu

SEQ ID NO: 717860 - RNA, 64 nt, hsa
cccacuuagguuuuucuucuuauagcuuuauagaacuauauaauaauauggacuugcuguguaa

SEQ ID NO: 717861 - RNA, 64 nt, hsa
cauauuuuucuuccaagcucaagucaggauugugacuauauauuaaugagacucaguaauccaa

SEQ ID NO: 717862 - RNA, 64 nt, hsa
uagggaaaguaaguugcacucauguaaguaucaaacuauauaaaaggaggccuugugcauuuca

SEQ ID NO: 717863 - RNA, 64 nt, hsa
gguuuauaccuaaauguaacuuuagcuuuauggaacuauauaguaaucccaaaucaaguuauuu

SEQ ID NO: 717864 - RNA, 64 nt, hsa
aaugaccacugaacuuacauuaagagaauuuacaacuauauauuaacauggcuucaauuguuuu

SEQ ID NO: 717865 - RNA, 64 nt, hsa
uauguauauauaguauauacacuauauacugggcacuauauauauauaguguguauguguguua

SEQ ID NO: 717866 - RNA, 64 nt, hsa
acacacacacaauauauguauauauaguauauacacuauauacugggcacuauauauauauagu

SEQ ID NO: 717867 - RNA, 64 nt, hsa
uacuauauaugcccacacaugcacuacauaacacacuauauauauauauauauauacacacaca

SEQ ID NO: 717868 - RNA, 64 nt, hsa
uauauagugugugauguauaugugugugauguauacuauauaugcccacacaugcacuacauaa

SEQ ID NO: 717869 - RNA, 64 nt, hsa
uauuccaccauaacacacacacacacacacacacacuauauacauauaguguauauacacauau

SEQ ID NO: 717870 - RNA, 64 nt, hsa; identical to SEQ ID NO: 22653

SEQ ID NO: 717871 - RNA, 64 nt, hsa; identical to SEQ ID NO: 22654

SEQ ID NO: 717872 - RNA, 64 nt, hsa; identical to SEQ ID NO: 22655

SEQ ID NO: 717873 - RNA, 64 nt, hsa; identical to SEQ ID NO: 22656

SEQ ID NO: 717874 - RNA, 64 nt, hsa; identical to SEQ ID NO: 22657

SEQ ID NO: 717875 - RNA, 64 nt, hsa; identical to SEQ ID NO: 22658

SEQ ID NO: 717876 - RNA, 64 nt, hsa; identical to SEQ ID NO: 22659

SEQ ID NO: 717877 - RNA, 64 nt, hsa; identical to SEQ ID NO: 22660

SEQ ID NO: 717878 - RNA, 64 nt, hsa; identical to SEQ ID NO: 22661

SEQ ID NO: 717879 - RNA, 64 nt, hsa; identical to SEQ ID NO: 22662

SEQ ID NO: 717880 - RNA, 64 nt, hsa; identical to SEQ ID NO: 22663

SEQ ID NO: 717881 - RNA, 64 nt, hsa; identical to SEQ ID NO: 22664

SEQ ID NO: 717882 - RNA, 64 nt, hsa; identical to SEQ ID NO: 22665

SEQ ID NO: 717883 - RNA, 64 nt, hsa; identical to SEQ ID NO: 22666

SEQ ID NO: 717884 - RNA, 64 nt, hsa; identical to SEQ ID NO: 22667

SEQ ID NO: 717885 - RNA, 64 nt, hsa; identical to SEQ ID NO: 22668

SEQ ID NO: 717886 - RNA, 64 nt, hsa; identical to SEQ ID NO: 22669

SEQ ID NO: 717887 - RNA, 64 nt, hsa; identical to SEQ ID NO: 22670

SEQ ID NO: 717888 - RNA, 64 nt, hsa; identical to SEQ ID NO: 22671

SEQ ID NO: 717889 - RNA, 64 nt, hsa; identical to SEQ ID NO: 22672

SEQ ID NO: 717890 - RNA, 64 nt, hsa; identical to SEQ ID NO: 22673

SEQ ID NO: 717891 - RNA, 64 nt, hsa; identical to SEQ ID NO: 22674

SEQ ID NO: 717892 - RNA, 64 nt, hsa; identical to SEQ ID NO: 22675

SEQ ID NO: 717893 - RNA, 64 nt, hsa; identical to SEQ ID NO: 22676

SEQ ID NO: 717894 - RNA, 64 nt, hsa; identical to SEQ ID NO: 22677

SEQ ID NO: 717895 - RNA, 64 nt, hsa; identical to SEQ ID NO: 22678

SEQ ID NO: 717896 - RNA, 64 nt, hsa; identical to SEQ ID NO: 22679

SEQ ID NO: 717897 - RNA, 64 nt, hsa; identical to SEQ ID NO: 22680

SEQ ID NO: 717898 - RNA, 64 nt, hsa; identical to SEQ ID NO: 22681

SEQ ID NO: 717899 - RNA, 64 nt, hsa; identical to SEQ ID NO: 22682

SEQ ID NO: 717900 - RNA, 64 nt, hsa; identical to SEQ ID NO: 22683

SEQ ID NO: 717901 - RNA, 64 nt, hsa; identical to SEQ ID NO: 22684

SEQ ID NO: 717902 - RNA, 64 nt, hsa; identical to SEQ ID NO: 22685

SEQ ID NO: 717903 - RNA, 64 nt, hsa; identical to SEQ ID NO: 22686

SEQ ID NO: 717904 - RNA, 64 nt, hsa; identical to SEQ ID NO: 22687

SEQ ID NO: 717905 - RNA, 64 nt, hsa; identical to SEQ ID NO: 22688

SEQ ID NO: 717906 - RNA, 64 nt, hsa; identical to SEQ ID NO: 22689

SEQ ID NO: 717907 - RNA, 64 nt, hsa; identical to SEQ ID NO: 22690

SEQ ID NO: 717908 - RNA, 64 nt, hsa; identical to SEQ ID NO: 22691

SEQ ID NO: 717909 - RNA, 64 nt, hsa; identical to SEQ ID NO: 22692

SEQ ID NO: 717910 - RNA, 64 nt, hsa; identical to SEQ ID NO: 22693

SEQ ID NO: 717911 - RNA, 64 nt, hsa; identical to SEQ ID NO: 22694

SEQ ID NO: 717912 - RNA, 64 nt, hsa; identical to SEQ ID NO: 22695

SEQ ID NO: 717913 - RNA, 64 nt, hsa; identical to SEQ ID NO: 22696

SEQ ID NO: 717914 - RNA, 64 nt, hsa; identical to SEQ ID NO: 22697

SEQ ID NO: 717915 - RNA, 64 nt, hsa; identical to SEQ ID NO: 22698

SEQ ID NO: 717916 - RNA, 64 nt, hsa; identical to SEQ ID NO: 22699

SEQ ID NO: 717917 - RNA, 64 nt, hsa; identical to SEQ ID NO: 22700

SEQ ID NO: 717918 - RNA, 64 nt, hsa; identical to SEQ ID NO: 22701

SEQ ID NO: 717919 - RNA, 64 nt, hsa; identical to SEQ ID NO: 22702

SEQ ID NO: 717920 - RNA, 64 nt, hsa; identical to SEQ ID NO: 22703

SEQ ID NO: 717921 - RNA, 64 nt, hsa; identical to SEQ ID NO: 22704

SEQ ID NO: 717922 - RNA, 64 nt, hsa; identical to SEQ ID NO: 22705

SEQ ID NO: 717923 - RNA, 64 nt, hsa; identical to SEQ ID NO: 22706

SEQ ID NO: 717924 - RNA, 64 nt, hsa; identical to SEQ ID NO: 22707

SEQ ID NO: 717925 - RNA, 64 nt, hsa; identical to SEQ ID NO: 22708

SEQ ID NO: 717926 - RNA, 64 nt, hsa; identical to SEQ ID NO: 22709

SEQ ID NO: 717927 - RNA, 64 nt, hsa; identical to SEQ ID NO: 22710

SEQ ID NO: 717928 - RNA, 64 nt, hsa; identical to SEQ ID NO: 22711

SEQ ID NO: 717929 - RNA, 64 nt, hsa; identical to SEQ ID NO: 22712

SEQ ID NO: 717930 - RNA, 64 nt, hsa; identical to SEQ ID NO: 22713

SEQ ID NO: 717931 - RNA, 64 nt, hsa; identical to SEQ ID NO: 22714

SEQ ID NO: 717932 - RNA, 64 nt, hsa; identical to SEQ ID NO: 22715

SEQ ID NO: 717933 - RNA, 64 nt, hsa; identical to SEQ ID NO: 22716

SEQ ID NO: 717934 - RNA, 64 nt, hsa; identical to SEQ ID NO: 22717

SEQ ID NO: 717935 - RNA, 64 nt, hsa; identical to SEQ ID NO: 22718

SEQ ID NO: 717936 - RNA, 64 nt, hsa; identical to SEQ ID NO: 22719

SEQ ID NO: 717937 - RNA, 64 nt, hsa; identical to SEQ ID NO: 22720

SEQ ID NO: 717938 - RNA, 64 nt, hsa; identical to SEQ ID NO: 22721

SEQ ID NO: 717939 - RNA, 64 nt, hsa; identical to SEQ ID NO: 22722

SEQ ID NO: 717940 - RNA, 64 nt, hsa; identical to SEQ ID NO: 22723

SEQ ID NO: 717941 - RNA, 64 nt, hsa; identical to SEQ ID NO: 22724

SEQ ID NO: 717942 - RNA, 64 nt, hsa; identical to SEQ ID NO: 22725

SEQ ID NO: 717943 - RNA, 64 nt, hsa; identical to SEQ ID NO: 22726

SEQ ID NO: 717944 - RNA, 64 nt, hsa; identical to SEQ ID NO: 22727

SEQ ID NO: 717945 - RNA, 64 nt, hsa; identical to SEQ ID NO: 22728

SEQ ID NO: 717946 - RNA, 64 nt, hsa; identical to SEQ ID NO: 22729

SEQ ID NO: 717947 - RNA, 64 nt, hsa; identical to SEQ ID NO: 22730

SEQ ID NO: 717948 - RNA, 64 nt, hsa; identical to SEQ ID NO: 22731

SEQ ID NO: 717949 - RNA, 64 nt, hsa; identical to SEQ ID NO: 22732

SEQ ID NO: 717950 - RNA, 64 nt, hsa; identical to SEQ ID NO: 22733

SEQ ID NO: 717951 - RNA, 60 nt, hsa; identical to SEQ ID NO: 22734

SEQ ID NO: 717952 - RNA, 64 nt, hsa; identical to SEQ ID NO: 22735

SEQ ID NO: 717953 - RNA, 64 nt, hsa; identical to SEQ ID NO: 22736

SEQ ID NO: 717954 - RNA, 64 nt, hsa; identical to SEQ ID NO: 22737

SEQ ID NO: 717955 - RNA, 64 nt, hsa; identical to SEQ ID NO: 22738

SEQ ID NO: 717956 - RNA, 64 nt, hsa; identical to SEQ ID NO: 22739

SEQ ID NO: 717957 - RNA, 64 nt, hsa; identical to SEQ ID NO: 22740

SEQ ID NO: 717958 - RNA, 64 nt, hsa; identical to SEQ ID NO: 22741

SEQ ID NO: 717959 - RNA, 64 nt, hsa; identical to SEQ ID NO: 22742

SEQ ID NO: 717960 - RNA, 64 nt, hsa; identical to SEQ ID NO: 22743

SEQ ID NO: 717961 - RNA, 64 nt, hsa; identical to SEQ ID NO: 22744

SEQ ID NO: 717962 - RNA, 64 nt, hsa; identical to SEQ ID NO: 22745

SEQ ID NO: 717963 - RNA, 64 nt, hsa; identical to SEQ ID NO: 22746

SEQ ID NO: 717964 - RNA, 64 nt, hsa; identical to SEQ ID NO: 22747

SEQ ID NO: 717965 - RNA, 64 nt, hsa; identical to SEQ ID NO: 22748

SEQ ID NO: 717966 - RNA, 64 nt, hsa; identical to SEQ ID NO: 22749

SEQ ID NO: 717967 - RNA, 64 nt, hsa; identical to SEQ ID NO: 22750

SEQ ID NO: 717968 - RNA, 64 nt, hsa; identical to SEQ ID NO: 22751

SEQ ID NO: 717969 - RNA, 64 nt, hsa; identical to SEQ ID NO: 22752

SEQ ID NO: 717970 - RNA, 64 nt, hsa; identical to SEQ ID NO: 22753

SEQ ID NO: 717971 - RNA, 64 nt, hsa; identical to SEQ ID NO: 22754

SEQ ID NO: 717972 - RNA, 64 nt, hsa; identical to SEQ ID NO: 22755

SEQ ID NO: 717973 - RNA, 64 nt, hsa; identical to SEQ ID NO: 22756

SEQ ID NO: 717974 - RNA, 64 nt, hsa; identical to SEQ ID NO: 22757

SEQ ID NO: 717975 - RNA, 64 nt, hsa; identical to SEQ ID NO: 22758

SEQ ID NO: 717976 - RNA, 64 nt, hsa; identical to SEQ ID NO: 22759

SEQ ID NO: 717977 - RNA, 64 nt, hsa; identical to SEQ ID NO: 22760

SEQ ID NO: 717978 - RNA, 64 nt, hsa; identical to SEQ ID NO: 22761

SEQ ID NO: 717979 - RNA, 64 nt, hsa; identical to SEQ ID NO: 22762

SEQ ID NO: 717980 - RNA, 64 nt, hsa; identical to SEQ ID NO: 22763

SEQ ID NO: 717981 - RNA, 64 nt, hsa; identical to SEQ ID NO: 22764

SEQ ID NO: 717982 - RNA, 64 nt, hsa; identical to SEQ ID NO: 22765

SEQ ID NO: 717983 - RNA, 64 nt, hsa; identical to SEQ ID NO: 22766

SEQ ID NO: 717984 - RNA, 64 nt, hsa; identical to SEQ ID NO: 22767

SEQ ID NO: 717985 - RNA, 64 nt, hsa; identical to SEQ ID NO: 22768

SEQ ID NO: 717986 - RNA, 64 nt, hsa; identical to SEQ ID NO: 22769

SEQ ID NO: 717987 - RNA, 64 nt, hsa; identical to SEQ ID NO: 22770

SEQ ID NO: 717988 - RNA, 64 nt, hsa; identical to SEQ ID NO: 22771

SEQ ID NO: 717989 - RNA, 64 nt, hsa; identical to SEQ ID NO: 22772

SEQ ID NO: 717990 - RNA, 64 nt, hsa; identical to SEQ ID NO: 22773

SEQ ID NO: 717991 - RNA, 64 nt, hsa; identical to SEQ ID NO: 22774

SEQ ID NO: 717992 - RNA, 64 nt, hsa; identical to SEQ ID NO: 22775

SEQ ID NO: 717993 - RNA, 64 nt, hsa; identical to SEQ ID NO: 22776

SEQ ID NO: 717994 - RNA, 64 nt, hsa; identical to SEQ ID NO: 22777

SEQ ID NO: 717995 - RNA, 64 nt, hsa; identical to SEQ ID NO: 22778

SEQ ID NO: 717996 - RNA, 64 nt, hsa; identical to SEQ ID NO: 22779

SEQ ID NO: 717997 - RNA, 64 nt, hsa; identical to SEQ ID NO: 22780

SEQ ID NO: 717998 - RNA, 64 nt, hsa; identical to SEQ ID NO: 22781

SEQ ID NO: 717999 - RNA, 64 nt, hsa; identical to SEQ ID NO: 22782

SEQ ID NO: 718000 - RNA, 64 nt, hsa; identical to SEQ ID NO: 22783

SEQ ID NO: 718001 - RNA, 64 nt, hsa; identical to SEQ ID NO: 22784

SEQ ID NO: 718002 - RNA, 64 nt, hsa; identical to SEQ ID NO: 22785

SEQ ID NO: 718003 - RNA, 64 nt, hsa; identical to SEQ ID NO: 22786

SEQ ID NO: 718004 - RNA, 64 nt, hsa; identical to SEQ ID NO: 22787

SEQ ID NO: 718005 - RNA, 64 nt, hsa; identical to SEQ ID NO: 22788

SEQ ID NO: 718006 - RNA, 64 nt, hsa; identical to SEQ ID NO: 22789

SEQ ID NO: 718007 - RNA, 64 nt, hsa; identical to SEQ ID NO: 22790

SEQ ID NO: 718008 - RNA, 64 nt, hsa; identical to SEQ ID NO: 22791

SEQ ID NO: 718009 - RNA, 64 nt, hsa; identical to SEQ ID NO: 22792

SEQ ID NO: 718010 - RNA, 64 nt, hsa; identical to SEQ ID NO: 22793

SEQ ID NO: 718011 - RNA, 64 nt, hsa; identical to SEQ ID NO: 22794

SEQ ID NO: 718012 - RNA, 64 nt, hsa; identical to SEQ ID NO: 22795

SEQ ID NO: 718013 - RNA, 64 nt, hsa; identical to SEQ ID NO: 22796

SEQ ID NO: 718014 - RNA, 64 nt, hsa; identical to SEQ ID NO: 22797

SEQ ID NO: 718015 - RNA, 64 nt, hsa; identical to SEQ ID NO: 22798

SEQ ID NO: 718016 - RNA, 64 nt, hsa; identical to SEQ ID NO: 22799

SEQ ID NO: 718017 - RNA, 64 nt, hsa; identical to SEQ ID NO: 22800

SEQ ID NO: 718018 - RNA, 64 nt, hsa; identical to SEQ ID NO: 22801

SEQ ID NO: 718019 - RNA, 64 nt, hsa; identical to SEQ ID NO: 22802

SEQ ID NO: 718020 - RNA, 64 nt, hsa; identical to SEQ ID NO: 22803

SEQ ID NO: 718021 - RNA, 64 nt, hsa; identical to SEQ ID NO: 22804

SEQ ID NO: 718022 - RNA, 64 nt, hsa; identical to SEQ ID NO: 22805

SEQ ID NO: 718023 - RNA, 64 nt, hsa; identical to SEQ ID NO: 22806

SEQ ID NO: 718024 - RNA, 64 nt, hsa; identical to SEQ ID NO: 22807

SEQ ID NO: 718025 - RNA, 64 nt, hsa; identical to SEQ ID NO: 22808

SEQ ID NO: 718026 - RNA, 64 nt, hsa; identical to SEQ ID NO: 22809

SEQ ID NO: 718027 - RNA, 64 nt, hsa; identical to SEQ ID NO: 22810

SEQ ID NO: 718028 - RNA, 64 nt, hsa; identical to SEQ ID NO: 22811

SEQ ID NO: 718029 - RNA, 64 nt, hsa; identical to SEQ ID NO: 22812

SEQ ID NO: 718030 - RNA, 64 nt, hsa; identical to SEQ ID NO: 22813

SEQ ID NO: 718031 - RNA, 64 nt, hsa; identical to SEQ ID NO: 22814

SEQ ID NO: 718032 - RNA, 64 nt, hsa; identical to SEQ ID NO: 22815

SEQ ID NO: 718033 - RNA, 64 nt, hsa; identical to SEQ ID NO: 22816

SEQ ID NO: 718034 - RNA, 64 nt, hsa; identical to SEQ ID NO: 22817

SEQ ID NO: 718035 - RNA, 64 nt, hsa; identical to SEQ ID NO: 22818

SEQ ID NO: 718036 - RNA, 64 nt, hsa; identical to SEQ ID NO: 22819

SEQ ID NO: 718037 - RNA, 64 nt, hsa; identical to SEQ ID NO: 22820

SEQ ID NO: 718038 - RNA, 64 nt, hsa; identical to SEQ ID NO: 22821

SEQ ID NO: 718039 - RNA, 64 nt, hsa; identical to SEQ ID NO: 22822

SEQ ID NO: 718040 - RNA, 64 nt, hsa; identical to SEQ ID NO: 22823

SEQ ID NO: 718041 - RNA, 64 nt, hsa; identical to SEQ ID NO: 22824

SEQ ID NO: 718042 - RNA, 64 nt, hsa; identical to SEQ ID NO: 22825

SEQ ID NO: 718043 - RNA, 64 nt, hsa; identical to SEQ ID NO: 22826

SEQ ID NO: 718044 - RNA, 64 nt, hsa; identical to SEQ ID NO: 22827

SEQ ID NO: 718045 - RNA, 64 nt, hsa; identical to SEQ ID NO: 22828

SEQ ID NO: 718046 - RNA, 64 nt, hsa; identical to SEQ ID NO: 22829

SEQ ID NO: 718047 - RNA, 64 nt, hsa; identical to SEQ ID NO: 22830

SEQ ID NO: 718048 - RNA, 64 nt, hsa; identical to SEQ ID NO: 22831

SEQ ID NO: 718049 - RNA, 64 nt, hsa; identical to SEQ ID NO: 22832

SEQ ID NO: 718050 - RNA, 64 nt, hsa; identical to SEQ ID NO: 22833

SEQ ID NO: 718051 - RNA, 64 nt, hsa; identical to SEQ ID NO: 22834

SEQ ID NO: 718052 - RNA, 64 nt, hsa; identical to SEQ ID NO: 22835

SEQ ID NO: 718053 - RNA, 64 nt, hsa; identical to SEQ ID NO: 22836

SEQ ID NO: 718054 - RNA, 64 nt, hsa; identical to SEQ ID NO: 22837

SEQ ID NO: 718055 - RNA, 64 nt, hsa; identical to SEQ ID NO: 22838

SEQ ID NO: 718056 - RNA, 64 nt, hsa; identical to SEQ ID NO: 22839

SEQ ID NO: 718057 - RNA, 64 nt, hsa; identical to SEQ ID NO: 22840

SEQ ID NO: 718058 - RNA, 64 nt, hsa; identical to SEQ ID NO: 22841

SEQ ID NO: 718059 - RNA, 64 nt, hsa; identical to SEQ ID NO: 22842

SEQ ID NO: 718060 - RNA, 64 nt, hsa; identical to SEQ ID NO: 22843

SEQ ID NO: 718061 - RNA, 64 nt, hsa; identical to SEQ ID NO: 22844

SEQ ID NO: 718062 - RNA, 64 nt, hsa; identical to SEQ ID NO: 22845

SEQ ID NO: 718063 - RNA, 64 nt, hsa; identical to SEQ ID NO: 22846

SEQ ID NO: 718064 - RNA, 64 nt, hsa; identical to SEQ ID NO: 22847

SEQ ID NO: 718065 - RNA, 64 nt, hsa; identical to SEQ ID NO: 22848

SEQ ID NO: 718066 - RNA, 64 nt, hsa; identical to SEQ ID NO: 22849

SEQ ID NO: 718067 - RNA, 64 nt, hsa; identical to SEQ ID NO: 22850

SEQ ID NO: 718068 - RNA, 64 nt, hsa; identical to SEQ ID NO: 22851

SEQ ID NO: 718069 - RNA, 64 nt, hsa; identical to SEQ ID NO: 22852

SEQ ID NO: 718070 - RNA, 64 nt, hsa; identical to SEQ ID NO: 22853

SEQ ID NO: 718071 - RNA, 64 nt, hsa; identical to SEQ ID NO: 22854

SEQ ID NO: 718072 - RNA, 64 nt, hsa; identical to SEQ ID NO: 22855

SEQ ID NO: 718073 - RNA, 64 nt, hsa; identical to SEQ ID NO: 22856

SEQ ID NO: 718074 - RNA, 64 nt, hsa; identical to SEQ ID NO: 22857

SEQ ID NO: 718075 - RNA, 64 nt, hsa; identical to SEQ ID NO: 22858

SEQ ID NO: 718076 - RNA, 64 nt, hsa; identical to SEQ ID NO: 22859

SEQ ID NO: 718077 - RNA, 64 nt, hsa; identical to SEQ ID NO: 22860

SEQ ID NO: 718078 - RNA, 64 nt, hsa; identical to SEQ ID NO: 22861

SEQ ID NO: 718079 - RNA, 64 nt, hsa; identical to SEQ ID NO: 22862

SEQ ID NO: 718080 - RNA, 64 nt, hsa; identical to SEQ ID NO: 22863

SEQ ID NO: 718081 - RNA, 64 nt, hsa; identical to SEQ ID NO: 22864

SEQ ID NO: 718082 - RNA, 64 nt, hsa; identical to SEQ ID NO: 22865

SEQ ID NO: 718083 - RNA, 64 nt, hsa; identical to SEQ ID NO: 22866

SEQ ID NO: 718084 - RNA, 64 nt, hsa; identical to SEQ ID NO: 22867

SEQ ID NO: 718085 - RNA, 64 nt, hsa; identical to SEQ ID NO: 22868

SEQ ID NO: 718086 - RNA, 64 nt, hsa; identical to SEQ ID NO: 22869

SEQ ID NO: 718087 - RNA, 64 nt, hsa; identical to SEQ ID NO: 22870

SEQ ID NO: 718088 - RNA, 64 nt, hsa; identical to SEQ ID NO: 22871

SEQ ID NO: 718089 - RNA, 64 nt, hsa; identical to SEQ ID NO: 22872

SEQ ID NO: 718090 - RNA, 64 nt, hsa; identical to SEQ ID NO: 22873

SEQ ID NO: 718091 - RNA, 64 nt, hsa; identical to SEQ ID NO: 22874

SEQ ID NO: 718092 - RNA, 64 nt, hsa; identical to SEQ ID NO: 22875

SEQ ID NO: 718093 - RNA, 64 nt, hsa; identical to SEQ ID NO: 22876

SEQ ID NO: 718094 - RNA, 64 nt, hsa; identical to SEQ ID NO: 22877

SEQ ID NO: 718095 - RNA, 64 nt, hsa; identical to SEQ ID NO: 22878

SEQ ID NO: 718096 - RNA, 64 nt, hsa; identical to SEQ ID NO: 22879

SEQ ID NO: 718097 - RNA, 64 nt, hsa; identical to SEQ ID NO: 22880

SEQ ID NO: 718098 - RNA, 64 nt, hsa; identical to SEQ ID NO: 22881

SEQ ID NO: 718099 - RNA, 64 nt, hsa; identical to SEQ ID NO: 22882

SEQ ID NO: 718100 - RNA, 64 nt, hsa; identical to SEQ ID NO: 22883

SEQ ID NO: 718101 - RNA, 64 nt, hsa; identical to SEQ ID NO: 22884

SEQ ID NO: 718102 - RNA, 64 nt, hsa; identical to SEQ ID NO: 22885

SEQ ID NO: 718103 - RNA, 64 nt, hsa; identical to SEQ ID NO: 22886

SEQ ID NO: 718104 - RNA, 64 nt, hsa; identical to SEQ ID NO: 22887

SEQ ID NO: 718105 - RNA, 64 nt, hsa; identical to SEQ ID NO: 22888

SEQ ID NO: 718106 - RNA, 64 nt, hsa; identical to SEQ ID NO: 22889

SEQ ID NO: 718107 - RNA, 64 nt, hsa; identical to SEQ ID NO: 22890

SEQ ID NO: 718108 - RNA, 64 nt, hsa; identical to SEQ ID NO: 22891

SEQ ID NO: 718109 - RNA, 64 nt, hsa; identical to SEQ ID NO: 22892

SEQ ID NO: 718110 - RNA, 64 nt, hsa; identical to SEQ ID NO: 22893

SEQ ID NO: 718111 - RNA, 64 nt, hsa; identical to SEQ ID NO: 22894

SEQ ID NO: 718112 - RNA, 64 nt, hsa; identical to SEQ ID NO: 22895

SEQ ID NO: 718113 - RNA, 64 nt, hsa; identical to SEQ ID NO: 22896

SEQ ID NO: 718114 - RNA, 64 nt, hsa; identical to SEQ ID NO: 22897

SEQ ID NO: 718115 - RNA, 64 nt, hsa; identical to SEQ ID NO: 22898

SEQ ID NO: 718116 - RNA, 64 nt, hsa; identical to SEQ ID NO: 22899

SEQ ID NO: 718117 - RNA, 64 nt, hsa; identical to SEQ ID NO: 22900

SEQ ID NO: 718118 - RNA, 64 nt, hsa; identical to SEQ ID NO: 22901

SEQ ID NO: 718119 - RNA, 64 nt, hsa; identical to SEQ ID NO: 22902

SEQ ID NO: 718120 - RNA, 64 nt, hsa; identical to SEQ ID NO: 22903

SEQ ID NO: 718121 - RNA, 64 nt, hsa; identical to SEQ ID NO: 22904

SEQ ID NO: 718122 - RNA, 64 nt, hsa; identical to SEQ ID NO: 22905

SEQ ID NO: 718123 - RNA, 64 nt, hsa; identical to SEQ ID NO: 22906

SEQ ID NO: 718124 - RNA, 64 nt, hsa; identical to SEQ ID NO: 22907

SEQ ID NO: 718125 - RNA, 64 nt, hsa; identical to SEQ ID NO: 22908

SEQ ID NO: 718126 - RNA, 64 nt, hsa; identical to SEQ ID NO: 22909

SEQ ID NO: 718127 - RNA, 64 nt, hsa; identical to SEQ ID NO: 22910

SEQ ID NO: 718128 - RNA, 64 nt, hsa; identical to SEQ ID NO: 22911

SEQ ID NO: 718129 - RNA, 64 nt, hsa; identical to SEQ ID NO: 22912

SEQ ID NO: 718130 - RNA, 64 nt, hsa; identical to SEQ ID NO: 22913

SEQ ID NO: 718131 - RNA, 64 nt, hsa; identical to SEQ ID NO: 22914

SEQ ID NO: 718132 - RNA, 64 nt, hsa; identical to SEQ ID NO: 22915

SEQ ID NO: 718133 - RNA, 64 nt, hsa; identical to SEQ ID NO: 22916

SEQ ID NO: 718134 - RNA, 64 nt, hsa; identical to SEQ ID NO: 22917

SEQ ID NO: 718135 - RNA, 64 nt, hsa; identical to SEQ ID NO: 22918

SEQ ID NO: 718136 - RNA, 64 nt, hsa; identical to SEQ ID NO: 22919

SEQ ID NO: 718137 - RNA, 62 nt, hsa; identical to SEQ ID NO: 22920

SEQ ID NO: 718138 - RNA, 64 nt, hsa; identical to SEQ ID NO: 22921

SEQ ID NO: 718139 - RNA, 64 nt, hsa; identical to SEQ ID NO: 22922

SEQ ID NO: 718140 - RNA, 64 nt, hsa; identical to SEQ ID NO: 22923

SEQ ID NO: 718141 - RNA, 64 nt, hsa; identical to SEQ ID NO: 22924

SEQ ID NO: 718142 - RNA, 64 nt, hsa; identical to SEQ ID NO: 22925

SEQ ID NO: 718143 - RNA, 64 nt, hsa; identical to SEQ ID NO: 22926

SEQ ID NO: 718144 - RNA, 64 nt, hsa; identical to SEQ ID NO: 22927

SEQ ID NO: 718145 - RNA, 64 nt, hsa; identical to SEQ ID NO: 22928

SEQ ID NO: 718146 - RNA, 64 nt, hsa; identical to SEQ ID NO: 22929

SEQ ID NO: 718147 - RNA, 64 nt, hsa; identical to SEQ ID NO: 22930

SEQ ID NO: 718148 - RNA, 64 nt, hsa; identical to SEQ ID NO: 22931

SEQ ID NO: 718149 - RNA, 64 nt, hsa; identical to SEQ ID NO: 22932

SEQ ID NO: 718150 - RNA, 64 nt, hsa; identical to SEQ ID NO: 22933

SEQ ID NO: 718151 - RNA, 64 nt, hsa; identical to SEQ ID NO: 22934

SEQ ID NO: 718152 - RNA, 64 nt, hsa; identical to SEQ ID NO: 22935

SEQ ID NO: 718153 - RNA, 64 nt, hsa; identical to SEQ ID NO: 22936

SEQ ID NO: 718154 - RNA, 64 nt, hsa; identical to SEQ ID NO: 22937

SEQ ID NO: 718155 - RNA, 64 nt, hsa; identical to SEQ ID NO: 22938

SEQ ID NO: 718156 - RNA, 64 nt, hsa; identical to SEQ ID NO: 22939

SEQ ID NO: 718157 - RNA, 64 nt, hsa; identical to SEQ ID NO: 22940

SEQ ID NO: 718158 - RNA, 64 nt, hsa; identical to SEQ ID NO: 22941

SEQ ID NO: 718159 - RNA, 64 nt, hsa; identical to SEQ ID NO: 22942

SEQ ID NO: 718160 - RNA, 64 nt, hsa; identical to SEQ ID NO: 22943

SEQ ID NO: 718161 - RNA, 64 nt, hsa; identical to SEQ ID NO: 22944

SEQ ID NO: 718162 - RNA, 64 nt, hsa; identical to SEQ ID NO: 22945

SEQ ID NO: 718163 - RNA, 64 nt, hsa; identical to SEQ ID NO: 22946

SEQ ID NO: 718164 - RNA, 64 nt, hsa; identical to SEQ ID NO: 22947

SEQ ID NO: 718165 - RNA, 64 nt, hsa; identical to SEQ ID NO: 22948

SEQ ID NO: 718166 - RNA, 64 nt, hsa; identical to SEQ ID NO: 22949

SEQ ID NO: 718167 - RNA, 64 nt, hsa; identical to SEQ ID NO: 22950

SEQ ID NO: 718168 - RNA, 64 nt, hsa; identical to SEQ ID NO: 22951

SEQ ID NO: 718169 - RNA, 64 nt, hsa; identical to SEQ ID NO: 22952

SEQ ID NO: 718170 - RNA, 64 nt, hsa; identical to SEQ ID NO: 22953

SEQ ID NO: 718171 - RNA, 64 nt, hsa; identical to SEQ ID NO: 22954

SEQ ID NO: 718172 - RNA, 64 nt, hsa; identical to SEQ ID NO: 22955

SEQ ID NO: 718173 - RNA, 64 nt, hsa; identical to SEQ ID NO: 22956

SEQ ID NO: 718174 - RNA, 64 nt, hsa; identical to SEQ ID NO: 22957

SEQ ID NO: 718175 - RNA, 64 nt, hsa; identical to SEQ ID NO: 22958

SEQ ID NO: 718176 - RNA, 64 nt, hsa; identical to SEQ ID NO: 22959

SEQ ID NO: 718177 - RNA, 64 nt, hsa; identical to SEQ ID NO: 22960

SEQ ID NO: 718178 - RNA, 64 nt, hsa; identical to SEQ ID NO: 22961

SEQ ID NO: 718179 - RNA, 64 nt, hsa; identical to SEQ ID NO: 22962

SEQ ID NO: 718180 - RNA, 64 nt, hsa; identical to SEQ ID NO: 22963

SEQ ID NO: 718181 - RNA, 64 nt, hsa; identical to SEQ ID NO: 22964

SEQ ID NO: 718182 - RNA, 64 nt, hsa; identical to SEQ ID NO: 22965

SEQ ID NO: 718183 - RNA, 64 nt, hsa; identical to SEQ ID NO: 22966

SEQ ID NO: 718184 - RNA, 64 nt, hsa; identical to SEQ ID NO: 22967

SEQ ID NO: 718185 - RNA, 64 nt, hsa; identical to SEQ ID NO: 22968

SEQ ID NO: 718186 - RNA, 64 nt, hsa; identical to SEQ ID NO: 22969

SEQ ID NO: 718187 - RNA, 64 nt, hsa; identical to SEQ ID NO: 22970

SEQ ID NO: 718188 - RNA, 64 nt, hsa; identical to SEQ ID NO: 22971

SEQ ID NO: 718189 - RNA, 64 nt, hsa; identical to SEQ ID NO: 22972

SEQ ID NO: 718190 - RNA, 64 nt, hsa; identical to SEQ ID NO: 22973

SEQ ID NO: 718191 - RNA, 64 nt, hsa; identical to SEQ ID NO: 22974

SEQ ID NO: 718192 - RNA, 64 nt, hsa; identical to SEQ ID NO: 22975

SEQ ID NO: 718193 - RNA, 64 nt, hsa; identical to SEQ ID NO: 22976

SEQ ID NO: 718194 - RNA, 64 nt, hsa; identical to SEQ ID NO: 22977

SEQ ID NO: 718195 - RNA, 64 nt, hsa; identical to SEQ ID NO: 22978

SEQ ID NO: 718196 - RNA, 64 nt, hsa; identical to SEQ ID NO: 22979

SEQ ID NO: 718197 - RNA, 64 nt, hsa; identical to SEQ ID NO: 22980

SEQ ID NO: 718198 - RNA, 64 nt, hsa; identical to SEQ ID NO: 22981

SEQ ID NO: 718199 - RNA, 64 nt, hsa; identical to SEQ ID NO: 22982

SEQ ID NO: 718200 - RNA, 64 nt, hsa; identical to SEQ ID NO: 22983

SEQ ID NO: 718201 - RNA, 64 nt, hsa; identical to SEQ ID NO: 22984

SEQ ID NO: 718202 - RNA, 64 nt, hsa; identical to SEQ ID NO: 22985

SEQ ID NO: 718203 - RNA, 64 nt, hsa; identical to SEQ ID NO: 22986

SEQ ID NO: 718204 - RNA, 64 nt, hsa; identical to SEQ ID NO: 22987

SEQ ID NO: 718205 - RNA, 64 nt, hsa; identical to SEQ ID NO: 22988

SEQ ID NO: 718206 - RNA, 64 nt, hsa; identical to SEQ ID NO: 22989

SEQ ID NO: 718207 - RNA, 64 nt, hsa; identical to SEQ ID NO: 22990

SEQ ID NO: 718208 - RNA, 64 nt, hsa; identical to SEQ ID NO: 22991

SEQ ID NO: 718209 - RNA, 64 nt, hsa; identical to SEQ ID NO: 22992

SEQ ID NO: 718210 - RNA, 64 nt, hsa; identical to SEQ ID NO: 22993

SEQ ID NO: 718211 - RNA, 64 nt, hsa; identical to SEQ ID NO: 22994

SEQ ID NO: 718212 - RNA, 52 nt, hsa; identical to SEQ ID NO: 22995

SEQ ID NO: 718213 - RNA, 56 nt, hsa; identical to SEQ ID NO: 22996

SEQ ID NO: 718214 - RNA, 64 nt, hsa; identical to SEQ ID NO: 22997

SEQ ID NO: 718215 - RNA, 64 nt, hsa; identical to SEQ ID NO: 22998

SEQ ID NO: 718216 - RNA, 64 nt, hsa; identical to SEQ ID NO: 22999

SEQ ID NO: 718217 - RNA, 64 nt, hsa; identical to SEQ ID NO: 23000

SEQ ID NO: 718218 - RNA, 64 nt, hsa; identical to SEQ ID NO: 23001

SEQ ID NO: 718219 - RNA, 64 nt, hsa; identical to SEQ ID NO: 23002

SEQ ID NO: 718220 - RNA, 64 nt, hsa; identical to SEQ ID NO: 23003

SEQ ID NO: 718221 - RNA, 64 nt, hsa; identical to SEQ ID NO: 23004

SEQ ID NO: 718222 - RNA, 64 nt, hsa; identical to SEQ ID NO: 23005

SEQ ID NO: 718223 - RNA, 64 nt, hsa; identical to SEQ ID NO: 23006

SEQ ID NO: 718224 - RNA, 64 nt, hsa; identical to SEQ ID NO: 23007

SEQ ID NO: 718225 - RNA, 64 nt, hsa; identical to SEQ ID NO: 23008

SEQ ID NO: 718226 - RNA, 64 nt, hsa; identical to SEQ ID NO: 23009

SEQ ID NO: 718227 - RNA, 64 nt, hsa; identical to SEQ ID NO: 23010

SEQ ID NO: 718228 - RNA, 64 nt, hsa; identical to SEQ ID NO: 23011

SEQ ID NO: 718229 - RNA, 64 nt, hsa; identical to SEQ ID NO: 23012

SEQ ID NO: 718230 - RNA, 64 nt, hsa; identical to SEQ ID NO: 23013

SEQ ID NO: 718231 - RNA, 64 nt, hsa; identical to SEQ ID NO: 23014

SEQ ID NO: 718232 - RNA, 64 nt, hsa; identical to SEQ ID NO: 23015

SEQ ID NO: 718233 - RNA, 64 nt, hsa; identical to SEQ ID NO: 23016

SEQ ID NO: 718234 - RNA, 64 nt, hsa; identical to SEQ ID NO: 23017

SEQ ID NO: 718235 - RNA, 64 nt, hsa; identical to SEQ ID NO: 23018

SEQ ID NO: 718236 - RNA, 64 nt, hsa; identical to SEQ ID NO: 23019

SEQ ID NO: 718237 - RNA, 64 nt, hsa; identical to SEQ ID NO: 23020

SEQ ID NO: 718238 - RNA, 64 nt, hsa; identical to SEQ ID NO: 23021

SEQ ID NO: 718239 - RNA, 64 nt, hsa; identical to SEQ ID NO: 23022

SEQ ID NO: 718240 - RNA, 64 nt, hsa; identical to SEQ ID NO: 23023

SEQ ID NO: 718241 - RNA, 64 nt, hsa; identical to SEQ ID NO: 23024

SEQ ID NO: 718242 - RNA, 64 nt, hsa; identical to SEQ ID NO: 23025

SEQ ID NO: 718243 - RNA, 64 nt, hsa; identical to SEQ ID NO: 23026

SEQ ID NO: 718244 - RNA, 64 nt, hsa; identical to SEQ ID NO: 23027

SEQ ID NO: 718245 - RNA, 64 nt, hsa; identical to SEQ ID NO: 23028

SEQ ID NO: 718246 - RNA, 64 nt, hsa; identical to SEQ ID NO: 23029

SEQ ID NO: 718247 - RNA, 64 nt, hsa; identical to SEQ ID NO: 23030

SEQ ID NO: 718248 - RNA, 64 nt, hsa; identical to SEQ ID NO: 23031

SEQ ID NO: 718249 - RNA, 64 nt, hsa; identical to SEQ ID NO: 23032

SEQ ID NO: 718250 - RNA, 64 nt, hsa; identical to SEQ ID NO: 23033

SEQ ID NO: 718251 - RNA, 64 nt, hsa; identical to SEQ ID NO: 23034

SEQ ID NO: 718252 - RNA, 64 nt, hsa; identical to SEQ ID NO: 23035

SEQ ID NO: 718253 - RNA, 64 nt, hsa; identical to SEQ ID NO: 23036

SEQ ID NO: 718254 - RNA, 64 nt, hsa; identical to SEQ ID NO: 23037

SEQ ID NO: 718255 - RNA, 64 nt, hsa; identical to SEQ ID NO: 23038

SEQ ID NO: 718256 - RNA, 64 nt, hsa; identical to SEQ ID NO: 23039

SEQ ID NO: 718257 - RNA, 64 nt, hsa; identical to SEQ ID NO: 23040

SEQ ID NO: 718258 - RNA, 64 nt, hsa; identical to SEQ ID NO: 23041

SEQ ID NO: 718259 - RNA, 64 nt, hsa; identical to SEQ ID NO: 23042

SEQ ID NO: 718260 - RNA, 64 nt, hsa; identical to SEQ ID NO: 23043

SEQ ID NO: 718261 - RNA, 64 nt, hsa; identical to SEQ ID NO: 23044

SEQ ID NO: 718262 - RNA, 64 nt, hsa; identical to SEQ ID NO: 23045

SEQ ID NO: 718263 - RNA, 64 nt, hsa; identical to SEQ ID NO: 23046

SEQ ID NO: 718264 - RNA, 64 nt, hsa; identical to SEQ ID NO: 23047

SEQ ID NO: 718265 - RNA, 64 nt, hsa; identical to SEQ ID NO: 23048

SEQ ID NO: 718266 - RNA, 64 nt, hsa; identical to SEQ ID NO: 23049

SEQ ID NO: 718267 - RNA, 64 nt, hsa; identical to SEQ ID NO: 23050

SEQ ID NO: 718268 - RNA, 64 nt, hsa; identical to SEQ ID NO: 23051

SEQ ID NO: 718269 - RNA, 64 nt, hsa; identical to SEQ ID NO: 23052

SEQ ID NO: 718270 - RNA, 64 nt, hsa; identical to SEQ ID NO: 23053

SEQ ID NO: 718271 - RNA, 64 nt, hsa; identical to SEQ ID NO: 23054

SEQ ID NO: 718272 - RNA, 64 nt, hsa; identical to SEQ ID NO: 23055

SEQ ID NO: 718273 - RNA, 64 nt, hsa; identical to SEQ ID NO: 23056

SEQ ID NO: 718274 - RNA, 64 nt, hsa; identical to SEQ ID NO: 23057

SEQ ID NO: 718275 - RNA, 64 nt, hsa; identical to SEQ ID NO: 23058

SEQ ID NO: 718276 - RNA, 64 nt, hsa; identical to SEQ ID NO: 23059

SEQ ID NO: 718277 - RNA, 64 nt, hsa; identical to SEQ ID NO: 23060

SEQ ID NO: 718278 - RNA, 64 nt, hsa; identical to SEQ ID NO: 23061

SEQ ID NO: 718279 - RNA, 64 nt, hsa; identical to SEQ ID NO: 23062

SEQ ID NO: 718280 - RNA, 64 nt, hsa; identical to SEQ ID NO: 23063

SEQ ID NO: 718281 - RNA, 64 nt, hsa; identical to SEQ ID NO: 23064

SEQ ID NO: 718282 - RNA, 64 nt, hsa; identical to SEQ ID NO: 23065

SEQ ID NO: 718283 - RNA, 64 nt, hsa; identical to SEQ ID NO: 23066

SEQ ID NO: 718284 - RNA, 64 nt, hsa; identical to SEQ ID NO: 23067

SEQ ID NO: 718285 - RNA, 64 nt, hsa; identical to SEQ ID NO: 23068

SEQ ID NO: 718286 - RNA, 64 nt, hsa; identical to SEQ ID NO: 23069

SEQ ID NO: 718287 - RNA, 64 nt, hsa; identical to SEQ ID NO: 23070

SEQ ID NO: 718288 - RNA, 64 nt, hsa; identical to SEQ ID NO: 23071

SEQ ID NO: 718289 - RNA, 64 nt, hsa; identical to SEQ ID NO: 23072

SEQ ID NO: 718290 - RNA, 64 nt, hsa; identical to SEQ ID NO: 23073

SEQ ID NO: 718291 - RNA, 64 nt, hsa; identical to SEQ ID NO: 23074

SEQ ID NO: 718292 - RNA, 64 nt, hsa; identical to SEQ ID NO: 23075

SEQ ID NO: 718293 - RNA, 64 nt, hsa; identical to SEQ ID NO: 23076

SEQ ID NO: 718294 - RNA, 64 nt, hsa; identical to SEQ ID NO: 23077

SEQ ID NO: 718295 - RNA, 64 nt, hsa; identical to SEQ ID NO: 23078

SEQ ID NO: 718296 - RNA, 64 nt, hsa; identical to SEQ ID NO: 23079

SEQ ID NO: 718297 - RNA, 64 nt, hsa; identical to SEQ ID NO: 23080

SEQ ID NO: 718298 - RNA, 64 nt, hsa; identical to SEQ ID NO: 23081

SEQ ID NO: 718299 - RNA, 64 nt, hsa; identical to SEQ ID NO: 23082

SEQ ID NO: 718300 - RNA, 64 nt, hsa; identical to SEQ ID NO: 23083

SEQ ID NO: 718301 - RNA, 64 nt, hsa; identical to SEQ ID NO: 23084

SEQ ID NO: 718302 - RNA, 64 nt, hsa; identical to SEQ ID NO: 23085

SEQ ID NO: 718303 - RNA, 64 nt, hsa; identical to SEQ ID NO: 23086

SEQ ID NO: 718304 - RNA, 64 nt, hsa; identical to SEQ ID NO: 23087

SEQ ID NO: 718305 - RNA, 64 nt, hsa; identical to SEQ ID NO: 23088

SEQ ID NO: 718306 - RNA, 64 nt, hsa; identical to SEQ ID NO: 23089

SEQ ID NO: 718307 - RNA, 64 nt, hsa; identical to SEQ ID NO: 23090

SEQ ID NO: 718308 - RNA, 64 nt, hsa; identical to SEQ ID NO: 23091

SEQ ID NO: 718309 - RNA, 64 nt, hsa; identical to SEQ ID NO: 23092

SEQ ID NO: 718310 - RNA, 64 nt, hsa; identical to SEQ ID NO: 23093

SEQ ID NO: 718311 - RNA, 64 nt, hsa; identical to SEQ ID NO: 23094

SEQ ID NO: 718312 - RNA, 64 nt, hsa; identical to SEQ ID NO: 23095

SEQ ID NO: 718313 - RNA, 64 nt, hsa; identical to SEQ ID NO: 23096

SEQ ID NO: 718314 - RNA, 64 nt, hsa; identical to SEQ ID NO: 23097

SEQ ID NO: 718315 - RNA, 64 nt, hsa; identical to SEQ ID NO: 23098

SEQ ID NO: 718316 - RNA, 64 nt, hsa; identical to SEQ ID NO: 23099

SEQ ID NO: 718317 - RNA, 64 nt, hsa; identical to SEQ ID NO: 23100

SEQ ID NO: 718318 - RNA, 64 nt, hsa; identical to SEQ ID NO: 23101

SEQ ID NO: 718319 - RNA, 64 nt, hsa; identical to SEQ ID NO: 23102

SEQ ID NO: 718320 - RNA, 64 nt, hsa; identical to SEQ ID NO: 23103

SEQ ID NO: 718321 - RNA, 64 nt, hsa; identical to SEQ ID NO: 23104

SEQ ID NO: 718322 - RNA, 64 nt, hsa; identical to SEQ ID NO: 23105

SEQ ID NO: 718323 - RNA, 64 nt, hsa; identical to SEQ ID NO: 23106

SEQ ID NO: 718324 - RNA, 64 nt, hsa; identical to SEQ ID NO: 23107

SEQ ID NO: 718325 - RNA, 64 nt, hsa; identical to SEQ ID NO: 23108

SEQ ID NO: 718326 - RNA, 64 nt, hsa; identical to SEQ ID NO: 23109

SEQ ID NO: 718327 - RNA, 64 nt, hsa; identical to SEQ ID NO: 23110

SEQ ID NO: 718328 - RNA, 64 nt, hsa; identical to SEQ ID NO: 23111

SEQ ID NO: 718329 - RNA, 64 nt, hsa; identical to SEQ ID NO: 23112

SEQ ID NO: 718330 - RNA, 64 nt, hsa; identical to SEQ ID NO: 23113

SEQ ID NO: 718331 - RNA, 64 nt, hsa; identical to SEQ ID NO: 23114

SEQ ID NO: 718332 - RNA, 64 nt, hsa; identical to SEQ ID NO: 23115

SEQ ID NO: 718333 - RNA, 64 nt, hsa; identical to SEQ ID NO: 23116

SEQ ID NO: 718334 - RNA, 64 nt, hsa; identical to SEQ ID NO: 23117

SEQ ID NO: 718335 - RNA, 64 nt, hsa; identical to SEQ ID NO: 23118

SEQ ID NO: 718336 - RNA, 64 nt, hsa; identical to SEQ ID NO: 23119

SEQ ID NO: 718337 - RNA, 64 nt, hsa; identical to SEQ ID NO: 23120

SEQ ID NO: 718338 - RNA, 64 nt, hsa; identical to SEQ ID NO: 23121

SEQ ID NO: 718339 - RNA, 64 nt, hsa; identical to SEQ ID NO: 23122

SEQ ID NO: 718340 - RNA, 64 nt, hsa; identical to SEQ ID NO: 23123

SEQ ID NO: 718341 - RNA, 64 nt, hsa; identical to SEQ ID NO: 23124

SEQ ID NO: 718342 - RNA, 64 nt, hsa; identical to SEQ ID NO: 23125

SEQ ID NO: 718343 - RNA, 64 nt, hsa; identical to SEQ ID NO: 23126

SEQ ID NO: 718344 - RNA, 64 nt, hsa; identical to SEQ ID NO: 23127

SEQ ID NO: 718345 - RNA, 64 nt, hsa; identical to SEQ ID NO: 23128

SEQ ID NO: 718346 - RNA, 64 nt, hsa; identical to SEQ ID NO: 23129

SEQ ID NO: 718347 - RNA, 64 nt, hsa; identical to SEQ ID NO: 23130

SEQ ID NO: 718348 - RNA, 64 nt, hsa; identical to SEQ ID NO: 23131

SEQ ID NO: 718349 - RNA, 64 nt, hsa; identical to SEQ ID NO: 23132

SEQ ID NO: 718350 - RNA, 64 nt, hsa; identical to SEQ ID NO: 23133

SEQ ID NO: 718351 - RNA, 64 nt, hsa; identical to SEQ ID NO: 23134

SEQ ID NO: 718352 - RNA, 64 nt, hsa; identical to SEQ ID NO: 23135

SEQ ID NO: 718353 - RNA, 64 nt, hsa; identical to SEQ ID NO: 23136

SEQ ID NO: 718354 - RNA, 64 nt, hsa; identical to SEQ ID NO: 23137

SEQ ID NO: 718355 - RNA, 64 nt, hsa; identical to SEQ ID NO: 23138

SEQ ID NO: 718356 - RNA, 64 nt, hsa; identical to SEQ ID NO: 23139

SEQ ID NO: 718357 - RNA, 64 nt, hsa; identical to SEQ ID NO: 23140

SEQ ID NO: 718358 - RNA, 64 nt, hsa; identical to SEQ ID NO: 23141

SEQ ID NO: 718359 - RNA, 64 nt, hsa; identical to SEQ ID NO: 23142

SEQ ID NO: 718360 - RNA, 64 nt, hsa; identical to SEQ ID NO: 23143

SEQ ID NO: 718361 - RNA, 64 nt, hsa; identical to SEQ ID NO: 145515

SEQ ID NO: 718362 - RNA, 64 nt, hsa; identical to SEQ ID NO: 145516

SEQ ID NO: 718363 - RNA, 64 nt, hsa; identical to SEQ ID NO: 145517

SEQ ID NO: 718364 - RNA, 64 nt, hsa; identical to SEQ ID NO: 145518

SEQ ID NO: 718365 - RNA, 64 nt, hsa; identical to SEQ ID NO: 145519

SEQ ID NO: 718366 - RNA, 64 nt, hsa; identical to SEQ ID NO: 145520

SEQ ID NO: 718367 - RNA, 64 nt, hsa; identical to SEQ ID NO: 145521

SEQ ID NO: 718368 - RNA, 64 nt, hsa; identical to SEQ ID NO: 145522

SEQ ID NO: 718369 - RNA, 64 nt, hsa; identical to SEQ ID NO: 145523

SEQ ID NO: 718370 - RNA, 64 nt, hsa; identical to SEQ ID NO: 145524

SEQ ID NO: 718371 - RNA, 64 nt, hsa; identical to SEQ ID NO: 145525

SEQ ID NO: 718372 - RNA, 64 nt, hsa; identical to SEQ ID NO: 145526

SEQ ID NO: 718373 - RNA, 64 nt, hsa; identical to SEQ ID NO: 145527

SEQ ID NO: 718374 - RNA, 64 nt, hsa; identical to SEQ ID NO: 145528

SEQ ID NO: 718375 - RNA, 64 nt, hsa; identical to SEQ ID NO: 145529

SEQ ID NO: 718376 - RNA, 64 nt, hsa; identical to SEQ ID NO: 145530

SEQ ID NO: 718377 - RNA, 64 nt, hsa; identical to SEQ ID NO: 145531

SEQ ID NO: 718378 - RNA, 64 nt, hsa; identical to SEQ ID NO: 145532

SEQ ID NO: 718379 - RNA, 64 nt, hsa; identical to SEQ ID NO: 145533

SEQ ID NO: 718380 - RNA, 64 nt, hsa; identical to SEQ ID NO: 145534

SEQ ID NO: 718381 - RNA, 64 nt, hsa; identical to SEQ ID NO: 145535

SEQ ID NO: 718382 - RNA, 64 nt, hsa; identical to SEQ ID NO: 145536

SEQ ID NO: 718383 - RNA, 64 nt, hsa
ugacgagcucaccguuggcuacccggucacggaggccggccaccugcagagccucuacacaggu

SEQ ID NO: 718384 - RNA, 64 nt, hsa
gagcccgagggccugacagguucccagcagcugggccggccagccuugcacugugggggcuggu

SEQ ID NO: 718385 - RNA, 64 nt, hsa
ggucccccacccucaccccggccccccacccgcagccggccacacuggagcagcucccagcaca

SEQ ID NO: 718386 - RNA, 64 nt, hsa
cccuguguccucucauccucccgccgcccgucaggccggccagccucacaucagucucuccgcc

SEQ ID NO: 718387 - RNA, 53 nt, hsa
cucugagucccuccgcguagucugccggccacaccgcaucuuccggccgucgg

SEQ ID NO: 718388 - RNA, 64 nt, hsa
ggaacacuggcuggagacccuccgcaugcaccuggccggccaccugccacugggcccacagcug

SEQ ID NO: 718389 - RNA, 64 nt, hsa
ucgccacaaugccaugucgcaauaggaagcaggggccggccaucgcuaccuucagcacacugac

SEQ ID NO: 718390 - RNA, 64 nt, hsa
agccacuggaauugucacacggcgagcacagagggccggccaccaguccucgaugcuucugaac

SEQ ID NO: 718391 - RNA, 64 nt, hsa
gccugaggccaggcccucugcacagaagccauaugccggccagccgcgccuccuccucugucca

SEQ ID NO: 718392 - RNA, 64 nt, hsa
cuguuucccuccuucugcguggucccuuugacgggccggccaccguguccgaggcgcaacgcua

SEQ ID NO: 718393 - RNA, 64 nt, hsa
ucccgucgcuguccucgcccuacauugaguacacgccggccagcccggccuacgcccaguaccc

SEQ ID NO: 718394 - RNA, 64 nt, hsa
cccaggcgcacaggggccgccgguaacaggggccgccggccaaaggccccuuuccagucauagc

SEQ ID NO: 718395 - RNA, 64 nt, hsa; identical to SEQ ID NO: 145515

SEQ ID NO: 718396 - RNA, 64 nt, hsa; identical to SEQ ID NO: 145516

SEQ ID NO: 718397 - RNA, 64 nt, hsa; identical to SEQ ID NO: 145517

SEQ ID NO: 718398 - RNA, 64 nt, hsa; identical to SEQ ID NO: 145518

SEQ ID NO: 718399 - RNA, 64 nt, hsa; identical to SEQ ID NO: 145519

SEQ ID NO: 718400 - RNA, 64 nt, hsa; identical to SEQ ID NO: 145520

SEQ ID NO: 718401 - RNA, 64 nt, hsa; identical to SEQ ID NO: 145521

SEQ ID NO: 718402 - RNA, 64 nt, hsa; identical to SEQ ID NO: 145522

SEQ ID NO: 718403 - RNA, 64 nt, hsa; identical to SEQ ID NO: 145523

SEQ ID NO: 718404 - RNA, 64 nt, hsa; identical to SEQ ID NO: 145524

SEQ ID NO: 718405 - RNA, 64 nt, hsa; identical to SEQ ID NO: 145525

SEQ ID NO: 718406 - RNA, 64 nt, hsa; identical to SEQ ID NO: 145526

SEQ ID NO: 718407 - RNA, 64 nt, hsa; identical to SEQ ID NO: 145527

SEQ ID NO: 718408 - RNA, 64 nt, hsa; identical to SEQ ID NO: 145528

SEQ ID NO: 718409 - RNA, 64 nt, hsa; identical to SEQ ID NO: 145529

SEQ ID NO: 718410 - RNA, 64 nt, hsa; identical to SEQ ID NO: 145530

SEQ ID NO: 718411 - RNA, 64 nt, hsa; identical to SEQ ID NO: 145531

SEQ ID NO: 718412 - RNA, 64 nt, hsa; identical to SEQ ID NO: 145532

SEQ ID NO: 718413 - RNA, 64 nt, hsa; identical to SEQ ID NO: 145533

SEQ ID NO: 718414 - RNA, 64 nt, hsa; identical to SEQ ID NO: 145534

SEQ ID NO: 718415 - RNA, 64 nt, hsa; identical to SEQ ID NO: 145535

SEQ ID NO: 718416 - RNA, 64 nt, hsa; identical to SEQ ID NO: 145536

SEQ ID NO: 718417 - RNA, 64 nt, hsa; identical to SEQ ID NO: 718383

SEQ ID NO: 718418 - RNA, 64 nt, hsa; identical to SEQ ID NO: 718384

SEQ ID NO: 718419 - RNA, 64 nt, hsa; identical to SEQ ID NO: 718385

SEQ ID NO: 718420 - RNA, 64 nt, hsa; identical to SEQ ID NO: 718386

SEQ ID NO: 718421 - RNA, 53 nt, hsa; identical to SEQ ID NO: 718387

SEQ ID NO: 718422 - RNA, 64 nt, hsa; identical to SEQ ID NO: 718388

SEQ ID NO: 718423 - RNA, 64 nt, hsa; identical to SEQ ID NO: 718389

SEQ ID NO: 718424 - RNA, 64 nt, hsa; identical to SEQ ID NO: 718390

SEQ ID NO: 718425 - RNA, 64 nt, hsa; identical to SEQ ID NO: 718391

SEQ ID NO: 718426 - RNA, 64 nt, hsa; identical to SEQ ID NO: 718392

SEQ ID NO: 718427 - RNA, 64 nt, hsa; identical to SEQ ID NO: 718393

SEQ ID NO: 718428 - RNA, 64 nt, hsa; identical to SEQ ID NO: 718394

SEQ ID NO: 718429 - RNA, 64 nt, hsa; identical to SEQ ID NO: 145515

SEQ ID NO: 718430 - RNA, 64 nt, hsa; identical to SEQ ID NO: 145516

SEQ ID NO: 718431 - RNA, 64 nt, hsa; identical to SEQ ID NO: 145517

SEQ ID NO: 718432 - RNA, 64 nt, hsa; identical to SEQ ID NO: 145518

SEQ ID NO: 718433 - RNA, 64 nt, hsa; identical to SEQ ID NO: 145519

SEQ ID NO: 718434 - RNA, 64 nt, hsa; identical to SEQ ID NO: 145520

SEQ ID NO: 718435 - RNA, 64 nt, hsa; identical to SEQ ID NO: 145521

SEQ ID NO: 718436 - RNA, 64 nt, hsa; identical to SEQ ID NO: 145522

SEQ ID NO: 718437 - RNA, 64 nt, hsa; identical to SEQ ID NO: 145523

SEQ ID NO: 718438 - RNA, 64 nt, hsa; identical to SEQ ID NO: 145524

SEQ ID NO: 718439 - RNA, 64 nt, hsa; identical to SEQ ID NO: 145525

SEQ ID NO: 718440 - RNA, 64 nt, hsa; identical to SEQ ID NO: 145526

SEQ ID NO: 718441 - RNA, 64 nt, hsa; identical to SEQ ID NO: 145527

SEQ ID NO: 718442 - RNA, 64 nt, hsa; identical to SEQ ID NO: 145528

SEQ ID NO: 718443 - RNA, 64 nt, hsa; identical to SEQ ID NO: 145529

SEQ ID NO: 718444 - RNA, 64 nt, hsa; identical to SEQ ID NO: 145530

SEQ ID NO: 718445 - RNA, 64 nt, hsa; identical to SEQ ID NO: 145531

SEQ ID NO: 718446 - RNA, 64 nt, hsa; identical to SEQ ID NO: 145532

SEQ ID NO: 718447 - RNA, 64 nt, hsa; identical to SEQ ID NO: 145533

SEQ ID NO: 718448 - RNA, 64 nt, hsa; identical to SEQ ID NO: 145534

SEQ ID NO: 718449 - RNA, 64 nt, hsa; identical to SEQ ID NO: 145535

SEQ ID NO: 718450 - RNA, 64 nt, hsa; identical to SEQ ID NO: 145536

SEQ ID NO: 718451 - RNA, 64 nt, hsa; identical to SEQ ID NO: 718383

SEQ ID NO: 718452 - RNA, 64 nt, hsa; identical to SEQ ID NO: 718384

SEQ ID NO: 718453 - RNA, 64 nt, hsa; identical to SEQ ID NO: 718385

SEQ ID NO: 718454 - RNA, 64 nt, hsa; identical to SEQ ID NO: 718386

SEQ ID NO: 718455 - RNA, 53 nt, hsa; identical to SEQ ID NO: 718387

SEQ ID NO: 718456 - RNA, 64 nt, hsa; identical to SEQ ID NO: 718388

SEQ ID NO: 718457 - RNA, 64 nt, hsa; identical to SEQ ID NO: 718389

SEQ ID NO: 718458 - RNA, 64 nt, hsa; identical to SEQ ID NO: 718390

SEQ ID NO: 718459 - RNA, 64 nt, hsa; identical to SEQ ID NO: 718391

SEQ ID NO: 718460 - RNA, 64 nt, hsa; identical to SEQ ID NO: 718392

SEQ ID NO: 718461 - RNA, 64 nt, hsa; identical to SEQ ID NO: 718393

SEQ ID NO: 718462 - RNA, 64 nt, hsa; identical to SEQ ID NO: 718394

SEQ ID NO: 718463 - RNA, 64 nt, hsa
aauaacccuuuugguaaccguauugacugcagagucuauuuaagcaugugguuuuaaaaauaga

SEQ ID NO: 718464 - RNA, 64 nt, hsa
gcguuucaguuacauuugcauuuaagacaaguguucuauuuauuucuuguauuguuuggaagaa

SEQ ID NO: 718465 - RNA, 64 nt, hsa
uauuauaguacauauaccauguaaacucucaaacucuauuuagcugugaaauaguggugugcaa

SEQ ID NO: 718466 - RNA, 64 nt, hsa
aaucagacuaaaaggugguaucucuucuuaguguucuauuuaucuuauuugcuaaugggagcac

SEQ ID NO: 718467 - RNA, 64 nt, hsa
cuaagcccuuaggccucugagagugcuguuggguucuauuuauuuauuuauuuguuccuuuguu

SEQ ID NO: 718468 - RNA, 64 nt, hsa
cgggaugggaggcacguggccucucuuuuauccgucuauuuauuuuguaaguguauucgugugg

SEQ ID NO: 718469 - RNA, 64 nt, hsa
agucuacagagaagauucuuguauuuauuacaacucuauuuaauuaaugucaguauuucaacug

SEQ ID NO: 718470 - RNA, 64 nt, hsa
ucuauuuaauuaaugucaguauuucaacugaaguucuauuuauuugugagacuguaaguuacau

SEQ ID NO: 718471 - RNA, 64 nt, hsa
guuacuuaccaaacuuuuugacaaggcugaagguucuauuuauuuacaauacauaggguuacuc

SEQ ID NO: 718472 - RNA, 64 nt, hsa
acuuugcaccaggucgacaaacuuuucugaagguucuauuuauuuaccauacauaggguuacuu

SEQ ID NO: 718473 - RNA, 64 nt, hsa
aacucauucguuuaaugaacuugacugucauaccucuauuuaguaauugcgaggguaagauuca

SEQ ID NO: 718474 - RNA, 64 nt, hsa
aaagcaacuaagagaaagaaaaacauuguagauaucuauuuauauuuaaaguuuauguuucaug

SEQ ID NO: 718475 - RNA, 64 nt, hsa
gggaaaauuuuccaagguuagauuccaauaaauaucuauuuauuauuaaauauuaaaauaucua

SEQ ID NO: 718476 - RNA, 64 nt, hsa
aauaaauaucuauuuauuauuaaauauuaaaauaucuauuuauuauuaaaaccauuuauaaggc

SEQ ID NO: 718477 - RNA, 64 nt, hsa
gacacuuuauugcacaugaaauuuguaauuuuuuucuauuuaaguacacauuuggaaauuaucc

SEQ ID NO: 718478 - RNA, 64 nt, hsa
uuuucauuuuaauguuauccuuuuagaccuuuucucuauuuacaaaaauguuacguguuucuau

SEQ ID NO: 718479 - RNA, 64 nt, hsa
guggcugcauuauguccuggggugugcaugugggucuauuuagagcuucugucccuuccuuccc

SEQ ID NO: 718480 - RNA, 64 nt, hsa
cuuucacagacaugguauggcagccauucuuuuaucuauuuaaccaagaggaugcuggggaauu

SEQ ID NO: 718481 - RNA, 64 nt, hsa
aguagaccuguagaagagcuaacagaauuauauuucuauuuaguuaaaauuguuaaugaaaaac

SEQ ID NO: 718482 - RNA, 64 nt, hsa
cuggggcagguuccaggaacuugaacuaaaaauaucuauuuaagccucucucucuuucucuccu

SEQ ID NO: 718483 - RNA, 64 nt, hsa
caaauggaauggaggcugugagcaaugugaggauucuauuuauuuauuuacguuugauaaaacu

SEQ ID NO: 718484 - RNA, 64 nt, hsa
uaacuucugcagaguuugccccagaauucagaguucuauuuagaggaaguuaaaacaacaacaa

SEQ ID NO: 718485 - RNA, 64 nt, hsa
augguggaaaaccuuaaaaauugagacaauucaaucuauuuaaucuauuaaauuuuuucucuga

SEQ ID NO: 718486 - RNA, 64 nt, hsa
cacaauuaaaauuaggcuacauucuuuccaguauucuauuuaaguaccuacuacauacugcucu

SEQ ID NO: 718487 - RNA, 64 nt, hsa
aggggaacauuucauuuguguuauuucuuaaacuucuauuuaggaaauuacauuaaguauuaau

SEQ ID NO: 718488 - RNA, 64 nt, hsa
agagagcaggguuuucucagauuccuuuuuaaucucuauuuaucugguuguuucugacaggaug

SEQ ID NO: 718489 - RNA, 64 nt, hsa
uuauguugaauaaauuuuaaaauuuaggaaauguucuauuuaaaguuaauuucuuucauaaagc

SEQ ID NO: 718490 - RNA, 64 nt, hsa
aucuucuuuaaaggaaggauaagacauugccaucucuauuuaacucauccauaugggucaauca

SEQ ID NO: 718491 - RNA, 64 nt, hsa
gugugggaggacagaguuagaggaaucuuccuuuucuauuuaugaagauucuacucuugguaag

SEQ ID NO: 718492 - RNA, 64 nt, hsa
ucucucaauuuagcauuugcuuuugguuuuuuucucuauuuagcauucuguuaaggcacaaaaa

SEQ ID NO: 718493 - RNA, 64 nt, hsa
gacauucugggucacagauauaagguauuuaaaaucuauuuaugcuuuauagagaaaccagaca

SEQ ID NO: 718494 - RNA, 64 nt, hsa
uugggaccaggcuuuuauuuucccugauauuauuucuauuuaauacucuuuucucucaagaaaa

SEQ ID NO: 718495 - RNA, 64 nt, hsa
uacuuugguugacccuuguaugucacagcucugcucuauuuauuauuauuuugcaaaauaacca

SEQ ID NO: 718496 - RNA, 64 nt, hsa
uuucuuauuuagggggaaauuauuugaaucagauucuauuuagucaaaccaccuuuuauguuuu

SEQ ID NO: 718497 - RNA, 64 nt, hsa
aaaaaaaaacuguuguagaaauucuuaauuuggaucuauuuauuagucagaguuucagcuuucu

SEQ ID NO: 718498 - RNA, 64 nt, hsa
gcauauucaacacacugccuuauuacauaacugaucuauuuauuaucgcauacagauauucuaa

SEQ ID NO: 718499 - RNA, 64 nt, hsa
gggaguauuugguauguugggauaaggaaacacuucuauuuaaugcuuccagggauuuuuuuuu

SEQ ID NO: 718500 - RNA, 64 nt, hsa
ccuggguuaggguguguguucaccuucaaaauguucuauuuaacaacugggucaugugcaucug

SEQ ID NO: 718501 - RNA, 64 nt, hsa
uuaaccgcaucagaagccuauuguaaauacaaguucuauuuaaguguacuaauuaacauauaau

SEQ ID NO: 718502 - RNA, 64 nt, hsa
uaaaugaaguuuauacaguacagugguucuacaaucuauuuauuggacauguccaugaccagaa

SEQ ID NO: 718503 - RNA, 64 nt, hsa
ucaauuugccuucaacaaagagaagucagcaaguucuauuuaugcugaaagaacuauuccauga

SEQ ID NO: 718504 - RNA, 64 nt, hsa
caauuaucuacccaccugucuuccucucuagcaaucuauuuacuguuuaucaaucuaucaaugu

SEQ ID NO: 718505 - RNA, 64 nt, hsa
ucacucccauguuggguuugagacagacaccuuuucuauuuaccuccuaauggcauggagacuc

SEQ ID NO: 718506 - RNA, 64 nt, hsa
cccugcccucaggcuccccagugcuccuggcccuucuauuuauuugacugauuauugcuucuuu

SEQ ID NO: 718507 - RNA, 52 nt, hsa
ggcgcaugagaccauauuaaauucuauuuacuauuuguugaauuuauuuuuc

SEQ ID NO: 718508 - RNA, 64 nt, hsa
agccuuuaaauucuaaacaaauuauaaugcaucaucuauuuaggaguuagauuuggaugugcua

SEQ ID NO: 718509 - RNA, 64 nt, hsa
cuaauauuuucacaguuuauuaauauauuuaauuucuauuuaaauuuuagauuauuuuuauuac

SEQ ID NO: 718510 - RNA, 64 nt, hsa
gagcaauaauaauuaauucacacaccauauggauucuauuuauaaaucacccacaaacuuguuc

SEQ ID NO: 718511 - RNA, 64 nt, hsa
aacauuaugacacuuuaaaacaguagcaaagaagucuauuuauuaacccacaaauguagcauca

SEQ ID NO: 718512 - RNA, 64 nt, hsa
aaacaagugaauaggaaaauaauuaauauauuauucuauuuagcuuguaaaacacauggaaucu

SEQ ID NO: 718513 - RNA, 64 nt, hsa
aauccuuuaauuaguuuauggcuucaucuccuuaucuauuuaaaaaacauaguaaauaauguuu

SEQ ID NO: 718514 - RNA, 64 nt, hsa
uuauuuuucuacuuucccacuuuucuaaaaggucucuauuuaaaugccacugucaaucccagca

SEQ ID NO: 718515 - RNA, 64 nt, hsa
cuccaccaaguucacuguucaucauuuacaggucucuauuuauguauuuauuauuuauuuuucu

SEQ ID NO: 718516 - RNA, 64 nt, hsa
cugagccaagcccuccccaucccauguauuuaucucuauuuaauauuuaugucuauuuaagccu

SEQ ID NO: 718517 - RNA, 64 nt, hsa
caucccauguauuuaucucuauuuaauauuuaugucuauuuaagccucauauuuaaagacaggg

SEQ ID NO: 718518 - RNA, 64 nt, hsa
cagcaaaaucucauuucauaagacuuacaauaacucuauuuaaaauucagguauuguacucggg

SEQ ID NO: 718519 - RNA, 64 nt, hsa
cuuaccuuucuaaacuccuuuagaguuaacgacuucuauuuaguauuguugguaucuccagccc

SEQ ID NO: 718520 - RNA, 64 nt, hsa
uauuuguguauuuauuuauuuaucuauuuauuauucuauuuaaucucuuggccucacccaggga

SEQ ID NO: 718521 - RNA, 64 nt, hsa
cuuccaguuauuuauuuguguauuuauuuauuuaucuauuuauuauucuauuuaaucucuuggc

SEQ ID NO: 718522 - RNA, 64 nt, hsa
ccucuuaaauuccuaaacaauaucaucuaggacuucuauuuaaguuauuuaaaauaaaucuucc

SEQ ID NO: 718523 - RNA, 64 nt, hsa
aacucuaccgagugguuuuuguauauacuaaaguucuauuuagagcuuuucuguuuugggcaag

SEQ ID NO: 718524 - RNA, 64 nt, hsa
uaaaugcaauauaugucuugucuuuauuauggcaucuauuuaggaguuguucaaaucacugcag

SEQ ID NO: 718525 - RNA, 64 nt, hsa
uaaaccugucucuauuacagcauguugccauacaucuauuuaagugcauaaggucuuuggccuu

SEQ ID NO: 718526 - RNA, 64 nt, hsa
uuuguuuauuucuuugguuuguuaacuagugucaucuauuuagagaaacauuuuuguuuuuaau

SEQ ID NO: 718527 - RNA, 64 nt, hsa
uguuuuagggaucaauuaccuaacuguuccuuggucuauuuauguauaagaaugcuuuuuaaag

SEQ ID NO: 718528 - RNA, 64 nt, hsa
uaagccauccuguuagcuuuuaaaggaaguuaauuuaauuaacauuaauauacucuaugggcuc

SEQ ID NO: 718529 - RNA, 64 nt, hsa
aagaccccaucuccauuuuuuuuuuaaugauuuuuuaauuaaaaaaaagaacaacaggauagag

SEQ ID NO: 718530 - RNA, 64 nt, hsa
ggaaaacuuaggacuuauuggguuauuauuauuuuuaauuaaagcugguuuaauuaaaaagaaa

SEQ ID NO: 718531 - RNA, 64 nt, hsa
uauuggguuauuauuauuuuuaauuaaagcugguuuaauuaaaaagaaagaaacuuuuuucugg

SEQ ID NO: 718532 - RNA, 64 nt, hsa
acugacauauacagaaaaaggagcaguuuuaguuuuaauuaauuaaaauuaacagaugugauga

SEQ ID NO: 718533 - RNA, 64 nt, hsa
acauauacagaaaaaggagcaguuuuaguuuuaauuaauuaaaauuaacagaugugaugaggau

SEQ ID NO: 718534 - RNA, 64 nt, hsa
ggcuggguaacagagugagauccugucucaaaaauuaauuaauuaauuaauuaaaauaaacuag

SEQ ID NO: 718535 - RNA, 64 nt, hsa
ggguaacagagugagauccugucucaaaaauuaauuaauuaauuaauuaaaauaaacuagguaa

SEQ ID NO: 718536 - RNA, 64 nt, hsa
aacagagugagauccugucucaaaaauuaauuaauuaauuaauuaaaauaaacuagguaaacuu

SEQ ID NO: 718537 - RNA, 64 nt, hsa
gagugagauccugucucaaaaauuaauuaauuaauuaauuaaaauaaacuagguaaacuuggau

SEQ ID NO: 718538 - RNA, 64 nt, hsa
uagaaguaggaagugaaaauagguauacaguggauuaauuaaaugcagcgaaccaauauuugua

SEQ ID NO: 718539 - RNA, 64 nt, hsa
auuagcauuuaguccaaugucuuuuuaagcuuauuuaauuaaaaaauuuccagugagcuuauca

SEQ ID NO: 718540 - RNA, 64 nt, hsa
uaucuguuuuucuggugagggucaaauauuuuuguuaauuaagcucacaaauuugauaaauuaa

SEQ ID NO: 718541 - RNA, 64 nt, hsa
ucuuucccccaguuguacuuacccuaucuuuucuuuaauuaacauucgauuccaugagcuucuu

SEQ ID NO: 718542 - RNA, 64 nt, hsa
auagagaauaucaucugauagugucuuauuuauauuaauuaaugucuuugaaaagggaaaagua

SEQ ID NO: 718543 - RNA, 64 nt, hsa
uuuuaacugacucuuaaugaaacuuuaauuuuacuuaauuaagaaauggaauuuauauacaaaa

SEQ ID NO: 718544 - RNA, 64 nt, hsa
aucaggacaaagagacagacuauuaacuccacaguuaauuaaggacguauguuccauguuuauu

SEQ ID NO: 718545 - RNA, 64 nt, hsa
cuucuuuccccacucaauucuuccugcccuguuauuaauuaagauaucuucagcuuguagucag

SEQ ID NO: 718546 - RNA, 64 nt, hsa
ucaauuucuuauuaauuaaucuugaugauucuuauuaauuaaucacauuugcaggaaauucaga

SEQ ID NO: 718547 - RNA, 64 nt, hsa
ugggccuguuacucauccugcuaucaauuucuuauuaauuaaucuugaugauucuuauuaauua

SEQ ID NO: 718548 - RNA, 64 nt, hsa
accaauuauaagugagaauacuguuuuccuuaguuuaauuaauacaauguuauguuuuuuagag

SEQ ID NO: 718549 - RNA, 64 nt, hsa
uaugaaauuugugccuaauuuaacuuaacauuguuuaauuaaauggaaccacuacuuauauaca

SEQ ID NO: 718550 - RNA, 64 nt, hsa
cacuaagaaaagagcaguuguaacucaaugaaauuuaauuaaacaugcuacuuuugauuucauu

SEQ ID NO: 718551 - RNA, 64 nt, hsa
agaggaccuauaugaaugguuuuaugucauuuuuuuaauuaaaaaagaaaaauucauauaaucg

SEQ ID NO: 718552 - RNA, 64 nt, hsa
uacaaaaaaaaaacacaugguuaaauguuaaauuuuaauuaaggcccccaaaaauuaaauauaa

SEQ ID NO: 718553 - RNA, 64 nt, hsa
uuacagcugaaaauuuugagaagguaaaaguuucuuaauuaaaauaugaacauauuuagcuugc

SEQ ID NO: 718554 - RNA, 64 nt, hsa
uucaacuauagguuagucagaaugcuguuuuucguuaauuaacuuagccuguguugauaucucc

SEQ ID NO: 718555 - RNA, 64 nt, hsa
uugauuuuuucuucagaauaugguauacuuaaaauuaauuaauuaagacaguuucuuuuuucuu

SEQ ID NO: 718556 - RNA, 64 nt, hsa
uuuuuucuucagaauaugguauacuuaaaauuaauuaauuaagacaguuucuuuuuucuuuucu

SEQ ID NO: 718557 - RNA, 64 nt, hsa
aucauaaaugugcuacacauuuauguuuguggauuuaauuaaaguauuuuaauaugguuuucag

SEQ ID NO: 718558 - RNA, 64 nt, hsa
ugacuuaucagcaauggaagaugcuuuggaugaguuaauuaaggauugugcucagcagcuguuu

SEQ ID NO: 718559 - RNA, 64 nt, hsa
caugggauuaacuugagggucacuauugagccuauuaauuaauuauuguuuuaauaaaacaaac

SEQ ID NO: 718560 - RNA, 64 nt, hsa
augguaauaugccugucuuuaaaguguuauuuuauuaauuaaaaggauauggcuauuauuauau

SEQ ID NO: 718561 - RNA, 64 nt, hsa
ugaucugcuguaaaagaugaagauuuaagugaccuuaauuaaccuguccugugcccuacccuua

SEQ ID NO: 718562 - RNA, 64 nt, hsa
ugaaauaaguucuuugacagagcauauugcuugguuaauuaaguaaccuaaaguaugcauuagg

SEQ ID NO: 718563 - RNA, 64 nt, hsa
aaagugucaugccuugaccaaucuaaugaauugauuaauuaacugggccuuuauacuuaacuaa

SEQ ID NO: 718564 - RNA, 64 nt, hsa
uucacugcagaaaauugauuaaguggcuguccuuuuaauuaagaguguggagucauaaacuuaa

SEQ ID NO: 718565 - RNA, 64 nt, hsa
gagggggagggugaugcauuaauuaauggcuucguuaauuaaugucauguugcuugucgcuuuc

SEQ ID NO: 718566 - RNA, 64 nt, hsa
ucagauggacugggaggagggggagggugaugcauuaauuaauggcuucguuaauuaaugucau

SEQ ID NO: 718567 - RNA, 64 nt, hsa
ggaugccaguuaauuaaaugaguacguaaauaaauuaauuaaaacacauagaucugcuuugugu

SEQ ID NO: 718568 - RNA, 64 nt, hsa
uacauucacucuguuucacguauguggaugccaguuaauuaaaugaguacguaaauaaauuaau

SEQ ID NO: 718569 - RNA, 64 nt, hsa
aaaauuaaugaagacagaggcuagaaagcauccauuaauuaaugagacacacuuaacuacuuau

SEQ ID NO: 718570 - RNA, 64 nt, hsa
uuuaguuuguuuuuguuugguauaaauuaauuuguuaauuaaauauuucuuaaguauaaaccuu

SEQ ID NO: 718571 - RNA, 64 nt, hsa
ucugcauugagcauauuuucuuacuuuuauuauuuuaauuaauaugacauaagcaaucauuuua

SEQ ID NO: 718572 - RNA, 64 nt, hsa
aaugcuuagugaagcauaaaguuaccuacaucaauuaauuaaaugaacuuauguacagaaaaca

SEQ ID NO: 718573 - RNA, 64 nt, hsa
gaauaaaaggccucuagaaauugcugaacaaugguuaauuaagauauugcuaacacaaucgagu

SEQ ID NO: 718574 - RNA, 64 nt, hsa
acaauacauagcugcaauguguacaauggcugauuuaauuaaauaaaauguacaaguguuaaau

SEQ ID NO: 718575 - RNA, 64 nt, hsa
ucuccauuuuacuuauggcuuuucuaauuuuuaauuaauuaauuuauuuuuuugagacagaguc

SEQ ID NO: 718576 - RNA, 64 nt, hsa
aaacucuccauuuuacuuauggcuuuucuaauuuuuaauuaauuaauuuauuuuuuugagacag

SEQ ID NO: 718577 - RNA, 64 nt, hsa
auuuuuagauucaaacaaucccuuuauccuuaauuuaauuaauuaucauaugcuuuuuuuaaug

SEQ ID NO: 718578 - RNA, 64 nt, hsa
uaaugauuguuaacuuuuugaaauuaguuuacaauuaauuaagauuucauuaugauggaaggag

SEQ ID NO: 718579 - RNA, 64 nt, hsa
uaguagagauaaauuuuuguuaauuaaauuaaguuuaauuaaaugccauguguuaaauaaaguc

SEQ ID NO: 718580 - RNA, 64 nt, hsa
cauccugaagggcuguaguagagauaaauuuuuguuaauuaaauuaaguuuaauuaaaugccau

SEQ ID NO: 718581 - RNA, 64 nt, hsa
aaugauaagaauaaauuuaauuuaccaaauauuguuaauuaaaauuuuagauacuuaacauuua

SEQ ID NO: 718582 - RNA, 64 nt, hsa
uauuauaucugggaccucucuuuuagaccuaaaauuaauuaacauaucuacuuauauguuacuu

SEQ ID NO: 718583 - RNA, 64 nt, hsa
aagcucacugcugaucguagaaaauuugcuuuaauuaauuaaguaucugggauuauucuuugaa

SEQ ID NO: 718584 - RNA, 64 nt, hsa
uaaaaagcucacugcugaucguagaaaauuugcuuuaauuaauuaaguaucugggauuauucuu

SEQ ID NO: 718585 - RNA, 64 nt, hsa
acaaucuguaacagaaucaagaaacaaauacauuuuaauuaaacaaucuauauggaacaaacau

SEQ ID NO: 718586 - RNA, 64 nt, hsa
ucuccauguauauaacagaaucaagaaacaaauuuuaauuaaacaaucuguaacagaaucaaga

SEQ ID NO: 718587 - RNA, 64 nt, hsa
uucuauguuuuuaagcuacacgagaauuuuuuuuuuaauuaauucucacuguuuguucagucug

SEQ ID NO: 718588 - RNA, 64 nt, hsa
gaaugagcugaaacagaccuccugauaccuuugcuuaauuaaacuagaugauaauucucaggua

SEQ ID NO: 718589 - RNA, 64 nt, hsa
ggcgacagagcaagacuccaucucaaaaaaaaaguuaauuaauuaauuagauuaaaguacaaca

SEQ ID NO: 718590 - RNA, 64 nt, hsa
acagagcaagacuccaucucaaaaaaaaaguuaauuaauuaauuagauuaaaguacaacaauua

SEQ ID NO: 718591 - RNA, 64 nt, hsa
uuguauuuaccaaagauuuaaaucaguugauuaauuaauuaacucaaauacugugaacuaucuc

SEQ ID NO: 718592 - RNA, 64 nt, hsa
auacuuguauuuaccaaagauuuaaaucaguugauuaauuaauuaacucaaauacugugaacua

SEQ ID NO: 718593 - RNA, 64 nt, hsa
auauauuuuuaagauaauaauauauguuuaccuuuuaauuaaugaaauaucuguauuuaauuuu

SEQ ID NO: 718594 - RNA, 64 nt, hsa
agguccaagauaccuaaaagagauuucaagagauuuaauuaaucaugaauguguaacacagugc

SEQ ID NO: 718595 - RNA, 64 nt, hsa
uauuugucaacagauuuaaagaaaaccacaguuauuaauuaaagaaaauuaauuauguguaguu

SEQ ID NO: 718596 - RNA, 64 nt, hsa
aaagaacuguauaagguggucauaagugaauauuuuaauuaaaauugguaaaaauaaauaauaa

SEQ ID NO: 718597 - RNA, 64 nt, hsa
cagggaaaauauccauuuaucuucucucucgugcuuaauuaauagcuuuaucuuuuuuuauacc

SEQ ID NO: 718598 - RNA, 64 nt, hsa
acugccucauugucuucuguacaucuuacuggguuuaauuaaaaaaaaagaaaaaacucuguug

SEQ ID NO: 718599 - RNA, 64 nt, hsa
auauugaugauccuacuaauuauccugcuguucuuuaauuaaugcuuaaugaauaauauggcac

SEQ ID NO: 718600 - RNA, 64 nt, hsa
gaaucauuacauuuauaauaacaaaggccacaauuuaauuaauugguaagauauaaugcaaaaa

SEQ ID NO: 718601 - RNA, 64 nt, hsa
auauguuuucaguacaauuuugaacagcaacuuuuuaauuaaacaucuuccaguguuaggaagu

SEQ ID NO: 718602 - RNA, 64 nt, hsa
uuguuuguuuguuuaauguaucccuguucuguuuuuaauuaaacuccaagucucauuuuacaua

SEQ ID NO: 718603 - RNA, 64 nt, hsa
aguuuuuuuuuuuuuuuuaaacauggugccacuuuuaauuaacuaaauguuacaaaauucucag

SEQ ID NO: 718604 - RNA, 64 nt, hsa
ucauuaacuucauaacagcaugaauuuauuugaauuaauuaacauuugaguuuguuuaagguau

SEQ ID NO: 718605 - RNA, 64 nt, hsa
uuaacuguauaaaaauguucauuuuacacaauauuuaauuaaaguauuucuugucugugaauuu

SEQ ID NO: 718606 - RNA, 64 nt, hsa
ccuaaaguuuaaaauaaaauuuacuucugauguuuuaauuaaaauguuugccacauuaacuuuu

SEQ ID NO: 718607 - RNA, 64 nt, hsa
cuuuuauuccgaagaacucggagcauuuauuuuguuaauuaaauugcacauauuuuuaaaaguu

SEQ ID NO: 718608 - RNA, 64 nt, hsa
ugcacuugauagggacucaaagaauguuauauuuuuaauuaauuucuuuuucucuuccguacaa

SEQ ID NO: 718609 - RNA, 64 nt, hsa
cauuuauuuacaugugauugugauucaucaucccuuaauuaaauaucaaauuauauuuguguga

SEQ ID NO: 718610 - RNA, 64 nt, hsa
cagcaugauguguuguguauaauuggaguagauauuaauuaagucaccuguauaauguuuugua

SEQ ID NO: 718611 - RNA, 64 nt, hsa
uaaauuauguuuuaaacacaugccuuaaauuuguuuaauuaaauuuaacucugguuucuaccag

SEQ ID NO: 718612 - RNA, 64 nt, hsa
gagccauucacacuuuuuauuuaauuaaauguauuuaauuaaaucucaaauuuauuuuaaugua

SEQ ID NO: 718613 - RNA, 64 nt, hsa
ucauaaacgauucugagccauucacacuuuuuauuuaauuaaauguauuuaauuaaaucucaaa

SEQ ID NO: 718614 - RNA, 64 nt, hsa
cugauuacucuuuuuuuaaguuaaagacuaucaguuaauuaagauugaguuuuuaugaugguua

SEQ ID NO: 718615 - RNA, 64 nt, hsa
uucuacuuucauuucuuaagcuuuuaaaauucauuuaauuaauauucuguuguuguuuugggga

SEQ ID NO: 718616 - RNA, 63 nt, hsa
augaaacccuaugguguuuguacauuuaauuaauuuaauuaagauauuugggcuuuuuuuuuu

SEQ ID NO: 718617 - RNA, 64 nt, hsa
uuauucaguaugaaacccuaugguguuuguacauuuaauuaauuuaauuaagauauuugggcuu

SEQ ID NO: 718618 - RNA, 64 nt, hsa
agcuuucuuacccagcauagugggagaguggagauuaauuaaaauuguuaauuaagaguuaauu

SEQ ID NO: 718619 - RNA, 64 nt, hsa
agcauagugggagaguggagauuaauuaaaauuguuaauuaagaguuaauuccuauugacccag

SEQ ID NO: 718620 - RNA, 64 nt, hsa
uuaauggauuuaauggaauuguaauuuuaaacauuuaauuaaauguaauuugggggauauuuug

SEQ ID NO: 718621 - RNA, 64 nt, hsa
uauaaaaauguuaauucagaauuaguuuaaugccuuaauuaaacuaauuaauagcuuuggacac

SEQ ID NO: 718622 - RNA, 64 nt, hsa
uggggggagaaaaaggaugucuuucaggauuauuuuaauuaauuuuuuucauaauugagacaga

SEQ ID NO: 718623 - RNA, 64 nt, hsa
aauuacauuguauagccccacagauuaaauuuaauuaauuaauucaaaacauguuaaacguuac

SEQ ID NO: 718624 - RNA, 64 nt, hsa
uaagaauuacauuguauagccccacagauuaaauuuaauuaauuaauucaaaacauguuaaacg

SEQ ID NO: 718625 - RNA, 64 nt, hsa
cagaaacauuugaaauagaauuugcaugucugccuuaauuaacuuaaagacugauuuuaaucug

SEQ ID NO: 718626 - RNA, 64 nt, hsa
aaauuacucauaauuuauaaugcuuaauauaaucuuaauuaaauuuagcaguuuuaguauaaga

SEQ ID NO: 718627 - RNA, 64 nt, hsa
uaaaaugcucaauuauauauuuuuguugaguuuuuuaauuaaagacuuguaaaaaaaaaaaaca

SEQ ID NO: 718628 - RNA, 64 nt, hsa
cccauuggaauguauuucuagguucucuucaggauuaauuaaauaaacaugcaauuuaugaaaa

SEQ ID NO: 718629 - RNA, 64 nt, hsa
gccuggcacauaguauguauucaaaacaaguguguuaauuaauaaaaauauauaaaucucauuu

SEQ ID NO: 718630 - RNA, 64 nt, hsa
cuccagccugcgugacagagagccugucucuaaauuaauuaauuaauuaauuuaauucaauuuu

SEQ ID NO: 718631 - RNA, 64 nt, hsa
agccugcgugacagagagccugucucuaaauuaauuaauuaauuaauuuaauucaauuuuaaaa

SEQ ID NO: 718632 - RNA, 64 nt, hsa
ugcgugacagagagccugucucuaaauuaauuaauuaauuaauuuaauucaauuuuaaaaagac

SEQ ID NO: 718633 - RNA, 64 nt, hsa
cccccgcccugccuggccucauccuuguauuuaauuaauuaaacaagccccuuuuuaaacccua

SEQ ID NO: 718634 - RNA, 64 nt, hsa
cccucccccgcccugccuggccucauccuuguauuuaauuaauuaaacaagccccuuuuuaaac

SEQ ID NO: 718635 - RNA, 64 nt, hsa
gaaauacauauuuuuauuugacuauguuuggaguuuaauuaauuauauauuuauacauuauuuu

SEQ ID NO: 718636 - RNA, 64 nt, hsa
accuuauucuacaucauuaaccaguaaggacuuuuuaauuaaccacaauaccacuaucacaccu

SEQ ID NO: 718637 - RNA, 64 nt, hsa
aguacgagcugcucuaagaagggaacccccaaauuuaauuaaagccuuaagcacaauuaauuaa

SEQ ID NO: 718638 - RNA, 64 nt, hsa
gaacccccaaauuuaauuaaagccuuaagcacaauuaauuaaaagugaaacguaauuguacaag

SEQ ID NO: 718639 - RNA, 64 nt, hsa
gaacugguuuuagcauuuacaaacuaaauuccaguuaauuaauuaauagcuuuauauugccuuu

SEQ ID NO: 718640 - RNA, 64 nt, hsa
ugguuuuagcauuuacaaacuaaauuccaguuaauuaauuaauagcuuuauauugccuuuccug

SEQ ID NO: 718641 - RNA, 64 nt, hsa
uggagaguggguuuuguccauuauuaauaauuaauuaauuaacaucaaacacggcuucucaugc

SEQ ID NO: 718642 - RNA, 64 nt, hsa
cuuuuggagaguggguuuuguccauuauuaauaauuaauuaauuaacaucaaacacggcuucuc

SEQ ID NO: 718643 - RNA, 63 nt, hsa
ugcauuaacccagaaauaccucgcuucuaucugugcacuuagcugggaacuuacccacuguaa

SEQ ID NO: 718644 - RNA, 63 nt, hsa
cguccuggcuccaguuggaacacuuuccugagaugcacuuacuucucagcuucugcgaucaga

SEQ ID NO: 718645 - RNA, 63 nt, hsa
aagggcccaaaugcauaaguuucuuugcacuguugcacuuacuuaauacaaauaaauguuuuu

SEQ ID NO: 718646 - RNA, 63 nt, hsa
cuacuguucaguuuuuuaaaaguuuugaaaugcugcacuuacauuuaaaaaaacaacaacaac

SEQ ID NO: 718647 - RNA, 63 nt, hsa
caccauuucccccugcucccccacagccgguucugcacuuaucaccgagucgccccuggaagc

SEQ ID NO: 718648 - RNA, 63 nt, hsa
ugaccaagaaauuggguuucuuuucccucagccugcacuuacucuucuauuaagaccagaaaa

SEQ ID NO: 718649 - RNA, 63 nt, hsa
auccuucuucucuguguuuucugguuuaaaagcugcacuuauauuuuagccuuauuauuuucu

SEQ ID NO: 718650 - RNA, 63 nt, hsa
augaaaugaugucauaagcgaucacuuccuauaugcacuuauucucaagaagaacaucuuuau

SEQ ID NO: 718651 - RNA, 63 nt, hsa
gaaaauuguuuuauuucaggcauguucccuuugugcacuuagguucauugugccucaguuccu

SEQ ID NO: 718652 - RNA, 63 nt, hsa
ucucuguaaaauaauuggaaugaaaauacuucuugcacuuaaacacugcacaugccguacuuu

SEQ ID NO: 718653 - RNA, 63 nt, hsa
uuucuuuagugggggaggguaagaaaagcaguuugcacuuaaaaagaaaaaaaaaaaacgggu

SEQ ID NO: 718654 - RNA, 63 nt, hsa
aaagcauuuugcacaguguuuguuuuccugucuugcacuuacaaauaaggucuaugggaguag

SEQ ID NO: 718655 - RNA, 63 nt, hsa
ggaagacagucuuagcacugucacuuagcagauugcacuuaagucccuugugcuggccagaug

SEQ ID NO: 718656 - RNA, 63 nt, hsa
cugaggggcuguccagucugcuagaaugcuaauugcacuuaggccucaugguucuaguaaacg

SEQ ID NO: 718657 - RNA, 63 nt, hsa
cuuguuugagcucuugagcuuagaaguugauuuugcacuuauuuuuuuggggggugggaaugu

SEQ ID NO: 718658 - RNA, 63 nt, hsa
ugaggcugacacgucugugugaugcaguguggcugcacuuaagggucuguuucucagcaucau

SEQ ID NO: 718659 - RNA, 63 nt, hsa
ccaguauucuaagacauuugaguaauugcuguuugcacuuacugcauggucagaccacgucac

SEQ ID NO: 718660 - RNA, 63 nt, hsa
uuuuacaugugauagucaguuguacaaagaaaaugcacuuaaaccuguuucuaaauuauauau

SEQ ID NO: 718661 - RNA, 63 nt, hsa
guucagccagucagugacugguggguuugaaucugcacuuauccccaccaccuggggaccccc

SEQ ID NO: 718662 - RNA, 63 nt, hsa
augacuaggaguguuaggggcagaaguuuugaaugcacuuaaccggaggagggcgcagggugg

SEQ ID NO: 718663 - RNA, 63 nt, hsa
aauuucauacuauuuagauuuucuuuuuuaucuugcacuuauuguccccuuuuuaguuuuuuu

SEQ ID NO: 718664 - RNA, 63 nt, hsa
guagcagcuuagauuaacguugauuucauuccaugcacuuagaguugcuuucaguaacauuuu

SEQ ID NO: 718665 - RNA, 63 nt, hsa
cuccuugggcucuucccgcaaaucaacacuuucugcacuuaucuuuuggagcaaauugacaug

SEQ ID NO: 718666 - RNA, 63 nt, hsa
gugcaggugacagcaggacuugcuaaagcacuuugcacuuaauggcuguugagggccacuuuu

SEQ ID NO: 718667 - RNA, 63 nt, hsa
auagauuuaaguaaacagauguauuuugcacagugcacuuaugucuauuuuaacaauccuccu

SEQ ID NO: 718668 - RNA, 63 nt, hsa
aucacgucuuuuguuaugcuaguaucagucagaugcacuuagagugaagaaacacuguaauua

SEQ ID NO: 718669 - RNA, 63 nt, hsa
aaaacaguucuuguggccuucuauuaaauaguuugcacuuaagccuugccaguguucugagcu

SEQ ID NO: 718670 - RNA, 63 nt, hsa
ucuuacugccaucauuauuuguuaaagauauuuugcacuuaauuuugugggaaaaauauugcu

SEQ ID NO: 718671 - RNA, 63 nt, hsa
cacgguucuaauuaagugugaagguauagcuauugcacuuaugccaucuccaaaauuucuuaa

SEQ ID NO: 718672 - RNA, 63 nt, hsa
ccccacccaucacauggcuggcuggcugcugggugcacuuacccuccuuggcuugguuacuuc

SEQ ID NO: 718673 - RNA, 63 nt, hsa
ugcacaggccucagcuuugaagaacggagucuuugcacuuacacacacucuuccuguucugcc

SEQ ID NO: 718674 - RNA, 63 nt, hsa
uuugcagcggaucacuggacaucaaagauucauugcacuuaugaacaaggaaccuucuuuuca

SEQ ID NO: 718675 - RNA, 63 nt, hsa
agggagaauuuuagacuuaauuuuuaacucuauugcacuuaaagauuuuaguuagguuaccac

SEQ ID NO: 718676 - RNA, 63 nt, hsa
uacaucuaaauuacaacccuuaauugccacgugugcacuuacuacucuccaguaugucuuauu

SEQ ID NO: 718677 - RNA, 63 nt, hsa
uacaaauuuaguuuaaguguuugaacaacuauaugcacuuacgguuguguguuuaaaaugucu

SEQ ID NO: 718678 - RNA, 63 nt, hsa
guaaaaagauauuucuaauuuacuguugcccauugcacuuacauaccaccaccaagaaagccu

SEQ ID NO: 718679 - RNA, 63 nt, hsa
guuuaaaauuuuugugcaauucauauauuaaauugcacuuacuugcauacgcucauauucuag

SEQ ID NO: 718680 - RNA, 63 nt, hsa
gucauuguccccacaaugugccagucgacuauuugcacuuaccuuguccuauauauccguacg

SEQ ID NO: 718681 - RNA, 63 nt, hsa
ugcagaggccagaggcccccagcccagggcuccugcacuuacuugcuuauuugacaacguuuc

SEQ ID NO: 718682 - RNA, 63 nt, hsa
gucaagcaagacuuugugaauuugugacaaguuugcacuuacaaaaucauguaaauaugucac

SEQ ID NO: 718683 - RNA, 63 nt, hsa
aaaugccuuaaaaggaaugcauauggauaaaguugcacuuauaacacccuucaacaaaaucua

SEQ ID NO: 718684 - RNA, 63 nt, hsa
uggagaguugugacaaguacagguuaucaaguuugcacuuaacuaugccaaaaaaaguuugaa

SEQ ID NO: 718685 - RNA, 63 nt, hsa
gccugauggagugagaagaaaguccuugguguuugcacuuaaaugaaaaccuuuucagugaug

SEQ ID NO: 718686 - RNA, 63 nt, hsa
uuauacacaacuuugcaaauuauuuauuacuugugcacuuaguaguuuuuacaaaacugcuuu

SEQ ID NO: 718687 - RNA, 63 nt, hsa
gaauuaguguucuagacucugcuuugcacagcuugcacuuacagugauuguacauauuguaca

SEQ ID NO: 718688 - RNA, 63 nt, hsa
aagucuuuuuuuuuuuugucuagguagucagucugcacuuaaauaucaaucauuuuccuuuuu

SEQ ID NO: 718689 - RNA, 63 nt, hsa
uauaaucacaggagacucugccuucauuauccuugcacuuaacggaaguuacaucaggcaagu

SEQ ID NO: 718690 - RNA, 63 nt, hsa
augucuaccuggcagauacucagaaauguaguuugcacuuaagcuguaauuuuauuuguucuu

SEQ ID NO: 718691 - RNA, 63 nt, hsa
cuaugaaguaaagaacugcacaugaagaaauacugcacuuacaaucccaccuuuccucaaaug

SEQ ID NO: 718692 - RNA, 63 nt, hsa
agagaucuguuauuuucagguagugccauaaucugcacuuagcauuggcuugcuucaguuguu

SEQ ID NO: 718693 - RNA, 63 nt, hsa
gcauacaauuugagcaugcuguauucuaccacuugcacuuacucaucuucuagccuuaugacc

SEQ ID NO: 718694 - RNA, 63 nt, hsa
gagcgugacacucauuuuagugcuuuguuuccgugcacuuaaaaauaauugagaagaaaaacu

SEQ ID NO: 718695 - RNA, 63 nt, hsa
ucaggguaauuguauugagaacucaaauauacgugcacuuacaugugugguucguacucaagu

SEQ ID NO: 718696 - RNA, 63 nt, hsa
cuuauaaauggagcacuuagaaauuuguuguucugcacuuaaccuagagagagaaaaaaugcu

SEQ ID NO: 718697 - RNA, 63 nt, hsa
uacaauuaaaaccucauuuuuuuuuuccauuuuugcacuuaacagugaugaauacuuuuacgu

SEQ ID NO: 718698 - RNA, 63 nt, hsa
uaauuucuuaauuuaaaaugauagcacuucucuugcacuuaagaauggcauccauaagauucu

SEQ ID NO: 718699 - RNA, 63 nt, hsa
ugugauuccacuggcggaggauucuuggaagcuugcacuuaguuuccccugacuucaccccau

SEQ ID NO: 718700 - RNA, 63 nt, hsa
aauuagaagcggauuuggaaaugcaaacuaacgugcacuuagauauccaagugggugagcuua

SEQ ID NO: 718701 - RNA, 63 nt, hsa
uuuaauuaaaaaggcaaaaccugaaccaccuucugcacuuaaagaagucuaacaguacaaaua

SEQ ID NO: 718702 - RNA, 63 nt, hsa
uauccagccuucacuccagcugguuaaaaauguugcacuuaucagcaacccuaccacuuucau

SEQ ID NO: 718703 - RNA, 63 nt, hsa
uauucaagaaaaugaacaugcucuucaaaaagaugcacuuaguauuaaguugaaacuugaaca

SEQ ID NO: 718704 - RNA, 63 nt, hsa
gcucuauaaauuaaguuugugcuuuccuugaaaugcacuuauucuuauuacaagcauuuuaua

SEQ ID NO: 718705 - RNA, 63 nt, hsa
uuaaaauguaauuuaaaugaaagaaaauugaguugcacuuauugaccauuuuuuaauuuacuu

SEQ ID NO: 718706 - RNA, 63 nt, hsa
aggaggagcacaagauccucagcaacgaacaccugcacuuagaaaaaguggacagcuucugcc

SEQ ID NO: 718707 - RNA, 63 nt, hsa
auuucauuaggaucuaaaguugucugaguuaaaugcacuuaugugacucauguguccucuuag

SEQ ID NO: 718708 - RNA, 63 nt, hsa
auuaaaauuuaaaaaaaaaacauuucacucaguugcacuuagucguaugucuugcaugcuuag

SEQ ID NO: 718709 - RNA, 63 nt, hsa
aauuuuuccaggagggagaccuguugguuauugugcacuuaaaagaaccacccacaccucucu

SEQ ID NO: 718710 - RNA, 63 nt, hsa
cuuuaaacauauucagaacagaugcuugaaauaugcacuuagcacuuugguuccacaucuguc

SEQ ID NO: 718711 - RNA, 63 nt, hsa
uuuuaaguguaacauaacuguguuuacuucccaugcacuuaauacccuuaugcgcuaauuuug

SEQ ID NO: 718712 - RNA, 63 nt, hsa
aacacagucugcugcuauauagugggggaagcgugcacuuauuucuaaacauggguuuuuaac

SEQ ID NO: 718713 - RNA, 63 nt, hsa
cuuucauugucuucaucuuccugccauacuuugugcacuuauugcucuccuucugagucagga

SEQ ID NO: 718714 - RNA, 63 nt, hsa
ugcagccagucacuguguaaagccucucugaugugcacuuaagaguggguugcuuucucacaa

SEQ ID NO: 718715 - RNA, 63 nt, hsa
aaggcaucagucccuauguauuugcaguucaccugcacuuaaggcacucuguuauuuagacuc

SEQ ID NO: 718716 - RNA, 63 nt, hsa
cagaaugaaaccacauuuuuugguuugauaauaugcacuuauugacucccacucauuguuaug

SEQ ID NO: 718717 - RNA, 63 nt, hsa
uugcaauuuagcuugcuuucaagcuucaccccuugcacuuaacauaagcuauuuuuggcauug

SEQ ID NO: 718718 - RNA, 63 nt, hsa
uuaauaauguauauucuuucaugcuuuuuucugugcacuuaccuaagugugaauauguaaagg

SEQ ID NO: 718719 - RNA, 63 nt, hsa; identical to SEQ ID NO: 642382

SEQ ID NO: 718720 - RNA, 63 nt, hsa; identical to SEQ ID NO: 642383

SEQ ID NO: 718721 - RNA, 63 nt, hsa
agagcuaauauauuuauugccuauggcuuguuuugcacuuaauaaaauaauuuguuuuugcaa

SEQ ID NO: 718722 - RNA, 63 nt, hsa
aacaccggcauaagaaauuugacauuucacagaugcacuuacauauuuugaccacaaggggga

SEQ ID NO: 718723 - RNA, 63 nt, hsa; identical to SEQ ID NO: 642384

SEQ ID NO: 718724 - RNA, 63 nt, hsa; identical to SEQ ID NO: 642385

SEQ ID NO: 718725 - RNA, 63 nt, hsa
accguuuauuuaacauauauuuuuauuuuugauugcacuuaaauuuuguauaauuuguguuuc

SEQ ID NO: 718726 - RNA, 63 nt, hsa
gaauugauugcauaugcaagcccuggccacagcugcacuuacaggaugccucauagacgauga

SEQ ID NO: 718727 - RNA, 63 nt, hsa
uacaauuauugaaugaagcguuuuacaauacauugcacuuaauccauuguuuaaauuuacaac

SEQ ID NO: 718728 - RNA, 63 nt, hsa
uaggaagugacuugaauguacaaagauacuugaugcacuuauuuuuuaaugugagacagcaag

SEQ ID NO: 718729 - RNA, 63 nt, hsa
uacuguguuauuuaaaugcuaagccaaaguaucugcacuuagguauaccucuuuaugccaaua

SEQ ID NO: 718730 - RNA, 63 nt, hsa
caaaaagacaaaugauuguaggauccauggaagugcacuuaggcuugcugugguggaggccau

SEQ ID NO: 718731 - RNA, 63 nt, hsa
guggagaguggcaggaagcaagcauguuugcugugcacuuaggaaaggcuggugagccagagg

SEQ ID NO: 718732 - RNA, 63 nt, hsa
agcuaaauuugucccuuuuuuauuguuauuaauugcacuuaacauuuuuaguuauacuggaua

SEQ ID NO: 718733 - RNA, 63 nt, hsa
aauuguguucuuaaaauauuguguaagaaucacugcacuuagcuguuggaauguuguuaaaug

SEQ ID NO: 718734 - RNA, 63 nt, hsa
guaaaaauuggguaaauuuacuacugaggggagugcacuuauuuauuuaacuuacuuaucugg

SEQ ID NO: 718735 - RNA, 63 nt, hsa; identical to SEQ ID NO: 642386

SEQ ID NO: 718736 - RNA, 63 nt, hsa; identical to SEQ ID NO: 642387

SEQ ID NO: 718737 - RNA, 63 nt, hsa
cacuuugcuuguauuuuaaaaggaggauauauuugcacuuauguauacuuuuacaguuugcca

SEQ ID NO: 718738 - RNA, 63 nt, hsa
gauuaaauaauacauuuauaaucuacaacuguuugcacuuacagcuuuuuuuguaaauauaaa

SEQ ID NO: 718739 - RNA, 63 nt, hsa
ccccaugauguaaguuuaccuauguaacaaaccugcacuuauacccaugaacuuaaaaugaaa

SEQ ID NO: 718740 - RNA, 63 nt, hsa
gcaaagccuaguagagaaccagugcaccucaggugcacuuacauaugguggggcugaggcaaa

SEQ ID NO: 718741 - RNA, 63 nt, hsa
aucaaacaaaaaauaaaucucgaagaaaaaaaaugcacuuacaugugcuuauuuggcuuuucu

SEQ ID NO: 718742 - RNA, 63 nt, hsa
guggcacuucaaaaggcagcaccacugggcgccugcacuuauuugaaaauggaacuuugggag

SEQ ID NO: 718743 - RNA, 63 nt, hsa
caauuuucucuuggugcuaccugauggaauuccugcacuuaaaguucuggcugacuaaacaag

SEQ ID NO: 718744 - RNA, 63 nt, hsa
ugggagggcaaaaaaaaaaaaaaaguuuuuaugugcacuuaaauuuggggacaauuuuaugua

SEQ ID NO: 718745 - RNA, 63 nt, hsa
gaaggcuucugacgcuuguggccagacugcaauugcacuuauguguuaugcuacuaauauuug

SEQ ID NO: 718746 - RNA, 54 nt, hsa; identical to SEQ ID NO: 190234

SEQ ID NO: 718747 - RNA, 63 nt, hsa
ggucauagauucuugagcuguugugguuuuuagugcacuuaauauuagcuugcuuaaggcaua

SEQ ID NO: 718748 - RNA, 63 nt, hsa
cacaugcacacagaacucugacacaggaucagcugcacuuaagaaaucaucccagcuaaguuc

SEQ ID NO: 718749 - RNA, 63 nt, hsa
agcuacauugacgagacacuuacugguuuaauuugcacuuauuaaccaucuauugaauacaca

SEQ ID NO: 718750 - RNA, 63 nt, hsa
uaaacaagauauuuaaacuagaguaucuuauucugcacuuaugcauuaguuaaaaaaagauaa

SEQ ID NO: 718751 - RNA, 63 nt, hsa
gucauagcuaugacauuuguuaaaaauaaacucugcacuuauuuugauuugaauuaauuuugg

SEQ ID NO: 718752 - RNA, 63 nt, hsa
cgagggcaggaguggcucaacuuggucucgucuugcacuuagugcaaauaccaauaauuaaga

SEQ ID NO: 718753 - RNA, 63 nt, hsa
guucacauggucaaaauuucaccacugaaacccugcacuuagcuagaaccucauuuuuaaaga

SEQ ID NO: 718754 - RNA, 63 nt, hsa; identical to SEQ ID NO: 642388

SEQ ID NO: 718755 - RNA, 63 nt, hsa; identical to SEQ ID NO: 642389

SEQ ID NO: 718756 - RNA, 63 nt, hsa
guuuuucauuuuaaaaaguccauaccuuauauaugcacuuaauuuguuggggcuuuacauacu

SEQ ID NO: 718757 - RNA, 63 nt, hsa
aauuccaccagggccagagcagcuccaccacugugcacuuagccaugauggcaacagaaacca

SEQ ID NO: 718758 - RNA, 63 nt, hsa
uucuucaaccagaaaaaccuauuguucuaaaagugcacuuaagagaugggauuacaaguggac

SEQ ID NO: 718759 - RNA, 63 nt, hsa
ugucaucauaaucuuuauggugggggcagacuuugcacuuacugcagugcaacacuugcacuu

SEQ ID NO: 718760 - RNA, 63 nt, hsa
ugaauguucuuuucaaaaaauaaaguagaaaaaugcacuuacuaagaacaugaaaaaaaauga

SEQ ID NO: 718761 - RNA, 63 nt, hsa
auaaacuauaauuguagaaagggguaauuucugugcacuuacaacaagcugaguguucauguu

SEQ ID NO: 718762 - RNA, 63 nt, hsa
ucauugaaaaaguccauagccaaaaccugacugugcacuuacuauaggacccugaccugccug

SEQ ID NO: 718763 - RNA, 63 nt, hsa
ugauuuuuaaaccugguuuacagguauuacuucugcacuuaccaaauaaugccagauggaaau

SEQ ID NO: 718764 - RNA, 63 nt, hsa
uugccuuaaaacuggagagaggaaucuaguauuugcacuuagcaaaauauuuaaaaacugaaa

SEQ ID NO: 718765 - RNA, 63 nt, hsa
cuggaauacaguuuucaguguaauuaauucaacugcacuuaacacuaauguccguguugguau

SEQ ID NO: 718766 - RNA, 63 nt, hsa
uauuuuggcauauuauucuccagguguuucuuaugcacuuauaaaaugauuugaacaaauaaa

SEQ ID NO: 718767 - RNA, 63 nt, hsa
ugccucagccuagauguuuugucuucucuuuucugcacuuaauaccugacaguaugaccgauc

SEQ ID NO: 718768 - RNA, 63 nt, hsa
cccauccccucccagaaauagagugacaaacucugcacuuaaguccccuguuucuguuuaacu

SEQ ID NO: 718769 - RNA, 63 nt, hsa
gaggggaaggaggagccccucuuucucccaugcugcacuuacuccuuuugcuaauaaaagugu

SEQ ID NO: 718770 - RNA, 63 nt, hsa
ccccaccgugguucuuuucacagcccucgacuuugcacuuaaaaagggauauuguaaaugaaa

SEQ ID NO: 718771 - RNA, 63 nt, hsa
gguugacuuaauauauuugcuuuuuuucucaccugcacuuagaggaaauuugaacaaguugga

SEQ ID NO: 718772 - RNA, 63 nt, hsa
cucauuuagagaggaaaaguaaccaucacugguugcacuuaugauuucaugugcggggaucau

SEQ ID NO: 718773 - RNA, 63 nt, hsa
cugucaagguacuugcuugugucugaacucuagugcacuuaugauuuuguagaccaugugaaa

SEQ ID NO: 718774 - RNA, 63 nt, hsa
uuguuguuuuguuugcuuugggaucuuguuggaugcacuuagauauggaaaauggaagccaaa

SEQ ID NO: 718775 - RNA, 63 nt, hsa
ugucucuaaauugauguucacccauuucaauauugcacuuauuaauggucuuuauuuuucuag

SEQ ID NO: 718776 - RNA, 63 nt, hsa
uguuuuguaagaaucacuguuacauucuucuuuugcacuuaaaguugcauugccuacuguuau

SEQ ID NO: 718777 - RNA, 63 nt, hsa
auaaugauguaaacauggaaaaacuuuaggaaaugcacuuauuaggcuguuuacauggguugc

SEQ ID NO: 718778 - RNA, 63 nt, hsa
cucucuugaauuuaggaaucauugaaaacuccuugcacuuagauuuaauuuauauguuaguua

SEQ ID NO: 718779 - RNA, 63 nt, hsa
aauauuuuuaacauuacugaggugaauuauuuaugcacuuaggaagugcuaaauuuuaaaagc

SEQ ID NO: 718780 - RNA, 63 nt, hsa
uccucucaagccacauuuccucccagugcugggugcacuuaacaacugcguucuggcuaacac

SEQ ID NO: 718781 - RNA, 63 nt, hsa
uuacacuaaaaauccuugcauuuuaaagagagaugcacuuaagaauagagugaacugcucaua

SEQ ID NO: 718782 - RNA, 63 nt, hsa
uuguugcugcauuaguguaauguggugugguuuugcacuuaaaagagguauucauaugcucua

SEQ ID NO: 718783 - RNA, 61 nt, hsa; identical to SEQ ID NO: 190271

SEQ ID NO: 718784 - RNA, 63 nt, hsa
guguuucuagguugaccuuguguuuuagaaauuugcacuuaauggaauuugcauuucagagau

SEQ ID NO: 718785 - RNA, 63 nt, hsa
aaaaaugucacuacugcaacauuaggaauguccugcacuuaauagaauuauuuuucaccgcua

SEQ ID NO: 718786 - RNA, 62 nt, hsa
gaguuuucggagaccaagaaauuaaaauacaauugcacuuacuguuuacuuguaaauguuau

SEQ ID NO: 718787 - RNA, 63 nt, hsa
cuacugcuuuguacgaauucuaaguauucuuguugcacuuaauuagccuguauauccucagaa

SEQ ID NO: 718788 - RNA, 63 nt, hsa
gagccuauagccagaacucagaaaaaauucaaaugcacuuauguucucauucuauggccauug

SEQ ID NO: 718789 - RNA, 63 nt, hsa
aagaaauauuccaaaugucuuuuagaagauagaugcacuuaugcaguaaauuaucuugggaua

SEQ ID NO: 718790 - RNA, 63 nt, hsa
gggaguauuauaucccuguauagugaugcaaaaugcacuuauguguaaccaguggugauuugg

SEQ ID NO: 718791 - RNA, 63 nt, hsa
uucaaaccuuuaaguuagcuuuccauaauucacugcacuuaaauaaguuuaaaucaaauacag

SEQ ID NO: 718792 - RNA, 63 nt, hsa
gcuaaaauuccugaaguucagcugcauacaguuugcacuuauggacuccuguuguugaaguuc

SEQ ID NO: 718793 - RNA, 63 nt, hsa
agagguauggagcagugcaacuuaaacucaaguugcacuuacauuuugaauuuuaaaaugaug

SEQ ID NO: 718794 - RNA, 63 nt, hsa
uuucauucugagcauguuugucccaaaaggugaugcacuuaagcugacagucccuucaguggu

SEQ ID NO: 718795 - RNA, 63 nt, hsa
caaaaacuugcugaaacacuugauauugcacagugcacuuauuuuguggccaaagcauggccu

SEQ ID NO: 718796 - RNA, 63 nt, hsa
caguaagcguuuuuuuucuuugaagauuuaugaugcacuuauucaauagcugucagccguucc

SEQ ID NO: 718797 - RNA, 63 nt, hsa
aaagucuacaccaauggaauuagaugagugcuaugcacuuaauuuuaaaauaaaacuaguuuu

SEQ ID NO: 718798 - RNA, 63 nt, hsa
ggacaggagacuccaagcgcuaguauugcacgcugcacuuaauggacuggacucuugccaugg

SEQ ID NO: 718799 - RNA, 63 nt, hsa
aacccauuugagggguggggggguguuaauuuaugcacuuauaagguguuuucuguguaacca

SEQ ID NO: 718800 - RNA, 63 nt, hsa
uggcugcagcagaacacguugagggagucuuggugcacuuaggucacuguaagguucuagggc

SEQ ID NO: 718801 - RNA, 63 nt, hsa; identical to SEQ ID NO: 642390

SEQ ID NO: 718802 - RNA, 63 nt, hsa; identical to SEQ ID NO: 642391

SEQ ID NO: 718803 - RNA, 63 nt, hsa
agguuaucagaauuaauaaaaguaucuguuaugugcacuuaagccgcagcugcuauagauagc

SEQ ID NO: 718804 - RNA, 63 nt, hsa
uacuuugaagucauaccaaugaaaaaauguauaugcacuuauaauuuuccuaauaaaguucug

SEQ ID NO: 718805 - RNA, 63 nt, hsa
gugguguuguucugauuguuuugaacuggagcaugcacuuauuuucagaaacuuagagaguug

SEQ ID NO: 718806 - RNA, 63 nt, hsa
cauaaauguacuucaccagugauuuuacugaaaugcacuuauauuagucuuuauguauuugcu

SEQ ID NO: 718807 - RNA, 63 nt, hsa
ggaaaggcaaguuggucuuauagaaagcacuacugcacuuaguagcuaugugauuuugagcaa

SEQ ID NO: 718808 - RNA, 63 nt, hsa
guuaagaagccaaagcuacuugaucaugcaaaaugcacuuauauauuuguuacacuguauugc

SEQ ID NO: 718809 - RNA, 63 nt, hsa
augguuuaucuccagcaacauuucucuaguacuugcacuuauuaucuuuugucuaauuuaacc

SEQ ID NO: 718810 - RNA, 63 nt, hsa
uuuacucccaguagcaagggauucuaaguuaguugcacuuacaugauuauuguuauuuaaaac

SEQ ID NO: 718811 - RNA, 63 nt, hsa
cgacuuacuugcuagucucuaugagguccuuauugcacuuauugggguugaagcucuucagag

SEQ ID NO: 718812 - RNA, 63 nt, hsa
cucccuucuucccuguguggggcucaagccuggugcacuuaguauagaagagcuaacguacuc

SEQ ID NO: 718813 - RNA, 63 nt, hsa
gggcagaagcucugccuaaaaugaagugaaagcugcacuuaacccuuugugauaaugaugaca

SEQ ID NO: 718814 - RNA, 63 nt, hsa
gaacuucuuuauuucaaaacagaagugucuccuugcacuuagccuuggcagacccuugacucc

SEQ ID NO: 718815 - RNA, 63 nt, hsa
gauccaggaggccggggccggguacugagagucugcacuuaacaagcucccaggccgagaagc

SEQ ID NO: 718816 - RNA, 63 nt, hsa
auguaugaaggaugaccccaucacucucuuuguugcacuuagcccucagguaagugcauaggc

SEQ ID NO: 718817 - RNA, 63 nt, hsa
aacauuuaugcgguaggcucagaugucguaauuugcacuuagguaccaggugucaggaaacag

SEQ ID NO: 718818 - RNA, 63 nt, hsa
uauauaaauagacuauauguucaauauuaucacugcacuuauaaaaaaagaaugauaugugag

SEQ ID NO: 718819 - RNA, 63 nt, hsa
aaaucacuugguaaggauuauaaacuuaauuacugcacuuaaaaugaaacauuacuuuuuuua

SEQ ID NO: 718820 - RNA, 63 nt, hsa
guucagcguuguaugucucucucuacacuguggugcacuuaacuuguggaauuuuuauacuaa

SEQ ID NO: 718821 - RNA, 63 nt, hsa
ccagugaaaaugaaaggaaguuucaguauuagaugcacuuaaguuagccuccaccacccuuuc

SEQ ID NO: 718822 - RNA, 63 nt, hsa
uuuuauauuugucgacgccaggucagucauuuuugcacuuaauuguauaugagauaacuagau

SEQ ID NO: 718823 - RNA, 63 nt, hsa; identical to SEQ ID NO: 642392

SEQ ID NO: 718824 - RNA, 63 nt, hsa; identical to SEQ ID NO: 642393

SEQ ID NO: 718825 - RNA, 63 nt, hsa
uagucuccuuauaguugaagauaaaauguugagugcacuuauuuuagaauauccuagacauaa

SEQ ID NO: 718826 - RNA, 63 nt, hsa
gccucgcuagucaagcugugaauguauauuguuugcacuuaauccuuaacuguauuaacguuc

SEQ ID NO: 718827 - RNA, 63 nt, hsa
acaggaaaagucaucccuauuuccuuguuuuacugcacuuaauauuauuugguugaauuuguu

SEQ ID NO: 718828 - RNA, 63 nt, hsa
cucccaagugccuaggccaugccuuacgacugcugcacuuaccauuugucauaugauggcacu

SEQ ID NO: 718829 - RNA, 63 nt, hsa
ugaauguuuauacuuuuauucuauaauuugcccugcacuuauuuuacaaccuaguaauaaugu

SEQ ID NO: 718830 - RNA, 63 nt, hsa
ggccaagaauauugcaaaauacaugaagcuucaugcacuuaaagaaguauuuuuagaauaaga

SEQ ID NO: 718831 - RNA, 63 nt, hsa
uuuucucuauuuuccccuguucuuuuuguguuaugcacuuaauuuuaugacugccgggggggu

SEQ ID NO: 718832 - RNA, 63 nt, hsa
ggaggcuuggaugggaauaugcugauuuuguucugcacuuaaaggcuucuccuccuggagggc

SEQ ID NO: 718833 - RNA, 63 nt, hsa
auaauuauaacuuaauguuagagaugguaaagcugcacuuacuugaacagcccaaaagcauua

SEQ ID NO: 718834 - RNA, 63 nt, hsa
gcagcuccccaccccagagccaaaugacaguagugcacuuaaaaaggaaaaucaggccuguug

SEQ ID NO: 718835 - RNA, 63 nt, hsa
uuggucauuugacaucagagauguuguaaguauugcacuuaauacgcaccuauuucucaauag

SEQ ID NO: 718836 - RNA, 63 nt, hsa
ugagaaucaaauggaaacauaucauucuggaggugcacuuacucuucuacaauguggccggau

SEQ ID NO: 718837 - RNA, 63 nt, hsa
uauuaaaacgacuccccaauuauuuugcagaauugcacuuaauauugaaauguacuguauagg

SEQ ID NO: 718838 - RNA, 63 nt, hsa
agacgcugcaaucacagauuuuaaaaaauuguuugcacuuaaaaauaguugaaugcuggugga

SEQ ID NO: 718839 - RNA, 63 nt, hsa
aaacugauuuuauuugggagaaacaaggaagggugcacuuaacuagcaaccuaagcaugauuu

SEQ ID NO: 718840 - RNA, 63 nt, hsa
cagcuuauuggacacauggauuuucuucagauuugcacuuacugcuagcucugcuuuuuaugc

SEQ ID NO: 718841 - RNA, 63 nt, hsa
uccuauuguacucucuucugcuuuuuagaagccugcacuuaagcuuagauuugugaagggaga

SEQ ID NO: 718842 - RNA, 63 nt, hsa
uccuaauggauucaauuacggacucuggauauuugcacuuauguacuugauacugaaugcaua

SEQ ID NO: 718843 - RNA, 63 nt, hsa
cagugguacgauuucuagcccguggcuuuaaaaugcacuuaaaguccuguccuugccuuuuau

SEQ ID NO: 718844 - RNA, 63 nt, hsa
auuaucccagcuauuagauagaagggauguuacugcacuuauguguaaucagaucuuuauuua

SEQ ID NO: 718845 - RNA, 63 nt, hsa
guaaggugacuuuauugugugaacaucauggagugcacuuauacaaaccuagaugggacaccu

SEQ ID NO: 718846 - RNA, 63 nt, hsa
guuuguuuauuauaaacaaaaagcaugugaaagugcacuuaagauagaguuuuuauuaauuac

SEQ ID NO: 718847 - RNA, 63 nt, hsa
cagugguacgauuucucgcccguggcuuuaaaaugcacuuaaaguccuguccuugccuuuuau

SEQ ID NO: 718848 - RNA, 63 nt, hsa
acuucaugcauggcuucuccuccaacuuccuccugcacuuaaaaagggccagguuccaaauua

SEQ ID NO: 718849 - RNA, 63 nt, hsa
aguccuuucugucauucugugugugugugugugugcacuuauguguauggguccauauguacg

SEQ ID NO: 718850 - RNA, 63 nt, hsa
augcauucaagaagcuaggggaaaaauaucucaugcacuuaaauaauggucuucaauuuaauu

SEQ ID NO: 718851 - RNA, 63 nt, hsa
gccuuguaaauaaugacauggaagacccugugcugcacuuaaaauauugcugcuugauuauuu

SEQ ID NO: 718852 - RNA, 61 nt, hsa; identical to SEQ ID NO: 190340

SEQ ID NO: 718853 - RNA, 63 nt, hsa
acuuuauuacagagcuccuugguuuuuuacuucugcacuuaaauuuuuuuaaauaacaugaug

SEQ ID NO: 718854 - RNA, 63 nt, hsa
uuuuuuuuaauuuucaggucaaguuuuuuauacugcacuuauuugucaaaauaaagauucuca

SEQ ID NO: 718855 - RNA, 63 nt, hsa
aguggcugaaauccagcauuuuuacauaggagaugcacuuagccucuaagccucguuuuacuc

SEQ ID NO: 718856 - RNA, 63 nt, hsa
cuuuggauggaggggagggccuuuguuaccuuuugcacuuauucuuucugugggugcuuugac

SEQ ID NO: 718857 - RNA, 63 nt, hsa
ggaucccucugucuggggugggaugccuuacuuugcacuuaauuuaauaagggcauucucgga

SEQ ID NO: 718858 - RNA, 63 nt, hsa
ggaaugucugacaggcuuaagcuuucguccccuugcacuuagacucgaaguuaguaaauccuu

SEQ ID NO: 718859 - RNA, 63 nt, hsa
gugcagaucacgaaugcaccugcuuccaggcagugcacuuagagaaaggucacuggcccgggc

SEQ ID NO: 718860 - RNA, 63 nt, hsa
gggauuguagguagauaacauccaaucacuguuugcacuuaucugaaaucuucccucuuggcu

SEQ ID NO: 718861 - RNA, 63 nt, hsa
ucauggcucuccacucagacugugccuggccccugcacuuacaacuuccugccgcucuguggc

SEQ ID NO: 718862 - RNA, 63 nt, hsa
auugaaaaguaaauguuuuauuaguucauugccugcacuuacugaucggaagagagaaagaac

SEQ ID NO: 718863 - RNA, 63 nt, hsa
uugggcuguuuucucaacaaauggaaugccauuugcacuuacacaagacuuuccccauacucu

SEQ ID NO: 718864 - RNA, 63 nt, hsa
gcugggagcagcacaaggacccagccuuuguucugcacuuaauaaaugguuuugcuacugcua

SEQ ID NO: 718865 - RNA, 63 nt, hsa
gugccgggaaggaacugccgggacucaccgagcugcacuuaacuguucucuuucuggcuauuu

SEQ ID NO: 718866 - RNA, 63 nt, hsa
cugagccugaaucugacucuugaggguuggggcugcacuuauuuauugcggggagacagcucu

SEQ ID NO: 718867 - RNA, 63 nt, hsa
aaucaaacaguccugaauucaaauccuuguuuuugcacuuauugucuggagagcuuuggauaa

SEQ ID NO: 718868 - RNA, 63 nt, hsa
guuuucacuggauuuuuaucucucucaacuuccugcacuuaacaauaugaaauagaaacuuuu

SEQ ID NO: 718869 - RNA, 63 nt, hsa
aagaagggggcucccugggaucuccagguguacugcacuuacccucaauccagccccggagaa

SEQ ID NO: 718870 - RNA, 63 nt, hsa
ggguuucaguacaaaugcugcugucuauuucugugcacuuaacaauggaacccaaacagaaga

SEQ ID NO: 718871 - RNA, 63 nt, hsa
cguguaaagagauuacacaugacuguaccauguugcacuuaaucaaauaguauguggggauuu

SEQ ID NO: 718872 - RNA, 63 nt, hsa
agaacagauaaucccuguauuucaagaccucugugcacuuauuuaugaaccugcccugcuccc

SEQ ID NO: 718873 - RNA, 63 nt, hsa
ugccgacuggcugccugacuucaucaugcucccugcacuuaggcugcgugggacaagggcugu

SEQ ID NO: 718874 - RNA, 63 nt, hsa
aauuaacaaaauguucuuccuuuaguuugcuuuugcacuuaaaauauauauaauugacuuuuu

SEQ ID NO: 718875 - RNA, 63 nt, hsa
uauaaguaugcguuacaggguuugauacuuuccugcacuuagguuuguccuauucuucauuua

SEQ ID NO: 718876 - RNA, 63 nt, hsa
uuagcauaauuuuagaugccugugaaauaguacugcacuuacauaaagugagacauugugaaa

SEQ ID NO: 718877 - RNA, 63 nt, hsa
cauaauacauguaguauuuugugucuggcgucuugcacuuagcaugguguucuugagguucau

SEQ ID NO: 718878 - RNA, 63 nt, hsa
acauccuuaaacaaaguaguauguacaugaaauugcacuuaaccaaaacuauuguguaaaaca

SEQ ID NO: 718879 - RNA, 62 nt, hsa
ugugaaaauauccuggaaauaaauacauguuucugcacuuagagccagggaccugccgcguu

SEQ ID NO: 718880 - RNA, 63 nt, hsa
agccccagcgagauuuuccggugaauacgggauugcacuuacucuuucaucacggaaacagac

SEQ ID NO: 718881 - RNA, 63 nt, hsa
auaagcccccgcggggcggagauuucuaccuucugcacuuacuccccaucagaagaucgaguu

SEQ ID NO: 718882 - RNA, 63 nt, hsa
gguuuauuucaccugaauauaauuccuaacugaugcacuuaguauaugucaguuuuuauaaau

SEQ ID NO: 718883 - RNA, 63 nt, hsa
gaaucucuaacaugcucuguuuacaucgauaaaugcacuuaaggaaaacaaacaaauuaaagc

SEQ ID NO: 718884 - RNA, 63 nt, hsa
ugacucauauguuuuaacaugauuuuaacaaacugcacuuauuaagaaauguguuugcccugu

SEQ ID NO: 718885 - RNA, 63 nt, hsa
ucacugugacucuagaguggccagacucagagcugcacuuaguagggguuccucaaaggaagg

SEQ ID NO: 718886 - RNA, 63 nt, hsa
aauucacccaugaaagagacccagugguuacugugcacuuaggaaaaccuucagccacaucuu

SEQ ID NO: 718887 - RNA, 63 nt, hsa
aauucacccaugagagagacccagugguugcuaugcacuuaggaaaacuuucagccacaucuu

SEQ ID NO: 718888 - RNA, 63 nt, hsa
aagacagccuacaugguccauugcuacucuugcugcacuuauguaaacaaucagaccacauuu

SEQ ID NO: 718889 - RNA, 58 nt, hsa; identical to SEQ ID NO: 190377

SEQ ID NO: 718890 - RNA, 63 nt, hsa
guauacaaauacaguauuuuccaugguucugccugcacuuacuuuguaaugccacgguugaga

SEQ ID NO: 718891 - RNA, 63 nt, hsa
cuuuucccguugaugucuugaugcuccuaucugugcacuuaccguagguagggacacgugucc

SEQ ID NO: 718892 - RNA, 63 nt, hsa
agaaaugaaugugaaagaaagccaagcaucacuugcacuuaaaucauuaccacggaagauaua

SEQ ID NO: 718893 - RNA, 63 nt, hsa
uggggaguaccuguccaagacagggcucauuuuugcacuuaucucgaauuugaagagauugcu

SEQ ID NO: 718894 - RNA, 63 nt, hsa
cugcaguaacuaucuauacaccuaccuccagugugcacuuagggggugagcgcgggugucgag

SEQ ID NO: 718895 - RNA, 63 nt, hsa
aggaagcacaugugcaccuuuccuuuacacuaaugcacuuaggauguuucugcaucaugucua

SEQ ID NO: 718896 - RNA, 63 nt, hsa
gcucagcgaccuuuccucucaaaugcggaagcgugcacuuacaguucagaccguucuccugua

SEQ ID NO: 718897 - RNA, 63 nt, hsa
auauuuucuggauucuggagguugauaaccauaugcacuuaacauuauauucuauaaacauua

SEQ ID NO: 718898 - RNA, 63 nt, hsa
uauguagaauguuaaaagcacagcaaacugcacugcacuuauaaagcaaaucuauuagaaaaa

SEQ ID NO: 718899 - RNA, 63 nt, hsa
gacuucgguguccucggcucugaaggcgcucucugcacuuagaugcugucagcccucaacgua

SEQ ID NO: 718900 - RNA, 63 nt, hsa; identical to SEQ ID NO: 642394

SEQ ID NO: 718901 - RNA, 63 nt, hsa; identical to SEQ ID NO: 642395

SEQ ID NO: 718902 - RNA, 63 nt, hsa
cagcuaacucugaccugggagcccucaggcaccugcacuuacaggccuugcucacagcugauu

SEQ ID NO: 718903 - RNA, 63 nt, hsa
aagacuuucugcugcacucacaggauccugagcugcacuuaccugugagagucuucaaacuuu

SEQ ID NO: 718904 - RNA, 63 nt, hsa
cuuaugugugugggcuugggacgagugcugguaugcacuuaggaccuucuugauagcucccug

SEQ ID NO: 718905 - RNA, 63 nt, hsa
augcuggucagucugaaaaggugaagcuggcugugcacuuacccccaucuuucucccucgggg

SEQ ID NO: 718906 - RNA, 63 nt, hsa
uccccuuucccugucccagccccaucuguggguugcacuuacaaacccccacccaccuucaga

SEQ ID NO: 718907 - RNA, 63 nt, hsa
uagaaaacuauugaaagaaaucacaggggaaacugcacuuagacugacagaauugaacaccaa

SEQ ID NO: 718908 - RNA, 63 nt, hsa
aaauguaugcaauuccugaguguagaaacuucuugcacuuauuuaaaauuuaggagagaacau

SEQ ID NO: 718909 - RNA, 63 nt, hsa
auuuuaaaagucuauuuuauuaugagcuuucuuugcacuuaaaaauuagcaugcugcuuuuug

SEQ ID NO: 718910 - RNA, 63 nt, hsa
ugcccaugccgcucaggcuacccuuaucuccucugcacuuauguuaucaauaaagaggcaaau

SEQ ID NO: 718911 - RNA, 63 nt, hsa
augccaguguguccuagaaccuagauaacgaagugcacuuacacuuauaaaauaacuugcauc

SEQ ID NO: 718912 - RNA, 63 nt, hsa; identical to SEQ ID NO: 100805

SEQ ID NO: 718913 - RNA, 63 nt, hsa; identical to SEQ ID NO: 100806

SEQ ID NO: 718914 - RNA, 63 nt, hsa; identical to SEQ ID NO: 100807

SEQ ID NO: 718915 - RNA, 63 nt, hsa; identical to SEQ ID NO: 100808

SEQ ID NO: 718916 - RNA, 63 nt, hsa; identical to SEQ ID NO: 100809

SEQ ID NO: 718917 - RNA, 63 nt, hsa; identical to SEQ ID NO: 100810

SEQ ID NO: 718918 - RNA, 63 nt, hsa; identical to SEQ ID NO: 100811

SEQ ID NO: 718919 - RNA, 63 nt, hsa; identical to SEQ ID NO: 100812

SEQ ID NO: 718920 - RNA, 63 nt, hsa; identical to SEQ ID NO: 100813

SEQ ID NO: 718921 - RNA, 63 nt, hsa; identical to SEQ ID NO: 100814

SEQ ID NO: 718922 - RNA, 63 nt, hsa; identical to SEQ ID NO: 100815

SEQ ID NO: 718923 - RNA, 63 nt, hsa; identical to SEQ ID NO: 100816

SEQ ID NO: 718924 - RNA, 63 nt, hsa; identical to SEQ ID NO: 100817

SEQ ID NO: 718925 - RNA, 63 nt, hsa; identical to SEQ ID NO: 100818

SEQ ID NO: 718926 - RNA, 63 nt, hsa; identical to SEQ ID NO: 100819

SEQ ID NO: 718927 - RNA, 63 nt, hsa; identical to SEQ ID NO: 100820

SEQ ID NO: 718928 - RNA, 63 nt, hsa; identical to SEQ ID NO: 100821

SEQ ID NO: 718929 - RNA, 63 nt, hsa; identical to SEQ ID NO: 100822

SEQ ID NO: 718930 - RNA, 63 nt, hsa; identical to SEQ ID NO: 100823

SEQ ID NO: 718931 - RNA, 63 nt, hsa; identical to SEQ ID NO: 100824

SEQ ID NO: 718932 - RNA, 63 nt, hsa; identical to SEQ ID NO: 100825

SEQ ID NO: 718933 - RNA, 63 nt, hsa; identical to SEQ ID NO: 100826

SEQ ID NO: 718934 - RNA, 63 nt, hsa; identical to SEQ ID NO: 100827

SEQ ID NO: 718935 - RNA, 63 nt, hsa; identical to SEQ ID NO: 100828

SEQ ID NO: 718936 - RNA, 63 nt, hsa; identical to SEQ ID NO: 100829

SEQ ID NO: 718937 - RNA, 63 nt, hsa; identical to SEQ ID NO: 100830

SEQ ID NO: 718938 - RNA, 63 nt, hsa; identical to SEQ ID NO: 100831

SEQ ID NO: 718939 - RNA, 63 nt, hsa; identical to SEQ ID NO: 100832

SEQ ID NO: 718940 - RNA, 63 nt, hsa; identical to SEQ ID NO: 100833

SEQ ID NO: 718941 - RNA, 63 nt, hsa; identical to SEQ ID NO: 100834

SEQ ID NO: 718942 - RNA, 63 nt, hsa; identical to SEQ ID NO: 100835

SEQ ID NO: 718943 - RNA, 63 nt, hsa; identical to SEQ ID NO: 100836

SEQ ID NO: 718944 - RNA, 63 nt, hsa; identical to SEQ ID NO: 100837

SEQ ID NO: 718945 - RNA, 63 nt, hsa; identical to SEQ ID NO: 100838

SEQ ID NO: 718946 - RNA, 63 nt, hsa; identical to SEQ ID NO: 100839

SEQ ID NO: 718947 - RNA, 63 nt, hsa; identical to SEQ ID NO: 100840

SEQ ID NO: 718948 - RNA, 63 nt, hsa; identical to SEQ ID NO: 100841

SEQ ID NO: 718949 - RNA, 63 nt, hsa; identical to SEQ ID NO: 100842

SEQ ID NO: 718950 - RNA, 63 nt, hsa; identical to SEQ ID NO: 100843

SEQ ID NO: 718951 - RNA, 63 nt, hsa; identical to SEQ ID NO: 100844

SEQ ID NO: 718952 - RNA, 63 nt, hsa; identical to SEQ ID NO: 100845

SEQ ID NO: 718953 - RNA, 63 nt, hsa; identical to SEQ ID NO: 100846

SEQ ID NO: 718954 - RNA, 63 nt, hsa; identical to SEQ ID NO: 100847

SEQ ID NO: 718955 - RNA, 63 nt, hsa; identical to SEQ ID NO: 100848

SEQ ID NO: 718956 - RNA, 63 nt, hsa; identical to SEQ ID NO: 100849

SEQ ID NO: 718957 - RNA, 63 nt, hsa; identical to SEQ ID NO: 100850

SEQ ID NO: 718958 - RNA, 63 nt, hsa; identical to SEQ ID NO: 100851

SEQ ID NO: 718959 - RNA, 63 nt, hsa; identical to SEQ ID NO: 100852

SEQ ID NO: 718960 - RNA, 52 nt, hsa; identical to SEQ ID NO: 100853

SEQ ID NO: 718961 - RNA, 63 nt, hsa; identical to SEQ ID NO: 100854

SEQ ID NO: 718962 - RNA, 63 nt, hsa; identical to SEQ ID NO: 100855

SEQ ID NO: 718963 - RNA, 63 nt, hsa; identical to SEQ ID NO: 100856

SEQ ID NO: 718964 - RNA, 63 nt, hsa; identical to SEQ ID NO: 100857

SEQ ID NO: 718965 - RNA, 63 nt, hsa; identical to SEQ ID NO: 100858

SEQ ID NO: 718966 - RNA, 63 nt, hsa; identical to SEQ ID NO: 100859

SEQ ID NO: 718967 - RNA, 63 nt, hsa; identical to SEQ ID NO: 100860

SEQ ID NO: 718968 - RNA, 63 nt, hsa; identical to SEQ ID NO: 100861

SEQ ID NO: 718969 - RNA, 63 nt, hsa; identical to SEQ ID NO: 100862

SEQ ID NO: 718970 - RNA, 63 nt, hsa; identical to SEQ ID NO: 100863

SEQ ID NO: 718971 - RNA, 63 nt, hsa; identical to SEQ ID NO: 100864

SEQ ID NO: 718972 - RNA, 63 nt, hsa; identical to SEQ ID NO: 100865

SEQ ID NO: 718973 - RNA, 63 nt, hsa; identical to SEQ ID NO: 100866

SEQ ID NO: 718974 - RNA, 63 nt, hsa; identical to SEQ ID NO: 100867

SEQ ID NO: 718975 - RNA, 63 nt, hsa; identical to SEQ ID NO: 100868

SEQ ID NO: 718976 - RNA, 63 nt, hsa; identical to SEQ ID NO: 100869

SEQ ID NO: 718977 - RNA, 63 nt, hsa; identical to SEQ ID NO: 100870

SEQ ID NO: 718978 - RNA, 63 nt, hsa; identical to SEQ ID NO: 100871

SEQ ID NO: 718979 - RNA, 63 nt, hsa; identical to SEQ ID NO: 100872

SEQ ID NO: 718980 - RNA, 63 nt, hsa; identical to SEQ ID NO: 100873

SEQ ID NO: 718981 - RNA, 63 nt, hsa; identical to SEQ ID NO: 100874

SEQ ID NO: 718982 - RNA, 63 nt, hsa; identical to SEQ ID NO: 100875

SEQ ID NO: 718983 - RNA, 63 nt, hsa; identical to SEQ ID NO: 100876

SEQ ID NO: 718984 - RNA, 63 nt, hsa; identical to SEQ ID NO: 100877

SEQ ID NO: 718985 - RNA, 63 nt, hsa; identical to SEQ ID NO: 100878

SEQ ID NO: 718986 - RNA, 63 nt, hsa; identical to SEQ ID NO: 100879

SEQ ID NO: 718987 - RNA, 63 nt, hsa; identical to SEQ ID NO: 100880

SEQ ID NO: 718988 - RNA, 63 nt, hsa; identical to SEQ ID NO: 100881

SEQ ID NO: 718989 - RNA, 63 nt, hsa; identical to SEQ ID NO: 100882

SEQ ID NO: 718990 - RNA, 63 nt, hsa; identical to SEQ ID NO: 100883

SEQ ID NO: 718991 - RNA, 63 nt, hsa; identical to SEQ ID NO: 100884

SEQ ID NO: 718992 - RNA, 63 nt, hsa; identical to SEQ ID NO: 100885

SEQ ID NO: 718993 - RNA, 63 nt, hsa; identical to SEQ ID NO: 100886

SEQ ID NO: 718994 - RNA, 63 nt, hsa; identical to SEQ ID NO: 100887

SEQ ID NO: 718995 - RNA, 63 nt, hsa; identical to SEQ ID NO: 100888

SEQ ID NO: 718996 - RNA, 63 nt, hsa; identical to SEQ ID NO: 100889

SEQ ID NO: 718997 - RNA, 63 nt, hsa; identical to SEQ ID NO: 100890

SEQ ID NO: 718998 - RNA, 63 nt, hsa; identical to SEQ ID NO: 100891

SEQ ID NO: 718999 - RNA, 63 nt, hsa; identical to SEQ ID NO: 100892

SEQ ID NO: 719000 - RNA, 63 nt, hsa; identical to SEQ ID NO: 100893

SEQ ID NO: 719001 - RNA, 63 nt, hsa; identical to SEQ ID NO: 100894

SEQ ID NO: 719002 - RNA, 63 nt, hsa; identical to SEQ ID NO: 100895

SEQ ID NO: 719003 - RNA, 63 nt, hsa; identical to SEQ ID NO: 100896

SEQ ID NO: 719004 - RNA, 63 nt, hsa; identical to SEQ ID NO: 100897

SEQ ID NO: 719005 - RNA, 63 nt, hsa; identical to SEQ ID NO: 100898

SEQ ID NO: 719006 - RNA, 63 nt, hsa; identical to SEQ ID NO: 100899

SEQ ID NO: 719007 - RNA, 63 nt, hsa; identical to SEQ ID NO: 100900

SEQ ID NO: 719008 - RNA, 63 nt, hsa; identical to SEQ ID NO: 100901

SEQ ID NO: 719009 - RNA, 63 nt, hsa; identical to SEQ ID NO: 100902

SEQ ID NO: 719010 - RNA, 63 nt, hsa; identical to SEQ ID NO: 100903

SEQ ID NO: 719011 - RNA, 63 nt, hsa; identical to SEQ ID NO: 100904

SEQ ID NO: 719012 - RNA, 63 nt, hsa; identical to SEQ ID NO: 100905

SEQ ID NO: 719013 - RNA, 63 nt, hsa; identical to SEQ ID NO: 100906

SEQ ID NO: 719014 - RNA, 63 nt, hsa; identical to SEQ ID NO: 100907

SEQ ID NO: 719015 - RNA, 63 nt, hsa; identical to SEQ ID NO: 100908

SEQ ID NO: 719016 - RNA, 63 nt, hsa; identical to SEQ ID NO: 100909

SEQ ID NO: 719017 - RNA, 63 nt, hsa; identical to SEQ ID NO: 100910

SEQ ID NO: 719018 - RNA, 63 nt, hsa; identical to SEQ ID NO: 100911

SEQ ID NO: 719019 - RNA, 63 nt, hsa; identical to SEQ ID NO: 100912

SEQ ID NO: 719020 - RNA, 63 nt, hsa; identical to SEQ ID NO: 100913

SEQ ID NO: 719021 - RNA, 63 nt, hsa; identical to SEQ ID NO: 100914

SEQ ID NO: 719022 - RNA, 63 nt, hsa; identical to SEQ ID NO: 100915

SEQ ID NO: 719023 - RNA, 63 nt, hsa; identical to SEQ ID NO: 100916

SEQ ID NO: 719024 - RNA, 63 nt, hsa; identical to SEQ ID NO: 100917

SEQ ID NO: 719025 - RNA, 63 nt, hsa; identical to SEQ ID NO: 100918

SEQ ID NO: 719026 - RNA, 63 nt, hsa; identical to SEQ ID NO: 100919

SEQ ID NO: 719027 - RNA, 63 nt, hsa; identical to SEQ ID NO: 100920

SEQ ID NO: 719028 - RNA, 63 nt, hsa; identical to SEQ ID NO: 100921

SEQ ID NO: 719029 - RNA, 63 nt, hsa; identical to SEQ ID NO: 100922

SEQ ID NO: 719030 - RNA, 63 nt, hsa; identical to SEQ ID NO: 100923

SEQ ID NO: 719031 - RNA, 63 nt, hsa; identical to SEQ ID NO: 100924

SEQ ID NO: 719032 - RNA, 63 nt, hsa; identical to SEQ ID NO: 100925

SEQ ID NO: 719033 - RNA, 63 nt, hsa; identical to SEQ ID NO: 100926

SEQ ID NO: 719034 - RNA, 63 nt, hsa; identical to SEQ ID NO: 100927

SEQ ID NO: 719035 - RNA, 63 nt, hsa; identical to SEQ ID NO: 100928

SEQ ID NO: 719036 - RNA, 63 nt, hsa; identical to SEQ ID NO: 100929

SEQ ID NO: 719037 - RNA, 63 nt, hsa; identical to SEQ ID NO: 100930

SEQ ID NO: 719038 - RNA, 63 nt, hsa; identical to SEQ ID NO: 100931

SEQ ID NO: 719039 - RNA, 63 nt, hsa; identical to SEQ ID NO: 100932

SEQ ID NO: 719040 - RNA, 63 nt, hsa; identical to SEQ ID NO: 100933

SEQ ID NO: 719041 - RNA, 63 nt, hsa; identical to SEQ ID NO: 100934

SEQ ID NO: 719042 - RNA, 63 nt, hsa; identical to SEQ ID NO: 100935

SEQ ID NO: 719043 - RNA, 63 nt, hsa; identical to SEQ ID NO: 100936

SEQ ID NO: 719044 - RNA, 63 nt, hsa; identical to SEQ ID NO: 100937

SEQ ID NO: 719045 - RNA, 63 nt, hsa; identical to SEQ ID NO: 100938

SEQ ID NO: 719046 - RNA, 63 nt, hsa; identical to SEQ ID NO: 100939

SEQ ID NO: 719047 - RNA, 63 nt, hsa; identical to SEQ ID NO: 100940

SEQ ID NO: 719048 - RNA, 63 nt, hsa; identical to SEQ ID NO: 100941

SEQ ID NO: 719049 - RNA, 63 nt, hsa; identical to SEQ ID NO: 100942

SEQ ID NO: 719050 - RNA, 63 nt, hsa; identical to SEQ ID NO: 100943

SEQ ID NO: 719051 - RNA, 63 nt, hsa; identical to SEQ ID NO: 100944

SEQ ID NO: 719052 - RNA, 63 nt, hsa; identical to SEQ ID NO: 100945

SEQ ID NO: 719053 - RNA, 63 nt, hsa; identical to SEQ ID NO: 100946

SEQ ID NO: 719054 - RNA, 63 nt, hsa; identical to SEQ ID NO: 100947

SEQ ID NO: 719055 - RNA, 63 nt, hsa; identical to SEQ ID NO: 100948

SEQ ID NO: 719056 - RNA, 63 nt, hsa; identical to SEQ ID NO: 100949

SEQ ID NO: 719057 - RNA, 63 nt, hsa; identical to SEQ ID NO: 100950

SEQ ID NO: 719058 - RNA, 63 nt, hsa; identical to SEQ ID NO: 100951

SEQ ID NO: 719059 - RNA, 63 nt, hsa; identical to SEQ ID NO: 100952

SEQ ID NO: 719060 - RNA, 63 nt, hsa; identical to SEQ ID NO: 100953

SEQ ID NO: 719061 - RNA, 63 nt, hsa; identical to SEQ ID NO: 100954

SEQ ID NO: 719062 - RNA, 63 nt, hsa; identical to SEQ ID NO: 100955

SEQ ID NO: 719063 - RNA, 63 nt, hsa; identical to SEQ ID NO: 100956

SEQ ID NO: 719064 - RNA, 63 nt, hsa; identical to SEQ ID NO: 100957

SEQ ID NO: 719065 - RNA, 63 nt, hsa; identical to SEQ ID NO: 100958

SEQ ID NO: 719066 - RNA, 63 nt, hsa; identical to SEQ ID NO: 100959

SEQ ID NO: 719067 - RNA, 63 nt, hsa; identical to SEQ ID NO: 100960

SEQ ID NO: 719068 - RNA, 63 nt, hsa; identical to SEQ ID NO: 100961

SEQ ID NO: 719069 - RNA, 63 nt, hsa; identical to SEQ ID NO: 100962

SEQ ID NO: 719070 - RNA, 63 nt, hsa; identical to SEQ ID NO: 100963

SEQ ID NO: 719071 - RNA, 63 nt, hsa; identical to SEQ ID NO: 100964

SEQ ID NO: 719072 - RNA, 63 nt, hsa; identical to SEQ ID NO: 100965

SEQ ID NO: 719073 - RNA, 63 nt, hsa; identical to SEQ ID NO: 100966

SEQ ID NO: 719074 - RNA, 63 nt, hsa; identical to SEQ ID NO: 100967

SEQ ID NO: 719075 - RNA, 62 nt, hsa; identical to SEQ ID NO: 100968

SEQ ID NO: 719076 - RNA, 63 nt, hsa; identical to SEQ ID NO: 100969

SEQ ID NO: 719077 - RNA, 63 nt, hsa; identical to SEQ ID NO: 100970

SEQ ID NO: 719078 - RNA, 63 nt, hsa; identical to SEQ ID NO: 100971

SEQ ID NO: 719079 - RNA, 63 nt, hsa; identical to SEQ ID NO: 100972

SEQ ID NO: 719080 - RNA, 63 nt, hsa; identical to SEQ ID NO: 100973

SEQ ID NO: 719081 - RNA, 63 nt, hsa; identical to SEQ ID NO: 100974

SEQ ID NO: 719082 - RNA, 63 nt, hsa; identical to SEQ ID NO: 100975

SEQ ID NO: 719083 - RNA, 63 nt, hsa; identical to SEQ ID NO: 100976

SEQ ID NO: 719084 - RNA, 63 nt, hsa; identical to SEQ ID NO: 100977

SEQ ID NO: 719085 - RNA, 63 nt, hsa; identical to SEQ ID NO: 100978

SEQ ID NO: 719086 - RNA, 63 nt, hsa; identical to SEQ ID NO: 100979

SEQ ID NO: 719087 - RNA, 63 nt, hsa; identical to SEQ ID NO: 100980

SEQ ID NO: 719088 - RNA, 63 nt, hsa; identical to SEQ ID NO: 100981

SEQ ID NO: 719089 - RNA, 63 nt, hsa; identical to SEQ ID NO: 100982

SEQ ID NO: 719090 - RNA, 63 nt, hsa; identical to SEQ ID NO: 100983

SEQ ID NO: 719091 - RNA, 63 nt, hsa; identical to SEQ ID NO: 100984

SEQ ID NO: 719092 - RNA, 63 nt, hsa; identical to SEQ ID NO: 100985

SEQ ID NO: 719093 - RNA, 63 nt, hsa; identical to SEQ ID NO: 100986

SEQ ID NO: 719094 - RNA, 63 nt, hsa; identical to SEQ ID NO: 100987

SEQ ID NO: 719095 - RNA, 63 nt, hsa; identical to SEQ ID NO: 100988

SEQ ID NO: 719096 - RNA, 63 nt, hsa; identical to SEQ ID NO: 100989

SEQ ID NO: 719097 - RNA, 63 nt, hsa; identical to SEQ ID NO: 100990

SEQ ID NO: 719098 - RNA, 63 nt, hsa; identical to SEQ ID NO: 100991

SEQ ID NO: 719099 - RNA, 63 nt, hsa; identical to SEQ ID NO: 100992

SEQ ID NO: 719100 - RNA, 63 nt, hsa; identical to SEQ ID NO: 100993

SEQ ID NO: 719101 - RNA, 63 nt, hsa; identical to SEQ ID NO: 100994

SEQ ID NO: 719102 - RNA, 63 nt, hsa; identical to SEQ ID NO: 100995

SEQ ID NO: 719103 - RNA, 63 nt, hsa; identical to SEQ ID NO: 100996

SEQ ID NO: 719104 - RNA, 63 nt, hsa; identical to SEQ ID NO: 100997

SEQ ID NO: 719105 - RNA, 63 nt, hsa; identical to SEQ ID NO: 100998

SEQ ID NO: 719106 - RNA, 63 nt, hsa; identical to SEQ ID NO: 100999

SEQ ID NO: 719107 - RNA, 63 nt, hsa; identical to SEQ ID NO: 101000

SEQ ID NO: 719108 - RNA, 63 nt, hsa; identical to SEQ ID NO: 101001

SEQ ID NO: 719109 - RNA, 63 nt, hsa; identical to SEQ ID NO: 101002

SEQ ID NO: 719110 - RNA, 63 nt, hsa; identical to SEQ ID NO: 101003

SEQ ID NO: 719111 - RNA, 63 nt, hsa; identical to SEQ ID NO: 101004

SEQ ID NO: 719112 - RNA, 63 nt, hsa; identical to SEQ ID NO: 101005

SEQ ID NO: 719113 - RNA, 63 nt, hsa; identical to SEQ ID NO: 101006

SEQ ID NO: 719114 - RNA, 63 nt, hsa; identical to SEQ ID NO: 101007

SEQ ID NO: 719115 - RNA, 63 nt, hsa; identical to SEQ ID NO: 101008

SEQ ID NO: 719116 - RNA, 63 nt, hsa; identical to SEQ ID NO: 101009

SEQ ID NO: 719117 - RNA, 63 nt, hsa; identical to SEQ ID NO: 101010

SEQ ID NO: 719118 - RNA, 63 nt, hsa; identical to SEQ ID NO: 101011

SEQ ID NO: 719119 - RNA, 63 nt, hsa; identical to SEQ ID NO: 101012

SEQ ID NO: 719120 - RNA, 63 nt, hsa; identical to SEQ ID NO: 101013

SEQ ID NO: 719121 - RNA, 63 nt, hsa; identical to SEQ ID NO: 101014

SEQ ID NO: 719122 - RNA, 63 nt, hsa; identical to SEQ ID NO: 101015

SEQ ID NO: 719123 - RNA, 63 nt, hsa; identical to SEQ ID NO: 101016

SEQ ID NO: 719124 - RNA, 63 nt, hsa; identical to SEQ ID NO: 101017

SEQ ID NO: 719125 - RNA, 63 nt, hsa; identical to SEQ ID NO: 101018

SEQ ID NO: 719126 - RNA, 63 nt, hsa; identical to SEQ ID NO: 101019

SEQ ID NO: 719127 - RNA, 63 nt, hsa; identical to SEQ ID NO: 101020

SEQ ID NO: 719128 - RNA, 63 nt, hsa; identical to SEQ ID NO: 101021

SEQ ID NO: 719129 - RNA, 63 nt, hsa; identical to SEQ ID NO: 101022

SEQ ID NO: 719130 - RNA, 63 nt, hsa; identical to SEQ ID NO: 101023

SEQ ID NO: 719131 - RNA, 63 nt, hsa; identical to SEQ ID NO: 101024

SEQ ID NO: 719132 - RNA, 63 nt, hsa; identical to SEQ ID NO: 101025

SEQ ID NO: 719133 - RNA, 63 nt, hsa; identical to SEQ ID NO: 101026

SEQ ID NO: 719134 - RNA, 63 nt, hsa; identical to SEQ ID NO: 101027

SEQ ID NO: 719135 - RNA, 63 nt, hsa; identical to SEQ ID NO: 101028

SEQ ID NO: 719136 - RNA, 63 nt, hsa; identical to SEQ ID NO: 101029

SEQ ID NO: 719137 - RNA, 63 nt, hsa; identical to SEQ ID NO: 101030

SEQ ID NO: 719138 - RNA, 63 nt, hsa; identical to SEQ ID NO: 101031

SEQ ID NO: 719139 - RNA, 63 nt, hsa; identical to SEQ ID NO: 101032

SEQ ID NO: 719140 - RNA, 63 nt, hsa; identical to SEQ ID NO: 101033

SEQ ID NO: 719141 - RNA, 63 nt, hsa; identical to SEQ ID NO: 101034

SEQ ID NO: 719142 - RNA, 63 nt, hsa; identical to SEQ ID NO: 101035

SEQ ID NO: 719143 - RNA, 63 nt, hsa; identical to SEQ ID NO: 101036

SEQ ID NO: 719144 - RNA, 63 nt, hsa; identical to SEQ ID NO: 101037

SEQ ID NO: 719145 - RNA, 63 nt, hsa; identical to SEQ ID NO: 101038

SEQ ID NO: 719146 - RNA, 63 nt, hsa; identical to SEQ ID NO: 101039

SEQ ID NO: 719147 - RNA, 63 nt, hsa; identical to SEQ ID NO: 101040

SEQ ID NO: 719148 - RNA, 63 nt, hsa; identical to SEQ ID NO: 101041

SEQ ID NO: 719149 - RNA, 63 nt, hsa; identical to SEQ ID NO: 101042

SEQ ID NO: 719150 - RNA, 63 nt, hsa; identical to SEQ ID NO: 101043

SEQ ID NO: 719151 - RNA, 63 nt, hsa; identical to SEQ ID NO: 101044

SEQ ID NO: 719152 - RNA, 63 nt, hsa; identical to SEQ ID NO: 101045

SEQ ID NO: 719153 - RNA, 63 nt, hsa; identical to SEQ ID NO: 101046

SEQ ID NO: 719154 - RNA, 63 nt, hsa; identical to SEQ ID NO: 101047

SEQ ID NO: 719155 - RNA, 63 nt, hsa; identical to SEQ ID NO: 101048

SEQ ID NO: 719156 - RNA, 63 nt, hsa; identical to SEQ ID NO: 101049

SEQ ID NO: 719157 - RNA, 63 nt, hsa; identical to SEQ ID NO: 101050

SEQ ID NO: 719158 - RNA, 63 nt, hsa; identical to SEQ ID NO: 101051

SEQ ID NO: 719159 - RNA, 63 nt, hsa; identical to SEQ ID NO: 101052

SEQ ID NO: 719160 - RNA, 63 nt, hsa; identical to SEQ ID NO: 101053

SEQ ID NO: 719161 - RNA, 63 nt, hsa; identical to SEQ ID NO: 101054

SEQ ID NO: 719162 - RNA, 63 nt, hsa; identical to SEQ ID NO: 101055

SEQ ID NO: 719163 - RNA, 63 nt, hsa; identical to SEQ ID NO: 101056

SEQ ID NO: 719164 - RNA, 63 nt, hsa; identical to SEQ ID NO: 101057

SEQ ID NO: 719165 - RNA, 63 nt, hsa; identical to SEQ ID NO: 101058

SEQ ID NO: 719166 - RNA, 63 nt, hsa; identical to SEQ ID NO: 101059

SEQ ID NO: 719167 - RNA, 63 nt, hsa; identical to SEQ ID NO: 101060

SEQ ID NO: 719168 - RNA, 63 nt, hsa; identical to SEQ ID NO: 101061

SEQ ID NO: 719169 - RNA, 63 nt, hsa; identical to SEQ ID NO: 101062

SEQ ID NO: 719170 - RNA, 63 nt, hsa; identical to SEQ ID NO: 101063

SEQ ID NO: 719171 - RNA, 63 nt, hsa; identical to SEQ ID NO: 101064

SEQ ID NO: 719172 - RNA, 63 nt, hsa; identical to SEQ ID NO: 101065

SEQ ID NO: 719173 - RNA, 63 nt, hsa; identical to SEQ ID NO: 101066

SEQ ID NO: 719174 - RNA, 63 nt, hsa; identical to SEQ ID NO: 101067

SEQ ID NO: 719175 - RNA, 63 nt, hsa; identical to SEQ ID NO: 101068

SEQ ID NO: 719176 - RNA, 63 nt, hsa; identical to SEQ ID NO: 101069

SEQ ID NO: 719177 - RNA, 63 nt, hsa; identical to SEQ ID NO: 101070

SEQ ID NO: 719178 - RNA, 63 nt, hsa; identical to SEQ ID NO: 101071

SEQ ID NO: 719179 - RNA, 63 nt, hsa; identical to SEQ ID NO: 101072

SEQ ID NO: 719180 - RNA, 63 nt, hsa; identical to SEQ ID NO: 101073

SEQ ID NO: 719181 - RNA, 63 nt, hsa; identical to SEQ ID NO: 101074

SEQ ID NO: 719182 - RNA, 63 nt, hsa; identical to SEQ ID NO: 101075

SEQ ID NO: 719183 - RNA, 63 nt, hsa; identical to SEQ ID NO: 101076

SEQ ID NO: 719184 - RNA, 63 nt, hsa; identical to SEQ ID NO: 101077

SEQ ID NO: 719185 - RNA, 63 nt, hsa; identical to SEQ ID NO: 101078

SEQ ID NO: 719186 - RNA, 63 nt, hsa; identical to SEQ ID NO: 101079

SEQ ID NO: 719187 - RNA, 63 nt, hsa; identical to SEQ ID NO: 101080

SEQ ID NO: 719188 - RNA, 63 nt, hsa; identical to SEQ ID NO: 101081

SEQ ID NO: 719189 - RNA, 63 nt, hsa; identical to SEQ ID NO: 101082

SEQ ID NO: 719190 - RNA, 63 nt, hsa; identical to SEQ ID NO: 101083

SEQ ID NO: 719191 - RNA, 63 nt, hsa; identical to SEQ ID NO: 101084

SEQ ID NO: 719192 - RNA, 63 nt, hsa; identical to SEQ ID NO: 101085

SEQ ID NO: 719193 - RNA, 63 nt, hsa; identical to SEQ ID NO: 101086

SEQ ID NO: 719194 - RNA, 63 nt, hsa; identical to SEQ ID NO: 101087

SEQ ID NO: 719195 - RNA, 63 nt, hsa; identical to SEQ ID NO: 101088

SEQ ID NO: 719196 - RNA, 63 nt, hsa; identical to SEQ ID NO: 101089

SEQ ID NO: 719197 - RNA, 63 nt, hsa; identical to SEQ ID NO: 101090

SEQ ID NO: 719198 - RNA, 63 nt, hsa; identical to SEQ ID NO: 101091

SEQ ID NO: 719199 - RNA, 63 nt, hsa; identical to SEQ ID NO: 101092

SEQ ID NO: 719200 - RNA, 63 nt, hsa; identical to SEQ ID NO: 101093

SEQ ID NO: 719201 - RNA, 63 nt, hsa; identical to SEQ ID NO: 101094

SEQ ID NO: 719202 - RNA, 63 nt, hsa; identical to SEQ ID NO: 101095

SEQ ID NO: 719203 - RNA, 63 nt, hsa; identical to SEQ ID NO: 101096

SEQ ID NO: 719204 - RNA, 63 nt, hsa; identical to SEQ ID NO: 101097

SEQ ID NO: 719205 - RNA, 63 nt, hsa; identical to SEQ ID NO: 101098

SEQ ID NO: 719206 - RNA, 63 nt, hsa; identical to SEQ ID NO: 101099

SEQ ID NO: 719207 - RNA, 63 nt, hsa; identical to SEQ ID NO: 101100

SEQ ID NO: 719208 - RNA, 63 nt, hsa; identical to SEQ ID NO: 101101

SEQ ID NO: 719209 - RNA, 63 nt, hsa; identical to SEQ ID NO: 101102

SEQ ID NO: 719210 - RNA, 63 nt, hsa; identical to SEQ ID NO: 101103

SEQ ID NO: 719211 - RNA, 63 nt, hsa; identical to SEQ ID NO: 101104

SEQ ID NO: 719212 - RNA, 63 nt, hsa; identical to SEQ ID NO: 101105

SEQ ID NO: 719213 - RNA, 63 nt, hsa; identical to SEQ ID NO: 101106

SEQ ID NO: 719214 - RNA, 63 nt, hsa; identical to SEQ ID NO: 101107

SEQ ID NO: 719215 - RNA, 63 nt, hsa; identical to SEQ ID NO: 101108

SEQ ID NO: 719216 - RNA, 63 nt, hsa; identical to SEQ ID NO: 101109

SEQ ID NO: 719217 - RNA, 63 nt, hsa; identical to SEQ ID NO: 101110

SEQ ID NO: 719218 - RNA, 63 nt, hsa; identical to SEQ ID NO: 101111

SEQ ID NO: 719219 - RNA, 63 nt, hsa; identical to SEQ ID NO: 101112

SEQ ID NO: 719220 - RNA, 63 nt, hsa; identical to SEQ ID NO: 101113

SEQ ID NO: 719221 - RNA, 63 nt, hsa; identical to SEQ ID NO: 101114

SEQ ID NO: 719222 - RNA, 63 nt, hsa; identical to SEQ ID NO: 101115

SEQ ID NO: 719223 - RNA, 63 nt, hsa; identical to SEQ ID NO: 101116

SEQ ID NO: 719224 - RNA, 63 nt, hsa; identical to SEQ ID NO: 101117

SEQ ID NO: 719225 - RNA, 63 nt, hsa; identical to SEQ ID NO: 101118

SEQ ID NO: 719226 - RNA, 63 nt, hsa; identical to SEQ ID NO: 101119

SEQ ID NO: 719227 - RNA, 63 nt, hsa; identical to SEQ ID NO: 101120

SEQ ID NO: 719228 - RNA, 63 nt, hsa; identical to SEQ ID NO: 101121

SEQ ID NO: 719229 - RNA, 63 nt, hsa; identical to SEQ ID NO: 101122

SEQ ID NO: 719230 - RNA, 63 nt, hsa; identical to SEQ ID NO: 101123

SEQ ID NO: 719231 - RNA, 63 nt, hsa; identical to SEQ ID NO: 101124

SEQ ID NO: 719232 - RNA, 63 nt, hsa; identical to SEQ ID NO: 101125

SEQ ID NO: 719233 - RNA, 63 nt, hsa; identical to SEQ ID NO: 101126

SEQ ID NO: 719234 - RNA, 63 nt, hsa; identical to SEQ ID NO: 101127

SEQ ID NO: 719235 - RNA, 63 nt, hsa; identical to SEQ ID NO: 101128

SEQ ID NO: 719236 - RNA, 63 nt, hsa; identical to SEQ ID NO: 101129

SEQ ID NO: 719237 - RNA, 63 nt, hsa; identical to SEQ ID NO: 101130

SEQ ID NO: 719238 - RNA, 63 nt, hsa; identical to SEQ ID NO: 101131

SEQ ID NO: 719239 - RNA, 63 nt, hsa; identical to SEQ ID NO: 101132

SEQ ID NO: 719240 - RNA, 63 nt, hsa; identical to SEQ ID NO: 101133

SEQ ID NO: 719241 - RNA, 63 nt, hsa; identical to SEQ ID NO: 101134

SEQ ID NO: 719242 - RNA, 63 nt, hsa; identical to SEQ ID NO: 101135

SEQ ID NO: 719243 - RNA, 63 nt, hsa; identical to SEQ ID NO: 101136

SEQ ID NO: 719244 - RNA, 63 nt, hsa; identical to SEQ ID NO: 101137

SEQ ID NO: 719245 - RNA, 63 nt, hsa; identical to SEQ ID NO: 101138

SEQ ID NO: 719246 - RNA, 63 nt, hsa; identical to SEQ ID NO: 101139

SEQ ID NO: 719247 - RNA, 63 nt, hsa; identical to SEQ ID NO: 101140

SEQ ID NO: 719248 - RNA, 63 nt, hsa; identical to SEQ ID NO: 101141

SEQ ID NO: 719249 - RNA, 63 nt, hsa; identical to SEQ ID NO: 101142

SEQ ID NO: 719250 - RNA, 63 nt, hsa; identical to SEQ ID NO: 101143

SEQ ID NO: 719251 - RNA, 63 nt, hsa; identical to SEQ ID NO: 101144

SEQ ID NO: 719252 - RNA, 63 nt, hsa; identical to SEQ ID NO: 101145

SEQ ID NO: 719253 - RNA, 63 nt, hsa; identical to SEQ ID NO: 101146

SEQ ID NO: 719254 - RNA, 63 nt, hsa; identical to SEQ ID NO: 101147

SEQ ID NO: 719255 - RNA, 63 nt, hsa; identical to SEQ ID NO: 101148

SEQ ID NO: 719256 - RNA, 63 nt, hsa; identical to SEQ ID NO: 101149

SEQ ID NO: 719257 - RNA, 63 nt, hsa; identical to SEQ ID NO: 101150

SEQ ID NO: 719258 - RNA, 63 nt, hsa; identical to SEQ ID NO: 101151

SEQ ID NO: 719259 - RNA, 63 nt, hsa; identical to SEQ ID NO: 101152

SEQ ID NO: 719260 - RNA, 63 nt, hsa; identical to SEQ ID NO: 101153

SEQ ID NO: 719261 - RNA, 63 nt, hsa; identical to SEQ ID NO: 101154

SEQ ID NO: 719262 - RNA, 63 nt, hsa; identical to SEQ ID NO: 101155

SEQ ID NO: 719263 - RNA, 63 nt, hsa; identical to SEQ ID NO: 101156

SEQ ID NO: 719264 - RNA, 63 nt, hsa; identical to SEQ ID NO: 101157

SEQ ID NO: 719265 - RNA, 63 nt, hsa; identical to SEQ ID NO: 101158

SEQ ID NO: 719266 - RNA, 63 nt, hsa; identical to SEQ ID NO: 101159

SEQ ID NO: 719267 - RNA, 63 nt, hsa; identical to SEQ ID NO: 101160

SEQ ID NO: 719268 - RNA, 63 nt, hsa; identical to SEQ ID NO: 101161

SEQ ID NO: 719269 - RNA, 63 nt, hsa; identical to SEQ ID NO: 101162

SEQ ID NO: 719270 - RNA, 63 nt, hsa; identical to SEQ ID NO: 101163

SEQ ID NO: 719271 - RNA, 63 nt, hsa; identical to SEQ ID NO: 101164

SEQ ID NO: 719272 - RNA, 63 nt, hsa; identical to SEQ ID NO: 101165

SEQ ID NO: 719273 - RNA, 63 nt, hsa; identical to SEQ ID NO: 101166

SEQ ID NO: 719274 - RNA, 63 nt, hsa; identical to SEQ ID NO: 101167

SEQ ID NO: 719275 - RNA, 63 nt, hsa; identical to SEQ ID NO: 101168

SEQ ID NO: 719276 - RNA, 63 nt, hsa; identical to SEQ ID NO: 101169
